United States Patent 7,341,835 (METHODS OF ANALYSIS OF ALTERNATIVE SPLICING IN MOUSE) - sequence listing, part 23

SEQ ID NO: 877897 - DNA, 25 bp, Mus musculus
agtcacaattgatccagaaaataat

SEQ ID NO: 877898 - DNA, 25 bp, Mus musculus
agtcacaattgatcgagaaaataat

SEQ ID NO: 877899 - DNA, 25 bp, Mus musculus
agtcacagtacaagaggcttgccaa

SEQ ID NO: 877900 - DNA, 25 bp, Mus musculus
agtcacagtacatgaggcttgccaa

SEQ ID NO: 877901 - DNA, 25 bp, Mus musculus
agtcacatccatcgaaagaaaggag

SEQ ID NO: 877902 - DNA, 25 bp, Mus musculus
agtcacatccatcgtcctattaaac

SEQ ID NO: 877903 - DNA, 25 bp, Mus musculus
agtcacatccatggaaagaaaggag

SEQ ID NO: 877904 - DNA, 25 bp, Mus musculus
agtcacatccatggtcctattaaac

SEQ ID NO: 877905 - DNA, 25 bp, Mus musculus
agtcaccagagacgacatgtccagc

SEQ ID NO: 877906 - DNA, 25 bp, Mus musculus
agtcaccagagaggacatgtccagc

SEQ ID NO: 877907 - DNA, 25 bp, Mus musculus
agtcacccaacatgctaatcacata

SEQ ID NO: 877908 - DNA, 25 bp, Mus musculus
agtcacccaagatgctaatcacata

SEQ ID NO: 877909 - DNA, 25 bp, Mus musculus
agtcacccagagaatacctcatgat

SEQ ID NO: 877910 - DNA, 25 bp, Mus musculus
agtcacccagcggaccttggagatc

SEQ ID NO: 877911 - DNA, 25 bp, Mus musculus
agtcacccaggggaccttggagatc

SEQ ID NO: 877912 - DNA, 25 bp, Mus musculus
agtcacccagtgaatacctcatgat

SEQ ID NO: 877913 - DNA, 25 bp, Mus musculus
agtcacctctctctggtagcagcct

SEQ ID NO: 877914 - DNA, 25 bp, Mus musculus
agtcacctctgtctggtagcagcct

SEQ ID NO: 877915 - DNA, 25 bp, Mus musculus
agtcacctgtagaatggtgccctcg

SEQ ID NO: 877916 - DNA, 25 bp, Mus musculus
agtcacctgtagtatggtgccctcg

SEQ ID NO: 877917 - DNA, 25 bp, Mus musculus
agtcacggagaactgctggagtggc

SEQ ID NO: 877918 - DNA, 25 bp, Mus musculus
agtcacggagaagtgctggagtggc

SEQ ID NO: 877919 - DNA, 25 bp, Mus musculus
agtcacggagctctgcacagaagag

SEQ ID NO: 877920 - DNA, 25 bp, Mus musculus
agtcacggagctgtgcacagaagag

SEQ ID NO: 877921 - DNA, 25 bp, Mus musculus
agtcactaccagctgcagacccacc

SEQ ID NO: 877922 - DNA, 25 bp, Mus musculus
agtcactaccaggtgcagacccacc

SEQ ID NO: 877923 - DNA, 25 bp, Mus musculus
agtcactcagctagtacccgcagag

SEQ ID NO: 877924 - DNA, 25 bp, Mus musculus
agtcactcagctgttagcattgccc

SEQ ID NO: 877925 - DNA, 25 bp, Mus musculus
agtcactcaggtagtacccgcagag

SEQ ID NO: 877926 - DNA, 25 bp, Mus musculus
agtcactcaggtgttagcattgccc

SEQ ID NO: 877927 - DNA, 25 bp, Mus musculus
agtcactgacatctcgcccgtgggc

SEQ ID NO: 877928 - DNA, 25 bp, Mus musculus
agtcactgacatctggcccgtgggc

SEQ ID NO: 877929 - DNA, 25 bp, Mus musculus
agtcactgactttgagcacaggatc

SEQ ID NO: 877930 - DNA, 25 bp, Mus musculus
agtcactgactttgtgcacaggatc

SEQ ID NO: 877931 - DNA, 25 bp, Mus musculus
agtcactgatcgatgagctaatgga

SEQ ID NO: 877932 - DNA, 25 bp, Mus musculus
agtcactgatcgttgagctaatgga

SEQ ID NO: 877933 - DNA, 25 bp, Mus musculus
agtcactgctagctatggcactgca

SEQ ID NO: 877934 - DNA, 25 bp, Mus musculus
agtcactgctaggtatggcactgca

SEQ ID NO: 877935 - DNA, 25 bp, Mus musculus
agtcactttcctaaccgcacagacc

SEQ ID NO: 877936 - DNA, 25 bp, Mus musculus
agtcactttcctaccagcaatgcca

SEQ ID NO: 877937 - DNA, 25 bp, Mus musculus
agtcactttccttaccgcacagacc

SEQ ID NO: 877938 - DNA, 25 bp, Mus musculus
agtcactttccttccagcaatgcca

SEQ ID NO: 877939 - DNA, 25 bp, Mus musculus
agtcagaactgagacgttatgggcc

SEQ ID NO: 877940 - DNA, 25 bp, Mus musculus
agtcagaactgagaggttatgggcc

SEQ ID NO: 877941 - DNA, 25 bp, Mus musculus
agtcagaagtcttcgctataaagtc

SEQ ID NO: 877942 - DNA, 25 bp, Mus musculus
agtcagaagtgttcgctataaagtc

SEQ ID NO: 877943 - DNA, 25 bp, Mus musculus
agtcagagagctcgcagtggttctg

SEQ ID NO: 877944 - DNA, 25 bp, Mus musculus
agtcagagaggtcgcagtggttctg

SEQ ID NO: 877945 - DNA, 25 bp, Mus musculus
agtcagagatcacccaagctgtctg

SEQ ID NO: 877946 - DNA, 25 bp, Mus musculus
agtcagagatcacgaagccaagctg

SEQ ID NO: 877947 - DNA, 25 bp, Mus musculus
agtcagagatcagccaagctgtctg

SEQ ID NO: 877948 - DNA, 25 bp, Mus musculus
agtcagagatcaggaagccaagctg

SEQ ID NO: 877949 - DNA, 25 bp, Mus musculus
agtcagatactgatgatgctggagg

SEQ ID NO: 877950 - DNA, 25 bp, Mus musculus
agtcagatactgttgatgctggagg

SEQ ID NO: 877951 - DNA, 25 bp, Mus musculus
agtcagatggaatccagcaagctaa

SEQ ID NO: 877952 - DNA, 25 bp, Mus musculus
agtcagatggtatccagcaagctaa

SEQ ID NO: 877953 - DNA, 25 bp, Mus musculus
agtcagcaaaagcaggaacacctct

SEQ ID NO: 877954 - DNA, 25 bp, Mus musculus
agtcagcaaaaggaggaacacctct

SEQ ID NO: 877955 - DNA, 25 bp, Mus musculus
agtcagcacgcccacttatggatgc

SEQ ID NO: 877956 - DNA, 25 bp, Mus musculus
agtcagcacgcccagttatggatgc

SEQ ID NO: 877957 - DNA, 25 bp, Mus musculus
agtcagcactgtccctgccagggcc

SEQ ID NO: 877958 - DNA, 25 bp, Mus musculus
agtcagcactgtgcctgccagggcc

SEQ ID NO: 877959 - DNA, 25 bp, Mus musculus
agtcagcatgctaataaccactttt

SEQ ID NO: 877960 - DNA, 25 bp, Mus musculus
agtcagcatgcttataaccactttt

SEQ ID NO: 877961 - DNA, 25 bp, Mus musculus
agtcagccagcattgaggatatgag

SEQ ID NO: 877962 - DNA, 25 bp, Mus musculus
agtcagccaggattgaggatatgag

SEQ ID NO: 877963 - DNA, 25 bp, Mus musculus
agtcagccagtgcctgcagaccctg

SEQ ID NO: 877964 - DNA, 25 bp, Mus musculus
agtcagccagtggctgcagaccctg

SEQ ID NO: 877965 - DNA, 25 bp, Mus musculus
agtcaggatgctgaagcgcagctgc

SEQ ID NO: 877966 - DNA, 25 bp, Mus musculus
agtcaggatggtgaagcgcagctgc

SEQ ID NO: 877967 - DNA, 25 bp, Mus musculus
agtcaggatttggactctgtctcca

SEQ ID NO: 877968 - DNA, 25 bp, Mus musculus
agtcaggatttggagtctgtctcca

SEQ ID NO: 877969 - DNA, 25 bp, Mus musculus
agtcaggctcacactctgctcctgg

SEQ ID NO: 877970 - DNA, 25 bp, Mus musculus
agtcaggctcactctctgctcctgg

SEQ ID NO: 877971 - DNA, 25 bp, Mus musculus
agtcagtaagctgtggtgtacctgc

SEQ ID NO: 877972 - DNA, 25 bp, Mus musculus
agtcagtaaggtgtggtgtacctgc

SEQ ID NO: 877973 - DNA, 25 bp, Mus musculus
agtcagtacctacatcgacagctga

SEQ ID NO: 877974 - DNA, 25 bp, Mus musculus
agtcagtacctaccgtgctgtgcgg

SEQ ID NO: 877975 - DNA, 25 bp, Mus musculus
agtcagtacctagatcgacagctga

SEQ ID NO: 877976 - DNA, 25 bp, Mus musculus
agtcagtacctagcgtgctgtgcgg

SEQ ID NO: 877977 - DNA, 25 bp, Mus musculus
agtcagtttgtacatgtttgcatag

SEQ ID NO: 877978 - DNA, 25 bp, Mus musculus
agtcagtttgtagatgtttgcatag

SEQ ID NO: 877979 - DNA, 25 bp, Mus musculus
agtcatacagaccagacaagacatg

SEQ ID NO: 877980 - DNA, 25 bp, Mus musculus
agtcatacaggacatcgatgtgtac

SEQ ID NO: 877981 - DNA, 25 bp, Mus musculus
agtcatacaggagatcgatgtgtac

SEQ ID NO: 877982 - DNA, 25 bp, Mus musculus
agtcatacagtccagacaagacatg

SEQ ID NO: 877983 - DNA, 25 bp, Mus musculus
agtcatcaagaccaccaattcagtg

SEQ ID NO: 877984 - DNA, 25 bp, Mus musculus
agtcatcaagaccagcaattcagtg

SEQ ID NO: 877985 - DNA, 25 bp, Mus musculus
agtcatcagaagagtacaactggac

SEQ ID NO: 877986 - DNA, 25 bp, Mus musculus
agtcatcagaagtgtacaactggac

SEQ ID NO: 877987 - DNA, 25 bp, Mus musculus
agtcatctctgaaacttctcctgtc

SEQ ID NO: 877988 - DNA, 25 bp, Mus musculus
agtcatctctgaaagttctcctgtc

SEQ ID NO: 877989 - DNA, 25 bp, Mus musculus
agtcatcttgactcgaagtgaagct

SEQ ID NO: 877990 - DNA, 25 bp, Mus musculus
agtcatcttgtctcgaagtgaagct

SEQ ID NO: 877991 - DNA, 25 bp, Mus musculus
agtcatgaagccctgctctggaaag

SEQ ID NO: 877992 - DNA, 25 bp, Mus musculus
agtcatgaaggcctgctctggaaag

SEQ ID NO: 877993 - DNA, 25 bp, Mus musculus
agtcatgacaagacaccctgttgaa

SEQ ID NO: 877994 - DNA, 25 bp, Mus musculus
agtcatgacaagtcaccctgttgaa

SEQ ID NO: 877995 - DNA, 25 bp, Mus musculus
agtcatgcagctcaagaattttgga

SEQ ID NO: 877996 - DNA, 25 bp, Mus musculus
agtcatgcaggtcaagaattttgga

SEQ ID NO: 877997 - DNA, 25 bp, Mus musculus
agtcatgtacctccaccacgtcggg

SEQ ID NO: 877998 - DNA, 25 bp, Mus musculus
agtcatgtacctgcaccacgtcggg

SEQ ID NO: 877999 - DNA, 25 bp, Mus musculus
agtcattcagatctttaaagaagtc

SEQ ID NO: 878000 - DNA, 25 bp, Mus musculus
agtcattcagatgtttaaagaagtc

SEQ ID NO: 878001 - DNA, 25 bp, Mus musculus
agtcattcagctgacaagtgacggt

SEQ ID NO: 878002 - DNA, 25 bp, Mus musculus
agtcattcaggtgacaagtgacggt

SEQ ID NO: 878003 - DNA, 25 bp, Mus musculus
agtcattccgatcgaatacctccat

SEQ ID NO: 878004 - DNA, 25 bp, Mus musculus
agtcattccgatggaatacctccat

SEQ ID NO: 878005 - DNA, 25 bp, Mus musculus
agtcattggcagctgtaagtgcaac

SEQ ID NO: 878006 - DNA, 25 bp, Mus musculus
agtcattggcaggtgtaagtgcaac

SEQ ID NO: 878007 - DNA, 25 bp, Mus musculus
agtcattgtgtgaacttgtataaaa

SEQ ID NO: 878008 - DNA, 25 bp, Mus musculus
agtcattgtgtgtacttgtataaaa

SEQ ID NO: 878009 - DNA, 25 bp, Mus musculus
agtcattttcatcatcacaaaattt

SEQ ID NO: 878010 - DNA, 25 bp, Mus musculus
agtcattttcatgatcacaaaattt

SEQ ID NO: 878011 - DNA, 25 bp, Mus musculus
agtcattttgtgcaccttacctgtg

SEQ ID NO: 878012 - DNA, 25 bp, Mus musculus
agtcattttgtgcacgatctgctga

SEQ ID NO: 878013 - DNA, 25 bp, Mus musculus
agtcattttgtgcagcttacctgtg

SEQ ID NO: 878014 - DNA, 25 bp, Mus musculus
agtcattttgtgcaggatctgctga

SEQ ID NO: 878015 - DNA, 25 bp, Mus musculus
agtccaacagagaatgaagcactct

SEQ ID NO: 878016 - DNA, 25 bp, Mus musculus
agtccaacagctcagccaacaagtg

SEQ ID NO: 878017 - DNA, 25 bp, Mus musculus
agtccaacaggtcagccaacaagtg

SEQ ID NO: 878018 - DNA, 25 bp, Mus musculus
agtccaacagtgaatgaagcactct

SEQ ID NO: 878019 - DNA, 25 bp, Mus musculus
agtccaagcacgccgcagcagcctg

SEQ ID NO: 878020 - DNA, 25 bp, Mus musculus
agtccaagcacgcggacagcttcgt

SEQ ID NO: 878021 - DNA, 25 bp, Mus musculus
agtccaagcacggcgcagcagcctg

SEQ ID NO: 878022 - DNA, 25 bp, Mus musculus
agtccaagcacggggacagcttcgt

SEQ ID NO: 878023 - DNA, 25 bp, Mus musculus
agtccacaacagcaaacacactggg

SEQ ID NO: 878024 - DNA, 25 bp, Mus musculus
agtccacaacaggaaacacactggg

SEQ ID NO: 878025 - DNA, 25 bp, Mus musculus
agtccacaccggcacaaccatcatg

SEQ ID NO: 878026 - DNA, 25 bp, Mus musculus
agtccacaccgggacaaccatcatg

SEQ ID NO: 878027 - DNA, 25 bp, Mus musculus
agtccacagccaagggattctgctt

SEQ ID NO: 878028 - DNA, 25 bp, Mus musculus
agtccacagccatgggattctgctt

SEQ ID NO: 878029 - DNA, 25 bp, Mus musculus
agtccactgcatagaacagcgtctg

SEQ ID NO: 878030 - DNA, 25 bp, Mus musculus
agtccactgcattgaacagcgtctg

SEQ ID NO: 878031 - DNA, 25 bp, Mus musculus
agtccagacaccatcccagcccact

SEQ ID NO: 878032 - DNA, 25 bp, Mus musculus
agtccagacaccatgccagcccact

SEQ ID NO: 878033 - DNA, 25 bp, Mus musculus
agtccagagcaacgttgctcttctg

SEQ ID NO: 878034 - DNA, 25 bp, Mus musculus
agtccagagcaaggttgctcttctg

SEQ ID NO: 878035 - DNA, 25 bp, Mus musculus
agtccagagcacccagctgctgaat

SEQ ID NO: 878036 - DNA, 25 bp, Mus musculus
agtccagagcaccctgctgctgaat

SEQ ID NO: 878037 - DNA, 25 bp, Mus musculus
agtccaggtgatttggttcatcttg

SEQ ID NO: 878038 - DNA, 25 bp, Mus musculus
agtccaggtgcagctgctggaccct

SEQ ID NO: 878039 - DNA, 25 bp, Mus musculus
agtccaggtggagctgctggaccct

SEQ ID NO: 878040 - DNA, 25 bp, Mus musculus
agtccaggtgttttggttcatcttg

SEQ ID NO: 878041 - DNA, 25 bp, Mus musculus
agtccagttgcgttgccatctattg

SEQ ID NO: 878042 - DNA, 25 bp, Mus musculus
agtccagttgggttgccatctattg

SEQ ID NO: 878043 - DNA, 25 bp, Mus musculus
agtccatcagcagtttggaacaaga

SEQ ID NO: 878044 - DNA, 25 bp, Mus musculus
agtccatcaggagtttggaacaaga

SEQ ID NO: 878045 - DNA, 25 bp, Mus musculus
agtccatccaggcctgtaaacttgc

SEQ ID NO: 878046 - DNA, 25 bp, Mus musculus
agtccatccagggctgtaaacttgc

SEQ ID NO: 878047 - DNA, 25 bp, Mus musculus
agtccatggagacattgatcctgtt

SEQ ID NO: 878048 - DNA, 25 bp, Mus musculus
agtccatggagagattgatcctgtt

SEQ ID NO: 878049 - DNA, 25 bp, Mus musculus
agtccatttagcatcgctgttggaa

SEQ ID NO: 878050 - DNA, 25 bp, Mus musculus
agtccatttagcatggctgttggaa

SEQ ID NO: 878051 - DNA, 25 bp, Mus musculus
agtcccaactcccacggatcgttgc

SEQ ID NO: 878052 - DNA, 25 bp, Mus musculus
agtcccaactcccagggatcgttgc

SEQ ID NO: 878053 - DNA, 25 bp, Mus musculus
agtcccagcgtcgtcattagcgatg

SEQ ID NO: 878054 - DNA, 25 bp, Mus musculus
agtcccagcgtcgtgattagcgatg

SEQ ID NO: 878055 - DNA, 25 bp, Mus musculus
agtcccagctgacactggctggtgg

SEQ ID NO: 878056 - DNA, 25 bp, Mus musculus
agtcccagctgagactggctggtgg

SEQ ID NO: 878057 - DNA, 25 bp, Mus musculus
agtcccaggacaaaaacctcagcga

SEQ ID NO: 878058 - DNA, 25 bp, Mus musculus
agtcccaggacataaacctcagcga

SEQ ID NO: 878059 - DNA, 25 bp, Mus musculus
agtccccatgagtgacgctggagag

SEQ ID NO: 878060 - DNA, 25 bp, Mus musculus
agtccccatgtgtgacgctggagag

SEQ ID NO: 878061 - DNA, 25 bp, Mus musculus
agtcccccagacatatcccaggttc

SEQ ID NO: 878062 - DNA, 25 bp, Mus musculus
agtcccccagtcatatcccaggttc

SEQ ID NO: 878063 - DNA, 25 bp, Mus musculus
agtccccgctgctccttggccccat

SEQ ID NO: 878064 - DNA, 25 bp, Mus musculus
agtccccgctgctcgttggccccat

SEQ ID NO: 878065 - DNA, 25 bp, Mus musculus
agtccccggagccacagctcccaga

SEQ ID NO: 878066 - DNA, 25 bp, Mus musculus
agtccccggagccagagctcccaga

SEQ ID NO: 878067 - DNA, 25 bp, Mus musculus
agtcccgaagcggacagcttcgtgg

SEQ ID NO: 878068 - DNA, 25 bp, Mus musculus
agtcccgaaggggacagcttcgtgg

SEQ ID NO: 878069 - DNA, 25 bp, Mus musculus
agtcccgaggatgagccccacatgg

SEQ ID NO: 878070 - DNA, 25 bp, Mus musculus
agtcccgaggccaaccgcgtagcca

SEQ ID NO: 878071 - DNA, 25 bp, Mus musculus
agtcccgaggccgacggattatgtg

SEQ ID NO: 878072 - DNA, 25 bp, Mus musculus
agtcccgaggccgagggattatgtg

SEQ ID NO: 878073 - DNA, 25 bp, Mus musculus
agtcccgagggcaaccgcgtagcca

SEQ ID NO: 878074 - DNA, 25 bp, Mus musculus
agtcccgaggttgagccccacatgg

SEQ ID NO: 878075 - DNA, 25 bp, Mus musculus
agtcccgatgaacaactaagtggaa

SEQ ID NO: 878076 - DNA, 25 bp, Mus musculus
agtcccgatgaacaatggataacga

SEQ ID NO: 878077 - DNA, 25 bp, Mus musculus
agtcccgatgaagaactaagtggaa

SEQ ID NO: 878078 - DNA, 25 bp, Mus musculus
agtcccgatgaagaatggataacga

SEQ ID NO: 878079 - DNA, 25 bp, Mus musculus
agtcccgcagcctttggaaggatgt

SEQ ID NO: 878080 - DNA, 25 bp, Mus musculus
agtcccgcaggctttggaaggatgt

SEQ ID NO: 878081 - DNA, 25 bp, Mus musculus
agtccctcacacacctgcacgttct

SEQ ID NO: 878082 - DNA, 25 bp, Mus musculus
agtccctcacactcctgcacgttct

SEQ ID NO: 878083 - DNA, 25 bp, Mus musculus
agtccctggaaaagctacttcattc

SEQ ID NO: 878084 - DNA, 25 bp, Mus musculus
agtccctggataagctacttcattc

SEQ ID NO: 878085 - DNA, 25 bp, Mus musculus
agtccctggtcagtcggagctcaac

SEQ ID NO: 878086 - DNA, 25 bp, Mus musculus
agtccctggtcagtgggagctcaac

SEQ ID NO: 878087 - DNA, 25 bp, Mus musculus
agtccctgtctcagcgtgaaacgca

SEQ ID NO: 878088 - DNA, 25 bp, Mus musculus
agtccctgtctcagggtgaaacgca

SEQ ID NO: 878089 - DNA, 25 bp, Mus musculus
agtccctttctgatcctctgtcaga

SEQ ID NO: 878090 - DNA, 25 bp, Mus musculus
agtccctttctgatgctctgtcaga

SEQ ID NO: 878091 - DNA, 25 bp, Mus musculus
agtccgcaccgccaaggagatcata

SEQ ID NO: 878092 - DNA, 25 bp, Mus musculus
agtccgcaccgccatggagatcata

SEQ ID NO: 878093 - DNA, 25 bp, Mus musculus
agtccgcccttgtgcgtagctccta

SEQ ID NO: 878094 - DNA, 25 bp, Mus musculus
agtccgcccttgtgggtagctccta

SEQ ID NO: 878095 - DNA, 25 bp, Mus musculus
agtccggctaggcttgttcctgctt

SEQ ID NO: 878096 - DNA, 25 bp, Mus musculus
agtccggctagggttgttcctgctt

SEQ ID NO: 878097 - DNA, 25 bp, Mus musculus
agtccgtgagctcttcatgtctgaa

SEQ ID NO: 878098 - DNA, 25 bp, Mus musculus
agtccgtgaggtcttcatgtctgaa

SEQ ID NO: 878099 - DNA, 25 bp, Mus musculus
agtccgtgatcacaattgcatttgt

SEQ ID NO: 878100 - DNA, 25 bp, Mus musculus
agtccgtgatcacttccgtatctac

SEQ ID NO: 878101 - DNA, 25 bp, Mus musculus
agtccgtgatcagaattgcatttgt

SEQ ID NO: 878102 - DNA, 25 bp, Mus musculus
agtccgtgatcagttccgtatctac

SEQ ID NO: 878103 - DNA, 25 bp, Mus musculus
agtccgtgttaacattttggccaca

SEQ ID NO: 878104 - DNA, 25 bp, Mus musculus
agtccgtgttaagattttggccaca

SEQ ID NO: 878105 - DNA, 25 bp, Mus musculus
agtcctacaccacggactttgactg

SEQ ID NO: 878106 - DNA, 25 bp, Mus musculus
agtcctacaccagggactttgactg

SEQ ID NO: 878107 - DNA, 25 bp, Mus musculus
agtcctcatcggactgtttaagact

SEQ ID NO: 878108 - DNA, 25 bp, Mus musculus
agtcctcatcggtctgtttaagact

SEQ ID NO: 878109 - DNA, 25 bp, Mus musculus
agtcctccccagaaatagatgaaga

SEQ ID NO: 878110 - DNA, 25 bp, Mus musculus
agtcctccccagtaatagatgaaga

SEQ ID NO: 878111 - DNA, 25 bp, Mus musculus
agtcctcgagacttcacccgaatgc

SEQ ID NO: 878112 - DNA, 25 bp, Mus musculus
agtcctcgagtcttcacccgaatgc

SEQ ID NO: 878113 - DNA, 25 bp, Mus musculus
agtcctctcgcactaatagtagacg

SEQ ID NO: 878114 - DNA, 25 bp, Mus musculus
agtcctctcgcagtaatagtagacg

SEQ ID NO: 878115 - DNA, 25 bp, Mus musculus
agtcctgaagacaacagacatcaat

SEQ ID NO: 878116 - DNA, 25 bp, Mus musculus
agtcctgaagtcaacagacatcaat

SEQ ID NO: 878117 - DNA, 25 bp, Mus musculus
agtcctgcccagcatggcagtacct

SEQ ID NO: 878118 - DNA, 25 bp, Mus musculus
agtcctgcccagctcaatggtggct

SEQ ID NO: 878119 - DNA, 25 bp, Mus musculus
agtcctgcccaggatggcagtacct

SEQ ID NO: 878120 - DNA, 25 bp, Mus musculus
agtcctgcccaggtcaatggtggct

SEQ ID NO: 878121 - DNA, 25 bp, Mus musculus
agtcctgcgagataagtttggggag

SEQ ID NO: 878122 - DNA, 25 bp, Mus musculus
agtcctgcgagatatgtttggggag

SEQ ID NO: 878123 - DNA, 25 bp, Mus musculus
agtcctgctcgacgctatgaactct

SEQ ID NO: 878124 - DNA, 25 bp, Mus musculus
agtcctgctcgaggctatgaactct

SEQ ID NO: 878125 - DNA, 25 bp, Mus musculus
agtcctggcaagatttgcctcctgg

SEQ ID NO: 878126 - DNA, 25 bp, Mus musculus
agtcctggcaagttttgcctcctgg

SEQ ID NO: 878127 - DNA, 25 bp, Mus musculus
agtcctggcacacagaacctgtgct

SEQ ID NO: 878128 - DNA, 25 bp, Mus musculus
agtcctggcacacgtacaaagtgaa

SEQ ID NO: 878129 - DNA, 25 bp, Mus musculus
agtcctggcacagagaacctgtgct

SEQ ID NO: 878130 - DNA, 25 bp, Mus musculus
agtcctggcacaggtacaaagtgaa

SEQ ID NO: 878131 - DNA, 25 bp, Mus musculus
agtcctgggaaacgtgtggtatctc

SEQ ID NO: 878132 - DNA, 25 bp, Mus musculus
agtcctgggaaaggtgtggtatctc

SEQ ID NO: 878133 - DNA, 25 bp, Mus musculus
agtcctggtgtgcccgggtcaccag

SEQ ID NO: 878134 - DNA, 25 bp, Mus musculus
agtcctggtgtgccggggtcaccag

SEQ ID NO: 878135 - DNA, 25 bp, Mus musculus
agtcctgttcagcaccatcagcacc

SEQ ID NO: 878136 - DNA, 25 bp, Mus musculus
agtcctgttcaggaccatcagcacc

SEQ ID NO: 878137 - DNA, 25 bp, Mus musculus
agtccttaagctgcagacccacctg

SEQ ID NO: 878138 - DNA, 25 bp, Mus musculus
agtccttaaggtgcagacccacctg

SEQ ID NO: 878139 - DNA, 25 bp, Mus musculus
agtccttatgacacgtccccatctg

SEQ ID NO: 878140 - DNA, 25 bp, Mus musculus
agtccttatggactctctgacacag

SEQ ID NO: 878141 - DNA, 25 bp, Mus musculus
agtccttatggagtctctgacacag

SEQ ID NO: 878142 - DNA, 25 bp, Mus musculus
agtccttatgtcacgtccccatctg

SEQ ID NO: 878143 - DNA, 25 bp, Mus musculus
agtccttgcatacactaatgtgcaa

SEQ ID NO: 878144 - DNA, 25 bp, Mus musculus
agtccttgcatacagtaatgtgcaa

SEQ ID NO: 878145 - DNA, 25 bp, Mus musculus
agtcctttcactcttttgatggatt

SEQ ID NO: 878146 - DNA, 25 bp, Mus musculus
agtcctttcagtcttttgatggatt

SEQ ID NO: 878147 - DNA, 25 bp, Mus musculus
agtcgaaagacgcagacatcgactc

SEQ ID NO: 878148 - DNA, 25 bp, Mus musculus
agtcgaaagaggcagacatcgactc

SEQ ID NO: 878149 - DNA, 25 bp, Mus musculus
agtcgaggaacccgtcaagacttgg

SEQ ID NO: 878150 - DNA, 25 bp, Mus musculus
agtcgaggaagccgtcaagacttgg

SEQ ID NO: 878151 - DNA, 25 bp, Mus musculus
agtcgcaacgaccacgtggtcacgg

SEQ ID NO: 878152 - DNA, 25 bp, Mus musculus
agtcgcaacgaccaggtggtcacgg

SEQ ID NO: 878153 - DNA, 25 bp, Mus musculus
agtcgcattgcttctattgtggggg

SEQ ID NO: 878154 - DNA, 25 bp, Mus musculus
agtcgcattggttctattgtggggg

SEQ ID NO: 878155 - DNA, 25 bp, Mus musculus
agtcgccatgacaccccaggatgag

SEQ ID NO: 878156 - DNA, 25 bp, Mus musculus
agtcgccatgcctacaacacagcag

SEQ ID NO: 878157 - DNA, 25 bp, Mus musculus
agtcgccatggctacaacacagcag

SEQ ID NO: 878158 - DNA, 25 bp, Mus musculus
agtcgccatgtcaccccaggatgag

SEQ ID NO: 878159 - DNA, 25 bp, Mus musculus
agtcgcccacagaccattggggctg

SEQ ID NO: 878160 - DNA, 25 bp, Mus musculus
agtcgcccacagacgattggggctg

SEQ ID NO: 878161 - DNA, 25 bp, Mus musculus
agtcgccgacaggacctacgagagg

SEQ ID NO: 878162 - DNA, 25 bp, Mus musculus
agtcgccgacaggacgcgacccagt

SEQ ID NO: 878163 - DNA, 25 bp, Mus musculus
agtcgccgacaggagctacgagagg

SEQ ID NO: 878164 - DNA, 25 bp, Mus musculus
agtcgccgacaggaggcgacccagt

SEQ ID NO: 878165 - DNA, 25 bp, Mus musculus
agtcgcgcagcacgatggctgacct

SEQ ID NO: 878166 - DNA, 25 bp, Mus musculus
agtcgcgcagcaggatggctgacct

SEQ ID NO: 878167 - DNA, 25 bp, Mus musculus
agtcgctcctatcgcatgtgggcac

SEQ ID NO: 878168 - DNA, 25 bp, Mus musculus
agtcgctcctatggcatgtgggcac

SEQ ID NO: 878169 - DNA, 25 bp, Mus musculus
agtcgctgccagcggggcaacaatg

SEQ ID NO: 878170 - DNA, 25 bp, Mus musculus
agtcgctgccaggggggcaacaatg

SEQ ID NO: 878171 - DNA, 25 bp, Mus musculus
agtcggacagaggcttccgccacaa

SEQ ID NO: 878172 - DNA, 25 bp, Mus musculus
agtcggacagccttccgccacaact

SEQ ID NO: 878173 - DNA, 25 bp, Mus musculus
agtcggacaggcttccgccacaact

SEQ ID NO: 878174 - DNA, 25 bp, Mus musculus
agtcggacagtggcttccgccacaa

SEQ ID NO: 878175 - DNA, 25 bp, Mus musculus
agtcggcacaatcacagccttggct

SEQ ID NO: 878176 - DNA, 25 bp, Mus musculus
agtcggcacaatcagagccttggct

SEQ ID NO: 878177 - DNA, 25 bp, Mus musculus
agtcggcctcaaccccctgaagaat

SEQ ID NO: 878178 - DNA, 25 bp, Mus musculus
agtcggcctcaagcccctgaagaat

SEQ ID NO: 878179 - DNA, 25 bp, Mus musculus
agtcggcctgcacgcctgtcgaggg

SEQ ID NO: 878180 - DNA, 25 bp, Mus musculus
agtcggcctgcacgtgcggacctat

SEQ ID NO: 878181 - DNA, 25 bp, Mus musculus
agtcggcctgcactttcaggcctgt

SEQ ID NO: 878182 - DNA, 25 bp, Mus musculus
agtcggcctgcaggcctgtcgaggg

SEQ ID NO: 878183 - DNA, 25 bp, Mus musculus
agtcggcctgcaggtgcggacctat

SEQ ID NO: 878184 - DNA, 25 bp, Mus musculus
agtcggcctgcagtttcaggcctgt

SEQ ID NO: 878185 - DNA, 25 bp, Mus musculus
agtcggcggggacacatctcaagac

SEQ ID NO: 878186 - DNA, 25 bp, Mus musculus
agtcggcggggacagatctcaagac

SEQ ID NO: 878187 - DNA, 25 bp, Mus musculus
agtcggctgacattaacagcagcaa

SEQ ID NO: 878188 - DNA, 25 bp, Mus musculus
agtcggctgagattaacagcagcaa

SEQ ID NO: 878189 - DNA, 25 bp, Mus musculus
agtcggtttatcatcacaccaagct

SEQ ID NO: 878190 - DNA, 25 bp, Mus musculus
agtcggtttatcatgacaccaagct

SEQ ID NO: 878191 - DNA, 25 bp, Mus musculus
agtcgtctgttaagagaccaatgtc

SEQ ID NO: 878192 - DNA, 25 bp, Mus musculus
agtcgtctgttatgagaccaatgtc

SEQ ID NO: 878193 - DNA, 25 bp, Mus musculus
agtcgttctgaccacagccaaaaga

SEQ ID NO: 878194 - DNA, 25 bp, Mus musculus
agtcgttctgaccagagccaaaaga

SEQ ID NO: 878195 - DNA, 25 bp, Mus musculus
agtctaaagaaacataagatcagca

SEQ ID NO: 878196 - DNA, 25 bp, Mus musculus
agtctaaagaaacatcagcatccgg

SEQ ID NO: 878197 - DNA, 25 bp, Mus musculus
agtctaaagaaagataagatcagca

SEQ ID NO: 878198 - DNA, 25 bp, Mus musculus
agtctaaagaaagatcagcatccgg

SEQ ID NO: 878199 - DNA, 25 bp, Mus musculus
agtctaacctcactgtcactgcaaa

SEQ ID NO: 878200 - DNA, 25 bp, Mus musculus
agtctaacctcagtgtcactgcaaa

SEQ ID NO: 878201 - DNA, 25 bp, Mus musculus
agtctacaaaagctcttcagagaag

SEQ ID NO: 878202 - DNA, 25 bp, Mus musculus
agtctacaaaagctgaagtatttga

SEQ ID NO: 878203 - DNA, 25 bp, Mus musculus
agtctacaaaaggtcttcagagaag

SEQ ID NO: 878204 - DNA, 25 bp, Mus musculus
agtctacaaaaggtgaagtatttga

SEQ ID NO: 878205 - DNA, 25 bp, Mus musculus
agtctaccgaagcacagttttgccg

SEQ ID NO: 878206 - DNA, 25 bp, Mus musculus
agtctaccgaagcagagttttgccg

SEQ ID NO: 878207 - DNA, 25 bp, Mus musculus
agtctacctgcaccatcgaatcctg

SEQ ID NO: 878208 - DNA, 25 bp, Mus musculus
agtctacctgcacgagaccccatgt

SEQ ID NO: 878209 - DNA, 25 bp, Mus musculus
agtctacctgcagcatcgaatcctg

SEQ ID NO: 878210 - DNA, 25 bp, Mus musculus
agtctacctgcaggagaccccatgt

SEQ ID NO: 878211 - DNA, 25 bp, Mus musculus
agtctagaaaacataggagacagct

SEQ ID NO: 878212 - DNA, 25 bp, Mus musculus
agtctagaaaaccctaatctttctg

SEQ ID NO: 878213 - DNA, 25 bp, Mus musculus
agtctagaaaacgctaatctttctg

SEQ ID NO: 878214 - DNA, 25 bp, Mus musculus
agtctagaaaacttaggagacagct

SEQ ID NO: 878215 - DNA, 25 bp, Mus musculus
agtctagaggagctcagttactact

SEQ ID NO: 878216 - DNA, 25 bp, Mus musculus
agtctagaggaggtcagttactact

SEQ ID NO: 878217 - DNA, 25 bp, Mus musculus
agtctagtggcagccggccacgact

SEQ ID NO: 878218 - DNA, 25 bp, Mus musculus
agtctagtggcagcgggccacgact

SEQ ID NO: 878219 - DNA, 25 bp, Mus musculus
agtctataagcgtcgacatgttaaa

SEQ ID NO: 878220 - DNA, 25 bp, Mus musculus
agtctataagggtcgacatgttaaa

SEQ ID NO: 878221 - DNA, 25 bp, Mus musculus
agtctatctatgaacagagaaaacg

SEQ ID NO: 878222 - DNA, 25 bp, Mus musculus
agtctatctatgtacagagaaaacg

SEQ ID NO: 878223 - DNA, 25 bp, Mus musculus
agtctatgtcagacagggaacaaca

SEQ ID NO: 878224 - DNA, 25 bp, Mus musculus
agtctatgtcagtcagggaacaaca

SEQ ID NO: 878225 - DNA, 25 bp, Mus musculus
agtctattataaactgatttcatca

SEQ ID NO: 878226 - DNA, 25 bp, Mus musculus
agtctattataatctgatttcatca

SEQ ID NO: 878227 - DNA, 25 bp, Mus musculus
agtctcaaacaaaaggtgaccagtg

SEQ ID NO: 878228 - DNA, 25 bp, Mus musculus
agtctcaaacaataggtgaccagtg

SEQ ID NO: 878229 - DNA, 25 bp, Mus musculus
agtctcatcacgctgctggcatcaa

SEQ ID NO: 878230 - DNA, 25 bp, Mus musculus
agtctcatcacggtgctggcatcaa

SEQ ID NO: 878231 - DNA, 25 bp, Mus musculus
agtctcatgtgcatctccatgctgt

SEQ ID NO: 878232 - DNA, 25 bp, Mus musculus
agtctcatgtgcatcttcatgactt

SEQ ID NO: 878233 - DNA, 25 bp, Mus musculus
agtctcatgtgcatgtccatgctgt

SEQ ID NO: 878234 - DNA, 25 bp, Mus musculus
agtctcatgtgcatgttcatgactt

SEQ ID NO: 878235 - DNA, 25 bp, Mus musculus
agtctcattcctccagctacactcc

SEQ ID NO: 878236 - DNA, 25 bp, Mus musculus
agtctcattcctcctgctacactcc

SEQ ID NO: 878237 - DNA, 25 bp, Mus musculus
agtctccaagatggcggtaaatgat

SEQ ID NO: 878238 - DNA, 25 bp, Mus musculus
agtctccaagcaagaactagagtca

SEQ ID NO: 878239 - DNA, 25 bp, Mus musculus
agtctccaaggaagaactagagtca

SEQ ID NO: 878240 - DNA, 25 bp, Mus musculus
agtctccaagttggcggtaaatgat

SEQ ID NO: 878241 - DNA, 25 bp, Mus musculus
agtctccacaagctgctgctgctcc

SEQ ID NO: 878242 - DNA, 25 bp, Mus musculus
agtctccacaaggtgctgctgctcc

SEQ ID NO: 878243 - DNA, 25 bp, Mus musculus
agtctccatctatacatcttaccaa

SEQ ID NO: 878244 - DNA, 25 bp, Mus musculus
agtctccatctatacgattcatgaa

SEQ ID NO: 878245 - DNA, 25 bp, Mus musculus
agtctccatctatagatcttaccaa

SEQ ID NO: 878246 - DNA, 25 bp, Mus musculus
agtctccatctataggattcatgaa

SEQ ID NO: 878247 - DNA, 25 bp, Mus musculus
agtctccatgcacgtagtgcatatg

SEQ ID NO: 878248 - DNA, 25 bp, Mus musculus
agtctccatgcaggtagtgcatatg

SEQ ID NO: 878249 - DNA, 25 bp, Mus musculus
agtctccatttccgtttccagattc

SEQ ID NO: 878250 - DNA, 25 bp, Mus musculus
agtctccatttcggtttccagattc

SEQ ID NO: 878251 - DNA, 25 bp, Mus musculus
agtctccgcggccgagacccctgtg

SEQ ID NO: 878252 - DNA, 25 bp, Mus musculus
agtctccgcggcggagacccctgtg

SEQ ID NO: 878253 - DNA, 25 bp, Mus musculus
agtctcctcccactgccctgggggg

SEQ ID NO: 878254 - DNA, 25 bp, Mus musculus
agtctcctcccagtgccctgggggg

SEQ ID NO: 878255 - DNA, 25 bp, Mus musculus
agtctccttcagataatgtatccat

SEQ ID NO: 878256 - DNA, 25 bp, Mus musculus
agtctccttcagttaatgtatccat

SEQ ID NO: 878257 - DNA, 25 bp, Mus musculus
agtctctccgaataccagaaggccc

SEQ ID NO: 878258 - DNA, 25 bp, Mus musculus
agtctctccgtataccagaaggccc

SEQ ID NO: 878259 - DNA, 25 bp, Mus musculus
agtctctctcagagaaacgggagaa

SEQ ID NO: 878260 - DNA, 25 bp, Mus musculus
agtctctctcagtgaaacgggagaa

SEQ ID NO: 878261 - DNA, 25 bp, Mus musculus
agtctcttcctcagacgataaggat

SEQ ID NO: 878262 - DNA, 25 bp, Mus musculus
agtctcttcctctgacgataaggat

SEQ ID NO: 878263 - DNA, 25 bp, Mus musculus
agtctgaagactacacagacacaaa

SEQ ID NO: 878264 - DNA, 25 bp, Mus musculus
agtctgaagactactcagacacaaa

SEQ ID NO: 878265 - DNA, 25 bp, Mus musculus
agtctgacaaagccttcatgtccaa

SEQ ID NO: 878266 - DNA, 25 bp, Mus musculus
agtctgacaaaggcttcatgtccaa

SEQ ID NO: 878267 - DNA, 25 bp, Mus musculus
agtctgacctctacaagaagactca

SEQ ID NO: 878268 - DNA, 25 bp, Mus musculus
agtctgacctgtacaagaagactca

SEQ ID NO: 878269 - DNA, 25 bp, Mus musculus
agtctgcaaaccatcatctcaagac

SEQ ID NO: 878270 - DNA, 25 bp, Mus musculus
agtctgcaaaccatccctcaatcta

SEQ ID NO: 878271 - DNA, 25 bp, Mus musculus
agtctgcaaaccatgatctcaagac

SEQ ID NO: 878272 - DNA, 25 bp, Mus musculus
agtctgcaaaccatgcctcaatcta

SEQ ID NO: 878273 - DNA, 25 bp, Mus musculus
agtctgcaacagatgtttaatgaac

SEQ ID NO: 878274 - DNA, 25 bp, Mus musculus
agtctgcaacagttgtttaatgaac

SEQ ID NO: 878275 - DNA, 25 bp, Mus musculus
agtctgcaaccatgcttttcatttc

SEQ ID NO: 878276 - DNA, 25 bp, Mus musculus
agtctgcaacgatgcttttcatttc

SEQ ID NO: 878277 - DNA, 25 bp, Mus musculus
agtctgcagcatcagggcgtctctg

SEQ ID NO: 878278 - DNA, 25 bp, Mus musculus
agtctgcagcatgagggcgtctctg

SEQ ID NO: 878279 - DNA, 25 bp, Mus musculus
agtctgcaggaaaacagcagaccca

SEQ ID NO: 878280 - DNA, 25 bp, Mus musculus
agtctgcaggctaggtttggcatga

SEQ ID NO: 878281 - DNA, 25 bp, Mus musculus
agtctgcaggctttggcatgacggg

SEQ ID NO: 878282 - DNA, 25 bp, Mus musculus
agtctgcagggtaggtttggcatga

SEQ ID NO: 878283 - DNA, 25 bp, Mus musculus
agtctgcagggtttggcatgacggg

SEQ ID NO: 878284 - DNA, 25 bp, Mus musculus
agtctgcaggtaaacagcagaccca

SEQ ID NO: 878285 - DNA, 25 bp, Mus musculus
agtctgccagatctctggctccctt

SEQ ID NO: 878286 - DNA, 25 bp, Mus musculus
agtctgccagcaacagcaggcagca

SEQ ID NO: 878287 - DNA, 25 bp, Mus musculus
agtctgccaggaacagcaggcagca

SEQ ID NO: 878288 - DNA, 25 bp, Mus musculus
agtctgccagttctctggctccctt

SEQ ID NO: 878289 - DNA, 25 bp, Mus musculus
agtctgccgactggttggctgtgat

SEQ ID NO: 878290 - DNA, 25 bp, Mus musculus
agtctgccgagtggttggctgtgat

SEQ ID NO: 878291 - DNA, 25 bp, Mus musculus
agtctgcgccctcacgatgactgag

SEQ ID NO: 878292 - DNA, 25 bp, Mus musculus
agtctgcgccctcaggatgactgag

SEQ ID NO: 878293 - DNA, 25 bp, Mus musculus
agtctgctcaggccggcttcatttg

SEQ ID NO: 878294 - DNA, 25 bp, Mus musculus
agtctgctcagggcggcttcatttg

SEQ ID NO: 878295 - DNA, 25 bp, Mus musculus
agtctgctctggcggaggcggctgg

SEQ ID NO: 878296 - DNA, 25 bp, Mus musculus
agtctgctctgggggaggcggctgg

SEQ ID NO: 878297 - DNA, 25 bp, Mus musculus
agtctgctgcatctaaataacttga

SEQ ID NO: 878298 - DNA, 25 bp, Mus musculus
agtctgctgcttctaaataacttga

SEQ ID NO: 878299 - DNA, 25 bp, Mus musculus
agtctggaggtgccgtccctacagc

SEQ ID NO: 878300 - DNA, 25 bp, Mus musculus
agtctggaggtggcgtccctacagc

SEQ ID NO: 878301 - DNA, 25 bp, Mus musculus
agtctggatacccactttgcagatg

SEQ ID NO: 878302 - DNA, 25 bp, Mus musculus
agtctggatacccagtttgcagatg

SEQ ID NO: 878303 - DNA, 25 bp, Mus musculus
agtctggccaccatgtgatggtgag

SEQ ID NO: 878304 - DNA, 25 bp, Mus musculus
agtctggccagcatgtgatggtgag

SEQ ID NO: 878305 - DNA, 25 bp, Mus musculus
agtctggccgtgctcacctatacca

SEQ ID NO: 878306 - DNA, 25 bp, Mus musculus
agtctggccgtgctgacctatacca

SEQ ID NO: 878307 - DNA, 25 bp, Mus musculus
agtctgggcacgatcatgccggcag

SEQ ID NO: 878308 - DNA, 25 bp, Mus musculus
agtctgggcacgttcatgccggcag

SEQ ID NO: 878309 - DNA, 25 bp, Mus musculus
agtctgggggagcaaagaccacagt

SEQ ID NO: 878310 - DNA, 25 bp, Mus musculus
agtctgggggaggaaagaccacagt

SEQ ID NO: 878311 - DNA, 25 bp, Mus musculus
agtctgtgagcctgggacccacgaa

SEQ ID NO: 878312 - DNA, 25 bp, Mus musculus
agtctgtgaggctgggacccacgaa

SEQ ID NO: 878313 - DNA, 25 bp, Mus musculus
agtctgtgcactaagtagaaaatga

SEQ ID NO: 878314 - DNA, 25 bp, Mus musculus
agtctgtgcacttagtagaaaatga

SEQ ID NO: 878315 - DNA, 25 bp, Mus musculus
agtctgttttatgacatgtccagct

SEQ ID NO: 878316 - DNA, 25 bp, Mus musculus
agtctgttttatgagatgtccagct

SEQ ID NO: 878317 - DNA, 25 bp, Mus musculus
agtcttaaaaatgcaccaacaattc

SEQ ID NO: 878318 - DNA, 25 bp, Mus musculus
agtcttaaaaatgctccaacaattc

SEQ ID NO: 878319 - DNA, 25 bp, Mus musculus
agtcttaagtatttcatgctggaga

SEQ ID NO: 878320 - DNA, 25 bp, Mus musculus
agtcttaagtatttcgctcagtgtt

SEQ ID NO: 878321 - DNA, 25 bp, Mus musculus
agtcttaagtatttgatgctggaga

SEQ ID NO: 878322 - DNA, 25 bp, Mus musculus
agtcttaagtatttggctcagtgtt

SEQ ID NO: 878323 - DNA, 25 bp, Mus musculus
agtcttacaataatcaccaatggac

SEQ ID NO: 878324 - DNA, 25 bp, Mus musculus
agtcttacaataatgaccaatggac

SEQ ID NO: 878325 - DNA, 25 bp, Mus musculus
agtcttacagcacattcgctcagca

SEQ ID NO: 878326 - DNA, 25 bp, Mus musculus
agtcttacagcagattcgctcagca

SEQ ID NO: 878327 - DNA, 25 bp, Mus musculus
agtcttcatctgactctggctcctc

SEQ ID NO: 878328 - DNA, 25 bp, Mus musculus
agtcttcatctgtctctggctcctc

SEQ ID NO: 878329 - DNA, 25 bp, Mus musculus
agtcttcattcacgttttggcaagc

SEQ ID NO: 878330 - DNA, 25 bp, Mus musculus
agtcttcattcaggttttggcaagc

SEQ ID NO: 878331 - DNA, 25 bp, Mus musculus
agtcttccaagcaacggcccctggc

SEQ ID NO: 878332 - DNA, 25 bp, Mus musculus
agtcttccaagcaagggcccctggc

SEQ ID NO: 878333 - DNA, 25 bp, Mus musculus
agtcttccccagcttgccctggcat

SEQ ID NO: 878334 - DNA, 25 bp, Mus musculus
agtcttccccaggttgccctggcat

SEQ ID NO: 878335 - DNA, 25 bp, Mus musculus
agtcttcgggcccctctgtcctgga

SEQ ID NO: 878336 - DNA, 25 bp, Mus musculus
agtcttcggggccctctgtcctgga

SEQ ID NO: 878337 - DNA, 25 bp, Mus musculus
agtcttcgtgcgacctcgcaagctg

SEQ ID NO: 878338 - DNA, 25 bp, Mus musculus
agtcttcgtgggacctcgcaagctg

SEQ ID NO: 878339 - DNA, 25 bp, Mus musculus
agtcttgccaagatgtggatgaatg

SEQ ID NO: 878340 - DNA, 25 bp, Mus musculus
agtcttgccaagttgtggatgaatg

SEQ ID NO: 878341 - DNA, 25 bp, Mus musculus
agtcttggataaacaattgctgtgt

SEQ ID NO: 878342 - DNA, 25 bp, Mus musculus
agtcttggataaactattgctgtgt

SEQ ID NO: 878343 - DNA, 25 bp, Mus musculus
agtcttgggcctcggcccataccca

SEQ ID NO: 878344 - DNA, 25 bp, Mus musculus
agtcttgggcctgggcccataccca

SEQ ID NO: 878345 - DNA, 25 bp, Mus musculus
agtctttgcgatagtaccaagactt

SEQ ID NO: 878346 - DNA, 25 bp, Mus musculus
agtctttgcgattgtaccaagactt

SEQ ID NO: 878347 - DNA, 25 bp, Mus musculus
agtgaaaataagagccattctgagg

SEQ ID NO: 878348 - DNA, 25 bp, Mus musculus
agtgaaaataagtgccattctgagg

SEQ ID NO: 878349 - DNA, 25 bp, Mus musculus
agtgaaacagctgggtgttaacccg

SEQ ID NO: 878350 - DNA, 25 bp, Mus musculus
agtgaaacaggtgggtgttaacccg

SEQ ID NO: 878351 - DNA, 25 bp, Mus musculus
agtgaaatcgccttgctatcttcgt

SEQ ID NO: 878352 - DNA, 25 bp, Mus musculus
agtgaaatcggcttgctatcttcgt

SEQ ID NO: 878353 - DNA, 25 bp, Mus musculus
agtgaaatgtctgcccagaaaaatg

SEQ ID NO: 878354 - DNA, 25 bp, Mus musculus
agtgaaatgtgtgcccagaaaaatg

SEQ ID NO: 878355 - DNA, 25 bp, Mus musculus
agtgaacctgcaagttgcttgtatg

SEQ ID NO: 878356 - DNA, 25 bp, Mus musculus
agtgaacctgcatgttgcttgtatg

SEQ ID NO: 878357 - DNA, 25 bp, Mus musculus
agtgaactctcacttagtcaccaca

SEQ ID NO: 878358 - DNA, 25 bp, Mus musculus
agtgaactctcagttagtcaccaca

SEQ ID NO: 878359 - DNA, 25 bp, Mus musculus
agtgaagaagaactcctacctggac

SEQ ID NO: 878360 - DNA, 25 bp, Mus musculus
agtgaagaagcgagatcatcagtac

SEQ ID NO: 878361 - DNA, 25 bp, Mus musculus
agtgaagaagggagatcatcagtac

SEQ ID NO: 878362 - DNA, 25 bp, Mus musculus
agtgaagaagtactcctacctggac

SEQ ID NO: 878363 - DNA, 25 bp, Mus musculus
agtgaagacgcttactgtcaaagtg

SEQ ID NO: 878364 - DNA, 25 bp, Mus musculus
agtgaagacggttactgtcaaagtg

SEQ ID NO: 878365 - DNA, 25 bp, Mus musculus
agtgaagagccacgttgggcctgga

SEQ ID NO: 878366 - DNA, 25 bp, Mus musculus
agtgaagagccaggttgggcctgga

SEQ ID NO: 878367 - DNA, 25 bp, Mus musculus
agtgaagaggagcacgattttctgc

SEQ ID NO: 878368 - DNA, 25 bp, Mus musculus
agtgaagaggagcaggattttctgc

SEQ ID NO: 878369 - DNA, 25 bp, Mus musculus
agtgaagaggagctcccccagaggt

SEQ ID NO: 878370 - DNA, 25 bp, Mus musculus
agtgaagaggaggtcccccagaggt

SEQ ID NO: 878371 - DNA, 25 bp, Mus musculus
agtgaagatgaagaagttttcacga

SEQ ID NO: 878372 - DNA, 25 bp, Mus musculus
agtgaagatgaagatgttttcacga

SEQ ID NO: 878373 - DNA, 25 bp, Mus musculus
agtgaagattcacgcttgttccccc

SEQ ID NO: 878374 - DNA, 25 bp, Mus musculus
agtgaagattcaggcttgttccccc

SEQ ID NO: 878375 - DNA, 25 bp, Mus musculus
agtgaagcccaaccctccagaaccc

SEQ ID NO: 878376 - DNA, 25 bp, Mus musculus
agtgaagcccaagcctccagaaccc

SEQ ID NO: 878377 - DNA, 25 bp, Mus musculus
agtgaaggagaagagtcttgatgaa

SEQ ID NO: 878378 - DNA, 25 bp, Mus musculus
agtgaaggagacttgatgaagtcag

SEQ ID NO: 878379 - DNA, 25 bp, Mus musculus
agtgaaggagagtcttgatgaagtc

SEQ ID NO: 878380 - DNA, 25 bp, Mus musculus
agtgaaggagtagagtcttgatgaa

SEQ ID NO: 878381 - DNA, 25 bp, Mus musculus
agtgaaggagtcttgatgaagtcag

SEQ ID NO: 878382 - DNA, 25 bp, Mus musculus
agtgaaggagtgtcttgatgaagtc

SEQ ID NO: 878383 - DNA, 25 bp, Mus musculus
agtgaaggctggctccctttgcggg

SEQ ID NO: 878384 - DNA, 25 bp, Mus musculus
agtgaaggctggctgcctttgcggg

SEQ ID NO: 878385 - DNA, 25 bp, Mus musculus
agtgaatatcctaaaaagcaccaga

SEQ ID NO: 878386 - DNA, 25 bp, Mus musculus
agtgaatatcgtaaaaagcaccaga

SEQ ID NO: 878387 - DNA, 25 bp, Mus musculus
agtgaatcagcccatctggctgctg

SEQ ID NO: 878388 - DNA, 25 bp, Mus musculus
agtgaatcagcctcaccttcagccc

SEQ ID NO: 878389 - DNA, 25 bp, Mus musculus
agtgaatcaggccatctggctgctg

SEQ ID NO: 878390 - DNA, 25 bp, Mus musculus
agtgaatcaggctcaccttcagccc

SEQ ID NO: 878391 - DNA, 25 bp, Mus musculus
agtgaattagatataatgtttaatt

SEQ ID NO: 878392 - DNA, 25 bp, Mus musculus
agtgaattagatttaatgtttaatt

SEQ ID NO: 878393 - DNA, 25 bp, Mus musculus
agtgaattggaacgggtatttctct

SEQ ID NO: 878394 - DNA, 25 bp, Mus musculus
agtgaattggaaggggtatttctct

SEQ ID NO: 878395 - DNA, 25 bp, Mus musculus
agtgacaaggcgagcctccagggac

SEQ ID NO: 878396 - DNA, 25 bp, Mus musculus
agtgacaaggcgtgcctccagggac

SEQ ID NO: 878397 - DNA, 25 bp, Mus musculus
agtgacaagggacaattcggtggct

SEQ ID NO: 878398 - DNA, 25 bp, Mus musculus
agtgacaagggacggaaaattgaat

SEQ ID NO: 878399 - DNA, 25 bp, Mus musculus
agtgacaagggagaattcggtggct

SEQ ID NO: 878400 - DNA, 25 bp, Mus musculus
agtgacaagggagggaaaattgaat

SEQ ID NO: 878401 - DNA, 25 bp, Mus musculus
agtgacacagcttcagcggtgggtc

SEQ ID NO: 878402 - DNA, 25 bp, Mus musculus
agtgacacaggttcagcggtgggtc

SEQ ID NO: 878403 - DNA, 25 bp, Mus musculus
agtgacacccttacagttgaaactt

SEQ ID NO: 878404 - DNA, 25 bp, Mus musculus
agtgacaccctttcagttgaaactt

SEQ ID NO: 878405 - DNA, 25 bp, Mus musculus
agtgacatcctacacaacaacggga

SEQ ID NO: 878406 - DNA, 25 bp, Mus musculus
agtgacatcctagacaacaacggga

SEQ ID NO: 878407 - DNA, 25 bp, Mus musculus
agtgacattcaacttcattctggct

SEQ ID NO: 878408 - DNA, 25 bp, Mus musculus
agtgacattcaagttcattctggct

SEQ ID NO: 878409 - DNA, 25 bp, Mus musculus
agtgaccaaactctgcgctgaggat

SEQ ID NO: 878410 - DNA, 25 bp, Mus musculus
agtgaccaaagtctgcgctgaggat

SEQ ID NO: 878411 - DNA, 25 bp, Mus musculus
agtgaccacgctggaccagctattc

SEQ ID NO: 878412 - DNA, 25 bp, Mus musculus
agtgaccacggtggaccagctattc

SEQ ID NO: 878413 - DNA, 25 bp, Mus musculus
agtgaccaggccgtccctgccattc

SEQ ID NO: 878414 - DNA, 25 bp, Mus musculus
agtgaccagggcgtccctgccattc

SEQ ID NO: 878415 - DNA, 25 bp, Mus musculus
agtgaccattgaccaagaactatgt

SEQ ID NO: 878416 - DNA, 25 bp, Mus musculus
agtgaccattgacgttatctggctg

SEQ ID NO: 878417 - DNA, 25 bp, Mus musculus
agtgaccattgagcaagaactatgt

SEQ ID NO: 878418 - DNA, 25 bp, Mus musculus
agtgaccattgaggttatctggctg

SEQ ID NO: 878419 - DNA, 25 bp, Mus musculus
agtgacccagagatcttcccggaag

SEQ ID NO: 878420 - DNA, 25 bp, Mus musculus
agtgacccagcaaatgtgggtttac

SEQ ID NO: 878421 - DNA, 25 bp, Mus musculus
agtgacccaggaaatgtgggtttac

SEQ ID NO: 878422 - DNA, 25 bp, Mus musculus
agtgacccagtgatcttcccggaag

SEQ ID NO: 878423 - DNA, 25 bp, Mus musculus
agtgaccccatgtgcccacagtaca

SEQ ID NO: 878424 - DNA, 25 bp, Mus musculus
agtgaccccatgtggccacagtaca

SEQ ID NO: 878425 - DNA, 25 bp, Mus musculus
agtgaccccctgccaggacactact

SEQ ID NO: 878426 - DNA, 25 bp, Mus musculus
agtgaccccctggcaggacactact

SEQ ID NO: 878427 - DNA, 25 bp, Mus musculus
agtgaccgggagaacagagctctgg

SEQ ID NO: 878428 - DNA, 25 bp, Mus musculus
agtgaccgggagaacctctggctgc

SEQ ID NO: 878429 - DNA, 25 bp, Mus musculus
agtgaccgggagaagagagctctgg

SEQ ID NO: 878430 - DNA, 25 bp, Mus musculus
agtgaccgggagaagctctggctgc

SEQ ID NO: 878431 - DNA, 25 bp, Mus musculus
agtgacctcctgcattaccccaagc

SEQ ID NO: 878432 - DNA, 25 bp, Mus musculus
agtgacctcctggattaccccaagc

SEQ ID NO: 878433 - DNA, 25 bp, Mus musculus
agtgacgcctgagacgtgactctgt

SEQ ID NO: 878434 - DNA, 25 bp, Mus musculus
agtgacgcctgagaggtgactctgt

SEQ ID NO: 878435 - DNA, 25 bp, Mus musculus
agtgactaaaagaagtagaaggagg

SEQ ID NO: 878436 - DNA, 25 bp, Mus musculus
agtgactaaaagtagtagaaggagg

SEQ ID NO: 878437 - DNA, 25 bp, Mus musculus
agtgactaccagcttatttctgaca

SEQ ID NO: 878438 - DNA, 25 bp, Mus musculus
agtgactaccaggttatttctgaca

SEQ ID NO: 878439 - DNA, 25 bp, Mus musculus
agtgactcacccaacatctggatcc

SEQ ID NO: 878440 - DNA, 25 bp, Mus musculus
agtgactcacccaagatctggatcc

SEQ ID NO: 878441 - DNA, 25 bp, Mus musculus
agtgactgagagaggaatgcagtgg

SEQ ID NO: 878442 - DNA, 25 bp, Mus musculus
agtgactgagagtggaatgcagtgg

SEQ ID NO: 878443 - DNA, 25 bp, Mus musculus
agtgactgagataacagcctcatcg

SEQ ID NO: 878444 - DNA, 25 bp, Mus musculus
agtgactgagttaacagcctcatcg

SEQ ID NO: 878445 - DNA, 25 bp, Mus musculus
agtgactgcatccatcagttttcct

SEQ ID NO: 878446 - DNA, 25 bp, Mus musculus
agtgactgcatccggaagatcagtt

SEQ ID NO: 878447 - DNA, 25 bp, Mus musculus
agtgactgcatcgatcagttttcct

SEQ ID NO: 878448 - DNA, 25 bp, Mus musculus
agtgactgcatcgggaagatcagtt

SEQ ID NO: 878449 - DNA, 25 bp, Mus musculus
agtgagaacagaaaccttgaggaaa

SEQ ID NO: 878450 - DNA, 25 bp, Mus musculus
agtgagaacagataccttgaggaaa

SEQ ID NO: 878451 - DNA, 25 bp, Mus musculus
agtgagacctcgtatagctggcatc

SEQ ID NO: 878452 - DNA, 25 bp, Mus musculus
agtgagacctggtatagctggcatc

SEQ ID NO: 878453 - DNA, 25 bp, Mus musculus
agtgagccagatgccttctgggagg

SEQ ID NO: 878454 - DNA, 25 bp, Mus musculus
agtgagccagttgccttctgggagg

SEQ ID NO: 878455 - DNA, 25 bp, Mus musculus
agtgagccccagaccacctcatcct

SEQ ID NO: 878456 - DNA, 25 bp, Mus musculus
agtgagccccagctctgtctccgtg

SEQ ID NO: 878457 - DNA, 25 bp, Mus musculus
agtgagccccaggtctgtctccgtg

SEQ ID NO: 878458 - DNA, 25 bp, Mus musculus
agtgagccccagtccacctcatcct

SEQ ID NO: 878459 - DNA, 25 bp, Mus musculus
agtgagcctggtcacgcagtccctc

SEQ ID NO: 878460 - DNA, 25 bp, Mus musculus
agtgagcctggtcacgtgaaagcag

SEQ ID NO: 878461 - DNA, 25 bp, Mus musculus
agtgagcctggtcaggcagtccctc

SEQ ID NO: 878462 - DNA, 25 bp, Mus musculus
agtgagcctggtcaggtgaaagcag

SEQ ID NO: 878463 - DNA, 25 bp, Mus musculus
agtgagcgacaggacgtgaacatcc

SEQ ID NO: 878464 - DNA, 25 bp, Mus musculus
agtgagcgacaggaggtgaacatcc

SEQ ID NO: 878465 - DNA, 25 bp, Mus musculus
agtgagggatggcacgctcaaagac

SEQ ID NO: 878466 - DNA, 25 bp, Mus musculus
agtgagggatggcaggctcaaagac

SEQ ID NO: 878467 - DNA, 25 bp, Mus musculus
agtgaggtggcccagacatcagaac

SEQ ID NO: 878468 - DNA, 25 bp, Mus musculus
agtgaggtgggccagacatcagaac

SEQ ID NO: 878469 - DNA, 25 bp, Mus musculus
agtgagtcagatttccccccagtct

SEQ ID NO: 878470 - DNA, 25 bp, Mus musculus
agtgagtcagttttccccccagtct

SEQ ID NO: 878471 - DNA, 25 bp, Mus musculus
agtgagtcccggatctatggaaaat

SEQ ID NO: 878472 - DNA, 25 bp, Mus musculus
agtgagtcccggttctatggaaaat

SEQ ID NO: 878473 - DNA, 25 bp, Mus musculus
agtgagtcggcacggctctgagtca

SEQ ID NO: 878474 - DNA, 25 bp, Mus musculus
agtgagtcggcacttgaaagtgggg

SEQ ID NO: 878475 - DNA, 25 bp, Mus musculus
agtgagtcggcagggctctgagtca

SEQ ID NO: 878476 - DNA, 25 bp, Mus musculus
agtgagtcggcagttgaaagtgggg

SEQ ID NO: 878477 - DNA, 25 bp, Mus musculus
agtgatcttcagggcgtgattagtg

SEQ ID NO: 878478 - DNA, 25 bp, Mus musculus
agtgatcttcagggggtgattagtg

SEQ ID NO: 878479 - DNA, 25 bp, Mus musculus
agtgatgaagagcacaactttctac

SEQ ID NO: 878480 - DNA, 25 bp, Mus musculus
agtgatgaagagcagaactttctac

SEQ ID NO: 878481 - DNA, 25 bp, Mus musculus
agtgatggcgccaatccagatcatg

SEQ ID NO: 878482 - DNA, 25 bp, Mus musculus
agtgatggcggcaatccagatcatg

SEQ ID NO: 878483 - DNA, 25 bp, Mus musculus
agtgattacagacaattgtatttct

SEQ ID NO: 878484 - DNA, 25 bp, Mus musculus
agtgattacagacgctttggtatag

SEQ ID NO: 878485 - DNA, 25 bp, Mus musculus
agtgattacagacgttgccatgaag

SEQ ID NO: 878486 - DNA, 25 bp, Mus musculus
agtgattacagagaattgtatttct

SEQ ID NO: 878487 - DNA, 25 bp, Mus musculus
agtgattacagaggctttggtatag

SEQ ID NO: 878488 - DNA, 25 bp, Mus musculus
agtgattacagaggttgccatgaag

SEQ ID NO: 878489 - DNA, 25 bp, Mus musculus
agtgatttcacttttcagaacatga

SEQ ID NO: 878490 - DNA, 25 bp, Mus musculus
agtgatttcagttttcagaacatga

SEQ ID NO: 878491 - DNA, 25 bp, Mus musculus
agtgatttggagattttctggaacc

SEQ ID NO: 878492 - DNA, 25 bp, Mus musculus
agtgatttggagtttttctggaacc

SEQ ID NO: 878493 - DNA, 25 bp, Mus musculus
agtgcaaacagactgacataatgat

SEQ ID NO: 878494 - DNA, 25 bp, Mus musculus
agtgcaaacagagtgacataatgat

SEQ ID NO: 878495 - DNA, 25 bp, Mus musculus
agtgcaagccccaacaggatgatta

SEQ ID NO: 878496 - DNA, 25 bp, Mus musculus
agtgcaagccccaagaggatgatta

SEQ ID NO: 878497 - DNA, 25 bp, Mus musculus
agtgcaatatcgatcaggctgggcg

SEQ ID NO: 878498 - DNA, 25 bp, Mus musculus
agtgcaatatggatcaggctgggcg

SEQ ID NO: 878499 - DNA, 25 bp, Mus musculus
agtgcaatgcagaccgtggtggatg

SEQ ID NO: 878500 - DNA, 25 bp, Mus musculus
agtgcaatgcagcacagtggtgact

SEQ ID NO: 878501 - DNA, 25 bp, Mus musculus
agtgcaatgcaggacagtggtgact

SEQ ID NO: 878502 - DNA, 25 bp, Mus musculus
agtgcaatgcagtccgtggtggatg

SEQ ID NO: 878503 - DNA, 25 bp, Mus musculus
agtgcacactggctttaacagcatt

SEQ ID NO: 878504 - DNA, 25 bp, Mus musculus
agtgcacactgggtttaacagcatt

SEQ ID NO: 878505 - DNA, 25 bp, Mus musculus
agtgcacagctgctatgcatggacc

SEQ ID NO: 878506 - DNA, 25 bp, Mus musculus
agtgcacagctggtatgcatggacc

SEQ ID NO: 878507 - DNA, 25 bp, Mus musculus
agtgcacagttccacacatctctta

SEQ ID NO: 878508 - DNA, 25 bp, Mus musculus
agtgcacagttccagacatctctta

SEQ ID NO: 878509 - DNA, 25 bp, Mus musculus
agtgcaccagcaacacccatgacaa

SEQ ID NO: 878510 - DNA, 25 bp, Mus musculus
agtgcaccagcaactcccatgacaa

SEQ ID NO: 878511 - DNA, 25 bp, Mus musculus
agtgcacccgcagcgtgcttccggc

SEQ ID NO: 878512 - DNA, 25 bp, Mus musculus
agtgcacccgcgtgcttccggctgt

SEQ ID NO: 878513 - DNA, 25 bp, Mus musculus
agtgcacccggagcgtgcttccggc

SEQ ID NO: 878514 - DNA, 25 bp, Mus musculus
agtgcacccgggtgcttccggctgt

SEQ ID NO: 878515 - DNA, 25 bp, Mus musculus
agtgcactgaggcgcgaagcctgtg

SEQ ID NO: 878516 - DNA, 25 bp, Mus musculus
agtgcactgaggcgggaagcctgtg

SEQ ID NO: 878517 - DNA, 25 bp, Mus musculus
agtgcagaagctgtagctatctctg

SEQ ID NO: 878518 - DNA, 25 bp, Mus musculus
agtgcagaaggtgtagctatctctg

SEQ ID NO: 878519 - DNA, 25 bp, Mus musculus
agtgcagatcagaatcaagctcatg

SEQ ID NO: 878520 - DNA, 25 bp, Mus musculus
agtgcagatcagtatcaagctcatg

SEQ ID NO: 878521 - DNA, 25 bp, Mus musculus
agtgcagcctcacccaagttgaagt

SEQ ID NO: 878522 - DNA, 25 bp, Mus musculus
agtgcagcctcagccaagttgaagt

SEQ ID NO: 878523 - DNA, 25 bp, Mus musculus
agtgcagcgacgcatcgaagcctgt

SEQ ID NO: 878524 - DNA, 25 bp, Mus musculus
agtgcagcgacggatcgaagcctgt

SEQ ID NO: 878525 - DNA, 25 bp, Mus musculus
agtgcagtggccctggaccatagcc

SEQ ID NO: 878526 - DNA, 25 bp, Mus musculus
agtgcagtgggcctggaccatagcc

SEQ ID NO: 878527 - DNA, 25 bp, Mus musculus
agtgcatcagacactggcagtgaag

SEQ ID NO: 878528 - DNA, 25 bp, Mus musculus
agtgcatcagtcactggcagtgaag

SEQ ID NO: 878529 - DNA, 25 bp, Mus musculus
agtgcatccatgcactattcaagag

SEQ ID NO: 878530 - DNA, 25 bp, Mus musculus
agtgcatccatgcagtattcaagag

SEQ ID NO: 878531 - DNA, 25 bp, Mus musculus
agtgccaaatggcccagcaaggacc

SEQ ID NO: 878532 - DNA, 25 bp, Mus musculus
agtgccaaatgggccagcaaggacc

SEQ ID NO: 878533 - DNA, 25 bp, Mus musculus
agtgccaaccaacggaatggcgaag

SEQ ID NO: 878534 - DNA, 25 bp, Mus musculus
agtgccaaccaagggaatggcgaag

SEQ ID NO: 878535 - DNA, 25 bp, Mus musculus
agtgccacaaagcaacctacttggt

SEQ ID NO: 878536 - DNA, 25 bp, Mus musculus
agtgccacaaaggaacctacttggt

SEQ ID NO: 878537 - DNA, 25 bp, Mus musculus
agtgccactgcacacggtgctggac

SEQ ID NO: 878538 - DNA, 25 bp, Mus musculus
agtgccactggacacggtgctggac

SEQ ID NO: 878539 - DNA, 25 bp, Mus musculus
agtgccagggagctgtgaatgaggc

SEQ ID NO: 878540 - DNA, 25 bp, Mus musculus
agtgccagggaggtgtgaatgaggc

SEQ ID NO: 878541 - DNA, 25 bp, Mus musculus
agtgccatgatgcacgactcgcctt

SEQ ID NO: 878542 - DNA, 25 bp, Mus musculus
agtgccatgatgcaggactcgcctt

SEQ ID NO: 878543 - DNA, 25 bp, Mus musculus
agtgccattaagcgagaaatcaaat

SEQ ID NO: 878544 - DNA, 25 bp, Mus musculus
agtgccattaagggagaaatcaaat

SEQ ID NO: 878545 - DNA, 25 bp, Mus musculus
agtgcccactcacgctcctattaat

SEQ ID NO: 878546 - DNA, 25 bp, Mus musculus
agtgcccactcaggctcctattaat

SEQ ID NO: 878547 - DNA, 25 bp, Mus musculus
agtgcccatgatcatctttgctaag

SEQ ID NO: 878548 - DNA, 25 bp, Mus musculus
agtgcccatgttcatctttgctaag

SEQ ID NO: 878549 - DNA, 25 bp, Mus musculus
agtgccccaaagccttcaacgggca

SEQ ID NO: 878550 - DNA, 25 bp, Mus musculus
agtgccccaaaggcttcaacgggca

SEQ ID NO: 878551 - DNA, 25 bp, Mus musculus
agtgcccccaccggatgcagaagag

SEQ ID NO: 878552 - DNA, 25 bp, Mus musculus
agtgcccccagagacctctcatggt

SEQ ID NO: 878553 - DNA, 25 bp, Mus musculus
agtgcccccagagagctctcatggt

SEQ ID NO: 878554 - DNA, 25 bp, Mus musculus
agtgcccccagcggatgcagaagag

SEQ ID NO: 878555 - DNA, 25 bp, Mus musculus
agtgcccctgtccacatactgcagg

SEQ ID NO: 878556 - DNA, 25 bp, Mus musculus
agtgcccctgtccagatactgcagg

SEQ ID NO: 878557 - DNA, 25 bp, Mus musculus
agtgcccgcccacgttgtcttgaca

SEQ ID NO: 878558 - DNA, 25 bp, Mus musculus
agtgcccgcccaggttgtcttgaca

SEQ ID NO: 878559 - DNA, 25 bp, Mus musculus
agtgccctgctaaccaagacccagc

SEQ ID NO: 878560 - DNA, 25 bp, Mus musculus
agtgccctgctaaccacccagcatg

SEQ ID NO: 878561 - DNA, 25 bp, Mus musculus
agtgccctgctaacgaagacccagc

SEQ ID NO: 878562 - DNA, 25 bp, Mus musculus
agtgccctgctaacgacccagcatg

SEQ ID NO: 878563 - DNA, 25 bp, Mus musculus
agtgccggtgctgtaagaggaaatc

SEQ ID NO: 878564 - DNA, 25 bp, Mus musculus
agtgccggtggtgtaagaggaaatc

SEQ ID NO: 878565 - DNA, 25 bp, Mus musculus
agtgccgtggaggacatggaggcgg

SEQ ID NO: 878566 - DNA, 25 bp, Mus musculus
agtgccgtggaggagatggaggcgg

SEQ ID NO: 878567 - DNA, 25 bp, Mus musculus
agtgcctagaaactcggacctgttc

SEQ ID NO: 878568 - DNA, 25 bp, Mus musculus
agtgcctagaaagtcggacctgttc

SEQ ID NO: 878569 - DNA, 25 bp, Mus musculus
agtgcctattcacggacagaggcag

SEQ ID NO: 878570 - DNA, 25 bp, Mus musculus
agtgcctattcagggacagaggcag

SEQ ID NO: 878571 - DNA, 25 bp, Mus musculus
agtgcctattgtgacgaactaatga

SEQ ID NO: 878572 - DNA, 25 bp, Mus musculus
agtgcctattgtgaggaactaatga

SEQ ID NO: 878573 - DNA, 25 bp, Mus musculus
agtgcctcagagaccatgatgggaa

SEQ ID NO: 878574 - DNA, 25 bp, Mus musculus
agtgcctcagtgaagaaactgacgc

SEQ ID NO: 878575 - DNA, 25 bp, Mus musculus
agtgcctcagtgaccatgatgggaa

SEQ ID NO: 878576 - DNA, 25 bp, Mus musculus
agtgcctcagtgctggtgagctctt

SEQ ID NO: 878577 - DNA, 25 bp, Mus musculus
agtgcctcagtggtggtgagctctt

SEQ ID NO: 878578 - DNA, 25 bp, Mus musculus
agtgcctcagtgtagaaactgacgc

SEQ ID NO: 878579 - DNA, 25 bp, Mus musculus
agtgcctcctgccgtccacctccag

SEQ ID NO: 878580 - DNA, 25 bp, Mus musculus
agtgcctcctgcggtccacctccag

SEQ ID NO: 878581 - DNA, 25 bp, Mus musculus
agtgcctgccagctgagaagccatt

SEQ ID NO: 878582 - DNA, 25 bp, Mus musculus
agtgcctgccaggtgagaagccatt

SEQ ID NO: 878583 - DNA, 25 bp, Mus musculus
agtgccttgggtcacagctttatct

SEQ ID NO: 878584 - DNA, 25 bp, Mus musculus
agtgccttgggtcagagctttatct

SEQ ID NO: 878585 - DNA, 25 bp, Mus musculus
agtgcgcgacagcctgtttggtctc

SEQ ID NO: 878586 - DNA, 25 bp, Mus musculus
agtgcgcgacagcttctggatggtg

SEQ ID NO: 878587 - DNA, 25 bp, Mus musculus
agtgcgcgacaggctgtttggtctc

SEQ ID NO: 878588 - DNA, 25 bp, Mus musculus
agtgcgcgacaggttctggatggtg

SEQ ID NO: 878589 - DNA, 25 bp, Mus musculus
agtgcggaaatgcgagaagaaatgg

SEQ ID NO: 878590 - DNA, 25 bp, Mus musculus
agtgcggaaatgggagaagaaatgg

SEQ ID NO: 878591 - DNA, 25 bp, Mus musculus
agtgcggaggccgggggcagagatc

SEQ ID NO: 878592 - DNA, 25 bp, Mus musculus
agtgcggagggcgggggcagagatc

SEQ ID NO: 878593 - DNA, 25 bp, Mus musculus
agtgcggtccaggacattgtgcctt

SEQ ID NO: 878594 - DNA, 25 bp, Mus musculus
agtgcggtccaggagattgtgcctt

SEQ ID NO: 878595 - DNA, 25 bp, Mus musculus
agtgcgttatcacagtgaagccata

SEQ ID NO: 878596 - DNA, 25 bp, Mus musculus
agtgcgttatcagagtgaagccata

SEQ ID NO: 878597 - DNA, 25 bp, Mus musculus
agtgctaaagcactgttgtgtaagc

SEQ ID NO: 878598 - DNA, 25 bp, Mus musculus
agtgctaaaggactgttgtgtaagc

SEQ ID NO: 878599 - DNA, 25 bp, Mus musculus
agtgctagaaactcttgaaaatctg

SEQ ID NO: 878600 - DNA, 25 bp, Mus musculus
agtgctagaatctcttgaaaatctg

SEQ ID NO: 878601 - DNA, 25 bp, Mus musculus
agtgctagatgacgcagataaattg

SEQ ID NO: 878602 - DNA, 25 bp, Mus musculus
agtgctagatgaggcagataaattg

SEQ ID NO: 878603 - DNA, 25 bp, Mus musculus
agtgctctcacaacaattgttcact

SEQ ID NO: 878604 - DNA, 25 bp, Mus musculus
agtgctctcacaactattgttcact

SEQ ID NO: 878605 - DNA, 25 bp, Mus musculus
agtgctctgacttgcgtctgaagac

SEQ ID NO: 878606 - DNA, 25 bp, Mus musculus
agtgctctgacttgggtctgaagac

SEQ ID NO: 878607 - DNA, 25 bp, Mus musculus
agtgctcttcagaatgtgaagagac

SEQ ID NO: 878608 - DNA, 25 bp, Mus musculus
agtgctcttcagtatgtgaagagac

SEQ ID NO: 878609 - DNA, 25 bp, Mus musculus
agtgctgaagatctgtgacttcggt

SEQ ID NO: 878610 - DNA, 25 bp, Mus musculus
agtgctgaagccagggaagcggcct

SEQ ID NO: 878611 - DNA, 25 bp, Mus musculus
agtgctgaaggcagggaagcggcct

SEQ ID NO: 878612 - DNA, 25 bp, Mus musculus
agtgctgaagttctgtgacttcggt

SEQ ID NO: 878613 - DNA, 25 bp, Mus musculus
agtgctgcagcaaaagccaaattca

SEQ ID NO: 878614 - DNA, 25 bp, Mus musculus
agtgctgcagcaggctactttttgt

SEQ ID NO: 878615 - DNA, 25 bp, Mus musculus
agtgctgcaggaaaagccaaattca

SEQ ID NO: 878616 - DNA, 25 bp, Mus musculus
agtgctgcaggaggctactttttgt

SEQ ID NO: 878617 - DNA, 25 bp, Mus musculus
agtgctgcctgacccctaggaccat

SEQ ID NO: 878618 - DNA, 25 bp, Mus musculus
agtgctgcctgagccctaggaccat

SEQ ID NO: 878619 - DNA, 25 bp, Mus musculus
agtgctggacagcccggggcccgcc

SEQ ID NO: 878620 - DNA, 25 bp, Mus musculus
agtgctggacaggccggggcccgcc

SEQ ID NO: 878621 - DNA, 25 bp, Mus musculus
agtgctggagaataaactgatgagg

SEQ ID NO: 878622 - DNA, 25 bp, Mus musculus
agtgctggagtataaactgatgagg

SEQ ID NO: 878623 - DNA, 25 bp, Mus musculus
agtgcttaagctagggaacatcctt

SEQ ID NO: 878624 - DNA, 25 bp, Mus musculus
agtgcttaaggtagggaacatcctt

SEQ ID NO: 878625 - DNA, 25 bp, Mus musculus
agtgcttacgacccggcactacgtg

SEQ ID NO: 878626 - DNA, 25 bp, Mus musculus
agtgcttacgtcccggcactacgtg

SEQ ID NO: 878627 - DNA, 25 bp, Mus musculus
agtgcttactctcttcttctctatt

SEQ ID NO: 878628 - DNA, 25 bp, Mus musculus
agtgcttactgtcttcttctctatt

SEQ ID NO: 878629 - DNA, 25 bp, Mus musculus
agtgcttattatcctggataataag

SEQ ID NO: 878630 - DNA, 25 bp, Mus musculus
agtgcttattatgctggataataag

SEQ ID NO: 878631 - DNA, 25 bp, Mus musculus
agtgcttccaaaccacaggctggct

SEQ ID NO: 878632 - DNA, 25 bp, Mus musculus
agtgcttccaaacccaggtgtcaga

SEQ ID NO: 878633 - DNA, 25 bp, Mus musculus
agtgcttccaaagcacaggctggct

SEQ ID NO: 878634 - DNA, 25 bp, Mus musculus
agtgcttccaaagccaggtgtcaga

SEQ ID NO: 878635 - DNA, 25 bp, Mus musculus
agtgcttcttccaccaatttgaaag

SEQ ID NO: 878636 - DNA, 25 bp, Mus musculus
agtgcttcttccacgaatttgaaag

SEQ ID NO: 878637 - DNA, 25 bp, Mus musculus
agtgcttggcgccaaaaggtggaca

SEQ ID NO: 878638 - DNA, 25 bp, Mus musculus
agtgcttggcgccatatgctaatga

SEQ ID NO: 878639 - DNA, 25 bp, Mus musculus
agtgcttggcgccgtgaaggcgata

SEQ ID NO: 878640 - DNA, 25 bp, Mus musculus
agtgcttggcgcgaaaaggtggaca

SEQ ID NO: 878641 - DNA, 25 bp, Mus musculus
agtgcttggcgcgatatgctaatga

SEQ ID NO: 878642 - DNA, 25 bp, Mus musculus
agtgcttggcgcggtgaaggcgata

SEQ ID NO: 878643 - DNA, 25 bp, Mus musculus
agtgcttttcaccgaaggagttcgc

SEQ ID NO: 878644 - DNA, 25 bp, Mus musculus
agtgcttttcacggaaggagttcgc

SEQ ID NO: 878645 - DNA, 25 bp, Mus musculus
agtggaaagccgagaagggtgacag

SEQ ID NO: 878646 - DNA, 25 bp, Mus musculus
agtggaaagccgtgaagggtgacag

SEQ ID NO: 878647 - DNA, 25 bp, Mus musculus
agtggaaaggcacgtgtccacagcc

SEQ ID NO: 878648 - DNA, 25 bp, Mus musculus
agtggaaaggcaggtgtccacagcc

SEQ ID NO: 878649 - DNA, 25 bp, Mus musculus
agtggaaatagccggtaccactgat

SEQ ID NO: 878650 - DNA, 25 bp, Mus musculus
agtggaaatagcgggtaccactgat

SEQ ID NO: 878651 - DNA, 25 bp, Mus musculus
agtggaaatgccactgctgagacag

SEQ ID NO: 878652 - DNA, 25 bp, Mus musculus
agtggaaatggcactgctgagacag

SEQ ID NO: 878653 - DNA, 25 bp, Mus musculus
agtggaacagatcgctgtagtgcct

SEQ ID NO: 878654 - DNA, 25 bp, Mus musculus
agtggaacagttcgctgtagtgcct

SEQ ID NO: 878655 - DNA, 25 bp, Mus musculus
agtggaactacacgcaaccccaaag

SEQ ID NO: 878656 - DNA, 25 bp, Mus musculus
agtggaactacaggcaaccccaaag

SEQ ID NO: 878657 - DNA, 25 bp, Mus musculus
agtggaactgctaagcaataacatg

SEQ ID NO: 878658 - DNA, 25 bp, Mus musculus
agtggaactggtaagcaataacatg

SEQ ID NO: 878659 - DNA, 25 bp, Mus musculus
agtggaagcaagagtgaaatcaagg

SEQ ID NO: 878660 - DNA, 25 bp, Mus musculus
agtggaagcaagtgtgaaatcaagg

SEQ ID NO: 878661 - DNA, 25 bp, Mus musculus
agtggaagctgttgagtatcttgga

SEQ ID NO: 878662 - DNA, 25 bp, Mus musculus
agtggaagctgttgtgtatcttgga

SEQ ID NO: 878663 - DNA, 25 bp, Mus musculus
agtggacaaagatgagtggataagt

SEQ ID NO: 878664 - DNA, 25 bp, Mus musculus
agtggacaaagatgtgtggataagt

SEQ ID NO: 878665 - DNA, 25 bp, Mus musculus
agtggacgtggtcacgcactggcag

SEQ ID NO: 878666 - DNA, 25 bp, Mus musculus
agtggacgtggtcaggcactggcag

SEQ ID NO: 878667 - DNA, 25 bp, Mus musculus
agtggacttgatccctgctgtctga

SEQ ID NO: 878668 - DNA, 25 bp, Mus musculus
agtggacttgttccctgctgtctga

SEQ ID NO: 878669 - DNA, 25 bp, Mus musculus
agtggagaagaggacgttgtcatcc

SEQ ID NO: 878670 - DNA, 25 bp, Mus musculus
agtggagaagaggaggttgtcatcc

SEQ ID NO: 878671 - DNA, 25 bp, Mus musculus
agtggagacgctcacacctcacgtg

SEQ ID NO: 878672 - DNA, 25 bp, Mus musculus
agtggagacgctcagacctcacgtg

SEQ ID NO: 878673 - DNA, 25 bp, Mus musculus
agtggagcgtggagaccatcttcaa

SEQ ID NO: 878674 - DNA, 25 bp, Mus musculus
agtggagcgtggagtccatcttcaa

SEQ ID NO: 878675 - DNA, 25 bp, Mus musculus
agtggaggagctggtggacatcatg

SEQ ID NO: 878676 - DNA, 25 bp, Mus musculus
agtggaggaggtggtggacatcatg

SEQ ID NO: 878677 - DNA, 25 bp, Mus musculus
agtggaggcaaacgatcgtaagagt

SEQ ID NO: 878678 - DNA, 25 bp, Mus musculus
agtggaggcaaaggatcgtaagagt

SEQ ID NO: 878679 - DNA, 25 bp, Mus musculus
agtggaggcaagatccctttgcggg

SEQ ID NO: 878680 - DNA, 25 bp, Mus musculus
agtggaggcaagatgcctttgcggg

SEQ ID NO: 878681 - DNA, 25 bp, Mus musculus
agtggaggcgcctccgcctcagata

SEQ ID NO: 878682 - DNA, 25 bp, Mus musculus
agtggaggcggctccgcctcagata

SEQ ID NO: 878683 - DNA, 25 bp, Mus musculus
agtggaggtgaacgccaatacatat

SEQ ID NO: 878684 - DNA, 25 bp, Mus musculus
agtggaggtgaaggccaatacatat

SEQ ID NO: 878685 - DNA, 25 bp, Mus musculus
agtggatcagatcatcatggcaaaa

SEQ ID NO: 878686 - DNA, 25 bp, Mus musculus
agtggatcagccactggcccagttc

SEQ ID NO: 878687 - DNA, 25 bp, Mus musculus
agtggatcaggcactggcccagttc

SEQ ID NO: 878688 - DNA, 25 bp, Mus musculus
agtggatcagttcatcatggcaaaa

SEQ ID NO: 878689 - DNA, 25 bp, Mus musculus
agtggatggagacgttcgggcctga

SEQ ID NO: 878690 - DNA, 25 bp, Mus musculus
agtggatggagaggttcgggcctga

SEQ ID NO: 878691 - DNA, 25 bp, Mus musculus
agtggcaagaggaacgctgttgtcc

SEQ ID NO: 878692 - DNA, 25 bp, Mus musculus
agtggcaagaggaaggctgttgtcc

SEQ ID NO: 878693 - DNA, 25 bp, Mus musculus
agtggcaatatgatgccaacccctt

SEQ ID NO: 878694 - DNA, 25 bp, Mus musculus
agtggcaatatgttgccaacccctt

SEQ ID NO: 878695 - DNA, 25 bp, Mus musculus
agtggcacagatgccctaggtctag

SEQ ID NO: 878696 - DNA, 25 bp, Mus musculus
agtggcacagcacgcccgggcgaag

SEQ ID NO: 878697 - DNA, 25 bp, Mus musculus
agtggcacagctctccaccgctatg

SEQ ID NO: 878698 - DNA, 25 bp, Mus musculus
agtggcacaggacgcccgggcgaag

SEQ ID NO: 878699 - DNA, 25 bp, Mus musculus
agtggcacaggtctccaccgctatg

SEQ ID NO: 878700 - DNA, 25 bp, Mus musculus
agtggcacagttgccctaggtctag

SEQ ID NO: 878701 - DNA, 25 bp, Mus musculus
agtggcagagcgataccacactcga

SEQ ID NO: 878702 - DNA, 25 bp, Mus musculus
agtggcagagggataccacactcga

SEQ ID NO: 878703 - DNA, 25 bp, Mus musculus
agtggcagcgcgccacgactgcttc

SEQ ID NO: 878704 - DNA, 25 bp, Mus musculus
agtggcagcgggccacgactgcttc

SEQ ID NO: 878705 - DNA, 25 bp, Mus musculus
agtggcatcgagcaccttgtgaata

SEQ ID NO: 878706 - DNA, 25 bp, Mus musculus
agtggcatcgaggaccttgtgaata

SEQ ID NO: 878707 - DNA, 25 bp, Mus musculus
agtggcatgccacgtgccagtcccg

SEQ ID NO: 878708 - DNA, 25 bp, Mus musculus
agtggcatgccaggtgccagtcccg

SEQ ID NO: 878709 - DNA, 25 bp, Mus musculus
agtggccaagatggctgtcagatat

SEQ ID NO: 878710 - DNA, 25 bp, Mus musculus
agtggccaagctgtcagatataaaa

SEQ ID NO: 878711 - DNA, 25 bp, Mus musculus
agtggccaaggtgtcagatataaaa

SEQ ID NO: 878712 - DNA, 25 bp, Mus musculus
agtggccaagttggctgtcagatat

SEQ ID NO: 878713 - DNA, 25 bp, Mus musculus
agtggccacttgaacgtggacttca

SEQ ID NO: 878714 - DNA, 25 bp, Mus musculus
agtggccacttgaaggtggacttca

SEQ ID NO: 878715 - DNA, 25 bp, Mus musculus
agtggcctcggtcattgaagtgagt

SEQ ID NO: 878716 - DNA, 25 bp, Mus musculus
agtggcctcggtgattgaagtgagt

SEQ ID NO: 878717 - DNA, 25 bp, Mus musculus
agtggcgcagatttactttcaagga

SEQ ID NO: 878718 - DNA, 25 bp, Mus musculus
agtggcgcagcatggcgcagaagaa

SEQ ID NO: 878719 - DNA, 25 bp, Mus musculus
agtggcgcaggatggcgcagaagaa

SEQ ID NO: 878720 - DNA, 25 bp, Mus musculus
agtggcgcagttttactttcaagga

SEQ ID NO: 878721 - DNA, 25 bp, Mus musculus
agtggctcagaggttgattcaggag

SEQ ID NO: 878722 - DNA, 25 bp, Mus musculus
agtggctcagtggttgattcaggag

SEQ ID NO: 878723 - DNA, 25 bp, Mus musculus
agtggctgtatggccatgagaatga

SEQ ID NO: 878724 - DNA, 25 bp, Mus musculus
agtggctgtatggccgcccgtggga

SEQ ID NO: 878725 - DNA, 25 bp, Mus musculus
agtggctgtatggcgatgagaatga

SEQ ID NO: 878726 - DNA, 25 bp, Mus musculus
agtggctgtatggcggcccgtggga

SEQ ID NO: 878727 - DNA, 25 bp, Mus musculus
agtggcttacagtgcaatgggcctg

SEQ ID NO: 878728 - DNA, 25 bp, Mus musculus
agtggcttacagtgcgaagacatgg

SEQ ID NO: 878729 - DNA, 25 bp, Mus musculus
agtggcttacagtggaatgggcctg

SEQ ID NO: 878730 - DNA, 25 bp, Mus musculus
agtggcttacagtgggaagacatgg

SEQ ID NO: 878731 - DNA, 25 bp, Mus musculus
agtggcttccggaacgaactggtga

SEQ ID NO: 878732 - DNA, 25 bp, Mus musculus
agtggcttccggaacgcctctggat

SEQ ID NO: 878733 - DNA, 25 bp, Mus musculus
agtggcttccggaaggaactggtga

SEQ ID NO: 878734 - DNA, 25 bp, Mus musculus
agtggcttccggaaggcctctggat

SEQ ID NO: 878735 - DNA, 25 bp, Mus musculus
agtgggagaacacatccgacgtatc

SEQ ID NO: 878736 - DNA, 25 bp, Mus musculus
agtgggagaacagatccgacgtatc

SEQ ID NO: 878737 - DNA, 25 bp, Mus musculus
agtgggatgccgatgacttccggat

SEQ ID NO: 878738 - DNA, 25 bp, Mus musculus
agtgggatgccgttgacttccggat

SEQ ID NO: 878739 - DNA, 25 bp, Mus musculus
agtgggcagagtatcccagtggcgg

SEQ ID NO: 878740 - DNA, 25 bp, Mus musculus
agtgggcagagtttcccagtggcgg

SEQ ID NO: 878741 - DNA, 25 bp, Mus musculus
agtggggagggcgacgtgctcctaa

SEQ ID NO: 878742 - DNA, 25 bp, Mus musculus
agtggggagggcgaggtgctcctaa

SEQ ID NO: 878743 - DNA, 25 bp, Mus musculus
agtggggcagcaccttgtctttagc

SEQ ID NO: 878744 - DNA, 25 bp, Mus musculus
agtggggcagcagcttgtctttagc

SEQ ID NO: 878745 - DNA, 25 bp, Mus musculus
agtggggcatgactgtaatgttcaa

SEQ ID NO: 878746 - DNA, 25 bp, Mus musculus
agtggggcatgagtgtaatgttcaa

SEQ ID NO: 878747 - DNA, 25 bp, Mus musculus
agtggggcggcccctgcccggatgg

SEQ ID NO: 878748 - DNA, 25 bp, Mus musculus
agtggggcgggccctgcccggatgg

SEQ ID NO: 878749 - DNA, 25 bp, Mus musculus
agtgggggctggccggagttcacag

SEQ ID NO: 878750 - DNA, 25 bp, Mus musculus
agtgggggctgggcggagttcacag

SEQ ID NO: 878751 - DNA, 25 bp, Mus musculus
agtgggtatcaatgcatttggacgc

SEQ ID NO: 878752 - DNA, 25 bp, Mus musculus
agtgggtatcaatggatttggacgc

SEQ ID NO: 878753 - DNA, 25 bp, Mus musculus
agtgggtttctgcatcttgggtctt

SEQ ID NO: 878754 - DNA, 25 bp, Mus musculus
agtgggtttctggatcttgggtctt

SEQ ID NO: 878755 - DNA, 25 bp, Mus musculus
agtggtaaaagtcatatagtcatag

SEQ ID NO: 878756 - DNA, 25 bp, Mus musculus
agtggtaaaagtgatatagtcatag

SEQ ID NO: 878757 - DNA, 25 bp, Mus musculus
agtggtacccagcgtgcaaatacct

SEQ ID NO: 878758 - DNA, 25 bp, Mus musculus
agtggtacccagggtgcaaatacct

SEQ ID NO: 878759 - DNA, 25 bp, Mus musculus
agtggtcgtgctggctttggtggca

SEQ ID NO: 878760 - DNA, 25 bp, Mus musculus
agtggtcgtggtggctttggtggca

SEQ ID NO: 878761 - DNA, 25 bp, Mus musculus
agtggtgctcagaggcagcatggag

SEQ ID NO: 878762 - DNA, 25 bp, Mus musculus
agtggtgctcagccaagatgggcat

SEQ ID NO: 878763 - DNA, 25 bp, Mus musculus
agtggtgctcaggcaagatgggcat

SEQ ID NO: 878764 - DNA, 25 bp, Mus musculus
agtggtgctcagtggcagcatggag

SEQ ID NO: 878765 - DNA, 25 bp, Mus musculus
agtggtggagatccacgacagtgac

SEQ ID NO: 878766 - DNA, 25 bp, Mus musculus
agtggtggagatgcacgacagtgac

SEQ ID NO: 878767 - DNA, 25 bp, Mus musculus
agtggtggagctcagagtcagagtt

SEQ ID NO: 878768 - DNA, 25 bp, Mus musculus
agtggtggagctcagggtagtacaa

SEQ ID NO: 878769 - DNA, 25 bp, Mus musculus
agtggtggaggtcagagtcagagtt

SEQ ID NO: 878770 - DNA, 25 bp, Mus musculus
agtggtggaggtcagggtagtacaa

SEQ ID NO: 878771 - DNA, 25 bp, Mus musculus
agtggtgtcgccattgctagcttgg

SEQ ID NO: 878772 - DNA, 25 bp, Mus musculus
agtggtgtcgctgttgccagtgttg

SEQ ID NO: 878773 - DNA, 25 bp, Mus musculus
agtggtgtcggcattgctagcttgg

SEQ ID NO: 878774 - DNA, 25 bp, Mus musculus
agtggtgtcggtgttgccagtgttg

SEQ ID NO: 878775 - DNA, 25 bp, Mus musculus
agtggtttccaacgtgtgagtactt

SEQ ID NO: 878776 - DNA, 25 bp, Mus musculus
agtggtttccaaggtgtgagtactt

SEQ ID NO: 878777 - DNA, 25 bp, Mus musculus
agtgtaaaagaaagatgatgacata

SEQ ID NO: 878778 - DNA, 25 bp, Mus musculus
agtgtaaaagtaagatgatgacata

SEQ ID NO: 878779 - DNA, 25 bp, Mus musculus
agtgtaacagcgcagaatgtttgca

SEQ ID NO: 878780 - DNA, 25 bp, Mus musculus
agtgtaacagggcagaatgtttgca

SEQ ID NO: 878781 - DNA, 25 bp, Mus musculus
agtgtaaccaaacatgtcgcactgg

SEQ ID NO: 878782 - DNA, 25 bp, Mus musculus
agtgtaaccaaagatgtcgcactgg

SEQ ID NO: 878783 - DNA, 25 bp, Mus musculus
agtgtacaaaaacgtacgtcatcac

SEQ ID NO: 878784 - DNA, 25 bp, Mus musculus
agtgtacaaaaaggtacgtcatcac

SEQ ID NO: 878785 - DNA, 25 bp, Mus musculus
agtgtaccatggctggctgtttgaa

SEQ ID NO: 878786 - DNA, 25 bp, Mus musculus
agtgtaccatgggtggctgtttgaa

SEQ ID NO: 878787 - DNA, 25 bp, Mus musculus
agtgtagtagctctgttcctgcgcc

SEQ ID NO: 878788 - DNA, 25 bp, Mus musculus
agtgtagtaggtctgttcctgcgcc

SEQ ID NO: 878789 - DNA, 25 bp, Mus musculus
agtgtagtggatcacgcactggccc

SEQ ID NO: 878790 - DNA, 25 bp, Mus musculus
agtgtagtggatcaggcactggccc

SEQ ID NO: 878791 - DNA, 25 bp, Mus musculus
agtgtatcagcatgatgctgttgaa

SEQ ID NO: 878792 - DNA, 25 bp, Mus musculus
agtgtatcaggatgatgctgttgaa

SEQ ID NO: 878793 - DNA, 25 bp, Mus musculus
agtgtatgaagacgctggagtcaaa

SEQ ID NO: 878794 - DNA, 25 bp, Mus musculus
agtgtatgaagaggctggagtcaaa

SEQ ID NO: 878795 - DNA, 25 bp, Mus musculus
agtgtatttccaaatgcagaccaca

SEQ ID NO: 878796 - DNA, 25 bp, Mus musculus
agtgtatttccatatgcagaccaca

SEQ ID NO: 878797 - DNA, 25 bp, Mus musculus
agtgtcaagaggatgtctccaagag

SEQ ID NO: 878798 - DNA, 25 bp, Mus musculus
agtgtcaagaggttgtctccaagag

SEQ ID NO: 878799 - DNA, 25 bp, Mus musculus
agtgtcagagcacgccaaccgagca

SEQ ID NO: 878800 - DNA, 25 bp, Mus musculus
agtgtcagagcactcagacagccag

SEQ ID NO: 878801 - DNA, 25 bp, Mus musculus
agtgtcagagcaggccaaccgagca

SEQ ID NO: 878802 - DNA, 25 bp, Mus musculus
agtgtcagaggactcagacagccag

SEQ ID NO: 878803 - DNA, 25 bp, Mus musculus
agtgtcagctgacaaagtgtcctcg

SEQ ID NO: 878804 - DNA, 25 bp, Mus musculus
agtgtcagctgacatagtgtcctcg

SEQ ID NO: 878805 - DNA, 25 bp, Mus musculus
agtgtcagtatgaggtccagtgtga

SEQ ID NO: 878806 - DNA, 25 bp, Mus musculus
agtgtcagtatgtggtccagtgtga

SEQ ID NO: 878807 - DNA, 25 bp, Mus musculus
agtgtcatagcacacatcctggccg

SEQ ID NO: 878808 - DNA, 25 bp, Mus musculus
agtgtcatagcacagatcctggccg

SEQ ID NO: 878809 - DNA, 25 bp, Mus musculus
agtgtcatggccattaccacagtat

SEQ ID NO: 878810 - DNA, 25 bp, Mus musculus
agtgtcatgggcattaccacagtat

SEQ ID NO: 878811 - DNA, 25 bp, Mus musculus
agtgtccagcagcgcagggagggat

SEQ ID NO: 878812 - DNA, 25 bp, Mus musculus
agtgtccagcagggcagggagggat

SEQ ID NO: 878813 - DNA, 25 bp, Mus musculus
agtgtccgtgcatgaccatgtaatt

SEQ ID NO: 878814 - DNA, 25 bp, Mus musculus
agtgtccgtgctgaaccccacagct

SEQ ID NO: 878815 - DNA, 25 bp, Mus musculus
agtgtccgtggatgaccatgtaatt

SEQ ID NO: 878816 - DNA, 25 bp, Mus musculus
agtgtccgtggtgaaccccacagct

SEQ ID NO: 878817 - DNA, 25 bp, Mus musculus
agtgtcctagcacattgtccttctg

SEQ ID NO: 878818 - DNA, 25 bp, Mus musculus
agtgtcctagcagattgtccttctg

SEQ ID NO: 878819 - DNA, 25 bp, Mus musculus
agtgtcctcctgcccaatatgtgaa

SEQ ID NO: 878820 - DNA, 25 bp, Mus musculus
agtgtcctcctggccaatatgtgaa

SEQ ID NO: 878821 - DNA, 25 bp, Mus musculus
agtgtcctgaagaacgtggccgaga

SEQ ID NO: 878822 - DNA, 25 bp, Mus musculus
agtgtcctgaagaaggtggccgaga

SEQ ID NO: 878823 - DNA, 25 bp, Mus musculus
agtgtcgccatgcttatcaccagga

SEQ ID NO: 878824 - DNA, 25 bp, Mus musculus
agtgtcgccatggttatcaccagga

SEQ ID NO: 878825 - DNA, 25 bp, Mus musculus
agtgtctcaattctaatattgtccc

SEQ ID NO: 878826 - DNA, 25 bp, Mus musculus
agtgtctcaattcttatattgtccc

SEQ ID NO: 878827 - DNA, 25 bp, Mus musculus
agtgtctcagaacgttttccaaggc

SEQ ID NO: 878828 - DNA, 25 bp, Mus musculus
agtgtctcagaaggttttccaaggc

SEQ ID NO: 878829 - DNA, 25 bp, Mus musculus
agtgtctcccagcctttgaagggcc

SEQ ID NO: 878830 - DNA, 25 bp, Mus musculus
agtgtctcccaggctttgaagggcc

SEQ ID NO: 878831 - DNA, 25 bp, Mus musculus
agtgtctctgtcctagtcttatctc

SEQ ID NO: 878832 - DNA, 25 bp, Mus musculus
agtgtctctgtcctattgcctttat

SEQ ID NO: 878833 - DNA, 25 bp, Mus musculus
agtgtctctgtccttgtcttatctc

SEQ ID NO: 878834 - DNA, 25 bp, Mus musculus
agtgtctctgtccttttgcctttat

SEQ ID NO: 878835 - DNA, 25 bp, Mus musculus
agtgtgacaaaagaattaaacagga

SEQ ID NO: 878836 - DNA, 25 bp, Mus musculus
agtgtgacaaaagatttaaacagga

SEQ ID NO: 878837 - DNA, 25 bp, Mus musculus
agtgtgacagccctcacgtagtcaa

SEQ ID NO: 878838 - DNA, 25 bp, Mus musculus
agtgtgacaggcctcacgtagtcaa

SEQ ID NO: 878839 - DNA, 25 bp, Mus musculus
agtgtgagctccctgtcctctgctg

SEQ ID NO: 878840 - DNA, 25 bp, Mus musculus
agtgtgagctccgtgtcctctgctg

SEQ ID NO: 878841 - DNA, 25 bp, Mus musculus
agtgtgagttgtcacgtaaagatga

SEQ ID NO: 878842 - DNA, 25 bp, Mus musculus
agtgtgagttgtcaggtaaagatga

SEQ ID NO: 878843 - DNA, 25 bp, Mus musculus
agtgtgataacagtcgccacccttc

SEQ ID NO: 878844 - DNA, 25 bp, Mus musculus
agtgtgataacagtggccacccttc

SEQ ID NO: 878845 - DNA, 25 bp, Mus musculus
agtgtgatcccgaacatcaactcac

SEQ ID NO: 878846 - DNA, 25 bp, Mus musculus
agtgtgatcccgaagatcaactcac

SEQ ID NO: 878847 - DNA, 25 bp, Mus musculus
agtgtgcagaatctctcacagatct

SEQ ID NO: 878848 - DNA, 25 bp, Mus musculus
agtgtgcagaatgtctcacagatct

SEQ ID NO: 878849 - DNA, 25 bp, Mus musculus
agtgtgcctctgcatgcacttccaa

SEQ ID NO: 878850 - DNA, 25 bp, Mus musculus
agtgtgcctctggatgcacttccaa

SEQ ID NO: 878851 - DNA, 25 bp, Mus musculus
agtgtgcggcaacgtgttcaatgct

SEQ ID NO: 878852 - DNA, 25 bp, Mus musculus
agtgtgcggcaaggtgttcaatgct

SEQ ID NO: 878853 - DNA, 25 bp, Mus musculus
agtgtgctctggctgccaacccttg

SEQ ID NO: 878854 - DNA, 25 bp, Mus musculus
agtgtgctctgggtgccaacccttg

SEQ ID NO: 878855 - DNA, 25 bp, Mus musculus
agtgtggaaaagctcttagatcaga

SEQ ID NO: 878856 - DNA, 25 bp, Mus musculus
agtgtggaaaaggtcttagatcaga

SEQ ID NO: 878857 - DNA, 25 bp, Mus musculus
agtgtggaccatcgcggtacctgga

SEQ ID NO: 878858 - DNA, 25 bp, Mus musculus
agtgtggaccatcggggtacctgga

SEQ ID NO: 878859 - DNA, 25 bp, Mus musculus
agtgtggataagcttttggaactga

SEQ ID NO: 878860 - DNA, 25 bp, Mus musculus
agtgtggataaggttttggaactga

SEQ ID NO: 878861 - DNA, 25 bp, Mus musculus
agtgtggtgccacgactggatccca

SEQ ID NO: 878862 - DNA, 25 bp, Mus musculus
agtgtggtgccaggactggatccca

SEQ ID NO: 878863 - DNA, 25 bp, Mus musculus
agtgtggtggagctcaccagtcccg

SEQ ID NO: 878864 - DNA, 25 bp, Mus musculus
agtgtggtggaggtcaccagtcccg

SEQ ID NO: 878865 - DNA, 25 bp, Mus musculus
agtgtgtcccagatttccagaatat

SEQ ID NO: 878866 - DNA, 25 bp, Mus musculus
agtgtgtcccagttttccagaatat

SEQ ID NO: 878867 - DNA, 25 bp, Mus musculus
agtgtgtgcaaaaaatccgagagga

SEQ ID NO: 878868 - DNA, 25 bp, Mus musculus
agtgtgtgcaaataatccgagagga

SEQ ID NO: 878869 - DNA, 25 bp, Mus musculus
agtgtgtgcagccgggagagttaga

SEQ ID NO: 878870 - DNA, 25 bp, Mus musculus
agtgtgtgcagcggggagagttaga

SEQ ID NO: 878871 - DNA, 25 bp, Mus musculus
agtgtgtgtttggacaacccagatt

SEQ ID NO: 878872 - DNA, 25 bp, Mus musculus
agtgtgtgtttggagaacccagatt

SEQ ID NO: 878873 - DNA, 25 bp, Mus musculus
agtgtgttaacccaaatttacggat

SEQ ID NO: 878874 - DNA, 25 bp, Mus musculus
agtgtgttaactattttggaaatat

SEQ ID NO: 878875 - DNA, 25 bp, Mus musculus
agtgtgttaagccaaatttacggat

SEQ ID NO: 878876 - DNA, 25 bp, Mus musculus
agtgtgttaagtattttggaaatat

SEQ ID NO: 878877 - DNA, 25 bp, Mus musculus
agtgtgttataacgaatgcccacaa

SEQ ID NO: 878878 - DNA, 25 bp, Mus musculus
agtgtgttataaggaatgcccacaa

SEQ ID NO: 878879 - DNA, 25 bp, Mus musculus
agtgttaaagggccgatgggcgcca

SEQ ID NO: 878880 - DNA, 25 bp, Mus musculus
agtgttaaaggggcgatgggcgcca

SEQ ID NO: 878881 - DNA, 25 bp, Mus musculus
agtgttagaacacatcccagaaatc

SEQ ID NO: 878882 - DNA, 25 bp, Mus musculus
agtgttagaacagatcccagaaatc

SEQ ID NO: 878883 - DNA, 25 bp, Mus musculus
agtgttatgaattgattccacggga

SEQ ID NO: 878884 - DNA, 25 bp, Mus musculus
agtgttatgatttgattccacggga

SEQ ID NO: 878885 - DNA, 25 bp, Mus musculus
agtgttcaagcctgctgctgtccct

SEQ ID NO: 878886 - DNA, 25 bp, Mus musculus
agtgttcaagcgtctcttgtggtac

SEQ ID NO: 878887 - DNA, 25 bp, Mus musculus
agtgttcaaggctgctgctgtccct

SEQ ID NO: 878888 - DNA, 25 bp, Mus musculus
agtgttcaagggtctcttgtggtac

SEQ ID NO: 878889 - DNA, 25 bp, Mus musculus
agtgttctgatctgcgtttggacaa

SEQ ID NO: 878890 - DNA, 25 bp, Mus musculus
agtgttctgatctgggtttggacaa

SEQ ID NO: 878891 - DNA, 25 bp, Mus musculus
agtgttgaatctcagaattatatcc

SEQ ID NO: 878892 - DNA, 25 bp, Mus musculus
agtgttgaatctgagaattatatcc

SEQ ID NO: 878893 - DNA, 25 bp, Mus musculus
agtgttgctaagcacaaggcctgta

SEQ ID NO: 878894 - DNA, 25 bp, Mus musculus
agtgttgctaaggacaaggcctgta

SEQ ID NO: 878895 - DNA, 25 bp, Mus musculus
agtgttggacagattgtaggtgaag

SEQ ID NO: 878896 - DNA, 25 bp, Mus musculus
agtgttggacagtttgtaggtgaag

SEQ ID NO: 878897 - DNA, 25 bp, Mus musculus
agtgttggattgatcggggcagaga

SEQ ID NO: 878898 - DNA, 25 bp, Mus musculus
agtgttggattgttcggggcagaga

SEQ ID NO: 878899 - DNA, 25 bp, Mus musculus
agtgttgggccccacggctatggaa

SEQ ID NO: 878900 - DNA, 25 bp, Mus musculus
agtgttgggccccagggctatggaa

SEQ ID NO: 878901 - DNA, 25 bp, Mus musculus
agtgtttaagccactggaaccaggg

SEQ ID NO: 878902 - DNA, 25 bp, Mus musculus
agtgtttaaggcactggaaccaggg

SEQ ID NO: 878903 - DNA, 25 bp, Mus musculus
agtgtttaataaagtagattatgaa

SEQ ID NO: 878904 - DNA, 25 bp, Mus musculus
agtgtttaataatgtagattatgaa

SEQ ID NO: 878905 - DNA, 25 bp, Mus musculus
agtgtttcggccagcagtcctactg

SEQ ID NO: 878906 - DNA, 25 bp, Mus musculus
agtgtttcggccaggagtcctactg

SEQ ID NO: 878907 - DNA, 25 bp, Mus musculus
agtgtttctgcaaacaacagaacag

SEQ ID NO: 878908 - DNA, 25 bp, Mus musculus
agtgtttctgcaaagaacagaacag

SEQ ID NO: 878909 - DNA, 25 bp, Mus musculus
agtgtttctgctgacgagagcaatg

SEQ ID NO: 878910 - DNA, 25 bp, Mus musculus
agtgtttctgctgaggagagcaatg

SEQ ID NO: 878911 - DNA, 25 bp, Mus musculus
agtgtttgacaacgatgggaatggt

SEQ ID NO: 878912 - DNA, 25 bp, Mus musculus
agtgtttgacaaggatgggaatggt

SEQ ID NO: 878913 - DNA, 25 bp, Mus musculus
agtgtttggacgctgtgccggactc

SEQ ID NO: 878914 - DNA, 25 bp, Mus musculus
agtgtttggacggtgtgccggactc

SEQ ID NO: 878915 - DNA, 25 bp, Mus musculus
agtgttttagagcgagtcctaatac

SEQ ID NO: 878916 - DNA, 25 bp, Mus musculus
agtgttttagtgcgagtcctaatac

SEQ ID NO: 878917 - DNA, 25 bp, Mus musculus
agtgtttttgcacaatgtgtgctgt

SEQ ID NO: 878918 - DNA, 25 bp, Mus musculus
agtgtttttgcagaatgtgtgctgt

SEQ ID NO: 878919 - DNA, 25 bp, Mus musculus
agttaaaaagaggaatgcagtggcc

SEQ ID NO: 878920 - DNA, 25 bp, Mus musculus
agttaaaaagtggaatgcagtggcc

SEQ ID NO: 878921 - DNA, 25 bp, Mus musculus
agttaaaacagacgcgtgtgacagg

SEQ ID NO: 878922 - DNA, 25 bp, Mus musculus
agttaaaacagaggcgtgtgacagg

SEQ ID NO: 878923 - DNA, 25 bp, Mus musculus
agttaaatgtgaatttgaacacaag

SEQ ID NO: 878924 - DNA, 25 bp, Mus musculus
agttaaatgtgattttgaacacaag

SEQ ID NO: 878925 - DNA, 25 bp, Mus musculus
agttaaccagagctgagcctaccac

SEQ ID NO: 878926 - DNA, 25 bp, Mus musculus
agttaaccagtgctgagcctaccac

SEQ ID NO: 878927 - DNA, 25 bp, Mus musculus
agttaactggcaaggattttcacca

SEQ ID NO: 878928 - DNA, 25 bp, Mus musculus
agttaactggcatggattttcacca

SEQ ID NO: 878929 - DNA, 25 bp, Mus musculus
agttaaggaacacgctttcatgctg

SEQ ID NO: 878930 - DNA, 25 bp, Mus musculus
agttaaggaacaggctttcatgctg

SEQ ID NO: 878931 - DNA, 25 bp, Mus musculus
agttaagtagacttttcacagagcc

SEQ ID NO: 878932 - DNA, 25 bp, Mus musculus
agttaagtagtcttttcacagagcc

SEQ ID NO: 878933 - DNA, 25 bp, Mus musculus
agttaatcagaacggctgttatgat

SEQ ID NO: 878934 - DNA, 25 bp, Mus musculus
agttaatcagaagggctgttatgat

SEQ ID NO: 878935 - DNA, 25 bp, Mus musculus
agttaatcttctctcctcgaagata

SEQ ID NO: 878936 - DNA, 25 bp, Mus musculus
agttaatcttctctcttctcacagg

SEQ ID NO: 878937 - DNA, 25 bp, Mus musculus
agttaatcttctttgagtcttcaga

SEQ ID NO: 878938 - DNA, 25 bp, Mus musculus
agttaatcttgtctcctcgaagata

SEQ ID NO: 878939 - DNA, 25 bp, Mus musculus
agttaatcttgtctcttctcacagg

SEQ ID NO: 878940 - DNA, 25 bp, Mus musculus
agttaatcttgtttgagtcttcaga

SEQ ID NO: 878941 - DNA, 25 bp, Mus musculus
agttacacagatgccctaaactaga

SEQ ID NO: 878942 - DNA, 25 bp, Mus musculus
agttacacagttgccctaaactaga

SEQ ID NO: 878943 - DNA, 25 bp, Mus musculus
agttacaccaagattctgggctaat

SEQ ID NO: 878944 - DNA, 25 bp, Mus musculus
agttacaccaagtttctgggctaat

SEQ ID NO: 878945 - DNA, 25 bp, Mus musculus
agttacgtagctctggtcagctacc

SEQ ID NO: 878946 - DNA, 25 bp, Mus musculus
agttacgtaggtctggtcagctacc

SEQ ID NO: 878947 - DNA, 25 bp, Mus musculus
agttacttagtgcagagaacagata

SEQ ID NO: 878948 - DNA, 25 bp, Mus musculus
agttacttagtgctgagacgtggaa

SEQ ID NO: 878949 - DNA, 25 bp, Mus musculus
agttacttagtggagagaacagata

SEQ ID NO: 878950 - DNA, 25 bp, Mus musculus
agttacttagtggtgagacgtggaa

SEQ ID NO: 878951 - DNA, 25 bp, Mus musculus
agttagaccatgaggtgaccatcat

SEQ ID NO: 878952 - DNA, 25 bp, Mus musculus
agttagaccatgccacccgatggcc

SEQ ID NO: 878953 - DNA, 25 bp, Mus musculus
agttagaccatggcacccgatggcc

SEQ ID NO: 878954 - DNA, 25 bp, Mus musculus
agttagaccatgtggtgaccatcat

SEQ ID NO: 878955 - DNA, 25 bp, Mus musculus
agttagagtaattacgcaacaggtt

SEQ ID NO: 878956 - DNA, 25 bp, Mus musculus
agttagagtaattaggcaacaggtt

SEQ ID NO: 878957 - DNA, 25 bp, Mus musculus
agttagcaagaaacatccatggggt

SEQ ID NO: 878958 - DNA, 25 bp, Mus musculus
agttagcaagaagaaacatccatgg

SEQ ID NO: 878959 - DNA, 25 bp, Mus musculus
agttagcaagtaacatccatggggt

SEQ ID NO: 878960 - DNA, 25 bp, Mus musculus
agttagcaagtagaaacatccatgg

SEQ ID NO: 878961 - DNA, 25 bp, Mus musculus
agttagcagtcaaactcagcaacag

SEQ ID NO: 878962 - DNA, 25 bp, Mus musculus
agttagcagtcaatatatggactaa

SEQ ID NO: 878963 - DNA, 25 bp, Mus musculus
agttagcagtcatactcagcaacag

SEQ ID NO: 878964 - DNA, 25 bp, Mus musculus
agttagcagtcattatatggactaa

SEQ ID NO: 878965 - DNA, 25 bp, Mus musculus
agttagccagaatggagaatggagt

SEQ ID NO: 878966 - DNA, 25 bp, Mus musculus
agttagccagtatggagaatggagt

SEQ ID NO: 878967 - DNA, 25 bp, Mus musculus
agttaggtgatccacgttttgtggt

SEQ ID NO: 878968 - DNA, 25 bp, Mus musculus
agttaggtgatccaggttttgtggt

SEQ ID NO: 878969 - DNA, 25 bp, Mus musculus
agttagtgagcacatgtgcatgaag

SEQ ID NO: 878970 - DNA, 25 bp, Mus musculus
agttagtgaggacatgtgcatgaag

SEQ ID NO: 878971 - DNA, 25 bp, Mus musculus
agttatcaaagacgatgtctcggaa

SEQ ID NO: 878972 - DNA, 25 bp, Mus musculus
agttatcaaagaggatgtctcggaa

SEQ ID NO: 878973 - DNA, 25 bp, Mus musculus
agttatgatgagcccaagcacgtga

SEQ ID NO: 878974 - DNA, 25 bp, Mus musculus
agttatgatgaggccaagcacgtga

SEQ ID NO: 878975 - DNA, 25 bp, Mus musculus
agttatgcagaacttgtcacaaacg

SEQ ID NO: 878976 - DNA, 25 bp, Mus musculus
agttatgcagtacttgtcacaaacg

SEQ ID NO: 878977 - DNA, 25 bp, Mus musculus
agttatttagacaagatcctgaggg

SEQ ID NO: 878978 - DNA, 25 bp, Mus musculus
agttatttagtcaagatcctgaggg

SEQ ID NO: 878979 - DNA, 25 bp, Mus musculus
agttcaaacatccacgtggctctgg

SEQ ID NO: 878980 - DNA, 25 bp, Mus musculus
agttcaaacatccaggtggctctgg

SEQ ID NO: 878981 - DNA, 25 bp, Mus musculus
agttcaaatgagacatcctatgagt

SEQ ID NO: 878982 - DNA, 25 bp, Mus musculus
agttcaaatgtgacatcctatgagt

SEQ ID NO: 878983 - DNA, 25 bp, Mus musculus
agttcaagagcaagaaatgcccccg

SEQ ID NO: 878984 - DNA, 25 bp, Mus musculus
agttcaagagcacacaatgtaggaa

SEQ ID NO: 878985 - DNA, 25 bp, Mus musculus
agttcaagaggaagaaatgcccccg

SEQ ID NO: 878986 - DNA, 25 bp, Mus musculus
agttcaagaggacacaatgtaggaa

SEQ ID NO: 878987 - DNA, 25 bp, Mus musculus
agttcaagcgagccaagtcccacct

SEQ ID NO: 878988 - DNA, 25 bp, Mus musculus
agttcaagcgaggcaagtcccacct

SEQ ID NO: 878989 - DNA, 25 bp, Mus musculus
agttcaatgaggcacagattgcccc

SEQ ID NO: 878990 - DNA, 25 bp, Mus musculus
agttcaatgagggacagattgcccc

SEQ ID NO: 878991 - DNA, 25 bp, Mus musculus
agttcacaagataaccaacaaccag

SEQ ID NO: 878992 - DNA, 25 bp, Mus musculus
agttcacaagcaatgtatcattgat

SEQ ID NO: 878993 - DNA, 25 bp, Mus musculus
agttcacaagctggttcatgggacg

SEQ ID NO: 878994 - DNA, 25 bp, Mus musculus
agttcacaaggaatgtatcattgat

SEQ ID NO: 878995 - DNA, 25 bp, Mus musculus
agttcacaaggtggttcatgggacg

SEQ ID NO: 878996 - DNA, 25 bp, Mus musculus
agttcacaagttaaccaacaaccag

SEQ ID NO: 878997 - DNA, 25 bp, Mus musculus
agttcacccgagtcccctgagggat

SEQ ID NO: 878998 - DNA, 25 bp, Mus musculus
agttcacccgagtcgcctgagggat

SEQ ID NO: 878999 - DNA, 25 bp, Mus musculus
agttcactctagagtcttttattca

SEQ ID NO: 879000 - DNA, 25 bp, Mus musculus
agttcactctagtgtcttttattca

SEQ ID NO: 879001 - DNA, 25 bp, Mus musculus
agttcacttgcacgtgttgtttgtg

SEQ ID NO: 879002 - DNA, 25 bp, Mus musculus
agttcacttgcactcgagcaaaaga

SEQ ID NO: 879003 - DNA, 25 bp, Mus musculus
agttcacttgcaggtgttgtttgtg

SEQ ID NO: 879004 - DNA, 25 bp, Mus musculus
agttcacttgcagtcgagcaaaaga

SEQ ID NO: 879005 - DNA, 25 bp, Mus musculus
agttcagaagagcatgactgagtgg

SEQ ID NO: 879006 - DNA, 25 bp, Mus musculus
agttcagaagaggatgactgagtgg

SEQ ID NO: 879007 - DNA, 25 bp, Mus musculus
agttcagaccagaaatgctccaggg

SEQ ID NO: 879008 - DNA, 25 bp, Mus musculus
agttcagaccagtaatgctccaggg

SEQ ID NO: 879009 - DNA, 25 bp, Mus musculus
agttcagcacaaatttcacaggctg

SEQ ID NO: 879010 - DNA, 25 bp, Mus musculus
agttcagcacaattttcacaggctg

SEQ ID NO: 879011 - DNA, 25 bp, Mus musculus
agttcagcagcctgcagcagggcaa

SEQ ID NO: 879012 - DNA, 25 bp, Mus musculus
agttcagcagcgcacctacgcccgg

SEQ ID NO: 879013 - DNA, 25 bp, Mus musculus
agttcagcaggctgcagcagggcaa

SEQ ID NO: 879014 - DNA, 25 bp, Mus musculus
agttcagcagggcacctacgcccgg

SEQ ID NO: 879015 - DNA, 25 bp, Mus musculus
agttcagtagctatgagccagaatt

SEQ ID NO: 879016 - DNA, 25 bp, Mus musculus
agttcagtaggtatgagccagaatt

SEQ ID NO: 879017 - DNA, 25 bp, Mus musculus
agttcataacagatctcagcgactc

SEQ ID NO: 879018 - DNA, 25 bp, Mus musculus
agttcataacagttctcagcgactc

SEQ ID NO: 879019 - DNA, 25 bp, Mus musculus
agttcatcagaggagaaatgggtct

SEQ ID NO: 879020 - DNA, 25 bp, Mus musculus
agttcatcagtggagaaatgggtct

SEQ ID NO: 879021 - DNA, 25 bp, Mus musculus
agttcatccgacagaagcgccgtgg

SEQ ID NO: 879022 - DNA, 25 bp, Mus musculus
agttcatccgactgaagcgccgtgg

SEQ ID NO: 879023 - DNA, 25 bp, Mus musculus
agttcatccgagagctgcagcaatt

SEQ ID NO: 879024 - DNA, 25 bp, Mus musculus
agttcatccgagtgctgcagcaatt

SEQ ID NO: 879025 - DNA, 25 bp, Mus musculus
agttcatcgtcagacggtggctgca

SEQ ID NO: 879026 - DNA, 25 bp, Mus musculus
agttcatcgtcagagggtggctgca

SEQ ID NO: 879027 - DNA, 25 bp, Mus musculus
agttcatcttagcacaggagcagtt

SEQ ID NO: 879028 - DNA, 25 bp, Mus musculus
agttcatcttagcagaggagcagtt

SEQ ID NO: 879029 - DNA, 25 bp, Mus musculus
agttcatgacaactgggccaatccg

SEQ ID NO: 879030 - DNA, 25 bp, Mus musculus
agttcatgacaagtgggccaatccg

SEQ ID NO: 879031 - DNA, 25 bp, Mus musculus
agttcattgcagagtccggcgggcc

SEQ ID NO: 879032 - DNA, 25 bp, Mus musculus
agttcattgcagtgtccggcgggcc

SEQ ID NO: 879033 - DNA, 25 bp, Mus musculus
agttccaacaatccccaaagccagc

SEQ ID NO: 879034 - DNA, 25 bp, Mus musculus
agttccaacattccccaaagccagc

SEQ ID NO: 879035 - DNA, 25 bp, Mus musculus
agttccaagaaacgtgcttacagac

SEQ ID NO: 879036 - DNA, 25 bp, Mus musculus
agttccaagaaaggtgcttacagac

SEQ ID NO: 879037 - DNA, 25 bp, Mus musculus
agttccaagatgactacttagtgat

SEQ ID NO: 879038 - DNA, 25 bp, Mus musculus
agttccaagatgtctacttagtgat

SEQ ID NO: 879039 - DNA, 25 bp, Mus musculus
agttccacggccacacggtgaatct

SEQ ID NO: 879040 - DNA, 25 bp, Mus musculus
agttccacgggcacacggtgaatct

SEQ ID NO: 879041 - DNA, 25 bp, Mus musculus
agttccagaactatgggcattagga

SEQ ID NO: 879042 - DNA, 25 bp, Mus musculus
agttccagaagtatgggcattagga

SEQ ID NO: 879043 - DNA, 25 bp, Mus musculus
agttccagaagtcatccagactctc

SEQ ID NO: 879044 - DNA, 25 bp, Mus musculus
agttccagaagtgatccagactctc

SEQ ID NO: 879045 - DNA, 25 bp, Mus musculus
agttccagagcttgttcaaacatga

SEQ ID NO: 879046 - DNA, 25 bp, Mus musculus
agttccagaggttgttcaaacatga

SEQ ID NO: 879047 - DNA, 25 bp, Mus musculus
agttccagggagacagacacagaca

SEQ ID NO: 879048 - DNA, 25 bp, Mus musculus
agttccagggagactgacacagaca

SEQ ID NO: 879049 - DNA, 25 bp, Mus musculus
agttccatcaacaacgactggtgga

SEQ ID NO: 879050 - DNA, 25 bp, Mus musculus
agttccatcaacaaggactggtgga

SEQ ID NO: 879051 - DNA, 25 bp, Mus musculus
agttcccaagaaccattcatttctg

SEQ ID NO: 879052 - DNA, 25 bp, Mus musculus
agttcccaagaagcattcatttctg

SEQ ID NO: 879053 - DNA, 25 bp, Mus musculus
agttcccaagatatttcacagctta

SEQ ID NO: 879054 - DNA, 25 bp, Mus musculus
agttcccaagcatgaacagggctct

SEQ ID NO: 879055 - DNA, 25 bp, Mus musculus
agttcccaaggatgaacagggctct

SEQ ID NO: 879056 - DNA, 25 bp, Mus musculus
agttcccaagttatttcacagctta

SEQ ID NO: 879057 - DNA, 25 bp, Mus musculus
agttcccactggcgctgaagtggag

SEQ ID NO: 879058 - DNA, 25 bp, Mus musculus
agttcccactggggctgaagtggag

SEQ ID NO: 879059 - DNA, 25 bp, Mus musculus
agttcccagatccggctcacgctaa

SEQ ID NO: 879060 - DNA, 25 bp, Mus musculus
agttcccagatcgggctcacgctaa

SEQ ID NO: 879061 - DNA, 25 bp, Mus musculus
agttcccatgttcttgctggttgtt

SEQ ID NO: 879062 - DNA, 25 bp, Mus musculus
agttcccatgttgttgctggttgtt

SEQ ID NO: 879063 - DNA, 25 bp, Mus musculus
agttccgaaagaagtggaataagtg

SEQ ID NO: 879064 - DNA, 25 bp, Mus musculus
agttccgaaagatgtggaataagtg

SEQ ID NO: 879065 - DNA, 25 bp, Mus musculus
agttccgacatgcatatagtgacct

SEQ ID NO: 879066 - DNA, 25 bp, Mus musculus
agttccgacatggatatagtgacct

SEQ ID NO: 879067 - DNA, 25 bp, Mus musculus
agttccgcagcctcagggaagaccc

SEQ ID NO: 879068 - DNA, 25 bp, Mus musculus
agttccgcaggctcagggaagaccc

SEQ ID NO: 879069 - DNA, 25 bp, Mus musculus
agttccggtcattacgttcaaccag

SEQ ID NO: 879070 - DNA, 25 bp, Mus musculus
agttccggtcattaggttcaaccag

SEQ ID NO: 879071 - DNA, 25 bp, Mus musculus
agttcctaccagatcctgaatacct

SEQ ID NO: 879072 - DNA, 25 bp, Mus musculus
agttcctaccagttcctgaatacct

SEQ ID NO: 879073 - DNA, 25 bp, Mus musculus
agttcctgagcggcatcccagagac

SEQ ID NO: 879074 - DNA, 25 bp, Mus musculus
agttcctgaggggcatcccagagac

SEQ ID NO: 879075 - DNA, 25 bp, Mus musculus
agttcctgcctggacgggacatgat

SEQ ID NO: 879076 - DNA, 25 bp, Mus musculus
agttcctgcctggaggggacatgat

SEQ ID NO: 879077 - DNA, 25 bp, Mus musculus
agttcctgcgcaaacggatcagtgg

SEQ ID NO: 879078 - DNA, 25 bp, Mus musculus
agttcctgcgcaaagggatcagtgg

SEQ ID NO: 879079 - DNA, 25 bp, Mus musculus
agttcgaatacccgcatgtcatgtt

SEQ ID NO: 879080 - DNA, 25 bp, Mus musculus
agttcgaataccggcatgtcatgtt

SEQ ID NO: 879081 - DNA, 25 bp, Mus musculus
agttcgacgccttaaaagatgatga

SEQ ID NO: 879082 - DNA, 25 bp, Mus musculus
agttcgacgcgttaaaagatgatga

SEQ ID NO: 879083 - DNA, 25 bp, Mus musculus
agttcgcagaacagaaactggacgc

SEQ ID NO: 879084 - DNA, 25 bp, Mus musculus
agttcgcagatcagaaactggacgc

SEQ ID NO: 879085 - DNA, 25 bp, Mus musculus
agttcggattaacatccttgccact

SEQ ID NO: 879086 - DNA, 25 bp, Mus musculus
agttcggattaagatccttgccact

SEQ ID NO: 879087 - DNA, 25 bp, Mus musculus
agttcggccagacgattactcactg

SEQ ID NO: 879088 - DNA, 25 bp, Mus musculus
agttcggccagaggattactcactg

SEQ ID NO: 879089 - DNA, 25 bp, Mus musculus
agttcgggtttaccctgccatatgt

SEQ ID NO: 879090 - DNA, 25 bp, Mus musculus
agttcgggtttagcctgccatatgt

SEQ ID NO: 879091 - DNA, 25 bp, Mus musculus
agttcgtagaagtgctgattgaagg

SEQ ID NO: 879092 - DNA, 25 bp, Mus musculus
agttcgtagaagtggtgattgaagg

SEQ ID NO: 879093 - DNA, 25 bp, Mus musculus
agttcgtggaagccaagaagaaata

SEQ ID NO: 879094 - DNA, 25 bp, Mus musculus
agttcgtggaagcggaagacagcgc

SEQ ID NO: 879095 - DNA, 25 bp, Mus musculus
agttcgtggaaggcaagaagaaata

SEQ ID NO: 879096 - DNA, 25 bp, Mus musculus
agttcgtggaaggggaagacagcgc

SEQ ID NO: 879097 - DNA, 25 bp, Mus musculus
agttctacagccctgagaataccca

SEQ ID NO: 879098 - DNA, 25 bp, Mus musculus
agttctacagcctgccacaggtgta

SEQ ID NO: 879099 - DNA, 25 bp, Mus musculus
agttctacaggcctgagaataccca

SEQ ID NO: 879100 - DNA, 25 bp, Mus musculus
agttctacaggctgccacaggtgta

SEQ ID NO: 879101 - DNA, 25 bp, Mus musculus
agttctaccactcgaccctctcctt

SEQ ID NO: 879102 - DNA, 25 bp, Mus musculus
agttctaccactggaccctctcctt

SEQ ID NO: 879103 - DNA, 25 bp, Mus musculus
agttctaccgcactggctgggcact

SEQ ID NO: 879104 - DNA, 25 bp, Mus musculus
agttctaccgcagtggctgggcact

SEQ ID NO: 879105 - DNA, 25 bp, Mus musculus
agttctatagttcacgcatctacta

SEQ ID NO: 879106 - DNA, 25 bp, Mus musculus
agttctatagttcaggcatctacta

SEQ ID NO: 879107 - DNA, 25 bp, Mus musculus
agttctatcatacccggacagaaga

SEQ ID NO: 879108 - DNA, 25 bp, Mus musculus
agttctatcataccgggacagaaga

SEQ ID NO: 879109 - DNA, 25 bp, Mus musculus
agttctcacaagcgataagcgtctt

SEQ ID NO: 879110 - DNA, 25 bp, Mus musculus
agttctcacaagggataagcgtctt

SEQ ID NO: 879111 - DNA, 25 bp, Mus musculus
agttctcacaggacatgaaggcacc

SEQ ID NO: 879112 - DNA, 25 bp, Mus musculus
agttctcacaggtcatgaaggcacc

SEQ ID NO: 879113 - DNA, 25 bp, Mus musculus
agttctcatgcacgcctatcgctgg

SEQ ID NO: 879114 - DNA, 25 bp, Mus musculus
agttctcatgcaggcctatcgctgg

SEQ ID NO: 879115 - DNA, 25 bp, Mus musculus
agttctcgcctgatcattttttggg

SEQ ID NO: 879116 - DNA, 25 bp, Mus musculus
agttctcgcctgatgattttttggg

SEQ ID NO: 879117 - DNA, 25 bp, Mus musculus
agttctctgacacgaatgaatttca

SEQ ID NO: 879118 - DNA, 25 bp, Mus musculus
agttctctgacaggaatgaatttca

SEQ ID NO: 879119 - DNA, 25 bp, Mus musculus
agttctgactgccacatttacattg

SEQ ID NO: 879120 - DNA, 25 bp, Mus musculus
agttctgactgccgttgaaatgggc

SEQ ID NO: 879121 - DNA, 25 bp, Mus musculus
agttctgactgcgacatttacattg

SEQ ID NO: 879122 - DNA, 25 bp, Mus musculus
agttctgactgcggttgaaatgggc

SEQ ID NO: 879123 - DNA, 25 bp, Mus musculus
agttctggcacacgttgcgagttgt

SEQ ID NO: 879124 - DNA, 25 bp, Mus musculus
agttctggcacaggttgcgagttgt

SEQ ID NO: 879125 - DNA, 25 bp, Mus musculus
agttctgggaccgcaatgtgctcag

SEQ ID NO: 879126 - DNA, 25 bp, Mus musculus
agttctgggagcgcaatgtgctcag

SEQ ID NO: 879127 - DNA, 25 bp, Mus musculus
agttctgtttaccacgaagccatga

SEQ ID NO: 879128 - DNA, 25 bp, Mus musculus
agttctgtttaccaggaagccatga

SEQ ID NO: 879129 - DNA, 25 bp, Mus musculus
agttcttcagagctgagcctaccac

SEQ ID NO: 879130 - DNA, 25 bp, Mus musculus
agttcttcagtgctgagcctaccac

SEQ ID NO: 879131 - DNA, 25 bp, Mus musculus
agttcttcccgtagatgccaccggc

SEQ ID NO: 879132 - DNA, 25 bp, Mus musculus
agttcttcccgttgatgccaccggc

SEQ ID NO: 879133 - DNA, 25 bp, Mus musculus
agttcttcctaccgagatggctcgt

SEQ ID NO: 879134 - DNA, 25 bp, Mus musculus
agttcttcctacggagatggctcgt

SEQ ID NO: 879135 - DNA, 25 bp, Mus musculus
agttcttggacggacatgcctggac

SEQ ID NO: 879136 - DNA, 25 bp, Mus musculus
agttcttggacggagatgcctggac

SEQ ID NO: 879137 - DNA, 25 bp, Mus musculus
agttctttcgatgcggaatataagc

SEQ ID NO: 879138 - DNA, 25 bp, Mus musculus
agttctttcgttgcggaatataagc

SEQ ID NO: 879139 - DNA, 25 bp, Mus musculus
agttctttctgacgtgtcagatgcc

SEQ ID NO: 879140 - DNA, 25 bp, Mus musculus
agttctttctgaggtgtcagatgcc

SEQ ID NO: 879141 - DNA, 25 bp, Mus musculus
agttgaccccagcccctgcaggtcg

SEQ ID NO: 879142 - DNA, 25 bp, Mus musculus
agttgaccccaggccctgcaggtcg

SEQ ID NO: 879143 - DNA, 25 bp, Mus musculus
agttgagaaaaacattgaagaccca

SEQ ID NO: 879144 - DNA, 25 bp, Mus musculus
agttgagaaaaagattgaagaccca

SEQ ID NO: 879145 - DNA, 25 bp, Mus musculus
agttgagtctgcagcgtaggtttgg

SEQ ID NO: 879146 - DNA, 25 bp, Mus musculus
agttgagtctgcagcgtttggcatg

SEQ ID NO: 879147 - DNA, 25 bp, Mus musculus
agttgagtctgcagggtaggtttgg

SEQ ID NO: 879148 - DNA, 25 bp, Mus musculus
agttgagtctgcagggtttggcatg

SEQ ID NO: 879149 - DNA, 25 bp, Mus musculus
agttgatgagcaagatgctgccctt

SEQ ID NO: 879150 - DNA, 25 bp, Mus musculus
agttgatgaggaagatgctgccctt

SEQ ID NO: 879151 - DNA, 25 bp, Mus musculus
agttgatgcgttcgaccccagcagc

SEQ ID NO: 879152 - DNA, 25 bp, Mus musculus
agttgatgcgttggaccccagcagc

SEQ ID NO: 879153 - DNA, 25 bp, Mus musculus
agttgatgtgatagagaaaaggaaa

SEQ ID NO: 879154 - DNA, 25 bp, Mus musculus
agttgatgtgttagagaaaaggaaa

SEQ ID NO: 879155 - DNA, 25 bp, Mus musculus
agttgcatagacgtggatgagtgtg

SEQ ID NO: 879156 - DNA, 25 bp, Mus musculus
agttgcatagtcgtggatgagtgtg

SEQ ID NO: 879157 - DNA, 25 bp, Mus musculus
agttgccaaaaacatgaaaacataa

SEQ ID NO: 879158 - DNA, 25 bp, Mus musculus
agttgccaaaaagatgaaaacataa

SEQ ID NO: 879159 - DNA, 25 bp, Mus musculus
agttgccaagcatgtggatttggag

SEQ ID NO: 879160 - DNA, 25 bp, Mus musculus
agttgccaaggatgtggatttggag

SEQ ID NO: 879161 - DNA, 25 bp, Mus musculus
agttgcccagactgcgctctctggc

SEQ ID NO: 879162 - DNA, 25 bp, Mus musculus
agttgcccagtctgcgctctctggc

SEQ ID NO: 879163 - DNA, 25 bp, Mus musculus
agttgcctcaaacaaggtgctcatg

SEQ ID NO: 879164 - DNA, 25 bp, Mus musculus
agttgcctcaaacatggtgctcatg

SEQ ID NO: 879165 - DNA, 25 bp, Mus musculus
agttgcctcggactttcagcctcaa

SEQ ID NO: 879166 - DNA, 25 bp, Mus musculus
agttgcctcggagtttcagcctcaa

SEQ ID NO: 879167 - DNA, 25 bp, Mus musculus
agttgcctgactcgctcggaagctg

SEQ ID NO: 879168 - DNA, 25 bp, Mus musculus
agttgcctgactggctcggaagctg

SEQ ID NO: 879169 - DNA, 25 bp, Mus musculus
agttgctagtgctgcacgctgctgg

SEQ ID NO: 879170 - DNA, 25 bp, Mus musculus
agttgctagtgctggacgctgctgg

SEQ ID NO: 879171 - DNA, 25 bp, Mus musculus
agttgctccccacccctgaggtgcg

SEQ ID NO: 879172 - DNA, 25 bp, Mus musculus
agttgctccccagccctgaggtgcg

SEQ ID NO: 879173 - DNA, 25 bp, Mus musculus
agttgctgacaacatcctgtgggaa

SEQ ID NO: 879174 - DNA, 25 bp, Mus musculus
agttgctgacaagatcctgtgggaa

SEQ ID NO: 879175 - DNA, 25 bp, Mus musculus
agttgctggcatgacagccctaaag

SEQ ID NO: 879176 - DNA, 25 bp, Mus musculus
agttgctggcatgagagccctaaag

SEQ ID NO: 879177 - DNA, 25 bp, Mus musculus
agttgcttctgttacgtgctggaga

SEQ ID NO: 879178 - DNA, 25 bp, Mus musculus
agttgcttctgttaggtgctggaga

SEQ ID NO: 879179 - DNA, 25 bp, Mus musculus
agttggaaatcactggtgatgagtt

SEQ ID NO: 879180 - DNA, 25 bp, Mus musculus
agttggaaatcagtggtgatgagtt

SEQ ID NO: 879181 - DNA, 25 bp, Mus musculus
agttggatctcataagagaggagcc

SEQ ID NO: 879182 - DNA, 25 bp, Mus musculus
agttggatctcatatgagaggagcc

SEQ ID NO: 879183 - DNA, 25 bp, Mus musculus
agttggatttttgaagccatatgaa

SEQ ID NO: 879184 - DNA, 25 bp, Mus musculus
agttggatttttgatgccatatgaa

SEQ ID NO: 879185 - DNA, 25 bp, Mus musculus
agttggctacatcacggtgcggttc

SEQ ID NO: 879186 - DNA, 25 bp, Mus musculus
agttggctacatcagggtgcggttc

SEQ ID NO: 879187 - DNA, 25 bp, Mus musculus
agttggctggagcgaaggtggctgg

SEQ ID NO: 879188 - DNA, 25 bp, Mus musculus
agttggctggagggaaggtggctgg

SEQ ID NO: 879189 - DNA, 25 bp, Mus musculus
agttggctggtggactgttctccag

SEQ ID NO: 879190 - DNA, 25 bp, Mus musculus
agttggctggtggagtgttctccag

SEQ ID NO: 879191 - DNA, 25 bp, Mus musculus
agttggcttgccttgagatttttaa

SEQ ID NO: 879192 - DNA, 25 bp, Mus musculus
agttggcttggcttgagatttttaa

SEQ ID NO: 879193 - DNA, 25 bp, Mus musculus
agttgtaggacaaacgtatggcttt

SEQ ID NO: 879194 - DNA, 25 bp, Mus musculus
agttgtaggacaaaggtatggcttt

SEQ ID NO: 879195 - DNA, 25 bp, Mus musculus
agttgtcgggcacaactgtgtctgt

SEQ ID NO: 879196 - DNA, 25 bp, Mus musculus
agttgtcgggcacccagccattcat

SEQ ID NO: 879197 - DNA, 25 bp, Mus musculus
agttgtcgggcagaactgtgtctgt

SEQ ID NO: 879198 - DNA, 25 bp, Mus musculus
agttgtcgggcagccagccattcat

SEQ ID NO: 879199 - DNA, 25 bp, Mus musculus
agtttaatttgacggaggacatgta

SEQ ID NO: 879200 - DNA, 25 bp, Mus musculus
agtttaatttgagggaggacatgta

SEQ ID NO: 879201 - DNA, 25 bp, Mus musculus
agtttagaagagcgctgtcaaatct

SEQ ID NO: 879202 - DNA, 25 bp, Mus musculus
agtttagaagagggctgtcaaatct

SEQ ID NO: 879203 - DNA, 25 bp, Mus musculus
agtttataagctcccctttgctgat

SEQ ID NO: 879204 - DNA, 25 bp, Mus musculus
agtttataaggtcccctttgctgat

SEQ ID NO: 879205 - DNA, 25 bp, Mus musculus
agtttcacagagatccttggtgttt

SEQ ID NO: 879206 - DNA, 25 bp, Mus musculus
agtttcacagagttccttggtgttt

SEQ ID NO: 879207 - DNA, 25 bp, Mus musculus
agtttcagagattctaagctgacta

SEQ ID NO: 879208 - DNA, 25 bp, Mus musculus
agtttcagagtttctaagctgacta

SEQ ID NO: 879209 - DNA, 25 bp, Mus musculus
agtttcatagcctggagattcagaa

SEQ ID NO: 879210 - DNA, 25 bp, Mus musculus
agtttcataggctggagattcagaa

SEQ ID NO: 879211 - DNA, 25 bp, Mus musculus
agtttcatcatgcgaaactgtgacg

SEQ ID NO: 879212 - DNA, 25 bp, Mus musculus
agtttcatcatgggaaactgtgacg

SEQ ID NO: 879213 - DNA, 25 bp, Mus musculus
agtttcatggagaatcaaaagccta

SEQ ID NO: 879214 - DNA, 25 bp, Mus musculus
agtttcatggagtatcaaaagccta

SEQ ID NO: 879215 - DNA, 25 bp, Mus musculus
agtttccacagaccgtgtaccagat

SEQ ID NO: 879216 - DNA, 25 bp, Mus musculus
agtttccacagagcgtgtaccagat

SEQ ID NO: 879217 - DNA, 25 bp, Mus musculus
agtttccgtgccattgaagatgagc

SEQ ID NO: 879218 - DNA, 25 bp, Mus musculus
agtttccgtgcctttgaagatgagc

SEQ ID NO: 879219 - DNA, 25 bp, Mus musculus
agtttccttgcacatatactgctgt

SEQ ID NO: 879220 - DNA, 25 bp, Mus musculus
agtttccttgcacggcctctatgac

SEQ ID NO: 879221 - DNA, 25 bp, Mus musculus
agtttccttgcacgtccattcacac

SEQ ID NO: 879222 - DNA, 25 bp, Mus musculus
agtttccttgcagatatactgctgt

SEQ ID NO: 879223 - DNA, 25 bp, Mus musculus
agtttccttgcagggcctctatgac

SEQ ID NO: 879224 - DNA, 25 bp, Mus musculus
agtttccttgcaggtccattcacac

SEQ ID NO: 879225 - DNA, 25 bp, Mus musculus
agtttctcaatgagctcatcctgtt

SEQ ID NO: 879226 - DNA, 25 bp, Mus musculus
agtttctcaatgtgctcatcctgtt

SEQ ID NO: 879227 - DNA, 25 bp, Mus musculus
agtttctcatcacgcgccgcctaag

SEQ ID NO: 879228 - DNA, 25 bp, Mus musculus
agtttctcatcacgggccgcctaag

SEQ ID NO: 879229 - DNA, 25 bp, Mus musculus
agtttctcatgacgaacctggcttt

SEQ ID NO: 879230 - DNA, 25 bp, Mus musculus
agtttctcatgaggaacctggcttt

SEQ ID NO: 879231 - DNA, 25 bp, Mus musculus
agtttctcgcagagtgttcctgact

SEQ ID NO: 879232 - DNA, 25 bp, Mus musculus
agtttctcgcagatatattaccaaa

SEQ ID NO: 879233 - DNA, 25 bp, Mus musculus
agtttctcgcagtgtgttcctgact

SEQ ID NO: 879234 - DNA, 25 bp, Mus musculus
agtttctcgcagttatattaccaaa

SEQ ID NO: 879235 - DNA, 25 bp, Mus musculus
agtttctctgccagagtgcttcaat

SEQ ID NO: 879236 - DNA, 25 bp, Mus musculus
agtttctctgcctgagtgcttcaat

SEQ ID NO: 879237 - DNA, 25 bp, Mus musculus
agtttctctgtcaaaggtggaaaga

SEQ ID NO: 879238 - DNA, 25 bp, Mus musculus
agtttctctgtcaatggtggaaaga

SEQ ID NO: 879239 - DNA, 25 bp, Mus musculus
agtttctgcagacttgtactggttt

SEQ ID NO: 879240 - DNA, 25 bp, Mus musculus
agtttctgcagagttgtactggttt

SEQ ID NO: 879241 - DNA, 25 bp, Mus musculus
agtttctttatctacgagacgaccg

SEQ ID NO: 879242 - DNA, 25 bp, Mus musculus
agtttctttatctaggagacgaccg

SEQ ID NO: 879243 - DNA, 25 bp, Mus musculus
agtttgaaaacctagctgccacgtc

SEQ ID NO: 879244 - DNA, 25 bp, Mus musculus
agtttgaaaagctagctgccacgtc

SEQ ID NO: 879245 - DNA, 25 bp, Mus musculus
agtttgacagcacacagagctgcag

SEQ ID NO: 879246 - DNA, 25 bp, Mus musculus
agtttgacaggacacagagctgcag

SEQ ID NO: 879247 - DNA, 25 bp, Mus musculus
agtttgactctcaggagagaatgtt

SEQ ID NO: 879248 - DNA, 25 bp, Mus musculus
agtttgactctctggagagaatgtt

SEQ ID NO: 879249 - DNA, 25 bp, Mus musculus
agtttgaggccacgttcttccattt

SEQ ID NO: 879250 - DNA, 25 bp, Mus musculus
agtttgaggccaggttcttccattt

SEQ ID NO: 879251 - DNA, 25 bp, Mus musculus
agtttgagttagaggtgactgggca

SEQ ID NO: 879252 - DNA, 25 bp, Mus musculus
agtttgagtttgaggtgactgggca

SEQ ID NO: 879253 - DNA, 25 bp, Mus musculus
agtttgatgcccaacgcaacttaag

SEQ ID NO: 879254 - DNA, 25 bp, Mus musculus
agtttgatgcccaaggcaacttaag

SEQ ID NO: 879255 - DNA, 25 bp, Mus musculus
agtttgcaaacaagtttgtggtgta

SEQ ID NO: 879256 - DNA, 25 bp, Mus musculus
agtttgcaaagaagtttgtggtgta

SEQ ID NO: 879257 - DNA, 25 bp, Mus musculus
agtttgcaagcaatgttgtggagaa

SEQ ID NO: 879258 - DNA, 25 bp, Mus musculus
agtttgcaaggaatgttgtggagaa

SEQ ID NO: 879259 - DNA, 25 bp, Mus musculus
agtttgcatacagactcgcttctta

SEQ ID NO: 879260 - DNA, 25 bp, Mus musculus
agtttgcatagagactcgcttctta

SEQ ID NO: 879261 - DNA, 25 bp, Mus musculus
agtttgcattccccttgcttcccag

SEQ ID NO: 879262 - DNA, 25 bp, Mus musculus
agtttgcattccgcttgcttcccag

SEQ ID NO: 879263 - DNA, 25 bp, Mus musculus
agtttgcatttacgaggactgacaa

SEQ ID NO: 879264 - DNA, 25 bp, Mus musculus
agtttgcatttaggaggactgacaa

SEQ ID NO: 879265 - DNA, 25 bp, Mus musculus
agtttgcggttgaaaatggaagaca

SEQ ID NO: 879266 - DNA, 25 bp, Mus musculus
agtttgcggttgtaaatggaagaca

SEQ ID NO: 879267 - DNA, 25 bp, Mus musculus
agtttgctgctgcaggtgccttact

SEQ ID NO: 879268 - DNA, 25 bp, Mus musculus
agtttgctgctggaggtgccttact

SEQ ID NO: 879269 - DNA, 25 bp, Mus musculus
agtttggaccgactcgttactgatg

SEQ ID NO: 879270 - DNA, 25 bp, Mus musculus
agtttggaccgactggttactgatg

SEQ ID NO: 879271 - DNA, 25 bp, Mus musculus
agtttggcagagtatacgaagcaga

SEQ ID NO: 879272 - DNA, 25 bp, Mus musculus
agtttggcagagtcaaaggtcccca

SEQ ID NO: 879273 - DNA, 25 bp, Mus musculus
agtttggcagtgtatacgaagcaga

SEQ ID NO: 879274 - DNA, 25 bp, Mus musculus
agtttggcagtgtcaaaggtcccca

SEQ ID NO: 879275 - DNA, 25 bp, Mus musculus
agtttggcatgaaacgaggaagcgg

SEQ ID NO: 879276 - DNA, 25 bp, Mus musculus
agtttggcatgaaacgcccagcttc

SEQ ID NO: 879277 - DNA, 25 bp, Mus musculus
agtttggcatgaaaggaggaagcgg

SEQ ID NO: 879278 - DNA, 25 bp, Mus musculus
agtttggcatgaaaggcccagcttc

SEQ ID NO: 879279 - DNA, 25 bp, Mus musculus
agtttggcttcccgttgccctatgc

SEQ ID NO: 879280 - DNA, 25 bp, Mus musculus
agtttggcttccggttgccctatgc

SEQ ID NO: 879281 - DNA, 25 bp, Mus musculus
agtttgggagctatgcttatcctaa

SEQ ID NO: 879282 - DNA, 25 bp, Mus musculus
agtttgggagctttgcttatcctaa

SEQ ID NO: 879283 - DNA, 25 bp, Mus musculus
agtttggtgtcgcgcagcacggaga

SEQ ID NO: 879284 - DNA, 25 bp, Mus musculus
agtttggtgtcgcggagcacggaga

SEQ ID NO: 879285 - DNA, 25 bp, Mus musculus
agtttgtatcgacacttctgtaagc

SEQ ID NO: 879286 - DNA, 25 bp, Mus musculus
agtttgtatcgacagttctgtaagc

SEQ ID NO: 879287 - DNA, 25 bp, Mus musculus
agtttgtccgcacaaatctgtcttt

SEQ ID NO: 879288 - DNA, 25 bp, Mus musculus
agtttgtccgcacgaacctgaatga

SEQ ID NO: 879289 - DNA, 25 bp, Mus musculus
agtttgtccgcagaaatctgtcttt

SEQ ID NO: 879290 - DNA, 25 bp, Mus musculus
agtttgtccgcaggaacctgaatga

SEQ ID NO: 879291 - DNA, 25 bp, Mus musculus
agtttgtctgcggcctcaacaagca

SEQ ID NO: 879292 - DNA, 25 bp, Mus musculus
agtttgtctggggcctcaacaagca

SEQ ID NO: 879293 - DNA, 25 bp, Mus musculus
agttttaagagacgatttaacagtg

SEQ ID NO: 879294 - DNA, 25 bp, Mus musculus
agttttaagagacgtggctttgcag

SEQ ID NO: 879295 - DNA, 25 bp, Mus musculus
agttttaagagaggatttaacagtg

SEQ ID NO: 879296 - DNA, 25 bp, Mus musculus
agttttaagagaggtggctttgcag

SEQ ID NO: 879297 - DNA, 25 bp, Mus musculus
agttttacagagatcctgggtgttt

SEQ ID NO: 879298 - DNA, 25 bp, Mus musculus
agttttacagagttcctgggtgttt

SEQ ID NO: 879299 - DNA, 25 bp, Mus musculus
agttttacagcaatctgggcaaatc

SEQ ID NO: 879300 - DNA, 25 bp, Mus musculus
agttttacaggaatctgggcaaatc

SEQ ID NO: 879301 - DNA, 25 bp, Mus musculus
agttttcacacctattgcagaccag

SEQ ID NO: 879302 - DNA, 25 bp, Mus musculus
agttttcacagctattgcagaccag

SEQ ID NO: 879303 - DNA, 25 bp, Mus musculus
agttttctgccacattcaagaacct

SEQ ID NO: 879304 - DNA, 25 bp, Mus musculus
agttttctgccagattcaagaacct

SEQ ID NO: 879305 - DNA, 25 bp, Mus musculus
agttttgacggcatttgctaatggt

SEQ ID NO: 879306 - DNA, 25 bp, Mus musculus
agttttgacggcttttgctaatggt

SEQ ID NO: 879307 - DNA, 25 bp, Mus musculus
agttttgcttaaccatggtgctgac

SEQ ID NO: 879308 - DNA, 25 bp, Mus musculus
agttttgcttaagcatggtgctgac

SEQ ID NO: 879309 - DNA, 25 bp, Mus musculus
agttttgttttgatatgaatgcagg

SEQ ID NO: 879310 - DNA, 25 bp, Mus musculus
agttttgttttgttatgaatgcagg

SEQ ID NO: 879311 - DNA, 25 bp, Mus musculus
agtttttacacacacgatttaattg

SEQ ID NO: 879312 - DNA, 25 bp, Mus musculus
agtttttacacacaggatttaattg

SEQ ID NO: 879313 - DNA, 25 bp, Mus musculus
agtttttgagaccggtgctcggcac

SEQ ID NO: 879314 - DNA, 25 bp, Mus musculus
agtttttgagacgggtgctcggcac

SEQ ID NO: 879315 - DNA, 25 bp, Mus musculus
ataaaaagatgtcaaatcctagaag

SEQ ID NO: 879316 - DNA, 25 bp, Mus musculus
ataaaaagatgtgaaatcctagaag

SEQ ID NO: 879317 - DNA, 25 bp, Mus musculus
ataaaaattacactaccaaagcagt

SEQ ID NO: 879318 - DNA, 25 bp, Mus musculus
ataaaaattacagtaccaaagcagt

SEQ ID NO: 879319 - DNA, 25 bp, Mus musculus
ataaaaattcagcatcctcctgtga

SEQ ID NO: 879320 - DNA, 25 bp, Mus musculus
ataaaaattcaggatcctcctgtga

SEQ ID NO: 879321 - DNA, 25 bp, Mus musculus
ataaaaattgcactctatagtctag

SEQ ID NO: 879322 - DNA, 25 bp, Mus musculus
ataaaaattggactctatagtctag

SEQ ID NO: 879323 - DNA, 25 bp, Mus musculus
ataaaacaacagattgttcagctaa

SEQ ID NO: 879324 - DNA, 25 bp, Mus musculus
ataaaacaacagtttgttcagctaa

SEQ ID NO: 879325 - DNA, 25 bp, Mus musculus
ataaaacatgccattctgcatttgg

SEQ ID NO: 879326 - DNA, 25 bp, Mus musculus
ataaaacatgctggaggcattccat

SEQ ID NO: 879327 - DNA, 25 bp, Mus musculus
ataaaacatggcattctgcatttgg

SEQ ID NO: 879328 - DNA, 25 bp, Mus musculus
ataaaacatggtggaggcattccat

SEQ ID NO: 879329 - DNA, 25 bp, Mus musculus
ataaaactctaaagggtcaggctcc

SEQ ID NO: 879330 - DNA, 25 bp, Mus musculus
ataaaactctaatgggtcaggctcc

SEQ ID NO: 879331 - DNA, 25 bp, Mus musculus
ataaaagcaacagacagtgcactga

SEQ ID NO: 879332 - DNA, 25 bp, Mus musculus
ataaaagcaacagacttcttgcctc

SEQ ID NO: 879333 - DNA, 25 bp, Mus musculus
ataaaagcaacagagagtgcactga

SEQ ID NO: 879334 - DNA, 25 bp, Mus musculus
ataaaagcaacagagttcttgcctc

SEQ ID NO: 879335 - DNA, 25 bp, Mus musculus
ataaaagcatcacgcaagaggcaaa

SEQ ID NO: 879336 - DNA, 25 bp, Mus musculus
ataaaagcatcacttgtgactgtga

SEQ ID NO: 879337 - DNA, 25 bp, Mus musculus
ataaaagcatcaggcaagaggcaaa

SEQ ID NO: 879338 - DNA, 25 bp, Mus musculus
ataaaagcatcagttgtgactgtga

SEQ ID NO: 879339 - DNA, 25 bp, Mus musculus
ataaaaggtgccacaggcaccatgt

SEQ ID NO: 879340 - DNA, 25 bp, Mus musculus
ataaaaggtggcacaggcaccatgt

SEQ ID NO: 879341 - DNA, 25 bp, Mus musculus
ataaaatcagctgctcgactgattc

SEQ ID NO: 879342 - DNA, 25 bp, Mus musculus
ataaaatcaggtgctcgactgattc

SEQ ID NO: 879343 - DNA, 25 bp, Mus musculus
ataaaatcccatagccaccgtgggc

SEQ ID NO: 879344 - DNA, 25 bp, Mus musculus
ataaaatcccattgccaccgtgggc

SEQ ID NO: 879345 - DNA, 25 bp, Mus musculus
ataaaatgcatgctattaatgggaa

SEQ ID NO: 879346 - DNA, 25 bp, Mus musculus
ataaaatgcatggtattaatgggaa

SEQ ID NO: 879347 - DNA, 25 bp, Mus musculus
ataaaatggagacaggtaagaagta

SEQ ID NO: 879348 - DNA, 25 bp, Mus musculus
ataaaatggagactctggatgtgga

SEQ ID NO: 879349 - DNA, 25 bp, Mus musculus
ataaaatggagagaggtaagaagta

SEQ ID NO: 879350 - DNA, 25 bp, Mus musculus
ataaaatggagagtctggatgtgga

SEQ ID NO: 879351 - DNA, 25 bp, Mus musculus
ataaaatgggagcctttgaaatcca

SEQ ID NO: 879352 - DNA, 25 bp, Mus musculus
ataaaatgggaggctttgaaatcca

SEQ ID NO: 879353 - DNA, 25 bp, Mus musculus
ataaacactgaaaaggatctccctc

SEQ ID NO: 879354 - DNA, 25 bp, Mus musculus
ataaacactgcaacttagcaggact

SEQ ID NO: 879355 - DNA, 25 bp, Mus musculus
ataaacactggaacttagcaggact

SEQ ID NO: 879356 - DNA, 25 bp, Mus musculus
ataaacactgtaaaggatctccctc

SEQ ID NO: 879357 - DNA, 25 bp, Mus musculus
ataaactatgagcacgtcaacatgg

SEQ ID NO: 879358 - DNA, 25 bp, Mus musculus
ataaactatgagcaggtcaacatgg

SEQ ID NO: 879359 - DNA, 25 bp, Mus musculus
ataaactgaaatcgtgtttgcgagt

SEQ ID NO: 879360 - DNA, 25 bp, Mus musculus
ataaactgaaatggtgtttgcgagt

SEQ ID NO: 879361 - DNA, 25 bp, Mus musculus
ataaacttaaagccagccaagccag

SEQ ID NO: 879362 - DNA, 25 bp, Mus musculus
ataaacttaaaggcagccaagccag

SEQ ID NO: 879363 - DNA, 25 bp, Mus musculus
ataaagaaagaagatcatcaaagta

SEQ ID NO: 879364 - DNA, 25 bp, Mus musculus
ataaagaaagctgaccagaatggag

SEQ ID NO: 879365 - DNA, 25 bp, Mus musculus
ataaagaaaggtgaccagaatggag

SEQ ID NO: 879366 - DNA, 25 bp, Mus musculus
ataaagaaagtagatcatcaaagta

SEQ ID NO: 879367 - DNA, 25 bp, Mus musculus
ataaagaagccaccccctctttgct

SEQ ID NO: 879368 - DNA, 25 bp, Mus musculus
ataaagaagccagcccctctttgct

SEQ ID NO: 879369 - DNA, 25 bp, Mus musculus
ataaagataacccgccactgaatgc

SEQ ID NO: 879370 - DNA, 25 bp, Mus musculus
ataaagataacccggcactgaatgc

SEQ ID NO: 879371 - DNA, 25 bp, Mus musculus
ataaagatctggcgcatatcgtcag

SEQ ID NO: 879372 - DNA, 25 bp, Mus musculus
ataaagatctggcggatatcgtcag

SEQ ID NO: 879373 - DNA, 25 bp, Mus musculus
ataaagatgtccagcttcgttatca

SEQ ID NO: 879374 - DNA, 25 bp, Mus musculus
ataaagatgtcctgcttcgttatca

SEQ ID NO: 879375 - DNA, 25 bp, Mus musculus
ataaagattcagatctctcggatct

SEQ ID NO: 879376 - DNA, 25 bp, Mus musculus
ataaagattcagttctctcggatct

SEQ ID NO: 879377 - DNA, 25 bp, Mus musculus
ataaagcagagacaaattgaacaag

SEQ ID NO: 879378 - DNA, 25 bp, Mus musculus
ataaagcagagacatattgaacaag

SEQ ID NO: 879379 - DNA, 25 bp, Mus musculus
ataaagccagatttcgtgctgtgta

SEQ ID NO: 879380 - DNA, 25 bp, Mus musculus
ataaagccagatttggtgctgtgta

SEQ ID NO: 879381 - DNA, 25 bp, Mus musculus
ataaagcgagattcactttcaggct

SEQ ID NO: 879382 - DNA, 25 bp, Mus musculus
ataaagcgagcctgaaaggaaatgt

SEQ ID NO: 879383 - DNA, 25 bp, Mus musculus
ataaagcgaggctgaaaggaaatgt

SEQ ID NO: 879384 - DNA, 25 bp, Mus musculus
ataaagcgagtttcactttcaggct

SEQ ID NO: 879385 - DNA, 25 bp, Mus musculus
ataaaggacaagcagcaagtaggct

SEQ ID NO: 879386 - DNA, 25 bp, Mus musculus
ataaaggacaaggagcaagtaggct

SEQ ID NO: 879387 - DNA, 25 bp, Mus musculus
ataaaggcactgcttactacacttg

SEQ ID NO: 879388 - DNA, 25 bp, Mus musculus
ataaaggcactggttactacacttg

SEQ ID NO: 879389 - DNA, 25 bp, Mus musculus
ataaagtagcagcacacagcttggg

SEQ ID NO: 879390 - DNA, 25 bp, Mus musculus
ataaagtagcaggacacagcttggg

SEQ ID NO: 879391 - DNA, 25 bp, Mus musculus
ataaagtctctgaaactcaagtcaa

SEQ ID NO: 879392 - DNA, 25 bp, Mus musculus
ataaagtctctgtaactcaagtcaa

SEQ ID NO: 879393 - DNA, 25 bp, Mus musculus
ataaagtgcgcacggcacccctgaa

SEQ ID NO: 879394 - DNA, 25 bp, Mus musculus
ataaagtgcgcagggcacccctgaa

SEQ ID NO: 879395 - DNA, 25 bp, Mus musculus
ataaatcaagagagctgtgtcaatg

SEQ ID NO: 879396 - DNA, 25 bp, Mus musculus
ataaatcaagagaggtgtgtcaatg

SEQ ID NO: 879397 - DNA, 25 bp, Mus musculus
ataaatcacgccagaaaagtagact

SEQ ID NO: 879398 - DNA, 25 bp, Mus musculus
ataaatcacgccagtaaagtagact

SEQ ID NO: 879399 - DNA, 25 bp, Mus musculus
ataaatctcaacctgctgaaagaca

SEQ ID NO: 879400 - DNA, 25 bp, Mus musculus
ataaatctcaacgtgctgaaagaca

SEQ ID NO: 879401 - DNA, 25 bp, Mus musculus
ataaatgagtctgctattgatagca

SEQ ID NO: 879402 - DNA, 25 bp, Mus musculus
ataaatgagtgtgctattgatagca

SEQ ID NO: 879403 - DNA, 25 bp, Mus musculus
ataaatgtgacacggacttgtcact

SEQ ID NO: 879404 - DNA, 25 bp, Mus musculus
ataaatgtgacagggacttgtcact

SEQ ID NO: 879405 - DNA, 25 bp, Mus musculus
ataacaaacttaaacccagtcaggc

SEQ ID NO: 879406 - DNA, 25 bp, Mus musculus
ataacaaacttaaactcaggcaaga

SEQ ID NO: 879407 - DNA, 25 bp, Mus musculus
ataacaaacttaaagccagtcaggc

SEQ ID NO: 879408 - DNA, 25 bp, Mus musculus
ataacaaacttaaagtcaggcaaga

SEQ ID NO: 879409 - DNA, 25 bp, Mus musculus
ataacaatgtatcgcaatcgcatcc

SEQ ID NO: 879410 - DNA, 25 bp, Mus musculus
ataacaatgtatggcaatcgcatcc

SEQ ID NO: 879411 - DNA, 25 bp, Mus musculus
ataacagacaagcatgacttcgcaa

SEQ ID NO: 879412 - DNA, 25 bp, Mus musculus
ataacagacaaggatgacttcgcaa

SEQ ID NO: 879413 - DNA, 25 bp, Mus musculus
ataacagagacaaacgggaccgtgc

SEQ ID NO: 879414 - DNA, 25 bp, Mus musculus
ataacagagacaaaggggaccgtgc

SEQ ID NO: 879415 - DNA, 25 bp, Mus musculus
ataacatatctccacaatcctaagg

SEQ ID NO: 879416 - DNA, 25 bp, Mus musculus
ataacatatctccagaatcctaagg

SEQ ID NO: 879417 - DNA, 25 bp, Mus musculus
ataacatcatgtttcgtccggacat

SEQ ID NO: 879418 - DNA, 25 bp, Mus musculus
ataacatcatgtttggtccggacat

SEQ ID NO: 879419 - DNA, 25 bp, Mus musculus
ataacatttgatgtgactggaccct

SEQ ID NO: 879420 - DNA, 25 bp, Mus musculus
ataacatttgttgtgactggaccct

SEQ ID NO: 879421 - DNA, 25 bp, Mus musculus
ataaccaagcagcctgccttaggag

SEQ ID NO: 879422 - DNA, 25 bp, Mus musculus
ataaccaagcaggctgccttaggag

SEQ ID NO: 879423 - DNA, 25 bp, Mus musculus
ataaccacagtaagctcacgaagtt

SEQ ID NO: 879424 - DNA, 25 bp, Mus musculus
ataaccacagtaaggtcacgaagtt

SEQ ID NO: 879425 - DNA, 25 bp, Mus musculus
ataaccaccacacacttcccacaac

SEQ ID NO: 879426 - DNA, 25 bp, Mus musculus
ataaccaccacagacttcccacaac

SEQ ID NO: 879427 - DNA, 25 bp, Mus musculus
ataaccagacagaggatatttggtc

SEQ ID NO: 879428 - DNA, 25 bp, Mus musculus
ataaccagacagtggatatttggtc

SEQ ID NO: 879429 - DNA, 25 bp, Mus musculus
ataacccggcagaactacacatact

SEQ ID NO: 879430 - DNA, 25 bp, Mus musculus
ataacccggcagtactacacatact

SEQ ID NO: 879431 - DNA, 25 bp, Mus musculus
ataaccgagccacacccagatgtca

SEQ ID NO: 879432 - DNA, 25 bp, Mus musculus
ataaccgagccagacccagatgtca

SEQ ID NO: 879433 - DNA, 25 bp, Mus musculus
ataaccgtgcagcttgagaatgagt

SEQ ID NO: 879434 - DNA, 25 bp, Mus musculus
ataaccgtgcaggttgagaatgagt

SEQ ID NO: 879435 - DNA, 25 bp, Mus musculus
ataacctaattgaaaatcattgcat

SEQ ID NO: 879436 - DNA, 25 bp, Mus musculus
ataacctaattgaatatcattgcat

SEQ ID NO: 879437 - DNA, 25 bp, Mus musculus
ataacggagttgctgaatgatacca

SEQ ID NO: 879438 - DNA, 25 bp, Mus musculus
ataacggagttggtgaatgatacca

SEQ ID NO: 879439 - DNA, 25 bp, Mus musculus
ataactaaagcttatgaaatgttgt

SEQ ID NO: 879440 - DNA, 25 bp, Mus musculus
ataactaaaggttatgaaatgttgt

SEQ ID NO: 879441 - DNA, 25 bp, Mus musculus
ataactaaccagattgaatgtcacc

SEQ ID NO: 879442 - DNA, 25 bp, Mus musculus
ataactaaccagtttgaatgtcacc

SEQ ID NO: 879443 - DNA, 25 bp, Mus musculus
ataactcatcaaccttatgaacttt

SEQ ID NO: 879444 - DNA, 25 bp, Mus musculus
ataactcatcaagcttatgaacttt

SEQ ID NO: 879445 - DNA, 25 bp, Mus musculus
ataactccagcactgtcaccgtgtg

SEQ ID NO: 879446 - DNA, 25 bp, Mus musculus
ataactccaggactgtcaccgtgtg

SEQ ID NO: 879447 - DNA, 25 bp, Mus musculus
ataactcgtacacggactgtatgct

SEQ ID NO: 879448 - DNA, 25 bp, Mus musculus
ataactcgtacagggactgtatgct

SEQ ID NO: 879449 - DNA, 25 bp, Mus musculus
ataactgtcagcctcgtactttctg

SEQ ID NO: 879450 - DNA, 25 bp, Mus musculus
ataactgtcagcctggtactttctg

SEQ ID NO: 879451 - DNA, 25 bp, Mus musculus
ataacttcctcagaaggacttgatc

SEQ ID NO: 879452 - DNA, 25 bp, Mus musculus
ataacttcctgagaaggacttgatc

SEQ ID NO: 879453 - DNA, 25 bp, Mus musculus
ataagaagccagatgtgaactgggg

SEQ ID NO: 879454 - DNA, 25 bp, Mus musculus
ataagaagccagttgtgaactgggg

SEQ ID NO: 879455 - DNA, 25 bp, Mus musculus
ataagaagtgattccacgatgatgc

SEQ ID NO: 879456 - DNA, 25 bp, Mus musculus
ataagaagtgtttccacgatgatgc

SEQ ID NO: 879457 - DNA, 25 bp, Mus musculus
ataagaatatcacgtgttgaactct

SEQ ID NO: 879458 - DNA, 25 bp, Mus musculus
ataagaatatcaggtgttgaactct

SEQ ID NO: 879459 - DNA, 25 bp, Mus musculus
ataagacatacacgggcatgacccc

SEQ ID NO: 879460 - DNA, 25 bp, Mus musculus
ataagacatacaggggcatgacccc

SEQ ID NO: 879461 - DNA, 25 bp, Mus musculus
ataagaccagatcatctttagatgg

SEQ ID NO: 879462 - DNA, 25 bp, Mus musculus
ataagaccagttcatctttagatgg

SEQ ID NO: 879463 - DNA, 25 bp, Mus musculus
ataagaccatcacattatgggacag

SEQ ID NO: 879464 - DNA, 25 bp, Mus musculus
ataagaccatcagattatgggacag

SEQ ID NO: 879465 - DNA, 25 bp, Mus musculus
ataagagaagctggctgtataggat

SEQ ID NO: 879466 - DNA, 25 bp, Mus musculus
ataagagaaggtggctgtataggat

SEQ ID NO: 879467 - DNA, 25 bp, Mus musculus
ataagatgagctcctccaccttcgc

SEQ ID NO: 879468 - DNA, 25 bp, Mus musculus
ataagatgaggtcctccaccttcgc

SEQ ID NO: 879469 - DNA, 25 bp, Mus musculus
ataagatgcactccatgaatgggtt

SEQ ID NO: 879470 - DNA, 25 bp, Mus musculus
ataagatgcactgcatgaatgggtt

SEQ ID NO: 879471 - DNA, 25 bp, Mus musculus
ataagattgttaatcagaaatacca

SEQ ID NO: 879472 - DNA, 25 bp, Mus musculus
ataagattgttattcagaaatacca

SEQ ID NO: 879473 - DNA, 25 bp, Mus musculus
ataagcaactggatgtgggagaaga

SEQ ID NO: 879474 - DNA, 25 bp, Mus musculus
ataagcaactggttgtgggagaaga

SEQ ID NO: 879475 - DNA, 25 bp, Mus musculus
ataagcacccagaacgctcagaagc

SEQ ID NO: 879476 - DNA, 25 bp, Mus musculus
ataagcacccagaaggctcagaagc

SEQ ID NO: 879477 - DNA, 25 bp, Mus musculus
ataagcagtacaaacctctttctca

SEQ ID NO: 879478 - DNA, 25 bp, Mus musculus
ataagcagtacaaagctctttctca

SEQ ID NO: 879479 - DNA, 25 bp, Mus musculus
ataagcccacctccagcttctgtca

SEQ ID NO: 879480 - DNA, 25 bp, Mus musculus
ataagcccacctccttctgtcagca

SEQ ID NO: 879481 - DNA, 25 bp, Mus musculus
ataagcccacctgcagcttctgtca

SEQ ID NO: 879482 - DNA, 25 bp, Mus musculus
ataagcccacctgcttctgtcagca

SEQ ID NO: 879483 - DNA, 25 bp, Mus musculus
ataagcgacatacatcaagatgaat

SEQ ID NO: 879484 - DNA, 25 bp, Mus musculus
ataagcgacatagatcaagatgaat

SEQ ID NO: 879485 - DNA, 25 bp, Mus musculus
ataagctacacgagcttcaagtcaa

SEQ ID NO: 879486 - DNA, 25 bp, Mus musculus
ataagctacaggagcttcaagtcaa

SEQ ID NO: 879487 - DNA, 25 bp, Mus musculus
ataagctgatgacacacatggccac

SEQ ID NO: 879488 - DNA, 25 bp, Mus musculus
ataagctgatgagacacatggccac

SEQ ID NO: 879489 - DNA, 25 bp, Mus musculus
ataaggacattacattgatcaggga

SEQ ID NO: 879490 - DNA, 25 bp, Mus musculus
ataaggacattagattgatcaggga

SEQ ID NO: 879491 - DNA, 25 bp, Mus musculus
ataaggatgaagatggagatcttat

SEQ ID NO: 879492 - DNA, 25 bp, Mus musculus
ataaggatgaagttggagatcttat

SEQ ID NO: 879493 - DNA, 25 bp, Mus musculus
ataagggaagagcgcatagatacat

SEQ ID NO: 879494 - DNA, 25 bp, Mus musculus
ataagggaagagggcatagatacat

SEQ ID NO: 879495 - DNA, 25 bp, Mus musculus
ataaggtagcagaggccagctgcct

SEQ ID NO: 879496 - DNA, 25 bp, Mus musculus
ataaggtagcagtggccagctgcct

SEQ ID NO: 879497 - DNA, 25 bp, Mus musculus
ataaggtggatcaccatgaacgctt

SEQ ID NO: 879498 - DNA, 25 bp, Mus musculus
ataaggtggatcacgatgaacgctt

SEQ ID NO: 879499 - DNA, 25 bp, Mus musculus
ataagtaaagagaacccatcttctc

SEQ ID NO: 879500 - DNA, 25 bp, Mus musculus
ataagtaaagcagaggagccaaaag

SEQ ID NO: 879501 - DNA, 25 bp, Mus musculus
ataagtaaaggagaggagccaaaag

SEQ ID NO: 879502 - DNA, 25 bp, Mus musculus
ataagtaaagtgaacccatcttctc

SEQ ID NO: 879503 - DNA, 25 bp, Mus musculus
ataagtaactatcttttagagaaat

SEQ ID NO: 879504 - DNA, 25 bp, Mus musculus
ataagtaactgtgacatgtaccgaa

SEQ ID NO: 879505 - DNA, 25 bp, Mus musculus
ataagtaactgtgagatgtaccgaa

SEQ ID NO: 879506 - DNA, 25 bp, Mus musculus
ataagtaactttcttttagagaaat

SEQ ID NO: 879507 - DNA, 25 bp, Mus musculus
ataagttcaaagcgcaacaggtcct

SEQ ID NO: 879508 - DNA, 25 bp, Mus musculus
ataagttcaaagctctaggactcca

SEQ ID NO: 879509 - DNA, 25 bp, Mus musculus
ataagttcaaagggcaacaggtcct

SEQ ID NO: 879510 - DNA, 25 bp, Mus musculus
ataagttcaaaggtctaggactcca

SEQ ID NO: 879511 - DNA, 25 bp, Mus musculus
ataagtttggatgatttaccttgct

SEQ ID NO: 879512 - DNA, 25 bp, Mus musculus
ataagtttggttgatttaccttgct

SEQ ID NO: 879513 - DNA, 25 bp, Mus musculus
ataataaaaagatgacaaatcctag

SEQ ID NO: 879514 - DNA, 25 bp, Mus musculus
ataataaaaagatgtcaaatcctag

SEQ ID NO: 879515 - DNA, 25 bp, Mus musculus
ataataaaaaggatgatgcgaagga

SEQ ID NO: 879516 - DNA, 25 bp, Mus musculus
ataataaaaaggttgatgcgaagga

SEQ ID NO: 879517 - DNA, 25 bp, Mus musculus
ataataaaagagagtctgttgggtt

SEQ ID NO: 879518 - DNA, 25 bp, Mus musculus
ataataaaagtgagtctgttgggtt

SEQ ID NO: 879519 - DNA, 25 bp, Mus musculus
ataataacccagaggtaatgctaga

SEQ ID NO: 879520 - DNA, 25 bp, Mus musculus
ataataacccagtggtaatgctaga

SEQ ID NO: 879521 - DNA, 25 bp, Mus musculus
ataataccagcattgtctacaacca

SEQ ID NO: 879522 - DNA, 25 bp, Mus musculus
ataataccaggattgtctacaacca

SEQ ID NO: 879523 - DNA, 25 bp, Mus musculus
ataataccgaggcgccatacaatca

SEQ ID NO: 879524 - DNA, 25 bp, Mus musculus
ataataccgaggggccatacaatca

SEQ ID NO: 879525 - DNA, 25 bp, Mus musculus
ataatcatgcacaacattcgacctc

SEQ ID NO: 879526 - DNA, 25 bp, Mus musculus
ataatcatgcacaagattcgacctc

SEQ ID NO: 879527 - DNA, 25 bp, Mus musculus
ataatccaatttcacgccactccat

SEQ ID NO: 879528 - DNA, 25 bp, Mus musculus
ataatccaatttcaggccactccat

SEQ ID NO: 879529 - DNA, 25 bp, Mus musculus
ataatcccagatatcggcagagggc

SEQ ID NO: 879530 - DNA, 25 bp, Mus musculus
ataatcccagttatcggcagagggc

SEQ ID NO: 879531 - DNA, 25 bp, Mus musculus
ataatcctgtttagatggaaggacc

SEQ ID NO: 879532 - DNA, 25 bp, Mus musculus
ataatcctgttttgatggaaggacc

SEQ ID NO: 879533 - DNA, 25 bp, Mus musculus
ataatctgtgaacatgtccagctcg

SEQ ID NO: 879534 - DNA, 25 bp, Mus musculus
ataatctgtgaagatgtccagctcg

SEQ ID NO: 879535 - DNA, 25 bp, Mus musculus
ataatgagacaaacactggaacttg

SEQ ID NO: 879536 - DNA, 25 bp, Mus musculus
ataatgagacaatcactggaacttg

SEQ ID NO: 879537 - DNA, 25 bp, Mus musculus
ataatgattccgatggagggacggc

SEQ ID NO: 879538 - DNA, 25 bp, Mus musculus
ataatgattccgttggagggacggc

SEQ ID NO: 879539 - DNA, 25 bp, Mus musculus
ataatgggtaagcaagtgaaagtga

SEQ ID NO: 879540 - DNA, 25 bp, Mus musculus
ataatgggtaaggaagtgaaagtga

SEQ ID NO: 879541 - DNA, 25 bp, Mus musculus
ataatggtgatgctcttctccatcg

SEQ ID NO: 879542 - DNA, 25 bp, Mus musculus
ataatggtgatggtcttctccatcg

SEQ ID NO: 879543 - DNA, 25 bp, Mus musculus
ataatgtagatgaaactgaaggctc

SEQ ID NO: 879544 - DNA, 25 bp, Mus musculus
ataatgtagatgaggaagcaaggga

SEQ ID NO: 879545 - DNA, 25 bp, Mus musculus
ataatgtagatgtaactgaaggctc

SEQ ID NO: 879546 - DNA, 25 bp, Mus musculus
ataatgtagatgtggaagcaaggga

SEQ ID NO: 879547 - DNA, 25 bp, Mus musculus
ataatgtgctttatgctgaggcaga

SEQ ID NO: 879548 - DNA, 25 bp, Mus musculus
ataatgtgctttttgctgaggcaga

SEQ ID NO: 879549 - DNA, 25 bp, Mus musculus
ataattcacaggcacctaaagccca

SEQ ID NO: 879550 - DNA, 25 bp, Mus musculus
ataattcacagggacctaaagccca

SEQ ID NO: 879551 - DNA, 25 bp, Mus musculus
ataattccaatgatgttgcaaaatc

SEQ ID NO: 879552 - DNA, 25 bp, Mus musculus
ataattccaatgttgttgcaaaatc

SEQ ID NO: 879553 - DNA, 25 bp, Mus musculus
ataattcctcacagacacactggat

SEQ ID NO: 879554 - DNA, 25 bp, Mus musculus
ataattcctcactgacacactggat

SEQ ID NO: 879555 - DNA, 25 bp, Mus musculus
ataattgaagcactgaaagcgtccc

SEQ ID NO: 879556 - DNA, 25 bp, Mus musculus
ataattgaaggactgaaagcgtccc

SEQ ID NO: 879557 - DNA, 25 bp, Mus musculus
ataattgataaccagccaagcattg

SEQ ID NO: 879558 - DNA, 25 bp, Mus musculus
ataattgataacgagccaagcattg

SEQ ID NO: 879559 - DNA, 25 bp, Mus musculus
ataattgcccagaatttaacagacc

SEQ ID NO: 879560 - DNA, 25 bp, Mus musculus
ataattgcccagcactcgttaatgt

SEQ ID NO: 879561 - DNA, 25 bp, Mus musculus
ataattgcccaggactcgttaatgt

SEQ ID NO: 879562 - DNA, 25 bp, Mus musculus
ataattgcccagtatttaacagacc

SEQ ID NO: 879563 - DNA, 25 bp, Mus musculus
ataattgtcttgatatggacgaatg

SEQ ID NO: 879564 - DNA, 25 bp, Mus musculus
ataattgtcttgttatggacgaatg

SEQ ID NO: 879565 - DNA, 25 bp, Mus musculus
atacaaattgctttcatgacttaca

SEQ ID NO: 879566 - DNA, 25 bp, Mus musculus
atacaaattggtttcatgacttaca

SEQ ID NO: 879567 - DNA, 25 bp, Mus musculus
atacaacaccagactgggcccacca

SEQ ID NO: 879568 - DNA, 25 bp, Mus musculus
atacaacacctgactgggcccacca

SEQ ID NO: 879569 - DNA, 25 bp, Mus musculus
atacaacatctgatcgaacctgtac

SEQ ID NO: 879570 - DNA, 25 bp, Mus musculus
atacaacatctgatcgtctatctcc

SEQ ID NO: 879571 - DNA, 25 bp, Mus musculus
atacaacatctgatggaacctgtac

SEQ ID NO: 879572 - DNA, 25 bp, Mus musculus
atacaacatctgatggtctatctcc

SEQ ID NO: 879573 - DNA, 25 bp, Mus musculus
atacaagacattgacacaatagagt

SEQ ID NO: 879574 - DNA, 25 bp, Mus musculus
atacaagacattgagacaatagagt

SEQ ID NO: 879575 - DNA, 25 bp, Mus musculus
atacaagaccagcggttcaaggaag

SEQ ID NO: 879576 - DNA, 25 bp, Mus musculus
atacaagaccaggggttcaaggaag

SEQ ID NO: 879577 - DNA, 25 bp, Mus musculus
atacaagagacgtgactacgggggc

SEQ ID NO: 879578 - DNA, 25 bp, Mus musculus
atacaagagaggtgactacgggggc

SEQ ID NO: 879579 - DNA, 25 bp, Mus musculus
atacaaggccttcccagccgacagc

SEQ ID NO: 879580 - DNA, 25 bp, Mus musculus
atacaaggccttccgagccgacagc

SEQ ID NO: 879581 - DNA, 25 bp, Mus musculus
atacaataagctgtcatcctttaca

SEQ ID NO: 879582 - DNA, 25 bp, Mus musculus
atacaataaggtgtcatcctttaca

SEQ ID NO: 879583 - DNA, 25 bp, Mus musculus
atacaatttgtcgaaaatctgtatc

SEQ ID NO: 879584 - DNA, 25 bp, Mus musculus
atacaatttgtcgataatctgtatc

SEQ ID NO: 879585 - DNA, 25 bp, Mus musculus
atacacagagaacaaaggctccttc

SEQ ID NO: 879586 - DNA, 25 bp, Mus musculus
atacacagagaactatagaagaaga

SEQ ID NO: 879587 - DNA, 25 bp, Mus musculus
atacacagagaagaaaggctccttc

SEQ ID NO: 879588 - DNA, 25 bp, Mus musculus
atacacagagaagtatagaagaaga

SEQ ID NO: 879589 - DNA, 25 bp, Mus musculus
atacacagagcaccgcctggggcta

SEQ ID NO: 879590 - DNA, 25 bp, Mus musculus
atacacagagccatcaatgacaaca

SEQ ID NO: 879591 - DNA, 25 bp, Mus musculus
atacacagagccttcaatgacaaca

SEQ ID NO: 879592 - DNA, 25 bp, Mus musculus
atacacagaggaccgcctggggcta

SEQ ID NO: 879593 - DNA, 25 bp, Mus musculus
atacacattatgccaggatctgcac

SEQ ID NO: 879594 - DNA, 25 bp, Mus musculus
atacacattatgcctggatctgcac

SEQ ID NO: 879595 - DNA, 25 bp, Mus musculus
atacaccacgcacaaagagccccgc

SEQ ID NO: 879596 - DNA, 25 bp, Mus musculus
atacaccacggacaaagagccccgc

SEQ ID NO: 879597 - DNA, 25 bp, Mus musculus
atacaccctgcaggcgtaagaccac

SEQ ID NO: 879598 - DNA, 25 bp, Mus musculus
atacaccctggaggcgtaagaccac

SEQ ID NO: 879599 - DNA, 25 bp, Mus musculus
atacactataagctttgctatgcgc

SEQ ID NO: 879600 - DNA, 25 bp, Mus musculus
atacactataaggtttgctatgcgc

SEQ ID NO: 879601 - DNA, 25 bp, Mus musculus
atacactcgcagcagacaaagcatt

SEQ ID NO: 879602 - DNA, 25 bp, Mus musculus
atacactcgcaggagacaaagcatt

SEQ ID NO: 879603 - DNA, 25 bp, Mus musculus
atacactggacgatctccccagcgc

SEQ ID NO: 879604 - DNA, 25 bp, Mus musculus
atacactggacgatgtccccagcgc

SEQ ID NO: 879605 - DNA, 25 bp, Mus musculus
atacagaaatctctcggcgcttgtc

SEQ ID NO: 879606 - DNA, 25 bp, Mus musculus
atacagaaatctctgggcgcttgtc

SEQ ID NO: 879607 - DNA, 25 bp, Mus musculus
atacagaaatggcacgaaaggagaa

SEQ ID NO: 879608 - DNA, 25 bp, Mus musculus
atacagaaatggcaggaaaggagaa

SEQ ID NO: 879609 - DNA, 25 bp, Mus musculus
atacagaatattcacattgaagaaa

SEQ ID NO: 879610 - DNA, 25 bp, Mus musculus
atacagaatattcagattgaagaaa

SEQ ID NO: 879611 - DNA, 25 bp, Mus musculus
atacagacagaacgacagaaccatg

SEQ ID NO: 879612 - DNA, 25 bp, Mus musculus
atacagacagtacgacagaaccatg

SEQ ID NO: 879613 - DNA, 25 bp, Mus musculus
atacagagatacttcaccattgtgt

SEQ ID NO: 879614 - DNA, 25 bp, Mus musculus
atacagagattcttcaccattgtgt

SEQ ID NO: 879615 - DNA, 25 bp, Mus musculus
atacagattgcacacgatcttcaac

SEQ ID NO: 879616 - DNA, 25 bp, Mus musculus
atacagattgcacaggatcttcaac

SEQ ID NO: 879617 - DNA, 25 bp, Mus musculus
atacagattttgcgaacatcaacag

SEQ ID NO: 879618 - DNA, 25 bp, Mus musculus
atacagattttgggaacatcaacag

SEQ ID NO: 879619 - DNA, 25 bp, Mus musculus
atacagcaaagaagcagagaaaaac

SEQ ID NO: 879620 - DNA, 25 bp, Mus musculus
atacagcaaagaaggagagaaaaac

SEQ ID NO: 879621 - DNA, 25 bp, Mus musculus
atacagcaacagagcgctctgtcac

SEQ ID NO: 879622 - DNA, 25 bp, Mus musculus
atacagcaacagtgcgctctgtcac

SEQ ID NO: 879623 - DNA, 25 bp, Mus musculus
atacagccagagaagtgacagggaa

SEQ ID NO: 879624 - DNA, 25 bp, Mus musculus
atacagccagcaaacaaagcttagc

SEQ ID NO: 879625 - DNA, 25 bp, Mus musculus
atacagccagcaaggaatctgctat

SEQ ID NO: 879626 - DNA, 25 bp, Mus musculus
atacagccaggaaacaaagcttagc

SEQ ID NO: 879627 - DNA, 25 bp, Mus musculus
atacagccaggaactgagtgttcga

SEQ ID NO: 879628 - DNA, 25 bp, Mus musculus
atacagccaggaagaggtagatgac

SEQ ID NO: 879629 - DNA, 25 bp, Mus musculus
atacagccaggaaggaatctgctat

SEQ ID NO: 879630 - DNA, 25 bp, Mus musculus
atacagccaggatctgagtgttcga

SEQ ID NO: 879631 - DNA, 25 bp, Mus musculus
atacagccaggatgaggtagatgac

SEQ ID NO: 879632 - DNA, 25 bp, Mus musculus
atacagccagtgaagtgacagggaa

SEQ ID NO: 879633 - DNA, 25 bp, Mus musculus
atacaggactcaggaagatgagagg

SEQ ID NO: 879634 - DNA, 25 bp, Mus musculus
atacaggactcaggaaggttgatgg

SEQ ID NO: 879635 - DNA, 25 bp, Mus musculus
atacaggactcaggtagatgagagg

SEQ ID NO: 879636 - DNA, 25 bp, Mus musculus
atacaggactcaggtaggttgatgg

SEQ ID NO: 879637 - DNA, 25 bp, Mus musculus
atacagtaaatgcaagatcaagatc

SEQ ID NO: 879638 - DNA, 25 bp, Mus musculus
atacagtaaatggaagatcaagatc

SEQ ID NO: 879639 - DNA, 25 bp, Mus musculus
atacagtcctaactgtgacttggta

SEQ ID NO: 879640 - DNA, 25 bp, Mus musculus
atacagtcctaagtgtgacttggta

SEQ ID NO: 879641 - DNA, 25 bp, Mus musculus
atacagtctgcaggaagaaggacag

SEQ ID NO: 879642 - DNA, 25 bp, Mus musculus
atacagtctggaggaagaaggacag

SEQ ID NO: 879643 - DNA, 25 bp, Mus musculus
atacagtggaagcttacagtgctcc

SEQ ID NO: 879644 - DNA, 25 bp, Mus musculus
atacagtggaaggttacagtgctcc

SEQ ID NO: 879645 - DNA, 25 bp, Mus musculus
atacatgatctgcttctccacagca

SEQ ID NO: 879646 - DNA, 25 bp, Mus musculus
atacatgatctggttctccacagca

SEQ ID NO: 879647 - DNA, 25 bp, Mus musculus
atacatgcagcaaagaccagtgagg

SEQ ID NO: 879648 - DNA, 25 bp, Mus musculus
atacatgcaggaaagaccagtgagg

SEQ ID NO: 879649 - DNA, 25 bp, Mus musculus
atacatgctttgatctcccgcatgg

SEQ ID NO: 879650 - DNA, 25 bp, Mus musculus
atacatgctttgatgtcccgcatgg

SEQ ID NO: 879651 - DNA, 25 bp, Mus musculus
atacatggagcaggccatcatgaag

SEQ ID NO: 879652 - DNA, 25 bp, Mus musculus
atacatggaggaggccatcatgaag

SEQ ID NO: 879653 - DNA, 25 bp, Mus musculus
atacatggtgctacaccatgaggcc

SEQ ID NO: 879654 - DNA, 25 bp, Mus musculus
atacatggtggtacaccatgaggcc

SEQ ID NO: 879655 - DNA, 25 bp, Mus musculus
atacatgtcaagatgtgaatgagtg

SEQ ID NO: 879656 - DNA, 25 bp, Mus musculus
atacatgtcaagatgtggatgagtg

SEQ ID NO: 879657 - DNA, 25 bp, Mus musculus
atacatgtcaagcatcagtgaacac

SEQ ID NO: 879658 - DNA, 25 bp, Mus musculus
atacatgtcaaggatcagtgaacac

SEQ ID NO: 879659 - DNA, 25 bp, Mus musculus
atacatgtcaagttgtgaatgagtg

SEQ ID NO: 879660 - DNA, 25 bp, Mus musculus
atacatgtcaagttgtggatgagtg

SEQ ID NO: 879661 - DNA, 25 bp, Mus musculus
atacattaaccccatcatccccttt

SEQ ID NO: 879662 - DNA, 25 bp, Mus musculus
atacattaacccgatcatccccttt

SEQ ID NO: 879663 - DNA, 25 bp, Mus musculus
atacattatttacgtgcttactaaa

SEQ ID NO: 879664 - DNA, 25 bp, Mus musculus
atacattatttaggtgcttactaaa

SEQ ID NO: 879665 - DNA, 25 bp, Mus musculus
atacattcagcaagccgaaatgttg

SEQ ID NO: 879666 - DNA, 25 bp, Mus musculus
atacattcaggaagccgaaatgttg

SEQ ID NO: 879667 - DNA, 25 bp, Mus musculus
atacattttcaccgacaagccctca

SEQ ID NO: 879668 - DNA, 25 bp, Mus musculus
atacattttcacggacaagccctca

SEQ ID NO: 879669 - DNA, 25 bp, Mus musculus
ataccaaatgacttcaccttgaaag

SEQ ID NO: 879670 - DNA, 25 bp, Mus musculus
ataccaaatgtcttcaccttgaaag

SEQ ID NO: 879671 - DNA, 25 bp, Mus musculus
ataccaacagctccaacagactctg

SEQ ID NO: 879672 - DNA, 25 bp, Mus musculus
ataccaacaggtccaacagactctg

SEQ ID NO: 879673 - DNA, 25 bp, Mus musculus
ataccactctcccttcaacaggttc

SEQ ID NO: 879674 - DNA, 25 bp, Mus musculus
ataccactctccgttcaacaggttc

SEQ ID NO: 879675 - DNA, 25 bp, Mus musculus
ataccagaagagaaagtttcactgt

SEQ ID NO: 879676 - DNA, 25 bp, Mus musculus
ataccagaagcgcttcctaccacac

SEQ ID NO: 879677 - DNA, 25 bp, Mus musculus
ataccagaagggcttcctaccacac

SEQ ID NO: 879678 - DNA, 25 bp, Mus musculus
ataccagaagtgaaagtttcactgt

SEQ ID NO: 879679 - DNA, 25 bp, Mus musculus
ataccagaatgacgatcccagaaag

SEQ ID NO: 879680 - DNA, 25 bp, Mus musculus
ataccagaatgaggatcccagaaag

SEQ ID NO: 879681 - DNA, 25 bp, Mus musculus
ataccagatcaacgacttccgggag

SEQ ID NO: 879682 - DNA, 25 bp, Mus musculus
ataccagatcaaggacttccgggag

SEQ ID NO: 879683 - DNA, 25 bp, Mus musculus
ataccagatgccctataagtatctt

SEQ ID NO: 879684 - DNA, 25 bp, Mus musculus
ataccagatggcctataagtatctt

SEQ ID NO: 879685 - DNA, 25 bp, Mus musculus
ataccagccctcctggctgcaatat

SEQ ID NO: 879686 - DNA, 25 bp, Mus musculus
ataccagccctcgtggctgcaatat

SEQ ID NO: 879687 - DNA, 25 bp, Mus musculus
ataccagctttagtcctcaaaggcc

SEQ ID NO: 879688 - DNA, 25 bp, Mus musculus
ataccagctttagtgctcaaaggcc

SEQ ID NO: 879689 - DNA, 25 bp, Mus musculus
ataccagggaaactcggatctgttg

SEQ ID NO: 879690 - DNA, 25 bp, Mus musculus
ataccagggaaactgggatctgttg

SEQ ID NO: 879691 - DNA, 25 bp, Mus musculus
ataccagtgaaaagcctgcccagaa

SEQ ID NO: 879692 - DNA, 25 bp, Mus musculus
ataccagtgaaatgactgcccagaa

SEQ ID NO: 879693 - DNA, 25 bp, Mus musculus
ataccagtgaaatgcctgcccagaa

SEQ ID NO: 879694 - DNA, 25 bp, Mus musculus
ataccagtgaaatgtctgcccagaa

SEQ ID NO: 879695 - DNA, 25 bp, Mus musculus
ataccagtggccttcccgaggagca

SEQ ID NO: 879696 - DNA, 25 bp, Mus musculus
ataccagtgggcttcccgaggagca

SEQ ID NO: 879697 - DNA, 25 bp, Mus musculus
ataccatgagcctcaccatcaacgc

SEQ ID NO: 879698 - DNA, 25 bp, Mus musculus
ataccatgaggctcaccatcaacgc

SEQ ID NO: 879699 - DNA, 25 bp, Mus musculus
atacccaaagccaggagctgtgaat

SEQ ID NO: 879700 - DNA, 25 bp, Mus musculus
atacccaaaggcaggagctgtgaat

SEQ ID NO: 879701 - DNA, 25 bp, Mus musculus
atacccaattgtcgtctgccatctg

SEQ ID NO: 879702 - DNA, 25 bp, Mus musculus
atacccaattgtggtctgccatctg

SEQ ID NO: 879703 - DNA, 25 bp, Mus musculus
atacccaccccacggcaggaatgac

SEQ ID NO: 879704 - DNA, 25 bp, Mus musculus
atacccaccccagggcaggaatgac

SEQ ID NO: 879705 - DNA, 25 bp, Mus musculus
atacccagagccctgcaactcccac

SEQ ID NO: 879706 - DNA, 25 bp, Mus musculus
atacccagaggcctgcaactcccac

SEQ ID NO: 879707 - DNA, 25 bp, Mus musculus
atacccagcaatatcagttgtaagc

SEQ ID NO: 879708 - DNA, 25 bp, Mus musculus
atacccagcattatcagttgtaagc

SEQ ID NO: 879709 - DNA, 25 bp, Mus musculus
atacccagccaaagccctggactat

SEQ ID NO: 879710 - DNA, 25 bp, Mus musculus
atacccagccaatgccctggactat

SEQ ID NO: 879711 - DNA, 25 bp, Mus musculus
ataccccactagccaagcgtcctga

SEQ ID NO: 879712 - DNA, 25 bp, Mus musculus
ataccccacttgccaagcgtcctga

SEQ ID NO: 879713 - DNA, 25 bp, Mus musculus
ataccccatggacgtactaaagact

SEQ ID NO: 879714 - DNA, 25 bp, Mus musculus
ataccccatggaggtactaaagact

SEQ ID NO: 879715 - DNA, 25 bp, Mus musculus
atacccctctataaaactggtggtg

SEQ ID NO: 879716 - DNA, 25 bp, Mus musculus
atacccctctctggtggtggagctg

SEQ ID NO: 879717 - DNA, 25 bp, Mus musculus
atacccctctgtggtggtggagctg

SEQ ID NO: 879718 - DNA, 25 bp, Mus musculus
atacccctctttaaaactggtggtg

SEQ ID NO: 879719 - DNA, 25 bp, Mus musculus
ataccctaagaaggagtggaagact

SEQ ID NO: 879720 - DNA, 25 bp, Mus musculus
ataccctaagcagggagtggagaga

SEQ ID NO: 879721 - DNA, 25 bp, Mus musculus
ataccctaagcagtggaagactcct

SEQ ID NO: 879722 - DNA, 25 bp, Mus musculus
ataccctaagcgagtggagagaggc

SEQ ID NO: 879723 - DNA, 25 bp, Mus musculus
ataccctaaggagggagtggagaga

SEQ ID NO: 879724 - DNA, 25 bp, Mus musculus
ataccctaaggagtggaagactcct

SEQ ID NO: 879725 - DNA, 25 bp, Mus musculus
ataccctaagggagtggagagaggc

SEQ ID NO: 879726 - DNA, 25 bp, Mus musculus
ataccctaagtaggagtggaagact

SEQ ID NO: 879727 - DNA, 25 bp, Mus musculus
ataccgagacctctattttgaaggt

SEQ ID NO: 879728 - DNA, 25 bp, Mus musculus
ataccgagacctgtattttgaaggt

SEQ ID NO: 879729 - DNA, 25 bp, Mus musculus
ataccgagggcccatacaatcattc

SEQ ID NO: 879730 - DNA, 25 bp, Mus musculus
ataccgaggggccatacaatcattc

SEQ ID NO: 879731 - DNA, 25 bp, Mus musculus
ataccgctgcagcgtcccagcctca

SEQ ID NO: 879732 - DNA, 25 bp, Mus musculus
ataccgctgcagggtcccagcctca

SEQ ID NO: 879733 - DNA, 25 bp, Mus musculus
atacctacaaatcacaatgtttctc

SEQ ID NO: 879734 - DNA, 25 bp, Mus musculus
atacctacaaatcagaatgtttctc

SEQ ID NO: 879735 - DNA, 25 bp, Mus musculus
atacctcaagcgtgaggatcctttt

SEQ ID NO: 879736 - DNA, 25 bp, Mus musculus
atacctcaagggtgaggatcctttt

SEQ ID NO: 879737 - DNA, 25 bp, Mus musculus
atacctcgcacacaggaagtatggc

SEQ ID NO: 879738 - DNA, 25 bp, Mus musculus
atacctcgcacagaggaagtatggc

SEQ ID NO: 879739 - DNA, 25 bp, Mus musculus
atacctgaaacgcttcgcatcctca

SEQ ID NO: 879740 - DNA, 25 bp, Mus musculus
atacctgaaacggttcgcatcctca

SEQ ID NO: 879741 - DNA, 25 bp, Mus musculus
atacctgacaggcacgccaggagtg

SEQ ID NO: 879742 - DNA, 25 bp, Mus musculus
atacctgacaggcaggccaggagtg

SEQ ID NO: 879743 - DNA, 25 bp, Mus musculus
atacctgaccaccgtgattgggata

SEQ ID NO: 879744 - DNA, 25 bp, Mus musculus
atacctgaccaccgtttggctcctt

SEQ ID NO: 879745 - DNA, 25 bp, Mus musculus
atacctgaccacggtgattgggata

SEQ ID NO: 879746 - DNA, 25 bp, Mus musculus
atacctgaccacggtttggctcctt

SEQ ID NO: 879747 - DNA, 25 bp, Mus musculus
atacctgcacagacatcgatgagtg

SEQ ID NO: 879748 - DNA, 25 bp, Mus musculus
atacctgcacagtcatcgatgagtg

SEQ ID NO: 879749 - DNA, 25 bp, Mus musculus
ataccttcccaacctcatcagtggt

SEQ ID NO: 879750 - DNA, 25 bp, Mus musculus
ataccttcccaagctcatcagtggt

SEQ ID NO: 879751 - DNA, 25 bp, Mus musculus
atacgaagacatagattcatctaag

SEQ ID NO: 879752 - DNA, 25 bp, Mus musculus
atacgaagacattgattcatctaag

SEQ ID NO: 879753 - DNA, 25 bp, Mus musculus
atacgacagctgcctcctagctttc

SEQ ID NO: 879754 - DNA, 25 bp, Mus musculus
atacgacagctgcgctacttgatta

SEQ ID NO: 879755 - DNA, 25 bp, Mus musculus
atacgacagctggctcctagctttc

SEQ ID NO: 879756 - DNA, 25 bp, Mus musculus
atacgacagctgggctacttgatta

SEQ ID NO: 879757 - DNA, 25 bp, Mus musculus
atacgagccgcctgagcagctccac

SEQ ID NO: 879758 - DNA, 25 bp, Mus musculus
atacgagccggctgagcagctccac

SEQ ID NO: 879759 - DNA, 25 bp, Mus musculus
atacgatgagcggatcctttcagat

SEQ ID NO: 879760 - DNA, 25 bp, Mus musculus
atacgatgaggggatcctttcagat

SEQ ID NO: 879761 - DNA, 25 bp, Mus musculus
atacgcaacaggcgaaaacactgtc

SEQ ID NO: 879762 - DNA, 25 bp, Mus musculus
atacgcaacaggggaaaacactgtc

SEQ ID NO: 879763 - DNA, 25 bp, Mus musculus
atacgctggaagcccatgcgatgcc

SEQ ID NO: 879764 - DNA, 25 bp, Mus musculus
atacgctggaaggccatgcgatgcc

SEQ ID NO: 879765 - DNA, 25 bp, Mus musculus
atacggctcgcagacaccaaatgag

SEQ ID NO: 879766 - DNA, 25 bp, Mus musculus
atacggctcggagacaccaaatgag

SEQ ID NO: 879767 - DNA, 25 bp, Mus musculus
atacgtgcttggcgccgcctgtgag

SEQ ID NO: 879768 - DNA, 25 bp, Mus musculus
atacgtgcttggcggcgcctgtgag

SEQ ID NO: 879769 - DNA, 25 bp, Mus musculus
atacgttcgcaactcacggatgatt

SEQ ID NO: 879770 - DNA, 25 bp, Mus musculus
atacgttcgcaagtcacggatgatt

SEQ ID NO: 879771 - DNA, 25 bp, Mus musculus
atacgtttttcacaatgccggacac

SEQ ID NO: 879772 - DNA, 25 bp, Mus musculus
atacgtttttcagaatgccggacac

SEQ ID NO: 879773 - DNA, 25 bp, Mus musculus
atactaacagagcctgtggtggatt

SEQ ID NO: 879774 - DNA, 25 bp, Mus musculus
atactaacagaggctgtggtggatt

SEQ ID NO: 879775 - DNA, 25 bp, Mus musculus
atactaatttatcgcggaaccctct

SEQ ID NO: 879776 - DNA, 25 bp, Mus musculus
atactaatttatggcggaaccctct

SEQ ID NO: 879777 - DNA, 25 bp, Mus musculus
atactaccagcagagcaatggtcca

SEQ ID NO: 879778 - DNA, 25 bp, Mus musculus
atactaccaggagagcaatggtcca

SEQ ID NO: 879779 - DNA, 25 bp, Mus musculus
atactacctgattactatagcccag

SEQ ID NO: 879780 - DNA, 25 bp, Mus musculus
atactacctgtttactatagcccag

SEQ ID NO: 879781 - DNA, 25 bp, Mus musculus
atactacgttgaacacctcaaccag

SEQ ID NO: 879782 - DNA, 25 bp, Mus musculus
atactacgttgatcacctcaaccag

SEQ ID NO: 879783 - DNA, 25 bp, Mus musculus
atactatcgccaaatacctggacaa

SEQ ID NO: 879784 - DNA, 25 bp, Mus musculus
atactatcgccatatacctggacaa

SEQ ID NO: 879785 - DNA, 25 bp, Mus musculus
atactcaaagcgcagcacatgagcg

SEQ ID NO: 879786 - DNA, 25 bp, Mus musculus
atactcaaagctgttggggccactc

SEQ ID NO: 879787 - DNA, 25 bp, Mus musculus
atactcaaagggcagcacatgagcg

SEQ ID NO: 879788 - DNA, 25 bp, Mus musculus
atactcaaaggtgttggggccactc

SEQ ID NO: 879789 - DNA, 25 bp, Mus musculus
atactcacagaaagaagaatcctca

SEQ ID NO: 879790 - DNA, 25 bp, Mus musculus
atactcacagtaagaagaatcctca

SEQ ID NO: 879791 - DNA, 25 bp, Mus musculus
atactcatctcacggctgtccaaga

SEQ ID NO: 879792 - DNA, 25 bp, Mus musculus
atactcatctcagggctgtccaaga

SEQ ID NO: 879793 - DNA, 25 bp, Mus musculus
atactcatttgttccgttcagttcc

SEQ ID NO: 879794 - DNA, 25 bp, Mus musculus
atactcatttgttcggttcagttcc

SEQ ID NO: 879795 - DNA, 25 bp, Mus musculus
atactccgccaacctggataatgcc

SEQ ID NO: 879796 - DNA, 25 bp, Mus musculus
atactccgccaagctggataatgcc

SEQ ID NO: 879797 - DNA, 25 bp, Mus musculus
atactcgagccacgttctctccact

SEQ ID NO: 879798 - DNA, 25 bp, Mus musculus
atactcgagccaggttctctccact

SEQ ID NO: 879799 - DNA, 25 bp, Mus musculus
atactctactagaacttggagaaat

SEQ ID NO: 879800 - DNA, 25 bp, Mus musculus
atactctacttgaacttggagaaat

SEQ ID NO: 879801 - DNA, 25 bp, Mus musculus
atactgatacagccgctgcagctgc

SEQ ID NO: 879802 - DNA, 25 bp, Mus musculus
atactgatacaggcgctgcagctgc

SEQ ID NO: 879803 - DNA, 25 bp, Mus musculus
atactgcttaagtatttttctgacc

SEQ ID NO: 879804 - DNA, 25 bp, Mus musculus
atactgcttatgtatttttctgacc

SEQ ID NO: 879805 - DNA, 25 bp, Mus musculus
atactgcttgtacgagacttatgac

SEQ ID NO: 879806 - DNA, 25 bp, Mus musculus
atactgcttgtaggagacttatgac

SEQ ID NO: 879807 - DNA, 25 bp, Mus musculus
atactggaagaagaaacagtcaagt

SEQ ID NO: 879808 - DNA, 25 bp, Mus musculus
atactggaagtagaaacagtcaagt

SEQ ID NO: 879809 - DNA, 25 bp, Mus musculus
atactggatatgaacgggctgaaga

SEQ ID NO: 879810 - DNA, 25 bp, Mus musculus
atactggatatgaaggggctgaaga

SEQ ID NO: 879811 - DNA, 25 bp, Mus musculus
atactggtgcctattcccccacaga

SEQ ID NO: 879812 - DNA, 25 bp, Mus musculus
atactggtgccttttcccccacaga

SEQ ID NO: 879813 - DNA, 25 bp, Mus musculus
atactgtgacagcagggctggcggc

SEQ ID NO: 879814 - DNA, 25 bp, Mus musculus
atactgtgacaggagggctggcggc

SEQ ID NO: 879815 - DNA, 25 bp, Mus musculus
atactgtgagctcgcccagtcctcc

SEQ ID NO: 879816 - DNA, 25 bp, Mus musculus
atactgtgagctcgttcacccaccc

SEQ ID NO: 879817 - DNA, 25 bp, Mus musculus
atactgtgagctggcccagtcctcc

SEQ ID NO: 879818 - DNA, 25 bp, Mus musculus
atactgtgagctggttcacccaccc

SEQ ID NO: 879819 - DNA, 25 bp, Mus musculus
atacttaagagtatctgtgtcccgg

SEQ ID NO: 879820 - DNA, 25 bp, Mus musculus
atacttaagagtttctgtgtcccgg

SEQ ID NO: 879821 - DNA, 25 bp, Mus musculus
atacttagacagctatccattatga

SEQ ID NO: 879822 - DNA, 25 bp, Mus musculus
atacttagacaggtatccattatga

SEQ ID NO: 879823 - DNA, 25 bp, Mus musculus
atacttcttcaataaacctactgaa

SEQ ID NO: 879824 - DNA, 25 bp, Mus musculus
atacttcttcaatatacctactgaa

SEQ ID NO: 879825 - DNA, 25 bp, Mus musculus
atactttgtgaaaatcctgagtcgc

SEQ ID NO: 879826 - DNA, 25 bp, Mus musculus
atactttgtgaatatcctgagtcgc

SEQ ID NO: 879827 - DNA, 25 bp, Mus musculus
atagaaaaatacatatcgatttacc

SEQ ID NO: 879828 - DNA, 25 bp, Mus musculus
atagaaaaatacttatcgatttacc

SEQ ID NO: 879829 - DNA, 25 bp, Mus musculus
atagaaacctcaaaacacaggcaga

SEQ ID NO: 879830 - DNA, 25 bp, Mus musculus
atagaaacctgaaaacacaggcaga

SEQ ID NO: 879831 - DNA, 25 bp, Mus musculus
atagaaagcaatgacgattctgatc

SEQ ID NO: 879832 - DNA, 25 bp, Mus musculus
atagaaagcaatgaggattctgatc

SEQ ID NO: 879833 - DNA, 25 bp, Mus musculus
atagaaatgcaaaacgaccctgata

SEQ ID NO: 879834 - DNA, 25 bp, Mus musculus
atagaaatgcaaaaggaccctgata

SEQ ID NO: 879835 - DNA, 25 bp, Mus musculus
atagaacaattaaacctttttgatg

SEQ ID NO: 879836 - DNA, 25 bp, Mus musculus
atagaacaattaaagctttttgatg

SEQ ID NO: 879837 - DNA, 25 bp, Mus musculus
atagaactggccgtgcggcctcact

SEQ ID NO: 879838 - DNA, 25 bp, Mus musculus
atagaactgggcgtgcggcctcact

SEQ ID NO: 879839 - DNA, 25 bp, Mus musculus
atagaagatgattcaggatttggaa

SEQ ID NO: 879840 - DNA, 25 bp, Mus musculus
atagaagatgattctggatttggaa

SEQ ID NO: 879841 - DNA, 25 bp, Mus musculus
atagaaggaaggagagcagtgagga

SEQ ID NO: 879842 - DNA, 25 bp, Mus musculus
atagaaggaaggtgagcagtgagga

SEQ ID NO: 879843 - DNA, 25 bp, Mus musculus
atagaattacgcacacccacaacag

SEQ ID NO: 879844 - DNA, 25 bp, Mus musculus
atagaattacgctcacccacaacag

SEQ ID NO: 879845 - DNA, 25 bp, Mus musculus
atagacacagaaacagctatgaagg

SEQ ID NO: 879846 - DNA, 25 bp, Mus musculus
atagacacagtaacagctatgaagg

SEQ ID NO: 879847 - DNA, 25 bp, Mus musculus
atagacatgaggcgatgaaggtctt

SEQ ID NO: 879848 - DNA, 25 bp, Mus musculus
atagacatgaggggatgaaggtctt

SEQ ID NO: 879849 - DNA, 25 bp, Mus musculus
atagacccccagccaggaagttatg

SEQ ID NO: 879850 - DNA, 25 bp, Mus musculus
atagacccccaggcaggaagttatg

SEQ ID NO: 879851 - DNA, 25 bp, Mus musculus
atagactccgtacgggctgaggatg

SEQ ID NO: 879852 - DNA, 25 bp, Mus musculus
atagactccgtaggggctgaggatg

SEQ ID NO: 879853 - DNA, 25 bp, Mus musculus
atagacttcaggaataaagtggtga

SEQ ID NO: 879854 - DNA, 25 bp, Mus musculus
atagacttcaggtataaagtggtga

SEQ ID NO: 879855 - DNA, 25 bp, Mus musculus
atagagaaagagccagaaatcctga

SEQ ID NO: 879856 - DNA, 25 bp, Mus musculus
atagagaaagaggcagaaatcctga

SEQ ID NO: 879857 - DNA, 25 bp, Mus musculus
atagagaagtatcagtcaactgtca

SEQ ID NO: 879858 - DNA, 25 bp, Mus musculus
atagagaagtatgagtcaactgtca

SEQ ID NO: 879859 - DNA, 25 bp, Mus musculus
atagagcaagctatcgatctggtga

SEQ ID NO: 879860 - DNA, 25 bp, Mus musculus
atagagcaagctatggatctggtga

SEQ ID NO: 879861 - DNA, 25 bp, Mus musculus
atagagcaggtaaactaccaaatat

SEQ ID NO: 879862 - DNA, 25 bp, Mus musculus
atagagcaggtaaagtaccaaatat

SEQ ID NO: 879863 - DNA, 25 bp, Mus musculus
atagaggacaagccccagatcttgc

SEQ ID NO: 879864 - DNA, 25 bp, Mus musculus
atagaggacaaggcccagatcttgc

SEQ ID NO: 879865 - DNA, 25 bp, Mus musculus
atagaggaggtgcacaatgtggacg

SEQ ID NO: 879866 - DNA, 25 bp, Mus musculus
atagaggaggtgcagaatgtggacg

SEQ ID NO: 879867 - DNA, 25 bp, Mus musculus
atagataaagaacatttaatcactt

SEQ ID NO: 879868 - DNA, 25 bp, Mus musculus
atagataaagaagatttaatcactt

SEQ ID NO: 879869 - DNA, 25 bp, Mus musculus
atagataatgcaatattttggattt

SEQ ID NO: 879870 - DNA, 25 bp, Mus musculus
atagataatggaatattttggattt

SEQ ID NO: 879871 - DNA, 25 bp, Mus musculus
atagatatcccgaactatgtgctca

SEQ ID NO: 879872 - DNA, 25 bp, Mus musculus
atagatatccggaactatgtgctca

SEQ ID NO: 879873 - DNA, 25 bp, Mus musculus
atagatcatatacacgagcagtaca

SEQ ID NO: 879874 - DNA, 25 bp, Mus musculus
atagatcatatacaggagcagtaca

SEQ ID NO: 879875 - DNA, 25 bp, Mus musculus
atagatccccagagactttgcaatt

SEQ ID NO: 879876 - DNA, 25 bp, Mus musculus
atagatccccagtgactttgcaatt

SEQ ID NO: 879877 - DNA, 25 bp, Mus musculus
atagatgcaaagccagaagaagagt

SEQ ID NO: 879878 - DNA, 25 bp, Mus musculus
atagatgcaaaggcagaagaagagt

SEQ ID NO: 879879 - DNA, 25 bp, Mus musculus
atagatgcccccatgtacatggatc

SEQ ID NO: 879880 - DNA, 25 bp, Mus musculus
atagatgcccgcatgtacatggatc

SEQ ID NO: 879881 - DNA, 25 bp, Mus musculus
atagatgctattcgtggccgtcggt

SEQ ID NO: 879882 - DNA, 25 bp, Mus musculus
atagatgctattggtggccgtcggt

SEQ ID NO: 879883 - DNA, 25 bp, Mus musculus
atagatggcattgaaggtgaccgag

SEQ ID NO: 879884 - DNA, 25 bp, Mus musculus
atagatggcattgatggtgaccgag

SEQ ID NO: 879885 - DNA, 25 bp, Mus musculus
atagatggcgaccgaatacgaaatg

SEQ ID NO: 879886 - DNA, 25 bp, Mus musculus
atagatggcgacggaatacgaaatg

SEQ ID NO: 879887 - DNA, 25 bp, Mus musculus
atagcaacctatttcactgcttcat

SEQ ID NO: 879888 - DNA, 25 bp, Mus musculus
atagcaacctatttgactgcttcat

SEQ ID NO: 879889 - DNA, 25 bp, Mus musculus
atagcaattaagcaactagaggctg

SEQ ID NO: 879890 - DNA, 25 bp, Mus musculus
atagcaattaagcgagtggccaggt

SEQ ID NO: 879891 - DNA, 25 bp, Mus musculus
atagcaattaaggaactagaggctg

SEQ ID NO: 879892 - DNA, 25 bp, Mus musculus
atagcaattaagggagtggccaggt

SEQ ID NO: 879893 - DNA, 25 bp, Mus musculus
atagcagacatgaacgcctttgttg

SEQ ID NO: 879894 - DNA, 25 bp, Mus musculus
atagcagacatgaaggcctttgttg

SEQ ID NO: 879895 - DNA, 25 bp, Mus musculus
atagcagccattaagctgcaggacc

SEQ ID NO: 879896 - DNA, 25 bp, Mus musculus
atagcagccatttagctgcaggacc

SEQ ID NO: 879897 - DNA, 25 bp, Mus musculus
atagcagcttggctcttgacgaagt

SEQ ID NO: 879898 - DNA, 25 bp, Mus musculus
atagcagcttgggtcttgacgaagt

SEQ ID NO: 879899 - DNA, 25 bp, Mus musculus
atagcatcagccactgttgtaggcg

SEQ ID NO: 879900 - DNA, 25 bp, Mus musculus
atagcatcaggcactgttgtaggcg

SEQ ID NO: 879901 - DNA, 25 bp, Mus musculus
atagcatcttctaacgttttccatt

SEQ ID NO: 879902 - DNA, 25 bp, Mus musculus
atagcatcttctaaggttttccatt

SEQ ID NO: 879903 - DNA, 25 bp, Mus musculus
atagcccactgacaggagcttccag

SEQ ID NO: 879904 - DNA, 25 bp, Mus musculus
atagcccactgagaggagcttccag

SEQ ID NO: 879905 - DNA, 25 bp, Mus musculus
atagcccagcagatgatgccagaag

SEQ ID NO: 879906 - DNA, 25 bp, Mus musculus
atagcccagcagttgatgccagaag

SEQ ID NO: 879907 - DNA, 25 bp, Mus musculus
atagcccggtttcacttgagagcac

SEQ ID NO: 879908 - DNA, 25 bp, Mus musculus
atagcccggtttcagttgagagcac

SEQ ID NO: 879909 - DNA, 25 bp, Mus musculus
atagcctgctcggtccaccataagt

SEQ ID NO: 879910 - DNA, 25 bp, Mus musculus
atagcctgctgggtccaccataagt

SEQ ID NO: 879911 - DNA, 25 bp, Mus musculus
atagcgcgctttgacggcctgaaga

SEQ ID NO: 879912 - DNA, 25 bp, Mus musculus
atagcgcgctttgagggcctgaaga

SEQ ID NO: 879913 - DNA, 25 bp, Mus musculus
atagctacaacaaccgccgagacct

SEQ ID NO: 879914 - DNA, 25 bp, Mus musculus
atagctacaacatccgccgagacct

SEQ ID NO: 879915 - DNA, 25 bp, Mus musculus
atagctccacatcaactcacagaag

SEQ ID NO: 879916 - DNA, 25 bp, Mus musculus
atagctccacatcacattctctggc

SEQ ID NO: 879917 - DNA, 25 bp, Mus musculus
atagctccacatcccatttaccaat

SEQ ID NO: 879918 - DNA, 25 bp, Mus musculus
atagctccacatgaactcacagaag

SEQ ID NO: 879919 - DNA, 25 bp, Mus musculus
atagctccacatgacattctctggc

SEQ ID NO: 879920 - DNA, 25 bp, Mus musculus
atagctccacatgccatttaccaat

SEQ ID NO: 879921 - DNA, 25 bp, Mus musculus
atagctcgccagcgcgaagattgtc

SEQ ID NO: 879922 - DNA, 25 bp, Mus musculus
atagctcgccagggcgaagattgtc

SEQ ID NO: 879923 - DNA, 25 bp, Mus musculus
atagctcgccaggtcggcgaagatt

SEQ ID NO: 879924 - DNA, 25 bp, Mus musculus
atagctcgccaggtgggcgaagatt

SEQ ID NO: 879925 - DNA, 25 bp, Mus musculus
atagctgatgaagtcgacctgacat

SEQ ID NO: 879926 - DNA, 25 bp, Mus musculus
atagctgatgaagtggacctgacat

SEQ ID NO: 879927 - DNA, 25 bp, Mus musculus
atagctgccgcagcaaaagccacag

SEQ ID NO: 879928 - DNA, 25 bp, Mus musculus
atagctgccgcagcaccacaggaaa

SEQ ID NO: 879929 - DNA, 25 bp, Mus musculus
atagctgccgcagctaaagccacag

SEQ ID NO: 879930 - DNA, 25 bp, Mus musculus
atagctgccgcagctccacaggaaa

SEQ ID NO: 879931 - DNA, 25 bp, Mus musculus
atagctgcgaagcctctgaggatga

SEQ ID NO: 879932 - DNA, 25 bp, Mus musculus
atagctgcgaaggctctgaggatga

SEQ ID NO: 879933 - DNA, 25 bp, Mus musculus
ataggaagcaccctgatgcagtcca

SEQ ID NO: 879934 - DNA, 25 bp, Mus musculus
ataggaagcagcctgatgcagtcca

SEQ ID NO: 879935 - DNA, 25 bp, Mus musculus
ataggaagtgtgtgcacatcaatga

SEQ ID NO: 879936 - DNA, 25 bp, Mus musculus
ataggaagtgtgtggacatcaatga

SEQ ID NO: 879937 - DNA, 25 bp, Mus musculus
ataggacactaccaacagcacatta

SEQ ID NO: 879938 - DNA, 25 bp, Mus musculus
ataggacactacgaacagcacatta

SEQ ID NO: 879939 - DNA, 25 bp, Mus musculus
ataggacagaagaagagaactccaa

SEQ ID NO: 879940 - DNA, 25 bp, Mus musculus
ataggacagaagtagagaactccaa

SEQ ID NO: 879941 - DNA, 25 bp, Mus musculus
ataggacgaccagacgagctgtctg

SEQ ID NO: 879942 - DNA, 25 bp, Mus musculus
ataggacgaccagaggagctgtctg

SEQ ID NO: 879943 - DNA, 25 bp, Mus musculus
ataggaggcgctaaccatagagatg

SEQ ID NO: 879944 - DNA, 25 bp, Mus musculus
ataggaggcggtaaccatagagatg

SEQ ID NO: 879945 - DNA, 25 bp, Mus musculus
ataggatccctgcagtccctggctc

SEQ ID NO: 879946 - DNA, 25 bp, Mus musculus
ataggatccctggagtccctggctc

SEQ ID NO: 879947 - DNA, 25 bp, Mus musculus
ataggattccagcagtccctggctc

SEQ ID NO: 879948 - DNA, 25 bp, Mus musculus
ataggattccaggagtccctggctc

SEQ ID NO: 879949 - DNA, 25 bp, Mus musculus
ataggcaaggcgcgcctggtgatgt

SEQ ID NO: 879950 - DNA, 25 bp, Mus musculus
ataggcaaggcgggcctggtgatgt

SEQ ID NO: 879951 - DNA, 25 bp, Mus musculus
ataggcagagcagctccatcagcag

SEQ ID NO: 879952 - DNA, 25 bp, Mus musculus
ataggcagagctcagtaccatgaat

SEQ ID NO: 879953 - DNA, 25 bp, Mus musculus
ataggcagaggagctccatcagcag

SEQ ID NO: 879954 - DNA, 25 bp, Mus musculus
ataggcagaggtcagtaccatgaat

SEQ ID NO: 879955 - DNA, 25 bp, Mus musculus
atagggacggctctgcctgaatcca

SEQ ID NO: 879956 - DNA, 25 bp, Mus musculus
atagggacgggtctgcctgaatcca

SEQ ID NO: 879957 - DNA, 25 bp, Mus musculus
ataggggagaagcacaccatggtga

SEQ ID NO: 879958 - DNA, 25 bp, Mus musculus
ataggggagaagcagaccatggtga

SEQ ID NO: 879959 - DNA, 25 bp, Mus musculus
ataggtacagatctgacacaacacc

SEQ ID NO: 879960 - DNA, 25 bp, Mus musculus
ataggtacagttctgacacaacacc

SEQ ID NO: 879961 - DNA, 25 bp, Mus musculus
ataggtcaggcctgtgtctcgtgtc

SEQ ID NO: 879962 - DNA, 25 bp, Mus musculus
ataggtcagggctgtgtctcgtgtc

SEQ ID NO: 879963 - DNA, 25 bp, Mus musculus
ataggtctcccacgtgacccaggcc

SEQ ID NO: 879964 - DNA, 25 bp, Mus musculus
ataggtctcccaggtgacccaggcc

SEQ ID NO: 879965 - DNA, 25 bp, Mus musculus
ataggttctgggaactgcgaaatca

SEQ ID NO: 879966 - DNA, 25 bp, Mus musculus
ataggttctgggaagtgcgaaatca

SEQ ID NO: 879967 - DNA, 25 bp, Mus musculus
atagtaagaaagatcgagctgcaag

SEQ ID NO: 879968 - DNA, 25 bp, Mus musculus
atagtaagaaagttcgagctgcaag

SEQ ID NO: 879969 - DNA, 25 bp, Mus musculus
atagtaggagaacgtgtgggcagaa

SEQ ID NO: 879970 - DNA, 25 bp, Mus musculus
atagtaggagaaggtgtgggcagaa

SEQ ID NO: 879971 - DNA, 25 bp, Mus musculus
atagtcaaagagagtgttgatggag

SEQ ID NO: 879972 - DNA, 25 bp, Mus musculus
atagtcaaagagtgtgttgatggag

SEQ ID NO: 879973 - DNA, 25 bp, Mus musculus
atagtcacagagctctttgctgtga

SEQ ID NO: 879974 - DNA, 25 bp, Mus musculus
atagtcacagccccgacctgtttga

SEQ ID NO: 879975 - DNA, 25 bp, Mus musculus
atagtcacaggcccgacctgtttga

SEQ ID NO: 879976 - DNA, 25 bp, Mus musculus
atagtcacagtgctctttgctgtga

SEQ ID NO: 879977 - DNA, 25 bp, Mus musculus
atagtcattttcatcatcacaaaat

SEQ ID NO: 879978 - DNA, 25 bp, Mus musculus
atagtcattttcatgatcacaaaat

SEQ ID NO: 879979 - DNA, 25 bp, Mus musculus
atagtccactgcatagaacagcgtc

SEQ ID NO: 879980 - DNA, 25 bp, Mus musculus
atagtccactgcattgaacagcgtc

SEQ ID NO: 879981 - DNA, 25 bp, Mus musculus
atagtccttatgagtggcaaatgca

SEQ ID NO: 879982 - DNA, 25 bp, Mus musculus
atagtccttatgtgtggcaaatgca

SEQ ID NO: 879983 - DNA, 25 bp, Mus musculus
atagtcgcattgcttctattgtggg

SEQ ID NO: 879984 - DNA, 25 bp, Mus musculus
atagtcgcattggttctattgtggg

SEQ ID NO: 879985 - DNA, 25 bp, Mus musculus
atagtgaacaaacctgaactctctg

SEQ ID NO: 879986 - DNA, 25 bp, Mus musculus
atagtgaacaaagctgaactctctg

SEQ ID NO: 879987 - DNA, 25 bp, Mus musculus
atagtgctagatgacgcagataaat

SEQ ID NO: 879988 - DNA, 25 bp, Mus musculus
atagtgctagatgaggcagataaat

SEQ ID NO: 879989 - DNA, 25 bp, Mus musculus
atagtggctgcacagaatgatgtca

SEQ ID NO: 879990 - DNA, 25 bp, Mus musculus
atagtggctgcagagaatgatgtca

SEQ ID NO: 879991 - DNA, 25 bp, Mus musculus
atagtgttatgaattgattccacgg

SEQ ID NO: 879992 - DNA, 25 bp, Mus musculus
atagtgttatgatttgattccacgg

SEQ ID NO: 879993 - DNA, 25 bp, Mus musculus
atagtgttctgtagttattttcctt

SEQ ID NO: 879994 - DNA, 25 bp, Mus musculus
atagtgttctgttgttattttcctt

SEQ ID NO: 879995 - DNA, 25 bp, Mus musculus
atagttactgcaccgagaagagtcc

SEQ ID NO: 879996 - DNA, 25 bp, Mus musculus
atagttactgcagcgagaagagtcc

SEQ ID NO: 879997 - DNA, 25 bp, Mus musculus
atagttgatgtgatagagaaaagga

SEQ ID NO: 879998 - DNA, 25 bp, Mus musculus
atagttgatgtgttagagaaaagga

SEQ ID NO: 879999 - DNA, 25 bp, Mus musculus
atagtttctctgccagagtgcttca

SEQ ID NO: 880000 - DNA, 25 bp, Mus musculus
atagtttctctgcctgagtgcttca

SEQ ID NO: 880001 - DNA, 25 bp, Mus musculus
atataaactcaacccaggaaccatg

SEQ ID NO: 880002 - DNA, 25 bp, Mus musculus
atataaactcaacggctcgggccat

SEQ ID NO: 880003 - DNA, 25 bp, Mus musculus
atataaactcaagccaggaaccatg

SEQ ID NO: 880004 - DNA, 25 bp, Mus musculus
atataaactcaagggctcgggccat

SEQ ID NO: 880005 - DNA, 25 bp, Mus musculus
atataaagagccttgcacagcatat

SEQ ID NO: 880006 - DNA, 25 bp, Mus musculus
atataaagaggcttgcacagcatat

SEQ ID NO: 880007 - DNA, 25 bp, Mus musculus
atataacatgcacatattcagtgaa

SEQ ID NO: 880008 - DNA, 25 bp, Mus musculus
atataacatgcagatattcagtgaa

SEQ ID NO: 880009 - DNA, 25 bp, Mus musculus
atataatcccaaccgatttgctgca

SEQ ID NO: 880010 - DNA, 25 bp, Mus musculus
atataatcccaagcgatttgctgca

SEQ ID NO: 880011 - DNA, 25 bp, Mus musculus
atatacaaagccagtttgaggaaga

SEQ ID NO: 880012 - DNA, 25 bp, Mus musculus
atatacaaaggcagtttgaggaaga

SEQ ID NO: 880013 - DNA, 25 bp, Mus musculus
atatacatggtgctacaccatgagg

SEQ ID NO: 880014 - DNA, 25 bp, Mus musculus
atatacatggtggtacaccatgagg

SEQ ID NO: 880015 - DNA, 25 bp, Mus musculus
atatacattatttacgtgcttacta

SEQ ID NO: 880016 - DNA, 25 bp, Mus musculus
atatacattatttaggtgcttacta

SEQ ID NO: 880017 - DNA, 25 bp, Mus musculus
atatacccagatccagacttcaggg

SEQ ID NO: 880018 - DNA, 25 bp, Mus musculus
atatacccagttccagacttcaggg

SEQ ID NO: 880019 - DNA, 25 bp, Mus musculus
atataccccatggacgtactaaaga

SEQ ID NO: 880020 - DNA, 25 bp, Mus musculus
atataccccatggaggtactaaaga

SEQ ID NO: 880021 - DNA, 25 bp, Mus musculus
atatactcaaagcgcagcacatgag

SEQ ID NO: 880022 - DNA, 25 bp, Mus musculus
atatactcaaagctgttggggccac

SEQ ID NO: 880023 - DNA, 25 bp, Mus musculus
atatactcaaagggcagcacatgag

SEQ ID NO: 880024 - DNA, 25 bp, Mus musculus
atatactcaaaggtgttggggccac

SEQ ID NO: 880025 - DNA, 25 bp, Mus musculus
atataggacactaccaacagcacat

SEQ ID NO: 880026 - DNA, 25 bp, Mus musculus
atataggacactacgaacagcacat

SEQ ID NO: 880027 - DNA, 25 bp, Mus musculus
atatataaagagccttgcacagcat

SEQ ID NO: 880028 - DNA, 25 bp, Mus musculus
atatataaagaggcttgcacagcat

SEQ ID NO: 880029 - DNA, 25 bp, Mus musculus
atatattatgcgtgtgctggataca

SEQ ID NO: 880030 - DNA, 25 bp, Mus musculus
atatattatgggtgtgctggataca

SEQ ID NO: 880031 - DNA, 25 bp, Mus musculus
atatattcgggacgacatagaatgg

SEQ ID NO: 880032 - DNA, 25 bp, Mus musculus
atatattcgggaggacatagaatgg

SEQ ID NO: 880033 - DNA, 25 bp, Mus musculus
atatattttattaatttcagtaatg

SEQ ID NO: 880034 - DNA, 25 bp, Mus musculus
atatattttatttatttcagtaatg

SEQ ID NO: 880035 - DNA, 25 bp, Mus musculus
atatcaaaccagatggcaccaacca

SEQ ID NO: 880036 - DNA, 25 bp, Mus musculus
atatcaaaccagttggcaccaacca

SEQ ID NO: 880037 - DNA, 25 bp, Mus musculus
atatcaacaagacacaaggtgaaga

SEQ ID NO: 880038 - DNA, 25 bp, Mus musculus
atatcaacaagacagaaggtgaaga

SEQ ID NO: 880039 - DNA, 25 bp, Mus musculus
atatcaacagcccacgtggtgtggt

SEQ ID NO: 880040 - DNA, 25 bp, Mus musculus
atatcaacagcccaggtggtgtggt

SEQ ID NO: 880041 - DNA, 25 bp, Mus musculus
atatcacacaaaaattccagaggtt

SEQ ID NO: 880042 - DNA, 25 bp, Mus musculus
atatcacacaaacacccacagttat

SEQ ID NO: 880043 - DNA, 25 bp, Mus musculus
atatcacacaaagacccacagttat

SEQ ID NO: 880044 - DNA, 25 bp, Mus musculus
atatcacacaaatattccagaggtt

SEQ ID NO: 880045 - DNA, 25 bp, Mus musculus
atatcaccaaagacctgaaggggaa

SEQ ID NO: 880046 - DNA, 25 bp, Mus musculus
atatcaccaaagctgaaaggggtct

SEQ ID NO: 880047 - DNA, 25 bp, Mus musculus
atatcaccaaaggtgaaaggggtct

SEQ ID NO: 880048 - DNA, 25 bp, Mus musculus
atatcaccaaagtcctgaaggggaa

SEQ ID NO: 880049 - DNA, 25 bp, Mus musculus
atatcactactgaggtcgtgcagac

SEQ ID NO: 880050 - DNA, 25 bp, Mus musculus
atatcactactgcggaaacaggcac

SEQ ID NO: 880051 - DNA, 25 bp, Mus musculus
atatcactactggggaaacaggcac

SEQ ID NO: 880052 - DNA, 25 bp, Mus musculus
atatcactactgtggtcgtgcagac

SEQ ID NO: 880053 - DNA, 25 bp, Mus musculus
atatcactgacaagaccaatgccct

SEQ ID NO: 880054 - DNA, 25 bp, Mus musculus
atatcactgacatgaccaatgccct

SEQ ID NO: 880055 - DNA, 25 bp, Mus musculus
atatcagcccagctgccctccctgg

SEQ ID NO: 880056 - DNA, 25 bp, Mus musculus
atatcagcccaggtgccctccctgg

SEQ ID NO: 880057 - DNA, 25 bp, Mus musculus
atatcagggctcaacgaggtagatg

SEQ ID NO: 880058 - DNA, 25 bp, Mus musculus
atatcagggctcaaggaggtagatg

SEQ ID NO: 880059 - DNA, 25 bp, Mus musculus
atatcagtgaagcgtgacaaaggtg

SEQ ID NO: 880060 - DNA, 25 bp, Mus musculus
atatcagtgaagggtgacaaaggtg

SEQ ID NO: 880061 - DNA, 25 bp, Mus musculus
atatcatatctgcccatcagacact

SEQ ID NO: 880062 - DNA, 25 bp, Mus musculus
atatcatatctggccatcagacact

SEQ ID NO: 880063 - DNA, 25 bp, Mus musculus
atatcattagcaacgctgttcctgg

SEQ ID NO: 880064 - DNA, 25 bp, Mus musculus
atatcattagcatcgctgttcctgg

SEQ ID NO: 880065 - DNA, 25 bp, Mus musculus
atatccaaagcgctacaaacctcct

SEQ ID NO: 880066 - DNA, 25 bp, Mus musculus
atatccaaagggctacaaacctcct

SEQ ID NO: 880067 - DNA, 25 bp, Mus musculus
atatccagcagacatgttcagcctg

SEQ ID NO: 880068 - DNA, 25 bp, Mus musculus
atatccagcagagatgttcagcctg

SEQ ID NO: 880069 - DNA, 25 bp, Mus musculus
atatccgaaagcagagtgtggacca

SEQ ID NO: 880070 - DNA, 25 bp, Mus musculus
atatccgaaagcagtgtgtggacca

SEQ ID NO: 880071 - DNA, 25 bp, Mus musculus
atatcctcagagtttgtgcctgtcc

SEQ ID NO: 880072 - DNA, 25 bp, Mus musculus
atatcctcagtgtttgtgcctgtcc

SEQ ID NO: 880073 - DNA, 25 bp, Mus musculus
atatccttccagatgtatcgggata

SEQ ID NO: 880074 - DNA, 25 bp, Mus musculus
atatccttccagatgtatctggata

SEQ ID NO: 880075 - DNA, 25 bp, Mus musculus
atatccttccagttgtatcgggata

SEQ ID NO: 880076 - DNA, 25 bp, Mus musculus
atatccttccagttgtatctggata

SEQ ID NO: 880077 - DNA, 25 bp, Mus musculus
atatccttctagagttgggcaacca

SEQ ID NO: 880078 - DNA, 25 bp, Mus musculus
atatccttctagtgttgggcaacca

SEQ ID NO: 880079 - DNA, 25 bp, Mus musculus
atatcgtcctgcgcactttgagcgc

SEQ ID NO: 880080 - DNA, 25 bp, Mus musculus
atatcgtcctgcgctctttgagcgc

SEQ ID NO: 880081 - DNA, 25 bp, Mus musculus
atatctaaccagcagatagtctaca

SEQ ID NO: 880082 - DNA, 25 bp, Mus musculus
atatctaaccaggagatagtctaca

SEQ ID NO: 880083 - DNA, 25 bp, Mus musculus
atatctcaacaacgcacggcagctc

SEQ ID NO: 880084 - DNA, 25 bp, Mus musculus
atatctcaacaaggcacggcagctc

SEQ ID NO: 880085 - DNA, 25 bp, Mus musculus
atatctccagaatcctaaggactgc

SEQ ID NO: 880086 - DNA, 25 bp, Mus musculus
atatctccagtatcctaaggactgc

SEQ ID NO: 880087 - DNA, 25 bp, Mus musculus
atatctgaagcgcgagaatcctttc

SEQ ID NO: 880088 - DNA, 25 bp, Mus musculus
atatctgaagggcgagaatcctttc

SEQ ID NO: 880089 - DNA, 25 bp, Mus musculus
atatctgacctgagctgagcctacc

SEQ ID NO: 880090 - DNA, 25 bp, Mus musculus
atatctgacctgtgctgagcctacc

SEQ ID NO: 880091 - DNA, 25 bp, Mus musculus
atatctggaacacggtcgaacctcc

SEQ ID NO: 880092 - DNA, 25 bp, Mus musculus
atatctggaacagggtcgaacctcc

SEQ ID NO: 880093 - DNA, 25 bp, Mus musculus
atatctgtaaacaattacatcgtca

SEQ ID NO: 880094 - DNA, 25 bp, Mus musculus
atatctgtaaactattacatcgtca

SEQ ID NO: 880095 - DNA, 25 bp, Mus musculus
atatcttcaatgaaattacacttgt

SEQ ID NO: 880096 - DNA, 25 bp, Mus musculus
atatcttcaatgctctgacagtctc

SEQ ID NO: 880097 - DNA, 25 bp, Mus musculus
atatcttcaatggtctgacagtctc

SEQ ID NO: 880098 - DNA, 25 bp, Mus musculus
atatcttcaatgtaattacacttgt

SEQ ID NO: 880099 - DNA, 25 bp, Mus musculus
atatcttggaaacgttcacagaggc

SEQ ID NO: 880100 - DNA, 25 bp, Mus musculus
atatcttggaaaggttcacagaggc

SEQ ID NO: 880101 - DNA, 25 bp, Mus musculus
atatcttggaccaccctatggtttt

SEQ ID NO: 880102 - DNA, 25 bp, Mus musculus
atatcttggaccacgctatggtttt

SEQ ID NO: 880103 - DNA, 25 bp, Mus musculus
atatctttgtgccacatcccaccat

SEQ ID NO: 880104 - DNA, 25 bp, Mus musculus
atatctttgtgccagatcccaccat

SEQ ID NO: 880105 - DNA, 25 bp, Mus musculus
atatgaaaaaggcggccacattatc

SEQ ID NO: 880106 - DNA, 25 bp, Mus musculus
atatgaaaaagggggccacattatc

SEQ ID NO: 880107 - DNA, 25 bp, Mus musculus
atatgaaaagccttctgagaacttt

SEQ ID NO: 880108 - DNA, 25 bp, Mus musculus
atatgaaaaggcttctgagaacttt

SEQ ID NO: 880109 - DNA, 25 bp, Mus musculus
atatgaacagccatgtaatgaattc

SEQ ID NO: 880110 - DNA, 25 bp, Mus musculus
atatgaacaggcatgtaatgaattc

SEQ ID NO: 880111 - DNA, 25 bp, Mus musculus
atatgaagtttgtcccttccaacca

SEQ ID NO: 880112 - DNA, 25 bp, Mus musculus
atatgaagtttgtcgcttccaacca

SEQ ID NO: 880113 - DNA, 25 bp, Mus musculus
atatgaatgaaactgacgctcatgc

SEQ ID NO: 880114 - DNA, 25 bp, Mus musculus
atatgaatgaaagtgacgctcatgc

SEQ ID NO: 880115 - DNA, 25 bp, Mus musculus
atatgaatgcaacgatcagaccatg

SEQ ID NO: 880116 - DNA, 25 bp, Mus musculus
atatgaatgcaaggatcagaccatg

SEQ ID NO: 880117 - DNA, 25 bp, Mus musculus
atatgacaactgatggctggctctc

SEQ ID NO: 880118 - DNA, 25 bp, Mus musculus
atatgacaactgttggctggctctc

SEQ ID NO: 880119 - DNA, 25 bp, Mus musculus
atatgacttccaaataagtttcttt

SEQ ID NO: 880120 - DNA, 25 bp, Mus musculus
atatgacttccatataagtttcttt

SEQ ID NO: 880121 - DNA, 25 bp, Mus musculus
atatgagaagacaaactacaactcc

SEQ ID NO: 880122 - DNA, 25 bp, Mus musculus
atatgagaagtcaaactacaactcc

SEQ ID NO: 880123 - DNA, 25 bp, Mus musculus
atatgagcaaacctatgcagagatg

SEQ ID NO: 880124 - DNA, 25 bp, Mus musculus
atatgagcaaacgtatgcagagatg

SEQ ID NO: 880125 - DNA, 25 bp, Mus musculus
atatgaggagatgctgaaccgagtg

SEQ ID NO: 880126 - DNA, 25 bp, Mus musculus
atatgaggagttgctgaaccgagtg

SEQ ID NO: 880127 - DNA, 25 bp, Mus musculus
atatgagggctcaactcgcaatgtg

SEQ ID NO: 880128 - DNA, 25 bp, Mus musculus
atatgagggctcaagtcgcaatgtg

SEQ ID NO: 880129 - DNA, 25 bp, Mus musculus
atatgatagaaaccagaaaacacag

SEQ ID NO: 880130 - DNA, 25 bp, Mus musculus
atatgatagaaacctgaaaacacag

SEQ ID NO: 880131 - DNA, 25 bp, Mus musculus
atatgatatgcacattgacaacaag

SEQ ID NO: 880132 - DNA, 25 bp, Mus musculus
atatgatatgcagattgacaacaag

SEQ ID NO: 880133 - DNA, 25 bp, Mus musculus
atatgatgctcaaacattaatggat

SEQ ID NO: 880134 - DNA, 25 bp, Mus musculus
atatgatgctgaaacattaatggat

SEQ ID NO: 880135 - DNA, 25 bp, Mus musculus
atatgattccagatgcacgccatcc

SEQ ID NO: 880136 - DNA, 25 bp, Mus musculus
atatgattccagcctactagtcagt

SEQ ID NO: 880137 - DNA, 25 bp, Mus musculus
atatgattccaggctactagtcagt

SEQ ID NO: 880138 - DNA, 25 bp, Mus musculus
atatgattccagttgcacgccatcc

SEQ ID NO: 880139 - DNA, 25 bp, Mus musculus
atatgcaacagatacttgctgggct

SEQ ID NO: 880140 - DNA, 25 bp, Mus musculus
atatgcaacagatagttgctgggct

SEQ ID NO: 880141 - DNA, 25 bp, Mus musculus
atatgcaataacaagctgcagtttc

SEQ ID NO: 880142 - DNA, 25 bp, Mus musculus
atatgcaatatcaagctgcagtttc

SEQ ID NO: 880143 - DNA, 25 bp, Mus musculus
atatgcagaagacaagaaaaattca

SEQ ID NO: 880144 - DNA, 25 bp, Mus musculus
atatgcagaagacttagcaaaacgt

SEQ ID NO: 880145 - DNA, 25 bp, Mus musculus
atatgcagaagagaagaaaaattca

SEQ ID NO: 880146 - DNA, 25 bp, Mus musculus
atatgcagaagagttagcaaaacgt

SEQ ID NO: 880147 - DNA, 25 bp, Mus musculus
atatgcagctgacgcgtaagttgga

SEQ ID NO: 880148 - DNA, 25 bp, Mus musculus
atatgcagctgactccacgtgaagt

SEQ ID NO: 880149 - DNA, 25 bp, Mus musculus
atatgcagctgaggcgtaagttgga

SEQ ID NO: 880150 - DNA, 25 bp, Mus musculus
atatgcagctgagtccacgtgaagt

SEQ ID NO: 880151 - DNA, 25 bp, Mus musculus
atatgccaagagccaccgttcccta

SEQ ID NO: 880152 - DNA, 25 bp, Mus musculus
atatgccaagtgccaccgttcccta

SEQ ID NO: 880153 - DNA, 25 bp, Mus musculus
atatgcccagccaatagagatggct

SEQ ID NO: 880154 - DNA, 25 bp, Mus musculus
atatgcccaggagactttccttctg

SEQ ID NO: 880155 - DNA, 25 bp, Mus musculus
atatgcccaggagagtttccttctg

SEQ ID NO: 880156 - DNA, 25 bp, Mus musculus
atatgcccaggcaatagagatggct

SEQ ID NO: 880157 - DNA, 25 bp, Mus musculus
atatgccgccagctctacaccagaa

SEQ ID NO: 880158 - DNA, 25 bp, Mus musculus
atatgccgccaggtctacaccagaa

SEQ ID NO: 880159 - DNA, 25 bp, Mus musculus
atatgcgaagctcccgccatgagaa

SEQ ID NO: 880160 - DNA, 25 bp, Mus musculus
atatgcgaagctccggccatgagaa

SEQ ID NO: 880161 - DNA, 25 bp, Mus musculus
atatgcgctgctggacgcagacgat

SEQ ID NO: 880162 - DNA, 25 bp, Mus musculus
atatgcgctgcttccagatgcctga

SEQ ID NO: 880163 - DNA, 25 bp, Mus musculus
atatgcgctggtggacgcagacgat

SEQ ID NO: 880164 - DNA, 25 bp, Mus musculus
atatgcgctggttccagatgcctga

SEQ ID NO: 880165 - DNA, 25 bp, Mus musculus
atatgcgtcccgaccagtccaacgt

SEQ ID NO: 880166 - DNA, 25 bp, Mus musculus
atatgcgtccggaccagtccaacgt

SEQ ID NO: 880167 - DNA, 25 bp, Mus musculus
atatgctgcagaccttcacttggtt

SEQ ID NO: 880168 - DNA, 25 bp, Mus musculus
atatgctgcagagcttcacttggtt

SEQ ID NO: 880169 - DNA, 25 bp, Mus musculus
atatgctgtcaacatcattgagaag

SEQ ID NO: 880170 - DNA, 25 bp, Mus musculus
atatgctgtcaagatcattgagaag

SEQ ID NO: 880171 - DNA, 25 bp, Mus musculus
atatgcttgcaacgaccttcgtgag

SEQ ID NO: 880172 - DNA, 25 bp, Mus musculus
atatgcttgcaaggaccttcgtgag

SEQ ID NO: 880173 - DNA, 25 bp, Mus musculus
atatggaaaatgattcaacctggat

SEQ ID NO: 880174 - DNA, 25 bp, Mus musculus
atatggaaaatgtttcaacctggat

SEQ ID NO: 880175 - DNA, 25 bp, Mus musculus
atatggagagaatgctattaagaag

SEQ ID NO: 880176 - DNA, 25 bp, Mus musculus
atatggagagacgtgtcctgggctt

SEQ ID NO: 880177 - DNA, 25 bp, Mus musculus
atatggagagtatgctattaagaag

SEQ ID NO: 880178 - DNA, 25 bp, Mus musculus
atatggagagtcgtgtcctgggctt

SEQ ID NO: 880179 - DNA, 25 bp, Mus musculus
atatggagcaaaaaatgggctacac

SEQ ID NO: 880180 - DNA, 25 bp, Mus musculus
atatggagcaaaagtatgaattagg

SEQ ID NO: 880181 - DNA, 25 bp, Mus musculus
atatggagcaaataatgggctacac

SEQ ID NO: 880182 - DNA, 25 bp, Mus musculus
atatggagcaaatgtatgaattagg

SEQ ID NO: 880183 - DNA, 25 bp, Mus musculus
atatggcaacgaccctgatattgaa

SEQ ID NO: 880184 - DNA, 25 bp, Mus musculus
atatggcaacgagcctgatattgaa

SEQ ID NO: 880185 - DNA, 25 bp, Mus musculus
atatggcagatgcctgaaaatattt

SEQ ID NO: 880186 - DNA, 25 bp, Mus musculus
atatggcagatggctgaaaatattt

SEQ ID NO: 880187 - DNA, 25 bp, Mus musculus
atatggtaacagccttacagaatga

SEQ ID NO: 880188 - DNA, 25 bp, Mus musculus
atatggtaactgccttacagaatga

SEQ ID NO: 880189 - DNA, 25 bp, Mus musculus
atatgtaatccaagcaaatgtggat

SEQ ID NO: 880190 - DNA, 25 bp, Mus musculus
atatgtaatccaaggaaatgtggat

SEQ ID NO: 880191 - DNA, 25 bp, Mus musculus
atatgtacagacccagaagtatcat

SEQ ID NO: 880192 - DNA, 25 bp, Mus musculus
atatgtacagccagaccgaaggctc

SEQ ID NO: 880193 - DNA, 25 bp, Mus musculus
atatgtacaggcagaccgaaggctc

SEQ ID NO: 880194 - DNA, 25 bp, Mus musculus
atatgtacagtcccagaagtatcat

SEQ ID NO: 880195 - DNA, 25 bp, Mus musculus
atatgtaccaacagtttttgacaac

SEQ ID NO: 880196 - DNA, 25 bp, Mus musculus
atatgtaccaactgtttttgacaac

SEQ ID NO: 880197 - DNA, 25 bp, Mus musculus
atatgtatgccacgttatgaaggtg

SEQ ID NO: 880198 - DNA, 25 bp, Mus musculus
atatgtatgccaggttatgaaggtg

SEQ ID NO: 880199 - DNA, 25 bp, Mus musculus
atatgtcaacagaattccagaggtt

SEQ ID NO: 880200 - DNA, 25 bp, Mus musculus
atatgtcaacagcacccacagttat

SEQ ID NO: 880201 - DNA, 25 bp, Mus musculus
atatgtcaacagcccagaaggctct

SEQ ID NO: 880202 - DNA, 25 bp, Mus musculus
atatgtcaacaggacccacagttat

SEQ ID NO: 880203 - DNA, 25 bp, Mus musculus
atatgtcaacaggccagaaggctct

SEQ ID NO: 880204 - DNA, 25 bp, Mus musculus
atatgtcaacagtattccagaggtt

SEQ ID NO: 880205 - DNA, 25 bp, Mus musculus
atatgtcaatgacgtaatcgtcgag

SEQ ID NO: 880206 - DNA, 25 bp, Mus musculus
atatgtcaatgaggaatcgtcgagc

SEQ ID NO: 880207 - DNA, 25 bp, Mus musculus
atatgtcaatgaggtaatcgtcgag

SEQ ID NO: 880208 - DNA, 25 bp, Mus musculus
atatgtcaatgaggtatcgtcgagc

SEQ ID NO: 880209 - DNA, 25 bp, Mus musculus
atatgtctccatctcgaaaagttcc

SEQ ID NO: 880210 - DNA, 25 bp, Mus musculus
atatgtctccatctggaaaagttcc

SEQ ID NO: 880211 - DNA, 25 bp, Mus musculus
atatgtctgtatgacaacaaagcca

SEQ ID NO: 880212 - DNA, 25 bp, Mus musculus
atatgtctgtatgactggctgagag

SEQ ID NO: 880213 - DNA, 25 bp, Mus musculus
atatgtctgtatgagaacaaagcca

SEQ ID NO: 880214 - DNA, 25 bp, Mus musculus
atatgtctgtatgagtggctgagag

SEQ ID NO: 880215 - DNA, 25 bp, Mus musculus
atatgttactagcagtcaagcttgg

SEQ ID NO: 880216 - DNA, 25 bp, Mus musculus
atatgttactaggagtcaagcttgg

SEQ ID NO: 880217 - DNA, 25 bp, Mus musculus
atatgttggagacgtgatcacaagt

SEQ ID NO: 880218 - DNA, 25 bp, Mus musculus
atatgttggagaggtgatcacaagt

SEQ ID NO: 880219 - DNA, 25 bp, Mus musculus
atattaaacttacaacaaaattata

SEQ ID NO: 880220 - DNA, 25 bp, Mus musculus
atattaaacttacaagtttgaggat

SEQ ID NO: 880221 - DNA, 25 bp, Mus musculus
atattaaacttacatcaaaattata

SEQ ID NO: 880222 - DNA, 25 bp, Mus musculus
atattaaacttacatgtttgaggat

SEQ ID NO: 880223 - DNA, 25 bp, Mus musculus
atattagtagactgccctgctcatt

SEQ ID NO: 880224 - DNA, 25 bp, Mus musculus
atattagtagtctgccctgctcatt

SEQ ID NO: 880225 - DNA, 25 bp, Mus musculus
atattcaagcaaccatttaagaaga

SEQ ID NO: 880226 - DNA, 25 bp, Mus musculus
atattcaagcaagcatttaagaaga

SEQ ID NO: 880227 - DNA, 25 bp, Mus musculus
atattcagagctctatcgtccaagc

SEQ ID NO: 880228 - DNA, 25 bp, Mus musculus
atattcagaggtctatcgtccaagc

SEQ ID NO: 880229 - DNA, 25 bp, Mus musculus
atattccataagatcatctttagat

SEQ ID NO: 880230 - DNA, 25 bp, Mus musculus
atattccataagttcatctttagat

SEQ ID NO: 880231 - DNA, 25 bp, Mus musculus
atattccccgaacccgagtgctggt

SEQ ID NO: 880232 - DNA, 25 bp, Mus musculus
atattccccgaagccgagtgctggt

SEQ ID NO: 880233 - DNA, 25 bp, Mus musculus
atattcgtgagccctctctgctctc

SEQ ID NO: 880234 - DNA, 25 bp, Mus musculus
atattcgtgagccgcaattcaaatg

SEQ ID NO: 880235 - DNA, 25 bp, Mus musculus
atattcgtgagcgctctctgctctc

SEQ ID NO: 880236 - DNA, 25 bp, Mus musculus
atattcgtgagcggcaattcaaatg

SEQ ID NO: 880237 - DNA, 25 bp, Mus musculus
atattctaagatgctcctgccagcg

SEQ ID NO: 880238 - DNA, 25 bp, Mus musculus
atattctaagttgctcctgccagcg

SEQ ID NO: 880239 - DNA, 25 bp, Mus musculus
atattctcagctctttgaaatgctt

SEQ ID NO: 880240 - DNA, 25 bp, Mus musculus
atattctcaggtctttgaaatgctt

SEQ ID NO: 880241 - DNA, 25 bp, Mus musculus
atattctcccagagatcttcaaaat

SEQ ID NO: 880242 - DNA, 25 bp, Mus musculus
atattctcccagtgatcttcaaaat

SEQ ID NO: 880243 - DNA, 25 bp, Mus musculus
atattctgcctgcgtgctgtaaaag

SEQ ID NO: 880244 - DNA, 25 bp, Mus musculus
atattctgcctgggtgctgtaaaag

SEQ ID NO: 880245 - DNA, 25 bp, Mus musculus
atattgacgttatacatgttatccc

SEQ ID NO: 880246 - DNA, 25 bp, Mus musculus
atattgacgttatagatgttatccc

SEQ ID NO: 880247 - DNA, 25 bp, Mus musculus
atattgagaaagatgttgcaatata

SEQ ID NO: 880248 - DNA, 25 bp, Mus musculus
atattgagaaagttgttgcaatata

SEQ ID NO: 880249 - DNA, 25 bp, Mus musculus
atattgataaagccatgaaagatgg

SEQ ID NO: 880250 - DNA, 25 bp, Mus musculus
atattgataaaggcatgaaagatgg

SEQ ID NO: 880251 - DNA, 25 bp, Mus musculus
atattggaaaagctgttcatctata

SEQ ID NO: 880252 - DNA, 25 bp, Mus musculus
atattggaaaaggtgttcatctata

SEQ ID NO: 880253 - DNA, 25 bp, Mus musculus
atattggacgagccatcctccagca

SEQ ID NO: 880254 - DNA, 25 bp, Mus musculus
atattggacgtgccatcctccagca

SEQ ID NO: 880255 - DNA, 25 bp, Mus musculus
atattggagagagtcggcatgttac

SEQ ID NO: 880256 - DNA, 25 bp, Mus musculus
atattggagagagtgggcatgttac

SEQ ID NO: 880257 - DNA, 25 bp, Mus musculus
atattgtcagctctgtgttccatga

SEQ ID NO: 880258 - DNA, 25 bp, Mus musculus
atattgtcaggtctgtgttccatga

SEQ ID NO: 880259 - DNA, 25 bp, Mus musculus
atatttaaggcaaaatctctgaaag

SEQ ID NO: 880260 - DNA, 25 bp, Mus musculus
atatttaagggaaaatctctgaaag

SEQ ID NO: 880261 - DNA, 25 bp, Mus musculus
atatttaccttgattaccattaatg

SEQ ID NO: 880262 - DNA, 25 bp, Mus musculus
atatttaccttgtttaccattaatg

SEQ ID NO: 880263 - DNA, 25 bp, Mus musculus
atatttacgactctcgacctcttcg

SEQ ID NO: 880264 - DNA, 25 bp, Mus musculus
atatttacgactctggacctcttcg

SEQ ID NO: 880265 - DNA, 25 bp, Mus musculus
atatttcgttatctcatcgcagaca

SEQ ID NO: 880266 - DNA, 25 bp, Mus musculus
atatttcgttttctcatcgcagaca

SEQ ID NO: 880267 - DNA, 25 bp, Mus musculus
atatttctttcacggcttcacattt

SEQ ID NO: 880268 - DNA, 25 bp, Mus musculus
atatttctttcagggcttcacattt

SEQ ID NO: 880269 - DNA, 25 bp, Mus musculus
atatttggagatggcgaagtccgtt

SEQ ID NO: 880270 - DNA, 25 bp, Mus musculus
atatttggagatggggaagtccgtt

SEQ ID NO: 880271 - DNA, 25 bp, Mus musculus
atattttcagctgaaccagaacagc

SEQ ID NO: 880272 - DNA, 25 bp, Mus musculus
atattttcaggtgaaccagaacagc

SEQ ID NO: 880273 - DNA, 25 bp, Mus musculus
atattttcccagcacggttagcata

SEQ ID NO: 880274 - DNA, 25 bp, Mus musculus
atattttcccagcagggttagcata

SEQ ID NO: 880275 - DNA, 25 bp, Mus musculus
atatttttacagcgaggagcctcga

SEQ ID NO: 880276 - DNA, 25 bp, Mus musculus
atatttttacagggaggagcctcga

SEQ ID NO: 880277 - DNA, 25 bp, Mus musculus
atcaaaaatcagataacaactattc

SEQ ID NO: 880278 - DNA, 25 bp, Mus musculus
atcaaaaatcagataagaaacctga

SEQ ID NO: 880279 - DNA, 25 bp, Mus musculus
atcaaaaatcagttaacaactattc

SEQ ID NO: 880280 - DNA, 25 bp, Mus musculus
atcaaaaatcagttaagaaacctga

SEQ ID NO: 880281 - DNA, 25 bp, Mus musculus
atcaaaactccgacataccgtgagc

SEQ ID NO: 880282 - DNA, 25 bp, Mus musculus
atcaaaactccgtcataccgtgagc

SEQ ID NO: 880283 - DNA, 25 bp, Mus musculus
atcaaaactgcaagtttggtgagcg

SEQ ID NO: 880284 - DNA, 25 bp, Mus musculus
atcaaaactggaagtttggtgagcg

SEQ ID NO: 880285 - DNA, 25 bp, Mus musculus
atcaaaacttcgcatgtgacctcca

SEQ ID NO: 880286 - DNA, 25 bp, Mus musculus
atcaaaacttcggatgtgacctcca

SEQ ID NO: 880287 - DNA, 25 bp, Mus musculus
atcaaaatgaatcgcgtcatcaact

SEQ ID NO: 880288 - DNA, 25 bp, Mus musculus
atcaaaatgaatcgggtcatcaact

SEQ ID NO: 880289 - DNA, 25 bp, Mus musculus
atcaaacagaagccaacactgcaag

SEQ ID NO: 880290 - DNA, 25 bp, Mus musculus
atcaaacagaaggcaacactgcaag

SEQ ID NO: 880291 - DNA, 25 bp, Mus musculus
atcaaacagagaaaagccatctgaa

SEQ ID NO: 880292 - DNA, 25 bp, Mus musculus
atcaaacagagaaatgccatctgaa

SEQ ID NO: 880293 - DNA, 25 bp, Mus musculus
atcaaacatatgccacttcttggac

SEQ ID NO: 880294 - DNA, 25 bp, Mus musculus
atcaaacatatgctgagaaatccat

SEQ ID NO: 880295 - DNA, 25 bp, Mus musculus
atcaaacatatggcacttcttggac

SEQ ID NO: 880296 - DNA, 25 bp, Mus musculus
atcaaacatatggtgagaaatccat

SEQ ID NO: 880297 - DNA, 25 bp, Mus musculus
atcaaaccagatggcaccaaccaag

SEQ ID NO: 880298 - DNA, 25 bp, Mus musculus
atcaaaccagttggcaccaaccaag

SEQ ID NO: 880299 - DNA, 25 bp, Mus musculus
atcaaacgatttctccgaccttcga

SEQ ID NO: 880300 - DNA, 25 bp, Mus musculus
atcaaacgatttctgcgaccttcga

SEQ ID NO: 880301 - DNA, 25 bp, Mus musculus
atcaaactatcacgtactctatcta

SEQ ID NO: 880302 - DNA, 25 bp, Mus musculus
atcaaactatcaggtactctatcta

SEQ ID NO: 880303 - DNA, 25 bp, Mus musculus
atcaaagagcaacagaaagcagcag

SEQ ID NO: 880304 - DNA, 25 bp, Mus musculus
atcaaagagcaagagaaagcagcag

SEQ ID NO: 880305 - DNA, 25 bp, Mus musculus
atcaaagaggccaatatgcgatctc

SEQ ID NO: 880306 - DNA, 25 bp, Mus musculus
atcaaagaggcctatatgcgatctc

SEQ ID NO: 880307 - DNA, 25 bp, Mus musculus
atcaaagatcttctgactgaagatg

SEQ ID NO: 880308 - DNA, 25 bp, Mus musculus
atcaaagatcttgtgactgaagatg

SEQ ID NO: 880309 - DNA, 25 bp, Mus musculus
atcaaagatttgaacgtgggctctg

SEQ ID NO: 880310 - DNA, 25 bp, Mus musculus
atcaaagatttgaaggtgggctctg

SEQ ID NO: 880311 - DNA, 25 bp, Mus musculus
atcaaagcagctcataaagcaatgg

SEQ ID NO: 880312 - DNA, 25 bp, Mus musculus
atcaaagcagctgataaagcaatgg

SEQ ID NO: 880313 - DNA, 25 bp, Mus musculus
atcaaagcagtccggcatgaggatc

SEQ ID NO: 880314 - DNA, 25 bp, Mus musculus
atcaaagcagtcgggcatgaggatc

SEQ ID NO: 880315 - DNA, 25 bp, Mus musculus
atcaaagccagaataatcaaattcg

SEQ ID NO: 880316 - DNA, 25 bp, Mus musculus
atcaaagccagattaatcaaattcg

SEQ ID NO: 880317 - DNA, 25 bp, Mus musculus
atcaaagcgacacgcatctggagga

SEQ ID NO: 880318 - DNA, 25 bp, Mus musculus
atcaaagcgacaggcatctggagga

SEQ ID NO: 880319 - DNA, 25 bp, Mus musculus
atcaaagctggcaacgtacggactc

SEQ ID NO: 880320 - DNA, 25 bp, Mus musculus
atcaaagctggcaacgttcgaacct

SEQ ID NO: 880321 - DNA, 25 bp, Mus musculus
atcaaagctggcaaggtacggactc

SEQ ID NO: 880322 - DNA, 25 bp, Mus musculus
atcaaagctggcaaggttcgaacct

SEQ ID NO: 880323 - DNA, 25 bp, Mus musculus
atcaaaggctcacgttgccaaagaa

SEQ ID NO: 880324 - DNA, 25 bp, Mus musculus
atcaaaggctcaggttgccaaagaa

SEQ ID NO: 880325 - DNA, 25 bp, Mus musculus
atcaaaggtcaacacaatctgatca

SEQ ID NO: 880326 - DNA, 25 bp, Mus musculus
atcaaaggtcaagacaatctgatca

SEQ ID NO: 880327 - DNA, 25 bp, Mus musculus
atcaaagtgatggccgcaatccaga

SEQ ID NO: 880328 - DNA, 25 bp, Mus musculus
atcaaagtgatggcggcaatccaga

SEQ ID NO: 880329 - DNA, 25 bp, Mus musculus
atcaaatacgagaccaacctgactt

SEQ ID NO: 880330 - DNA, 25 bp, Mus musculus
atcaaatacgagtccaacctgactt

SEQ ID NO: 880331 - DNA, 25 bp, Mus musculus
atcaaatatgctgaccttcttcccg

SEQ ID NO: 880332 - DNA, 25 bp, Mus musculus
atcaaatatggtgaccttcttcccg

SEQ ID NO: 880333 - DNA, 25 bp, Mus musculus
atcaaatgaaagcttctggagaagc

SEQ ID NO: 880334 - DNA, 25 bp, Mus musculus
atcaaatgaaaggttctggagaagc

SEQ ID NO: 880335 - DNA, 25 bp, Mus musculus
atcaaatggcagaatatatgttttg

SEQ ID NO: 880336 - DNA, 25 bp, Mus musculus
atcaaatggcagaggtcacttttgt

SEQ ID NO: 880337 - DNA, 25 bp, Mus musculus
atcaaatggcagtatatatgttttg

SEQ ID NO: 880338 - DNA, 25 bp, Mus musculus
atcaaatggcagtggtcacttttgt

SEQ ID NO: 880339 - DNA, 25 bp, Mus musculus
atcaacaaataccacatattgaaag

SEQ ID NO: 880340 - DNA, 25 bp, Mus musculus
atcaacaaataccagatattgaaag

SEQ ID NO: 880341 - DNA, 25 bp, Mus musculus
atcaacaagaagcaccccagcactg

SEQ ID NO: 880342 - DNA, 25 bp, Mus musculus
atcaacaagaaggaccccagcactg

SEQ ID NO: 880343 - DNA, 25 bp, Mus musculus
atcaacaagacacaaggtgaagatg

SEQ ID NO: 880344 - DNA, 25 bp, Mus musculus
atcaacaagacacgttgtcctccaa

SEQ ID NO: 880345 - DNA, 25 bp, Mus musculus
atcaacaagacagaaggtgaagatg

SEQ ID NO: 880346 - DNA, 25 bp, Mus musculus
atcaacaagacaggttgtcctccaa

SEQ ID NO: 880347 - DNA, 25 bp, Mus musculus
atcaacaaggaagacgttttgctgc

SEQ ID NO: 880348 - DNA, 25 bp, Mus musculus
atcaacaaggaagaggttttgctgc

SEQ ID NO: 880349 - DNA, 25 bp, Mus musculus
atcaacacaacgctgggccagggtg

SEQ ID NO: 880350 - DNA, 25 bp, Mus musculus
atcaacacaaggctgggccagggtg

SEQ ID NO: 880351 - DNA, 25 bp, Mus musculus
atcaacacagactttcctgccccct

SEQ ID NO: 880352 - DNA, 25 bp, Mus musculus
atcaacacagccattcctgaagtgg

SEQ ID NO: 880353 - DNA, 25 bp, Mus musculus
atcaacacaggcattcctgaagtgg

SEQ ID NO: 880354 - DNA, 25 bp, Mus musculus
atcaacacagtctttcctgccccct

SEQ ID NO: 880355 - DNA, 25 bp, Mus musculus
atcaacagccaaccctctgagagcc

SEQ ID NO: 880356 - DNA, 25 bp, Mus musculus
atcaacagccaagcctctgagagcc

SEQ ID NO: 880357 - DNA, 25 bp, Mus musculus
atcaacagcccacgtggtgtggtaa

SEQ ID NO: 880358 - DNA, 25 bp, Mus musculus
atcaacagcccaggtggtgtggtaa

SEQ ID NO: 880359 - DNA, 25 bp, Mus musculus
atcaacatgaacctgggtggccacg

SEQ ID NO: 880360 - DNA, 25 bp, Mus musculus
atcaacatgaacgtgggtggccacg

SEQ ID NO: 880361 - DNA, 25 bp, Mus musculus
atcaaccaagctgctcttctcagca

SEQ ID NO: 880362 - DNA, 25 bp, Mus musculus
atcaaccaaggtgctcttctcagca

SEQ ID NO: 880363 - DNA, 25 bp, Mus musculus
atcaaccagggactattcgagctcc

SEQ ID NO: 880364 - DNA, 25 bp, Mus musculus
atcaaccagggacttttcgagctcc

SEQ ID NO: 880365 - DNA, 25 bp, Mus musculus
atcaaccatgggaacatcccaacgc

SEQ ID NO: 880366 - DNA, 25 bp, Mus musculus
atcaaccatgggaagatcccaacgc

SEQ ID NO: 880367 - DNA, 25 bp, Mus musculus
atcaacccagcacgttctgtccctc

SEQ ID NO: 880368 - DNA, 25 bp, Mus musculus
atcaacccagcaggttctgtccctc

SEQ ID NO: 880369 - DNA, 25 bp, Mus musculus
atcaaccctgagacagctcttcttc

SEQ ID NO: 880370 - DNA, 25 bp, Mus musculus
atcaaccctgagagccaggaccctg

SEQ ID NO: 880371 - DNA, 25 bp, Mus musculus
atcaaccctgagtcagctcttcttc

SEQ ID NO: 880372 - DNA, 25 bp, Mus musculus
atcaaccctgagtgccaggaccctg

SEQ ID NO: 880373 - DNA, 25 bp, Mus musculus
atcaaccgaccagtacttggacctc

SEQ ID NO: 880374 - DNA, 25 bp, Mus musculus
atcaaccgacgagtacttggacctc

SEQ ID NO: 880375 - DNA, 25 bp, Mus musculus
atcaacctcaactgagtgtgcaaca

SEQ ID NO: 880376 - DNA, 25 bp, Mus musculus
atcaacctcaactgtgtgtgcaaca

SEQ ID NO: 880377 - DNA, 25 bp, Mus musculus
atcaacgctgtcagattcttcccga

SEQ ID NO: 880378 - DNA, 25 bp, Mus musculus
atcaacgctgtcagtttcttcccga

SEQ ID NO: 880379 - DNA, 25 bp, Mus musculus
atcaacgggactaatgggcctgctc

SEQ ID NO: 880380 - DNA, 25 bp, Mus musculus
atcaacgggacttatgggcctgctc

SEQ ID NO: 880381 - DNA, 25 bp, Mus musculus
atcaactaaccaatactggagtaac

SEQ ID NO: 880382 - DNA, 25 bp, Mus musculus
atcaactaacgaatactggagtaac

SEQ ID NO: 880383 - DNA, 25 bp, Mus musculus
atcaactctggcatcggagctgtga

SEQ ID NO: 880384 - DNA, 25 bp, Mus musculus
atcaactctggcatgggagctgtga

SEQ ID NO: 880385 - DNA, 25 bp, Mus musculus
atcaacttgattatcatgttccaga

SEQ ID NO: 880386 - DNA, 25 bp, Mus musculus
atcaacttgattatgatgttccaga

SEQ ID NO: 880387 - DNA, 25 bp, Mus musculus
atcaagaaagaggaagactcggcca

SEQ ID NO: 880388 - DNA, 25 bp, Mus musculus
atcaagaaagtggaagactcggcca

SEQ ID NO: 880389 - DNA, 25 bp, Mus musculus
atcaagaaggagaacacaggctggg

SEQ ID NO: 880390 - DNA, 25 bp, Mus musculus
atcaagaaggagaagacaggctggg

SEQ ID NO: 880391 - DNA, 25 bp, Mus musculus
atcaagaatgaactgtatcccctac

SEQ ID NO: 880392 - DNA, 25 bp, Mus musculus
atcaagaatgaagtgtatcccctac

SEQ ID NO: 880393 - DNA, 25 bp, Mus musculus
atcaagacccacgcaaactacagct

SEQ ID NO: 880394 - DNA, 25 bp, Mus musculus
atcaagacccacgctaactacagct

SEQ ID NO: 880395 - DNA, 25 bp, Mus musculus
atcaagaccgccaacattgaggatg

SEQ ID NO: 880396 - DNA, 25 bp, Mus musculus
atcaagaccgccaagattgaggatg

SEQ ID NO: 880397 - DNA, 25 bp, Mus musculus
atcaagagagaagtggctggaagca

SEQ ID NO: 880398 - DNA, 25 bp, Mus musculus
atcaagagagctgacgtgttgctga

SEQ ID NO: 880399 - DNA, 25 bp, Mus musculus
atcaagagaggtgacgtgttgctga

SEQ ID NO: 880400 - DNA, 25 bp, Mus musculus
atcaagagagtagtggctggaagca

SEQ ID NO: 880401 - DNA, 25 bp, Mus musculus
atcaagagatcttctcggacctgta

SEQ ID NO: 880402 - DNA, 25 bp, Mus musculus
atcaagagatgttctcggacctgta

SEQ ID NO: 880403 - DNA, 25 bp, Mus musculus
atcaagagcaagctcaacaagcatg

SEQ ID NO: 880404 - DNA, 25 bp, Mus musculus
atcaagagcaaggtcaacaagcatg

SEQ ID NO: 880405 - DNA, 25 bp, Mus musculus
atcaagagctccgacacgctatccg

SEQ ID NO: 880406 - DNA, 25 bp, Mus musculus
atcaagagctccgagacgctatccg

SEQ ID NO: 880407 - DNA, 25 bp, Mus musculus
atcaagatctggcacttggagggca

SEQ ID NO: 880408 - DNA, 25 bp, Mus musculus
atcaagatctgggacttggagggca

SEQ ID NO: 880409 - DNA, 25 bp, Mus musculus
atcaagatgactaacatgctaaaag

SEQ ID NO: 880410 - DNA, 25 bp, Mus musculus
atcaagatgactaagatgctaaaag

SEQ ID NO: 880411 - DNA, 25 bp, Mus musculus
atcaagcatgcaggaaggggaggac

SEQ ID NO: 880412 - DNA, 25 bp, Mus musculus
atcaagcatggaggaaggggaggac

SEQ ID NO: 880413 - DNA, 25 bp, Mus musculus
atcaagcatttccgcatgctccacc

SEQ ID NO: 880414 - DNA, 25 bp, Mus musculus
atcaagcatttcggcatgctccacc

SEQ ID NO: 880415 - DNA, 25 bp, Mus musculus
atcaagccagctaagcagcctcttt

SEQ ID NO: 880416 - DNA, 25 bp, Mus musculus
atcaagccaggtaagcagcctcttt

SEQ ID NO: 880417 - DNA, 25 bp, Mus musculus
atcaagcgagagcatgaggaggaat

SEQ ID NO: 880418 - DNA, 25 bp, Mus musculus
atcaagcgagaggatgaggaggaat

SEQ ID NO: 880419 - DNA, 25 bp, Mus musculus
atcaagcgcgccctcgccaacagcc

SEQ ID NO: 880420 - DNA, 25 bp, Mus musculus
atcaagcgcgccctggccaacagcc

SEQ ID NO: 880421 - DNA, 25 bp, Mus musculus
atcaagcgctcacatatgctgaagg

SEQ ID NO: 880422 - DNA, 25 bp, Mus musculus
atcaagcgctcagatatgctgaagg

SEQ ID NO: 880423 - DNA, 25 bp, Mus musculus
atcaagctacagatatgggacacag

SEQ ID NO: 880424 - DNA, 25 bp, Mus musculus
atcaagctacagatttgggacacag

SEQ ID NO: 880425 - DNA, 25 bp, Mus musculus
atcaagctaccgagactccggggtg

SEQ ID NO: 880426 - DNA, 25 bp, Mus musculus
atcaagctaccgtgactccggggtg

SEQ ID NO: 880427 - DNA, 25 bp, Mus musculus
atcaagctagcgatggagaacgatg

SEQ ID NO: 880428 - DNA, 25 bp, Mus musculus
atcaagctagggatggagaacgatg

SEQ ID NO: 880429 - DNA, 25 bp, Mus musculus
atcaaggacgcacgcatgtttgctc

SEQ ID NO: 880430 - DNA, 25 bp, Mus musculus
atcaaggacgcaggcatgtttgctc

SEQ ID NO: 880431 - DNA, 25 bp, Mus musculus
atcaaggagcaggacatcaacaagg

SEQ ID NO: 880432 - DNA, 25 bp, Mus musculus
atcaaggagctgaacccggagcagg

SEQ ID NO: 880433 - DNA, 25 bp, Mus musculus
atcaaggagctgaagccggagcagg

SEQ ID NO: 880434 - DNA, 25 bp, Mus musculus
atcaaggagctggacatcaacaagg

SEQ ID NO: 880435 - DNA, 25 bp, Mus musculus
atcaaggaggcgctcccggacggtg

SEQ ID NO: 880436 - DNA, 25 bp, Mus musculus
atcaaggaggcggtcccggacggtg

SEQ ID NO: 880437 - DNA, 25 bp, Mus musculus
atcaaggagtgcaagaccaacgagt

SEQ ID NO: 880438 - DNA, 25 bp, Mus musculus
atcaaggagtgctagaccaacgagt

SEQ ID NO: 880439 - DNA, 25 bp, Mus musculus
atcaaggatatcgacgtgatcatgg

SEQ ID NO: 880440 - DNA, 25 bp, Mus musculus
atcaaggatatcgaggtgatcatgg

SEQ ID NO: 880441 - DNA, 25 bp, Mus musculus
atcaaggtctggagagaagctggat

SEQ ID NO: 880442 - DNA, 25 bp, Mus musculus
atcaaggtctggatattgaagtaat

SEQ ID NO: 880443 - DNA, 25 bp, Mus musculus
atcaaggtctggtgagaagctggat

SEQ ID NO: 880444 - DNA, 25 bp, Mus musculus
atcaaggtctggttattgaagtaat

SEQ ID NO: 880445 - DNA, 25 bp, Mus musculus
atcaagtagatgctgttcagtttat

SEQ ID NO: 880446 - DNA, 25 bp, Mus musculus
atcaagtagatggtgttcagtttat

SEQ ID NO: 880447 - DNA, 25 bp, Mus musculus
atcaagtgaccatgcaagcgtattt

SEQ ID NO: 880448 - DNA, 25 bp, Mus musculus
atcaagtgaccatggaagcgtattt

SEQ ID NO: 880449 - DNA, 25 bp, Mus musculus
atcaagtgagcaatctgaggaagct

SEQ ID NO: 880450 - DNA, 25 bp, Mus musculus
atcaagtgaggaatctgaggaagct

SEQ ID NO: 880451 - DNA, 25 bp, Mus musculus
atcaataaagagcacgtgtcacaac

SEQ ID NO: 880452 - DNA, 25 bp, Mus musculus
atcaataaagagcaggtgtcacaac

SEQ ID NO: 880453 - DNA, 25 bp, Mus musculus
atcaataagattgacaccactgttc

SEQ ID NO: 880454 - DNA, 25 bp, Mus musculus
atcaataagattgagaccactgttc

SEQ ID NO: 880455 - DNA, 25 bp, Mus musculus
atcaatacagctatactcgaaatct

SEQ ID NO: 880456 - DNA, 25 bp, Mus musculus
atcaatacagctccaaaaggtgtga

SEQ ID NO: 880457 - DNA, 25 bp, Mus musculus
atcaatacaggtatactcgaaatct

SEQ ID NO: 880458 - DNA, 25 bp, Mus musculus
atcaatacaggtccaaaaggtgtga

SEQ ID NO: 880459 - DNA, 25 bp, Mus musculus
atcaatcaagatgactgtgatgagc

SEQ ID NO: 880460 - DNA, 25 bp, Mus musculus
atcaatcaagttgactgtgatgagc

SEQ ID NO: 880461 - DNA, 25 bp, Mus musculus
atcaatctgcagaagcggcctctgg

SEQ ID NO: 880462 - DNA, 25 bp, Mus musculus
atcaatctgcagtagcggcctctgg

SEQ ID NO: 880463 - DNA, 25 bp, Mus musculus
atcaatgacttcaacggtttgattt

SEQ ID NO: 880464 - DNA, 25 bp, Mus musculus
atcaatgacttcaagggtttgattt

SEQ ID NO: 880465 - DNA, 25 bp, Mus musculus
atcaatgcagattttcccttcccct

SEQ ID NO: 880466 - DNA, 25 bp, Mus musculus
atcaatgcagcaaaggaaacagtta

SEQ ID NO: 880467 - DNA, 25 bp, Mus musculus
atcaatgcaggaaaggaaacagtta

SEQ ID NO: 880468 - DNA, 25 bp, Mus musculus
atcaatgcagtttttcccttcccct

SEQ ID NO: 880469 - DNA, 25 bp, Mus musculus
atcaatgccatatgattctttccca

SEQ ID NO: 880470 - DNA, 25 bp, Mus musculus
atcaatgccatatgtttctttccca

SEQ ID NO: 880471 - DNA, 25 bp, Mus musculus
atcaatgctttgaatttaaaatctg

SEQ ID NO: 880472 - DNA, 25 bp, Mus musculus
atcaatgctttgatcacagaggcga

SEQ ID NO: 880473 - DNA, 25 bp, Mus musculus
atcaatgctttgtatttaaaatctg

SEQ ID NO: 880474 - DNA, 25 bp, Mus musculus
atcaatgctttgttcacagaggcga

SEQ ID NO: 880475 - DNA, 25 bp, Mus musculus
atcaatgttaagcgatcgcttacac

SEQ ID NO: 880476 - DNA, 25 bp, Mus musculus
atcaatgttaagggatcgcttacac

SEQ ID NO: 880477 - DNA, 25 bp, Mus musculus
atcaattgccagagcccggcgggca

SEQ ID NO: 880478 - DNA, 25 bp, Mus musculus
atcaattgcctgagcccggcgggca

SEQ ID NO: 880479 - DNA, 25 bp, Mus musculus
atcaattgctcacgaaactcacagg

SEQ ID NO: 880480 - DNA, 25 bp, Mus musculus
atcaattgctcaggaaactcacagg

SEQ ID NO: 880481 - DNA, 25 bp, Mus musculus
atcacaacttgaatgaacgaagaag

SEQ ID NO: 880482 - DNA, 25 bp, Mus musculus
atcacaacttgattgaacgaagaag

SEQ ID NO: 880483 - DNA, 25 bp, Mus musculus
atcacaagccagcaggtggccaggt

SEQ ID NO: 880484 - DNA, 25 bp, Mus musculus
atcacaagccaggaggtggccaggt

SEQ ID NO: 880485 - DNA, 25 bp, Mus musculus
atcacaaggtctgatactcttggtc

SEQ ID NO: 880486 - DNA, 25 bp, Mus musculus
atcacaaggtgtgatactcttggtc

SEQ ID NO: 880487 - DNA, 25 bp, Mus musculus
atcacacaaaaattccagaggttgg

SEQ ID NO: 880488 - DNA, 25 bp, Mus musculus
atcacacaaacacccacagttatca

SEQ ID NO: 880489 - DNA, 25 bp, Mus musculus
atcacacaaagacccacagttatca

SEQ ID NO: 880490 - DNA, 25 bp, Mus musculus
atcacacaaatattccagaggttgg

SEQ ID NO: 880491 - DNA, 25 bp, Mus musculus
atcacacagataaactggggctcca

SEQ ID NO: 880492 - DNA, 25 bp, Mus musculus
atcacacagataaagtggggctcca

SEQ ID NO: 880493 - DNA, 25 bp, Mus musculus
atcacacagcaagtcgtgattggca

SEQ ID NO: 880494 - DNA, 25 bp, Mus musculus
atcacacagcaagtggtgattggca

SEQ ID NO: 880495 - DNA, 25 bp, Mus musculus
atcacaccagcctcagctcacaact

SEQ ID NO: 880496 - DNA, 25 bp, Mus musculus
atcacaccaggctcagctcacaact

SEQ ID NO: 880497 - DNA, 25 bp, Mus musculus
atcacaccatagatgaccactgtgt

SEQ ID NO: 880498 - DNA, 25 bp, Mus musculus
atcacaccattgatgaccactgtgt

SEQ ID NO: 880499 - DNA, 25 bp, Mus musculus
atcacactagatctttccagtggcc

SEQ ID NO: 880500 - DNA, 25 bp, Mus musculus
atcacactagttctttccagtggcc

SEQ ID NO: 880501 - DNA, 25 bp, Mus musculus
atcacactattgcgatggaagactg

SEQ ID NO: 880502 - DNA, 25 bp, Mus musculus
atcacactattgctcctgagttcaa

SEQ ID NO: 880503 - DNA, 25 bp, Mus musculus
atcacactattgggatggaagactg

SEQ ID NO: 880504 - DNA, 25 bp, Mus musculus
atcacactattggtcctgagttcaa

SEQ ID NO: 880505 - DNA, 25 bp, Mus musculus
atcacactgtagaagagaaggagga

SEQ ID NO: 880506 - DNA, 25 bp, Mus musculus
atcacactgttgaagagaaggagga

SEQ ID NO: 880507 - DNA, 25 bp, Mus musculus
atcacagaaaccaaccagttggcca

SEQ ID NO: 880508 - DNA, 25 bp, Mus musculus
atcacagaaaccaagcagttggcca

SEQ ID NO: 880509 - DNA, 25 bp, Mus musculus
atcacagaagctccctagcaggaga

SEQ ID NO: 880510 - DNA, 25 bp, Mus musculus
atcacagaaggtccctagcaggaga

SEQ ID NO: 880511 - DNA, 25 bp, Mus musculus
atcacagagtgtcgaaaagaacaca

SEQ ID NO: 880512 - DNA, 25 bp, Mus musculus
atcacagagtgtcggaaaagaacac

SEQ ID NO: 880513 - DNA, 25 bp, Mus musculus
atcacagagtgtggaaaagaacaca

SEQ ID NO: 880514 - DNA, 25 bp, Mus musculus
atcacagagtgtgggaaaagaacac

SEQ ID NO: 880515 - DNA, 25 bp, Mus musculus
atcacagatgacatcttaccacatg

SEQ ID NO: 880516 - DNA, 25 bp, Mus musculus
atcacagatgacatgttaccacatg

SEQ ID NO: 880517 - DNA, 25 bp, Mus musculus
atcacagcagctgcaggcttaggtg

SEQ ID NO: 880518 - DNA, 25 bp, Mus musculus
atcacagcaggtgcaggcttaggtg

SEQ ID NO: 880519 - DNA, 25 bp, Mus musculus
atcacagccccccttcagtatggtg

SEQ ID NO: 880520 - DNA, 25 bp, Mus musculus
atcacagcccccgttcagtatggtg

SEQ ID NO: 880521 - DNA, 25 bp, Mus musculus
atcacagctatgactggtgatggtg

SEQ ID NO: 880522 - DNA, 25 bp, Mus musculus
atcacagctatgtctggtgatggtg

SEQ ID NO: 880523 - DNA, 25 bp, Mus musculus
atcacaggacggaaagcgaatggac

SEQ ID NO: 880524 - DNA, 25 bp, Mus musculus
atcacaggacggaatgcgaatggac

SEQ ID NO: 880525 - DNA, 25 bp, Mus musculus
atcacagtatcacacgtatccaact

SEQ ID NO: 880526 - DNA, 25 bp, Mus musculus
atcacagtatcacaggtatccaact

SEQ ID NO: 880527 - DNA, 25 bp, Mus musculus
atcacagtcctgcttcctccacgta

SEQ ID NO: 880528 - DNA, 25 bp, Mus musculus
atcacagtcctggttcctccacgta

SEQ ID NO: 880529 - DNA, 25 bp, Mus musculus
atcacagtgacacggcccaatgtaa

SEQ ID NO: 880530 - DNA, 25 bp, Mus musculus
atcacagtgacagggcccaatgtaa

SEQ ID NO: 880531 - DNA, 25 bp, Mus musculus
atcacatattccccgtatacagcgt

SEQ ID NO: 880532 - DNA, 25 bp, Mus musculus
atcacatattgcccgtatacagcgt

SEQ ID NO: 880533 - DNA, 25 bp, Mus musculus
atcacatatttaccccgtatacagc

SEQ ID NO: 880534 - DNA, 25 bp, Mus musculus
atcacatatttagcccgtatacagc

SEQ ID NO: 880535 - DNA, 25 bp, Mus musculus
atcacatcagctgacagagttagtc

SEQ ID NO: 880536 - DNA, 25 bp, Mus musculus
atcacatcaggtgacagagttagtc

SEQ ID NO: 880537 - DNA, 25 bp, Mus musculus
atcacatgatcgagcctcaaggcat

SEQ ID NO: 880538 - DNA, 25 bp, Mus musculus
atcacatgatggagcctcaaggcat

SEQ ID NO: 880539 - DNA, 25 bp, Mus musculus
atcacattggcgtcttctgggacct

SEQ ID NO: 880540 - DNA, 25 bp, Mus musculus
atcacattggggtcttctgggacct

SEQ ID NO: 880541 - DNA, 25 bp, Mus musculus
atcaccaaagacctgaaggggaaga

SEQ ID NO: 880542 - DNA, 25 bp, Mus musculus
atcaccaaagatgcatttttggaac

SEQ ID NO: 880543 - DNA, 25 bp, Mus musculus
atcaccaaagctgaaaggggtctgc

SEQ ID NO: 880544 - DNA, 25 bp, Mus musculus
atcaccaaaggtgaaaggggtctgc

SEQ ID NO: 880545 - DNA, 25 bp, Mus musculus
atcaccaaagtcctgaaggggaaga

SEQ ID NO: 880546 - DNA, 25 bp, Mus musculus
atcaccaaagttgcatttttggaac

SEQ ID NO: 880547 - DNA, 25 bp, Mus musculus
atcaccaactactaactctggcctg

SEQ ID NO: 880548 - DNA, 25 bp, Mus musculus
atcaccaactactatctctggcctg

SEQ ID NO: 880549 - DNA, 25 bp, Mus musculus
atcaccacaccgcctgcgaccccag

SEQ ID NO: 880550 - DNA, 25 bp, Mus musculus
atcaccacacggcctgcgaccccag

SEQ ID NO: 880551 - DNA, 25 bp, Mus musculus
atcaccacagacatgaacagcagca

SEQ ID NO: 880552 - DNA, 25 bp, Mus musculus
atcaccacagacttgaacagcagca

SEQ ID NO: 880553 - DNA, 25 bp, Mus musculus
atcaccacagagaaagtgagcaaaa

SEQ ID NO: 880554 - DNA, 25 bp, Mus musculus
atcaccacagagaatgtgagcaaaa

SEQ ID NO: 880555 - DNA, 25 bp, Mus musculus
atcaccacaggacgaggtgttacag

SEQ ID NO: 880556 - DNA, 25 bp, Mus musculus
atcaccacaggacgtgttacagcca

SEQ ID NO: 880557 - DNA, 25 bp, Mus musculus
atcaccacaggaggaggtgttacag

SEQ ID NO: 880558 - DNA, 25 bp, Mus musculus
atcaccacaggaggtgttacagcca

SEQ ID NO: 880559 - DNA, 25 bp, Mus musculus
atcaccaccaagcacttgaaggaga

SEQ ID NO: 880560 - DNA, 25 bp, Mus musculus
atcaccaccaaggacttgaaggaga

SEQ ID NO: 880561 - DNA, 25 bp, Mus musculus
atcaccaccgtcctgggggagccca

SEQ ID NO: 880562 - DNA, 25 bp, Mus musculus
atcaccaccgtcgtgggggagccca

SEQ ID NO: 880563 - DNA, 25 bp, Mus musculus
atcaccagatatcacggtgtgaacc

SEQ ID NO: 880564 - DNA, 25 bp, Mus musculus
atcaccagatatcagggtgtgaacc

SEQ ID NO: 880565 - DNA, 25 bp, Mus musculus
atcaccagcgcgaacgtgatgctag

SEQ ID NO: 880566 - DNA, 25 bp, Mus musculus
atcaccagcgcgaaggtgatgctag

SEQ ID NO: 880567 - DNA, 25 bp, Mus musculus
atcaccaggaagccctatggaggtg

SEQ ID NO: 880568 - DNA, 25 bp, Mus musculus
atcaccaggaaggcctatggaggtg

SEQ ID NO: 880569 - DNA, 25 bp, Mus musculus
atcaccagtgcaaaagtaatgatgg

SEQ ID NO: 880570 - DNA, 25 bp, Mus musculus
atcaccagtgcaaatgtaatgatgg

SEQ ID NO: 880571 - DNA, 25 bp, Mus musculus
atcaccatgaagatctgagacaagg

SEQ ID NO: 880572 - DNA, 25 bp, Mus musculus
atcaccatgaagttctgagacaagg

SEQ ID NO: 880573 - DNA, 25 bp, Mus musculus
atcaccattcagctctttgttgctg

SEQ ID NO: 880574 - DNA, 25 bp, Mus musculus
atcaccattcaggtctttgttgctg

SEQ ID NO: 880575 - DNA, 25 bp, Mus musculus
atcacccaaacatactgaagttgtt

SEQ ID NO: 880576 - DNA, 25 bp, Mus musculus
atcacccaaacatagtgaagttgtt

SEQ ID NO: 880577 - DNA, 25 bp, Mus musculus
atcacccaagcttcagacaatgaat

SEQ ID NO: 880578 - DNA, 25 bp, Mus musculus
atcacccaaggttcagacaatgaat

SEQ ID NO: 880579 - DNA, 25 bp, Mus musculus
atcacccacgagcagcctcaaagcc

SEQ ID NO: 880580 - DNA, 25 bp, Mus musculus
atcacccacgagcctcaaagccctt

SEQ ID NO: 880581 - DNA, 25 bp, Mus musculus
atcacccacgaggagcctcaaagcc

SEQ ID NO: 880582 - DNA, 25 bp, Mus musculus
atcacccacgaggctcaaagccctt

SEQ ID NO: 880583 - DNA, 25 bp, Mus musculus
atcacccaggaactgatggcctgtg

SEQ ID NO: 880584 - DNA, 25 bp, Mus musculus
atcacccaggaagtgatggcctgtg

SEQ ID NO: 880585 - DNA, 25 bp, Mus musculus
atcaccccagagctgtggccaaacg

SEQ ID NO: 880586 - DNA, 25 bp, Mus musculus
atcaccccagaggtgtggccaaacg

SEQ ID NO: 880587 - DNA, 25 bp, Mus musculus
atcacccggactcacatcatcttta

SEQ ID NO: 880588 - DNA, 25 bp, Mus musculus
atcacccggactcagatcatcttta

SEQ ID NO: 880589 - DNA, 25 bp, Mus musculus
atcaccgaagccaacctcaccgggc

SEQ ID NO: 880590 - DNA, 25 bp, Mus musculus
atcaccgaaggcaacctcaccgggc

SEQ ID NO: 880591 - DNA, 25 bp, Mus musculus
atcaccggcgagcagtctgcaggtg

SEQ ID NO: 880592 - DNA, 25 bp, Mus musculus
atcaccggcgaggagtctgcaggtg

SEQ ID NO: 880593 - DNA, 25 bp, Mus musculus
atcacctatgagacactaaagtaca

SEQ ID NO: 880594 - DNA, 25 bp, Mus musculus
atcacctatgagagcggagaagctg

SEQ ID NO: 880595 - DNA, 25 bp, Mus musculus
atcacctatgagatggtagaagaga

SEQ ID NO: 880596 - DNA, 25 bp, Mus musculus
atcacctatgagtcactaaagtaca

SEQ ID NO: 880597 - DNA, 25 bp, Mus musculus
atcacctatgagtgcggagaagctg

SEQ ID NO: 880598 - DNA, 25 bp, Mus musculus
atcacctatgagttggtagaagaga

SEQ ID NO: 880599 - DNA, 25 bp, Mus musculus
atcacctcggtgcacgctatctatg

SEQ ID NO: 880600 - DNA, 25 bp, Mus musculus
atcacctcggtgcaggctatctatg

SEQ ID NO: 880601 - DNA, 25 bp, Mus musculus
atcaccttccagaactctgcagccc

SEQ ID NO: 880602 - DNA, 25 bp, Mus musculus
atcaccttccagactcagaactttc

SEQ ID NO: 880603 - DNA, 25 bp, Mus musculus
atcaccttccagcctcaaactacca

SEQ ID NO: 880604 - DNA, 25 bp, Mus musculus
atcaccttccaggctcaaactacca

SEQ ID NO: 880605 - DNA, 25 bp, Mus musculus
atcaccttccagtactctgcagccc

SEQ ID NO: 880606 - DNA, 25 bp, Mus musculus
atcaccttccagtctcagaactttc

SEQ ID NO: 880607 - DNA, 25 bp, Mus musculus
atcacgaggacccgccatccccagt

SEQ ID NO: 880608 - DNA, 25 bp, Mus musculus
atcacgaggaccggccatccccagt

SEQ ID NO: 880609 - DNA, 25 bp, Mus musculus
atcacgccgacgcacaaagaagaag

SEQ ID NO: 880610 - DNA, 25 bp, Mus musculus
atcacgccgacgcagaaagaagaag

SEQ ID NO: 880611 - DNA, 25 bp, Mus musculus
atcacggaactccctaagccgggca

SEQ ID NO: 880612 - DNA, 25 bp, Mus musculus
atcacggaactcctgaatgatacca

SEQ ID NO: 880613 - DNA, 25 bp, Mus musculus
atcacggaactcgctaagccgggca

SEQ ID NO: 880614 - DNA, 25 bp, Mus musculus
atcacggaactcgtgaatgatacca

SEQ ID NO: 880615 - DNA, 25 bp, Mus musculus
atcacggaagctgtctcagacataa

SEQ ID NO: 880616 - DNA, 25 bp, Mus musculus
atcacggaaggtgtctcagacataa

SEQ ID NO: 880617 - DNA, 25 bp, Mus musculus
atcacggatgagatggcagagcacc

SEQ ID NO: 880618 - DNA, 25 bp, Mus musculus
atcacggatgagttggcagagcacc

SEQ ID NO: 880619 - DNA, 25 bp, Mus musculus
atcacggcagatggcagtgaaattc

SEQ ID NO: 880620 - DNA, 25 bp, Mus musculus
atcacggcagttggcagtgaaattc

SEQ ID NO: 880621 - DNA, 25 bp, Mus musculus
atcactaaagaacaaatgctggaca

SEQ ID NO: 880622 - DNA, 25 bp, Mus musculus
atcactaaagaagaaatgctggaca

SEQ ID NO: 880623 - DNA, 25 bp, Mus musculus
atcactaagcagcattcatttcata

SEQ ID NO: 880624 - DNA, 25 bp, Mus musculus
atcactaagcaggattcatttcata

SEQ ID NO: 880625 - DNA, 25 bp, Mus musculus
atcactaataaacaagtgtgctggt

SEQ ID NO: 880626 - DNA, 25 bp, Mus musculus
atcactaataaagaagtgtgctggt

SEQ ID NO: 880627 - DNA, 25 bp, Mus musculus
atcactactgaggtcgtgcagactt

SEQ ID NO: 880628 - DNA, 25 bp, Mus musculus
atcactactgcggaaacaggcactt

SEQ ID NO: 880629 - DNA, 25 bp, Mus musculus
atcactactggggaaacaggcactt

SEQ ID NO: 880630 - DNA, 25 bp, Mus musculus
atcactactgtggtcgtgcagactt

SEQ ID NO: 880631 - DNA, 25 bp, Mus musculus
atcactatgactgacggaagtcaaa

SEQ ID NO: 880632 - DNA, 25 bp, Mus musculus
atcactatgactgagggaagtcaaa

SEQ ID NO: 880633 - DNA, 25 bp, Mus musculus
atcactcaagcagaagctgtgtgag

SEQ ID NO: 880634 - DNA, 25 bp, Mus musculus
atcactcaaggagaagctgtgtgag

SEQ ID NO: 880635 - DNA, 25 bp, Mus musculus
atcactcaggagaagccctcgaagg

SEQ ID NO: 880636 - DNA, 25 bp, Mus musculus
atcactcaggagcttctgacgggaa

SEQ ID NO: 880637 - DNA, 25 bp, Mus musculus
atcactcaggaggttctgacgggaa

SEQ ID NO: 880638 - DNA, 25 bp, Mus musculus
atcactcaggagtagccctcgaagg

SEQ ID NO: 880639 - DNA, 25 bp, Mus musculus
atcactccccagccgtgggaatggt

SEQ ID NO: 880640 - DNA, 25 bp, Mus musculus
atcactccccaggcgtgggaatggt

SEQ ID NO: 880641 - DNA, 25 bp, Mus musculus
atcactcggaagcattcctttcaca

SEQ ID NO: 880642 - DNA, 25 bp, Mus musculus
atcactcggaaggattcctttcaca

SEQ ID NO: 880643 - DNA, 25 bp, Mus musculus
atcactctgttcagagaacctaaca

SEQ ID NO: 880644 - DNA, 25 bp, Mus musculus
atcactctgttcagtgaacctaaca

SEQ ID NO: 880645 - DNA, 25 bp, Mus musculus
atcactgaaaaaagtagttcctaat

SEQ ID NO: 880646 - DNA, 25 bp, Mus musculus
atcactgaaaaatgtagttcctaat

SEQ ID NO: 880647 - DNA, 25 bp, Mus musculus
atcactgacaagaccaatgccctgg

SEQ ID NO: 880648 - DNA, 25 bp, Mus musculus
atcactgacatgaccaatgccctgg

SEQ ID NO: 880649 - DNA, 25 bp, Mus musculus
atcactgaggagaacgtgcctttca

SEQ ID NO: 880650 - DNA, 25 bp, Mus musculus
atcactgaggagaaggtgcctttca

SEQ ID NO: 880651 - DNA, 25 bp, Mus musculus
atcactgcacctccagtgaccaatc

SEQ ID NO: 880652 - DNA, 25 bp, Mus musculus
atcactgcacgtccagtgaccaatc

SEQ ID NO: 880653 - DNA, 25 bp, Mus musculus
atcactgcagatcagagtaaaggca

SEQ ID NO: 880654 - DNA, 25 bp, Mus musculus
atcactgcagttcagagtaaaggca

SEQ ID NO: 880655 - DNA, 25 bp, Mus musculus
atcactgcccagcaagggaagattt

SEQ ID NO: 880656 - DNA, 25 bp, Mus musculus
atcactgcccaggaagggaagattt

SEQ ID NO: 880657 - DNA, 25 bp, Mus musculus
atcactgtccaacacccagcaacta

SEQ ID NO: 880658 - DNA, 25 bp, Mus musculus
atcactgtccaacggcccaagtcca

SEQ ID NO: 880659 - DNA, 25 bp, Mus musculus
atcactgtccaactggacacgggcc

SEQ ID NO: 880660 - DNA, 25 bp, Mus musculus
atcactgtccaagacccagcaacta

SEQ ID NO: 880661 - DNA, 25 bp, Mus musculus
atcactgtccaagggcccaagtcca

SEQ ID NO: 880662 - DNA, 25 bp, Mus musculus
atcactgtccaagtggacacgggcc

SEQ ID NO: 880663 - DNA, 25 bp, Mus musculus
atcactgtggacatcatgtacggtg

SEQ ID NO: 880664 - DNA, 25 bp, Mus musculus
atcactgtggacatgatgtacggtg

SEQ ID NO: 880665 - DNA, 25 bp, Mus musculus
atcactgtggtacacgcaaaattgg

SEQ ID NO: 880666 - DNA, 25 bp, Mus musculus
atcactgtggtacaggcaaaattgg

SEQ ID NO: 880667 - DNA, 25 bp, Mus musculus
atcactgttgtgcactggccctttg

SEQ ID NO: 880668 - DNA, 25 bp, Mus musculus
atcactgttgtggactggccctttg

SEQ ID NO: 880669 - DNA, 25 bp, Mus musculus
atcacttaacagctgtgggcaatag

SEQ ID NO: 880670 - DNA, 25 bp, Mus musculus
atcacttaacaggtgtgggcaatag

SEQ ID NO: 880671 - DNA, 25 bp, Mus musculus
atcacttcaactgggtaaagcagga

SEQ ID NO: 880672 - DNA, 25 bp, Mus musculus
atcacttcaagtgggtaaagcagga

SEQ ID NO: 880673 - DNA, 25 bp, Mus musculus
atcacttctgggacactgtccccac

SEQ ID NO: 880674 - DNA, 25 bp, Mus musculus
atcacttctgggtcactgtccccac

SEQ ID NO: 880675 - DNA, 25 bp, Mus musculus
atcacttgtacaccgacttatcgga

SEQ ID NO: 880676 - DNA, 25 bp, Mus musculus
atcacttgtacagcgacttatcgga

SEQ ID NO: 880677 - DNA, 25 bp, Mus musculus
atcactttcaaacgcatctagtctt

SEQ ID NO: 880678 - DNA, 25 bp, Mus musculus
atcactttcaaaggcatctagtctt

SEQ ID NO: 880679 - DNA, 25 bp, Mus musculus
atcagaaaagaggtcttgcccctca

SEQ ID NO: 880680 - DNA, 25 bp, Mus musculus
atcagaaaagcccacttctaattca

SEQ ID NO: 880681 - DNA, 25 bp, Mus musculus
atcagaaaagcccagttctaattca

SEQ ID NO: 880682 - DNA, 25 bp, Mus musculus
atcagaaaagctcttgcccctcaga

SEQ ID NO: 880683 - DNA, 25 bp, Mus musculus
atcagaaaaggtcttgcccctcaga

SEQ ID NO: 880684 - DNA, 25 bp, Mus musculus
atcagaaaagtggtcttgcccctca

SEQ ID NO: 880685 - DNA, 25 bp, Mus musculus
atcagaacccagcccacacactgga

SEQ ID NO: 880686 - DNA, 25 bp, Mus musculus
atcagaacccaggccacacactgga

SEQ ID NO: 880687 - DNA, 25 bp, Mus musculus
atcagaagagagacacgatgaagat

SEQ ID NO: 880688 - DNA, 25 bp, Mus musculus
atcagaagagagtcacgatgaagat

SEQ ID NO: 880689 - DNA, 25 bp, Mus musculus
atcagaatcacaaccagccagacca

SEQ ID NO: 880690 - DNA, 25 bp, Mus musculus
atcagaatcacatccagccagacca

SEQ ID NO: 880691 - DNA, 25 bp, Mus musculus
atcagaattttccacttccagtgca

SEQ ID NO: 880692 - DNA, 25 bp, Mus musculus
atcagaattttccagttccagtgca

SEQ ID NO: 880693 - DNA, 25 bp, Mus musculus
atcagacaggccaacgtttcatact

SEQ ID NO: 880694 - DNA, 25 bp, Mus musculus
atcagacagggcaacgtttcatact

SEQ ID NO: 880695 - DNA, 25 bp, Mus musculus
atcagaccacagcttctcccctatg

SEQ ID NO: 880696 - DNA, 25 bp, Mus musculus
atcagaccacagctttgtccagagg

SEQ ID NO: 880697 - DNA, 25 bp, Mus musculus
atcagaccacaggttctcccctatg

SEQ ID NO: 880698 - DNA, 25 bp, Mus musculus
atcagaccacaggtttgtccagagg

SEQ ID NO: 880699 - DNA, 25 bp, Mus musculus
atcagacttccacgtgaatctaaac

SEQ ID NO: 880700 - DNA, 25 bp, Mus musculus
atcagacttccaggtgaatctaaac

SEQ ID NO: 880701 - DNA, 25 bp, Mus musculus
atcagagcgatgactggtccttcgg

SEQ ID NO: 880702 - DNA, 25 bp, Mus musculus
atcagagcgatgtctggtccttcgg

SEQ ID NO: 880703 - DNA, 25 bp, Mus musculus
atcagagtaacgaccaatctcacac

SEQ ID NO: 880704 - DNA, 25 bp, Mus musculus
atcagagtaacgacgaatctcacac

SEQ ID NO: 880705 - DNA, 25 bp, Mus musculus
atcagagtaaggaccaatctcacac

SEQ ID NO: 880706 - DNA, 25 bp, Mus musculus
atcagagtaaggacgaatctcacac

SEQ ID NO: 880707 - DNA, 25 bp, Mus musculus
atcagatgcccaccaccccttgggg

SEQ ID NO: 880708 - DNA, 25 bp, Mus musculus
atcagatgcccagcaccccttgggg

SEQ ID NO: 880709 - DNA, 25 bp, Mus musculus
atcagattcgagcgaaattctttgc

SEQ ID NO: 880710 - DNA, 25 bp, Mus musculus
atcagattcgagggaaattctttgc

SEQ ID NO: 880711 - DNA, 25 bp, Mus musculus
atcagattctaccacgaaatgttgg

SEQ ID NO: 880712 - DNA, 25 bp, Mus musculus
atcagattctaccaggaaatgttgg

SEQ ID NO: 880713 - DNA, 25 bp, Mus musculus
atcagcaaagcatcgaccattatca

SEQ ID NO: 880714 - DNA, 25 bp, Mus musculus
atcagcaaaggatcgaccattatca

SEQ ID NO: 880715 - DNA, 25 bp, Mus musculus
atcagcaactgagacgggagcaaat

SEQ ID NO: 880716 - DNA, 25 bp, Mus musculus
atcagcaactgagaggggagcaaat

SEQ ID NO: 880717 - DNA, 25 bp, Mus musculus
atcagcaagcagattaccaggaagg

SEQ ID NO: 880718 - DNA, 25 bp, Mus musculus
atcagcaagcagcttcaggatctca

SEQ ID NO: 880719 - DNA, 25 bp, Mus musculus
atcagcaagctgattaccaggaagg

SEQ ID NO: 880720 - DNA, 25 bp, Mus musculus
atcagcaagctgcttcaggatctca

SEQ ID NO: 880721 - DNA, 25 bp, Mus musculus
atcagcaaggagctagctgagccac

SEQ ID NO: 880722 - DNA, 25 bp, Mus musculus
atcagcaaggtgctagctgagccac

SEQ ID NO: 880723 - DNA, 25 bp, Mus musculus
atcagcaatgtggacctggccatgg

SEQ ID NO: 880724 - DNA, 25 bp, Mus musculus
atcagcaatgtggagctggccatgg

SEQ ID NO: 880725 - DNA, 25 bp, Mus musculus
atcagcaccatgcacgctgtcttct

SEQ ID NO: 880726 - DNA, 25 bp, Mus musculus
atcagcaccatgcaggctgtcttct

SEQ ID NO: 880727 - DNA, 25 bp, Mus musculus
atcagcacgaatcgtgcagtctttg

SEQ ID NO: 880728 - DNA, 25 bp, Mus musculus
atcagcacgaatggtgcagtctttg

SEQ ID NO: 880729 - DNA, 25 bp, Mus musculus
atcagcactttgcacgttggtgaga

SEQ ID NO: 880730 - DNA, 25 bp, Mus musculus
atcagcactttgcaggttggtgaga

SEQ ID NO: 880731 - DNA, 25 bp, Mus musculus
atcagcagatcgatttgaatgtaac

SEQ ID NO: 880732 - DNA, 25 bp, Mus musculus
atcagcagatcgttttgaatgtaac

SEQ ID NO: 880733 - DNA, 25 bp, Mus musculus
atcagcagccagatcccagccacag

SEQ ID NO: 880734 - DNA, 25 bp, Mus musculus
atcagcagccagttcccagccacag

SEQ ID NO: 880735 - DNA, 25 bp, Mus musculus
atcagcaggccaactctacaatggc

SEQ ID NO: 880736 - DNA, 25 bp, Mus musculus
atcagcaggccatctctacaatggc

SEQ ID NO: 880737 - DNA, 25 bp, Mus musculus
atcagcatacaacggagactctgga

SEQ ID NO: 880738 - DNA, 25 bp, Mus musculus
atcagcatacaagggagactctgga

SEQ ID NO: 880739 - DNA, 25 bp, Mus musculus
atcagccaacccaaatgcccggccc

SEQ ID NO: 880740 - DNA, 25 bp, Mus musculus
atcagccaacccaattgcccggccc

SEQ ID NO: 880741 - DNA, 25 bp, Mus musculus
atcagccacagacgccgttcccata

SEQ ID NO: 880742 - DNA, 25 bp, Mus musculus
atcagccacagaggccgttcccata

SEQ ID NO: 880743 - DNA, 25 bp, Mus musculus
atcagcccagacacagtggctgctt

SEQ ID NO: 880744 - DNA, 25 bp, Mus musculus
atcagcccagacactgtggctgctt

SEQ ID NO: 880745 - DNA, 25 bp, Mus musculus
atcagcccagctgccctccctgggg

SEQ ID NO: 880746 - DNA, 25 bp, Mus musculus
atcagcccaggtgccctccctgggg

SEQ ID NO: 880747 - DNA, 25 bp, Mus musculus
atcagccgccatgaagctcaacgtg

SEQ ID NO: 880748 - DNA, 25 bp, Mus musculus
atcagccgccatgatgctcaacgtg

SEQ ID NO: 880749 - DNA, 25 bp, Mus musculus
atcagccgggaagacgtgctgagct

SEQ ID NO: 880750 - DNA, 25 bp, Mus musculus
atcagccgggaagaggtgctgagct

SEQ ID NO: 880751 - DNA, 25 bp, Mus musculus
atcagccgttttaacataccgattt

SEQ ID NO: 880752 - DNA, 25 bp, Mus musculus
atcagccgttttaagataccgattt

SEQ ID NO: 880753 - DNA, 25 bp, Mus musculus
atcagcctagcacgcccagcaacac

SEQ ID NO: 880754 - DNA, 25 bp, Mus musculus
atcagcctagcaggcccagcaacac

SEQ ID NO: 880755 - DNA, 25 bp, Mus musculus
atcagcgtggcaccttctatcagcc

SEQ ID NO: 880756 - DNA, 25 bp, Mus musculus
atcagcgtggcagcttctatcagcc

SEQ ID NO: 880757 - DNA, 25 bp, Mus musculus
atcagctaaagaaaagtggagacca

SEQ ID NO: 880758 - DNA, 25 bp, Mus musculus
atcagctaaagataagtggagacca

SEQ ID NO: 880759 - DNA, 25 bp, Mus musculus
atcagctgaacgctccctggctgaa

SEQ ID NO: 880760 - DNA, 25 bp, Mus musculus
atcagctgaaggctccctggctgaa

SEQ ID NO: 880761 - DNA, 25 bp, Mus musculus
atcagcttagactccttcgccctgc

SEQ ID NO: 880762 - DNA, 25 bp, Mus musculus
atcagcttagtctccttcgccctgc

SEQ ID NO: 880763 - DNA, 25 bp, Mus musculus
atcagcttcacgctggctatcgact

SEQ ID NO: 880764 - DNA, 25 bp, Mus musculus
atcagcttcacggtggctatcgact

SEQ ID NO: 880765 - DNA, 25 bp, Mus musculus
atcaggaaatgtggcgtggctgctg

SEQ ID NO: 880766 - DNA, 25 bp, Mus musculus
atcaggaaatgtggggtggctgctg

SEQ ID NO: 880767 - DNA, 25 bp, Mus musculus
atcaggaaggagcaggaagaattga

SEQ ID NO: 880768 - DNA, 25 bp, Mus musculus
atcaggaaggtgcaggaagaattga

SEQ ID NO: 880769 - DNA, 25 bp, Mus musculus
atcaggacagacttgaaccggacat

SEQ ID NO: 880770 - DNA, 25 bp, Mus musculus
atcaggacagtcttgaaccggacat

SEQ ID NO: 880771 - DNA, 25 bp, Mus musculus
atcaggactccattaacaacttcag

SEQ ID NO: 880772 - DNA, 25 bp, Mus musculus
atcaggactccatttacaacttcag

SEQ ID NO: 880773 - DNA, 25 bp, Mus musculus
atcaggagtataaggctcactttgt

SEQ ID NO: 880774 - DNA, 25 bp, Mus musculus
atcaggagtatatggctcactttgt

SEQ ID NO: 880775 - DNA, 25 bp, Mus musculus
atcaggatacagctgatctggtact

SEQ ID NO: 880776 - DNA, 25 bp, Mus musculus
atcaggatacaggtgatctggtact

SEQ ID NO: 880777 - DNA, 25 bp, Mus musculus
atcaggcatgaagccgtcccgctct

SEQ ID NO: 880778 - DNA, 25 bp, Mus musculus
atcaggcatgaagcggtcccgctct

SEQ ID NO: 880779 - DNA, 25 bp, Mus musculus
atcagggaagatacattgtgtgtga

SEQ ID NO: 880780 - DNA, 25 bp, Mus musculus
atcagggaagcttccctgttgaaag

SEQ ID NO: 880781 - DNA, 25 bp, Mus musculus
atcagggaaggttccctgttgaaag

SEQ ID NO: 880782 - DNA, 25 bp, Mus musculus
atcagggaagttacattgtgtgtga

SEQ ID NO: 880783 - DNA, 25 bp, Mus musculus
atcagggcgaagcgactgaagccca

SEQ ID NO: 880784 - DNA, 25 bp, Mus musculus
atcagggcgaagggactgaagccca

SEQ ID NO: 880785 - DNA, 25 bp, Mus musculus
atcagggctcaacgaggtagatgac

SEQ ID NO: 880786 - DNA, 25 bp, Mus musculus
atcagggctcaaggaggtagatgac

SEQ ID NO: 880787 - DNA, 25 bp, Mus musculus
atcaggtcaccaccatgggattttg

SEQ ID NO: 880788 - DNA, 25 bp, Mus musculus
atcaggtcaccagcatgggattttg

SEQ ID NO: 880789 - DNA, 25 bp, Mus musculus
atcaggtgctagcttaaagatcgag

SEQ ID NO: 880790 - DNA, 25 bp, Mus musculus
atcaggtgctaggttaaagatcgag

SEQ ID NO: 880791 - DNA, 25 bp, Mus musculus
atcagtacagacatgcctgcagcct

SEQ ID NO: 880792 - DNA, 25 bp, Mus musculus
atcagtacagcactaggcaagttgc

SEQ ID NO: 880793 - DNA, 25 bp, Mus musculus
atcagtacagcagtaggcaagttgc

SEQ ID NO: 880794 - DNA, 25 bp, Mus musculus
atcagtacagcgagcagatcaagcg

SEQ ID NO: 880795 - DNA, 25 bp, Mus musculus
atcagtacagggagcagatcaagcg

SEQ ID NO: 880796 - DNA, 25 bp, Mus musculus
atcagtacagtcatgcctgcagcct

SEQ ID NO: 880797 - DNA, 25 bp, Mus musculus
atcagtacctcacagactccaaatt

SEQ ID NO: 880798 - DNA, 25 bp, Mus musculus
atcagtacctcagagactccaaatt

SEQ ID NO: 880799 - DNA, 25 bp, Mus musculus
atcagtatacatcggagactctgga

SEQ ID NO: 880800 - DNA, 25 bp, Mus musculus
atcagtatacatgggagactctgga

SEQ ID NO: 880801 - DNA, 25 bp, Mus musculus
atcagtcctcagatgcggtgagcac

SEQ ID NO: 880802 - DNA, 25 bp, Mus musculus
atcagtcctcagttgcggtgagcac

SEQ ID NO: 880803 - DNA, 25 bp, Mus musculus
atcagtcctccccacaaatagatga

SEQ ID NO: 880804 - DNA, 25 bp, Mus musculus
atcagtcctccccagaaatagatga

SEQ ID NO: 880805 - DNA, 25 bp, Mus musculus
atcagtgaagcgtgacaaaggtgat

SEQ ID NO: 880806 - DNA, 25 bp, Mus musculus
atcagtgaagggtgacaaaggtgat

SEQ ID NO: 880807 - DNA, 25 bp, Mus musculus
atcagtgacgctaaaccagtcagcc

SEQ ID NO: 880808 - DNA, 25 bp, Mus musculus
atcagtgacggtaaaccagtcagcc

SEQ ID NO: 880809 - DNA, 25 bp, Mus musculus
atcagtgccatgacatcgacgagtg

SEQ ID NO: 880810 - DNA, 25 bp, Mus musculus
atcagtgccatgtcatcgacgagtg

SEQ ID NO: 880811 - DNA, 25 bp, Mus musculus
atcagtggatcacaccctgaaagct

SEQ ID NO: 880812 - DNA, 25 bp, Mus musculus
atcagtggatcagaccctgaaagct

SEQ ID NO: 880813 - DNA, 25 bp, Mus musculus
atcagtgggaagatgactctaaagg

SEQ ID NO: 880814 - DNA, 25 bp, Mus musculus
atcagtgggaagttgactctaaagg

SEQ ID NO: 880815 - DNA, 25 bp, Mus musculus
atcagtggggcgccccctgcccgga

SEQ ID NO: 880816 - DNA, 25 bp, Mus musculus
atcagtggggcggcccctgcccgga

SEQ ID NO: 880817 - DNA, 25 bp, Mus musculus
atcagtgtatcacgatgatgctgtt

SEQ ID NO: 880818 - DNA, 25 bp, Mus musculus
atcagtgtatcaggatgatgctgtt

SEQ ID NO: 880819 - DNA, 25 bp, Mus musculus
atcagtgtgagtatatacacttctg

SEQ ID NO: 880820 - DNA, 25 bp, Mus musculus
atcagtgtgagtttatacacttctg

SEQ ID NO: 880821 - DNA, 25 bp, Mus musculus
atcagttaagctcattgttgtggga

SEQ ID NO: 880822 - DNA, 25 bp, Mus musculus
atcagttaaggtcattgttgtggga

SEQ ID NO: 880823 - DNA, 25 bp, Mus musculus
atcagttcaactctgttatctccta

SEQ ID NO: 880824 - DNA, 25 bp, Mus musculus
atcagttcaagtctgttatctccta

SEQ ID NO: 880825 - DNA, 25 bp, Mus musculus
atcagttctcagacttggattcagc

SEQ ID NO: 880826 - DNA, 25 bp, Mus musculus
atcagttctcagtcttggattcagc

SEQ ID NO: 880827 - DNA, 25 bp, Mus musculus
atcagttctgacccccacttcgagg

SEQ ID NO: 880828 - DNA, 25 bp, Mus musculus
atcagttctgagctcaaagatccag

SEQ ID NO: 880829 - DNA, 25 bp, Mus musculus
atcagttctgtcccccacttcgagg

SEQ ID NO: 880830 - DNA, 25 bp, Mus musculus
atcagttctgtgctcaaagatccag

SEQ ID NO: 880831 - DNA, 25 bp, Mus musculus
atcataacagctcactgccaggggg

SEQ ID NO: 880832 - DNA, 25 bp, Mus musculus
atcataacaggtcactgccaggggg

SEQ ID NO: 880833 - DNA, 25 bp, Mus musculus
atcataacccggcacaactacacat

SEQ ID NO: 880834 - DNA, 25 bp, Mus musculus
atcataacccggcagaactacacat

SEQ ID NO: 880835 - DNA, 25 bp, Mus musculus
atcataaccgtgcacgttgagaatg

SEQ ID NO: 880836 - DNA, 25 bp, Mus musculus
atcataaccgtgcaggttgagaatg

SEQ ID NO: 880837 - DNA, 25 bp, Mus musculus
atcatacaccctcgaggcgtaagac

SEQ ID NO: 880838 - DNA, 25 bp, Mus musculus
atcatacaccctggaggcgtaagac

SEQ ID NO: 880839 - DNA, 25 bp, Mus musculus
atcataccgctgcacggtcccagcc

SEQ ID NO: 880840 - DNA, 25 bp, Mus musculus
atcataccgctgcagggtcccagcc

SEQ ID NO: 880841 - DNA, 25 bp, Mus musculus
atcatatctgcccatcagacactgg

SEQ ID NO: 880842 - DNA, 25 bp, Mus musculus
atcatatctggccatcagacactgg

SEQ ID NO: 880843 - DNA, 25 bp, Mus musculus
atcatatggagacacgtgtcctggg

SEQ ID NO: 880844 - DNA, 25 bp, Mus musculus
atcatatggagactatgctattaag

SEQ ID NO: 880845 - DNA, 25 bp, Mus musculus
atcatatggagagacgtgtcctggg

SEQ ID NO: 880846 - DNA, 25 bp, Mus musculus
atcatatggagagtatgctattaag

SEQ ID NO: 880847 - DNA, 25 bp, Mus musculus
atcatatggcagagactgagttgaa

SEQ ID NO: 880848 - DNA, 25 bp, Mus musculus
atcatatggcagatgactgagttga

SEQ ID NO: 880849 - DNA, 25 bp, Mus musculus
atcatatggcagtgactgagttgaa

SEQ ID NO: 880850 - DNA, 25 bp, Mus musculus
atcatatggcagttgactgagttga

SEQ ID NO: 880851 - DNA, 25 bp, Mus musculus
atcatcaaaaacaacattttctata

SEQ ID NO: 880852 - DNA, 25 bp, Mus musculus
atcatcaaaaagacattcaggtatt

SEQ ID NO: 880853 - DNA, 25 bp, Mus musculus
atcatcaaaaagtcattcaggtatt

SEQ ID NO: 880854 - DNA, 25 bp, Mus musculus
atcatcaaaactcgaagtttggtga

SEQ ID NO: 880855 - DNA, 25 bp, Mus musculus
atcatcaaaactggaagtttggtga

SEQ ID NO: 880856 - DNA, 25 bp, Mus musculus
atcatcaaaatcaacattttctata

SEQ ID NO: 880857 - DNA, 25 bp, Mus musculus
atcatcaaacagaacgcaacactgc

SEQ ID NO: 880858 - DNA, 25 bp, Mus musculus
atcatcaaacagaaggcaacactgc

SEQ ID NO: 880859 - DNA, 25 bp, Mus musculus
atcatcaaggaggccctcccggacg

SEQ ID NO: 880860 - DNA, 25 bp, Mus musculus
atcatcaaggaggcgctcccggacg

SEQ ID NO: 880861 - DNA, 25 bp, Mus musculus
atcatcacagacaccacggcgacga

SEQ ID NO: 880862 - DNA, 25 bp, Mus musculus
atcatcacagattctcgagcaggtg

SEQ ID NO: 880863 - DNA, 25 bp, Mus musculus
atcatcacagtcaccacggcgacga

SEQ ID NO: 880864 - DNA, 25 bp, Mus musculus
atcatcacagtttctcgagcaggtg

SEQ ID NO: 880865 - DNA, 25 bp, Mus musculus
atcatcaccatgcgaaatgcctcct

SEQ ID NO: 880866 - DNA, 25 bp, Mus musculus
atcatcaccatgggaaatgcctcct

SEQ ID NO: 880867 - DNA, 25 bp, Mus musculus
atcatcacggcacatggcagtgaaa

SEQ ID NO: 880868 - DNA, 25 bp, Mus musculus
atcatcacggcagatggcagtgaaa

SEQ ID NO: 880869 - DNA, 25 bp, Mus musculus
atcatcactgcccctggctaaacaa

SEQ ID NO: 880870 - DNA, 25 bp, Mus musculus
atcatcactgccgctggctaaacaa

SEQ ID NO: 880871 - DNA, 25 bp, Mus musculus
atcatcacttctggcacactgtccc

SEQ ID NO: 880872 - DNA, 25 bp, Mus musculus
atcatcacttctgggacactgtccc

SEQ ID NO: 880873 - DNA, 25 bp, Mus musculus
atcatcagggcgaacggactgaagc

SEQ ID NO: 880874 - DNA, 25 bp, Mus musculus
atcatcagggcgaagggactgaagc

SEQ ID NO: 880875 - DNA, 25 bp, Mus musculus
atcatcatcgagccaaacgaccggc

SEQ ID NO: 880876 - DNA, 25 bp, Mus musculus
atcatcatcgaggcaaacgaccggc

SEQ ID NO: 880877 - DNA, 25 bp, Mus musculus
atcatcattgctcgtcccccaggaa

SEQ ID NO: 880878 - DNA, 25 bp, Mus musculus
atcatcattgctggtcccccaggaa

SEQ ID NO: 880879 - DNA, 25 bp, Mus musculus
atcatccacaggcacttaaaaccca

SEQ ID NO: 880880 - DNA, 25 bp, Mus musculus
atcatccacagggacttaaaaccca

SEQ ID NO: 880881 - DNA, 25 bp, Mus musculus
atcatccaccagacgggaagtaaaa

SEQ ID NO: 880882 - DNA, 25 bp, Mus musculus
atcatccaccagtcgggaagtaaaa

SEQ ID NO: 880883 - DNA, 25 bp, Mus musculus
atcatccacgcactgattgacgaga

SEQ ID NO: 880884 - DNA, 25 bp, Mus musculus
atcatccacgcagtgattgacgaga

SEQ ID NO: 880885 - DNA, 25 bp, Mus musculus
atcatccagactgaattccgatgct

SEQ ID NO: 880886 - DNA, 25 bp, Mus musculus
atcatccagactgatttccgatgct

SEQ ID NO: 880887 - DNA, 25 bp, Mus musculus
atcatccagctgcgtggcaccatta

SEQ ID NO: 880888 - DNA, 25 bp, Mus musculus
atcatccagctgggtggcaccatta

SEQ ID NO: 880889 - DNA, 25 bp, Mus musculus
atcatcccaacatacttaagttgtt

SEQ ID NO: 880890 - DNA, 25 bp, Mus musculus
atcatcccaacatagttaagttgtt

SEQ ID NO: 880891 - DNA, 25 bp, Mus musculus
atcatcccaccacgggcttgctgtc

SEQ ID NO: 880892 - DNA, 25 bp, Mus musculus
atcatcccaccaggggcttgctgtc

SEQ ID NO: 880893 - DNA, 25 bp, Mus musculus
atcatcccagcctatgggaaggtgt

SEQ ID NO: 880894 - DNA, 25 bp, Mus musculus
atcatcccaggctatgggaaggtgt

SEQ ID NO: 880895 - DNA, 25 bp, Mus musculus
atcatcccccatatgcagtggaagt

SEQ ID NO: 880896 - DNA, 25 bp, Mus musculus
atcatcccccatttgcagtggaagt

SEQ ID NO: 880897 - DNA, 25 bp, Mus musculus
atcatcccgaagcttcttgctcaga

SEQ ID NO: 880898 - DNA, 25 bp, Mus musculus
atcatcccgaaggttcttgctcaga

SEQ ID NO: 880899 - DNA, 25 bp, Mus musculus
atcatcctgagtgacatggaaatag

SEQ ID NO: 880900 - DNA, 25 bp, Mus musculus
atcatcctgagtgacgtcatccact

SEQ ID NO: 880901 - DNA, 25 bp, Mus musculus
atcatcctgagtgagatggaaatag

SEQ ID NO: 880902 - DNA, 25 bp, Mus musculus
atcatcctgagtgaggtcatccact

SEQ ID NO: 880903 - DNA, 25 bp, Mus musculus
atcatcctgctgacaggactatgac

SEQ ID NO: 880904 - DNA, 25 bp, Mus musculus
atcatcctgctgacctacattcagc

SEQ ID NO: 880905 - DNA, 25 bp, Mus musculus
atcatcctgctgtcaggactatgac

SEQ ID NO: 880906 - DNA, 25 bp, Mus musculus
atcatcctgctgtcctacattcagc

SEQ ID NO: 880907 - DNA, 25 bp, Mus musculus
atcatcctggtgatcctgctggcag

SEQ ID NO: 880908 - DNA, 25 bp, Mus musculus
atcatcctggtgttcctgctggcag

SEQ ID NO: 880909 - DNA, 25 bp, Mus musculus
atcatccttaccaagagatgtcgat

SEQ ID NO: 880910 - DNA, 25 bp, Mus musculus
atcatccttaccagggagaagaaac

SEQ ID NO: 880911 - DNA, 25 bp, Mus musculus
atcatccttagcaagagatgtcgat

SEQ ID NO: 880912 - DNA, 25 bp, Mus musculus
atcatccttagcagggagaagaaac

SEQ ID NO: 880913 - DNA, 25 bp, Mus musculus
atcatcgaaatgaagattggataac

SEQ ID NO: 880914 - DNA, 25 bp, Mus musculus
atcatcgaaatgatgccagaatttc

SEQ ID NO: 880915 - DNA, 25 bp, Mus musculus
atcatcgaaatgcaaatcagagatg

SEQ ID NO: 880916 - DNA, 25 bp, Mus musculus
atcatcgaaatggaaatcagagatg

SEQ ID NO: 880917 - DNA, 25 bp, Mus musculus
atcatcgaaatgtagattggataac

SEQ ID NO: 880918 - DNA, 25 bp, Mus musculus
atcatcgaaatgttgccagaatttc

SEQ ID NO: 880919 - DNA, 25 bp, Mus musculus
atcatcgatgctgcacaggaggccc

SEQ ID NO: 880920 - DNA, 25 bp, Mus musculus
atcatcgatggtgcacaggaggccc

SEQ ID NO: 880921 - DNA, 25 bp, Mus musculus
atcatcgcactgcacacaattgcct

SEQ ID NO: 880922 - DNA, 25 bp, Mus musculus
atcatcgcactgcagacaattgcct

SEQ ID NO: 880923 - DNA, 25 bp, Mus musculus
atcatcggagatttggaccaatcga

SEQ ID NO: 880924 - DNA, 25 bp, Mus musculus
atcatcggagttttggaccaatcga

SEQ ID NO: 880925 - DNA, 25 bp, Mus musculus
atcatcgggaaacgcgctgcctatt

SEQ ID NO: 880926 - DNA, 25 bp, Mus musculus
atcatcgggaaaggcgctgcctatt

SEQ ID NO: 880927 - DNA, 25 bp, Mus musculus
atcatcgtgcggcatgagtccacgg

SEQ ID NO: 880928 - DNA, 25 bp, Mus musculus
atcatcgtgcgggatgagtccacgg

SEQ ID NO: 880929 - DNA, 25 bp, Mus musculus
atcatctacttaaacgctttatctt

SEQ ID NO: 880930 - DNA, 25 bp, Mus musculus
atcatctacttaaaggctttatctt

SEQ ID NO: 880931 - DNA, 25 bp, Mus musculus
atcatctcactgacaatttagagac

SEQ ID NO: 880932 - DNA, 25 bp, Mus musculus
atcatctcactgtcaatttagagac

SEQ ID NO: 880933 - DNA, 25 bp, Mus musculus
atcatctgcggaagcgaaacaacct

SEQ ID NO: 880934 - DNA, 25 bp, Mus musculus
atcatctgcggaagggaaacaacct

SEQ ID NO: 880935 - DNA, 25 bp, Mus musculus
atcatctgttgaaacctttcctgca

SEQ ID NO: 880936 - DNA, 25 bp, Mus musculus
atcatctgttgaaagctttcctgca

SEQ ID NO: 880937 - DNA, 25 bp, Mus musculus
atcatgaacaaaagtacttcccttt

SEQ ID NO: 880938 - DNA, 25 bp, Mus musculus
atcatgaacaaatgtacttcccttt

SEQ ID NO: 880939 - DNA, 25 bp, Mus musculus
atcatgataaatgacgacatagcat

SEQ ID NO: 880940 - DNA, 25 bp, Mus musculus
atcatgataaatgaggacatagcat

SEQ ID NO: 880941 - DNA, 25 bp, Mus musculus
atcatgatgatgccttcctctccat

SEQ ID NO: 880942 - DNA, 25 bp, Mus musculus
atcatgatgatggcttcctctccat

SEQ ID NO: 880943 - DNA, 25 bp, Mus musculus
atcatgcacaagattcgacctcata

SEQ ID NO: 880944 - DNA, 25 bp, Mus musculus
atcatgcacaagtttcgacctcata

SEQ ID NO: 880945 - DNA, 25 bp, Mus musculus
atcatgcagaagctggctggcgaac

SEQ ID NO: 880946 - DNA, 25 bp, Mus musculus
atcatgcagaaggtggctggcgaac

SEQ ID NO: 880947 - DNA, 25 bp, Mus musculus
atcatgcataaattcaatctgtata

SEQ ID NO: 880948 - DNA, 25 bp, Mus musculus
atcatgcataaattgaatctgtata

SEQ ID NO: 880949 - DNA, 25 bp, Mus musculus
atcatgccagctacccgcaagatgg

SEQ ID NO: 880950 - DNA, 25 bp, Mus musculus
atcatgccaggtacccgcaagatgg

SEQ ID NO: 880951 - DNA, 25 bp, Mus musculus
atcatgcgcccgaatgacagtcctt

SEQ ID NO: 880952 - DNA, 25 bp, Mus musculus
atcatgcgcccgtatgacagtcctt

SEQ ID NO: 880953 - DNA, 25 bp, Mus musculus
atcatgcgggaatgacaagcagtag

SEQ ID NO: 880954 - DNA, 25 bp, Mus musculus
atcatgcgggaatgtcaagcagtag

SEQ ID NO: 880955 - DNA, 25 bp, Mus musculus
atcatgctattaaacctggagagta

SEQ ID NO: 880956 - DNA, 25 bp, Mus musculus
atcatgctattaaacctggtgagaa

SEQ ID NO: 880957 - DNA, 25 bp, Mus musculus
atcatgctattaaagctggagagta

SEQ ID NO: 880958 - DNA, 25 bp, Mus musculus
atcatgctattaaagctggtgagaa

SEQ ID NO: 880959 - DNA, 25 bp, Mus musculus
atcatgctggcaaacgcgggttcca

SEQ ID NO: 880960 - DNA, 25 bp, Mus musculus
atcatgctggcaaaggcgggttcca

SEQ ID NO: 880961 - DNA, 25 bp, Mus musculus
atcatggagaagctattcgagaggg

SEQ ID NO: 880962 - DNA, 25 bp, Mus musculus
atcatggagaaggtattcgagaggg

SEQ ID NO: 880963 - DNA, 25 bp, Mus musculus
atcatggcggagaaagtgaacaact

SEQ ID NO: 880964 - DNA, 25 bp, Mus musculus
atcatggcggctttgagcaggttgt

SEQ ID NO: 880965 - DNA, 25 bp, Mus musculus
atcatggcgggtttgagcaggttgt

SEQ ID NO: 880966 - DNA, 25 bp, Mus musculus
atcatggcggtgaaagtgaacaact

SEQ ID NO: 880967 - DNA, 25 bp, Mus musculus
atcatggtgcagaaccatgcactag

SEQ ID NO: 880968 - DNA, 25 bp, Mus musculus
atcatggtgcagtaccatgcactag

SEQ ID NO: 880969 - DNA, 25 bp, Mus musculus
atcatgtcatcacgcagcctgatct

SEQ ID NO: 880970 - DNA, 25 bp, Mus musculus
atcatgtcatcaggcagcctgatct

SEQ ID NO: 880971 - DNA, 25 bp, Mus musculus
atcatgtggtacaacgatgaggtgc

SEQ ID NO: 880972 - DNA, 25 bp, Mus musculus
atcatgtggtacaaggatgaggtgc

SEQ ID NO: 880973 - DNA, 25 bp, Mus musculus
atcatgttgctgaaccttcaaaaga

SEQ ID NO: 880974 - DNA, 25 bp, Mus musculus
atcatgttgctgaagcttcaaaaga

SEQ ID NO: 880975 - DNA, 25 bp, Mus musculus
atcatgtttgctccggacatctgcg

SEQ ID NO: 880976 - DNA, 25 bp, Mus musculus
atcatgtttggtccggacatctgcg

SEQ ID NO: 880977 - DNA, 25 bp, Mus musculus
atcattaaaaacatcctggaaaaca

SEQ ID NO: 880978 - DNA, 25 bp, Mus musculus
atcattaaaaacttcctggaaaaca

SEQ ID NO: 880979 - DNA, 25 bp, Mus musculus
atcattacagaaaacggtgtgtttg

SEQ ID NO: 880980 - DNA, 25 bp, Mus musculus
atcattacagaaaagggtgtgtttg

SEQ ID NO: 880981 - DNA, 25 bp, Mus musculus
atcattacagaatttgcaaagtccc

SEQ ID NO: 880982 - DNA, 25 bp, Mus musculus
atcattacagtatttgcaaagtccc

SEQ ID NO: 880983 - DNA, 25 bp, Mus musculus
atcattactgaaaatctttggagta

SEQ ID NO: 880984 - DNA, 25 bp, Mus musculus
atcattactgtaaatctttggagta

SEQ ID NO: 880985 - DNA, 25 bp, Mus musculus
atcattattttacacacagaatgtt

SEQ ID NO: 880986 - DNA, 25 bp, Mus musculus
atcattattttagacacagaatgtt

SEQ ID NO: 880987 - DNA, 25 bp, Mus musculus
atcattcactttaactcagctattg

SEQ ID NO: 880988 - DNA, 25 bp, Mus musculus
atcattcactttaagtcagctattg

SEQ ID NO: 880989 - DNA, 25 bp, Mus musculus
atcattccaagaagaagcccgggac

SEQ ID NO: 880990 - DNA, 25 bp, Mus musculus
atcattccaagatgaagcccgggac

SEQ ID NO: 880991 - DNA, 25 bp, Mus musculus
atcattccacagctctgcgaagacc

SEQ ID NO: 880992 - DNA, 25 bp, Mus musculus
atcattccacaggtctgcgaagacc

SEQ ID NO: 880993 - DNA, 25 bp, Mus musculus
atcattcccaagaacctgctggact

SEQ ID NO: 880994 - DNA, 25 bp, Mus musculus
atcattcccaagcactgtgccggtg

SEQ ID NO: 880995 - DNA, 25 bp, Mus musculus
atcattcccaaggactgtgccggtg

SEQ ID NO: 880996 - DNA, 25 bp, Mus musculus
atcattcccaagtacctgctggact

SEQ ID NO: 880997 - DNA, 25 bp, Mus musculus
atcattcgccaaaacgaaggatacc

SEQ ID NO: 880998 - DNA, 25 bp, Mus musculus
atcattcgccaaaaggaaggatacc

SEQ ID NO: 880999 - DNA, 25 bp, Mus musculus
atcattctcactagtgggaagtgta

SEQ ID NO: 881000 - DNA, 25 bp, Mus musculus
atcattctcacttgtgggaagtgta

SEQ ID NO: 881001 - DNA, 25 bp, Mus musculus
atcattgacttaaacgaactagagg

SEQ ID NO: 881002 - DNA, 25 bp, Mus musculus
atcattgacttaaaggaactagagg

SEQ ID NO: 881003 - DNA, 25 bp, Mus musculus
atcattgatggcaacatcttctgtg

SEQ ID NO: 881004 - DNA, 25 bp, Mus musculus
atcattgatggcaagatcttctgtg

SEQ ID NO: 881005 - DNA, 25 bp, Mus musculus
atcattgccaacccagtgaactcca

SEQ ID NO: 881006 - DNA, 25 bp, Mus musculus
atcattgccaaccctgtgaactcca

SEQ ID NO: 881007 - DNA, 25 bp, Mus musculus
atcattgctgttaaccaaatgcggc

SEQ ID NO: 881008 - DNA, 25 bp, Mus musculus
atcattgctgttaagcaaatgcggc

SEQ ID NO: 881009 - DNA, 25 bp, Mus musculus
atcattggctggcggacacctactg

SEQ ID NO: 881010 - DNA, 25 bp, Mus musculus
atcattggctgggggacacctactg

SEQ ID NO: 881011 - DNA, 25 bp, Mus musculus
atcattgggaagaagggagagactg

SEQ ID NO: 881012 - DNA, 25 bp, Mus musculus
atcattgggaagtagggagagactg

SEQ ID NO: 881013 - DNA, 25 bp, Mus musculus
atcattgtatacatcatcccttcag

SEQ ID NO: 881014 - DNA, 25 bp, Mus musculus
atcattgtatacatgatcccttcag

SEQ ID NO: 881015 - DNA, 25 bp, Mus musculus
atcatttaagaaaacatataacaaa

SEQ ID NO: 881016 - DNA, 25 bp, Mus musculus
atcatttaagtaaacatataacaaa

SEQ ID NO: 881017 - DNA, 25 bp, Mus musculus
atcatttcaactgtatggaaagaaa

SEQ ID NO: 881018 - DNA, 25 bp, Mus musculus
atcatttcaactgtttggaaagaaa

SEQ ID NO: 881019 - DNA, 25 bp, Mus musculus
atcatttcacagaggttatgacttt

SEQ ID NO: 881020 - DNA, 25 bp, Mus musculus
atcatttcacagtggttatgacttt

SEQ ID NO: 881021 - DNA, 25 bp, Mus musculus
atccaaactacattcccaaccgagg

SEQ ID NO: 881022 - DNA, 25 bp, Mus musculus
atccaaactacattcttttcatctt

SEQ ID NO: 881023 - DNA, 25 bp, Mus musculus
atccaaactacattgccaaccgagg

SEQ ID NO: 881024 - DNA, 25 bp, Mus musculus
atccaaactacattgttttcatctt

SEQ ID NO: 881025 - DNA, 25 bp, Mus musculus
atccaaaggcaaagttggttctacg

SEQ ID NO: 881026 - DNA, 25 bp, Mus musculus
atccaaaggcaatgttggttctacg

SEQ ID NO: 881027 - DNA, 25 bp, Mus musculus
atccaaatatacaacgctcaaactc

SEQ ID NO: 881028 - DNA, 25 bp, Mus musculus
atccaaatatacaaggctcaaactc

SEQ ID NO: 881029 - DNA, 25 bp, Mus musculus
atccaacacccccctgctgccttcc

SEQ ID NO: 881030 - DNA, 25 bp, Mus musculus
atccaacaccccccttctcttgcct

SEQ ID NO: 881031 - DNA, 25 bp, Mus musculus
atccaacaccccgctgctgccttcc

SEQ ID NO: 881032 - DNA, 25 bp, Mus musculus
atccaacaccccgcttctcttgcct

SEQ ID NO: 881033 - DNA, 25 bp, Mus musculus
atccaacctcctagcaaagctgtag

SEQ ID NO: 881034 - DNA, 25 bp, Mus musculus
atccaacctcctaggaaagctgtag

SEQ ID NO: 881035 - DNA, 25 bp, Mus musculus
atccaactaccacctgtggcacgag

SEQ ID NO: 881036 - DNA, 25 bp, Mus musculus
atccaactaccagctgtggcacgag

SEQ ID NO: 881037 - DNA, 25 bp, Mus musculus
atccaactcaaatattgatctgcat

SEQ ID NO: 881038 - DNA, 25 bp, Mus musculus
atccaactcatatattgatctgcat

SEQ ID NO: 881039 - DNA, 25 bp, Mus musculus
atccaagacaaagacggacgaacag

SEQ ID NO: 881040 - DNA, 25 bp, Mus musculus
atccaagacaaagagggacgaacag

SEQ ID NO: 881041 - DNA, 25 bp, Mus musculus
atccaagacaagcaacagacccttg

SEQ ID NO: 881042 - DNA, 25 bp, Mus musculus
atccaagacaaggaacagacccttg

SEQ ID NO: 881043 - DNA, 25 bp, Mus musculus
atccaagatattaacgagaactgcc

SEQ ID NO: 881044 - DNA, 25 bp, Mus musculus
atccaagatattaaggagaactgcc

SEQ ID NO: 881045 - DNA, 25 bp, Mus musculus
atccaagatctgaaagttgggatgg

SEQ ID NO: 881046 - DNA, 25 bp, Mus musculus
atccaagatctgaatgttgggatgg

SEQ ID NO: 881047 - DNA, 25 bp, Mus musculus
atccaagccacggacgtggaaatga

SEQ ID NO: 881048 - DNA, 25 bp, Mus musculus
atccaagccacggaggtggaaatga

SEQ ID NO: 881049 - DNA, 25 bp, Mus musculus
atccaagccagatccacagcaaaga

SEQ ID NO: 881050 - DNA, 25 bp, Mus musculus
atccaagccagatccccctacatga

SEQ ID NO: 881051 - DNA, 25 bp, Mus musculus
atccaagccagatcgacagcaaaga

SEQ ID NO: 881052 - DNA, 25 bp, Mus musculus
atccaagccagatcgccctacatga

SEQ ID NO: 881053 - DNA, 25 bp, Mus musculus
atccaagggggtccctgtgggccga

SEQ ID NO: 881054 - DNA, 25 bp, Mus musculus
atccaagggggtgcctgtgggccga

SEQ ID NO: 881055 - DNA, 25 bp, Mus musculus
atccaagtaatgagaggaagacgac

SEQ ID NO: 881056 - DNA, 25 bp, Mus musculus
atccaagtaatgtgaggaagacgac

SEQ ID NO: 881057 - DNA, 25 bp, Mus musculus
atccaagtgtcagacgactcagaca

SEQ ID NO: 881058 - DNA, 25 bp, Mus musculus
atccaagtgtcagaggactcagaca

SEQ ID NO: 881059 - DNA, 25 bp, Mus musculus
atccaattcaagactacagtgtgca

SEQ ID NO: 881060 - DNA, 25 bp, Mus musculus
atccaattcaagtctacagtgtgca

SEQ ID NO: 881061 - DNA, 25 bp, Mus musculus
atccaatttcagcccactccatgtc

SEQ ID NO: 881062 - DNA, 25 bp, Mus musculus
atccaatttcaggccactccatgtc

SEQ ID NO: 881063 - DNA, 25 bp, Mus musculus
atccacaatgcacggatcagctcct

SEQ ID NO: 881064 - DNA, 25 bp, Mus musculus
atccacaatgcagggatcagctcct

SEQ ID NO: 881065 - DNA, 25 bp, Mus musculus
atccacacagccgacaagccacaca

SEQ ID NO: 881066 - DNA, 25 bp, Mus musculus
atccacacaggcgacaagccacaca

SEQ ID NO: 881067 - DNA, 25 bp, Mus musculus
atccacaccccacgttttatgtatg

SEQ ID NO: 881068 - DNA, 25 bp, Mus musculus
atccacaccccaggttttatgtatg

SEQ ID NO: 881069 - DNA, 25 bp, Mus musculus
atccacagagatccagaagccccac

SEQ ID NO: 881070 - DNA, 25 bp, Mus musculus
atccacagaggaaacgaaaaacatg

SEQ ID NO: 881071 - DNA, 25 bp, Mus musculus
atccacagaggaaaggaaaaacatg

SEQ ID NO: 881072 - DNA, 25 bp, Mus musculus
atccacagagttccagaagccccac

SEQ ID NO: 881073 - DNA, 25 bp, Mus musculus
atccacaggaacaacatcctgcaca

SEQ ID NO: 881074 - DNA, 25 bp, Mus musculus
atccacaggaacaacgtgtggccaa

SEQ ID NO: 881075 - DNA, 25 bp, Mus musculus
atccacaggaacaagatcctgcaca

SEQ ID NO: 881076 - DNA, 25 bp, Mus musculus
atccacaggaacaaggtgtggccaa

SEQ ID NO: 881077 - DNA, 25 bp, Mus musculus
atccacaggcaacgttgtctacttc

SEQ ID NO: 881078 - DNA, 25 bp, Mus musculus
atccacaggcaaggttgtctacttc

SEQ ID NO: 881079 - DNA, 25 bp, Mus musculus
atccacattgagagcaccaagaccg

SEQ ID NO: 881080 - DNA, 25 bp, Mus musculus
atccacattgagcgccggaatgcat

SEQ ID NO: 881081 - DNA, 25 bp, Mus musculus
atccacattgagggccggaatgcat

SEQ ID NO: 881082 - DNA, 25 bp, Mus musculus
atccacattgagtgcaccaagaccg

SEQ ID NO: 881083 - DNA, 25 bp, Mus musculus
atccaccacactgcgcctgctgtgt

SEQ ID NO: 881084 - DNA, 25 bp, Mus musculus
atccaccacagtgcgcctgctgtgt

SEQ ID NO: 881085 - DNA, 25 bp, Mus musculus
atccaccattactcaacggctggcc

SEQ ID NO: 881086 - DNA, 25 bp, Mus musculus
atccaccattactctacggctggcc

SEQ ID NO: 881087 - DNA, 25 bp, Mus musculus
atccacccccagctcccaaagagca

SEQ ID NO: 881088 - DNA, 25 bp, Mus musculus
atccacccccaggtcccaaagagca

SEQ ID NO: 881089 - DNA, 25 bp, Mus musculus
atccacgcagcttctggccagcgat

SEQ ID NO: 881090 - DNA, 25 bp, Mus musculus
atccacgcaggttctggccagcgat

SEQ ID NO: 881091 - DNA, 25 bp, Mus musculus
atccactcggagagcctgcgagctg

SEQ ID NO: 881092 - DNA, 25 bp, Mus musculus
atccactcggagtgcctgcgagctg

SEQ ID NO: 881093 - DNA, 25 bp, Mus musculus
atccactctctcatcggctcaataa

SEQ ID NO: 881094 - DNA, 25 bp, Mus musculus
atccactctctcatgggctcaataa

SEQ ID NO: 881095 - DNA, 25 bp, Mus musculus
atccacttatcacttcattgtatct

SEQ ID NO: 881096 - DNA, 25 bp, Mus musculus
atccacttatcagttcattgtatct

SEQ ID NO: 881097 - DNA, 25 bp, Mus musculus
atccagaaacgacaagaagcagacc

SEQ ID NO: 881098 - DNA, 25 bp, Mus musculus
atccagaaacgagaagaagcagacc

SEQ ID NO: 881099 - DNA, 25 bp, Mus musculus
atccagaaatccaacaaaatgtaca

SEQ ID NO: 881100 - DNA, 25 bp, Mus musculus
atccagaaatccaagaaaatgtaca

SEQ ID NO: 881101 - DNA, 25 bp, Mus musculus
atccagaatgtgcatcggtcatggg

SEQ ID NO: 881102 - DNA, 25 bp, Mus musculus
atccagaatgtggatcggtcatggg

SEQ ID NO: 881103 - DNA, 25 bp, Mus musculus
atccagacaacgcacaagtgagact

SEQ ID NO: 881104 - DNA, 25 bp, Mus musculus
atccagacaaggcacaagtgagact

SEQ ID NO: 881105 - DNA, 25 bp, Mus musculus
atccagacacagatccgcgtcgtga

SEQ ID NO: 881106 - DNA, 25 bp, Mus musculus
atccagacacagttccgcgtcgtga

SEQ ID NO: 881107 - DNA, 25 bp, Mus musculus
atccagactgagttcatctccagtt

SEQ ID NO: 881108 - DNA, 25 bp, Mus musculus
atccagactgatatccgatgctgtg

SEQ ID NO: 881109 - DNA, 25 bp, Mus musculus
atccagactgatttccgatgctgtg

SEQ ID NO: 881110 - DNA, 25 bp, Mus musculus
atccagactgtgttcatctccagtt

SEQ ID NO: 881111 - DNA, 25 bp, Mus musculus
atccagagacaacggagagcctgga

SEQ ID NO: 881112 - DNA, 25 bp, Mus musculus
atccagagacaagggagagcctgga

SEQ ID NO: 881113 - DNA, 25 bp, Mus musculus
atccagagccagggaagggcaatgc

SEQ ID NO: 881114 - DNA, 25 bp, Mus musculus
atccagagccagggtagggcaatgc

SEQ ID NO: 881115 - DNA, 25 bp, Mus musculus
atccagatagctcaccttttagatc

SEQ ID NO: 881116 - DNA, 25 bp, Mus musculus
atccagatagctcagcttttagatc

SEQ ID NO: 881117 - DNA, 25 bp, Mus musculus
atccagatcagaaaccctaggacct

SEQ ID NO: 881118 - DNA, 25 bp, Mus musculus
atccagatcagaaacgcagtttgtg

SEQ ID NO: 881119 - DNA, 25 bp, Mus musculus
atccagatcagaaacggtgtgtggg

SEQ ID NO: 881120 - DNA, 25 bp, Mus musculus
atccagatcagaaagcctaggacct

SEQ ID NO: 881121 - DNA, 25 bp, Mus musculus
atccagatcagaaaggcagtttgtg

SEQ ID NO: 881122 - DNA, 25 bp, Mus musculus
atccagatcagaaagggtgtgtggg

SEQ ID NO: 881123 - DNA, 25 bp, Mus musculus
atccagatgtgcagcgccgtgtcca

SEQ ID NO: 881124 - DNA, 25 bp, Mus musculus
atccagatgtgcagggccgtgtcca

SEQ ID NO: 881125 - DNA, 25 bp, Mus musculus
atccagcagaagaggtgaaacagcg

SEQ ID NO: 881126 - DNA, 25 bp, Mus musculus
atccagcagaagtggtgaaacagcg

SEQ ID NO: 881127 - DNA, 25 bp, Mus musculus
atccagcagcagattgtgcagtggg

SEQ ID NO: 881128 - DNA, 25 bp, Mus musculus
atccagcagcagcaccagtgtgtgg

SEQ ID NO: 881129 - DNA, 25 bp, Mus musculus
atccagcagcaggaccagtgtgtgg

SEQ ID NO: 881130 - DNA, 25 bp, Mus musculus
atccagcagcagtttgtgcagtggg

SEQ ID NO: 881131 - DNA, 25 bp, Mus musculus
atccagccgctgcacgccccccagc

SEQ ID NO: 881132 - DNA, 25 bp, Mus musculus
atccagccgctgcaggccccccagc

SEQ ID NO: 881133 - DNA, 25 bp, Mus musculus
atccagctagattacaaaaacaaca

SEQ ID NO: 881134 - DNA, 25 bp, Mus musculus
atccagctagtttacaaaaacaaca

SEQ ID NO: 881135 - DNA, 25 bp, Mus musculus
atccaggaaatcctcccaacaaggg

SEQ ID NO: 881136 - DNA, 25 bp, Mus musculus
atccaggaaatcctgccaacaaggg

SEQ ID NO: 881137 - DNA, 25 bp, Mus musculus
atccaggacacgattctgtgttgtg

SEQ ID NO: 881138 - DNA, 25 bp, Mus musculus
atccaggacacgtttctgtgttgtg

SEQ ID NO: 881139 - DNA, 25 bp, Mus musculus
atccaggaccaacacgtcttgttat

SEQ ID NO: 881140 - DNA, 25 bp, Mus musculus
atccaggaccaagacgtcttgttat

SEQ ID NO: 881141 - DNA, 25 bp, Mus musculus
atccaggacccgcctgacacttggt

SEQ ID NO: 881142 - DNA, 25 bp, Mus musculus
atccaggacccggctgacacttggt

SEQ ID NO: 881143 - DNA, 25 bp, Mus musculus
atccaggaggctcgtggcattatga

SEQ ID NO: 881144 - DNA, 25 bp, Mus musculus
atccaggaggctggtggcattatga

SEQ ID NO: 881145 - DNA, 25 bp, Mus musculus
atccaggctgacaacgcccttttag

SEQ ID NO: 881146 - DNA, 25 bp, Mus musculus
atccaggctgacaaggcccttttag

SEQ ID NO: 881147 - DNA, 25 bp, Mus musculus
atccagggacgacattgaagaagaa

SEQ ID NO: 881148 - DNA, 25 bp, Mus musculus
atccagggacgagattgaagaagaa

SEQ ID NO: 881149 - DNA, 25 bp, Mus musculus
atccagggagcaaaggatatgtttc

SEQ ID NO: 881150 - DNA, 25 bp, Mus musculus
atccagggaggaaaggatatgtttc

SEQ ID NO: 881151 - DNA, 25 bp, Mus musculus
atccagggccctcccggcagagcgc

SEQ ID NO: 881152 - DNA, 25 bp, Mus musculus
atccagggccctccgggcagagcgc

SEQ ID NO: 881153 - DNA, 25 bp, Mus musculus
atccagggtgagaatatgattcctt

SEQ ID NO: 881154 - DNA, 25 bp, Mus musculus
atccagggtgagtatatgattcctt

SEQ ID NO: 881155 - DNA, 25 bp, Mus musculus
atccagttattgcagtccatgtcag

SEQ ID NO: 881156 - DNA, 25 bp, Mus musculus
atccagttattggagtccatgtcag

SEQ ID NO: 881157 - DNA, 25 bp, Mus musculus
atccagtttattctcccgggaggga

SEQ ID NO: 881158 - DNA, 25 bp, Mus musculus
atccagtttattctgccgggaggga

SEQ ID NO: 881159 - DNA, 25 bp, Mus musculus
atccataaacaccgcttttttcaca

SEQ ID NO: 881160 - DNA, 25 bp, Mus musculus
atccataaacacggcttttttcaca

SEQ ID NO: 881161 - DNA, 25 bp, Mus musculus
atccataatgagctggagtttgagt

SEQ ID NO: 881162 - DNA, 25 bp, Mus musculus
atccataatgaggtggagtttgagt

SEQ ID NO: 881163 - DNA, 25 bp, Mus musculus
atccatcaccagcctcgagaaagag

SEQ ID NO: 881164 - DNA, 25 bp, Mus musculus
atccatcaccaggctcgagaaagag

SEQ ID NO: 881165 - DNA, 25 bp, Mus musculus
atccatcagaggaccagcatgagtg

SEQ ID NO: 881166 - DNA, 25 bp, Mus musculus
atccatcagaggtccagcatgagtg

SEQ ID NO: 881167 - DNA, 25 bp, Mus musculus
atccatccaacaagcatgcagctct

SEQ ID NO: 881168 - DNA, 25 bp, Mus musculus
atccatccaacaaggatgcagctct

SEQ ID NO: 881169 - DNA, 25 bp, Mus musculus
atccatccaatgagcgcaatattca

SEQ ID NO: 881170 - DNA, 25 bp, Mus musculus
atccatccaatgagggcaatattca

SEQ ID NO: 881171 - DNA, 25 bp, Mus musculus
atccatccgccaggaaatctcagaa

SEQ ID NO: 881172 - DNA, 25 bp, Mus musculus
atccatccgcgaggaaatctcagaa

SEQ ID NO: 881173 - DNA, 25 bp, Mus musculus
atccatctatggaacgtggtattaa

SEQ ID NO: 881174 - DNA, 25 bp, Mus musculus
atccatctatggaaggtggtattaa

SEQ ID NO: 881175 - DNA, 25 bp, Mus musculus
atccatctctaggacgacgacgagt

SEQ ID NO: 881176 - DNA, 25 bp, Mus musculus
atccatctcttggacgacgacgagt

SEQ ID NO: 881177 - DNA, 25 bp, Mus musculus
atccatgaaccacaacctcacatct

SEQ ID NO: 881178 - DNA, 25 bp, Mus musculus
atccatgaaccagaacctcacatct

SEQ ID NO: 881179 - DNA, 25 bp, Mus musculus
atccatgaagcgcttaggcactgat

SEQ ID NO: 881180 - DNA, 25 bp, Mus musculus
atccatgaagggcttaggcactgat

SEQ ID NO: 881181 - DNA, 25 bp, Mus musculus
atccatgacgtacgtctgcgcaggg

SEQ ID NO: 881182 - DNA, 25 bp, Mus musculus
atccatgacgtaggtctgcgcaggg

SEQ ID NO: 881183 - DNA, 25 bp, Mus musculus
atccatgacttaaacgccaatgtgg

SEQ ID NO: 881184 - DNA, 25 bp, Mus musculus
atccatgacttaaaggccaatgtgg

SEQ ID NO: 881185 - DNA, 25 bp, Mus musculus
atccatgatagtctctccaaccgca

SEQ ID NO: 881186 - DNA, 25 bp, Mus musculus
atccatgatagtctgtccaaccgca

SEQ ID NO: 881187 - DNA, 25 bp, Mus musculus
atccatgcagaattcaagagacagt

SEQ ID NO: 881188 - DNA, 25 bp, Mus musculus
atccatgcagtattcaagagacagt

SEQ ID NO: 881189 - DNA, 25 bp, Mus musculus
atccatgcatgtcatctggcagtga

SEQ ID NO: 881190 - DNA, 25 bp, Mus musculus
atccatgcatgtgatctggcagtga

SEQ ID NO: 881191 - DNA, 25 bp, Mus musculus
atccatggagctattcctccacgaa

SEQ ID NO: 881192 - DNA, 25 bp, Mus musculus
atccatggaggtattcctccacgaa

SEQ ID NO: 881193 - DNA, 25 bp, Mus musculus
atccatgtatagaaccaaggcacca

SEQ ID NO: 881194 - DNA, 25 bp, Mus musculus
atccatgtatagtaccaaggcacca

SEQ ID NO: 881195 - DNA, 25 bp, Mus musculus
atccatgttcgacaccacgccccac

SEQ ID NO: 881196 - DNA, 25 bp, Mus musculus
atccatgttcgagaccacgccccac

SEQ ID NO: 881197 - DNA, 25 bp, Mus musculus
atccattaccagctgcctcgcacct

SEQ ID NO: 881198 - DNA, 25 bp, Mus musculus
atccattaccaggtgcctcgcacct

SEQ ID NO: 881199 - DNA, 25 bp, Mus musculus
atccattatgaaattgaagaccaaa

SEQ ID NO: 881200 - DNA, 25 bp, Mus musculus
atccattatgaacaaacagggaagc

SEQ ID NO: 881201 - DNA, 25 bp, Mus musculus
atccattatgaagaaacagggaagc

SEQ ID NO: 881202 - DNA, 25 bp, Mus musculus
atccattatgaatttgaagaccaaa

SEQ ID NO: 881203 - DNA, 25 bp, Mus musculus
atccattcaaagccattggccagga

SEQ ID NO: 881204 - DNA, 25 bp, Mus musculus
atccattcaaaggcattggccagga

SEQ ID NO: 881205 - DNA, 25 bp, Mus musculus
atccattcaacgcctacttggatgt

SEQ ID NO: 881206 - DNA, 25 bp, Mus musculus
atccattcaaggcctacttggatgt

SEQ ID NO: 881207 - DNA, 25 bp, Mus musculus
atccattcacctaccattaccacac

SEQ ID NO: 881208 - DNA, 25 bp, Mus musculus
atccattcacctaccgcaagagatg

SEQ ID NO: 881209 - DNA, 25 bp, Mus musculus
atccattcacctacgattaccacac

SEQ ID NO: 881210 - DNA, 25 bp, Mus musculus
atccattcacctacggcaagagatg

SEQ ID NO: 881211 - DNA, 25 bp, Mus musculus
atccattcatttcacttgcctctct

SEQ ID NO: 881212 - DNA, 25 bp, Mus musculus
atccattcatttcagttgcctctct

SEQ ID NO: 881213 - DNA, 25 bp, Mus musculus
atccatttctggctctgttccctct

SEQ ID NO: 881214 - DNA, 25 bp, Mus musculus
atccatttctgggtctgttccctct

SEQ ID NO: 881215 - DNA, 25 bp, Mus musculus
atcccaaaggctttgcatatataga

SEQ ID NO: 881216 - DNA, 25 bp, Mus musculus
atcccaaagggtttgcatatataga

SEQ ID NO: 881217 - DNA, 25 bp, Mus musculus
atcccaaattcacggagtggcacca

SEQ ID NO: 881218 - DNA, 25 bp, Mus musculus
atcccaaattcagggagtggcacca

SEQ ID NO: 881219 - DNA, 25 bp, Mus musculus
atcccaacagctgatgaccccacaa

SEQ ID NO: 881220 - DNA, 25 bp, Mus musculus
atcccaacaggtgatgaccccacaa

SEQ ID NO: 881221 - DNA, 25 bp, Mus musculus
atcccaacatagataagttgtttga

SEQ ID NO: 881222 - DNA, 25 bp, Mus musculus
atcccaacatagttaagttgtttga

SEQ ID NO: 881223 - DNA, 25 bp, Mus musculus
atcccaagcataaacgaaatggtaa

SEQ ID NO: 881224 - DNA, 25 bp, Mus musculus
atcccaagcataaaggaaatggtaa

SEQ ID NO: 881225 - DNA, 25 bp, Mus musculus
atcccaagggctgacccagtgcgac

SEQ ID NO: 881226 - DNA, 25 bp, Mus musculus
atcccaaggggtgacccagtgcgac

SEQ ID NO: 881227 - DNA, 25 bp, Mus musculus
atcccaagtcgtcagcagtgtttga

SEQ ID NO: 881228 - DNA, 25 bp, Mus musculus
atcccaagtcgtgagcagtgtttga

SEQ ID NO: 881229 - DNA, 25 bp, Mus musculus
atcccaatgccactccatggcggaa

SEQ ID NO: 881230 - DNA, 25 bp, Mus musculus
atcccaatgccactgcatggcggaa

SEQ ID NO: 881231 - DNA, 25 bp, Mus musculus
atcccaccaattcccacagagaacc

SEQ ID NO: 881232 - DNA, 25 bp, Mus musculus
atcccaccaattgccacagagaacc

SEQ ID NO: 881233 - DNA, 25 bp, Mus musculus
atcccaccagcctgcaacctgaaga

SEQ ID NO: 881234 - DNA, 25 bp, Mus musculus
atcccaccagcggcttgctgtccac

SEQ ID NO: 881235 - DNA, 25 bp, Mus musculus
atcccaccaggctgcaacctgaaga

SEQ ID NO: 881236 - DNA, 25 bp, Mus musculus
atcccaccaggggcttgctgtccac

SEQ ID NO: 881237 - DNA, 25 bp, Mus musculus
atcccacgagagcgttttttgcaga

SEQ ID NO: 881238 - DNA, 25 bp, Mus musculus
atcccacgagagggttttttgcaga

SEQ ID NO: 881239 - DNA, 25 bp, Mus musculus
atcccactgtaccagatggaggcca

SEQ ID NO: 881240 - DNA, 25 bp, Mus musculus
atcccactgtacgagatggaggcca

SEQ ID NO: 881241 - DNA, 25 bp, Mus musculus
atcccagcagccccaaaaggaaaga

SEQ ID NO: 881242 - DNA, 25 bp, Mus musculus
atcccagcagctcatgaccccacag

SEQ ID NO: 881243 - DNA, 25 bp, Mus musculus
atcccagcaggcccaaaaggaaaga

SEQ ID NO: 881244 - DNA, 25 bp, Mus musculus
atcccagcaggtcatgaccccacag

SEQ ID NO: 881245 - DNA, 25 bp, Mus musculus
atcccagcgagaagcagaaattctc

SEQ ID NO: 881246 - DNA, 25 bp, Mus musculus
atcccagcgagaaggagaaattctc

SEQ ID NO: 881247 - DNA, 25 bp, Mus musculus
atcccagcgcttccagcagcttttc

SEQ ID NO: 881248 - DNA, 25 bp, Mus musculus
atcccagcgcttcctgcagcttttc

SEQ ID NO: 881249 - DNA, 25 bp, Mus musculus
atcccagctactcacatggacgtcc

SEQ ID NO: 881250 - DNA, 25 bp, Mus musculus
atcccagctactcagatggacgtcc

SEQ ID NO: 881251 - DNA, 25 bp, Mus musculus
atcccaggagatcttcccacggtgg

SEQ ID NO: 881252 - DNA, 25 bp, Mus musculus
atcccaggagttcttcccacggtgg

SEQ ID NO: 881253 - DNA, 25 bp, Mus musculus
atcccagtacagcaagatgagtctc

SEQ ID NO: 881254 - DNA, 25 bp, Mus musculus
atcccagtacaggaagatgagtctc

SEQ ID NO: 881255 - DNA, 25 bp, Mus musculus
atccccaaagatctccctgagaccc

SEQ ID NO: 881256 - DNA, 25 bp, Mus musculus
atccccaaagttctccctgagaccc

SEQ ID NO: 881257 - DNA, 25 bp, Mus musculus
atccccaactacgatgacctgagac

SEQ ID NO: 881258 - DNA, 25 bp, Mus musculus
atccccaacttcgatgacctgagac

SEQ ID NO: 881259 - DNA, 25 bp, Mus musculus
atccccaagaaccacacccgagtca

SEQ ID NO: 881260 - DNA, 25 bp, Mus musculus
atccccaagaaccagacccgagtca

SEQ ID NO: 881261 - DNA, 25 bp, Mus musculus
atccccaatgaggaaaccatccttg

SEQ ID NO: 881262 - DNA, 25 bp, Mus musculus
atccccaatgtggaaaccatccttg

SEQ ID NO: 881263 - DNA, 25 bp, Mus musculus
atccccacagatgacaacgttgtgt

SEQ ID NO: 881264 - DNA, 25 bp, Mus musculus
atccccacagatttgacctcctggt

SEQ ID NO: 881265 - DNA, 25 bp, Mus musculus
atccccacagcagaaatgctcttct

SEQ ID NO: 881266 - DNA, 25 bp, Mus musculus
atccccacagctgatggacagaatc

SEQ ID NO: 881267 - DNA, 25 bp, Mus musculus
atccccacaggagaaatgctcttct

SEQ ID NO: 881268 - DNA, 25 bp, Mus musculus
atccccacaggtgatggacagaatc

SEQ ID NO: 881269 - DNA, 25 bp, Mus musculus
atccccacagttgacaacgttgtgt

SEQ ID NO: 881270 - DNA, 25 bp, Mus musculus
atccccacagttttgacctcctggt

SEQ ID NO: 881271 - DNA, 25 bp, Mus musculus
atccccactgagatgatcccccagc

SEQ ID NO: 881272 - DNA, 25 bp, Mus musculus
atccccactgagttgatcccccagc

SEQ ID NO: 881273 - DNA, 25 bp, Mus musculus
atccccagagagaaccttcttccac

SEQ ID NO: 881274 - DNA, 25 bp, Mus musculus
atccccagagagatgaggaaagtga

SEQ ID NO: 881275 - DNA, 25 bp, Mus musculus
atccccagagagcatttctggctgc

SEQ ID NO: 881276 - DNA, 25 bp, Mus musculus
atccccagagaggatttctggctgc

SEQ ID NO: 881277 - DNA, 25 bp, Mus musculus
atccccagagagtaccttcttccac

SEQ ID NO: 881278 - DNA, 25 bp, Mus musculus
atccccagagagttgaggaaagtga

SEQ ID NO: 881279 - DNA, 25 bp, Mus musculus
atccccagagcattatcacaaaatt

SEQ ID NO: 881280 - DNA, 25 bp, Mus musculus
atccccagaggattatcacaaaatt

SEQ ID NO: 881281 - DNA, 25 bp, Mus musculus
atccccagttgacacctctgttctg

SEQ ID NO: 881282 - DNA, 25 bp, Mus musculus
atccccagttgacagctctgttctg

SEQ ID NO: 881283 - DNA, 25 bp, Mus musculus
atcccccagagccacgagcaatgct

SEQ ID NO: 881284 - DNA, 25 bp, Mus musculus
atcccccagagccaggagcaatgct

SEQ ID NO: 881285 - DNA, 25 bp, Mus musculus
atccccgacatccacgtggaggtgg

SEQ ID NO: 881286 - DNA, 25 bp, Mus musculus
atccccgacatcgacgtggaggtgg

SEQ ID NO: 881287 - DNA, 25 bp, Mus musculus
atccccgatgacagcgacaactgtc

SEQ ID NO: 881288 - DNA, 25 bp, Mus musculus
atccccgatgacagggacaactgtc

SEQ ID NO: 881289 - DNA, 25 bp, Mus musculus
atccccgatgatcatcccctctgga

SEQ ID NO: 881290 - DNA, 25 bp, Mus musculus
atccccgatgttcatcccctctgga

SEQ ID NO: 881291 - DNA, 25 bp, Mus musculus
atccccgcagttcgcctgaatgtgt

SEQ ID NO: 881292 - DNA, 25 bp, Mus musculus
atccccgcagttggcctgaatgtgt

SEQ ID NO: 881293 - DNA, 25 bp, Mus musculus
atcccctatgatcctatacactggt

SEQ ID NO: 881294 - DNA, 25 bp, Mus musculus
atcccctatgttcctatacactggt

SEQ ID NO: 881295 - DNA, 25 bp, Mus musculus
atccccttatcacagcctgccccag

SEQ ID NO: 881296 - DNA, 25 bp, Mus musculus
atccccttatcagagcctgccccag

SEQ ID NO: 881297 - DNA, 25 bp, Mus musculus
atccccttttagacaactgccacgt

SEQ ID NO: 881298 - DNA, 25 bp, Mus musculus
atccccttttagtcaactgccacgt

SEQ ID NO: 881299 - DNA, 25 bp, Mus musculus
atcccgaataagattatttattcaa

SEQ ID NO: 881300 - DNA, 25 bp, Mus musculus
atcccgaatatgattatttattcaa

SEQ ID NO: 881301 - DNA, 25 bp, Mus musculus
atcccgaccattcggtttaatgtgg

SEQ ID NO: 881302 - DNA, 25 bp, Mus musculus
atcccgaccattgggtttaatgtgg

SEQ ID NO: 881303 - DNA, 25 bp, Mus musculus
atcccgatcaagatcatactctcct

SEQ ID NO: 881304 - DNA, 25 bp, Mus musculus
atcccgatcaagttcatactctcct

SEQ ID NO: 881305 - DNA, 25 bp, Mus musculus
atcccgcagacgctacctcctgtat

SEQ ID NO: 881306 - DNA, 25 bp, Mus musculus
atcccgcagacggtacctcctgtat

SEQ ID NO: 881307 - DNA, 25 bp, Mus musculus
atcccgctggctggagacctggccc

SEQ ID NO: 881308 - DNA, 25 bp, Mus musculus
atcccgctgggtggagacctggccc

SEQ ID NO: 881309 - DNA, 25 bp, Mus musculus
atcccggctgcacggtctgtcaccg

SEQ ID NO: 881310 - DNA, 25 bp, Mus musculus
atcccggctgcagggtctgtcaccg

SEQ ID NO: 881311 - DNA, 25 bp, Mus musculus
atccctaaagcgaacatctgtgtca

SEQ ID NO: 881312 - DNA, 25 bp, Mus musculus
atccctaaagctgtcataagccgaa

SEQ ID NO: 881313 - DNA, 25 bp, Mus musculus
atccctaaagggaacatctgtgtca

SEQ ID NO: 881314 - DNA, 25 bp, Mus musculus
atccctaaaggtgtcataagccgaa

SEQ ID NO: 881315 - DNA, 25 bp, Mus musculus
atccctaagcagcagccatcctcgg

SEQ ID NO: 881316 - DNA, 25 bp, Mus musculus
atccctaagcagccatcctcggctg

SEQ ID NO: 881317 - DNA, 25 bp, Mus musculus
atccctaagcaggagccatcctcgg

SEQ ID NO: 881318 - DNA, 25 bp, Mus musculus
atccctaagcaggcatcctcggctg

SEQ ID NO: 881319 - DNA, 25 bp, Mus musculus
atccctaccatacgtttcaatgtgg

SEQ ID NO: 881320 - DNA, 25 bp, Mus musculus
atccctaccataggtttcaatgtgg

SEQ ID NO: 881321 - DNA, 25 bp, Mus musculus
atccctagatatcaaagtctggatg

SEQ ID NO: 881322 - DNA, 25 bp, Mus musculus
atccctagatatgaaagtctggatg

SEQ ID NO: 881323 - DNA, 25 bp, Mus musculus
atccctcaagctctgcctacttctc

SEQ ID NO: 881324 - DNA, 25 bp, Mus musculus
atccctcaaggtctgcctacttctc

SEQ ID NO: 881325 - DNA, 25 bp, Mus musculus
atccctcagaagcaactccatcgcc

SEQ ID NO: 881326 - DNA, 25 bp, Mus musculus
atccctcagaagcatctccatcgcc

SEQ ID NO: 881327 - DNA, 25 bp, Mus musculus
atccctctggagaattccaaggctg

SEQ ID NO: 881328 - DNA, 25 bp, Mus musculus
atccctctggatcggttaagcatat

SEQ ID NO: 881329 - DNA, 25 bp, Mus musculus
atccctctggtgaattccaaggctg

SEQ ID NO: 881330 - DNA, 25 bp, Mus musculus
atccctctggttcggttaagcatat

SEQ ID NO: 881331 - DNA, 25 bp, Mus musculus
atccctgaccgggactacctgagaa

SEQ ID NO: 881332 - DNA, 25 bp, Mus musculus
atccctgaccgggagtacctgagaa

SEQ ID NO: 881333 - DNA, 25 bp, Mus musculus
atccctgcagctaacgcagaaaaga

SEQ ID NO: 881334 - DNA, 25 bp, Mus musculus
atccctgcagctaaggcagaaaaga

SEQ ID NO: 881335 - DNA, 25 bp, Mus musculus
atccctgcaggacacgtggcctctg

SEQ ID NO: 881336 - DNA, 25 bp, Mus musculus
atccctgcaggacaggtggcctctg

SEQ ID NO: 881337 - DNA, 25 bp, Mus musculus
atccctgcctgacgagctgcagaag

SEQ ID NO: 881338 - DNA, 25 bp, Mus musculus
atccctgcctgaggagctgcagaag

SEQ ID NO: 881339 - DNA, 25 bp, Mus musculus
atccctggtgcccacaggacatagt

SEQ ID NO: 881340 - DNA, 25 bp, Mus musculus
atccctggtgcccagaggacatagt

SEQ ID NO: 881341 - DNA, 25 bp, Mus musculus
atccctgtggcacgtgaccttggac

SEQ ID NO: 881342 - DNA, 25 bp, Mus musculus
atccctgtggcactggaggtgaagc

SEQ ID NO: 881343 - DNA, 25 bp, Mus musculus
atccctgtggcaggtgaccttggac

SEQ ID NO: 881344 - DNA, 25 bp, Mus musculus
atccctgtggcagtggaggtgaagc

SEQ ID NO: 881345 - DNA, 25 bp, Mus musculus
atcccttcagccgacaaacatccca

SEQ ID NO: 881346 - DNA, 25 bp, Mus musculus
atcccttcagccgacaagaactttg

SEQ ID NO: 881347 - DNA, 25 bp, Mus musculus
atcccttcagccgagaaacatccca

SEQ ID NO: 881348 - DNA, 25 bp, Mus musculus
atcccttcagccgagaagaactttg

SEQ ID NO: 881349 - DNA, 25 bp, Mus musculus
atcccttgtaaacaaacgtgtgaga

SEQ ID NO: 881350 - DNA, 25 bp, Mus musculus
atcccttgtaaagaaacgtgtgaga

SEQ ID NO: 881351 - DNA, 25 bp, Mus musculus
atccctttggctcctgcgcttcagc

SEQ ID NO: 881352 - DNA, 25 bp, Mus musculus
atccctttggcttcacactcgctta

SEQ ID NO: 881353 - DNA, 25 bp, Mus musculus
atccctttgggtcctgcgcttcagc

SEQ ID NO: 881354 - DNA, 25 bp, Mus musculus
atccctttgggttcacactcgctta

SEQ ID NO: 881355 - DNA, 25 bp, Mus musculus
atccgaaaagtgacggaagagaaca

SEQ ID NO: 881356 - DNA, 25 bp, Mus musculus
atccgaaaagtgtcggaagagaaca

SEQ ID NO: 881357 - DNA, 25 bp, Mus musculus
atccgaaagcagagtgtggaccact

SEQ ID NO: 881358 - DNA, 25 bp, Mus musculus
atccgaaagcagtgtgtggaccact

SEQ ID NO: 881359 - DNA, 25 bp, Mus musculus
atccgaatctttgactgtgagaaac

SEQ ID NO: 881360 - DNA, 25 bp, Mus musculus
atccgaatctttgagtgtgagaaac

SEQ ID NO: 881361 - DNA, 25 bp, Mus musculus
atccgaccaccacgctacctcattc

SEQ ID NO: 881362 - DNA, 25 bp, Mus musculus
atccgaccaccaggctacctcattc

SEQ ID NO: 881363 - DNA, 25 bp, Mus musculus
atccgagagaagctcttgggcactg

SEQ ID NO: 881364 - DNA, 25 bp, Mus musculus
atccgagagaaggtcttgggcactg

SEQ ID NO: 881365 - DNA, 25 bp, Mus musculus
atccgcaacagtaacaagatgcaga

SEQ ID NO: 881366 - DNA, 25 bp, Mus musculus
atccgcaacagtaagaagatgcaga

SEQ ID NO: 881367 - DNA, 25 bp, Mus musculus
atccgcaagctgactgatcagtgca

SEQ ID NO: 881368 - DNA, 25 bp, Mus musculus
atccgcaagctgccccccaagtgtc

SEQ ID NO: 881369 - DNA, 25 bp, Mus musculus
atccgcaagctggcccccaagtgtc

SEQ ID NO: 881370 - DNA, 25 bp, Mus musculus
atccgcaagctgtctgatcagtgca

SEQ ID NO: 881371 - DNA, 25 bp, Mus musculus
atccgcctacagcacgaagcccaat

SEQ ID NO: 881372 - DNA, 25 bp, Mus musculus
atccgcctacagcaggaagcccaat

SEQ ID NO: 881373 - DNA, 25 bp, Mus musculus
atccgcctgtgcaacgagaacggct

SEQ ID NO: 881374 - DNA, 25 bp, Mus musculus
atccgcctgtgcaaggagaacggct

SEQ ID NO: 881375 - DNA, 25 bp, Mus musculus
atccgctcgttcctttctctcatat

SEQ ID NO: 881376 - DNA, 25 bp, Mus musculus
atccgctcgttcgtttctctcatat

SEQ ID NO: 881377 - DNA, 25 bp, Mus musculus
atccgctggagccccagtggcacca

SEQ ID NO: 881378 - DNA, 25 bp, Mus musculus
atccgctggagccccatggttttcg

SEQ ID NO: 881379 - DNA, 25 bp, Mus musculus
atccgctggagcccgagtggcacca

SEQ ID NO: 881380 - DNA, 25 bp, Mus musculus
atccgctggagcccgatggttttcg

SEQ ID NO: 881381 - DNA, 25 bp, Mus musculus
atccgctgtcagcagctgaaatacg

SEQ ID NO: 881382 - DNA, 25 bp, Mus musculus
atccgctgtcaggagctgaaatacg

SEQ ID NO: 881383 - DNA, 25 bp, Mus musculus
atccggaaaaagttcgtgatggcat

SEQ ID NO: 881384 - DNA, 25 bp, Mus musculus
atccggaaaaagttggtgatggcat

SEQ ID NO: 881385 - DNA, 25 bp, Mus musculus
atccggaacctcaacgtagaccagc

SEQ ID NO: 881386 - DNA, 25 bp, Mus musculus
atccggaacctcaaggtagaccagc

SEQ ID NO: 881387 - DNA, 25 bp, Mus musculus
atccggaagtataagccggaagagg

SEQ ID NO: 881388 - DNA, 25 bp, Mus musculus
atccggaagtattagccggaagagg

SEQ ID NO: 881389 - DNA, 25 bp, Mus musculus
atccggaatcagatctgctttcagc

SEQ ID NO: 881390 - DNA, 25 bp, Mus musculus
atccggaatcagttctgctttcagc

SEQ ID NO: 881391 - DNA, 25 bp, Mus musculus
atccggacagccagcgatggggatt

SEQ ID NO: 881392 - DNA, 25 bp, Mus musculus
atccggacagcctgacgatgctcac

SEQ ID NO: 881393 - DNA, 25 bp, Mus musculus
atccggacaggcagcgatggggatt

SEQ ID NO: 881394 - DNA, 25 bp, Mus musculus
atccggacaggctgacgatgctcac

SEQ ID NO: 881395 - DNA, 25 bp, Mus musculus
atccggaccctagacgcaaagctgg

SEQ ID NO: 881396 - DNA, 25 bp, Mus musculus
atccggaccctagaggcaaagctgg

SEQ ID NO: 881397 - DNA, 25 bp, Mus musculus
atccggcacaaacgaacctacctga

SEQ ID NO: 881398 - DNA, 25 bp, Mus musculus
atccggcacaaaggaacctacctga

SEQ ID NO: 881399 - DNA, 25 bp, Mus musculus
atccggcctggggactatgagcagt

SEQ ID NO: 881400 - DNA, 25 bp, Mus musculus
atccggcctggggagtatgagcagt

SEQ ID NO: 881401 - DNA, 25 bp, Mus musculus
atccgggaacagagcagtgcccgga

SEQ ID NO: 881402 - DNA, 25 bp, Mus musculus
atccgggaacagtgcagtgcccgga

SEQ ID NO: 881403 - DNA, 25 bp, Mus musculus
atccgggacaaaattctggctgcca

SEQ ID NO: 881404 - DNA, 25 bp, Mus musculus
atccgggacaaatttctggctgcca

SEQ ID NO: 881405 - DNA, 25 bp, Mus musculus
atccggggcttgcacaggcctacgt

SEQ ID NO: 881406 - DNA, 25 bp, Mus musculus
atccggggcttgcagaggcctacgt

SEQ ID NO: 881407 - DNA, 25 bp, Mus musculus
atccggtgtaagcatgatgaattca

SEQ ID NO: 881408 - DNA, 25 bp, Mus musculus
atccggtgtaaggatgatgaattca

SEQ ID NO: 881409 - DNA, 25 bp, Mus musculus
atccgtatcaactcaacaaggacat

SEQ ID NO: 881410 - DNA, 25 bp, Mus musculus
atccgtatcaagacatgttcagcat

SEQ ID NO: 881411 - DNA, 25 bp, Mus musculus
atccgtatcatctcaacaaggacat

SEQ ID NO: 881412 - DNA, 25 bp, Mus musculus
atccgtatcatgacatgttcagcat

SEQ ID NO: 881413 - DNA, 25 bp, Mus musculus
atccgtgtccagcgcgttgcctgtg

SEQ ID NO: 881414 - DNA, 25 bp, Mus musculus
atccgtgtccagcgggttgcctgtg

SEQ ID NO: 881415 - DNA, 25 bp, Mus musculus
atcctaaatcagctgctgaaatcgt

SEQ ID NO: 881416 - DNA, 25 bp, Mus musculus
atcctaaatcaggtgctgaaatcgt

SEQ ID NO: 881417 - DNA, 25 bp, Mus musculus
atcctaacccagactgtttcaattc

SEQ ID NO: 881418 - DNA, 25 bp, Mus musculus
atcctaacccagtctgtttcaattc

SEQ ID NO: 881419 - DNA, 25 bp, Mus musculus
atcctacacgccatcgacggtccag

SEQ ID NO: 881420 - DNA, 25 bp, Mus musculus
atcctacacggcatcgacggtccag

SEQ ID NO: 881421 - DNA, 25 bp, Mus musculus
atcctacctgtggacacggtgctac

SEQ ID NO: 881422 - DNA, 25 bp, Mus musculus
atcctacctgtggagacggtgctac

SEQ ID NO: 881423 - DNA, 25 bp, Mus musculus
atcctacggtcacgaaaccgcatca

SEQ ID NO: 881424 - DNA, 25 bp, Mus musculus
atcctacggtcaggaaaccgcatca

SEQ ID NO: 881425 - DNA, 25 bp, Mus musculus
atcctactgtgcaggactctagggc

SEQ ID NO: 881426 - DNA, 25 bp, Mus musculus
atcctactgtgctggactctagggc

SEQ ID NO: 881427 - DNA, 25 bp, Mus musculus
atcctagcatctttcggtacctttc

SEQ ID NO: 881428 - DNA, 25 bp, Mus musculus
atcctagcatctttgggtacctttc

SEQ ID NO: 881429 - DNA, 25 bp, Mus musculus
atcctagcggattgcctgagaatac

SEQ ID NO: 881430 - DNA, 25 bp, Mus musculus
atcctagcggtttgcctgagaatac

SEQ ID NO: 881431 - DNA, 25 bp, Mus musculus
atcctcaaagcatacaacttctctc

SEQ ID NO: 881432 - DNA, 25 bp, Mus musculus
atcctcaaagcgacccctgaacaga

SEQ ID NO: 881433 - DNA, 25 bp, Mus musculus
atcctcaaagctgtaccgccgactc

SEQ ID NO: 881434 - DNA, 25 bp, Mus musculus
atcctcaaaggatacaacttctctc

SEQ ID NO: 881435 - DNA, 25 bp, Mus musculus
atcctcaaagggacccctgaacaga

SEQ ID NO: 881436 - DNA, 25 bp, Mus musculus
atcctcaaaggtgtaccgccgactc

SEQ ID NO: 881437 - DNA, 25 bp, Mus musculus
atcctcagaaaacaagatgagtatc

SEQ ID NO: 881438 - DNA, 25 bp, Mus musculus
atcctcagaaaagaagatgagtatc

SEQ ID NO: 881439 - DNA, 25 bp, Mus musculus
atcctcagacaagacgtaaagaaga

SEQ ID NO: 881440 - DNA, 25 bp, Mus musculus
atcctcagacaagaggtaaagaaga

SEQ ID NO: 881441 - DNA, 25 bp, Mus musculus
atcctcagagctttgaccggatcgc

SEQ ID NO: 881442 - DNA, 25 bp, Mus musculus
atcctcagaggtttgaccggatcgc

SEQ ID NO: 881443 - DNA, 25 bp, Mus musculus
atcctccaagagccggagtcgccgg

SEQ ID NO: 881444 - DNA, 25 bp, Mus musculus
atcctccaagaggcggagtcgccgg

SEQ ID NO: 881445 - DNA, 25 bp, Mus musculus
atcctccacaaaccctgtggtgaag

SEQ ID NO: 881446 - DNA, 25 bp, Mus musculus
atcctccacaaagcctgtggtgaag

SEQ ID NO: 881447 - DNA, 25 bp, Mus musculus
atcctccacccgaatggtaacatca

SEQ ID NO: 881448 - DNA, 25 bp, Mus musculus
atcctccacccgtatggtaacatca

SEQ ID NO: 881449 - DNA, 25 bp, Mus musculus
atcctccactggcacgtcaaaaatg

SEQ ID NO: 881450 - DNA, 25 bp, Mus musculus
atcctccactggcaggtcaaaaatg

SEQ ID NO: 881451 - DNA, 25 bp, Mus musculus
atcctccagtctctccagaacaagt

SEQ ID NO: 881452 - DNA, 25 bp, Mus musculus
atcctccagtgtctccagaacaagt

SEQ ID NO: 881453 - DNA, 25 bp, Mus musculus
atcctcccagctaacaaaagcgcgg

SEQ ID NO: 881454 - DNA, 25 bp, Mus musculus
atcctcccagctaagaaaagcgcgg

SEQ ID NO: 881455 - DNA, 25 bp, Mus musculus
atcctcccccaacactacaggcgcc

SEQ ID NO: 881456 - DNA, 25 bp, Mus musculus
atcctcccccaagactacaggcgcc

SEQ ID NO: 881457 - DNA, 25 bp, Mus musculus
atcctccgacagttcaaccagacag

SEQ ID NO: 881458 - DNA, 25 bp, Mus musculus
atcctccgactgttcaaccagacag

SEQ ID NO: 881459 - DNA, 25 bp, Mus musculus
atcctccgagagttctgtccttgga

SEQ ID NO: 881460 - DNA, 25 bp, Mus musculus
atcctccgagtgttctgtccttgga

SEQ ID NO: 881461 - DNA, 25 bp, Mus musculus
atcctccttagcaacgtcaacaaca

SEQ ID NO: 881462 - DNA, 25 bp, Mus musculus
atcctccttagcaaggtcaacaaca

SEQ ID NO: 881463 - DNA, 25 bp, Mus musculus
atcctcgatacaccacagaactcgg

SEQ ID NO: 881464 - DNA, 25 bp, Mus musculus
atcctcgatacagcacagaactcgg

SEQ ID NO: 881465 - DNA, 25 bp, Mus musculus
atcctcggcaacaacacgctgccgt

SEQ ID NO: 881466 - DNA, 25 bp, Mus musculus
atcctcggcaacaagacgctgccgt

SEQ ID NO: 881467 - DNA, 25 bp, Mus musculus
atcctcgggggactcgcaatgtttg

SEQ ID NO: 881468 - DNA, 25 bp, Mus musculus
atcctcgggggactcgccatgtttg

SEQ ID NO: 881469 - DNA, 25 bp, Mus musculus
atcctcgggggactggcaatgtttg

SEQ ID NO: 881470 - DNA, 25 bp, Mus musculus
atcctcgggggactggccatgtttg

SEQ ID NO: 881471 - DNA, 25 bp, Mus musculus
atcctcgttatccgaatgaccaata

SEQ ID NO: 881472 - DNA, 25 bp, Mus musculus
atcctcgttatcggaatgaccaata

SEQ ID NO: 881473 - DNA, 25 bp, Mus musculus
atcctctaccagctctacaaagcgc

SEQ ID NO: 881474 - DNA, 25 bp, Mus musculus
atcctctaccaggtctacaaagcgc

SEQ ID NO: 881475 - DNA, 25 bp, Mus musculus
atcctctaccctcaaccagcaagcc

SEQ ID NO: 881476 - DNA, 25 bp, Mus musculus
atcctctaccctcatccagcaagcc

SEQ ID NO: 881477 - DNA, 25 bp, Mus musculus
atcctctcaatgaattcctggagga

SEQ ID NO: 881478 - DNA, 25 bp, Mus musculus
atcctctcaatgtattcctggagga

SEQ ID NO: 881479 - DNA, 25 bp, Mus musculus
atcctctctccacacagacaataca

SEQ ID NO: 881480 - DNA, 25 bp, Mus musculus
atcctctctccagacagacaataca

SEQ ID NO: 881481 - DNA, 25 bp, Mus musculus
atcctctggaacgtcgctgacgtgg

SEQ ID NO: 881482 - DNA, 25 bp, Mus musculus
atcctctggaacgtggctgacgtgg

SEQ ID NO: 881483 - DNA, 25 bp, Mus musculus
atcctctgtggacgctttggccact

SEQ ID NO: 881484 - DNA, 25 bp, Mus musculus
atcctctgtggaggctttggccact

SEQ ID NO: 881485 - DNA, 25 bp, Mus musculus
atcctcttcatcagcatgctgcaca

SEQ ID NO: 881486 - DNA, 25 bp, Mus musculus
atcctcttcatcaggatgctgcaca

SEQ ID NO: 881487 - DNA, 25 bp, Mus musculus
atcctcttctatgcggcaggccaga

SEQ ID NO: 881488 - DNA, 25 bp, Mus musculus
atcctcttctcagcattccggctgg

SEQ ID NO: 881489 - DNA, 25 bp, Mus musculus
atcctcttctgagcattccggctgg

SEQ ID NO: 881490 - DNA, 25 bp, Mus musculus
atcctcttctttgcggcaggccaga

SEQ ID NO: 881491 - DNA, 25 bp, Mus musculus
atcctctttatcaaactgctggaga

SEQ ID NO: 881492 - DNA, 25 bp, Mus musculus
atcctctttatcaatctgctggaga

SEQ ID NO: 881493 - DNA, 25 bp, Mus musculus
atcctctttttccaccagttggaat

SEQ ID NO: 881494 - DNA, 25 bp, Mus musculus
atcctctttttccagcagttggaat

SEQ ID NO: 881495 - DNA, 25 bp, Mus musculus
atcctgaaaatacaattgccaagaa

SEQ ID NO: 881496 - DNA, 25 bp, Mus musculus
atcctgaaaatagaattgccaagaa

SEQ ID NO: 881497 - DNA, 25 bp, Mus musculus
atcctgaaacagctactacttgtcc

SEQ ID NO: 881498 - DNA, 25 bp, Mus musculus
atcctgaaacaggtactacttgtcc

SEQ ID NO: 881499 - DNA, 25 bp, Mus musculus
atcctgaaagccgagaaaggtgacc

SEQ ID NO: 881500 - DNA, 25 bp, Mus musculus
atcctgaaagcggtgaaccttcagc

SEQ ID NO: 881501 - DNA, 25 bp, Mus musculus
atcctgaaaggcgagaaaggtgacc

SEQ ID NO: 881502 - DNA, 25 bp, Mus musculus
atcctgaaaggggtgaaccttcagc

SEQ ID NO: 881503 - DNA, 25 bp, Mus musculus
atcctgaaccaactgaccgggttgg

SEQ ID NO: 881504 - DNA, 25 bp, Mus musculus
atcctgaaccaagtgaccgggttgg

SEQ ID NO: 881505 - DNA, 25 bp, Mus musculus
atcctgaatgtgaacagatctcagg

SEQ ID NO: 881506 - DNA, 25 bp, Mus musculus
atcctgaatgtgaagagatctcagg

SEQ ID NO: 881507 - DNA, 25 bp, Mus musculus
atcctgaccagacagcttctgtgtg

SEQ ID NO: 881508 - DNA, 25 bp, Mus musculus
atcctgaccagagagcttctgtgtg

SEQ ID NO: 881509 - DNA, 25 bp, Mus musculus
atcctgagatacaacgaaagaaagg

SEQ ID NO: 881510 - DNA, 25 bp, Mus musculus
atcctgagatacaaggaaagaaagg

SEQ ID NO: 881511 - DNA, 25 bp, Mus musculus
atcctgagcaaacgctacaacaagg

SEQ ID NO: 881512 - DNA, 25 bp, Mus musculus
atcctgagcaaaggctacaacaagg

SEQ ID NO: 881513 - DNA, 25 bp, Mus musculus
atcctgaggaagaggtttgagccat

SEQ ID NO: 881514 - DNA, 25 bp, Mus musculus
atcctgaggaagtggtttgagccat

SEQ ID NO: 881515 - DNA, 25 bp, Mus musculus
atcctgagtgagatggaaataggga

SEQ ID NO: 881516 - DNA, 25 bp, Mus musculus
atcctgagtgagctcatccactgga

SEQ ID NO: 881517 - DNA, 25 bp, Mus musculus
atcctgagtgaggtcatccactgga

SEQ ID NO: 881518 - DNA, 25 bp, Mus musculus
atcctgagtgagttggaaataggga

SEQ ID NO: 881519 - DNA, 25 bp, Mus musculus
atcctgatcacacgacagctccctc

SEQ ID NO: 881520 - DNA, 25 bp, Mus musculus
atcctgatcacaggacagctccctc

SEQ ID NO: 881521 - DNA, 25 bp, Mus musculus
atcctgcaaaggccatccctggatc

SEQ ID NO: 881522 - DNA, 25 bp, Mus musculus
atcctgcaaagggcatccctggatc

SEQ ID NO: 881523 - DNA, 25 bp, Mus musculus
atcctgcagagcccagcctttcggg

SEQ ID NO: 881524 - DNA, 25 bp, Mus musculus
atcctgcagagcccatctttcaggg

SEQ ID NO: 881525 - DNA, 25 bp, Mus musculus
atcctgcagagccctgcctttcggg

SEQ ID NO: 881526 - DNA, 25 bp, Mus musculus
atcctgcagagcccttctttcaggg

SEQ ID NO: 881527 - DNA, 25 bp, Mus musculus
atcctgcatctgaacaggtggccat

SEQ ID NO: 881528 - DNA, 25 bp, Mus musculus
atcctgcatctgaagaggtggccat

SEQ ID NO: 881529 - DNA, 25 bp, Mus musculus
atcctgccatagcgcaacaaatccg

SEQ ID NO: 881530 - DNA, 25 bp, Mus musculus
atcctgccatagggcaacaaatccg

SEQ ID NO: 881531 - DNA, 25 bp, Mus musculus
atcctgcccagtcttgaagaaattg

SEQ ID NO: 881532 - DNA, 25 bp, Mus musculus
atcctgcccagtgttgaagaaattg

SEQ ID NO: 881533 - DNA, 25 bp, Mus musculus
atcctgccctatgatcataccaggg

SEQ ID NO: 881534 - DNA, 25 bp, Mus musculus
atcctgccctttgatcataccaggg

SEQ ID NO: 881535 - DNA, 25 bp, Mus musculus
atcctgctagcgctcctgggttttg

SEQ ID NO: 881536 - DNA, 25 bp, Mus musculus
atcctgctagcggtcctgggttttg

SEQ ID NO: 881537 - DNA, 25 bp, Mus musculus
atcctgctatagctcagttctcagt

SEQ ID NO: 881538 - DNA, 25 bp, Mus musculus
atcctgctataggtcagttctcagt

SEQ ID NO: 881539 - DNA, 25 bp, Mus musculus
atcctgctgacaggactatgacttg

SEQ ID NO: 881540 - DNA, 25 bp, Mus musculus
atcctgctgacctacattcagccat

SEQ ID NO: 881541 - DNA, 25 bp, Mus musculus
atcctgctgagaggactatgacttg

SEQ ID NO: 881542 - DNA, 25 bp, Mus musculus
atcctgctgagctacattcagccat

SEQ ID NO: 881543 - DNA, 25 bp, Mus musculus
atcctggaggaaccttcgctgcctg

SEQ ID NO: 881544 - DNA, 25 bp, Mus musculus
atcctggaggtaccttcgctgcctg

SEQ ID NO: 881545 - DNA, 25 bp, Mus musculus
atcctggcagagaccgagggcatgc

SEQ ID NO: 881546 - DNA, 25 bp, Mus musculus
atcctggcagagacggagggcatgc

SEQ ID NO: 881547 - DNA, 25 bp, Mus musculus
atcctggcagaggacgtttccaagc

SEQ ID NO: 881548 - DNA, 25 bp, Mus musculus
atcctggcagaggaggtttccaagc

SEQ ID NO: 881549 - DNA, 25 bp, Mus musculus
atcctggccatgcacgcccaggacc

SEQ ID NO: 881550 - DNA, 25 bp, Mus musculus
atcctggccatgcaggcccaggacc

SEQ ID NO: 881551 - DNA, 25 bp, Mus musculus
atcctggcctcacgtgacaaccagg

SEQ ID NO: 881552 - DNA, 25 bp, Mus musculus
atcctggcctcaggtgacaaccagg

SEQ ID NO: 881553 - DNA, 25 bp, Mus musculus
atcctgggtcgcagctggcatgcac

SEQ ID NO: 881554 - DNA, 25 bp, Mus musculus
atcctgggtcgcaggtggcatgcac

SEQ ID NO: 881555 - DNA, 25 bp, Mus musculus
atcctggtgaagctggagccatggg

SEQ ID NO: 881556 - DNA, 25 bp, Mus musculus
atcctggtgaaggtggagccatggg

SEQ ID NO: 881557 - DNA, 25 bp, Mus musculus
atcctgtcatgccggctagtggtgg

SEQ ID NO: 881558 - DNA, 25 bp, Mus musculus
atcctgtcatgcgggctagtggtgg

SEQ ID NO: 881559 - DNA, 25 bp, Mus musculus
atcctgtccgagcatggatgccctg

SEQ ID NO: 881560 - DNA, 25 bp, Mus musculus
atcctgtccgaggatggatgccctg

SEQ ID NO: 881561 - DNA, 25 bp, Mus musculus
atcctgtcctctaatagctccttcc

SEQ ID NO: 881562 - DNA, 25 bp, Mus musculus
atcctgtcctcttatagctccttcc

SEQ ID NO: 881563 - DNA, 25 bp, Mus musculus
atcctgtgacaacgcctgaagaaac

SEQ ID NO: 881564 - DNA, 25 bp, Mus musculus
atcctgtgacaaggcctgaagaaac

SEQ ID NO: 881565 - DNA, 25 bp, Mus musculus
atcctgtgagatgggtgcaaagctt

SEQ ID NO: 881566 - DNA, 25 bp, Mus musculus
atcctgtgagttgggtgcaaagctt

SEQ ID NO: 881567 - DNA, 25 bp, Mus musculus
atcctgtgcgtgcgggagacaggtt

SEQ ID NO: 881568 - DNA, 25 bp, Mus musculus
atcctgtgcgtgggggagacaggtt

SEQ ID NO: 881569 - DNA, 25 bp, Mus musculus
atcctgttttcatggaaggaccctc

SEQ ID NO: 881570 - DNA, 25 bp, Mus musculus
atcctgttttgatggaaggaccctc

SEQ ID NO: 881571 - DNA, 25 bp, Mus musculus
atccttacagcacgtggccccttct

SEQ ID NO: 881572 - DNA, 25 bp, Mus musculus
atccttacagcaggtggccccttct

SEQ ID NO: 881573 - DNA, 25 bp, Mus musculus
atccttatagcagaaaccatcaaaa

SEQ ID NO: 881574 - DNA, 25 bp, Mus musculus
atccttataggagaaaccatcaaaa

SEQ ID NO: 881575 - DNA, 25 bp, Mus musculus
atccttcaaagcagaagcctcctgc

SEQ ID NO: 881576 - DNA, 25 bp, Mus musculus
atccttcaaagcagtagcctcctgc

SEQ ID NO: 881577 - DNA, 25 bp, Mus musculus
atccttcaagaaaccctgaagctgc

SEQ ID NO: 881578 - DNA, 25 bp, Mus musculus
atccttcaagtaaccctgaagctgc

SEQ ID NO: 881579 - DNA, 25 bp, Mus musculus
atccttcaccaaattatcaaaagtt

SEQ ID NO: 881580 - DNA, 25 bp, Mus musculus
atccttcaccaatttatcaaaagtt

SEQ ID NO: 881581 - DNA, 25 bp, Mus musculus
atccttcatcctcacaaacaaagga

SEQ ID NO: 881582 - DNA, 25 bp, Mus musculus
atccttcatcctcagaaacaaagga

SEQ ID NO: 881583 - DNA, 25 bp, Mus musculus
atccttccagatgtatcgggatatt

SEQ ID NO: 881584 - DNA, 25 bp, Mus musculus
atccttccagatgtatctggatatt

SEQ ID NO: 881585 - DNA, 25 bp, Mus musculus
atccttccagttgtatcgggatatt

SEQ ID NO: 881586 - DNA, 25 bp, Mus musculus
atccttccagttgtatctggatatt

SEQ ID NO: 881587 - DNA, 25 bp, Mus musculus
atccttcctctcatgctcttagtga

SEQ ID NO: 881588 - DNA, 25 bp, Mus musculus
atccttcctctcttgctcttagtga

SEQ ID NO: 881589 - DNA, 25 bp, Mus musculus
atccttcgagcatgtctcggaacta

SEQ ID NO: 881590 - DNA, 25 bp, Mus musculus
atccttcgagccttgctttgcttcc

SEQ ID NO: 881591 - DNA, 25 bp, Mus musculus
atccttcgaggatgtctcggaacta

SEQ ID NO: 881592 - DNA, 25 bp, Mus musculus
atccttcgaggcttgctttgcttcc

SEQ ID NO: 881593 - DNA, 25 bp, Mus musculus
atccttctagagttgggcaaccatt

SEQ ID NO: 881594 - DNA, 25 bp, Mus musculus
atccttctagtgttgggcaaccatt

SEQ ID NO: 881595 - DNA, 25 bp, Mus musculus
atccttgaaacccctctgggcgtgg

SEQ ID NO: 881596 - DNA, 25 bp, Mus musculus
atccttgaaagccctctgggcgtgg

SEQ ID NO: 881597 - DNA, 25 bp, Mus musculus
atccttgctattcctcctgggcctg

SEQ ID NO: 881598 - DNA, 25 bp, Mus musculus
atccttgctattgctcctgggcctg

SEQ ID NO: 881599 - DNA, 25 bp, Mus musculus
atccttgctgctctgtgcgtgatga

SEQ ID NO: 881600 - DNA, 25 bp, Mus musculus
atccttgctggtctgtgcgtgatga

SEQ ID NO: 881601 - DNA, 25 bp, Mus musculus
atccttggctggaagctcaggccct

SEQ ID NO: 881602 - DNA, 25 bp, Mus musculus
atccttggctggactcaggccctgg

SEQ ID NO: 881603 - DNA, 25 bp, Mus musculus
atccttggctggtagctcaggccct

SEQ ID NO: 881604 - DNA, 25 bp, Mus musculus
atccttggctggtctcaggccctgg

SEQ ID NO: 881605 - DNA, 25 bp, Mus musculus
atccttgtcaaacatcgactgtgcc

SEQ ID NO: 881606 - DNA, 25 bp, Mus musculus
atccttgtcaaactctacaaaatac

SEQ ID NO: 881607 - DNA, 25 bp, Mus musculus
atccttgtcaaagatcgactgtgcc

SEQ ID NO: 881608 - DNA, 25 bp, Mus musculus
atccttgtcaaagtctacaaaatac

SEQ ID NO: 881609 - DNA, 25 bp, Mus musculus
atcctttcatgtaacgtggtttgtg

SEQ ID NO: 881610 - DNA, 25 bp, Mus musculus
atcctttcatgtaaggtggtttgtg

SEQ ID NO: 881611 - DNA, 25 bp, Mus musculus
atcctttctactatcattggtacag

SEQ ID NO: 881612 - DNA, 25 bp, Mus musculus
atcctttctactatgattggtacag

SEQ ID NO: 881613 - DNA, 25 bp, Mus musculus
atccttttccagacagtccaggatg

SEQ ID NO: 881614 - DNA, 25 bp, Mus musculus
atccttttccagtcagtccaggatg

SEQ ID NO: 881615 - DNA, 25 bp, Mus musculus
atcgaaaactcccatttgttgagaa

SEQ ID NO: 881616 - DNA, 25 bp, Mus musculus
atcgaaaactccgatttgttgagaa

SEQ ID NO: 881617 - DNA, 25 bp, Mus musculus
atcgaaacagtacacagtgagataa

SEQ ID NO: 881618 - DNA, 25 bp, Mus musculus
atcgaaacagtacagagtgagataa

SEQ ID NO: 881619 - DNA, 25 bp, Mus musculus
atcgaaagtgagcttgccaacctta

SEQ ID NO: 881620 - DNA, 25 bp, Mus musculus
atcgaaagtgaggttgccaacctta

SEQ ID NO: 881621 - DNA, 25 bp, Mus musculus
atcgaacaatgacgtgatagagtgc

SEQ ID NO: 881622 - DNA, 25 bp, Mus musculus
atcgaacaatgaggtgatagagtgc

SEQ ID NO: 881623 - DNA, 25 bp, Mus musculus
atcgaagagacgcagctggtggctg

SEQ ID NO: 881624 - DNA, 25 bp, Mus musculus
atcgaagagacggagctggtggctg

SEQ ID NO: 881625 - DNA, 25 bp, Mus musculus
atcgaagcagaaaatgaacaggttg

SEQ ID NO: 881626 - DNA, 25 bp, Mus musculus
atcgaagcagtaaatgaacaggttg

SEQ ID NO: 881627 - DNA, 25 bp, Mus musculus
atcgaagcgtttcatgactccggaa

SEQ ID NO: 881628 - DNA, 25 bp, Mus musculus
atcgaagcgtttccaatcccggaag

SEQ ID NO: 881629 - DNA, 25 bp, Mus musculus
atcgaagcgtttcgctccttccgct

SEQ ID NO: 881630 - DNA, 25 bp, Mus musculus
atcgaagcgtttgatgactccggaa

SEQ ID NO: 881631 - DNA, 25 bp, Mus musculus
atcgaagcgtttgcaatcccggaag

SEQ ID NO: 881632 - DNA, 25 bp, Mus musculus
atcgaagcgtttggctccttccgct

SEQ ID NO: 881633 - DNA, 25 bp, Mus musculus
atcgacaaagacaacactgcttatc

SEQ ID NO: 881634 - DNA, 25 bp, Mus musculus
atcgacaaagtcaacactgcttatc

SEQ ID NO: 881635 - DNA, 25 bp, Mus musculus
atcgacaaggagctcatcagtcctg

SEQ ID NO: 881636 - DNA, 25 bp, Mus musculus
atcgacaaggaggtcatcagtcctg

SEQ ID NO: 881637 - DNA, 25 bp, Mus musculus
atcgacagtgccaaccctcctgcaa

SEQ ID NO: 881638 - DNA, 25 bp, Mus musculus
atcgacagtggcaaccctcctgcaa

SEQ ID NO: 881639 - DNA, 25 bp, Mus musculus
atcgacatcagaccaggtctctacg

SEQ ID NO: 881640 - DNA, 25 bp, Mus musculus
atcgacatcagacctggtctctacg

SEQ ID NO: 881641 - DNA, 25 bp, Mus musculus
atcgaccaagagatgctaaaatgca

SEQ ID NO: 881642 - DNA, 25 bp, Mus musculus
atcgaccaagagttgctaaaatgca

SEQ ID NO: 881643 - DNA, 25 bp, Mus musculus
atcgaccaggctgcagaggacgtgg

SEQ ID NO: 881644 - DNA, 25 bp, Mus musculus
atcgaccagggtgcagaggacgtgg

SEQ ID NO: 881645 - DNA, 25 bp, Mus musculus
atcgaccctgagcttgcaagatacc

SEQ ID NO: 881646 - DNA, 25 bp, Mus musculus
atcgaccctgaggttgcaagatacc

SEQ ID NO: 881647 - DNA, 25 bp, Mus musculus
atcgacgaatctgtcaaactgatcc

SEQ ID NO: 881648 - DNA, 25 bp, Mus musculus
atcgacgaatctgtgaaactgatcc

SEQ ID NO: 881649 - DNA, 25 bp, Mus musculus
atcgacggcctgctagtattaaaga

SEQ ID NO: 881650 - DNA, 25 bp, Mus musculus
atcgacggcctggtagtattaaaga

SEQ ID NO: 881651 - DNA, 25 bp, Mus musculus
atcgacgtggagatcacaggaccag

SEQ ID NO: 881652 - DNA, 25 bp, Mus musculus
atcgacgtggagttcacaggaccag

SEQ ID NO: 881653 - DNA, 25 bp, Mus musculus
atcgactacgagagagatcctgcca

SEQ ID NO: 881654 - DNA, 25 bp, Mus musculus
atcgactacggcaacagagagatcc

SEQ ID NO: 881655 - DNA, 25 bp, Mus musculus
atcgactacggcaagagagagatcc

SEQ ID NO: 881656 - DNA, 25 bp, Mus musculus
atcgactacgtgagagatcctgcca

SEQ ID NO: 881657 - DNA, 25 bp, Mus musculus
atcgacttagagcccaatttcgaga

SEQ ID NO: 881658 - DNA, 25 bp, Mus musculus
atcgacttagaggccaatttcgaga

SEQ ID NO: 881659 - DNA, 25 bp, Mus musculus
atcgacttcaagcacacagcaggcc

SEQ ID NO: 881660 - DNA, 25 bp, Mus musculus
atcgacttcaaggacacagcaggcc

SEQ ID NO: 881661 - DNA, 25 bp, Mus musculus
atcgagaaagagcagtaggtaatgt

SEQ ID NO: 881662 - DNA, 25 bp, Mus musculus
atcgagaaagaggagtaggtaatgt

SEQ ID NO: 881663 - DNA, 25 bp, Mus musculus
atcgagaagccacgagaaactacaa

SEQ ID NO: 881664 - DNA, 25 bp, Mus musculus
atcgagaagccacgtggtgaccata

SEQ ID NO: 881665 - DNA, 25 bp, Mus musculus
atcgagaagccaggagaaactacaa

SEQ ID NO: 881666 - DNA, 25 bp, Mus musculus
atcgagaagccaggtggtgaccata

SEQ ID NO: 881667 - DNA, 25 bp, Mus musculus
atcgagagcaaaaactctcagtttg

SEQ ID NO: 881668 - DNA, 25 bp, Mus musculus
atcgagagcaaaaagtctcagtttg

SEQ ID NO: 881669 - DNA, 25 bp, Mus musculus
atcgagaggcgcgacgccgcaaaac

SEQ ID NO: 881670 - DNA, 25 bp, Mus musculus
atcgagaggcgcgaggccgcaaaac

SEQ ID NO: 881671 - DNA, 25 bp, Mus musculus
atcgagatccagagcaaacactgga

SEQ ID NO: 881672 - DNA, 25 bp, Mus musculus
atcgagatccagtgcaaacactgga

SEQ ID NO: 881673 - DNA, 25 bp, Mus musculus
atcgagatcttcctcacctacatct

SEQ ID NO: 881674 - DNA, 25 bp, Mus musculus
atcgagatcttcctgacctacatct

SEQ ID NO: 881675 - DNA, 25 bp, Mus musculus
atcgaggagatcgacggcctgatct

SEQ ID NO: 881676 - DNA, 25 bp, Mus musculus
atcgaggagatcgagggcctgatct

SEQ ID NO: 881677 - DNA, 25 bp, Mus musculus
atcgaggaggagcacaaaagcaaaa

SEQ ID NO: 881678 - DNA, 25 bp, Mus musculus
atcgaggaggagcagaaaagcaaaa

SEQ ID NO: 881679 - DNA, 25 bp, Mus musculus
atcgaggcagcttccgcacatattt

SEQ ID NO: 881680 - DNA, 25 bp, Mus musculus
atcgaggcagcttcggcacatattt

SEQ ID NO: 881681 - DNA, 25 bp, Mus musculus
atcgaggtgccaaaccacttagttg

SEQ ID NO: 881682 - DNA, 25 bp, Mus musculus
atcgaggtgccaaagcacttagttg

SEQ ID NO: 881683 - DNA, 25 bp, Mus musculus
atcgagtggaagattgagaagtcca

SEQ ID NO: 881684 - DNA, 25 bp, Mus musculus
atcgagtggaagtttgagaagtcca

SEQ ID NO: 881685 - DNA, 25 bp, Mus musculus
atcgagtgtcaacactgtgatttac

SEQ ID NO: 881686 - DNA, 25 bp, Mus musculus
atcgagtgtcaagactgtgatttac

SEQ ID NO: 881687 - DNA, 25 bp, Mus musculus
atcgagtttgaaattcctatcacat

SEQ ID NO: 881688 - DNA, 25 bp, Mus musculus
atcgagtttgaatttcctatcacat

SEQ ID NO: 881689 - DNA, 25 bp, Mus musculus
atcgataccgagatgcaattgctga

SEQ ID NO: 881690 - DNA, 25 bp, Mus musculus
atcgataccgtgatgcaattgctga

SEQ ID NO: 881691 - DNA, 25 bp, Mus musculus
atcgatgcattgaacgatgtggata

SEQ ID NO: 881692 - DNA, 25 bp, Mus musculus
atcgatgcattgaaggatgtggata

SEQ ID NO: 881693 - DNA, 25 bp, Mus musculus
atcgatggagatcgaatcctcaatg

SEQ ID NO: 881694 - DNA, 25 bp, Mus musculus
atcgatggagatggaatcctcaatg

SEQ ID NO: 881695 - DNA, 25 bp, Mus musculus
atcgatgtgcgacattgtgaaggga

SEQ ID NO: 881696 - DNA, 25 bp, Mus musculus
atcgatgtgcgacggaaggttgtga

SEQ ID NO: 881697 - DNA, 25 bp, Mus musculus
atcgatgtgcgagattgtgaaggga

SEQ ID NO: 881698 - DNA, 25 bp, Mus musculus
atcgatgtgcgagggaaggttgtga

SEQ ID NO: 881699 - DNA, 25 bp, Mus musculus
atcgattcaagcatcgtggaaggga

SEQ ID NO: 881700 - DNA, 25 bp, Mus musculus
atcgattcaagcatggtggaaggga

SEQ ID NO: 881701 - DNA, 25 bp, Mus musculus
atcgcactgcagacaattgcctata

SEQ ID NO: 881702 - DNA, 25 bp, Mus musculus
atcgcactgcagtcaattgcctata

SEQ ID NO: 881703 - DNA, 25 bp, Mus musculus
atcgcactggcacacggttactact

SEQ ID NO: 881704 - DNA, 25 bp, Mus musculus
atcgcactggcacagggttactact

SEQ ID NO: 881705 - DNA, 25 bp, Mus musculus
atcgcagagttcaactgtaaactgg

SEQ ID NO: 881706 - DNA, 25 bp, Mus musculus
atcgcagagttcaagtgtaaactgg

SEQ ID NO: 881707 - DNA, 25 bp, Mus musculus
atcgccaaggagaattaccctctgt

SEQ ID NO: 881708 - DNA, 25 bp, Mus musculus
atcgccaaggagtattaccctctgt

SEQ ID NO: 881709 - DNA, 25 bp, Mus musculus
atcgccacagagcctacagagtgat

SEQ ID NO: 881710 - DNA, 25 bp, Mus musculus
atcgccacagtgcctacagagtgat

SEQ ID NO: 881711 - DNA, 25 bp, Mus musculus
atcgccaccacacgggaagaagtca

SEQ ID NO: 881712 - DNA, 25 bp, Mus musculus
atcgccaccacaggggaagaagtca

SEQ ID NO: 881713 - DNA, 25 bp, Mus musculus
atcgccactaagaggggaggcgcac

SEQ ID NO: 881714 - DNA, 25 bp, Mus musculus
atcgccactaagtggggaggcgcac

SEQ ID NO: 881715 - DNA, 25 bp, Mus musculus
atcgccagagagatcaaatgctccc

SEQ ID NO: 881716 - DNA, 25 bp, Mus musculus
atcgccagagagatgaaatgctccc

SEQ ID NO: 881717 - DNA, 25 bp, Mus musculus
atcgccaggatgatcccagctaccg

SEQ ID NO: 881718 - DNA, 25 bp, Mus musculus
atcgccaggatgttcccagctaccg

SEQ ID NO: 881719 - DNA, 25 bp, Mus musculus
atcgccatccagctcatcacgcgca

SEQ ID NO: 881720 - DNA, 25 bp, Mus musculus
atcgccatccagctgatcacgcgca

SEQ ID NO: 881721 - DNA, 25 bp, Mus musculus
atcgccatcctggccatcattacag

SEQ ID NO: 881722 - DNA, 25 bp, Mus musculus
atcgccatcctggccgggaattcta

SEQ ID NO: 881723 - DNA, 25 bp, Mus musculus
atcgccatcctggcgatcattacag

SEQ ID NO: 881724 - DNA, 25 bp, Mus musculus
atcgccatcctggcggggaattcta

SEQ ID NO: 881725 - DNA, 25 bp, Mus musculus
atcgccccggccaacgtattgctgt

SEQ ID NO: 881726 - DNA, 25 bp, Mus musculus
atcgccccggccaaggtattgctgt

SEQ ID NO: 881727 - DNA, 25 bp, Mus musculus
atcgcccctgagatcctgcagggcc

SEQ ID NO: 881728 - DNA, 25 bp, Mus musculus
atcgcccctgagttcctgcagggcc

SEQ ID NO: 881729 - DNA, 25 bp, Mus musculus
atcgccctggtgcggttggtggctg

SEQ ID NO: 881730 - DNA, 25 bp, Mus musculus
atcgccctggtgcgtccaagtacag

SEQ ID NO: 881731 - DNA, 25 bp, Mus musculus
atcgccctggtggggttggtggctg

SEQ ID NO: 881732 - DNA, 25 bp, Mus musculus
atcgccctggtgggtccaagtacag

SEQ ID NO: 881733 - DNA, 25 bp, Mus musculus
atcgccgcagtgctgtttgcctacg

SEQ ID NO: 881734 - DNA, 25 bp, Mus musculus
atcgccgcagtggtgtttgcctacg

SEQ ID NO: 881735 - DNA, 25 bp, Mus musculus
atcgccgccttcagtcactgcaccg

SEQ ID NO: 881736 - DNA, 25 bp, Mus musculus
atcgccgccttctgtcactgcaccg

SEQ ID NO: 881737 - DNA, 25 bp, Mus musculus
atcgcctatgagattaacccagaac

SEQ ID NO: 881738 - DNA, 25 bp, Mus musculus
atcgcctatgagtttaacccagaac

SEQ ID NO: 881739 - DNA, 25 bp, Mus musculus
atcgcctgctcatgcaatttgacat

SEQ ID NO: 881740 - DNA, 25 bp, Mus musculus
atcgcctgctcatggaatttgacat

SEQ ID NO: 881741 - DNA, 25 bp, Mus musculus
atcgctacagatactttatgcatgg

SEQ ID NO: 881742 - DNA, 25 bp, Mus musculus
atcgctacagttactttatgcatgg

SEQ ID NO: 881743 - DNA, 25 bp, Mus musculus
atcgctacttatcaactgtatgtgg

SEQ ID NO: 881744 - DNA, 25 bp, Mus musculus
atcgctacttatcatctgtatgtgg

SEQ ID NO: 881745 - DNA, 25 bp, Mus musculus
atcgctgaatttaccgtcaccattc

SEQ ID NO: 881746 - DNA, 25 bp, Mus musculus
atcgctgaatttaccgtggctctcc

SEQ ID NO: 881747 - DNA, 25 bp, Mus musculus
atcgctgaatttacggtcaccattc

SEQ ID NO: 881748 - DNA, 25 bp, Mus musculus
atcgctgaatttacggtggctctcc

SEQ ID NO: 881749 - DNA, 25 bp, Mus musculus
atcgctgatgcttgcatctatgaca

SEQ ID NO: 881750 - DNA, 25 bp, Mus musculus
atcgctgatggttgcatctatgaca

SEQ ID NO: 881751 - DNA, 25 bp, Mus musculus
atcgctgcagctctagttatttacg

SEQ ID NO: 881752 - DNA, 25 bp, Mus musculus
atcgctgcagctcttgttatttacg

SEQ ID NO: 881753 - DNA, 25 bp, Mus musculus
atcgctgccaaacacatcgaaaagg

SEQ ID NO: 881754 - DNA, 25 bp, Mus musculus
atcgctgccaaacagatcgaaaagg

SEQ ID NO: 881755 - DNA, 25 bp, Mus musculus
atcgctgtccagcagctggagaagc

SEQ ID NO: 881756 - DNA, 25 bp, Mus musculus
atcgctgtccagctcgtagtgcatg

SEQ ID NO: 881757 - DNA, 25 bp, Mus musculus
atcgctgtccaggagctggagaagc

SEQ ID NO: 881758 - DNA, 25 bp, Mus musculus
atcgctgtccaggtcgtagtgcatg

SEQ ID NO: 881759 - DNA, 25 bp, Mus musculus
atcgcttgacaaatcggaacagtct

SEQ ID NO: 881760 - DNA, 25 bp, Mus musculus
atcgcttgacaaatgggaacagtct

SEQ ID NO: 881761 - DNA, 25 bp, Mus musculus
atcgctttcaacagtatggtcttgg

SEQ ID NO: 881762 - DNA, 25 bp, Mus musculus
atcgctttcaactgtatggtcttgg

SEQ ID NO: 881763 - DNA, 25 bp, Mus musculus
atcggaaaaaggaacgtcatcgtgg

SEQ ID NO: 881764 - DNA, 25 bp, Mus musculus
atcggaaaaaggaaggtcatcgtgg

SEQ ID NO: 881765 - DNA, 25 bp, Mus musculus
atcggaacccagattgatctccgag

SEQ ID NO: 881766 - DNA, 25 bp, Mus musculus
atcggaacccagtttgatctccgag

SEQ ID NO: 881767 - DNA, 25 bp, Mus musculus
atcggacgctttgtcatcgaagagg

SEQ ID NO: 881768 - DNA, 25 bp, Mus musculus
atcggacgctttgtgatcgaagagg

SEQ ID NO: 881769 - DNA, 25 bp, Mus musculus
atcggagatttgcactccaacgtcg

SEQ ID NO: 881770 - DNA, 25 bp, Mus musculus
atcggagatttgcagtccaacgtcg

SEQ ID NO: 881771 - DNA, 25 bp, Mus musculus
atcggagccgcaccagttgccccag

SEQ ID NO: 881772 - DNA, 25 bp, Mus musculus
atcggagccgcagcagttgccccag

SEQ ID NO: 881773 - DNA, 25 bp, Mus musculus
atcggatcaatgcctctgcctggta

SEQ ID NO: 881774 - DNA, 25 bp, Mus musculus
atcggatcaatggctctgcctggta

SEQ ID NO: 881775 - DNA, 25 bp, Mus musculus
atcggatgcaaggtttgaagaaaag

SEQ ID NO: 881776 - DNA, 25 bp, Mus musculus
atcggatgcatggtttgaagaaaag

SEQ ID NO: 881777 - DNA, 25 bp, Mus musculus
atcggatgggccatccccagtgtgt

SEQ ID NO: 881778 - DNA, 25 bp, Mus musculus
atcggatggggcatccccagtgtgt

SEQ ID NO: 881779 - DNA, 25 bp, Mus musculus
atcggattcacaaataaagtggtga

SEQ ID NO: 881780 - DNA, 25 bp, Mus musculus
atcggattcacatataaagtggtga

SEQ ID NO: 881781 - DNA, 25 bp, Mus musculus
atcggcatcgcggacgatcggtcat

SEQ ID NO: 881782 - DNA, 25 bp, Mus musculus
atcggcatcgcggaggatcggtcat

SEQ ID NO: 881783 - DNA, 25 bp, Mus musculus
atcggccaattccacctgatgcagg

SEQ ID NO: 881784 - DNA, 25 bp, Mus musculus
atcggccaattccagctgatgcagg

SEQ ID NO: 881785 - DNA, 25 bp, Mus musculus
atcggccagccacgtatgcactcac

SEQ ID NO: 881786 - DNA, 25 bp, Mus musculus
atcggccagccaggtatgcactcac

SEQ ID NO: 881787 - DNA, 25 bp, Mus musculus
atcggccccaagcatggaatgcaga

SEQ ID NO: 881788 - DNA, 25 bp, Mus musculus
atcggccccaaggatggaatgcaga

SEQ ID NO: 881789 - DNA, 25 bp, Mus musculus
atcggcggcgagaagccgctgcggc

SEQ ID NO: 881790 - DNA, 25 bp, Mus musculus
atcggcggcgagtagccgctgcggc

SEQ ID NO: 881791 - DNA, 25 bp, Mus musculus
atcggctatgcaggtagaagaggac

SEQ ID NO: 881792 - DNA, 25 bp, Mus musculus
atcggctatggaggtagaagaggac

SEQ ID NO: 881793 - DNA, 25 bp, Mus musculus
atcggctctcggcttggaggatcct

SEQ ID NO: 881794 - DNA, 25 bp, Mus musculus
atcggctctcgggttggaggatcct

SEQ ID NO: 881795 - DNA, 25 bp, Mus musculus
atcggctctgaccatggggaacccc

SEQ ID NO: 881796 - DNA, 25 bp, Mus musculus
atcggctctgacgatggggaacccc

SEQ ID NO: 881797 - DNA, 25 bp, Mus musculus
atcgggaaagccgctgcctattccc

SEQ ID NO: 881798 - DNA, 25 bp, Mus musculus
atcgggaaaggcgctgcctattccc

SEQ ID NO: 881799 - DNA, 25 bp, Mus musculus
atcgggacaggacgcgtccagagat

SEQ ID NO: 881800 - DNA, 25 bp, Mus musculus
atcgggacaggaggcgtccagagat

SEQ ID NO: 881801 - DNA, 25 bp, Mus musculus
atcgggatgtggccccaactcccat

SEQ ID NO: 881802 - DNA, 25 bp, Mus musculus
atcgggatgtgggcccaactcccat

SEQ ID NO: 881803 - DNA, 25 bp, Mus musculus
atcgggctgcagatgggcaccaaca

SEQ ID NO: 881804 - DNA, 25 bp, Mus musculus
atcgggctgcagttgggcaccaaca

SEQ ID NO: 881805 - DNA, 25 bp, Mus musculus
atcgggcttcagcgggctgaggcga

SEQ ID NO: 881806 - DNA, 25 bp, Mus musculus
atcgggcttcagggggctgaggcga

SEQ ID NO: 881807 - DNA, 25 bp, Mus musculus
atcggggcagaacagattgtggatg

SEQ ID NO: 881808 - DNA, 25 bp, Mus musculus
atcggggcagaagagattgtggatg

SEQ ID NO: 881809 - DNA, 25 bp, Mus musculus
atcgggggccagcgttatcaggcag

SEQ ID NO: 881810 - DNA, 25 bp, Mus musculus
atcgggggccagggttatcaggcag

SEQ ID NO: 881811 - DNA, 25 bp, Mus musculus
atcggtacagaggcaggacagcttt

SEQ ID NO: 881812 - DNA, 25 bp, Mus musculus
atcggtacagcacagctttgcaaat

SEQ ID NO: 881813 - DNA, 25 bp, Mus musculus
atcggtacaggacagctttgcaaat

SEQ ID NO: 881814 - DNA, 25 bp, Mus musculus
atcggtacagtggcaggacagcttt

SEQ ID NO: 881815 - DNA, 25 bp, Mus musculus
atcggtcccaagcgtgacagaggct

SEQ ID NO: 881816 - DNA, 25 bp, Mus musculus
atcggtcccaagggtgacagaggct

SEQ ID NO: 881817 - DNA, 25 bp, Mus musculus
atcggtgtctcgcccttctgggcct

SEQ ID NO: 881818 - DNA, 25 bp, Mus musculus
atcggtgtctcggccttctgggcct

SEQ ID NO: 881819 - DNA, 25 bp, Mus musculus
atcggttctggccctccggcactca

SEQ ID NO: 881820 - DNA, 25 bp, Mus musculus
atcggttctggccggattcctctgc

SEQ ID NO: 881821 - DNA, 25 bp, Mus musculus
atcggttctggcgctccggcactca

SEQ ID NO: 881822 - DNA, 25 bp, Mus musculus
atcggttctggcgggattcctctgc

SEQ ID NO: 881823 - DNA, 25 bp, Mus musculus
atcgtaaagtctttgttggacgatt

SEQ ID NO: 881824 - DNA, 25 bp, Mus musculus
atcgtaaagtgtttgttggacgatt

SEQ ID NO: 881825 - DNA, 25 bp, Mus musculus
atcgtacgacaaagcagacgtcata

SEQ ID NO: 881826 - DNA, 25 bp, Mus musculus
atcgtacgacaatgcagacgtcata

SEQ ID NO: 881827 - DNA, 25 bp, Mus musculus
atcgtactcgcgctccttgtgtacg

SEQ ID NO: 881828 - DNA, 25 bp, Mus musculus
atcgtactcgggctccttgtgtacg

SEQ ID NO: 881829 - DNA, 25 bp, Mus musculus
atcgtagatcagagcatggataagg

SEQ ID NO: 881830 - DNA, 25 bp, Mus musculus
atcgtagatcagtgcatggataagg

SEQ ID NO: 881831 - DNA, 25 bp, Mus musculus
atcgtattactgaaccttaaaaagc

SEQ ID NO: 881832 - DNA, 25 bp, Mus musculus
atcgtattactgaagcttaaaaagc

SEQ ID NO: 881833 - DNA, 25 bp, Mus musculus
atcgtcaagatgctcctctctgggt

SEQ ID NO: 881834 - DNA, 25 bp, Mus musculus
atcgtcaagatggtcctctctgggt

SEQ ID NO: 881835 - DNA, 25 bp, Mus musculus
atcgtcacagaatatgcttccctgg

SEQ ID NO: 881836 - DNA, 25 bp, Mus musculus
atcgtcacagcggacgatgcaagac

SEQ ID NO: 881837 - DNA, 25 bp, Mus musculus
atcgtcacagcggaggatgcaagac

SEQ ID NO: 881838 - DNA, 25 bp, Mus musculus
atcgtcacagtatatgcttccctgg

SEQ ID NO: 881839 - DNA, 25 bp, Mus musculus
atcgtcacccacagcaatgagaggt

SEQ ID NO: 881840 - DNA, 25 bp, Mus musculus
atcgtcacccactgcaatgagaggt

SEQ ID NO: 881841 - DNA, 25 bp, Mus musculus
atcgtcagagcgtggctgcataagg

SEQ ID NO: 881842 - DNA, 25 bp, Mus musculus
atcgtcagagggtggctgcataagg

SEQ ID NO: 881843 - DNA, 25 bp, Mus musculus
atcgtcatcaacaacgagactaggg

SEQ ID NO: 881844 - DNA, 25 bp, Mus musculus
atcgtcatcaacaaggagactaggg

SEQ ID NO: 881845 - DNA, 25 bp, Mus musculus
atcgtccgccagactcagtccgcta

SEQ ID NO: 881846 - DNA, 25 bp, Mus musculus
atcgtccgccagagtacagttgacc

SEQ ID NO: 881847 - DNA, 25 bp, Mus musculus
atcgtccgccagtctcagtccgcta

SEQ ID NO: 881848 - DNA, 25 bp, Mus musculus
atcgtccgccagtgtacagttgacc

SEQ ID NO: 881849 - DNA, 25 bp, Mus musculus
atcgtcctctcgacccggagagtgg

SEQ ID NO: 881850 - DNA, 25 bp, Mus musculus
atcgtcctctcgtcccggagagtgg

SEQ ID NO: 881851 - DNA, 25 bp, Mus musculus
atcgtcctgcgcactttgagcgctg

SEQ ID NO: 881852 - DNA, 25 bp, Mus musculus
atcgtcctgcgctctttgagcgctg

SEQ ID NO: 881853 - DNA, 25 bp, Mus musculus
atcgtcgccaagcatgaggttgccc

SEQ ID NO: 881854 - DNA, 25 bp, Mus musculus
atcgtcgccaaggatgaggttgccc

SEQ ID NO: 881855 - DNA, 25 bp, Mus musculus
atcgtcgtcgtgcaccaatgaaaag

SEQ ID NO: 881856 - DNA, 25 bp, Mus musculus
atcgtcgtcgtggaccaatgaaaag

SEQ ID NO: 881857 - DNA, 25 bp, Mus musculus
atcgtctctgggaacgtgcggttcc

SEQ ID NO: 881858 - DNA, 25 bp, Mus musculus
atcgtctctgggaaggtgcggttcc

SEQ ID NO: 881859 - DNA, 25 bp, Mus musculus
atcgtcttgcagaggttgacagaca

SEQ ID NO: 881860 - DNA, 25 bp, Mus musculus
atcgtcttgcagcttgacagacata

SEQ ID NO: 881861 - DNA, 25 bp, Mus musculus
atcgtcttgcaggttgacagacata

SEQ ID NO: 881862 - DNA, 25 bp, Mus musculus
atcgtcttgcagtggttgacagaca

SEQ ID NO: 881863 - DNA, 25 bp, Mus musculus
atcgtgactgagaggaaccttgtgt

SEQ ID NO: 881864 - DNA, 25 bp, Mus musculus
atcgtgactgagtggaaccttgtgt

SEQ ID NO: 881865 - DNA, 25 bp, Mus musculus
atcgtgagccatatgactaggaccc

SEQ ID NO: 881866 - DNA, 25 bp, Mus musculus
atcgtgagccatttgactaggaccc

SEQ ID NO: 881867 - DNA, 25 bp, Mus musculus
atcgtgatcgccaagaagccagttg

SEQ ID NO: 881868 - DNA, 25 bp, Mus musculus
atcgtgatcgctgagaaggaccgaa

SEQ ID NO: 881869 - DNA, 25 bp, Mus musculus
atcgtgatcggcaagaagccagttg

SEQ ID NO: 881870 - DNA, 25 bp, Mus musculus
atcgtgatcggtgagaaggaccgaa

SEQ ID NO: 881871 - DNA, 25 bp, Mus musculus
atcgtgctcaagcttaactacatcc

SEQ ID NO: 881872 - DNA, 25 bp, Mus musculus
atcgtgctcaaggttaactacatcc

SEQ ID NO: 881873 - DNA, 25 bp, Mus musculus
atcgtgctccagagtggcgctgact

SEQ ID NO: 881874 - DNA, 25 bp, Mus musculus
atcgtgctccagtgtggcgctgact

SEQ ID NO: 881875 - DNA, 25 bp, Mus musculus
atcgtggactggcatattcaccatg

SEQ ID NO: 881876 - DNA, 25 bp, Mus musculus
atcgtggactgggatattcaccatg

SEQ ID NO: 881877 - DNA, 25 bp, Mus musculus
atcgtggaggagcaacagaagcgcc

SEQ ID NO: 881878 - DNA, 25 bp, Mus musculus
atcgtggaggaggaacagaagcgcc

SEQ ID NO: 881879 - DNA, 25 bp, Mus musculus
atcgtggcaaaaagtcagtccgacc

SEQ ID NO: 881880 - DNA, 25 bp, Mus musculus
atcgtggcaaaatgtcagtccgacc

SEQ ID NO: 881881 - DNA, 25 bp, Mus musculus
atcgtggcagcccccatgaatgaag

SEQ ID NO: 881882 - DNA, 25 bp, Mus musculus
atcgtggcaggccccatgaatgaag

SEQ ID NO: 881883 - DNA, 25 bp, Mus musculus
atcgtggccacctaaatttttatct

SEQ ID NO: 881884 - DNA, 25 bp, Mus musculus
atcgtggccacctatatttttatct

SEQ ID NO: 881885 - DNA, 25 bp, Mus musculus
atcgttatgttgattcacaatgaca

SEQ ID NO: 881886 - DNA, 25 bp, Mus musculus
atcgttatgttgtttcacaatgaca

SEQ ID NO: 881887 - DNA, 25 bp, Mus musculus
atcgttctctgtgacatcattgggc

SEQ ID NO: 881888 - DNA, 25 bp, Mus musculus
atcgttctctgtgagatcattgggc

SEQ ID NO: 881889 - DNA, 25 bp, Mus musculus
atcgttcttccacccaaggacccct

SEQ ID NO: 881890 - DNA, 25 bp, Mus musculus
atcgttcttccagccaaggacccct

SEQ ID NO: 881891 - DNA, 25 bp, Mus musculus
atcgttggagctcacgtgcccctgg

SEQ ID NO: 881892 - DNA, 25 bp, Mus musculus
atcgttggagctcaggtgcccctgg

SEQ ID NO: 881893 - DNA, 25 bp, Mus musculus
atcgtttacatactcccacaagccg

SEQ ID NO: 881894 - DNA, 25 bp, Mus musculus
atcgtttacatactgccacaagccg

SEQ ID NO: 881895 - DNA, 25 bp, Mus musculus
atcgttttataacagagcagtattt

SEQ ID NO: 881896 - DNA, 25 bp, Mus musculus
atcgttttataagagagcagtattt

SEQ ID NO: 881897 - DNA, 25 bp, Mus musculus
atctaaagtgcattggtcttgattt

SEQ ID NO: 881898 - DNA, 25 bp, Mus musculus
atctaaagtggattggtcttgattt

SEQ ID NO: 881899 - DNA, 25 bp, Mus musculus
atctaatatgaacgaagtacttaag

SEQ ID NO: 881900 - DNA, 25 bp, Mus musculus
atctaatatgaaggaagtacttaag

SEQ ID NO: 881901 - DNA, 25 bp, Mus musculus
atctaatgatcaaacgctgaggcgg

SEQ ID NO: 881902 - DNA, 25 bp, Mus musculus
atctaatgatgaaacgctgaggcgg

SEQ ID NO: 881903 - DNA, 25 bp, Mus musculus
atctaatgctgacacctcctcatgg

SEQ ID NO: 881904 - DNA, 25 bp, Mus musculus
atctaatgctgacagctcctcatgg

SEQ ID NO: 881905 - DNA, 25 bp, Mus musculus
atctaattgtgggactctgcagtga

SEQ ID NO: 881906 - DNA, 25 bp, Mus musculus
atctaattgtgggagtctgcagtga

SEQ ID NO: 881907 - DNA, 25 bp, Mus musculus
atctacaaagaattatcaagaaatt

SEQ ID NO: 881908 - DNA, 25 bp, Mus musculus
atctacaaagtattatcaagaaatt

SEQ ID NO: 881909 - DNA, 25 bp, Mus musculus
atctacactgttcttggccgcccca

SEQ ID NO: 881910 - DNA, 25 bp, Mus musculus
atctacactgttgttggccgcccca

SEQ ID NO: 881911 - DNA, 25 bp, Mus musculus
atctacagcaaaccaggactagaca

SEQ ID NO: 881912 - DNA, 25 bp, Mus musculus
atctacagcaaacctggactagaca

SEQ ID NO: 881913 - DNA, 25 bp, Mus musculus
atctacatggagccccactctcgga

SEQ ID NO: 881914 - DNA, 25 bp, Mus musculus
atctacatggaggcccactctcgga

SEQ ID NO: 881915 - DNA, 25 bp, Mus musculus
atctacatttcacacatcccgctta

SEQ ID NO: 881916 - DNA, 25 bp, Mus musculus
atctacatttcacatcctcctacca

SEQ ID NO: 881917 - DNA, 25 bp, Mus musculus
atctacatttcagacatcccgctta

SEQ ID NO: 881918 - DNA, 25 bp, Mus musculus
atctacatttcagatcctcctacca

SEQ ID NO: 881919 - DNA, 25 bp, Mus musculus
atctacctcaggaatgaatcagaat

SEQ ID NO: 881920 - DNA, 25 bp, Mus musculus
atctacctcaggtatgaatcagaat

SEQ ID NO: 881921 - DNA, 25 bp, Mus musculus
atctacgtcctccgaggctatgatg

SEQ ID NO: 881922 - DNA, 25 bp, Mus musculus
atctacgtcctcggaggctatgatg

SEQ ID NO: 881923 - DNA, 25 bp, Mus musculus
atctacgttggcaaagtggactatg

SEQ ID NO: 881924 - DNA, 25 bp, Mus musculus
atctacgttggcaatgtggactatg

SEQ ID NO: 881925 - DNA, 25 bp, Mus musculus
atctactataagagtgacctgacca

SEQ ID NO: 881926 - DNA, 25 bp, Mus musculus
atctactataagtgtgacctgacca

SEQ ID NO: 881927 - DNA, 25 bp, Mus musculus
atctactccaagcacgctgagctga

SEQ ID NO: 881928 - DNA, 25 bp, Mus musculus
atctactccaagcaggctgagctga

SEQ ID NO: 881929 - DNA, 25 bp, Mus musculus
atctactcctcacctggaattttgg

SEQ ID NO: 881930 - DNA, 25 bp, Mus musculus
atctactcctcagctggaattttgg

SEQ ID NO: 881931 - DNA, 25 bp, Mus musculus
atctactggcaacgtggtctacttc

SEQ ID NO: 881932 - DNA, 25 bp, Mus musculus
atctactggcaacgtggtctatttc

SEQ ID NO: 881933 - DNA, 25 bp, Mus musculus
atctactggcaaggtggtctacttc

SEQ ID NO: 881934 - DNA, 25 bp, Mus musculus
atctactggcaaggtggtctatttc

SEQ ID NO: 881935 - DNA, 25 bp, Mus musculus
atctacttaaagcctttatcttctg

SEQ ID NO: 881936 - DNA, 25 bp, Mus musculus
atctacttaaaggctttatcttctg

SEQ ID NO: 881937 - DNA, 25 bp, Mus musculus
atctacttcaagcctcagtacaagg

SEQ ID NO: 881938 - DNA, 25 bp, Mus musculus
atctacttcaaggctcagtacaagg

SEQ ID NO: 881939 - DNA, 25 bp, Mus musculus
atctagaagtgcagaataaaccgca

SEQ ID NO: 881940 - DNA, 25 bp, Mus musculus
atctagaagtgcagtataaaccgca

SEQ ID NO: 881941 - DNA, 25 bp, Mus musculus
atctagaatattaattcatagaaaa

SEQ ID NO: 881942 - DNA, 25 bp, Mus musculus
atctagaatatttattcatagaaaa

SEQ ID NO: 881943 - DNA, 25 bp, Mus musculus
atctagattccgcaaatacatggat

SEQ ID NO: 881944 - DNA, 25 bp, Mus musculus
atctagattcggcaaatacatggat

SEQ ID NO: 881945 - DNA, 25 bp, Mus musculus
atctagccagcgtcacagctctgtg

SEQ ID NO: 881946 - DNA, 25 bp, Mus musculus
atctagccagggtcacagctctgtg

SEQ ID NO: 881947 - DNA, 25 bp, Mus musculus
atctagctaatgcggtagctgggag

SEQ ID NO: 881948 - DNA, 25 bp, Mus musculus
atctagctaatggggtagctgggag

SEQ ID NO: 881949 - DNA, 25 bp, Mus musculus
atctagttgtcaggagtttaagaag

SEQ ID NO: 881950 - DNA, 25 bp, Mus musculus
atctagttgtgaggagtttaagaag

SEQ ID NO: 881951 - DNA, 25 bp, Mus musculus
atctataaagacatccgcggggaca

SEQ ID NO: 881952 - DNA, 25 bp, Mus musculus
atctataaagacttccgcggggaca

SEQ ID NO: 881953 - DNA, 25 bp, Mus musculus
atctataaagtggacggtggctgta

SEQ ID NO: 881954 - DNA, 25 bp, Mus musculus
atctataaagtggagggtggctgta

SEQ ID NO: 881955 - DNA, 25 bp, Mus musculus
atctataagcagcctgctgtggagg

SEQ ID NO: 881956 - DNA, 25 bp, Mus musculus
atctataagcaggctgctgtggagg

SEQ ID NO: 881957 - DNA, 25 bp, Mus musculus
atctatacagacatcattcacaatc

SEQ ID NO: 881958 - DNA, 25 bp, Mus musculus
atctatacagacatcggcagattca

SEQ ID NO: 881959 - DNA, 25 bp, Mus musculus
atctatacagacatgattcacaatc

SEQ ID NO: 881960 - DNA, 25 bp, Mus musculus
atctatacagacatgggcagattca

SEQ ID NO: 881961 - DNA, 25 bp, Mus musculus
atctatcaagcgagcaccatcatgt

SEQ ID NO: 881962 - DNA, 25 bp, Mus musculus
atctatcaagggagcaccatcatgt

SEQ ID NO: 881963 - DNA, 25 bp, Mus musculus
atctatcagagaaacgtggaagctc

SEQ ID NO: 881964 - DNA, 25 bp, Mus musculus
atctatcagagaaaggtggaagctc

SEQ ID NO: 881965 - DNA, 25 bp, Mus musculus
atctatctatctatcatctatctac

SEQ ID NO: 881966 - DNA, 25 bp, Mus musculus
atctatctatctatgatctatctac

SEQ ID NO: 881967 - DNA, 25 bp, Mus musculus
atctatgactggaatggaggaacac

SEQ ID NO: 881968 - DNA, 25 bp, Mus musculus
atctatgactggtatggaggaacac

SEQ ID NO: 881969 - DNA, 25 bp, Mus musculus
atctatgagcagctggggaccagtg

SEQ ID NO: 881970 - DNA, 25 bp, Mus musculus
atctatgagcaggtggggaccagtg

SEQ ID NO: 881971 - DNA, 25 bp, Mus musculus
atctatgcagccagcccctgtgtca

SEQ ID NO: 881972 - DNA, 25 bp, Mus musculus
atctatgcagccaggccctgtgtca

SEQ ID NO: 881973 - DNA, 25 bp, Mus musculus
atctatgccgtgcacaacaattacg

SEQ ID NO: 881974 - DNA, 25 bp, Mus musculus
atctatgccgtgcatgaacggggta

SEQ ID NO: 881975 - DNA, 25 bp, Mus musculus
atctatgccgtggacaacaattacg

SEQ ID NO: 881976 - DNA, 25 bp, Mus musculus
atctatgccgtggatgaacggggta

SEQ ID NO: 881977 - DNA, 25 bp, Mus musculus
atctatggagagagtgctgaggctg

SEQ ID NO: 881978 - DNA, 25 bp, Mus musculus
atctatggagagtgtgctgaggctg

SEQ ID NO: 881979 - DNA, 25 bp, Mus musculus
atctatgggatgtaactctcagtga

SEQ ID NO: 881980 - DNA, 25 bp, Mus musculus
atctatgggatgtatctctcagtga

SEQ ID NO: 881981 - DNA, 25 bp, Mus musculus
atctatgtcagtgacgttcctgctg

SEQ ID NO: 881982 - DNA, 25 bp, Mus musculus
atctatgtcagtgaggttcctgctg

SEQ ID NO: 881983 - DNA, 25 bp, Mus musculus
atctattaacggcttgctaggaaga

SEQ ID NO: 881984 - DNA, 25 bp, Mus musculus
atctattaacgggttgctaggaaga

SEQ ID NO: 881985 - DNA, 25 bp, Mus musculus
atctatttccagcgcttccgagtgg

SEQ ID NO: 881986 - DNA, 25 bp, Mus musculus
atctatttccagggcttccgagtgg

SEQ ID NO: 881987 - DNA, 25 bp, Mus musculus
atctcaaaccagcattatcccacct

SEQ ID NO: 881988 - DNA, 25 bp, Mus musculus
atctcaaaccaggattatcccacct

SEQ ID NO: 881989 - DNA, 25 bp, Mus musculus
atctcaaaggcacgttcggggctgg

SEQ ID NO: 881990 - DNA, 25 bp, Mus musculus
atctcaaaggcaggttcggggctgg

SEQ ID NO: 881991 - DNA, 25 bp, Mus musculus
atctcaacagaacacgatttgtgca

SEQ ID NO: 881992 - DNA, 25 bp, Mus musculus
atctcaacagaacactgctcttggc

SEQ ID NO: 881993 - DNA, 25 bp, Mus musculus
atctcaacagaacaggatttgtgca

SEQ ID NO: 881994 - DNA, 25 bp, Mus musculus
atctcaacagaacagtgctcttggc

SEQ ID NO: 881995 - DNA, 25 bp, Mus musculus
atctcaaccaccatcgagaacagtc

SEQ ID NO: 881996 - DNA, 25 bp, Mus musculus
atctcaaccaccatggagaacagtc

SEQ ID NO: 881997 - DNA, 25 bp, Mus musculus
atctcaagaaagcatggatgatcca

SEQ ID NO: 881998 - DNA, 25 bp, Mus musculus
atctcaagaaaggatggatgatcca

SEQ ID NO: 881999 - DNA, 25 bp, Mus musculus
atctcaagtggaaccgccaatgcag

SEQ ID NO: 882000 - DNA, 25 bp, Mus musculus
atctcaagtggaacggccaatgcag

SEQ ID NO: 882001 - DNA, 25 bp, Mus musculus
atctcacaaccggcaccaccacaag

SEQ ID NO: 882002 - DNA, 25 bp, Mus musculus
atctcacaacgggcaccaccacaag

SEQ ID NO: 882003 - DNA, 25 bp, Mus musculus
atctcactgacaatttagagacaga

SEQ ID NO: 882004 - DNA, 25 bp, Mus musculus
atctcactgagaatttagagacaga

SEQ ID NO: 882005 - DNA, 25 bp, Mus musculus
atctcactgtgctaaaggcccacgt

SEQ ID NO: 882006 - DNA, 25 bp, Mus musculus
atctcactgtgctataggcccacgt

SEQ ID NO: 882007 - DNA, 25 bp, Mus musculus
atctcactgtgctcaacccagccca

SEQ ID NO: 882008 - DNA, 25 bp, Mus musculus
atctcactgtgctctacccagccca

SEQ ID NO: 882009 - DNA, 25 bp, Mus musculus
atctcagaaaatcgctcctcggtgg

SEQ ID NO: 882010 - DNA, 25 bp, Mus musculus
atctcagaaaatggctcctcggtgg

SEQ ID NO: 882011 - DNA, 25 bp, Mus musculus
atctcagagacacgaaacctatttc

SEQ ID NO: 882012 - DNA, 25 bp, Mus musculus
atctcagagacaggaaacctatttc

SEQ ID NO: 882013 - DNA, 25 bp, Mus musculus
atctcagagctgactgcagacctgc

SEQ ID NO: 882014 - DNA, 25 bp, Mus musculus
atctcagagctgtctgcagacctgc

SEQ ID NO: 882015 - DNA, 25 bp, Mus musculus
atctcagaggggctccgtgtgaatg

SEQ ID NO: 882016 - DNA, 25 bp, Mus musculus
atctcagagggggtccgtgtgaatg

SEQ ID NO: 882017 - DNA, 25 bp, Mus musculus
atctcagcacaccacaactatgccg

SEQ ID NO: 882018 - DNA, 25 bp, Mus musculus
atctcagcacaccagaactatgccg

SEQ ID NO: 882019 - DNA, 25 bp, Mus musculus
atctcagcagagcctacaaccaaat

SEQ ID NO: 882020 - DNA, 25 bp, Mus musculus
atctcagcagaggctacaaccaaat

SEQ ID NO: 882021 - DNA, 25 bp, Mus musculus
atctcagctcagagaacagtttgca

SEQ ID NO: 882022 - DNA, 25 bp, Mus musculus
atctcagctcagtgaacagtttgca

SEQ ID NO: 882023 - DNA, 25 bp, Mus musculus
atctcagggagtcgtggccgcacag

SEQ ID NO: 882024 - DNA, 25 bp, Mus musculus
atctcagggagtggtggccgcacag

SEQ ID NO: 882025 - DNA, 25 bp, Mus musculus
atctcataagtaaacgagaggagcc

SEQ ID NO: 882026 - DNA, 25 bp, Mus musculus
atctcataagtaaaggagaggagcc

SEQ ID NO: 882027 - DNA, 25 bp, Mus musculus
atctcatcaagctacggatggagaa

SEQ ID NO: 882028 - DNA, 25 bp, Mus musculus
atctcatcaagctagggatggagaa

SEQ ID NO: 882029 - DNA, 25 bp, Mus musculus
atctcatcaatgcacgaaaggaaac

SEQ ID NO: 882030 - DNA, 25 bp, Mus musculus
atctcatcaatgcaggaaaggaaac

SEQ ID NO: 882031 - DNA, 25 bp, Mus musculus
atctcatgtttaatagttcctgctg

SEQ ID NO: 882032 - DNA, 25 bp, Mus musculus
atctcatgtttaattgttcctgctg

SEQ ID NO: 882033 - DNA, 25 bp, Mus musculus
atctcattggagcctccatccctga

SEQ ID NO: 882034 - DNA, 25 bp, Mus musculus
atctcattggaggctccatccctga

SEQ ID NO: 882035 - DNA, 25 bp, Mus musculus
atctccaaaggcagcaccttcctgc

SEQ ID NO: 882036 - DNA, 25 bp, Mus musculus
atctccaaaggcaggaccttcctgc

SEQ ID NO: 882037 - DNA, 25 bp, Mus musculus
atctccaacctgcttcgtcccttca

SEQ ID NO: 882038 - DNA, 25 bp, Mus musculus
atctccaacctggttcgtcccttca

SEQ ID NO: 882039 - DNA, 25 bp, Mus musculus
atctccaatgctcctgtctctgtca

SEQ ID NO: 882040 - DNA, 25 bp, Mus musculus
atctccaatgctgctgtctctgtca

SEQ ID NO: 882041 - DNA, 25 bp, Mus musculus
atctccacagctccggtgctcttag

SEQ ID NO: 882042 - DNA, 25 bp, Mus musculus
atctccacagctgcggtgctcttag

SEQ ID NO: 882043 - DNA, 25 bp, Mus musculus
atctccacttcccgcctggaggtgt

SEQ ID NO: 882044 - DNA, 25 bp, Mus musculus
atctccacttccggcctggaggtgt

SEQ ID NO: 882045 - DNA, 25 bp, Mus musculus
atctccatagagaaaacacgagaag

SEQ ID NO: 882046 - DNA, 25 bp, Mus musculus
atctccatagtgaaaacacgagaag

SEQ ID NO: 882047 - DNA, 25 bp, Mus musculus
atctccattgctaaagctgggatca

SEQ ID NO: 882048 - DNA, 25 bp, Mus musculus
atctccattgctaatgctgggatca

SEQ ID NO: 882049 - DNA, 25 bp, Mus musculus
atctccccatacaacgacctcctgg

SEQ ID NO: 882050 - DNA, 25 bp, Mus musculus
atctccccatacaaggacctcctgg

SEQ ID NO: 882051 - DNA, 25 bp, Mus musculus
atctccggctcagaaatgtcactgt

SEQ ID NO: 882052 - DNA, 25 bp, Mus musculus
atctccggctcagatatgtcactgt

SEQ ID NO: 882053 - DNA, 25 bp, Mus musculus
atctccgtggccaatgtgcttcagc

SEQ ID NO: 882054 - DNA, 25 bp, Mus musculus
atctccgtgggcaatgtgcttcagc

SEQ ID NO: 882055 - DNA, 25 bp, Mus musculus
atctccgttgtcacagctaccaagg

SEQ ID NO: 882056 - DNA, 25 bp, Mus musculus
atctccgttgtcactaccaaggggg

SEQ ID NO: 882057 - DNA, 25 bp, Mus musculus
atctccgttgtctcagctaccaagg

SEQ ID NO: 882058 - DNA, 25 bp, Mus musculus
atctccgttgtctctaccaaggggg

SEQ ID NO: 882059 - DNA, 25 bp, Mus musculus
atctcctatccacgaggagagcatt

SEQ ID NO: 882060 - DNA, 25 bp, Mus musculus
atctcctatccaggaggagagcatt

SEQ ID NO: 882061 - DNA, 25 bp, Mus musculus
atctcctcagagtcagatgccaagc

SEQ ID NO: 882062 - DNA, 25 bp, Mus musculus
atctcctcagagtcagcaagaaact

SEQ ID NO: 882063 - DNA, 25 bp, Mus musculus
atctcctcagagtctgatgccaagc

SEQ ID NO: 882064 - DNA, 25 bp, Mus musculus
atctcctcagagtctgcaagaaact

SEQ ID NO: 882065 - DNA, 25 bp, Mus musculus
atctcctctaaaagccaacaactct

SEQ ID NO: 882066 - DNA, 25 bp, Mus musculus
atctcctctaaaagcgccgcgcctg

SEQ ID NO: 882067 - DNA, 25 bp, Mus musculus
atctcctctaaaaggcaacaactct

SEQ ID NO: 882068 - DNA, 25 bp, Mus musculus
atctcctctaaaagggccgcgcctg

SEQ ID NO: 882069 - DNA, 25 bp, Mus musculus
atctcctctggaatcgcctatttac

SEQ ID NO: 882070 - DNA, 25 bp, Mus musculus
atctcctctggaatggcctatttac

SEQ ID NO: 882071 - DNA, 25 bp, Mus musculus
atctcctgtgacaagttattggatg

SEQ ID NO: 882072 - DNA, 25 bp, Mus musculus
atctcctgtgactagttattggatg

SEQ ID NO: 882073 - DNA, 25 bp, Mus musculus
atctccttccaaagaggatttgttg

SEQ ID NO: 882074 - DNA, 25 bp, Mus musculus
atctccttccaatgaggatttgttg

SEQ ID NO: 882075 - DNA, 25 bp, Mus musculus
atctcgacagcgcggagacgcgtgg

SEQ ID NO: 882076 - DNA, 25 bp, Mus musculus
atctcgacagcggggagacgcgtgg

SEQ ID NO: 882077 - DNA, 25 bp, Mus musculus
atctcgctgctatacgcatgaaaga

SEQ ID NO: 882078 - DNA, 25 bp, Mus musculus
atctcgctgctatacgctactattg

SEQ ID NO: 882079 - DNA, 25 bp, Mus musculus
atctcgctgctataggcatgaaaga

SEQ ID NO: 882080 - DNA, 25 bp, Mus musculus
atctcgctgctataggctactattg

SEQ ID NO: 882081 - DNA, 25 bp, Mus musculus
atctcggcagaactgcaggctccgc

SEQ ID NO: 882082 - DNA, 25 bp, Mus musculus
atctcggcagaagtgcaggctccgc

SEQ ID NO: 882083 - DNA, 25 bp, Mus musculus
atctctaaaactactatcatcctga

SEQ ID NO: 882084 - DNA, 25 bp, Mus musculus
atctctaaaactcaagcaccttcag

SEQ ID NO: 882085 - DNA, 25 bp, Mus musculus
atctctaaaactgaagcaccttcag

SEQ ID NO: 882086 - DNA, 25 bp, Mus musculus
atctctaaaacttctatcatcctga

SEQ ID NO: 882087 - DNA, 25 bp, Mus musculus
atctctacagaggaaggcattactg

SEQ ID NO: 882088 - DNA, 25 bp, Mus musculus
atctctacaggtagggacccgaaag

SEQ ID NO: 882089 - DNA, 25 bp, Mus musculus
atctctacaggttgggacccgaaag

SEQ ID NO: 882090 - DNA, 25 bp, Mus musculus
atctctacagtggaaggcattactg

SEQ ID NO: 882091 - DNA, 25 bp, Mus musculus
atctctacattgcacattcatcgtg

SEQ ID NO: 882092 - DNA, 25 bp, Mus musculus
atctctacattgcagattcatcgtg

SEQ ID NO: 882093 - DNA, 25 bp, Mus musculus
atctctataaaattcaacttactga

SEQ ID NO: 882094 - DNA, 25 bp, Mus musculus
atctctataatattcaacttactga

SEQ ID NO: 882095 - DNA, 25 bp, Mus musculus
atctctatgtcacacatgtggttcc

SEQ ID NO: 882096 - DNA, 25 bp, Mus musculus
atctctatgtcacagatgtggttcc

SEQ ID NO: 882097 - DNA, 25 bp, Mus musculus
atctctcacatggacaaactgctgt

SEQ ID NO: 882098 - DNA, 25 bp, Mus musculus
atctctcacatggagaaactgctgt

SEQ ID NO: 882099 - DNA, 25 bp, Mus musculus
atctctccagccaggctgcttctga

SEQ ID NO: 882100 - DNA, 25 bp, Mus musculus
atctctccagccagtgaggatccca

SEQ ID NO: 882101 - DNA, 25 bp, Mus musculus
atctctccagccatatctggcacca

SEQ ID NO: 882102 - DNA, 25 bp, Mus musculus
atctctccagcctggctgcttctga

SEQ ID NO: 882103 - DNA, 25 bp, Mus musculus
atctctccagcctgtgaggatccca

SEQ ID NO: 882104 - DNA, 25 bp, Mus musculus
atctctccagccttatctggcacca

SEQ ID NO: 882105 - DNA, 25 bp, Mus musculus
atctctcgacataccatcccttcag

SEQ ID NO: 882106 - DNA, 25 bp, Mus musculus
atctctcgacattccatcccttcag

SEQ ID NO: 882107 - DNA, 25 bp, Mus musculus
atctctctcttacacatcaagatct

SEQ ID NO: 882108 - DNA, 25 bp, Mus musculus
atctctctcttacacgcactacaga

SEQ ID NO: 882109 - DNA, 25 bp, Mus musculus
atctctctcttacagatcaagatct

SEQ ID NO: 882110 - DNA, 25 bp, Mus musculus
atctctctcttacaggcactacaga

SEQ ID NO: 882111 - DNA, 25 bp, Mus musculus
atctctgaacctcttccagctacgg

SEQ ID NO: 882112 - DNA, 25 bp, Mus musculus
atctctgaacctgttccagctacgg

SEQ ID NO: 882113 - DNA, 25 bp, Mus musculus
atctctgacaagaacaggacatatt

SEQ ID NO: 882114 - DNA, 25 bp, Mus musculus
atctctgacaagtacaggacatatt

SEQ ID NO: 882115 - DNA, 25 bp, Mus musculus
atctctgccgcgtcatcgagcatgg

SEQ ID NO: 882116 - DNA, 25 bp, Mus musculus
atctctgccgggtcatcgagcatgg

SEQ ID NO: 882117 - DNA, 25 bp, Mus musculus
atctctgggaagattgctacagaag

SEQ ID NO: 882118 - DNA, 25 bp, Mus musculus
atctctgggaagtttgctacagaag

SEQ ID NO: 882119 - DNA, 25 bp, Mus musculus
atctctgtgatccagaatggctacg

SEQ ID NO: 882120 - DNA, 25 bp, Mus musculus
atctctgtgatcgagaatggctacg

SEQ ID NO: 882121 - DNA, 25 bp, Mus musculus
atctctgtggaacagacctctgcta

SEQ ID NO: 882122 - DNA, 25 bp, Mus musculus
atctctgtggaagagacctctgcta

SEQ ID NO: 882123 - DNA, 25 bp, Mus musculus
atctcttaaatacaatgtcaaaact

SEQ ID NO: 882124 - DNA, 25 bp, Mus musculus
atctcttaaatagaatgtcaaaact

SEQ ID NO: 882125 - DNA, 25 bp, Mus musculus
atctcttacaagctacactttcttc

SEQ ID NO: 882126 - DNA, 25 bp, Mus musculus
atctcttacaaggtacactttcttc

SEQ ID NO: 882127 - DNA, 25 bp, Mus musculus
atctcttcagcttcctagatagagc

SEQ ID NO: 882128 - DNA, 25 bp, Mus musculus
atctcttcaggttcctagatagagc

SEQ ID NO: 882129 - DNA, 25 bp, Mus musculus
atctcttccaagagccaacaactgt

SEQ ID NO: 882130 - DNA, 25 bp, Mus musculus
atctcttccaagaggcaacaactgt

SEQ ID NO: 882131 - DNA, 25 bp, Mus musculus
atctgaaataataggatttttatca

SEQ ID NO: 882132 - DNA, 25 bp, Mus musculus
atctgaaataattggatttttatca

SEQ ID NO: 882133 - DNA, 25 bp, Mus musculus
atctgaaatactgattggacaatgt

SEQ ID NO: 882134 - DNA, 25 bp, Mus musculus
atctgaaatagtgattggacaatgt

SEQ ID NO: 882135 - DNA, 25 bp, Mus musculus
atctgaacgaatcgaccaatgacac

SEQ ID NO: 882136 - DNA, 25 bp, Mus musculus
atctgaacgaatggaccaatgacac

SEQ ID NO: 882137 - DNA, 25 bp, Mus musculus
atctgaacgcctcactgactccatc

SEQ ID NO: 882138 - DNA, 25 bp, Mus musculus
atctgaacgcctcagtgactccatc

SEQ ID NO: 882139 - DNA, 25 bp, Mus musculus
atctgaactgcagaaggaacctctg

SEQ ID NO: 882140 - DNA, 25 bp, Mus musculus
atctgaactggagaaggaacctctg

SEQ ID NO: 882141 - DNA, 25 bp, Mus musculus
atctgaagaacgcgtatggctttgt

SEQ ID NO: 882142 - DNA, 25 bp, Mus musculus
atctgaagaacgctctgttatgttc

SEQ ID NO: 882143 - DNA, 25 bp, Mus musculus
atctgaagaacgggtatggctttgt

SEQ ID NO: 882144 - DNA, 25 bp, Mus musculus
atctgaagaacggtctgttatgttc

SEQ ID NO: 882145 - DNA, 25 bp, Mus musculus
atctgaagatcgcgccagcctcccc

SEQ ID NO: 882146 - DNA, 25 bp, Mus musculus
atctgaagatggcgccagcctcccc

SEQ ID NO: 882147 - DNA, 25 bp, Mus musculus
atctgaagcctcaacggcgccctga

SEQ ID NO: 882148 - DNA, 25 bp, Mus musculus
atctgaagcctcaagggcgccctga

SEQ ID NO: 882149 - DNA, 25 bp, Mus musculus
atctgaagctacacagatagcctcc

SEQ ID NO: 882150 - DNA, 25 bp, Mus musculus
atctgaagctacactgatagcctcc

SEQ ID NO: 882151 - DNA, 25 bp, Mus musculus
atctgaataactgcggacctatggt

SEQ ID NO: 882152 - DNA, 25 bp, Mus musculus
atctgaataagtgcggacctatggt

SEQ ID NO: 882153 - DNA, 25 bp, Mus musculus
atctgaatataaaaagaaagaaatg

SEQ ID NO: 882154 - DNA, 25 bp, Mus musculus
atctgaatataataagaaagaaatg

SEQ ID NO: 882155 - DNA, 25 bp, Mus musculus
atctgacaacagccaagagaaacat

SEQ ID NO: 882156 - DNA, 25 bp, Mus musculus
atctgacaacagctcaccttcgtct

SEQ ID NO: 882157 - DNA, 25 bp, Mus musculus
atctgacaacaggcaagagaaacat

SEQ ID NO: 882158 - DNA, 25 bp, Mus musculus
atctgacaacaggtcaccttcgtct

SEQ ID NO: 882159 - DNA, 25 bp, Mus musculus
atctgacaagctgcagcaagggtcc

SEQ ID NO: 882160 - DNA, 25 bp, Mus musculus
atctgacaaggtgcagcaagggtcc

SEQ ID NO: 882161 - DNA, 25 bp, Mus musculus
atctgacccaagagattgctatgga

SEQ ID NO: 882162 - DNA, 25 bp, Mus musculus
atctgacccaagcttatgatggagc

SEQ ID NO: 882163 - DNA, 25 bp, Mus musculus
atctgacccaaggttatgatggagc

SEQ ID NO: 882164 - DNA, 25 bp, Mus musculus
atctgacccaagtgattgctatgga

SEQ ID NO: 882165 - DNA, 25 bp, Mus musculus
atctgacctgagctgagcctaccac

SEQ ID NO: 882166 - DNA, 25 bp, Mus musculus
atctgacctgtgctgagcctaccac

SEQ ID NO: 882167 - DNA, 25 bp, Mus musculus
atctgatgaccaaactgtctgcctg

SEQ ID NO: 882168 - DNA, 25 bp, Mus musculus
atctgatgaccatactgtctgcctg

SEQ ID NO: 882169 - DNA, 25 bp, Mus musculus
atctgatgagtaaccggccggtttc

SEQ ID NO: 882170 - DNA, 25 bp, Mus musculus
atctgatgagtaacgggccggtttc

SEQ ID NO: 882171 - DNA, 25 bp, Mus musculus
atctgatggggacgtgtttgcctgg

SEQ ID NO: 882172 - DNA, 25 bp, Mus musculus
atctgatggggaggtgtttgcctgg

SEQ ID NO: 882173 - DNA, 25 bp, Mus musculus
atctgcaagaacacctaggctggcc

SEQ ID NO: 882174 - DNA, 25 bp, Mus musculus
atctgcaagaactcctaggctggcc

SEQ ID NO: 882175 - DNA, 25 bp, Mus musculus
atctgcaagctgcatgataaggacc

SEQ ID NO: 882176 - DNA, 25 bp, Mus musculus
atctgcaagctggatgataaggacc

SEQ ID NO: 882177 - DNA, 25 bp, Mus musculus
atctgcacagctggccccaaagtac

SEQ ID NO: 882178 - DNA, 25 bp, Mus musculus
atctgcacaggtggccccaaagtac

SEQ ID NO: 882179 - DNA, 25 bp, Mus musculus
atctgcagagctcagtcagaaggca

SEQ ID NO: 882180 - DNA, 25 bp, Mus musculus
atctgcagagctggacgctagtgac

SEQ ID NO: 882181 - DNA, 25 bp, Mus musculus
atctgcagaggtcagtcagaaggca

SEQ ID NO: 882182 - DNA, 25 bp, Mus musculus
atctgcagaggtggacgctagtgac

SEQ ID NO: 882183 - DNA, 25 bp, Mus musculus
atctgcagcgagagcccttcgcatt

SEQ ID NO: 882184 - DNA, 25 bp, Mus musculus
atctgcagcgagattggccaaggag

SEQ ID NO: 882185 - DNA, 25 bp, Mus musculus
atctgcagcgagcctatagtttggc

SEQ ID NO: 882186 - DNA, 25 bp, Mus musculus
atctgcagcgaggctatagtttggc

SEQ ID NO: 882187 - DNA, 25 bp, Mus musculus
atctgcagcgagtgcccttcgcatt

SEQ ID NO: 882188 - DNA, 25 bp, Mus musculus
atctgcagcgagtttggccaaggag

SEQ ID NO: 882189 - DNA, 25 bp, Mus musculus
atctgccaagagacaaacagaagtt

SEQ ID NO: 882190 - DNA, 25 bp, Mus musculus
atctgccaagaggtccagtgtgagc

SEQ ID NO: 882191 - DNA, 25 bp, Mus musculus
atctgccaagtgacaaacagaagtt

SEQ ID NO: 882192 - DNA, 25 bp, Mus musculus
atctgccaagtggtccagtgtgagc

SEQ ID NO: 882193 - DNA, 25 bp, Mus musculus
atctgccagcagaatggcattgtac

SEQ ID NO: 882194 - DNA, 25 bp, Mus musculus
atctgccagcagtatggcattgtac

SEQ ID NO: 882195 - DNA, 25 bp, Mus musculus
atctgccgagagcggtcccacagag

SEQ ID NO: 882196 - DNA, 25 bp, Mus musculus
atctgccgagaggggtcccacagag

SEQ ID NO: 882197 - DNA, 25 bp, Mus musculus
atctgcctaccacgtgcagagcccc

SEQ ID NO: 882198 - DNA, 25 bp, Mus musculus
atctgcctaccacgtggcaaaggaa

SEQ ID NO: 882199 - DNA, 25 bp, Mus musculus
atctgcctaccaggtgcagagcccc

SEQ ID NO: 882200 - DNA, 25 bp, Mus musculus
atctgcctaccaggtggcaaaggaa

SEQ ID NO: 882201 - DNA, 25 bp, Mus musculus
atctgcctcaagaaatttgtcaagc

SEQ ID NO: 882202 - DNA, 25 bp, Mus musculus
atctgcctcaagtaatttgtcaagc

SEQ ID NO: 882203 - DNA, 25 bp, Mus musculus
atctgcgccccgcgctccagcatac

SEQ ID NO: 882204 - DNA, 25 bp, Mus musculus
atctgcgccccgggctccagcatac

SEQ ID NO: 882205 - DNA, 25 bp, Mus musculus
atctgcggaaggcaaacaacctgat

SEQ ID NO: 882206 - DNA, 25 bp, Mus musculus
atctgcggaagggaaacaacctgat

SEQ ID NO: 882207 - DNA, 25 bp, Mus musculus
atctgcgtcattcacagaggaatgc

SEQ ID NO: 882208 - DNA, 25 bp, Mus musculus
atctgcgtcattcagagaggaatgc

SEQ ID NO: 882209 - DNA, 25 bp, Mus musculus
atctgctccaagccccacagctggc

SEQ ID NO: 882210 - DNA, 25 bp, Mus musculus
atctgctccaaggcccacagctggc

SEQ ID NO: 882211 - DNA, 25 bp, Mus musculus
atctgctccacgagtttgatgaata

SEQ ID NO: 882212 - DNA, 25 bp, Mus musculus
atctgctccacgtgtttgatgaata

SEQ ID NO: 882213 - DNA, 25 bp, Mus musculus
atctgctgctgctgaacaatgttaa

SEQ ID NO: 882214 - DNA, 25 bp, Mus musculus
atctgctgctgctgtacaatgttaa

SEQ ID NO: 882215 - DNA, 25 bp, Mus musculus
atctggaaaacacgcccacagaaca

SEQ ID NO: 882216 - DNA, 25 bp, Mus musculus
atctggaaaacaggcccacagaaca

SEQ ID NO: 882217 - DNA, 25 bp, Mus musculus
atctggaacaagaacgtcaacattt

SEQ ID NO: 882218 - DNA, 25 bp, Mus musculus
atctggaacaagtacgtcaacattt

SEQ ID NO: 882219 - DNA, 25 bp, Mus musculus
atctggacaattaccgtgcccgagg

SEQ ID NO: 882220 - DNA, 25 bp, Mus musculus
atctggacaattacggtgcccgagg

SEQ ID NO: 882221 - DNA, 25 bp, Mus musculus
atctggagcagcagcctcagggctg

SEQ ID NO: 882222 - DNA, 25 bp, Mus musculus
atctggagcagctgcctcagggctg

SEQ ID NO: 882223 - DNA, 25 bp, Mus musculus
atctggagccggagccagaggaaga

SEQ ID NO: 882224 - DNA, 25 bp, Mus musculus
atctggagccggtgccagaggaaga

SEQ ID NO: 882225 - DNA, 25 bp, Mus musculus
atctggataaagagttcaggaagga

SEQ ID NO: 882226 - DNA, 25 bp, Mus musculus
atctggataaagtgttcaggaagga

SEQ ID NO: 882227 - DNA, 25 bp, Mus musculus
atctggatcaataaagaagagatga

SEQ ID NO: 882228 - DNA, 25 bp, Mus musculus
atctggatcaataatgaagagatga

SEQ ID NO: 882229 - DNA, 25 bp, Mus musculus
atctggatcacacgagaaaataatg

SEQ ID NO: 882230 - DNA, 25 bp, Mus musculus
atctggatcacaggagaaaataatg

SEQ ID NO: 882231 - DNA, 25 bp, Mus musculus
atctggatgccccacgaactggatg

SEQ ID NO: 882232 - DNA, 25 bp, Mus musculus
atctggatgccccacttttataggc

SEQ ID NO: 882233 - DNA, 25 bp, Mus musculus
atctggatgccccaggaactggatg

SEQ ID NO: 882234 - DNA, 25 bp, Mus musculus
atctggatgccccagttttataggc

SEQ ID NO: 882235 - DNA, 25 bp, Mus musculus
atctggatttatcacaaacatacaa

SEQ ID NO: 882236 - DNA, 25 bp, Mus musculus
atctggatttatcagaaacatacaa

SEQ ID NO: 882237 - DNA, 25 bp, Mus musculus
atctggcaaaggctatacctggcct

SEQ ID NO: 882238 - DNA, 25 bp, Mus musculus
atctggcaaagggtatacctggcct

SEQ ID NO: 882239 - DNA, 25 bp, Mus musculus
atctggcgacatcatatttgaagga

SEQ ID NO: 882240 - DNA, 25 bp, Mus musculus
atctggcgacatgatatttgaagga

SEQ ID NO: 882241 - DNA, 25 bp, Mus musculus
atctggcgggcaaatatcgtcagat

SEQ ID NO: 882242 - DNA, 25 bp, Mus musculus
atctggcgggcaatggtgaatgaga

SEQ ID NO: 882243 - DNA, 25 bp, Mus musculus
atctggcgggcatatatcgtcagat

SEQ ID NO: 882244 - DNA, 25 bp, Mus musculus
atctggcgggcattggtgaatgaga

SEQ ID NO: 882245 - DNA, 25 bp, Mus musculus
atctggctccaactcgcgtccctac

SEQ ID NO: 882246 - DNA, 25 bp, Mus musculus
atctggctccaactggcgtccctac

SEQ ID NO: 882247 - DNA, 25 bp, Mus musculus
atctggctctgtctgtccaccatag

SEQ ID NO: 882248 - DNA, 25 bp, Mus musculus
atctggctctgtgtgtccaccatag

SEQ ID NO: 882249 - DNA, 25 bp, Mus musculus
atctgggaagaagccaccatggggc

SEQ ID NO: 882250 - DNA, 25 bp, Mus musculus
atctgggaagtagccaccatggggc

SEQ ID NO: 882251 - DNA, 25 bp, Mus musculus
atctgggacgtgaacagcctggagt

SEQ ID NO: 882252 - DNA, 25 bp, Mus musculus
atctgggacgtgaagagcctggagt

SEQ ID NO: 882253 - DNA, 25 bp, Mus musculus
atctgggagtaacttccttggagga

SEQ ID NO: 882254 - DNA, 25 bp, Mus musculus
atctgggagtaagttccttggagga

SEQ ID NO: 882255 - DNA, 25 bp, Mus musculus
atctgggataagcacgacccacctg

SEQ ID NO: 882256 - DNA, 25 bp, Mus musculus
atctgggataaggacgacccacctg

SEQ ID NO: 882257 - DNA, 25 bp, Mus musculus
atctgggattcactcattaggattg

SEQ ID NO: 882258 - DNA, 25 bp, Mus musculus
atctgggattcagtcattaggattg

SEQ ID NO: 882259 - DNA, 25 bp, Mus musculus
atctggtgaagacctacggacatat

SEQ ID NO: 882260 - DNA, 25 bp, Mus musculus
atctggtgaagagctacggacatat

SEQ ID NO: 882261 - DNA, 25 bp, Mus musculus
atctggtgtggcagtagaaacagat

SEQ ID NO: 882262 - DNA, 25 bp, Mus musculus
atctggtgtggcattttttggacca

SEQ ID NO: 882263 - DNA, 25 bp, Mus musculus
atctggtgtggctgtagaaacagat

SEQ ID NO: 882264 - DNA, 25 bp, Mus musculus
atctggtgtggctttttttggacca

SEQ ID NO: 882265 - DNA, 25 bp, Mus musculus
atctgtaccaggctgtacattggtg

SEQ ID NO: 882266 - DNA, 25 bp, Mus musculus
atctgtaccagggtgtacattggtg

SEQ ID NO: 882267 - DNA, 25 bp, Mus musculus
atctgtagcccgcacaccatggggc

SEQ ID NO: 882268 - DNA, 25 bp, Mus musculus
atctgtagcccggacaccatggggc

SEQ ID NO: 882269 - DNA, 25 bp, Mus musculus
atctgtcctgagcagtgtgcagcca

SEQ ID NO: 882270 - DNA, 25 bp, Mus musculus
atctgtcctgaggagtgtgcagcca

SEQ ID NO: 882271 - DNA, 25 bp, Mus musculus
atctgtcctgcgatccatgatgtac

SEQ ID NO: 882272 - DNA, 25 bp, Mus musculus
atctgtcctgcgttccatgatgtac

SEQ ID NO: 882273 - DNA, 25 bp, Mus musculus
atctgtctgaaaaccatgatggagc

SEQ ID NO: 882274 - DNA, 25 bp, Mus musculus
atctgtctgaaaacgatgatggagc

SEQ ID NO: 882275 - DNA, 25 bp, Mus musculus
atctgtgaagatgtccagctcgccg

SEQ ID NO: 882276 - DNA, 25 bp, Mus musculus
atctgtgaagttgtccagctcgccg

SEQ ID NO: 882277 - DNA, 25 bp, Mus musculus
atctgtgatccccgcacaactgggg

SEQ ID NO: 882278 - DNA, 25 bp, Mus musculus
atctgtgatccccggacaactgggg

SEQ ID NO: 882279 - DNA, 25 bp, Mus musculus
atctgtgatgagctggacttatatg

SEQ ID NO: 882280 - DNA, 25 bp, Mus musculus
atctgtgatgaggtggacttatatg

SEQ ID NO: 882281 - DNA, 25 bp, Mus musculus
atctgtgatgccatcattaacaaca

SEQ ID NO: 882282 - DNA, 25 bp, Mus musculus
atctgtgatgccatgattaacaaca

SEQ ID NO: 882283 - DNA, 25 bp, Mus musculus
atctgtgctgcccacatcttggtga

SEQ ID NO: 882284 - DNA, 25 bp, Mus musculus
atctgtgctgcccagatcttggtga

SEQ ID NO: 882285 - DNA, 25 bp, Mus musculus
atctgtggcaagagcggatcactat

SEQ ID NO: 882286 - DNA, 25 bp, Mus musculus
atctgtggcaagaggggatcactat

SEQ ID NO: 882287 - DNA, 25 bp, Mus musculus
atctgttctgaaactgcttcagatc

SEQ ID NO: 882288 - DNA, 25 bp, Mus musculus
atctgttctgaatctgcttcagatc

SEQ ID NO: 882289 - DNA, 25 bp, Mus musculus
atctgttgaaagctttcctgcagtt

SEQ ID NO: 882290 - DNA, 25 bp, Mus musculus
atctgttgaaaggtttcctgcagtt

SEQ ID NO: 882291 - DNA, 25 bp, Mus musculus
atctgttgcactcgccatcatcaac

SEQ ID NO: 882292 - DNA, 25 bp, Mus musculus
atctgttgcactggccatcatcaac

SEQ ID NO: 882293 - DNA, 25 bp, Mus musculus
atctgttggctaatggcgatttgac

SEQ ID NO: 882294 - DNA, 25 bp, Mus musculus
atctgttggctattggcgatttgac

SEQ ID NO: 882295 - DNA, 25 bp, Mus musculus
atctgttgtgctcaacttcatcctc

SEQ ID NO: 882296 - DNA, 25 bp, Mus musculus
atctgttgtggtcaacttcatcctc

SEQ ID NO: 882297 - DNA, 25 bp, Mus musculus
atctgttttttaccacaatggaagg

SEQ ID NO: 882298 - DNA, 25 bp, Mus musculus
atctgttttttagcacaatggaagg

SEQ ID NO: 882299 - DNA, 25 bp, Mus musculus
atcttaaaaacacgtgtcctggagc

SEQ ID NO: 882300 - DNA, 25 bp, Mus musculus
atcttaaaaacaggtgtcctggagc

SEQ ID NO: 882301 - DNA, 25 bp, Mus musculus
atcttaaagatgaggtcctgtaata

SEQ ID NO: 882302 - DNA, 25 bp, Mus musculus
atcttaaagatgcaggcgccgagga

SEQ ID NO: 882303 - DNA, 25 bp, Mus musculus
atcttaaagatgccttgtccatgcg

SEQ ID NO: 882304 - DNA, 25 bp, Mus musculus
atcttaaagatgcgggctgaggcga

SEQ ID NO: 882305 - DNA, 25 bp, Mus musculus
atcttaaagatggaggcgccgagga

SEQ ID NO: 882306 - DNA, 25 bp, Mus musculus
atcttaaagatggcttgtccatgcg

SEQ ID NO: 882307 - DNA, 25 bp, Mus musculus
atcttaaagatgggggctgaggcga

SEQ ID NO: 882308 - DNA, 25 bp, Mus musculus
atcttaaagatgtggtcctgtaata

SEQ ID NO: 882309 - DNA, 25 bp, Mus musculus
atcttaaagcatgtcatgtctaaca

SEQ ID NO: 882310 - DNA, 25 bp, Mus musculus
atcttaaagcatgtgatgtctaaca

SEQ ID NO: 882311 - DNA, 25 bp, Mus musculus
atcttaagactgccctgctgcaaaa

SEQ ID NO: 882312 - DNA, 25 bp, Mus musculus
atcttaagactggcctgctgcaaaa

SEQ ID NO: 882313 - DNA, 25 bp, Mus musculus
atcttaagaggacgtccttgttcac

SEQ ID NO: 882314 - DNA, 25 bp, Mus musculus
atcttaagaggaggtccttgttcac

SEQ ID NO: 882315 - DNA, 25 bp, Mus musculus
atcttaagtgaagacggcattcaag

SEQ ID NO: 882316 - DNA, 25 bp, Mus musculus
atcttaagtgaagagggcattcaag

SEQ ID NO: 882317 - DNA, 25 bp, Mus musculus
atcttacccaaaccccacctggaag

SEQ ID NO: 882318 - DNA, 25 bp, Mus musculus
atcttacccaaagcccacctggaag

SEQ ID NO: 882319 - DNA, 25 bp, Mus musculus
atcttagaacatcctttactgtgat

SEQ ID NO: 882320 - DNA, 25 bp, Mus musculus
atcttagaacttcctttactgtgat

SEQ ID NO: 882321 - DNA, 25 bp, Mus musculus
atcttagacctgcaagagaaacaaa

SEQ ID NO: 882322 - DNA, 25 bp, Mus musculus
atcttagacctggaagagaaacaaa

SEQ ID NO: 882323 - DNA, 25 bp, Mus musculus
atcttagcagaggagcagttcatcc

SEQ ID NO: 882324 - DNA, 25 bp, Mus musculus
atcttagcagctcggtctccagtct

SEQ ID NO: 882325 - DNA, 25 bp, Mus musculus
atcttagcaggtcggtctccagtct

SEQ ID NO: 882326 - DNA, 25 bp, Mus musculus
atcttagcagtggagcagttcatcc

SEQ ID NO: 882327 - DNA, 25 bp, Mus musculus
atcttataagtaaacagaacccatc

SEQ ID NO: 882328 - DNA, 25 bp, Mus musculus
atcttataagtaaagagaacccatc

SEQ ID NO: 882329 - DNA, 25 bp, Mus musculus
atcttatcagcagcacggcatccct

SEQ ID NO: 882330 - DNA, 25 bp, Mus musculus
atcttatcaggagcacggcatccct

SEQ ID NO: 882331 - DNA, 25 bp, Mus musculus
atcttattccatagtagtgggcagc

SEQ ID NO: 882332 - DNA, 25 bp, Mus musculus
atcttattccattgtagtgggcagc

SEQ ID NO: 882333 - DNA, 25 bp, Mus musculus
atcttcaacacaggtgtgtgatgtg

SEQ ID NO: 882334 - DNA, 25 bp, Mus musculus
atcttcaacactgtgtgatgtgatc

SEQ ID NO: 882335 - DNA, 25 bp, Mus musculus
atcttcaacagaggtgtgtgatgtg

SEQ ID NO: 882336 - DNA, 25 bp, Mus musculus
atcttcaacagtgtgtgatgtgatc

SEQ ID NO: 882337 - DNA, 25 bp, Mus musculus
atcttcaatgaaattacacttgtga

SEQ ID NO: 882338 - DNA, 25 bp, Mus musculus
atcttcaatgctctgacagtctcta

SEQ ID NO: 882339 - DNA, 25 bp, Mus musculus
atcttcaatggtctgacagtctcta

SEQ ID NO: 882340 - DNA, 25 bp, Mus musculus
atcttcaatgtaattacacttgtga

SEQ ID NO: 882341 - DNA, 25 bp, Mus musculus
atcttcacactgcgtggcacccctt

SEQ ID NO: 882342 - DNA, 25 bp, Mus musculus
atcttcacactgggtggcacccctt

SEQ ID NO: 882343 - DNA, 25 bp, Mus musculus
atcttcactgggcccttcctcctag

SEQ ID NO: 882344 - DNA, 25 bp, Mus musculus
atcttcactggggccttcctcctag

SEQ ID NO: 882345 - DNA, 25 bp, Mus musculus
atcttcagagacaataaaatcgccg

SEQ ID NO: 882346 - DNA, 25 bp, Mus musculus
atcttcagagtcaataaaatcgccg

SEQ ID NO: 882347 - DNA, 25 bp, Mus musculus
atcttcatataccgttcctttagaa

SEQ ID NO: 882348 - DNA, 25 bp, Mus musculus
atcttcatatacggttcctttagaa

SEQ ID NO: 882349 - DNA, 25 bp, Mus musculus
atcttcatctgctgcgaccagagtg

SEQ ID NO: 882350 - DNA, 25 bp, Mus musculus
atcttcatctgctgggaccagagtg

SEQ ID NO: 882351 - DNA, 25 bp, Mus musculus
atcttcccacagctcggcgctcagt

SEQ ID NO: 882352 - DNA, 25 bp, Mus musculus
atcttcccacagctgggcgctcagt

SEQ ID NO: 882353 - DNA, 25 bp, Mus musculus
atcttcctagctctgttcggcttcg

SEQ ID NO: 882354 - DNA, 25 bp, Mus musculus
atcttcctagctgtgttcggcttcg

SEQ ID NO: 882355 - DNA, 25 bp, Mus musculus
atcttcctcaggaggtccctagtat

SEQ ID NO: 882356 - DNA, 25 bp, Mus musculus
atcttcctcaggtggtccctagtat

SEQ ID NO: 882357 - DNA, 25 bp, Mus musculus
atcttccttgactcctgcgccatga

SEQ ID NO: 882358 - DNA, 25 bp, Mus musculus
atcttccttgagactcctgcgccat

SEQ ID NO: 882359 - DNA, 25 bp, Mus musculus
atcttccttgtctcctgcgccatga

SEQ ID NO: 882360 - DNA, 25 bp, Mus musculus
atcttccttgtgactcctgcgccat

SEQ ID NO: 882361 - DNA, 25 bp, Mus musculus
atcttcgatgagcgcgccttctcca

SEQ ID NO: 882362 - DNA, 25 bp, Mus musculus
atcttcgatgagggcgccttctcca

SEQ ID NO: 882363 - DNA, 25 bp, Mus musculus
atcttcgcagttcacgttgctctca

SEQ ID NO: 882364 - DNA, 25 bp, Mus musculus
atcttcgcagttcaggttgctctca

SEQ ID NO: 882365 - DNA, 25 bp, Mus musculus
atcttcgccatacgtagcattgcca

SEQ ID NO: 882366 - DNA, 25 bp, Mus musculus
atcttcgccataggtagcattgcca

SEQ ID NO: 882367 - DNA, 25 bp, Mus musculus
atcttcgtactacaggctgctgtcc

SEQ ID NO: 882368 - DNA, 25 bp, Mus musculus
atcttcgtactacctcacttcatga

SEQ ID NO: 882369 - DNA, 25 bp, Mus musculus
atcttcgtactacctcctggacttc

SEQ ID NO: 882370 - DNA, 25 bp, Mus musculus
atcttcgtactagaggctgctgtcc

SEQ ID NO: 882371 - DNA, 25 bp, Mus musculus
atcttcgtactagctcacttcatga

SEQ ID NO: 882372 - DNA, 25 bp, Mus musculus
atcttcgtactagctcctggacttc

SEQ ID NO: 882373 - DNA, 25 bp, Mus musculus
atcttctaagcttttccattattat

SEQ ID NO: 882374 - DNA, 25 bp, Mus musculus
atcttctaaggttttccattattat

SEQ ID NO: 882375 - DNA, 25 bp, Mus musculus
atcttctatggacagaaacaacccg

SEQ ID NO: 882376 - DNA, 25 bp, Mus musculus
atcttctatggagagaaacaacccg

SEQ ID NO: 882377 - DNA, 25 bp, Mus musculus
atcttctccatgcacacccgctatg

SEQ ID NO: 882378 - DNA, 25 bp, Mus musculus
atcttctccatgcagacccgctatg

SEQ ID NO: 882379 - DNA, 25 bp, Mus musculus
atcttctcccagattacctccctag

SEQ ID NO: 882380 - DNA, 25 bp, Mus musculus
atcttctcccagcagatgagctgta

SEQ ID NO: 882381 - DNA, 25 bp, Mus musculus
atcttctcccaggagatgagctgta

SEQ ID NO: 882382 - DNA, 25 bp, Mus musculus
atcttctcccagtttacctccctag

SEQ ID NO: 882383 - DNA, 25 bp, Mus musculus
atcttctgatatgacgacccatcct

SEQ ID NO: 882384 - DNA, 25 bp, Mus musculus
atcttctgatatgaggacccatcct

SEQ ID NO: 882385 - DNA, 25 bp, Mus musculus
atcttctgccatacccgcaaaacag

SEQ ID NO: 882386 - DNA, 25 bp, Mus musculus
atcttctgccattcccgcaaaacag

SEQ ID NO: 882387 - DNA, 25 bp, Mus musculus
atcttctggagacaagtgtgctggt

SEQ ID NO: 882388 - DNA, 25 bp, Mus musculus
atcttctggagacggcatcatggct

SEQ ID NO: 882389 - DNA, 25 bp, Mus musculus
atcttctggagagaagtgtgctggt

SEQ ID NO: 882390 - DNA, 25 bp, Mus musculus
atcttctggagagggcatcatggct

SEQ ID NO: 882391 - DNA, 25 bp, Mus musculus
atcttgaaagcctcacccttgcttg

SEQ ID NO: 882392 - DNA, 25 bp, Mus musculus
atcttgaaaggctcacccttgcttg

SEQ ID NO: 882393 - DNA, 25 bp, Mus musculus
atcttgaagcagctggactccccta

SEQ ID NO: 882394 - DNA, 25 bp, Mus musculus
atcttgaagcaggtggactccccta

SEQ ID NO: 882395 - DNA, 25 bp, Mus musculus
atcttgacaaagaaatcgaccttcc

SEQ ID NO: 882396 - DNA, 25 bp, Mus musculus
atcttgacaaagtaatcgaccttcc

SEQ ID NO: 882397 - DNA, 25 bp, Mus musculus
atcttgactcggaggaagacgatga

SEQ ID NO: 882398 - DNA, 25 bp, Mus musculus
atcttgactcggaggacaccatgat

SEQ ID NO: 882399 - DNA, 25 bp, Mus musculus
atcttgactcggtggaagacgatga

SEQ ID NO: 882400 - DNA, 25 bp, Mus musculus
atcttgactcggtggacaccatgat

SEQ ID NO: 882401 - DNA, 25 bp, Mus musculus
atcttgatgaaacgagagatgtctt

SEQ ID NO: 882402 - DNA, 25 bp, Mus musculus
atcttgatgaaaggagagatgtctt

SEQ ID NO: 882403 - DNA, 25 bp, Mus musculus
atcttggaaatgcatgagacctcat

SEQ ID NO: 882404 - DNA, 25 bp, Mus musculus
atcttggaaatggatgagacctcat

SEQ ID NO: 882405 - DNA, 25 bp, Mus musculus
atcttggaagaatcagactttagca

SEQ ID NO: 882406 - DNA, 25 bp, Mus musculus
atcttggaagaatctgactttagca

SEQ ID NO: 882407 - DNA, 25 bp, Mus musculus
atcttggaatcctacgtcctgtcat

SEQ ID NO: 882408 - DNA, 25 bp, Mus musculus
atcttggaatcctaggtcctgtcat

SEQ ID NO: 882409 - DNA, 25 bp, Mus musculus
atcttggaccaccctatggttttgg

SEQ ID NO: 882410 - DNA, 25 bp, Mus musculus
atcttggaccacgctatggttttgg

SEQ ID NO: 882411 - DNA, 25 bp, Mus musculus
atcttggatgatctggacacagccg

SEQ ID NO: 882412 - DNA, 25 bp, Mus musculus
atcttggatgttctggacacagccg

SEQ ID NO: 882413 - DNA, 25 bp, Mus musculus
atcttggcctcactcggcacattcc

SEQ ID NO: 882414 - DNA, 25 bp, Mus musculus
atcttggcctcactgggcacattcc

SEQ ID NO: 882415 - DNA, 25 bp, Mus musculus
atcttggctataaaaaatgccaggc

SEQ ID NO: 882416 - DNA, 25 bp, Mus musculus
atcttggctatataaaatgccaggc

SEQ ID NO: 882417 - DNA, 25 bp, Mus musculus
atcttggggtgaagggttcagcatt

SEQ ID NO: 882418 - DNA, 25 bp, Mus musculus
atcttggggtgatgggttcagcatt

SEQ ID NO: 882419 - DNA, 25 bp, Mus musculus
atcttggtccagcatctttctcaag

SEQ ID NO: 882420 - DNA, 25 bp, Mus musculus
atcttggtccagctcatcccagtgg

SEQ ID NO: 882421 - DNA, 25 bp, Mus musculus
atcttggtccaggatctttctcaag

SEQ ID NO: 882422 - DNA, 25 bp, Mus musculus
atcttggtccaggtcatcccagtgg

SEQ ID NO: 882423 - DNA, 25 bp, Mus musculus
atcttgtaagcgtggggatgtcctt

SEQ ID NO: 882424 - DNA, 25 bp, Mus musculus
atcttgtaagggtggggatgtcctt

SEQ ID NO: 882425 - DNA, 25 bp, Mus musculus
atcttgtcctgtaacgtggtctgtg

SEQ ID NO: 882426 - DNA, 25 bp, Mus musculus
atcttgtcctgtaaggtggtctgtg

SEQ ID NO: 882427 - DNA, 25 bp, Mus musculus
atcttgtttgcactcatctgtttac

SEQ ID NO: 882428 - DNA, 25 bp, Mus musculus
atcttgtttgcactgatctgtttac

SEQ ID NO: 882429 - DNA, 25 bp, Mus musculus
atctttccaaaaccaactgctttgc

SEQ ID NO: 882430 - DNA, 25 bp, Mus musculus
atctttccaaaacctcctgggacct

SEQ ID NO: 882431 - DNA, 25 bp, Mus musculus
atctttccaaaagcaactgctttgc

SEQ ID NO: 882432 - DNA, 25 bp, Mus musculus
atctttccaaaagctcctgggacct

SEQ ID NO: 882433 - DNA, 25 bp, Mus musculus
atctttccagaacggaagcaaaagt

SEQ ID NO: 882434 - DNA, 25 bp, Mus musculus
atctttccagaagggaagcaaaagt

SEQ ID NO: 882435 - DNA, 25 bp, Mus musculus
atctttcccaggaccatagccagcc

SEQ ID NO: 882436 - DNA, 25 bp, Mus musculus
atctttcccaggaccgctactggca

SEQ ID NO: 882437 - DNA, 25 bp, Mus musculus
atctttcccaggacgatagccagcc

SEQ ID NO: 882438 - DNA, 25 bp, Mus musculus
atctttcccaggacggctactggca

SEQ ID NO: 882439 - DNA, 25 bp, Mus musculus
atctttcttggacagaaagcagcaa

SEQ ID NO: 882440 - DNA, 25 bp, Mus musculus
atctttcttggagagaaagcagcaa

SEQ ID NO: 882441 - DNA, 25 bp, Mus musculus
atctttgcagcttcctggtgtgctg

SEQ ID NO: 882442 - DNA, 25 bp, Mus musculus
atctttgcaggttcctggtgtgctg

SEQ ID NO: 882443 - DNA, 25 bp, Mus musculus
atctttgctgtgaaaaatgaaaaac

SEQ ID NO: 882444 - DNA, 25 bp, Mus musculus
atctttgctgtgtaaaatgaaaaac

SEQ ID NO: 882445 - DNA, 25 bp, Mus musculus
atctttggagaaaaatgtggaattg

SEQ ID NO: 882446 - DNA, 25 bp, Mus musculus
atctttggagaataatgtggaattg

SEQ ID NO: 882447 - DNA, 25 bp, Mus musculus
atctttggctggcgtctgccggctg

SEQ ID NO: 882448 - DNA, 25 bp, Mus musculus
atctttggctggggtctgccggctg

SEQ ID NO: 882449 - DNA, 25 bp, Mus musculus
atctttgtgcagagtgtcatgccat

SEQ ID NO: 882450 - DNA, 25 bp, Mus musculus
atctttgtgcagtgtgtcatgccat

SEQ ID NO: 882451 - DNA, 25 bp, Mus musculus
atctttgtgccacatcccaccatgg

SEQ ID NO: 882452 - DNA, 25 bp, Mus musculus
atctttgtgccagatcccaccatgg

SEQ ID NO: 882453 - DNA, 25 bp, Mus musculus
atctttgtggtgcgcggacctggct

SEQ ID NO: 882454 - DNA, 25 bp, Mus musculus
atctttgtggtgggcggacctggct

SEQ ID NO: 882455 - DNA, 25 bp, Mus musculus
atcttttcgcagaagccacagaaga

SEQ ID NO: 882456 - DNA, 25 bp, Mus musculus
atcttttcgcagtagccacagaaga

SEQ ID NO: 882457 - DNA, 25 bp, Mus musculus
atcttttctgcgcttgatccaaaag

SEQ ID NO: 882458 - DNA, 25 bp, Mus musculus
atcttttctgcggttgatccaaaag

SEQ ID NO: 882459 - DNA, 25 bp, Mus musculus
atgaaaaaacagaagtgagctctgg

SEQ ID NO: 882460 - DNA, 25 bp, Mus musculus
atgaaaaaactgaagtgagctctgg

SEQ ID NO: 882461 - DNA, 25 bp, Mus musculus
atgaaaaaggcggccacattatctt

SEQ ID NO: 882462 - DNA, 25 bp, Mus musculus
atgaaaaagggggccacattatctt

SEQ ID NO: 882463 - DNA, 25 bp, Mus musculus
atgaaaacccagagagatgagtcag

SEQ ID NO: 882464 - DNA, 25 bp, Mus musculus
atgaaaacccagtgagatgagtcag

SEQ ID NO: 882465 - DNA, 25 bp, Mus musculus
atgaaaactgagggagatgagacag

SEQ ID NO: 882466 - DNA, 25 bp, Mus musculus
atgaaaactgtgggagatgagacag

SEQ ID NO: 882467 - DNA, 25 bp, Mus musculus
atgaaaagatgcctcgacaaaaaca

SEQ ID NO: 882468 - DNA, 25 bp, Mus musculus
atgaaaagatgcctggacaaaaaca

SEQ ID NO: 882469 - DNA, 25 bp, Mus musculus
atgaaacaaactgctgctgcttctt

SEQ ID NO: 882470 - DNA, 25 bp, Mus musculus
atgaaacaaagtgctgctgcttctt

SEQ ID NO: 882471 - DNA, 25 bp, Mus musculus
atgaaacaactgcacttgctcttgc

SEQ ID NO: 882472 - DNA, 25 bp, Mus musculus
atgaaacaactgcagttgctcttgc

SEQ ID NO: 882473 - DNA, 25 bp, Mus musculus
atgaaacaagccgactgctggatac

SEQ ID NO: 882474 - DNA, 25 bp, Mus musculus
atgaaacaaggcgactgctggatac

SEQ ID NO: 882475 - DNA, 25 bp, Mus musculus
atgaaacacgaaaaagtgattggtc

SEQ ID NO: 882476 - DNA, 25 bp, Mus musculus
atgaaacacgaaaatgtgattggtc

SEQ ID NO: 882477 - DNA, 25 bp, Mus musculus
atgaaacagctgaacgatgctattg

SEQ ID NO: 882478 - DNA, 25 bp, Mus musculus
atgaaacagctgaaggatgctattg

SEQ ID NO: 882479 - DNA, 25 bp, Mus musculus
atgaaaccatggcaagatctccaag

SEQ ID NO: 882480 - DNA, 25 bp, Mus musculus
atgaaaccatggcatgatctccaag

SEQ ID NO: 882481 - DNA, 25 bp, Mus musculus
atgaaagaggctgtcgatgaagatg

SEQ ID NO: 882482 - DNA, 25 bp, Mus musculus
atgaaagaggctgtggatgaagatg

SEQ ID NO: 882483 - DNA, 25 bp, Mus musculus
atgaaagcagaggtccatgccgtgg

SEQ ID NO: 882484 - DNA, 25 bp, Mus musculus
atgaaagcagccatgtactcggtgg

SEQ ID NO: 882485 - DNA, 25 bp, Mus musculus
atgaaagcagcgcttacatacctag

SEQ ID NO: 882486 - DNA, 25 bp, Mus musculus
atgaaagcaggcatgtactcggtgg

SEQ ID NO: 882487 - DNA, 25 bp, Mus musculus
atgaaagcagggcttacatacctag

SEQ ID NO: 882488 - DNA, 25 bp, Mus musculus
atgaaagcagtggtccatgccgtgg

SEQ ID NO: 882489 - DNA, 25 bp, Mus musculus
atgaaaggagacagcggtgtatttg

SEQ ID NO: 882490 - DNA, 25 bp, Mus musculus
atgaaaggagacaggggtgtatttg

SEQ ID NO: 882491 - DNA, 25 bp, Mus musculus
atgaaaggcacaaacttggtacatt

SEQ ID NO: 882492 - DNA, 25 bp, Mus musculus
atgaaaggcacatacttggtacatt

SEQ ID NO: 882493 - DNA, 25 bp, Mus musculus
atgaaaggcctccgtactgatgaag

SEQ ID NO: 882494 - DNA, 25 bp, Mus musculus
atgaaaggcctcggtactgatgaag

SEQ ID NO: 882495 - DNA, 25 bp, Mus musculus
atgaaaggcgagatttatgtcattg

SEQ ID NO: 882496 - DNA, 25 bp, Mus musculus
atgaaaggcgagttttatgtcattg

SEQ ID NO: 882497 - DNA, 25 bp, Mus musculus
atgaaagggggccacgatgacgatg

SEQ ID NO: 882498 - DNA, 25 bp, Mus musculus
atgaaagggggccaggatgacgatg

SEQ ID NO: 882499 - DNA, 25 bp, Mus musculus
atgaaaggtaaaaaccttggctcat

SEQ ID NO: 882500 - DNA, 25 bp, Mus musculus
atgaaaggtaaaaagcttggctcat

SEQ ID NO: 882501 - DNA, 25 bp, Mus musculus
atgaaaggtatcccagtacagcttc

SEQ ID NO: 882502 - DNA, 25 bp, Mus musculus
atgaaaggtatccctgtacagcttc

SEQ ID NO: 882503 - DNA, 25 bp, Mus musculus
atgaaagtggctcactggttgattc

SEQ ID NO: 882504 - DNA, 25 bp, Mus musculus
atgaaagtggctcagtggttgattc

SEQ ID NO: 882505 - DNA, 25 bp, Mus musculus
atgaaatatttactttatccttatg

SEQ ID NO: 882506 - DNA, 25 bp, Mus musculus
atgaaatatttagtttatccttatg

SEQ ID NO: 882507 - DNA, 25 bp, Mus musculus
atgaaatcacagaactagacaccct

SEQ ID NO: 882508 - DNA, 25 bp, Mus musculus
atgaaatcacagtactagacaccct

SEQ ID NO: 882509 - DNA, 25 bp, Mus musculus
atgaaatccaacaatatatttctcc

SEQ ID NO: 882510 - DNA, 25 bp, Mus musculus
atgaaatccaactatatatttctcc

SEQ ID NO: 882511 - DNA, 25 bp, Mus musculus
atgaaatgatagcatcgacatccac

SEQ ID NO: 882512 - DNA, 25 bp, Mus musculus
atgaaatgattgcatcgacatccac

SEQ ID NO: 882513 - DNA, 25 bp, Mus musculus
atgaaattgatgaggctcgtgtgaa

SEQ ID NO: 882514 - DNA, 25 bp, Mus musculus
atgaaattgatgagtgtgcaaatga

SEQ ID NO: 882515 - DNA, 25 bp, Mus musculus
atgaaattgatgtggctcgtgtgaa

SEQ ID NO: 882516 - DNA, 25 bp, Mus musculus
atgaaattgatgtgtgtgcaaatga

SEQ ID NO: 882517 - DNA, 25 bp, Mus musculus
atgaacaagaggcacatgggcatat

SEQ ID NO: 882518 - DNA, 25 bp, Mus musculus
atgaacaagaggcacctgtactacc

SEQ ID NO: 882519 - DNA, 25 bp, Mus musculus
atgaacaagaggcagatgggcatat

SEQ ID NO: 882520 - DNA, 25 bp, Mus musculus
atgaacaagaggcagctgtactacc

SEQ ID NO: 882521 - DNA, 25 bp, Mus musculus
atgaacaatgtacatggtgtgcaga

SEQ ID NO: 882522 - DNA, 25 bp, Mus musculus
atgaacaatgtagatggtgtgcaga

SEQ ID NO: 882523 - DNA, 25 bp, Mus musculus
atgaacaatttccacgtcatgagca

SEQ ID NO: 882524 - DNA, 25 bp, Mus musculus
atgaacaatttccaggtcatgagca

SEQ ID NO: 882525 - DNA, 25 bp, Mus musculus
atgaacacacagaatggcttagaaa

SEQ ID NO: 882526 - DNA, 25 bp, Mus musculus
atgaacacacagtatggcttagaaa

SEQ ID NO: 882527 - DNA, 25 bp, Mus musculus
atgaacagcaaacgtcaatatccaa

SEQ ID NO: 882528 - DNA, 25 bp, Mus musculus
atgaacagcaaaggtcaatatccaa

SEQ ID NO: 882529 - DNA, 25 bp, Mus musculus
atgaacatagccccttctgagttag

SEQ ID NO: 882530 - DNA, 25 bp, Mus musculus
atgaacataggcccttctgagttag

SEQ ID NO: 882531 - DNA, 25 bp, Mus musculus
atgaacatttaacagtgaatgccat

SEQ ID NO: 882532 - DNA, 25 bp, Mus musculus
atgaacatttaacgcaattctgcct

SEQ ID NO: 882533 - DNA, 25 bp, Mus musculus
atgaacatttaagagtgaatgccat

SEQ ID NO: 882534 - DNA, 25 bp, Mus musculus
atgaacatttaaggcaattctgcct

SEQ ID NO: 882535 - DNA, 25 bp, Mus musculus
atgaacccaatgcttatgatgatgg

SEQ ID NO: 882536 - DNA, 25 bp, Mus musculus
atgaacccaatggttatgatgatgg

SEQ ID NO: 882537 - DNA, 25 bp, Mus musculus
atgaaccctgaacggagcctctgat

SEQ ID NO: 882538 - DNA, 25 bp, Mus musculus
atgaaccctgaagggagcctctgat

SEQ ID NO: 882539 - DNA, 25 bp, Mus musculus
atgaacgagcaggacgtactaaatg

SEQ ID NO: 882540 - DNA, 25 bp, Mus musculus
atgaacgagcaggaggtactaaatg

SEQ ID NO: 882541 - DNA, 25 bp, Mus musculus
atgaactcaatccggacaaacctga

SEQ ID NO: 882542 - DNA, 25 bp, Mus musculus
atgaactcaatcgggacaaacctga

SEQ ID NO: 882543 - DNA, 25 bp, Mus musculus
atgaactgcattcagatgggcggga

SEQ ID NO: 882544 - DNA, 25 bp, Mus musculus
atgaactgcattgagatgggcggga

SEQ ID NO: 882545 - DNA, 25 bp, Mus musculus
atgaactgcgcacgttacatccagg

SEQ ID NO: 882546 - DNA, 25 bp, Mus musculus
atgaactgcgcaggttacatccagg

SEQ ID NO: 882547 - DNA, 25 bp, Mus musculus
atgaactggaagaacgggaaagcta

SEQ ID NO: 882548 - DNA, 25 bp, Mus musculus
atgaactggaagaaggggaaagcta

SEQ ID NO: 882549 - DNA, 25 bp, Mus musculus
atgaactgtcagatgtccaacatca

SEQ ID NO: 882550 - DNA, 25 bp, Mus musculus
atgaactgtcagttgtccaacatca

SEQ ID NO: 882551 - DNA, 25 bp, Mus musculus
atgaacttaaagctgacaacatgta

SEQ ID NO: 882552 - DNA, 25 bp, Mus musculus
atgaacttaaaggtgacaacatgta

SEQ ID NO: 882553 - DNA, 25 bp, Mus musculus
atgaagaaaactgtcgcaacataac

SEQ ID NO: 882554 - DNA, 25 bp, Mus musculus
atgaagaaaactgtggcaacataac

SEQ ID NO: 882555 - DNA, 25 bp, Mus musculus
atgaagaaagcagccagttatctgc

SEQ ID NO: 882556 - DNA, 25 bp, Mus musculus
atgaagaaagcgtccatcttcaggg

SEQ ID NO: 882557 - DNA, 25 bp, Mus musculus
atgaagaaaggagccagttatctgc

SEQ ID NO: 882558 - DNA, 25 bp, Mus musculus
atgaagaaagggtccatcttcaggg

SEQ ID NO: 882559 - DNA, 25 bp, Mus musculus
atgaagaacgagaaagtcatgccct

SEQ ID NO: 882560 - DNA, 25 bp, Mus musculus
atgaagaacgtgaaagtcatgccct

SEQ ID NO: 882561 - DNA, 25 bp, Mus musculus
atgaagaccccgcgtcttgttgcag

SEQ ID NO: 882562 - DNA, 25 bp, Mus musculus
atgaagaccccgggtcttgttgcag

SEQ ID NO: 882563 - DNA, 25 bp, Mus musculus
atgaagactgtgcaagtgctccaag

SEQ ID NO: 882564 - DNA, 25 bp, Mus musculus
atgaagactgtgcatgtgctccaag

SEQ ID NO: 882565 - DNA, 25 bp, Mus musculus
atgaagagagatacaactcagtgct

SEQ ID NO: 882566 - DNA, 25 bp, Mus musculus
atgaagagagttacaactcagtgct

SEQ ID NO: 882567 - DNA, 25 bp, Mus musculus
atgaagagattcaaagcagaatacc

SEQ ID NO: 882568 - DNA, 25 bp, Mus musculus
atgaagagattcaatgcagaatacc

SEQ ID NO: 882569 - DNA, 25 bp, Mus musculus
atgaagagccagaacaaacctcaga

SEQ ID NO: 882570 - DNA, 25 bp, Mus musculus
atgaagagccagaagaaacctcaga

SEQ ID NO: 882571 - DNA, 25 bp, Mus musculus
atgaagagggcaaaaatggttatgt

SEQ ID NO: 882572 - DNA, 25 bp, Mus musculus
atgaagagggcaaatatggttatgt

SEQ ID NO: 882573 - DNA, 25 bp, Mus musculus
atgaagataaaccaccaaacaccaa

SEQ ID NO: 882574 - DNA, 25 bp, Mus musculus
atgaagataaacgaccaaacaccaa

SEQ ID NO: 882575 - DNA, 25 bp, Mus musculus
atgaagataacctaagtaccagcag

SEQ ID NO: 882576 - DNA, 25 bp, Mus musculus
atgaagataacctatgtaccagcag

SEQ ID NO: 882577 - DNA, 25 bp, Mus musculus
atgaagatcagacgaaacatccaca

SEQ ID NO: 882578 - DNA, 25 bp, Mus musculus
atgaagatcagaggaaacatccaca

SEQ ID NO: 882579 - DNA, 25 bp, Mus musculus
atgaagatgataacacctgctctca

SEQ ID NO: 882580 - DNA, 25 bp, Mus musculus
atgaagatgataactcctgctctca

SEQ ID NO: 882581 - DNA, 25 bp, Mus musculus
atgaagatgctgcacgcaccagaaa

SEQ ID NO: 882582 - DNA, 25 bp, Mus musculus
atgaagatgctgcacgtctgggaag

SEQ ID NO: 882583 - DNA, 25 bp, Mus musculus
atgaagatgctgcaggcaccagaaa

SEQ ID NO: 882584 - DNA, 25 bp, Mus musculus
atgaagatgctgcaggtctgggaag

SEQ ID NO: 882585 - DNA, 25 bp, Mus musculus
atgaagatggagcataccataaagg

SEQ ID NO: 882586 - DNA, 25 bp, Mus musculus
atgaagatggaggataccataaagg

SEQ ID NO: 882587 - DNA, 25 bp, Mus musculus
atgaagcagacaccatgacggacgg

SEQ ID NO: 882588 - DNA, 25 bp, Mus musculus
atgaagcagacagcatgacggacgg

SEQ ID NO: 882589 - DNA, 25 bp, Mus musculus
atgaagcataagcgctttgccttcg

SEQ ID NO: 882590 - DNA, 25 bp, Mus musculus
atgaagcataagggctttgccttcg

SEQ ID NO: 882591 - DNA, 25 bp, Mus musculus
atgaagcatgcgcatccccggatcc

SEQ ID NO: 882592 - DNA, 25 bp, Mus musculus
atgaagcatgcgctttctgatgtct

SEQ ID NO: 882593 - DNA, 25 bp, Mus musculus
atgaagcatgcggatccccggatcc

SEQ ID NO: 882594 - DNA, 25 bp, Mus musculus
atgaagcatgcggtttctgatgtct

SEQ ID NO: 882595 - DNA, 25 bp, Mus musculus
atgaagcccgagatctgcggcagga

SEQ ID NO: 882596 - DNA, 25 bp, Mus musculus
atgaagcccgagttctgcggcagga

SEQ ID NO: 882597 - DNA, 25 bp, Mus musculus
atgaagcgggaacctgtgcaggagg

SEQ ID NO: 882598 - DNA, 25 bp, Mus musculus
atgaagcgggaagctgtgcaggagg

SEQ ID NO: 882599 - DNA, 25 bp, Mus musculus
atgaagctccatggcgttcccaggc

SEQ ID NO: 882600 - DNA, 25 bp, Mus musculus
atgaagctccatggggttcccaggc

SEQ ID NO: 882601 - DNA, 25 bp, Mus musculus
atgaaggaatgtattgcccagctac

SEQ ID NO: 882602 - DNA, 25 bp, Mus musculus
atgaaggaatgttttgcccagctac

SEQ ID NO: 882603 - DNA, 25 bp, Mus musculus
atgaaggatcagcatgacgatgctg

SEQ ID NO: 882604 - DNA, 25 bp, Mus musculus
atgaaggatcagccccttaaggatg

SEQ ID NO: 882605 - DNA, 25 bp, Mus musculus
atgaaggatcaggatgacgatgctg

SEQ ID NO: 882606 - DNA, 25 bp, Mus musculus
atgaaggatcaggcccttaaggatg

SEQ ID NO: 882607 - DNA, 25 bp, Mus musculus
atgaaggccccgcgccgccttctgc

SEQ ID NO: 882608 - DNA, 25 bp, Mus musculus
atgaaggccccgggccgccttctgc

SEQ ID NO: 882609 - DNA, 25 bp, Mus musculus
atgaaggcgtggcaacatacgcagc

SEQ ID NO: 882610 - DNA, 25 bp, Mus musculus
atgaaggcgtgggaacatacgcagc

SEQ ID NO: 882611 - DNA, 25 bp, Mus musculus
atgaaggtagaacgacatgtcttcc

SEQ ID NO: 882612 - DNA, 25 bp, Mus musculus
atgaaggtagaaggacatgtcttcc

SEQ ID NO: 882613 - DNA, 25 bp, Mus musculus
atgaaggtcgatgtcggcccagacc

SEQ ID NO: 882614 - DNA, 25 bp, Mus musculus
atgaaggtcgatgtgggcccagacc

SEQ ID NO: 882615 - DNA, 25 bp, Mus musculus
atgaaggtgccgcttttggcacgtg

SEQ ID NO: 882616 - DNA, 25 bp, Mus musculus
atgaaggtgccggttttggcacgtg

SEQ ID NO: 882617 - DNA, 25 bp, Mus musculus
atgaaggttcatctctcccttctca

SEQ ID NO: 882618 - DNA, 25 bp, Mus musculus
atgaaggttcatgtctcccttctca

SEQ ID NO: 882619 - DNA, 25 bp, Mus musculus
atgaagtacctgaacgtgctggcca

SEQ ID NO: 882620 - DNA, 25 bp, Mus musculus
atgaagtacctgtacgtgctggcca

SEQ ID NO: 882621 - DNA, 25 bp, Mus musculus
atgaagtagagccaccaagtccaca

SEQ ID NO: 882622 - DNA, 25 bp, Mus musculus
atgaagtagagccacgcttgccatc

SEQ ID NO: 882623 - DNA, 25 bp, Mus musculus
atgaagtagagccagcaagtccaca

SEQ ID NO: 882624 - DNA, 25 bp, Mus musculus
atgaagtagagccaggcttgccatc

SEQ ID NO: 882625 - DNA, 25 bp, Mus musculus
atgaagtcccagaggccagtgaaga

SEQ ID NO: 882626 - DNA, 25 bp, Mus musculus
atgaagtcccagtggccagtgaaga

SEQ ID NO: 882627 - DNA, 25 bp, Mus musculus
atgaagtttgtcccttccaaccaga

SEQ ID NO: 882628 - DNA, 25 bp, Mus musculus
atgaagtttgtcgcttccaaccaga

SEQ ID NO: 882629 - DNA, 25 bp, Mus musculus
atgaataagcagatccgggcttgca

SEQ ID NO: 882630 - DNA, 25 bp, Mus musculus
atgaataagcagttccgggcttgca

SEQ ID NO: 882631 - DNA, 25 bp, Mus musculus
atgaatacagcagtggaggctggag

SEQ ID NO: 882632 - DNA, 25 bp, Mus musculus
atgaatacaggagtggaggctggag

SEQ ID NO: 882633 - DNA, 25 bp, Mus musculus
atgaatatagatttttaaataatac

SEQ ID NO: 882634 - DNA, 25 bp, Mus musculus
atgaatatagttttttaaataatac

SEQ ID NO: 882635 - DNA, 25 bp, Mus musculus
atgaatatccagagactaagtctgg

SEQ ID NO: 882636 - DNA, 25 bp, Mus musculus
atgaatatccagtgactaagtctgg

SEQ ID NO: 882637 - DNA, 25 bp, Mus musculus
atgaatatgaagatgttgtagaaga

SEQ ID NO: 882638 - DNA, 25 bp, Mus musculus
atgaatatgaagttgttgtagaaga

SEQ ID NO: 882639 - DNA, 25 bp, Mus musculus
atgaatattgagttagaacacattg

SEQ ID NO: 882640 - DNA, 25 bp, Mus musculus
atgaatattgtgttagaacacattg

SEQ ID NO: 882641 - DNA, 25 bp, Mus musculus
atgaatcagcacatcctcatattca

SEQ ID NO: 882642 - DNA, 25 bp, Mus musculus
atgaatcagcacttcctcatattca

SEQ ID NO: 882643 - DNA, 25 bp, Mus musculus
atgaatcttcagcggctggctgtgg

SEQ ID NO: 882644 - DNA, 25 bp, Mus musculus
atgaatcttcaggggctggctgtgg

SEQ ID NO: 882645 - DNA, 25 bp, Mus musculus
atgaatgaaactgacgctcatgctt

SEQ ID NO: 882646 - DNA, 25 bp, Mus musculus
atgaatgaaagtgacgctcatgctt

SEQ ID NO: 882647 - DNA, 25 bp, Mus musculus
atgaatgaacttcggggactgcagg

SEQ ID NO: 882648 - DNA, 25 bp, Mus musculus
atgaatgaacttgggggactgcagg

SEQ ID NO: 882649 - DNA, 25 bp, Mus musculus
atgaatgacgaataggtgaagggaa

SEQ ID NO: 882650 - DNA, 25 bp, Mus musculus
atgaatgacgtataggtgaagggaa

SEQ ID NO: 882651 - DNA, 25 bp, Mus musculus
atgaatgtactgaacgatttctggt

SEQ ID NO: 882652 - DNA, 25 bp, Mus musculus
atgaatgtactgaaggatttctggt

SEQ ID NO: 882653 - DNA, 25 bp, Mus musculus
atgaattagttccagatgaccttgg

SEQ ID NO: 882654 - DNA, 25 bp, Mus musculus
atgaattagttcgagatgaccttgg

SEQ ID NO: 882655 - DNA, 25 bp, Mus musculus
atgaattatgagcacgatcagtatg

SEQ ID NO: 882656 - DNA, 25 bp, Mus musculus
atgaattatgagcaggatcagtatg

SEQ ID NO: 882657 - DNA, 25 bp, Mus musculus
atgaattcagcgatgacctggatgg

SEQ ID NO: 882658 - DNA, 25 bp, Mus musculus
atgaattcagggatgacctggatgg

SEQ ID NO: 882659 - DNA, 25 bp, Mus musculus
atgaatttcagacggccttcagcgg

SEQ ID NO: 882660 - DNA, 25 bp, Mus musculus
atgaatttcagagggccttcagcgg

SEQ ID NO: 882661 - DNA, 25 bp, Mus musculus
atgacaaaagcctgcagcaagaaac

SEQ ID NO: 882662 - DNA, 25 bp, Mus musculus
atgacaaaaggctgcagcaagaaac

SEQ ID NO: 882663 - DNA, 25 bp, Mus musculus
atgacaaacaattttcagtatggtc

SEQ ID NO: 882664 - DNA, 25 bp, Mus musculus
atgacaaacatttttcagtatggtc

SEQ ID NO: 882665 - DNA, 25 bp, Mus musculus
atgacaacattacacgcacgtccac

SEQ ID NO: 882666 - DNA, 25 bp, Mus musculus
atgacaacattacaggcacgtccac

SEQ ID NO: 882667 - DNA, 25 bp, Mus musculus
atgacaaccaggctggtgcccccaa

SEQ ID NO: 882668 - DNA, 25 bp, Mus musculus
atgacaaccagggtggtgcccccaa

SEQ ID NO: 882669 - DNA, 25 bp, Mus musculus
atgacaactgatggctggctctcac

SEQ ID NO: 882670 - DNA, 25 bp, Mus musculus
atgacaactgttggctggctctcac

SEQ ID NO: 882671 - DNA, 25 bp, Mus musculus
atgacaagaaagcaattgtggacca

SEQ ID NO: 882672 - DNA, 25 bp, Mus musculus
atgacaagaaaggaattgtggacca

SEQ ID NO: 882673 - DNA, 25 bp, Mus musculus
atgacaagctcattcttcagtttgg

SEQ ID NO: 882674 - DNA, 25 bp, Mus musculus
atgacaagctcattgttcagtttgg

SEQ ID NO: 882675 - DNA, 25 bp, Mus musculus
atgacacagaagactttgttgctgg

SEQ ID NO: 882676 - DNA, 25 bp, Mus musculus
atgacacagaagtctttgttgctgg

SEQ ID NO: 882677 - DNA, 25 bp, Mus musculus
atgacacagtacagggacatacatc

SEQ ID NO: 882678 - DNA, 25 bp, Mus musculus
atgacacagttcagggacatacatc

SEQ ID NO: 882679 - DNA, 25 bp, Mus musculus
atgacacataatctggacgattgtg

SEQ ID NO: 882680 - DNA, 25 bp, Mus musculus
atgacacataatgtggacgattgtg

SEQ ID NO: 882681 - DNA, 25 bp, Mus musculus
atgacaccacctgtcctgtgtgccg

SEQ ID NO: 882682 - DNA, 25 bp, Mus musculus
atgacaccacgtgtcctgtgtgccg

SEQ ID NO: 882683 - DNA, 25 bp, Mus musculus
atgacaccagcacttcctccatcag

SEQ ID NO: 882684 - DNA, 25 bp, Mus musculus
atgacaccaggacttcctccatcag

SEQ ID NO: 882685 - DNA, 25 bp, Mus musculus
atgacacctgagcatttgacggcca

SEQ ID NO: 882686 - DNA, 25 bp, Mus musculus
atgacacctgaggatttgacggcca

SEQ ID NO: 882687 - DNA, 25 bp, Mus musculus
atgacactaaacatggagtggatgc

SEQ ID NO: 882688 - DNA, 25 bp, Mus musculus
atgacactaatcatggagtggatgc

SEQ ID NO: 882689 - DNA, 25 bp, Mus musculus
atgacagatcagcaccaagatggtt

SEQ ID NO: 882690 - DNA, 25 bp, Mus musculus
atgacagatcaggaccaagatggtt

SEQ ID NO: 882691 - DNA, 25 bp, Mus musculus
atgacagcagagcaaatggctagtg

SEQ ID NO: 882692 - DNA, 25 bp, Mus musculus
atgacagcagaggaaatggctagtg

SEQ ID NO: 882693 - DNA, 25 bp, Mus musculus
atgacagctacttgcgatactctgt

SEQ ID NO: 882694 - DNA, 25 bp, Mus musculus
atgacagctacttgggatactctgt

SEQ ID NO: 882695 - DNA, 25 bp, Mus musculus
atgacagctatgaccccagtgacct

SEQ ID NO: 882696 - DNA, 25 bp, Mus musculus
atgacagctatgtccccagtgacct

SEQ ID NO: 882697 - DNA, 25 bp, Mus musculus
atgacagtgaagcgccagaatgaag

SEQ ID NO: 882698 - DNA, 25 bp, Mus musculus
atgacagtgaagggccagaatgaag

SEQ ID NO: 882699 - DNA, 25 bp, Mus musculus
atgacatcaccacccgagaaacctg

SEQ ID NO: 882700 - DNA, 25 bp, Mus musculus
atgacatcaccagccgagaaacctg

SEQ ID NO: 882701 - DNA, 25 bp, Mus musculus
atgacatccggacacccagcgatgg

SEQ ID NO: 882702 - DNA, 25 bp, Mus musculus
atgacatccggacacgctgacgatg

SEQ ID NO: 882703 - DNA, 25 bp, Mus musculus
atgacatccggacagccagcgatgg

SEQ ID NO: 882704 - DNA, 25 bp, Mus musculus
atgacatccggacaggctgacgatg

SEQ ID NO: 882705 - DNA, 25 bp, Mus musculus
atgacattgcagctctaccaatgga

SEQ ID NO: 882706 - DNA, 25 bp, Mus musculus
atgacattgcaggtctaccaatgga

SEQ ID NO: 882707 - DNA, 25 bp, Mus musculus
atgacatttaaaacagttgccatcc

SEQ ID NO: 882708 - DNA, 25 bp, Mus musculus
atgacatttaaaactgttgccatcc

SEQ ID NO: 882709 - DNA, 25 bp, Mus musculus
atgaccaaagccttggacaccaaac

SEQ ID NO: 882710 - DNA, 25 bp, Mus musculus
atgaccaaaggcttggacaccaaac

SEQ ID NO: 882711 - DNA, 25 bp, Mus musculus
atgaccaaccagaacagtattctct

SEQ ID NO: 882712 - DNA, 25 bp, Mus musculus
atgaccaaccagaattctcttcaag

SEQ ID NO: 882713 - DNA, 25 bp, Mus musculus
atgaccaaccagtacagtattctct

SEQ ID NO: 882714 - DNA, 25 bp, Mus musculus
atgaccaaccagtattctcttcaag

SEQ ID NO: 882715 - DNA, 25 bp, Mus musculus
atgaccaaggagaacgagttctttg

SEQ ID NO: 882716 - DNA, 25 bp, Mus musculus
atgaccaaggagaaggagttctttg

SEQ ID NO: 882717 - DNA, 25 bp, Mus musculus
atgaccaagttacacgaggcagtga

SEQ ID NO: 882718 - DNA, 25 bp, Mus musculus
atgaccaagttacacgtctcctgtt

SEQ ID NO: 882719 - DNA, 25 bp, Mus musculus
atgaccaagttacaggaggcagtga

SEQ ID NO: 882720 - DNA, 25 bp, Mus musculus
atgaccaagttacaggtctcctgtt

SEQ ID NO: 882721 - DNA, 25 bp, Mus musculus
atgaccacaactatacgcccacgcc

SEQ ID NO: 882722 - DNA, 25 bp, Mus musculus
atgaccacaagtatacgcccacgcc

SEQ ID NO: 882723 - DNA, 25 bp, Mus musculus
atgaccacacaacgcttcctgaatt

SEQ ID NO: 882724 - DNA, 25 bp, Mus musculus
atgaccacacaaggcttcctgaatt

SEQ ID NO: 882725 - DNA, 25 bp, Mus musculus
atgaccagagagtgatgtggagaga

SEQ ID NO: 882726 - DNA, 25 bp, Mus musculus
atgaccagagccccgggcctctggc

SEQ ID NO: 882727 - DNA, 25 bp, Mus musculus
atgaccagaggcccgggcctctggc

SEQ ID NO: 882728 - DNA, 25 bp, Mus musculus
atgaccagagtgtgatgtggagaga

SEQ ID NO: 882729 - DNA, 25 bp, Mus musculus
atgaccagctaacgtttgcagccag

SEQ ID NO: 882730 - DNA, 25 bp, Mus musculus
atgaccagctaaggtttgcagccag

SEQ ID NO: 882731 - DNA, 25 bp, Mus musculus
atgaccaggtttcacgcccacccag

SEQ ID NO: 882732 - DNA, 25 bp, Mus musculus
atgaccaggtttcaggcccacccag

SEQ ID NO: 882733 - DNA, 25 bp, Mus musculus
atgaccagtgacgttaggagaggag

SEQ ID NO: 882734 - DNA, 25 bp, Mus musculus
atgaccagtgatcggcgccagtggt

SEQ ID NO: 882735 - DNA, 25 bp, Mus musculus
atgaccagtgtcgttaggagaggag

SEQ ID NO: 882736 - DNA, 25 bp, Mus musculus
atgaccagtgttcggcgccagtggt

SEQ ID NO: 882737 - DNA, 25 bp, Mus musculus
atgaccatacagatcatgtcatcag

SEQ ID NO: 882738 - DNA, 25 bp, Mus musculus
atgaccatacagttcatgtcatcag

SEQ ID NO: 882739 - DNA, 25 bp, Mus musculus
atgaccattagtatagcaagaagcc

SEQ ID NO: 882740 - DNA, 25 bp, Mus musculus
atgaccattagtattgcaagaagcc

SEQ ID NO: 882741 - DNA, 25 bp, Mus musculus
atgacccagagacacgtgtattcac

SEQ ID NO: 882742 - DNA, 25 bp, Mus musculus
atgacccagagacaggtgtattcac

SEQ ID NO: 882743 - DNA, 25 bp, Mus musculus
atgaccccaccattcaagatgctta

SEQ ID NO: 882744 - DNA, 25 bp, Mus musculus
atgaccccaccattgaagatgctta

SEQ ID NO: 882745 - DNA, 25 bp, Mus musculus
atgaccccagagaccgtctggttcc

SEQ ID NO: 882746 - DNA, 25 bp, Mus musculus
atgaccccagtgaccgtctggttcc

SEQ ID NO: 882747 - DNA, 25 bp, Mus musculus
atgacccctgcgaggcggtgctggt

SEQ ID NO: 882748 - DNA, 25 bp, Mus musculus
atgacccctgcgtggcggtgctggt

SEQ ID NO: 882749 - DNA, 25 bp, Mus musculus
atgaccctagagtattatacgtgtc

SEQ ID NO: 882750 - DNA, 25 bp, Mus musculus
atgaccctagcttaagtatacctgg

SEQ ID NO: 882751 - DNA, 25 bp, Mus musculus
atgaccctagcttatgtatacctgg

SEQ ID NO: 882752 - DNA, 25 bp, Mus musculus
atgaccctagtgtattatacgtgtc

SEQ ID NO: 882753 - DNA, 25 bp, Mus musculus
atgaccctgaaaataaaaatgatcc

SEQ ID NO: 882754 - DNA, 25 bp, Mus musculus
atgaccctgaaattaaaaatgatcc

SEQ ID NO: 882755 - DNA, 25 bp, Mus musculus
atgaccctgacatcgtagctttcag

SEQ ID NO: 882756 - DNA, 25 bp, Mus musculus
atgaccctgagatcgtagctttcag

SEQ ID NO: 882757 - DNA, 25 bp, Mus musculus
atgaccgtgccgaacgtgctggcca

SEQ ID NO: 882758 - DNA, 25 bp, Mus musculus
atgaccgtgccgtacgtgctggcca

SEQ ID NO: 882759 - DNA, 25 bp, Mus musculus
atgacctccaagcgcccaatgtaaa

SEQ ID NO: 882760 - DNA, 25 bp, Mus musculus
atgacctccaagggcccaatgtaaa

SEQ ID NO: 882761 - DNA, 25 bp, Mus musculus
atgacctccgcttggcccagcacat

SEQ ID NO: 882762 - DNA, 25 bp, Mus musculus
atgacctccggttggcccagcacat

SEQ ID NO: 882763 - DNA, 25 bp, Mus musculus
atgacctgatagcacctgtgagtac

SEQ ID NO: 882764 - DNA, 25 bp, Mus musculus
atgacctgatagcagctgtgagtac

SEQ ID NO: 882765 - DNA, 25 bp, Mus musculus
atgacctgcttgcccattcaaatat

SEQ ID NO: 882766 - DNA, 25 bp, Mus musculus
atgacctgcttggccattcaaatat

SEQ ID NO: 882767 - DNA, 25 bp, Mus musculus
atgacctggaagacgagctctatgc

SEQ ID NO: 882768 - DNA, 25 bp, Mus musculus
atgacctggaagataaactgaagtg

SEQ ID NO: 882769 - DNA, 25 bp, Mus musculus
atgacctggaagccctcgtcaaaca

SEQ ID NO: 882770 - DNA, 25 bp, Mus musculus
atgacctggaaggcctcgtcaaaca

SEQ ID NO: 882771 - DNA, 25 bp, Mus musculus
atgacctggaagtcgagctctatgc

SEQ ID NO: 882772 - DNA, 25 bp, Mus musculus
atgacctggaagttaaactgaagtg

SEQ ID NO: 882773 - DNA, 25 bp, Mus musculus
atgacgacagcactcgtctcattcg

SEQ ID NO: 882774 - DNA, 25 bp, Mus musculus
atgacgacagcactggtctcattcg

SEQ ID NO: 882775 - DNA, 25 bp, Mus musculus
atgacgacgacgagcatggagatga

SEQ ID NO: 882776 - DNA, 25 bp, Mus musculus
atgacgacgacgaggatggagatga

SEQ ID NO: 882777 - DNA, 25 bp, Mus musculus
atgacgactgggcgggacagtatga

SEQ ID NO: 882778 - DNA, 25 bp, Mus musculus
atgacgactgggggggacagtatga

SEQ ID NO: 882779 - DNA, 25 bp, Mus musculus
atgacgatggaccgtgccacaggtt

SEQ ID NO: 882780 - DNA, 25 bp, Mus musculus
atgacgatggactcccttctcagca

SEQ ID NO: 882781 - DNA, 25 bp, Mus musculus
atgacgatggatccgtgccacaggt

SEQ ID NO: 882782 - DNA, 25 bp, Mus musculus
atgacgatggtccgtgccacaggtt

SEQ ID NO: 882783 - DNA, 25 bp, Mus musculus
atgacgatggtctcccttctcagca

SEQ ID NO: 882784 - DNA, 25 bp, Mus musculus
atgacgatggttccgtgccacaggt

SEQ ID NO: 882785 - DNA, 25 bp, Mus musculus
atgacgctgaacacttgccccgccc

SEQ ID NO: 882786 - DNA, 25 bp, Mus musculus
atgacgctgatcacttgccccgccc

SEQ ID NO: 882787 - DNA, 25 bp, Mus musculus
atgacggctttgaacatattgctat

SEQ ID NO: 882788 - DNA, 25 bp, Mus musculus
atgacggctttgaagatattgctat

SEQ ID NO: 882789 - DNA, 25 bp, Mus musculus
atgacggtgatgaccatggcacctg

SEQ ID NO: 882790 - DNA, 25 bp, Mus musculus
atgacggtgatgacgatggcacctg

SEQ ID NO: 882791 - DNA, 25 bp, Mus musculus
atgacgtcttggctcatgctgcctg

SEQ ID NO: 882792 - DNA, 25 bp, Mus musculus
atgacgtcttgggtcatgctgcctg

SEQ ID NO: 882793 - DNA, 25 bp, Mus musculus
atgacgttcagacgttcatcgtggg

SEQ ID NO: 882794 - DNA, 25 bp, Mus musculus
atgacgttcagaggttcatcgtggg

SEQ ID NO: 882795 - DNA, 25 bp, Mus musculus
atgactaagcctttcgttcacagca

SEQ ID NO: 882796 - DNA, 25 bp, Mus musculus
atgactaagcctttggttcacagca

SEQ ID NO: 882797 - DNA, 25 bp, Mus musculus
atgactacattacgttatttgggaa

SEQ ID NO: 882798 - DNA, 25 bp, Mus musculus
atgactacattaggttatttgggaa

SEQ ID NO: 882799 - DNA, 25 bp, Mus musculus
atgactaccaggcacctgatgacac

SEQ ID NO: 882800 - DNA, 25 bp, Mus musculus
atgactaccaggcagctgatgacac

SEQ ID NO: 882801 - DNA, 25 bp, Mus musculus
atgactaccgaccagtgaagttctt

SEQ ID NO: 882802 - DNA, 25 bp, Mus musculus
atgactaccgtccagtgaagttctt

SEQ ID NO: 882803 - DNA, 25 bp, Mus musculus
atgactcagagcaacaggtggatat

SEQ ID NO: 882804 - DNA, 25 bp, Mus musculus
atgactcagagcaagaggtggatat

SEQ ID NO: 882805 - DNA, 25 bp, Mus musculus
atgactgccgccccaacccgtgtca

SEQ ID NO: 882806 - DNA, 25 bp, Mus musculus
atgactgccgcccctacccgtgtca

SEQ ID NO: 882807 - DNA, 25 bp, Mus musculus
atgactggagcctgaaaggtgccct

SEQ ID NO: 882808 - DNA, 25 bp, Mus musculus
atgactggagcgagtttcgaacttt

SEQ ID NO: 882809 - DNA, 25 bp, Mus musculus
atgactggaggctgaaaggtgccct

SEQ ID NO: 882810 - DNA, 25 bp, Mus musculus
atgactggagggagtttcgaacttt

SEQ ID NO: 882811 - DNA, 25 bp, Mus musculus
atgactgtcaagaacgtaatatctt

SEQ ID NO: 882812 - DNA, 25 bp, Mus musculus
atgactgtcaagaaggtaatatctt

SEQ ID NO: 882813 - DNA, 25 bp, Mus musculus
atgactgtggagcagatctataagg

SEQ ID NO: 882814 - DNA, 25 bp, Mus musculus
atgactgtggaggagatctataagg

SEQ ID NO: 882815 - DNA, 25 bp, Mus musculus
atgactgtggcgattgtgaaagcac

SEQ ID NO: 882816 - DNA, 25 bp, Mus musculus
atgactgtggcgtttgtgaaagcac

SEQ ID NO: 882817 - DNA, 25 bp, Mus musculus
atgacttaccagcgtttgacctgat

SEQ ID NO: 882818 - DNA, 25 bp, Mus musculus
atgacttaccagggtttgacctgat

SEQ ID NO: 882819 - DNA, 25 bp, Mus musculus
atgacttagaagacgagctgtatgc

SEQ ID NO: 882820 - DNA, 25 bp, Mus musculus
atgacttagaagagaaagtggccca

SEQ ID NO: 882821 - DNA, 25 bp, Mus musculus
atgacttagaagataagtttctttg

SEQ ID NO: 882822 - DNA, 25 bp, Mus musculus
atgacttagaagatcaactctacca

SEQ ID NO: 882823 - DNA, 25 bp, Mus musculus
atgacttagaagtcgagctgtatgc

SEQ ID NO: 882824 - DNA, 25 bp, Mus musculus
atgacttagaagtgaaagtggccca

SEQ ID NO: 882825 - DNA, 25 bp, Mus musculus
atgacttagaagttaagtttctttg

SEQ ID NO: 882826 - DNA, 25 bp, Mus musculus
atgacttagaagttcaactctacca

SEQ ID NO: 882827 - DNA, 25 bp, Mus musculus
atgacttcagagaatacctgtctcc

SEQ ID NO: 882828 - DNA, 25 bp, Mus musculus
atgacttcagctgctgacctcactt

SEQ ID NO: 882829 - DNA, 25 bp, Mus musculus
atgacttcaggtgctgacctcactt

SEQ ID NO: 882830 - DNA, 25 bp, Mus musculus
atgacttcagtgaatacctgtctcc

SEQ ID NO: 882831 - DNA, 25 bp, Mus musculus
atgagaaaagctattgttggggact

SEQ ID NO: 882832 - DNA, 25 bp, Mus musculus
atgagaaaaggtattgttggggact

SEQ ID NO: 882833 - DNA, 25 bp, Mus musculus
atgagaaacgcacctcccgtcattc

SEQ ID NO: 882834 - DNA, 25 bp, Mus musculus
atgagaaacggacctcccgtcattc

SEQ ID NO: 882835 - DNA, 25 bp, Mus musculus
atgagaaagagtccctcgcccacgt

SEQ ID NO: 882836 - DNA, 25 bp, Mus musculus
atgagaaagagtgcctcgcccacgt

SEQ ID NO: 882837 - DNA, 25 bp, Mus musculus
atgagaaagttcagatgtaccgcat

SEQ ID NO: 882838 - DNA, 25 bp, Mus musculus
atgagaaagttcagttgtaccgcat

SEQ ID NO: 882839 - DNA, 25 bp, Mus musculus
atgagaagaacaatcgtaccatcac

SEQ ID NO: 882840 - DNA, 25 bp, Mus musculus
atgagaagaacaatggtaccatcac

SEQ ID NO: 882841 - DNA, 25 bp, Mus musculus
atgagaagaagaagctggcagagaa

SEQ ID NO: 882842 - DNA, 25 bp, Mus musculus
atgagaagaagatgctggcagagaa

SEQ ID NO: 882843 - DNA, 25 bp, Mus musculus
atgagaagagcaagcttcttgatgg

SEQ ID NO: 882844 - DNA, 25 bp, Mus musculus
atgagaagaggaagcttcttgatgg

SEQ ID NO: 882845 - DNA, 25 bp, Mus musculus
atgagaatgggctacgcaaaagatg

SEQ ID NO: 882846 - DNA, 25 bp, Mus musculus
atgagaatgggctactcacagttgc

SEQ ID NO: 882847 - DNA, 25 bp, Mus musculus
atgagaatgggctaggcaaaagatg

SEQ ID NO: 882848 - DNA, 25 bp, Mus musculus
atgagaatgggctagtcacagttgc

SEQ ID NO: 882849 - DNA, 25 bp, Mus musculus
atgagacgggaacctgtacagagag

SEQ ID NO: 882850 - DNA, 25 bp, Mus musculus
atgagacgggaagctgtacagagag

SEQ ID NO: 882851 - DNA, 25 bp, Mus musculus
atgagagaagcttttaggttaattt

SEQ ID NO: 882852 - DNA, 25 bp, Mus musculus
atgagagaaggttttaggttaattt

SEQ ID NO: 882853 - DNA, 25 bp, Mus musculus
atgagagcagctcaaggaggccatg

SEQ ID NO: 882854 - DNA, 25 bp, Mus musculus
atgagagcaggtcaaggaggccatg

SEQ ID NO: 882855 - DNA, 25 bp, Mus musculus
atgagagcatagatgatgaacattt

SEQ ID NO: 882856 - DNA, 25 bp, Mus musculus
atgagagcattgatgatgaacattt

SEQ ID NO: 882857 - DNA, 25 bp, Mus musculus
atgagagcgaagaggcggaagaaga

SEQ ID NO: 882858 - DNA, 25 bp, Mus musculus
atgagagcgaagtggcggaagaaga

SEQ ID NO: 882859 - DNA, 25 bp, Mus musculus
atgagagctacgcatatgttctacc

SEQ ID NO: 882860 - DNA, 25 bp, Mus musculus
atgagagctacggatatgttctacc

SEQ ID NO: 882861 - DNA, 25 bp, Mus musculus
atgagagtgagacaggcatgaaagt

SEQ ID NO: 882862 - DNA, 25 bp, Mus musculus
atgagagtgagacaggtatgaaggt

SEQ ID NO: 882863 - DNA, 25 bp, Mus musculus
atgagagtgagagaggcatgaaagt

SEQ ID NO: 882864 - DNA, 25 bp, Mus musculus
atgagagtgagagaggtatgaaggt

SEQ ID NO: 882865 - DNA, 25 bp, Mus musculus
atgagatacaagcgtcaatatagac

SEQ ID NO: 882866 - DNA, 25 bp, Mus musculus
atgagatacaagctgtagtggctgg

SEQ ID NO: 882867 - DNA, 25 bp, Mus musculus
atgagatacaagggtcaatatagac

SEQ ID NO: 882868 - DNA, 25 bp, Mus musculus
atgagatacaaggtgtagtggctgg

SEQ ID NO: 882869 - DNA, 25 bp, Mus musculus
atgagatcaacgctgaccatttgaa

SEQ ID NO: 882870 - DNA, 25 bp, Mus musculus
atgagatcaacggtgaccatttgaa

SEQ ID NO: 882871 - DNA, 25 bp, Mus musculus
atgagatgctcatccgctacccacc

SEQ ID NO: 882872 - DNA, 25 bp, Mus musculus
atgagatgctcatcggctacccacc

SEQ ID NO: 882873 - DNA, 25 bp, Mus musculus
atgagattcgcacaccgcaacctcc

SEQ ID NO: 882874 - DNA, 25 bp, Mus musculus
atgagattcgcacagcgcaacctcc

SEQ ID NO: 882875 - DNA, 25 bp, Mus musculus
atgagattctagataatgctgctga

SEQ ID NO: 882876 - DNA, 25 bp, Mus musculus
atgagattctagttaatgctgctga

SEQ ID NO: 882877 - DNA, 25 bp, Mus musculus
atgagattggcagcccagcggagct

SEQ ID NO: 882878 - DNA, 25 bp, Mus musculus
atgagattgggagcccagcggagct

SEQ ID NO: 882879 - DNA, 25 bp, Mus musculus
atgagcaaacctatgcagagatgcc

SEQ ID NO: 882880 - DNA, 25 bp, Mus musculus
atgagcaaacgtatgcagagatgcc

SEQ ID NO: 882881 - DNA, 25 bp, Mus musculus
atgagcaaagcaagtttgcttgact

SEQ ID NO: 882882 - DNA, 25 bp, Mus musculus
atgagcaaaggaagtttgcttgact

SEQ ID NO: 882883 - DNA, 25 bp, Mus musculus
atgagcacagcctggtgatcgatac

SEQ ID NO: 882884 - DNA, 25 bp, Mus musculus
atgagcacaggctggtgatcgatac

SEQ ID NO: 882885 - DNA, 25 bp, Mus musculus
atgagcagacaagacgctttcctgg

SEQ ID NO: 882886 - DNA, 25 bp, Mus musculus
atgagcagacaagaggctttcctgg

SEQ ID NO: 882887 - DNA, 25 bp, Mus musculus
atgagcagcaatcgtaaatatgtgt

SEQ ID NO: 882888 - DNA, 25 bp, Mus musculus
atgagcagcaatggtaaatatgtgt

SEQ ID NO: 882889 - DNA, 25 bp, Mus musculus
atgagcagctcctgacaaacgtcct

SEQ ID NO: 882890 - DNA, 25 bp, Mus musculus
atgagcagctcctgtcaaacgtcct

SEQ ID NO: 882891 - DNA, 25 bp, Mus musculus
atgagcatccagagtatccagagtg

SEQ ID NO: 882892 - DNA, 25 bp, Mus musculus
atgagcatccagtgtatccagagtg

SEQ ID NO: 882893 - DNA, 25 bp, Mus musculus
atgagccaagcaccagagtgagggc

SEQ ID NO: 882894 - DNA, 25 bp, Mus musculus
atgagccaagccatagagatctctg

SEQ ID NO: 882895 - DNA, 25 bp, Mus musculus
atgagccaaggaccagagtgagggc

SEQ ID NO: 882896 - DNA, 25 bp, Mus musculus
atgagccaaggcatagagatctctg

SEQ ID NO: 882897 - DNA, 25 bp, Mus musculus
atgagcctgcgcaacggcaaagagc

SEQ ID NO: 882898 - DNA, 25 bp, Mus musculus
atgagcctgcgcaagggcaaagagc

SEQ ID NO: 882899 - DNA, 25 bp, Mus musculus
atgagcgaggagacgccaatggctg

SEQ ID NO: 882900 - DNA, 25 bp, Mus musculus
atgagcgaggagagacgccaatggc

SEQ ID NO: 882901 - DNA, 25 bp, Mus musculus
atgagcgaggagtcgccaatggctg

SEQ ID NO: 882902 - DNA, 25 bp, Mus musculus
atgagcgaggagtgacgccaatggc

SEQ ID NO: 882903 - DNA, 25 bp, Mus musculus
atgagcgcaggcagtactacgaggg

SEQ ID NO: 882904 - DNA, 25 bp, Mus musculus
atgagcgcaggctgtactacgaggg

SEQ ID NO: 882905 - DNA, 25 bp, Mus musculus
atgagctacacacgttttgtccaag

SEQ ID NO: 882906 - DNA, 25 bp, Mus musculus
atgagctacacaggttttgtccaag

SEQ ID NO: 882907 - DNA, 25 bp, Mus musculus
atgagctacttgaaaagtaaagaac

SEQ ID NO: 882908 - DNA, 25 bp, Mus musculus
atgagctacttgtaaagtaaagaac

SEQ ID NO: 882909 - DNA, 25 bp, Mus musculus
atgagctcaacccgtacatccccac

SEQ ID NO: 882910 - DNA, 25 bp, Mus musculus
atgagctcaaccggtacatccccac

SEQ ID NO: 882911 - DNA, 25 bp, Mus musculus
atgagctttgtcaacaacctacatg

SEQ ID NO: 882912 - DNA, 25 bp, Mus musculus
atgagctttgtcaacggctggggag

SEQ ID NO: 882913 - DNA, 25 bp, Mus musculus
atgagctttgtcaagaacctacatg

SEQ ID NO: 882914 - DNA, 25 bp, Mus musculus
atgagctttgtcaagggctggggag

SEQ ID NO: 882915 - DNA, 25 bp, Mus musculus
atgaggaaacccagtcgcatagggc

SEQ ID NO: 882916 - DNA, 25 bp, Mus musculus
atgaggaaaccctgtcgcatagggc

SEQ ID NO: 882917 - DNA, 25 bp, Mus musculus
atgaggaaagacatgatactgtcag

SEQ ID NO: 882918 - DNA, 25 bp, Mus musculus
atgaggaaagacttgatactgtcag

SEQ ID NO: 882919 - DNA, 25 bp, Mus musculus
atgaggaacaagattcgagagcaaa

SEQ ID NO: 882920 - DNA, 25 bp, Mus musculus
atgaggaacaagtttcgagagcaaa

SEQ ID NO: 882921 - DNA, 25 bp, Mus musculus
atgaggacaaaacacgaatggaagc

SEQ ID NO: 882922 - DNA, 25 bp, Mus musculus
atgaggacaaaacactgaccaagaa

SEQ ID NO: 882923 - DNA, 25 bp, Mus musculus
atgaggacaaaacaggaatggaagc

SEQ ID NO: 882924 - DNA, 25 bp, Mus musculus
atgaggacaaaacagtgaccaagaa

SEQ ID NO: 882925 - DNA, 25 bp, Mus musculus
atgaggagagctacacaccccttga

SEQ ID NO: 882926 - DNA, 25 bp, Mus musculus
atgaggagaggtacacaccccttga

SEQ ID NO: 882927 - DNA, 25 bp, Mus musculus
atgaggagcactgcccggtggccac

SEQ ID NO: 882928 - DNA, 25 bp, Mus musculus
atgaggagcactgcgcggtggccac

SEQ ID NO: 882929 - DNA, 25 bp, Mus musculus
atgaggccacagatgtggatgcggc

SEQ ID NO: 882930 - DNA, 25 bp, Mus musculus
atgaggccacagttgtggatgcggc

SEQ ID NO: 882931 - DNA, 25 bp, Mus musculus
atgaggcctcagccacctgcgaagc

SEQ ID NO: 882932 - DNA, 25 bp, Mus musculus
atgaggcctcaggcacctgcgaagc

SEQ ID NO: 882933 - DNA, 25 bp, Mus musculus
atgaggcgatacaacgaacttgtgg

SEQ ID NO: 882934 - DNA, 25 bp, Mus musculus
atgaggcgatacaaggaacttgtgg

SEQ ID NO: 882935 - DNA, 25 bp, Mus musculus
atgagggaagacaacgtgatgatga

SEQ ID NO: 882936 - DNA, 25 bp, Mus musculus
atgagggaagacaaggtgatgatga

SEQ ID NO: 882937 - DNA, 25 bp, Mus musculus
atgagggagaggagcgtctggtcag

SEQ ID NO: 882938 - DNA, 25 bp, Mus musculus
atgagggagaggagggtctggtcag

SEQ ID NO: 882939 - DNA, 25 bp, Mus musculus
atgagggcagcttgatgctggagtt

SEQ ID NO: 882940 - DNA, 25 bp, Mus musculus
atgagggcaggttgatgctggagtt

SEQ ID NO: 882941 - DNA, 25 bp, Mus musculus
atgagggctcaactcgcaatgtgtc

SEQ ID NO: 882942 - DNA, 25 bp, Mus musculus
atgagggctcaagtcgcaatgtgtc

SEQ ID NO: 882943 - DNA, 25 bp, Mus musculus
atgaggtcaactgcccttctcgaac

SEQ ID NO: 882944 - DNA, 25 bp, Mus musculus
atgaggtcaactgcgcttctcgaac

SEQ ID NO: 882945 - DNA, 25 bp, Mus musculus
atgaggtcagatatgggggcttctc

SEQ ID NO: 882946 - DNA, 25 bp, Mus musculus
atgaggtcagttatgggggcttctc

SEQ ID NO: 882947 - DNA, 25 bp, Mus musculus
atgaggttcctgatcatgatgaacc

SEQ ID NO: 882948 - DNA, 25 bp, Mus musculus
atgaggttcctgatcgaaaaccaac

SEQ ID NO: 882949 - DNA, 25 bp, Mus musculus
atgaggttcctgatgatgatgaacc

SEQ ID NO: 882950 - DNA, 25 bp, Mus musculus
atgaggttcctgatggaaaaccaac

SEQ ID NO: 882951 - DNA, 25 bp, Mus musculus
atgagtaacgcgccggtttcagtgt

SEQ ID NO: 882952 - DNA, 25 bp, Mus musculus
atgagtaacgggccggtttcagtgt

SEQ ID NO: 882953 - DNA, 25 bp, Mus musculus
atgagtacaaagcatacgaggaaac

SEQ ID NO: 882954 - DNA, 25 bp, Mus musculus
atgagtacaaaggatacgaggaaac

SEQ ID NO: 882955 - DNA, 25 bp, Mus musculus
atgagtacctcacgaaatctgtcat

SEQ ID NO: 882956 - DNA, 25 bp, Mus musculus
atgagtacctcacgttcaggaaaag

SEQ ID NO: 882957 - DNA, 25 bp, Mus musculus
atgagtacctcaggaaatctgtcat

SEQ ID NO: 882958 - DNA, 25 bp, Mus musculus
atgagtacctcaggttcaggaaaag

SEQ ID NO: 882959 - DNA, 25 bp, Mus musculus
atgagtagcaacaaaacgctgccgt

SEQ ID NO: 882960 - DNA, 25 bp, Mus musculus
atgagtagcaacaaagagcagcggt

SEQ ID NO: 882961 - DNA, 25 bp, Mus musculus
atgagtagcaacaatacgctgccgt

SEQ ID NO: 882962 - DNA, 25 bp, Mus musculus
atgagtagcaacaatgagcagcggt

SEQ ID NO: 882963 - DNA, 25 bp, Mus musculus
atgagtattacacaggctggttttg

SEQ ID NO: 882964 - DNA, 25 bp, Mus musculus
atgagtattacagaggctggttttg

SEQ ID NO: 882965 - DNA, 25 bp, Mus musculus
atgagtcagccacgattgaggatat

SEQ ID NO: 882966 - DNA, 25 bp, Mus musculus
atgagtcagccaggattgaggatat

SEQ ID NO: 882967 - DNA, 25 bp, Mus musculus
atgagtccaccgcaagcattgccaa

SEQ ID NO: 882968 - DNA, 25 bp, Mus musculus
atgagtccaccggaagcattgccaa

SEQ ID NO: 882969 - DNA, 25 bp, Mus musculus
atgagtcccgcaccctttggaagga

SEQ ID NO: 882970 - DNA, 25 bp, Mus musculus
atgagtcccgcagcctttggaagga

SEQ ID NO: 882971 - DNA, 25 bp, Mus musculus
atgagtctgctgcatctaaataact

SEQ ID NO: 882972 - DNA, 25 bp, Mus musculus
atgagtctgctggatctaaataact

SEQ ID NO: 882973 - DNA, 25 bp, Mus musculus
atgagtcttccccacgttgccctgg

SEQ ID NO: 882974 - DNA, 25 bp, Mus musculus
atgagtcttccccaggttgccctgg

SEQ ID NO: 882975 - DNA, 25 bp, Mus musculus
atgagtgaccagcatcggcaggttt

SEQ ID NO: 882976 - DNA, 25 bp, Mus musculus
atgagtgaccaggatcggcaggttt

SEQ ID NO: 882977 - DNA, 25 bp, Mus musculus
atgagtgccaaatgccccagcaagg

SEQ ID NO: 882978 - DNA, 25 bp, Mus musculus
atgagtgccaaatggcccagcaagg

SEQ ID NO: 882979 - DNA, 25 bp, Mus musculus
atgagtggaagaccctgacctatga

SEQ ID NO: 882980 - DNA, 25 bp, Mus musculus
atgagtggaagagcctgacctatga

SEQ ID NO: 882981 - DNA, 25 bp, Mus musculus
atgagtgtcatgcgcattaccacag

SEQ ID NO: 882982 - DNA, 25 bp, Mus musculus
atgagtgtcatgggcattaccacag

SEQ ID NO: 882983 - DNA, 25 bp, Mus musculus
atgagtgtgctctgcgtgccaaccc

SEQ ID NO: 882984 - DNA, 25 bp, Mus musculus
atgagtgtgctctgggtgccaaccc

SEQ ID NO: 882985 - DNA, 25 bp, Mus musculus
atgagtgttttactgcgagtcctaa

SEQ ID NO: 882986 - DNA, 25 bp, Mus musculus
atgagtgttttagtgcgagtcctaa

SEQ ID NO: 882987 - DNA, 25 bp, Mus musculus
atgagttcatcgatggctaaagtaa

SEQ ID NO: 882988 - DNA, 25 bp, Mus musculus
atgagttcatcgatgtctacttcat

SEQ ID NO: 882989 - DNA, 25 bp, Mus musculus
atgagttcatcgttggctaaagtaa

SEQ ID NO: 882990 - DNA, 25 bp, Mus musculus
atgagttcatcgttgtctacttcat

SEQ ID NO: 882991 - DNA, 25 bp, Mus musculus
atgagttctaccgcagtggctgggc

SEQ ID NO: 882992 - DNA, 25 bp, Mus musculus
atgagttctaccgctgtggctgggc

SEQ ID NO: 882993 - DNA, 25 bp, Mus musculus
atgataaatgagcacatagcattgt

SEQ ID NO: 882994 - DNA, 25 bp, Mus musculus
atgataaatgaggacatagcattgt

SEQ ID NO: 882995 - DNA, 25 bp, Mus musculus
atgataacagagacaatccccttct

SEQ ID NO: 882996 - DNA, 25 bp, Mus musculus
atgataacagagcaacccgatagca

SEQ ID NO: 882997 - DNA, 25 bp, Mus musculus
atgataacagagcatacaagcaatg

SEQ ID NO: 882998 - DNA, 25 bp, Mus musculus
atgataacagaggaacccgatagca

SEQ ID NO: 882999 - DNA, 25 bp, Mus musculus
atgataacagaggatacaagcaatg

SEQ ID NO: 883000 - DNA, 25 bp, Mus musculus
atgataacagagtcaatccccttct

SEQ ID NO: 883001 - DNA, 25 bp, Mus musculus
atgataagaatgagtatgttctggg

SEQ ID NO: 883002 - DNA, 25 bp, Mus musculus
atgataagaatgtgtatgttctggg

SEQ ID NO: 883003 - DNA, 25 bp, Mus musculus
atgataatgtagatcaaactgaagg

SEQ ID NO: 883004 - DNA, 25 bp, Mus musculus
atgataatgtagatcaggaagcaag

SEQ ID NO: 883005 - DNA, 25 bp, Mus musculus
atgataatgtagatgaaactgaagg

SEQ ID NO: 883006 - DNA, 25 bp, Mus musculus
atgataatgtagatgaggaagcaag

SEQ ID NO: 883007 - DNA, 25 bp, Mus musculus
atgatagaaaccagaaaacacaggc

SEQ ID NO: 883008 - DNA, 25 bp, Mus musculus
atgatagaaacctgaaaacacaggc

SEQ ID NO: 883009 - DNA, 25 bp, Mus musculus
atgatatcacaaatgttaactcatt

SEQ ID NO: 883010 - DNA, 25 bp, Mus musculus
atgatatcacaattgttaactcatt

SEQ ID NO: 883011 - DNA, 25 bp, Mus musculus
atgatattagtactctgccctgctc

SEQ ID NO: 883012 - DNA, 25 bp, Mus musculus
atgatattagtagtctgccctgctc

SEQ ID NO: 883013 - DNA, 25 bp, Mus musculus
atgatattcaagcaacagcgtctgt

SEQ ID NO: 883014 - DNA, 25 bp, Mus musculus
atgatattcaagcgtctgttgcggt

SEQ ID NO: 883015 - DNA, 25 bp, Mus musculus
atgatattcaaggaacagcgtctgt

SEQ ID NO: 883016 - DNA, 25 bp, Mus musculus
atgatattcaagggtctgttgcggt

SEQ ID NO: 883017 - DNA, 25 bp, Mus musculus
atgatattggctttgatctgtggat

SEQ ID NO: 883018 - DNA, 25 bp, Mus musculus
atgatattgggtttgatctgtggat

SEQ ID NO: 883019 - DNA, 25 bp, Mus musculus
atgatatttaccttctttaccatta

SEQ ID NO: 883020 - DNA, 25 bp, Mus musculus
atgatatttaccttgtttaccatta

SEQ ID NO: 883021 - DNA, 25 bp, Mus musculus
atgatcaacgaaccaatggcaccat

SEQ ID NO: 883022 - DNA, 25 bp, Mus musculus
atgatcaacgaagcaatggcaccat

SEQ ID NO: 883023 - DNA, 25 bp, Mus musculus
atgatcaggtgctacgttaaagatc

SEQ ID NO: 883024 - DNA, 25 bp, Mus musculus
atgatcaggtgctaggttaaagatc

SEQ ID NO: 883025 - DNA, 25 bp, Mus musculus
atgatcatatggcactgactgagtt

SEQ ID NO: 883026 - DNA, 25 bp, Mus musculus
atgatcatatggcacttgactgagt

SEQ ID NO: 883027 - DNA, 25 bp, Mus musculus
atgatcatatggcagtgactgagtt

SEQ ID NO: 883028 - DNA, 25 bp, Mus musculus
atgatcatatggcagttgactgagt

SEQ ID NO: 883029 - DNA, 25 bp, Mus musculus
atgatccacacacagaatttggtct

SEQ ID NO: 883030 - DNA, 25 bp, Mus musculus
atgatccacagacagaatttggtct

SEQ ID NO: 883031 - DNA, 25 bp, Mus musculus
atgatccagcagatgctgtccacgg

SEQ ID NO: 883032 - DNA, 25 bp, Mus musculus
atgatccagcagttgctgtccacgg

SEQ ID NO: 883033 - DNA, 25 bp, Mus musculus
atgatccccaatctggaaaccatcc

SEQ ID NO: 883034 - DNA, 25 bp, Mus musculus
atgatccccaatgtggaaaccatcc

SEQ ID NO: 883035 - DNA, 25 bp, Mus musculus
atgatccgagagcccttggaagcta

SEQ ID NO: 883036 - DNA, 25 bp, Mus musculus
atgatccgagaggccttggaagcta

SEQ ID NO: 883037 - DNA, 25 bp, Mus musculus
atgatccgcaagcgccagggcaaca

SEQ ID NO: 883038 - DNA, 25 bp, Mus musculus
atgatccgcaagggccagggcaaca

SEQ ID NO: 883039 - DNA, 25 bp, Mus musculus
atgatccgctgtcacgagctgaaat

SEQ ID NO: 883040 - DNA, 25 bp, Mus musculus
atgatccgctgtcaggagctgaaat

SEQ ID NO: 883041 - DNA, 25 bp, Mus musculus
atgatccttaagctggtgatggccc

SEQ ID NO: 883042 - DNA, 25 bp, Mus musculus
atgatccttaaggtggtgatggccc

SEQ ID NO: 883043 - DNA, 25 bp, Mus musculus
atgatcgacttagacgccaatttcg

SEQ ID NO: 883044 - DNA, 25 bp, Mus musculus
atgatcgacttagaggccaatttcg

SEQ ID NO: 883045 - DNA, 25 bp, Mus musculus
atgatcgtaaagagtttgttggacg

SEQ ID NO: 883046 - DNA, 25 bp, Mus musculus
atgatcgtaaagtgtttgttggacg

SEQ ID NO: 883047 - DNA, 25 bp, Mus musculus
atgatcgtcgtccaccaatgaaaag

SEQ ID NO: 883048 - DNA, 25 bp, Mus musculus
atgatcgtcgtcgaccaatgaaaag

SEQ ID NO: 883049 - DNA, 25 bp, Mus musculus
atgatcgtcgtcgtcgaccaatgaa

SEQ ID NO: 883050 - DNA, 25 bp, Mus musculus
atgatcgtcgtcgtggaccaatgaa

SEQ ID NO: 883051 - DNA, 25 bp, Mus musculus
atgatctcagcagacgctacaacca

SEQ ID NO: 883052 - DNA, 25 bp, Mus musculus
atgatctcagcagaggctacaacca

SEQ ID NO: 883053 - DNA, 25 bp, Mus musculus
atgatcttctgccaaacccgcaaaa

SEQ ID NO: 883054 - DNA, 25 bp, Mus musculus
atgatcttctgccatacccgcaaaa

SEQ ID NO: 883055 - DNA, 25 bp, Mus musculus
atgatgaaagcacccatgtactcgg

SEQ ID NO: 883056 - DNA, 25 bp, Mus musculus
atgatgaaagcactggtccatgccg

SEQ ID NO: 883057 - DNA, 25 bp, Mus musculus
atgatgaaagcagccatgtactcgg

SEQ ID NO: 883058 - DNA, 25 bp, Mus musculus
atgatgaaagcagtggtccatgccg

SEQ ID NO: 883059 - DNA, 25 bp, Mus musculus
atgatgaaagccctctctatagcct

SEQ ID NO: 883060 - DNA, 25 bp, Mus musculus
atgatgaaaggcctctctatagcct

SEQ ID NO: 883061 - DNA, 25 bp, Mus musculus
atgatgaaaggcgacttttatgtca

SEQ ID NO: 883062 - DNA, 25 bp, Mus musculus
atgatgaaaggcgagttttatgtca

SEQ ID NO: 883063 - DNA, 25 bp, Mus musculus
atgatgaagatgaggagcaagaaat

SEQ ID NO: 883064 - DNA, 25 bp, Mus musculus
atgatgaagatgtggagcaagaaat

SEQ ID NO: 883065 - DNA, 25 bp, Mus musculus
atgatgaatgaccaataggtgaagg

SEQ ID NO: 883066 - DNA, 25 bp, Mus musculus
atgatgaatgacgaataggtgaagg

SEQ ID NO: 883067 - DNA, 25 bp, Mus musculus
atgatgacaccaagtccaagtggga

SEQ ID NO: 883068 - DNA, 25 bp, Mus musculus
atgatgacacgaagtccaagtggga

SEQ ID NO: 883069 - DNA, 25 bp, Mus musculus
atgatgacgatgcatccgtgccaca

SEQ ID NO: 883070 - DNA, 25 bp, Mus musculus
atgatgacgatgctccgtgccacag

SEQ ID NO: 883071 - DNA, 25 bp, Mus musculus
atgatgacgatgctctcccttctca

SEQ ID NO: 883072 - DNA, 25 bp, Mus musculus
atgatgacgatggatccgtgccaca

SEQ ID NO: 883073 - DNA, 25 bp, Mus musculus
atgatgacgatggtccgtgccacag

SEQ ID NO: 883074 - DNA, 25 bp, Mus musculus
atgatgacgatggtctcccttctca

SEQ ID NO: 883075 - DNA, 25 bp, Mus musculus
atgatgatcgtcgtcgaccaatgaa

SEQ ID NO: 883076 - DNA, 25 bp, Mus musculus
atgatgatcgtcgtggaccaatgaa

SEQ ID NO: 883077 - DNA, 25 bp, Mus musculus
atgatgatcgtgcaccctgccatca

SEQ ID NO: 883078 - DNA, 25 bp, Mus musculus
atgatgatcgtgccgggatccgcag

SEQ ID NO: 883079 - DNA, 25 bp, Mus musculus
atgatgatcgtgctttggcctggaa

SEQ ID NO: 883080 - DNA, 25 bp, Mus musculus
atgatgatcgtggaccctgccatca

SEQ ID NO: 883081 - DNA, 25 bp, Mus musculus
atgatgatcgtggcgggatccgcag

SEQ ID NO: 883082 - DNA, 25 bp, Mus musculus
atgatgatcgtggtttggcctggaa

SEQ ID NO: 883083 - DNA, 25 bp, Mus musculus
atgatgatgacacgaagtccaagtg

SEQ ID NO: 883084 - DNA, 25 bp, Mus musculus
atgatgatgacaggaagtccaagtg

SEQ ID NO: 883085 - DNA, 25 bp, Mus musculus
atgatgatgccttcctctccatcat

SEQ ID NO: 883086 - DNA, 25 bp, Mus musculus
atgatgatgcgttcctctccatcat

SEQ ID NO: 883087 - DNA, 25 bp, Mus musculus
atgatgatgtcattcctgatgacag

SEQ ID NO: 883088 - DNA, 25 bp, Mus musculus
atgatgatgtcattgctgatgacag

SEQ ID NO: 883089 - DNA, 25 bp, Mus musculus
atgatgcactgtcacaacaagcctg

SEQ ID NO: 883090 - DNA, 25 bp, Mus musculus
atgatgcactgtcacgttccgagtc

SEQ ID NO: 883091 - DNA, 25 bp, Mus musculus
atgatgcactgtcagaacaagcctg

SEQ ID NO: 883092 - DNA, 25 bp, Mus musculus
atgatgcactgtcaggttccgagtc

SEQ ID NO: 883093 - DNA, 25 bp, Mus musculus
atgatgcccaagcttcactggttga

SEQ ID NO: 883094 - DNA, 25 bp, Mus musculus
atgatgcccaaggttcactggttga

SEQ ID NO: 883095 - DNA, 25 bp, Mus musculus
atgatgccccagcaaacacaattag

SEQ ID NO: 883096 - DNA, 25 bp, Mus musculus
atgatgccccaggaaacacaattag

SEQ ID NO: 883097 - DNA, 25 bp, Mus musculus
atgatgccgcccttaatgtatcccc

SEQ ID NO: 883098 - DNA, 25 bp, Mus musculus
atgatgccgccctttatgtatcccc

SEQ ID NO: 883099 - DNA, 25 bp, Mus musculus
atgatgcgggatgctgggatatgaa

SEQ ID NO: 883100 - DNA, 25 bp, Mus musculus
atgatgcgggttgctgggatatgaa

SEQ ID NO: 883101 - DNA, 25 bp, Mus musculus
atgatgctagagcgacttagagaac

SEQ ID NO: 883102 - DNA, 25 bp, Mus musculus
atgatgctagagggacttagagaac

SEQ ID NO: 883103 - DNA, 25 bp, Mus musculus
atgatgctctgtatgaagggggata

SEQ ID NO: 883104 - DNA, 25 bp, Mus musculus
atgatgctctgtttgaagggggata

SEQ ID NO: 883105 - DNA, 25 bp, Mus musculus
atgatgcttgagcccctcgatgggt

SEQ ID NO: 883106 - DNA, 25 bp, Mus musculus
atgatgcttgaggccctcgatgggt

SEQ ID NO: 883107 - DNA, 25 bp, Mus musculus
atgatggacatatcaattactggga

SEQ ID NO: 883108 - DNA, 25 bp, Mus musculus
atgatggacatatctattactggga

SEQ ID NO: 883109 - DNA, 25 bp, Mus musculus
atgatggcatggcgtatggcgacta

SEQ ID NO: 883110 - DNA, 25 bp, Mus musculus
atgatggcatggggtatggcgacta

SEQ ID NO: 883111 - DNA, 25 bp, Mus musculus
atgatggggtatgtcactgctgtga

SEQ ID NO: 883112 - DNA, 25 bp, Mus musculus
atgatggggtatgtgactgctgtga

SEQ ID NO: 883113 - DNA, 25 bp, Mus musculus
atgatggttgggcacgggcccatga

SEQ ID NO: 883114 - DNA, 25 bp, Mus musculus
atgatggttgggcaggggcccatga

SEQ ID NO: 883115 - DNA, 25 bp, Mus musculus
atgatgtatacaccttcgccattgt

SEQ ID NO: 883116 - DNA, 25 bp, Mus musculus
atgatgtatacagcttcgccattgt

SEQ ID NO: 883117 - DNA, 25 bp, Mus musculus
atgatgtcagcaaaccacacgcctt

SEQ ID NO: 883118 - DNA, 25 bp, Mus musculus
atgatgtcaggaaaccacacgcctt

SEQ ID NO: 883119 - DNA, 25 bp, Mus musculus
atgatgtcattgctgatgacagctt

SEQ ID NO: 883120 - DNA, 25 bp, Mus musculus
atgatgtcattggtgatgacagctt

SEQ ID NO: 883121 - DNA, 25 bp, Mus musculus
atgatgtcctatatgaactgagaaa

SEQ ID NO: 883122 - DNA, 25 bp, Mus musculus
atgatgtcctatttgaactgagaaa

SEQ ID NO: 883123 - DNA, 25 bp, Mus musculus
atgatgtcgccatgcatgagccttc

SEQ ID NO: 883124 - DNA, 25 bp, Mus musculus
atgatgtcgccatggatgagccttc

SEQ ID NO: 883125 - DNA, 25 bp, Mus musculus
atgatgtggaccaacggtggatgcg

SEQ ID NO: 883126 - DNA, 25 bp, Mus musculus
atgatgtggaccaagggtggatgcg

SEQ ID NO: 883127 - DNA, 25 bp, Mus musculus
atgatgttgtccctcacaggtttgg

SEQ ID NO: 883128 - DNA, 25 bp, Mus musculus
atgatgttgtccctgacaggtttgg

SEQ ID NO: 883129 - DNA, 25 bp, Mus musculus
atgattaacctgctgctggatttct

SEQ ID NO: 883130 - DNA, 25 bp, Mus musculus
atgattaacctggtgctggatttct

SEQ ID NO: 883131 - DNA, 25 bp, Mus musculus
atgattacatcgcaggctgccagct

SEQ ID NO: 883132 - DNA, 25 bp, Mus musculus
atgattacatcggaggctgccagct

SEQ ID NO: 883133 - DNA, 25 bp, Mus musculus
atgattatggatacagcaggaaatg

SEQ ID NO: 883134 - DNA, 25 bp, Mus musculus
atgattatggattcagcaggaaatg

SEQ ID NO: 883135 - DNA, 25 bp, Mus musculus
atgattccagatgcacgccatccct

SEQ ID NO: 883136 - DNA, 25 bp, Mus musculus
atgattccagcctactagtcagtgc

SEQ ID NO: 883137 - DNA, 25 bp, Mus musculus
atgattccaggctactagtcagtgc

SEQ ID NO: 883138 - DNA, 25 bp, Mus musculus
atgattccagttgcacgccatccct

SEQ ID NO: 883139 - DNA, 25 bp, Mus musculus
atgattctgtttcgaacttccacgt

SEQ ID NO: 883140 - DNA, 25 bp, Mus musculus
atgattctgtttggaacttccacgt

SEQ ID NO: 883141 - DNA, 25 bp, Mus musculus
atgattgaaaaacaccaggaggaag

SEQ ID NO: 883142 - DNA, 25 bp, Mus musculus
atgattgaaaaacagcaggaggaag

SEQ ID NO: 883143 - DNA, 25 bp, Mus musculus
atgattgcagccaacgagcctgtac

SEQ ID NO: 883144 - DNA, 25 bp, Mus musculus
atgattgcagccaaggagcctgtac

SEQ ID NO: 883145 - DNA, 25 bp, Mus musculus
atgattgcatcaaaagaggctgttc

SEQ ID NO: 883146 - DNA, 25 bp, Mus musculus
atgattgcatcaaatgaggctgttc

SEQ ID NO: 883147 - DNA, 25 bp, Mus musculus
atgattggaaaaatcgtggccaata

SEQ ID NO: 883148 - DNA, 25 bp, Mus musculus
atgattggaaaaatggtggccaata

SEQ ID NO: 883149 - DNA, 25 bp, Mus musculus
atgatttcccagcacagcaagctga

SEQ ID NO: 883150 - DNA, 25 bp, Mus musculus
atgatttcccagcagagcaagctga

SEQ ID NO: 883151 - DNA, 25 bp, Mus musculus
atgattttacagagtgctaccagta

SEQ ID NO: 883152 - DNA, 25 bp, Mus musculus
atgattttacagtgtgctaccagta

SEQ ID NO: 883153 - DNA, 25 bp, Mus musculus
atgcaaaaactaccctgcgggaagc

SEQ ID NO: 883154 - DNA, 25 bp, Mus musculus
atgcaaaaactagcctgcgggaagc

SEQ ID NO: 883155 - DNA, 25 bp, Mus musculus
atgcaaaccagcaactgcgactgta

SEQ ID NO: 883156 - DNA, 25 bp, Mus musculus
atgcaaaccagcaagtgcgactgta

SEQ ID NO: 883157 - DNA, 25 bp, Mus musculus
atgcaaatagccagccgagagacgg

SEQ ID NO: 883158 - DNA, 25 bp, Mus musculus
atgcaaataggcagccgagagacgg

SEQ ID NO: 883159 - DNA, 25 bp, Mus musculus
atgcaacagatacgattgctgggct

SEQ ID NO: 883160 - DNA, 25 bp, Mus musculus
atgcaacagatacgtttgctgggct

SEQ ID NO: 883161 - DNA, 25 bp, Mus musculus
atgcaacagatacttgctgggcttt

SEQ ID NO: 883162 - DNA, 25 bp, Mus musculus
atgcaacagatagttgctgggcttt

SEQ ID NO: 883163 - DNA, 25 bp, Mus musculus
atgcaacatactgctggctggactt

SEQ ID NO: 883164 - DNA, 25 bp, Mus musculus
atgcaacatagtgctggctggactt

SEQ ID NO: 883165 - DNA, 25 bp, Mus musculus
atgcaacctatgatcatggcatttg

SEQ ID NO: 883166 - DNA, 25 bp, Mus musculus
atgcaacctatgatgatggcatttg

SEQ ID NO: 883167 - DNA, 25 bp, Mus musculus
atgcaagcagccatcttcgaaaaat

SEQ ID NO: 883168 - DNA, 25 bp, Mus musculus
atgcaagcaggcatcttcgaaaaat

SEQ ID NO: 883169 - DNA, 25 bp, Mus musculus
atgcaagtggagctgaagtatttga

SEQ ID NO: 883170 - DNA, 25 bp, Mus musculus
atgcaagtggaggtgaagtatttga

SEQ ID NO: 883171 - DNA, 25 bp, Mus musculus
atgcaatcaaagatgtcctggggaa

SEQ ID NO: 883172 - DNA, 25 bp, Mus musculus
atgcaatcaaagttgtcctggggaa

SEQ ID NO: 883173 - DNA, 25 bp, Mus musculus
atgcaattgcagcgacggaatctgg

SEQ ID NO: 883174 - DNA, 25 bp, Mus musculus
atgcaattgcagggacggaatctgg

SEQ ID NO: 883175 - DNA, 25 bp, Mus musculus
atgcacaaacagagccccaggtact

SEQ ID NO: 883176 - DNA, 25 bp, Mus musculus
atgcacaaacagccggaaattgtga

SEQ ID NO: 883177 - DNA, 25 bp, Mus musculus
atgcacaaacaggcggaaattgtga

SEQ ID NO: 883178 - DNA, 25 bp, Mus musculus
atgcacaaacagtgccccaggtact

SEQ ID NO: 883179 - DNA, 25 bp, Mus musculus
atgcacaaagagcctgccagctctt

SEQ ID NO: 883180 - DNA, 25 bp, Mus musculus
atgcacaaagaggctgccagctctt

SEQ ID NO: 883181 - DNA, 25 bp, Mus musculus
atgcacaagcagcctcctctgctgg

SEQ ID NO: 883182 - DNA, 25 bp, Mus musculus
atgcacaagcaggctcctctgctgg

SEQ ID NO: 883183 - DNA, 25 bp, Mus musculus
atgcacacagcgacctgaagcccac

SEQ ID NO: 883184 - DNA, 25 bp, Mus musculus
atgcacacagggacctgaagcccac

SEQ ID NO: 883185 - DNA, 25 bp, Mus musculus
atgcacacctcacgttccctcagct

SEQ ID NO: 883186 - DNA, 25 bp, Mus musculus
atgcacacctcaggttccctcagct

SEQ ID NO: 883187 - DNA, 25 bp, Mus musculus
atgcacatcaagaaactggaggagc

SEQ ID NO: 883188 - DNA, 25 bp, Mus musculus
atgcacatcaagtaactggaggagc

SEQ ID NO: 883189 - DNA, 25 bp, Mus musculus
atgcacatgtgtagcgtgtgtgagg

SEQ ID NO: 883190 - DNA, 25 bp, Mus musculus
atgcacatgtgtagggtgtgtgagg

SEQ ID NO: 883191 - DNA, 25 bp, Mus musculus
atgcaccaaatgactcgaccgatca

SEQ ID NO: 883192 - DNA, 25 bp, Mus musculus
atgcaccaaatgtctcgaccgatca

SEQ ID NO: 883193 - DNA, 25 bp, Mus musculus
atgcaccccgcggcacatggtcaac

SEQ ID NO: 883194 - DNA, 25 bp, Mus musculus
atgcaccccggggcacatggtcaac

SEQ ID NO: 883195 - DNA, 25 bp, Mus musculus
atgcacccgcagctggtgctgcagg

SEQ ID NO: 883196 - DNA, 25 bp, Mus musculus
atgcacccgcaggtggtgctgcagg

SEQ ID NO: 883197 - DNA, 25 bp, Mus musculus
atgcaccgagacatcaagcccgcca

SEQ ID NO: 883198 - DNA, 25 bp, Mus musculus
atgcaccgagtcatcaagcccgcca

SEQ ID NO: 883199 - DNA, 25 bp, Mus musculus
atgcacggagagatgcttttactga

SEQ ID NO: 883200 - DNA, 25 bp, Mus musculus
atgcacggagagttgcttttactga

SEQ ID NO: 883201 - DNA, 25 bp, Mus musculus
atgcacgggaagcaagtgggcagca

SEQ ID NO: 883202 - DNA, 25 bp, Mus musculus
atgcacgggaaggaagtgggcagca

SEQ ID NO: 883203 - DNA, 25 bp, Mus musculus
atgcactctgatcgtactggaaatc

SEQ ID NO: 883204 - DNA, 25 bp, Mus musculus
atgcactctgatggtactggaaatc

SEQ ID NO: 883205 - DNA, 25 bp, Mus musculus
atgcactgtcagaacaagcctgcca

SEQ ID NO: 883206 - DNA, 25 bp, Mus musculus
atgcactgtcagcttccgagtccga

SEQ ID NO: 883207 - DNA, 25 bp, Mus musculus
atgcactgtcaggttccgagtccga

SEQ ID NO: 883208 - DNA, 25 bp, Mus musculus
atgcactgtcagtacaagcctgcca

SEQ ID NO: 883209 - DNA, 25 bp, Mus musculus
atgcacttacagctggattacatta

SEQ ID NO: 883210 - DNA, 25 bp, Mus musculus
atgcacttacaggtggattacatta

SEQ ID NO: 883211 - DNA, 25 bp, Mus musculus
atgcacttcggggacgtggccaagc

SEQ ID NO: 883212 - DNA, 25 bp, Mus musculus
atgcacttcggggaggtggccaagc

SEQ ID NO: 883213 - DNA, 25 bp, Mus musculus
atgcagaacaacaacgaggagactc

SEQ ID NO: 883214 - DNA, 25 bp, Mus musculus
atgcagaacaacaaggaggagactc

SEQ ID NO: 883215 - DNA, 25 bp, Mus musculus
atgcagaacactcacagcggagtga

SEQ ID NO: 883216 - DNA, 25 bp, Mus musculus
atgcagaacagtcacagcggagtga

SEQ ID NO: 883217 - DNA, 25 bp, Mus musculus
atgcagaagcggcgcactccagtga

SEQ ID NO: 883218 - DNA, 25 bp, Mus musculus
atgcagaagcggggcactccagtga

SEQ ID NO: 883219 - DNA, 25 bp, Mus musculus
atgcagacgcagcaatcgtgcattt

SEQ ID NO: 883220 - DNA, 25 bp, Mus musculus
atgcagacgcagcattcgtgcattt

SEQ ID NO: 883221 - DNA, 25 bp, Mus musculus
atgcagactacagccgtcagcagag

SEQ ID NO: 883222 - DNA, 25 bp, Mus musculus
atgcagactacagcggtcagcagag

SEQ ID NO: 883223 - DNA, 25 bp, Mus musculus
atgcagagacagccacggtggttct

SEQ ID NO: 883224 - DNA, 25 bp, Mus musculus
atgcagagacaggcacggtggttct

SEQ ID NO: 883225 - DNA, 25 bp, Mus musculus
atgcagaggaagctccgggcagcag

SEQ ID NO: 883226 - DNA, 25 bp, Mus musculus
atgcagaggaaggtccgggcagcag

SEQ ID NO: 883227 - DNA, 25 bp, Mus musculus
atgcagatagctagccgagagactg

SEQ ID NO: 883228 - DNA, 25 bp, Mus musculus
atgcagataggtagccgagagactg

SEQ ID NO: 883229 - DNA, 25 bp, Mus musculus
atgcagcaagagcacgtggtgaatt

SEQ ID NO: 883230 - DNA, 25 bp, Mus musculus
atgcagcaagagcaggtggtgaatt

SEQ ID NO: 883231 - DNA, 25 bp, Mus musculus
atgcagcaagcttctgagctcatgc

SEQ ID NO: 883232 - DNA, 25 bp, Mus musculus
atgcagcaaggttctgagctcatgc

SEQ ID NO: 883233 - DNA, 25 bp, Mus musculus
atgcagccaggccatgacgtggtct

SEQ ID NO: 883234 - DNA, 25 bp, Mus musculus
atgcagccaggcgatgacgtggtct

SEQ ID NO: 883235 - DNA, 25 bp, Mus musculus
atgcagcggaggatgtggatgaatg

SEQ ID NO: 883236 - DNA, 25 bp, Mus musculus
atgcagcggaggttgtggatgaatg

SEQ ID NO: 883237 - DNA, 25 bp, Mus musculus
atgcagctgggcaacatccttacca

SEQ ID NO: 883238 - DNA, 25 bp, Mus musculus
atgcagctgggcaagatccttacca

SEQ ID NO: 883239 - DNA, 25 bp, Mus musculus
atgcagctggtggaccactacacca

SEQ ID NO: 883240 - DNA, 25 bp, Mus musculus
atgcagctggtggagcactacacca

SEQ ID NO: 883241 - DNA, 25 bp, Mus musculus
atgcagcttaagctcttacattccg

SEQ ID NO: 883242 - DNA, 25 bp, Mus musculus
atgcagcttaaggtcttacattccg

SEQ ID NO: 883243 - DNA, 25 bp, Mus musculus
atgcaggaccagaggatgcctggac

SEQ ID NO: 883244 - DNA, 25 bp, Mus musculus
atgcaggaccagtggatgcctggac

SEQ ID NO: 883245 - DNA, 25 bp, Mus musculus
atgcaggactctctccttagtgcat

SEQ ID NO: 883246 - DNA, 25 bp, Mus musculus
atgcaggactgtctccttagtgcat

SEQ ID NO: 883247 - DNA, 25 bp, Mus musculus
atgcaggcccaaccctccattgagg

SEQ ID NO: 883248 - DNA, 25 bp, Mus musculus
atgcaggcccaacgtctccatggtg

SEQ ID NO: 883249 - DNA, 25 bp, Mus musculus
atgcaggcccaagcctccattgagg

SEQ ID NO: 883250 - DNA, 25 bp, Mus musculus
atgcaggcccaaggtctccatggtg

SEQ ID NO: 883251 - DNA, 25 bp, Mus musculus
atgcagggccagaacgagctcccag

SEQ ID NO: 883252 - DNA, 25 bp, Mus musculus
atgcagggccagaacgtgatggtgc

SEQ ID NO: 883253 - DNA, 25 bp, Mus musculus
atgcagggccagaaggagctcccag

SEQ ID NO: 883254 - DNA, 25 bp, Mus musculus
atgcagggccagaaggtgatggtgc

SEQ ID NO: 883255 - DNA, 25 bp, Mus musculus
atgcagtgtaaacattgcaaattca

SEQ ID NO: 883256 - DNA, 25 bp, Mus musculus
atgcagtgtaaagattgcaaattca

SEQ ID NO: 883257 - DNA, 25 bp, Mus musculus
atgcagtgtgtgaaccaaggagaac

SEQ ID NO: 883258 - DNA, 25 bp, Mus musculus
atgcagtgtgtgaagcaaggagaac

SEQ ID NO: 883259 - DNA, 25 bp, Mus musculus
atgcagttaagacaacagcacatta

SEQ ID NO: 883260 - DNA, 25 bp, Mus musculus
atgcagttaagacgatcgctgcaga

SEQ ID NO: 883261 - DNA, 25 bp, Mus musculus
atgcagttaagagaacagcacatta

SEQ ID NO: 883262 - DNA, 25 bp, Mus musculus
atgcagttaagaggatcgctgcaga

SEQ ID NO: 883263 - DNA, 25 bp, Mus musculus
atgcagttgtgtcactatgcaagct

SEQ ID NO: 883264 - DNA, 25 bp, Mus musculus
atgcagttgtgtgactatgcaagct

SEQ ID NO: 883265 - DNA, 25 bp, Mus musculus
atgcataaattgaatctgtataaac

SEQ ID NO: 883266 - DNA, 25 bp, Mus musculus
atgcataaattgtatctgtataaac

SEQ ID NO: 883267 - DNA, 25 bp, Mus musculus
atgcatcaacagccaaggtagagat

SEQ ID NO: 883268 - DNA, 25 bp, Mus musculus
atgcatcaacaggcaaggtagagat

SEQ ID NO: 883269 - DNA, 25 bp, Mus musculus
atgcatctggtcatcccacgaacct

SEQ ID NO: 883270 - DNA, 25 bp, Mus musculus
atgcatctggtcatgccacgaacct

SEQ ID NO: 883271 - DNA, 25 bp, Mus musculus
atgcatgctgctatggaaaagttga

SEQ ID NO: 883272 - DNA, 25 bp, Mus musculus
atgcatgctggtatggaaaagttga

SEQ ID NO: 883273 - DNA, 25 bp, Mus musculus
atgcatgggcagacacagccctgga

SEQ ID NO: 883274 - DNA, 25 bp, Mus musculus
atgcatgggcagtcacagccctgga

SEQ ID NO: 883275 - DNA, 25 bp, Mus musculus
atgcatgtagatatcgcagacgagg

SEQ ID NO: 883276 - DNA, 25 bp, Mus musculus
atgcatgtagatatggcagacgagg

SEQ ID NO: 883277 - DNA, 25 bp, Mus musculus
atgcattcggcactgtgtggtatga

SEQ ID NO: 883278 - DNA, 25 bp, Mus musculus
atgcattcgggactgtgtggtatga

SEQ ID NO: 883279 - DNA, 25 bp, Mus musculus
atgcattctttacctattcctttgg

SEQ ID NO: 883280 - DNA, 25 bp, Mus musculus
atgcattctttagctattcctttgg

SEQ ID NO: 883281 - DNA, 25 bp, Mus musculus
atgcattgggatcgaactgtccaag

SEQ ID NO: 883282 - DNA, 25 bp, Mus musculus
atgcattgggatggaactgtccaag

SEQ ID NO: 883283 - DNA, 25 bp, Mus musculus
atgcatttgttggacgctttctgtc

SEQ ID NO: 883284 - DNA, 25 bp, Mus musculus
atgcatttgttggaggctttctgtc

SEQ ID NO: 883285 - DNA, 25 bp, Mus musculus
atgccaaactccgtgtcgaccagct

SEQ ID NO: 883286 - DNA, 25 bp, Mus musculus
atgccaaactgcgtgtcgaccagct

SEQ ID NO: 883287 - DNA, 25 bp, Mus musculus
atgccaaatctccacgatggaggcc

SEQ ID NO: 883288 - DNA, 25 bp, Mus musculus
atgccaaatctccaggatggaggcc

SEQ ID NO: 883289 - DNA, 25 bp, Mus musculus
atgccaacagatggctgaggacaag

SEQ ID NO: 883290 - DNA, 25 bp, Mus musculus
atgccaacagcagatggctgaggac

SEQ ID NO: 883291 - DNA, 25 bp, Mus musculus
atgccaacaggagatggctgaggac

SEQ ID NO: 883292 - DNA, 25 bp, Mus musculus
atgccaacagttggctgaggacaag

SEQ ID NO: 883293 - DNA, 25 bp, Mus musculus
atgccaacgatgcacggagccgaaa

SEQ ID NO: 883294 - DNA, 25 bp, Mus musculus
atgccaacgatgcagggagccgaaa

SEQ ID NO: 883295 - DNA, 25 bp, Mus musculus
atgccaacgtgacagtcattcagaa

SEQ ID NO: 883296 - DNA, 25 bp, Mus musculus
atgccaacgtgacggagcctgtata

SEQ ID NO: 883297 - DNA, 25 bp, Mus musculus
atgccaacgtgagagtcattcagaa

SEQ ID NO: 883298 - DNA, 25 bp, Mus musculus
atgccaacgtgagggagcctgtata

SEQ ID NO: 883299 - DNA, 25 bp, Mus musculus
atgccaagccatgacgcaagaaact

SEQ ID NO: 883300 - DNA, 25 bp, Mus musculus
atgccaagccatgaggcaagaaact

SEQ ID NO: 883301 - DNA, 25 bp, Mus musculus
atgccaaggcagcctgtcaggttgt

SEQ ID NO: 883302 - DNA, 25 bp, Mus musculus
atgccaaggcaggctgtcaggttgt

SEQ ID NO: 883303 - DNA, 25 bp, Mus musculus
atgccaagtttgagcatgccaccag

SEQ ID NO: 883304 - DNA, 25 bp, Mus musculus
atgccaagtttgagtctggagacgt

SEQ ID NO: 883305 - DNA, 25 bp, Mus musculus
atgccaagtttgtgcatgccaccag

SEQ ID NO: 883306 - DNA, 25 bp, Mus musculus
atgccaagtttgtgtctggagacgt

SEQ ID NO: 883307 - DNA, 25 bp, Mus musculus
atgccaattgagctcatgatgaatg

SEQ ID NO: 883308 - DNA, 25 bp, Mus musculus
atgccaattgaggtcatgatgaatg

SEQ ID NO: 883309 - DNA, 25 bp, Mus musculus
atgccacagccaaacttgaagaaat

SEQ ID NO: 883310 - DNA, 25 bp, Mus musculus
atgccacagccaaagttgaagaaat

SEQ ID NO: 883311 - DNA, 25 bp, Mus musculus
atgccacaggactacctgtgctccc

SEQ ID NO: 883312 - DNA, 25 bp, Mus musculus
atgccacaggtctacctgtgctccc

SEQ ID NO: 883313 - DNA, 25 bp, Mus musculus
atgccacatcctctgccaataactt

SEQ ID NO: 883314 - DNA, 25 bp, Mus musculus
atgccacatcctgtgccaataactt

SEQ ID NO: 883315 - DNA, 25 bp, Mus musculus
atgccaccacccttcatgccccctc

SEQ ID NO: 883316 - DNA, 25 bp, Mus musculus
atgccaccacccttgatgccccctc

SEQ ID NO: 883317 - DNA, 25 bp, Mus musculus
atgccaccagctacgccatcactgt

SEQ ID NO: 883318 - DNA, 25 bp, Mus musculus
atgccaccaggtacgccatcactgt

SEQ ID NO: 883319 - DNA, 25 bp, Mus musculus
atgccacggaggatcaggatgagga

SEQ ID NO: 883320 - DNA, 25 bp, Mus musculus
atgccacggaggatctcccgcatgg

SEQ ID NO: 883321 - DNA, 25 bp, Mus musculus
atgccacggaggatgaggatgagga

SEQ ID NO: 883322 - DNA, 25 bp, Mus musculus
atgccacggaggatgtcccgcatgg

SEQ ID NO: 883323 - DNA, 25 bp, Mus musculus
atgccacggggccacgcatcttcat

SEQ ID NO: 883324 - DNA, 25 bp, Mus musculus
atgccacggggccaggcatcttcat

SEQ ID NO: 883325 - DNA, 25 bp, Mus musculus
atgccactaggtcgactgcatatgt

SEQ ID NO: 883326 - DNA, 25 bp, Mus musculus
atgccactaggtggactgcatatgt

SEQ ID NO: 883327 - DNA, 25 bp, Mus musculus
atgccagaacagatagtcgtacaag

SEQ ID NO: 883328 - DNA, 25 bp, Mus musculus
atgccagaacagttagtcgtacaag

SEQ ID NO: 883329 - DNA, 25 bp, Mus musculus
atgccagaaggacgcggcgctctcg

SEQ ID NO: 883330 - DNA, 25 bp, Mus musculus
atgccagaaggaggcggcgctctcg

SEQ ID NO: 883331 - DNA, 25 bp, Mus musculus
atgccagacttaaacatttcacagg

SEQ ID NO: 883332 - DNA, 25 bp, Mus musculus
atgccagacttaaactggcccagac

SEQ ID NO: 883333 - DNA, 25 bp, Mus musculus
atgccagacttaaagatttcacagg

SEQ ID NO: 883334 - DNA, 25 bp, Mus musculus
atgccagacttaaagtggcccagac

SEQ ID NO: 883335 - DNA, 25 bp, Mus musculus
atgccagatgagcatcatggctgct

SEQ ID NO: 883336 - DNA, 25 bp, Mus musculus
atgccagatgaggatcatggctgct

SEQ ID NO: 883337 - DNA, 25 bp, Mus musculus
atgccagcacagccacacaaaccaa

SEQ ID NO: 883338 - DNA, 25 bp, Mus musculus
atgccagcacaggcacacaaaccaa

SEQ ID NO: 883339 - DNA, 25 bp, Mus musculus
atgccagcaccccccgccgctcctc

SEQ ID NO: 883340 - DNA, 25 bp, Mus musculus
atgccagcacccgccgccgctcctc

SEQ ID NO: 883341 - DNA, 25 bp, Mus musculus
atgccagcatcacggagcctgtata

SEQ ID NO: 883342 - DNA, 25 bp, Mus musculus
atgccagcatcagggagcctgtata

SEQ ID NO: 883343 - DNA, 25 bp, Mus musculus
atgccagccacacacccacagtctg

SEQ ID NO: 883344 - DNA, 25 bp, Mus musculus
atgccagccacacagccacagtctg

SEQ ID NO: 883345 - DNA, 25 bp, Mus musculus
atgccaggccagcctcctgtgggcc

SEQ ID NO: 883346 - DNA, 25 bp, Mus musculus
atgccaggccaggctcctgtgggcc

SEQ ID NO: 883347 - DNA, 25 bp, Mus musculus
atgccagtaatacaatcaaactaca

SEQ ID NO: 883348 - DNA, 25 bp, Mus musculus
atgccagtaatacattcaaactaca

SEQ ID NO: 883349 - DNA, 25 bp, Mus musculus
atgccagtggcgcagaggtgtttga

SEQ ID NO: 883350 - DNA, 25 bp, Mus musculus
atgccagtggcggagaggtgtttga

SEQ ID NO: 883351 - DNA, 25 bp, Mus musculus
atgccatcaacacgggaattttcac

SEQ ID NO: 883352 - DNA, 25 bp, Mus musculus
atgccatcaacaggggaattttcac

SEQ ID NO: 883353 - DNA, 25 bp, Mus musculus
atgccatcagctctctggcttctgt

SEQ ID NO: 883354 - DNA, 25 bp, Mus musculus
atgccatcaggtctctggcttctgt

SEQ ID NO: 883355 - DNA, 25 bp, Mus musculus
atgccatccaggccgaactgggaga

SEQ ID NO: 883356 - DNA, 25 bp, Mus musculus
atgccatccagggcgaactgggaga

SEQ ID NO: 883357 - DNA, 25 bp, Mus musculus
atgccatggccaaaatccaagcaaa

SEQ ID NO: 883358 - DNA, 25 bp, Mus musculus
atgccatggccataatccaagcaaa

SEQ ID NO: 883359 - DNA, 25 bp, Mus musculus
atgcccaagaggaacgttagcgcgg

SEQ ID NO: 883360 - DNA, 25 bp, Mus musculus
atgcccaagaggaaggttagcgcgg

SEQ ID NO: 883361 - DNA, 25 bp, Mus musculus
atgcccaagccaatcaacgtccggg

SEQ ID NO: 883362 - DNA, 25 bp, Mus musculus
atgcccaagccattcaacgtccggg

SEQ ID NO: 883363 - DNA, 25 bp, Mus musculus
atgcccaatgctctgcgcggactca

SEQ ID NO: 883364 - DNA, 25 bp, Mus musculus
atgcccaatggtctgcgcggactca

SEQ ID NO: 883365 - DNA, 25 bp, Mus musculus
atgcccactgcaggaggtaaaagtt

SEQ ID NO: 883366 - DNA, 25 bp, Mus musculus
atgcccactggaggaggtaaaagtt

SEQ ID NO: 883367 - DNA, 25 bp, Mus musculus
atgcccaggagactttccttctgtc

SEQ ID NO: 883368 - DNA, 25 bp, Mus musculus
atgcccaggagagtttccttctgtc

SEQ ID NO: 883369 - DNA, 25 bp, Mus musculus
atgccccaggaaacacaattagaag

SEQ ID NO: 883370 - DNA, 25 bp, Mus musculus
atgccccaggtaacacaattagaag

SEQ ID NO: 883371 - DNA, 25 bp, Mus musculus
atgccccagtttgactctgtgaaag

SEQ ID NO: 883372 - DNA, 25 bp, Mus musculus
atgccccagtttgagtctgtgaaag

SEQ ID NO: 883373 - DNA, 25 bp, Mus musculus
atgcccctaacacccacggtcagag

SEQ ID NO: 883374 - DNA, 25 bp, Mus musculus
atgcccctaacagccacggtcagag

SEQ ID NO: 883375 - DNA, 25 bp, Mus musculus
atgcccctgcagtacacatatggag

SEQ ID NO: 883376 - DNA, 25 bp, Mus musculus
atgcccctgcagtagacatatggag

SEQ ID NO: 883377 - DNA, 25 bp, Mus musculus
atgcccctgctcaactctgaaaatg

SEQ ID NO: 883378 - DNA, 25 bp, Mus musculus
atgcccctgctcaagtctgaaaatg

SEQ ID NO: 883379 - DNA, 25 bp, Mus musculus
atgccctacaagagttcctcctgct

SEQ ID NO: 883380 - DNA, 25 bp, Mus musculus
atgccctacaagtgttcctcctgct

SEQ ID NO: 883381 - DNA, 25 bp, Mus musculus
atgccctcaacaccttgtctgaaaa

SEQ ID NO: 883382 - DNA, 25 bp, Mus musculus
atgccctcaacagcttgtctgaaaa

SEQ ID NO: 883383 - DNA, 25 bp, Mus musculus
atgccctccgtgaactggaaggcct

SEQ ID NO: 883384 - DNA, 25 bp, Mus musculus
atgccctccgtgaagtggaaggcct

SEQ ID NO: 883385 - DNA, 25 bp, Mus musculus
atgccctggacgttcagtgtggaaa

SEQ ID NO: 883386 - DNA, 25 bp, Mus musculus
atgccctggacgttgagtgtggaaa

SEQ ID NO: 883387 - DNA, 25 bp, Mus musculus
atgccgaatgtcaacgtggcagtgt

SEQ ID NO: 883388 - DNA, 25 bp, Mus musculus
atgccgaatgtcaaggtggcagtgt

SEQ ID NO: 883389 - DNA, 25 bp, Mus musculus
atgccgccagctctacaccagaaag

SEQ ID NO: 883390 - DNA, 25 bp, Mus musculus
atgccgccaggtctacaccagaaag

SEQ ID NO: 883391 - DNA, 25 bp, Mus musculus
atgccgccctttatgtatcccccat

SEQ ID NO: 883392 - DNA, 25 bp, Mus musculus
atgccgccctttttgtatcccccat

SEQ ID NO: 883393 - DNA, 25 bp, Mus musculus
atgccgtgatcacgctgatggtaaa

SEQ ID NO: 883394 - DNA, 25 bp, Mus musculus
atgccgtgatcaggctgatggtaaa

SEQ ID NO: 883395 - DNA, 25 bp, Mus musculus
atgcctacagcaccggaagcagctt

SEQ ID NO: 883396 - DNA, 25 bp, Mus musculus
atgcctacaggaccggaagcagctt

SEQ ID NO: 883397 - DNA, 25 bp, Mus musculus
atgcctacatccagcgttgccccgt

SEQ ID NO: 883398 - DNA, 25 bp, Mus musculus
atgcctacatccagggttgccccgt

SEQ ID NO: 883399 - DNA, 25 bp, Mus musculus
atgcctccgtgctgcgggcagaatc

SEQ ID NO: 883400 - DNA, 25 bp, Mus musculus
atgcctccgtgctgggggcagaatc

SEQ ID NO: 883401 - DNA, 25 bp, Mus musculus
atgcctcctgagaaaacgagggcga

SEQ ID NO: 883402 - DNA, 25 bp, Mus musculus
atgcctcctgtgaaaacgagggcga

SEQ ID NO: 883403 - DNA, 25 bp, Mus musculus
atgcctctgttgatgacagccgtct

SEQ ID NO: 883404 - DNA, 25 bp, Mus musculus
atgcctctgttgttgacagccgtct

SEQ ID NO: 883405 - DNA, 25 bp, Mus musculus
atgcctgacagacgggaatgtgtcc

SEQ ID NO: 883406 - DNA, 25 bp, Mus musculus
atgcctgacagaggggaatgtgtcc

SEQ ID NO: 883407 - DNA, 25 bp, Mus musculus
atgcctgattccaatgattcgcctc

SEQ ID NO: 883408 - DNA, 25 bp, Mus musculus
atgcctgattcctatgattcgcctc

SEQ ID NO: 883409 - DNA, 25 bp, Mus musculus
atgcctgcataacgttataagtaca

SEQ ID NO: 883410 - DNA, 25 bp, Mus musculus
atgcctgcataactgagcaactgtt

SEQ ID NO: 883411 - DNA, 25 bp, Mus musculus
atgcctgcataaggttataagtaca

SEQ ID NO: 883412 - DNA, 25 bp, Mus musculus
atgcctgcataagtgagcaactgtt

SEQ ID NO: 883413 - DNA, 25 bp, Mus musculus
atgcctggaaagcgccaaggagatc

SEQ ID NO: 883414 - DNA, 25 bp, Mus musculus
atgcctggaaagggccaaggagatc

SEQ ID NO: 883415 - DNA, 25 bp, Mus musculus
atgcctgtgctacacagtgtgctca

SEQ ID NO: 883416 - DNA, 25 bp, Mus musculus
atgcctgtgctagacagtgtgctca

SEQ ID NO: 883417 - DNA, 25 bp, Mus musculus
atgccttctcagctgtcatgatgct

SEQ ID NO: 883418 - DNA, 25 bp, Mus musculus
atgccttctcaggtgtcatgatgct

SEQ ID NO: 883419 - DNA, 25 bp, Mus musculus
atgccttgtgccaacttgagcatcg

SEQ ID NO: 883420 - DNA, 25 bp, Mus musculus
atgccttgtgcctacttgagcatcg

SEQ ID NO: 883421 - DNA, 25 bp, Mus musculus
atgcctttgaccggggagacaatcc

SEQ ID NO: 883422 - DNA, 25 bp, Mus musculus
atgcctttgagcggggagacaatcc

SEQ ID NO: 883423 - DNA, 25 bp, Mus musculus
atgcgaagctcccgccatgagaatt

SEQ ID NO: 883424 - DNA, 25 bp, Mus musculus
atgcgaagctccggccatgagaatt

SEQ ID NO: 883425 - DNA, 25 bp, Mus musculus
atgcgaggagagcacgaaatgtggt

SEQ ID NO: 883426 - DNA, 25 bp, Mus musculus
atgcgaggagagcaggaaatgtggt

SEQ ID NO: 883427 - DNA, 25 bp, Mus musculus
atgcgcaaggagcccgtgcagcgag

SEQ ID NO: 883428 - DNA, 25 bp, Mus musculus
atgcgcaaggaggccgtgcagcgag

SEQ ID NO: 883429 - DNA, 25 bp, Mus musculus
atgcgcacagagaacgtggggactc

SEQ ID NO: 883430 - DNA, 25 bp, Mus musculus
atgcgcacagagaaggtggggactc

SEQ ID NO: 883431 - DNA, 25 bp, Mus musculus
atgcgcatggtggacgaccccgtgg

SEQ ID NO: 883432 - DNA, 25 bp, Mus musculus
atgcgcatggtggaggaccccgtgg

SEQ ID NO: 883433 - DNA, 25 bp, Mus musculus
atgcgccacgagaacgtcattgggc

SEQ ID NO: 883434 - DNA, 25 bp, Mus musculus
atgcgccacgagaactggacatttg

SEQ ID NO: 883435 - DNA, 25 bp, Mus musculus
atgcgccacgagaaggtcattgggc

SEQ ID NO: 883436 - DNA, 25 bp, Mus musculus
atgcgccacgagaagtggacatttg

SEQ ID NO: 883437 - DNA, 25 bp, Mus musculus
atgcgcggcccaaccgagcagctta

SEQ ID NO: 883438 - DNA, 25 bp, Mus musculus
atgcgcggccgaaccgagcagctta

SEQ ID NO: 883439 - DNA, 25 bp, Mus musculus
atgcggaaaaccacttcatcaaatt

SEQ ID NO: 883440 - DNA, 25 bp, Mus musculus
atgcggaaaacctcttcatcaaatt

SEQ ID NO: 883441 - DNA, 25 bp, Mus musculus
atgcggactacttacctgaagccag

SEQ ID NO: 883442 - DNA, 25 bp, Mus musculus
atgcggactacttagctgaagccag

SEQ ID NO: 883443 - DNA, 25 bp, Mus musculus
atgcggcccacccacgacctgtgaa

SEQ ID NO: 883444 - DNA, 25 bp, Mus musculus
atgcggcccacccaggacctgtgaa

SEQ ID NO: 883445 - DNA, 25 bp, Mus musculus
atgcgggaatgtcaagcagtaggta

SEQ ID NO: 883446 - DNA, 25 bp, Mus musculus
atgcgggaatgtgaagcagtaggta

SEQ ID NO: 883447 - DNA, 25 bp, Mus musculus
atgcgtctagctcttccaagttgct

SEQ ID NO: 883448 - DNA, 25 bp, Mus musculus
atgcgtctaggtcttccaagttgct

SEQ ID NO: 883449 - DNA, 25 bp, Mus musculus
atgcgtggcgcatccatcctaagcc

SEQ ID NO: 883450 - DNA, 25 bp, Mus musculus
atgcgtggcggatccatcctaagcc

SEQ ID NO: 883451 - DNA, 25 bp, Mus musculus
atgctaacaggacgttggtggttcg

SEQ ID NO: 883452 - DNA, 25 bp, Mus musculus
atgctaacaggaggttggtggttcg

SEQ ID NO: 883453 - DNA, 25 bp, Mus musculus
atgctaatgtgacttccaacgaggg

SEQ ID NO: 883454 - DNA, 25 bp, Mus musculus
atgctaatgtgagttccaacgaggg

SEQ ID NO: 883455 - DNA, 25 bp, Mus musculus
atgctacaaactcacagacaagaca

SEQ ID NO: 883456 - DNA, 25 bp, Mus musculus
atgctacaaactgacagacaagaca

SEQ ID NO: 883457 - DNA, 25 bp, Mus musculus
atgctacaagcacaactcctaatag

SEQ ID NO: 883458 - DNA, 25 bp, Mus musculus
atgctacaagcacatctcctaatag

SEQ ID NO: 883459 - DNA, 25 bp, Mus musculus
atgctacatggcctcccccccttct

SEQ ID NO: 883460 - DNA, 25 bp, Mus musculus
atgctacatggcctgccccccttct

SEQ ID NO: 883461 - DNA, 25 bp, Mus musculus
atgctacgagcttccatatcaacct

SEQ ID NO: 883462 - DNA, 25 bp, Mus musculus
atgctacgaggttccatatcaacct

SEQ ID NO: 883463 - DNA, 25 bp, Mus musculus
atgctactgtgcgcaatggatctgt

SEQ ID NO: 883464 - DNA, 25 bp, Mus musculus
atgctactgtgcgctatggatctgt

SEQ ID NO: 883465 - DNA, 25 bp, Mus musculus
atgctagatgcacctgtcattaaga

SEQ ID NO: 883466 - DNA, 25 bp, Mus musculus
atgctagatgcagctgtcattaaga

SEQ ID NO: 883467 - DNA, 25 bp, Mus musculus
atgctagcagagcggcggcggaagc

SEQ ID NO: 883468 - DNA, 25 bp, Mus musculus
atgctagcagaggggcggcggaagc

SEQ ID NO: 883469 - DNA, 25 bp, Mus musculus
atgctagcagcctagcagaaatgga

SEQ ID NO: 883470 - DNA, 25 bp, Mus musculus
atgctagcaggctagcagaaatgga

SEQ ID NO: 883471 - DNA, 25 bp, Mus musculus
atgctaggaacaaacagaacctgca

SEQ ID NO: 883472 - DNA, 25 bp, Mus musculus
atgctaggaacaaacagaccccgag

SEQ ID NO: 883473 - DNA, 25 bp, Mus musculus
atgctaggaacaaacgtcaggtgcc

SEQ ID NO: 883474 - DNA, 25 bp, Mus musculus
atgctaggaacaaagagaacctgca

SEQ ID NO: 883475 - DNA, 25 bp, Mus musculus
atgctaggaacaaagagaccccgag

SEQ ID NO: 883476 - DNA, 25 bp, Mus musculus
atgctaggaacaaaggtcaggtgcc

SEQ ID NO: 883477 - DNA, 25 bp, Mus musculus
atgctatccagaagtacgtgccctg

SEQ ID NO: 883478 - DNA, 25 bp, Mus musculus
atgctatccagatgtacgtgccctg

SEQ ID NO: 883479 - DNA, 25 bp, Mus musculus
atgctatgtcagaaggcttatcagg

SEQ ID NO: 883480 - DNA, 25 bp, Mus musculus
atgctatgtcagcaaaccatccaat

SEQ ID NO: 883481 - DNA, 25 bp, Mus musculus
atgctatgtcaggaaaccatccaat

SEQ ID NO: 883482 - DNA, 25 bp, Mus musculus
atgctatgtcagtaggcttatcagg

SEQ ID NO: 883483 - DNA, 25 bp, Mus musculus
atgctattaaagctggagagtaagg

SEQ ID NO: 883484 - DNA, 25 bp, Mus musculus
atgctattaaagctggtgagaaatg

SEQ ID NO: 883485 - DNA, 25 bp, Mus musculus
atgctattaaaggtggagagtaagg

SEQ ID NO: 883486 - DNA, 25 bp, Mus musculus
atgctattaaaggtggtgagaaatg

SEQ ID NO: 883487 - DNA, 25 bp, Mus musculus
atgctattgaagaccgctgtgtggt

SEQ ID NO: 883488 - DNA, 25 bp, Mus musculus
atgctattgaagacggctgtgtggt

SEQ ID NO: 883489 - DNA, 25 bp, Mus musculus
atgctcaaagccatcgtttgactct

SEQ ID NO: 883490 - DNA, 25 bp, Mus musculus
atgctcaaagccatggtttgactct

SEQ ID NO: 883491 - DNA, 25 bp, Mus musculus
atgctcaacgccaacctcgctgttc

SEQ ID NO: 883492 - DNA, 25 bp, Mus musculus
atgctcaacgccaagctcgctgttc

SEQ ID NO: 883493 - DNA, 25 bp, Mus musculus
atgctcaagcaacgagcagactctg

SEQ ID NO: 883494 - DNA, 25 bp, Mus musculus
atgctcaagcaaggagcagactctg

SEQ ID NO: 883495 - DNA, 25 bp, Mus musculus
atgctcaaggctaacgcccaggccc

SEQ ID NO: 883496 - DNA, 25 bp, Mus musculus
atgctcaaggctaaggcccaggccc

SEQ ID NO: 883497 - DNA, 25 bp, Mus musculus
atgctcactggatccccgcccttca

SEQ ID NO: 883498 - DNA, 25 bp, Mus musculus
atgctcactggatcgccgcccttca

SEQ ID NO: 883499 - DNA, 25 bp, Mus musculus
atgctcatcgcctacccaccattct

SEQ ID NO: 883500 - DNA, 25 bp, Mus musculus
atgctcatcggctacccaccattct

SEQ ID NO: 883501 - DNA, 25 bp, Mus musculus
atgctcatgttctacgcagcaagag

SEQ ID NO: 883502 - DNA, 25 bp, Mus musculus
atgctcatgttctaggcagcaagag

SEQ ID NO: 883503 - DNA, 25 bp, Mus musculus
atgctcccgctaagtcgtcagcgca

SEQ ID NO: 883504 - DNA, 25 bp, Mus musculus
atgctcccgctactgttgcagaggt

SEQ ID NO: 883505 - DNA, 25 bp, Mus musculus
atgctcccgctagtgttgcagaggt

SEQ ID NO: 883506 - DNA, 25 bp, Mus musculus
atgctcccgctatgtcgtcagcgca

SEQ ID NO: 883507 - DNA, 25 bp, Mus musculus
atgctccgtggtccaccggcttcgg

SEQ ID NO: 883508 - DNA, 25 bp, Mus musculus
atgctccgtggtgcaccggcttcgg

SEQ ID NO: 883509 - DNA, 25 bp, Mus musculus
atgctcctgaagcctgggtggtcag

SEQ ID NO: 883510 - DNA, 25 bp, Mus musculus
atgctcctgaaggctgggtggtcag

SEQ ID NO: 883511 - DNA, 25 bp, Mus musculus
atgctctataagcatgttcgcaacc

SEQ ID NO: 883512 - DNA, 25 bp, Mus musculus
atgctctataaggatgttcgcaacc

SEQ ID NO: 883513 - DNA, 25 bp, Mus musculus
atgctcttttctcgtacaaacattg

SEQ ID NO: 883514 - DNA, 25 bp, Mus musculus
atgctcttttctggtacaaacattg

SEQ ID NO: 883515 - DNA, 25 bp, Mus musculus
atgctgaaactgaatgccatgttcc

SEQ ID NO: 883516 - DNA, 25 bp, Mus musculus
atgctgaaactgtatgccatgttcc

SEQ ID NO: 883517 - DNA, 25 bp, Mus musculus
atgctgaaagacaatgcctccgaca

SEQ ID NO: 883518 - DNA, 25 bp, Mus musculus
atgctgaaagatgatgcgactgaca

SEQ ID NO: 883519 - DNA, 25 bp, Mus musculus
atgctgaaagtcaatgcctccgaca

SEQ ID NO: 883520 - DNA, 25 bp, Mus musculus
atgctgaaagttgatgcgactgaca

SEQ ID NO: 883521 - DNA, 25 bp, Mus musculus
atgctgaaatcgacagccagaagta

SEQ ID NO: 883522 - DNA, 25 bp, Mus musculus
atgctgaaatggacagccagaagta

SEQ ID NO: 883523 - DNA, 25 bp, Mus musculus
atgctgaaggaacgtgtgcgccttg

SEQ ID NO: 883524 - DNA, 25 bp, Mus musculus
atgctgaaggaaggtgtgcgccttg

SEQ ID NO: 883525 - DNA, 25 bp, Mus musculus
atgctgaagtcattcagcccctgcc

SEQ ID NO: 883526 - DNA, 25 bp, Mus musculus
atgctgaagtgattcagcccctgcc

SEQ ID NO: 883527 - DNA, 25 bp, Mus musculus
atgctgaatgccaagagctacgatg

SEQ ID NO: 883528 - DNA, 25 bp, Mus musculus
atgctgaatgctattttgacagaga

SEQ ID NO: 883529 - DNA, 25 bp, Mus musculus
atgctgaatggcaagagctacgatg

SEQ ID NO: 883530 - DNA, 25 bp, Mus musculus
atgctgaatggtattttgacagaga

SEQ ID NO: 883531 - DNA, 25 bp, Mus musculus
atgctgacagctcctcatggactcc

SEQ ID NO: 883532 - DNA, 25 bp, Mus musculus
atgctgacaggtcctcatggactcc

SEQ ID NO: 883533 - DNA, 25 bp, Mus musculus
atgctgagacagcatataagctggt

SEQ ID NO: 883534 - DNA, 25 bp, Mus musculus
atgctgagacaggatataagctggt

SEQ ID NO: 883535 - DNA, 25 bp, Mus musculus
atgctgatggattctctgctctcca

SEQ ID NO: 883536 - DNA, 25 bp, Mus musculus
atgctgatggtttctctgctctcca

SEQ ID NO: 883537 - DNA, 25 bp, Mus musculus
atgctgattgcatttgctatctact

SEQ ID NO: 883538 - DNA, 25 bp, Mus musculus
atgctgattggatttgctatctact

SEQ ID NO: 883539 - DNA, 25 bp, Mus musculus
atgctgcaaaagaaatatccaaggg

SEQ ID NO: 883540 - DNA, 25 bp, Mus musculus
atgctgcaaaagaattatccaaggg

SEQ ID NO: 883541 - DNA, 25 bp, Mus musculus
atgctgcagagcaacatctcagaaa

SEQ ID NO: 883542 - DNA, 25 bp, Mus musculus
atgctgcagagctacatctcagaaa

SEQ ID NO: 883543 - DNA, 25 bp, Mus musculus
atgctgccaaagcataccatacttg

SEQ ID NO: 883544 - DNA, 25 bp, Mus musculus
atgctgccaaaggataccatacttg

SEQ ID NO: 883545 - DNA, 25 bp, Mus musculus
atgctgccctcacgccctgcagttc

SEQ ID NO: 883546 - DNA, 25 bp, Mus musculus
atgctgccctcaggccctgcagttc

SEQ ID NO: 883547 - DNA, 25 bp, Mus musculus
atgctgcgccttaacgaggaagagc

SEQ ID NO: 883548 - DNA, 25 bp, Mus musculus
atgctgcgccttaaggaggaagagc

SEQ ID NO: 883549 - DNA, 25 bp, Mus musculus
atgctgctggaaaacactcagtttt

SEQ ID NO: 883550 - DNA, 25 bp, Mus musculus
atgctgctggaaaagactcagtttt

SEQ ID NO: 883551 - DNA, 25 bp, Mus musculus
atgctgctttctcgtcccaccagca

SEQ ID NO: 883552 - DNA, 25 bp, Mus musculus
atgctgctttctggtcccaccagca

SEQ ID NO: 883553 - DNA, 25 bp, Mus musculus
atgctggacaatttaggctacagaa

SEQ ID NO: 883554 - DNA, 25 bp, Mus musculus
atgctggacaattttggctacagaa

SEQ ID NO: 883555 - DNA, 25 bp, Mus musculus
atgctggagaatcttctctgtccac

SEQ ID NO: 883556 - DNA, 25 bp, Mus musculus
atgctggagaatgttctctgtccac

SEQ ID NO: 883557 - DNA, 25 bp, Mus musculus
atgctggagtttcacgaactaatga

SEQ ID NO: 883558 - DNA, 25 bp, Mus musculus
atgctggagtttcaggaactaatga

SEQ ID NO: 883559 - DNA, 25 bp, Mus musculus
atgctggatgatactatcgtggagc

SEQ ID NO: 883560 - DNA, 25 bp, Mus musculus
atgctggatgttactatcgtggagc

SEQ ID NO: 883561 - DNA, 25 bp, Mus musculus
atgctggcaaagccgggttccagca

SEQ ID NO: 883562 - DNA, 25 bp, Mus musculus
atgctggcaaaggcgggttccagca

SEQ ID NO: 883563 - DNA, 25 bp, Mus musculus
atgctggcagagcccaacgatgaga

SEQ ID NO: 883564 - DNA, 25 bp, Mus musculus
atgctggcagctatctgtgtgactt

SEQ ID NO: 883565 - DNA, 25 bp, Mus musculus
atgctggcaggtatctgtgtgactt

SEQ ID NO: 883566 - DNA, 25 bp, Mus musculus
atgctggcagtgcccaacgatgaga

SEQ ID NO: 883567 - DNA, 25 bp, Mus musculus
atgctggcccttaccgtcttggaaa

SEQ ID NO: 883568 - DNA, 25 bp, Mus musculus
atgctggcccttacctcctgggctg

SEQ ID NO: 883569 - DNA, 25 bp, Mus musculus
atgctggcccttacggtcttggaaa

SEQ ID NO: 883570 - DNA, 25 bp, Mus musculus
atgctggcccttacgtcctgggctg

SEQ ID NO: 883571 - DNA, 25 bp, Mus musculus
atgctggcctggcgttccacgccta

SEQ ID NO: 883572 - DNA, 25 bp, Mus musculus
atgctggcctggggttccacgccta

SEQ ID NO: 883573 - DNA, 25 bp, Mus musculus
atgctgggaggacgtggcccagagt

SEQ ID NO: 883574 - DNA, 25 bp, Mus musculus
atgctgggaggaggtggcccagagt

SEQ ID NO: 883575 - DNA, 25 bp, Mus musculus
atgctggtggagctcatcctctcca

SEQ ID NO: 883576 - DNA, 25 bp, Mus musculus
atgctggtggaggtcatcctctcca

SEQ ID NO: 883577 - DNA, 25 bp, Mus musculus
atgctggtgtccgacatgcatgctg

SEQ ID NO: 883578 - DNA, 25 bp, Mus musculus
atgctggtgtccgacgtcttcagat

SEQ ID NO: 883579 - DNA, 25 bp, Mus musculus
atgctggtgtccgactgtcctgcag

SEQ ID NO: 883580 - DNA, 25 bp, Mus musculus
atgctggtgtccgagatgcatgctg

SEQ ID NO: 883581 - DNA, 25 bp, Mus musculus
atgctggtgtccgaggtcttcagat

SEQ ID NO: 883582 - DNA, 25 bp, Mus musculus
atgctggtgtccgagtgtcctgcag

SEQ ID NO: 883583 - DNA, 25 bp, Mus musculus
atgctgtaccacaacgctggacact

SEQ ID NO: 883584 - DNA, 25 bp, Mus musculus
atgctgtaccacaaggctggacact

SEQ ID NO: 883585 - DNA, 25 bp, Mus musculus
atgctgtatctggtcctctaccttc

SEQ ID NO: 883586 - DNA, 25 bp, Mus musculus
atgctgtatctggtgctctaccttc

SEQ ID NO: 883587 - DNA, 25 bp, Mus musculus
atgctgtcagatccccctgtttggc

SEQ ID NO: 883588 - DNA, 25 bp, Mus musculus
atgctgtcagttccccctgtttggc

SEQ ID NO: 883589 - DNA, 25 bp, Mus musculus
atgctgtcattgcggcggatgtggt

SEQ ID NO: 883590 - DNA, 25 bp, Mus musculus
atgctgtcattggggcggatgtggt

SEQ ID NO: 883591 - DNA, 25 bp, Mus musculus
atgctgtcggaggctacagatgtct

SEQ ID NO: 883592 - DNA, 25 bp, Mus musculus
atgctgtcggtggctacagatgtct

SEQ ID NO: 883593 - DNA, 25 bp, Mus musculus
atgctgtgaatctgattcccatgct

SEQ ID NO: 883594 - DNA, 25 bp, Mus musculus
atgctgtgaatctgtttcccatgct

SEQ ID NO: 883595 - DNA, 25 bp, Mus musculus
atgctgtgagacatgcaagaaagca

SEQ ID NO: 883596 - DNA, 25 bp, Mus musculus
atgctgtgagcacgacagaaaatgt

SEQ ID NO: 883597 - DNA, 25 bp, Mus musculus
atgctgtgaggacgacagaaaatgt

SEQ ID NO: 883598 - DNA, 25 bp, Mus musculus
atgctgtgagtcatgcaagaaagca

SEQ ID NO: 883599 - DNA, 25 bp, Mus musculus
atgctgtggagaatcatgacttgca

SEQ ID NO: 883600 - DNA, 25 bp, Mus musculus
atgctgtggagattcatgacttgca

SEQ ID NO: 883601 - DNA, 25 bp, Mus musculus
atgctgtggcagaacaagccacgct

SEQ ID NO: 883602 - DNA, 25 bp, Mus musculus
atgctgtggcagaagaagccacgct

SEQ ID NO: 883603 - DNA, 25 bp, Mus musculus
atgctgtttgtcgcactttatcttc

SEQ ID NO: 883604 - DNA, 25 bp, Mus musculus
atgctgtttgtcgctctttatcttc

SEQ ID NO: 883605 - DNA, 25 bp, Mus musculus
atgcttcgagatgaaggaggttttg

SEQ ID NO: 883606 - DNA, 25 bp, Mus musculus
atgcttcgagatgatggaggttttg

SEQ ID NO: 883607 - DNA, 25 bp, Mus musculus
atgcttcggaaactccttcaggctc

SEQ ID NO: 883608 - DNA, 25 bp, Mus musculus
atgcttcggaaagtccttcaggctc

SEQ ID NO: 883609 - DNA, 25 bp, Mus musculus
atgcttctcggacggtctgccagtg

SEQ ID NO: 883610 - DNA, 25 bp, Mus musculus
atgcttctcggagggtctgccagtg

SEQ ID NO: 883611 - DNA, 25 bp, Mus musculus
atgcttctgttggacataccttcct

SEQ ID NO: 883612 - DNA, 25 bp, Mus musculus
atgcttctgttggagataccttcct

SEQ ID NO: 883613 - DNA, 25 bp, Mus musculus
atgcttgcaacgaccttcgtgagaa

SEQ ID NO: 883614 - DNA, 25 bp, Mus musculus
atgcttgcaaggaccttcgtgagaa

SEQ ID NO: 883615 - DNA, 25 bp, Mus musculus
atgcttgccttaaacgtaatgctgc

SEQ ID NO: 883616 - DNA, 25 bp, Mus musculus
atgcttgccttaaaggtaatgctgc

SEQ ID NO: 883617 - DNA, 25 bp, Mus musculus
atgcttgttaagctgaatgccctta

SEQ ID NO: 883618 - DNA, 25 bp, Mus musculus
atgcttgttaaggtgaatgccctta

SEQ ID NO: 883619 - DNA, 25 bp, Mus musculus
atgctttaacagcttgttccatgcc

SEQ ID NO: 883620 - DNA, 25 bp, Mus musculus
atgctttaacaggttgttccatgcc

SEQ ID NO: 883621 - DNA, 25 bp, Mus musculus
atgctttcagagctttacaggtggt

SEQ ID NO: 883622 - DNA, 25 bp, Mus musculus
atgctttcagaggtttacaggtggt

SEQ ID NO: 883623 - DNA, 25 bp, Mus musculus
atgctttgggcttcatgtgtccatt

SEQ ID NO: 883624 - DNA, 25 bp, Mus musculus
atgctttgggcttcttgtgtccatt

SEQ ID NO: 883625 - DNA, 25 bp, Mus musculus
atggaaaatgattcaacctggatga

SEQ ID NO: 883626 - DNA, 25 bp, Mus musculus
atggaaaatgtttcaacctggatga

SEQ ID NO: 883627 - DNA, 25 bp, Mus musculus
atggaaactaagccattactcatca

SEQ ID NO: 883628 - DNA, 25 bp, Mus musculus
atggaaactaagcctggccttgtgg

SEQ ID NO: 883629 - DNA, 25 bp, Mus musculus
atggaaactaaggcattactcatca

SEQ ID NO: 883630 - DNA, 25 bp, Mus musculus
atggaaactaaggctggccttgtgg

SEQ ID NO: 883631 - DNA, 25 bp, Mus musculus
atggaaagtgataagaaagattgga

SEQ ID NO: 883632 - DNA, 25 bp, Mus musculus
atggaaagtgttaagaaagattgga

SEQ ID NO: 883633 - DNA, 25 bp, Mus musculus
atggaaatacagcaaccaaagtcaa

SEQ ID NO: 883634 - DNA, 25 bp, Mus musculus
atggaaatacaggaaccaaagtcaa

SEQ ID NO: 883635 - DNA, 25 bp, Mus musculus
atggaacaatcacacacagcttacc

SEQ ID NO: 883636 - DNA, 25 bp, Mus musculus
atggaacaatcacacaggccagaag

SEQ ID NO: 883637 - DNA, 25 bp, Mus musculus
atggaacaatcacacgtgtagatgt

SEQ ID NO: 883638 - DNA, 25 bp, Mus musculus
atggaacaatcacagacagcttacc

SEQ ID NO: 883639 - DNA, 25 bp, Mus musculus
atggaacaatcacagaggccagaag

SEQ ID NO: 883640 - DNA, 25 bp, Mus musculus
atggaacaatcacaggtgtagatgt

SEQ ID NO: 883641 - DNA, 25 bp, Mus musculus
atggaacccaagcccacgttgaagt

SEQ ID NO: 883642 - DNA, 25 bp, Mus musculus
atggaacccaagccgacgttgaagt

SEQ ID NO: 883643 - DNA, 25 bp, Mus musculus
atggaaccgatcagaatatacactt

SEQ ID NO: 883644 - DNA, 25 bp, Mus musculus
atggaaccgatcagtatatacactt

SEQ ID NO: 883645 - DNA, 25 bp, Mus musculus
atggaacggcagatcataatgttca

SEQ ID NO: 883646 - DNA, 25 bp, Mus musculus
atggaacggcagatctggtacacgg

SEQ ID NO: 883647 - DNA, 25 bp, Mus musculus
atggaacggcagatgataatgttca

SEQ ID NO: 883648 - DNA, 25 bp, Mus musculus
atggaacggcagatgtggtacacgg

SEQ ID NO: 883649 - DNA, 25 bp, Mus musculus
atggaagagccacgggagaagtgca

SEQ ID NO: 883650 - DNA, 25 bp, Mus musculus
atggaagagccaggggagaagtgca

SEQ ID NO: 883651 - DNA, 25 bp, Mus musculus
atggaagattctcgcacttcaccaa

SEQ ID NO: 883652 - DNA, 25 bp, Mus musculus
atggaagattctggcacttcaccaa

SEQ ID NO: 883653 - DNA, 25 bp, Mus musculus
atggaagcagaactcttcctaatga

SEQ ID NO: 883654 - DNA, 25 bp, Mus musculus
atggaagcagtactcttcctaatga

SEQ ID NO: 883655 - DNA, 25 bp, Mus musculus
atggaagccaagctgaaagccgccc

SEQ ID NO: 883656 - DNA, 25 bp, Mus musculus
atggaagccaaggtgaaagccgccc

SEQ ID NO: 883657 - DNA, 25 bp, Mus musculus
atggaagccgagctctgcattacat

SEQ ID NO: 883658 - DNA, 25 bp, Mus musculus
atggaagccgaggtctgcattacat

SEQ ID NO: 883659 - DNA, 25 bp, Mus musculus
atggaagctgtgaggaaagaagcaa

SEQ ID NO: 883660 - DNA, 25 bp, Mus musculus
atggaagctgtgtggaaagaagcaa

SEQ ID NO: 883661 - DNA, 25 bp, Mus musculus
atggaagtccttaacgtgcagaccc

SEQ ID NO: 883662 - DNA, 25 bp, Mus musculus
atggaagtccttaaggtgcagaccc

SEQ ID NO: 883663 - DNA, 25 bp, Mus musculus
atggaatcagctgccaacaggctgc

SEQ ID NO: 883664 - DNA, 25 bp, Mus musculus
atggaatcagctgctctgccctgtc

SEQ ID NO: 883665 - DNA, 25 bp, Mus musculus
atggaatcaggtgccaacaggctgc

SEQ ID NO: 883666 - DNA, 25 bp, Mus musculus
atggaatcaggtgctctgccctgtc

SEQ ID NO: 883667 - DNA, 25 bp, Mus musculus
atggaatctgactctctcctctctt

SEQ ID NO: 883668 - DNA, 25 bp, Mus musculus
atggaatctgtctctctcctctctt

SEQ ID NO: 883669 - DNA, 25 bp, Mus musculus
atggaatcttatctaaaacatcaag

SEQ ID NO: 883670 - DNA, 25 bp, Mus musculus
atggaatcttatgtaaaacatcaag

SEQ ID NO: 883671 - DNA, 25 bp, Mus musculus
atggaatgaccacgtttgtgggcat

SEQ ID NO: 883672 - DNA, 25 bp, Mus musculus
atggaatgaccaggtttgtgggcat

SEQ ID NO: 883673 - DNA, 25 bp, Mus musculus
atggaattacactccaccttgtcaa

SEQ ID NO: 883674 - DNA, 25 bp, Mus musculus
atggaattacactcgaccttgtcaa

SEQ ID NO: 883675 - DNA, 25 bp, Mus musculus
atggacaatcagagcactgtccagg

SEQ ID NO: 883676 - DNA, 25 bp, Mus musculus
atggacaatcagcgcctgttggtct

SEQ ID NO: 883677 - DNA, 25 bp, Mus musculus
atggacaatcagggcctgttggtct

SEQ ID NO: 883678 - DNA, 25 bp, Mus musculus
atggacaatcagtgcactgtccagg

SEQ ID NO: 883679 - DNA, 25 bp, Mus musculus
atggacaatgcaatttctgccagct

SEQ ID NO: 883680 - DNA, 25 bp, Mus musculus
atggacaatgcattttctgccagct

SEQ ID NO: 883681 - DNA, 25 bp, Mus musculus
atggacagatgtccactcccgagac

SEQ ID NO: 883682 - DNA, 25 bp, Mus musculus
atggacagatgtgcactcccgagac

SEQ ID NO: 883683 - DNA, 25 bp, Mus musculus
atggacagcaagaattgacagtacc

SEQ ID NO: 883684 - DNA, 25 bp, Mus musculus
atggacagcaagtattgacagtacc

SEQ ID NO: 883685 - DNA, 25 bp, Mus musculus
atggacatatcaattactgggattc

SEQ ID NO: 883686 - DNA, 25 bp, Mus musculus
atggacatatcatttactgggattc

SEQ ID NO: 883687 - DNA, 25 bp, Mus musculus
atggacatcctgaactactttgaga

SEQ ID NO: 883688 - DNA, 25 bp, Mus musculus
atggacatcctgcctccttccttgt

SEQ ID NO: 883689 - DNA, 25 bp, Mus musculus
atggacatcctggctccttccttgt

SEQ ID NO: 883690 - DNA, 25 bp, Mus musculus
atggacatcctgtactactttgaga

SEQ ID NO: 883691 - DNA, 25 bp, Mus musculus
atggacatggagactcgccttttcc

SEQ ID NO: 883692 - DNA, 25 bp, Mus musculus
atggacatggagtctcgccttttcc

SEQ ID NO: 883693 - DNA, 25 bp, Mus musculus
atggaccaagcggtaggtctggtgc

SEQ ID NO: 883694 - DNA, 25 bp, Mus musculus
atggaccaagctgttggggccactc

SEQ ID NO: 883695 - DNA, 25 bp, Mus musculus
atggaccaaggggtaggtctggtgc

SEQ ID NO: 883696 - DNA, 25 bp, Mus musculus
atggaccaaggtgttggggccactc

SEQ ID NO: 883697 - DNA, 25 bp, Mus musculus
atggacccagaacatgtagagctgg

SEQ ID NO: 883698 - DNA, 25 bp, Mus musculus
atggacccagagatttcctgcaaaa

SEQ ID NO: 883699 - DNA, 25 bp, Mus musculus
atggacccagagttttcctgcaaaa

SEQ ID NO: 883700 - DNA, 25 bp, Mus musculus
atggacccagtacatgtagagctgg

SEQ ID NO: 883701 - DNA, 25 bp, Mus musculus
atggaccccgagccagagtctttgt

SEQ ID NO: 883702 - DNA, 25 bp, Mus musculus
atggaccccgaggcagagtctttgt

SEQ ID NO: 883703 - DNA, 25 bp, Mus musculus
atggaccgccagccactgggaaaac

SEQ ID NO: 883704 - DNA, 25 bp, Mus musculus
atggaccgccaggcactgggaaaac

SEQ ID NO: 883705 - DNA, 25 bp, Mus musculus
atggacctcacaaacgtagttcttc

SEQ ID NO: 883706 - DNA, 25 bp, Mus musculus
atggacctcacaaaggtagttcttc

SEQ ID NO: 883707 - DNA, 25 bp, Mus musculus
atggacctcccacagtttactgact

SEQ ID NO: 883708 - DNA, 25 bp, Mus musculus
atggacctcccactttactgactgc

SEQ ID NO: 883709 - DNA, 25 bp, Mus musculus
atggacctcccagagtttactgact

SEQ ID NO: 883710 - DNA, 25 bp, Mus musculus
atggacctcccagtttactgactgc

SEQ ID NO: 883711 - DNA, 25 bp, Mus musculus
atggacgactgaaacatatcgatga

SEQ ID NO: 883712 - DNA, 25 bp, Mus musculus
atggacgactgaaagatatcgatga

SEQ ID NO: 883713 - DNA, 25 bp, Mus musculus
atggacgcagcttctccaaacctct

SEQ ID NO: 883714 - DNA, 25 bp, Mus musculus
atggacgcaggttctccaaacctct

SEQ ID NO: 883715 - DNA, 25 bp, Mus musculus
atggacggcaagctcggctcctgcg

SEQ ID NO: 883716 - DNA, 25 bp, Mus musculus
atggacggcaaggtcggctcctgcg

SEQ ID NO: 883717 - DNA, 25 bp, Mus musculus
atggacgtcaccgacgatgaagagg

SEQ ID NO: 883718 - DNA, 25 bp, Mus musculus
atggacgtcaccgaggatgaagagg

SEQ ID NO: 883719 - DNA, 25 bp, Mus musculus
atggactcgggtcgcaacctccagc

SEQ ID NO: 883720 - DNA, 25 bp, Mus musculus
atggactcgggtcggaacctccagc

SEQ ID NO: 883721 - DNA, 25 bp, Mus musculus
atggactctgatagcagagcgtttc

SEQ ID NO: 883722 - DNA, 25 bp, Mus musculus
atggactctgattgcagagcgtttc

SEQ ID NO: 883723 - DNA, 25 bp, Mus musculus
atggactgcatgcagggccgtgtag

SEQ ID NO: 883724 - DNA, 25 bp, Mus musculus
atggactgcatggagggccgtgtag

SEQ ID NO: 883725 - DNA, 25 bp, Mus musculus
atggactttaagcacacttggatat

SEQ ID NO: 883726 - DNA, 25 bp, Mus musculus
atggactttaaggacacttggatat

SEQ ID NO: 883727 - DNA, 25 bp, Mus musculus
atggagaaatccaaccatatcttcg

SEQ ID NO: 883728 - DNA, 25 bp, Mus musculus
atggagaaatgcaaccatatcttcg

SEQ ID NO: 883729 - DNA, 25 bp, Mus musculus
atggagaactatgacgctctcctga

SEQ ID NO: 883730 - DNA, 25 bp, Mus musculus
atggagaactatgaggctctcctga

SEQ ID NO: 883731 - DNA, 25 bp, Mus musculus
atggagaatgctaccgcgcccgggt

SEQ ID NO: 883732 - DNA, 25 bp, Mus musculus
atggagaatggtaccgcgcccgggt

SEQ ID NO: 883733 - DNA, 25 bp, Mus musculus
atggagaattgacaaaatggagctg

SEQ ID NO: 883734 - DNA, 25 bp, Mus musculus
atggagaattgagaaaatggagctg

SEQ ID NO: 883735 - DNA, 25 bp, Mus musculus
atggagacaccctgctccacctggc

SEQ ID NO: 883736 - DNA, 25 bp, Mus musculus
atggagacacgctgctccacctggc

SEQ ID NO: 883737 - DNA, 25 bp, Mus musculus
atggagacagaacctcatcagaaca

SEQ ID NO: 883738 - DNA, 25 bp, Mus musculus
atggagacagaacgtggtggagact

SEQ ID NO: 883739 - DNA, 25 bp, Mus musculus
atggagacagaagctcatcagaaca

SEQ ID NO: 883740 - DNA, 25 bp, Mus musculus
atggagacagaaggtggtggagact

SEQ ID NO: 883741 - DNA, 25 bp, Mus musculus
atggagacagcgcgcgagtttgtag

SEQ ID NO: 883742 - DNA, 25 bp, Mus musculus
atggagacagcgggcgagtttgtag

SEQ ID NO: 883743 - DNA, 25 bp, Mus musculus
atggagactgcattcacatagatga

SEQ ID NO: 883744 - DNA, 25 bp, Mus musculus
atggagactgcattgacatagatga

SEQ ID NO: 883745 - DNA, 25 bp, Mus musculus
atggagagcaccaaggagcctggct

SEQ ID NO: 883746 - DNA, 25 bp, Mus musculus
atggagagcagcaaggagcctggct

SEQ ID NO: 883747 - DNA, 25 bp, Mus musculus
atggagagcatgacaaatgcggtgc

SEQ ID NO: 883748 - DNA, 25 bp, Mus musculus
atggagagcatgtcaaatgcggtgc

SEQ ID NO: 883749 - DNA, 25 bp, Mus musculus
atggagatagccttgccagatgaga

SEQ ID NO: 883750 - DNA, 25 bp, Mus musculus
atggagataggcttgccagatgaga

SEQ ID NO: 883751 - DNA, 25 bp, Mus musculus
atggagatatcgatattatgtcctt

SEQ ID NO: 883752 - DNA, 25 bp, Mus musculus
atggagatatcgttattatgtcctt

SEQ ID NO: 883753 - DNA, 25 bp, Mus musculus
atggagatcatgcaggcctactcgg

SEQ ID NO: 883754 - DNA, 25 bp, Mus musculus
atggagatcatggaggcctactcgg

SEQ ID NO: 883755 - DNA, 25 bp, Mus musculus
atggagatggaacaggtccagtccc

SEQ ID NO: 883756 - DNA, 25 bp, Mus musculus
atggagatggaagaggtccagtccc

SEQ ID NO: 883757 - DNA, 25 bp, Mus musculus
atggagatggatgacctactggtag

SEQ ID NO: 883758 - DNA, 25 bp, Mus musculus
atggagatggcctagatgacctact

SEQ ID NO: 883759 - DNA, 25 bp, Mus musculus
atggagatgggctagatgacctact

SEQ ID NO: 883760 - DNA, 25 bp, Mus musculus
atggagatggttgacctactggtag

SEQ ID NO: 883761 - DNA, 25 bp, Mus musculus
atggagcaagatcattccctgatgt

SEQ ID NO: 883762 - DNA, 25 bp, Mus musculus
atggagcaagttcattccctgatgt

SEQ ID NO: 883763 - DNA, 25 bp, Mus musculus
atggagcaggagccctgcctagccc

SEQ ID NO: 883764 - DNA, 25 bp, Mus musculus
atggagcaggtgccctgcctagccc

SEQ ID NO: 883765 - DNA, 25 bp, Mus musculus
atggagcccagaagatgtttggaat

SEQ ID NO: 883766 - DNA, 25 bp, Mus musculus
atggagcccagaagttgtttggaat

SEQ ID NO: 883767 - DNA, 25 bp, Mus musculus
atggagccccagcgtacccagccag

SEQ ID NO: 883768 - DNA, 25 bp, Mus musculus
atggagccccagggtacccagccag

SEQ ID NO: 883769 - DNA, 25 bp, Mus musculus
atggagccttggatgaagttgtgct

SEQ ID NO: 883770 - DNA, 25 bp, Mus musculus
atggagccttggttgaagttgtgct

SEQ ID NO: 883771 - DNA, 25 bp, Mus musculus
atggagctctatctacctccagtgt

SEQ ID NO: 883772 - DNA, 25 bp, Mus musculus
atggagctctttctacctccagtgt

SEQ ID NO: 883773 - DNA, 25 bp, Mus musculus
atggaggagcagcccgtgtatcttc

SEQ ID NO: 883774 - DNA, 25 bp, Mus musculus
atggaggagcagccggtgtatcttc

SEQ ID NO: 883775 - DNA, 25 bp, Mus musculus
atggaggccgagcctgagaatcagg

SEQ ID NO: 883776 - DNA, 25 bp, Mus musculus
atggaggccgaggctgagaatcagg

SEQ ID NO: 883777 - DNA, 25 bp, Mus musculus
atggaggccggacaggagccgctgc

SEQ ID NO: 883778 - DNA, 25 bp, Mus musculus
atggaggccggagaggagccgctgc

SEQ ID NO: 883779 - DNA, 25 bp, Mus musculus
atggaggctgcacacagcagctttg

SEQ ID NO: 883780 - DNA, 25 bp, Mus musculus
atggaggctgcagacagcagctttg

SEQ ID NO: 883781 - DNA, 25 bp, Mus musculus
atggaggctgccatcgtcactacgt

SEQ ID NO: 883782 - DNA, 25 bp, Mus musculus
atggaggctgccatggtcactacgt

SEQ ID NO: 883783 - DNA, 25 bp, Mus musculus
atggaggtcggccacgtggttgcat

SEQ ID NO: 883784 - DNA, 25 bp, Mus musculus
atggaggtcggccaggtggttgcat

SEQ ID NO: 883785 - DNA, 25 bp, Mus musculus
atggagtctaagctctaaaagctgt

SEQ ID NO: 883786 - DNA, 25 bp, Mus musculus
atggagtctatgctctaaaagctgt

SEQ ID NO: 883787 - DNA, 25 bp, Mus musculus
atggagtgatggcttatggctatga

SEQ ID NO: 883788 - DNA, 25 bp, Mus musculus
atggagtgatgggttatggctatga

SEQ ID NO: 883789 - DNA, 25 bp, Mus musculus
atggagtgtaagaggcggcccctga

SEQ ID NO: 883790 - DNA, 25 bp, Mus musculus
atggagtgtaagtggcggcccctga

SEQ ID NO: 883791 - DNA, 25 bp, Mus musculus
atggagtgttgtgacgagtccatga

SEQ ID NO: 883792 - DNA, 25 bp, Mus musculus
atggagtgttgtgaggagtccatga

SEQ ID NO: 883793 - DNA, 25 bp, Mus musculus
atggagttggaaatcgctttcttcg

SEQ ID NO: 883794 - DNA, 25 bp, Mus musculus
atggagttggaaatggctttcttcg

SEQ ID NO: 883795 - DNA, 25 bp, Mus musculus
atggagttggacattggtgcccagg

SEQ ID NO: 883796 - DNA, 25 bp, Mus musculus
atggagttggactttggtgcccagg

SEQ ID NO: 883797 - DNA, 25 bp, Mus musculus
atggagttgtccaacgaatgtggct

SEQ ID NO: 883798 - DNA, 25 bp, Mus musculus
atggagttgtccaaggaatgtggct

SEQ ID NO: 883799 - DNA, 25 bp, Mus musculus
atggagttgtctctcatgcagccct

SEQ ID NO: 883800 - DNA, 25 bp, Mus musculus
atggagttgtctctgatgcagccct

SEQ ID NO: 883801 - DNA, 25 bp, Mus musculus
atggataaagaaaccactggtatag

SEQ ID NO: 883802 - DNA, 25 bp, Mus musculus
atggataaagaaacgactggtatag

SEQ ID NO: 883803 - DNA, 25 bp, Mus musculus
atggataatccacacaacctgcctt

SEQ ID NO: 883804 - DNA, 25 bp, Mus musculus
atggataatccacagaacctgcctt

SEQ ID NO: 883805 - DNA, 25 bp, Mus musculus
atggataccctgatctaatcgttgg

SEQ ID NO: 883806 - DNA, 25 bp, Mus musculus
atggataccctgttctaatcgttgg

SEQ ID NO: 883807 - DNA, 25 bp, Mus musculus
atggatatgttgatgtagccgttgg

SEQ ID NO: 883808 - DNA, 25 bp, Mus musculus
atggatatgttgttgtagccgttgg

SEQ ID NO: 883809 - DNA, 25 bp, Mus musculus
atggatcccactcatgccaagtatc

SEQ ID NO: 883810 - DNA, 25 bp, Mus musculus
atggatcccactgatgccaagtatc

SEQ ID NO: 883811 - DNA, 25 bp, Mus musculus
atggatcccctagacccccagaaac

SEQ ID NO: 883812 - DNA, 25 bp, Mus musculus
atggatcccctagagccccagaaac

SEQ ID NO: 883813 - DNA, 25 bp, Mus musculus
atggatcgacatctgcaatgaagac

SEQ ID NO: 883814 - DNA, 25 bp, Mus musculus
atggatcgacatgtgcaatgaagac

SEQ ID NO: 883815 - DNA, 25 bp, Mus musculus
atggatcgctcgacagacattgtga

SEQ ID NO: 883816 - DNA, 25 bp, Mus musculus
atggatcgctcgtcagacattgtga

SEQ ID NO: 883817 - DNA, 25 bp, Mus musculus
atggatctttctatcgaatgtcagg

SEQ ID NO: 883818 - DNA, 25 bp, Mus musculus
atggatctttgtatcgaatgtcagg

SEQ ID NO: 883819 - DNA, 25 bp, Mus musculus
atggatgaaaatgtgagcagctact

SEQ ID NO: 883820 - DNA, 25 bp, Mus musculus
atggatgaaattgtgagcagctact

SEQ ID NO: 883821 - DNA, 25 bp, Mus musculus
atggatgaagaggatgtgcggctgc

SEQ ID NO: 883822 - DNA, 25 bp, Mus musculus
atggatgaaggcaagctacagtttc

SEQ ID NO: 883823 - DNA, 25 bp, Mus musculus
atggatgaaggctagctacagtttc

SEQ ID NO: 883824 - DNA, 25 bp, Mus musculus
atggatgaagtggatgtgcggctgc

SEQ ID NO: 883825 - DNA, 25 bp, Mus musculus
atggatgacaagctgaaggagttgt

SEQ ID NO: 883826 - DNA, 25 bp, Mus musculus
atggatgacaaggtgaaggagttgt

SEQ ID NO: 883827 - DNA, 25 bp, Mus musculus
atggatgacttccgctgggctttga

SEQ ID NO: 883828 - DNA, 25 bp, Mus musculus
atggatgacttccggtgggctttga

SEQ ID NO: 883829 - DNA, 25 bp, Mus musculus
atggatgatgccaacatgtgcattg

SEQ ID NO: 883830 - DNA, 25 bp, Mus musculus
atggatgatgcctacatgtgcattg

SEQ ID NO: 883831 - DNA, 25 bp, Mus musculus
atggatgcttatgaaagcctgtcat

SEQ ID NO: 883832 - DNA, 25 bp, Mus musculus
atggatgcttatgatagcctgtcat

SEQ ID NO: 883833 - DNA, 25 bp, Mus musculus
atggatggagcgatcgcttacactt

SEQ ID NO: 883834 - DNA, 25 bp, Mus musculus
atggatggagggatcgcttacactt

SEQ ID NO: 883835 - DNA, 25 bp, Mus musculus
atggatggtatgctcatctttggtg

SEQ ID NO: 883836 - DNA, 25 bp, Mus musculus
atggatggtatggtcatctttggtg

SEQ ID NO: 883837 - DNA, 25 bp, Mus musculus
atggatgtggtcaacgagcggatcc

SEQ ID NO: 883838 - DNA, 25 bp, Mus musculus
atggatgtggtcaaggagcggatcc

SEQ ID NO: 883839 - DNA, 25 bp, Mus musculus
atggattatgagcaggcagacaatg

SEQ ID NO: 883840 - DNA, 25 bp, Mus musculus
atggattatgaggaggcagacaatg

SEQ ID NO: 883841 - DNA, 25 bp, Mus musculus
atggattcttctcctgttgttggag

SEQ ID NO: 883842 - DNA, 25 bp, Mus musculus
atggattcttgtcctgttgttggag

SEQ ID NO: 883843 - DNA, 25 bp, Mus musculus
atggattttaagctgagactgtgga

SEQ ID NO: 883844 - DNA, 25 bp, Mus musculus
atggattttaaggtgagactgtgga

SEQ ID NO: 883845 - DNA, 25 bp, Mus musculus
atggcaaaagatcccagtctaattg

SEQ ID NO: 883846 - DNA, 25 bp, Mus musculus
atggcaaaagatgccagtctaattg

SEQ ID NO: 883847 - DNA, 25 bp, Mus musculus
atggcaaaatcactcataatcccca

SEQ ID NO: 883848 - DNA, 25 bp, Mus musculus
atggcaaaatcagtcataatcccca

SEQ ID NO: 883849 - DNA, 25 bp, Mus musculus
atggcaaatacgatacccgtctctg

SEQ ID NO: 883850 - DNA, 25 bp, Mus musculus
atggcaaatacgttacccgtctctg

SEQ ID NO: 883851 - DNA, 25 bp, Mus musculus
atggcaaatgagggtgttaatgctg

SEQ ID NO: 883852 - DNA, 25 bp, Mus musculus
atggcaaatgtgggtgttaatgctg

SEQ ID NO: 883853 - DNA, 25 bp, Mus musculus
atggcaacagaggtgctgaccgtcc

SEQ ID NO: 883854 - DNA, 25 bp, Mus musculus
atggcaacagtggtgctgaccgtcc

SEQ ID NO: 883855 - DNA, 25 bp, Mus musculus
atggcaacttctctcgaaccaagca

SEQ ID NO: 883856 - DNA, 25 bp, Mus musculus
atggcaacttctctggaaccaagca

SEQ ID NO: 883857 - DNA, 25 bp, Mus musculus
atggcaagagctacagcagcggtgg

SEQ ID NO: 883858 - DNA, 25 bp, Mus musculus
atggcaagaggtacagcagcggtgg

SEQ ID NO: 883859 - DNA, 25 bp, Mus musculus
atggcaagtgctcacgaagactctt

SEQ ID NO: 883860 - DNA, 25 bp, Mus musculus
atggcaagtgctcacgaggccatga

SEQ ID NO: 883861 - DNA, 25 bp, Mus musculus
atggcaagtgctcaggaagactctt

SEQ ID NO: 883862 - DNA, 25 bp, Mus musculus
atggcaagtgctcaggaggccatga

SEQ ID NO: 883863 - DNA, 25 bp, Mus musculus
atggcaatgccacgtggcccagagt

SEQ ID NO: 883864 - DNA, 25 bp, Mus musculus
atggcaatgccacgttgaacgacat

SEQ ID NO: 883865 - DNA, 25 bp, Mus musculus
atggcaatgccaggtggcccagagt

SEQ ID NO: 883866 - DNA, 25 bp, Mus musculus
atggcaatgccaggttgaacgacat

SEQ ID NO: 883867 - DNA, 25 bp, Mus musculus
atggcacatttgatgtccatctgga

SEQ ID NO: 883868 - DNA, 25 bp, Mus musculus
atggcacatttgttgtccatctgga

SEQ ID NO: 883869 - DNA, 25 bp, Mus musculus
atggcaccatccgacagggaatgct

SEQ ID NO: 883870 - DNA, 25 bp, Mus musculus
atggcaccatccgagagggaatgct

SEQ ID NO: 883871 - DNA, 25 bp, Mus musculus
atggcactgattcgtgctgtcagat

SEQ ID NO: 883872 - DNA, 25 bp, Mus musculus
atggcactgattggtgctgtcagat

SEQ ID NO: 883873 - DNA, 25 bp, Mus musculus
atggcactttttgacgaagagatgg

SEQ ID NO: 883874 - DNA, 25 bp, Mus musculus
atggcactttttgaggaagagatgg

SEQ ID NO: 883875 - DNA, 25 bp, Mus musculus
atggcagagaacaaggagaatatgc

SEQ ID NO: 883876 - DNA, 25 bp, Mus musculus
atggcagagaactaggagaatatgc

SEQ ID NO: 883877 - DNA, 25 bp, Mus musculus
atggcagagttaaactacatttctg

SEQ ID NO: 883878 - DNA, 25 bp, Mus musculus
atggcagagttaaagtacatttctg

SEQ ID NO: 883879 - DNA, 25 bp, Mus musculus
atggcagagttcaacgccagcctgt

SEQ ID NO: 883880 - DNA, 25 bp, Mus musculus
atggcagagttcaaggccagcctgt

SEQ ID NO: 883881 - DNA, 25 bp, Mus musculus
atggcagatgcctgaaaatatttac

SEQ ID NO: 883882 - DNA, 25 bp, Mus musculus
atggcagatggctgaaaatatttac

SEQ ID NO: 883883 - DNA, 25 bp, Mus musculus
atggcagcagacctcgaaagcaaag

SEQ ID NO: 883884 - DNA, 25 bp, Mus musculus
atggcagcagacctggaaagcaaag

SEQ ID NO: 883885 - DNA, 25 bp, Mus musculus
atggcagcggcggtggcggaggtga

SEQ ID NO: 883886 - DNA, 25 bp, Mus musculus
atggcagcgggggtggcggaggtga

SEQ ID NO: 883887 - DNA, 25 bp, Mus musculus
atggcaggacgtcacacacagcgtt

SEQ ID NO: 883888 - DNA, 25 bp, Mus musculus
atggcaggacgtcagacacagcgtt

SEQ ID NO: 883889 - DNA, 25 bp, Mus musculus
atggcatcacactacatctttccag

SEQ ID NO: 883890 - DNA, 25 bp, Mus musculus
atggcatcacactagatctttccag

SEQ ID NO: 883891 - DNA, 25 bp, Mus musculus
atggcatcagagagcgggaagctat

SEQ ID NO: 883892 - DNA, 25 bp, Mus musculus
atggcatcagagtgcgggaagctat

SEQ ID NO: 883893 - DNA, 25 bp, Mus musculus
atggcatcgtcacacaatatgcttc

SEQ ID NO: 883894 - DNA, 25 bp, Mus musculus
atggcatcgtcacagaatatgcttc

SEQ ID NO: 883895 - DNA, 25 bp, Mus musculus
atggcatgggctatggcgactaccc

SEQ ID NO: 883896 - DNA, 25 bp, Mus musculus
atggcatggggtatggcgactaccc

SEQ ID NO: 883897 - DNA, 25 bp, Mus musculus
atggcattgaactcagggtcacctc

SEQ ID NO: 883898 - DNA, 25 bp, Mus musculus
atggcattgaactctgggtcacctc

SEQ ID NO: 883899 - DNA, 25 bp, Mus musculus
atggccaacaaacacgtgtgcaaac

SEQ ID NO: 883900 - DNA, 25 bp, Mus musculus
atggccaacaaacaggtgtgcaaac

SEQ ID NO: 883901 - DNA, 25 bp, Mus musculus
atggccaatgagggtggatttctgg

SEQ ID NO: 883902 - DNA, 25 bp, Mus musculus
atggccaatgtgggtggatttctgg

SEQ ID NO: 883903 - DNA, 25 bp, Mus musculus
atggccactgtgccctcctgagtga

SEQ ID NO: 883904 - DNA, 25 bp, Mus musculus
atggccactgtgctctctgtgatga

SEQ ID NO: 883905 - DNA, 25 bp, Mus musculus
atggccactgtggcctcctgagtga

SEQ ID NO: 883906 - DNA, 25 bp, Mus musculus
atggccactgtggtctctgtgatga

SEQ ID NO: 883907 - DNA, 25 bp, Mus musculus
atggccagcgcttggatgaagaaac

SEQ ID NO: 883908 - DNA, 25 bp, Mus musculus
atggccagcggttggatgaagaaac

SEQ ID NO: 883909 - DNA, 25 bp, Mus musculus
atggccagtgcacaagctccacagg

SEQ ID NO: 883910 - DNA, 25 bp, Mus musculus
atggccagtgcagaagctccacagg

SEQ ID NO: 883911 - DNA, 25 bp, Mus musculus
atggccatgaagccgggagaaaatt

SEQ ID NO: 883912 - DNA, 25 bp, Mus musculus
atggccatgaaggcgggagaaaatt

SEQ ID NO: 883913 - DNA, 25 bp, Mus musculus
atggccattgtcaacgaagaagaga

SEQ ID NO: 883914 - DNA, 25 bp, Mus musculus
atggccattgtcaaggaagaagaga

SEQ ID NO: 883915 - DNA, 25 bp, Mus musculus
atggcccccatgcttcagcatgggc

SEQ ID NO: 883916 - DNA, 25 bp, Mus musculus
atggcccccatggttcagcatgggc

SEQ ID NO: 883917 - DNA, 25 bp, Mus musculus
atggccccgatcaacgtgggagatg

SEQ ID NO: 883918 - DNA, 25 bp, Mus musculus
atggccccgatcaaggtgggagatg

SEQ ID NO: 883919 - DNA, 25 bp, Mus musculus
atggcccgctttgacggcctgagga

SEQ ID NO: 883920 - DNA, 25 bp, Mus musculus
atggcccgctttgagggcctgagga

SEQ ID NO: 883921 - DNA, 25 bp, Mus musculus
atggccctaaagcggttggtgctat

SEQ ID NO: 883922 - DNA, 25 bp, Mus musculus
atggccctaaaggggttggtgctat

SEQ ID NO: 883923 - DNA, 25 bp, Mus musculus
atggccctagagctgccagagccac

SEQ ID NO: 883924 - DNA, 25 bp, Mus musculus
atggccctagaggtgccagagccac

SEQ ID NO: 883925 - DNA, 25 bp, Mus musculus
atggccctggaacacgccgaatctg

SEQ ID NO: 883926 - DNA, 25 bp, Mus musculus
atggccctggaacaggccgaatctg

SEQ ID NO: 883927 - DNA, 25 bp, Mus musculus
atggccctggggctgggtccttggc

SEQ ID NO: 883928 - DNA, 25 bp, Mus musculus
atggccctgggggtgggtccttggc

SEQ ID NO: 883929 - DNA, 25 bp, Mus musculus
atggccctgttgcatggagaacaac

SEQ ID NO: 883930 - DNA, 25 bp, Mus musculus
atggccctgttggatggagaacaac

SEQ ID NO: 883931 - DNA, 25 bp, Mus musculus
atggcctattacatcccaacaattc

SEQ ID NO: 883932 - DNA, 25 bp, Mus musculus
atggcctattacatcgatacatggg

SEQ ID NO: 883933 - DNA, 25 bp, Mus musculus
atggcctattacatgccaacaattc

SEQ ID NO: 883934 - DNA, 25 bp, Mus musculus
atggcctattacatggatacatggg

SEQ ID NO: 883935 - DNA, 25 bp, Mus musculus
atggcctcaatgcgtacaagtgtga

SEQ ID NO: 883936 - DNA, 25 bp, Mus musculus
atggcctcaatgggtacaagtgtga

SEQ ID NO: 883937 - DNA, 25 bp, Mus musculus
atggcctccatgtgcatataccgct

SEQ ID NO: 883938 - DNA, 25 bp, Mus musculus
atggcctccatgtgccatttggcac

SEQ ID NO: 883939 - DNA, 25 bp, Mus musculus
atggcctccatgtggatataccgct

SEQ ID NO: 883940 - DNA, 25 bp, Mus musculus
atggcctccatgtggcatttggcac

SEQ ID NO: 883941 - DNA, 25 bp, Mus musculus
atggcctccggcctcgaggatccga

SEQ ID NO: 883942 - DNA, 25 bp, Mus musculus
atggcctccggcctggaggatccga

SEQ ID NO: 883943 - DNA, 25 bp, Mus musculus
atggcctgtgtgcatgtgaacgagt

SEQ ID NO: 883944 - DNA, 25 bp, Mus musculus
atggcctgtgtggatgtgaacgagt

SEQ ID NO: 883945 - DNA, 25 bp, Mus musculus
atggccttgcagaatttacatgaga

SEQ ID NO: 883946 - DNA, 25 bp, Mus musculus
atggccttgcagtatttacatgaga

SEQ ID NO: 883947 - DNA, 25 bp, Mus musculus
atggcctttaagacatttggagaac

SEQ ID NO: 883948 - DNA, 25 bp, Mus musculus
atggcctttaagtcatttggagaac

SEQ ID NO: 883949 - DNA, 25 bp, Mus musculus
atggcgaaccagctgatcaggtgta

SEQ ID NO: 883950 - DNA, 25 bp, Mus musculus
atggcgaaccaggtgatcaggtgta

SEQ ID NO: 883951 - DNA, 25 bp, Mus musculus
atggcgatgtcaaacctgacaacgt

SEQ ID NO: 883952 - DNA, 25 bp, Mus musculus
atggcgatgtcaaagctgacaacgt

SEQ ID NO: 883953 - DNA, 25 bp, Mus musculus
atggcgccgccgcgttcaagcgctg

SEQ ID NO: 883954 - DNA, 25 bp, Mus musculus
atggcgccgccgggttcaagcgctg

SEQ ID NO: 883955 - DNA, 25 bp, Mus musculus
atggcgctgtccagcgtcttcaaag

SEQ ID NO: 883956 - DNA, 25 bp, Mus musculus
atggcgctgtccagggtcttcaaag

SEQ ID NO: 883957 - DNA, 25 bp, Mus musculus
atggcggcacagcttgctgcaggaa

SEQ ID NO: 883958 - DNA, 25 bp, Mus musculus
atggcggcacaggttgctgcaggaa

SEQ ID NO: 883959 - DNA, 25 bp, Mus musculus
atggcgggccggactatgcaagctg

SEQ ID NO: 883960 - DNA, 25 bp, Mus musculus
atggcgggccggctttctgttgatg

SEQ ID NO: 883961 - DNA, 25 bp, Mus musculus
atggcgggccgggtttctgttgatg

SEQ ID NO: 883962 - DNA, 25 bp, Mus musculus
atggcgggccggtctatgcaagctg

SEQ ID NO: 883963 - DNA, 25 bp, Mus musculus
atggcgtcaccacagtgggcagaga

SEQ ID NO: 883964 - DNA, 25 bp, Mus musculus
atggcgtcaccagagtgggcagaga

SEQ ID NO: 883965 - DNA, 25 bp, Mus musculus
atggcgttccagaatgacgtgtatg

SEQ ID NO: 883966 - DNA, 25 bp, Mus musculus
atggcgttccagtatgacgtgtatg

SEQ ID NO: 883967 - DNA, 25 bp, Mus musculus
atggctactcaacctgacctgatgg

SEQ ID NO: 883968 - DNA, 25 bp, Mus musculus
atggctactcaagctgacctgatgg

SEQ ID NO: 883969 - DNA, 25 bp, Mus musculus
atggctatactggtagctttgtatg

SEQ ID NO: 883970 - DNA, 25 bp, Mus musculus
atggctatactggttgctttgtatg

SEQ ID NO: 883971 - DNA, 25 bp, Mus musculus
atggctatggaacgtctatcctgac

SEQ ID NO: 883972 - DNA, 25 bp, Mus musculus
atggctatggaaggtctatcctgac

SEQ ID NO: 883973 - DNA, 25 bp, Mus musculus
atggctattgacccagattccctaa

SEQ ID NO: 883974 - DNA, 25 bp, Mus musculus
atggctattgtcccagattccctaa

SEQ ID NO: 883975 - DNA, 25 bp, Mus musculus
atggctcagctaatgcggtggtgct

SEQ ID NO: 883976 - DNA, 25 bp, Mus musculus
atggctcagctattgcggtggtgct

SEQ ID NO: 883977 - DNA, 25 bp, Mus musculus
atggctccagatgggaatggtggtc

SEQ ID NO: 883978 - DNA, 25 bp, Mus musculus
atggctccagttgggaatggtggtc

SEQ ID NO: 883979 - DNA, 25 bp, Mus musculus
atggctcccaaggacgcccccaaga

SEQ ID NO: 883980 - DNA, 25 bp, Mus musculus
atggctcccaaggaggcccccaaga

SEQ ID NO: 883981 - DNA, 25 bp, Mus musculus
atggctccttaccacgagatcgaga

SEQ ID NO: 883982 - DNA, 25 bp, Mus musculus
atggctccttaccaggagatcgaga

SEQ ID NO: 883983 - DNA, 25 bp, Mus musculus
atggctcggtgtctcccttagaaga

SEQ ID NO: 883984 - DNA, 25 bp, Mus musculus
atggctcggtgtctgctgcttttga

SEQ ID NO: 883985 - DNA, 25 bp, Mus musculus
atggctcggtgtgtcccttagaaga

SEQ ID NO: 883986 - DNA, 25 bp, Mus musculus
atggctcggtgtgtgctgcttttga

SEQ ID NO: 883987 - DNA, 25 bp, Mus musculus
atggctctagattcattcagctgaa

SEQ ID NO: 883988 - DNA, 25 bp, Mus musculus
atggctctagtttcattcagctgaa

SEQ ID NO: 883989 - DNA, 25 bp, Mus musculus
atggctctgacacccgcaagtctat

SEQ ID NO: 883990 - DNA, 25 bp, Mus musculus
atggctctgacagccgcaagtctat

SEQ ID NO: 883991 - DNA, 25 bp, Mus musculus
atggctctggtcctggacgcagacg

SEQ ID NO: 883992 - DNA, 25 bp, Mus musculus
atggctctggtcgtggacgcagacg

SEQ ID NO: 883993 - DNA, 25 bp, Mus musculus
atggctgacacgctccgaggagaca

SEQ ID NO: 883994 - DNA, 25 bp, Mus musculus
atggctgacacgcttccaggtccga

SEQ ID NO: 883995 - DNA, 25 bp, Mus musculus
atggctgacacggtccgaggagaca

SEQ ID NO: 883996 - DNA, 25 bp, Mus musculus
atggctgacacggttccaggtccga

SEQ ID NO: 883997 - DNA, 25 bp, Mus musculus
atggctgaggaccctcctgtgtccc

SEQ ID NO: 883998 - DNA, 25 bp, Mus musculus
atggctgaggacgctcctgtgtccc

SEQ ID NO: 883999 - DNA, 25 bp, Mus musculus
atggctgcatcaccatctctgctgt

SEQ ID NO: 884000 - DNA, 25 bp, Mus musculus
atggctgcatcagcatctctgctgt

SEQ ID NO: 884001 - DNA, 25 bp, Mus musculus
atggctgccaaatggcaccttgaag

SEQ ID NO: 884002 - DNA, 25 bp, Mus musculus
atggctgccatatggcaccttgaag

SEQ ID NO: 884003 - DNA, 25 bp, Mus musculus
atggctggagggcatgccaacaagg

SEQ ID NO: 884004 - DNA, 25 bp, Mus musculus
atggctggagggctgatggtaatgc

SEQ ID NO: 884005 - DNA, 25 bp, Mus musculus
atggctggaggggatgccaacaagg

SEQ ID NO: 884006 - DNA, 25 bp, Mus musculus
atggctggaggggtgatggtaatgc

SEQ ID NO: 884007 - DNA, 25 bp, Mus musculus
atggctggatcagtctttctagatg

SEQ ID NO: 884008 - DNA, 25 bp, Mus musculus
atggctggatcagtgtttctagatg

SEQ ID NO: 884009 - DNA, 25 bp, Mus musculus
atggcttaaaagccgaagaagcagg

SEQ ID NO: 884010 - DNA, 25 bp, Mus musculus
atggcttaaaagctcgtgtggccag

SEQ ID NO: 884011 - DNA, 25 bp, Mus musculus
atggcttaaaaggcgaagaagcagg

SEQ ID NO: 884012 - DNA, 25 bp, Mus musculus
atggcttaaaaggtcgtgtggccag

SEQ ID NO: 884013 - DNA, 25 bp, Mus musculus
atggcttatgaacacatcaagcggg

SEQ ID NO: 884014 - DNA, 25 bp, Mus musculus
atggcttatgaacagatcaagcggg

SEQ ID NO: 884015 - DNA, 25 bp, Mus musculus
atggcttcactgcgctggcattgac

SEQ ID NO: 884016 - DNA, 25 bp, Mus musculus
atggcttcactgggctggcattgac

SEQ ID NO: 884017 - DNA, 25 bp, Mus musculus
atggcttctggacgtggtgtcccca

SEQ ID NO: 884018 - DNA, 25 bp, Mus musculus
atggcttctggaggtggtgtcccca

SEQ ID NO: 884019 - DNA, 25 bp, Mus musculus
atggcttggaatgacactgcagatc

SEQ ID NO: 884020 - DNA, 25 bp, Mus musculus
atggcttggaatgagactgcagatc

SEQ ID NO: 884021 - DNA, 25 bp, Mus musculus
atggctttgggtcacatgatcccta

SEQ ID NO: 884022 - DNA, 25 bp, Mus musculus
atggctttgggtcagatgatcccta

SEQ ID NO: 884023 - DNA, 25 bp, Mus musculus
atgggaagctggccttcaacctgga

SEQ ID NO: 884024 - DNA, 25 bp, Mus musculus
atgggaagctgggcttcaacctgga

SEQ ID NO: 884025 - DNA, 25 bp, Mus musculus
atgggaaggatgaacattcctatca

SEQ ID NO: 884026 - DNA, 25 bp, Mus musculus
atgggaaggatgaagattcctatca

SEQ ID NO: 884027 - DNA, 25 bp, Mus musculus
atgggactagcatgatgtctacaga

SEQ ID NO: 884028 - DNA, 25 bp, Mus musculus
atgggactaggatgatgtctacaga

SEQ ID NO: 884029 - DNA, 25 bp, Mus musculus
atgggactccagccattgtaatggc

SEQ ID NO: 884030 - DNA, 25 bp, Mus musculus
atgggactccaggcattgtaatggc

SEQ ID NO: 884031 - DNA, 25 bp, Mus musculus
atgggactgcaagtagtgggcacta

SEQ ID NO: 884032 - DNA, 25 bp, Mus musculus
atgggactgcaagttgtgggcacta

SEQ ID NO: 884033 - DNA, 25 bp, Mus musculus
atgggagcaaagcgtgctgtggaga

SEQ ID NO: 884034 - DNA, 25 bp, Mus musculus
atgggagcaaagggtgctgtggaga

SEQ ID NO: 884035 - DNA, 25 bp, Mus musculus
atgggagccaacattcctatgatgg

SEQ ID NO: 884036 - DNA, 25 bp, Mus musculus
atgggagccaactttcctatgatgg

SEQ ID NO: 884037 - DNA, 25 bp, Mus musculus
atgggaggtggcaacccctggcaca

SEQ ID NO: 884038 - DNA, 25 bp, Mus musculus
atgggaggtggcaagccctggcaca

SEQ ID NO: 884039 - DNA, 25 bp, Mus musculus
atgggatatgagctgcagcagaaag

SEQ ID NO: 884040 - DNA, 25 bp, Mus musculus
atgggatatgaggtgcagcagaaag

SEQ ID NO: 884041 - DNA, 25 bp, Mus musculus
atgggatgaaaccgttctgtgatga

SEQ ID NO: 884042 - DNA, 25 bp, Mus musculus
atgggatgaaacggttctgtgatga

SEQ ID NO: 884043 - DNA, 25 bp, Mus musculus
atgggatgaactaatcatttttcct

SEQ ID NO: 884044 - DNA, 25 bp, Mus musculus
atgggatgaacttatcatttttcct

SEQ ID NO: 884045 - DNA, 25 bp, Mus musculus
atgggcaaaactcaatccaacagag

SEQ ID NO: 884046 - DNA, 25 bp, Mus musculus
atgggcaaaactcattccaacagag

SEQ ID NO: 884047 - DNA, 25 bp, Mus musculus
atgggcaatgacacgtccccatctg

SEQ ID NO: 884048 - DNA, 25 bp, Mus musculus
atgggcaatgtcacgtccccatctg

SEQ ID NO: 884049 - DNA, 25 bp, Mus musculus
atgggcagagggaacatcccaaccc

SEQ ID NO: 884050 - DNA, 25 bp, Mus musculus
atgggcagagggtacatcccaaccc

SEQ ID NO: 884051 - DNA, 25 bp, Mus musculus
atgggcagctgacattcctgctgct

SEQ ID NO: 884052 - DNA, 25 bp, Mus musculus
atgggcagctgacgtgtgactttga

SEQ ID NO: 884053 - DNA, 25 bp, Mus musculus
atgggcagctgagattcctgctgct

SEQ ID NO: 884054 - DNA, 25 bp, Mus musculus
atgggcagctgaggtgtgactttga

SEQ ID NO: 884055 - DNA, 25 bp, Mus musculus
atgggcaggcctccccagcgcagac

SEQ ID NO: 884056 - DNA, 25 bp, Mus musculus
atgggcaggcctccgcagacttaat

SEQ ID NO: 884057 - DNA, 25 bp, Mus musculus
atgggcaggcctgcccagcgcagac

SEQ ID NO: 884058 - DNA, 25 bp, Mus musculus
atgggcaggcctgcgcagacttaat

SEQ ID NO: 884059 - DNA, 25 bp, Mus musculus
atgggcatatcacacgtattgactg

SEQ ID NO: 884060 - DNA, 25 bp, Mus musculus
atgggcatatcacaggtattgactg

SEQ ID NO: 884061 - DNA, 25 bp, Mus musculus
atgggcatcacactcagtacaggct

SEQ ID NO: 884062 - DNA, 25 bp, Mus musculus
atgggcatcacagtcagtacaggct

SEQ ID NO: 884063 - DNA, 25 bp, Mus musculus
atgggccaagagtaaccagctcttt

SEQ ID NO: 884064 - DNA, 25 bp, Mus musculus
atgggccaagcagaaaagaaatggt

SEQ ID NO: 884065 - DNA, 25 bp, Mus musculus
atgggccaaggagaaaagaaatggt

SEQ ID NO: 884066 - DNA, 25 bp, Mus musculus
atgggccaagtgtaaccagctcttt

SEQ ID NO: 884067 - DNA, 25 bp, Mus musculus
atgggcccaacaaacgcagctgaga

SEQ ID NO: 884068 - DNA, 25 bp, Mus musculus
atgggcccaacaaaggcagctgaga

SEQ ID NO: 884069 - DNA, 25 bp, Mus musculus
atgggcccacagtgcgggctgaaga

SEQ ID NO: 884070 - DNA, 25 bp, Mus musculus
atgggcccacagtgcttctcactgt

SEQ ID NO: 884071 - DNA, 25 bp, Mus musculus
atgggcccacagtgggggctgaaga

SEQ ID NO: 884072 - DNA, 25 bp, Mus musculus
atgggcccacagtggttctcactgt

SEQ ID NO: 884073 - DNA, 25 bp, Mus musculus
atgggccccgcacactgtatgctgc

SEQ ID NO: 884074 - DNA, 25 bp, Mus musculus
atgggccccggacactgtatgctgc

SEQ ID NO: 884075 - DNA, 25 bp, Mus musculus
atgggccctgcacgactgttcccga

SEQ ID NO: 884076 - DNA, 25 bp, Mus musculus
atgggccctgcaggactgttcccga

SEQ ID NO: 884077 - DNA, 25 bp, Mus musculus
atgggcctattgtgcgttccactcg

SEQ ID NO: 884078 - DNA, 25 bp, Mus musculus
atgggcctattgtgggttccactcg

SEQ ID NO: 884079 - DNA, 25 bp, Mus musculus
atgggccttgtacacgtatcacaag

SEQ ID NO: 884080 - DNA, 25 bp, Mus musculus
atgggccttgtacaggtatcacaag

SEQ ID NO: 884081 - DNA, 25 bp, Mus musculus
atgggcgcacagctctgctgtgcca

SEQ ID NO: 884082 - DNA, 25 bp, Mus musculus
atgggcgcacaggtctgctgtgcca

SEQ ID NO: 884083 - DNA, 25 bp, Mus musculus
atgggcgcggtcaacaaaggctctg

SEQ ID NO: 884084 - DNA, 25 bp, Mus musculus
atgggcgcggtcaacgatcatctgc

SEQ ID NO: 884085 - DNA, 25 bp, Mus musculus
atgggcgcggtcaagaaaggctctg

SEQ ID NO: 884086 - DNA, 25 bp, Mus musculus
atgggcgcggtcaaggatcatctgc

SEQ ID NO: 884087 - DNA, 25 bp, Mus musculus
atgggctaaagacatttgaaagtga

SEQ ID NO: 884088 - DNA, 25 bp, Mus musculus
atgggctaaagagatttgaaagtga

SEQ ID NO: 884089 - DNA, 25 bp, Mus musculus
atgggctacaaaccatctgccagca

SEQ ID NO: 884090 - DNA, 25 bp, Mus musculus
atgggctacaacccgtatgtgcagc

SEQ ID NO: 884091 - DNA, 25 bp, Mus musculus
atgggctacaaggcctcttcctgca

SEQ ID NO: 884092 - DNA, 25 bp, Mus musculus
atgggctacataccatctgccagca

SEQ ID NO: 884093 - DNA, 25 bp, Mus musculus
atgggctacatcccgtatgtgcagc

SEQ ID NO: 884094 - DNA, 25 bp, Mus musculus
atgggctacatggcctcttcctgca

SEQ ID NO: 884095 - DNA, 25 bp, Mus musculus
atgggctcagcaaacgcagctgaga

SEQ ID NO: 884096 - DNA, 25 bp, Mus musculus
atgggctcagcaaaggcagctgaga

SEQ ID NO: 884097 - DNA, 25 bp, Mus musculus
atgggctgaagacatttgaaagtga

SEQ ID NO: 884098 - DNA, 25 bp, Mus musculus
atgggctgaagagatttgaaagtga

SEQ ID NO: 884099 - DNA, 25 bp, Mus musculus
atggggacaacgaacgtgaccccat

SEQ ID NO: 884100 - DNA, 25 bp, Mus musculus
atggggacaacgaaggtgaccccat

SEQ ID NO: 884101 - DNA, 25 bp, Mus musculus
atggggagagagggcaatgcgagca

SEQ ID NO: 884102 - DNA, 25 bp, Mus musculus
atggggagagtgggcaatgcgagca

SEQ ID NO: 884103 - DNA, 25 bp, Mus musculus
atggggagctggccccacagggctt

SEQ ID NO: 884104 - DNA, 25 bp, Mus musculus
atggggagctggctaagctggtgct

SEQ ID NO: 884105 - DNA, 25 bp, Mus musculus
atggggagctgggcccacagggctt

SEQ ID NO: 884106 - DNA, 25 bp, Mus musculus
atggggagctgggtaagctggtgct

SEQ ID NO: 884107 - DNA, 25 bp, Mus musculus
atggggaggaagcatgtaggatcca

SEQ ID NO: 884108 - DNA, 25 bp, Mus musculus
atggggaggaaggatgtaggatcca

SEQ ID NO: 884109 - DNA, 25 bp, Mus musculus
atggggcaggccatgggtgccatcc

SEQ ID NO: 884110 - DNA, 25 bp, Mus musculus
atggggcagggcatgggtgccatcc

SEQ ID NO: 884111 - DNA, 25 bp, Mus musculus
atggggctacagcatcaaccacgac

SEQ ID NO: 884112 - DNA, 25 bp, Mus musculus
atggggctacaggatcaaccacgac

SEQ ID NO: 884113 - DNA, 25 bp, Mus musculus
atgggggacccacgccagagtccta

SEQ ID NO: 884114 - DNA, 25 bp, Mus musculus
atgggggacccaggccagagtccta

SEQ ID NO: 884115 - DNA, 25 bp, Mus musculus
atgggggacgctcctgactatgaca

SEQ ID NO: 884116 - DNA, 25 bp, Mus musculus
atgggggacggtcctgactatgaca

SEQ ID NO: 884117 - DNA, 25 bp, Mus musculus
atgggggcagctggctttgtggctc

SEQ ID NO: 884118 - DNA, 25 bp, Mus musculus
atgggggcaggtggctttgtggctc

SEQ ID NO: 884119 - DNA, 25 bp, Mus musculus
atgggggtcccattcctctactgag

SEQ ID NO: 884120 - DNA, 25 bp, Mus musculus
atgggggtcccattgctctactgag

SEQ ID NO: 884121 - DNA, 25 bp, Mus musculus
atggggtatgtgactgctgtgatgg

SEQ ID NO: 884122 - DNA, 25 bp, Mus musculus
atggggtatgtgtctgctgtgatgg

SEQ ID NO: 884123 - DNA, 25 bp, Mus musculus
atggggtcaaacctgaccgccagtg

SEQ ID NO: 884124 - DNA, 25 bp, Mus musculus
atggggtcaaacgtgaccgccagtg

SEQ ID NO: 884125 - DNA, 25 bp, Mus musculus
atgggtacaatgctaccatcatgtg

SEQ ID NO: 884126 - DNA, 25 bp, Mus musculus
atgggtacaatggtaccatcatgtg

SEQ ID NO: 884127 - DNA, 25 bp, Mus musculus
atgggtatctatataaagctcaagg

SEQ ID NO: 884128 - DNA, 25 bp, Mus musculus
atgggtatctttataaagctcaagg

SEQ ID NO: 884129 - DNA, 25 bp, Mus musculus
atgggtcccgagcacgtcaatgacc

SEQ ID NO: 884130 - DNA, 25 bp, Mus musculus
atgggtcccgagcaggtcaatgacc

SEQ ID NO: 884131 - DNA, 25 bp, Mus musculus
atgggtccttactgtctgctacatc

SEQ ID NO: 884132 - DNA, 25 bp, Mus musculus
atgggtcctttctgtctgctacatc

SEQ ID NO: 884133 - DNA, 25 bp, Mus musculus
atgggtctcaagatgttgttgatga

SEQ ID NO: 884134 - DNA, 25 bp, Mus musculus
atgggtctcaagttgttgttgatga

SEQ ID NO: 884135 - DNA, 25 bp, Mus musculus
atgggtgaagaacaagctgactgcg

SEQ ID NO: 884136 - DNA, 25 bp, Mus musculus
atgggtgaagaagaagctgactgcg

SEQ ID NO: 884137 - DNA, 25 bp, Mus musculus
atgggtgatgctcctgactatgacc

SEQ ID NO: 884138 - DNA, 25 bp, Mus musculus
atgggtgatggtcctgactatgacc

SEQ ID NO: 884139 - DNA, 25 bp, Mus musculus
atgggtgtgaggaggtggagcagcc

SEQ ID NO: 884140 - DNA, 25 bp, Mus musculus
atgggtgtgaggtggtggagcagcc

SEQ ID NO: 884141 - DNA, 25 bp, Mus musculus
atgggtgttgcactcaaatgggtcg

SEQ ID NO: 884142 - DNA, 25 bp, Mus musculus
atgggtgttgcagtcaaatgggtcg

SEQ ID NO: 884143 - DNA, 25 bp, Mus musculus
atgggtttcaagacttgtgatggat

SEQ ID NO: 884144 - DNA, 25 bp, Mus musculus
atgggtttcaagtcttgtgatggat

SEQ ID NO: 884145 - DNA, 25 bp, Mus musculus
atgggttttgatagcaacgcagtaa

SEQ ID NO: 884146 - DNA, 25 bp, Mus musculus
atgggttttgataggaacgcagtaa

SEQ ID NO: 884147 - DNA, 25 bp, Mus musculus
atggtaaagacaccacagcccccca

SEQ ID NO: 884148 - DNA, 25 bp, Mus musculus
atggtaaagacaccctaaccatgcc

SEQ ID NO: 884149 - DNA, 25 bp, Mus musculus
atggtaaagacagcacagcccccca

SEQ ID NO: 884150 - DNA, 25 bp, Mus musculus
atggtaaagacagcctaaccatgcc

SEQ ID NO: 884151 - DNA, 25 bp, Mus musculus
atggtaccaatccaccatctggatc

SEQ ID NO: 884152 - DNA, 25 bp, Mus musculus
atggtaccaatccagcatctggatc

SEQ ID NO: 884153 - DNA, 25 bp, Mus musculus
atggtacgaagcgccctttccgtca

SEQ ID NO: 884154 - DNA, 25 bp, Mus musculus
atggtacgaagcgcgctttccgtca

SEQ ID NO: 884155 - DNA, 25 bp, Mus musculus
atggtagattaccctcacaacaact

SEQ ID NO: 884156 - DNA, 25 bp, Mus musculus
atggtagattacgctcacaacaact

SEQ ID NO: 884157 - DNA, 25 bp, Mus musculus
atggtagcaaattaaaatgtccata

SEQ ID NO: 884158 - DNA, 25 bp, Mus musculus
atggtagcaatttaaaatgtccata

SEQ ID NO: 884159 - DNA, 25 bp, Mus musculus
atggtagcacagtacatctgttgga

SEQ ID NO: 884160 - DNA, 25 bp, Mus musculus
atggtagcacagtagatctgttgga

SEQ ID NO: 884161 - DNA, 25 bp, Mus musculus
atggtagccgcaagctgtgctgaat

SEQ ID NO: 884162 - DNA, 25 bp, Mus musculus
atggtagccgctgccgtgacttact

SEQ ID NO: 884163 - DNA, 25 bp, Mus musculus
atggtagccggaagctgtgctgaat

SEQ ID NO: 884164 - DNA, 25 bp, Mus musculus
atggtagccggtgccgtgacttact

SEQ ID NO: 884165 - DNA, 25 bp, Mus musculus
atggtataagcatgacatcgttctg

SEQ ID NO: 884166 - DNA, 25 bp, Mus musculus
atggtataaggatgacatcgttctg

SEQ ID NO: 884167 - DNA, 25 bp, Mus musculus
atggtatcttaacgaactccaggat

SEQ ID NO: 884168 - DNA, 25 bp, Mus musculus
atggtatcttaaggaactccaggat

SEQ ID NO: 884169 - DNA, 25 bp, Mus musculus
atggtcaaggcgcagccagatgtta

SEQ ID NO: 884170 - DNA, 25 bp, Mus musculus
atggtcaaggcggagccagatgtta

SEQ ID NO: 884171 - DNA, 25 bp, Mus musculus
atggtcacacagatacttgttgcct

SEQ ID NO: 884172 - DNA, 25 bp, Mus musculus
atggtcacacagttacttgttgcct

SEQ ID NO: 884173 - DNA, 25 bp, Mus musculus
atggtcactgaggaccctgatgctg

SEQ ID NO: 884174 - DNA, 25 bp, Mus musculus
atggtcactgtggaccctgatgctg

SEQ ID NO: 884175 - DNA, 25 bp, Mus musculus
atggtcagcaatcgggctggagaga

SEQ ID NO: 884176 - DNA, 25 bp, Mus musculus
atggtcagcaatcggttcagacctc

SEQ ID NO: 884177 - DNA, 25 bp, Mus musculus
atggtcagcaatggggctggagaga

SEQ ID NO: 884178 - DNA, 25 bp, Mus musculus
atggtcagcaatgggttcagacctc

SEQ ID NO: 884179 - DNA, 25 bp, Mus musculus
atggtcgtggactgatgcacagatc

SEQ ID NO: 884180 - DNA, 25 bp, Mus musculus
atggtcgtggactgttgcacagatc

SEQ ID NO: 884181 - DNA, 25 bp, Mus musculus
atggtcgttgtgcgaatctgctaca

SEQ ID NO: 884182 - DNA, 25 bp, Mus musculus
atggtcgttgtgggaatctgctaca

SEQ ID NO: 884183 - DNA, 25 bp, Mus musculus
atggtcttcagccccatgggagccg

SEQ ID NO: 884184 - DNA, 25 bp, Mus musculus
atggtcttcagcgccatgggagccg

SEQ ID NO: 884185 - DNA, 25 bp, Mus musculus
atggtcttcgtggacattgatgaga

SEQ ID NO: 884186 - DNA, 25 bp, Mus musculus
atggtcttcgtggagattgatgaga

SEQ ID NO: 884187 - DNA, 25 bp, Mus musculus
atggtcttctatccccaatatctct

SEQ ID NO: 884188 - DNA, 25 bp, Mus musculus
atggtcttctatgcccaatatctct

SEQ ID NO: 884189 - DNA, 25 bp, Mus musculus
atggtcttggcagtcccaaagaggt

SEQ ID NO: 884190 - DNA, 25 bp, Mus musculus
atggtcttgggagtcccaaagaggt

SEQ ID NO: 884191 - DNA, 25 bp, Mus musculus
atggtgaaatagattatgaagcaat

SEQ ID NO: 884192 - DNA, 25 bp, Mus musculus
atggtgaaatagtttatgaagcaat

SEQ ID NO: 884193 - DNA, 25 bp, Mus musculus
atggtgaatgcacacacgtggacga

SEQ ID NO: 884194 - DNA, 25 bp, Mus musculus
atggtgaatgcacagacgtggacga

SEQ ID NO: 884195 - DNA, 25 bp, Mus musculus
atggtgacacctttctccatattgc

SEQ ID NO: 884196 - DNA, 25 bp, Mus musculus
atggtgacacgtttctccatattgc

SEQ ID NO: 884197 - DNA, 25 bp, Mus musculus
atggtgaccaagcccaaagctggcc

SEQ ID NO: 884198 - DNA, 25 bp, Mus musculus
atggtgaccaaggccaaagctggcc

SEQ ID NO: 884199 - DNA, 25 bp, Mus musculus
atggtgacggagcgtggcatgtatg

SEQ ID NO: 884200 - DNA, 25 bp, Mus musculus
atggtgacggagggtggcatgtatg

SEQ ID NO: 884201 - DNA, 25 bp, Mus musculus
atggtgcagtgtcctctgcagtaga

SEQ ID NO: 884202 - DNA, 25 bp, Mus musculus
atggtgcagtgtgctctgcagtaga

SEQ ID NO: 884203 - DNA, 25 bp, Mus musculus
atggtggactgtcacactgctgggc

SEQ ID NO: 884204 - DNA, 25 bp, Mus musculus
atggtggactgtcacgattctcttt

SEQ ID NO: 884205 - DNA, 25 bp, Mus musculus
atggtggactgtcagactgctgggc

SEQ ID NO: 884206 - DNA, 25 bp, Mus musculus
atggtggactgtcaggattctcttt

SEQ ID NO: 884207 - DNA, 25 bp, Mus musculus
atggtggaggaacgacacttcgctg

SEQ ID NO: 884208 - DNA, 25 bp, Mus musculus
atggtggaggaaggacacttcgctg

SEQ ID NO: 884209 - DNA, 25 bp, Mus musculus
atggtggatttacgagaggatgaag

SEQ ID NO: 884210 - DNA, 25 bp, Mus musculus
atggtggatttaggagaggatgaag

SEQ ID NO: 884211 - DNA, 25 bp, Mus musculus
atggtggcaggtcactccagctccg

SEQ ID NO: 884212 - DNA, 25 bp, Mus musculus
atggtggcaggtcggacctgaccaa

SEQ ID NO: 884213 - DNA, 25 bp, Mus musculus
atggtggcaggtgactccagctccg

SEQ ID NO: 884214 - DNA, 25 bp, Mus musculus
atggtggcaggtgggacctgaccaa

SEQ ID NO: 884215 - DNA, 25 bp, Mus musculus
atggtggcttgttactggcactgtc

SEQ ID NO: 884216 - DNA, 25 bp, Mus musculus
atggtggcttgttagtggcactgtc

SEQ ID NO: 884217 - DNA, 25 bp, Mus musculus
atggtggtctcccggttctgcagga

SEQ ID NO: 884218 - DNA, 25 bp, Mus musculus
atggtggtctccgggttctgcagga

SEQ ID NO: 884219 - DNA, 25 bp, Mus musculus
atggtggttatctgcgtatcctaga

SEQ ID NO: 884220 - DNA, 25 bp, Mus musculus
atggtggttatctgggtatcctaga

SEQ ID NO: 884221 - DNA, 25 bp, Mus musculus
atggtgtaagctggatgatgacttc

SEQ ID NO: 884222 - DNA, 25 bp, Mus musculus
atggtgtaaggtggatgatgacttc

SEQ ID NO: 884223 - DNA, 25 bp, Mus musculus
atggtgtgagcggtcccacagaggc

SEQ ID NO: 884224 - DNA, 25 bp, Mus musculus
atggtgtgaggggtcccacagaggc

SEQ ID NO: 884225 - DNA, 25 bp, Mus musculus
atggtgtggtggcccgttggagcct

SEQ ID NO: 884226 - DNA, 25 bp, Mus musculus
atggtgtggtggccggttggagcct

SEQ ID NO: 884227 - DNA, 25 bp, Mus musculus
atggtgttactaagcttcctgtggg

SEQ ID NO: 884228 - DNA, 25 bp, Mus musculus
atggtgttactatgcttcctgtggg

SEQ ID NO: 884229 - DNA, 25 bp, Mus musculus
atggtgtttatcaatacacatctcc

SEQ ID NO: 884230 - DNA, 25 bp, Mus musculus
atggtgtttatctatacacatctcc

SEQ ID NO: 884231 - DNA, 25 bp, Mus musculus
atggttatcaccaggtacgtggtta

SEQ ID NO: 884232 - DNA, 25 bp, Mus musculus
atggttatcacctggtacgtggtta

SEQ ID NO: 884233 - DNA, 25 bp, Mus musculus
atggttatccccaatgtcagataca

SEQ ID NO: 884234 - DNA, 25 bp, Mus musculus
atggttatcccctatgtcagataca

SEQ ID NO: 884235 - DNA, 25 bp, Mus musculus
atggttattgatttccccccatcaa

SEQ ID NO: 884236 - DNA, 25 bp, Mus musculus
atggttattgatttgcccccatcaa

SEQ ID NO: 884237 - DNA, 25 bp, Mus musculus
atggttcaagatgaagtgtccggcc

SEQ ID NO: 884238 - DNA, 25 bp, Mus musculus
atggttcaagttgaagtgtccggcc

SEQ ID NO: 884239 - DNA, 25 bp, Mus musculus
atggttcacagacatcccagaaacc

SEQ ID NO: 884240 - DNA, 25 bp, Mus musculus
atggttcacagagatcccagaaacc

SEQ ID NO: 884241 - DNA, 25 bp, Mus musculus
atggttcacccacgctatggtgtgc

SEQ ID NO: 884242 - DNA, 25 bp, Mus musculus
atggttcacccaggctatggtgtgc

SEQ ID NO: 884243 - DNA, 25 bp, Mus musculus
atggttccagattcatacagcaaaa

SEQ ID NO: 884244 - DNA, 25 bp, Mus musculus
atggttccagtttcatacagcaaaa

SEQ ID NO: 884245 - DNA, 25 bp, Mus musculus
atggttgggcagcggcccatgaaga

SEQ ID NO: 884246 - DNA, 25 bp, Mus musculus
atggttgggcaggggcccatgaaga

SEQ ID NO: 884247 - DNA, 25 bp, Mus musculus
atggttttatcgaatatgagaaggc

SEQ ID NO: 884248 - DNA, 25 bp, Mus musculus
atggttttatcgtatatgagaaggc

SEQ ID NO: 884249 - DNA, 25 bp, Mus musculus
atggtttttgctctcagtgtgttgt

SEQ ID NO: 884250 - DNA, 25 bp, Mus musculus
atggtttttggtctcagtgtgttgt

SEQ ID NO: 884251 - DNA, 25 bp, Mus musculus
atgtaacagaggcttcccatctcct

SEQ ID NO: 884252 - DNA, 25 bp, Mus musculus
atgtaacagaggctttgaagatcaa

SEQ ID NO: 884253 - DNA, 25 bp, Mus musculus
atgtaacagagggttcccatctcct

SEQ ID NO: 884254 - DNA, 25 bp, Mus musculus
atgtaacagagggtttgaagatcaa

SEQ ID NO: 884255 - DNA, 25 bp, Mus musculus
atgtaagattctcggctctggtatt

SEQ ID NO: 884256 - DNA, 25 bp, Mus musculus
atgtaagattctgggctctggtatt

SEQ ID NO: 884257 - DNA, 25 bp, Mus musculus
atgtaatccaagcaaatgtggatca

SEQ ID NO: 884258 - DNA, 25 bp, Mus musculus
atgtaatccaaggaaatgtggatca

SEQ ID NO: 884259 - DNA, 25 bp, Mus musculus
atgtaatggacgcgcattttgttcc

SEQ ID NO: 884260 - DNA, 25 bp, Mus musculus
atgtaatggacgggcattttgttcc

SEQ ID NO: 884261 - DNA, 25 bp, Mus musculus
atgtacaaagcaggaaaagctgacc

SEQ ID NO: 884262 - DNA, 25 bp, Mus musculus
atgtacaaaggaggaaaagctgacc

SEQ ID NO: 884263 - DNA, 25 bp, Mus musculus
atgtacaggttccacttctcttgct

SEQ ID NO: 884264 - DNA, 25 bp, Mus musculus
atgtacaggttccagttctcttgct

SEQ ID NO: 884265 - DNA, 25 bp, Mus musculus
atgtaccagaaatacgagcagttga

SEQ ID NO: 884266 - DNA, 25 bp, Mus musculus
atgtaccagaaataggagcagttga

SEQ ID NO: 884267 - DNA, 25 bp, Mus musculus
atgtaccaggagctgaaggtgcctg

SEQ ID NO: 884268 - DNA, 25 bp, Mus musculus
atgtaccaggaggtgaaggtgcctg

SEQ ID NO: 884269 - DNA, 25 bp, Mus musculus
atgtacgagacttgcgaggatgacc

SEQ ID NO: 884270 - DNA, 25 bp, Mus musculus
atgtacgagacttgggaggatgacc

SEQ ID NO: 884271 - DNA, 25 bp, Mus musculus
atgtactaagacctgttcccgtcta

SEQ ID NO: 884272 - DNA, 25 bp, Mus musculus
atgtactaagattccccctgctctt

SEQ ID NO: 884273 - DNA, 25 bp, Mus musculus
atgtactaagcgatacagtggaatg

SEQ ID NO: 884274 - DNA, 25 bp, Mus musculus
atgtactaagctatacagttttgca

SEQ ID NO: 884275 - DNA, 25 bp, Mus musculus
atgtactaagggatacagtggaatg

SEQ ID NO: 884276 - DNA, 25 bp, Mus musculus
atgtactaaggtatacagttttgca

SEQ ID NO: 884277 - DNA, 25 bp, Mus musculus
atgtactaagtcctgttcccgtcta

SEQ ID NO: 884278 - DNA, 25 bp, Mus musculus
atgtactaagtttccccctgctctt

SEQ ID NO: 884279 - DNA, 25 bp, Mus musculus
atgtagaaaacgaaggtggcaagtg

SEQ ID NO: 884280 - DNA, 25 bp, Mus musculus
atgtagaaaacgctggcaagtggga

SEQ ID NO: 884281 - DNA, 25 bp, Mus musculus
atgtagaaaacggtggcaagtggga

SEQ ID NO: 884282 - DNA, 25 bp, Mus musculus
atgtagaaaacgtaggtggcaagtg

SEQ ID NO: 884283 - DNA, 25 bp, Mus musculus
atgtagatgaaacggctgccccact

SEQ ID NO: 884284 - DNA, 25 bp, Mus musculus
atgtagatgaaagggctgccccact

SEQ ID NO: 884285 - DNA, 25 bp, Mus musculus
atgtagatgcagaccgtccagactg

SEQ ID NO: 884286 - DNA, 25 bp, Mus musculus
atgtagatgcagtccgtccagactg

SEQ ID NO: 884287 - DNA, 25 bp, Mus musculus
atgtaggcctcaacaataagtcttg

SEQ ID NO: 884288 - DNA, 25 bp, Mus musculus
atgtaggcctcaactataagtcttg

SEQ ID NO: 884289 - DNA, 25 bp, Mus musculus
atgtataacaagcattctcaaagct

SEQ ID NO: 884290 - DNA, 25 bp, Mus musculus
atgtataacaaggattctcaaagct

SEQ ID NO: 884291 - DNA, 25 bp, Mus musculus
atgtatacagatgccgatgaatgtg

SEQ ID NO: 884292 - DNA, 25 bp, Mus musculus
atgtatacagcttcgccattgtgat

SEQ ID NO: 884293 - DNA, 25 bp, Mus musculus
atgtatacagctttgttaactgaaa

SEQ ID NO: 884294 - DNA, 25 bp, Mus musculus
atgtatacaggttcgccattgtgat

SEQ ID NO: 884295 - DNA, 25 bp, Mus musculus
atgtatacaggtttgttaactgaaa

SEQ ID NO: 884296 - DNA, 25 bp, Mus musculus
atgtatacagttgccgatgaatgtg

SEQ ID NO: 884297 - DNA, 25 bp, Mus musculus
atgtatagataaaaatgtcatggaa

SEQ ID NO: 884298 - DNA, 25 bp, Mus musculus
atgtatagataataatgtcatggaa

SEQ ID NO: 884299 - DNA, 25 bp, Mus musculus
atgtatatctttcgttttggcttgg

SEQ ID NO: 884300 - DNA, 25 bp, Mus musculus
atgtatatctttggttttggcttgg

SEQ ID NO: 884301 - DNA, 25 bp, Mus musculus
atgtatatgtgctacgcaccagccc

SEQ ID NO: 884302 - DNA, 25 bp, Mus musculus
atgtatatgtgctaggcaccagccc

SEQ ID NO: 884303 - DNA, 25 bp, Mus musculus
atgtatcagatgcacgttgcgttac

SEQ ID NO: 884304 - DNA, 25 bp, Mus musculus
atgtatcagatgcaggttgcgttac

SEQ ID NO: 884305 - DNA, 25 bp, Mus musculus
atgtatcaggctaagacatacaaca

SEQ ID NO: 884306 - DNA, 25 bp, Mus musculus
atgtatcagggtaagacatacaaca

SEQ ID NO: 884307 - DNA, 25 bp, Mus musculus
atgtatccagcctcacccagactta

SEQ ID NO: 884308 - DNA, 25 bp, Mus musculus
atgtatccaggctcacccagactta

SEQ ID NO: 884309 - DNA, 25 bp, Mus musculus
atgtatcctgcacgctgccccgaca

SEQ ID NO: 884310 - DNA, 25 bp, Mus musculus
atgtatcctggacgctgccccgaca

SEQ ID NO: 884311 - DNA, 25 bp, Mus musculus
atgtatgatgagattgtagaagact

SEQ ID NO: 884312 - DNA, 25 bp, Mus musculus
atgtatgatgagtttgtagaagact

SEQ ID NO: 884313 - DNA, 25 bp, Mus musculus
atgtatgcgggacgtcccatcagta

SEQ ID NO: 884314 - DNA, 25 bp, Mus musculus
atgtatgcgggaggtcccatcagta

SEQ ID NO: 884315 - DNA, 25 bp, Mus musculus
atgtatgtagcactcacagatttca

SEQ ID NO: 884316 - DNA, 25 bp, Mus musculus
atgtatgtaggactcacagatttca

SEQ ID NO: 884317 - DNA, 25 bp, Mus musculus
atgtattcggtgccaaatgggaaga

SEQ ID NO: 884318 - DNA, 25 bp, Mus musculus
atgtattcggtgcctaatgggaaga

SEQ ID NO: 884319 - DNA, 25 bp, Mus musculus
atgtcaacagaattccagaggttgg

SEQ ID NO: 884320 - DNA, 25 bp, Mus musculus
atgtcaacagcacccacagttatca

SEQ ID NO: 884321 - DNA, 25 bp, Mus musculus
atgtcaacagcccagaaggctcttt

SEQ ID NO: 884322 - DNA, 25 bp, Mus musculus
atgtcaacagctactggaaaaacaa

SEQ ID NO: 884323 - DNA, 25 bp, Mus musculus
atgtcaacaggacccacagttatca

SEQ ID NO: 884324 - DNA, 25 bp, Mus musculus
atgtcaacaggccagaaggctcttt

SEQ ID NO: 884325 - DNA, 25 bp, Mus musculus
atgtcaacaggtactggaaaaacaa

SEQ ID NO: 884326 - DNA, 25 bp, Mus musculus
atgtcaacagtattccagaggttgg

SEQ ID NO: 884327 - DNA, 25 bp, Mus musculus
atgtcaagaccaaacggcccccttg

SEQ ID NO: 884328 - DNA, 25 bp, Mus musculus
atgtcaagaccatacggcccccttg

SEQ ID NO: 884329 - DNA, 25 bp, Mus musculus
atgtcaatcacaacttgaaagatgc

SEQ ID NO: 884330 - DNA, 25 bp, Mus musculus
atgtcaatcacatcttgaaagatgc

SEQ ID NO: 884331 - DNA, 25 bp, Mus musculus
atgtcaatgaggaatcgtcgagcag

SEQ ID NO: 884332 - DNA, 25 bp, Mus musculus
atgtcaatgaggtatcgtcgagcag

SEQ ID NO: 884333 - DNA, 25 bp, Mus musculus
atgtcacacaatccaattcgctttg

SEQ ID NO: 884334 - DNA, 25 bp, Mus musculus
atgtcacacaatgcaattcgctttg

SEQ ID NO: 884335 - DNA, 25 bp, Mus musculus
atgtcacagagcacttttaataacc

SEQ ID NO: 884336 - DNA, 25 bp, Mus musculus
atgtcacagagcagaatgattggca

SEQ ID NO: 884337 - DNA, 25 bp, Mus musculus
atgtcacagagctcttttaataacc

SEQ ID NO: 884338 - DNA, 25 bp, Mus musculus
atgtcacagagctgaatgattggca

SEQ ID NO: 884339 - DNA, 25 bp, Mus musculus
atgtcacctatgatcaggactacca

SEQ ID NO: 884340 - DNA, 25 bp, Mus musculus
atgtcacctatgatcgacaagaagc

SEQ ID NO: 884341 - DNA, 25 bp, Mus musculus
atgtcacctatgatgaggactacca

SEQ ID NO: 884342 - DNA, 25 bp, Mus musculus
atgtcacctatgatggacaagaagc

SEQ ID NO: 884343 - DNA, 25 bp, Mus musculus
atgtcaccttcacctacccctgcag

SEQ ID NO: 884344 - DNA, 25 bp, Mus musculus
atgtcaccttcagctacccctgcag

SEQ ID NO: 884345 - DNA, 25 bp, Mus musculus
atgtcagaaagactctactgtatac

SEQ ID NO: 884346 - DNA, 25 bp, Mus musculus
atgtcagaaagagtctactgtatac

SEQ ID NO: 884347 - DNA, 25 bp, Mus musculus
atgtcagaactacaaacgctgtttg

SEQ ID NO: 884348 - DNA, 25 bp, Mus musculus
atgtcagaactacatacgctgtttg

SEQ ID NO: 884349 - DNA, 25 bp, Mus musculus
atgtcagagagacttgcccacctct

SEQ ID NO: 884350 - DNA, 25 bp, Mus musculus
atgtcagagagagttgcccacctct

SEQ ID NO: 884351 - DNA, 25 bp, Mus musculus
atgtcagaggaaattatgacatgca

SEQ ID NO: 884352 - DNA, 25 bp, Mus musculus
atgtcagaggaatttatgacatgca

SEQ ID NO: 884353 - DNA, 25 bp, Mus musculus
atgtcagaggagctggagcctacta

SEQ ID NO: 884354 - DNA, 25 bp, Mus musculus
atgtcagaggaggtggagcctacta

SEQ ID NO: 884355 - DNA, 25 bp, Mus musculus
atgtcagcagcaaatgatggatgtc

SEQ ID NO: 884356 - DNA, 25 bp, Mus musculus
atgtcagcagcctggcgcattggat

SEQ ID NO: 884357 - DNA, 25 bp, Mus musculus
atgtcagcaggaaatgatggatgtc

SEQ ID NO: 884358 - DNA, 25 bp, Mus musculus
atgtcagcaggctggcgcattggat

SEQ ID NO: 884359 - DNA, 25 bp, Mus musculus
atgtcagcccagctgctgtgagtgg

SEQ ID NO: 884360 - DNA, 25 bp, Mus musculus
atgtcagcccaggtgctgtgagtgg

SEQ ID NO: 884361 - DNA, 25 bp, Mus musculus
atgtcaggactgagcgagaaggatg

SEQ ID NO: 884362 - DNA, 25 bp, Mus musculus
atgtcaggactgagggagaaggatg

SEQ ID NO: 884363 - DNA, 25 bp, Mus musculus
atgtcaggagatcaccttttccact

SEQ ID NO: 884364 - DNA, 25 bp, Mus musculus
atgtcaggagttcaccttttccact

SEQ ID NO: 884365 - DNA, 25 bp, Mus musculus
atgtcatcagcatccagccatgccc

SEQ ID NO: 884366 - DNA, 25 bp, Mus musculus
atgtcatcagccagcctgatctctc

SEQ ID NO: 884367 - DNA, 25 bp, Mus musculus
atgtcatcaggatccagccatgccc

SEQ ID NO: 884368 - DNA, 25 bp, Mus musculus
atgtcatcaggcagcctgatctctc

SEQ ID NO: 884369 - DNA, 25 bp, Mus musculus
atgtcatcctcacacaacattgtgc

SEQ ID NO: 884370 - DNA, 25 bp, Mus musculus
atgtcatcctcacgcacaccaagat

SEQ ID NO: 884371 - DNA, 25 bp, Mus musculus
atgtcatcctcacgcagtgccctga

SEQ ID NO: 884372 - DNA, 25 bp, Mus musculus
atgtcatcctcagacaacattgtgc

SEQ ID NO: 884373 - DNA, 25 bp, Mus musculus
atgtcatcctcaggcacaccaagat

SEQ ID NO: 884374 - DNA, 25 bp, Mus musculus
atgtcatcctcaggcagtgccctga

SEQ ID NO: 884375 - DNA, 25 bp, Mus musculus
atgtcatctatgagctgatccagac

SEQ ID NO: 884376 - DNA, 25 bp, Mus musculus
atgtcatctatgtgctgatccagac

SEQ ID NO: 884377 - DNA, 25 bp, Mus musculus
atgtcatgccacagcactacctgtg

SEQ ID NO: 884378 - DNA, 25 bp, Mus musculus
atgtcatgccacaggactacctgtg

SEQ ID NO: 884379 - DNA, 25 bp, Mus musculus
atgtccaaagccctcgatttcatca

SEQ ID NO: 884380 - DNA, 25 bp, Mus musculus
atgtccaaagccctggatttcatca

SEQ ID NO: 884381 - DNA, 25 bp, Mus musculus
atgtccaccacatctccaagatgtg

SEQ ID NO: 884382 - DNA, 25 bp, Mus musculus
atgtccaccagatctccaagatgtg

SEQ ID NO: 884383 - DNA, 25 bp, Mus musculus
atgtcccacaattctcgactatctc

SEQ ID NO: 884384 - DNA, 25 bp, Mus musculus
atgtcccacactaacccctctaaat

SEQ ID NO: 884385 - DNA, 25 bp, Mus musculus
atgtcccacagtaacccctctaaat

SEQ ID NO: 884386 - DNA, 25 bp, Mus musculus
atgtcccacatttctcgactatctc

SEQ ID NO: 884387 - DNA, 25 bp, Mus musculus
atgtcccatctgcccctgaaaggac

SEQ ID NO: 884388 - DNA, 25 bp, Mus musculus
atgtcccatctggccctgaaaggac

SEQ ID NO: 884389 - DNA, 25 bp, Mus musculus
atgtcccatgaacgaaggaaatcct

SEQ ID NO: 884390 - DNA, 25 bp, Mus musculus
atgtcccatgaaggaaggaaatcct

SEQ ID NO: 884391 - DNA, 25 bp, Mus musculus
atgtccccaagacgtacttttctca

SEQ ID NO: 884392 - DNA, 25 bp, Mus musculus
atgtccccaagaggtacttttctca

SEQ ID NO: 884393 - DNA, 25 bp, Mus musculus
atgtccctgcagatggatcctgagt

SEQ ID NO: 884394 - DNA, 25 bp, Mus musculus
atgtccctgcagttggatcctgagt

SEQ ID NO: 884395 - DNA, 25 bp, Mus musculus
atgtccgcaggccgctcaaagactt

SEQ ID NO: 884396 - DNA, 25 bp, Mus musculus
atgtccgcaggcggctcaaagactt

SEQ ID NO: 884397 - DNA, 25 bp, Mus musculus
atgtccggggacgacatgatttttg

SEQ ID NO: 884398 - DNA, 25 bp, Mus musculus
atgtccggggacgagatgatttttg

SEQ ID NO: 884399 - DNA, 25 bp, Mus musculus
atgtccgtgtgcagcatgttcattc

SEQ ID NO: 884400 - DNA, 25 bp, Mus musculus
atgtccgtgtgcaggatgttcattc

SEQ ID NO: 884401 - DNA, 25 bp, Mus musculus
atgtcctacacgaccctcccagctg

SEQ ID NO: 884402 - DNA, 25 bp, Mus musculus
atgtcctacacgtccctcccagctg

SEQ ID NO: 884403 - DNA, 25 bp, Mus musculus
atgtcctacagcaacgcatcgtcaa

SEQ ID NO: 884404 - DNA, 25 bp, Mus musculus
atgtcctacagcaaggcatcgtcaa

SEQ ID NO: 884405 - DNA, 25 bp, Mus musculus
atgtcctcagccccctgagaccctc

SEQ ID NO: 884406 - DNA, 25 bp, Mus musculus
atgtcctcaggcccctgagaccctc

SEQ ID NO: 884407 - DNA, 25 bp, Mus musculus
atgtcgaagaaacttactgcagcta

SEQ ID NO: 884408 - DNA, 25 bp, Mus musculus
atgtcgaagaaagttactgcagcta

SEQ ID NO: 884409 - DNA, 25 bp, Mus musculus
atgtcgcaggcacactgggttccct

SEQ ID NO: 884410 - DNA, 25 bp, Mus musculus
atgtcgcagggacactgggttccct

SEQ ID NO: 884411 - DNA, 25 bp, Mus musculus
atgtcgccagcgcccctccagcagc

SEQ ID NO: 884412 - DNA, 25 bp, Mus musculus
atgtcgccagggcccctccagcagc

SEQ ID NO: 884413 - DNA, 25 bp, Mus musculus
atgtcgccatggatgagccttccct

SEQ ID NO: 884414 - DNA, 25 bp, Mus musculus
atgtcgccatggttgagccttccct

SEQ ID NO: 884415 - DNA, 25 bp, Mus musculus
atgtcggaagcaccctggaacacca

SEQ ID NO: 884416 - DNA, 25 bp, Mus musculus
atgtcggaagcaccgtggaacacca

SEQ ID NO: 884417 - DNA, 25 bp, Mus musculus
atgtcggaggctccctggaacactc

SEQ ID NO: 884418 - DNA, 25 bp, Mus musculus
atgtcggaggctccgtggaacactc

SEQ ID NO: 884419 - DNA, 25 bp, Mus musculus
atgtcggcaatacacgccgcctggc

SEQ ID NO: 884420 - DNA, 25 bp, Mus musculus
atgtcggcaatacaggccgcctggc

SEQ ID NO: 884421 - DNA, 25 bp, Mus musculus
atgtctaagtccgactctcccaagg

SEQ ID NO: 884422 - DNA, 25 bp, Mus musculus
atgtctaagtccgagtctcccaagg

SEQ ID NO: 884423 - DNA, 25 bp, Mus musculus
atgtctactacacactccccttggt

SEQ ID NO: 884424 - DNA, 25 bp, Mus musculus
atgtctactacacagtccccttggt

SEQ ID NO: 884425 - DNA, 25 bp, Mus musculus
atgtctatgaacttgatcctaagca

SEQ ID NO: 884426 - DNA, 25 bp, Mus musculus
atgtctatgatcttgatcctaagca

SEQ ID NO: 884427 - DNA, 25 bp, Mus musculus
atgtctccactgcaaggaccgctac

SEQ ID NO: 884428 - DNA, 25 bp, Mus musculus
atgtctccactgcatggaccgctac

SEQ ID NO: 884429 - DNA, 25 bp, Mus musculus
atgtctccatctcgaaaagttcctt

SEQ ID NO: 884430 - DNA, 25 bp, Mus musculus
atgtctccatctggaaaagttcctt

SEQ ID NO: 884431 - DNA, 25 bp, Mus musculus
atgtctctggctatctccttcctga

SEQ ID NO: 884432 - DNA, 25 bp, Mus musculus
atgtctctggctttctccttcctga

SEQ ID NO: 884433 - DNA, 25 bp, Mus musculus
atgtctgcagctgccatgttggctg

SEQ ID NO: 884434 - DNA, 25 bp, Mus musculus
atgtctgcaggtgccatgttggctg

SEQ ID NO: 884435 - DNA, 25 bp, Mus musculus
atgtctgcctcaaacctcattggct

SEQ ID NO: 884436 - DNA, 25 bp, Mus musculus
atgtctgcctcaaagctcattggct

SEQ ID NO: 884437 - DNA, 25 bp, Mus musculus
atgtctggagccatctgccctgtca

SEQ ID NO: 884438 - DNA, 25 bp, Mus musculus
atgtctggaggcatctgccctgtca

SEQ ID NO: 884439 - DNA, 25 bp, Mus musculus
atgtctggtcgttccgagttttaat

SEQ ID NO: 884440 - DNA, 25 bp, Mus musculus
atgtctggtcgttcggagttttaat

SEQ ID NO: 884441 - DNA, 25 bp, Mus musculus
atgtctgtatgacaacaaagccagt

SEQ ID NO: 884442 - DNA, 25 bp, Mus musculus
atgtctgtatgactggctgagaggg

SEQ ID NO: 884443 - DNA, 25 bp, Mus musculus
atgtctgtatgagaacaaagccagt

SEQ ID NO: 884444 - DNA, 25 bp, Mus musculus
atgtctgtatgagtggctgagaggg

SEQ ID NO: 884445 - DNA, 25 bp, Mus musculus
atgtcttcagagcacgtacggatgc

SEQ ID NO: 884446 - DNA, 25 bp, Mus musculus
atgtcttcagagcaggtacggatgc

SEQ ID NO: 884447 - DNA, 25 bp, Mus musculus
atgtcttccagtcacagaacacctt

SEQ ID NO: 884448 - DNA, 25 bp, Mus musculus
atgtcttccagtcagagaacacctt

SEQ ID NO: 884449 - DNA, 25 bp, Mus musculus
atgtctttgaaaaactgcccactag

SEQ ID NO: 884450 - DNA, 25 bp, Mus musculus
atgtctttgaaaaagtgcccactag

SEQ ID NO: 884451 - DNA, 25 bp, Mus musculus
atgtgaaatgtccacgttgctacaa

SEQ ID NO: 884452 - DNA, 25 bp, Mus musculus
atgtgaaatgtccaggttgctacaa

SEQ ID NO: 884453 - DNA, 25 bp, Mus musculus
atgtgaacaaagagaattccaaggc

SEQ ID NO: 884454 - DNA, 25 bp, Mus musculus
atgtgaacaaagtgaattccaaggc

SEQ ID NO: 884455 - DNA, 25 bp, Mus musculus
atgtgaacagcaagatgacaacagg

SEQ ID NO: 884456 - DNA, 25 bp, Mus musculus
atgtgaacaggaagatgacaacagg

SEQ ID NO: 884457 - DNA, 25 bp, Mus musculus
atgtgaagaaagccccacgcctact

SEQ ID NO: 884458 - DNA, 25 bp, Mus musculus
atgtgaagaaaggcccacgcctact

SEQ ID NO: 884459 - DNA, 25 bp, Mus musculus
atgtgaagagctggttttggggtcc

SEQ ID NO: 884460 - DNA, 25 bp, Mus musculus
atgtgaagagctttgttgtctcatg

SEQ ID NO: 884461 - DNA, 25 bp, Mus musculus
atgtgaagaggtggttttggggtcc

SEQ ID NO: 884462 - DNA, 25 bp, Mus musculus
atgtgaagaggtttgttgtctcatg

SEQ ID NO: 884463 - DNA, 25 bp, Mus musculus
atgtgaagtgctctcgtcctcctcc

SEQ ID NO: 884464 - DNA, 25 bp, Mus musculus
atgtgaagtgctctggtcctcctcc

SEQ ID NO: 884465 - DNA, 25 bp, Mus musculus
atgtgaagttcaagctgtacgatcg

SEQ ID NO: 884466 - DNA, 25 bp, Mus musculus
atgtgaagttcatgctgtacgatcg

SEQ ID NO: 884467 - DNA, 25 bp, Mus musculus
atgtgaataaaacacagctgatcac

SEQ ID NO: 884468 - DNA, 25 bp, Mus musculus
atgtgaataaaagacagctgatcac

SEQ ID NO: 884469 - DNA, 25 bp, Mus musculus
atgtgacatacgatcaggactacca

SEQ ID NO: 884470 - DNA, 25 bp, Mus musculus
atgtgacatacgatgaggactacca

SEQ ID NO: 884471 - DNA, 25 bp, Mus musculus
atgtgacatactggcgtgagcatgc

SEQ ID NO: 884472 - DNA, 25 bp, Mus musculus
atgtgacatactggggtgagcatgc

SEQ ID NO: 884473 - DNA, 25 bp, Mus musculus
atgtgacatgaaagtggattttgat

SEQ ID NO: 884474 - DNA, 25 bp, Mus musculus
atgtgacatgaatgtggattttgat

SEQ ID NO: 884475 - DNA, 25 bp, Mus musculus
atgtgaccatcacgtactgcagggt

SEQ ID NO: 884476 - DNA, 25 bp, Mus musculus
atgtgaccatcaggtactgcagggt

SEQ ID NO: 884477 - DNA, 25 bp, Mus musculus
atgtgactcaagctcgtgtggccag

SEQ ID NO: 884478 - DNA, 25 bp, Mus musculus
atgtgactcaaggtcgtgtggccag

SEQ ID NO: 884479 - DNA, 25 bp, Mus musculus
atgtgacttacattcttgaaccaga

SEQ ID NO: 884480 - DNA, 25 bp, Mus musculus
atgtgacttacattgttgaaccaga

SEQ ID NO: 884481 - DNA, 25 bp, Mus musculus
atgtgagcagattttctcctcaaaa

SEQ ID NO: 884482 - DNA, 25 bp, Mus musculus
atgtgagcagcaggcctctgaagac

SEQ ID NO: 884483 - DNA, 25 bp, Mus musculus
atgtgagcaggaggcctctgaagac

SEQ ID NO: 884484 - DNA, 25 bp, Mus musculus
atgtgagcagtacacggattgtgca

SEQ ID NO: 884485 - DNA, 25 bp, Mus musculus
atgtgagcagtacagggattgtgca

SEQ ID NO: 884486 - DNA, 25 bp, Mus musculus
atgtgagcagtttttctcctcaaaa

SEQ ID NO: 884487 - DNA, 25 bp, Mus musculus
atgtgatgagaaagttccatggcta

SEQ ID NO: 884488 - DNA, 25 bp, Mus musculus
atgtgatgagtaagttccatggcta

SEQ ID NO: 884489 - DNA, 25 bp, Mus musculus
atgtgatggtcacctctgacggagt

SEQ ID NO: 884490 - DNA, 25 bp, Mus musculus
atgtgatggtcagctctgacggagt

SEQ ID NO: 884491 - DNA, 25 bp, Mus musculus
atgtgatttcagcttgatgactgag

SEQ ID NO: 884492 - DNA, 25 bp, Mus musculus
atgtgatttcaggttgatgactgag

SEQ ID NO: 884493 - DNA, 25 bp, Mus musculus
atgtgattttcacgaaaagtgcaag

SEQ ID NO: 884494 - DNA, 25 bp, Mus musculus
atgtgattttcaggaaaagtgcaag

SEQ ID NO: 884495 - DNA, 25 bp, Mus musculus
atgtgcaaccacagcgactggaaat

SEQ ID NO: 884496 - DNA, 25 bp, Mus musculus
atgtgcaaccacagggactggaaat

SEQ ID NO: 884497 - DNA, 25 bp, Mus musculus
atgtgcaacctgcaccatgggcttg

SEQ ID NO: 884498 - DNA, 25 bp, Mus musculus
atgtgcaacctggaccatgggcttg

SEQ ID NO: 884499 - DNA, 25 bp, Mus musculus
atgtgcagagtgctcatcagggcac

SEQ ID NO: 884500 - DNA, 25 bp, Mus musculus
atgtgcagagtgctgatcagggcac

SEQ ID NO: 884501 - DNA, 25 bp, Mus musculus
atgtgcagcgcactgagctgctgtg

SEQ ID NO: 884502 - DNA, 25 bp, Mus musculus
atgtgcagcgcagtgagctgctgtg

SEQ ID NO: 884503 - DNA, 25 bp, Mus musculus
atgtgcagttagctatctctggaga

SEQ ID NO: 884504 - DNA, 25 bp, Mus musculus
atgtgcagttaggtatctctggaga

SEQ ID NO: 884505 - DNA, 25 bp, Mus musculus
atgtgccaagaaatgtatatttaca

SEQ ID NO: 884506 - DNA, 25 bp, Mus musculus
atgtgccaagtaatgtatatttaca

SEQ ID NO: 884507 - DNA, 25 bp, Mus musculus
atgtgcccattccacctgtcgcaga

SEQ ID NO: 884508 - DNA, 25 bp, Mus musculus
atgtgcccattccagctgtcgcaga

SEQ ID NO: 884509 - DNA, 25 bp, Mus musculus
atgtgcccattgcacggatgcctgc

SEQ ID NO: 884510 - DNA, 25 bp, Mus musculus
atgtgcccattgcagggatgcctgc

SEQ ID NO: 884511 - DNA, 25 bp, Mus musculus
atgtgccccttgatgtagagtataa

SEQ ID NO: 884512 - DNA, 25 bp, Mus musculus
atgtgccccttgttgtagagtataa

SEQ ID NO: 884513 - DNA, 25 bp, Mus musculus
atgtgctaagagagggagagtagaa

SEQ ID NO: 884514 - DNA, 25 bp, Mus musculus
atgtgctaagtgagggagagtagaa

SEQ ID NO: 884515 - DNA, 25 bp, Mus musculus
atgtgctgaaagcgttcaacttctc

SEQ ID NO: 884516 - DNA, 25 bp, Mus musculus
atgtgctgaaagggttcaacttctc

SEQ ID NO: 884517 - DNA, 25 bp, Mus musculus
atgtgctgcacctgaacaatgctga

SEQ ID NO: 884518 - DNA, 25 bp, Mus musculus
atgtgctgcacctgtacaatgctga

SEQ ID NO: 884519 - DNA, 25 bp, Mus musculus
atgtgcttacatgcatgtgtaatac

SEQ ID NO: 884520 - DNA, 25 bp, Mus musculus
atgtgcttaccagtctactgtgctt

SEQ ID NO: 884521 - DNA, 25 bp, Mus musculus
atgtgcttacgagtctactgtgctt

SEQ ID NO: 884522 - DNA, 25 bp, Mus musculus
atgtgcttacttgcatgtgtaatac

SEQ ID NO: 884523 - DNA, 25 bp, Mus musculus
atgtgcttgtcatacaactgggcgg

SEQ ID NO: 884524 - DNA, 25 bp, Mus musculus
atgtgcttgtcatagaactgggcgg

SEQ ID NO: 884525 - DNA, 25 bp, Mus musculus
atgtgcttttagctgaggcagagcc

SEQ ID NO: 884526 - DNA, 25 bp, Mus musculus
atgtgctttttgctgaggcagagcc

SEQ ID NO: 884527 - DNA, 25 bp, Mus musculus
atgtggaaaatgctaaaattgtact

SEQ ID NO: 884528 - DNA, 25 bp, Mus musculus
atgtggaaaatggtaaaattgtact

SEQ ID NO: 884529 - DNA, 25 bp, Mus musculus
atgtggaagacgccaaggggatcaa

SEQ ID NO: 884530 - DNA, 25 bp, Mus musculus
atgtggaagacggcaaggggatcaa

SEQ ID NO: 884531 - DNA, 25 bp, Mus musculus
atgtggaccaagcgtggatgcgagc

SEQ ID NO: 884532 - DNA, 25 bp, Mus musculus
atgtggaccaagggtggatgcgagc

SEQ ID NO: 884533 - DNA, 25 bp, Mus musculus
atgtggagactgccacccagctgga

SEQ ID NO: 884534 - DNA, 25 bp, Mus musculus
atgtggagactggcacccagctgga

SEQ ID NO: 884535 - DNA, 25 bp, Mus musculus
atgtggcatgcttcctgacggaaac

SEQ ID NO: 884536 - DNA, 25 bp, Mus musculus
atgtggcatggttcctgacggaaac

SEQ ID NO: 884537 - DNA, 25 bp, Mus musculus
atgtggccaaagatatgcttccatc

SEQ ID NO: 884538 - DNA, 25 bp, Mus musculus
atgtggccaaagttatgcttccatc

SEQ ID NO: 884539 - DNA, 25 bp, Mus musculus
atgtggccatcacggctgtggcaga

SEQ ID NO: 884540 - DNA, 25 bp, Mus musculus
atgtggccatcacgggctgtggcag

SEQ ID NO: 884541 - DNA, 25 bp, Mus musculus
atgtggccatcagggctgtggcaga

SEQ ID NO: 884542 - DNA, 25 bp, Mus musculus
atgtggccatcaggggctgtggcag

SEQ ID NO: 884543 - DNA, 25 bp, Mus musculus
atgtggcctcagcgtgcttggacat

SEQ ID NO: 884544 - DNA, 25 bp, Mus musculus
atgtggcctcagggtgcttggacat

SEQ ID NO: 884545 - DNA, 25 bp, Mus musculus
atgtggcctctgtacgctggcccgg

SEQ ID NO: 884546 - DNA, 25 bp, Mus musculus
atgtggcctctgtaggctggcccgg

SEQ ID NO: 884547 - DNA, 25 bp, Mus musculus
atgtggctgagtcacgtcctggctt

SEQ ID NO: 884548 - DNA, 25 bp, Mus musculus
atgtggctgagtcaggtcctggctt

SEQ ID NO: 884549 - DNA, 25 bp, Mus musculus
atgtgggaagaaccctggcttcagt

SEQ ID NO: 884550 - DNA, 25 bp, Mus musculus
atgtgggaagtaccctggcttcagt

SEQ ID NO: 884551 - DNA, 25 bp, Mus musculus
atgtggggccagctgtcctgtccat

SEQ ID NO: 884552 - DNA, 25 bp, Mus musculus
atgtggggccaggtgtcctgtccat

SEQ ID NO: 884553 - DNA, 25 bp, Mus musculus
atgtggtacaagcatgaggtgctgc

SEQ ID NO: 884554 - DNA, 25 bp, Mus musculus
atgtggtacaaggatgaggtgctgc

SEQ ID NO: 884555 - DNA, 25 bp, Mus musculus
atgtggtgatgactgacagtgaaga

SEQ ID NO: 884556 - DNA, 25 bp, Mus musculus
atgtggtgatgagtgacagtgaaga

SEQ ID NO: 884557 - DNA, 25 bp, Mus musculus
atgtgtagggcagctgtcccgacca

SEQ ID NO: 884558 - DNA, 25 bp, Mus musculus
atgtgtaggggagctgtcccgacca

SEQ ID NO: 884559 - DNA, 25 bp, Mus musculus
atgtgtatggcgagaagaaacatgt

SEQ ID NO: 884560 - DNA, 25 bp, Mus musculus
atgtgtatggggagaagaaacatgt

SEQ ID NO: 884561 - DNA, 25 bp, Mus musculus
atgtgtccagagcaagatttgagct

SEQ ID NO: 884562 - DNA, 25 bp, Mus musculus
atgtgtccagtgcaagatttgagct

SEQ ID NO: 884563 - DNA, 25 bp, Mus musculus
atgtgtcctcatcaccggggaaagc

SEQ ID NO: 884564 - DNA, 25 bp, Mus musculus
atgtgtcctcatcagcggggaaagc

SEQ ID NO: 884565 - DNA, 25 bp, Mus musculus
atgtgtcctcgacagacccagccat

SEQ ID NO: 884566 - DNA, 25 bp, Mus musculus
atgtgtcctcgacttttactacaga

SEQ ID NO: 884567 - DNA, 25 bp, Mus musculus
atgtgtcctcgagagacccagccat

SEQ ID NO: 884568 - DNA, 25 bp, Mus musculus
atgtgtcctcgagttttactacaga

SEQ ID NO: 884569 - DNA, 25 bp, Mus musculus
atgtgtgaggacgtgaatgagtgtg

SEQ ID NO: 884570 - DNA, 25 bp, Mus musculus
atgtgtgaggtcgtgaatgagtgtg

SEQ ID NO: 884571 - DNA, 25 bp, Mus musculus
atgtgtggtgagatattaagacatc

SEQ ID NO: 884572 - DNA, 25 bp, Mus musculus
atgtgtggtgtgatattaagacatc

SEQ ID NO: 884573 - DNA, 25 bp, Mus musculus
atgtgttaaaagacatcactcaaga

SEQ ID NO: 884574 - DNA, 25 bp, Mus musculus
atgtgttaaaagtcatcactcaaga

SEQ ID NO: 884575 - DNA, 25 bp, Mus musculus
atgtgttaagattccgtggtatatt

SEQ ID NO: 884576 - DNA, 25 bp, Mus musculus
atgtgttaagattcggtggtatatt

SEQ ID NO: 884577 - DNA, 25 bp, Mus musculus
atgtgttaagcaagtgataagtaaa

SEQ ID NO: 884578 - DNA, 25 bp, Mus musculus
atgtgttaaggaagtgataagtaaa

SEQ ID NO: 884579 - DNA, 25 bp, Mus musculus
atgtgttcagaggaaagattacaca

SEQ ID NO: 884580 - DNA, 25 bp, Mus musculus
atgtgttcagtggaaagattacaca

SEQ ID NO: 884581 - DNA, 25 bp, Mus musculus
atgtgtttatgacaccttttggaat

SEQ ID NO: 884582 - DNA, 25 bp, Mus musculus
atgtgtttatgacagcttttggaat

SEQ ID NO: 884583 - DNA, 25 bp, Mus musculus
atgttacggaggacccgagtcagaa

SEQ ID NO: 884584 - DNA, 25 bp, Mus musculus
atgttacggaggtcccgagtcagaa

SEQ ID NO: 884585 - DNA, 25 bp, Mus musculus
atgttactagcagtcaagcttggca

SEQ ID NO: 884586 - DNA, 25 bp, Mus musculus
atgttactaggagtcaagcttggca

SEQ ID NO: 884587 - DNA, 25 bp, Mus musculus
atgttactatcaaactattctgcag

SEQ ID NO: 884588 - DNA, 25 bp, Mus musculus
atgttactatcaaagtattctgcag

SEQ ID NO: 884589 - DNA, 25 bp, Mus musculus
atgttataccagcactgagcttgct

SEQ ID NO: 884590 - DNA, 25 bp, Mus musculus
atgttataccaggactgagcttgct

SEQ ID NO: 884591 - DNA, 25 bp, Mus musculus
atgttatctcacaatcctttgtgag

SEQ ID NO: 884592 - DNA, 25 bp, Mus musculus
atgttatctcactatcctttgtgag

SEQ ID NO: 884593 - DNA, 25 bp, Mus musculus
atgttatgttcgtattttctgctgt

SEQ ID NO: 884594 - DNA, 25 bp, Mus musculus
atgttatgttggtattttctgctgt

SEQ ID NO: 884595 - DNA, 25 bp, Mus musculus
atgttcaaacagacgtggatggata

SEQ ID NO: 884596 - DNA, 25 bp, Mus musculus
atgttcaaacagtcgtggatggata

SEQ ID NO: 884597 - DNA, 25 bp, Mus musculus
atgttcacacctaacatggaacagc

SEQ ID NO: 884598 - DNA, 25 bp, Mus musculus
atgttcacacctaacattgagcagc

SEQ ID NO: 884599 - DNA, 25 bp, Mus musculus
atgttcacacctaagatggaacagc

SEQ ID NO: 884600 - DNA, 25 bp, Mus musculus
atgttcacacctaagattgagcagc

SEQ ID NO: 884601 - DNA, 25 bp, Mus musculus
atgttcacagaacaacagctgctaa

SEQ ID NO: 884602 - DNA, 25 bp, Mus musculus
atgttcacagtacaacagctgctaa

SEQ ID NO: 884603 - DNA, 25 bp, Mus musculus
atgttcacctatcgctgcacgtggg

SEQ ID NO: 884604 - DNA, 25 bp, Mus musculus
atgttcacctatggctgcacgtggg

SEQ ID NO: 884605 - DNA, 25 bp, Mus musculus
atgttcacttcacgtattgacctca

SEQ ID NO: 884606 - DNA, 25 bp, Mus musculus
atgttcacttcacgtgtggacctcg

SEQ ID NO: 884607 - DNA, 25 bp, Mus musculus
atgttcacttcaggtattgacctca

SEQ ID NO: 884608 - DNA, 25 bp, Mus musculus
atgttcacttcaggtgtggacctcg

SEQ ID NO: 884609 - DNA, 25 bp, Mus musculus
atgttcagacgtcgtctggacagct

SEQ ID NO: 884610 - DNA, 25 bp, Mus musculus
atgttcagacgtggtctggacagct

SEQ ID NO: 884611 - DNA, 25 bp, Mus musculus
atgttccaggcgaggaatggagttg

SEQ ID NO: 884612 - DNA, 25 bp, Mus musculus
atgttccaggggaggaatggagttg

SEQ ID NO: 884613 - DNA, 25 bp, Mus musculus
atgttccgagaccacacccctgagc

SEQ ID NO: 884614 - DNA, 25 bp, Mus musculus
atgttccgagaccagacccctgagc

SEQ ID NO: 884615 - DNA, 25 bp, Mus musculus
atgttcgacagaatttttggacaag

SEQ ID NO: 884616 - DNA, 25 bp, Mus musculus
atgttcgacagattttttggacaag

SEQ ID NO: 884617 - DNA, 25 bp, Mus musculus
atgttcgaggaccacatggcttcac

SEQ ID NO: 884618 - DNA, 25 bp, Mus musculus
atgttcgaggaccagatggcttcac

SEQ ID NO: 884619 - DNA, 25 bp, Mus musculus
atgttcgtctttcggggctatactg

SEQ ID NO: 884620 - DNA, 25 bp, Mus musculus
atgttcgtctttgggggctatactg

SEQ ID NO: 884621 - DNA, 25 bp, Mus musculus
atgttctaccggcactggtggaact

SEQ ID NO: 884622 - DNA, 25 bp, Mus musculus
atgttctaccgggactggtggaact

SEQ ID NO: 884623 - DNA, 25 bp, Mus musculus
atgttctatgagtccgtttatggcc

SEQ ID NO: 884624 - DNA, 25 bp, Mus musculus
atgttctatgagtcggtttatggcc

SEQ ID NO: 884625 - DNA, 25 bp, Mus musculus
atgttctgtgcaatctgggtcgctg

SEQ ID NO: 884626 - DNA, 25 bp, Mus musculus
atgttctgtgcattctgggtcgctg

SEQ ID NO: 884627 - DNA, 25 bp, Mus musculus
atgttctgtgctcgcttcaaggtga

SEQ ID NO: 884628 - DNA, 25 bp, Mus musculus
atgttctgtgctggcttcaaggtga

SEQ ID NO: 884629 - DNA, 25 bp, Mus musculus
atgttcttcaacaacgcattgtgaa

SEQ ID NO: 884630 - DNA, 25 bp, Mus musculus
atgttcttcaacaaggcattgtgaa

SEQ ID NO: 884631 - DNA, 25 bp, Mus musculus
atgttcttctccaccgtactacttg

SEQ ID NO: 884632 - DNA, 25 bp, Mus musculus
atgttcttctccaccttctaccacg

SEQ ID NO: 884633 - DNA, 25 bp, Mus musculus
atgttcttctccacggtactacttg

SEQ ID NO: 884634 - DNA, 25 bp, Mus musculus
atgttcttctccacgttctaccacg

SEQ ID NO: 884635 - DNA, 25 bp, Mus musculus
atgttcttggaaacctgatatctca

SEQ ID NO: 884636 - DNA, 25 bp, Mus musculus
atgttcttggtaacctgatatctca

SEQ ID NO: 884637 - DNA, 25 bp, Mus musculus
atgttgaaagatgatgccacagaga

SEQ ID NO: 884638 - DNA, 25 bp, Mus musculus
atgttgaaagttgatgccacagaga

SEQ ID NO: 884639 - DNA, 25 bp, Mus musculus
atgttgaagtccgacgcaacggaga

SEQ ID NO: 884640 - DNA, 25 bp, Mus musculus
atgttgaagtgcgacgcaacggaga

SEQ ID NO: 884641 - DNA, 25 bp, Mus musculus
atgttgaggaggaacgccaggtgcc

SEQ ID NO: 884642 - DNA, 25 bp, Mus musculus
atgttgaggaggaaggccaggtgcc

SEQ ID NO: 884643 - DNA, 25 bp, Mus musculus
atgttgatcttgcacattctacgca

SEQ ID NO: 884644 - DNA, 25 bp, Mus musculus
atgttgatcttgcagattctacgca

SEQ ID NO: 884645 - DNA, 25 bp, Mus musculus
atgttgattcaagaagctactatgg

SEQ ID NO: 884646 - DNA, 25 bp, Mus musculus
atgttgattctagaagctactatgg

SEQ ID NO: 884647 - DNA, 25 bp, Mus musculus
atgttgccttagacggacctagaga

SEQ ID NO: 884648 - DNA, 25 bp, Mus musculus
atgttgcctttgacggacctagaga

SEQ ID NO: 884649 - DNA, 25 bp, Mus musculus
atgttgctgaagcttcaaaagaaag

SEQ ID NO: 884650 - DNA, 25 bp, Mus musculus
atgttgctgaaggttcaaaagaaag

SEQ ID NO: 884651 - DNA, 25 bp, Mus musculus
atgttgctgcagctgaacgatgtca

SEQ ID NO: 884652 - DNA, 25 bp, Mus musculus
atgttgctgcaggtgaacgatgtca

SEQ ID NO: 884653 - DNA, 25 bp, Mus musculus
atgttgctgtcacgaacccatgtga

SEQ ID NO: 884654 - DNA, 25 bp, Mus musculus
atgttgctgtcaggaacccatgtga

SEQ ID NO: 884655 - DNA, 25 bp, Mus musculus
atgttggactcacaggccactactt

SEQ ID NO: 884656 - DNA, 25 bp, Mus musculus
atgttggactcagaggccactactt

SEQ ID NO: 884657 - DNA, 25 bp, Mus musculus
atgttggcacgagacgaccctctca

SEQ ID NO: 884658 - DNA, 25 bp, Mus musculus
atgttggcacgagaggaccctctca

SEQ ID NO: 884659 - DNA, 25 bp, Mus musculus
atgttggctgaaagtttgttaactg

SEQ ID NO: 884660 - DNA, 25 bp, Mus musculus
atgttggctgaatgtttgttaactg

SEQ ID NO: 884661 - DNA, 25 bp, Mus musculus
atgttgggaacagacgactctgggg

SEQ ID NO: 884662 - DNA, 25 bp, Mus musculus
atgttgggaacagaggactctgggg

SEQ ID NO: 884663 - DNA, 25 bp, Mus musculus
atgttgtacgcctgatggatgtctg

SEQ ID NO: 884664 - DNA, 25 bp, Mus musculus
atgttgtacggctgatggatgtctg

SEQ ID NO: 884665 - DNA, 25 bp, Mus musculus
atgttgtcaaagtttatgaacctca

SEQ ID NO: 884666 - DNA, 25 bp, Mus musculus
atgttgtcaatgtttatgaacctca

SEQ ID NO: 884667 - DNA, 25 bp, Mus musculus
atgttgtccctgacaggtttggcca

SEQ ID NO: 884668 - DNA, 25 bp, Mus musculus
atgttgtccctgtcaggtttggcca

SEQ ID NO: 884669 - DNA, 25 bp, Mus musculus
atgttgttagatcacgctgctttct

SEQ ID NO: 884670 - DNA, 25 bp, Mus musculus
atgttgttagatcacgggggctttg

SEQ ID NO: 884671 - DNA, 25 bp, Mus musculus
atgttgttagatcaggctgctttct

SEQ ID NO: 884672 - DNA, 25 bp, Mus musculus
atgttgttagatcaggggggctttg

SEQ ID NO: 884673 - DNA, 25 bp, Mus musculus
atgttgttcctggccctatatgtgc

SEQ ID NO: 884674 - DNA, 25 bp, Mus musculus
atgttgttcctggcgctatatgtgc

SEQ ID NO: 884675 - DNA, 25 bp, Mus musculus
atgtttaattcttcctgctgctgtc

SEQ ID NO: 884676 - DNA, 25 bp, Mus musculus
atgtttaattgttcctgctgctgtc

SEQ ID NO: 884677 - DNA, 25 bp, Mus musculus
atgtttacagaggccggcctcattg

SEQ ID NO: 884678 - DNA, 25 bp, Mus musculus
atgtttacagataggtgacagcagg

SEQ ID NO: 884679 - DNA, 25 bp, Mus musculus
atgtttacagtggccggcctcattg

SEQ ID NO: 884680 - DNA, 25 bp, Mus musculus
atgtttacagttaggtgacagcagg

SEQ ID NO: 884681 - DNA, 25 bp, Mus musculus
atgtttatgatacgggacgaacagg

SEQ ID NO: 884682 - DNA, 25 bp, Mus musculus
atgtttatgataggggacgaacagg

SEQ ID NO: 884683 - DNA, 25 bp, Mus musculus
atgtttcaggaggtttgttgaagta

SEQ ID NO: 884684 - DNA, 25 bp, Mus musculus
atgtttcaggtggtttgttgaagta

SEQ ID NO: 884685 - DNA, 25 bp, Mus musculus
atgtttccagatggcctctattact

SEQ ID NO: 884686 - DNA, 25 bp, Mus musculus
atgtttccagttggcctctattact

SEQ ID NO: 884687 - DNA, 25 bp, Mus musculus
atgtttgaacagccccacgaagccg

SEQ ID NO: 884688 - DNA, 25 bp, Mus musculus
atgtttgaacaggcccacgaagccg

SEQ ID NO: 884689 - DNA, 25 bp, Mus musculus
atgtttgagaagaatgacatcagca

SEQ ID NO: 884690 - DNA, 25 bp, Mus musculus
atgtttgagaagtatgacatcagca

SEQ ID NO: 884691 - DNA, 25 bp, Mus musculus
atgtttgcagccgagctatagaaat

SEQ ID NO: 884692 - DNA, 25 bp, Mus musculus
atgtttgcaggcgagctatagaaat

SEQ ID NO: 884693 - DNA, 25 bp, Mus musculus
atgtttgctgaaaacaatggcctgc

SEQ ID NO: 884694 - DNA, 25 bp, Mus musculus
atgtttgctgtaaacaatggcctgc

SEQ ID NO: 884695 - DNA, 25 bp, Mus musculus
atgtttggagcccatgacaccacag

SEQ ID NO: 884696 - DNA, 25 bp, Mus musculus
atgtttggagcccatgacaccacgg

SEQ ID NO: 884697 - DNA, 25 bp, Mus musculus
atgtttggaggccatgacaccacag

SEQ ID NO: 884698 - DNA, 25 bp, Mus musculus
atgtttggaggccatgacaccacgg

SEQ ID NO: 884699 - DNA, 25 bp, Mus musculus
atgtttgtgaagcgggctccagaag

SEQ ID NO: 884700 - DNA, 25 bp, Mus musculus
atgtttgtgaagggggctccagaag

SEQ ID NO: 884701 - DNA, 25 bp, Mus musculus
atgttttatcacatttccctggagc

SEQ ID NO: 884702 - DNA, 25 bp, Mus musculus
atgttttatcacttttccctggagc

SEQ ID NO: 884703 - DNA, 25 bp, Mus musculus
atgttttctggactgacactagcag

SEQ ID NO: 884704 - DNA, 25 bp, Mus musculus
atgttttctggagtgacactagcag

SEQ ID NO: 884705 - DNA, 25 bp, Mus musculus
attaaaaaagaatacatgtgccaac

SEQ ID NO: 884706 - DNA, 25 bp, Mus musculus
attaaaaaagaatagatgtgccaac

SEQ ID NO: 884707 - DNA, 25 bp, Mus musculus
attaaaacaaagatgtctcatttcc

SEQ ID NO: 884708 - DNA, 25 bp, Mus musculus
attaaaacaaagttgtctcatttcc

SEQ ID NO: 884709 - DNA, 25 bp, Mus musculus
attaaaagctaaacaagagcatgaa

SEQ ID NO: 884710 - DNA, 25 bp, Mus musculus
attaaaagctaaactagagcatgaa

SEQ ID NO: 884711 - DNA, 25 bp, Mus musculus
attaaaatcagcaacagcccagatg

SEQ ID NO: 884712 - DNA, 25 bp, Mus musculus
attaaaatcagcaagagcccagatg

SEQ ID NO: 884713 - DNA, 25 bp, Mus musculus
attaaacgaacaatccagttcattc

SEQ ID NO: 884714 - DNA, 25 bp, Mus musculus
attaaacgaagaatccagttcattc

SEQ ID NO: 884715 - DNA, 25 bp, Mus musculus
attaaactagccctgaggagcgatg

SEQ ID NO: 884716 - DNA, 25 bp, Mus musculus
attaaactaggcctgaggagcgatg

SEQ ID NO: 884717 - DNA, 25 bp, Mus musculus
attaaacttacaacaaaattatatt

SEQ ID NO: 884718 - DNA, 25 bp, Mus musculus
attaaacttacaagtttgaggattg

SEQ ID NO: 884719 - DNA, 25 bp, Mus musculus
attaaacttacatcaaaattatatt

SEQ ID NO: 884720 - DNA, 25 bp, Mus musculus
attaaacttacatgtttgaggattg

SEQ ID NO: 884721 - DNA, 25 bp, Mus musculus
attaaagtgaagaccaccacagaaa

SEQ ID NO: 884722 - DNA, 25 bp, Mus musculus
attaaagtgaagacgctgactggga

SEQ ID NO: 884723 - DNA, 25 bp, Mus musculus
attaaagtgaagtccaccacagaaa

SEQ ID NO: 884724 - DNA, 25 bp, Mus musculus
attaaagtgaagtcgctgactggga

SEQ ID NO: 884725 - DNA, 25 bp, Mus musculus
attaacaagccaaatgaaaaagttc

SEQ ID NO: 884726 - DNA, 25 bp, Mus musculus
attaacaagccatatgaaaaagttc

SEQ ID NO: 884727 - DNA, 25 bp, Mus musculus
attaacagagcatattttgcccgag

SEQ ID NO: 884728 - DNA, 25 bp, Mus musculus
attaacagaggatattttgcccgag

SEQ ID NO: 884729 - DNA, 25 bp, Mus musculus
attaaccagcctcctctaaaacaaa

SEQ ID NO: 884730 - DNA, 25 bp, Mus musculus
attaaccagcctgctctaaaacaaa

SEQ ID NO: 884731 - DNA, 25 bp, Mus musculus
attaacccagctccgtacactgtca

SEQ ID NO: 884732 - DNA, 25 bp, Mus musculus
attaacccaggtccgtacactgtca

SEQ ID NO: 884733 - DNA, 25 bp, Mus musculus
attaagaagcagccagagatcctgc

SEQ ID NO: 884734 - DNA, 25 bp, Mus musculus
attaagaagcaggcagagatcctgc

SEQ ID NO: 884735 - DNA, 25 bp, Mus musculus
attaagaatgagctggcgagtggga

SEQ ID NO: 884736 - DNA, 25 bp, Mus musculus
attaagaatgaggtggcgagtggga

SEQ ID NO: 884737 - DNA, 25 bp, Mus musculus
attaagactggaaacgcctccattc

SEQ ID NO: 884738 - DNA, 25 bp, Mus musculus
attaagactggaaaggcctccattc

SEQ ID NO: 884739 - DNA, 25 bp, Mus musculus
attaagagcagcaacggcatgcagc

SEQ ID NO: 884740 - DNA, 25 bp, Mus musculus
attaagagcagcaagggcatgcagc

SEQ ID NO: 884741 - DNA, 25 bp, Mus musculus
attaagcagatgaacatgtaccgag

SEQ ID NO: 884742 - DNA, 25 bp, Mus musculus
attaagcagatgaagatgtaccgag

SEQ ID NO: 884743 - DNA, 25 bp, Mus musculus
attaagcataaacggaggtgcagaa

SEQ ID NO: 884744 - DNA, 25 bp, Mus musculus
attaagcataaagggaggtgcagaa

SEQ ID NO: 884745 - DNA, 25 bp, Mus musculus
attaagcatgagctagagcggcgtg

SEQ ID NO: 884746 - DNA, 25 bp, Mus musculus
attaagcatgaggtagagcggcgtg

SEQ ID NO: 884747 - DNA, 25 bp, Mus musculus
attaatagccagatcaacatgtacc

SEQ ID NO: 884748 - DNA, 25 bp, Mus musculus
attaatagccagttcaacatgtacc

SEQ ID NO: 884749 - DNA, 25 bp, Mus musculus
attaatcaaaagcgcatcgatccgg

SEQ ID NO: 884750 - DNA, 25 bp, Mus musculus
attaatcaaaagggcatcgatccgg

SEQ ID NO: 884751 - DNA, 25 bp, Mus musculus
attaatccagcatccacagggtctg

SEQ ID NO: 884752 - DNA, 25 bp, Mus musculus
attaatccaggatccacagggtctg

SEQ ID NO: 884753 - DNA, 25 bp, Mus musculus
attaatgctgccaacggctcctcca

SEQ ID NO: 884754 - DNA, 25 bp, Mus musculus
attaatgctgccaagggctcctcca

SEQ ID NO: 884755 - DNA, 25 bp, Mus musculus
attaatggaggccacgaaaacggca

SEQ ID NO: 884756 - DNA, 25 bp, Mus musculus
attaatggaggccaggaaaacggca

SEQ ID NO: 884757 - DNA, 25 bp, Mus musculus
attaatgttacacgcatacagtcat

SEQ ID NO: 884758 - DNA, 25 bp, Mus musculus
attaatgttacaggcatacagtcat

SEQ ID NO: 884759 - DNA, 25 bp, Mus musculus
attaattacacttctccaagccagc

SEQ ID NO: 884760 - DNA, 25 bp, Mus musculus
attaattacagttctccaagccagc

SEQ ID NO: 884761 - DNA, 25 bp, Mus musculus
attaattcagctgatgctagactga

SEQ ID NO: 884762 - DNA, 25 bp, Mus musculus
attaattcaggtgatgctagactga

SEQ ID NO: 884763 - DNA, 25 bp, Mus musculus
attacacaataatgcagtgatagaa

SEQ ID NO: 884764 - DNA, 25 bp, Mus musculus
attacacaataatggagtgatagaa

SEQ ID NO: 884765 - DNA, 25 bp, Mus musculus
attacacagctgaacgagagactag

SEQ ID NO: 884766 - DNA, 25 bp, Mus musculus
attacacagctgaaggagagactag

SEQ ID NO: 884767 - DNA, 25 bp, Mus musculus
attacactcgaccttgtcaaaagcc

SEQ ID NO: 884768 - DNA, 25 bp, Mus musculus
attacactcgtccttgtcaaaagcc

SEQ ID NO: 884769 - DNA, 25 bp, Mus musculus
attacagaaaagcgtgtgtttgacg

SEQ ID NO: 884770 - DNA, 25 bp, Mus musculus
attacagaaaagggtgtgtttgacg

SEQ ID NO: 884771 - DNA, 25 bp, Mus musculus
attacagataagcaactgctgaaga

SEQ ID NO: 884772 - DNA, 25 bp, Mus musculus
attacagataagctgttctcattgt

SEQ ID NO: 884773 - DNA, 25 bp, Mus musculus
attacagataaggaactgctgaaga

SEQ ID NO: 884774 - DNA, 25 bp, Mus musculus
attacagataaggtgttctcattgt

SEQ ID NO: 884775 - DNA, 25 bp, Mus musculus
attacagctcagcaagcagtggctg

SEQ ID NO: 884776 - DNA, 25 bp, Mus musculus
attacagctcaggaagcagtggctg

SEQ ID NO: 884777 - DNA, 25 bp, Mus musculus
attacatacagccacagaagtgaca

SEQ ID NO: 884778 - DNA, 25 bp, Mus musculus
attacatacagccacgaaacaaagc

SEQ ID NO: 884779 - DNA, 25 bp, Mus musculus
attacatacagccacgaaggaatct

SEQ ID NO: 884780 - DNA, 25 bp, Mus musculus
attacatacagccagagaagtgaca

SEQ ID NO: 884781 - DNA, 25 bp, Mus musculus
attacatacagccaggaaacaaagc

SEQ ID NO: 884782 - DNA, 25 bp, Mus musculus
attacatacagccaggaaggaatct

SEQ ID NO: 884783 - DNA, 25 bp, Mus musculus
attaccctaacttatacattgatgg

SEQ ID NO: 884784 - DNA, 25 bp, Mus musculus
attaccctaagttatacattgatgg

SEQ ID NO: 884785 - DNA, 25 bp, Mus musculus
attacctaaatgactgataatggtc

SEQ ID NO: 884786 - DNA, 25 bp, Mus musculus
attacctaaatgcacaggatccttg

SEQ ID NO: 884787 - DNA, 25 bp, Mus musculus
attacctaaatggacaggatccttg

SEQ ID NO: 884788 - DNA, 25 bp, Mus musculus
attacctaaatgtctgataatggtc

SEQ ID NO: 884789 - DNA, 25 bp, Mus musculus
attaccttgccacgagactacggat

SEQ ID NO: 884790 - DNA, 25 bp, Mus musculus
attaccttgccaggagactacggat

SEQ ID NO: 884791 - DNA, 25 bp, Mus musculus
attacgacagagataacatagaagt

SEQ ID NO: 884792 - DNA, 25 bp, Mus musculus
attacgacagagttaacatagaagt

SEQ ID NO: 884793 - DNA, 25 bp, Mus musculus
attacgtaatcaagtacttaagcag

SEQ ID NO: 884794 - DNA, 25 bp, Mus musculus
attacgtaatgaagtacttaagcag

SEQ ID NO: 884795 - DNA, 25 bp, Mus musculus
attacgtgaagacagggcacatctg

SEQ ID NO: 884796 - DNA, 25 bp, Mus musculus
attacgtgaagagagggcacatctg

SEQ ID NO: 884797 - DNA, 25 bp, Mus musculus
attacgtgcgcccacacccagcacc

SEQ ID NO: 884798 - DNA, 25 bp, Mus musculus
attacgtgcgcccagacccagcacc

SEQ ID NO: 884799 - DNA, 25 bp, Mus musculus
attactaatcaaaatacgcctacta

SEQ ID NO: 884800 - DNA, 25 bp, Mus musculus
attactaatcaaagtggacccaaca

SEQ ID NO: 884801 - DNA, 25 bp, Mus musculus
attactaatcaatatacgcctacta

SEQ ID NO: 884802 - DNA, 25 bp, Mus musculus
attactaatcaatgtggacccaaca

SEQ ID NO: 884803 - DNA, 25 bp, Mus musculus
attactacattataaatgcaagttc

SEQ ID NO: 884804 - DNA, 25 bp, Mus musculus
attactacattataactacatcaaa

SEQ ID NO: 884805 - DNA, 25 bp, Mus musculus
attactacattatatatgcaagttc

SEQ ID NO: 884806 - DNA, 25 bp, Mus musculus
attactacattatatctacatcaaa

SEQ ID NO: 884807 - DNA, 25 bp, Mus musculus
attactattattcacctgtggaaag

SEQ ID NO: 884808 - DNA, 25 bp, Mus musculus
attactattattcagctgtggaaag

SEQ ID NO: 884809 - DNA, 25 bp, Mus musculus
attactcatgtacacaacatgatga

SEQ ID NO: 884810 - DNA, 25 bp, Mus musculus
attactcatgtacagaacatgatga

SEQ ID NO: 884811 - DNA, 25 bp, Mus musculus
attactgaagcttaaaaagcaagct

SEQ ID NO: 884812 - DNA, 25 bp, Mus musculus
attactgaaggttaaaaagcaagct

SEQ ID NO: 884813 - DNA, 25 bp, Mus musculus
attactgatcgaattgaaagaattc

SEQ ID NO: 884814 - DNA, 25 bp, Mus musculus
attactgatcgatttgaaagaattc

SEQ ID NO: 884815 - DNA, 25 bp, Mus musculus
attactgcatagaggaagaaaagga

SEQ ID NO: 884816 - DNA, 25 bp, Mus musculus
attactgcatagtggaagaaaagga

SEQ ID NO: 884817 - DNA, 25 bp, Mus musculus
attactgctacccccatcttagaac

SEQ ID NO: 884818 - DNA, 25 bp, Mus musculus
attactgctacccctgtggcaatgt

SEQ ID NO: 884819 - DNA, 25 bp, Mus musculus
attactgctaccgccatcttagaac

SEQ ID NO: 884820 - DNA, 25 bp, Mus musculus
attactgctaccgctgtggcaatgt

SEQ ID NO: 884821 - DNA, 25 bp, Mus musculus
attactgggaagatctcaggaaaca

SEQ ID NO: 884822 - DNA, 25 bp, Mus musculus
attactgggaagttctcaggaaaca

SEQ ID NO: 884823 - DNA, 25 bp, Mus musculus
attactgtacagctggtacctgttg

SEQ ID NO: 884824 - DNA, 25 bp, Mus musculus
attactgtacaggtggtacctgttg

SEQ ID NO: 884825 - DNA, 25 bp, Mus musculus
attactttgtcaagtttctggatgc

SEQ ID NO: 884826 - DNA, 25 bp, Mus musculus
attactttgtcatgtttctggatgc

SEQ ID NO: 884827 - DNA, 25 bp, Mus musculus
attagaaaaatgataaactttgcaa

SEQ ID NO: 884828 - DNA, 25 bp, Mus musculus
attagaaaaatgttaaactttgcaa

SEQ ID NO: 884829 - DNA, 25 bp, Mus musculus
attagagagttcaacgggctgagat

SEQ ID NO: 884830 - DNA, 25 bp, Mus musculus
attagagagttcaaggggctgagat

SEQ ID NO: 884831 - DNA, 25 bp, Mus musculus
attagcaaagctgccaatgtgaata

SEQ ID NO: 884832 - DNA, 25 bp, Mus musculus
attagcaaaggtgccaatgtgaata

SEQ ID NO: 884833 - DNA, 25 bp, Mus musculus
attagccagaagcacgcttggttcc

SEQ ID NO: 884834 - DNA, 25 bp, Mus musculus
attagccagaagcaggcttggttcc

SEQ ID NO: 884835 - DNA, 25 bp, Mus musculus
attagcctttgacgtgtgcctgcag

SEQ ID NO: 884836 - DNA, 25 bp, Mus musculus
attagcctttgaggtgtgcctgcag

SEQ ID NO: 884837 - DNA, 25 bp, Mus musculus
attaggaagaaaaacatgagtgtgt

SEQ ID NO: 884838 - DNA, 25 bp, Mus musculus
attaggaagaaaaagatgagtgtgt

SEQ ID NO: 884839 - DNA, 25 bp, Mus musculus
attagtctagaaaacataggagaca

SEQ ID NO: 884840 - DNA, 25 bp, Mus musculus
attagtctagaaaacgctaatcttt

SEQ ID NO: 884841 - DNA, 25 bp, Mus musculus
attagtctagaaaagataggagaca

SEQ ID NO: 884842 - DNA, 25 bp, Mus musculus
attagtctagaaaaggctaatcttt

SEQ ID NO: 884843 - DNA, 25 bp, Mus musculus
attagtgcttaacctagggaacatc

SEQ ID NO: 884844 - DNA, 25 bp, Mus musculus
attagtgcttaagctagggaacatc

SEQ ID NO: 884845 - DNA, 25 bp, Mus musculus
attagtgggaagcagctatactggg

SEQ ID NO: 884846 - DNA, 25 bp, Mus musculus
attagtgggatgcagctatactggg

SEQ ID NO: 884847 - DNA, 25 bp, Mus musculus
attagttcataacacatctcagcga

SEQ ID NO: 884848 - DNA, 25 bp, Mus musculus
attagttcataacagatctcagcga

SEQ ID NO: 884849 - DNA, 25 bp, Mus musculus
attataaaatgggaccctttgaaat

SEQ ID NO: 884850 - DNA, 25 bp, Mus musculus
attataaaatgggagcctttgaaat

SEQ ID NO: 884851 - DNA, 25 bp, Mus musculus
attataagagctactcaccagatga

SEQ ID NO: 884852 - DNA, 25 bp, Mus musculus
attataagaggtactcaccagatga

SEQ ID NO: 884853 - DNA, 25 bp, Mus musculus
attatagcccactgagaggagcttc

SEQ ID NO: 884854 - DNA, 25 bp, Mus musculus
attatagcccactgtgaggagcttc

SEQ ID NO: 884855 - DNA, 25 bp, Mus musculus
attatatcagcttgtacgggatcaa

SEQ ID NO: 884856 - DNA, 25 bp, Mus musculus
attatatcaggttgtacgggatcaa

SEQ ID NO: 884857 - DNA, 25 bp, Mus musculus
attatatgatgcagaaacattaatg

SEQ ID NO: 884858 - DNA, 25 bp, Mus musculus
attatatgatgctgaaacattaatg

SEQ ID NO: 884859 - DNA, 25 bp, Mus musculus
attatatgcaatatcaagctgcagt

SEQ ID NO: 884860 - DNA, 25 bp, Mus musculus
attatatgcaatttcaagctgcagt

SEQ ID NO: 884861 - DNA, 25 bp, Mus musculus
attatcaaagaggcctatatgcgat

SEQ ID NO: 884862 - DNA, 25 bp, Mus musculus
attatcaaagaggcgtatatgcgat

SEQ ID NO: 884863 - DNA, 25 bp, Mus musculus
attatcaacgagaactgtattggca

SEQ ID NO: 884864 - DNA, 25 bp, Mus musculus
attatcaacgagtactgtattggca

SEQ ID NO: 884865 - DNA, 25 bp, Mus musculus
attatcactgcgccctctctttcat

SEQ ID NO: 884866 - DNA, 25 bp, Mus musculus
attatcactgggccctctctttcat

SEQ ID NO: 884867 - DNA, 25 bp, Mus musculus
attatccaagactctccaaaagata

SEQ ID NO: 884868 - DNA, 25 bp, Mus musculus
attatccaagtctctccaaaagata

SEQ ID NO: 884869 - DNA, 25 bp, Mus musculus
attatcctgagcaaaggctacaaca

SEQ ID NO: 884870 - DNA, 25 bp, Mus musculus
attatcctgagcaatggctacaaca

SEQ ID NO: 884871 - DNA, 25 bp, Mus musculus
attatctgagcaaggctacctggct

SEQ ID NO: 884872 - DNA, 25 bp, Mus musculus
attatctgaggaaggctacctggct

SEQ ID NO: 884873 - DNA, 25 bp, Mus musculus
attatcttgaatgtggaatgggtac

SEQ ID NO: 884874 - DNA, 25 bp, Mus musculus
attatcttgattgtggaatgggtac

SEQ ID NO: 884875 - DNA, 25 bp, Mus musculus
attatgacagatcacgaccaagatg

SEQ ID NO: 884876 - DNA, 25 bp, Mus musculus
attatgacagatcaggaccaagatg

SEQ ID NO: 884877 - DNA, 25 bp, Mus musculus
attatgcatgctcgtatggaaaagt

SEQ ID NO: 884878 - DNA, 25 bp, Mus musculus
attatgcatgctggtatggaaaagt

SEQ ID NO: 884879 - DNA, 25 bp, Mus musculus
attatgctagcacgctagcagaaat

SEQ ID NO: 884880 - DNA, 25 bp, Mus musculus
attatgctagcaggctagcagaaat

SEQ ID NO: 884881 - DNA, 25 bp, Mus musculus
attatggaagcccctgcattcaact

SEQ ID NO: 884882 - DNA, 25 bp, Mus musculus
attatggaaggccctgcattcaact

SEQ ID NO: 884883 - DNA, 25 bp, Mus musculus
attatggatcttagtatcgaatgtc

SEQ ID NO: 884884 - DNA, 25 bp, Mus musculus
attatggatctttgtatcgaatgtc

SEQ ID NO: 884885 - DNA, 25 bp, Mus musculus
attattcatcggcacttaaagccta

SEQ ID NO: 884886 - DNA, 25 bp, Mus musculus
attattcatcgggacttaaagccta

SEQ ID NO: 884887 - DNA, 25 bp, Mus musculus
attattccagaacttccaggtggcg

SEQ ID NO: 884888 - DNA, 25 bp, Mus musculus
attattccagtacttccaggtggcg

SEQ ID NO: 884889 - DNA, 25 bp, Mus musculus
attattgaaaagccagtgaggagca

SEQ ID NO: 884890 - DNA, 25 bp, Mus musculus
attattgaaaaggcagtgaggagca

SEQ ID NO: 884891 - DNA, 25 bp, Mus musculus
attattgaaaatcagtccaagggac

SEQ ID NO: 884892 - DNA, 25 bp, Mus musculus
attattgaaaatgagtccaagggac

SEQ ID NO: 884893 - DNA, 25 bp, Mus musculus
attattgaaggaaacttgccgccaa

SEQ ID NO: 884894 - DNA, 25 bp, Mus musculus
attattgaaggaaagttgccgccaa

SEQ ID NO: 884895 - DNA, 25 bp, Mus musculus
attattttaagactcagagtgaagg

SEQ ID NO: 884896 - DNA, 25 bp, Mus musculus
attattttaagactgagagtgaagg

SEQ ID NO: 884897 - DNA, 25 bp, Mus musculus
attattttgccacagactgtcacca

SEQ ID NO: 884898 - DNA, 25 bp, Mus musculus
attattttgccagagactgtcacca

SEQ ID NO: 884899 - DNA, 25 bp, Mus musculus
attcaaacagcacctacatcagagc

SEQ ID NO: 884900 - DNA, 25 bp, Mus musculus
attcaaacaggacctacatcagagc

SEQ ID NO: 884901 - DNA, 25 bp, Mus musculus
attcaaaccacgactgttcagtctt

SEQ ID NO: 884902 - DNA, 25 bp, Mus musculus
attcaaaccaggactgttcagtctt

SEQ ID NO: 884903 - DNA, 25 bp, Mus musculus
attcaaagacaagacgtggacacgc

SEQ ID NO: 884904 - DNA, 25 bp, Mus musculus
attcaaagacaagaggtggacacgc

SEQ ID NO: 884905 - DNA, 25 bp, Mus musculus
attcaacagacaaaagaggagttgt

SEQ ID NO: 884906 - DNA, 25 bp, Mus musculus
attcaacagacaaatagaagaggag

SEQ ID NO: 884907 - DNA, 25 bp, Mus musculus
attcaacagacaagtcaagagcaat

SEQ ID NO: 884908 - DNA, 25 bp, Mus musculus
attcaacagacataagaggagttgt

SEQ ID NO: 884909 - DNA, 25 bp, Mus musculus
attcaacagacatatagaagaggag

SEQ ID NO: 884910 - DNA, 25 bp, Mus musculus
attcaacagacatgtcaagagcaat

SEQ ID NO: 884911 - DNA, 25 bp, Mus musculus
attcaaccagcaggtacagaagggg

SEQ ID NO: 884912 - DNA, 25 bp, Mus musculus
attcaaccaggaggtacagaagggg

SEQ ID NO: 884913 - DNA, 25 bp, Mus musculus
attcaactcagtccatttaaaaatg

SEQ ID NO: 884914 - DNA, 25 bp, Mus musculus
attcaactcagtgcatttaaaaatg

SEQ ID NO: 884915 - DNA, 25 bp, Mus musculus
attcaagacagtgacgggaaacagg

SEQ ID NO: 884916 - DNA, 25 bp, Mus musculus
attcaagacagtgaggggaaacagg

SEQ ID NO: 884917 - DNA, 25 bp, Mus musculus
attcaagagcatagtgaccaagttc

SEQ ID NO: 884918 - DNA, 25 bp, Mus musculus
attcaagagcattgtgaccaagttc

SEQ ID NO: 884919 - DNA, 25 bp, Mus musculus
attcaaggaaaacacgacccatcct

SEQ ID NO: 884920 - DNA, 25 bp, Mus musculus
attcaaggaaaacactctataaagc

SEQ ID NO: 884921 - DNA, 25 bp, Mus musculus
attcaaggaaaacaggacccatcct

SEQ ID NO: 884922 - DNA, 25 bp, Mus musculus
attcaaggaaaacagtctataaagc

SEQ ID NO: 884923 - DNA, 25 bp, Mus musculus
attcaaggggcacgtgtttgctttg

SEQ ID NO: 884924 - DNA, 25 bp, Mus musculus
attcaaggggcaggtgtttgctttg

SEQ ID NO: 884925 - DNA, 25 bp, Mus musculus
attcaatgaaatccttgtatatagt

SEQ ID NO: 884926 - DNA, 25 bp, Mus musculus
attcaatgaaatgcttgtatatagt

SEQ ID NO: 884927 - DNA, 25 bp, Mus musculus
attcaatgacgtctacctggtgacc

SEQ ID NO: 884928 - DNA, 25 bp, Mus musculus
attcaatgacgtgtacctggtgacc

SEQ ID NO: 884929 - DNA, 25 bp, Mus musculus
attcaatggaacctgttcgaaggtg

SEQ ID NO: 884930 - DNA, 25 bp, Mus musculus
attcaatggatcctgttcgaaggtg

SEQ ID NO: 884931 - DNA, 25 bp, Mus musculus
attcacaaccagcaacggcaccaca

SEQ ID NO: 884932 - DNA, 25 bp, Mus musculus
attcacaaccaggaacggcaccaca

SEQ ID NO: 884933 - DNA, 25 bp, Mus musculus
attcacacagattctggaacaagaa

SEQ ID NO: 884934 - DNA, 25 bp, Mus musculus
attcacacagcccgatacaaagcag

SEQ ID NO: 884935 - DNA, 25 bp, Mus musculus
attcacacaggccgatacaaagcag

SEQ ID NO: 884936 - DNA, 25 bp, Mus musculus
attcacacagtttctggaacaagaa

SEQ ID NO: 884937 - DNA, 25 bp, Mus musculus
attcacagaaggcttgactacagtc

SEQ ID NO: 884938 - DNA, 25 bp, Mus musculus
attcacagaagggttgactacagtc

SEQ ID NO: 884939 - DNA, 25 bp, Mus musculus
attcacagaagtccctgaagtactt

SEQ ID NO: 884940 - DNA, 25 bp, Mus musculus
attcacagaagtgcctgaagtactt

SEQ ID NO: 884941 - DNA, 25 bp, Mus musculus
attcacagcccacgttttctgcttt

SEQ ID NO: 884942 - DNA, 25 bp, Mus musculus
attcacagcccaggttttctgcttt

SEQ ID NO: 884943 - DNA, 25 bp, Mus musculus
attcacagggatctcgctgccagga

SEQ ID NO: 884944 - DNA, 25 bp, Mus musculus
attcacagggatctggctgccagga

SEQ ID NO: 884945 - DNA, 25 bp, Mus musculus
attcacattcagccacaccaagatg

SEQ ID NO: 884946 - DNA, 25 bp, Mus musculus
attcacattcagctatcacgtatgg

SEQ ID NO: 884947 - DNA, 25 bp, Mus musculus
attcacattcaggcacaccaagatg

SEQ ID NO: 884948 - DNA, 25 bp, Mus musculus
attcacattcaggtatcacgtatgg

SEQ ID NO: 884949 - DNA, 25 bp, Mus musculus
attcaccaagctctctaagctgccc

SEQ ID NO: 884950 - DNA, 25 bp, Mus musculus
attcaccaaggtctctaagctgccc

SEQ ID NO: 884951 - DNA, 25 bp, Mus musculus
attcaccattcacgaaaacttgaac

SEQ ID NO: 884952 - DNA, 25 bp, Mus musculus
attcaccattcaggaaaacttgaac

SEQ ID NO: 884953 - DNA, 25 bp, Mus musculus
attcaccgatcacaaacctgatatc

SEQ ID NO: 884954 - DNA, 25 bp, Mus musculus
attcaccgatcacgacaacatccac

SEQ ID NO: 884955 - DNA, 25 bp, Mus musculus
attcaccgatcagaaacctgatatc

SEQ ID NO: 884956 - DNA, 25 bp, Mus musculus
attcaccgatcaggacaacatccac

SEQ ID NO: 884957 - DNA, 25 bp, Mus musculus
attcacgcgccgcgcccttagaaga

SEQ ID NO: 884958 - DNA, 25 bp, Mus musculus
attcacgcgccgcgcctccatgttc

SEQ ID NO: 884959 - DNA, 25 bp, Mus musculus
attcacgcgccgcggccttagaaga

SEQ ID NO: 884960 - DNA, 25 bp, Mus musculus
attcacgcgccgcggctccatgttc

SEQ ID NO: 884961 - DNA, 25 bp, Mus musculus
attcactcagataacagtgcaccat

SEQ ID NO: 884962 - DNA, 25 bp, Mus musculus
attcactcagcgtgatgttgggctc

SEQ ID NO: 884963 - DNA, 25 bp, Mus musculus
attcactcagggtgatgttgggctc

SEQ ID NO: 884964 - DNA, 25 bp, Mus musculus
attcactcagttaacagtgcaccat

SEQ ID NO: 884965 - DNA, 25 bp, Mus musculus
attcactgcaacaacgtgtcagctg

SEQ ID NO: 884966 - DNA, 25 bp, Mus musculus
attcactgcaacaaggtgtcagctg

SEQ ID NO: 884967 - DNA, 25 bp, Mus musculus
attcactgcagtcatatggacgagt

SEQ ID NO: 884968 - DNA, 25 bp, Mus musculus
attcactgcagtgatatggacgagt

SEQ ID NO: 884969 - DNA, 25 bp, Mus musculus
attcactgttcaccccacagtgaga

SEQ ID NO: 884970 - DNA, 25 bp, Mus musculus
attcactgttcacgcatccgaaggt

SEQ ID NO: 884971 - DNA, 25 bp, Mus musculus
attcactgttcagcccacagtgaga

SEQ ID NO: 884972 - DNA, 25 bp, Mus musculus
attcactgttcaggcatccgaaggt

SEQ ID NO: 884973 - DNA, 25 bp, Mus musculus
attcactttaagacagctattgaga

SEQ ID NO: 884974 - DNA, 25 bp, Mus musculus
attcactttaagtcagctattgaga

SEQ ID NO: 884975 - DNA, 25 bp, Mus musculus
attcactttcaacgtgccataccag

SEQ ID NO: 884976 - DNA, 25 bp, Mus musculus
attcactttcaaggtgccataccag

SEQ ID NO: 884977 - DNA, 25 bp, Mus musculus
attcagaaaactaagctttccatag

SEQ ID NO: 884978 - DNA, 25 bp, Mus musculus
attcagaaaacttagctttccatag

SEQ ID NO: 884979 - DNA, 25 bp, Mus musculus
attcagaagaaagccgtcaagaatt

SEQ ID NO: 884980 - DNA, 25 bp, Mus musculus
attcagaagaaagcggtcaagaatt

SEQ ID NO: 884981 - DNA, 25 bp, Mus musculus
attcagagcgagaggagattgaagt

SEQ ID NO: 884982 - DNA, 25 bp, Mus musculus
attcagagcgagtggagattgaagt

SEQ ID NO: 884983 - DNA, 25 bp, Mus musculus
attcagagtgagcgtctggtcaagg

SEQ ID NO: 884984 - DNA, 25 bp, Mus musculus
attcagagtgagggtctggtcaagg

SEQ ID NO: 884985 - DNA, 25 bp, Mus musculus
attcagatctgtctatgtggtactg

SEQ ID NO: 884986 - DNA, 25 bp, Mus musculus
attcagatctgtgtatgtggtactg

SEQ ID NO: 884987 - DNA, 25 bp, Mus musculus
attcagcaggaaccgtcccaggttc

SEQ ID NO: 884988 - DNA, 25 bp, Mus musculus
attcagcaggaactaaaatctcttt

SEQ ID NO: 884989 - DNA, 25 bp, Mus musculus
attcagcaggaagcgtcccaggttc

SEQ ID NO: 884990 - DNA, 25 bp, Mus musculus
attcagcaggaagtaaaatctcttt

SEQ ID NO: 884991 - DNA, 25 bp, Mus musculus
attcagcagtgtcttgtgggaggag

SEQ ID NO: 884992 - DNA, 25 bp, Mus musculus
attcagcagtgtgttgtgggaggag

SEQ ID NO: 884993 - DNA, 25 bp, Mus musculus
attcagcattaacagaaattgcttt

SEQ ID NO: 884994 - DNA, 25 bp, Mus musculus
attcagcattaagagaaattgcttt

SEQ ID NO: 884995 - DNA, 25 bp, Mus musculus
attcagccatggcgtatggctccta

SEQ ID NO: 884996 - DNA, 25 bp, Mus musculus
attcagccatggggtatggctccta

SEQ ID NO: 884997 - DNA, 25 bp, Mus musculus
attcagctcaagcctgtcaagtcct

SEQ ID NO: 884998 - DNA, 25 bp, Mus musculus
attcagctcaaggctgtcaagtcct

SEQ ID NO: 884999 - DNA, 25 bp, Mus musculus
attcaggaagccgcagtggctactg

SEQ ID NO: 885000 - DNA, 25 bp, Mus musculus
attcaggaaggcgcagtggctactg

SEQ ID NO: 885001 - DNA, 25 bp, Mus musculus
attcaggctgctcatcctaaattga

SEQ ID NO: 885002 - DNA, 25 bp, Mus musculus
attcaggctggtcatcctaaattga

SEQ ID NO: 885003 - DNA, 25 bp, Mus musculus
attcaggggaagacaatcctagtac

SEQ ID NO: 885004 - DNA, 25 bp, Mus musculus
attcaggggaagactatcctagtac

SEQ ID NO: 885005 - DNA, 25 bp, Mus musculus
attcagggggcaggatgacttgtgt

SEQ ID NO: 885006 - DNA, 25 bp, Mus musculus
attcaggggggaggatgacttgtgt

SEQ ID NO: 885007 - DNA, 25 bp, Mus musculus
attcaggtgtcaaataatggtcctt

SEQ ID NO: 885008 - DNA, 25 bp, Mus musculus
attcaggtgtcatataatggtcctt

SEQ ID NO: 885009 - DNA, 25 bp, Mus musculus
attcagtgtctacgtggaaatggct

SEQ ID NO: 885010 - DNA, 25 bp, Mus musculus
attcagtgtctaggtggaaatggct

SEQ ID NO: 885011 - DNA, 25 bp, Mus musculus
attcagttgcataaatgctgtgagg

SEQ ID NO: 885012 - DNA, 25 bp, Mus musculus
attcagttgcataattgctgtgagg

SEQ ID NO: 885013 - DNA, 25 bp, Mus musculus
attcataaagattgaggaagacaca

SEQ ID NO: 885014 - DNA, 25 bp, Mus musculus
attcataaagtttgaggaagacaca

SEQ ID NO: 885015 - DNA, 25 bp, Mus musculus
attcataagaagatactgcagctgg

SEQ ID NO: 885016 - DNA, 25 bp, Mus musculus
attcataagaagttactgcagctgg

SEQ ID NO: 885017 - DNA, 25 bp, Mus musculus
attcatatgattcacatgctgtatt

SEQ ID NO: 885018 - DNA, 25 bp, Mus musculus
attcatatgattcagatgctgtatt

SEQ ID NO: 885019 - DNA, 25 bp, Mus musculus
attcatcatttgcactttctaaaga

SEQ ID NO: 885020 - DNA, 25 bp, Mus musculus
attcatcatttggactttctaaaga

SEQ ID NO: 885021 - DNA, 25 bp, Mus musculus
attcatccacttcgtggagaattca

SEQ ID NO: 885022 - DNA, 25 bp, Mus musculus
attcatccacttggtggagaattca

SEQ ID NO: 885023 - DNA, 25 bp, Mus musculus
attcatcccgagctgactccactgc

SEQ ID NO: 885024 - DNA, 25 bp, Mus musculus
attcatcccgaggtgactccactgc

SEQ ID NO: 885025 - DNA, 25 bp, Mus musculus
attcatgagccacaaccgcatattc

SEQ ID NO: 885026 - DNA, 25 bp, Mus musculus
attcatgagccagaaccgcatattc

SEQ ID NO: 885027 - DNA, 25 bp, Mus musculus
attcatgatgaccacgattacttac

SEQ ID NO: 885028 - DNA, 25 bp, Mus musculus
attcatgatgaccaggattacttac

SEQ ID NO: 885029 - DNA, 25 bp, Mus musculus
attcatgatttccacagagaagacc

SEQ ID NO: 885030 - DNA, 25 bp, Mus musculus
attcatgatttccaccctcatgtca

SEQ ID NO: 885031 - DNA, 25 bp, Mus musculus
attcatgatttccagagagaagacc

SEQ ID NO: 885032 - DNA, 25 bp, Mus musculus
attcatgatttccagcctcatgtca

SEQ ID NO: 885033 - DNA, 25 bp, Mus musculus
attcatgcagaaaatcttttcagaa

SEQ ID NO: 885034 - DNA, 25 bp, Mus musculus
attcatgcagctccacgcctcaaag

SEQ ID NO: 885035 - DNA, 25 bp, Mus musculus
attcatgcaggtccacgcctcaaag

SEQ ID NO: 885036 - DNA, 25 bp, Mus musculus
attcatgcagtaaatcttttcagaa

SEQ ID NO: 885037 - DNA, 25 bp, Mus musculus
attcatgcggaaagacgtgcgagac

SEQ ID NO: 885038 - DNA, 25 bp, Mus musculus
attcatgcggatgcgttttgactta

SEQ ID NO: 885039 - DNA, 25 bp, Mus musculus
attcatgcggtaagacgtgcgagac

SEQ ID NO: 885040 - DNA, 25 bp, Mus musculus
attcatgcggttgcgttttgactta

SEQ ID NO: 885041 - DNA, 25 bp, Mus musculus
attcatgctacaattgggcaaggag

SEQ ID NO: 885042 - DNA, 25 bp, Mus musculus
attcatgctagaattgggcaaggag

SEQ ID NO: 885043 - DNA, 25 bp, Mus musculus
attcatggtactcctgtattttcat

SEQ ID NO: 885044 - DNA, 25 bp, Mus musculus
attcatggtactgctgtattttcat

SEQ ID NO: 885045 - DNA, 25 bp, Mus musculus
attcatggtgaacgacacatcttac

SEQ ID NO: 885046 - DNA, 25 bp, Mus musculus
attcatggtgaaggacacatcttac

SEQ ID NO: 885047 - DNA, 25 bp, Mus musculus
attcatgtgccacgctggatggcaa

SEQ ID NO: 885048 - DNA, 25 bp, Mus musculus
attcatgtgccacggtggtgacttt

SEQ ID NO: 885049 - DNA, 25 bp, Mus musculus
attcatgtgccaggctggatggcaa

SEQ ID NO: 885050 - DNA, 25 bp, Mus musculus
attcatgtgccagggtggtgacttt

SEQ ID NO: 885051 - DNA, 25 bp, Mus musculus
attcattgctaacacgatgcccatc

SEQ ID NO: 885052 - DNA, 25 bp, Mus musculus
attcattgctaacacgggatcatga

SEQ ID NO: 885053 - DNA, 25 bp, Mus musculus
attcattgctaacaggatgcccatc

SEQ ID NO: 885054 - DNA, 25 bp, Mus musculus
attcattgctaacaggggatcatga

SEQ ID NO: 885055 - DNA, 25 bp, Mus musculus
attcatttatcgatccagaaaatag

SEQ ID NO: 885056 - DNA, 25 bp, Mus musculus
attcatttatggatccagaaaatag

SEQ ID NO: 885057 - DNA, 25 bp, Mus musculus
attcatttgcagatcactctggaac

SEQ ID NO: 885058 - DNA, 25 bp, Mus musculus
attcatttgcagttcactctggaac

SEQ ID NO: 885059 - DNA, 25 bp, Mus musculus
attccaaacacacccagccaatgcc

SEQ ID NO: 885060 - DNA, 25 bp, Mus musculus
attccaaacacacccccagccagcc

SEQ ID NO: 885061 - DNA, 25 bp, Mus musculus
attccaaacacagccagccaatgcc

SEQ ID NO: 885062 - DNA, 25 bp, Mus musculus
attccaaacacagccccagccagcc

SEQ ID NO: 885063 - DNA, 25 bp, Mus musculus
attccacaagattgtgaaatggaat

SEQ ID NO: 885064 - DNA, 25 bp, Mus musculus
attccacaagtttgtgaaatggaat

SEQ ID NO: 885065 - DNA, 25 bp, Mus musculus
attccaccaccacgtattccaataa

SEQ ID NO: 885066 - DNA, 25 bp, Mus musculus
attccaccaccaggtattccaataa

SEQ ID NO: 885067 - DNA, 25 bp, Mus musculus
attccaccagcagtatgagccccgg

SEQ ID NO: 885068 - DNA, 25 bp, Mus musculus
attccaccaggagtatgagccccgg

SEQ ID NO: 885069 - DNA, 25 bp, Mus musculus
attccaccccagactctgcagagga

SEQ ID NO: 885070 - DNA, 25 bp, Mus musculus
attccaccccagtctctgcagagga

SEQ ID NO: 885071 - DNA, 25 bp, Mus musculus
attccacgtgcgagcttcttgccac

SEQ ID NO: 885072 - DNA, 25 bp, Mus musculus
attccacgtgcgtgcttcttgccac

SEQ ID NO: 885073 - DNA, 25 bp, Mus musculus
attccacttgacagggacgtggaac

SEQ ID NO: 885074 - DNA, 25 bp, Mus musculus
attccacttgactgggacgtggaac

SEQ ID NO: 885075 - DNA, 25 bp, Mus musculus
attccagagaatctaataggattta

SEQ ID NO: 885076 - DNA, 25 bp, Mus musculus
attccagagaatcttataggattta

SEQ ID NO: 885077 - DNA, 25 bp, Mus musculus
attccagcagcctggttttaacctg

SEQ ID NO: 885078 - DNA, 25 bp, Mus musculus
attccagcaggctggttttaacctg

SEQ ID NO: 885079 - DNA, 25 bp, Mus musculus
attccagggaggcgaagagtcatac

SEQ ID NO: 885080 - DNA, 25 bp, Mus musculus
attccagggaggggaagagtcatac

SEQ ID NO: 885081 - DNA, 25 bp, Mus musculus
attccaggtgcagcaggtgatcaag

SEQ ID NO: 885082 - DNA, 25 bp, Mus musculus
attccaggtgcagctggtgatcaag

SEQ ID NO: 885083 - DNA, 25 bp, Mus musculus
attccataagatcatctttagatgg

SEQ ID NO: 885084 - DNA, 25 bp, Mus musculus
attccataagttcatctttagatgg

SEQ ID NO: 885085 - DNA, 25 bp, Mus musculus
attccatacccaaacgcaggagctg

SEQ ID NO: 885086 - DNA, 25 bp, Mus musculus
attccatacccaaaggcaggagctg

SEQ ID NO: 885087 - DNA, 25 bp, Mus musculus
attccatttcacacttgtggaatgt

SEQ ID NO: 885088 - DNA, 25 bp, Mus musculus
attccatttcactcttgtggaatgt

SEQ ID NO: 885089 - DNA, 25 bp, Mus musculus
attcccaccattcgtttcaatgtgg

SEQ ID NO: 885090 - DNA, 25 bp, Mus musculus
attcccaccattggtttcaatgtgg

SEQ ID NO: 885091 - DNA, 25 bp, Mus musculus
attcccaggagacgcaatgacctgg

SEQ ID NO: 885092 - DNA, 25 bp, Mus musculus
attcccaggagacggaatgacctgg

SEQ ID NO: 885093 - DNA, 25 bp, Mus musculus
attccccagagataagctgacgctg

SEQ ID NO: 885094 - DNA, 25 bp, Mus musculus
attccccagagatatgctgacgctg

SEQ ID NO: 885095 - DNA, 25 bp, Mus musculus
attccccaggagctcttggtgcgct

SEQ ID NO: 885096 - DNA, 25 bp, Mus musculus
attccccaggaggtcttggtgcgct

SEQ ID NO: 885097 - DNA, 25 bp, Mus musculus
attccccgaacccgagtgctggtcc

SEQ ID NO: 885098 - DNA, 25 bp, Mus musculus
attccccgaagccgagtgctggtcc

SEQ ID NO: 885099 - DNA, 25 bp, Mus musculus
attccccggataacctggaccatgt

SEQ ID NO: 885100 - DNA, 25 bp, Mus musculus
attccccggataacgtggaccatgt

SEQ ID NO: 885101 - DNA, 25 bp, Mus musculus
attcccgaaccacatatgagcggaa

SEQ ID NO: 885102 - DNA, 25 bp, Mus musculus
attcccgaaccagatatgagcggaa

SEQ ID NO: 885103 - DNA, 25 bp, Mus musculus
attcccgaattacactgtcttaata

SEQ ID NO: 885104 - DNA, 25 bp, Mus musculus
attcccgaattacagtgtcttaata

SEQ ID NO: 885105 - DNA, 25 bp, Mus musculus
attcccggagaacagtttattgcca

SEQ ID NO: 885106 - DNA, 25 bp, Mus musculus
attcccggagaagagtttattgcca

SEQ ID NO: 885107 - DNA, 25 bp, Mus musculus
attccctgaggaagcatgttcacca

SEQ ID NO: 885108 - DNA, 25 bp, Mus musculus
attccctgaggatgcatgttcacca

SEQ ID NO: 885109 - DNA, 25 bp, Mus musculus
attccgcaggcgagaagaccaccaa

SEQ ID NO: 885110 - DNA, 25 bp, Mus musculus
attccgcaggggagaagaccaccaa

SEQ ID NO: 885111 - DNA, 25 bp, Mus musculus
attccggaagcacctcatcagcctg

SEQ ID NO: 885112 - DNA, 25 bp, Mus musculus
attccggaagccaacaggcctcttt

SEQ ID NO: 885113 - DNA, 25 bp, Mus musculus
attccggaagccaagaggcctcttt

SEQ ID NO: 885114 - DNA, 25 bp, Mus musculus
attccggaaggacctcatcagcctg

SEQ ID NO: 885115 - DNA, 25 bp, Mus musculus
attccggagctgcactgaacttttg

SEQ ID NO: 885116 - DNA, 25 bp, Mus musculus
attccggagctggactgaacttttg

SEQ ID NO: 885117 - DNA, 25 bp, Mus musculus
attcctagggacaactcactgttct

SEQ ID NO: 885118 - DNA, 25 bp, Mus musculus
attcctagggacaagtcactgttct

SEQ ID NO: 885119 - DNA, 25 bp, Mus musculus
attcctcaagccttttcatgaggtc

SEQ ID NO: 885120 - DNA, 25 bp, Mus musculus
attcctcaaggcttttcatgaggtc

SEQ ID NO: 885121 - DNA, 25 bp, Mus musculus
attcctcacacacacactggatgcc

SEQ ID NO: 885122 - DNA, 25 bp, Mus musculus
attcctcacagacacactggatgcc

SEQ ID NO: 885123 - DNA, 25 bp, Mus musculus
attcctccactccacatcatgtcat

SEQ ID NO: 885124 - DNA, 25 bp, Mus musculus
attcctccactccagatcatgtcat

SEQ ID NO: 885125 - DNA, 25 bp, Mus musculus
attcctccagcagtacatcataaac

SEQ ID NO: 885126 - DNA, 25 bp, Mus musculus
attcctccaggagtacatcataaac

SEQ ID NO: 885127 - DNA, 25 bp, Mus musculus
attcctctagcagagattatttcat

SEQ ID NO: 885128 - DNA, 25 bp, Mus musculus
attcctctaggagagattatttcat

SEQ ID NO: 885129 - DNA, 25 bp, Mus musculus
attcctgaaaatcatactgtggatg

SEQ ID NO: 885130 - DNA, 25 bp, Mus musculus
attcctgaaaatgatactgtggatg

SEQ ID NO: 885131 - DNA, 25 bp, Mus musculus
attcctgaagatgcgaccatcaaag

SEQ ID NO: 885132 - DNA, 25 bp, Mus musculus
attcctgaagttgcgaccatcaaag

SEQ ID NO: 885133 - DNA, 25 bp, Mus musculus
attcctggactcagcgtagatggaa

SEQ ID NO: 885134 - DNA, 25 bp, Mus musculus
attcctggactcagggtagatggaa

SEQ ID NO: 885135 - DNA, 25 bp, Mus musculus
attccttatagtctcattcctttct

SEQ ID NO: 885136 - DNA, 25 bp, Mus musculus
attccttatagtctgattcctttct

SEQ ID NO: 885137 - DNA, 25 bp, Mus musculus
attccttcacctcgtggaaaattct

SEQ ID NO: 885138 - DNA, 25 bp, Mus musculus
attccttcacctggtggaaaattct

SEQ ID NO: 885139 - DNA, 25 bp, Mus musculus
attccttcagctcgctggatttgtg

SEQ ID NO: 885140 - DNA, 25 bp, Mus musculus
attccttcaggtcgctggatttgtg

SEQ ID NO: 885141 - DNA, 25 bp, Mus musculus
attccttcatagaacatcaagatgt

SEQ ID NO: 885142 - DNA, 25 bp, Mus musculus
attccttcatagaacgtacttcaag

SEQ ID NO: 885143 - DNA, 25 bp, Mus musculus
attccttcatagaagatcaagatgt

SEQ ID NO: 885144 - DNA, 25 bp, Mus musculus
attccttcatagaaggtacttcaag

SEQ ID NO: 885145 - DNA, 25 bp, Mus musculus
attccttccaactcaggctgcttct

SEQ ID NO: 885146 - DNA, 25 bp, Mus musculus
attccttccaactctggctgcttct

SEQ ID NO: 885147 - DNA, 25 bp, Mus musculus
attccttggagacactctcccttgc

SEQ ID NO: 885148 - DNA, 25 bp, Mus musculus
attccttggagagactctcccttgc

SEQ ID NO: 885149 - DNA, 25 bp, Mus musculus
attccttttgcccctcatattgaag

SEQ ID NO: 885150 - DNA, 25 bp, Mus musculus
attccttttggccctcatattgaag

SEQ ID NO: 885151 - DNA, 25 bp, Mus musculus
attcgaaagagtcgtatctctgatg

SEQ ID NO: 885152 - DNA, 25 bp, Mus musculus
attcgaaagagtggtatctctgatg

SEQ ID NO: 885153 - DNA, 25 bp, Mus musculus
attcgaactgctgttgatcagtgta

SEQ ID NO: 885154 - DNA, 25 bp, Mus musculus
attcgaactggtgttgatcagtgta

SEQ ID NO: 885155 - DNA, 25 bp, Mus musculus
attcgacatcctataacccagttta

SEQ ID NO: 885156 - DNA, 25 bp, Mus musculus
attcgacatcctattacccagttta

SEQ ID NO: 885157 - DNA, 25 bp, Mus musculus
attcgagaagtcaaccatccaaaac

SEQ ID NO: 885158 - DNA, 25 bp, Mus musculus
attcgagaagtctaccatccaaaac

SEQ ID NO: 885159 - DNA, 25 bp, Mus musculus
attcgagagaaacgtgtggactgtg

SEQ ID NO: 885160 - DNA, 25 bp, Mus musculus
attcgagagaaaggtgtggactgtg

SEQ ID NO: 885161 - DNA, 25 bp, Mus musculus
attcgagagaagatgacaatacttg

SEQ ID NO: 885162 - DNA, 25 bp, Mus musculus
attcgagagaagttgacaatacttg

SEQ ID NO: 885163 - DNA, 25 bp, Mus musculus
attcgatcaatacacgtatactcga

SEQ ID NO: 885164 - DNA, 25 bp, Mus musculus
attcgatcaatacaggtatactcga

SEQ ID NO: 885165 - DNA, 25 bp, Mus musculus
attcgatgtcgccaccgcccctcca

SEQ ID NO: 885166 - DNA, 25 bp, Mus musculus
attcgatgtcgccagcgcccctcca

SEQ ID NO: 885167 - DNA, 25 bp, Mus musculus
attcgcaaagcacccatttcgatga

SEQ ID NO: 885168 - DNA, 25 bp, Mus musculus
attcgcaaaggacccatttcgatga

SEQ ID NO: 885169 - DNA, 25 bp, Mus musculus
attcgcaagctgcctgaccagtgca

SEQ ID NO: 885170 - DNA, 25 bp, Mus musculus
attcgcaagctggctgaccagtgca

SEQ ID NO: 885171 - DNA, 25 bp, Mus musculus
attcgcacagcgcaacctccgcaga

SEQ ID NO: 885172 - DNA, 25 bp, Mus musculus
attcgcacagggcaacctccgcaga

SEQ ID NO: 885173 - DNA, 25 bp, Mus musculus
attcgccaaaaccaaggatacccag

SEQ ID NO: 885174 - DNA, 25 bp, Mus musculus
attcgccaaaacgaaggatacccag

SEQ ID NO: 885175 - DNA, 25 bp, Mus musculus
attcgctgagctaccatcgtggaaa

SEQ ID NO: 885176 - DNA, 25 bp, Mus musculus
attcgctgaggtaccatcgtggaaa

SEQ ID NO: 885177 - DNA, 25 bp, Mus musculus
attcggattctgaactcagacatga

SEQ ID NO: 885178 - DNA, 25 bp, Mus musculus
attcggattctgaagtcagacatga

SEQ ID NO: 885179 - DNA, 25 bp, Mus musculus
attcggattctgcgattgaagaggg

SEQ ID NO: 885180 - DNA, 25 bp, Mus musculus
attcggattctgggattgaagaggg

SEQ ID NO: 885181 - DNA, 25 bp, Mus musculus
attcgggctctgtacgttgtgaacc

SEQ ID NO: 885182 - DNA, 25 bp, Mus musculus
attcgggctctgtaggttgtgaacc

SEQ ID NO: 885183 - DNA, 25 bp, Mus musculus
attcggggaaaaccattcggactgt

SEQ ID NO: 885184 - DNA, 25 bp, Mus musculus
attcggggaaaagcattcggactgt

SEQ ID NO: 885185 - DNA, 25 bp, Mus musculus
attcgtgatgggcttttggccagac

SEQ ID NO: 885186 - DNA, 25 bp, Mus musculus
attcgtgatggggttttggccagac

SEQ ID NO: 885187 - DNA, 25 bp, Mus musculus
attcgtgggcgccccgcgcagcaag

SEQ ID NO: 885188 - DNA, 25 bp, Mus musculus
attcgtgggcgcccggcgcagcaag

SEQ ID NO: 885189 - DNA, 25 bp, Mus musculus
attcgtttgtcacattttccactca

SEQ ID NO: 885190 - DNA, 25 bp, Mus musculus
attcgtttgtcagattttccactca

SEQ ID NO: 885191 - DNA, 25 bp, Mus musculus
attctaaacaatcaccccaggagtt

SEQ ID NO: 885192 - DNA, 25 bp, Mus musculus
attctaaacaatcagcccaggagtt

SEQ ID NO: 885193 - DNA, 25 bp, Mus musculus
attctaaacgagatatcttgtcccg

SEQ ID NO: 885194 - DNA, 25 bp, Mus musculus
attctaaacgtgatatcttgtcccg

SEQ ID NO: 885195 - DNA, 25 bp, Mus musculus
attctaacagagatataccgcattg

SEQ ID NO: 885196 - DNA, 25 bp, Mus musculus
attctaacagtgatataccgcattg

SEQ ID NO: 885197 - DNA, 25 bp, Mus musculus
attctacaagcaagacccaagagtt

SEQ ID NO: 885198 - DNA, 25 bp, Mus musculus
attctacaagcatgacccaagagtt

SEQ ID NO: 885199 - DNA, 25 bp, Mus musculus
attctaccagcaaatgttggctgtc

SEQ ID NO: 885200 - DNA, 25 bp, Mus musculus
attctaccaggaaatgttggctgtc

SEQ ID NO: 885201 - DNA, 25 bp, Mus musculus
attctactactgcgactcgtactgg

SEQ ID NO: 885202 - DNA, 25 bp, Mus musculus
attctactactgggactcgtactgg

SEQ ID NO: 885203 - DNA, 25 bp, Mus musculus
attctatacacacgtgattttcgat

SEQ ID NO: 885204 - DNA, 25 bp, Mus musculus
attctatacacaggtgattttcgat

SEQ ID NO: 885205 - DNA, 25 bp, Mus musculus
attctatgctaaaaacatgtacctg

SEQ ID NO: 885206 - DNA, 25 bp, Mus musculus
attctatgctaataacatgtacctg

SEQ ID NO: 885207 - DNA, 25 bp, Mus musculus
attctcaaaattcaattgctgatag

SEQ ID NO: 885208 - DNA, 25 bp, Mus musculus
attctcaaaattcaatttctgttgc

SEQ ID NO: 885209 - DNA, 25 bp, Mus musculus
attctcaaaattcatttgctgatag

SEQ ID NO: 885210 - DNA, 25 bp, Mus musculus
attctcaaaattcattttctgttgc

SEQ ID NO: 885211 - DNA, 25 bp, Mus musculus
attctcacagacaggagaaatcttc

SEQ ID NO: 885212 - DNA, 25 bp, Mus musculus
attctcacagtcaggagaaatcttc

SEQ ID NO: 885213 - DNA, 25 bp, Mus musculus
attctcactactgggaagtgtaggc

SEQ ID NO: 885214 - DNA, 25 bp, Mus musculus
attctcactagtgggaagtgtaggc

SEQ ID NO: 885215 - DNA, 25 bp, Mus musculus
attctcagcagctcccaaattcgat

SEQ ID NO: 885216 - DNA, 25 bp, Mus musculus
attctcagcagctcgcaaattcgat

SEQ ID NO: 885217 - DNA, 25 bp, Mus musculus
attctcatcgccgagctgaatgtca

SEQ ID NO: 885218 - DNA, 25 bp, Mus musculus
attctcatcggcgagctgaatgtca

SEQ ID NO: 885219 - DNA, 25 bp, Mus musculus
attctcattctgcacggcagagtcg

SEQ ID NO: 885220 - DNA, 25 bp, Mus musculus
attctcattctgcagggcagagtcg

SEQ ID NO: 885221 - DNA, 25 bp, Mus musculus
attctccacagtcgctggagagtca

SEQ ID NO: 885222 - DNA, 25 bp, Mus musculus
attctccacagtggctggagagtca

SEQ ID NO: 885223 - DNA, 25 bp, Mus musculus
attctccagaaacctccaatcactg

SEQ ID NO: 885224 - DNA, 25 bp, Mus musculus
attctccagaaagctccaatcactg

SEQ ID NO: 885225 - DNA, 25 bp, Mus musculus
attctccatgcagcagcctggtggt

SEQ ID NO: 885226 - DNA, 25 bp, Mus musculus
attctccatggagcagcctggtggt

SEQ ID NO: 885227 - DNA, 25 bp, Mus musculus
attctcccagagatcttcaaaattt

SEQ ID NO: 885228 - DNA, 25 bp, Mus musculus
attctcccagtgatcttcaaaattt

SEQ ID NO: 885229 - DNA, 25 bp, Mus musculus
attctccgagcacattccatggccc

SEQ ID NO: 885230 - DNA, 25 bp, Mus musculus
attctccgagcagattccatggccc

SEQ ID NO: 885231 - DNA, 25 bp, Mus musculus
attctccttcaacgacaactcaaac

SEQ ID NO: 885232 - DNA, 25 bp, Mus musculus
attctccttcaaggacaactcaaac

SEQ ID NO: 885233 - DNA, 25 bp, Mus musculus
attctctacccacatgaggtggcat

SEQ ID NO: 885234 - DNA, 25 bp, Mus musculus
attctctacccagatgaggtggcat

SEQ ID NO: 885235 - DNA, 25 bp, Mus musculus
attctctcaatgctgtatgcccagc

SEQ ID NO: 885236 - DNA, 25 bp, Mus musculus
attctctcaatggtgtatgcccagc

SEQ ID NO: 885237 - DNA, 25 bp, Mus musculus
attctctggaagacctagtcactcg

SEQ ID NO: 885238 - DNA, 25 bp, Mus musculus
attctctggaagattaggtcagaga

SEQ ID NO: 885239 - DNA, 25 bp, Mus musculus
attctctggaagtcctagtcactcg

SEQ ID NO: 885240 - DNA, 25 bp, Mus musculus
attctctggaagtttaggtcagaga

SEQ ID NO: 885241 - DNA, 25 bp, Mus musculus
attctgacatagatggcgaggctga

SEQ ID NO: 885242 - DNA, 25 bp, Mus musculus
attctgacatcctgcagagcctatc

SEQ ID NO: 885243 - DNA, 25 bp, Mus musculus
attctgacatgctgcagagcctatc

SEQ ID NO: 885244 - DNA, 25 bp, Mus musculus
attctgacattgatggcgaggctga

SEQ ID NO: 885245 - DNA, 25 bp, Mus musculus
attctgatcctactgtcaaaggtcc

SEQ ID NO: 885246 - DNA, 25 bp, Mus musculus
attctgatcctagtgtcaaaggtcc

SEQ ID NO: 885247 - DNA, 25 bp, Mus musculus
attctgatgtattaaaaatcactgg

SEQ ID NO: 885248 - DNA, 25 bp, Mus musculus
attctgatgttttaaaaatcactgg

SEQ ID NO: 885249 - DNA, 25 bp, Mus musculus
attctgcaaaaacacatgtggaaag

SEQ ID NO: 885250 - DNA, 25 bp, Mus musculus
attctgcaaaaacagatgtggaaag

SEQ ID NO: 885251 - DNA, 25 bp, Mus musculus
attctgcaaaaccttatgcacacat

SEQ ID NO: 885252 - DNA, 25 bp, Mus musculus
attctgcaaacttcaagcacaaatg

SEQ ID NO: 885253 - DNA, 25 bp, Mus musculus
attctgcaaagttcaagcacaaatg

SEQ ID NO: 885254 - DNA, 25 bp, Mus musculus
attctgcaaatccttatgcacacat

SEQ ID NO: 885255 - DNA, 25 bp, Mus musculus
attctgcaagtgcgtgggaccatca

SEQ ID NO: 885256 - DNA, 25 bp, Mus musculus
attctgcaagtgggtgggaccatca

SEQ ID NO: 885257 - DNA, 25 bp, Mus musculus
attctgcacactaaatccatggcct

SEQ ID NO: 885258 - DNA, 25 bp, Mus musculus
attctgcacagtaaatccatggcct

SEQ ID NO: 885259 - DNA, 25 bp, Mus musculus
attctgcagcatccaggtgccgtgt

SEQ ID NO: 885260 - DNA, 25 bp, Mus musculus
attctgcagcatcctggtgccgtgt

SEQ ID NO: 885261 - DNA, 25 bp, Mus musculus
attctgccgaatcgtccaagatgga

SEQ ID NO: 885262 - DNA, 25 bp, Mus musculus
attctgccgaatggtccaagatgga

SEQ ID NO: 885263 - DNA, 25 bp, Mus musculus
attctgcgaccagactttataaagc

SEQ ID NO: 885264 - DNA, 25 bp, Mus musculus
attctgcgaccagagtttataaagc

SEQ ID NO: 885265 - DNA, 25 bp, Mus musculus
attctgcgccagctcattgagaagg

SEQ ID NO: 885266 - DNA, 25 bp, Mus musculus
attctgcgccaggtcattgagaagg

SEQ ID NO: 885267 - DNA, 25 bp, Mus musculus
attctggagcagagccaataacttc

SEQ ID NO: 885268 - DNA, 25 bp, Mus musculus
attctggagcagtgccaataacttc

SEQ ID NO: 885269 - DNA, 25 bp, Mus musculus
attctggcttggccaaagctatgaa

SEQ ID NO: 885270 - DNA, 25 bp, Mus musculus
attctggcttgggcaaagctatgaa

SEQ ID NO: 885271 - DNA, 25 bp, Mus musculus
attctgggaagacgttggcctgtgg

SEQ ID NO: 885272 - DNA, 25 bp, Mus musculus
attctgggaagaggttggcctgtgg

SEQ ID NO: 885273 - DNA, 25 bp, Mus musculus
attctggtagctcacatctttggtt

SEQ ID NO: 885274 - DNA, 25 bp, Mus musculus
attctggtagctcagatctttggtt

SEQ ID NO: 885275 - DNA, 25 bp, Mus musculus
attctggtgcagctagagcagctgt

SEQ ID NO: 885276 - DNA, 25 bp, Mus musculus
attctggtgcaggtagagcagctgt

SEQ ID NO: 885277 - DNA, 25 bp, Mus musculus
attctggttgcccacgtgctgggct

SEQ ID NO: 885278 - DNA, 25 bp, Mus musculus
attctggttgcccaggtgctgggct

SEQ ID NO: 885279 - DNA, 25 bp, Mus musculus
attctgtccctggacggtggctata

SEQ ID NO: 885280 - DNA, 25 bp, Mus musculus
attctgtccctggagggtggctata

SEQ ID NO: 885281 - DNA, 25 bp, Mus musculus
attctgtgcccgctggcgtgtgctg

SEQ ID NO: 885282 - DNA, 25 bp, Mus musculus
attctgtgcccggtggcgtgtgctg

SEQ ID NO: 885283 - DNA, 25 bp, Mus musculus
attctgtgcgcatacgttttggctc

SEQ ID NO: 885284 - DNA, 25 bp, Mus musculus
attctgtgcgcataggttttggctc

SEQ ID NO: 885285 - DNA, 25 bp, Mus musculus
attctgtttgcaacttccacgtgtg

SEQ ID NO: 885286 - DNA, 25 bp, Mus musculus
attctgtttggaacttccacgtgtg

SEQ ID NO: 885287 - DNA, 25 bp, Mus musculus
attctgttttgccacatagctgatt

SEQ ID NO: 885288 - DNA, 25 bp, Mus musculus
attctgttttgccagatagctgatt

SEQ ID NO: 885289 - DNA, 25 bp, Mus musculus
attcttaactatacaaagggcctgt

SEQ ID NO: 885290 - DNA, 25 bp, Mus musculus
attcttaactttacaaagggcctgt

SEQ ID NO: 885291 - DNA, 25 bp, Mus musculus
attcttaataagcaagaaactcaga

SEQ ID NO: 885292 - DNA, 25 bp, Mus musculus
attcttaataaggaagaaactcaga

SEQ ID NO: 885293 - DNA, 25 bp, Mus musculus
attcttacagctgaatctgtctccg

SEQ ID NO: 885294 - DNA, 25 bp, Mus musculus
attcttacaggtgaatctgtctccg

SEQ ID NO: 885295 - DNA, 25 bp, Mus musculus
attcttactacacgaatgagtgcca

SEQ ID NO: 885296 - DNA, 25 bp, Mus musculus
attcttactacaggaatgagtgcca

SEQ ID NO: 885297 - DNA, 25 bp, Mus musculus
attcttagcaagcgtctgtcaccgc

SEQ ID NO: 885298 - DNA, 25 bp, Mus musculus
attcttagcaagggtctgtcaccgc

SEQ ID NO: 885299 - DNA, 25 bp, Mus musculus
attcttattctagacggtggataca

SEQ ID NO: 885300 - DNA, 25 bp, Mus musculus
attcttattctagagggtggataca

SEQ ID NO: 885301 - DNA, 25 bp, Mus musculus
attcttcacctactacagacaagta

SEQ ID NO: 885302 - DNA, 25 bp, Mus musculus
attcttcacctagtacagacaagta

SEQ ID NO: 885303 - DNA, 25 bp, Mus musculus
attcttccgccgaacaagtgcggag

SEQ ID NO: 885304 - DNA, 25 bp, Mus musculus
attcttccgcggaacaagtgcggag

SEQ ID NO: 885305 - DNA, 25 bp, Mus musculus
attcttcggatgatatcaacaagtt

SEQ ID NO: 885306 - DNA, 25 bp, Mus musculus
attcttcggatgttatcaacaagtt

SEQ ID NO: 885307 - DNA, 25 bp, Mus musculus
attcttctggacatcgttgtgctgt

SEQ ID NO: 885308 - DNA, 25 bp, Mus musculus
attcttctggtcatcgttgtgctgt

SEQ ID NO: 885309 - DNA, 25 bp, Mus musculus
attcttctggtgtacggaaagacca

SEQ ID NO: 885310 - DNA, 25 bp, Mus musculus
attcttctggtgtagggaaagacca

SEQ ID NO: 885311 - DNA, 25 bp, Mus musculus
attcttgcagacacctttgtcctgg

SEQ ID NO: 885312 - DNA, 25 bp, Mus musculus
attcttgcagatccgtctaccttga

SEQ ID NO: 885313 - DNA, 25 bp, Mus musculus
attcttgcagtcacctttgtcctgg

SEQ ID NO: 885314 - DNA, 25 bp, Mus musculus
attcttgcagttccgtctaccttga

SEQ ID NO: 885315 - DNA, 25 bp, Mus musculus
attcttggtgctctctaggtatgaa

SEQ ID NO: 885316 - DNA, 25 bp, Mus musculus
attcttggtggtctctaggtatgaa

SEQ ID NO: 885317 - DNA, 25 bp, Mus musculus
attcttgtgtcacgaactagtggct

SEQ ID NO: 885318 - DNA, 25 bp, Mus musculus
attcttgtgtcaggaactagtggct

SEQ ID NO: 885319 - DNA, 25 bp, Mus musculus
attctttttaagctatcccagaatg

SEQ ID NO: 885320 - DNA, 25 bp, Mus musculus
attctttttaaggtatcccagaatg

SEQ ID NO: 885321 - DNA, 25 bp, Mus musculus
attgaaaaacagcaggaggaagcag

SEQ ID NO: 885322 - DNA, 25 bp, Mus musculus
attgaaaaacaggaggaggaagcag

SEQ ID NO: 885323 - DNA, 25 bp, Mus musculus
attgaaaactggtcagtacttggct

SEQ ID NO: 885324 - DNA, 25 bp, Mus musculus
attgaaaactggtctgtacttggct

SEQ ID NO: 885325 - DNA, 25 bp, Mus musculus
attgaaaagaaaatcaaagatgact

SEQ ID NO: 885326 - DNA, 25 bp, Mus musculus
attgaaaagaaattcaaagatgact

SEQ ID NO: 885327 - DNA, 25 bp, Mus musculus
attgaaaggcaacggacccacatca

SEQ ID NO: 885328 - DNA, 25 bp, Mus musculus
attgaaaggcaagggacccacatca

SEQ ID NO: 885329 - DNA, 25 bp, Mus musculus
attgaaaggctgaacgaaacagaga

SEQ ID NO: 885330 - DNA, 25 bp, Mus musculus
attgaaaggctgaaggaaacagaga

SEQ ID NO: 885331 - DNA, 25 bp, Mus musculus
attgaaatctttctcgtatacattg

SEQ ID NO: 885332 - DNA, 25 bp, Mus musculus
attgaaatctttctggtatacattg

SEQ ID NO: 885333 - DNA, 25 bp, Mus musculus
attgaaatgcaaacaacagatgtaa

SEQ ID NO: 885334 - DNA, 25 bp, Mus musculus
attgaaatgcaaactacagatgtaa

SEQ ID NO: 885335 - DNA, 25 bp, Mus musculus
attgaacaagaaaatgttatcaatc

SEQ ID NO: 885336 - DNA, 25 bp, Mus musculus
attgaacaagtaaatgttatcaatc

SEQ ID NO: 885337 - DNA, 25 bp, Mus musculus
attgaacagctccgaaggagactgg

SEQ ID NO: 885338 - DNA, 25 bp, Mus musculus
attgaacagctcggaaggagactgg

SEQ ID NO: 885339 - DNA, 25 bp, Mus musculus
attgaacctgaagacgttgccaggc

SEQ ID NO: 885340 - DNA, 25 bp, Mus musculus
attgaacctgaagaggttgccaggc

SEQ ID NO: 885341 - DNA, 25 bp, Mus musculus
attgaactcacggtcacctccagga

SEQ ID NO: 885342 - DNA, 25 bp, Mus musculus
attgaactcagggtcacctccagga

SEQ ID NO: 885343 - DNA, 25 bp, Mus musculus
attgaagaaaagattcaggccgcag

SEQ ID NO: 885344 - DNA, 25 bp, Mus musculus
attgaagaaaagcctaaagatcgca

SEQ ID NO: 885345 - DNA, 25 bp, Mus musculus
attgaagaaaaggctaaagatcgca

SEQ ID NO: 885346 - DNA, 25 bp, Mus musculus
attgaagaaaagtttcaggccgcag

SEQ ID NO: 885347 - DNA, 25 bp, Mus musculus
attgaagaactggacgttgtcgagg

SEQ ID NO: 885348 - DNA, 25 bp, Mus musculus
attgaagaactggaggttgtcgagg

SEQ ID NO: 885349 - DNA, 25 bp, Mus musculus
attgaagacgcctgtgtggttccag

SEQ ID NO: 885350 - DNA, 25 bp, Mus musculus
attgaagacggctgtgtggttccag

SEQ ID NO: 885351 - DNA, 25 bp, Mus musculus
attgaagataagctcaagtccttgc

SEQ ID NO: 885352 - DNA, 25 bp, Mus musculus
attgaagataaggtcaagtccttgc

SEQ ID NO: 885353 - DNA, 25 bp, Mus musculus
attgaagatcaaaacaatcctcgca

SEQ ID NO: 885354 - DNA, 25 bp, Mus musculus
attgaagatcaaaagaatcctcgca

SEQ ID NO: 885355 - DNA, 25 bp, Mus musculus
attgaagcaaagcagttggaatttt

SEQ ID NO: 885356 - DNA, 25 bp, Mus musculus
attgaagcaaaggagttggaatttt

SEQ ID NO: 885357 - DNA, 25 bp, Mus musculus
attgaaggaaagatgccgccaatgc

SEQ ID NO: 885358 - DNA, 25 bp, Mus musculus
attgaaggaaagttgccgccaatgc

SEQ ID NO: 885359 - DNA, 25 bp, Mus musculus
attgaagtgaaacctgctcctgaca

SEQ ID NO: 885360 - DNA, 25 bp, Mus musculus
attgaagtgaaacgagatttctaat

SEQ ID NO: 885361 - DNA, 25 bp, Mus musculus
attgaagtgaaagctgctcctgaca

SEQ ID NO: 885362 - DNA, 25 bp, Mus musculus
attgaagtgaaaggagatttctaat

SEQ ID NO: 885363 - DNA, 25 bp, Mus musculus
attgaagtgttaaacacaccaacag

SEQ ID NO: 885364 - DNA, 25 bp, Mus musculus
attgaagtgttatacacaccaacag

SEQ ID NO: 885365 - DNA, 25 bp, Mus musculus
attgaatatgagatgtgcataatgc

SEQ ID NO: 885366 - DNA, 25 bp, Mus musculus
attgaatatgagctgtcagctgtgc

SEQ ID NO: 885367 - DNA, 25 bp, Mus musculus
attgaatatgaggtgtcagctgtgc

SEQ ID NO: 885368 - DNA, 25 bp, Mus musculus
attgaatatgagttgtgcataatgc

SEQ ID NO: 885369 - DNA, 25 bp, Mus musculus
attgaatcagctgaactggaccccg

SEQ ID NO: 885370 - DNA, 25 bp, Mus musculus
attgaatcaggtgaactggaccccg

SEQ ID NO: 885371 - DNA, 25 bp, Mus musculus
attgaatgagcacaccctggtgatc

SEQ ID NO: 885372 - DNA, 25 bp, Mus musculus
attgaatgagcacagcctggtgatc

SEQ ID NO: 885373 - DNA, 25 bp, Mus musculus
attgaatgtgagctaataaatctgc

SEQ ID NO: 885374 - DNA, 25 bp, Mus musculus
attgaatgtgaggtaataaatctgc

SEQ ID NO: 885375 - DNA, 25 bp, Mus musculus
attgacaatgaaacccagaaaatta

SEQ ID NO: 885376 - DNA, 25 bp, Mus musculus
attgacaatgaatcccagaaaatta

SEQ ID NO: 885377 - DNA, 25 bp, Mus musculus
attgacacaatgctcctaccagaac

SEQ ID NO: 885378 - DNA, 25 bp, Mus musculus
attgacacaatggtcctaccagaac

SEQ ID NO: 885379 - DNA, 25 bp, Mus musculus
attgacattcgccccggtctctatg

SEQ ID NO: 885380 - DNA, 25 bp, Mus musculus
attgacattcgcccgggtctctatg

SEQ ID NO: 885381 - DNA, 25 bp, Mus musculus
attgaccagcctgtgcagattattc

SEQ ID NO: 885382 - DNA, 25 bp, Mus musculus
attgaccagcgtgtgcagattattc

SEQ ID NO: 885383 - DNA, 25 bp, Mus musculus
attgacgcagattgtttgctgcatg

SEQ ID NO: 885384 - DNA, 25 bp, Mus musculus
attgacgcagtttgtttgctgcatg

SEQ ID NO: 885385 - DNA, 25 bp, Mus musculus
attgacgttatacatgttatcccac

SEQ ID NO: 885386 - DNA, 25 bp, Mus musculus
attgacgttatagatgttatcccac

SEQ ID NO: 885387 - DNA, 25 bp, Mus musculus
attgacttaaagcaactagaggctg

SEQ ID NO: 885388 - DNA, 25 bp, Mus musculus
attgacttaaaggaactagaggctg

SEQ ID NO: 885389 - DNA, 25 bp, Mus musculus
attgactttgaacaccactacggac

SEQ ID NO: 885390 - DNA, 25 bp, Mus musculus
attgactttgagcgcaaaaaagacg

SEQ ID NO: 885391 - DNA, 25 bp, Mus musculus
attgactttgagggcaaaaaagacg

SEQ ID NO: 885392 - DNA, 25 bp, Mus musculus
attgactttgtacaccactacggac

SEQ ID NO: 885393 - DNA, 25 bp, Mus musculus
attgagaaagatgttgcaatatatg

SEQ ID NO: 885394 - DNA, 25 bp, Mus musculus
attgagaaagttgttgcaatatatg

SEQ ID NO: 885395 - DNA, 25 bp, Mus musculus
attgagaaccccagcgtccattcac

SEQ ID NO: 885396 - DNA, 25 bp, Mus musculus
attgagaaccccagggtccattcac

SEQ ID NO: 885397 - DNA, 25 bp, Mus musculus
attgagaacgctcacccactgccct

SEQ ID NO: 885398 - DNA, 25 bp, Mus musculus
attgagaacgctcagccactgccct

SEQ ID NO: 885399 - DNA, 25 bp, Mus musculus
attgagacattgaggaaaaaaggtt

SEQ ID NO: 885400 - DNA, 25 bp, Mus musculus
attgagacattgtggaaaaaaggtt

SEQ ID NO: 885401 - DNA, 25 bp, Mus musculus
attgagagagctgatagaaattgag

SEQ ID NO: 885402 - DNA, 25 bp, Mus musculus
attgagagaggtgatagaaattgag

SEQ ID NO: 885403 - DNA, 25 bp, Mus musculus
attgagcaagcacagctggacagtg

SEQ ID NO: 885404 - DNA, 25 bp, Mus musculus
attgagcaagcagagctggacagtg

SEQ ID NO: 885405 - DNA, 25 bp, Mus musculus
attgagcaggccatcgacctcgtga

SEQ ID NO: 885406 - DNA, 25 bp, Mus musculus
attgagcaggccatggacctcgtga

SEQ ID NO: 885407 - DNA, 25 bp, Mus musculus
attgagccgacccacgtctgtgcag

SEQ ID NO: 885408 - DNA, 25 bp, Mus musculus
attgagccgacccaggtctgtgcag

SEQ ID NO: 885409 - DNA, 25 bp, Mus musculus
attgagcgactccacgaaactaatc

SEQ ID NO: 885410 - DNA, 25 bp, Mus musculus
attgagcgactccaggaaactaatc

SEQ ID NO: 885411 - DNA, 25 bp, Mus musculus
attgaggaagctatatatcaagaaa

SEQ ID NO: 885412 - DNA, 25 bp, Mus musculus
attgaggaaggtatatatcaagaaa

SEQ ID NO: 885413 - DNA, 25 bp, Mus musculus
attgaggacccgcagctagaagcga

SEQ ID NO: 885414 - DNA, 25 bp, Mus musculus
attgaggacccggagctagaagcga

SEQ ID NO: 885415 - DNA, 25 bp, Mus musculus
attgaggcaaagaacctagccagct

SEQ ID NO: 885416 - DNA, 25 bp, Mus musculus
attgaggcaaagtacctagccagct

SEQ ID NO: 885417 - DNA, 25 bp, Mus musculus
attgaggcaagacgctaaagaaggt

SEQ ID NO: 885418 - DNA, 25 bp, Mus musculus
attgaggcaagaggctaaagaaggt

SEQ ID NO: 885419 - DNA, 25 bp, Mus musculus
attgaggccaagcacgataaataca

SEQ ID NO: 885420 - DNA, 25 bp, Mus musculus
attgaggccaagcacgtggacgaga

SEQ ID NO: 885421 - DNA, 25 bp, Mus musculus
attgaggccaagcaggataaataca

SEQ ID NO: 885422 - DNA, 25 bp, Mus musculus
attgaggccaagcaggtggacgaga

SEQ ID NO: 885423 - DNA, 25 bp, Mus musculus
attgagggcctccagaatggctctg

SEQ ID NO: 885424 - DNA, 25 bp, Mus musculus
attgagggcctcgagaatggctctg

SEQ ID NO: 885425 - DNA, 25 bp, Mus musculus
attgaggtgctgtcctctctggcca

SEQ ID NO: 885426 - DNA, 25 bp, Mus musculus
attgaggtgctgtcgtctctggcca

SEQ ID NO: 885427 - DNA, 25 bp, Mus musculus
attgagtattggcaatattacagcc

SEQ ID NO: 885428 - DNA, 25 bp, Mus musculus
attgagtattgggaatattacagcc

SEQ ID NO: 885429 - DNA, 25 bp, Mus musculus
attgataaagccatgaaagatggtc

SEQ ID NO: 885430 - DNA, 25 bp, Mus musculus
attgataaaggcatgaaagatggtc

SEQ ID NO: 885431 - DNA, 25 bp, Mus musculus
attgataatctacacgtgaacagat

SEQ ID NO: 885432 - DNA, 25 bp, Mus musculus
attgataatctagacgtgaacagat

SEQ ID NO: 885433 - DNA, 25 bp, Mus musculus
attgatctaatgaacgtatttaatg

SEQ ID NO: 885434 - DNA, 25 bp, Mus musculus
attgatctaatgaaggtatttaatg

SEQ ID NO: 885435 - DNA, 25 bp, Mus musculus
attgatgaaatacactctttcctac

SEQ ID NO: 885436 - DNA, 25 bp, Mus musculus
attgatgaaatagactctttcctac

SEQ ID NO: 885437 - DNA, 25 bp, Mus musculus
attgatgaagctgtagaagtgttct

SEQ ID NO: 885438 - DNA, 25 bp, Mus musculus
attgatgaaggtgtagaagtgttct

SEQ ID NO: 885439 - DNA, 25 bp, Mus musculus
attgatgaccagagttacaagcacc

SEQ ID NO: 885440 - DNA, 25 bp, Mus musculus
attgatgaccagtgttacaagcacc

SEQ ID NO: 885441 - DNA, 25 bp, Mus musculus
attgatgcacatacggaaagcaatc

SEQ ID NO: 885442 - DNA, 25 bp, Mus musculus
attgatgcacattcggaaagcaatc

SEQ ID NO: 885443 - DNA, 25 bp, Mus musculus
attgatggcaagatcttctgtgtgc

SEQ ID NO: 885444 - DNA, 25 bp, Mus musculus
attgatggcaagttcttctgtgtgc

SEQ ID NO: 885445 - DNA, 25 bp, Mus musculus
attgatgggatgcacacacctctgg

SEQ ID NO: 885446 - DNA, 25 bp, Mus musculus
attgatgggatggacacacctctgg

SEQ ID NO: 885447 - DNA, 25 bp, Mus musculus
attgatgtacagcagggcacgagtg

SEQ ID NO: 885448 - DNA, 25 bp, Mus musculus
attgatgtacaggagggcacgagtg

SEQ ID NO: 885449 - DNA, 25 bp, Mus musculus
attgatgtcacgaagccagcgatct

SEQ ID NO: 885450 - DNA, 25 bp, Mus musculus
attgatgtcacgctctattacaatg

SEQ ID NO: 885451 - DNA, 25 bp, Mus musculus
attgatgtcacggtctattacaatg

SEQ ID NO: 885452 - DNA, 25 bp, Mus musculus
attgatgtcacgtagccagcgatct

SEQ ID NO: 885453 - DNA, 25 bp, Mus musculus
attgatgttaggatggatgaaaccg

SEQ ID NO: 885454 - DNA, 25 bp, Mus musculus
attgatgttaggttggatgaaaccg

SEQ ID NO: 885455 - DNA, 25 bp, Mus musculus
attgatgttgcacacaaaaaattac

SEQ ID NO: 885456 - DNA, 25 bp, Mus musculus
attgatgttgcacagaaaaaattac

SEQ ID NO: 885457 - DNA, 25 bp, Mus musculus
attgattttgagaacgatgatgaca

SEQ ID NO: 885458 - DNA, 25 bp, Mus musculus
attgattttgagaaggatgatgaca

SEQ ID NO: 885459 - DNA, 25 bp, Mus musculus
attgcaaacaagcaacatttacatc

SEQ ID NO: 885460 - DNA, 25 bp, Mus musculus
attgcaaacaaggaacatttacatc

SEQ ID NO: 885461 - DNA, 25 bp, Mus musculus
attgcaaccacccgagaagaggctc

SEQ ID NO: 885462 - DNA, 25 bp, Mus musculus
attgcaaccaccggagaagaggctc

SEQ ID NO: 885463 - DNA, 25 bp, Mus musculus
attgcaagaccaaactcagcgggga

SEQ ID NO: 885464 - DNA, 25 bp, Mus musculus
attgcaagaccaaagtcagcgggga

SEQ ID NO: 885465 - DNA, 25 bp, Mus musculus
attgcaatagaaagtgccagaaaaa

SEQ ID NO: 885466 - DNA, 25 bp, Mus musculus
attgcaatagtaagtgccagaaaaa

SEQ ID NO: 885467 - DNA, 25 bp, Mus musculus
attgcaatggctctcatgggaggaa

SEQ ID NO: 885468 - DNA, 25 bp, Mus musculus
attgcaatggctgtcatgggaggaa

SEQ ID NO: 885469 - DNA, 25 bp, Mus musculus
attgcacagaccctcaacacctccc

SEQ ID NO: 885470 - DNA, 25 bp, Mus musculus
attgcacagagcctcaacacctccc

SEQ ID NO: 885471 - DNA, 25 bp, Mus musculus
attgcaccagctgatgttattgtag

SEQ ID NO: 885472 - DNA, 25 bp, Mus musculus
attgcaccaggtgatgttattgtag

SEQ ID NO: 885473 - DNA, 25 bp, Mus musculus
attgcaccagtacacgtcacagcct

SEQ ID NO: 885474 - DNA, 25 bp, Mus musculus
attgcaccagtacaggtcacagcct

SEQ ID NO: 885475 - DNA, 25 bp, Mus musculus
attgcacctatacatggcattcgct

SEQ ID NO: 885476 - DNA, 25 bp, Mus musculus
attgcacctatactgtctataatat

SEQ ID NO: 885477 - DNA, 25 bp, Mus musculus
attgcacctatagatggcattcgct

SEQ ID NO: 885478 - DNA, 25 bp, Mus musculus
attgcacctatagtgtctataatat

SEQ ID NO: 885479 - DNA, 25 bp, Mus musculus
attgcacggcagattacaaaagaag

SEQ ID NO: 885480 - DNA, 25 bp, Mus musculus
attgcacggcagtttacaaaagaag

SEQ ID NO: 885481 - DNA, 25 bp, Mus musculus
attgcacttccgcgctggccttggt

SEQ ID NO: 885482 - DNA, 25 bp, Mus musculus
attgcacttcggcgctggccttggt

SEQ ID NO: 885483 - DNA, 25 bp, Mus musculus
attgcagaaatacgcagatttgtag

SEQ ID NO: 885484 - DNA, 25 bp, Mus musculus
attgcagaaatacggcagatttgta

SEQ ID NO: 885485 - DNA, 25 bp, Mus musculus
attgcagaaataggcagatttgtag

SEQ ID NO: 885486 - DNA, 25 bp, Mus musculus
attgcagaaatagggcagatttgta

SEQ ID NO: 885487 - DNA, 25 bp, Mus musculus
attgcagagatgcagcggctgcagg

SEQ ID NO: 885488 - DNA, 25 bp, Mus musculus
attgcagagatggagcggctgcagg

SEQ ID NO: 885489 - DNA, 25 bp, Mus musculus
attgcagccaagcaccacaacatgc

SEQ ID NO: 885490 - DNA, 25 bp, Mus musculus
attgcagccaagcagcacaacatgc

SEQ ID NO: 885491 - DNA, 25 bp, Mus musculus
attgcagccaagcagcctgtacggg

SEQ ID NO: 885492 - DNA, 25 bp, Mus musculus
attgcagccaaggagcctgtacggg

SEQ ID NO: 885493 - DNA, 25 bp, Mus musculus
attgcagtaaagattgtgcaagatg

SEQ ID NO: 885494 - DNA, 25 bp, Mus musculus
attgcagtaaagtttgtgcaagatg

SEQ ID NO: 885495 - DNA, 25 bp, Mus musculus
attgcatcaaaacaggctgttcgag

SEQ ID NO: 885496 - DNA, 25 bp, Mus musculus
attgcatcaaaagaggctgttcgag

SEQ ID NO: 885497 - DNA, 25 bp, Mus musculus
attgcatctaatcgctcgttgttga

SEQ ID NO: 885498 - DNA, 25 bp, Mus musculus
attgcatctaatggctcgttgttga

SEQ ID NO: 885499 - DNA, 25 bp, Mus musculus
attgcattagcaaagaatgtttcca

SEQ ID NO: 885500 - DNA, 25 bp, Mus musculus
attgcattaggaaagaatgtttcca

SEQ ID NO: 885501 - DNA, 25 bp, Mus musculus
attgccaaaaaccgaagtttgcaga

SEQ ID NO: 885502 - DNA, 25 bp, Mus musculus
attgccaaaaacggaagtttgcaga

SEQ ID NO: 885503 - DNA, 25 bp, Mus musculus
attgccaaagaggacattttcggac

SEQ ID NO: 885504 - DNA, 25 bp, Mus musculus
attgccaaagaggagattttcggac

SEQ ID NO: 885505 - DNA, 25 bp, Mus musculus
attgccaaccagacgtaccaccaga

SEQ ID NO: 885506 - DNA, 25 bp, Mus musculus
attgccaaccagtcgtaccaccaga

SEQ ID NO: 885507 - DNA, 25 bp, Mus musculus
attgccaacccactgaactccacca

SEQ ID NO: 885508 - DNA, 25 bp, Mus musculus
attgccaacccagtgaactccacca

SEQ ID NO: 885509 - DNA, 25 bp, Mus musculus
attgccaagaaccgtatttgaatat

SEQ ID NO: 885510 - DNA, 25 bp, Mus musculus
attgccaagaacggtatttgaatat

SEQ ID NO: 885511 - DNA, 25 bp, Mus musculus
attgccaagcaacgaagcctgctga

SEQ ID NO: 885512 - DNA, 25 bp, Mus musculus
attgccaagcaaggaagcctgctga

SEQ ID NO: 885513 - DNA, 25 bp, Mus musculus
attgccaaggaggacatctttggac

SEQ ID NO: 885514 - DNA, 25 bp, Mus musculus
attgccaaggaggagatctttggac

SEQ ID NO: 885515 - DNA, 25 bp, Mus musculus
attgccagaaagagaaatgctttga

SEQ ID NO: 885516 - DNA, 25 bp, Mus musculus
attgccagaaagtgaaatgctttga

SEQ ID NO: 885517 - DNA, 25 bp, Mus musculus
attgccagagatccttgtgtgtgtg

SEQ ID NO: 885518 - DNA, 25 bp, Mus musculus
attgccagagccatgaatcctacaa

SEQ ID NO: 885519 - DNA, 25 bp, Mus musculus
attgccagaggcatgaatcctacaa

SEQ ID NO: 885520 - DNA, 25 bp, Mus musculus
attgccagagttccttgtgtgtgtg

SEQ ID NO: 885521 - DNA, 25 bp, Mus musculus
attgccaggacaagcctagtgaata

SEQ ID NO: 885522 - DNA, 25 bp, Mus musculus
attgccaggagaagcctagtgaata

SEQ ID NO: 885523 - DNA, 25 bp, Mus musculus
attgccatgagcaacatgccttggc

SEQ ID NO: 885524 - DNA, 25 bp, Mus musculus
attgccatgagcaagatgccttggc

SEQ ID NO: 885525 - DNA, 25 bp, Mus musculus
attgcccctgcaaacgttttccatc

SEQ ID NO: 885526 - DNA, 25 bp, Mus musculus
attgcccctgcaaaggttttccatc

SEQ ID NO: 885527 - DNA, 25 bp, Mus musculus
attgccctcacgatcaacaaggcag

SEQ ID NO: 885528 - DNA, 25 bp, Mus musculus
attgccctcacgcataaaaataaga

SEQ ID NO: 885529 - DNA, 25 bp, Mus musculus
attgccctcacggataaaaataaga

SEQ ID NO: 885530 - DNA, 25 bp, Mus musculus
attgccctcacgttcaacaaggcag

SEQ ID NO: 885531 - DNA, 25 bp, Mus musculus
attgccttgattcacgaccaggtag

SEQ ID NO: 885532 - DNA, 25 bp, Mus musculus
attgccttgattcaggaccaggtag

SEQ ID NO: 885533 - DNA, 25 bp, Mus musculus
attgcctttgcacacaactggtgca

SEQ ID NO: 885534 - DNA, 25 bp, Mus musculus
attgcctttgcacagaactggtgca

SEQ ID NO: 885535 - DNA, 25 bp, Mus musculus
attgccttttgtcacggattcgata

SEQ ID NO: 885536 - DNA, 25 bp, Mus musculus
attgccttttgtcagggattcgata

SEQ ID NO: 885537 - DNA, 25 bp, Mus musculus
attgcgactgctcaccatgagcatc

SEQ ID NO: 885538 - DNA, 25 bp, Mus musculus
attgcgactgctcagaccatgagca

SEQ ID NO: 885539 - DNA, 25 bp, Mus musculus
attgcgactgctgaccatgagcatc

SEQ ID NO: 885540 - DNA, 25 bp, Mus musculus
attgcgactgctgagaccatgagca

SEQ ID NO: 885541 - DNA, 25 bp, Mus musculus
attgcgacttctaacggcggcagac

SEQ ID NO: 885542 - DNA, 25 bp, Mus musculus
attgcgacttctaagggcggcagac

SEQ ID NO: 885543 - DNA, 25 bp, Mus musculus
attgcggctcttgacgttttagaag

SEQ ID NO: 885544 - DNA, 25 bp, Mus musculus
attgcggctcttgaggttttagaag

SEQ ID NO: 885545 - DNA, 25 bp, Mus musculus
attgcgttctcccacttgattggca

SEQ ID NO: 885546 - DNA, 25 bp, Mus musculus
attgcgttctcccagttgattggca

SEQ ID NO: 885547 - DNA, 25 bp, Mus musculus
attgctacagaccacaagaattgga

SEQ ID NO: 885548 - DNA, 25 bp, Mus musculus
attgctacagctcggctgggaggat

SEQ ID NO: 885549 - DNA, 25 bp, Mus musculus
attgctacagctgcacagagcatcc

SEQ ID NO: 885550 - DNA, 25 bp, Mus musculus
attgctacagctgggctgggaggat

SEQ ID NO: 885551 - DNA, 25 bp, Mus musculus
attgctacaggtgcacagagcatcc

SEQ ID NO: 885552 - DNA, 25 bp, Mus musculus
attgctacagtccacaagaattgga

SEQ ID NO: 885553 - DNA, 25 bp, Mus musculus
attgctagcttcaacgacccaaaga

SEQ ID NO: 885554 - DNA, 25 bp, Mus musculus
attgctagcttcaaggacccaaaga

SEQ ID NO: 885555 - DNA, 25 bp, Mus musculus
attgctcaagagacattttaagtct

SEQ ID NO: 885556 - DNA, 25 bp, Mus musculus
attgctcaagagtcctaaacctgga

SEQ ID NO: 885557 - DNA, 25 bp, Mus musculus
attgctcaagtgacattttaagtct

SEQ ID NO: 885558 - DNA, 25 bp, Mus musculus
attgctcaagtgtcctaaacctgga

SEQ ID NO: 885559 - DNA, 25 bp, Mus musculus
attgctcaggaggctttagaaaggc

SEQ ID NO: 885560 - DNA, 25 bp, Mus musculus
attgctcaggtggctttagaaaggc

SEQ ID NO: 885561 - DNA, 25 bp, Mus musculus
attgctccagcaggaatgggctcct

SEQ ID NO: 885562 - DNA, 25 bp, Mus musculus
attgctccaggaggaatgggctcct

SEQ ID NO: 885563 - DNA, 25 bp, Mus musculus
attgctctggagaccagtgacaagc

SEQ ID NO: 885564 - DNA, 25 bp, Mus musculus
attgctctggagagacaagcaccga

SEQ ID NO: 885565 - DNA, 25 bp, Mus musculus
attgctctggagtccagtgacaagc

SEQ ID NO: 885566 - DNA, 25 bp, Mus musculus
attgctctggagtgacaagcaccga

SEQ ID NO: 885567 - DNA, 25 bp, Mus musculus
attgctcttagcatcgttcataagt

SEQ ID NO: 885568 - DNA, 25 bp, Mus musculus
attgctcttagcatggttcataagt

SEQ ID NO: 885569 - DNA, 25 bp, Mus musculus
attgctgataagatctcccttgatc

SEQ ID NO: 885570 - DNA, 25 bp, Mus musculus
attgctgataagatgtctggtgaga

SEQ ID NO: 885571 - DNA, 25 bp, Mus musculus
attgctgataagttctcccttgatc

SEQ ID NO: 885572 - DNA, 25 bp, Mus musculus
attgctgataagttgtctggtgaga

SEQ ID NO: 885573 - DNA, 25 bp, Mus musculus
attgctgcagcaaatgctgccattg

SEQ ID NO: 885574 - DNA, 25 bp, Mus musculus
attgctgcagcgagtgtcaagtcaa

SEQ ID NO: 885575 - DNA, 25 bp, Mus musculus
attgctgcaggaaatgctgccattg

SEQ ID NO: 885576 - DNA, 25 bp, Mus musculus
attgctgcagggagtgtcaagtcaa

SEQ ID NO: 885577 - DNA, 25 bp, Mus musculus
attgctgcagtgaaaggtgtgtttg

SEQ ID NO: 885578 - DNA, 25 bp, Mus musculus
attgctgcagtgaatggtgtgtttg

SEQ ID NO: 885579 - DNA, 25 bp, Mus musculus
attgctgctgcaccctgtgcacagc

SEQ ID NO: 885580 - DNA, 25 bp, Mus musculus
attgctgctgcacgttaccaacata

SEQ ID NO: 885581 - DNA, 25 bp, Mus musculus
attgctgctgcagcctgtgcacagc

SEQ ID NO: 885582 - DNA, 25 bp, Mus musculus
attgctgctgcaggttaccaacata

SEQ ID NO: 885583 - DNA, 25 bp, Mus musculus
attgctgtctctgaaaaatgaatct

SEQ ID NO: 885584 - DNA, 25 bp, Mus musculus
attgctgtctgtgaaaaatgaatct

SEQ ID NO: 885585 - DNA, 25 bp, Mus musculus
attgctgttaagcaaatgcggcgct

SEQ ID NO: 885586 - DNA, 25 bp, Mus musculus
attgctgttaaggaaatgcggcgct

SEQ ID NO: 885587 - DNA, 25 bp, Mus musculus
attgcttcagcaaaaccaaatgcag

SEQ ID NO: 885588 - DNA, 25 bp, Mus musculus
attgcttcagcataaccaaatgcag

SEQ ID NO: 885589 - DNA, 25 bp, Mus musculus
attgcttcatgaatggatgtgacaa

SEQ ID NO: 885590 - DNA, 25 bp, Mus musculus
attgcttcatgattggatgtgacaa

SEQ ID NO: 885591 - DNA, 25 bp, Mus musculus
attgcttctggacacatctctggga

SEQ ID NO: 885592 - DNA, 25 bp, Mus musculus
attgcttctggagacatctctggga

SEQ ID NO: 885593 - DNA, 25 bp, Mus musculus
attggaaaaatgctggccaatatgt

SEQ ID NO: 885594 - DNA, 25 bp, Mus musculus
attggaaaaatggtggccaatatgt

SEQ ID NO: 885595 - DNA, 25 bp, Mus musculus
attggaaaagaggtccttctgtagc

SEQ ID NO: 885596 - DNA, 25 bp, Mus musculus
attggaaaagatatgatgaggaatt

SEQ ID NO: 885597 - DNA, 25 bp, Mus musculus
attggaaaagatctaacaagagtct

SEQ ID NO: 885598 - DNA, 25 bp, Mus musculus
attggaaaagatgtaacaagagtct

SEQ ID NO: 885599 - DNA, 25 bp, Mus musculus
attggaaaagatttgatgaggaatt

SEQ ID NO: 885600 - DNA, 25 bp, Mus musculus
attggaaaagcaatcttctatttgg

SEQ ID NO: 885601 - DNA, 25 bp, Mus musculus
attggaaaagctgttcatctatact

SEQ ID NO: 885602 - DNA, 25 bp, Mus musculus
attggaaaaggaatcttctatttgg

SEQ ID NO: 885603 - DNA, 25 bp, Mus musculus
attggaaaaggtgttcatctatact

SEQ ID NO: 885604 - DNA, 25 bp, Mus musculus
attggaaaagtggtccttctgtagc

SEQ ID NO: 885605 - DNA, 25 bp, Mus musculus
attggaaagacgaacgtcttcctga

SEQ ID NO: 885606 - DNA, 25 bp, Mus musculus
attggaaagacgaaggtcttcctga

SEQ ID NO: 885607 - DNA, 25 bp, Mus musculus
attggaactgctatgatgtcctgtc

SEQ ID NO: 885608 - DNA, 25 bp, Mus musculus
attggaactggtatgatgtcctgtc

SEQ ID NO: 885609 - DNA, 25 bp, Mus musculus
attggaagagagtatcctcagagat

SEQ ID NO: 885610 - DNA, 25 bp, Mus musculus
attggaagagtgtatcctcagagat

SEQ ID NO: 885611 - DNA, 25 bp, Mus musculus
attggaagatcacgtcgctttggtc

SEQ ID NO: 885612 - DNA, 25 bp, Mus musculus
attggaagatcaggtcgctttggtc

SEQ ID NO: 885613 - DNA, 25 bp, Mus musculus
attggaatgacccagagtgggaccg

SEQ ID NO: 885614 - DNA, 25 bp, Mus musculus
attggaatgaccgagagtgggaccg

SEQ ID NO: 885615 - DNA, 25 bp, Mus musculus
attggaccagctctctcagtttggg

SEQ ID NO: 885616 - DNA, 25 bp, Mus musculus
attggaccaggtctctcagtttggg

SEQ ID NO: 885617 - DNA, 25 bp, Mus musculus
attggacgtaagatcgaacaacagg

SEQ ID NO: 885618 - DNA, 25 bp, Mus musculus
attggacgtaagttcgaacaacagg

SEQ ID NO: 885619 - DNA, 25 bp, Mus musculus
attggactacagaacggtgtactgc

SEQ ID NO: 885620 - DNA, 25 bp, Mus musculus
attggactacagtacggtgtactgc

SEQ ID NO: 885621 - DNA, 25 bp, Mus musculus
attggagagagtcggcatgttactg

SEQ ID NO: 885622 - DNA, 25 bp, Mus musculus
attggagagagtgggcatgttactg

SEQ ID NO: 885623 - DNA, 25 bp, Mus musculus
attggagcaatacacgtccttccaa

SEQ ID NO: 885624 - DNA, 25 bp, Mus musculus
attggagcaatacaggtccttccaa

SEQ ID NO: 885625 - DNA, 25 bp, Mus musculus
attggagctattcacgggatgatgg

SEQ ID NO: 885626 - DNA, 25 bp, Mus musculus
attggagctattcaggggatgatgg

SEQ ID NO: 885627 - DNA, 25 bp, Mus musculus
attggaggatttgacgcctacctag

SEQ ID NO: 885628 - DNA, 25 bp, Mus musculus
attggaggatttgaggcctacctag

SEQ ID NO: 885629 - DNA, 25 bp, Mus musculus
attggaggcattcgcctgcgccacc

SEQ ID NO: 885630 - DNA, 25 bp, Mus musculus
attggaggcattcggctgcgccacc

SEQ ID NO: 885631 - DNA, 25 bp, Mus musculus
attggaggctacaacgttcgctatg

SEQ ID NO: 885632 - DNA, 25 bp, Mus musculus
attggaggctacaaggttcgctatg

SEQ ID NO: 885633 - DNA, 25 bp, Mus musculus
attggaggctataacgtccccaggg

SEQ ID NO: 885634 - DNA, 25 bp, Mus musculus
attggaggctataaggtccccaggg

SEQ ID NO: 885635 - DNA, 25 bp, Mus musculus
attggatatcaacgccctgcaccag

SEQ ID NO: 885636 - DNA, 25 bp, Mus musculus
attggatatcaaggccctgcaccag

SEQ ID NO: 885637 - DNA, 25 bp, Mus musculus
attggatcagcccatgacagagatt

SEQ ID NO: 885638 - DNA, 25 bp, Mus musculus
attggatcagccgatgacagagatt

SEQ ID NO: 885639 - DNA, 25 bp, Mus musculus
attggatgaatattcagttagaaca

SEQ ID NO: 885640 - DNA, 25 bp, Mus musculus
attggatgaatattgagttagaaca

SEQ ID NO: 885641 - DNA, 25 bp, Mus musculus
attggatgcacacgagtatgagttc

SEQ ID NO: 885642 - DNA, 25 bp, Mus musculus
attggatgcacaggagtatgagttc

SEQ ID NO: 885643 - DNA, 25 bp, Mus musculus
attggcagctcacgcctatgggctt

SEQ ID NO: 885644 - DNA, 25 bp, Mus musculus
attggcagctcaggcctatgggctt

SEQ ID NO: 885645 - DNA, 25 bp, Mus musculus
attggcaggcctctccagcttggtg

SEQ ID NO: 885646 - DNA, 25 bp, Mus musculus
attggcaggcctgtccagcttggtg

SEQ ID NO: 885647 - DNA, 25 bp, Mus musculus
attggcaggctgcacgtaactagtt

SEQ ID NO: 885648 - DNA, 25 bp, Mus musculus
attggcaggctgcaggtaactagtt

SEQ ID NO: 885649 - DNA, 25 bp, Mus musculus
attggccaagcagacggccctggat

SEQ ID NO: 885650 - DNA, 25 bp, Mus musculus
attggccaagcagagggccctggat

SEQ ID NO: 885651 - DNA, 25 bp, Mus musculus
attggccacttaaacggtgcctcag

SEQ ID NO: 885652 - DNA, 25 bp, Mus musculus
attggccacttaaagggtgcctcag

SEQ ID NO: 885653 - DNA, 25 bp, Mus musculus
attggcccaccacgtcctcaagggg

SEQ ID NO: 885654 - DNA, 25 bp, Mus musculus
attggcccaccaggtcctcaagggg

SEQ ID NO: 885655 - DNA, 25 bp, Mus musculus
attggcctggcacgcccttttagct

SEQ ID NO: 885656 - DNA, 25 bp, Mus musculus
attggcctggcaggcccttttagct

SEQ ID NO: 885657 - DNA, 25 bp, Mus musculus
attggcgaccttcacggaaaatgcc

SEQ ID NO: 885658 - DNA, 25 bp, Mus musculus
attggcgaccttcagggaaaatgcc

SEQ ID NO: 885659 - DNA, 25 bp, Mus musculus
attggcggagctgtggacctcgttt

SEQ ID NO: 885660 - DNA, 25 bp, Mus musculus
attggcggaggtgtggacctcgttt

SEQ ID NO: 885661 - DNA, 25 bp, Mus musculus
attggcgttttactgaacaacgtgg

SEQ ID NO: 885662 - DNA, 25 bp, Mus musculus
attggcgttttagtgaacaacgtgg

SEQ ID NO: 885663 - DNA, 25 bp, Mus musculus
attggctccgactgcaagaatgcct

SEQ ID NO: 885664 - DNA, 25 bp, Mus musculus
attggctccgactggaagaatgcct

SEQ ID NO: 885665 - DNA, 25 bp, Mus musculus
attggctgggcgacacctactgtgt

SEQ ID NO: 885666 - DNA, 25 bp, Mus musculus
attggctgggggacacctactgtgt

SEQ ID NO: 885667 - DNA, 25 bp, Mus musculus
attggcttgaagcatgctcagattg

SEQ ID NO: 885668 - DNA, 25 bp, Mus musculus
attggcttgaaggatgctcagattg

SEQ ID NO: 885669 - DNA, 25 bp, Mus musculus
attggctttcagcatgcggtacaca

SEQ ID NO: 885670 - DNA, 25 bp, Mus musculus
attggctttcaggatgcggtacaca

SEQ ID NO: 885671 - DNA, 25 bp, Mus musculus
attgggaagaagctcaatgtgactg

SEQ ID NO: 885672 - DNA, 25 bp, Mus musculus
attgggaagaaggtcaatgtgactg

SEQ ID NO: 885673 - DNA, 25 bp, Mus musculus
attgggagatacagcgcatggatgg

SEQ ID NO: 885674 - DNA, 25 bp, Mus musculus
attgggagatacagggcatggatgg

SEQ ID NO: 885675 - DNA, 25 bp, Mus musculus
attgggcaaaatggcggagcaacct

SEQ ID NO: 885676 - DNA, 25 bp, Mus musculus
attgggcaaaatgggggagcaacct

SEQ ID NO: 885677 - DNA, 25 bp, Mus musculus
attgggctcaaccataagtcctgct

SEQ ID NO: 885678 - DNA, 25 bp, Mus musculus
attgggctcaacgataagtcctgct

SEQ ID NO: 885679 - DNA, 25 bp, Mus musculus
attgggctgccgacaaggatgaagg

SEQ ID NO: 885680 - DNA, 25 bp, Mus musculus
attgggctgccgacaggtcaatata

SEQ ID NO: 885681 - DNA, 25 bp, Mus musculus
attgggctgccgactaggatgaagg

SEQ ID NO: 885682 - DNA, 25 bp, Mus musculus
attgggctgccgactggtcaatata

SEQ ID NO: 885683 - DNA, 25 bp, Mus musculus
attggggcagcttcctttggagaag

SEQ ID NO: 885684 - DNA, 25 bp, Mus musculus
attggggcaggttcctttggagaag

SEQ ID NO: 885685 - DNA, 25 bp, Mus musculus
attgggggaaatctggtgacagcag

SEQ ID NO: 885686 - DNA, 25 bp, Mus musculus
attgggggaaatgtggtgacagcag

SEQ ID NO: 885687 - DNA, 25 bp, Mus musculus
attgggggaaggaggattcagctat

SEQ ID NO: 885688 - DNA, 25 bp, Mus musculus
attgggggaaggtggattcagctat

SEQ ID NO: 885689 - DNA, 25 bp, Mus musculus
attgggggcatcaacctccggcacc

SEQ ID NO: 885690 - DNA, 25 bp, Mus musculus
attgggggcatcaagctccggcacc

SEQ ID NO: 885691 - DNA, 25 bp, Mus musculus
attgggtacaagaggttctatagat

SEQ ID NO: 885692 - DNA, 25 bp, Mus musculus
attgggtacaagtggttctatagat

SEQ ID NO: 885693 - DNA, 25 bp, Mus musculus
attggtacagatgtgggcacagtgc

SEQ ID NO: 885694 - DNA, 25 bp, Mus musculus
attggtacagttgtgggcacagtgc

SEQ ID NO: 885695 - DNA, 25 bp, Mus musculus
attggtcctgcctctgtctgtacaa

SEQ ID NO: 885696 - DNA, 25 bp, Mus musculus
attggtcctggctctgtctgtacaa

SEQ ID NO: 885697 - DNA, 25 bp, Mus musculus
attggtctcctaaaccaactgaacc

SEQ ID NO: 885698 - DNA, 25 bp, Mus musculus
attggtctcctaaagcaactgaacc

SEQ ID NO: 885699 - DNA, 25 bp, Mus musculus
attggtgaaaaacgagtctttgttg

SEQ ID NO: 885700 - DNA, 25 bp, Mus musculus
attggtgaaaaaggagtctttgttg

SEQ ID NO: 885701 - DNA, 25 bp, Mus musculus
attggtgaaaagagcaatccagaag

SEQ ID NO: 885702 - DNA, 25 bp, Mus musculus
attggtgaaaagtgcaatccagaag

SEQ ID NO: 885703 - DNA, 25 bp, Mus musculus
attggtggctttgacgcctacgagg

SEQ ID NO: 885704 - DNA, 25 bp, Mus musculus
attggtggctttgaggcctacgagg

SEQ ID NO: 885705 - DNA, 25 bp, Mus musculus
attggttacctgccctttgtagaga

SEQ ID NO: 885706 - DNA, 25 bp, Mus musculus
attggttacctggcctttgtagaga

SEQ ID NO: 885707 - DNA, 25 bp, Mus musculus
attggttgtgcccatcttttgatac

SEQ ID NO: 885708 - DNA, 25 bp, Mus musculus
attggttgtggccatcttttgatac

SEQ ID NO: 885709 - DNA, 25 bp, Mus musculus
attgtagaagctcgtgggatgcagg

SEQ ID NO: 885710 - DNA, 25 bp, Mus musculus
attgtagaagctggtgggatgcagg

SEQ ID NO: 885711 - DNA, 25 bp, Mus musculus
attgtagagcgaatcatgaaggatg

SEQ ID NO: 885712 - DNA, 25 bp, Mus musculus
attgtagagcgaatgatgaaggatg

SEQ ID NO: 885713 - DNA, 25 bp, Mus musculus
attgtagattatttattagaaaaag

SEQ ID NO: 885714 - DNA, 25 bp, Mus musculus
attgtagattttttattagaaaaag

SEQ ID NO: 885715 - DNA, 25 bp, Mus musculus
attgtatacacacgtgtgttgttcg

SEQ ID NO: 885716 - DNA, 25 bp, Mus musculus
attgtatacacaggtgtgttgttcg

SEQ ID NO: 885717 - DNA, 25 bp, Mus musculus
attgtatacatgatcccttcaggct

SEQ ID NO: 885718 - DNA, 25 bp, Mus musculus
attgtatacatgttcccttcaggct

SEQ ID NO: 885719 - DNA, 25 bp, Mus musculus
attgtattccagattgactgtacca

SEQ ID NO: 885720 - DNA, 25 bp, Mus musculus
attgtattccagtttgactgtacca

SEQ ID NO: 885721 - DNA, 25 bp, Mus musculus
attgtcacagcttcttctgacaacc

SEQ ID NO: 885722 - DNA, 25 bp, Mus musculus
attgtcacaggttcttctgacaacc

SEQ ID NO: 885723 - DNA, 25 bp, Mus musculus
attgtcatgcacaacatccggccac

SEQ ID NO: 885724 - DNA, 25 bp, Mus musculus
attgtcatgcacaagatccggccac

SEQ ID NO: 885725 - DNA, 25 bp, Mus musculus
attgtcgagggacctctccctactc

SEQ ID NO: 885726 - DNA, 25 bp, Mus musculus
attgtcgagggagctctccctactc

SEQ ID NO: 885727 - DNA, 25 bp, Mus musculus
attgtctatgagattctgatgtctg

SEQ ID NO: 885728 - DNA, 25 bp, Mus musculus
attgtctatgagtttctgatgtctg

SEQ ID NO: 885729 - DNA, 25 bp, Mus musculus
attgtctgcaagtgtctgcccagaa

SEQ ID NO: 885730 - DNA, 25 bp, Mus musculus
attgtctgcatgtgtctgcccagaa

SEQ ID NO: 885731 - DNA, 25 bp, Mus musculus
attgtctggacatggctgcagcaac

SEQ ID NO: 885732 - DNA, 25 bp, Mus musculus
attgtctggagatggctgcagcaac

SEQ ID NO: 885733 - DNA, 25 bp, Mus musculus
attgtctgttatcacctcactgaca

SEQ ID NO: 885734 - DNA, 25 bp, Mus musculus
attgtctgttatgacctcactgaca

SEQ ID NO: 885735 - DNA, 25 bp, Mus musculus
attgtgaaacccgacttcaatgctc

SEQ ID NO: 885736 - DNA, 25 bp, Mus musculus
attgtgaaacccgagttcaatgctc

SEQ ID NO: 885737 - DNA, 25 bp, Mus musculus
attgtgaaagaggtcctgtaataaa

SEQ ID NO: 885738 - DNA, 25 bp, Mus musculus
attgtgaaagtggtcctgtaataaa

SEQ ID NO: 885739 - DNA, 25 bp, Mus musculus
attgtgaagtctcttattggtgcag

SEQ ID NO: 885740 - DNA, 25 bp, Mus musculus
attgtgaagtctgttattggtgcag

SEQ ID NO: 885741 - DNA, 25 bp, Mus musculus
attgtgacagagagggacttggtat

SEQ ID NO: 885742 - DNA, 25 bp, Mus musculus
attgtgacagagtgggacttggtat

SEQ ID NO: 885743 - DNA, 25 bp, Mus musculus
attgtgacagctacctgtgtgacaa

SEQ ID NO: 885744 - DNA, 25 bp, Mus musculus
attgtgacaggtacctgtgtgacaa

SEQ ID NO: 885745 - DNA, 25 bp, Mus musculus
attgtgcgcaagctcaatgccgaag

SEQ ID NO: 885746 - DNA, 25 bp, Mus musculus
attgtgcgcaaggtcaatgccgaag

SEQ ID NO: 885747 - DNA, 25 bp, Mus musculus
attgtgctacagcttgattttcctt

SEQ ID NO: 885748 - DNA, 25 bp, Mus musculus
attgtgctacaggttgattttcctt

SEQ ID NO: 885749 - DNA, 25 bp, Mus musculus
attgtgcttgatgttcaaatagata

SEQ ID NO: 885750 - DNA, 25 bp, Mus musculus
attgtgcttgctgcctttattgtct

SEQ ID NO: 885751 - DNA, 25 bp, Mus musculus
attgtgcttggtgcctttattgtct

SEQ ID NO: 885752 - DNA, 25 bp, Mus musculus
attgtgcttgttgttcaaatagata

SEQ ID NO: 885753 - DNA, 25 bp, Mus musculus
attgtggaatgacattcatgaagct

SEQ ID NO: 885754 - DNA, 25 bp, Mus musculus
attgtggaatgagattcatgaagct

SEQ ID NO: 885755 - DNA, 25 bp, Mus musculus
attgtggagaagcgtatgcctggtt

SEQ ID NO: 885756 - DNA, 25 bp, Mus musculus
attgtggagaagggtatgcctggtt

SEQ ID NO: 885757 - DNA, 25 bp, Mus musculus
attgtggagttccgtgcgtgcttcc

SEQ ID NO: 885758 - DNA, 25 bp, Mus musculus
attgtggagttcggtgcgtgcttcc

SEQ ID NO: 885759 - DNA, 25 bp, Mus musculus
attgtggctcatccagtcaatccac

SEQ ID NO: 885760 - DNA, 25 bp, Mus musculus
attgtggctcatcctgtcaatccac

SEQ ID NO: 885761 - DNA, 25 bp, Mus musculus
attgtgggagactgcagtgatgagc

SEQ ID NO: 885762 - DNA, 25 bp, Mus musculus
attgtgggagtctgcagtgatgagc

SEQ ID NO: 885763 - DNA, 25 bp, Mus musculus
attgtgtgtctgccttatggtagca

SEQ ID NO: 885764 - DNA, 25 bp, Mus musculus
attgtgtgtctgcgagaagatgacc

SEQ ID NO: 885765 - DNA, 25 bp, Mus musculus
attgtgtgtctggcttatggtagca

SEQ ID NO: 885766 - DNA, 25 bp, Mus musculus
attgtgtgtctgggagaagatgacc

SEQ ID NO: 885767 - DNA, 25 bp, Mus musculus
attgtgttggagcatgatggcagcc

SEQ ID NO: 885768 - DNA, 25 bp, Mus musculus
attgtgttggaggatgatggcagcc

SEQ ID NO: 885769 - DNA, 25 bp, Mus musculus
attgtgtttgtacacccatccctga

SEQ ID NO: 885770 - DNA, 25 bp, Mus musculus
attgtgtttgtagacccatccctga

SEQ ID NO: 885771 - DNA, 25 bp, Mus musculus
attgtgttttcacatgtccctggta

SEQ ID NO: 885772 - DNA, 25 bp, Mus musculus
attgtgttttcagatgtccctggta

SEQ ID NO: 885773 - DNA, 25 bp, Mus musculus
attgttgaacagctctcggtgctgc

SEQ ID NO: 885774 - DNA, 25 bp, Mus musculus
attgttgaacaggtctcggtgctgc

SEQ ID NO: 885775 - DNA, 25 bp, Mus musculus
attgttggaggacggaacctagctc

SEQ ID NO: 885776 - DNA, 25 bp, Mus musculus
attgttggaggagggaacctagctc

SEQ ID NO: 885777 - DNA, 25 bp, Mus musculus
attgttgtcaagctttgatctcatt

SEQ ID NO: 885778 - DNA, 25 bp, Mus musculus
attgttgtcaaggtttgatctcatt

SEQ ID NO: 885779 - DNA, 25 bp, Mus musculus
attgtttatcagaactttccagagt

SEQ ID NO: 885780 - DNA, 25 bp, Mus musculus
attgtttatcagaagtttccagagt

SEQ ID NO: 885781 - DNA, 25 bp, Mus musculus
attgtttatggacgaaaacacagaa

SEQ ID NO: 885782 - DNA, 25 bp, Mus musculus
attgtttatggaggaaaacacagaa

SEQ ID NO: 885783 - DNA, 25 bp, Mus musculus
attgtttgtgcacttgctttattct

SEQ ID NO: 885784 - DNA, 25 bp, Mus musculus
attgtttgtgcagttgctttattct

SEQ ID NO: 885785 - DNA, 25 bp, Mus musculus
attgtttttgctcatgggaactttt

SEQ ID NO: 885786 - DNA, 25 bp, Mus musculus
attgtttttgctcatttctaagtta

SEQ ID NO: 885787 - DNA, 25 bp, Mus musculus
attgtttttgctgatgggaactttt

SEQ ID NO: 885788 - DNA, 25 bp, Mus musculus
attgtttttgctgatttctaagtta

SEQ ID NO: 885789 - DNA, 25 bp, Mus musculus
atttaaaacacttgccatccacacc

SEQ ID NO: 885790 - DNA, 25 bp, Mus musculus
atttaaaacagttgccatccacacc

SEQ ID NO: 885791 - DNA, 25 bp, Mus musculus
atttaaaatgcatgtgaaatgatct

SEQ ID NO: 885792 - DNA, 25 bp, Mus musculus
atttaaaatggatgtgaaatgatct

SEQ ID NO: 885793 - DNA, 25 bp, Mus musculus
atttaaccagagctgtctgtctagg

SEQ ID NO: 885794 - DNA, 25 bp, Mus musculus
atttaaccagtgctgtctgtctagg

SEQ ID NO: 885795 - DNA, 25 bp, Mus musculus
atttaagaagagaaggtggctgcag

SEQ ID NO: 885796 - DNA, 25 bp, Mus musculus
atttaagaagatgaaaccagatttc

SEQ ID NO: 885797 - DNA, 25 bp, Mus musculus
atttaagaagtgaaggtggctgcag

SEQ ID NO: 885798 - DNA, 25 bp, Mus musculus
atttaagaagttgaaaccagatttc

SEQ ID NO: 885799 - DNA, 25 bp, Mus musculus
atttaagaatcaatgccccagtggt

SEQ ID NO: 885800 - DNA, 25 bp, Mus musculus
atttaagaatgaatgccccagtggt

SEQ ID NO: 885801 - DNA, 25 bp, Mus musculus
atttacacccagcaatcccaggatc

SEQ ID NO: 885802 - DNA, 25 bp, Mus musculus
atttacacccaggaatcccaggatc

SEQ ID NO: 885803 - DNA, 25 bp, Mus musculus
atttacagcgagcaactgcgtgaga

SEQ ID NO: 885804 - DNA, 25 bp, Mus musculus
atttacagcgaggaactgcgtgaga

SEQ ID NO: 885805 - DNA, 25 bp, Mus musculus
atttaccttgattaccattaatgtg

SEQ ID NO: 885806 - DNA, 25 bp, Mus musculus
atttaccttgtttaccattaatgtg

SEQ ID NO: 885807 - DNA, 25 bp, Mus musculus
atttacgactctcgacctcttcgct

SEQ ID NO: 885808 - DNA, 25 bp, Mus musculus
atttacgactctggacctcttcgct

SEQ ID NO: 885809 - DNA, 25 bp, Mus musculus
atttactatgacggactcatggcct

SEQ ID NO: 885810 - DNA, 25 bp, Mus musculus
atttactatgtcggactcatggcct

SEQ ID NO: 885811 - DNA, 25 bp, Mus musculus
atttactgtggccacgatcgacgtg

SEQ ID NO: 885812 - DNA, 25 bp, Mus musculus
atttactgtggccaggatcgacgtg

SEQ ID NO: 885813 - DNA, 25 bp, Mus musculus
atttacttcaagcgcctgtggaagt

SEQ ID NO: 885814 - DNA, 25 bp, Mus musculus
atttacttcaagggcctgtggaagt

SEQ ID NO: 885815 - DNA, 25 bp, Mus musculus
atttagacagattgtttccgcagta

SEQ ID NO: 885816 - DNA, 25 bp, Mus musculus
atttagacagtttgtttccgcagta

SEQ ID NO: 885817 - DNA, 25 bp, Mus musculus
atttagcatgcctgttggaaagcct

SEQ ID NO: 885818 - DNA, 25 bp, Mus musculus
atttagcatggctgttggaaagcct

SEQ ID NO: 885819 - DNA, 25 bp, Mus musculus
atttagtctgccgtgtgcagcctgg

SEQ ID NO: 885820 - DNA, 25 bp, Mus musculus
atttagtctggcgtgtgcagcctgg

SEQ ID NO: 885821 - DNA, 25 bp, Mus musculus
atttagtgacttcactccagaagaa

SEQ ID NO: 885822 - DNA, 25 bp, Mus musculus
atttagtgacttgactccagaagaa

SEQ ID NO: 885823 - DNA, 25 bp, Mus musculus
atttagtgagccacagtacacgaac

SEQ ID NO: 885824 - DNA, 25 bp, Mus musculus
atttagtgaggcacagtacacgaac

SEQ ID NO: 885825 - DNA, 25 bp, Mus musculus
atttataacaagcccaccgatgata

SEQ ID NO: 885826 - DNA, 25 bp, Mus musculus
atttataacaaggccaccgatgata

SEQ ID NO: 885827 - DNA, 25 bp, Mus musculus
atttatccagctgtgaaattgaaac

SEQ ID NO: 885828 - DNA, 25 bp, Mus musculus
atttatccaggtgtgaaattgaaac

SEQ ID NO: 885829 - DNA, 25 bp, Mus musculus
atttatctctgttgcggcttcacac

SEQ ID NO: 885830 - DNA, 25 bp, Mus musculus
atttatctctgttggggcttcacac

SEQ ID NO: 885831 - DNA, 25 bp, Mus musculus
atttatgacgactgatgctgctctg

SEQ ID NO: 885832 - DNA, 25 bp, Mus musculus
atttatgacgtctgatgctgctctg

SEQ ID NO: 885833 - DNA, 25 bp, Mus musculus
atttatgcactgctgaatcttgcta

SEQ ID NO: 885834 - DNA, 25 bp, Mus musculus
atttatgcactggtgaatcttgcta

SEQ ID NO: 885835 - DNA, 25 bp, Mus musculus
atttatgtcccacgcattttctcta

SEQ ID NO: 885836 - DNA, 25 bp, Mus musculus
atttatgtcccaggcattttctcta

SEQ ID NO: 885837 - DNA, 25 bp, Mus musculus
atttattaagcctctcagcaatgct

SEQ ID NO: 885838 - DNA, 25 bp, Mus musculus
atttattaaggctctcagcaatgct

SEQ ID NO: 885839 - DNA, 25 bp, Mus musculus
atttcaactgtaaggaaagaaaaca

SEQ ID NO: 885840 - DNA, 25 bp, Mus musculus
atttcaactgtatggaaagaaaaca

SEQ ID NO: 885841 - DNA, 25 bp, Mus musculus
atttcaagatgtatacatagtcatg

SEQ ID NO: 885842 - DNA, 25 bp, Mus musculus
atttcaagatgtttacatagtcatg

SEQ ID NO: 885843 - DNA, 25 bp, Mus musculus
atttcacagccccacttcacagcca

SEQ ID NO: 885844 - DNA, 25 bp, Mus musculus
atttcacagccccagttcacagcca

SEQ ID NO: 885845 - DNA, 25 bp, Mus musculus
atttcagatcacacctcagggattt

SEQ ID NO: 885846 - DNA, 25 bp, Mus musculus
atttcagatcactcctcagggattt

SEQ ID NO: 885847 - DNA, 25 bp, Mus musculus
atttcaggccagcgaccgagaacac

SEQ ID NO: 885848 - DNA, 25 bp, Mus musculus
atttcaggccagggaccgagaacac

SEQ ID NO: 885849 - DNA, 25 bp, Mus musculus
atttcatcaactatcatgcttcgga

SEQ ID NO: 885850 - DNA, 25 bp, Mus musculus
atttcatcaactttcatgcttcgga

SEQ ID NO: 885851 - DNA, 25 bp, Mus musculus
atttcatgctggatgacctcaatgc

SEQ ID NO: 885852 - DNA, 25 bp, Mus musculus
atttcatgctggttgacctcaatgc

SEQ ID NO: 885853 - DNA, 25 bp, Mus musculus
atttcatggagacacgtgacactca

SEQ ID NO: 885854 - DNA, 25 bp, Mus musculus
atttcatggagacggaggggcggaa

SEQ ID NO: 885855 - DNA, 25 bp, Mus musculus
atttcatggagagacgtgacactca

SEQ ID NO: 885856 - DNA, 25 bp, Mus musculus
atttcatggagagggaggggcggaa

SEQ ID NO: 885857 - DNA, 25 bp, Mus musculus
atttccacagtgatgctctagctag

SEQ ID NO: 885858 - DNA, 25 bp, Mus musculus
atttccacagtgttgctctagctag

SEQ ID NO: 885859 - DNA, 25 bp, Mus musculus
atttccacatagagctggggatcga

SEQ ID NO: 885860 - DNA, 25 bp, Mus musculus
atttccacatagatcagcaatcagc

SEQ ID NO: 885861 - DNA, 25 bp, Mus musculus
atttccacatagtgctggggatcga

SEQ ID NO: 885862 - DNA, 25 bp, Mus musculus
atttccacatagttcagcaatcagc

SEQ ID NO: 885863 - DNA, 25 bp, Mus musculus
atttccaccacctgcatcgagaact

SEQ ID NO: 885864 - DNA, 25 bp, Mus musculus
atttccaccacctggatcgagaact

SEQ ID NO: 885865 - DNA, 25 bp, Mus musculus
atttccagtgaaccaattgacttga

SEQ ID NO: 885866 - DNA, 25 bp, Mus musculus
atttccagtgaagcaattgacttga

SEQ ID NO: 885867 - DNA, 25 bp, Mus musculus
atttcccactgacgccaatgtgctt

SEQ ID NO: 885868 - DNA, 25 bp, Mus musculus
atttcccactgaggccaatgtgctt

SEQ ID NO: 885869 - DNA, 25 bp, Mus musculus
atttcccagcagagcaagctgacga

SEQ ID NO: 885870 - DNA, 25 bp, Mus musculus
atttcccagcagtgcaagctgacga

SEQ ID NO: 885871 - DNA, 25 bp, Mus musculus
atttccccaagaatggggatcctgg

SEQ ID NO: 885872 - DNA, 25 bp, Mus musculus
atttccccaagattggggatcctgg

SEQ ID NO: 885873 - DNA, 25 bp, Mus musculus
atttccgagatattcataacaagaa

SEQ ID NO: 885874 - DNA, 25 bp, Mus musculus
atttccgagatattgataacaagaa

SEQ ID NO: 885875 - DNA, 25 bp, Mus musculus
atttccgtcctacaaacctcatcca

SEQ ID NO: 885876 - DNA, 25 bp, Mus musculus
atttccgtcctagaaacctcatcca

SEQ ID NO: 885877 - DNA, 25 bp, Mus musculus
atttcctacaaagacgtggcagaac

SEQ ID NO: 885878 - DNA, 25 bp, Mus musculus
atttcctacaaagaggtggcagaac

SEQ ID NO: 885879 - DNA, 25 bp, Mus musculus
atttcctcagctgaagctgtgtgac

SEQ ID NO: 885880 - DNA, 25 bp, Mus musculus
atttcctcaggtgaagctgtgtgac

SEQ ID NO: 885881 - DNA, 25 bp, Mus musculus
atttcctcctacaacacggtagagg

SEQ ID NO: 885882 - DNA, 25 bp, Mus musculus
atttcctcctacattgagcagacac

SEQ ID NO: 885883 - DNA, 25 bp, Mus musculus
atttcctcctactacacggtagagg

SEQ ID NO: 885884 - DNA, 25 bp, Mus musculus
atttcctcctactttgagcagacac

SEQ ID NO: 885885 - DNA, 25 bp, Mus musculus
atttcctgagccactgatgcgttct

SEQ ID NO: 885886 - DNA, 25 bp, Mus musculus
atttcctgaggcactgatgcgttct

SEQ ID NO: 885887 - DNA, 25 bp, Mus musculus
atttcctgattgatccccagaaagg

SEQ ID NO: 885888 - DNA, 25 bp, Mus musculus
atttcctgattgttccccagaaagg

SEQ ID NO: 885889 - DNA, 25 bp, Mus musculus
atttccttgataagtattctctgaa

SEQ ID NO: 885890 - DNA, 25 bp, Mus musculus
atttccttgatatgtattctctgaa

SEQ ID NO: 885891 - DNA, 25 bp, Mus musculus
atttcctttcagaagacccagcatg

SEQ ID NO: 885892 - DNA, 25 bp, Mus musculus
atttcctttcagtagacccagcatg

SEQ ID NO: 885893 - DNA, 25 bp, Mus musculus
atttcgcaagcgtcatgtaaaagtt

SEQ ID NO: 885894 - DNA, 25 bp, Mus musculus
atttcgcaagggtcatgtaaaagtt

SEQ ID NO: 885895 - DNA, 25 bp, Mus musculus
atttcgccagatagtgtctgctgtg

SEQ ID NO: 885896 - DNA, 25 bp, Mus musculus
atttcgccagttagtgtctgctgtg

SEQ ID NO: 885897 - DNA, 25 bp, Mus musculus
atttcggatgatcctgccttctctg

SEQ ID NO: 885898 - DNA, 25 bp, Mus musculus
atttcggatgttcctgccttctctg

SEQ ID NO: 885899 - DNA, 25 bp, Mus musculus
atttcggctcagactcgcatgtgtg

SEQ ID NO: 885900 - DNA, 25 bp, Mus musculus
atttcggctcagcgaagtgactttc

SEQ ID NO: 885901 - DNA, 25 bp, Mus musculus
atttcggctcagggaagtgactttc

SEQ ID NO: 885902 - DNA, 25 bp, Mus musculus
atttcggctcagtctcgcatgtgtg

SEQ ID NO: 885903 - DNA, 25 bp, Mus musculus
atttcgggatataaatccagatgtg

SEQ ID NO: 885904 - DNA, 25 bp, Mus musculus
atttcgggatttaaatccagatgtg

SEQ ID NO: 885905 - DNA, 25 bp, Mus musculus
atttctattgtactcaactttgccc

SEQ ID NO: 885906 - DNA, 25 bp, Mus musculus
atttctattgtagtcaactttgccc

SEQ ID NO: 885907 - DNA, 25 bp, Mus musculus
atttctctctggcacggatggaaga

SEQ ID NO: 885908 - DNA, 25 bp, Mus musculus
atttctctctggcagggatggaaga

SEQ ID NO: 885909 - DNA, 25 bp, Mus musculus
atttctctgcagcattacattgctg

SEQ ID NO: 885910 - DNA, 25 bp, Mus musculus
atttctctgcaggattacattgctg

SEQ ID NO: 885911 - DNA, 25 bp, Mus musculus
atttctgacattgacgtggataaga

SEQ ID NO: 885912 - DNA, 25 bp, Mus musculus
atttctgacattgaggtggataaga

SEQ ID NO: 885913 - DNA, 25 bp, Mus musculus
atttcttaccaacgaatggagccaa

SEQ ID NO: 885914 - DNA, 25 bp, Mus musculus
atttcttaccaaggaatggagccaa

SEQ ID NO: 885915 - DNA, 25 bp, Mus musculus
atttcttcctggcgtgttgttcagc

SEQ ID NO: 885916 - DNA, 25 bp, Mus musculus
atttcttcctggggtgttgttcagc

SEQ ID NO: 885917 - DNA, 25 bp, Mus musculus
atttcttctctggacacaaatacta

SEQ ID NO: 885918 - DNA, 25 bp, Mus musculus
atttcttctctggagacaaatacta

SEQ ID NO: 885919 - DNA, 25 bp, Mus musculus
atttcttgagctaaatgaggaaggc

SEQ ID NO: 885920 - DNA, 25 bp, Mus musculus
atttcttgaggtaaatgaggaaggc

SEQ ID NO: 885921 - DNA, 25 bp, Mus musculus
atttctttcatacatgaagcccgag

SEQ ID NO: 885922 - DNA, 25 bp, Mus musculus
atttctttcatagatgaagcccgag

SEQ ID NO: 885923 - DNA, 25 bp, Mus musculus
atttgaaaagaatgggatcaaacac

SEQ ID NO: 885924 - DNA, 25 bp, Mus musculus
atttgaaaagtatgggatcaaacac

SEQ ID NO: 885925 - DNA, 25 bp, Mus musculus
atttgaacagaacattggacagccc

SEQ ID NO: 885926 - DNA, 25 bp, Mus musculus
atttgaacagaagattggacagccc

SEQ ID NO: 885927 - DNA, 25 bp, Mus musculus
atttgaacagctcaaaggcattgct

SEQ ID NO: 885928 - DNA, 25 bp, Mus musculus
atttgaacaggtcaaaggcattgct

SEQ ID NO: 885929 - DNA, 25 bp, Mus musculus
atttgaagagatcaccagtgtaatc

SEQ ID NO: 885930 - DNA, 25 bp, Mus musculus
atttgaagagttcaccagtgtaatc

SEQ ID NO: 885931 - DNA, 25 bp, Mus musculus
atttgaaggatcaacgcagagatgc

SEQ ID NO: 885932 - DNA, 25 bp, Mus musculus
atttgaaggatcaaggcagagatgc

SEQ ID NO: 885933 - DNA, 25 bp, Mus musculus
atttgaatttcacgatgtttgatgt

SEQ ID NO: 885934 - DNA, 25 bp, Mus musculus
atttgaatttcaggatgtttgatgt

SEQ ID NO: 885935 - DNA, 25 bp, Mus musculus
atttgacaaaaacaccttatagagc

SEQ ID NO: 885936 - DNA, 25 bp, Mus musculus
atttgacaaaaacagcttatagagc

SEQ ID NO: 885937 - DNA, 25 bp, Mus musculus
atttgagaagcgccacatccgggac

SEQ ID NO: 885938 - DNA, 25 bp, Mus musculus
atttgagaagggccacatccgggac

SEQ ID NO: 885939 - DNA, 25 bp, Mus musculus
atttgagaggaagtgatttaataca

SEQ ID NO: 885940 - DNA, 25 bp, Mus musculus
atttgagaggtagtgatttaataca

SEQ ID NO: 885941 - DNA, 25 bp, Mus musculus
atttgagattaacaaatgtgacctt

SEQ ID NO: 885942 - DNA, 25 bp, Mus musculus
atttgagattaacgaagcctgctgc

SEQ ID NO: 885943 - DNA, 25 bp, Mus musculus
atttgagattaagaaatgtgacctt

SEQ ID NO: 885944 - DNA, 25 bp, Mus musculus
atttgagattaaggaagcctgctgc

SEQ ID NO: 885945 - DNA, 25 bp, Mus musculus
atttgagctaaacatcttgcgtcgg

SEQ ID NO: 885946 - DNA, 25 bp, Mus musculus
atttgagctaaagatcttgcgtcgg

SEQ ID NO: 885947 - DNA, 25 bp, Mus musculus
atttgaggagcaagtgcagagtgtc

SEQ ID NO: 885948 - DNA, 25 bp, Mus musculus
atttgaggagcatgtgcagagtgtc

SEQ ID NO: 885949 - DNA, 25 bp, Mus musculus
atttgaggggctcaggacaaagagg

SEQ ID NO: 885950 - DNA, 25 bp, Mus musculus
atttgagggggtcaggacaaagagg

SEQ ID NO: 885951 - DNA, 25 bp, Mus musculus
atttgaggtcttcacatttggaaat

SEQ ID NO: 885952 - DNA, 25 bp, Mus musculus
atttgaggtcttcagatttggaaat

SEQ ID NO: 885953 - DNA, 25 bp, Mus musculus
atttgagtggaaagcgctcttcgtg

SEQ ID NO: 885954 - DNA, 25 bp, Mus musculus
atttgagtggaatgcgctcttcgtg

SEQ ID NO: 885955 - DNA, 25 bp, Mus musculus
atttgatgaagagacatacaactca

SEQ ID NO: 885956 - DNA, 25 bp, Mus musculus
atttgatgaagagagatacaactca

SEQ ID NO: 885957 - DNA, 25 bp, Mus musculus
atttgatgagcacagtggtgactac

SEQ ID NO: 885958 - DNA, 25 bp, Mus musculus
atttgatgaggacagtggtgactac

SEQ ID NO: 885959 - DNA, 25 bp, Mus musculus
atttgcacccctacactttctgacc

SEQ ID NO: 885960 - DNA, 25 bp, Mus musculus
atttgcacccctactctttctgacc

SEQ ID NO: 885961 - DNA, 25 bp, Mus musculus
atttgcagattcaaagttcacagtc

SEQ ID NO: 885962 - DNA, 25 bp, Mus musculus
atttgcagattcaaatgaccagcag

SEQ ID NO: 885963 - DNA, 25 bp, Mus musculus
atttgcagattcaatgttcacagtc

SEQ ID NO: 885964 - DNA, 25 bp, Mus musculus
atttgcagattcaattgaccagcag

SEQ ID NO: 885965 - DNA, 25 bp, Mus musculus
atttgcagccaacgccacagaggat

SEQ ID NO: 885966 - DNA, 25 bp, Mus musculus
atttgcagccaaggccacagaggat

SEQ ID NO: 885967 - DNA, 25 bp, Mus musculus
atttgcatgcaacgcttgttccccc

SEQ ID NO: 885968 - DNA, 25 bp, Mus musculus
atttgcatgcaacgtacagaagaaa

SEQ ID NO: 885969 - DNA, 25 bp, Mus musculus
atttgcatgcaaggcttgttccccc

SEQ ID NO: 885970 - DNA, 25 bp, Mus musculus
atttgcatgcaaggtacagaagaaa

SEQ ID NO: 885971 - DNA, 25 bp, Mus musculus
atttgcccagaggagggcattggcg

SEQ ID NO: 885972 - DNA, 25 bp, Mus musculus
atttgcccagtggagggcattggcg

SEQ ID NO: 885973 - DNA, 25 bp, Mus musculus
atttgcgaagacatcgacgagtgtc

SEQ ID NO: 885974 - DNA, 25 bp, Mus musculus
atttgcgaagtcatcgacgagtgtc

SEQ ID NO: 885975 - DNA, 25 bp, Mus musculus
atttgcgtagccgcctgtgtggtcc

SEQ ID NO: 885976 - DNA, 25 bp, Mus musculus
atttgcgtaggcgcctgtgtggtcc

SEQ ID NO: 885977 - DNA, 25 bp, Mus musculus
atttgctgtggacatcggcctggcc

SEQ ID NO: 885978 - DNA, 25 bp, Mus musculus
atttgctgtggacctccttcaaaaa

SEQ ID NO: 885979 - DNA, 25 bp, Mus musculus
atttgctgtggagatcggcctggcc

SEQ ID NO: 885980 - DNA, 25 bp, Mus musculus
atttgctgtggagctccttcaaaaa

SEQ ID NO: 885981 - DNA, 25 bp, Mus musculus
atttggaaatcaatacttgtatcaa

SEQ ID NO: 885982 - DNA, 25 bp, Mus musculus
atttggaaatcattacttgtatcaa

SEQ ID NO: 885983 - DNA, 25 bp, Mus musculus
atttggaagaatttcagatgcccgt

SEQ ID NO: 885984 - DNA, 25 bp, Mus musculus
atttggaagaatttcagtgtctctg

SEQ ID NO: 885985 - DNA, 25 bp, Mus musculus
atttggaagaatttgagatgcccgt

SEQ ID NO: 885986 - DNA, 25 bp, Mus musculus
atttggaagaatttgagtgtctctg

SEQ ID NO: 885987 - DNA, 25 bp, Mus musculus
atttggacaacccacgcgctaagcg

SEQ ID NO: 885988 - DNA, 25 bp, Mus musculus
atttggacaacccaggcgctaagcg

SEQ ID NO: 885989 - DNA, 25 bp, Mus musculus
atttggacagattccagcaggagcc

SEQ ID NO: 885990 - DNA, 25 bp, Mus musculus
atttggacagcttccttgtgactcc

SEQ ID NO: 885991 - DNA, 25 bp, Mus musculus
atttggacaggttccttgtgactcc

SEQ ID NO: 885992 - DNA, 25 bp, Mus musculus
atttggacagtttccagcaggagcc

SEQ ID NO: 885993 - DNA, 25 bp, Mus musculus
atttggacttggcgatcctgtacta

SEQ ID NO: 885994 - DNA, 25 bp, Mus musculus
atttggacttggggatcctgtacta

SEQ ID NO: 885995 - DNA, 25 bp, Mus musculus
atttggagacagaaaagccaccacc

SEQ ID NO: 885996 - DNA, 25 bp, Mus musculus
atttggagacagtaaagccaccacc

SEQ ID NO: 885997 - DNA, 25 bp, Mus musculus
atttggagatggcgaagtccgttga

SEQ ID NO: 885998 - DNA, 25 bp, Mus musculus
atttggagatggggaagtccgttga

SEQ ID NO: 885999 - DNA, 25 bp, Mus musculus
atttggagtagaacaatccccttct

SEQ ID NO: 886000 - DNA, 25 bp, Mus musculus
atttggagtagatcaatccccttct

SEQ ID NO: 886001 - DNA, 25 bp, Mus musculus
atttggatgacgatggaagactgtg

SEQ ID NO: 886002 - DNA, 25 bp, Mus musculus
atttggatgaggatggaagactgtg

SEQ ID NO: 886003 - DNA, 25 bp, Mus musculus
atttggcatcatccaaatgacaatg

SEQ ID NO: 886004 - DNA, 25 bp, Mus musculus
atttggcatcatgcaaatgacaatg

SEQ ID NO: 886005 - DNA, 25 bp, Mus musculus
atttggctttatcacgcgttctgtc

SEQ ID NO: 886006 - DNA, 25 bp, Mus musculus
atttggctttatcacgggcgttcaa

SEQ ID NO: 886007 - DNA, 25 bp, Mus musculus
atttggctttatcaggcgttctgtc

SEQ ID NO: 886008 - DNA, 25 bp, Mus musculus
atttggctttatcaggggcgttcaa

SEQ ID NO: 886009 - DNA, 25 bp, Mus musculus
atttgggaacagcatgggggctgct

SEQ ID NO: 886010 - DNA, 25 bp, Mus musculus
atttgggaacaggatgggggctgct

SEQ ID NO: 886011 - DNA, 25 bp, Mus musculus
atttgggatgattcgctatgcagat

SEQ ID NO: 886012 - DNA, 25 bp, Mus musculus
atttgggatgtttcgctatgcagat

SEQ ID NO: 886013 - DNA, 25 bp, Mus musculus
atttgggatttcaacaccctagagt

SEQ ID NO: 886014 - DNA, 25 bp, Mus musculus
atttgggatttcaagaccctagagt

SEQ ID NO: 886015 - DNA, 25 bp, Mus musculus
atttggggctggacatatggagggt

SEQ ID NO: 886016 - DNA, 25 bp, Mus musculus
atttggggctggtcatatggagggt

SEQ ID NO: 886017 - DNA, 25 bp, Mus musculus
atttgggtacatcgaatatgcccaa

SEQ ID NO: 886018 - DNA, 25 bp, Mus musculus
atttgggtacatggaatatgcccaa

SEQ ID NO: 886019 - DNA, 25 bp, Mus musculus
atttggtgagctgcggcttgttcag

SEQ ID NO: 886020 - DNA, 25 bp, Mus musculus
atttggtgaggtgcggcttgttcag

SEQ ID NO: 886021 - DNA, 25 bp, Mus musculus
atttggttcagactcttttacatgt

SEQ ID NO: 886022 - DNA, 25 bp, Mus musculus
atttggttcagacttgtcctgggga

SEQ ID NO: 886023 - DNA, 25 bp, Mus musculus
atttggttcagagtcttttacatgt

SEQ ID NO: 886024 - DNA, 25 bp, Mus musculus
atttggttcagagttgtcctgggga

SEQ ID NO: 886025 - DNA, 25 bp, Mus musculus
atttggttccaacatatagctgact

SEQ ID NO: 886026 - DNA, 25 bp, Mus musculus
atttggttccaagatatagctgact

SEQ ID NO: 886027 - DNA, 25 bp, Mus musculus
atttgtatgtataggctgttatgtt

SEQ ID NO: 886028 - DNA, 25 bp, Mus musculus
atttgtatgtattggctgttatgtt

SEQ ID NO: 886029 - DNA, 25 bp, Mus musculus
atttgtcaaagactcccttactaaa

SEQ ID NO: 886030 - DNA, 25 bp, Mus musculus
atttgtcaaagactgccttactaaa

SEQ ID NO: 886031 - DNA, 25 bp, Mus musculus
atttgtcctacatgtaacgtgacca

SEQ ID NO: 886032 - DNA, 25 bp, Mus musculus
atttgtcctagatgtaacgtgacca

SEQ ID NO: 886033 - DNA, 25 bp, Mus musculus
atttgtcgataatctgtatcgattc

SEQ ID NO: 886034 - DNA, 25 bp, Mus musculus
atttgtcgattatctgtatcgattc

SEQ ID NO: 886035 - DNA, 25 bp, Mus musculus
atttgtctaaactgggattgagctt

SEQ ID NO: 886036 - DNA, 25 bp, Mus musculus
atttgtctaatctgggattgagctt

SEQ ID NO: 886037 - DNA, 25 bp, Mus musculus
atttgtctacaaccacaagcgctgt

SEQ ID NO: 886038 - DNA, 25 bp, Mus musculus
atttgtctacaagcacaagcgctgt

SEQ ID NO: 886039 - DNA, 25 bp, Mus musculus
atttgtgaagcagaaatatctggaa

SEQ ID NO: 886040 - DNA, 25 bp, Mus musculus
atttgtgaagcagatatatctggaa

SEQ ID NO: 886041 - DNA, 25 bp, Mus musculus
atttgtgagcagaacatgttactaa

SEQ ID NO: 886042 - DNA, 25 bp, Mus musculus
atttgtgagcagctgtccacaaagt

SEQ ID NO: 886043 - DNA, 25 bp, Mus musculus
atttgtgagcaggtgtccacaaagt

SEQ ID NO: 886044 - DNA, 25 bp, Mus musculus
atttgtgagcagtacatgttactaa

SEQ ID NO: 886045 - DNA, 25 bp, Mus musculus
atttgtggaaagaatgtacagacgg

SEQ ID NO: 886046 - DNA, 25 bp, Mus musculus
atttgtggaaagtatgtacagacgg

SEQ ID NO: 886047 - DNA, 25 bp, Mus musculus
atttgttaacagctcaaaatgcaga

SEQ ID NO: 886048 - DNA, 25 bp, Mus musculus
atttgttaacaggtcaaaatgcaga

SEQ ID NO: 886049 - DNA, 25 bp, Mus musculus
atttgttcaaccagctgtttggaga

SEQ ID NO: 886050 - DNA, 25 bp, Mus musculus
atttgttcaagcagctgtttggaga

SEQ ID NO: 886051 - DNA, 25 bp, Mus musculus
atttgttcccagccaaattccatca

SEQ ID NO: 886052 - DNA, 25 bp, Mus musculus
atttgttcccaggcaaattccatca

SEQ ID NO: 886053 - DNA, 25 bp, Mus musculus
atttgttgcccacgttctcctgtgt

SEQ ID NO: 886054 - DNA, 25 bp, Mus musculus
atttgttgcccaggttctcctgtgt

SEQ ID NO: 886055 - DNA, 25 bp, Mus musculus
atttgttggctgctcgtgctaatgt

SEQ ID NO: 886056 - DNA, 25 bp, Mus musculus
atttgttggctgctggtgctaatgt

SEQ ID NO: 886057 - DNA, 25 bp, Mus musculus
attttaaagcagccattagctatgg

SEQ ID NO: 886058 - DNA, 25 bp, Mus musculus
attttaaagcaggcattagctatgg

SEQ ID NO: 886059 - DNA, 25 bp, Mus musculus
attttaagactgagagtgaagggca

SEQ ID NO: 886060 - DNA, 25 bp, Mus musculus
attttaagactgtgagtgaagggca

SEQ ID NO: 886061 - DNA, 25 bp, Mus musculus
attttaagagagggtgcctccgaag

SEQ ID NO: 886062 - DNA, 25 bp, Mus musculus
attttaagagatcctggacctgaga

SEQ ID NO: 886063 - DNA, 25 bp, Mus musculus
attttaagagtgggtgcctccgaag

SEQ ID NO: 886064 - DNA, 25 bp, Mus musculus
attttaagagttcctggacctgaga

SEQ ID NO: 886065 - DNA, 25 bp, Mus musculus
attttaagccagagttgtaagcttg

SEQ ID NO: 886066 - DNA, 25 bp, Mus musculus
attttaagccagtgttgtaagcttg

SEQ ID NO: 886067 - DNA, 25 bp, Mus musculus
attttactccagatggcagactttc

SEQ ID NO: 886068 - DNA, 25 bp, Mus musculus
attttactccagccctggctgtcct

SEQ ID NO: 886069 - DNA, 25 bp, Mus musculus
attttactccaggcctggctgtcct

SEQ ID NO: 886070 - DNA, 25 bp, Mus musculus
attttactccagttggcagactttc

SEQ ID NO: 886071 - DNA, 25 bp, Mus musculus
attttagatctgcctcactagtagc

SEQ ID NO: 886072 - DNA, 25 bp, Mus musculus
attttagatctggctcactagtagc

SEQ ID NO: 886073 - DNA, 25 bp, Mus musculus
attttagcagctgaatatgaccatc

SEQ ID NO: 886074 - DNA, 25 bp, Mus musculus
attttagcagcttcttactgtgttt

SEQ ID NO: 886075 - DNA, 25 bp, Mus musculus
attttagcaggtgaatatgaccatc

SEQ ID NO: 886076 - DNA, 25 bp, Mus musculus
attttagcaggttcttactgtgttt

SEQ ID NO: 886077 - DNA, 25 bp, Mus musculus
attttagttaagcgagtggatgagt

SEQ ID NO: 886078 - DNA, 25 bp, Mus musculus
attttagttaagggagtggatgagt

SEQ ID NO: 886079 - DNA, 25 bp, Mus musculus
attttcaataaacctgatgagtaca

SEQ ID NO: 886080 - DNA, 25 bp, Mus musculus
attttcaataaagctgatgagtaca

SEQ ID NO: 886081 - DNA, 25 bp, Mus musculus
attttcacgtctctcgacaagccct

SEQ ID NO: 886082 - DNA, 25 bp, Mus musculus
attttcacgtctctggacaagccct

SEQ ID NO: 886083 - DNA, 25 bp, Mus musculus
attttcacgtggagcctgacagcag

SEQ ID NO: 886084 - DNA, 25 bp, Mus musculus
attttcacgtggccgggccaggctg

SEQ ID NO: 886085 - DNA, 25 bp, Mus musculus
attttcacgtgggcgggccaggctg

SEQ ID NO: 886086 - DNA, 25 bp, Mus musculus
attttcacgtggtgcctgacagcag

SEQ ID NO: 886087 - DNA, 25 bp, Mus musculus
attttcagaaagcttcgattttcat

SEQ ID NO: 886088 - DNA, 25 bp, Mus musculus
attttcagaaaggttcgattttcat

SEQ ID NO: 886089 - DNA, 25 bp, Mus musculus
attttcagggcattgtgcttcttct

SEQ ID NO: 886090 - DNA, 25 bp, Mus musculus
attttcaggggattgtgcttcttct

SEQ ID NO: 886091 - DNA, 25 bp, Mus musculus
attttcagtcagatatactttatta

SEQ ID NO: 886092 - DNA, 25 bp, Mus musculus
attttcagtcagttatactttatta

SEQ ID NO: 886093 - DNA, 25 bp, Mus musculus
attttccaagaacagttagctgcca

SEQ ID NO: 886094 - DNA, 25 bp, Mus musculus
attttccaagtacagttagctgcca

SEQ ID NO: 886095 - DNA, 25 bp, Mus musculus
attttccaatatcgctttatcctct

SEQ ID NO: 886096 - DNA, 25 bp, Mus musculus
attttccaatatggctttatcctct

SEQ ID NO: 886097 - DNA, 25 bp, Mus musculus
attttcccagcacggttagcataaa

SEQ ID NO: 886098 - DNA, 25 bp, Mus musculus
attttcccagcagggttagcataaa

SEQ ID NO: 886099 - DNA, 25 bp, Mus musculus
attttcggcaagcatgagccccaag

SEQ ID NO: 886100 - DNA, 25 bp, Mus musculus
attttcggcaagcgcgtctactggg

SEQ ID NO: 886101 - DNA, 25 bp, Mus musculus
attttcggcaaggatgagccccaag

SEQ ID NO: 886102 - DNA, 25 bp, Mus musculus
attttcggcaagggcgtctactggg

SEQ ID NO: 886103 - DNA, 25 bp, Mus musculus
attttctatgctgccattaaccact

SEQ ID NO: 886104 - DNA, 25 bp, Mus musculus
attttctatggtgccattaaccact

SEQ ID NO: 886105 - DNA, 25 bp, Mus musculus
attttctcagcgaggcgccttgtct

SEQ ID NO: 886106 - DNA, 25 bp, Mus musculus
attttctcagcggccgatcaacagt

SEQ ID NO: 886107 - DNA, 25 bp, Mus musculus
attttctcagctgtgcatgtagccg

SEQ ID NO: 886108 - DNA, 25 bp, Mus musculus
attttctcagggaggcgccttgtct

SEQ ID NO: 886109 - DNA, 25 bp, Mus musculus
attttctcaggggccgatcaacagt

SEQ ID NO: 886110 - DNA, 25 bp, Mus musculus
attttctcaggtgtgcatgtagccg

SEQ ID NO: 886111 - DNA, 25 bp, Mus musculus
attttctggaacagcctatatgctc

SEQ ID NO: 886112 - DNA, 25 bp, Mus musculus
attttctggaactgcctatatgctc

SEQ ID NO: 886113 - DNA, 25 bp, Mus musculus
attttctggatgcatcattgctcaa

SEQ ID NO: 886114 - DNA, 25 bp, Mus musculus
attttctggatggatcattgctcaa

SEQ ID NO: 886115 - DNA, 25 bp, Mus musculus
attttctgggcaatgaattccacag

SEQ ID NO: 886116 - DNA, 25 bp, Mus musculus
attttctggggaatgaattccacag

SEQ ID NO: 886117 - DNA, 25 bp, Mus musculus
attttcttggcgagcaagagtgcaa

SEQ ID NO: 886118 - DNA, 25 bp, Mus musculus
attttcttggggagcaagagtgcaa

SEQ ID NO: 886119 - DNA, 25 bp, Mus musculus
attttgaaagatgtccttcaagaac

SEQ ID NO: 886120 - DNA, 25 bp, Mus musculus
attttgaaagttgtccttcaagaac

SEQ ID NO: 886121 - DNA, 25 bp, Mus musculus
attttgagtctacacgtttgtacag

SEQ ID NO: 886122 - DNA, 25 bp, Mus musculus
attttgagtctacaggtttgtacag

SEQ ID NO: 886123 - DNA, 25 bp, Mus musculus
attttgcacgcactcacctgttgca

SEQ ID NO: 886124 - DNA, 25 bp, Mus musculus
attttgcacggactcacctgttgca

SEQ ID NO: 886125 - DNA, 25 bp, Mus musculus
attttgcaggaaagcgcaaataagt

SEQ ID NO: 886126 - DNA, 25 bp, Mus musculus
attttgcaggaaagggcaaataagt

SEQ ID NO: 886127 - DNA, 25 bp, Mus musculus
attttgccagagactgtcaccatct

SEQ ID NO: 886128 - DNA, 25 bp, Mus musculus
attttgccagtgactgtcaccatct

SEQ ID NO: 886129 - DNA, 25 bp, Mus musculus
attttggaacagccaacaatatcac

SEQ ID NO: 886130 - DNA, 25 bp, Mus musculus
attttggaacaggcaacaatatcac

SEQ ID NO: 886131 - DNA, 25 bp, Mus musculus
attttggcagattaactaaactcca

SEQ ID NO: 886132 - DNA, 25 bp, Mus musculus
attttggcagtttaactaaactcca

SEQ ID NO: 886133 - DNA, 25 bp, Mus musculus
attttgtggccactggggctgaaga

SEQ ID NO: 886134 - DNA, 25 bp, Mus musculus
attttgtggccagtggggctgaaga

SEQ ID NO: 886135 - DNA, 25 bp, Mus musculus
attttgttatgccactcaggatttg

SEQ ID NO: 886136 - DNA, 25 bp, Mus musculus
attttgttatgccagtcaggatttg

SEQ ID NO: 886137 - DNA, 25 bp, Mus musculus
atttttaatgacactctttggtttg

SEQ ID NO: 886138 - DNA, 25 bp, Mus musculus
atttttaatgactctctttggtttg

SEQ ID NO: 886139 - DNA, 25 bp, Mus musculus
atttttacagcgaggagcctcgatt

SEQ ID NO: 886140 - DNA, 25 bp, Mus musculus
atttttacagggaggagcctcgatt

SEQ ID NO: 886141 - DNA, 25 bp, Mus musculus
atttttattcggctcaacagagcat

SEQ ID NO: 886142 - DNA, 25 bp, Mus musculus
atttttattcgggtcaacagagcat

SEQ ID NO: 886143 - DNA, 25 bp, Mus musculus
atttttcggaagacagcgtggaaga

SEQ ID NO: 886144 - DNA, 25 bp, Mus musculus
atttttcggaagtcagcgtggaaga

SEQ ID NO: 886145 - DNA, 25 bp, Mus musculus
atttttgacaagccacggcaagctg

SEQ ID NO: 886146 - DNA, 25 bp, Mus musculus
atttttgacaaggcacggcaagctg

SEQ ID NO: 886147 - DNA, 25 bp, Mus musculus
atttttgctgagctaaatagcgata

SEQ ID NO: 886148 - DNA, 25 bp, Mus musculus
atttttgctgaggtaaatagcgata

SEQ ID NO: 886149 - DNA, 25 bp, Mus musculus
atttttttgaagattggacctgcct

SEQ ID NO: 886150 - DNA, 25 bp, Mus musculus
atttttttgaagtttggacctgcct

SEQ ID NO: 886151 - DNA, 25 bp, Mus musculus
atttttttgcttagctcttgtctgt

SEQ ID NO: 886152 - DNA, 25 bp, Mus musculus
atttttttgcttaggtcttgtctgt

SEQ ID NO: 886153 - DNA, 25 bp, Mus musculus
caaaaaacccaacgtgatgctgaca

SEQ ID NO: 886154 - DNA, 25 bp, Mus musculus
caaaaaacccaaggtgatgctgaca

SEQ ID NO: 886155 - DNA, 25 bp, Mus musculus
caaaaaagccagccctctgatcctg

SEQ ID NO: 886156 - DNA, 25 bp, Mus musculus
caaaaaagccaggcctctgatcctg

SEQ ID NO: 886157 - DNA, 25 bp, Mus musculus
caaaaaagcgaaagatgtgaccgtt

SEQ ID NO: 886158 - DNA, 25 bp, Mus musculus
caaaaaagcgtaagatgtgaccgtt

SEQ ID NO: 886159 - DNA, 25 bp, Mus musculus
caaaaacaagcaaacagctctgcac

SEQ ID NO: 886160 - DNA, 25 bp, Mus musculus
caaaaacaagcaggaccagtatgaa

SEQ ID NO: 886161 - DNA, 25 bp, Mus musculus
caaaaacaagcaggagccgaggaag

SEQ ID NO: 886162 - DNA, 25 bp, Mus musculus
caaaaacaaggaaacagctctgcac

SEQ ID NO: 886163 - DNA, 25 bp, Mus musculus
caaaaacaaggaggaccagtatgaa

SEQ ID NO: 886164 - DNA, 25 bp, Mus musculus
caaaaacaaggaggagccgaggaag

SEQ ID NO: 886165 - DNA, 25 bp, Mus musculus
caaaaacaatcgtgacttggacttt

SEQ ID NO: 886166 - DNA, 25 bp, Mus musculus
caaaaacaatggtgacttggacttt

SEQ ID NO: 886167 - DNA, 25 bp, Mus musculus
caaaaacacgccatcttgagtagtg

SEQ ID NO: 886168 - DNA, 25 bp, Mus musculus
caaaaacacggcatcttgagtagtg

SEQ ID NO: 886169 - DNA, 25 bp, Mus musculus
caaaaacatcatcgttctcccaaga

SEQ ID NO: 886170 - DNA, 25 bp, Mus musculus
caaaaacatcatggttctcccaaga

SEQ ID NO: 886171 - DNA, 25 bp, Mus musculus
caaaaaccagaacaatctaatcaaa

SEQ ID NO: 886172 - DNA, 25 bp, Mus musculus
caaaaaccagaagaatctaatcaaa

SEQ ID NO: 886173 - DNA, 25 bp, Mus musculus
caaaaactagcctgcgggaagctga

SEQ ID NO: 886174 - DNA, 25 bp, Mus musculus
caaaaactaggctgcgggaagctga

SEQ ID NO: 886175 - DNA, 25 bp, Mus musculus
caaaaacttgaccctcatcaaaaag

SEQ ID NO: 886176 - DNA, 25 bp, Mus musculus
caaaaacttgtccctcatcaaaaag

SEQ ID NO: 886177 - DNA, 25 bp, Mus musculus
caaaaagatgggcactatcttcgac

SEQ ID NO: 886178 - DNA, 25 bp, Mus musculus
caaaaagatgggcagtatcttcgac

SEQ ID NO: 886179 - DNA, 25 bp, Mus musculus
caaaaagcacagaacaagcctgcca

SEQ ID NO: 886180 - DNA, 25 bp, Mus musculus
caaaaagcacagtacaagcctgcca

SEQ ID NO: 886181 - DNA, 25 bp, Mus musculus
caaaaagcagatggagacacggaaa

SEQ ID NO: 886182 - DNA, 25 bp, Mus musculus
caaaaagcagattgtccatcccatg

SEQ ID NO: 886183 - DNA, 25 bp, Mus musculus
caaaaagcagttggagacacggaaa

SEQ ID NO: 886184 - DNA, 25 bp, Mus musculus
caaaaagcagtttgtccatcccatg

SEQ ID NO: 886185 - DNA, 25 bp, Mus musculus
caaaaagccgaactgctttgagctt

SEQ ID NO: 886186 - DNA, 25 bp, Mus musculus
caaaaagccgtactgctttgagctt

SEQ ID NO: 886187 - DNA, 25 bp, Mus musculus
caaaaaggagctggcaatcgttgtg

SEQ ID NO: 886188 - DNA, 25 bp, Mus musculus
caaaaaggaggtggcaatcgttgtg

SEQ ID NO: 886189 - DNA, 25 bp, Mus musculus
caaaaagtgtgcaggtttcaactct

SEQ ID NO: 886190 - DNA, 25 bp, Mus musculus
caaaaagtgtgctggtttcaactct

SEQ ID NO: 886191 - DNA, 25 bp, Mus musculus
caaaaatcacggaacgtgtctcaga

SEQ ID NO: 886192 - DNA, 25 bp, Mus musculus
caaaaatcacggaaggtgtctcaga

SEQ ID NO: 886193 - DNA, 25 bp, Mus musculus
caaaaatcagataacaactattcca

SEQ ID NO: 886194 - DNA, 25 bp, Mus musculus
caaaaatcagataagaaacctgacc

SEQ ID NO: 886195 - DNA, 25 bp, Mus musculus
caaaaatcagttaacaactattcca

SEQ ID NO: 886196 - DNA, 25 bp, Mus musculus
caaaaatcagttaagaaacctgacc

SEQ ID NO: 886197 - DNA, 25 bp, Mus musculus
caaaaatctcaaaggtggattacag

SEQ ID NO: 886198 - DNA, 25 bp, Mus musculus
caaaaatctcaatggtggattacag

SEQ ID NO: 886199 - DNA, 25 bp, Mus musculus
caaaaatggcacaaccgttcttgct

SEQ ID NO: 886200 - DNA, 25 bp, Mus musculus
caaaaatggcactaccgttcttgct

SEQ ID NO: 886201 - DNA, 25 bp, Mus musculus
caaaacaaagcacgcgaggcagagc

SEQ ID NO: 886202 - DNA, 25 bp, Mus musculus
caaaacaaaggacgcgaggcagagc

SEQ ID NO: 886203 - DNA, 25 bp, Mus musculus
caaaacacagaacacgccgcaagat

SEQ ID NO: 886204 - DNA, 25 bp, Mus musculus
caaaacacagaacaggccgcaagat

SEQ ID NO: 886205 - DNA, 25 bp, Mus musculus
caaaacagacccgactgggtgatcg

SEQ ID NO: 886206 - DNA, 25 bp, Mus musculus
caaaacagacccgagtgggtgatcg

SEQ ID NO: 886207 - DNA, 25 bp, Mus musculus
caaaaccaaacaatttgctcctatt

SEQ ID NO: 886208 - DNA, 25 bp, Mus musculus
caaaaccaaacattttgctcctatt

SEQ ID NO: 886209 - DNA, 25 bp, Mus musculus
caaaaccaagaatgcccagcaagta

SEQ ID NO: 886210 - DNA, 25 bp, Mus musculus
caaaaccaagcatgtggagtacatg

SEQ ID NO: 886211 - DNA, 25 bp, Mus musculus
caaaaccaaggatgtggagtacatg

SEQ ID NO: 886212 - DNA, 25 bp, Mus musculus
caaaaccaagtatgcccagcaagta

SEQ ID NO: 886213 - DNA, 25 bp, Mus musculus
caaaaccaggctctcgccaggcagt

SEQ ID NO: 886214 - DNA, 25 bp, Mus musculus
caaaaccaggctctggccaggcagt

SEQ ID NO: 886215 - DNA, 25 bp, Mus musculus
caaaaccatgaggacgaagtcaaca

SEQ ID NO: 886216 - DNA, 25 bp, Mus musculus
caaaaccatgaggaggaagtcaaca

SEQ ID NO: 886217 - DNA, 25 bp, Mus musculus
caaaaccattaacgtgtcatatgct

SEQ ID NO: 886218 - DNA, 25 bp, Mus musculus
caaaaccattaaggtgtcatatgct

SEQ ID NO: 886219 - DNA, 25 bp, Mus musculus
caaaacccaaagccctttgccatga

SEQ ID NO: 886220 - DNA, 25 bp, Mus musculus
caaaacccaatgccctttgccatga

SEQ ID NO: 886221 - DNA, 25 bp, Mus musculus
caaaacccagagcgccagtaagagc

SEQ ID NO: 886222 - DNA, 25 bp, Mus musculus
caaaacccagagggccagtaagagc

SEQ ID NO: 886223 - DNA, 25 bp, Mus musculus
caaaacctcaattcagtggttgaat

SEQ ID NO: 886224 - DNA, 25 bp, Mus musculus
caaaacctcaattctgtggttgaat

SEQ ID NO: 886225 - DNA, 25 bp, Mus musculus
caaaacctgaagcaactgagagaga

SEQ ID NO: 886226 - DNA, 25 bp, Mus musculus
caaaacctgaaggaactgagagaga

SEQ ID NO: 886227 - DNA, 25 bp, Mus musculus
caaaactcaaaccaacagaggcggg

SEQ ID NO: 886228 - DNA, 25 bp, Mus musculus
caaaactcaatccaacagaggcggg

SEQ ID NO: 886229 - DNA, 25 bp, Mus musculus
caaaactccagaaaatgtggctccc

SEQ ID NO: 886230 - DNA, 25 bp, Mus musculus
caaaactccagaaattgtggctccc

SEQ ID NO: 886231 - DNA, 25 bp, Mus musculus
caaaactccgacataccgtgagcca

SEQ ID NO: 886232 - DNA, 25 bp, Mus musculus
caaaactccgtcataccgtgagcca

SEQ ID NO: 886233 - DNA, 25 bp, Mus musculus
caaaactgagagaccttcagaatgc

SEQ ID NO: 886234 - DNA, 25 bp, Mus musculus
caaaactgagcctgagaatacgatc

SEQ ID NO: 886235 - DNA, 25 bp, Mus musculus
caaaactgaggctgagaatacgatc

SEQ ID NO: 886236 - DNA, 25 bp, Mus musculus
caaaactgagtgaccttcagaatgc

SEQ ID NO: 886237 - DNA, 25 bp, Mus musculus
caaaactgcaagatgcacccagctg

SEQ ID NO: 886238 - DNA, 25 bp, Mus musculus
caaaactgcaagttgcacccagctg

SEQ ID NO: 886239 - DNA, 25 bp, Mus musculus
caaaactggagccaccccaaatctg

SEQ ID NO: 886240 - DNA, 25 bp, Mus musculus
caaaactggagccagcccaaatctg

SEQ ID NO: 886241 - DNA, 25 bp, Mus musculus
caaaacttcgcatgtgacctccaca

SEQ ID NO: 886242 - DNA, 25 bp, Mus musculus
caaaacttcggatgtgacctccaca

SEQ ID NO: 886243 - DNA, 25 bp, Mus musculus
caaaagaaacttcacgtggccacag

SEQ ID NO: 886244 - DNA, 25 bp, Mus musculus
caaaagaaacttcaggtggccacag

SEQ ID NO: 886245 - DNA, 25 bp, Mus musculus
caaaagacgaactacgtcctgtgcc

SEQ ID NO: 886246 - DNA, 25 bp, Mus musculus
caaaagacgaactaggtcctgtgcc

SEQ ID NO: 886247 - DNA, 25 bp, Mus musculus
caaaagagagaaaactcatggggaa

SEQ ID NO: 886248 - DNA, 25 bp, Mus musculus
caaaagagagaatactcatggggaa

SEQ ID NO: 886249 - DNA, 25 bp, Mus musculus
caaaagatctgcaaaatcatggacc

SEQ ID NO: 886250 - DNA, 25 bp, Mus musculus
caaaagatctgcaatatcatggacc

SEQ ID NO: 886251 - DNA, 25 bp, Mus musculus
caaaagcatttacggcttcagaaag

SEQ ID NO: 886252 - DNA, 25 bp, Mus musculus
caaaagcatttagggcttcagaaag

SEQ ID NO: 886253 - DNA, 25 bp, Mus musculus
caaaagccaaagatgtgtgccaaaa

SEQ ID NO: 886254 - DNA, 25 bp, Mus musculus
caaaagccaaagttgtgtgccaaaa

SEQ ID NO: 886255 - DNA, 25 bp, Mus musculus
caaaagccagaccacgatcaagtta

SEQ ID NO: 886256 - DNA, 25 bp, Mus musculus
caaaagccagaccacttccaagaat

SEQ ID NO: 886257 - DNA, 25 bp, Mus musculus
caaaagccagaccaggatcaagtta

SEQ ID NO: 886258 - DNA, 25 bp, Mus musculus
caaaagccagaccagttccaagaat

SEQ ID NO: 886259 - DNA, 25 bp, Mus musculus
caaaagccagagcccaggctgtccc

SEQ ID NO: 886260 - DNA, 25 bp, Mus musculus
caaaagccagagttggaggtgagct

SEQ ID NO: 886261 - DNA, 25 bp, Mus musculus
caaaagccagtgcccaggctgtccc

SEQ ID NO: 886262 - DNA, 25 bp, Mus musculus
caaaagccagtgttggaggtgagct

SEQ ID NO: 886263 - DNA, 25 bp, Mus musculus
caaaagctcagaaacctgtgtatga

SEQ ID NO: 886264 - DNA, 25 bp, Mus musculus
caaaagctcagaaagctgtgtatga

SEQ ID NO: 886265 - DNA, 25 bp, Mus musculus
caaaagcttctggaccaagtatcct

SEQ ID NO: 886266 - DNA, 25 bp, Mus musculus
caaaagcttctggagcaagtatcct

SEQ ID NO: 886267 - DNA, 25 bp, Mus musculus
caaaaggagcagctgcttttggata

SEQ ID NO: 886268 - DNA, 25 bp, Mus musculus
caaaaggagcaggtgcttttggata

SEQ ID NO: 886269 - DNA, 25 bp, Mus musculus
caaaaggagggcatccaggtggaag

SEQ ID NO: 886270 - DNA, 25 bp, Mus musculus
caaaaggagggcatcgtggaagatt

SEQ ID NO: 886271 - DNA, 25 bp, Mus musculus
caaaaggagggcatgcaggtggaag

SEQ ID NO: 886272 - DNA, 25 bp, Mus musculus
caaaaggagggcatggtggaagatt

SEQ ID NO: 886273 - DNA, 25 bp, Mus musculus
caaaaggcaccagccttgaggattt

SEQ ID NO: 886274 - DNA, 25 bp, Mus musculus
caaaaggcaccagcgttgaggattt

SEQ ID NO: 886275 - DNA, 25 bp, Mus musculus
caaaaggcagaacattgaggtaggc

SEQ ID NO: 886276 - DNA, 25 bp, Mus musculus
caaaaggcagaagattgaggtaggc

SEQ ID NO: 886277 - DNA, 25 bp, Mus musculus
caaaaggctcaacggctttgctgag

SEQ ID NO: 886278 - DNA, 25 bp, Mus musculus
caaaaggctcaagggctttgctgag

SEQ ID NO: 886279 - DNA, 25 bp, Mus musculus
caaaagtacttcctcgtgggtgcag

SEQ ID NO: 886280 - DNA, 25 bp, Mus musculus
caaaagtacttcctggtgggtgcag

SEQ ID NO: 886281 - DNA, 25 bp, Mus musculus
caaaagtcatatggtgagcggatgc

SEQ ID NO: 886282 - DNA, 25 bp, Mus musculus
caaaagtcatttggtgagcggatgc

SEQ ID NO: 886283 - DNA, 25 bp, Mus musculus
caaaagtgaccaattttcagagatc

SEQ ID NO: 886284 - DNA, 25 bp, Mus musculus
caaaagtgaccatttttcagagatc

SEQ ID NO: 886285 - DNA, 25 bp, Mus musculus
caaaagtttatgaattcccatctgc

SEQ ID NO: 886286 - DNA, 25 bp, Mus musculus
caaaagtttatgtattcccatctgc

SEQ ID NO: 886287 - DNA, 25 bp, Mus musculus
caaaataaccaactagcctcaatgt

SEQ ID NO: 886288 - DNA, 25 bp, Mus musculus
caaaataaccaagtagcctcaatgt

SEQ ID NO: 886289 - DNA, 25 bp, Mus musculus
caaaatagcgatctctggaataaaa

SEQ ID NO: 886290 - DNA, 25 bp, Mus musculus
caaaatagcgatgtctggaataaaa

SEQ ID NO: 886291 - DNA, 25 bp, Mus musculus
caaaatatctggaacacttttacac

SEQ ID NO: 886292 - DNA, 25 bp, Mus musculus
caaaatatctggaagacttttacac

SEQ ID NO: 886293 - DNA, 25 bp, Mus musculus
caaaatatgccaagactttatacct

SEQ ID NO: 886294 - DNA, 25 bp, Mus musculus
caaaatatgccaagtctttatacct

SEQ ID NO: 886295 - DNA, 25 bp, Mus musculus
caaaatatggacatcccaatgggac

SEQ ID NO: 886296 - DNA, 25 bp, Mus musculus
caaaatatggtcatcccaatgggac

SEQ ID NO: 886297 - DNA, 25 bp, Mus musculus
caaaatcacagaataccacctcctc

SEQ ID NO: 886298 - DNA, 25 bp, Mus musculus
caaaatcacagacaagcagaacaag

SEQ ID NO: 886299 - DNA, 25 bp, Mus musculus
caaaatcacagagaagcagaacaag

SEQ ID NO: 886300 - DNA, 25 bp, Mus musculus
caaaatcacagattaccacctcctc

SEQ ID NO: 886301 - DNA, 25 bp, Mus musculus
caaaatcacgaggatgaaagcagaa

SEQ ID NO: 886302 - DNA, 25 bp, Mus musculus
caaaatcacgtggatgaaagcagaa

SEQ ID NO: 886303 - DNA, 25 bp, Mus musculus
caaaatcattagataacaactattc

SEQ ID NO: 886304 - DNA, 25 bp, Mus musculus
caaaatcattagttaacaactattc

SEQ ID NO: 886305 - DNA, 25 bp, Mus musculus
caaaatctgagagacgtgaaccacc

SEQ ID NO: 886306 - DNA, 25 bp, Mus musculus
caaaatctgagagaggtgaaccacc

SEQ ID NO: 886307 - DNA, 25 bp, Mus musculus
caaaatgaagaacatgggcttaggt

SEQ ID NO: 886308 - DNA, 25 bp, Mus musculus
caaaatgaagaactggaactatgga

SEQ ID NO: 886309 - DNA, 25 bp, Mus musculus
caaaatgaagaagatgggcttaggt

SEQ ID NO: 886310 - DNA, 25 bp, Mus musculus
caaaatgaagaagtggaactatgga

SEQ ID NO: 886311 - DNA, 25 bp, Mus musculus
caaaatgaagcaagctctgagttct

SEQ ID NO: 886312 - DNA, 25 bp, Mus musculus
caaaatgaaggaagctctgagttct

SEQ ID NO: 886313 - DNA, 25 bp, Mus musculus
caaaatgaatcgcgtcatcaacttc

SEQ ID NO: 886314 - DNA, 25 bp, Mus musculus
caaaatgaatcgggtcatcaacttc

SEQ ID NO: 886315 - DNA, 25 bp, Mus musculus
caaaatgagagaaatgttctttgaa

SEQ ID NO: 886316 - DNA, 25 bp, Mus musculus
caaaatgagagatatgttctttgaa

SEQ ID NO: 886317 - DNA, 25 bp, Mus musculus
caaaatgcttcacggccgccttttt

SEQ ID NO: 886318 - DNA, 25 bp, Mus musculus
caaaatgcttcagggccgccttttt

SEQ ID NO: 886319 - DNA, 25 bp, Mus musculus
caaaatggccatctcagggatgaga

SEQ ID NO: 886320 - DNA, 25 bp, Mus musculus
caaaatggccatgtcagggatgaga

SEQ ID NO: 886321 - DNA, 25 bp, Mus musculus
caaaattattggaaaaaatggtgat

SEQ ID NO: 886322 - DNA, 25 bp, Mus musculus
caaaattattggaataaatggtgat

SEQ ID NO: 886323 - DNA, 25 bp, Mus musculus
caaaattcaaatgctgatagcccaa

SEQ ID NO: 886324 - DNA, 25 bp, Mus musculus
caaaattcaaattctgttgcccctc

SEQ ID NO: 886325 - DNA, 25 bp, Mus musculus
caaaattcaattgctgatagcccaa

SEQ ID NO: 886326 - DNA, 25 bp, Mus musculus
caaaattcaatttctgttgcccctc

SEQ ID NO: 886327 - DNA, 25 bp, Mus musculus
caaaatttatctacttatcatgtgc

SEQ ID NO: 886328 - DNA, 25 bp, Mus musculus
caaaatttatgtacttatcatgtgc

SEQ ID NO: 886329 - DNA, 25 bp, Mus musculus
caaacaaagagacctggaaagtctt

SEQ ID NO: 886330 - DNA, 25 bp, Mus musculus
caaacaaagagagctggaaagtctt

SEQ ID NO: 886331 - DNA, 25 bp, Mus musculus
caaacaacagcgcagcagaagaagc

SEQ ID NO: 886332 - DNA, 25 bp, Mus musculus
caaacaacagcgtggcagacgaagc

SEQ ID NO: 886333 - DNA, 25 bp, Mus musculus
caaacaacagggcagcagaagaagc

SEQ ID NO: 886334 - DNA, 25 bp, Mus musculus
caaacaacagggtggcagacgaagc

SEQ ID NO: 886335 - DNA, 25 bp, Mus musculus
caaacaactgaacttcactgcctcg

SEQ ID NO: 886336 - DNA, 25 bp, Mus musculus
caaacaactgtacttcactgcctcg

SEQ ID NO: 886337 - DNA, 25 bp, Mus musculus
caaacaagagcaagatttggaggaa

SEQ ID NO: 886338 - DNA, 25 bp, Mus musculus
caaacaagagcatgatttggaggaa

SEQ ID NO: 886339 - DNA, 25 bp, Mus musculus
caaacaagatgggacgcacctccaa

SEQ ID NO: 886340 - DNA, 25 bp, Mus musculus
caaacaagatgggaggcacctccaa

SEQ ID NO: 886341 - DNA, 25 bp, Mus musculus
caaacaagtgttcacagccggaaac

SEQ ID NO: 886342 - DNA, 25 bp, Mus musculus
caaacaagtgttcacgcctccttct

SEQ ID NO: 886343 - DNA, 25 bp, Mus musculus
caaacaagtgttcagagccggaaac

SEQ ID NO: 886344 - DNA, 25 bp, Mus musculus
caaacaagtgttcaggcctccttct

SEQ ID NO: 886345 - DNA, 25 bp, Mus musculus
caaacaatgcagacttttagttggt

SEQ ID NO: 886346 - DNA, 25 bp, Mus musculus
caaacaatgcagtcttttagttggt

SEQ ID NO: 886347 - DNA, 25 bp, Mus musculus
caaacacaagatggaaatctacatt

SEQ ID NO: 886348 - DNA, 25 bp, Mus musculus
caaacacaagttggaaatctacatt

SEQ ID NO: 886349 - DNA, 25 bp, Mus musculus
caaacacagcaacacctgataaagt

SEQ ID NO: 886350 - DNA, 25 bp, Mus musculus
caaacacagcaacagctgataaagt

SEQ ID NO: 886351 - DNA, 25 bp, Mus musculus
caaacaccagcgtgttcccatggcc

SEQ ID NO: 886352 - DNA, 25 bp, Mus musculus
caaacaccagggtgttcccatggcc

SEQ ID NO: 886353 - DNA, 25 bp, Mus musculus
caaacaccccagctgatcatggaac

SEQ ID NO: 886354 - DNA, 25 bp, Mus musculus
caaacaccccaggtgatcatggaac

SEQ ID NO: 886355 - DNA, 25 bp, Mus musculus
caaacactgacacggatcaagtttg

SEQ ID NO: 886356 - DNA, 25 bp, Mus musculus
caaacactgacagggatcaagtttg

SEQ ID NO: 886357 - DNA, 25 bp, Mus musculus
caaacactgagcaacagtccaactt

SEQ ID NO: 886358 - DNA, 25 bp, Mus musculus
caaacactgagcaagagtccaactt

SEQ ID NO: 886359 - DNA, 25 bp, Mus musculus
caaacactgcagcttaaaatgccat

SEQ ID NO: 886360 - DNA, 25 bp, Mus musculus
caaacactgcaggttaaaatgccat

SEQ ID NO: 886361 - DNA, 25 bp, Mus musculus
caaacagaagccaacactgcaagat

SEQ ID NO: 886362 - DNA, 25 bp, Mus musculus
caaacagaaggcaacactgcaagat

SEQ ID NO: 886363 - DNA, 25 bp, Mus musculus
caaacagagaaaagccatctgaagg

SEQ ID NO: 886364 - DNA, 25 bp, Mus musculus
caaacagagaaatgccatctgaagg

SEQ ID NO: 886365 - DNA, 25 bp, Mus musculus
caaacagatgaacatcattcaccag

SEQ ID NO: 886366 - DNA, 25 bp, Mus musculus
caaacagatgaacattatccaccag

SEQ ID NO: 886367 - DNA, 25 bp, Mus musculus
caaacagatgaagatcattcaccag

SEQ ID NO: 886368 - DNA, 25 bp, Mus musculus
caaacagatgaagattatccaccag

SEQ ID NO: 886369 - DNA, 25 bp, Mus musculus
caaacagcagaacgtagagcttgag

SEQ ID NO: 886370 - DNA, 25 bp, Mus musculus
caaacagcagaaggtagagcttgag

SEQ ID NO: 886371 - DNA, 25 bp, Mus musculus
caaacagggaatggcgaagaaggca

SEQ ID NO: 886372 - DNA, 25 bp, Mus musculus
caaacagggaatggggaagaaggca

SEQ ID NO: 886373 - DNA, 25 bp, Mus musculus
caaacataatctgaccccatctctg

SEQ ID NO: 886374 - DNA, 25 bp, Mus musculus
caaacataatgtgaccccatctctg

SEQ ID NO: 886375 - DNA, 25 bp, Mus musculus
caaacatatgccacttcttggacag

SEQ ID NO: 886376 - DNA, 25 bp, Mus musculus
caaacatatgctgagaaatccattg

SEQ ID NO: 886377 - DNA, 25 bp, Mus musculus
caaacatatggcacttcttggacag

SEQ ID NO: 886378 - DNA, 25 bp, Mus musculus
caaacatatggtgagaaatccattg

SEQ ID NO: 886379 - DNA, 25 bp, Mus musculus
caaacatggcagcagagtcactcgg

SEQ ID NO: 886380 - DNA, 25 bp, Mus musculus
caaacatggcagcctctacacagag

SEQ ID NO: 886381 - DNA, 25 bp, Mus musculus
caaacatggcaggagagtcactcgg

SEQ ID NO: 886382 - DNA, 25 bp, Mus musculus
caaacatggcaggctctacacagag

SEQ ID NO: 886383 - DNA, 25 bp, Mus musculus
caaacattatgacggtgctctcgat

SEQ ID NO: 886384 - DNA, 25 bp, Mus musculus
caaacattatgagggtgctctcgat

SEQ ID NO: 886385 - DNA, 25 bp, Mus musculus
caaaccacccagatctcttgcttaa

SEQ ID NO: 886386 - DNA, 25 bp, Mus musculus
caaaccacccagttctcttgcttaa

SEQ ID NO: 886387 - DNA, 25 bp, Mus musculus
caaaccagcaagagcgactgtatct

SEQ ID NO: 886388 - DNA, 25 bp, Mus musculus
caaaccagcaagtgcgactgtatct

SEQ ID NO: 886389 - DNA, 25 bp, Mus musculus
caaaccaggcagctatatcttccgg

SEQ ID NO: 886390 - DNA, 25 bp, Mus musculus
caaaccaggcaggtatatcttccgg

SEQ ID NO: 886391 - DNA, 25 bp, Mus musculus
caaaccattcagattgcaggagaca

SEQ ID NO: 886392 - DNA, 25 bp, Mus musculus
caaaccattcagtttgcaggagaca

SEQ ID NO: 886393 - DNA, 25 bp, Mus musculus
caaacctaaaggctatgcatttata

SEQ ID NO: 886394 - DNA, 25 bp, Mus musculus
caaacctaaagggtatgcatttata

SEQ ID NO: 886395 - DNA, 25 bp, Mus musculus
caaacctctgcgccggtatctgacc

SEQ ID NO: 886396 - DNA, 25 bp, Mus musculus
caaacctctgcggcggtatctgacc

SEQ ID NO: 886397 - DNA, 25 bp, Mus musculus
caaacctgcaccaacgttccgctgc

SEQ ID NO: 886398 - DNA, 25 bp, Mus musculus
caaacctgcaccaaggttccgctgc

SEQ ID NO: 886399 - DNA, 25 bp, Mus musculus
caaacgactcactacggaagctatg

SEQ ID NO: 886400 - DNA, 25 bp, Mus musculus
caaacgactcactagggaagctatg

SEQ ID NO: 886401 - DNA, 25 bp, Mus musculus
caaacgatttctccgaccttcgaga

SEQ ID NO: 886402 - DNA, 25 bp, Mus musculus
caaacgatttctgcgaccttcgaga

SEQ ID NO: 886403 - DNA, 25 bp, Mus musculus
caaacgccccagctctcttgtgctg

SEQ ID NO: 886404 - DNA, 25 bp, Mus musculus
caaacgccccaggtctcttgtgctg

SEQ ID NO: 886405 - DNA, 25 bp, Mus musculus
caaactacattgatttcatcttcca

SEQ ID NO: 886406 - DNA, 25 bp, Mus musculus
caaactacattgccaaccgaggtcc

SEQ ID NO: 886407 - DNA, 25 bp, Mus musculus
caaactacattggcaaccgaggtcc

SEQ ID NO: 886408 - DNA, 25 bp, Mus musculus
caaactacattgttttcatcttcca

SEQ ID NO: 886409 - DNA, 25 bp, Mus musculus
caaactactccgacaagcatgaaga

SEQ ID NO: 886410 - DNA, 25 bp, Mus musculus
caaactactcggacaagcatgaaga

SEQ ID NO: 886411 - DNA, 25 bp, Mus musculus
caaactagacaacatgtcttgggaa

SEQ ID NO: 886412 - DNA, 25 bp, Mus musculus
caaactagacaagatgtcttgggaa

SEQ ID NO: 886413 - DNA, 25 bp, Mus musculus
caaactcaagatgggaagtcattgc

SEQ ID NO: 886414 - DNA, 25 bp, Mus musculus
caaactcaagttgggaagtcattgc

SEQ ID NO: 886415 - DNA, 25 bp, Mus musculus
caaactcacaagaacaaacatgtca

SEQ ID NO: 886416 - DNA, 25 bp, Mus musculus
caaactcacaagaacacttccaact

SEQ ID NO: 886417 - DNA, 25 bp, Mus musculus
caaactcacaagaactcgcaatgtg

SEQ ID NO: 886418 - DNA, 25 bp, Mus musculus
caaactcacaagaagaaacatgtca

SEQ ID NO: 886419 - DNA, 25 bp, Mus musculus
caaactcacaagaagacttccaact

SEQ ID NO: 886420 - DNA, 25 bp, Mus musculus
caaactcacaagaagtcgcaatgtg

SEQ ID NO: 886421 - DNA, 25 bp, Mus musculus
caaactcatcatccgcgagtgcatt

SEQ ID NO: 886422 - DNA, 25 bp, Mus musculus
caaactcatcatgcgcgagtgcatt

SEQ ID NO: 886423 - DNA, 25 bp, Mus musculus
caaactctcagacaaccgagcccga

SEQ ID NO: 886424 - DNA, 25 bp, Mus musculus
caaactctcagagaaccgagcccga

SEQ ID NO: 886425 - DNA, 25 bp, Mus musculus
caaactgaagcgcgactaccctgat

SEQ ID NO: 886426 - DNA, 25 bp, Mus musculus
caaactgaagcgggactaccctgat

SEQ ID NO: 886427 - DNA, 25 bp, Mus musculus
caaactgctcagcaataaagctggc

SEQ ID NO: 886428 - DNA, 25 bp, Mus musculus
caaactgctcaggaataaagctggc

SEQ ID NO: 886429 - DNA, 25 bp, Mus musculus
caaactgctgaaagcgctgagagtc

SEQ ID NO: 886430 - DNA, 25 bp, Mus musculus
caaactgctgaatgcgctgagagtc

SEQ ID NO: 886431 - DNA, 25 bp, Mus musculus
caaactgcttcacctccaagaggtt

SEQ ID NO: 886432 - DNA, 25 bp, Mus musculus
caaactgcttcagctccaagaggtt

SEQ ID NO: 886433 - DNA, 25 bp, Mus musculus
caaactggagcaaagcacagacaac

SEQ ID NO: 886434 - DNA, 25 bp, Mus musculus
caaactggaggaaagcacagacaac

SEQ ID NO: 886435 - DNA, 25 bp, Mus musculus
caaacttcaaagccattcctgttga

SEQ ID NO: 886436 - DNA, 25 bp, Mus musculus
caaacttcaaaggcattcctgttga

SEQ ID NO: 886437 - DNA, 25 bp, Mus musculus
caaacttcaagaagcatacagtttc

SEQ ID NO: 886438 - DNA, 25 bp, Mus musculus
caaacttcaagaagtaccagtacat

SEQ ID NO: 886439 - DNA, 25 bp, Mus musculus
caaacttcaagatgcatacagtttc

SEQ ID NO: 886440 - DNA, 25 bp, Mus musculus
caaacttcaagatgtaccagtacat

SEQ ID NO: 886441 - DNA, 25 bp, Mus musculus
caaacttcagagtgaatgccatcca

SEQ ID NO: 886442 - DNA, 25 bp, Mus musculus
caaacttcagataataacagacttt

SEQ ID NO: 886443 - DNA, 25 bp, Mus musculus
caaacttcagtgtgaatgccatcca

SEQ ID NO: 886444 - DNA, 25 bp, Mus musculus
caaacttcagttaataacagacttt

SEQ ID NO: 886445 - DNA, 25 bp, Mus musculus
caaacttgagcaaatctacgctcct

SEQ ID NO: 886446 - DNA, 25 bp, Mus musculus
caaacttgaggaaatctacgctcct

SEQ ID NO: 886447 - DNA, 25 bp, Mus musculus
caaactttgccgaatcacaggacca

SEQ ID NO: 886448 - DNA, 25 bp, Mus musculus
caaactttgccgtatcacaggacca

SEQ ID NO: 886449 - DNA, 25 bp, Mus musculus
caaacttttccactgtgtccattgt

SEQ ID NO: 886450 - DNA, 25 bp, Mus musculus
caaacttttccagtgtgtccattgt

SEQ ID NO: 886451 - DNA, 25 bp, Mus musculus
caaagaaaacagatcatccagagga

SEQ ID NO: 886452 - DNA, 25 bp, Mus musculus
caaagaaaacagatcgtacaaagaa

SEQ ID NO: 886453 - DNA, 25 bp, Mus musculus
caaagaaaacagatgatccagagga

SEQ ID NO: 886454 - DNA, 25 bp, Mus musculus
caaagaaaacagatggtacaaagaa

SEQ ID NO: 886455 - DNA, 25 bp, Mus musculus
caaagaaaacagcgctattccagat

SEQ ID NO: 886456 - DNA, 25 bp, Mus musculus
caaagaaaacagggctattccagat

SEQ ID NO: 886457 - DNA, 25 bp, Mus musculus
caaagaaaagcaaagacaagctgaa

SEQ ID NO: 886458 - DNA, 25 bp, Mus musculus
caaagaaaaggaaagacaagctgaa

SEQ ID NO: 886459 - DNA, 25 bp, Mus musculus
caaagaaacgagaacgaacaagagc

SEQ ID NO: 886460 - DNA, 25 bp, Mus musculus
caaagaaacgagaaggaacaagagc

SEQ ID NO: 886461 - DNA, 25 bp, Mus musculus
caaagaaagagacaccagagggaca

SEQ ID NO: 886462 - DNA, 25 bp, Mus musculus
caaagaaagagacatggcagcagca

SEQ ID NO: 886463 - DNA, 25 bp, Mus musculus
caaagaaagagagaccagagggaca

SEQ ID NO: 886464 - DNA, 25 bp, Mus musculus
caaagaaagagagatggcagcagca

SEQ ID NO: 886465 - DNA, 25 bp, Mus musculus
caaagaacatggagccccctggtga

SEQ ID NO: 886466 - DNA, 25 bp, Mus musculus
caaagaacatggaggcccctggtga

SEQ ID NO: 886467 - DNA, 25 bp, Mus musculus
caaagaacggcgatcctttccgtca

SEQ ID NO: 886468 - DNA, 25 bp, Mus musculus
caaagaacggcgatgctttccgtca

SEQ ID NO: 886469 - DNA, 25 bp, Mus musculus
caaagaactcaagaatgatagattt

SEQ ID NO: 886470 - DNA, 25 bp, Mus musculus
caaagaactcaagattgatagattt

SEQ ID NO: 886471 - DNA, 25 bp, Mus musculus
caaagaagacacccatataatgccc

SEQ ID NO: 886472 - DNA, 25 bp, Mus musculus
caaagaagactcccatataatgccc

SEQ ID NO: 886473 - DNA, 25 bp, Mus musculus
caaagaagcaaacgataaacaagct

SEQ ID NO: 886474 - DNA, 25 bp, Mus musculus
caaagaagcaaaggataaacaagct

SEQ ID NO: 886475 - DNA, 25 bp, Mus musculus
caaagaatatgacttcgaggtccac

SEQ ID NO: 886476 - DNA, 25 bp, Mus musculus
caaagaatatgagttcgaggtccac

SEQ ID NO: 886477 - DNA, 25 bp, Mus musculus
caaagaatccagaaaatgtaaagca

SEQ ID NO: 886478 - DNA, 25 bp, Mus musculus
caaagaatccagaatatgtaaagca

SEQ ID NO: 886479 - DNA, 25 bp, Mus musculus
caaagacaaactactccaattatga

SEQ ID NO: 886480 - DNA, 25 bp, Mus musculus
caaagacaaagtactccaattatga

SEQ ID NO: 886481 - DNA, 25 bp, Mus musculus
caaagacaagacctggacacgcatc

SEQ ID NO: 886482 - DNA, 25 bp, Mus musculus
caaagacaagacgtggacacgcatc

SEQ ID NO: 886483 - DNA, 25 bp, Mus musculus
caaagacaagctcaaacatgtctgt

SEQ ID NO: 886484 - DNA, 25 bp, Mus musculus
caaagacaagctgagggtggtgagc

SEQ ID NO: 886485 - DNA, 25 bp, Mus musculus
caaagacaaggtcaaacatgtctgt

SEQ ID NO: 886486 - DNA, 25 bp, Mus musculus
caaagacaaggtgagggtggtgagc

SEQ ID NO: 886487 - DNA, 25 bp, Mus musculus
caaagacagattttcatgaatataa

SEQ ID NO: 886488 - DNA, 25 bp, Mus musculus
caaagacagattttgatgaatataa

SEQ ID NO: 886489 - DNA, 25 bp, Mus musculus
caaagacagcagaaaactttcgagc

SEQ ID NO: 886490 - DNA, 25 bp, Mus musculus
caaagacagcagtaaactttcgagc

SEQ ID NO: 886491 - DNA, 25 bp, Mus musculus
caaagaccagatcgccaaggatgtg

SEQ ID NO: 886492 - DNA, 25 bp, Mus musculus
caaagaccagttcgccaaggatgtg

SEQ ID NO: 886493 - DNA, 25 bp, Mus musculus
caaagaccccaacaggaggatgacc

SEQ ID NO: 886494 - DNA, 25 bp, Mus musculus
caaagaccccaagaggaggatgacc

SEQ ID NO: 886495 - DNA, 25 bp, Mus musculus
caaagaccctatcgtcaacgtgtgg

SEQ ID NO: 886496 - DNA, 25 bp, Mus musculus
caaagaccctcacacatgtcttcca

SEQ ID NO: 886497 - DNA, 25 bp, Mus musculus
caaagaccctcacagatgtcttcca

SEQ ID NO: 886498 - DNA, 25 bp, Mus musculus
caaagaccctttcgtcaacgtgtgg

SEQ ID NO: 886499 - DNA, 25 bp, Mus musculus
caaagacgaggagtcgttccgatct

SEQ ID NO: 886500 - DNA, 25 bp, Mus musculus
caaagacgaggagtggttccgatct

SEQ ID NO: 886501 - DNA, 25 bp, Mus musculus
caaagacggaagcactggaaatggc

SEQ ID NO: 886502 - DNA, 25 bp, Mus musculus
caaagacggaaggactggaaatggc

SEQ ID NO: 886503 - DNA, 25 bp, Mus musculus
caaagactgcagagaacttcagagc

SEQ ID NO: 886504 - DNA, 25 bp, Mus musculus
caaagactgcagtgaacttcagagc

SEQ ID NO: 886505 - DNA, 25 bp, Mus musculus
caaagagaagaagaattaactctgc

SEQ ID NO: 886506 - DNA, 25 bp, Mus musculus
caaagagaagaagaatttgggcttc

SEQ ID NO: 886507 - DNA, 25 bp, Mus musculus
caaagagaagaagatttaactctgc

SEQ ID NO: 886508 - DNA, 25 bp, Mus musculus
caaagagaagaagattttgggcttc

SEQ ID NO: 886509 - DNA, 25 bp, Mus musculus
caaagagaagcaaaagtgatagtgg

SEQ ID NO: 886510 - DNA, 25 bp, Mus musculus
caaagagaagcaagctatagtgaca

SEQ ID NO: 886511 - DNA, 25 bp, Mus musculus
caaagagaaggaaaagtgatagtgg

SEQ ID NO: 886512 - DNA, 25 bp, Mus musculus
caaagagaaggaagctatagtgaca

SEQ ID NO: 886513 - DNA, 25 bp, Mus musculus
caaagagatataccattggccggac

SEQ ID NO: 886514 - DNA, 25 bp, Mus musculus
caaagagatatagcattggccggac

SEQ ID NO: 886515 - DNA, 25 bp, Mus musculus
caaagagatggactcatgcacttct

SEQ ID NO: 886516 - DNA, 25 bp, Mus musculus
caaagagatggagtcatgcacttct

SEQ ID NO: 886517 - DNA, 25 bp, Mus musculus
caaagagattaccccagaagacttg

SEQ ID NO: 886518 - DNA, 25 bp, Mus musculus
caaagagattacgccagaagacttg

SEQ ID NO: 886519 - DNA, 25 bp, Mus musculus
caaagagcacttttcagcacaagtg

SEQ ID NO: 886520 - DNA, 25 bp, Mus musculus
caaagagcacttttcgactacattg

SEQ ID NO: 886521 - DNA, 25 bp, Mus musculus
caaagagcacttttgagcacaagtg

SEQ ID NO: 886522 - DNA, 25 bp, Mus musculus
caaagagcacttttggactacattg

SEQ ID NO: 886523 - DNA, 25 bp, Mus musculus
caaagagcttctttcgtccgcagaa

SEQ ID NO: 886524 - DNA, 25 bp, Mus musculus
caaagagcttctttggtccgcagaa

SEQ ID NO: 886525 - DNA, 25 bp, Mus musculus
caaagaggagattttcggaccagtg

SEQ ID NO: 886526 - DNA, 25 bp, Mus musculus
caaagaggagtttttcggaccagtg

SEQ ID NO: 886527 - DNA, 25 bp, Mus musculus
caaagaggccaatatgcgatctctt

SEQ ID NO: 886528 - DNA, 25 bp, Mus musculus
caaagaggcctatatgcgatctctt

SEQ ID NO: 886529 - DNA, 25 bp, Mus musculus
caaagagtttgtctcgggcctcaac

SEQ ID NO: 886530 - DNA, 25 bp, Mus musculus
caaagagtttgtctggggcctcaac

SEQ ID NO: 886531 - DNA, 25 bp, Mus musculus
caaagatcaaatatcatgtagaaga

SEQ ID NO: 886532 - DNA, 25 bp, Mus musculus
caaagatcaattatcatgtagaaga

SEQ ID NO: 886533 - DNA, 25 bp, Mus musculus
caaagatcttctgactgaagatggg

SEQ ID NO: 886534 - DNA, 25 bp, Mus musculus
caaagatcttgtgactgaagatggg

SEQ ID NO: 886535 - DNA, 25 bp, Mus musculus
caaagatgccagcggatctgagtgt

SEQ ID NO: 886536 - DNA, 25 bp, Mus musculus
caaagatgccaggggatctgagtgt

SEQ ID NO: 886537 - DNA, 25 bp, Mus musculus
caaagatgtacacctgggtccttgg

SEQ ID NO: 886538 - DNA, 25 bp, Mus musculus
caaagatgtacacgggtggcaaaat

SEQ ID NO: 886539 - DNA, 25 bp, Mus musculus
caaagatgtacagctgggtccttgg

SEQ ID NO: 886540 - DNA, 25 bp, Mus musculus
caaagatgtacaggggtggcaaaat

SEQ ID NO: 886541 - DNA, 25 bp, Mus musculus
caaagattccttctggccgtataaa

SEQ ID NO: 886542 - DNA, 25 bp, Mus musculus
caaagattccttgtggccgtataaa

SEQ ID NO: 886543 - DNA, 25 bp, Mus musculus
caaagattgcacttccgcgctggcc

SEQ ID NO: 886544 - DNA, 25 bp, Mus musculus
caaagattgcacttgcgcgctggcc

SEQ ID NO: 886545 - DNA, 25 bp, Mus musculus
caaagattggaacaatcaagatcat

SEQ ID NO: 886546 - DNA, 25 bp, Mus musculus
caaagattggaagaatcaagatcat

SEQ ID NO: 886547 - DNA, 25 bp, Mus musculus
caaagatttgaacgtgggctctgtg

SEQ ID NO: 886548 - DNA, 25 bp, Mus musculus
caaagatttgaaggtgggctctgtg

SEQ ID NO: 886549 - DNA, 25 bp, Mus musculus
caaagattttaaacgcactcctgga

SEQ ID NO: 886550 - DNA, 25 bp, Mus musculus
caaagattttaatcgcactcctgga

SEQ ID NO: 886551 - DNA, 25 bp, Mus musculus
caaagcaaaaatgaggagtgggaag

SEQ ID NO: 886552 - DNA, 25 bp, Mus musculus
caaagcaaaattgaggagtgggaag

SEQ ID NO: 886553 - DNA, 25 bp, Mus musculus
caaagcaaagaacttctacctctgt

SEQ ID NO: 886554 - DNA, 25 bp, Mus musculus
caaagcaaagaagttctacctctgt

SEQ ID NO: 886555 - DNA, 25 bp, Mus musculus
caaagcaatccaaggatcttatttg

SEQ ID NO: 886556 - DNA, 25 bp, Mus musculus
caaagcaatccatggatcttatttg

SEQ ID NO: 886557 - DNA, 25 bp, Mus musculus
caaagcacagataaaatctgtggtt

SEQ ID NO: 886558 - DNA, 25 bp, Mus musculus
caaagcacagttaaaatctgtggtt

SEQ ID NO: 886559 - DNA, 25 bp, Mus musculus
caaagcacggggtactgatccattg

SEQ ID NO: 886560 - DNA, 25 bp, Mus musculus
caaagcacggggtagtgatccattg

SEQ ID NO: 886561 - DNA, 25 bp, Mus musculus
caaagcagagaatgaggaacaatat

SEQ ID NO: 886562 - DNA, 25 bp, Mus musculus
caaagcagagtatgaggaacaatat

SEQ ID NO: 886563 - DNA, 25 bp, Mus musculus
caaagcagctggagtttttggcttt

SEQ ID NO: 886564 - DNA, 25 bp, Mus musculus
caaagcagctggtgtttttggcttt

SEQ ID NO: 886565 - DNA, 25 bp, Mus musculus
caaagcatcatacacaccagaggga

SEQ ID NO: 886566 - DNA, 25 bp, Mus musculus
caaagcatcatacagaccagaggga

SEQ ID NO: 886567 - DNA, 25 bp, Mus musculus
caaagcatggagggtgatgaggaag

SEQ ID NO: 886568 - DNA, 25 bp, Mus musculus
caaagcatggtgggtgatgaggaag

SEQ ID NO: 886569 - DNA, 25 bp, Mus musculus
caaagcattctcaacgagatttctc

SEQ ID NO: 886570 - DNA, 25 bp, Mus musculus
caaagcattctcaaggagatttctc

SEQ ID NO: 886571 - DNA, 25 bp, Mus musculus
caaagccagaataatcaaattcgga

SEQ ID NO: 886572 - DNA, 25 bp, Mus musculus
caaagccagattaatcaaattcgga

SEQ ID NO: 886573 - DNA, 25 bp, Mus musculus
caaagccatgctttgactctgctga

SEQ ID NO: 886574 - DNA, 25 bp, Mus musculus
caaagccatggtttgactctgctga

SEQ ID NO: 886575 - DNA, 25 bp, Mus musculus
caaagccctgcatttcatcaagatg

SEQ ID NO: 886576 - DNA, 25 bp, Mus musculus
caaagccctggatttcatcaagatg

SEQ ID NO: 886577 - DNA, 25 bp, Mus musculus
caaagccggcactccggctcctccc

SEQ ID NO: 886578 - DNA, 25 bp, Mus musculus
caaagccggcactcgggctcctccc

SEQ ID NO: 886579 - DNA, 25 bp, Mus musculus
caaagccgtgcagaccaagccatac

SEQ ID NO: 886580 - DNA, 25 bp, Mus musculus
caaagccgtgcagaccatctactgc

SEQ ID NO: 886581 - DNA, 25 bp, Mus musculus
caaagccgtgcagagcaagccatac

SEQ ID NO: 886582 - DNA, 25 bp, Mus musculus
caaagccgtgcagagcatctactgc

SEQ ID NO: 886583 - DNA, 25 bp, Mus musculus
caaagcctataacgagcctctaaag

SEQ ID NO: 886584 - DNA, 25 bp, Mus musculus
caaagcctataaggagcctctaaag

SEQ ID NO: 886585 - DNA, 25 bp, Mus musculus
caaagcgacacgcatctggaggacc

SEQ ID NO: 886586 - DNA, 25 bp, Mus musculus
caaagcgacaggcatctggaggacc

SEQ ID NO: 886587 - DNA, 25 bp, Mus musculus
caaagcgtggttcatctggtggctc

SEQ ID NO: 886588 - DNA, 25 bp, Mus musculus
caaagcgtggttgatctggtggctc

SEQ ID NO: 886589 - DNA, 25 bp, Mus musculus
caaagctaatgtcccgtttgttgct

SEQ ID NO: 886590 - DNA, 25 bp, Mus musculus
caaagctaatgtccggtttgttgct

SEQ ID NO: 886591 - DNA, 25 bp, Mus musculus
caaagctccacacgggatctttcca

SEQ ID NO: 886592 - DNA, 25 bp, Mus musculus
caaagctccacaggggatctttcca

SEQ ID NO: 886593 - DNA, 25 bp, Mus musculus
caaagctctgatcctgggcatctac

SEQ ID NO: 886594 - DNA, 25 bp, Mus musculus
caaagctctggacgaccttggaaga

SEQ ID NO: 886595 - DNA, 25 bp, Mus musculus
caaagctctggaggaccttggaaga

SEQ ID NO: 886596 - DNA, 25 bp, Mus musculus
caaagctctgttcctgggcatctac

SEQ ID NO: 886597 - DNA, 25 bp, Mus musculus
caaagctgaaagatattcggcagag

SEQ ID NO: 886598 - DNA, 25 bp, Mus musculus
caaagctgaaagttattcggcagag

SEQ ID NO: 886599 - DNA, 25 bp, Mus musculus
caaagctgagaaggaagaagagaac

SEQ ID NO: 886600 - DNA, 25 bp, Mus musculus
caaagctgagtaggaagaagagaac

SEQ ID NO: 886601 - DNA, 25 bp, Mus musculus
caaagctgcgagtgacagactggct

SEQ ID NO: 886602 - DNA, 25 bp, Mus musculus
caaagctgcgtgtgacagactggct

SEQ ID NO: 886603 - DNA, 25 bp, Mus musculus
caaagctggcaacgtacggactcga

SEQ ID NO: 886604 - DNA, 25 bp, Mus musculus
caaagctggcaacgttcgaacctca

SEQ ID NO: 886605 - DNA, 25 bp, Mus musculus
caaagctggcaaggtacggactcga

SEQ ID NO: 886606 - DNA, 25 bp, Mus musculus
caaagctggcaaggttcgaacctca

SEQ ID NO: 886607 - DNA, 25 bp, Mus musculus
caaagctgggagttcgccaagaagg

SEQ ID NO: 886608 - DNA, 25 bp, Mus musculus
caaagctgggagttggccaagaagg

SEQ ID NO: 886609 - DNA, 25 bp, Mus musculus
caaagcttctctggttctctgccat

SEQ ID NO: 886610 - DNA, 25 bp, Mus musculus
caaagcttctgtggttctctgccat

SEQ ID NO: 886611 - DNA, 25 bp, Mus musculus
caaagcttgagaaaaaccatggtga

SEQ ID NO: 886612 - DNA, 25 bp, Mus musculus
caaagcttgagaaataccatggtga

SEQ ID NO: 886613 - DNA, 25 bp, Mus musculus
caaagctttggacggctccactcta

SEQ ID NO: 886614 - DNA, 25 bp, Mus musculus
caaagctttggagggctccactcta

SEQ ID NO: 886615 - DNA, 25 bp, Mus musculus
caaaggaaatgacacaggatatcga

SEQ ID NO: 886616 - DNA, 25 bp, Mus musculus
caaaggaaatgagacaggatatcga

SEQ ID NO: 886617 - DNA, 25 bp, Mus musculus
caaaggacaactatttgtgctttca

SEQ ID NO: 886618 - DNA, 25 bp, Mus musculus
caaaggacaagtatttgtgctttca

SEQ ID NO: 886619 - DNA, 25 bp, Mus musculus
caaaggacagaataatcctcaggtc

SEQ ID NO: 886620 - DNA, 25 bp, Mus musculus
caaaggacagctggctgtataggat

SEQ ID NO: 886621 - DNA, 25 bp, Mus musculus
caaaggacaggtggctgtataggat

SEQ ID NO: 886622 - DNA, 25 bp, Mus musculus
caaaggacagtataatcctcaggtc

SEQ ID NO: 886623 - DNA, 25 bp, Mus musculus
caaaggactgaacggagtggaaaat

SEQ ID NO: 886624 - DNA, 25 bp, Mus musculus
caaaggactgaagggagtggaaaat

SEQ ID NO: 886625 - DNA, 25 bp, Mus musculus
caaaggactgtgctcaatgtgcgga

SEQ ID NO: 886626 - DNA, 25 bp, Mus musculus
caaaggactgtggtcaatgtgcgga

SEQ ID NO: 886627 - DNA, 25 bp, Mus musculus
caaaggagagcacggcgcacctgga

SEQ ID NO: 886628 - DNA, 25 bp, Mus musculus
caaaggagagcagggcgcacctgga

SEQ ID NO: 886629 - DNA, 25 bp, Mus musculus
caaaggaggcagctgcgattggagc

SEQ ID NO: 886630 - DNA, 25 bp, Mus musculus
caaaggaggcaggtgcgattggagc

SEQ ID NO: 886631 - DNA, 25 bp, Mus musculus
caaaggatatgatgcttgagatgga

SEQ ID NO: 886632 - DNA, 25 bp, Mus musculus
caaaggatatgatggttgagatgga

SEQ ID NO: 886633 - DNA, 25 bp, Mus musculus
caaaggatctagatgagaatgaagt

SEQ ID NO: 886634 - DNA, 25 bp, Mus musculus
caaaggatctagttgagaatgaagt

SEQ ID NO: 886635 - DNA, 25 bp, Mus musculus
caaaggattgcaacttctggagact

SEQ ID NO: 886636 - DNA, 25 bp, Mus musculus
caaaggattggaacttctggagact

SEQ ID NO: 886637 - DNA, 25 bp, Mus musculus
caaaggcaaaagcacgtacctgttt

SEQ ID NO: 886638 - DNA, 25 bp, Mus musculus
caaaggcaaaagcaggtacctgttt

SEQ ID NO: 886639 - DNA, 25 bp, Mus musculus
caaaggcaaacttggttctacggat

SEQ ID NO: 886640 - DNA, 25 bp, Mus musculus
caaaggcaaagttggttctacggat

SEQ ID NO: 886641 - DNA, 25 bp, Mus musculus
caaaggcagcaccttcctgcctctg

SEQ ID NO: 886642 - DNA, 25 bp, Mus musculus
caaaggcagctccttcctgcctctg

SEQ ID NO: 886643 - DNA, 25 bp, Mus musculus
caaaggccctggcgaatgtatcatt

SEQ ID NO: 886644 - DNA, 25 bp, Mus musculus
caaaggccctggggaatgtatcatt

SEQ ID NO: 886645 - DNA, 25 bp, Mus musculus
caaaggctttaacctctggtgcaag

SEQ ID NO: 886646 - DNA, 25 bp, Mus musculus
caaaggctttaagctctggtgcaag

SEQ ID NO: 886647 - DNA, 25 bp, Mus musculus
caaaggcttttgcggcaggggctga

SEQ ID NO: 886648 - DNA, 25 bp, Mus musculus
caaaggcttttgcggctgactttgt

SEQ ID NO: 886649 - DNA, 25 bp, Mus musculus
caaaggcttttggggcaggggctga

SEQ ID NO: 886650 - DNA, 25 bp, Mus musculus
caaaggcttttggggctgactttgt

SEQ ID NO: 886651 - DNA, 25 bp, Mus musculus
caaaggtcttaacggtgagccaggc

SEQ ID NO: 886652 - DNA, 25 bp, Mus musculus
caaaggtcttaagggtgagccaggc

SEQ ID NO: 886653 - DNA, 25 bp, Mus musculus
caaagtaagccacaatggctacaag

SEQ ID NO: 886654 - DNA, 25 bp, Mus musculus
caaagtaagccagaatggctacaag

SEQ ID NO: 886655 - DNA, 25 bp, Mus musculus
caaagtaattcacgctcaaactgct

SEQ ID NO: 886656 - DNA, 25 bp, Mus musculus
caaagtaattcaggctcaaactgct

SEQ ID NO: 886657 - DNA, 25 bp, Mus musculus
caaagtattccacgctctgtgcaag

SEQ ID NO: 886658 - DNA, 25 bp, Mus musculus
caaagtattccaggctctgtgcaag

SEQ ID NO: 886659 - DNA, 25 bp, Mus musculus
caaagtcaagagtatcccatatgca

SEQ ID NO: 886660 - DNA, 25 bp, Mus musculus
caaagtcaagtgtatcccatatgca

SEQ ID NO: 886661 - DNA, 25 bp, Mus musculus
caaagtcattcccacacccccggct

SEQ ID NO: 886662 - DNA, 25 bp, Mus musculus
caaagtcattccgacacccccggct

SEQ ID NO: 886663 - DNA, 25 bp, Mus musculus
caaagtcattcttgatattccagaa

SEQ ID NO: 886664 - DNA, 25 bp, Mus musculus
caaagtcattgttgatattccagaa

SEQ ID NO: 886665 - DNA, 25 bp, Mus musculus
caaagtccatggagaatggaggatc

SEQ ID NO: 886666 - DNA, 25 bp, Mus musculus
caaagtccatggtgaatggaggatc

SEQ ID NO: 886667 - DNA, 25 bp, Mus musculus
caaagtccctcacacacctgcacgt

SEQ ID NO: 886668 - DNA, 25 bp, Mus musculus
caaagtccctcacagacctgcacgt

SEQ ID NO: 886669 - DNA, 25 bp, Mus musculus
caaagtctatctatcaacagagaaa

SEQ ID NO: 886670 - DNA, 25 bp, Mus musculus
caaagtctatctatgaacagagaaa

SEQ ID NO: 886671 - DNA, 25 bp, Mus musculus
caaagtctctctcacagaaacggga

SEQ ID NO: 886672 - DNA, 25 bp, Mus musculus
caaagtctctctcagagaaacggga

SEQ ID NO: 886673 - DNA, 25 bp, Mus musculus
caaagtgaagagctcaggagctgtc

SEQ ID NO: 886674 - DNA, 25 bp, Mus musculus
caaagtgaagtgctcaggagctgtc

SEQ ID NO: 886675 - DNA, 25 bp, Mus musculus
caaagtgagaccacgtatagctggc

SEQ ID NO: 886676 - DNA, 25 bp, Mus musculus
caaagtgagacctcgtatagctggc

SEQ ID NO: 886677 - DNA, 25 bp, Mus musculus
caaagtgatggccgcaatccagatc

SEQ ID NO: 886678 - DNA, 25 bp, Mus musculus
caaagtgatggcggcaatccagatc

SEQ ID NO: 886679 - DNA, 25 bp, Mus musculus
caaagtgcgatgcgctgttcctggg

SEQ ID NO: 886680 - DNA, 25 bp, Mus musculus
caaagtgcgatgcgtcgtcccccag

SEQ ID NO: 886681 - DNA, 25 bp, Mus musculus
caaagtgcgatgggctgttcctggg

SEQ ID NO: 886682 - DNA, 25 bp, Mus musculus
caaagtgcgatgggtcgtcccccag

SEQ ID NO: 886683 - DNA, 25 bp, Mus musculus
caaagtgcgcgacacgctgtttggt

SEQ ID NO: 886684 - DNA, 25 bp, Mus musculus
caaagtgcgcgacacgttctggatg

SEQ ID NO: 886685 - DNA, 25 bp, Mus musculus
caaagtgcgcgacaggctgtttggt

SEQ ID NO: 886686 - DNA, 25 bp, Mus musculus
caaagtgcgcgacaggttctggatg

SEQ ID NO: 886687 - DNA, 25 bp, Mus musculus
caaagtgtccgtcgatgaccatgta

SEQ ID NO: 886688 - DNA, 25 bp, Mus musculus
caaagtgtccgtcgtgaaccccaca

SEQ ID NO: 886689 - DNA, 25 bp, Mus musculus
caaagtgtccgtggatgaccatgta

SEQ ID NO: 886690 - DNA, 25 bp, Mus musculus
caaagtgtccgtggtgaaccccaca

SEQ ID NO: 886691 - DNA, 25 bp, Mus musculus
caaagtgttggacacattgtaggtg

SEQ ID NO: 886692 - DNA, 25 bp, Mus musculus
caaagtgttggacagattgtaggtg

SEQ ID NO: 886693 - DNA, 25 bp, Mus musculus
caaagtttccacagagcgtgtacca

SEQ ID NO: 886694 - DNA, 25 bp, Mus musculus
caaagtttccacagtgcgtgtacca

SEQ ID NO: 886695 - DNA, 25 bp, Mus musculus
caaagtttgaaaagctagctgccac

SEQ ID NO: 886696 - DNA, 25 bp, Mus musculus
caaagtttgaaatgctagctgccac

SEQ ID NO: 886697 - DNA, 25 bp, Mus musculus
caaatacaatatcccatatatagag

SEQ ID NO: 886698 - DNA, 25 bp, Mus musculus
caaatacaatttcccatatatagag

SEQ ID NO: 886699 - DNA, 25 bp, Mus musculus
caaatacattcacgaagccgaaatg

SEQ ID NO: 886700 - DNA, 25 bp, Mus musculus
caaatacattcaggaagccgaaatg

SEQ ID NO: 886701 - DNA, 25 bp, Mus musculus
caaataccagatattgaaagatgca

SEQ ID NO: 886702 - DNA, 25 bp, Mus musculus
caaataccagttattgaaagatgca

SEQ ID NO: 886703 - DNA, 25 bp, Mus musculus
caaatacgagaccaacctgactttc

SEQ ID NO: 886704 - DNA, 25 bp, Mus musculus
caaatacgagtccaacctgactttc

SEQ ID NO: 886705 - DNA, 25 bp, Mus musculus
caaatagtacagccagtgggaactc

SEQ ID NO: 886706 - DNA, 25 bp, Mus musculus
caaatagtacaggcagtgggaactc

SEQ ID NO: 886707 - DNA, 25 bp, Mus musculus
caaatataaaagctgacaggagaca

SEQ ID NO: 886708 - DNA, 25 bp, Mus musculus
caaatataaaaggtgacaggagaca

SEQ ID NO: 886709 - DNA, 25 bp, Mus musculus
caaatatacaagcctcaaactcaga

SEQ ID NO: 886710 - DNA, 25 bp, Mus musculus
caaatatacaaggctcaaactcaga

SEQ ID NO: 886711 - DNA, 25 bp, Mus musculus
caaatattctcccacagatcttcaa

SEQ ID NO: 886712 - DNA, 25 bp, Mus musculus
caaatattctcccagagatcttcaa

SEQ ID NO: 886713 - DNA, 25 bp, Mus musculus
caaatcaaagcgacaggcatctgga

SEQ ID NO: 886714 - DNA, 25 bp, Mus musculus
caaatcaaagcgactggcatctgga

SEQ ID NO: 886715 - DNA, 25 bp, Mus musculus
caaatcacatgaaggagcctcaagg

SEQ ID NO: 886716 - DNA, 25 bp, Mus musculus
caaatcacatgatggagcctcaagg

SEQ ID NO: 886717 - DNA, 25 bp, Mus musculus
caaatcccaacttccgtgaggagga

SEQ ID NO: 886718 - DNA, 25 bp, Mus musculus
caaatcccaagttccgtgaggagga

SEQ ID NO: 886719 - DNA, 25 bp, Mus musculus
caaatccttcctcaaacttcatggc

SEQ ID NO: 886720 - DNA, 25 bp, Mus musculus
caaatccttcctgaaacttcatggc

SEQ ID NO: 886721 - DNA, 25 bp, Mus musculus
caaatccttgctcgtctgtgcgtga

SEQ ID NO: 886722 - DNA, 25 bp, Mus musculus
caaatccttgctggtctgtgcgtga

SEQ ID NO: 886723 - DNA, 25 bp, Mus musculus
caaatctaagcagttgccgttatac

SEQ ID NO: 886724 - DNA, 25 bp, Mus musculus
caaatctaaggagttgccgttatac

SEQ ID NO: 886725 - DNA, 25 bp, Mus musculus
caaatctgaactcgagaaggaacct

SEQ ID NO: 886726 - DNA, 25 bp, Mus musculus
caaatctgaactggagaaggaacct

SEQ ID NO: 886727 - DNA, 25 bp, Mus musculus
caaatgaaagcttctggagaagcat

SEQ ID NO: 886728 - DNA, 25 bp, Mus musculus
caaatgaaaggttctggagaagcat

SEQ ID NO: 886729 - DNA, 25 bp, Mus musculus
caaatgacagcggcatcgatgtggt

SEQ ID NO: 886730 - DNA, 25 bp, Mus musculus
caaatgacagctatggccctgtcag

SEQ ID NO: 886731 - DNA, 25 bp, Mus musculus
caaatgacaggggcatcgatgtggt

SEQ ID NO: 886732 - DNA, 25 bp, Mus musculus
caaatgacaggtatggccctgtcag

SEQ ID NO: 886733 - DNA, 25 bp, Mus musculus
caaatgatccagacatgcggtggaa

SEQ ID NO: 886734 - DNA, 25 bp, Mus musculus
caaatgatcctgacatgcggtggaa

SEQ ID NO: 886735 - DNA, 25 bp, Mus musculus
caaatgatggagagtgtgtccctgg

SEQ ID NO: 886736 - DNA, 25 bp, Mus musculus
caaatgatggagtgtgtgtccctgg

SEQ ID NO: 886737 - DNA, 25 bp, Mus musculus
caaatgcatcaacgctgccatcagc

SEQ ID NO: 886738 - DNA, 25 bp, Mus musculus
caaatgcatcaaggctgccatcagc

SEQ ID NO: 886739 - DNA, 25 bp, Mus musculus
caaatgctacaaacagacagacaag

SEQ ID NO: 886740 - DNA, 25 bp, Mus musculus
caaatgctacaaactgacagacaag

SEQ ID NO: 886741 - DNA, 25 bp, Mus musculus
caaatgctgaatcgtattttgacag

SEQ ID NO: 886742 - DNA, 25 bp, Mus musculus
caaatgctgaatggtattttgacag

SEQ ID NO: 886743 - DNA, 25 bp, Mus musculus
caaatggaagcaaacttcatggctc

SEQ ID NO: 886744 - DNA, 25 bp, Mus musculus
caaatggaaggaaacttcatggctc

SEQ ID NO: 886745 - DNA, 25 bp, Mus musculus
caaatggcaaataccttacccgtct

SEQ ID NO: 886746 - DNA, 25 bp, Mus musculus
caaatggcaaatacgttacccgtct

SEQ ID NO: 886747 - DNA, 25 bp, Mus musculus
caaatggcagaatatatgttttgta

SEQ ID NO: 886748 - DNA, 25 bp, Mus musculus
caaatggcagaggtcacttttgtcc

SEQ ID NO: 886749 - DNA, 25 bp, Mus musculus
caaatggcagccgaacccatctcgg

SEQ ID NO: 886750 - DNA, 25 bp, Mus musculus
caaatggcaggcgaacccatctcgg

SEQ ID NO: 886751 - DNA, 25 bp, Mus musculus
caaatggcagtatatatgttttgta

SEQ ID NO: 886752 - DNA, 25 bp, Mus musculus
caaatggcagtggtcacttttgtcc

SEQ ID NO: 886753 - DNA, 25 bp, Mus musculus
caaatggccatgataacagctatct

SEQ ID NO: 886754 - DNA, 25 bp, Mus musculus
caaatggccatgttaacagctatct

SEQ ID NO: 886755 - DNA, 25 bp, Mus musculus
caaatgtcagaaagagtctactgta

SEQ ID NO: 886756 - DNA, 25 bp, Mus musculus
caaatgtcagaaagtgtctactgta

SEQ ID NO: 886757 - DNA, 25 bp, Mus musculus
caaatgtgaaagcctaccttggacc

SEQ ID NO: 886758 - DNA, 25 bp, Mus musculus
caaatgtgaaagcctggcacagaag

SEQ ID NO: 886759 - DNA, 25 bp, Mus musculus
caaatgtgaaaggctaccttggacc

SEQ ID NO: 886760 - DNA, 25 bp, Mus musculus
caaatgtgaaaggctggcacagaag

SEQ ID NO: 886761 - DNA, 25 bp, Mus musculus
caaatgttggctgaacggctgtttc

SEQ ID NO: 886762 - DNA, 25 bp, Mus musculus
caaatgttgggccaagatctgcaag

SEQ ID NO: 886763 - DNA, 25 bp, Mus musculus
caaatgttgggccattgtgtttaag

SEQ ID NO: 886764 - DNA, 25 bp, Mus musculus
caaatgttgggcctaggattgtgtt

SEQ ID NO: 886765 - DNA, 25 bp, Mus musculus
caaatgttgggcctgtgcatgtagc

SEQ ID NO: 886766 - DNA, 25 bp, Mus musculus
caaatgttgggcgaagatctgcaag

SEQ ID NO: 886767 - DNA, 25 bp, Mus musculus
caaatgttgggcgattgtgtttaag

SEQ ID NO: 886768 - DNA, 25 bp, Mus musculus
caaatgttgggcgtaggattgtgtt

SEQ ID NO: 886769 - DNA, 25 bp, Mus musculus
caaatgttgggcgtgtgcatgtagc

SEQ ID NO: 886770 - DNA, 25 bp, Mus musculus
caaatgttgggtgaacggctgtttc

SEQ ID NO: 886771 - DNA, 25 bp, Mus musculus
caaattcaaccacgaggtacagaag

SEQ ID NO: 886772 - DNA, 25 bp, Mus musculus
caaattcaaccaggaggtacagaag

SEQ ID NO: 886773 - DNA, 25 bp, Mus musculus
caaattcacattcacgcacaccaag

SEQ ID NO: 886774 - DNA, 25 bp, Mus musculus
caaattcacattcaggcacaccaag

SEQ ID NO: 886775 - DNA, 25 bp, Mus musculus
caaattctcattagacgtctgtgaa

SEQ ID NO: 886776 - DNA, 25 bp, Mus musculus
caaattctcatttgacgtctgtgaa

SEQ ID NO: 886777 - DNA, 25 bp, Mus musculus
caaattgcttcagcaaaaccaaatg

SEQ ID NO: 886778 - DNA, 25 bp, Mus musculus
caaattgcttcagctaaaccaaatg

SEQ ID NO: 886779 - DNA, 25 bp, Mus musculus
caaattggaccacgtctctcagttt

SEQ ID NO: 886780 - DNA, 25 bp, Mus musculus
caaattggaccaggtctctcagttt

SEQ ID NO: 886781 - DNA, 25 bp, Mus musculus
caaattggatcatatccatccgttt

SEQ ID NO: 886782 - DNA, 25 bp, Mus musculus
caaattggatgatatccatccgttt

SEQ ID NO: 886783 - DNA, 25 bp, Mus musculus
caaattgtcaggcacatgaaggatc

SEQ ID NO: 886784 - DNA, 25 bp, Mus musculus
caaattgtcagggacatgaaggatc

SEQ ID NO: 886785 - DNA, 25 bp, Mus musculus
caaatttcgccacatagtgtctgct

SEQ ID NO: 886786 - DNA, 25 bp, Mus musculus
caaatttcgccagatagtgtctgct

SEQ ID NO: 886787 - DNA, 25 bp, Mus musculus
caaatttgccagcaatgtagtagaa

SEQ ID NO: 886788 - DNA, 25 bp, Mus musculus
caaatttgccaggaatgtagtagaa

SEQ ID NO: 886789 - DNA, 25 bp, Mus musculus
caacaaacaactttgcacggatatt

SEQ ID NO: 886790 - DNA, 25 bp, Mus musculus
caacaaacaagtttgcacggatatt

SEQ ID NO: 886791 - DNA, 25 bp, Mus musculus
caacaaacagctgtgcaaaccgcga

SEQ ID NO: 886792 - DNA, 25 bp, Mus musculus
caacaaacaggtgtgcaaaccgcga

SEQ ID NO: 886793 - DNA, 25 bp, Mus musculus
caacaaagtgcgatccgctgttcct

SEQ ID NO: 886794 - DNA, 25 bp, Mus musculus
caacaaagtgcgatccgtcgtcccc

SEQ ID NO: 886795 - DNA, 25 bp, Mus musculus
caacaaagtgcgatgcgctgttcct

SEQ ID NO: 886796 - DNA, 25 bp, Mus musculus
caacaaagtgcgatgcgtcgtcccc

SEQ ID NO: 886797 - DNA, 25 bp, Mus musculus
caacaaataccacatattgaaagat

SEQ ID NO: 886798 - DNA, 25 bp, Mus musculus
caacaaataccagatattgaaagat

SEQ ID NO: 886799 - DNA, 25 bp, Mus musculus
caacaaatggcatgcagaaaatgcc

SEQ ID NO: 886800 - DNA, 25 bp, Mus musculus
caacaaatgggatgcagaaaatgcc

SEQ ID NO: 886801 - DNA, 25 bp, Mus musculus
caacaacaatgacagtgctgcaaag

SEQ ID NO: 886802 - DNA, 25 bp, Mus musculus
caacaacaatgagagtgctgcaaag

SEQ ID NO: 886803 - DNA, 25 bp, Mus musculus
caacaacaggattcgtgagatgacc

SEQ ID NO: 886804 - DNA, 25 bp, Mus musculus
caacaacaggtttcgtgagatgacc

SEQ ID NO: 886805 - DNA, 25 bp, Mus musculus
caacaacataagctgcttcaagaag

SEQ ID NO: 886806 - DNA, 25 bp, Mus musculus
caacaacataaggtgcttcaagaag

SEQ ID NO: 886807 - DNA, 25 bp, Mus musculus
caacaacccgccttttgtcatacat

SEQ ID NO: 886808 - DNA, 25 bp, Mus musculus
caacaacccggcttttgtcatacat

SEQ ID NO: 886809 - DNA, 25 bp, Mus musculus
caacaacctagcaacattatccagc

SEQ ID NO: 886810 - DNA, 25 bp, Mus musculus
caacaacctagcaagattatccagc

SEQ ID NO: 886811 - DNA, 25 bp, Mus musculus
caacaactcataccaccgaccatca

SEQ ID NO: 886812 - DNA, 25 bp, Mus musculus
caacaactcatagcaccgaccatca

SEQ ID NO: 886813 - DNA, 25 bp, Mus musculus
caacaacttggagacattaatatta

SEQ ID NO: 886814 - DNA, 25 bp, Mus musculus
caacaacttggagagattaatatta

SEQ ID NO: 886815 - DNA, 25 bp, Mus musculus
caacaagaagcaccccagcactggg

SEQ ID NO: 886816 - DNA, 25 bp, Mus musculus
caacaagaagctagaggcagtcatg

SEQ ID NO: 886817 - DNA, 25 bp, Mus musculus
caacaagaagctatatgtggctcag

SEQ ID NO: 886818 - DNA, 25 bp, Mus musculus
caacaagaaggaccccagcactggg

SEQ ID NO: 886819 - DNA, 25 bp, Mus musculus
caacaagaaggtagaggcagtcatg

SEQ ID NO: 886820 - DNA, 25 bp, Mus musculus
caacaagaaggtatatgtggctcag

SEQ ID NO: 886821 - DNA, 25 bp, Mus musculus
caacaagacacccacaatgggctac

SEQ ID NO: 886822 - DNA, 25 bp, Mus musculus
caacaagacacccagaatgggctac

SEQ ID NO: 886823 - DNA, 25 bp, Mus musculus
caacaagagatggaatacgaccata

SEQ ID NO: 886824 - DNA, 25 bp, Mus musculus
caacaagagatggattacgaccata

SEQ ID NO: 886825 - DNA, 25 bp, Mus musculus
caacaagcacaacttctgcctatct

SEQ ID NO: 886826 - DNA, 25 bp, Mus musculus
caacaagcacaagttctgcctatct

SEQ ID NO: 886827 - DNA, 25 bp, Mus musculus
caacaagcagcacctccccaatgcc

SEQ ID NO: 886828 - DNA, 25 bp, Mus musculus
caacaagcagccttttgatggcttc

SEQ ID NO: 886829 - DNA, 25 bp, Mus musculus
caacaagcaggacctccccaatgcc

SEQ ID NO: 886830 - DNA, 25 bp, Mus musculus
caacaagcaggcttttgatggcttc

SEQ ID NO: 886831 - DNA, 25 bp, Mus musculus
caacaaggaagacgttttgctgcct

SEQ ID NO: 886832 - DNA, 25 bp, Mus musculus
caacaaggaagaggttttgctgcct

SEQ ID NO: 886833 - DNA, 25 bp, Mus musculus
caacaaggagcacatacagaagatc

SEQ ID NO: 886834 - DNA, 25 bp, Mus musculus
caacaaggagcagatacagaagatc

SEQ ID NO: 886835 - DNA, 25 bp, Mus musculus
caacaaggaggacacctacaagccc

SEQ ID NO: 886836 - DNA, 25 bp, Mus musculus
caacaaggaggacagctacaagccc

SEQ ID NO: 886837 - DNA, 25 bp, Mus musculus
caacaaggctcgcgtgccagggcca

SEQ ID NO: 886838 - DNA, 25 bp, Mus musculus
caacaaggctcgggtgccagggcca

SEQ ID NO: 886839 - DNA, 25 bp, Mus musculus
caacaagttcgacgccttaaaagat

SEQ ID NO: 886840 - DNA, 25 bp, Mus musculus
caacaagttcgacggcttaaaagat

SEQ ID NO: 886841 - DNA, 25 bp, Mus musculus
caacaatagaaactggccattcctc

SEQ ID NO: 886842 - DNA, 25 bp, Mus musculus
caacaatagaaagtggccattcctc

SEQ ID NO: 886843 - DNA, 25 bp, Mus musculus
caacaatgaaaaacttcagaagcag

SEQ ID NO: 886844 - DNA, 25 bp, Mus musculus
caacaatgaaaatcttcagaagcag

SEQ ID NO: 886845 - DNA, 25 bp, Mus musculus
caacaatgagagtgctgcaaagatg

SEQ ID NO: 886846 - DNA, 25 bp, Mus musculus
caacaatgagtgtgctgcaaagatg

SEQ ID NO: 886847 - DNA, 25 bp, Mus musculus
caacaatgcaaactatgccatctct

SEQ ID NO: 886848 - DNA, 25 bp, Mus musculus
caacaatgcaaagtatgccatctct

SEQ ID NO: 886849 - DNA, 25 bp, Mus musculus
caacaatgcaggcgttgacaacttc

SEQ ID NO: 886850 - DNA, 25 bp, Mus musculus
caacaatgcaggggttgacaacttc

SEQ ID NO: 886851 - DNA, 25 bp, Mus musculus
caacaattccaaagattttggccag

SEQ ID NO: 886852 - DNA, 25 bp, Mus musculus
caacaattccaatgattttggccag

SEQ ID NO: 886853 - DNA, 25 bp, Mus musculus
caacacaaaaagcttcctagaggaa

SEQ ID NO: 886854 - DNA, 25 bp, Mus musculus
caacacaaaaaggttcctagaggaa

SEQ ID NO: 886855 - DNA, 25 bp, Mus musculus
caacacaaagcgcatttgcttcatc

SEQ ID NO: 886856 - DNA, 25 bp, Mus musculus
caacacaaagggcatttgcttcatc

SEQ ID NO: 886857 - DNA, 25 bp, Mus musculus
caacacaagtaactagcttcttact

SEQ ID NO: 886858 - DNA, 25 bp, Mus musculus
caacacaagtaagtagcttcttact

SEQ ID NO: 886859 - DNA, 25 bp, Mus musculus
caacacacaccgctcttggaaggag

SEQ ID NO: 886860 - DNA, 25 bp, Mus musculus
caacacacaccggtcttggaaggag

SEQ ID NO: 886861 - DNA, 25 bp, Mus musculus
caacacaccatcatcgcaggaaatg

SEQ ID NO: 886862 - DNA, 25 bp, Mus musculus
caacacaccatcatggcaggaaatg

SEQ ID NO: 886863 - DNA, 25 bp, Mus musculus
caacacagcgtgttcctaacacatc

SEQ ID NO: 886864 - DNA, 25 bp, Mus musculus
caacacagcgtgttgctaacacatc

SEQ ID NO: 886865 - DNA, 25 bp, Mus musculus
caacacagctaacctcttcgactcc

SEQ ID NO: 886866 - DNA, 25 bp, Mus musculus
caacacagctaagctcttcgactcc

SEQ ID NO: 886867 - DNA, 25 bp, Mus musculus
caacacatcactagtcttccccagg

SEQ ID NO: 886868 - DNA, 25 bp, Mus musculus
caacacatcacttgtcttccccagg

SEQ ID NO: 886869 - DNA, 25 bp, Mus musculus
caacaccaagagaggtattgtggcc

SEQ ID NO: 886870 - DNA, 25 bp, Mus musculus
caacaccaagagcttactggcggtt

SEQ ID NO: 886871 - DNA, 25 bp, Mus musculus
caacaccaagaggttactggcggtt

SEQ ID NO: 886872 - DNA, 25 bp, Mus musculus
caacaccaagagtggtattgtggcc

SEQ ID NO: 886873 - DNA, 25 bp, Mus musculus
caacaccaatgtgaagaactctagc

SEQ ID NO: 886874 - DNA, 25 bp, Mus musculus
caacaccaatgtgatgaactctagc

SEQ ID NO: 886875 - DNA, 25 bp, Mus musculus
caacaccatcaacatctgggataaa

SEQ ID NO: 886876 - DNA, 25 bp, Mus musculus
caacaccatcaagatctgggataaa

SEQ ID NO: 886877 - DNA, 25 bp, Mus musculus
caacaccatcagcctgtgggacata

SEQ ID NO: 886878 - DNA, 25 bp, Mus musculus
caacaccatcaggctgtgggacata

SEQ ID NO: 886879 - DNA, 25 bp, Mus musculus
caacacccaccgaggtcaactcaca

SEQ ID NO: 886880 - DNA, 25 bp, Mus musculus
caacacccaccgagtggtcaactca

SEQ ID NO: 886881 - DNA, 25 bp, Mus musculus
caacacccaccgtggtcaactcaca

SEQ ID NO: 886882 - DNA, 25 bp, Mus musculus
caacacccaccgtgtggtcaactca

SEQ ID NO: 886883 - DNA, 25 bp, Mus musculus
caacaccccgctgctgccttccttt

SEQ ID NO: 886884 - DNA, 25 bp, Mus musculus
caacaccccgcttctcttgcctctc

SEQ ID NO: 886885 - DNA, 25 bp, Mus musculus
caacaccccggtgctgccttccttt

SEQ ID NO: 886886 - DNA, 25 bp, Mus musculus
caacaccccggttctcttgcctctc

SEQ ID NO: 886887 - DNA, 25 bp, Mus musculus
caacaccccttcagtgcctgtgctg

SEQ ID NO: 886888 - DNA, 25 bp, Mus musculus
caacaccccttctgtgcctgtgctg

SEQ ID NO: 886889 - DNA, 25 bp, Mus musculus
caacacccggcgctccttccagtgc

SEQ ID NO: 886890 - DNA, 25 bp, Mus musculus
caacacccggggctccttccagtgc

SEQ ID NO: 886891 - DNA, 25 bp, Mus musculus
caacaccctaatttataggcaatgc

SEQ ID NO: 886892 - DNA, 25 bp, Mus musculus
caacaccctagacaggatttccagg

SEQ ID NO: 886893 - DNA, 25 bp, Mus musculus
caacaccctagagaggatttccagg

SEQ ID NO: 886894 - DNA, 25 bp, Mus musculus
caacaccctattttataggcaatgc

SEQ ID NO: 886895 - DNA, 25 bp, Mus musculus
caacaccgctgccacgcacaatgga

SEQ ID NO: 886896 - DNA, 25 bp, Mus musculus
caacaccgctgccaggcacaatgga

SEQ ID NO: 886897 - DNA, 25 bp, Mus musculus
caacacctatcacgcaacaattggc

SEQ ID NO: 886898 - DNA, 25 bp, Mus musculus
caacacctatcaggcaacaattggc

SEQ ID NO: 886899 - DNA, 25 bp, Mus musculus
caacacgccacgcgtcctctccggg

SEQ ID NO: 886900 - DNA, 25 bp, Mus musculus
caacacgccaggcgtcctctccggg

SEQ ID NO: 886901 - DNA, 25 bp, Mus musculus
caacacgccctgcgccgacaactgg

SEQ ID NO: 886902 - DNA, 25 bp, Mus musculus
caacacgccctgggccgacaactgg

SEQ ID NO: 886903 - DNA, 25 bp, Mus musculus
caacacggacagactggtccctgag

SEQ ID NO: 886904 - DNA, 25 bp, Mus musculus
caacacggacagtctggtccctgag

SEQ ID NO: 886905 - DNA, 25 bp, Mus musculus
caacacgtaccagtccaaagaccct

SEQ ID NO: 886906 - DNA, 25 bp, Mus musculus
caacacgtaccagtgcaaagaccct

SEQ ID NO: 886907 - DNA, 25 bp, Mus musculus
caacactgacagcagtctggtgtgt

SEQ ID NO: 886908 - DNA, 25 bp, Mus musculus
caacactgacaggagtctggtgtgt

SEQ ID NO: 886909 - DNA, 25 bp, Mus musculus
caacactttgagcattttggcttta

SEQ ID NO: 886910 - DNA, 25 bp, Mus musculus
caacactttgaggattttggcttta

SEQ ID NO: 886911 - DNA, 25 bp, Mus musculus
caacagacaaaagaggagttgtggg

SEQ ID NO: 886912 - DNA, 25 bp, Mus musculus
caacagacaaatagaagaggagttg

SEQ ID NO: 886913 - DNA, 25 bp, Mus musculus
caacagacaactcaagagcaatctg

SEQ ID NO: 886914 - DNA, 25 bp, Mus musculus
caacagacaagtcaagagcaatctg

SEQ ID NO: 886915 - DNA, 25 bp, Mus musculus
caacagacaatagaggagttgtggg

SEQ ID NO: 886916 - DNA, 25 bp, Mus musculus
caacagacaattagaagaggagttg

SEQ ID NO: 886917 - DNA, 25 bp, Mus musculus
caacagacacagacctggtacctgg

SEQ ID NO: 886918 - DNA, 25 bp, Mus musculus
caacagacacagtcctggtacctgg

SEQ ID NO: 886919 - DNA, 25 bp, Mus musculus
caacagagagagcccaagccgaaag

SEQ ID NO: 886920 - DNA, 25 bp, Mus musculus
caacagagagagcccaatattaatt

SEQ ID NO: 886921 - DNA, 25 bp, Mus musculus
caacagagagagccgaagccgaaag

SEQ ID NO: 886922 - DNA, 25 bp, Mus musculus
caacagagagagccgaatattaatt

SEQ ID NO: 886923 - DNA, 25 bp, Mus musculus
caacagagtccatgagtttacagga

SEQ ID NO: 886924 - DNA, 25 bp, Mus musculus
caacagagtccatgtgtttacagga

SEQ ID NO: 886925 - DNA, 25 bp, Mus musculus
caacagataagaaacatggcttgcc

SEQ ID NO: 886926 - DNA, 25 bp, Mus musculus
caacagataagaaagatggcttgcc

SEQ ID NO: 886927 - DNA, 25 bp, Mus musculus
caacagatacatgctgggctttgcc

SEQ ID NO: 886928 - DNA, 25 bp, Mus musculus
caacagatacgtatgctgggctttg

SEQ ID NO: 886929 - DNA, 25 bp, Mus musculus
caacagatacgtttgctgggctttg

SEQ ID NO: 886930 - DNA, 25 bp, Mus musculus
caacagatacttgctgggctttgcc

SEQ ID NO: 886931 - DNA, 25 bp, Mus musculus
caacagatggcacacggcttactct

SEQ ID NO: 886932 - DNA, 25 bp, Mus musculus
caacagatggcacagggcttactct

SEQ ID NO: 886933 - DNA, 25 bp, Mus musculus
caacagcaattaaacgatgttctgg

SEQ ID NO: 886934 - DNA, 25 bp, Mus musculus
caacagcaattaaaggatgttctgg

SEQ ID NO: 886935 - DNA, 25 bp, Mus musculus
caacagcacaaaaacggactcagct

SEQ ID NO: 886936 - DNA, 25 bp, Mus musculus
caacagcacaaaaagggactcagct

SEQ ID NO: 886937 - DNA, 25 bp, Mus musculus
caacagcaggaacacctttgggaag

SEQ ID NO: 886938 - DNA, 25 bp, Mus musculus
caacagcaggaagacctttgggaag

SEQ ID NO: 886939 - DNA, 25 bp, Mus musculus
caacagcatcaaacaatttgtcgtc

SEQ ID NO: 886940 - DNA, 25 bp, Mus musculus
caacagcatcaaacatggaggaatc

SEQ ID NO: 886941 - DNA, 25 bp, Mus musculus
caacagcatcaaactatttgtcgtc

SEQ ID NO: 886942 - DNA, 25 bp, Mus musculus
caacagcatcaaacttggaggaatc

SEQ ID NO: 886943 - DNA, 25 bp, Mus musculus
caacagccagcctctgaggtcatcg

SEQ ID NO: 886944 - DNA, 25 bp, Mus musculus
caacagccaggctctgaggtcatcg

SEQ ID NO: 886945 - DNA, 25 bp, Mus musculus
caacagcccaataacgtattcaatt

SEQ ID NO: 886946 - DNA, 25 bp, Mus musculus
caacagcccaataaggtattcaatt

SEQ ID NO: 886947 - DNA, 25 bp, Mus musculus
caacagcccattcccatgatggacc

SEQ ID NO: 886948 - DNA, 25 bp, Mus musculus
caacagcccattgccatgatggacc

SEQ ID NO: 886949 - DNA, 25 bp, Mus musculus
caacagcgttaatggggcccagaca

SEQ ID NO: 886950 - DNA, 25 bp, Mus musculus
caacagcgtttatggggcccagaca

SEQ ID NO: 886951 - DNA, 25 bp, Mus musculus
caacagctaccgagagcctggctcc

SEQ ID NO: 886952 - DNA, 25 bp, Mus musculus
caacagctaccgagtgcctggctcc

SEQ ID NO: 886953 - DNA, 25 bp, Mus musculus
caacagggagaaccatgtgctgctg

SEQ ID NO: 886954 - DNA, 25 bp, Mus musculus
caacagggagaagcatgtgctgctg

SEQ ID NO: 886955 - DNA, 25 bp, Mus musculus
caacaggtcaaaatgtcctgcaggt

SEQ ID NO: 886956 - DNA, 25 bp, Mus musculus
caacaggtcaaattgtcctgcaggt

SEQ ID NO: 886957 - DNA, 25 bp, Mus musculus
caacagtaagaagatgcagagctgg

SEQ ID NO: 886958 - DNA, 25 bp, Mus musculus
caacagtaagtagatgcagagctgg

SEQ ID NO: 886959 - DNA, 25 bp, Mus musculus
caacagtctgaccgaggctgtactg

SEQ ID NO: 886960 - DNA, 25 bp, Mus musculus
caacagtctgacggaggctgtactg

SEQ ID NO: 886961 - DNA, 25 bp, Mus musculus
caacagtggctgcttggatccttgg

SEQ ID NO: 886962 - DNA, 25 bp, Mus musculus
caacagtggctggttggatccttgg

SEQ ID NO: 886963 - DNA, 25 bp, Mus musculus
caacagttcatccgcaaaatgaccc

SEQ ID NO: 886964 - DNA, 25 bp, Mus musculus
caacagttcatccggaaaatgaccc

SEQ ID NO: 886965 - DNA, 25 bp, Mus musculus
caacataacgaactggagcgccgcc

SEQ ID NO: 886966 - DNA, 25 bp, Mus musculus
caacataacgaagtggagcgccgcc

SEQ ID NO: 886967 - DNA, 25 bp, Mus musculus
caacataacgagcctgagctcgggg

SEQ ID NO: 886968 - DNA, 25 bp, Mus musculus
caacataacgaggctgagctcgggg

SEQ ID NO: 886969 - DNA, 25 bp, Mus musculus
caacatacagcataagaacaagaag

SEQ ID NO: 886970 - DNA, 25 bp, Mus musculus
caacatacaggataagaacaagaag

SEQ ID NO: 886971 - DNA, 25 bp, Mus musculus
caacatcaaactgtgctcccttatg

SEQ ID NO: 886972 - DNA, 25 bp, Mus musculus
caacatcaaagtgtgctcccttatg

SEQ ID NO: 886973 - DNA, 25 bp, Mus musculus
caacatcaagacagctgaggcccag

SEQ ID NO: 886974 - DNA, 25 bp, Mus musculus
caacatcaagctgtctttggactcc

SEQ ID NO: 886975 - DNA, 25 bp, Mus musculus
caacatcaaggtgtctttggactcc

SEQ ID NO: 886976 - DNA, 25 bp, Mus musculus
caacatcaagtcagctgaggcccag

SEQ ID NO: 886977 - DNA, 25 bp, Mus musculus
caacatcagctcctacgtgcggctc

SEQ ID NO: 886978 - DNA, 25 bp, Mus musculus
caacatcagctcgtacgtgcggctc

SEQ ID NO: 886979 - DNA, 25 bp, Mus musculus
caacatcaggccctggctcacagag

SEQ ID NO: 886980 - DNA, 25 bp, Mus musculus
caacatcagggcctggctcacagag

SEQ ID NO: 886981 - DNA, 25 bp, Mus musculus
caacatcatctacacagacctgaag

SEQ ID NO: 886982 - DNA, 25 bp, Mus musculus
caacatcatctacagagacctgaag

SEQ ID NO: 886983 - DNA, 25 bp, Mus musculus
caacatcatgagagtgatctccatc

SEQ ID NO: 886984 - DNA, 25 bp, Mus musculus
caacatcatgagtgtgatctccatc

SEQ ID NO: 886985 - DNA, 25 bp, Mus musculus
caacatcatgcaagttaaaatctcc

SEQ ID NO: 886986 - DNA, 25 bp, Mus musculus
caacatcatgcacgccaagtggcag

SEQ ID NO: 886987 - DNA, 25 bp, Mus musculus
caacatcatgcaggccaagtggcag

SEQ ID NO: 886988 - DNA, 25 bp, Mus musculus
caacatcatggaagttaaaatctcc

SEQ ID NO: 886989 - DNA, 25 bp, Mus musculus
caacatccagccaggcattaatgaa

SEQ ID NO: 886990 - DNA, 25 bp, Mus musculus
caacatccaggcaggcattaatgaa

SEQ ID NO: 886991 - DNA, 25 bp, Mus musculus
caacatcctagacgccatgatttcc

SEQ ID NO: 886992 - DNA, 25 bp, Mus musculus
caacatcctagaggccatgatttcc

SEQ ID NO: 886993 - DNA, 25 bp, Mus musculus
caacatcgtgtccgcccctccaacc

SEQ ID NO: 886994 - DNA, 25 bp, Mus musculus
caacatcgtgtccggccctccaacc

SEQ ID NO: 886995 - DNA, 25 bp, Mus musculus
caacatctacagatatttacagagt

SEQ ID NO: 886996 - DNA, 25 bp, Mus musculus
caacatctacagttatttacagagt

SEQ ID NO: 886997 - DNA, 25 bp, Mus musculus
caacatctcaaagcagcgtcagatc

SEQ ID NO: 886998 - DNA, 25 bp, Mus musculus
caacatctcaaagctgcgtcagatc

SEQ ID NO: 886999 - DNA, 25 bp, Mus musculus
caacatctgatgcaacctgtaccat

SEQ ID NO: 887000 - DNA, 25 bp, Mus musculus
caacatctgatgctctatctccacg

SEQ ID NO: 887001 - DNA, 25 bp, Mus musculus
caacatctgatggaacctgtaccat

SEQ ID NO: 887002 - DNA, 25 bp, Mus musculus
caacatctgatggtctatctccacg

SEQ ID NO: 887003 - DNA, 25 bp, Mus musculus
caacatctggagagagacttgcctg

SEQ ID NO: 887004 - DNA, 25 bp, Mus musculus
caacatctggcacaagctggatggc

SEQ ID NO: 887005 - DNA, 25 bp, Mus musculus
caacatctgggacaagctggatggc

SEQ ID NO: 887006 - DNA, 25 bp, Mus musculus
caacatctggtgagagacttgcctg

SEQ ID NO: 887007 - DNA, 25 bp, Mus musculus
caacatgaacagaagagagaggggg

SEQ ID NO: 887008 - DNA, 25 bp, Mus musculus
caacatgaacagaagagcacttctg

SEQ ID NO: 887009 - DNA, 25 bp, Mus musculus
caacatgaacagacagagagcactt

SEQ ID NO: 887010 - DNA, 25 bp, Mus musculus
caacatgaacagtagagagaggggg

SEQ ID NO: 887011 - DNA, 25 bp, Mus musculus
caacatgaacagtagagcacttctg

SEQ ID NO: 887012 - DNA, 25 bp, Mus musculus
caacatgaacagtcagagagcactt

SEQ ID NO: 887013 - DNA, 25 bp, Mus musculus
caacatgaagctcatgtaggaaatt

SEQ ID NO: 887014 - DNA, 25 bp, Mus musculus
caacatgaaggtcatgtaggaaatt

SEQ ID NO: 887015 - DNA, 25 bp, Mus musculus
caacatgaatgtcaccgagataatc

SEQ ID NO: 887016 - DNA, 25 bp, Mus musculus
caacatgaatgtgaccgagataatc

SEQ ID NO: 887017 - DNA, 25 bp, Mus musculus
caacatgcacagcctatttaagagt

SEQ ID NO: 887018 - DNA, 25 bp, Mus musculus
caacatgcacaggctatttaagagt

SEQ ID NO: 887019 - DNA, 25 bp, Mus musculus
caacatgcagatcgtgtcagtggat

SEQ ID NO: 887020 - DNA, 25 bp, Mus musculus
caacatgcagatggtgtcagtggat

SEQ ID NO: 887021 - DNA, 25 bp, Mus musculus
caacatggaaacacccgttactctg

SEQ ID NO: 887022 - DNA, 25 bp, Mus musculus
caacatggaaactcccgttactctg

SEQ ID NO: 887023 - DNA, 25 bp, Mus musculus
caacatggaagtcaaggatgcgaac

SEQ ID NO: 887024 - DNA, 25 bp, Mus musculus
caacatggaagtgaaggatgcgaac

SEQ ID NO: 887025 - DNA, 25 bp, Mus musculus
caacatggagccggcgtgtctccac

SEQ ID NO: 887026 - DNA, 25 bp, Mus musculus
caacatggaggcggcgtgtctccac

SEQ ID NO: 887027 - DNA, 25 bp, Mus musculus
caacatggagtacacgatcaataag

SEQ ID NO: 887028 - DNA, 25 bp, Mus musculus
caacatggagtacaggatcaataag

SEQ ID NO: 887029 - DNA, 25 bp, Mus musculus
caacatggatgggaaggtctcgctg

SEQ ID NO: 887030 - DNA, 25 bp, Mus musculus
caacatggatgggatggtctcgctg

SEQ ID NO: 887031 - DNA, 25 bp, Mus musculus
caacatggctgaccctttcagtgct

SEQ ID NO: 887032 - DNA, 25 bp, Mus musculus
caacatggctgactgctacggagcc

SEQ ID NO: 887033 - DNA, 25 bp, Mus musculus
caacatggctgagcctttcagtgct

SEQ ID NO: 887034 - DNA, 25 bp, Mus musculus
caacatggctgagtgctacggagcc

SEQ ID NO: 887035 - DNA, 25 bp, Mus musculus
caacatggtgcatgtattcatgtca

SEQ ID NO: 887036 - DNA, 25 bp, Mus musculus
caacatggtggatgtattcatgtca

SEQ ID NO: 887037 - DNA, 25 bp, Mus musculus
caacattacccaccttccccgctcg

SEQ ID NO: 887038 - DNA, 25 bp, Mus musculus
caacattacccagcttccccgctcg

SEQ ID NO: 887039 - DNA, 25 bp, Mus musculus
caacattagcagctccagcagtggt

SEQ ID NO: 887040 - DNA, 25 bp, Mus musculus
caacattagcaggtccagcagtggt

SEQ ID NO: 887041 - DNA, 25 bp, Mus musculus
caacattatgatagatttttcagtg

SEQ ID NO: 887042 - DNA, 25 bp, Mus musculus
caacattatgatagttttttcagtg

SEQ ID NO: 887043 - DNA, 25 bp, Mus musculus
caacattcagaacgctgctgaaata

SEQ ID NO: 887044 - DNA, 25 bp, Mus musculus
caacattcagaaggctgctgaaata

SEQ ID NO: 887045 - DNA, 25 bp, Mus musculus
caacattccgagctacctgaatgac

SEQ ID NO: 887046 - DNA, 25 bp, Mus musculus
caacattccgaggtacctgaatgac

SEQ ID NO: 887047 - DNA, 25 bp, Mus musculus
caacattcctcctccacctcctgga

SEQ ID NO: 887048 - DNA, 25 bp, Mus musculus
caacattcctgctccacctcctgga

SEQ ID NO: 887049 - DNA, 25 bp, Mus musculus
caacattcttcatactgaagatctt

SEQ ID NO: 887050 - DNA, 25 bp, Mus musculus
caacattcttcatagtgaagatctt

SEQ ID NO: 887051 - DNA, 25 bp, Mus musculus
caacattgagcacagtctgcgagaa

SEQ ID NO: 887052 - DNA, 25 bp, Mus musculus
caacattgagcagagtctgcgagaa

SEQ ID NO: 887053 - DNA, 25 bp, Mus musculus
caacattgagcatcataaagacaca

SEQ ID NO: 887054 - DNA, 25 bp, Mus musculus
caacattgaggatcataaagacaca

SEQ ID NO: 887055 - DNA, 25 bp, Mus musculus
caacattgatgaagcgtcaggaact

SEQ ID NO: 887056 - DNA, 25 bp, Mus musculus
caacattgatgaagggtcaggaact

SEQ ID NO: 887057 - DNA, 25 bp, Mus musculus
caacattgctggacatttcaatgat

SEQ ID NO: 887058 - DNA, 25 bp, Mus musculus
caacattgctggatcctctcccagt

SEQ ID NO: 887059 - DNA, 25 bp, Mus musculus
caacattgctggtcatttcaatgat

SEQ ID NO: 887060 - DNA, 25 bp, Mus musculus
caacattgctggttcctctcccagt

SEQ ID NO: 887061 - DNA, 25 bp, Mus musculus
caacattggtcttaaggcactgaag

SEQ ID NO: 887062 - DNA, 25 bp, Mus musculus
caacattggtcttatggcactgaag

SEQ ID NO: 887063 - DNA, 25 bp, Mus musculus
caacatttatgacaatggagatgta

SEQ ID NO: 887064 - DNA, 25 bp, Mus musculus
caacatttatgagaatggagatgta

SEQ ID NO: 887065 - DNA, 25 bp, Mus musculus
caacatttgtgtcgtgaggctccca

SEQ ID NO: 887066 - DNA, 25 bp, Mus musculus
caacatttgtgtggtgaggctccca

SEQ ID NO: 887067 - DNA, 25 bp, Mus musculus
caaccaacagaccaacgacaaacga

SEQ ID NO: 887068 - DNA, 25 bp, Mus musculus
caaccaacagcagacaactggggaa

SEQ ID NO: 887069 - DNA, 25 bp, Mus musculus
caaccaacagcagagaactggggaa

SEQ ID NO: 887070 - DNA, 25 bp, Mus musculus
caaccaacagtccaacgacaaacga

SEQ ID NO: 887071 - DNA, 25 bp, Mus musculus
caaccaactcaagacgagcttcctg

SEQ ID NO: 887072 - DNA, 25 bp, Mus musculus
caaccaactcaagaggagcttcctg

SEQ ID NO: 887073 - DNA, 25 bp, Mus musculus
caaccacactctccattttgagtgg

SEQ ID NO: 887074 - DNA, 25 bp, Mus musculus
caaccacactgtccattttgagtgg

SEQ ID NO: 887075 - DNA, 25 bp, Mus musculus
caaccacaggcactggaaatggcag

SEQ ID NO: 887076 - DNA, 25 bp, Mus musculus
caaccacagggactggaaatggcag

SEQ ID NO: 887077 - DNA, 25 bp, Mus musculus
caaccaccagatttggttcatcttg

SEQ ID NO: 887078 - DNA, 25 bp, Mus musculus
caaccaccagttttggttcatcttg

SEQ ID NO: 887079 - DNA, 25 bp, Mus musculus
caaccacctcagacattcttacact

SEQ ID NO: 887080 - DNA, 25 bp, Mus musculus
caaccacctcagtcattcttacact

SEQ ID NO: 887081 - DNA, 25 bp, Mus musculus
caaccagaagatggaggtgcagcgc

SEQ ID NO: 887082 - DNA, 25 bp, Mus musculus
caaccagaagttggaggtgcagcgc

SEQ ID NO: 887083 - DNA, 25 bp, Mus musculus
caaccagacaagccatgtcggaccc

SEQ ID NO: 887084 - DNA, 25 bp, Mus musculus
caaccagacatgccatgtcggaccc

SEQ ID NO: 887085 - DNA, 25 bp, Mus musculus
caaccagacctgccccaggatccgg

SEQ ID NO: 887086 - DNA, 25 bp, Mus musculus
caaccagacctggcccaggatccgg

SEQ ID NO: 887087 - DNA, 25 bp, Mus musculus
caaccagacgctggatttctgggtc

SEQ ID NO: 887088 - DNA, 25 bp, Mus musculus
caaccagacggtggatttctgggtc

SEQ ID NO: 887089 - DNA, 25 bp, Mus musculus
caaccagcaactgaaaagtgaactt

SEQ ID NO: 887090 - DNA, 25 bp, Mus musculus
caaccagcaactgataagtgaactt

SEQ ID NO: 887091 - DNA, 25 bp, Mus musculus
caaccagcgcctgaatgggaaacac

SEQ ID NO: 887092 - DNA, 25 bp, Mus musculus
caaccagcgcgtgaatgggaaacac

SEQ ID NO: 887093 - DNA, 25 bp, Mus musculus
caaccagcggaaatgtgagcgtgtt

SEQ ID NO: 887094 - DNA, 25 bp, Mus musculus
caaccagcggtaatgtgagcgtgtt

SEQ ID NO: 887095 - DNA, 25 bp, Mus musculus
caaccagctacgcgtccagcggctc

SEQ ID NO: 887096 - DNA, 25 bp, Mus musculus
caaccagctacgggtccagcggctc

SEQ ID NO: 887097 - DNA, 25 bp, Mus musculus
caaccagctgaacgaactgagagag

SEQ ID NO: 887098 - DNA, 25 bp, Mus musculus
caaccagctgaaggaactgagagag

SEQ ID NO: 887099 - DNA, 25 bp, Mus musculus
caaccagctgcctgaagccatcagt

SEQ ID NO: 887100 - DNA, 25 bp, Mus musculus
caaccagctggctgaagccatcagt

SEQ ID NO: 887101 - DNA, 25 bp, Mus musculus
caaccagcttatgacgattgaggag

SEQ ID NO: 887102 - DNA, 25 bp, Mus musculus
caaccagcttatgaggattgaggag

SEQ ID NO: 887103 - DNA, 25 bp, Mus musculus
caaccagggactattcgagctcctg

SEQ ID NO: 887104 - DNA, 25 bp, Mus musculus
caaccagggacttttcgagctcctg

SEQ ID NO: 887105 - DNA, 25 bp, Mus musculus
caaccagggtgaaggcgggctagga

SEQ ID NO: 887106 - DNA, 25 bp, Mus musculus
caaccagggtgatggcgggctagga

SEQ ID NO: 887107 - DNA, 25 bp, Mus musculus
caaccatcagcggctggtgtcattt

SEQ ID NO: 887108 - DNA, 25 bp, Mus musculus
caaccatcagctctaggtggctgtg

SEQ ID NO: 887109 - DNA, 25 bp, Mus musculus
caaccatcaggggctggtgtcattt

SEQ ID NO: 887110 - DNA, 25 bp, Mus musculus
caaccatcaggtctaggtggctgtg

SEQ ID NO: 887111 - DNA, 25 bp, Mus musculus
caaccatgggaacatcccaacgctg

SEQ ID NO: 887112 - DNA, 25 bp, Mus musculus
caaccatgggaagatcccaacgctg

SEQ ID NO: 887113 - DNA, 25 bp, Mus musculus
caacccaaacgtcgaaggacctgct

SEQ ID NO: 887114 - DNA, 25 bp, Mus musculus
caacccaaacgtggaaggacctgct

SEQ ID NO: 887115 - DNA, 25 bp, Mus musculus
caacccacccagcaacaattgtgag

SEQ ID NO: 887116 - DNA, 25 bp, Mus musculus
caacccacccaggaacaattgtgag

SEQ ID NO: 887117 - DNA, 25 bp, Mus musculus
caacccacgcaacatggctgccagc

SEQ ID NO: 887118 - DNA, 25 bp, Mus musculus
caacccacgcaagatggctgccagc

SEQ ID NO: 887119 - DNA, 25 bp, Mus musculus
caacccactgcggacacgtggatga

SEQ ID NO: 887120 - DNA, 25 bp, Mus musculus
caacccactgcggagacgtggatga

SEQ ID NO: 887121 - DNA, 25 bp, Mus musculus
caacccagaggacggagtgagctac

SEQ ID NO: 887122 - DNA, 25 bp, Mus musculus
caacccagaggagggagtgagctac

SEQ ID NO: 887123 - DNA, 25 bp, Mus musculus
caaccccaaatcgacagccaacctc

SEQ ID NO: 887124 - DNA, 25 bp, Mus musculus
caaccccaaatcgagagccaacctc

SEQ ID NO: 887125 - DNA, 25 bp, Mus musculus
caaccccacccacgtggaggatgcg

SEQ ID NO: 887126 - DNA, 25 bp, Mus musculus
caaccccacccactttctgtgttgt

SEQ ID NO: 887127 - DNA, 25 bp, Mus musculus
caaccccacccaggtggaggatgcg

SEQ ID NO: 887128 - DNA, 25 bp, Mus musculus
caaccccacccagtttctgtgttgt

SEQ ID NO: 887129 - DNA, 25 bp, Mus musculus
caaccccacctccacgcattatggc

SEQ ID NO: 887130 - DNA, 25 bp, Mus musculus
caaccccacctccaggcattatggc

SEQ ID NO: 887131 - DNA, 25 bp, Mus musculus
caacccccgctgcataacaagcccg

SEQ ID NO: 887132 - DNA, 25 bp, Mus musculus
caacccccgctggataacaagcccg

SEQ ID NO: 887133 - DNA, 25 bp, Mus musculus
caaccctcagagctttaataagatt

SEQ ID NO: 887134 - DNA, 25 bp, Mus musculus
caaccctcagaggtttaataagatt

SEQ ID NO: 887135 - DNA, 25 bp, Mus musculus
caaccctcgtctcttctgtcggaaa

SEQ ID NO: 887136 - DNA, 25 bp, Mus musculus
caaccctcgtgtcttctgtcggaaa

SEQ ID NO: 887137 - DNA, 25 bp, Mus musculus
caaccctgagacagctcttcttcaa

SEQ ID NO: 887138 - DNA, 25 bp, Mus musculus
caaccctgagagccaggaccctggc

SEQ ID NO: 887139 - DNA, 25 bp, Mus musculus
caaccctgagcactggaaagaaaag

SEQ ID NO: 887140 - DNA, 25 bp, Mus musculus
caaccctgaggactggaaagaaaag

SEQ ID NO: 887141 - DNA, 25 bp, Mus musculus
caaccctgagtcagctcttcttcaa

SEQ ID NO: 887142 - DNA, 25 bp, Mus musculus
caaccctgagtgccaggaccctggc

SEQ ID NO: 887143 - DNA, 25 bp, Mus musculus
caaccctgcccacctgaggcaaaag

SEQ ID NO: 887144 - DNA, 25 bp, Mus musculus
caaccctgcccagctgaggcaaaag

SEQ ID NO: 887145 - DNA, 25 bp, Mus musculus
caaccctgtcaacgtgggctgtcaa

SEQ ID NO: 887146 - DNA, 25 bp, Mus musculus
caaccctgtcaaggtgggctgtcaa

SEQ ID NO: 887147 - DNA, 25 bp, Mus musculus
caaccgaactaccacacggttctat

SEQ ID NO: 887148 - DNA, 25 bp, Mus musculus
caaccgaactaccagacggttctat

SEQ ID NO: 887149 - DNA, 25 bp, Mus musculus
caaccgagaccacatcatcttcatg

SEQ ID NO: 887150 - DNA, 25 bp, Mus musculus
caaccgagaccagatcatcttcatg

SEQ ID NO: 887151 - DNA, 25 bp, Mus musculus
caaccgcagagacgaactggcccaa

SEQ ID NO: 887152 - DNA, 25 bp, Mus musculus
caaccgcagagaggaactggcccaa

SEQ ID NO: 887153 - DNA, 25 bp, Mus musculus
caaccgcggttacacggcatctgac

SEQ ID NO: 887154 - DNA, 25 bp, Mus musculus
caaccgcggttacagggcatctgac

SEQ ID NO: 887155 - DNA, 25 bp, Mus musculus
caaccgctttggcacacgcaactct

SEQ ID NO: 887156 - DNA, 25 bp, Mus musculus
caaccgctttggcagacgcaactct

SEQ ID NO: 887157 - DNA, 25 bp, Mus musculus
caaccgggagaggtctgctctgact

SEQ ID NO: 887158 - DNA, 25 bp, Mus musculus
caaccgggagcaggaggacaggaag

SEQ ID NO: 887159 - DNA, 25 bp, Mus musculus
caaccgggagcattctcagagcttc

SEQ ID NO: 887160 - DNA, 25 bp, Mus musculus
caaccgggaggaggaggacaggaag

SEQ ID NO: 887161 - DNA, 25 bp, Mus musculus
caaccgggaggattctcagagcttc

SEQ ID NO: 887162 - DNA, 25 bp, Mus musculus
caaccgggagtggtctgctctgact

SEQ ID NO: 887163 - DNA, 25 bp, Mus musculus
caaccgtagtcacaatgagtctgca

SEQ ID NO: 887164 - DNA, 25 bp, Mus musculus
caaccgtagtcagaatgagtctgca

SEQ ID NO: 887165 - DNA, 25 bp, Mus musculus
caacctaaatcacgaattcgtcaac

SEQ ID NO: 887166 - DNA, 25 bp, Mus musculus
caacctaaatcaggaattcgtcaac

SEQ ID NO: 887167 - DNA, 25 bp, Mus musculus
caacctacaacaacacacagatcca

SEQ ID NO: 887168 - DNA, 25 bp, Mus musculus
caacctacaacatcacacagatcca

SEQ ID NO: 887169 - DNA, 25 bp, Mus musculus
caacctacaacggcaagatgaagag

SEQ ID NO: 887170 - DNA, 25 bp, Mus musculus
caacctacaagggcaagatgaagag

SEQ ID NO: 887171 - DNA, 25 bp, Mus musculus
caacctagagaacaagcgagatgag

SEQ ID NO: 887172 - DNA, 25 bp, Mus musculus
caacctagagaaccgagatgagcgc

SEQ ID NO: 887173 - DNA, 25 bp, Mus musculus
caacctagagaagaagcgagatgag

SEQ ID NO: 887174 - DNA, 25 bp, Mus musculus
caacctagagaagcgagatgagcgc

SEQ ID NO: 887175 - DNA, 25 bp, Mus musculus
caacctagcaagattatccagctga

SEQ ID NO: 887176 - DNA, 25 bp, Mus musculus
caacctagcaagtttatccagctga

SEQ ID NO: 887177 - DNA, 25 bp, Mus musculus
caacctatgatgatggcatttgcaa

SEQ ID NO: 887178 - DNA, 25 bp, Mus musculus
caacctatgatgttggcatttgcaa

SEQ ID NO: 887179 - DNA, 25 bp, Mus musculus
caacctcaactgagtgtgcaacaga

SEQ ID NO: 887180 - DNA, 25 bp, Mus musculus
caacctcaactgtgtgtgcaacaga

SEQ ID NO: 887181 - DNA, 25 bp, Mus musculus
caacctcatcgtgtagagccttcca

SEQ ID NO: 887182 - DNA, 25 bp, Mus musculus
caacctcatcgtgttgagccttcca

SEQ ID NO: 887183 - DNA, 25 bp, Mus musculus
caacctcctaggaaagctgtagagg

SEQ ID NO: 887184 - DNA, 25 bp, Mus musculus
caacctcctaggtaagctgtagagg

SEQ ID NO: 887185 - DNA, 25 bp, Mus musculus
caacctctgggacaatcatcaccct

SEQ ID NO: 887186 - DNA, 25 bp, Mus musculus
caacctctgggacattcatcaccct

SEQ ID NO: 887187 - DNA, 25 bp, Mus musculus
caacctgaggctggccaggaacagt

SEQ ID NO: 887188 - DNA, 25 bp, Mus musculus
caacctgagggtggccaggaacagt

SEQ ID NO: 887189 - DNA, 25 bp, Mus musculus
caacctgatggactttgaccctgac

SEQ ID NO: 887190 - DNA, 25 bp, Mus musculus
caacctgatggagtttgaccctgac

SEQ ID NO: 887191 - DNA, 25 bp, Mus musculus
caacctgcagaatcttcaggacgag

SEQ ID NO: 887192 - DNA, 25 bp, Mus musculus
caacctgcagatggcagcagtgaca

SEQ ID NO: 887193 - DNA, 25 bp, Mus musculus
caacctgcagatggcagctcaacgg

SEQ ID NO: 887194 - DNA, 25 bp, Mus musculus
caacctgcagtatcttcaggacgag

SEQ ID NO: 887195 - DNA, 25 bp, Mus musculus
caacctgcagttggcagcagtgaca

SEQ ID NO: 887196 - DNA, 25 bp, Mus musculus
caacctgcagttggcagctcaacgg

SEQ ID NO: 887197 - DNA, 25 bp, Mus musculus
caacctgcctaaaaccagcagcagc

SEQ ID NO: 887198 - DNA, 25 bp, Mus musculus
caacctgcctaataccagcagcagc

SEQ ID NO: 887199 - DNA, 25 bp, Mus musculus
caacctgcggcacaaaaatttcaca

SEQ ID NO: 887200 - DNA, 25 bp, Mus musculus
caacctgcggcacataaatttcaca

SEQ ID NO: 887201 - DNA, 25 bp, Mus musculus
caacctgctgttctcgttccttgcc

SEQ ID NO: 887202 - DNA, 25 bp, Mus musculus
caacctgctgttctggttccttgcc

SEQ ID NO: 887203 - DNA, 25 bp, Mus musculus
caacctggaacgcgcacacggtgac

SEQ ID NO: 887204 - DNA, 25 bp, Mus musculus
caacctggaacgggcacacggtgac

SEQ ID NO: 887205 - DNA, 25 bp, Mus musculus
caacctggaggacatcttcctaaag

SEQ ID NO: 887206 - DNA, 25 bp, Mus musculus
caacctggaggagatcttcctaaag

SEQ ID NO: 887207 - DNA, 25 bp, Mus musculus
caacctggctgtcggtggtgagaag

SEQ ID NO: 887208 - DNA, 25 bp, Mus musculus
caacctggctgtgggtggtgagaag

SEQ ID NO: 887209 - DNA, 25 bp, Mus musculus
caacctggtcaatgaaacaactgac

SEQ ID NO: 887210 - DNA, 25 bp, Mus musculus
caacctggtcacccatccctgacgg

SEQ ID NO: 887211 - DNA, 25 bp, Mus musculus
caacctggtctatgaaacaactgac

SEQ ID NO: 887212 - DNA, 25 bp, Mus musculus
caacctggtctcccatccctgacgg

SEQ ID NO: 887213 - DNA, 25 bp, Mus musculus
caacctgtagcgaactgtgcaccaa

SEQ ID NO: 887214 - DNA, 25 bp, Mus musculus
caacctgtagggaactgtgcaccaa

SEQ ID NO: 887215 - DNA, 25 bp, Mus musculus
caacctgtatcacaatatgtctgta

SEQ ID NO: 887216 - DNA, 25 bp, Mus musculus
caacctgtatcagaatatgtctgta

SEQ ID NO: 887217 - DNA, 25 bp, Mus musculus
caacctgttcaaaacccaccccaga

SEQ ID NO: 887218 - DNA, 25 bp, Mus musculus
caacctgttcaaaagccaccccaga

SEQ ID NO: 887219 - DNA, 25 bp, Mus musculus
caaccttcatgaaacgaatacagat

SEQ ID NO: 887220 - DNA, 25 bp, Mus musculus
caaccttcatgaaacttccgacgag

SEQ ID NO: 887221 - DNA, 25 bp, Mus musculus
caaccttcatgaaaggaatacagat

SEQ ID NO: 887222 - DNA, 25 bp, Mus musculus
caaccttcatgaaagttccgacgag

SEQ ID NO: 887223 - DNA, 25 bp, Mus musculus
caacctttaccacacagcactgcat

SEQ ID NO: 887224 - DNA, 25 bp, Mus musculus
caacctttaccagacagcactgcat

SEQ ID NO: 887225 - DNA, 25 bp, Mus musculus
caacgaactatgatcgcctgactcc

SEQ ID NO: 887226 - DNA, 25 bp, Mus musculus
caacgaactatgatggcctgactcc

SEQ ID NO: 887227 - DNA, 25 bp, Mus musculus
caacgacaaaacagctaacccagta

SEQ ID NO: 887228 - DNA, 25 bp, Mus musculus
caacgacaaaactgctaacccagta

SEQ ID NO: 887229 - DNA, 25 bp, Mus musculus
caacgacagctgatcgttccagcat

SEQ ID NO: 887230 - DNA, 25 bp, Mus musculus
caacgacagctgatggttccagcat

SEQ ID NO: 887231 - DNA, 25 bp, Mus musculus
caacgaccagctggtcacggacctc

SEQ ID NO: 887232 - DNA, 25 bp, Mus musculus
caacgaccaggtggtcacggacctc

SEQ ID NO: 887233 - DNA, 25 bp, Mus musculus
caacgagcgactggtgacgtatgcc

SEQ ID NO: 887234 - DNA, 25 bp, Mus musculus
caacgagcgacttgggatggctacc

SEQ ID NO: 887235 - DNA, 25 bp, Mus musculus
caacgagcgagtggtgacgtatgcc

SEQ ID NO: 887236 - DNA, 25 bp, Mus musculus
caacgagcgagttgggatggctacc

SEQ ID NO: 887237 - DNA, 25 bp, Mus musculus
caacgatcagcaaatcatccccatg

SEQ ID NO: 887238 - DNA, 25 bp, Mus musculus
caacgatcaggaaatcatccccatg

SEQ ID NO: 887239 - DNA, 25 bp, Mus musculus
caacgatgagatttttgtgcttggc

SEQ ID NO: 887240 - DNA, 25 bp, Mus musculus
caacgatgagttttttgtgcttggc

SEQ ID NO: 887241 - DNA, 25 bp, Mus musculus
caacgatgtactctctcttttggaa

SEQ ID NO: 887242 - DNA, 25 bp, Mus musculus
caacgatgtactgtctcttttggaa

SEQ ID NO: 887243 - DNA, 25 bp, Mus musculus
caacgatgtgctcctgttggacaaa

SEQ ID NO: 887244 - DNA, 25 bp, Mus musculus
caacgatgtgctcgagctgttggac

SEQ ID NO: 887245 - DNA, 25 bp, Mus musculus
caacgatgtgctgctgttggacaaa

SEQ ID NO: 887246 - DNA, 25 bp, Mus musculus
caacgatgtgctggagctgttggac

SEQ ID NO: 887247 - DNA, 25 bp, Mus musculus
caacgattcaagcaggagccccgaa

SEQ ID NO: 887248 - DNA, 25 bp, Mus musculus
caacgattcaagctcttgcttctag

SEQ ID NO: 887249 - DNA, 25 bp, Mus musculus
caacgattcaaggaggagccccgaa

SEQ ID NO: 887250 - DNA, 25 bp, Mus musculus
caacgattcaaggtcttgcttctag

SEQ ID NO: 887251 - DNA, 25 bp, Mus musculus
caacgccaagctcgctgttcagaag

SEQ ID NO: 887252 - DNA, 25 bp, Mus musculus
caacgccaaggtcgctgttcagaag

SEQ ID NO: 887253 - DNA, 25 bp, Mus musculus
caacgccacgcgcaagctggtgtac

SEQ ID NO: 887254 - DNA, 25 bp, Mus musculus
caacgccacgggcaagctggtgtac

SEQ ID NO: 887255 - DNA, 25 bp, Mus musculus
caacgctgacaacctgaagaaggag

SEQ ID NO: 887256 - DNA, 25 bp, Mus musculus
caacgctgacaagctgaagaaggag

SEQ ID NO: 887257 - DNA, 25 bp, Mus musculus
caacgctgacttagagaagctgaag

SEQ ID NO: 887258 - DNA, 25 bp, Mus musculus
caacgctgactttgagaagctgaag

SEQ ID NO: 887259 - DNA, 25 bp, Mus musculus
caacgctgtcagattcttcccgagt

SEQ ID NO: 887260 - DNA, 25 bp, Mus musculus
caacgctgtcagtttcttcccgagt

SEQ ID NO: 887261 - DNA, 25 bp, Mus musculus
caacggatcgagaaagctacagatg

SEQ ID NO: 887262 - DNA, 25 bp, Mus musculus
caacggatcgctcttggaaacatgt

SEQ ID NO: 887263 - DNA, 25 bp, Mus musculus
caacggatcggtcttggaaacatgt

SEQ ID NO: 887264 - DNA, 25 bp, Mus musculus
caacggatcgtgaaagctacagatg

SEQ ID NO: 887265 - DNA, 25 bp, Mus musculus
caacggatgaaacattggcaggaga

SEQ ID NO: 887266 - DNA, 25 bp, Mus musculus
caacggatgaaagattggcaggaga

SEQ ID NO: 887267 - DNA, 25 bp, Mus musculus
caacggcaagacccaatcagagaac

SEQ ID NO: 887268 - DNA, 25 bp, Mus musculus
caacggcaagtcccaatcagagaac

SEQ ID NO: 887269 - DNA, 25 bp, Mus musculus
caacggcacttgtaccttggactct

SEQ ID NO: 887270 - DNA, 25 bp, Mus musculus
caacggcacttgtagcttggactct

SEQ ID NO: 887271 - DNA, 25 bp, Mus musculus
caacggccccagaaattactgtgct

SEQ ID NO: 887272 - DNA, 25 bp, Mus musculus
caacggccccagaagctgactgcgg

SEQ ID NO: 887273 - DNA, 25 bp, Mus musculus
caacggccccagtaattactgtgct

SEQ ID NO: 887274 - DNA, 25 bp, Mus musculus
caacggccccagtagctgactgcgg

SEQ ID NO: 887275 - DNA, 25 bp, Mus musculus
caacggcgcctccgctggacattgt

SEQ ID NO: 887276 - DNA, 25 bp, Mus musculus
caacggcgcctcggctggacattgt

SEQ ID NO: 887277 - DNA, 25 bp, Mus musculus
caacgggactaatgggcctgctccg

SEQ ID NO: 887278 - DNA, 25 bp, Mus musculus
caacgggacttatgggcctgctccg

SEQ ID NO: 887279 - DNA, 25 bp, Mus musculus
caacgggctgagatctcttgatgct

SEQ ID NO: 887280 - DNA, 25 bp, Mus musculus
caacgggctgagctctgtgcagacg

SEQ ID NO: 887281 - DNA, 25 bp, Mus musculus
caacgggctgaggtctgtgcagacg

SEQ ID NO: 887282 - DNA, 25 bp, Mus musculus
caacgggctgagttctcttgatgct

SEQ ID NO: 887283 - DNA, 25 bp, Mus musculus
caacgggggagacctcttcttccat

SEQ ID NO: 887284 - DNA, 25 bp, Mus musculus
caacgggggagagctcttcttccat

SEQ ID NO: 887285 - DNA, 25 bp, Mus musculus
caacgtcattgacgtggagcatcag

SEQ ID NO: 887286 - DNA, 25 bp, Mus musculus
caacgtcattgaggtggagcatcag

SEQ ID NO: 887287 - DNA, 25 bp, Mus musculus
caacgtcctgacaatgcagaccttg

SEQ ID NO: 887288 - DNA, 25 bp, Mus musculus
caacgtcctgactatgcagaccttg

SEQ ID NO: 887289 - DNA, 25 bp, Mus musculus
caacgtctgaattccagtccctgac

SEQ ID NO: 887290 - DNA, 25 bp, Mus musculus
caacgtctgatttccagtccctgac

SEQ ID NO: 887291 - DNA, 25 bp, Mus musculus
caacgtgaacttctacatgtttata

SEQ ID NO: 887292 - DNA, 25 bp, Mus musculus
caacgtgaacttgtacatgtttata

SEQ ID NO: 887293 - DNA, 25 bp, Mus musculus
caacgtgatcgttacgactggagag

SEQ ID NO: 887294 - DNA, 25 bp, Mus musculus
caacgtgatcgttaggactggagag

SEQ ID NO: 887295 - DNA, 25 bp, Mus musculus
caacgtgtcataatatcattgacaa

SEQ ID NO: 887296 - DNA, 25 bp, Mus musculus
caacgtgtcatattatcattgacaa

SEQ ID NO: 887297 - DNA, 25 bp, Mus musculus
caacgtgtccaactcttggctactg

SEQ ID NO: 887298 - DNA, 25 bp, Mus musculus
caacgtgtccaagtcttggctactg

SEQ ID NO: 887299 - DNA, 25 bp, Mus musculus
caactaagcgcatgtgggagctggg

SEQ ID NO: 887300 - DNA, 25 bp, Mus musculus
caactaagcggatgtgggagctggg

SEQ ID NO: 887301 - DNA, 25 bp, Mus musculus
caactacacgagacctgtgttcctg

SEQ ID NO: 887302 - DNA, 25 bp, Mus musculus
caactacacgagtcctgtgttcctg

SEQ ID NO: 887303 - DNA, 25 bp, Mus musculus
caactaccaccactacatagtgaaa

SEQ ID NO: 887304 - DNA, 25 bp, Mus musculus
caactaccaccagtacatagtgaaa

SEQ ID NO: 887305 - DNA, 25 bp, Mus musculus
caactaccagctgtggcacgagctg

SEQ ID NO: 887306 - DNA, 25 bp, Mus musculus
caactaccaggtgtggcacgagctg

SEQ ID NO: 887307 - DNA, 25 bp, Mus musculus
caactacccaggcgctggatgggct

SEQ ID NO: 887308 - DNA, 25 bp, Mus musculus
caactacccaggggctggatgggct

SEQ ID NO: 887309 - DNA, 25 bp, Mus musculus
caactaccgccaagggcagcccatt

SEQ ID NO: 887310 - DNA, 25 bp, Mus musculus
caactaccgccatgggcagcccatt

SEQ ID NO: 887311 - DNA, 25 bp, Mus musculus
caactacctccgactctgtgtgata

SEQ ID NO: 887312 - DNA, 25 bp, Mus musculus
caactacctccgtctctgtgtgata

SEQ ID NO: 887313 - DNA, 25 bp, Mus musculus
caactacggaaacaatgatgaagtg

SEQ ID NO: 887314 - DNA, 25 bp, Mus musculus
caactacggaaacatcagaaacatc

SEQ ID NO: 887315 - DNA, 25 bp, Mus musculus
caactacggaaacgtgactcagaac

SEQ ID NO: 887316 - DNA, 25 bp, Mus musculus
caactacggaaagaatgatgaagtg

SEQ ID NO: 887317 - DNA, 25 bp, Mus musculus
caactacggaaagatcagaaacatc

SEQ ID NO: 887318 - DNA, 25 bp, Mus musculus
caactacggaaaggtgactcagaac

SEQ ID NO: 887319 - DNA, 25 bp, Mus musculus
caactacgtgaaccaatggagacat

SEQ ID NO: 887320 - DNA, 25 bp, Mus musculus
caactacgtgaagcaatggagacat

SEQ ID NO: 887321 - DNA, 25 bp, Mus musculus
caactactatctctggcctgctgtg

SEQ ID NO: 887322 - DNA, 25 bp, Mus musculus
caactactatgtctggcctgctgtg

SEQ ID NO: 887323 - DNA, 25 bp, Mus musculus
caactataagacggatgtttgggct

SEQ ID NO: 887324 - DNA, 25 bp, Mus musculus
caactataagtcggatgtttgggct

SEQ ID NO: 887325 - DNA, 25 bp, Mus musculus
caactataccaccagaaacatcttg

SEQ ID NO: 887326 - DNA, 25 bp, Mus musculus
caactataccacgagaaacatcttg

SEQ ID NO: 887327 - DNA, 25 bp, Mus musculus
caactatatacacgctacagacaag

SEQ ID NO: 887328 - DNA, 25 bp, Mus musculus
caactatatacaggctacagacaag

SEQ ID NO: 887329 - DNA, 25 bp, Mus musculus
caactatgaccaagtggtgctggga

SEQ ID NO: 887330 - DNA, 25 bp, Mus musculus
caactatgaccatgtggtgctggga

SEQ ID NO: 887331 - DNA, 25 bp, Mus musculus
caactatgagctgttccagttacta

SEQ ID NO: 887332 - DNA, 25 bp, Mus musculus
caactatgaggtgttccagttacta

SEQ ID NO: 887333 - DNA, 25 bp, Mus musculus
caactcaacatgaatggttttcgga

SEQ ID NO: 887334 - DNA, 25 bp, Mus musculus
caactcaacatgtatggttttcgga

SEQ ID NO: 887335 - DNA, 25 bp, Mus musculus
caactcagtgcatttaaaaatgact

SEQ ID NO: 887336 - DNA, 25 bp, Mus musculus
caactcagtggatttaaaaatgact

SEQ ID NO: 887337 - DNA, 25 bp, Mus musculus
caactcatagcaccgaccatcatgg

SEQ ID NO: 887338 - DNA, 25 bp, Mus musculus
caactcataggaccgaccatcatgg

SEQ ID NO: 887339 - DNA, 25 bp, Mus musculus
caactcatcagcctcaacgagaagg

SEQ ID NO: 887340 - DNA, 25 bp, Mus musculus
caactcatcagcctgaacgagaagg

SEQ ID NO: 887341 - DNA, 25 bp, Mus musculus
caactccacagactcagctgcagct

SEQ ID NO: 887342 - DNA, 25 bp, Mus musculus
caactccacagagtcagctgcagct

SEQ ID NO: 887343 - DNA, 25 bp, Mus musculus
caactccaccctgaagagctttgac

SEQ ID NO: 887344 - DNA, 25 bp, Mus musculus
caactccaccgtgaagagctttgac

SEQ ID NO: 887345 - DNA, 25 bp, Mus musculus
caactccacctcagcacagaagaat

SEQ ID NO: 887346 - DNA, 25 bp, Mus musculus
caactccacctctgcacagaagaat

SEQ ID NO: 887347 - DNA, 25 bp, Mus musculus
caactcccagcgatcgttgctggag

SEQ ID NO: 887348 - DNA, 25 bp, Mus musculus
caactcccagctgacacccctcccc

SEQ ID NO: 887349 - DNA, 25 bp, Mus musculus
caactcccagggatcgttgctggag

SEQ ID NO: 887350 - DNA, 25 bp, Mus musculus
caactcccaggtgacacccctcccc

SEQ ID NO: 887351 - DNA, 25 bp, Mus musculus
caactcctggtgctcactagctctg

SEQ ID NO: 887352 - DNA, 25 bp, Mus musculus
caactcctggtggtcactagctctg

SEQ ID NO: 887353 - DNA, 25 bp, Mus musculus
caactcctgtacctcggcaaagcat

SEQ ID NO: 887354 - DNA, 25 bp, Mus musculus
caactcctgtacctgggcaaagcat

SEQ ID NO: 887355 - DNA, 25 bp, Mus musculus
caactcggctggggacattctcaga

SEQ ID NO: 887356 - DNA, 25 bp, Mus musculus
caactcggctggggtcattctcaga

SEQ ID NO: 887357 - DNA, 25 bp, Mus musculus
caactctaatctgtcgctgagcagt

SEQ ID NO: 887358 - DNA, 25 bp, Mus musculus
caactctaatctgtggctgagcagt

SEQ ID NO: 887359 - DNA, 25 bp, Mus musculus
caactctaatgtcacctccggccct

SEQ ID NO: 887360 - DNA, 25 bp, Mus musculus
caactctaatgtcagctccggccct

SEQ ID NO: 887361 - DNA, 25 bp, Mus musculus
caactctacaagaggtacctgctgc

SEQ ID NO: 887362 - DNA, 25 bp, Mus musculus
caactctacaagtggtacctgctgc

SEQ ID NO: 887363 - DNA, 25 bp, Mus musculus
caactctatgctgctttttgaccat

SEQ ID NO: 887364 - DNA, 25 bp, Mus musculus
caactctatggtgctttttgaccat

SEQ ID NO: 887365 - DNA, 25 bp, Mus musculus
caactctcccagcgctttctgaggg

SEQ ID NO: 887366 - DNA, 25 bp, Mus musculus
caactctcccagggctttctgaggg

SEQ ID NO: 887367 - DNA, 25 bp, Mus musculus
caactctgaaagatattaccaggag

SEQ ID NO: 887368 - DNA, 25 bp, Mus musculus
caactctgaaagattttaccaggag

SEQ ID NO: 887369 - DNA, 25 bp, Mus musculus
caactctgctcacatgtataacttt

SEQ ID NO: 887370 - DNA, 25 bp, Mus musculus
caactctgctcagatgtataacttt

SEQ ID NO: 887371 - DNA, 25 bp, Mus musculus
caactctggcatcggagctgtgatg

SEQ ID NO: 887372 - DNA, 25 bp, Mus musculus
caactctggcatgggagctgtgatg

SEQ ID NO: 887373 - DNA, 25 bp, Mus musculus
caactcttattgatggaaatctaca

SEQ ID NO: 887374 - DNA, 25 bp, Mus musculus
caactcttattgcgctgtgcctaag

SEQ ID NO: 887375 - DNA, 25 bp, Mus musculus
caactcttattgggctgtgcctaag

SEQ ID NO: 887376 - DNA, 25 bp, Mus musculus
caactcttattgttggaaatctaca

SEQ ID NO: 887377 - DNA, 25 bp, Mus musculus
caactcttgcagcatgagaaaacta

SEQ ID NO: 887378 - DNA, 25 bp, Mus musculus
caactcttgcaggatgagaaaacta

SEQ ID NO: 887379 - DNA, 25 bp, Mus musculus
caactgaaagaggttggcatggcca

SEQ ID NO: 887380 - DNA, 25 bp, Mus musculus
caactgaaagctctctcggcgtaca

SEQ ID NO: 887381 - DNA, 25 bp, Mus musculus
caactgaaaggtctctcggcgtaca

SEQ ID NO: 887382 - DNA, 25 bp, Mus musculus
caactgaaagtggttggcatggcca

SEQ ID NO: 887383 - DNA, 25 bp, Mus musculus
caactgagaattcaagtctgtcacc

SEQ ID NO: 887384 - DNA, 25 bp, Mus musculus
caactgagaattcatgtctgtcacc

SEQ ID NO: 887385 - DNA, 25 bp, Mus musculus
caactgagagcggagcaaattttgc

SEQ ID NO: 887386 - DNA, 25 bp, Mus musculus
caactgagaggggagcaaattttgc

SEQ ID NO: 887387 - DNA, 25 bp, Mus musculus
caactgataaagatcccaaggaaga

SEQ ID NO: 887388 - DNA, 25 bp, Mus musculus
caactgataaagttcccaaggaaga

SEQ ID NO: 887389 - DNA, 25 bp, Mus musculus
caactgccagaaccttgtgcgctgg

SEQ ID NO: 887390 - DNA, 25 bp, Mus musculus
caactgccagcttatctgtgcgaca

SEQ ID NO: 887391 - DNA, 25 bp, Mus musculus
caactgccaggttatctgtgcgaca

SEQ ID NO: 887392 - DNA, 25 bp, Mus musculus
caactgccagtaccttgtgcgctgg

SEQ ID NO: 887393 - DNA, 25 bp, Mus musculus
caactgccctcatacgagttgctgc

SEQ ID NO: 887394 - DNA, 25 bp, Mus musculus
caactgccctcataggagttgctgc

SEQ ID NO: 887395 - DNA, 25 bp, Mus musculus
caactgctcacacagtcagtccgac

SEQ ID NO: 887396 - DNA, 25 bp, Mus musculus
caactgctcacagagtcagtccgac

SEQ ID NO: 887397 - DNA, 25 bp, Mus musculus
caactgctgaagacgtgactgcgcc

SEQ ID NO: 887398 - DNA, 25 bp, Mus musculus
caactgctgaagtcgtgactgcgcc

SEQ ID NO: 887399 - DNA, 25 bp, Mus musculus
caactggaagcacgacaacaatcct

SEQ ID NO: 887400 - DNA, 25 bp, Mus musculus
caactggaagcaggacaacaatcct

SEQ ID NO: 887401 - DNA, 25 bp, Mus musculus
caactggagatacaactgtttctca

SEQ ID NO: 887402 - DNA, 25 bp, Mus musculus
caactggagatagaactgtttctca

SEQ ID NO: 887403 - DNA, 25 bp, Mus musculus
caactggagcgtctcgtgctacaag

SEQ ID NO: 887404 - DNA, 25 bp, Mus musculus
caactggagcgtctggtgctacaag

SEQ ID NO: 887405 - DNA, 25 bp, Mus musculus
caactggcaatgaatgaatgcaaag

SEQ ID NO: 887406 - DNA, 25 bp, Mus musculus
caactggcaatgtatgaatgcaaag

SEQ ID NO: 887407 - DNA, 25 bp, Mus musculus
caactggcgacacgcccacatgcag

SEQ ID NO: 887408 - DNA, 25 bp, Mus musculus
caactggcgacacgctctgatgggc

SEQ ID NO: 887409 - DNA, 25 bp, Mus musculus
caactggcgacaggcccacatgcag

SEQ ID NO: 887410 - DNA, 25 bp, Mus musculus
caactggcgacaggctctgatgggc

SEQ ID NO: 887411 - DNA, 25 bp, Mus musculus
caactggctgatgcttgacttccct

SEQ ID NO: 887412 - DNA, 25 bp, Mus musculus
caactggctgttgcttgacttccct

SEQ ID NO: 887413 - DNA, 25 bp, Mus musculus
caactgggaaaagcagaggatggta

SEQ ID NO: 887414 - DNA, 25 bp, Mus musculus
caactgggaaaagctgaggatggta

SEQ ID NO: 887415 - DNA, 25 bp, Mus musculus
caactgtcaggactctcccagtgaa

SEQ ID NO: 887416 - DNA, 25 bp, Mus musculus
caactgtcaggagtctcccagtgaa

SEQ ID NO: 887417 - DNA, 25 bp, Mus musculus
caactgtgagcgacaggtacaaggt

SEQ ID NO: 887418 - DNA, 25 bp, Mus musculus
caactgtgagggacaggtacaaggt

SEQ ID NO: 887419 - DNA, 25 bp, Mus musculus
caacttaacaatgtggacatcggat

SEQ ID NO: 887420 - DNA, 25 bp, Mus musculus
caacttaacattgtggacatcggat

SEQ ID NO: 887421 - DNA, 25 bp, Mus musculus
caacttacaggaagttgtgccagcc

SEQ ID NO: 887422 - DNA, 25 bp, Mus musculus
caacttacaggatgttgtgccagcc

SEQ ID NO: 887423 - DNA, 25 bp, Mus musculus
caacttcaatgaattcctgttccgc

SEQ ID NO: 887424 - DNA, 25 bp, Mus musculus
caacttcaatgatttcctgttccgc

SEQ ID NO: 887425 - DNA, 25 bp, Mus musculus
caacttcctaaacttgtatctagtt

SEQ ID NO: 887426 - DNA, 25 bp, Mus musculus
caacttcctaaagttgtatctagtt

SEQ ID NO: 887427 - DNA, 25 bp, Mus musculus
caacttcctgaacggtgcccacgtg

SEQ ID NO: 887428 - DNA, 25 bp, Mus musculus
caacttcctgaagggtgcccacgtg

SEQ ID NO: 887429 - DNA, 25 bp, Mus musculus
caacttctcctcagtgtttacaaaa

SEQ ID NO: 887430 - DNA, 25 bp, Mus musculus
caacttctcctctgtgtttacaaaa

SEQ ID NO: 887431 - DNA, 25 bp, Mus musculus
caacttgagagcattggatatacaa

SEQ ID NO: 887432 - DNA, 25 bp, Mus musculus
caacttgagagctttggatatacaa

SEQ ID NO: 887433 - DNA, 25 bp, Mus musculus
caacttgataagcctaaagaggcca

SEQ ID NO: 887434 - DNA, 25 bp, Mus musculus
caacttgataaggctaaagaggcca

SEQ ID NO: 887435 - DNA, 25 bp, Mus musculus
caacttgattatcatgttccagaag

SEQ ID NO: 887436 - DNA, 25 bp, Mus musculus
caacttgattatgatgttccagaag

SEQ ID NO: 887437 - DNA, 25 bp, Mus musculus
caacttgctccctcccttagcgctc

SEQ ID NO: 887438 - DNA, 25 bp, Mus musculus
caacttgctccctcgcttagcgctc

SEQ ID NO: 887439 - DNA, 25 bp, Mus musculus
caacttggaatcccagaacaggagt

SEQ ID NO: 887440 - DNA, 25 bp, Mus musculus
caacttggaatccctgaacaggagt

SEQ ID NO: 887441 - DNA, 25 bp, Mus musculus
caacttggagagattaatattacag

SEQ ID NO: 887442 - DNA, 25 bp, Mus musculus
caacttggagagtttaatattacag

SEQ ID NO: 887443 - DNA, 25 bp, Mus musculus
caacttgtccaaattcgaggactcc

SEQ ID NO: 887444 - DNA, 25 bp, Mus musculus
caacttgtccaatttcgaggactcc

SEQ ID NO: 887445 - DNA, 25 bp, Mus musculus
caactttaagatggagccagatcct

SEQ ID NO: 887446 - DNA, 25 bp, Mus musculus
caactttaagttggagccagatcct

SEQ ID NO: 887447 - DNA, 25 bp, Mus musculus
caactttatcagcttcctggagagc

SEQ ID NO: 887448 - DNA, 25 bp, Mus musculus
caactttatcaggttcctggagagc

SEQ ID NO: 887449 - DNA, 25 bp, Mus musculus
caactttcagagctgcttaagtaga

SEQ ID NO: 887450 - DNA, 25 bp, Mus musculus
caactttcagtgctgcttaagtaga

SEQ ID NO: 887451 - DNA, 25 bp, Mus musculus
caagaaaaagtcaaagccatagcac

SEQ ID NO: 887452 - DNA, 25 bp, Mus musculus
caagaaaaagtcaatgccatagcac

SEQ ID NO: 887453 - DNA, 25 bp, Mus musculus
caagaaaaatatcgctgtagtgcct

SEQ ID NO: 887454 - DNA, 25 bp, Mus musculus
caagaaaaatttcgctgtagtgcct

SEQ ID NO: 887455 - DNA, 25 bp, Mus musculus
caagaaaaccaagaagtcgcctggc

SEQ ID NO: 887456 - DNA, 25 bp, Mus musculus
caagaaaaccaagatgtcgcctggc

SEQ ID NO: 887457 - DNA, 25 bp, Mus musculus
caagaaaactgtacattcgtatctt

SEQ ID NO: 887458 - DNA, 25 bp, Mus musculus
caagaaaactgttcattcgtatctt

SEQ ID NO: 887459 - DNA, 25 bp, Mus musculus
caagaaaatactcaattttctcagc

SEQ ID NO: 887460 - DNA, 25 bp, Mus musculus
caagaaaatactgaattttctcagc

SEQ ID NO: 887461 - DNA, 25 bp, Mus musculus
caagaaactccacgctgcgctggct

SEQ ID NO: 887462 - DNA, 25 bp, Mus musculus
caagaaactccaggctgcgctggct

SEQ ID NO: 887463 - DNA, 25 bp, Mus musculus
caagaaagaaatcgcaaaagatgtg

SEQ ID NO: 887464 - DNA, 25 bp, Mus musculus
caagaaagaaatggcaaaagatgtg

SEQ ID NO: 887465 - DNA, 25 bp, Mus musculus
caagaaagagattcaagccacagtg

SEQ ID NO: 887466 - DNA, 25 bp, Mus musculus
caagaaagagctgacgatcatctgt

SEQ ID NO: 887467 - DNA, 25 bp, Mus musculus
caagaaagagctgaggatcatctgt

SEQ ID NO: 887468 - DNA, 25 bp, Mus musculus
caagaaagagtttcaagccacagtg

SEQ ID NO: 887469 - DNA, 25 bp, Mus musculus
caagaaatttgacgcctctggcttc

SEQ ID NO: 887470 - DNA, 25 bp, Mus musculus
caagaaatttgaggcctctggcttc

SEQ ID NO: 887471 - DNA, 25 bp, Mus musculus
caagaacaagccccagtctgtgcga

SEQ ID NO: 887472 - DNA, 25 bp, Mus musculus
caagaacaaggcccagtctgtgcga

SEQ ID NO: 887473 - DNA, 25 bp, Mus musculus
caagaacacaaaagcgttttgtgca

SEQ ID NO: 887474 - DNA, 25 bp, Mus musculus
caagaacacaaaagggttttgtgca

SEQ ID NO: 887475 - DNA, 25 bp, Mus musculus
caagaacagtccaaatctcggtgct

SEQ ID NO: 887476 - DNA, 25 bp, Mus musculus
caagaacagtgcaaatctcggtgct

SEQ ID NO: 887477 - DNA, 25 bp, Mus musculus
caagaacagtgtcacccaaatctcg

SEQ ID NO: 887478 - DNA, 25 bp, Mus musculus
caagaacagtgtcagccaaatctcg

SEQ ID NO: 887479 - DNA, 25 bp, Mus musculus
caagaacatccacaacaactggcgg

SEQ ID NO: 887480 - DNA, 25 bp, Mus musculus
caagaacatccacgtcctgcctggc

SEQ ID NO: 887481 - DNA, 25 bp, Mus musculus
caagaacatccagaacaactggcgg

SEQ ID NO: 887482 - DNA, 25 bp, Mus musculus
caagaacatccaggtcctgcctggc

SEQ ID NO: 887483 - DNA, 25 bp, Mus musculus
caagaaccagacccgagtcagaact

SEQ ID NO: 887484 - DNA, 25 bp, Mus musculus
caagaaccagccgctcaactccact

SEQ ID NO: 887485 - DNA, 25 bp, Mus musculus
caagaaccaggcgctcaactccact

SEQ ID NO: 887486 - DNA, 25 bp, Mus musculus
caagaaccagtcccgagtcagaact

SEQ ID NO: 887487 - DNA, 25 bp, Mus musculus
caagaaccgaagccgtcctcctgag

SEQ ID NO: 887488 - DNA, 25 bp, Mus musculus
caagaaccgaaggcgtcctcctgag

SEQ ID NO: 887489 - DNA, 25 bp, Mus musculus
caagaaccggctcctgtccaaatat

SEQ ID NO: 887490 - DNA, 25 bp, Mus musculus
caagaaccgggtcctgtccaaatat

SEQ ID NO: 887491 - DNA, 25 bp, Mus musculus
caagaacctgagagagttctggaaa

SEQ ID NO: 887492 - DNA, 25 bp, Mus musculus
caagaacctgagtgagttctggaaa

SEQ ID NO: 887493 - DNA, 25 bp, Mus musculus
caagaacgccgacatggcccgaatg

SEQ ID NO: 887494 - DNA, 25 bp, Mus musculus
caagaacgccgagatggcccgaatg

SEQ ID NO: 887495 - DNA, 25 bp, Mus musculus
caagaactgacccacatggtttctg

SEQ ID NO: 887496 - DNA, 25 bp, Mus musculus
caagaactgacccagatggtttctg

SEQ ID NO: 887497 - DNA, 25 bp, Mus musculus
caagaactgcagaattgagctcctt

SEQ ID NO: 887498 - DNA, 25 bp, Mus musculus
caagaactgcagtattgagctcctt

SEQ ID NO: 887499 - DNA, 25 bp, Mus musculus
caagaactggagcccccaggtgttg

SEQ ID NO: 887500 - DNA, 25 bp, Mus musculus
caagaactggaggccccaggtgttg

SEQ ID NO: 887501 - DNA, 25 bp, Mus musculus
caagaactgtctttcgaatcaccac

SEQ ID NO: 887502 - DNA, 25 bp, Mus musculus
caagaactgtctttggaatcaccac

SEQ ID NO: 887503 - DNA, 25 bp, Mus musculus
caagaacttggttactattatcttc

SEQ ID NO: 887504 - DNA, 25 bp, Mus musculus
caagaacttggttagtattatcttc

SEQ ID NO: 887505 - DNA, 25 bp, Mus musculus
caagaagaactgagattcctactgg

SEQ ID NO: 887506 - DNA, 25 bp, Mus musculus
caagaagaactgtgattcctactgg

SEQ ID NO: 887507 - DNA, 25 bp, Mus musculus
caagaagaagagcgagcgagatctt

SEQ ID NO: 887508 - DNA, 25 bp, Mus musculus
caagaagaagagggagcgagatctt

SEQ ID NO: 887509 - DNA, 25 bp, Mus musculus
caagaagaggaactttgtagctgat

SEQ ID NO: 887510 - DNA, 25 bp, Mus musculus
caagaagaggaagtttgtagctgat

SEQ ID NO: 887511 - DNA, 25 bp, Mus musculus
caagaagatccacgtcggtcaccag

SEQ ID NO: 887512 - DNA, 25 bp, Mus musculus
caagaagatccaggtcggtcaccag

SEQ ID NO: 887513 - DNA, 25 bp, Mus musculus
caagaagatggccctctctttcagc

SEQ ID NO: 887514 - DNA, 25 bp, Mus musculus
caagaagatggccgtggcaaccctg

SEQ ID NO: 887515 - DNA, 25 bp, Mus musculus
caagaagatggcgctctctttcagc

SEQ ID NO: 887516 - DNA, 25 bp, Mus musculus
caagaagatggcggtggcaaccctg

SEQ ID NO: 887517 - DNA, 25 bp, Mus musculus
caagaagcagccagagacagtcccc

SEQ ID NO: 887518 - DNA, 25 bp, Mus musculus
caagaagcagcctcgcagccttcag

SEQ ID NO: 887519 - DNA, 25 bp, Mus musculus
caagaagcaggcagagacagtcccc

SEQ ID NO: 887520 - DNA, 25 bp, Mus musculus
caagaagcaggctcgcagccttcag

SEQ ID NO: 887521 - DNA, 25 bp, Mus musculus
caagaagccacacgaatcctgacct

SEQ ID NO: 887522 - DNA, 25 bp, Mus musculus
caagaagccacaggaatcctgacct

SEQ ID NO: 887523 - DNA, 25 bp, Mus musculus
caagaagccgggcgctctgccagta

SEQ ID NO: 887524 - DNA, 25 bp, Mus musculus
caagaagccgggggctctgccagta

SEQ ID NO: 887525 - DNA, 25 bp, Mus musculus
caagaagcgggcctccagtgctcgt

SEQ ID NO: 887526 - DNA, 25 bp, Mus musculus
caagaagcgggcgtccagtgctcgt

SEQ ID NO: 887527 - DNA, 25 bp, Mus musculus
caagaagctgctagagcactgggaa

SEQ ID NO: 887528 - DNA, 25 bp, Mus musculus
caagaagctgctagtgcactgggaa

SEQ ID NO: 887529 - DNA, 25 bp, Mus musculus
caagaaggagaacacaggctgggac

SEQ ID NO: 887530 - DNA, 25 bp, Mus musculus
caagaaggagaacgaacaagccaag

SEQ ID NO: 887531 - DNA, 25 bp, Mus musculus
caagaaggagaagacaggctgggac

SEQ ID NO: 887532 - DNA, 25 bp, Mus musculus
caagaaggagaaggaacaagccaag

SEQ ID NO: 887533 - DNA, 25 bp, Mus musculus
caagaaggcaagattactgtgtagc

SEQ ID NO: 887534 - DNA, 25 bp, Mus musculus
caagaaggcaagtttactgtgtagc

SEQ ID NO: 887535 - DNA, 25 bp, Mus musculus
caagaaggcaccagactttgtgttc

SEQ ID NO: 887536 - DNA, 25 bp, Mus musculus
caagaaggcacctgactttgtgttc

SEQ ID NO: 887537 - DNA, 25 bp, Mus musculus
caagaagttccaacctagatacttg

SEQ ID NO: 887538 - DNA, 25 bp, Mus musculus
caagaagttccaagaccccagatgg

SEQ ID NO: 887539 - DNA, 25 bp, Mus musculus
caagaagttccatcctagatacttg

SEQ ID NO: 887540 - DNA, 25 bp, Mus musculus
caagaagttccatgaccccagatgg

SEQ ID NO: 887541 - DNA, 25 bp, Mus musculus
caagaataacctcgcttcctgctac

SEQ ID NO: 887542 - DNA, 25 bp, Mus musculus
caagaataacctggcttcctgctac

SEQ ID NO: 887543 - DNA, 25 bp, Mus musculus
caagaataagtacaggagatcaacc

SEQ ID NO: 887544 - DNA, 25 bp, Mus musculus
caagaataagtagaggagatcaacc

SEQ ID NO: 887545 - DNA, 25 bp, Mus musculus
caagaatcaatgatacagcagctcg

SEQ ID NO: 887546 - DNA, 25 bp, Mus musculus
caagaatcaatgttacagcagctcg

SEQ ID NO: 887547 - DNA, 25 bp, Mus musculus
caagaatgacataggctcgtgagct

SEQ ID NO: 887548 - DNA, 25 bp, Mus musculus
caagaatgacatatttgccattggc

SEQ ID NO: 887549 - DNA, 25 bp, Mus musculus
caagaatgacattggctcgtgagct

SEQ ID NO: 887550 - DNA, 25 bp, Mus musculus
caagaatgacatttttgccattggc

SEQ ID NO: 887551 - DNA, 25 bp, Mus musculus
caagaattccataatgtgagctctc

SEQ ID NO: 887552 - DNA, 25 bp, Mus musculus
caagaattccattatgtgagctctc

SEQ ID NO: 887553 - DNA, 25 bp, Mus musculus
caagacaaagagcgacgaacagctt

SEQ ID NO: 887554 - DNA, 25 bp, Mus musculus
caagacaaagagggacgaacagctt

SEQ ID NO: 887555 - DNA, 25 bp, Mus musculus
caagacaaccacacagtccattttg

SEQ ID NO: 887556 - DNA, 25 bp, Mus musculus
caagacaaccacactgtccattttg

SEQ ID NO: 887557 - DNA, 25 bp, Mus musculus
caagacacccagaatgggctacaca

SEQ ID NO: 887558 - DNA, 25 bp, Mus musculus
caagacacccagcccagccacgctg

SEQ ID NO: 887559 - DNA, 25 bp, Mus musculus
caagacacccaggccagccacgctg

SEQ ID NO: 887560 - DNA, 25 bp, Mus musculus
caagacacccagtatgggctacaca

SEQ ID NO: 887561 - DNA, 25 bp, Mus musculus
caagacagtgagcggaaacaggcac

SEQ ID NO: 887562 - DNA, 25 bp, Mus musculus
caagacagtgaggggaaacaggcac

SEQ ID NO: 887563 - DNA, 25 bp, Mus musculus
caagacatagacttgccatgtagcc

SEQ ID NO: 887564 - DNA, 25 bp, Mus musculus
caagacatagctcattctggagtca

SEQ ID NO: 887565 - DNA, 25 bp, Mus musculus
caagacataggtcattctggagtca

SEQ ID NO: 887566 - DNA, 25 bp, Mus musculus
caagacatagtcttgccatgtagcc

SEQ ID NO: 887567 - DNA, 25 bp, Mus musculus
caagacattgagacaatagagtcca

SEQ ID NO: 887568 - DNA, 25 bp, Mus musculus
caagacattgagtcaatagagtcca

SEQ ID NO: 887569 - DNA, 25 bp, Mus musculus
caagaccaggcgttcaaggaaggtg

SEQ ID NO: 887570 - DNA, 25 bp, Mus musculus
caagaccaggggttcaaggaaggtg

SEQ ID NO: 887571 - DNA, 25 bp, Mus musculus
caagaccatccccgagcttctcaag

SEQ ID NO: 887572 - DNA, 25 bp, Mus musculus
caagaccatccccgtgcttctcaag

SEQ ID NO: 887573 - DNA, 25 bp, Mus musculus
caagacccacatctggcaagttccg

SEQ ID NO: 887574 - DNA, 25 bp, Mus musculus
caagacccacgcaaactacagctga

SEQ ID NO: 887575 - DNA, 25 bp, Mus musculus
caagacccacgctaactacagctga

SEQ ID NO: 887576 - DNA, 25 bp, Mus musculus
caagacccacttctggcaagttccg

SEQ ID NO: 887577 - DNA, 25 bp, Mus musculus
caagacccagcccacaacaagcctg

SEQ ID NO: 887578 - DNA, 25 bp, Mus musculus
caagacccagcccacgttccgagtc

SEQ ID NO: 887579 - DNA, 25 bp, Mus musculus
caagacccagcccagaacaagcctg

SEQ ID NO: 887580 - DNA, 25 bp, Mus musculus
caagacccagcccaggttccgagtc

SEQ ID NO: 887581 - DNA, 25 bp, Mus musculus
caagacccggcacggcgtggaggat

SEQ ID NO: 887582 - DNA, 25 bp, Mus musculus
caagacccggcagggcgtggaggat

SEQ ID NO: 887583 - DNA, 25 bp, Mus musculus
caagacccggcatgagtatctttcc

SEQ ID NO: 887584 - DNA, 25 bp, Mus musculus
caagacccgggatgagtatctttcc

SEQ ID NO: 887585 - DNA, 25 bp, Mus musculus
caagaccgccaacattgaggatgag

SEQ ID NO: 887586 - DNA, 25 bp, Mus musculus
caagaccgccaagattgaggatgag

SEQ ID NO: 887587 - DNA, 25 bp, Mus musculus
caagacctgcaacagctaggattgg

SEQ ID NO: 887588 - DNA, 25 bp, Mus musculus
caagacctgcaaccagagctaggat

SEQ ID NO: 887589 - DNA, 25 bp, Mus musculus
caagacctgcaacccctacctgacc

SEQ ID NO: 887590 - DNA, 25 bp, Mus musculus
caagacctgcaacgaatctccggtt

SEQ ID NO: 887591 - DNA, 25 bp, Mus musculus
caagacctgcaagagctaggattgg

SEQ ID NO: 887592 - DNA, 25 bp, Mus musculus
caagacctgcaagcagagctaggat

SEQ ID NO: 887593 - DNA, 25 bp, Mus musculus
caagacctgcaagccctacctgacc

SEQ ID NO: 887594 - DNA, 25 bp, Mus musculus
caagacctgcaaggaatctccggtt

SEQ ID NO: 887595 - DNA, 25 bp, Mus musculus
caagacgaagcaggcccagaagata

SEQ ID NO: 887596 - DNA, 25 bp, Mus musculus
caagacgaaggaggcccagaagata

SEQ ID NO: 887597 - DNA, 25 bp, Mus musculus
caagacgcagaagccgtttacaagc

SEQ ID NO: 887598 - DNA, 25 bp, Mus musculus
caagacgcagccgtttacaagctaa

SEQ ID NO: 887599 - DNA, 25 bp, Mus musculus
caagacgcaggcgtttacaagctaa

SEQ ID NO: 887600 - DNA, 25 bp, Mus musculus
caagacgcagtagccgtttacaagc

SEQ ID NO: 887601 - DNA, 25 bp, Mus musculus
caagactaccaacctccacttcgaa

SEQ ID NO: 887602 - DNA, 25 bp, Mus musculus
caagactaccaactgaacaccttta

SEQ ID NO: 887603 - DNA, 25 bp, Mus musculus
caagactaccaagctccacttcgaa

SEQ ID NO: 887604 - DNA, 25 bp, Mus musculus
caagactaccaagtgaacaccttta

SEQ ID NO: 887605 - DNA, 25 bp, Mus musculus
caagactcagaataagcctgcacga

SEQ ID NO: 887606 - DNA, 25 bp, Mus musculus
caagactcagacaccccttgatggt

SEQ ID NO: 887607 - DNA, 25 bp, Mus musculus
caagactcagacacgccttgatggt

SEQ ID NO: 887608 - DNA, 25 bp, Mus musculus
caagactcagtataagcctgcacga

SEQ ID NO: 887609 - DNA, 25 bp, Mus musculus
caagactgaatgcctggatggcaag

SEQ ID NO: 887610 - DNA, 25 bp, Mus musculus
caagactgaatggctggatggcaag

SEQ ID NO: 887611 - DNA, 25 bp, Mus musculus
caagactgggactgaaggtagagtc

SEQ ID NO: 887612 - DNA, 25 bp, Mus musculus
caagactgggtctgaaggtagagtc

SEQ ID NO: 887613 - DNA, 25 bp, Mus musculus
caagacttcaccacagtgtttacaa

SEQ ID NO: 887614 - DNA, 25 bp, Mus musculus
caagacttcaccactgtgtttacaa

SEQ ID NO: 887615 - DNA, 25 bp, Mus musculus
caagactttgaaccccgctacgtcc

SEQ ID NO: 887616 - DNA, 25 bp, Mus musculus
caagactttgaagcccgctacgtcc

SEQ ID NO: 887617 - DNA, 25 bp, Mus musculus
caagagaaaactctccctaatgcta

SEQ ID NO: 887618 - DNA, 25 bp, Mus musculus
caagagaaaactgtccctaatgcta

SEQ ID NO: 887619 - DNA, 25 bp, Mus musculus
caagagaaagatctcctgggctcag

SEQ ID NO: 887620 - DNA, 25 bp, Mus musculus
caagagaaagccttgtttgcagtcc

SEQ ID NO: 887621 - DNA, 25 bp, Mus musculus
caagagaaagcttcaattttatata

SEQ ID NO: 887622 - DNA, 25 bp, Mus musculus
caagagaaaggcttgtttgcagtcc

SEQ ID NO: 887623 - DNA, 25 bp, Mus musculus
caagagaaaggttcaattttatata

SEQ ID NO: 887624 - DNA, 25 bp, Mus musculus
caagagaaagttctcctgggctcag

SEQ ID NO: 887625 - DNA, 25 bp, Mus musculus
caagagaagaaactagttccagcag

SEQ ID NO: 887626 - DNA, 25 bp, Mus musculus
caagagaagaaacttccagcagcaa

SEQ ID NO: 887627 - DNA, 25 bp, Mus musculus
caagagaagaaagtagttccagcag

SEQ ID NO: 887628 - DNA, 25 bp, Mus musculus
caagagaagaaagttccagcagcaa

SEQ ID NO: 887629 - DNA, 25 bp, Mus musculus
caagagaagcacctcatgttcattc

SEQ ID NO: 887630 - DNA, 25 bp, Mus musculus
caagagaagcacctgatgttcattc

SEQ ID NO: 887631 - DNA, 25 bp, Mus musculus
caagagaatgagctgatgttcctgg

SEQ ID NO: 887632 - DNA, 25 bp, Mus musculus
caagagaatgtgaacaatagtcctg

SEQ ID NO: 887633 - DNA, 25 bp, Mus musculus
caagagaatgtgaagaatagtcctg

SEQ ID NO: 887634 - DNA, 25 bp, Mus musculus
caagagaatgtgctgatgttcctgg

SEQ ID NO: 887635 - DNA, 25 bp, Mus musculus
caagagacaacaatcgactatagag

SEQ ID NO: 887636 - DNA, 25 bp, Mus musculus
caagagacaacaatggactatagag

SEQ ID NO: 887637 - DNA, 25 bp, Mus musculus
caagagacagccagagatgcagctg

SEQ ID NO: 887638 - DNA, 25 bp, Mus musculus
caagagacaggcagagatgcagctg

SEQ ID NO: 887639 - DNA, 25 bp, Mus musculus
caagagagcaagctcatcattctgg

SEQ ID NO: 887640 - DNA, 25 bp, Mus musculus
caagagagcaaggtcatcattctgg

SEQ ID NO: 887641 - DNA, 25 bp, Mus musculus
caagagagcgcaagctctgcagagc

SEQ ID NO: 887642 - DNA, 25 bp, Mus musculus
caagagagcggaagctctgcagagc

SEQ ID NO: 887643 - DNA, 25 bp, Mus musculus
caagagataagaagtccatcatgtg

SEQ ID NO: 887644 - DNA, 25 bp, Mus musculus
caagagataagatgtccatcatgtg

SEQ ID NO: 887645 - DNA, 25 bp, Mus musculus
caagagatggaaaacgaccataagc

SEQ ID NO: 887646 - DNA, 25 bp, Mus musculus
caagagatggaatacgaccataagc

SEQ ID NO: 887647 - DNA, 25 bp, Mus musculus
caagagcaagaagaagcagaccatt

SEQ ID NO: 887648 - DNA, 25 bp, Mus musculus
caagagcaagattggcgccgagttc

SEQ ID NO: 887649 - DNA, 25 bp, Mus musculus
caagagcaagcccatgatgatgcca

SEQ ID NO: 887650 - DNA, 25 bp, Mus musculus
caagagcaagctcaacaagcatgca

SEQ ID NO: 887651 - DNA, 25 bp, Mus musculus
caagagcaaggccatgatgatgcca

SEQ ID NO: 887652 - DNA, 25 bp, Mus musculus
caagagcaaggtcaacaagcatgca

SEQ ID NO: 887653 - DNA, 25 bp, Mus musculus
caagagcaagtagaagcagaccatt

SEQ ID NO: 887654 - DNA, 25 bp, Mus musculus
caagagcaagtttggcgccgagttc

SEQ ID NO: 887655 - DNA, 25 bp, Mus musculus
caagagcagaggctcacatatctgc

SEQ ID NO: 887656 - DNA, 25 bp, Mus musculus
caagagcagagggtcacatatctgc

SEQ ID NO: 887657 - DNA, 25 bp, Mus musculus
caagagcagggccacatgtagtgct

SEQ ID NO: 887658 - DNA, 25 bp, Mus musculus
caagagcagggccactgctgagcag

SEQ ID NO: 887659 - DNA, 25 bp, Mus musculus
caagagcagggccagatgtagtgct

SEQ ID NO: 887660 - DNA, 25 bp, Mus musculus
caagagcagggccagtgctgagcag

SEQ ID NO: 887661 - DNA, 25 bp, Mus musculus
caagagcgatatgaaattgtaagca

SEQ ID NO: 887662 - DNA, 25 bp, Mus musculus
caagagcgatttgaaattgtaagca

SEQ ID NO: 887663 - DNA, 25 bp, Mus musculus
caagagctcagggacgttgctacct

SEQ ID NO: 887664 - DNA, 25 bp, Mus musculus
caagagctcagggaggttgctacct

SEQ ID NO: 887665 - DNA, 25 bp, Mus musculus
caagagctccgacacgctatccggc

SEQ ID NO: 887666 - DNA, 25 bp, Mus musculus
caagagctccgagacgctatccggc

SEQ ID NO: 887667 - DNA, 25 bp, Mus musculus
caagagctccggctctgaagtgtcc

SEQ ID NO: 887668 - DNA, 25 bp, Mus musculus
caagagctccgggtctgaagtgtcc

SEQ ID NO: 887669 - DNA, 25 bp, Mus musculus
caagagctcgaacgcatacacagtc

SEQ ID NO: 887670 - DNA, 25 bp, Mus musculus
caagagctcgaaggcatacacagtc

SEQ ID NO: 887671 - DNA, 25 bp, Mus musculus
caagagctctgacctggaaggtgat

SEQ ID NO: 887672 - DNA, 25 bp, Mus musculus
caagagctctgagctggaaggtgat

SEQ ID NO: 887673 - DNA, 25 bp, Mus musculus
caagagcttgtcagaatcaggtctg

SEQ ID NO: 887674 - DNA, 25 bp, Mus musculus
caagagcttgtcagtatcaggtctg

SEQ ID NO: 887675 - DNA, 25 bp, Mus musculus
caagagcttttgcacagaagaatgg

SEQ ID NO: 887676 - DNA, 25 bp, Mus musculus
caagagcttttgcagagaagaatgg

SEQ ID NO: 887677 - DNA, 25 bp, Mus musculus
caagaggaagccagtagagtccatc

SEQ ID NO: 887678 - DNA, 25 bp, Mus musculus
caagaggaagcccgaggatgagagc

SEQ ID NO: 887679 - DNA, 25 bp, Mus musculus
caagaggaagcctgttgtccctgga

SEQ ID NO: 887680 - DNA, 25 bp, Mus musculus
caagaggaagctgtgtggagatgtt

SEQ ID NO: 887681 - DNA, 25 bp, Mus musculus
caagaggaagcttagcgcggatgga

SEQ ID NO: 887682 - DNA, 25 bp, Mus musculus
caagaggaaggcagtagagtccatc

SEQ ID NO: 887683 - DNA, 25 bp, Mus musculus
caagaggaaggccgaggatgagagc

SEQ ID NO: 887684 - DNA, 25 bp, Mus musculus
caagaggaaggctgttgtccctgga

SEQ ID NO: 887685 - DNA, 25 bp, Mus musculus
caagaggaaggtgtgtggagatgtt

SEQ ID NO: 887686 - DNA, 25 bp, Mus musculus
caagaggaaggttagcgcggatgga

SEQ ID NO: 887687 - DNA, 25 bp, Mus musculus
caagaggacgctgtgccgatgctct

SEQ ID NO: 887688 - DNA, 25 bp, Mus musculus
caagaggacggtgtgccgatgctct

SEQ ID NO: 887689 - DNA, 25 bp, Mus musculus
caagaggagccaagaatgtatcatt

SEQ ID NO: 887690 - DNA, 25 bp, Mus musculus
caagaggagccatgaatgtatcatt

SEQ ID NO: 887691 - DNA, 25 bp, Mus musculus
caagaggaggggatatcatgctttt

SEQ ID NO: 887692 - DNA, 25 bp, Mus musculus
caagaggaggggccatgaatcctac

SEQ ID NO: 887693 - DNA, 25 bp, Mus musculus
caagaggagggggcatgaatcctac

SEQ ID NO: 887694 - DNA, 25 bp, Mus musculus
caagaggaggggttatcatgctttt

SEQ ID NO: 887695 - DNA, 25 bp, Mus musculus
caagaggatgagatcgactggggtg

SEQ ID NO: 887696 - DNA, 25 bp, Mus musculus
caagaggatgagttcgactggggtg

SEQ ID NO: 887697 - DNA, 25 bp, Mus musculus
caagaggcagatgggcatatcaagt

SEQ ID NO: 887698 - DNA, 25 bp, Mus musculus
caagaggcagctgtactaccaagtc

SEQ ID NO: 887699 - DNA, 25 bp, Mus musculus
caagaggcaggtgtactaccaagtc

SEQ ID NO: 887700 - DNA, 25 bp, Mus musculus
caagaggcagttgggcatatcaagt

SEQ ID NO: 887701 - DNA, 25 bp, Mus musculus
caagaggcggctcacgtgttataga

SEQ ID NO: 887702 - DNA, 25 bp, Mus musculus
caagaggcggctcacgtttctccca

SEQ ID NO: 887703 - DNA, 25 bp, Mus musculus
caagaggcggctcaggtgttataga

SEQ ID NO: 887704 - DNA, 25 bp, Mus musculus
caagaggcggctcaggtttctccca

SEQ ID NO: 887705 - DNA, 25 bp, Mus musculus
caagaggcgtgacgtgctttcagct

SEQ ID NO: 887706 - DNA, 25 bp, Mus musculus
caagaggcgtgaggtgctttcagct

SEQ ID NO: 887707 - DNA, 25 bp, Mus musculus
caagagggagagaatatgctggctt

SEQ ID NO: 887708 - DNA, 25 bp, Mus musculus
caagagggagagtatatgctggctt

SEQ ID NO: 887709 - DNA, 25 bp, Mus musculus
caagagggagatccacttaaatgga

SEQ ID NO: 887710 - DNA, 25 bp, Mus musculus
caagagggagatgcacttaaatgga

SEQ ID NO: 887711 - DNA, 25 bp, Mus musculus
caagaggttccacgagacctttgag

SEQ ID NO: 887712 - DNA, 25 bp, Mus musculus
caagaggttccaggagacctttgag

SEQ ID NO: 887713 - DNA, 25 bp, Mus musculus
caagagtcagatccaggcttttaca

SEQ ID NO: 887714 - DNA, 25 bp, Mus musculus
caagagtcagttccaggcttttaca

SEQ ID NO: 887715 - DNA, 25 bp, Mus musculus
caagagtgaccacccgtgggaatgg

SEQ ID NO: 887716 - DNA, 25 bp, Mus musculus
caagagtgaccagccgtgggaatgg

SEQ ID NO: 887717 - DNA, 25 bp, Mus musculus
caagagtgagcccaggcccgagtcc

SEQ ID NO: 887718 - DNA, 25 bp, Mus musculus
caagagtgaggccaggcccgagtcc

SEQ ID NO: 887719 - DNA, 25 bp, Mus musculus
caagagtgcaagcacttgaatgctg

SEQ ID NO: 887720 - DNA, 25 bp, Mus musculus
caagagtgcaaggacttgaatgctg

SEQ ID NO: 887721 - DNA, 25 bp, Mus musculus
caagagtgccagcctgaacctgtgg

SEQ ID NO: 887722 - DNA, 25 bp, Mus musculus
caagagtgccaggctgaacctgtgg

SEQ ID NO: 887723 - DNA, 25 bp, Mus musculus
caagataaagctcacttcaattgct

SEQ ID NO: 887724 - DNA, 25 bp, Mus musculus
caagataaaggtcacttcaattgct

SEQ ID NO: 887725 - DNA, 25 bp, Mus musculus
caagataagagaaatgccagaattt

SEQ ID NO: 887726 - DNA, 25 bp, Mus musculus
caagataagagatatgccagaattt

SEQ ID NO: 887727 - DNA, 25 bp, Mus musculus
caagataatcagacggcgcttgcag

SEQ ID NO: 887728 - DNA, 25 bp, Mus musculus
caagataatcagtcggcgcttgcag

SEQ ID NO: 887729 - DNA, 25 bp, Mus musculus
caagatacagacgagcctgggtggg

SEQ ID NO: 887730 - DNA, 25 bp, Mus musculus
caagatacagtcgagcctgggtggg

SEQ ID NO: 887731 - DNA, 25 bp, Mus musculus
caagataccttccacgtgtgaaccc

SEQ ID NO: 887732 - DNA, 25 bp, Mus musculus
caagataccttccaggtgtgaaccc

SEQ ID NO: 887733 - DNA, 25 bp, Mus musculus
caagatattaagcagaactgcctca

SEQ ID NO: 887734 - DNA, 25 bp, Mus musculus
caagatattaaggagaactgcctca

SEQ ID NO: 887735 - DNA, 25 bp, Mus musculus
caagatattcagctggatccagacc

SEQ ID NO: 887736 - DNA, 25 bp, Mus musculus
caagatattcaggtggatccagacc

SEQ ID NO: 887737 - DNA, 25 bp, Mus musculus
caagatcaagaccgctgaccaccag

SEQ ID NO: 887738 - DNA, 25 bp, Mus musculus
caagatcaagagtcggatggaatgc

SEQ ID NO: 887739 - DNA, 25 bp, Mus musculus
caagatcaagtccgctgaccaccag

SEQ ID NO: 887740 - DNA, 25 bp, Mus musculus
caagatcaagtgtcggatggaatgc

SEQ ID NO: 887741 - DNA, 25 bp, Mus musculus
caagatcacgcgcgaccccaacatc

SEQ ID NO: 887742 - DNA, 25 bp, Mus musculus
caagatcacgggcgaccccaacatc

SEQ ID NO: 887743 - DNA, 25 bp, Mus musculus
caagatcataaactcctgccccgaa

SEQ ID NO: 887744 - DNA, 25 bp, Mus musculus
caagatcataaagtcctgccccgaa

SEQ ID NO: 887745 - DNA, 25 bp, Mus musculus
caagatccacaaagaggcggttaca

SEQ ID NO: 887746 - DNA, 25 bp, Mus musculus
caagatccacaaagtggcggttaca

SEQ ID NO: 887747 - DNA, 25 bp, Mus musculus
caagatccagacactgggcctgggg

SEQ ID NO: 887748 - DNA, 25 bp, Mus musculus
caagatccagtcactgggcctgggg

SEQ ID NO: 887749 - DNA, 25 bp, Mus musculus
caagatcccaagcttctggtggaag

SEQ ID NO: 887750 - DNA, 25 bp, Mus musculus
caagatcccaaggttctggtggaag

SEQ ID NO: 887751 - DNA, 25 bp, Mus musculus
caagatcccactgattatagagcga

SEQ ID NO: 887752 - DNA, 25 bp, Mus musculus
caagatcccagtgattatagagcga

SEQ ID NO: 887753 - DNA, 25 bp, Mus musculus
caagatccggaacgtcacttccaac

SEQ ID NO: 887754 - DNA, 25 bp, Mus musculus
caagatccggtacgtcacttccaac

SEQ ID NO: 887755 - DNA, 25 bp, Mus musculus
caagatcctgatccaagactaccac

SEQ ID NO: 887756 - DNA, 25 bp, Mus musculus
caagatcctggaccacttggaatct

SEQ ID NO: 887757 - DNA, 25 bp, Mus musculus
caagatcctggagcacttggaatct

SEQ ID NO: 887758 - DNA, 25 bp, Mus musculus
caagatcctgttccaagactaccac

SEQ ID NO: 887759 - DNA, 25 bp, Mus musculus
caagatcgcctccaccctatttaag

SEQ ID NO: 887760 - DNA, 25 bp, Mus musculus
caagatcgcctccacgccagcagca

SEQ ID NO: 887761 - DNA, 25 bp, Mus musculus
caagatcgcctccagcctatttaag

SEQ ID NO: 887762 - DNA, 25 bp, Mus musculus
caagatcgcctccaggccagcagca

SEQ ID NO: 887763 - DNA, 25 bp, Mus musculus
caagatcggatccacgccctggggc

SEQ ID NO: 887764 - DNA, 25 bp, Mus musculus
caagatcggatccaggccctggggc

SEQ ID NO: 887765 - DNA, 25 bp, Mus musculus
caagatctatgatgaacaacatgcc

SEQ ID NO: 887766 - DNA, 25 bp, Mus musculus
caagatctatgatgtacaacatgcc

SEQ ID NO: 887767 - DNA, 25 bp, Mus musculus
caagatctcgctggatatgttctct

SEQ ID NO: 887768 - DNA, 25 bp, Mus musculus
caagatctcggtggatatgttctct

SEQ ID NO: 887769 - DNA, 25 bp, Mus musculus
caagatctgaaacttgggatggcta

SEQ ID NO: 887770 - DNA, 25 bp, Mus musculus
caagatctgaaagttgggatggcta

SEQ ID NO: 887771 - DNA, 25 bp, Mus musculus
caagatctggcacttggagggcaag

SEQ ID NO: 887772 - DNA, 25 bp, Mus musculus
caagatctgggacttggagggcaag

SEQ ID NO: 887773 - DNA, 25 bp, Mus musculus
caagatgaaacacgagccggttcga

SEQ ID NO: 887774 - DNA, 25 bp, Mus musculus
caagatgaaacaggagccggttcga

SEQ ID NO: 887775 - DNA, 25 bp, Mus musculus
caagatgaacacaaaaacccagcac

SEQ ID NO: 887776 - DNA, 25 bp, Mus musculus
caagatgaacactaaaacccagcac

SEQ ID NO: 887777 - DNA, 25 bp, Mus musculus
caagatgactaacatgctaaaagga

SEQ ID NO: 887778 - DNA, 25 bp, Mus musculus
caagatgactaagatgctaaaagga

SEQ ID NO: 887779 - DNA, 25 bp, Mus musculus
caagatgagacacgagacaatcagg

SEQ ID NO: 887780 - DNA, 25 bp, Mus musculus
caagatgagacaggagacaatcagg

SEQ ID NO: 887781 - DNA, 25 bp, Mus musculus
caagatgagtctcacgaacctgaca

SEQ ID NO: 887782 - DNA, 25 bp, Mus musculus
caagatgagtctcacgttccacgag

SEQ ID NO: 887783 - DNA, 25 bp, Mus musculus
caagatgagtctcaggaacctgaca

SEQ ID NO: 887784 - DNA, 25 bp, Mus musculus
caagatgagtctcaggttccacgag

SEQ ID NO: 887785 - DNA, 25 bp, Mus musculus
caagatgatgcccacaccagttatc

SEQ ID NO: 887786 - DNA, 25 bp, Mus musculus
caagatgatggccacaccagttatc

SEQ ID NO: 887787 - DNA, 25 bp, Mus musculus
caagatgcccaaatcaacgtccggg

SEQ ID NO: 887788 - DNA, 25 bp, Mus musculus
caagatgcccaattcaacgtccggg

SEQ ID NO: 887789 - DNA, 25 bp, Mus musculus
caagatggagcagatcgggcgcatc

SEQ ID NO: 887790 - DNA, 25 bp, Mus musculus
caagatggaggagatcgggcgcatc

SEQ ID NO: 887791 - DNA, 25 bp, Mus musculus
caagatgggctgtgcctcttaggca

SEQ ID NO: 887792 - DNA, 25 bp, Mus musculus
caagatgggctgtggctcttaggca

SEQ ID NO: 887793 - DNA, 25 bp, Mus musculus
caagatgtacctagaaaccatgtga

SEQ ID NO: 887794 - DNA, 25 bp, Mus musculus
caagatgtaccttgaaaccatgtga

SEQ ID NO: 887795 - DNA, 25 bp, Mus musculus
caagattacgcccgaagactgtact

SEQ ID NO: 887796 - DNA, 25 bp, Mus musculus
caagattacgctacagcaagggaga

SEQ ID NO: 887797 - DNA, 25 bp, Mus musculus
caagattacggccgaagactgtact

SEQ ID NO: 887798 - DNA, 25 bp, Mus musculus
caagattacggtacagcaagggaga

SEQ ID NO: 887799 - DNA, 25 bp, Mus musculus
caagattgccagctggaatgtgctg

SEQ ID NO: 887800 - DNA, 25 bp, Mus musculus
caagattgccaggtggaatgtgctg

SEQ ID NO: 887801 - DNA, 25 bp, Mus musculus
caagatttatgacactaccgttaat

SEQ ID NO: 887802 - DNA, 25 bp, Mus musculus
caagatttatgagactaccgttaat

SEQ ID NO: 887803 - DNA, 25 bp, Mus musculus
caagatttggattcaagtcaatctg

SEQ ID NO: 887804 - DNA, 25 bp, Mus musculus
caagatttggtttcaagtcaatctg

SEQ ID NO: 887805 - DNA, 25 bp, Mus musculus
caagcaaaactgaacgatctgaacc

SEQ ID NO: 887806 - DNA, 25 bp, Mus musculus
caagcaaaactgaacgatggcgtgg

SEQ ID NO: 887807 - DNA, 25 bp, Mus musculus
caagcaaaactgaaggatctgaacc

SEQ ID NO: 887808 - DNA, 25 bp, Mus musculus
caagcaaaactgaaggatggcgtgg

SEQ ID NO: 887809 - DNA, 25 bp, Mus musculus
caagcaaatgatcaaacttcaagag

SEQ ID NO: 887810 - DNA, 25 bp, Mus musculus
caagcaaatgttcaaacttcaagag

SEQ ID NO: 887811 - DNA, 25 bp, Mus musculus
caagcacaagctgagactgtggaga

SEQ ID NO: 887812 - DNA, 25 bp, Mus musculus
caagcacaaggaacagtttgatgaa

SEQ ID NO: 887813 - DNA, 25 bp, Mus musculus
caagcacaaggaactgtttgatgaa

SEQ ID NO: 887814 - DNA, 25 bp, Mus musculus
caagcacaaggtgagactgtggaga

SEQ ID NO: 887815 - DNA, 25 bp, Mus musculus
caagcacacagtacctagtcactcg

SEQ ID NO: 887816 - DNA, 25 bp, Mus musculus
caagcacacagttcctagtcactcg

SEQ ID NO: 887817 - DNA, 25 bp, Mus musculus
caagcacagcagaatcgccagccgc

SEQ ID NO: 887818 - DNA, 25 bp, Mus musculus
caagcacagcagtatcgccagccgc

SEQ ID NO: 887819 - DNA, 25 bp, Mus musculus
caagcacatgaatgaaacaagccac

SEQ ID NO: 887820 - DNA, 25 bp, Mus musculus
caagcacatgtatgaaacaagccac

SEQ ID NO: 887821 - DNA, 25 bp, Mus musculus
caagcaccgtgtcaccatgaacgag

SEQ ID NO: 887822 - DNA, 25 bp, Mus musculus
caagcaccgtgtgaccatgaacgag

SEQ ID NO: 887823 - DNA, 25 bp, Mus musculus
caagcacgggccgggggcagagatc

SEQ ID NO: 887824 - DNA, 25 bp, Mus musculus
caagcacggggcgggggcagagatc

SEQ ID NO: 887825 - DNA, 25 bp, Mus musculus
caagcacgtgcttgaagacttgatt

SEQ ID NO: 887826 - DNA, 25 bp, Mus musculus
caagcacgtggttgaagacttgatt

SEQ ID NO: 887827 - DNA, 25 bp, Mus musculus
caagcactctcacgctaccggctct

SEQ ID NO: 887828 - DNA, 25 bp, Mus musculus
caagcactctcaggctaccggctct

SEQ ID NO: 887829 - DNA, 25 bp, Mus musculus
caagcagaaagagacagaacgaatt

SEQ ID NO: 887830 - DNA, 25 bp, Mus musculus
caagcagaaagagagagaacgaatt

SEQ ID NO: 887831 - DNA, 25 bp, Mus musculus
caagcagaagcaacagaaagctgca

SEQ ID NO: 887832 - DNA, 25 bp, Mus musculus
caagcagaagctggtgaagctaaag

SEQ ID NO: 887833 - DNA, 25 bp, Mus musculus
caagcagaaggaacagaaagctgca

SEQ ID NO: 887834 - DNA, 25 bp, Mus musculus
caagcagaaggtggtgaagctaaag

SEQ ID NO: 887835 - DNA, 25 bp, Mus musculus
caagcagaggaggacgtcacgctca

SEQ ID NO: 887836 - DNA, 25 bp, Mus musculus
caagcagaggaggaggtcacgctca

SEQ ID NO: 887837 - DNA, 25 bp, Mus musculus
caagcagatgaacatcatccatgaa

SEQ ID NO: 887838 - DNA, 25 bp, Mus musculus
caagcagatgaagatcatccatgaa

SEQ ID NO: 887839 - DNA, 25 bp, Mus musculus
caagcagatgggacagcaaagagcc

SEQ ID NO: 887840 - DNA, 25 bp, Mus musculus
caagcagatgggtcagcaaagagcc

SEQ ID NO: 887841 - DNA, 25 bp, Mus musculus
caagcagcaagaaacgtacccctgc

SEQ ID NO: 887842 - DNA, 25 bp, Mus musculus
caagcagcaagaaaggtacccctgc

SEQ ID NO: 887843 - DNA, 25 bp, Mus musculus
caagcagcagcccaaacaatcctcc

SEQ ID NO: 887844 - DNA, 25 bp, Mus musculus
caagcagcagcccatacaatcctcc

SEQ ID NO: 887845 - DNA, 25 bp, Mus musculus
caagcagcagggaacgctttgccac

SEQ ID NO: 887846 - DNA, 25 bp, Mus musculus
caagcagcagggaactcaggctttg

SEQ ID NO: 887847 - DNA, 25 bp, Mus musculus
caagcagcagggaaggctttgccac

SEQ ID NO: 887848 - DNA, 25 bp, Mus musculus
caagcagcagggaagtcaggctttg

SEQ ID NO: 887849 - DNA, 25 bp, Mus musculus
caagcagcctagtggcagcaaccct

SEQ ID NO: 887850 - DNA, 25 bp, Mus musculus
caagcagccttgtggcagcaaccct

SEQ ID NO: 887851 - DNA, 25 bp, Mus musculus
caagcaggagatcctggacaagcca

SEQ ID NO: 887852 - DNA, 25 bp, Mus musculus
caagcaggagttcctggacaagcca

SEQ ID NO: 887853 - DNA, 25 bp, Mus musculus
caagcaggcatattagcctgcataa

SEQ ID NO: 887854 - DNA, 25 bp, Mus musculus
caagcaggcatatttgcctgcataa

SEQ ID NO: 887855 - DNA, 25 bp, Mus musculus
caagcagggaccaggccctctgcca

SEQ ID NO: 887856 - DNA, 25 bp, Mus musculus
caagcagggaccatggttggggtgc

SEQ ID NO: 887857 - DNA, 25 bp, Mus musculus
caagcagggacctggccctctgcca

SEQ ID NO: 887858 - DNA, 25 bp, Mus musculus
caagcagggaccttggttggggtgc

SEQ ID NO: 887859 - DNA, 25 bp, Mus musculus
caagcagggcatcaactataaaaag

SEQ ID NO: 887860 - DNA, 25 bp, Mus musculus
caagcagggcatcatctataaaaag

SEQ ID NO: 887861 - DNA, 25 bp, Mus musculus
caagcagtgctacttgggtgcaaag

SEQ ID NO: 887862 - DNA, 25 bp, Mus musculus
caagcagtgctagttgggtgcaaag

SEQ ID NO: 887863 - DNA, 25 bp, Mus musculus
caagcatacagaccctatcagaatt

SEQ ID NO: 887864 - DNA, 25 bp, Mus musculus
caagcatacagagcctatcagaatt

SEQ ID NO: 887865 - DNA, 25 bp, Mus musculus
caagccaaagcgctcatccaggttg

SEQ ID NO: 887866 - DNA, 25 bp, Mus musculus
caagccaaagggctcatccaggttg

SEQ ID NO: 887867 - DNA, 25 bp, Mus musculus
caagccaacaagagctctgaagata

SEQ ID NO: 887868 - DNA, 25 bp, Mus musculus
caagccaacaagtgctctgaagata

SEQ ID NO: 887869 - DNA, 25 bp, Mus musculus
caagccaagcagagtttgaaaggaa

SEQ ID NO: 887870 - DNA, 25 bp, Mus musculus
caagccaagcagtgtttgaaaggaa

SEQ ID NO: 887871 - DNA, 25 bp, Mus musculus
caagccacagcaatgtggggctgga

SEQ ID NO: 887872 - DNA, 25 bp, Mus musculus
caagccacagcatggtgacattata

SEQ ID NO: 887873 - DNA, 25 bp, Mus musculus
caagccacaggaatgtggggctgga

SEQ ID NO: 887874 - DNA, 25 bp, Mus musculus
caagccacaggatggtgacattata

SEQ ID NO: 887875 - DNA, 25 bp, Mus musculus
caagccacgagacgtgagggagttt

SEQ ID NO: 887876 - DNA, 25 bp, Mus musculus
caagccacgagaggtgagggagttt

SEQ ID NO: 887877 - DNA, 25 bp, Mus musculus
caagccacggagctggaaatgagct

SEQ ID NO: 887878 - DNA, 25 bp, Mus musculus
caagccacggaggtggaaatgagct

SEQ ID NO: 887879 - DNA, 25 bp, Mus musculus
caagccactctagcagtgttccgaa

SEQ ID NO: 887880 - DNA, 25 bp, Mus musculus
caagccactctagctgtgttccgaa

SEQ ID NO: 887881 - DNA, 25 bp, Mus musculus
caagccagaatactcgggtggctac

SEQ ID NO: 887882 - DNA, 25 bp, Mus musculus
caagccagaatactggggtggctac

SEQ ID NO: 887883 - DNA, 25 bp, Mus musculus
caagccagatcgacagcaaagagcc

SEQ ID NO: 887884 - DNA, 25 bp, Mus musculus
caagccagatcgccctacatgaaga

SEQ ID NO: 887885 - DNA, 25 bp, Mus musculus
caagccagatcggcctacatgaaga

SEQ ID NO: 887886 - DNA, 25 bp, Mus musculus
caagccagatcgtcagcaaagagcc

SEQ ID NO: 887887 - DNA, 25 bp, Mus musculus
caagccatcactaacatcaaaccac

SEQ ID NO: 887888 - DNA, 25 bp, Mus musculus
caagccatcactaagatcaaaccac

SEQ ID NO: 887889 - DNA, 25 bp, Mus musculus
caagccatcgctcagaagcgtagga

SEQ ID NO: 887890 - DNA, 25 bp, Mus musculus
caagccatcgctgagaagcgtagga

SEQ ID NO: 887891 - DNA, 25 bp, Mus musculus
caagccatggaacactgtgggagca

SEQ ID NO: 887892 - DNA, 25 bp, Mus musculus
caagccatggtacactgtgggagca

SEQ ID NO: 887893 - DNA, 25 bp, Mus musculus
caagcccatcagaaaatcaccgtgc

SEQ ID NO: 887894 - DNA, 25 bp, Mus musculus
caagcccatcagtaaatcaccgtgc

SEQ ID NO: 887895 - DNA, 25 bp, Mus musculus
caagcccatgaagtgcccccgcctg

SEQ ID NO: 887896 - DNA, 25 bp, Mus musculus
caagcccatgtagtgcccccgcctg

SEQ ID NO: 887897 - DNA, 25 bp, Mus musculus
caagccccagcagtcggtgacattc

SEQ ID NO: 887898 - DNA, 25 bp, Mus musculus
caagccccaggagtcggtgacattc

SEQ ID NO: 887899 - DNA, 25 bp, Mus musculus
caagccccctgacgtgacaaaccga

SEQ ID NO: 887900 - DNA, 25 bp, Mus musculus
caagccccctgaggtgacaaaccga

SEQ ID NO: 887901 - DNA, 25 bp, Mus musculus
caagccccctgcaacggtgactctg

SEQ ID NO: 887902 - DNA, 25 bp, Mus musculus
caagccccctgcaagggtgactctg

SEQ ID NO: 887903 - DNA, 25 bp, Mus musculus
caagcccctcagcttctgtgctgaa

SEQ ID NO: 887904 - DNA, 25 bp, Mus musculus
caagcccctcaggttctgtgctgaa

SEQ ID NO: 887905 - DNA, 25 bp, Mus musculus
caagcccctgccgacacccatcggc

SEQ ID NO: 887906 - DNA, 25 bp, Mus musculus
caagcccctgcgacacctgcggctc

SEQ ID NO: 887907 - DNA, 25 bp, Mus musculus
caagcccctggcgacacccatcggc

SEQ ID NO: 887908 - DNA, 25 bp, Mus musculus
caagcccctgggacacctgcggctc

SEQ ID NO: 887909 - DNA, 25 bp, Mus musculus
caagccctatttcacgaaactccca

SEQ ID NO: 887910 - DNA, 25 bp, Mus musculus
caagccctatttcacgttgtctact

SEQ ID NO: 887911 - DNA, 25 bp, Mus musculus
caagccctatttcaggaaactccca

SEQ ID NO: 887912 - DNA, 25 bp, Mus musculus
caagccctatttcaggttgtctact

SEQ ID NO: 887913 - DNA, 25 bp, Mus musculus
caagccctcaggctgtgaatctcct

SEQ ID NO: 887914 - DNA, 25 bp, Mus musculus
caagccctcagggtgtgaatctcct

SEQ ID NO: 887915 - DNA, 25 bp, Mus musculus
caagccgaagcgcctggcgtatgtg

SEQ ID NO: 887916 - DNA, 25 bp, Mus musculus
caagccgaagggcctggcgtatgtg

SEQ ID NO: 887917 - DNA, 25 bp, Mus musculus
caagccgccttccaccatgcagttt

SEQ ID NO: 887918 - DNA, 25 bp, Mus musculus
caagccgccttcgaccatgcagttt

SEQ ID NO: 887919 - DNA, 25 bp, Mus musculus
caagccggtgcccggctttcaggta

SEQ ID NO: 887920 - DNA, 25 bp, Mus musculus
caagccggtgccgggctttcaggta

SEQ ID NO: 887921 - DNA, 25 bp, Mus musculus
caagccgtgtgcaccgtgaaaccta

SEQ ID NO: 887922 - DNA, 25 bp, Mus musculus
caagccgtgtgcacggtgaaaccta

SEQ ID NO: 887923 - DNA, 25 bp, Mus musculus
caagcctacaaagacgcctttgcca

SEQ ID NO: 887924 - DNA, 25 bp, Mus musculus
caagcctacaaagaggcctttgcca

SEQ ID NO: 887925 - DNA, 25 bp, Mus musculus
caagcctcgcagatcagagccttga

SEQ ID NO: 887926 - DNA, 25 bp, Mus musculus
caagcctcgcagatgagagccttga

SEQ ID NO: 887927 - DNA, 25 bp, Mus musculus
caagcctgagcactgggacaagcca

SEQ ID NO: 887928 - DNA, 25 bp, Mus musculus
caagcctgagcactgggatgaagag

SEQ ID NO: 887929 - DNA, 25 bp, Mus musculus
caagcctgaggactgggacaagcca

SEQ ID NO: 887930 - DNA, 25 bp, Mus musculus
caagcctgaggactgggatgaagag

SEQ ID NO: 887931 - DNA, 25 bp, Mus musculus
caagcctgccaacaccctaccactg

SEQ ID NO: 887932 - DNA, 25 bp, Mus musculus
caagcctgccaagaccctaccactg

SEQ ID NO: 887933 - DNA, 25 bp, Mus musculus
caagcctgcgcacttgactgcgttg

SEQ ID NO: 887934 - DNA, 25 bp, Mus musculus
caagcctgcggacttgactgcgttg

SEQ ID NO: 887935 - DNA, 25 bp, Mus musculus
caagccttcctgcgctttacatatg

SEQ ID NO: 887936 - DNA, 25 bp, Mus musculus
caagccttcctgggctttacatatg

SEQ ID NO: 887937 - DNA, 25 bp, Mus musculus
caagccttctaacctacctgaacca

SEQ ID NO: 887938 - DNA, 25 bp, Mus musculus
caagccttctaagctacctgaacca

SEQ ID NO: 887939 - DNA, 25 bp, Mus musculus
caagcgaaggctctcggcagcaagg

SEQ ID NO: 887940 - DNA, 25 bp, Mus musculus
caagcgaaggctgtcggcagcaagg

SEQ ID NO: 887941 - DNA, 25 bp, Mus musculus
caagcgagagcatgaggaggaatcc

SEQ ID NO: 887942 - DNA, 25 bp, Mus musculus
caagcgagaggatgaggaggaatcc

SEQ ID NO: 887943 - DNA, 25 bp, Mus musculus
caagcgatgctccatgctttcttct

SEQ ID NO: 887944 - DNA, 25 bp, Mus musculus
caagcgatgctcgatgctttcttct

SEQ ID NO: 887945 - DNA, 25 bp, Mus musculus
caagcgatgctgatctttttgactc

SEQ ID NO: 887946 - DNA, 25 bp, Mus musculus
caagcgatgctgttctttttgactc

SEQ ID NO: 887947 - DNA, 25 bp, Mus musculus
caagcgccgcaactttctggagacg

SEQ ID NO: 887948 - DNA, 25 bp, Mus musculus
caagcgccgcaagtttctggagacg

SEQ ID NO: 887949 - DNA, 25 bp, Mus musculus
caagcgcgccctcgccaacagcctc

SEQ ID NO: 887950 - DNA, 25 bp, Mus musculus
caagcgcgccctggccaacagcctc

SEQ ID NO: 887951 - DNA, 25 bp, Mus musculus
caagcggtctctcacttatgggaca

SEQ ID NO: 887952 - DNA, 25 bp, Mus musculus
caagcggtctctgacttatgggaca

SEQ ID NO: 887953 - DNA, 25 bp, Mus musculus
caagcgtgccattgacctggagacg

SEQ ID NO: 887954 - DNA, 25 bp, Mus musculus
caagcgtgccattgtcctggagacg

SEQ ID NO: 887955 - DNA, 25 bp, Mus musculus
caagctaaagcccatgagagcactg

SEQ ID NO: 887956 - DNA, 25 bp, Mus musculus
caagctaaaggccatgagagcactg

SEQ ID NO: 887957 - DNA, 25 bp, Mus musculus
caagctacagagatcctgcagcgct

SEQ ID NO: 887958 - DNA, 25 bp, Mus musculus
caagctacagagttcctgcagcgct

SEQ ID NO: 887959 - DNA, 25 bp, Mus musculus
caagctacagatatgggacacagca

SEQ ID NO: 887960 - DNA, 25 bp, Mus musculus
caagctacagatttgggacacagca

SEQ ID NO: 887961 - DNA, 25 bp, Mus musculus
caagctaccgagactccggggtgcc

SEQ ID NO: 887962 - DNA, 25 bp, Mus musculus
caagctaccgtgactccggggtgcc

SEQ ID NO: 887963 - DNA, 25 bp, Mus musculus
caagctagaaatcgtctggggaagg

SEQ ID NO: 887964 - DNA, 25 bp, Mus musculus
caagctagaaatggtctggggaagg

SEQ ID NO: 887965 - DNA, 25 bp, Mus musculus
caagctatatcggacacacagcttc

SEQ ID NO: 887966 - DNA, 25 bp, Mus musculus
caagctatatcggagacacagcttc

SEQ ID NO: 887967 - DNA, 25 bp, Mus musculus
caagctcaagatacccctgattcac

SEQ ID NO: 887968 - DNA, 25 bp, Mus musculus
caagctcaagttacccctgattcac

SEQ ID NO: 887969 - DNA, 25 bp, Mus musculus
caagctcacgcctcacttctgtatt

SEQ ID NO: 887970 - DNA, 25 bp, Mus musculus
caagctcacgcctcatgaccagcag

SEQ ID NO: 887971 - DNA, 25 bp, Mus musculus
caagctcacgcctctcttctgtatt

SEQ ID NO: 887972 - DNA, 25 bp, Mus musculus
caagctcacgcctcttgaccagcag

SEQ ID NO: 887973 - DNA, 25 bp, Mus musculus
caagctcatgcacgatgatctacac

SEQ ID NO: 887974 - DNA, 25 bp, Mus musculus
caagctcatgcaggatgatctacac

SEQ ID NO: 887975 - DNA, 25 bp, Mus musculus
caagctccagcacacgatgcgggct

SEQ ID NO: 887976 - DNA, 25 bp, Mus musculus
caagctccagcacaggatgcgggct

SEQ ID NO: 887977 - DNA, 25 bp, Mus musculus
caagctcctccacgttgtctatctg

SEQ ID NO: 887978 - DNA, 25 bp, Mus musculus
caagctcctccaggttgtctatctg

SEQ ID NO: 887979 - DNA, 25 bp, Mus musculus
caagctctacaacgtctccaacggt

SEQ ID NO: 887980 - DNA, 25 bp, Mus musculus
caagctctacaaggtctccaacggt

SEQ ID NO: 887981 - DNA, 25 bp, Mus musculus
caagctctccagccacagagtcatc

SEQ ID NO: 887982 - DNA, 25 bp, Mus musculus
caagctctccaggcacagagtcatc

SEQ ID NO: 887983 - DNA, 25 bp, Mus musculus
caagctcttgaaacaatttgaattc

SEQ ID NO: 887984 - DNA, 25 bp, Mus musculus
caagctcttgaatcaatttgaattc

SEQ ID NO: 887985 - DNA, 25 bp, Mus musculus
caagctgaaggacgctgaaactcgg

SEQ ID NO: 887986 - DNA, 25 bp, Mus musculus
caagctgaaggaggctgaaactcgg

SEQ ID NO: 887987 - DNA, 25 bp, Mus musculus
caagctgaccaaagcggagaagctg

SEQ ID NO: 887988 - DNA, 25 bp, Mus musculus
caagctgaccaacttacagtccatc

SEQ ID NO: 887989 - DNA, 25 bp, Mus musculus
caagctgaccaagttacagtccatc

SEQ ID NO: 887990 - DNA, 25 bp, Mus musculus
caagctgaccaatgcggagaagctg

SEQ ID NO: 887991 - DNA, 25 bp, Mus musculus
caagctgactgacgacaaggcagat

SEQ ID NO: 887992 - DNA, 25 bp, Mus musculus
caagctgactgaggacaaggcagat

SEQ ID NO: 887993 - DNA, 25 bp, Mus musculus
caagctgaggcgcggcatcgtgaag

SEQ ID NO: 887994 - DNA, 25 bp, Mus musculus
caagctgaggcggggcatcgtgaag

SEQ ID NO: 887995 - DNA, 25 bp, Mus musculus
caagctgagtcacctgttgctcaag

SEQ ID NO: 887996 - DNA, 25 bp, Mus musculus
caagctgagtcagctgttgctcaag

SEQ ID NO: 887997 - DNA, 25 bp, Mus musculus
caagctgatgaaaaagctgctggaa

SEQ ID NO: 887998 - DNA, 25 bp, Mus musculus
caagctgatgaataagctgctggaa

SEQ ID NO: 887999 - DNA, 25 bp, Mus musculus
caagctgatgagcactgattctgca

SEQ ID NO: 888000 - DNA, 25 bp, Mus musculus
caagctgatgagcagtgattctgca

SEQ ID NO: 888001 - DNA, 25 bp, Mus musculus
caagctgccatgacagatctggaga

SEQ ID NO: 888002 - DNA, 25 bp, Mus musculus
caagctgccatgactgatctggaga

SEQ ID NO: 888003 - DNA, 25 bp, Mus musculus
caagctgcggaacgatgatccagtc

SEQ ID NO: 888004 - DNA, 25 bp, Mus musculus
caagctgcggaaggatgatccagtc

SEQ ID NO: 888005 - DNA, 25 bp, Mus musculus
caagctgcttagagagttttgtcaa

SEQ ID NO: 888006 - DNA, 25 bp, Mus musculus
caagctgcttagagtgttttgtcaa

SEQ ID NO: 888007 - DNA, 25 bp, Mus musculus
caagctggagagacctgtgatcctg

SEQ ID NO: 888008 - DNA, 25 bp, Mus musculus
caagctggagagtcctgtgatcctg

SEQ ID NO: 888009 - DNA, 25 bp, Mus musculus
caagctggagcacgaggagtaccag

SEQ ID NO: 888010 - DNA, 25 bp, Mus musculus
caagctggagcaggaggagtaccag

SEQ ID NO: 888011 - DNA, 25 bp, Mus musculus
caagctggatcacgatgcgggctcc

SEQ ID NO: 888012 - DNA, 25 bp, Mus musculus
caagctggatcaggatgcgggctcc

SEQ ID NO: 888013 - DNA, 25 bp, Mus musculus
caagctggatgacgacctttgtgct

SEQ ID NO: 888014 - DNA, 25 bp, Mus musculus
caagctggatgaggacctttgtgct

SEQ ID NO: 888015 - DNA, 25 bp, Mus musculus
caagctggtcaacgtgtggaatctg

SEQ ID NO: 888016 - DNA, 25 bp, Mus musculus
caagctggtcaaggtgtggaatctg

SEQ ID NO: 888017 - DNA, 25 bp, Mus musculus
caagctgtacagcttgggcttaggt

SEQ ID NO: 888018 - DNA, 25 bp, Mus musculus
caagctgtacaggttgggcttaggt

SEQ ID NO: 888019 - DNA, 25 bp, Mus musculus
caagcttaaacctgcgaggactcac

SEQ ID NO: 888020 - DNA, 25 bp, Mus musculus
caagcttaaacctgggaggactcac

SEQ ID NO: 888021 - DNA, 25 bp, Mus musculus
caagcttcaacgacatccacaccac

SEQ ID NO: 888022 - DNA, 25 bp, Mus musculus
caagcttcaaggacatccacaccac

SEQ ID NO: 888023 - DNA, 25 bp, Mus musculus
caagcttcataaaattaacagaccc

SEQ ID NO: 888024 - DNA, 25 bp, Mus musculus
caagcttcataatattaacagaccc

SEQ ID NO: 888025 - DNA, 25 bp, Mus musculus
caagcttctgagcagctagaagcga

SEQ ID NO: 888026 - DNA, 25 bp, Mus musculus
caagcttctgaggagctagaagcga

SEQ ID NO: 888027 - DNA, 25 bp, Mus musculus
caagcttgcccactatgtgggatcc

SEQ ID NO: 888028 - DNA, 25 bp, Mus musculus
caagcttgcccagtatgtgggatcc

SEQ ID NO: 888029 - DNA, 25 bp, Mus musculus
caaggaaaacagactataaagcacc

SEQ ID NO: 888030 - DNA, 25 bp, Mus musculus
caaggaaaacagcacccatcctctg

SEQ ID NO: 888031 - DNA, 25 bp, Mus musculus
caaggaaaacaggacccatcctctg

SEQ ID NO: 888032 - DNA, 25 bp, Mus musculus
caaggaaaacagtctataaagcacc

SEQ ID NO: 888033 - DNA, 25 bp, Mus musculus
caaggaaatgctggctgcgttgatg

SEQ ID NO: 888034 - DNA, 25 bp, Mus musculus
caaggaaatggtggctgcgttgatg

SEQ ID NO: 888035 - DNA, 25 bp, Mus musculus
caaggaacagatcctgaagctgcag

SEQ ID NO: 888036 - DNA, 25 bp, Mus musculus
caaggaacagttcctgaagctgcag

SEQ ID NO: 888037 - DNA, 25 bp, Mus musculus
caaggaacgacaagcgcgattcgac

SEQ ID NO: 888038 - DNA, 25 bp, Mus musculus
caaggaacgacaagggcgattcgac

SEQ ID NO: 888039 - DNA, 25 bp, Mus musculus
caaggaagacttactggacataaag

SEQ ID NO: 888040 - DNA, 25 bp, Mus musculus
caaggaagactttctggacataaag

SEQ ID NO: 888041 - DNA, 25 bp, Mus musculus
caaggaagagaacgaggacatcaca

SEQ ID NO: 888042 - DNA, 25 bp, Mus musculus
caaggaagagaaggaggacatcaca

SEQ ID NO: 888043 - DNA, 25 bp, Mus musculus
caaggaagagcgagctagcacctca

SEQ ID NO: 888044 - DNA, 25 bp, Mus musculus
caaggaagagcttttgctgcctctc

SEQ ID NO: 888045 - DNA, 25 bp, Mus musculus
caaggaagagggagctagcacctca

SEQ ID NO: 888046 - DNA, 25 bp, Mus musculus
caaggaagaggttttgctgcctctc

SEQ ID NO: 888047 - DNA, 25 bp, Mus musculus
caaggaagcagacatgcccggaacc

SEQ ID NO: 888048 - DNA, 25 bp, Mus musculus
caaggaagcagagatgcccggaacc

SEQ ID NO: 888049 - DNA, 25 bp, Mus musculus
caaggaagcgggaacagcacagtgt

SEQ ID NO: 888050 - DNA, 25 bp, Mus musculus
caaggaagcgggtacagcacagtgt

SEQ ID NO: 888051 - DNA, 25 bp, Mus musculus
caaggaatcacccgccagatcccac

SEQ ID NO: 888052 - DNA, 25 bp, Mus musculus
caaggaatcagccgccagatcccac

SEQ ID NO: 888053 - DNA, 25 bp, Mus musculus
caaggacaagaactaagtgatgtgg

SEQ ID NO: 888054 - DNA, 25 bp, Mus musculus
caaggacaagaacttagtgatgtgg

SEQ ID NO: 888055 - DNA, 25 bp, Mus musculus
caaggacacaagcgtgaagagggtg

SEQ ID NO: 888056 - DNA, 25 bp, Mus musculus
caaggacacaagggtgaagagggtg

SEQ ID NO: 888057 - DNA, 25 bp, Mus musculus
caaggaccatcactaccagtttttg

SEQ ID NO: 888058 - DNA, 25 bp, Mus musculus
caaggaccatcagtaccagtttttg

SEQ ID NO: 888059 - DNA, 25 bp, Mus musculus
caaggacccccagagttgatggtgt

SEQ ID NO: 888060 - DNA, 25 bp, Mus musculus
caaggaccccgagagttgatggtgt

SEQ ID NO: 888061 - DNA, 25 bp, Mus musculus
caaggaccgagacggttacacatca

SEQ ID NO: 888062 - DNA, 25 bp, Mus musculus
caaggaccgagacgtgagacgtgga

SEQ ID NO: 888063 - DNA, 25 bp, Mus musculus
caaggaccgagacgtgatctgtaaa

SEQ ID NO: 888064 - DNA, 25 bp, Mus musculus
caaggaccgagagggttacacatca

SEQ ID NO: 888065 - DNA, 25 bp, Mus musculus
caaggaccgagaggtgagacgtgga

SEQ ID NO: 888066 - DNA, 25 bp, Mus musculus
caaggaccgagaggtgatctgtaaa

SEQ ID NO: 888067 - DNA, 25 bp, Mus musculus
caaggacctccacgacctcagggtc

SEQ ID NO: 888068 - DNA, 25 bp, Mus musculus
caaggacctccaggacctcagggtc

SEQ ID NO: 888069 - DNA, 25 bp, Mus musculus
caaggacgcatactggaagtagtgg

SEQ ID NO: 888070 - DNA, 25 bp, Mus musculus
caaggacgcatagtggaagtagtgg

SEQ ID NO: 888071 - DNA, 25 bp, Mus musculus
caaggacggtcctaccctcagcgtt

SEQ ID NO: 888072 - DNA, 25 bp, Mus musculus
caaggacggtcctagcctcagcgtt

SEQ ID NO: 888073 - DNA, 25 bp, Mus musculus
caaggactccagccatgtcatgtta

SEQ ID NO: 888074 - DNA, 25 bp, Mus musculus
caaggactccaggcatgtcatgtta

SEQ ID NO: 888075 - DNA, 25 bp, Mus musculus
caaggacttacacgaagacaaggag

SEQ ID NO: 888076 - DNA, 25 bp, Mus musculus
caaggacttacaggaagacaaggag

SEQ ID NO: 888077 - DNA, 25 bp, Mus musculus
caaggagaaagtgacgacttttgct

SEQ ID NO: 888078 - DNA, 25 bp, Mus musculus
caaggagaaagtgaggacttttgct

SEQ ID NO: 888079 - DNA, 25 bp, Mus musculus
caaggagaactgcacgcatcagaag

SEQ ID NO: 888080 - DNA, 25 bp, Mus musculus
caaggagaactgcacgttctcccat

SEQ ID NO: 888081 - DNA, 25 bp, Mus musculus
caaggagaactgcaggcatcagaag

SEQ ID NO: 888082 - DNA, 25 bp, Mus musculus
caaggagaactgcaggttctcccat

SEQ ID NO: 888083 - DNA, 25 bp, Mus musculus
caaggagaagaaccaatgtctgacc

SEQ ID NO: 888084 - DNA, 25 bp, Mus musculus
caaggagaagaagaaaaagtcagca

SEQ ID NO: 888085 - DNA, 25 bp, Mus musculus
caaggagaagaagcaatgtctgacc

SEQ ID NO: 888086 - DNA, 25 bp, Mus musculus
caaggagaagcagttctttgatgtg

SEQ ID NO: 888087 - DNA, 25 bp, Mus musculus
caaggagaaggacgtggtgaataag

SEQ ID NO: 888088 - DNA, 25 bp, Mus musculus
caaggagaaggaggtggtgaataag

SEQ ID NO: 888089 - DNA, 25 bp, Mus musculus
caaggagaaggagttctttgatgtg

SEQ ID NO: 888090 - DNA, 25 bp, Mus musculus
caaggagaagtagaaaaagtcagca

SEQ ID NO: 888091 - DNA, 25 bp, Mus musculus
caaggagacagagacatttgtgtca

SEQ ID NO: 888092 - DNA, 25 bp, Mus musculus
caaggagacagagagatttgtgtca

SEQ ID NO: 888093 - DNA, 25 bp, Mus musculus
caaggagagaagcgcgctgctggcg

SEQ ID NO: 888094 - DNA, 25 bp, Mus musculus
caaggagagaagggcgctgctggcg

SEQ ID NO: 888095 - DNA, 25 bp, Mus musculus
caaggagagagtcagtgcatctgat

SEQ ID NO: 888096 - DNA, 25 bp, Mus musculus
caaggagagagtgagtgcatctgat

SEQ ID NO: 888097 - DNA, 25 bp, Mus musculus
caaggagaggaacacggactccaag

SEQ ID NO: 888098 - DNA, 25 bp, Mus musculus
caaggagaggaagacggactccaag

SEQ ID NO: 888099 - DNA, 25 bp, Mus musculus
caaggagatgatgtctgtaggtggg

SEQ ID NO: 888100 - DNA, 25 bp, Mus musculus
caaggagatgctctgctggtgtacc

SEQ ID NO: 888101 - DNA, 25 bp, Mus musculus
caaggagatgctggggctgcgacag

SEQ ID NO: 888102 - DNA, 25 bp, Mus musculus
caaggagatgctgtggggcctgtac

SEQ ID NO: 888103 - DNA, 25 bp, Mus musculus
caaggagatggtctgctggtgtacc

SEQ ID NO: 888104 - DNA, 25 bp, Mus musculus
caaggagatggtggggctgcgacag

SEQ ID NO: 888105 - DNA, 25 bp, Mus musculus
caaggagatggtgtggggcctgtac

SEQ ID NO: 888106 - DNA, 25 bp, Mus musculus
caaggagatgttgtctgtaggtggg

SEQ ID NO: 888107 - DNA, 25 bp, Mus musculus
caaggagcagatacagaagatcatt

SEQ ID NO: 888108 - DNA, 25 bp, Mus musculus
caaggagcagctgactaacgagatc

SEQ ID NO: 888109 - DNA, 25 bp, Mus musculus
caaggagcaggtgactaacgagatc

SEQ ID NO: 888110 - DNA, 25 bp, Mus musculus
caaggagcagttacagaagatcatt

SEQ ID NO: 888111 - DNA, 25 bp, Mus musculus
caaggagcccagcccggctcaacat

SEQ ID NO: 888112 - DNA, 25 bp, Mus musculus
caaggagcccaggccggctcaacat

SEQ ID NO: 888113 - DNA, 25 bp, Mus musculus
caaggagcggtgatgaaaaactgga

SEQ ID NO: 888114 - DNA, 25 bp, Mus musculus
caaggagcggtgttgaaaaactgga

SEQ ID NO: 888115 - DNA, 25 bp, Mus musculus
caaggagctccatgcggaagtcatc

SEQ ID NO: 888116 - DNA, 25 bp, Mus musculus
caaggagctccatggggaagtcatc

SEQ ID NO: 888117 - DNA, 25 bp, Mus musculus
caaggagctgaacccggagcaggaa

SEQ ID NO: 888118 - DNA, 25 bp, Mus musculus
caaggagctgaagccggagcaggaa

SEQ ID NO: 888119 - DNA, 25 bp, Mus musculus
caaggagctgagacctgatggaacc

SEQ ID NO: 888120 - DNA, 25 bp, Mus musculus
caaggagctgagtcctgatggaacc

SEQ ID NO: 888121 - DNA, 25 bp, Mus musculus
caaggagctgttcacagttgaagag

SEQ ID NO: 888122 - DNA, 25 bp, Mus musculus
caaggagctgttcagagttgaagag

SEQ ID NO: 888123 - DNA, 25 bp, Mus musculus
caaggaggacagctacaagcccatc

SEQ ID NO: 888124 - DNA, 25 bp, Mus musculus
caaggaggacaggtacaagcccatc

SEQ ID NO: 888125 - DNA, 25 bp, Mus musculus
caaggaggagatctttggaccagtg

SEQ ID NO: 888126 - DNA, 25 bp, Mus musculus
caaggaggagttctttggaccagtg

SEQ ID NO: 888127 - DNA, 25 bp, Mus musculus
caaggaggccatgaccaacaaggcg

SEQ ID NO: 888128 - DNA, 25 bp, Mus musculus
caaggaggccatgagcaacaaggcg

SEQ ID NO: 888129 - DNA, 25 bp, Mus musculus
caaggaggcgctcccggacggtgtc

SEQ ID NO: 888130 - DNA, 25 bp, Mus musculus
caaggaggcggtcccggacggtgtc

SEQ ID NO: 888131 - DNA, 25 bp, Mus musculus
caaggagggcagcttgtctttctac

SEQ ID NO: 888132 - DNA, 25 bp, Mus musculus
caaggagggcaggttgtctttctac

SEQ ID NO: 888133 - DNA, 25 bp, Mus musculus
caaggaggtccacctgctcggcact

SEQ ID NO: 888134 - DNA, 25 bp, Mus musculus
caaggaggtccacctgttcatgact

SEQ ID NO: 888135 - DNA, 25 bp, Mus musculus
caaggaggtccagctgctcggcact

SEQ ID NO: 888136 - DNA, 25 bp, Mus musculus
caaggaggtccagctgttcatgact

SEQ ID NO: 888137 - DNA, 25 bp, Mus musculus
caaggatatcgacgtgatcatgggt

SEQ ID NO: 888138 - DNA, 25 bp, Mus musculus
caaggatatcgaggtgatcatgggt

SEQ ID NO: 888139 - DNA, 25 bp, Mus musculus
caaggatctgcacaaattagtcttg

SEQ ID NO: 888140 - DNA, 25 bp, Mus musculus
caaggatctgcagaaattagtcttg

SEQ ID NO: 888141 - DNA, 25 bp, Mus musculus
caaggatgagtgcgtggaagagcag

SEQ ID NO: 888142 - DNA, 25 bp, Mus musculus
caaggatgagtgggtggaagagcag

SEQ ID NO: 888143 - DNA, 25 bp, Mus musculus
caaggatgctatcccaatgtgtgcg

SEQ ID NO: 888144 - DNA, 25 bp, Mus musculus
caaggatgctatgccaatgtgtgcg

SEQ ID NO: 888145 - DNA, 25 bp, Mus musculus
caaggatggacacattcattacttc

SEQ ID NO: 888146 - DNA, 25 bp, Mus musculus
caaggatggacagattcattacttc

SEQ ID NO: 888147 - DNA, 25 bp, Mus musculus
caaggatggcaaaggagagtgtggt

SEQ ID NO: 888148 - DNA, 25 bp, Mus musculus
caaggatggcaatggagagtgtggt

SEQ ID NO: 888149 - DNA, 25 bp, Mus musculus
caaggatgtcctcacccccctgaga

SEQ ID NO: 888150 - DNA, 25 bp, Mus musculus
caaggatgtcctcagccccctgaga

SEQ ID NO: 888151 - DNA, 25 bp, Mus musculus
caaggcaaagaacgaagcatgattg

SEQ ID NO: 888152 - DNA, 25 bp, Mus musculus
caaggcaaagaaggaagcatgattg

SEQ ID NO: 888153 - DNA, 25 bp, Mus musculus
caaggcaaagctgttgaacgaggag

SEQ ID NO: 888154 - DNA, 25 bp, Mus musculus
caaggcaaaggtgttgaacgaggag

SEQ ID NO: 888155 - DNA, 25 bp, Mus musculus
caaggcacacaacccctcactggag

SEQ ID NO: 888156 - DNA, 25 bp, Mus musculus
caaggcacacaagccctcactggag

SEQ ID NO: 888157 - DNA, 25 bp, Mus musculus
caaggcacctctcgtaccaacgcag

SEQ ID NO: 888158 - DNA, 25 bp, Mus musculus
caaggcacctctggtaccaacgcag

SEQ ID NO: 888159 - DNA, 25 bp, Mus musculus
caaggcactcaacgactataagtca

SEQ ID NO: 888160 - DNA, 25 bp, Mus musculus
caaggcactcaaggactataagtca

SEQ ID NO: 888161 - DNA, 25 bp, Mus musculus
caaggcagactccacaatggagaag

SEQ ID NO: 888162 - DNA, 25 bp, Mus musculus
caaggcagactccagaatggagaag

SEQ ID NO: 888163 - DNA, 25 bp, Mus musculus
caaggccaacagccgataccaaaag

SEQ ID NO: 888164 - DNA, 25 bp, Mus musculus
caaggccaacaggcgataccaaaag

SEQ ID NO: 888165 - DNA, 25 bp, Mus musculus
caaggccaagaaagtattatgaggg

SEQ ID NO: 888166 - DNA, 25 bp, Mus musculus
caaggccaagcacacgaatgaaagg

SEQ ID NO: 888167 - DNA, 25 bp, Mus musculus
caaggccaagcacaggaatgaaagg

SEQ ID NO: 888168 - DNA, 25 bp, Mus musculus
caaggccaagtaagtattatgaggg

SEQ ID NO: 888169 - DNA, 25 bp, Mus musculus
caaggccacgcagctctttgttcag

SEQ ID NO: 888170 - DNA, 25 bp, Mus musculus
caaggccacggagctctttgttcag

SEQ ID NO: 888171 - DNA, 25 bp, Mus musculus
caaggccaggaggcagttctggcta

SEQ ID NO: 888172 - DNA, 25 bp, Mus musculus
caaggccaggaggctgttctggcta

SEQ ID NO: 888173 - DNA, 25 bp, Mus musculus
caaggccatcaccacggtgtttcca

SEQ ID NO: 888174 - DNA, 25 bp, Mus musculus
caaggccatcaccagggtgtttcca

SEQ ID NO: 888175 - DNA, 25 bp, Mus musculus
caaggcccagcattttcactggctc

SEQ ID NO: 888176 - DNA, 25 bp, Mus musculus
caaggcccagctggtgaccatagaa

SEQ ID NO: 888177 - DNA, 25 bp, Mus musculus
caaggcccaggattttcactggctc

SEQ ID NO: 888178 - DNA, 25 bp, Mus musculus
caaggcccaggtggtgaccatagaa

SEQ ID NO: 888179 - DNA, 25 bp, Mus musculus
caaggcccagtttacgcagtcatgg

SEQ ID NO: 888180 - DNA, 25 bp, Mus musculus
caaggcccagtttaggcagtcatgg

SEQ ID NO: 888181 - DNA, 25 bp, Mus musculus
caaggcccctagccccatctcttct

SEQ ID NO: 888182 - DNA, 25 bp, Mus musculus
caaggcccctaggcccatctcttct

SEQ ID NO: 888183 - DNA, 25 bp, Mus musculus
caaggcccggcttcctgtatcctca

SEQ ID NO: 888184 - DNA, 25 bp, Mus musculus
caaggcccggcttcgtgtatcctca

SEQ ID NO: 888185 - DNA, 25 bp, Mus musculus
caaggcctcctcaacctaaagaacg

SEQ ID NO: 888186 - DNA, 25 bp, Mus musculus
caaggcctcctcaagctaaagaacg

SEQ ID NO: 888187 - DNA, 25 bp, Mus musculus
caaggcctggaccaaaaccacgagc

SEQ ID NO: 888188 - DNA, 25 bp, Mus musculus
caaggcctggaccacgctgagcagg

SEQ ID NO: 888189 - DNA, 25 bp, Mus musculus
caaggcctggacgaaaaccacgagc

SEQ ID NO: 888190 - DNA, 25 bp, Mus musculus
caaggcctggacgacgctgagcagg

SEQ ID NO: 888191 - DNA, 25 bp, Mus musculus
caaggccttagtctcctacatagcc

SEQ ID NO: 888192 - DNA, 25 bp, Mus musculus
caaggccttagtctgctacatagcc

SEQ ID NO: 888193 - DNA, 25 bp, Mus musculus
caaggccttcaacacagacagttcc

SEQ ID NO: 888194 - DNA, 25 bp, Mus musculus
caaggccttcaagacagacagttcc

SEQ ID NO: 888195 - DNA, 25 bp, Mus musculus
caaggccttccgagccgacagctcc

SEQ ID NO: 888196 - DNA, 25 bp, Mus musculus
caaggccttccgtgccgacagctcc

SEQ ID NO: 888197 - DNA, 25 bp, Mus musculus
caaggcgacacattcggagaggtgt

SEQ ID NO: 888198 - DNA, 25 bp, Mus musculus
caaggcgacacattgggagaggtgt

SEQ ID NO: 888199 - DNA, 25 bp, Mus musculus
caaggcgcagcatttctataattgg

SEQ ID NO: 888200 - DNA, 25 bp, Mus musculus
caaggcgcaggatttctataattgg

SEQ ID NO: 888201 - DNA, 25 bp, Mus musculus
caaggcggagcccaagcgccgctcc

SEQ ID NO: 888202 - DNA, 25 bp, Mus musculus
caaggcggaggccaagcgccgctcc

SEQ ID NO: 888203 - DNA, 25 bp, Mus musculus
caaggcggagtggacgtgtgaaatt

SEQ ID NO: 888204 - DNA, 25 bp, Mus musculus
caaggcggagtggaggtgtgaaatt

SEQ ID NO: 888205 - DNA, 25 bp, Mus musculus
caaggctaagccccaggccctggtg

SEQ ID NO: 888206 - DNA, 25 bp, Mus musculus
caaggctaagctgatttacgtgggc

SEQ ID NO: 888207 - DNA, 25 bp, Mus musculus
caaggctaaggcccaggccctggtg

SEQ ID NO: 888208 - DNA, 25 bp, Mus musculus
caaggctaaggtgatttacgtgggc

SEQ ID NO: 888209 - DNA, 25 bp, Mus musculus
caaggctacggacgctatggggcat

SEQ ID NO: 888210 - DNA, 25 bp, Mus musculus
caaggctacggaggctatggggcat

SEQ ID NO: 888211 - DNA, 25 bp, Mus musculus
caaggctcggctgccagggccattg

SEQ ID NO: 888212 - DNA, 25 bp, Mus musculus
caaggctcgggtgccagggccattg

SEQ ID NO: 888213 - DNA, 25 bp, Mus musculus
caaggcttccggaaagcaatttcct

SEQ ID NO: 888214 - DNA, 25 bp, Mus musculus
caaggcttccggaatgcaatttcct

SEQ ID NO: 888215 - DNA, 25 bp, Mus musculus
caaggctttgagactaaagacatta

SEQ ID NO: 888216 - DNA, 25 bp, Mus musculus
caaggctttgagtctaaagacatta

SEQ ID NO: 888217 - DNA, 25 bp, Mus musculus
caagggaggtgacgaggaagaagtg

SEQ ID NO: 888218 - DNA, 25 bp, Mus musculus
caagggaggtgaggaggaagaagtg

SEQ ID NO: 888219 - DNA, 25 bp, Mus musculus
caagggcaagggactccgagggagc

SEQ ID NO: 888220 - DNA, 25 bp, Mus musculus
caagggcaagggatcttggcccagc

SEQ ID NO: 888221 - DNA, 25 bp, Mus musculus
caagggcaagggtctccgagggagc

SEQ ID NO: 888222 - DNA, 25 bp, Mus musculus
caagggcaagggttcttggcccagc

SEQ ID NO: 888223 - DNA, 25 bp, Mus musculus
caagggcaggctgtttaggaatcct

SEQ ID NO: 888224 - DNA, 25 bp, Mus musculus
caagggcagggtgtttaggaatcct

SEQ ID NO: 888225 - DNA, 25 bp, Mus musculus
caagggcattggcgatgaagctctc

SEQ ID NO: 888226 - DNA, 25 bp, Mus musculus
caagggcattggggatgaagctctc

SEQ ID NO: 888227 - DNA, 25 bp, Mus musculus
caagggccagctggcaaagatgttc

SEQ ID NO: 888228 - DNA, 25 bp, Mus musculus
caagggccaggtggcaaagatgttc

SEQ ID NO: 888229 - DNA, 25 bp, Mus musculus
caagggcctgcacggccggctccca

SEQ ID NO: 888230 - DNA, 25 bp, Mus musculus
caagggcctgcagggccggctccca

SEQ ID NO: 888231 - DNA, 25 bp, Mus musculus
caagggctcttgcgcagcgctcacc

SEQ ID NO: 888232 - DNA, 25 bp, Mus musculus
caagggctcttgctgttccggggca

SEQ ID NO: 888233 - DNA, 25 bp, Mus musculus
caagggctcttgggcagcgctcacc

SEQ ID NO: 888234 - DNA, 25 bp, Mus musculus
caagggctcttggtgttccggggca

SEQ ID NO: 888235 - DNA, 25 bp, Mus musculus
caagggcttcttcacacgaacagtc

SEQ ID NO: 888236 - DNA, 25 bp, Mus musculus
caagggcttcttcactgatactgtc

SEQ ID NO: 888237 - DNA, 25 bp, Mus musculus
caagggcttcttcagacgaacagtc

SEQ ID NO: 888238 - DNA, 25 bp, Mus musculus
caagggcttcttcagtgatactgtc

SEQ ID NO: 888239 - DNA, 25 bp, Mus musculus
caaggggagcagcgagcggagggag

SEQ ID NO: 888240 - DNA, 25 bp, Mus musculus
caaggggagcagggagcggagggag

SEQ ID NO: 888241 - DNA, 25 bp, Mus musculus
caaggggatcgactcgtacatggac

SEQ ID NO: 888242 - DNA, 25 bp, Mus musculus
caaggggatcgactggtacatggac

SEQ ID NO: 888243 - DNA, 25 bp, Mus musculus
caaggggcagctgtttgctttgtct

SEQ ID NO: 888244 - DNA, 25 bp, Mus musculus
caaggggcaggtgtttgctttgtct

SEQ ID NO: 888245 - DNA, 25 bp, Mus musculus
caagggggtgcctgtgggccgaagc

SEQ ID NO: 888246 - DNA, 25 bp, Mus musculus
caagggggtggctgtgggccgaagc

SEQ ID NO: 888247 - DNA, 25 bp, Mus musculus
caagggtagtcactcactgtatcca

SEQ ID NO: 888248 - DNA, 25 bp, Mus musculus
caagggtagtcactgactgtatcca

SEQ ID NO: 888249 - DNA, 25 bp, Mus musculus
caagggtgaacacggtgcctctggt

SEQ ID NO: 888250 - DNA, 25 bp, Mus musculus
caagggtgaacagggtgcctctggt

SEQ ID NO: 888251 - DNA, 25 bp, Mus musculus
caagggtgacaacggtgactcagct

SEQ ID NO: 888252 - DNA, 25 bp, Mus musculus
caagggtgacaagggtgactcagct

SEQ ID NO: 888253 - DNA, 25 bp, Mus musculus
caagggtgccaacggggagccaggc

SEQ ID NO: 888254 - DNA, 25 bp, Mus musculus
caagggtgccaagggggagccaggc

SEQ ID NO: 888255 - DNA, 25 bp, Mus musculus
caagggttggacaacgttgctgaag

SEQ ID NO: 888256 - DNA, 25 bp, Mus musculus
caagggttggacaaggttgctgaag

SEQ ID NO: 888257 - DNA, 25 bp, Mus musculus
caaggtagcaaacggtgtggaatat

SEQ ID NO: 888258 - DNA, 25 bp, Mus musculus
caaggtagcaaagggtgtggaatat

SEQ ID NO: 888259 - DNA, 25 bp, Mus musculus
caaggtatcactcagagaggcagct

SEQ ID NO: 888260 - DNA, 25 bp, Mus musculus
caaggtatcactgagagaggcagct

SEQ ID NO: 888261 - DNA, 25 bp, Mus musculus
caaggtcctgaaccactcggggata

SEQ ID NO: 888262 - DNA, 25 bp, Mus musculus
caaggtcctgaagcactcggggata

SEQ ID NO: 888263 - DNA, 25 bp, Mus musculus
caaggtctggagagaagctggatgg

SEQ ID NO: 888264 - DNA, 25 bp, Mus musculus
caaggtctggatattgaagtaatgg

SEQ ID NO: 888265 - DNA, 25 bp, Mus musculus
caaggtctggtgagaagctggatgg

SEQ ID NO: 888266 - DNA, 25 bp, Mus musculus
caaggtctggttattgaagtaatgg

SEQ ID NO: 888267 - DNA, 25 bp, Mus musculus
caaggtgaccaacggacgtgcaatc

SEQ ID NO: 888268 - DNA, 25 bp, Mus musculus
caaggtgaccaagggacgtgcaatc

SEQ ID NO: 888269 - DNA, 25 bp, Mus musculus
caaggtgacgatgctgcttgttgtc

SEQ ID NO: 888270 - DNA, 25 bp, Mus musculus
caaggtgacgttgctgcttgttgtc

SEQ ID NO: 888271 - DNA, 25 bp, Mus musculus
caaggtgatgatcaaactgtcacat

SEQ ID NO: 888272 - DNA, 25 bp, Mus musculus
caaggtgatgatgaaactgtcacat

SEQ ID NO: 888273 - DNA, 25 bp, Mus musculus
caaggtggggccgaccaaccatgaa

SEQ ID NO: 888274 - DNA, 25 bp, Mus musculus
caaggtggggccgagcaaccatgaa

SEQ ID NO: 888275 - DNA, 25 bp, Mus musculus
caaggtggttctcaaacgaagtgag

SEQ ID NO: 888276 - DNA, 25 bp, Mus musculus
caaggtggttctgaaacgaagtgag

SEQ ID NO: 888277 - DNA, 25 bp, Mus musculus
caaggtgtatgaaacgctgtcagcc

SEQ ID NO: 888278 - DNA, 25 bp, Mus musculus
caaggtgtatgaaaggctgtcagcc

SEQ ID NO: 888279 - DNA, 25 bp, Mus musculus
caaggtgttccacgagcgcatcaac

SEQ ID NO: 888280 - DNA, 25 bp, Mus musculus
caaggtgttccacgtaggtgcatga

SEQ ID NO: 888281 - DNA, 25 bp, Mus musculus
caaggtgttccaggagcgcatcaac

SEQ ID NO: 888282 - DNA, 25 bp, Mus musculus
caaggtgttccaggtaggtgcatga

SEQ ID NO: 888283 - DNA, 25 bp, Mus musculus
caaggttacgaagtcatgggagtct

SEQ ID NO: 888284 - DNA, 25 bp, Mus musculus
caaggttacgaagtgatgggagtct

SEQ ID NO: 888285 - DNA, 25 bp, Mus musculus
caaggttattggcattgagtgttcc

SEQ ID NO: 888286 - DNA, 25 bp, Mus musculus
caaggttattgggattgagtgttcc

SEQ ID NO: 888287 - DNA, 25 bp, Mus musculus
caaggttctcaacgacagtgacctg

SEQ ID NO: 888288 - DNA, 25 bp, Mus musculus
caaggttctcaaggacagtgacctg

SEQ ID NO: 888289 - DNA, 25 bp, Mus musculus
caaggttggcaataagtattacaac

SEQ ID NO: 888290 - DNA, 25 bp, Mus musculus
caaggttggcaatatgtattacaac

SEQ ID NO: 888291 - DNA, 25 bp, Mus musculus
caagtaatgcaactgtggcaccttt

SEQ ID NO: 888292 - DNA, 25 bp, Mus musculus
caagtaatgcaagtgtggcaccttt

SEQ ID NO: 888293 - DNA, 25 bp, Mus musculus
caagtacaacatcttgattgccacg

SEQ ID NO: 888294 - DNA, 25 bp, Mus musculus
caagtacaacttcttgattgccacg

SEQ ID NO: 888295 - DNA, 25 bp, Mus musculus
caagtacacgacagacggcaaccac

SEQ ID NO: 888296 - DNA, 25 bp, Mus musculus
caagtacacgcaaatgtgtcatgga

SEQ ID NO: 888297 - DNA, 25 bp, Mus musculus
caagtacacggaaatgtgtcatgga

SEQ ID NO: 888298 - DNA, 25 bp, Mus musculus
caagtacacgtcagacggcaaccac

SEQ ID NO: 888299 - DNA, 25 bp, Mus musculus
caagtaccaacaagaccaggtggtg

SEQ ID NO: 888300 - DNA, 25 bp, Mus musculus
caagtaccaacatgaccaggtggtg

SEQ ID NO: 888301 - DNA, 25 bp, Mus musculus
caagtaccctgaaacagttaaacat

SEQ ID NO: 888302 - DNA, 25 bp, Mus musculus
caagtaccctgaaagagttaaacat

SEQ ID NO: 888303 - DNA, 25 bp, Mus musculus
caagtacccttgctccaatgaagct

SEQ ID NO: 888304 - DNA, 25 bp, Mus musculus
caagtacccttgctgcaatgaagct

SEQ ID NO: 888305 - DNA, 25 bp, Mus musculus
caagtacctggactttatctcagaa

SEQ ID NO: 888306 - DNA, 25 bp, Mus musculus
caagtacctggagtttatctcagaa

SEQ ID NO: 888307 - DNA, 25 bp, Mus musculus
caagtagacaccattttcaaaatga

SEQ ID NO: 888308 - DNA, 25 bp, Mus musculus
caagtagacagcattttcaaaatga

SEQ ID NO: 888309 - DNA, 25 bp, Mus musculus
caagtagatgctgttcagtttatgt

SEQ ID NO: 888310 - DNA, 25 bp, Mus musculus
caagtagatggtgttcagtttatgt

SEQ ID NO: 888311 - DNA, 25 bp, Mus musculus
caagtagctgatattgacgggcagt

SEQ ID NO: 888312 - DNA, 25 bp, Mus musculus
caagtagctgttattgacgggcagt

SEQ ID NO: 888313 - DNA, 25 bp, Mus musculus
caagtagtccaacacagaatgaagc

SEQ ID NO: 888314 - DNA, 25 bp, Mus musculus
caagtagtccaacagagaatgaagc

SEQ ID NO: 888315 - DNA, 25 bp, Mus musculus
caagtagttcagcctgggaagctca

SEQ ID NO: 888316 - DNA, 25 bp, Mus musculus
caagtagttcaggctgggaagctca

SEQ ID NO: 888317 - DNA, 25 bp, Mus musculus
caagtataagctgatgttccctgtt

SEQ ID NO: 888318 - DNA, 25 bp, Mus musculus
caagtataagctggctctcgagggc

SEQ ID NO: 888319 - DNA, 25 bp, Mus musculus
caagtataaggtgatgttccctgtt

SEQ ID NO: 888320 - DNA, 25 bp, Mus musculus
caagtataaggtggctctcgagggc

SEQ ID NO: 888321 - DNA, 25 bp, Mus musculus
caagtatagcagctctggaatttgc

SEQ ID NO: 888322 - DNA, 25 bp, Mus musculus
caagtatagcaggtctggaatttgc

SEQ ID NO: 888323 - DNA, 25 bp, Mus musculus
caagtatctcagaaagacccaaatg

SEQ ID NO: 888324 - DNA, 25 bp, Mus musculus
caagtatctcagattgaagaccaaa

SEQ ID NO: 888325 - DNA, 25 bp, Mus musculus
caagtatctcagtaagacccaaatg

SEQ ID NO: 888326 - DNA, 25 bp, Mus musculus
caagtatctcagtttgaagaccaaa

SEQ ID NO: 888327 - DNA, 25 bp, Mus musculus
caagtatttgttcaaccagctgttt

SEQ ID NO: 888328 - DNA, 25 bp, Mus musculus
caagtatttgttcatccagctgttt

SEQ ID NO: 888329 - DNA, 25 bp, Mus musculus
caagtcaaagctggcctcagggccc

SEQ ID NO: 888330 - DNA, 25 bp, Mus musculus
caagtcaaaggtggcctcagggccc

SEQ ID NO: 888331 - DNA, 25 bp, Mus musculus
caagtcaaatgatccagacatgcgg

SEQ ID NO: 888332 - DNA, 25 bp, Mus musculus
caagtcaaatgatcgagacatgcgg

SEQ ID NO: 888333 - DNA, 25 bp, Mus musculus
caagtcaatgcaaaatttccaggcc

SEQ ID NO: 888334 - DNA, 25 bp, Mus musculus
caagtcaatgcccagctaatgtatc

SEQ ID NO: 888335 - DNA, 25 bp, Mus musculus
caagtcaatggaaaatttccaggcc

SEQ ID NO: 888336 - DNA, 25 bp, Mus musculus
caagtcaatggccagctaatgtatc

SEQ ID NO: 888337 - DNA, 25 bp, Mus musculus
caagtcacccagagaatacctcatg

SEQ ID NO: 888338 - DNA, 25 bp, Mus musculus
caagtcacccagtgaatacctcatg

SEQ ID NO: 888339 - DNA, 25 bp, Mus musculus
caagtcactgatcgatgagctaatg

SEQ ID NO: 888340 - DNA, 25 bp, Mus musculus
caagtcactgatcgttgagctaatg

SEQ ID NO: 888341 - DNA, 25 bp, Mus musculus
caagtcagagatcacccaagctgtc

SEQ ID NO: 888342 - DNA, 25 bp, Mus musculus
caagtcagagatcacgaagccaagc

SEQ ID NO: 888343 - DNA, 25 bp, Mus musculus
caagtcagagatcagccaagctgtc

SEQ ID NO: 888344 - DNA, 25 bp, Mus musculus
caagtcagagatcaggaagccaagc

SEQ ID NO: 888345 - DNA, 25 bp, Mus musculus
caagtcagctctggagatgcggaaa

SEQ ID NO: 888346 - DNA, 25 bp, Mus musculus
caagtcagctgtggagatgcggaaa

SEQ ID NO: 888347 - DNA, 25 bp, Mus musculus
caagtcatgtcattgtgcttcttct

SEQ ID NO: 888348 - DNA, 25 bp, Mus musculus
caagtcatgtgattgtgcttcttct

SEQ ID NO: 888349 - DNA, 25 bp, Mus musculus
caagtccaacgacgaccagtccatg

SEQ ID NO: 888350 - DNA, 25 bp, Mus musculus
caagtccaacgaggaccagtccatg

SEQ ID NO: 888351 - DNA, 25 bp, Mus musculus
caagtccaccaacatctcatttaca

SEQ ID NO: 888352 - DNA, 25 bp, Mus musculus
caagtccaccaagatctcatttaca

SEQ ID NO: 888353 - DNA, 25 bp, Mus musculus
caagtccccatgagtgacgctggag

SEQ ID NO: 888354 - DNA, 25 bp, Mus musculus
caagtccccatgtgtgacgctggag

SEQ ID NO: 888355 - DNA, 25 bp, Mus musculus
caagtcccccagacatatcccaggt

SEQ ID NO: 888356 - DNA, 25 bp, Mus musculus
caagtcccccagtcatatcccaggt

SEQ ID NO: 888357 - DNA, 25 bp, Mus musculus
caagtccctggaaaagctacttcat

SEQ ID NO: 888358 - DNA, 25 bp, Mus musculus
caagtccctggataagctacttcat

SEQ ID NO: 888359 - DNA, 25 bp, Mus musculus
caagtccgtgatcacaattgcattt

SEQ ID NO: 888360 - DNA, 25 bp, Mus musculus
caagtccgtgatcacttccgtatct

SEQ ID NO: 888361 - DNA, 25 bp, Mus musculus
caagtccgtgatcagaattgcattt

SEQ ID NO: 888362 - DNA, 25 bp, Mus musculus
caagtccgtgatcagttccgtatct

SEQ ID NO: 888363 - DNA, 25 bp, Mus musculus
caagtcctacaccacggactttgac

SEQ ID NO: 888364 - DNA, 25 bp, Mus musculus
caagtcctacaccagggactttgac

SEQ ID NO: 888365 - DNA, 25 bp, Mus musculus
caagtcctctcgcactaatagtaga

SEQ ID NO: 888366 - DNA, 25 bp, Mus musculus
caagtcctctcgcagtaatagtaga

SEQ ID NO: 888367 - DNA, 25 bp, Mus musculus
caagtcctgaagacaacagacatca

SEQ ID NO: 888368 - DNA, 25 bp, Mus musculus
caagtcctgaagtcaacagacatca

SEQ ID NO: 888369 - DNA, 25 bp, Mus musculus
caagtcctttcactcttttgatgga

SEQ ID NO: 888370 - DNA, 25 bp, Mus musculus
caagtcctttcagtcttttgatgga

SEQ ID NO: 888371 - DNA, 25 bp, Mus musculus
caagtcgaggaacccgtcaagactt

SEQ ID NO: 888372 - DNA, 25 bp, Mus musculus
caagtcgaggaagccgtcaagactt

SEQ ID NO: 888373 - DNA, 25 bp, Mus musculus
caagtcgcttcaccctttaccctcc

SEQ ID NO: 888374 - DNA, 25 bp, Mus musculus
caagtcgcttcagcctttaccctcc

SEQ ID NO: 888375 - DNA, 25 bp, Mus musculus
caagtcgggccacgtacatccaatg

SEQ ID NO: 888376 - DNA, 25 bp, Mus musculus
caagtcgggccaggtacatccaatg

SEQ ID NO: 888377 - DNA, 25 bp, Mus musculus
caagtcgtcgccaaccagccccacc

SEQ ID NO: 888378 - DNA, 25 bp, Mus musculus
caagtcgtcggcaaccagccccacc

SEQ ID NO: 888379 - DNA, 25 bp, Mus musculus
caagtctacaactctcccaggaata

SEQ ID NO: 888380 - DNA, 25 bp, Mus musculus
caagtctacatctctcccaggaata

SEQ ID NO: 888381 - DNA, 25 bp, Mus musculus
caagtctacctgcaccatcgaatcc

SEQ ID NO: 888382 - DNA, 25 bp, Mus musculus
caagtctacctgcacgagaccccat

SEQ ID NO: 888383 - DNA, 25 bp, Mus musculus
caagtctacctgcagcatcgaatcc

SEQ ID NO: 888384 - DNA, 25 bp, Mus musculus
caagtctacctgcaggagaccccat

SEQ ID NO: 888385 - DNA, 25 bp, Mus musculus
caagtctataagcgtcgacatgtta

SEQ ID NO: 888386 - DNA, 25 bp, Mus musculus
caagtctataagggtcgacatgtta

SEQ ID NO: 888387 - DNA, 25 bp, Mus musculus
caagtctcagctggaggaccccctg

SEQ ID NO: 888388 - DNA, 25 bp, Mus musculus
caagtctcaggtggaggaccccctg

SEQ ID NO: 888389 - DNA, 25 bp, Mus musculus
caagtctccatgcacgtagtgcata

SEQ ID NO: 888390 - DNA, 25 bp, Mus musculus
caagtctccatgcaggtagtgcata

SEQ ID NO: 888391 - DNA, 25 bp, Mus musculus
caagtctcggctggatgaaactcag

SEQ ID NO: 888392 - DNA, 25 bp, Mus musculus
caagtctcgggtggatgaaactcag

SEQ ID NO: 888393 - DNA, 25 bp, Mus musculus
caagtctgtgagcctgggacccacg

SEQ ID NO: 888394 - DNA, 25 bp, Mus musculus
caagtctgtgaggctgggacccacg

SEQ ID NO: 888395 - DNA, 25 bp, Mus musculus
caagtctgtgctttgtcccatctgt

SEQ ID NO: 888396 - DNA, 25 bp, Mus musculus
caagtctgtggtttgtcccatctgt

SEQ ID NO: 888397 - DNA, 25 bp, Mus musculus
caagtgacaaggagtgcttacagac

SEQ ID NO: 888398 - DNA, 25 bp, Mus musculus
caagtgacaaggtgtgcttacagac

SEQ ID NO: 888399 - DNA, 25 bp, Mus musculus
caagtgaccatgcaagcgtatttga

SEQ ID NO: 888400 - DNA, 25 bp, Mus musculus
caagtgaccatggaagcgtatttga

SEQ ID NO: 888401 - DNA, 25 bp, Mus musculus
caagtgacccagagatcttcccgga

SEQ ID NO: 888402 - DNA, 25 bp, Mus musculus
caagtgacccagtgatcttcccgga

SEQ ID NO: 888403 - DNA, 25 bp, Mus musculus
caagtgcaagatgatttaccttgct

SEQ ID NO: 888404 - DNA, 25 bp, Mus musculus
caagtgcaagcaatagctgtctgcc

SEQ ID NO: 888405 - DNA, 25 bp, Mus musculus
caagtgcaagccaaaggcagagcaa

SEQ ID NO: 888406 - DNA, 25 bp, Mus musculus
caagtgcaagctttctgaaagacag

SEQ ID NO: 888407 - DNA, 25 bp, Mus musculus
caagtgcaaggaatagctgtctgcc

SEQ ID NO: 888408 - DNA, 25 bp, Mus musculus
caagtgcaaggcaaaggcagagcaa

SEQ ID NO: 888409 - DNA, 25 bp, Mus musculus
caagtgcaaggtttctgaaagacag

SEQ ID NO: 888410 - DNA, 25 bp, Mus musculus
caagtgcaagttgatttaccttgct

SEQ ID NO: 888411 - DNA, 25 bp, Mus musculus
caagtgctgcagcaggctacttttt

SEQ ID NO: 888412 - DNA, 25 bp, Mus musculus
caagtgctgcaggaggctacttttt

SEQ ID NO: 888413 - DNA, 25 bp, Mus musculus
caagtgcttacgacccggcactacg

SEQ ID NO: 888414 - DNA, 25 bp, Mus musculus
caagtgcttacgtcccggcactacg

SEQ ID NO: 888415 - DNA, 25 bp, Mus musculus
caagtggaactacacgcaaccccaa

SEQ ID NO: 888416 - DNA, 25 bp, Mus musculus
caagtggaactacaggcaaccccaa

SEQ ID NO: 888417 - DNA, 25 bp, Mus musculus
caagtggagagacgataccggatgt

SEQ ID NO: 888418 - DNA, 25 bp, Mus musculus
caagtggagagaggataccggatgt

SEQ ID NO: 888419 - DNA, 25 bp, Mus musculus
caagtggaggagctggtggacatca

SEQ ID NO: 888420 - DNA, 25 bp, Mus musculus
caagtggaggaggtggtggacatca

SEQ ID NO: 888421 - DNA, 25 bp, Mus musculus
caagtggctgaccacctggaccaca

SEQ ID NO: 888422 - DNA, 25 bp, Mus musculus
caagtggctgccacccgatggcctc

SEQ ID NO: 888423 - DNA, 25 bp, Mus musculus
caagtggctggcacccgatggcctc

SEQ ID NO: 888424 - DNA, 25 bp, Mus musculus
caagtggctgtccacctggaccaca

SEQ ID NO: 888425 - DNA, 25 bp, Mus musculus
caagtgggagaacgtgcagcagctg

SEQ ID NO: 888426 - DNA, 25 bp, Mus musculus
caagtgggagaaggtgcagcagctg

SEQ ID NO: 888427 - DNA, 25 bp, Mus musculus
caagtgggtgcaatccatgtggtgt

SEQ ID NO: 888428 - DNA, 25 bp, Mus musculus
caagtgggtggaatccatgtggtgt

SEQ ID NO: 888429 - DNA, 25 bp, Mus musculus
caagtggtttccaacgtgtgagtac

SEQ ID NO: 888430 - DNA, 25 bp, Mus musculus
caagtggtttccaaggtgtgagtac

SEQ ID NO: 888431 - DNA, 25 bp, Mus musculus
caagtgtcagagcactcagacagcc

SEQ ID NO: 888432 - DNA, 25 bp, Mus musculus
caagtgtcagaggactcagacagcc

SEQ ID NO: 888433 - DNA, 25 bp, Mus musculus
caagtgtctcagaacgttttccaag

SEQ ID NO: 888434 - DNA, 25 bp, Mus musculus
caagtgtctcagaaggttttccaag

SEQ ID NO: 888435 - DNA, 25 bp, Mus musculus
caagtgtgagcggatccggggtcgt

SEQ ID NO: 888436 - DNA, 25 bp, Mus musculus
caagtgtgagctccctgtcctctgc

SEQ ID NO: 888437 - DNA, 25 bp, Mus musculus
caagtgtgagctccgtgtcctctgc

SEQ ID NO: 888438 - DNA, 25 bp, Mus musculus
caagtgtgaggggatccggggtcgt

SEQ ID NO: 888439 - DNA, 25 bp, Mus musculus
caagtgtttaagccactggaaccag

SEQ ID NO: 888440 - DNA, 25 bp, Mus musculus
caagtgtttaaggcactggaaccag

SEQ ID NO: 888441 - DNA, 25 bp, Mus musculus
caagttaaaacagacgcgtgtgaca

SEQ ID NO: 888442 - DNA, 25 bp, Mus musculus
caagttaaaacagaggcgtgtgaca

SEQ ID NO: 888443 - DNA, 25 bp, Mus musculus
caagttaaatgtgaatttgaacaca

SEQ ID NO: 888444 - DNA, 25 bp, Mus musculus
caagttaaatgtgattttgaacaca

SEQ ID NO: 888445 - DNA, 25 bp, Mus musculus
caagttacagcaggcagtgacattc

SEQ ID NO: 888446 - DNA, 25 bp, Mus musculus
caagttacagcaggcagtgacgttc

SEQ ID NO: 888447 - DNA, 25 bp, Mus musculus
caagttacagctctcctgtttctgg

SEQ ID NO: 888448 - DNA, 25 bp, Mus musculus
caagttacaggaggcagtgacattc

SEQ ID NO: 888449 - DNA, 25 bp, Mus musculus
caagttacaggaggcagtgacgttc

SEQ ID NO: 888450 - DNA, 25 bp, Mus musculus
caagttacaggtctcctgtttctgg

SEQ ID NO: 888451 - DNA, 25 bp, Mus musculus
caagttagagctgagggtggtaaga

SEQ ID NO: 888452 - DNA, 25 bp, Mus musculus
caagttagaggtgagggtggtaaga

SEQ ID NO: 888453 - DNA, 25 bp, Mus musculus
caagttatcaaagacgatgtctcgg

SEQ ID NO: 888454 - DNA, 25 bp, Mus musculus
caagttatcaaagaggatgtctcgg

SEQ ID NO: 888455 - DNA, 25 bp, Mus musculus
caagttcaaatgagacatcctatga

SEQ ID NO: 888456 - DNA, 25 bp, Mus musculus
caagttcaaatgtgacatcctatga

SEQ ID NO: 888457 - DNA, 25 bp, Mus musculus
caagttcacagacctccagaaagca

SEQ ID NO: 888458 - DNA, 25 bp, Mus musculus
caagttcacagagctccagaaagca

SEQ ID NO: 888459 - DNA, 25 bp, Mus musculus
caagttcaccaacatatttatcaac

SEQ ID NO: 888460 - DNA, 25 bp, Mus musculus
caagttcaccaagatatttatcaac

SEQ ID NO: 888461 - DNA, 25 bp, Mus musculus
caagttcacttgcacgtgttgtttg

SEQ ID NO: 888462 - DNA, 25 bp, Mus musculus
caagttcacttgcactcgagcaaaa

SEQ ID NO: 888463 - DNA, 25 bp, Mus musculus
caagttcacttgcaggtgttgtttg

SEQ ID NO: 888464 - DNA, 25 bp, Mus musculus
caagttcacttgcagtcgagcaaaa

SEQ ID NO: 888465 - DNA, 25 bp, Mus musculus
caagttcgacgccttaaaagatgat

SEQ ID NO: 888466 - DNA, 25 bp, Mus musculus
caagttcgacgcgttaaaagatgat

SEQ ID NO: 888467 - DNA, 25 bp, Mus musculus
caagttcgggtttaccctgccatat

SEQ ID NO: 888468 - DNA, 25 bp, Mus musculus
caagttcgggtttagcctgccatat

SEQ ID NO: 888469 - DNA, 25 bp, Mus musculus
caagttctacagccctgagaatacc

SEQ ID NO: 888470 - DNA, 25 bp, Mus musculus
caagttctacagcctgccacaggtg

SEQ ID NO: 888471 - DNA, 25 bp, Mus musculus
caagttctacaggcctgagaatacc

SEQ ID NO: 888472 - DNA, 25 bp, Mus musculus
caagttctacaggctgccacaggtg

SEQ ID NO: 888473 - DNA, 25 bp, Mus musculus
caagttctaccactcgaccctctcc

SEQ ID NO: 888474 - DNA, 25 bp, Mus musculus
caagttctaccactggaccctctcc

SEQ ID NO: 888475 - DNA, 25 bp, Mus musculus
caagttgcccagactgcgctctctg

SEQ ID NO: 888476 - DNA, 25 bp, Mus musculus
caagttgcccagtctgcgctctctg

SEQ ID NO: 888477 - DNA, 25 bp, Mus musculus
caagtttgagaacttgtgcaagagt

SEQ ID NO: 888478 - DNA, 25 bp, Mus musculus
caagtttgagaagttgtgcaagagt

SEQ ID NO: 888479 - DNA, 25 bp, Mus musculus
caagtttgaggccacgttcttccat

SEQ ID NO: 888480 - DNA, 25 bp, Mus musculus
caagtttgaggccaggttcttccat

SEQ ID NO: 888481 - DNA, 25 bp, Mus musculus
caagtttgcaagcaatgttgtggag

SEQ ID NO: 888482 - DNA, 25 bp, Mus musculus
caagtttgcaaggaatgttgtggag

SEQ ID NO: 888483 - DNA, 25 bp, Mus musculus
caagtttgcacacgttgtactccag

SEQ ID NO: 888484 - DNA, 25 bp, Mus musculus
caagtttgcacaggttgtactccag

SEQ ID NO: 888485 - DNA, 25 bp, Mus musculus
caagtttgcccactgtctctgcctc

SEQ ID NO: 888486 - DNA, 25 bp, Mus musculus
caagtttgcccagtgtctctgcctc

SEQ ID NO: 888487 - DNA, 25 bp, Mus musculus
caagtttggcttcccgttgccctat

SEQ ID NO: 888488 - DNA, 25 bp, Mus musculus
caagtttggcttccggttgccctat

SEQ ID NO: 888489 - DNA, 25 bp, Mus musculus
caagtttgtccgcacaaatctgtct

SEQ ID NO: 888490 - DNA, 25 bp, Mus musculus
caagtttgtccgcacgaacctgaat

SEQ ID NO: 888491 - DNA, 25 bp, Mus musculus
caagtttgtccgcagaaatctgtct

SEQ ID NO: 888492 - DNA, 25 bp, Mus musculus
caagtttgtccgcaggaacctgaat

SEQ ID NO: 888493 - DNA, 25 bp, Mus musculus
caataaagacaccacagtgctacaa

SEQ ID NO: 888494 - DNA, 25 bp, Mus musculus
caataaagacacgacagtgctacaa

SEQ ID NO: 888495 - DNA, 25 bp, Mus musculus
caataaagagcacgtgtcacaactg

SEQ ID NO: 888496 - DNA, 25 bp, Mus musculus
caataaagagcaggtgtcacaactg

SEQ ID NO: 888497 - DNA, 25 bp, Mus musculus
caataaagatatcagtgaagacaat

SEQ ID NO: 888498 - DNA, 25 bp, Mus musculus
caataaagatatgagtgaagacaat

SEQ ID NO: 888499 - DNA, 25 bp, Mus musculus
caataaagccatctacatccgagtc

SEQ ID NO: 888500 - DNA, 25 bp, Mus musculus
caataaagccatgtacatccgagtc

SEQ ID NO: 888501 - DNA, 25 bp, Mus musculus
caataacaaatactacacaggatac

SEQ ID NO: 888502 - DNA, 25 bp, Mus musculus
caataacaaatagtacacaggatac

SEQ ID NO: 888503 - DNA, 25 bp, Mus musculus
caataagagaagctggctgtatagg

SEQ ID NO: 888504 - DNA, 25 bp, Mus musculus
caataagagaaggtggctgtatagg

SEQ ID NO: 888505 - DNA, 25 bp, Mus musculus
caataagattgacaccactgttcct

SEQ ID NO: 888506 - DNA, 25 bp, Mus musculus
caataagattgagaccactgttcct

SEQ ID NO: 888507 - DNA, 25 bp, Mus musculus
caataagctacacgagcttcaagtc

SEQ ID NO: 888508 - DNA, 25 bp, Mus musculus
caataagctacaggagcttcaagtc

SEQ ID NO: 888509 - DNA, 25 bp, Mus musculus
caataatcccagatatcggcagagg

SEQ ID NO: 888510 - DNA, 25 bp, Mus musculus
caataatcccagttatcggcagagg

SEQ ID NO: 888511 - DNA, 25 bp, Mus musculus
caataatctgtgaacatgtccagct

SEQ ID NO: 888512 - DNA, 25 bp, Mus musculus
caataatctgtgaagatgtccagct

SEQ ID NO: 888513 - DNA, 25 bp, Mus musculus
caataatgaacacaactggattgct

SEQ ID NO: 888514 - DNA, 25 bp, Mus musculus
caataatgaagacaactggattgct

SEQ ID NO: 888515 - DNA, 25 bp, Mus musculus
caataattatttcgctgatgaagaa

SEQ ID NO: 888516 - DNA, 25 bp, Mus musculus
caataattatttggctgatgaagaa

SEQ ID NO: 888517 - DNA, 25 bp, Mus musculus
caataccagataataaatgacacct

SEQ ID NO: 888518 - DNA, 25 bp, Mus musculus
caataccagatattaaatgacacct

SEQ ID NO: 888519 - DNA, 25 bp, Mus musculus
caataccagtgaaaagcctgcccag

SEQ ID NO: 888520 - DNA, 25 bp, Mus musculus
caataccagtgaaatgcctgcccag

SEQ ID NO: 888521 - DNA, 25 bp, Mus musculus
caatacgagccgcctgagcagctcc

SEQ ID NO: 888522 - DNA, 25 bp, Mus musculus
caatacgagccggctgagcagctcc

SEQ ID NO: 888523 - DNA, 25 bp, Mus musculus
caatactccagacgatgcaaaagtc

SEQ ID NO: 888524 - DNA, 25 bp, Mus musculus
caatactccagaggatgcaaaagtc

SEQ ID NO: 888525 - DNA, 25 bp, Mus musculus
caatagaaagaggccattcctccgg

SEQ ID NO: 888526 - DNA, 25 bp, Mus musculus
caatagaaagtggccattcctccgg

SEQ ID NO: 888527 - DNA, 25 bp, Mus musculus
caataggaggcttaaggtcaataga

SEQ ID NO: 888528 - DNA, 25 bp, Mus musculus
caataggagggttaaggtcaataga

SEQ ID NO: 888529 - DNA, 25 bp, Mus musculus
caatagtaggagaacgtgtgggcag

SEQ ID NO: 888530 - DNA, 25 bp, Mus musculus
caatagtaggagaaggtgtgggcag

SEQ ID NO: 888531 - DNA, 25 bp, Mus musculus
caatagtgcccgaaactgctatgtc

SEQ ID NO: 888532 - DNA, 25 bp, Mus musculus
caatagtgccggaaactgctatgtc

SEQ ID NO: 888533 - DNA, 25 bp, Mus musculus
caatatacagctcctttctgacaga

SEQ ID NO: 888534 - DNA, 25 bp, Mus musculus
caatatacaggtcctttctgacaga

SEQ ID NO: 888535 - DNA, 25 bp, Mus musculus
caatatcactgacaaaaacattgca

SEQ ID NO: 888536 - DNA, 25 bp, Mus musculus
caatatcactgaccagaaaaacatt

SEQ ID NO: 888537 - DNA, 25 bp, Mus musculus
caatatcactgagaaaaacattgca

SEQ ID NO: 888538 - DNA, 25 bp, Mus musculus
caatatcactgagcagaaaaacatt

SEQ ID NO: 888539 - DNA, 25 bp, Mus musculus
caatatcatgcggggatatccctgg

SEQ ID NO: 888540 - DNA, 25 bp, Mus musculus
caatatcatggggggatatccctgg

SEQ ID NO: 888541 - DNA, 25 bp, Mus musculus
caatatgaaaaacctggagaactgt

SEQ ID NO: 888542 - DNA, 25 bp, Mus musculus
caatatgaaaaagctggagaactgt

SEQ ID NO: 888543 - DNA, 25 bp, Mus musculus
caatatgcagaatctcatgaccgcc

SEQ ID NO: 888544 - DNA, 25 bp, Mus musculus
caatatgcagtatctcatgaccgcc

SEQ ID NO: 888545 - DNA, 25 bp, Mus musculus
caatcaagagagaagtggctggaag

SEQ ID NO: 888546 - DNA, 25 bp, Mus musculus
caatcaagagagtagtggctggaag

SEQ ID NO: 888547 - DNA, 25 bp, Mus musculus
caatcaagagcatgaagagaaagtt

SEQ ID NO: 888548 - DNA, 25 bp, Mus musculus
caatcaagaggatgaagagaaagtt

SEQ ID NO: 888549 - DNA, 25 bp, Mus musculus
caatcaagcgctcacatatgctgaa

SEQ ID NO: 888550 - DNA, 25 bp, Mus musculus
caatcaagcgctcagatatgctgaa

SEQ ID NO: 888551 - DNA, 25 bp, Mus musculus
caatcacacgagcgagcacttttca

SEQ ID NO: 888552 - DNA, 25 bp, Mus musculus
caatcacacgtgcgagcacttttca

SEQ ID NO: 888553 - DNA, 25 bp, Mus musculus
caatcacgccaactgcatcgtgcag

SEQ ID NO: 888554 - DNA, 25 bp, Mus musculus
caatcacgccaagtgcatcgtgcag

SEQ ID NO: 888555 - DNA, 25 bp, Mus musculus
caatcacttgtacaccgacttatcg

SEQ ID NO: 888556 - DNA, 25 bp, Mus musculus
caatcacttgtacagcgacttatcg

SEQ ID NO: 888557 - DNA, 25 bp, Mus musculus
caatcataaactcttgtccagagtg

SEQ ID NO: 888558 - DNA, 25 bp, Mus musculus
caatcataaagtcttgtccagagtg

SEQ ID NO: 888559 - DNA, 25 bp, Mus musculus
caatccaacacccccctgctgcctt

SEQ ID NO: 888560 - DNA, 25 bp, Mus musculus
caatccaacaccccccttctcttgc

SEQ ID NO: 888561 - DNA, 25 bp, Mus musculus
caatccaacaccccgctgctgcctt

SEQ ID NO: 888562 - DNA, 25 bp, Mus musculus
caatccaacaccccgcttctcttgc

SEQ ID NO: 888563 - DNA, 25 bp, Mus musculus
caatccagaccacctggactctgac

SEQ ID NO: 888564 - DNA, 25 bp, Mus musculus
caatccagaccagctggactctgac

SEQ ID NO: 888565 - DNA, 25 bp, Mus musculus
caatccgctcgttcctttctctcat

SEQ ID NO: 888566 - DNA, 25 bp, Mus musculus
caatccgctcgttcgtttctctcat

SEQ ID NO: 888567 - DNA, 25 bp, Mus musculus
caatcctcagagctttgaccggatc

SEQ ID NO: 888568 - DNA, 25 bp, Mus musculus
caatcctcagaggtttgaccggatc

SEQ ID NO: 888569 - DNA, 25 bp, Mus musculus
caatcctgccatagcgcaacaaatc

SEQ ID NO: 888570 - DNA, 25 bp, Mus musculus
caatcctgccatagggcaacaaatc

SEQ ID NO: 888571 - DNA, 25 bp, Mus musculus
caatccttcaccaaattatcaaaag

SEQ ID NO: 888572 - DNA, 25 bp, Mus musculus
caatccttcaccaatttatcaaaag

SEQ ID NO: 888573 - DNA, 25 bp, Mus musculus
caatctaatgatcaaacgctgaggc

SEQ ID NO: 888574 - DNA, 25 bp, Mus musculus
caatctaatgatgaaacgctgaggc

SEQ ID NO: 888575 - DNA, 25 bp, Mus musculus
caatctcaccctgtggacgtcagaa

SEQ ID NO: 888576 - DNA, 25 bp, Mus musculus
caatctcaccgtgtggacgtcagaa

SEQ ID NO: 888577 - DNA, 25 bp, Mus musculus
caatctctccagccaggctgcttct

SEQ ID NO: 888578 - DNA, 25 bp, Mus musculus
caatctctccagccagtgaggatcc

SEQ ID NO: 888579 - DNA, 25 bp, Mus musculus
caatctctccagccatatctggcac

SEQ ID NO: 888580 - DNA, 25 bp, Mus musculus
caatctctccagcctggctgcttct

SEQ ID NO: 888581 - DNA, 25 bp, Mus musculus
caatctctccagcctgtgaggatcc

SEQ ID NO: 888582 - DNA, 25 bp, Mus musculus
caatctctccagccttatctggcac

SEQ ID NO: 888583 - DNA, 25 bp, Mus musculus
caatctgaaatactgattggacaat

SEQ ID NO: 888584 - DNA, 25 bp, Mus musculus
caatctgaaatagtgattggacaat

SEQ ID NO: 888585 - DNA, 25 bp, Mus musculus
caatctgcagaagcggcctctggag

SEQ ID NO: 888586 - DNA, 25 bp, Mus musculus
caatctgcagtagcggcctctggag

SEQ ID NO: 888587 - DNA, 25 bp, Mus musculus
caatctgccaagagacaaacagaag

SEQ ID NO: 888588 - DNA, 25 bp, Mus musculus
caatctgccaagaggtccagtgtga

SEQ ID NO: 888589 - DNA, 25 bp, Mus musculus
caatctgccaagtgacaaacagaag

SEQ ID NO: 888590 - DNA, 25 bp, Mus musculus
caatctgccaagtggtccagtgtga

SEQ ID NO: 888591 - DNA, 25 bp, Mus musculus
caatgaaaaaccaaatcgctaacct

SEQ ID NO: 888592 - DNA, 25 bp, Mus musculus
caatgaaaaagcaaatcgctaacct

SEQ ID NO: 888593 - DNA, 25 bp, Mus musculus
caatgaaaacctatccaacggttgt

SEQ ID NO: 888594 - DNA, 25 bp, Mus musculus
caatgaaaacgtatccaacggttgt

SEQ ID NO: 888595 - DNA, 25 bp, Mus musculus
caatgaaaatctcatggtttttaca

SEQ ID NO: 888596 - DNA, 25 bp, Mus musculus
caatgaaaatcttcagaagcagctg

SEQ ID NO: 888597 - DNA, 25 bp, Mus musculus
caatgaaaatgtcatggtttttaca

SEQ ID NO: 888598 - DNA, 25 bp, Mus musculus
caatgaaaatgttcagaagcagctg

SEQ ID NO: 888599 - DNA, 25 bp, Mus musculus
caatgaaatgcttgtatatagtgga

SEQ ID NO: 888600 - DNA, 25 bp, Mus musculus
caatgaaatggttgtatatagtgga

SEQ ID NO: 888601 - DNA, 25 bp, Mus musculus
caatgaagagctggggtcagagagt

SEQ ID NO: 888602 - DNA, 25 bp, Mus musculus
caatgaagaggtggggtcagagagt

SEQ ID NO: 888603 - DNA, 25 bp, Mus musculus
caatgaatgaacttcggggactgca

SEQ ID NO: 888604 - DNA, 25 bp, Mus musculus
caatgaatgaacttgggggactgca

SEQ ID NO: 888605 - DNA, 25 bp, Mus musculus
caatgacaagctgttctttgcctcc

SEQ ID NO: 888606 - DNA, 25 bp, Mus musculus
caatgacaaggtgttctttgcctcc

SEQ ID NO: 888607 - DNA, 25 bp, Mus musculus
caatgacacagacgggctggctgtg

SEQ ID NO: 888608 - DNA, 25 bp, Mus musculus
caatgacacagacgtggcggagaac

SEQ ID NO: 888609 - DNA, 25 bp, Mus musculus
caatgacacagaggggctggctgtg

SEQ ID NO: 888610 - DNA, 25 bp, Mus musculus
caatgacacagaggtggcggagaac

SEQ ID NO: 888611 - DNA, 25 bp, Mus musculus
caatgacacggacgtcctccagcgc

SEQ ID NO: 888612 - DNA, 25 bp, Mus musculus
caatgacacggaggtcctccagcgc

SEQ ID NO: 888613 - DNA, 25 bp, Mus musculus
caatgaccacaactatacgcccacg

SEQ ID NO: 888614 - DNA, 25 bp, Mus musculus
caatgaccacaagtatacgcccacg

SEQ ID NO: 888615 - DNA, 25 bp, Mus musculus
caatgaccagctaacgtttgcagcc

SEQ ID NO: 888616 - DNA, 25 bp, Mus musculus
caatgaccagctaaggtttgcagcc

SEQ ID NO: 888617 - DNA, 25 bp, Mus musculus
caatgacctccgcttggcccagcac

SEQ ID NO: 888618 - DNA, 25 bp, Mus musculus
caatgacctccggttggcccagcac

SEQ ID NO: 888619 - DNA, 25 bp, Mus musculus
caatgactaccgaccagtgaagttc

SEQ ID NO: 888620 - DNA, 25 bp, Mus musculus
caatgactaccgtccagtgaagttc

SEQ ID NO: 888621 - DNA, 25 bp, Mus musculus
caatgacttagacgagtgtgaccag

SEQ ID NO: 888622 - DNA, 25 bp, Mus musculus
caatgacttagaggagtgtgaccag

SEQ ID NO: 888623 - DNA, 25 bp, Mus musculus
caatgacttcaacggtttgatttcc

SEQ ID NO: 888624 - DNA, 25 bp, Mus musculus
caatgacttcaagggtttgatttcc

SEQ ID NO: 888625 - DNA, 25 bp, Mus musculus
caatgacttcagagaatacctgtct

SEQ ID NO: 888626 - DNA, 25 bp, Mus musculus
caatgacttcagctgctgacctcac

SEQ ID NO: 888627 - DNA, 25 bp, Mus musculus
caatgacttcaggtgctgacctcac

SEQ ID NO: 888628 - DNA, 25 bp, Mus musculus
caatgacttcagtgaatacctgtct

SEQ ID NO: 888629 - DNA, 25 bp, Mus musculus
caatgagaagatctatgagctgcgg

SEQ ID NO: 888630 - DNA, 25 bp, Mus musculus
caatgagaagttctatgagctgcgg

SEQ ID NO: 888631 - DNA, 25 bp, Mus musculus
caatgagagaagcttttaggttaat

SEQ ID NO: 888632 - DNA, 25 bp, Mus musculus
caatgagagaaggttttaggttaat

SEQ ID NO: 888633 - DNA, 25 bp, Mus musculus
caatgagagcagctcaaggaggcca

SEQ ID NO: 888634 - DNA, 25 bp, Mus musculus
caatgagagcaggtcaaggaggcca

SEQ ID NO: 888635 - DNA, 25 bp, Mus musculus
caatgagatataaacatacattggg

SEQ ID NO: 888636 - DNA, 25 bp, Mus musculus
caatgagatatatacatacattggg

SEQ ID NO: 888637 - DNA, 25 bp, Mus musculus
caatgagcagcaatcgtaaatatgt

SEQ ID NO: 888638 - DNA, 25 bp, Mus musculus
caatgagcagcaatggtaaatatgt

SEQ ID NO: 888639 - DNA, 25 bp, Mus musculus
caatgaggagagctacacacccctt

SEQ ID NO: 888640 - DNA, 25 bp, Mus musculus
caatgaggagaggtacacacccctt

SEQ ID NO: 888641 - DNA, 25 bp, Mus musculus
caatgataccacagtgctgctgcct

SEQ ID NO: 888642 - DNA, 25 bp, Mus musculus
caatgataccactgtgctgctgcct

SEQ ID NO: 888643 - DNA, 25 bp, Mus musculus
caatgatattagtactctgccctgc

SEQ ID NO: 888644 - DNA, 25 bp, Mus musculus
caatgatattagtagtctgccctgc

SEQ ID NO: 888645 - DNA, 25 bp, Mus musculus
caatgatgaaagcacccatgtactc

SEQ ID NO: 888646 - DNA, 25 bp, Mus musculus
caatgatgaaagcactggtccatgc

SEQ ID NO: 888647 - DNA, 25 bp, Mus musculus
caatgatgaaagcagccatgtactc

SEQ ID NO: 888648 - DNA, 25 bp, Mus musculus
caatgatgaaagcagtggtccatgc

SEQ ID NO: 888649 - DNA, 25 bp, Mus musculus
caatgatgcccacaaggtgaccgag

SEQ ID NO: 888650 - DNA, 25 bp, Mus musculus
caatgatgcccagaaggtgaccgag

SEQ ID NO: 888651 - DNA, 25 bp, Mus musculus
caatgatgtgaacgccctgcttgac

SEQ ID NO: 888652 - DNA, 25 bp, Mus musculus
caatgatgtgaaggccctgcttgac

SEQ ID NO: 888653 - DNA, 25 bp, Mus musculus
caatgattcgccagacgggcctggg

SEQ ID NO: 888654 - DNA, 25 bp, Mus musculus
caatgattcggcagacgggcctggg

SEQ ID NO: 888655 - DNA, 25 bp, Mus musculus
caatgcaaatggcaacaactgtata

SEQ ID NO: 888656 - DNA, 25 bp, Mus musculus
caatgcaaatgggaacaactgtata

SEQ ID NO: 888657 - DNA, 25 bp, Mus musculus
caatgccaacgtgacagtcattcag

SEQ ID NO: 888658 - DNA, 25 bp, Mus musculus
caatgccaacgtgacggagcctgta

SEQ ID NO: 888659 - DNA, 25 bp, Mus musculus
caatgccaacgtgagagtcattcag

SEQ ID NO: 888660 - DNA, 25 bp, Mus musculus
caatgccaacgtgagggagcctgta

SEQ ID NO: 888661 - DNA, 25 bp, Mus musculus
caatgccatatgattctttcccaat

SEQ ID NO: 888662 - DNA, 25 bp, Mus musculus
caatgccatatgtttctttcccaat

SEQ ID NO: 888663 - DNA, 25 bp, Mus musculus
caatgccgagaacaaggaactttgc

SEQ ID NO: 888664 - DNA, 25 bp, Mus musculus
caatgccgagaagaaggaactttgc

SEQ ID NO: 888665 - DNA, 25 bp, Mus musculus
caatgcctagaacagtggttcttcg

SEQ ID NO: 888666 - DNA, 25 bp, Mus musculus
caatgcctagaacgggcaatgtcat

SEQ ID NO: 888667 - DNA, 25 bp, Mus musculus
caatgcctagaagagtggttcttcg

SEQ ID NO: 888668 - DNA, 25 bp, Mus musculus
caatgcctagaaggggcaatgtcat

SEQ ID NO: 888669 - DNA, 25 bp, Mus musculus
caatgccttccacgatgtggagtca

SEQ ID NO: 888670 - DNA, 25 bp, Mus musculus
caatgccttccaggatgtggagtca

SEQ ID NO: 888671 - DNA, 25 bp, Mus musculus
caatgcctttttctgataggttggg

SEQ ID NO: 888672 - DNA, 25 bp, Mus musculus
caatgcctttttgtgataggttggg

SEQ ID NO: 888673 - DNA, 25 bp, Mus musculus
caatgctaaccgcgcatttcagaag

SEQ ID NO: 888674 - DNA, 25 bp, Mus musculus
caatgctaaccgggcatttcagaag

SEQ ID NO: 888675 - DNA, 25 bp, Mus musculus
caatgctagcaaaggccgagaagca

SEQ ID NO: 888676 - DNA, 25 bp, Mus musculus
caatgctagcaatggccgagaagca

SEQ ID NO: 888677 - DNA, 25 bp, Mus musculus
caatgctcagccctttggctcggtt

SEQ ID NO: 888678 - DNA, 25 bp, Mus musculus
caatgctcaggcctttggctcggtt

SEQ ID NO: 888679 - DNA, 25 bp, Mus musculus
caatgctctcagcgaaaattccaga

SEQ ID NO: 888680 - DNA, 25 bp, Mus musculus
caatgctctcagggaaaattccaga

SEQ ID NO: 888681 - DNA, 25 bp, Mus musculus
caatgctgagagcaactgtgggtta

SEQ ID NO: 888682 - DNA, 25 bp, Mus musculus
caatgctgagcatgcccaagaattc

SEQ ID NO: 888683 - DNA, 25 bp, Mus musculus
caatgctgaggatgcccaagaattc

SEQ ID NO: 888684 - DNA, 25 bp, Mus musculus
caatgctgagtgcaactgtgggtta

SEQ ID NO: 888685 - DNA, 25 bp, Mus musculus
caatgctttgaatttaaaatctggc

SEQ ID NO: 888686 - DNA, 25 bp, Mus musculus
caatgctttgatcacagaggcgaag

SEQ ID NO: 888687 - DNA, 25 bp, Mus musculus
caatgctttgtatttaaaatctggc

SEQ ID NO: 888688 - DNA, 25 bp, Mus musculus
caatgctttgttcacagaggcgaag

SEQ ID NO: 888689 - DNA, 25 bp, Mus musculus
caatggaaaaatacctgaatcaagt

SEQ ID NO: 888690 - DNA, 25 bp, Mus musculus
caatggaaaattacctgaatcaagt

SEQ ID NO: 888691 - DNA, 25 bp, Mus musculus
caatggaaggaacgtcaatggaggg

SEQ ID NO: 888692 - DNA, 25 bp, Mus musculus
caatggaaggaaggtcaatggaggg

SEQ ID NO: 888693 - DNA, 25 bp, Mus musculus
caatggacagagtgcctttcaggtg

SEQ ID NO: 888694 - DNA, 25 bp, Mus musculus
caatggacagtgtgcctttcaggtg

SEQ ID NO: 888695 - DNA, 25 bp, Mus musculus
caatggagatggaacaggtccagtc

SEQ ID NO: 888696 - DNA, 25 bp, Mus musculus
caatggagatggaagaggtccagtc

SEQ ID NO: 888697 - DNA, 25 bp, Mus musculus
caatggagatggatgacctactggt

SEQ ID NO: 888698 - DNA, 25 bp, Mus musculus
caatggagatggcctagatgaccta

SEQ ID NO: 888699 - DNA, 25 bp, Mus musculus
caatggagatgggctagatgaccta

SEQ ID NO: 888700 - DNA, 25 bp, Mus musculus
caatggagatggttgacctactggt

SEQ ID NO: 888701 - DNA, 25 bp, Mus musculus
caatggcatcatcgtgctcccccgg

SEQ ID NO: 888702 - DNA, 25 bp, Mus musculus
caatggcatcatggtgctcccccgg

SEQ ID NO: 888703 - DNA, 25 bp, Mus musculus
caatggccaaatcaaagaaatcggc

SEQ ID NO: 888704 - DNA, 25 bp, Mus musculus
caatggccaattcaaagaaatcggc

SEQ ID NO: 888705 - DNA, 25 bp, Mus musculus
caatggccagaagcaccaagaatga

SEQ ID NO: 888706 - DNA, 25 bp, Mus musculus
caatggccagctcaggagtttactg

SEQ ID NO: 888707 - DNA, 25 bp, Mus musculus
caatggccaggtcaggagtttactg

SEQ ID NO: 888708 - DNA, 25 bp, Mus musculus
caatggccagtagcaccaagaatga

SEQ ID NO: 888709 - DNA, 25 bp, Mus musculus
caatggctactcaacctgacctgat

SEQ ID NO: 888710 - DNA, 25 bp, Mus musculus
caatggctactcaagctgacctgat

SEQ ID NO: 888711 - DNA, 25 bp, Mus musculus
caatggctatggaacgtctatcctg

SEQ ID NO: 888712 - DNA, 25 bp, Mus musculus
caatggctatggaaggtctatcctg

SEQ ID NO: 888713 - DNA, 25 bp, Mus musculus
caatggcttcactgcgctggcattg

SEQ ID NO: 888714 - DNA, 25 bp, Mus musculus
caatggcttcactgggctggcattg

SEQ ID NO: 888715 - DNA, 25 bp, Mus musculus
caatgggaacgcacaaaatgaggaa

SEQ ID NO: 888716 - DNA, 25 bp, Mus musculus
caatgggaacgctcaaaatgaggaa

SEQ ID NO: 888717 - DNA, 25 bp, Mus musculus
caatgggaagacattcagctggtca

SEQ ID NO: 888718 - DNA, 25 bp, Mus musculus
caatgggaagtcattcagctggtca

SEQ ID NO: 888719 - DNA, 25 bp, Mus musculus
caatgggtgaagaacaagctgactg

SEQ ID NO: 888720 - DNA, 25 bp, Mus musculus
caatgggtgaagaagaagctgactg

SEQ ID NO: 888721 - DNA, 25 bp, Mus musculus
caatggtgagctgcaggcagagatt

SEQ ID NO: 888722 - DNA, 25 bp, Mus musculus
caatggtgaggtgcaggcagagatt

SEQ ID NO: 888723 - DNA, 25 bp, Mus musculus
caatggtgtttatcaatacacatct

SEQ ID NO: 888724 - DNA, 25 bp, Mus musculus
caatggtgtttatctatacacatct

SEQ ID NO: 888725 - DNA, 25 bp, Mus musculus
caatggttcgccaactgaatggaac

SEQ ID NO: 888726 - DNA, 25 bp, Mus musculus
caatggttcggcaactgaatggaac

SEQ ID NO: 888727 - DNA, 25 bp, Mus musculus
caatgtaaagcaccttttccggcgt

SEQ ID NO: 888728 - DNA, 25 bp, Mus musculus
caatgtaaagcagcttttccggcgt

SEQ ID NO: 888729 - DNA, 25 bp, Mus musculus
caatgtacagatgtggagagagcat

SEQ ID NO: 888730 - DNA, 25 bp, Mus musculus
caatgtacagttgtggagagagcat

SEQ ID NO: 888731 - DNA, 25 bp, Mus musculus
caatgtagagccagtcagagcgctc

SEQ ID NO: 888732 - DNA, 25 bp, Mus musculus
caatgtagaggcagtcagagcgctc

SEQ ID NO: 888733 - DNA, 25 bp, Mus musculus
caatgtcactcacgtgcggacattc

SEQ ID NO: 888734 - DNA, 25 bp, Mus musculus
caatgtcactcaggtgcggacattc

SEQ ID NO: 888735 - DNA, 25 bp, Mus musculus
caatgtcatcgacttgctggacgtt

SEQ ID NO: 888736 - DNA, 25 bp, Mus musculus
caatgtcatcgagttgctggacgtt

SEQ ID NO: 888737 - DNA, 25 bp, Mus musculus
caatgtctgcagctgccatgttggc

SEQ ID NO: 888738 - DNA, 25 bp, Mus musculus
caatgtctgcaggtgccatgttggc

SEQ ID NO: 888739 - DNA, 25 bp, Mus musculus
caatgtgatgagaaagttccatggc

SEQ ID NO: 888740 - DNA, 25 bp, Mus musculus
caatgtgatgagtaagttccatggc

SEQ ID NO: 888741 - DNA, 25 bp, Mus musculus
caatgtgattttcacgaaaagtgca

SEQ ID NO: 888742 - DNA, 25 bp, Mus musculus
caatgtgattttcaggaaaagtgca

SEQ ID NO: 888743 - DNA, 25 bp, Mus musculus
caatgtgcttacatgcatgtgtaat

SEQ ID NO: 888744 - DNA, 25 bp, Mus musculus
caatgtgcttaccagtctactgtgc

SEQ ID NO: 888745 - DNA, 25 bp, Mus musculus
caatgtgcttacgagtctactgtgc

SEQ ID NO: 888746 - DNA, 25 bp, Mus musculus
caatgtgcttacttgcatgtgtaat

SEQ ID NO: 888747 - DNA, 25 bp, Mus musculus
caatgtggacaacgtattctttgat

SEQ ID NO: 888748 - DNA, 25 bp, Mus musculus
caatgtggacaacgtcattgtgctc

SEQ ID NO: 888749 - DNA, 25 bp, Mus musculus
caatgtggacaaggtattctttgat

SEQ ID NO: 888750 - DNA, 25 bp, Mus musculus
caatgtggacaaggtcattgtgctc

SEQ ID NO: 888751 - DNA, 25 bp, Mus musculus
caatgtggacctggccatgggcaag

SEQ ID NO: 888752 - DNA, 25 bp, Mus musculus
caatgtggacgtggccatgggcaag

SEQ ID NO: 888753 - DNA, 25 bp, Mus musculus
caatgtggtgcacgtgatcgaatgg

SEQ ID NO: 888754 - DNA, 25 bp, Mus musculus
caatgtggtgcaggtgatcgaatgg

SEQ ID NO: 888755 - DNA, 25 bp, Mus musculus
caatgtgtccagagcaagatttgag

SEQ ID NO: 888756 - DNA, 25 bp, Mus musculus
caatgtgtccagtgcaagatttgag

SEQ ID NO: 888757 - DNA, 25 bp, Mus musculus
caatgtgtggtgagatattaagaca

SEQ ID NO: 888758 - DNA, 25 bp, Mus musculus
caatgtgtggtgtgatattaagaca

SEQ ID NO: 888759 - DNA, 25 bp, Mus musculus
caatgttaagcgatcgcttacactt

SEQ ID NO: 888760 - DNA, 25 bp, Mus musculus
caatgttaagggatcgcttacactt

SEQ ID NO: 888761 - DNA, 25 bp, Mus musculus
caatgttacagacgccgacagcata

SEQ ID NO: 888762 - DNA, 25 bp, Mus musculus
caatgttacagaggccgacagcata

SEQ ID NO: 888763 - DNA, 25 bp, Mus musculus
caatgttcaggaccttgcagaagga

SEQ ID NO: 888764 - DNA, 25 bp, Mus musculus
caatgttcaggagcttgcagaagga

SEQ ID NO: 888765 - DNA, 25 bp, Mus musculus
caatgttggactcacaggccactac

SEQ ID NO: 888766 - DNA, 25 bp, Mus musculus
caatgttggactcagaggccactac

SEQ ID NO: 888767 - DNA, 25 bp, Mus musculus
caatgttgtacgcctgatggatgtc

SEQ ID NO: 888768 - DNA, 25 bp, Mus musculus
caatgttgtacggctgatggatgtc

SEQ ID NO: 888769 - DNA, 25 bp, Mus musculus
caatgtttatgatacgggacgaaca

SEQ ID NO: 888770 - DNA, 25 bp, Mus musculus
caatgtttatgataggggacgaaca

SEQ ID NO: 888771 - DNA, 25 bp, Mus musculus
caatgtttgcctcggaaatgctcat

SEQ ID NO: 888772 - DNA, 25 bp, Mus musculus
caatgtttgcctgggaaatgctcat

SEQ ID NO: 888773 - DNA, 25 bp, Mus musculus
caattacttgcacttggaaaagatt

SEQ ID NO: 888774 - DNA, 25 bp, Mus musculus
caattacttgcagttggaaaagatt

SEQ ID NO: 888775 - DNA, 25 bp, Mus musculus
caattactttgtcaagtttctggat

SEQ ID NO: 888776 - DNA, 25 bp, Mus musculus
caattactttgtcatgtttctggat

SEQ ID NO: 888777 - DNA, 25 bp, Mus musculus
caattatatccccgtggacttgctg

SEQ ID NO: 888778 - DNA, 25 bp, Mus musculus
caattatatcccggtggacttgctg

SEQ ID NO: 888779 - DNA, 25 bp, Mus musculus
caattcaatggaacctgttcgaagg

SEQ ID NO: 888780 - DNA, 25 bp, Mus musculus
caattcaatggatcctgttcgaagg

SEQ ID NO: 888781 - DNA, 25 bp, Mus musculus
caattcaccaagctctctaagctgc

SEQ ID NO: 888782 - DNA, 25 bp, Mus musculus
caattcaccaaggtctctaagctgc

SEQ ID NO: 888783 - DNA, 25 bp, Mus musculus
caattcaggacgcgtggtcccagga

SEQ ID NO: 888784 - DNA, 25 bp, Mus musculus
caattcaggacgggtggtcccagga

SEQ ID NO: 888785 - DNA, 25 bp, Mus musculus
caattccttggacgttcattctgtg

SEQ ID NO: 888786 - DNA, 25 bp, Mus musculus
caattccttggaggttcattctgtg

SEQ ID NO: 888787 - DNA, 25 bp, Mus musculus
caattcgtgcaccgtaacgtacctg

SEQ ID NO: 888788 - DNA, 25 bp, Mus musculus
caattcgtgcacggtaacgtacctg

SEQ ID NO: 888789 - DNA, 25 bp, Mus musculus
caattctaacagagatataccgcat

SEQ ID NO: 888790 - DNA, 25 bp, Mus musculus
caattctaacagtgatataccgcat

SEQ ID NO: 888791 - DNA, 25 bp, Mus musculus
caattctatacacacgtgattttcg

SEQ ID NO: 888792 - DNA, 25 bp, Mus musculus
caattctatacacaggtgattttcg

SEQ ID NO: 888793 - DNA, 25 bp, Mus musculus
caattcttacagctgaatctgtctc

SEQ ID NO: 888794 - DNA, 25 bp, Mus musculus
caattcttacaggtgaatctgtctc

SEQ ID NO: 888795 - DNA, 25 bp, Mus musculus
caattgatccagaaaataatgtaat

SEQ ID NO: 888796 - DNA, 25 bp, Mus musculus
caattgatcctgaaaataatgtaat

SEQ ID NO: 888797 - DNA, 25 bp, Mus musculus
caattgatggctgctgttgtgatgg

SEQ ID NO: 888798 - DNA, 25 bp, Mus musculus
caattgatgggtgctgttgtgatgg

SEQ ID NO: 888799 - DNA, 25 bp, Mus musculus
caattgcaagatcaagtcctgctac

SEQ ID NO: 888800 - DNA, 25 bp, Mus musculus
caattgcaagttcaagtcctgctac

SEQ ID NO: 888801 - DNA, 25 bp, Mus musculus
caattgcacgctagtgcagtacata

SEQ ID NO: 888802 - DNA, 25 bp, Mus musculus
caattgcacggtagtgcagtacata

SEQ ID NO: 888803 - DNA, 25 bp, Mus musculus
caattgcagaaatacggcagatttg

SEQ ID NO: 888804 - DNA, 25 bp, Mus musculus
caattgcagaaatagggcagatttg

SEQ ID NO: 888805 - DNA, 25 bp, Mus musculus
caattgccaacgaactgaaataccg

SEQ ID NO: 888806 - DNA, 25 bp, Mus musculus
caattgccaaggaactgaaataccg

SEQ ID NO: 888807 - DNA, 25 bp, Mus musculus
caattgccaggacaagcctagtgaa

SEQ ID NO: 888808 - DNA, 25 bp, Mus musculus
caattgccaggagaagcctagtgaa

SEQ ID NO: 888809 - DNA, 25 bp, Mus musculus
caattgcttcatgaatggatgtgac

SEQ ID NO: 888810 - DNA, 25 bp, Mus musculus
caattgcttcatgattggatgtgac

SEQ ID NO: 888811 - DNA, 25 bp, Mus musculus
caattggaaaagaggtccttctgta

SEQ ID NO: 888812 - DNA, 25 bp, Mus musculus
caattggaaaagatatgatgaggaa

SEQ ID NO: 888813 - DNA, 25 bp, Mus musculus
caattggaaaagatttgatgaggaa

SEQ ID NO: 888814 - DNA, 25 bp, Mus musculus
caattggaaaagcaatcttctattt

SEQ ID NO: 888815 - DNA, 25 bp, Mus musculus
caattggaaaaggaatcttctattt

SEQ ID NO: 888816 - DNA, 25 bp, Mus musculus
caattggaaaagtggtccttctgta

SEQ ID NO: 888817 - DNA, 25 bp, Mus musculus
caattggagaagagcaaaaggatga

SEQ ID NO: 888818 - DNA, 25 bp, Mus musculus
caattggagaagtgcaaaaggatga

SEQ ID NO: 888819 - DNA, 25 bp, Mus musculus
caattgtctgttatcacctcactga

SEQ ID NO: 888820 - DNA, 25 bp, Mus musculus
caattgtctgttatgacctcactga

SEQ ID NO: 888821 - DNA, 25 bp, Mus musculus
caattgtggaatgacattcatgaag

SEQ ID NO: 888822 - DNA, 25 bp, Mus musculus
caattgtggaatgagattcatgaag

SEQ ID NO: 888823 - DNA, 25 bp, Mus musculus
caattgttgaaaagatccaagcaaa

SEQ ID NO: 888824 - DNA, 25 bp, Mus musculus
caattgttgaaatgatccaagcaaa

SEQ ID NO: 888825 - DNA, 25 bp, Mus musculus
caatttagtgacttcactccagaag

SEQ ID NO: 888826 - DNA, 25 bp, Mus musculus
caatttagtgacttgactccagaag

SEQ ID NO: 888827 - DNA, 25 bp, Mus musculus
caatttagtgagccacagtacacga

SEQ ID NO: 888828 - DNA, 25 bp, Mus musculus
caatttagtgaggcacagtacacga

SEQ ID NO: 888829 - DNA, 25 bp, Mus musculus
caatttcaccctattagaaagaagc

SEQ ID NO: 888830 - DNA, 25 bp, Mus musculus
caatttcaccgtattagaaagaagc

SEQ ID NO: 888831 - DNA, 25 bp, Mus musculus
caatttccagctcatgagcatggtg

SEQ ID NO: 888832 - DNA, 25 bp, Mus musculus
caatttccaggtcatgagcatggtg

SEQ ID NO: 888833 - DNA, 25 bp, Mus musculus
caatttcgggatataaatccagatg

SEQ ID NO: 888834 - DNA, 25 bp, Mus musculus
caatttcgggatttaaatccagatg

SEQ ID NO: 888835 - DNA, 25 bp, Mus musculus
caatttgcagctagctatccgagag

SEQ ID NO: 888836 - DNA, 25 bp, Mus musculus
caatttgcaggtagctatccgagag

SEQ ID NO: 888837 - DNA, 25 bp, Mus musculus
caatttggagaacgtacattatttt

SEQ ID NO: 888838 - DNA, 25 bp, Mus musculus
caatttggagaaggtacattatttt

SEQ ID NO: 888839 - DNA, 25 bp, Mus musculus
caatttgtcgataatctgtatcgat

SEQ ID NO: 888840 - DNA, 25 bp, Mus musculus
caatttgtcgattatctgtatcgat

SEQ ID NO: 888841 - DNA, 25 bp, Mus musculus
caattttaagagagggtgcctccga

SEQ ID NO: 888842 - DNA, 25 bp, Mus musculus
caattttaagagtgggtgcctccga

SEQ ID NO: 888843 - DNA, 25 bp, Mus musculus
caattttcagcgggtgctgcagaat

SEQ ID NO: 888844 - DNA, 25 bp, Mus musculus
caattttcagggggtgctgcagaat

SEQ ID NO: 888845 - DNA, 25 bp, Mus musculus
cacaaaaaaaacctgcagctcatta

SEQ ID NO: 888846 - DNA, 25 bp, Mus musculus
cacaaaaaaatcctgcagctcatta

SEQ ID NO: 888847 - DNA, 25 bp, Mus musculus
cacaaaaacatcatcgttctcccaa

SEQ ID NO: 888848 - DNA, 25 bp, Mus musculus
cacaaaaacatcatggttctcccaa

SEQ ID NO: 888849 - DNA, 25 bp, Mus musculus
cacaaaaagccaccaccaagtgatc

SEQ ID NO: 888850 - DNA, 25 bp, Mus musculus
cacaaaaagccacggatggctgtgt

SEQ ID NO: 888851 - DNA, 25 bp, Mus musculus
cacaaaaagccagcaccaagtgatc

SEQ ID NO: 888852 - DNA, 25 bp, Mus musculus
cacaaaaagccagggatggctgtgt

SEQ ID NO: 888853 - DNA, 25 bp, Mus musculus
cacaaaacagcctggccttgtggta

SEQ ID NO: 888854 - DNA, 25 bp, Mus musculus
cacaaaacaggctggccttgtggta

SEQ ID NO: 888855 - DNA, 25 bp, Mus musculus
cacaaacaagcttcatgccatccct

SEQ ID NO: 888856 - DNA, 25 bp, Mus musculus
cacaaacaaggttcatgccatccct

SEQ ID NO: 888857 - DNA, 25 bp, Mus musculus
cacaaacaccagcgtgttcccatgg

SEQ ID NO: 888858 - DNA, 25 bp, Mus musculus
cacaaacaccagggtgttcccatgg

SEQ ID NO: 888859 - DNA, 25 bp, Mus musculus
cacaaacacccacgtcattgatggc

SEQ ID NO: 888860 - DNA, 25 bp, Mus musculus
cacaaacacccaggtcattgatggc

SEQ ID NO: 888861 - DNA, 25 bp, Mus musculus
cacaaacatacacgggaaatatcag

SEQ ID NO: 888862 - DNA, 25 bp, Mus musculus
cacaaacatacaggggaaatatcag

SEQ ID NO: 888863 - DNA, 25 bp, Mus musculus
cacaaacgagctataagtattgttt

SEQ ID NO: 888864 - DNA, 25 bp, Mus musculus
cacaaacgagctccttatgtctcct

SEQ ID NO: 888865 - DNA, 25 bp, Mus musculus
cacaaacgaggtataagtattgttt

SEQ ID NO: 888866 - DNA, 25 bp, Mus musculus
cacaaacgaggtccttatgtctcct

SEQ ID NO: 888867 - DNA, 25 bp, Mus musculus
cacaaagccccacgcattcttcagc

SEQ ID NO: 888868 - DNA, 25 bp, Mus musculus
cacaaagccccaggcattcttcagc

SEQ ID NO: 888869 - DNA, 25 bp, Mus musculus
cacaaatatgcgcgctagcggacat

SEQ ID NO: 888870 - DNA, 25 bp, Mus musculus
cacaaatatgggcgctagcggacat

SEQ ID NO: 888871 - DNA, 25 bp, Mus musculus
cacaaatcaaaacgtgtgatccttg

SEQ ID NO: 888872 - DNA, 25 bp, Mus musculus
cacaaatcaaaaggtgtgatccttg

SEQ ID NO: 888873 - DNA, 25 bp, Mus musculus
cacaaatccaaatggaacataacct

SEQ ID NO: 888874 - DNA, 25 bp, Mus musculus
cacaaatccatatggaacataacct

SEQ ID NO: 888875 - DNA, 25 bp, Mus musculus
cacaacaaatagcatggtagaatca

SEQ ID NO: 888876 - DNA, 25 bp, Mus musculus
cacaacaaattgcatggtagaatca

SEQ ID NO: 888877 - DNA, 25 bp, Mus musculus
cacaacaacaggattcgtgagatga

SEQ ID NO: 888878 - DNA, 25 bp, Mus musculus
cacaacaacaggtttcgtgagatga

SEQ ID NO: 888879 - DNA, 25 bp, Mus musculus
cacaacacaacaatcttgggatacg

SEQ ID NO: 888880 - DNA, 25 bp, Mus musculus
cacaacacaagaatcttgggatacg

SEQ ID NO: 888881 - DNA, 25 bp, Mus musculus
cacaacacaagtaactagcttctta

SEQ ID NO: 888882 - DNA, 25 bp, Mus musculus
cacaacacaagtaagtagcttctta

SEQ ID NO: 888883 - DNA, 25 bp, Mus musculus
cacaacacagctcagccaaagcagc

SEQ ID NO: 888884 - DNA, 25 bp, Mus musculus
cacaacacaggtcagccaaagcagc

SEQ ID NO: 888885 - DNA, 25 bp, Mus musculus
cacaacagagccttccacttctatg

SEQ ID NO: 888886 - DNA, 25 bp, Mus musculus
cacaacagaggcttccacttctatg

SEQ ID NO: 888887 - DNA, 25 bp, Mus musculus
cacaacagcaaacgaatttgcagat

SEQ ID NO: 888888 - DNA, 25 bp, Mus musculus
cacaacagcaaaggaatttgcagat

SEQ ID NO: 888889 - DNA, 25 bp, Mus musculus
cacaacaggtcaaaatgtcctgcag

SEQ ID NO: 888890 - DNA, 25 bp, Mus musculus
cacaacaggtcaaattgtcctgcag

SEQ ID NO: 888891 - DNA, 25 bp, Mus musculus
cacaacatcgacaatgtctgcattg

SEQ ID NO: 888892 - DNA, 25 bp, Mus musculus
cacaacatcgtcaatgtctgcattg

SEQ ID NO: 888893 - DNA, 25 bp, Mus musculus
cacaacatctggcacaagctggatg

SEQ ID NO: 888894 - DNA, 25 bp, Mus musculus
cacaacatctgggacaagctggatg

SEQ ID NO: 888895 - DNA, 25 bp, Mus musculus
cacaaccaatgacgaatacttggac

SEQ ID NO: 888896 - DNA, 25 bp, Mus musculus
cacaaccaatgacgaatacttggat

SEQ ID NO: 888897 - DNA, 25 bp, Mus musculus
cacaaccaatgaggaatacttggac

SEQ ID NO: 888898 - DNA, 25 bp, Mus musculus
cacaaccaatgaggaatacttggat

SEQ ID NO: 888899 - DNA, 25 bp, Mus musculus
cacaaccatcaacgtcattattgtc

SEQ ID NO: 888900 - DNA, 25 bp, Mus musculus
cacaaccatcaaggtcattattgtc

SEQ ID NO: 888901 - DNA, 25 bp, Mus musculus
cacaacctgcagaatcttcaggacg

SEQ ID NO: 888902 - DNA, 25 bp, Mus musculus
cacaacctgcagtatcttcaggacg

SEQ ID NO: 888903 - DNA, 25 bp, Mus musculus
cacaacctgtctggagagacagagg

SEQ ID NO: 888904 - DNA, 25 bp, Mus musculus
cacaacctgtctggggagacagagg

SEQ ID NO: 888905 - DNA, 25 bp, Mus musculus
cacaacctgtgtggagagacagagg

SEQ ID NO: 888906 - DNA, 25 bp, Mus musculus
cacaacctgtgtggggagacagagg

SEQ ID NO: 888907 - DNA, 25 bp, Mus musculus
cacaactataaacttgtggtgacag

SEQ ID NO: 888908 - DNA, 25 bp, Mus musculus
cacaactataaagttgtggtgacag

SEQ ID NO: 888909 - DNA, 25 bp, Mus musculus
cacaactgcctgcatgtagatgagt

SEQ ID NO: 888910 - DNA, 25 bp, Mus musculus
cacaactgcctggatgtagatgagt

SEQ ID NO: 888911 - DNA, 25 bp, Mus musculus
cacaacttctcctcagtgtttacaa

SEQ ID NO: 888912 - DNA, 25 bp, Mus musculus
cacaacttctcctctgtgtttacaa

SEQ ID NO: 888913 - DNA, 25 bp, Mus musculus
cacaacttgaatgaacgaagaagaa

SEQ ID NO: 888914 - DNA, 25 bp, Mus musculus
cacaacttgattgaacgaagaagaa

SEQ ID NO: 888915 - DNA, 25 bp, Mus musculus
cacaagaaagaagagccaagtggag

SEQ ID NO: 888916 - DNA, 25 bp, Mus musculus
cacaagaaagctcagtctacatctg

SEQ ID NO: 888917 - DNA, 25 bp, Mus musculus
cacaagaaaggtcagtctacatctg

SEQ ID NO: 888918 - DNA, 25 bp, Mus musculus
cacaagaaagtagagccaagtggag

SEQ ID NO: 888919 - DNA, 25 bp, Mus musculus
cacaagaacagtccaaatctcggtg

SEQ ID NO: 888920 - DNA, 25 bp, Mus musculus
cacaagaacagtgcaaatctcggtg

SEQ ID NO: 888921 - DNA, 25 bp, Mus musculus
cacaagaacatccacaacaactggc

SEQ ID NO: 888922 - DNA, 25 bp, Mus musculus
cacaagaacatccacgtcctgcctg

SEQ ID NO: 888923 - DNA, 25 bp, Mus musculus
cacaagaacatccagaacaactggc

SEQ ID NO: 888924 - DNA, 25 bp, Mus musculus
cacaagaacatccaggtcctgcctg

SEQ ID NO: 888925 - DNA, 25 bp, Mus musculus
cacaagaactgacggcactgatgga

SEQ ID NO: 888926 - DNA, 25 bp, Mus musculus
cacaagaactgagggcactgatgga

SEQ ID NO: 888927 - DNA, 25 bp, Mus musculus
cacaagaagatccacgtcggtcacc

SEQ ID NO: 888928 - DNA, 25 bp, Mus musculus
cacaagaagatccaggtcggtcacc

SEQ ID NO: 888929 - DNA, 25 bp, Mus musculus
cacaagagaatgagctgatgttcct

SEQ ID NO: 888930 - DNA, 25 bp, Mus musculus
cacaagagaatgtgctgatgttcct

SEQ ID NO: 888931 - DNA, 25 bp, Mus musculus
cacaagatacagacgagcctgggtg

SEQ ID NO: 888932 - DNA, 25 bp, Mus musculus
cacaagatacagtcgagcctgggtg

SEQ ID NO: 888933 - DNA, 25 bp, Mus musculus
cacaagatagcagtaggtgccatga

SEQ ID NO: 888934 - DNA, 25 bp, Mus musculus
cacaagataggagtaggtgccatga

SEQ ID NO: 888935 - DNA, 25 bp, Mus musculus
cacaagatcaagagtcggatggaat

SEQ ID NO: 888936 - DNA, 25 bp, Mus musculus
cacaagatcaagtgtcggatggaat

SEQ ID NO: 888937 - DNA, 25 bp, Mus musculus
cacaagatcccaagcttctggtgga

SEQ ID NO: 888938 - DNA, 25 bp, Mus musculus
cacaagatcccaaggttctggtgga

SEQ ID NO: 888939 - DNA, 25 bp, Mus musculus
cacaagcaggagatcctggacaagc

SEQ ID NO: 888940 - DNA, 25 bp, Mus musculus
cacaagcaggagttcctggacaagc

SEQ ID NO: 888941 - DNA, 25 bp, Mus musculus
cacaagcagtgctacttgggtgcaa

SEQ ID NO: 888942 - DNA, 25 bp, Mus musculus
cacaagcagtgctagttgggtgcaa

SEQ ID NO: 888943 - DNA, 25 bp, Mus musculus
cacaagcatggacatcagtatcaag

SEQ ID NO: 888944 - DNA, 25 bp, Mus musculus
cacaagcatggagatcagtatcaag

SEQ ID NO: 888945 - DNA, 25 bp, Mus musculus
cacaagccagcaggtggccaggtgg

SEQ ID NO: 888946 - DNA, 25 bp, Mus musculus
cacaagccaggaggtggccaggtgg

SEQ ID NO: 888947 - DNA, 25 bp, Mus musculus
cacaagcgctgactgaaaatgtgct

SEQ ID NO: 888948 - DNA, 25 bp, Mus musculus
cacaagcgctgagtgaaaatgtgct

SEQ ID NO: 888949 - DNA, 25 bp, Mus musculus
cacaaggtcaaacagttctgtgaaa

SEQ ID NO: 888950 - DNA, 25 bp, Mus musculus
cacaaggtcaaagagttctgtgaaa

SEQ ID NO: 888951 - DNA, 25 bp, Mus musculus
cacaagtaagaagcttcttactacc

SEQ ID NO: 888952 - DNA, 25 bp, Mus musculus
cacaagtaagtagcttcttactacc

SEQ ID NO: 888953 - DNA, 25 bp, Mus musculus
cacaagtacaacatcttgattgcca

SEQ ID NO: 888954 - DNA, 25 bp, Mus musculus
cacaagtacaacttcttgattgcca

SEQ ID NO: 888955 - DNA, 25 bp, Mus musculus
cacaagtacacgacagacggcaacc

SEQ ID NO: 888956 - DNA, 25 bp, Mus musculus
cacaagtacacgcaaatgtgtcatg

SEQ ID NO: 888957 - DNA, 25 bp, Mus musculus
cacaagtacacggaaatgtgtcatg

SEQ ID NO: 888958 - DNA, 25 bp, Mus musculus
cacaagtacacgtcagacggcaacc

SEQ ID NO: 888959 - DNA, 25 bp, Mus musculus
cacaagtataagctgatgttccctg

SEQ ID NO: 888960 - DNA, 25 bp, Mus musculus
cacaagtataaggtgatgttccctg

SEQ ID NO: 888961 - DNA, 25 bp, Mus musculus
cacaagtcaatgcaaaatttccagg

SEQ ID NO: 888962 - DNA, 25 bp, Mus musculus
cacaagtcaatgcccagctaatgta

SEQ ID NO: 888963 - DNA, 25 bp, Mus musculus
cacaagtcaatggaaaatttccagg

SEQ ID NO: 888964 - DNA, 25 bp, Mus musculus
cacaagtcaatggccagctaatgta

SEQ ID NO: 888965 - DNA, 25 bp, Mus musculus
cacaagttagagctgagggtggtaa

SEQ ID NO: 888966 - DNA, 25 bp, Mus musculus
cacaagttagaggtgagggtggtaa

SEQ ID NO: 888967 - DNA, 25 bp, Mus musculus
cacaataacttgcacctacagccag

SEQ ID NO: 888968 - DNA, 25 bp, Mus musculus
cacaataacttggacctacagccag

SEQ ID NO: 888969 - DNA, 25 bp, Mus musculus
cacaataattatttcgctgatgaag

SEQ ID NO: 888970 - DNA, 25 bp, Mus musculus
cacaataattatttggctgatgaag

SEQ ID NO: 888971 - DNA, 25 bp, Mus musculus
cacaatactccagacgatgcaaaag

SEQ ID NO: 888972 - DNA, 25 bp, Mus musculus
cacaatactccagaggatgcaaaag

SEQ ID NO: 888973 - DNA, 25 bp, Mus musculus
cacaatcaaagacgaaagcaagcct

SEQ ID NO: 888974 - DNA, 25 bp, Mus musculus
cacaatcaaagaggaaagcaagcct

SEQ ID NO: 888975 - DNA, 25 bp, Mus musculus
cacaatcaagccacttcggaggagg

SEQ ID NO: 888976 - DNA, 25 bp, Mus musculus
cacaatcaagcccccactgtgttcc

SEQ ID NO: 888977 - DNA, 25 bp, Mus musculus
cacaatcaagctccacaggatgatt

SEQ ID NO: 888978 - DNA, 25 bp, Mus musculus
cacaatcaaggcacttcggaggagg

SEQ ID NO: 888979 - DNA, 25 bp, Mus musculus
cacaatcaaggccccactgtgttcc

SEQ ID NO: 888980 - DNA, 25 bp, Mus musculus
cacaatcaaggtccacaggatgatt

SEQ ID NO: 888981 - DNA, 25 bp, Mus musculus
cacaatccagaccacctggactctg

SEQ ID NO: 888982 - DNA, 25 bp, Mus musculus
cacaatccagaccagctggactctg

SEQ ID NO: 888983 - DNA, 25 bp, Mus musculus
cacaatcctttaccagctactccat

SEQ ID NO: 888984 - DNA, 25 bp, Mus musculus
cacaatcctttagcagctactccat

SEQ ID NO: 888985 - DNA, 25 bp, Mus musculus
cacaatgagatataaacatacattg

SEQ ID NO: 888986 - DNA, 25 bp, Mus musculus
cacaatgagatatatacatacattg

SEQ ID NO: 888987 - DNA, 25 bp, Mus musculus
cacaatgattcgccagacgggcctg

SEQ ID NO: 888988 - DNA, 25 bp, Mus musculus
cacaatgattcggcagacgggcctg

SEQ ID NO: 888989 - DNA, 25 bp, Mus musculus
cacaatgcagcgatcagctcctgtg

SEQ ID NO: 888990 - DNA, 25 bp, Mus musculus
cacaatgcagggatcagctcctgtg

SEQ ID NO: 888991 - DNA, 25 bp, Mus musculus
cacaatggacagagtgcctttcagg

SEQ ID NO: 888992 - DNA, 25 bp, Mus musculus
cacaatggacagtgtgcctttcagg

SEQ ID NO: 888993 - DNA, 25 bp, Mus musculus
cacaatggagcatatccgtgtgggc

SEQ ID NO: 888994 - DNA, 25 bp, Mus musculus
cacaatggaggatatccgtgtgggc

SEQ ID NO: 888995 - DNA, 25 bp, Mus musculus
cacaatggcatcatcgtgctccccc

SEQ ID NO: 888996 - DNA, 25 bp, Mus musculus
cacaatggcatcatggtgctccccc

SEQ ID NO: 888997 - DNA, 25 bp, Mus musculus
cacaattgatccagaaaataatgta

SEQ ID NO: 888998 - DNA, 25 bp, Mus musculus
cacaattgatcctgaaaataatgta

SEQ ID NO: 888999 - DNA, 25 bp, Mus musculus
cacaattggtcaccacagccgcttt

SEQ ID NO: 889000 - DNA, 25 bp, Mus musculus
cacaattggtgaccacagccgcttt

SEQ ID NO: 889001 - DNA, 25 bp, Mus musculus
cacaatttcaccctattagaaagaa

SEQ ID NO: 889002 - DNA, 25 bp, Mus musculus
cacaatttcaccgtattagaaagaa

SEQ ID NO: 889003 - DNA, 25 bp, Mus musculus
cacacaaaacagcctggccttgtgg

SEQ ID NO: 889004 - DNA, 25 bp, Mus musculus
cacacaaaacaggctggccttgtgg

SEQ ID NO: 889005 - DNA, 25 bp, Mus musculus
cacacaacggatgaacaagttgatt

SEQ ID NO: 889006 - DNA, 25 bp, Mus musculus
cacacaacggttgaacaagttgatt

SEQ ID NO: 889007 - DNA, 25 bp, Mus musculus
cacacaagaaagctcagtctacatc

SEQ ID NO: 889008 - DNA, 25 bp, Mus musculus
cacacaagaaaggtcagtctacatc

SEQ ID NO: 889009 - DNA, 25 bp, Mus musculus
cacacaagaactgacggcactgatg

SEQ ID NO: 889010 - DNA, 25 bp, Mus musculus
cacacaagaactgagggcactgatg

SEQ ID NO: 889011 - DNA, 25 bp, Mus musculus
cacacaataacttgcacctacagcc

SEQ ID NO: 889012 - DNA, 25 bp, Mus musculus
cacacaataacttggacctacagcc

SEQ ID NO: 889013 - DNA, 25 bp, Mus musculus
cacacaattgcgccggcggcggctg

SEQ ID NO: 889014 - DNA, 25 bp, Mus musculus
cacacaattgctggacgcagacgat

SEQ ID NO: 889015 - DNA, 25 bp, Mus musculus
cacacaattgggccggcggcggctg

SEQ ID NO: 889016 - DNA, 25 bp, Mus musculus
cacacaattggtggacgcagacgat

SEQ ID NO: 889017 - DNA, 25 bp, Mus musculus
cacacacaacggatgaacaagttga

SEQ ID NO: 889018 - DNA, 25 bp, Mus musculus
cacacacaacggttgaacaagttga

SEQ ID NO: 889019 - DNA, 25 bp, Mus musculus
cacacaccccagagaactgtattca

SEQ ID NO: 889020 - DNA, 25 bp, Mus musculus
cacacaccccagagtactgtattca

SEQ ID NO: 889021 - DNA, 25 bp, Mus musculus
cacacaccgcagcttgtcaggatgt

SEQ ID NO: 889022 - DNA, 25 bp, Mus musculus
cacacaccgcaggttgtcaggatgt

SEQ ID NO: 889023 - DNA, 25 bp, Mus musculus
cacacaccggacttggaaggagact

SEQ ID NO: 889024 - DNA, 25 bp, Mus musculus
cacacaccggtcttggaaggagact

SEQ ID NO: 889025 - DNA, 25 bp, Mus musculus
cacacacggaagaacaacatcagaa

SEQ ID NO: 889026 - DNA, 25 bp, Mus musculus
cacacacggaagaagaacatcagaa

SEQ ID NO: 889027 - DNA, 25 bp, Mus musculus
cacacacttaagaatgaagagcatc

SEQ ID NO: 889028 - DNA, 25 bp, Mus musculus
cacacacttaagtatgaagagcatc

SEQ ID NO: 889029 - DNA, 25 bp, Mus musculus
cacacagaagaatctctcctttgct

SEQ ID NO: 889030 - DNA, 25 bp, Mus musculus
cacacagaagtatctctcctttgct

SEQ ID NO: 889031 - DNA, 25 bp, Mus musculus
cacacagataaactggggctccagg

SEQ ID NO: 889032 - DNA, 25 bp, Mus musculus
cacacagataaagtggggctccagg

SEQ ID NO: 889033 - DNA, 25 bp, Mus musculus
cacacagcaagtcgtgattggcacg

SEQ ID NO: 889034 - DNA, 25 bp, Mus musculus
cacacagcaagtggtgattggcacg

SEQ ID NO: 889035 - DNA, 25 bp, Mus musculus
cacacagcagccaacataatggagt

SEQ ID NO: 889036 - DNA, 25 bp, Mus musculus
cacacagcaggcaacataatggagt

SEQ ID NO: 889037 - DNA, 25 bp, Mus musculus
cacacagccaagcacgtattcctca

SEQ ID NO: 889038 - DNA, 25 bp, Mus musculus
cacacagccaagcaggtattcctca

SEQ ID NO: 889039 - DNA, 25 bp, Mus musculus
cacacagccaagcgtcgattccgag

SEQ ID NO: 889040 - DNA, 25 bp, Mus musculus
cacacagccaagggtcgattccgag

SEQ ID NO: 889041 - DNA, 25 bp, Mus musculus
cacacagctccacagcacgtacgac

SEQ ID NO: 889042 - DNA, 25 bp, Mus musculus
cacacagctccagagcacgtacgac

SEQ ID NO: 889043 - DNA, 25 bp, Mus musculus
cacacaggcaggcacattgaccttg

SEQ ID NO: 889044 - DNA, 25 bp, Mus musculus
cacacaggcaggcagattgaccttg

SEQ ID NO: 889045 - DNA, 25 bp, Mus musculus
cacacaggtaagcgcagatgtcatc

SEQ ID NO: 889046 - DNA, 25 bp, Mus musculus
cacacaggtaagggcagatgtcatc

SEQ ID NO: 889047 - DNA, 25 bp, Mus musculus
cacacagtcaagccttaaagaaagt

SEQ ID NO: 889048 - DNA, 25 bp, Mus musculus
cacacagtcaaggcttaaagaaagt

SEQ ID NO: 889049 - DNA, 25 bp, Mus musculus
cacacagtggagcattaccaggcaa

SEQ ID NO: 889050 - DNA, 25 bp, Mus musculus
cacacagtggaggattaccaggcaa

SEQ ID NO: 889051 - DNA, 25 bp, Mus musculus
cacacatacccagcaatatcagttg

SEQ ID NO: 889052 - DNA, 25 bp, Mus musculus
cacacatacccagctatatcagttg

SEQ ID NO: 889053 - DNA, 25 bp, Mus musculus
cacacatgacctctacatgatcatg

SEQ ID NO: 889054 - DNA, 25 bp, Mus musculus
cacacatgacctgtacatgatcatg

SEQ ID NO: 889055 - DNA, 25 bp, Mus musculus
cacacatgatcgcaacaccatggac

SEQ ID NO: 889056 - DNA, 25 bp, Mus musculus
cacacatgatcggaacaccatggac

SEQ ID NO: 889057 - DNA, 25 bp, Mus musculus
cacaccaaagcagtgccaggaggta

SEQ ID NO: 889058 - DNA, 25 bp, Mus musculus
cacaccaaaggagtgccaggaggta

SEQ ID NO: 889059 - DNA, 25 bp, Mus musculus
cacaccaagaaccacgcgctcaact

SEQ ID NO: 889060 - DNA, 25 bp, Mus musculus
cacaccaagaaccaggcgctcaact

SEQ ID NO: 889061 - DNA, 25 bp, Mus musculus
cacaccacacagaacaatctctcct

SEQ ID NO: 889062 - DNA, 25 bp, Mus musculus
cacaccacacagaagaatctctcct

SEQ ID NO: 889063 - DNA, 25 bp, Mus musculus
cacaccacagccggtgtctattggg

SEQ ID NO: 889064 - DNA, 25 bp, Mus musculus
cacaccacaggcggtgtctattggg

SEQ ID NO: 889065 - DNA, 25 bp, Mus musculus
cacaccacccagactatgaaatccc

SEQ ID NO: 889066 - DNA, 25 bp, Mus musculus
cacaccacccagtctatgaaatccc

SEQ ID NO: 889067 - DNA, 25 bp, Mus musculus
cacaccagagataccatgatggccc

SEQ ID NO: 889068 - DNA, 25 bp, Mus musculus
cacaccagagcagataccatgatgg

SEQ ID NO: 889069 - DNA, 25 bp, Mus musculus
cacaccagaggagataccatgatgg

SEQ ID NO: 889070 - DNA, 25 bp, Mus musculus
cacaccagagttaccatgatggccc

SEQ ID NO: 889071 - DNA, 25 bp, Mus musculus
cacaccatcatgccaggaaatgtgg

SEQ ID NO: 889072 - DNA, 25 bp, Mus musculus
cacaccatcatggcaggaaatgtgg

SEQ ID NO: 889073 - DNA, 25 bp, Mus musculus
cacaccattcagctttctcccagat

SEQ ID NO: 889074 - DNA, 25 bp, Mus musculus
cacaccattcaggtttctcccagat

SEQ ID NO: 889075 - DNA, 25 bp, Mus musculus
cacacccatacacaaattagacggc

SEQ ID NO: 889076 - DNA, 25 bp, Mus musculus
cacacccatacagaaattagacggc

SEQ ID NO: 889077 - DNA, 25 bp, Mus musculus
cacaccccagagaactgtattcaac

SEQ ID NO: 889078 - DNA, 25 bp, Mus musculus
cacaccccagagtactgtattcaac

SEQ ID NO: 889079 - DNA, 25 bp, Mus musculus
cacaccccagcttttatgtatgaaa

SEQ ID NO: 889080 - DNA, 25 bp, Mus musculus
cacaccccaggttttatgtatgaaa

SEQ ID NO: 889081 - DNA, 25 bp, Mus musculus
cacacccctgaaatcgcattatcca

SEQ ID NO: 889082 - DNA, 25 bp, Mus musculus
cacacccctgaaatggcattatcca

SEQ ID NO: 889083 - DNA, 25 bp, Mus musculus
cacaccctcccccacagtgctgacc

SEQ ID NO: 889084 - DNA, 25 bp, Mus musculus
cacaccctcccccagagtgctgacc

SEQ ID NO: 889085 - DNA, 25 bp, Mus musculus
cacaccgcagcttgtcaggatgtcc

SEQ ID NO: 889086 - DNA, 25 bp, Mus musculus
cacaccgcaggttgtcaggatgtcc

SEQ ID NO: 889087 - DNA, 25 bp, Mus musculus
cacacctaagatggaacagctagcc

SEQ ID NO: 889088 - DNA, 25 bp, Mus musculus
cacacctaagattgagcagctagcc

SEQ ID NO: 889089 - DNA, 25 bp, Mus musculus
cacacctaagttggaacagctagcc

SEQ ID NO: 889090 - DNA, 25 bp, Mus musculus
cacacctaagtttgagcagctagcc

SEQ ID NO: 889091 - DNA, 25 bp, Mus musculus
cacacctagccaccaccaccaccaa

SEQ ID NO: 889092 - DNA, 25 bp, Mus musculus
cacacctagccagcaccaccaccaa

SEQ ID NO: 889093 - DNA, 25 bp, Mus musculus
cacacctcagcttccctcagctctc

SEQ ID NO: 889094 - DNA, 25 bp, Mus musculus
cacacctcaggttccctcagctctc

SEQ ID NO: 889095 - DNA, 25 bp, Mus musculus
cacacctcgaagcatcctgcacaac

SEQ ID NO: 889096 - DNA, 25 bp, Mus musculus
cacacctcgaaggatcctgcacaac

SEQ ID NO: 889097 - DNA, 25 bp, Mus musculus
cacacctctctgagtgctgagctac

SEQ ID NO: 889098 - DNA, 25 bp, Mus musculus
cacacctctctgtgtgctgagctac

SEQ ID NO: 889099 - DNA, 25 bp, Mus musculus
cacacctgaaccagatatctgtcat

SEQ ID NO: 889100 - DNA, 25 bp, Mus musculus
cacacctgaacctgatatctgtcat

SEQ ID NO: 889101 - DNA, 25 bp, Mus musculus
cacacctggctattcacaagaaggc

SEQ ID NO: 889102 - DNA, 25 bp, Mus musculus
cacacctggctattcactccacggc

SEQ ID NO: 889103 - DNA, 25 bp, Mus musculus
cacacctggctattgacaagaaggc

SEQ ID NO: 889104 - DNA, 25 bp, Mus musculus
cacacctggctattgactccacggc

SEQ ID NO: 889105 - DNA, 25 bp, Mus musculus
cacacgaccttgcacgtaccatgcg

SEQ ID NO: 889106 - DNA, 25 bp, Mus musculus
cacacgaccttggacgtaccatgcg

SEQ ID NO: 889107 - DNA, 25 bp, Mus musculus
cacacgcatcgaggcggctacccga

SEQ ID NO: 889108 - DNA, 25 bp, Mus musculus
cacacgcatcgagggggctacccga

SEQ ID NO: 889109 - DNA, 25 bp, Mus musculus
cacacgcgccctcacatgtcacctg

SEQ ID NO: 889110 - DNA, 25 bp, Mus musculus
cacacgcgccctcactgggaagatg

SEQ ID NO: 889111 - DNA, 25 bp, Mus musculus
cacacgcgccctcagatgtcacctg

SEQ ID NO: 889112 - DNA, 25 bp, Mus musculus
cacacgcgccctcagtgggaagatg

SEQ ID NO: 889113 - DNA, 25 bp, Mus musculus
cacacgctgtgcagaatgagcaaca

SEQ ID NO: 889114 - DNA, 25 bp, Mus musculus
cacacgctgtgctgaatgagcaaca

SEQ ID NO: 889115 - DNA, 25 bp, Mus musculus
cacacggaagaacaacatcagaaag

SEQ ID NO: 889116 - DNA, 25 bp, Mus musculus
cacacggaagaagaacatcagaaag

SEQ ID NO: 889117 - DNA, 25 bp, Mus musculus
cacacgggctgctgcaaagggataa

SEQ ID NO: 889118 - DNA, 25 bp, Mus musculus
cacacgggctgctggaaagggataa

SEQ ID NO: 889119 - DNA, 25 bp, Mus musculus
cacacgtgaccactatggcaagaag

SEQ ID NO: 889120 - DNA, 25 bp, Mus musculus
cacacgtgaccagtatggcaagaag

SEQ ID NO: 889121 - DNA, 25 bp, Mus musculus
cacacgtgctcacagcagagcctct

SEQ ID NO: 889122 - DNA, 25 bp, Mus musculus
cacacgtgctcacccctttgttcag

SEQ ID NO: 889123 - DNA, 25 bp, Mus musculus
cacacgtgctcagagcagagcctct

SEQ ID NO: 889124 - DNA, 25 bp, Mus musculus
cacacgtgctcagccctttgttcag

SEQ ID NO: 889125 - DNA, 25 bp, Mus musculus
cacactacagcctccttcctgacat

SEQ ID NO: 889126 - DNA, 25 bp, Mus musculus
cacactacagctctgtaactggttc

SEQ ID NO: 889127 - DNA, 25 bp, Mus musculus
cacactacaggctccttcctgacat

SEQ ID NO: 889128 - DNA, 25 bp, Mus musculus
cacactacaggtctgtaactggttc

SEQ ID NO: 889129 - DNA, 25 bp, Mus musculus
cacactattgcgatggaagactgtg

SEQ ID NO: 889130 - DNA, 25 bp, Mus musculus
cacactattgctcctgagttcaatt

SEQ ID NO: 889131 - DNA, 25 bp, Mus musculus
cacactattgggatggaagactgtg

SEQ ID NO: 889132 - DNA, 25 bp, Mus musculus
cacactattggtcctgagttcaatt

SEQ ID NO: 889133 - DNA, 25 bp, Mus musculus
cacactcaagatcaattctctccgt

SEQ ID NO: 889134 - DNA, 25 bp, Mus musculus
cacactcaagttcaattctctccgt

SEQ ID NO: 889135 - DNA, 25 bp, Mus musculus
cacactcacagaaacgtgtccaccc

SEQ ID NO: 889136 - DNA, 25 bp, Mus musculus
cacactcacagaaaggtgtccaccc

SEQ ID NO: 889137 - DNA, 25 bp, Mus musculus
cacactcagagacacgcctcaggat

SEQ ID NO: 889138 - DNA, 25 bp, Mus musculus
cacactcagagacaggcctcaggat

SEQ ID NO: 889139 - DNA, 25 bp, Mus musculus
cacactcaggcgacaattcaagctt

SEQ ID NO: 889140 - DNA, 25 bp, Mus musculus
cacactcaggggacaattcaagctt

SEQ ID NO: 889141 - DNA, 25 bp, Mus musculus
cacactccagtccaccaatcccagg

SEQ ID NO: 889142 - DNA, 25 bp, Mus musculus
cacactccagtccagcaatcccagg

SEQ ID NO: 889143 - DNA, 25 bp, Mus musculus
cacactccatcacttctcatcgcag

SEQ ID NO: 889144 - DNA, 25 bp, Mus musculus
cacactccatcagttctcatcgcag

SEQ ID NO: 889145 - DNA, 25 bp, Mus musculus
cacactccgacacctttccaccacc

SEQ ID NO: 889146 - DNA, 25 bp, Mus musculus
cacactccgacagctttccaccacc

SEQ ID NO: 889147 - DNA, 25 bp, Mus musculus
cacactcttcaacgtaaagtggatc

SEQ ID NO: 889148 - DNA, 25 bp, Mus musculus
cacactcttcaaggtaaagtggatc

SEQ ID NO: 889149 - DNA, 25 bp, Mus musculus
cacactcttcagagggcccgggatg

SEQ ID NO: 889150 - DNA, 25 bp, Mus musculus
cacactcttcagtgggcccgggatg

SEQ ID NO: 889151 - DNA, 25 bp, Mus musculus
cacactgcaagaaccagcactgcgg

SEQ ID NO: 889152 - DNA, 25 bp, Mus musculus
cacactgcaagatccagcactgcgg

SEQ ID NO: 889153 - DNA, 25 bp, Mus musculus
cacactgcgctaccctgtgaagcca

SEQ ID NO: 889154 - DNA, 25 bp, Mus musculus
cacactgcgctagcctgtgaagcca

SEQ ID NO: 889155 - DNA, 25 bp, Mus musculus
cacacttaagaatgaagagcatcat

SEQ ID NO: 889156 - DNA, 25 bp, Mus musculus
cacacttaagtatgaagagcatcat

SEQ ID NO: 889157 - DNA, 25 bp, Mus musculus
cacacttattcacacgcaaacgcac

SEQ ID NO: 889158 - DNA, 25 bp, Mus musculus
cacacttattcacaggcaaacgcac

SEQ ID NO: 889159 - DNA, 25 bp, Mus musculus
cacacttcacaacgatggaatagag

SEQ ID NO: 889160 - DNA, 25 bp, Mus musculus
cacacttcacaaggatggaatagag

SEQ ID NO: 889161 - DNA, 25 bp, Mus musculus
cacacttccccgtctgtatgctggg

SEQ ID NO: 889162 - DNA, 25 bp, Mus musculus
cacacttcccggtctgtatgctggg

SEQ ID NO: 889163 - DNA, 25 bp, Mus musculus
cacacttcggacacagtacatgaag

SEQ ID NO: 889164 - DNA, 25 bp, Mus musculus
cacacttcggacactgtacatgaag

SEQ ID NO: 889165 - DNA, 25 bp, Mus musculus
cacacttcttccagccttaaccatg

SEQ ID NO: 889166 - DNA, 25 bp, Mus musculus
cacacttcttcctgccttaaccatg

SEQ ID NO: 889167 - DNA, 25 bp, Mus musculus
cacagaaaaccacactgtcctgtgc

SEQ ID NO: 889168 - DNA, 25 bp, Mus musculus
cacagaaaaccacagtgtcctgtgc

SEQ ID NO: 889169 - DNA, 25 bp, Mus musculus
cacagaaaagaacgctggtgaggac

SEQ ID NO: 889170 - DNA, 25 bp, Mus musculus
cacagaaaagaaggctggtgaggac

SEQ ID NO: 889171 - DNA, 25 bp, Mus musculus
cacagaaaccaaccagttggccaaa

SEQ ID NO: 889172 - DNA, 25 bp, Mus musculus
cacagaaaccaagcagttggccaaa

SEQ ID NO: 889173 - DNA, 25 bp, Mus musculus
cacagaaatgctgcacaatgtcacc

SEQ ID NO: 889174 - DNA, 25 bp, Mus musculus
cacagaaatggtgcacaatgtcacc

SEQ ID NO: 889175 - DNA, 25 bp, Mus musculus
cacagaacagcccgcaagataattc

SEQ ID NO: 889176 - DNA, 25 bp, Mus musculus
cacagaacaggccgcaagataattc

SEQ ID NO: 889177 - DNA, 25 bp, Mus musculus
cacagaacgacagcgccatctgtcc

SEQ ID NO: 889178 - DNA, 25 bp, Mus musculus
cacagaacgagagcgccatctgtcc

SEQ ID NO: 889179 - DNA, 25 bp, Mus musculus
cacagaactcacaagccttattcct

SEQ ID NO: 889180 - DNA, 25 bp, Mus musculus
cacagaactcactagccttattcct

SEQ ID NO: 889181 - DNA, 25 bp, Mus musculus
cacagaagaaagcattgtggaacaa

SEQ ID NO: 889182 - DNA, 25 bp, Mus musculus
cacagaagaaaggattgtggaacaa

SEQ ID NO: 889183 - DNA, 25 bp, Mus musculus
cacagaagacagccaccacggctat

SEQ ID NO: 889184 - DNA, 25 bp, Mus musculus
cacagaagacaggcaccacggctat

SEQ ID NO: 889185 - DNA, 25 bp, Mus musculus
cacagaagatggcacaatagtgatt

SEQ ID NO: 889186 - DNA, 25 bp, Mus musculus
cacagaagatggcagaatagtgatt

SEQ ID NO: 889187 - DNA, 25 bp, Mus musculus
cacagaagcagtcagtacaacacat

SEQ ID NO: 889188 - DNA, 25 bp, Mus musculus
cacagaagcagtcgtatttatgagc

SEQ ID NO: 889189 - DNA, 25 bp, Mus musculus
cacagaagcagtgagtacaacacat

SEQ ID NO: 889190 - DNA, 25 bp, Mus musculus
cacagaagcagtggtatttatgagc

SEQ ID NO: 889191 - DNA, 25 bp, Mus musculus
cacagaagcgagccattgacgtcac

SEQ ID NO: 889192 - DNA, 25 bp, Mus musculus
cacagaagcgaggcattgacgtcac

SEQ ID NO: 889193 - DNA, 25 bp, Mus musculus
cacagaagtgcctgaagtacttgaa

SEQ ID NO: 889194 - DNA, 25 bp, Mus musculus
cacagaagtggctgaagtacttgaa

SEQ ID NO: 889195 - DNA, 25 bp, Mus musculus
cacagaatcccactctcctcactac

SEQ ID NO: 889196 - DNA, 25 bp, Mus musculus
cacagaatcccactggggaaacggc

SEQ ID NO: 889197 - DNA, 25 bp, Mus musculus
cacagaatcccagtctcctcactac

SEQ ID NO: 889198 - DNA, 25 bp, Mus musculus
cacagaatcccagtggggaaacggc

SEQ ID NO: 889199 - DNA, 25 bp, Mus musculus
cacagaatgcaactcacacaaggac

SEQ ID NO: 889200 - DNA, 25 bp, Mus musculus
cacagaatgcaagtcacacaaggac

SEQ ID NO: 889201 - DNA, 25 bp, Mus musculus
cacagacaagctggagcgaatcaag

SEQ ID NO: 889202 - DNA, 25 bp, Mus musculus
cacagacaaggtggagcgaatcaag

SEQ ID NO: 889203 - DNA, 25 bp, Mus musculus
cacagacaatccaatggtctttgcc

SEQ ID NO: 889204 - DNA, 25 bp, Mus musculus
cacagacaatcctatggtctttgcc

SEQ ID NO: 889205 - DNA, 25 bp, Mus musculus
cacagacaccgctcctgtcttatct

SEQ ID NO: 889206 - DNA, 25 bp, Mus musculus
cacagacaccgctcgtgtcttatct

SEQ ID NO: 889207 - DNA, 25 bp, Mus musculus
cacagacatgatggtgggcattggg

SEQ ID NO: 889208 - DNA, 25 bp, Mus musculus
cacagacatgttggtgggcattggg

SEQ ID NO: 889209 - DNA, 25 bp, Mus musculus
cacagaccagctgggagcatgccgg

SEQ ID NO: 889210 - DNA, 25 bp, Mus musculus
cacagaccaggtgggagcatgccgg

SEQ ID NO: 889211 - DNA, 25 bp, Mus musculus
cacagactcaagcctccttgtcagc

SEQ ID NO: 889212 - DNA, 25 bp, Mus musculus
cacagactcaaggctccttgtcagc

SEQ ID NO: 889213 - DNA, 25 bp, Mus musculus
cacagacttctccgtgaaggaggac

SEQ ID NO: 889214 - DNA, 25 bp, Mus musculus
cacagacttctcggtgaaggaggac

SEQ ID NO: 889215 - DNA, 25 bp, Mus musculus
cacagagaaactgagcaaaatcagc

SEQ ID NO: 889216 - DNA, 25 bp, Mus musculus
cacagagaaagtgagcaaaatcagc

SEQ ID NO: 889217 - DNA, 25 bp, Mus musculus
cacagagaagctggggactctagac

SEQ ID NO: 889218 - DNA, 25 bp, Mus musculus
cacagagaaggtggggactctagac

SEQ ID NO: 889219 - DNA, 25 bp, Mus musculus
cacagagaatgacggtaagatgatc

SEQ ID NO: 889220 - DNA, 25 bp, Mus musculus
cacagagaatgagggtaagatgatc

SEQ ID NO: 889221 - DNA, 25 bp, Mus musculus
cacagagacctcaacgctgaaaatc

SEQ ID NO: 889222 - DNA, 25 bp, Mus musculus
cacagagacctcaaggctgaaaatc

SEQ ID NO: 889223 - DNA, 25 bp, Mus musculus
cacagagatccaccaagtccctatt

SEQ ID NO: 889224 - DNA, 25 bp, Mus musculus
cacagagatccacctagtccctatt

SEQ ID NO: 889225 - DNA, 25 bp, Mus musculus
cacagagattcacgttctcccctat

SEQ ID NO: 889226 - DNA, 25 bp, Mus musculus
cacagagattcaggttctcccctat

SEQ ID NO: 889227 - DNA, 25 bp, Mus musculus
cacagagcaaagcaatccagactgg

SEQ ID NO: 889228 - DNA, 25 bp, Mus musculus
cacagagcaaaggaatccagactgg

SEQ ID NO: 889229 - DNA, 25 bp, Mus musculus
cacagagcaccgcgcaagagtccat

SEQ ID NO: 889230 - DNA, 25 bp, Mus musculus
cacagagcaccgcggactcctgaga

SEQ ID NO: 889231 - DNA, 25 bp, Mus musculus
cacagagcaccgggcaagagtccat

SEQ ID NO: 889232 - DNA, 25 bp, Mus musculus
cacagagcaccggggactcctgaga

SEQ ID NO: 889233 - DNA, 25 bp, Mus musculus
cacagagcagatttaataacccacg

SEQ ID NO: 889234 - DNA, 25 bp, Mus musculus
cacagagcagttttaataacccacg

SEQ ID NO: 889235 - DNA, 25 bp, Mus musculus
cacagagccaacaatgacaacacaa

SEQ ID NO: 889236 - DNA, 25 bp, Mus musculus
cacagagccatcaatgacaacacaa

SEQ ID NO: 889237 - DNA, 25 bp, Mus musculus
cacagagcctgacgtgtttaaatac

SEQ ID NO: 889238 - DNA, 25 bp, Mus musculus
cacagagcctgaggtgtttaaatac

SEQ ID NO: 889239 - DNA, 25 bp, Mus musculus
cacagagcttcccacgtctctttga

SEQ ID NO: 889240 - DNA, 25 bp, Mus musculus
cacagagcttcccaggtctctttga

SEQ ID NO: 889241 - DNA, 25 bp, Mus musculus
cacagaggaaagcaaaaacatgcag

SEQ ID NO: 889242 - DNA, 25 bp, Mus musculus
cacagaggaaaggaaaaacatgcag

SEQ ID NO: 889243 - DNA, 25 bp, Mus musculus
cacagaggaacacgtgtcttggctc

SEQ ID NO: 889244 - DNA, 25 bp, Mus musculus
cacagaggaacaggtgtcttggctc

SEQ ID NO: 889245 - DNA, 25 bp, Mus musculus
cacagaggaccacgtggtctccacg

SEQ ID NO: 889246 - DNA, 25 bp, Mus musculus
cacagaggaccaggtggtctccacg

SEQ ID NO: 889247 - DNA, 25 bp, Mus musculus
cacagaggcgctgaaggaatatgac

SEQ ID NO: 889248 - DNA, 25 bp, Mus musculus
cacagaggcggtgaaggaatatgac

SEQ ID NO: 889249 - DNA, 25 bp, Mus musculus
cacagatgacatcttaccacatgac

SEQ ID NO: 889250 - DNA, 25 bp, Mus musculus
cacagatgacatgttaccacatgac

SEQ ID NO: 889251 - DNA, 25 bp, Mus musculus
cacagatgtgcggaacagtgctgag

SEQ ID NO: 889252 - DNA, 25 bp, Mus musculus
cacagatgtggggaacagtgctgag

SEQ ID NO: 889253 - DNA, 25 bp, Mus musculus
cacagattagctcttattttaacta

SEQ ID NO: 889254 - DNA, 25 bp, Mus musculus
cacagattagctgttattttaacta

SEQ ID NO: 889255 - DNA, 25 bp, Mus musculus
cacagattggcacgaagatcaaact

SEQ ID NO: 889256 - DNA, 25 bp, Mus musculus
cacagattggcaggaagatcaaact

SEQ ID NO: 889257 - DNA, 25 bp, Mus musculus
cacagcaaacagagccctttgccat

SEQ ID NO: 889258 - DNA, 25 bp, Mus musculus
cacagcaaacagtgccctttgccat

SEQ ID NO: 889259 - DNA, 25 bp, Mus musculus
cacagcaactagccatgaagcacta

SEQ ID NO: 889260 - DNA, 25 bp, Mus musculus
cacagcaactaggcatgaagcacta

SEQ ID NO: 889261 - DNA, 25 bp, Mus musculus
cacagcacatatggtcagaaaacac

SEQ ID NO: 889262 - DNA, 25 bp, Mus musculus
cacagcacatttggtcagaaaacac

SEQ ID NO: 889263 - DNA, 25 bp, Mus musculus
cacagcacctatcgggctgaatgcg

SEQ ID NO: 889264 - DNA, 25 bp, Mus musculus
cacagcacctatggggctgaatgcg

SEQ ID NO: 889265 - DNA, 25 bp, Mus musculus
cacagcagccagcagatgtcctctg

SEQ ID NO: 889266 - DNA, 25 bp, Mus musculus
cacagcagccaggagatgtcctctg

SEQ ID NO: 889267 - DNA, 25 bp, Mus musculus
cacagcagcgctgtcctccatgaag

SEQ ID NO: 889268 - DNA, 25 bp, Mus musculus
cacagcagcggtgtcctccatgaag

SEQ ID NO: 889269 - DNA, 25 bp, Mus musculus
cacagcaggacacgcagagtttaca

SEQ ID NO: 889270 - DNA, 25 bp, Mus musculus
cacagcaggacaggcagagtttaca

SEQ ID NO: 889271 - DNA, 25 bp, Mus musculus
cacagcagtacacccagtctgagag

SEQ ID NO: 889272 - DNA, 25 bp, Mus musculus
cacagcagtacagccagtctgagag

SEQ ID NO: 889273 - DNA, 25 bp, Mus musculus
cacagcatcattaccaacctccttt

SEQ ID NO: 889274 - DNA, 25 bp, Mus musculus
cacagcatcattacgaacctccttt

SEQ ID NO: 889275 - DNA, 25 bp, Mus musculus
cacagcatcgaggacgaagaattca

SEQ ID NO: 889276 - DNA, 25 bp, Mus musculus
cacagcatcgaggaggaagaattca

SEQ ID NO: 889277 - DNA, 25 bp, Mus musculus
cacagcatgactctgtgtccattgt

SEQ ID NO: 889278 - DNA, 25 bp, Mus musculus
cacagcatgactgtgtgtccattgt

SEQ ID NO: 889279 - DNA, 25 bp, Mus musculus
cacagcattaagcctcggctattag

SEQ ID NO: 889280 - DNA, 25 bp, Mus musculus
cacagcattaaggctcggctattag

SEQ ID NO: 889281 - DNA, 25 bp, Mus musculus
cacagccaacagctcagaccaagcc

SEQ ID NO: 889282 - DNA, 25 bp, Mus musculus
cacagccaacaggtcagaccaagcc

SEQ ID NO: 889283 - DNA, 25 bp, Mus musculus
cacagccaagcacccctgcgctcca

SEQ ID NO: 889284 - DNA, 25 bp, Mus musculus
cacagccaagcacgtattcctcagt

SEQ ID NO: 889285 - DNA, 25 bp, Mus musculus
cacagccaagcaggtattcctcagt

SEQ ID NO: 889286 - DNA, 25 bp, Mus musculus
cacagccaaggacccctgcgctcca

SEQ ID NO: 889287 - DNA, 25 bp, Mus musculus
cacagccagcatctgttcctggcgc

SEQ ID NO: 889288 - DNA, 25 bp, Mus musculus
cacagccagcatgtgttcctggcgc

SEQ ID NO: 889289 - DNA, 25 bp, Mus musculus
cacagccaggagtcctgtctcaact

SEQ ID NO: 889290 - DNA, 25 bp, Mus musculus
cacagccaggtgtcctgtctcaact

SEQ ID NO: 889291 - DNA, 25 bp, Mus musculus
cacagcccagcttttctgcttttgt

SEQ ID NO: 889292 - DNA, 25 bp, Mus musculus
cacagcccaggttttctgcttttgt

SEQ ID NO: 889293 - DNA, 25 bp, Mus musculus
cacagcccccagctcgtagtgcatg

SEQ ID NO: 889294 - DNA, 25 bp, Mus musculus
cacagcccccaggtcgtagtgcatg

SEQ ID NO: 889295 - DNA, 25 bp, Mus musculus
cacagccccgcacacactgggttcc

SEQ ID NO: 889296 - DNA, 25 bp, Mus musculus
cacagccccgcagacactgggttcc

SEQ ID NO: 889297 - DNA, 25 bp, Mus musculus
cacagccgagttcacattctccgag

SEQ ID NO: 889298 - DNA, 25 bp, Mus musculus
cacagccgagttcacggaacagatt

SEQ ID NO: 889299 - DNA, 25 bp, Mus musculus
cacagccgagttcagattctccgag

SEQ ID NO: 889300 - DNA, 25 bp, Mus musculus
cacagccgagttcagggaacagatt

SEQ ID NO: 889301 - DNA, 25 bp, Mus musculus
cacagccgcttccgcattctggaat

SEQ ID NO: 889302 - DNA, 25 bp, Mus musculus
cacagccgcttcggcattctggaat

SEQ ID NO: 889303 - DNA, 25 bp, Mus musculus
cacagccggggacgtggtggagaag

SEQ ID NO: 889304 - DNA, 25 bp, Mus musculus
cacagccggggaggtggtggagaag

SEQ ID NO: 889305 - DNA, 25 bp, Mus musculus
cacagcctagagcggtgaactggtg

SEQ ID NO: 889306 - DNA, 25 bp, Mus musculus
cacagcctagaggggtgaactggtg

SEQ ID NO: 889307 - DNA, 25 bp, Mus musculus
cacagcctgccacacgaagagagct

SEQ ID NO: 889308 - DNA, 25 bp, Mus musculus
cacagcctgccacaggaagagagct

SEQ ID NO: 889309 - DNA, 25 bp, Mus musculus
cacagccttccacgatgcctgaagg

SEQ ID NO: 889310 - DNA, 25 bp, Mus musculus
cacagccttccaggatgcctgaagg

SEQ ID NO: 889311 - DNA, 25 bp, Mus musculus
cacagcggagcatgcaagacgtcgg

SEQ ID NO: 889312 - DNA, 25 bp, Mus musculus
cacagcggaggatgcaagacgtcgg

SEQ ID NO: 889313 - DNA, 25 bp, Mus musculus
cacagcgtcctccgggtagctggga

SEQ ID NO: 889314 - DNA, 25 bp, Mus musculus
cacagcgtcctcggggtagctggga

SEQ ID NO: 889315 - DNA, 25 bp, Mus musculus
cacagcgtgttgctaacacatcaac

SEQ ID NO: 889316 - DNA, 25 bp, Mus musculus
cacagcgtgttggtaacacatcaac

SEQ ID NO: 889317 - DNA, 25 bp, Mus musculus
cacagcgttcacaacatcatttcca

SEQ ID NO: 889318 - DNA, 25 bp, Mus musculus
cacagcgttcacaactctgagttca

SEQ ID NO: 889319 - DNA, 25 bp, Mus musculus
cacagcgttcacaagatcatttcca

SEQ ID NO: 889320 - DNA, 25 bp, Mus musculus
cacagcgttcacaagtctgagttca

SEQ ID NO: 889321 - DNA, 25 bp, Mus musculus
cacagctaagatcacagccatgaac

SEQ ID NO: 889322 - DNA, 25 bp, Mus musculus
cacagctaagctcttcgactccacg

SEQ ID NO: 889323 - DNA, 25 bp, Mus musculus
cacagctaaggtcttcgactccacg

SEQ ID NO: 889324 - DNA, 25 bp, Mus musculus
cacagctaagttcacagccatgaac

SEQ ID NO: 889325 - DNA, 25 bp, Mus musculus
cacagctatgactggtgatggtgtg

SEQ ID NO: 889326 - DNA, 25 bp, Mus musculus
cacagctatgtctggtgatggtgtg

SEQ ID NO: 889327 - DNA, 25 bp, Mus musculus
cacagctcacagaaccctgcagagc

SEQ ID NO: 889328 - DNA, 25 bp, Mus musculus
cacagctcacagaagcctgcagagc

SEQ ID NO: 889329 - DNA, 25 bp, Mus musculus
cacagctcggagatgggagctttgt

SEQ ID NO: 889330 - DNA, 25 bp, Mus musculus
cacagctcggagcacagatgggagc

SEQ ID NO: 889331 - DNA, 25 bp, Mus musculus
cacagctcggaggacagatgggagc

SEQ ID NO: 889332 - DNA, 25 bp, Mus musculus
cacagctcggagttgggagctttgt

SEQ ID NO: 889333 - DNA, 25 bp, Mus musculus
cacagctctgcagatggtgaaagag

SEQ ID NO: 889334 - DNA, 25 bp, Mus musculus
cacagctctggagatggtgaaagag

SEQ ID NO: 889335 - DNA, 25 bp, Mus musculus
cacagctgccagcttatagtaatgg

SEQ ID NO: 889336 - DNA, 25 bp, Mus musculus
cacagctgccaggttatagtaatgg

SEQ ID NO: 889337 - DNA, 25 bp, Mus musculus
cacagctgtctactccccatggaca

SEQ ID NO: 889338 - DNA, 25 bp, Mus musculus
cacagctgtctagtccccatggaca

SEQ ID NO: 889339 - DNA, 25 bp, Mus musculus
cacagcttcagtatacaggggtgca

SEQ ID NO: 889340 - DNA, 25 bp, Mus musculus
cacagcttcagtttacaggggtgca

SEQ ID NO: 889341 - DNA, 25 bp, Mus musculus
cacagcttcccacgagatgtacgac

SEQ ID NO: 889342 - DNA, 25 bp, Mus musculus
cacagcttcccaggagatgtacgac

SEQ ID NO: 889343 - DNA, 25 bp, Mus musculus
cacagctttccacaattcctcagag

SEQ ID NO: 889344 - DNA, 25 bp, Mus musculus
cacagctttccacacttacaacagc

SEQ ID NO: 889345 - DNA, 25 bp, Mus musculus
cacagctttccagaattcctcagag

SEQ ID NO: 889346 - DNA, 25 bp, Mus musculus
cacagctttccagacttacaacagc

SEQ ID NO: 889347 - DNA, 25 bp, Mus musculus
cacaggaaacaagacatggagcaga

SEQ ID NO: 889348 - DNA, 25 bp, Mus musculus
cacaggaaacaagagatggagcaga

SEQ ID NO: 889349 - DNA, 25 bp, Mus musculus
cacaggaacaagatcctgcacaggg

SEQ ID NO: 889350 - DNA, 25 bp, Mus musculus
cacaggaacaagctgtggccaaacg

SEQ ID NO: 889351 - DNA, 25 bp, Mus musculus
cacaggaacaaggtgtggccaaacg

SEQ ID NO: 889352 - DNA, 25 bp, Mus musculus
cacaggaacaagttcctgcacaggg

SEQ ID NO: 889353 - DNA, 25 bp, Mus musculus
cacaggaacatcctgactttatatg

SEQ ID NO: 889354 - DNA, 25 bp, Mus musculus
cacaggaacatcgtgactttatatg

SEQ ID NO: 889355 - DNA, 25 bp, Mus musculus
cacaggaagtcacctagcagccaca

SEQ ID NO: 889356 - DNA, 25 bp, Mus musculus
cacaggaagtcagctagcagccaca

SEQ ID NO: 889357 - DNA, 25 bp, Mus musculus
cacaggaatgcgtgccatctatggc

SEQ ID NO: 889358 - DNA, 25 bp, Mus musculus
cacaggaatgggtgccatctatggc

SEQ ID NO: 889359 - DNA, 25 bp, Mus musculus
cacaggacagatcaagactggtgct

SEQ ID NO: 889360 - DNA, 25 bp, Mus musculus
cacaggacagttcaagactggtgct

SEQ ID NO: 889361 - DNA, 25 bp, Mus musculus
cacaggaccactcactacaacctac

SEQ ID NO: 889362 - DNA, 25 bp, Mus musculus
cacaggaccactcagtacaacctac

SEQ ID NO: 889363 - DNA, 25 bp, Mus musculus
cacaggacccaacggagagccaggt

SEQ ID NO: 889364 - DNA, 25 bp, Mus musculus
cacaggacccaagggagagccaggt

SEQ ID NO: 889365 - DNA, 25 bp, Mus musculus
cacaggacggaaagcgaatggaccc

SEQ ID NO: 889366 - DNA, 25 bp, Mus musculus
cacaggacggaatgcgaatggaccc

SEQ ID NO: 889367 - DNA, 25 bp, Mus musculus
cacaggactgagcaagcaatgaagc

SEQ ID NO: 889368 - DNA, 25 bp, Mus musculus
cacaggactgaggaagcaatgaagc

SEQ ID NO: 889369 - DNA, 25 bp, Mus musculus
cacaggagccaagacctatgagcca

SEQ ID NO: 889370 - DNA, 25 bp, Mus musculus
cacaggagccaagactgaagaacaa

SEQ ID NO: 889371 - DNA, 25 bp, Mus musculus
cacaggagccaagagctatgagcca

SEQ ID NO: 889372 - DNA, 25 bp, Mus musculus
cacaggagccaagagtgaagaacaa

SEQ ID NO: 889373 - DNA, 25 bp, Mus musculus
cacaggagtgccaacatatcgatga

SEQ ID NO: 889374 - DNA, 25 bp, Mus musculus
cacaggagtgccaagatatcgatga

SEQ ID NO: 889375 - DNA, 25 bp, Mus musculus
cacaggatggccagactcagcctca

SEQ ID NO: 889376 - DNA, 25 bp, Mus musculus
cacaggatggccaggcagactcagc

SEQ ID NO: 889377 - DNA, 25 bp, Mus musculus
cacaggatgggcagactcagcctca

SEQ ID NO: 889378 - DNA, 25 bp, Mus musculus
cacaggatgggcaggcagactcagc

SEQ ID NO: 889379 - DNA, 25 bp, Mus musculus
cacaggattcagcccactaaacctc

SEQ ID NO: 889380 - DNA, 25 bp, Mus musculus
cacaggattcagctctgtttcctag

SEQ ID NO: 889381 - DNA, 25 bp, Mus musculus
cacaggattcaggccactaaacctc

SEQ ID NO: 889382 - DNA, 25 bp, Mus musculus
cacaggattcaggtctgtttcctag

SEQ ID NO: 889383 - DNA, 25 bp, Mus musculus
cacaggattgagctccagaaggatg

SEQ ID NO: 889384 - DNA, 25 bp, Mus musculus
cacaggattgaggtccagaaggatg

SEQ ID NO: 889385 - DNA, 25 bp, Mus musculus
cacaggcaagcttgtctacttcacc

SEQ ID NO: 889386 - DNA, 25 bp, Mus musculus
cacaggcaaggttgtctacttcacc

SEQ ID NO: 889387 - DNA, 25 bp, Mus musculus
cacaggcagcacaggacattcatgg

SEQ ID NO: 889388 - DNA, 25 bp, Mus musculus
cacaggcagcacagtggacattcat

SEQ ID NO: 889389 - DNA, 25 bp, Mus musculus
cacaggcagcactggacattcatgg

SEQ ID NO: 889390 - DNA, 25 bp, Mus musculus
cacaggcagcactgtggacattcat

SEQ ID NO: 889391 - DNA, 25 bp, Mus musculus
cacaggcaggcacattgaccttggc

SEQ ID NO: 889392 - DNA, 25 bp, Mus musculus
cacaggcaggcagattgaccttggc

SEQ ID NO: 889393 - DNA, 25 bp, Mus musculus
cacaggcatgctggctgcttgtctc

SEQ ID NO: 889394 - DNA, 25 bp, Mus musculus
cacaggcatggtggctgcttgtctc

SEQ ID NO: 889395 - DNA, 25 bp, Mus musculus
cacaggccgagacgttgcaataaaa

SEQ ID NO: 889396 - DNA, 25 bp, Mus musculus
cacaggccgagaggttgcaataaaa

SEQ ID NO: 889397 - DNA, 25 bp, Mus musculus
cacaggccgctcaacttcctggtat

SEQ ID NO: 889398 - DNA, 25 bp, Mus musculus
cacaggccgctcaagttcctggtat

SEQ ID NO: 889399 - DNA, 25 bp, Mus musculus
cacaggccttggcctggagcacccg

SEQ ID NO: 889400 - DNA, 25 bp, Mus musculus
cacaggccttgggctggagcacccg

SEQ ID NO: 889401 - DNA, 25 bp, Mus musculus
cacaggcgggcgctgtatcctcaga

SEQ ID NO: 889402 - DNA, 25 bp, Mus musculus
cacaggcgggcggtgtatcctcaga

SEQ ID NO: 889403 - DNA, 25 bp, Mus musculus
cacaggctccagcctgttggaaagc

SEQ ID NO: 889404 - DNA, 25 bp, Mus musculus
cacaggctccaggctgttggaaagc

SEQ ID NO: 889405 - DNA, 25 bp, Mus musculus
cacaggctcctgagcgcagccttgg

SEQ ID NO: 889406 - DNA, 25 bp, Mus musculus
cacaggctcctgcccaggagcaaga

SEQ ID NO: 889407 - DNA, 25 bp, Mus musculus
cacaggctcctggccaggagcaaga

SEQ ID NO: 889408 - DNA, 25 bp, Mus musculus
cacaggctcctgtgcgcagccttgg

SEQ ID NO: 889409 - DNA, 25 bp, Mus musculus
cacagggatctgcctgccaggaact

SEQ ID NO: 889410 - DNA, 25 bp, Mus musculus
cacagggatctggctgccaggaact

SEQ ID NO: 889411 - DNA, 25 bp, Mus musculus
cacagggcaaagactggtcttacac

SEQ ID NO: 889412 - DNA, 25 bp, Mus musculus
cacagggcaaagtctggtcttacac

SEQ ID NO: 889413 - DNA, 25 bp, Mus musculus
cacaggtgtgaacatattgacgagt

SEQ ID NO: 889414 - DNA, 25 bp, Mus musculus
cacaggtgtgaagatattgacgagt

SEQ ID NO: 889415 - DNA, 25 bp, Mus musculus
cacaggtttctgcttatggttcagg

SEQ ID NO: 889416 - DNA, 25 bp, Mus musculus
cacaggtttctggttatggttcagg

SEQ ID NO: 889417 - DNA, 25 bp, Mus musculus
cacagtaaggacacgaagttgggag

SEQ ID NO: 889418 - DNA, 25 bp, Mus musculus
cacagtaaggtcacgaagttgggag

SEQ ID NO: 889419 - DNA, 25 bp, Mus musculus
cacagtacaacaggcttgccaagtc

SEQ ID NO: 889420 - DNA, 25 bp, Mus musculus
cacagtacaagaggcttgccaagtc

SEQ ID NO: 889421 - DNA, 25 bp, Mus musculus
cacagtatcacacgtatccaactgg

SEQ ID NO: 889422 - DNA, 25 bp, Mus musculus
cacagtatcacaggtatccaactgg

SEQ ID NO: 889423 - DNA, 25 bp, Mus musculus
cacagtatggcagttatggaacagc

SEQ ID NO: 889424 - DNA, 25 bp, Mus musculus
cacagtatgggagttatggaacagc

SEQ ID NO: 889425 - DNA, 25 bp, Mus musculus
cacagtcaagcactcattgtgggtg

SEQ ID NO: 889426 - DNA, 25 bp, Mus musculus
cacagtcaagccttaaagaaagtgt

SEQ ID NO: 889427 - DNA, 25 bp, Mus musculus
cacagtcaaggactcattgtgggtg

SEQ ID NO: 889428 - DNA, 25 bp, Mus musculus
cacagtcaaggcttaaagaaagtgt

SEQ ID NO: 889429 - DNA, 25 bp, Mus musculus
cacagtcagatgcaatccagcaagc

SEQ ID NO: 889430 - DNA, 25 bp, Mus musculus
cacagtcagatggaatccagcaagc

SEQ ID NO: 889431 - DNA, 25 bp, Mus musculus
cacagtcagcatgcaaataaccact

SEQ ID NO: 889432 - DNA, 25 bp, Mus musculus
cacagtcagcatgctaataaccact

SEQ ID NO: 889433 - DNA, 25 bp, Mus musculus
cacagtccggctgtattcagcctgc

SEQ ID NO: 889434 - DNA, 25 bp, Mus musculus
cacagtccgggtgtattcagcctgc

SEQ ID NO: 889435 - DNA, 25 bp, Mus musculus
cacagtcctcagcgttcaagttcct

SEQ ID NO: 889436 - DNA, 25 bp, Mus musculus
cacagtcctcagggttcaagttcct

SEQ ID NO: 889437 - DNA, 25 bp, Mus musculus
cacagtcctcgacacttcacccgaa

SEQ ID NO: 889438 - DNA, 25 bp, Mus musculus
cacagtcctcgagacttcacccgaa

SEQ ID NO: 889439 - DNA, 25 bp, Mus musculus
cacagtcctgagctgtgccaccagg

SEQ ID NO: 889440 - DNA, 25 bp, Mus musculus
cacagtcctgaggtgtgccaccagg

SEQ ID NO: 889441 - DNA, 25 bp, Mus musculus
cacagtctccacaacgtgctgctgc

SEQ ID NO: 889442 - DNA, 25 bp, Mus musculus
cacagtctccacaaggtgctgctgc

SEQ ID NO: 889443 - DNA, 25 bp, Mus musculus
cacagtgaagccccgtgagcactgc

SEQ ID NO: 889444 - DNA, 25 bp, Mus musculus
cacagtgaaggcccgtgagcactgc

SEQ ID NO: 889445 - DNA, 25 bp, Mus musculus
cacagtgaatatcgtaaaaagcacc

SEQ ID NO: 889446 - DNA, 25 bp, Mus musculus
cacagtgaatatggtaaaaagcacc

SEQ ID NO: 889447 - DNA, 25 bp, Mus musculus
cacagtgaatcaccctcaccttcag

SEQ ID NO: 889448 - DNA, 25 bp, Mus musculus
cacagtgaatcagcctcaccttcag

SEQ ID NO: 889449 - DNA, 25 bp, Mus musculus
cacagtgacaaggccagcctccagg

SEQ ID NO: 889450 - DNA, 25 bp, Mus musculus
cacagtgacaaggcgagcctccagg

SEQ ID NO: 889451 - DNA, 25 bp, Mus musculus
cacagtgactgacataacagcctca

SEQ ID NO: 889452 - DNA, 25 bp, Mus musculus
cacagtgactgagataacagcctca

SEQ ID NO: 889453 - DNA, 25 bp, Mus musculus
cacagtgcacactgcgtttaacagc

SEQ ID NO: 889454 - DNA, 25 bp, Mus musculus
cacagtgcacactgggtttaacagc

SEQ ID NO: 889455 - DNA, 25 bp, Mus musculus
cacagtgcattgccgacaaaccaga

SEQ ID NO: 889456 - DNA, 25 bp, Mus musculus
cacagtgcattggcgacaaaccaga

SEQ ID NO: 889457 - DNA, 25 bp, Mus musculus
cacagtggagcattaccaggcaatt

SEQ ID NO: 889458 - DNA, 25 bp, Mus musculus
cacagtggaggattaccaggcaatt

SEQ ID NO: 889459 - DNA, 25 bp, Mus musculus
cacagtgtaaaaacagaaagtgtgg

SEQ ID NO: 889460 - DNA, 25 bp, Mus musculus
cacagtgtaaaatcagaaagtgtgg

SEQ ID NO: 889461 - DNA, 25 bp, Mus musculus
cacagtgtaaagctctatgtcagaa

SEQ ID NO: 889462 - DNA, 25 bp, Mus musculus
cacagtgtaaaggtctatgtcagaa

SEQ ID NO: 889463 - DNA, 25 bp, Mus musculus
cacagttatgaatgcaattggcagt

SEQ ID NO: 889464 - DNA, 25 bp, Mus musculus
cacagttatgctgtgggagatcccg

SEQ ID NO: 889465 - DNA, 25 bp, Mus musculus
cacagttatggtgtgggagatcccg

SEQ ID NO: 889466 - DNA, 25 bp, Mus musculus
cacagttatgtatgcaattggcagt

SEQ ID NO: 889467 - DNA, 25 bp, Mus musculus
cacagttccaagccctggagatgga

SEQ ID NO: 889468 - DNA, 25 bp, Mus musculus
cacagttccaaggcctggagatgga

SEQ ID NO: 889469 - DNA, 25 bp, Mus musculus
cacagttcgcagatacacttttggc

SEQ ID NO: 889470 - DNA, 25 bp, Mus musculus
cacagttcgcagcaggcagagtaag

SEQ ID NO: 889471 - DNA, 25 bp, Mus musculus
cacagttcgcaggaggcagagtaag

SEQ ID NO: 889472 - DNA, 25 bp, Mus musculus
cacagttcgcagttacacttttggc

SEQ ID NO: 889473 - DNA, 25 bp, Mus musculus
cacagtttcttgctctggaataaaa

SEQ ID NO: 889474 - DNA, 25 bp, Mus musculus
cacagtttcttggtctggaataaaa

SEQ ID NO: 889475 - DNA, 25 bp, Mus musculus
cacataaagcagaatgctcagtgtt

SEQ ID NO: 889476 - DNA, 25 bp, Mus musculus
cacataaagcagtatgctcagtgtt

SEQ ID NO: 889477 - DNA, 25 bp, Mus musculus
cacataacagacaacgatgacttcg

SEQ ID NO: 889478 - DNA, 25 bp, Mus musculus
cacataacagacaaggatgacttcg

SEQ ID NO: 889479 - DNA, 25 bp, Mus musculus
cacataattgaacgactgaaagcgt

SEQ ID NO: 889480 - DNA, 25 bp, Mus musculus
cacataattgaaggactgaaagcgt

SEQ ID NO: 889481 - DNA, 25 bp, Mus musculus
cacatacaagagaggtgactacggg

SEQ ID NO: 889482 - DNA, 25 bp, Mus musculus
cacatacaagagtggtgactacggg

SEQ ID NO: 889483 - DNA, 25 bp, Mus musculus
cacatacagcaacacagcgctctgt

SEQ ID NO: 889484 - DNA, 25 bp, Mus musculus
cacatacagcaacagagcgctctgt

SEQ ID NO: 889485 - DNA, 25 bp, Mus musculus
cacataccaacacgtccaacagact

SEQ ID NO: 889486 - DNA, 25 bp, Mus musculus
cacataccaacaggtccaacagact

SEQ ID NO: 889487 - DNA, 25 bp, Mus musculus
cacatacccagcaatatcagttgta

SEQ ID NO: 889488 - DNA, 25 bp, Mus musculus
cacatacccagctatatcagttgta

SEQ ID NO: 889489 - DNA, 25 bp, Mus musculus
cacataccctaaccagggagtggag

SEQ ID NO: 889490 - DNA, 25 bp, Mus musculus
cacataccctaacgagtggaagact

SEQ ID NO: 889491 - DNA, 25 bp, Mus musculus
cacataccctaacggagtggagaga

SEQ ID NO: 889492 - DNA, 25 bp, Mus musculus
cacataccctaactaggagtggaag

SEQ ID NO: 889493 - DNA, 25 bp, Mus musculus
cacataccctaagcagggagtggag

SEQ ID NO: 889494 - DNA, 25 bp, Mus musculus
cacataccctaaggagtggaagact

SEQ ID NO: 889495 - DNA, 25 bp, Mus musculus
cacataccctaagggagtggagaga

SEQ ID NO: 889496 - DNA, 25 bp, Mus musculus
cacataccctaagtaggagtggaag

SEQ ID NO: 889497 - DNA, 25 bp, Mus musculus
cacatagaagcctctcagcaccatg

SEQ ID NO: 889498 - DNA, 25 bp, Mus musculus
cacatagaaggctctcagcaccatg

SEQ ID NO: 889499 - DNA, 25 bp, Mus musculus
cacatagcagataaacttctgcact

SEQ ID NO: 889500 - DNA, 25 bp, Mus musculus
cacatagcagttaaacttctgcact

SEQ ID NO: 889501 - DNA, 25 bp, Mus musculus
cacatatgaaaaagcgggccacatt

SEQ ID NO: 889502 - DNA, 25 bp, Mus musculus
cacatatgaaaaagggggccacatt

SEQ ID NO: 889503 - DNA, 25 bp, Mus musculus
cacatatgaggacttgctgaaccga

SEQ ID NO: 889504 - DNA, 25 bp, Mus musculus
cacatatgaggagttgctgaaccga

SEQ ID NO: 889505 - DNA, 25 bp, Mus musculus
cacatatgccgccacgtctacacca

SEQ ID NO: 889506 - DNA, 25 bp, Mus musculus
cacatatgccgccaggtctacacca

SEQ ID NO: 889507 - DNA, 25 bp, Mus musculus
cacatatggtaacagccttacagaa

SEQ ID NO: 889508 - DNA, 25 bp, Mus musculus
cacatatggtaagagccttacagaa

SEQ ID NO: 889509 - DNA, 25 bp, Mus musculus
cacatattcctcaaagctgatggac

SEQ ID NO: 889510 - DNA, 25 bp, Mus musculus
cacatattcctctaagctgatggac

SEQ ID NO: 889511 - DNA, 25 bp, Mus musculus
cacatcaaagatctagtgactgaag

SEQ ID NO: 889512 - DNA, 25 bp, Mus musculus
cacatcaaagatcttgtgactgaag

SEQ ID NO: 889513 - DNA, 25 bp, Mus musculus
cacatcaaagctttggtgtactttt

SEQ ID NO: 889514 - DNA, 25 bp, Mus musculus
cacatcaaaggtttggtgtactttt

SEQ ID NO: 889515 - DNA, 25 bp, Mus musculus
cacatcaattagagcccggcgggca

SEQ ID NO: 889516 - DNA, 25 bp, Mus musculus
cacatcaattgccagagcccggcgg

SEQ ID NO: 889517 - DNA, 25 bp, Mus musculus
cacatcaattgcgagagcccggcgg

SEQ ID NO: 889518 - DNA, 25 bp, Mus musculus
cacatcaatttgagcccggcgggca

SEQ ID NO: 889519 - DNA, 25 bp, Mus musculus
cacatcacttctcttccccagggaa

SEQ ID NO: 889520 - DNA, 25 bp, Mus musculus
cacatcacttgtcttccccagggaa

SEQ ID NO: 889521 - DNA, 25 bp, Mus musculus
cacatcagcagatccatttgaatgt

SEQ ID NO: 889522 - DNA, 25 bp, Mus musculus
cacatcagcagatcgatttgaatgt

SEQ ID NO: 889523 - DNA, 25 bp, Mus musculus
cacatcattcccaacgactgtgccg

SEQ ID NO: 889524 - DNA, 25 bp, Mus musculus
cacatcattcccaaggactgtgccg

SEQ ID NO: 889525 - DNA, 25 bp, Mus musculus
cacatccaaaaacccacctgtgcac

SEQ ID NO: 889526 - DNA, 25 bp, Mus musculus
cacatccaaatacccacctgtgcac

SEQ ID NO: 889527 - DNA, 25 bp, Mus musculus
cacatccagcagcacgaccagtgtg

SEQ ID NO: 889528 - DNA, 25 bp, Mus musculus
cacatccagcagcactttgtgcagt

SEQ ID NO: 889529 - DNA, 25 bp, Mus musculus
cacatccagcagcaggaccagtgtg

SEQ ID NO: 889530 - DNA, 25 bp, Mus musculus
cacatccagcagcagtttgtgcagt

SEQ ID NO: 889531 - DNA, 25 bp, Mus musculus
cacatccatgcaaagaaaggagagg

SEQ ID NO: 889532 - DNA, 25 bp, Mus musculus
cacatccatgctcctattaaactta

SEQ ID NO: 889533 - DNA, 25 bp, Mus musculus
cacatccatggaaagaaaggagagg

SEQ ID NO: 889534 - DNA, 25 bp, Mus musculus
cacatccatggtcctattaaactta

SEQ ID NO: 889535 - DNA, 25 bp, Mus musculus
cacatcccagccttccccagtctga

SEQ ID NO: 889536 - DNA, 25 bp, Mus musculus
cacatcccaggcttccccagtctga

SEQ ID NO: 889537 - DNA, 25 bp, Mus musculus
cacatcctcccgactctaatgagct

SEQ ID NO: 889538 - DNA, 25 bp, Mus musculus
cacatcctccggactctaatgagct

SEQ ID NO: 889539 - DNA, 25 bp, Mus musculus
cacatcctctaccacctctacaaag

SEQ ID NO: 889540 - DNA, 25 bp, Mus musculus
cacatcctctaccagctctacaaag

SEQ ID NO: 889541 - DNA, 25 bp, Mus musculus
cacatcctgtccgacgatggatgcc

SEQ ID NO: 889542 - DNA, 25 bp, Mus musculus
cacatcctgtccgaggatggatgcc

SEQ ID NO: 889543 - DNA, 25 bp, Mus musculus
cacatcgacctgattgatctggaca

SEQ ID NO: 889544 - DNA, 25 bp, Mus musculus
cacatcgacctgtttgatctggaca

SEQ ID NO: 889545 - DNA, 25 bp, Mus musculus
cacatctcacagactgtggatattc

SEQ ID NO: 889546 - DNA, 25 bp, Mus musculus
cacatctcacagtctgtggatattc

SEQ ID NO: 889547 - DNA, 25 bp, Mus musculus
cacatctccaacctcgttcgtccct

SEQ ID NO: 889548 - DNA, 25 bp, Mus musculus
cacatctccaacctggttcgtccct

SEQ ID NO: 889549 - DNA, 25 bp, Mus musculus
cacatctgctcgctctgtgatgctg

SEQ ID NO: 889550 - DNA, 25 bp, Mus musculus
cacatctgctcggtctgtgatgctg

SEQ ID NO: 889551 - DNA, 25 bp, Mus musculus
cacatgaaggaatgaattgcccagc

SEQ ID NO: 889552 - DNA, 25 bp, Mus musculus
cacatgaaggaatgtattgcccagc

SEQ ID NO: 889553 - DNA, 25 bp, Mus musculus
cacatgaccagtcatcggcgccagt

SEQ ID NO: 889554 - DNA, 25 bp, Mus musculus
cacatgaccagtctcgttaggagag

SEQ ID NO: 889555 - DNA, 25 bp, Mus musculus
cacatgaccagtgatcggcgccagt

SEQ ID NO: 889556 - DNA, 25 bp, Mus musculus
cacatgaccagtgtcgttaggagag

SEQ ID NO: 889557 - DNA, 25 bp, Mus musculus
cacatgacctctacatgatcatgcg

SEQ ID NO: 889558 - DNA, 25 bp, Mus musculus
cacatgacctgtacatgatcatgcg

SEQ ID NO: 889559 - DNA, 25 bp, Mus musculus
cacatgactgtggacgagatctata

SEQ ID NO: 889560 - DNA, 25 bp, Mus musculus
cacatgactgtggaggagatctata

SEQ ID NO: 889561 - DNA, 25 bp, Mus musculus
cacatgatcgcaacaccatggacgc

SEQ ID NO: 889562 - DNA, 25 bp, Mus musculus
cacatgatcggaacaccatggacgc

SEQ ID NO: 889563 - DNA, 25 bp, Mus musculus
cacatgatgctagacggacttagag

SEQ ID NO: 889564 - DNA, 25 bp, Mus musculus
cacatgatgctagagggacttagag

SEQ ID NO: 889565 - DNA, 25 bp, Mus musculus
cacatgatgtcacgaaaccacacgc

SEQ ID NO: 889566 - DNA, 25 bp, Mus musculus
cacatgatgtcaggaaaccacacgc

SEQ ID NO: 889567 - DNA, 25 bp, Mus musculus
cacatgccagcggatgcccctttct

SEQ ID NO: 889568 - DNA, 25 bp, Mus musculus
cacatgccaggggatgcccctttct

SEQ ID NO: 889569 - DNA, 25 bp, Mus musculus
cacatgcttgaacgggaccatccag

SEQ ID NO: 889570 - DNA, 25 bp, Mus musculus
cacatgcttgtacgggaccatccag

SEQ ID NO: 889571 - DNA, 25 bp, Mus musculus
cacatggaaaagcatttgaccgtca

SEQ ID NO: 889572 - DNA, 25 bp, Mus musculus
cacatggaaaaggatttgaccgtca

SEQ ID NO: 889573 - DNA, 25 bp, Mus musculus
cacatggaagccgacgtctgcatta

SEQ ID NO: 889574 - DNA, 25 bp, Mus musculus
cacatggaagccgaggtctgcatta

SEQ ID NO: 889575 - DNA, 25 bp, Mus musculus
cacatggatgaaaatgtgagcagct

SEQ ID NO: 889576 - DNA, 25 bp, Mus musculus
cacatggatgaatatgtgagcagct

SEQ ID NO: 889577 - DNA, 25 bp, Mus musculus
cacatggggagacagggcaatgcga

SEQ ID NO: 889578 - DNA, 25 bp, Mus musculus
cacatggggagagagggcaatgcga

SEQ ID NO: 889579 - DNA, 25 bp, Mus musculus
cacatgtcacagctaaagtccagga

SEQ ID NO: 889580 - DNA, 25 bp, Mus musculus
cacatgtcacaggtaaagtccagga

SEQ ID NO: 889581 - DNA, 25 bp, Mus musculus
cacatgtgtaggctgtgtgaggacg

SEQ ID NO: 889582 - DNA, 25 bp, Mus musculus
cacatgtgtagggtgtgtgaggacg

SEQ ID NO: 889583 - DNA, 25 bp, Mus musculus
cacatgttgcctatgacggacctag

SEQ ID NO: 889584 - DNA, 25 bp, Mus musculus
cacatgttgcctttgacggacctag

SEQ ID NO: 889585 - DNA, 25 bp, Mus musculus
cacattatgcctcgatctgcactct

SEQ ID NO: 889586 - DNA, 25 bp, Mus musculus
cacattatgcctggatctgcactct

SEQ ID NO: 889587 - DNA, 25 bp, Mus musculus
cacattcagcacagtcatctccagc

SEQ ID NO: 889588 - DNA, 25 bp, Mus musculus
cacattcagcactgtcatctccagc

SEQ ID NO: 889589 - DNA, 25 bp, Mus musculus
cacattccagcgccctctgcctccc

SEQ ID NO: 889590 - DNA, 25 bp, Mus musculus
cacattccagggccctctgcctccc

SEQ ID NO: 889591 - DNA, 25 bp, Mus musculus
cacattccccacaactgaaaatcac

SEQ ID NO: 889592 - DNA, 25 bp, Mus musculus
cacattccccactactgaaaatcac

SEQ ID NO: 889593 - DNA, 25 bp, Mus musculus
cacattcgacagcagttgaacaccc

SEQ ID NO: 889594 - DNA, 25 bp, Mus musculus
cacattcgacaggagttgaacaccc

SEQ ID NO: 889595 - DNA, 25 bp, Mus musculus
cacattctggagcactgccaataac

SEQ ID NO: 889596 - DNA, 25 bp, Mus musculus
cacattctggagcagtgccaataac

SEQ ID NO: 889597 - DNA, 25 bp, Mus musculus
cacattgaagatgagtttgatgcct

SEQ ID NO: 889598 - DNA, 25 bp, Mus musculus
cacattgaagttgagtttgatgcct

SEQ ID NO: 889599 - DNA, 25 bp, Mus musculus
cacattgcacggcacattacaaaag

SEQ ID NO: 889600 - DNA, 25 bp, Mus musculus
cacattgcacggcagattacaaaag

SEQ ID NO: 889601 - DNA, 25 bp, Mus musculus
cacattgctgcacatggtgcagtat

SEQ ID NO: 889602 - DNA, 25 bp, Mus musculus
cacattgctggacatggtgcagtat

SEQ ID NO: 889603 - DNA, 25 bp, Mus musculus
cacattgtcaagctggtggccaaaa

SEQ ID NO: 889604 - DNA, 25 bp, Mus musculus
cacattgtcaaggtggtggccaaaa

SEQ ID NO: 889605 - DNA, 25 bp, Mus musculus
cacattgttgtcaacgtttgatctc

SEQ ID NO: 889606 - DNA, 25 bp, Mus musculus
cacattgttgtcaaggtttgatctc

SEQ ID NO: 889607 - DNA, 25 bp, Mus musculus
cacatttgagaacggccggtttgtg

SEQ ID NO: 889608 - DNA, 25 bp, Mus musculus
cacatttgagagtgaagtgagggga

SEQ ID NO: 889609 - DNA, 25 bp, Mus musculus
cacatttgagtacggccggtttgtg

SEQ ID NO: 889610 - DNA, 25 bp, Mus musculus
cacatttgagtgtgaagtgagggga

SEQ ID NO: 889611 - DNA, 25 bp, Mus musculus
cacatttggagccaaggaaaatcat

SEQ ID NO: 889612 - DNA, 25 bp, Mus musculus
cacatttggagcgaaggaaaatcat

SEQ ID NO: 889613 - DNA, 25 bp, Mus musculus
cacatttgttaacacgtcaaaatgc

SEQ ID NO: 889614 - DNA, 25 bp, Mus musculus
cacatttgttaacaggtcaaaatgc

SEQ ID NO: 889615 - DNA, 25 bp, Mus musculus
cacattttaagccacagttgtaagc

SEQ ID NO: 889616 - DNA, 25 bp, Mus musculus
cacattttaagccagagttgtaagc

SEQ ID NO: 889617 - DNA, 25 bp, Mus musculus
cacatttttcgacatccgcagacat

SEQ ID NO: 889618 - DNA, 25 bp, Mus musculus
cacatttttcgagatccgcagacat

SEQ ID NO: 889619 - DNA, 25 bp, Mus musculus
caccaaaatgaacgaagctctgagt

SEQ ID NO: 889620 - DNA, 25 bp, Mus musculus
caccaaaatgaaggaagctctgagt

SEQ ID NO: 889621 - DNA, 25 bp, Mus musculus
caccaaacagaaatatccagagcac

SEQ ID NO: 889622 - DNA, 25 bp, Mus musculus
caccaaacagtaatatccagagcac

SEQ ID NO: 889623 - DNA, 25 bp, Mus musculus
caccaaagctgaaacatattcggca

SEQ ID NO: 889624 - DNA, 25 bp, Mus musculus
caccaaagctgaaagatattcggca

SEQ ID NO: 889625 - DNA, 25 bp, Mus musculus
caccaaatagtacacgcagtgggaa

SEQ ID NO: 889626 - DNA, 25 bp, Mus musculus
caccaaatagtacaggcagtgggaa

SEQ ID NO: 889627 - DNA, 25 bp, Mus musculus
caccaaatgacacctatggccctgt

SEQ ID NO: 889628 - DNA, 25 bp, Mus musculus
caccaaatgacagctatggccctgt

SEQ ID NO: 889629 - DNA, 25 bp, Mus musculus
caccaaatgttgggcctaggattgt

SEQ ID NO: 889630 - DNA, 25 bp, Mus musculus
caccaaatgttgggcgaagatctgc

SEQ ID NO: 889631 - DNA, 25 bp, Mus musculus
caccaaatgttgggcgattgtgttt

SEQ ID NO: 889632 - DNA, 25 bp, Mus musculus
caccaaatgttgggcgtgtgcatgt

SEQ ID NO: 889633 - DNA, 25 bp, Mus musculus
caccaaatgttggggctaggattgt

SEQ ID NO: 889634 - DNA, 25 bp, Mus musculus
caccaaatgttgggggaagatctgc

SEQ ID NO: 889635 - DNA, 25 bp, Mus musculus
caccaaatgttgggggattgtgttt

SEQ ID NO: 889636 - DNA, 25 bp, Mus musculus
caccaaatgttgggggtgtgcatgt

SEQ ID NO: 889637 - DNA, 25 bp, Mus musculus
caccaacactttgacgattttggct

SEQ ID NO: 889638 - DNA, 25 bp, Mus musculus
caccaacactttgaggattttggct

SEQ ID NO: 889639 - DNA, 25 bp, Mus musculus
caccaaccagcagatcatacattct

SEQ ID NO: 889640 - DNA, 25 bp, Mus musculus
caccaaccagcttagcagatcatac

SEQ ID NO: 889641 - DNA, 25 bp, Mus musculus
caccaaccaggagatcatacattct

SEQ ID NO: 889642 - DNA, 25 bp, Mus musculus
caccaaccaggttagcagatcatac

SEQ ID NO: 889643 - DNA, 25 bp, Mus musculus
caccaacctgcacatggcagcagtg

SEQ ID NO: 889644 - DNA, 25 bp, Mus musculus
caccaacctgcacatggcagctcaa

SEQ ID NO: 889645 - DNA, 25 bp, Mus musculus
caccaacctgcagatggcagcagtg

SEQ ID NO: 889646 - DNA, 25 bp, Mus musculus
caccaacctgcagatggcagctcaa

SEQ ID NO: 889647 - DNA, 25 bp, Mus musculus
caccaactactaactctggcctgct

SEQ ID NO: 889648 - DNA, 25 bp, Mus musculus
caccaactactatctctggcctgct

SEQ ID NO: 889649 - DNA, 25 bp, Mus musculus
caccaactatggaattaaccagcgc

SEQ ID NO: 889650 - DNA, 25 bp, Mus musculus
caccaactatggtattaaccagcgc

SEQ ID NO: 889651 - DNA, 25 bp, Mus musculus
caccaactctacaacaggtacctgc

SEQ ID NO: 889652 - DNA, 25 bp, Mus musculus
caccaactctacaagaggtacctgc

SEQ ID NO: 889653 - DNA, 25 bp, Mus musculus
caccaagaaagactttcaagccaca

SEQ ID NO: 889654 - DNA, 25 bp, Mus musculus
caccaagaaagagtttcaagccaca

SEQ ID NO: 889655 - DNA, 25 bp, Mus musculus
caccaagaaccacgcgctcaactcc

SEQ ID NO: 889656 - DNA, 25 bp, Mus musculus
caccaagaaccaggcgctcaactcc

SEQ ID NO: 889657 - DNA, 25 bp, Mus musculus
caccaagaagcacatcttctctgtc

SEQ ID NO: 889658 - DNA, 25 bp, Mus musculus
caccaagaagcagatcttctctgtc

SEQ ID NO: 889659 - DNA, 25 bp, Mus musculus
caccaagaagtgccagcctgacaag

SEQ ID NO: 889660 - DNA, 25 bp, Mus musculus
caccaagaagtggcagcctgacaag

SEQ ID NO: 889661 - DNA, 25 bp, Mus musculus
caccaagatcaacaccgctgaccac

SEQ ID NO: 889662 - DNA, 25 bp, Mus musculus
caccaagatcaagaccgctgaccac

SEQ ID NO: 889663 - DNA, 25 bp, Mus musculus
caccaagatcaccggcgaccccaac

SEQ ID NO: 889664 - DNA, 25 bp, Mus musculus
caccaagatcacgggcgaccccaac

SEQ ID NO: 889665 - DNA, 25 bp, Mus musculus
caccaagatcccagtgattatagag

SEQ ID NO: 889666 - DNA, 25 bp, Mus musculus
caccaagatccctgtgattatagag

SEQ ID NO: 889667 - DNA, 25 bp, Mus musculus
caccaagatctccgtggatatgttc

SEQ ID NO: 889668 - DNA, 25 bp, Mus musculus
caccaagatctcggtggatatgttc

SEQ ID NO: 889669 - DNA, 25 bp, Mus musculus
caccaagcagaaacagcacctcttc

SEQ ID NO: 889670 - DNA, 25 bp, Mus musculus
caccaagcagcagattacctggagc

SEQ ID NO: 889671 - DNA, 25 bp, Mus musculus
caccaagcagccatctcggaaacgc

SEQ ID NO: 889672 - DNA, 25 bp, Mus musculus
caccaagcagccttctctccgtgga

SEQ ID NO: 889673 - DNA, 25 bp, Mus musculus
caccaagcaggagattacctggagc

SEQ ID NO: 889674 - DNA, 25 bp, Mus musculus
caccaagcaggcatctcggaaacgc

SEQ ID NO: 889675 - DNA, 25 bp, Mus musculus
caccaagcaggcttctctccgtgga

SEQ ID NO: 889676 - DNA, 25 bp, Mus musculus
caccaagcagtaacagcacctcttc

SEQ ID NO: 889677 - DNA, 25 bp, Mus musculus
caccaagccacaccaatgtggggct

SEQ ID NO: 889678 - DNA, 25 bp, Mus musculus
caccaagccacacgatggtgacatt

SEQ ID NO: 889679 - DNA, 25 bp, Mus musculus
caccaagccacagcaatgtggggct

SEQ ID NO: 889680 - DNA, 25 bp, Mus musculus
caccaagccacaggatggtgacatt

SEQ ID NO: 889681 - DNA, 25 bp, Mus musculus
caccaagctcaacatacccctgatt

SEQ ID NO: 889682 - DNA, 25 bp, Mus musculus
caccaagctcaagatacccctgatt

SEQ ID NO: 889683 - DNA, 25 bp, Mus musculus
caccaaggagcacgtgactaacgag

SEQ ID NO: 889684 - DNA, 25 bp, Mus musculus
caccaaggagcaggtgactaacgag

SEQ ID NO: 889685 - DNA, 25 bp, Mus musculus
caccaaggcgcacgatttctataat

SEQ ID NO: 889686 - DNA, 25 bp, Mus musculus
caccaaggcgcaggatttctataat

SEQ ID NO: 889687 - DNA, 25 bp, Mus musculus
caccaataagagaacctggctgtat

SEQ ID NO: 889688 - DNA, 25 bp, Mus musculus
caccaataagagaagctggctgtat

SEQ ID NO: 889689 - DNA, 25 bp, Mus musculus
caccaatgaactctacatgatgatg

SEQ ID NO: 889690 - DNA, 25 bp, Mus musculus
caccaatgaactgtacatgatgatg

SEQ ID NO: 889691 - DNA, 25 bp, Mus musculus
caccaatgtgaacaactctagccag

SEQ ID NO: 889692 - DNA, 25 bp, Mus musculus
caccaatgtgaagaactctagccag

SEQ ID NO: 889693 - DNA, 25 bp, Mus musculus
caccaatgtgcttacatgcatgtgt

SEQ ID NO: 889694 - DNA, 25 bp, Mus musculus
caccaatgtgcttacgagtctactg

SEQ ID NO: 889695 - DNA, 25 bp, Mus musculus
caccaatgtgcttagatgcatgtgt

SEQ ID NO: 889696 - DNA, 25 bp, Mus musculus
caccaatgtgcttaggagtctactg

SEQ ID NO: 889697 - DNA, 25 bp, Mus musculus
caccaattcaccaacgtctctaagc

SEQ ID NO: 889698 - DNA, 25 bp, Mus musculus
caccaattcaccaaggtctctaagc

SEQ ID NO: 889699 - DNA, 25 bp, Mus musculus
caccacaaagctgggcctttgtctc

SEQ ID NO: 889700 - DNA, 25 bp, Mus musculus
caccacaaaggtgggcctttgtctc

SEQ ID NO: 889701 - DNA, 25 bp, Mus musculus
caccacacagaacaatctctccttt

SEQ ID NO: 889702 - DNA, 25 bp, Mus musculus
caccacacagaagaatctctccttt

SEQ ID NO: 889703 - DNA, 25 bp, Mus musculus
caccacacagacagaggagctgaac

SEQ ID NO: 889704 - DNA, 25 bp, Mus musculus
caccacacagcttgtctgagcagcc

SEQ ID NO: 889705 - DNA, 25 bp, Mus musculus
caccacacaggttgtctgagcagcc

SEQ ID NO: 889706 - DNA, 25 bp, Mus musculus
caccacacagtcagaggagctgaac

SEQ ID NO: 889707 - DNA, 25 bp, Mus musculus
caccacaccacacgcggtgtctatt

SEQ ID NO: 889708 - DNA, 25 bp, Mus musculus
caccacaccacaggcggtgtctatt

SEQ ID NO: 889709 - DNA, 25 bp, Mus musculus
caccacacgcagaatcatggagaac

SEQ ID NO: 889710 - DNA, 25 bp, Mus musculus
caccacacgcagtatcatggagaac

SEQ ID NO: 889711 - DNA, 25 bp, Mus musculus
caccacacttcccggtctgtatgct

SEQ ID NO: 889712 - DNA, 25 bp, Mus musculus
caccacacttccgggtctgtatgct

SEQ ID NO: 889713 - DNA, 25 bp, Mus musculus
caccacagagaaagtgagcaaaatc

SEQ ID NO: 889714 - DNA, 25 bp, Mus musculus
caccacagagaatgtgagcaaaatc

SEQ ID NO: 889715 - DNA, 25 bp, Mus musculus
caccacaggctcctcagcgcagcct

SEQ ID NO: 889716 - DNA, 25 bp, Mus musculus
caccacaggctcctcgccaggagca

SEQ ID NO: 889717 - DNA, 25 bp, Mus musculus
caccacaggctcctgagcgcagcct

SEQ ID NO: 889718 - DNA, 25 bp, Mus musculus
caccacaggctcctggccaggagca

SEQ ID NO: 889719 - DNA, 25 bp, Mus musculus
caccacagtatgcgagttatggaac

SEQ ID NO: 889720 - DNA, 25 bp, Mus musculus
caccacagtatgggagttatggaac

SEQ ID NO: 889721 - DNA, 25 bp, Mus musculus
caccacatacaaacacttcgatgag

SEQ ID NO: 889722 - DNA, 25 bp, Mus musculus
caccacatacaatcacttcgatgag

SEQ ID NO: 889723 - DNA, 25 bp, Mus musculus
caccaccaactatgcaattaaccag

SEQ ID NO: 889724 - DNA, 25 bp, Mus musculus
caccaccaactatggaattaaccag

SEQ ID NO: 889725 - DNA, 25 bp, Mus musculus
caccaccaagatcccatggtttcca

SEQ ID NO: 889726 - DNA, 25 bp, Mus musculus
caccaccaagcacttgaaggagaag

SEQ ID NO: 889727 - DNA, 25 bp, Mus musculus
caccaccaaggacttgaaggagaag

SEQ ID NO: 889728 - DNA, 25 bp, Mus musculus
caccaccaagttcccatggtttcca

SEQ ID NO: 889729 - DNA, 25 bp, Mus musculus
caccaccaatgactacgtctaccgg

SEQ ID NO: 889730 - DNA, 25 bp, Mus musculus
caccaccaatgagtacgtctaccgg

SEQ ID NO: 889731 - DNA, 25 bp, Mus musculus
caccaccacaggccctgaagctgca

SEQ ID NO: 889732 - DNA, 25 bp, Mus musculus
caccaccacagggcctgaagctgca

SEQ ID NO: 889733 - DNA, 25 bp, Mus musculus
caccacccagactatgaaatccctg

SEQ ID NO: 889734 - DNA, 25 bp, Mus musculus
caccacccagtctatgaaatccctg

SEQ ID NO: 889735 - DNA, 25 bp, Mus musculus
caccaccccctgcacgagcccccac

SEQ ID NO: 889736 - DNA, 25 bp, Mus musculus
caccaccccctgcaggagcccccac

SEQ ID NO: 889737 - DNA, 25 bp, Mus musculus
caccacccgctacccgcgggcagaa

SEQ ID NO: 889738 - DNA, 25 bp, Mus musculus
caccacccgctaccggcgggcagaa

SEQ ID NO: 889739 - DNA, 25 bp, Mus musculus
caccacctggatcgagaactcgcca

SEQ ID NO: 889740 - DNA, 25 bp, Mus musculus
caccacctggttcgagaactcgcca

SEQ ID NO: 889741 - DNA, 25 bp, Mus musculus
caccacctgttccagaagttggcat

SEQ ID NO: 889742 - DNA, 25 bp, Mus musculus
caccacctgttcgagaagttggcat

SEQ ID NO: 889743 - DNA, 25 bp, Mus musculus
caccacgagcagataagaggagtcc

SEQ ID NO: 889744 - DNA, 25 bp, Mus musculus
caccacgagcagatgttccaagttg

SEQ ID NO: 889745 - DNA, 25 bp, Mus musculus
caccacgagcagttaagaggagtcc

SEQ ID NO: 889746 - DNA, 25 bp, Mus musculus
caccacgagcagttgttccaagttg

SEQ ID NO: 889747 - DNA, 25 bp, Mus musculus
caccactaaccactctgacaccacc

SEQ ID NO: 889748 - DNA, 25 bp, Mus musculus
caccactaaccggactcagaagaag

SEQ ID NO: 889749 - DNA, 25 bp, Mus musculus
caccactaacgactctgacaccacc

SEQ ID NO: 889750 - DNA, 25 bp, Mus musculus
caccactaacgggactcagaagaag

SEQ ID NO: 889751 - DNA, 25 bp, Mus musculus
caccactcctctcgatcccagagtg

SEQ ID NO: 889752 - DNA, 25 bp, Mus musculus
caccactcctctggatcccagagtg

SEQ ID NO: 889753 - DNA, 25 bp, Mus musculus
caccactgctgacgtcatatctcag

SEQ ID NO: 889754 - DNA, 25 bp, Mus musculus
caccactgctgaggtcatatctcag

SEQ ID NO: 889755 - DNA, 25 bp, Mus musculus
caccacttatggccctacaaagatt

SEQ ID NO: 889756 - DNA, 25 bp, Mus musculus
caccacttatgggcctacaaagatt

SEQ ID NO: 889757 - DNA, 25 bp, Mus musculus
caccagaaagcccacagaaaggaat

SEQ ID NO: 889758 - DNA, 25 bp, Mus musculus
caccagaaagcccaccagagaaagg

SEQ ID NO: 889759 - DNA, 25 bp, Mus musculus
caccagaaagcccagagaaaggaat

SEQ ID NO: 889760 - DNA, 25 bp, Mus musculus
caccagaaagcccagcagagaaagg

SEQ ID NO: 889761 - DNA, 25 bp, Mus musculus
caccagaagctagacgaggagcaga

SEQ ID NO: 889762 - DNA, 25 bp, Mus musculus
caccagaagctagaggaggagcaga

SEQ ID NO: 889763 - DNA, 25 bp, Mus musculus
caccagaaggagaacctgaacaacc

SEQ ID NO: 889764 - DNA, 25 bp, Mus musculus
caccagaaggagtacctgaacaacc

SEQ ID NO: 889765 - DNA, 25 bp, Mus musculus
caccagagacaacgtccactgggca

SEQ ID NO: 889766 - DNA, 25 bp, Mus musculus
caccagagacaaggtccactgggca

SEQ ID NO: 889767 - DNA, 25 bp, Mus musculus
caccagagagcacatgtccagcctg

SEQ ID NO: 889768 - DNA, 25 bp, Mus musculus
caccagagagctatcattgaggcgg

SEQ ID NO: 889769 - DNA, 25 bp, Mus musculus
caccagagagctttcattgaggcgg

SEQ ID NO: 889770 - DNA, 25 bp, Mus musculus
caccagagaggacatgtccagcctg

SEQ ID NO: 889771 - DNA, 25 bp, Mus musculus
caccagagcagcctcatctccgaac

SEQ ID NO: 889772 - DNA, 25 bp, Mus musculus
caccagagcagcgtcatctccgaac

SEQ ID NO: 889773 - DNA, 25 bp, Mus musculus
caccagagtagaaaaatatgacttc

SEQ ID NO: 889774 - DNA, 25 bp, Mus musculus
caccagagtagaaaagaaggaatag

SEQ ID NO: 889775 - DNA, 25 bp, Mus musculus
caccagagtagaaaagaataggaaa

SEQ ID NO: 889776 - DNA, 25 bp, Mus musculus
caccagagtagaaatatatgacttc

SEQ ID NO: 889777 - DNA, 25 bp, Mus musculus
caccagagtagaaatgaaggaatag

SEQ ID NO: 889778 - DNA, 25 bp, Mus musculus
caccagagtagaaatgaataggaaa

SEQ ID NO: 889779 - DNA, 25 bp, Mus musculus
caccagatatcacggtgtgaacctt

SEQ ID NO: 889780 - DNA, 25 bp, Mus musculus
caccagatatcagggtgtgaacctt

SEQ ID NO: 889781 - DNA, 25 bp, Mus musculus
caccagatgcagagttgtggtcctc

SEQ ID NO: 889782 - DNA, 25 bp, Mus musculus
caccagatgcagcagagaagatggg

SEQ ID NO: 889783 - DNA, 25 bp, Mus musculus
caccagatgcagcatccctggagct

SEQ ID NO: 889784 - DNA, 25 bp, Mus musculus
caccagatgcaggagagaagatggg

SEQ ID NO: 889785 - DNA, 25 bp, Mus musculus
caccagatgcaggatccctggagct

SEQ ID NO: 889786 - DNA, 25 bp, Mus musculus
caccagatgcagtgttgtggtcctc

SEQ ID NO: 889787 - DNA, 25 bp, Mus musculus
caccagcaacccagattgcttcatg

SEQ ID NO: 889788 - DNA, 25 bp, Mus musculus
caccagcaaccctgattgcttcatg

SEQ ID NO: 889789 - DNA, 25 bp, Mus musculus
caccagcaagctggttctagtgagc

SEQ ID NO: 889790 - DNA, 25 bp, Mus musculus
caccagcaaggtggttctagtgagc

SEQ ID NO: 889791 - DNA, 25 bp, Mus musculus
caccagcagcataaccatgagattg

SEQ ID NO: 889792 - DNA, 25 bp, Mus musculus
caccagcagcataagcatgagattg

SEQ ID NO: 889793 - DNA, 25 bp, Mus musculus
caccagcagttcaacaagcgttctg

SEQ ID NO: 889794 - DNA, 25 bp, Mus musculus
caccagcagttcaagaagcgttctg

SEQ ID NO: 889795 - DNA, 25 bp, Mus musculus
caccagcatttgctataggagggat

SEQ ID NO: 889796 - DNA, 25 bp, Mus musculus
caccagcatttggtataggagggat

SEQ ID NO: 889797 - DNA, 25 bp, Mus musculus
caccagccaatgcgcctgccgattt

SEQ ID NO: 889798 - DNA, 25 bp, Mus musculus
caccagccaatgggcctgccgattt

SEQ ID NO: 889799 - DNA, 25 bp, Mus musculus
caccagccatctcacagactatggt

SEQ ID NO: 889800 - DNA, 25 bp, Mus musculus
caccagccatctcagagactatggt

SEQ ID NO: 889801 - DNA, 25 bp, Mus musculus
caccagcccagagacaggtcttttg

SEQ ID NO: 889802 - DNA, 25 bp, Mus musculus
caccagcccagagagaggtcttttg

SEQ ID NO: 889803 - DNA, 25 bp, Mus musculus
caccagcgcgaacgtgatgctagaa

SEQ ID NO: 889804 - DNA, 25 bp, Mus musculus
caccagcgcgaaggtgatgctagaa

SEQ ID NO: 889805 - DNA, 25 bp, Mus musculus
caccagctagtggacgagaagactc

SEQ ID NO: 889806 - DNA, 25 bp, Mus musculus
caccagctagtggaggagaagactc

SEQ ID NO: 889807 - DNA, 25 bp, Mus musculus
caccagctctaattcagaccattcg

SEQ ID NO: 889808 - DNA, 25 bp, Mus musculus
caccagctcttattcagaccattcg

SEQ ID NO: 889809 - DNA, 25 bp, Mus musculus
caccaggaacagagagaacattata

SEQ ID NO: 889810 - DNA, 25 bp, Mus musculus
caccaggaacagtgagaacattata

SEQ ID NO: 889811 - DNA, 25 bp, Mus musculus
caccaggaagccctatggaggtgcc

SEQ ID NO: 889812 - DNA, 25 bp, Mus musculus
caccaggaaggcctatggaggtgcc

SEQ ID NO: 889813 - DNA, 25 bp, Mus musculus
caccaggagtttctcctcctacaga

SEQ ID NO: 889814 - DNA, 25 bp, Mus musculus
caccaggagtttctgctcctacaga

SEQ ID NO: 889815 - DNA, 25 bp, Mus musculus
caccaggatggccacggccccaatc

SEQ ID NO: 889816 - DNA, 25 bp, Mus musculus
caccaggatggccagggccccaatc

SEQ ID NO: 889817 - DNA, 25 bp, Mus musculus
caccaggcaccacgtcctgtttatt

SEQ ID NO: 889818 - DNA, 25 bp, Mus musculus
caccaggcaccaggtcctgtttatt

SEQ ID NO: 889819 - DNA, 25 bp, Mus musculus
caccaggcacccatcgctcaaacta

SEQ ID NO: 889820 - DNA, 25 bp, Mus musculus
caccaggcacccatggctcaaacta

SEQ ID NO: 889821 - DNA, 25 bp, Mus musculus
caccaggcagaacgcgacagactta

SEQ ID NO: 889822 - DNA, 25 bp, Mus musculus
caccaggcagaaggcgacagactta

SEQ ID NO: 889823 - DNA, 25 bp, Mus musculus
caccagggcaagaaccatcctcctc

SEQ ID NO: 889824 - DNA, 25 bp, Mus musculus
caccagggcaagaacgtgggaatcc

SEQ ID NO: 889825 - DNA, 25 bp, Mus musculus
caccagggcaagaagcatcctcctc

SEQ ID NO: 889826 - DNA, 25 bp, Mus musculus
caccagggcaagaaggtgggaatcc

SEQ ID NO: 889827 - DNA, 25 bp, Mus musculus
caccagggtggtcacgaaaatcatg

SEQ ID NO: 889828 - DNA, 25 bp, Mus musculus
caccagggtggtcaggaaaatcatg

SEQ ID NO: 889829 - DNA, 25 bp, Mus musculus
caccaggtggagagcatatccgagg

SEQ ID NO: 889830 - DNA, 25 bp, Mus musculus
caccaggtggagataagtcattgtg

SEQ ID NO: 889831 - DNA, 25 bp, Mus musculus
caccaggtggagtgcatatccgagg

SEQ ID NO: 889832 - DNA, 25 bp, Mus musculus
caccaggtggagttaagtcattgtg

SEQ ID NO: 889833 - DNA, 25 bp, Mus musculus
caccagtcagtacgacaactgcctg

SEQ ID NO: 889834 - DNA, 25 bp, Mus musculus
caccagtcagtacgtcaactgcctg

SEQ ID NO: 889835 - DNA, 25 bp, Mus musculus
caccagtgagcgcgccccacacaag

SEQ ID NO: 889836 - DNA, 25 bp, Mus musculus
caccagtgagcgggccccacacaag

SEQ ID NO: 889837 - DNA, 25 bp, Mus musculus
caccagtgcaaaagtaatgatggag

SEQ ID NO: 889838 - DNA, 25 bp, Mus musculus
caccagtgcaaatgtaatgatggag

SEQ ID NO: 889839 - DNA, 25 bp, Mus musculus
caccagtgccgcacagtctggaata

SEQ ID NO: 889840 - DNA, 25 bp, Mus musculus
caccagtgccgcactgtctggaata

SEQ ID NO: 889841 - DNA, 25 bp, Mus musculus
caccagttacagaatctggtcgatt

SEQ ID NO: 889842 - DNA, 25 bp, Mus musculus
caccagttacagtatctggtcgatt

SEQ ID NO: 889843 - DNA, 25 bp, Mus musculus
caccagttcgagcgggctgaagaat

SEQ ID NO: 889844 - DNA, 25 bp, Mus musculus
caccagttcgagggggctgaagaat

SEQ ID NO: 889845 - DNA, 25 bp, Mus musculus
caccatagccagcacagcgctggag

SEQ ID NO: 889846 - DNA, 25 bp, Mus musculus
caccatagccaggacagcgctggag

SEQ ID NO: 889847 - DNA, 25 bp, Mus musculus
caccataggaaacaaaatgtatgta

SEQ ID NO: 889848 - DNA, 25 bp, Mus musculus
caccataggaaacataatgtatgta

SEQ ID NO: 889849 - DNA, 25 bp, Mus musculus
caccatatttgacgatcgcgtctac

SEQ ID NO: 889850 - DNA, 25 bp, Mus musculus
caccatatttgaggatcgcgtctac

SEQ ID NO: 889851 - DNA, 25 bp, Mus musculus
caccatcaacacaccctttggggcg

SEQ ID NO: 889852 - DNA, 25 bp, Mus musculus
caccatcaacacacgctttggggcg

SEQ ID NO: 889853 - DNA, 25 bp, Mus musculus
caccatcaagatctgggataaaagc

SEQ ID NO: 889854 - DNA, 25 bp, Mus musculus
caccatcaagcacccaggaggtact

SEQ ID NO: 889855 - DNA, 25 bp, Mus musculus
caccatcaagcatgtttatgacaaa

SEQ ID NO: 889856 - DNA, 25 bp, Mus musculus
caccatcaagcgtgccggacacatg

SEQ ID NO: 889857 - DNA, 25 bp, Mus musculus
caccatcaagctctgggaaggtctg

SEQ ID NO: 889858 - DNA, 25 bp, Mus musculus
caccatcaaggacccaggaggtact

SEQ ID NO: 889859 - DNA, 25 bp, Mus musculus
caccatcaaggatgtttatgacaaa

SEQ ID NO: 889860 - DNA, 25 bp, Mus musculus
caccatcaagggtgccggacacatg

SEQ ID NO: 889861 - DNA, 25 bp, Mus musculus
caccatcaaggtctgggaaggtctg

SEQ ID NO: 889862 - DNA, 25 bp, Mus musculus
caccatcaagttctgggataaaagc

SEQ ID NO: 889863 - DNA, 25 bp, Mus musculus
caccatcacacaccctcggcccaca

SEQ ID NO: 889864 - DNA, 25 bp, Mus musculus
caccatcacacagcctcggcccaca

SEQ ID NO: 889865 - DNA, 25 bp, Mus musculus
caccatcaccaacctcctccagaca

SEQ ID NO: 889866 - DNA, 25 bp, Mus musculus
caccatcaccaagctcctccagaca

SEQ ID NO: 889867 - DNA, 25 bp, Mus musculus
caccatcactcacacctatgtcccc

SEQ ID NO: 889868 - DNA, 25 bp, Mus musculus
caccatcactcagacctatgtcccc

SEQ ID NO: 889869 - DNA, 25 bp, Mus musculus
caccatcatcagccaaacaggcatg

SEQ ID NO: 889870 - DNA, 25 bp, Mus musculus
caccatcatcaggcaaacaggcatg

SEQ ID NO: 889871 - DNA, 25 bp, Mus musculus
caccatcatgccaggaaatgtggta

SEQ ID NO: 889872 - DNA, 25 bp, Mus musculus
caccatcatggcaggaaatgtggta

SEQ ID NO: 889873 - DNA, 25 bp, Mus musculus
caccatccagaaactcatcgaggct

SEQ ID NO: 889874 - DNA, 25 bp, Mus musculus
caccatccagtaactcatcgaggct

SEQ ID NO: 889875 - DNA, 25 bp, Mus musculus
caccatccatagagaccatgagggt

SEQ ID NO: 889876 - DNA, 25 bp, Mus musculus
caccatccatagtgaccatgagggt

SEQ ID NO: 889877 - DNA, 25 bp, Mus musculus
caccatcccatgctatataatgacc

SEQ ID NO: 889878 - DNA, 25 bp, Mus musculus
caccatcccatggtatataatgacc

SEQ ID NO: 889879 - DNA, 25 bp, Mus musculus
caccatcccccacaccaccacaaga

SEQ ID NO: 889880 - DNA, 25 bp, Mus musculus
caccatcccccacagcaccacaaga

SEQ ID NO: 889881 - DNA, 25 bp, Mus musculus
caccatccgcccatttcagcctttt

SEQ ID NO: 889882 - DNA, 25 bp, Mus musculus
caccatccgcccttttcagcctttt

SEQ ID NO: 889883 - DNA, 25 bp, Mus musculus
caccatcgtcagccaatggctcgtg

SEQ ID NO: 889884 - DNA, 25 bp, Mus musculus
caccatcgtcaggcaatggctcgtg

SEQ ID NO: 889885 - DNA, 25 bp, Mus musculus
caccatctatttagaggactatttt

SEQ ID NO: 889886 - DNA, 25 bp, Mus musculus
caccatctattttgaggactatttt

SEQ ID NO: 889887 - DNA, 25 bp, Mus musculus
caccatcttcaacgcctgggctaaa

SEQ ID NO: 889888 - DNA, 25 bp, Mus musculus
caccatcttcaaggcctgggctaaa

SEQ ID NO: 889889 - DNA, 25 bp, Mus musculus
caccatgaagatctgagacaagggt

SEQ ID NO: 889890 - DNA, 25 bp, Mus musculus
caccatgaagttctgagacaagggt

SEQ ID NO: 889891 - DNA, 25 bp, Mus musculus
caccatgagagacttccagacagaa

SEQ ID NO: 889892 - DNA, 25 bp, Mus musculus
caccatgagagagttccagacagaa

SEQ ID NO: 889893 - DNA, 25 bp, Mus musculus
caccatgcagcctgtcttctcgtct

SEQ ID NO: 889894 - DNA, 25 bp, Mus musculus
caccatgcaggctgtcttctcgtct

SEQ ID NO: 889895 - DNA, 25 bp, Mus musculus
caccatgcatagcaagcaccttcag

SEQ ID NO: 889896 - DNA, 25 bp, Mus musculus
caccatgcataggaagcaccttcag

SEQ ID NO: 889897 - DNA, 25 bp, Mus musculus
caccatgcccctggctagagatctg

SEQ ID NO: 889898 - DNA, 25 bp, Mus musculus
caccatgcccgtggctagagatctg

SEQ ID NO: 889899 - DNA, 25 bp, Mus musculus
caccatggatccaaaattgtcagca

SEQ ID NO: 889900 - DNA, 25 bp, Mus musculus
caccatggatcctaaattgtcagca

SEQ ID NO: 889901 - DNA, 25 bp, Mus musculus
caccatggtgagatgtcactgatga

SEQ ID NO: 889902 - DNA, 25 bp, Mus musculus
caccatggtgagttgtcactgatga

SEQ ID NO: 889903 - DNA, 25 bp, Mus musculus
caccatgtctacgacctcatcaacc

SEQ ID NO: 889904 - DNA, 25 bp, Mus musculus
caccatgtctacgagctcatcaacc

SEQ ID NO: 889905 - DNA, 25 bp, Mus musculus
caccattaatctctacccgcttacc

SEQ ID NO: 889906 - DNA, 25 bp, Mus musculus
caccattaatctgtacccgcttacc

SEQ ID NO: 889907 - DNA, 25 bp, Mus musculus
caccattactctacggctggcccgc

SEQ ID NO: 889908 - DNA, 25 bp, Mus musculus
caccattactcttcggctggcccgc

SEQ ID NO: 889909 - DNA, 25 bp, Mus musculus
caccattcagcaaaacttgaacttg

SEQ ID NO: 889910 - DNA, 25 bp, Mus musculus
caccattcagctctttgttgctggc

SEQ ID NO: 889911 - DNA, 25 bp, Mus musculus
caccattcagctttctcccagatgg

SEQ ID NO: 889912 - DNA, 25 bp, Mus musculus
caccattcaggaaaacttgaacttg

SEQ ID NO: 889913 - DNA, 25 bp, Mus musculus
caccattcaggtctttgttgctggc

SEQ ID NO: 889914 - DNA, 25 bp, Mus musculus
caccattcaggtttctcccagatgg

SEQ ID NO: 889915 - DNA, 25 bp, Mus musculus
caccattgagtacaaggccccagag

SEQ ID NO: 889916 - DNA, 25 bp, Mus musculus
caccattgagtacatggccccagag

SEQ ID NO: 889917 - DNA, 25 bp, Mus musculus
caccattggaggaaaaaacattgct

SEQ ID NO: 889918 - DNA, 25 bp, Mus musculus
caccattggaggaataaacattgct

SEQ ID NO: 889919 - DNA, 25 bp, Mus musculus
caccattggcagcgacctgattgag

SEQ ID NO: 889920 - DNA, 25 bp, Mus musculus
caccattggcagggacctgattgag

SEQ ID NO: 889921 - DNA, 25 bp, Mus musculus
caccattggtctccaggcaccgctc

SEQ ID NO: 889922 - DNA, 25 bp, Mus musculus
caccattggtctgcaggcaccgctc

SEQ ID NO: 889923 - DNA, 25 bp, Mus musculus
caccatttctgcaacccgcctgtgt

SEQ ID NO: 889924 - DNA, 25 bp, Mus musculus
caccatttctgcaagccgcctgtgt

SEQ ID NO: 889925 - DNA, 25 bp, Mus musculus
caccattttgcaagaaccatatgtc

SEQ ID NO: 889926 - DNA, 25 bp, Mus musculus
caccattttggaagaaccatatgtc

SEQ ID NO: 889927 - DNA, 25 bp, Mus musculus
caccatttttaacgcttgggctgtg

SEQ ID NO: 889928 - DNA, 25 bp, Mus musculus
caccatttttaaggcttgggctgtg

SEQ ID NO: 889929 - DNA, 25 bp, Mus musculus
cacccaaacatactgaagttgttcg

SEQ ID NO: 889930 - DNA, 25 bp, Mus musculus
cacccaaacatagtgaagttgttcg

SEQ ID NO: 889931 - DNA, 25 bp, Mus musculus
cacccaagagctcattggtgattac

SEQ ID NO: 889932 - DNA, 25 bp, Mus musculus
cacccaagaggtcattggtgattac

SEQ ID NO: 889933 - DNA, 25 bp, Mus musculus
cacccaattgcctgttaacaaaatc

SEQ ID NO: 889934 - DNA, 25 bp, Mus musculus
cacccaattggctgttaacaaaatc

SEQ ID NO: 889935 - DNA, 25 bp, Mus musculus
cacccaccacaacgtacccagccct

SEQ ID NO: 889936 - DNA, 25 bp, Mus musculus
cacccaccacaaggtacccagccct

SEQ ID NO: 889937 - DNA, 25 bp, Mus musculus
cacccaccatgaaacagctccagac

SEQ ID NO: 889938 - DNA, 25 bp, Mus musculus
cacccaccatgaaagagctccagac

SEQ ID NO: 889939 - DNA, 25 bp, Mus musculus
cacccacctctgaacgttacagcat

SEQ ID NO: 889940 - DNA, 25 bp, Mus musculus
cacccacctctgaaggttacagcat

SEQ ID NO: 889941 - DNA, 25 bp, Mus musculus
cacccacgaaatcgcaaatcccaaa

SEQ ID NO: 889942 - DNA, 25 bp, Mus musculus
cacccacgaaatggcaaatcccaaa

SEQ ID NO: 889943 - DNA, 25 bp, Mus musculus
cacccacgagcagcctcaaagccct

SEQ ID NO: 889944 - DNA, 25 bp, Mus musculus
cacccacgagcctcaaagcccttct

SEQ ID NO: 889945 - DNA, 25 bp, Mus musculus
cacccacgaggagcctcaaagccct

SEQ ID NO: 889946 - DNA, 25 bp, Mus musculus
cacccacgaggctcaaagcccttct

SEQ ID NO: 889947 - DNA, 25 bp, Mus musculus
cacccacgtatgcccctgcagcggc

SEQ ID NO: 889948 - DNA, 25 bp, Mus musculus
cacccacgtatggccctgcagcggc

SEQ ID NO: 889949 - DNA, 25 bp, Mus musculus
cacccagaagagctagaggccgagg

SEQ ID NO: 889950 - DNA, 25 bp, Mus musculus
cacccagaagaggtagaggccgagg

SEQ ID NO: 889951 - DNA, 25 bp, Mus musculus
cacccagaagcctcagaagcagagc

SEQ ID NO: 889952 - DNA, 25 bp, Mus musculus
cacccagaaggctcagaagcagagc

SEQ ID NO: 889953 - DNA, 25 bp, Mus musculus
cacccagacaagaaggtatcgcagg

SEQ ID NO: 889954 - DNA, 25 bp, Mus musculus
cacccagacaagtaggtatcgcagg

SEQ ID NO: 889955 - DNA, 25 bp, Mus musculus
cacccagacctccctccatgaacat

SEQ ID NO: 889956 - DNA, 25 bp, Mus musculus
cacccagacctcgctccatgaacat

SEQ ID NO: 889957 - DNA, 25 bp, Mus musculus
cacccagcagctagaagaaaaactc

SEQ ID NO: 889958 - DNA, 25 bp, Mus musculus
cacccagcaggtagaagaaaaactc

SEQ ID NO: 889959 - DNA, 25 bp, Mus musculus
cacccagcctgcagtcctgggtgga

SEQ ID NO: 889960 - DNA, 25 bp, Mus musculus
cacccagcctgctgtcctgggtgga

SEQ ID NO: 889961 - DNA, 25 bp, Mus musculus
cacccaggagatcttcagaacaaaa

SEQ ID NO: 889962 - DNA, 25 bp, Mus musculus
cacccaggagatggagttccagaag

SEQ ID NO: 889963 - DNA, 25 bp, Mus musculus
cacccaggagttcttcagaacaaaa

SEQ ID NO: 889964 - DNA, 25 bp, Mus musculus
cacccaggagttggagttccagaag

SEQ ID NO: 889965 - DNA, 25 bp, Mus musculus
cacccaggatctgagagtctgggtt

SEQ ID NO: 889966 - DNA, 25 bp, Mus musculus
cacccaggatgtgagagtctgggtt

SEQ ID NO: 889967 - DNA, 25 bp, Mus musculus
cacccagtcactcacgtgttagcat

SEQ ID NO: 889968 - DNA, 25 bp, Mus musculus
cacccagtcactcaggtgttagcat

SEQ ID NO: 889969 - DNA, 25 bp, Mus musculus
cacccataatctcggctgaatcatg

SEQ ID NO: 889970 - DNA, 25 bp, Mus musculus
cacccataatctgggctgaatcatg

SEQ ID NO: 889971 - DNA, 25 bp, Mus musculus
cacccatcacaccctgcctgcagct

SEQ ID NO: 889972 - DNA, 25 bp, Mus musculus
cacccatcacacgctgcctgcagct

SEQ ID NO: 889973 - DNA, 25 bp, Mus musculus
cacccatggaagacaaagtctggag

SEQ ID NO: 889974 - DNA, 25 bp, Mus musculus
cacccatggaagcaccccccattgg

SEQ ID NO: 889975 - DNA, 25 bp, Mus musculus
cacccatggaaggaccccccattgg

SEQ ID NO: 889976 - DNA, 25 bp, Mus musculus
cacccatggaagtcaaagtctggag

SEQ ID NO: 889977 - DNA, 25 bp, Mus musculus
cacccatgtactaacacctgttccc

SEQ ID NO: 889978 - DNA, 25 bp, Mus musculus
cacccatgtactaacggatacagtg

SEQ ID NO: 889979 - DNA, 25 bp, Mus musculus
cacccatgtactaacgtatacagtt

SEQ ID NO: 889980 - DNA, 25 bp, Mus musculus
cacccatgtactaactttccccctg

SEQ ID NO: 889981 - DNA, 25 bp, Mus musculus
cacccatgtactaagacctgttccc

SEQ ID NO: 889982 - DNA, 25 bp, Mus musculus
cacccatgtactaagggatacagtg

SEQ ID NO: 889983 - DNA, 25 bp, Mus musculus
cacccatgtactaaggtatacagtt

SEQ ID NO: 889984 - DNA, 25 bp, Mus musculus
cacccatgtactaagtttccccctg

SEQ ID NO: 889985 - DNA, 25 bp, Mus musculus
caccccaaccagctctcgccagtga

SEQ ID NO: 889986 - DNA, 25 bp, Mus musculus
caccccaaccaggtctcgccagtga

SEQ ID NO: 889987 - DNA, 25 bp, Mus musculus
caccccaatagacataatgcagggg

SEQ ID NO: 889988 - DNA, 25 bp, Mus musculus
caccccaatagacatggcttgccag

SEQ ID NO: 889989 - DNA, 25 bp, Mus musculus
caccccaatagagataatgcagggg

SEQ ID NO: 889990 - DNA, 25 bp, Mus musculus
caccccaatagagatggcttgccag

SEQ ID NO: 889991 - DNA, 25 bp, Mus musculus
caccccaatctccatatgtttgatg

SEQ ID NO: 889992 - DNA, 25 bp, Mus musculus
caccccaatctcctagatatgtttg

SEQ ID NO: 889993 - DNA, 25 bp, Mus musculus
caccccaatctcgatatgtttgatg

SEQ ID NO: 889994 - DNA, 25 bp, Mus musculus
caccccaatctcgtagatatgtttg

SEQ ID NO: 889995 - DNA, 25 bp, Mus musculus
caccccagagctgtggccaaacgta

SEQ ID NO: 889996 - DNA, 25 bp, Mus musculus
caccccagaggtgtggccaaacgta

SEQ ID NO: 889997 - DNA, 25 bp, Mus musculus
caccccagcctaaaccatacctttc

SEQ ID NO: 889998 - DNA, 25 bp, Mus musculus
caccccagcctataccatacctttc

SEQ ID NO: 889999 - DNA, 25 bp, Mus musculus
cacccccaatgactacactgcagcc

SEQ ID NO: 890000 - DNA, 25 bp, Mus musculus
cacccccaatgagtacactgcagcc

SEQ ID NO: 890001 - DNA, 25 bp, Mus musculus
cacccccaggcaatcctggcccagt

SEQ ID NO: 890002 - DNA, 25 bp, Mus musculus
cacccccaggcaatgctggcccagt

SEQ ID NO: 890003 - DNA, 25 bp, Mus musculus
cacccccatcagccccctcaagttc

SEQ ID NO: 890004 - DNA, 25 bp, Mus musculus
cacccccatcaggcccctcaagttc

SEQ ID NO: 890005 - DNA, 25 bp, Mus musculus
caccccccagcaagagccagaggga

SEQ ID NO: 890006 - DNA, 25 bp, Mus musculus
caccccccagcacatgacagatgac

SEQ ID NO: 890007 - DNA, 25 bp, Mus musculus
caccccccaggaagagccagaggga

SEQ ID NO: 890008 - DNA, 25 bp, Mus musculus
caccccccaggacatgacagatgac

SEQ ID NO: 890009 - DNA, 25 bp, Mus musculus
caccccccatgacacgatggctggc

SEQ ID NO: 890010 - DNA, 25 bp, Mus musculus
caccccccatgacaggatggctggc

SEQ ID NO: 890011 - DNA, 25 bp, Mus musculus
caccccctgcagcagcccccacaac

SEQ ID NO: 890012 - DNA, 25 bp, Mus musculus
caccccctgcaggagcccccacaac

SEQ ID NO: 890013 - DNA, 25 bp, Mus musculus
caccccgaggagcactatacactcg

SEQ ID NO: 890014 - DNA, 25 bp, Mus musculus
caccccgaggagcagtatacactcg

SEQ ID NO: 890015 - DNA, 25 bp, Mus musculus
caccccgctgccaaatctcatgcat

SEQ ID NO: 890016 - DNA, 25 bp, Mus musculus
caccccgctggcaaatctcatgcat

SEQ ID NO: 890017 - DNA, 25 bp, Mus musculus
caccccggatgacccctgggcattt

SEQ ID NO: 890018 - DNA, 25 bp, Mus musculus
caccccggatgagccctgggcattt

SEQ ID NO: 890019 - DNA, 25 bp, Mus musculus
cacccctactctttctgacctgtga

SEQ ID NO: 890020 - DNA, 25 bp, Mus musculus
cacccctactgtttctgacctgtga

SEQ ID NO: 890021 - DNA, 25 bp, Mus musculus
cacccctctggacatcctctggacc

SEQ ID NO: 890022 - DNA, 25 bp, Mus musculus
cacccctctggagatcctctggacc

SEQ ID NO: 890023 - DNA, 25 bp, Mus musculus
cacccctgaaatcgcattatccaat

SEQ ID NO: 890024 - DNA, 25 bp, Mus musculus
cacccctgaaatggcattatccaat

SEQ ID NO: 890025 - DNA, 25 bp, Mus musculus
cacccctgagaacttggctccagaa

SEQ ID NO: 890026 - DNA, 25 bp, Mus musculus
cacccctgagtacttggctccagaa

SEQ ID NO: 890027 - DNA, 25 bp, Mus musculus
cacccctgcacacgcaggtcctggt

SEQ ID NO: 890028 - DNA, 25 bp, Mus musculus
cacccctgcacaggcaggtcctggt

SEQ ID NO: 890029 - DNA, 25 bp, Mus musculus
cacccctgccagactcctggctgct

SEQ ID NO: 890030 - DNA, 25 bp, Mus musculus
cacccctgccagataatcagccttt

SEQ ID NO: 890031 - DNA, 25 bp, Mus musculus
cacccctgccagtctcctggctgct

SEQ ID NO: 890032 - DNA, 25 bp, Mus musculus
cacccctgccagttaatcagccttt

SEQ ID NO: 890033 - DNA, 25 bp, Mus musculus
cacccctgctgcaacgcattgctga

SEQ ID NO: 890034 - DNA, 25 bp, Mus musculus
cacccctgctgcaaggcattgctga

SEQ ID NO: 890035 - DNA, 25 bp, Mus musculus
cacccctggccacgtgcgcaccctg

SEQ ID NO: 890036 - DNA, 25 bp, Mus musculus
cacccctggccaggtgcgcaccctg

SEQ ID NO: 890037 - DNA, 25 bp, Mus musculus
cacccctgggacaagctcaggccct

SEQ ID NO: 890038 - DNA, 25 bp, Mus musculus
cacccctgggactagctcaggccct

SEQ ID NO: 890039 - DNA, 25 bp, Mus musculus
caccccttcactgcctgtgctgacc

SEQ ID NO: 890040 - DNA, 25 bp, Mus musculus
caccccttcagtgcctgtgctgacc

SEQ ID NO: 890041 - DNA, 25 bp, Mus musculus
caccccttcttccacggtctggact

SEQ ID NO: 890042 - DNA, 25 bp, Mus musculus
caccccttcttccagggtctggact

SEQ ID NO: 890043 - DNA, 25 bp, Mus musculus
cacccgagctagcggaagacaccca

SEQ ID NO: 890044 - DNA, 25 bp, Mus musculus
cacccgagctaggggaagacaccca

SEQ ID NO: 890045 - DNA, 25 bp, Mus musculus
cacccgagtttgtcccccccgagat

SEQ ID NO: 890046 - DNA, 25 bp, Mus musculus
cacccgagtttgtcgcccccgagat

SEQ ID NO: 890047 - DNA, 25 bp, Mus musculus
cacccgcatccactgcagcgaggcc

SEQ ID NO: 890048 - DNA, 25 bp, Mus musculus
cacccgcatccagtgcagcgaggcc

SEQ ID NO: 890049 - DNA, 25 bp, Mus musculus
cacccgccgctccccggccctgctg

SEQ ID NO: 890050 - DNA, 25 bp, Mus musculus
cacccgccgctccgttacctgcctt

SEQ ID NO: 890051 - DNA, 25 bp, Mus musculus
cacccgccgctcgccggccctgctg

SEQ ID NO: 890052 - DNA, 25 bp, Mus musculus
cacccgccgctcggttacctgcctt

SEQ ID NO: 890053 - DNA, 25 bp, Mus musculus
cacccgctaccgccgggcagaacag

SEQ ID NO: 890054 - DNA, 25 bp, Mus musculus
cacccgctaccggcgggcagaacag

SEQ ID NO: 890055 - DNA, 25 bp, Mus musculus
cacccggactcacatcatctttaga

SEQ ID NO: 890056 - DNA, 25 bp, Mus musculus
cacccggactcagatcatctttaga

SEQ ID NO: 890057 - DNA, 25 bp, Mus musculus
cacccggctcacagatgatgtctcc

SEQ ID NO: 890058 - DNA, 25 bp, Mus musculus
cacccggctcacagttgatgtctcc

SEQ ID NO: 890059 - DNA, 25 bp, Mus musculus
cacccggggatacacaacatctccc

SEQ ID NO: 890060 - DNA, 25 bp, Mus musculus
cacccggggatacacctttggggcg

SEQ ID NO: 890061 - DNA, 25 bp, Mus musculus
cacccggggatacagaacatctccc

SEQ ID NO: 890062 - DNA, 25 bp, Mus musculus
cacccggggatacagctttggggcg

SEQ ID NO: 890063 - DNA, 25 bp, Mus musculus
cacccgtcaaatatgaatacccaga

SEQ ID NO: 890064 - DNA, 25 bp, Mus musculus
cacccgtcaaatttgaatacccaga

SEQ ID NO: 890065 - DNA, 25 bp, Mus musculus
caccctacaccatagaatttttgcg

SEQ ID NO: 890066 - DNA, 25 bp, Mus musculus
caccctacacgatagaatttttgcg

SEQ ID NO: 890067 - DNA, 25 bp, Mus musculus
caccctagagaggatttccagggca

SEQ ID NO: 890068 - DNA, 25 bp, Mus musculus
caccctagagtggatttccagggca

SEQ ID NO: 890069 - DNA, 25 bp, Mus musculus
caccctagatgacgcagctgcggca

SEQ ID NO: 890070 - DNA, 25 bp, Mus musculus
caccctagatgaggcagctgcggca

SEQ ID NO: 890071 - DNA, 25 bp, Mus musculus
caccctcaagattgtagaagaagag

SEQ ID NO: 890072 - DNA, 25 bp, Mus musculus
caccctcaagtttgtagaagaagag

SEQ ID NO: 890073 - DNA, 25 bp, Mus musculus
caccctcacaagataatcgttatgt

SEQ ID NO: 890074 - DNA, 25 bp, Mus musculus
caccctcacaagttaatcgttatgt

SEQ ID NO: 890075 - DNA, 25 bp, Mus musculus
caccctcatgttatcactcaacaag

SEQ ID NO: 890076 - DNA, 25 bp, Mus musculus
caccctcatgttatgactcaacaag

SEQ ID NO: 890077 - DNA, 25 bp, Mus musculus
caccctcccccacagtgctgaccta

SEQ ID NO: 890078 - DNA, 25 bp, Mus musculus
caccctcccccagagtgctgaccta

SEQ ID NO: 890079 - DNA, 25 bp, Mus musculus
caccctctacagcagttttcttcaa

SEQ ID NO: 890080 - DNA, 25 bp, Mus musculus
caccctctacaggagttttcttcaa

SEQ ID NO: 890081 - DNA, 25 bp, Mus musculus
caccctcttccacacccatgacaac

SEQ ID NO: 890082 - DNA, 25 bp, Mus musculus
caccctcttccagacccatgacaac

SEQ ID NO: 890083 - DNA, 25 bp, Mus musculus
caccctgaaaagagcaggtgtgcat

SEQ ID NO: 890084 - DNA, 25 bp, Mus musculus
caccctgaaaagtgcaggtgtgcat

SEQ ID NO: 890085 - DNA, 25 bp, Mus musculus
caccctgaggatgcagtggatgaac

SEQ ID NO: 890086 - DNA, 25 bp, Mus musculus
caccctgaggatgctgtggatgaac

SEQ ID NO: 890087 - DNA, 25 bp, Mus musculus
caccctggagcttcctggtgtcgca

SEQ ID NO: 890088 - DNA, 25 bp, Mus musculus
caccctggaggttcctggtgtcgca

SEQ ID NO: 890089 - DNA, 25 bp, Mus musculus
caccctggggaacttatatgaagcc

SEQ ID NO: 890090 - DNA, 25 bp, Mus musculus
caccctggggaagttatatgaagcc

SEQ ID NO: 890091 - DNA, 25 bp, Mus musculus
caccctggggccgtcgggatggagg

SEQ ID NO: 890092 - DNA, 25 bp, Mus musculus
caccctgggggcgtcgggatggagg

SEQ ID NO: 890093 - DNA, 25 bp, Mus musculus
caccctggtggcagaacgtgaaaag

SEQ ID NO: 890094 - DNA, 25 bp, Mus musculus
caccctggtggctgaacgtgaaaag

SEQ ID NO: 890095 - DNA, 25 bp, Mus musculus
caccctgtgagacatctactgccat

SEQ ID NO: 890096 - DNA, 25 bp, Mus musculus
caccctgtgagacccagatctactg

SEQ ID NO: 890097 - DNA, 25 bp, Mus musculus
caccctgtgagagatctactgccat

SEQ ID NO: 890098 - DNA, 25 bp, Mus musculus
caccctgtgagagccagatctactg

SEQ ID NO: 890099 - DNA, 25 bp, Mus musculus
caccctgtgataaacaccagaatat

SEQ ID NO: 890100 - DNA, 25 bp, Mus musculus
caccctgtgataaacgtgtccccaa

SEQ ID NO: 890101 - DNA, 25 bp, Mus musculus
caccctgtgataaagaccagaatat

SEQ ID NO: 890102 - DNA, 25 bp, Mus musculus
caccctgtgataaaggtgtccccaa

SEQ ID NO: 890103 - DNA, 25 bp, Mus musculus
caccctgtgcagaaatgagggagga

SEQ ID NO: 890104 - DNA, 25 bp, Mus musculus
caccctgtgcagtaatgagggagga

SEQ ID NO: 890105 - DNA, 25 bp, Mus musculus
caccctgtgtgagactgtggctatc

SEQ ID NO: 890106 - DNA, 25 bp, Mus musculus
caccctgtgtgagagtgtggctatc

SEQ ID NO: 890107 - DNA, 25 bp, Mus musculus
cacccttcagaacaagcccaccacc

SEQ ID NO: 890108 - DNA, 25 bp, Mus musculus
cacccttcagtacaagcccaccacc

SEQ ID NO: 890109 - DNA, 25 bp, Mus musculus
cacccttcttagagggtcctgtgtc

SEQ ID NO: 890110 - DNA, 25 bp, Mus musculus
cacccttcttagtgggtcctgtgtc

SEQ ID NO: 890111 - DNA, 25 bp, Mus musculus
cacccttgagacaagtccatcatct

SEQ ID NO: 890112 - DNA, 25 bp, Mus musculus
cacccttgagtcaagtccatcatct

SEQ ID NO: 890113 - DNA, 25 bp, Mus musculus
caccgaacacagagaggatgccatg

SEQ ID NO: 890114 - DNA, 25 bp, Mus musculus
caccgaacacagtgaggatgccatg

SEQ ID NO: 890115 - DNA, 25 bp, Mus musculus
caccgaagagagtgtgaacatggct

SEQ ID NO: 890116 - DNA, 25 bp, Mus musculus
caccgaagagtgtgtgaacatggct

SEQ ID NO: 890117 - DNA, 25 bp, Mus musculus
caccgacagcatcaaaatgccaggc

SEQ ID NO: 890118 - DNA, 25 bp, Mus musculus
caccgacagcatcaaggacaattca

SEQ ID NO: 890119 - DNA, 25 bp, Mus musculus
caccgacagcatcaaggcctgggag

SEQ ID NO: 890120 - DNA, 25 bp, Mus musculus
caccgacagcatcataatgccaggc

SEQ ID NO: 890121 - DNA, 25 bp, Mus musculus
caccgacagcatcatggacaattca

SEQ ID NO: 890122 - DNA, 25 bp, Mus musculus
caccgacagcatcatggcctgggag

SEQ ID NO: 890123 - DNA, 25 bp, Mus musculus
caccgacatcaacgactccaaagct

SEQ ID NO: 890124 - DNA, 25 bp, Mus musculus
caccgacatcaaggactccaaagct

SEQ ID NO: 890125 - DNA, 25 bp, Mus musculus
caccgagaatctctcctcccacgag

SEQ ID NO: 890126 - DNA, 25 bp, Mus musculus
caccgagaatctgtcctcccacgag

SEQ ID NO: 890127 - DNA, 25 bp, Mus musculus
caccgagcagctgacattcccactg

SEQ ID NO: 890128 - DNA, 25 bp, Mus musculus
caccgagcaggtgacattcccactg

SEQ ID NO: 890129 - DNA, 25 bp, Mus musculus
caccgaggagcttccacaactcata

SEQ ID NO: 890130 - DNA, 25 bp, Mus musculus
caccgaggaggttccacaactcata

SEQ ID NO: 890131 - DNA, 25 bp, Mus musculus
caccgagtggcacaccacgcccggg

SEQ ID NO: 890132 - DNA, 25 bp, Mus musculus
caccgagtggcacagcacgcccggg

SEQ ID NO: 890133 - DNA, 25 bp, Mus musculus
caccgatcagaaacctgatatctca

SEQ ID NO: 890134 - DNA, 25 bp, Mus musculus
caccgatcagcacaacatccacgct

SEQ ID NO: 890135 - DNA, 25 bp, Mus musculus
caccgatcaggacaacatccacgct

SEQ ID NO: 890136 - DNA, 25 bp, Mus musculus
caccgatcagtaacctgatatctca

SEQ ID NO: 890137 - DNA, 25 bp, Mus musculus
caccgatttaaaccttgtgccccag

SEQ ID NO: 890138 - DNA, 25 bp, Mus musculus
caccgatttaaagcttgtgccccag

SEQ ID NO: 890139 - DNA, 25 bp, Mus musculus
caccgatttctgcctagtgaggaat

SEQ ID NO: 890140 - DNA, 25 bp, Mus musculus
caccgatttctggctagtgaggaat

SEQ ID NO: 890141 - DNA, 25 bp, Mus musculus
caccgcagcgctgtcagctatgaag

SEQ ID NO: 890142 - DNA, 25 bp, Mus musculus
caccgcagcggtgtcagctatgaag

SEQ ID NO: 890143 - DNA, 25 bp, Mus musculus
caccgcagtgtcaacgtggccaaag

SEQ ID NO: 890144 - DNA, 25 bp, Mus musculus
caccgcagtgtcaaggtggccaaag

SEQ ID NO: 890145 - DNA, 25 bp, Mus musculus
caccgcatcagatccgcatcaagca

SEQ ID NO: 890146 - DNA, 25 bp, Mus musculus
caccgcatcagatcggcatcaagca

SEQ ID NO: 890147 - DNA, 25 bp, Mus musculus
caccgccaagagaataaagactcgg

SEQ ID NO: 890148 - DNA, 25 bp, Mus musculus
caccgccaagatggattcatgggtg

SEQ ID NO: 890149 - DNA, 25 bp, Mus musculus
caccgccaagtgaataaagactcgg

SEQ ID NO: 890150 - DNA, 25 bp, Mus musculus
caccgccaagttggattcatgggtg

SEQ ID NO: 890151 - DNA, 25 bp, Mus musculus
caccgccaggatcaaacccatcctg

SEQ ID NO: 890152 - DNA, 25 bp, Mus musculus
caccgccaggatgaaacccatcctg

SEQ ID NO: 890153 - DNA, 25 bp, Mus musculus
caccgccgcgccatggatgggcaga

SEQ ID NO: 890154 - DNA, 25 bp, Mus musculus
caccgccgcggcatggatgggcaga

SEQ ID NO: 890155 - DNA, 25 bp, Mus musculus
caccgcgcagatctcaagcatacac

SEQ ID NO: 890156 - DNA, 25 bp, Mus musculus
caccgcgcagccagctgaaaaagtt

SEQ ID NO: 890157 - DNA, 25 bp, Mus musculus
caccgcgcaggcagctgaaaaagtt

SEQ ID NO: 890158 - DNA, 25 bp, Mus musculus
caccgcgcagttctcaagcatacac

SEQ ID NO: 890159 - DNA, 25 bp, Mus musculus
caccgcggccgtccagttggaattg

SEQ ID NO: 890160 - DNA, 25 bp, Mus musculus
caccgcggccgtgcagttggaattg

SEQ ID NO: 890161 - DNA, 25 bp, Mus musculus
caccgctcagaacaaggcctgagct

SEQ ID NO: 890162 - DNA, 25 bp, Mus musculus
caccgctcagaagaaggcctgagct

SEQ ID NO: 890163 - DNA, 25 bp, Mus musculus
caccgctcagagactctgggagctt

SEQ ID NO: 890164 - DNA, 25 bp, Mus musculus
caccgctcagtgactctgggagctt

SEQ ID NO: 890165 - DNA, 25 bp, Mus musculus
caccgctccaatcagggtatgaact

SEQ ID NO: 890166 - DNA, 25 bp, Mus musculus
caccgctccaatgagggtatgaact

SEQ ID NO: 890167 - DNA, 25 bp, Mus musculus
caccgctgccagccacaatggaagg

SEQ ID NO: 890168 - DNA, 25 bp, Mus musculus
caccgctgccaggcacaatggaagg

SEQ ID NO: 890169 - DNA, 25 bp, Mus musculus
caccgctggaaaagttattaagtgc

SEQ ID NO: 890170 - DNA, 25 bp, Mus musculus
caccgctggaaatgttattaagtgc

SEQ ID NO: 890171 - DNA, 25 bp, Mus musculus
caccggaacaaacatgcctgcaaca

SEQ ID NO: 890172 - DNA, 25 bp, Mus musculus
caccggaacatacatgcctgcaaca

SEQ ID NO: 890173 - DNA, 25 bp, Mus musculus
caccggagcgatcccagccactcag

SEQ ID NO: 890174 - DNA, 25 bp, Mus musculus
caccggagcgttcccagccactcag

SEQ ID NO: 890175 - DNA, 25 bp, Mus musculus
caccggagctttgacttgctggttg

SEQ ID NO: 890176 - DNA, 25 bp, Mus musculus
caccggagctttgagttgctggttg

SEQ ID NO: 890177 - DNA, 25 bp, Mus musculus
caccggagtcatcggggtctgctgc

SEQ ID NO: 890178 - DNA, 25 bp, Mus musculus
caccggagtcatgggggtctgctgc

SEQ ID NO: 890179 - DNA, 25 bp, Mus musculus
caccggcaagctgatgcttcttgga

SEQ ID NO: 890180 - DNA, 25 bp, Mus musculus
caccggcaaggtgatgcttcttgga

SEQ ID NO: 890181 - DNA, 25 bp, Mus musculus
caccggcgagcagtctgcaggtgct

SEQ ID NO: 890182 - DNA, 25 bp, Mus musculus
caccggcgaggagtctgcaggtgct

SEQ ID NO: 890183 - DNA, 25 bp, Mus musculus
caccggctggagcaacccatgcttc

SEQ ID NO: 890184 - DNA, 25 bp, Mus musculus
caccggctggaggaacccatgcttc

SEQ ID NO: 890185 - DNA, 25 bp, Mus musculus
caccggcttctgcaagtcacctggg

SEQ ID NO: 890186 - DNA, 25 bp, Mus musculus
caccggcttctgccccccactgcct

SEQ ID NO: 890187 - DNA, 25 bp, Mus musculus
caccggcttctggaagtcacctggg

SEQ ID NO: 890188 - DNA, 25 bp, Mus musculus
caccggcttctggcccccactgcct

SEQ ID NO: 890189 - DNA, 25 bp, Mus musculus
caccgggaaaagacctattcagagt

SEQ ID NO: 890190 - DNA, 25 bp, Mus musculus
caccgggaaaagtcctattcagagt

SEQ ID NO: 890191 - DNA, 25 bp, Mus musculus
caccggggtattcacctgttccagt

SEQ ID NO: 890192 - DNA, 25 bp, Mus musculus
caccggggtattcagctgttccagt

SEQ ID NO: 890193 - DNA, 25 bp, Mus musculus
caccgtagaggaatcgaggcagctt

SEQ ID NO: 890194 - DNA, 25 bp, Mus musculus
caccgtagaggaatggaggcagctt

SEQ ID NO: 890195 - DNA, 25 bp, Mus musculus
caccgtatgaagctggaagatatca

SEQ ID NO: 890196 - DNA, 25 bp, Mus musculus
caccgtatgaaggtggaagatatca

SEQ ID NO: 890197 - DNA, 25 bp, Mus musculus
caccgtggtctgcgaagtggctgat

SEQ ID NO: 890198 - DNA, 25 bp, Mus musculus
caccgtggtctgggaagtggctgat

SEQ ID NO: 890199 - DNA, 25 bp, Mus musculus
caccgtgtgcagcttctctgtgaaa

SEQ ID NO: 890200 - DNA, 25 bp, Mus musculus
caccgtgtgcaggttctctgtgaaa

SEQ ID NO: 890201 - DNA, 25 bp, Mus musculus
caccgtgtggcagactgctcaacag

SEQ ID NO: 890202 - DNA, 25 bp, Mus musculus
caccgtgtggcagagtgctcaacag

SEQ ID NO: 890203 - DNA, 25 bp, Mus musculus
caccgttcgttcaacgggcagaatc

SEQ ID NO: 890204 - DNA, 25 bp, Mus musculus
caccgttcgttcaaggggcagaatc

SEQ ID NO: 890205 - DNA, 25 bp, Mus musculus
cacctacaaccaaaggtacttcgag

SEQ ID NO: 890206 - DNA, 25 bp, Mus musculus
cacctacaaccataggtacttcgag

SEQ ID NO: 890207 - DNA, 25 bp, Mus musculus
cacctacacccaatacaagcagctc

SEQ ID NO: 890208 - DNA, 25 bp, Mus musculus
cacctacacccattacaagcagctc

SEQ ID NO: 890209 - DNA, 25 bp, Mus musculus
cacctacagagacgaggcttctcag

SEQ ID NO: 890210 - DNA, 25 bp, Mus musculus
cacctacagagaggaggcttctcag

SEQ ID NO: 890211 - DNA, 25 bp, Mus musculus
cacctacagtcacgtccagtgtcac

SEQ ID NO: 890212 - DNA, 25 bp, Mus musculus
cacctacagtcaggtccagtgtcac

SEQ ID NO: 890213 - DNA, 25 bp, Mus musculus
cacctacatcatccttagtgggtac

SEQ ID NO: 890214 - DNA, 25 bp, Mus musculus
cacctacatcatgcttagtgggtac

SEQ ID NO: 890215 - DNA, 25 bp, Mus musculus
cacctacatcctcctgagcggagcg

SEQ ID NO: 890216 - DNA, 25 bp, Mus musculus
cacctacatcctgctgagcggagcg

SEQ ID NO: 890217 - DNA, 25 bp, Mus musculus
cacctaccagaacctagaactgcgc

SEQ ID NO: 890218 - DNA, 25 bp, Mus musculus
cacctaccagtacctagaactgcgc

SEQ ID NO: 890219 - DNA, 25 bp, Mus musculus
cacctacccacctaagtgctcccaa

SEQ ID NO: 890220 - DNA, 25 bp, Mus musculus
cacctacccacctatgtgctcccaa

SEQ ID NO: 890221 - DNA, 25 bp, Mus musculus
cacctacgacgaacaagtggctgca

SEQ ID NO: 890222 - DNA, 25 bp, Mus musculus
cacctacgacgaactagtggctgca

SEQ ID NO: 890223 - DNA, 25 bp, Mus musculus
cacctacgtcaccctgagagtgagc

SEQ ID NO: 890224 - DNA, 25 bp, Mus musculus
cacctacgtcacgctgagagtgagc

SEQ ID NO: 890225 - DNA, 25 bp, Mus musculus
cacctactataccacctctggagaa

SEQ ID NO: 890226 - DNA, 25 bp, Mus musculus
cacctactataccagctctggagaa

SEQ ID NO: 890227 - DNA, 25 bp, Mus musculus
cacctactcacacagaattgaagga

SEQ ID NO: 890228 - DNA, 25 bp, Mus musculus
cacctactcacagagaattgaagga

SEQ ID NO: 890229 - DNA, 25 bp, Mus musculus
cacctactcacctctcagaactgtg

SEQ ID NO: 890230 - DNA, 25 bp, Mus musculus
cacctactcagctctcagaactgtg

SEQ ID NO: 890231 - DNA, 25 bp, Mus musculus
cacctaggcctgatccagagctcag

SEQ ID NO: 890232 - DNA, 25 bp, Mus musculus
cacctaggcctgttccagagctcag

SEQ ID NO: 890233 - DNA, 25 bp, Mus musculus
cacctatcagccaacaattggcatt

SEQ ID NO: 890234 - DNA, 25 bp, Mus musculus
cacctatcaggcaacaattggcatt

SEQ ID NO: 890235 - DNA, 25 bp, Mus musculus
cacctatcgtctcgccagtggtgtg

SEQ ID NO: 890236 - DNA, 25 bp, Mus musculus
cacctatcgtgtcgccagtggtgtg

SEQ ID NO: 890237 - DNA, 25 bp, Mus musculus
cacctatgagaatgatgtcagaaca

SEQ ID NO: 890238 - DNA, 25 bp, Mus musculus
cacctatgagacactaaagtacata

SEQ ID NO: 890239 - DNA, 25 bp, Mus musculus
cacctatgagagcggagaagctgca

SEQ ID NO: 890240 - DNA, 25 bp, Mus musculus
cacctatgagatggtagaagagagt

SEQ ID NO: 890241 - DNA, 25 bp, Mus musculus
cacctatgaggacgccttaagatac

SEQ ID NO: 890242 - DNA, 25 bp, Mus musculus
cacctatgaggaggccttaagatac

SEQ ID NO: 890243 - DNA, 25 bp, Mus musculus
cacctatgagtatgatgtcagaaca

SEQ ID NO: 890244 - DNA, 25 bp, Mus musculus
cacctatgagtcactaaagtacata

SEQ ID NO: 890245 - DNA, 25 bp, Mus musculus
cacctatgagtgcggagaagctgca

SEQ ID NO: 890246 - DNA, 25 bp, Mus musculus
cacctatgagttggtagaagagagt

SEQ ID NO: 890247 - DNA, 25 bp, Mus musculus
cacctatggctaagtcaccgtcctt

SEQ ID NO: 890248 - DNA, 25 bp, Mus musculus
cacctatggctatgtcaccgtcctt

SEQ ID NO: 890249 - DNA, 25 bp, Mus musculus
cacctattcctgcgtcggtgtgttc

SEQ ID NO: 890250 - DNA, 25 bp, Mus musculus
cacctattcctgggtcggtgtgttc

SEQ ID NO: 890251 - DNA, 25 bp, Mus musculus
cacctcaaggagcgttcagaagcgg

SEQ ID NO: 890252 - DNA, 25 bp, Mus musculus
cacctcaaggagggttcagaagcgg

SEQ ID NO: 890253 - DNA, 25 bp, Mus musculus
cacctcatcatccacctggatagca

SEQ ID NO: 890254 - DNA, 25 bp, Mus musculus
cacctcatcatccagctggatagca

SEQ ID NO: 890255 - DNA, 25 bp, Mus musculus
cacctcatcctgcactacgtgagcg

SEQ ID NO: 890256 - DNA, 25 bp, Mus musculus
cacctcatcctggactacgtgagcg

SEQ ID NO: 890257 - DNA, 25 bp, Mus musculus
cacctcatgccgagcaactgtgggt

SEQ ID NO: 890258 - DNA, 25 bp, Mus musculus
cacctcatgccgtgcaactgtgggt

SEQ ID NO: 890259 - DNA, 25 bp, Mus musculus
cacctcatggagatacattggtcaa

SEQ ID NO: 890260 - DNA, 25 bp, Mus musculus
cacctcatggtgatacattggtcaa

SEQ ID NO: 890261 - DNA, 25 bp, Mus musculus
cacctccagatataagctctcgaac

SEQ ID NO: 890262 - DNA, 25 bp, Mus musculus
cacctccagatatatgctctcgaac

SEQ ID NO: 890263 - DNA, 25 bp, Mus musculus
cacctccagctcttcgcagaagact

SEQ ID NO: 890264 - DNA, 25 bp, Mus musculus
cacctccagctcttggcagaagact

SEQ ID NO: 890265 - DNA, 25 bp, Mus musculus
cacctccaggacctgtctcccactc

SEQ ID NO: 890266 - DNA, 25 bp, Mus musculus
cacctccaggacctttctaagctga

SEQ ID NO: 890267 - DNA, 25 bp, Mus musculus
cacctccaggacgtgtctcccactc

SEQ ID NO: 890268 - DNA, 25 bp, Mus musculus
cacctccaggacgtttctaagctga

SEQ ID NO: 890269 - DNA, 25 bp, Mus musculus
cacctcccagaggcaccaccgaggg

SEQ ID NO: 890270 - DNA, 25 bp, Mus musculus
cacctcccagtggcaccaccgaggg

SEQ ID NO: 890271 - DNA, 25 bp, Mus musculus
cacctccgccagatctagactggct

SEQ ID NO: 890272 - DNA, 25 bp, Mus musculus
cacctccgccagttctagactggct

SEQ ID NO: 890273 - DNA, 25 bp, Mus musculus
cacctccttcctcaagagtaaaggt

SEQ ID NO: 890274 - DNA, 25 bp, Mus musculus
cacctccttcctgaagagtaaaggt

SEQ ID NO: 890275 - DNA, 25 bp, Mus musculus
cacctcgaagcatcctgcacaacta

SEQ ID NO: 890276 - DNA, 25 bp, Mus musculus
cacctcgaaggatcctgcacaacta

SEQ ID NO: 890277 - DNA, 25 bp, Mus musculus
cacctcgcaaattacgtccacagca

SEQ ID NO: 890278 - DNA, 25 bp, Mus musculus
cacctcgcaaattaggtccacagca

SEQ ID NO: 890279 - DNA, 25 bp, Mus musculus
cacctcggtgcacgctatctatgtg

SEQ ID NO: 890280 - DNA, 25 bp, Mus musculus
cacctcggtgcaggctatctatgtg

SEQ ID NO: 890281 - DNA, 25 bp, Mus musculus
cacctctacaagagacatcttgaaa

SEQ ID NO: 890282 - DNA, 25 bp, Mus musculus
cacctctacaagtgacatcttgaaa

SEQ ID NO: 890283 - DNA, 25 bp, Mus musculus
cacctctcgtcacatgtcgtcaccg

SEQ ID NO: 890284 - DNA, 25 bp, Mus musculus
cacctctcgtcacgactgcaagagg

SEQ ID NO: 890285 - DNA, 25 bp, Mus musculus
cacctctcgtcagatgtcgtcaccg

SEQ ID NO: 890286 - DNA, 25 bp, Mus musculus
cacctctcgtcaggactgcaagagg

SEQ ID NO: 890287 - DNA, 25 bp, Mus musculus
cacctctctgagtgctgagctacgt

SEQ ID NO: 890288 - DNA, 25 bp, Mus musculus
cacctctctgctggaatgcagagaa

SEQ ID NO: 890289 - DNA, 25 bp, Mus musculus
cacctctctggtggaatgcagagaa

SEQ ID NO: 890290 - DNA, 25 bp, Mus musculus
cacctctctgtgtgctgagctacgt

SEQ ID NO: 890291 - DNA, 25 bp, Mus musculus
cacctctgcctgctcatttggctgt

SEQ ID NO: 890292 - DNA, 25 bp, Mus musculus
cacctctgcctggtcatttggctgt

SEQ ID NO: 890293 - DNA, 25 bp, Mus musculus
cacctcttatatcgttctctgacaa

SEQ ID NO: 890294 - DNA, 25 bp, Mus musculus
cacctcttatatggttctctgacaa

SEQ ID NO: 890295 - DNA, 25 bp, Mus musculus
cacctcttccagacgctgaatcgca

SEQ ID NO: 890296 - DNA, 25 bp, Mus musculus
cacctcttccagtcgctgaatcgca

SEQ ID NO: 890297 - DNA, 25 bp, Mus musculus
cacctgaaccagatatctgtcatga

SEQ ID NO: 890298 - DNA, 25 bp, Mus musculus
cacctgaacctgatatctgtcatga

SEQ ID NO: 890299 - DNA, 25 bp, Mus musculus
cacctgaatgcacattgaggatggg

SEQ ID NO: 890300 - DNA, 25 bp, Mus musculus
cacctgaatgcagattgaggatggg

SEQ ID NO: 890301 - DNA, 25 bp, Mus musculus
cacctgacagctcctgagcagaatg

SEQ ID NO: 890302 - DNA, 25 bp, Mus musculus
cacctgacaggtcctgagcagaatg

SEQ ID NO: 890303 - DNA, 25 bp, Mus musculus
cacctgacatcccggtctgccttct

SEQ ID NO: 890304 - DNA, 25 bp, Mus musculus
cacctgacatccgggtctgccttct

SEQ ID NO: 890305 - DNA, 25 bp, Mus musculus
cacctgatctaacgagattacctgg

SEQ ID NO: 890306 - DNA, 25 bp, Mus musculus
cacctgatctaaggagattacctgg

SEQ ID NO: 890307 - DNA, 25 bp, Mus musculus
cacctgatggctgtcgttcacctgc

SEQ ID NO: 890308 - DNA, 25 bp, Mus musculus
cacctgatggctgtggttcacctgc

SEQ ID NO: 890309 - DNA, 25 bp, Mus musculus
cacctgcaagactacagagagccag

SEQ ID NO: 890310 - DNA, 25 bp, Mus musculus
cacctgcaagattctggtgctaaga

SEQ ID NO: 890311 - DNA, 25 bp, Mus musculus
cacctgcaagccccacgatgtgtgc

SEQ ID NO: 890312 - DNA, 25 bp, Mus musculus
cacctgcaaggcccacgatgtgtgc

SEQ ID NO: 890313 - DNA, 25 bp, Mus musculus
cacctgcaagtctacagagagccag

SEQ ID NO: 890314 - DNA, 25 bp, Mus musculus
cacctgcaagtttctggtgctaaga

SEQ ID NO: 890315 - DNA, 25 bp, Mus musculus
cacctgcacaagctgggtatcatct

SEQ ID NO: 890316 - DNA, 25 bp, Mus musculus
cacctgcacaaggtgggtatcatct

SEQ ID NO: 890317 - DNA, 25 bp, Mus musculus
cacctgcatgaacgtggtctacata

SEQ ID NO: 890318 - DNA, 25 bp, Mus musculus
cacctgcatgaaggtggtctacata

SEQ ID NO: 890319 - DNA, 25 bp, Mus musculus
cacctgccaaagcgaaccatgatcc

SEQ ID NO: 890320 - DNA, 25 bp, Mus musculus
cacctgccaaagggaaccatgatcc

SEQ ID NO: 890321 - DNA, 25 bp, Mus musculus
cacctgccggctgcgaccgagggcc

SEQ ID NO: 890322 - DNA, 25 bp, Mus musculus
cacctgccgggtgcgaccgagggcc

SEQ ID NO: 890323 - DNA, 25 bp, Mus musculus
cacctgcgagaggacgcctcccacc

SEQ ID NO: 890324 - DNA, 25 bp, Mus musculus
cacctgcgagaggaggcctcccacc

SEQ ID NO: 890325 - DNA, 25 bp, Mus musculus
cacctgctcactcaaccctctgcag

SEQ ID NO: 890326 - DNA, 25 bp, Mus musculus
cacctgctcactgaaccctctgcag

SEQ ID NO: 890327 - DNA, 25 bp, Mus musculus
cacctgctgtctcacttcttcaact

SEQ ID NO: 890328 - DNA, 25 bp, Mus musculus
cacctgctgtctcagttcttcaact

SEQ ID NO: 890329 - DNA, 25 bp, Mus musculus
cacctgcttgaccacgtgttcttcc

SEQ ID NO: 890330 - DNA, 25 bp, Mus musculus
cacctgcttgaccaggtgttcttcc

SEQ ID NO: 890331 - DNA, 25 bp, Mus musculus
cacctggaagccctccccaggagaa

SEQ ID NO: 890332 - DNA, 25 bp, Mus musculus
cacctggaagctgtggtgtacctgc

SEQ ID NO: 890333 - DNA, 25 bp, Mus musculus
cacctggaaggcctccccaggagaa

SEQ ID NO: 890334 - DNA, 25 bp, Mus musculus
cacctggaaggtgtggtgtacctgc

SEQ ID NO: 890335 - DNA, 25 bp, Mus musculus
cacctggacgaattccaccgaactg

SEQ ID NO: 890336 - DNA, 25 bp, Mus musculus
cacctggacgcacacgcctcctgtg

SEQ ID NO: 890337 - DNA, 25 bp, Mus musculus
cacctggacgcacaggcctcctgtg

SEQ ID NO: 890338 - DNA, 25 bp, Mus musculus
cacctggacgtattccaccgaactg

SEQ ID NO: 890339 - DNA, 25 bp, Mus musculus
cacctggagacaatacgcatggagt

SEQ ID NO: 890340 - DNA, 25 bp, Mus musculus
cacctggagacattacgcatggagt

SEQ ID NO: 890341 - DNA, 25 bp, Mus musculus
cacctggatgtcaacccggagaacc

SEQ ID NO: 890342 - DNA, 25 bp, Mus musculus
cacctggatgtcaagccggagaacc

SEQ ID NO: 890343 - DNA, 25 bp, Mus musculus
cacctggcataacgccactcagaag

SEQ ID NO: 890344 - DNA, 25 bp, Mus musculus
cacctggcataaggccactcagaag

SEQ ID NO: 890345 - DNA, 25 bp, Mus musculus
cacctggccaaacggtcattatcgt

SEQ ID NO: 890346 - DNA, 25 bp, Mus musculus
cacctggccaaacgtcagcctccaa

SEQ ID NO: 890347 - DNA, 25 bp, Mus musculus
cacctggccaaacgtcggacatcaa

SEQ ID NO: 890348 - DNA, 25 bp, Mus musculus
cacctggccaaagggtcattatcgt

SEQ ID NO: 890349 - DNA, 25 bp, Mus musculus
cacctggccaaaggtcagcctccaa

SEQ ID NO: 890350 - DNA, 25 bp, Mus musculus
cacctggccaaaggtcggacatcaa

SEQ ID NO: 890351 - DNA, 25 bp, Mus musculus
cacctggccatgtccaaagataaca

SEQ ID NO: 890352 - DNA, 25 bp, Mus musculus
cacctggccatgtcgaaagataaca

SEQ ID NO: 890353 - DNA, 25 bp, Mus musculus
cacctggctattcacaagaaggctt

SEQ ID NO: 890354 - DNA, 25 bp, Mus musculus
cacctggctattcactccacggctg

SEQ ID NO: 890355 - DNA, 25 bp, Mus musculus
cacctggctattgacaagaaggctt

SEQ ID NO: 890356 - DNA, 25 bp, Mus musculus
cacctggctattgactccacggctg

SEQ ID NO: 890357 - DNA, 25 bp, Mus musculus
cacctgggaacccatggagaaatgc

SEQ ID NO: 890358 - DNA, 25 bp, Mus musculus
cacctgggaagccatggagaaatgc

SEQ ID NO: 890359 - DNA, 25 bp, Mus musculus
cacctgggaccacgtctttgtctgg

SEQ ID NO: 890360 - DNA, 25 bp, Mus musculus
cacctgggaccacgtgttcttgtgg

SEQ ID NO: 890361 - DNA, 25 bp, Mus musculus
cacctgggaccaggtctttgtctgg

SEQ ID NO: 890362 - DNA, 25 bp, Mus musculus
cacctgggaccaggtgttcttgtgg

SEQ ID NO: 890363 - DNA, 25 bp, Mus musculus
cacctgggagaacacatacaaagga

SEQ ID NO: 890364 - DNA, 25 bp, Mus musculus
cacctgggagaacagatacaaagga

SEQ ID NO: 890365 - DNA, 25 bp, Mus musculus
cacctggtcgcatacatcatctggg

SEQ ID NO: 890366 - DNA, 25 bp, Mus musculus
cacctggtcggatacatcatctggg

SEQ ID NO: 890367 - DNA, 25 bp, Mus musculus
cacctgtccagcaagctgtgctaaa

SEQ ID NO: 890368 - DNA, 25 bp, Mus musculus
cacctgtccagctagctgtgctaaa

SEQ ID NO: 890369 - DNA, 25 bp, Mus musculus
cacctgtcgcccatattttaatatc

SEQ ID NO: 890370 - DNA, 25 bp, Mus musculus
cacctgtcgcccctgagtgcaatat

SEQ ID NO: 890371 - DNA, 25 bp, Mus musculus
cacctgtcgcccgtgagtgcaatat

SEQ ID NO: 890372 - DNA, 25 bp, Mus musculus
cacctgtcgcccttattttaatatc

SEQ ID NO: 890373 - DNA, 25 bp, Mus musculus
cacctgtgagcacgagccagaggaa

SEQ ID NO: 890374 - DNA, 25 bp, Mus musculus
cacctgtgagcaggagccagaggaa

SEQ ID NO: 890375 - DNA, 25 bp, Mus musculus
cacctgtgcagtagggacggaggca

SEQ ID NO: 890376 - DNA, 25 bp, Mus musculus
cacctgtgcagttgggacggaggca

SEQ ID NO: 890377 - DNA, 25 bp, Mus musculus
cacctgtggcatatcggtgccgggt

SEQ ID NO: 890378 - DNA, 25 bp, Mus musculus
cacctgtggcatatgggtgccgggt

SEQ ID NO: 890379 - DNA, 25 bp, Mus musculus
cacctgttacctcggcccccagatt

SEQ ID NO: 890380 - DNA, 25 bp, Mus musculus
cacctgttacctgggcccccagatt

SEQ ID NO: 890381 - DNA, 25 bp, Mus musculus
cacctgttccagaagttggcatcgc

SEQ ID NO: 890382 - DNA, 25 bp, Mus musculus
cacctgttcctgaagttggcatcgc

SEQ ID NO: 890383 - DNA, 25 bp, Mus musculus
cacctgttcttgcctcactgtcaga

SEQ ID NO: 890384 - DNA, 25 bp, Mus musculus
cacctgttcttggctcactgtcaga

SEQ ID NO: 890385 - DNA, 25 bp, Mus musculus
cacctgttttctatcgaaggcagta

SEQ ID NO: 890386 - DNA, 25 bp, Mus musculus
cacctgttttctatggaaggcagta

SEQ ID NO: 890387 - DNA, 25 bp, Mus musculus
caccttacagttaacgaagctgtgc

SEQ ID NO: 890388 - DNA, 25 bp, Mus musculus
caccttacagttaaggaagctgtgc

SEQ ID NO: 890389 - DNA, 25 bp, Mus musculus
caccttcaacagcctgggcggtctg

SEQ ID NO: 890390 - DNA, 25 bp, Mus musculus
caccttcaacaggctgggcggtctg

SEQ ID NO: 890391 - DNA, 25 bp, Mus musculus
caccttcaagtacacagatgaactc

SEQ ID NO: 890392 - DNA, 25 bp, Mus musculus
caccttcaagtacagagatgaactc

SEQ ID NO: 890393 - DNA, 25 bp, Mus musculus
caccttccacatctcgcacagcgga

SEQ ID NO: 890394 - DNA, 25 bp, Mus musculus
caccttccacatctggcacagcgga

SEQ ID NO: 890395 - DNA, 25 bp, Mus musculus
caccttccagaactctgcagcccct

SEQ ID NO: 890396 - DNA, 25 bp, Mus musculus
caccttccagactcagaactttcgt

SEQ ID NO: 890397 - DNA, 25 bp, Mus musculus
caccttccagcacttcacggagcag

SEQ ID NO: 890398 - DNA, 25 bp, Mus musculus
caccttccagcctcaaactaccatc

SEQ ID NO: 890399 - DNA, 25 bp, Mus musculus
caccttccaggacttcacggagcag

SEQ ID NO: 890400 - DNA, 25 bp, Mus musculus
caccttccaggctcaaactaccatc

SEQ ID NO: 890401 - DNA, 25 bp, Mus musculus
caccttccagtactctgcagcccct

SEQ ID NO: 890402 - DNA, 25 bp, Mus musculus
caccttccagtctcagaactttcgt

SEQ ID NO: 890403 - DNA, 25 bp, Mus musculus
caccttccagttcagtcacctgata

SEQ ID NO: 890404 - DNA, 25 bp, Mus musculus
caccttccagttccagagtcacctg

SEQ ID NO: 890405 - DNA, 25 bp, Mus musculus
caccttccagttgagtcacctgata

SEQ ID NO: 890406 - DNA, 25 bp, Mus musculus
caccttccagttgcagagtcacctg

SEQ ID NO: 890407 - DNA, 25 bp, Mus musculus
caccttccatcctaaatagtctaca

SEQ ID NO: 890408 - DNA, 25 bp, Mus musculus
caccttccatcctatatagtctaca

SEQ ID NO: 890409 - DNA, 25 bp, Mus musculus
caccttccgccactttcgtgatcct

SEQ ID NO: 890410 - DNA, 25 bp, Mus musculus
caccttccgccagtttcgtgatcct

SEQ ID NO: 890411 - DNA, 25 bp, Mus musculus
caccttctctctcttcctcctggcc

SEQ ID NO: 890412 - DNA, 25 bp, Mus musculus
caccttctctgtcttcctcctggcc

SEQ ID NO: 890413 - DNA, 25 bp, Mus musculus
caccttctgcagcaaatctcccgga

SEQ ID NO: 890414 - DNA, 25 bp, Mus musculus
caccttctgcaggaaatctcccgga

SEQ ID NO: 890415 - DNA, 25 bp, Mus musculus
caccttcttttgccgtgcccacact

SEQ ID NO: 890416 - DNA, 25 bp, Mus musculus
caccttcttttgcttctgcagtgag

SEQ ID NO: 890417 - DNA, 25 bp, Mus musculus
caccttcttttggcgtgcccacact

SEQ ID NO: 890418 - DNA, 25 bp, Mus musculus
caccttcttttggttctgcagtgag

SEQ ID NO: 890419 - DNA, 25 bp, Mus musculus
caccttgccgctcacattttggcag

SEQ ID NO: 890420 - DNA, 25 bp, Mus musculus
caccttgccgctcagattttggcag

SEQ ID NO: 890421 - DNA, 25 bp, Mus musculus
caccttgcgttaagactcctgtccc

SEQ ID NO: 890422 - DNA, 25 bp, Mus musculus
caccttgcgttatgactcctgtccc

SEQ ID NO: 890423 - DNA, 25 bp, Mus musculus
caccttggagaacataaaaatatat

SEQ ID NO: 890424 - DNA, 25 bp, Mus musculus
caccttggagaagataaaaatatat

SEQ ID NO: 890425 - DNA, 25 bp, Mus musculus
caccttgggccacattgtgtcacaa

SEQ ID NO: 890426 - DNA, 25 bp, Mus musculus
caccttgggccagattgtgtcacaa

SEQ ID NO: 890427 - DNA, 25 bp, Mus musculus
cacctttcagaacactgtggaagtc

SEQ ID NO: 890428 - DNA, 25 bp, Mus musculus
cacctttcagaacagtgtggaagtc

SEQ ID NO: 890429 - DNA, 25 bp, Mus musculus
cacctttcggtgctagcctggatgt

SEQ ID NO: 890430 - DNA, 25 bp, Mus musculus
cacctttcggtggtagcctggatgt

SEQ ID NO: 890431 - DNA, 25 bp, Mus musculus
cacctttgagctgaagtcagagtcc

SEQ ID NO: 890432 - DNA, 25 bp, Mus musculus
cacctttgaggtgaagtcagagtcc

SEQ ID NO: 890433 - DNA, 25 bp, Mus musculus
cacctttgatgacatatgtgtcaca

SEQ ID NO: 890434 - DNA, 25 bp, Mus musculus
cacctttgatgagatatgtgtcaca

SEQ ID NO: 890435 - DNA, 25 bp, Mus musculus
cacctttgcctcagtggagcagttc

SEQ ID NO: 890436 - DNA, 25 bp, Mus musculus
cacctttgcctctgtggagcagttc

SEQ ID NO: 890437 - DNA, 25 bp, Mus musculus
cacgaagcagagcctgaggagcctg

SEQ ID NO: 890438 - DNA, 25 bp, Mus musculus
cacgaagcagaggctgaggagcctg

SEQ ID NO: 890439 - DNA, 25 bp, Mus musculus
cacgacacagaactgtatatggttg

SEQ ID NO: 890440 - DNA, 25 bp, Mus musculus
cacgacacagaagtgtatatggttg

SEQ ID NO: 890441 - DNA, 25 bp, Mus musculus
cacgacattgagctgtctcttatca

SEQ ID NO: 890442 - DNA, 25 bp, Mus musculus
cacgacattgtgctgtctcttatca

SEQ ID NO: 890443 - DNA, 25 bp, Mus musculus
cacgaccgtgcgtggtatgaaggcc

SEQ ID NO: 890444 - DNA, 25 bp, Mus musculus
cacgaccgtgggtggtatgaaggcc

SEQ ID NO: 890445 - DNA, 25 bp, Mus musculus
cacgacctagctcatgggccatttt

SEQ ID NO: 890446 - DNA, 25 bp, Mus musculus
cacgacctaggtcatgggccatttt

SEQ ID NO: 890447 - DNA, 25 bp, Mus musculus
cacgaccttgcacgtaccatgcggg

SEQ ID NO: 890448 - DNA, 25 bp, Mus musculus
cacgaccttggacgtaccatgcggg

SEQ ID NO: 890449 - DNA, 25 bp, Mus musculus
cacgactctgagcaagcaggctgag

SEQ ID NO: 890450 - DNA, 25 bp, Mus musculus
cacgactctgaggaagcaggctgag

SEQ ID NO: 890451 - DNA, 25 bp, Mus musculus
cacgacttggctctgctgcgcctgc

SEQ ID NO: 890452 - DNA, 25 bp, Mus musculus
cacgacttgggtctgctgcgcctgc

SEQ ID NO: 890453 - DNA, 25 bp, Mus musculus
cacgagaaggagctcatcgaagcgt

SEQ ID NO: 890454 - DNA, 25 bp, Mus musculus
cacgagaaggagctcccaaggcggc

SEQ ID NO: 890455 - DNA, 25 bp, Mus musculus
cacgagaaggagctgatcgaagcgt

SEQ ID NO: 890456 - DNA, 25 bp, Mus musculus
cacgagaaggagctgccaaggcggc

SEQ ID NO: 890457 - DNA, 25 bp, Mus musculus
cacgagaatgagatgtttagcatgg

SEQ ID NO: 890458 - DNA, 25 bp, Mus musculus
cacgagaatgagttgtttagcatgg

SEQ ID NO: 890459 - DNA, 25 bp, Mus musculus
cacgagacagactggtcttaggcaa

SEQ ID NO: 890460 - DNA, 25 bp, Mus musculus
cacgagacagtctggtcttaggcaa

SEQ ID NO: 890461 - DNA, 25 bp, Mus musculus
cacgagatggccattgagccgctag

SEQ ID NO: 890462 - DNA, 25 bp, Mus musculus
cacgagatgggcattgagccgctag

SEQ ID NO: 890463 - DNA, 25 bp, Mus musculus
cacgagcaagaaagcaaagggagag

SEQ ID NO: 890464 - DNA, 25 bp, Mus musculus
cacgagcaagagtactgtttggcag

SEQ ID NO: 890465 - DNA, 25 bp, Mus musculus
cacgagcaagtaagcaaagggagag

SEQ ID NO: 890466 - DNA, 25 bp, Mus musculus
cacgagcaagtgtactgtttggcag

SEQ ID NO: 890467 - DNA, 25 bp, Mus musculus
cacgagcgctatatggtgtcaggta

SEQ ID NO: 890468 - DNA, 25 bp, Mus musculus
cacgagcgctatttggtgtcaggta

SEQ ID NO: 890469 - DNA, 25 bp, Mus musculus
cacgagctggagagagcaaaccaac

SEQ ID NO: 890470 - DNA, 25 bp, Mus musculus
cacgagctggagtgagcaaaccaac

SEQ ID NO: 890471 - DNA, 25 bp, Mus musculus
cacgaggaccctcacgtttgatgaa

SEQ ID NO: 890472 - DNA, 25 bp, Mus musculus
cacgaggaccctcaggtttgatgaa

SEQ ID NO: 890473 - DNA, 25 bp, Mus musculus
cacgagggcgagcctcggctattag

SEQ ID NO: 890474 - DNA, 25 bp, Mus musculus
cacgagggcgaggctcggctattag

SEQ ID NO: 890475 - DNA, 25 bp, Mus musculus
cacgagggcgcgctgtggacaaatg

SEQ ID NO: 890476 - DNA, 25 bp, Mus musculus
cacgagggcgcggtgtggacaaatg

SEQ ID NO: 890477 - DNA, 25 bp, Mus musculus
cacgagtcagcgcactgatcgagtc

SEQ ID NO: 890478 - DNA, 25 bp, Mus musculus
cacgagtcagcggactgatcgagtc

SEQ ID NO: 890479 - DNA, 25 bp, Mus musculus
cacgagtgcaggcacaccccagcct

SEQ ID NO: 890480 - DNA, 25 bp, Mus musculus
cacgagtgcagggacaccccagcct

SEQ ID NO: 890481 - DNA, 25 bp, Mus musculus
cacgagtgcctgcacgatcggaacg

SEQ ID NO: 890482 - DNA, 25 bp, Mus musculus
cacgagtgcctgcaggatcggaacg

SEQ ID NO: 890483 - DNA, 25 bp, Mus musculus
cacgatataccacaagtctacaacc

SEQ ID NO: 890484 - DNA, 25 bp, Mus musculus
cacgatataccagaagtctacaacc

SEQ ID NO: 890485 - DNA, 25 bp, Mus musculus
cacgatccagcacacaaggcaggga

SEQ ID NO: 890486 - DNA, 25 bp, Mus musculus
cacgatccagcacacgcagggagtg

SEQ ID NO: 890487 - DNA, 25 bp, Mus musculus
cacgatccagcacagaaggcaggga

SEQ ID NO: 890488 - DNA, 25 bp, Mus musculus
cacgatccagcacaggcagggagtg

SEQ ID NO: 890489 - DNA, 25 bp, Mus musculus
cacgatgtgtggaaattctctgcac

SEQ ID NO: 890490 - DNA, 25 bp, Mus musculus
cacgatgtgtggtaattctctgcac

SEQ ID NO: 890491 - DNA, 25 bp, Mus musculus
cacgattacttgctgtcccttactc

SEQ ID NO: 890492 - DNA, 25 bp, Mus musculus
cacgattacttggtgtcccttactc

SEQ ID NO: 890493 - DNA, 25 bp, Mus musculus
cacgcaccagaggtatgtgtgcaac

SEQ ID NO: 890494 - DNA, 25 bp, Mus musculus
cacgcaccagtggtatgtgtgcaac

SEQ ID NO: 890495 - DNA, 25 bp, Mus musculus
cacgcacttctcctcgtactggctc

SEQ ID NO: 890496 - DNA, 25 bp, Mus musculus
cacgcacttctcctggtactggctc

SEQ ID NO: 890497 - DNA, 25 bp, Mus musculus
cacgcagacagacgtggacagtcac

SEQ ID NO: 890498 - DNA, 25 bp, Mus musculus
cacgcagacagaggtggacagtcac

SEQ ID NO: 890499 - DNA, 25 bp, Mus musculus
cacgcagccttcaggctcagttctg

SEQ ID NO: 890500 - DNA, 25 bp, Mus musculus
cacgcagccttctggctcagttctg

SEQ ID NO: 890501 - DNA, 25 bp, Mus musculus
cacgcatcgaggcggctacccgact

SEQ ID NO: 890502 - DNA, 25 bp, Mus musculus
cacgcatcgagggggctacccgact

SEQ ID NO: 890503 - DNA, 25 bp, Mus musculus
cacgcattcatgcacaaaatctttt

SEQ ID NO: 890504 - DNA, 25 bp, Mus musculus
cacgcattcatgcagaaaatctttt

SEQ ID NO: 890505 - DNA, 25 bp, Mus musculus
cacgccacctctctcgtggaatgca

SEQ ID NO: 890506 - DNA, 25 bp, Mus musculus
cacgccacctctctggtggaatgca

SEQ ID NO: 890507 - DNA, 25 bp, Mus musculus
cacgccacttctcggcagctctgct

SEQ ID NO: 890508 - DNA, 25 bp, Mus musculus
cacgccacttgtcggcagctctgct

SEQ ID NO: 890509 - DNA, 25 bp, Mus musculus
cacgccagtgctaaagtagacttcg

SEQ ID NO: 890510 - DNA, 25 bp, Mus musculus
cacgccagtgcttaagtagacttcg

SEQ ID NO: 890511 - DNA, 25 bp, Mus musculus
cacgccatcaaaaatgaagcacaca

SEQ ID NO: 890512 - DNA, 25 bp, Mus musculus
cacgccatcaaatatgaagcacaca

SEQ ID NO: 890513 - DNA, 25 bp, Mus musculus
cacgccatgtatctttccaccggct

SEQ ID NO: 890514 - DNA, 25 bp, Mus musculus
cacgccatgtatgtttccaccggct

SEQ ID NO: 890515 - DNA, 25 bp, Mus musculus
cacgcccaacagctaccgctattac

SEQ ID NO: 890516 - DNA, 25 bp, Mus musculus
cacgcccaacaggtaccgctattac

SEQ ID NO: 890517 - DNA, 25 bp, Mus musculus
cacgcccagctccgataccgtgtca

SEQ ID NO: 890518 - DNA, 25 bp, Mus musculus
cacgcccagctcggataccgtgtca

SEQ ID NO: 890519 - DNA, 25 bp, Mus musculus
cacgccctgcagcacgtgattcagg

SEQ ID NO: 890520 - DNA, 25 bp, Mus musculus
cacgccctgcagcaggtgattcagg

SEQ ID NO: 890521 - DNA, 25 bp, Mus musculus
cacgcccttccacgtgactggttat

SEQ ID NO: 890522 - DNA, 25 bp, Mus musculus
cacgcccttccaggtgactggttat

SEQ ID NO: 890523 - DNA, 25 bp, Mus musculus
cacgccgacgcacaaagaagaagta

SEQ ID NO: 890524 - DNA, 25 bp, Mus musculus
cacgccgacgcagaaagaagaagta

SEQ ID NO: 890525 - DNA, 25 bp, Mus musculus
cacgccgtccaagacgccattgtga

SEQ ID NO: 890526 - DNA, 25 bp, Mus musculus
cacgccgtccaagaggccattgtga

SEQ ID NO: 890527 - DNA, 25 bp, Mus musculus
cacgcctgtgctggttacgctctgg

SEQ ID NO: 890528 - DNA, 25 bp, Mus musculus
cacgcctgtggtggttacgctctgg

SEQ ID NO: 890529 - DNA, 25 bp, Mus musculus
cacgcgactcaacgagggggccaac

SEQ ID NO: 890530 - DNA, 25 bp, Mus musculus
cacgcgactcaaggagggggccaac

SEQ ID NO: 890531 - DNA, 25 bp, Mus musculus
cacgcgaggaccatgtcatgttgcc

SEQ ID NO: 890532 - DNA, 25 bp, Mus musculus
cacgcgaggagcatgtcatgttgcc

SEQ ID NO: 890533 - DNA, 25 bp, Mus musculus
cacgcgaggtcttccaaagaaccaa

SEQ ID NO: 890534 - DNA, 25 bp, Mus musculus
cacgcgaggtcttccgccttcccag

SEQ ID NO: 890535 - DNA, 25 bp, Mus musculus
cacgcgaggtcttcgaaagaaccaa

SEQ ID NO: 890536 - DNA, 25 bp, Mus musculus
cacgcgaggtcttcggccttcccag

SEQ ID NO: 890537 - DNA, 25 bp, Mus musculus
cacgcgcaagccctgaggtgcgcac

SEQ ID NO: 890538 - DNA, 25 bp, Mus musculus
cacgcgcaaggcctgaggtgcgcac

SEQ ID NO: 890539 - DNA, 25 bp, Mus musculus
cacgcgccctcacatgtcacctgta

SEQ ID NO: 890540 - DNA, 25 bp, Mus musculus
cacgcgccctcactgggaagatgcc

SEQ ID NO: 890541 - DNA, 25 bp, Mus musculus
cacgcgccctcagatgtcacctgta

SEQ ID NO: 890542 - DNA, 25 bp, Mus musculus
cacgcgccctcagtgggaagatgcc

SEQ ID NO: 890543 - DNA, 25 bp, Mus musculus
cacgcgccgcggccttagaagaaat

SEQ ID NO: 890544 - DNA, 25 bp, Mus musculus
cacgcgccgcggctccatgttctac

SEQ ID NO: 890545 - DNA, 25 bp, Mus musculus
cacgcgccgcgggcttagaagaaat

SEQ ID NO: 890546 - DNA, 25 bp, Mus musculus
cacgcgccgcgggtccatgttctac

SEQ ID NO: 890547 - DNA, 25 bp, Mus musculus
cacgcggcagcctcacctgcggagg

SEQ ID NO: 890548 - DNA, 25 bp, Mus musculus
cacgcggcaggctcacctgcggagg

SEQ ID NO: 890549 - DNA, 25 bp, Mus musculus
cacgcggcatagcccttcagaagta

SEQ ID NO: 890550 - DNA, 25 bp, Mus musculus
cacgcggcataggccttcagaagta

SEQ ID NO: 890551 - DNA, 25 bp, Mus musculus
cacgctacttagccccaaccatact

SEQ ID NO: 890552 - DNA, 25 bp, Mus musculus
cacgctacttagctgatgcaagaag

SEQ ID NO: 890553 - DNA, 25 bp, Mus musculus
cacgctacttaggcccaaccatact

SEQ ID NO: 890554 - DNA, 25 bp, Mus musculus
cacgctacttaggtgatgcaagaag

SEQ ID NO: 890555 - DNA, 25 bp, Mus musculus
cacgctcaagtcaacagatatgatc

SEQ ID NO: 890556 - DNA, 25 bp, Mus musculus
cacgctcaagtcaagagatatgatc

SEQ ID NO: 890557 - DNA, 25 bp, Mus musculus
cacgctcacaggcttaagcgagatg

SEQ ID NO: 890558 - DNA, 25 bp, Mus musculus
cacgctcacagggttaagcgagatg

SEQ ID NO: 890559 - DNA, 25 bp, Mus musculus
cacgctcaccctcacgaaaggcggg

SEQ ID NO: 890560 - DNA, 25 bp, Mus musculus
cacgctcaccctcaggaaaggcggg

SEQ ID NO: 890561 - DNA, 25 bp, Mus musculus
cacgctccagcatacccccacggcc

SEQ ID NO: 890562 - DNA, 25 bp, Mus musculus
cacgctccagcatagccccacggcc

SEQ ID NO: 890563 - DNA, 25 bp, Mus musculus
cacgctgcagatatgatcatacaaa

SEQ ID NO: 890564 - DNA, 25 bp, Mus musculus
cacgctgcagttatgatcatacaaa

SEQ ID NO: 890565 - DNA, 25 bp, Mus musculus
cacgctggccagacagctgcagcac

SEQ ID NO: 890566 - DNA, 25 bp, Mus musculus
cacgctggccagctattgttagaac

SEQ ID NO: 890567 - DNA, 25 bp, Mus musculus
cacgctggccaggtattgttagaac

SEQ ID NO: 890568 - DNA, 25 bp, Mus musculus
cacgctggccagtcagctgcagcac

SEQ ID NO: 890569 - DNA, 25 bp, Mus musculus
cacgctggttcacatcacgtctaat

SEQ ID NO: 890570 - DNA, 25 bp, Mus musculus
cacgctggttcagatcacgtctaat

SEQ ID NO: 890571 - DNA, 25 bp, Mus musculus
cacgcttgccttccttgctcctgca

SEQ ID NO: 890572 - DNA, 25 bp, Mus musculus
cacgcttgccttgcttgctcctgca

SEQ ID NO: 890573 - DNA, 25 bp, Mus musculus
cacggaaccaagctggctatggcgg

SEQ ID NO: 890574 - DNA, 25 bp, Mus musculus
cacggaaccaaggtggctatggcgg

SEQ ID NO: 890575 - DNA, 25 bp, Mus musculus
cacggactgaagaccttatgttcat

SEQ ID NO: 890576 - DNA, 25 bp, Mus musculus
cacggactgaagacgttatgttcat

SEQ ID NO: 890577 - DNA, 25 bp, Mus musculus
cacggagaagagctggagtggcaga

SEQ ID NO: 890578 - DNA, 25 bp, Mus musculus
cacggagaagtgctggagtggcaga

SEQ ID NO: 890579 - DNA, 25 bp, Mus musculus
cacggagaccacagtcaaaaaagtt

SEQ ID NO: 890580 - DNA, 25 bp, Mus musculus
cacggagaccactgtcaaaaaagtt

SEQ ID NO: 890581 - DNA, 25 bp, Mus musculus
cacggagaccccaacggagagatgg

SEQ ID NO: 890582 - DNA, 25 bp, Mus musculus
cacggagaccccaagggagagatgg

SEQ ID NO: 890583 - DNA, 25 bp, Mus musculus
cacggagaggagcgagggagccatc

SEQ ID NO: 890584 - DNA, 25 bp, Mus musculus
cacggagaggagggagggagccatc

SEQ ID NO: 890585 - DNA, 25 bp, Mus musculus
cacggagattagcggagccaggtat

SEQ ID NO: 890586 - DNA, 25 bp, Mus musculus
cacggagattaggggagccaggtat

SEQ ID NO: 890587 - DNA, 25 bp, Mus musculus
cacggagcagcccaccttgggacac

SEQ ID NO: 890588 - DNA, 25 bp, Mus musculus
cacggagcaggccaccttgggacac

SEQ ID NO: 890589 - DNA, 25 bp, Mus musculus
cacggaggccagcctgtccttctac

SEQ ID NO: 890590 - DNA, 25 bp, Mus musculus
cacggaggccaggctgtccttctac

SEQ ID NO: 890591 - DNA, 25 bp, Mus musculus
cacggagtctgacggaaccttcaga

SEQ ID NO: 890592 - DNA, 25 bp, Mus musculus
cacggagtctgagggaaccttcaga

SEQ ID NO: 890593 - DNA, 25 bp, Mus musculus
cacggagtggcagacttcttgggat

SEQ ID NO: 890594 - DNA, 25 bp, Mus musculus
cacggagtgggagacttcttgggat

SEQ ID NO: 890595 - DNA, 25 bp, Mus musculus
cacggatcactgatgtggacaatgg

SEQ ID NO: 890596 - DNA, 25 bp, Mus musculus
cacggatcactgttgtggacaatgg

SEQ ID NO: 890597 - DNA, 25 bp, Mus musculus
cacggatcgcagctgcctgtcccag

SEQ ID NO: 890598 - DNA, 25 bp, Mus musculus
cacggatcgcaggtgcctgtcccag

SEQ ID NO: 890599 - DNA, 25 bp, Mus musculus
cacggatgagatggcagagcaccta

SEQ ID NO: 890600 - DNA, 25 bp, Mus musculus
cacggatgagttggcagagcaccta

SEQ ID NO: 890601 - DNA, 25 bp, Mus musculus
cacggcagaggacattaacaacatg

SEQ ID NO: 890602 - DNA, 25 bp, Mus musculus
cacggcagaggagattaacaacatg

SEQ ID NO: 890603 - DNA, 25 bp, Mus musculus
cacggcaggtaaacagtattcatga

SEQ ID NO: 890604 - DNA, 25 bp, Mus musculus
cacggcaggtaatcagtattcatga

SEQ ID NO: 890605 - DNA, 25 bp, Mus musculus
cacggcatctataatgtcacccaga

SEQ ID NO: 890606 - DNA, 25 bp, Mus musculus
cacggcatctatccggagctgaccc

SEQ ID NO: 890607 - DNA, 25 bp, Mus musculus
cacggcatctatctacgtgccctgg

SEQ ID NO: 890608 - DNA, 25 bp, Mus musculus
cacggcatctatgcggagctgaccc

SEQ ID NO: 890609 - DNA, 25 bp, Mus musculus
cacggcatctatgtacgtgccctgg

SEQ ID NO: 890610 - DNA, 25 bp, Mus musculus
cacggcatctattatgtcacccaga

SEQ ID NO: 890611 - DNA, 25 bp, Mus musculus
cacggcatgcagaggaatctggggt

SEQ ID NO: 890612 - DNA, 25 bp, Mus musculus
cacggcatgcagcgtgtgtctgcag

SEQ ID NO: 890613 - DNA, 25 bp, Mus musculus
cacggcatgcagggtgtgtctgcag

SEQ ID NO: 890614 - DNA, 25 bp, Mus musculus
cacggcatgcagtggaatctggggt

SEQ ID NO: 890615 - DNA, 25 bp, Mus musculus
cacggccaatgtcgcaactcatgaa

SEQ ID NO: 890616 - DNA, 25 bp, Mus musculus
cacggccaatgtggcaactcatgaa

SEQ ID NO: 890617 - DNA, 25 bp, Mus musculus
cacggccaggacagtatagtggaga

SEQ ID NO: 890618 - DNA, 25 bp, Mus musculus
cacggccaggactgtatagtggaga

SEQ ID NO: 890619 - DNA, 25 bp, Mus musculus
cacggccatgggctctgtgacagca

SEQ ID NO: 890620 - DNA, 25 bp, Mus musculus
cacggccatggggtctgtgacagca

SEQ ID NO: 890621 - DNA, 25 bp, Mus musculus
cacggcccctttctcatccagccag

SEQ ID NO: 890622 - DNA, 25 bp, Mus musculus
cacggcccctttctgatccagccag

SEQ ID NO: 890623 - DNA, 25 bp, Mus musculus
cacggccgcgaacaagaccccctct

SEQ ID NO: 890624 - DNA, 25 bp, Mus musculus
cacggccgcgaacatgaccccctct

SEQ ID NO: 890625 - DNA, 25 bp, Mus musculus
cacggcctgcagcagacctggtact

SEQ ID NO: 890626 - DNA, 25 bp, Mus musculus
cacggcctgcaggagacctggtact

SEQ ID NO: 890627 - DNA, 25 bp, Mus musculus
cacggctccaagcatgccaacaagg

SEQ ID NO: 890628 - DNA, 25 bp, Mus musculus
cacggctccaaggatgccaacaagg

SEQ ID NO: 890629 - DNA, 25 bp, Mus musculus
cacggctgctcacctcctgcagatt

SEQ ID NO: 890630 - DNA, 25 bp, Mus musculus
cacggctgctgacctcctgcagatt

SEQ ID NO: 890631 - DNA, 25 bp, Mus musculus
cacgggaatgaccctgactacatcg

SEQ ID NO: 890632 - DNA, 25 bp, Mus musculus
cacgggaatgacgctgactacatcg

SEQ ID NO: 890633 - DNA, 25 bp, Mus musculus
cacgggagagacctaccaggatctt

SEQ ID NO: 890634 - DNA, 25 bp, Mus musculus
cacgggagagtcctaccaggatctt

SEQ ID NO: 890635 - DNA, 25 bp, Mus musculus
cacgggctacagcttgcgttacagt

SEQ ID NO: 890636 - DNA, 25 bp, Mus musculus
cacgggctacaggttgcgttacagt

SEQ ID NO: 890637 - DNA, 25 bp, Mus musculus
cacgggctgctgcaaagggataaac

SEQ ID NO: 890638 - DNA, 25 bp, Mus musculus
cacgggctgctggaaagggataaac

SEQ ID NO: 890639 - DNA, 25 bp, Mus musculus
cacggggaagctgatctactttaca

SEQ ID NO: 890640 - DNA, 25 bp, Mus musculus
cacggggaaggtgatctactttaca

SEQ ID NO: 890641 - DNA, 25 bp, Mus musculus
cacggggctgcacgtcacagcggag

SEQ ID NO: 890642 - DNA, 25 bp, Mus musculus
cacggggctgcaggtcacagcggag

SEQ ID NO: 890643 - DNA, 25 bp, Mus musculus
cacggggtagagatccattgtaggt

SEQ ID NO: 890644 - DNA, 25 bp, Mus musculus
cacggggtagtgatccattgtaggt

SEQ ID NO: 890645 - DNA, 25 bp, Mus musculus
cacggtcatcggtaattcgcaccgg

SEQ ID NO: 890646 - DNA, 25 bp, Mus musculus
cacggtcatcggtatttcgcaccgg

SEQ ID NO: 890647 - DNA, 25 bp, Mus musculus
cacggtcattagaccacttcctgga

SEQ ID NO: 890648 - DNA, 25 bp, Mus musculus
cacggtcattagtccacttcctgga

SEQ ID NO: 890649 - DNA, 25 bp, Mus musculus
cacggtccagcatgagagtcattca

SEQ ID NO: 890650 - DNA, 25 bp, Mus musculus
cacggtccaggatgagagtcattca

SEQ ID NO: 890651 - DNA, 25 bp, Mus musculus
cacggtgaagatctggaacaacgac

SEQ ID NO: 890652 - DNA, 25 bp, Mus musculus
cacggtgaagttctggaacaacgac

SEQ ID NO: 890653 - DNA, 25 bp, Mus musculus
cacggtgctggcccagcgactctgc

SEQ ID NO: 890654 - DNA, 25 bp, Mus musculus
cacggtgctggcgcagcgactctgc

SEQ ID NO: 890655 - DNA, 25 bp, Mus musculus
cacgtacacgctttatgtcatccag

SEQ ID NO: 890656 - DNA, 25 bp, Mus musculus
cacgtacacggtttatgtcatccag

SEQ ID NO: 890657 - DNA, 25 bp, Mus musculus
cacgtaccagtgcaaagaccctaaa

SEQ ID NO: 890658 - DNA, 25 bp, Mus musculus
cacgtaccagtggaaagaccctaaa

SEQ ID NO: 890659 - DNA, 25 bp, Mus musculus
cacgtacctcagaacaagcccacca

SEQ ID NO: 890660 - DNA, 25 bp, Mus musculus
cacgtacctcagatctggctcaagg

SEQ ID NO: 890661 - DNA, 25 bp, Mus musculus
cacgtacctcagcctcatgtacagt

SEQ ID NO: 890662 - DNA, 25 bp, Mus musculus
cacgtacctcaggctcatgtacagt

SEQ ID NO: 890663 - DNA, 25 bp, Mus musculus
cacgtacctcagtacaagcccacca

SEQ ID NO: 890664 - DNA, 25 bp, Mus musculus
cacgtacctcagttctggctcaagg

SEQ ID NO: 890665 - DNA, 25 bp, Mus musculus
cacgtactcccacccttgagctgtg

SEQ ID NO: 890666 - DNA, 25 bp, Mus musculus
cacgtactcccaccgttgagctgtg

SEQ ID NO: 890667 - DNA, 25 bp, Mus musculus
cacgtatttaccccagaaacagtat

SEQ ID NO: 890668 - DNA, 25 bp, Mus musculus
cacgtatttaccgcagaaacagtat

SEQ ID NO: 890669 - DNA, 25 bp, Mus musculus
cacgtcacaacaccctggccctaat

SEQ ID NO: 890670 - DNA, 25 bp, Mus musculus
cacgtcacaacagcctggccctaat

SEQ ID NO: 890671 - DNA, 25 bp, Mus musculus
cacgtcgcacagcatggaggagtgc

SEQ ID NO: 890672 - DNA, 25 bp, Mus musculus
cacgtcgcacaggatggaggagtgc

SEQ ID NO: 890673 - DNA, 25 bp, Mus musculus
cacgtctcacgacgaccatgacttc

SEQ ID NO: 890674 - DNA, 25 bp, Mus musculus
cacgtctcacgaggaccatgacttc

SEQ ID NO: 890675 - DNA, 25 bp, Mus musculus
cacgtctctgcacaagccctcagtg

SEQ ID NO: 890676 - DNA, 25 bp, Mus musculus
cacgtctctggacaagccctcagtg

SEQ ID NO: 890677 - DNA, 25 bp, Mus musculus
cacgtctctgtgcacacagaagcca

SEQ ID NO: 890678 - DNA, 25 bp, Mus musculus
cacgtctctgtggacacagaagcca

SEQ ID NO: 890679 - DNA, 25 bp, Mus musculus
cacgtctgccagagcgaccagtacc

SEQ ID NO: 890680 - DNA, 25 bp, Mus musculus
cacgtctgccagtgcgaccagtacc

SEQ ID NO: 890681 - DNA, 25 bp, Mus musculus
cacgtgacagagggctccctgctgg

SEQ ID NO: 890682 - DNA, 25 bp, Mus musculus
cacgtgacagtgggctccctgctgg

SEQ ID NO: 890683 - DNA, 25 bp, Mus musculus
cacgtgcacgcgagaaagccaagta

SEQ ID NO: 890684 - DNA, 25 bp, Mus musculus
cacgtgcacgcgtgaaagccaagta

SEQ ID NO: 890685 - DNA, 25 bp, Mus musculus
cacgtgcaggctctgttgcatgagt

SEQ ID NO: 890686 - DNA, 25 bp, Mus musculus
cacgtgcagggtctgttgcatgagt

SEQ ID NO: 890687 - DNA, 25 bp, Mus musculus
cacgtggaacaactgctagccattg

SEQ ID NO: 890688 - DNA, 25 bp, Mus musculus
cacgtggaacaagtgctagccattg

SEQ ID NO: 890689 - DNA, 25 bp, Mus musculus
cacgtggagcccttcacgcctcctt

SEQ ID NO: 890690 - DNA, 25 bp, Mus musculus
cacgtggagcccttgacgcctcctt

SEQ ID NO: 890691 - DNA, 25 bp, Mus musculus
cacgtggcaccgcgtcccagtgccc

SEQ ID NO: 890692 - DNA, 25 bp, Mus musculus
cacgtggcaccgggtcccagtgccc

SEQ ID NO: 890693 - DNA, 25 bp, Mus musculus
cacgtgttcaagctgtttgtggcca

SEQ ID NO: 890694 - DNA, 25 bp, Mus musculus
cacgtgttcaaggtgtttgtggcca

SEQ ID NO: 890695 - DNA, 25 bp, Mus musculus
cacgttcatcgacgacctgaagaag

SEQ ID NO: 890696 - DNA, 25 bp, Mus musculus
cacgttcatcgaggacctgaagaag

SEQ ID NO: 890697 - DNA, 25 bp, Mus musculus
cacgttcttccgcctggtgtcaccg

SEQ ID NO: 890698 - DNA, 25 bp, Mus musculus
cacgttcttccggctggtgtcaccg

SEQ ID NO: 890699 - DNA, 25 bp, Mus musculus
cacgttggtctccgtgctcttagta

SEQ ID NO: 890700 - DNA, 25 bp, Mus musculus
cacgttggtctcggtgctcttagta

SEQ ID NO: 890701 - DNA, 25 bp, Mus musculus
cactaaaaactggacgcctcagctg

SEQ ID NO: 890702 - DNA, 25 bp, Mus musculus
cactaaaaactggaggcctcagctg

SEQ ID NO: 890703 - DNA, 25 bp, Mus musculus
cactaaagaacaaatgctggacata

SEQ ID NO: 890704 - DNA, 25 bp, Mus musculus
cactaaagaagaaatgctggacata

SEQ ID NO: 890705 - DNA, 25 bp, Mus musculus
cactaaagtagacactcagggtgac

SEQ ID NO: 890706 - DNA, 25 bp, Mus musculus
cactaaagtagagactcagggtgac

SEQ ID NO: 890707 - DNA, 25 bp, Mus musculus
cactaaatttttgacatgcgatgat

SEQ ID NO: 890708 - DNA, 25 bp, Mus musculus
cactaaatttttgagatgcgatgat

SEQ ID NO: 890709 - DNA, 25 bp, Mus musculus
cactaacattcacaggaaatatctg

SEQ ID NO: 890710 - DNA, 25 bp, Mus musculus
cactaacattcagaggaaatatctg

SEQ ID NO: 890711 - DNA, 25 bp, Mus musculus
cactaagcagcattcatttcatacc

SEQ ID NO: 890712 - DNA, 25 bp, Mus musculus
cactaagcaggattcatttcatacc

SEQ ID NO: 890713 - DNA, 25 bp, Mus musculus
cactacaaagctcgagtatgaacag

SEQ ID NO: 890714 - DNA, 25 bp, Mus musculus
cactacaaagctggagtatgaacag

SEQ ID NO: 890715 - DNA, 25 bp, Mus musculus
cactacaggaagagggaggtctgaa

SEQ ID NO: 890716 - DNA, 25 bp, Mus musculus
cactacaggaagtgggaggtctgaa

SEQ ID NO: 890717 - DNA, 25 bp, Mus musculus
cactacatgaagaattacaatgact

SEQ ID NO: 890718 - DNA, 25 bp, Mus musculus
cactacatgaagtattacaatgact

SEQ ID NO: 890719 - DNA, 25 bp, Mus musculus
cactaccaacaacgactcagacttg

SEQ ID NO: 890720 - DNA, 25 bp, Mus musculus
cactaccaacaaggactcagacttg

SEQ ID NO: 890721 - DNA, 25 bp, Mus musculus
cactaccaagatcacagctgcggtg

SEQ ID NO: 890722 - DNA, 25 bp, Mus musculus
cactaccaagttcacagctgcggtg

SEQ ID NO: 890723 - DNA, 25 bp, Mus musculus
cactaccagctgccctataggttgc

SEQ ID NO: 890724 - DNA, 25 bp, Mus musculus
cactaccagctgcgtaacgacattg

SEQ ID NO: 890725 - DNA, 25 bp, Mus musculus
cactaccagctggcctataggttgc

SEQ ID NO: 890726 - DNA, 25 bp, Mus musculus
cactaccagctgggtaacgacattg

SEQ ID NO: 890727 - DNA, 25 bp, Mus musculus
cactaccatgtcaacatttctgact

SEQ ID NO: 890728 - DNA, 25 bp, Mus musculus
cactaccatgtcaagatttctgact

SEQ ID NO: 890729 - DNA, 25 bp, Mus musculus
cactaccctgcctgtatcaacctct

SEQ ID NO: 890730 - DNA, 25 bp, Mus musculus
cactaccctggctgtatcaacctct

SEQ ID NO: 890731 - DNA, 25 bp, Mus musculus
cactaccgatcgcgatatcgtggcc

SEQ ID NO: 890732 - DNA, 25 bp, Mus musculus
cactaccgatcgggatatcgtggcc

SEQ ID NO: 890733 - DNA, 25 bp, Mus musculus
cactacgcagataccgtgacggtgg

SEQ ID NO: 890734 - DNA, 25 bp, Mus musculus
cactacgcagcaggattacaaccag

SEQ ID NO: 890735 - DNA, 25 bp, Mus musculus
cactacgcaggaggattacaaccag

SEQ ID NO: 890736 - DNA, 25 bp, Mus musculus
cactacgcagttaccgtgacggtgg

SEQ ID NO: 890737 - DNA, 25 bp, Mus musculus
cactacggagctgcatcctgagctc

SEQ ID NO: 890738 - DNA, 25 bp, Mus musculus
cactacggaggtgcatcctgagctc

SEQ ID NO: 890739 - DNA, 25 bp, Mus musculus
cactactacgaacgtggcataggag

SEQ ID NO: 890740 - DNA, 25 bp, Mus musculus
cactactacgaaggtggcataggag

SEQ ID NO: 890741 - DNA, 25 bp, Mus musculus
cactactcacctcgttcaaccagat

SEQ ID NO: 890742 - DNA, 25 bp, Mus musculus
cactactcacctggttcaaccagat

SEQ ID NO: 890743 - DNA, 25 bp, Mus musculus
cactactctgagaaccttcgggaac

SEQ ID NO: 890744 - DNA, 25 bp, Mus musculus
cactactctgagaagcttcgggaac

SEQ ID NO: 890745 - DNA, 25 bp, Mus musculus
cactactgattttacctctgatctc

SEQ ID NO: 890746 - DNA, 25 bp, Mus musculus
cactactgattttagctctgatctc

SEQ ID NO: 890747 - DNA, 25 bp, Mus musculus
cactactgcagacgctgaagagatc

SEQ ID NO: 890748 - DNA, 25 bp, Mus musculus
cactactgcagaggctgaagagatc

SEQ ID NO: 890749 - DNA, 25 bp, Mus musculus
cactagaccagaagtttgtctatgt

SEQ ID NO: 890750 - DNA, 25 bp, Mus musculus
cactagaccagatgtttgtctatgt

SEQ ID NO: 890751 - DNA, 25 bp, Mus musculus
cactagagttgtaaggagaacactg

SEQ ID NO: 890752 - DNA, 25 bp, Mus musculus
cactagagttgttaggagaacactg

SEQ ID NO: 890753 - DNA, 25 bp, Mus musculus
cactagatagagcagaagcattgag

SEQ ID NO: 890754 - DNA, 25 bp, Mus musculus
cactagatagtgcagaagcattgag

SEQ ID NO: 890755 - DNA, 25 bp, Mus musculus
cactagatatcaaaatcgggtcatg

SEQ ID NO: 890756 - DNA, 25 bp, Mus musculus
cactagatatcaatctgtggttctc

SEQ ID NO: 890757 - DNA, 25 bp, Mus musculus
cactagatatcataatcgggtcatg

SEQ ID NO: 890758 - DNA, 25 bp, Mus musculus
cactagatatcattctgtggttctc

SEQ ID NO: 890759 - DNA, 25 bp, Mus musculus
cactagtcggagatacagccgctgt

SEQ ID NO: 890760 - DNA, 25 bp, Mus musculus
cactagtcggagctgtatcgttact

SEQ ID NO: 890761 - DNA, 25 bp, Mus musculus
cactagtcggaggtgtatcgttact

SEQ ID NO: 890762 - DNA, 25 bp, Mus musculus
cactagtcggagttacagccgctgt

SEQ ID NO: 890763 - DNA, 25 bp, Mus musculus
cactataaagtcctaaaatatgaaa

SEQ ID NO: 890764 - DNA, 25 bp, Mus musculus
cactataaagtcgtaaaatatgaaa

SEQ ID NO: 890765 - DNA, 25 bp, Mus musculus
cactatagagcactcctaccggaaa

SEQ ID NO: 890766 - DNA, 25 bp, Mus musculus
cactatagaggactcctaccggaaa

SEQ ID NO: 890767 - DNA, 25 bp, Mus musculus
cactatatcaagactctctctttgg

SEQ ID NO: 890768 - DNA, 25 bp, Mus musculus
cactatatcaagtctctctctttgg

SEQ ID NO: 890769 - DNA, 25 bp, Mus musculus
cactatcaagaacggtgtgactgag

SEQ ID NO: 890770 - DNA, 25 bp, Mus musculus
cactatcaagaagggtgtgactgag

SEQ ID NO: 890771 - DNA, 25 bp, Mus musculus
cactatcacagacacgtgcgaccgc

SEQ ID NO: 890772 - DNA, 25 bp, Mus musculus
cactatcacagacgatctagaagca

SEQ ID NO: 890773 - DNA, 25 bp, Mus musculus
cactatcacagagacgtgcgaccgc

SEQ ID NO: 890774 - DNA, 25 bp, Mus musculus
cactatcacagaggatctagaagca

SEQ ID NO: 890775 - DNA, 25 bp, Mus musculus
cactatcgtgaacgtgcacaggatc

SEQ ID NO: 890776 - DNA, 25 bp, Mus musculus
cactatcgtgaaggtgcacaggatc

SEQ ID NO: 890777 - DNA, 25 bp, Mus musculus
cactatgactgacggaagtcaaata

SEQ ID NO: 890778 - DNA, 25 bp, Mus musculus
cactatgactgagggaagtcaaata

SEQ ID NO: 890779 - DNA, 25 bp, Mus musculus
cactatgggaaacagattctgaaaa

SEQ ID NO: 890780 - DNA, 25 bp, Mus musculus
cactatgggaaagagattctgaaaa

SEQ ID NO: 890781 - DNA, 25 bp, Mus musculus
cactatgggatcagaattgatgata

SEQ ID NO: 890782 - DNA, 25 bp, Mus musculus
cactatgggatcagtattgatgata

SEQ ID NO: 890783 - DNA, 25 bp, Mus musculus
cactatgtgcaacacggcccccttg

SEQ ID NO: 890784 - DNA, 25 bp, Mus musculus
cactatgtgcaagacggcccccttg

SEQ ID NO: 890785 - DNA, 25 bp, Mus musculus
cactattaaaagagggtgcctcaga

SEQ ID NO: 890786 - DNA, 25 bp, Mus musculus
cactattaaaagtgggtgcctcaga

SEQ ID NO: 890787 - DNA, 25 bp, Mus musculus
cactattattcccggtgtggaatat

SEQ ID NO: 890788 - DNA, 25 bp, Mus musculus
cactattattccgggtgtggaatat

SEQ ID NO: 890789 - DNA, 25 bp, Mus musculus
cactattgctaacgtgacaagcaag

SEQ ID NO: 890790 - DNA, 25 bp, Mus musculus
cactattgctaaggtgacaagcaag

SEQ ID NO: 890791 - DNA, 25 bp, Mus musculus
cactattggctgcgcaatgaatgca

SEQ ID NO: 890792 - DNA, 25 bp, Mus musculus
cactattggctgggcaatgaatgca

SEQ ID NO: 890793 - DNA, 25 bp, Mus musculus
cactattggtgacgttccaatttca

SEQ ID NO: 890794 - DNA, 25 bp, Mus musculus
cactattggtgaggttccaatttca

SEQ ID NO: 890795 - DNA, 25 bp, Mus musculus
cactcaaaagatcttcagtgagcgc

SEQ ID NO: 890796 - DNA, 25 bp, Mus musculus
cactcaaaaggacgtctgtggggct

SEQ ID NO: 890797 - DNA, 25 bp, Mus musculus
cactcaaaaggaggtctgtggggct

SEQ ID NO: 890798 - DNA, 25 bp, Mus musculus
cactcaaaagttcttcagtgagcgc

SEQ ID NO: 890799 - DNA, 25 bp, Mus musculus
cactcaaacaagcttcagagtctca

SEQ ID NO: 890800 - DNA, 25 bp, Mus musculus
cactcaaacaaggttcagagtctca

SEQ ID NO: 890801 - DNA, 25 bp, Mus musculus
cactcaaagcaacccaaagccacgg

SEQ ID NO: 890802 - DNA, 25 bp, Mus musculus
cactcaaagcaagccaaagccacgg

SEQ ID NO: 890803 - DNA, 25 bp, Mus musculus
cactcaagagcactgggtaaggttg

SEQ ID NO: 890804 - DNA, 25 bp, Mus musculus
cactcaagagcagtgggtaaggttg

SEQ ID NO: 890805 - DNA, 25 bp, Mus musculus
cactcaagtgaacgtaattgcagcc

SEQ ID NO: 890806 - DNA, 25 bp, Mus musculus
cactcaagtgaaggtaattgcagcc

SEQ ID NO: 890807 - DNA, 25 bp, Mus musculus
cactcacagaaacgtgtccacccag

SEQ ID NO: 890808 - DNA, 25 bp, Mus musculus
cactcacagaaaggtgtccacccag

SEQ ID NO: 890809 - DNA, 25 bp, Mus musculus
cactcaccctcacgctctgagtcag

SEQ ID NO: 890810 - DNA, 25 bp, Mus musculus
cactcaccctcaggctctgagtcag

SEQ ID NO: 890811 - DNA, 25 bp, Mus musculus
cactcactagagggaacaccatact

SEQ ID NO: 890812 - DNA, 25 bp, Mus musculus
cactcactagtgggaacaccatact

SEQ ID NO: 890813 - DNA, 25 bp, Mus musculus
cactcagagacacgcctcaggatat

SEQ ID NO: 890814 - DNA, 25 bp, Mus musculus
cactcagagacaggcctcaggatat

SEQ ID NO: 890815 - DNA, 25 bp, Mus musculus
cactcagcacagagcgagggaagac

SEQ ID NO: 890816 - DNA, 25 bp, Mus musculus
cactcagcacagtgcgagggaagac

SEQ ID NO: 890817 - DNA, 25 bp, Mus musculus
cactcaggagaagccctcgaagggt

SEQ ID NO: 890818 - DNA, 25 bp, Mus musculus
cactcaggagcttctgacgggaaca

SEQ ID NO: 890819 - DNA, 25 bp, Mus musculus
cactcaggaggttctgacgggaaca

SEQ ID NO: 890820 - DNA, 25 bp, Mus musculus
cactcaggagtagccctcgaagggt

SEQ ID NO: 890821 - DNA, 25 bp, Mus musculus
cactcaggccatcgtccagagaaat

SEQ ID NO: 890822 - DNA, 25 bp, Mus musculus
cactcaggccatggtccagagaaat

SEQ ID NO: 890823 - DNA, 25 bp, Mus musculus
cactcatcaagcatcgaggaagggg

SEQ ID NO: 890824 - DNA, 25 bp, Mus musculus
cactcatcaagcatggaggaagggg

SEQ ID NO: 890825 - DNA, 25 bp, Mus musculus
cactcatgcaggatgctgatgcccc

SEQ ID NO: 890826 - DNA, 25 bp, Mus musculus
cactcatgcaggttgctgatgcccc

SEQ ID NO: 890827 - DNA, 25 bp, Mus musculus
cactccaagagaaacatctcctggg

SEQ ID NO: 890828 - DNA, 25 bp, Mus musculus
cactccaagagaaagatctcctggg

SEQ ID NO: 890829 - DNA, 25 bp, Mus musculus
cactccacacgacaggctcacaata

SEQ ID NO: 890830 - DNA, 25 bp, Mus musculus
cactccacacgacgagccagatgtt

SEQ ID NO: 890831 - DNA, 25 bp, Mus musculus
cactccacacgagaggctcacaata

SEQ ID NO: 890832 - DNA, 25 bp, Mus musculus
cactccacacgaggagccagatgtt

SEQ ID NO: 890833 - DNA, 25 bp, Mus musculus
cactccagaaagtggagtggcctta

SEQ ID NO: 890834 - DNA, 25 bp, Mus musculus
cactccagaatgtggagtggcctta

SEQ ID NO: 890835 - DNA, 25 bp, Mus musculus
cactccagcccacaattaaccctga

SEQ ID NO: 890836 - DNA, 25 bp, Mus musculus
cactccagcccacatggaggatgag

SEQ ID NO: 890837 - DNA, 25 bp, Mus musculus
cactccagcccaccagacaggagga

SEQ ID NO: 890838 - DNA, 25 bp, Mus musculus
cactccagcccacctggagatggag

SEQ ID NO: 890839 - DNA, 25 bp, Mus musculus
cactccagcccagaattaaccctga

SEQ ID NO: 890840 - DNA, 25 bp, Mus musculus
cactccagcccagatggaggatgag

SEQ ID NO: 890841 - DNA, 25 bp, Mus musculus
cactccagcccagcagacaggagga

SEQ ID NO: 890842 - DNA, 25 bp, Mus musculus
cactccagcccagctggagatggag

SEQ ID NO: 890843 - DNA, 25 bp, Mus musculus
cactccagtaaacactccttgttgc

SEQ ID NO: 890844 - DNA, 25 bp, Mus musculus
cactccagtaaagactccttgttgc

SEQ ID NO: 890845 - DNA, 25 bp, Mus musculus
cactccagtccaccaatcccaggat

SEQ ID NO: 890846 - DNA, 25 bp, Mus musculus
cactccagtccagcaatcccaggat

SEQ ID NO: 890847 - DNA, 25 bp, Mus musculus
cactcccacaagagcctggcagaca

SEQ ID NO: 890848 - DNA, 25 bp, Mus musculus
cactcccacaagtgcctggcagaca

SEQ ID NO: 890849 - DNA, 25 bp, Mus musculus
cactccccagatatacaaaaagtat

SEQ ID NO: 890850 - DNA, 25 bp, Mus musculus
cactccccagccgtgggaatggtgt

SEQ ID NO: 890851 - DNA, 25 bp, Mus musculus
cactccccaggcgtgggaatggtgt

SEQ ID NO: 890852 - DNA, 25 bp, Mus musculus
cactccccagttatacaaaaagtat

SEQ ID NO: 890853 - DNA, 25 bp, Mus musculus
cactccctctggctctctcaaaaga

SEQ ID NO: 890854 - DNA, 25 bp, Mus musculus
cactccctctgggtctctcaaaaga

SEQ ID NO: 890855 - DNA, 25 bp, Mus musculus
cactcctctgcatcccagagtgctt

SEQ ID NO: 890856 - DNA, 25 bp, Mus musculus
cactcctctggatcccagagtgctt

SEQ ID NO: 890857 - DNA, 25 bp, Mus musculus
cactcctgactacgccccagatcct

SEQ ID NO: 890858 - DNA, 25 bp, Mus musculus
cactcctgactaggccccagatcct

SEQ ID NO: 890859 - DNA, 25 bp, Mus musculus
cactcctgtttgaacggatcgcccg

SEQ ID NO: 890860 - DNA, 25 bp, Mus musculus
cactcctgtttgaagggatcgcccg

SEQ ID NO: 890861 - DNA, 25 bp, Mus musculus
cactccttccagcatcccctgccgt

SEQ ID NO: 890862 - DNA, 25 bp, Mus musculus
cactccttccaggatcccctgccgt

SEQ ID NO: 890863 - DNA, 25 bp, Mus musculus
cactcgagacggcccattgctcctg

SEQ ID NO: 890864 - DNA, 25 bp, Mus musculus
cactcgagacgggccattgctcctg

SEQ ID NO: 890865 - DNA, 25 bp, Mus musculus
cactcgcactacctatgtgacatca

SEQ ID NO: 890866 - DNA, 25 bp, Mus musculus
cactcgcactacgtatgtgacatca

SEQ ID NO: 890867 - DNA, 25 bp, Mus musculus
cactcggaagcattcctttcacaag

SEQ ID NO: 890868 - DNA, 25 bp, Mus musculus
cactcggaaggattcctttcacaag

SEQ ID NO: 890869 - DNA, 25 bp, Mus musculus
cactcggctgcacatcgcaacgagc

SEQ ID NO: 890870 - DNA, 25 bp, Mus musculus
cactcggctgcagatcgcaacgagc

SEQ ID NO: 890871 - DNA, 25 bp, Mus musculus
cactcggctttgaaaagagctgtcg

SEQ ID NO: 890872 - DNA, 25 bp, Mus musculus
cactcggctttgtaaagagctgtcg

SEQ ID NO: 890873 - DNA, 25 bp, Mus musculus
cactcggtgcaacaaagctgtagta

SEQ ID NO: 890874 - DNA, 25 bp, Mus musculus
cactcggtgcaaccagaaagctgta

SEQ ID NO: 890875 - DNA, 25 bp, Mus musculus
cactcggtgcaagaaagctgtagta

SEQ ID NO: 890876 - DNA, 25 bp, Mus musculus
cactcggtgcaagcagaaagctgta

SEQ ID NO: 890877 - DNA, 25 bp, Mus musculus
cactctacagctgagctccacctga

SEQ ID NO: 890878 - DNA, 25 bp, Mus musculus
cactctacaggcaacgtgagctcca

SEQ ID NO: 890879 - DNA, 25 bp, Mus musculus
cactctacaggcaaggtgagctcca

SEQ ID NO: 890880 - DNA, 25 bp, Mus musculus
cactctacaggtgagctccacctga

SEQ ID NO: 890881 - DNA, 25 bp, Mus musculus
cactctactgagggaagtgccacaa

SEQ ID NO: 890882 - DNA, 25 bp, Mus musculus
cactctactgtgggaagtgccacaa

SEQ ID NO: 890883 - DNA, 25 bp, Mus musculus
cactctagcactgttccgaatgcca

SEQ ID NO: 890884 - DNA, 25 bp, Mus musculus
cactctagcagtgttccgaatgcca

SEQ ID NO: 890885 - DNA, 25 bp, Mus musculus
cactctcaggttttcgctaccggct

SEQ ID NO: 890886 - DNA, 25 bp, Mus musculus
cactctcaggttttggctaccggct

SEQ ID NO: 890887 - DNA, 25 bp, Mus musculus
cactctcagtgctgcgttttcagag

SEQ ID NO: 890888 - DNA, 25 bp, Mus musculus
cactctcagtgctgggttttcagag

SEQ ID NO: 890889 - DNA, 25 bp, Mus musculus
cactctccagagcttggggcgatca

SEQ ID NO: 890890 - DNA, 25 bp, Mus musculus
cactctccagaggttggggcgatca

SEQ ID NO: 890891 - DNA, 25 bp, Mus musculus
cactctcccaaagacagtccctcca

SEQ ID NO: 890892 - DNA, 25 bp, Mus musculus
cactctcccaaagagagtccctcca

SEQ ID NO: 890893 - DNA, 25 bp, Mus musculus
cactctccgaatctaaatcacccag

SEQ ID NO: 890894 - DNA, 25 bp, Mus musculus
cactctccgaatgtaaatcacccag

SEQ ID NO: 890895 - DNA, 25 bp, Mus musculus
cactctcctgaacttccaggtcctg

SEQ ID NO: 890896 - DNA, 25 bp, Mus musculus
cactctcctgcgctgcaactggacg

SEQ ID NO: 890897 - DNA, 25 bp, Mus musculus
cactctcctgctcctgagtcagaaa

SEQ ID NO: 890898 - DNA, 25 bp, Mus musculus
cactctcctgggctgcaactggacg

SEQ ID NO: 890899 - DNA, 25 bp, Mus musculus
cactctcctggtcctgagtcagaaa

SEQ ID NO: 890900 - DNA, 25 bp, Mus musculus
cactctcctgtacttccaggtcctg

SEQ ID NO: 890901 - DNA, 25 bp, Mus musculus
cactctcgagcaaatcatgaaggac

SEQ ID NO: 890902 - DNA, 25 bp, Mus musculus
cactctcgaggaaatcatgaaggac

SEQ ID NO: 890903 - DNA, 25 bp, Mus musculus
cactctctcatgcgctcaataaact

SEQ ID NO: 890904 - DNA, 25 bp, Mus musculus
cactctctcatgggctcaataaact

SEQ ID NO: 890905 - DNA, 25 bp, Mus musculus
cactctgaacttaacatctctgaaa

SEQ ID NO: 890906 - DNA, 25 bp, Mus musculus
cactctgaactttacatctctgaaa

SEQ ID NO: 890907 - DNA, 25 bp, Mus musculus
cactctgactctgaccccgttggta

SEQ ID NO: 890908 - DNA, 25 bp, Mus musculus
cactctgactctgagcccgttggta

SEQ ID NO: 890909 - DNA, 25 bp, Mus musculus
cactctgaggatcctggccatgagg

SEQ ID NO: 890910 - DNA, 25 bp, Mus musculus
cactctgaggttcctggccatgagg

SEQ ID NO: 890911 - DNA, 25 bp, Mus musculus
cactctgatgctactggaaatctag

SEQ ID NO: 890912 - DNA, 25 bp, Mus musculus
cactctgatggtactggaaatctag

SEQ ID NO: 890913 - DNA, 25 bp, Mus musculus
cactctgcagatcagtcaaagagta

SEQ ID NO: 890914 - DNA, 25 bp, Mus musculus
cactctgcagcgaacatcatgggtg

SEQ ID NO: 890915 - DNA, 25 bp, Mus musculus
cactctgcagggaacatcatgggtg

SEQ ID NO: 890916 - DNA, 25 bp, Mus musculus
cactctgcagttcagtcaaagagta

SEQ ID NO: 890917 - DNA, 25 bp, Mus musculus
cactctgccagcaacgtgtagctac

SEQ ID NO: 890918 - DNA, 25 bp, Mus musculus
cactctgccagcaaggtgtagctac

SEQ ID NO: 890919 - DNA, 25 bp, Mus musculus
cactctgcgaagcgaaatgctcata

SEQ ID NO: 890920 - DNA, 25 bp, Mus musculus
cactctgcgaagggaaatgctcata

SEQ ID NO: 890921 - DNA, 25 bp, Mus musculus
cactctgcgtgcagttccggaattg

SEQ ID NO: 890922 - DNA, 25 bp, Mus musculus
cactctgcgtgctgttccggaattg

SEQ ID NO: 890923 - DNA, 25 bp, Mus musculus
cactctggaggacgtgttcctatat

SEQ ID NO: 890924 - DNA, 25 bp, Mus musculus
cactctggaggaggtgttcctatat

SEQ ID NO: 890925 - DNA, 25 bp, Mus musculus
cactctgtcaagccccgagaccaga

SEQ ID NO: 890926 - DNA, 25 bp, Mus musculus
cactctgtcaaggcccgagaccaga

SEQ ID NO: 890927 - DNA, 25 bp, Mus musculus
cactctgtcgcacattggaagaatt

SEQ ID NO: 890928 - DNA, 25 bp, Mus musculus
cactctgtcgcagattggaagaatt

SEQ ID NO: 890929 - DNA, 25 bp, Mus musculus
cactctgtctgttacaagaaatgga

SEQ ID NO: 890930 - DNA, 25 bp, Mus musculus
cactctgtctgttagaagaaatgga

SEQ ID NO: 890931 - DNA, 25 bp, Mus musculus
cactctgttcagagaacctaacact

SEQ ID NO: 890932 - DNA, 25 bp, Mus musculus
cactctgttcagtgaacctaacact

SEQ ID NO: 890933 - DNA, 25 bp, Mus musculus
cactcttactcacaggaagaaaagt

SEQ ID NO: 890934 - DNA, 25 bp, Mus musculus
cactcttactcacgaagaaaagtat

SEQ ID NO: 890935 - DNA, 25 bp, Mus musculus
cactcttactcagaggaagaaaagt

SEQ ID NO: 890936 - DNA, 25 bp, Mus musculus
cactcttactcaggaagaaaagtat

SEQ ID NO: 890937 - DNA, 25 bp, Mus musculus
cactcttcagagggcccgggatgaa

SEQ ID NO: 890938 - DNA, 25 bp, Mus musculus
cactcttcagtgggcccgggatgaa

SEQ ID NO: 890939 - DNA, 25 bp, Mus musculus
cactgaaaaccacatttcacatgga

SEQ ID NO: 890940 - DNA, 25 bp, Mus musculus
cactgaaaacgacatttcacatgga

SEQ ID NO: 890941 - DNA, 25 bp, Mus musculus
cactgaaaagcgccatggctactta

SEQ ID NO: 890942 - DNA, 25 bp, Mus musculus
cactgaaaagggccatggctactta

SEQ ID NO: 890943 - DNA, 25 bp, Mus musculus
cactgaacagcttgctccaggacct

SEQ ID NO: 890944 - DNA, 25 bp, Mus musculus
cactgaacaggttgctccaggacct

SEQ ID NO: 890945 - DNA, 25 bp, Mus musculus
cactgaagcctgtgacagcggagcc

SEQ ID NO: 890946 - DNA, 25 bp, Mus musculus
cactgaagcctgtgactgcagcgga

SEQ ID NO: 890947 - DNA, 25 bp, Mus musculus
cactgaagcctgtgtcagcggagcc

SEQ ID NO: 890948 - DNA, 25 bp, Mus musculus
cactgaagcctgtgtctgcagcgga

SEQ ID NO: 890949 - DNA, 25 bp, Mus musculus
cactgacatctgccccgtgggcgtc

SEQ ID NO: 890950 - DNA, 25 bp, Mus musculus
cactgacatctggcccgtgggcgtc

SEQ ID NO: 890951 - DNA, 25 bp, Mus musculus
cactgaccctcacatagtgtttcta

SEQ ID NO: 890952 - DNA, 25 bp, Mus musculus
cactgaccctcagatagtgtttcta

SEQ ID NO: 890953 - DNA, 25 bp, Mus musculus
cactgacgtgagcaccccccagccc

SEQ ID NO: 890954 - DNA, 25 bp, Mus musculus
cactgacgtgaggaccccccagccc

SEQ ID NO: 890955 - DNA, 25 bp, Mus musculus
cactgactttgaccacaggatcccc

SEQ ID NO: 890956 - DNA, 25 bp, Mus musculus
cactgactttgagcacaggatcccc

SEQ ID NO: 890957 - DNA, 25 bp, Mus musculus
cactgagccaacatcgtcgtgaaaa

SEQ ID NO: 890958 - DNA, 25 bp, Mus musculus
cactgagccaacatggtcgtgaaaa

SEQ ID NO: 890959 - DNA, 25 bp, Mus musculus
cactgaggagaacgtgcctttcatt

SEQ ID NO: 890960 - DNA, 25 bp, Mus musculus
cactgaggagaaggtgcctttcatt

SEQ ID NO: 890961 - DNA, 25 bp, Mus musculus
cactgagggacactaccttctgaat

SEQ ID NO: 890962 - DNA, 25 bp, Mus musculus
cactgagggacagtaccttctgaat

SEQ ID NO: 890963 - DNA, 25 bp, Mus musculus
cactgatatcagcaggagccatggg

SEQ ID NO: 890964 - DNA, 25 bp, Mus musculus
cactgatatcaggaggagccatggg

SEQ ID NO: 890965 - DNA, 25 bp, Mus musculus
cactgatcagcaactgaaacatttg

SEQ ID NO: 890966 - DNA, 25 bp, Mus musculus
cactgatcaggaactgaaacatttg

SEQ ID NO: 890967 - DNA, 25 bp, Mus musculus
cactgatccccacacgagaaatgct

SEQ ID NO: 890968 - DNA, 25 bp, Mus musculus
cactgatccccacacgtgatggaca

SEQ ID NO: 890969 - DNA, 25 bp, Mus musculus
cactgatccccacaggagaaatgct

SEQ ID NO: 890970 - DNA, 25 bp, Mus musculus
cactgatccccacaggtgatggaca

SEQ ID NO: 890971 - DNA, 25 bp, Mus musculus
cactgatcgaagagctaatggaggt

SEQ ID NO: 890972 - DNA, 25 bp, Mus musculus
cactgatcgatgagctaatggaggt

SEQ ID NO: 890973 - DNA, 25 bp, Mus musculus
cactgatcggcaccggggagatctg

SEQ ID NO: 890974 - DNA, 25 bp, Mus musculus
cactgatcgggaccggggagatctg

SEQ ID NO: 890975 - DNA, 25 bp, Mus musculus
cactgatgagagaggtcctccgggt

SEQ ID NO: 890976 - DNA, 25 bp, Mus musculus
cactgatgagtgaggtcctccgggt

SEQ ID NO: 890977 - DNA, 25 bp, Mus musculus
cactgatgcaaacttccaggtgttc

SEQ ID NO: 890978 - DNA, 25 bp, Mus musculus
cactgatgcaaagttccaggtgttc

SEQ ID NO: 890979 - DNA, 25 bp, Mus musculus
cactgcaaaaagcacaactgcccca

SEQ ID NO: 890980 - DNA, 25 bp, Mus musculus
cactgcaaaaaggacaactgcccca

SEQ ID NO: 890981 - DNA, 25 bp, Mus musculus
cactgcaaagctctcatcctgggca

SEQ ID NO: 890982 - DNA, 25 bp, Mus musculus
cactgcaaagctctgatcctgggca

SEQ ID NO: 890983 - DNA, 25 bp, Mus musculus
cactgcaacaagctgtcagctgatg

SEQ ID NO: 890984 - DNA, 25 bp, Mus musculus
cactgcaacaaggtgtcagctgatg

SEQ ID NO: 890985 - DNA, 25 bp, Mus musculus
cactgcaagaaccagcactgcggcg

SEQ ID NO: 890986 - DNA, 25 bp, Mus musculus
cactgcaagatccagcactgcggcg

SEQ ID NO: 890987 - DNA, 25 bp, Mus musculus
cactgcaatgtagacgcagtcagag

SEQ ID NO: 890988 - DNA, 25 bp, Mus musculus
cactgcaatgtagaggcagtcagag

SEQ ID NO: 890989 - DNA, 25 bp, Mus musculus
cactgcagacagaccctgctgcagt

SEQ ID NO: 890990 - DNA, 25 bp, Mus musculus
cactgcagacagtccctgctgcagt

SEQ ID NO: 890991 - DNA, 25 bp, Mus musculus
cactgcagagacaggtacttggact

SEQ ID NO: 890992 - DNA, 25 bp, Mus musculus
cactgcagagccattgcccgaagaa

SEQ ID NO: 890993 - DNA, 25 bp, Mus musculus
cactgcagaggcattgcccgaagaa

SEQ ID NO: 890994 - DNA, 25 bp, Mus musculus
cactgcagagtcaggtacttggact

SEQ ID NO: 890995 - DNA, 25 bp, Mus musculus
cactgcagcgacggctccgggtgcg

SEQ ID NO: 890996 - DNA, 25 bp, Mus musculus
cactgcagcgctgctgtggctggaa

SEQ ID NO: 890997 - DNA, 25 bp, Mus musculus
cactgcagcggtgctgtggctggaa

SEQ ID NO: 890998 - DNA, 25 bp, Mus musculus
cactgcagcgtcggctccgggtgcg

SEQ ID NO: 890999 - DNA, 25 bp, Mus musculus
cactgcaggacacgaggattacaac

SEQ ID NO: 891000 - DNA, 25 bp, Mus musculus
cactgcaggacaggaggattacaac

SEQ ID NO: 891001 - DNA, 25 bp, Mus musculus
cactgcagtgatatggacgagtgca

SEQ ID NO: 891002 - DNA, 25 bp, Mus musculus
cactgcagtgttatggacgagtgca

SEQ ID NO: 891003 - DNA, 25 bp, Mus musculus
cactgcatccagctctgttcctaac

SEQ ID NO: 891004 - DNA, 25 bp, Mus musculus
cactgcatccaggtctgttcctaac

SEQ ID NO: 891005 - DNA, 25 bp, Mus musculus
cactgccaacagatctacacacaat

SEQ ID NO: 891006 - DNA, 25 bp, Mus musculus
cactgccaacagcgtgcatcgcttt

SEQ ID NO: 891007 - DNA, 25 bp, Mus musculus
cactgccaacagggtgcatcgcttt

SEQ ID NO: 891008 - DNA, 25 bp, Mus musculus
cactgccaacagttctacacacaat

SEQ ID NO: 891009 - DNA, 25 bp, Mus musculus
cactgccaagaccactgaggtctgg

SEQ ID NO: 891010 - DNA, 25 bp, Mus musculus
cactgccaagaccagtgaggtctgg

SEQ ID NO: 891011 - DNA, 25 bp, Mus musculus
cactgccaagcccaccacatcaacc

SEQ ID NO: 891012 - DNA, 25 bp, Mus musculus
cactgccaagcggacaatgacggcc

SEQ ID NO: 891013 - DNA, 25 bp, Mus musculus
cactgccaagctgaaagcagccatt

SEQ ID NO: 891014 - DNA, 25 bp, Mus musculus
cactgccaagctggagcctggttct

SEQ ID NO: 891015 - DNA, 25 bp, Mus musculus
cactgccaaggccaccacatcaacc

SEQ ID NO: 891016 - DNA, 25 bp, Mus musculus
cactgccaaggggacaatgacggcc

SEQ ID NO: 891017 - DNA, 25 bp, Mus musculus
cactgccaaggtgaaagcagccatt

SEQ ID NO: 891018 - DNA, 25 bp, Mus musculus
cactgccaaggtggagcctggttct

SEQ ID NO: 891019 - DNA, 25 bp, Mus musculus
cactgccaccgcacacgaagttggg

SEQ ID NO: 891020 - DNA, 25 bp, Mus musculus
cactgccaccgccttcacattctct

SEQ ID NO: 891021 - DNA, 25 bp, Mus musculus
cactgccaccgcgttcacattctct

SEQ ID NO: 891022 - DNA, 25 bp, Mus musculus
cactgccaccgctcacgaagttggg

SEQ ID NO: 891023 - DNA, 25 bp, Mus musculus
cactgccagcagcttggtgtcagcc

SEQ ID NO: 891024 - DNA, 25 bp, Mus musculus
cactgccagcaggttggtgtcagcc

SEQ ID NO: 891025 - DNA, 25 bp, Mus musculus
cactgccaggatatcaacgaatgtg

SEQ ID NO: 891026 - DNA, 25 bp, Mus musculus
cactgccaggttatcaacgaatgtg

SEQ ID NO: 891027 - DNA, 25 bp, Mus musculus
cactgcccaaagacaccagaggacc

SEQ ID NO: 891028 - DNA, 25 bp, Mus musculus
cactgcccaaagtcaccagaggacc

SEQ ID NO: 891029 - DNA, 25 bp, Mus musculus
cactgcccagcaagggaagatttcg

SEQ ID NO: 891030 - DNA, 25 bp, Mus musculus
cactgcccaggaagggaagatttcg

SEQ ID NO: 891031 - DNA, 25 bp, Mus musculus
cactgccgggagatggctcagcggc

SEQ ID NO: 891032 - DNA, 25 bp, Mus musculus
cactgccgggagttggctcagcggc

SEQ ID NO: 891033 - DNA, 25 bp, Mus musculus
cactgcgccacacgaaagcactgcc

SEQ ID NO: 891034 - DNA, 25 bp, Mus musculus
cactgcgccacaggaaagcactgcc

SEQ ID NO: 891035 - DNA, 25 bp, Mus musculus
cactgcgctaccctgtgaagccaga

SEQ ID NO: 891036 - DNA, 25 bp, Mus musculus
cactgcgctagcctgtgaagccaga

SEQ ID NO: 891037 - DNA, 25 bp, Mus musculus
cactgcgctattggcccttctatgt

SEQ ID NO: 891038 - DNA, 25 bp, Mus musculus
cactgcgctattgggccttctatgt

SEQ ID NO: 891039 - DNA, 25 bp, Mus musculus
cactgcggagacgtggatgaatgta

SEQ ID NO: 891040 - DNA, 25 bp, Mus musculus
cactgcggagtcgtggatgaatgta

SEQ ID NO: 891041 - DNA, 25 bp, Mus musculus
cactgcgtccaccaagaacgccagc

SEQ ID NO: 891042 - DNA, 25 bp, Mus musculus
cactgcgtccaccatgaacgccagc

SEQ ID NO: 891043 - DNA, 25 bp, Mus musculus
cactgctaatgacactcagtccgct

SEQ ID NO: 891044 - DNA, 25 bp, Mus musculus
cactgctaatgagactcagtccgct

SEQ ID NO: 891045 - DNA, 25 bp, Mus musculus
cactgctagtgcaacaacttttaca

SEQ ID NO: 891046 - DNA, 25 bp, Mus musculus
cactgctagtgcaagaacttttaca

SEQ ID NO: 891047 - DNA, 25 bp, Mus musculus
cactgctcagagccaccagaggacc

SEQ ID NO: 891048 - DNA, 25 bp, Mus musculus
cactgctcagaggcaccagaggacc

SEQ ID NO: 891049 - DNA, 25 bp, Mus musculus
cactgctcattgcacgccagattaa

SEQ ID NO: 891050 - DNA, 25 bp, Mus musculus
cactgctcattgcaggccagattaa

SEQ ID NO: 891051 - DNA, 25 bp, Mus musculus
cactgctctgcctcgacttcggatg

SEQ ID NO: 891052 - DNA, 25 bp, Mus musculus
cactgctctggctcgacttcggatg

SEQ ID NO: 891053 - DNA, 25 bp, Mus musculus
cactgctctgttgtcacttcctgat

SEQ ID NO: 891054 - DNA, 25 bp, Mus musculus
cactgctctgttgtgacttcctgat

SEQ ID NO: 891055 - DNA, 25 bp, Mus musculus
cactgctgaaagctactaatgcatc

SEQ ID NO: 891056 - DNA, 25 bp, Mus musculus
cactgctgaaaggtactaatgcatc

SEQ ID NO: 891057 - DNA, 25 bp, Mus musculus
cactgctgagctcatatctcagcaa

SEQ ID NO: 891058 - DNA, 25 bp, Mus musculus
cactgctgaggtcatatctcagcaa

SEQ ID NO: 891059 - DNA, 25 bp, Mus musculus
cactgctgcgctcacaccctccaaa

SEQ ID NO: 891060 - DNA, 25 bp, Mus musculus
cactgctgcgctcagaccctccaaa

SEQ ID NO: 891061 - DNA, 25 bp, Mus musculus
cactgctgcttaaacgacttggact

SEQ ID NO: 891062 - DNA, 25 bp, Mus musculus
cactgctgcttaaaggacttggact

SEQ ID NO: 891063 - DNA, 25 bp, Mus musculus
cactgctggtcacctctgcaatctg

SEQ ID NO: 891064 - DNA, 25 bp, Mus musculus
cactgctggtcacgcagagttcacg

SEQ ID NO: 891065 - DNA, 25 bp, Mus musculus
cactgctggtcagctctgcaatctg

SEQ ID NO: 891066 - DNA, 25 bp, Mus musculus
cactgctggtcaggcagagttcacg

SEQ ID NO: 891067 - DNA, 25 bp, Mus musculus
cactgctttgcctgtaccccagtag

SEQ ID NO: 891068 - DNA, 25 bp, Mus musculus
cactgctttggctgtaccccagtag

SEQ ID NO: 891069 - DNA, 25 bp, Mus musculus
cactggaaggtccacagaaggcaag

SEQ ID NO: 891070 - DNA, 25 bp, Mus musculus
cactggaaggtccacgacctcagac

SEQ ID NO: 891071 - DNA, 25 bp, Mus musculus
cactggaaggtccagagaaggcaag

SEQ ID NO: 891072 - DNA, 25 bp, Mus musculus
cactggaaggtccaggacctcagac

SEQ ID NO: 891073 - DNA, 25 bp, Mus musculus
cactggacagagctcttacagaaca

SEQ ID NO: 891074 - DNA, 25 bp, Mus musculus
cactggacagagctgttacagaaca

SEQ ID NO: 891075 - DNA, 25 bp, Mus musculus
cactggacgatgaccccagcgcagc

SEQ ID NO: 891076 - DNA, 25 bp, Mus musculus
cactggacgatgtccccagcgcagc

SEQ ID NO: 891077 - DNA, 25 bp, Mus musculus
cactggagaacaagtggccatgcgc

SEQ ID NO: 891078 - DNA, 25 bp, Mus musculus
cactggagaagaagtggccatgcgc

SEQ ID NO: 891079 - DNA, 25 bp, Mus musculus
cactggagagaacgtggatgtctac

SEQ ID NO: 891080 - DNA, 25 bp, Mus musculus
cactggagagaaggtggatgtctac

SEQ ID NO: 891081 - DNA, 25 bp, Mus musculus
cactggagagctatcttcagagaac

SEQ ID NO: 891082 - DNA, 25 bp, Mus musculus
cactggagagctctacgtctggggt

SEQ ID NO: 891083 - DNA, 25 bp, Mus musculus
cactggagaggtatcttcagagaac

SEQ ID NO: 891084 - DNA, 25 bp, Mus musculus
cactggagaggtctacgtctggggt

SEQ ID NO: 891085 - DNA, 25 bp, Mus musculus
cactggagcaacaactgaagaagaa

SEQ ID NO: 891086 - DNA, 25 bp, Mus musculus
cactggagcaacaagtgaagaagaa

SEQ ID NO: 891087 - DNA, 25 bp, Mus musculus
cactggatcgccgcccttcactgca

SEQ ID NO: 891088 - DNA, 25 bp, Mus musculus
cactggatcggcgcccttcactgca

SEQ ID NO: 891089 - DNA, 25 bp, Mus musculus
cactggatgtgctgcagcgctcccc

SEQ ID NO: 891090 - DNA, 25 bp, Mus musculus
cactggatgtgctggagcgctcccc

SEQ ID NO: 891091 - DNA, 25 bp, Mus musculus
cactggcacgaaatcctagtttcgt

SEQ ID NO: 891092 - DNA, 25 bp, Mus musculus
cactggcacgaattcctagtttcgt

SEQ ID NO: 891093 - DNA, 25 bp, Mus musculus
cactggcagtgacatccgccatcgc

SEQ ID NO: 891094 - DNA, 25 bp, Mus musculus
cactggcagtgagatccgccatcgc

SEQ ID NO: 891095 - DNA, 25 bp, Mus musculus
cactggccaaggccaagttccccca

SEQ ID NO: 891096 - DNA, 25 bp, Mus musculus
cactggccaagggcaagttccccca

SEQ ID NO: 891097 - DNA, 25 bp, Mus musculus
cactggccagaacgatgtcaatggg

SEQ ID NO: 891098 - DNA, 25 bp, Mus musculus
cactggccagaaggatgtcaatggg

SEQ ID NO: 891099 - DNA, 25 bp, Mus musculus
cactggccctcacgctcagcaggga

SEQ ID NO: 891100 - DNA, 25 bp, Mus musculus
cactggccctcaggctcagcaggga

SEQ ID NO: 891101 - DNA, 25 bp, Mus musculus
cactgggaacagcgtcttcttcagg

SEQ ID NO: 891102 - DNA, 25 bp, Mus musculus
cactgggaacagggtcttcttcagg

SEQ ID NO: 891103 - DNA, 25 bp, Mus musculus
cactgggccccgctgaaagctatga

SEQ ID NO: 891104 - DNA, 25 bp, Mus musculus
cactgggccccggtgaaagctatga

SEQ ID NO: 891105 - DNA, 25 bp, Mus musculus
cactgggcgcaccgcgaaagatgaa

SEQ ID NO: 891106 - DNA, 25 bp, Mus musculus
cactgggcgcacggcgaaagatgaa

SEQ ID NO: 891107 - DNA, 25 bp, Mus musculus
cactgggctctacgcgtgacaccag

SEQ ID NO: 891108 - DNA, 25 bp, Mus musculus
cactgggctctacgggtgacaccag

SEQ ID NO: 891109 - DNA, 25 bp, Mus musculus
cactggggagaggggccattgcagg

SEQ ID NO: 891110 - DNA, 25 bp, Mus musculus
cactggggagtggggccattgcagg

SEQ ID NO: 891111 - DNA, 25 bp, Mus musculus
cactggtatcaactctgtaaggaga

SEQ ID NO: 891112 - DNA, 25 bp, Mus musculus
cactggtatcaactgtgtaaggaga

SEQ ID NO: 891113 - DNA, 25 bp, Mus musculus
cactggtcagctgaagtaaatgaca

SEQ ID NO: 891114 - DNA, 25 bp, Mus musculus
cactggtcaggtgaagtaaatgaca

SEQ ID NO: 891115 - DNA, 25 bp, Mus musculus
cactggtgagaaccctctgcaggtc

SEQ ID NO: 891116 - DNA, 25 bp, Mus musculus
cactggtgagaggcccccgagaaga

SEQ ID NO: 891117 - DNA, 25 bp, Mus musculus
cactggtgagtaccctctgcaggtc

SEQ ID NO: 891118 - DNA, 25 bp, Mus musculus
cactggtgagtggcccccgagaaga

SEQ ID NO: 891119 - DNA, 25 bp, Mus musculus
cactggtgcctcatcagtggacaac

SEQ ID NO: 891120 - DNA, 25 bp, Mus musculus
cactggtgcctcatgagtggacaac

SEQ ID NO: 891121 - DNA, 25 bp, Mus musculus
cactggtggcaacacgtccctcgtt

SEQ ID NO: 891122 - DNA, 25 bp, Mus musculus
cactggtggcaacaggtccctcgtt

SEQ ID NO: 891123 - DNA, 25 bp, Mus musculus
cactgtaaggcccatcctttgtgag

SEQ ID NO: 891124 - DNA, 25 bp, Mus musculus
cactgtaaggccgatcctttgtgag

SEQ ID NO: 891125 - DNA, 25 bp, Mus musculus
cactgtactcaacactgcaggcgct

SEQ ID NO: 891126 - DNA, 25 bp, Mus musculus
cactgtactcaactcctggatcagt

SEQ ID NO: 891127 - DNA, 25 bp, Mus musculus
cactgtactcaagactgcaggcgct

SEQ ID NO: 891128 - DNA, 25 bp, Mus musculus
cactgtactcaagtcctggatcagt

SEQ ID NO: 891129 - DNA, 25 bp, Mus musculus
cactgtagagcttcgagtcaagatc

SEQ ID NO: 891130 - DNA, 25 bp, Mus musculus
cactgtagaggttcgagtcaagatc

SEQ ID NO: 891131 - DNA, 25 bp, Mus musculus
cactgtagtttcactgttcctggtg

SEQ ID NO: 891132 - DNA, 25 bp, Mus musculus
cactgtagtttctctgttcctggtg

SEQ ID NO: 891133 - DNA, 25 bp, Mus musculus
cactgtatcaaacgctacctggggg

SEQ ID NO: 891134 - DNA, 25 bp, Mus musculus
cactgtatcaaaggctacctggggg

SEQ ID NO: 891135 - DNA, 25 bp, Mus musculus
cactgtatcgcttccatgtaagtct

SEQ ID NO: 891136 - DNA, 25 bp, Mus musculus
cactgtatcggttccatgtaagtct

SEQ ID NO: 891137 - DNA, 25 bp, Mus musculus
cactgtcaagcatgtgtttgagttt

SEQ ID NO: 891138 - DNA, 25 bp, Mus musculus
cactgtcaagcgcagggtcaaagat

SEQ ID NO: 891139 - DNA, 25 bp, Mus musculus
cactgtcaagcggaagatggagaac

SEQ ID NO: 891140 - DNA, 25 bp, Mus musculus
cactgtcaagcttctcatgctgcct

SEQ ID NO: 891141 - DNA, 25 bp, Mus musculus
cactgtcaaggatgtgtttgagttt

SEQ ID NO: 891142 - DNA, 25 bp, Mus musculus
cactgtcaagggcagggtcaaagat

SEQ ID NO: 891143 - DNA, 25 bp, Mus musculus
cactgtcaaggggaagatggagaac

SEQ ID NO: 891144 - DNA, 25 bp, Mus musculus
cactgtcaaggttctcatgctgcct

SEQ ID NO: 891145 - DNA, 25 bp, Mus musculus
cactgtcacaagcatcacatgaaag

SEQ ID NO: 891146 - DNA, 25 bp, Mus musculus
cactgtcacaaggatcacatgaaag

SEQ ID NO: 891147 - DNA, 25 bp, Mus musculus
cactgtcatgctatggcagattcca

SEQ ID NO: 891148 - DNA, 25 bp, Mus musculus
cactgtcatggtatggcagattcca

SEQ ID NO: 891149 - DNA, 25 bp, Mus musculus
cactgtccaaagcgccagaaggggg

SEQ ID NO: 891150 - DNA, 25 bp, Mus musculus
cactgtccaaagggccagaaggggg

SEQ ID NO: 891151 - DNA, 25 bp, Mus musculus
cactgtccacctcattgaattcgcc

SEQ ID NO: 891152 - DNA, 25 bp, Mus musculus
cactgtccacctgattgaattcgcc

SEQ ID NO: 891153 - DNA, 25 bp, Mus musculus
cactgtcgaacacacagacagatct

SEQ ID NO: 891154 - DNA, 25 bp, Mus musculus
cactgtcgaacacagagacagatct

SEQ ID NO: 891155 - DNA, 25 bp, Mus musculus
cactgtctagcaccatcaaaaagga

SEQ ID NO: 891156 - DNA, 25 bp, Mus musculus
cactgtctaggaccatcaaaaagga

SEQ ID NO: 891157 - DNA, 25 bp, Mus musculus
cactgtctgctgccaccccttgagt

SEQ ID NO: 891158 - DNA, 25 bp, Mus musculus
cactgtctgctggcaccccttgagt

SEQ ID NO: 891159 - DNA, 25 bp, Mus musculus
cactgtgagccacacactctacgag

SEQ ID NO: 891160 - DNA, 25 bp, Mus musculus
cactgtgagccacagactctacgag

SEQ ID NO: 891161 - DNA, 25 bp, Mus musculus
cactgtgaggatctttaactcagtt

SEQ ID NO: 891162 - DNA, 25 bp, Mus musculus
cactgtgaggttctttaactcagtt

SEQ ID NO: 891163 - DNA, 25 bp, Mus musculus
cactgtgcacctcaaagtctaagaa

SEQ ID NO: 891164 - DNA, 25 bp, Mus musculus
cactgtgcacctcatagtctaagaa

SEQ ID NO: 891165 - DNA, 25 bp, Mus musculus
cactgtgcagatccgctcgctgtcc

SEQ ID NO: 891166 - DNA, 25 bp, Mus musculus
cactgtgcagctcattctctttggg

SEQ ID NO: 891167 - DNA, 25 bp, Mus musculus
cactgtgcaggtcattctctttggg

SEQ ID NO: 891168 - DNA, 25 bp, Mus musculus
cactgtgcagttccgctcgctgtcc

SEQ ID NO: 891169 - DNA, 25 bp, Mus musculus
cactgtggaacatttggctatccag

SEQ ID NO: 891170 - DNA, 25 bp, Mus musculus
cactgtggaagatttggctatccag

SEQ ID NO: 891171 - DNA, 25 bp, Mus musculus
cactgtggacatcatgtacggtggc

SEQ ID NO: 891172 - DNA, 25 bp, Mus musculus
cactgtggacatgatgtacggtggc

SEQ ID NO: 891173 - DNA, 25 bp, Mus musculus
cactgtggagacaccaacgagtgca

SEQ ID NO: 891174 - DNA, 25 bp, Mus musculus
cactgtggagcagctgaagttcaac

SEQ ID NO: 891175 - DNA, 25 bp, Mus musculus
cactgtggaggagctgaagttcaac

SEQ ID NO: 891176 - DNA, 25 bp, Mus musculus
cactgtggagtcaccaacgagtgca

SEQ ID NO: 891177 - DNA, 25 bp, Mus musculus
cactgtggcatgttcgaatgaatga

SEQ ID NO: 891178 - DNA, 25 bp, Mus musculus
cactgtggcatgttggaatgaatga

SEQ ID NO: 891179 - DNA, 25 bp, Mus musculus
cactgtgggcagcaggcaacagatt

SEQ ID NO: 891180 - DNA, 25 bp, Mus musculus
cactgtgggcaggaggcaacagatt

SEQ ID NO: 891181 - DNA, 25 bp, Mus musculus
cactgtggtaagctggaagggactc

SEQ ID NO: 891182 - DNA, 25 bp, Mus musculus
cactgtggtaaggtggaagggactc

SEQ ID NO: 891183 - DNA, 25 bp, Mus musculus
cactgtggtacacgcaaaattggca

SEQ ID NO: 891184 - DNA, 25 bp, Mus musculus
cactgtggtacaggcaaaattggca

SEQ ID NO: 891185 - DNA, 25 bp, Mus musculus
cactgtgtaaaacgccttaaccatg

SEQ ID NO: 891186 - DNA, 25 bp, Mus musculus
cactgtgtaaaaggccttaaccatg

SEQ ID NO: 891187 - DNA, 25 bp, Mus musculus
cactgtgtgtctccctcgtgcctca

SEQ ID NO: 891188 - DNA, 25 bp, Mus musculus
cactgtgtgtctgcctcgtgcctca

SEQ ID NO: 891189 - DNA, 25 bp, Mus musculus
cactgtgttgagcacatcgagtcac

SEQ ID NO: 891190 - DNA, 25 bp, Mus musculus
cactgtgttgagctcctgagttcaa

SEQ ID NO: 891191 - DNA, 25 bp, Mus musculus
cactgtgttgaggacatcgagtcac

SEQ ID NO: 891192 - DNA, 25 bp, Mus musculus
cactgtgttgaggtcctgagttcaa

SEQ ID NO: 891193 - DNA, 25 bp, Mus musculus
cactgtgttggacatgacatcacca

SEQ ID NO: 891194 - DNA, 25 bp, Mus musculus
cactgtgttggagatgacatcacca

SEQ ID NO: 891195 - DNA, 25 bp, Mus musculus
cactgttcagccatccgaaggtgtc

SEQ ID NO: 891196 - DNA, 25 bp, Mus musculus
cactgttcagcccacagtgagaatc

SEQ ID NO: 891197 - DNA, 25 bp, Mus musculus
cactgttcaggcatccgaaggtgtc

SEQ ID NO: 891198 - DNA, 25 bp, Mus musculus
cactgttcaggccacagtgagaatc

SEQ ID NO: 891199 - DNA, 25 bp, Mus musculus
cactgttctcttggagttctgacgg

SEQ ID NO: 891200 - DNA, 25 bp, Mus musculus
cactgttctcttggtgttctgacgg

SEQ ID NO: 891201 - DNA, 25 bp, Mus musculus
cactgttgtgcactggccctttgat

SEQ ID NO: 891202 - DNA, 25 bp, Mus musculus
cactgttgtggactggccctttgat

SEQ ID NO: 891203 - DNA, 25 bp, Mus musculus
cactgttgtggcagaaaaggaccgt

SEQ ID NO: 891204 - DNA, 25 bp, Mus musculus
cactgttgtggctgaaaaggaccgt

SEQ ID NO: 891205 - DNA, 25 bp, Mus musculus
cacttaacagctccccaggcaagaa

SEQ ID NO: 891206 - DNA, 25 bp, Mus musculus
cacttaacagctgtgggcaatagca

SEQ ID NO: 891207 - DNA, 25 bp, Mus musculus
cacttaacaggtccccaggcaagaa

SEQ ID NO: 891208 - DNA, 25 bp, Mus musculus
cacttaacaggtgtgggcaatagca

SEQ ID NO: 891209 - DNA, 25 bp, Mus musculus
cacttaagacctattactgacagtc

SEQ ID NO: 891210 - DNA, 25 bp, Mus musculus
cacttaagaccttttactgacagtc

SEQ ID NO: 891211 - DNA, 25 bp, Mus musculus
cacttacagctgcttgaggaagctg

SEQ ID NO: 891212 - DNA, 25 bp, Mus musculus
cacttacagctggttgaggaagctg

SEQ ID NO: 891213 - DNA, 25 bp, Mus musculus
cacttactacaatttctgaagtgaa

SEQ ID NO: 891214 - DNA, 25 bp, Mus musculus
cacttactactatttctgaagtgaa

SEQ ID NO: 891215 - DNA, 25 bp, Mus musculus
cacttacttatacaccaggcctgat

SEQ ID NO: 891216 - DNA, 25 bp, Mus musculus
cacttacttatacacgcctgatgga

SEQ ID NO: 891217 - DNA, 25 bp, Mus musculus
cacttacttatacagcaggcctgat

SEQ ID NO: 891218 - DNA, 25 bp, Mus musculus
cacttacttatacaggcctgatgga

SEQ ID NO: 891219 - DNA, 25 bp, Mus musculus
cacttataaaatcctgtgactatca

SEQ ID NO: 891220 - DNA, 25 bp, Mus musculus
cacttataaaatgctgtgactatca

SEQ ID NO: 891221 - DNA, 25 bp, Mus musculus
cacttatacacacgtgcaaactcgt

SEQ ID NO: 891222 - DNA, 25 bp, Mus musculus
cacttatacacaggtgcaaactcgt

SEQ ID NO: 891223 - DNA, 25 bp, Mus musculus
cacttatgggcctacaaagatttgc

SEQ ID NO: 891224 - DNA, 25 bp, Mus musculus
cacttatggggctacaaagatttgc

SEQ ID NO: 891225 - DNA, 25 bp, Mus musculus
cacttattcacacgcaaacgcactc

SEQ ID NO: 891226 - DNA, 25 bp, Mus musculus
cacttattcacaggcaaacgcactc

SEQ ID NO: 891227 - DNA, 25 bp, Mus musculus
cacttcaacctgtacggaactgtgc

SEQ ID NO: 891228 - DNA, 25 bp, Mus musculus
cacttcaacctgtagggaactgtgc

SEQ ID NO: 891229 - DNA, 25 bp, Mus musculus
cacttcaagaagctgtgtggccctt

SEQ ID NO: 891230 - DNA, 25 bp, Mus musculus
cacttcaagaaggtgtgtggccctt

SEQ ID NO: 891231 - DNA, 25 bp, Mus musculus
cacttcacaacgatggaatagagtt

SEQ ID NO: 891232 - DNA, 25 bp, Mus musculus
cacttcacaaggatggaatagagtt

SEQ ID NO: 891233 - DNA, 25 bp, Mus musculus
cacttcacctctggagatgggaagg

SEQ ID NO: 891234 - DNA, 25 bp, Mus musculus
cacttcacctgtggagatgggaagg

SEQ ID NO: 891235 - DNA, 25 bp, Mus musculus
cacttcagaaacatctccctgaaac

SEQ ID NO: 891236 - DNA, 25 bp, Mus musculus
cacttcagaaacatgtccctgaaac

SEQ ID NO: 891237 - DNA, 25 bp, Mus musculus
cacttccaagctagcgttggtatat

SEQ ID NO: 891238 - DNA, 25 bp, Mus musculus
cacttccaaggtagcgttggtatat

SEQ ID NO: 891239 - DNA, 25 bp, Mus musculus
cacttccacggtcggatacttatct

SEQ ID NO: 891240 - DNA, 25 bp, Mus musculus
cacttccacggtgggatacttatct

SEQ ID NO: 891241 - DNA, 25 bp, Mus musculus
cacttccaggctcgagatgcagacg

SEQ ID NO: 891242 - DNA, 25 bp, Mus musculus
cacttccagggtcgagatgcagacg

SEQ ID NO: 891243 - DNA, 25 bp, Mus musculus
cacttcccagaggctccagaagaat

SEQ ID NO: 891244 - DNA, 25 bp, Mus musculus
cacttcccagtggctccagaagaat

SEQ ID NO: 891245 - DNA, 25 bp, Mus musculus
cacttcccgctgcacgtgcaatgga

SEQ ID NO: 891246 - DNA, 25 bp, Mus musculus
cacttcccgctggacgtgcaatgga

SEQ ID NO: 891247 - DNA, 25 bp, Mus musculus
cacttccttcagagtgtactgcagt

SEQ ID NO: 891248 - DNA, 25 bp, Mus musculus
cacttccttcagtgtgtactgcagt

SEQ ID NO: 891249 - DNA, 25 bp, Mus musculus
cacttcctttccacttcagttcagg

SEQ ID NO: 891250 - DNA, 25 bp, Mus musculus
cacttcctttcctcttcagttcagg

SEQ ID NO: 891251 - DNA, 25 bp, Mus musculus
cacttcgaaaagcctcgggatgtgt

SEQ ID NO: 891252 - DNA, 25 bp, Mus musculus
cacttcgaaaaggctcgggatgtgt

SEQ ID NO: 891253 - DNA, 25 bp, Mus musculus
cacttcggacacagtacatgaagta

SEQ ID NO: 891254 - DNA, 25 bp, Mus musculus
cacttcggacactgtacatgaagta

SEQ ID NO: 891255 - DNA, 25 bp, Mus musculus
cacttcggcccacaacaatgctaaa

SEQ ID NO: 891256 - DNA, 25 bp, Mus musculus
cacttcggcccagaacaatgctaaa

SEQ ID NO: 891257 - DNA, 25 bp, Mus musculus
cacttcgggccaagtttctcttgca

SEQ ID NO: 891258 - DNA, 25 bp, Mus musculus
cacttcgggccatgtttctcttgca

SEQ ID NO: 891259 - DNA, 25 bp, Mus musculus
cacttcggggagctggccaagcagg

SEQ ID NO: 891260 - DNA, 25 bp, Mus musculus
cacttcggggaggtggccaagcagg

SEQ ID NO: 891261 - DNA, 25 bp, Mus musculus
cacttctgagtcaacagcttggatt

SEQ ID NO: 891262 - DNA, 25 bp, Mus musculus
cacttctgagtcaagagcttggatt

SEQ ID NO: 891263 - DNA, 25 bp, Mus musculus
cacttctgggacactgtccccactg

SEQ ID NO: 891264 - DNA, 25 bp, Mus musculus
cacttctgggtcactgtccccactg

SEQ ID NO: 891265 - DNA, 25 bp, Mus musculus
cacttgaacattgacgcactgcagt

SEQ ID NO: 891266 - DNA, 25 bp, Mus musculus
cacttgaacattgaggcactgcagt

SEQ ID NO: 891267 - DNA, 25 bp, Mus musculus
cacttgaccagactcgcgctctcca

SEQ ID NO: 891268 - DNA, 25 bp, Mus musculus
cacttgaccagactggcgctctcca

SEQ ID NO: 891269 - DNA, 25 bp, Mus musculus
cacttgagggagcacaaggacaggc

SEQ ID NO: 891270 - DNA, 25 bp, Mus musculus
cacttgagggagcagaaggacaggc

SEQ ID NO: 891271 - DNA, 25 bp, Mus musculus
cacttgatgtaaaacgaaaagaaca

SEQ ID NO: 891272 - DNA, 25 bp, Mus musculus
cacttgatgtaaaaggaaaagaaca

SEQ ID NO: 891273 - DNA, 25 bp, Mus musculus
cacttgcagcagcgtggtgctccaa

SEQ ID NO: 891274 - DNA, 25 bp, Mus musculus
cacttgcagcagggtggtgctccaa

SEQ ID NO: 891275 - DNA, 25 bp, Mus musculus
cacttgcaggcgagactccggcagc

SEQ ID NO: 891276 - DNA, 25 bp, Mus musculus
cacttgcaggggagactccggcagc

SEQ ID NO: 891277 - DNA, 25 bp, Mus musculus
cacttgccgcctatctttctatggc

SEQ ID NO: 891278 - DNA, 25 bp, Mus musculus
cacttgccgcctatgtttctatggc

SEQ ID NO: 891279 - DNA, 25 bp, Mus musculus
cacttgcgacagagagaagaagcca

SEQ ID NO: 891280 - DNA, 25 bp, Mus musculus
cacttgcgacagtgagaagaagcca

SEQ ID NO: 891281 - DNA, 25 bp, Mus musculus
cacttgcttcagccagagtaacagt

SEQ ID NO: 891282 - DNA, 25 bp, Mus musculus
cacttgcttcaggcagagtaacagt

SEQ ID NO: 891283 - DNA, 25 bp, Mus musculus
cacttggaatcacagcagaaacgac

SEQ ID NO: 891284 - DNA, 25 bp, Mus musculus
cacttggaatcacagcagcagaaac

SEQ ID NO: 891285 - DNA, 25 bp, Mus musculus
cacttggaatcagagcagaaacgac

SEQ ID NO: 891286 - DNA, 25 bp, Mus musculus
cacttggaatcagagcagcagaaac

SEQ ID NO: 891287 - DNA, 25 bp, Mus musculus
cacttggacagagccggaacggcca

SEQ ID NO: 891288 - DNA, 25 bp, Mus musculus
cacttggacagagcgggaacggcca

SEQ ID NO: 891289 - DNA, 25 bp, Mus musculus
cacttgggagcccatggaggacctg

SEQ ID NO: 891290 - DNA, 25 bp, Mus musculus
cacttgggaggccatggaggacctg

SEQ ID NO: 891291 - DNA, 25 bp, Mus musculus
cacttgggcaaacagcagagccgcc

SEQ ID NO: 891292 - DNA, 25 bp, Mus musculus
cacttgggcaaacagccgccgggat

SEQ ID NO: 891293 - DNA, 25 bp, Mus musculus
cacttgggcaaagagcagagccgcc

SEQ ID NO: 891294 - DNA, 25 bp, Mus musculus
cacttgggcaaagagccgccgggat

SEQ ID NO: 891295 - DNA, 25 bp, Mus musculus
cacttgggcatgatccagagcaatg

SEQ ID NO: 891296 - DNA, 25 bp, Mus musculus
cacttgggcatgctttggtggcccc

SEQ ID NO: 891297 - DNA, 25 bp, Mus musculus
cacttgggcatggtttggtggcccc

SEQ ID NO: 891298 - DNA, 25 bp, Mus musculus
cacttgggcatgttccagagcaatg

SEQ ID NO: 891299 - DNA, 25 bp, Mus musculus
cacttggggaagcctgagatggggg

SEQ ID NO: 891300 - DNA, 25 bp, Mus musculus
cacttggggaaggctgagatggggg

SEQ ID NO: 891301 - DNA, 25 bp, Mus musculus
cacttgtgaaagcctgcaagagcca

SEQ ID NO: 891302 - DNA, 25 bp, Mus musculus
cacttgtgaaaggctgcaagagcca

SEQ ID NO: 891303 - DNA, 25 bp, Mus musculus
cacttgtgcgcaggcccactgatct

SEQ ID NO: 891304 - DNA, 25 bp, Mus musculus
cacttgtgcgcgtgactcaggaggc

SEQ ID NO: 891305 - DNA, 25 bp, Mus musculus
cacttgtgcggaggcccactgatct

SEQ ID NO: 891306 - DNA, 25 bp, Mus musculus
cacttgtgcgggtgactcaggaggc

SEQ ID NO: 891307 - DNA, 25 bp, Mus musculus
cactttacagctggctttgcagctg

SEQ ID NO: 891308 - DNA, 25 bp, Mus musculus
cactttacaggtggctttgcagctg

SEQ ID NO: 891309 - DNA, 25 bp, Mus musculus
cactttagagcaaattatgaaagat

SEQ ID NO: 891310 - DNA, 25 bp, Mus musculus
cactttagaggaaattatgaaagat

SEQ ID NO: 891311 - DNA, 25 bp, Mus musculus
cactttatagaacttcacctcaggc

SEQ ID NO: 891312 - DNA, 25 bp, Mus musculus
cactttatagtacttcacctcaggc

SEQ ID NO: 891313 - DNA, 25 bp, Mus musculus
cactttatgcttcacatcgccttga

SEQ ID NO: 891314 - DNA, 25 bp, Mus musculus
cactttatgcttcagatcgccttga

SEQ ID NO: 891315 - DNA, 25 bp, Mus musculus
cactttcaagctgccataccaggag

SEQ ID NO: 891316 - DNA, 25 bp, Mus musculus
cactttcaaggtgccataccaggag

SEQ ID NO: 891317 - DNA, 25 bp, Mus musculus
cactttcatgccgttcaaccgaggc

SEQ ID NO: 891318 - DNA, 25 bp, Mus musculus
cactttcatggcgttcaaccgaggc

SEQ ID NO: 891319 - DNA, 25 bp, Mus musculus
cactttccaccactctcctaggctc

SEQ ID NO: 891320 - DNA, 25 bp, Mus musculus
cactttccaccagtctcctaggctc

SEQ ID NO: 891321 - DNA, 25 bp, Mus musculus
cactttccagacaaccaaggccgtg

SEQ ID NO: 891322 - DNA, 25 bp, Mus musculus
cactttccagtcaaccaaggccgtg

SEQ ID NO: 891323 - DNA, 25 bp, Mus musculus
cactttccatcttataaacactggg

SEQ ID NO: 891324 - DNA, 25 bp, Mus musculus
cactttccatgttataaacactggg

SEQ ID NO: 891325 - DNA, 25 bp, Mus musculus
cactttctactacccttttgggctc

SEQ ID NO: 891326 - DNA, 25 bp, Mus musculus
cactttctactagccttttgggctc

SEQ ID NO: 891327 - DNA, 25 bp, Mus musculus
cactttgaagagaattgttgtgtga

SEQ ID NO: 891328 - DNA, 25 bp, Mus musculus
cactttgaagagctgtgagtgttga

SEQ ID NO: 891329 - DNA, 25 bp, Mus musculus
cactttgaagaggtgtgagtgttga

SEQ ID NO: 891330 - DNA, 25 bp, Mus musculus
cactttgaagagtattgttgtgtga

SEQ ID NO: 891331 - DNA, 25 bp, Mus musculus
cactttgacctgaaccccgagaaca

SEQ ID NO: 891332 - DNA, 25 bp, Mus musculus
cactttgacctgaagcccgagaaca

SEQ ID NO: 891333 - DNA, 25 bp, Mus musculus
cactttgcagcttggtgagaccaga

SEQ ID NO: 891334 - DNA, 25 bp, Mus musculus
cactttgcaggttggtgagaccaga

SEQ ID NO: 891335 - DNA, 25 bp, Mus musculus
cactttggaacacattcaagtcaat

SEQ ID NO: 891336 - DNA, 25 bp, Mus musculus
cactttggaacagattcaagtcaat

SEQ ID NO: 891337 - DNA, 25 bp, Mus musculus
cactttggacagagttgcaatgttt

SEQ ID NO: 891338 - DNA, 25 bp, Mus musculus
cactttggacagtgttgcaatgttt

SEQ ID NO: 891339 - DNA, 25 bp, Mus musculus
cactttggccagcaggagttgcagg

SEQ ID NO: 891340 - DNA, 25 bp, Mus musculus
cactttggccaggaggagttgcagg

SEQ ID NO: 891341 - DNA, 25 bp, Mus musculus
cactttgtaacaccactgagggtgg

SEQ ID NO: 891342 - DNA, 25 bp, Mus musculus
cactttgtaacagcactgagggtgg

SEQ ID NO: 891343 - DNA, 25 bp, Mus musculus
cactttgtcgctatgtagatgccgg

SEQ ID NO: 891344 - DNA, 25 bp, Mus musculus
cactttgtcgctcaagatgtagatg

SEQ ID NO: 891345 - DNA, 25 bp, Mus musculus
cactttgtcgctgaagatgtagatg

SEQ ID NO: 891346 - DNA, 25 bp, Mus musculus
cactttgtcgctttgtagatgccgg

SEQ ID NO: 891347 - DNA, 25 bp, Mus musculus
cacttttgaaagagtggagcagatg

SEQ ID NO: 891348 - DNA, 25 bp, Mus musculus
cacttttgaaagtgtggagcagatg

SEQ ID NO: 891349 - DNA, 25 bp, Mus musculus
cacttttggagattcgggcctgtgt

SEQ ID NO: 891350 - DNA, 25 bp, Mus musculus
cacttttggagattggggcctgtgt

SEQ ID NO: 891351 - DNA, 25 bp, Mus musculus
cacttttgtgcattacgatgttgat

SEQ ID NO: 891352 - DNA, 25 bp, Mus musculus
cacttttgtggattacgatgttgat

SEQ ID NO: 891353 - DNA, 25 bp, Mus musculus
cagaaaaagaatgccgctggcgcat

SEQ ID NO: 891354 - DNA, 25 bp, Mus musculus
cagaaaaagaatgcggctggcgcat

SEQ ID NO: 891355 - DNA, 25 bp, Mus musculus
cagaaaaataatcttgatttagtga

SEQ ID NO: 891356 - DNA, 25 bp, Mus musculus
cagaaaaataatgttgatttagtga

SEQ ID NO: 891357 - DNA, 25 bp, Mus musculus
cagaaaacagatctttgtaccataa

SEQ ID NO: 891358 - DNA, 25 bp, Mus musculus
cagaaaacagctgctgcctaggact

SEQ ID NO: 891359 - DNA, 25 bp, Mus musculus
cagaaaacaggactctacagtgatg

SEQ ID NO: 891360 - DNA, 25 bp, Mus musculus
cagaaaacaggagtctacagtgatg

SEQ ID NO: 891361 - DNA, 25 bp, Mus musculus
cagaaaacaggtgctgcctaggact

SEQ ID NO: 891362 - DNA, 25 bp, Mus musculus
cagaaaacagttctttgtaccataa

SEQ ID NO: 891363 - DNA, 25 bp, Mus musculus
cagaaaaccacactgtcctgtgcat

SEQ ID NO: 891364 - DNA, 25 bp, Mus musculus
cagaaaaccacagtgtcctgtgcat

SEQ ID NO: 891365 - DNA, 25 bp, Mus musculus
cagaaaaccgcttgctgtggttcca

SEQ ID NO: 891366 - DNA, 25 bp, Mus musculus
cagaaaaccggttgctgtggttcca

SEQ ID NO: 891367 - DNA, 25 bp, Mus musculus
cagaaaactccaccaagtatgcggt

SEQ ID NO: 891368 - DNA, 25 bp, Mus musculus
cagaaaactccacctagtatgcggt

SEQ ID NO: 891369 - DNA, 25 bp, Mus musculus
cagaaaactgctaccactgccttgt

SEQ ID NO: 891370 - DNA, 25 bp, Mus musculus
cagaaaactggtaccactgccttgt

SEQ ID NO: 891371 - DNA, 25 bp, Mus musculus
cagaaaagaaagcagatcactatgt

SEQ ID NO: 891372 - DNA, 25 bp, Mus musculus
cagaaaagaaaggagatcactatgt

SEQ ID NO: 891373 - DNA, 25 bp, Mus musculus
cagaaaagactgacattactaagaa

SEQ ID NO: 891374 - DNA, 25 bp, Mus musculus
cagaaaagactgtcattactaagaa

SEQ ID NO: 891375 - DNA, 25 bp, Mus musculus
cagaaaagagctcaaaatgcagatc

SEQ ID NO: 891376 - DNA, 25 bp, Mus musculus
cagaaaagaggtcaaaatgcagatc

SEQ ID NO: 891377 - DNA, 25 bp, Mus musculus
cagaaaagcccacttctaattcaga

SEQ ID NO: 891378 - DNA, 25 bp, Mus musculus
cagaaaagcccagttctaattcaga

SEQ ID NO: 891379 - DNA, 25 bp, Mus musculus
cagaaaataaagcaattgaacctgg

SEQ ID NO: 891380 - DNA, 25 bp, Mus musculus
cagaaaataaaggaattgaacctgg

SEQ ID NO: 891381 - DNA, 25 bp, Mus musculus
cagaaaatcctgcacgactacaaat

SEQ ID NO: 891382 - DNA, 25 bp, Mus musculus
cagaaaatcctgcaggactacaaat

SEQ ID NO: 891383 - DNA, 25 bp, Mus musculus
cagaaaatcttactcttcagttcaa

SEQ ID NO: 891384 - DNA, 25 bp, Mus musculus
cagaaaatcttagtcttcagttcaa

SEQ ID NO: 891385 - DNA, 25 bp, Mus musculus
cagaaaatgtgccggtggcaatagt

SEQ ID NO: 891386 - DNA, 25 bp, Mus musculus
cagaaaatgtgcgggtggcaatagt

SEQ ID NO: 891387 - DNA, 25 bp, Mus musculus
cagaaaattaaacagtacatccaga

SEQ ID NO: 891388 - DNA, 25 bp, Mus musculus
cagaaaattaaagagtacatccaga

SEQ ID NO: 891389 - DNA, 25 bp, Mus musculus
cagaaaattgacctgcctgagtacc

SEQ ID NO: 891390 - DNA, 25 bp, Mus musculus
cagaaaattgacgtgcctgagtacc

SEQ ID NO: 891391 - DNA, 25 bp, Mus musculus
cagaaacacacacgcagatgtcatc

SEQ ID NO: 891392 - DNA, 25 bp, Mus musculus
cagaaacacacacgcatgctgaagg

SEQ ID NO: 891393 - DNA, 25 bp, Mus musculus
cagaaacacacacggatgctgaagg

SEQ ID NO: 891394 - DNA, 25 bp, Mus musculus
cagaaacacacaggcagatgtcatc

SEQ ID NO: 891395 - DNA, 25 bp, Mus musculus
cagaaacatcagaatcagcagcgtc

SEQ ID NO: 891396 - DNA, 25 bp, Mus musculus
cagaaacatcagtatcagcagcgtc

SEQ ID NO: 891397 - DNA, 25 bp, Mus musculus
cagaaacatgaccctgaaacgaatc

SEQ ID NO: 891398 - DNA, 25 bp, Mus musculus
cagaaacatgtccctgaaacgaatc

SEQ ID NO: 891399 - DNA, 25 bp, Mus musculus
cagaaaccaggacacgattccccct

SEQ ID NO: 891400 - DNA, 25 bp, Mus musculus
cagaaaccaggacaggattccccct

SEQ ID NO: 891401 - DNA, 25 bp, Mus musculus
cagaaaccatagcggattctggctt

SEQ ID NO: 891402 - DNA, 25 bp, Mus musculus
cagaaaccataggggattctggctt

SEQ ID NO: 891403 - DNA, 25 bp, Mus musculus
cagaaacccgctcttgcccctcgac

SEQ ID NO: 891404 - DNA, 25 bp, Mus musculus
cagaaacccgctgttgcccctcgac

SEQ ID NO: 891405 - DNA, 25 bp, Mus musculus
cagaaacgagaagaagcagaccatt

SEQ ID NO: 891406 - DNA, 25 bp, Mus musculus
cagaaacgagtagaagcagaccatt

SEQ ID NO: 891407 - DNA, 25 bp, Mus musculus
cagaaactaaaaaaagtgacgagat

SEQ ID NO: 891408 - DNA, 25 bp, Mus musculus
cagaaactaaaaataagtgacgaga

SEQ ID NO: 891409 - DNA, 25 bp, Mus musculus
cagaaactaaaataagtgacgagat

SEQ ID NO: 891410 - DNA, 25 bp, Mus musculus
cagaaactaaaattaagtgacgaga

SEQ ID NO: 891411 - DNA, 25 bp, Mus musculus
cagaaactacagcaagttgaaattc

SEQ ID NO: 891412 - DNA, 25 bp, Mus musculus
cagaaactacaggaagttgaaattc

SEQ ID NO: 891413 - DNA, 25 bp, Mus musculus
cagaaactccagaagtggccacaga

SEQ ID NO: 891414 - DNA, 25 bp, Mus musculus
cagaaactccagaggccacagagga

SEQ ID NO: 891415 - DNA, 25 bp, Mus musculus
cagaaactccagtagtggccacaga

SEQ ID NO: 891416 - DNA, 25 bp, Mus musculus
cagaaactccagtggccacagagga

SEQ ID NO: 891417 - DNA, 25 bp, Mus musculus
cagaaactggccagcaagcctgcct

SEQ ID NO: 891418 - DNA, 25 bp, Mus musculus
cagaaactgggcagcaagcctgcct

SEQ ID NO: 891419 - DNA, 25 bp, Mus musculus
cagaaactggggcccgtgattccct

SEQ ID NO: 891420 - DNA, 25 bp, Mus musculus
cagaaactggggccggtgattccct

SEQ ID NO: 891421 - DNA, 25 bp, Mus musculus
cagaaagaagaggaaaccagaggaa

SEQ ID NO: 891422 - DNA, 25 bp, Mus musculus
cagaaagaagtggaaaccagaggaa

SEQ ID NO: 891423 - DNA, 25 bp, Mus musculus
cagaaagacaagaaaacagaaatat

SEQ ID NO: 891424 - DNA, 25 bp, Mus musculus
cagaaagacaagtaaacagaaatat

SEQ ID NO: 891425 - DNA, 25 bp, Mus musculus
cagaaagatgaaaggctgtggtcaa

SEQ ID NO: 891426 - DNA, 25 bp, Mus musculus
cagaaagatgaatggctgtggtcaa

SEQ ID NO: 891427 - DNA, 25 bp, Mus musculus
cagaaagcaacaggcatgaagtaca

SEQ ID NO: 891428 - DNA, 25 bp, Mus musculus
cagaaagcaacagggatgaagtaca

SEQ ID NO: 891429 - DNA, 25 bp, Mus musculus
cagaaagcacagatggacagctccc

SEQ ID NO: 891430 - DNA, 25 bp, Mus musculus
cagaaagcacagttggacagctccc

SEQ ID NO: 891431 - DNA, 25 bp, Mus musculus
cagaaagcagcccgtctactgtgtg

SEQ ID NO: 891432 - DNA, 25 bp, Mus musculus
cagaaagcagcctccgagacaggag

SEQ ID NO: 891433 - DNA, 25 bp, Mus musculus
cagaaagcagcctcggagacaggag

SEQ ID NO: 891434 - DNA, 25 bp, Mus musculus
cagaaagcagcgctgactgtgaatg

SEQ ID NO: 891435 - DNA, 25 bp, Mus musculus
cagaaagcaggccgtctactgtgtg

SEQ ID NO: 891436 - DNA, 25 bp, Mus musculus
cagaaagcagggctgactgtgaatg

SEQ ID NO: 891437 - DNA, 25 bp, Mus musculus
cagaaagccacaagctaatccacac

SEQ ID NO: 891438 - DNA, 25 bp, Mus musculus
cagaaagccacatgctaatccacac

SEQ ID NO: 891439 - DNA, 25 bp, Mus musculus
cagaaagcccagagaaaggaatcca

SEQ ID NO: 891440 - DNA, 25 bp, Mus musculus
cagaaagcccagcagagaaaggaat

SEQ ID NO: 891441 - DNA, 25 bp, Mus musculus
cagaaagcccaggagagaaaggaat

SEQ ID NO: 891442 - DNA, 25 bp, Mus musculus
cagaaagcccagtgaaaggaatcca

SEQ ID NO: 891443 - DNA, 25 bp, Mus musculus
cagaaaggagaaaatttacctttat

SEQ ID NO: 891444 - DNA, 25 bp, Mus musculus
cagaaaggagaatatttacctttat

SEQ ID NO: 891445 - DNA, 25 bp, Mus musculus
cagaaagtagaacgctcagaaccaa

SEQ ID NO: 891446 - DNA, 25 bp, Mus musculus
cagaaagtagaaggctcagaaccaa

SEQ ID NO: 891447 - DNA, 25 bp, Mus musculus
cagaaataaaaaagaaatttgcatt

SEQ ID NO: 891448 - DNA, 25 bp, Mus musculus
cagaaataaaaatgaaatttgcatt

SEQ ID NO: 891449 - DNA, 25 bp, Mus musculus
cagaaataccagaacagaaagtttc

SEQ ID NO: 891450 - DNA, 25 bp, Mus musculus
cagaaataccagaagagaaagtttc

SEQ ID NO: 891451 - DNA, 25 bp, Mus musculus
cagaaatccaagaaaatgtacaggc

SEQ ID NO: 891452 - DNA, 25 bp, Mus musculus
cagaaatccaagtaaatgtacaggc

SEQ ID NO: 891453 - DNA, 25 bp, Mus musculus
cagaaatcctcaaacctgtaccgcc

SEQ ID NO: 891454 - DNA, 25 bp, Mus musculus
cagaaatcctcaaagctgtaccgcc

SEQ ID NO: 891455 - DNA, 25 bp, Mus musculus
cagaaatcgaagcacaaaatgaaca

SEQ ID NO: 891456 - DNA, 25 bp, Mus musculus
cagaaatcgaagcagaaaatgaaca

SEQ ID NO: 891457 - DNA, 25 bp, Mus musculus
cagaaatcgcagaaagccacaggtt

SEQ ID NO: 891458 - DNA, 25 bp, Mus musculus
cagaaatcgcagtaagccacaggtt

SEQ ID NO: 891459 - DNA, 25 bp, Mus musculus
cagaaatctctccgcgcttgtcagg

SEQ ID NO: 891460 - DNA, 25 bp, Mus musculus
cagaaatctctcggcgcttgtcagg

SEQ ID NO: 891461 - DNA, 25 bp, Mus musculus
cagaaatggcagcaaaggagaacaa

SEQ ID NO: 891462 - DNA, 25 bp, Mus musculus
cagaaatggcaggaaaggagaacaa

SEQ ID NO: 891463 - DNA, 25 bp, Mus musculus
cagaaattccagcatgtctgtgtta

SEQ ID NO: 891464 - DNA, 25 bp, Mus musculus
cagaaattccagcattgctgtgtct

SEQ ID NO: 891465 - DNA, 25 bp, Mus musculus
cagaaattccaggatgtctgtgtta

SEQ ID NO: 891466 - DNA, 25 bp, Mus musculus
cagaaattccaggattgctgtgtct

SEQ ID NO: 891467 - DNA, 25 bp, Mus musculus
cagaacaacaagcacgcttttgatg

SEQ ID NO: 891468 - DNA, 25 bp, Mus musculus
cagaacaacaagcaggagactcccc

SEQ ID NO: 891469 - DNA, 25 bp, Mus musculus
cagaacaacaagcaggcttttgatg

SEQ ID NO: 891470 - DNA, 25 bp, Mus musculus
cagaacaacaaggaggagactcccc

SEQ ID NO: 891471 - DNA, 25 bp, Mus musculus
cagaacacaaggccaagatcatcat

SEQ ID NO: 891472 - DNA, 25 bp, Mus musculus
cagaacacaagggcaagatcatcat

SEQ ID NO: 891473 - DNA, 25 bp, Mus musculus
cagaacacccaacgcttgatatttg

SEQ ID NO: 891474 - DNA, 25 bp, Mus musculus
cagaacacccaacgcttgatcttcg

SEQ ID NO: 891475 - DNA, 25 bp, Mus musculus
cagaacacccaaggcttgatatttg

SEQ ID NO: 891476 - DNA, 25 bp, Mus musculus
cagaacacccaaggcttgatcttcg

SEQ ID NO: 891477 - DNA, 25 bp, Mus musculus
cagaacactcaacgtctgattttcg

SEQ ID NO: 891478 - DNA, 25 bp, Mus musculus
cagaacactcaaggtctgattttcg

SEQ ID NO: 891479 - DNA, 25 bp, Mus musculus
cagaacactgccaccatgaggtctg

SEQ ID NO: 891480 - DNA, 25 bp, Mus musculus
cagaacactggcaccatgaggtctg

SEQ ID NO: 891481 - DNA, 25 bp, Mus musculus
cagaacagctatggatttgccagct

SEQ ID NO: 891482 - DNA, 25 bp, Mus musculus
cagaacagctcttcctaaggcttac

SEQ ID NO: 891483 - DNA, 25 bp, Mus musculus
cagaacagctgttcctaaggcttac

SEQ ID NO: 891484 - DNA, 25 bp, Mus musculus
cagaacagctttggatttgccagct

SEQ ID NO: 891485 - DNA, 25 bp, Mus musculus
cagaacatgcagaaagaaatcctga

SEQ ID NO: 891486 - DNA, 25 bp, Mus musculus
cagaacatgcagtaagaaatcctga

SEQ ID NO: 891487 - DNA, 25 bp, Mus musculus
cagaacattcagctatttgatttca

SEQ ID NO: 891488 - DNA, 25 bp, Mus musculus
cagaacattcaggtatttgatttca

SEQ ID NO: 891489 - DNA, 25 bp, Mus musculus
cagaacattcggctccgggagtgtg

SEQ ID NO: 891490 - DNA, 25 bp, Mus musculus
cagaacattcgggtccgggagtgtg

SEQ ID NO: 891491 - DNA, 25 bp, Mus musculus
cagaaccatcctgacgcctgactac

SEQ ID NO: 891492 - DNA, 25 bp, Mus musculus
cagaaccatcctgaggcctgactac

SEQ ID NO: 891493 - DNA, 25 bp, Mus musculus
cagaacccagcccacacactggaag

SEQ ID NO: 891494 - DNA, 25 bp, Mus musculus
cagaacccaggccacacactggaag

SEQ ID NO: 891495 - DNA, 25 bp, Mus musculus
cagaacctcaagcagctgcgggaac

SEQ ID NO: 891496 - DNA, 25 bp, Mus musculus
cagaacctcaaggagctgcgggaac

SEQ ID NO: 891497 - DNA, 25 bp, Mus musculus
cagaacctttcaatcttcctgagct

SEQ ID NO: 891498 - DNA, 25 bp, Mus musculus
cagaacctttgaatcttcctgagct

SEQ ID NO: 891499 - DNA, 25 bp, Mus musculus
cagaacgcagatgtgaactttcacc

SEQ ID NO: 891500 - DNA, 25 bp, Mus musculus
cagaacgcagcctcaccctcgctca

SEQ ID NO: 891501 - DNA, 25 bp, Mus musculus
cagaacgcaggctcaccctcgctca

SEQ ID NO: 891502 - DNA, 25 bp, Mus musculus
cagaacgcagttgtgaactttcacc

SEQ ID NO: 891503 - DNA, 25 bp, Mus musculus
cagaacgctgctagtgaatggctgc

SEQ ID NO: 891504 - DNA, 25 bp, Mus musculus
cagaacgctgctcatttgaagacat

SEQ ID NO: 891505 - DNA, 25 bp, Mus musculus
cagaacgctgctgatttgaagacat

SEQ ID NO: 891506 - DNA, 25 bp, Mus musculus
cagaacgctgcttgtgaatggctgc

SEQ ID NO: 891507 - DNA, 25 bp, Mus musculus
cagaacggtttgaacgtccctgcat

SEQ ID NO: 891508 - DNA, 25 bp, Mus musculus
cagaacggtttgaaggtccctgcat

SEQ ID NO: 891509 - DNA, 25 bp, Mus musculus
cagaacgtccagccatgtgagacaa

SEQ ID NO: 891510 - DNA, 25 bp, Mus musculus
cagaacgtccaggcatgtgagacaa

SEQ ID NO: 891511 - DNA, 25 bp, Mus musculus
cagaactatcccctggtctccattg

SEQ ID NO: 891512 - DNA, 25 bp, Mus musculus
cagaactatcccgtggtctccattg

SEQ ID NO: 891513 - DNA, 25 bp, Mus musculus
cagaactatgagctagcctacccgg

SEQ ID NO: 891514 - DNA, 25 bp, Mus musculus
cagaactatgaggtagcctacccgg

SEQ ID NO: 891515 - DNA, 25 bp, Mus musculus
cagaactcacgccactatctggacc

SEQ ID NO: 891516 - DNA, 25 bp, Mus musculus
cagaactcacgccagtatctggacc

SEQ ID NO: 891517 - DNA, 25 bp, Mus musculus
cagaactcagatcaccacaatggag

SEQ ID NO: 891518 - DNA, 25 bp, Mus musculus
cagaactcagttcaccacaatggag

SEQ ID NO: 891519 - DNA, 25 bp, Mus musculus
cagaactcccacatgtatgcacata

SEQ ID NO: 891520 - DNA, 25 bp, Mus musculus
cagaactcccacttgtatgcacata

SEQ ID NO: 891521 - DNA, 25 bp, Mus musculus
cagaactgagagcttatgggccagg

SEQ ID NO: 891522 - DNA, 25 bp, Mus musculus
cagaactgagaggttatgggccagg

SEQ ID NO: 891523 - DNA, 25 bp, Mus musculus
cagaactggacagacgagtgtgaca

SEQ ID NO: 891524 - DNA, 25 bp, Mus musculus
cagaactggacagaggagtgtgaca

SEQ ID NO: 891525 - DNA, 25 bp, Mus musculus
cagaactggcaccacctagaaaatc

SEQ ID NO: 891526 - DNA, 25 bp, Mus musculus
cagaactggcaccagctagaaaatc

SEQ ID NO: 891527 - DNA, 25 bp, Mus musculus
cagaactggccacacaccttgttgc

SEQ ID NO: 891528 - DNA, 25 bp, Mus musculus
cagaactggccacatccgtctacct

SEQ ID NO: 891529 - DNA, 25 bp, Mus musculus
cagaactggccacccccctgccttt

SEQ ID NO: 891530 - DNA, 25 bp, Mus musculus
cagaactggccagacaccttgttgc

SEQ ID NO: 891531 - DNA, 25 bp, Mus musculus
cagaactggccagatccgtctacct

SEQ ID NO: 891532 - DNA, 25 bp, Mus musculus
cagaactggccagccccctgccttt

SEQ ID NO: 891533 - DNA, 25 bp, Mus musculus
cagaactgttagcaatgcgatgcag

SEQ ID NO: 891534 - DNA, 25 bp, Mus musculus
cagaactgttaggaatgcgatgcag

SEQ ID NO: 891535 - DNA, 25 bp, Mus musculus
cagaacttctcacacaattgacata

SEQ ID NO: 891536 - DNA, 25 bp, Mus musculus
cagaacttctcagacaattgacata

SEQ ID NO: 891537 - DNA, 25 bp, Mus musculus
cagaagaaaaatacatcgttaaagc

SEQ ID NO: 891538 - DNA, 25 bp, Mus musculus
cagaagaaaaattcatcgttaaagc

SEQ ID NO: 891539 - DNA, 25 bp, Mus musculus
cagaagaaagattatgtgcggacct

SEQ ID NO: 891540 - DNA, 25 bp, Mus musculus
cagaagaaagcattgtggaacaaac

SEQ ID NO: 891541 - DNA, 25 bp, Mus musculus
cagaagaaagcgctcaagaatttca

SEQ ID NO: 891542 - DNA, 25 bp, Mus musculus
cagaagaaagcggtcaagaatttca

SEQ ID NO: 891543 - DNA, 25 bp, Mus musculus
cagaagaaaggagaaccacatgaaa

SEQ ID NO: 891544 - DNA, 25 bp, Mus musculus
cagaagaaaggagatccacatgaaa

SEQ ID NO: 891545 - DNA, 25 bp, Mus musculus
cagaagaaaggattgtggaacaaac

SEQ ID NO: 891546 - DNA, 25 bp, Mus musculus
cagaagaaagtttatgtgcggacct

SEQ ID NO: 891547 - DNA, 25 bp, Mus musculus
cagaagaagacaacaacaagcagat

SEQ ID NO: 891548 - DNA, 25 bp, Mus musculus
cagaagaagacatcaacaagcagat

SEQ ID NO: 891549 - DNA, 25 bp, Mus musculus
cagaagaagcagcagtacctggagg

SEQ ID NO: 891550 - DNA, 25 bp, Mus musculus
cagaagaagcaggagtacctggagg

SEQ ID NO: 891551 - DNA, 25 bp, Mus musculus
cagaagacagcaacccgctttgaac

SEQ ID NO: 891552 - DNA, 25 bp, Mus musculus
cagaagacagccaccacggctattc

SEQ ID NO: 891553 - DNA, 25 bp, Mus musculus
cagaagacaggaacccgctttgaac

SEQ ID NO: 891554 - DNA, 25 bp, Mus musculus
cagaagacaggcaccacggctattc

SEQ ID NO: 891555 - DNA, 25 bp, Mus musculus
cagaagacatcaagtgctgtaacag

SEQ ID NO: 891556 - DNA, 25 bp, Mus musculus
cagaagacatcatgtgctgtaacag

SEQ ID NO: 891557 - DNA, 25 bp, Mus musculus
cagaagacatctacaaaaccgccca

SEQ ID NO: 891558 - DNA, 25 bp, Mus musculus
cagaagacatctactaaaccgccca

SEQ ID NO: 891559 - DNA, 25 bp, Mus musculus
cagaagacatgtcaccttctctgtc

SEQ ID NO: 891560 - DNA, 25 bp, Mus musculus
cagaagacatgtcagcttctctgtc

SEQ ID NO: 891561 - DNA, 25 bp, Mus musculus
cagaagaccataccaggcgcaattc

SEQ ID NO: 891562 - DNA, 25 bp, Mus musculus
cagaagaccatacgcgcaattcaga

SEQ ID NO: 891563 - DNA, 25 bp, Mus musculus
cagaagaccatagcaggcgcaattc

SEQ ID NO: 891564 - DNA, 25 bp, Mus musculus
cagaagaccataggcgcaattcaga

SEQ ID NO: 891565 - DNA, 25 bp, Mus musculus
cagaagaccccacccagcatgcgtc

SEQ ID NO: 891566 - DNA, 25 bp, Mus musculus
cagaagaccccaccgagcatgcgtc

SEQ ID NO: 891567 - DNA, 25 bp, Mus musculus
cagaagacctgcaacgacccagagc

SEQ ID NO: 891568 - DNA, 25 bp, Mus musculus
cagaagacctgcaaggacccagagc

SEQ ID NO: 891569 - DNA, 25 bp, Mus musculus
cagaagagaatacatattatggtgg

SEQ ID NO: 891570 - DNA, 25 bp, Mus musculus
cagaagagaatagatattatggtgg

SEQ ID NO: 891571 - DNA, 25 bp, Mus musculus
cagaagagagacacgatgaagatga

SEQ ID NO: 891572 - DNA, 25 bp, Mus musculus
cagaagagagtcacgatgaagatga

SEQ ID NO: 891573 - DNA, 25 bp, Mus musculus
cagaagatagtagaatcacagataa

SEQ ID NO: 891574 - DNA, 25 bp, Mus musculus
cagaagatagtagattcacagataa

SEQ ID NO: 891575 - DNA, 25 bp, Mus musculus
cagaagatgaagatgtctggtgaga

SEQ ID NO: 891576 - DNA, 25 bp, Mus musculus
cagaagatgaagttgtctggtgaga

SEQ ID NO: 891577 - DNA, 25 bp, Mus musculus
cagaagatggcacaatagtgattga

SEQ ID NO: 891578 - DNA, 25 bp, Mus musculus
cagaagatggcagaatagtgattga

SEQ ID NO: 891579 - DNA, 25 bp, Mus musculus
cagaagcaacaacgaggatctcagc

SEQ ID NO: 891580 - DNA, 25 bp, Mus musculus
cagaagcaacaaggaggatctcagc

SEQ ID NO: 891581 - DNA, 25 bp, Mus musculus
cagaagcaagcagttcacaggccgc

SEQ ID NO: 891582 - DNA, 25 bp, Mus musculus
cagaagcaaggagttcacaggccgc

SEQ ID NO: 891583 - DNA, 25 bp, Mus musculus
cagaagcacctcaaccagcagcagg

SEQ ID NO: 891584 - DNA, 25 bp, Mus musculus
cagaagcacctcaagcagcagcagg

SEQ ID NO: 891585 - DNA, 25 bp, Mus musculus
cagaagcagcagcgcacacatatga

SEQ ID NO: 891586 - DNA, 25 bp, Mus musculus
cagaagcagcagggcacacatatga

SEQ ID NO: 891587 - DNA, 25 bp, Mus musculus
cagaagccagcacatgtgttctgag

SEQ ID NO: 891588 - DNA, 25 bp, Mus musculus
cagaagccagcagatgtgttctgag

SEQ ID NO: 891589 - DNA, 25 bp, Mus musculus
cagaagccagcccctgacctcacct

SEQ ID NO: 891590 - DNA, 25 bp, Mus musculus
cagaagccaggccctgacctcacct

SEQ ID NO: 891591 - DNA, 25 bp, Mus musculus
cagaagccatttcacacgctaatgt

SEQ ID NO: 891592 - DNA, 25 bp, Mus musculus
cagaagccatttcagacgctaatgt

SEQ ID NO: 891593 - DNA, 25 bp, Mus musculus
cagaagcctcagcaacaaagtgaga

SEQ ID NO: 891594 - DNA, 25 bp, Mus musculus
cagaagcctcaggaacaaagtgaga

SEQ ID NO: 891595 - DNA, 25 bp, Mus musculus
cagaagcgagccattgacgtcactc

SEQ ID NO: 891596 - DNA, 25 bp, Mus musculus
cagaagcgaggcattgacgtcactc

SEQ ID NO: 891597 - DNA, 25 bp, Mus musculus
cagaagcgggccactccagtgaacc

SEQ ID NO: 891598 - DNA, 25 bp, Mus musculus
cagaagcggggcactccagtgaacc

SEQ ID NO: 891599 - DNA, 25 bp, Mus musculus
cagaagctagagcaggagcagaggc

SEQ ID NO: 891600 - DNA, 25 bp, Mus musculus
cagaagctagaggaggagcagaggc

SEQ ID NO: 891601 - DNA, 25 bp, Mus musculus
cagaagctgcgtctgaagaagatcc

SEQ ID NO: 891602 - DNA, 25 bp, Mus musculus
cagaagctgcgtgtgaagaagatcc

SEQ ID NO: 891603 - DNA, 25 bp, Mus musculus
cagaagctggagcaccttgaacttg

SEQ ID NO: 891604 - DNA, 25 bp, Mus musculus
cagaagctggagcagcttgaacttg

SEQ ID NO: 891605 - DNA, 25 bp, Mus musculus
cagaagctggaggacgccaagcaca

SEQ ID NO: 891606 - DNA, 25 bp, Mus musculus
cagaagctggaggaggccaagcaca

SEQ ID NO: 891607 - DNA, 25 bp, Mus musculus
cagaaggaagtaaaaatccatcgaa

SEQ ID NO: 891608 - DNA, 25 bp, Mus musculus
cagaaggaagtataaatccatcgaa

SEQ ID NO: 891609 - DNA, 25 bp, Mus musculus
cagaaggaatatgacaaagagagcc

SEQ ID NO: 891610 - DNA, 25 bp, Mus musculus
cagaaggaatatgagaaagagagcc

SEQ ID NO: 891611 - DNA, 25 bp, Mus musculus
cagaaggaattacacccgaagaagc

SEQ ID NO: 891612 - DNA, 25 bp, Mus musculus
cagaaggaattacagccgaagaagc

SEQ ID NO: 891613 - DNA, 25 bp, Mus musculus
cagaaggcacagatggacagatgga

SEQ ID NO: 891614 - DNA, 25 bp, Mus musculus
cagaaggcacagctgaaggagacaa

SEQ ID NO: 891615 - DNA, 25 bp, Mus musculus
cagaaggcacaggtgaaggagacaa

SEQ ID NO: 891616 - DNA, 25 bp, Mus musculus
cagaaggcacagttggacagatgga

SEQ ID NO: 891617 - DNA, 25 bp, Mus musculus
cagaaggcagagaactgtgccaagt

SEQ ID NO: 891618 - DNA, 25 bp, Mus musculus
cagaaggcagagtactgtgccaagt

SEQ ID NO: 891619 - DNA, 25 bp, Mus musculus
cagaaggccattgacgtgctgtctg

SEQ ID NO: 891620 - DNA, 25 bp, Mus musculus
cagaaggccattgaggtgctgtctg

SEQ ID NO: 891621 - DNA, 25 bp, Mus musculus
cagaagggacaactccttcggccca

SEQ ID NO: 891622 - DNA, 25 bp, Mus musculus
cagaagggacaactgcttcggccca

SEQ ID NO: 891623 - DNA, 25 bp, Mus musculus
cagaagggactgacaactcttgtct

SEQ ID NO: 891624 - DNA, 25 bp, Mus musculus
cagaagggactgcacccatacaata

SEQ ID NO: 891625 - DNA, 25 bp, Mus musculus
cagaagggactggacccatacaata

SEQ ID NO: 891626 - DNA, 25 bp, Mus musculus
cagaagggactgtcaactcttgtct

SEQ ID NO: 891627 - DNA, 25 bp, Mus musculus
cagaagggttagcatgatgctgttg

SEQ ID NO: 891628 - DNA, 25 bp, Mus musculus
cagaagggttaggatgatgctgttg

SEQ ID NO: 891629 - DNA, 25 bp, Mus musculus
cagaagtaagattggcctgttcgac

SEQ ID NO: 891630 - DNA, 25 bp, Mus musculus
cagaagtaagtttggcctgttcgac

SEQ ID NO: 891631 - DNA, 25 bp, Mus musculus
cagaagtatggaaacgacccaacag

SEQ ID NO: 891632 - DNA, 25 bp, Mus musculus
cagaagtatggaaaggacccaacag

SEQ ID NO: 891633 - DNA, 25 bp, Mus musculus
cagaagtcacagaaaccccgagact

SEQ ID NO: 891634 - DNA, 25 bp, Mus musculus
cagaagtcacagtaaccccgagact

SEQ ID NO: 891635 - DNA, 25 bp, Mus musculus
cagaagtcagaaagaaaaatgactt

SEQ ID NO: 891636 - DNA, 25 bp, Mus musculus
cagaagtcagaaagcacaatgtctc

SEQ ID NO: 891637 - DNA, 25 bp, Mus musculus
cagaagtcagaaattacacttgtga

SEQ ID NO: 891638 - DNA, 25 bp, Mus musculus
cagaagtcagtaagaaaaatgactt

SEQ ID NO: 891639 - DNA, 25 bp, Mus musculus
cagaagtcagtaagcacaatgtctc

SEQ ID NO: 891640 - DNA, 25 bp, Mus musculus
cagaagtcagtaattacacttgtga

SEQ ID NO: 891641 - DNA, 25 bp, Mus musculus
cagaagtgcattgacaaagaagtca

SEQ ID NO: 891642 - DNA, 25 bp, Mus musculus
cagaagtgcattgacagctgtctgt

SEQ ID NO: 891643 - DNA, 25 bp, Mus musculus
cagaagtgcattgagaaagaagtca

SEQ ID NO: 891644 - DNA, 25 bp, Mus musculus
cagaagtgcattgagagctgtctgt

SEQ ID NO: 891645 - DNA, 25 bp, Mus musculus
cagaagtgcctgacagaggagggcg

SEQ ID NO: 891646 - DNA, 25 bp, Mus musculus
cagaagtgcctgctcttgctcccag

SEQ ID NO: 891647 - DNA, 25 bp, Mus musculus
cagaagtgcctggtcttgctcccag

SEQ ID NO: 891648 - DNA, 25 bp, Mus musculus
cagaagtgcctgtcagaggagggcg

SEQ ID NO: 891649 - DNA, 25 bp, Mus musculus
cagaagtgtgcggacgcaggagcta

SEQ ID NO: 891650 - DNA, 25 bp, Mus musculus
cagaagtgtgcggaggcaggagcta

SEQ ID NO: 891651 - DNA, 25 bp, Mus musculus
cagaagtgttaacgtccaaaaatat

SEQ ID NO: 891652 - DNA, 25 bp, Mus musculus
cagaagtgttaaggtccaaaaatat

SEQ ID NO: 891653 - DNA, 25 bp, Mus musculus
cagaagttccggcctctggccgacg

SEQ ID NO: 891654 - DNA, 25 bp, Mus musculus
cagaagttccgggctctggccgacg

SEQ ID NO: 891655 - DNA, 25 bp, Mus musculus
cagaagttcctgcgtttgatgaaga

SEQ ID NO: 891656 - DNA, 25 bp, Mus musculus
cagaagttcctgggtttgatgaaga

SEQ ID NO: 891657 - DNA, 25 bp, Mus musculus
cagaagtttcctgacattttgtgta

SEQ ID NO: 891658 - DNA, 25 bp, Mus musculus
cagaagtttcctgagattttgtgta

SEQ ID NO: 891659 - DNA, 25 bp, Mus musculus
cagaagtttggcaacgaagcagaac

SEQ ID NO: 891660 - DNA, 25 bp, Mus musculus
cagaagtttggcaaggaagcagaac

SEQ ID NO: 891661 - DNA, 25 bp, Mus musculus
cagaagttttttgaatttggcagtc

SEQ ID NO: 891662 - DNA, 25 bp, Mus musculus
cagaagttttttgattttggcagtc

SEQ ID NO: 891663 - DNA, 25 bp, Mus musculus
cagaataaacagactgtgacagagc

SEQ ID NO: 891664 - DNA, 25 bp, Mus musculus
cagaataaacagtctgtgacagagc

SEQ ID NO: 891665 - DNA, 25 bp, Mus musculus
cagaataaccagctgctggtgggaa

SEQ ID NO: 891666 - DNA, 25 bp, Mus musculus
cagaataaccaggtgctggtgggaa

SEQ ID NO: 891667 - DNA, 25 bp, Mus musculus
cagaatactgcggtggctacatcct

SEQ ID NO: 891668 - DNA, 25 bp, Mus musculus
cagaatactggggtggctacatcct

SEQ ID NO: 891669 - DNA, 25 bp, Mus musculus
cagaatattcagattgaagaaattg

SEQ ID NO: 891670 - DNA, 25 bp, Mus musculus
cagaatattcagtttgaagaaattg

SEQ ID NO: 891671 - DNA, 25 bp, Mus musculus
cagaatcaaaagctggcagatgagg

SEQ ID NO: 891672 - DNA, 25 bp, Mus musculus
cagaatcaaaaggtggcagatgagg

SEQ ID NO: 891673 - DNA, 25 bp, Mus musculus
cagaatcacaaccagccagaccact

SEQ ID NO: 891674 - DNA, 25 bp, Mus musculus
cagaatcacagaaggaacaatgttg

SEQ ID NO: 891675 - DNA, 25 bp, Mus musculus
cagaatcacagatggaacaatgttg

SEQ ID NO: 891676 - DNA, 25 bp, Mus musculus
cagaatcacatccagccagaccact

SEQ ID NO: 891677 - DNA, 25 bp, Mus musculus
cagaatcagacacgaatctgcttga

SEQ ID NO: 891678 - DNA, 25 bp, Mus musculus
cagaatcagacacgtgatttgaact

SEQ ID NO: 891679 - DNA, 25 bp, Mus musculus
cagaatcagacaggaatctgcttga

SEQ ID NO: 891680 - DNA, 25 bp, Mus musculus
cagaatcagacaggtgatttgaact

SEQ ID NO: 891681 - DNA, 25 bp, Mus musculus
cagaatcagcaacacagacaccaaa

SEQ ID NO: 891682 - DNA, 25 bp, Mus musculus
cagaatcagcaagacagacaccaaa

SEQ ID NO: 891683 - DNA, 25 bp, Mus musculus
cagaatctatggctgaggaagatct

SEQ ID NO: 891684 - DNA, 25 bp, Mus musculus
cagaatctatgggtgaggaagatct

SEQ ID NO: 891685 - DNA, 25 bp, Mus musculus
cagaatctcctgcacctcccagaga

SEQ ID NO: 891686 - DNA, 25 bp, Mus musculus
cagaatctcctgcagctcccagaga

SEQ ID NO: 891687 - DNA, 25 bp, Mus musculus
cagaatctctgaccttcgttgcctt

SEQ ID NO: 891688 - DNA, 25 bp, Mus musculus
cagaatctctgagcttcgttgcctt

SEQ ID NO: 891689 - DNA, 25 bp, Mus musculus
cagaatgaaaagcaaagtgctttga

SEQ ID NO: 891690 - DNA, 25 bp, Mus musculus
cagaatgaaaaggaaagtgctttga

SEQ ID NO: 891691 - DNA, 25 bp, Mus musculus
cagaatgcaactcacacaaggacca

SEQ ID NO: 891692 - DNA, 25 bp, Mus musculus
cagaatgcaagtcacacaaggacca

SEQ ID NO: 891693 - DNA, 25 bp, Mus musculus
cagaatgcacagcaacgactaaggc

SEQ ID NO: 891694 - DNA, 25 bp, Mus musculus
cagaatgcacaggaacgactaaggc

SEQ ID NO: 891695 - DNA, 25 bp, Mus musculus
cagaatgctgtgcgcacactggatg

SEQ ID NO: 891696 - DNA, 25 bp, Mus musculus
cagaatgctgtgggcacactggatg

SEQ ID NO: 891697 - DNA, 25 bp, Mus musculus
cagaatgtgctgcacattctggagg

SEQ ID NO: 891698 - DNA, 25 bp, Mus musculus
cagaatgtgctgcagattctggagg

SEQ ID NO: 891699 - DNA, 25 bp, Mus musculus
cagaatgtgtaaatgtaaagtgtgg

SEQ ID NO: 891700 - DNA, 25 bp, Mus musculus
cagaatgtgtaattgtaaagtgtgg

SEQ ID NO: 891701 - DNA, 25 bp, Mus musculus
cagaattgctctcataagctggccc

SEQ ID NO: 891702 - DNA, 25 bp, Mus musculus
cagaattgctctgataagctggccc

SEQ ID NO: 891703 - DNA, 25 bp, Mus musculus
cagaattttccacttccagtgcaga

SEQ ID NO: 891704 - DNA, 25 bp, Mus musculus
cagaattttccagttccagtgcaga

SEQ ID NO: 891705 - DNA, 25 bp, Mus musculus
cagacaaaatcatacagcccatcca

SEQ ID NO: 891706 - DNA, 25 bp, Mus musculus
cagacaaaatcatagagcccatcca

SEQ ID NO: 891707 - DNA, 25 bp, Mus musculus
cagacaaatctgtccctagtggtgg

SEQ ID NO: 891708 - DNA, 25 bp, Mus musculus
cagacaaatctgtcgctagtggtgg

SEQ ID NO: 891709 - DNA, 25 bp, Mus musculus
cagacaacaaagacaatgggacatg

SEQ ID NO: 891710 - DNA, 25 bp, Mus musculus
cagacaacaaagtcaatgggacatg

SEQ ID NO: 891711 - DNA, 25 bp, Mus musculus
cagacaacctcacagatcgttacga

SEQ ID NO: 891712 - DNA, 25 bp, Mus musculus
cagacaacctgacagatcgttacga

SEQ ID NO: 891713 - DNA, 25 bp, Mus musculus
cagacaagaaggcaagcaagcctgg

SEQ ID NO: 891714 - DNA, 25 bp, Mus musculus
cagacaagaaggcaagcctggctgt

SEQ ID NO: 891715 - DNA, 25 bp, Mus musculus
cagacaagaagggaagcaagcctgg

SEQ ID NO: 891716 - DNA, 25 bp, Mus musculus
cagacaagaagggaagcctggctgt

SEQ ID NO: 891717 - DNA, 25 bp, Mus musculus
cagacaagacagcaaccctgaccca

SEQ ID NO: 891718 - DNA, 25 bp, Mus musculus
cagacaagacaggaaccctgaccca

SEQ ID NO: 891719 - DNA, 25 bp, Mus musculus
cagacaagagcctttcctggaaaat

SEQ ID NO: 891720 - DNA, 25 bp, Mus musculus
cagacaagagctaaagaagaagaat

SEQ ID NO: 891721 - DNA, 25 bp, Mus musculus
cagacaagaggctttcctggaaaat

SEQ ID NO: 891722 - DNA, 25 bp, Mus musculus
cagacaagaggtaaagaagaagaat

SEQ ID NO: 891723 - DNA, 25 bp, Mus musculus
cagacaagatcgattatttctccct

SEQ ID NO: 891724 - DNA, 25 bp, Mus musculus
cagacaagatggattatttctccct

SEQ ID NO: 891725 - DNA, 25 bp, Mus musculus
cagacaagttatcacggcaatggaa

SEQ ID NO: 891726 - DNA, 25 bp, Mus musculus
cagacaagttatgacggcaatggaa

SEQ ID NO: 891727 - DNA, 25 bp, Mus musculus
cagacacaagcacgtcagatgtacc

SEQ ID NO: 891728 - DNA, 25 bp, Mus musculus
cagacacaagcaggtcagatgtacc

SEQ ID NO: 891729 - DNA, 25 bp, Mus musculus
cagacacaagcattcccactatgtc

SEQ ID NO: 891730 - DNA, 25 bp, Mus musculus
cagacacaagcttcatcacgaggca

SEQ ID NO: 891731 - DNA, 25 bp, Mus musculus
cagacacaaggattcccactatgtc

SEQ ID NO: 891732 - DNA, 25 bp, Mus musculus
cagacacaaggttcatcacgaggca

SEQ ID NO: 891733 - DNA, 25 bp, Mus musculus
cagacacagctagacctttggatga

SEQ ID NO: 891734 - DNA, 25 bp, Mus musculus
cagacacagctagagctttggatga

SEQ ID NO: 891735 - DNA, 25 bp, Mus musculus
cagacaccagcaagcccctgaggaa

SEQ ID NO: 891736 - DNA, 25 bp, Mus musculus
cagacaccaggaagcccctgaggaa

SEQ ID NO: 891737 - DNA, 25 bp, Mus musculus
cagacacccaggcaacttctccagc

SEQ ID NO: 891738 - DNA, 25 bp, Mus musculus
cagacacccagggaacttctccagc

SEQ ID NO: 891739 - DNA, 25 bp, Mus musculus
cagacaccgctcctgtcttatctag

SEQ ID NO: 891740 - DNA, 25 bp, Mus musculus
cagacaccgctcgtgtcttatctag

SEQ ID NO: 891741 - DNA, 25 bp, Mus musculus
cagacaccggcacgtgggtaatgct

SEQ ID NO: 891742 - DNA, 25 bp, Mus musculus
cagacaccggcaggtgggtaatgct

SEQ ID NO: 891743 - DNA, 25 bp, Mus musculus
cagacacctgccagtgcttaatttc

SEQ ID NO: 891744 - DNA, 25 bp, Mus musculus
cagacacctgctcaacatggcgccg

SEQ ID NO: 891745 - DNA, 25 bp, Mus musculus
cagacacctggcagtgcttaatttc

SEQ ID NO: 891746 - DNA, 25 bp, Mus musculus
cagacacctggtcaacatggcgccg

SEQ ID NO: 891747 - DNA, 25 bp, Mus musculus
cagacacgattcaccaggtcctgta

SEQ ID NO: 891748 - DNA, 25 bp, Mus musculus
cagacacgattcacgaggtcctgta

SEQ ID NO: 891749 - DNA, 25 bp, Mus musculus
cagacacttctgaccatcttgaccg

SEQ ID NO: 891750 - DNA, 25 bp, Mus musculus
cagacacttctgacgatcttgaccg

SEQ ID NO: 891751 - DNA, 25 bp, Mus musculus
cagacagaaacccactcaccgccca

SEQ ID NO: 891752 - DNA, 25 bp, Mus musculus
cagacagaaacccagtcaccgccca

SEQ ID NO: 891753 - DNA, 25 bp, Mus musculus
cagacagaccggccatcctccttca

SEQ ID NO: 891754 - DNA, 25 bp, Mus musculus
cagacagaccgggcatcctccttca

SEQ ID NO: 891755 - DNA, 25 bp, Mus musculus
cagacagacgcgtccacctcaggaa

SEQ ID NO: 891756 - DNA, 25 bp, Mus musculus
cagacagacgggtccacctcaggaa

SEQ ID NO: 891757 - DNA, 25 bp, Mus musculus
cagacagctcttcctgtttccaaat

SEQ ID NO: 891758 - DNA, 25 bp, Mus musculus
cagacagctcttgctgtttccaaat

SEQ ID NO: 891759 - DNA, 25 bp, Mus musculus
cagacagctgcactgcttacagaca

SEQ ID NO: 891760 - DNA, 25 bp, Mus musculus
cagacagctgcagtgcttacagaca

SEQ ID NO: 891761 - DNA, 25 bp, Mus musculus
cagacaggagtgcgagtctgctggg

SEQ ID NO: 891762 - DNA, 25 bp, Mus musculus
cagacaggagtgggagtctgctggg

SEQ ID NO: 891763 - DNA, 25 bp, Mus musculus
cagacaggcagagtccagctcttcc

SEQ ID NO: 891764 - DNA, 25 bp, Mus musculus
cagacaggcagagtcctcttccgaa

SEQ ID NO: 891765 - DNA, 25 bp, Mus musculus
cagacaggcagagtgcagctcttcc

SEQ ID NO: 891766 - DNA, 25 bp, Mus musculus
cagacaggcagagtgctcttccgaa

SEQ ID NO: 891767 - DNA, 25 bp, Mus musculus
cagacaggtaacagtgtcagctgac

SEQ ID NO: 891768 - DNA, 25 bp, Mus musculus
cagacaggtaactgtgtcagctgac

SEQ ID NO: 891769 - DNA, 25 bp, Mus musculus
cagacagtccagcaggtgacaggaa

SEQ ID NO: 891770 - DNA, 25 bp, Mus musculus
cagacagtccaggaggtgacaggaa

SEQ ID NO: 891771 - DNA, 25 bp, Mus musculus
cagacagtggctgtccacccagctg

SEQ ID NO: 891772 - DNA, 25 bp, Mus musculus
cagacagtgggtgtccacccagctg

SEQ ID NO: 891773 - DNA, 25 bp, Mus musculus
cagacataggaacatcaccagcaaa

SEQ ID NO: 891774 - DNA, 25 bp, Mus musculus
cagacataggaagatcaccagcaaa

SEQ ID NO: 891775 - DNA, 25 bp, Mus musculus
cagacatatcaacgccagcaccaaa

SEQ ID NO: 891776 - DNA, 25 bp, Mus musculus
cagacatatcaaggccagcaccaaa

SEQ ID NO: 891777 - DNA, 25 bp, Mus musculus
cagacatcagaaaccttacaatcta

SEQ ID NO: 891778 - DNA, 25 bp, Mus musculus
cagacatcagaaagcacaatgggtc

SEQ ID NO: 891779 - DNA, 25 bp, Mus musculus
cagacatcagataatggaggtgact

SEQ ID NO: 891780 - DNA, 25 bp, Mus musculus
cagacatcagtaaccttacaatcta

SEQ ID NO: 891781 - DNA, 25 bp, Mus musculus
cagacatcagtaagcacaatgggtc

SEQ ID NO: 891782 - DNA, 25 bp, Mus musculus
cagacatcagttaatggaggtgact

SEQ ID NO: 891783 - DNA, 25 bp, Mus musculus
cagacatccatccgcgaggaaatct

SEQ ID NO: 891784 - DNA, 25 bp, Mus musculus
cagacatccatccgggaggaaatct

SEQ ID NO: 891785 - DNA, 25 bp, Mus musculus
cagacatctgcctcagcatgggact

SEQ ID NO: 891786 - DNA, 25 bp, Mus musculus
cagacatctggctcagcatgggact

SEQ ID NO: 891787 - DNA, 25 bp, Mus musculus
cagacatgacagcagggcttcgttt

SEQ ID NO: 891788 - DNA, 25 bp, Mus musculus
cagacatgacaggagggcttcgttt

SEQ ID NO: 891789 - DNA, 25 bp, Mus musculus
cagacatggagagcagcaaggagcc

SEQ ID NO: 891790 - DNA, 25 bp, Mus musculus
cagacatggagagctgcaaggagcc

SEQ ID NO: 891791 - DNA, 25 bp, Mus musculus
cagacatgtgatatcaggctccgag

SEQ ID NO: 891792 - DNA, 25 bp, Mus musculus
cagacatgtgttatcaggctccgag

SEQ ID NO: 891793 - DNA, 25 bp, Mus musculus
cagacattcagacccacaggcacca

SEQ ID NO: 891794 - DNA, 25 bp, Mus musculus
cagacattcagagccacaggcacca

SEQ ID NO: 891795 - DNA, 25 bp, Mus musculus
cagaccaaagatggatgcatctatg

SEQ ID NO: 891796 - DNA, 25 bp, Mus musculus
cagaccaaagttggatgcatctatg

SEQ ID NO: 891797 - DNA, 25 bp, Mus musculus
cagaccaagatggacgagatcgggc

SEQ ID NO: 891798 - DNA, 25 bp, Mus musculus
cagaccaagatggaggagatcgggc

SEQ ID NO: 891799 - DNA, 25 bp, Mus musculus
cagaccacagcacggcaacccagag

SEQ ID NO: 891800 - DNA, 25 bp, Mus musculus
cagaccacagcagggcaacccagag

SEQ ID NO: 891801 - DNA, 25 bp, Mus musculus
cagaccacagcttctcccctatggg

SEQ ID NO: 891802 - DNA, 25 bp, Mus musculus
cagaccacagctttgtccagagggg

SEQ ID NO: 891803 - DNA, 25 bp, Mus musculus
cagaccacaggttctcccctatggg

SEQ ID NO: 891804 - DNA, 25 bp, Mus musculus
cagaccacaggtttgtccagagggg

SEQ ID NO: 891805 - DNA, 25 bp, Mus musculus
cagaccacctatcagcaagtccctc

SEQ ID NO: 891806 - DNA, 25 bp, Mus musculus
cagaccacctatccaagtccctcca

SEQ ID NO: 891807 - DNA, 25 bp, Mus musculus
cagaccacctatgagcaagtccctc

SEQ ID NO: 891808 - DNA, 25 bp, Mus musculus
cagaccacctatgcaagtccctcca

SEQ ID NO: 891809 - DNA, 25 bp, Mus musculus
cagaccactgatgacagaggtcctc

SEQ ID NO: 891810 - DNA, 25 bp, Mus musculus
cagaccactgatgagagaggtcctc

SEQ ID NO: 891811 - DNA, 25 bp, Mus musculus
cagaccagcggcaaccctgagactg

SEQ ID NO: 891812 - DNA, 25 bp, Mus musculus
cagaccagcggcaagcctgagactg

SEQ ID NO: 891813 - DNA, 25 bp, Mus musculus
cagaccagtcactaagtgctgtgag

SEQ ID NO: 891814 - DNA, 25 bp, Mus musculus
cagaccagtcactatgtgctgtgag

SEQ ID NO: 891815 - DNA, 25 bp, Mus musculus
cagacccgagagggtgatcgtcgag

SEQ ID NO: 891816 - DNA, 25 bp, Mus musculus
cagacccgagtgggtgatcgtcgag

SEQ ID NO: 891817 - DNA, 25 bp, Mus musculus
cagaccgcacagcaaatgcaagaga

SEQ ID NO: 891818 - DNA, 25 bp, Mus musculus
cagaccgcacaggaaatgcaagaga

SEQ ID NO: 891819 - DNA, 25 bp, Mus musculus
cagacctaaccattcaggccacagt

SEQ ID NO: 891820 - DNA, 25 bp, Mus musculus
cagacctaacgattcaggccacagt

SEQ ID NO: 891821 - DNA, 25 bp, Mus musculus
cagacctcagaggcttggatgaagt

SEQ ID NO: 891822 - DNA, 25 bp, Mus musculus
cagacctcaggtctttagcatgagc

SEQ ID NO: 891823 - DNA, 25 bp, Mus musculus
cagacctcaggtgtttagcatgagc

SEQ ID NO: 891824 - DNA, 25 bp, Mus musculus
cagacctcagtggcttggatgaagt

SEQ ID NO: 891825 - DNA, 25 bp, Mus musculus
cagacctctgacaaggatgagagcg

SEQ ID NO: 891826 - DNA, 25 bp, Mus musculus
cagacctctgagcgaacatcccaac

SEQ ID NO: 891827 - DNA, 25 bp, Mus musculus
cagacctctgtcaaggatgagagcg

SEQ ID NO: 891828 - DNA, 25 bp, Mus musculus
cagacctctgtgcgaacatcccaac

SEQ ID NO: 891829 - DNA, 25 bp, Mus musculus
cagacctgccccaacggtctgaatc

SEQ ID NO: 891830 - DNA, 25 bp, Mus musculus
cagacctgccccaagggtctgaatc

SEQ ID NO: 891831 - DNA, 25 bp, Mus musculus
cagacgcagcaaacgtgcattttgg

SEQ ID NO: 891832 - DNA, 25 bp, Mus musculus
cagacgcagcaatcgtgcattttgg

SEQ ID NO: 891833 - DNA, 25 bp, Mus musculus
cagacgccagctagccttctctaca

SEQ ID NO: 891834 - DNA, 25 bp, Mus musculus
cagacgccagcttgccttctctaca

SEQ ID NO: 891835 - DNA, 25 bp, Mus musculus
cagacgctaacccacgagaacgtca

SEQ ID NO: 891836 - DNA, 25 bp, Mus musculus
cagacgctaacccaggagaacgtca

SEQ ID NO: 891837 - DNA, 25 bp, Mus musculus
cagacgcttgcaaacgtgtgccaat

SEQ ID NO: 891838 - DNA, 25 bp, Mus musculus
cagacgcttgcaaaggtgtgccaat

SEQ ID NO: 891839 - DNA, 25 bp, Mus musculus
cagacggtgacaaggttattgatga

SEQ ID NO: 891840 - DNA, 25 bp, Mus musculus
cagacggtgacatggttattgatga

SEQ ID NO: 891841 - DNA, 25 bp, Mus musculus
cagactaacaagattcttgtattct

SEQ ID NO: 891842 - DNA, 25 bp, Mus musculus
cagactaacaagtttcttgtattct

SEQ ID NO: 891843 - DNA, 25 bp, Mus musculus
cagactacagcgctcagcagagcac

SEQ ID NO: 891844 - DNA, 25 bp, Mus musculus
cagactacagcggtcagcagagcac

SEQ ID NO: 891845 - DNA, 25 bp, Mus musculus
cagactatcacactttcagctccag

SEQ ID NO: 891846 - DNA, 25 bp, Mus musculus
cagactatcacagtttcagctccag

SEQ ID NO: 891847 - DNA, 25 bp, Mus musculus
cagactcaagcctccttgtcagcgc

SEQ ID NO: 891848 - DNA, 25 bp, Mus musculus
cagactcaaggctccttgtcagcgc

SEQ ID NO: 891849 - DNA, 25 bp, Mus musculus
cagactccagaatggagaagatgac

SEQ ID NO: 891850 - DNA, 25 bp, Mus musculus
cagactccagtatggagaagatgac

SEQ ID NO: 891851 - DNA, 25 bp, Mus musculus
cagactccccagattctcaagggag

SEQ ID NO: 891852 - DNA, 25 bp, Mus musculus
cagactccccagtttctcaagggag

SEQ ID NO: 891853 - DNA, 25 bp, Mus musculus
cagactccctcacgagggagctctc

SEQ ID NO: 891854 - DNA, 25 bp, Mus musculus
cagactccctcaggagggagctctc

SEQ ID NO: 891855 - DNA, 25 bp, Mus musculus
cagactctagctggccgaggacccg

SEQ ID NO: 891856 - DNA, 25 bp, Mus musculus
cagactctagctgggcgaggacccg

SEQ ID NO: 891857 - DNA, 25 bp, Mus musculus
cagactctgccactcacagcagaga

SEQ ID NO: 891858 - DNA, 25 bp, Mus musculus
cagactctgccagtcacagcagaga

SEQ ID NO: 891859 - DNA, 25 bp, Mus musculus
cagactctgtagcatttgcaaattt

SEQ ID NO: 891860 - DNA, 25 bp, Mus musculus
cagactctgtaggatttgcaaattt

SEQ ID NO: 891861 - DNA, 25 bp, Mus musculus
cagactgatgcaactaacagacaga

SEQ ID NO: 891862 - DNA, 25 bp, Mus musculus
cagactgatgcatctaacagacaga

SEQ ID NO: 891863 - DNA, 25 bp, Mus musculus
cagactgcaaagcacaggctgtgcg

SEQ ID NO: 891864 - DNA, 25 bp, Mus musculus
cagactgcaaagcctgtgcgccccc

SEQ ID NO: 891865 - DNA, 25 bp, Mus musculus
cagactgcaaagctgaccagagcga

SEQ ID NO: 891866 - DNA, 25 bp, Mus musculus
cagactgcaaaggacaggctgtgcg

SEQ ID NO: 891867 - DNA, 25 bp, Mus musculus
cagactgcaaaggctgtgcgccccc

SEQ ID NO: 891868 - DNA, 25 bp, Mus musculus
cagactgcaaaggtgaccagagcga

SEQ ID NO: 891869 - DNA, 25 bp, Mus musculus
cagactgcagattcaggtcagagtt

SEQ ID NO: 891870 - DNA, 25 bp, Mus musculus
cagactgcagcctaggatgtcaggc

SEQ ID NO: 891871 - DNA, 25 bp, Mus musculus
cagactgcaggctaggatgtcaggc

SEQ ID NO: 891872 - DNA, 25 bp, Mus musculus
cagactgcagtttcaggtcagagtt

SEQ ID NO: 891873 - DNA, 25 bp, Mus musculus
cagactgccctgcacgacaagaaag

SEQ ID NO: 891874 - DNA, 25 bp, Mus musculus
cagactgccctgcaggacaagaaag

SEQ ID NO: 891875 - DNA, 25 bp, Mus musculus
cagactgctaagccctccagtgaag

SEQ ID NO: 891876 - DNA, 25 bp, Mus musculus
cagactgctaaggcctccagtgaag

SEQ ID NO: 891877 - DNA, 25 bp, Mus musculus
cagactgctttttactggtgatcat

SEQ ID NO: 891878 - DNA, 25 bp, Mus musculus
cagactgctttttagtggtgatcat

SEQ ID NO: 891879 - DNA, 25 bp, Mus musculus
cagactggagccattctggaattta

SEQ ID NO: 891880 - DNA, 25 bp, Mus musculus
cagactggaggcattctggaattta

SEQ ID NO: 891881 - DNA, 25 bp, Mus musculus
cagactgtgtatatagttctggata

SEQ ID NO: 891882 - DNA, 25 bp, Mus musculus
cagactgtgtatattgttctggata

SEQ ID NO: 891883 - DNA, 25 bp, Mus musculus
cagacttcatggaccccctggttgc

SEQ ID NO: 891884 - DNA, 25 bp, Mus musculus
cagacttcatggacgccctggttgc

SEQ ID NO: 891885 - DNA, 25 bp, Mus musculus
cagacttcccacagtctctgaacta

SEQ ID NO: 891886 - DNA, 25 bp, Mus musculus
cagacttcccactgtctctgaacta

SEQ ID NO: 891887 - DNA, 25 bp, Mus musculus
cagacttctaagccctctcctgcag

SEQ ID NO: 891888 - DNA, 25 bp, Mus musculus
cagacttctaaggcctctcctgcag

SEQ ID NO: 891889 - DNA, 25 bp, Mus musculus
cagacttctgcaaattcatcaattg

SEQ ID NO: 891890 - DNA, 25 bp, Mus musculus
cagacttctgcatattcatcaattg

SEQ ID NO: 891891 - DNA, 25 bp, Mus musculus
cagacttctgcgcttaaggtgatgg

SEQ ID NO: 891892 - DNA, 25 bp, Mus musculus
cagacttctgggcttaaggtgatgg

SEQ ID NO: 891893 - DNA, 25 bp, Mus musculus
cagactttgccacctcctttaagat

SEQ ID NO: 891894 - DNA, 25 bp, Mus musculus
cagactttgccagctcctttaagat

SEQ ID NO: 891895 - DNA, 25 bp, Mus musculus
cagactttggaccaaagacccagcc

SEQ ID NO: 891896 - DNA, 25 bp, Mus musculus
cagactttggaccaactgttctcag

SEQ ID NO: 891897 - DNA, 25 bp, Mus musculus
cagactttggaccatagacccagcc

SEQ ID NO: 891898 - DNA, 25 bp, Mus musculus
cagactttggaccatctgttctcag

SEQ ID NO: 891899 - DNA, 25 bp, Mus musculus
cagagaaaaacgcctcttgcttctt

SEQ ID NO: 891900 - DNA, 25 bp, Mus musculus
cagagaaaaacggctcttgcttctt

SEQ ID NO: 891901 - DNA, 25 bp, Mus musculus
cagagaaaatgacttgccaaaaggc

SEQ ID NO: 891902 - DNA, 25 bp, Mus musculus
cagagaaaatgagttgccaaaaggc

SEQ ID NO: 891903 - DNA, 25 bp, Mus musculus
cagagaaactgtgtcactacttctc

SEQ ID NO: 891904 - DNA, 25 bp, Mus musculus
cagagaaactgtgtgactacttctc

SEQ ID NO: 891905 - DNA, 25 bp, Mus musculus
cagagaaatggacagaagcccggga

SEQ ID NO: 891906 - DNA, 25 bp, Mus musculus
cagagaaatggagagaagcccggga

SEQ ID NO: 891907 - DNA, 25 bp, Mus musculus
cagagaactgcttgaacagatggat

SEQ ID NO: 891908 - DNA, 25 bp, Mus musculus
cagagaactggttgaacagatggat

SEQ ID NO: 891909 - DNA, 25 bp, Mus musculus
cagagaagaactgaccattaatcga

SEQ ID NO: 891910 - DNA, 25 bp, Mus musculus
cagagaagaagtgaccattaatcga

SEQ ID NO: 891911 - DNA, 25 bp, Mus musculus
cagagaagagcaaggaaagcaatga

SEQ ID NO: 891912 - DNA, 25 bp, Mus musculus
cagagaagaggaaggaaagcaatga

SEQ ID NO: 891913 - DNA, 25 bp, Mus musculus
cagagaagcagacgaagcccatgat

SEQ ID NO: 891914 - DNA, 25 bp, Mus musculus
cagagaagcagaggaagcccatgat

SEQ ID NO: 891915 - DNA, 25 bp, Mus musculus
cagagaagccagcttacaaactacc

SEQ ID NO: 891916 - DNA, 25 bp, Mus musculus
cagagaagccaggttacaaactacc

SEQ ID NO: 891917 - DNA, 25 bp, Mus musculus
cagagaagtcaacggcaaggcatct

SEQ ID NO: 891918 - DNA, 25 bp, Mus musculus
cagagaagtcaagggcaaggcatct

SEQ ID NO: 891919 - DNA, 25 bp, Mus musculus
cagagaagtcatcacgcagctcttg

SEQ ID NO: 891920 - DNA, 25 bp, Mus musculus
cagagaagtcatcaggcagctcttg

SEQ ID NO: 891921 - DNA, 25 bp, Mus musculus
cagagaagtccacgaagatgggctc

SEQ ID NO: 891922 - DNA, 25 bp, Mus musculus
cagagaagtccaggaagatgggctc

SEQ ID NO: 891923 - DNA, 25 bp, Mus musculus
cagagaatcgtgcataccatcgaca

SEQ ID NO: 891924 - DNA, 25 bp, Mus musculus
cagagaatcgtggataccatcgaca

SEQ ID NO: 891925 - DNA, 25 bp, Mus musculus
cagagaatgaagcccgcagagaagg

SEQ ID NO: 891926 - DNA, 25 bp, Mus musculus
cagagaatgaaggccgcagagaagg

SEQ ID NO: 891927 - DNA, 25 bp, Mus musculus
cagagaatttcacgaatagtggtct

SEQ ID NO: 891928 - DNA, 25 bp, Mus musculus
cagagaatttcaggaatagtggtct

SEQ ID NO: 891929 - DNA, 25 bp, Mus musculus
cagagacaagcgagagcctggacaa

SEQ ID NO: 891930 - DNA, 25 bp, Mus musculus
cagagacaagctccactgggcagcc

SEQ ID NO: 891931 - DNA, 25 bp, Mus musculus
cagagacaagggagagcctggacaa

SEQ ID NO: 891932 - DNA, 25 bp, Mus musculus
cagagacaaggtccactgggcagcc

SEQ ID NO: 891933 - DNA, 25 bp, Mus musculus
cagagacatgcaagtctgtcacctg

SEQ ID NO: 891934 - DNA, 25 bp, Mus musculus
cagagacatgcatgtctgtcacctg

SEQ ID NO: 891935 - DNA, 25 bp, Mus musculus
cagagaccagctctttggccagtat

SEQ ID NO: 891936 - DNA, 25 bp, Mus musculus
cagagaccaggtctttggccagtat

SEQ ID NO: 891937 - DNA, 25 bp, Mus musculus
cagagacccacaccacgactactgt

SEQ ID NO: 891938 - DNA, 25 bp, Mus musculus
cagagacccacacctcgactactgt

SEQ ID NO: 891939 - DNA, 25 bp, Mus musculus
cagagaccgcttcgcgaatgaaggc

SEQ ID NO: 891940 - DNA, 25 bp, Mus musculus
cagagaccgcttcgggaatgaaggc

SEQ ID NO: 891941 - DNA, 25 bp, Mus musculus
cagagacctcaacgctgaaaatctg

SEQ ID NO: 891942 - DNA, 25 bp, Mus musculus
cagagacctcaaggctgaaaatctg

SEQ ID NO: 891943 - DNA, 25 bp, Mus musculus
cagagacgtcgcaacctcatcaaac

SEQ ID NO: 891944 - DNA, 25 bp, Mus musculus
cagagacgtcgcaagctcatcaaac

SEQ ID NO: 891945 - DNA, 25 bp, Mus musculus
cagagagagccgaagccgaaagcgg

SEQ ID NO: 891946 - DNA, 25 bp, Mus musculus
cagagagagccgaatattaattaac

SEQ ID NO: 891947 - DNA, 25 bp, Mus musculus
cagagagagccgtagccgaaagcgg

SEQ ID NO: 891948 - DNA, 25 bp, Mus musculus
cagagagagccgtatattaattaac

SEQ ID NO: 891949 - DNA, 25 bp, Mus musculus
cagagagatcctcaagttcaaagag

SEQ ID NO: 891950 - DNA, 25 bp, Mus musculus
cagagagatcctcatgttcaaagag

SEQ ID NO: 891951 - DNA, 25 bp, Mus musculus
cagagagatgaaatgctcccactgc

SEQ ID NO: 891952 - DNA, 25 bp, Mus musculus
cagagagatgaaggcgcagcagaaa

SEQ ID NO: 891953 - DNA, 25 bp, Mus musculus
cagagagatgaaggggcagcagaaa

SEQ ID NO: 891954 - DNA, 25 bp, Mus musculus
cagagagatgcacgtaacccctcta

SEQ ID NO: 891955 - DNA, 25 bp, Mus musculus
cagagagatgcactatgacttctcc

SEQ ID NO: 891956 - DNA, 25 bp, Mus musculus
cagagagatgcaggtaacccctcta

SEQ ID NO: 891957 - DNA, 25 bp, Mus musculus
cagagagatgcagtatgacttctcc

SEQ ID NO: 891958 - DNA, 25 bp, Mus musculus
cagagagatgtaatgctcccactgc

SEQ ID NO: 891959 - DNA, 25 bp, Mus musculus
cagagagcagaattgactttgggat

SEQ ID NO: 891960 - DNA, 25 bp, Mus musculus
cagagagcagattctgccctttcct

SEQ ID NO: 891961 - DNA, 25 bp, Mus musculus
cagagagcagtattgactttgggat

SEQ ID NO: 891962 - DNA, 25 bp, Mus musculus
cagagagcagtttctgccctttcct

SEQ ID NO: 891963 - DNA, 25 bp, Mus musculus
cagagagccagctgcgtggccttgg

SEQ ID NO: 891964 - DNA, 25 bp, Mus musculus
cagagagccagctgggtggccttgg

SEQ ID NO: 891965 - DNA, 25 bp, Mus musculus
cagagagcggagctctccggccaaa

SEQ ID NO: 891966 - DNA, 25 bp, Mus musculus
cagagagcggaggtctccggccaaa

SEQ ID NO: 891967 - DNA, 25 bp, Mus musculus
cagagagctgtgaacacatcaacga

SEQ ID NO: 891968 - DNA, 25 bp, Mus musculus
cagagagctgtgaagacatcaacga

SEQ ID NO: 891969 - DNA, 25 bp, Mus musculus
cagagaggagcttttttcgccgtgg

SEQ ID NO: 891970 - DNA, 25 bp, Mus musculus
cagagaggaggttttttcgccgtgg

SEQ ID NO: 891971 - DNA, 25 bp, Mus musculus
cagagaggcccacgtctgctctggc

SEQ ID NO: 891972 - DNA, 25 bp, Mus musculus
cagagaggcccaggtctgctctggc

SEQ ID NO: 891973 - DNA, 25 bp, Mus musculus
cagagaggttcacatctctgctccc

SEQ ID NO: 891974 - DNA, 25 bp, Mus musculus
cagagaggttcagatctctgctccc

SEQ ID NO: 891975 - DNA, 25 bp, Mus musculus
cagagagtaagaactgtgccaagtg

SEQ ID NO: 891976 - DNA, 25 bp, Mus musculus
cagagagtaagatctgtgccaagtg

SEQ ID NO: 891977 - DNA, 25 bp, Mus musculus
cagagagtcgccgtccctacagccg

SEQ ID NO: 891978 - DNA, 25 bp, Mus musculus
cagagagtcgcgtctgagtgcccgg

SEQ ID NO: 891979 - DNA, 25 bp, Mus musculus
cagagagtcggcgtccctacagccg

SEQ ID NO: 891980 - DNA, 25 bp, Mus musculus
cagagagtcgggtctgagtgcccgg

SEQ ID NO: 891981 - DNA, 25 bp, Mus musculus
cagagatcagcaagccaagctgtct

SEQ ID NO: 891982 - DNA, 25 bp, Mus musculus
cagagatcagccaagctgtctgaaa

SEQ ID NO: 891983 - DNA, 25 bp, Mus musculus
cagagatcaggaagccaagctgtct

SEQ ID NO: 891984 - DNA, 25 bp, Mus musculus
cagagatcaggcaagctgtctgaaa

SEQ ID NO: 891985 - DNA, 25 bp, Mus musculus
cagagatccaccaagtccctattct

SEQ ID NO: 891986 - DNA, 25 bp, Mus musculus
cagagatccacctagtccctattct

SEQ ID NO: 891987 - DNA, 25 bp, Mus musculus
cagagatgacagctttgtggtggca

SEQ ID NO: 891988 - DNA, 25 bp, Mus musculus
cagagatgacaggtttgtggtggca

SEQ ID NO: 891989 - DNA, 25 bp, Mus musculus
cagagatgagacaaggaatgagtgt

SEQ ID NO: 891990 - DNA, 25 bp, Mus musculus
cagagatgagtcaaggaatgagtgt

SEQ ID NO: 891991 - DNA, 25 bp, Mus musculus
cagagatggagacgctggaatgaca

SEQ ID NO: 891992 - DNA, 25 bp, Mus musculus
cagagatggagaggctggaatgaca

SEQ ID NO: 891993 - DNA, 25 bp, Mus musculus
cagagattggaccggatatcctaca

SEQ ID NO: 891994 - DNA, 25 bp, Mus musculus
cagagattggacgggatatcctaca

SEQ ID NO: 891995 - DNA, 25 bp, Mus musculus
cagagattttatctccgaatgacaa

SEQ ID NO: 891996 - DNA, 25 bp, Mus musculus
cagagattttttctccgaatgacaa

SEQ ID NO: 891997 - DNA, 25 bp, Mus musculus
cagagcaaagaacctgctgagtctg

SEQ ID NO: 891998 - DNA, 25 bp, Mus musculus
cagagcaaagcaatccagactggca

SEQ ID NO: 891999 - DNA, 25 bp, Mus musculus
cagagcaaagctggagaacgaggtt

SEQ ID NO: 892000 - DNA, 25 bp, Mus musculus
cagagcaaaggaatccagactggca

SEQ ID NO: 892001 - DNA, 25 bp, Mus musculus
cagagcaaagggcggctctactaca

SEQ ID NO: 892002 - DNA, 25 bp, Mus musculus
cagagcaaaggggggctctactaca

SEQ ID NO: 892003 - DNA, 25 bp, Mus musculus
cagagcaaaggtggagaacgaggtt

SEQ ID NO: 892004 - DNA, 25 bp, Mus musculus
cagagcaaagtacctgctgagtctg

SEQ ID NO: 892005 - DNA, 25 bp, Mus musculus
cagagcaagaagcagagcgtggcaa

SEQ ID NO: 892006 - DNA, 25 bp, Mus musculus
cagagcaagaaggagagcgtggcaa

SEQ ID NO: 892007 - DNA, 25 bp, Mus musculus
cagagcaaggactataatgatgact

SEQ ID NO: 892008 - DNA, 25 bp, Mus musculus
cagagcaaggtctataatgatgact

SEQ ID NO: 892009 - DNA, 25 bp, Mus musculus
cagagcacagaggctcctccaagtg

SEQ ID NO: 892010 - DNA, 25 bp, Mus musculus
cagagcacagctgcctggatcctga

SEQ ID NO: 892011 - DNA, 25 bp, Mus musculus
cagagcacagcttattaaaagcaat

SEQ ID NO: 892012 - DNA, 25 bp, Mus musculus
cagagcacaggtgcctggatcctga

SEQ ID NO: 892013 - DNA, 25 bp, Mus musculus
cagagcacaggttattaaaagcaat

SEQ ID NO: 892014 - DNA, 25 bp, Mus musculus
cagagcacagtggctcctccaagtg

SEQ ID NO: 892015 - DNA, 25 bp, Mus musculus
cagagcacccagccttccactgctg

SEQ ID NO: 892016 - DNA, 25 bp, Mus musculus
cagagcacccaggcttccactgctg

SEQ ID NO: 892017 - DNA, 25 bp, Mus musculus
cagagcaccctgcactacattgcag

SEQ ID NO: 892018 - DNA, 25 bp, Mus musculus
cagagcaccctggactacattgcag

SEQ ID NO: 892019 - DNA, 25 bp, Mus musculus
cagagcaccggagccatcccagcca

SEQ ID NO: 892020 - DNA, 25 bp, Mus musculus
cagagcaccggagcgatcccagcca

SEQ ID NO: 892021 - DNA, 25 bp, Mus musculus
cagagcagagaggaggtggaccacc

SEQ ID NO: 892022 - DNA, 25 bp, Mus musculus
cagagcagagtggaggtggaccacc

SEQ ID NO: 892023 - DNA, 25 bp, Mus musculus
cagagcagatggcatgagccggcag

SEQ ID NO: 892024 - DNA, 25 bp, Mus musculus
cagagcagatgggatgagccggcag

SEQ ID NO: 892025 - DNA, 25 bp, Mus musculus
cagagcaggcggcactgtcctgtgc

SEQ ID NO: 892026 - DNA, 25 bp, Mus musculus
cagagcaggcgggactgtcctgtgc

SEQ ID NO: 892027 - DNA, 25 bp, Mus musculus
cagagcagtgagcagtgggagacat

SEQ ID NO: 892028 - DNA, 25 bp, Mus musculus
cagagcagtgagcataccgctattg

SEQ ID NO: 892029 - DNA, 25 bp, Mus musculus
cagagcagtgaggagtgggagacat

SEQ ID NO: 892030 - DNA, 25 bp, Mus musculus
cagagcagtgaggataccgctattg

SEQ ID NO: 892031 - DNA, 25 bp, Mus musculus
cagagcatcacgaaatagatatgat

SEQ ID NO: 892032 - DNA, 25 bp, Mus musculus
cagagcatcacgccagtagaaatag

SEQ ID NO: 892033 - DNA, 25 bp, Mus musculus
cagagcatcacggcagtagaaatag

SEQ ID NO: 892034 - DNA, 25 bp, Mus musculus
cagagcatcacgtaatagatatgat

SEQ ID NO: 892035 - DNA, 25 bp, Mus musculus
cagagcatgggtcacgttttctact

SEQ ID NO: 892036 - DNA, 25 bp, Mus musculus
cagagcatgggtcaggttttctact

SEQ ID NO: 892037 - DNA, 25 bp, Mus musculus
cagagccaagcacttacgcctggtg

SEQ ID NO: 892038 - DNA, 25 bp, Mus musculus
cagagccaaggacttacgcctggtg

SEQ ID NO: 892039 - DNA, 25 bp, Mus musculus
cagagccacgctcaagatgctgaat

SEQ ID NO: 892040 - DNA, 25 bp, Mus musculus
cagagccacggtcaagatgctgaat

SEQ ID NO: 892041 - DNA, 25 bp, Mus musculus
cagagccagccctccgcttactggc

SEQ ID NO: 892042 - DNA, 25 bp, Mus musculus
cagagccagccctcggcttactggc

SEQ ID NO: 892043 - DNA, 25 bp, Mus musculus
cagagccagggaagggcaatgcgag

SEQ ID NO: 892044 - DNA, 25 bp, Mus musculus
cagagccagggatgggcaatgcgag

SEQ ID NO: 892045 - DNA, 25 bp, Mus musculus
cagagccatcaccccaaacaggcca

SEQ ID NO: 892046 - DNA, 25 bp, Mus musculus
cagagccatcacccgaaacaggcca

SEQ ID NO: 892047 - DNA, 25 bp, Mus musculus
cagagccatgatccctttgcccctg

SEQ ID NO: 892048 - DNA, 25 bp, Mus musculus
cagagccatgtacaaccaggcccaa

SEQ ID NO: 892049 - DNA, 25 bp, Mus musculus
cagagccatgtagaaccaggcccaa

SEQ ID NO: 892050 - DNA, 25 bp, Mus musculus
cagagccatgttccctttgcccctg

SEQ ID NO: 892051 - DNA, 25 bp, Mus musculus
cagagcccttcacgaactctgcctg

SEQ ID NO: 892052 - DNA, 25 bp, Mus musculus
cagagcccttcaggaactctgcctg

SEQ ID NO: 892053 - DNA, 25 bp, Mus musculus
cagagcctctagcccctaggaccat

SEQ ID NO: 892054 - DNA, 25 bp, Mus musculus
cagagcctctaggccctaggaccat

SEQ ID NO: 892055 - DNA, 25 bp, Mus musculus
cagagccttctcctcaaacactgtg

SEQ ID NO: 892056 - DNA, 25 bp, Mus musculus
cagagccttctcctgaaacactgtg

SEQ ID NO: 892057 - DNA, 25 bp, Mus musculus
cagagcggcttccgccagctgtgcc

SEQ ID NO: 892058 - DNA, 25 bp, Mus musculus
cagagcggcttccggcagctgtgcc

SEQ ID NO: 892059 - DNA, 25 bp, Mus musculus
cagagctaacagcacgaagaggagg

SEQ ID NO: 892060 - DNA, 25 bp, Mus musculus
cagagctaacaggacgaagaggagg

SEQ ID NO: 892061 - DNA, 25 bp, Mus musculus
cagagctaagaatgtgagactatca

SEQ ID NO: 892062 - DNA, 25 bp, Mus musculus
cagagctaagtatgtgagactatca

SEQ ID NO: 892063 - DNA, 25 bp, Mus musculus
cagagctactttcacgtgctgtgca

SEQ ID NO: 892064 - DNA, 25 bp, Mus musculus
cagagctactttcaggtgctgtgca

SEQ ID NO: 892065 - DNA, 25 bp, Mus musculus
cagagctaggaagacgtcagccatg

SEQ ID NO: 892066 - DNA, 25 bp, Mus musculus
cagagctaggaagaggtcagccatg

SEQ ID NO: 892067 - DNA, 25 bp, Mus musculus
cagagctattgcaccgatggtgaac

SEQ ID NO: 892068 - DNA, 25 bp, Mus musculus
cagagctattgcacggatggtgaac

SEQ ID NO: 892069 - DNA, 25 bp, Mus musculus
cagagctcaaagcgaagctaacagg

SEQ ID NO: 892070 - DNA, 25 bp, Mus musculus
cagagctcaaagggaagctaacagg

SEQ ID NO: 892071 - DNA, 25 bp, Mus musculus
cagagctcagcatttctggtaggtc

SEQ ID NO: 892072 - DNA, 25 bp, Mus musculus
cagagctcaggatttctggtaggtc

SEQ ID NO: 892073 - DNA, 25 bp, Mus musculus
cagagctcgggacgtacagtggtcc

SEQ ID NO: 892074 - DNA, 25 bp, Mus musculus
cagagctcgggacgttcccgtgaga

SEQ ID NO: 892075 - DNA, 25 bp, Mus musculus
cagagctcgggaggtacagtggtcc

SEQ ID NO: 892076 - DNA, 25 bp, Mus musculus
cagagctcgggaggttcccgtgaga

SEQ ID NO: 892077 - DNA, 25 bp, Mus musculus
cagagctctttgatgacttgggtgt

SEQ ID NO: 892078 - DNA, 25 bp, Mus musculus
cagagctctttgttgacttgggtgt

SEQ ID NO: 892079 - DNA, 25 bp, Mus musculus
cagagctggtacagaatgctgtgtc

SEQ ID NO: 892080 - DNA, 25 bp, Mus musculus
cagagctggtacagtatgctgtgtc

SEQ ID NO: 892081 - DNA, 25 bp, Mus musculus
cagagctgtgagcccttgagagtga

SEQ ID NO: 892082 - DNA, 25 bp, Mus musculus
cagagctgtgaggccttgagagtga

SEQ ID NO: 892083 - DNA, 25 bp, Mus musculus
cagagcttcccacgtctctttgagc

SEQ ID NO: 892084 - DNA, 25 bp, Mus musculus
cagagcttcccaggtctctttgagc

SEQ ID NO: 892085 - DNA, 25 bp, Mus musculus
cagagcttctcgctgtggatcatat

SEQ ID NO: 892086 - DNA, 25 bp, Mus musculus
cagagcttctcggtgtggatcatat

SEQ ID NO: 892087 - DNA, 25 bp, Mus musculus
cagaggaaaaagaagccctcctgcc

SEQ ID NO: 892088 - DNA, 25 bp, Mus musculus
cagaggaaaatccacgaactcagca

SEQ ID NO: 892089 - DNA, 25 bp, Mus musculus
cagaggaaaatccaggaactcagca

SEQ ID NO: 892090 - DNA, 25 bp, Mus musculus
cagaggaaaatgaagccctcctgcc

SEQ ID NO: 892091 - DNA, 25 bp, Mus musculus
cagaggaaagagaacgtctgggccc

SEQ ID NO: 892092 - DNA, 25 bp, Mus musculus
cagaggaaagagaaggtctgggccc

SEQ ID NO: 892093 - DNA, 25 bp, Mus musculus
cagaggaaagagagaaagtccaagt

SEQ ID NO: 892094 - DNA, 25 bp, Mus musculus
cagaggaaagcaaaaacatgcagag

SEQ ID NO: 892095 - DNA, 25 bp, Mus musculus
cagaggaaaggaaaaacatgcagag

SEQ ID NO: 892096 - DNA, 25 bp, Mus musculus
cagaggaaagtgagaaagtccaagt

SEQ ID NO: 892097 - DNA, 25 bp, Mus musculus
cagaggaagagagacgagtgaccat

SEQ ID NO: 892098 - DNA, 25 bp, Mus musculus
cagaggaagagagaggagtgaccat

SEQ ID NO: 892099 - DNA, 25 bp, Mus musculus
cagaggaaggaagacgtttatggga

SEQ ID NO: 892100 - DNA, 25 bp, Mus musculus
cagaggaaggaagaggtttatggga

SEQ ID NO: 892101 - DNA, 25 bp, Mus musculus
cagaggaaggagcaaatcttcctga

SEQ ID NO: 892102 - DNA, 25 bp, Mus musculus
cagaggaaggaggaaatcttcctga

SEQ ID NO: 892103 - DNA, 25 bp, Mus musculus
cagaggaagtagacaatcctcctga

SEQ ID NO: 892104 - DNA, 25 bp, Mus musculus
cagaggaagtagtcaatcctcctga

SEQ ID NO: 892105 - DNA, 25 bp, Mus musculus
cagaggaatggcctactcagttcgt

SEQ ID NO: 892106 - DNA, 25 bp, Mus musculus
cagaggaatggcgtactcagttcgt

SEQ ID NO: 892107 - DNA, 25 bp, Mus musculus
cagaggacaactcttcgttgagtac

SEQ ID NO: 892108 - DNA, 25 bp, Mus musculus
cagaggacaagtcttcgttgagtac

SEQ ID NO: 892109 - DNA, 25 bp, Mus musculus
cagaggacagcaccaggaaagatgg

SEQ ID NO: 892110 - DNA, 25 bp, Mus musculus
cagaggacagcacgaaagatggtcc

SEQ ID NO: 892111 - DNA, 25 bp, Mus musculus
cagaggacagcacggaaggtgtgaa

SEQ ID NO: 892112 - DNA, 25 bp, Mus musculus
cagaggacagcacgtgtgaacctga

SEQ ID NO: 892113 - DNA, 25 bp, Mus musculus
cagaggacagcagcaggaaagatgg

SEQ ID NO: 892114 - DNA, 25 bp, Mus musculus
cagaggacagcaggaaagatggtcc

SEQ ID NO: 892115 - DNA, 25 bp, Mus musculus
cagaggacagcagggaaggtgtgaa

SEQ ID NO: 892116 - DNA, 25 bp, Mus musculus
cagaggacagcaggtgtgaacctga

SEQ ID NO: 892117 - DNA, 25 bp, Mus musculus
cagaggagaaccggaagctggctca

SEQ ID NO: 892118 - DNA, 25 bp, Mus musculus
cagaggagaagcggaagctggctca

SEQ ID NO: 892119 - DNA, 25 bp, Mus musculus
cagaggagacgaaacagcttggatt

SEQ ID NO: 892120 - DNA, 25 bp, Mus musculus
cagaggagacgaaagagcttggatt

SEQ ID NO: 892121 - DNA, 25 bp, Mus musculus
cagaggagattgaacagctccgaga

SEQ ID NO: 892122 - DNA, 25 bp, Mus musculus
cagaggagattgaagagctccgaga

SEQ ID NO: 892123 - DNA, 25 bp, Mus musculus
cagaggaggagaaggacaagcctgt

SEQ ID NO: 892124 - DNA, 25 bp, Mus musculus
cagaggaggagactgagttcaccca

SEQ ID NO: 892125 - DNA, 25 bp, Mus musculus
cagaggaggagagtgagttcaccca

SEQ ID NO: 892126 - DNA, 25 bp, Mus musculus
cagaggaggagatggacaagcctgt

SEQ ID NO: 892127 - DNA, 25 bp, Mus musculus
cagaggataaatgcagctgtagcca

SEQ ID NO: 892128 - DNA, 25 bp, Mus musculus
cagaggataattgcagctgtagcca

SEQ ID NO: 892129 - DNA, 25 bp, Mus musculus
cagaggatgaagaccaatggacaga

SEQ ID NO: 892130 - DNA, 25 bp, Mus musculus
cagaggatgaagtccaatggacaga

SEQ ID NO: 892131 - DNA, 25 bp, Mus musculus
cagaggatgcgacgcatttccaaga

SEQ ID NO: 892132 - DNA, 25 bp, Mus musculus
cagaggatgcgaggcatttccaaga

SEQ ID NO: 892133 - DNA, 25 bp, Mus musculus
cagaggcaagaacttcgccaatgcc

SEQ ID NO: 892134 - DNA, 25 bp, Mus musculus
cagaggcaagaagttcgccaatgcc

SEQ ID NO: 892135 - DNA, 25 bp, Mus musculus
cagaggcaccgccatgtgctggctg

SEQ ID NO: 892136 - DNA, 25 bp, Mus musculus
cagaggcaccgccgaccgtctgggc

SEQ ID NO: 892137 - DNA, 25 bp, Mus musculus
cagaggcaccgcgatgtgctggctg

SEQ ID NO: 892138 - DNA, 25 bp, Mus musculus
cagaggcaccgcggaccgtctgggc

SEQ ID NO: 892139 - DNA, 25 bp, Mus musculus
cagaggcagataaacataatggagg

SEQ ID NO: 892140 - DNA, 25 bp, Mus musculus
cagaggcagataaagataatggagg

SEQ ID NO: 892141 - DNA, 25 bp, Mus musculus
cagaggccagagctattaagaatgg

SEQ ID NO: 892142 - DNA, 25 bp, Mus musculus
cagaggccagctgctcctctggtca

SEQ ID NO: 892143 - DNA, 25 bp, Mus musculus
cagaggccaggtgctcctctggtca

SEQ ID NO: 892144 - DNA, 25 bp, Mus musculus
cagaggccagtgctattaagaatgg

SEQ ID NO: 892145 - DNA, 25 bp, Mus musculus
cagaggctaatgaaccgctggagag

SEQ ID NO: 892146 - DNA, 25 bp, Mus musculus
cagaggctaatgaagcgctggagag

SEQ ID NO: 892147 - DNA, 25 bp, Mus musculus
cagaggctggccaaaatctctgtgt

SEQ ID NO: 892148 - DNA, 25 bp, Mus musculus
cagaggctggccaatatctctgtgt

SEQ ID NO: 892149 - DNA, 25 bp, Mus musculus
cagaggcttgagctgaaggagcatc

SEQ ID NO: 892150 - DNA, 25 bp, Mus musculus
cagaggcttgaggtgaaggagcatc

SEQ ID NO: 892151 - DNA, 25 bp, Mus musculus
cagagggaggaccaccatttaagaa

SEQ ID NO: 892152 - DNA, 25 bp, Mus musculus
cagagggaggaccacgagggcactc

SEQ ID NO: 892153 - DNA, 25 bp, Mus musculus
cagagggaggaccagcatttaagaa

SEQ ID NO: 892154 - DNA, 25 bp, Mus musculus
cagagggaggaccaggagggcactc

SEQ ID NO: 892155 - DNA, 25 bp, Mus musculus
cagagggatccccacttctggaatg

SEQ ID NO: 892156 - DNA, 25 bp, Mus musculus
cagagggatccccagttctggaatg

SEQ ID NO: 892157 - DNA, 25 bp, Mus musculus
cagagggatcggcaatgcctgcagg

SEQ ID NO: 892158 - DNA, 25 bp, Mus musculus
cagagggatcggcattgcctgcagg

SEQ ID NO: 892159 - DNA, 25 bp, Mus musculus
cagagggccctgcacgcctcggtgt

SEQ ID NO: 892160 - DNA, 25 bp, Mus musculus
cagagggccctgcaggcctcggtgt

SEQ ID NO: 892161 - DNA, 25 bp, Mus musculus
cagagggctgaagacaatatccggt

SEQ ID NO: 892162 - DNA, 25 bp, Mus musculus
cagagggctgaagactgatgacatt

SEQ ID NO: 892163 - DNA, 25 bp, Mus musculus
cagagggctgaagagaatatccggt

SEQ ID NO: 892164 - DNA, 25 bp, Mus musculus
cagagggctgaagagtgatgacatt

SEQ ID NO: 892165 - DNA, 25 bp, Mus musculus
cagagggctggccgcattggtggag

SEQ ID NO: 892166 - DNA, 25 bp, Mus musculus
cagagggctggccggattggtggag

SEQ ID NO: 892167 - DNA, 25 bp, Mus musculus
cagaggggaaagctcgtggaaagtg

SEQ ID NO: 892168 - DNA, 25 bp, Mus musculus
cagaggggaaagctggtggaaagtg

SEQ ID NO: 892169 - DNA, 25 bp, Mus musculus
cagaggtaaacacaatagaatccct

SEQ ID NO: 892170 - DNA, 25 bp, Mus musculus
cagaggtaaacagaatagaatccct

SEQ ID NO: 892171 - DNA, 25 bp, Mus musculus
cagaggtgccagctctgcaaagtgc

SEQ ID NO: 892172 - DNA, 25 bp, Mus musculus
cagaggtgccaggtatgcaaagtgc

SEQ ID NO: 892173 - DNA, 25 bp, Mus musculus
cagaggtgccaggtctgcaaagtgc

SEQ ID NO: 892174 - DNA, 25 bp, Mus musculus
cagaggtgccaggtttgcaaagtgc

SEQ ID NO: 892175 - DNA, 25 bp, Mus musculus
cagaggttccatcttcagaatttag

SEQ ID NO: 892176 - DNA, 25 bp, Mus musculus
cagaggttccatgttcagaatttag

SEQ ID NO: 892177 - DNA, 25 bp, Mus musculus
cagagtaacgaccaatctcacacgc

SEQ ID NO: 892178 - DNA, 25 bp, Mus musculus
cagagtaacgacgaatctcacacgc

SEQ ID NO: 892179 - DNA, 25 bp, Mus musculus
cagagtaactttgcagaaacggtca

SEQ ID NO: 892180 - DNA, 25 bp, Mus musculus
cagagtaactttgctgaaacggtca

SEQ ID NO: 892181 - DNA, 25 bp, Mus musculus
cagagtaaggaccaatctcacacgc

SEQ ID NO: 892182 - DNA, 25 bp, Mus musculus
cagagtaaggacgaatctcacacgc

SEQ ID NO: 892183 - DNA, 25 bp, Mus musculus
cagagtacagcagacagacagtgac

SEQ ID NO: 892184 - DNA, 25 bp, Mus musculus
cagagtacagcagctggagatgcag

SEQ ID NO: 892185 - DNA, 25 bp, Mus musculus
cagagtacaggagacagacagtgac

SEQ ID NO: 892186 - DNA, 25 bp, Mus musculus
cagagtacaggagctggagatgcag

SEQ ID NO: 892187 - DNA, 25 bp, Mus musculus
cagagtagaaaaatatgacttctgc

SEQ ID NO: 892188 - DNA, 25 bp, Mus musculus
cagagtagaaaacaaggaataggaa

SEQ ID NO: 892189 - DNA, 25 bp, Mus musculus
cagagtagaaaacaataggaaagca

SEQ ID NO: 892190 - DNA, 25 bp, Mus musculus
cagagtagaaaagaaggaataggaa

SEQ ID NO: 892191 - DNA, 25 bp, Mus musculus
cagagtagaaaagaataggaaagca

SEQ ID NO: 892192 - DNA, 25 bp, Mus musculus
cagagtagaaaattatgacttctgc

SEQ ID NO: 892193 - DNA, 25 bp, Mus musculus
cagagtcaaagccacggtctcttgt

SEQ ID NO: 892194 - DNA, 25 bp, Mus musculus
cagagtcaaagccacgtgccagctg

SEQ ID NO: 892195 - DNA, 25 bp, Mus musculus
cagagtcaaagccagggtctcttgt

SEQ ID NO: 892196 - DNA, 25 bp, Mus musculus
cagagtcaaagccaggtgccagctg

SEQ ID NO: 892197 - DNA, 25 bp, Mus musculus
cagagtcaagatagagtcagcagat

SEQ ID NO: 892198 - DNA, 25 bp, Mus musculus
cagagtcaagcagaagccaatgccg

SEQ ID NO: 892199 - DNA, 25 bp, Mus musculus
cagagtcaaggagaagccaatgccg

SEQ ID NO: 892200 - DNA, 25 bp, Mus musculus
cagagtcaagttagagtcagcagat

SEQ ID NO: 892201 - DNA, 25 bp, Mus musculus
cagagtcattcacgtgacaagtgac

SEQ ID NO: 892202 - DNA, 25 bp, Mus musculus
cagagtcattcaggtgacaagtgac

SEQ ID NO: 892203 - DNA, 25 bp, Mus musculus
cagagtccatgactttacaggaaca

SEQ ID NO: 892204 - DNA, 25 bp, Mus musculus
cagagtccatgagtttacaggaaca

SEQ ID NO: 892205 - DNA, 25 bp, Mus musculus
cagagtcctgcttgtgttagtcttt

SEQ ID NO: 892206 - DNA, 25 bp, Mus musculus
cagagtcctggcaacttttgcctcc

SEQ ID NO: 892207 - DNA, 25 bp, Mus musculus
cagagtcctggcaagttttgcctcc

SEQ ID NO: 892208 - DNA, 25 bp, Mus musculus
cagagtcctggttgtgttagtcttt

SEQ ID NO: 892209 - DNA, 25 bp, Mus musculus
cagagtctctccctgtagctgtact

SEQ ID NO: 892210 - DNA, 25 bp, Mus musculus
cagagtctctccgtgtagctgtact

SEQ ID NO: 892211 - DNA, 25 bp, Mus musculus
cagagtctgcagaaccagtgtgcag

SEQ ID NO: 892212 - DNA, 25 bp, Mus musculus
cagagtctgcagtaccagtgtgcag

SEQ ID NO: 892213 - DNA, 25 bp, Mus musculus
cagagtgaagaacaactcctacctg

SEQ ID NO: 892214 - DNA, 25 bp, Mus musculus
cagagtgaagaaccgagatcatcag

SEQ ID NO: 892215 - DNA, 25 bp, Mus musculus
cagagtgaagaagaactcctacctg

SEQ ID NO: 892216 - DNA, 25 bp, Mus musculus
cagagtgaagaagcgagatcatcag

SEQ ID NO: 892217 - DNA, 25 bp, Mus musculus
cagagtgaagcgagcaagagcagtg

SEQ ID NO: 892218 - DNA, 25 bp, Mus musculus
cagagtgaagggagcaagagcagtg

SEQ ID NO: 892219 - DNA, 25 bp, Mus musculus
cagagtgaattagaaataatgttta

SEQ ID NO: 892220 - DNA, 25 bp, Mus musculus
cagagtgaattagatataatgttta

SEQ ID NO: 892221 - DNA, 25 bp, Mus musculus
cagagtgagcagccccacagtgaac

SEQ ID NO: 892222 - DNA, 25 bp, Mus musculus
cagagtgagcaggcccacagtgaac

SEQ ID NO: 892223 - DNA, 25 bp, Mus musculus
cagagtgaggctctggtcaaggcct

SEQ ID NO: 892224 - DNA, 25 bp, Mus musculus
cagagtgagggtctggtcaaggcct

SEQ ID NO: 892225 - DNA, 25 bp, Mus musculus
cagagtgcagagcccaagaactaca

SEQ ID NO: 892226 - DNA, 25 bp, Mus musculus
cagagtgcagaggccaagaactaca

SEQ ID NO: 892227 - DNA, 25 bp, Mus musculus
cagagtgcagcaatattgattgtgg

SEQ ID NO: 892228 - DNA, 25 bp, Mus musculus
cagagtgcagcattattgattgtgg

SEQ ID NO: 892229 - DNA, 25 bp, Mus musculus
cagagtgcagctgtggtttcagaac

SEQ ID NO: 892230 - DNA, 25 bp, Mus musculus
cagagtgcaggtgtggtttcagaac

SEQ ID NO: 892231 - DNA, 25 bp, Mus musculus
cagagtgctgatcagggcactgaca

SEQ ID NO: 892232 - DNA, 25 bp, Mus musculus
cagagtgctgttcagggcactgaca

SEQ ID NO: 892233 - DNA, 25 bp, Mus musculus
cagagtggaagtctgatcaggtgta

SEQ ID NO: 892234 - DNA, 25 bp, Mus musculus
cagagtggaagtgtgatcaggtgta

SEQ ID NO: 892235 - DNA, 25 bp, Mus musculus
cagagtggcatcgacgaccttgtga

SEQ ID NO: 892236 - DNA, 25 bp, Mus musculus
cagagtggcatcgaggaccttgtga

SEQ ID NO: 892237 - DNA, 25 bp, Mus musculus
cagagtgtacagcgaccctagggta

SEQ ID NO: 892238 - DNA, 25 bp, Mus musculus
cagagtgtacagggaccctagggta

SEQ ID NO: 892239 - DNA, 25 bp, Mus musculus
cagagtgtaccatgcctggctgttt

SEQ ID NO: 892240 - DNA, 25 bp, Mus musculus
cagagtgtaccatggctggctgttt

SEQ ID NO: 892241 - DNA, 25 bp, Mus musculus
cagagttcagaaagtactgcccagc

SEQ ID NO: 892242 - DNA, 25 bp, Mus musculus
cagagttcagtaagtactgcccagc

SEQ ID NO: 892243 - DNA, 25 bp, Mus musculus
cagagttcccaacgatgaacagggc

SEQ ID NO: 892244 - DNA, 25 bp, Mus musculus
cagagttcccaaggatgaacagggc

SEQ ID NO: 892245 - DNA, 25 bp, Mus musculus
cagagttcccagatgaagaaactga

SEQ ID NO: 892246 - DNA, 25 bp, Mus musculus
cagagttcccagttgaagaaactga

SEQ ID NO: 892247 - DNA, 25 bp, Mus musculus
cagagtttcaagccaaacgaatgca

SEQ ID NO: 892248 - DNA, 25 bp, Mus musculus
cagagtttcaagctgggatgtgtgt

SEQ ID NO: 892249 - DNA, 25 bp, Mus musculus
cagagtttcaaggcaaacgaatgca

SEQ ID NO: 892250 - DNA, 25 bp, Mus musculus
cagagtttcaaggtgggatgtgtgt

SEQ ID NO: 892251 - DNA, 25 bp, Mus musculus
cagagttttgttttcttatgaatgc

SEQ ID NO: 892252 - DNA, 25 bp, Mus musculus
cagagttttgttttgttatgaatgc

SEQ ID NO: 892253 - DNA, 25 bp, Mus musculus
cagataaaaacgcgaatccactcaa

SEQ ID NO: 892254 - DNA, 25 bp, Mus musculus
cagataaaaacgggaatccactcaa

SEQ ID NO: 892255 - DNA, 25 bp, Mus musculus
cagataactgggctcacgttgaccc

SEQ ID NO: 892256 - DNA, 25 bp, Mus musculus
cagataactggggtcacgttgaccc

SEQ ID NO: 892257 - DNA, 25 bp, Mus musculus
cagataagaaagatggcttgccagt

SEQ ID NO: 892258 - DNA, 25 bp, Mus musculus
cagataagaaagttggcttgccagt

SEQ ID NO: 892259 - DNA, 25 bp, Mus musculus
cagatacaatagcaaacctgtccag

SEQ ID NO: 892260 - DNA, 25 bp, Mus musculus
cagatacaataggaaacctgtccag

SEQ ID NO: 892261 - DNA, 25 bp, Mus musculus
cagatacactataacgtttgctatg

SEQ ID NO: 892262 - DNA, 25 bp, Mus musculus
cagatacactataaggtttgctatg

SEQ ID NO: 892263 - DNA, 25 bp, Mus musculus
cagataccagatcgattccatgaaa

SEQ ID NO: 892264 - DNA, 25 bp, Mus musculus
cagataccagcttgctggtgaccag

SEQ ID NO: 892265 - DNA, 25 bp, Mus musculus
cagataccaggttgctggtgaccag

SEQ ID NO: 892266 - DNA, 25 bp, Mus musculus
cagataccagttcgattccatgaaa

SEQ ID NO: 892267 - DNA, 25 bp, Mus musculus
cagataccggccccaacgaaggagc

SEQ ID NO: 892268 - DNA, 25 bp, Mus musculus
cagataccggctggggacgacgagc

SEQ ID NO: 892269 - DNA, 25 bp, Mus musculus
cagataccgggcccaacgaaggagc

SEQ ID NO: 892270 - DNA, 25 bp, Mus musculus
cagataccgggtggggacgacgagc

SEQ ID NO: 892271 - DNA, 25 bp, Mus musculus
cagatactggtgccatttcccccac

SEQ ID NO: 892272 - DNA, 25 bp, Mus musculus
cagatactggtgccttttcccccac

SEQ ID NO: 892273 - DNA, 25 bp, Mus musculus
cagatacttctgagagtgcaaagag

SEQ ID NO: 892274 - DNA, 25 bp, Mus musculus
cagatacttctgtgagtgcaaagag

SEQ ID NO: 892275 - DNA, 25 bp, Mus musculus
cagatagagacacaggtggccagtg

SEQ ID NO: 892276 - DNA, 25 bp, Mus musculus
cagatagagacagaggtggccagtg

SEQ ID NO: 892277 - DNA, 25 bp, Mus musculus
cagatagctcagcttttagatctgt

SEQ ID NO: 892278 - DNA, 25 bp, Mus musculus
cagatagctcaggttttagatctgt

SEQ ID NO: 892279 - DNA, 25 bp, Mus musculus
cagataggaaaaccatatatattta

SEQ ID NO: 892280 - DNA, 25 bp, Mus musculus
cagataggaaaagcatatatattta

SEQ ID NO: 892281 - DNA, 25 bp, Mus musculus
cagatatcagcgtgtgaacctttat

SEQ ID NO: 892282 - DNA, 25 bp, Mus musculus
cagatatcagggtgtgaacctttat

SEQ ID NO: 892283 - DNA, 25 bp, Mus musculus
cagatatcctcactgtttgtgcctg

SEQ ID NO: 892284 - DNA, 25 bp, Mus musculus
cagatatcctcagtgtttgtgcctg

SEQ ID NO: 892285 - DNA, 25 bp, Mus musculus
cagatatgcccacgcaatagagatg

SEQ ID NO: 892286 - DNA, 25 bp, Mus musculus
cagatatgcccaggcaatagagatg

SEQ ID NO: 892287 - DNA, 25 bp, Mus musculus
cagatatggcagatcgctgaaaata

SEQ ID NO: 892288 - DNA, 25 bp, Mus musculus
cagatatggcagatggctgaaaata

SEQ ID NO: 892289 - DNA, 25 bp, Mus musculus
cagatcaaatatcgtgaccttcttc

SEQ ID NO: 892290 - DNA, 25 bp, Mus musculus
cagatcaaatatggtgaccttcttc

SEQ ID NO: 892291 - DNA, 25 bp, Mus musculus
cagatcaagagcaacgtcaacaagc

SEQ ID NO: 892292 - DNA, 25 bp, Mus musculus
cagatcaagagcaaggtcaacaagc

SEQ ID NO: 892293 - DNA, 25 bp, Mus musculus
cagatcaccgaacccaacctcaccg

SEQ ID NO: 892294 - DNA, 25 bp, Mus musculus
cagatcaccgaagccaacctcaccg

SEQ ID NO: 892295 - DNA, 25 bp, Mus musculus
cagatcacggatgacatggcagagc

SEQ ID NO: 892296 - DNA, 25 bp, Mus musculus
cagatcacggatgagatggcagagc

SEQ ID NO: 892297 - DNA, 25 bp, Mus musculus
cagatcactcaggacaagccctcga

SEQ ID NO: 892298 - DNA, 25 bp, Mus musculus
cagatcactcaggacgttctgacgg

SEQ ID NO: 892299 - DNA, 25 bp, Mus musculus
cagatcactcaggagaagccctcga

SEQ ID NO: 892300 - DNA, 25 bp, Mus musculus
cagatcactcaggaggttctgacgg

SEQ ID NO: 892301 - DNA, 25 bp, Mus musculus
cagatcagaaagcattacaccagcg

SEQ ID NO: 892302 - DNA, 25 bp, Mus musculus
cagatcagaaagccagtttgtgcac

SEQ ID NO: 892303 - DNA, 25 bp, Mus musculus
cagatcagaaagcctaggacctgcc

SEQ ID NO: 892304 - DNA, 25 bp, Mus musculus
cagatcagaaagcgtgtgtgggatg

SEQ ID NO: 892305 - DNA, 25 bp, Mus musculus
cagatcagaaaggattacaccagcg

SEQ ID NO: 892306 - DNA, 25 bp, Mus musculus
cagatcagaaaggcagtttgtgcac

SEQ ID NO: 892307 - DNA, 25 bp, Mus musculus
cagatcagaaaggctaggacctgcc

SEQ ID NO: 892308 - DNA, 25 bp, Mus musculus
cagatcagaaagggtgtgtgggatg

SEQ ID NO: 892309 - DNA, 25 bp, Mus musculus
cagatcagcttcaccgtggctatcg

SEQ ID NO: 892310 - DNA, 25 bp, Mus musculus
cagatcagcttcacggtggctatcg

SEQ ID NO: 892311 - DNA, 25 bp, Mus musculus
cagatcatcaccatcggaaatgcct

SEQ ID NO: 892312 - DNA, 25 bp, Mus musculus
cagatcatcaccatgggaaatgcct

SEQ ID NO: 892313 - DNA, 25 bp, Mus musculus
cagatcatcatcgacgcaaacgacc

SEQ ID NO: 892314 - DNA, 25 bp, Mus musculus
cagatcatcatcgaggcaaacgacc

SEQ ID NO: 892315 - DNA, 25 bp, Mus musculus
cagatcattcccaacaacctgctgg

SEQ ID NO: 892316 - DNA, 25 bp, Mus musculus
cagatcattcccaagaacctgctgg

SEQ ID NO: 892317 - DNA, 25 bp, Mus musculus
cagatcattccgaggaacttcccgc

SEQ ID NO: 892318 - DNA, 25 bp, Mus musculus
cagatcattccgtggaacttcccgc

SEQ ID NO: 892319 - DNA, 25 bp, Mus musculus
cagatccaaatgctaactcacctca

SEQ ID NO: 892320 - DNA, 25 bp, Mus musculus
cagatccaaatggtaactcacctca

SEQ ID NO: 892321 - DNA, 25 bp, Mus musculus
cagatccaagacaaccaacagaccc

SEQ ID NO: 892322 - DNA, 25 bp, Mus musculus
cagatccaagacaagcaacagaccc

SEQ ID NO: 892323 - DNA, 25 bp, Mus musculus
cagatccaggagcacttcttcctgg

SEQ ID NO: 892324 - DNA, 25 bp, Mus musculus
cagatccaggagctggtggaagcca

SEQ ID NO: 892325 - DNA, 25 bp, Mus musculus
cagatccaggaggacttcttcctgg

SEQ ID NO: 892326 - DNA, 25 bp, Mus musculus
cagatccaggaggtggtggaagcca

SEQ ID NO: 892327 - DNA, 25 bp, Mus musculus
cagatccattcaaacgcattggcca

SEQ ID NO: 892328 - DNA, 25 bp, Mus musculus
cagatccattcaaaggcattggcca

SEQ ID NO: 892329 - DNA, 25 bp, Mus musculus
cagatcccaagtcgagagcagtgtt

SEQ ID NO: 892330 - DNA, 25 bp, Mus musculus
cagatcccaagtcgtgagcagtgtt

SEQ ID NO: 892331 - DNA, 25 bp, Mus musculus
cagatcccgctgcgtggagacctgg

SEQ ID NO: 892332 - DNA, 25 bp, Mus musculus
cagatcccgctgggtggagacctgg

SEQ ID NO: 892333 - DNA, 25 bp, Mus musculus
cagatccctaagcaccagccatcct

SEQ ID NO: 892334 - DNA, 25 bp, Mus musculus
cagatccctaagcacccatcctcgg

SEQ ID NO: 892335 - DNA, 25 bp, Mus musculus
cagatccctaagcagcagccatcct

SEQ ID NO: 892336 - DNA, 25 bp, Mus musculus
cagatccctaagcagccatcctcgg

SEQ ID NO: 892337 - DNA, 25 bp, Mus musculus
cagatccgcaagcacttcttatact

SEQ ID NO: 892338 - DNA, 25 bp, Mus musculus
cagatccgcaaggacttcttatact

SEQ ID NO: 892339 - DNA, 25 bp, Mus musculus
cagatccggactagcccctggaact

SEQ ID NO: 892340 - DNA, 25 bp, Mus musculus
cagatccggagtagcccctggaact

SEQ ID NO: 892341 - DNA, 25 bp, Mus musculus
cagatcctgaagactgctggagtta

SEQ ID NO: 892342 - DNA, 25 bp, Mus musculus
cagatcctgaagcattcgggaatta

SEQ ID NO: 892343 - DNA, 25 bp, Mus musculus
cagatcctgaaggattcgggaatta

SEQ ID NO: 892344 - DNA, 25 bp, Mus musculus
cagatcctgaagtctgctggagtta

SEQ ID NO: 892345 - DNA, 25 bp, Mus musculus
cagatcctgctagccctcctgggtt

SEQ ID NO: 892346 - DNA, 25 bp, Mus musculus
cagatcctgctagcgctcctgggtt

SEQ ID NO: 892347 - DNA, 25 bp, Mus musculus
cagatcctgctatacctcagttctc

SEQ ID NO: 892348 - DNA, 25 bp, Mus musculus
cagatcctgctatagctcagttctc

SEQ ID NO: 892349 - DNA, 25 bp, Mus musculus
cagatcgaaagtgacgttgccaacc

SEQ ID NO: 892350 - DNA, 25 bp, Mus musculus
cagatcgaaagtgaggttgccaacc

SEQ ID NO: 892351 - DNA, 25 bp, Mus musculus
cagatcgacggcctcgtagtattaa

SEQ ID NO: 892352 - DNA, 25 bp, Mus musculus
cagatcgacggcctggtagtattaa

SEQ ID NO: 892353 - DNA, 25 bp, Mus musculus
cagatcgcagctacagaaccttggc

SEQ ID NO: 892354 - DNA, 25 bp, Mus musculus
cagatcgcaggtacagaaccttggc

SEQ ID NO: 892355 - DNA, 25 bp, Mus musculus
cagatcggctctgacgatggggaac

SEQ ID NO: 892356 - DNA, 25 bp, Mus musculus
cagatcggctctgaggatggggaac

SEQ ID NO: 892357 - DNA, 25 bp, Mus musculus
cagatctacgcttgttctcaagaag

SEQ ID NO: 892358 - DNA, 25 bp, Mus musculus
cagatctacggttgttctcaagaag

SEQ ID NO: 892359 - DNA, 25 bp, Mus musculus
cagatctcagagatttcattgtttt

SEQ ID NO: 892360 - DNA, 25 bp, Mus musculus
cagatctcagagttttcattgtttt

SEQ ID NO: 892361 - DNA, 25 bp, Mus musculus
cagatctcgctcaagaagtcctgac

SEQ ID NO: 892362 - DNA, 25 bp, Mus musculus
cagatctcgctctagaagtcctgac

SEQ ID NO: 892363 - DNA, 25 bp, Mus musculus
cagatctctcagcggagacccagcg

SEQ ID NO: 892364 - DNA, 25 bp, Mus musculus
cagatctctcagcggatcatgaggg

SEQ ID NO: 892365 - DNA, 25 bp, Mus musculus
cagatctctcaggggagacccagcg

SEQ ID NO: 892366 - DNA, 25 bp, Mus musculus
cagatctctcaggggatcatgaggg

SEQ ID NO: 892367 - DNA, 25 bp, Mus musculus
cagatctgcaggaatgacctgggtg

SEQ ID NO: 892368 - DNA, 25 bp, Mus musculus
cagatctgcaggtatgacctgggtg

SEQ ID NO: 892369 - DNA, 25 bp, Mus musculus
cagatcttcaagccctgggctgtgg

SEQ ID NO: 892370 - DNA, 25 bp, Mus musculus
cagatcttcaaggcctgggctgtgg

SEQ ID NO: 892371 - DNA, 25 bp, Mus musculus
cagatcttcctagcactgttcggct

SEQ ID NO: 892372 - DNA, 25 bp, Mus musculus
cagatcttcctagctctgttcggct

SEQ ID NO: 892373 - DNA, 25 bp, Mus musculus
cagatgaaacaaagtgctgctgctt

SEQ ID NO: 892374 - DNA, 25 bp, Mus musculus
cagatgaaacaatgtgctgctgctt

SEQ ID NO: 892375 - DNA, 25 bp, Mus musculus
cagatgaagaagctgctgtgtttgg

SEQ ID NO: 892376 - DNA, 25 bp, Mus musculus
cagatgaagaaggtgctgtgtttgg

SEQ ID NO: 892377 - DNA, 25 bp, Mus musculus
cagatgacagcctgctcaggatctg

SEQ ID NO: 892378 - DNA, 25 bp, Mus musculus
cagatgacaggctgctcaggatctg

SEQ ID NO: 892379 - DNA, 25 bp, Mus musculus
cagatgacattgcacctctaccaat

SEQ ID NO: 892380 - DNA, 25 bp, Mus musculus
cagatgacattgcagctctaccaat

SEQ ID NO: 892381 - DNA, 25 bp, Mus musculus
cagatgagaaaccgacctcccgtca

SEQ ID NO: 892382 - DNA, 25 bp, Mus musculus
cagatgagaaacggacctcccgtca

SEQ ID NO: 892383 - DNA, 25 bp, Mus musculus
cagatgagcctgccacagctgcttg

SEQ ID NO: 892384 - DNA, 25 bp, Mus musculus
cagatgagcctggcacagctgcttg

SEQ ID NO: 892385 - DNA, 25 bp, Mus musculus
cagatgagctacttcaaaagtaaag

SEQ ID NO: 892386 - DNA, 25 bp, Mus musculus
cagatgagctacttgaaaagtaaag

SEQ ID NO: 892387 - DNA, 25 bp, Mus musculus
cagatgagtccacccgaagcattgc

SEQ ID NO: 892388 - DNA, 25 bp, Mus musculus
cagatgagtccaccggaagcattgc

SEQ ID NO: 892389 - DNA, 25 bp, Mus musculus
cagatgatcaagaatttcaagaagc

SEQ ID NO: 892390 - DNA, 25 bp, Mus musculus
cagatgatcaagtatttcaagaagc

SEQ ID NO: 892391 - DNA, 25 bp, Mus musculus
cagatgcaagcagtggggaataata

SEQ ID NO: 892392 - DNA, 25 bp, Mus musculus
cagatgcaaggagtggggaataata

SEQ ID NO: 892393 - DNA, 25 bp, Mus musculus
cagatgcacccccgggcacatggtc

SEQ ID NO: 892394 - DNA, 25 bp, Mus musculus
cagatgcaccccggggcacatggtc

SEQ ID NO: 892395 - DNA, 25 bp, Mus musculus
cagatgcctacaccaccggaagcag

SEQ ID NO: 892396 - DNA, 25 bp, Mus musculus
cagatgcctacagcaccggaagcag

SEQ ID NO: 892397 - DNA, 25 bp, Mus musculus
cagatgctacgacgttccatatcaa

SEQ ID NO: 892398 - DNA, 25 bp, Mus musculus
cagatgctacgaggttccatatcaa

SEQ ID NO: 892399 - DNA, 25 bp, Mus musculus
cagatgctgactaggacttggccgt

SEQ ID NO: 892400 - DNA, 25 bp, Mus musculus
cagatgctgacttggacttggccgt

SEQ ID NO: 892401 - DNA, 25 bp, Mus musculus
cagatgctggcggagcgtctgttcc

SEQ ID NO: 892402 - DNA, 25 bp, Mus musculus
cagatgctgggggagcgtctgttcc

SEQ ID NO: 892403 - DNA, 25 bp, Mus musculus
cagatggaaacatgacatcgttctg

SEQ ID NO: 892404 - DNA, 25 bp, Mus musculus
cagatggaaagatgacatcgttctg

SEQ ID NO: 892405 - DNA, 25 bp, Mus musculus
cagatggaatctctctctctcctct

SEQ ID NO: 892406 - DNA, 25 bp, Mus musculus
cagatggaatctgtctctctcctct

SEQ ID NO: 892407 - DNA, 25 bp, Mus musculus
cagatggcaaagcaacaggaacaag

SEQ ID NO: 892408 - DNA, 25 bp, Mus musculus
cagatggcaaaggaacaggaacaag

SEQ ID NO: 892409 - DNA, 25 bp, Mus musculus
cagatggcaaatcagggtgttaatg

SEQ ID NO: 892410 - DNA, 25 bp, Mus musculus
cagatggcaaatgagggtgttaatg

SEQ ID NO: 892411 - DNA, 25 bp, Mus musculus
cagatggcacagcgcttactctcag

SEQ ID NO: 892412 - DNA, 25 bp, Mus musculus
cagatggcacagggcttactctcag

SEQ ID NO: 892413 - DNA, 25 bp, Mus musculus
cagatggcagcaccccacaggccca

SEQ ID NO: 892414 - DNA, 25 bp, Mus musculus
cagatggcagccccaagtatctggt

SEQ ID NO: 892415 - DNA, 25 bp, Mus musculus
cagatggcaggaccccacaggccca

SEQ ID NO: 892416 - DNA, 25 bp, Mus musculus
cagatggcaggcccaagtatctggt

SEQ ID NO: 892417 - DNA, 25 bp, Mus musculus
cagatggctctgcccgaagctttgc

SEQ ID NO: 892418 - DNA, 25 bp, Mus musculus
cagatggctctggccgaagctttgc

SEQ ID NO: 892419 - DNA, 25 bp, Mus musculus
cagatggctgagcaaatggtagaag

SEQ ID NO: 892420 - DNA, 25 bp, Mus musculus
cagatggctgaggaaatggtagaag

SEQ ID NO: 892421 - DNA, 25 bp, Mus musculus
cagatgggctggcccttggccgatc

SEQ ID NO: 892422 - DNA, 25 bp, Mus musculus
cagatgggctgggccttggccgatc

SEQ ID NO: 892423 - DNA, 25 bp, Mus musculus
cagatggtacagcagccttcaagga

SEQ ID NO: 892424 - DNA, 25 bp, Mus musculus
cagatggtacaggagccttcaagga

SEQ ID NO: 892425 - DNA, 25 bp, Mus musculus
cagatgtgagcacgaggcctctgaa

SEQ ID NO: 892426 - DNA, 25 bp, Mus musculus
cagatgtgagcaggaggcctctgaa

SEQ ID NO: 892427 - DNA, 25 bp, Mus musculus
cagatgtgcagccccgtgtccacca

SEQ ID NO: 892428 - DNA, 25 bp, Mus musculus
cagatgtgcagcgccgtgtccacca

SEQ ID NO: 892429 - DNA, 25 bp, Mus musculus
cagatgtgccccttcttgtagagta

SEQ ID NO: 892430 - DNA, 25 bp, Mus musculus
cagatgtgccccttgttgtagagta

SEQ ID NO: 892431 - DNA, 25 bp, Mus musculus
cagatgttcatgataggagacaaat

SEQ ID NO: 892432 - DNA, 25 bp, Mus musculus
cagatgttcatgcgactttcagtta

SEQ ID NO: 892433 - DNA, 25 bp, Mus musculus
cagatgttcatgggactttcagtta

SEQ ID NO: 892434 - DNA, 25 bp, Mus musculus
cagatgttcatgttaggagacaaat

SEQ ID NO: 892435 - DNA, 25 bp, Mus musculus
cagatgttctctactcctggaatcc

SEQ ID NO: 892436 - DNA, 25 bp, Mus musculus
cagatgttctcttctcctggaatcc

SEQ ID NO: 892437 - DNA, 25 bp, Mus musculus
cagattaaagacaaataatttagta

SEQ ID NO: 892438 - DNA, 25 bp, Mus musculus
cagattaaagtcaaataatttagta

SEQ ID NO: 892439 - DNA, 25 bp, Mus musculus
cagattagctcttattttaactaat

SEQ ID NO: 892440 - DNA, 25 bp, Mus musculus
cagattagctgttattttaactaat

SEQ ID NO: 892441 - DNA, 25 bp, Mus musculus
cagattattcagcccagtggagaga

SEQ ID NO: 892442 - DNA, 25 bp, Mus musculus
cagattattcaggccagtggagaga

SEQ ID NO: 892443 - DNA, 25 bp, Mus musculus
cagattcaaaagaccagcagttatt

SEQ ID NO: 892444 - DNA, 25 bp, Mus musculus
cagattcaaacttcacagtcagacc

SEQ ID NO: 892445 - DNA, 25 bp, Mus musculus
cagattcaaagttcacagtcagacc

SEQ ID NO: 892446 - DNA, 25 bp, Mus musculus
cagattcaaatgaccagcagttatt

SEQ ID NO: 892447 - DNA, 25 bp, Mus musculus
cagattcaggaacgcgcagtggcta

SEQ ID NO: 892448 - DNA, 25 bp, Mus musculus
cagattcaggaaggcgcagtggcta

SEQ ID NO: 892449 - DNA, 25 bp, Mus musculus
cagattccagaatggctcatcatct

SEQ ID NO: 892450 - DNA, 25 bp, Mus musculus
cagattccagtatggctcatcatct

SEQ ID NO: 892451 - DNA, 25 bp, Mus musculus
cagattccccaggacgtcttggtgc

SEQ ID NO: 892452 - DNA, 25 bp, Mus musculus
cagattccccaggaggtcttggtgc

SEQ ID NO: 892453 - DNA, 25 bp, Mus musculus
cagattcgctgacgtaccatcgtgg

SEQ ID NO: 892454 - DNA, 25 bp, Mus musculus
cagattcgctgaggtaccatcgtgg

SEQ ID NO: 892455 - DNA, 25 bp, Mus musculus
cagattctaccacgaaatgttggct

SEQ ID NO: 892456 - DNA, 25 bp, Mus musculus
cagattctaccaggaaatgttggct

SEQ ID NO: 892457 - DNA, 25 bp, Mus musculus
cagattctccagctcaacaactatg

SEQ ID NO: 892458 - DNA, 25 bp, Mus musculus
cagattctccaggtcaacaactatg

SEQ ID NO: 892459 - DNA, 25 bp, Mus musculus
cagattgaaactttgaatgaagagt

SEQ ID NO: 892460 - DNA, 25 bp, Mus musculus
cagattgaaagtttgaatgaagagt

SEQ ID NO: 892461 - DNA, 25 bp, Mus musculus
cagattgaagcaaacgagttggaat

SEQ ID NO: 892462 - DNA, 25 bp, Mus musculus
cagattgaagcaaaggagttggaat

SEQ ID NO: 892463 - DNA, 25 bp, Mus musculus
cagattgaagctcagatgtaccagc

SEQ ID NO: 892464 - DNA, 25 bp, Mus musculus
cagattgaaggtcagatgtaccagc

SEQ ID NO: 892465 - DNA, 25 bp, Mus musculus
cagattgaggaacctatatatcaag

SEQ ID NO: 892466 - DNA, 25 bp, Mus musculus
cagattgaggaagctatatatcaag

SEQ ID NO: 892467 - DNA, 25 bp, Mus musculus
cagattgattcgctgtctacaaaat

SEQ ID NO: 892468 - DNA, 25 bp, Mus musculus
cagattgattcggtgtctacaaaat

SEQ ID NO: 892469 - DNA, 25 bp, Mus musculus
cagattgcacagcatcttcaacaat

SEQ ID NO: 892470 - DNA, 25 bp, Mus musculus
cagattgcacaggatcttcaacaat

SEQ ID NO: 892471 - DNA, 25 bp, Mus musculus
cagattgcagaggaggatttctatg

SEQ ID NO: 892472 - DNA, 25 bp, Mus musculus
cagattgcagagttcaaggaagcct

SEQ ID NO: 892473 - DNA, 25 bp, Mus musculus
cagattgcagcaggatttctatgag

SEQ ID NO: 892474 - DNA, 25 bp, Mus musculus
cagattgcaggaggatttctatgag

SEQ ID NO: 892475 - DNA, 25 bp, Mus musculus
cagattgcagtggaggatttctatg

SEQ ID NO: 892476 - DNA, 25 bp, Mus musculus
cagattgcagtgttcaaggaagcct

SEQ ID NO: 892477 - DNA, 25 bp, Mus musculus
cagattgctaaaagtactattaatc

SEQ ID NO: 892478 - DNA, 25 bp, Mus musculus
cagattgctaaacaccagagtaatg

SEQ ID NO: 892479 - DNA, 25 bp, Mus musculus
cagattgctaaagaccagagtaatg

SEQ ID NO: 892480 - DNA, 25 bp, Mus musculus
cagattgctaaatgtactattaatc

SEQ ID NO: 892481 - DNA, 25 bp, Mus musculus
cagattgctgaattcaaggaagctt

SEQ ID NO: 892482 - DNA, 25 bp, Mus musculus
cagattgctgtattcaaggaagctt

SEQ ID NO: 892483 - DNA, 25 bp, Mus musculus
cagattggctttcacgatgcggtac

SEQ ID NO: 892484 - DNA, 25 bp, Mus musculus
cagattggctttcaggatgcggtac

SEQ ID NO: 892485 - DNA, 25 bp, Mus musculus
cagattggttgtcgccatcttttga

SEQ ID NO: 892486 - DNA, 25 bp, Mus musculus
cagattggttgtggccatcttttga

SEQ ID NO: 892487 - DNA, 25 bp, Mus musculus
cagatttaagagtttgtttctaatg

SEQ ID NO: 892488 - DNA, 25 bp, Mus musculus
cagatttaagctgggcatgttcaca

SEQ ID NO: 892489 - DNA, 25 bp, Mus musculus
cagatttaagcttccttccactgta

SEQ ID NO: 892490 - DNA, 25 bp, Mus musculus
cagatttaaggtgggcatgttcaca

SEQ ID NO: 892491 - DNA, 25 bp, Mus musculus
cagatttaaggttccttccactgta

SEQ ID NO: 892492 - DNA, 25 bp, Mus musculus
cagatttaagtgtttgtttctaatg

SEQ ID NO: 892493 - DNA, 25 bp, Mus musculus
cagatttccacagtcttgctctagc

SEQ ID NO: 892494 - DNA, 25 bp, Mus musculus
cagatttccacagtgttgctctagc

SEQ ID NO: 892495 - DNA, 25 bp, Mus musculus
cagatttgcactgaatcatccagag

SEQ ID NO: 892496 - DNA, 25 bp, Mus musculus
cagatttgcagtgaatcatccagag

SEQ ID NO: 892497 - DNA, 25 bp, Mus musculus
cagatttggacaccttccttgtgac

SEQ ID NO: 892498 - DNA, 25 bp, Mus musculus
cagatttggacactttccagcagga

SEQ ID NO: 892499 - DNA, 25 bp, Mus musculus
cagatttggacagcttccttgtgac

SEQ ID NO: 892500 - DNA, 25 bp, Mus musculus
cagatttggacagtttccagcagga

SEQ ID NO: 892501 - DNA, 25 bp, Mus musculus
cagattttagcaccttcttactgtg

SEQ ID NO: 892502 - DNA, 25 bp, Mus musculus
cagattttagcacgtgaatatgacc

SEQ ID NO: 892503 - DNA, 25 bp, Mus musculus
cagattttagcagcttcttactgtg

SEQ ID NO: 892504 - DNA, 25 bp, Mus musculus
cagattttagcaggtgaatatgacc

SEQ ID NO: 892505 - DNA, 25 bp, Mus musculus
cagattttcaggccattgtgcttct

SEQ ID NO: 892506 - DNA, 25 bp, Mus musculus
cagattttcagggcattgtgcttct

SEQ ID NO: 892507 - DNA, 25 bp, Mus musculus
cagcaaacagacaagctcatctgag

SEQ ID NO: 892508 - DNA, 25 bp, Mus musculus
cagcaaacagagccctttgccatga

SEQ ID NO: 892509 - DNA, 25 bp, Mus musculus
cagcaaacagatgcgtgtacatcca

SEQ ID NO: 892510 - DNA, 25 bp, Mus musculus
cagcaaacagccatttcgtagagtg

SEQ ID NO: 892511 - DNA, 25 bp, Mus musculus
cagcaaacaggcatttcgtagagtg

SEQ ID NO: 892512 - DNA, 25 bp, Mus musculus
cagcaaacagtcaagctcatctgag

SEQ ID NO: 892513 - DNA, 25 bp, Mus musculus
cagcaaacagtgccctttgccatga

SEQ ID NO: 892514 - DNA, 25 bp, Mus musculus
cagcaaacagttgcgtgtacatcca

SEQ ID NO: 892515 - DNA, 25 bp, Mus musculus
cagcaaacataaagtgaccccatct

SEQ ID NO: 892516 - DNA, 25 bp, Mus musculus
cagcaaacataatgtgaccccatct

SEQ ID NO: 892517 - DNA, 25 bp, Mus musculus
cagcaaacatggcaccagagtcact

SEQ ID NO: 892518 - DNA, 25 bp, Mus musculus
cagcaaacatggcacgctctacaca

SEQ ID NO: 892519 - DNA, 25 bp, Mus musculus
cagcaaacatggcagcagagtcact

SEQ ID NO: 892520 - DNA, 25 bp, Mus musculus
cagcaaacatggcaggctctacaca

SEQ ID NO: 892521 - DNA, 25 bp, Mus musculus
cagcaaaccacgactagacaaggct

SEQ ID NO: 892522 - DNA, 25 bp, Mus musculus
cagcaaaccaggactagacaaggct

SEQ ID NO: 892523 - DNA, 25 bp, Mus musculus
cagcaaaccattcactttgcaggag

SEQ ID NO: 892524 - DNA, 25 bp, Mus musculus
cagcaaaccattcagtttgcaggag

SEQ ID NO: 892525 - DNA, 25 bp, Mus musculus
cagcaaagaaggagagaaaaacacc

SEQ ID NO: 892526 - DNA, 25 bp, Mus musculus
cagcaaagaaggtgagaaaaacacc

SEQ ID NO: 892527 - DNA, 25 bp, Mus musculus
cagcaaatgaggccgaacagctaat

SEQ ID NO: 892528 - DNA, 25 bp, Mus musculus
cagcaaatgagggcgaacagctaat

SEQ ID NO: 892529 - DNA, 25 bp, Mus musculus
cagcaacaacagatacaacagcagc

SEQ ID NO: 892530 - DNA, 25 bp, Mus musculus
cagcaacaacagttacaacagcagc

SEQ ID NO: 892531 - DNA, 25 bp, Mus musculus
cagcaacaaccccccttttgtcata

SEQ ID NO: 892532 - DNA, 25 bp, Mus musculus
cagcaacaacccgccttttgtcata

SEQ ID NO: 892533 - DNA, 25 bp, Mus musculus
cagcaacaatgcagcggttgacaac

SEQ ID NO: 892534 - DNA, 25 bp, Mus musculus
cagcaacaatgcaggggttgacaac

SEQ ID NO: 892535 - DNA, 25 bp, Mus musculus
cagcaacagttgccatccagcattc

SEQ ID NO: 892536 - DNA, 25 bp, Mus musculus
cagcaacagttgcgttctccccagg

SEQ ID NO: 892537 - DNA, 25 bp, Mus musculus
cagcaacagttgctcccatgcatca

SEQ ID NO: 892538 - DNA, 25 bp, Mus musculus
cagcaacagttggcatccagcattc

SEQ ID NO: 892539 - DNA, 25 bp, Mus musculus
cagcaacagttgggttctccccagg

SEQ ID NO: 892540 - DNA, 25 bp, Mus musculus
cagcaacagttggtcccatgcatca

SEQ ID NO: 892541 - DNA, 25 bp, Mus musculus
cagcaacatgcacaccctatttaag

SEQ ID NO: 892542 - DNA, 25 bp, Mus musculus
cagcaacatgcacagcctatttaag

SEQ ID NO: 892543 - DNA, 25 bp, Mus musculus
cagcaacattagcacgtccagcagt

SEQ ID NO: 892544 - DNA, 25 bp, Mus musculus
cagcaacattagcaggtccagcagt

SEQ ID NO: 892545 - DNA, 25 bp, Mus musculus
cagcaaccaaaacccagtcttcagt

SEQ ID NO: 892546 - DNA, 25 bp, Mus musculus
cagcaaccaaaagccagtcttcagt

SEQ ID NO: 892547 - DNA, 25 bp, Mus musculus
cagcaacccacattgcttcatggat

SEQ ID NO: 892548 - DNA, 25 bp, Mus musculus
cagcaacccagattgcttcatggat

SEQ ID NO: 892549 - DNA, 25 bp, Mus musculus
cagcaaccctgacgactggaaagaa

SEQ ID NO: 892550 - DNA, 25 bp, Mus musculus
cagcaaccctgaggactggaaagaa

SEQ ID NO: 892551 - DNA, 25 bp, Mus musculus
cagcaactagccatgaagcactacc

SEQ ID NO: 892552 - DNA, 25 bp, Mus musculus
cagcaactaggcatgaagcactacc

SEQ ID NO: 892553 - DNA, 25 bp, Mus musculus
cagcaactatgacgtgttccagtta

SEQ ID NO: 892554 - DNA, 25 bp, Mus musculus
cagcaactatgaggtgttccagtta

SEQ ID NO: 892555 - DNA, 25 bp, Mus musculus
cagcaactccacagactcagctgca

SEQ ID NO: 892556 - DNA, 25 bp, Mus musculus
cagcaactccacagtctcagctgca

SEQ ID NO: 892557 - DNA, 25 bp, Mus musculus
cagcaactgagacgggagcaaattt

SEQ ID NO: 892558 - DNA, 25 bp, Mus musculus
cagcaactgagaggggagcaaattt

SEQ ID NO: 892559 - DNA, 25 bp, Mus musculus
cagcaactgtcaggagtctcccagt

SEQ ID NO: 892560 - DNA, 25 bp, Mus musculus
cagcaactgtcaggtgtctcccagt

SEQ ID NO: 892561 - DNA, 25 bp, Mus musculus
cagcaagacaagctgcgaagtttcc

SEQ ID NO: 892562 - DNA, 25 bp, Mus musculus
cagcaagacaaggtgcgaagtttcc

SEQ ID NO: 892563 - DNA, 25 bp, Mus musculus
cagcaagactggctctgaaggtaga

SEQ ID NO: 892564 - DNA, 25 bp, Mus musculus
cagcaagactgggtctgaaggtaga

SEQ ID NO: 892565 - DNA, 25 bp, Mus musculus
cagcaagagcagctggtgaattttt

SEQ ID NO: 892566 - DNA, 25 bp, Mus musculus
cagcaagagcaggtggtgaattttt

SEQ ID NO: 892567 - DNA, 25 bp, Mus musculus
cagcaagccatgctgtttccatgga

SEQ ID NO: 892568 - DNA, 25 bp, Mus musculus
cagcaagccatggtgtttccatgga

SEQ ID NO: 892569 - DNA, 25 bp, Mus musculus
cagcaaggcctcaagttgggatatc

SEQ ID NO: 892570 - DNA, 25 bp, Mus musculus
cagcaaggcctctagttgggatatc

SEQ ID NO: 892571 - DNA, 25 bp, Mus musculus
cagcaatatacacgtcctttctgac

SEQ ID NO: 892572 - DNA, 25 bp, Mus musculus
cagcaatatacaggtcctttctgac

SEQ ID NO: 892573 - DNA, 25 bp, Mus musculus
cagcaatcaagagacaagtggctgg

SEQ ID NO: 892574 - DNA, 25 bp, Mus musculus
cagcaatcaagagagaagtggctgg

SEQ ID NO: 892575 - DNA, 25 bp, Mus musculus
cagcaatgagcatgtgactaaagca

SEQ ID NO: 892576 - DNA, 25 bp, Mus musculus
cagcaatgaggatgtgactaaagca

SEQ ID NO: 892577 - DNA, 25 bp, Mus musculus
cagcaatgtggacctggccatgggc

SEQ ID NO: 892578 - DNA, 25 bp, Mus musculus
cagcaatgtggagctggccatgggc

SEQ ID NO: 892579 - DNA, 25 bp, Mus musculus
cagcaattaaagcatgttctggagg

SEQ ID NO: 892580 - DNA, 25 bp, Mus musculus
cagcaattaaaggatgttctggagg

SEQ ID NO: 892581 - DNA, 25 bp, Mus musculus
cagcaattgccaggagaagcctagt

SEQ ID NO: 892582 - DNA, 25 bp, Mus musculus
cagcaattgccaggtgaagcctagt

SEQ ID NO: 892583 - DNA, 25 bp, Mus musculus
cagcacaaaaagcgactcagctgta

SEQ ID NO: 892584 - DNA, 25 bp, Mus musculus
cagcacaaaaagggactcagctgta

SEQ ID NO: 892585 - DNA, 25 bp, Mus musculus
cagcacaaagcgtgctgaatccaca

SEQ ID NO: 892586 - DNA, 25 bp, Mus musculus
cagcacaaagggtgctgaatccaca

SEQ ID NO: 892587 - DNA, 25 bp, Mus musculus
cagcacaagcgacggaagctaacag

SEQ ID NO: 892588 - DNA, 25 bp, Mus musculus
cagcacaagcgagggaagctaacag

SEQ ID NO: 892589 - DNA, 25 bp, Mus musculus
cagcacaagctgcagcagcagcagc

SEQ ID NO: 892590 - DNA, 25 bp, Mus musculus
cagcacaagctggagcagcagcagc

SEQ ID NO: 892591 - DNA, 25 bp, Mus musculus
cagcacacacagctactttgagact

SEQ ID NO: 892592 - DNA, 25 bp, Mus musculus
cagcacacacaggtactttgagact

SEQ ID NO: 892593 - DNA, 25 bp, Mus musculus
cagcacacagccagaggtgttaaag

SEQ ID NO: 892594 - DNA, 25 bp, Mus musculus
cagcacacaggcagaggtgttaaag

SEQ ID NO: 892595 - DNA, 25 bp, Mus musculus
cagcacacccagcagcccgagcaac

SEQ ID NO: 892596 - DNA, 25 bp, Mus musculus
cagcacacccaggagcccgagcaac

SEQ ID NO: 892597 - DNA, 25 bp, Mus musculus
cagcacactgagatatgcagatcgg

SEQ ID NO: 892598 - DNA, 25 bp, Mus musculus
cagcacactgagttatgcagatcgg

SEQ ID NO: 892599 - DNA, 25 bp, Mus musculus
cagcacagcatgagaaactctctgg

SEQ ID NO: 892600 - DNA, 25 bp, Mus musculus
cagcacagcatgtgaaactctctgg

SEQ ID NO: 892601 - DNA, 25 bp, Mus musculus
cagcacataaaaacttgcattgagg

SEQ ID NO: 892602 - DNA, 25 bp, Mus musculus
cagcacataaaatcttgcattgagg

SEQ ID NO: 892603 - DNA, 25 bp, Mus musculus
cagcacatccaaaaacccacctgtg

SEQ ID NO: 892604 - DNA, 25 bp, Mus musculus
cagcacatccaataacccacctgtg

SEQ ID NO: 892605 - DNA, 25 bp, Mus musculus
cagcacattcaactccatacaaggt

SEQ ID NO: 892606 - DNA, 25 bp, Mus musculus
cagcacattcaagtccatacaaggt

SEQ ID NO: 892607 - DNA, 25 bp, Mus musculus
cagcaccagctcaaattcagaccat

SEQ ID NO: 892608 - DNA, 25 bp, Mus musculus
cagcaccagctctaattcagaccat

SEQ ID NO: 892609 - DNA, 25 bp, Mus musculus
cagcaccatgcacgctgtcttctcg

SEQ ID NO: 892610 - DNA, 25 bp, Mus musculus
cagcaccatgcaggctgtcttctcg

SEQ ID NO: 892611 - DNA, 25 bp, Mus musculus
cagcacccacgtatccccctgcagc

SEQ ID NO: 892612 - DNA, 25 bp, Mus musculus
cagcacccacgtatgcccctgcagc

SEQ ID NO: 892613 - DNA, 25 bp, Mus musculus
cagcacccagcttgatgggggtact

SEQ ID NO: 892614 - DNA, 25 bp, Mus musculus
cagcacccaggttgatgggggtact

SEQ ID NO: 892615 - DNA, 25 bp, Mus musculus
cagcacccctgccacataatcagcc

SEQ ID NO: 892616 - DNA, 25 bp, Mus musculus
cagcacccctgccactctcctggct

SEQ ID NO: 892617 - DNA, 25 bp, Mus musculus
cagcacccctgccagataatcagcc

SEQ ID NO: 892618 - DNA, 25 bp, Mus musculus
cagcacccctgccagtctcctggct

SEQ ID NO: 892619 - DNA, 25 bp, Mus musculus
cagcaccggaacatacatgcctgca

SEQ ID NO: 892620 - DNA, 25 bp, Mus musculus
cagcaccggaacttacatgcctgca

SEQ ID NO: 892621 - DNA, 25 bp, Mus musculus
cagcaccggcctgttgcccaccaac

SEQ ID NO: 892622 - DNA, 25 bp, Mus musculus
cagcaccggcgtgttgcccaccaac

SEQ ID NO: 892623 - DNA, 25 bp, Mus musculus
cagcacctaccactacctagaactg

SEQ ID NO: 892624 - DNA, 25 bp, Mus musculus
cagcacctaccagtacctagaactg

SEQ ID NO: 892625 - DNA, 25 bp, Mus musculus
cagcacctcatgctgatacattggt

SEQ ID NO: 892626 - DNA, 25 bp, Mus musculus
cagcacctcatggtgatacattggt

SEQ ID NO: 892627 - DNA, 25 bp, Mus musculus
cagcacctctaccccctggtcttgg

SEQ ID NO: 892628 - DNA, 25 bp, Mus musculus
cagcacctctacgccctggtcttgg

SEQ ID NO: 892629 - DNA, 25 bp, Mus musculus
cagcacgacttgcctctgctgcgcc

SEQ ID NO: 892630 - DNA, 25 bp, Mus musculus
cagcacgacttggctctgctgcgcc

SEQ ID NO: 892631 - DNA, 25 bp, Mus musculus
cagcacgcccagatatggatgctgt

SEQ ID NO: 892632 - DNA, 25 bp, Mus musculus
cagcacgcccagttatggatgctgt

SEQ ID NO: 892633 - DNA, 25 bp, Mus musculus
cagcacggatcactcatgtggacaa

SEQ ID NO: 892634 - DNA, 25 bp, Mus musculus
cagcacggatcactgatgtggacaa

SEQ ID NO: 892635 - DNA, 25 bp, Mus musculus
cagcacgggctacacgttgcgttac

SEQ ID NO: 892636 - DNA, 25 bp, Mus musculus
cagcacgggctacaggttgcgttac

SEQ ID NO: 892637 - DNA, 25 bp, Mus musculus
cagcactaccaacttcacagctgcg

SEQ ID NO: 892638 - DNA, 25 bp, Mus musculus
cagcactaccaagttcacagctgcg

SEQ ID NO: 892639 - DNA, 25 bp, Mus musculus
cagcactaccagagaggcacagctc

SEQ ID NO: 892640 - DNA, 25 bp, Mus musculus
cagcactaccagtgaggcacagctc

SEQ ID NO: 892641 - DNA, 25 bp, Mus musculus
cagcactaccctcgctgtatcaacc

SEQ ID NO: 892642 - DNA, 25 bp, Mus musculus
cagcactaccctggctgtatcaacc

SEQ ID NO: 892643 - DNA, 25 bp, Mus musculus
cagcactgagggacagtaccttctg

SEQ ID NO: 892644 - DNA, 25 bp, Mus musculus
cagcactgagggactgtaccttctg

SEQ ID NO: 892645 - DNA, 25 bp, Mus musculus
cagcactgcatccacctctgttcct

SEQ ID NO: 892646 - DNA, 25 bp, Mus musculus
cagcactgcatccagctctgttcct

SEQ ID NO: 892647 - DNA, 25 bp, Mus musculus
cagcactgcatgagaaactctctgg

SEQ ID NO: 892648 - DNA, 25 bp, Mus musculus
cagcactgcatgtgaaactctctgg

SEQ ID NO: 892649 - DNA, 25 bp, Mus musculus
cagcactgccaacacatctacacac

SEQ ID NO: 892650 - DNA, 25 bp, Mus musculus
cagcactgccaacacggtgcatcgc

SEQ ID NO: 892651 - DNA, 25 bp, Mus musculus
cagcactgccaacagatctacacac

SEQ ID NO: 892652 - DNA, 25 bp, Mus musculus
cagcactgccaacagggtgcatcgc

SEQ ID NO: 892653 - DNA, 25 bp, Mus musculus
cagcactgtcaaccggaagatggag

SEQ ID NO: 892654 - DNA, 25 bp, Mus musculus
cagcactgtcaaccttctcatgctg

SEQ ID NO: 892655 - DNA, 25 bp, Mus musculus
cagcactgtcaacgatgtgtttgag

SEQ ID NO: 892656 - DNA, 25 bp, Mus musculus
cagcactgtcaagcggaagatggag

SEQ ID NO: 892657 - DNA, 25 bp, Mus musculus
cagcactgtcaagcttctcatgctg

SEQ ID NO: 892658 - DNA, 25 bp, Mus musculus
cagcactgtcaaggatgtgtttgag

SEQ ID NO: 892659 - DNA, 25 bp, Mus musculus
cagcactgtgcctgccagggccagt

SEQ ID NO: 892660 - DNA, 25 bp, Mus musculus
cagcactgtggctgccagggccagt

SEQ ID NO: 892661 - DNA, 25 bp, Mus musculus
cagcactgtttgagctggctttatg

SEQ ID NO: 892662 - DNA, 25 bp, Mus musculus
cagcactgtttgtgctggctttatg

SEQ ID NO: 892663 - DNA, 25 bp, Mus musculus
cagcacttcccactggctccagaag

SEQ ID NO: 892664 - DNA, 25 bp, Mus musculus
cagcacttcccagtggctccagaag

SEQ ID NO: 892665 - DNA, 25 bp, Mus musculus
cagcactttgcacgttggtgagacc

SEQ ID NO: 892666 - DNA, 25 bp, Mus musculus
cagcactttgcaggttggtgagacc

SEQ ID NO: 892667 - DNA, 25 bp, Mus musculus
cagcagaaaaactctgagccctgga

SEQ ID NO: 892668 - DNA, 25 bp, Mus musculus
cagcagaaaacccgttgctgtggtt

SEQ ID NO: 892669 - DNA, 25 bp, Mus musculus
cagcagaaaaccggttgctgtggtt

SEQ ID NO: 892670 - DNA, 25 bp, Mus musculus
cagcagaaaatctctgagccctgga

SEQ ID NO: 892671 - DNA, 25 bp, Mus musculus
cagcagaaacatcactatcagcagc

SEQ ID NO: 892672 - DNA, 25 bp, Mus musculus
cagcagaaacatcagtatcagcagc

SEQ ID NO: 892673 - DNA, 25 bp, Mus musculus
cagcagaaaccgaaaaagccttgat

SEQ ID NO: 892674 - DNA, 25 bp, Mus musculus
cagcagaaaccgtaaaagccttgat

SEQ ID NO: 892675 - DNA, 25 bp, Mus musculus
cagcagaaagatgttaaacactctg

SEQ ID NO: 892676 - DNA, 25 bp, Mus musculus
cagcagaaagttgttaaacactctg

SEQ ID NO: 892677 - DNA, 25 bp, Mus musculus
cagcagaaattcacaacagacatca

SEQ ID NO: 892678 - DNA, 25 bp, Mus musculus
cagcagaaattctcaacagacatca

SEQ ID NO: 892679 - DNA, 25 bp, Mus musculus
cagcagaacaatccgcttgaaccaa

SEQ ID NO: 892680 - DNA, 25 bp, Mus musculus
cagcagaacattccgcttgaaccaa

SEQ ID NO: 892681 - DNA, 25 bp, Mus musculus
cagcagaacgctgacttgaaagacg

SEQ ID NO: 892682 - DNA, 25 bp, Mus musculus
cagcagaacgctgcacatttgaaga

SEQ ID NO: 892683 - DNA, 25 bp, Mus musculus
cagcagaacgctgcatgtgaatggc

SEQ ID NO: 892684 - DNA, 25 bp, Mus musculus
cagcagaacgctgctcatttgaaga

SEQ ID NO: 892685 - DNA, 25 bp, Mus musculus
cagcagaacgctgcttgtgaatggc

SEQ ID NO: 892686 - DNA, 25 bp, Mus musculus
cagcagaacggtgacttgaaagacg

SEQ ID NO: 892687 - DNA, 25 bp, Mus musculus
cagcagacaacaaacacaatgggac

SEQ ID NO: 892688 - DNA, 25 bp, Mus musculus
cagcagacaacaaagacaatgggac

SEQ ID NO: 892689 - DNA, 25 bp, Mus musculus
cagcagagaagaagtgaccattaat

SEQ ID NO: 892690 - DNA, 25 bp, Mus musculus
cagcagagaagatgtgaccattaat

SEQ ID NO: 892691 - DNA, 25 bp, Mus musculus
cagcagagcaggagaagagaaggag

SEQ ID NO: 892692 - DNA, 25 bp, Mus musculus
cagcagagcaggtgaagagaaggag

SEQ ID NO: 892693 - DNA, 25 bp, Mus musculus
cagcagaggctgcactatgagagta

SEQ ID NO: 892694 - DNA, 25 bp, Mus musculus
cagcagaggctggactatgagagta

SEQ ID NO: 892695 - DNA, 25 bp, Mus musculus
cagcagagtgaacggagcaagagca

SEQ ID NO: 892696 - DNA, 25 bp, Mus musculus
cagcagagtgaagggagcaagagca

SEQ ID NO: 892697 - DNA, 25 bp, Mus musculus
cagcagagtggaagagtgatcaggt

SEQ ID NO: 892698 - DNA, 25 bp, Mus musculus
cagcagagtggaagtgtgatcaggt

SEQ ID NO: 892699 - DNA, 25 bp, Mus musculus
cagcagatattacaaagtgaaaaag

SEQ ID NO: 892700 - DNA, 25 bp, Mus musculus
cagcagatattagaaagtgaaaaag

SEQ ID NO: 892701 - DNA, 25 bp, Mus musculus
cagcagatcaagatttccatggaga

SEQ ID NO: 892702 - DNA, 25 bp, Mus musculus
cagcagatcaagttttccatggaga

SEQ ID NO: 892703 - DNA, 25 bp, Mus musculus
cagcagatccagcaggttaacatgc

SEQ ID NO: 892704 - DNA, 25 bp, Mus musculus
cagcagatccagcttaacatgcctt

SEQ ID NO: 892705 - DNA, 25 bp, Mus musculus
cagcagatccaggaggttaacatgc

SEQ ID NO: 892706 - DNA, 25 bp, Mus musculus
cagcagatccaggttaacatgcctt

SEQ ID NO: 892707 - DNA, 25 bp, Mus musculus
cagcagatcgatttgaatgtaacct

SEQ ID NO: 892708 - DNA, 25 bp, Mus musculus
cagcagatcgttttgaatgtaacct

SEQ ID NO: 892709 - DNA, 25 bp, Mus musculus
cagcagatctctcacgggagaccca

SEQ ID NO: 892710 - DNA, 25 bp, Mus musculus
cagcagatctctcacgggatcatga

SEQ ID NO: 892711 - DNA, 25 bp, Mus musculus
cagcagatctctcaggggagaccca

SEQ ID NO: 892712 - DNA, 25 bp, Mus musculus
cagcagatctctcaggggatcatga

SEQ ID NO: 892713 - DNA, 25 bp, Mus musculus
cagcagatggctgacgaaatggtag

SEQ ID NO: 892714 - DNA, 25 bp, Mus musculus
cagcagatggctgaggaaatggtag

SEQ ID NO: 892715 - DNA, 25 bp, Mus musculus
cagcagatgtggcagtgtttggatg

SEQ ID NO: 892716 - DNA, 25 bp, Mus musculus
cagcagatgtgggagtgtttggatg

SEQ ID NO: 892717 - DNA, 25 bp, Mus musculus
cagcagatttgcactgaatcatcca

SEQ ID NO: 892718 - DNA, 25 bp, Mus musculus
cagcagatttgctctgaatcatcca

SEQ ID NO: 892719 - DNA, 25 bp, Mus musculus
cagcagcaacagttcgcatccagca

SEQ ID NO: 892720 - DNA, 25 bp, Mus musculus
cagcagcaacagttcggttctcccc

SEQ ID NO: 892721 - DNA, 25 bp, Mus musculus
cagcagcaacagttcgtcccatgca

SEQ ID NO: 892722 - DNA, 25 bp, Mus musculus
cagcagcaacagttggcatccagca

SEQ ID NO: 892723 - DNA, 25 bp, Mus musculus
cagcagcaacagttgggttctcccc

SEQ ID NO: 892724 - DNA, 25 bp, Mus musculus
cagcagcaacagttggtcccatgca

SEQ ID NO: 892725 - DNA, 25 bp, Mus musculus
cagcagcaagctgtctggtcggagg

SEQ ID NO: 892726 - DNA, 25 bp, Mus musculus
cagcagcaaggcctcaagttgggat

SEQ ID NO: 892727 - DNA, 25 bp, Mus musculus
cagcagcaaggcctgaagttgggat

SEQ ID NO: 892728 - DNA, 25 bp, Mus musculus
cagcagcaaggtgtctggtcggagg

SEQ ID NO: 892729 - DNA, 25 bp, Mus musculus
cagcagcacaagctccagcagcagc

SEQ ID NO: 892730 - DNA, 25 bp, Mus musculus
cagcagcacaagctgcagcagcagc

SEQ ID NO: 892731 - DNA, 25 bp, Mus musculus
cagcagcaccagatttcaatgggag

SEQ ID NO: 892732 - DNA, 25 bp, Mus musculus
cagcagcaccagcgcctgtccacca

SEQ ID NO: 892733 - DNA, 25 bp, Mus musculus
cagcagcaccagggcctgtccacca

SEQ ID NO: 892734 - DNA, 25 bp, Mus musculus
cagcagcaccagttttcaatgggag

SEQ ID NO: 892735 - DNA, 25 bp, Mus musculus
cagcagcagaaaatctctgagccct

SEQ ID NO: 892736 - DNA, 25 bp, Mus musculus
cagcagcagaaattctctgagccct

SEQ ID NO: 892737 - DNA, 25 bp, Mus musculus
cagcagcagatccaccaggttaaca

SEQ ID NO: 892738 - DNA, 25 bp, Mus musculus
cagcagcagatccacgttaacatgc

SEQ ID NO: 892739 - DNA, 25 bp, Mus musculus
cagcagcagatccagcaggttaaca

SEQ ID NO: 892740 - DNA, 25 bp, Mus musculus
cagcagcagatccaggttaacatgc

SEQ ID NO: 892741 - DNA, 25 bp, Mus musculus
cagcagcaggagcacatcgccaagc

SEQ ID NO: 892742 - DNA, 25 bp, Mus musculus
cagcagcaggagcagatcgccaagc

SEQ ID NO: 892743 - DNA, 25 bp, Mus musculus
cagcagcagttgcacgaatctcagc

SEQ ID NO: 892744 - DNA, 25 bp, Mus musculus
cagcagcagttgcaggaatctcagc

SEQ ID NO: 892745 - DNA, 25 bp, Mus musculus
cagcagcagtttcagggcgtgcgca

SEQ ID NO: 892746 - DNA, 25 bp, Mus musculus
cagcagcagtttgagggcgtgcgca

SEQ ID NO: 892747 - DNA, 25 bp, Mus musculus
cagcagcagtttgtcgagggcgtgc

SEQ ID NO: 892748 - DNA, 25 bp, Mus musculus
cagcagcagtttgtggagggcgtgc

SEQ ID NO: 892749 - DNA, 25 bp, Mus musculus
cagcagcataagcatgagattgact

SEQ ID NO: 892750 - DNA, 25 bp, Mus musculus
cagcagcataaggatgagattgact

SEQ ID NO: 892751 - DNA, 25 bp, Mus musculus
cagcagccaaggacacttagcctgt

SEQ ID NO: 892752 - DNA, 25 bp, Mus musculus
cagcagccaaggtcacttagcctgt

SEQ ID NO: 892753 - DNA, 25 bp, Mus musculus
cagcagccagatcccagccacagct

SEQ ID NO: 892754 - DNA, 25 bp, Mus musculus
cagcagccagcagatgtcctctgag

SEQ ID NO: 892755 - DNA, 25 bp, Mus musculus
cagcagccagctggcagccacctgc

SEQ ID NO: 892756 - DNA, 25 bp, Mus musculus
cagcagccaggagatgtcctctgag

SEQ ID NO: 892757 - DNA, 25 bp, Mus musculus
cagcagccaggtggcagccacctgc

SEQ ID NO: 892758 - DNA, 25 bp, Mus musculus
cagcagccagttcccagccacagct

SEQ ID NO: 892759 - DNA, 25 bp, Mus musculus
cagcagccctctttgatctgtggat

SEQ ID NO: 892760 - DNA, 25 bp, Mus musculus
cagcagccctggagtctgagagcaa

SEQ ID NO: 892761 - DNA, 25 bp, Mus musculus
cagcagccctggtgtctgagagcaa

SEQ ID NO: 892762 - DNA, 25 bp, Mus musculus
cagcagccctgtttgatctgtggat

SEQ ID NO: 892763 - DNA, 25 bp, Mus musculus
cagcagccgtgagacggtttgtgga

SEQ ID NO: 892764 - DNA, 25 bp, Mus musculus
cagcagccgtgagagggtttgtgga

SEQ ID NO: 892765 - DNA, 25 bp, Mus musculus
cagcagcctaaaaaagggcaagaaa

SEQ ID NO: 892766 - DNA, 25 bp, Mus musculus
cagcagcctaaataagggcaagaaa

SEQ ID NO: 892767 - DNA, 25 bp, Mus musculus
cagcagcgacactccgcccagctgt

SEQ ID NO: 892768 - DNA, 25 bp, Mus musculus
cagcagcgacactcggcccagctgt

SEQ ID NO: 892769 - DNA, 25 bp, Mus musculus
cagcagcgagcacatgtctcatttc

SEQ ID NO: 892770 - DNA, 25 bp, Mus musculus
cagcagcgagcagatgtctcatttc

SEQ ID NO: 892771 - DNA, 25 bp, Mus musculus
cagcagcgcaagaccttcacagcct

SEQ ID NO: 892772 - DNA, 25 bp, Mus musculus
cagcagcgcaagtccttcacagcct

SEQ ID NO: 892773 - DNA, 25 bp, Mus musculus
cagcagcgctcacggcgacgcagga

SEQ ID NO: 892774 - DNA, 25 bp, Mus musculus
cagcagcgctcagggcgacgcagga

SEQ ID NO: 892775 - DNA, 25 bp, Mus musculus
cagcagcggcaccacagcacccaag

SEQ ID NO: 892776 - DNA, 25 bp, Mus musculus
cagcagcggcacgacagcacccaag

SEQ ID NO: 892777 - DNA, 25 bp, Mus musculus
cagcagcgtggagacatatgagcca

SEQ ID NO: 892778 - DNA, 25 bp, Mus musculus
cagcagcgtggagagatatgagcca

SEQ ID NO: 892779 - DNA, 25 bp, Mus musculus
cagcagctcagacccccatcagcat

SEQ ID NO: 892780 - DNA, 25 bp, Mus musculus
cagcagctcagagccccatcagcat

SEQ ID NO: 892781 - DNA, 25 bp, Mus musculus
cagcagctcgcaaattcgatggaag

SEQ ID NO: 892782 - DNA, 25 bp, Mus musculus
cagcagctcggaaattcgatggaag

SEQ ID NO: 892783 - DNA, 25 bp, Mus musculus
cagcagctgaaattagtccgtgctc

SEQ ID NO: 892784 - DNA, 25 bp, Mus musculus
cagcagctgaaatttgtccgtgctc

SEQ ID NO: 892785 - DNA, 25 bp, Mus musculus
cagcagctgaggcacagaaaaggca

SEQ ID NO: 892786 - DNA, 25 bp, Mus musculus
cagcagctgaggcacggtcagaaag

SEQ ID NO: 892787 - DNA, 25 bp, Mus musculus
cagcagctgaggcagagaaaaggca

SEQ ID NO: 892788 - DNA, 25 bp, Mus musculus
cagcagctgaggcagggtcagaaag

SEQ ID NO: 892789 - DNA, 25 bp, Mus musculus
cagcagctgcagaacatggacaagg

SEQ ID NO: 892790 - DNA, 25 bp, Mus musculus
cagcagctgcagtacatggacaagg

SEQ ID NO: 892791 - DNA, 25 bp, Mus musculus
cagcagctggagcaccttattaatc

SEQ ID NO: 892792 - DNA, 25 bp, Mus musculus
cagcagctggaggaccttattaatc

SEQ ID NO: 892793 - DNA, 25 bp, Mus musculus
cagcaggaagaaaaatctctttgtg

SEQ ID NO: 892794 - DNA, 25 bp, Mus musculus
cagcaggaagaatggaagcttctct

SEQ ID NO: 892795 - DNA, 25 bp, Mus musculus
cagcaggaagacaggaagatctgtg

SEQ ID NO: 892796 - DNA, 25 bp, Mus musculus
cagcaggaagacctttgggaagtcc

SEQ ID NO: 892797 - DNA, 25 bp, Mus musculus
cagcaggaagcaaagaaaggagagg

SEQ ID NO: 892798 - DNA, 25 bp, Mus musculus
cagcaggaagcgcatccagtatgga

SEQ ID NO: 892799 - DNA, 25 bp, Mus musculus
cagcaggaagcgtcccaggttcctg

SEQ ID NO: 892800 - DNA, 25 bp, Mus musculus
cagcaggaaggaaagaaaggagagg

SEQ ID NO: 892801 - DNA, 25 bp, Mus musculus
cagcaggaagggcatccagtatgga

SEQ ID NO: 892802 - DNA, 25 bp, Mus musculus
cagcaggaagggtcccaggttcctg

SEQ ID NO: 892803 - DNA, 25 bp, Mus musculus
cagcaggaagtaaaatctctttgtg

SEQ ID NO: 892804 - DNA, 25 bp, Mus musculus
cagcaggaagtatggaagcttctct

SEQ ID NO: 892805 - DNA, 25 bp, Mus musculus
cagcaggaagtcaggaagatctgtg

SEQ ID NO: 892806 - DNA, 25 bp, Mus musculus
cagcaggaagtcctttgggaagtcc

SEQ ID NO: 892807 - DNA, 25 bp, Mus musculus
cagcaggacaatgaccagttgaact

SEQ ID NO: 892808 - DNA, 25 bp, Mus musculus
cagcaggacattgaccagttgaact

SEQ ID NO: 892809 - DNA, 25 bp, Mus musculus
cagcaggacgtgctgacagagttag

SEQ ID NO: 892810 - DNA, 25 bp, Mus musculus
cagcaggacgtggtgacagagttag

SEQ ID NO: 892811 - DNA, 25 bp, Mus musculus
cagcaggagcagatcgccaagcagc

SEQ ID NO: 892812 - DNA, 25 bp, Mus musculus
cagcaggagcagttcgccaagcagc

SEQ ID NO: 892813 - DNA, 25 bp, Mus musculus
cagcaggcagctgccagaccctcta

SEQ ID NO: 892814 - DNA, 25 bp, Mus musculus
cagcaggcaggtgccagaccctcta

SEQ ID NO: 892815 - DNA, 25 bp, Mus musculus
cagcaggccgcgctagaaaatgcta

SEQ ID NO: 892816 - DNA, 25 bp, Mus musculus
cagcaggccgcggtagaaaatgcta

SEQ ID NO: 892817 - DNA, 25 bp, Mus musculus
cagcaggctctgcacttggagagca

SEQ ID NO: 892818 - DNA, 25 bp, Mus musculus
cagcaggctctgcagttggagagca

SEQ ID NO: 892819 - DNA, 25 bp, Mus musculus
cagcagggcatcaacaagtcaacaa

SEQ ID NO: 892820 - DNA, 25 bp, Mus musculus
cagcagggcatcaactattggctgg

SEQ ID NO: 892821 - DNA, 25 bp, Mus musculus
cagcagggcatcaagaagtcaacaa

SEQ ID NO: 892822 - DNA, 25 bp, Mus musculus
cagcagggcatcaagtattggctgg

SEQ ID NO: 892823 - DNA, 25 bp, Mus musculus
cagcagggcttgctcttctcctctt

SEQ ID NO: 892824 - DNA, 25 bp, Mus musculus
cagcagggcttgctgttctcctctt

SEQ ID NO: 892825 - DNA, 25 bp, Mus musculus
cagcaggggctgcacggggcacagc

SEQ ID NO: 892826 - DNA, 25 bp, Mus musculus
cagcaggggctgcagggggcacagc

SEQ ID NO: 892827 - DNA, 25 bp, Mus musculus
cagcaggggtttcacgcagaaaatg

SEQ ID NO: 892828 - DNA, 25 bp, Mus musculus
cagcaggggtttcacgtctgcatta

SEQ ID NO: 892829 - DNA, 25 bp, Mus musculus
cagcaggggtttcaggcagaaaatg

SEQ ID NO: 892830 - DNA, 25 bp, Mus musculus
cagcaggggtttcaggtctgcatta

SEQ ID NO: 892831 - DNA, 25 bp, Mus musculus
cagcaggtaattaacgagatggtgc

SEQ ID NO: 892832 - DNA, 25 bp, Mus musculus
cagcaggtaattagtgaaatggtta

SEQ ID NO: 892833 - DNA, 25 bp, Mus musculus
cagcaggtaatttacgagatggtgc

SEQ ID NO: 892834 - DNA, 25 bp, Mus musculus
cagcaggtaatttgtgaaatggtta

SEQ ID NO: 892835 - DNA, 25 bp, Mus musculus
cagcagtaagacaaagccacctgga

SEQ ID NO: 892836 - DNA, 25 bp, Mus musculus
cagcagtaagacaatgccacctgga

SEQ ID NO: 892837 - DNA, 25 bp, Mus musculus
cagcagtaccgagtcgagctggctg

SEQ ID NO: 892838 - DNA, 25 bp, Mus musculus
cagcagtaccgagtggagctggctg

SEQ ID NO: 892839 - DNA, 25 bp, Mus musculus
cagcagtatttgattttgaatacgg

SEQ ID NO: 892840 - DNA, 25 bp, Mus musculus
cagcagtatttgtttttgaatacgg

SEQ ID NO: 892841 - DNA, 25 bp, Mus musculus
cagcagtctcagctgcccccaaagc

SEQ ID NO: 892842 - DNA, 25 bp, Mus musculus
cagcagtctcaggtgcccccaaagc

SEQ ID NO: 892843 - DNA, 25 bp, Mus musculus
cagcagtgagcaaatttttaaacaa

SEQ ID NO: 892844 - DNA, 25 bp, Mus musculus
cagcagtgaggaaatttttaaacaa

SEQ ID NO: 892845 - DNA, 25 bp, Mus musculus
cagcagtggcataacgtacagaaag

SEQ ID NO: 892846 - DNA, 25 bp, Mus musculus
cagcagtggcataaggtacagaaag

SEQ ID NO: 892847 - DNA, 25 bp, Mus musculus
cagcagtgtgaacggctcaggatgc

SEQ ID NO: 892848 - DNA, 25 bp, Mus musculus
cagcagtgtgaagggctcaggatgc

SEQ ID NO: 892849 - DNA, 25 bp, Mus musculus
cagcagtgtgatgtgggaggagaaa

SEQ ID NO: 892850 - DNA, 25 bp, Mus musculus
cagcagtgtgttgtgggaggagaaa

SEQ ID NO: 892851 - DNA, 25 bp, Mus musculus
cagcagtgttacaacagttggtgaa

SEQ ID NO: 892852 - DNA, 25 bp, Mus musculus
cagcagtgttacaagagttggtgaa

SEQ ID NO: 892853 - DNA, 25 bp, Mus musculus
cagcagttattgtgcattctcaaac

SEQ ID NO: 892854 - DNA, 25 bp, Mus musculus
cagcagttattgtggattctcaaac

SEQ ID NO: 892855 - DNA, 25 bp, Mus musculus
cagcagttcaagaagcgttctgtgg

SEQ ID NO: 892856 - DNA, 25 bp, Mus musculus
cagcagttcaagtagcgttctgtgg

SEQ ID NO: 892857 - DNA, 25 bp, Mus musculus
cagcagttcacgattctcgagcagg

SEQ ID NO: 892858 - DNA, 25 bp, Mus musculus
cagcagttcacgtttctcgagcagg

SEQ ID NO: 892859 - DNA, 25 bp, Mus musculus
cagcagttgcagcaatctcagcaaa

SEQ ID NO: 892860 - DNA, 25 bp, Mus musculus
cagcagttgcaggaatctcagcaaa

SEQ ID NO: 892861 - DNA, 25 bp, Mus musculus
cagcagtttgtgcagggcgtgcgca

SEQ ID NO: 892862 - DNA, 25 bp, Mus musculus
cagcagtttgtggagggcgtgcgca

SEQ ID NO: 892863 - DNA, 25 bp, Mus musculus
cagcataggacattatccttcccgt

SEQ ID NO: 892864 - DNA, 25 bp, Mus musculus
cagcataggacattttccttcccgt

SEQ ID NO: 892865 - DNA, 25 bp, Mus musculus
cagcatataattcaatttgaccagc

SEQ ID NO: 892866 - DNA, 25 bp, Mus musculus
cagcatataattcattttgaccagc

SEQ ID NO: 892867 - DNA, 25 bp, Mus musculus
cagcatcaaacaaggaggaatcgtc

SEQ ID NO: 892868 - DNA, 25 bp, Mus musculus
cagcatcaaacaatttgtcgtccta

SEQ ID NO: 892869 - DNA, 25 bp, Mus musculus
cagcatcaaacatggaggaatcgtc

SEQ ID NO: 892870 - DNA, 25 bp, Mus musculus
cagcatcaaacattttgtcgtccta

SEQ ID NO: 892871 - DNA, 25 bp, Mus musculus
cagcatcaggactcacaggtaaatg

SEQ ID NO: 892872 - DNA, 25 bp, Mus musculus
cagcatcaggactctcaggtaaatg

SEQ ID NO: 892873 - DNA, 25 bp, Mus musculus
cagcatcaggattgctgaaagacag

SEQ ID NO: 892874 - DNA, 25 bp, Mus musculus
cagcatcaggtttgctgaaagacag

SEQ ID NO: 892875 - DNA, 25 bp, Mus musculus
cagcatcatgaacccagactataat

SEQ ID NO: 892876 - DNA, 25 bp, Mus musculus
cagcatcatgaagccagactataat

SEQ ID NO: 892877 - DNA, 25 bp, Mus musculus
cagcatcattaccaacctcctttac

SEQ ID NO: 892878 - DNA, 25 bp, Mus musculus
cagcatcattacgaacctcctttac

SEQ ID NO: 892879 - DNA, 25 bp, Mus musculus
cagcatcatttaatcgtcaggggag

SEQ ID NO: 892880 - DNA, 25 bp, Mus musculus
cagcatcatttaatggtcaggggag

SEQ ID NO: 892881 - DNA, 25 bp, Mus musculus
cagcatccagctcacctacttcccc

SEQ ID NO: 892882 - DNA, 25 bp, Mus musculus
cagcatccaggtcacctacttcccc

SEQ ID NO: 892883 - DNA, 25 bp, Mus musculus
cagcatcccactcgaaagggcatcg

SEQ ID NO: 892884 - DNA, 25 bp, Mus musculus
cagcatcccactggaaagggcatcg

SEQ ID NO: 892885 - DNA, 25 bp, Mus musculus
cagcatcctcagctatttggagagc

SEQ ID NO: 892886 - DNA, 25 bp, Mus musculus
cagcatcctcaggtatttggagagc

SEQ ID NO: 892887 - DNA, 25 bp, Mus musculus
cagcatcgaggacgaagaattcaac

SEQ ID NO: 892888 - DNA, 25 bp, Mus musculus
cagcatcgaggaggaagaattcaac

SEQ ID NO: 892889 - DNA, 25 bp, Mus musculus
cagcatctcccacgtaaatcacaac

SEQ ID NO: 892890 - DNA, 25 bp, Mus musculus
cagcatctcccaggtaaatcacaac

SEQ ID NO: 892891 - DNA, 25 bp, Mus musculus
cagcatctggcgattttctgggaac

SEQ ID NO: 892892 - DNA, 25 bp, Mus musculus
cagcatctggggattttctgggaac

SEQ ID NO: 892893 - DNA, 25 bp, Mus musculus
cagcatctgtaataccaggatgctg

SEQ ID NO: 892894 - DNA, 25 bp, Mus musculus
cagcatctgtaatacgtgtgtgctg

SEQ ID NO: 892895 - DNA, 25 bp, Mus musculus
cagcatctgtaatagcaggatgctg

SEQ ID NO: 892896 - DNA, 25 bp, Mus musculus
cagcatctgtaataggtgtgtgctg

SEQ ID NO: 892897 - DNA, 25 bp, Mus musculus
cagcatcttgacaacacagaggagg

SEQ ID NO: 892898 - DNA, 25 bp, Mus musculus
cagcatcttgacaagacagaggagg

SEQ ID NO: 892899 - DNA, 25 bp, Mus musculus
cagcatgaaacgatatgaacttcca

SEQ ID NO: 892900 - DNA, 25 bp, Mus musculus
cagcatgaaacgttatgaacttcca

SEQ ID NO: 892901 - DNA, 25 bp, Mus musculus
cagcatggcagacgctcctcttcca

SEQ ID NO: 892902 - DNA, 25 bp, Mus musculus
cagcatggcagaggctcctcttcca

SEQ ID NO: 892903 - DNA, 25 bp, Mus musculus
cagcatgggcaaagaagtgcttcag

SEQ ID NO: 892904 - DNA, 25 bp, Mus musculus
cagcatgggcaatgaagtgcttcag

SEQ ID NO: 892905 - DNA, 25 bp, Mus musculus
cagcatgtccagagggatggacaag

SEQ ID NO: 892906 - DNA, 25 bp, Mus musculus
cagcatgtccagtgggatggacaag

SEQ ID NO: 892907 - DNA, 25 bp, Mus musculus
cagcatgtggtcaacgacttaatgg

SEQ ID NO: 892908 - DNA, 25 bp, Mus musculus
cagcatgtggtcaacgttcttgcag

SEQ ID NO: 892909 - DNA, 25 bp, Mus musculus
cagcatgtggtcaaggacttaatgg

SEQ ID NO: 892910 - DNA, 25 bp, Mus musculus
cagcatgtggtcaaggttcttgcag

SEQ ID NO: 892911 - DNA, 25 bp, Mus musculus
cagcattaagagaaattgcttttac

SEQ ID NO: 892912 - DNA, 25 bp, Mus musculus
cagcattaagcctcggctattagcc

SEQ ID NO: 892913 - DNA, 25 bp, Mus musculus
cagcattaaggctcggctattagcc

SEQ ID NO: 892914 - DNA, 25 bp, Mus musculus
cagcattaagtgaaattgcttttac

SEQ ID NO: 892915 - DNA, 25 bp, Mus musculus
cagcattactcacagaaagctgatg

SEQ ID NO: 892916 - DNA, 25 bp, Mus musculus
cagcattactcacagagagccgcag

SEQ ID NO: 892917 - DNA, 25 bp, Mus musculus
cagcattactcagagaaagctgatg

SEQ ID NO: 892918 - DNA, 25 bp, Mus musculus
cagcattactcagagagagccgcag

SEQ ID NO: 892919 - DNA, 25 bp, Mus musculus
cagcattgctgacgttgaaaatgag

SEQ ID NO: 892920 - DNA, 25 bp, Mus musculus
cagcattgctgaggttgaaaatgag

SEQ ID NO: 892921 - DNA, 25 bp, Mus musculus
cagcattgtcagattcttagcaagg

SEQ ID NO: 892922 - DNA, 25 bp, Mus musculus
cagcattgtcagtttcttagcaagg

SEQ ID NO: 892923 - DNA, 25 bp, Mus musculus
cagcatttgcagactccaaaaaaca

SEQ ID NO: 892924 - DNA, 25 bp, Mus musculus
cagcatttgcagtctccaaaaaaca

SEQ ID NO: 892925 - DNA, 25 bp, Mus musculus
cagcatttggcggagagcacggtca

SEQ ID NO: 892926 - DNA, 25 bp, Mus musculus
cagcatttgggggagagcacggtca

SEQ ID NO: 892927 - DNA, 25 bp, Mus musculus
cagcattttgaaaacttccaatctg

SEQ ID NO: 892928 - DNA, 25 bp, Mus musculus
cagcattttgaaaagttccaatctg

SEQ ID NO: 892929 - DNA, 25 bp, Mus musculus
cagccaaacacgcgctctcaggtcc

SEQ ID NO: 892930 - DNA, 25 bp, Mus musculus
cagccaaacacgggctctcaggtcc

SEQ ID NO: 892931 - DNA, 25 bp, Mus musculus
cagccaacagagaaagcccagagtc

SEQ ID NO: 892932 - DNA, 25 bp, Mus musculus
cagccaacagagccagtaagcccag

SEQ ID NO: 892933 - DNA, 25 bp, Mus musculus
cagccaacagaggcagtaagcccag

SEQ ID NO: 892934 - DNA, 25 bp, Mus musculus
cagccaacagagtaagcccagagtc

SEQ ID NO: 892935 - DNA, 25 bp, Mus musculus
cagccaacagcactcctgagctgag

SEQ ID NO: 892936 - DNA, 25 bp, Mus musculus
cagccaacagctcagaccaagccac

SEQ ID NO: 892937 - DNA, 25 bp, Mus musculus
cagccaacaggactcctgagctgag

SEQ ID NO: 892938 - DNA, 25 bp, Mus musculus
cagccaacaggtcagaccaagccac

SEQ ID NO: 892939 - DNA, 25 bp, Mus musculus
cagccaacccaaatgcccggcccac

SEQ ID NO: 892940 - DNA, 25 bp, Mus musculus
cagccaacccaattgcccggcccac

SEQ ID NO: 892941 - DNA, 25 bp, Mus musculus
cagccaacgtccgacattgttgcca

SEQ ID NO: 892942 - DNA, 25 bp, Mus musculus
cagccaacgtccgagattgttgcca

SEQ ID NO: 892943 - DNA, 25 bp, Mus musculus
cagccaacttagactcctgcgccat

SEQ ID NO: 892944 - DNA, 25 bp, Mus musculus
cagccaactttgactcctgcgccat

SEQ ID NO: 892945 - DNA, 25 bp, Mus musculus
cagccaagaaagagggcacagaagt

SEQ ID NO: 892946 - DNA, 25 bp, Mus musculus
cagccaagaaagtgggcacagaagt

SEQ ID NO: 892947 - DNA, 25 bp, Mus musculus
cagccaagctcacagtgcctgctca

SEQ ID NO: 892948 - DNA, 25 bp, Mus musculus
cagccaagctcagagtgcctgctca

SEQ ID NO: 892949 - DNA, 25 bp, Mus musculus
cagccaaggcatcagacactgcccc

SEQ ID NO: 892950 - DNA, 25 bp, Mus musculus
cagccaaggcatcgcagtcatcggg

SEQ ID NO: 892951 - DNA, 25 bp, Mus musculus
cagccaaggcatctcatcggggtag

SEQ ID NO: 892952 - DNA, 25 bp, Mus musculus
cagccaaggcatgagacactgcccc

SEQ ID NO: 892953 - DNA, 25 bp, Mus musculus
cagccaaggcatggcagtcatcggg

SEQ ID NO: 892954 - DNA, 25 bp, Mus musculus
cagccaaggcatgtcatcggggtag

SEQ ID NO: 892955 - DNA, 25 bp, Mus musculus
cagccaatgaggcaggggattcttc

SEQ ID NO: 892956 - DNA, 25 bp, Mus musculus
cagccaatgaggcggattcttctca

SEQ ID NO: 892957 - DNA, 25 bp, Mus musculus
cagccaatgagggaggggattcttc

SEQ ID NO: 892958 - DNA, 25 bp, Mus musculus
cagccaatgagggggattcttctca

SEQ ID NO: 892959 - DNA, 25 bp, Mus musculus
cagccaattgccagtgatggtgtgg

SEQ ID NO: 892960 - DNA, 25 bp, Mus musculus
cagccaattgcctgtgatggtgtgg

SEQ ID NO: 892961 - DNA, 25 bp, Mus musculus
cagccacaaaatcatcaggattcca

SEQ ID NO: 892962 - DNA, 25 bp, Mus musculus
cagccacaaaatgatcaggattcca

SEQ ID NO: 892963 - DNA, 25 bp, Mus musculus
cagccacaaggaccctttcatttca

SEQ ID NO: 892964 - DNA, 25 bp, Mus musculus
cagccacaaggaccgtttcatttca

SEQ ID NO: 892965 - DNA, 25 bp, Mus musculus
cagccacaatgagactgtggtgcag

SEQ ID NO: 892966 - DNA, 25 bp, Mus musculus
cagccacaatgagagtgtggtgcag

SEQ ID NO: 892967 - DNA, 25 bp, Mus musculus
cagccacatataccaggccttgctc

SEQ ID NO: 892968 - DNA, 25 bp, Mus musculus
cagccacatatacctggtgtattct

SEQ ID NO: 892969 - DNA, 25 bp, Mus musculus
cagccacatatacgccttgctccag

SEQ ID NO: 892970 - DNA, 25 bp, Mus musculus
cagccacatatagcaggccttgctc

SEQ ID NO: 892971 - DNA, 25 bp, Mus musculus
cagccacatatagctggtgtattct

SEQ ID NO: 892972 - DNA, 25 bp, Mus musculus
cagccacatataggccttgctccag

SEQ ID NO: 892973 - DNA, 25 bp, Mus musculus
cagccaccagcccctgcccggatgg

SEQ ID NO: 892974 - DNA, 25 bp, Mus musculus
cagccaccagctgactctactggat

SEQ ID NO: 892975 - DNA, 25 bp, Mus musculus
cagccaccaggccctgcccggatgg

SEQ ID NO: 892976 - DNA, 25 bp, Mus musculus
cagccaccaggtgactctactggat

SEQ ID NO: 892977 - DNA, 25 bp, Mus musculus
cagccaccgcacctgcgggaggcaa

SEQ ID NO: 892978 - DNA, 25 bp, Mus musculus
cagccaccgccctcatgcgtgctcc

SEQ ID NO: 892979 - DNA, 25 bp, Mus musculus
cagccaccgcgctcatgcgtgctcc

SEQ ID NO: 892980 - DNA, 25 bp, Mus musculus
cagccaccgctcctgcgggaggcaa

SEQ ID NO: 892981 - DNA, 25 bp, Mus musculus
cagccacttccgctcaactattttg

SEQ ID NO: 892982 - DNA, 25 bp, Mus musculus
cagccacttccggtcaactattttg

SEQ ID NO: 892983 - DNA, 25 bp, Mus musculus
cagccagaaaatcgacatttgggct

SEQ ID NO: 892984 - DNA, 25 bp, Mus musculus
cagccagaaaatggacatttgggct

SEQ ID NO: 892985 - DNA, 25 bp, Mus musculus
cagccagaacagccagcccttcggc

SEQ ID NO: 892986 - DNA, 25 bp, Mus musculus
cagccagaacaggcagcccttcggc

SEQ ID NO: 892987 - DNA, 25 bp, Mus musculus
cagccagaagaatatccagttatgg

SEQ ID NO: 892988 - DNA, 25 bp, Mus musculus
cagccagaagaattggctggacccc

SEQ ID NO: 892989 - DNA, 25 bp, Mus musculus
cagccagaagagatcctcagctctc

SEQ ID NO: 892990 - DNA, 25 bp, Mus musculus
cagccagaagagccatggcgagtgc

SEQ ID NO: 892991 - DNA, 25 bp, Mus musculus
cagccagaagaggcatggcgagtgc

SEQ ID NO: 892992 - DNA, 25 bp, Mus musculus
cagccagaagagttcctcagctctc

SEQ ID NO: 892993 - DNA, 25 bp, Mus musculus
cagccagaagcagcgtttgacgtca

SEQ ID NO: 892994 - DNA, 25 bp, Mus musculus
cagccagaagcatcggaatggaaat

SEQ ID NO: 892995 - DNA, 25 bp, Mus musculus
cagccagaagcgtttgacgtcatcg

SEQ ID NO: 892996 - DNA, 25 bp, Mus musculus
cagccagaagctagcccctggaact

SEQ ID NO: 892997 - DNA, 25 bp, Mus musculus
cagccagaaggagcgtttgacgtca

SEQ ID NO: 892998 - DNA, 25 bp, Mus musculus
cagccagaaggatcggaatggaaat

SEQ ID NO: 892999 - DNA, 25 bp, Mus musculus
cagccagaagggtttgacgtcatcg

SEQ ID NO: 893000 - DNA, 25 bp, Mus musculus
cagccagaaggtagcccctggaact

SEQ ID NO: 893001 - DNA, 25 bp, Mus musculus
cagccagaagtatatccagttatgg

SEQ ID NO: 893002 - DNA, 25 bp, Mus musculus
cagccagaagtattggctggacccc

SEQ ID NO: 893003 - DNA, 25 bp, Mus musculus
cagccagacaaacgtacactaggag

SEQ ID NO: 893004 - DNA, 25 bp, Mus musculus
cagccagacaaaggtacactaggag

SEQ ID NO: 893005 - DNA, 25 bp, Mus musculus
cagccagagaccgacggagggagcc

SEQ ID NO: 893006 - DNA, 25 bp, Mus musculus
cagccagagaccgagggagggagcc

SEQ ID NO: 893007 - DNA, 25 bp, Mus musculus
cagccagagactttatggtctcggt

SEQ ID NO: 893008 - DNA, 25 bp, Mus musculus
cagccagagagtttatggtctcggt

SEQ ID NO: 893009 - DNA, 25 bp, Mus musculus
cagccagaggcacagtgaagaaatc

SEQ ID NO: 893010 - DNA, 25 bp, Mus musculus
cagccagaggcagagtgaagaaatc

SEQ ID NO: 893011 - DNA, 25 bp, Mus musculus
cagccagcagagtgccaggtgatcg

SEQ ID NO: 893012 - DNA, 25 bp, Mus musculus
cagccagcagcagaacccagagtcc

SEQ ID NO: 893013 - DNA, 25 bp, Mus musculus
cagccagcagcagaatttgtggccc

SEQ ID NO: 893014 - DNA, 25 bp, Mus musculus
cagccagcagcagatcccagagtcc

SEQ ID NO: 893015 - DNA, 25 bp, Mus musculus
cagccagcagcagattttgtggccc

SEQ ID NO: 893016 - DNA, 25 bp, Mus musculus
cagccagcagtgtgccaggtgatcg

SEQ ID NO: 893017 - DNA, 25 bp, Mus musculus
cagccagcatcacccgcagcagtca

SEQ ID NO: 893018 - DNA, 25 bp, Mus musculus
cagccagcatcaccggcagcagtca

SEQ ID NO: 893019 - DNA, 25 bp, Mus musculus
cagccagcctcctgcgtgttctctt

SEQ ID NO: 893020 - DNA, 25 bp, Mus musculus
cagccagcctcctgcgttggctgca

SEQ ID NO: 893021 - DNA, 25 bp, Mus musculus
cagccagcctcctgggtgttctctt

SEQ ID NO: 893022 - DNA, 25 bp, Mus musculus
cagccagcctcctgggttggctgca

SEQ ID NO: 893023 - DNA, 25 bp, Mus musculus
cagccagctgaccctgagagggcct

SEQ ID NO: 893024 - DNA, 25 bp, Mus musculus
cagccagctgacgctgagagggcct

SEQ ID NO: 893025 - DNA, 25 bp, Mus musculus
cagccaggaagaaacgaaaatcaga

SEQ ID NO: 893026 - DNA, 25 bp, Mus musculus
cagccaggaagaaaggaaaatcaga

SEQ ID NO: 893027 - DNA, 25 bp, Mus musculus
cagccaggagcgagcggacatggac

SEQ ID NO: 893028 - DNA, 25 bp, Mus musculus
cagccaggagctatcctctgaactc

SEQ ID NO: 893029 - DNA, 25 bp, Mus musculus
cagccaggagggagcggacatggac

SEQ ID NO: 893030 - DNA, 25 bp, Mus musculus
cagccaggaggtatcctctgaactc

SEQ ID NO: 893031 - DNA, 25 bp, Mus musculus
cagccaggatcaggtagatgacttc

SEQ ID NO: 893032 - DNA, 25 bp, Mus musculus
cagccaggatctgagtgttcgagag

SEQ ID NO: 893033 - DNA, 25 bp, Mus musculus
cagccaggatgaggtagatgacttc

SEQ ID NO: 893034 - DNA, 25 bp, Mus musculus
cagccaggatgtgagtgttcgagag

SEQ ID NO: 893035 - DNA, 25 bp, Mus musculus
cagccaggcgatgacgtggtctcca

SEQ ID NO: 893036 - DNA, 25 bp, Mus musculus
cagccaggcgcaacctgcgggaggc

SEQ ID NO: 893037 - DNA, 25 bp, Mus musculus
cagccaggcgcatcctgcgggaggc

SEQ ID NO: 893038 - DNA, 25 bp, Mus musculus
cagccaggcgcggccggatatgtgg

SEQ ID NO: 893039 - DNA, 25 bp, Mus musculus
cagccaggcgcggcgggatatgtgg

SEQ ID NO: 893040 - DNA, 25 bp, Mus musculus
cagccaggcgttgacgtggtctcca

SEQ ID NO: 893041 - DNA, 25 bp, Mus musculus
cagccagggccacatgtcatggacc

SEQ ID NO: 893042 - DNA, 25 bp, Mus musculus
cagccagggccagatgtcatggacc

SEQ ID NO: 893043 - DNA, 25 bp, Mus musculus
cagccaggtaccagatgtgatggtg

SEQ ID NO: 893044 - DNA, 25 bp, Mus musculus
cagccaggtacctgatgtgatggtg

SEQ ID NO: 893045 - DNA, 25 bp, Mus musculus
cagccagtgaagaggaagttagaag

SEQ ID NO: 893046 - DNA, 25 bp, Mus musculus
cagccagtgaagtggaagttagaag

SEQ ID NO: 893047 - DNA, 25 bp, Mus musculus
cagccagttcagcaagacagaagtg

SEQ ID NO: 893048 - DNA, 25 bp, Mus musculus
cagccagttcaggaagacagaagtg

SEQ ID NO: 893049 - DNA, 25 bp, Mus musculus
cagccatacacccccagaggctccc

SEQ ID NO: 893050 - DNA, 25 bp, Mus musculus
cagccatacagccccagaggctccc

SEQ ID NO: 893051 - DNA, 25 bp, Mus musculus
cagccatcagggaacatacattgtg

SEQ ID NO: 893052 - DNA, 25 bp, Mus musculus
cagccatcagggaaccttccctgtt

SEQ ID NO: 893053 - DNA, 25 bp, Mus musculus
cagccatcagggaagatacattgtg

SEQ ID NO: 893054 - DNA, 25 bp, Mus musculus
cagccatcagggaagcttccctgtt

SEQ ID NO: 893055 - DNA, 25 bp, Mus musculus
cagccatcattccgtgtatgatgtt

SEQ ID NO: 893056 - DNA, 25 bp, Mus musculus
cagccatcattcggtgtatgatgtt

SEQ ID NO: 893057 - DNA, 25 bp, Mus musculus
cagccatcccccccagtgctacaaa

SEQ ID NO: 893058 - DNA, 25 bp, Mus musculus
cagccatcccccccttgaaagatgc

SEQ ID NO: 893059 - DNA, 25 bp, Mus musculus
cagccatcccccctgctacaaatgg

SEQ ID NO: 893060 - DNA, 25 bp, Mus musculus
cagccatcccccgcagtgctacaaa

SEQ ID NO: 893061 - DNA, 25 bp, Mus musculus
cagccatcccccgcttgaaagatgc

SEQ ID NO: 893062 - DNA, 25 bp, Mus musculus
cagccatcccccgtgctacaaatgg

SEQ ID NO: 893063 - DNA, 25 bp, Mus musculus
cagccatctcagagactatggtcaa

SEQ ID NO: 893064 - DNA, 25 bp, Mus musculus
cagccatctcagtgactatggtcaa

SEQ ID NO: 893065 - DNA, 25 bp, Mus musculus
cagccatgagcaaagtctcacgcga

SEQ ID NO: 893066 - DNA, 25 bp, Mus musculus
cagccatgagcagcaaagtctcacg

SEQ ID NO: 893067 - DNA, 25 bp, Mus musculus
cagccatgaggaaagtctcacgcga

SEQ ID NO: 893068 - DNA, 25 bp, Mus musculus
cagccatgaggagcaaagtctcacg

SEQ ID NO: 893069 - DNA, 25 bp, Mus musculus
cagccatggaagaggaagccccctc

SEQ ID NO: 893070 - DNA, 25 bp, Mus musculus
cagccatggaagtggaagccccctc

SEQ ID NO: 893071 - DNA, 25 bp, Mus musculus
cagccatggcggccaggaggacaca

SEQ ID NO: 893072 - DNA, 25 bp, Mus musculus
cagccatggcgggcaggaggacaca

SEQ ID NO: 893073 - DNA, 25 bp, Mus musculus
cagccatgggctatggctcctacat

SEQ ID NO: 893074 - DNA, 25 bp, Mus musculus
cagccatggggtatggctcctacat

SEQ ID NO: 893075 - DNA, 25 bp, Mus musculus
cagcccaaccatcctgctgaaccga

SEQ ID NO: 893076 - DNA, 25 bp, Mus musculus
cagcccaaccatgctgctgaaccga

SEQ ID NO: 893077 - DNA, 25 bp, Mus musculus
cagcccaagaagaaccaagagccgg

SEQ ID NO: 893078 - DNA, 25 bp, Mus musculus
cagcccaagaagacgcaaatccaga

SEQ ID NO: 893079 - DNA, 25 bp, Mus musculus
cagcccaagaagtaccaagagccgg

SEQ ID NO: 893080 - DNA, 25 bp, Mus musculus
cagcccaagaagtcgcaaatccaga

SEQ ID NO: 893081 - DNA, 25 bp, Mus musculus
cagcccaataagctattcaattgat

SEQ ID NO: 893082 - DNA, 25 bp, Mus musculus
cagcccaataaggtattcaattgat

SEQ ID NO: 893083 - DNA, 25 bp, Mus musculus
cagcccacaacacacgtcagccaaa

SEQ ID NO: 893084 - DNA, 25 bp, Mus musculus
cagcccacaacacaggtcagccaaa

SEQ ID NO: 893085 - DNA, 25 bp, Mus musculus
cagcccactgcatcaaacaacatca

SEQ ID NO: 893086 - DNA, 25 bp, Mus musculus
cagcccactggatcaaacaacatca

SEQ ID NO: 893087 - DNA, 25 bp, Mus musculus
cagcccagacacagtggctgctttg

SEQ ID NO: 893088 - DNA, 25 bp, Mus musculus
cagcccagacactgtggctgctttg

SEQ ID NO: 893089 - DNA, 25 bp, Mus musculus
cagcccagagagaggtcttttggct

SEQ ID NO: 893090 - DNA, 25 bp, Mus musculus
cagcccagagagtggtcttttggct

SEQ ID NO: 893091 - DNA, 25 bp, Mus musculus
cagcccagctatccttacccagtgc

SEQ ID NO: 893092 - DNA, 25 bp, Mus musculus
cagcccagctatgcttacccagtgc

SEQ ID NO: 893093 - DNA, 25 bp, Mus musculus
cagcccagtgcacgcctgccactgg

SEQ ID NO: 893094 - DNA, 25 bp, Mus musculus
cagcccagtgcaggcctgccactgg

SEQ ID NO: 893095 - DNA, 25 bp, Mus musculus
cagcccattcttaacattcctttga

SEQ ID NO: 893096 - DNA, 25 bp, Mus musculus
cagcccattcttaagattcctttga

SEQ ID NO: 893097 - DNA, 25 bp, Mus musculus
cagccccaatgtatcggcctgttca

SEQ ID NO: 893098 - DNA, 25 bp, Mus musculus
cagccccaatgtatgggcctgttca

SEQ ID NO: 893099 - DNA, 25 bp, Mus musculus
cagccccactattgccttaagtttg

SEQ ID NO: 893100 - DNA, 25 bp, Mus musculus
cagccccactattgcggcatctttc

SEQ ID NO: 893101 - DNA, 25 bp, Mus musculus
cagccccactattggcttaagtttg

SEQ ID NO: 893102 - DNA, 25 bp, Mus musculus
cagccccactattggggcatctttc

SEQ ID NO: 893103 - DNA, 25 bp, Mus musculus
cagccccagcagagaaaagaagcca

SEQ ID NO: 893104 - DNA, 25 bp, Mus musculus
cagccccagcagtgaaaagaagcca

SEQ ID NO: 893105 - DNA, 25 bp, Mus musculus
cagccccagcgacacagaggcttac

SEQ ID NO: 893106 - DNA, 25 bp, Mus musculus
cagccccagcgacagctagctgagc

SEQ ID NO: 893107 - DNA, 25 bp, Mus musculus
cagccccagcgactccttcggggag

SEQ ID NO: 893108 - DNA, 25 bp, Mus musculus
cagccccagcgagacagaggcttac

SEQ ID NO: 893109 - DNA, 25 bp, Mus musculus
cagccccagcgagagctagctgagc

SEQ ID NO: 893110 - DNA, 25 bp, Mus musculus
cagccccagcgagtccttcggggag

SEQ ID NO: 893111 - DNA, 25 bp, Mus musculus
cagccccagctccccaacgagtccc

SEQ ID NO: 893112 - DNA, 25 bp, Mus musculus
cagccccagctcgccaacgagtccc

SEQ ID NO: 893113 - DNA, 25 bp, Mus musculus
cagccccagctgctgcccccttatc

SEQ ID NO: 893114 - DNA, 25 bp, Mus musculus
cagccccagctggtgcccccttatc

SEQ ID NO: 893115 - DNA, 25 bp, Mus musculus
cagccccagggaagaggaacagctc

SEQ ID NO: 893116 - DNA, 25 bp, Mus musculus
cagccccagggatgaggaacagctc

SEQ ID NO: 893117 - DNA, 25 bp, Mus musculus
cagccccatcctcacctcaccagtc

SEQ ID NO: 893118 - DNA, 25 bp, Mus musculus
cagccccatcctcagctcaccagtc

SEQ ID NO: 893119 - DNA, 25 bp, Mus musculus
cagcccccaagaaacaatggcttca

SEQ ID NO: 893120 - DNA, 25 bp, Mus musculus
cagcccccaagaaagaatggcttca

SEQ ID NO: 893121 - DNA, 25 bp, Mus musculus
cagcccccagctcgtagtgcatgtt

SEQ ID NO: 893122 - DNA, 25 bp, Mus musculus
cagcccccaggtcgtagtgcatgtt

SEQ ID NO: 893123 - DNA, 25 bp, Mus musculus
cagcccccgcagcgagctccgcttt

SEQ ID NO: 893124 - DNA, 25 bp, Mus musculus
cagcccccgcagggagctccgcttt

SEQ ID NO: 893125 - DNA, 25 bp, Mus musculus
cagccccgcacacactgggttccct

SEQ ID NO: 893126 - DNA, 25 bp, Mus musculus
cagccccgcagacactgggttccct

SEQ ID NO: 893127 - DNA, 25 bp, Mus musculus
cagccccttgagaatggcaagaaga

SEQ ID NO: 893128 - DNA, 25 bp, Mus musculus
cagccccttgagtatggcaagaaga

SEQ ID NO: 893129 - DNA, 25 bp, Mus musculus
cagcccggatgacgtggctctggtc

SEQ ID NO: 893130 - DNA, 25 bp, Mus musculus
cagcccggatgaggtggctctggtc

SEQ ID NO: 893131 - DNA, 25 bp, Mus musculus
cagcccggattattcgagatccatc

SEQ ID NO: 893132 - DNA, 25 bp, Mus musculus
cagcccggattattggagatccatc

SEQ ID NO: 893133 - DNA, 25 bp, Mus musculus
cagcccgtgttccaccaccacctct

SEQ ID NO: 893134 - DNA, 25 bp, Mus musculus
cagcccgtgttccagcaccacctct

SEQ ID NO: 893135 - DNA, 25 bp, Mus musculus
cagccctcacagccacccggtcctt

SEQ ID NO: 893136 - DNA, 25 bp, Mus musculus
cagccctcacaggcacccggtcctt

SEQ ID NO: 893137 - DNA, 25 bp, Mus musculus
cagccctcagaggagacccaagagc

SEQ ID NO: 893138 - DNA, 25 bp, Mus musculus
cagccctcagtggagacccaagagc

SEQ ID NO: 893139 - DNA, 25 bp, Mus musculus
cagccctcatcaatgaggaactcta

SEQ ID NO: 893140 - DNA, 25 bp, Mus musculus
cagccctcatcattgaggaactcta

SEQ ID NO: 893141 - DNA, 25 bp, Mus musculus
cagccctcccagatatgcccgccga

SEQ ID NO: 893142 - DNA, 25 bp, Mus musculus
cagccctcccagttatgcccgccga

SEQ ID NO: 893143 - DNA, 25 bp, Mus musculus
cagccctgagcacgagtctgcaggt

SEQ ID NO: 893144 - DNA, 25 bp, Mus musculus
cagccctgagcaggagtctgcaggt

SEQ ID NO: 893145 - DNA, 25 bp, Mus musculus
cagccctgatagacccaactcattt

SEQ ID NO: 893146 - DNA, 25 bp, Mus musculus
cagccctgatagtcccaactcattt

SEQ ID NO: 893147 - DNA, 25 bp, Mus musculus
cagccctgattccacgcttcttgcc

SEQ ID NO: 893148 - DNA, 25 bp, Mus musculus
cagccctgattccaggcttcttgcc

SEQ ID NO: 893149 - DNA, 25 bp, Mus musculus
cagccctgccccagcaccacctacc

SEQ ID NO: 893150 - DNA, 25 bp, Mus musculus
cagccctgcccctgcaccacctacc

SEQ ID NO: 893151 - DNA, 25 bp, Mus musculus
cagccctgcgcacgtgtgtcccctt

SEQ ID NO: 893152 - DNA, 25 bp, Mus musculus
cagccctgcggacgtgtgtcccctt

SEQ ID NO: 893153 - DNA, 25 bp, Mus musculus
cagccctgctctcactattccggct

SEQ ID NO: 893154 - DNA, 25 bp, Mus musculus
cagccctgctctcagtattccggct

SEQ ID NO: 893155 - DNA, 25 bp, Mus musculus
cagccctgtaaatgccttgctgaaa

SEQ ID NO: 893156 - DNA, 25 bp, Mus musculus
cagccctgtaaatggcttgctgaaa

SEQ ID NO: 893157 - DNA, 25 bp, Mus musculus
cagccctgtacaaacgggcagccac

SEQ ID NO: 893158 - DNA, 25 bp, Mus musculus
cagccctgtacaaaggggcagccac

SEQ ID NO: 893159 - DNA, 25 bp, Mus musculus
cagcccttccaccgcgaggatcagc

SEQ ID NO: 893160 - DNA, 25 bp, Mus musculus
cagcccttccaccgggaggatcagc

SEQ ID NO: 893161 - DNA, 25 bp, Mus musculus
cagccgaaccagccaagctctcctc

SEQ ID NO: 893162 - DNA, 25 bp, Mus musculus
cagccgaaccaggcaagctctcctc

SEQ ID NO: 893163 - DNA, 25 bp, Mus musculus
cagccgaaggacgccctatgaagtc

SEQ ID NO: 893164 - DNA, 25 bp, Mus musculus
cagccgaaggacgcgctatgaagtc

SEQ ID NO: 893165 - DNA, 25 bp, Mus musculus
cagccgaggaggcatccaagaacct

SEQ ID NO: 893166 - DNA, 25 bp, Mus musculus
cagccgaggaggctatttcctggtg

SEQ ID NO: 893167 - DNA, 25 bp, Mus musculus
cagccgaggagggatccaagaacct

SEQ ID NO: 893168 - DNA, 25 bp, Mus musculus
cagccgaggagggtatttcctggtg

SEQ ID NO: 893169 - DNA, 25 bp, Mus musculus
cagccgagtgagtgaattagatgta

SEQ ID NO: 893170 - DNA, 25 bp, Mus musculus
cagccgagtgtgtgaattagatgta

SEQ ID NO: 893171 - DNA, 25 bp, Mus musculus
cagccgagttcacattctccgagtc

SEQ ID NO: 893172 - DNA, 25 bp, Mus musculus
cagccgagttcacggaacagattct

SEQ ID NO: 893173 - DNA, 25 bp, Mus musculus
cagccgagttcagattctccgagtc

SEQ ID NO: 893174 - DNA, 25 bp, Mus musculus
cagccgagttcagggaacagattct

SEQ ID NO: 893175 - DNA, 25 bp, Mus musculus
cagccgccacagcaactggtgtgcc

SEQ ID NO: 893176 - DNA, 25 bp, Mus musculus
cagccgccacagctcctgttgagtc

SEQ ID NO: 893177 - DNA, 25 bp, Mus musculus
cagccgccacaggaactggtgtgcc

SEQ ID NO: 893178 - DNA, 25 bp, Mus musculus
cagccgccacaggtcctgttgagtc

SEQ ID NO: 893179 - DNA, 25 bp, Mus musculus
cagccgccatgaagctcaacgtgga

SEQ ID NO: 893180 - DNA, 25 bp, Mus musculus
cagccgccatgatgctcaacgtgga

SEQ ID NO: 893181 - DNA, 25 bp, Mus musculus
cagccgcccgcccatctgcttcacc

SEQ ID NO: 893182 - DNA, 25 bp, Mus musculus
cagccgcccgcgacaggccatctgc

SEQ ID NO: 893183 - DNA, 25 bp, Mus musculus
cagccgcccggccatctgcttcacc

SEQ ID NO: 893184 - DNA, 25 bp, Mus musculus
cagccgcccgggacaggccatctgc

SEQ ID NO: 893185 - DNA, 25 bp, Mus musculus
cagccgcctgtgcccgccccgtctc

SEQ ID NO: 893186 - DNA, 25 bp, Mus musculus
cagccgcctgtgccggccccgtctc

SEQ ID NO: 893187 - DNA, 25 bp, Mus musculus
cagccgctgcagcccccccagcctg

SEQ ID NO: 893188 - DNA, 25 bp, Mus musculus
cagccgctgcaggccccccagcctg

SEQ ID NO: 893189 - DNA, 25 bp, Mus musculus
cagccgcttactacctgaatgatct

SEQ ID NO: 893190 - DNA, 25 bp, Mus musculus
cagccgcttagtacctgaatgatct

SEQ ID NO: 893191 - DNA, 25 bp, Mus musculus
cagccggagcagcggagcccaaaga

SEQ ID NO: 893192 - DNA, 25 bp, Mus musculus
cagccggagcaggggagcccaaaga

SEQ ID NO: 893193 - DNA, 25 bp, Mus musculus
cagccggatgctgacatggtttttg

SEQ ID NO: 893194 - DNA, 25 bp, Mus musculus
cagccggatgctgagatggtttttg

SEQ ID NO: 893195 - DNA, 25 bp, Mus musculus
cagccggcggacccggaacgtgctt

SEQ ID NO: 893196 - DNA, 25 bp, Mus musculus
cagccggcggacgcggaacgtgctt

SEQ ID NO: 893197 - DNA, 25 bp, Mus musculus
cagccgggaagacgtgctgagctat

SEQ ID NO: 893198 - DNA, 25 bp, Mus musculus
cagccgggaagaggtgctgagctat

SEQ ID NO: 893199 - DNA, 25 bp, Mus musculus
cagccgggctatgacatattactac

SEQ ID NO: 893200 - DNA, 25 bp, Mus musculus
cagccgggctatgagatattactac

SEQ ID NO: 893201 - DNA, 25 bp, Mus musculus
cagccggggtggccaattggagaag

SEQ ID NO: 893202 - DNA, 25 bp, Mus musculus
cagccggggtggcctattggagaag

SEQ ID NO: 893203 - DNA, 25 bp, Mus musculus
cagccgtcagctaaaaactggtgtg

SEQ ID NO: 893204 - DNA, 25 bp, Mus musculus
cagccgtcaggtaaaaactggtgtg

SEQ ID NO: 893205 - DNA, 25 bp, Mus musculus
cagccgtctgattgtgaagaccgca

SEQ ID NO: 893206 - DNA, 25 bp, Mus musculus
cagccgtctgtttgtgaagaccgca

SEQ ID NO: 893207 - DNA, 25 bp, Mus musculus
cagccgtgagagcgtttgtggatga

SEQ ID NO: 893208 - DNA, 25 bp, Mus musculus
cagccgtgagagggtttgtggatga

SEQ ID NO: 893209 - DNA, 25 bp, Mus musculus
cagccgtgctaaatcttgctgctgg

SEQ ID NO: 893210 - DNA, 25 bp, Mus musculus
cagccgtgctaattcttgctgctgg

SEQ ID NO: 893211 - DNA, 25 bp, Mus musculus
cagccgttttaacataccgatttct

SEQ ID NO: 893212 - DNA, 25 bp, Mus musculus
cagccgttttaagataccgatttct

SEQ ID NO: 893213 - DNA, 25 bp, Mus musculus
cagcctaaaaaagggcaagaaatgc

SEQ ID NO: 893214 - DNA, 25 bp, Mus musculus
cagcctaaaatagggcaagaaatgc

SEQ ID NO: 893215 - DNA, 25 bp, Mus musculus
cagcctaaagcccgaccagtccaac

SEQ ID NO: 893216 - DNA, 25 bp, Mus musculus
cagcctaaagccggaccagtccaac

SEQ ID NO: 893217 - DNA, 25 bp, Mus musculus
cagcctaagcagcttctatttccag

SEQ ID NO: 893218 - DNA, 25 bp, Mus musculus
cagcctaagcaggttctatttccag

SEQ ID NO: 893219 - DNA, 25 bp, Mus musculus
cagcctacagaaactgttccgagaa

SEQ ID NO: 893220 - DNA, 25 bp, Mus musculus
cagcctacagaatctgttccgagaa

SEQ ID NO: 893221 - DNA, 25 bp, Mus musculus
cagcctacagcactgggaatttgcc

SEQ ID NO: 893222 - DNA, 25 bp, Mus musculus
cagcctacaggactgggaatttgcc

SEQ ID NO: 893223 - DNA, 25 bp, Mus musculus
cagcctacccaacgaaactgccagg

SEQ ID NO: 893224 - DNA, 25 bp, Mus musculus
cagcctacccaaggaaactgccagg

SEQ ID NO: 893225 - DNA, 25 bp, Mus musculus
cagcctactgcgttccaggagtgga

SEQ ID NO: 893226 - DNA, 25 bp, Mus musculus
cagcctactgggttccaggagtgga

SEQ ID NO: 893227 - DNA, 25 bp, Mus musculus
cagcctagaacacgcagcagaagaa

SEQ ID NO: 893228 - DNA, 25 bp, Mus musculus
cagcctagaacaggcagcagaagaa

SEQ ID NO: 893229 - DNA, 25 bp, Mus musculus
cagcctagagcggtgaactggtgtg

SEQ ID NO: 893230 - DNA, 25 bp, Mus musculus
cagcctagaggggtgaactggtgtg

SEQ ID NO: 893231 - DNA, 25 bp, Mus musculus
cagcctagccttcatgaaagaatat

SEQ ID NO: 893232 - DNA, 25 bp, Mus musculus
cagcctagccttgatgaaagaatat

SEQ ID NO: 893233 - DNA, 25 bp, Mus musculus
cagcctatgaagattgaagagaata

SEQ ID NO: 893234 - DNA, 25 bp, Mus musculus
cagcctatgaagtttgaagagaata

SEQ ID NO: 893235 - DNA, 25 bp, Mus musculus
cagcctcaagatctggttcaacaac

SEQ ID NO: 893236 - DNA, 25 bp, Mus musculus
cagcctcaagttctggttcaacaac

SEQ ID NO: 893237 - DNA, 25 bp, Mus musculus
cagcctcacaatagaacagttgaag

SEQ ID NO: 893238 - DNA, 25 bp, Mus musculus
cagcctcacatcccaggtttagctc

SEQ ID NO: 893239 - DNA, 25 bp, Mus musculus
cagcctcacatcgcaggtttagctc

SEQ ID NO: 893240 - DNA, 25 bp, Mus musculus
cagcctcacattagaacagttgaag

SEQ ID NO: 893241 - DNA, 25 bp, Mus musculus
cagcctcagtgacgccataactgca

SEQ ID NO: 893242 - DNA, 25 bp, Mus musculus
cagcctcagtgaggccataactgca

SEQ ID NO: 893243 - DNA, 25 bp, Mus musculus
cagcctccaaaacgtgttcttctgt

SEQ ID NO: 893244 - DNA, 25 bp, Mus musculus
cagcctccaaaaggtgttcttctgt

SEQ ID NO: 893245 - DNA, 25 bp, Mus musculus
cagcctccagctcccagcatccaag

SEQ ID NO: 893246 - DNA, 25 bp, Mus musculus
cagcctccagctccgagcatccaag

SEQ ID NO: 893247 - DNA, 25 bp, Mus musculus
cagcctccgccgcgagtgagtccct

SEQ ID NO: 893248 - DNA, 25 bp, Mus musculus
cagcctccgccgggagtgagtccct

SEQ ID NO: 893249 - DNA, 25 bp, Mus musculus
cagcctctacagatcgtgatggaac

SEQ ID NO: 893250 - DNA, 25 bp, Mus musculus
cagcctctacagatggtgatggaac

SEQ ID NO: 893251 - DNA, 25 bp, Mus musculus
cagcctgagccagccagaggaagag

SEQ ID NO: 893252 - DNA, 25 bp, Mus musculus
cagcctgagcgagccagaggaagag

SEQ ID NO: 893253 - DNA, 25 bp, Mus musculus
cagcctgaggagacgcagaggcagg

SEQ ID NO: 893254 - DNA, 25 bp, Mus musculus
cagcctgaggagtcgcagaggcagg

SEQ ID NO: 893255 - DNA, 25 bp, Mus musculus
cagcctgatgaaaatgcctttgagt

SEQ ID NO: 893256 - DNA, 25 bp, Mus musculus
cagcctgatgaaagcatctgtggca

SEQ ID NO: 893257 - DNA, 25 bp, Mus musculus
cagcctgatgaatatgcctttgagt

SEQ ID NO: 893258 - DNA, 25 bp, Mus musculus
cagcctgatgaatgcatctgtggca

SEQ ID NO: 893259 - DNA, 25 bp, Mus musculus
cagcctgcagaccaactggtatggc

SEQ ID NO: 893260 - DNA, 25 bp, Mus musculus
cagcctgcagtccaactggtatggc

SEQ ID NO: 893261 - DNA, 25 bp, Mus musculus
cagcctgccacacgaagagagctca

SEQ ID NO: 893262 - DNA, 25 bp, Mus musculus
cagcctgccacaggaagagagctca

SEQ ID NO: 893263 - DNA, 25 bp, Mus musculus
cagcctgcccagcctgcctatccct

SEQ ID NO: 893264 - DNA, 25 bp, Mus musculus
cagcctgcccaggctgcctatccct

SEQ ID NO: 893265 - DNA, 25 bp, Mus musculus
cagcctgccctcccccaaattgtgg

SEQ ID NO: 893266 - DNA, 25 bp, Mus musculus
cagcctgccctcccgcaaattgtgg

SEQ ID NO: 893267 - DNA, 25 bp, Mus musculus
cagcctggagaacgtcccacctgct

SEQ ID NO: 893268 - DNA, 25 bp, Mus musculus
cagcctggagaaggtcccacctgct

SEQ ID NO: 893269 - DNA, 25 bp, Mus musculus
cagcctggagagctccatatcctgt

SEQ ID NO: 893270 - DNA, 25 bp, Mus musculus
cagcctggagaggtccatatcctgt

SEQ ID NO: 893271 - DNA, 25 bp, Mus musculus
cagcctggagcacacagagctgcag

SEQ ID NO: 893272 - DNA, 25 bp, Mus musculus
cagcctggaggacacagagctgcag

SEQ ID NO: 893273 - DNA, 25 bp, Mus musculus
cagcctgggcctcaagtccccaaga

SEQ ID NO: 893274 - DNA, 25 bp, Mus musculus
cagcctgggcctcatgtccccaaga

SEQ ID NO: 893275 - DNA, 25 bp, Mus musculus
cagcctgtcccatgcatttgaaata

SEQ ID NO: 893276 - DNA, 25 bp, Mus musculus
cagcctgtcccatggatttgaaata

SEQ ID NO: 893277 - DNA, 25 bp, Mus musculus
cagcctgtctagctggggtgactag

SEQ ID NO: 893278 - DNA, 25 bp, Mus musculus
cagcctgtctaggtggggtgactag

SEQ ID NO: 893279 - DNA, 25 bp, Mus musculus
cagcctgttcaacaaatcaacatgc

SEQ ID NO: 893280 - DNA, 25 bp, Mus musculus
cagcctgttcaacgttcgcccagag

SEQ ID NO: 893281 - DNA, 25 bp, Mus musculus
cagcctgttcaagaaatcaacatgc

SEQ ID NO: 893282 - DNA, 25 bp, Mus musculus
cagcctgttcaaggttcgcccagag

SEQ ID NO: 893283 - DNA, 25 bp, Mus musculus
cagccttactagctcatgcacagat

SEQ ID NO: 893284 - DNA, 25 bp, Mus musculus
cagccttactaggtcatgcacagat

SEQ ID NO: 893285 - DNA, 25 bp, Mus musculus
cagccttatgccctggttccacggc

SEQ ID NO: 893286 - DNA, 25 bp, Mus musculus
cagccttatgccgtggttccacggc

SEQ ID NO: 893287 - DNA, 25 bp, Mus musculus
cagccttcaaagaatgtctgtaagg

SEQ ID NO: 893288 - DNA, 25 bp, Mus musculus
cagccttcaaagtatgtctgtaagg

SEQ ID NO: 893289 - DNA, 25 bp, Mus musculus
cagccttcagcacagtggtgatgcc

SEQ ID NO: 893290 - DNA, 25 bp, Mus musculus
cagccttcaggacagtggtgatgcc

SEQ ID NO: 893291 - DNA, 25 bp, Mus musculus
cagccttgaaagcacccgctaacgt

SEQ ID NO: 893292 - DNA, 25 bp, Mus musculus
cagccttgaaagcagccgctaacgt

SEQ ID NO: 893293 - DNA, 25 bp, Mus musculus
cagccttgagaactttcactcctgg

SEQ ID NO: 893294 - DNA, 25 bp, Mus musculus
cagccttgagaagtttcactcctgg

SEQ ID NO: 893295 - DNA, 25 bp, Mus musculus
cagccttgccagatccaccttgaat

SEQ ID NO: 893296 - DNA, 25 bp, Mus musculus
cagccttgccagttccaccttgaat

SEQ ID NO: 893297 - DNA, 25 bp, Mus musculus
cagccttgtaaaaacgtatatcatg

SEQ ID NO: 893298 - DNA, 25 bp, Mus musculus
cagccttgtaaaaaggtatatcatg

SEQ ID NO: 893299 - DNA, 25 bp, Mus musculus
cagcctttacaggacgcctttgatg

SEQ ID NO: 893300 - DNA, 25 bp, Mus musculus
cagcctttactggacgcctttgatg

SEQ ID NO: 893301 - DNA, 25 bp, Mus musculus
cagcctttagagtggcagtgtgtag

SEQ ID NO: 893302 - DNA, 25 bp, Mus musculus
cagcctttagtgtggcagtgtgtag

SEQ ID NO: 893303 - DNA, 25 bp, Mus musculus
cagcgaaaccagctccacaggatga

SEQ ID NO: 893304 - DNA, 25 bp, Mus musculus
cagcgaaaccaggtccacaggatga

SEQ ID NO: 893305 - DNA, 25 bp, Mus musculus
cagcgaacaaagctcattcattgaa

SEQ ID NO: 893306 - DNA, 25 bp, Mus musculus
cagcgaacaatgctcattcattgaa

SEQ ID NO: 893307 - DNA, 25 bp, Mus musculus
cagcgaagtccacatgctgagcgag

SEQ ID NO: 893308 - DNA, 25 bp, Mus musculus
cagcgaagtccagatgctgagcgag

SEQ ID NO: 893309 - DNA, 25 bp, Mus musculus
cagcgacaccatgacgtacattcta

SEQ ID NO: 893310 - DNA, 25 bp, Mus musculus
cagcgacaccatgaggtacattcta

SEQ ID NO: 893311 - DNA, 25 bp, Mus musculus
cagcgacactcgccccagctgtggt

SEQ ID NO: 893312 - DNA, 25 bp, Mus musculus
cagcgacactcggcccagctgtggt

SEQ ID NO: 893313 - DNA, 25 bp, Mus musculus
cagcgagaccagacctgcacacctg

SEQ ID NO: 893314 - DNA, 25 bp, Mus musculus
cagcgagaccagtcctgcacacctg

SEQ ID NO: 893315 - DNA, 25 bp, Mus musculus
cagcgagagcaacctctctgagatg

SEQ ID NO: 893316 - DNA, 25 bp, Mus musculus
cagcgagagcaagctctctgagatg

SEQ ID NO: 893317 - DNA, 25 bp, Mus musculus
cagcgagatcaacatcatgaagagt

SEQ ID NO: 893318 - DNA, 25 bp, Mus musculus
cagcgagatcaagatcatgaagagt

SEQ ID NO: 893319 - DNA, 25 bp, Mus musculus
cagcgagcagatgtctcatttccgt

SEQ ID NO: 893320 - DNA, 25 bp, Mus musculus
cagcgagcagccctgcaactcccac

SEQ ID NO: 893321 - DNA, 25 bp, Mus musculus
cagcgagcaggcctgcaactcccac

SEQ ID NO: 893322 - DNA, 25 bp, Mus musculus
cagcgagcagttgtctcatttccgt

SEQ ID NO: 893323 - DNA, 25 bp, Mus musculus
cagcgaggccgacatctgtcgcttt

SEQ ID NO: 893324 - DNA, 25 bp, Mus musculus
cagcgaggccgagatctgtcgcttt

SEQ ID NO: 893325 - DNA, 25 bp, Mus musculus
cagcgagtcctcccccagtgacttc

SEQ ID NO: 893326 - DNA, 25 bp, Mus musculus
cagcgagtcctcgcccagtgacttc

SEQ ID NO: 893327 - DNA, 25 bp, Mus musculus
cagcgagtggcacagttgcacagca

SEQ ID NO: 893328 - DNA, 25 bp, Mus musculus
cagcgagtggcagagttgcacagca

SEQ ID NO: 893329 - DNA, 25 bp, Mus musculus
cagcgatcagctaatagtgcagcgg

SEQ ID NO: 893330 - DNA, 25 bp, Mus musculus
cagcgatcaggtaatagtgcagcgg

SEQ ID NO: 893331 - DNA, 25 bp, Mus musculus
cagcgatgggagagggagccgaggg

SEQ ID NO: 893332 - DNA, 25 bp, Mus musculus
cagcgatgggagtgggagccgaggg

SEQ ID NO: 893333 - DNA, 25 bp, Mus musculus
cagcgattatctatactacattagt

SEQ ID NO: 893334 - DNA, 25 bp, Mus musculus
cagcgattatctttactacattagt

SEQ ID NO: 893335 - DNA, 25 bp, Mus musculus
cagcgcaaactgcgcaaacgctaca

SEQ ID NO: 893336 - DNA, 25 bp, Mus musculus
cagcgcaaactgggcaaacgctaca

SEQ ID NO: 893337 - DNA, 25 bp, Mus musculus
cagcgcaactcacatggctccagat

SEQ ID NO: 893338 - DNA, 25 bp, Mus musculus
cagcgcaactcacgctgactcccct

SEQ ID NO: 893339 - DNA, 25 bp, Mus musculus
cagcgcaactcagatggctccagat

SEQ ID NO: 893340 - DNA, 25 bp, Mus musculus
cagcgcaactcaggctgactcccct

SEQ ID NO: 893341 - DNA, 25 bp, Mus musculus
cagcgcactgagcgcccaggagacc

SEQ ID NO: 893342 - DNA, 25 bp, Mus musculus
cagcgcactgagggcccaggagacc

SEQ ID NO: 893343 - DNA, 25 bp, Mus musculus
cagcgcagagttagactatccctct

SEQ ID NO: 893344 - DNA, 25 bp, Mus musculus
cagcgcagagtttgactatccctct

SEQ ID NO: 893345 - DNA, 25 bp, Mus musculus
cagcgccctgagctcgacaagtgac

SEQ ID NO: 893346 - DNA, 25 bp, Mus musculus
cagcgccctgagctggacaagtgac

SEQ ID NO: 893347 - DNA, 25 bp, Mus musculus
cagcgccctggacctattgaagtct

SEQ ID NO: 893348 - DNA, 25 bp, Mus musculus
cagcgccctggagctattgaagtct

SEQ ID NO: 893349 - DNA, 25 bp, Mus musculus
cagcgccgcctgaccgcttcccgcc

SEQ ID NO: 893350 - DNA, 25 bp, Mus musculus
cagcgccgcctgtccgcttcccgcc

SEQ ID NO: 893351 - DNA, 25 bp, Mus musculus
cagcgcgaagctgatgctagaagat

SEQ ID NO: 893352 - DNA, 25 bp, Mus musculus
cagcgcgaaggtgatgctagaagat

SEQ ID NO: 893353 - DNA, 25 bp, Mus musculus
cagcgcgggccgctgtacattggtg

SEQ ID NO: 893354 - DNA, 25 bp, Mus musculus
cagcgcgggccggtgtacattggtg

SEQ ID NO: 893355 - DNA, 25 bp, Mus musculus
cagcgcgtgaagctctccagtcctg

SEQ ID NO: 893356 - DNA, 25 bp, Mus musculus
cagcgcgtgaaggtctccagtcctg

SEQ ID NO: 893357 - DNA, 25 bp, Mus musculus
cagcgctcacggcaaccagtgacct

SEQ ID NO: 893358 - DNA, 25 bp, Mus musculus
cagcgctcacgggaaccagtgacct

SEQ ID NO: 893359 - DNA, 25 bp, Mus musculus
cagcgctcagcgcgacgcaggagga

SEQ ID NO: 893360 - DNA, 25 bp, Mus musculus
cagcgctcagggcgacgcaggagga

SEQ ID NO: 893361 - DNA, 25 bp, Mus musculus
cagcgctctctgctcacctatgagg

SEQ ID NO: 893362 - DNA, 25 bp, Mus musculus
cagcgctctctgctcagtctgaaga

SEQ ID NO: 893363 - DNA, 25 bp, Mus musculus
cagcgctctctgctgacctatgagg

SEQ ID NO: 893364 - DNA, 25 bp, Mus musculus
cagcgctctctgctgagtctgaaga

SEQ ID NO: 893365 - DNA, 25 bp, Mus musculus
cagcgctcttctcttatgttcttgc

SEQ ID NO: 893366 - DNA, 25 bp, Mus musculus
cagcgctcttctgttatgttcttgc

SEQ ID NO: 893367 - DNA, 25 bp, Mus musculus
cagcgctgacagctacagagctatc

SEQ ID NO: 893368 - DNA, 25 bp, Mus musculus
cagcgctgacaggtacagagctatc

SEQ ID NO: 893369 - DNA, 25 bp, Mus musculus
cagcgctgacttagagaaacggaag

SEQ ID NO: 893370 - DNA, 25 bp, Mus musculus
cagcgctgacttaggcctgcatgag

SEQ ID NO: 893371 - DNA, 25 bp, Mus musculus
cagcgctgactttgagaaacggaag

SEQ ID NO: 893372 - DNA, 25 bp, Mus musculus
cagcgctgactttggcctgcatgag

SEQ ID NO: 893373 - DNA, 25 bp, Mus musculus
cagcgctgtgatgatgaccagccac

SEQ ID NO: 893374 - DNA, 25 bp, Mus musculus
cagcgctgtgttgatgaccagccac

SEQ ID NO: 893375 - DNA, 25 bp, Mus musculus
cagcggacttcacttctatttggct

SEQ ID NO: 893376 - DNA, 25 bp, Mus musculus
cagcggacttcagttctatttggct

SEQ ID NO: 893377 - DNA, 25 bp, Mus musculus
cagcggcaaaatagtgtttctagaa

SEQ ID NO: 893378 - DNA, 25 bp, Mus musculus
cagcggcaaattagtgtttctagaa

SEQ ID NO: 893379 - DNA, 25 bp, Mus musculus
cagcggcaagcctgagactggtgtt

SEQ ID NO: 893380 - DNA, 25 bp, Mus musculus
cagcggcaaggctgagactggtgtt

SEQ ID NO: 893381 - DNA, 25 bp, Mus musculus
cagcggcacgacagcacccaagaaa

SEQ ID NO: 893382 - DNA, 25 bp, Mus musculus
cagcggcacgtcagcacccaagaaa

SEQ ID NO: 893383 - DNA, 25 bp, Mus musculus
cagcggcagcaacacgagcagctcc

SEQ ID NO: 893384 - DNA, 25 bp, Mus musculus
cagcggcagcaacaggagcagctcc

SEQ ID NO: 893385 - DNA, 25 bp, Mus musculus
cagcggcagctgctcaccctgagca

SEQ ID NO: 893386 - DNA, 25 bp, Mus musculus
cagcggcagctgctgaccctgagca

SEQ ID NO: 893387 - DNA, 25 bp, Mus musculus
cagcggcattcacgttctaaatggc

SEQ ID NO: 893388 - DNA, 25 bp, Mus musculus
cagcggcattcaggttctaaatggc

SEQ ID NO: 893389 - DNA, 25 bp, Mus musculus
cagcgggagaagatggttggtaaag

SEQ ID NO: 893390 - DNA, 25 bp, Mus musculus
cagcgggagaagcctctgcaccccg

SEQ ID NO: 893391 - DNA, 25 bp, Mus musculus
cagcgggagaagcttgatccaaaag

SEQ ID NO: 893392 - DNA, 25 bp, Mus musculus
cagcgggagaaggctctgcaccccg

SEQ ID NO: 893393 - DNA, 25 bp, Mus musculus
cagcgggagaaggttgatccaaaag

SEQ ID NO: 893394 - DNA, 25 bp, Mus musculus
cagcgggagaagttggttggtaaag

SEQ ID NO: 893395 - DNA, 25 bp, Mus musculus
cagcgggcctcgcacagacctgatg

SEQ ID NO: 893396 - DNA, 25 bp, Mus musculus
cagcgggcctcgcagagacctgatg

SEQ ID NO: 893397 - DNA, 25 bp, Mus musculus
cagcgggcgactcacgcaccatgag

SEQ ID NO: 893398 - DNA, 25 bp, Mus musculus
cagcgggcgactcaggcaccatgag

SEQ ID NO: 893399 - DNA, 25 bp, Mus musculus
cagcggtggcagaatgttggcttcc

SEQ ID NO: 893400 - DNA, 25 bp, Mus musculus
cagcggtggcagtatgttggcttcc

SEQ ID NO: 893401 - DNA, 25 bp, Mus musculus
cagcgtagagctttatgcagagaaa

SEQ ID NO: 893402 - DNA, 25 bp, Mus musculus
cagcgtagaggtttatgcagagaaa

SEQ ID NO: 893403 - DNA, 25 bp, Mus musculus
cagcgtcatgtgcacagacaggctt

SEQ ID NO: 893404 - DNA, 25 bp, Mus musculus
cagcgtcatgtgcacgctttgatat

SEQ ID NO: 893405 - DNA, 25 bp, Mus musculus
cagcgtcatgtgcagagacaggctt

SEQ ID NO: 893406 - DNA, 25 bp, Mus musculus
cagcgtcatgtgcaggctttgatat

SEQ ID NO: 893407 - DNA, 25 bp, Mus musculus
cagcgtcctaaccggcaatgtcatc

SEQ ID NO: 893408 - DNA, 25 bp, Mus musculus
cagcgtcctaacgggcaatgtcatc

SEQ ID NO: 893409 - DNA, 25 bp, Mus musculus
cagcgtcctcgtaactgccattctg

SEQ ID NO: 893410 - DNA, 25 bp, Mus musculus
cagcgtcctcgtaagtgccattctg

SEQ ID NO: 893411 - DNA, 25 bp, Mus musculus
cagcgtcgtgattagcgatgatgaa

SEQ ID NO: 893412 - DNA, 25 bp, Mus musculus
cagcgtcgtgtttagcgatgatgaa

SEQ ID NO: 893413 - DNA, 25 bp, Mus musculus
cagcgtcttccaaatatggcatgaa

SEQ ID NO: 893414 - DNA, 25 bp, Mus musculus
cagcgtcttccatatatggcatgaa

SEQ ID NO: 893415 - DNA, 25 bp, Mus musculus
cagcgtgaatggcggcaatggcatc

SEQ ID NO: 893416 - DNA, 25 bp, Mus musculus
cagcgtgaatgggggcaatggcatc

SEQ ID NO: 893417 - DNA, 25 bp, Mus musculus
cagcgtgatcccaatgagaggtatg

SEQ ID NO: 893418 - DNA, 25 bp, Mus musculus
cagcgtgatcgcaatgagaggtatg

SEQ ID NO: 893419 - DNA, 25 bp, Mus musculus
cagcgtggagaaccacccagatgca

SEQ ID NO: 893420 - DNA, 25 bp, Mus musculus
cagcgtggagaagcacccagatgca

SEQ ID NO: 893421 - DNA, 25 bp, Mus musculus
cagcgtggagagatatgagccagag

SEQ ID NO: 893422 - DNA, 25 bp, Mus musculus
cagcgtggagagttatgagccagag

SEQ ID NO: 893423 - DNA, 25 bp, Mus musculus
cagcgtggagcccttggatgaagca

SEQ ID NO: 893424 - DNA, 25 bp, Mus musculus
cagcgtggagctgcagcccttggat

SEQ ID NO: 893425 - DNA, 25 bp, Mus musculus
cagcgtggaggccttggatgaagca

SEQ ID NO: 893426 - DNA, 25 bp, Mus musculus
cagcgtggaggtgcagcccttggat

SEQ ID NO: 893427 - DNA, 25 bp, Mus musculus
cagcgtgttgctaacacatcaacac

SEQ ID NO: 893428 - DNA, 25 bp, Mus musculus
cagcgtgttggtaacacatcaacac

SEQ ID NO: 893429 - DNA, 25 bp, Mus musculus
cagcgttcacaacatcatttccatg

SEQ ID NO: 893430 - DNA, 25 bp, Mus musculus
cagcgttcacaactctgagttcact

SEQ ID NO: 893431 - DNA, 25 bp, Mus musculus
cagcgttcacaagatcatttccatg

SEQ ID NO: 893432 - DNA, 25 bp, Mus musculus
cagcgttcacaagtctgagttcact

SEQ ID NO: 893433 - DNA, 25 bp, Mus musculus
cagcgttgcgcagtaggtttacggc

SEQ ID NO: 893434 - DNA, 25 bp, Mus musculus
cagcgttgcgcagttggtttacggc

SEQ ID NO: 893435 - DNA, 25 bp, Mus musculus
cagcgttgtcagtcatatggggccc

SEQ ID NO: 893436 - DNA, 25 bp, Mus musculus
cagcgttgtcagtcttatggggccc

SEQ ID NO: 893437 - DNA, 25 bp, Mus musculus
cagctaaacaacaacatctgtgata

SEQ ID NO: 893438 - DNA, 25 bp, Mus musculus
cagctaaacaacaagatctgtgata

SEQ ID NO: 893439 - DNA, 25 bp, Mus musculus
cagctaaaggagcctgtgaggggaa

SEQ ID NO: 893440 - DNA, 25 bp, Mus musculus
cagctaaaggaggctgtgaggggaa

SEQ ID NO: 893441 - DNA, 25 bp, Mus musculus
cagctaacccagaaatgacatcaga

SEQ ID NO: 893442 - DNA, 25 bp, Mus musculus
cagctaacccagtaatgacatcaga

SEQ ID NO: 893443 - DNA, 25 bp, Mus musculus
cagctaatgatactctcggccagtg

SEQ ID NO: 893444 - DNA, 25 bp, Mus musculus
cagctaatgatactgtcggccagtg

SEQ ID NO: 893445 - DNA, 25 bp, Mus musculus
cagctacacctgcccgtcagggatc

SEQ ID NO: 893446 - DNA, 25 bp, Mus musculus
cagctacacctgcccgtccaaccgt

SEQ ID NO: 893447 - DNA, 25 bp, Mus musculus
cagctacacctgccggtcagggatc

SEQ ID NO: 893448 - DNA, 25 bp, Mus musculus
cagctacacctgccggtccaaccgt

SEQ ID NO: 893449 - DNA, 25 bp, Mus musculus
cagctacatgagcgcagtggatttg

SEQ ID NO: 893450 - DNA, 25 bp, Mus musculus
cagctacatgagggcagtggatttg

SEQ ID NO: 893451 - DNA, 25 bp, Mus musculus
cagctaccgagaccctggctccatc

SEQ ID NO: 893452 - DNA, 25 bp, Mus musculus
cagctaccgagagcctggctccatc

SEQ ID NO: 893453 - DNA, 25 bp, Mus musculus
cagctaccggagttcgatcggtcat

SEQ ID NO: 893454 - DNA, 25 bp, Mus musculus
cagctaccggagttggatcggtcat

SEQ ID NO: 893455 - DNA, 25 bp, Mus musculus
cagctacctcaacatctttgtccct

SEQ ID NO: 893456 - DNA, 25 bp, Mus musculus
cagctacctcaagatctttgtccct

SEQ ID NO: 893457 - DNA, 25 bp, Mus musculus
cagctactagcagccctaaactgag

SEQ ID NO: 893458 - DNA, 25 bp, Mus musculus
cagctactaggagccctaaactgag

SEQ ID NO: 893459 - DNA, 25 bp, Mus musculus
cagctactaggcagcaaaatggctg

SEQ ID NO: 893460 - DNA, 25 bp, Mus musculus
cagctactaggctgcaaaatggctg

SEQ ID NO: 893461 - DNA, 25 bp, Mus musculus
cagctactcccacgttgcccacatt

SEQ ID NO: 893462 - DNA, 25 bp, Mus musculus
cagctactcccaggttgcccacatt

SEQ ID NO: 893463 - DNA, 25 bp, Mus musculus
cagctactcgcgacccgcaggagga

SEQ ID NO: 893464 - DNA, 25 bp, Mus musculus
cagctactcgggacccgcaggagga

SEQ ID NO: 893465 - DNA, 25 bp, Mus musculus
cagctactggagaacaagtcttgga

SEQ ID NO: 893466 - DNA, 25 bp, Mus musculus
cagctactggagaacgtgcaaaaca

SEQ ID NO: 893467 - DNA, 25 bp, Mus musculus
cagctactggagaagaagtcttgga

SEQ ID NO: 893468 - DNA, 25 bp, Mus musculus
cagctactggagaaggtgcaaaaca

SEQ ID NO: 893469 - DNA, 25 bp, Mus musculus
cagctacttcgacaggcttcaggga

SEQ ID NO: 893470 - DNA, 25 bp, Mus musculus
cagctacttcgagaggcttcaggga

SEQ ID NO: 893471 - DNA, 25 bp, Mus musculus
cagctacttctcaacgaaacttcat

SEQ ID NO: 893472 - DNA, 25 bp, Mus musculus
cagctacttctcaacgaggcgcttc

SEQ ID NO: 893473 - DNA, 25 bp, Mus musculus
cagctacttctcaaggaaacttcat

SEQ ID NO: 893474 - DNA, 25 bp, Mus musculus
cagctacttctcaaggaggcgcttc

SEQ ID NO: 893475 - DNA, 25 bp, Mus musculus
cagctagaaacgagatgtccctgct

SEQ ID NO: 893476 - DNA, 25 bp, Mus musculus
cagctagaaacttctcctctgttcc

SEQ ID NO: 893477 - DNA, 25 bp, Mus musculus
cagctagaaaggagatgtccctgct

SEQ ID NO: 893478 - DNA, 25 bp, Mus musculus
cagctagaaagttctcctctgttcc

SEQ ID NO: 893479 - DNA, 25 bp, Mus musculus
cagctagctatgacctatgaggaga

SEQ ID NO: 893480 - DNA, 25 bp, Mus musculus
cagctagctatgtcctatgaggaga

SEQ ID NO: 893481 - DNA, 25 bp, Mus musculus
cagctagctgcatcaccgacaacca

SEQ ID NO: 893482 - DNA, 25 bp, Mus musculus
cagctagctggatcaccgacaacca

SEQ ID NO: 893483 - DNA, 25 bp, Mus musculus
cagctagggaatcaaggtgaagaga

SEQ ID NO: 893484 - DNA, 25 bp, Mus musculus
cagctagggaatgaaggtgaagaga

SEQ ID NO: 893485 - DNA, 25 bp, Mus musculus
cagctagtctttaaatggagaatgg

SEQ ID NO: 893486 - DNA, 25 bp, Mus musculus
cagctagtctttaaggtaagaagta

SEQ ID NO: 893487 - DNA, 25 bp, Mus musculus
cagctagtcttttaatggagaatgg

SEQ ID NO: 893488 - DNA, 25 bp, Mus musculus
cagctagtcttttaggtaagaagta

SEQ ID NO: 893489 - DNA, 25 bp, Mus musculus
cagctagtggagcagaagactctga

SEQ ID NO: 893490 - DNA, 25 bp, Mus musculus
cagctagtggaggagaagactctga

SEQ ID NO: 893491 - DNA, 25 bp, Mus musculus
cagctatcccagcaccgggacttca

SEQ ID NO: 893492 - DNA, 25 bp, Mus musculus
cagctatcccagccccctctgcccc

SEQ ID NO: 893493 - DNA, 25 bp, Mus musculus
cagctatcccaggaccgggacttca

SEQ ID NO: 893494 - DNA, 25 bp, Mus musculus
cagctatcccaggcccctctgcccc

SEQ ID NO: 893495 - DNA, 25 bp, Mus musculus
cagctatgagaagcaacaggccacc

SEQ ID NO: 893496 - DNA, 25 bp, Mus musculus
cagctatgagcctggagtactcgga

SEQ ID NO: 893497 - DNA, 25 bp, Mus musculus
cagctatgaggctggagtactcgga

SEQ ID NO: 893498 - DNA, 25 bp, Mus musculus
cagctatgagtagcaacaggccacc

SEQ ID NO: 893499 - DNA, 25 bp, Mus musculus
cagctcaaagcaaccagctccctga

SEQ ID NO: 893500 - DNA, 25 bp, Mus musculus
cagctcaaagctgtgtgtcaaccac

SEQ ID NO: 893501 - DNA, 25 bp, Mus musculus
cagctcaaaggaaccagctccctga

SEQ ID NO: 893502 - DNA, 25 bp, Mus musculus
cagctcaaaggtgtgtgtcaaccac

SEQ ID NO: 893503 - DNA, 25 bp, Mus musculus
cagctcaacggcaacacccaatcag

SEQ ID NO: 893504 - DNA, 25 bp, Mus musculus
cagctcaacggcaagacccaatcag

SEQ ID NO: 893505 - DNA, 25 bp, Mus musculus
cagctcaagcagcccctcaacacaa

SEQ ID NO: 893506 - DNA, 25 bp, Mus musculus
cagctcaagcaggccctcaacacaa

SEQ ID NO: 893507 - DNA, 25 bp, Mus musculus
cagctcaaggagcctcaacgcacag

SEQ ID NO: 893508 - DNA, 25 bp, Mus musculus
cagctcaaggaggctcaacgcacag

SEQ ID NO: 893509 - DNA, 25 bp, Mus musculus
cagctcacagaaccctgcagagcct

SEQ ID NO: 893510 - DNA, 25 bp, Mus musculus
cagctcacagaagcctgcagagcct

SEQ ID NO: 893511 - DNA, 25 bp, Mus musculus
cagctcagagcacacgtgcctggat

SEQ ID NO: 893512 - DNA, 25 bp, Mus musculus
cagctcagagcacaggtgcctggat

SEQ ID NO: 893513 - DNA, 25 bp, Mus musculus
cagctcagagccccatcagcatttc

SEQ ID NO: 893514 - DNA, 25 bp, Mus musculus
cagctcagaggcccatcagcatttc

SEQ ID NO: 893515 - DNA, 25 bp, Mus musculus
cagctcagcatgaaagccgggctgg

SEQ ID NO: 893516 - DNA, 25 bp, Mus musculus
cagctcagcatgtaagccgggctgg

SEQ ID NO: 893517 - DNA, 25 bp, Mus musculus
cagctcagggcacgaaaccttctgg

SEQ ID NO: 893518 - DNA, 25 bp, Mus musculus
cagctcagggcaggaaaccttctgg

SEQ ID NO: 893519 - DNA, 25 bp, Mus musculus
cagctcatagacaacatgggagctt

SEQ ID NO: 893520 - DNA, 25 bp, Mus musculus
cagctcatagacaagatgggagctt

SEQ ID NO: 893521 - DNA, 25 bp, Mus musculus
cagctcatccagatgagctgggcca

SEQ ID NO: 893522 - DNA, 25 bp, Mus musculus
cagctcatccagttgagctgggcca

SEQ ID NO: 893523 - DNA, 25 bp, Mus musculus
cagctcattaagctcacacggctgc

SEQ ID NO: 893524 - DNA, 25 bp, Mus musculus
cagctcattaaggtcacacggctgc

SEQ ID NO: 893525 - DNA, 25 bp, Mus musculus
cagctcattgatgtcgatgagaaaa

SEQ ID NO: 893526 - DNA, 25 bp, Mus musculus
cagctcattgatgtggatgagaaaa

SEQ ID NO: 893527 - DNA, 25 bp, Mus musculus
cagctcatttcacattgccctctgc

SEQ ID NO: 893528 - DNA, 25 bp, Mus musculus
cagctcatttcagattgccctctgc

SEQ ID NO: 893529 - DNA, 25 bp, Mus musculus
cagctccaaaagcacttggcagcca

SEQ ID NO: 893530 - DNA, 25 bp, Mus musculus
cagctccaaaagcagttggcagcca

SEQ ID NO: 893531 - DNA, 25 bp, Mus musculus
cagctccagctgcgtagccccagtg

SEQ ID NO: 893532 - DNA, 25 bp, Mus musculus
cagctccagctgggtagccccagtg

SEQ ID NO: 893533 - DNA, 25 bp, Mus musculus
cagctcccaggactcgtcaatgtgg

SEQ ID NO: 893534 - DNA, 25 bp, Mus musculus
cagctcccaggactggtcaatgtgg

SEQ ID NO: 893535 - DNA, 25 bp, Mus musculus
cagctccctgacagaggatggtttg

SEQ ID NO: 893536 - DNA, 25 bp, Mus musculus
cagctccctgacagctatattgtct

SEQ ID NO: 893537 - DNA, 25 bp, Mus musculus
cagctccctgactgaggatggtttg

SEQ ID NO: 893538 - DNA, 25 bp, Mus musculus
cagctccctgactgctatattgtct

SEQ ID NO: 893539 - DNA, 25 bp, Mus musculus
cagctccctgctcccgcaagacatt

SEQ ID NO: 893540 - DNA, 25 bp, Mus musculus
cagctccctgctccggcaagacatt

SEQ ID NO: 893541 - DNA, 25 bp, Mus musculus
cagctccgggctgactcaagtccat

SEQ ID NO: 893542 - DNA, 25 bp, Mus musculus
cagctccgggctgagtcaagtccat

SEQ ID NO: 893543 - DNA, 25 bp, Mus musculus
cagctcctacagcacccgtttgtta

SEQ ID NO: 893544 - DNA, 25 bp, Mus musculus
cagctcctacaggacccgtttgtta

SEQ ID NO: 893545 - DNA, 25 bp, Mus musculus
cagctcctccgacgtggtgacgtat

SEQ ID NO: 893546 - DNA, 25 bp, Mus musculus
cagctcctccgaggtggtgacgtat

SEQ ID NO: 893547 - DNA, 25 bp, Mus musculus
cagctcctgacaaacgtcctggaaa

SEQ ID NO: 893548 - DNA, 25 bp, Mus musculus
cagctcctgagaaacgtcctggaaa

SEQ ID NO: 893549 - DNA, 25 bp, Mus musculus
cagctcctgcagcaaattagccgtc

SEQ ID NO: 893550 - DNA, 25 bp, Mus musculus
cagctcctgcaggaaattagccgtc

SEQ ID NO: 893551 - DNA, 25 bp, Mus musculus
cagctcctggagcacccccaggctg

SEQ ID NO: 893552 - DNA, 25 bp, Mus musculus
cagctcctggagcagccccaggctg

SEQ ID NO: 893553 - DNA, 25 bp, Mus musculus
cagctcggaccactgccaaggaagg

SEQ ID NO: 893554 - DNA, 25 bp, Mus musculus
cagctcggaccagtgccaaggaagg

SEQ ID NO: 893555 - DNA, 25 bp, Mus musculus
cagctcggagatgggagctttgtgg

SEQ ID NO: 893556 - DNA, 25 bp, Mus musculus
cagctcggagcacagatgggagctt

SEQ ID NO: 893557 - DNA, 25 bp, Mus musculus
cagctcggaggacagatgggagctt

SEQ ID NO: 893558 - DNA, 25 bp, Mus musculus
cagctcggaggacaggtcaatggcc

SEQ ID NO: 893559 - DNA, 25 bp, Mus musculus
cagctcggaggagaggtcaatggcc

SEQ ID NO: 893560 - DNA, 25 bp, Mus musculus
cagctcggagttgggagctttgtgg

SEQ ID NO: 893561 - DNA, 25 bp, Mus musculus
cagctcggctatcactccaggatcc

SEQ ID NO: 893562 - DNA, 25 bp, Mus musculus
cagctcggctatcagtccaggatcc

SEQ ID NO: 893563 - DNA, 25 bp, Mus musculus
cagctctcaccgagcgcagccttgg

SEQ ID NO: 893564 - DNA, 25 bp, Mus musculus
cagctctcaccgtgcgcagccttgg

SEQ ID NO: 893565 - DNA, 25 bp, Mus musculus
cagctctcctgttacgcgtctcttt

SEQ ID NO: 893566 - DNA, 25 bp, Mus musculus
cagctctcctgttaggcgtctcttt

SEQ ID NO: 893567 - DNA, 25 bp, Mus musculus
cagctctctatgatcttaccaatat

SEQ ID NO: 893568 - DNA, 25 bp, Mus musculus
cagctctctatgttcttaccaatat

SEQ ID NO: 893569 - DNA, 25 bp, Mus musculus
cagctctgagagcatgtgcccgata

SEQ ID NO: 893570 - DNA, 25 bp, Mus musculus
cagctctgagaggatgtgcccgata

SEQ ID NO: 893571 - DNA, 25 bp, Mus musculus
cagctctgcccacactcgggggcaa

SEQ ID NO: 893572 - DNA, 25 bp, Mus musculus
cagctctgcccagactcgggggcaa

SEQ ID NO: 893573 - DNA, 25 bp, Mus musculus
cagctctggaaactgattcaagggt

SEQ ID NO: 893574 - DNA, 25 bp, Mus musculus
cagctctggaaagtgattcaagggt

SEQ ID NO: 893575 - DNA, 25 bp, Mus musculus
cagctctgtgcacgtatataatttg

SEQ ID NO: 893576 - DNA, 25 bp, Mus musculus
cagctctgtgcaggtatataatttg

SEQ ID NO: 893577 - DNA, 25 bp, Mus musculus
cagctctgtgctgtattttcatctg

SEQ ID NO: 893578 - DNA, 25 bp, Mus musculus
cagctctgtgctttgggctcagttt

SEQ ID NO: 893579 - DNA, 25 bp, Mus musculus
cagctctgtggtgtattttcatctg

SEQ ID NO: 893580 - DNA, 25 bp, Mus musculus
cagctctgtggtttgggctcagttt

SEQ ID NO: 893581 - DNA, 25 bp, Mus musculus
cagctcttggattacccatcgcctt

SEQ ID NO: 893582 - DNA, 25 bp, Mus musculus
cagctcttggtttacccatcgcctt

SEQ ID NO: 893583 - DNA, 25 bp, Mus musculus
cagctctttgatcacgtggtaaaga

SEQ ID NO: 893584 - DNA, 25 bp, Mus musculus
cagctctttgatcaggtggtaaaga

SEQ ID NO: 893585 - DNA, 25 bp, Mus musculus
cagctgaaatttctccgtgctccga

SEQ ID NO: 893586 - DNA, 25 bp, Mus musculus
cagctgaaatttgtccgtgctccga

SEQ ID NO: 893587 - DNA, 25 bp, Mus musculus
cagctgaaggatgactgtcctgaag

SEQ ID NO: 893588 - DNA, 25 bp, Mus musculus
cagctgaaggatgagtgtcctgaag

SEQ ID NO: 893589 - DNA, 25 bp, Mus musculus
cagctgacaaagtgtcctcgcatct

SEQ ID NO: 893590 - DNA, 25 bp, Mus musculus
cagctgacaatgtgtcctcgcatct

SEQ ID NO: 893591 - DNA, 25 bp, Mus musculus
cagctgacagacctgaagagtgcag

SEQ ID NO: 893592 - DNA, 25 bp, Mus musculus
cagctgacagcattcagtttgcctg

SEQ ID NO: 893593 - DNA, 25 bp, Mus musculus
cagctgacaggattcagtttgcctg

SEQ ID NO: 893594 - DNA, 25 bp, Mus musculus
cagctgacagtcctgaagagtgcag

SEQ ID NO: 893595 - DNA, 25 bp, Mus musculus
cagctgactcagcaaatggaacttc

SEQ ID NO: 893596 - DNA, 25 bp, Mus musculus
cagctgactcagcccggcaagctga

SEQ ID NO: 893597 - DNA, 25 bp, Mus musculus
cagctgactcaggaaatggaacttc

SEQ ID NO: 893598 - DNA, 25 bp, Mus musculus
cagctgactcaggccggcaagctga

SEQ ID NO: 893599 - DNA, 25 bp, Mus musculus
cagctgactgagcacactctgcaga

SEQ ID NO: 893600 - DNA, 25 bp, Mus musculus
cagctgactgagcacgcggtggagg

SEQ ID NO: 893601 - DNA, 25 bp, Mus musculus
cagctgactgagcagactctgcaga

SEQ ID NO: 893602 - DNA, 25 bp, Mus musculus
cagctgactgagcaggcggtggagg

SEQ ID NO: 893603 - DNA, 25 bp, Mus musculus
cagctgagagctttgccaaggagcg

SEQ ID NO: 893604 - DNA, 25 bp, Mus musculus
cagctgagaggtttgccaaggagcg

SEQ ID NO: 893605 - DNA, 25 bp, Mus musculus
cagctgagcacgatgagccacgtgg

SEQ ID NO: 893606 - DNA, 25 bp, Mus musculus
cagctgagcacgttgagccacgtgg

SEQ ID NO: 893607 - DNA, 25 bp, Mus musculus
cagctgaggcagagaaaaggcagga

SEQ ID NO: 893608 - DNA, 25 bp, Mus musculus
cagctgaggcagcgtcagaaagcat

SEQ ID NO: 893609 - DNA, 25 bp, Mus musculus
cagctgaggcagctctccaaggaag

SEQ ID NO: 893610 - DNA, 25 bp, Mus musculus
cagctgaggcagggtcagaaagcat

SEQ ID NO: 893611 - DNA, 25 bp, Mus musculus
cagctgaggcaggtctccaaggaag

SEQ ID NO: 893612 - DNA, 25 bp, Mus musculus
cagctgaggcagtgaaaaggcagga

SEQ ID NO: 893613 - DNA, 25 bp, Mus musculus
cagctgagtttacaatccaagagaa

SEQ ID NO: 893614 - DNA, 25 bp, Mus musculus
cagctgagtttacaattttctaatg

SEQ ID NO: 893615 - DNA, 25 bp, Mus musculus
cagctgagtttagaatccaagagaa

SEQ ID NO: 893616 - DNA, 25 bp, Mus musculus
cagctgagtttagaattttctaatg

SEQ ID NO: 893617 - DNA, 25 bp, Mus musculus
cagctgatggagctttttaaatttg

SEQ ID NO: 893618 - DNA, 25 bp, Mus musculus
cagctgatggaggtttttaaatttg

SEQ ID NO: 893619 - DNA, 25 bp, Mus musculus
cagctgatggcaaacgaaaagagaa

SEQ ID NO: 893620 - DNA, 25 bp, Mus musculus
cagctgatggcaaaggaaaagagaa

SEQ ID NO: 893621 - DNA, 25 bp, Mus musculus
cagctgattgacaaaatcctggaag

SEQ ID NO: 893622 - DNA, 25 bp, Mus musculus
cagctgattgacaatatcctggaag

SEQ ID NO: 893623 - DNA, 25 bp, Mus musculus
cagctgcacaagcacctgttgcagc

SEQ ID NO: 893624 - DNA, 25 bp, Mus musculus
cagctgcacaagcagctgttgcagc

SEQ ID NO: 893625 - DNA, 25 bp, Mus musculus
cagctgcagaacatggacaaggaag

SEQ ID NO: 893626 - DNA, 25 bp, Mus musculus
cagctgcagatcatggacaaggaag

SEQ ID NO: 893627 - DNA, 25 bp, Mus musculus
cagctgcagcagcgctcatggcaga

SEQ ID NO: 893628 - DNA, 25 bp, Mus musculus
cagctgcagcagggctcatggcaga

SEQ ID NO: 893629 - DNA, 25 bp, Mus musculus
cagctgcaggaatagtgattgacgg

SEQ ID NO: 893630 - DNA, 25 bp, Mus musculus
cagctgcagggcaacatccggactc

SEQ ID NO: 893631 - DNA, 25 bp, Mus musculus
cagctgcagggcaagatccggactc

SEQ ID NO: 893632 - DNA, 25 bp, Mus musculus
cagctgcaggtatagtgattgacgg

SEQ ID NO: 893633 - DNA, 25 bp, Mus musculus
cagctgccagactctgatagacttg

SEQ ID NO: 893634 - DNA, 25 bp, Mus musculus
cagctgccagcacgtagatcatgat

SEQ ID NO: 893635 - DNA, 25 bp, Mus musculus
cagctgccagcacgtctccccctcc

SEQ ID NO: 893636 - DNA, 25 bp, Mus musculus
cagctgccagcaggtagatcatgat

SEQ ID NO: 893637 - DNA, 25 bp, Mus musculus
cagctgccagcaggtctccccctcc

SEQ ID NO: 893638 - DNA, 25 bp, Mus musculus
cagctgccagcttatagtaatggga

SEQ ID NO: 893639 - DNA, 25 bp, Mus musculus
cagctgccaggaagcatttatctta

SEQ ID NO: 893640 - DNA, 25 bp, Mus musculus
cagctgccaggaaggatttatctta

SEQ ID NO: 893641 - DNA, 25 bp, Mus musculus
cagctgccaggttatagtaatggga

SEQ ID NO: 893642 - DNA, 25 bp, Mus musculus
cagctgccagtctctgatagacttg

SEQ ID NO: 893643 - DNA, 25 bp, Mus musculus
cagctgccatcggacaaggctgtct

SEQ ID NO: 893644 - DNA, 25 bp, Mus musculus
cagctgccatgggacaaggctgtct

SEQ ID NO: 893645 - DNA, 25 bp, Mus musculus
cagctgcccggacaaaacatgaaga

SEQ ID NO: 893646 - DNA, 25 bp, Mus musculus
cagctgcccggacataacatgaaga

SEQ ID NO: 893647 - DNA, 25 bp, Mus musculus
cagctgcctcacatcgatccaatca

SEQ ID NO: 893648 - DNA, 25 bp, Mus musculus
cagctgcctcacatggatccaatca

SEQ ID NO: 893649 - DNA, 25 bp, Mus musculus
cagctgcgagcctctacacagagag

SEQ ID NO: 893650 - DNA, 25 bp, Mus musculus
cagctgcgaggctctacacagagag

SEQ ID NO: 893651 - DNA, 25 bp, Mus musculus
cagctgcgatgaccttaaaagatga

SEQ ID NO: 893652 - DNA, 25 bp, Mus musculus
cagctgcgatgagcttaaaagatga

SEQ ID NO: 893653 - DNA, 25 bp, Mus musculus
cagctgcgggcacgcgaatcgtaca

SEQ ID NO: 893654 - DNA, 25 bp, Mus musculus
cagctgcgggcacgggaatcgtaca

SEQ ID NO: 893655 - DNA, 25 bp, Mus musculus
cagctgctactgcaaatgctgacct

SEQ ID NO: 893656 - DNA, 25 bp, Mus musculus
cagctgctactggaaatgctgacct

SEQ ID NO: 893657 - DNA, 25 bp, Mus musculus
cagctgctccagactggatgagcta

SEQ ID NO: 893658 - DNA, 25 bp, Mus musculus
cagctgctccagtctggatgagcta

SEQ ID NO: 893659 - DNA, 25 bp, Mus musculus
cagctgctcttaaacactttaatct

SEQ ID NO: 893660 - DNA, 25 bp, Mus musculus
cagctgctcttaaacctagctcgga

SEQ ID NO: 893661 - DNA, 25 bp, Mus musculus
cagctgctcttaaacctcggaacac

SEQ ID NO: 893662 - DNA, 25 bp, Mus musculus
cagctgctcttaaagactttaatct

SEQ ID NO: 893663 - DNA, 25 bp, Mus musculus
cagctgctcttaaagctagctcgga

SEQ ID NO: 893664 - DNA, 25 bp, Mus musculus
cagctgctcttaaagctcggaacac

SEQ ID NO: 893665 - DNA, 25 bp, Mus musculus
cagctgcttaagcttcaggccttcc

SEQ ID NO: 893666 - DNA, 25 bp, Mus musculus
cagctgcttaaggttcaggccttcc

SEQ ID NO: 893667 - DNA, 25 bp, Mus musculus
cagctggaacaagacgtagtatggc

SEQ ID NO: 893668 - DNA, 25 bp, Mus musculus
cagctggaacaagaggtagtatggc

SEQ ID NO: 893669 - DNA, 25 bp, Mus musculus
cagctggaacagaggccgcacgagg

SEQ ID NO: 893670 - DNA, 25 bp, Mus musculus
cagctggaacagtggccgcacgagg

SEQ ID NO: 893671 - DNA, 25 bp, Mus musculus
cagctggaaggacgaagatgggctc

SEQ ID NO: 893672 - DNA, 25 bp, Mus musculus
cagctggaaggaggaagatgggctc

SEQ ID NO: 893673 - DNA, 25 bp, Mus musculus
cagctggaagtgaacaacccagatt

SEQ ID NO: 893674 - DNA, 25 bp, Mus musculus
cagctggaagtgaacgcctgaacca

SEQ ID NO: 893675 - DNA, 25 bp, Mus musculus
cagctggaagtgaagaacccagatt

SEQ ID NO: 893676 - DNA, 25 bp, Mus musculus
cagctggaagtgaaggcctgaacca

SEQ ID NO: 893677 - DNA, 25 bp, Mus musculus
cagctggacaagatccctggctggt

SEQ ID NO: 893678 - DNA, 25 bp, Mus musculus
cagctggacaagttccctggctggt

SEQ ID NO: 893679 - DNA, 25 bp, Mus musculus
cagctggacagagacttaattgaca

SEQ ID NO: 893680 - DNA, 25 bp, Mus musculus
cagctggacagagagttaattgaca

SEQ ID NO: 893681 - DNA, 25 bp, Mus musculus
cagctggagtctgtcgcaagcagga

SEQ ID NO: 893682 - DNA, 25 bp, Mus musculus
cagctggagtgtgtcgcaagcagga

SEQ ID NO: 893683 - DNA, 25 bp, Mus musculus
cagctggatgatcctcgtgtcatcc

SEQ ID NO: 893684 - DNA, 25 bp, Mus musculus
cagctggatgatgctcgtgtcatcc

SEQ ID NO: 893685 - DNA, 25 bp, Mus musculus
cagctggcagagccatacttgtacc

SEQ ID NO: 893686 - DNA, 25 bp, Mus musculus
cagctggcagaggcatacttgtacc

SEQ ID NO: 893687 - DNA, 25 bp, Mus musculus
cagctggcatggaacatgaaagaga

SEQ ID NO: 893688 - DNA, 25 bp, Mus musculus
cagctggcatggaagatgaaagaga

SEQ ID NO: 893689 - DNA, 25 bp, Mus musculus
cagctggccataccctggtgcctga

SEQ ID NO: 893690 - DNA, 25 bp, Mus musculus
cagctggccatagcctggtgcctga

SEQ ID NO: 893691 - DNA, 25 bp, Mus musculus
cagctggccctgcatcttttctcag

SEQ ID NO: 893692 - DNA, 25 bp, Mus musculus
cagctggccctggatcttttctcag

SEQ ID NO: 893693 - DNA, 25 bp, Mus musculus
cagctggctaagaatgtgactgtgg

SEQ ID NO: 893694 - DNA, 25 bp, Mus musculus
cagctggctaagtatgtgactgtgg

SEQ ID NO: 893695 - DNA, 25 bp, Mus musculus
cagctgggcaagatccttaccaaaa

SEQ ID NO: 893696 - DNA, 25 bp, Mus musculus
cagctgggcaagttccttaccaaaa

SEQ ID NO: 893697 - DNA, 25 bp, Mus musculus
cagctgggccaaagaaaaccaactc

SEQ ID NO: 893698 - DNA, 25 bp, Mus musculus
cagctgggccaatgaaaaccaactc

SEQ ID NO: 893699 - DNA, 25 bp, Mus musculus
cagctggtacagcctgtgaaatttg

SEQ ID NO: 893700 - DNA, 25 bp, Mus musculus
cagctggtacagcggctgtgaacaa

SEQ ID NO: 893701 - DNA, 25 bp, Mus musculus
cagctggtacaggctgtgaaatttg

SEQ ID NO: 893702 - DNA, 25 bp, Mus musculus
cagctggtacaggggctgtgaacaa

SEQ ID NO: 893703 - DNA, 25 bp, Mus musculus
cagctggtcacagacatctttcaga

SEQ ID NO: 893704 - DNA, 25 bp, Mus musculus
cagctggtcacagagatctttcaga

SEQ ID NO: 893705 - DNA, 25 bp, Mus musculus
cagctggtggagcactacaccacag

SEQ ID NO: 893706 - DNA, 25 bp, Mus musculus
cagctggtggagcaggaagtgaaca

SEQ ID NO: 893707 - DNA, 25 bp, Mus musculus
cagctggtggagccatggctggaaa

SEQ ID NO: 893708 - DNA, 25 bp, Mus musculus
cagctggtggaggactacaccacag

SEQ ID NO: 893709 - DNA, 25 bp, Mus musculus
cagctggtggaggaggaagtgaaca

SEQ ID NO: 893710 - DNA, 25 bp, Mus musculus
cagctggtggaggcatggctggaaa

SEQ ID NO: 893711 - DNA, 25 bp, Mus musculus
cagctggtttcccgcgtatgcatgg

SEQ ID NO: 893712 - DNA, 25 bp, Mus musculus
cagctggtttcccgggtatgcatgg

SEQ ID NO: 893713 - DNA, 25 bp, Mus musculus
cagctgtaatgaagcaaaatatctg

SEQ ID NO: 893714 - DNA, 25 bp, Mus musculus
cagctgtaatgaaggaaaatatctg

SEQ ID NO: 893715 - DNA, 25 bp, Mus musculus
cagctgtaccagcgaacggagaagc

SEQ ID NO: 893716 - DNA, 25 bp, Mus musculus
cagctgtaccagggaacggagaagc

SEQ ID NO: 893717 - DNA, 25 bp, Mus musculus
cagctgtatgagcacaaccacgagg

SEQ ID NO: 893718 - DNA, 25 bp, Mus musculus
cagctgtatgaggacaaccacgagg

SEQ ID NO: 893719 - DNA, 25 bp, Mus musculus
cagctgtcaccaacattaccacagc

SEQ ID NO: 893720 - DNA, 25 bp, Mus musculus
cagctgtcaccatcattaccacagc

SEQ ID NO: 893721 - DNA, 25 bp, Mus musculus
cagctgtctctaggcgtgacccaga

SEQ ID NO: 893722 - DNA, 25 bp, Mus musculus
cagctgtctctaggggtgacccaga

SEQ ID NO: 893723 - DNA, 25 bp, Mus musculus
cagctgtgaaaacggtcaagcagtg

SEQ ID NO: 893724 - DNA, 25 bp, Mus musculus
cagctgtgaaaagggtcaagcagtg

SEQ ID NO: 893725 - DNA, 25 bp, Mus musculus
cagctgtgcacccacacgttctcaa

SEQ ID NO: 893726 - DNA, 25 bp, Mus musculus
cagctgtgcaccgacacgttctcaa

SEQ ID NO: 893727 - DNA, 25 bp, Mus musculus
cagctgtgcagacaccccctgcagg

SEQ ID NO: 893728 - DNA, 25 bp, Mus musculus
cagctgtgcagacagcccctgcagg

SEQ ID NO: 893729 - DNA, 25 bp, Mus musculus
cagctgtgggaggtcctcgattcca

SEQ ID NO: 893730 - DNA, 25 bp, Mus musculus
cagctgtgggtggtcctcgattcca

SEQ ID NO: 893731 - DNA, 25 bp, Mus musculus
cagctgttagatgacggccataaaa

SEQ ID NO: 893732 - DNA, 25 bp, Mus musculus
cagctgttagttgacggccataaaa

SEQ ID NO: 893733 - DNA, 25 bp, Mus musculus
cagctgtttgatgacggccgcctga

SEQ ID NO: 893734 - DNA, 25 bp, Mus musculus
cagctgtttgatgagggccgcctga

SEQ ID NO: 893735 - DNA, 25 bp, Mus musculus
cagcttaaagcacggagaattacca

SEQ ID NO: 893736 - DNA, 25 bp, Mus musculus
cagcttaaagcagggagaattacca

SEQ ID NO: 893737 - DNA, 25 bp, Mus musculus
cagcttcaactacggaaaagccttg

SEQ ID NO: 893738 - DNA, 25 bp, Mus musculus
cagcttcaactagggaaaagccttg

SEQ ID NO: 893739 - DNA, 25 bp, Mus musculus
cagcttcaagcgtacacggtccttg

SEQ ID NO: 893740 - DNA, 25 bp, Mus musculus
cagcttcaagggtacacggtccttg

SEQ ID NO: 893741 - DNA, 25 bp, Mus musculus
cagcttcacgctggctatcgacttc

SEQ ID NO: 893742 - DNA, 25 bp, Mus musculus
cagcttcacggtggctatcgacttc

SEQ ID NO: 893743 - DNA, 25 bp, Mus musculus
cagcttcagagacatggtgtcttgt

SEQ ID NO: 893744 - DNA, 25 bp, Mus musculus
cagcttcagagacctgccaggccgc

SEQ ID NO: 893745 - DNA, 25 bp, Mus musculus
cagcttcagagactgtttaattcct

SEQ ID NO: 893746 - DNA, 25 bp, Mus musculus
cagcttcagagagatggtgtcttgt

SEQ ID NO: 893747 - DNA, 25 bp, Mus musculus
cagcttcagagagctgccaggccgc

SEQ ID NO: 893748 - DNA, 25 bp, Mus musculus
cagcttcagagagtgtttaattcct

SEQ ID NO: 893749 - DNA, 25 bp, Mus musculus
cagcttcagtatacaggggtgcaga

SEQ ID NO: 893750 - DNA, 25 bp, Mus musculus
cagcttcagtttacaggggtgcaga

SEQ ID NO: 893751 - DNA, 25 bp, Mus musculus
cagcttccacagaaactcaagtcaa

SEQ ID NO: 893752 - DNA, 25 bp, Mus musculus
cagcttccacagaccatgccttaag

SEQ ID NO: 893753 - DNA, 25 bp, Mus musculus
cagcttccacagctttcctttggat

SEQ ID NO: 893754 - DNA, 25 bp, Mus musculus
cagcttccacaggtttcctttggat

SEQ ID NO: 893755 - DNA, 25 bp, Mus musculus
cagcttccacagtaactcaagtcaa

SEQ ID NO: 893756 - DNA, 25 bp, Mus musculus
cagcttccacagtccatgccttaag

SEQ ID NO: 893757 - DNA, 25 bp, Mus musculus
cagcttccacattactgactggctc

SEQ ID NO: 893758 - DNA, 25 bp, Mus musculus
cagcttccacattagtgactggctc

SEQ ID NO: 893759 - DNA, 25 bp, Mus musculus
cagcttccaggcatgctcagggtat

SEQ ID NO: 893760 - DNA, 25 bp, Mus musculus
cagcttccaggcttgctcagggtat

SEQ ID NO: 893761 - DNA, 25 bp, Mus musculus
cagcttccctcgcaacctcctgacc

SEQ ID NO: 893762 - DNA, 25 bp, Mus musculus
cagcttccctcgcggggctgcggtc

SEQ ID NO: 893763 - DNA, 25 bp, Mus musculus
cagcttccctcggaacctcctgacc

SEQ ID NO: 893764 - DNA, 25 bp, Mus musculus
cagcttccctcggggggctgcggtc

SEQ ID NO: 893765 - DNA, 25 bp, Mus musculus
cagcttccgggacttcctgctcatt

SEQ ID NO: 893766 - DNA, 25 bp, Mus musculus
cagcttccgggagttcctgctcatt

SEQ ID NO: 893767 - DNA, 25 bp, Mus musculus
cagcttcctcaacgctaacttagga

SEQ ID NO: 893768 - DNA, 25 bp, Mus musculus
cagcttcctcaaggctaacttagga

SEQ ID NO: 893769 - DNA, 25 bp, Mus musculus
cagcttcctgagatagaagacatgg

SEQ ID NO: 893770 - DNA, 25 bp, Mus musculus
cagcttcctgagttagaagacatgg

SEQ ID NO: 893771 - DNA, 25 bp, Mus musculus
cagcttcgggcccacctctccagtc

SEQ ID NO: 893772 - DNA, 25 bp, Mus musculus
cagcttcgggcccagctctccagtc

SEQ ID NO: 893773 - DNA, 25 bp, Mus musculus
cagcttcgtaaactttgcacttggg

SEQ ID NO: 893774 - DNA, 25 bp, Mus musculus
cagcttcgtaaagtttgcacttggg

SEQ ID NO: 893775 - DNA, 25 bp, Mus musculus
cagcttctccctcgatttgagctca

SEQ ID NO: 893776 - DNA, 25 bp, Mus musculus
cagcttctccctggatttgagctca

SEQ ID NO: 893777 - DNA, 25 bp, Mus musculus
cagcttcttccatgaacttctccat

SEQ ID NO: 893778 - DNA, 25 bp, Mus musculus
cagcttcttccatgtacttctccat

SEQ ID NO: 893779 - DNA, 25 bp, Mus musculus
cagcttcttttcaatcatccagaac

SEQ ID NO: 893780 - DNA, 25 bp, Mus musculus
cagcttcttttctatcatccagaac

SEQ ID NO: 893781 - DNA, 25 bp, Mus musculus
cagcttgagtgcaacaggcaagtgc

SEQ ID NO: 893782 - DNA, 25 bp, Mus musculus
cagcttgagtgcaacgcaccccggc

SEQ ID NO: 893783 - DNA, 25 bp, Mus musculus
cagcttgagtgcaagaggcaagtgc

SEQ ID NO: 893784 - DNA, 25 bp, Mus musculus
cagcttgagtgcaaggcaccccggc

SEQ ID NO: 893785 - DNA, 25 bp, Mus musculus
cagcttgcctcaccgaaaatgggct

SEQ ID NO: 893786 - DNA, 25 bp, Mus musculus
cagcttgcctcagcgaaaatgggct

SEQ ID NO: 893787 - DNA, 25 bp, Mus musculus
cagcttgcggaatccacagggccag

SEQ ID NO: 893788 - DNA, 25 bp, Mus musculus
cagcttgcggaatcgacagggccag

SEQ ID NO: 893789 - DNA, 25 bp, Mus musculus
cagcttgtgcagcatcagtatggaa

SEQ ID NO: 893790 - DNA, 25 bp, Mus musculus
cagcttgtgcaggatcagtatggaa

SEQ ID NO: 893791 - DNA, 25 bp, Mus musculus
cagcttgttctgcgacgcactcttg

SEQ ID NO: 893792 - DNA, 25 bp, Mus musculus
cagcttgttctgggacgcactcttg

SEQ ID NO: 893793 - DNA, 25 bp, Mus musculus
cagctttatcaacgagaagaaatac

SEQ ID NO: 893794 - DNA, 25 bp, Mus musculus
cagctttatcaaggagaagaaatac

SEQ ID NO: 893795 - DNA, 25 bp, Mus musculus
cagctttattacaaccgcgaacttt

SEQ ID NO: 893796 - DNA, 25 bp, Mus musculus
cagctttattacaagcgcgaacttt

SEQ ID NO: 893797 - DNA, 25 bp, Mus musculus
cagctttcagcacgtggtgaaatta

SEQ ID NO: 893798 - DNA, 25 bp, Mus musculus
cagctttcagcaggtggtgaaatta

SEQ ID NO: 893799 - DNA, 25 bp, Mus musculus
cagctttcttagccagcgagagggc

SEQ ID NO: 893800 - DNA, 25 bp, Mus musculus
cagctttcttaggcagcgagagggc

SEQ ID NO: 893801 - DNA, 25 bp, Mus musculus
cagctttgagatggctatgaacggc

SEQ ID NO: 893802 - DNA, 25 bp, Mus musculus
cagctttgagttggctatgaacggc

SEQ ID NO: 893803 - DNA, 25 bp, Mus musculus
cagctttggcaacgtgctgctggca

SEQ ID NO: 893804 - DNA, 25 bp, Mus musculus
cagctttggcaaggtgctgctggca

SEQ ID NO: 893805 - DNA, 25 bp, Mus musculus
cagcttttacaaccttcaaaaccgc

SEQ ID NO: 893806 - DNA, 25 bp, Mus musculus
cagcttttacaagcttcaaaaccgc

SEQ ID NO: 893807 - DNA, 25 bp, Mus musculus
cagcttttggcaagccttacaggag

SEQ ID NO: 893808 - DNA, 25 bp, Mus musculus
cagcttttggcaaggcttacaggag

SEQ ID NO: 893809 - DNA, 25 bp, Mus musculus
cagctttttaacaacgtgaactgaa

SEQ ID NO: 893810 - DNA, 25 bp, Mus musculus
cagctttttaacaaggtgaactgaa

SEQ ID NO: 893811 - DNA, 25 bp, Mus musculus
caggaaaaacagaggccagcaagct

SEQ ID NO: 893812 - DNA, 25 bp, Mus musculus
caggaaaaacagtggccagcaagct

SEQ ID NO: 893813 - DNA, 25 bp, Mus musculus
caggaaaacaatgctgatagcccaa

SEQ ID NO: 893814 - DNA, 25 bp, Mus musculus
caggaaaacattgctgatagcccaa

SEQ ID NO: 893815 - DNA, 25 bp, Mus musculus
caggaaaaccagcttgctggtgacc

SEQ ID NO: 893816 - DNA, 25 bp, Mus musculus
caggaaaaccaggttgctggtgacc

SEQ ID NO: 893817 - DNA, 25 bp, Mus musculus
caggaaaagcggccatcttctgtca

SEQ ID NO: 893818 - DNA, 25 bp, Mus musculus
caggaaaagcgggcatcttctgtca

SEQ ID NO: 893819 - DNA, 25 bp, Mus musculus
caggaaaataagatctgaaaatcaa

SEQ ID NO: 893820 - DNA, 25 bp, Mus musculus
caggaaaataagttctgaaaatcaa

SEQ ID NO: 893821 - DNA, 25 bp, Mus musculus
caggaaacaagacatggagcagatg

SEQ ID NO: 893822 - DNA, 25 bp, Mus musculus
caggaaacaagagatggagcagatg

SEQ ID NO: 893823 - DNA, 25 bp, Mus musculus
caggaaacagcacattcctcagaca

SEQ ID NO: 893824 - DNA, 25 bp, Mus musculus
caggaaacagcacggaaggatctgt

SEQ ID NO: 893825 - DNA, 25 bp, Mus musculus
caggaaacagcagattcctcagaca

SEQ ID NO: 893826 - DNA, 25 bp, Mus musculus
caggaaacagcagggaaggatctgt

SEQ ID NO: 893827 - DNA, 25 bp, Mus musculus
caggaaatacatcctgtctgtgctt

SEQ ID NO: 893828 - DNA, 25 bp, Mus musculus
caggaaatacatgctgtctgtgctt

SEQ ID NO: 893829 - DNA, 25 bp, Mus musculus
caggaaatactgaacgataagaaac

SEQ ID NO: 893830 - DNA, 25 bp, Mus musculus
caggaaatactgaaggataagaaac

SEQ ID NO: 893831 - DNA, 25 bp, Mus musculus
caggaaatcctgccaacaagggatc

SEQ ID NO: 893832 - DNA, 25 bp, Mus musculus
caggaaatcctggcaacaagggatc

SEQ ID NO: 893833 - DNA, 25 bp, Mus musculus
caggaaatgcagcttttccttactg

SEQ ID NO: 893834 - DNA, 25 bp, Mus musculus
caggaaatgcaggttttccttactg

SEQ ID NO: 893835 - DNA, 25 bp, Mus musculus
caggaaatgtggcgtggctgctgaa

SEQ ID NO: 893836 - DNA, 25 bp, Mus musculus
caggaaatgtggggtggctgctgaa

SEQ ID NO: 893837 - DNA, 25 bp, Mus musculus
caggaaattcagccgatgctgggcc

SEQ ID NO: 893838 - DNA, 25 bp, Mus musculus
caggaaattcagcctcaagtacctg

SEQ ID NO: 893839 - DNA, 25 bp, Mus musculus
caggaaattcaggcgatgctgggcc

SEQ ID NO: 893840 - DNA, 25 bp, Mus musculus
caggaaattcaggctcaagtacctg

SEQ ID NO: 893841 - DNA, 25 bp, Mus musculus
caggaacaagatcctgcacagggac

SEQ ID NO: 893842 - DNA, 25 bp, Mus musculus
caggaacaagcatatcaataaagct

SEQ ID NO: 893843 - DNA, 25 bp, Mus musculus
caggaacaagctgtggccaaacgta

SEQ ID NO: 893844 - DNA, 25 bp, Mus musculus
caggaacaaggatatcaataaagct

SEQ ID NO: 893845 - DNA, 25 bp, Mus musculus
caggaacaaggtgtggccaaacgta

SEQ ID NO: 893846 - DNA, 25 bp, Mus musculus
caggaacaagttcctgcacagggac

SEQ ID NO: 893847 - DNA, 25 bp, Mus musculus
caggaacatcaacgtgggaagaccc

SEQ ID NO: 893848 - DNA, 25 bp, Mus musculus
caggaacatcaaggtgggaagaccc

SEQ ID NO: 893849 - DNA, 25 bp, Mus musculus
caggaacatgggcgcagacctgtgc

SEQ ID NO: 893850 - DNA, 25 bp, Mus musculus
caggaacatgggcggagacctgtgc

SEQ ID NO: 893851 - DNA, 25 bp, Mus musculus
caggaaccaatgagacaccatgatt

SEQ ID NO: 893852 - DNA, 25 bp, Mus musculus
caggaaccaatgcagccattccgta

SEQ ID NO: 893853 - DNA, 25 bp, Mus musculus
caggaaccaatggagccattccgta

SEQ ID NO: 893854 - DNA, 25 bp, Mus musculus
caggaaccaatgtgacaccatgatt

SEQ ID NO: 893855 - DNA, 25 bp, Mus musculus
caggaacctgctcacacacctgtgc

SEQ ID NO: 893856 - DNA, 25 bp, Mus musculus
caggaacctggtcacacacctgtgc

SEQ ID NO: 893857 - DNA, 25 bp, Mus musculus
caggaactcaaacaagtcacagtaa

SEQ ID NO: 893858 - DNA, 25 bp, Mus musculus
caggaactcaaagaagtcacagtaa

SEQ ID NO: 893859 - DNA, 25 bp, Mus musculus
caggaactcacacctccattactta

SEQ ID NO: 893860 - DNA, 25 bp, Mus musculus
caggaactcacagctccattactta

SEQ ID NO: 893861 - DNA, 25 bp, Mus musculus
caggaactcgagcctcctggaggaa

SEQ ID NO: 893862 - DNA, 25 bp, Mus musculus
caggaactcgaggctcctggaggaa

SEQ ID NO: 893863 - DNA, 25 bp, Mus musculus
caggaactgaggctccggagggtgt

SEQ ID NO: 893864 - DNA, 25 bp, Mus musculus
caggaactgagggtccggagggtgt

SEQ ID NO: 893865 - DNA, 25 bp, Mus musculus
caggaactgtctggacgaccccccg

SEQ ID NO: 893866 - DNA, 25 bp, Mus musculus
caggaactgtgtggacgaccccccg

SEQ ID NO: 893867 - DNA, 25 bp, Mus musculus
caggaacttcagatggcgagtcttt

SEQ ID NO: 893868 - DNA, 25 bp, Mus musculus
caggaacttcagcatcatctgggag

SEQ ID NO: 893869 - DNA, 25 bp, Mus musculus
caggaacttcaggatcatctgggag

SEQ ID NO: 893870 - DNA, 25 bp, Mus musculus
caggaacttcagttggcgagtcttt

SEQ ID NO: 893871 - DNA, 25 bp, Mus musculus
caggaagaagcttgctcaggaccac

SEQ ID NO: 893872 - DNA, 25 bp, Mus musculus
caggaagaaggttgctcaggaccac

SEQ ID NO: 893873 - DNA, 25 bp, Mus musculus
caggaagagcagcatttcatcactg

SEQ ID NO: 893874 - DNA, 25 bp, Mus musculus
caggaagagcaggatttcatcactg

SEQ ID NO: 893875 - DNA, 25 bp, Mus musculus
caggaagatcaacccaaagaactcc

SEQ ID NO: 893876 - DNA, 25 bp, Mus musculus
caggaagatcaacccaaagaatgca

SEQ ID NO: 893877 - DNA, 25 bp, Mus musculus
caggaagatcaagccaaagaactcc

SEQ ID NO: 893878 - DNA, 25 bp, Mus musculus
caggaagatcaagccaaagaatgca

SEQ ID NO: 893879 - DNA, 25 bp, Mus musculus
caggaagcccagaaaatccaatcag

SEQ ID NO: 893880 - DNA, 25 bp, Mus musculus
caggaagcccagtaaatccaatcag

SEQ ID NO: 893881 - DNA, 25 bp, Mus musculus
caggaagctgcagaaggggtggaag

SEQ ID NO: 893882 - DNA, 25 bp, Mus musculus
caggaagctgctccagctcagcttg

SEQ ID NO: 893883 - DNA, 25 bp, Mus musculus
caggaagctggagaaggggtggaag

SEQ ID NO: 893884 - DNA, 25 bp, Mus musculus
caggaagctggtccagctcagcttg

SEQ ID NO: 893885 - DNA, 25 bp, Mus musculus
caggaagcttcacattataccgaaa

SEQ ID NO: 893886 - DNA, 25 bp, Mus musculus
caggaagcttcacgctatgtctttc

SEQ ID NO: 893887 - DNA, 25 bp, Mus musculus
caggaagcttcagattataccgaaa

SEQ ID NO: 893888 - DNA, 25 bp, Mus musculus
caggaagcttcaggctatgtctttc

SEQ ID NO: 893889 - DNA, 25 bp, Mus musculus
caggaagggactatattgatcagtg

SEQ ID NO: 893890 - DNA, 25 bp, Mus musculus
caggaagggactttattgatcagtg

SEQ ID NO: 893891 - DNA, 25 bp, Mus musculus
caggaagtcatgaacgcctgctctg

SEQ ID NO: 893892 - DNA, 25 bp, Mus musculus
caggaagtcatgaaggcctgctctg

SEQ ID NO: 893893 - DNA, 25 bp, Mus musculus
caggaagtgaaatccgcttgctatc

SEQ ID NO: 893894 - DNA, 25 bp, Mus musculus
caggaagtgaaatcggcttgctatc

SEQ ID NO: 893895 - DNA, 25 bp, Mus musculus
caggaagtgcaataaggatcaggct

SEQ ID NO: 893896 - DNA, 25 bp, Mus musculus
caggaagtgcaatatggatcaggct

SEQ ID NO: 893897 - DNA, 25 bp, Mus musculus
caggaagttcacaacataaccaaca

SEQ ID NO: 893898 - DNA, 25 bp, Mus musculus
caggaagttcacaacgaatgtatca

SEQ ID NO: 893899 - DNA, 25 bp, Mus musculus
caggaagttcacaagataaccaaca

SEQ ID NO: 893900 - DNA, 25 bp, Mus musculus
caggaagttcacaaggaatgtatca

SEQ ID NO: 893901 - DNA, 25 bp, Mus musculus
caggaatacgagaaagccctgcagg

SEQ ID NO: 893902 - DNA, 25 bp, Mus musculus
caggaatacgagtaagccctgcagg

SEQ ID NO: 893903 - DNA, 25 bp, Mus musculus
caggaatggaagccaaacagttctg

SEQ ID NO: 893904 - DNA, 25 bp, Mus musculus
caggaatggaaggcaaacagttctg

SEQ ID NO: 893905 - DNA, 25 bp, Mus musculus
caggacaaaaacaaccaaacagctc

SEQ ID NO: 893906 - DNA, 25 bp, Mus musculus
caggacaaaaacaagcaaacagctc

SEQ ID NO: 893907 - DNA, 25 bp, Mus musculus
caggacaaacggctgtggctggagg

SEQ ID NO: 893908 - DNA, 25 bp, Mus musculus
caggacaaacgggtgtggctggagg

SEQ ID NO: 893909 - DNA, 25 bp, Mus musculus
caggacaactgaaacgtctctcggc

SEQ ID NO: 893910 - DNA, 25 bp, Mus musculus
caggacaactgaaaggtctctcggc

SEQ ID NO: 893911 - DNA, 25 bp, Mus musculus
caggacaactgccacgttatctgtg

SEQ ID NO: 893912 - DNA, 25 bp, Mus musculus
caggacaactgccaggttatctgtg

SEQ ID NO: 893913 - DNA, 25 bp, Mus musculus
caggacaagcagctcccatgcatca

SEQ ID NO: 893914 - DNA, 25 bp, Mus musculus
caggacaagcaggtcccatgcatca

SEQ ID NO: 893915 - DNA, 25 bp, Mus musculus
caggacaatgcaccttcacttggtt

SEQ ID NO: 893916 - DNA, 25 bp, Mus musculus
caggacaatgcactgctgaaaggag

SEQ ID NO: 893917 - DNA, 25 bp, Mus musculus
caggacaatgcagcttcacttggtt

SEQ ID NO: 893918 - DNA, 25 bp, Mus musculus
caggacaatgcagtgctgaaaggag

SEQ ID NO: 893919 - DNA, 25 bp, Mus musculus
caggacacacaattcggccggcggc

SEQ ID NO: 893920 - DNA, 25 bp, Mus musculus
caggacacacaattcgtggacgcag

SEQ ID NO: 893921 - DNA, 25 bp, Mus musculus
caggacacacaattgggccggcggc

SEQ ID NO: 893922 - DNA, 25 bp, Mus musculus
caggacacacaattggtggacgcag

SEQ ID NO: 893923 - DNA, 25 bp, Mus musculus
caggacacacagacactgtcctgtt

SEQ ID NO: 893924 - DNA, 25 bp, Mus musculus
caggacacacagtcactgtcctgtt

SEQ ID NO: 893925 - DNA, 25 bp, Mus musculus
caggacacacggcctacttgtcctg

SEQ ID NO: 893926 - DNA, 25 bp, Mus musculus
caggacacacgggctacttgtcctg

SEQ ID NO: 893927 - DNA, 25 bp, Mus musculus
caggacacagagccaccaggtaaca

SEQ ID NO: 893928 - DNA, 25 bp, Mus musculus
caggacacagaggcaccaggtaaca

SEQ ID NO: 893929 - DNA, 25 bp, Mus musculus
caggacactgatcgccaccggggag

SEQ ID NO: 893930 - DNA, 25 bp, Mus musculus
caggacactgatcggcaccggggag

SEQ ID NO: 893931 - DNA, 25 bp, Mus musculus
caggacactgtatccgttccatgta

SEQ ID NO: 893932 - DNA, 25 bp, Mus musculus
caggacactgtatcggttccatgta

SEQ ID NO: 893933 - DNA, 25 bp, Mus musculus
caggacagcgagcgcaatctgcaga

SEQ ID NO: 893934 - DNA, 25 bp, Mus musculus
caggacagcgagggcaatctgcaga

SEQ ID NO: 893935 - DNA, 25 bp, Mus musculus
caggacagtaggcaacagacgccgc

SEQ ID NO: 893936 - DNA, 25 bp, Mus musculus
caggacagtagggaacagacgccgc

SEQ ID NO: 893937 - DNA, 25 bp, Mus musculus
caggacagtgacagcatcacggctg

SEQ ID NO: 893938 - DNA, 25 bp, Mus musculus
caggacagtgactgcatcacggctg

SEQ ID NO: 893939 - DNA, 25 bp, Mus musculus
caggacagtgtctacatattgatga

SEQ ID NO: 893940 - DNA, 25 bp, Mus musculus
caggacagtgtctagatattgatga

SEQ ID NO: 893941 - DNA, 25 bp, Mus musculus
caggacatagaacttgccttgtatt

SEQ ID NO: 893942 - DNA, 25 bp, Mus musculus
caggacatagaagttgccttgtatt

SEQ ID NO: 893943 - DNA, 25 bp, Mus musculus
caggacatgatacacggcttgaagc

SEQ ID NO: 893944 - DNA, 25 bp, Mus musculus
caggacatgatagacggcttgaagc

SEQ ID NO: 893945 - DNA, 25 bp, Mus musculus
caggaccaagacgtcttgttattga

SEQ ID NO: 893946 - DNA, 25 bp, Mus musculus
caggaccaagtcgtcttgttattga

SEQ ID NO: 893947 - DNA, 25 bp, Mus musculus
caggaccaataacgaggtccccagc

SEQ ID NO: 893948 - DNA, 25 bp, Mus musculus
caggaccaataaggaggtccccagc

SEQ ID NO: 893949 - DNA, 25 bp, Mus musculus
caggaccacgatgtccctggtagat

SEQ ID NO: 893950 - DNA, 25 bp, Mus musculus
caggaccacgttgtccctggtagat

SEQ ID NO: 893951 - DNA, 25 bp, Mus musculus
caggaccactcactacaacctactc

SEQ ID NO: 893952 - DNA, 25 bp, Mus musculus
caggaccactcagtacaacctactc

SEQ ID NO: 893953 - DNA, 25 bp, Mus musculus
caggaccaggcacgagtacctggag

SEQ ID NO: 893954 - DNA, 25 bp, Mus musculus
caggaccaggcactacacctatggc

SEQ ID NO: 893955 - DNA, 25 bp, Mus musculus
caggaccaggcaggagtacctggag

SEQ ID NO: 893956 - DNA, 25 bp, Mus musculus
caggaccaggcagtacacctatggc

SEQ ID NO: 893957 - DNA, 25 bp, Mus musculus
caggacccagagcaagtccacatgc

SEQ ID NO: 893958 - DNA, 25 bp, Mus musculus
caggacccagaggaagtccacatgc

SEQ ID NO: 893959 - DNA, 25 bp, Mus musculus
caggaccccaaggtcatgatgctag

SEQ ID NO: 893960 - DNA, 25 bp, Mus musculus
caggaccccatggtcatgatgctag

SEQ ID NO: 893961 - DNA, 25 bp, Mus musculus
caggaccctatgaacttgaaaacac

SEQ ID NO: 893962 - DNA, 25 bp, Mus musculus
caggaccctatgaagttgaaaacac

SEQ ID NO: 893963 - DNA, 25 bp, Mus musculus
caggaccctggcacacctcagcatg

SEQ ID NO: 893964 - DNA, 25 bp, Mus musculus
caggaccctggctcacctcagcatg

SEQ ID NO: 893965 - DNA, 25 bp, Mus musculus
caggacctaaagcattacatgcgtc

SEQ ID NO: 893966 - DNA, 25 bp, Mus musculus
caggacctaaaggattacatgcgtc

SEQ ID NO: 893967 - DNA, 25 bp, Mus musculus
caggacctccaacgcaagatcactt

SEQ ID NO: 893968 - DNA, 25 bp, Mus musculus
caggacctccaaggcaagatcactt

SEQ ID NO: 893969 - DNA, 25 bp, Mus musculus
caggacctgactcacagaggaagaa

SEQ ID NO: 893970 - DNA, 25 bp, Mus musculus
caggacctgactcagagaggaagaa

SEQ ID NO: 893971 - DNA, 25 bp, Mus musculus
caggaccttggcagcggaatcaaag

SEQ ID NO: 893972 - DNA, 25 bp, Mus musculus
caggaccttggcaggggaatcaaag

SEQ ID NO: 893973 - DNA, 25 bp, Mus musculus
caggacgagacaacatcccattagc

SEQ ID NO: 893974 - DNA, 25 bp, Mus musculus
caggacgagacatcatcccattagc

SEQ ID NO: 893975 - DNA, 25 bp, Mus musculus
caggacgccaagcgcttaagtctaa

SEQ ID NO: 893976 - DNA, 25 bp, Mus musculus
caggacgccaagggcttaagtctaa

SEQ ID NO: 893977 - DNA, 25 bp, Mus musculus
caggacgcccagcaactgtatgagg

SEQ ID NO: 893978 - DNA, 25 bp, Mus musculus
caggacgcccagctctttcaacact

SEQ ID NO: 893979 - DNA, 25 bp, Mus musculus
caggacgcccaggaactgtatgagg

SEQ ID NO: 893980 - DNA, 25 bp, Mus musculus
caggacgcccaggtctttcaacact

SEQ ID NO: 893981 - DNA, 25 bp, Mus musculus
caggacggggagacccatataatgc

SEQ ID NO: 893982 - DNA, 25 bp, Mus musculus
caggacggggagtcccatataatgc

SEQ ID NO: 893983 - DNA, 25 bp, Mus musculus
caggactcagctactgcggtgctgt

SEQ ID NO: 893984 - DNA, 25 bp, Mus musculus
caggactcaggtactgcggtgctgt

SEQ ID NO: 893985 - DNA, 25 bp, Mus musculus
caggactcaggtagatgagaggcca

SEQ ID NO: 893986 - DNA, 25 bp, Mus musculus
caggactcaggtaggttgatggaaa

SEQ ID NO: 893987 - DNA, 25 bp, Mus musculus
caggactcaggttgatgagaggcca

SEQ ID NO: 893988 - DNA, 25 bp, Mus musculus
caggactcaggttggttgatggaaa

SEQ ID NO: 893989 - DNA, 25 bp, Mus musculus
caggactccattaacaacttcaggg

SEQ ID NO: 893990 - DNA, 25 bp, Mus musculus
caggactccatttacaacttcaggg

SEQ ID NO: 893991 - DNA, 25 bp, Mus musculus
caggactgacagaacaactaatgcg

SEQ ID NO: 893992 - DNA, 25 bp, Mus musculus
caggactgacagtacaactaatgcg

SEQ ID NO: 893993 - DNA, 25 bp, Mus musculus
caggactgacttcacggcttttgca

SEQ ID NO: 893994 - DNA, 25 bp, Mus musculus
caggactgacttcagggcttttgca

SEQ ID NO: 893995 - DNA, 25 bp, Mus musculus
caggactgagcaagcaatgaagctg

SEQ ID NO: 893996 - DNA, 25 bp, Mus musculus
caggactgaggaagcaatgaagctg

SEQ ID NO: 893997 - DNA, 25 bp, Mus musculus
caggagaatcagctatgctaacacc

SEQ ID NO: 893998 - DNA, 25 bp, Mus musculus
caggagaatctgctatgctaacacc

SEQ ID NO: 893999 - DNA, 25 bp, Mus musculus
caggagaatgctccgtctcccaggg

SEQ ID NO: 894000 - DNA, 25 bp, Mus musculus
caggagaatggtccgtctcccaggg

SEQ ID NO: 894001 - DNA, 25 bp, Mus musculus
caggagaatgtccacatcagcagcg

SEQ ID NO: 894002 - DNA, 25 bp, Mus musculus
caggagaatgtcgacatcagcagcg

SEQ ID NO: 894003 - DNA, 25 bp, Mus musculus
caggagacggaatgacctggatgac

SEQ ID NO: 894004 - DNA, 25 bp, Mus musculus
caggagacggtatgacctggatgac

SEQ ID NO: 894005 - DNA, 25 bp, Mus musculus
caggagagcacacgattaagttgtc

SEQ ID NO: 894006 - DNA, 25 bp, Mus musculus
caggagagcacaggattaagttgtc

SEQ ID NO: 894007 - DNA, 25 bp, Mus musculus
caggagagccagccttagaatcaga

SEQ ID NO: 894008 - DNA, 25 bp, Mus musculus
caggagagccaggcttagaatcaga

SEQ ID NO: 894009 - DNA, 25 bp, Mus musculus
caggagagcgagaaagagttcctag

SEQ ID NO: 894010 - DNA, 25 bp, Mus musculus
caggagagcgtgaaagagttcctag

SEQ ID NO: 894011 - DNA, 25 bp, Mus musculus
caggagagctatcctggtggtgagg

SEQ ID NO: 894012 - DNA, 25 bp, Mus musculus
caggagagctatgctggtggtgagg

SEQ ID NO: 894013 - DNA, 25 bp, Mus musculus
caggagatatgcccaacaaaagcgg

SEQ ID NO: 894014 - DNA, 25 bp, Mus musculus
caggagatatgcgcaacaaaagcgg

SEQ ID NO: 894015 - DNA, 25 bp, Mus musculus
caggagatcaagaatctctctggct

SEQ ID NO: 894016 - DNA, 25 bp, Mus musculus
caggagatcaagtatctctctggct

SEQ ID NO: 894017 - DNA, 25 bp, Mus musculus
caggagatcatcaacggcatgggtt

SEQ ID NO: 894018 - DNA, 25 bp, Mus musculus
caggagatcatcaagggcatgggtt

SEQ ID NO: 894019 - DNA, 25 bp, Mus musculus
caggagatcatgcaagaaaagtctt

SEQ ID NO: 894020 - DNA, 25 bp, Mus musculus
caggagatcatgcatgaaaagtctt

SEQ ID NO: 894021 - DNA, 25 bp, Mus musculus
caggagatgcctcatcaacatgaca

SEQ ID NO: 894022 - DNA, 25 bp, Mus musculus
caggagatgcctgatcaacatgaca

SEQ ID NO: 894023 - DNA, 25 bp, Mus musculus
caggagattaagcctgccacctagg

SEQ ID NO: 894024 - DNA, 25 bp, Mus musculus
caggagattaaggctgccacctagg

SEQ ID NO: 894025 - DNA, 25 bp, Mus musculus
caggagattttgaaagacaagaagc

SEQ ID NO: 894026 - DNA, 25 bp, Mus musculus
caggagattttgaatgacaagaagc

SEQ ID NO: 894027 - DNA, 25 bp, Mus musculus
caggagcagctgcctgcagagctgg

SEQ ID NO: 894028 - DNA, 25 bp, Mus musculus
caggagcagctggctgcagagctgg

SEQ ID NO: 894029 - DNA, 25 bp, Mus musculus
caggagcaggaacgggagaaggaca

SEQ ID NO: 894030 - DNA, 25 bp, Mus musculus
caggagcaggaaggggagaaggaca

SEQ ID NO: 894031 - DNA, 25 bp, Mus musculus
caggagcattttaataagaagatag

SEQ ID NO: 894032 - DNA, 25 bp, Mus musculus
caggagcatttttataagaagatag

SEQ ID NO: 894033 - DNA, 25 bp, Mus musculus
caggagccaagacctatgagccaga

SEQ ID NO: 894034 - DNA, 25 bp, Mus musculus
caggagccaagactgaagaacaatc

SEQ ID NO: 894035 - DNA, 25 bp, Mus musculus
caggagccaagagctatgagccaga

SEQ ID NO: 894036 - DNA, 25 bp, Mus musculus
caggagccaagagtgaagaacaatc

SEQ ID NO: 894037 - DNA, 25 bp, Mus musculus
caggagcccaagccacaggtagagg

SEQ ID NO: 894038 - DNA, 25 bp, Mus musculus
caggagcccaaggcacaggtagagg

SEQ ID NO: 894039 - DNA, 25 bp, Mus musculus
caggagcccagacaactgcctcctg

SEQ ID NO: 894040 - DNA, 25 bp, Mus musculus
caggagcccagagaactgcctcctg

SEQ ID NO: 894041 - DNA, 25 bp, Mus musculus
caggagcgaaagagacaccagcagt

SEQ ID NO: 894042 - DNA, 25 bp, Mus musculus
caggagcgaaagtgacaccagcagt

SEQ ID NO: 894043 - DNA, 25 bp, Mus musculus
caggagcgacatgacgtagccaagt

SEQ ID NO: 894044 - DNA, 25 bp, Mus musculus
caggagcgacatgaggtagccaagt

SEQ ID NO: 894045 - DNA, 25 bp, Mus musculus
caggagcggcagactcagagagaag

SEQ ID NO: 894046 - DNA, 25 bp, Mus musculus
caggagcggcagtctcagagagaag

SEQ ID NO: 894047 - DNA, 25 bp, Mus musculus
caggagcgtgcattggtgaccaggc

SEQ ID NO: 894048 - DNA, 25 bp, Mus musculus
caggagcgtgctctccaggaacaca

SEQ ID NO: 894049 - DNA, 25 bp, Mus musculus
caggagcgtgctgtccaggaacaca

SEQ ID NO: 894050 - DNA, 25 bp, Mus musculus
caggagcgtggattggtgaccaggc

SEQ ID NO: 894051 - DNA, 25 bp, Mus musculus
caggagctcacacgagagaaggaga

SEQ ID NO: 894052 - DNA, 25 bp, Mus musculus
caggagctcacaggagagaaggaga

SEQ ID NO: 894053 - DNA, 25 bp, Mus musculus
caggagcttgctttgaaggagataa

SEQ ID NO: 894054 - DNA, 25 bp, Mus musculus
caggagcttggtttgaaggagataa

SEQ ID NO: 894055 - DNA, 25 bp, Mus musculus
caggaggaactacacacagtgattg

SEQ ID NO: 894056 - DNA, 25 bp, Mus musculus
caggaggaactagacacagtgattg

SEQ ID NO: 894057 - DNA, 25 bp, Mus musculus
caggaggacaggaacagactcgcaa

SEQ ID NO: 894058 - DNA, 25 bp, Mus musculus
caggaggacaggaagagactcgcaa

SEQ ID NO: 894059 - DNA, 25 bp, Mus musculus
caggaggacgagctgctgctggtga

SEQ ID NO: 894060 - DNA, 25 bp, Mus musculus
caggaggacgaggtgctgctggtga

SEQ ID NO: 894061 - DNA, 25 bp, Mus musculus
caggaggagcagcattttggcagtg

SEQ ID NO: 894062 - DNA, 25 bp, Mus musculus
caggaggagcaggattttggcagtg

SEQ ID NO: 894063 - DNA, 25 bp, Mus musculus
caggaggagctgcagatggaagcaa

SEQ ID NO: 894064 - DNA, 25 bp, Mus musculus
caggaggagctgcatggaagcaaaa

SEQ ID NO: 894065 - DNA, 25 bp, Mus musculus
caggaggagctggagatggaagcaa

SEQ ID NO: 894066 - DNA, 25 bp, Mus musculus
caggaggagctggatggaagcaaaa

SEQ ID NO: 894067 - DNA, 25 bp, Mus musculus
caggaggaggagccagtgaagaagc

SEQ ID NO: 894068 - DNA, 25 bp, Mus musculus
caggaggaggaggcagtgaagaagc

SEQ ID NO: 894069 - DNA, 25 bp, Mus musculus
caggaggcaaagagaactctggttg

SEQ ID NO: 894070 - DNA, 25 bp, Mus musculus
caggaggcaaagtgaactctggttg

SEQ ID NO: 894071 - DNA, 25 bp, Mus musculus
caggaggcagaaaggatgagcgcag

SEQ ID NO: 894072 - DNA, 25 bp, Mus musculus
caggaggcagctcattcattcaaca

SEQ ID NO: 894073 - DNA, 25 bp, Mus musculus
caggaggcaggtcattcattcaaca

SEQ ID NO: 894074 - DNA, 25 bp, Mus musculus
caggaggcagtaaggatgagcgcag

SEQ ID NO: 894075 - DNA, 25 bp, Mus musculus
caggaggctgctggcattatgacgg

SEQ ID NO: 894076 - DNA, 25 bp, Mus musculus
caggaggctggacagtccttagcca

SEQ ID NO: 894077 - DNA, 25 bp, Mus musculus
caggaggctggagagtccttagcca

SEQ ID NO: 894078 - DNA, 25 bp, Mus musculus
caggaggctggtggcattatgacgg

SEQ ID NO: 894079 - DNA, 25 bp, Mus musculus
caggagggacagccatcaccccaat

SEQ ID NO: 894080 - DNA, 25 bp, Mus musculus
caggagggacaggcatcaccccaat

SEQ ID NO: 894081 - DNA, 25 bp, Mus musculus
caggagtataaggctcactttgttc

SEQ ID NO: 894082 - DNA, 25 bp, Mus musculus
caggagtatatggctcactttgttc

SEQ ID NO: 894083 - DNA, 25 bp, Mus musculus
caggagtgccaacatatcgatgagt

SEQ ID NO: 894084 - DNA, 25 bp, Mus musculus
caggagtgccaagatatcgatgagt

SEQ ID NO: 894085 - DNA, 25 bp, Mus musculus
caggagtggccacgtatggcgtaaa

SEQ ID NO: 894086 - DNA, 25 bp, Mus musculus
caggagtggccaggtatggcgtaaa

SEQ ID NO: 894087 - DNA, 25 bp, Mus musculus
caggagttggttcacgtggaacatc

SEQ ID NO: 894088 - DNA, 25 bp, Mus musculus
caggagttggttcactatcctgtgg

SEQ ID NO: 894089 - DNA, 25 bp, Mus musculus
caggagttggttcaggtggaacatc

SEQ ID NO: 894090 - DNA, 25 bp, Mus musculus
caggagttggttcagtatcctgtgg

SEQ ID NO: 894091 - DNA, 25 bp, Mus musculus
caggagtttccacacgttgaagctt

SEQ ID NO: 894092 - DNA, 25 bp, Mus musculus
caggagtttccacaggttgaagctt

SEQ ID NO: 894093 - DNA, 25 bp, Mus musculus
caggagtttctgctcctacagaacc

SEQ ID NO: 894094 - DNA, 25 bp, Mus musculus
caggagtttctggtcctacagaacc

SEQ ID NO: 894095 - DNA, 25 bp, Mus musculus
caggatacagctgatctggtactgc

SEQ ID NO: 894096 - DNA, 25 bp, Mus musculus
caggatacaggtgatctggtactgc

SEQ ID NO: 894097 - DNA, 25 bp, Mus musculus
caggatactatgaatataacaggca

SEQ ID NO: 894098 - DNA, 25 bp, Mus musculus
caggatactatgtatataacaggca

SEQ ID NO: 894099 - DNA, 25 bp, Mus musculus
caggatactggaccttgcctctcca

SEQ ID NO: 894100 - DNA, 25 bp, Mus musculus
caggatactggagcttgcctctcca

SEQ ID NO: 894101 - DNA, 25 bp, Mus musculus
caggatagagactaatgctcatact

SEQ ID NO: 894102 - DNA, 25 bp, Mus musculus
caggatagagtctaatgctcatact

SEQ ID NO: 894103 - DNA, 25 bp, Mus musculus
caggatagtgctgaagcggcatctg

SEQ ID NO: 894104 - DNA, 25 bp, Mus musculus
caggatagtgctgatgcggcatctg

SEQ ID NO: 894105 - DNA, 25 bp, Mus musculus
caggatatgacagaagtctgcgtgg

SEQ ID NO: 894106 - DNA, 25 bp, Mus musculus
caggatatgacagatgtctgcgtgg

SEQ ID NO: 894107 - DNA, 25 bp, Mus musculus
caggatatgtactcttcgtaccacc

SEQ ID NO: 894108 - DNA, 25 bp, Mus musculus
caggatatgttctcttcgtaccacc

SEQ ID NO: 894109 - DNA, 25 bp, Mus musculus
caggatcaaggactcctggggtctg

SEQ ID NO: 894110 - DNA, 25 bp, Mus musculus
caggatcaaggagtcctggggtctg

SEQ ID NO: 894111 - DNA, 25 bp, Mus musculus
caggatcagttaagagacttcagac

SEQ ID NO: 894112 - DNA, 25 bp, Mus musculus
caggatcagttaaggcagtaatgga

SEQ ID NO: 894113 - DNA, 25 bp, Mus musculus
caggatcagttaagtttttatttca

SEQ ID NO: 894114 - DNA, 25 bp, Mus musculus
caggatcagttatgagacttcagac

SEQ ID NO: 894115 - DNA, 25 bp, Mus musculus
caggatcagttatggcagtaatgga

SEQ ID NO: 894116 - DNA, 25 bp, Mus musculus
caggatcagttatgtttttatttca

SEQ ID NO: 894117 - DNA, 25 bp, Mus musculus
caggatcccagcgaaaagcccattg

SEQ ID NO: 894118 - DNA, 25 bp, Mus musculus
caggatcccagcgataagcccattg

SEQ ID NO: 894119 - DNA, 25 bp, Mus musculus
caggatccccagcctgcccttgggg

SEQ ID NO: 894120 - DNA, 25 bp, Mus musculus
caggatccccaggctgcccttgggg

SEQ ID NO: 894121 - DNA, 25 bp, Mus musculus
caggatgaaagacgagtagacatgg

SEQ ID NO: 894122 - DNA, 25 bp, Mus musculus
caggatgaaagacgtgtagacatgg

SEQ ID NO: 894123 - DNA, 25 bp, Mus musculus
caggatgaagcccacgctcatgcac

SEQ ID NO: 894124 - DNA, 25 bp, Mus musculus
caggatgaagccgacgctcatgcac

SEQ ID NO: 894125 - DNA, 25 bp, Mus musculus
caggatgattgacgatgcaattcga

SEQ ID NO: 894126 - DNA, 25 bp, Mus musculus
caggatgattgaggatgcaattcga

SEQ ID NO: 894127 - DNA, 25 bp, Mus musculus
caggatgcctcggccgtgttcacct

SEQ ID NO: 894128 - DNA, 25 bp, Mus musculus
caggatgcctcggcggtgttcacct

SEQ ID NO: 894129 - DNA, 25 bp, Mus musculus
caggatgctaaccactgctgcacta

SEQ ID NO: 894130 - DNA, 25 bp, Mus musculus
caggatgctaaccagtgctgcacta

SEQ ID NO: 894131 - DNA, 25 bp, Mus musculus
caggatgctgagcttggtgatggca

SEQ ID NO: 894132 - DNA, 25 bp, Mus musculus
caggatgctgaggttggtgatggca

SEQ ID NO: 894133 - DNA, 25 bp, Mus musculus
caggatggaacccggcgcagcgcgt

SEQ ID NO: 894134 - DNA, 25 bp, Mus musculus
caggatggaaccgggcgcagcgcgt

SEQ ID NO: 894135 - DNA, 25 bp, Mus musculus
caggatggaaggcaagcacttgaag

SEQ ID NO: 894136 - DNA, 25 bp, Mus musculus
caggatggaaggcatgcacttgaag

SEQ ID NO: 894137 - DNA, 25 bp, Mus musculus
caggatggagcagagagggccacct

SEQ ID NO: 894138 - DNA, 25 bp, Mus musculus
caggatggaggagagagggccacct

SEQ ID NO: 894139 - DNA, 25 bp, Mus musculus
caggatggccagacgtggggcctgt

SEQ ID NO: 894140 - DNA, 25 bp, Mus musculus
caggatggccagcgccccaatcctg

SEQ ID NO: 894141 - DNA, 25 bp, Mus musculus
caggatggccagggccccaatcctg

SEQ ID NO: 894142 - DNA, 25 bp, Mus musculus
caggatggccagtcgtggggcctgt

SEQ ID NO: 894143 - DNA, 25 bp, Mus musculus
caggatggcgaccatttccagagca

SEQ ID NO: 894144 - DNA, 25 bp, Mus musculus
caggatggcgacgatttccagagca

SEQ ID NO: 894145 - DNA, 25 bp, Mus musculus
caggatggtctccgacatcaacaat

SEQ ID NO: 894146 - DNA, 25 bp, Mus musculus
caggatggtctcggacatcaacaat

SEQ ID NO: 894147 - DNA, 25 bp, Mus musculus
caggatgtcgagctacggtcagaat

SEQ ID NO: 894148 - DNA, 25 bp, Mus musculus
caggatgtcgaggtacggtcagaat

SEQ ID NO: 894149 - DNA, 25 bp, Mus musculus
caggatgtctagaacctctaggaat

SEQ ID NO: 894150 - DNA, 25 bp, Mus musculus
caggatgtctagaagctctaggaat

SEQ ID NO: 894151 - DNA, 25 bp, Mus musculus
caggatgtgatgctgccctactttg

SEQ ID NO: 894152 - DNA, 25 bp, Mus musculus
caggatgtgatggtgccctactttg

SEQ ID NO: 894153 - DNA, 25 bp, Mus musculus
caggatgtgccgccctggacagaag

SEQ ID NO: 894154 - DNA, 25 bp, Mus musculus
caggatgtgccgccgtggacagaag

SEQ ID NO: 894155 - DNA, 25 bp, Mus musculus
caggatgtggcagactgtccccact

SEQ ID NO: 894156 - DNA, 25 bp, Mus musculus
caggatgtggcagagtgtccccact

SEQ ID NO: 894157 - DNA, 25 bp, Mus musculus
caggatgttgagctgtctcaaaagc

SEQ ID NO: 894158 - DNA, 25 bp, Mus musculus
caggatgttgaggtgtctcaaaagc

SEQ ID NO: 894159 - DNA, 25 bp, Mus musculus
caggattaaaaacgatactcactgt

SEQ ID NO: 894160 - DNA, 25 bp, Mus musculus
caggattaaaaaggatactcactgt

SEQ ID NO: 894161 - DNA, 25 bp, Mus musculus
caggattcaccttggtgaccagatc

SEQ ID NO: 894162 - DNA, 25 bp, Mus musculus
caggattcacgttggtgaccagatc

SEQ ID NO: 894163 - DNA, 25 bp, Mus musculus
caggattcagcccactaaacctcgg

SEQ ID NO: 894164 - DNA, 25 bp, Mus musculus
caggattcagctctgtttcctaggc

SEQ ID NO: 894165 - DNA, 25 bp, Mus musculus
caggattcaggccactaaacctcgg

SEQ ID NO: 894166 - DNA, 25 bp, Mus musculus
caggattcaggtctgtttcctaggc

SEQ ID NO: 894167 - DNA, 25 bp, Mus musculus
caggattccaacaacgcatttgtat

SEQ ID NO: 894168 - DNA, 25 bp, Mus musculus
caggattccaacaaggcatttgtat

SEQ ID NO: 894169 - DNA, 25 bp, Mus musculus
caggattccagccacaccagcggag

SEQ ID NO: 894170 - DNA, 25 bp, Mus musculus
caggattccagccagaccagcggag

SEQ ID NO: 894171 - DNA, 25 bp, Mus musculus
caggattcgcaacctgaccagtgca

SEQ ID NO: 894172 - DNA, 25 bp, Mus musculus
caggattcgcaagctgaccagtgca

SEQ ID NO: 894173 - DNA, 25 bp, Mus musculus
caggattgagctccagaaggatgca

SEQ ID NO: 894174 - DNA, 25 bp, Mus musculus
caggattgaggtccagaaggatgca

SEQ ID NO: 894175 - DNA, 25 bp, Mus musculus
caggatttggagactgtctccaagg

SEQ ID NO: 894176 - DNA, 25 bp, Mus musculus
caggatttggagtctgtctccaagg

SEQ ID NO: 894177 - DNA, 25 bp, Mus musculus
caggatttggggctgctgtaacaga

SEQ ID NO: 894178 - DNA, 25 bp, Mus musculus
caggatttgggggtgctgtaacaga

SEQ ID NO: 894179 - DNA, 25 bp, Mus musculus
caggattttgcccagccgtatggga

SEQ ID NO: 894180 - DNA, 25 bp, Mus musculus
caggattttggccagccgtatggga

SEQ ID NO: 894181 - DNA, 25 bp, Mus musculus
caggcaaaagtgtgcatgaactctt

SEQ ID NO: 894182 - DNA, 25 bp, Mus musculus
caggcaaaagtgtggatgaactctt

SEQ ID NO: 894183 - DNA, 25 bp, Mus musculus
caggcaagaacccgagacaatcagg

SEQ ID NO: 894184 - DNA, 25 bp, Mus musculus
caggcaagaaccggagacaatcagg

SEQ ID NO: 894185 - DNA, 25 bp, Mus musculus
caggcaatgacgaaataaccccttc

SEQ ID NO: 894186 - DNA, 25 bp, Mus musculus
caggcaatgacgtaataaccccttc

SEQ ID NO: 894187 - DNA, 25 bp, Mus musculus
caggcacaagccttgttggagacgg

SEQ ID NO: 894188 - DNA, 25 bp, Mus musculus
caggcacaaggcttgttggagacgg

SEQ ID NO: 894189 - DNA, 25 bp, Mus musculus
caggcacagcagcacttgattgtgg

SEQ ID NO: 894190 - DNA, 25 bp, Mus musculus
caggcacagcagcagttgattgtgg

SEQ ID NO: 894191 - DNA, 25 bp, Mus musculus
caggcacagtgtcacttcctgtcag

SEQ ID NO: 894192 - DNA, 25 bp, Mus musculus
caggcacagtgtcagttcctgtcag

SEQ ID NO: 894193 - DNA, 25 bp, Mus musculus
caggcaccagaaacctcatccagct

SEQ ID NO: 894194 - DNA, 25 bp, Mus musculus
caggcaccagagtgtccattgtcca

SEQ ID NO: 894195 - DNA, 25 bp, Mus musculus
caggcaccagccagtaagtgctccc

SEQ ID NO: 894196 - DNA, 25 bp, Mus musculus
caggcaccagctcctgtttattgct

SEQ ID NO: 894197 - DNA, 25 bp, Mus musculus
caggcaccagcttcctccaacaccg

SEQ ID NO: 894198 - DNA, 25 bp, Mus musculus
caggcaccagcttgctccaggacct

SEQ ID NO: 894199 - DNA, 25 bp, Mus musculus
caggcaccaggcagtaagtgctccc

SEQ ID NO: 894200 - DNA, 25 bp, Mus musculus
caggcaccaggtcctgtttattgct

SEQ ID NO: 894201 - DNA, 25 bp, Mus musculus
caggcaccaggttcctccaacaccg

SEQ ID NO: 894202 - DNA, 25 bp, Mus musculus
caggcaccaggttgctccaggacct

SEQ ID NO: 894203 - DNA, 25 bp, Mus musculus
caggcaccagtaacctcatccagct

SEQ ID NO: 894204 - DNA, 25 bp, Mus musculus
caggcaccagtgtgtccattgtcca

SEQ ID NO: 894205 - DNA, 25 bp, Mus musculus
caggcacccacagttttgctctgca

SEQ ID NO: 894206 - DNA, 25 bp, Mus musculus
caggcacccagagttttgctctgca

SEQ ID NO: 894207 - DNA, 25 bp, Mus musculus
caggcacccatgcctcaaactacca

SEQ ID NO: 894208 - DNA, 25 bp, Mus musculus
caggcacccatggctcaaactacca

SEQ ID NO: 894209 - DNA, 25 bp, Mus musculus
caggcacgagctgcaggtcctggtg

SEQ ID NO: 894210 - DNA, 25 bp, Mus musculus
caggcacgaggtgcaggtcctggtg

SEQ ID NO: 894211 - DNA, 25 bp, Mus musculus
caggcacggaatcgctattgtgaga

SEQ ID NO: 894212 - DNA, 25 bp, Mus musculus
caggcacggaatggctattgtgaga

SEQ ID NO: 894213 - DNA, 25 bp, Mus musculus
caggcagaagccgacagacttatta

SEQ ID NO: 894214 - DNA, 25 bp, Mus musculus
caggcagaagctgggaagtcatcaa

SEQ ID NO: 894215 - DNA, 25 bp, Mus musculus
caggcagaaggcaacgttcggctcc

SEQ ID NO: 894216 - DNA, 25 bp, Mus musculus
caggcagaaggcaaggttcggctcc

SEQ ID NO: 894217 - DNA, 25 bp, Mus musculus
caggcagaaggcgacagacttatta

SEQ ID NO: 894218 - DNA, 25 bp, Mus musculus
caggcagaaggtgggaagtcatcaa

SEQ ID NO: 894219 - DNA, 25 bp, Mus musculus
caggcagacccacgtttcagttctc

SEQ ID NO: 894220 - DNA, 25 bp, Mus musculus
caggcagacccaggtttcagttctc

SEQ ID NO: 894221 - DNA, 25 bp, Mus musculus
caggcagcacaggacattcatggcg

SEQ ID NO: 894222 - DNA, 25 bp, Mus musculus
caggcagcacagtggacattcatgg

SEQ ID NO: 894223 - DNA, 25 bp, Mus musculus
caggcagcactggacattcatggcg

SEQ ID NO: 894224 - DNA, 25 bp, Mus musculus
caggcagcactgtggacattcatgg

SEQ ID NO: 894225 - DNA, 25 bp, Mus musculus
caggcagcagtacccgaagctgctc

SEQ ID NO: 894226 - DNA, 25 bp, Mus musculus
caggcagcagtaccggaagctgctc

SEQ ID NO: 894227 - DNA, 25 bp, Mus musculus
caggcagcccagcgatgcagcgtcg

SEQ ID NO: 894228 - DNA, 25 bp, Mus musculus
caggcagcccagggatgcagcgtcg

SEQ ID NO: 894229 - DNA, 25 bp, Mus musculus
caggcagctaaactgtgttatattg

SEQ ID NO: 894230 - DNA, 25 bp, Mus musculus
caggcagctaaagtgtgttatattg

SEQ ID NO: 894231 - DNA, 25 bp, Mus musculus
caggcagctcagcaaaataaaaacc

SEQ ID NO: 894232 - DNA, 25 bp, Mus musculus
caggcagctcaggaaaataaaaacc

SEQ ID NO: 894233 - DNA, 25 bp, Mus musculus
caggcaggatttcacgcaattacct

SEQ ID NO: 894234 - DNA, 25 bp, Mus musculus
caggcaggatttcaggcaattacct

SEQ ID NO: 894235 - DNA, 25 bp, Mus musculus
caggcaggcgaccttcggacagtgt

SEQ ID NO: 894236 - DNA, 25 bp, Mus musculus
caggcaggcgtccttcggacagtgt

SEQ ID NO: 894237 - DNA, 25 bp, Mus musculus
caggcaggttcgaacatgtctatca

SEQ ID NO: 894238 - DNA, 25 bp, Mus musculus
caggcaggttcgaagatgtctatca

SEQ ID NO: 894239 - DNA, 25 bp, Mus musculus
caggcagtgaagcaccgtgcaggca

SEQ ID NO: 894240 - DNA, 25 bp, Mus musculus
caggcagtgaagccccttgctgctg

SEQ ID NO: 894241 - DNA, 25 bp, Mus musculus
caggcagtgaaggaccgtgcaggca

SEQ ID NO: 894242 - DNA, 25 bp, Mus musculus
caggcagtgaaggcccttgctgctg

SEQ ID NO: 894243 - DNA, 25 bp, Mus musculus
caggcagttcaacgcaataaaagcg

SEQ ID NO: 894244 - DNA, 25 bp, Mus musculus
caggcagttcaacggctaacttaaa

SEQ ID NO: 894245 - DNA, 25 bp, Mus musculus
caggcagttcaaggcaataaaagcg

SEQ ID NO: 894246 - DNA, 25 bp, Mus musculus
caggcagttcaagggctaacttaaa

SEQ ID NO: 894247 - DNA, 25 bp, Mus musculus
caggcatccaggctcatgttggtgc

SEQ ID NO: 894248 - DNA, 25 bp, Mus musculus
caggcatccagggtcatgttggtgc

SEQ ID NO: 894249 - DNA, 25 bp, Mus musculus
caggcatctgcacacgtggccccaa

SEQ ID NO: 894250 - DNA, 25 bp, Mus musculus
caggcatctgcacaggtggccccaa

SEQ ID NO: 894251 - DNA, 25 bp, Mus musculus
caggcatgaagccgtcccgctctgg

SEQ ID NO: 894252 - DNA, 25 bp, Mus musculus
caggcatgaagcggtcccgctctgg

SEQ ID NO: 894253 - DNA, 25 bp, Mus musculus
caggcatgacagcagctggagaagc

SEQ ID NO: 894254 - DNA, 25 bp, Mus musculus
caggcatgacaggagctggagaagc

SEQ ID NO: 894255 - DNA, 25 bp, Mus musculus
caggcatgcaagcacgcatcttcga

SEQ ID NO: 894256 - DNA, 25 bp, Mus musculus
caggcatgcaagcaggcatcttcga

SEQ ID NO: 894257 - DNA, 25 bp, Mus musculus
caggcatgccagcctatcaagtact

SEQ ID NO: 894258 - DNA, 25 bp, Mus musculus
caggcatgccaggctatcaagtact

SEQ ID NO: 894259 - DNA, 25 bp, Mus musculus
caggcatgcgagctctgctttgatc

SEQ ID NO: 894260 - DNA, 25 bp, Mus musculus
caggcatgcgaggtctgctttgatc

SEQ ID NO: 894261 - DNA, 25 bp, Mus musculus
caggcattcatgcgcaaagacgtgc

SEQ ID NO: 894262 - DNA, 25 bp, Mus musculus
caggcattcatgcgcatgcgttttg

SEQ ID NO: 894263 - DNA, 25 bp, Mus musculus
caggcattcatgcggaaagacgtgc

SEQ ID NO: 894264 - DNA, 25 bp, Mus musculus
caggcattcatgcggatgcgttttg

SEQ ID NO: 894265 - DNA, 25 bp, Mus musculus
caggccaaccagctcaccgtgggtg

SEQ ID NO: 894266 - DNA, 25 bp, Mus musculus
caggccaaccaggtcaccgtgggtg

SEQ ID NO: 894267 - DNA, 25 bp, Mus musculus
caggccaagaagctggccttacaaa

SEQ ID NO: 894268 - DNA, 25 bp, Mus musculus
caggccaagaaggtggccttacaaa

SEQ ID NO: 894269 - DNA, 25 bp, Mus musculus
caggccaagggcagcgtgtttagga

SEQ ID NO: 894270 - DNA, 25 bp, Mus musculus
caggccaagggcagggtgtttagga

SEQ ID NO: 894271 - DNA, 25 bp, Mus musculus
caggccaaggtgagagaacgatttc

SEQ ID NO: 894272 - DNA, 25 bp, Mus musculus
caggccaaggtgtgagaacgatttc

SEQ ID NO: 894273 - DNA, 25 bp, Mus musculus
caggccaagtctccaatcagaagag

SEQ ID NO: 894274 - DNA, 25 bp, Mus musculus
caggccaagtctgcaatcagaagag

SEQ ID NO: 894275 - DNA, 25 bp, Mus musculus
caggccacaacgtggcccaggagcg

SEQ ID NO: 894276 - DNA, 25 bp, Mus musculus
caggccacaaggtggcccaggagcg

SEQ ID NO: 894277 - DNA, 25 bp, Mus musculus
caggccacagcaaagcacagacaac

SEQ ID NO: 894278 - DNA, 25 bp, Mus musculus
caggccacaggaaagcacagacaac

SEQ ID NO: 894279 - DNA, 25 bp, Mus musculus
caggccacgaaaagaacacgagagc

SEQ ID NO: 894280 - DNA, 25 bp, Mus musculus
caggccacgaaatgaacacgagagc

SEQ ID NO: 894281 - DNA, 25 bp, Mus musculus
caggccactcagcatcggaacgtca

SEQ ID NO: 894282 - DNA, 25 bp, Mus musculus
caggccactcaggatcggaacgtca

SEQ ID NO: 894283 - DNA, 25 bp, Mus musculus
caggccagagcagacaggaggtgga

SEQ ID NO: 894284 - DNA, 25 bp, Mus musculus
caggccagagcagagaggaggtgga

SEQ ID NO: 894285 - DNA, 25 bp, Mus musculus
caggccagagccgacagagttctag

SEQ ID NO: 894286 - DNA, 25 bp, Mus musculus
caggccagaggcgacagagttctag

SEQ ID NO: 894287 - DNA, 25 bp, Mus musculus
caggccatcaagctgactcacaaag

SEQ ID NO: 894288 - DNA, 25 bp, Mus musculus
caggccatcaaggtgactcacaaag

SEQ ID NO: 894289 - DNA, 25 bp, Mus musculus
caggccatcctgcgttgctcttctg

SEQ ID NO: 894290 - DNA, 25 bp, Mus musculus
caggccatcctgggttgctcttctg

SEQ ID NO: 894291 - DNA, 25 bp, Mus musculus
caggccatcctgtcccacttttcca

SEQ ID NO: 894292 - DNA, 25 bp, Mus musculus
caggccatcctgtcgcacttttcca

SEQ ID NO: 894293 - DNA, 25 bp, Mus musculus
caggccatctcacctgatgaagagg

SEQ ID NO: 894294 - DNA, 25 bp, Mus musculus
caggccatctcagctgatgaagagg

SEQ ID NO: 894295 - DNA, 25 bp, Mus musculus
caggccatgaagaacatctttgatg

SEQ ID NO: 894296 - DNA, 25 bp, Mus musculus
caggccatgaagaagatctttgatg

SEQ ID NO: 894297 - DNA, 25 bp, Mus musculus
caggccatgctcaacacacccaaca

SEQ ID NO: 894298 - DNA, 25 bp, Mus musculus
caggccatgctcaagacacccaaca

SEQ ID NO: 894299 - DNA, 25 bp, Mus musculus
caggccatgttactccacgaccaca

SEQ ID NO: 894300 - DNA, 25 bp, Mus musculus
caggccatgttactgcacgaccaca

SEQ ID NO: 894301 - DNA, 25 bp, Mus musculus
caggcccaagcctccattgagggtg

SEQ ID NO: 894302 - DNA, 25 bp, Mus musculus
caggcccaagctctccatggtgggt

SEQ ID NO: 894303 - DNA, 25 bp, Mus musculus
caggcccaaggctccattgagggtg

SEQ ID NO: 894304 - DNA, 25 bp, Mus musculus
caggcccaaggtctccatggtgggt

SEQ ID NO: 894305 - DNA, 25 bp, Mus musculus
caggcccaggaacaaacatgtatca

SEQ ID NO: 894306 - DNA, 25 bp, Mus musculus
caggcccaggaacaagaatgtccct

SEQ ID NO: 894307 - DNA, 25 bp, Mus musculus
caggcccaggaagaaacatgtatca

SEQ ID NO: 894308 - DNA, 25 bp, Mus musculus
caggcccaggaagaagaatgtccct

SEQ ID NO: 894309 - DNA, 25 bp, Mus musculus
caggccccaccgcaactgtagcatc

SEQ ID NO: 894310 - DNA, 25 bp, Mus musculus
caggccccaccgcatctgtagcatc

SEQ ID NO: 894311 - DNA, 25 bp, Mus musculus
caggccccagctttggtggccccaa

SEQ ID NO: 894312 - DNA, 25 bp, Mus musculus
caggccccaggtttggtggccccaa

SEQ ID NO: 894313 - DNA, 25 bp, Mus musculus
caggccccagtgcgctctgtgtacc

SEQ ID NO: 894314 - DNA, 25 bp, Mus musculus
caggccccagtgggctctgtgtacc

SEQ ID NO: 894315 - DNA, 25 bp, Mus musculus
caggccgctcaacttcctggtatat

SEQ ID NO: 894316 - DNA, 25 bp, Mus musculus
caggccgctcaagttcctggtatat

SEQ ID NO: 894317 - DNA, 25 bp, Mus musculus
caggccgcttcaaacatgtcctgtt

SEQ ID NO: 894318 - DNA, 25 bp, Mus musculus
caggccgcttcaaagatgtcctgtt

SEQ ID NO: 894319 - DNA, 25 bp, Mus musculus
caggccgtcaagatcctccatgata

SEQ ID NO: 894320 - DNA, 25 bp, Mus musculus
caggccgtcaagttcctccatgata

SEQ ID NO: 894321 - DNA, 25 bp, Mus musculus
caggcctagctcaagtcttttattc

SEQ ID NO: 894322 - DNA, 25 bp, Mus musculus
caggcctagctctagtcttttattc

SEQ ID NO: 894323 - DNA, 25 bp, Mus musculus
caggcctatctaaacgacactcacc

SEQ ID NO: 894324 - DNA, 25 bp, Mus musculus
caggcctatctaaaggacactcacc

SEQ ID NO: 894325 - DNA, 25 bp, Mus musculus
caggcctcagccatctgttgcactg

SEQ ID NO: 894326 - DNA, 25 bp, Mus musculus
caggcctcaggcatctgttgcactg

SEQ ID NO: 894327 - DNA, 25 bp, Mus musculus
caggcctcatagccaccgtggtcac

SEQ ID NO: 894328 - DNA, 25 bp, Mus musculus
caggcctcataggcaccgtggtcac

SEQ ID NO: 894329 - DNA, 25 bp, Mus musculus
caggcctgccaccacgttacgtctg

SEQ ID NO: 894330 - DNA, 25 bp, Mus musculus
caggcctgccaccaggttacgtctg

SEQ ID NO: 894331 - DNA, 25 bp, Mus musculus
caggcctgcttacacgaagccgaga

SEQ ID NO: 894332 - DNA, 25 bp, Mus musculus
caggcctgcttacaggaagccgaga

SEQ ID NO: 894333 - DNA, 25 bp, Mus musculus
caggccttggcctggagcacccgga

SEQ ID NO: 894334 - DNA, 25 bp, Mus musculus
caggccttgggctggagcacccgga

SEQ ID NO: 894335 - DNA, 25 bp, Mus musculus
caggcctttcagagacgaagagagt

SEQ ID NO: 894336 - DNA, 25 bp, Mus musculus
caggcctttcagtgacgaagagagt

SEQ ID NO: 894337 - DNA, 25 bp, Mus musculus
caggcgccagggcaaggaggtcaga

SEQ ID NO: 894338 - DNA, 25 bp, Mus musculus
caggcgccagggcatggaggtcaga

SEQ ID NO: 894339 - DNA, 25 bp, Mus musculus
caggcgccattgctcctgtgatggc

SEQ ID NO: 894340 - DNA, 25 bp, Mus musculus
caggcgccattgctgctgtgatggc

SEQ ID NO: 894341 - DNA, 25 bp, Mus musculus
caggcgcgagcttctgcagaccccg

SEQ ID NO: 894342 - DNA, 25 bp, Mus musculus
caggcgcgaggacctccagaaatct

SEQ ID NO: 894343 - DNA, 25 bp, Mus musculus
caggcgcgaggagctccagaaatct

SEQ ID NO: 894344 - DNA, 25 bp, Mus musculus
caggcgcgaggttctgcagaccccg

SEQ ID NO: 894345 - DNA, 25 bp, Mus musculus
caggcgctctctgacgaaatcaaga

SEQ ID NO: 894346 - DNA, 25 bp, Mus musculus
caggcgctctctgaggaaatcaaga

SEQ ID NO: 894347 - DNA, 25 bp, Mus musculus
caggcgctgtacgacgctccagcat

SEQ ID NO: 894348 - DNA, 25 bp, Mus musculus
caggcgctgtacgaggctccagcat

SEQ ID NO: 894349 - DNA, 25 bp, Mus musculus
caggcgcttgcacaaggggcgccta

SEQ ID NO: 894350 - DNA, 25 bp, Mus musculus
caggcgcttgcacgcatgacgagtg

SEQ ID NO: 894351 - DNA, 25 bp, Mus musculus
caggcgcttgcagaaggggcgccta

SEQ ID NO: 894352 - DNA, 25 bp, Mus musculus
caggcgcttgcaggcatgacgagtg

SEQ ID NO: 894353 - DNA, 25 bp, Mus musculus
caggcggaaactatccattatgatg

SEQ ID NO: 894354 - DNA, 25 bp, Mus musculus
caggcggaaagtatccattatgatg

SEQ ID NO: 894355 - DNA, 25 bp, Mus musculus
caggcggagaagaactctcaaaaag

SEQ ID NO: 894356 - DNA, 25 bp, Mus musculus
caggcggagaagtactctcaaaaag

SEQ ID NO: 894357 - DNA, 25 bp, Mus musculus
caggcggcatctctcgggcccacat

SEQ ID NO: 894358 - DNA, 25 bp, Mus musculus
caggcggcatctctggggcccacat

SEQ ID NO: 894359 - DNA, 25 bp, Mus musculus
caggcgggatagctctggagcctgg

SEQ ID NO: 894360 - DNA, 25 bp, Mus musculus
caggcgggataggtctggagcctgg

SEQ ID NO: 894361 - DNA, 25 bp, Mus musculus
caggcgtcagaaagaaaaatgactt

SEQ ID NO: 894362 - DNA, 25 bp, Mus musculus
caggcgtcagtaagaaaaatgactt

SEQ ID NO: 894363 - DNA, 25 bp, Mus musculus
caggcgtccaagcccatcagctcca

SEQ ID NO: 894364 - DNA, 25 bp, Mus musculus
caggcgtccaagctcccagcagcaa

SEQ ID NO: 894365 - DNA, 25 bp, Mus musculus
caggcgtccaaggccatcagctcca

SEQ ID NO: 894366 - DNA, 25 bp, Mus musculus
caggcgtccaaggtcccagcagcaa

SEQ ID NO: 894367 - DNA, 25 bp, Mus musculus
caggcgtgggcccgcagcctcgtgt

SEQ ID NO: 894368 - DNA, 25 bp, Mus musculus
caggcgtggggccgcagcctcgtgt

SEQ ID NO: 894369 - DNA, 25 bp, Mus musculus
caggctacaaagaacccaagagatg

SEQ ID NO: 894370 - DNA, 25 bp, Mus musculus
caggctacaaagtacccaagagatg

SEQ ID NO: 894371 - DNA, 25 bp, Mus musculus
caggctacacagcaagcatgtgtaa

SEQ ID NO: 894372 - DNA, 25 bp, Mus musculus
caggctacacaggaagcatgtgtaa

SEQ ID NO: 894373 - DNA, 25 bp, Mus musculus
caggctacatcgatttgttttacaa

SEQ ID NO: 894374 - DNA, 25 bp, Mus musculus
caggctacatcgttttgttttacaa

SEQ ID NO: 894375 - DNA, 25 bp, Mus musculus
caggctacatggcgttgacctgtag

SEQ ID NO: 894376 - DNA, 25 bp, Mus musculus
caggctacatggggttgacctgtag

SEQ ID NO: 894377 - DNA, 25 bp, Mus musculus
caggctagagatcctgcagcttctg

SEQ ID NO: 894378 - DNA, 25 bp, Mus musculus
caggctagagttcctgcagcttctg

SEQ ID NO: 894379 - DNA, 25 bp, Mus musculus
caggctatcctgagcttgcaggtca

SEQ ID NO: 894380 - DNA, 25 bp, Mus musculus
caggctatcctgaggttgcaggtca

SEQ ID NO: 894381 - DNA, 25 bp, Mus musculus
caggctcacactctgctcctggctc

SEQ ID NO: 894382 - DNA, 25 bp, Mus musculus
caggctcacagtctgctcctggctc

SEQ ID NO: 894383 - DNA, 25 bp, Mus musculus
caggctcagctgctgcagttcgtac

SEQ ID NO: 894384 - DNA, 25 bp, Mus musculus
caggctcagctggtgcagttcgtac

SEQ ID NO: 894385 - DNA, 25 bp, Mus musculus
caggctcaggccaccccacatcatg

SEQ ID NO: 894386 - DNA, 25 bp, Mus musculus
caggctcaggctaccgagtctattg

SEQ ID NO: 894387 - DNA, 25 bp, Mus musculus
caggctcagggcaccccacatcatg

SEQ ID NO: 894388 - DNA, 25 bp, Mus musculus
caggctcagggtaccgagtctattg

SEQ ID NO: 894389 - DNA, 25 bp, Mus musculus
caggctccagatcatgagaagctgt

SEQ ID NO: 894390 - DNA, 25 bp, Mus musculus
caggctccagatcctgtggccagcg

SEQ ID NO: 894391 - DNA, 25 bp, Mus musculus
caggctccagatgatgagaagctgt

SEQ ID NO: 894392 - DNA, 25 bp, Mus musculus
caggctccagatgctgtggccagcg

SEQ ID NO: 894393 - DNA, 25 bp, Mus musculus
caggctccagcctgttggaaagcct

SEQ ID NO: 894394 - DNA, 25 bp, Mus musculus
caggctccaggctgttggaaagcct

SEQ ID NO: 894395 - DNA, 25 bp, Mus musculus
caggctcctgagcgcagccttgggt

SEQ ID NO: 894396 - DNA, 25 bp, Mus musculus
caggctcctgcccaggagcaagacc

SEQ ID NO: 894397 - DNA, 25 bp, Mus musculus
caggctcctggccaggagcaagacc

SEQ ID NO: 894398 - DNA, 25 bp, Mus musculus
caggctcctgtgcgcagccttgggt

SEQ ID NO: 894399 - DNA, 25 bp, Mus musculus
caggctctcattgacgcttatgtaa

SEQ ID NO: 894400 - DNA, 25 bp, Mus musculus
caggctctcattgaggcttatgtaa

SEQ ID NO: 894401 - DNA, 25 bp, Mus musculus
caggctctgcagatggagagcaaag

SEQ ID NO: 894402 - DNA, 25 bp, Mus musculus
caggctctgcagttggagagcaaag

SEQ ID NO: 894403 - DNA, 25 bp, Mus musculus
caggctctggcagttggaaccctgt

SEQ ID NO: 894404 - DNA, 25 bp, Mus musculus
caggctctgggagttggaaccctgt

SEQ ID NO: 894405 - DNA, 25 bp, Mus musculus
caggctctttcacccgtggcccact

SEQ ID NO: 894406 - DNA, 25 bp, Mus musculus
caggctctttcagccgtggcccact

SEQ ID NO: 894407 - DNA, 25 bp, Mus musculus
caggctgaatctgagaatagccaag

SEQ ID NO: 894408 - DNA, 25 bp, Mus musculus
caggctgaatgtgagaatagccaag

SEQ ID NO: 894409 - DNA, 25 bp, Mus musculus
caggctgacaagccccttttagcta

SEQ ID NO: 894410 - DNA, 25 bp, Mus musculus
caggctgacaaggcccttttagcta

SEQ ID NO: 894411 - DNA, 25 bp, Mus musculus
caggctgagaagaactctcagaagg

SEQ ID NO: 894412 - DNA, 25 bp, Mus musculus
caggctgagaagtactctcagaagg

SEQ ID NO: 894413 - DNA, 25 bp, Mus musculus
caggctgagcagaacggccttcttg

SEQ ID NO: 894414 - DNA, 25 bp, Mus musculus
caggctgagcagaagggccttcttg

SEQ ID NO: 894415 - DNA, 25 bp, Mus musculus
caggctgcaaagacctcttctccac

SEQ ID NO: 894416 - DNA, 25 bp, Mus musculus
caggctgcaaagtcctcttctccac

SEQ ID NO: 894417 - DNA, 25 bp, Mus musculus
caggctgcagctaactagttctccc

SEQ ID NO: 894418 - DNA, 25 bp, Mus musculus
caggctgcaggtaactagttctccc

SEQ ID NO: 894419 - DNA, 25 bp, Mus musculus
caggctgctcagctcggcctgctga

SEQ ID NO: 894420 - DNA, 25 bp, Mus musculus
caggctgctcaggtcggcctgctga

SEQ ID NO: 894421 - DNA, 25 bp, Mus musculus
caggctggagctctttgcaagagaa

SEQ ID NO: 894422 - DNA, 25 bp, Mus musculus
caggctggaggtctttgcaagagaa

SEQ ID NO: 894423 - DNA, 25 bp, Mus musculus
caggctggcaagctcaaacctgcga

SEQ ID NO: 894424 - DNA, 25 bp, Mus musculus
caggctggcaaggtcaaacctgcga

SEQ ID NO: 894425 - DNA, 25 bp, Mus musculus
caggctggcaggaaccacacagagc

SEQ ID NO: 894426 - DNA, 25 bp, Mus musculus
caggctggcaggagctcaccgagtc

SEQ ID NO: 894427 - DNA, 25 bp, Mus musculus
caggctggcaggtaccacacagagc

SEQ ID NO: 894428 - DNA, 25 bp, Mus musculus
caggctggcaggtgctcaccgagtc

SEQ ID NO: 894429 - DNA, 25 bp, Mus musculus
caggctggctcagacgtgtctgcct

SEQ ID NO: 894430 - DNA, 25 bp, Mus musculus
caggctggctcagaggtgtctgcct

SEQ ID NO: 894431 - DNA, 25 bp, Mus musculus
caggctgtatggctctgacagaagt

SEQ ID NO: 894432 - DNA, 25 bp, Mus musculus
caggctgtatgggtctgacagaagt

SEQ ID NO: 894433 - DNA, 25 bp, Mus musculus
caggctgtcatgccaggcactgggg

SEQ ID NO: 894434 - DNA, 25 bp, Mus musculus
caggctgtcatgcgcactggggagc

SEQ ID NO: 894435 - DNA, 25 bp, Mus musculus
caggctgtcatggcaggcactgggg

SEQ ID NO: 894436 - DNA, 25 bp, Mus musculus
caggctgtcatgggcactggggagc

SEQ ID NO: 894437 - DNA, 25 bp, Mus musculus
caggctgtgaatgaaataatagcta

SEQ ID NO: 894438 - DNA, 25 bp, Mus musculus
caggctgtgaatgatataatagcta

SEQ ID NO: 894439 - DNA, 25 bp, Mus musculus
caggctgttcagaaggctgtgggct

SEQ ID NO: 894440 - DNA, 25 bp, Mus musculus
caggctgttcagctcctgctctccc

SEQ ID NO: 894441 - DNA, 25 bp, Mus musculus
caggctgttcaggtcctgctctccc

SEQ ID NO: 894442 - DNA, 25 bp, Mus musculus
caggctgttcagtaggctgtgggct

SEQ ID NO: 894443 - DNA, 25 bp, Mus musculus
caggcttaatatcagaaaggaacat

SEQ ID NO: 894444 - DNA, 25 bp, Mus musculus
caggcttaatatgagaaaggaacat

SEQ ID NO: 894445 - DNA, 25 bp, Mus musculus
caggcttcaccccacgtgaacacct

SEQ ID NO: 894446 - DNA, 25 bp, Mus musculus
caggcttcaccccacgtttgtatgg

SEQ ID NO: 894447 - DNA, 25 bp, Mus musculus
caggcttcaccccaggtgaacacct

SEQ ID NO: 894448 - DNA, 25 bp, Mus musculus
caggcttcaccccaggtttgtatgg

SEQ ID NO: 894449 - DNA, 25 bp, Mus musculus
caggcttgtgattctatctttcctg

SEQ ID NO: 894450 - DNA, 25 bp, Mus musculus
caggcttgtgtttctatctttcctg

SEQ ID NO: 894451 - DNA, 25 bp, Mus musculus
cagggaaaactgtccggccaggtat

SEQ ID NO: 894452 - DNA, 25 bp, Mus musculus
cagggaaaactgtcgggccaggtat

SEQ ID NO: 894453 - DNA, 25 bp, Mus musculus
cagggaaaagcaacaccatggacgc

SEQ ID NO: 894454 - DNA, 25 bp, Mus musculus
cagggaaaagcacagagctgatgag

SEQ ID NO: 894455 - DNA, 25 bp, Mus musculus
cagggaaaaggaacaccatggacgc

SEQ ID NO: 894456 - DNA, 25 bp, Mus musculus
cagggaaaaggacagagctgatgag

SEQ ID NO: 894457 - DNA, 25 bp, Mus musculus
cagggaaagcagatgatgctgcagc

SEQ ID NO: 894458 - DNA, 25 bp, Mus musculus
cagggaaagcagcttcgacttcatc

SEQ ID NO: 894459 - DNA, 25 bp, Mus musculus
cagggaaagcaggttcgacttcatc

SEQ ID NO: 894460 - DNA, 25 bp, Mus musculus
cagggaaagcagttgatgctgcagc

SEQ ID NO: 894461 - DNA, 25 bp, Mus musculus
cagggacacatgcacaaaagtaaag

SEQ ID NO: 894462 - DNA, 25 bp, Mus musculus
cagggacacatgcacctggtgaatg

SEQ ID NO: 894463 - DNA, 25 bp, Mus musculus
cagggacacatgcacgcgcatacct

SEQ ID NO: 894464 - DNA, 25 bp, Mus musculus
cagggacacatgcagaaaagtaaag

SEQ ID NO: 894465 - DNA, 25 bp, Mus musculus
cagggacacatgcagctggtgaatg

SEQ ID NO: 894466 - DNA, 25 bp, Mus musculus
cagggacacatgcaggcgcatacct

SEQ ID NO: 894467 - DNA, 25 bp, Mus musculus
cagggacagcagcacgttcttcgtg

SEQ ID NO: 894468 - DNA, 25 bp, Mus musculus
cagggacagcagcaggttcttcgtg

SEQ ID NO: 894469 - DNA, 25 bp, Mus musculus
cagggaccagtgattgacaggcgct

SEQ ID NO: 894470 - DNA, 25 bp, Mus musculus
cagggaccagtgtttgacaggcgct

SEQ ID NO: 894471 - DNA, 25 bp, Mus musculus
cagggacgagattgaagaagaagca

SEQ ID NO: 894472 - DNA, 25 bp, Mus musculus
cagggacgagtttgaagaagaagca

SEQ ID NO: 894473 - DNA, 25 bp, Mus musculus
cagggactcagacggcctagatgga

SEQ ID NO: 894474 - DNA, 25 bp, Mus musculus
cagggactcagagggcctagatgga

SEQ ID NO: 894475 - DNA, 25 bp, Mus musculus
cagggactgggtcgacttggcttgg

SEQ ID NO: 894476 - DNA, 25 bp, Mus musculus
cagggactgggtggacttggcttgg

SEQ ID NO: 894477 - DNA, 25 bp, Mus musculus
cagggacttcagctttgaaggacag

SEQ ID NO: 894478 - DNA, 25 bp, Mus musculus
cagggacttcaggtttgaaggacag

SEQ ID NO: 894479 - DNA, 25 bp, Mus musculus
cagggagaagcaacttacaaagagt

SEQ ID NO: 894480 - DNA, 25 bp, Mus musculus
cagggagaagcatgtgctgctgggc

SEQ ID NO: 894481 - DNA, 25 bp, Mus musculus
cagggagaaggaacttacaaagagt

SEQ ID NO: 894482 - DNA, 25 bp, Mus musculus
cagggagaaggatgtgctgctgggc

SEQ ID NO: 894483 - DNA, 25 bp, Mus musculus
cagggagacacacacagacagcatc

SEQ ID NO: 894484 - DNA, 25 bp, Mus musculus
cagggagacagacacagacagcatc

SEQ ID NO: 894485 - DNA, 25 bp, Mus musculus
cagggagacgaaggaggcgttcttc

SEQ ID NO: 894486 - DNA, 25 bp, Mus musculus
cagggagacgcacacgcatatctgc

SEQ ID NO: 894487 - DNA, 25 bp, Mus musculus
cagggagacgcacaggcatatctgc

SEQ ID NO: 894488 - DNA, 25 bp, Mus musculus
cagggagacgtaggaggcgttcttc

SEQ ID NO: 894489 - DNA, 25 bp, Mus musculus
cagggagagcgacaagaattttatt

SEQ ID NO: 894490 - DNA, 25 bp, Mus musculus
cagggagagcgagaagaattttatt

SEQ ID NO: 894491 - DNA, 25 bp, Mus musculus
cagggagaggccaaccacctgctca

SEQ ID NO: 894492 - DNA, 25 bp, Mus musculus
cagggagaggccaagcacctgctca

SEQ ID NO: 894493 - DNA, 25 bp, Mus musculus
cagggagatctcaacttcccagtgg

SEQ ID NO: 894494 - DNA, 25 bp, Mus musculus
cagggagatctcaagttcccagtgg

SEQ ID NO: 894495 - DNA, 25 bp, Mus musculus
cagggagcacagaacctttgacatg

SEQ ID NO: 894496 - DNA, 25 bp, Mus musculus
cagggagcacagctcatcctgtgct

SEQ ID NO: 894497 - DNA, 25 bp, Mus musculus
cagggagcacaggtcatcctgtgct

SEQ ID NO: 894498 - DNA, 25 bp, Mus musculus
cagggagcacagtacctttgacatg

SEQ ID NO: 894499 - DNA, 25 bp, Mus musculus
cagggagcacctcaattctgatggc

SEQ ID NO: 894500 - DNA, 25 bp, Mus musculus
cagggagcacctgaattctgatggc

SEQ ID NO: 894501 - DNA, 25 bp, Mus musculus
cagggagccagcttcgtctgacaga

SEQ ID NO: 894502 - DNA, 25 bp, Mus musculus
cagggagccagcttggtctgacaga

SEQ ID NO: 894503 - DNA, 25 bp, Mus musculus
cagggagctggagacgctgccttgg

SEQ ID NO: 894504 - DNA, 25 bp, Mus musculus
cagggagctggagaggctgccttgg

SEQ ID NO: 894505 - DNA, 25 bp, Mus musculus
cagggaggagattttacatctccgg

SEQ ID NO: 894506 - DNA, 25 bp, Mus musculus
cagggaggagtttttacatctccgg

SEQ ID NO: 894507 - DNA, 25 bp, Mus musculus
cagggagtaaagcgacatctctaca

SEQ ID NO: 894508 - DNA, 25 bp, Mus musculus
cagggagtaaagggacatctctaca

SEQ ID NO: 894509 - DNA, 25 bp, Mus musculus
cagggatcagatgggactgagtacg

SEQ ID NO: 894510 - DNA, 25 bp, Mus musculus
cagggatcagttgggactgagtacg

SEQ ID NO: 894511 - DNA, 25 bp, Mus musculus
cagggatctgcctgccaggaactgt

SEQ ID NO: 894512 - DNA, 25 bp, Mus musculus
cagggatctggctgccaggaactgt

SEQ ID NO: 894513 - DNA, 25 bp, Mus musculus
cagggattcatgctgtattttcatc

SEQ ID NO: 894514 - DNA, 25 bp, Mus musculus
cagggattcatggtgtattttcatc

SEQ ID NO: 894515 - DNA, 25 bp, Mus musculus
cagggatttgaaacacgtttgtgtc

SEQ ID NO: 894516 - DNA, 25 bp, Mus musculus
cagggatttgaatcacgtttgtgtc

SEQ ID NO: 894517 - DNA, 25 bp, Mus musculus
cagggcaaagactggtcttacaccc

SEQ ID NO: 894518 - DNA, 25 bp, Mus musculus
cagggcaaagcgaagtttgccatcc

SEQ ID NO: 894519 - DNA, 25 bp, Mus musculus
cagggcaaagggaagtttgccatcc

SEQ ID NO: 894520 - DNA, 25 bp, Mus musculus
cagggcaaagtctggtcttacaccc

SEQ ID NO: 894521 - DNA, 25 bp, Mus musculus
cagggcaagaagcatcctcctcctt

SEQ ID NO: 894522 - DNA, 25 bp, Mus musculus
cagggcaagaagctgggaatcctag

SEQ ID NO: 894523 - DNA, 25 bp, Mus musculus
cagggcaagaaggatcctcctcctt

SEQ ID NO: 894524 - DNA, 25 bp, Mus musculus
cagggcaagaaggtgggaatcctag

SEQ ID NO: 894525 - DNA, 25 bp, Mus musculus
cagggcacaggcatcgtggctgctt

SEQ ID NO: 894526 - DNA, 25 bp, Mus musculus
cagggcacaggcatggtggctgctt

SEQ ID NO: 894527 - DNA, 25 bp, Mus musculus
cagggcaccaagatctccagccaac

SEQ ID NO: 894528 - DNA, 25 bp, Mus musculus
cagggcaccaagcctgctttggcag

SEQ ID NO: 894529 - DNA, 25 bp, Mus musculus
cagggcaccaaggctgctttggcag

SEQ ID NO: 894530 - DNA, 25 bp, Mus musculus
cagggcaccaagttctccagccaac

SEQ ID NO: 894531 - DNA, 25 bp, Mus musculus
cagggcagaagccacgccctgacct

SEQ ID NO: 894532 - DNA, 25 bp, Mus musculus
cagggcagaagccaggccctgacct

SEQ ID NO: 894533 - DNA, 25 bp, Mus musculus
cagggcagagccaaccacttacgcc

SEQ ID NO: 894534 - DNA, 25 bp, Mus musculus
cagggcagagccaagcacttacgcc

SEQ ID NO: 894535 - DNA, 25 bp, Mus musculus
cagggcagctagctcgatcaccgac

SEQ ID NO: 894536 - DNA, 25 bp, Mus musculus
cagggcagctagctggatcaccgac

SEQ ID NO: 894537 - DNA, 25 bp, Mus musculus
cagggcatcaagaagtcaacaaaag

SEQ ID NO: 894538 - DNA, 25 bp, Mus musculus
cagggcatcaagaattggctggatc

SEQ ID NO: 894539 - DNA, 25 bp, Mus musculus
cagggcatcaagtagtcaacaaaag

SEQ ID NO: 894540 - DNA, 25 bp, Mus musculus
cagggcatcaagtattggctggatc

SEQ ID NO: 894541 - DNA, 25 bp, Mus musculus
cagggccaaaaaagtgcggaatgat

SEQ ID NO: 894542 - DNA, 25 bp, Mus musculus
cagggccaaaaatgtgcggaatgat

SEQ ID NO: 894543 - DNA, 25 bp, Mus musculus
cagggccacactcgtgctgtgacat

SEQ ID NO: 894544 - DNA, 25 bp, Mus musculus
cagggccacactggtgctgtgacat

SEQ ID NO: 894545 - DNA, 25 bp, Mus musculus
cagggccagaagcagctcccagcga

SEQ ID NO: 894546 - DNA, 25 bp, Mus musculus
cagggccagaagctgatggtgcagg

SEQ ID NO: 894547 - DNA, 25 bp, Mus musculus
cagggccagaaggagctcccagcga

SEQ ID NO: 894548 - DNA, 25 bp, Mus musculus
cagggccagaaggtgatggtgcagg

SEQ ID NO: 894549 - DNA, 25 bp, Mus musculus
cagggccagcagcgtctcctgcaag

SEQ ID NO: 894550 - DNA, 25 bp, Mus musculus
cagggccagcagggtctcctgcaag

SEQ ID NO: 894551 - DNA, 25 bp, Mus musculus
cagggcccagcaattgcattgggca

SEQ ID NO: 894552 - DNA, 25 bp, Mus musculus
cagggcccaggaattgcattgggca

SEQ ID NO: 894553 - DNA, 25 bp, Mus musculus
cagggccctcagcaacaatggccca

SEQ ID NO: 894554 - DNA, 25 bp, Mus musculus
cagggccctcaggaacaatggccca

SEQ ID NO: 894555 - DNA, 25 bp, Mus musculus
cagggccctccgcgcagagcgccga

SEQ ID NO: 894556 - DNA, 25 bp, Mus musculus
cagggccctccgggcagagcgccga

SEQ ID NO: 894557 - DNA, 25 bp, Mus musculus
cagggccgcaagctcctggagctcc

SEQ ID NO: 894558 - DNA, 25 bp, Mus musculus
cagggccgcaaggtcctggagctcc

SEQ ID NO: 894559 - DNA, 25 bp, Mus musculus
cagggcctggagatggatccagaga

SEQ ID NO: 894560 - DNA, 25 bp, Mus musculus
cagggcctggagttggatccagaga

SEQ ID NO: 894561 - DNA, 25 bp, Mus musculus
cagggcgaagcgactgaagcccatg

SEQ ID NO: 894562 - DNA, 25 bp, Mus musculus
cagggcgaagggactgaagcccatg

SEQ ID NO: 894563 - DNA, 25 bp, Mus musculus
cagggctatattcacggctacaaca

SEQ ID NO: 894564 - DNA, 25 bp, Mus musculus
cagggctatattcacgtgacagact

SEQ ID NO: 894565 - DNA, 25 bp, Mus musculus
cagggctatattcagggctacaaca

SEQ ID NO: 894566 - DNA, 25 bp, Mus musculus
cagggctatattcaggtgacagact

SEQ ID NO: 894567 - DNA, 25 bp, Mus musculus
cagggctccttgcacgatatcttta

SEQ ID NO: 894568 - DNA, 25 bp, Mus musculus
cagggctccttgcaggatatcttta

SEQ ID NO: 894569 - DNA, 25 bp, Mus musculus
cagggctctccgaacctagctagca

SEQ ID NO: 894570 - DNA, 25 bp, Mus musculus
cagggctctccgagaccgaagcccc

SEQ ID NO: 894571 - DNA, 25 bp, Mus musculus
cagggctctccgccgcatctcccaa

SEQ ID NO: 894572 - DNA, 25 bp, Mus musculus
cagggctctccggcgcatctcccaa

SEQ ID NO: 894573 - DNA, 25 bp, Mus musculus
cagggctctccgtacctagctagca

SEQ ID NO: 894574 - DNA, 25 bp, Mus musculus
cagggctctccgtgaccgaagcccc

SEQ ID NO: 894575 - DNA, 25 bp, Mus musculus
cagggctgagccttgttccccctgt

SEQ ID NO: 894576 - DNA, 25 bp, Mus musculus
cagggctgaggcttgttccccctgt

SEQ ID NO: 894577 - DNA, 25 bp, Mus musculus
cagggctgtggacgtgatgcctaag

SEQ ID NO: 894578 - DNA, 25 bp, Mus musculus
cagggctgtggaggtgatgcctaag

SEQ ID NO: 894579 - DNA, 25 bp, Mus musculus
cagggcttaccacgtgtccctggaa

SEQ ID NO: 894580 - DNA, 25 bp, Mus musculus
cagggcttaccaggtgtccctggaa

SEQ ID NO: 894581 - DNA, 25 bp, Mus musculus
cagggcttgctgatctcctcttgcc

SEQ ID NO: 894582 - DNA, 25 bp, Mus musculus
cagggcttgctgttctcctcttgcc

SEQ ID NO: 894583 - DNA, 25 bp, Mus musculus
cagggctttctggacggagttggtg

SEQ ID NO: 894584 - DNA, 25 bp, Mus musculus
cagggctttctggagggagttggtg

SEQ ID NO: 894585 - DNA, 25 bp, Mus musculus
caggggaaacagaggagcgagttgt

SEQ ID NO: 894586 - DNA, 25 bp, Mus musculus
caggggaaacagtggagcgagttgt

SEQ ID NO: 894587 - DNA, 25 bp, Mus musculus
caggggaagactatcctagtacagc

SEQ ID NO: 894588 - DNA, 25 bp, Mus musculus
caggggaagactttcctagtacagc

SEQ ID NO: 894589 - DNA, 25 bp, Mus musculus
caggggaccaggaaatcacccctga

SEQ ID NO: 894590 - DNA, 25 bp, Mus musculus
caggggaccaggtaatcacccctga

SEQ ID NO: 894591 - DNA, 25 bp, Mus musculus
caggggaggcagctatggatgtatt

SEQ ID NO: 894592 - DNA, 25 bp, Mus musculus
caggggaggcaggtatggatgtatt

SEQ ID NO: 894593 - DNA, 25 bp, Mus musculus
caggggattgataatgagaagatct

SEQ ID NO: 894594 - DNA, 25 bp, Mus musculus
caggggattgattatgagaagatct

SEQ ID NO: 894595 - DNA, 25 bp, Mus musculus
caggggccagcagctgaagttgctt

SEQ ID NO: 894596 - DNA, 25 bp, Mus musculus
caggggccagctccaggtcacagga

SEQ ID NO: 894597 - DNA, 25 bp, Mus musculus
caggggccagctcctggtcacagga

SEQ ID NO: 894598 - DNA, 25 bp, Mus musculus
caggggccaggagctgaagttgctt

SEQ ID NO: 894599 - DNA, 25 bp, Mus musculus
caggggcctcagatcgaccaaaagc

SEQ ID NO: 894600 - DNA, 25 bp, Mus musculus
caggggcctcagctggatgaaactc

SEQ ID NO: 894601 - DNA, 25 bp, Mus musculus
caggggcctcaggtggatgaaactc

SEQ ID NO: 894602 - DNA, 25 bp, Mus musculus
caggggcctcagttcgaccaaaagc

SEQ ID NO: 894603 - DNA, 25 bp, Mus musculus
caggggccttccaggcagtagaggc

SEQ ID NO: 894604 - DNA, 25 bp, Mus musculus
caggggccttcctggcagtagaggc

SEQ ID NO: 894605 - DNA, 25 bp, Mus musculus
caggggctcaagccagacacgctga

SEQ ID NO: 894606 - DNA, 25 bp, Mus musculus
caggggctcaaggcagacacgctga

SEQ ID NO: 894607 - DNA, 25 bp, Mus musculus
caggggctgcagcgggcacagcatg

SEQ ID NO: 894608 - DNA, 25 bp, Mus musculus
caggggctgcagggggcacagcatg

SEQ ID NO: 894609 - DNA, 25 bp, Mus musculus
caggggctttcacggggactgcagg

SEQ ID NO: 894610 - DNA, 25 bp, Mus musculus
caggggctttcagggggactgcagg

SEQ ID NO: 894611 - DNA, 25 bp, Mus musculus
cagggggattgattcgtacatggat

SEQ ID NO: 894612 - DNA, 25 bp, Mus musculus
cagggggattgattggtacatggat

SEQ ID NO: 894613 - DNA, 25 bp, Mus musculus
cagggggctgaccgacgagtccggc

SEQ ID NO: 894614 - DNA, 25 bp, Mus musculus
cagggggctgacggacgagtccggc

SEQ ID NO: 894615 - DNA, 25 bp, Mus musculus
caggggggagatcgcatttttggac

SEQ ID NO: 894616 - DNA, 25 bp, Mus musculus
caggggggagttcgcatttttggac

SEQ ID NO: 894617 - DNA, 25 bp, Mus musculus
cagggggtaaatctgattagtgtta

SEQ ID NO: 894618 - DNA, 25 bp, Mus musculus
cagggggtaaatgtgattagtgtta

SEQ ID NO: 894619 - DNA, 25 bp, Mus musculus
caggggtaagcacacctctgcccac

SEQ ID NO: 894620 - DNA, 25 bp, Mus musculus
caggggtaagcacacgatcacgtgg

SEQ ID NO: 894621 - DNA, 25 bp, Mus musculus
caggggtaagcacagctctgcccac

SEQ ID NO: 894622 - DNA, 25 bp, Mus musculus
caggggtaagcacaggatcacgtgg

SEQ ID NO: 894623 - DNA, 25 bp, Mus musculus
caggggtttcagccagaaaatgtaa

SEQ ID NO: 894624 - DNA, 25 bp, Mus musculus
caggggtttcagctctgcattacat

SEQ ID NO: 894625 - DNA, 25 bp, Mus musculus
caggggtttcaggcagaaaatgtaa

SEQ ID NO: 894626 - DNA, 25 bp, Mus musculus
caggggtttcaggtctgcattacat

SEQ ID NO: 894627 - DNA, 25 bp, Mus musculus
cagggtatttctaaagatgagccca

SEQ ID NO: 894628 - DNA, 25 bp, Mus musculus
cagggtatttgtaaagatgagccca

SEQ ID NO: 894629 - DNA, 25 bp, Mus musculus
cagggtcactgtcactccagctccg

SEQ ID NO: 894630 - DNA, 25 bp, Mus musculus
cagggtcactgtgactccagctccg

SEQ ID NO: 894631 - DNA, 25 bp, Mus musculus
cagggtcagaagcgtgagcgaggtc

SEQ ID NO: 894632 - DNA, 25 bp, Mus musculus
cagggtcagaagggtgagcgaggtc

SEQ ID NO: 894633 - DNA, 25 bp, Mus musculus
cagggtcaggtgcaaaatggaacac

SEQ ID NO: 894634 - DNA, 25 bp, Mus musculus
cagggtcaggtgcaagtgcagaatg

SEQ ID NO: 894635 - DNA, 25 bp, Mus musculus
cagggtcaggtgcataatggaacac

SEQ ID NO: 894636 - DNA, 25 bp, Mus musculus
cagggtcaggtgcatgtgcagaatg

SEQ ID NO: 894637 - DNA, 25 bp, Mus musculus
cagggtccagaacatggctctttat

SEQ ID NO: 894638 - DNA, 25 bp, Mus musculus
cagggtccagtacatggctctttat

SEQ ID NO: 894639 - DNA, 25 bp, Mus musculus
cagggtctatgacctaattatagat

SEQ ID NO: 894640 - DNA, 25 bp, Mus musculus
cagggtctatgagctaattatagat

SEQ ID NO: 894641 - DNA, 25 bp, Mus musculus
cagggtctggatcacgtttaccact

SEQ ID NO: 894642 - DNA, 25 bp, Mus musculus
cagggtctggatcaggtttaccact

SEQ ID NO: 894643 - DNA, 25 bp, Mus musculus
cagggtgcagggacctgatcacacg

SEQ ID NO: 894644 - DNA, 25 bp, Mus musculus
cagggtgcagggtcctgatcacacg

SEQ ID NO: 894645 - DNA, 25 bp, Mus musculus
cagggtgcatgaaacgccgcaccat

SEQ ID NO: 894646 - DNA, 25 bp, Mus musculus
cagggtgcatgaaaggccgcaccat

SEQ ID NO: 894647 - DNA, 25 bp, Mus musculus
cagggtggaagaaacgcttggggca

SEQ ID NO: 894648 - DNA, 25 bp, Mus musculus
cagggtggaagaaaggcttggggca

SEQ ID NO: 894649 - DNA, 25 bp, Mus musculus
cagggtggtcagcaaaatcatgtca

SEQ ID NO: 894650 - DNA, 25 bp, Mus musculus
cagggtggtcagcaaggtctatatg

SEQ ID NO: 894651 - DNA, 25 bp, Mus musculus
cagggtggtcaggaaaatcatgtca

SEQ ID NO: 894652 - DNA, 25 bp, Mus musculus
cagggtggtcaggaaggtctatatg

SEQ ID NO: 894653 - DNA, 25 bp, Mus musculus
cagggtggttctgacccaacaggag

SEQ ID NO: 894654 - DNA, 25 bp, Mus musculus
cagggtggttctgagccaacaggag

SEQ ID NO: 894655 - DNA, 25 bp, Mus musculus
cagggtgtcttccacatcctgctcc

SEQ ID NO: 894656 - DNA, 25 bp, Mus musculus
cagggtgtcttccagatcctgctcc

SEQ ID NO: 894657 - DNA, 25 bp, Mus musculus
cagggttcagcgggcagacagcatg

SEQ ID NO: 894658 - DNA, 25 bp, Mus musculus
cagggttcagggggcagacagcatg

SEQ ID NO: 894659 - DNA, 25 bp, Mus musculus
caggtaaaaatgcattagtcgtatc

SEQ ID NO: 894660 - DNA, 25 bp, Mus musculus
caggtaaaaatggattagtcgtatc

SEQ ID NO: 894661 - DNA, 25 bp, Mus musculus
caggtaagaaggctcagcggaacct

SEQ ID NO: 894662 - DNA, 25 bp, Mus musculus
caggtaagaaggctgagcggaacct

SEQ ID NO: 894663 - DNA, 25 bp, Mus musculus
caggtaaggtaacatctcaagcata

SEQ ID NO: 894664 - DNA, 25 bp, Mus musculus
caggtaaggtaagatctcaagcata

SEQ ID NO: 894665 - DNA, 25 bp, Mus musculus
caggtacaagacgaactggagaaac

SEQ ID NO: 894666 - DNA, 25 bp, Mus musculus
caggtacaagtcgaactggagaaac

SEQ ID NO: 894667 - DNA, 25 bp, Mus musculus
caggtacagatcatattgatcagtg

SEQ ID NO: 894668 - DNA, 25 bp, Mus musculus
caggtacagatcttattgatcagtg

SEQ ID NO: 894669 - DNA, 25 bp, Mus musculus
caggtacaggcacgcaaaggctcgg

SEQ ID NO: 894670 - DNA, 25 bp, Mus musculus
caggtacaggcaggcaaaggctcgg

SEQ ID NO: 894671 - DNA, 25 bp, Mus musculus
caggtagagtcacacaaatcactca

SEQ ID NO: 894672 - DNA, 25 bp, Mus musculus
caggtagagtcacagaaatcactca

SEQ ID NO: 894673 - DNA, 25 bp, Mus musculus
caggtagccaagcttgaggcggccc

SEQ ID NO: 894674 - DNA, 25 bp, Mus musculus
caggtagccaaggttgaggcggccc

SEQ ID NO: 894675 - DNA, 25 bp, Mus musculus
caggtatgccagcttatccagtctt

SEQ ID NO: 894676 - DNA, 25 bp, Mus musculus
caggtatgccaggttatccagtctt

SEQ ID NO: 894677 - DNA, 25 bp, Mus musculus
caggtcaaaaagtcctgcaggtctt

SEQ ID NO: 894678 - DNA, 25 bp, Mus musculus
caggtcaaaatgtcctgcaggtctt

SEQ ID NO: 894679 - DNA, 25 bp, Mus musculus
caggtcaacaagcttggacttttca

SEQ ID NO: 894680 - DNA, 25 bp, Mus musculus
caggtcaacaaggttggacttttca

SEQ ID NO: 894681 - DNA, 25 bp, Mus musculus
caggtcaaccagcgaaaatgccaag

SEQ ID NO: 894682 - DNA, 25 bp, Mus musculus
caggtcaaccagggaaaatgccaag

SEQ ID NO: 894683 - DNA, 25 bp, Mus musculus
caggtcaagatccgcaacgtcactt

SEQ ID NO: 894684 - DNA, 25 bp, Mus musculus
caggtcaagatccggaacgtcactt

SEQ ID NO: 894685 - DNA, 25 bp, Mus musculus
caggtcaatgaccccgtccgtgtgc

SEQ ID NO: 894686 - DNA, 25 bp, Mus musculus
caggtcaatgtccccgtccgtgtgc

SEQ ID NO: 894687 - DNA, 25 bp, Mus musculus
caggtcacagagaccgatgagtgcc

SEQ ID NO: 894688 - DNA, 25 bp, Mus musculus
caggtcacagtgaccgatgagtgcc

SEQ ID NO: 894689 - DNA, 25 bp, Mus musculus
caggtcagattgaacgtcagatgta

SEQ ID NO: 894690 - DNA, 25 bp, Mus musculus
caggtcagattgaaggtcagatgta

SEQ ID NO: 894691 - DNA, 25 bp, Mus musculus
caggtccaagccttgagatttttaa

SEQ ID NO: 894692 - DNA, 25 bp, Mus musculus
caggtccaaggcttgagatttttaa

SEQ ID NO: 894693 - DNA, 25 bp, Mus musculus
caggtccatgaccgaaatgcgactg

SEQ ID NO: 894694 - DNA, 25 bp, Mus musculus
caggtccatgacggaaatgcgactg

SEQ ID NO: 894695 - DNA, 25 bp, Mus musculus
caggtcccctctcgtctttggattc

SEQ ID NO: 894696 - DNA, 25 bp, Mus musculus
caggtcccctctggtctttggattc

SEQ ID NO: 894697 - DNA, 25 bp, Mus musculus
caggtcgctcagcacatcagcaact

SEQ ID NO: 894698 - DNA, 25 bp, Mus musculus
caggtcgctcagccttgcagatggg

SEQ ID NO: 894699 - DNA, 25 bp, Mus musculus
caggtcgctcaggacatcagcaact

SEQ ID NO: 894700 - DNA, 25 bp, Mus musculus
caggtcgctcaggcttgcagatggg

SEQ ID NO: 894701 - DNA, 25 bp, Mus musculus
caggtctggtaacgggcccatcctg

SEQ ID NO: 894702 - DNA, 25 bp, Mus musculus
caggtctggtaaggggcccatcctg

SEQ ID NO: 894703 - DNA, 25 bp, Mus musculus
caggtcttcaaagccccagaggaac

SEQ ID NO: 894704 - DNA, 25 bp, Mus musculus
caggtcttcatagccccagaggaac

SEQ ID NO: 894705 - DNA, 25 bp, Mus musculus
caggtgacagccatcgactgggccc

SEQ ID NO: 894706 - DNA, 25 bp, Mus musculus
caggtgacaggcatcgactgggccc

SEQ ID NO: 894707 - DNA, 25 bp, Mus musculus
caggtgatcgagtcagcaatggaga

SEQ ID NO: 894708 - DNA, 25 bp, Mus musculus
caggtgatcgtgtcagcaatggaga

SEQ ID NO: 894709 - DNA, 25 bp, Mus musculus
caggtgatgacacaggacaaaggtg

SEQ ID NO: 894710 - DNA, 25 bp, Mus musculus
caggtgatgacactcacctctcctc

SEQ ID NO: 894711 - DNA, 25 bp, Mus musculus
caggtgatgacagaggacaaaggtg

SEQ ID NO: 894712 - DNA, 25 bp, Mus musculus
caggtgatgacagtcacctctcctc

SEQ ID NO: 894713 - DNA, 25 bp, Mus musculus
caggtgcaagtaatcccacagggcc

SEQ ID NO: 894714 - DNA, 25 bp, Mus musculus
caggtgcaagtattcccacagggcc

SEQ ID NO: 894715 - DNA, 25 bp, Mus musculus
caggtgcagactaaatgatcagagg

SEQ ID NO: 894716 - DNA, 25 bp, Mus musculus
caggtgcagacttaatgatcagagg

SEQ ID NO: 894717 - DNA, 25 bp, Mus musculus
caggtgccccaagaagaggacgctc

SEQ ID NO: 894718 - DNA, 25 bp, Mus musculus
caggtgccccaagatgaggacgctc

SEQ ID NO: 894719 - DNA, 25 bp, Mus musculus
caggtgctacagctcctagggaaga

SEQ ID NO: 894720 - DNA, 25 bp, Mus musculus
caggtgctacaggtcctagggaaga

SEQ ID NO: 894721 - DNA, 25 bp, Mus musculus
caggtgctagcttaaagatcgaggt

SEQ ID NO: 894722 - DNA, 25 bp, Mus musculus
caggtgctaggttaaagatcgaggt

SEQ ID NO: 894723 - DNA, 25 bp, Mus musculus
caggtgctccagcccatccagaagg

SEQ ID NO: 894724 - DNA, 25 bp, Mus musculus
caggtgctccaggccatccagaagg

SEQ ID NO: 894725 - DNA, 25 bp, Mus musculus
caggtgctgaaacgtattcccaagc

SEQ ID NO: 894726 - DNA, 25 bp, Mus musculus
caggtgctgaaaggtattcccaagc

SEQ ID NO: 894727 - DNA, 25 bp, Mus musculus
caggtgctgctcaacgctcccccgg

SEQ ID NO: 894728 - DNA, 25 bp, Mus musculus
caggtgctgctcaaggctcccccgg

SEQ ID NO: 894729 - DNA, 25 bp, Mus musculus
caggtgcttcagcggctgacgttca

SEQ ID NO: 894730 - DNA, 25 bp, Mus musculus
caggtgcttcaggggctgacgttca

SEQ ID NO: 894731 - DNA, 25 bp, Mus musculus
caggtggaagccgacgttagcaaca

SEQ ID NO: 894732 - DNA, 25 bp, Mus musculus
caggtggaagccgaggttagcaaca

SEQ ID NO: 894733 - DNA, 25 bp, Mus musculus
caggtggagcagcgctcaaactcag

SEQ ID NO: 894734 - DNA, 25 bp, Mus musculus
caggtggagcagggctcaaactcag

SEQ ID NO: 894735 - DNA, 25 bp, Mus musculus
caggtggcaaagaaccagcattttg

SEQ ID NO: 894736 - DNA, 25 bp, Mus musculus
caggtggcaaagtaccagcattttg

SEQ ID NO: 894737 - DNA, 25 bp, Mus musculus
caggtggtgacgatctgggcttcag

SEQ ID NO: 894738 - DNA, 25 bp, Mus musculus
caggtggtgacgttctgggcttcag

SEQ ID NO: 894739 - DNA, 25 bp, Mus musculus
caggtggtgatcagcgaccagtacc

SEQ ID NO: 894740 - DNA, 25 bp, Mus musculus
caggtggtgatctgcgaccagtacc

SEQ ID NO: 894741 - DNA, 25 bp, Mus musculus
caggtgtatgatgaagaccctcgag

SEQ ID NO: 894742 - DNA, 25 bp, Mus musculus
caggtgtatgttgaagaccctcgag

SEQ ID NO: 894743 - DNA, 25 bp, Mus musculus
caggtgtcaaataatggtccttgtt

SEQ ID NO: 894744 - DNA, 25 bp, Mus musculus
caggtgtcaattaatggtccttgtt

SEQ ID NO: 894745 - DNA, 25 bp, Mus musculus
caggtgttcgagcactctgccgcta

SEQ ID NO: 894746 - DNA, 25 bp, Mus musculus
caggtgttcgaggactctgccgcta

SEQ ID NO: 894747 - DNA, 25 bp, Mus musculus
caggtgttggagactgaatgccagc

SEQ ID NO: 894748 - DNA, 25 bp, Mus musculus
caggtgttggagcagactgaatgcc

SEQ ID NO: 894749 - DNA, 25 bp, Mus musculus
caggtgttggaggagactgaatgcc

SEQ ID NO: 894750 - DNA, 25 bp, Mus musculus
caggtgttggagtctgaatgccagc

SEQ ID NO: 894751 - DNA, 25 bp, Mus musculus
caggttacgatgaacactgccaaag

SEQ ID NO: 894752 - DNA, 25 bp, Mus musculus
caggttacgatgaacgctgtcatgg

SEQ ID NO: 894753 - DNA, 25 bp, Mus musculus
caggttacgatgaagactgccaaag

SEQ ID NO: 894754 - DNA, 25 bp, Mus musculus
caggttacgatgaaggctgtcatgg

SEQ ID NO: 894755 - DNA, 25 bp, Mus musculus
caggttactgcagtccatgagtcgg

SEQ ID NO: 894756 - DNA, 25 bp, Mus musculus
caggttactgcagtgcatgagtcgg

SEQ ID NO: 894757 - DNA, 25 bp, Mus musculus
caggttatggggccaccagctgcat

SEQ ID NO: 894758 - DNA, 25 bp, Mus musculus
caggttatgggggcaccagctgcat

SEQ ID NO: 894759 - DNA, 25 bp, Mus musculus
caggttcaataacacggtgcaggtg

SEQ ID NO: 894760 - DNA, 25 bp, Mus musculus
caggttcaataagacggtgcaggtg

SEQ ID NO: 894761 - DNA, 25 bp, Mus musculus
caggttcaggctaaccaggaatatt

SEQ ID NO: 894762 - DNA, 25 bp, Mus musculus
caggttcagggtaaccaggaatatt

SEQ ID NO: 894763 - DNA, 25 bp, Mus musculus
caggttccagacaatcctcctgatc

SEQ ID NO: 894764 - DNA, 25 bp, Mus musculus
caggttccagatctcttgctaccct

SEQ ID NO: 894765 - DNA, 25 bp, Mus musculus
caggttccagctctcccaggaaacc

SEQ ID NO: 894766 - DNA, 25 bp, Mus musculus
caggttccaggtctcccaggaaacc

SEQ ID NO: 894767 - DNA, 25 bp, Mus musculus
caggttccagtcaatcctcctgatc

SEQ ID NO: 894768 - DNA, 25 bp, Mus musculus
caggttccagttctcttgctaccct

SEQ ID NO: 894769 - DNA, 25 bp, Mus musculus
caggttccctgtaagcacatcgaga

SEQ ID NO: 894770 - DNA, 25 bp, Mus musculus
caggttccctgtcacatcgagaacc

SEQ ID NO: 894771 - DNA, 25 bp, Mus musculus
caggttccctgtgacatcgagaacc

SEQ ID NO: 894772 - DNA, 25 bp, Mus musculus
caggttccctgttagcacatcgaga

SEQ ID NO: 894773 - DNA, 25 bp, Mus musculus
caggttctagatatgtgctgactag

SEQ ID NO: 894774 - DNA, 25 bp, Mus musculus
caggttctagttatgtgctgactag

SEQ ID NO: 894775 - DNA, 25 bp, Mus musculus
caggttctttggctctgtatgagaa

SEQ ID NO: 894776 - DNA, 25 bp, Mus musculus
caggttctttgggtctgtatgagaa

SEQ ID NO: 894777 - DNA, 25 bp, Mus musculus
caggttgacccttccgttgatgttc

SEQ ID NO: 894778 - DNA, 25 bp, Mus musculus
caggttgacccttcggttgatgttc

SEQ ID NO: 894779 - DNA, 25 bp, Mus musculus
caggttgccaccaacacctgtacat

SEQ ID NO: 894780 - DNA, 25 bp, Mus musculus
caggttgccaccaagacctgtacat

SEQ ID NO: 894781 - DNA, 25 bp, Mus musculus
caggttgtaccgaacgcactacacg

SEQ ID NO: 894782 - DNA, 25 bp, Mus musculus
caggttgtaccgaaggcactacacg

SEQ ID NO: 894783 - DNA, 25 bp, Mus musculus
caggtttagaagacagcgtggaaga

SEQ ID NO: 894784 - DNA, 25 bp, Mus musculus
caggtttagaagtcagcgtggaaga

SEQ ID NO: 894785 - DNA, 25 bp, Mus musculus
caggtttatcaaaacacttccaact

SEQ ID NO: 894786 - DNA, 25 bp, Mus musculus
caggtttatcaaaagacttccaact

SEQ ID NO: 894787 - DNA, 25 bp, Mus musculus
caggtttcagccccacccagtgccc

SEQ ID NO: 894788 - DNA, 25 bp, Mus musculus
caggtttcaggcccacccagtgccc

SEQ ID NO: 894789 - DNA, 25 bp, Mus musculus
caggtttgccagaacgaacctgaat

SEQ ID NO: 894790 - DNA, 25 bp, Mus musculus
caggtttgccagaaggaacctgaat

SEQ ID NO: 894791 - DNA, 25 bp, Mus musculus
caggtttggtaaaacccatggccat

SEQ ID NO: 894792 - DNA, 25 bp, Mus musculus
caggtttggtaaaagccatggccat

SEQ ID NO: 894793 - DNA, 25 bp, Mus musculus
cagtaaacagagtccactgcaagcc

SEQ ID NO: 894794 - DNA, 25 bp, Mus musculus
cagtaaacagtgtccactgcaagcc

SEQ ID NO: 894795 - DNA, 25 bp, Mus musculus
cagtaaagccaacgtgcagcagcta

SEQ ID NO: 894796 - DNA, 25 bp, Mus musculus
cagtaaagccaaggtgcagcagcta

SEQ ID NO: 894797 - DNA, 25 bp, Mus musculus
cagtaaatggaagatcaagatcgcg

SEQ ID NO: 894798 - DNA, 25 bp, Mus musculus
cagtaaatggtagatcaagatcgcg

SEQ ID NO: 894799 - DNA, 25 bp, Mus musculus
cagtaaccagcttgctccgggctgg

SEQ ID NO: 894800 - DNA, 25 bp, Mus musculus
cagtaaccaggttgctccgggctgg

SEQ ID NO: 894801 - DNA, 25 bp, Mus musculus
cagtaagacaaacccacctggagaa

SEQ ID NO: 894802 - DNA, 25 bp, Mus musculus
cagtaagacaaagccacctggagaa

SEQ ID NO: 894803 - DNA, 25 bp, Mus musculus
cagtaagtacagatgatacactaaa

SEQ ID NO: 894804 - DNA, 25 bp, Mus musculus
cagtaagtacagttgatacactaaa

SEQ ID NO: 894805 - DNA, 25 bp, Mus musculus
cagtacaaacctctttctcatcatt

SEQ ID NO: 894806 - DNA, 25 bp, Mus musculus
cagtacaaacgtctttctcatcatt

SEQ ID NO: 894807 - DNA, 25 bp, Mus musculus
cagtacagaagacacaggtgagaac

SEQ ID NO: 894808 - DNA, 25 bp, Mus musculus
cagtacagaagagacaggtgagaac

SEQ ID NO: 894809 - DNA, 25 bp, Mus musculus
cagtacagagcctttttcagggctg

SEQ ID NO: 894810 - DNA, 25 bp, Mus musculus
cagtacagagctctatggccagcct

SEQ ID NO: 894811 - DNA, 25 bp, Mus musculus
cagtacagaggctttttcagggctg

SEQ ID NO: 894812 - DNA, 25 bp, Mus musculus
cagtacagaggtctatggccagcct

SEQ ID NO: 894813 - DNA, 25 bp, Mus musculus
cagtacagcactaggcaagttgcac

SEQ ID NO: 894814 - DNA, 25 bp, Mus musculus
cagtacagcagtaggcaagttgcac

SEQ ID NO: 894815 - DNA, 25 bp, Mus musculus
cagtacagccagctgaccgagctga

SEQ ID NO: 894816 - DNA, 25 bp, Mus musculus
cagtacagccaggtgaccgagctga

SEQ ID NO: 894817 - DNA, 25 bp, Mus musculus
cagtacagcctcacaatagaacagt

SEQ ID NO: 894818 - DNA, 25 bp, Mus musculus
cagtacagcctcactatagaacagt

SEQ ID NO: 894819 - DNA, 25 bp, Mus musculus
cagtacatccctcgagccggccctc

SEQ ID NO: 894820 - DNA, 25 bp, Mus musculus
cagtacatccctggagccggccctc

SEQ ID NO: 894821 - DNA, 25 bp, Mus musculus
cagtaccaagacaaagcctatttct

SEQ ID NO: 894822 - DNA, 25 bp, Mus musculus
cagtaccaagtcaaagcctatttct

SEQ ID NO: 894823 - DNA, 25 bp, Mus musculus
cagtaccatgtgcacgacccaaggc

SEQ ID NO: 894824 - DNA, 25 bp, Mus musculus
cagtaccatgtgcaggacccaaggc

SEQ ID NO: 894825 - DNA, 25 bp, Mus musculus
cagtaccgagtgcagctggctgaga

SEQ ID NO: 894826 - DNA, 25 bp, Mus musculus
cagtaccgagtggagctggctgaga

SEQ ID NO: 894827 - DNA, 25 bp, Mus musculus
cagtacctgaagaccaaggcactga

SEQ ID NO: 894828 - DNA, 25 bp, Mus musculus
cagtacctgaagtccaaggcactga

SEQ ID NO: 894829 - DNA, 25 bp, Mus musculus
cagtacctttcaaagctttggatat

SEQ ID NO: 894830 - DNA, 25 bp, Mus musculus
cagtacctttgaaagctttggatat

SEQ ID NO: 894831 - DNA, 25 bp, Mus musculus
cagtactatgggcatgtctgtgtta

SEQ ID NO: 894832 - DNA, 25 bp, Mus musculus
cagtactatggggatgtctgtgtta

SEQ ID NO: 894833 - DNA, 25 bp, Mus musculus
cagtactcagctagttacagccagc

SEQ ID NO: 894834 - DNA, 25 bp, Mus musculus
cagtactcaggtagttacagccagc

SEQ ID NO: 894835 - DNA, 25 bp, Mus musculus
cagtactcgatggccgagaggtgtc

SEQ ID NO: 894836 - DNA, 25 bp, Mus musculus
cagtactcgatggcggagaggtgtc

SEQ ID NO: 894837 - DNA, 25 bp, Mus musculus
cagtacttagaccacgacctgtatg

SEQ ID NO: 894838 - DNA, 25 bp, Mus musculus
cagtacttagaccaggacctgtatg

SEQ ID NO: 894839 - DNA, 25 bp, Mus musculus
cagtagaacaagaatcatctcagag

SEQ ID NO: 894840 - DNA, 25 bp, Mus musculus
cagtagaacaagagactaagtctgg

SEQ ID NO: 894841 - DNA, 25 bp, Mus musculus
cagtagaacaagtatcatctcagag

SEQ ID NO: 894842 - DNA, 25 bp, Mus musculus
cagtagaacaagtgactaagtctgg

SEQ ID NO: 894843 - DNA, 25 bp, Mus musculus
cagtagagaactcaaagaaccacca

SEQ ID NO: 894844 - DNA, 25 bp, Mus musculus
cagtagagaactcatagaaccacca

SEQ ID NO: 894845 - DNA, 25 bp, Mus musculus
cagtagagctatctaataatctgga

SEQ ID NO: 894846 - DNA, 25 bp, Mus musculus
cagtagagctatcttataatctgga

SEQ ID NO: 894847 - DNA, 25 bp, Mus musculus
cagtagccagcccatggaagtacaa

SEQ ID NO: 894848 - DNA, 25 bp, Mus musculus
cagtagccaggccatggaagtacaa

SEQ ID NO: 894849 - DNA, 25 bp, Mus musculus
cagtaggcagagatggcaccaccca

SEQ ID NO: 894850 - DNA, 25 bp, Mus musculus
cagtaggcagtgatggcaccaccca

SEQ ID NO: 894851 - DNA, 25 bp, Mus musculus
cagtaggctacccgtgatggtgtgg

SEQ ID NO: 894852 - DNA, 25 bp, Mus musculus
cagtaggctaccggtgatggtgtgg

SEQ ID NO: 894853 - DNA, 25 bp, Mus musculus
cagtaggtatcacggtggactcagt

SEQ ID NO: 894854 - DNA, 25 bp, Mus musculus
cagtaggtatcagggtggactcagt

SEQ ID NO: 894855 - DNA, 25 bp, Mus musculus
cagtagtactagatgccaaatccga

SEQ ID NO: 894856 - DNA, 25 bp, Mus musculus
cagtagtactagttgccaaatccga

SEQ ID NO: 894857 - DNA, 25 bp, Mus musculus
cagtagtccaagagattagaatttt

SEQ ID NO: 894858 - DNA, 25 bp, Mus musculus
cagtagtccaagatgcctttgagtg

SEQ ID NO: 894859 - DNA, 25 bp, Mus musculus
cagtagtccaagtgattagaatttt

SEQ ID NO: 894860 - DNA, 25 bp, Mus musculus
cagtagtccaagttgcctttgagtg

SEQ ID NO: 894861 - DNA, 25 bp, Mus musculus
cagtagtggtcacagtccagctaca

SEQ ID NO: 894862 - DNA, 25 bp, Mus musculus
cagtagtggtcagagtccagctaca

SEQ ID NO: 894863 - DNA, 25 bp, Mus musculus
cagtataattcacacaactgggaag

SEQ ID NO: 894864 - DNA, 25 bp, Mus musculus
cagtataattcacagaactgggaag

SEQ ID NO: 894865 - DNA, 25 bp, Mus musculus
cagtatacaaatcgcgtagataaag

SEQ ID NO: 894866 - DNA, 25 bp, Mus musculus
cagtatacaaatcgggtagataaag

SEQ ID NO: 894867 - DNA, 25 bp, Mus musculus
cagtatagatgtaggcaaaagaaag

SEQ ID NO: 894868 - DNA, 25 bp, Mus musculus
cagtatagatgttggcaaaagaaag

SEQ ID NO: 894869 - DNA, 25 bp, Mus musculus
cagtatagcgccaactctggagagg

SEQ ID NO: 894870 - DNA, 25 bp, Mus musculus
cagtatagcgccaagtctggagagg

SEQ ID NO: 894871 - DNA, 25 bp, Mus musculus
cagtatcacaacaacattgaggaag

SEQ ID NO: 894872 - DNA, 25 bp, Mus musculus
cagtatcacaacaacgcccatctgc

SEQ ID NO: 894873 - DNA, 25 bp, Mus musculus
cagtatcacaacaagattgaggaag

SEQ ID NO: 894874 - DNA, 25 bp, Mus musculus
cagtatcacaacaaggcccatctgc

SEQ ID NO: 894875 - DNA, 25 bp, Mus musculus
cagtatcatgtcaaacacctggtca

SEQ ID NO: 894876 - DNA, 25 bp, Mus musculus
cagtatcatgtcaatcacctggtca

SEQ ID NO: 894877 - DNA, 25 bp, Mus musculus
cagtatcctgatcacatttgacaat

SEQ ID NO: 894878 - DNA, 25 bp, Mus musculus
cagtatcctgttcacatttgacaat

SEQ ID NO: 894879 - DNA, 25 bp, Mus musculus
cagtatctgtatcgtcgtggctcta

SEQ ID NO: 894880 - DNA, 25 bp, Mus musculus
cagtatctgtatggtcgtggctcta

SEQ ID NO: 894881 - DNA, 25 bp, Mus musculus
cagtatgagattagcaattgttggc

SEQ ID NO: 894882 - DNA, 25 bp, Mus musculus
cagtatgagattaggaattgttggc

SEQ ID NO: 894883 - DNA, 25 bp, Mus musculus
cagtatgccaaggacaatggtacca

SEQ ID NO: 894884 - DNA, 25 bp, Mus musculus
cagtatgccaaggagaatggtacca

SEQ ID NO: 894885 - DNA, 25 bp, Mus musculus
cagtatggaagtacccagaaatcct

SEQ ID NO: 894886 - DNA, 25 bp, Mus musculus
cagtatggaagttcccagaaatcct

SEQ ID NO: 894887 - DNA, 25 bp, Mus musculus
cagtatggagacacggactatttga

SEQ ID NO: 894888 - DNA, 25 bp, Mus musculus
cagtatggagagcatcgagattgac

SEQ ID NO: 894889 - DNA, 25 bp, Mus musculus
cagtatggagaggatcgagattgac

SEQ ID NO: 894890 - DNA, 25 bp, Mus musculus
cagtatggagatcctcaccacgatg

SEQ ID NO: 894891 - DNA, 25 bp, Mus musculus
cagtatggagtcacggactatttga

SEQ ID NO: 894892 - DNA, 25 bp, Mus musculus
cagtatggagttcctcaccacgatg

SEQ ID NO: 894893 - DNA, 25 bp, Mus musculus
cagtatggcatcaccggagacaatg

SEQ ID NO: 894894 - DNA, 25 bp, Mus musculus
cagtatggcatcacgggagacaatg

SEQ ID NO: 894895 - DNA, 25 bp, Mus musculus
cagtatggccaggacgtatatgaca

SEQ ID NO: 894896 - DNA, 25 bp, Mus musculus
cagtatggccaggaggtatatgaca

SEQ ID NO: 894897 - DNA, 25 bp, Mus musculus
cagtatgttcagccatatcctcctt

SEQ ID NO: 894898 - DNA, 25 bp, Mus musculus
cagtatgttcaggcatatcctcctt

SEQ ID NO: 894899 - DNA, 25 bp, Mus musculus
cagtatgttgcgcatgctatgggtc

SEQ ID NO: 894900 - DNA, 25 bp, Mus musculus
cagtatgttgcggatgctatgggtc

SEQ ID NO: 894901 - DNA, 25 bp, Mus musculus
cagtattatctgcaaatcagattgt

SEQ ID NO: 894902 - DNA, 25 bp, Mus musculus
cagtattatctgcatatcagattgt

SEQ ID NO: 894903 - DNA, 25 bp, Mus musculus
cagtattcgaaacatgcactgctgt

SEQ ID NO: 894904 - DNA, 25 bp, Mus musculus
cagtattcgaaagatgcactgctgt

SEQ ID NO: 894905 - DNA, 25 bp, Mus musculus
cagtattctacaccccaggagtgtt

SEQ ID NO: 894906 - DNA, 25 bp, Mus musculus
cagtattctacacctcaagactgca

SEQ ID NO: 894907 - DNA, 25 bp, Mus musculus
cagtattctacacctgaggaatgtg

SEQ ID NO: 894908 - DNA, 25 bp, Mus musculus
cagtattctacagcccaggagtgtt

SEQ ID NO: 894909 - DNA, 25 bp, Mus musculus
cagtattctacagctcaagactgca

SEQ ID NO: 894910 - DNA, 25 bp, Mus musculus
cagtattctacagctgaggaatgtg

SEQ ID NO: 894911 - DNA, 25 bp, Mus musculus
cagtcaagaaagcacatctgatttg

SEQ ID NO: 894912 - DNA, 25 bp, Mus musculus
cagtcaagaaagcctgtaccccagt

SEQ ID NO: 894913 - DNA, 25 bp, Mus musculus
cagtcaagaaaggacatctgatttg

SEQ ID NO: 894914 - DNA, 25 bp, Mus musculus
cagtcaagaaaggctgtaccccagt

SEQ ID NO: 894915 - DNA, 25 bp, Mus musculus
cagtcacaaggacaactatgagtct

SEQ ID NO: 894916 - DNA, 25 bp, Mus musculus
cagtcacaaggagaactatgagtct

SEQ ID NO: 894917 - DNA, 25 bp, Mus musculus
cagtcacaagtgcgttttattgact

SEQ ID NO: 894918 - DNA, 25 bp, Mus musculus
cagtcacaagtgggttttattgact

SEQ ID NO: 894919 - DNA, 25 bp, Mus musculus
cagtcactaccacgtgcagacccac

SEQ ID NO: 894920 - DNA, 25 bp, Mus musculus
cagtcactaccaggtgcagacccac

SEQ ID NO: 894921 - DNA, 25 bp, Mus musculus
cagtcactatctgctgtgagtggct

SEQ ID NO: 894922 - DNA, 25 bp, Mus musculus
cagtcactatgtgctgtgagtggct

SEQ ID NO: 894923 - DNA, 25 bp, Mus musculus
cagtcactgaagcttctgggtgagc

SEQ ID NO: 894924 - DNA, 25 bp, Mus musculus
cagtcactgaaggttctgggtgagc

SEQ ID NO: 894925 - DNA, 25 bp, Mus musculus
cagtcactgctacgtatggcactgc

SEQ ID NO: 894926 - DNA, 25 bp, Mus musculus
cagtcactgctaggtatggcactgc

SEQ ID NO: 894927 - DNA, 25 bp, Mus musculus
cagtcactttccaaaccgcacagac

SEQ ID NO: 894928 - DNA, 25 bp, Mus musculus
cagtcactttccaaccagcaatgcc

SEQ ID NO: 894929 - DNA, 25 bp, Mus musculus
cagtcactttcctaaccgcacagac

SEQ ID NO: 894930 - DNA, 25 bp, Mus musculus
cagtcactttcctaccagcaatgcc

SEQ ID NO: 894931 - DNA, 25 bp, Mus musculus
cagtcagatactcatgatgctggag

SEQ ID NO: 894932 - DNA, 25 bp, Mus musculus
cagtcagatactgatgatgctggag

SEQ ID NO: 894933 - DNA, 25 bp, Mus musculus
cagtcagatcagctttggactcctt

SEQ ID NO: 894934 - DNA, 25 bp, Mus musculus
cagtcagatcaggtttggactcctt

SEQ ID NO: 894935 - DNA, 25 bp, Mus musculus
cagtcagcaaaacgaggaacacctc

SEQ ID NO: 894936 - DNA, 25 bp, Mus musculus
cagtcagcaaaaggaggaacacctc

SEQ ID NO: 894937 - DNA, 25 bp, Mus musculus
cagtcagcatgcaaataaccacttt

SEQ ID NO: 894938 - DNA, 25 bp, Mus musculus
cagtcagcatgctaataaccacttt

SEQ ID NO: 894939 - DNA, 25 bp, Mus musculus
cagtcagccagtcgctgcagaccct

SEQ ID NO: 894940 - DNA, 25 bp, Mus musculus
cagtcagccagtggctgcagaccct

SEQ ID NO: 894941 - DNA, 25 bp, Mus musculus
cagtcagtacctaccgtgctgtgcg

SEQ ID NO: 894942 - DNA, 25 bp, Mus musculus
cagtcagtacctagatcgacagctg

SEQ ID NO: 894943 - DNA, 25 bp, Mus musculus
cagtcagtaccttccgtgctgtgcg

SEQ ID NO: 894944 - DNA, 25 bp, Mus musculus
cagtcagtaccttgatcgacagctg

SEQ ID NO: 894945 - DNA, 25 bp, Mus musculus
cagtcagtacgacaactgcctgacc

SEQ ID NO: 894946 - DNA, 25 bp, Mus musculus
cagtcagtacgagaactgcctgacc

SEQ ID NO: 894947 - DNA, 25 bp, Mus musculus
cagtcatccccgatcatcatcccct

SEQ ID NO: 894948 - DNA, 25 bp, Mus musculus
cagtcatccccgatgatcatcccct

SEQ ID NO: 894949 - DNA, 25 bp, Mus musculus
cagtcatcctgtgacttgggtgcaa

SEQ ID NO: 894950 - DNA, 25 bp, Mus musculus
cagtcatcctgtgagttgggtgcaa

SEQ ID NO: 894951 - DNA, 25 bp, Mus musculus
cagtcatctaagacatctacagcca

SEQ ID NO: 894952 - DNA, 25 bp, Mus musculus
cagtcatctaagtcatctacagcca

SEQ ID NO: 894953 - DNA, 25 bp, Mus musculus
cagtccaagcaccccgcagcagcct

SEQ ID NO: 894954 - DNA, 25 bp, Mus musculus
cagtccaagcaccgggacagcttcg

SEQ ID NO: 894955 - DNA, 25 bp, Mus musculus
cagtccaagcacgccgcagcagcct

SEQ ID NO: 894956 - DNA, 25 bp, Mus musculus
cagtccaagcacggggacagcttcg

SEQ ID NO: 894957 - DNA, 25 bp, Mus musculus
cagtccaagtataacgtggctctcg

SEQ ID NO: 894958 - DNA, 25 bp, Mus musculus
cagtccaagtataaggtggctctcg

SEQ ID NO: 894959 - DNA, 25 bp, Mus musculus
cagtcccagcagagtgatggttgcc

SEQ ID NO: 894960 - DNA, 25 bp, Mus musculus
cagtcccagcagcacatggatttga

SEQ ID NO: 894961 - DNA, 25 bp, Mus musculus
cagtcccagcaggacatggatttga

SEQ ID NO: 894962 - DNA, 25 bp, Mus musculus
cagtcccagcagtgtgatggttgcc

SEQ ID NO: 894963 - DNA, 25 bp, Mus musculus
cagtccccaaagcatgataatgaag

SEQ ID NO: 894964 - DNA, 25 bp, Mus musculus
cagtccccaaaggatgataatgaag

SEQ ID NO: 894965 - DNA, 25 bp, Mus musculus
cagtccctgatccgctatgtggaga

SEQ ID NO: 894966 - DNA, 25 bp, Mus musculus
cagtccctgatccggtatgtggaga

SEQ ID NO: 894967 - DNA, 25 bp, Mus musculus
cagtccctggcggtacacaagagca

SEQ ID NO: 894968 - DNA, 25 bp, Mus musculus
cagtccctggcggttcacaagagca

SEQ ID NO: 894969 - DNA, 25 bp, Mus musculus
cagtccgcagctctttggccagtat

SEQ ID NO: 894970 - DNA, 25 bp, Mus musculus
cagtccgcaggtctttggccagtat

SEQ ID NO: 894971 - DNA, 25 bp, Mus musculus
cagtcctaagagtgacttggtactt

SEQ ID NO: 894972 - DNA, 25 bp, Mus musculus
cagtcctaagtgtgacttggtactt

SEQ ID NO: 894973 - DNA, 25 bp, Mus musculus
cagtcctacagtctctacagctacc

SEQ ID NO: 894974 - DNA, 25 bp, Mus musculus
cagtcctacagtgtctacagctacc

SEQ ID NO: 894975 - DNA, 25 bp, Mus musculus
cagtcctagaagcagatgcgattca

SEQ ID NO: 894976 - DNA, 25 bp, Mus musculus
cagtcctagaaggagatgcgattca

SEQ ID NO: 894977 - DNA, 25 bp, Mus musculus
cagtcctatgccagtaccagtgaca

SEQ ID NO: 894978 - DNA, 25 bp, Mus musculus
cagtcctatggcagtaccagtgaca

SEQ ID NO: 894979 - DNA, 25 bp, Mus musculus
cagtcctcaacacacaccctgctct

SEQ ID NO: 894980 - DNA, 25 bp, Mus musculus
cagtcctcaacacagaccctgctct

SEQ ID NO: 894981 - DNA, 25 bp, Mus musculus
cagtcctcagatgcggtgagcaccc

SEQ ID NO: 894982 - DNA, 25 bp, Mus musculus
cagtcctcagccaaacaggtatggg

SEQ ID NO: 894983 - DNA, 25 bp, Mus musculus
cagtcctcagcgttcaagttccttg

SEQ ID NO: 894984 - DNA, 25 bp, Mus musculus
cagtcctcaggcaaacaggtatggg

SEQ ID NO: 894985 - DNA, 25 bp, Mus musculus
cagtcctcagggttcaagttccttg

SEQ ID NO: 894986 - DNA, 25 bp, Mus musculus
cagtcctcagttgcggtgagcaccc

SEQ ID NO: 894987 - DNA, 25 bp, Mus musculus
cagtcctccccacaaatagatgaag

SEQ ID NO: 894988 - DNA, 25 bp, Mus musculus
cagtcctccccagaaatagatgaag

SEQ ID NO: 894989 - DNA, 25 bp, Mus musculus
cagtcctccgcgaaaatgaccatgg

SEQ ID NO: 894990 - DNA, 25 bp, Mus musculus
cagtcctccgcgtaaatgaccatgg

SEQ ID NO: 894991 - DNA, 25 bp, Mus musculus
cagtcctcggagcagtatatatcct

SEQ ID NO: 894992 - DNA, 25 bp, Mus musculus
cagtcctcggaggagtatatatcct

SEQ ID NO: 894993 - DNA, 25 bp, Mus musculus
cagtcctgagctgtgccaccaggtc

SEQ ID NO: 894994 - DNA, 25 bp, Mus musculus
cagtcctgaggtgtgccaccaggtc

SEQ ID NO: 894995 - DNA, 25 bp, Mus musculus
cagtcctgcccacctcaatggtggc

SEQ ID NO: 894996 - DNA, 25 bp, Mus musculus
cagtcctgcccacgatggcagtacc

SEQ ID NO: 894997 - DNA, 25 bp, Mus musculus
cagtcctgcccagctcaatggtggc

SEQ ID NO: 894998 - DNA, 25 bp, Mus musculus
cagtcctgcccaggatggcagtacc

SEQ ID NO: 894999 - DNA, 25 bp, Mus musculus
cagtcctggccgccaagttgaagtt

SEQ ID NO: 895000 - DNA, 25 bp, Mus musculus
cagtcctggccggcaagttgaagtt

SEQ ID NO: 895001 - DNA, 25 bp, Mus musculus
cagtcctgtcctcacggaccgcagc

SEQ ID NO: 895002 - DNA, 25 bp, Mus musculus
cagtcctgtcctcacggccttcagg

SEQ ID NO: 895003 - DNA, 25 bp, Mus musculus
cagtcctgtcctcagggaccgcagc

SEQ ID NO: 895004 - DNA, 25 bp, Mus musculus
cagtcctgtcctcagggccttcagg

SEQ ID NO: 895005 - DNA, 25 bp, Mus musculus
cagtcctgttcaccaccatcagcac

SEQ ID NO: 895006 - DNA, 25 bp, Mus musculus
cagtcctgttcagcaccatcagcac

SEQ ID NO: 895007 - DNA, 25 bp, Mus musculus
cagtcgcccctgaacatggagagaa

SEQ ID NO: 895008 - DNA, 25 bp, Mus musculus
cagtcgcccctgaagatggagagaa

SEQ ID NO: 895009 - DNA, 25 bp, Mus musculus
cagtcgctgccacgggggcaacaat

SEQ ID NO: 895010 - DNA, 25 bp, Mus musculus
cagtcgctgccaggggggcaacaat

SEQ ID NO: 895011 - DNA, 25 bp, Mus musculus
cagtcggcctcaagcccctgaagaa

SEQ ID NO: 895012 - DNA, 25 bp, Mus musculus
cagtcggcctcatgcccctgaagaa

SEQ ID NO: 895013 - DNA, 25 bp, Mus musculus
cagtcgtgagctaccgaaagaaggc

SEQ ID NO: 895014 - DNA, 25 bp, Mus musculus
cagtcgtgaggtaccgaaagaaggc

SEQ ID NO: 895015 - DNA, 25 bp, Mus musculus
cagtctacagacacctgctatgtcc

SEQ ID NO: 895016 - DNA, 25 bp, Mus musculus
cagtctacagctcacccgaatttca

SEQ ID NO: 895017 - DNA, 25 bp, Mus musculus
cagtctacagctcagccgaatttca

SEQ ID NO: 895018 - DNA, 25 bp, Mus musculus
cagtctacagtcacctgctatgtcc

SEQ ID NO: 895019 - DNA, 25 bp, Mus musculus
cagtctacttacagaggtgactccg

SEQ ID NO: 895020 - DNA, 25 bp, Mus musculus
cagtctacttacagtggtgactccg

SEQ ID NO: 895021 - DNA, 25 bp, Mus musculus
cagtctagaggacgtcagttactac

SEQ ID NO: 895022 - DNA, 25 bp, Mus musculus
cagtctagaggaggtcagttactac

SEQ ID NO: 895023 - DNA, 25 bp, Mus musculus
cagtctatgacccacgcagtgatcc

SEQ ID NO: 895024 - DNA, 25 bp, Mus musculus
cagtctatgacccaggcagtgatcc

SEQ ID NO: 895025 - DNA, 25 bp, Mus musculus
cagtctatgagaagcgatgtaatcg

SEQ ID NO: 895026 - DNA, 25 bp, Mus musculus
cagtctatgagaagggatgtaatcg

SEQ ID NO: 895027 - DNA, 25 bp, Mus musculus
cagtctcatcaccgtgctggcatca

SEQ ID NO: 895028 - DNA, 25 bp, Mus musculus
cagtctcatcacggtgctggcatca

SEQ ID NO: 895029 - DNA, 25 bp, Mus musculus
cagtctccacaacgtgctgctgctc

SEQ ID NO: 895030 - DNA, 25 bp, Mus musculus
cagtctccacaaggtgctgctgctc

SEQ ID NO: 895031 - DNA, 25 bp, Mus musculus
cagtctcctcagagagtcagtcctt

SEQ ID NO: 895032 - DNA, 25 bp, Mus musculus
cagtctcctcagagtctgcgagaaa

SEQ ID NO: 895033 - DNA, 25 bp, Mus musculus
cagtctcctcagccaaaacaacagc

SEQ ID NO: 895034 - DNA, 25 bp, Mus musculus
cagtctcctcagccaaaacgacacc

SEQ ID NO: 895035 - DNA, 25 bp, Mus musculus
cagtctcctcaggcaaaacaacagc

SEQ ID NO: 895036 - DNA, 25 bp, Mus musculus
cagtctcctcaggcaaaacgacacc

SEQ ID NO: 895037 - DNA, 25 bp, Mus musculus
cagtctcctcagtgagtcagtcctt

SEQ ID NO: 895038 - DNA, 25 bp, Mus musculus
cagtctcctcagtgtctgcgagaaa

SEQ ID NO: 895039 - DNA, 25 bp, Mus musculus
cagtctctatcaaacgttgccgagg

SEQ ID NO: 895040 - DNA, 25 bp, Mus musculus
cagtctctatcaaaggttgccgagg

SEQ ID NO: 895041 - DNA, 25 bp, Mus musculus
cagtctctcactgcctgtgctgacc

SEQ ID NO: 895042 - DNA, 25 bp, Mus musculus
cagtctctcagtgcctgtgctgacc

SEQ ID NO: 895043 - DNA, 25 bp, Mus musculus
cagtctctggcttcagacaatgaat

SEQ ID NO: 895044 - DNA, 25 bp, Mus musculus
cagtctctgggttcagacaatgaat

SEQ ID NO: 895045 - DNA, 25 bp, Mus musculus
cagtctgacacaccaattaccaagg

SEQ ID NO: 895046 - DNA, 25 bp, Mus musculus
cagtctgacacagcaattaccaagg

SEQ ID NO: 895047 - DNA, 25 bp, Mus musculus
cagtctgatggcccagcagcagaag

SEQ ID NO: 895048 - DNA, 25 bp, Mus musculus
cagtctgatggcgcagcagcagaag

SEQ ID NO: 895049 - DNA, 25 bp, Mus musculus
cagtctgcaacacttgtttaatgaa

SEQ ID NO: 895050 - DNA, 25 bp, Mus musculus
cagtctgcaacagttgtttaatgaa

SEQ ID NO: 895051 - DNA, 25 bp, Mus musculus
cagtctgcagctcctaggtgctata

SEQ ID NO: 895052 - DNA, 25 bp, Mus musculus
cagtctgcaggtcctaggtgctata

SEQ ID NO: 895053 - DNA, 25 bp, Mus musculus
cagtctgctgccccggttgcgaggc

SEQ ID NO: 895054 - DNA, 25 bp, Mus musculus
cagtctgctggcccggttgcgaggc

SEQ ID NO: 895055 - DNA, 25 bp, Mus musculus
cagtctggagccgtccctacagccg

SEQ ID NO: 895056 - DNA, 25 bp, Mus musculus
cagtctggaggcgtccctacagccg

SEQ ID NO: 895057 - DNA, 25 bp, Mus musculus
cagtctggaggtcgcgtccctacag

SEQ ID NO: 895058 - DNA, 25 bp, Mus musculus
cagtctggaggtggcgtccctacag

SEQ ID NO: 895059 - DNA, 25 bp, Mus musculus
cagtctgggcaccttcatgccggca

SEQ ID NO: 895060 - DNA, 25 bp, Mus musculus
cagtctgggcacgttcatgccggca

SEQ ID NO: 895061 - DNA, 25 bp, Mus musculus
cagtctgggggacgaaagaccacag

SEQ ID NO: 895062 - DNA, 25 bp, Mus musculus
cagtctgggggaggaaagaccacag

SEQ ID NO: 895063 - DNA, 25 bp, Mus musculus
cagtctgtgcacatagtagaaaatg

SEQ ID NO: 895064 - DNA, 25 bp, Mus musculus
cagtctgtgcacttagtagaaaatg

SEQ ID NO: 895065 - DNA, 25 bp, Mus musculus
cagtcttcagcagatgaagccttat

SEQ ID NO: 895066 - DNA, 25 bp, Mus musculus
cagtcttcaggagatgaagccttat

SEQ ID NO: 895067 - DNA, 25 bp, Mus musculus
cagtcttcatctcactctggctcct

SEQ ID NO: 895068 - DNA, 25 bp, Mus musculus
cagtcttcatctgactctggctcct

SEQ ID NO: 895069 - DNA, 25 bp, Mus musculus
cagtcttctctgcaaacccaggctg

SEQ ID NO: 895070 - DNA, 25 bp, Mus musculus
cagtcttctctggaaacccaggctg

SEQ ID NO: 895071 - DNA, 25 bp, Mus musculus
cagtcttgctagcaccaatcatctg

SEQ ID NO: 895072 - DNA, 25 bp, Mus musculus
cagtcttgctagcagcaatcatctg

SEQ ID NO: 895073 - DNA, 25 bp, Mus musculus
cagtctttagctgacctgaataatg

SEQ ID NO: 895074 - DNA, 25 bp, Mus musculus
cagtctttaggtgacctgaataatg

SEQ ID NO: 895075 - DNA, 25 bp, Mus musculus
cagtgaaaacctccttgtttctggg

SEQ ID NO: 895076 - DNA, 25 bp, Mus musculus
cagtgaaaacctgcttgtttctggg

SEQ ID NO: 895077 - DNA, 25 bp, Mus musculus
cagtgaaaagaatccatcgaaggcc

SEQ ID NO: 895078 - DNA, 25 bp, Mus musculus
cagtgaaaagtatccatcgaaggcc

SEQ ID NO: 895079 - DNA, 25 bp, Mus musculus
cagtgaaaataacagccattctgag

SEQ ID NO: 895080 - DNA, 25 bp, Mus musculus
cagtgaaaataagagccattctgag

SEQ ID NO: 895081 - DNA, 25 bp, Mus musculus
cagtgaagagacacatactcaccaa

SEQ ID NO: 895082 - DNA, 25 bp, Mus musculus
cagtgaagaggacgtcccccagagg

SEQ ID NO: 895083 - DNA, 25 bp, Mus musculus
cagtgaagaggaggtcccccagagg

SEQ ID NO: 895084 - DNA, 25 bp, Mus musculus
cagtgaagagtcacatactcaccaa

SEQ ID NO: 895085 - DNA, 25 bp, Mus musculus
cagtgaagcgagctcacagagagtg

SEQ ID NO: 895086 - DNA, 25 bp, Mus musculus
cagtgaagcgaggtcacagagagtg

SEQ ID NO: 895087 - DNA, 25 bp, Mus musculus
cagtgaattggaacgggtatttctc

SEQ ID NO: 895088 - DNA, 25 bp, Mus musculus
cagtgaattggatcgggtatttctc

SEQ ID NO: 895089 - DNA, 25 bp, Mus musculus
cagtgacaagattgacagttatgcc

SEQ ID NO: 895090 - DNA, 25 bp, Mus musculus
cagtgacaaggaacagctgcaggca

SEQ ID NO: 895091 - DNA, 25 bp, Mus musculus
cagtgacaaggaactgctgcaggca

SEQ ID NO: 895092 - DNA, 25 bp, Mus musculus
cagtgacaaggccagcctccaggga

SEQ ID NO: 895093 - DNA, 25 bp, Mus musculus
cagtgacaaggcgagcctccaggga

SEQ ID NO: 895094 - DNA, 25 bp, Mus musculus
cagtgacaagtttgacagttatgcc

SEQ ID NO: 895095 - DNA, 25 bp, Mus musculus
cagtgacattcaagttcattctggc

SEQ ID NO: 895096 - DNA, 25 bp, Mus musculus
cagtgacattcatgttcattctggc

SEQ ID NO: 895097 - DNA, 25 bp, Mus musculus
cagtgaccaccatgagaacaagtac

SEQ ID NO: 895098 - DNA, 25 bp, Mus musculus
cagtgaccaccatgtgaacaagtac

SEQ ID NO: 895099 - DNA, 25 bp, Mus musculus
cagtgaccagaacatcaaactgaag

SEQ ID NO: 895100 - DNA, 25 bp, Mus musculus
cagtgaccagcctggcagcgagctg

SEQ ID NO: 895101 - DNA, 25 bp, Mus musculus
cagtgaccaggctggcagcgagctg

SEQ ID NO: 895102 - DNA, 25 bp, Mus musculus
cagtgaccagtacatcaaactgaag

SEQ ID NO: 895103 - DNA, 25 bp, Mus musculus
cagtgactaaaactagtagaaggag

SEQ ID NO: 895104 - DNA, 25 bp, Mus musculus
cagtgactaaaagtagtagaaggag

SEQ ID NO: 895105 - DNA, 25 bp, Mus musculus
cagtgactgtgttacatgctcctga

SEQ ID NO: 895106 - DNA, 25 bp, Mus musculus
cagtgactgtgttacttgaacccac

SEQ ID NO: 895107 - DNA, 25 bp, Mus musculus
cagtgactgtgttagatgctcctga

SEQ ID NO: 895108 - DNA, 25 bp, Mus musculus
cagtgactgtgttagttgaacccac

SEQ ID NO: 895109 - DNA, 25 bp, Mus musculus
cagtgacttccgtgctgggattttc

SEQ ID NO: 895110 - DNA, 25 bp, Mus musculus
cagtgacttccgtggtgggattttc

SEQ ID NO: 895111 - DNA, 25 bp, Mus musculus
cagtgagaaccagaccatcgtgctg

SEQ ID NO: 895112 - DNA, 25 bp, Mus musculus
cagtgagaaccagacggacagcatc

SEQ ID NO: 895113 - DNA, 25 bp, Mus musculus
cagtgagaaccagagcatcgtgctg

SEQ ID NO: 895114 - DNA, 25 bp, Mus musculus
cagtgagaaccagagggacagcatc

SEQ ID NO: 895115 - DNA, 25 bp, Mus musculus
cagtgagaacgtcacgaggctgtcg

SEQ ID NO: 895116 - DNA, 25 bp, Mus musculus
cagtgagaacgtcaggaggctgtcg

SEQ ID NO: 895117 - DNA, 25 bp, Mus musculus
cagtgagaagcgatattacttccac

SEQ ID NO: 895118 - DNA, 25 bp, Mus musculus
cagtgagaagggatattacttccac

SEQ ID NO: 895119 - DNA, 25 bp, Mus musculus
cagtgagaccagctgacaaagtcat

SEQ ID NO: 895120 - DNA, 25 bp, Mus musculus
cagtgagaccaggtgacaaagtcat

SEQ ID NO: 895121 - DNA, 25 bp, Mus musculus
cagtgagggaagagcctcaggagat

SEQ ID NO: 895122 - DNA, 25 bp, Mus musculus
cagtgagggaagtgcctcaggagat

SEQ ID NO: 895123 - DNA, 25 bp, Mus musculus
cagtgagtaaaaatcaacaagtgtg

SEQ ID NO: 895124 - DNA, 25 bp, Mus musculus
cagtgagtaaaaatgaacaagtgtg

SEQ ID NO: 895125 - DNA, 25 bp, Mus musculus
cagtgagtcccgcatctatggaaaa

SEQ ID NO: 895126 - DNA, 25 bp, Mus musculus
cagtgagtcccggatctatggaaaa

SEQ ID NO: 895127 - DNA, 25 bp, Mus musculus
cagtgatatcagcaaggaggattct

SEQ ID NO: 895128 - DNA, 25 bp, Mus musculus
cagtgatatcaggaaggaggattct

SEQ ID NO: 895129 - DNA, 25 bp, Mus musculus
cagtgatcagcttcagcgtcctctc

SEQ ID NO: 895130 - DNA, 25 bp, Mus musculus
cagtgatcaggttcagcgtcctctc

SEQ ID NO: 895131 - DNA, 25 bp, Mus musculus
cagtgatgatccacagacagaattt

SEQ ID NO: 895132 - DNA, 25 bp, Mus musculus
cagtgatgatccactgacagaattt

SEQ ID NO: 895133 - DNA, 25 bp, Mus musculus
cagtgattggagctctgatagctgt

SEQ ID NO: 895134 - DNA, 25 bp, Mus musculus
cagtgattggaggtctgatagctgt

SEQ ID NO: 895135 - DNA, 25 bp, Mus musculus
cagtgcaaaaagcctatcaccacag

SEQ ID NO: 895136 - DNA, 25 bp, Mus musculus
cagtgcaaaaaggctatcaccacag

SEQ ID NO: 895137 - DNA, 25 bp, Mus musculus
cagtgcaaaactaatgatggagggt

SEQ ID NO: 895138 - DNA, 25 bp, Mus musculus
cagtgcaaaagtaatgatggagggt

SEQ ID NO: 895139 - DNA, 25 bp, Mus musculus
cagtgcacactgcgtttaacagcat

SEQ ID NO: 895140 - DNA, 25 bp, Mus musculus
cagtgcacactgggtttaacagcat

SEQ ID NO: 895141 - DNA, 25 bp, Mus musculus
cagtgcacagctcgtatgcatggac

SEQ ID NO: 895142 - DNA, 25 bp, Mus musculus
cagtgcacagctggtatgcatggac

SEQ ID NO: 895143 - DNA, 25 bp, Mus musculus
cagtgcaccctgcaacagcttcaga

SEQ ID NO: 895144 - DNA, 25 bp, Mus musculus
cagtgcaccctggaacagcttcaga

SEQ ID NO: 895145 - DNA, 25 bp, Mus musculus
cagtgcagatcacaatcaagctcat

SEQ ID NO: 895146 - DNA, 25 bp, Mus musculus
cagtgcagatcagaatcaagctcat

SEQ ID NO: 895147 - DNA, 25 bp, Mus musculus
cagtgcagccagcactgtgccaggt

SEQ ID NO: 895148 - DNA, 25 bp, Mus musculus
cagtgcagccagcagtgtgccaggt

SEQ ID NO: 895149 - DNA, 25 bp, Mus musculus
cagtgcaggaggcacgactgacgtg

SEQ ID NO: 895150 - DNA, 25 bp, Mus musculus
cagtgcaggagggacgactgacgtg

SEQ ID NO: 895151 - DNA, 25 bp, Mus musculus
cagtgcagtgaccacaacatcaaac

SEQ ID NO: 895152 - DNA, 25 bp, Mus musculus
cagtgcagtgaccagaacatcaaac

SEQ ID NO: 895153 - DNA, 25 bp, Mus musculus
cagtgcattgccgacaaaccagagg

SEQ ID NO: 895154 - DNA, 25 bp, Mus musculus
cagtgcattggcgacaaaccagagg

SEQ ID NO: 895155 - DNA, 25 bp, Mus musculus
cagtgccaacatttaaacgagtgtg

SEQ ID NO: 895156 - DNA, 25 bp, Mus musculus
cagtgccaacctgtgtgtcaaccac

SEQ ID NO: 895157 - DNA, 25 bp, Mus musculus
cagtgccaacctttctacgtcttaa

SEQ ID NO: 895158 - DNA, 25 bp, Mus musculus
cagtgccaacgtgtgtgtcaaccac

SEQ ID NO: 895159 - DNA, 25 bp, Mus musculus
cagtgccaacgtttctacgtcttaa

SEQ ID NO: 895160 - DNA, 25 bp, Mus musculus
cagtgccaacttttaaacgagtgtg

SEQ ID NO: 895161 - DNA, 25 bp, Mus musculus
cagtgccagggacgtgtgaatgagg

SEQ ID NO: 895162 - DNA, 25 bp, Mus musculus
cagtgccagggaggtgtgaatgagg

SEQ ID NO: 895163 - DNA, 25 bp, Mus musculus
cagtgccatgacatcgacgagtgct

SEQ ID NO: 895164 - DNA, 25 bp, Mus musculus
cagtgccatgtcatcgacgagtgct

SEQ ID NO: 895165 - DNA, 25 bp, Mus musculus
cagtgcccagacctgtgttacattg

SEQ ID NO: 895166 - DNA, 25 bp, Mus musculus
cagtgcccagcagcatcactatttc

SEQ ID NO: 895167 - DNA, 25 bp, Mus musculus
cagtgcccagcatcactatttcatg

SEQ ID NO: 895168 - DNA, 25 bp, Mus musculus
cagtgcccaggagcatcactatttc

SEQ ID NO: 895169 - DNA, 25 bp, Mus musculus
cagtgcccaggatcactatttcatg

SEQ ID NO: 895170 - DNA, 25 bp, Mus musculus
cagtgcccagtcctgtgttacattg

SEQ ID NO: 895171 - DNA, 25 bp, Mus musculus
cagtgcccatagctggcggtccctg

SEQ ID NO: 895172 - DNA, 25 bp, Mus musculus
cagtgcccattgctggcggtccctg

SEQ ID NO: 895173 - DNA, 25 bp, Mus musculus
cagtgccccaaacgcttcaacgggc

SEQ ID NO: 895174 - DNA, 25 bp, Mus musculus
cagtgccccaaaggcttcaacgggc

SEQ ID NO: 895175 - DNA, 25 bp, Mus musculus
cagtgccgcacactctggaataaaa

SEQ ID NO: 895176 - DNA, 25 bp, Mus musculus
cagtgccgcacagtctggaataaaa

SEQ ID NO: 895177 - DNA, 25 bp, Mus musculus
cagtgccgctgcttccaaggagaag

SEQ ID NO: 895178 - DNA, 25 bp, Mus musculus
cagtgccgctgcttgcaaggagaag

SEQ ID NO: 895179 - DNA, 25 bp, Mus musculus
cagtgcctagatattgatgaatgtc

SEQ ID NO: 895180 - DNA, 25 bp, Mus musculus
cagtgcctagttattgatgaatgtc

SEQ ID NO: 895181 - DNA, 25 bp, Mus musculus
cagtgcctgacacccatggcagact

SEQ ID NO: 895182 - DNA, 25 bp, Mus musculus
cagtgcctgacaccgatggcagact

SEQ ID NO: 895183 - DNA, 25 bp, Mus musculus
cagtgcctgagaatcggaagagaaa

SEQ ID NO: 895184 - DNA, 25 bp, Mus musculus
cagtgcctgagaatgggaagagaaa

SEQ ID NO: 895185 - DNA, 25 bp, Mus musculus
cagtgcctgccacgtgagaagccat

SEQ ID NO: 895186 - DNA, 25 bp, Mus musculus
cagtgcctgccaggtgagaagccat

SEQ ID NO: 895187 - DNA, 25 bp, Mus musculus
cagtgccttcagagtgatccacctt

SEQ ID NO: 895188 - DNA, 25 bp, Mus musculus
cagtgccttcagctgccttggagca

SEQ ID NO: 895189 - DNA, 25 bp, Mus musculus
cagtgccttcaggtgccttggagca

SEQ ID NO: 895190 - DNA, 25 bp, Mus musculus
cagtgccttcagtgtgatccacctt

SEQ ID NO: 895191 - DNA, 25 bp, Mus musculus
cagtgcgcagcctgatgcagacagt

SEQ ID NO: 895192 - DNA, 25 bp, Mus musculus
cagtgcgcaggctgatgcagacagt

SEQ ID NO: 895193 - DNA, 25 bp, Mus musculus
cagtgcgcgccatgaggctgtagag

SEQ ID NO: 895194 - DNA, 25 bp, Mus musculus
cagtgcgcgcgatgaggctgtagag

SEQ ID NO: 895195 - DNA, 25 bp, Mus musculus
cagtgctcccagcggtgatctgctt

SEQ ID NO: 895196 - DNA, 25 bp, Mus musculus
cagtgctcccaggggtgatctgctt

SEQ ID NO: 895197 - DNA, 25 bp, Mus musculus
cagtgctgacagcgtccctccctaa

SEQ ID NO: 895198 - DNA, 25 bp, Mus musculus
cagtgctgacagggtccctccctaa

SEQ ID NO: 895199 - DNA, 25 bp, Mus musculus
cagtgcttagagaacgatgtggaca

SEQ ID NO: 895200 - DNA, 25 bp, Mus musculus
cagtgcttagctcttctgtcggaaa

SEQ ID NO: 895201 - DNA, 25 bp, Mus musculus
cagtgcttaggtcttctgtcggaaa

SEQ ID NO: 895202 - DNA, 25 bp, Mus musculus
cagtgcttagtgaacgatgtggaca

SEQ ID NO: 895203 - DNA, 25 bp, Mus musculus
cagtggaagaagctcagcaacttat

SEQ ID NO: 895204 - DNA, 25 bp, Mus musculus
cagtggaagaagctgagcaacttat

SEQ ID NO: 895205 - DNA, 25 bp, Mus musculus
cagtggaagcaactgtgaaatcaag

SEQ ID NO: 895206 - DNA, 25 bp, Mus musculus
cagtggaagcaagtgtgaaatcaag

SEQ ID NO: 895207 - DNA, 25 bp, Mus musculus
cagtggaccaaattttcaggatggc

SEQ ID NO: 895208 - DNA, 25 bp, Mus musculus
cagtggaccatattttcaggatggc

SEQ ID NO: 895209 - DNA, 25 bp, Mus musculus
cagtggagactgagcaaatcggcca

SEQ ID NO: 895210 - DNA, 25 bp, Mus musculus
cagtggagactgctcttgctttgtg

SEQ ID NO: 895211 - DNA, 25 bp, Mus musculus
cagtggagactggtcttgctttgtg

SEQ ID NO: 895212 - DNA, 25 bp, Mus musculus
cagtggagactgtgcaaatcggcca

SEQ ID NO: 895213 - DNA, 25 bp, Mus musculus
cagtggagccagagcctccttcccc

SEQ ID NO: 895214 - DNA, 25 bp, Mus musculus
cagtggagccagtgcctccttcccc

SEQ ID NO: 895215 - DNA, 25 bp, Mus musculus
cagtggataaagctctccagagctt

SEQ ID NO: 895216 - DNA, 25 bp, Mus musculus
cagtggataaaggtctccagagctt

SEQ ID NO: 895217 - DNA, 25 bp, Mus musculus
cagtggataaatagatgcccgtgtg

SEQ ID NO: 895218 - DNA, 25 bp, Mus musculus
cagtggataaattgatgcccgtgtg

SEQ ID NO: 895219 - DNA, 25 bp, Mus musculus
cagtggatcacaccctgaaagcttt

SEQ ID NO: 895220 - DNA, 25 bp, Mus musculus
cagtggatcagaccctgaaagcttt

SEQ ID NO: 895221 - DNA, 25 bp, Mus musculus
cagtggatcgcaaaaggcctactgg

SEQ ID NO: 895222 - DNA, 25 bp, Mus musculus
cagtggatcggaaaaggcctactgg

SEQ ID NO: 895223 - DNA, 25 bp, Mus musculus
cagtggattctgaccacctcatcct

SEQ ID NO: 895224 - DNA, 25 bp, Mus musculus
cagtggattctgtccacctcatcct

SEQ ID NO: 895225 - DNA, 25 bp, Mus musculus
cagtggcaagcaaaagaatgatgag

SEQ ID NO: 895226 - DNA, 25 bp, Mus musculus
cagtggcaagcaaatgaatgatgag

SEQ ID NO: 895227 - DNA, 25 bp, Mus musculus
cagtggcaatatcatgccaacccct

SEQ ID NO: 895228 - DNA, 25 bp, Mus musculus
cagtggcaatatgatgccaacccct

SEQ ID NO: 895229 - DNA, 25 bp, Mus musculus
cagtggcaccctcaccaccgcgtcc

SEQ ID NO: 895230 - DNA, 25 bp, Mus musculus
cagtggcaccctcagcaccgcgtcc

SEQ ID NO: 895231 - DNA, 25 bp, Mus musculus
cagtggcactgtcacatcaaacctg

SEQ ID NO: 895232 - DNA, 25 bp, Mus musculus
cagtggcactgtcagatcaaacctg

SEQ ID NO: 895233 - DNA, 25 bp, Mus musculus
cagtggcataagctacagaaagtta

SEQ ID NO: 895234 - DNA, 25 bp, Mus musculus
cagtggcataaggtacagaaagtta

SEQ ID NO: 895235 - DNA, 25 bp, Mus musculus
cagtggcatgaaaacgcccttgctg

SEQ ID NO: 895236 - DNA, 25 bp, Mus musculus
cagtggcatgaaaaggcccttgctg

SEQ ID NO: 895237 - DNA, 25 bp, Mus musculus
cagtggccccagctgcccccagcat

SEQ ID NO: 895238 - DNA, 25 bp, Mus musculus
cagtggccccaggtgcccccagcat

SEQ ID NO: 895239 - DNA, 25 bp, Mus musculus
cagtggcgagaccgcggcatggaac

SEQ ID NO: 895240 - DNA, 25 bp, Mus musculus
cagtggcgagaccggggcatggaac

SEQ ID NO: 895241 - DNA, 25 bp, Mus musculus
cagtggctgcaaaaacttgagaatt

SEQ ID NO: 895242 - DNA, 25 bp, Mus musculus
cagtggctgcaaaaaggtcctggtc

SEQ ID NO: 895243 - DNA, 25 bp, Mus musculus
cagtggctgcaaaatcttgagaatt

SEQ ID NO: 895244 - DNA, 25 bp, Mus musculus
cagtggctgcaaaatggtcctggtc

SEQ ID NO: 895245 - DNA, 25 bp, Mus musculus
cagtggctgcagcagtgaacagtca

SEQ ID NO: 895246 - DNA, 25 bp, Mus musculus
cagtggctgcaggagtgaacagtca

SEQ ID NO: 895247 - DNA, 25 bp, Mus musculus
cagtggctggaactctaaacgattt

SEQ ID NO: 895248 - DNA, 25 bp, Mus musculus
cagtggctggaagtctaaacgattt

SEQ ID NO: 895249 - DNA, 25 bp, Mus musculus
cagtggctggctatcgccccatcga

SEQ ID NO: 895250 - DNA, 25 bp, Mus musculus
cagtggctggctatggccccatcga

SEQ ID NO: 895251 - DNA, 25 bp, Mus musculus
cagtgggaaaggcagtcatgtggct

SEQ ID NO: 895252 - DNA, 25 bp, Mus musculus
cagtgggaaagggagtcatgtggct

SEQ ID NO: 895253 - DNA, 25 bp, Mus musculus
cagtgggaagatgactctaaaggag

SEQ ID NO: 895254 - DNA, 25 bp, Mus musculus
cagtgggaagttgactctaaaggag

SEQ ID NO: 895255 - DNA, 25 bp, Mus musculus
cagtgggacctcagcctgactgctg

SEQ ID NO: 895256 - DNA, 25 bp, Mus musculus
cagtgggacctcaggctgactgctg

SEQ ID NO: 895257 - DNA, 25 bp, Mus musculus
cagtgggagacgagcctctttcacg

SEQ ID NO: 895258 - DNA, 25 bp, Mus musculus
cagtgggagacgaggctctttcacg

SEQ ID NO: 895259 - DNA, 25 bp, Mus musculus
cagtgggcaacgctctggagggcat

SEQ ID NO: 895260 - DNA, 25 bp, Mus musculus
cagtgggcaaggctctggagggcat

SEQ ID NO: 895261 - DNA, 25 bp, Mus musculus
cagtgggcagagaatcccagtggcg

SEQ ID NO: 895262 - DNA, 25 bp, Mus musculus
cagtgggcagagtatcccagtggcg

SEQ ID NO: 895263 - DNA, 25 bp, Mus musculus
cagtgggctggtcacccgcgtgttc

SEQ ID NO: 895264 - DNA, 25 bp, Mus musculus
cagtgggctggtcagccgcgtgttc

SEQ ID NO: 895265 - DNA, 25 bp, Mus musculus
cagtgggggctgcgcggagttcaca

SEQ ID NO: 895266 - DNA, 25 bp, Mus musculus
cagtgggggctgggcggagttcaca

SEQ ID NO: 895267 - DNA, 25 bp, Mus musculus
cagtgggtgcccgaccagccgatgt

SEQ ID NO: 895268 - DNA, 25 bp, Mus musculus
cagtgggtgcccgacccgatgtcct

SEQ ID NO: 895269 - DNA, 25 bp, Mus musculus
cagtgggtgcccgagcagccgatgt

SEQ ID NO: 895270 - DNA, 25 bp, Mus musculus
cagtgggtgcccgagccgatgtcct

SEQ ID NO: 895271 - DNA, 25 bp, Mus musculus
cagtgggtggagctggaacgcacgg

SEQ ID NO: 895272 - DNA, 25 bp, Mus musculus
cagtgggtggaggtggaacgcacgg

SEQ ID NO: 895273 - DNA, 25 bp, Mus musculus
cagtgggtttctcgatcttgggtct

SEQ ID NO: 895274 - DNA, 25 bp, Mus musculus
cagtgggtttctggatcttgggtct

SEQ ID NO: 895275 - DNA, 25 bp, Mus musculus
cagtggttagcgtgtcgtagtcact

SEQ ID NO: 895276 - DNA, 25 bp, Mus musculus
cagtggttagggtgtcgtagtcact

SEQ ID NO: 895277 - DNA, 25 bp, Mus musculus
cagtgtaaaaacagaaagtgtggag

SEQ ID NO: 895278 - DNA, 25 bp, Mus musculus
cagtgtaaaatcagaaagtgtggag

SEQ ID NO: 895279 - DNA, 25 bp, Mus musculus
cagtgtaaagattgcaaattcaact

SEQ ID NO: 895280 - DNA, 25 bp, Mus musculus
cagtgtaaagctctatgtcagaaac

SEQ ID NO: 895281 - DNA, 25 bp, Mus musculus
cagtgtaaaggtctatgtcagaaac

SEQ ID NO: 895282 - DNA, 25 bp, Mus musculus
cagtgtaaagtttgcaaattcaact

SEQ ID NO: 895283 - DNA, 25 bp, Mus musculus
cagtgtagaactatttttttgaata

SEQ ID NO: 895284 - DNA, 25 bp, Mus musculus
cagtgtagaactttttttttgaata

SEQ ID NO: 895285 - DNA, 25 bp, Mus musculus
cagtgtcaagctggccaaagtggag

SEQ ID NO: 895286 - DNA, 25 bp, Mus musculus
cagtgtcaaggtggccaaagtggag

SEQ ID NO: 895287 - DNA, 25 bp, Mus musculus
cagtgtcaatcaatcgtgtcccaga

SEQ ID NO: 895288 - DNA, 25 bp, Mus musculus
cagtgtcaatcaatggtgtcccaga

SEQ ID NO: 895289 - DNA, 25 bp, Mus musculus
cagtgtcaggagcacattgccaggg

SEQ ID NO: 895290 - DNA, 25 bp, Mus musculus
cagtgtcaggagcagattgccaggg

SEQ ID NO: 895291 - DNA, 25 bp, Mus musculus
cagtgtcagtatctggtccagtgtg

SEQ ID NO: 895292 - DNA, 25 bp, Mus musculus
cagtgtcagtatgtggtccagtgtg

SEQ ID NO: 895293 - DNA, 25 bp, Mus musculus
cagtgtcatcagcggtggtctcagt

SEQ ID NO: 895294 - DNA, 25 bp, Mus musculus
cagtgtcatcaggggtggtctcagt

SEQ ID NO: 895295 - DNA, 25 bp, Mus musculus
cagtgtccagagctttgcctgtggc

SEQ ID NO: 895296 - DNA, 25 bp, Mus musculus
cagtgtccagaggtttgcctgtggc

SEQ ID NO: 895297 - DNA, 25 bp, Mus musculus
cagtgtcccaccaactccagggtga

SEQ ID NO: 895298 - DNA, 25 bp, Mus musculus
cagtgtcccaccaagtccagggtga

SEQ ID NO: 895299 - DNA, 25 bp, Mus musculus
cagtgtcgcaagcacaactgcgtga

SEQ ID NO: 895300 - DNA, 25 bp, Mus musculus
cagtgtcgcaaggacaactgcgtga

SEQ ID NO: 895301 - DNA, 25 bp, Mus musculus
cagtgtctagatattgatgaatgcc

SEQ ID NO: 895302 - DNA, 25 bp, Mus musculus
cagtgtctagctggaaatggctaca

SEQ ID NO: 895303 - DNA, 25 bp, Mus musculus
cagtgtctaggtggaaatggctaca

SEQ ID NO: 895304 - DNA, 25 bp, Mus musculus
cagtgtctagttattgatgaatgcc

SEQ ID NO: 895305 - DNA, 25 bp, Mus musculus
cagtgtgaagacattgacgagtgtg

SEQ ID NO: 895306 - DNA, 25 bp, Mus musculus
cagtgtgaagcgctcaggatgctac

SEQ ID NO: 895307 - DNA, 25 bp, Mus musculus
cagtgtgaagggctcaggatgctac

SEQ ID NO: 895308 - DNA, 25 bp, Mus musculus
cagtgtgaagtcattgacgagtgtg

SEQ ID NO: 895309 - DNA, 25 bp, Mus musculus
cagtgtgaccctaccgacccttgac

SEQ ID NO: 895310 - DNA, 25 bp, Mus musculus
cagtgtgaccgtaccgacccttgac

SEQ ID NO: 895311 - DNA, 25 bp, Mus musculus
cagtgtgaggacatggatgaatgtg

SEQ ID NO: 895312 - DNA, 25 bp, Mus musculus
cagtgtgaggtcatggatgaatgtg

SEQ ID NO: 895313 - DNA, 25 bp, Mus musculus
cagtgtgagtatatacacttctgat

SEQ ID NO: 895314 - DNA, 25 bp, Mus musculus
cagtgtgagtttatacacttctgat

SEQ ID NO: 895315 - DNA, 25 bp, Mus musculus
cagtgtgcccagcaccctgagctca

SEQ ID NO: 895316 - DNA, 25 bp, Mus musculus
cagtgtgcccaggaccctgagctca

SEQ ID NO: 895317 - DNA, 25 bp, Mus musculus
cagtgtgcctctcgatgcacttcca

SEQ ID NO: 895318 - DNA, 25 bp, Mus musculus
cagtgtgcctctggatgcacttcca

SEQ ID NO: 895319 - DNA, 25 bp, Mus musculus
cagtgtgcgaagatgtggatgagtg

SEQ ID NO: 895320 - DNA, 25 bp, Mus musculus
cagtgtgcgaagttgtggatgagtg

SEQ ID NO: 895321 - DNA, 25 bp, Mus musculus
cagtgtggagcggcagtctctggat

SEQ ID NO: 895322 - DNA, 25 bp, Mus musculus
cagtgtggaggggcagtctctggat

SEQ ID NO: 895323 - DNA, 25 bp, Mus musculus
cagtgtgtcccacatttccagaata

SEQ ID NO: 895324 - DNA, 25 bp, Mus musculus
cagtgtgtcccagatttccagaata

SEQ ID NO: 895325 - DNA, 25 bp, Mus musculus
cagtgtgtgaagcaaggagaactca

SEQ ID NO: 895326 - DNA, 25 bp, Mus musculus
cagtgtgtgaaggaaggagaactca

SEQ ID NO: 895327 - DNA, 25 bp, Mus musculus
cagtgtgtgcaaaaaatccgagagg

SEQ ID NO: 895328 - DNA, 25 bp, Mus musculus
cagtgtgtgcaataaatccgagagg

SEQ ID NO: 895329 - DNA, 25 bp, Mus musculus
cagtgtgtggatgtggacgagtgtg

SEQ ID NO: 895330 - DNA, 25 bp, Mus musculus
cagtgtgtggttgtggacgagtgtg

SEQ ID NO: 895331 - DNA, 25 bp, Mus musculus
cagtgtgtgttattcgactctgggc

SEQ ID NO: 895332 - DNA, 25 bp, Mus musculus
cagtgtgtgttattggactctgggc

SEQ ID NO: 895333 - DNA, 25 bp, Mus musculus
cagtgttacaagagttggtgaaaag

SEQ ID NO: 895334 - DNA, 25 bp, Mus musculus
cagtgttacaagtgttggtgaaaag

SEQ ID NO: 895335 - DNA, 25 bp, Mus musculus
cagtgttacacgattcaactaatga

SEQ ID NO: 895336 - DNA, 25 bp, Mus musculus
cagtgttacaggattcaactaatga

SEQ ID NO: 895337 - DNA, 25 bp, Mus musculus
cagtgttgctaacgacaaggcctgt

SEQ ID NO: 895338 - DNA, 25 bp, Mus musculus
cagtgttgctaaggacaaggcctgt

SEQ ID NO: 895339 - DNA, 25 bp, Mus musculus
cagtgttggattcttcggggcagag

SEQ ID NO: 895340 - DNA, 25 bp, Mus musculus
cagtgttggattgttcggggcagag

SEQ ID NO: 895341 - DNA, 25 bp, Mus musculus
cagtgtttaataaagtagattatga

SEQ ID NO: 895342 - DNA, 25 bp, Mus musculus
cagtgtttaatatagtagattatga

SEQ ID NO: 895343 - DNA, 25 bp, Mus musculus
cagttaagagaacagcacattagtt

SEQ ID NO: 895344 - DNA, 25 bp, Mus musculus
cagttaagagcatcgctgcagagca

SEQ ID NO: 895345 - DNA, 25 bp, Mus musculus
cagttaagaggatcgctgcagagca

SEQ ID NO: 895346 - DNA, 25 bp, Mus musculus
cagttaagagtacagcacattagtt

SEQ ID NO: 895347 - DNA, 25 bp, Mus musculus
cagttaattgcccgggaagagtcct

SEQ ID NO: 895348 - DNA, 25 bp, Mus musculus
cagttaattggccgggaagagtcct

SEQ ID NO: 895349 - DNA, 25 bp, Mus musculus
cagttacaattacacgggatttgac

SEQ ID NO: 895350 - DNA, 25 bp, Mus musculus
cagttacaattacaggggatttgac

SEQ ID NO: 895351 - DNA, 25 bp, Mus musculus
cagttacagagaagtcataaagctt

SEQ ID NO: 895352 - DNA, 25 bp, Mus musculus
cagttacagagatgtcataaagctt

SEQ ID NO: 895353 - DNA, 25 bp, Mus musculus
cagttaccacagcacaacaacaggc

SEQ ID NO: 895354 - DNA, 25 bp, Mus musculus
cagttaccacaggacaacaacaggc

SEQ ID NO: 895355 - DNA, 25 bp, Mus musculus
cagttacggagggcagtaaatcgtc

SEQ ID NO: 895356 - DNA, 25 bp, Mus musculus
cagttacggagggctgtaaatcgtc

SEQ ID NO: 895357 - DNA, 25 bp, Mus musculus
cagttataacatttcatgtgactgg

SEQ ID NO: 895358 - DNA, 25 bp, Mus musculus
cagttataacatttgatgtgactgg

SEQ ID NO: 895359 - DNA, 25 bp, Mus musculus
cagttatgtcaggacttcacctttt

SEQ ID NO: 895360 - DNA, 25 bp, Mus musculus
cagttatgtcaggagttcacctttt

SEQ ID NO: 895361 - DNA, 25 bp, Mus musculus
cagttattggagtccatgtcagacg

SEQ ID NO: 895362 - DNA, 25 bp, Mus musculus
cagttattggtgtccatgtcagacg

SEQ ID NO: 895363 - DNA, 25 bp, Mus musculus
cagttattgtggattctcaaacaag

SEQ ID NO: 895364 - DNA, 25 bp, Mus musculus
cagttattgtggtttctcaaacaag

SEQ ID NO: 895365 - DNA, 25 bp, Mus musculus
cagttcaaacagctctatgaactgg

SEQ ID NO: 895366 - DNA, 25 bp, Mus musculus
cagttcaaacaggtctatgaactgg

SEQ ID NO: 895367 - DNA, 25 bp, Mus musculus
cagttcaaatcccaagttccgtgag

SEQ ID NO: 895368 - DNA, 25 bp, Mus musculus
cagttcaaatcccatgttccgtgag

SEQ ID NO: 895369 - DNA, 25 bp, Mus musculus
cagttcaaccggcagaatttgccag

SEQ ID NO: 895370 - DNA, 25 bp, Mus musculus
cagttcaaccgggagaatttgccag

SEQ ID NO: 895371 - DNA, 25 bp, Mus musculus
cagttcaaggagatgccagaccagt

SEQ ID NO: 895372 - DNA, 25 bp, Mus musculus
cagttcaaggtgatgccagaccagt

SEQ ID NO: 895373 - DNA, 25 bp, Mus musculus
cagttcacagaaataccagatcctg

SEQ ID NO: 895374 - DNA, 25 bp, Mus musculus
cagttcacagtaataccagatcctg

SEQ ID NO: 895375 - DNA, 25 bp, Mus musculus
cagttcagccaggacggagcggaca

SEQ ID NO: 895376 - DNA, 25 bp, Mus musculus
cagttcagccaggagggagcggaca

SEQ ID NO: 895377 - DNA, 25 bp, Mus musculus
cagttcagcctactcggttccagga

SEQ ID NO: 895378 - DNA, 25 bp, Mus musculus
cagttcagcctactgggttccagga

SEQ ID NO: 895379 - DNA, 25 bp, Mus musculus
cagttcatccgacagctgcagcaat

SEQ ID NO: 895380 - DNA, 25 bp, Mus musculus
cagttcatccgagagctgcagcaat

SEQ ID NO: 895381 - DNA, 25 bp, Mus musculus
cagttcatccggaaaatgacccgct

SEQ ID NO: 895382 - DNA, 25 bp, Mus musculus
cagttcatccggtaaatgacccgct

SEQ ID NO: 895383 - DNA, 25 bp, Mus musculus
cagttcatgaaatcttttgagcata

SEQ ID NO: 895384 - DNA, 25 bp, Mus musculus
cagttcatgacgttacgtccccatt

SEQ ID NO: 895385 - DNA, 25 bp, Mus musculus
cagttcatgaggttacgtccccatt

SEQ ID NO: 895386 - DNA, 25 bp, Mus musculus
cagttcatgatatcttttgagcata

SEQ ID NO: 895387 - DNA, 25 bp, Mus musculus
cagttcattgcacagtccggcgggc

SEQ ID NO: 895388 - DNA, 25 bp, Mus musculus
cagttcattgcagagtccggcgggc

SEQ ID NO: 895389 - DNA, 25 bp, Mus musculus
cagttccaagccctggagatggagt

SEQ ID NO: 895390 - DNA, 25 bp, Mus musculus
cagttccaaggcctggagatggagt

SEQ ID NO: 895391 - DNA, 25 bp, Mus musculus
cagttccagaaagtcatcacagaat

SEQ ID NO: 895392 - DNA, 25 bp, Mus musculus
cagttccagaaagtgatcacagaat

SEQ ID NO: 895393 - DNA, 25 bp, Mus musculus
cagttccgtcagctatctacagaag

SEQ ID NO: 895394 - DNA, 25 bp, Mus musculus
cagttccgtcaggtatctacagaag

SEQ ID NO: 895395 - DNA, 25 bp, Mus musculus
cagttcctaccacatcctgaatacc

SEQ ID NO: 895396 - DNA, 25 bp, Mus musculus
cagttcctaccagatcctgaatacc

SEQ ID NO: 895397 - DNA, 25 bp, Mus musculus
cagttcctagctgtcccaccaagga

SEQ ID NO: 895398 - DNA, 25 bp, Mus musculus
cagttcctagctgtgccaccaagga

SEQ ID NO: 895399 - DNA, 25 bp, Mus musculus
cagttcctcccgaacgcgctcaagg

SEQ ID NO: 895400 - DNA, 25 bp, Mus musculus
cagttcctcccgaaggcgctcaagg

SEQ ID NO: 895401 - DNA, 25 bp, Mus musculus
cagttcgaggcggctgaagaatact

SEQ ID NO: 895402 - DNA, 25 bp, Mus musculus
cagttcgagggggctgaagaatact

SEQ ID NO: 895403 - DNA, 25 bp, Mus musculus
cagttcgcagatacacttttggcgt

SEQ ID NO: 895404 - DNA, 25 bp, Mus musculus
cagttcgcagcaggcagagtaagaa

SEQ ID NO: 895405 - DNA, 25 bp, Mus musculus
cagttcgcaggaggcagagtaagaa

SEQ ID NO: 895406 - DNA, 25 bp, Mus musculus
cagttcgcagttacacttttggcgt

SEQ ID NO: 895407 - DNA, 25 bp, Mus musculus
cagttcgctgttgtcatgagcaatg

SEQ ID NO: 895408 - DNA, 25 bp, Mus musculus
cagttcgctgttgtgatgagcaatg

SEQ ID NO: 895409 - DNA, 25 bp, Mus musculus
cagttcgtacagcctttgaaatatg

SEQ ID NO: 895410 - DNA, 25 bp, Mus musculus
cagttcgtacaggctttgaaatatg

SEQ ID NO: 895411 - DNA, 25 bp, Mus musculus
cagttcgttgccaacgtcatgcagg

SEQ ID NO: 895412 - DNA, 25 bp, Mus musculus
cagttcgttgccaaggtcatgcagg

SEQ ID NO: 895413 - DNA, 25 bp, Mus musculus
cagttctcagacttggattcagccg

SEQ ID NO: 895414 - DNA, 25 bp, Mus musculus
cagttctcagagccccgtattcgag

SEQ ID NO: 895415 - DNA, 25 bp, Mus musculus
cagttctcagtcttggattcagccg

SEQ ID NO: 895416 - DNA, 25 bp, Mus musculus
cagttctcagtgccccgtattcgag

SEQ ID NO: 895417 - DNA, 25 bp, Mus musculus
cagttctcccagcttgttcctcaaa

SEQ ID NO: 895418 - DNA, 25 bp, Mus musculus
cagttctcccaggttgttcctcaaa

SEQ ID NO: 895419 - DNA, 25 bp, Mus musculus
cagttctctgttcaccccttcccac

SEQ ID NO: 895420 - DNA, 25 bp, Mus musculus
cagttctctgttcacgatatgcagt

SEQ ID NO: 895421 - DNA, 25 bp, Mus musculus
cagttctctgttcagcccttcccac

SEQ ID NO: 895422 - DNA, 25 bp, Mus musculus
cagttctctgttcaggatatgcagt

SEQ ID NO: 895423 - DNA, 25 bp, Mus musculus
cagttctgccagcgcctgtgagaga

SEQ ID NO: 895424 - DNA, 25 bp, Mus musculus
cagttctgccagggcctgtgagaga

SEQ ID NO: 895425 - DNA, 25 bp, Mus musculus
cagttctgggaactctccaggcttt

SEQ ID NO: 895426 - DNA, 25 bp, Mus musculus
cagttctgggaagtctccaggcttt

SEQ ID NO: 895427 - DNA, 25 bp, Mus musculus
cagttcttcccgatgatgccaccgg

SEQ ID NO: 895428 - DNA, 25 bp, Mus musculus
cagttcttcccgttgatgccaccgg

SEQ ID NO: 895429 - DNA, 25 bp, Mus musculus
cagttgacaccagccgtctaccctg

SEQ ID NO: 895430 - DNA, 25 bp, Mus musculus
cagttgacaccgaacagtccaattt

SEQ ID NO: 895431 - DNA, 25 bp, Mus musculus
cagttgacacgagccgtctaccctg

SEQ ID NO: 895432 - DNA, 25 bp, Mus musculus
cagttgacacggaacagtccaattt

SEQ ID NO: 895433 - DNA, 25 bp, Mus musculus
cagttgacagctctgttctggaagg

SEQ ID NO: 895434 - DNA, 25 bp, Mus musculus
cagttgacaggtctgttctggaagg

SEQ ID NO: 895435 - DNA, 25 bp, Mus musculus
cagttgaccccacgccctgcaggtc

SEQ ID NO: 895436 - DNA, 25 bp, Mus musculus
cagttgaccccaggccctgcaggtc

SEQ ID NO: 895437 - DNA, 25 bp, Mus musculus
cagttgatccgagacgagtatgagg

SEQ ID NO: 895438 - DNA, 25 bp, Mus musculus
cagttgatccgagaggagtatgagg

SEQ ID NO: 895439 - DNA, 25 bp, Mus musculus
cagttgcataaaagctgtgaggagg

SEQ ID NO: 895440 - DNA, 25 bp, Mus musculus
cagttgcataaatgctgtgaggagg

SEQ ID NO: 895441 - DNA, 25 bp, Mus musculus
cagttgccacaccaaataccgaagc

SEQ ID NO: 895442 - DNA, 25 bp, Mus musculus
cagttgccacaccaaatataaacta

SEQ ID NO: 895443 - DNA, 25 bp, Mus musculus
cagttgccacaccatataccgaagc

SEQ ID NO: 895444 - DNA, 25 bp, Mus musculus
cagttgccacaccatatataaacta

SEQ ID NO: 895445 - DNA, 25 bp, Mus musculus
cagttggaggtggaccacgaccaca

SEQ ID NO: 895446 - DNA, 25 bp, Mus musculus
cagttggaggtggagcacgaccaca

SEQ ID NO: 895447 - DNA, 25 bp, Mus musculus
cagttggatgaaaccctgtcttcat

SEQ ID NO: 895448 - DNA, 25 bp, Mus musculus
cagttggatgaaacgctgtcttcat

SEQ ID NO: 895449 - DNA, 25 bp, Mus musculus
cagttggctggacggaaggtggctg

SEQ ID NO: 895450 - DNA, 25 bp, Mus musculus
cagttggctggagggaaggtggctg

SEQ ID NO: 895451 - DNA, 25 bp, Mus musculus
cagttggtacagcatcagtatggca

SEQ ID NO: 895452 - DNA, 25 bp, Mus musculus
cagttggtacaggatcagtatggca

SEQ ID NO: 895453 - DNA, 25 bp, Mus musculus
cagttgtcaaagataatactaaata

SEQ ID NO: 895454 - DNA, 25 bp, Mus musculus
cagttgtcaaagttaatactaaata

SEQ ID NO: 895455 - DNA, 25 bp, Mus musculus
cagttgtgtgactatgcaagctgcg

SEQ ID NO: 895456 - DNA, 25 bp, Mus musculus
cagttgtgtgtctatgcaagctgcg

SEQ ID NO: 895457 - DNA, 25 bp, Mus musculus
cagttgttcatgacctgaaggggaa

SEQ ID NO: 895458 - DNA, 25 bp, Mus musculus
cagttgttcatgtcctgaaggggaa

SEQ ID NO: 895459 - DNA, 25 bp, Mus musculus
cagtttactttcaacgtgccatact

SEQ ID NO: 895460 - DNA, 25 bp, Mus musculus
cagtttactttcaaggtgccatact

SEQ ID NO: 895461 - DNA, 25 bp, Mus musculus
cagtttagaagacggctgtcaaatc

SEQ ID NO: 895462 - DNA, 25 bp, Mus musculus
cagtttagaagagggctgtcaaatc

SEQ ID NO: 895463 - DNA, 25 bp, Mus musculus
cagtttatcaaactcatgtaggaaa

SEQ ID NO: 895464 - DNA, 25 bp, Mus musculus
cagtttatcaaagtcatgtaggaaa

SEQ ID NO: 895465 - DNA, 25 bp, Mus musculus
cagtttatcccgagccggcgattgg

SEQ ID NO: 895466 - DNA, 25 bp, Mus musculus
cagtttatcccgtgccggcgattgg

SEQ ID NO: 895467 - DNA, 25 bp, Mus musculus
cagtttattctgccgggagggaagc

SEQ ID NO: 895468 - DNA, 25 bp, Mus musculus
cagtttattctggcgggagggaagc

SEQ ID NO: 895469 - DNA, 25 bp, Mus musculus
cagtttccacagaatggactcgcta

SEQ ID NO: 895470 - DNA, 25 bp, Mus musculus
cagtttccacagtatggactcgcta

SEQ ID NO: 895471 - DNA, 25 bp, Mus musculus
cagtttctcaagcgttgagctccat

SEQ ID NO: 895472 - DNA, 25 bp, Mus musculus
cagtttctcaagggttgagctccat

SEQ ID NO: 895473 - DNA, 25 bp, Mus musculus
cagtttctcaatcagctcatcctgt

SEQ ID NO: 895474 - DNA, 25 bp, Mus musculus
cagtttctcaatgagctcatcctgt

SEQ ID NO: 895475 - DNA, 25 bp, Mus musculus
cagtttctcgcacagtgttcctgac

SEQ ID NO: 895476 - DNA, 25 bp, Mus musculus
cagtttctcgcacatatattaccaa

SEQ ID NO: 895477 - DNA, 25 bp, Mus musculus
cagtttctcgcagagtgttcctgac

SEQ ID NO: 895478 - DNA, 25 bp, Mus musculus
cagtttctcgcagatatattaccaa

SEQ ID NO: 895479 - DNA, 25 bp, Mus musculus
cagtttctctaccacgtctgtcacc

SEQ ID NO: 895480 - DNA, 25 bp, Mus musculus
cagtttctctaccaggtctgtcacc

SEQ ID NO: 895481 - DNA, 25 bp, Mus musculus
cagtttctgcagacttgtactggtt

SEQ ID NO: 895482 - DNA, 25 bp, Mus musculus
cagtttctgcagtcttgtactggtt

SEQ ID NO: 895483 - DNA, 25 bp, Mus musculus
cagtttcttgctctggaataaaagc

SEQ ID NO: 895484 - DNA, 25 bp, Mus musculus
cagtttcttggtctggaataaaagc

SEQ ID NO: 895485 - DNA, 25 bp, Mus musculus
cagtttgcaataatctctgaaccaa

SEQ ID NO: 895486 - DNA, 25 bp, Mus musculus
cagtttgcaataatgtctgaaccaa

SEQ ID NO: 895487 - DNA, 25 bp, Mus musculus
cagtttgctttgcagcatgggattc

SEQ ID NO: 895488 - DNA, 25 bp, Mus musculus
cagtttgctttggagcatgggattc

SEQ ID NO: 895489 - DNA, 25 bp, Mus musculus
cagtttggagcacgtaccatgcggg

SEQ ID NO: 895490 - DNA, 25 bp, Mus musculus
cagtttggagcctcacccgggtggc

SEQ ID NO: 895491 - DNA, 25 bp, Mus musculus
cagtttggaggacgtaccatgcggg

SEQ ID NO: 895492 - DNA, 25 bp, Mus musculus
cagtttggaggctcacccgggtggc

SEQ ID NO: 895493 - DNA, 25 bp, Mus musculus
cagtttggggagattgaggccattg

SEQ ID NO: 895494 - DNA, 25 bp, Mus musculus
cagtttggggagtttgaggccattg

SEQ ID NO: 895495 - DNA, 25 bp, Mus musculus
cagtttggttatgacgtctggcggg

SEQ ID NO: 895496 - DNA, 25 bp, Mus musculus
cagtttggttatgaggtctggcggg

SEQ ID NO: 895497 - DNA, 25 bp, Mus musculus
cagtttgtagatgtttgcatagatc

SEQ ID NO: 895498 - DNA, 25 bp, Mus musculus
cagtttgtagttgtttgcatagatc

SEQ ID NO: 895499 - DNA, 25 bp, Mus musculus
cagtttgtattgccttctcaaggat

SEQ ID NO: 895500 - DNA, 25 bp, Mus musculus
cagtttgtattggcttctcaaggat

SEQ ID NO: 895501 - DNA, 25 bp, Mus musculus
cagtttgttcaaaacagcatgggct

SEQ ID NO: 895502 - DNA, 25 bp, Mus musculus
cagtttgttcaaaagagcatgggct

SEQ ID NO: 895503 - DNA, 25 bp, Mus musculus
cagttttacagacatcctgggtgtt

SEQ ID NO: 895504 - DNA, 25 bp, Mus musculus
cagttttacagagatcctgggtgtt

SEQ ID NO: 895505 - DNA, 25 bp, Mus musculus
cagttttcagaaagaagcaactttg

SEQ ID NO: 895506 - DNA, 25 bp, Mus musculus
cagttttcagtaagaagcaactttg

SEQ ID NO: 895507 - DNA, 25 bp, Mus musculus
cagttttctatgaacgtattctact

SEQ ID NO: 895508 - DNA, 25 bp, Mus musculus
cagttttctatgaaggtattctact

SEQ ID NO: 895509 - DNA, 25 bp, Mus musculus
cagttttctcagcaaattgggcttg

SEQ ID NO: 895510 - DNA, 25 bp, Mus musculus
cagttttctcaggaaattgggcttg

SEQ ID NO: 895511 - DNA, 25 bp, Mus musculus
cagttttgacggcatttgctaatgg

SEQ ID NO: 895512 - DNA, 25 bp, Mus musculus
cagttttgacgggatttgctaatgg

SEQ ID NO: 895513 - DNA, 25 bp, Mus musculus
cagttttgagccaagaaatctcaag

SEQ ID NO: 895514 - DNA, 25 bp, Mus musculus
cagttttgaggcaagaaatctcaag

SEQ ID NO: 895515 - DNA, 25 bp, Mus musculus
cagtttttcgatgacatggcggatc

SEQ ID NO: 895516 - DNA, 25 bp, Mus musculus
cagtttttcgatgacgctgaattgc

SEQ ID NO: 895517 - DNA, 25 bp, Mus musculus
cagtttttcgatgagatggcggatc

SEQ ID NO: 895518 - DNA, 25 bp, Mus musculus
cagtttttcgatgaggctgaattgc

SEQ ID NO: 895519 - DNA, 25 bp, Mus musculus
cataaaagagcaactcattatacaa

SEQ ID NO: 895520 - DNA, 25 bp, Mus musculus
cataaaagaggaactcattatacaa

SEQ ID NO: 895521 - DNA, 25 bp, Mus musculus
cataaaaggaagagagaattcaaca

SEQ ID NO: 895522 - DNA, 25 bp, Mus musculus
cataaaaggaagcagagagaattca

SEQ ID NO: 895523 - DNA, 25 bp, Mus musculus
cataaaaggaaggagagagaattca

SEQ ID NO: 895524 - DNA, 25 bp, Mus musculus
cataaaaggaagtgagaattcaaca

SEQ ID NO: 895525 - DNA, 25 bp, Mus musculus
cataaaatcccaatgccaccgtggg

SEQ ID NO: 895526 - DNA, 25 bp, Mus musculus
cataaaatcccattgccaccgtggg

SEQ ID NO: 895527 - DNA, 25 bp, Mus musculus
cataaacacgccttttttcacaggg

SEQ ID NO: 895528 - DNA, 25 bp, Mus musculus
cataaacacggcttttttcacaggg

SEQ ID NO: 895529 - DNA, 25 bp, Mus musculus
cataaaccacaacactggggacaaa

SEQ ID NO: 895530 - DNA, 25 bp, Mus musculus
cataaaccacaagactggggacaaa

SEQ ID NO: 895531 - DNA, 25 bp, Mus musculus
cataaagaaaatccagcgttcctgc

SEQ ID NO: 895532 - DNA, 25 bp, Mus musculus
cataaagaaaatgcagcgttcctgc

SEQ ID NO: 895533 - DNA, 25 bp, Mus musculus
cataaagattcacttctctcggatc

SEQ ID NO: 895534 - DNA, 25 bp, Mus musculus
cataaagattcagttctctcggatc

SEQ ID NO: 895535 - DNA, 25 bp, Mus musculus
cataaagcagaatgctcagtgtttg

SEQ ID NO: 895536 - DNA, 25 bp, Mus musculus
cataaagcagacaatagtatcagat

SEQ ID NO: 895537 - DNA, 25 bp, Mus musculus
cataaagcagtatgctcagtgtttg

SEQ ID NO: 895538 - DNA, 25 bp, Mus musculus
cataaagcagtcaatagtatcagat

SEQ ID NO: 895539 - DNA, 25 bp, Mus musculus
cataaatgagagcactgcctgggtg

SEQ ID NO: 895540 - DNA, 25 bp, Mus musculus
cataaatgagaggactgcctgggtg

SEQ ID NO: 895541 - DNA, 25 bp, Mus musculus
cataaatgatgtatgtcgcactggc

SEQ ID NO: 895542 - DNA, 25 bp, Mus musculus
cataaatgatgtttgtcgcactggc

SEQ ID NO: 895543 - DNA, 25 bp, Mus musculus
cataacaaagccatcgcccacaggg

SEQ ID NO: 895544 - DNA, 25 bp, Mus musculus
cataacaaaggcatcgcccacaggg

SEQ ID NO: 895545 - DNA, 25 bp, Mus musculus
cataacagacaacgatgacttcgca

SEQ ID NO: 895546 - DNA, 25 bp, Mus musculus
cataacagacaaggatgacttcgca

SEQ ID NO: 895547 - DNA, 25 bp, Mus musculus
cataaccaagcacgctgccttagga

SEQ ID NO: 895548 - DNA, 25 bp, Mus musculus
cataaccaagcaggctgccttagga

SEQ ID NO: 895549 - DNA, 25 bp, Mus musculus
cataacccggcacaactacacatac

SEQ ID NO: 895550 - DNA, 25 bp, Mus musculus
cataacccggcagaactacacatac

SEQ ID NO: 895551 - DNA, 25 bp, Mus musculus
cataaccctctgagcctcatgtacc

SEQ ID NO: 895552 - DNA, 25 bp, Mus musculus
cataaccctctgtgcctcatgtacc

SEQ ID NO: 895553 - DNA, 25 bp, Mus musculus
cataaccgtgcacgttgagaatgag

SEQ ID NO: 895554 - DNA, 25 bp, Mus musculus
cataaccgtgcaggttgagaatgag

SEQ ID NO: 895555 - DNA, 25 bp, Mus musculus
cataacgaagaggagcgccgccgcc

SEQ ID NO: 895556 - DNA, 25 bp, Mus musculus
cataacgaagtggagcgccgccgcc

SEQ ID NO: 895557 - DNA, 25 bp, Mus musculus
cataactgaagatgaaaaaggtcat

SEQ ID NO: 895558 - DNA, 25 bp, Mus musculus
cataactgaagatgtaaaaggtcat

SEQ ID NO: 895559 - DNA, 25 bp, Mus musculus
cataacttaaaccctaatggaggct

SEQ ID NO: 895560 - DNA, 25 bp, Mus musculus
cataacttaaacgctaatggaggct

SEQ ID NO: 895561 - DNA, 25 bp, Mus musculus
cataacttccagagaatctcagtat

SEQ ID NO: 895562 - DNA, 25 bp, Mus musculus
cataacttccagatccaggccttca

SEQ ID NO: 895563 - DNA, 25 bp, Mus musculus
cataacttccagtgaatctcagtat

SEQ ID NO: 895564 - DNA, 25 bp, Mus musculus
cataacttccagttccaggccttca

SEQ ID NO: 895565 - DNA, 25 bp, Mus musculus
cataagaagaaactgcagctggcag

SEQ ID NO: 895566 - DNA, 25 bp, Mus musculus
cataagaagatactgcagctggcag

SEQ ID NO: 895567 - DNA, 25 bp, Mus musculus
cataagcaactgcatgtgggagaag

SEQ ID NO: 895568 - DNA, 25 bp, Mus musculus
cataagcaactggatgtgggagaag

SEQ ID NO: 895569 - DNA, 25 bp, Mus musculus
cataaggcaagacacattacaaaag

SEQ ID NO: 895570 - DNA, 25 bp, Mus musculus
cataaggcaagacagattacaaaag

SEQ ID NO: 895571 - DNA, 25 bp, Mus musculus
cataagtatatccacgtcgtctacc

SEQ ID NO: 895572 - DNA, 25 bp, Mus musculus
cataagtatatccaggtcgtctacc

SEQ ID NO: 895573 - DNA, 25 bp, Mus musculus
cataagtggttctacctttaaggac

SEQ ID NO: 895574 - DNA, 25 bp, Mus musculus
cataagtggttctacgagctcagac

SEQ ID NO: 895575 - DNA, 25 bp, Mus musculus
cataagtggttctagctttaaggac

SEQ ID NO: 895576 - DNA, 25 bp, Mus musculus
cataagtggttctaggagctcagac

SEQ ID NO: 895577 - DNA, 25 bp, Mus musculus
cataagttcaaacctctaggactcc

SEQ ID NO: 895578 - DNA, 25 bp, Mus musculus
cataagttcaaacggcaacaggtcc

SEQ ID NO: 895579 - DNA, 25 bp, Mus musculus
cataagttcaaagctctaggactcc

SEQ ID NO: 895580 - DNA, 25 bp, Mus musculus
cataagttcaaagggcaacaggtcc

SEQ ID NO: 895581 - DNA, 25 bp, Mus musculus
cataatagcaagcattggagaagca

SEQ ID NO: 895582 - DNA, 25 bp, Mus musculus
cataatagcaaggattggagaagca

SEQ ID NO: 895583 - DNA, 25 bp, Mus musculus
cataatcgaaggatggctgctgagc

SEQ ID NO: 895584 - DNA, 25 bp, Mus musculus
cataatcgaaggttggctgctgagc

SEQ ID NO: 895585 - DNA, 25 bp, Mus musculus
cataatgctctcaacgatttgaggt

SEQ ID NO: 895586 - DNA, 25 bp, Mus musculus
cataatgctctcaaggatttgaggt

SEQ ID NO: 895587 - DNA, 25 bp, Mus musculus
cataatgggaaccaccaaggacaca

SEQ ID NO: 895588 - DNA, 25 bp, Mus musculus
cataatgggaacgaccaaggacaca

SEQ ID NO: 895589 - DNA, 25 bp, Mus musculus
cataattcacagcgacctaaagccc

SEQ ID NO: 895590 - DNA, 25 bp, Mus musculus
cataattcacagggacctaaagccc

SEQ ID NO: 895591 - DNA, 25 bp, Mus musculus
cataattcagaaaatcagaaaatgc

SEQ ID NO: 895592 - DNA, 25 bp, Mus musculus
cataattcagtaaatcagaaaatgc

SEQ ID NO: 895593 - DNA, 25 bp, Mus musculus
cataattgcccacgactcgttaatg

SEQ ID NO: 895594 - DNA, 25 bp, Mus musculus
cataattgcccactatttaacagac

SEQ ID NO: 895595 - DNA, 25 bp, Mus musculus
cataattgcccaggactcgttaatg

SEQ ID NO: 895596 - DNA, 25 bp, Mus musculus
cataattgcccagtatttaacagac

SEQ ID NO: 895597 - DNA, 25 bp, Mus musculus
cataattgtcttcatatggacgaat

SEQ ID NO: 895598 - DNA, 25 bp, Mus musculus
cataattgtcttgatatggacgaat

SEQ ID NO: 895599 - DNA, 25 bp, Mus musculus
catacaagactgctaccagcaaacc

SEQ ID NO: 895600 - DNA, 25 bp, Mus musculus
catacaagactggtaccagcaaacc

SEQ ID NO: 895601 - DNA, 25 bp, Mus musculus
catacaagataaaaccaaaaagaag

SEQ ID NO: 895602 - DNA, 25 bp, Mus musculus
catacaagataaaagcaaaaagaag

SEQ ID NO: 895603 - DNA, 25 bp, Mus musculus
catacaatacaaataaagagagaca

SEQ ID NO: 895604 - DNA, 25 bp, Mus musculus
catacaatacaaattaagagagaca

SEQ ID NO: 895605 - DNA, 25 bp, Mus musculus
catacaccagcaactctgatgatca

SEQ ID NO: 895606 - DNA, 25 bp, Mus musculus
catacaccaggaactctgatgatca

SEQ ID NO: 895607 - DNA, 25 bp, Mus musculus
catacactcgcacgagacaaagcat

SEQ ID NO: 895608 - DNA, 25 bp, Mus musculus
catacactcgcaggagacaaagcat

SEQ ID NO: 895609 - DNA, 25 bp, Mus musculus
catacagattttcggaacatcaaca

SEQ ID NO: 895610 - DNA, 25 bp, Mus musculus
catacagattttgggaacatcaaca

SEQ ID NO: 895611 - DNA, 25 bp, Mus musculus
catacagcaacacagcgctctgtca

SEQ ID NO: 895612 - DNA, 25 bp, Mus musculus
catacagcaacagagcgctctgtca

SEQ ID NO: 895613 - DNA, 25 bp, Mus musculus
catacagctgctaaacaccagagaa

SEQ ID NO: 895614 - DNA, 25 bp, Mus musculus
catacagctggtaaacaccagagaa

SEQ ID NO: 895615 - DNA, 25 bp, Mus musculus
catacaggagatcgatgtgtacttg

SEQ ID NO: 895616 - DNA, 25 bp, Mus musculus
catacaggagttcgatgtgtacttg

SEQ ID NO: 895617 - DNA, 25 bp, Mus musculus
cataccaaaaagcacatggagacac

SEQ ID NO: 895618 - DNA, 25 bp, Mus musculus
cataccaaaaagcacattgtccatc

SEQ ID NO: 895619 - DNA, 25 bp, Mus musculus
cataccaaaaagcagatggagacac

SEQ ID NO: 895620 - DNA, 25 bp, Mus musculus
cataccaaaaagcagattgtccatc

SEQ ID NO: 895621 - DNA, 25 bp, Mus musculus
cataccagcagcaatatggaaggag

SEQ ID NO: 895622 - DNA, 25 bp, Mus musculus
cataccagcagctatatggaaggag

SEQ ID NO: 895623 - DNA, 25 bp, Mus musculus
catacccagtcccttgccatctctc

SEQ ID NO: 895624 - DNA, 25 bp, Mus musculus
catacccagtctgtcatcaataaac

SEQ ID NO: 895625 - DNA, 25 bp, Mus musculus
catacccagtgccttgccatctctc

SEQ ID NO: 895626 - DNA, 25 bp, Mus musculus
catacccagtgtgtcatcaataaac

SEQ ID NO: 895627 - DNA, 25 bp, Mus musculus
cataccccagcacacccagcatcag

SEQ ID NO: 895628 - DNA, 25 bp, Mus musculus
cataccccaggacacccagcatcag

SEQ ID NO: 895629 - DNA, 25 bp, Mus musculus
catacccgagataaagactattttg

SEQ ID NO: 895630 - DNA, 25 bp, Mus musculus
catacccgagttaaagactattttg

SEQ ID NO: 895631 - DNA, 25 bp, Mus musculus
cataccgctgcacggtcccagcctc

SEQ ID NO: 895632 - DNA, 25 bp, Mus musculus
cataccgctgcagggtcccagcctc

SEQ ID NO: 895633 - DNA, 25 bp, Mus musculus
catacctgcacacacatcgatgagt

SEQ ID NO: 895634 - DNA, 25 bp, Mus musculus
catacctgcacagacatcgatgagt

SEQ ID NO: 895635 - DNA, 25 bp, Mus musculus
catacctggggacacaattgcccta

SEQ ID NO: 895636 - DNA, 25 bp, Mus musculus
catacctggggacagaattgcccta

SEQ ID NO: 895637 - DNA, 25 bp, Mus musculus
catacgaagacaaagattcatctaa

SEQ ID NO: 895638 - DNA, 25 bp, Mus musculus
catacgaagacatagattcatctaa

SEQ ID NO: 895639 - DNA, 25 bp, Mus musculus
catacgacagctccctcctagcttt

SEQ ID NO: 895640 - DNA, 25 bp, Mus musculus
catacgacagctcggctacttgatt

SEQ ID NO: 895641 - DNA, 25 bp, Mus musculus
catacgacagctgcctcctagcttt

SEQ ID NO: 895642 - DNA, 25 bp, Mus musculus
catacgacagctgggctacttgatt

SEQ ID NO: 895643 - DNA, 25 bp, Mus musculus
catacgctggaacgccatgcgatgc

SEQ ID NO: 895644 - DNA, 25 bp, Mus musculus
catacgctggaaggccatgcgatgc

SEQ ID NO: 895645 - DNA, 25 bp, Mus musculus
catacggatgaggagattgccaagc

SEQ ID NO: 895646 - DNA, 25 bp, Mus musculus
catacggatgtggagattgccaagc

SEQ ID NO: 895647 - DNA, 25 bp, Mus musculus
catacgtgacagaaatggctcaggg

SEQ ID NO: 895648 - DNA, 25 bp, Mus musculus
catacgtgacagtaatggctcaggg

SEQ ID NO: 895649 - DNA, 25 bp, Mus musculus
catactaacagacgctgtggtggat

SEQ ID NO: 895650 - DNA, 25 bp, Mus musculus
catactaacagaggctgtggtggat

SEQ ID NO: 895651 - DNA, 25 bp, Mus musculus
catactacgttgatcacctcaacca

SEQ ID NO: 895652 - DNA, 25 bp, Mus musculus
catactacgttgttcacctcaacca

SEQ ID NO: 895653 - DNA, 25 bp, Mus musculus
catactatggtaaacatccctcaag

SEQ ID NO: 895654 - DNA, 25 bp, Mus musculus
catactatggtaaagatccctcaag

SEQ ID NO: 895655 - DNA, 25 bp, Mus musculus
catactccagaagctgtccggcaaa

SEQ ID NO: 895656 - DNA, 25 bp, Mus musculus
catactccagtagctgtccggcaaa

SEQ ID NO: 895657 - DNA, 25 bp, Mus musculus
catactctgtgccacacatcctgca

SEQ ID NO: 895658 - DNA, 25 bp, Mus musculus
catactctgtgccacccatgaatgt

SEQ ID NO: 895659 - DNA, 25 bp, Mus musculus
catactctgtgccagacatcctgca

SEQ ID NO: 895660 - DNA, 25 bp, Mus musculus
catactctgtgccagccatgaatgt

SEQ ID NO: 895661 - DNA, 25 bp, Mus musculus
catacttaagagaatctgtgtcccg

SEQ ID NO: 895662 - DNA, 25 bp, Mus musculus
catacttaagagtatctgtgtcccg

SEQ ID NO: 895663 - DNA, 25 bp, Mus musculus
catactttatagcactcattctgat

SEQ ID NO: 895664 - DNA, 25 bp, Mus musculus
catactttataggactcattctgat

SEQ ID NO: 895665 - DNA, 25 bp, Mus musculus
catagaaaagaactttcagccaaca

SEQ ID NO: 895666 - DNA, 25 bp, Mus musculus
catagaaaagtactttcagccaaca

SEQ ID NO: 895667 - DNA, 25 bp, Mus musculus
catagacaacatgggagctttctgg

SEQ ID NO: 895668 - DNA, 25 bp, Mus musculus
catagacaacttgggagctttctgg

SEQ ID NO: 895669 - DNA, 25 bp, Mus musculus
catagaccagcgctcctccagacaa

SEQ ID NO: 895670 - DNA, 25 bp, Mus musculus
catagaccagcggtcctccagacaa

SEQ ID NO: 895671 - DNA, 25 bp, Mus musculus
catagacccccacccaggaagttat

SEQ ID NO: 895672 - DNA, 25 bp, Mus musculus
catagacccccagccaggaagttat

SEQ ID NO: 895673 - DNA, 25 bp, Mus musculus
catagactcgtcaaacccaatagaa

SEQ ID NO: 895674 - DNA, 25 bp, Mus musculus
catagactcgtcaatcccaatagaa

SEQ ID NO: 895675 - DNA, 25 bp, Mus musculus
catagacttcagcaataaagtggtg

SEQ ID NO: 895676 - DNA, 25 bp, Mus musculus
catagacttcaggaataaagtggtg

SEQ ID NO: 895677 - DNA, 25 bp, Mus musculus
catagagatctaaacgcagaaaacc

SEQ ID NO: 895678 - DNA, 25 bp, Mus musculus
catagagatctaaaggcagaaaacc

SEQ ID NO: 895679 - DNA, 25 bp, Mus musculus
catagatgttcacacaacaacagct

SEQ ID NO: 895680 - DNA, 25 bp, Mus musculus
catagatgttcacagaacaacagct

SEQ ID NO: 895681 - DNA, 25 bp, Mus musculus
catagcaacatgaacgtcatgtagg

SEQ ID NO: 895682 - DNA, 25 bp, Mus musculus
catagcaacatgaaggtcatgtagg

SEQ ID NO: 895683 - DNA, 25 bp, Mus musculus
catagcaattaacgaactagaggct

SEQ ID NO: 895684 - DNA, 25 bp, Mus musculus
catagcaattaacggagtggccagg

SEQ ID NO: 895685 - DNA, 25 bp, Mus musculus
catagcaattaaggaactagaggct

SEQ ID NO: 895686 - DNA, 25 bp, Mus musculus
catagcaattaagggagtggccagg

SEQ ID NO: 895687 - DNA, 25 bp, Mus musculus
catagcacagatcctggccggctat

SEQ ID NO: 895688 - DNA, 25 bp, Mus musculus
catagcacagttcctggccggctat

SEQ ID NO: 895689 - DNA, 25 bp, Mus musculus
catagcagcagtgacgaaattttta

SEQ ID NO: 895690 - DNA, 25 bp, Mus musculus
catagcagcagtgaggaaattttta

SEQ ID NO: 895691 - DNA, 25 bp, Mus musculus
catagctgtctgctttgtggacagt

SEQ ID NO: 895692 - DNA, 25 bp, Mus musculus
catagctgtctggtttgtggacagt

SEQ ID NO: 895693 - DNA, 25 bp, Mus musculus
cataggaaaagtcatcaccaacttg

SEQ ID NO: 895694 - DNA, 25 bp, Mus musculus
cataggaaaagtgatcaccaacttg

SEQ ID NO: 895695 - DNA, 25 bp, Mus musculus
cataggaaacaaaatgtatgtattt

SEQ ID NO: 895696 - DNA, 25 bp, Mus musculus
cataggaaacaatatgtatgtattt

SEQ ID NO: 895697 - DNA, 25 bp, Mus musculus
cataggacagaacaagagaactcca

SEQ ID NO: 895698 - DNA, 25 bp, Mus musculus
cataggacagaagaagagaactcca

SEQ ID NO: 895699 - DNA, 25 bp, Mus musculus
cataggacatttaccttcccgtcga

SEQ ID NO: 895700 - DNA, 25 bp, Mus musculus
cataggacattttccttcccgtcga

SEQ ID NO: 895701 - DNA, 25 bp, Mus musculus
catagtactacattcatcccagggg

SEQ ID NO: 895702 - DNA, 25 bp, Mus musculus
catagtactagattcatcccagggg

SEQ ID NO: 895703 - DNA, 25 bp, Mus musculus
catagtcacggagcactgcacagaa

SEQ ID NO: 895704 - DNA, 25 bp, Mus musculus
catagtcacggagctctgcacagaa

SEQ ID NO: 895705 - DNA, 25 bp, Mus musculus
catagtgacctcctcgattacccca

SEQ ID NO: 895706 - DNA, 25 bp, Mus musculus
catagtgacctcctggattacccca

SEQ ID NO: 895707 - DNA, 25 bp, Mus musculus
catagttctttgaaaaatgatcaac

SEQ ID NO: 895708 - DNA, 25 bp, Mus musculus
catagttctttgtaaaatgatcaac

SEQ ID NO: 895709 - DNA, 25 bp, Mus musculus
catagttgatcttatcaatgtggat

SEQ ID NO: 895710 - DNA, 25 bp, Mus musculus
catagttgatgtcatagagaaaagg

SEQ ID NO: 895711 - DNA, 25 bp, Mus musculus
catagttgatgtgatagagaaaagg

SEQ ID NO: 895712 - DNA, 25 bp, Mus musculus
catagttgatgttatcaatgtggat

SEQ ID NO: 895713 - DNA, 25 bp, Mus musculus
catataaactggcgagatgtccctg

SEQ ID NO: 895714 - DNA, 25 bp, Mus musculus
catataaactggggagatgtccctg

SEQ ID NO: 895715 - DNA, 25 bp, Mus musculus
catataaagtctctcaaactcaagt

SEQ ID NO: 895716 - DNA, 25 bp, Mus musculus
catataaagtctctgaaactcaagt

SEQ ID NO: 895717 - DNA, 25 bp, Mus musculus
catataattcatattgaccagcctc

SEQ ID NO: 895718 - DNA, 25 bp, Mus musculus
catataattcattttgaccagcctc

SEQ ID NO: 895719 - DNA, 25 bp, Mus musculus
catatacatggtcgtacaccatgag

SEQ ID NO: 895720 - DNA, 25 bp, Mus musculus
catatacatggtggtacaccatgag

SEQ ID NO: 895721 - DNA, 25 bp, Mus musculus
catatacttagacacgtatccatta

SEQ ID NO: 895722 - DNA, 25 bp, Mus musculus
catatacttagacaggtatccatta

SEQ ID NO: 895723 - DNA, 25 bp, Mus musculus
catatagagcagaaccaaatatgcc

SEQ ID NO: 895724 - DNA, 25 bp, Mus musculus
catatagagcagtaccaaatatgcc

SEQ ID NO: 895725 - DNA, 25 bp, Mus musculus
catatagctcagctacagctgacag

SEQ ID NO: 895726 - DNA, 25 bp, Mus musculus
catatagctcaggtacagctgacag

SEQ ID NO: 895727 - DNA, 25 bp, Mus musculus
catatatcttcaatcaaattacact

SEQ ID NO: 895728 - DNA, 25 bp, Mus musculus
catatatcttcaatcgtctgacagt

SEQ ID NO: 895729 - DNA, 25 bp, Mus musculus
catatatcttcaatgaaattacact

SEQ ID NO: 895730 - DNA, 25 bp, Mus musculus
catatatcttcaatggtctgacagt

SEQ ID NO: 895731 - DNA, 25 bp, Mus musculus
catatcaaagccagattaatcaaat

SEQ ID NO: 895732 - DNA, 25 bp, Mus musculus
catatcaaagccagtttaatcaaat

SEQ ID NO: 895733 - DNA, 25 bp, Mus musculus
catatcaagaagcagtttgacaaga

SEQ ID NO: 895734 - DNA, 25 bp, Mus musculus
catatcaagaagccctggctgtcct

SEQ ID NO: 895735 - DNA, 25 bp, Mus musculus
catatcaagaaggagtttgacaaga

SEQ ID NO: 895736 - DNA, 25 bp, Mus musculus
catatcaagaaggcctggctgtcct

SEQ ID NO: 895737 - DNA, 25 bp, Mus musculus
catatcacagctattgactgggctc

SEQ ID NO: 895738 - DNA, 25 bp, Mus musculus
catatcacaggtattgactgggctc

SEQ ID NO: 895739 - DNA, 25 bp, Mus musculus
catatcactactcgggaaacaggca

SEQ ID NO: 895740 - DNA, 25 bp, Mus musculus
catatcactactctggtcgtgcaga

SEQ ID NO: 895741 - DNA, 25 bp, Mus musculus
catatcactactggggaaacaggca

SEQ ID NO: 895742 - DNA, 25 bp, Mus musculus
catatcactactgtggtcgtgcaga

SEQ ID NO: 895743 - DNA, 25 bp, Mus musculus
catatcagcacgcacgattccggag

SEQ ID NO: 895744 - DNA, 25 bp, Mus musculus
catatcagcacgcgtcacccagaag

SEQ ID NO: 895745 - DNA, 25 bp, Mus musculus
catatcagcacggacgattccggag

SEQ ID NO: 895746 - DNA, 25 bp, Mus musculus
catatcagcacgggtcacccagaag

SEQ ID NO: 895747 - DNA, 25 bp, Mus musculus
catatcatctcacatggaggctgca

SEQ ID NO: 895748 - DNA, 25 bp, Mus musculus
catatcatctcagatggaggctgca

SEQ ID NO: 895749 - DNA, 25 bp, Mus musculus
catatccttccacatgtatcgggat

SEQ ID NO: 895750 - DNA, 25 bp, Mus musculus
catatccttccacatgtatctggat

SEQ ID NO: 895751 - DNA, 25 bp, Mus musculus
catatccttccagatgtatcgggat

SEQ ID NO: 895752 - DNA, 25 bp, Mus musculus
catatccttccagatgtatctggat

SEQ ID NO: 895753 - DNA, 25 bp, Mus musculus
catatctaccagctaagattaaaag

SEQ ID NO: 895754 - DNA, 25 bp, Mus musculus
catatctaccaggtaagattaaaag

SEQ ID NO: 895755 - DNA, 25 bp, Mus musculus
catatctgcaagcacatgagcccac

SEQ ID NO: 895756 - DNA, 25 bp, Mus musculus
catatctgcaaggacatgagcccac

SEQ ID NO: 895757 - DNA, 25 bp, Mus musculus
catatctgtaccagcgtgtacattg

SEQ ID NO: 895758 - DNA, 25 bp, Mus musculus
catatctgtaccagggtgtacattg

SEQ ID NO: 895759 - DNA, 25 bp, Mus musculus
catatctgtgatgacgtggacttat

SEQ ID NO: 895760 - DNA, 25 bp, Mus musculus
catatctgtgatgaggtggacttat

SEQ ID NO: 895761 - DNA, 25 bp, Mus musculus
catatctttcagaggagcctatcac

SEQ ID NO: 895762 - DNA, 25 bp, Mus musculus
catatctttcagtggagcctatcac

SEQ ID NO: 895763 - DNA, 25 bp, Mus musculus
catatgaaaaagcgggccacattat

SEQ ID NO: 895764 - DNA, 25 bp, Mus musculus
catatgaaaaagggggccacattat

SEQ ID NO: 895765 - DNA, 25 bp, Mus musculus
catatgaaattgatctgtgtgcaaa

SEQ ID NO: 895766 - DNA, 25 bp, Mus musculus
catatgaaattgatgtgtgtgcaaa

SEQ ID NO: 895767 - DNA, 25 bp, Mus musculus
catatgattcagatgctgtattatg

SEQ ID NO: 895768 - DNA, 25 bp, Mus musculus
catatgattcagttgctgtattatg

SEQ ID NO: 895769 - DNA, 25 bp, Mus musculus
catatgcagcagatttttatcatta

SEQ ID NO: 895770 - DNA, 25 bp, Mus musculus
catatgcagcagcggggagcaccgt

SEQ ID NO: 895771 - DNA, 25 bp, Mus musculus
catatgcagcaggggggagcaccgt

SEQ ID NO: 895772 - DNA, 25 bp, Mus musculus
catatgcagcagttttttatcatta

SEQ ID NO: 895773 - DNA, 25 bp, Mus musculus
catatgccatccagcccgaactggg

SEQ ID NO: 895774 - DNA, 25 bp, Mus musculus
catatgccatccaggccgaactggg

SEQ ID NO: 895775 - DNA, 25 bp, Mus musculus
catatgccgccacgtctacaccaga

SEQ ID NO: 895776 - DNA, 25 bp, Mus musculus
catatgccgccaggtctacaccaga

SEQ ID NO: 895777 - DNA, 25 bp, Mus musculus
catatgcttccgagactcgggcggc

SEQ ID NO: 895778 - DNA, 25 bp, Mus musculus
catatgcttccttggggactgatcc

SEQ ID NO: 895779 - DNA, 25 bp, Mus musculus
catatgcttcggagactcgggcggc

SEQ ID NO: 895780 - DNA, 25 bp, Mus musculus
catatgcttcgttggggactgatcc

SEQ ID NO: 895781 - DNA, 25 bp, Mus musculus
catatggaaaatctttcaacctgga

SEQ ID NO: 895782 - DNA, 25 bp, Mus musculus
catatggaaaatgtttcaacctgga

SEQ ID NO: 895783 - DNA, 25 bp, Mus musculus
catatggcagagactgagttgaata

SEQ ID NO: 895784 - DNA, 25 bp, Mus musculus
catatggcagatgactgagttgaat

SEQ ID NO: 895785 - DNA, 25 bp, Mus musculus
catatggcagtgactgagttgaata

SEQ ID NO: 895786 - DNA, 25 bp, Mus musculus
catatggcagttgactgagttgaat

SEQ ID NO: 895787 - DNA, 25 bp, Mus musculus
catatggctctggtcgtggacgcag

SEQ ID NO: 895788 - DNA, 25 bp, Mus musculus
catatggctctggtggtggacgcag

SEQ ID NO: 895789 - DNA, 25 bp, Mus musculus
catatgttactacgagtcaagcttg

SEQ ID NO: 895790 - DNA, 25 bp, Mus musculus
catatgttactaggagtcaagcttg

SEQ ID NO: 895791 - DNA, 25 bp, Mus musculus
catattaaccagccagctctaaaac

SEQ ID NO: 895792 - DNA, 25 bp, Mus musculus
catattaaccagcctgctctaaaac

SEQ ID NO: 895793 - DNA, 25 bp, Mus musculus
catattcctcaaagctgatggacaa

SEQ ID NO: 895794 - DNA, 25 bp, Mus musculus
catattcctctaagctgatggacaa

SEQ ID NO: 895795 - DNA, 25 bp, Mus musculus
catattgataaacgcatgaaagatg

SEQ ID NO: 895796 - DNA, 25 bp, Mus musculus
catattgataaaggcatgaaagatg

SEQ ID NO: 895797 - DNA, 25 bp, Mus musculus
catattgcctcgtacaccattaagt

SEQ ID NO: 895798 - DNA, 25 bp, Mus musculus
catattgcctggtacaccattaagt

SEQ ID NO: 895799 - DNA, 25 bp, Mus musculus
catattggaaaacgtgttcatctat

SEQ ID NO: 895800 - DNA, 25 bp, Mus musculus
catattggaaaaggtgttcatctat

SEQ ID NO: 895801 - DNA, 25 bp, Mus musculus
catattgtattccactttgactgta

SEQ ID NO: 895802 - DNA, 25 bp, Mus musculus
catattgtattccagtttgactgta

SEQ ID NO: 895803 - DNA, 25 bp, Mus musculus
catatttactctgctggtggggggc

SEQ ID NO: 895804 - DNA, 25 bp, Mus musculus
catatttactgtgctggtggggggc

SEQ ID NO: 895805 - DNA, 25 bp, Mus musculus
catatttgagcatcgcgtctactgg

SEQ ID NO: 895806 - DNA, 25 bp, Mus musculus
catatttgaggatcgcgtctactgg

SEQ ID NO: 895807 - DNA, 25 bp, Mus musculus
catcaaaaagacattcaggtattga

SEQ ID NO: 895808 - DNA, 25 bp, Mus musculus
catcaaaaagcacacaacaagcctg

SEQ ID NO: 895809 - DNA, 25 bp, Mus musculus
catcaaaaagcacagaacaagcctg

SEQ ID NO: 895810 - DNA, 25 bp, Mus musculus
catcaaaaagctggacagtgctcga

SEQ ID NO: 895811 - DNA, 25 bp, Mus musculus
catcaaaaaggtggacagtgctcga

SEQ ID NO: 895812 - DNA, 25 bp, Mus musculus
catcaaaaagtcattcaggtattga

SEQ ID NO: 895813 - DNA, 25 bp, Mus musculus
catcaaaactcccacataccgtgag

SEQ ID NO: 895814 - DNA, 25 bp, Mus musculus
catcaaaactccgacataccgtgag

SEQ ID NO: 895815 - DNA, 25 bp, Mus musculus
catcaaacagaacgcaacactgcaa

SEQ ID NO: 895816 - DNA, 25 bp, Mus musculus
catcaaacagaaggcaacactgcaa

SEQ ID NO: 895817 - DNA, 25 bp, Mus musculus
catcaaacagctagtgaagcatttg

SEQ ID NO: 895818 - DNA, 25 bp, Mus musculus
catcaaacaggtagtgaagcatttg

SEQ ID NO: 895819 - DNA, 25 bp, Mus musculus
catcaaaccgacaaacttcgccatg

SEQ ID NO: 895820 - DNA, 25 bp, Mus musculus
catcaaaccgtcaaacttcgccatg

SEQ ID NO: 895821 - DNA, 25 bp, Mus musculus
catcaaagagacctggacacacaac

SEQ ID NO: 895822 - DNA, 25 bp, Mus musculus
catcaaagagctcgggttccctccg

SEQ ID NO: 895823 - DNA, 25 bp, Mus musculus
catcaaagaggtcgggttccctccg

SEQ ID NO: 895824 - DNA, 25 bp, Mus musculus
catcaaagagtcctggacacacaac

SEQ ID NO: 895825 - DNA, 25 bp, Mus musculus
catcaaagatctagtgactgaagat

SEQ ID NO: 895826 - DNA, 25 bp, Mus musculus
catcaaagatcttgtgactgaagat

SEQ ID NO: 895827 - DNA, 25 bp, Mus musculus
catcaaagctccaattggttgtggt

SEQ ID NO: 895828 - DNA, 25 bp, Mus musculus
catcaaagctgcaattggttgtggt

SEQ ID NO: 895829 - DNA, 25 bp, Mus musculus
catcaaagtcattcccacacccccg

SEQ ID NO: 895830 - DNA, 25 bp, Mus musculus
catcaaagtcattcgcacacccccg

SEQ ID NO: 895831 - DNA, 25 bp, Mus musculus
catcaaatacgacaccaacctgact

SEQ ID NO: 895832 - DNA, 25 bp, Mus musculus
catcaaatacgagaccaacctgact

SEQ ID NO: 895833 - DNA, 25 bp, Mus musculus
catcaaattgagaattattttggag

SEQ ID NO: 895834 - DNA, 25 bp, Mus musculus
catcaaattgagtattattttggag

SEQ ID NO: 895835 - DNA, 25 bp, Mus musculus
catcaaattgcacaagacagtggta

SEQ ID NO: 895836 - DNA, 25 bp, Mus musculus
catcaaattggacaagacagtggta

SEQ ID NO: 895837 - DNA, 25 bp, Mus musculus
catcaacaagcactggtggaaggtt

SEQ ID NO: 895838 - DNA, 25 bp, Mus musculus
catcaacaagcagactagggtccgg

SEQ ID NO: 895839 - DNA, 25 bp, Mus musculus
catcaacaagctgacaagagcagat

SEQ ID NO: 895840 - DNA, 25 bp, Mus musculus
catcaacaaggactggtggaaggtt

SEQ ID NO: 895841 - DNA, 25 bp, Mus musculus
catcaacaaggagactagggtccgg

SEQ ID NO: 895842 - DNA, 25 bp, Mus musculus
catcaacaaggtgacaagagcagat

SEQ ID NO: 895843 - DNA, 25 bp, Mus musculus
catcaacacaccctttggggcgatg

SEQ ID NO: 895844 - DNA, 25 bp, Mus musculus
catcaacacaccgtttggggcgatg

SEQ ID NO: 895845 - DNA, 25 bp, Mus musculus
catcaaccagcatggcgaggagacc

SEQ ID NO: 895846 - DNA, 25 bp, Mus musculus
catcaaccagctggtgtacatgggc

SEQ ID NO: 895847 - DNA, 25 bp, Mus musculus
catcaaccaggatggcgaggagacc

SEQ ID NO: 895848 - DNA, 25 bp, Mus musculus
catcaaccaggtggtgtacatgggc

SEQ ID NO: 895849 - DNA, 25 bp, Mus musculus
catcaaccctgacacagctcttctt

SEQ ID NO: 895850 - DNA, 25 bp, Mus musculus
catcaaccctgactgccaggaccct

SEQ ID NO: 895851 - DNA, 25 bp, Mus musculus
catcaaccctgagacagctcttctt

SEQ ID NO: 895852 - DNA, 25 bp, Mus musculus
catcaaccctgagtgccaggaccct

SEQ ID NO: 895853 - DNA, 25 bp, Mus musculus
catcaacctctactttggctccaag

SEQ ID NO: 895854 - DNA, 25 bp, Mus musculus
catcaacctctagtttggctccaag

SEQ ID NO: 895855 - DNA, 25 bp, Mus musculus
catcaactggacaggagagggtgtg

SEQ ID NO: 895856 - DNA, 25 bp, Mus musculus
catcaactggtcaggagagggtgtg

SEQ ID NO: 895857 - DNA, 25 bp, Mus musculus
catcaagaacagcctggagtatgaa

SEQ ID NO: 895858 - DNA, 25 bp, Mus musculus
catcaagaacaggctggagtatgaa

SEQ ID NO: 895859 - DNA, 25 bp, Mus musculus
catcaagaagcgagaagaaatgggt

SEQ ID NO: 895860 - DNA, 25 bp, Mus musculus
catcaagaaggcctaccgaaagaag

SEQ ID NO: 895861 - DNA, 25 bp, Mus musculus
catcaagaaggcgtaccgaaagaag

SEQ ID NO: 895862 - DNA, 25 bp, Mus musculus
catcaagaagggagaagaaatgggt

SEQ ID NO: 895863 - DNA, 25 bp, Mus musculus
catcaagaccagcaattcagtgaag

SEQ ID NO: 895864 - DNA, 25 bp, Mus musculus
catcaagaccaggaattcagtgaag

SEQ ID NO: 895865 - DNA, 25 bp, Mus musculus
catcaagataatcacacggcgcttg

SEQ ID NO: 895866 - DNA, 25 bp, Mus musculus
catcaagataatcagacggcgcttg

SEQ ID NO: 895867 - DNA, 25 bp, Mus musculus
catcaagatctgcgacttggagggc

SEQ ID NO: 895868 - DNA, 25 bp, Mus musculus
catcaagatctgggacttggagggc

SEQ ID NO: 895869 - DNA, 25 bp, Mus musculus
catcaagcgccccaacagcctcgct

SEQ ID NO: 895870 - DNA, 25 bp, Mus musculus
catcaagcgcgccaacagcctcgct

SEQ ID NO: 895871 - DNA, 25 bp, Mus musculus
catcaagctacccagactccggggt

SEQ ID NO: 895872 - DNA, 25 bp, Mus musculus
catcaagctaccgagactccggggt

SEQ ID NO: 895873 - DNA, 25 bp, Mus musculus
catcaaggaagagaaggaggacatc

SEQ ID NO: 895874 - DNA, 25 bp, Mus musculus
catcaaggaagagatggaggacatc

SEQ ID NO: 895875 - DNA, 25 bp, Mus musculus
catcaaggaggccctcccggacggt

SEQ ID NO: 895876 - DNA, 25 bp, Mus musculus
catcaaggaggcgctcccggacggt

SEQ ID NO: 895877 - DNA, 25 bp, Mus musculus
catcaaggtacttgtgtcagatgcc

SEQ ID NO: 895878 - DNA, 25 bp, Mus musculus
catcaaggtagttgtgtcagatgcc

SEQ ID NO: 895879 - DNA, 25 bp, Mus musculus
catcaagtagatcgtgttcagttta

SEQ ID NO: 895880 - DNA, 25 bp, Mus musculus
catcaagtagatggtgttcagttta

SEQ ID NO: 895881 - DNA, 25 bp, Mus musculus
catcaagtttctcccctaccactga

SEQ ID NO: 895882 - DNA, 25 bp, Mus musculus
catcaagtttctgccctaccactga

SEQ ID NO: 895883 - DNA, 25 bp, Mus musculus
catcaatcagcctggagacaccatg

SEQ ID NO: 895884 - DNA, 25 bp, Mus musculus
catcaatcaggctggagacaccatg

SEQ ID NO: 895885 - DNA, 25 bp, Mus musculus
catcaatctgcacaagcggcctctg

SEQ ID NO: 895886 - DNA, 25 bp, Mus musculus
catcaatctgcagaagcggcctctg

SEQ ID NO: 895887 - DNA, 25 bp, Mus musculus
catcaatgagccaacagcagctgct

SEQ ID NO: 895888 - DNA, 25 bp, Mus musculus
catcaatgagcctacagcagctgct

SEQ ID NO: 895889 - DNA, 25 bp, Mus musculus
catcaatgctcttttctactattca

SEQ ID NO: 895890 - DNA, 25 bp, Mus musculus
catcaatgctgttttctactattca

SEQ ID NO: 895891 - DNA, 25 bp, Mus musculus
catcaatgctttcaatttaaaatct

SEQ ID NO: 895892 - DNA, 25 bp, Mus musculus
catcaatgctttcttcacagaggcg

SEQ ID NO: 895893 - DNA, 25 bp, Mus musculus
catcaatgctttgaatttaaaatct

SEQ ID NO: 895894 - DNA, 25 bp, Mus musculus
catcaatgctttgttcacagaggcg

SEQ ID NO: 895895 - DNA, 25 bp, Mus musculus
catcaattcaatggatcctgttcga

SEQ ID NO: 895896 - DNA, 25 bp, Mus musculus
catcaattcaatggttcctgttcga

SEQ ID NO: 895897 - DNA, 25 bp, Mus musculus
catcacaagccacgaggtggccagg

SEQ ID NO: 895898 - DNA, 25 bp, Mus musculus
catcacaagccaggaggtggccagg

SEQ ID NO: 895899 - DNA, 25 bp, Mus musculus
catcacacagcctcggcccacactg

SEQ ID NO: 895900 - DNA, 25 bp, Mus musculus
catcacacaggctcggcccacactg

SEQ ID NO: 895901 - DNA, 25 bp, Mus musculus
catcacagcagccacgagatgtcct

SEQ ID NO: 895902 - DNA, 25 bp, Mus musculus
catcacagcagccaggagatgtcct

SEQ ID NO: 895903 - DNA, 25 bp, Mus musculus
catcacagccagcaagtcacctggg

SEQ ID NO: 895904 - DNA, 25 bp, Mus musculus
catcacagccaggaagtcacctggg

SEQ ID NO: 895905 - DNA, 25 bp, Mus musculus
catcacatactgcatccaaaactac

SEQ ID NO: 895906 - DNA, 25 bp, Mus musculus
catcacatactggatccaaaactac

SEQ ID NO: 895907 - DNA, 25 bp, Mus musculus
catcaccaacacagacgtctttatt

SEQ ID NO: 895908 - DNA, 25 bp, Mus musculus
catcaccaacacgtctttattgcca

SEQ ID NO: 895909 - DNA, 25 bp, Mus musculus
catcaccaactcagacgtctttatt

SEQ ID NO: 895910 - DNA, 25 bp, Mus musculus
catcaccaactcgtctttattgcca

SEQ ID NO: 895911 - DNA, 25 bp, Mus musculus
catcaccaagctcctccagacaacc

SEQ ID NO: 895912 - DNA, 25 bp, Mus musculus
catcaccaaggtcctccagacaacc

SEQ ID NO: 895913 - DNA, 25 bp, Mus musculus
catcaccacacgcacaatcatggag

SEQ ID NO: 895914 - DNA, 25 bp, Mus musculus
catcaccacacgcagaatcatggag

SEQ ID NO: 895915 - DNA, 25 bp, Mus musculus
catcaccaccgtcgttcccactgca

SEQ ID NO: 895916 - DNA, 25 bp, Mus musculus
catcaccaccgtggttcccactgca

SEQ ID NO: 895917 - DNA, 25 bp, Mus musculus
catcaccaggaacgcctatggaggt

SEQ ID NO: 895918 - DNA, 25 bp, Mus musculus
catcaccaggaaggcctatggaggt

SEQ ID NO: 895919 - DNA, 25 bp, Mus musculus
catcaccatgaacttctgagacaag

SEQ ID NO: 895920 - DNA, 25 bp, Mus musculus
catcaccatgaagttctgagacaag

SEQ ID NO: 895921 - DNA, 25 bp, Mus musculus
catcaccatgcgaaatgcctccttt

SEQ ID NO: 895922 - DNA, 25 bp, Mus musculus
catcaccatgggaaatgcctccttt

SEQ ID NO: 895923 - DNA, 25 bp, Mus musculus
catcaccccagacgtgtggccaaac

SEQ ID NO: 895924 - DNA, 25 bp, Mus musculus
catcaccccagaggtgtggccaaac

SEQ ID NO: 895925 - DNA, 25 bp, Mus musculus
catcaccctctacacgagttttctt

SEQ ID NO: 895926 - DNA, 25 bp, Mus musculus
catcaccctctacaggagttttctt

SEQ ID NO: 895927 - DNA, 25 bp, Mus musculus
catcacccttatgactcggggataa

SEQ ID NO: 895928 - DNA, 25 bp, Mus musculus
catcacccttggccatccactaaat

SEQ ID NO: 895929 - DNA, 25 bp, Mus musculus
catcacccttgggcatccactaaat

SEQ ID NO: 895930 - DNA, 25 bp, Mus musculus
catcacccttttgactcggggataa

SEQ ID NO: 895931 - DNA, 25 bp, Mus musculus
catcacctacatccacctgagcgga

SEQ ID NO: 895932 - DNA, 25 bp, Mus musculus
catcacctacatcctcctgagcgga

SEQ ID NO: 895933 - DNA, 25 bp, Mus musculus
catcacctatgacacactaaagtac

SEQ ID NO: 895934 - DNA, 25 bp, Mus musculus
catcacctatgacagcggagaagct

SEQ ID NO: 895935 - DNA, 25 bp, Mus musculus
catcacctatgacatggtagaagag

SEQ ID NO: 895936 - DNA, 25 bp, Mus musculus
catcacctatgagacactaaagtac

SEQ ID NO: 895937 - DNA, 25 bp, Mus musculus
catcacctatgagagcggagaagct

SEQ ID NO: 895938 - DNA, 25 bp, Mus musculus
catcacctatgagatggtagaagag

SEQ ID NO: 895939 - DNA, 25 bp, Mus musculus
catcacctctgcctactatcgtggg

SEQ ID NO: 895940 - DNA, 25 bp, Mus musculus
catcacctctgcgtactatcgtggg

SEQ ID NO: 895941 - DNA, 25 bp, Mus musculus
catcacgaagaacatctggagaaca

SEQ ID NO: 895942 - DNA, 25 bp, Mus musculus
catcacgaagtacatctggagaaca

SEQ ID NO: 895943 - DNA, 25 bp, Mus musculus
catcacgaatcccactttccaaaca

SEQ ID NO: 895944 - DNA, 25 bp, Mus musculus
catcacgaatgccactttccaaaca

SEQ ID NO: 895945 - DNA, 25 bp, Mus musculus
catcacgctaagcattctgagggca

SEQ ID NO: 895946 - DNA, 25 bp, Mus musculus
catcacgctaaggattctgagggca

SEQ ID NO: 895947 - DNA, 25 bp, Mus musculus
catcacgctcacagccttaagcgag

SEQ ID NO: 895948 - DNA, 25 bp, Mus musculus
catcacgctcacaggcttaagcgag

SEQ ID NO: 895949 - DNA, 25 bp, Mus musculus
catcacggaaatactcattgcaaac

SEQ ID NO: 895950 - DNA, 25 bp, Mus musculus
catcacggaaattctcattgcaaac

SEQ ID NO: 895951 - DNA, 25 bp, Mus musculus
catcactaaagaagaaatgctggac

SEQ ID NO: 895952 - DNA, 25 bp, Mus musculus
catcactaaagatgaaatgctggac

SEQ ID NO: 895953 - DNA, 25 bp, Mus musculus
catcactaagatcaaaccacatagg

SEQ ID NO: 895954 - DNA, 25 bp, Mus musculus
catcactaagcacgattcatttcat

SEQ ID NO: 895955 - DNA, 25 bp, Mus musculus
catcactaagcaggattcatttcat

SEQ ID NO: 895956 - DNA, 25 bp, Mus musculus
catcactaagttcaaaccacatagg

SEQ ID NO: 895957 - DNA, 25 bp, Mus musculus
catcactcggaacgattcctttcac

SEQ ID NO: 895958 - DNA, 25 bp, Mus musculus
catcactcggaaggattcctttcac

SEQ ID NO: 895959 - DNA, 25 bp, Mus musculus
catcactgcacttctgatcttcctg

SEQ ID NO: 895960 - DNA, 25 bp, Mus musculus
catcactgcagttctgatcttcctg

SEQ ID NO: 895961 - DNA, 25 bp, Mus musculus
catcactgccagcacgttggtgtca

SEQ ID NO: 895962 - DNA, 25 bp, Mus musculus
catcactgccagcaggttggtgtca

SEQ ID NO: 895963 - DNA, 25 bp, Mus musculus
catcactgcccctggctaaacaact

SEQ ID NO: 895964 - DNA, 25 bp, Mus musculus
catcactgccgctggctaaacaact

SEQ ID NO: 895965 - DNA, 25 bp, Mus musculus
catcactgtgcgccagctggaggct

SEQ ID NO: 895966 - DNA, 25 bp, Mus musculus
catcactgtgcggcagctggaggct

SEQ ID NO: 895967 - DNA, 25 bp, Mus musculus
catcactgttgtcgactggcccttt

SEQ ID NO: 895968 - DNA, 25 bp, Mus musculus
catcactgttgtggactggcccttt

SEQ ID NO: 895969 - DNA, 25 bp, Mus musculus
catcacttctggcacactgtcccca

SEQ ID NO: 895970 - DNA, 25 bp, Mus musculus
catcacttctgggacactgtcccca

SEQ ID NO: 895971 - DNA, 25 bp, Mus musculus
catcactttcaacggtgtttgcaca

SEQ ID NO: 895972 - DNA, 25 bp, Mus musculus
catcactttcaagggtgtttgcaca

SEQ ID NO: 895973 - DNA, 25 bp, Mus musculus
catcactttggccacgaggagttgc

SEQ ID NO: 895974 - DNA, 25 bp, Mus musculus
catcactttggccaggaggagttgc

SEQ ID NO: 895975 - DNA, 25 bp, Mus musculus
catcagaaatcgcacaaagccacag

SEQ ID NO: 895976 - DNA, 25 bp, Mus musculus
catcagaaatcgcagaaagccacag

SEQ ID NO: 895977 - DNA, 25 bp, Mus musculus
catcagaacccacgccacacactgg

SEQ ID NO: 895978 - DNA, 25 bp, Mus musculus
catcagaacccaggccacacactgg

SEQ ID NO: 895979 - DNA, 25 bp, Mus musculus
catcagaagagactcacgatgaaga

SEQ ID NO: 895980 - DNA, 25 bp, Mus musculus
catcagaagagagtcacgatgaaga

SEQ ID NO: 895981 - DNA, 25 bp, Mus musculus
catcagaagcagcagctatctggag

SEQ ID NO: 895982 - DNA, 25 bp, Mus musculus
catcagaagcaggagctatctggag

SEQ ID NO: 895983 - DNA, 25 bp, Mus musculus
catcagaccacgtctctacggcagt

SEQ ID NO: 895984 - DNA, 25 bp, Mus musculus
catcagaccaggtctctacggcagt

SEQ ID NO: 895985 - DNA, 25 bp, Mus musculus
catcagagagacatcttctctgtca

SEQ ID NO: 895986 - DNA, 25 bp, Mus musculus
catcagagagacttcttctctgtca

SEQ ID NO: 895987 - DNA, 25 bp, Mus musculus
catcagagatgacacgtttgtggtg

SEQ ID NO: 895988 - DNA, 25 bp, Mus musculus
catcagagatgacaggtttgtggtg

SEQ ID NO: 895989 - DNA, 25 bp, Mus musculus
catcagatcgccatcaagcagatcc

SEQ ID NO: 895990 - DNA, 25 bp, Mus musculus
catcagatcggcatcaagcagatcc

SEQ ID NO: 895991 - DNA, 25 bp, Mus musculus
catcagcaagcccctgcctggcccc

SEQ ID NO: 895992 - DNA, 25 bp, Mus musculus
catcagcaaggccctgcctggcccc

SEQ ID NO: 895993 - DNA, 25 bp, Mus musculus
catcagcagatccatttgaatgtaa

SEQ ID NO: 895994 - DNA, 25 bp, Mus musculus
catcagcagatcgatttgaatgtaa

SEQ ID NO: 895995 - DNA, 25 bp, Mus musculus
catcagcagccacatcccagccaca

SEQ ID NO: 895996 - DNA, 25 bp, Mus musculus
catcagcagccagatcccagccaca

SEQ ID NO: 895997 - DNA, 25 bp, Mus musculus
catcagcattgtcctcatcgttctc

SEQ ID NO: 895998 - DNA, 25 bp, Mus musculus
catcagcattgtgctcatcgttctc

SEQ ID NO: 895999 - DNA, 25 bp, Mus musculus
catcagccagcagccagtcctgttt

SEQ ID NO: 896000 - DNA, 25 bp, Mus musculus
catcagccaggagccagtcctgttt

SEQ ID NO: 896001 - DNA, 25 bp, Mus musculus
catcagcctgaacgagaaggatgaa

SEQ ID NO: 896002 - DNA, 25 bp, Mus musculus
catcagcctgtacgagaaggatgaa

SEQ ID NO: 896003 - DNA, 25 bp, Mus musculus
catcagcttccacacaaactcaagt

SEQ ID NO: 896004 - DNA, 25 bp, Mus musculus
catcagcttccacacaccatgcctt

SEQ ID NO: 896005 - DNA, 25 bp, Mus musculus
catcagcttccacacgtttcctttg

SEQ ID NO: 896006 - DNA, 25 bp, Mus musculus
catcagcttccacagaaactcaagt

SEQ ID NO: 896007 - DNA, 25 bp, Mus musculus
catcagcttccacagaccatgcctt

SEQ ID NO: 896008 - DNA, 25 bp, Mus musculus
catcagcttccacaggtttcctttg

SEQ ID NO: 896009 - DNA, 25 bp, Mus musculus
catcaggactctcaggtaaatgcat

SEQ ID NO: 896010 - DNA, 25 bp, Mus musculus
catcaggactctgaggtaaatgcat

SEQ ID NO: 896011 - DNA, 25 bp, Mus musculus
catcaggaggagctttgaaaagcga

SEQ ID NO: 896012 - DNA, 25 bp, Mus musculus
catcaggaggaggtttgaaaagcga

SEQ ID NO: 896013 - DNA, 25 bp, Mus musculus
catcaggatgttgacgtgtctcaaa

SEQ ID NO: 896014 - DNA, 25 bp, Mus musculus
catcaggatgttgaggtgtctcaaa

SEQ ID NO: 896015 - DNA, 25 bp, Mus musculus
catcagggcgaacggactgaagccc

SEQ ID NO: 896016 - DNA, 25 bp, Mus musculus
catcagggcgaagggactgaagccc

SEQ ID NO: 896017 - DNA, 25 bp, Mus musculus
catcagtacaacattgtcggcttgc

SEQ ID NO: 896018 - DNA, 25 bp, Mus musculus
catcagtacaactttgtcggcttgc

SEQ ID NO: 896019 - DNA, 25 bp, Mus musculus
catcagtacagcagtaggcaagttg

SEQ ID NO: 896020 - DNA, 25 bp, Mus musculus
catcagtacagctgtaggcaagttg

SEQ ID NO: 896021 - DNA, 25 bp, Mus musculus
catcagtcagatctcaggttccaat

SEQ ID NO: 896022 - DNA, 25 bp, Mus musculus
catcagtcagttctcaggttccaat

SEQ ID NO: 896023 - DNA, 25 bp, Mus musculus
catcagtcctcacatgcggtgagca

SEQ ID NO: 896024 - DNA, 25 bp, Mus musculus
catcagtcctcagatgcggtgagca

SEQ ID NO: 896025 - DNA, 25 bp, Mus musculus
catcagtgagcgaatggctgcagtc

SEQ ID NO: 896026 - DNA, 25 bp, Mus musculus
catcagtgagcgtatggctgcagtc

SEQ ID NO: 896027 - DNA, 25 bp, Mus musculus
catcagtggatcagaccctgaaagc

SEQ ID NO: 896028 - DNA, 25 bp, Mus musculus
catcagtggatctgaccctgaaagc

SEQ ID NO: 896029 - DNA, 25 bp, Mus musculus
catcagtgtcatcacgggtggtctc

SEQ ID NO: 896030 - DNA, 25 bp, Mus musculus
catcagtgtcatcaggggtggtctc

SEQ ID NO: 896031 - DNA, 25 bp, Mus musculus
catcagttgtcaaacataatactaa

SEQ ID NO: 896032 - DNA, 25 bp, Mus musculus
catcagttgtcaaagataatactaa

SEQ ID NO: 896033 - DNA, 25 bp, Mus musculus
catcataaagcctggcccagtaccc

SEQ ID NO: 896034 - DNA, 25 bp, Mus musculus
catcataaaggctggcccagtaccc

SEQ ID NO: 896035 - DNA, 25 bp, Mus musculus
catcatacaagtatgtgtggccatc

SEQ ID NO: 896036 - DNA, 25 bp, Mus musculus
catcatacaagtttgtgtggccatc

SEQ ID NO: 896037 - DNA, 25 bp, Mus musculus
catcatacagaccagagggattata

SEQ ID NO: 896038 - DNA, 25 bp, Mus musculus
catcatacagtccagagggattata

SEQ ID NO: 896039 - DNA, 25 bp, Mus musculus
catcatatctttcacaggagcctat

SEQ ID NO: 896040 - DNA, 25 bp, Mus musculus
catcatatctttcagaggagcctat

SEQ ID NO: 896041 - DNA, 25 bp, Mus musculus
catcatcaagcaaagggaacaggaa

SEQ ID NO: 896042 - DNA, 25 bp, Mus musculus
catcatcaaggaaagggaacaggaa

SEQ ID NO: 896043 - DNA, 25 bp, Mus musculus
catcatcacgaaactgaggctcctt

SEQ ID NO: 896044 - DNA, 25 bp, Mus musculus
catcatcacgatcatttcccagaag

SEQ ID NO: 896045 - DNA, 25 bp, Mus musculus
catcatcacgtaactgaggctcctt

SEQ ID NO: 896046 - DNA, 25 bp, Mus musculus
catcatcacgttcatttcccagaag

SEQ ID NO: 896047 - DNA, 25 bp, Mus musculus
catcatcactttcaagggtgtttgc

SEQ ID NO: 896048 - DNA, 25 bp, Mus musculus
catcatcactttcatgggtgtttgc

SEQ ID NO: 896049 - DNA, 25 bp, Mus musculus
catcatcatgcctgagtttgagacc

SEQ ID NO: 896050 - DNA, 25 bp, Mus musculus
catcatcatggctgagtttgagacc

SEQ ID NO: 896051 - DNA, 25 bp, Mus musculus
catcatccacgcagtgattgacgag

SEQ ID NO: 896052 - DNA, 25 bp, Mus musculus
catcatccacgctgtgattgacgag

SEQ ID NO: 896053 - DNA, 25 bp, Mus musculus
catcatccagctggacaagtctgtg

SEQ ID NO: 896054 - DNA, 25 bp, Mus musculus
catcatccagctggatagcagtgtg

SEQ ID NO: 896055 - DNA, 25 bp, Mus musculus
catcatccaggtggacaagtctgtg

SEQ ID NO: 896056 - DNA, 25 bp, Mus musculus
catcatccaggtggatagcagtgtg

SEQ ID NO: 896057 - DNA, 25 bp, Mus musculus
catcatcccgaacgttcttgctcag

SEQ ID NO: 896058 - DNA, 25 bp, Mus musculus
catcatcccgaaggttcttgctcag

SEQ ID NO: 896059 - DNA, 25 bp, Mus musculus
catcatccgacagcagctccaggct

SEQ ID NO: 896060 - DNA, 25 bp, Mus musculus
catcatccgacagctccaggctcac

SEQ ID NO: 896061 - DNA, 25 bp, Mus musculus
catcatccgagagcagctccaggct

SEQ ID NO: 896062 - DNA, 25 bp, Mus musculus
catcatccgagagctccaggctcac

SEQ ID NO: 896063 - DNA, 25 bp, Mus musculus
catcatcctggtcttcctgctggca

SEQ ID NO: 896064 - DNA, 25 bp, Mus musculus
catcatcctggtgttcctgctggca

SEQ ID NO: 896065 - DNA, 25 bp, Mus musculus
catcatcgagccaaacgaccggcac

SEQ ID NO: 896066 - DNA, 25 bp, Mus musculus
catcatcgaggcaaacgaccggcac

SEQ ID NO: 896067 - DNA, 25 bp, Mus musculus
catcatcgtgcgcgatgagtccacg

SEQ ID NO: 896068 - DNA, 25 bp, Mus musculus
catcatcgtgcgggatgagtccacg

SEQ ID NO: 896069 - DNA, 25 bp, Mus musculus
catcatctacagagacctgaagcca

SEQ ID NO: 896070 - DNA, 25 bp, Mus musculus
catcatctacagtgacctgaagcca

SEQ ID NO: 896071 - DNA, 25 bp, Mus musculus
catcatctttcaaaattcgcagaaa

SEQ ID NO: 896072 - DNA, 25 bp, Mus musculus
catcatctttcaaatttcgcagaaa

SEQ ID NO: 896073 - DNA, 25 bp, Mus musculus
catcatctttgtcgacagtgcggcc

SEQ ID NO: 896074 - DNA, 25 bp, Mus musculus
catcatctttgtggacagtgcggcc

SEQ ID NO: 896075 - DNA, 25 bp, Mus musculus
catcatgaacaaatgtacttccctt

SEQ ID NO: 896076 - DNA, 25 bp, Mus musculus
catcatgaacaattgtacttccctt

SEQ ID NO: 896077 - DNA, 25 bp, Mus musculus
catcatgagcaactcagccagtgag

SEQ ID NO: 896078 - DNA, 25 bp, Mus musculus
catcatgagctactcagccagtgag

SEQ ID NO: 896079 - DNA, 25 bp, Mus musculus
catcatgaggctggagttctacttc

SEQ ID NO: 896080 - DNA, 25 bp, Mus musculus
catcatgagggtggagttctacttc

SEQ ID NO: 896081 - DNA, 25 bp, Mus musculus
catcatgcaccccaagtggaagcac

SEQ ID NO: 896082 - DNA, 25 bp, Mus musculus
catcatgcaccccaagtggcagcgc

SEQ ID NO: 896083 - DNA, 25 bp, Mus musculus
catcatgcacgccaagtggaagcac

SEQ ID NO: 896084 - DNA, 25 bp, Mus musculus
catcatgcacgccaagtggcagcgc

SEQ ID NO: 896085 - DNA, 25 bp, Mus musculus
catcatgcagaacgtggctggcgaa

SEQ ID NO: 896086 - DNA, 25 bp, Mus musculus
catcatgcagaaggtggctggcgaa

SEQ ID NO: 896087 - DNA, 25 bp, Mus musculus
catcatgcgccccaatgacagtcct

SEQ ID NO: 896088 - DNA, 25 bp, Mus musculus
catcatgcgcccgaatgacagtcct

SEQ ID NO: 896089 - DNA, 25 bp, Mus musculus
catcatggagaacctattcgagagg

SEQ ID NO: 896090 - DNA, 25 bp, Mus musculus
catcatggagaagctattcgagagg

SEQ ID NO: 896091 - DNA, 25 bp, Mus musculus
catcattacgaacctcctttaccac

SEQ ID NO: 896092 - DNA, 25 bp, Mus musculus
catcattacgtacctcctttaccac

SEQ ID NO: 896093 - DNA, 25 bp, Mus musculus
catcattcagaaatggcaaaatgct

SEQ ID NO: 896094 - DNA, 25 bp, Mus musculus
catcattcagcgctgcaaaataaat

SEQ ID NO: 896095 - DNA, 25 bp, Mus musculus
catcattcagctttttcctgatgag

SEQ ID NO: 896096 - DNA, 25 bp, Mus musculus
catcattcagggctgcaaaataaat

SEQ ID NO: 896097 - DNA, 25 bp, Mus musculus
catcattcaggtttttcctgatgag

SEQ ID NO: 896098 - DNA, 25 bp, Mus musculus
catcattcagtaatggcaaaatgct

SEQ ID NO: 896099 - DNA, 25 bp, Mus musculus
catcattccacacctctgcgaagac

SEQ ID NO: 896100 - DNA, 25 bp, Mus musculus
catcattccacagctctgcgaagac

SEQ ID NO: 896101 - DNA, 25 bp, Mus musculus
catcattcccaacgactgtgccggt

SEQ ID NO: 896102 - DNA, 25 bp, Mus musculus
catcattcccaaggactgtgccggt

SEQ ID NO: 896103 - DNA, 25 bp, Mus musculus
catcattcctatcaccttgcgtgtg

SEQ ID NO: 896104 - DNA, 25 bp, Mus musculus
catcattcctatcagcttgcgtgtg

SEQ ID NO: 896105 - DNA, 25 bp, Mus musculus
catcattctgagcgatggcctggaa

SEQ ID NO: 896106 - DNA, 25 bp, Mus musculus
catcattctgagggatggcctggaa

SEQ ID NO: 896107 - DNA, 25 bp, Mus musculus
catcattgctcgtcccccaggaact

SEQ ID NO: 896108 - DNA, 25 bp, Mus musculus
catcattgctggtcccccaggaact

SEQ ID NO: 896109 - DNA, 25 bp, Mus musculus
catcattgggaacaagggagagact

SEQ ID NO: 896110 - DNA, 25 bp, Mus musculus
catcattgggaagaagggagagact

SEQ ID NO: 896111 - DNA, 25 bp, Mus musculus
catcatttaatgctcaggggagtac

SEQ ID NO: 896112 - DNA, 25 bp, Mus musculus
catcatttaatggtcaggggagtac

SEQ ID NO: 896113 - DNA, 25 bp, Mus musculus
catcatttggactttctaaagaaga

SEQ ID NO: 896114 - DNA, 25 bp, Mus musculus
catcatttggtctttctaaagaaga

SEQ ID NO: 896115 - DNA, 25 bp, Mus musculus
catcattttcagcaatgctgccatt

SEQ ID NO: 896116 - DNA, 25 bp, Mus musculus
catcattttctgcaatgctgccatt

SEQ ID NO: 896117 - DNA, 25 bp, Mus musculus
catccaaataacacagacacgcttt

SEQ ID NO: 896118 - DNA, 25 bp, Mus musculus
catccaaataacactgacacgcttt

SEQ ID NO: 896119 - DNA, 25 bp, Mus musculus
catccaacaaggatgcagctctaat

SEQ ID NO: 896120 - DNA, 25 bp, Mus musculus
catccaacaaggttgcagctctaat

SEQ ID NO: 896121 - DNA, 25 bp, Mus musculus
catccaacacagccctgttgaccac

SEQ ID NO: 896122 - DNA, 25 bp, Mus musculus
catccaacacagccgtgttgaccac

SEQ ID NO: 896123 - DNA, 25 bp, Mus musculus
catccaatgaggccaatattcatga

SEQ ID NO: 896124 - DNA, 25 bp, Mus musculus
catccaatgagggcaatattcatga

SEQ ID NO: 896125 - DNA, 25 bp, Mus musculus
catccacagaatcctagactttggc

SEQ ID NO: 896126 - DNA, 25 bp, Mus musculus
catccacagacacttgaagcctggc

SEQ ID NO: 896127 - DNA, 25 bp, Mus musculus
catccacagagacttgaagcctggc

SEQ ID NO: 896128 - DNA, 25 bp, Mus musculus
catccacagattcctagactttggc

SEQ ID NO: 896129 - DNA, 25 bp, Mus musculus
catccacaggcacttaaaacccagt

SEQ ID NO: 896130 - DNA, 25 bp, Mus musculus
catccacagggacttaaaacccagt

SEQ ID NO: 896131 - DNA, 25 bp, Mus musculus
catccacattgacagcaccaagacc

SEQ ID NO: 896132 - DNA, 25 bp, Mus musculus
catccacattgagagcaccaagacc

SEQ ID NO: 896133 - DNA, 25 bp, Mus musculus
catccaccagacgggaagtaaaaag

SEQ ID NO: 896134 - DNA, 25 bp, Mus musculus
catccaccagcctggaaatggaacg

SEQ ID NO: 896135 - DNA, 25 bp, Mus musculus
catccaccaggctggaaatggaacg

SEQ ID NO: 896136 - DNA, 25 bp, Mus musculus
catccaccagtcgggaagtaaaaag

SEQ ID NO: 896137 - DNA, 25 bp, Mus musculus
catccacgagcagatgctgaaggat

SEQ ID NO: 896138 - DNA, 25 bp, Mus musculus
catccacgaggagatgctgaaggat

SEQ ID NO: 896139 - DNA, 25 bp, Mus musculus
catccacgcactgattgacgagaga

SEQ ID NO: 896140 - DNA, 25 bp, Mus musculus
catccacgcagtgattgacgagaga

SEQ ID NO: 896141 - DNA, 25 bp, Mus musculus
catccactggattcgaatgagaaca

SEQ ID NO: 896142 - DNA, 25 bp, Mus musculus
catccactggtttcgaatgagaaca

SEQ ID NO: 896143 - DNA, 25 bp, Mus musculus
catccacttatcacttcattgtatc

SEQ ID NO: 896144 - DNA, 25 bp, Mus musculus
catccacttatctcttcattgtatc

SEQ ID NO: 896145 - DNA, 25 bp, Mus musculus
catccacttgctggagaattcaggg

SEQ ID NO: 896146 - DNA, 25 bp, Mus musculus
catccacttggtggagaattcaggg

SEQ ID NO: 896147 - DNA, 25 bp, Mus musculus
catccagaatgtcgatcggtcatgg

SEQ ID NO: 896148 - DNA, 25 bp, Mus musculus
catccagaatgtggatcggtcatgg

SEQ ID NO: 896149 - DNA, 25 bp, Mus musculus
catccagactgaattccgatgctgt

SEQ ID NO: 896150 - DNA, 25 bp, Mus musculus
catccagactgatttccgatgctgt

SEQ ID NO: 896151 - DNA, 25 bp, Mus musculus
catccagcagcacgaccagtgtgtg

SEQ ID NO: 896152 - DNA, 25 bp, Mus musculus
catccagcagcactttgtgcagtgg

SEQ ID NO: 896153 - DNA, 25 bp, Mus musculus
catccagcagcaggaccagtgtgtg

SEQ ID NO: 896154 - DNA, 25 bp, Mus musculus
catccagcagcagtttgtgcagtgg

SEQ ID NO: 896155 - DNA, 25 bp, Mus musculus
catccagcagcgttttctggctaag

SEQ ID NO: 896156 - DNA, 25 bp, Mus musculus
catccagcagggttttctggctaag

SEQ ID NO: 896157 - DNA, 25 bp, Mus musculus
catccagctgatcacgcgcatggag

SEQ ID NO: 896158 - DNA, 25 bp, Mus musculus
catccagctgcgtggcaccattatt

SEQ ID NO: 896159 - DNA, 25 bp, Mus musculus
catccagctgggtggcaccattatt

SEQ ID NO: 896160 - DNA, 25 bp, Mus musculus
catccagctgttcacgcgcatggag

SEQ ID NO: 896161 - DNA, 25 bp, Mus musculus
catccaggacacctttctgtgttgt

SEQ ID NO: 896162 - DNA, 25 bp, Mus musculus
catccaggacacgtttctgtgttgt

SEQ ID NO: 896163 - DNA, 25 bp, Mus musculus
catccaggagctcttggacaagcac

SEQ ID NO: 896164 - DNA, 25 bp, Mus musculus
catccaggaggtcttggacaagcac

SEQ ID NO: 896165 - DNA, 25 bp, Mus musculus
catccaggcagaagagtggtacttt

SEQ ID NO: 896166 - DNA, 25 bp, Mus musculus
catccaggcagaagtgtggtacttt

SEQ ID NO: 896167 - DNA, 25 bp, Mus musculus
catccaggccaaattagaaaaagtc

SEQ ID NO: 896168 - DNA, 25 bp, Mus musculus
catccaggccaatttagaaaaagtc

SEQ ID NO: 896169 - DNA, 25 bp, Mus musculus
catccaggccagcctgggcagcatc

SEQ ID NO: 896170 - DNA, 25 bp, Mus musculus
catccaggccaggctgggcagcatc

SEQ ID NO: 896171 - DNA, 25 bp, Mus musculus
catccaggcccgaacgacatacaca

SEQ ID NO: 896172 - DNA, 25 bp, Mus musculus
catccaggcccgaaggacatacaca

SEQ ID NO: 896173 - DNA, 25 bp, Mus musculus
catccaggctggccgcccggatggc

SEQ ID NO: 896174 - DNA, 25 bp, Mus musculus
catccaggctgggcgcccggatggc

SEQ ID NO: 896175 - DNA, 25 bp, Mus musculus
catccaggtgaaactgtttgtggtc

SEQ ID NO: 896176 - DNA, 25 bp, Mus musculus
catccaggtgtaactgtttgtggtc

SEQ ID NO: 896177 - DNA, 25 bp, Mus musculus
catccagtacttcacactgaacccc

SEQ ID NO: 896178 - DNA, 25 bp, Mus musculus
catccagtacttcagactgaacccc

SEQ ID NO: 896179 - DNA, 25 bp, Mus musculus
catccagtcaagcgcctttgatacc

SEQ ID NO: 896180 - DNA, 25 bp, Mus musculus
catccagtcaagggcctttgatacc

SEQ ID NO: 896181 - DNA, 25 bp, Mus musculus
catccagtcagagacgtcgcagtgg

SEQ ID NO: 896182 - DNA, 25 bp, Mus musculus
catccagtcagagaggtcgcagtgg

SEQ ID NO: 896183 - DNA, 25 bp, Mus musculus
catccagtctcgaaagaactgtgcg

SEQ ID NO: 896184 - DNA, 25 bp, Mus musculus
catccagtctcgtaagaactgtgcg

SEQ ID NO: 896185 - DNA, 25 bp, Mus musculus
catccatcaactaaccaatactgga

SEQ ID NO: 896186 - DNA, 25 bp, Mus musculus
catccatcaactaagcaatactgga

SEQ ID NO: 896187 - DNA, 25 bp, Mus musculus
catccatcagagctccagcatgagt

SEQ ID NO: 896188 - DNA, 25 bp, Mus musculus
catccatcagaggtccagcatgagt

SEQ ID NO: 896189 - DNA, 25 bp, Mus musculus
catccatcagtacacggagcagatc

SEQ ID NO: 896190 - DNA, 25 bp, Mus musculus
catccatcagtacactcatgcctgc

SEQ ID NO: 896191 - DNA, 25 bp, Mus musculus
catccatcagtacagggagcagatc

SEQ ID NO: 896192 - DNA, 25 bp, Mus musculus
catccatcagtacagtcatgcctgc

SEQ ID NO: 896193 - DNA, 25 bp, Mus musculus
catccatgttcgacaccacgcccca

SEQ ID NO: 896194 - DNA, 25 bp, Mus musculus
catccatgttcgtcaccacgcccca

SEQ ID NO: 896195 - DNA, 25 bp, Mus musculus
catccattaccacgtgcctcgcacc

SEQ ID NO: 896196 - DNA, 25 bp, Mus musculus
catccattaccaggtgcctcgcacc

SEQ ID NO: 896197 - DNA, 25 bp, Mus musculus
catcccaacaactatcctgatggca

SEQ ID NO: 896198 - DNA, 25 bp, Mus musculus
catcccaacatacttaagttgtttg

SEQ ID NO: 896199 - DNA, 25 bp, Mus musculus
catcccaacatagttaagttgtttg

SEQ ID NO: 896200 - DNA, 25 bp, Mus musculus
catcccaacatctatcctgatggca

SEQ ID NO: 896201 - DNA, 25 bp, Mus musculus
catcccaacatggacgcggcgtgtc

SEQ ID NO: 896202 - DNA, 25 bp, Mus musculus
catcccaacatggaggcggcgtgtc

SEQ ID NO: 896203 - DNA, 25 bp, Mus musculus
catcccaaccagccagaactcattg

SEQ ID NO: 896204 - DNA, 25 bp, Mus musculus
catcccaaccaggcagaactcattg

SEQ ID NO: 896205 - DNA, 25 bp, Mus musculus
catcccactgcaaagggcatcggtg

SEQ ID NO: 896206 - DNA, 25 bp, Mus musculus
catcccactggaaagggcatcggtg

SEQ ID NO: 896207 - DNA, 25 bp, Mus musculus
catcccagtacacgaagatgagtct

SEQ ID NO: 896208 - DNA, 25 bp, Mus musculus
catcccagtacaggaagatgagtct

SEQ ID NO: 896209 - DNA, 25 bp, Mus musculus
catcccagtgaattcagtcagcacc

SEQ ID NO: 896210 - DNA, 25 bp, Mus musculus
catcccagtgtattcagtcagcacc

SEQ ID NO: 896211 - DNA, 25 bp, Mus musculus
catccccaagacatcaagcctcctt

SEQ ID NO: 896212 - DNA, 25 bp, Mus musculus
catccccaagcggacaaatgtaata

SEQ ID NO: 896213 - DNA, 25 bp, Mus musculus
catccccaagcggacgacactcatt

SEQ ID NO: 896214 - DNA, 25 bp, Mus musculus
catccccaaggggacaaatgtaata

SEQ ID NO: 896215 - DNA, 25 bp, Mus musculus
catccccaaggggacgacactcatt

SEQ ID NO: 896216 - DNA, 25 bp, Mus musculus
catccccaagtcatcaagcctcctt

SEQ ID NO: 896217 - DNA, 25 bp, Mus musculus
catccccactgacatgatcccccag

SEQ ID NO: 896218 - DNA, 25 bp, Mus musculus
catccccactgagatgatcccccag

SEQ ID NO: 896219 - DNA, 25 bp, Mus musculus
catccccagagacaaccttcttcca

SEQ ID NO: 896220 - DNA, 25 bp, Mus musculus
catccccagagacatgaggaaagtg

SEQ ID NO: 896221 - DNA, 25 bp, Mus musculus
catccccagagaccatttctggctg

SEQ ID NO: 896222 - DNA, 25 bp, Mus musculus
catccccagagagaaccttcttcca

SEQ ID NO: 896223 - DNA, 25 bp, Mus musculus
catccccagagagatgaggaaagtg

SEQ ID NO: 896224 - DNA, 25 bp, Mus musculus
catccccagagagcatttctggctg

SEQ ID NO: 896225 - DNA, 25 bp, Mus musculus
catcccccacagcaccacaagagat

SEQ ID NO: 896226 - DNA, 25 bp, Mus musculus
catcccccacaggaccacaagagat

SEQ ID NO: 896227 - DNA, 25 bp, Mus musculus
catcccccatatgcagtggaagtgg

SEQ ID NO: 896228 - DNA, 25 bp, Mus musculus
catcccccatttgcagtggaagtgg

SEQ ID NO: 896229 - DNA, 25 bp, Mus musculus
catccccccagccacgatgatgtct

SEQ ID NO: 896230 - DNA, 25 bp, Mus musculus
catccccccagccaggatgatgtct

SEQ ID NO: 896231 - DNA, 25 bp, Mus musculus
catcccctcctacacgagcgggaga

SEQ ID NO: 896232 - DNA, 25 bp, Mus musculus
catcccctcctacaggagcgggaga

SEQ ID NO: 896233 - DNA, 25 bp, Mus musculus
catccccttttacacaactgccacg

SEQ ID NO: 896234 - DNA, 25 bp, Mus musculus
catccccttttagacaactgccacg

SEQ ID NO: 896235 - DNA, 25 bp, Mus musculus
catcccgaagcttcttgctcagaat

SEQ ID NO: 896236 - DNA, 25 bp, Mus musculus
catcccgaaggttcttgctcagaat

SEQ ID NO: 896237 - DNA, 25 bp, Mus musculus
catcccgaggcagaaatgtctgcgg

SEQ ID NO: 896238 - DNA, 25 bp, Mus musculus
catcccgagggagaaatgtctgcgg

SEQ ID NO: 896239 - DNA, 25 bp, Mus musculus
catcccgcagaccgtacctcctgta

SEQ ID NO: 896240 - DNA, 25 bp, Mus musculus
catcccgcagacggtacctcctgta

SEQ ID NO: 896241 - DNA, 25 bp, Mus musculus
catccctctgccctggttccccggg

SEQ ID NO: 896242 - DNA, 25 bp, Mus musculus
catccctctggcctggttccccggg

SEQ ID NO: 896243 - DNA, 25 bp, Mus musculus
catccctgataagacactatggtgg

SEQ ID NO: 896244 - DNA, 25 bp, Mus musculus
catccctgataagagactatggtgg

SEQ ID NO: 896245 - DNA, 25 bp, Mus musculus
catccctgtgggcactggtctaggt

SEQ ID NO: 896246 - DNA, 25 bp, Mus musculus
catccctgtgggcagtggtctaggt

SEQ ID NO: 896247 - DNA, 25 bp, Mus musculus
catccgaaaagtcacggaagagaac

SEQ ID NO: 896248 - DNA, 25 bp, Mus musculus
catccgaaaagtgacggaagagaac

SEQ ID NO: 896249 - DNA, 25 bp, Mus musculus
catccgcatccagacgatgctgccc

SEQ ID NO: 896250 - DNA, 25 bp, Mus musculus
catccgcatccagaggatgctgccc

SEQ ID NO: 896251 - DNA, 25 bp, Mus musculus
catccgcccaattcagccttttatg

SEQ ID NO: 896252 - DNA, 25 bp, Mus musculus
catccgcccatttcagccttttatg

SEQ ID NO: 896253 - DNA, 25 bp, Mus musculus
catccgctgacacccatgcggactg

SEQ ID NO: 896254 - DNA, 25 bp, Mus musculus
catccgctgacatgctggtggactg

SEQ ID NO: 896255 - DNA, 25 bp, Mus musculus
catccgctgagacccatgcggactg

SEQ ID NO: 896256 - DNA, 25 bp, Mus musculus
catccgctgagatgctggtggactg

SEQ ID NO: 896257 - DNA, 25 bp, Mus musculus
catccggaagctggcaaaaacgcag

SEQ ID NO: 896258 - DNA, 25 bp, Mus musculus
catccggaaggaccttcgtccaccc

SEQ ID NO: 896259 - DNA, 25 bp, Mus musculus
catccggaaggagcttcgtccaccc

SEQ ID NO: 896260 - DNA, 25 bp, Mus musculus
catccggaaggtggcaaaaacgcag

SEQ ID NO: 896261 - DNA, 25 bp, Mus musculus
catccggaatcacatctgctttcag

SEQ ID NO: 896262 - DNA, 25 bp, Mus musculus
catccggaatcagatctgctttcag

SEQ ID NO: 896263 - DNA, 25 bp, Mus musculus
catccggatggagacggaagccttg

SEQ ID NO: 896264 - DNA, 25 bp, Mus musculus
catccggatggagagggaagccttg

SEQ ID NO: 896265 - DNA, 25 bp, Mus musculus
catccggtggtccacgaatggcctg

SEQ ID NO: 896266 - DNA, 25 bp, Mus musculus
catccggtggtccaggaatggcctg

SEQ ID NO: 896267 - DNA, 25 bp, Mus musculus
catccgtgagctatttgaatatcat

SEQ ID NO: 896268 - DNA, 25 bp, Mus musculus
catccgtgaggtatttgaatatcat

SEQ ID NO: 896269 - DNA, 25 bp, Mus musculus
catccgtgggctagcccatgccatt

SEQ ID NO: 896270 - DNA, 25 bp, Mus musculus
catccgtggggtagcccatgccatt

SEQ ID NO: 896271 - DNA, 25 bp, Mus musculus
catcctaaatcacctgctgaaatcg

SEQ ID NO: 896272 - DNA, 25 bp, Mus musculus
catcctaaatcagctgctgaaatcg

SEQ ID NO: 896273 - DNA, 25 bp, Mus musculus
catcctaacccacactgtttcaatt

SEQ ID NO: 896274 - DNA, 25 bp, Mus musculus
catcctaacccagactgtttcaatt

SEQ ID NO: 896275 - DNA, 25 bp, Mus musculus
catcctagagcccatgatttccggg

SEQ ID NO: 896276 - DNA, 25 bp, Mus musculus
catcctagaggccatgatttccggg

SEQ ID NO: 896277 - DNA, 25 bp, Mus musculus
catcctcaatagatgaactttctag

SEQ ID NO: 896278 - DNA, 25 bp, Mus musculus
catcctcaatagttgaactttctag

SEQ ID NO: 896279 - DNA, 25 bp, Mus musculus
catcctcactgcagcgaagtttctt

SEQ ID NO: 896280 - DNA, 25 bp, Mus musculus
catcctcactgcagggaagtttctt

SEQ ID NO: 896281 - DNA, 25 bp, Mus musculus
catcctcagaaaacaagatgagtat

SEQ ID NO: 896282 - DNA, 25 bp, Mus musculus
catcctcagaaatcaagatgagtat

SEQ ID NO: 896283 - DNA, 25 bp, Mus musculus
catcctccaagacgcggagtcgccg

SEQ ID NO: 896284 - DNA, 25 bp, Mus musculus
catcctccaagaggcggagtcgccg

SEQ ID NO: 896285 - DNA, 25 bp, Mus musculus
catcctccaccccaatggtaacatc

SEQ ID NO: 896286 - DNA, 25 bp, Mus musculus
catcctccacccgaatggtaacatc

SEQ ID NO: 896287 - DNA, 25 bp, Mus musculus
catcctctaccacctctacaaagcg

SEQ ID NO: 896288 - DNA, 25 bp, Mus musculus
catcctctaccagctctacaaagcg

SEQ ID NO: 896289 - DNA, 25 bp, Mus musculus
catcctgaagaccctgctatgtgga

SEQ ID NO: 896290 - DNA, 25 bp, Mus musculus
catcctgaagtccctgctatgtgga

SEQ ID NO: 896291 - DNA, 25 bp, Mus musculus
catcctgagtgacatggaaataggg

SEQ ID NO: 896292 - DNA, 25 bp, Mus musculus
catcctgagtgacgtcatccactgg

SEQ ID NO: 896293 - DNA, 25 bp, Mus musculus
catcctgagtgagatggaaataggg

SEQ ID NO: 896294 - DNA, 25 bp, Mus musculus
catcctgagtgaggtcatccactgg

SEQ ID NO: 896295 - DNA, 25 bp, Mus musculus
catcctgcagcaaattgccttcaag

SEQ ID NO: 896296 - DNA, 25 bp, Mus musculus
catcctgcaggaaattgccttcaag

SEQ ID NO: 896297 - DNA, 25 bp, Mus musculus
catcctggcgatcattacaggggaa

SEQ ID NO: 896298 - DNA, 25 bp, Mus musculus
catcctggcgcggaattctaccgga

SEQ ID NO: 896299 - DNA, 25 bp, Mus musculus
catcctggcggggaattctaccgga

SEQ ID NO: 896300 - DNA, 25 bp, Mus musculus
catcctggcgttcattacaggggaa

SEQ ID NO: 896301 - DNA, 25 bp, Mus musculus
catcctggtgatcctgctggcagag

SEQ ID NO: 896302 - DNA, 25 bp, Mus musculus
catcctggtgttcctgctggcagag

SEQ ID NO: 896303 - DNA, 25 bp, Mus musculus
catcctggtttgaacatcccaatac

SEQ ID NO: 896304 - DNA, 25 bp, Mus musculus
catcctggtttgaacgtttggagtc

SEQ ID NO: 896305 - DNA, 25 bp, Mus musculus
catcctggtttgaagatcccaatac

SEQ ID NO: 896306 - DNA, 25 bp, Mus musculus
catcctggtttgaaggtttggagtc

SEQ ID NO: 896307 - DNA, 25 bp, Mus musculus
catcctgtccatcttcttcctcatg

SEQ ID NO: 896308 - DNA, 25 bp, Mus musculus
catcctgtccatgttcttcctcatg

SEQ ID NO: 896309 - DNA, 25 bp, Mus musculus
catcctgtccccaaccgcataaaga

SEQ ID NO: 896310 - DNA, 25 bp, Mus musculus
catcctgtccccaagcgcataaaga

SEQ ID NO: 896311 - DNA, 25 bp, Mus musculus
catcctgtcccgaaacaagccttca

SEQ ID NO: 896312 - DNA, 25 bp, Mus musculus
catcctgtcccgtaacaagccttca

SEQ ID NO: 896313 - DNA, 25 bp, Mus musculus
catcctgtccgacgatggatgccct

SEQ ID NO: 896314 - DNA, 25 bp, Mus musculus
catcctgtccgaggatggatgccct

SEQ ID NO: 896315 - DNA, 25 bp, Mus musculus
catcctgtcgcacttttccacagac

SEQ ID NO: 896316 - DNA, 25 bp, Mus musculus
catcctgtcggacttttccacagac

SEQ ID NO: 896317 - DNA, 25 bp, Mus musculus
catcctgtctatcgagaaaataagt

SEQ ID NO: 896318 - DNA, 25 bp, Mus musculus
catcctgtctatggagaaaataagt

SEQ ID NO: 896319 - DNA, 25 bp, Mus musculus
catcctgtctcacacacaagctctc

SEQ ID NO: 896320 - DNA, 25 bp, Mus musculus
catcctgtctcacagacaagctctc

SEQ ID NO: 896321 - DNA, 25 bp, Mus musculus
catcctgttgaacgtggtgatccca

SEQ ID NO: 896322 - DNA, 25 bp, Mus musculus
catcctgttgtacgtggtgatccca

SEQ ID NO: 896323 - DNA, 25 bp, Mus musculus
catccttagatttacacattcaaac

SEQ ID NO: 896324 - DNA, 25 bp, Mus musculus
catccttagatttagacattcaaac

SEQ ID NO: 896325 - DNA, 25 bp, Mus musculus
catccttcaaagcaccccaatcatg

SEQ ID NO: 896326 - DNA, 25 bp, Mus musculus
catccttcaaagcagcccaatcatg

SEQ ID NO: 896327 - DNA, 25 bp, Mus musculus
catccttcagaactacatgatggtg

SEQ ID NO: 896328 - DNA, 25 bp, Mus musculus
catccttcagaagtacatgatggtg

SEQ ID NO: 896329 - DNA, 25 bp, Mus musculus
catccttggctacacgattatcaga

SEQ ID NO: 896330 - DNA, 25 bp, Mus musculus
catccttggctacaggattatcaga

SEQ ID NO: 896331 - DNA, 25 bp, Mus musculus
catccttggttcaaaacagaagcaa

SEQ ID NO: 896332 - DNA, 25 bp, Mus musculus
catccttggttcaatacagaagcaa

SEQ ID NO: 896333 - DNA, 25 bp, Mus musculus
catcctttgtgtatttaagcaatgt

SEQ ID NO: 896334 - DNA, 25 bp, Mus musculus
catcctttgtgtttttaagcaatgt

SEQ ID NO: 896335 - DNA, 25 bp, Mus musculus
catccttttccacacagtccaggat

SEQ ID NO: 896336 - DNA, 25 bp, Mus musculus
catccttttccagacagtccaggat

SEQ ID NO: 896337 - DNA, 25 bp, Mus musculus
catcgaaatgaagattggataacca

SEQ ID NO: 896338 - DNA, 25 bp, Mus musculus
catcgaaatgatgccagaatttcag

SEQ ID NO: 896339 - DNA, 25 bp, Mus musculus
catcgaaatgcaaatcagagatggc

SEQ ID NO: 896340 - DNA, 25 bp, Mus musculus
catcgaaatggaaatcagagatggc

SEQ ID NO: 896341 - DNA, 25 bp, Mus musculus
catcgaaatgtagattggataacca

SEQ ID NO: 896342 - DNA, 25 bp, Mus musculus
catcgaaatgttgccagaatttcag

SEQ ID NO: 896343 - DNA, 25 bp, Mus musculus
catcgacaagctacgcttcctggaa

SEQ ID NO: 896344 - DNA, 25 bp, Mus musculus
catcgacaaggacgtcatcagtcct

SEQ ID NO: 896345 - DNA, 25 bp, Mus musculus
catcgacaaggaggtcatcagtcct

SEQ ID NO: 896346 - DNA, 25 bp, Mus musculus
catcgacaaggtacgcttcctggaa

SEQ ID NO: 896347 - DNA, 25 bp, Mus musculus
catcgacataatcattacagatgcc

SEQ ID NO: 896348 - DNA, 25 bp, Mus musculus
catcgacataatgattacagatgcc

SEQ ID NO: 896349 - DNA, 25 bp, Mus musculus
catcgaccaagacatgctaaaatgc

SEQ ID NO: 896350 - DNA, 25 bp, Mus musculus
catcgaccaagagatgctaaaatgc

SEQ ID NO: 896351 - DNA, 25 bp, Mus musculus
catcgaccctgaccttgcaagatac

SEQ ID NO: 896352 - DNA, 25 bp, Mus musculus
catcgaccctgagcttgcaagatac

SEQ ID NO: 896353 - DNA, 25 bp, Mus musculus
catcgacctgattgatctggacact

SEQ ID NO: 896354 - DNA, 25 bp, Mus musculus
catcgacctgtttgatctggacact

SEQ ID NO: 896355 - DNA, 25 bp, Mus musculus
catcgacgtggacatcacaggacca

SEQ ID NO: 896356 - DNA, 25 bp, Mus musculus
catcgacgtggagatcacaggacca

SEQ ID NO: 896357 - DNA, 25 bp, Mus musculus
catcgactcaagcatggatcaacaa

SEQ ID NO: 896358 - DNA, 25 bp, Mus musculus
catcgactcaaggatggatcaacaa

SEQ ID NO: 896359 - DNA, 25 bp, Mus musculus
catcgactgcaataagatctatgaa

SEQ ID NO: 896360 - DNA, 25 bp, Mus musculus
catcgactgcaatatgatctatgaa

SEQ ID NO: 896361 - DNA, 25 bp, Mus musculus
catcgacttcaacgacacagcaggc

SEQ ID NO: 896362 - DNA, 25 bp, Mus musculus
catcgacttcaaggacacagcaggc

SEQ ID NO: 896363 - DNA, 25 bp, Mus musculus
catcgacttcagcttctgtctaaag

SEQ ID NO: 896364 - DNA, 25 bp, Mus musculus
catcgacttcaggttctgtctaaag

SEQ ID NO: 896365 - DNA, 25 bp, Mus musculus
catcgagaaagacgagtaggtaatg

SEQ ID NO: 896366 - DNA, 25 bp, Mus musculus
catcgagaaagaggagtaggtaatg

SEQ ID NO: 896367 - DNA, 25 bp, Mus musculus
catcgagagtgtccctacctacaaa

SEQ ID NO: 896368 - DNA, 25 bp, Mus musculus
catcgagagtgtgcctacctacaaa

SEQ ID NO: 896369 - DNA, 25 bp, Mus musculus
catcgagcagctattcccaagccag

SEQ ID NO: 896370 - DNA, 25 bp, Mus musculus
catcgagcagctgtcaccggatgaa

SEQ ID NO: 896371 - DNA, 25 bp, Mus musculus
catcgagcaggtattcccaagccag

SEQ ID NO: 896372 - DNA, 25 bp, Mus musculus
catcgagcaggtgtcaccggatgaa

SEQ ID NO: 896373 - DNA, 25 bp, Mus musculus
catcgaggagcaagaattcaacgac

SEQ ID NO: 896374 - DNA, 25 bp, Mus musculus
catcgaggaggaagaattcaacgac

SEQ ID NO: 896375 - DNA, 25 bp, Mus musculus
catcgagtaccgcgcggctgagaag

SEQ ID NO: 896376 - DNA, 25 bp, Mus musculus
catcgagtaccgcggggctgagaag

SEQ ID NO: 896377 - DNA, 25 bp, Mus musculus
catcgagtggaactttgagaagtcc

SEQ ID NO: 896378 - DNA, 25 bp, Mus musculus
catcgagtggaagtttgagaagtcc

SEQ ID NO: 896379 - DNA, 25 bp, Mus musculus
catcgagttctgggagcgcaatgtg

SEQ ID NO: 896380 - DNA, 25 bp, Mus musculus
catcgagttctgggtgcgcaatgtg

SEQ ID NO: 896381 - DNA, 25 bp, Mus musculus
catcgagtttgaaattcctatcaca

SEQ ID NO: 896382 - DNA, 25 bp, Mus musculus
catcgagtttgatattcctatcaca

SEQ ID NO: 896383 - DNA, 25 bp, Mus musculus
catcgcactgcacacaattgcctat

SEQ ID NO: 896384 - DNA, 25 bp, Mus musculus
catcgcactgcagacaattgcctat

SEQ ID NO: 896385 - DNA, 25 bp, Mus musculus
catcgcagagatgacatcctgctga

SEQ ID NO: 896386 - DNA, 25 bp, Mus musculus
catcgcagagttgacatcctgctga

SEQ ID NO: 896387 - DNA, 25 bp, Mus musculus
catcgcccacagcacagtctgtgcg

SEQ ID NO: 896388 - DNA, 25 bp, Mus musculus
catcgcccacagcagagtctgtgcg

SEQ ID NO: 896389 - DNA, 25 bp, Mus musculus
catcgcccctgacatcctgcagggc

SEQ ID NO: 896390 - DNA, 25 bp, Mus musculus
catcgcccctgagatcctgcagggc

SEQ ID NO: 896391 - DNA, 25 bp, Mus musculus
catcgccgcagtcgtgtttgcctac

SEQ ID NO: 896392 - DNA, 25 bp, Mus musculus
catcgccgcagtggtgtttgcctac

SEQ ID NO: 896393 - DNA, 25 bp, Mus musculus
catcgcctatgactttaacccagaa

SEQ ID NO: 896394 - DNA, 25 bp, Mus musculus
catcgcctatgagtttaacccagaa

SEQ ID NO: 896395 - DNA, 25 bp, Mus musculus
catcgcctgcagcgcatggaacaag

SEQ ID NO: 896396 - DNA, 25 bp, Mus musculus
catcgcctgcagggcatggaacaag

SEQ ID NO: 896397 - DNA, 25 bp, Mus musculus
catcgcggagatggtttcaccccaa

SEQ ID NO: 896398 - DNA, 25 bp, Mus musculus
catcgcggagcatcggtcatgggac

SEQ ID NO: 896399 - DNA, 25 bp, Mus musculus
catcgcggaggatcggtcatgggac

SEQ ID NO: 896400 - DNA, 25 bp, Mus musculus
catcgcggagttggtttcaccccaa

SEQ ID NO: 896401 - DNA, 25 bp, Mus musculus
catcggaacaggcaaatgggaagac

SEQ ID NO: 896402 - DNA, 25 bp, Mus musculus
catcggaacagggaaatgggaagac

SEQ ID NO: 896403 - DNA, 25 bp, Mus musculus
catcggaacccacattgatctccga

SEQ ID NO: 896404 - DNA, 25 bp, Mus musculus
catcggaacccagattgatctccga

SEQ ID NO: 896405 - DNA, 25 bp, Mus musculus
catcggatcaatcgctctgcctggt

SEQ ID NO: 896406 - DNA, 25 bp, Mus musculus
catcggatcaatggctctgcctggt

SEQ ID NO: 896407 - DNA, 25 bp, Mus musculus
catcggcaagatctacctgtcctgg

SEQ ID NO: 896408 - DNA, 25 bp, Mus musculus
catcggcaagctaatccagtgcctg

SEQ ID NO: 896409 - DNA, 25 bp, Mus musculus
catcggcaaggtaatccagtgcctg

SEQ ID NO: 896410 - DNA, 25 bp, Mus musculus
catcggcaagttctacctgtcctgg

SEQ ID NO: 896411 - DNA, 25 bp, Mus musculus
catcggcggcgactagccgctgcgg

SEQ ID NO: 896412 - DNA, 25 bp, Mus musculus
catcggcggcgagtagccgctgcgg

SEQ ID NO: 896413 - DNA, 25 bp, Mus musculus
catcggcgggcaagtttggtgagcg

SEQ ID NO: 896414 - DNA, 25 bp, Mus musculus
catcggcggggaagtttggtgagcg

SEQ ID NO: 896415 - DNA, 25 bp, Mus musculus
catcggctctcgccttggaggatcc

SEQ ID NO: 896416 - DNA, 25 bp, Mus musculus
catcggctctcggcttggaggatcc

SEQ ID NO: 896417 - DNA, 25 bp, Mus musculus
catcggcttcagatatttatcaaca

SEQ ID NO: 896418 - DNA, 25 bp, Mus musculus
catcggcttcagttatttatcaaca

SEQ ID NO: 896419 - DNA, 25 bp, Mus musculus
catcggcttcctatttgcataggag

SEQ ID NO: 896420 - DNA, 25 bp, Mus musculus
catcggcttcgtatttgcataggag

SEQ ID NO: 896421 - DNA, 25 bp, Mus musculus
catcgggaaccagaccctggtcaac

SEQ ID NO: 896422 - DNA, 25 bp, Mus musculus
catcgggaaccagagcctggtcaac

SEQ ID NO: 896423 - DNA, 25 bp, Mus musculus
catcgggaagccccagcctgtgatg

SEQ ID NO: 896424 - DNA, 25 bp, Mus musculus
catcgggaagcccctgcctgtgatg

SEQ ID NO: 896425 - DNA, 25 bp, Mus musculus
catcgggctgcacatgggcaccaac

SEQ ID NO: 896426 - DNA, 25 bp, Mus musculus
catcgggctgcagatgggcaccaac

SEQ ID NO: 896427 - DNA, 25 bp, Mus musculus
catcgggttcttcacctcctggaga

SEQ ID NO: 896428 - DNA, 25 bp, Mus musculus
catcgggttcttcagctcctggaga

SEQ ID NO: 896429 - DNA, 25 bp, Mus musculus
catcggtctctgacagtcctcctac

SEQ ID NO: 896430 - DNA, 25 bp, Mus musculus
catcggtctctgactgtcctcctac

SEQ ID NO: 896431 - DNA, 25 bp, Mus musculus
catcgtcaagatcgtcctctctggg

SEQ ID NO: 896432 - DNA, 25 bp, Mus musculus
catcgtcaagatggtcctctctggg

SEQ ID NO: 896433 - DNA, 25 bp, Mus musculus
catcgtcagccaatggctcgtgggc

SEQ ID NO: 896434 - DNA, 25 bp, Mus musculus
catcgtcagcgaatggctcgtgggc

SEQ ID NO: 896435 - DNA, 25 bp, Mus musculus
catcgtccgccacactcagtccgct

SEQ ID NO: 896436 - DNA, 25 bp, Mus musculus
catcgtccgccacagtacagttgac

SEQ ID NO: 896437 - DNA, 25 bp, Mus musculus
catcgtccgccagactcagtccgct

SEQ ID NO: 896438 - DNA, 25 bp, Mus musculus
catcgtccgccagagtacagttgac

SEQ ID NO: 896439 - DNA, 25 bp, Mus musculus
catcgtcctctccacccggagagtg

SEQ ID NO: 896440 - DNA, 25 bp, Mus musculus
catcgtcctctcgacccggagagtg

SEQ ID NO: 896441 - DNA, 25 bp, Mus musculus
catcgtcgccaacgatgaggttgcc

SEQ ID NO: 896442 - DNA, 25 bp, Mus musculus
catcgtcgccaaggatgaggttgcc

SEQ ID NO: 896443 - DNA, 25 bp, Mus musculus
catcgtcgcctgcacgatactttgg

SEQ ID NO: 896444 - DNA, 25 bp, Mus musculus
catcgtcgcctgcacgtgattttcg

SEQ ID NO: 896445 - DNA, 25 bp, Mus musculus
catcgtcgcctgcacgtgtctaagc

SEQ ID NO: 896446 - DNA, 25 bp, Mus musculus
catcgtcgcctgcaggatactttgg

SEQ ID NO: 896447 - DNA, 25 bp, Mus musculus
catcgtcgcctgcaggtgattttcg

SEQ ID NO: 896448 - DNA, 25 bp, Mus musculus
catcgtcgcctgcaggtgtctaagc

SEQ ID NO: 896449 - DNA, 25 bp, Mus musculus
catcgtcttgcacaggttgacagac

SEQ ID NO: 896450 - DNA, 25 bp, Mus musculus
catcgtcttgcacgttgacagacat

SEQ ID NO: 896451 - DNA, 25 bp, Mus musculus
catcgtcttgcagaggttgacagac

SEQ ID NO: 896452 - DNA, 25 bp, Mus musculus
catcgtcttgcaggttgacagacat

SEQ ID NO: 896453 - DNA, 25 bp, Mus musculus
catcgtgactgactggaaccttgtg

SEQ ID NO: 896454 - DNA, 25 bp, Mus musculus
catcgtgactgagtggaaccttgtg

SEQ ID NO: 896455 - DNA, 25 bp, Mus musculus
catcgtgcggcatgagtccacgggg

SEQ ID NO: 896456 - DNA, 25 bp, Mus musculus
catcgtgcgggatgagtccacgggg

SEQ ID NO: 896457 - DNA, 25 bp, Mus musculus
catcgtgctccactgtggcgctgac

SEQ ID NO: 896458 - DNA, 25 bp, Mus musculus
catcgtgctccagtgtggcgctgac

SEQ ID NO: 896459 - DNA, 25 bp, Mus musculus
catcgtggactgcgatattcaccat

SEQ ID NO: 896460 - DNA, 25 bp, Mus musculus
catcgtggactgggatattcaccat

SEQ ID NO: 896461 - DNA, 25 bp, Mus musculus
catcgtggaggacgaacagaagcgc

SEQ ID NO: 896462 - DNA, 25 bp, Mus musculus
catcgtggaggaggaacagaagcgc

SEQ ID NO: 896463 - DNA, 25 bp, Mus musculus
catcgtggtgaatgttgtatgggca

SEQ ID NO: 896464 - DNA, 25 bp, Mus musculus
catcgtggtgcacagtgaacttttg

SEQ ID NO: 896465 - DNA, 25 bp, Mus musculus
catcgtggtggacagtgaacttttg

SEQ ID NO: 896466 - DNA, 25 bp, Mus musculus
catcgtggtgtatgttgtatgggca

SEQ ID NO: 896467 - DNA, 25 bp, Mus musculus
catcgtgtccggccctccaacccac

SEQ ID NO: 896468 - DNA, 25 bp, Mus musculus
catcgtgtccgggcctccaacccac

SEQ ID NO: 896469 - DNA, 25 bp, Mus musculus
catcgttaagctcttccatggtgcc

SEQ ID NO: 896470 - DNA, 25 bp, Mus musculus
catcgttaaggtcttccatggtgcc

SEQ ID NO: 896471 - DNA, 25 bp, Mus musculus
catcgttcgagctacgcatggtggt

SEQ ID NO: 896472 - DNA, 25 bp, Mus musculus
catcgttcgagctaggcatggtggt

SEQ ID NO: 896473 - DNA, 25 bp, Mus musculus
catctaaactagccttgaacacaac

SEQ ID NO: 896474 - DNA, 25 bp, Mus musculus
catctaaacttgccttgaacacaac

SEQ ID NO: 896475 - DNA, 25 bp, Mus musculus
catctaagaaagcttgtgatcagct

SEQ ID NO: 896476 - DNA, 25 bp, Mus musculus
catctaagaaaggttgtgatcagct

SEQ ID NO: 896477 - DNA, 25 bp, Mus musculus
catctaattcagatcatgattctgg

SEQ ID NO: 896478 - DNA, 25 bp, Mus musculus
catctaattcagttcatgattctgg

SEQ ID NO: 896479 - DNA, 25 bp, Mus musculus
catctacaactgccagggtgcccag

SEQ ID NO: 896480 - DNA, 25 bp, Mus musculus
catctacaactggcagggtgcccag

SEQ ID NO: 896481 - DNA, 25 bp, Mus musculus
catctacacaatttcggagtgagct

SEQ ID NO: 896482 - DNA, 25 bp, Mus musculus
catctacacaatttgggagtgagct

SEQ ID NO: 896483 - DNA, 25 bp, Mus musculus
catctacatggacgcccactctcgg

SEQ ID NO: 896484 - DNA, 25 bp, Mus musculus
catctacatggaggcccactctcgg

SEQ ID NO: 896485 - DNA, 25 bp, Mus musculus
catctactataacagtgacctgacc

SEQ ID NO: 896486 - DNA, 25 bp, Mus musculus
catctactataagagtgacctgacc

SEQ ID NO: 896487 - DNA, 25 bp, Mus musculus
catctactcttgcttcttcattgag

SEQ ID NO: 896488 - DNA, 25 bp, Mus musculus
catctactcttggttcttcattgag

SEQ ID NO: 896489 - DNA, 25 bp, Mus musculus
catctacttaaacgctttatcttct

SEQ ID NO: 896490 - DNA, 25 bp, Mus musculus
catctacttaaaggctttatcttct

SEQ ID NO: 896491 - DNA, 25 bp, Mus musculus
catctacttcaaccctcagtacaag

SEQ ID NO: 896492 - DNA, 25 bp, Mus musculus
catctacttcaagcctcagtacaag

SEQ ID NO: 896493 - DNA, 25 bp, Mus musculus
catctacttgagcacctattatcta

SEQ ID NO: 896494 - DNA, 25 bp, Mus musculus
catctacttgagcagctattatcta

SEQ ID NO: 896495 - DNA, 25 bp, Mus musculus
catctagacacttcgaacctcagat

SEQ ID NO: 896496 - DNA, 25 bp, Mus musculus
catctagacagttcgaacctcagat

SEQ ID NO: 896497 - DNA, 25 bp, Mus musculus
catctagcattacaaggaggtgccc

SEQ ID NO: 896498 - DNA, 25 bp, Mus musculus
catctagcattacatggaggtgccc

SEQ ID NO: 896499 - DNA, 25 bp, Mus musculus
catctagctaatcgggtagctggga

SEQ ID NO: 896500 - DNA, 25 bp, Mus musculus
catctagctaatggggtagctggga

SEQ ID NO: 896501 - DNA, 25 bp, Mus musculus
catctataagcaccctgctgtggag

SEQ ID NO: 896502 - DNA, 25 bp, Mus musculus
catctataagcagcctgctgtggag

SEQ ID NO: 896503 - DNA, 25 bp, Mus musculus
catctatcagccatggcgagtgccc

SEQ ID NO: 896504 - DNA, 25 bp, Mus musculus
catctatcaggcatggcgagtgccc

SEQ ID NO: 896505 - DNA, 25 bp, Mus musculus
catctatgactgcaatggaggaaca

SEQ ID NO: 896506 - DNA, 25 bp, Mus musculus
catctatgactggaatggaggaaca

SEQ ID NO: 896507 - DNA, 25 bp, Mus musculus
catctatgagcacaaagtgtattgg

SEQ ID NO: 896508 - DNA, 25 bp, Mus musculus
catctatgagcacgtggggaccagt

SEQ ID NO: 896509 - DNA, 25 bp, Mus musculus
catctatgagcaggtggggaccagt

SEQ ID NO: 896510 - DNA, 25 bp, Mus musculus
catctatgagcgctacgagggcctt

SEQ ID NO: 896511 - DNA, 25 bp, Mus musculus
catctatgaggacaaagtgtattgg

SEQ ID NO: 896512 - DNA, 25 bp, Mus musculus
catctatgagggctacgagggcctt

SEQ ID NO: 896513 - DNA, 25 bp, Mus musculus
catctatggaagctggtattaatgg

SEQ ID NO: 896514 - DNA, 25 bp, Mus musculus
catctatggaaggtggtattaatgg

SEQ ID NO: 896515 - DNA, 25 bp, Mus musculus
catctattaacgcgttgctaggaag

SEQ ID NO: 896516 - DNA, 25 bp, Mus musculus
catctattaacgggttgctaggaag

SEQ ID NO: 896517 - DNA, 25 bp, Mus musculus
catctattgaggcaaaagattccag

SEQ ID NO: 896518 - DNA, 25 bp, Mus musculus
catctattgagggaaaagattccag

SEQ ID NO: 896519 - DNA, 25 bp, Mus musculus
catctatttccacggcttccgagtg

SEQ ID NO: 896520 - DNA, 25 bp, Mus musculus
catctatttccagggcttccgagtg

SEQ ID NO: 896521 - DNA, 25 bp, Mus musculus
catctattttcaggactatttttga

SEQ ID NO: 896522 - DNA, 25 bp, Mus musculus
catctattttgaggactatttttga

SEQ ID NO: 896523 - DNA, 25 bp, Mus musculus
catctcaaaccacgattatcccacc

SEQ ID NO: 896524 - DNA, 25 bp, Mus musculus
catctcaaaccaggattatcccacc

SEQ ID NO: 896525 - DNA, 25 bp, Mus musculus
catctcaaagctccgtcagatctgc

SEQ ID NO: 896526 - DNA, 25 bp, Mus musculus
catctcaaagctgcgtcagatctgc

SEQ ID NO: 896527 - DNA, 25 bp, Mus musculus
catctcaacaagcacttggctttta

SEQ ID NO: 896528 - DNA, 25 bp, Mus musculus
catctcaacaaggacttggctttta

SEQ ID NO: 896529 - DNA, 25 bp, Mus musculus
catctcaagcaaaacgaagagatgg

SEQ ID NO: 896530 - DNA, 25 bp, Mus musculus
catctcaagcccaagcagtagctgg

SEQ ID NO: 896531 - DNA, 25 bp, Mus musculus
catctcaagcgcaagcagtagctgg

SEQ ID NO: 896532 - DNA, 25 bp, Mus musculus
catctcaagctaaacgaagagatgg

SEQ ID NO: 896533 - DNA, 25 bp, Mus musculus
catctcacaaaaaacatcggaccag

SEQ ID NO: 896534 - DNA, 25 bp, Mus musculus
catctcacaataaacatcggaccag

SEQ ID NO: 896535 - DNA, 25 bp, Mus musculus
catctcacagactgtggatattcat

SEQ ID NO: 896536 - DNA, 25 bp, Mus musculus
catctcacagtctgtggatattcat

SEQ ID NO: 896537 - DNA, 25 bp, Mus musculus
catctcactgcaatgcctgtcaccc

SEQ ID NO: 896538 - DNA, 25 bp, Mus musculus
catctcactgctggagctggcaaca

SEQ ID NO: 896539 - DNA, 25 bp, Mus musculus
catctcactggaatgcctgtcaccc

SEQ ID NO: 896540 - DNA, 25 bp, Mus musculus
catctcactggtggagctggcaaca

SEQ ID NO: 896541 - DNA, 25 bp, Mus musculus
catctcacttcaccactggagatgg

SEQ ID NO: 896542 - DNA, 25 bp, Mus musculus
catctcacttcacctctggagatgg

SEQ ID NO: 896543 - DNA, 25 bp, Mus musculus
catctcagacagctgtttgcccaac

SEQ ID NO: 896544 - DNA, 25 bp, Mus musculus
catctcagacaggtgtttgcccaac

SEQ ID NO: 896545 - DNA, 25 bp, Mus musculus
catctcagagatgggctttgctgga

SEQ ID NO: 896546 - DNA, 25 bp, Mus musculus
catctcagagcctggtgtttgcttt

SEQ ID NO: 896547 - DNA, 25 bp, Mus musculus
catctcagagctctctgcagacctg

SEQ ID NO: 896548 - DNA, 25 bp, Mus musculus
catctcagagctgtctgcagacctg

SEQ ID NO: 896549 - DNA, 25 bp, Mus musculus
catctcagaggctggtgtttgcttt

SEQ ID NO: 896550 - DNA, 25 bp, Mus musculus
catctcagagggcgtccgtgtgaat

SEQ ID NO: 896551 - DNA, 25 bp, Mus musculus
catctcagagggggtccgtgtgaat

SEQ ID NO: 896552 - DNA, 25 bp, Mus musculus
catctcagagttgggctttgctgga

SEQ ID NO: 896553 - DNA, 25 bp, Mus musculus
catctcagctcactgaacagtttgc

SEQ ID NO: 896554 - DNA, 25 bp, Mus musculus
catctcagctcagtgaacagtttgc

SEQ ID NO: 896555 - DNA, 25 bp, Mus musculus
catctccaacctcgttcgtcccttc

SEQ ID NO: 896556 - DNA, 25 bp, Mus musculus
catctccaacctggttcgtcccttc

SEQ ID NO: 896557 - DNA, 25 bp, Mus musculus
catctccaagatcaagtcgccgtag

SEQ ID NO: 896558 - DNA, 25 bp, Mus musculus
catctccaagatgcacatgatcctg

SEQ ID NO: 896559 - DNA, 25 bp, Mus musculus
catctccaagcaactggcttcccaa

SEQ ID NO: 896560 - DNA, 25 bp, Mus musculus
catctccaaggaactggcttcccaa

SEQ ID NO: 896561 - DNA, 25 bp, Mus musculus
catctccaagttcaagtcgccgtag

SEQ ID NO: 896562 - DNA, 25 bp, Mus musculus
catctccaagttgcacatgatcctg

SEQ ID NO: 896563 - DNA, 25 bp, Mus musculus
catctccaatgacaaatttgagtat

SEQ ID NO: 896564 - DNA, 25 bp, Mus musculus
catctccaatgacatatttgagtat

SEQ ID NO: 896565 - DNA, 25 bp, Mus musculus
catctccacagcagcggtgctctta

SEQ ID NO: 896566 - DNA, 25 bp, Mus musculus
catctccacagctgcggtgctctta

SEQ ID NO: 896567 - DNA, 25 bp, Mus musculus
catctcccagacatacgggagccag

SEQ ID NO: 896568 - DNA, 25 bp, Mus musculus
catctcccagactgataatggtctt

SEQ ID NO: 896569 - DNA, 25 bp, Mus musculus
catctcccagcgactgcgcagctgc

SEQ ID NO: 896570 - DNA, 25 bp, Mus musculus
catctcccagcgtgtagagtcagtg

SEQ ID NO: 896571 - DNA, 25 bp, Mus musculus
catctcccagctaaatcacaacaag

SEQ ID NO: 896572 - DNA, 25 bp, Mus musculus
catctcccagggactgcgcagctgc

SEQ ID NO: 896573 - DNA, 25 bp, Mus musculus
catctcccagggtgtagagtcagtg

SEQ ID NO: 896574 - DNA, 25 bp, Mus musculus
catctcccaggtaaatcacaacaag

SEQ ID NO: 896575 - DNA, 25 bp, Mus musculus
catctcccagtcatacgggagccag

SEQ ID NO: 896576 - DNA, 25 bp, Mus musculus
catctcccagtctgataatggtctt

SEQ ID NO: 896577 - DNA, 25 bp, Mus musculus
catctcctctaacacgtaccagctc

SEQ ID NO: 896578 - DNA, 25 bp, Mus musculus
catctcctctaacaggtaccagctc

SEQ ID NO: 896579 - DNA, 25 bp, Mus musculus
catctccttcagagaggatgccccg

SEQ ID NO: 896580 - DNA, 25 bp, Mus musculus
catctccttcagtgaggatgccccg

SEQ ID NO: 896581 - DNA, 25 bp, Mus musculus
catctctcgacaatccatcccttca

SEQ ID NO: 896582 - DNA, 25 bp, Mus musculus
catctctcgacattccatcccttca

SEQ ID NO: 896583 - DNA, 25 bp, Mus musculus
catctctgaaagatctcctgtctat

SEQ ID NO: 896584 - DNA, 25 bp, Mus musculus
catctctgaaagttctcctgtctat

SEQ ID NO: 896585 - DNA, 25 bp, Mus musculus
catctctgggcgatcctaaaactcc

SEQ ID NO: 896586 - DNA, 25 bp, Mus musculus
catctctgggggatcctaaaactcc

SEQ ID NO: 896587 - DNA, 25 bp, Mus musculus
catctctgtctcagagaaatacaac

SEQ ID NO: 896588 - DNA, 25 bp, Mus musculus
catctctgtctcagtgaaatacaac

SEQ ID NO: 896589 - DNA, 25 bp, Mus musculus
catctcttcccccacatgcctgtcg

SEQ ID NO: 896590 - DNA, 25 bp, Mus musculus
catctcttcccccagatgcctgtcg

SEQ ID NO: 896591 - DNA, 25 bp, Mus musculus
catctgaaagctgggttgcaggcct

SEQ ID NO: 896592 - DNA, 25 bp, Mus musculus
catctgaaaggtgggttgcaggcct

SEQ ID NO: 896593 - DNA, 25 bp, Mus musculus
catctgaaggagatcgcaattccgg

SEQ ID NO: 896594 - DNA, 25 bp, Mus musculus
catctgaaggagatggcaattccgg

SEQ ID NO: 896595 - DNA, 25 bp, Mus musculus
catctgacaacacccaagagaaaca

SEQ ID NO: 896596 - DNA, 25 bp, Mus musculus
catctgacaacacgtcaccttcgtc

SEQ ID NO: 896597 - DNA, 25 bp, Mus musculus
catctgacaacagccaagagaaaca

SEQ ID NO: 896598 - DNA, 25 bp, Mus musculus
catctgacaacaggtcaccttcgtc

SEQ ID NO: 896599 - DNA, 25 bp, Mus musculus
catctgactctgcacggacctctag

SEQ ID NO: 896600 - DNA, 25 bp, Mus musculus
catctgactctgcagggacctctag

SEQ ID NO: 896601 - DNA, 25 bp, Mus musculus
catctgatctgagacaaactgacag

SEQ ID NO: 896602 - DNA, 25 bp, Mus musculus
catctgatctgagacgcctctcctg

SEQ ID NO: 896603 - DNA, 25 bp, Mus musculus
catctgatctgagacttagaaactg

SEQ ID NO: 896604 - DNA, 25 bp, Mus musculus
catctgatctgagagaaactgacag

SEQ ID NO: 896605 - DNA, 25 bp, Mus musculus
catctgatctgagaggcctctcctg

SEQ ID NO: 896606 - DNA, 25 bp, Mus musculus
catctgatctgagagttagaaactg

SEQ ID NO: 896607 - DNA, 25 bp, Mus musculus
catctgcaggagcacgccaacgagg

SEQ ID NO: 896608 - DNA, 25 bp, Mus musculus
catctgcaggagcaggccaacgagg

SEQ ID NO: 896609 - DNA, 25 bp, Mus musculus
catctgccagacgctgggtccggac

SEQ ID NO: 896610 - DNA, 25 bp, Mus musculus
catctgccagcacaatggcattgta

SEQ ID NO: 896611 - DNA, 25 bp, Mus musculus
catctgccagcagaatggcattgta

SEQ ID NO: 896612 - DNA, 25 bp, Mus musculus
catctgccagtcgctgggtccggac

SEQ ID NO: 896613 - DNA, 25 bp, Mus musculus
catctgccgagacgggtcccacaga

SEQ ID NO: 896614 - DNA, 25 bp, Mus musculus
catctgccgagaggggtcccacaga

SEQ ID NO: 896615 - DNA, 25 bp, Mus musculus
catctgccgcatgacgtgtggtact

SEQ ID NO: 896616 - DNA, 25 bp, Mus musculus
catctgccgcatgaggtgtggtact

SEQ ID NO: 896617 - DNA, 25 bp, Mus musculus
catctgcctcaacaaatttgtcaag

SEQ ID NO: 896618 - DNA, 25 bp, Mus musculus
catctgcctcaacgatgacggtggc

SEQ ID NO: 896619 - DNA, 25 bp, Mus musculus
catctgcctcaagaaatttgtcaag

SEQ ID NO: 896620 - DNA, 25 bp, Mus musculus
catctgcctctacgatgacggtggc

SEQ ID NO: 896621 - DNA, 25 bp, Mus musculus
catctgcggaagcgaaacaacctga

SEQ ID NO: 896622 - DNA, 25 bp, Mus musculus
catctgcggaagggaaacaacctga

SEQ ID NO: 896623 - DNA, 25 bp, Mus musculus
catctgctagagaagggcaagtctg

SEQ ID NO: 896624 - DNA, 25 bp, Mus musculus
catctgctagagaaggtgcttcccg

SEQ ID NO: 896625 - DNA, 25 bp, Mus musculus
catctgctagagactggctctccaa

SEQ ID NO: 896626 - DNA, 25 bp, Mus musculus
catctgctagagctctggtgttcta

SEQ ID NO: 896627 - DNA, 25 bp, Mus musculus
catctgctagagcttcacaacaaag

SEQ ID NO: 896628 - DNA, 25 bp, Mus musculus
catctgctagaggtctggtgttcta

SEQ ID NO: 896629 - DNA, 25 bp, Mus musculus
catctgctagaggttcacaacaaag

SEQ ID NO: 896630 - DNA, 25 bp, Mus musculus
catctgctagagtagggcaagtctg

SEQ ID NO: 896631 - DNA, 25 bp, Mus musculus
catctgctagagtaggtgcttcccg

SEQ ID NO: 896632 - DNA, 25 bp, Mus musculus
catctgctagagtctggctctccaa

SEQ ID NO: 896633 - DNA, 25 bp, Mus musculus
catctgctccacctgtttgatgaat

SEQ ID NO: 896634 - DNA, 25 bp, Mus musculus
catctgctccacgtgtttgatgaat

SEQ ID NO: 896635 - DNA, 25 bp, Mus musculus
catctgctcgctctgtgatgctgga

SEQ ID NO: 896636 - DNA, 25 bp, Mus musculus
catctgctcggtctgtgatgctgga

SEQ ID NO: 896637 - DNA, 25 bp, Mus musculus
catctgctggcaccagagtgagggc

SEQ ID NO: 896638 - DNA, 25 bp, Mus musculus
catctgctgggaccagagtgagggc

SEQ ID NO: 896639 - DNA, 25 bp, Mus musculus
catctggaagccccttctctggtct

SEQ ID NO: 896640 - DNA, 25 bp, Mus musculus
catctggaagctatctcagacgagg

SEQ ID NO: 896641 - DNA, 25 bp, Mus musculus
catctggaaggcccttctctggtct

SEQ ID NO: 896642 - DNA, 25 bp, Mus musculus
catctggaaggtatctcagacgagg

SEQ ID NO: 896643 - DNA, 25 bp, Mus musculus
catctggagccgcagccagaggaag

SEQ ID NO: 896644 - DNA, 25 bp, Mus musculus
catctggagccggagccagaggaag

SEQ ID NO: 896645 - DNA, 25 bp, Mus musculus
catctggcaaagcgtatacctggcc

SEQ ID NO: 896646 - DNA, 25 bp, Mus musculus
catctggcaaagggtatacctggcc

SEQ ID NO: 896647 - DNA, 25 bp, Mus musculus
catctggcacagaagctgattggcg

SEQ ID NO: 896648 - DNA, 25 bp, Mus musculus
catctggcacagtagctgattggcg

SEQ ID NO: 896649 - DNA, 25 bp, Mus musculus
catctggcagcgccgccacgcatcc

SEQ ID NO: 896650 - DNA, 25 bp, Mus musculus
catctggcagggccgccacgcatcc

SEQ ID NO: 896651 - DNA, 25 bp, Mus musculus
catctggcatcagacctgcccagcg

SEQ ID NO: 896652 - DNA, 25 bp, Mus musculus
catctggcatcagagctgcccagcg

SEQ ID NO: 896653 - DNA, 25 bp, Mus musculus
catctggctttcaacggaacaaaga

SEQ ID NO: 896654 - DNA, 25 bp, Mus musculus
catctggctttcaacttgtggagct

SEQ ID NO: 896655 - DNA, 25 bp, Mus musculus
catctggctttcaagggaacaaaga

SEQ ID NO: 896656 - DNA, 25 bp, Mus musculus
catctggctttcaagttgtggagct

SEQ ID NO: 896657 - DNA, 25 bp, Mus musculus
catctgggacctcacgtcccggaac

SEQ ID NO: 896658 - DNA, 25 bp, Mus musculus
catctgggacctcaggtcccggaac

SEQ ID NO: 896659 - DNA, 25 bp, Mus musculus
catctgggataacgacgacccacct

SEQ ID NO: 896660 - DNA, 25 bp, Mus musculus
catctgggataaggacgacccacct

SEQ ID NO: 896661 - DNA, 25 bp, Mus musculus
catctggggacaaacgtggaaatgg

SEQ ID NO: 896662 - DNA, 25 bp, Mus musculus
catctggggacaaaggtggaaatgg

SEQ ID NO: 896663 - DNA, 25 bp, Mus musculus
catctggtcatgccacgaacctctc

SEQ ID NO: 896664 - DNA, 25 bp, Mus musculus
catctggtcatggcacgaacctctc

SEQ ID NO: 896665 - DNA, 25 bp, Mus musculus
catctgtaatagcaggatgctggtc

SEQ ID NO: 896666 - DNA, 25 bp, Mus musculus
catctgtaatagctgtgtgctgaag

SEQ ID NO: 896667 - DNA, 25 bp, Mus musculus
catctgtaataggaggatgctggtc

SEQ ID NO: 896668 - DNA, 25 bp, Mus musculus
catctgtaataggtgtgtgctgaag

SEQ ID NO: 896669 - DNA, 25 bp, Mus musculus
catctgtacccgcttcatcagcaaa

SEQ ID NO: 896670 - DNA, 25 bp, Mus musculus
catctgtacccggttcatcagcaaa

SEQ ID NO: 896671 - DNA, 25 bp, Mus musculus
catctgtagccccgacaccatgggg

SEQ ID NO: 896672 - DNA, 25 bp, Mus musculus
catctgtagcccggacaccatgggg

SEQ ID NO: 896673 - DNA, 25 bp, Mus musculus
catctgtccacatgcccctgtgatg

SEQ ID NO: 896674 - DNA, 25 bp, Mus musculus
catctgtccacatggccctgtgatg

SEQ ID NO: 896675 - DNA, 25 bp, Mus musculus
catctgtcctgacgagtgtgcagcc

SEQ ID NO: 896676 - DNA, 25 bp, Mus musculus
catctgtcctgaggagtgtgcagcc

SEQ ID NO: 896677 - DNA, 25 bp, Mus musculus
catctgttgaaacctttcctgcagt

SEQ ID NO: 896678 - DNA, 25 bp, Mus musculus
catctgttgaaagctttcctgcagt

SEQ ID NO: 896679 - DNA, 25 bp, Mus musculus
catctgtttcaaatcccagaaaccg

SEQ ID NO: 896680 - DNA, 25 bp, Mus musculus
catctgtttcaaatcccagaaactg

SEQ ID NO: 896681 - DNA, 25 bp, Mus musculus
catctgtttcaacaagatctgcctc

SEQ ID NO: 896682 - DNA, 25 bp, Mus musculus
catctgtttcaagaagatctgcctc

SEQ ID NO: 896683 - DNA, 25 bp, Mus musculus
catctgtttcaattcccagaaaccg

SEQ ID NO: 896684 - DNA, 25 bp, Mus musculus
catctgtttcaattcccagaaactg

SEQ ID NO: 896685 - DNA, 25 bp, Mus musculus
catctgttttttagcacaatggaag

SEQ ID NO: 896686 - DNA, 25 bp, Mus musculus
catctgtttttttgcacaatggaag

SEQ ID NO: 896687 - DNA, 25 bp, Mus musculus
catcttcaaccgcatctccctgact

SEQ ID NO: 896688 - DNA, 25 bp, Mus musculus
catcttcaaccggatctccctgact

SEQ ID NO: 896689 - DNA, 25 bp, Mus musculus
catcttcaagccctgggcagttttt

SEQ ID NO: 896690 - DNA, 25 bp, Mus musculus
catcttcaagccctgggctaaagag

SEQ ID NO: 896691 - DNA, 25 bp, Mus musculus
catcttcaaggcctgggcagttttt

SEQ ID NO: 896692 - DNA, 25 bp, Mus musculus
catcttcaaggcctgggctaaagag

SEQ ID NO: 896693 - DNA, 25 bp, Mus musculus
catcttcaccagactaaatccagtg

SEQ ID NO: 896694 - DNA, 25 bp, Mus musculus
catcttcaccagctccagctagctg

SEQ ID NO: 896695 - DNA, 25 bp, Mus musculus
catcttcaccaggtccagctagctg

SEQ ID NO: 896696 - DNA, 25 bp, Mus musculus
catcttcaccagtctaaatccagtg

SEQ ID NO: 896697 - DNA, 25 bp, Mus musculus
catcttccagcgcaagcgccgtggg

SEQ ID NO: 896698 - DNA, 25 bp, Mus musculus
catcttccagcggaagcgccgtggg

SEQ ID NO: 896699 - DNA, 25 bp, Mus musculus
catcttccccagcttctccaagcca

SEQ ID NO: 896700 - DNA, 25 bp, Mus musculus
catcttccccaggttctccaagcca

SEQ ID NO: 896701 - DNA, 25 bp, Mus musculus
catcttcctcagcaggtccctagta

SEQ ID NO: 896702 - DNA, 25 bp, Mus musculus
catcttcctcaggaggtccctagta

SEQ ID NO: 896703 - DNA, 25 bp, Mus musculus
catcttcctgaggaatgtcacagcg

SEQ ID NO: 896704 - DNA, 25 bp, Mus musculus
catcttcctgcacacatcttacctg

SEQ ID NO: 896705 - DNA, 25 bp, Mus musculus
catcttcctggacacatcttacctg

SEQ ID NO: 896706 - DNA, 25 bp, Mus musculus
catcttcctgtggaatgtcacagcg

SEQ ID NO: 896707 - DNA, 25 bp, Mus musculus
catcttcgtaaagacaagtataatg

SEQ ID NO: 896708 - DNA, 25 bp, Mus musculus
catcttcgtaaagactataatgccg

SEQ ID NO: 896709 - DNA, 25 bp, Mus musculus
catcttcgtaaagagaagtataatg

SEQ ID NO: 896710 - DNA, 25 bp, Mus musculus
catcttcgtaaagagtataatgccg

SEQ ID NO: 896711 - DNA, 25 bp, Mus musculus
catcttctcccacgagatgagctgt

SEQ ID NO: 896712 - DNA, 25 bp, Mus musculus
catcttctcccaggagatgagctgt

SEQ ID NO: 896713 - DNA, 25 bp, Mus musculus
catcttctggcgggcagctggcatc

SEQ ID NO: 896714 - DNA, 25 bp, Mus musculus
catcttctggggggcagctggcatc

SEQ ID NO: 896715 - DNA, 25 bp, Mus musculus
catcttgaaacctcacttccggaga

SEQ ID NO: 896716 - DNA, 25 bp, Mus musculus
catcttgaaagctcacttccggaga

SEQ ID NO: 896717 - DNA, 25 bp, Mus musculus
catcttgacaagacagaggagggcg

SEQ ID NO: 896718 - DNA, 25 bp, Mus musculus
catcttgacaagtcagaggagggcg

SEQ ID NO: 896719 - DNA, 25 bp, Mus musculus
catcttgactcgcaggaagacgatg

SEQ ID NO: 896720 - DNA, 25 bp, Mus musculus
catcttgactcgctggacaccatga

SEQ ID NO: 896721 - DNA, 25 bp, Mus musculus
catcttgactcggaggaagacgatg

SEQ ID NO: 896722 - DNA, 25 bp, Mus musculus
catcttgactcggtggacaccatga

SEQ ID NO: 896723 - DNA, 25 bp, Mus musculus
catcttgagaatcattctgatgtat

SEQ ID NO: 896724 - DNA, 25 bp, Mus musculus
catcttgagaatgattctgatgtat

SEQ ID NO: 896725 - DNA, 25 bp, Mus musculus
catcttggaaatcgatgagacctca

SEQ ID NO: 896726 - DNA, 25 bp, Mus musculus
catcttggaaatggatgagacctca

SEQ ID NO: 896727 - DNA, 25 bp, Mus musculus
catcttggagaaagaggcctcagca

SEQ ID NO: 896728 - DNA, 25 bp, Mus musculus
catcttggagtaagaggcctcagca

SEQ ID NO: 896729 - DNA, 25 bp, Mus musculus
catcttggtccacgatctttctcaa

SEQ ID NO: 896730 - DNA, 25 bp, Mus musculus
catcttggtccacgtcatcccagtg

SEQ ID NO: 896731 - DNA, 25 bp, Mus musculus
catcttggtccaggatctttctcaa

SEQ ID NO: 896732 - DNA, 25 bp, Mus musculus
catcttggtccaggtcatcccagtg

SEQ ID NO: 896733 - DNA, 25 bp, Mus musculus
catctttagaagaactgctctggat

SEQ ID NO: 896734 - DNA, 25 bp, Mus musculus
catctttagaagaagtgctctggat

SEQ ID NO: 896735 - DNA, 25 bp, Mus musculus
catctttcaaaaatcgcagaaaagt

SEQ ID NO: 896736 - DNA, 25 bp, Mus musculus
catctttcaaaattcgcagaaaagt

SEQ ID NO: 896737 - DNA, 25 bp, Mus musculus
catctttcatctcacatgcctgcaa

SEQ ID NO: 896738 - DNA, 25 bp, Mus musculus
catctttcatctcagatgcctgcaa

SEQ ID NO: 896739 - DNA, 25 bp, Mus musculus
catctttcatttatctttcctgcat

SEQ ID NO: 896740 - DNA, 25 bp, Mus musculus
catctttcatttttctttcctgcat

SEQ ID NO: 896741 - DNA, 25 bp, Mus musculus
catctttgacagcgtgctaacagag

SEQ ID NO: 896742 - DNA, 25 bp, Mus musculus
catctttgacagggtgctaacagag

SEQ ID NO: 896743 - DNA, 25 bp, Mus musculus
catctttgtcaccgatgttcctgat

SEQ ID NO: 896744 - DNA, 25 bp, Mus musculus
catctttgtcacggatgttcctgat

SEQ ID NO: 896745 - DNA, 25 bp, Mus musculus
catctttgtgcacagtgtcatgcca

SEQ ID NO: 896746 - DNA, 25 bp, Mus musculus
catctttgtgcagagtgtcatgcca

SEQ ID NO: 896747 - DNA, 25 bp, Mus musculus
catcttttcagccacgaagagcttt

SEQ ID NO: 896748 - DNA, 25 bp, Mus musculus
catcttttcagccaggaagagcttt

SEQ ID NO: 896749 - DNA, 25 bp, Mus musculus
catcttttctgccgttgatccaaaa

SEQ ID NO: 896750 - DNA, 25 bp, Mus musculus
catcttttctgcggttgatccaaaa

SEQ ID NO: 896751 - DNA, 25 bp, Mus musculus
catgaaacagcctctcaccccggaa

SEQ ID NO: 896752 - DNA, 25 bp, Mus musculus
catgaaacaggctctcaccccggaa

SEQ ID NO: 896753 - DNA, 25 bp, Mus musculus
catgaaacttatgacacggtacata

SEQ ID NO: 896754 - DNA, 25 bp, Mus musculus
catgaaacttatgagacggtacata

SEQ ID NO: 896755 - DNA, 25 bp, Mus musculus
catgaaatccttccaggaaggccgg

SEQ ID NO: 896756 - DNA, 25 bp, Mus musculus
catgaaatccttcctggaaggccgg

SEQ ID NO: 896757 - DNA, 25 bp, Mus musculus
catgaacaaaagtacttccctttgc

SEQ ID NO: 896758 - DNA, 25 bp, Mus musculus
catgaacaaatgtacttccctttgc

SEQ ID NO: 896759 - DNA, 25 bp, Mus musculus
catgaacagaagagagagggggaga

SEQ ID NO: 896760 - DNA, 25 bp, Mus musculus
catgaacagaagagcacttctgaca

SEQ ID NO: 896761 - DNA, 25 bp, Mus musculus
catgaacagacagagagcacttctg

SEQ ID NO: 896762 - DNA, 25 bp, Mus musculus
catgaacagagagagagcacttctg

SEQ ID NO: 896763 - DNA, 25 bp, Mus musculus
catgaacagatgagagagggggaga

SEQ ID NO: 896764 - DNA, 25 bp, Mus musculus
catgaacagatgagcacttctgaca

SEQ ID NO: 896765 - DNA, 25 bp, Mus musculus
catgaaccagaacctcacatcttac

SEQ ID NO: 896766 - DNA, 25 bp, Mus musculus
catgaaccagtacctcacatcttac

SEQ ID NO: 896767 - DNA, 25 bp, Mus musculus
catgaactgtcacatgtccaacatc

SEQ ID NO: 896768 - DNA, 25 bp, Mus musculus
catgaactgtcagatgtccaacatc

SEQ ID NO: 896769 - DNA, 25 bp, Mus musculus
catgaactgttgccccttgattgtg

SEQ ID NO: 896770 - DNA, 25 bp, Mus musculus
catgaactgttggcccttgattgtg

SEQ ID NO: 896771 - DNA, 25 bp, Mus musculus
catgaagaacaattgccagccatgt

SEQ ID NO: 896772 - DNA, 25 bp, Mus musculus
catgaagaacatccacaggagagcg

SEQ ID NO: 896773 - DNA, 25 bp, Mus musculus
catgaagaacctgaccgagctgaac

SEQ ID NO: 896774 - DNA, 25 bp, Mus musculus
catgaagaacgtgaccgagctgaac

SEQ ID NO: 896775 - DNA, 25 bp, Mus musculus
catgaagaactattgccagccatgt

SEQ ID NO: 896776 - DNA, 25 bp, Mus musculus
catgaagaacttccacaggagagcg

SEQ ID NO: 896777 - DNA, 25 bp, Mus musculus
catgaagaagatctttgatgatgct

SEQ ID NO: 896778 - DNA, 25 bp, Mus musculus
catgaagaagcatgcgggcgcagcg

SEQ ID NO: 896779 - DNA, 25 bp, Mus musculus
catgaagaaggatgcgggcgcagcg

SEQ ID NO: 896780 - DNA, 25 bp, Mus musculus
catgaagaagttctttgatgatgct

SEQ ID NO: 896781 - DNA, 25 bp, Mus musculus
catgaagatgccgtcgtggaatgta

SEQ ID NO: 896782 - DNA, 25 bp, Mus musculus
catgaagatgccgtggtggaatgta

SEQ ID NO: 896783 - DNA, 25 bp, Mus musculus
catgaagatggaccataccataaag

SEQ ID NO: 896784 - DNA, 25 bp, Mus musculus
catgaagatggagcataccataaag

SEQ ID NO: 896785 - DNA, 25 bp, Mus musculus
catgaagcataacggctttgccttc

SEQ ID NO: 896786 - DNA, 25 bp, Mus musculus
catgaagcataagggctttgccttc

SEQ ID NO: 896787 - DNA, 25 bp, Mus musculus
catgaagccaccaacacccatctga

SEQ ID NO: 896788 - DNA, 25 bp, Mus musculus
catgaagccaccaagacccatctga

SEQ ID NO: 896789 - DNA, 25 bp, Mus musculus
catgaagctgagtgaagatggcacc

SEQ ID NO: 896790 - DNA, 25 bp, Mus musculus
catgaagctgtgtgaagatggcacc

SEQ ID NO: 896791 - DNA, 25 bp, Mus musculus
catgaaggaatgaattgcccagcta

SEQ ID NO: 896792 - DNA, 25 bp, Mus musculus
catgaaggaatgtattgcccagcta

SEQ ID NO: 896793 - DNA, 25 bp, Mus musculus
catgaaggagcatcaggttatccag

SEQ ID NO: 896794 - DNA, 25 bp, Mus musculus
catgaaggaggatcaggttatccag

SEQ ID NO: 896795 - DNA, 25 bp, Mus musculus
catgaaggatcacgatgacgatgct

SEQ ID NO: 896796 - DNA, 25 bp, Mus musculus
catgaaggatcacgcccttaaggat

SEQ ID NO: 896797 - DNA, 25 bp, Mus musculus
catgaaggatcaggatgacgatgct

SEQ ID NO: 896798 - DNA, 25 bp, Mus musculus
catgaaggatcaggcccttaaggat

SEQ ID NO: 896799 - DNA, 25 bp, Mus musculus
catgaaggcccccggccgccttctg

SEQ ID NO: 896800 - DNA, 25 bp, Mus musculus
catgaaggccccgggccgccttctg

SEQ ID NO: 896801 - DNA, 25 bp, Mus musculus
catgaagtacagcctggacattgtg

SEQ ID NO: 896802 - DNA, 25 bp, Mus musculus
catgaagtacaggctggacattgtg

SEQ ID NO: 896803 - DNA, 25 bp, Mus musculus
catgaagtacctcaacgtgctggcc

SEQ ID NO: 896804 - DNA, 25 bp, Mus musculus
catgaagtacctgaacgtgctggcc

SEQ ID NO: 896805 - DNA, 25 bp, Mus musculus
catgaagtagagaccatccatgtgg

SEQ ID NO: 896806 - DNA, 25 bp, Mus musculus
catgaagtagagtccatccatgtgg

SEQ ID NO: 896807 - DNA, 25 bp, Mus musculus
catgaagtcccactggccagtgaag

SEQ ID NO: 896808 - DNA, 25 bp, Mus musculus
catgaagtcccagtggccagtgaag

SEQ ID NO: 896809 - DNA, 25 bp, Mus musculus
catgaagttgctgagcccgagttcc

SEQ ID NO: 896810 - DNA, 25 bp, Mus musculus
catgaagttggtgagcccgagttcc

SEQ ID NO: 896811 - DNA, 25 bp, Mus musculus
catgaataagcacttccgggcttgc

SEQ ID NO: 896812 - DNA, 25 bp, Mus musculus
catgaataagcagttccgggcttgc

SEQ ID NO: 896813 - DNA, 25 bp, Mus musculus
catgaatacacaattgccaacactc

SEQ ID NO: 896814 - DNA, 25 bp, Mus musculus
catgaatacacatttgccaacactc

SEQ ID NO: 896815 - DNA, 25 bp, Mus musculus
catgaatcccgaatatgattattta

SEQ ID NO: 896816 - DNA, 25 bp, Mus musculus
catgaatcccgaatttgattattta

SEQ ID NO: 896817 - DNA, 25 bp, Mus musculus
catgaatcttcacgggctggctgtg

SEQ ID NO: 896818 - DNA, 25 bp, Mus musculus
catgaatcttcaggggctggctgtg

SEQ ID NO: 896819 - DNA, 25 bp, Mus musculus
catgaatgtgaccgagataatcatg

SEQ ID NO: 896820 - DNA, 25 bp, Mus musculus
catgaatgtgtccgagataatcatg

SEQ ID NO: 896821 - DNA, 25 bp, Mus musculus
catgaattttgcaccgactcacctg

SEQ ID NO: 896822 - DNA, 25 bp, Mus musculus
catgaattttgcacggactcacctg

SEQ ID NO: 896823 - DNA, 25 bp, Mus musculus
catgacaaccagcgtggtgccccca

SEQ ID NO: 896824 - DNA, 25 bp, Mus musculus
catgacaaccagggtggtgccccca

SEQ ID NO: 896825 - DNA, 25 bp, Mus musculus
catgacacagactagaggaaatgaa

SEQ ID NO: 896826 - DNA, 25 bp, Mus musculus
catgacacagtctagaggaaatgaa

SEQ ID NO: 896827 - DNA, 25 bp, Mus musculus
catgacagtgaacggccagaatgaa

SEQ ID NO: 896828 - DNA, 25 bp, Mus musculus
catgacagtgaagggccagaatgaa

SEQ ID NO: 896829 - DNA, 25 bp, Mus musculus
catgacatcgcggacatggtttcac

SEQ ID NO: 896830 - DNA, 25 bp, Mus musculus
catgacatcgcggagatggtttcac

SEQ ID NO: 896831 - DNA, 25 bp, Mus musculus
catgaccatacacatcatgtcatca

SEQ ID NO: 896832 - DNA, 25 bp, Mus musculus
catgaccatacagatcatgtcatca

SEQ ID NO: 896833 - DNA, 25 bp, Mus musculus
catgacccttggcacacagggtccc

SEQ ID NO: 896834 - DNA, 25 bp, Mus musculus
catgacccttggcagacagggtccc

SEQ ID NO: 896835 - DNA, 25 bp, Mus musculus
catgacctctatataaactgaagtg

SEQ ID NO: 896836 - DNA, 25 bp, Mus musculus
catgacctctatttaaactgaagtg

SEQ ID NO: 896837 - DNA, 25 bp, Mus musculus
catgaccttgacttgatccggctaa

SEQ ID NO: 896838 - DNA, 25 bp, Mus musculus
catgaccttgtcttgatccggctaa

SEQ ID NO: 896839 - DNA, 25 bp, Mus musculus
catgacggtgtgcaagcattcctga

SEQ ID NO: 896840 - DNA, 25 bp, Mus musculus
catgacggtgtgcatgcattcctga

SEQ ID NO: 896841 - DNA, 25 bp, Mus musculus
catgacgtagctctgcgcagggtga

SEQ ID NO: 896842 - DNA, 25 bp, Mus musculus
catgacgtaggtctgcgcagggtga

SEQ ID NO: 896843 - DNA, 25 bp, Mus musculus
catgacgtccaccactgaaaatgtg

SEQ ID NO: 896844 - DNA, 25 bp, Mus musculus
catgacgtccaccagtgaaaatgtg

SEQ ID NO: 896845 - DNA, 25 bp, Mus musculus
catgactctgctgatcaagatatca

SEQ ID NO: 896846 - DNA, 25 bp, Mus musculus
catgactctggtgatcaagatatca

SEQ ID NO: 896847 - DNA, 25 bp, Mus musculus
catgactgccaacattcatgaataa

SEQ ID NO: 896848 - DNA, 25 bp, Mus musculus
catgactgccaagattcatgaataa

SEQ ID NO: 896849 - DNA, 25 bp, Mus musculus
catgactgtggacgagatctataag

SEQ ID NO: 896850 - DNA, 25 bp, Mus musculus
catgactgtggaggagatctataag

SEQ ID NO: 896851 - DNA, 25 bp, Mus musculus
catgacttaaagcccaatgtggagc

SEQ ID NO: 896852 - DNA, 25 bp, Mus musculus
catgacttaaaggccaatgtggagc

SEQ ID NO: 896853 - DNA, 25 bp, Mus musculus
catgagaatgatccagctacatcaa

SEQ ID NO: 896854 - DNA, 25 bp, Mus musculus
catgagaatgatcctgctacatcaa

SEQ ID NO: 896855 - DNA, 25 bp, Mus musculus
catgagaccctgaacatgggctgtg

SEQ ID NO: 896856 - DNA, 25 bp, Mus musculus
catgagaccctgcacatgaacaagc

SEQ ID NO: 896857 - DNA, 25 bp, Mus musculus
catgagaccctggacatgaacaagc

SEQ ID NO: 896858 - DNA, 25 bp, Mus musculus
catgagaccctgtacatgggctgtg

SEQ ID NO: 896859 - DNA, 25 bp, Mus musculus
catgagacggcagatggagcagtca

SEQ ID NO: 896860 - DNA, 25 bp, Mus musculus
catgagacgggagatggagcagtca

SEQ ID NO: 896861 - DNA, 25 bp, Mus musculus
catgagagacatccagacagaactc

SEQ ID NO: 896862 - DNA, 25 bp, Mus musculus
catgagagacttccagacagaactc

SEQ ID NO: 896863 - DNA, 25 bp, Mus musculus
catgagagagatcccatggtttcca

SEQ ID NO: 896864 - DNA, 25 bp, Mus musculus
catgagagagcactgcctccagagc

SEQ ID NO: 896865 - DNA, 25 bp, Mus musculus
catgagagagctatatgctatgatg

SEQ ID NO: 896866 - DNA, 25 bp, Mus musculus
catgagagaggactgcctccagagc

SEQ ID NO: 896867 - DNA, 25 bp, Mus musculus
catgagagaggtatatgctatgatg

SEQ ID NO: 896868 - DNA, 25 bp, Mus musculus
catgagagagttcccatggtttcca

SEQ ID NO: 896869 - DNA, 25 bp, Mus musculus
catgagagccaacaacccagagcag

SEQ ID NO: 896870 - DNA, 25 bp, Mus musculus
catgagagccaacatcccagagcag

SEQ ID NO: 896871 - DNA, 25 bp, Mus musculus
catgagagcgaactggcggaagaag

SEQ ID NO: 896872 - DNA, 25 bp, Mus musculus
catgagagcgaagtggcggaagaag

SEQ ID NO: 896873 - DNA, 25 bp, Mus musculus
catgagagtcagctttcccaacctc

SEQ ID NO: 896874 - DNA, 25 bp, Mus musculus
catgagagtcaggtttcccaacctc

SEQ ID NO: 896875 - DNA, 25 bp, Mus musculus
catgagagtccgaaaacagtgtgcc

SEQ ID NO: 896876 - DNA, 25 bp, Mus musculus
catgagagtccgaatacagtgtgcc

SEQ ID NO: 896877 - DNA, 25 bp, Mus musculus
catgagatggattctgacgttgggt

SEQ ID NO: 896878 - DNA, 25 bp, Mus musculus
catgagatggccgttatgctctgta

SEQ ID NO: 896879 - DNA, 25 bp, Mus musculus
catgagatggcgcaggcgttatgct

SEQ ID NO: 896880 - DNA, 25 bp, Mus musculus
catgagatgggcgttatgctctgta

SEQ ID NO: 896881 - DNA, 25 bp, Mus musculus
catgagatggggcaggcgttatgct

SEQ ID NO: 896882 - DNA, 25 bp, Mus musculus
catgagatggtttctgacgttgggt

SEQ ID NO: 896883 - DNA, 25 bp, Mus musculus
catgagcaagatgccttggcagaac

SEQ ID NO: 896884 - DNA, 25 bp, Mus musculus
catgagcaagttgccttggcagaac

SEQ ID NO: 896885 - DNA, 25 bp, Mus musculus
catgagccagaaccgcatattcttc

SEQ ID NO: 896886 - DNA, 25 bp, Mus musculus
catgagccagtaccgcatattcttc

SEQ ID NO: 896887 - DNA, 25 bp, Mus musculus
catgagcctgaataaggatggctcc

SEQ ID NO: 896888 - DNA, 25 bp, Mus musculus
catgagcctgtataaggatggctcc

SEQ ID NO: 896889 - DNA, 25 bp, Mus musculus
catgagcgaggacacgccaatggct

SEQ ID NO: 896890 - DNA, 25 bp, Mus musculus
catgagcgaggacagacgccaatgg

SEQ ID NO: 896891 - DNA, 25 bp, Mus musculus
catgagcgaggagacgccaatggct

SEQ ID NO: 896892 - DNA, 25 bp, Mus musculus
catgagcgaggagagacgccaatgg

SEQ ID NO: 896893 - DNA, 25 bp, Mus musculus
catgagcgcgacatacttcaatgac

SEQ ID NO: 896894 - DNA, 25 bp, Mus musculus
catgagcgcgtcatacttcaatgac

SEQ ID NO: 896895 - DNA, 25 bp, Mus musculus
catgagcggcagcagcgagaggatg

SEQ ID NO: 896896 - DNA, 25 bp, Mus musculus
catgagcggcaggagcgagaggatg

SEQ ID NO: 896897 - DNA, 25 bp, Mus musculus
catgaggaacaacattcgagagcaa

SEQ ID NO: 896898 - DNA, 25 bp, Mus musculus
catgaggaacaagattcgagagcaa

SEQ ID NO: 896899 - DNA, 25 bp, Mus musculus
catgaggagaagcctatgggaaggt

SEQ ID NO: 896900 - DNA, 25 bp, Mus musculus
catgaggagaaggctatgggaaggt

SEQ ID NO: 896901 - DNA, 25 bp, Mus musculus
catgaggaggtgcttcaggttcttc

SEQ ID NO: 896902 - DNA, 25 bp, Mus musculus
catgaggaggtggttcaggttcttc

SEQ ID NO: 896903 - DNA, 25 bp, Mus musculus
catgaggagtcaatagagggagaag

SEQ ID NO: 896904 - DNA, 25 bp, Mus musculus
catgaggagtcaattgagggagaag

SEQ ID NO: 896905 - DNA, 25 bp, Mus musculus
catgaggccacacttgtggatgcgg

SEQ ID NO: 896906 - DNA, 25 bp, Mus musculus
catgaggccacagttgtggatgcgg

SEQ ID NO: 896907 - DNA, 25 bp, Mus musculus
catgagtacaagaatctgagtctga

SEQ ID NO: 896908 - DNA, 25 bp, Mus musculus
catgagtacaagtatctgagtctga

SEQ ID NO: 896909 - DNA, 25 bp, Mus musculus
catgagtgaccaccatcggcaggtt

SEQ ID NO: 896910 - DNA, 25 bp, Mus musculus
catgagtgaccagcatcggcaggtt

SEQ ID NO: 896911 - DNA, 25 bp, Mus musculus
catgagttcatccatggctaaagta

SEQ ID NO: 896912 - DNA, 25 bp, Mus musculus
catgagttcatccatgtctacttca

SEQ ID NO: 896913 - DNA, 25 bp, Mus musculus
catgagttcatcgatggctaaagta

SEQ ID NO: 896914 - DNA, 25 bp, Mus musculus
catgagttcatcgatgtctacttca

SEQ ID NO: 896915 - DNA, 25 bp, Mus musculus
catgataaatgacgacatagcattg

SEQ ID NO: 896916 - DNA, 25 bp, Mus musculus
catgataaatgaggacatagcattg

SEQ ID NO: 896917 - DNA, 25 bp, Mus musculus
catgatagtctgaccaaccgcaccc

SEQ ID NO: 896918 - DNA, 25 bp, Mus musculus
catgatagtctgtccaaccgcaccc

SEQ ID NO: 896919 - DNA, 25 bp, Mus musculus
catgatatggacagcggatagccca

SEQ ID NO: 896920 - DNA, 25 bp, Mus musculus
catgatatggacaggggatagccca

SEQ ID NO: 896921 - DNA, 25 bp, Mus musculus
catgatccagaaaaagagccgtgag

SEQ ID NO: 896922 - DNA, 25 bp, Mus musculus
catgatccagtaaaagagccgtgag

SEQ ID NO: 896923 - DNA, 25 bp, Mus musculus
catgatccgcaacggccagggcaac

SEQ ID NO: 896924 - DNA, 25 bp, Mus musculus
catgatccgcaagggccagggcaac

SEQ ID NO: 896925 - DNA, 25 bp, Mus musculus
catgatctggatctccacagcagtg

SEQ ID NO: 896926 - DNA, 25 bp, Mus musculus
catgatctggttctccacagcagtg

SEQ ID NO: 896927 - DNA, 25 bp, Mus musculus
catgatcttgctattgaagtggacc

SEQ ID NO: 896928 - DNA, 25 bp, Mus musculus
catgatcttgcttttgaagtggacc

SEQ ID NO: 896929 - DNA, 25 bp, Mus musculus
catgatgaccagcattacttacact

SEQ ID NO: 896930 - DNA, 25 bp, Mus musculus
catgatgaccaggattacttacact

SEQ ID NO: 896931 - DNA, 25 bp, Mus musculus
catgatgagaacatcagcacctgcg

SEQ ID NO: 896932 - DNA, 25 bp, Mus musculus
catgatgagaacatgagcacctgcg

SEQ ID NO: 896933 - DNA, 25 bp, Mus musculus
catgatgatcgtcgaccctgccatc

SEQ ID NO: 896934 - DNA, 25 bp, Mus musculus
catgatgatcgtcgcgggatccgca

SEQ ID NO: 896935 - DNA, 25 bp, Mus musculus
catgatgatcgtcgtttggcctgga

SEQ ID NO: 896936 - DNA, 25 bp, Mus musculus
catgatgatcgtggaccctgccatc

SEQ ID NO: 896937 - DNA, 25 bp, Mus musculus
catgatgatcgtggcgggatccgca

SEQ ID NO: 896938 - DNA, 25 bp, Mus musculus
catgatgatcgtggtttggcctgga

SEQ ID NO: 896939 - DNA, 25 bp, Mus musculus
catgatgatgaacttgttcctagcg

SEQ ID NO: 896940 - DNA, 25 bp, Mus musculus
catgatgatgtacttgttcctagcg

SEQ ID NO: 896941 - DNA, 25 bp, Mus musculus
catgatgcagcactcgcctttcttc

SEQ ID NO: 896942 - DNA, 25 bp, Mus musculus
catgatgcaggactcgcctttcttc

SEQ ID NO: 896943 - DNA, 25 bp, Mus musculus
catgatgcccaacgttcactggttg

SEQ ID NO: 896944 - DNA, 25 bp, Mus musculus
catgatgcccaaggttcactggttg

SEQ ID NO: 896945 - DNA, 25 bp, Mus musculus
catgatgctaagcgagacagtgagg

SEQ ID NO: 896946 - DNA, 25 bp, Mus musculus
catgatgctaagggagacagtgagg

SEQ ID NO: 896947 - DNA, 25 bp, Mus musculus
catgatgctagacggacttagagaa

SEQ ID NO: 896948 - DNA, 25 bp, Mus musculus
catgatgctagagggacttagagaa

SEQ ID NO: 896949 - DNA, 25 bp, Mus musculus
catgatgcttgacccctcgatgggt

SEQ ID NO: 896950 - DNA, 25 bp, Mus musculus
catgatgcttgacgccctcgatggg

SEQ ID NO: 896951 - DNA, 25 bp, Mus musculus
catgatgcttgagccctcgatgggt

SEQ ID NO: 896952 - DNA, 25 bp, Mus musculus
catgatgcttgaggccctcgatggg

SEQ ID NO: 896953 - DNA, 25 bp, Mus musculus
catgatggagcatgtggagaacagc

SEQ ID NO: 896954 - DNA, 25 bp, Mus musculus
catgatggaggatgtggagaacagc

SEQ ID NO: 896955 - DNA, 25 bp, Mus musculus
catgatggcaacccaggtctcccgg

SEQ ID NO: 896956 - DNA, 25 bp, Mus musculus
catgatggcaaccctggtctcccgg

SEQ ID NO: 896957 - DNA, 25 bp, Mus musculus
catgatgtcagcctcaatactatca

SEQ ID NO: 896958 - DNA, 25 bp, Mus musculus
catgatgtcagcgtcaatactatca

SEQ ID NO: 896959 - DNA, 25 bp, Mus musculus
catgattacgctggatgggaagagg

SEQ ID NO: 896960 - DNA, 25 bp, Mus musculus
catgattacggtggatgggaagagg

SEQ ID NO: 896961 - DNA, 25 bp, Mus musculus
catgattagaggcggacatgtcaat

SEQ ID NO: 896962 - DNA, 25 bp, Mus musculus
catgattagagggggacatgtcaat

SEQ ID NO: 896963 - DNA, 25 bp, Mus musculus
catgattcagaacttaataaagcac

SEQ ID NO: 896964 - DNA, 25 bp, Mus musculus
catgattcagtacttaataaagcac

SEQ ID NO: 896965 - DNA, 25 bp, Mus musculus
catgatttccagagagaagacctga

SEQ ID NO: 896966 - DNA, 25 bp, Mus musculus
catgatttccagcctcatgtcatag

SEQ ID NO: 896967 - DNA, 25 bp, Mus musculus
catgatttccaggctcatgtcatag

SEQ ID NO: 896968 - DNA, 25 bp, Mus musculus
catgatttccagtgagaagacctga

SEQ ID NO: 896969 - DNA, 25 bp, Mus musculus
catgatttttctataccgttattgt

SEQ ID NO: 896970 - DNA, 25 bp, Mus musculus
catgatttttctttaccgttattgt

SEQ ID NO: 896971 - DNA, 25 bp, Mus musculus
catgcaaatcagaacgctaggcaag

SEQ ID NO: 896972 - DNA, 25 bp, Mus musculus
catgcaaatcagaaggctaggcaag

SEQ ID NO: 896973 - DNA, 25 bp, Mus musculus
catgcaaatgcacacgaaactttgc

SEQ ID NO: 896974 - DNA, 25 bp, Mus musculus
catgcaaatgcacaggaaactttgc

SEQ ID NO: 896975 - DNA, 25 bp, Mus musculus
catgcaacagcctgctgttcatgtg

SEQ ID NO: 896976 - DNA, 25 bp, Mus musculus
catgcaacaggctgctgttcatgtg

SEQ ID NO: 896977 - DNA, 25 bp, Mus musculus
catgcaagatcctatggagatcttc

SEQ ID NO: 896978 - DNA, 25 bp, Mus musculus
catgcaagatgctatggagatcttc

SEQ ID NO: 896979 - DNA, 25 bp, Mus musculus
catgcaatagaaatgatcaaaacag

SEQ ID NO: 896980 - DNA, 25 bp, Mus musculus
catgcaatagatccagttcagacat

SEQ ID NO: 896981 - DNA, 25 bp, Mus musculus
catgcaatagtaatgatcaaaacag

SEQ ID NO: 896982 - DNA, 25 bp, Mus musculus
catgcaatagttccagttcagacat

SEQ ID NO: 896983 - DNA, 25 bp, Mus musculus
catgcaattgcacggacggaatctg

SEQ ID NO: 896984 - DNA, 25 bp, Mus musculus
catgcaattgcagggacggaatctg

SEQ ID NO: 896985 - DNA, 25 bp, Mus musculus
catgcacaagatccggccacacatt

SEQ ID NO: 896986 - DNA, 25 bp, Mus musculus
catgcacaagatgccacgcctgtgg

SEQ ID NO: 896987 - DNA, 25 bp, Mus musculus
catgcacaagattcgacctcatatt

SEQ ID NO: 896988 - DNA, 25 bp, Mus musculus
catgcacaagttccggccacacatt

SEQ ID NO: 896989 - DNA, 25 bp, Mus musculus
catgcacaagttgccacgcctgtgg

SEQ ID NO: 896990 - DNA, 25 bp, Mus musculus
catgcacaagtttcgacctcatatt

SEQ ID NO: 896991 - DNA, 25 bp, Mus musculus
catgcaccaaatcactcgaccgatc

SEQ ID NO: 896992 - DNA, 25 bp, Mus musculus
catgcaccaaatgactcgaccgatc

SEQ ID NO: 896993 - DNA, 25 bp, Mus musculus
catgcacccgcacgtggtgctgcag

SEQ ID NO: 896994 - DNA, 25 bp, Mus musculus
catgcacccgcaggtggtgctgcag

SEQ ID NO: 896995 - DNA, 25 bp, Mus musculus
catgcacttacacctggattacatt

SEQ ID NO: 896996 - DNA, 25 bp, Mus musculus
catgcacttacagctggattacatt

SEQ ID NO: 896997 - DNA, 25 bp, Mus musculus
catgcagaacaccacgtacgctcta

SEQ ID NO: 896998 - DNA, 25 bp, Mus musculus
catgcagaacaccaggtacgctcta

SEQ ID NO: 896999 - DNA, 25 bp, Mus musculus
catgcagaacagcgctgttttgcgg

SEQ ID NO: 897000 - DNA, 25 bp, Mus musculus
catgcagaacagggctgttttgcgg

SEQ ID NO: 897001 - DNA, 25 bp, Mus musculus
catgcagaagctggctggcgaacgc

SEQ ID NO: 897002 - DNA, 25 bp, Mus musculus
catgcagaaggtggctggcgaacgc

SEQ ID NO: 897003 - DNA, 25 bp, Mus musculus
catgcagatgctgtcagtggattcc

SEQ ID NO: 897004 - DNA, 25 bp, Mus musculus
catgcagatggtgtcagtggattcc

SEQ ID NO: 897005 - DNA, 25 bp, Mus musculus
catgcagcagattcaagtcaatctg

SEQ ID NO: 897006 - DNA, 25 bp, Mus musculus
catgcagcagtttcaagtcaatctg

SEQ ID NO: 897007 - DNA, 25 bp, Mus musculus
catgcataaattcaatctgtataaa

SEQ ID NO: 897008 - DNA, 25 bp, Mus musculus
catgcataaattgaatctgtataaa

SEQ ID NO: 897009 - DNA, 25 bp, Mus musculus
catgcatgtgatctggcagtgagtg

SEQ ID NO: 897010 - DNA, 25 bp, Mus musculus
catgcatgtgttctggcagtgagtg

SEQ ID NO: 897011 - DNA, 25 bp, Mus musculus
catgccaattgacgtcatgatgaat

SEQ ID NO: 897012 - DNA, 25 bp, Mus musculus
catgccaattgaggtcatgatgaat

SEQ ID NO: 897013 - DNA, 25 bp, Mus musculus
catgcccatgccctctgatcagacc

SEQ ID NO: 897014 - DNA, 25 bp, Mus musculus
catgcccatgccctgtgatcagacc

SEQ ID NO: 897015 - DNA, 25 bp, Mus musculus
catgcccatttgcacagagtactgc

SEQ ID NO: 897016 - DNA, 25 bp, Mus musculus
catgcccatttgcagagagtactgc

SEQ ID NO: 897017 - DNA, 25 bp, Mus musculus
catgcccggcttagaactctccgct

SEQ ID NO: 897018 - DNA, 25 bp, Mus musculus
catgcccggcttagtactctccgct

SEQ ID NO: 897019 - DNA, 25 bp, Mus musculus
catgccctggccgacgaagccgaga

SEQ ID NO: 897020 - DNA, 25 bp, Mus musculus
catgccctggccgaggaagccgaga

SEQ ID NO: 897021 - DNA, 25 bp, Mus musculus
catgcccttgagatccagaagacag

SEQ ID NO: 897022 - DNA, 25 bp, Mus musculus
catgcccttgagttccagaagacag

SEQ ID NO: 897023 - DNA, 25 bp, Mus musculus
catgccgtggagagaaacaaggagt

SEQ ID NO: 897024 - DNA, 25 bp, Mus musculus
catgccgtggagtgaaacaaggagt

SEQ ID NO: 897025 - DNA, 25 bp, Mus musculus
catgcctggaaacggccaaggagat

SEQ ID NO: 897026 - DNA, 25 bp, Mus musculus
catgcctggaaagggccaaggagat

SEQ ID NO: 897027 - DNA, 25 bp, Mus musculus
catgcctgtctgcaaacaacctgat

SEQ ID NO: 897028 - DNA, 25 bp, Mus musculus
catgcctgtctggaaacaacctgat

SEQ ID NO: 897029 - DNA, 25 bp, Mus musculus
catgccttcttactctgtcctactg

SEQ ID NO: 897030 - DNA, 25 bp, Mus musculus
catgccttcttactgtgtcctactg

SEQ ID NO: 897031 - DNA, 25 bp, Mus musculus
catgcctttgcgcttggaagtgttt

SEQ ID NO: 897032 - DNA, 25 bp, Mus musculus
catgcctttgggcttggaagtgttt

SEQ ID NO: 897033 - DNA, 25 bp, Mus musculus
catgcgaagattagagttgtatttc

SEQ ID NO: 897034 - DNA, 25 bp, Mus musculus
catgcgaagatttgagttgtatttc

SEQ ID NO: 897035 - DNA, 25 bp, Mus musculus
catgcgccagccactgaacaacctg

SEQ ID NO: 897036 - DNA, 25 bp, Mus musculus
catgcgccaggcactgaacaacctg

SEQ ID NO: 897037 - DNA, 25 bp, Mus musculus
catgcgcccgaatgacagtccttac

SEQ ID NO: 897038 - DNA, 25 bp, Mus musculus
catgcgcccgtatgacagtccttac

SEQ ID NO: 897039 - DNA, 25 bp, Mus musculus
catgcggagagactcggatgagcac

SEQ ID NO: 897040 - DNA, 25 bp, Mus musculus
catgcggagagactgggatgagcac

SEQ ID NO: 897041 - DNA, 25 bp, Mus musculus
catgcggcggccagagaccgctgct

SEQ ID NO: 897042 - DNA, 25 bp, Mus musculus
catgcggcgggcagagaccgctgct

SEQ ID NO: 897043 - DNA, 25 bp, Mus musculus
catgcgggaatgacaagcagtaggt

SEQ ID NO: 897044 - DNA, 25 bp, Mus musculus
catgcgggaatgtcaagcagtaggt

SEQ ID NO: 897045 - DNA, 25 bp, Mus musculus
catgctacctgcaccgtgggagtgt

SEQ ID NO: 897046 - DNA, 25 bp, Mus musculus
catgctacctgcacggtgggagtgt

SEQ ID NO: 897047 - DNA, 25 bp, Mus musculus
catgctattaaacctggagagtaag

SEQ ID NO: 897048 - DNA, 25 bp, Mus musculus
catgctattaaacctggtgagaaat

SEQ ID NO: 897049 - DNA, 25 bp, Mus musculus
catgctattaaagctggagagtaag

SEQ ID NO: 897050 - DNA, 25 bp, Mus musculus
catgctattaaagctggtgagaaat

SEQ ID NO: 897051 - DNA, 25 bp, Mus musculus
catgctcaagacacccaacacattc

SEQ ID NO: 897052 - DNA, 25 bp, Mus musculus
catgctcaagtcacccaacacattc

SEQ ID NO: 897053 - DNA, 25 bp, Mus musculus
catgctcatgagcgattcatgatgg

SEQ ID NO: 897054 - DNA, 25 bp, Mus musculus
catgctcatgagggattcatgatgg

SEQ ID NO: 897055 - DNA, 25 bp, Mus musculus
catgctcatgctgggcagcaatgct

SEQ ID NO: 897056 - DNA, 25 bp, Mus musculus
catgctcatggtgggcagcaatgct

SEQ ID NO: 897057 - DNA, 25 bp, Mus musculus
catgctctataacgatgttcgcaac

SEQ ID NO: 897058 - DNA, 25 bp, Mus musculus
catgctctataaggatgttcgcaac

SEQ ID NO: 897059 - DNA, 25 bp, Mus musculus
catgctctgcagccttcgagtacct

SEQ ID NO: 897060 - DNA, 25 bp, Mus musculus
catgctctgcaggcttcgagtacct

SEQ ID NO: 897061 - DNA, 25 bp, Mus musculus
catgctcttttcaggtacaaacatt

SEQ ID NO: 897062 - DNA, 25 bp, Mus musculus
catgctcttttctggtacaaacatt

SEQ ID NO: 897063 - DNA, 25 bp, Mus musculus
catgctgagacacgatataagctgg

SEQ ID NO: 897064 - DNA, 25 bp, Mus musculus
catgctgagacaggatataagctgg

SEQ ID NO: 897065 - DNA, 25 bp, Mus musculus
catgctgcagctgctgggccccaag

SEQ ID NO: 897066 - DNA, 25 bp, Mus musculus
catgctgcaggtgctgggccccaag

SEQ ID NO: 897067 - DNA, 25 bp, Mus musculus
catgctgccaaacgataccatactt

SEQ ID NO: 897068 - DNA, 25 bp, Mus musculus
catgctgccaaaggataccatactt

SEQ ID NO: 897069 - DNA, 25 bp, Mus musculus
catgctgcccctcaccagcagcaac

SEQ ID NO: 897070 - DNA, 25 bp, Mus musculus
catgctgcccctcagcagcagcaac

SEQ ID NO: 897071 - DNA, 25 bp, Mus musculus
catgctggaaagaccagattttagt

SEQ ID NO: 897072 - DNA, 25 bp, Mus musculus
catgctggaaagtccagattttagt

SEQ ID NO: 897073 - DNA, 25 bp, Mus musculus
catgctggagaaacttctctgtcca

SEQ ID NO: 897074 - DNA, 25 bp, Mus musculus
catgctggagaatcttctctgtcca

SEQ ID NO: 897075 - DNA, 25 bp, Mus musculus
catgctggcaaacgcgggttccagc

SEQ ID NO: 897076 - DNA, 25 bp, Mus musculus
catgctggcaaaggcgggttccagc

SEQ ID NO: 897077 - DNA, 25 bp, Mus musculus
catgctggtaagcattcactaatcc

SEQ ID NO: 897078 - DNA, 25 bp, Mus musculus
catgctggtaaggattcactaatcc

SEQ ID NO: 897079 - DNA, 25 bp, Mus musculus
catgctgtggagattcatgacttgc

SEQ ID NO: 897080 - DNA, 25 bp, Mus musculus
catgctgtggagtttcatgacttgc

SEQ ID NO: 897081 - DNA, 25 bp, Mus musculus
catgctgttctgaatgaagggacct

SEQ ID NO: 897082 - DNA, 25 bp, Mus musculus
catgctgttctgtatgaagggacct

SEQ ID NO: 897083 - DNA, 25 bp, Mus musculus
catgcttcacagagagcagaatgta

SEQ ID NO: 897084 - DNA, 25 bp, Mus musculus
catgcttcacagtgagcagaatgta

SEQ ID NO: 897085 - DNA, 25 bp, Mus musculus
catgcttcagaggcttctggatgtg

SEQ ID NO: 897086 - DNA, 25 bp, Mus musculus
catgcttcagtggcttctggatgtg

SEQ ID NO: 897087 - DNA, 25 bp, Mus musculus
catgcttctgagcctcagtttgtag

SEQ ID NO: 897088 - DNA, 25 bp, Mus musculus
catgcttctgaggctcagtttgtag

SEQ ID NO: 897089 - DNA, 25 bp, Mus musculus
catgcttgtgagcatactctcctct

SEQ ID NO: 897090 - DNA, 25 bp, Mus musculus
catgcttgtgaggatactctcctct

SEQ ID NO: 897091 - DNA, 25 bp, Mus musculus
catgcttgttaacgtgaatgccctt

SEQ ID NO: 897092 - DNA, 25 bp, Mus musculus
catgcttgttaaggtgaatgccctt

SEQ ID NO: 897093 - DNA, 25 bp, Mus musculus
catgctttaacacgttgttccatgc

SEQ ID NO: 897094 - DNA, 25 bp, Mus musculus
catgctttaacaggttgttccatgc

SEQ ID NO: 897095 - DNA, 25 bp, Mus musculus
catgctttgatgacccgcatggttc

SEQ ID NO: 897096 - DNA, 25 bp, Mus musculus
catgctttgatgtcccgcatggttc

SEQ ID NO: 897097 - DNA, 25 bp, Mus musculus
catggaaaagcatttgaccgtcacc

SEQ ID NO: 897098 - DNA, 25 bp, Mus musculus
catggaaaaggatttgaccgtcacc

SEQ ID NO: 897099 - DNA, 25 bp, Mus musculus
catggaaactaacgcattactcatc

SEQ ID NO: 897100 - DNA, 25 bp, Mus musculus
catggaaactaacgctggccttgtg

SEQ ID NO: 897101 - DNA, 25 bp, Mus musculus
catggaaactaaggcattactcatc

SEQ ID NO: 897102 - DNA, 25 bp, Mus musculus
catggaaactaaggctggccttgtg

SEQ ID NO: 897103 - DNA, 25 bp, Mus musculus
catggaacagcaggaagtgaacatc

SEQ ID NO: 897104 - DNA, 25 bp, Mus musculus
catggaacaggaggaagtgaacatc

SEQ ID NO: 897105 - DNA, 25 bp, Mus musculus
catggaagccaacgtgaaagccgcc

SEQ ID NO: 897106 - DNA, 25 bp, Mus musculus
catggaagccaaggtgaaagccgcc

SEQ ID NO: 897107 - DNA, 25 bp, Mus musculus
catggaagccgacgtctgcattaca

SEQ ID NO: 897108 - DNA, 25 bp, Mus musculus
catggaagccgaggtctgcattaca

SEQ ID NO: 897109 - DNA, 25 bp, Mus musculus
catggaataacctcagctatgtaaa

SEQ ID NO: 897110 - DNA, 25 bp, Mus musculus
catggaataagctcagctatgtaaa

SEQ ID NO: 897111 - DNA, 25 bp, Mus musculus
catggacaaacaagaccgtcttatt

SEQ ID NO: 897112 - DNA, 25 bp, Mus musculus
catggacaaagaagaccgtcttatt

SEQ ID NO: 897113 - DNA, 25 bp, Mus musculus
catggacaatcactgcactgtccag

SEQ ID NO: 897114 - DNA, 25 bp, Mus musculus
catggacaatcagtgcactgtccag

SEQ ID NO: 897115 - DNA, 25 bp, Mus musculus
catggacaatgcaatttctgccagc

SEQ ID NO: 897116 - DNA, 25 bp, Mus musculus
catggacaatgctatttctgccagc

SEQ ID NO: 897117 - DNA, 25 bp, Mus musculus
catggacatccgtgcctccattgtc

SEQ ID NO: 897118 - DNA, 25 bp, Mus musculus
catggacatccgtggctccattgtc

SEQ ID NO: 897119 - DNA, 25 bp, Mus musculus
catggacatcctcaactactttgag

SEQ ID NO: 897120 - DNA, 25 bp, Mus musculus
catggacatcctccctccttccttg

SEQ ID NO: 897121 - DNA, 25 bp, Mus musculus
catggacatcctgaactactttgag

SEQ ID NO: 897122 - DNA, 25 bp, Mus musculus
catggacatcctgcctccttccttg

SEQ ID NO: 897123 - DNA, 25 bp, Mus musculus
catggacatggactctcgccttttc

SEQ ID NO: 897124 - DNA, 25 bp, Mus musculus
catggacatggagtctcgccttttc

SEQ ID NO: 897125 - DNA, 25 bp, Mus musculus
catggacgagattcagccagacctg

SEQ ID NO: 897126 - DNA, 25 bp, Mus musculus
catggacgagcacattgtgattcag

SEQ ID NO: 897127 - DNA, 25 bp, Mus musculus
catggacgaggacattgtgattcag

SEQ ID NO: 897128 - DNA, 25 bp, Mus musculus
catggacgagtttcagccagacctg

SEQ ID NO: 897129 - DNA, 25 bp, Mus musculus
catggacggcaacgtcggctcctgc

SEQ ID NO: 897130 - DNA, 25 bp, Mus musculus
catggacggcaaggtcggctcctgc

SEQ ID NO: 897131 - DNA, 25 bp, Mus musculus
catggactagcgattcaggcctggt

SEQ ID NO: 897132 - DNA, 25 bp, Mus musculus
catggactagcgccctggtctcagc

SEQ ID NO: 897133 - DNA, 25 bp, Mus musculus
catggactagcggcctggtctcagc

SEQ ID NO: 897134 - DNA, 25 bp, Mus musculus
catggactagcgtttcaggcctggt

SEQ ID NO: 897135 - DNA, 25 bp, Mus musculus
catggacttgagctgtcggaaatgg

SEQ ID NO: 897136 - DNA, 25 bp, Mus musculus
catggacttgaggtgtcggaaatgg

SEQ ID NO: 897137 - DNA, 25 bp, Mus musculus
catggactttaacgacacttggata

SEQ ID NO: 897138 - DNA, 25 bp, Mus musculus
catggactttaaggacacttggata

SEQ ID NO: 897139 - DNA, 25 bp, Mus musculus
catggagaacagctgcttttacaac

SEQ ID NO: 897140 - DNA, 25 bp, Mus musculus
catggagaacaggtgcttttacaac

SEQ ID NO: 897141 - DNA, 25 bp, Mus musculus
catggagaagctattcgagagggac

SEQ ID NO: 897142 - DNA, 25 bp, Mus musculus
catggagaaggtattcgagagggac

SEQ ID NO: 897143 - DNA, 25 bp, Mus musculus
catggagatcatcgaggcctactcg

SEQ ID NO: 897144 - DNA, 25 bp, Mus musculus
catggagatcatggaggcctactcg

SEQ ID NO: 897145 - DNA, 25 bp, Mus musculus
catggagatgcagcagttgaccttc

SEQ ID NO: 897146 - DNA, 25 bp, Mus musculus
catggagatgctggaagggcatcaa

SEQ ID NO: 897147 - DNA, 25 bp, Mus musculus
catggagatggagcagttgaccttc

SEQ ID NO: 897148 - DNA, 25 bp, Mus musculus
catggagatggtggaagggcatcaa

SEQ ID NO: 897149 - DNA, 25 bp, Mus musculus
catggagcagcttcatcgaggcatc

SEQ ID NO: 897150 - DNA, 25 bp, Mus musculus
catggagcaggttcatcgaggcatc

SEQ ID NO: 897151 - DNA, 25 bp, Mus musculus
catggagcggagcctctctgccttt

SEQ ID NO: 897152 - DNA, 25 bp, Mus musculus
catggagcggagctctcattgggag

SEQ ID NO: 897153 - DNA, 25 bp, Mus musculus
catggagcggaggctctctgccttt

SEQ ID NO: 897154 - DNA, 25 bp, Mus musculus
catggagcggaggtctcattgggag

SEQ ID NO: 897155 - DNA, 25 bp, Mus musculus
catggaggagctgcggcggcagcac

SEQ ID NO: 897156 - DNA, 25 bp, Mus musculus
catggaggaggtgcggcggcagcac

SEQ ID NO: 897157 - DNA, 25 bp, Mus musculus
catggaggccgacgctgagaatcag

SEQ ID NO: 897158 - DNA, 25 bp, Mus musculus
catggaggccgaggctgagaatcag

SEQ ID NO: 897159 - DNA, 25 bp, Mus musculus
catggagtacagcatcaataagcca

SEQ ID NO: 897160 - DNA, 25 bp, Mus musculus
catggagtacaggatcaataagcca

SEQ ID NO: 897161 - DNA, 25 bp, Mus musculus
catggagttaagaggctaaaagcca

SEQ ID NO: 897162 - DNA, 25 bp, Mus musculus
catggagttaagcacggaaataacc

SEQ ID NO: 897163 - DNA, 25 bp, Mus musculus
catggagttaaggacggaaataacc

SEQ ID NO: 897164 - DNA, 25 bp, Mus musculus
catggagttaagtggctaaaagcca

SEQ ID NO: 897165 - DNA, 25 bp, Mus musculus
catggatacagagaatcttcaccat

SEQ ID NO: 897166 - DNA, 25 bp, Mus musculus
catggatacagagattcttcaccat

SEQ ID NO: 897167 - DNA, 25 bp, Mus musculus
catggataccagtgcgcttcccgag

SEQ ID NO: 897168 - DNA, 25 bp, Mus musculus
catggataccagtgggcttcccgag

SEQ ID NO: 897169 - DNA, 25 bp, Mus musculus
catggatatgagctccagagattca

SEQ ID NO: 897170 - DNA, 25 bp, Mus musculus
catggatatgaggtccagagattca

SEQ ID NO: 897171 - DNA, 25 bp, Mus musculus
catggatccaccagtgagtgaggag

SEQ ID NO: 897172 - DNA, 25 bp, Mus musculus
catggatccagcagtgagtgaggag

SEQ ID NO: 897173 - DNA, 25 bp, Mus musculus
catggatcctaaattgtcagcaact

SEQ ID NO: 897174 - DNA, 25 bp, Mus musculus
catggatccttaattgtcagcaact

SEQ ID NO: 897175 - DNA, 25 bp, Mus musculus
catggatctgctgtgagtgttgagt

SEQ ID NO: 897176 - DNA, 25 bp, Mus musculus
catggatctggtgtgagtgttgagt

SEQ ID NO: 897177 - DNA, 25 bp, Mus musculus
catggatgaattagctggactcttg

SEQ ID NO: 897178 - DNA, 25 bp, Mus musculus
catggatgaattcaagccccacagg

SEQ ID NO: 897179 - DNA, 25 bp, Mus musculus
catggatgaattgaagccccacagg

SEQ ID NO: 897180 - DNA, 25 bp, Mus musculus
catggatgaatttgctggactcttg

SEQ ID NO: 897181 - DNA, 25 bp, Mus musculus
catggatgacaacgtgaaggagttg

SEQ ID NO: 897182 - DNA, 25 bp, Mus musculus
catggatgacaaggtgaaggagttg

SEQ ID NO: 897183 - DNA, 25 bp, Mus musculus
catggatgccatcacgtctctggct

SEQ ID NO: 897184 - DNA, 25 bp, Mus musculus
catggatgccatcaggtctctggct

SEQ ID NO: 897185 - DNA, 25 bp, Mus musculus
catggatggagtcacggatgacgac

SEQ ID NO: 897186 - DNA, 25 bp, Mus musculus
catggatggagtgacggatgacgac

SEQ ID NO: 897187 - DNA, 25 bp, Mus musculus
catggatgggatcgtctcgctggct

SEQ ID NO: 897188 - DNA, 25 bp, Mus musculus
catggatgggatggtctcgctggct

SEQ ID NO: 897189 - DNA, 25 bp, Mus musculus
catggatgggtcctaactgtctgct

SEQ ID NO: 897190 - DNA, 25 bp, Mus musculus
catggatgggtccttactgtctgct

SEQ ID NO: 897191 - DNA, 25 bp, Mus musculus
catggcaaaagaagccagtctaatt

SEQ ID NO: 897192 - DNA, 25 bp, Mus musculus
catggcaaaagatgccagtctaatt

SEQ ID NO: 897193 - DNA, 25 bp, Mus musculus
catggcacccagccacggagggagt

SEQ ID NO: 897194 - DNA, 25 bp, Mus musculus
catggcacccagccgcgaagggagc

SEQ ID NO: 897195 - DNA, 25 bp, Mus musculus
catggcacccaggcacggagggagt

SEQ ID NO: 897196 - DNA, 25 bp, Mus musculus
catggcacccaggcgcgaagggagc

SEQ ID NO: 897197 - DNA, 25 bp, Mus musculus
catggcagagcctcctcttccagag

SEQ ID NO: 897198 - DNA, 25 bp, Mus musculus
catggcagaggctcctcttccagag

SEQ ID NO: 897199 - DNA, 25 bp, Mus musculus
catggcagtgcccacacccccacca

SEQ ID NO: 897200 - DNA, 25 bp, Mus musculus
catggcagtggccacacccccacca

SEQ ID NO: 897201 - DNA, 25 bp, Mus musculus
catggcatcagacagcgggaagcta

SEQ ID NO: 897202 - DNA, 25 bp, Mus musculus
catggcatcagagagcgggaagcta

SEQ ID NO: 897203 - DNA, 25 bp, Mus musculus
catggcatccagcgaccagagcacc

SEQ ID NO: 897204 - DNA, 25 bp, Mus musculus
catggcatccagggaccagagcacc

SEQ ID NO: 897205 - DNA, 25 bp, Mus musculus
catggccaagaatacctccggaagc

SEQ ID NO: 897206 - DNA, 25 bp, Mus musculus
catggccaagatggagttccagaag

SEQ ID NO: 897207 - DNA, 25 bp, Mus musculus
catggccaagcggagtttggtggac

SEQ ID NO: 897208 - DNA, 25 bp, Mus musculus
catggccaaggggagtttggtggac

SEQ ID NO: 897209 - DNA, 25 bp, Mus musculus
catggccaagtatacctccggaagc

SEQ ID NO: 897210 - DNA, 25 bp, Mus musculus
catggccaagttggagttccagaag

SEQ ID NO: 897211 - DNA, 25 bp, Mus musculus
catggccactgtcgcctcctgagtg

SEQ ID NO: 897212 - DNA, 25 bp, Mus musculus
catggccactgtcgtctctgtgatg

SEQ ID NO: 897213 - DNA, 25 bp, Mus musculus
catggccactgtggcctcctgagtg

SEQ ID NO: 897214 - DNA, 25 bp, Mus musculus
catggccactgtggtctctgtgatg

SEQ ID NO: 897215 - DNA, 25 bp, Mus musculus
catggccctagacgtgccagagcca

SEQ ID NO: 897216 - DNA, 25 bp, Mus musculus
catggccctagaggtgccagagcca

SEQ ID NO: 897217 - DNA, 25 bp, Mus musculus
catggccctgggcctgggtccttgg

SEQ ID NO: 897218 - DNA, 25 bp, Mus musculus
catggccctggggctgggtccttgg

SEQ ID NO: 897219 - DNA, 25 bp, Mus musculus
catggccgtcatcacgcctcctgga

SEQ ID NO: 897220 - DNA, 25 bp, Mus musculus
catggccgtcatcaggcctcctgga

SEQ ID NO: 897221 - DNA, 25 bp, Mus musculus
catggcctgcagcctgttgtggtcc

SEQ ID NO: 897222 - DNA, 25 bp, Mus musculus
catggcctgcaggctgttgtggtcc

SEQ ID NO: 897223 - DNA, 25 bp, Mus musculus
catggcctgtggcgtggagtccatg

SEQ ID NO: 897224 - DNA, 25 bp, Mus musculus
catggcctgtggggtggagtccatg

SEQ ID NO: 897225 - DNA, 25 bp, Mus musculus
catggccttctacacgatgctggcc

SEQ ID NO: 897226 - DNA, 25 bp, Mus musculus
catggccttctacaggatgctggcc

SEQ ID NO: 897227 - DNA, 25 bp, Mus musculus
catggccttgcactatttacatgag

SEQ ID NO: 897228 - DNA, 25 bp, Mus musculus
catggccttgcagtatttacatgag

SEQ ID NO: 897229 - DNA, 25 bp, Mus musculus
catggcgaaccacgtgatcaggtgt

SEQ ID NO: 897230 - DNA, 25 bp, Mus musculus
catggcgaaccaggtgatcaggtgt

SEQ ID NO: 897231 - DNA, 25 bp, Mus musculus
catggcgaagccagggctgtctctg

SEQ ID NO: 897232 - DNA, 25 bp, Mus musculus
catggcgaaggcagggctgtctctg

SEQ ID NO: 897233 - DNA, 25 bp, Mus musculus
catggcggaaacctcgtgctgatct

SEQ ID NO: 897234 - DNA, 25 bp, Mus musculus
catggcggaaacctggtgctgatct

SEQ ID NO: 897235 - DNA, 25 bp, Mus musculus
catggcggcacacgttgctgcagga

SEQ ID NO: 897236 - DNA, 25 bp, Mus musculus
catggcggcacaggttgctgcagga

SEQ ID NO: 897237 - DNA, 25 bp, Mus musculus
catggcgttccacaatgacgtgtat

SEQ ID NO: 897238 - DNA, 25 bp, Mus musculus
catggcgttccagaatgacgtgtat

SEQ ID NO: 897239 - DNA, 25 bp, Mus musculus
catggctattttaacggaataatgc

SEQ ID NO: 897240 - DNA, 25 bp, Mus musculus
catggctattttaagggaataatgc

SEQ ID NO: 897241 - DNA, 25 bp, Mus musculus
catggctcagactccgtggtttccg

SEQ ID NO: 897242 - DNA, 25 bp, Mus musculus
catggctcagcaagcttccctgcta

SEQ ID NO: 897243 - DNA, 25 bp, Mus musculus
catggctcagctgaaccagaccttc

SEQ ID NO: 897244 - DNA, 25 bp, Mus musculus
catggctcaggaagcttccctgcta

SEQ ID NO: 897245 - DNA, 25 bp, Mus musculus
catggctcaggtgaaccagaccttc

SEQ ID NO: 897246 - DNA, 25 bp, Mus musculus
catggctcagtctccgtggtttccg

SEQ ID NO: 897247 - DNA, 25 bp, Mus musculus
catggctgacacccttccaggtccg

SEQ ID NO: 897248 - DNA, 25 bp, Mus musculus
catggctgacaccgtccgaggagac

SEQ ID NO: 897249 - DNA, 25 bp, Mus musculus
catggctgacacgcttccaggtccg

SEQ ID NO: 897250 - DNA, 25 bp, Mus musculus
catggctgacacggtccgaggagac

SEQ ID NO: 897251 - DNA, 25 bp, Mus musculus
catggctgagagctacggagcccaa

SEQ ID NO: 897252 - DNA, 25 bp, Mus musculus
catggctgagcctttcagtgctacg

SEQ ID NO: 897253 - DNA, 25 bp, Mus musculus
catggctgaggctttcagtgctacg

SEQ ID NO: 897254 - DNA, 25 bp, Mus musculus
catggctgagtgctacggagcccaa

SEQ ID NO: 897255 - DNA, 25 bp, Mus musculus
catggctgcgcgtttcctgtgcttt

SEQ ID NO: 897256 - DNA, 25 bp, Mus musculus
catggctgcgggtttcctgtgcttt

SEQ ID NO: 897257 - DNA, 25 bp, Mus musculus
catggctggaggcgatgccaacaag

SEQ ID NO: 897258 - DNA, 25 bp, Mus musculus
catggctggaggcgtgatggtaatg

SEQ ID NO: 897259 - DNA, 25 bp, Mus musculus
catggctggaggggatgccaacaag

SEQ ID NO: 897260 - DNA, 25 bp, Mus musculus
catggctggaggggtgatggtaatg

SEQ ID NO: 897261 - DNA, 25 bp, Mus musculus
catggctgtgtgattgatcctgtta

SEQ ID NO: 897262 - DNA, 25 bp, Mus musculus
catggctgtgtgtttgatcctgtta

SEQ ID NO: 897263 - DNA, 25 bp, Mus musculus
catggcttaaaacccgaagaagcag

SEQ ID NO: 897264 - DNA, 25 bp, Mus musculus
catggcttaaaacctcgtgtggcca

SEQ ID NO: 897265 - DNA, 25 bp, Mus musculus
catggcttaaaagccgaagaagcag

SEQ ID NO: 897266 - DNA, 25 bp, Mus musculus
catggcttaaaagctcgtgtggcca

SEQ ID NO: 897267 - DNA, 25 bp, Mus musculus
catgggacagctgaacacctttatg

SEQ ID NO: 897268 - DNA, 25 bp, Mus musculus
catgggacaggtgaacacctttatg

SEQ ID NO: 897269 - DNA, 25 bp, Mus musculus
catgggagcaaacggtgctgtggag

SEQ ID NO: 897270 - DNA, 25 bp, Mus musculus
catgggagcaaagggtgctgtggag

SEQ ID NO: 897271 - DNA, 25 bp, Mus musculus
catgggatacaaagtcctctcagca

SEQ ID NO: 897272 - DNA, 25 bp, Mus musculus
catgggatacaacaacaatttttat

SEQ ID NO: 897273 - DNA, 25 bp, Mus musculus
catgggatacaagaacaatttttat

SEQ ID NO: 897274 - DNA, 25 bp, Mus musculus
catgggatacaatgtcctctcagca

SEQ ID NO: 897275 - DNA, 25 bp, Mus musculus
catgggatatgacgtgcagcagaaa

SEQ ID NO: 897276 - DNA, 25 bp, Mus musculus
catgggatatgaggtgcagcagaaa

SEQ ID NO: 897277 - DNA, 25 bp, Mus musculus
catgggatggagagtctgtattgtc

SEQ ID NO: 897278 - DNA, 25 bp, Mus musculus
catgggatggcggacagctgttgta

SEQ ID NO: 897279 - DNA, 25 bp, Mus musculus
catgggatgggggacagctgttgta

SEQ ID NO: 897280 - DNA, 25 bp, Mus musculus
catgggatggtgagtctgtattgtc

SEQ ID NO: 897281 - DNA, 25 bp, Mus musculus
catgggcaatcaagtgcttcagaac

SEQ ID NO: 897282 - DNA, 25 bp, Mus musculus
catgggcaatgaagtgcttcagaac

SEQ ID NO: 897283 - DNA, 25 bp, Mus musculus
catgggcagacacagccctggacca

SEQ ID NO: 897284 - DNA, 25 bp, Mus musculus
catgggcagagacagccctggacca

SEQ ID NO: 897285 - DNA, 25 bp, Mus musculus
catgggcagaggcaacatcccaacc

SEQ ID NO: 897286 - DNA, 25 bp, Mus musculus
catgggcagagggaacatcccaacc

SEQ ID NO: 897287 - DNA, 25 bp, Mus musculus
catgggcccgattgacgacagtgtg

SEQ ID NO: 897288 - DNA, 25 bp, Mus musculus
catgggcccgtttgacgacagtgtg

SEQ ID NO: 897289 - DNA, 25 bp, Mus musculus
catgggcgcacacgtctgctgtgcc

SEQ ID NO: 897290 - DNA, 25 bp, Mus musculus
catgggcgcacaggtctgctgtgcc

SEQ ID NO: 897291 - DNA, 25 bp, Mus musculus
catggggaacttctcatcattcaat

SEQ ID NO: 897292 - DNA, 25 bp, Mus musculus
catggggaacttctgatcattcaat

SEQ ID NO: 897293 - DNA, 25 bp, Mus musculus
catggggagtttgacatcccactga

SEQ ID NO: 897294 - DNA, 25 bp, Mus musculus
catggggagtttgagatcccactga

SEQ ID NO: 897295 - DNA, 25 bp, Mus musculus
catggggctacaccatcaaccacga

SEQ ID NO: 897296 - DNA, 25 bp, Mus musculus
catggggctacagcatcaaccacga

SEQ ID NO: 897297 - DNA, 25 bp, Mus musculus
catgggtataaagaccacgtccaag

SEQ ID NO: 897298 - DNA, 25 bp, Mus musculus
catgggtataaagagcacgtccaag

SEQ ID NO: 897299 - DNA, 25 bp, Mus musculus
catgggtcagcttttctactattca

SEQ ID NO: 897300 - DNA, 25 bp, Mus musculus
catgggtcaggttttctactattca

SEQ ID NO: 897301 - DNA, 25 bp, Mus musculus
catgggtctcaacatgttgttgatg

SEQ ID NO: 897302 - DNA, 25 bp, Mus musculus
catgggtctcaagatgttgttgatg

SEQ ID NO: 897303 - DNA, 25 bp, Mus musculus
catgggtggaaacaccatgttctca

SEQ ID NO: 897304 - DNA, 25 bp, Mus musculus
catgggtggaaacagcatgttctca

SEQ ID NO: 897305 - DNA, 25 bp, Mus musculus
catgggtgtgagcaggtggagcagc

SEQ ID NO: 897306 - DNA, 25 bp, Mus musculus
catgggtgtgaggaggtggagcagc

SEQ ID NO: 897307 - DNA, 25 bp, Mus musculus
catgggtttcaactcttgtgatgga

SEQ ID NO: 897308 - DNA, 25 bp, Mus musculus
catgggtttcaagtcttgtgatgga

SEQ ID NO: 897309 - DNA, 25 bp, Mus musculus
catggtactgctgtattttcatctg

SEQ ID NO: 897310 - DNA, 25 bp, Mus musculus
catggtactggtgtattttcatctg

SEQ ID NO: 897311 - DNA, 25 bp, Mus musculus
catggtagaaagatctaaaggggtg

SEQ ID NO: 897312 - DNA, 25 bp, Mus musculus
catggtagaaagccctttgtagatt

SEQ ID NO: 897313 - DNA, 25 bp, Mus musculus
catggtagaaaggcctttgtagatt

SEQ ID NO: 897314 - DNA, 25 bp, Mus musculus
catggtagaaagttctaaaggggtg

SEQ ID NO: 897315 - DNA, 25 bp, Mus musculus
catggtagagagatctgagtgcatc

SEQ ID NO: 897316 - DNA, 25 bp, Mus musculus
catggtagagagttctgagtgcatc

SEQ ID NO: 897317 - DNA, 25 bp, Mus musculus
catggtagagtgctataccaaatct

SEQ ID NO: 897318 - DNA, 25 bp, Mus musculus
catggtagagtggtataccaaatct

SEQ ID NO: 897319 - DNA, 25 bp, Mus musculus
catggtcacacaaacaaacaggtat

SEQ ID NO: 897320 - DNA, 25 bp, Mus musculus
catggtcacacaaacgtatgtgatg

SEQ ID NO: 897321 - DNA, 25 bp, Mus musculus
catggtcacacaaagaaacaggtat

SEQ ID NO: 897322 - DNA, 25 bp, Mus musculus
catggtcacacaaaggtatgtgatg

SEQ ID NO: 897323 - DNA, 25 bp, Mus musculus
catggtcacacacatacttgttgcc

SEQ ID NO: 897324 - DNA, 25 bp, Mus musculus
catggtcacacagatacttgttgcc

SEQ ID NO: 897325 - DNA, 25 bp, Mus musculus
catggtccagcattgaggctaagta

SEQ ID NO: 897326 - DNA, 25 bp, Mus musculus
catggtccaggattgaggctaagta

SEQ ID NO: 897327 - DNA, 25 bp, Mus musculus
catggtcttaagcccatcgtacctt

SEQ ID NO: 897328 - DNA, 25 bp, Mus musculus
catggtcttaaggccatcgtacctt

SEQ ID NO: 897329 - DNA, 25 bp, Mus musculus
catggtgaaatacattatgaagcaa

SEQ ID NO: 897330 - DNA, 25 bp, Mus musculus
catggtgaaatagattatgaagcaa

SEQ ID NO: 897331 - DNA, 25 bp, Mus musculus
catggtgaagagcacgtatctcaga

SEQ ID NO: 897332 - DNA, 25 bp, Mus musculus
catggtgaagagcaggtatctcaga

SEQ ID NO: 897333 - DNA, 25 bp, Mus musculus
catggtgaagcacacatcttacctg

SEQ ID NO: 897334 - DNA, 25 bp, Mus musculus
catggtgaaggacacatcttacctg

SEQ ID NO: 897335 - DNA, 25 bp, Mus musculus
catggtgaccaacgccaaagctggc

SEQ ID NO: 897336 - DNA, 25 bp, Mus musculus
catggtgaccaaggccaaagctggc

SEQ ID NO: 897337 - DNA, 25 bp, Mus musculus
catggtgcacttcacaaggcccgag

SEQ ID NO: 897338 - DNA, 25 bp, Mus musculus
catggtgcacttcagaaggcccgag

SEQ ID NO: 897339 - DNA, 25 bp, Mus musculus
catggtgcagaaccatgcactagga

SEQ ID NO: 897340 - DNA, 25 bp, Mus musculus
catggtgcagtaccatgcactagga

SEQ ID NO: 897341 - DNA, 25 bp, Mus musculus
catggtggagcaccccgtggctgag

SEQ ID NO: 897342 - DNA, 25 bp, Mus musculus
catggtggagccctgtctgctggat

SEQ ID NO: 897343 - DNA, 25 bp, Mus musculus
catggtggaggaccccgtggctgag

SEQ ID NO: 897344 - DNA, 25 bp, Mus musculus
catggtggaggcctgtctgctggat

SEQ ID NO: 897345 - DNA, 25 bp, Mus musculus
catggtggtcagcggagaccacacc

SEQ ID NO: 897346 - DNA, 25 bp, Mus musculus
catggtggtcaggggagaccacacc

SEQ ID NO: 897347 - DNA, 25 bp, Mus musculus
catggtgtggtgcttggagcctctc

SEQ ID NO: 897348 - DNA, 25 bp, Mus musculus
catggtgtggtggttggagcctctc

SEQ ID NO: 897349 - DNA, 25 bp, Mus musculus
catgtacaacagaatgaccagtgcc

SEQ ID NO: 897350 - DNA, 25 bp, Mus musculus
catgtacaacagtatgaccagtgcc

SEQ ID NO: 897351 - DNA, 25 bp, Mus musculus
catgtaccaactgtccccaaggaat

SEQ ID NO: 897352 - DNA, 25 bp, Mus musculus
catgtaccaagtgtccccaaggaat

SEQ ID NO: 897353 - DNA, 25 bp, Mus musculus
catgtactcctgcacgtttagccga

SEQ ID NO: 897354 - DNA, 25 bp, Mus musculus
catgtactcctgcaggtttagccga

SEQ ID NO: 897355 - DNA, 25 bp, Mus musculus
catgtactcgcgccgtcgttcccgg

SEQ ID NO: 897356 - DNA, 25 bp, Mus musculus
catgtactcgggccgtcgttcccgg

SEQ ID NO: 897357 - DNA, 25 bp, Mus musculus
catgtagaagctccactgccatcac

SEQ ID NO: 897358 - DNA, 25 bp, Mus musculus
catgtagaaggtccactgccatcac

SEQ ID NO: 897359 - DNA, 25 bp, Mus musculus
catgtagatatgccagacgaggcat

SEQ ID NO: 897360 - DNA, 25 bp, Mus musculus
catgtagatatggcagacgaggcat

SEQ ID NO: 897361 - DNA, 25 bp, Mus musculus
catgtatatcagacactgtcctgtt

SEQ ID NO: 897362 - DNA, 25 bp, Mus musculus
catgtatatcagtcactgtcctgtt

SEQ ID NO: 897363 - DNA, 25 bp, Mus musculus
catgtatgatgactttgtagaagac

SEQ ID NO: 897364 - DNA, 25 bp, Mus musculus
catgtatgatgagtttgtagaagac

SEQ ID NO: 897365 - DNA, 25 bp, Mus musculus
catgtcaaaaagctatggttccgac

SEQ ID NO: 897366 - DNA, 25 bp, Mus musculus
catgtcaaaaaggtatggttccgac

SEQ ID NO: 897367 - DNA, 25 bp, Mus musculus
catgtcacagagcacttttaataac

SEQ ID NO: 897368 - DNA, 25 bp, Mus musculus
catgtcacagagcagttttaataac

SEQ ID NO: 897369 - DNA, 25 bp, Mus musculus
catgtcacagctaaagtccaggaag

SEQ ID NO: 897370 - DNA, 25 bp, Mus musculus
catgtcacaggtaaagtccaggaag

SEQ ID NO: 897371 - DNA, 25 bp, Mus musculus
catgtcaccaaaactgtgaagggag

SEQ ID NO: 897372 - DNA, 25 bp, Mus musculus
catgtcaccaaatctgtgaagggag

SEQ ID NO: 897373 - DNA, 25 bp, Mus musculus
catgtccaaaatattgcggtagagg

SEQ ID NO: 897374 - DNA, 25 bp, Mus musculus
catgtccaaaattttgcggtagagg

SEQ ID NO: 897375 - DNA, 25 bp, Mus musculus
catgtcccagacattcagtactgtg

SEQ ID NO: 897376 - DNA, 25 bp, Mus musculus
catgtcccagtcattcagtactgtg

SEQ ID NO: 897377 - DNA, 25 bp, Mus musculus
catgtcctacacaacaccattctgg

SEQ ID NO: 897378 - DNA, 25 bp, Mus musculus
catgtcctacacaagaccattctgg

SEQ ID NO: 897379 - DNA, 25 bp, Mus musculus
catgtcctacacctccctcccagct

SEQ ID NO: 897380 - DNA, 25 bp, Mus musculus
catgtcctacacgtccctcccagct

SEQ ID NO: 897381 - DNA, 25 bp, Mus musculus
catgtcggaaagaaatgtcccaggt

SEQ ID NO: 897382 - DNA, 25 bp, Mus musculus
catgtcggaaagtaatgtcccaggt

SEQ ID NO: 897383 - DNA, 25 bp, Mus musculus
catgtcggaccataccggcctgcaa

SEQ ID NO: 897384 - DNA, 25 bp, Mus musculus
catgtcggaccatagcggcctgcaa

SEQ ID NO: 897385 - DNA, 25 bp, Mus musculus
catgtcgtggagatgagacagatag

SEQ ID NO: 897386 - DNA, 25 bp, Mus musculus
catgtcgtggagttgagacagatag

SEQ ID NO: 897387 - DNA, 25 bp, Mus musculus
catgtctacgagctcatcaaccagg

SEQ ID NO: 897388 - DNA, 25 bp, Mus musculus
catgtctacgaggtcatcaaccagg

SEQ ID NO: 897389 - DNA, 25 bp, Mus musculus
catgtctgacctctcaaactgggct

SEQ ID NO: 897390 - DNA, 25 bp, Mus musculus
catgtctgacctgtcaaactgggct

SEQ ID NO: 897391 - DNA, 25 bp, Mus musculus
catgtctgagaccccgtacgtgtca

SEQ ID NO: 897392 - DNA, 25 bp, Mus musculus
catgtctgagacccggtacgtgtca

SEQ ID NO: 897393 - DNA, 25 bp, Mus musculus
catgtcttcaagaaaaggatctccc

SEQ ID NO: 897394 - DNA, 25 bp, Mus musculus
catgtcttcaagtaaaggatctccc

SEQ ID NO: 897395 - DNA, 25 bp, Mus musculus
catgtcttcgatgacacaactctca

SEQ ID NO: 897396 - DNA, 25 bp, Mus musculus
catgtcttcgatgagacaactctca

SEQ ID NO: 897397 - DNA, 25 bp, Mus musculus
catgtgaacaggcacacgctgggct

SEQ ID NO: 897398 - DNA, 25 bp, Mus musculus
catgtgaacagggacacgctgggct

SEQ ID NO: 897399 - DNA, 25 bp, Mus musculus
catgtgaagaaacccccacgcctac

SEQ ID NO: 897400 - DNA, 25 bp, Mus musculus
catgtgaagaaagccccacgcctac

SEQ ID NO: 897401 - DNA, 25 bp, Mus musculus
catgtgactcaacctcgtgtggcca

SEQ ID NO: 897402 - DNA, 25 bp, Mus musculus
catgtgactcaagctcgtgtggcca

SEQ ID NO: 897403 - DNA, 25 bp, Mus musculus
catgtgatttcacgttgatgactga

SEQ ID NO: 897404 - DNA, 25 bp, Mus musculus
catgtgatttcaggttgatgactga

SEQ ID NO: 897405 - DNA, 25 bp, Mus musculus
catgtgcaacagcgtcatccaggat

SEQ ID NO: 897406 - DNA, 25 bp, Mus musculus
catgtgcaacccgtcatccaggatt

SEQ ID NO: 897407 - DNA, 25 bp, Mus musculus
catgtgcaacctccaccatgggctt

SEQ ID NO: 897408 - DNA, 25 bp, Mus musculus
catgtgcaacctgcaccatgggctt

SEQ ID NO: 897409 - DNA, 25 bp, Mus musculus
catgtgcaacgcgtcatccaggatt

SEQ ID NO: 897410 - DNA, 25 bp, Mus musculus
catgtgcaactgcgtcatccaggat

SEQ ID NO: 897411 - DNA, 25 bp, Mus musculus
catgtgcagcctgagctgctgtggc

SEQ ID NO: 897412 - DNA, 25 bp, Mus musculus
catgtgcagcgcactgagctgctgt

SEQ ID NO: 897413 - DNA, 25 bp, Mus musculus
catgtgcagcgcagcctgagctgct

SEQ ID NO: 897414 - DNA, 25 bp, Mus musculus
catgtgcagcgcaggctgagctgct

SEQ ID NO: 897415 - DNA, 25 bp, Mus musculus
catgtgcagcgctctgagctgctgt

SEQ ID NO: 897416 - DNA, 25 bp, Mus musculus
catgtgcagcgtgagctgctgtggc

SEQ ID NO: 897417 - DNA, 25 bp, Mus musculus
catgtgcatgaccatgctgtggaga

SEQ ID NO: 897418 - DNA, 25 bp, Mus musculus
catgtgcatgatcatgacttgcaga

SEQ ID NO: 897419 - DNA, 25 bp, Mus musculus
catgtgcatgtccatgctgtggaga

SEQ ID NO: 897420 - DNA, 25 bp, Mus musculus
catgtgcatgttcatgacttgcaga

SEQ ID NO: 897421 - DNA, 25 bp, Mus musculus
catgtgccagcctggatggcaagca

SEQ ID NO: 897422 - DNA, 25 bp, Mus musculus
catgtgccagcctggcgacttcacc

SEQ ID NO: 897423 - DNA, 25 bp, Mus musculus
catgtgccagcgtggtgactttaca

SEQ ID NO: 897424 - DNA, 25 bp, Mus musculus
catgtgccaggctggatggcaagca

SEQ ID NO: 897425 - DNA, 25 bp, Mus musculus
catgtgccaggctggcgacttcacc

SEQ ID NO: 897426 - DNA, 25 bp, Mus musculus
catgtgccagggtggtgactttaca

SEQ ID NO: 897427 - DNA, 25 bp, Mus musculus
catgtgctgccactccctccacaga

SEQ ID NO: 897428 - DNA, 25 bp, Mus musculus
catgtgctgccagtccctccacaga

SEQ ID NO: 897429 - DNA, 25 bp, Mus musculus
catgtggcagagaggctgctgcagc

SEQ ID NO: 897430 - DNA, 25 bp, Mus musculus
catgtggcagagtggctgctgcagc

SEQ ID NO: 897431 - DNA, 25 bp, Mus musculus
catgtggctccacatgaacgaaccg

SEQ ID NO: 897432 - DNA, 25 bp, Mus musculus
catgtggctcgacatgaacgaaccg

SEQ ID NO: 897433 - DNA, 25 bp, Mus musculus
catgtggggccacgtgtcctgtcca

SEQ ID NO: 897434 - DNA, 25 bp, Mus musculus
catgtggggccaggtgtcctgtcca

SEQ ID NO: 897435 - DNA, 25 bp, Mus musculus
catgtggtacaacgatgaggtgctg

SEQ ID NO: 897436 - DNA, 25 bp, Mus musculus
catgtggtacaaggatgaggtgctg

SEQ ID NO: 897437 - DNA, 25 bp, Mus musculus
catgtggtcaagcacttaatgggca

SEQ ID NO: 897438 - DNA, 25 bp, Mus musculus
catgtggtcaagcttcttgcagaat

SEQ ID NO: 897439 - DNA, 25 bp, Mus musculus
catgtggtcaaggacttaatgggca

SEQ ID NO: 897440 - DNA, 25 bp, Mus musculus
catgtggtcaaggttcttgcagaat

SEQ ID NO: 897441 - DNA, 25 bp, Mus musculus
catgtggttcatcggctggactgta

SEQ ID NO: 897442 - DNA, 25 bp, Mus musculus
catgtggttcatgggctggactgta

SEQ ID NO: 897443 - DNA, 25 bp, Mus musculus
catgtgtaaccaggtgatccaagac

SEQ ID NO: 897444 - DNA, 25 bp, Mus musculus
catgtgtaacgaggtgatccaagac

SEQ ID NO: 897445 - DNA, 25 bp, Mus musculus
catgtgtactcgctcaaacccaaga

SEQ ID NO: 897446 - DNA, 25 bp, Mus musculus
catgtgtactcggtcaaacccaaga

SEQ ID NO: 897447 - DNA, 25 bp, Mus musculus
catgtgtagcagctttcaaagctga

SEQ ID NO: 897448 - DNA, 25 bp, Mus musculus
catgtgtagcaggtttcaaagctga

SEQ ID NO: 897449 - DNA, 25 bp, Mus musculus
catgtgtaggctgtgtgaggacgag

SEQ ID NO: 897450 - DNA, 25 bp, Mus musculus
catgtgtagggtgtgtgaggacgag

SEQ ID NO: 897451 - DNA, 25 bp, Mus musculus
catgtgtgtgagcaggttccccctg

SEQ ID NO: 897452 - DNA, 25 bp, Mus musculus
catgtgtgtgaggaggttccccctg

SEQ ID NO: 897453 - DNA, 25 bp, Mus musculus
catgtgtttgtgcacgcggccctgg

SEQ ID NO: 897454 - DNA, 25 bp, Mus musculus
catgtgtttgtgcaggcggccctgg

SEQ ID NO: 897455 - DNA, 25 bp, Mus musculus
catgttactgcacgaccacaggagg

SEQ ID NO: 897456 - DNA, 25 bp, Mus musculus
catgttactggacgaccacaggagg

SEQ ID NO: 897457 - DNA, 25 bp, Mus musculus
catgttataccaccactgagcttgc

SEQ ID NO: 897458 - DNA, 25 bp, Mus musculus
catgttataccagcactgagcttgc

SEQ ID NO: 897459 - DNA, 25 bp, Mus musculus
catgttatatcaagtctccgacaca

SEQ ID NO: 897460 - DNA, 25 bp, Mus musculus
catgttatatcatgtctccgacaca

SEQ ID NO: 897461 - DNA, 25 bp, Mus musculus
catgttattgaaagcgtatgaatct

SEQ ID NO: 897462 - DNA, 25 bp, Mus musculus
catgttattgaaagggtatgaatct

SEQ ID NO: 897463 - DNA, 25 bp, Mus musculus
catgttcaatctgaacctgttccag

SEQ ID NO: 897464 - DNA, 25 bp, Mus musculus
catgttcaatgtgaacctgttccag

SEQ ID NO: 897465 - DNA, 25 bp, Mus musculus
catgttcgtgattgtgctgtcctcc

SEQ ID NO: 897466 - DNA, 25 bp, Mus musculus
catgttcgtgtttgtgctgtcctcc

SEQ ID NO: 897467 - DNA, 25 bp, Mus musculus
catgttctagccagcaagagcttcc

SEQ ID NO: 897468 - DNA, 25 bp, Mus musculus
catgttctaggcagcaagagcttcc

SEQ ID NO: 897469 - DNA, 25 bp, Mus musculus
catgttgctgaaccttcaaaagaaa

SEQ ID NO: 897470 - DNA, 25 bp, Mus musculus
catgttgctgaagcttcaaaagaaa

SEQ ID NO: 897471 - DNA, 25 bp, Mus musculus
catgttgctgcacgtgaacgatgtc

SEQ ID NO: 897472 - DNA, 25 bp, Mus musculus
catgttgctgcaggtgaacgatgtc

SEQ ID NO: 897473 - DNA, 25 bp, Mus musculus
catgttggtgagactgaactcaaag

SEQ ID NO: 897474 - DNA, 25 bp, Mus musculus
catgttggtgagtctgaactcaaag

SEQ ID NO: 897475 - DNA, 25 bp, Mus musculus
catgtttaagcttggtgaagatctt

SEQ ID NO: 897476 - DNA, 25 bp, Mus musculus
catgtttaaggttggtgaagatctt

SEQ ID NO: 897477 - DNA, 25 bp, Mus musculus
catgtttagctacacgaagcagttt

SEQ ID NO: 897478 - DNA, 25 bp, Mus musculus
catgtttagctacacgagcatctgg

SEQ ID NO: 897479 - DNA, 25 bp, Mus musculus
catgtttagctacaggaagcagttt

SEQ ID NO: 897480 - DNA, 25 bp, Mus musculus
catgtttagctacaggagcatctgg

SEQ ID NO: 897481 - DNA, 25 bp, Mus musculus
catgtttcagctgggcaggtcaaca

SEQ ID NO: 897482 - DNA, 25 bp, Mus musculus
catgtttcaggtgggcaggtcaaca

SEQ ID NO: 897483 - DNA, 25 bp, Mus musculus
catgttttccgactcgtgaccaacc

SEQ ID NO: 897484 - DNA, 25 bp, Mus musculus
catgttttccgactggtgaccaacc

SEQ ID NO: 897485 - DNA, 25 bp, Mus musculus
cattaaaaacatcctggaaaacact

SEQ ID NO: 897486 - DNA, 25 bp, Mus musculus
cattaaaaacttcctggaaaacact

SEQ ID NO: 897487 - DNA, 25 bp, Mus musculus
cattaaaacaaacatgtctcatttc

SEQ ID NO: 897488 - DNA, 25 bp, Mus musculus
cattaaaacaaagatgtctcatttc

SEQ ID NO: 897489 - DNA, 25 bp, Mus musculus
cattaaatttgcaaattcgttcatt

SEQ ID NO: 897490 - DNA, 25 bp, Mus musculus
cattaaatttgcaatttcgttcatt

SEQ ID NO: 897491 - DNA, 25 bp, Mus musculus
cattaacaagccatatgaaaaagtt

SEQ ID NO: 897492 - DNA, 25 bp, Mus musculus
cattaacaagccttatgaaaaagtt

SEQ ID NO: 897493 - DNA, 25 bp, Mus musculus
cattaacccgatcatcccctttact

SEQ ID NO: 897494 - DNA, 25 bp, Mus musculus
cattaacccgttcatcccctttact

SEQ ID NO: 897495 - DNA, 25 bp, Mus musculus
cattaacgtgcttcattatgatgga

SEQ ID NO: 897496 - DNA, 25 bp, Mus musculus
cattaacgtggttcattatgatgga

SEQ ID NO: 897497 - DNA, 25 bp, Mus musculus
cattaagaagcacgcagagatcctg

SEQ ID NO: 897498 - DNA, 25 bp, Mus musculus
cattaagaagcaggcagagatcctg

SEQ ID NO: 897499 - DNA, 25 bp, Mus musculus
cattaagcatgacgtagagcggcgt

SEQ ID NO: 897500 - DNA, 25 bp, Mus musculus
cattaagcatgaggtagagcggcgt

SEQ ID NO: 897501 - DNA, 25 bp, Mus musculus
cattaatagccacatcaacatgtac

SEQ ID NO: 897502 - DNA, 25 bp, Mus musculus
cattaatagccagatcaacatgtac

SEQ ID NO: 897503 - DNA, 25 bp, Mus musculus
cattaatcaaaacggcatcgatccg

SEQ ID NO: 897504 - DNA, 25 bp, Mus musculus
cattaatcaaaagggcatcgatccg

SEQ ID NO: 897505 - DNA, 25 bp, Mus musculus
cattaatgagcgccttaaagctgct

SEQ ID NO: 897506 - DNA, 25 bp, Mus musculus
cattaatgagggccttaaagctgct

SEQ ID NO: 897507 - DNA, 25 bp, Mus musculus
cattacaaacagatattcagaaact

SEQ ID NO: 897508 - DNA, 25 bp, Mus musculus
cattacaaacagttattcagaaact

SEQ ID NO: 897509 - DNA, 25 bp, Mus musculus
cattacaaccaacacaccaacgaca

SEQ ID NO: 897510 - DNA, 25 bp, Mus musculus
cattacaaccaacagaccaacgaca

SEQ ID NO: 897511 - DNA, 25 bp, Mus musculus
cattacaaccagagggcatgaagag

SEQ ID NO: 897512 - DNA, 25 bp, Mus musculus
cattacaaccagagttttcctccct

SEQ ID NO: 897513 - DNA, 25 bp, Mus musculus
cattacaaccagtgggcatgaagag

SEQ ID NO: 897514 - DNA, 25 bp, Mus musculus
cattacaaccagtgttttcctccct

SEQ ID NO: 897515 - DNA, 25 bp, Mus musculus
cattacacagcactcccctctcaag

SEQ ID NO: 897516 - DNA, 25 bp, Mus musculus
cattacacaggactcccctctcaag

SEQ ID NO: 897517 - DNA, 25 bp, Mus musculus
cattacacagtccgcgtgtattcag

SEQ ID NO: 897518 - DNA, 25 bp, Mus musculus
cattacacagtccgggtgtattcag

SEQ ID NO: 897519 - DNA, 25 bp, Mus musculus
cattacaccaaggaacttccccctg

SEQ ID NO: 897520 - DNA, 25 bp, Mus musculus
cattacaccatggaacttccccctg

SEQ ID NO: 897521 - DNA, 25 bp, Mus musculus
cattacagaaaacggtgtgtttgac

SEQ ID NO: 897522 - DNA, 25 bp, Mus musculus
cattacagaaaagggtgtgtttgac

SEQ ID NO: 897523 - DNA, 25 bp, Mus musculus
cattacattgagctggtgaaggctg

SEQ ID NO: 897524 - DNA, 25 bp, Mus musculus
cattacattgaggtggtgaaggctg

SEQ ID NO: 897525 - DNA, 25 bp, Mus musculus
cattaccatccccacgtcactggat

SEQ ID NO: 897526 - DNA, 25 bp, Mus musculus
cattaccatccccaggtcactggat

SEQ ID NO: 897527 - DNA, 25 bp, Mus musculus
cattacccagcttccccgctcgttg

SEQ ID NO: 897528 - DNA, 25 bp, Mus musculus
cattacccaggttccccgctcgttg

SEQ ID NO: 897529 - DNA, 25 bp, Mus musculus
cattacctaaatcactgataatggt

SEQ ID NO: 897530 - DNA, 25 bp, Mus musculus
cattacctaaatcgacaggatcctt

SEQ ID NO: 897531 - DNA, 25 bp, Mus musculus
cattacctaaatgactgataatggt

SEQ ID NO: 897532 - DNA, 25 bp, Mus musculus
cattacctaaatggacaggatcctt

SEQ ID NO: 897533 - DNA, 25 bp, Mus musculus
cattacgtcatgaactatgagatgt

SEQ ID NO: 897534 - DNA, 25 bp, Mus musculus
cattacgtcatgtactatgagatgt

SEQ ID NO: 897535 - DNA, 25 bp, Mus musculus
cattactcagagaaagctgatggtt

SEQ ID NO: 897536 - DNA, 25 bp, Mus musculus
cattactcagagagagccgcaggtc

SEQ ID NO: 897537 - DNA, 25 bp, Mus musculus
cattactcagtgaaagctgatggtt

SEQ ID NO: 897538 - DNA, 25 bp, Mus musculus
cattactcagtgagagccgcaggtc

SEQ ID NO: 897539 - DNA, 25 bp, Mus musculus
cattactccatggaagatttggcaa

SEQ ID NO: 897540 - DNA, 25 bp, Mus musculus
cattactccatggatgatttggcaa

SEQ ID NO: 897541 - DNA, 25 bp, Mus musculus
cattactcgcagagagatgagtcag

SEQ ID NO: 897542 - DNA, 25 bp, Mus musculus
cattactcgcagcgcaacaaagaat

SEQ ID NO: 897543 - DNA, 25 bp, Mus musculus
cattactcgcagggcaacaaagaat

SEQ ID NO: 897544 - DNA, 25 bp, Mus musculus
cattactcgcagtgagatgagtcag

SEQ ID NO: 897545 - DNA, 25 bp, Mus musculus
cattactctcaacacatcacagtca

SEQ ID NO: 897546 - DNA, 25 bp, Mus musculus
cattactctcaacagatcacagtca

SEQ ID NO: 897547 - DNA, 25 bp, Mus musculus
cattactgcatacaggaagaaaagg

SEQ ID NO: 897548 - DNA, 25 bp, Mus musculus
cattactgcatagaggaagaaaagg

SEQ ID NO: 897549 - DNA, 25 bp, Mus musculus
cattactgtacacgtggtacctgtt

SEQ ID NO: 897550 - DNA, 25 bp, Mus musculus
cattactgtacaggtggtacctgtt

SEQ ID NO: 897551 - DNA, 25 bp, Mus musculus
cattagataacagacctgcacgaaa

SEQ ID NO: 897552 - DNA, 25 bp, Mus musculus
cattagataacagagctgcacgaaa

SEQ ID NO: 897553 - DNA, 25 bp, Mus musculus
cattaggagcgaactgacaggccgt

SEQ ID NO: 897554 - DNA, 25 bp, Mus musculus
cattaggagcgatctgacaggccgt

SEQ ID NO: 897555 - DNA, 25 bp, Mus musculus
cattagtataccaagaagccagttg

SEQ ID NO: 897556 - DNA, 25 bp, Mus musculus
cattagtatagcaagaagccagttg

SEQ ID NO: 897557 - DNA, 25 bp, Mus musculus
cattatcaacgactactgtattggc

SEQ ID NO: 897558 - DNA, 25 bp, Mus musculus
cattatcaacgagtactgtattggc

SEQ ID NO: 897559 - DNA, 25 bp, Mus musculus
cattatcaagagccctacctcaggc

SEQ ID NO: 897560 - DNA, 25 bp, Mus musculus
cattatcaagtgccctacctcaggc

SEQ ID NO: 897561 - DNA, 25 bp, Mus musculus
cattatcaccagcttctgcaagggg

SEQ ID NO: 897562 - DNA, 25 bp, Mus musculus
cattatcaccaggttctgcaagggg

SEQ ID NO: 897563 - DNA, 25 bp, Mus musculus
cattatcagtctcaccatcctcatg

SEQ ID NO: 897564 - DNA, 25 bp, Mus musculus
cattatcagtctcagcatcctcatg

SEQ ID NO: 897565 - DNA, 25 bp, Mus musculus
cattatccaatgctacatggactcc

SEQ ID NO: 897566 - DNA, 25 bp, Mus musculus
cattatccaatggtacatggactcc

SEQ ID NO: 897567 - DNA, 25 bp, Mus musculus
cattatcttgaaaaccatactccca

SEQ ID NO: 897568 - DNA, 25 bp, Mus musculus
cattatcttgaaaagcatactccca

SEQ ID NO: 897569 - DNA, 25 bp, Mus musculus
cattatgaggtgacagaaatgcttc

SEQ ID NO: 897570 - DNA, 25 bp, Mus musculus
cattatgaggtgtcagaaatgcttc

SEQ ID NO: 897571 - DNA, 25 bp, Mus musculus
cattatgatagaattttcagtgaat

SEQ ID NO: 897572 - DNA, 25 bp, Mus musculus
cattatgatagatttttcagtgaat

SEQ ID NO: 897573 - DNA, 25 bp, Mus musculus
cattatgcaggagacgtgcagtatg

SEQ ID NO: 897574 - DNA, 25 bp, Mus musculus
cattatgcaggagaggtgcagtatg

SEQ ID NO: 897575 - DNA, 25 bp, Mus musculus
cattatgccaaagacatgaaggagt

SEQ ID NO: 897576 - DNA, 25 bp, Mus musculus
cattatgccaaagagatgaaggagt

SEQ ID NO: 897577 - DNA, 25 bp, Mus musculus
cattatgcctcgatctgcactctac

SEQ ID NO: 897578 - DNA, 25 bp, Mus musculus
cattatgcctggatctgcactctac

SEQ ID NO: 897579 - DNA, 25 bp, Mus musculus
cattatgctggcaacgtgctctacc

SEQ ID NO: 897580 - DNA, 25 bp, Mus musculus
cattatgctggcaaggtgctctacc

SEQ ID NO: 897581 - DNA, 25 bp, Mus musculus
cattattaaacgcatggctcccagc

SEQ ID NO: 897582 - DNA, 25 bp, Mus musculus
cattattaaacggatggctcccagc

SEQ ID NO: 897583 - DNA, 25 bp, Mus musculus
cattattccaaggcattatctcttg

SEQ ID NO: 897584 - DNA, 25 bp, Mus musculus
cattattccaaggctttatctcttg

SEQ ID NO: 897585 - DNA, 25 bp, Mus musculus
cattattctatgcctagaaaatgcc

SEQ ID NO: 897586 - DNA, 25 bp, Mus musculus
cattattctatggctagaaaatgcc

SEQ ID NO: 897587 - DNA, 25 bp, Mus musculus
cattattctgaagtggctgatggtc

SEQ ID NO: 897588 - DNA, 25 bp, Mus musculus
cattattctgtagtggctgatggtc

SEQ ID NO: 897589 - DNA, 25 bp, Mus musculus
cattattgagcccactgcagatgac

SEQ ID NO: 897590 - DNA, 25 bp, Mus musculus
cattattgaggccactgcagatgac

SEQ ID NO: 897591 - DNA, 25 bp, Mus musculus
cattatttacagcgacctcaagctg

SEQ ID NO: 897592 - DNA, 25 bp, Mus musculus
cattatttacagggacctcaagctg

SEQ ID NO: 897593 - DNA, 25 bp, Mus musculus
cattatttagctgcttactaaatac

SEQ ID NO: 897594 - DNA, 25 bp, Mus musculus
cattatttaggtgcttactaaatac

SEQ ID NO: 897595 - DNA, 25 bp, Mus musculus
cattattttacacacagaatgttct

SEQ ID NO: 897596 - DNA, 25 bp, Mus musculus
cattattttagacacagaatgttct

SEQ ID NO: 897597 - DNA, 25 bp, Mus musculus
cattcaacggggcattcatcagttg

SEQ ID NO: 897598 - DNA, 25 bp, Mus musculus
cattcaacgggggattcatcagttg

SEQ ID NO: 897599 - DNA, 25 bp, Mus musculus
cattcaacgttttccagcagagttt

SEQ ID NO: 897600 - DNA, 25 bp, Mus musculus
cattcaacgttttcgagcagagttt

SEQ ID NO: 897601 - DNA, 25 bp, Mus musculus
cattcaagccattatttgaaattca

SEQ ID NO: 897602 - DNA, 25 bp, Mus musculus
cattcaagcctttatttgaaattca

SEQ ID NO: 897603 - DNA, 25 bp, Mus musculus
cattcacaaccacgaacggcaccac

SEQ ID NO: 897604 - DNA, 25 bp, Mus musculus
cattcacaaccaggaacggcaccac

SEQ ID NO: 897605 - DNA, 25 bp, Mus musculus
cattcacactgagaccagacttctt

SEQ ID NO: 897606 - DNA, 25 bp, Mus musculus
cattcacactgagagcagacttctt

SEQ ID NO: 897607 - DNA, 25 bp, Mus musculus
cattcacagatgaacataacactgt

SEQ ID NO: 897608 - DNA, 25 bp, Mus musculus
cattcacagatgaagataacactgt

SEQ ID NO: 897609 - DNA, 25 bp, Mus musculus
cattcacctacgattaccacaccct

SEQ ID NO: 897610 - DNA, 25 bp, Mus musculus
cattcacctacgccaagagatgtcg

SEQ ID NO: 897611 - DNA, 25 bp, Mus musculus
cattcacctacggcaagagatgtcg

SEQ ID NO: 897612 - DNA, 25 bp, Mus musculus
cattcacctacgtttaccacaccct

SEQ ID NO: 897613 - DNA, 25 bp, Mus musculus
cattcactttaactcagctattgag

SEQ ID NO: 897614 - DNA, 25 bp, Mus musculus
cattcactttaagtcagctattgag

SEQ ID NO: 897615 - DNA, 25 bp, Mus musculus
cattcagaaaacatagctttccata

SEQ ID NO: 897616 - DNA, 25 bp, Mus musculus
cattcagaaaacttagctttccata

SEQ ID NO: 897617 - DNA, 25 bp, Mus musculus
cattcagaagcctgctgaaatagcc

SEQ ID NO: 897618 - DNA, 25 bp, Mus musculus
cattcagaaggctgctgaaatagcc

SEQ ID NO: 897619 - DNA, 25 bp, Mus musculus
cattcagactcgctcagatccagct

SEQ ID NO: 897620 - DNA, 25 bp, Mus musculus
cattcagactcggtcagatccagct

SEQ ID NO: 897621 - DNA, 25 bp, Mus musculus
cattcagatgattaaagaagtccca

SEQ ID NO: 897622 - DNA, 25 bp, Mus musculus
cattcagatgtttaaagaagtccca

SEQ ID NO: 897623 - DNA, 25 bp, Mus musculus
cattcagcacagtcatctccagcag

SEQ ID NO: 897624 - DNA, 25 bp, Mus musculus
cattcagcactgtcatctccagcag

SEQ ID NO: 897625 - DNA, 25 bp, Mus musculus
cattcagctgatccagtttgtcctg

SEQ ID NO: 897626 - DNA, 25 bp, Mus musculus
cattcagctggacaccttaccagaa

SEQ ID NO: 897627 - DNA, 25 bp, Mus musculus
cattcagctggacagcttaccagaa

SEQ ID NO: 897628 - DNA, 25 bp, Mus musculus
cattcagctgttccagtttgtcctg

SEQ ID NO: 897629 - DNA, 25 bp, Mus musculus
cattcataaaagagtaagtgagcaa

SEQ ID NO: 897630 - DNA, 25 bp, Mus musculus
cattcataaaagtgtaagtgagcaa

SEQ ID NO: 897631 - DNA, 25 bp, Mus musculus
cattcatcccgacgtgactccactg

SEQ ID NO: 897632 - DNA, 25 bp, Mus musculus
cattcatcccgaggtgactccactg

SEQ ID NO: 897633 - DNA, 25 bp, Mus musculus
cattcatctctgctcttgacgaagt

SEQ ID NO: 897634 - DNA, 25 bp, Mus musculus
cattcatctctggtcttgacgaagt

SEQ ID NO: 897635 - DNA, 25 bp, Mus musculus
cattcatcttatcacgagcacggca

SEQ ID NO: 897636 - DNA, 25 bp, Mus musculus
cattcatcttatcaggagcacggca

SEQ ID NO: 897637 - DNA, 25 bp, Mus musculus
cattcatgtgctaacagagggagag

SEQ ID NO: 897638 - DNA, 25 bp, Mus musculus
cattcatgtgctaagagagggagag

SEQ ID NO: 897639 - DNA, 25 bp, Mus musculus
cattcattctcatccccgagctgaa

SEQ ID NO: 897640 - DNA, 25 bp, Mus musculus
cattcattctcatcgccgagctgaa

SEQ ID NO: 897641 - DNA, 25 bp, Mus musculus
cattcatttatgactgttacaaaat

SEQ ID NO: 897642 - DNA, 25 bp, Mus musculus
cattcatttatgcgatccagaaaat

SEQ ID NO: 897643 - DNA, 25 bp, Mus musculus
cattcatttatgggatccagaaaat

SEQ ID NO: 897644 - DNA, 25 bp, Mus musculus
cattcatttatgtctgttacaaaat

SEQ ID NO: 897645 - DNA, 25 bp, Mus musculus
cattcatttcagatgcctctctgca

SEQ ID NO: 897646 - DNA, 25 bp, Mus musculus
cattcatttcagttgcctctctgca

SEQ ID NO: 897647 - DNA, 25 bp, Mus musculus
cattcatttgcacatcactctggaa

SEQ ID NO: 897648 - DNA, 25 bp, Mus musculus
cattcatttgcagatcactctggaa

SEQ ID NO: 897649 - DNA, 25 bp, Mus musculus
cattccaacctacaagggcaagatg

SEQ ID NO: 897650 - DNA, 25 bp, Mus musculus
cattccaacctacatgggcaagatg

SEQ ID NO: 897651 - DNA, 25 bp, Mus musculus
cattccaagaagaagcccgggacgg

SEQ ID NO: 897652 - DNA, 25 bp, Mus musculus
cattccaagatgaagcccgggacgg

SEQ ID NO: 897653 - DNA, 25 bp, Mus musculus
cattccaaggagctcaggaaggtcc

SEQ ID NO: 897654 - DNA, 25 bp, Mus musculus
cattccaaggaggtcaggaaggtcc

SEQ ID NO: 897655 - DNA, 25 bp, Mus musculus
cattccacagctctgcgaagacctc

SEQ ID NO: 897656 - DNA, 25 bp, Mus musculus
cattccacaggtctgcgaagacctc

SEQ ID NO: 897657 - DNA, 25 bp, Mus musculus
cattccaccaaccaccagatcatac

SEQ ID NO: 897658 - DNA, 25 bp, Mus musculus
cattccaccaaccaccttagcagat

SEQ ID NO: 897659 - DNA, 25 bp, Mus musculus
cattccaccaaccagcagatcatac

SEQ ID NO: 897660 - DNA, 25 bp, Mus musculus
cattccaccaaccagcttagcagat

SEQ ID NO: 897661 - DNA, 25 bp, Mus musculus
cattccaccccacactctgcagagg

SEQ ID NO: 897662 - DNA, 25 bp, Mus musculus
cattccaccccagactctgcagagg

SEQ ID NO: 897663 - DNA, 25 bp, Mus musculus
cattccatggagcatgtgtccatgg

SEQ ID NO: 897664 - DNA, 25 bp, Mus musculus
cattccatggaggatgtgtccatgg

SEQ ID NO: 897665 - DNA, 25 bp, Mus musculus
cattcccaagaacctgctggactcg

SEQ ID NO: 897666 - DNA, 25 bp, Mus musculus
cattcccaagcactgtgccggtgtg

SEQ ID NO: 897667 - DNA, 25 bp, Mus musculus
cattcccaaggactgtgccggtgtg

SEQ ID NO: 897668 - DNA, 25 bp, Mus musculus
cattcccaagtacctgctggactcg

SEQ ID NO: 897669 - DNA, 25 bp, Mus musculus
cattccccaatgctccatttactcg

SEQ ID NO: 897670 - DNA, 25 bp, Mus musculus
cattccccaatggtccatttactcg

SEQ ID NO: 897671 - DNA, 25 bp, Mus musculus
cattccccacaactgaaaatcacca

SEQ ID NO: 897672 - DNA, 25 bp, Mus musculus
cattccccactactgaaaatcacca

SEQ ID NO: 897673 - DNA, 25 bp, Mus musculus
cattccgatgcaatacctccatgct

SEQ ID NO: 897674 - DNA, 25 bp, Mus musculus
cattccgatggaatacctccatgct

SEQ ID NO: 897675 - DNA, 25 bp, Mus musculus
cattccgcagaggtatcagaagcca

SEQ ID NO: 897676 - DNA, 25 bp, Mus musculus
cattccgcagtggtatcagaagcca

SEQ ID NO: 897677 - DNA, 25 bp, Mus musculus
cattcctatcagcttgcgtgtgaac

SEQ ID NO: 897678 - DNA, 25 bp, Mus musculus
cattcctatcaggttgcgtgtgaac

SEQ ID NO: 897679 - DNA, 25 bp, Mus musculus
cattcctccacctacactcctctcc

SEQ ID NO: 897680 - DNA, 25 bp, Mus musculus
cattcctccagctacactcctctcc

SEQ ID NO: 897681 - DNA, 25 bp, Mus musculus
cattcctcttcgcccccattgctcc

SEQ ID NO: 897682 - DNA, 25 bp, Mus musculus
cattcctcttcgccgccattgctcc

SEQ ID NO: 897683 - DNA, 25 bp, Mus musculus
cattcctgacagccgacctcttcag

SEQ ID NO: 897684 - DNA, 25 bp, Mus musculus
cattcctgacaggcgacctcttcag

SEQ ID NO: 897685 - DNA, 25 bp, Mus musculus
cattcctggatcaacgtgcgcaggc

SEQ ID NO: 897686 - DNA, 25 bp, Mus musculus
cattcctggatcaaggtgcgcaggc

SEQ ID NO: 897687 - DNA, 25 bp, Mus musculus
cattcgaattggccggcggccagcg

SEQ ID NO: 897688 - DNA, 25 bp, Mus musculus
cattcgaattgggcggcggccagcg

SEQ ID NO: 897689 - DNA, 25 bp, Mus musculus
cattcgacagcagttgaacacccgc

SEQ ID NO: 897690 - DNA, 25 bp, Mus musculus
cattcgacaggagttgaacacccgc

SEQ ID NO: 897691 - DNA, 25 bp, Mus musculus
cattcgaggacatgcggaatgtgtt

SEQ ID NO: 897692 - DNA, 25 bp, Mus musculus
cattcgaggacatggggaatgtgtt

SEQ ID NO: 897693 - DNA, 25 bp, Mus musculus
cattcgccaaaacgaaggataccca

SEQ ID NO: 897694 - DNA, 25 bp, Mus musculus
cattcgccaaaaggaaggataccca

SEQ ID NO: 897695 - DNA, 25 bp, Mus musculus
cattcgcccgcgtctctatggcagt

SEQ ID NO: 897696 - DNA, 25 bp, Mus musculus
cattcgcccgggtctctatggcagt

SEQ ID NO: 897697 - DNA, 25 bp, Mus musculus
cattctcaagcagatttctcctctt

SEQ ID NO: 897698 - DNA, 25 bp, Mus musculus
cattctcaaggagatttctcctctt

SEQ ID NO: 897699 - DNA, 25 bp, Mus musculus
cattctcaatggaaatatggaaacc

SEQ ID NO: 897700 - DNA, 25 bp, Mus musculus
cattctcaatggcaaaaagagcttg

SEQ ID NO: 897701 - DNA, 25 bp, Mus musculus
cattctcaatgggaaaaagagcttg

SEQ ID NO: 897702 - DNA, 25 bp, Mus musculus
cattctcaatggtaatatggaaacc

SEQ ID NO: 897703 - DNA, 25 bp, Mus musculus
cattctcagcagcccgcagatcatg

SEQ ID NO: 897704 - DNA, 25 bp, Mus musculus
cattctcagcaggccgcagatcatg

SEQ ID NO: 897705 - DNA, 25 bp, Mus musculus
cattctctcaatcgtgtatgcccag

SEQ ID NO: 897706 - DNA, 25 bp, Mus musculus
cattctctcaatggtgtatgcccag

SEQ ID NO: 897707 - DNA, 25 bp, Mus musculus
cattctctggaacattaggtcagag

SEQ ID NO: 897708 - DNA, 25 bp, Mus musculus
cattctctggaactcctagtcactc

SEQ ID NO: 897709 - DNA, 25 bp, Mus musculus
cattctctggaagattaggtcagag

SEQ ID NO: 897710 - DNA, 25 bp, Mus musculus
cattctctggaagtcctagtcactc

SEQ ID NO: 897711 - DNA, 25 bp, Mus musculus
cattctgcaagtcggtgggaccatc

SEQ ID NO: 897712 - DNA, 25 bp, Mus musculus
cattctgcaagtgggtgggaccatc

SEQ ID NO: 897713 - DNA, 25 bp, Mus musculus
cattctgcagcattatacacacgaa

SEQ ID NO: 897714 - DNA, 25 bp, Mus musculus
cattctgcagcgcagagtcgaggtc

SEQ ID NO: 897715 - DNA, 25 bp, Mus musculus
cattctgcaggattatacacacgaa

SEQ ID NO: 897716 - DNA, 25 bp, Mus musculus
cattctgcagggcagagtcgaggtc

SEQ ID NO: 897717 - DNA, 25 bp, Mus musculus
cattctgcgccacgtcattgagaag

SEQ ID NO: 897718 - DNA, 25 bp, Mus musculus
cattctgcgccaggtcattgagaag

SEQ ID NO: 897719 - DNA, 25 bp, Mus musculus
cattctgctccaaacagatttccgc

SEQ ID NO: 897720 - DNA, 25 bp, Mus musculus
cattctgctccaaagagatttccgc

SEQ ID NO: 897721 - DNA, 25 bp, Mus musculus
cattctggagcactgccaataactt

SEQ ID NO: 897722 - DNA, 25 bp, Mus musculus
cattctggagcagtgccaataactt

SEQ ID NO: 897723 - DNA, 25 bp, Mus musculus
cattctggcccataaatgctgttgg

SEQ ID NO: 897724 - DNA, 25 bp, Mus musculus
cattctggcccatatatgctgttgg

SEQ ID NO: 897725 - DNA, 25 bp, Mus musculus
cattctggcttgcccaaagctatga

SEQ ID NO: 897726 - DNA, 25 bp, Mus musculus
cattctggcttggccaaagctatga

SEQ ID NO: 897727 - DNA, 25 bp, Mus musculus
cattctggtgcacgtagagcagctg

SEQ ID NO: 897728 - DNA, 25 bp, Mus musculus
cattctggtgcaggtagagcagctg

SEQ ID NO: 897729 - DNA, 25 bp, Mus musculus
cattcttaagattcctttgagagac

SEQ ID NO: 897730 - DNA, 25 bp, Mus musculus
cattcttaagcgtttaaaggctgaa

SEQ ID NO: 897731 - DNA, 25 bp, Mus musculus
cattcttaagggtttaaaggctgaa

SEQ ID NO: 897732 - DNA, 25 bp, Mus musculus
cattcttaagtttcctttgagagac

SEQ ID NO: 897733 - DNA, 25 bp, Mus musculus
cattcttaataacgaagaaactcag

SEQ ID NO: 897734 - DNA, 25 bp, Mus musculus
cattcttaataaggaagaaactcag

SEQ ID NO: 897735 - DNA, 25 bp, Mus musculus
cattcttagaaaacgcctccttggc

SEQ ID NO: 897736 - DNA, 25 bp, Mus musculus
cattcttagaaatcgcctccttggc

SEQ ID NO: 897737 - DNA, 25 bp, Mus musculus
cattcttcagctcgttatcaaccca

SEQ ID NO: 897738 - DNA, 25 bp, Mus musculus
cattcttcaggtcgttatcaaccca

SEQ ID NO: 897739 - DNA, 25 bp, Mus musculus
cattcttcatagagaagatcttgga

SEQ ID NO: 897740 - DNA, 25 bp, Mus musculus
cattcttcatagtgaagatcttgga

SEQ ID NO: 897741 - DNA, 25 bp, Mus musculus
cattcttgataacaccaccctgcag

SEQ ID NO: 897742 - DNA, 25 bp, Mus musculus
cattcttgataacagcaccctgcag

SEQ ID NO: 897743 - DNA, 25 bp, Mus musculus
cattctttagctattcctttggact

SEQ ID NO: 897744 - DNA, 25 bp, Mus musculus
cattctttaggtattcctttggact

SEQ ID NO: 897745 - DNA, 25 bp, Mus musculus
cattctttttaacctatcccagaat

SEQ ID NO: 897746 - DNA, 25 bp, Mus musculus
cattctttttaagctatcccagaat

SEQ ID NO: 897747 - DNA, 25 bp, Mus musculus
cattgaagataacgtcaagtccttg

SEQ ID NO: 897748 - DNA, 25 bp, Mus musculus
cattgaagataaggtcaagtccttg

SEQ ID NO: 897749 - DNA, 25 bp, Mus musculus
cattgaatatagacctgaaaaccat

SEQ ID NO: 897750 - DNA, 25 bp, Mus musculus
cattgaatatagtcctgaaaaccat

SEQ ID NO: 897751 - DNA, 25 bp, Mus musculus
cattgaatatcaagcggctgagaaa

SEQ ID NO: 897752 - DNA, 25 bp, Mus musculus
cattgaatatcaaggggctgagaaa

SEQ ID NO: 897753 - DNA, 25 bp, Mus musculus
cattgaatatgacatgtgcataatg

SEQ ID NO: 897754 - DNA, 25 bp, Mus musculus
cattgaatatgacgtgtcagctgtg

SEQ ID NO: 897755 - DNA, 25 bp, Mus musculus
cattgaatatgagatgtgcataatg

SEQ ID NO: 897756 - DNA, 25 bp, Mus musculus
cattgaatatgaggtgtcagctgtg

SEQ ID NO: 897757 - DNA, 25 bp, Mus musculus
cattgacaggcacataacagatcaa

SEQ ID NO: 897758 - DNA, 25 bp, Mus musculus
cattgacagggacataacagatcaa

SEQ ID NO: 897759 - DNA, 25 bp, Mus musculus
cattgacataggcaacgtctagctc

SEQ ID NO: 897760 - DNA, 25 bp, Mus musculus
cattgacataggctcgttcaggcct

SEQ ID NO: 897761 - DNA, 25 bp, Mus musculus
cattgacatagggaacgtctagctc

SEQ ID NO: 897762 - DNA, 25 bp, Mus musculus
cattgacatagggtcgttcaggcct

SEQ ID NO: 897763 - DNA, 25 bp, Mus musculus
cattgactgcagctccctggaaaca

SEQ ID NO: 897764 - DNA, 25 bp, Mus musculus
cattgactgcaggtccctggaaaca

SEQ ID NO: 897765 - DNA, 25 bp, Mus musculus
cattgacttaaacgaactagaggct

SEQ ID NO: 897766 - DNA, 25 bp, Mus musculus
cattgacttaaaggaactagaggct

SEQ ID NO: 897767 - DNA, 25 bp, Mus musculus
cattgactttgacggcaaaaaagac

SEQ ID NO: 897768 - DNA, 25 bp, Mus musculus
cattgactttgagggcaaaaaagac

SEQ ID NO: 897769 - DNA, 25 bp, Mus musculus
cattgagaagagccccaagccagtg

SEQ ID NO: 897770 - DNA, 25 bp, Mus musculus
cattgagaagtgccccaagccagtg

SEQ ID NO: 897771 - DNA, 25 bp, Mus musculus
cattgagacattcaggaaaaaaggt

SEQ ID NO: 897772 - DNA, 25 bp, Mus musculus
cattgagacattgaggaaaaaaggt

SEQ ID NO: 897773 - DNA, 25 bp, Mus musculus
cattgagcagagtctgcgagaaatc

SEQ ID NO: 897774 - DNA, 25 bp, Mus musculus
cattgagcagtgtctgcgagaaatc

SEQ ID NO: 897775 - DNA, 25 bp, Mus musculus
cattgaggaccccgagctagaagcg

SEQ ID NO: 897776 - DNA, 25 bp, Mus musculus
cattgaggacccggagctagaagcg

SEQ ID NO: 897777 - DNA, 25 bp, Mus musculus
cattgaggcaaacaacctagccagc

SEQ ID NO: 897778 - DNA, 25 bp, Mus musculus
cattgaggcaaagaacctagccagc

SEQ ID NO: 897779 - DNA, 25 bp, Mus musculus
cattgagggcagcctggacactgca

SEQ ID NO: 897780 - DNA, 25 bp, Mus musculus
cattgagggcaggctggacactgca

SEQ ID NO: 897781 - DNA, 25 bp, Mus musculus
cattgagtacatcgccccagagatt

SEQ ID NO: 897782 - DNA, 25 bp, Mus musculus
cattgagtacatggccccagagatt

SEQ ID NO: 897783 - DNA, 25 bp, Mus musculus
cattgataagaattttgattctgac

SEQ ID NO: 897784 - DNA, 25 bp, Mus musculus
cattgataagtattttgattctgac

SEQ ID NO: 897785 - DNA, 25 bp, Mus musculus
cattgataatcccgaccagcgaatc

SEQ ID NO: 897786 - DNA, 25 bp, Mus musculus
cattgataatccggaccagcgaatc

SEQ ID NO: 897787 - DNA, 25 bp, Mus musculus
cattgatcagctggtgactgcaggc

SEQ ID NO: 897788 - DNA, 25 bp, Mus musculus
cattgatcaggtggtgactgcaggc

SEQ ID NO: 897789 - DNA, 25 bp, Mus musculus
cattgatcatcggccctgaagacac

SEQ ID NO: 897790 - DNA, 25 bp, Mus musculus
cattgatcatgggccctgaagacac

SEQ ID NO: 897791 - DNA, 25 bp, Mus musculus
cattgatccgatttggaacattgca

SEQ ID NO: 897792 - DNA, 25 bp, Mus musculus
cattgatccgttttggaacattgca

SEQ ID NO: 897793 - DNA, 25 bp, Mus musculus
cattgatctgcttatccaggccgtg

SEQ ID NO: 897794 - DNA, 25 bp, Mus musculus
cattgatctggttatccaggccgtg

SEQ ID NO: 897795 - DNA, 25 bp, Mus musculus
cattgatgaagcctcaggaactgtg

SEQ ID NO: 897796 - DNA, 25 bp, Mus musculus
cattgatgaagcgtcaggaactgtg

SEQ ID NO: 897797 - DNA, 25 bp, Mus musculus
cattgatgagggcacgttgatgctg

SEQ ID NO: 897798 - DNA, 25 bp, Mus musculus
cattgatgagggcaggttgatgctg

SEQ ID NO: 897799 - DNA, 25 bp, Mus musculus
cattgatgcacaaacggaaagcaat

SEQ ID NO: 897800 - DNA, 25 bp, Mus musculus
cattgatgcacatacggaaagcaat

SEQ ID NO: 897801 - DNA, 25 bp, Mus musculus
cattgatggcaacatcttctgtgtg

SEQ ID NO: 897802 - DNA, 25 bp, Mus musculus
cattgatggcaagatcttctgtgtg

SEQ ID NO: 897803 - DNA, 25 bp, Mus musculus
cattgatgtacacgagggcacgagt

SEQ ID NO: 897804 - DNA, 25 bp, Mus musculus
cattgatgtacaggagggcacgagt

SEQ ID NO: 897805 - DNA, 25 bp, Mus musculus
cattgatgtcaccaagccagcgatc

SEQ ID NO: 897806 - DNA, 25 bp, Mus musculus
cattgatgtcaccgtctattacaat

SEQ ID NO: 897807 - DNA, 25 bp, Mus musculus
cattgatgtcacgaagccagcgatc

SEQ ID NO: 897808 - DNA, 25 bp, Mus musculus
cattgatgtcacggtctattacaat

SEQ ID NO: 897809 - DNA, 25 bp, Mus musculus
cattgatgtgcatgagaaaaaccag

SEQ ID NO: 897810 - DNA, 25 bp, Mus musculus
cattgatgtggatgagaaaaaccag

SEQ ID NO: 897811 - DNA, 25 bp, Mus musculus
cattgcaaacaacgaacatttacat

SEQ ID NO: 897812 - DNA, 25 bp, Mus musculus
cattgcaaacaaggaacatttacat

SEQ ID NO: 897813 - DNA, 25 bp, Mus musculus
cattgcaaagcctgggatcatctgt

SEQ ID NO: 897814 - DNA, 25 bp, Mus musculus
cattgcaaaggctgggatcatctgt

SEQ ID NO: 897815 - DNA, 25 bp, Mus musculus
cattgcaagaaaattgaaaaagagt

SEQ ID NO: 897816 - DNA, 25 bp, Mus musculus
cattgcaagaaatttgaaaaagagt

SEQ ID NO: 897817 - DNA, 25 bp, Mus musculus
cattgcaatgcatgagtttcatcct

SEQ ID NO: 897818 - DNA, 25 bp, Mus musculus
cattgcaatggatgagtttcatcct

SEQ ID NO: 897819 - DNA, 25 bp, Mus musculus
cattgcaatggcactcatgggagga

SEQ ID NO: 897820 - DNA, 25 bp, Mus musculus
cattgcaatggctctcatgggagga

SEQ ID NO: 897821 - DNA, 25 bp, Mus musculus
cattgcacggcacattacaaaagaa

SEQ ID NO: 897822 - DNA, 25 bp, Mus musculus
cattgcacggcagattacaaaagaa

SEQ ID NO: 897823 - DNA, 25 bp, Mus musculus
cattgcagaaagacattagtactga

SEQ ID NO: 897824 - DNA, 25 bp, Mus musculus
cattgcagaaagtcattagtactga

SEQ ID NO: 897825 - DNA, 25 bp, Mus musculus
cattgcagagatcgagcggctgcag

SEQ ID NO: 897826 - DNA, 25 bp, Mus musculus
cattgcagagatggagcggctgcag

SEQ ID NO: 897827 - DNA, 25 bp, Mus musculus
cattgccaacccagtgaactccacc

SEQ ID NO: 897828 - DNA, 25 bp, Mus musculus
cattgccaaccctgtgaactccacc

SEQ ID NO: 897829 - DNA, 25 bp, Mus musculus
cattgccagaaacagaaatgctttg

SEQ ID NO: 897830 - DNA, 25 bp, Mus musculus
cattgccagaaagagaaatgctttg

SEQ ID NO: 897831 - DNA, 25 bp, Mus musculus
cattgcccagaccgtgttcctgggc

SEQ ID NO: 897832 - DNA, 25 bp, Mus musculus
cattgcccagctgaaaatccagggc

SEQ ID NO: 897833 - DNA, 25 bp, Mus musculus
cattgcccaggtgaaaatccagggc

SEQ ID NO: 897834 - DNA, 25 bp, Mus musculus
cattgcccagtccgtgttcctgggc

SEQ ID NO: 897835 - DNA, 25 bp, Mus musculus
cattgcctcaagctgagctgtcctc

SEQ ID NO: 897836 - DNA, 25 bp, Mus musculus
cattgcctcaaggtgagctgtcctc

SEQ ID NO: 897837 - DNA, 25 bp, Mus musculus
cattgctaaacctgggatcactacc

SEQ ID NO: 897838 - DNA, 25 bp, Mus musculus
cattgctaaagctgggatcactacc

SEQ ID NO: 897839 - DNA, 25 bp, Mus musculus
cattgctaacagcatgcccatccca

SEQ ID NO: 897840 - DNA, 25 bp, Mus musculus
cattgctaacagcggatcatgaggg

SEQ ID NO: 897841 - DNA, 25 bp, Mus musculus
cattgctaacaggatgcccatccca

SEQ ID NO: 897842 - DNA, 25 bp, Mus musculus
cattgctaacaggggatcatgaggg

SEQ ID NO: 897843 - DNA, 25 bp, Mus musculus
cattgctaccagcgtccgcctggct

SEQ ID NO: 897844 - DNA, 25 bp, Mus musculus
cattgctaccagggtccgcctggct

SEQ ID NO: 897845 - DNA, 25 bp, Mus musculus
cattgctctggacaccagtgacaag

SEQ ID NO: 897846 - DNA, 25 bp, Mus musculus
cattgctctggactgacaagcaccg

SEQ ID NO: 897847 - DNA, 25 bp, Mus musculus
cattgctctggagaccagtgacaag

SEQ ID NO: 897848 - DNA, 25 bp, Mus musculus
cattgctctggagtgacaagcaccg

SEQ ID NO: 897849 - DNA, 25 bp, Mus musculus
cattgctgacagcatgcctagccga

SEQ ID NO: 897850 - DNA, 25 bp, Mus musculus
cattgctgacaggatgcctagccga

SEQ ID NO: 897851 - DNA, 25 bp, Mus musculus
cattgctgagcttgaaaatgaggag

SEQ ID NO: 897852 - DNA, 25 bp, Mus musculus
cattgctgaggttgaaaatgaggag

SEQ ID NO: 897853 - DNA, 25 bp, Mus musculus
cattgctgttaaccaaatgcggcgc

SEQ ID NO: 897854 - DNA, 25 bp, Mus musculus
cattgctgttaagcaaatgcggcgc

SEQ ID NO: 897855 - DNA, 25 bp, Mus musculus
cattgctttgtgacctactctacag

SEQ ID NO: 897856 - DNA, 25 bp, Mus musculus
cattgctttgtgacgtactctacag

SEQ ID NO: 897857 - DNA, 25 bp, Mus musculus
cattggaaacagcttcagacaatga

SEQ ID NO: 897858 - DNA, 25 bp, Mus musculus
cattggaaacaggttcagacaatga

SEQ ID NO: 897859 - DNA, 25 bp, Mus musculus
cattggacagattgtccttctgaag

SEQ ID NO: 897860 - DNA, 25 bp, Mus musculus
cattggacagtttgtccttctgaag

SEQ ID NO: 897861 - DNA, 25 bp, Mus musculus
cattggactacacaacggtgtactg

SEQ ID NO: 897862 - DNA, 25 bp, Mus musculus
cattggactacagaacggtgtactg

SEQ ID NO: 897863 - DNA, 25 bp, Mus musculus
cattggagccagccaggtgcagtct

SEQ ID NO: 897864 - DNA, 25 bp, Mus musculus
cattggagccagctacgtacagacg

SEQ ID NO: 897865 - DNA, 25 bp, Mus musculus
cattggagccaggcaggtgcagtct

SEQ ID NO: 897866 - DNA, 25 bp, Mus musculus
cattggagccaggtacgtacagacg

SEQ ID NO: 897867 - DNA, 25 bp, Mus musculus
cattggaggaataaacattgctgag

SEQ ID NO: 897868 - DNA, 25 bp, Mus musculus
cattggaggaattaacattgctgag

SEQ ID NO: 897869 - DNA, 25 bp, Mus musculus
cattggatatcaaggccctgcacca

SEQ ID NO: 897870 - DNA, 25 bp, Mus musculus
cattggatatcatggccctgcacca

SEQ ID NO: 897871 - DNA, 25 bp, Mus musculus
cattggattcagctacagaagccta

SEQ ID NO: 897872 - DNA, 25 bp, Mus musculus
cattggattcaggtacagaagccta

SEQ ID NO: 897873 - DNA, 25 bp, Mus musculus
cattggcaaactcacatccaatctc

SEQ ID NO: 897874 - DNA, 25 bp, Mus musculus
cattggcaaactcagatccaatctc

SEQ ID NO: 897875 - DNA, 25 bp, Mus musculus
cattggcaggcacctgattgaggac

SEQ ID NO: 897876 - DNA, 25 bp, Mus musculus
cattggcagggacctgattgaggac

SEQ ID NO: 897877 - DNA, 25 bp, Mus musculus
cattggccagctcgagtagatgaag

SEQ ID NO: 897878 - DNA, 25 bp, Mus musculus
cattggccagctcgtgtagatgaag

SEQ ID NO: 897879 - DNA, 25 bp, Mus musculus
cattggcttgaacgatgctcagatt

SEQ ID NO: 897880 - DNA, 25 bp, Mus musculus
cattggcttgaaggatgctcagatt

SEQ ID NO: 897881 - DNA, 25 bp, Mus musculus
cattgggaagaacgtcaatgtgact

SEQ ID NO: 897882 - DNA, 25 bp, Mus musculus
cattgggaagaagggagagactgta

SEQ ID NO: 897883 - DNA, 25 bp, Mus musculus
cattgggaagaaggtcaatgtgact

SEQ ID NO: 897884 - DNA, 25 bp, Mus musculus
cattgggaagtagggagagactgta

SEQ ID NO: 897885 - DNA, 25 bp, Mus musculus
cattgggatgcaactgtccaagatc

SEQ ID NO: 897886 - DNA, 25 bp, Mus musculus
cattgggatggaactgtccaagatc

SEQ ID NO: 897887 - DNA, 25 bp, Mus musculus
cattgggcacagcggcccagtggat

SEQ ID NO: 897888 - DNA, 25 bp, Mus musculus
cattgggcacaggggcccagtggat

SEQ ID NO: 897889 - DNA, 25 bp, Mus musculus
cattggtaccaaacccttcgacagt

SEQ ID NO: 897890 - DNA, 25 bp, Mus musculus
cattggtaccaaacgcttcgacagt

SEQ ID NO: 897891 - DNA, 25 bp, Mus musculus
cattggtctaatctctgaccgcctc

SEQ ID NO: 897892 - DNA, 25 bp, Mus musculus
cattggtctattctctgaccgcctc

SEQ ID NO: 897893 - DNA, 25 bp, Mus musculus
cattggtctgcaggcaccgctcctc

SEQ ID NO: 897894 - DNA, 25 bp, Mus musculus
cattggtctggaggcaccgctcctc

SEQ ID NO: 897895 - DNA, 25 bp, Mus musculus
cattggtcttaacgcactgaagcca

SEQ ID NO: 897896 - DNA, 25 bp, Mus musculus
cattggtcttaaggcactgaagcca

SEQ ID NO: 897897 - DNA, 25 bp, Mus musculus
cattggtgagctgaaaaatgaatct

SEQ ID NO: 897898 - DNA, 25 bp, Mus musculus
cattggtgaggtgaaaaatgaatct

SEQ ID NO: 897899 - DNA, 25 bp, Mus musculus
cattggtgtgagcttccatgtgggc

SEQ ID NO: 897900 - DNA, 25 bp, Mus musculus
cattggtgtgaggttccatgtgggc

SEQ ID NO: 897901 - DNA, 25 bp, Mus musculus
cattggttgaaatgcgcttcaatgt

SEQ ID NO: 897902 - DNA, 25 bp, Mus musculus
cattggttgaaatgggcttcaatgt

SEQ ID NO: 897903 - DNA, 25 bp, Mus musculus
cattggttgggataaactcgcatgt

SEQ ID NO: 897904 - DNA, 25 bp, Mus musculus
cattggttgggatatactcgcatgt

SEQ ID NO: 897905 - DNA, 25 bp, Mus musculus
cattgtagagagatacattggcttc

SEQ ID NO: 897906 - DNA, 25 bp, Mus musculus
cattgtagagagttacattggcttc

SEQ ID NO: 897907 - DNA, 25 bp, Mus musculus
cattgtatacatcatcccttcaggc

SEQ ID NO: 897908 - DNA, 25 bp, Mus musculus
cattgtatacatgatcccttcaggc

SEQ ID NO: 897909 - DNA, 25 bp, Mus musculus
cattgtcaagcaagaagagacagaa

SEQ ID NO: 897910 - DNA, 25 bp, Mus musculus
cattgtcaagctggtggccaaaaaa

SEQ ID NO: 897911 - DNA, 25 bp, Mus musculus
cattgtcaaggaagaagagacagaa

SEQ ID NO: 897912 - DNA, 25 bp, Mus musculus
cattgtcaaggtggtggccaaaaaa

SEQ ID NO: 897913 - DNA, 25 bp, Mus musculus
cattgtcacaagcactcatgaaagt

SEQ ID NO: 897914 - DNA, 25 bp, Mus musculus
cattgtcacaagcactctgaccaag

SEQ ID NO: 897915 - DNA, 25 bp, Mus musculus
cattgtcacaagcagtcatgaaagt

SEQ ID NO: 897916 - DNA, 25 bp, Mus musculus
cattgtcacaagcagtctgaccaag

SEQ ID NO: 897917 - DNA, 25 bp, Mus musculus
cattgtctatgactttctgatgtct

SEQ ID NO: 897918 - DNA, 25 bp, Mus musculus
cattgtctatgagtttctgatgtct

SEQ ID NO: 897919 - DNA, 25 bp, Mus musculus
cattgtctccagcgtcctgattcgt

SEQ ID NO: 897920 - DNA, 25 bp, Mus musculus
cattgtctccagggtcctgattcgt

SEQ ID NO: 897921 - DNA, 25 bp, Mus musculus
cattgtgaagatgtgaacgagtgcg

SEQ ID NO: 897922 - DNA, 25 bp, Mus musculus
cattgtgaagtcacttattggtgca

SEQ ID NO: 897923 - DNA, 25 bp, Mus musculus
cattgtgaagtctcttattggtgca

SEQ ID NO: 897924 - DNA, 25 bp, Mus musculus
cattgtgaagttgtgaacgagtgcg

SEQ ID NO: 897925 - DNA, 25 bp, Mus musculus
cattgtgacagactgggacttggta

SEQ ID NO: 897926 - DNA, 25 bp, Mus musculus
cattgtgacagagtgggacttggta

SEQ ID NO: 897927 - DNA, 25 bp, Mus musculus
cattgtgaggggagctgttgtggaa

SEQ ID NO: 897928 - DNA, 25 bp, Mus musculus
cattgtgaggggagttctgtagtgg

SEQ ID NO: 897929 - DNA, 25 bp, Mus musculus
cattgtgaggggtgctgttgtggaa

SEQ ID NO: 897930 - DNA, 25 bp, Mus musculus
cattgtgaggggtgttctgtagtgg

SEQ ID NO: 897931 - DNA, 25 bp, Mus musculus
cattgtgatcagactgaactcagca

SEQ ID NO: 897932 - DNA, 25 bp, Mus musculus
cattgtgatcagtctgaactcagca

SEQ ID NO: 897933 - DNA, 25 bp, Mus musculus
cattgtgcgcaacgtcaatgccgaa

SEQ ID NO: 897934 - DNA, 25 bp, Mus musculus
cattgtgcgcaaggtcaatgccgaa

SEQ ID NO: 897935 - DNA, 25 bp, Mus musculus
cattgtggagaacggtatgcctggt

SEQ ID NO: 897936 - DNA, 25 bp, Mus musculus
cattgtggagaagggtatgcctggt

SEQ ID NO: 897937 - DNA, 25 bp, Mus musculus
cattgtggggctctcctgtgtagat

SEQ ID NO: 897938 - DNA, 25 bp, Mus musculus
cattgtggggctctgctgtgtagat

SEQ ID NO: 897939 - DNA, 25 bp, Mus musculus
cattgtgtgagtcactggggtcatg

SEQ ID NO: 897940 - DNA, 25 bp, Mus musculus
cattgtgtgagtcagtggggtcatg

SEQ ID NO: 897941 - DNA, 25 bp, Mus musculus
cattgtgttggacgatgatggcagc

SEQ ID NO: 897942 - DNA, 25 bp, Mus musculus
cattgtgttggaggatgatggcagc

SEQ ID NO: 897943 - DNA, 25 bp, Mus musculus
cattgttgtcaacgtttgatctcat

SEQ ID NO: 897944 - DNA, 25 bp, Mus musculus
cattgttgtcaaggtttgatctcat

SEQ ID NO: 897945 - DNA, 25 bp, Mus musculus
catttaaaggcacacgaagcggaac

SEQ ID NO: 897946 - DNA, 25 bp, Mus musculus
catttaaaggcacaggaagcggaac

SEQ ID NO: 897947 - DNA, 25 bp, Mus musculus
catttaagacaagtcgttgctatgg

SEQ ID NO: 897948 - DNA, 25 bp, Mus musculus
catttaagacaagtggttgctatgg

SEQ ID NO: 897949 - DNA, 25 bp, Mus musculus
catttacacccaccaatcccaggat

SEQ ID NO: 897950 - DNA, 25 bp, Mus musculus
catttacacccagcaatcccaggat

SEQ ID NO: 897951 - DNA, 25 bp, Mus musculus
catttacagcgacgaactgcgtgag

SEQ ID NO: 897952 - DNA, 25 bp, Mus musculus
catttacagcgaggaactgcgtgag

SEQ ID NO: 897953 - DNA, 25 bp, Mus musculus
catttacgagctgatcaaagagaag

SEQ ID NO: 897954 - DNA, 25 bp, Mus musculus
catttacgaggtgatcaaagagaag

SEQ ID NO: 897955 - DNA, 25 bp, Mus musculus
catttacttcaacggcctgtggaag

SEQ ID NO: 897956 - DNA, 25 bp, Mus musculus
catttacttcaagggcctgtggaag

SEQ ID NO: 897957 - DNA, 25 bp, Mus musculus
catttagaagctgtgccgatgctct

SEQ ID NO: 897958 - DNA, 25 bp, Mus musculus
catttagaaggtgtgccgatgctct

SEQ ID NO: 897959 - DNA, 25 bp, Mus musculus
catttataacaaccccaccgatgat

SEQ ID NO: 897960 - DNA, 25 bp, Mus musculus
catttataacaagcccaccgatgat

SEQ ID NO: 897961 - DNA, 25 bp, Mus musculus
catttatctgtaacagcgtggaaga

SEQ ID NO: 897962 - DNA, 25 bp, Mus musculus
catttatctgtatcagcgtggaaga

SEQ ID NO: 897963 - DNA, 25 bp, Mus musculus
catttatgagaatggagatgtatgc

SEQ ID NO: 897964 - DNA, 25 bp, Mus musculus
catttatgagtatggagatgtatgc

SEQ ID NO: 897965 - DNA, 25 bp, Mus musculus
catttatgcactcgtgaatcttgct

SEQ ID NO: 897966 - DNA, 25 bp, Mus musculus
catttatgcactggtgaatcttgct

SEQ ID NO: 897967 - DNA, 25 bp, Mus musculus
catttcaaagcttagcgatgcaact

SEQ ID NO: 897968 - DNA, 25 bp, Mus musculus
catttcaaaggttagcgatgcaact

SEQ ID NO: 897969 - DNA, 25 bp, Mus musculus
catttcaactcccacctgacacccc

SEQ ID NO: 897970 - DNA, 25 bp, Mus musculus
catttcaactcccagctgacacccc

SEQ ID NO: 897971 - DNA, 25 bp, Mus musculus
catttcaactgtatggaaagaaaac

SEQ ID NO: 897972 - DNA, 25 bp, Mus musculus
catttcaactgtttggaaagaaaac

SEQ ID NO: 897973 - DNA, 25 bp, Mus musculus
catttcacagaggttatgactttgg

SEQ ID NO: 897974 - DNA, 25 bp, Mus musculus
catttcacagtggttatgactttgg

SEQ ID NO: 897975 - DNA, 25 bp, Mus musculus
catttcactgtgctggaagggactc

SEQ ID NO: 897976 - DNA, 25 bp, Mus musculus
catttcactgtggtggaagggactc

SEQ ID NO: 897977 - DNA, 25 bp, Mus musculus
catttcagggagactgctgggctga

SEQ ID NO: 897978 - DNA, 25 bp, Mus musculus
catttcagggagtctgctgggctga

SEQ ID NO: 897979 - DNA, 25 bp, Mus musculus
catttccacatactgctggggatcg

SEQ ID NO: 897980 - DNA, 25 bp, Mus musculus
catttccacatacttcagcaatcag

SEQ ID NO: 897981 - DNA, 25 bp, Mus musculus
catttccacatagtgctggggatcg

SEQ ID NO: 897982 - DNA, 25 bp, Mus musculus
catttccacatagttcagcaatcag

SEQ ID NO: 897983 - DNA, 25 bp, Mus musculus
catttcccacagacctggatttgga

SEQ ID NO: 897984 - DNA, 25 bp, Mus musculus
catttcccacagtcctggatttgga

SEQ ID NO: 897985 - DNA, 25 bp, Mus musculus
catttccctgccaggttcaccggac

SEQ ID NO: 897986 - DNA, 25 bp, Mus musculus
catttccctggcaggttcaccggac

SEQ ID NO: 897987 - DNA, 25 bp, Mus musculus
catttccgagcctactaaagcaggt

SEQ ID NO: 897988 - DNA, 25 bp, Mus musculus
catttccgagcgcagatttactggg

SEQ ID NO: 897989 - DNA, 25 bp, Mus musculus
catttccgaggctactaaagcaggt

SEQ ID NO: 897990 - DNA, 25 bp, Mus musculus
catttccgagggcagatttactggg

SEQ ID NO: 897991 - DNA, 25 bp, Mus musculus
catttccttaacctcggatcgctta

SEQ ID NO: 897992 - DNA, 25 bp, Mus musculus
catttccttaacctgggatcgctta

SEQ ID NO: 897993 - DNA, 25 bp, Mus musculus
catttcctttcacaagacccagcat

SEQ ID NO: 897994 - DNA, 25 bp, Mus musculus
catttcctttcagaagacccagcat

SEQ ID NO: 897995 - DNA, 25 bp, Mus musculus
catttcggctcacactcgcatgtgt

SEQ ID NO: 897996 - DNA, 25 bp, Mus musculus
catttcggctcacggaagtgacttt

SEQ ID NO: 897997 - DNA, 25 bp, Mus musculus
catttcggctcagactcgcatgtgt

SEQ ID NO: 897998 - DNA, 25 bp, Mus musculus
catttcggctcagggaagtgacttt

SEQ ID NO: 897999 - DNA, 25 bp, Mus musculus
catttctgagcgcctgcaccctaga

SEQ ID NO: 898000 - DNA, 25 bp, Mus musculus
catttctgagggcctgcaccctaga

SEQ ID NO: 898001 - DNA, 25 bp, Mus musculus
catttctgcaagccgcctgtgtcat

SEQ ID NO: 898002 - DNA, 25 bp, Mus musculus
catttctgcaaggcgcctgtgtcat

SEQ ID NO: 898003 - DNA, 25 bp, Mus musculus
catttctgggcacacccagaaagca

SEQ ID NO: 898004 - DNA, 25 bp, Mus musculus
catttctggggacacccagaaagca

SEQ ID NO: 898005 - DNA, 25 bp, Mus musculus
catttgaaaatgatgccagaatttc

SEQ ID NO: 898006 - DNA, 25 bp, Mus musculus
catttgaaaatgttgccagaatttc

SEQ ID NO: 898007 - DNA, 25 bp, Mus musculus
catttgagacagatccgacgagata

SEQ ID NO: 898008 - DNA, 25 bp, Mus musculus
catttgagacagttccgacgagata

SEQ ID NO: 898009 - DNA, 25 bp, Mus musculus
catttgatacgccttactgcaaagt

SEQ ID NO: 898010 - DNA, 25 bp, Mus musculus
catttgatacgcgttactgcaaagt

SEQ ID NO: 898011 - DNA, 25 bp, Mus musculus
catttgctcaagcacgtgggctctc

SEQ ID NO: 898012 - DNA, 25 bp, Mus musculus
catttgctcaaggacgtgggctctc

SEQ ID NO: 898013 - DNA, 25 bp, Mus musculus
catttggacttgcggatcctgtact

SEQ ID NO: 898014 - DNA, 25 bp, Mus musculus
catttggacttggggatcctgtact

SEQ ID NO: 898015 - DNA, 25 bp, Mus musculus
catttggagccaaggaaaatcatat

SEQ ID NO: 898016 - DNA, 25 bp, Mus musculus
catttggagcgaaggaaaatcatat

SEQ ID NO: 898017 - DNA, 25 bp, Mus musculus
catttggatgccaccacccctgtgt

SEQ ID NO: 898018 - DNA, 25 bp, Mus musculus
catttggatggcaccacccctgtgt

SEQ ID NO: 898019 - DNA, 25 bp, Mus musculus
catttgggaacacgatgggggctgc

SEQ ID NO: 898020 - DNA, 25 bp, Mus musculus
catttgggaacaggatgggggctgc

SEQ ID NO: 898021 - DNA, 25 bp, Mus musculus
catttggttccaagatatagctgac

SEQ ID NO: 898022 - DNA, 25 bp, Mus musculus
catttggttccatgatatagctgac

SEQ ID NO: 898023 - DNA, 25 bp, Mus musculus
catttgtatgtaaaggctgttatgt

SEQ ID NO: 898024 - DNA, 25 bp, Mus musculus
catttgtatgtataggctgttatgt

SEQ ID NO: 898025 - DNA, 25 bp, Mus musculus
catttgtgtgctgaggctcccacct

SEQ ID NO: 898026 - DNA, 25 bp, Mus musculus
catttgtgtggtgaggctcccacct

SEQ ID NO: 898027 - DNA, 25 bp, Mus musculus
catttgttaacacgtcaaaatgcag

SEQ ID NO: 898028 - DNA, 25 bp, Mus musculus
catttgttaacaggtcaaaatgcag

SEQ ID NO: 898029 - DNA, 25 bp, Mus musculus
catttgttcgcttcagttcccatga

SEQ ID NO: 898030 - DNA, 25 bp, Mus musculus
catttgttcggttcagttcccatga

SEQ ID NO: 898031 - DNA, 25 bp, Mus musculus
catttgttggagcctttctgtctca

SEQ ID NO: 898032 - DNA, 25 bp, Mus musculus
catttgttggaggctttctgtctca

SEQ ID NO: 898033 - DNA, 25 bp, Mus musculus
cattttaaagcacgcattagctatg

SEQ ID NO: 898034 - DNA, 25 bp, Mus musculus
cattttaaagcaggcattagctatg

SEQ ID NO: 898035 - DNA, 25 bp, Mus musculus
cattttaagccacagttgtaagctt

SEQ ID NO: 898036 - DNA, 25 bp, Mus musculus
cattttaagccagagttgtaagctt

SEQ ID NO: 898037 - DNA, 25 bp, Mus musculus
cattttacagaactgtatgaggctg

SEQ ID NO: 898038 - DNA, 25 bp, Mus musculus
cattttacagaatctgcaccatcct

SEQ ID NO: 898039 - DNA, 25 bp, Mus musculus
cattttacagtactgtatgaggctg

SEQ ID NO: 898040 - DNA, 25 bp, Mus musculus
cattttacagtatctgcaccatcct

SEQ ID NO: 898041 - DNA, 25 bp, Mus musculus
cattttactccacatggcagacttt

SEQ ID NO: 898042 - DNA, 25 bp, Mus musculus
cattttactccacccctggctgtcc

SEQ ID NO: 898043 - DNA, 25 bp, Mus musculus
cattttactccagatggcagacttt

SEQ ID NO: 898044 - DNA, 25 bp, Mus musculus
cattttactccagccctggctgtcc

SEQ ID NO: 898045 - DNA, 25 bp, Mus musculus
cattttagatctccctcactagtag

SEQ ID NO: 898046 - DNA, 25 bp, Mus musculus
cattttagatctgcctcactagtag

SEQ ID NO: 898047 - DNA, 25 bp, Mus musculus
cattttagcaaataattttgaaaat

SEQ ID NO: 898048 - DNA, 25 bp, Mus musculus
cattttagcacgttttctgattaac

SEQ ID NO: 898049 - DNA, 25 bp, Mus musculus
cattttagcaggttttctgattaac

SEQ ID NO: 898050 - DNA, 25 bp, Mus musculus
cattttagcatataattttgaaaat

SEQ ID NO: 898051 - DNA, 25 bp, Mus musculus
cattttattcatatttctggatatg

SEQ ID NO: 898052 - DNA, 25 bp, Mus musculus
cattttattcatccaacaactattt

SEQ ID NO: 898053 - DNA, 25 bp, Mus musculus
cattttattcatccttaggtggaga

SEQ ID NO: 898054 - DNA, 25 bp, Mus musculus
cattttattcatgcaacaactattt

SEQ ID NO: 898055 - DNA, 25 bp, Mus musculus
cattttattcatgcttaggtggaga

SEQ ID NO: 898056 - DNA, 25 bp, Mus musculus
cattttattcatttttctggatatg

SEQ ID NO: 898057 - DNA, 25 bp, Mus musculus
cattttcacctctaagaagtaaatg

SEQ ID NO: 898058 - DNA, 25 bp, Mus musculus
cattttcacctctatgaagtaaatg

SEQ ID NO: 898059 - DNA, 25 bp, Mus musculus
cattttcacgtgcagcctgacagca

SEQ ID NO: 898060 - DNA, 25 bp, Mus musculus
cattttcacgtgcgcgggccaggct

SEQ ID NO: 898061 - DNA, 25 bp, Mus musculus
cattttcacgtggagcctgacagca

SEQ ID NO: 898062 - DNA, 25 bp, Mus musculus
cattttcacgtgggcgggccaggct

SEQ ID NO: 898063 - DNA, 25 bp, Mus musculus
cattttcagaaacgttcgattttca

SEQ ID NO: 898064 - DNA, 25 bp, Mus musculus
cattttcagaaaggttcgattttca

SEQ ID NO: 898065 - DNA, 25 bp, Mus musculus
cattttcagtcacatatactttatt

SEQ ID NO: 898066 - DNA, 25 bp, Mus musculus
cattttcagtcagatatactttatt

SEQ ID NO: 898067 - DNA, 25 bp, Mus musculus
cattttcatgatcacaaaatttgtt

SEQ ID NO: 898068 - DNA, 25 bp, Mus musculus
cattttcatgttcacaaaatttgtt

SEQ ID NO: 898069 - DNA, 25 bp, Mus musculus
cattttcggctgcacgtcgactgtg

SEQ ID NO: 898070 - DNA, 25 bp, Mus musculus
cattttcggctggacgtcgactgtg

SEQ ID NO: 898071 - DNA, 25 bp, Mus musculus
cattttctctatgagtattggagaa

SEQ ID NO: 898072 - DNA, 25 bp, Mus musculus
cattttctctttgagtattggagaa

SEQ ID NO: 898073 - DNA, 25 bp, Mus musculus
cattttgaaaagatccaatctgagt

SEQ ID NO: 898074 - DNA, 25 bp, Mus musculus
cattttgaaaagttccaatctgagt

SEQ ID NO: 898075 - DNA, 25 bp, Mus musculus
cattttgaaacacgagaagccctgc

SEQ ID NO: 898076 - DNA, 25 bp, Mus musculus
cattttgaaagacgagaagccctgc

SEQ ID NO: 898077 - DNA, 25 bp, Mus musculus
cattttgacaagaagcagacaggca

SEQ ID NO: 898078 - DNA, 25 bp, Mus musculus
cattttgacaagcaccatggcgggg

SEQ ID NO: 898079 - DNA, 25 bp, Mus musculus
cattttgacaaggaccatggcgggg

SEQ ID NO: 898080 - DNA, 25 bp, Mus musculus
cattttgacaagtagcagacaggca

SEQ ID NO: 898081 - DNA, 25 bp, Mus musculus
cattttgactttcccagcgcagact

SEQ ID NO: 898082 - DNA, 25 bp, Mus musculus
cattttgactttgccagcgcagact

SEQ ID NO: 898083 - DNA, 25 bp, Mus musculus
cattttgaggctatcagtgacgagg

SEQ ID NO: 898084 - DNA, 25 bp, Mus musculus
cattttgaggctttcagtgacgagg

SEQ ID NO: 898085 - DNA, 25 bp, Mus musculus
cattttgatgcagaagtgctttgtc

SEQ ID NO: 898086 - DNA, 25 bp, Mus musculus
cattttgatgcagatgtgctttgtc

SEQ ID NO: 898087 - DNA, 25 bp, Mus musculus
cattttgccgcaacccagataatga

SEQ ID NO: 898088 - DNA, 25 bp, Mus musculus
cattttgccggaacccagataatga

SEQ ID NO: 898089 - DNA, 25 bp, Mus musculus
cattttgggttacccagagcttttg

SEQ ID NO: 898090 - DNA, 25 bp, Mus musculus
cattttgggttaccgagagcttttg

SEQ ID NO: 898091 - DNA, 25 bp, Mus musculus
cattttgtgcagcatctgctgatga

SEQ ID NO: 898092 - DNA, 25 bp, Mus musculus
cattttgtgcagcttacctgtggtt

SEQ ID NO: 898093 - DNA, 25 bp, Mus musculus
cattttgtgcaggatctgctgatga

SEQ ID NO: 898094 - DNA, 25 bp, Mus musculus
cattttgtgcaggttacctgtggtt

SEQ ID NO: 898095 - DNA, 25 bp, Mus musculus
catttttaacagattagttcataaa

SEQ ID NO: 898096 - DNA, 25 bp, Mus musculus
catttttaacagtttagttcataaa

SEQ ID NO: 898097 - DNA, 25 bp, Mus musculus
catttttaagccttgggctgtggag

SEQ ID NO: 898098 - DNA, 25 bp, Mus musculus
catttttaaggcttgggctgtggag

SEQ ID NO: 898099 - DNA, 25 bp, Mus musculus
catttttaatcactctgttatctcc

SEQ ID NO: 898100 - DNA, 25 bp, Mus musculus
catttttaatcagtctgttatctcc

SEQ ID NO: 898101 - DNA, 25 bp, Mus musculus
catttttcaaaaatgtatatttaca

SEQ ID NO: 898102 - DNA, 25 bp, Mus musculus
catttttcaaggaagagaagtggtg

SEQ ID NO: 898103 - DNA, 25 bp, Mus musculus
catttttcaaggtagagaagtggtg

SEQ ID NO: 898104 - DNA, 25 bp, Mus musculus
catttttcaataatgtatatttaca

SEQ ID NO: 898105 - DNA, 25 bp, Mus musculus
catttttcgacatccgcagacatcc

SEQ ID NO: 898106 - DNA, 25 bp, Mus musculus
catttttcgagatccgcagacatcc

SEQ ID NO: 898107 - DNA, 25 bp, Mus musculus
catttttgctgacgtaaatagcgat

SEQ ID NO: 898108 - DNA, 25 bp, Mus musculus
catttttgctgaggtaaatagcgat

SEQ ID NO: 898109 - DNA, 25 bp, Mus musculus
ccaaaaagcacaacccaagaggcac

SEQ ID NO: 898110 - DNA, 25 bp, Mus musculus
ccaaaaagcacatcccaagaggcac

SEQ ID NO: 898111 - DNA, 25 bp, Mus musculus
ccaaaagattcaaacccaatgttag

SEQ ID NO: 898112 - DNA, 25 bp, Mus musculus
ccaaaagattcaaagccaatgttag

SEQ ID NO: 898113 - DNA, 25 bp, Mus musculus
ccaaaagcagatggcagccaaggag

SEQ ID NO: 898114 - DNA, 25 bp, Mus musculus
ccaaaagcagttggcagccaaggag

SEQ ID NO: 898115 - DNA, 25 bp, Mus musculus
ccaaaagccaaacatgtgtgccaaa

SEQ ID NO: 898116 - DNA, 25 bp, Mus musculus
ccaaaagccaaagatgtgtgccaaa

SEQ ID NO: 898117 - DNA, 25 bp, Mus musculus
ccaaaagctttgcacattgaggcct

SEQ ID NO: 898118 - DNA, 25 bp, Mus musculus
ccaaaagctttgcagattgaggcct

SEQ ID NO: 898119 - DNA, 25 bp, Mus musculus
ccaaaaggaagaaacgtggcaccag

SEQ ID NO: 898120 - DNA, 25 bp, Mus musculus
ccaaaaggaagaaaggtggcaccag

SEQ ID NO: 898121 - DNA, 25 bp, Mus musculus
ccaaaaggagacaccggcttgccag

SEQ ID NO: 898122 - DNA, 25 bp, Mus musculus
ccaaaaggagacacgggcttgccag

SEQ ID NO: 898123 - DNA, 25 bp, Mus musculus
ccaaaaggagactttctgcactggc

SEQ ID NO: 898124 - DNA, 25 bp, Mus musculus
ccaaaaggagtctttctgcactggc

SEQ ID NO: 898125 - DNA, 25 bp, Mus musculus
ccaaaagtgaccaattttcagagat

SEQ ID NO: 898126 - DNA, 25 bp, Mus musculus
ccaaaagtgacctattttcagagat

SEQ ID NO: 898127 - DNA, 25 bp, Mus musculus
ccaaaatcaacaacacccacgccct

SEQ ID NO: 898128 - DNA, 25 bp, Mus musculus
ccaaaatcaacatcacccacgccct

SEQ ID NO: 898129 - DNA, 25 bp, Mus musculus
ccaaaatcacagaataccacctcct

SEQ ID NO: 898130 - DNA, 25 bp, Mus musculus
ccaaaatcacagagaacaccttccc

SEQ ID NO: 898131 - DNA, 25 bp, Mus musculus
ccaaaatcacagagaagcagaacaa

SEQ ID NO: 898132 - DNA, 25 bp, Mus musculus
ccaaaatcacagtataccacctcct

SEQ ID NO: 898133 - DNA, 25 bp, Mus musculus
ccaaaatcacagtgaacaccttccc

SEQ ID NO: 898134 - DNA, 25 bp, Mus musculus
ccaaaatcacagtgaagcagaacaa

SEQ ID NO: 898135 - DNA, 25 bp, Mus musculus
ccaaaatctcagaactcaagtgatt

SEQ ID NO: 898136 - DNA, 25 bp, Mus musculus
ccaaaatctcagcctggcctgtgag

SEQ ID NO: 898137 - DNA, 25 bp, Mus musculus
ccaaaatctcaggctggcctgtgag

SEQ ID NO: 898138 - DNA, 25 bp, Mus musculus
ccaaaatctcagtactcaagtgatt

SEQ ID NO: 898139 - DNA, 25 bp, Mus musculus
ccaaaatgagagaaatgtgtgaggt

SEQ ID NO: 898140 - DNA, 25 bp, Mus musculus
ccaaaatgagtgaaatgtgtgaggt

SEQ ID NO: 898141 - DNA, 25 bp, Mus musculus
ccaaaatggccaagtcagggatgag

SEQ ID NO: 898142 - DNA, 25 bp, Mus musculus
ccaaaatggccatgtcagggatgag

SEQ ID NO: 898143 - DNA, 25 bp, Mus musculus
ccaaacacagccagccaatgccaac

SEQ ID NO: 898144 - DNA, 25 bp, Mus musculus
ccaaacacagccccagccagccaat

SEQ ID NO: 898145 - DNA, 25 bp, Mus musculus
ccaaacacaggcagccaatgccaac

SEQ ID NO: 898146 - DNA, 25 bp, Mus musculus
ccaaacacaggcccagccagccaat

SEQ ID NO: 898147 - DNA, 25 bp, Mus musculus
ccaaacacggcctctcaggtcctca

SEQ ID NO: 898148 - DNA, 25 bp, Mus musculus
ccaaacacgggctctcaggtcctca

SEQ ID NO: 898149 - DNA, 25 bp, Mus musculus
ccaaacagcaagcgcctgtgagaga

SEQ ID NO: 898150 - DNA, 25 bp, Mus musculus
ccaaacagcaagggcctgtgagaga

SEQ ID NO: 898151 - DNA, 25 bp, Mus musculus
ccaaacatagagaagttgttcgaag

SEQ ID NO: 898152 - DNA, 25 bp, Mus musculus
ccaaacatagtgaagttgttcgaag

SEQ ID NO: 898153 - DNA, 25 bp, Mus musculus
ccaaaccacccacatctcttgctta

SEQ ID NO: 898154 - DNA, 25 bp, Mus musculus
ccaaaccacccagatctcttgctta

SEQ ID NO: 898155 - DNA, 25 bp, Mus musculus
ccaaaccaggaaaaagtttacatga

SEQ ID NO: 898156 - DNA, 25 bp, Mus musculus
ccaaaccaggaaaatgtttacatga

SEQ ID NO: 898157 - DNA, 25 bp, Mus musculus
ccaaacctcacaggccagagcaagc

SEQ ID NO: 898158 - DNA, 25 bp, Mus musculus
ccaaacctcagaggccagagcaagc

SEQ ID NO: 898159 - DNA, 25 bp, Mus musculus
ccaaacgaatcaccttatgaccaga

SEQ ID NO: 898160 - DNA, 25 bp, Mus musculus
ccaaacgaatcagcttatgaccaga

SEQ ID NO: 898161 - DNA, 25 bp, Mus musculus
ccaaacgccccacgtctcttgtgct

SEQ ID NO: 898162 - DNA, 25 bp, Mus musculus
ccaaacgccccaggtctcttgtgct

SEQ ID NO: 898163 - DNA, 25 bp, Mus musculus
ccaaactacattcccaaccgaggtc

SEQ ID NO: 898164 - DNA, 25 bp, Mus musculus
ccaaactacattcttttcatcttcc

SEQ ID NO: 898165 - DNA, 25 bp, Mus musculus
ccaaactacattgccaaccgaggtc

SEQ ID NO: 898166 - DNA, 25 bp, Mus musculus
ccaaactacattgttttcatcttcc

SEQ ID NO: 898167 - DNA, 25 bp, Mus musculus
ccaaactctgctggataccctccgt

SEQ ID NO: 898168 - DNA, 25 bp, Mus musculus
ccaaactctgcttcttctggttctt

SEQ ID NO: 898169 - DNA, 25 bp, Mus musculus
ccaaactctggtggataccctccgt

SEQ ID NO: 898170 - DNA, 25 bp, Mus musculus
ccaaactctggttcttctggttctt

SEQ ID NO: 898171 - DNA, 25 bp, Mus musculus
ccaaactgctcacgaataaagctgg

SEQ ID NO: 898172 - DNA, 25 bp, Mus musculus
ccaaactgctcaggaataaagctgg

SEQ ID NO: 898173 - DNA, 25 bp, Mus musculus
ccaaacttcaaacgcattcctgttg

SEQ ID NO: 898174 - DNA, 25 bp, Mus musculus
ccaaacttcaaaggcattcctgttg

SEQ ID NO: 898175 - DNA, 25 bp, Mus musculus
ccaaactttgagctctcccatgact

SEQ ID NO: 898176 - DNA, 25 bp, Mus musculus
ccaaactttgaggtctcccatgact

SEQ ID NO: 898177 - DNA, 25 bp, Mus musculus
ccaaagacagcacaaaactttcgag

SEQ ID NO: 898178 - DNA, 25 bp, Mus musculus
ccaaagacagcagaaaactttcgag

SEQ ID NO: 898179 - DNA, 25 bp, Mus musculus
ccaaagaccacgaggatgaaggctg

SEQ ID NO: 898180 - DNA, 25 bp, Mus musculus
ccaaagaccacgtggatgaaggctg

SEQ ID NO: 898181 - DNA, 25 bp, Mus musculus
ccaaagactgcacagaacttcagag

SEQ ID NO: 898182 - DNA, 25 bp, Mus musculus
ccaaagactgcagagaacttcagag

SEQ ID NO: 898183 - DNA, 25 bp, Mus musculus
ccaaagagatataccattggccgga

SEQ ID NO: 898184 - DNA, 25 bp, Mus musculus
ccaaagagatattccattggccgga

SEQ ID NO: 898185 - DNA, 25 bp, Mus musculus
ccaaagaggaagccatcgtcatgta

SEQ ID NO: 898186 - DNA, 25 bp, Mus musculus
ccaaagaggaaggcatcgtcatgta

SEQ ID NO: 898187 - DNA, 25 bp, Mus musculus
ccaaagaggacaaacatcttgactc

SEQ ID NO: 898188 - DNA, 25 bp, Mus musculus
ccaaagaggacaaagatcttgactc

SEQ ID NO: 898189 - DNA, 25 bp, Mus musculus
ccaaagatggaagaagccctctggg

SEQ ID NO: 898190 - DNA, 25 bp, Mus musculus
ccaaagatggaagatgccctctggg

SEQ ID NO: 898191 - DNA, 25 bp, Mus musculus
ccaaagcaaagaagttctacctctg

SEQ ID NO: 898192 - DNA, 25 bp, Mus musculus
ccaaagcaaagatgttctacctctg

SEQ ID NO: 898193 - DNA, 25 bp, Mus musculus
ccaaagctatggagagtcagcgagc

SEQ ID NO: 898194 - DNA, 25 bp, Mus musculus
ccaaagctatggtgagtcagcgagc

SEQ ID NO: 898195 - DNA, 25 bp, Mus musculus
ccaaagctgaaacatattcggcaga

SEQ ID NO: 898196 - DNA, 25 bp, Mus musculus
ccaaagctgaaagatattcggcaga

SEQ ID NO: 898197 - DNA, 25 bp, Mus musculus
ccaaaggaaactcctgtcgagagca

SEQ ID NO: 898198 - DNA, 25 bp, Mus musculus
ccaaaggaaactgctgtcgagagca

SEQ ID NO: 898199 - DNA, 25 bp, Mus musculus
ccaaaggaccttcacgaaatggctg

SEQ ID NO: 898200 - DNA, 25 bp, Mus musculus
ccaaaggaccttcaggaaatggctg

SEQ ID NO: 898201 - DNA, 25 bp, Mus musculus
ccaaaggtcaaggcaccaatgagga

SEQ ID NO: 898202 - DNA, 25 bp, Mus musculus
ccaaaggtcaaggctccaatgagga

SEQ ID NO: 898203 - DNA, 25 bp, Mus musculus
ccaaagtcagacaagaagatgaaaa

SEQ ID NO: 898204 - DNA, 25 bp, Mus musculus
ccaaagtcagtcaagaagatgaaaa

SEQ ID NO: 898205 - DNA, 25 bp, Mus musculus
ccaaagtccatgctgaatggaggat

SEQ ID NO: 898206 - DNA, 25 bp, Mus musculus
ccaaagtccatggtgaatggaggat

SEQ ID NO: 898207 - DNA, 25 bp, Mus musculus
ccaaagtcttctgatttgaactgtg

SEQ ID NO: 898208 - DNA, 25 bp, Mus musculus
ccaaagtcttgtgatttgaactgtg

SEQ ID NO: 898209 - DNA, 25 bp, Mus musculus
ccaaagtgcaagcccgcgtgcagga

SEQ ID NO: 898210 - DNA, 25 bp, Mus musculus
ccaaagtgcaaggccgcgtgcagga

SEQ ID NO: 898211 - DNA, 25 bp, Mus musculus
ccaaataaagctgcaatgatgagga

SEQ ID NO: 898212 - DNA, 25 bp, Mus musculus
ccaaataaaggtgcaatgatgagga

SEQ ID NO: 898213 - DNA, 25 bp, Mus musculus
ccaaataacacacacacgctttcct

SEQ ID NO: 898214 - DNA, 25 bp, Mus musculus
ccaaataacacagacacgctttcct

SEQ ID NO: 898215 - DNA, 25 bp, Mus musculus
ccaaatagtacacgcagtgggaact

SEQ ID NO: 898216 - DNA, 25 bp, Mus musculus
ccaaatagtacaggcagtgggaact

SEQ ID NO: 898217 - DNA, 25 bp, Mus musculus
ccaaatatacaacgctcaaactcag

SEQ ID NO: 898218 - DNA, 25 bp, Mus musculus
ccaaatatacaaggctcaaactcag

SEQ ID NO: 898219 - DNA, 25 bp, Mus musculus
ccaaatatagcaggcactgaggaag

SEQ ID NO: 898220 - DNA, 25 bp, Mus musculus
ccaaatataggaggcactgaggaag

SEQ ID NO: 898221 - DNA, 25 bp, Mus musculus
ccaaatccagcttctagcaccgatg

SEQ ID NO: 898222 - DNA, 25 bp, Mus musculus
ccaaatccaggttctagcaccgatg

SEQ ID NO: 898223 - DNA, 25 bp, Mus musculus
ccaaatcgagagccaacctcacttg

SEQ ID NO: 898224 - DNA, 25 bp, Mus musculus
ccaaatcgagtgccaacctcacttg

SEQ ID NO: 898225 - DNA, 25 bp, Mus musculus
ccaaatctatacctacatcggctcc

SEQ ID NO: 898226 - DNA, 25 bp, Mus musculus
ccaaatctattcctacatcggctcc

SEQ ID NO: 898227 - DNA, 25 bp, Mus musculus
ccaaatctccagcatggaggcctgc

SEQ ID NO: 898228 - DNA, 25 bp, Mus musculus
ccaaatctccaggatggaggcctgc

SEQ ID NO: 898229 - DNA, 25 bp, Mus musculus
ccaaatctgcagatctcataggatg

SEQ ID NO: 898230 - DNA, 25 bp, Mus musculus
ccaaatctgcagatgtgaatcctaa

SEQ ID NO: 898231 - DNA, 25 bp, Mus musculus
ccaaatctgcagttctcataggatg

SEQ ID NO: 898232 - DNA, 25 bp, Mus musculus
ccaaatctgcagttgtgaatcctaa

SEQ ID NO: 898233 - DNA, 25 bp, Mus musculus
ccaaatgctgcggagcccaccacgc

SEQ ID NO: 898234 - DNA, 25 bp, Mus musculus
ccaaatgctggggagcccaccacgc

SEQ ID NO: 898235 - DNA, 25 bp, Mus musculus
ccaaatggagatataatcatgtgtg

SEQ ID NO: 898236 - DNA, 25 bp, Mus musculus
ccaaatggagatttaatcatgtgtg

SEQ ID NO: 898237 - DNA, 25 bp, Mus musculus
ccaaatggccatcataacagctatc

SEQ ID NO: 898238 - DNA, 25 bp, Mus musculus
ccaaatggccatgataacagctatc

SEQ ID NO: 898239 - DNA, 25 bp, Mus musculus
ccaaatgttgggcctaggattgtgt

SEQ ID NO: 898240 - DNA, 25 bp, Mus musculus
ccaaatgttgggcgaagatctgcaa

SEQ ID NO: 898241 - DNA, 25 bp, Mus musculus
ccaaatgttgggcgattgtgtttaa

SEQ ID NO: 898242 - DNA, 25 bp, Mus musculus
ccaaatgttgggcgtgtgcatgtag

SEQ ID NO: 898243 - DNA, 25 bp, Mus musculus
ccaaatgttggggctaggattgtgt

SEQ ID NO: 898244 - DNA, 25 bp, Mus musculus
ccaaatgttgggggaagatctgcaa

SEQ ID NO: 898245 - DNA, 25 bp, Mus musculus
ccaaatgttgggggattgtgtttaa

SEQ ID NO: 898246 - DNA, 25 bp, Mus musculus
ccaaatgttgggggtgtgcatgtag

SEQ ID NO: 898247 - DNA, 25 bp, Mus musculus
ccaaattagacagacagaatcggat

SEQ ID NO: 898248 - DNA, 25 bp, Mus musculus
ccaaattagacagagagaatcggat

SEQ ID NO: 898249 - DNA, 25 bp, Mus musculus
ccaaattagacatgctcgtaaagcg

SEQ ID NO: 898250 - DNA, 25 bp, Mus musculus
ccaaattagagatgctcgtaaagcg

SEQ ID NO: 898251 - DNA, 25 bp, Mus musculus
ccaaattcagcgagtggcaccactt

SEQ ID NO: 898252 - DNA, 25 bp, Mus musculus
ccaaattcagggagtggcaccactt

SEQ ID NO: 898253 - DNA, 25 bp, Mus musculus
ccaaattgacagctagctacatcaa

SEQ ID NO: 898254 - DNA, 25 bp, Mus musculus
ccaaattgacaggtagctacatcaa

SEQ ID NO: 898255 - DNA, 25 bp, Mus musculus
ccaacaaacgaacaagactctgaca

SEQ ID NO: 898256 - DNA, 25 bp, Mus musculus
ccaacaaacgaacaagcaggttcag

SEQ ID NO: 898257 - DNA, 25 bp, Mus musculus
ccaacaaacgaacatgactctgaca

SEQ ID NO: 898258 - DNA, 25 bp, Mus musculus
ccaacaaacgaacatgcaggttcag

SEQ ID NO: 898259 - DNA, 25 bp, Mus musculus
ccaacaaatgtgctccgtgcttctg

SEQ ID NO: 898260 - DNA, 25 bp, Mus musculus
ccaacaaatgtggtccgtgcttctg

SEQ ID NO: 898261 - DNA, 25 bp, Mus musculus
ccaacaacatcaaagaaaaattcaa

SEQ ID NO: 898262 - DNA, 25 bp, Mus musculus
ccaacaacatcatagaaaaattcaa

SEQ ID NO: 898263 - DNA, 25 bp, Mus musculus
ccaacaacttgacacgcttagaatc

SEQ ID NO: 898264 - DNA, 25 bp, Mus musculus
ccaacaacttgacaggcttagaatc

SEQ ID NO: 898265 - DNA, 25 bp, Mus musculus
ccaacaagtgcaaacgttatggttt

SEQ ID NO: 898266 - DNA, 25 bp, Mus musculus
ccaacaagtgcaaaggttatggttt

SEQ ID NO: 898267 - DNA, 25 bp, Mus musculus
ccaacacagccgagttgaccactgg

SEQ ID NO: 898268 - DNA, 25 bp, Mus musculus
ccaacacagccgtgttgaccactgg

SEQ ID NO: 898269 - DNA, 25 bp, Mus musculus
ccaacacccaggctacatatggaag

SEQ ID NO: 898270 - DNA, 25 bp, Mus musculus
ccaacacccagggtacatatggaag

SEQ ID NO: 898271 - DNA, 25 bp, Mus musculus
ccaacacctgcaaacacaatgggcc

SEQ ID NO: 898272 - DNA, 25 bp, Mus musculus
ccaacacctgcaaagacaatgggcc

SEQ ID NO: 898273 - DNA, 25 bp, Mus musculus
ccaacactagcgacaataaatatat

SEQ ID NO: 898274 - DNA, 25 bp, Mus musculus
ccaacactagggacaataaatatat

SEQ ID NO: 898275 - DNA, 25 bp, Mus musculus
ccaacactggctgctgggacctgag

SEQ ID NO: 898276 - DNA, 25 bp, Mus musculus
ccaacactgggtgctgggacctgag

SEQ ID NO: 898277 - DNA, 25 bp, Mus musculus
ccaacactttgacgattttggcttt

SEQ ID NO: 898278 - DNA, 25 bp, Mus musculus
ccaacactttgaggattttggcttt

SEQ ID NO: 898279 - DNA, 25 bp, Mus musculus
ccaacagaagctcacatcatgttca

SEQ ID NO: 898280 - DNA, 25 bp, Mus musculus
ccaacagaagctccatgtctgctgg

SEQ ID NO: 898281 - DNA, 25 bp, Mus musculus
ccaacagaagctgacatcatgttca

SEQ ID NO: 898282 - DNA, 25 bp, Mus musculus
ccaacagaagctgcatgtctgctgg

SEQ ID NO: 898283 - DNA, 25 bp, Mus musculus
ccaacagagcaaactctggcaaaca

SEQ ID NO: 898284 - DNA, 25 bp, Mus musculus
ccaacagagcaactgacaaatgacc

SEQ ID NO: 898285 - DNA, 25 bp, Mus musculus
ccaacagagcaagtgacaaatgacc

SEQ ID NO: 898286 - DNA, 25 bp, Mus musculus
ccaacagagcaatctctggcaaaca

SEQ ID NO: 898287 - DNA, 25 bp, Mus musculus
ccaacagcaagccacgcactgaaac

SEQ ID NO: 898288 - DNA, 25 bp, Mus musculus
ccaacagcaagccaggcactgaaac

SEQ ID NO: 898289 - DNA, 25 bp, Mus musculus
ccaacagcagagaactggggaaccc

SEQ ID NO: 898290 - DNA, 25 bp, Mus musculus
ccaacagcagagtactggggaaccc

SEQ ID NO: 898291 - DNA, 25 bp, Mus musculus
ccaacagcagctctttcagaggact

SEQ ID NO: 898292 - DNA, 25 bp, Mus musculus
ccaacagcaggtctttcagaggact

SEQ ID NO: 898293 - DNA, 25 bp, Mus musculus
ccaacatcagctcgtacgtgcggct

SEQ ID NO: 898294 - DNA, 25 bp, Mus musculus
ccaacatcagctggtacgtgcggct

SEQ ID NO: 898295 - DNA, 25 bp, Mus musculus
ccaacatcatcaaactaggggatgg

SEQ ID NO: 898296 - DNA, 25 bp, Mus musculus
ccaacatcatgaaactaggggatgg

SEQ ID NO: 898297 - DNA, 25 bp, Mus musculus
ccaacatcatgacagtgatctccat

SEQ ID NO: 898298 - DNA, 25 bp, Mus musculus
ccaacatcatgagagtgatctccat

SEQ ID NO: 898299 - DNA, 25 bp, Mus musculus
ccaacatccttcaacaaaccctgaa

SEQ ID NO: 898300 - DNA, 25 bp, Mus musculus
ccaacatccttcaagaaaccctgaa

SEQ ID NO: 898301 - DNA, 25 bp, Mus musculus
ccaacattgctgcacatttcaatga

SEQ ID NO: 898302 - DNA, 25 bp, Mus musculus
ccaacattgctgcatcctctcccag

SEQ ID NO: 898303 - DNA, 25 bp, Mus musculus
ccaacattgctgctggcatcagaaa

SEQ ID NO: 898304 - DNA, 25 bp, Mus musculus
ccaacattgctggacatttcaatga

SEQ ID NO: 898305 - DNA, 25 bp, Mus musculus
ccaacattgctggatcctctcccag

SEQ ID NO: 898306 - DNA, 25 bp, Mus musculus
ccaacattgctggtggcatcagaaa

SEQ ID NO: 898307 - DNA, 25 bp, Mus musculus
ccaaccagaaagagtccaaagctgc

SEQ ID NO: 898308 - DNA, 25 bp, Mus musculus
ccaaccagaaagtgtccaaagctgc

SEQ ID NO: 898309 - DNA, 25 bp, Mus musculus
ccaaccagacctcccccaggatccg

SEQ ID NO: 898310 - DNA, 25 bp, Mus musculus
ccaaccagacctgccccaggatccg

SEQ ID NO: 898311 - DNA, 25 bp, Mus musculus
ccaaccagagcaaacaacctgctga

SEQ ID NO: 898312 - DNA, 25 bp, Mus musculus
ccaaccagagcaaagaacctgctga

SEQ ID NO: 898313 - DNA, 25 bp, Mus musculus
ccaacccaaaagcccggcccacaga

SEQ ID NO: 898314 - DNA, 25 bp, Mus musculus
ccaacccaaatgcccggcccacaga

SEQ ID NO: 898315 - DNA, 25 bp, Mus musculus
ccaacccaagctcttttgtgactgg

SEQ ID NO: 898316 - DNA, 25 bp, Mus musculus
ccaacccaaggtcttttgtgactgg

SEQ ID NO: 898317 - DNA, 25 bp, Mus musculus
ccaaccccattagtcgtctgggtgg

SEQ ID NO: 898318 - DNA, 25 bp, Mus musculus
ccaaccccattagtggtctgggtgg

SEQ ID NO: 898319 - DNA, 25 bp, Mus musculus
ccaacccctatggcaggccacagat

SEQ ID NO: 898320 - DNA, 25 bp, Mus musculus
ccaacccctatggctggccacagat

SEQ ID NO: 898321 - DNA, 25 bp, Mus musculus
ccaacccctgccccaatgacccatg

SEQ ID NO: 898322 - DNA, 25 bp, Mus musculus
ccaacccctgcccctatgacccatg

SEQ ID NO: 898323 - DNA, 25 bp, Mus musculus
ccaaccctcagacgtttaataagat

SEQ ID NO: 898324 - DNA, 25 bp, Mus musculus
ccaaccctcagaggtttaataagat

SEQ ID NO: 898325 - DNA, 25 bp, Mus musculus
ccaaccgtgagccactttacaagat

SEQ ID NO: 898326 - DNA, 25 bp, Mus musculus
ccaaccgtgagccagtttacaagat

SEQ ID NO: 898327 - DNA, 25 bp, Mus musculus
ccaacctcacatacatacctgggag

SEQ ID NO: 898328 - DNA, 25 bp, Mus musculus
ccaacctcacatacttacctgggag

SEQ ID NO: 898329 - DNA, 25 bp, Mus musculus
ccaacctcagctttctgacctgtga

SEQ ID NO: 898330 - DNA, 25 bp, Mus musculus
ccaacctcaggtttctgacctgtga

SEQ ID NO: 898331 - DNA, 25 bp, Mus musculus
ccaacctcctagcaaagctgtagag

SEQ ID NO: 898332 - DNA, 25 bp, Mus musculus
ccaacctcctaggaaagctgtagag

SEQ ID NO: 898333 - DNA, 25 bp, Mus musculus
ccaaccttgaaccacaatgtctgta

SEQ ID NO: 898334 - DNA, 25 bp, Mus musculus
ccaaccttgaaccagaatgtctgta

SEQ ID NO: 898335 - DNA, 25 bp, Mus musculus
ccaacgaaagagttcaatgtgggag

SEQ ID NO: 898336 - DNA, 25 bp, Mus musculus
ccaacgaaagtgttcaatgtgggag

SEQ ID NO: 898337 - DNA, 25 bp, Mus musculus
ccaacgagctagatgatcccgatga

SEQ ID NO: 898338 - DNA, 25 bp, Mus musculus
ccaacgagctagttgatcccgatga

SEQ ID NO: 898339 - DNA, 25 bp, Mus musculus
ccaacgagtcggatggcatgtcagg

SEQ ID NO: 898340 - DNA, 25 bp, Mus musculus
ccaacgagtcggcagatggcatgtc

SEQ ID NO: 898341 - DNA, 25 bp, Mus musculus
ccaacgagtcgggagatggcatgtc

SEQ ID NO: 898342 - DNA, 25 bp, Mus musculus
ccaacgagtcggttggcatgtcagg

SEQ ID NO: 898343 - DNA, 25 bp, Mus musculus
ccaacgatgcagcgagccgaaactc

SEQ ID NO: 898344 - DNA, 25 bp, Mus musculus
ccaacgatgcagggagccgaaactc

SEQ ID NO: 898345 - DNA, 25 bp, Mus musculus
ccaacgccaacgcaattgccgtgca

SEQ ID NO: 898346 - DNA, 25 bp, Mus musculus
ccaacgccaacgcatttgccgtgca

SEQ ID NO: 898347 - DNA, 25 bp, Mus musculus
ccaacgtccgagattgttgccagtg

SEQ ID NO: 898348 - DNA, 25 bp, Mus musculus
ccaacgtccgagtttgttgccagtg

SEQ ID NO: 898349 - DNA, 25 bp, Mus musculus
ccaacgtgaactagtacatgtttat

SEQ ID NO: 898350 - DNA, 25 bp, Mus musculus
ccaacgtgaacttgtacatgtttat

SEQ ID NO: 898351 - DNA, 25 bp, Mus musculus
ccaacgtgagagtcattcagaatta

SEQ ID NO: 898352 - DNA, 25 bp, Mus musculus
ccaacgtgagcgagcctgtatatgg

SEQ ID NO: 898353 - DNA, 25 bp, Mus musculus
ccaacgtgagggagcctgtatatgg

SEQ ID NO: 898354 - DNA, 25 bp, Mus musculus
ccaacgtgagtgtcattcagaatta

SEQ ID NO: 898355 - DNA, 25 bp, Mus musculus
ccaacgtggaagcagcctgtgattc

SEQ ID NO: 898356 - DNA, 25 bp, Mus musculus
ccaacgtggaagccctctgctcatc

SEQ ID NO: 898357 - DNA, 25 bp, Mus musculus
ccaacgtggaaggagcctgtgattc

SEQ ID NO: 898358 - DNA, 25 bp, Mus musculus
ccaacgtggaaggcctctgctcatc

SEQ ID NO: 898359 - DNA, 25 bp, Mus musculus
ccaacgtgtcataatatcattgaca

SEQ ID NO: 898360 - DNA, 25 bp, Mus musculus
ccaacgtgtcattatatcattgaca

SEQ ID NO: 898361 - DNA, 25 bp, Mus musculus
ccaacgttcaagctctcactcatgg

SEQ ID NO: 898362 - DNA, 25 bp, Mus musculus
ccaacgttcaaggtctcactcatgg

SEQ ID NO: 898363 - DNA, 25 bp, Mus musculus
ccaactacacgacacctgtgttcct

SEQ ID NO: 898364 - DNA, 25 bp, Mus musculus
ccaactacacgagacctgtgttcct

SEQ ID NO: 898365 - DNA, 25 bp, Mus musculus
ccaactacagaaaagcagtcagctg

SEQ ID NO: 898366 - DNA, 25 bp, Mus musculus
ccaactacagtaaagcagtcagctg

SEQ ID NO: 898367 - DNA, 25 bp, Mus musculus
ccaactatggaattaaccagcgctt

SEQ ID NO: 898368 - DNA, 25 bp, Mus musculus
ccaactatggtattaaccagcgctt

SEQ ID NO: 898369 - DNA, 25 bp, Mus musculus
ccaactcaagagcagcttcctgaag

SEQ ID NO: 898370 - DNA, 25 bp, Mus musculus
ccaactcaagaggagcttcctgaag

SEQ ID NO: 898371 - DNA, 25 bp, Mus musculus
ccaactcctggtcgtcactagctct

SEQ ID NO: 898372 - DNA, 25 bp, Mus musculus
ccaactcctggtggtcactagctct

SEQ ID NO: 898373 - DNA, 25 bp, Mus musculus
ccaactctacaacaggtacctgctg

SEQ ID NO: 898374 - DNA, 25 bp, Mus musculus
ccaactctacaagaggtacctgctg

SEQ ID NO: 898375 - DNA, 25 bp, Mus musculus
ccaactctatagccttcgaggtgga

SEQ ID NO: 898376 - DNA, 25 bp, Mus musculus
ccaactctataggcttcgaggtgga

SEQ ID NO: 898377 - DNA, 25 bp, Mus musculus
ccaactctgaagactctgcaggtgc

SEQ ID NO: 898378 - DNA, 25 bp, Mus musculus
ccaactctgaagtctctgcaggtgc

SEQ ID NO: 898379 - DNA, 25 bp, Mus musculus
ccaactctggcttgttatggagttt

SEQ ID NO: 898380 - DNA, 25 bp, Mus musculus
ccaactctgggttgttatggagttt

SEQ ID NO: 898381 - DNA, 25 bp, Mus musculus
ccaactcttggcattgaccttggcc

SEQ ID NO: 898382 - DNA, 25 bp, Mus musculus
ccaactcttggctttgaccttggcc

SEQ ID NO: 898383 - DNA, 25 bp, Mus musculus
ccaactgatactttatattgctgtg

SEQ ID NO: 898384 - DNA, 25 bp, Mus musculus
ccaactgatagtttatattgctgtg

SEQ ID NO: 898385 - DNA, 25 bp, Mus musculus
ccaactgctgaacacgtgactgcgc

SEQ ID NO: 898386 - DNA, 25 bp, Mus musculus
ccaactgctgaagacgtgactgcgc

SEQ ID NO: 898387 - DNA, 25 bp, Mus musculus
ccaactggctgaaacacaaacccgt

SEQ ID NO: 898388 - DNA, 25 bp, Mus musculus
ccaactggctgaaagacaaacccgt

SEQ ID NO: 898389 - DNA, 25 bp, Mus musculus
ccaactgtaccatccctgagatctg

SEQ ID NO: 898390 - DNA, 25 bp, Mus musculus
ccaactgtaccatcgctgagatctg

SEQ ID NO: 898391 - DNA, 25 bp, Mus musculus
ccaactgtctaaattgatcagggac

SEQ ID NO: 898392 - DNA, 25 bp, Mus musculus
ccaactgtctaatttgatcagggac

SEQ ID NO: 898393 - DNA, 25 bp, Mus musculus
ccaacttgttgcgtcgcagtaacgg

SEQ ID NO: 898394 - DNA, 25 bp, Mus musculus
ccaacttgttgcgtggcagtaacgg

SEQ ID NO: 898395 - DNA, 25 bp, Mus musculus
ccaagaaaaaaaatgacatcctgct

SEQ ID NO: 898396 - DNA, 25 bp, Mus musculus
ccaagaaaaaaattgacatcctgct

SEQ ID NO: 898397 - DNA, 25 bp, Mus musculus
ccaagaaaaagaccattcacatcat

SEQ ID NO: 898398 - DNA, 25 bp, Mus musculus
ccaagaaaaagagcattcacatcat

SEQ ID NO: 898399 - DNA, 25 bp, Mus musculus
ccaagaaacatgcactgataaagca

SEQ ID NO: 898400 - DNA, 25 bp, Mus musculus
ccaagaaacatgcgattactgctgg

SEQ ID NO: 898401 - DNA, 25 bp, Mus musculus
ccaagaaacatggactgataaagca

SEQ ID NO: 898402 - DNA, 25 bp, Mus musculus
ccaagaaacatgggattactgctgg

SEQ ID NO: 898403 - DNA, 25 bp, Mus musculus
ccaagaaactagcactaactgaaga

SEQ ID NO: 898404 - DNA, 25 bp, Mus musculus
ccaagaaactaggactaactgaaga

SEQ ID NO: 898405 - DNA, 25 bp, Mus musculus
ccaagaaaggaatggcttcacttct

SEQ ID NO: 898406 - DNA, 25 bp, Mus musculus
ccaagaaaggtatggcttcacttct

SEQ ID NO: 898407 - DNA, 25 bp, Mus musculus
ccaagaaagtgaaacaccattgcag

SEQ ID NO: 898408 - DNA, 25 bp, Mus musculus
ccaagaaagtgaaagaccattgcag

SEQ ID NO: 898409 - DNA, 25 bp, Mus musculus
ccaagaaatgaagcgctggctgaag

SEQ ID NO: 898410 - DNA, 25 bp, Mus musculus
ccaagaaatgtagcgctggctgaag

SEQ ID NO: 898411 - DNA, 25 bp, Mus musculus
ccaagaacaagaaaccgacgagccg

SEQ ID NO: 898412 - DNA, 25 bp, Mus musculus
ccaagaacaagaaagcgacgagccg

SEQ ID NO: 898413 - DNA, 25 bp, Mus musculus
ccaagaaccgaacccgtcctcctga

SEQ ID NO: 898414 - DNA, 25 bp, Mus musculus
ccaagaaccgaagccgtcctcctga

SEQ ID NO: 898415 - DNA, 25 bp, Mus musculus
ccaagaactggacgccccaggtgtt

SEQ ID NO: 898416 - DNA, 25 bp, Mus musculus
ccaagaactggagccctgctgggaa

SEQ ID NO: 898417 - DNA, 25 bp, Mus musculus
ccaagaactggagcgctgctgggaa

SEQ ID NO: 898418 - DNA, 25 bp, Mus musculus
ccaagaactggaggccccaggtgtt

SEQ ID NO: 898419 - DNA, 25 bp, Mus musculus
ccaagaagaactcagattcctactg

SEQ ID NO: 898420 - DNA, 25 bp, Mus musculus
ccaagaagaactgagattcctactg

SEQ ID NO: 898421 - DNA, 25 bp, Mus musculus
ccaagaagagtgcaatccttgtttg

SEQ ID NO: 898422 - DNA, 25 bp, Mus musculus
ccaagaagagtggaatccttgtttg

SEQ ID NO: 898423 - DNA, 25 bp, Mus musculus
ccaagaagcacatcttctctgtcct

SEQ ID NO: 898424 - DNA, 25 bp, Mus musculus
ccaagaagcagatcttctctgtcct

SEQ ID NO: 898425 - DNA, 25 bp, Mus musculus
ccaagaagggcaaacatgagtggtt

SEQ ID NO: 898426 - DNA, 25 bp, Mus musculus
ccaagaagggcaaagatgagtggtt

SEQ ID NO: 898427 - DNA, 25 bp, Mus musculus
ccaagaagtgccagcctgacaagct

SEQ ID NO: 898428 - DNA, 25 bp, Mus musculus
ccaagaagtggcagcctgacaagct

SEQ ID NO: 898429 - DNA, 25 bp, Mus musculus
ccaagaagttccaacctagatactt

SEQ ID NO: 898430 - DNA, 25 bp, Mus musculus
ccaagaagttccaagaccccagatg

SEQ ID NO: 898431 - DNA, 25 bp, Mus musculus
ccaagaagttcctacctagatactt

SEQ ID NO: 898432 - DNA, 25 bp, Mus musculus
ccaagaagttcctagaccccagatg

SEQ ID NO: 898433 - DNA, 25 bp, Mus musculus
ccaagacaaagacggacgaacagct

SEQ ID NO: 898434 - DNA, 25 bp, Mus musculus
ccaagacaaagagggacgaacagct

SEQ ID NO: 898435 - DNA, 25 bp, Mus musculus
ccaagacaagcaacagacccttgat

SEQ ID NO: 898436 - DNA, 25 bp, Mus musculus
ccaagacaaggaacagacccttgat

SEQ ID NO: 898437 - DNA, 25 bp, Mus musculus
ccaagacacacacgtgttctgggcc

SEQ ID NO: 898438 - DNA, 25 bp, Mus musculus
ccaagacacagacgtgttctgggcc

SEQ ID NO: 898439 - DNA, 25 bp, Mus musculus
ccaagacacccacgccagccacgct

SEQ ID NO: 898440 - DNA, 25 bp, Mus musculus
ccaagacacccaggccagccacgct

SEQ ID NO: 898441 - DNA, 25 bp, Mus musculus
ccaagacatggaagcgctgggactg

SEQ ID NO: 898442 - DNA, 25 bp, Mus musculus
ccaagacatggaagggctgggactg

SEQ ID NO: 898443 - DNA, 25 bp, Mus musculus
ccaagaccagagaggtctggtatga

SEQ ID NO: 898444 - DNA, 25 bp, Mus musculus
ccaagaccagctcacggatgattga

SEQ ID NO: 898445 - DNA, 25 bp, Mus musculus
ccaagaccaggtcacggatgattga

SEQ ID NO: 898446 - DNA, 25 bp, Mus musculus
ccaagaccagtgaggtctggtatga

SEQ ID NO: 898447 - DNA, 25 bp, Mus musculus
ccaagaccatcagtcttcccgatgt

SEQ ID NO: 898448 - DNA, 25 bp, Mus musculus
ccaagaccatcagtgttcccgatgt

SEQ ID NO: 898449 - DNA, 25 bp, Mus musculus
ccaagacctggcatctgccccagca

SEQ ID NO: 898450 - DNA, 25 bp, Mus musculus
ccaagacctggcatgtgccccagca

SEQ ID NO: 898451 - DNA, 25 bp, Mus musculus
ccaagactgaatcgctggatggcaa

SEQ ID NO: 898452 - DNA, 25 bp, Mus musculus
ccaagactgaatggctggatggcaa

SEQ ID NO: 898453 - DNA, 25 bp, Mus musculus
ccaagacttcagagcataccaagaa

SEQ ID NO: 898454 - DNA, 25 bp, Mus musculus
ccaagacttcagaggataccaagaa

SEQ ID NO: 898455 - DNA, 25 bp, Mus musculus
ccaagactttgaagcccgctacgtc

SEQ ID NO: 898456 - DNA, 25 bp, Mus musculus
ccaagactttgatgcccgctacgtc

SEQ ID NO: 898457 - DNA, 25 bp, Mus musculus
ccaagagaaaacaacatgatgaagg

SEQ ID NO: 898458 - DNA, 25 bp, Mus musculus
ccaagagaaaacaagatgatgaagg

SEQ ID NO: 898459 - DNA, 25 bp, Mus musculus
ccaagagaaaacagtccctaatgct

SEQ ID NO: 898460 - DNA, 25 bp, Mus musculus
ccaagagaaaactgtccctaatgct

SEQ ID NO: 898461 - DNA, 25 bp, Mus musculus
ccaagagaaccgccatggagagtag

SEQ ID NO: 898462 - DNA, 25 bp, Mus musculus
ccaagagaaccggcatggagagtag

SEQ ID NO: 898463 - DNA, 25 bp, Mus musculus
ccaagagattggcacgggtgccttc

SEQ ID NO: 898464 - DNA, 25 bp, Mus musculus
ccaagagattggcaggggtgccttc

SEQ ID NO: 898465 - DNA, 25 bp, Mus musculus
ccaagagctcaactgccccacccct

SEQ ID NO: 898466 - DNA, 25 bp, Mus musculus
ccaagagctcaagtgccccacccct

SEQ ID NO: 898467 - DNA, 25 bp, Mus musculus
ccaagagctcagctttgggattccc

SEQ ID NO: 898468 - DNA, 25 bp, Mus musculus
ccaagagctcaggtttgggattccc

SEQ ID NO: 898469 - DNA, 25 bp, Mus musculus
ccaagaggaaagacaaagtcagcat

SEQ ID NO: 898470 - DNA, 25 bp, Mus musculus
ccaagaggaaagacagctacaacca

SEQ ID NO: 898471 - DNA, 25 bp, Mus musculus
ccaagaggaaagctaccagcagtgc

SEQ ID NO: 898472 - DNA, 25 bp, Mus musculus
ccaagaggaaaggtaccagcagtgc

SEQ ID NO: 898473 - DNA, 25 bp, Mus musculus
ccaagaggaaagtcaaagtcagcat

SEQ ID NO: 898474 - DNA, 25 bp, Mus musculus
ccaagaggaaagtcagctacaacca

SEQ ID NO: 898475 - DNA, 25 bp, Mus musculus
ccaagaggactcttcgaactattct

SEQ ID NO: 898476 - DNA, 25 bp, Mus musculus
ccaagaggactcttggaactattct

SEQ ID NO: 898477 - DNA, 25 bp, Mus musculus
ccaagaggagggcgcatgaatccta

SEQ ID NO: 898478 - DNA, 25 bp, Mus musculus
ccaagaggagggcttatcatgcttt

SEQ ID NO: 898479 - DNA, 25 bp, Mus musculus
ccaagaggagggggcatgaatccta

SEQ ID NO: 898480 - DNA, 25 bp, Mus musculus
ccaagaggaggggttatcatgcttt

SEQ ID NO: 898481 - DNA, 25 bp, Mus musculus
ccaagagtgcaacgacttgaatgct

SEQ ID NO: 898482 - DNA, 25 bp, Mus musculus
ccaagagtgcaaggacttgaatgct

SEQ ID NO: 898483 - DNA, 25 bp, Mus musculus
ccaagatattaacgagaactgcctc

SEQ ID NO: 898484 - DNA, 25 bp, Mus musculus
ccaagatattaaggagaactgcctc

SEQ ID NO: 898485 - DNA, 25 bp, Mus musculus
ccaagatcaagaaacaggaagactc

SEQ ID NO: 898486 - DNA, 25 bp, Mus musculus
ccaagatcaagaaagaggaagactc

SEQ ID NO: 898487 - DNA, 25 bp, Mus musculus
ccaagatcaatcaacatgactgtga

SEQ ID NO: 898488 - DNA, 25 bp, Mus musculus
ccaagatcaatcaagatgactgtga

SEQ ID NO: 898489 - DNA, 25 bp, Mus musculus
ccaagatcagcaagcagcttcagga

SEQ ID NO: 898490 - DNA, 25 bp, Mus musculus
ccaagatcagcaagctgattaccag

SEQ ID NO: 898491 - DNA, 25 bp, Mus musculus
ccaagatcagcaaggagcttcagga

SEQ ID NO: 898492 - DNA, 25 bp, Mus musculus
ccaagatcagcaaggtgattaccag

SEQ ID NO: 898493 - DNA, 25 bp, Mus musculus
ccaagatctgaaagttgggatggct

SEQ ID NO: 898494 - DNA, 25 bp, Mus musculus
ccaagatctgaatgttgggatggct

SEQ ID NO: 898495 - DNA, 25 bp, Mus musculus
ccaagatgcccaaatcaacgtccgg

SEQ ID NO: 898496 - DNA, 25 bp, Mus musculus
ccaagatgcccatatcaacgtccgg

SEQ ID NO: 898497 - DNA, 25 bp, Mus musculus
ccaagatggagcacctggcacagct

SEQ ID NO: 898498 - DNA, 25 bp, Mus musculus
ccaagatggagctcctggcacagct

SEQ ID NO: 898499 - DNA, 25 bp, Mus musculus
ccaagatgtaccatgaaaccatgtg

SEQ ID NO: 898500 - DNA, 25 bp, Mus musculus
ccaagatgtaccttgaaaccatgtg

SEQ ID NO: 898501 - DNA, 25 bp, Mus musculus
ccaagattgaagcgctggacatcca

SEQ ID NO: 898502 - DNA, 25 bp, Mus musculus
ccaagattgaagggctggacatcca

SEQ ID NO: 898503 - DNA, 25 bp, Mus musculus
ccaagcaatgaggtacacggatgaa

SEQ ID NO: 898504 - DNA, 25 bp, Mus musculus
ccaagcaatgtggtacacggatgaa

SEQ ID NO: 898505 - DNA, 25 bp, Mus musculus
ccaagcacacagatcctagtcactc

SEQ ID NO: 898506 - DNA, 25 bp, Mus musculus
ccaagcacacagttcctagtcactc

SEQ ID NO: 898507 - DNA, 25 bp, Mus musculus
ccaagcacagcaatgaaaggcctta

SEQ ID NO: 898508 - DNA, 25 bp, Mus musculus
ccaagcacagcacaatcgccagccg

SEQ ID NO: 898509 - DNA, 25 bp, Mus musculus
ccaagcacagcagaatcgccagccg

SEQ ID NO: 898510 - DNA, 25 bp, Mus musculus
ccaagcacaggaatgaaaggcctta

SEQ ID NO: 898511 - DNA, 25 bp, Mus musculus
ccaagcacatcccacgcttccccag

SEQ ID NO: 898512 - DNA, 25 bp, Mus musculus
ccaagcacatcccaggcttccccag

SEQ ID NO: 898513 - DNA, 25 bp, Mus musculus
ccaagcagagcgccctggatcttat

SEQ ID NO: 898514 - DNA, 25 bp, Mus musculus
ccaagcagagggccctggatcttat

SEQ ID NO: 898515 - DNA, 25 bp, Mus musculus
ccaagcataaagcaaatggtaactc

SEQ ID NO: 898516 - DNA, 25 bp, Mus musculus
ccaagcataaaggaaatggtaactc

SEQ ID NO: 898517 - DNA, 25 bp, Mus musculus
ccaagcatacagagcctatcagaat

SEQ ID NO: 898518 - DNA, 25 bp, Mus musculus
ccaagcatacagtgcctatcagaat

SEQ ID NO: 898519 - DNA, 25 bp, Mus musculus
ccaagccaagcactgtttgaaagga

SEQ ID NO: 898520 - DNA, 25 bp, Mus musculus
ccaagccaagcagtgtttgaaagga

SEQ ID NO: 898521 - DNA, 25 bp, Mus musculus
ccaagccaagcccaagtaaaacaga

SEQ ID NO: 898522 - DNA, 25 bp, Mus musculus
ccaagccaagcccatgtaaaacaga

SEQ ID NO: 898523 - DNA, 25 bp, Mus musculus
ccaagccaagctggtcctgaagagc

SEQ ID NO: 898524 - DNA, 25 bp, Mus musculus
ccaagccaaggtggtcctgaagagc

SEQ ID NO: 898525 - DNA, 25 bp, Mus musculus
ccaagccacgaagtattcagtactg

SEQ ID NO: 898526 - DNA, 25 bp, Mus musculus
ccaagccacggacgtggaaatgagc

SEQ ID NO: 898527 - DNA, 25 bp, Mus musculus
ccaagccacggaggtggaaatgagc

SEQ ID NO: 898528 - DNA, 25 bp, Mus musculus
ccaagccacgtagtattcagtactg

SEQ ID NO: 898529 - DNA, 25 bp, Mus musculus
ccaagccagatccacagcaaagagc

SEQ ID NO: 898530 - DNA, 25 bp, Mus musculus
ccaagccagatccccctacatgaag

SEQ ID NO: 898531 - DNA, 25 bp, Mus musculus
ccaagccagatcgacagcaaagagc

SEQ ID NO: 898532 - DNA, 25 bp, Mus musculus
ccaagccagatcgccctacatgaag

SEQ ID NO: 898533 - DNA, 25 bp, Mus musculus
ccaagccatgagccaagaaactaca

SEQ ID NO: 898534 - DNA, 25 bp, Mus musculus
ccaagccatgaggcaagaaactaca

SEQ ID NO: 898535 - DNA, 25 bp, Mus musculus
ccaagccattggaacttgccatgta

SEQ ID NO: 898536 - DNA, 25 bp, Mus musculus
ccaagccattggaagttgccatgta

SEQ ID NO: 898537 - DNA, 25 bp, Mus musculus
ccaagcccactgccgctgacctgtt

SEQ ID NO: 898538 - DNA, 25 bp, Mus musculus
ccaagcccactggcgctgacctgtt

SEQ ID NO: 898539 - DNA, 25 bp, Mus musculus
ccaagcccagcacaccgtgcattaa

SEQ ID NO: 898540 - DNA, 25 bp, Mus musculus
ccaagcccaggacaccgtgcattaa

SEQ ID NO: 898541 - DNA, 25 bp, Mus musculus
ccaagcccatctaaaacagactagc

SEQ ID NO: 898542 - DNA, 25 bp, Mus musculus
ccaagcccatgtaaaacagactagc

SEQ ID NO: 898543 - DNA, 25 bp, Mus musculus
ccaagccctctacactttcaggcct

SEQ ID NO: 898544 - DNA, 25 bp, Mus musculus
ccaagccctctacagtttcaggcct

SEQ ID NO: 898545 - DNA, 25 bp, Mus musculus
ccaagccttcctcggctttacatat

SEQ ID NO: 898546 - DNA, 25 bp, Mus musculus
ccaagccttcctgggctttacatat

SEQ ID NO: 898547 - DNA, 25 bp, Mus musculus
ccaagcgcagggcggtggtcgtctt

SEQ ID NO: 898548 - DNA, 25 bp, Mus musculus
ccaagcgcaggggggtggtcgtctt

SEQ ID NO: 898549 - DNA, 25 bp, Mus musculus
ccaagcgctgcaacttccccagccc

SEQ ID NO: 898550 - DNA, 25 bp, Mus musculus
ccaagcgctggaacttccccagccc

SEQ ID NO: 898551 - DNA, 25 bp, Mus musculus
ccaagctagaggacaaccttctggt

SEQ ID NO: 898552 - DNA, 25 bp, Mus musculus
ccaagctagaggtcaaccttctggt

SEQ ID NO: 898553 - DNA, 25 bp, Mus musculus
ccaagctatgcttctttggctccca

SEQ ID NO: 898554 - DNA, 25 bp, Mus musculus
ccaagctatggttctttggctccca

SEQ ID NO: 898555 - DNA, 25 bp, Mus musculus
ccaagctcagagtgcctgctcactg

SEQ ID NO: 898556 - DNA, 25 bp, Mus musculus
ccaagctcagtgtgcctgctcactg

SEQ ID NO: 898557 - DNA, 25 bp, Mus musculus
ccaagctctatgctcgggagccaca

SEQ ID NO: 898558 - DNA, 25 bp, Mus musculus
ccaagctctatggtcgggagccaca

SEQ ID NO: 898559 - DNA, 25 bp, Mus musculus
ccaagctgagtcagctgttgctcaa

SEQ ID NO: 898560 - DNA, 25 bp, Mus musculus
ccaagctgagtctgctgttgctcaa

SEQ ID NO: 898561 - DNA, 25 bp, Mus musculus
ccaagctgtaagctgctcgtcctca

SEQ ID NO: 898562 - DNA, 25 bp, Mus musculus
ccaagctgtaaggtgctcgtcctca

SEQ ID NO: 898563 - DNA, 25 bp, Mus musculus
ccaagctgtacacgttgggcttagg

SEQ ID NO: 898564 - DNA, 25 bp, Mus musculus
ccaagctgtacaggttgggcttagg

SEQ ID NO: 898565 - DNA, 25 bp, Mus musculus
ccaagctgtgcgcatgccgggagac

SEQ ID NO: 898566 - DNA, 25 bp, Mus musculus
ccaagctgtgcggatgccgggagac

SEQ ID NO: 898567 - DNA, 25 bp, Mus musculus
ccaagcttctgacgagctagaagcg

SEQ ID NO: 898568 - DNA, 25 bp, Mus musculus
ccaagcttctgaggagctagaagcg

SEQ ID NO: 898569 - DNA, 25 bp, Mus musculus
ccaaggagagctcaatactatcaat

SEQ ID NO: 898570 - DNA, 25 bp, Mus musculus
ccaaggagaggtcaatactatcaat

SEQ ID NO: 898571 - DNA, 25 bp, Mus musculus
ccaaggagcagcttcgctatattgt

SEQ ID NO: 898572 - DNA, 25 bp, Mus musculus
ccaaggagcagcttggctatattgt

SEQ ID NO: 898573 - DNA, 25 bp, Mus musculus
ccaaggagcccacgccggctcaaca

SEQ ID NO: 898574 - DNA, 25 bp, Mus musculus
ccaaggagcccaggccggctcaaca

SEQ ID NO: 898575 - DNA, 25 bp, Mus musculus
ccaaggaggccgaacatcccttcaa

SEQ ID NO: 898576 - DNA, 25 bp, Mus musculus
ccaaggaggccgtacatcccttcaa

SEQ ID NO: 898577 - DNA, 25 bp, Mus musculus
ccaaggagtatgagcgagccgtcta

SEQ ID NO: 898578 - DNA, 25 bp, Mus musculus
ccaaggagtatgagggagccgtcta

SEQ ID NO: 898579 - DNA, 25 bp, Mus musculus
ccaaggatgagtcggtggaagagca

SEQ ID NO: 898580 - DNA, 25 bp, Mus musculus
ccaaggatgagtgggtggaagagca

SEQ ID NO: 898581 - DNA, 25 bp, Mus musculus
ccaaggatgctgcgaagtccgtggg

SEQ ID NO: 898582 - DNA, 25 bp, Mus musculus
ccaaggatgctgggaagtccgtggg

SEQ ID NO: 898583 - DNA, 25 bp, Mus musculus
ccaaggcacacaagccctcactgga

SEQ ID NO: 898584 - DNA, 25 bp, Mus musculus
ccaaggcacacatgccctcactgga

SEQ ID NO: 898585 - DNA, 25 bp, Mus musculus
ccaaggcatgacatcggggtagcct

SEQ ID NO: 898586 - DNA, 25 bp, Mus musculus
ccaaggcatgagacactgccccagg

SEQ ID NO: 898587 - DNA, 25 bp, Mus musculus
ccaaggcatgccagtcatcggggta

SEQ ID NO: 898588 - DNA, 25 bp, Mus musculus
ccaaggcatggcagtcatcggggta

SEQ ID NO: 898589 - DNA, 25 bp, Mus musculus
ccaaggcatgtcatcggggtagcct

SEQ ID NO: 898590 - DNA, 25 bp, Mus musculus
ccaaggcatgtgacactgccccagg

SEQ ID NO: 898591 - DNA, 25 bp, Mus musculus
ccaaggccagagaaatcttggtaga

SEQ ID NO: 898592 - DNA, 25 bp, Mus musculus
ccaaggccagcatcaaccctgtgac

SEQ ID NO: 898593 - DNA, 25 bp, Mus musculus
ccaaggccaggatcaaccctgtgac

SEQ ID NO: 898594 - DNA, 25 bp, Mus musculus
ccaaggccagtgaaatcttggtaga

SEQ ID NO: 898595 - DNA, 25 bp, Mus musculus
ccaaggcgtgattaaggttgaggaa

SEQ ID NO: 898596 - DNA, 25 bp, Mus musculus
ccaaggcgtgtttaaggttgaggaa

SEQ ID NO: 898597 - DNA, 25 bp, Mus musculus
ccaaggctcaggcccgctccaggtt

SEQ ID NO: 898598 - DNA, 25 bp, Mus musculus
ccaaggctcaggccggctccaggtt

SEQ ID NO: 898599 - DNA, 25 bp, Mus musculus
ccaaggctccggaaccacgataaga

SEQ ID NO: 898600 - DNA, 25 bp, Mus musculus
ccaaggctccggaagcacgataaga

SEQ ID NO: 898601 - DNA, 25 bp, Mus musculus
ccaaggctggagcacgttctgccac

SEQ ID NO: 898602 - DNA, 25 bp, Mus musculus
ccaaggctggagcaggttctgccac

SEQ ID NO: 898603 - DNA, 25 bp, Mus musculus
ccaagggcaaaaagcgctcatcaaa

SEQ ID NO: 898604 - DNA, 25 bp, Mus musculus
ccaagggcaaaaagggctcatcaaa

SEQ ID NO: 898605 - DNA, 25 bp, Mus musculus
ccaagggcaaggcactccgagggag

SEQ ID NO: 898606 - DNA, 25 bp, Mus musculus
ccaagggcaagggactccgagggag

SEQ ID NO: 898607 - DNA, 25 bp, Mus musculus
ccaagggttgtgatcggaggctcct

SEQ ID NO: 898608 - DNA, 25 bp, Mus musculus
ccaagggttgtgatcggcggctcct

SEQ ID NO: 898609 - DNA, 25 bp, Mus musculus
ccaagggttgtgatgggaggctcct

SEQ ID NO: 898610 - DNA, 25 bp, Mus musculus
ccaagggttgtgatgggcggctcct

SEQ ID NO: 898611 - DNA, 25 bp, Mus musculus
ccaaggtgatgaagaaactgtcaca

SEQ ID NO: 898612 - DNA, 25 bp, Mus musculus
ccaaggtgatgatgaaactgtcaca

SEQ ID NO: 898613 - DNA, 25 bp, Mus musculus
ccaagtaatgagaggaagacgactg

SEQ ID NO: 898614 - DNA, 25 bp, Mus musculus
ccaagtaatgcaagtgtggcacctt

SEQ ID NO: 898615 - DNA, 25 bp, Mus musculus
ccaagtaatgcatgtgtggcacctt

SEQ ID NO: 898616 - DNA, 25 bp, Mus musculus
ccaagtaatgtgaggaagacgactg

SEQ ID NO: 898617 - DNA, 25 bp, Mus musculus
ccaagtacacagagtgtgattcagt

SEQ ID NO: 898618 - DNA, 25 bp, Mus musculus
ccaagtacacagtgtgtgattcagt

SEQ ID NO: 898619 - DNA, 25 bp, Mus musculus
ccaagtagttcaccctgggaagctc

SEQ ID NO: 898620 - DNA, 25 bp, Mus musculus
ccaagtagttcagcctgggaagctc

SEQ ID NO: 898621 - DNA, 25 bp, Mus musculus
ccaagtatctcacaaagacccaaat

SEQ ID NO: 898622 - DNA, 25 bp, Mus musculus
ccaagtatctcacattgaagaccaa

SEQ ID NO: 898623 - DNA, 25 bp, Mus musculus
ccaagtatctcagaaagacccaaat

SEQ ID NO: 898624 - DNA, 25 bp, Mus musculus
ccaagtatctcagattgaagaccaa

SEQ ID NO: 898625 - DNA, 25 bp, Mus musculus
ccaagtatgcagagctcgatgaagc

SEQ ID NO: 898626 - DNA, 25 bp, Mus musculus
ccaagtatgcagtgctcgatgaagc

SEQ ID NO: 898627 - DNA, 25 bp, Mus musculus
ccaagtccagcacgaattgtctggg

SEQ ID NO: 898628 - DNA, 25 bp, Mus musculus
ccaagtccagcaggaattgtctggg

SEQ ID NO: 898629 - DNA, 25 bp, Mus musculus
ccaagtccccatctgtgacgctgga

SEQ ID NO: 898630 - DNA, 25 bp, Mus musculus
ccaagtccccatgtgtgacgctgga

SEQ ID NO: 898631 - DNA, 25 bp, Mus musculus
ccaagtcccccacacatatcccagg

SEQ ID NO: 898632 - DNA, 25 bp, Mus musculus
ccaagtcccccagacatatcccagg

SEQ ID NO: 898633 - DNA, 25 bp, Mus musculus
ccaagtctacagctggtgtctacca

SEQ ID NO: 898634 - DNA, 25 bp, Mus musculus
ccaagtctacaggtggtgtctacca

SEQ ID NO: 898635 - DNA, 25 bp, Mus musculus
ccaagtctgtgacgctgggacccac

SEQ ID NO: 898636 - DNA, 25 bp, Mus musculus
ccaagtctgtgaggctgggacccac

SEQ ID NO: 898637 - DNA, 25 bp, Mus musculus
ccaagtgacaagctgcttacagaca

SEQ ID NO: 898638 - DNA, 25 bp, Mus musculus
ccaagtgacaaggtgcttacagaca

SEQ ID NO: 898639 - DNA, 25 bp, Mus musculus
ccaagtgacccacagatcttcccgg

SEQ ID NO: 898640 - DNA, 25 bp, Mus musculus
ccaagtgacccagagatcttcccgg

SEQ ID NO: 898641 - DNA, 25 bp, Mus musculus
ccaagtgccacaaacgaacctactt

SEQ ID NO: 898642 - DNA, 25 bp, Mus musculus
ccaagtgccacaaaggaacctactt

SEQ ID NO: 898643 - DNA, 25 bp, Mus musculus
ccaagtgctgcacgaggctactttt

SEQ ID NO: 898644 - DNA, 25 bp, Mus musculus
ccaagtgctgcaggaggctactttt

SEQ ID NO: 898645 - DNA, 25 bp, Mus musculus
ccaagtgctggacatctttggcttt

SEQ ID NO: 898646 - DNA, 25 bp, Mus musculus
ccaagtgctggagatctttggcttt

SEQ ID NO: 898647 - DNA, 25 bp, Mus musculus
ccaagtgtcagacgactcagacagc

SEQ ID NO: 898648 - DNA, 25 bp, Mus musculus
ccaagtgtcagaggactcagacagc

SEQ ID NO: 898649 - DNA, 25 bp, Mus musculus
ccaagtgtttaacccactggaacca

SEQ ID NO: 898650 - DNA, 25 bp, Mus musculus
ccaagtgtttaagccactggaacca

SEQ ID NO: 898651 - DNA, 25 bp, Mus musculus
ccaagttagcagcactccagggcag

SEQ ID NO: 898652 - DNA, 25 bp, Mus musculus
ccaagttagcaggactccagggcag

SEQ ID NO: 898653 - DNA, 25 bp, Mus musculus
ccaagttcaaatcagacatcctatg

SEQ ID NO: 898654 - DNA, 25 bp, Mus musculus
ccaagttcaaatgagacatcctatg

SEQ ID NO: 898655 - DNA, 25 bp, Mus musculus
ccaagttgcccacactgcgctctct

SEQ ID NO: 898656 - DNA, 25 bp, Mus musculus
ccaagttgcccagactgcgctctct

SEQ ID NO: 898657 - DNA, 25 bp, Mus musculus
ccaagtttacagcgattaatacagc

SEQ ID NO: 898658 - DNA, 25 bp, Mus musculus
ccaagtttacagggattaatacagc

SEQ ID NO: 898659 - DNA, 25 bp, Mus musculus
ccaataaaaattcaccatcctcctg

SEQ ID NO: 898660 - DNA, 25 bp, Mus musculus
ccaataaaaattcagcatcctcctg

SEQ ID NO: 898661 - DNA, 25 bp, Mus musculus
ccaataagagaacctggctgtatag

SEQ ID NO: 898662 - DNA, 25 bp, Mus musculus
ccaataagagaagctggctgtatag

SEQ ID NO: 898663 - DNA, 25 bp, Mus musculus
ccaataagctacaggagcttcaagt

SEQ ID NO: 898664 - DNA, 25 bp, Mus musculus
ccaataagctactggagcttcaagt

SEQ ID NO: 898665 - DNA, 25 bp, Mus musculus
ccaatacaagcacaggggagtatac

SEQ ID NO: 898666 - DNA, 25 bp, Mus musculus
ccaatacaaggacaggggagtatac

SEQ ID NO: 898667 - DNA, 25 bp, Mus musculus
ccaataccgagaccagtattttgaa

SEQ ID NO: 898668 - DNA, 25 bp, Mus musculus
ccaataccgagacctgtattttgaa

SEQ ID NO: 898669 - DNA, 25 bp, Mus musculus
ccaatagcacagaacttcccagcaa

SEQ ID NO: 898670 - DNA, 25 bp, Mus musculus
ccaatagcacagtacttcccagcaa

SEQ ID NO: 898671 - DNA, 25 bp, Mus musculus
ccaatagttcagacatcctacaggc

SEQ ID NO: 898672 - DNA, 25 bp, Mus musculus
ccaatagttcagtcatcctacaggc

SEQ ID NO: 898673 - DNA, 25 bp, Mus musculus
ccaatatctgacctctgctgagcct

SEQ ID NO: 898674 - DNA, 25 bp, Mus musculus
ccaatatctgacctgtgctgagcct

SEQ ID NO: 898675 - DNA, 25 bp, Mus musculus
ccaatcaagcgagacgatgaggagg

SEQ ID NO: 898676 - DNA, 25 bp, Mus musculus
ccaatcaagcgagaggatgaggagg

SEQ ID NO: 898677 - DNA, 25 bp, Mus musculus
ccaatcagaatcacaaccagccaga

SEQ ID NO: 898678 - DNA, 25 bp, Mus musculus
ccaatcagaatcactaccagccaga

SEQ ID NO: 898679 - DNA, 25 bp, Mus musculus
ccaatcagccagaacagcgatggaa

SEQ ID NO: 898680 - DNA, 25 bp, Mus musculus
ccaatcagccagcagaacagcgatg

SEQ ID NO: 898681 - DNA, 25 bp, Mus musculus
ccaatcagccagccttcgaccatgg

SEQ ID NO: 898682 - DNA, 25 bp, Mus musculus
ccaatcagccaggagaacagcgatg

SEQ ID NO: 898683 - DNA, 25 bp, Mus musculus
ccaatcagccaggcttcgaccatgg

SEQ ID NO: 898684 - DNA, 25 bp, Mus musculus
ccaatcagccagtacagcgatggaa

SEQ ID NO: 898685 - DNA, 25 bp, Mus musculus
ccaatcccactgattttaggtgatg

SEQ ID NO: 898686 - DNA, 25 bp, Mus musculus
ccaatcccactgtttttaggtgatg

SEQ ID NO: 898687 - DNA, 25 bp, Mus musculus
ccaatcccagatatgctcctgggag

SEQ ID NO: 898688 - DNA, 25 bp, Mus musculus
ccaatcccagttatgctcctgggag

SEQ ID NO: 898689 - DNA, 25 bp, Mus musculus
ccaatcccctggctgtcgacctact

SEQ ID NO: 898690 - DNA, 25 bp, Mus musculus
ccaatcccctgggtgtcgacctact

SEQ ID NO: 898691 - DNA, 25 bp, Mus musculus
ccaatcctcagacgtttgaccggat

SEQ ID NO: 898692 - DNA, 25 bp, Mus musculus
ccaatcctcagaggtttgaccggat

SEQ ID NO: 898693 - DNA, 25 bp, Mus musculus
ccaatctattagccatcagaccatg

SEQ ID NO: 898694 - DNA, 25 bp, Mus musculus
ccaatctattagcgaaagagatacc

SEQ ID NO: 898695 - DNA, 25 bp, Mus musculus
ccaatctattaggcatcagaccatg

SEQ ID NO: 898696 - DNA, 25 bp, Mus musculus
ccaatctattagggaaagagatacc

SEQ ID NO: 898697 - DNA, 25 bp, Mus musculus
ccaatctgcagcgaccctatagttt

SEQ ID NO: 898698 - DNA, 25 bp, Mus musculus
ccaatctgcagcgactgcccttcgc

SEQ ID NO: 898699 - DNA, 25 bp, Mus musculus
ccaatctgcagcgactttggccaag

SEQ ID NO: 898700 - DNA, 25 bp, Mus musculus
ccaatctgcagcgagcctatagttt

SEQ ID NO: 898701 - DNA, 25 bp, Mus musculus
ccaatctgcagcgagtgcccttcgc

SEQ ID NO: 898702 - DNA, 25 bp, Mus musculus
ccaatctgcagcgagtttggccaag

SEQ ID NO: 898703 - DNA, 25 bp, Mus musculus
ccaatctgccaacagacaaacagaa

SEQ ID NO: 898704 - DNA, 25 bp, Mus musculus
ccaatctgccaactggtccagtgtg

SEQ ID NO: 898705 - DNA, 25 bp, Mus musculus
ccaatctgccaagagacaaacagaa

SEQ ID NO: 898706 - DNA, 25 bp, Mus musculus
ccaatctgccaagtggtccagtgtg

SEQ ID NO: 898707 - DNA, 25 bp, Mus musculus
ccaatctgctaatggcctttgtgct

SEQ ID NO: 898708 - DNA, 25 bp, Mus musculus
ccaatctgcttatggcctttgtgct

SEQ ID NO: 898709 - DNA, 25 bp, Mus musculus
ccaatgaactctacatgatgatgag

SEQ ID NO: 898710 - DNA, 25 bp, Mus musculus
ccaatgaactgtacatgatgatgag

SEQ ID NO: 898711 - DNA, 25 bp, Mus musculus
ccaatgacaaatttgagtatctgtt

SEQ ID NO: 898712 - DNA, 25 bp, Mus musculus
ccaatgacaattttgagtatctgtt

SEQ ID NO: 898713 - DNA, 25 bp, Mus musculus
ccaatgaccacaagtatacgcccac

SEQ ID NO: 898714 - DNA, 25 bp, Mus musculus
ccaatgaccacatgtatacgcccac

SEQ ID NO: 898715 - DNA, 25 bp, Mus musculus
ccaatgaccctgaaaataaaaatga

SEQ ID NO: 898716 - DNA, 25 bp, Mus musculus
ccaatgaccctgaatataaaaatga

SEQ ID NO: 898717 - DNA, 25 bp, Mus musculus
ccaatgagagagcacacaatgtagg

SEQ ID NO: 898718 - DNA, 25 bp, Mus musculus
ccaatgagagaggacacaatgtagg

SEQ ID NO: 898719 - DNA, 25 bp, Mus musculus
ccaatgagctctacatgatgatgcg

SEQ ID NO: 898720 - DNA, 25 bp, Mus musculus
ccaatgagctgtacatgatgatgcg

SEQ ID NO: 898721 - DNA, 25 bp, Mus musculus
ccaatgccactgcatggcggaagaa

SEQ ID NO: 898722 - DNA, 25 bp, Mus musculus
ccaatgccactggatggcggaagaa

SEQ ID NO: 898723 - DNA, 25 bp, Mus musculus
ccaatgcctctgttcatgacagccg

SEQ ID NO: 898724 - DNA, 25 bp, Mus musculus
ccaatgcctctgttgatgacagccg

SEQ ID NO: 898725 - DNA, 25 bp, Mus musculus
ccaatgcgaacgacttcttcgccaa

SEQ ID NO: 898726 - DNA, 25 bp, Mus musculus
ccaatgcgaacgtcttcttcgccaa

SEQ ID NO: 898727 - DNA, 25 bp, Mus musculus
ccaatgctgtcattcgggcggatgt

SEQ ID NO: 898728 - DNA, 25 bp, Mus musculus
ccaatgctgtcattggggcggatgt

SEQ ID NO: 898729 - DNA, 25 bp, Mus musculus
ccaatggagatgcatgacctactgg

SEQ ID NO: 898730 - DNA, 25 bp, Mus musculus
ccaatggagatgcgctagatgacct

SEQ ID NO: 898731 - DNA, 25 bp, Mus musculus
ccaatggagatggatgacctactgg

SEQ ID NO: 898732 - DNA, 25 bp, Mus musculus
ccaatggagatgggctagatgacct

SEQ ID NO: 898733 - DNA, 25 bp, Mus musculus
ccaatggccatgaacccgggagaaa

SEQ ID NO: 898734 - DNA, 25 bp, Mus musculus
ccaatggccatgaagccgggagaaa

SEQ ID NO: 898735 - DNA, 25 bp, Mus musculus
ccaatggcgaatacatccctgctgt

SEQ ID NO: 898736 - DNA, 25 bp, Mus musculus
ccaatggcgacaatctttcagaaga

SEQ ID NO: 898737 - DNA, 25 bp, Mus musculus
ccaatggcgacattctttcagaaga

SEQ ID NO: 898738 - DNA, 25 bp, Mus musculus
ccaatggcgattacatccctgctgt

SEQ ID NO: 898739 - DNA, 25 bp, Mus musculus
ccaatgtatgcgcctgttcacctga

SEQ ID NO: 898740 - DNA, 25 bp, Mus musculus
ccaatgtatgggcctgttcacctga

SEQ ID NO: 898741 - DNA, 25 bp, Mus musculus
ccaatgtcctgaattcagagtgggt

SEQ ID NO: 898742 - DNA, 25 bp, Mus musculus
ccaatgtcctgatttcagagtgggt

SEQ ID NO: 898743 - DNA, 25 bp, Mus musculus
ccaatgtgaacaactctagccagga

SEQ ID NO: 898744 - DNA, 25 bp, Mus musculus
ccaatgtgaagaactctagccagga

SEQ ID NO: 898745 - DNA, 25 bp, Mus musculus
ccaatgtgagagggcgattgtttat

SEQ ID NO: 898746 - DNA, 25 bp, Mus musculus
ccaatgtgagtgggcgattgtttat

SEQ ID NO: 898747 - DNA, 25 bp, Mus musculus
ccaatgtgcttacatgcatgtgtaa

SEQ ID NO: 898748 - DNA, 25 bp, Mus musculus
ccaatgtgcttacgagtctactgtg

SEQ ID NO: 898749 - DNA, 25 bp, Mus musculus
ccaatgtgcttagatgcatgtgtaa

SEQ ID NO: 898750 - DNA, 25 bp, Mus musculus
ccaatgtgcttaggagtctactgtg

SEQ ID NO: 898751 - DNA, 25 bp, Mus musculus
ccaatgtggcctcacggtgcttgga

SEQ ID NO: 898752 - DNA, 25 bp, Mus musculus
ccaatgtggcctcagggtgcttgga

SEQ ID NO: 898753 - DNA, 25 bp, Mus musculus
ccaatgtgtccgacttcccggagag

SEQ ID NO: 898754 - DNA, 25 bp, Mus musculus
ccaatgtgtccgtcttcccggagag

SEQ ID NO: 898755 - DNA, 25 bp, Mus musculus
ccaatgtgtggtcagatattaagac

SEQ ID NO: 898756 - DNA, 25 bp, Mus musculus
ccaatgtgtggtgagatattaagac

SEQ ID NO: 898757 - DNA, 25 bp, Mus musculus
ccaatgttgtaccgctgatggatgt

SEQ ID NO: 898758 - DNA, 25 bp, Mus musculus
ccaatgttgtacggctgatggatgt

SEQ ID NO: 898759 - DNA, 25 bp, Mus musculus
ccaattactgagcaaattgctgtta

SEQ ID NO: 898760 - DNA, 25 bp, Mus musculus
ccaattactgaggaaattgctgtta

SEQ ID NO: 898761 - DNA, 25 bp, Mus musculus
ccaattcaagactacagtgtgcagc

SEQ ID NO: 898762 - DNA, 25 bp, Mus musculus
ccaattcaagtctacagtgtgcagc

SEQ ID NO: 898763 - DNA, 25 bp, Mus musculus
ccaattcaccaacgtctctaagctg

SEQ ID NO: 898764 - DNA, 25 bp, Mus musculus
ccaattcaccaaggtctctaagctg

SEQ ID NO: 898765 - DNA, 25 bp, Mus musculus
ccaattccagctgatgcagggaaag

SEQ ID NO: 898766 - DNA, 25 bp, Mus musculus
ccaattccaggtgatgcagggaaag

SEQ ID NO: 898767 - DNA, 25 bp, Mus musculus
ccaattcgagaagtcaaccatccaa

SEQ ID NO: 898768 - DNA, 25 bp, Mus musculus
ccaattcgagaagtgaaccatccaa

SEQ ID NO: 898769 - DNA, 25 bp, Mus musculus
ccaattctggaccaccaaggccttt

SEQ ID NO: 898770 - DNA, 25 bp, Mus musculus
ccaattctggcacactcactcttac

SEQ ID NO: 898771 - DNA, 25 bp, Mus musculus
ccaattctgggacactcactcttac

SEQ ID NO: 898772 - DNA, 25 bp, Mus musculus
ccaattctggtccaccaaggccttt

SEQ ID NO: 898773 - DNA, 25 bp, Mus musculus
ccaattgcagaaataggcagatttg

SEQ ID NO: 898774 - DNA, 25 bp, Mus musculus
ccaattgcagaaattggcagatttg

SEQ ID NO: 898775 - DNA, 25 bp, Mus musculus
ccaattgcctctgatggtgtggatc

SEQ ID NO: 898776 - DNA, 25 bp, Mus musculus
ccaattgcctgtgatggtgtggatc

SEQ ID NO: 898777 - DNA, 25 bp, Mus musculus
ccaatttcagcccactccatgtcca

SEQ ID NO: 898778 - DNA, 25 bp, Mus musculus
ccaatttcaggccactccatgtcca

SEQ ID NO: 898779 - DNA, 25 bp, Mus musculus
ccaatttcgggaattaaatccagat

SEQ ID NO: 898780 - DNA, 25 bp, Mus musculus
ccaatttcgggatttaaatccagat

SEQ ID NO: 898781 - DNA, 25 bp, Mus musculus
ccaattttaagacagggtgcctccg

SEQ ID NO: 898782 - DNA, 25 bp, Mus musculus
ccaattttaagagagggtgcctccg

SEQ ID NO: 898783 - DNA, 25 bp, Mus musculus
ccacaaagtaagccagaatggctac

SEQ ID NO: 898784 - DNA, 25 bp, Mus musculus
ccacaaagtaagcctgaatggctac

SEQ ID NO: 898785 - DNA, 25 bp, Mus musculus
ccacaaatgctgcctaaaacgctgc

SEQ ID NO: 898786 - DNA, 25 bp, Mus musculus
ccacaaatgctggctaaaacgctgc

SEQ ID NO: 898787 - DNA, 25 bp, Mus musculus
ccacaacaacagctttcgtgagatg

SEQ ID NO: 898788 - DNA, 25 bp, Mus musculus
ccacaacaacaggtttcgtgagatg

SEQ ID NO: 898789 - DNA, 25 bp, Mus musculus
ccacaacatctgcgacaagctggat

SEQ ID NO: 898790 - DNA, 25 bp, Mus musculus
ccacaacatctgggacaagctggat

SEQ ID NO: 898791 - DNA, 25 bp, Mus musculus
ccacaacctgcactatcttcaggac

SEQ ID NO: 898792 - DNA, 25 bp, Mus musculus
ccacaacctgcagtatcttcaggac

SEQ ID NO: 898793 - DNA, 25 bp, Mus musculus
ccacaactataccacgagaaacatc

SEQ ID NO: 898794 - DNA, 25 bp, Mus musculus
ccacaactataccaggagaaacatc

SEQ ID NO: 898795 - DNA, 25 bp, Mus musculus
ccacaactgcagcctgtttggtctc

SEQ ID NO: 898796 - DNA, 25 bp, Mus musculus
ccacaactgcaggctgtttggtctc

SEQ ID NO: 898797 - DNA, 25 bp, Mus musculus
ccacaagagggagaaccacttaaat

SEQ ID NO: 898798 - DNA, 25 bp, Mus musculus
ccacaagagggagatccacttaaat

SEQ ID NO: 898799 - DNA, 25 bp, Mus musculus
ccacaagatacactcgagcctgggt

SEQ ID NO: 898800 - DNA, 25 bp, Mus musculus
ccacaagatacagtcgagcctgggt

SEQ ID NO: 898801 - DNA, 25 bp, Mus musculus
ccacaagcctgaaatcaactccacc

SEQ ID NO: 898802 - DNA, 25 bp, Mus musculus
ccacaagcctgacccaggagggccg

SEQ ID NO: 898803 - DNA, 25 bp, Mus musculus
ccacaagcctgagccaggagggccg

SEQ ID NO: 898804 - DNA, 25 bp, Mus musculus
ccacaagcctgatatcaactccacc

SEQ ID NO: 898805 - DNA, 25 bp, Mus musculus
ccacaagctgaccaaagcggagaag

SEQ ID NO: 898806 - DNA, 25 bp, Mus musculus
ccacaagctgaccaagttacagtcc

SEQ ID NO: 898807 - DNA, 25 bp, Mus musculus
ccacaagctgaccatagcggagaag

SEQ ID NO: 898808 - DNA, 25 bp, Mus musculus
ccacaagctgaccatgttacagtcc

SEQ ID NO: 898809 - DNA, 25 bp, Mus musculus
ccacaaggaacaccatatgaaggcg

SEQ ID NO: 898810 - DNA, 25 bp, Mus musculus
ccacaaggaagaccatatgaaggcg

SEQ ID NO: 898811 - DNA, 25 bp, Mus musculus
ccacaaggaccgattcatttcaggg

SEQ ID NO: 898812 - DNA, 25 bp, Mus musculus
ccacaaggaccgtttcatttcaggg

SEQ ID NO: 898813 - DNA, 25 bp, Mus musculus
ccacaagtacaacatcttgattgcc

SEQ ID NO: 898814 - DNA, 25 bp, Mus musculus
ccacaagtacaagatcttgattgcc

SEQ ID NO: 898815 - DNA, 25 bp, Mus musculus
ccacaagtgcttaccacccggcact

SEQ ID NO: 898816 - DNA, 25 bp, Mus musculus
ccacaagtgcttacgacccggcact

SEQ ID NO: 898817 - DNA, 25 bp, Mus musculus
ccacaagttctgactcttcagcact

SEQ ID NO: 898818 - DNA, 25 bp, Mus musculus
ccacaagttctgtctcttcagcact

SEQ ID NO: 898819 - DNA, 25 bp, Mus musculus
ccacaatgagagagtggtgcaggtc

SEQ ID NO: 898820 - DNA, 25 bp, Mus musculus
ccacaatgagagtgtggtgcaggtc

SEQ ID NO: 898821 - DNA, 25 bp, Mus musculus
ccacaatgattccgcagacgggcct

SEQ ID NO: 898822 - DNA, 25 bp, Mus musculus
ccacaatgattcggcagacgggcct

SEQ ID NO: 898823 - DNA, 25 bp, Mus musculus
ccacacaagaaacctcagtctacat

SEQ ID NO: 898824 - DNA, 25 bp, Mus musculus
ccacacaagaaagctcagtctacat

SEQ ID NO: 898825 - DNA, 25 bp, Mus musculus
ccacacactgcgctaccctgtgaag

SEQ ID NO: 898826 - DNA, 25 bp, Mus musculus
ccacacactgcgcttccctgtgaag

SEQ ID NO: 898827 - DNA, 25 bp, Mus musculus
ccacacaggactccctgaagctgtt

SEQ ID NO: 898828 - DNA, 25 bp, Mus musculus
ccacacaggactgcctgaagctgtt

SEQ ID NO: 898829 - DNA, 25 bp, Mus musculus
ccacacagtcaacccttaaagaaag

SEQ ID NO: 898830 - DNA, 25 bp, Mus musculus
ccacacagtcaagccttaaagaaag

SEQ ID NO: 898831 - DNA, 25 bp, Mus musculus
ccacacagtggacgattaccaggca

SEQ ID NO: 898832 - DNA, 25 bp, Mus musculus
ccacacagtggaggattaccaggca

SEQ ID NO: 898833 - DNA, 25 bp, Mus musculus
ccacacagttccaacccctggagat

SEQ ID NO: 898834 - DNA, 25 bp, Mus musculus
ccacacagttccaagccctggagat

SEQ ID NO: 898835 - DNA, 25 bp, Mus musculus
ccacacataaagcacaatgctcagt

SEQ ID NO: 898836 - DNA, 25 bp, Mus musculus
ccacacataaagcagaatgctcagt

SEQ ID NO: 898837 - DNA, 25 bp, Mus musculus
ccacacatgatccgaacaccatgga

SEQ ID NO: 898838 - DNA, 25 bp, Mus musculus
ccacacatgatcggaacaccatgga

SEQ ID NO: 898839 - DNA, 25 bp, Mus musculus
ccacaccacccacactatgaaatcc

SEQ ID NO: 898840 - DNA, 25 bp, Mus musculus
ccacaccacccagactatgaaatcc

SEQ ID NO: 898841 - DNA, 25 bp, Mus musculus
ccacaccgggacaaccatcatggca

SEQ ID NO: 898842 - DNA, 25 bp, Mus musculus
ccacaccgggtcaaccatcatggca

SEQ ID NO: 898843 - DNA, 25 bp, Mus musculus
ccacacctcatgcccagcaactgtg

SEQ ID NO: 898844 - DNA, 25 bp, Mus musculus
ccacacctcatgccgagcaactgtg

SEQ ID NO: 898845 - DNA, 25 bp, Mus musculus
ccacacctcgaacgatcctgcacaa

SEQ ID NO: 898846 - DNA, 25 bp, Mus musculus
ccacacctcgaaggatcctgcacaa

SEQ ID NO: 898847 - DNA, 25 bp, Mus musculus
ccacacctttcggtcgtagcctgga

SEQ ID NO: 898848 - DNA, 25 bp, Mus musculus
ccacacctttcggtggtagcctgga

SEQ ID NO: 898849 - DNA, 25 bp, Mus musculus
ccacacgcagaatcatggagaacgg

SEQ ID NO: 898850 - DNA, 25 bp, Mus musculus
ccacacgcagtatcatggagaacgg

SEQ ID NO: 898851 - DNA, 25 bp, Mus musculus
ccacacgctacttacccccaaccat

SEQ ID NO: 898852 - DNA, 25 bp, Mus musculus
ccacacgctacttacgtgatgcaag

SEQ ID NO: 898853 - DNA, 25 bp, Mus musculus
ccacacgctacttagccccaaccat

SEQ ID NO: 898854 - DNA, 25 bp, Mus musculus
ccacacgctacttaggtgatgcaag

SEQ ID NO: 898855 - DNA, 25 bp, Mus musculus
ccacacggagagctgcccagacggc

SEQ ID NO: 898856 - DNA, 25 bp, Mus musculus
ccacacggagtgctgcccagacggc

SEQ ID NO: 898857 - DNA, 25 bp, Mus musculus
ccacacgttcttcccgctggtgtca

SEQ ID NO: 898858 - DNA, 25 bp, Mus musculus
ccacacgttcttccggctggtgtca

SEQ ID NO: 898859 - DNA, 25 bp, Mus musculus
ccacactgcgctcagtgcaccaatg

SEQ ID NO: 898860 - DNA, 25 bp, Mus musculus
ccacactgcgctgagtgcaccaatg

SEQ ID NO: 898861 - DNA, 25 bp, Mus musculus
ccacactgctgaccgccatcacgtc

SEQ ID NO: 898862 - DNA, 25 bp, Mus musculus
ccacactgctgagcgccatcacgtc

SEQ ID NO: 898863 - DNA, 25 bp, Mus musculus
ccacactggccgccactgggaagcc

SEQ ID NO: 898864 - DNA, 25 bp, Mus musculus
ccacactggccggcactgggaagcc

SEQ ID NO: 898865 - DNA, 25 bp, Mus musculus
ccacacttcacaaggatggaataga

SEQ ID NO: 898866 - DNA, 25 bp, Mus musculus
ccacacttcacatggatggaataga

SEQ ID NO: 898867 - DNA, 25 bp, Mus musculus
ccacagaaacagcctttgctctgct

SEQ ID NO: 898868 - DNA, 25 bp, Mus musculus
ccacagaaacaggctttgctctgct

SEQ ID NO: 898869 - DNA, 25 bp, Mus musculus
ccacagaagacacgcaccacggcta

SEQ ID NO: 898870 - DNA, 25 bp, Mus musculus
ccacagaagacaggcaccacggcta

SEQ ID NO: 898871 - DNA, 25 bp, Mus musculus
ccacagaagcagcaggggagaaccc

SEQ ID NO: 898872 - DNA, 25 bp, Mus musculus
ccacagaagcagcggagaaccccct

SEQ ID NO: 898873 - DNA, 25 bp, Mus musculus
ccacagaagcaggaggggagaaccc

SEQ ID NO: 898874 - DNA, 25 bp, Mus musculus
ccacagaagcaggggagaaccccct

SEQ ID NO: 898875 - DNA, 25 bp, Mus musculus
ccacagaaggcaaccgtgtgactgg

SEQ ID NO: 898876 - DNA, 25 bp, Mus musculus
ccacagaagggaaccgtgtgactgg

SEQ ID NO: 898877 - DNA, 25 bp, Mus musculus
ccacagacagcgccactgccggtgg

SEQ ID NO: 898878 - DNA, 25 bp, Mus musculus
ccacagacagggccactgccggtgg

SEQ ID NO: 898879 - DNA, 25 bp, Mus musculus
ccacagacccaacatgtctctccta

SEQ ID NO: 898880 - DNA, 25 bp, Mus musculus
ccacagacccaagatgtctctccta

SEQ ID NO: 898881 - DNA, 25 bp, Mus musculus
ccacagagcaaacgaatccagactg

SEQ ID NO: 898882 - DNA, 25 bp, Mus musculus
ccacagagcaaaggaatccagactg

SEQ ID NO: 898883 - DNA, 25 bp, Mus musculus
ccacagagcaagaacgagagcgtgg

SEQ ID NO: 898884 - DNA, 25 bp, Mus musculus
ccacagagcaagaaggagagcgtgg

SEQ ID NO: 898885 - DNA, 25 bp, Mus musculus
ccacagaggaaacgaaaaacatgca

SEQ ID NO: 898886 - DNA, 25 bp, Mus musculus
ccacagaggaaaggaaaaacatgca

SEQ ID NO: 898887 - DNA, 25 bp, Mus musculus
ccacagcaaaagcccagatattctc

SEQ ID NO: 898888 - DNA, 25 bp, Mus musculus
ccacagcaaaaggccagatattctc

SEQ ID NO: 898889 - DNA, 25 bp, Mus musculus
ccacagcaagcaccctactggacac

SEQ ID NO: 898890 - DNA, 25 bp, Mus musculus
ccacagcaaggaccctactggacac

SEQ ID NO: 898891 - DNA, 25 bp, Mus musculus
ccacagccaaagatgaagaaatact

SEQ ID NO: 898892 - DNA, 25 bp, Mus musculus
ccacagccaaagttgaagaaatact

SEQ ID NO: 898893 - DNA, 25 bp, Mus musculus
ccacagccaacacgtcagaccaagc

SEQ ID NO: 898894 - DNA, 25 bp, Mus musculus
ccacagccaacaggtcagaccaagc

SEQ ID NO: 898895 - DNA, 25 bp, Mus musculus
ccacagccagaagacatcctcagct

SEQ ID NO: 898896 - DNA, 25 bp, Mus musculus
ccacagccagaagacccatggcgag

SEQ ID NO: 898897 - DNA, 25 bp, Mus musculus
ccacagccagaagagatcctcagct

SEQ ID NO: 898898 - DNA, 25 bp, Mus musculus
ccacagccagaagagccatggcgag

SEQ ID NO: 898899 - DNA, 25 bp, Mus musculus
ccacagccatcggattctgcttctt

SEQ ID NO: 898900 - DNA, 25 bp, Mus musculus
ccacagccatgggattctgcttctt

SEQ ID NO: 898901 - DNA, 25 bp, Mus musculus
ccacagccccgcagacactgggttc

SEQ ID NO: 898902 - DNA, 25 bp, Mus musculus
ccacagccccgctgacactgggttc

SEQ ID NO: 898903 - DNA, 25 bp, Mus musculus
ccacagcctgaggacacgcagaggc

SEQ ID NO: 898904 - DNA, 25 bp, Mus musculus
ccacagcctgaggagacgcagaggc

SEQ ID NO: 898905 - DNA, 25 bp, Mus musculus
ccacagctagctatcacctatgagg

SEQ ID NO: 898906 - DNA, 25 bp, Mus musculus
ccacagctagctatgacctatgagg

SEQ ID NO: 898907 - DNA, 25 bp, Mus musculus
ccacagctcggacatgggagctttg

SEQ ID NO: 898908 - DNA, 25 bp, Mus musculus
ccacagctcggacgacagatgggag

SEQ ID NO: 898909 - DNA, 25 bp, Mus musculus
ccacagctcggagatgggagctttg

SEQ ID NO: 898910 - DNA, 25 bp, Mus musculus
ccacagctcggaggacagatgggag

SEQ ID NO: 898911 - DNA, 25 bp, Mus musculus
ccacagctgactcaccccggcaagc

SEQ ID NO: 898912 - DNA, 25 bp, Mus musculus
ccacagctgactcagcccggcaagc

SEQ ID NO: 898913 - DNA, 25 bp, Mus musculus
ccacagcttcagaatacaggggtgc

SEQ ID NO: 898914 - DNA, 25 bp, Mus musculus
ccacagcttcagtatacaggggtgc

SEQ ID NO: 898915 - DNA, 25 bp, Mus musculus
ccacaggaacaacatcctgcacagg

SEQ ID NO: 898916 - DNA, 25 bp, Mus musculus
ccacaggaacaacgtgtggccaaac

SEQ ID NO: 898917 - DNA, 25 bp, Mus musculus
ccacaggaacaagatcctgcacagg

SEQ ID NO: 898918 - DNA, 25 bp, Mus musculus
ccacaggaacaaggtgtggccaaac

SEQ ID NO: 898919 - DNA, 25 bp, Mus musculus
ccacaggagtggacccgtaggcctc

SEQ ID NO: 898920 - DNA, 25 bp, Mus musculus
ccacaggagtggtcccgtaggcctc

SEQ ID NO: 898921 - DNA, 25 bp, Mus musculus
ccacaggatgaaataacagttactt

SEQ ID NO: 898922 - DNA, 25 bp, Mus musculus
ccacaggatgatggcagtgaaattc

SEQ ID NO: 898923 - DNA, 25 bp, Mus musculus
ccacaggatgggacccagcctgcag

SEQ ID NO: 898924 - DNA, 25 bp, Mus musculus
ccacaggatgggtcccagcctgcag

SEQ ID NO: 898925 - DNA, 25 bp, Mus musculus
ccacaggatgtaataacagttactt

SEQ ID NO: 898926 - DNA, 25 bp, Mus musculus
ccacaggatgttggcagtgaaattc

SEQ ID NO: 898927 - DNA, 25 bp, Mus musculus
ccacaggcaccgagtctgacctggc

SEQ ID NO: 898928 - DNA, 25 bp, Mus musculus
ccacaggcaccgtgtctgacctggc

SEQ ID NO: 898929 - DNA, 25 bp, Mus musculus
ccacaggcagcacagtggacattca

SEQ ID NO: 898930 - DNA, 25 bp, Mus musculus
ccacaggcagcactggacattcatg

SEQ ID NO: 898931 - DNA, 25 bp, Mus musculus
ccacaggcagcagagtggacattca

SEQ ID NO: 898932 - DNA, 25 bp, Mus musculus
ccacaggcagcagtggacattcatg

SEQ ID NO: 898933 - DNA, 25 bp, Mus musculus
ccacaggcgtccaacctcccagcag

SEQ ID NO: 898934 - DNA, 25 bp, Mus musculus
ccacaggcgtccaacgccatcagct

SEQ ID NO: 898935 - DNA, 25 bp, Mus musculus
ccacaggcgtccaagctcccagcag

SEQ ID NO: 898936 - DNA, 25 bp, Mus musculus
ccacaggcgtccaaggccatcagct

SEQ ID NO: 898937 - DNA, 25 bp, Mus musculus
ccacaggctcctcagcgcagccttg

SEQ ID NO: 898938 - DNA, 25 bp, Mus musculus
ccacaggctcctcgccaggagcaag

SEQ ID NO: 898939 - DNA, 25 bp, Mus musculus
ccacaggctcctgagcgcagccttg

SEQ ID NO: 898940 - DNA, 25 bp, Mus musculus
ccacaggctcctggccaggagcaag

SEQ ID NO: 898941 - DNA, 25 bp, Mus musculus
ccacaggctgcaaactcctcttctc

SEQ ID NO: 898942 - DNA, 25 bp, Mus musculus
ccacaggctgcaaagtcctcttctc

SEQ ID NO: 898943 - DNA, 25 bp, Mus musculus
ccacaggctgctcacgtcggcctgc

SEQ ID NO: 898944 - DNA, 25 bp, Mus musculus
ccacaggctgctcaggtcggcctgc

SEQ ID NO: 898945 - DNA, 25 bp, Mus musculus
ccacaggctggcaacgtcaaacctg

SEQ ID NO: 898946 - DNA, 25 bp, Mus musculus
ccacaggctggcaaggtcaaacctg

SEQ ID NO: 898947 - DNA, 25 bp, Mus musculus
ccacagggagactccaccacatatg

SEQ ID NO: 898948 - DNA, 25 bp, Mus musculus
ccacagggagtctccaccacatatg

SEQ ID NO: 898949 - DNA, 25 bp, Mus musculus
ccacagtcagactctcttgagattc

SEQ ID NO: 898950 - DNA, 25 bp, Mus musculus
ccacagtcagtctctcttgagattc

SEQ ID NO: 898951 - DNA, 25 bp, Mus musculus
ccacagtcatctaactcatctacag

SEQ ID NO: 898952 - DNA, 25 bp, Mus musculus
ccacagtcatctaagtcatctacag

SEQ ID NO: 898953 - DNA, 25 bp, Mus musculus
ccacagtcctcacggttcaagttcc

SEQ ID NO: 898954 - DNA, 25 bp, Mus musculus
ccacagtcctcagggttcaagttcc

SEQ ID NO: 898955 - DNA, 25 bp, Mus musculus
ccacagtgagacagtactatgccta

SEQ ID NO: 898956 - DNA, 25 bp, Mus musculus
ccacagtgagtcagtactatgccta

SEQ ID NO: 898957 - DNA, 25 bp, Mus musculus
ccacagtgtaaacctctatgtcaga

SEQ ID NO: 898958 - DNA, 25 bp, Mus musculus
ccacagtgtaaagctctatgtcaga

SEQ ID NO: 898959 - DNA, 25 bp, Mus musculus
ccacagttcgcacatacacttttgg

SEQ ID NO: 898960 - DNA, 25 bp, Mus musculus
ccacagttcgcacgaggcagagtaa

SEQ ID NO: 898961 - DNA, 25 bp, Mus musculus
ccacagttcgcagatacacttttgg

SEQ ID NO: 898962 - DNA, 25 bp, Mus musculus
ccacagttcgcaggaggcagagtaa

SEQ ID NO: 898963 - DNA, 25 bp, Mus musculus
ccacagttcgtacacgctttgaaat

SEQ ID NO: 898964 - DNA, 25 bp, Mus musculus
ccacagttcgtacaggctttgaaat

SEQ ID NO: 898965 - DNA, 25 bp, Mus musculus
ccacagttgttcatctcctgaaggg

SEQ ID NO: 898966 - DNA, 25 bp, Mus musculus
ccacagttgttcatgtcctgaaggg

SEQ ID NO: 898967 - DNA, 25 bp, Mus musculus
ccacagtttcttcgtctggaataaa

SEQ ID NO: 898968 - DNA, 25 bp, Mus musculus
ccacagtttcttggtctggaataaa

SEQ ID NO: 898969 - DNA, 25 bp, Mus musculus
ccacataacttaaacgctaatggag

SEQ ID NO: 898970 - DNA, 25 bp, Mus musculus
ccacataacttaaaggctaatggag

SEQ ID NO: 898971 - DNA, 25 bp, Mus musculus
ccacatacaaacacttcgatgagaa

SEQ ID NO: 898972 - DNA, 25 bp, Mus musculus
ccacatacaatcacttcgatgagaa

SEQ ID NO: 898973 - DNA, 25 bp, Mus musculus
ccacatatagcaggccttgctccag

SEQ ID NO: 898974 - DNA, 25 bp, Mus musculus
ccacatatagcccttgctccagctg

SEQ ID NO: 898975 - DNA, 25 bp, Mus musculus
ccacatatagctggtgtattctcag

SEQ ID NO: 898976 - DNA, 25 bp, Mus musculus
ccacatataggaggccttgctccag

SEQ ID NO: 898977 - DNA, 25 bp, Mus musculus
ccacatataggccttgctccagctg

SEQ ID NO: 898978 - DNA, 25 bp, Mus musculus
ccacatataggtggtgtattctcag

SEQ ID NO: 898979 - DNA, 25 bp, Mus musculus
ccacatccagattgtgaagagggac

SEQ ID NO: 898980 - DNA, 25 bp, Mus musculus
ccacatccagtttgtgaagagggac

SEQ ID NO: 898981 - DNA, 25 bp, Mus musculus
ccacatccccagaggtataatagga

SEQ ID NO: 898982 - DNA, 25 bp, Mus musculus
ccacatccccagtggtataatagga

SEQ ID NO: 898983 - DNA, 25 bp, Mus musculus
ccacatcctgagccaataacttcgc

SEQ ID NO: 898984 - DNA, 25 bp, Mus musculus
ccacatcctgcgagccttaaacctg

SEQ ID NO: 898985 - DNA, 25 bp, Mus musculus
ccacatcctgggagccttaaacctg

SEQ ID NO: 898986 - DNA, 25 bp, Mus musculus
ccacatcctgtgccaataacttcgc

SEQ ID NO: 898987 - DNA, 25 bp, Mus musculus
ccacatcctttgtgaatttaagcaa

SEQ ID NO: 898988 - DNA, 25 bp, Mus musculus
ccacatcctttgtgtatttaagcaa

SEQ ID NO: 898989 - DNA, 25 bp, Mus musculus
ccacatcgacctcattgatctggac

SEQ ID NO: 898990 - DNA, 25 bp, Mus musculus
ccacatcgacctgattgatctggac

SEQ ID NO: 898991 - DNA, 25 bp, Mus musculus
ccacatctccagatgaagtcctgca

SEQ ID NO: 898992 - DNA, 25 bp, Mus musculus
ccacatctccagttgaagtcctgca

SEQ ID NO: 898993 - DNA, 25 bp, Mus musculus
ccacatgaagctctgctttggagac

SEQ ID NO: 898994 - DNA, 25 bp, Mus musculus
ccacatgaaggtctgctttggagac

SEQ ID NO: 898995 - DNA, 25 bp, Mus musculus
ccacatgcaatgattccagcggttt

SEQ ID NO: 898996 - DNA, 25 bp, Mus musculus
ccacatgcaatgtttccagcggttt

SEQ ID NO: 898997 - DNA, 25 bp, Mus musculus
ccacatgtcacacctaaagtccagg

SEQ ID NO: 898998 - DNA, 25 bp, Mus musculus
ccacatgtcacagctaaagtccagg

SEQ ID NO: 898999 - DNA, 25 bp, Mus musculus
ccacatgtgctgccagtccctccac

SEQ ID NO: 899000 - DNA, 25 bp, Mus musculus
ccacatgtgctgcctgtccctccac

SEQ ID NO: 899001 - DNA, 25 bp, Mus musculus
ccacattcagactccgtcagatcca

SEQ ID NO: 899002 - DNA, 25 bp, Mus musculus
ccacattcagactcggtcagatcca

SEQ ID NO: 899003 - DNA, 25 bp, Mus musculus
ccacattccaaggacgtcaggaagg

SEQ ID NO: 899004 - DNA, 25 bp, Mus musculus
ccacattccaaggaggtcaggaagg

SEQ ID NO: 899005 - DNA, 25 bp, Mus musculus
ccacattccccacaactgaaaatca

SEQ ID NO: 899006 - DNA, 25 bp, Mus musculus
ccacattccccagaactgaaaatca

SEQ ID NO: 899007 - DNA, 25 bp, Mus musculus
ccacattgagagcaccaagaccggc

SEQ ID NO: 899008 - DNA, 25 bp, Mus musculus
ccacattgagcgccggaatgcatcg

SEQ ID NO: 899009 - DNA, 25 bp, Mus musculus
ccacattgagggccggaatgcatcg

SEQ ID NO: 899010 - DNA, 25 bp, Mus musculus
ccacattgagtgcaccaagaccggc

SEQ ID NO: 899011 - DNA, 25 bp, Mus musculus
ccacattgtcaacgtggtggccaaa

SEQ ID NO: 899012 - DNA, 25 bp, Mus musculus
ccacattgtcaaggtggtggccaaa

SEQ ID NO: 899013 - DNA, 25 bp, Mus musculus
ccacattgtctccacggtcctgatt

SEQ ID NO: 899014 - DNA, 25 bp, Mus musculus
ccacattgtctccagggtcctgatt

SEQ ID NO: 899015 - DNA, 25 bp, Mus musculus
ccacatttgatacgccttactgcaa

SEQ ID NO: 899016 - DNA, 25 bp, Mus musculus
ccacatttgatacggcttactgcaa

SEQ ID NO: 899017 - DNA, 25 bp, Mus musculus
ccaccaaaagcaggatactcccatc

SEQ ID NO: 899018 - DNA, 25 bp, Mus musculus
ccaccaaaaggaggatactcccatc

SEQ ID NO: 899019 - DNA, 25 bp, Mus musculus
ccaccaactatgcaattaaccagcg

SEQ ID NO: 899020 - DNA, 25 bp, Mus musculus
ccaccaactatggaattaaccagcg

SEQ ID NO: 899021 - DNA, 25 bp, Mus musculus
ccaccaagaagcagatcttctctgt

SEQ ID NO: 899022 - DNA, 25 bp, Mus musculus
ccaccaagaagctgatcttctctgt

SEQ ID NO: 899023 - DNA, 25 bp, Mus musculus
ccaccaagtccagcaggaattgtct

SEQ ID NO: 899024 - DNA, 25 bp, Mus musculus
ccaccaagtccagctggaattgtct

SEQ ID NO: 899025 - DNA, 25 bp, Mus musculus
ccaccaatgactacgtctaccggct

SEQ ID NO: 899026 - DNA, 25 bp, Mus musculus
ccaccaatgagtacgtctaccggct

SEQ ID NO: 899027 - DNA, 25 bp, Mus musculus
ccaccaattcccacagagaaccagg

SEQ ID NO: 899028 - DNA, 25 bp, Mus musculus
ccaccaattcgcacagagaaccagg

SEQ ID NO: 899029 - DNA, 25 bp, Mus musculus
ccaccacaagctacccagccctgcc

SEQ ID NO: 899030 - DNA, 25 bp, Mus musculus
ccaccacaaggtacccagccctgcc

SEQ ID NO: 899031 - DNA, 25 bp, Mus musculus
ccaccacacctgactcctccttcac

SEQ ID NO: 899032 - DNA, 25 bp, Mus musculus
ccaccacacctgtctcctccttcac

SEQ ID NO: 899033 - DNA, 25 bp, Mus musculus
ccaccacacgcgcttgctgaatatc

SEQ ID NO: 899034 - DNA, 25 bp, Mus musculus
ccaccacacgggcttgctgaatatc

SEQ ID NO: 899035 - DNA, 25 bp, Mus musculus
ccaccacagcagaactgtctggcct

SEQ ID NO: 899036 - DNA, 25 bp, Mus musculus
ccaccacagcagccactacagactc

SEQ ID NO: 899037 - DNA, 25 bp, Mus musculus
ccaccacagcaggcactacagactc

SEQ ID NO: 899038 - DNA, 25 bp, Mus musculus
ccaccacagcagtactgtctggcct

SEQ ID NO: 899039 - DNA, 25 bp, Mus musculus
ccaccacagctgcagaaatatctag

SEQ ID NO: 899040 - DNA, 25 bp, Mus musculus
ccaccacagctggagaaatatctag

SEQ ID NO: 899041 - DNA, 25 bp, Mus musculus
ccaccacaggccctgaagctgcacc

SEQ ID NO: 899042 - DNA, 25 bp, Mus musculus
ccaccacagggcctgaagctgcacc

SEQ ID NO: 899043 - DNA, 25 bp, Mus musculus
ccaccaccagctattccaataactg

SEQ ID NO: 899044 - DNA, 25 bp, Mus musculus
ccaccaccagctttcctgctgaacc

SEQ ID NO: 899045 - DNA, 25 bp, Mus musculus
ccaccaccaggtattccaataactg

SEQ ID NO: 899046 - DNA, 25 bp, Mus musculus
ccaccaccaggtttcctgctgaacc

SEQ ID NO: 899047 - DNA, 25 bp, Mus musculus
ccaccacccttcatgccccctccag

SEQ ID NO: 899048 - DNA, 25 bp, Mus musculus
ccaccacccttcttgccccctccag

SEQ ID NO: 899049 - DNA, 25 bp, Mus musculus
ccaccaccgctgacgatgcagatct

SEQ ID NO: 899050 - DNA, 25 bp, Mus musculus
ccaccaccgctgtcgatgcagatct

SEQ ID NO: 899051 - DNA, 25 bp, Mus musculus
ccaccacctgcaactggtgagcaga

SEQ ID NO: 899052 - DNA, 25 bp, Mus musculus
ccaccacctggaactggtgagcaga

SEQ ID NO: 899053 - DNA, 25 bp, Mus musculus
ccaccacgagcatctccaagatgtg

SEQ ID NO: 899054 - DNA, 25 bp, Mus musculus
ccaccacgaggatctccaagatgtg

SEQ ID NO: 899055 - DNA, 25 bp, Mus musculus
ccaccactagtgagtcacatcaagt

SEQ ID NO: 899056 - DNA, 25 bp, Mus musculus
ccaccactagtgtgtcacatcaagt

SEQ ID NO: 899057 - DNA, 25 bp, Mus musculus
ccaccactgattaacgattcaggag

SEQ ID NO: 899058 - DNA, 25 bp, Mus musculus
ccaccactgattaaggattcaggag

SEQ ID NO: 899059 - DNA, 25 bp, Mus musculus
ccaccacttacacacataccaggaa

SEQ ID NO: 899060 - DNA, 25 bp, Mus musculus
ccaccacttacacagataccaggaa

SEQ ID NO: 899061 - DNA, 25 bp, Mus musculus
ccaccagagtgatgattggtctttt

SEQ ID NO: 899062 - DNA, 25 bp, Mus musculus
ccaccagagtgatgtttggtctttt

SEQ ID NO: 899063 - DNA, 25 bp, Mus musculus
ccaccagatgcaccatccctggagc

SEQ ID NO: 899064 - DNA, 25 bp, Mus musculus
ccaccagatgcacgagagaagatgg

SEQ ID NO: 899065 - DNA, 25 bp, Mus musculus
ccaccagatgcactgttgtggtcct

SEQ ID NO: 899066 - DNA, 25 bp, Mus musculus
ccaccagatgcagcatccctggagc

SEQ ID NO: 899067 - DNA, 25 bp, Mus musculus
ccaccagatgcaggagagaagatgg

SEQ ID NO: 899068 - DNA, 25 bp, Mus musculus
ccaccagatgcagtgttgtggtcct

SEQ ID NO: 899069 - DNA, 25 bp, Mus musculus
ccaccagcagattcggctcgtccag

SEQ ID NO: 899070 - DNA, 25 bp, Mus musculus
ccaccagcagctccagacaagaatc

SEQ ID NO: 899071 - DNA, 25 bp, Mus musculus
ccaccagcagctgtctccctcccag

SEQ ID NO: 899072 - DNA, 25 bp, Mus musculus
ccaccagcaggtccagacaagaatc

SEQ ID NO: 899073 - DNA, 25 bp, Mus musculus
ccaccagcaggtgtctccctcccag

SEQ ID NO: 899074 - DNA, 25 bp, Mus musculus
ccaccagcagtttcggctcgtccag

SEQ ID NO: 899075 - DNA, 25 bp, Mus musculus
ccaccagccccgagtgtgaggaaca

SEQ ID NO: 899076 - DNA, 25 bp, Mus musculus
ccaccagccccgtgtgtgaggaaca

SEQ ID NO: 899077 - DNA, 25 bp, Mus musculus
ccaccaggaacacagagaacattat

SEQ ID NO: 899078 - DNA, 25 bp, Mus musculus
ccaccaggaacagagagaacattat

SEQ ID NO: 899079 - DNA, 25 bp, Mus musculus
ccaccaggaaggctgttaggagtgg

SEQ ID NO: 899080 - DNA, 25 bp, Mus musculus
ccaccaggaagggtgttaggagtgg

SEQ ID NO: 899081 - DNA, 25 bp, Mus musculus
ccaccaggatggctcatatagacag

SEQ ID NO: 899082 - DNA, 25 bp, Mus musculus
ccaccaggatggctgatatagacag

SEQ ID NO: 899083 - DNA, 25 bp, Mus musculus
ccaccagggtcagccggagcacctg

SEQ ID NO: 899084 - DNA, 25 bp, Mus musculus
ccaccagggtcagcgggagcacctg

SEQ ID NO: 899085 - DNA, 25 bp, Mus musculus
ccaccatcatcacgcaaacaggcat

SEQ ID NO: 899086 - DNA, 25 bp, Mus musculus
ccaccatcatcaggcaaacaggcat

SEQ ID NO: 899087 - DNA, 25 bp, Mus musculus
ccaccatgaaagagctccagacgat

SEQ ID NO: 899088 - DNA, 25 bp, Mus musculus
ccaccatgaaagtgctccagacgat

SEQ ID NO: 899089 - DNA, 25 bp, Mus musculus
ccaccatgaaattgtggccctaata

SEQ ID NO: 899090 - DNA, 25 bp, Mus musculus
ccaccatgaatttgtggccctaata

SEQ ID NO: 899091 - DNA, 25 bp, Mus musculus
ccaccatgagcgaccaagatcactc

SEQ ID NO: 899092 - DNA, 25 bp, Mus musculus
ccaccatgagcgtccaagatcactc

SEQ ID NO: 899093 - DNA, 25 bp, Mus musculus
ccaccatgatataggaccatgtgtt

SEQ ID NO: 899094 - DNA, 25 bp, Mus musculus
ccaccatgatattggaccatgtgtt

SEQ ID NO: 899095 - DNA, 25 bp, Mus musculus
ccaccatggagaaaagcaaccatat

SEQ ID NO: 899096 - DNA, 25 bp, Mus musculus
ccaccatggagaaatgcaaccatat

SEQ ID NO: 899097 - DNA, 25 bp, Mus musculus
ccaccattactcaacggctggcccg

SEQ ID NO: 899098 - DNA, 25 bp, Mus musculus
ccaccattactctacggctggcccg

SEQ ID NO: 899099 - DNA, 25 bp, Mus musculus
ccaccatttcagagtcagcttgcga

SEQ ID NO: 899100 - DNA, 25 bp, Mus musculus
ccaccatttcagtgtcagcttgcga

SEQ ID NO: 899101 - DNA, 25 bp, Mus musculus
ccacccaaagccagaagagtgtttt

SEQ ID NO: 899102 - DNA, 25 bp, Mus musculus
ccacccaaaggcagaagagtgtttt

SEQ ID NO: 899103 - DNA, 25 bp, Mus musculus
ccacccagaagacgtagaggccgag

SEQ ID NO: 899104 - DNA, 25 bp, Mus musculus
ccacccagaagaggtagaggccgag

SEQ ID NO: 899105 - DNA, 25 bp, Mus musculus
ccacccagccctggctgccacactc

SEQ ID NO: 899106 - DNA, 25 bp, Mus musculus
ccacccagccgtggctgccacactc

SEQ ID NO: 899107 - DNA, 25 bp, Mus musculus
ccacccattcagcgcatatttggaa

SEQ ID NO: 899108 - DNA, 25 bp, Mus musculus
ccacccattcagggcatatttggaa

SEQ ID NO: 899109 - DNA, 25 bp, Mus musculus
ccaccccagtggaaatcacggttat

SEQ ID NO: 899110 - DNA, 25 bp, Mus musculus
ccaccccagtggaattcacggttat

SEQ ID NO: 899111 - DNA, 25 bp, Mus musculus
ccacccccagaaacgtgtgccgtca

SEQ ID NO: 899112 - DNA, 25 bp, Mus musculus
ccacccccagctcccaaagagcagc

SEQ ID NO: 899113 - DNA, 25 bp, Mus musculus
ccacccccaggtcccaaagagcagc

SEQ ID NO: 899114 - DNA, 25 bp, Mus musculus
ccacccccagtaacgtgtgccgtca

SEQ ID NO: 899115 - DNA, 25 bp, Mus musculus
ccaccccctgcacgagcccccacaa

SEQ ID NO: 899116 - DNA, 25 bp, Mus musculus
ccaccccctgcaggagcccccacaa

SEQ ID NO: 899117 - DNA, 25 bp, Mus musculus
ccaccccttctacacgggcaatgaa

SEQ ID NO: 899118 - DNA, 25 bp, Mus musculus
ccaccccttctacaggggcaatgaa

SEQ ID NO: 899119 - DNA, 25 bp, Mus musculus
ccacccgacaggcccgcagcctcgt

SEQ ID NO: 899120 - DNA, 25 bp, Mus musculus
ccacccgacagggccgcagcctcgt

SEQ ID NO: 899121 - DNA, 25 bp, Mus musculus
ccacccgctacccgcgggcagaaca

SEQ ID NO: 899122 - DNA, 25 bp, Mus musculus
ccacccgctaccggcgggcagaaca

SEQ ID NO: 899123 - DNA, 25 bp, Mus musculus
ccaccctgaaaactgcaggtgtgca

SEQ ID NO: 899124 - DNA, 25 bp, Mus musculus
ccaccctgaaaagtgcaggtgtgca

SEQ ID NO: 899125 - DNA, 25 bp, Mus musculus
ccaccctgcctgaccggccttcaac

SEQ ID NO: 899126 - DNA, 25 bp, Mus musculus
ccaccctgcctgacgggccttcaac

SEQ ID NO: 899127 - DNA, 25 bp, Mus musculus
ccaccctggttgctggatataaagt

SEQ ID NO: 899128 - DNA, 25 bp, Mus musculus
ccaccctggttggtggatataaagt

SEQ ID NO: 899129 - DNA, 25 bp, Mus musculus
ccacccttgccacaacctgaagtga

SEQ ID NO: 899130 - DNA, 25 bp, Mus musculus
ccacccttgccacatcctgaagtga

SEQ ID NO: 899131 - DNA, 25 bp, Mus musculus
ccacccttgcttcacgtacgccagg

SEQ ID NO: 899132 - DNA, 25 bp, Mus musculus
ccacccttgcttcaggtacgccagg

SEQ ID NO: 899133 - DNA, 25 bp, Mus musculus
ccaccgaacacactgaggatgccat

SEQ ID NO: 899134 - DNA, 25 bp, Mus musculus
ccaccgaacacagtgaggatgccat

SEQ ID NO: 899135 - DNA, 25 bp, Mus musculus
ccaccgacggcatcggctttgccat

SEQ ID NO: 899136 - DNA, 25 bp, Mus musculus
ccaccgacgggatcggctttgccat

SEQ ID NO: 899137 - DNA, 25 bp, Mus musculus
ccaccgcccgagactgtgtttcctg

SEQ ID NO: 899138 - DNA, 25 bp, Mus musculus
ccaccgcccgagtctgtgtttcctg

SEQ ID NO: 899139 - DNA, 25 bp, Mus musculus
ccaccggcacactccatctgatttg

SEQ ID NO: 899140 - DNA, 25 bp, Mus musculus
ccaccggcacactcgatctgatttg

SEQ ID NO: 899141 - DNA, 25 bp, Mus musculus
ccaccggctgcacaccccatctctg

SEQ ID NO: 899142 - DNA, 25 bp, Mus musculus
ccaccggctgcacacgagcaacacg

SEQ ID NO: 899143 - DNA, 25 bp, Mus musculus
ccaccggctgcacagcccatctctg

SEQ ID NO: 899144 - DNA, 25 bp, Mus musculus
ccaccggctgcacaggagcaacacg

SEQ ID NO: 899145 - DNA, 25 bp, Mus musculus
ccaccggctggacgaacccatgctt

SEQ ID NO: 899146 - DNA, 25 bp, Mus musculus
ccaccggctggaggaacccatgctt

SEQ ID NO: 899147 - DNA, 25 bp, Mus musculus
ccaccgtcagagtgtgggatgtaaa

SEQ ID NO: 899148 - DNA, 25 bp, Mus musculus
ccaccgtcagtgtgtgggatgtaaa

SEQ ID NO: 899149 - DNA, 25 bp, Mus musculus
ccaccgtcggtgctccgatccggag

SEQ ID NO: 899150 - DNA, 25 bp, Mus musculus
ccaccgtcggtgctcgccttcccag

SEQ ID NO: 899151 - DNA, 25 bp, Mus musculus
ccaccgtcggtgctgcgatccggag

SEQ ID NO: 899152 - DNA, 25 bp, Mus musculus
ccaccgtcggtgctggccttcccag

SEQ ID NO: 899153 - DNA, 25 bp, Mus musculus
ccaccgtgctgtgactgtttccacc

SEQ ID NO: 899154 - DNA, 25 bp, Mus musculus
ccaccgtgctgtgagtgtttccacc

SEQ ID NO: 899155 - DNA, 25 bp, Mus musculus
ccaccgtggtctcggaagtggctga

SEQ ID NO: 899156 - DNA, 25 bp, Mus musculus
ccaccgtggtctgggaagtggctga

SEQ ID NO: 899157 - DNA, 25 bp, Mus musculus
ccacctacaaccataggtacttcga

SEQ ID NO: 899158 - DNA, 25 bp, Mus musculus
ccacctacaaccttaggtacttcga

SEQ ID NO: 899159 - DNA, 25 bp, Mus musculus
ccacctacccagaacgacggcacta

SEQ ID NO: 899160 - DNA, 25 bp, Mus musculus
ccacctacccagaacgacggcatta

SEQ ID NO: 899161 - DNA, 25 bp, Mus musculus
ccacctacccagaaggacggcacta

SEQ ID NO: 899162 - DNA, 25 bp, Mus musculus
ccacctacccagaaggacggcatta

SEQ ID NO: 899163 - DNA, 25 bp, Mus musculus
ccacctatgagaaacggaagacctc

SEQ ID NO: 899164 - DNA, 25 bp, Mus musculus
ccacctatgagaaagggaagacctc

SEQ ID NO: 899165 - DNA, 25 bp, Mus musculus
ccacctattcctccgtcggtgtgtt

SEQ ID NO: 899166 - DNA, 25 bp, Mus musculus
ccacctattcctgcgtcggtgtgtt

SEQ ID NO: 899167 - DNA, 25 bp, Mus musculus
ccacctcaatgaaacgaggcactgt

SEQ ID NO: 899168 - DNA, 25 bp, Mus musculus
ccacctcaatgaaaggaggcactgt

SEQ ID NO: 899169 - DNA, 25 bp, Mus musculus
ccacctcacgagcttcctggacatc

SEQ ID NO: 899170 - DNA, 25 bp, Mus musculus
ccacctcacgaggttcctggacatc

SEQ ID NO: 899171 - DNA, 25 bp, Mus musculus
ccacctcagggcgacctgactgtga

SEQ ID NO: 899172 - DNA, 25 bp, Mus musculus
ccacctcagggcgagctgactgtga

SEQ ID NO: 899173 - DNA, 25 bp, Mus musculus
ccacctccaactcagcctccaagac

SEQ ID NO: 899174 - DNA, 25 bp, Mus musculus
ccacctccaagtcagcctccaagac

SEQ ID NO: 899175 - DNA, 25 bp, Mus musculus
ccacctccacagcacaagagcaaga

SEQ ID NO: 899176 - DNA, 25 bp, Mus musculus
ccacctccacaggacaagagcaaga

SEQ ID NO: 899177 - DNA, 25 bp, Mus musculus
ccacctccagaccacgctgcagtgt

SEQ ID NO: 899178 - DNA, 25 bp, Mus musculus
ccacctccagaccaggctgcagtgt

SEQ ID NO: 899179 - DNA, 25 bp, Mus musculus
ccacctccagaggtgtcttccaggg

SEQ ID NO: 899180 - DNA, 25 bp, Mus musculus
ccacctccagccattatggctcctc

SEQ ID NO: 899181 - DNA, 25 bp, Mus musculus
ccacctccagcgtgaagttgattcc

SEQ ID NO: 899182 - DNA, 25 bp, Mus musculus
ccacctccaggcattatggctcctc

SEQ ID NO: 899183 - DNA, 25 bp, Mus musculus
ccacctccagggtgaagttgattcc

SEQ ID NO: 899184 - DNA, 25 bp, Mus musculus
ccacctccagtggtgtcttccaggg

SEQ ID NO: 899185 - DNA, 25 bp, Mus musculus
ccacctcccaagattccactttgaa

SEQ ID NO: 899186 - DNA, 25 bp, Mus musculus
ccacctcccaagtttccactttgaa

SEQ ID NO: 899187 - DNA, 25 bp, Mus musculus
ccacctccctctaaccccaacgcct

SEQ ID NO: 899188 - DNA, 25 bp, Mus musculus
ccacctccctctaagcccaacgcct

SEQ ID NO: 899189 - DNA, 25 bp, Mus musculus
ccacctccgaagccgcaacagacga

SEQ ID NO: 899190 - DNA, 25 bp, Mus musculus
ccacctccgaaggcgcaacagacga

SEQ ID NO: 899191 - DNA, 25 bp, Mus musculus
ccacctccgccacttctagactggc

SEQ ID NO: 899192 - DNA, 25 bp, Mus musculus
ccacctccgccagttctagactggc

SEQ ID NO: 899193 - DNA, 25 bp, Mus musculus
ccacctcctaaagaaactggcattg

SEQ ID NO: 899194 - DNA, 25 bp, Mus musculus
ccacctcctaaagatactggcattg

SEQ ID NO: 899195 - DNA, 25 bp, Mus musculus
ccacctctacaactgacatcttgaa

SEQ ID NO: 899196 - DNA, 25 bp, Mus musculus
ccacctctacaagtgacatcttgaa

SEQ ID NO: 899197 - DNA, 25 bp, Mus musculus
ccacctctgaagcttacagcatcaa

SEQ ID NO: 899198 - DNA, 25 bp, Mus musculus
ccacctctgaaggttacagcatcaa

SEQ ID NO: 899199 - DNA, 25 bp, Mus musculus
ccacctgccaaacggaaccatgatc

SEQ ID NO: 899200 - DNA, 25 bp, Mus musculus
ccacctgccaaagggaaccatgatc

SEQ ID NO: 899201 - DNA, 25 bp, Mus musculus
ccacctgggcagctcagccggctcc

SEQ ID NO: 899202 - DNA, 25 bp, Mus musculus
ccacctgggcaggtcagccggctcc

SEQ ID NO: 899203 - DNA, 25 bp, Mus musculus
ccacctggtgcccccggtcttgctg

SEQ ID NO: 899204 - DNA, 25 bp, Mus musculus
ccacctggtgccccgggtcttgctg

SEQ ID NO: 899205 - DNA, 25 bp, Mus musculus
ccacctgtgataaacatcaggaaat

SEQ ID NO: 899206 - DNA, 25 bp, Mus musculus
ccacctgtgataaagatcaggaaat

SEQ ID NO: 899207 - DNA, 25 bp, Mus musculus
ccacctgtgattatcgatatggaac

SEQ ID NO: 899208 - DNA, 25 bp, Mus musculus
ccacctgtgattatggatatggaac

SEQ ID NO: 899209 - DNA, 25 bp, Mus musculus
ccaccttactggctaatgcatgtca

SEQ ID NO: 899210 - DNA, 25 bp, Mus musculus
ccaccttactgggtaatgcatgtca

SEQ ID NO: 899211 - DNA, 25 bp, Mus musculus
ccaccttcaatgcctacaaactgga

SEQ ID NO: 899212 - DNA, 25 bp, Mus musculus
ccaccttcaatggctacaaactgga

SEQ ID NO: 899213 - DNA, 25 bp, Mus musculus
ccaccttcgaaactctgatcgtctg

SEQ ID NO: 899214 - DNA, 25 bp, Mus musculus
ccaccttcgaaagtctgatcgtctg

SEQ ID NO: 899215 - DNA, 25 bp, Mus musculus
ccaccttctttccccgtcaatctgt

SEQ ID NO: 899216 - DNA, 25 bp, Mus musculus
ccaccttctttcccggtcaatctgt

SEQ ID NO: 899217 - DNA, 25 bp, Mus musculus
ccaccttgtcaaagtggccctgctt

SEQ ID NO: 899218 - DNA, 25 bp, Mus musculus
ccaccttgtcaatgtggccctgctt

SEQ ID NO: 899219 - DNA, 25 bp, Mus musculus
ccacgaaatgagcaagatgcaacag

SEQ ID NO: 899220 - DNA, 25 bp, Mus musculus
ccacgaaatgaggaagatgcaacag

SEQ ID NO: 899221 - DNA, 25 bp, Mus musculus
ccacgaacaactgcaccagggacct

SEQ ID NO: 899222 - DNA, 25 bp, Mus musculus
ccacgaacaagtgcaccagggacct

SEQ ID NO: 899223 - DNA, 25 bp, Mus musculus
ccacgacagggctccgagccgcaag

SEQ ID NO: 899224 - DNA, 25 bp, Mus musculus
ccacgacagggctcggagccgcaag

SEQ ID NO: 899225 - DNA, 25 bp, Mus musculus
ccacgacctcagctgcccggagagg

SEQ ID NO: 899226 - DNA, 25 bp, Mus musculus
ccacgacctcaggtgcccggagagg

SEQ ID NO: 899227 - DNA, 25 bp, Mus musculus
ccacgacgcactgaaggaggactgg

SEQ ID NO: 899228 - DNA, 25 bp, Mus musculus
ccacgacgcagtgaaggaggactgg

SEQ ID NO: 899229 - DNA, 25 bp, Mus musculus
ccacgactgcctacaagaaaacgca

SEQ ID NO: 899230 - DNA, 25 bp, Mus musculus
ccacgactgcgtacaagaaaacgca

SEQ ID NO: 899231 - DNA, 25 bp, Mus musculus
ccacgagaacaggacatttggtccg

SEQ ID NO: 899232 - DNA, 25 bp, Mus musculus
ccacgagaacctcattgggctactg

SEQ ID NO: 899233 - DNA, 25 bp, Mus musculus
ccacgagaacgtcattgggctactg

SEQ ID NO: 899234 - DNA, 25 bp, Mus musculus
ccacgagaactggacatttggtccg

SEQ ID NO: 899235 - DNA, 25 bp, Mus musculus
ccacgagaggcttttttgcagattt

SEQ ID NO: 899236 - DNA, 25 bp, Mus musculus
ccacgagagggttttttgcagattt

SEQ ID NO: 899237 - DNA, 25 bp, Mus musculus
ccacgagcagataagaggagtcctc

SEQ ID NO: 899238 - DNA, 25 bp, Mus musculus
ccacgagcagatgttccaagttgcc

SEQ ID NO: 899239 - DNA, 25 bp, Mus musculus
ccacgagcagttaagaggagtcctc

SEQ ID NO: 899240 - DNA, 25 bp, Mus musculus
ccacgagcagttgttccaagttgcc

SEQ ID NO: 899241 - DNA, 25 bp, Mus musculus
ccacgagcgctaaatggtgtcaggt

SEQ ID NO: 899242 - DNA, 25 bp, Mus musculus
ccacgagcgctatatggtgtcaggt

SEQ ID NO: 899243 - DNA, 25 bp, Mus musculus
ccacgaggagcacgagcagttgagg

SEQ ID NO: 899244 - DNA, 25 bp, Mus musculus
ccacgaggaggacgagcagttgagg

SEQ ID NO: 899245 - DNA, 25 bp, Mus musculus
ccacgagtcagcccactgatcgagt

SEQ ID NO: 899246 - DNA, 25 bp, Mus musculus
ccacgagtcagcgcactgatcgagt

SEQ ID NO: 899247 - DNA, 25 bp, Mus musculus
ccacgagtgcagcgacaccccagcc

SEQ ID NO: 899248 - DNA, 25 bp, Mus musculus
ccacgagtgcagggacaccccagcc

SEQ ID NO: 899249 - DNA, 25 bp, Mus musculus
ccacgatgtgtgcaaattctctgca

SEQ ID NO: 899250 - DNA, 25 bp, Mus musculus
ccacgatgtgtggaaattctctgca

SEQ ID NO: 899251 - DNA, 25 bp, Mus musculus
ccacgcagagcaaagatggtccaga

SEQ ID NO: 899252 - DNA, 25 bp, Mus musculus
ccacgcagagcgaaggtgtgaacct

SEQ ID NO: 899253 - DNA, 25 bp, Mus musculus
ccacgcagaggaaagatggtccaga

SEQ ID NO: 899254 - DNA, 25 bp, Mus musculus
ccacgcagagggaaggtgtgaacct

SEQ ID NO: 899255 - DNA, 25 bp, Mus musculus
ccacgcattttgcccgaacccagat

SEQ ID NO: 899256 - DNA, 25 bp, Mus musculus
ccacgcattttgccggaacccagat

SEQ ID NO: 899257 - DNA, 25 bp, Mus musculus
ccacgccaaactctcgtggataccc

SEQ ID NO: 899258 - DNA, 25 bp, Mus musculus
ccacgccaaactctcgttcttctgg

SEQ ID NO: 899259 - DNA, 25 bp, Mus musculus
ccacgccaaactctggtggataccc

SEQ ID NO: 899260 - DNA, 25 bp, Mus musculus
ccacgccaaactctggttcttctgg

SEQ ID NO: 899261 - DNA, 25 bp, Mus musculus
ccacgccatgccaacgctagcagta

SEQ ID NO: 899262 - DNA, 25 bp, Mus musculus
ccacgccatgccaaggctagcagta

SEQ ID NO: 899263 - DNA, 25 bp, Mus musculus
ccacgcccaacacgtaccgctatta

SEQ ID NO: 899264 - DNA, 25 bp, Mus musculus
ccacgcccaacaggtaccgctatta

SEQ ID NO: 899265 - DNA, 25 bp, Mus musculus
ccacgccccttccccggcagcagga

SEQ ID NO: 899266 - DNA, 25 bp, Mus musculus
ccacgccccttcccgggcagcagga

SEQ ID NO: 899267 - DNA, 25 bp, Mus musculus
ccacgcctgaatctggcaggtgatc

SEQ ID NO: 899268 - DNA, 25 bp, Mus musculus
ccacgcctgattctggcaggtgatc

SEQ ID NO: 899269 - DNA, 25 bp, Mus musculus
ccacgcctgcctggcgaatgaattc

SEQ ID NO: 899270 - DNA, 25 bp, Mus musculus
ccacgcctgcctggggaatgaattc

SEQ ID NO: 899271 - DNA, 25 bp, Mus musculus
ccacgcgccaggcaatggacctgtc

SEQ ID NO: 899272 - DNA, 25 bp, Mus musculus
ccacgcgccagggaatggacctgtc

SEQ ID NO: 899273 - DNA, 25 bp, Mus musculus
ccacgcgggattcccgtcacagttt

SEQ ID NO: 899274 - DNA, 25 bp, Mus musculus
ccacgcgggattccggtcacagttt

SEQ ID NO: 899275 - DNA, 25 bp, Mus musculus
ccacgctacactcgagagtacagtt

SEQ ID NO: 899276 - DNA, 25 bp, Mus musculus
ccacgctacagtcgagagtacagtt

SEQ ID NO: 899277 - DNA, 25 bp, Mus musculus
ccacgctggccacacagctgcagca

SEQ ID NO: 899278 - DNA, 25 bp, Mus musculus
ccacgctggccacgtattgttagaa

SEQ ID NO: 899279 - DNA, 25 bp, Mus musculus
ccacgctggccagacagctgcagca

SEQ ID NO: 899280 - DNA, 25 bp, Mus musculus
ccacgctggccaggtattgttagaa

SEQ ID NO: 899281 - DNA, 25 bp, Mus musculus
ccacggaaagcccatgtagaagacg

SEQ ID NO: 899282 - DNA, 25 bp, Mus musculus
ccacggaaaggccatgtagaagacg

SEQ ID NO: 899283 - DNA, 25 bp, Mus musculus
ccacggaacaagctagatgccaccc

SEQ ID NO: 899284 - DNA, 25 bp, Mus musculus
ccacggaacaaggtagatgccaccc

SEQ ID NO: 899285 - DNA, 25 bp, Mus musculus
ccacggaaccaacgtggctatggcg

SEQ ID NO: 899286 - DNA, 25 bp, Mus musculus
ccacggaaccaaggtggctatggcg

SEQ ID NO: 899287 - DNA, 25 bp, Mus musculus
ccacggaagtgacacaatgaatcgc

SEQ ID NO: 899288 - DNA, 25 bp, Mus musculus
ccacggaagtgacagaatgaatcgc

SEQ ID NO: 899289 - DNA, 25 bp, Mus musculus
ccacggagaggacggagggagccat

SEQ ID NO: 899290 - DNA, 25 bp, Mus musculus
ccacggagaggagggagggagccat

SEQ ID NO: 899291 - DNA, 25 bp, Mus musculus
ccacggaggatgacccgcatggttc

SEQ ID NO: 899292 - DNA, 25 bp, Mus musculus
ccacggaggatgaggatgaggaaga

SEQ ID NO: 899293 - DNA, 25 bp, Mus musculus
ccacggaggatgtcccgcatggttc

SEQ ID NO: 899294 - DNA, 25 bp, Mus musculus
ccacggaggatgtggatgaggaaga

SEQ ID NO: 899295 - DNA, 25 bp, Mus musculus
ccacggcatgcacaggaatctgggg

SEQ ID NO: 899296 - DNA, 25 bp, Mus musculus
ccacggcatgcacggtgtgtctgca

SEQ ID NO: 899297 - DNA, 25 bp, Mus musculus
ccacggcatgcagaggaatctgggg

SEQ ID NO: 899298 - DNA, 25 bp, Mus musculus
ccacggcatgcaggagaaggaggga

SEQ ID NO: 899299 - DNA, 25 bp, Mus musculus
ccacggcatgcagggtgtgtctgca

SEQ ID NO: 899300 - DNA, 25 bp, Mus musculus
ccacggcatggaggagaaggaggga

SEQ ID NO: 899301 - DNA, 25 bp, Mus musculus
ccacggccatggcgtctgtgacagc

SEQ ID NO: 899302 - DNA, 25 bp, Mus musculus
ccacggccatggggtctgtgacagc

SEQ ID NO: 899303 - DNA, 25 bp, Mus musculus
ccacggcctgcacgagacctggtac

SEQ ID NO: 899304 - DNA, 25 bp, Mus musculus
ccacggcctgcaggagacctggtac

SEQ ID NO: 899305 - DNA, 25 bp, Mus musculus
ccacggctccaacgatgccaacaag

SEQ ID NO: 899306 - DNA, 25 bp, Mus musculus
ccacggctccaaggatgccaacaag

SEQ ID NO: 899307 - DNA, 25 bp, Mus musculus
ccacgggattgaatattgcctggat

SEQ ID NO: 899308 - DNA, 25 bp, Mus musculus
ccacgggattgattattgcctggat

SEQ ID NO: 899309 - DNA, 25 bp, Mus musculus
ccacgggcagagacttaaagttctt

SEQ ID NO: 899310 - DNA, 25 bp, Mus musculus
ccacgggcagtgacttaaagttctt

SEQ ID NO: 899311 - DNA, 25 bp, Mus musculus
ccacgggccccgcacccacagccgc

SEQ ID NO: 899312 - DNA, 25 bp, Mus musculus
ccacgggccccgcagccacagccgc

SEQ ID NO: 899313 - DNA, 25 bp, Mus musculus
ccacggggccagccatcttcatgct

SEQ ID NO: 899314 - DNA, 25 bp, Mus musculus
ccacggggccaggcatcttcatgct

SEQ ID NO: 899315 - DNA, 25 bp, Mus musculus
ccacggtcatcgatgaagttcgcac

SEQ ID NO: 899316 - DNA, 25 bp, Mus musculus
ccacggtcatcgttgaagttcgcac

SEQ ID NO: 899317 - DNA, 25 bp, Mus musculus
ccacggtgctggcccagcgactctg

SEQ ID NO: 899318 - DNA, 25 bp, Mus musculus
ccacggtgctgggccagcgactctg

SEQ ID NO: 899319 - DNA, 25 bp, Mus musculus
ccacgtaaagatggagaaatggagg

SEQ ID NO: 899320 - DNA, 25 bp, Mus musculus
ccacgtaaagttggagaaatggagg

SEQ ID NO: 899321 - DNA, 25 bp, Mus musculus
ccacgtacctagaacaccacgctgc

SEQ ID NO: 899322 - DNA, 25 bp, Mus musculus
ccacgtacctagtacaccacgctgc

SEQ ID NO: 899323 - DNA, 25 bp, Mus musculus
ccacgtacctcacgctcatgtacag

SEQ ID NO: 899324 - DNA, 25 bp, Mus musculus
ccacgtacctcactacaagcccacc

SEQ ID NO: 899325 - DNA, 25 bp, Mus musculus
ccacgtacctcacttctggctcaag

SEQ ID NO: 899326 - DNA, 25 bp, Mus musculus
ccacgtacctcaggctcatgtacag

SEQ ID NO: 899327 - DNA, 25 bp, Mus musculus
ccacgtacctcagtacaagcccacc

SEQ ID NO: 899328 - DNA, 25 bp, Mus musculus
ccacgtacctcagttctggctcaag

SEQ ID NO: 899329 - DNA, 25 bp, Mus musculus
ccacgtatgcagcctctgcctggta

SEQ ID NO: 899330 - DNA, 25 bp, Mus musculus
ccacgtatgcaggctctgcctggta

SEQ ID NO: 899331 - DNA, 25 bp, Mus musculus
ccacgtcacaacagcctggccctaa

SEQ ID NO: 899332 - DNA, 25 bp, Mus musculus
ccacgtcacaactgcctggccctaa

SEQ ID NO: 899333 - DNA, 25 bp, Mus musculus
ccacgtgacgagcgcagaactttcc

SEQ ID NO: 899334 - DNA, 25 bp, Mus musculus
ccacgtgacgagggcagaactttcc

SEQ ID NO: 899335 - DNA, 25 bp, Mus musculus
ccacgtgcaaagctttctgcaaaga

SEQ ID NO: 899336 - DNA, 25 bp, Mus musculus
ccacgtgcaaaggtttctgcaaaga

SEQ ID NO: 899337 - DNA, 25 bp, Mus musculus
ccacgtgcgtccttcttgccacctg

SEQ ID NO: 899338 - DNA, 25 bp, Mus musculus
ccacgtgcgtgcttcttgccacctg

SEQ ID NO: 899339 - DNA, 25 bp, Mus musculus
ccacgtggcacccggtcccagtgcc

SEQ ID NO: 899340 - DNA, 25 bp, Mus musculus
ccacgtggcaccgggtcccagtgcc

SEQ ID NO: 899341 - DNA, 25 bp, Mus musculus
ccacgtggcctccacaagccaccat

SEQ ID NO: 899342 - DNA, 25 bp, Mus musculus
ccacgtggcctccagaagccaccat

SEQ ID NO: 899343 - DNA, 25 bp, Mus musculus
ccacgtgtgcagcgtcctgtgggca

SEQ ID NO: 899344 - DNA, 25 bp, Mus musculus
ccacgtgtgcagggtcctgtgggca

SEQ ID NO: 899345 - DNA, 25 bp, Mus musculus
ccacgtgttcaacgtgtttgtggcc

SEQ ID NO: 899346 - DNA, 25 bp, Mus musculus
ccacgtgttcaaggtgtttgtggcc

SEQ ID NO: 899347 - DNA, 25 bp, Mus musculus
ccacgttgccgaatttgtcctggat

SEQ ID NO: 899348 - DNA, 25 bp, Mus musculus
ccacgttgccgacaacctgccagat

SEQ ID NO: 899349 - DNA, 25 bp, Mus musculus
ccacgttgccgacttcctggtggct

SEQ ID NO: 899350 - DNA, 25 bp, Mus musculus
ccacgttgccgagaacctgccagat

SEQ ID NO: 899351 - DNA, 25 bp, Mus musculus
ccacgttgccgagttcctggtggct

SEQ ID NO: 899352 - DNA, 25 bp, Mus musculus
ccacgttgccgattttgtcctggat

SEQ ID NO: 899353 - DNA, 25 bp, Mus musculus
ccactaacatctaacgtgccaagtg

SEQ ID NO: 899354 - DNA, 25 bp, Mus musculus
ccactaacatctaaggtgccaagtg

SEQ ID NO: 899355 - DNA, 25 bp, Mus musculus
ccactaagagcccacgttgtctgtt

SEQ ID NO: 899356 - DNA, 25 bp, Mus musculus
ccactaagagcccactgccatgtcg

SEQ ID NO: 899357 - DNA, 25 bp, Mus musculus
ccactaagagcccaggttgtctgtt

SEQ ID NO: 899358 - DNA, 25 bp, Mus musculus
ccactaagagcccagtgccatgtcg

SEQ ID NO: 899359 - DNA, 25 bp, Mus musculus
ccactaccaaccaccagcacccagt

SEQ ID NO: 899360 - DNA, 25 bp, Mus musculus
ccactaccaagcaccagcacccagt

SEQ ID NO: 899361 - DNA, 25 bp, Mus musculus
ccactaccccgggacgcaccaggat

SEQ ID NO: 899362 - DNA, 25 bp, Mus musculus
ccactaccccgggaggcaccaggat

SEQ ID NO: 899363 - DNA, 25 bp, Mus musculus
ccactaggtgcactgcatatgtacc

SEQ ID NO: 899364 - DNA, 25 bp, Mus musculus
ccactaggtggactgcatatgtacc

SEQ ID NO: 899365 - DNA, 25 bp, Mus musculus
ccactagtccagttcggttgccatc

SEQ ID NO: 899366 - DNA, 25 bp, Mus musculus
ccactagtccagttgggttgccatc

SEQ ID NO: 899367 - DNA, 25 bp, Mus musculus
ccactagtcggacgtgtatcgttac

SEQ ID NO: 899368 - DNA, 25 bp, Mus musculus
ccactagtcggacttacagccgctg

SEQ ID NO: 899369 - DNA, 25 bp, Mus musculus
ccactagtcggaggtgtatcgttac

SEQ ID NO: 899370 - DNA, 25 bp, Mus musculus
ccactagtcggagttacagccgctg

SEQ ID NO: 899371 - DNA, 25 bp, Mus musculus
ccactatatcaacactctctctttg

SEQ ID NO: 899372 - DNA, 25 bp, Mus musculus
ccactatatcaagactctctctttg

SEQ ID NO: 899373 - DNA, 25 bp, Mus musculus
ccactattaaaacagggtgcctcag

SEQ ID NO: 899374 - DNA, 25 bp, Mus musculus
ccactattaaaagagggtgcctcag

SEQ ID NO: 899375 - DNA, 25 bp, Mus musculus
ccactattaaacctggtgatgactg

SEQ ID NO: 899376 - DNA, 25 bp, Mus musculus
ccactattaatcctggtgatgactg

SEQ ID NO: 899377 - DNA, 25 bp, Mus musculus
ccactattggcgcatctttcatgac

SEQ ID NO: 899378 - DNA, 25 bp, Mus musculus
ccactattggcttaagtttgctgtg

SEQ ID NO: 899379 - DNA, 25 bp, Mus musculus
ccactattggggcatctttcatgac

SEQ ID NO: 899380 - DNA, 25 bp, Mus musculus
ccactattgggttaagtttgctgtg

SEQ ID NO: 899381 - DNA, 25 bp, Mus musculus
ccactcaaacaacgttcagagtctc

SEQ ID NO: 899382 - DNA, 25 bp, Mus musculus
ccactcaaacaaggttcagagtctc

SEQ ID NO: 899383 - DNA, 25 bp, Mus musculus
ccactcacaccaaacgagtgccagg

SEQ ID NO: 899384 - DNA, 25 bp, Mus musculus
ccactcacaccaaaggagtgccagg

SEQ ID NO: 899385 - DNA, 25 bp, Mus musculus
ccactcagacagcgttcctccagcc

SEQ ID NO: 899386 - DNA, 25 bp, Mus musculus
ccactcagacagggttcctccagcc

SEQ ID NO: 899387 - DNA, 25 bp, Mus musculus
ccactcaggtcacacagaccgatga

SEQ ID NO: 899388 - DNA, 25 bp, Mus musculus
ccactcaggtcacagagaccgatga

SEQ ID NO: 899389 - DNA, 25 bp, Mus musculus
ccactcatcttgcaaaggacttggt

SEQ ID NO: 899390 - DNA, 25 bp, Mus musculus
ccactcatcttggaaaggacttggt

SEQ ID NO: 899391 - DNA, 25 bp, Mus musculus
ccactcatggagctgacctgcaggc

SEQ ID NO: 899392 - DNA, 25 bp, Mus musculus
ccactcatggtgctgacctgcaggc

SEQ ID NO: 899393 - DNA, 25 bp, Mus musculus
ccactcattcagcgagtgttgtgaa

SEQ ID NO: 899394 - DNA, 25 bp, Mus musculus
ccactcattcagggagtgttgtgaa

SEQ ID NO: 899395 - DNA, 25 bp, Mus musculus
ccactcattgccctgggtgtgatca

SEQ ID NO: 899396 - DNA, 25 bp, Mus musculus
ccactcattggcctgggtgtgatca

SEQ ID NO: 899397 - DNA, 25 bp, Mus musculus
ccactccaccggctatgaagctaaa

SEQ ID NO: 899398 - DNA, 25 bp, Mus musculus
ccactccaccgggtatgaagctaaa

SEQ ID NO: 899399 - DNA, 25 bp, Mus musculus
ccactcccaatgaccgtcaagatgc

SEQ ID NO: 899400 - DNA, 25 bp, Mus musculus
ccactcccaatgacggtcaagatgc

SEQ ID NO: 899401 - DNA, 25 bp, Mus musculus
ccactccctctgcctctctcaaaag

SEQ ID NO: 899402 - DNA, 25 bp, Mus musculus
ccactccctctggctctctcaaaag

SEQ ID NO: 899403 - DNA, 25 bp, Mus musculus
ccactccggacacacaatatccagt

SEQ ID NO: 899404 - DNA, 25 bp, Mus musculus
ccactccggacacagaatatccagt

SEQ ID NO: 899405 - DNA, 25 bp, Mus musculus
ccactccttccacgatcccctgccg

SEQ ID NO: 899406 - DNA, 25 bp, Mus musculus
ccactccttccaggatcccctgccg

SEQ ID NO: 899407 - DNA, 25 bp, Mus musculus
ccactcggagagcctgcgagctggc

SEQ ID NO: 899408 - DNA, 25 bp, Mus musculus
ccactcggagtgcctgcgagctggc

SEQ ID NO: 899409 - DNA, 25 bp, Mus musculus
ccactctccgaaagtaaatcaccca

SEQ ID NO: 899410 - DNA, 25 bp, Mus musculus
ccactctccgaatgtaaatcaccca

SEQ ID NO: 899411 - DNA, 25 bp, Mus musculus
ccactctccgatcaacaggttccaa

SEQ ID NO: 899412 - DNA, 25 bp, Mus musculus
ccactctccgttcaacaggttccaa

SEQ ID NO: 899413 - DNA, 25 bp, Mus musculus
ccactctctcatcggctcaataaac

SEQ ID NO: 899414 - DNA, 25 bp, Mus musculus
ccactctctcatgggctcaataaac

SEQ ID NO: 899415 - DNA, 25 bp, Mus musculus
ccactctgaactaaacatctctgaa

SEQ ID NO: 899416 - DNA, 25 bp, Mus musculus
ccactctgaacttaacatctctgaa

SEQ ID NO: 899417 - DNA, 25 bp, Mus musculus
ccactctgtcaacgcccgagaccag

SEQ ID NO: 899418 - DNA, 25 bp, Mus musculus
ccactctgtcaaggcccgagaccag

SEQ ID NO: 899419 - DNA, 25 bp, Mus musculus
ccactgaccgagaagtgcccccgcc

SEQ ID NO: 899420 - DNA, 25 bp, Mus musculus
ccactgaccgagtagtgcccccgcc

SEQ ID NO: 899421 - DNA, 25 bp, Mus musculus
ccactgacgtgacgaccccccagcc

SEQ ID NO: 899422 - DNA, 25 bp, Mus musculus
ccactgacgtgaggaccccccagcc

SEQ ID NO: 899423 - DNA, 25 bp, Mus musculus
ccactgatcctggacgctgttcatc

SEQ ID NO: 899424 - DNA, 25 bp, Mus musculus
ccactgatcctggaggctgttcatc

SEQ ID NO: 899425 - DNA, 25 bp, Mus musculus
ccactgattaagcattcaggagggg

SEQ ID NO: 899426 - DNA, 25 bp, Mus musculus
ccactgattaaggattcaggagggg

SEQ ID NO: 899427 - DNA, 25 bp, Mus musculus
ccactgcaaaaacgacaactgcccc

SEQ ID NO: 899428 - DNA, 25 bp, Mus musculus
ccactgcaaaaaggacaactgcccc

SEQ ID NO: 899429 - DNA, 25 bp, Mus musculus
ccactgcaagcgcgaagaaagccaa

SEQ ID NO: 899430 - DNA, 25 bp, Mus musculus
ccactgcaagcgggaagaaagccaa

SEQ ID NO: 899431 - DNA, 25 bp, Mus musculus
ccactgcaggatttctggcaccaga

SEQ ID NO: 899432 - DNA, 25 bp, Mus musculus
ccactgcaggttttctggcaccaga

SEQ ID NO: 899433 - DNA, 25 bp, Mus musculus
ccactgcattcaacagcgtctgttg

SEQ ID NO: 899434 - DNA, 25 bp, Mus musculus
ccactgcattgaacagcgtctgttg

SEQ ID NO: 899435 - DNA, 25 bp, Mus musculus
ccactgccagaacatctgcagaggt

SEQ ID NO: 899436 - DNA, 25 bp, Mus musculus
ccactgccagaagatctgcagaggt

SEQ ID NO: 899437 - DNA, 25 bp, Mus musculus
ccactgccataatgacaagtaccag

SEQ ID NO: 899438 - DNA, 25 bp, Mus musculus
ccactgccataatgtcaagtaccag

SEQ ID NO: 899439 - DNA, 25 bp, Mus musculus
ccactgccatgtcacccagtataat

SEQ ID NO: 899440 - DNA, 25 bp, Mus musculus
ccactgccatgtcagccagtataat

SEQ ID NO: 899441 - DNA, 25 bp, Mus musculus
ccactgcccaaactcaccagaggac

SEQ ID NO: 899442 - DNA, 25 bp, Mus musculus
ccactgcccaaagtcaccagaggac

SEQ ID NO: 899443 - DNA, 25 bp, Mus musculus
ccactgccccgcgacctaaaatggg

SEQ ID NO: 899444 - DNA, 25 bp, Mus musculus
ccactgccccgcgagctaaaatggg

SEQ ID NO: 899445 - DNA, 25 bp, Mus musculus
ccactgccggatcctaataactatt

SEQ ID NO: 899446 - DNA, 25 bp, Mus musculus
ccactgccggttcctaataactatt

SEQ ID NO: 899447 - DNA, 25 bp, Mus musculus
ccactgcgggcccaccagcccctgg

SEQ ID NO: 899448 - DNA, 25 bp, Mus musculus
ccactgcgggcccaccccctggcgc

SEQ ID NO: 899449 - DNA, 25 bp, Mus musculus
ccactgcgggcccacttgctgatag

SEQ ID NO: 899450 - DNA, 25 bp, Mus musculus
ccactgcgggcccagcagcccctgg

SEQ ID NO: 899451 - DNA, 25 bp, Mus musculus
ccactgcgggcccagcccctggcgc

SEQ ID NO: 899452 - DNA, 25 bp, Mus musculus
ccactgcgggcccagttgctgatag

SEQ ID NO: 899453 - DNA, 25 bp, Mus musculus
ccactgctatggcaaccagtataat

SEQ ID NO: 899454 - DNA, 25 bp, Mus musculus
ccactgctatggcatccagtataat

SEQ ID NO: 899455 - DNA, 25 bp, Mus musculus
ccactgctcagacccaccagaggac

SEQ ID NO: 899456 - DNA, 25 bp, Mus musculus
ccactgctcagagccaccagaggac

SEQ ID NO: 899457 - DNA, 25 bp, Mus musculus
ccactggatcctgacccacgctgtt

SEQ ID NO: 899458 - DNA, 25 bp, Mus musculus
ccactggatcctgagccacgctgtt

SEQ ID NO: 899459 - DNA, 25 bp, Mus musculus
ccactggcactacacatgctcatga

SEQ ID NO: 899460 - DNA, 25 bp, Mus musculus
ccactggcactacagatgctcatga

SEQ ID NO: 899461 - DNA, 25 bp, Mus musculus
ccactggcagctcaaaaatgtgatg

SEQ ID NO: 899462 - DNA, 25 bp, Mus musculus
ccactggcaggtcaaaaatgtgatg

SEQ ID NO: 899463 - DNA, 25 bp, Mus musculus
ccactgggcccccgtgaaagctatg

SEQ ID NO: 899464 - DNA, 25 bp, Mus musculus
ccactgggccccggtgaaagctatg

SEQ ID NO: 899465 - DNA, 25 bp, Mus musculus
ccactgggcgcacggcgaaagatga

SEQ ID NO: 899466 - DNA, 25 bp, Mus musculus
ccactgggcgcagggcgaaagatga

SEQ ID NO: 899467 - DNA, 25 bp, Mus musculus
ccactggggaggaacgtgacctggc

SEQ ID NO: 899468 - DNA, 25 bp, Mus musculus
ccactggggaggaaggtgacctggc

SEQ ID NO: 899469 - DNA, 25 bp, Mus musculus
ccactggtcaacacaaaacacagat

SEQ ID NO: 899470 - DNA, 25 bp, Mus musculus
ccactggtcaacactaaacacagat

SEQ ID NO: 899471 - DNA, 25 bp, Mus musculus
ccactggtggcggccatgtaggagt

SEQ ID NO: 899472 - DNA, 25 bp, Mus musculus
ccactggtgggggccatgtaggagt

SEQ ID NO: 899473 - DNA, 25 bp, Mus musculus
ccactggttgagatcctctttagga

SEQ ID NO: 899474 - DNA, 25 bp, Mus musculus
ccactggttgagcgcaatggcatct

SEQ ID NO: 899475 - DNA, 25 bp, Mus musculus
ccactggttgagggcaatggcatct

SEQ ID NO: 899476 - DNA, 25 bp, Mus musculus
ccactggttgagttcctctttagga

SEQ ID NO: 899477 - DNA, 25 bp, Mus musculus
ccactgtacgagatggaggccacct

SEQ ID NO: 899478 - DNA, 25 bp, Mus musculus
ccactgtacgtgatggaggccacct

SEQ ID NO: 899479 - DNA, 25 bp, Mus musculus
ccactgtgtcagctgtggcccatag

SEQ ID NO: 899480 - DNA, 25 bp, Mus musculus
ccactgtgtcaggtgtggcccatag

SEQ ID NO: 899481 - DNA, 25 bp, Mus musculus
ccactgtgtggaagaacccctcagc

SEQ ID NO: 899482 - DNA, 25 bp, Mus musculus
ccactgtgtggaagtacccctcagc

SEQ ID NO: 899483 - DNA, 25 bp, Mus musculus
ccactgtgttgaccacatcgagtca

SEQ ID NO: 899484 - DNA, 25 bp, Mus musculus
ccactgtgttgacgtcctgagttca

SEQ ID NO: 899485 - DNA, 25 bp, Mus musculus
ccactgtgttgagcacatcgagtca

SEQ ID NO: 899486 - DNA, 25 bp, Mus musculus
ccactgtgttgaggtcctgagttca

SEQ ID NO: 899487 - DNA, 25 bp, Mus musculus
ccacttaaagcgtgcctcagccaac

SEQ ID NO: 899488 - DNA, 25 bp, Mus musculus
ccacttaaagggtgcctcagccaac

SEQ ID NO: 899489 - DNA, 25 bp, Mus musculus
ccacttaagaccaattactgacagt

SEQ ID NO: 899490 - DNA, 25 bp, Mus musculus
ccacttaagacctattactgacagt

SEQ ID NO: 899491 - DNA, 25 bp, Mus musculus
ccacttacacagataccaggaatgg

SEQ ID NO: 899492 - DNA, 25 bp, Mus musculus
ccacttacacagttaccaggaatgg

SEQ ID NO: 899493 - DNA, 25 bp, Mus musculus
ccacttatcacttcattgtatctgg

SEQ ID NO: 899494 - DNA, 25 bp, Mus musculus
ccacttatcagttcattgtatctgg

SEQ ID NO: 899495 - DNA, 25 bp, Mus musculus
ccacttcaacagcactcatttcacc

SEQ ID NO: 899496 - DNA, 25 bp, Mus musculus
ccacttcaacaggactcatttcacc

SEQ ID NO: 899497 - DNA, 25 bp, Mus musculus
ccacttcaagatcaaagatcctgct

SEQ ID NO: 899498 - DNA, 25 bp, Mus musculus
ccacttcaagttcaaagatcctgct

SEQ ID NO: 899499 - DNA, 25 bp, Mus musculus
ccacttcagcaccacatccctgctg

SEQ ID NO: 899500 - DNA, 25 bp, Mus musculus
ccacttcagcaccagatccctgctg

SEQ ID NO: 899501 - DNA, 25 bp, Mus musculus
ccacttcgaaaacgctcgggatgtg

SEQ ID NO: 899502 - DNA, 25 bp, Mus musculus
ccacttcgaaaaggctcgggatgtg

SEQ ID NO: 899503 - DNA, 25 bp, Mus musculus
ccacttcgggcactcagcaccagtt

SEQ ID NO: 899504 - DNA, 25 bp, Mus musculus
ccacttcgggcactgagcaccagtt

SEQ ID NO: 899505 - DNA, 25 bp, Mus musculus
ccacttgaagctggacttcatggaa

SEQ ID NO: 899506 - DNA, 25 bp, Mus musculus
ccacttgaaggtggacttcatggaa

SEQ ID NO: 899507 - DNA, 25 bp, Mus musculus
ccacttgactcggacgtggaacacc

SEQ ID NO: 899508 - DNA, 25 bp, Mus musculus
ccacttgactgggacgtggaacacc

SEQ ID NO: 899509 - DNA, 25 bp, Mus musculus
ccacttgcagcacggtggtgctcca

SEQ ID NO: 899510 - DNA, 25 bp, Mus musculus
ccacttgcagcagggtggtgctcca

SEQ ID NO: 899511 - DNA, 25 bp, Mus musculus
ccacttgcgacacagagaagaagcc

SEQ ID NO: 899512 - DNA, 25 bp, Mus musculus
ccacttgcgacagagagaagaagcc

SEQ ID NO: 899513 - DNA, 25 bp, Mus musculus
ccacttggatcacacgtacctggaa

SEQ ID NO: 899514 - DNA, 25 bp, Mus musculus
ccacttggatcacaggtacctggaa

SEQ ID NO: 899515 - DNA, 25 bp, Mus musculus
ccacttggggaaccctgagatgggg

SEQ ID NO: 899516 - DNA, 25 bp, Mus musculus
ccacttggggaagcctgagatgggg

SEQ ID NO: 899517 - DNA, 25 bp, Mus musculus
ccacttgtcacagcactgtctatga

SEQ ID NO: 899518 - DNA, 25 bp, Mus musculus
ccacttgtcacagctctgtctatga

SEQ ID NO: 899519 - DNA, 25 bp, Mus musculus
ccagaaaaagtcaacgtgatgttag

SEQ ID NO: 899520 - DNA, 25 bp, Mus musculus
ccagaaaaagtcaaggtgatgttag

SEQ ID NO: 899521 - DNA, 25 bp, Mus musculus
ccagaaaatgcacatttgggcttcc

SEQ ID NO: 899522 - DNA, 25 bp, Mus musculus
ccagaaaatggacatttgggcttcc

SEQ ID NO: 899523 - DNA, 25 bp, Mus musculus
ccagaaacagatctggagaattgaa

SEQ ID NO: 899524 - DNA, 25 bp, Mus musculus
ccagaaacagttctggagaattgaa

SEQ ID NO: 899525 - DNA, 25 bp, Mus musculus
ccagaaacatgtaggcctcattcac

SEQ ID NO: 899526 - DNA, 25 bp, Mus musculus
ccagaaacatgttggcctcattcac

SEQ ID NO: 899527 - DNA, 25 bp, Mus musculus
ccagaaagagaccagcagcacgccg

SEQ ID NO: 899528 - DNA, 25 bp, Mus musculus
ccagaaagagatcacatccctgaat

SEQ ID NO: 899529 - DNA, 25 bp, Mus musculus
ccagaaagagatcagatccctgaat

SEQ ID NO: 899530 - DNA, 25 bp, Mus musculus
ccagaaagagtccagcagcacgccg

SEQ ID NO: 899531 - DNA, 25 bp, Mus musculus
ccagaaagccaagtcaaacacccat

SEQ ID NO: 899532 - DNA, 25 bp, Mus musculus
ccagaaagccaagtgaaacacccat

SEQ ID NO: 899533 - DNA, 25 bp, Mus musculus
ccagaaagcccacagaaaggaatcc

SEQ ID NO: 899534 - DNA, 25 bp, Mus musculus
ccagaaagcccaccagagaaaggaa

SEQ ID NO: 899535 - DNA, 25 bp, Mus musculus
ccagaaagcccagagaaaggaatcc

SEQ ID NO: 899536 - DNA, 25 bp, Mus musculus
ccagaaagcccagcagagaaaggaa

SEQ ID NO: 899537 - DNA, 25 bp, Mus musculus
ccagaaagcccgtggccctgctcca

SEQ ID NO: 899538 - DNA, 25 bp, Mus musculus
ccagaaagccggtggccctgctcca

SEQ ID NO: 899539 - DNA, 25 bp, Mus musculus
ccagaaagtgatcacagaatacctg

SEQ ID NO: 899540 - DNA, 25 bp, Mus musculus
ccagaaagtgttcacagaatacctg

SEQ ID NO: 899541 - DNA, 25 bp, Mus musculus
ccagaaatagcagcagttgaccttc

SEQ ID NO: 899542 - DNA, 25 bp, Mus musculus
ccagaaataggagcagttgaccttc

SEQ ID NO: 899543 - DNA, 25 bp, Mus musculus
ccagaaatccaacaaaatgtacagg

SEQ ID NO: 899544 - DNA, 25 bp, Mus musculus
ccagaaatccaagaaaatgtacagg

SEQ ID NO: 899545 - DNA, 25 bp, Mus musculus
ccagaaattccacgatgtctgtgtt

SEQ ID NO: 899546 - DNA, 25 bp, Mus musculus
ccagaaattccacgattgctgtgtc

SEQ ID NO: 899547 - DNA, 25 bp, Mus musculus
ccagaaattccaggatgtctgtgtt

SEQ ID NO: 899548 - DNA, 25 bp, Mus musculus
ccagaaattccaggattgctgtgtc

SEQ ID NO: 899549 - DNA, 25 bp, Mus musculus
ccagaacaagagctgaggctgcagc

SEQ ID NO: 899550 - DNA, 25 bp, Mus musculus
ccagaacaagtgctgaggctgcagc

SEQ ID NO: 899551 - DNA, 25 bp, Mus musculus
ccagaacaatcgattggaagaattg

SEQ ID NO: 899552 - DNA, 25 bp, Mus musculus
ccagaacaatcgcgaacagactgct

SEQ ID NO: 899553 - DNA, 25 bp, Mus musculus
ccagaacaatcgggaacagactgct

SEQ ID NO: 899554 - DNA, 25 bp, Mus musculus
ccagaacaatcgtttggaagaattg

SEQ ID NO: 899555 - DNA, 25 bp, Mus musculus
ccagaacagcatcactcaagtgtct

SEQ ID NO: 899556 - DNA, 25 bp, Mus musculus
ccagaacagcatcagtcaagtgtct

SEQ ID NO: 899557 - DNA, 25 bp, Mus musculus
ccagaaccagcccaagaaaggagag

SEQ ID NO: 899558 - DNA, 25 bp, Mus musculus
ccagaaccaggccaagaaaggagag

SEQ ID NO: 899559 - DNA, 25 bp, Mus musculus
ccagaacgacatcaataatgcaaga

SEQ ID NO: 899560 - DNA, 25 bp, Mus musculus
ccagaacgacatgaataatgcaaga

SEQ ID NO: 899561 - DNA, 25 bp, Mus musculus
ccagaagactagattgaggaggagg

SEQ ID NO: 899562 - DNA, 25 bp, Mus musculus
ccagaagactagccgccgtgccacg

SEQ ID NO: 899563 - DNA, 25 bp, Mus musculus
ccagaagactaggcgccgtgccacg

SEQ ID NO: 899564 - DNA, 25 bp, Mus musculus
ccagaagactagtttgaggaggagg

SEQ ID NO: 899565 - DNA, 25 bp, Mus musculus
ccagaagcagccttggttcctgctc

SEQ ID NO: 899566 - DNA, 25 bp, Mus musculus
ccagaagcagcgaaaaggctctagg

SEQ ID NO: 899567 - DNA, 25 bp, Mus musculus
ccagaagcagctactctatctacaa

SEQ ID NO: 899568 - DNA, 25 bp, Mus musculus
ccagaagcagctggtgaatgagcaa

SEQ ID NO: 899569 - DNA, 25 bp, Mus musculus
ccagaagcagctgtccccagaactg

SEQ ID NO: 899570 - DNA, 25 bp, Mus musculus
ccagaagcaggcttggttcctgctc

SEQ ID NO: 899571 - DNA, 25 bp, Mus musculus
ccagaagcagggaaaaggctctagg

SEQ ID NO: 899572 - DNA, 25 bp, Mus musculus
ccagaagcaggtactctatctacaa

SEQ ID NO: 899573 - DNA, 25 bp, Mus musculus
ccagaagcaggtggtgaatgagcaa

SEQ ID NO: 899574 - DNA, 25 bp, Mus musculus
ccagaagcaggtgtccccagaactg

SEQ ID NO: 899575 - DNA, 25 bp, Mus musculus
ccagaagcctcacgaacaaagtgag

SEQ ID NO: 899576 - DNA, 25 bp, Mus musculus
ccagaagcctcaggaacaaagtgag

SEQ ID NO: 899577 - DNA, 25 bp, Mus musculus
ccagaagctagacgaggagcagagg

SEQ ID NO: 899578 - DNA, 25 bp, Mus musculus
ccagaagctagaggaggagcagagg

SEQ ID NO: 899579 - DNA, 25 bp, Mus musculus
ccagaaggaacggaacgctctggag

SEQ ID NO: 899580 - DNA, 25 bp, Mus musculus
ccagaaggaacggatcgctctggag

SEQ ID NO: 899581 - DNA, 25 bp, Mus musculus
ccagaaggagaacctgaacaaccaa

SEQ ID NO: 899582 - DNA, 25 bp, Mus musculus
ccagaaggagatccttaagctgttg

SEQ ID NO: 899583 - DNA, 25 bp, Mus musculus
ccagaaggagcactcaagcacatgc

SEQ ID NO: 899584 - DNA, 25 bp, Mus musculus
ccagaaggagcactgaagcacatgc

SEQ ID NO: 899585 - DNA, 25 bp, Mus musculus
ccagaaggagccggcgctctcgcag

SEQ ID NO: 899586 - DNA, 25 bp, Mus musculus
ccagaaggaggcggcgctctcgcag

SEQ ID NO: 899587 - DNA, 25 bp, Mus musculus
ccagaaggagtacctgaacaaccaa

SEQ ID NO: 899588 - DNA, 25 bp, Mus musculus
ccagaaggagttccttaagctgttg

SEQ ID NO: 899589 - DNA, 25 bp, Mus musculus
ccagaagtatccatcatcagaagta

SEQ ID NO: 899590 - DNA, 25 bp, Mus musculus
ccagaagtatccatcttctgtatct

SEQ ID NO: 899591 - DNA, 25 bp, Mus musculus
ccagaagtatccatgatcagaagta

SEQ ID NO: 899592 - DNA, 25 bp, Mus musculus
ccagaagtatccatgttctgtatct

SEQ ID NO: 899593 - DNA, 25 bp, Mus musculus
ccagaagtcacacaaaccccgagac

SEQ ID NO: 899594 - DNA, 25 bp, Mus musculus
ccagaagtcacagaaaccccgagac

SEQ ID NO: 899595 - DNA, 25 bp, Mus musculus
ccagaagtgcctcacagaggagggc

SEQ ID NO: 899596 - DNA, 25 bp, Mus musculus
ccagaagtgcctcctcttgctccca

SEQ ID NO: 899597 - DNA, 25 bp, Mus musculus
ccagaagtgcctgacagaggagggc

SEQ ID NO: 899598 - DNA, 25 bp, Mus musculus
ccagaagtgcctgctcttgctccca

SEQ ID NO: 899599 - DNA, 25 bp, Mus musculus
ccagaagttccgccctctggccgac

SEQ ID NO: 899600 - DNA, 25 bp, Mus musculus
ccagaagttccggcctctggccgac

SEQ ID NO: 899601 - DNA, 25 bp, Mus musculus
ccagaataaccacctgctggtggga

SEQ ID NO: 899602 - DNA, 25 bp, Mus musculus
ccagaataaccagctgctggtggga

SEQ ID NO: 899603 - DNA, 25 bp, Mus musculus
ccagaatacatgctttacatgttca

SEQ ID NO: 899604 - DNA, 25 bp, Mus musculus
ccagaatacatggtttacatgttca

SEQ ID NO: 899605 - DNA, 25 bp, Mus musculus
ccagaatgagcatcccagaaagctt

SEQ ID NO: 899606 - DNA, 25 bp, Mus musculus
ccagaatgaggatcccagaaagctt

SEQ ID NO: 899607 - DNA, 25 bp, Mus musculus
ccagaatgctgtcggcacactggat

SEQ ID NO: 899608 - DNA, 25 bp, Mus musculus
ccagaatgctgtgggcacactggat

SEQ ID NO: 899609 - DNA, 25 bp, Mus musculus
ccagaatgtgcatcggtcatgggac

SEQ ID NO: 899610 - DNA, 25 bp, Mus musculus
ccagaatgtggatcggtcatgggac

SEQ ID NO: 899611 - DNA, 25 bp, Mus musculus
ccagaatgtgtaattgtaaagtgtg

SEQ ID NO: 899612 - DNA, 25 bp, Mus musculus
ccagaatgtgtatttgtaaagtgtg

SEQ ID NO: 899613 - DNA, 25 bp, Mus musculus
ccagaattactgcatctcccctcaa

SEQ ID NO: 899614 - DNA, 25 bp, Mus musculus
ccagaattactggatctcccctcaa

SEQ ID NO: 899615 - DNA, 25 bp, Mus musculus
ccagaattatggaacgccctgcatt

SEQ ID NO: 899616 - DNA, 25 bp, Mus musculus
ccagaattatggaaggccctgcatt

SEQ ID NO: 899617 - DNA, 25 bp, Mus musculus
ccagacaaagctacactaggaggca

SEQ ID NO: 899618 - DNA, 25 bp, Mus musculus
ccagacaaaggtacactaggaggca

SEQ ID NO: 899619 - DNA, 25 bp, Mus musculus
ccagacaagaagccaagcctggctg

SEQ ID NO: 899620 - DNA, 25 bp, Mus musculus
ccagacaagaagcgaagcaagcctg

SEQ ID NO: 899621 - DNA, 25 bp, Mus musculus
ccagacaagaaggcaagcctggctg

SEQ ID NO: 899622 - DNA, 25 bp, Mus musculus
ccagacaagaagggaagcaagcctg

SEQ ID NO: 899623 - DNA, 25 bp, Mus musculus
ccagacaagtaggtatcgcagggtg

SEQ ID NO: 899624 - DNA, 25 bp, Mus musculus
ccagacaagttggtatcgcagggtg

SEQ ID NO: 899625 - DNA, 25 bp, Mus musculus
ccagacacaacagacgcttccactt

SEQ ID NO: 899626 - DNA, 25 bp, Mus musculus
ccagacacaacagaggcttccactt

SEQ ID NO: 899627 - DNA, 25 bp, Mus musculus
ccagacacagaccacgtgggagcat

SEQ ID NO: 899628 - DNA, 25 bp, Mus musculus
ccagacacagaccaggtgggagcat

SEQ ID NO: 899629 - DNA, 25 bp, Mus musculus
ccagacacagatccgcgtcgtgaag

SEQ ID NO: 899630 - DNA, 25 bp, Mus musculus
ccagacacagttccgcgtcgtgaag

SEQ ID NO: 899631 - DNA, 25 bp, Mus musculus
ccagacacatatgttcagcatatca

SEQ ID NO: 899632 - DNA, 25 bp, Mus musculus
ccagacacatttgttcagcatatca

SEQ ID NO: 899633 - DNA, 25 bp, Mus musculus
ccagacaccatgccagcccactcaa

SEQ ID NO: 899634 - DNA, 25 bp, Mus musculus
ccagacaccatggcagcccactcaa

SEQ ID NO: 899635 - DNA, 25 bp, Mus musculus
ccagacacccagaggctggtccagg

SEQ ID NO: 899636 - DNA, 25 bp, Mus musculus
ccagacacccagtggctggtccagg

SEQ ID NO: 899637 - DNA, 25 bp, Mus musculus
ccagacagtacagacgctttttcag

SEQ ID NO: 899638 - DNA, 25 bp, Mus musculus
ccagacagtacagacgtctatggcc

SEQ ID NO: 899639 - DNA, 25 bp, Mus musculus
ccagacagtacagaggctttttcag

SEQ ID NO: 899640 - DNA, 25 bp, Mus musculus
ccagacagtacagaggtctatggcc

SEQ ID NO: 899641 - DNA, 25 bp, Mus musculus
ccagacagtccaccaggtgacagga

SEQ ID NO: 899642 - DNA, 25 bp, Mus musculus
ccagacagtccagcaggtgacagga

SEQ ID NO: 899643 - DNA, 25 bp, Mus musculus
ccagacataaagctacatacttcac

SEQ ID NO: 899644 - DNA, 25 bp, Mus musculus
ccagacataaaggtacatacttcac

SEQ ID NO: 899645 - DNA, 25 bp, Mus musculus
ccagacatcatcaacgaaagggaac

SEQ ID NO: 899646 - DNA, 25 bp, Mus musculus
ccagacatcatcaaggaaagggaac

SEQ ID NO: 899647 - DNA, 25 bp, Mus musculus
ccagacattgacagccacataacag

SEQ ID NO: 899648 - DNA, 25 bp, Mus musculus
ccagacattgacaggcacataacag

SEQ ID NO: 899649 - DNA, 25 bp, Mus musculus
ccagacattgagccaccacctaccc

SEQ ID NO: 899650 - DNA, 25 bp, Mus musculus
ccagacattgaggcaccacctaccc

SEQ ID NO: 899651 - DNA, 25 bp, Mus musculus
ccagaccaagattgagacactccag

SEQ ID NO: 899652 - DNA, 25 bp, Mus musculus
ccagaccaagcaccacctgttcttc

SEQ ID NO: 899653 - DNA, 25 bp, Mus musculus
ccagaccaagcgtacagcctgttcc

SEQ ID NO: 899654 - DNA, 25 bp, Mus musculus
ccagaccaagctgcacaggaagacg

SEQ ID NO: 899655 - DNA, 25 bp, Mus musculus
ccagaccaaggaccacctgttcttc

SEQ ID NO: 899656 - DNA, 25 bp, Mus musculus
ccagaccaagggtacagcctgttcc

SEQ ID NO: 899657 - DNA, 25 bp, Mus musculus
ccagaccaaggtgcacaggaagacg

SEQ ID NO: 899658 - DNA, 25 bp, Mus musculus
ccagaccaagtttgagacactccag

SEQ ID NO: 899659 - DNA, 25 bp, Mus musculus
ccagaccagaagctctgctgagagg

SEQ ID NO: 899660 - DNA, 25 bp, Mus musculus
ccagaccagaaggtctgctgagagg

SEQ ID NO: 899661 - DNA, 25 bp, Mus musculus
ccagacccacagacttccaaattga

SEQ ID NO: 899662 - DNA, 25 bp, Mus musculus
ccagacccacagaggctcccaaaca

SEQ ID NO: 899663 - DNA, 25 bp, Mus musculus
ccagacccacagtcttccaaattga

SEQ ID NO: 899664 - DNA, 25 bp, Mus musculus
ccagacccacagtggctcccaaaca

SEQ ID NO: 899665 - DNA, 25 bp, Mus musculus
ccagaccctgagctctatgacccct

SEQ ID NO: 899666 - DNA, 25 bp, Mus musculus
ccagaccctgaggtctatgacccct

SEQ ID NO: 899667 - DNA, 25 bp, Mus musculus
ccagaccgcacacgaaatgcaagag

SEQ ID NO: 899668 - DNA, 25 bp, Mus musculus
ccagaccgcacaggaaatgcaagag

SEQ ID NO: 899669 - DNA, 25 bp, Mus musculus
ccagacctcatccacaccagagggc

SEQ ID NO: 899670 - DNA, 25 bp, Mus musculus
ccagacctcatccaccttactggcg

SEQ ID NO: 899671 - DNA, 25 bp, Mus musculus
ccagacctcatccagaccagagggc

SEQ ID NO: 899672 - DNA, 25 bp, Mus musculus
ccagacctcatccagcttactggcg

SEQ ID NO: 899673 - DNA, 25 bp, Mus musculus
ccagacctcatccattccagaatat

SEQ ID NO: 899674 - DNA, 25 bp, Mus musculus
ccagacctcatcgattccagaatat

SEQ ID NO: 899675 - DNA, 25 bp, Mus musculus
ccagacctcgcgacagattgtgatg

SEQ ID NO: 899676 - DNA, 25 bp, Mus musculus
ccagacctcgggacagattgtgatg

SEQ ID NO: 899677 - DNA, 25 bp, Mus musculus
ccagacctggctccagtctgttctc

SEQ ID NO: 899678 - DNA, 25 bp, Mus musculus
ccagacctggctccattccatgagg

SEQ ID NO: 899679 - DNA, 25 bp, Mus musculus
ccagacctggctcctgtctgttctc

SEQ ID NO: 899680 - DNA, 25 bp, Mus musculus
ccagacctggctcctttccatgagg

SEQ ID NO: 899681 - DNA, 25 bp, Mus musculus
ccagacctggctgcccagacccctc

SEQ ID NO: 899682 - DNA, 25 bp, Mus musculus
ccagacctgggtgcccagacccctc

SEQ ID NO: 899683 - DNA, 25 bp, Mus musculus
ccagaccttcagcaagctcttagct

SEQ ID NO: 899684 - DNA, 25 bp, Mus musculus
ccagaccttcagcggctcagctgca

SEQ ID NO: 899685 - DNA, 25 bp, Mus musculus
ccagaccttcagctcttagctgacg

SEQ ID NO: 899686 - DNA, 25 bp, Mus musculus
ccagaccttcaggaagctcttagct

SEQ ID NO: 899687 - DNA, 25 bp, Mus musculus
ccagaccttcaggggctcagctgca

SEQ ID NO: 899688 - DNA, 25 bp, Mus musculus
ccagaccttcaggtcttagctgacg

SEQ ID NO: 899689 - DNA, 25 bp, Mus musculus
ccagacgatgcacacgccatagaag

SEQ ID NO: 899690 - DNA, 25 bp, Mus musculus
ccagacgatgcacaggccatagaag

SEQ ID NO: 899691 - DNA, 25 bp, Mus musculus
ccagacgggaagcctcttatccgag

SEQ ID NO: 899692 - DNA, 25 bp, Mus musculus
ccagacgggaaggctcttatccgag

SEQ ID NO: 899693 - DNA, 25 bp, Mus musculus
ccagactcggcgccctgttctccgg

SEQ ID NO: 899694 - DNA, 25 bp, Mus musculus
ccagactcggggccctgttctccgg

SEQ ID NO: 899695 - DNA, 25 bp, Mus musculus
ccagactgagcctgtgtttcaaatc

SEQ ID NO: 899696 - DNA, 25 bp, Mus musculus
ccagactgaggctgtgtttcaaatc

SEQ ID NO: 899697 - DNA, 25 bp, Mus musculus
ccagactgatatccgatgctgtgga

SEQ ID NO: 899698 - DNA, 25 bp, Mus musculus
ccagactgatttccgatgctgtgga

SEQ ID NO: 899699 - DNA, 25 bp, Mus musculus
ccagactgcaaaccacaggctgtgc

SEQ ID NO: 899700 - DNA, 25 bp, Mus musculus
ccagactgcaaacgctgtgcgcccc

SEQ ID NO: 899701 - DNA, 25 bp, Mus musculus
ccagactgcaaacgtgaccagagcg

SEQ ID NO: 899702 - DNA, 25 bp, Mus musculus
ccagactgcaaagcacaggctgtgc

SEQ ID NO: 899703 - DNA, 25 bp, Mus musculus
ccagactgcaaaggctgtgcgcccc

SEQ ID NO: 899704 - DNA, 25 bp, Mus musculus
ccagactgcaaaggtgaccagagcg

SEQ ID NO: 899705 - DNA, 25 bp, Mus musculus
ccagactgcatgcaactacatgaat

SEQ ID NO: 899706 - DNA, 25 bp, Mus musculus
ccagactgcatgcctctgagggtaa

SEQ ID NO: 899707 - DNA, 25 bp, Mus musculus
ccagactgcatgcgtagcctctgag

SEQ ID NO: 899708 - DNA, 25 bp, Mus musculus
ccagactgcatggaactacatgaat

SEQ ID NO: 899709 - DNA, 25 bp, Mus musculus
ccagactgcatggctctgagggtaa

SEQ ID NO: 899710 - DNA, 25 bp, Mus musculus
ccagactgcatgggtagcctctgag

SEQ ID NO: 899711 - DNA, 25 bp, Mus musculus
ccagactgctaacgcctccagtgaa

SEQ ID NO: 899712 - DNA, 25 bp, Mus musculus
ccagactgctaaggcctccagtgaa

SEQ ID NO: 899713 - DNA, 25 bp, Mus musculus
ccagacttaaagaggcccagacgtc

SEQ ID NO: 899714 - DNA, 25 bp, Mus musculus
ccagacttaaagatttcacaggtct

SEQ ID NO: 899715 - DNA, 25 bp, Mus musculus
ccagacttaaagtggcccagacgtc

SEQ ID NO: 899716 - DNA, 25 bp, Mus musculus
ccagacttaaagttttcacaggtct

SEQ ID NO: 899717 - DNA, 25 bp, Mus musculus
ccagagaaactgaagtatcttcagg

SEQ ID NO: 899718 - DNA, 25 bp, Mus musculus
ccagagaaactgaatcttcaggaca

SEQ ID NO: 899719 - DNA, 25 bp, Mus musculus
ccagagaaactgtagtatcttcagg

SEQ ID NO: 899720 - DNA, 25 bp, Mus musculus
ccagagaaactgtatcttcaggaca

SEQ ID NO: 899721 - DNA, 25 bp, Mus musculus
ccagagaaagctgcttaaacttcac

SEQ ID NO: 899722 - DNA, 25 bp, Mus musculus
ccagagaaaggtgcttaaacttcac

SEQ ID NO: 899723 - DNA, 25 bp, Mus musculus
ccagagaagatattcctgtgatccg

SEQ ID NO: 899724 - DNA, 25 bp, Mus musculus
ccagagaagatattgctgtgatccg

SEQ ID NO: 899725 - DNA, 25 bp, Mus musculus
ccagagaatcttataggatttaaac

SEQ ID NO: 899726 - DNA, 25 bp, Mus musculus
ccagagaatcttttaggatttaaac

SEQ ID NO: 899727 - DNA, 25 bp, Mus musculus
ccagagacacagcaacctgaggaga

SEQ ID NO: 899728 - DNA, 25 bp, Mus musculus
ccagagacacaggaacctgaggaga

SEQ ID NO: 899729 - DNA, 25 bp, Mus musculus
ccagagacagcgcactgctggctgg

SEQ ID NO: 899730 - DNA, 25 bp, Mus musculus
ccagagacagctgtattcactgcac

SEQ ID NO: 899731 - DNA, 25 bp, Mus musculus
ccagagacagggcactgctggctgg

SEQ ID NO: 899732 - DNA, 25 bp, Mus musculus
ccagagacaggtgtattcactgcac

SEQ ID NO: 899733 - DNA, 25 bp, Mus musculus
ccagagacatgcatgtctgtcacct

SEQ ID NO: 899734 - DNA, 25 bp, Mus musculus
ccagagacatgcttgtctgtcacct

SEQ ID NO: 899735 - DNA, 25 bp, Mus musculus
ccagagacccagaaagacctgggga

SEQ ID NO: 899736 - DNA, 25 bp, Mus musculus
ccagagacccagtaagacctgggga

SEQ ID NO: 899737 - DNA, 25 bp, Mus musculus
ccagagaccgagcgagggagccatc

SEQ ID NO: 899738 - DNA, 25 bp, Mus musculus
ccagagaccgagggagggagccatc

SEQ ID NO: 899739 - DNA, 25 bp, Mus musculus
ccagagagaaagattcagtttaagg

SEQ ID NO: 899740 - DNA, 25 bp, Mus musculus
ccagagagaaagtttcagtttaagg

SEQ ID NO: 899741 - DNA, 25 bp, Mus musculus
ccagagagacagcacccttcccagt

SEQ ID NO: 899742 - DNA, 25 bp, Mus musculus
ccagagagacagcacggtccaccaa

SEQ ID NO: 899743 - DNA, 25 bp, Mus musculus
ccagagagacagcagccttcccagt

SEQ ID NO: 899744 - DNA, 25 bp, Mus musculus
ccagagagacagcagggtccaccaa

SEQ ID NO: 899745 - DNA, 25 bp, Mus musculus
ccagagagctatcattgaggcggaa

SEQ ID NO: 899746 - DNA, 25 bp, Mus musculus
ccagagagctgtcattgaggcggaa

SEQ ID NO: 899747 - DNA, 25 bp, Mus musculus
ccagagagctgtgattgaggcggaa

SEQ ID NO: 899748 - DNA, 25 bp, Mus musculus
ccagagagctttcattgaggcggaa

SEQ ID NO: 899749 - DNA, 25 bp, Mus musculus
ccagagataacctgacgctgggcaa

SEQ ID NO: 899750 - DNA, 25 bp, Mus musculus
ccagagataagctgacgctgggcaa

SEQ ID NO: 899751 - DNA, 25 bp, Mus musculus
ccagagatccagctgccaaacggag

SEQ ID NO: 899752 - DNA, 25 bp, Mus musculus
ccagagatcctgctgccaaacggag

SEQ ID NO: 899753 - DNA, 25 bp, Mus musculus
ccagagattcagatgtggagttgct

SEQ ID NO: 899754 - DNA, 25 bp, Mus musculus
ccagagattcagttgtggagttgct

SEQ ID NO: 899755 - DNA, 25 bp, Mus musculus
ccagagattgagaacgtcatagaag

SEQ ID NO: 899756 - DNA, 25 bp, Mus musculus
ccagagattgagaaggtcatagaag

SEQ ID NO: 899757 - DNA, 25 bp, Mus musculus
ccagagcaaccgattctatggcgtt

SEQ ID NO: 899758 - DNA, 25 bp, Mus musculus
ccagagcaaccgtttctatggcgtt

SEQ ID NO: 899759 - DNA, 25 bp, Mus musculus
ccagagcaagcttgctcttctggtg

SEQ ID NO: 899760 - DNA, 25 bp, Mus musculus
ccagagcaaggttgctcttctggtg

SEQ ID NO: 899761 - DNA, 25 bp, Mus musculus
ccagagcacccacgcttccactgct

SEQ ID NO: 899762 - DNA, 25 bp, Mus musculus
ccagagcacccaggcttccactgct

SEQ ID NO: 899763 - DNA, 25 bp, Mus musculus
ccagagcaccctcctgctgaataat

SEQ ID NO: 899764 - DNA, 25 bp, Mus musculus
ccagagcaccctcgactacattgca

SEQ ID NO: 899765 - DNA, 25 bp, Mus musculus
ccagagcaccctgctgctgaataat

SEQ ID NO: 899766 - DNA, 25 bp, Mus musculus
ccagagcaccctggactacattgca

SEQ ID NO: 899767 - DNA, 25 bp, Mus musculus
ccagagcagacagacagctgcagaa

SEQ ID NO: 899768 - DNA, 25 bp, Mus musculus
ccagagcagacagagagctgcagaa

SEQ ID NO: 899769 - DNA, 25 bp, Mus musculus
ccagagcagcagcgccctgttctcc

SEQ ID NO: 899770 - DNA, 25 bp, Mus musculus
ccagagcagcagggccctgttctcc

SEQ ID NO: 899771 - DNA, 25 bp, Mus musculus
ccagagcagcctcatctccgaacct

SEQ ID NO: 899772 - DNA, 25 bp, Mus musculus
ccagagcagcgtcatctccgaacct

SEQ ID NO: 899773 - DNA, 25 bp, Mus musculus
ccagagcatcaccaaatagatatga

SEQ ID NO: 899774 - DNA, 25 bp, Mus musculus
ccagagcatcaccccagtagaaata

SEQ ID NO: 899775 - DNA, 25 bp, Mus musculus
ccagagcatcacgaaatagatatga

SEQ ID NO: 899776 - DNA, 25 bp, Mus musculus
ccagagcatcacgccagtagaaata

SEQ ID NO: 899777 - DNA, 25 bp, Mus musculus
ccagagccagcagcaatgctactgc

SEQ ID NO: 899778 - DNA, 25 bp, Mus musculus
ccagagccagccacaagatgtgagg

SEQ ID NO: 899779 - DNA, 25 bp, Mus musculus
ccagagccaggagcaatgctactgc

SEQ ID NO: 899780 - DNA, 25 bp, Mus musculus
ccagagccaggcacaagatgtgagg

SEQ ID NO: 899781 - DNA, 25 bp, Mus musculus
ccagagccagggaagggcaatgcga

SEQ ID NO: 899782 - DNA, 25 bp, Mus musculus
ccagagccagggtagggcaatgcga

SEQ ID NO: 899783 - DNA, 25 bp, Mus musculus
ccagagccatccggtgctcttagca

SEQ ID NO: 899784 - DNA, 25 bp, Mus musculus
ccagagccatctggaaccaggccca

SEQ ID NO: 899785 - DNA, 25 bp, Mus musculus
ccagagccatgcggtgctcttagca

SEQ ID NO: 899786 - DNA, 25 bp, Mus musculus
ccagagccatgtagaaccaggccca

SEQ ID NO: 899787 - DNA, 25 bp, Mus musculus
ccagagccatgtggaaccaggccca

SEQ ID NO: 899788 - DNA, 25 bp, Mus musculus
ccagagccatgttgaaccaggccca

SEQ ID NO: 899789 - DNA, 25 bp, Mus musculus
ccagagcccaggaacgagactgaga

SEQ ID NO: 899790 - DNA, 25 bp, Mus musculus
ccagagcccaggaaggagactgaga

SEQ ID NO: 899791 - DNA, 25 bp, Mus musculus
ccagagccctcagactgctcctgga

SEQ ID NO: 899792 - DNA, 25 bp, Mus musculus
ccagagccctcagagtgctcctgga

SEQ ID NO: 899793 - DNA, 25 bp, Mus musculus
ccagagcgatgtctggtcttttgga

SEQ ID NO: 899794 - DNA, 25 bp, Mus musculus
ccagagcgatgtgtggtcttttgga

SEQ ID NO: 899795 - DNA, 25 bp, Mus musculus
ccagagctagatttgtcaaatcctg

SEQ ID NO: 899796 - DNA, 25 bp, Mus musculus
ccagagctagttttgtcaaatcctg

SEQ ID NO: 899797 - DNA, 25 bp, Mus musculus
ccagagctcaagcagcgaatctgca

SEQ ID NO: 899798 - DNA, 25 bp, Mus musculus
ccagagctcaagcctaaccctttca

SEQ ID NO: 899799 - DNA, 25 bp, Mus musculus
ccagagctcaaggagcgaatctgca

SEQ ID NO: 899800 - DNA, 25 bp, Mus musculus
ccagagctcaaggctaaccctttca

SEQ ID NO: 899801 - DNA, 25 bp, Mus musculus
ccagagctccggcctcaagtccacc

SEQ ID NO: 899802 - DNA, 25 bp, Mus musculus
ccagagctccgggctcaagtccacc

SEQ ID NO: 899803 - DNA, 25 bp, Mus musculus
ccagagctcctgattattcatggag

SEQ ID NO: 899804 - DNA, 25 bp, Mus musculus
ccagagctcctgtttattcatggag

SEQ ID NO: 899805 - DNA, 25 bp, Mus musculus
ccagagctgatgcacgccatgctgg

SEQ ID NO: 899806 - DNA, 25 bp, Mus musculus
ccagagctgatgcaggccatgctgg

SEQ ID NO: 899807 - DNA, 25 bp, Mus musculus
ccagagctgttttgcgttgcatgag

SEQ ID NO: 899808 - DNA, 25 bp, Mus musculus
ccagagctgttttgggttgcatgag

SEQ ID NO: 899809 - DNA, 25 bp, Mus musculus
ccagagcttctccgtgtggatcata

SEQ ID NO: 899810 - DNA, 25 bp, Mus musculus
ccagagcttctcggtgtggatcata

SEQ ID NO: 899811 - DNA, 25 bp, Mus musculus
ccagaggaagcctttcggcagcatc

SEQ ID NO: 899812 - DNA, 25 bp, Mus musculus
ccagaggaaggctttcggcagcatc

SEQ ID NO: 899813 - DNA, 25 bp, Mus musculus
ccagaggaagtacacaatcctcctg

SEQ ID NO: 899814 - DNA, 25 bp, Mus musculus
ccagaggaagtagacaatcctcctg

SEQ ID NO: 899815 - DNA, 25 bp, Mus musculus
ccagaggagaagatcaagactctgg

SEQ ID NO: 899816 - DNA, 25 bp, Mus musculus
ccagaggagaagttcaagactctgg

SEQ ID NO: 899817 - DNA, 25 bp, Mus musculus
ccagaggatgaactccaatggacag

SEQ ID NO: 899818 - DNA, 25 bp, Mus musculus
ccagaggatgaagtccaatggacag

SEQ ID NO: 899819 - DNA, 25 bp, Mus musculus
ccagaggcagagtgaagaaatcgaa

SEQ ID NO: 899820 - DNA, 25 bp, Mus musculus
ccagaggcagtgtgaagaaatcgaa

SEQ ID NO: 899821 - DNA, 25 bp, Mus musculus
ccagaggccagattcgtggaggtta

SEQ ID NO: 899822 - DNA, 25 bp, Mus musculus
ccagaggccagattggtggaggtta

SEQ ID NO: 899823 - DNA, 25 bp, Mus musculus
ccagaggtgccacgtctgcaaagtg

SEQ ID NO: 899824 - DNA, 25 bp, Mus musculus
ccagaggtgccaggtctgcaaagtg

SEQ ID NO: 899825 - DNA, 25 bp, Mus musculus
ccagagtacatgtgctttctcctgt

SEQ ID NO: 899826 - DNA, 25 bp, Mus musculus
ccagagtacatgtggtttctcctgt

SEQ ID NO: 899827 - DNA, 25 bp, Mus musculus
ccagagtacctctgcgcatcttctc

SEQ ID NO: 899828 - DNA, 25 bp, Mus musculus
ccagagtacctctgggcatcttctc

SEQ ID NO: 899829 - DNA, 25 bp, Mus musculus
ccagagtacgggcgtcctagtgtgt

SEQ ID NO: 899830 - DNA, 25 bp, Mus musculus
ccagagtacgggggtcctagtgtgt

SEQ ID NO: 899831 - DNA, 25 bp, Mus musculus
ccagagtagaaaaatatgacttctg

SEQ ID NO: 899832 - DNA, 25 bp, Mus musculus
ccagagtagaaaagaaggaatagga

SEQ ID NO: 899833 - DNA, 25 bp, Mus musculus
ccagagtagaaaagaataggaaagc

SEQ ID NO: 899834 - DNA, 25 bp, Mus musculus
ccagagtagaaatatatgacttctg

SEQ ID NO: 899835 - DNA, 25 bp, Mus musculus
ccagagtagaaatgaaggaatagga

SEQ ID NO: 899836 - DNA, 25 bp, Mus musculus
ccagagtagaaatgaataggaaagc

SEQ ID NO: 899837 - DNA, 25 bp, Mus musculus
ccagagtatatgcagctgtgtgacc

SEQ ID NO: 899838 - DNA, 25 bp, Mus musculus
ccagagtatatggagctgtgtgacc

SEQ ID NO: 899839 - DNA, 25 bp, Mus musculus
ccagagtcatgagtcgaaggagtct

SEQ ID NO: 899840 - DNA, 25 bp, Mus musculus
ccagagtcatgagtggaaggagtct

SEQ ID NO: 899841 - DNA, 25 bp, Mus musculus
ccagagtctctccctgtagctgtac

SEQ ID NO: 899842 - DNA, 25 bp, Mus musculus
ccagagtctctcgctgtagctgtac

SEQ ID NO: 899843 - DNA, 25 bp, Mus musculus
ccagagtgacgtctggtctttcggg

SEQ ID NO: 899844 - DNA, 25 bp, Mus musculus
ccagagtgacgtgtggtctttcggg

SEQ ID NO: 899845 - DNA, 25 bp, Mus musculus
ccagagtgatgtatggtcttttggt

SEQ ID NO: 899846 - DNA, 25 bp, Mus musculus
ccagagtgatgtttggtcttttggt

SEQ ID NO: 899847 - DNA, 25 bp, Mus musculus
ccagagtgcagcattattgattgtg

SEQ ID NO: 899848 - DNA, 25 bp, Mus musculus
ccagagtgcagctttattgattgtg

SEQ ID NO: 899849 - DNA, 25 bp, Mus musculus
ccagagttacagcaacgtcatccat

SEQ ID NO: 899850 - DNA, 25 bp, Mus musculus
ccagagttacaggaacgtcatccat

SEQ ID NO: 899851 - DNA, 25 bp, Mus musculus
ccagagttagctgtcaagactccag

SEQ ID NO: 899852 - DNA, 25 bp, Mus musculus
ccagagttaggtgtcaagactccag

SEQ ID NO: 899853 - DNA, 25 bp, Mus musculus
ccagagttcccacatgaagaaactg

SEQ ID NO: 899854 - DNA, 25 bp, Mus musculus
ccagagttcccagatgaagaaactg

SEQ ID NO: 899855 - DNA, 25 bp, Mus musculus
ccagagttggctcacagcctctacc

SEQ ID NO: 899856 - DNA, 25 bp, Mus musculus
ccagagttgggtcacagcctctacc

SEQ ID NO: 899857 - DNA, 25 bp, Mus musculus
ccagataaacactaaatttatgtgg

SEQ ID NO: 899858 - DNA, 25 bp, Mus musculus
ccagataaacactatatttatgtgg

SEQ ID NO: 899859 - DNA, 25 bp, Mus musculus
ccagataatgtgaacttgtttttat

SEQ ID NO: 899860 - DNA, 25 bp, Mus musculus
ccagataatgtgaagttgtttttat

SEQ ID NO: 899861 - DNA, 25 bp, Mus musculus
ccagatacaatacgaaacctgtcca

SEQ ID NO: 899862 - DNA, 25 bp, Mus musculus
ccagatacaataggaaacctgtcca

SEQ ID NO: 899863 - DNA, 25 bp, Mus musculus
ccagatagctcaccttttagatctg

SEQ ID NO: 899864 - DNA, 25 bp, Mus musculus
ccagatagctcagcttttagatctg

SEQ ID NO: 899865 - DNA, 25 bp, Mus musculus
ccagatatatcctctcgaacagtgt

SEQ ID NO: 899866 - DNA, 25 bp, Mus musculus
ccagatatatgctctcgaacagtgt

SEQ ID NO: 899867 - DNA, 25 bp, Mus musculus
ccagatatcctgagcagaggggcag

SEQ ID NO: 899868 - DNA, 25 bp, Mus musculus
ccagatatcctgtgcagaggggcag

SEQ ID NO: 899869 - DNA, 25 bp, Mus musculus
ccagatcaagcacttccgggagaag

SEQ ID NO: 899870 - DNA, 25 bp, Mus musculus
ccagatcaagcaggtagatatgggc

SEQ ID NO: 899871 - DNA, 25 bp, Mus musculus
ccagatcaaggacttccgggagaag

SEQ ID NO: 899872 - DNA, 25 bp, Mus musculus
ccagatcaaggaggtagatatgggc

SEQ ID NO: 899873 - DNA, 25 bp, Mus musculus
ccagatcagaaaccctaggacctgc

SEQ ID NO: 899874 - DNA, 25 bp, Mus musculus
ccagatcagaaacgcagtttgtgca

SEQ ID NO: 899875 - DNA, 25 bp, Mus musculus
ccagatcagaaacggtgtgtgggat

SEQ ID NO: 899876 - DNA, 25 bp, Mus musculus
ccagatcagaaagcctaggacctgc

SEQ ID NO: 899877 - DNA, 25 bp, Mus musculus
ccagatcagaaaggcagtttgtgca

SEQ ID NO: 899878 - DNA, 25 bp, Mus musculus
ccagatcagaaagggtgtgtgggat

SEQ ID NO: 899879 - DNA, 25 bp, Mus musculus
ccagatccagcgctttgcagtccgc

SEQ ID NO: 899880 - DNA, 25 bp, Mus musculus
ccagatccagggctttgcagtccgc

SEQ ID NO: 899881 - DNA, 25 bp, Mus musculus
ccagatccgcaacgacttcttatac

SEQ ID NO: 899882 - DNA, 25 bp, Mus musculus
ccagatccgcaaggacttcttatac

SEQ ID NO: 899883 - DNA, 25 bp, Mus musculus
ccagatcctgaacactgctggagtt

SEQ ID NO: 899884 - DNA, 25 bp, Mus musculus
ccagatcctgaaccattcgggaatt

SEQ ID NO: 899885 - DNA, 25 bp, Mus musculus
ccagatcctgaagactgctggagtt

SEQ ID NO: 899886 - DNA, 25 bp, Mus musculus
ccagatcctgaagcattcgggaatt

SEQ ID NO: 899887 - DNA, 25 bp, Mus musculus
ccagatcgacaacacgttcctacac

SEQ ID NO: 899888 - DNA, 25 bp, Mus musculus
ccagatcgacaacaggttcctacac

SEQ ID NO: 899889 - DNA, 25 bp, Mus musculus
ccagatctgcagcaatgacctgggt

SEQ ID NO: 899890 - DNA, 25 bp, Mus musculus
ccagatctgcaggaatgacctgggt

SEQ ID NO: 899891 - DNA, 25 bp, Mus musculus
ccagatgaagaacgtgctgtgtttg

SEQ ID NO: 899892 - DNA, 25 bp, Mus musculus
ccagatgaagaaggtgctgtgtttg

SEQ ID NO: 899893 - DNA, 25 bp, Mus musculus
ccagatgacaacagacgcatgctgg

SEQ ID NO: 899894 - DNA, 25 bp, Mus musculus
ccagatgacatcagacgcatgctgg

SEQ ID NO: 899895 - DNA, 25 bp, Mus musculus
ccagatgagcagcctaacatccact

SEQ ID NO: 899896 - DNA, 25 bp, Mus musculus
ccagatgagcaggctaacatccact

SEQ ID NO: 899897 - DNA, 25 bp, Mus musculus
ccagatgcaaggtgatggggaataa

SEQ ID NO: 899898 - DNA, 25 bp, Mus musculus
ccagatgcaaggtgttggggaataa

SEQ ID NO: 899899 - DNA, 25 bp, Mus musculus
ccagatgcagagttgtggtcctcaa

SEQ ID NO: 899900 - DNA, 25 bp, Mus musculus
ccagatgcagcagagaagatggggc

SEQ ID NO: 899901 - DNA, 25 bp, Mus musculus
ccagatgcagcatccctggagctgg

SEQ ID NO: 899902 - DNA, 25 bp, Mus musculus
ccagatgcaggagagaagatggggc

SEQ ID NO: 899903 - DNA, 25 bp, Mus musculus
ccagatgcaggatccctggagctgg

SEQ ID NO: 899904 - DNA, 25 bp, Mus musculus
ccagatgcagtgttgtggtcctcaa

SEQ ID NO: 899905 - DNA, 25 bp, Mus musculus
ccagatgccaggatgttgatgaatg

SEQ ID NO: 899906 - DNA, 25 bp, Mus musculus
ccagatgccaggttgttgatgaatg

SEQ ID NO: 899907 - DNA, 25 bp, Mus musculus
ccagatggaaatctgtatcctaaac

SEQ ID NO: 899908 - DNA, 25 bp, Mus musculus
ccagatggaattctgtatcctaaac

SEQ ID NO: 899909 - DNA, 25 bp, Mus musculus
ccagatggtgactgaggcaaatgac

SEQ ID NO: 899910 - DNA, 25 bp, Mus musculus
ccagatggtgcccaaccacgtgaaa

SEQ ID NO: 899911 - DNA, 25 bp, Mus musculus
ccagatggtgcccatccacgtgaaa

SEQ ID NO: 899912 - DNA, 25 bp, Mus musculus
ccagatggtgtctgaggcaaatgac

SEQ ID NO: 899913 - DNA, 25 bp, Mus musculus
ccagatgtcaagaaagcgtgtacct

SEQ ID NO: 899914 - DNA, 25 bp, Mus musculus
ccagatgtcaagatatctgtttcaa

SEQ ID NO: 899915 - DNA, 25 bp, Mus musculus
ccagatgtcaagtaagcgtgtacct

SEQ ID NO: 899916 - DNA, 25 bp, Mus musculus
ccagatgtcaagttatctgtttcaa

SEQ ID NO: 899917 - DNA, 25 bp, Mus musculus
ccagatgtgcagcgccgtgtccacc

SEQ ID NO: 899918 - DNA, 25 bp, Mus musculus
ccagatgtgcagggccgtgtccacc

SEQ ID NO: 899919 - DNA, 25 bp, Mus musculus
ccagatgttgccaagaagacatccc

SEQ ID NO: 899920 - DNA, 25 bp, Mus musculus
ccagatgttggcaagaagacatccc

SEQ ID NO: 899921 - DNA, 25 bp, Mus musculus
ccagattattcacgccagtggagag

SEQ ID NO: 899922 - DNA, 25 bp, Mus musculus
ccagattattcaggccagtggagag

SEQ ID NO: 899923 - DNA, 25 bp, Mus musculus
ccagattcaaacagccgtggtgaga

SEQ ID NO: 899924 - DNA, 25 bp, Mus musculus
ccagattcaaactgccgtggtgaga

SEQ ID NO: 899925 - DNA, 25 bp, Mus musculus
ccagattcagccgacaactggccaa

SEQ ID NO: 899926 - DNA, 25 bp, Mus musculus
ccagattcaggcgacaactggccaa

SEQ ID NO: 899927 - DNA, 25 bp, Mus musculus
ccagattctccacgtcaacaactat

SEQ ID NO: 899928 - DNA, 25 bp, Mus musculus
ccagattctccaggtcaacaactat

SEQ ID NO: 899929 - DNA, 25 bp, Mus musculus
ccagattgagcaccacctcttcccc

SEQ ID NO: 899930 - DNA, 25 bp, Mus musculus
ccagattgagcacctcctcttcccc

SEQ ID NO: 899931 - DNA, 25 bp, Mus musculus
ccagcaaatgagcgcgaacagctaa

SEQ ID NO: 899932 - DNA, 25 bp, Mus musculus
ccagcaaatgagggcgaacagctaa

SEQ ID NO: 899933 - DNA, 25 bp, Mus musculus
ccagcaacaacacatacaacagcag

SEQ ID NO: 899934 - DNA, 25 bp, Mus musculus
ccagcaacaacagatacaacagcag

SEQ ID NO: 899935 - DNA, 25 bp, Mus musculus
ccagcaactgaaaagtgaacttcag

SEQ ID NO: 899936 - DNA, 25 bp, Mus musculus
ccagcaactgaatagtgaacttcag

SEQ ID NO: 899937 - DNA, 25 bp, Mus musculus
ccagcaagccatcgtgtttccatgg

SEQ ID NO: 899938 - DNA, 25 bp, Mus musculus
ccagcaagccatggtgtttccatgg

SEQ ID NO: 899939 - DNA, 25 bp, Mus musculus
ccagcaagcgctggggcaggagctc

SEQ ID NO: 899940 - DNA, 25 bp, Mus musculus
ccagcaagcggtggggcaggagctc

SEQ ID NO: 899941 - DNA, 25 bp, Mus musculus
ccagcaagctgctccactggctggt

SEQ ID NO: 899942 - DNA, 25 bp, Mus musculus
ccagcaagctgctcgactggctggt

SEQ ID NO: 899943 - DNA, 25 bp, Mus musculus
ccagcaatccatgacatcagggcac

SEQ ID NO: 899944 - DNA, 25 bp, Mus musculus
ccagcaatccatgagatcagggcac

SEQ ID NO: 899945 - DNA, 25 bp, Mus musculus
ccagcacaagctgtggcgaaagtgc

SEQ ID NO: 899946 - DNA, 25 bp, Mus musculus
ccagcacaagggatggtagcaagac

SEQ ID NO: 899947 - DNA, 25 bp, Mus musculus
ccagcacaagggcagttggtagcaa

SEQ ID NO: 899948 - DNA, 25 bp, Mus musculus
ccagcacaaggggagttggtagcaa

SEQ ID NO: 899949 - DNA, 25 bp, Mus musculus
ccagcacaagggttggtagcaagac

SEQ ID NO: 899950 - DNA, 25 bp, Mus musculus
ccagcacaaggtgtggcgaaagtgc

SEQ ID NO: 899951 - DNA, 25 bp, Mus musculus
ccagcacacccaccagcccgagcaa

SEQ ID NO: 899952 - DNA, 25 bp, Mus musculus
ccagcacacccagcagcccgagcaa

SEQ ID NO: 899953 - DNA, 25 bp, Mus musculus
ccagcacagcatcagaaactctctg

SEQ ID NO: 899954 - DNA, 25 bp, Mus musculus
ccagcacagcatgagaaactctctg

SEQ ID NO: 899955 - DNA, 25 bp, Mus musculus
ccagcacccgccgccgctcctcttc

SEQ ID NO: 899956 - DNA, 25 bp, Mus musculus
ccagcacccggcgccgctcctcttc

SEQ ID NO: 899957 - DNA, 25 bp, Mus musculus
ccagcacctcagctttctaaggact

SEQ ID NO: 899958 - DNA, 25 bp, Mus musculus
ccagcacctcaggtttctaaggact

SEQ ID NO: 899959 - DNA, 25 bp, Mus musculus
ccagcacctctacgccctggtcttg

SEQ ID NO: 899960 - DNA, 25 bp, Mus musculus
ccagcacctctaggccctggtcttg

SEQ ID NO: 899961 - DNA, 25 bp, Mus musculus
ccagcaccttaggactgtaaagagc

SEQ ID NO: 899962 - DNA, 25 bp, Mus musculus
ccagcaccttaggagtgtaaagagc

SEQ ID NO: 899963 - DNA, 25 bp, Mus musculus
ccagcactaccacagaggcacagct

SEQ ID NO: 899964 - DNA, 25 bp, Mus musculus
ccagcactaccagagaggcacagct

SEQ ID NO: 899965 - DNA, 25 bp, Mus musculus
ccagcactgcatcagaaactctctg

SEQ ID NO: 899966 - DNA, 25 bp, Mus musculus
ccagcactgcatgagaaactctctg

SEQ ID NO: 899967 - DNA, 25 bp, Mus musculus
ccagcactggggatgtccagctcgc

SEQ ID NO: 899968 - DNA, 25 bp, Mus musculus
ccagcactggggttgtccagctcgc

SEQ ID NO: 899969 - DNA, 25 bp, Mus musculus
ccagcacttggagtcgtgaatcaaa

SEQ ID NO: 899970 - DNA, 25 bp, Mus musculus
ccagcacttggagtggtgaatcaaa

SEQ ID NO: 899971 - DNA, 25 bp, Mus musculus
ccagcagaagaggtgaaacagcgct

SEQ ID NO: 899972 - DNA, 25 bp, Mus musculus
ccagcagaagtggtgaaacagcgct

SEQ ID NO: 899973 - DNA, 25 bp, Mus musculus
ccagcagactatctcctgtctatct

SEQ ID NO: 899974 - DNA, 25 bp, Mus musculus
ccagcagactctaaaacagactagc

SEQ ID NO: 899975 - DNA, 25 bp, Mus musculus
ccagcagactgtaaaacagactagc

SEQ ID NO: 899976 - DNA, 25 bp, Mus musculus
ccagcagactttctcctgtctatct

SEQ ID NO: 899977 - DNA, 25 bp, Mus musculus
ccagcagatgctatgcacccgagac

SEQ ID NO: 899978 - DNA, 25 bp, Mus musculus
ccagcagatggtatgcacccgagac

SEQ ID NO: 899979 - DNA, 25 bp, Mus musculus
ccagcagatgtgcgagtgtttggat

SEQ ID NO: 899980 - DNA, 25 bp, Mus musculus
ccagcagatgtgggagtgtttggat

SEQ ID NO: 899981 - DNA, 25 bp, Mus musculus
ccagcagcacggaggacttccctga

SEQ ID NO: 899982 - DNA, 25 bp, Mus musculus
ccagcagcacggtggacttccctga

SEQ ID NO: 899983 - DNA, 25 bp, Mus musculus
ccagcagcagactcctctcaaggag

SEQ ID NO: 899984 - DNA, 25 bp, Mus musculus
ccagcagcagactcgtctcaaggag

SEQ ID NO: 899985 - DNA, 25 bp, Mus musculus
ccagcagcagatattgtggccctaa

SEQ ID NO: 899986 - DNA, 25 bp, Mus musculus
ccagcagcagatcccagagtcccag

SEQ ID NO: 899987 - DNA, 25 bp, Mus musculus
ccagcagcagatgccagagtcccag

SEQ ID NO: 899988 - DNA, 25 bp, Mus musculus
ccagcagcagattgtgcagtgggat

SEQ ID NO: 899989 - DNA, 25 bp, Mus musculus
ccagcagcagattttgtggccctaa

SEQ ID NO: 899990 - DNA, 25 bp, Mus musculus
ccagcagcagcaccagtgtgtggcg

SEQ ID NO: 899991 - DNA, 25 bp, Mus musculus
ccagcagcaggaccagtgtgtggcg

SEQ ID NO: 899992 - DNA, 25 bp, Mus musculus
ccagcagcagtttgtgcagtgggat

SEQ ID NO: 899993 - DNA, 25 bp, Mus musculus
ccagcagcataacatgagattgact

SEQ ID NO: 899994 - DNA, 25 bp, Mus musculus
ccagcagcataaccatgagattgac

SEQ ID NO: 899995 - DNA, 25 bp, Mus musculus
ccagcagcataagatgagattgact

SEQ ID NO: 899996 - DNA, 25 bp, Mus musculus
ccagcagcataagcatgagattgac

SEQ ID NO: 899997 - DNA, 25 bp, Mus musculus
ccagcagctcaaagagacatgtctc

SEQ ID NO: 899998 - DNA, 25 bp, Mus musculus
ccagcagctcaatgagacatgtctc

SEQ ID NO: 899999 - DNA, 25 bp, Mus musculus
ccagcaggagcgcacgttcctcatg

SEQ ID NO: 900000 - DNA, 25 bp, Mus musculus
ccagcaggagcgcaggttcctcatg

SEQ ID NO: 900001 - DNA, 25 bp, Mus musculus
ccagcaggatgacgctaaaatgttt

SEQ ID NO: 900002 - DNA, 25 bp, Mus musculus
ccagcaggatgacggtaaaatgttt

SEQ ID NO: 900003 - DNA, 25 bp, Mus musculus
ccagcaggggttcaatcagacccag

SEQ ID NO: 900004 - DNA, 25 bp, Mus musculus
ccagcaggggttcattcagacccag

SEQ ID NO: 900005 - DNA, 25 bp, Mus musculus
ccagcaggtaataaacgagatggtg

SEQ ID NO: 900006 - DNA, 25 bp, Mus musculus
ccagcaggtaattaacgagatggtg

SEQ ID NO: 900007 - DNA, 25 bp, Mus musculus
ccagcagtatttcattttgaatacg

SEQ ID NO: 900008 - DNA, 25 bp, Mus musculus
ccagcagtatttgattttgaatacg

SEQ ID NO: 900009 - DNA, 25 bp, Mus musculus
ccagcagtgaggcacttgaaagtga

SEQ ID NO: 900010 - DNA, 25 bp, Mus musculus
ccagcagtgagggacttgaaagtga

SEQ ID NO: 900011 - DNA, 25 bp, Mus musculus
ccagcagttcaacaagcgttctgtg

SEQ ID NO: 900012 - DNA, 25 bp, Mus musculus
ccagcagttcaagaagcgttctgtg

SEQ ID NO: 900013 - DNA, 25 bp, Mus musculus
ccagcagttcaccattctcgagcag

SEQ ID NO: 900014 - DNA, 25 bp, Mus musculus
ccagcagttcacgattctcgagcag

SEQ ID NO: 900015 - DNA, 25 bp, Mus musculus
ccagcagttcagtacctatgagcca

SEQ ID NO: 900016 - DNA, 25 bp, Mus musculus
ccagcagttcagtagctatgagcca

SEQ ID NO: 900017 - DNA, 25 bp, Mus musculus
ccagcatcacccccagcagtcagag

SEQ ID NO: 900018 - DNA, 25 bp, Mus musculus
ccagcatcacccgcagcagtcagag

SEQ ID NO: 900019 - DNA, 25 bp, Mus musculus
ccagcatcactgcacatcagagtaa

SEQ ID NO: 900020 - DNA, 25 bp, Mus musculus
ccagcatcactgcagatcagagtaa

SEQ ID NO: 900021 - DNA, 25 bp, Mus musculus
ccagcatcagcgagcctgtatatgg

SEQ ID NO: 900022 - DNA, 25 bp, Mus musculus
ccagcatcagggagcctgtatatgg

SEQ ID NO: 900023 - DNA, 25 bp, Mus musculus
ccagcatctctgcccggtcatcgag

SEQ ID NO: 900024 - DNA, 25 bp, Mus musculus
ccagcatctctgccgggtcatcgag

SEQ ID NO: 900025 - DNA, 25 bp, Mus musculus
ccagcatgcagaacagtcacagcgg

SEQ ID NO: 900026 - DNA, 25 bp, Mus musculus
ccagcatgcagaactgtcacagcgg

SEQ ID NO: 900027 - DNA, 25 bp, Mus musculus
ccagcatggctctacattcattcag

SEQ ID NO: 900028 - DNA, 25 bp, Mus musculus
ccagcatggctctagattcattcag

SEQ ID NO: 900029 - DNA, 25 bp, Mus musculus
ccagcatggttccacattcatacag

SEQ ID NO: 900030 - DNA, 25 bp, Mus musculus
ccagcatggttccagattcatacag

SEQ ID NO: 900031 - DNA, 25 bp, Mus musculus
ccagcattggaagactgtatcctca

SEQ ID NO: 900032 - DNA, 25 bp, Mus musculus
ccagcattggaagagtgtatcctca

SEQ ID NO: 900033 - DNA, 25 bp, Mus musculus
ccagcatttgctataggagggattg

SEQ ID NO: 900034 - DNA, 25 bp, Mus musculus
ccagcatttggtataggagggattg

SEQ ID NO: 900035 - DNA, 25 bp, Mus musculus
ccagccaaccagcgcaaatgtgagc

SEQ ID NO: 900036 - DNA, 25 bp, Mus musculus
ccagccaaccagcggaaatgtgagc

SEQ ID NO: 900037 - DNA, 25 bp, Mus musculus
ccagccaatgcgcctgccgatttcc

SEQ ID NO: 900038 - DNA, 25 bp, Mus musculus
ccagccaatgggcctgccgatttcc

SEQ ID NO: 900039 - DNA, 25 bp, Mus musculus
ccagccacaaaaagatcaggattcc

SEQ ID NO: 900040 - DNA, 25 bp, Mus musculus
ccagccacaaaatgatcaggattcc

SEQ ID NO: 900041 - DNA, 25 bp, Mus musculus
ccagccacacagccacagtctggtg

SEQ ID NO: 900042 - DNA, 25 bp, Mus musculus
ccagccacacaggcacagtctggtg

SEQ ID NO: 900043 - DNA, 25 bp, Mus musculus
ccagccacagcagctcttagggaag

SEQ ID NO: 900044 - DNA, 25 bp, Mus musculus
ccagccacagcccaagcccagcagt

SEQ ID NO: 900045 - DNA, 25 bp, Mus musculus
ccagccacagccccaggccttgtca

SEQ ID NO: 900046 - DNA, 25 bp, Mus musculus
ccagccacaggagctcttagggaag

SEQ ID NO: 900047 - DNA, 25 bp, Mus musculus
ccagccacaggccaagcccagcagt

SEQ ID NO: 900048 - DNA, 25 bp, Mus musculus
ccagccacaggcccaggccttgtca

SEQ ID NO: 900049 - DNA, 25 bp, Mus musculus
ccagccacgaagacccttctgcagt

SEQ ID NO: 900050 - DNA, 25 bp, Mus musculus
ccagccacgaagtcccttctgcagt

SEQ ID NO: 900051 - DNA, 25 bp, Mus musculus
ccagccactcagaacccctggcctc

SEQ ID NO: 900052 - DNA, 25 bp, Mus musculus
ccagccactcagtacccctggcctc

SEQ ID NO: 900053 - DNA, 25 bp, Mus musculus
ccagccacttcccgtcaactatttt

SEQ ID NO: 900054 - DNA, 25 bp, Mus musculus
ccagccacttccggtcaactatttt

SEQ ID NO: 900055 - DNA, 25 bp, Mus musculus
ccagccagaacacgcagcccttcgg

SEQ ID NO: 900056 - DNA, 25 bp, Mus musculus
ccagccagaacaggcagcccttcgg

SEQ ID NO: 900057 - DNA, 25 bp, Mus musculus
ccagccagagaggacgttttttcgc

SEQ ID NO: 900058 - DNA, 25 bp, Mus musculus
ccagccagagaggaggttttttcgc

SEQ ID NO: 900059 - DNA, 25 bp, Mus musculus
ccagccagcaatcgtgctcagacct

SEQ ID NO: 900060 - DNA, 25 bp, Mus musculus
ccagccagcaatggtgctcagacct

SEQ ID NO: 900061 - DNA, 25 bp, Mus musculus
ccagccatcgttaacgtcttccatg

SEQ ID NO: 900062 - DNA, 25 bp, Mus musculus
ccagccatcgttaaggtcttccatg

SEQ ID NO: 900063 - DNA, 25 bp, Mus musculus
ccagccatctcacagactatggtca

SEQ ID NO: 900064 - DNA, 25 bp, Mus musculus
ccagccatctcagagactatggtca

SEQ ID NO: 900065 - DNA, 25 bp, Mus musculus
ccagcccaaccaagctgctgaaccg

SEQ ID NO: 900066 - DNA, 25 bp, Mus musculus
ccagcccaaccatgctgctgaaccg

SEQ ID NO: 900067 - DNA, 25 bp, Mus musculus
ccagcccacaagacctgcacaggat

SEQ ID NO: 900068 - DNA, 25 bp, Mus musculus
ccagcccacaagtcctgcacaggat

SEQ ID NO: 900069 - DNA, 25 bp, Mus musculus
ccagcccagagacaggtcttttggc

SEQ ID NO: 900070 - DNA, 25 bp, Mus musculus
ccagcccagagagaggtcttttggc

SEQ ID NO: 900071 - DNA, 25 bp, Mus musculus
ccagcccagagatccagctgccaaa

SEQ ID NO: 900072 - DNA, 25 bp, Mus musculus
ccagcccagagatcgagctgccaaa

SEQ ID NO: 900073 - DNA, 25 bp, Mus musculus
ccagcccagagctacatttgtcaaa

SEQ ID NO: 900074 - DNA, 25 bp, Mus musculus
ccagcccagagctagatttgtcaaa

SEQ ID NO: 900075 - DNA, 25 bp, Mus musculus
ccagccccagaccttcaggctcccg

SEQ ID NO: 900076 - DNA, 25 bp, Mus musculus
ccagccccagaggcaacacagaaga

SEQ ID NO: 900077 - DNA, 25 bp, Mus musculus
ccagccccagaggctacacagaaga

SEQ ID NO: 900078 - DNA, 25 bp, Mus musculus
ccagccccagcacagaaaagaagcc

SEQ ID NO: 900079 - DNA, 25 bp, Mus musculus
ccagccccagcagagaaaagaagcc

SEQ ID NO: 900080 - DNA, 25 bp, Mus musculus
ccagccccagcagcctggtagattg

SEQ ID NO: 900081 - DNA, 25 bp, Mus musculus
ccagccccaggagcctggtagattg

SEQ ID NO: 900082 - DNA, 25 bp, Mus musculus
ccagccccagtccttcaggctcccg

SEQ ID NO: 900083 - DNA, 25 bp, Mus musculus
ccagccccggtagacgtatggatgg

SEQ ID NO: 900084 - DNA, 25 bp, Mus musculus
ccagccccggtagaggtatggatgg

SEQ ID NO: 900085 - DNA, 25 bp, Mus musculus
ccagccctcgccttactggcagaaa

SEQ ID NO: 900086 - DNA, 25 bp, Mus musculus
ccagccctcggcttactggcagaaa

SEQ ID NO: 900087 - DNA, 25 bp, Mus musculus
ccagccctggagactccaccaactc

SEQ ID NO: 900088 - DNA, 25 bp, Mus musculus
ccagccctggagtctccaccaactc

SEQ ID NO: 900089 - DNA, 25 bp, Mus musculus
ccagccgagggagacgcaatacaga

SEQ ID NO: 900090 - DNA, 25 bp, Mus musculus
ccagccgagggagaggcaatacaga

SEQ ID NO: 900091 - DNA, 25 bp, Mus musculus
ccagccgccacacgaactggtgtgc

SEQ ID NO: 900092 - DNA, 25 bp, Mus musculus
ccagccgccacacgtcctgttgagt

SEQ ID NO: 900093 - DNA, 25 bp, Mus musculus
ccagccgccacaggaactggtgtgc

SEQ ID NO: 900094 - DNA, 25 bp, Mus musculus
ccagccgccacaggtcctgttgagt

SEQ ID NO: 900095 - DNA, 25 bp, Mus musculus
ccagccgctgcacgccccccagcct

SEQ ID NO: 900096 - DNA, 25 bp, Mus musculus
ccagccgctgcaggccccccagcct

SEQ ID NO: 900097 - DNA, 25 bp, Mus musculus
ccagccgggatacacgtgtgaatga

SEQ ID NO: 900098 - DNA, 25 bp, Mus musculus
ccagccgggatacaggtgtgaatga

SEQ ID NO: 900099 - DNA, 25 bp, Mus musculus
ccagcctacctgccccaaatctccc

SEQ ID NO: 900100 - DNA, 25 bp, Mus musculus
ccagcctacctgccgcaaatctccc

SEQ ID NO: 900101 - DNA, 25 bp, Mus musculus
ccagcctcaggacacgtataaggca

SEQ ID NO: 900102 - DNA, 25 bp, Mus musculus
ccagcctcaggacaggtataaggca

SEQ ID NO: 900103 - DNA, 25 bp, Mus musculus
ccagcctcattgctggcaaccactc

SEQ ID NO: 900104 - DNA, 25 bp, Mus musculus
ccagcctcattggtggcaaccactc

SEQ ID NO: 900105 - DNA, 25 bp, Mus musculus
ccagcctcccagtacttccaactgg

SEQ ID NO: 900106 - DNA, 25 bp, Mus musculus
ccagcctcccagtagttccaactgg

SEQ ID NO: 900107 - DNA, 25 bp, Mus musculus
ccagcctcctggctgttctcttcca

SEQ ID NO: 900108 - DNA, 25 bp, Mus musculus
ccagcctcctggcttggctgcaagc

SEQ ID NO: 900109 - DNA, 25 bp, Mus musculus
ccagcctcctgggtgttctcttcca

SEQ ID NO: 900110 - DNA, 25 bp, Mus musculus
ccagcctcctgggttggctgcaagc

SEQ ID NO: 900111 - DNA, 25 bp, Mus musculus
ccagcctgaaaacttcctagacaaa

SEQ ID NO: 900112 - DNA, 25 bp, Mus musculus
ccagcctgaaaagttcctagacaaa

SEQ ID NO: 900113 - DNA, 25 bp, Mus musculus
ccagcctgacagatttctatcactc

SEQ ID NO: 900114 - DNA, 25 bp, Mus musculus
ccagcctgacagttttctatcactc

SEQ ID NO: 900115 - DNA, 25 bp, Mus musculus
ccagcctgcactcctgggtggagcc

SEQ ID NO: 900116 - DNA, 25 bp, Mus musculus
ccagcctgcagtcctgggtggagcc

SEQ ID NO: 900117 - DNA, 25 bp, Mus musculus
ccagcctgcctctgcgcttcctcgg

SEQ ID NO: 900118 - DNA, 25 bp, Mus musculus
ccagcctgcctctgggcttcctcgg

SEQ ID NO: 900119 - DNA, 25 bp, Mus musculus
ccagcctggagacgtccatatcctg

SEQ ID NO: 900120 - DNA, 25 bp, Mus musculus
ccagcctggagaggtccatatcctg

SEQ ID NO: 900121 - DNA, 25 bp, Mus musculus
ccagcctgggcacatggggctcctg

SEQ ID NO: 900122 - DNA, 25 bp, Mus musculus
ccagcctgggccaccaaagaaaatg

SEQ ID NO: 900123 - DNA, 25 bp, Mus musculus
ccagcctgggccaccgagcagctga

SEQ ID NO: 900124 - DNA, 25 bp, Mus musculus
ccagcctgggccacgaaagaaaatg

SEQ ID NO: 900125 - DNA, 25 bp, Mus musculus
ccagcctgggccacggagcagctga

SEQ ID NO: 900126 - DNA, 25 bp, Mus musculus
ccagcctggggacatggggctcctg

SEQ ID NO: 900127 - DNA, 25 bp, Mus musculus
ccagcctgtgcaatagtcactgctg

SEQ ID NO: 900128 - DNA, 25 bp, Mus musculus
ccagcctgtgcgtccgaagcagtac

SEQ ID NO: 900129 - DNA, 25 bp, Mus musculus
ccagcctgtggaatagtcactgctg

SEQ ID NO: 900130 - DNA, 25 bp, Mus musculus
ccagcctgtgggtccgaagcagtac

SEQ ID NO: 900131 - DNA, 25 bp, Mus musculus
ccagccttgccacttccaccttgaa

SEQ ID NO: 900132 - DNA, 25 bp, Mus musculus
ccagccttgccagttccaccttgaa

SEQ ID NO: 900133 - DNA, 25 bp, Mus musculus
ccagcgaagacccacacatggctga

SEQ ID NO: 900134 - DNA, 25 bp, Mus musculus
ccagcgaagacccagacatggctga

SEQ ID NO: 900135 - DNA, 25 bp, Mus musculus
ccagcgagaaggagaaattctccca

SEQ ID NO: 900136 - DNA, 25 bp, Mus musculus
ccagcgagaaggtgaaattctccca

SEQ ID NO: 900137 - DNA, 25 bp, Mus musculus
ccagcgagcgctgcgaagctggggt

SEQ ID NO: 900138 - DNA, 25 bp, Mus musculus
ccagcgagcggtgcgaagctggggt

SEQ ID NO: 900139 - DNA, 25 bp, Mus musculus
ccagcgaggaaacacgcactctcga

SEQ ID NO: 900140 - DNA, 25 bp, Mus musculus
ccagcgaggaaacaggcactctcga

SEQ ID NO: 900141 - DNA, 25 bp, Mus musculus
ccagcgagttattacgatgcctggt

SEQ ID NO: 900142 - DNA, 25 bp, Mus musculus
ccagcgagttattacgcacatgact

SEQ ID NO: 900143 - DNA, 25 bp, Mus musculus
ccagcgagttattaggatgcctggt

SEQ ID NO: 900144 - DNA, 25 bp, Mus musculus
ccagcgagttattaggcacatgact

SEQ ID NO: 900145 - DNA, 25 bp, Mus musculus
ccagcgattatcaatactacattag

SEQ ID NO: 900146 - DNA, 25 bp, Mus musculus
ccagcgattatctatactacattag

SEQ ID NO: 900147 - DNA, 25 bp, Mus musculus
ccagcgattctgaaggtgaagagat

SEQ ID NO: 900148 - DNA, 25 bp, Mus musculus
ccagcgattctgtaggtgaagagat

SEQ ID NO: 900149 - DNA, 25 bp, Mus musculus
ccagcgatttaaaacggatgtcaat

SEQ ID NO: 900150 - DNA, 25 bp, Mus musculus
ccagcgatttaaaagggatgtcaat

SEQ ID NO: 900151 - DNA, 25 bp, Mus musculus
ccagcgcacctacgcgctgactcct

SEQ ID NO: 900152 - DNA, 25 bp, Mus musculus
ccagcgcacctacgggctgactcct

SEQ ID NO: 900153 - DNA, 25 bp, Mus musculus
ccagcgcgtgccatgaagcactacc

SEQ ID NO: 900154 - DNA, 25 bp, Mus musculus
ccagcgcgtgcgacgaattcatacc

SEQ ID NO: 900155 - DNA, 25 bp, Mus musculus
ccagcgcgtggcatgaagcactacc

SEQ ID NO: 900156 - DNA, 25 bp, Mus musculus
ccagcgcgtgggacgaattcatacc

SEQ ID NO: 900157 - DNA, 25 bp, Mus musculus
ccagcgctcttcagttatgttcttg

SEQ ID NO: 900158 - DNA, 25 bp, Mus musculus
ccagcgctcttctgttatgttcttg

SEQ ID NO: 900159 - DNA, 25 bp, Mus musculus
ccagcgcttcctccagcttttcttt

SEQ ID NO: 900160 - DNA, 25 bp, Mus musculus
ccagcgcttcctgcagcttttcttt

SEQ ID NO: 900161 - DNA, 25 bp, Mus musculus
ccagcggcccagcggcttgacttac

SEQ ID NO: 900162 - DNA, 25 bp, Mus musculus
ccagcggcccaggggcttgacttac

SEQ ID NO: 900163 - DNA, 25 bp, Mus musculus
ccagcggctgatactgaatcactgc

SEQ ID NO: 900164 - DNA, 25 bp, Mus musculus
ccagcggctgattctgaatcactgc

SEQ ID NO: 900165 - DNA, 25 bp, Mus musculus
ccagcgggagaacatggttggtaaa

SEQ ID NO: 900166 - DNA, 25 bp, Mus musculus
ccagcgggagaacgctctgcacccc

SEQ ID NO: 900167 - DNA, 25 bp, Mus musculus
ccagcgggagaacgttgatccaaaa

SEQ ID NO: 900168 - DNA, 25 bp, Mus musculus
ccagcgggagaagatggttggtaaa

SEQ ID NO: 900169 - DNA, 25 bp, Mus musculus
ccagcgggagaaggctctgcacccc

SEQ ID NO: 900170 - DNA, 25 bp, Mus musculus
ccagcgggagaaggttgatccaaaa

SEQ ID NO: 900171 - DNA, 25 bp, Mus musculus
ccagcggttctgagatatgcattgg

SEQ ID NO: 900172 - DNA, 25 bp, Mus musculus
ccagcggttctgtgatatgcattgg

SEQ ID NO: 900173 - DNA, 25 bp, Mus musculus
ccagcgtcctaacgggcaatgtcat

SEQ ID NO: 900174 - DNA, 25 bp, Mus musculus
ccagcgtcctaaggggcaatgtcat

SEQ ID NO: 900175 - DNA, 25 bp, Mus musculus
ccagcgtgcgcatgatgccaggcag

SEQ ID NO: 900176 - DNA, 25 bp, Mus musculus
ccagcgtgcggatgatgccaggcag

SEQ ID NO: 900177 - DNA, 25 bp, Mus musculus
ccagctaaagctatgctaacagaac

SEQ ID NO: 900178 - DNA, 25 bp, Mus musculus
ccagctaaaggacgctgtgagggga

SEQ ID NO: 900179 - DNA, 25 bp, Mus musculus
ccagctaaaggaggctgtgagggga

SEQ ID NO: 900180 - DNA, 25 bp, Mus musculus
ccagctaaaggtatgctaacagaac

SEQ ID NO: 900181 - DNA, 25 bp, Mus musculus
ccagctacatctcacgccagggctt

SEQ ID NO: 900182 - DNA, 25 bp, Mus musculus
ccagctacatctcacgcccctggtt

SEQ ID NO: 900183 - DNA, 25 bp, Mus musculus
ccagctacatctcaggccagggctt

SEQ ID NO: 900184 - DNA, 25 bp, Mus musculus
ccagctacatctcaggcccctggtt

SEQ ID NO: 900185 - DNA, 25 bp, Mus musculus
ccagctacctcaagatctttgtccc

SEQ ID NO: 900186 - DNA, 25 bp, Mus musculus
ccagctacctcatgatctttgtccc

SEQ ID NO: 900187 - DNA, 25 bp, Mus musculus
ccagctacggctccagcggctcctg

SEQ ID NO: 900188 - DNA, 25 bp, Mus musculus
ccagctacgggtccagcggctcctg

SEQ ID NO: 900189 - DNA, 25 bp, Mus musculus
ccagctactcagatggacgtcctat

SEQ ID NO: 900190 - DNA, 25 bp, Mus musculus
ccagctactcagttggacgtcctat

SEQ ID NO: 900191 - DNA, 25 bp, Mus musculus
ccagctagtggacgagaagactctg

SEQ ID NO: 900192 - DNA, 25 bp, Mus musculus
ccagctagtggaggagaagactctg

SEQ ID NO: 900193 - DNA, 25 bp, Mus musculus
ccagctatgccagactggtggaacc

SEQ ID NO: 900194 - DNA, 25 bp, Mus musculus
ccagctatgccagagtggtggaacc

SEQ ID NO: 900195 - DNA, 25 bp, Mus musculus
ccagctcaagcagcattgcctgaac

SEQ ID NO: 900196 - DNA, 25 bp, Mus musculus
ccagctcaaggagcattgcctgaac

SEQ ID NO: 900197 - DNA, 25 bp, Mus musculus
ccagctcagcaaagagtacacactg

SEQ ID NO: 900198 - DNA, 25 bp, Mus musculus
ccagctcagcaatgagtacacactg

SEQ ID NO: 900199 - DNA, 25 bp, Mus musculus
ccagctccaacgatctgaaagagtt

SEQ ID NO: 900200 - DNA, 25 bp, Mus musculus
ccagctccaacgatgtgaaagagtt

SEQ ID NO: 900201 - DNA, 25 bp, Mus musculus
ccagctccagagtgtggacctggtg

SEQ ID NO: 900202 - DNA, 25 bp, Mus musculus
ccagctccagtgtgtggacctggtg

SEQ ID NO: 900203 - DNA, 25 bp, Mus musculus
ccagctccccgttacgccagcaggt

SEQ ID NO: 900204 - DNA, 25 bp, Mus musculus
ccagctccccgttaggccagcaggt

SEQ ID NO: 900205 - DNA, 25 bp, Mus musculus
ccagctcctctgatgttgccaccca

SEQ ID NO: 900206 - DNA, 25 bp, Mus musculus
ccagctcctctgttgttgccaccca

SEQ ID NO: 900207 - DNA, 25 bp, Mus musculus
ccagctcgagctgacatggaggaca

SEQ ID NO: 900208 - DNA, 25 bp, Mus musculus
ccagctcgaggtgacatggaggaca

SEQ ID NO: 900209 - DNA, 25 bp, Mus musculus
ccagctcgcagccgcgcaagctgag

SEQ ID NO: 900210 - DNA, 25 bp, Mus musculus
ccagctcgcagccgggcaagctgag

SEQ ID NO: 900211 - DNA, 25 bp, Mus musculus
ccagctcggacccacccccaaaagg

SEQ ID NO: 900212 - DNA, 25 bp, Mus musculus
ccagctcggacccagccccaaaagg

SEQ ID NO: 900213 - DNA, 25 bp, Mus musculus
ccagctctcacccagcgcagccttg

SEQ ID NO: 900214 - DNA, 25 bp, Mus musculus
ccagctctcaccgagcgcagccttg

SEQ ID NO: 900215 - DNA, 25 bp, Mus musculus
ccagctctggcatgggttgaagaca

SEQ ID NO: 900216 - DNA, 25 bp, Mus musculus
ccagctctggcgagaactctgatat

SEQ ID NO: 900217 - DNA, 25 bp, Mus musculus
ccagctctgggatgggttgaagaca

SEQ ID NO: 900218 - DNA, 25 bp, Mus musculus
ccagctctggggaacccttggccac

SEQ ID NO: 900219 - DNA, 25 bp, Mus musculus
ccagctctggggaacctgctgccca

SEQ ID NO: 900220 - DNA, 25 bp, Mus musculus
ccagctctggggaagccttggccac

SEQ ID NO: 900221 - DNA, 25 bp, Mus musculus
ccagctctggggaagctgctgccca

SEQ ID NO: 900222 - DNA, 25 bp, Mus musculus
ccagctctggggagaactctgatat

SEQ ID NO: 900223 - DNA, 25 bp, Mus musculus
ccagctcttgccagaagactttaac

SEQ ID NO: 900224 - DNA, 25 bp, Mus musculus
ccagctcttggcagaagactttaac

SEQ ID NO: 900225 - DNA, 25 bp, Mus musculus
ccagctctttgtgtaggatgtttcg

SEQ ID NO: 900226 - DNA, 25 bp, Mus musculus
ccagctctttgtgttggatgtttcg

SEQ ID NO: 900227 - DNA, 25 bp, Mus musculus
ccagctgaagacttgattgcaattt

SEQ ID NO: 900228 - DNA, 25 bp, Mus musculus
ccagctgaagcaactgagagagata

SEQ ID NO: 900229 - DNA, 25 bp, Mus musculus
ccagctgaaggaactgagagagata

SEQ ID NO: 900230 - DNA, 25 bp, Mus musculus
ccagctgaagtcttgattgcaattt

SEQ ID NO: 900231 - DNA, 25 bp, Mus musculus
ccagctgacgctgagagggccttgg

SEQ ID NO: 900232 - DNA, 25 bp, Mus musculus
ccagctgacggtgagagggccttgg

SEQ ID NO: 900233 - DNA, 25 bp, Mus musculus
ccagctgactcaccaaatggaactt

SEQ ID NO: 900234 - DNA, 25 bp, Mus musculus
ccagctgactcagcaaatggaactt

SEQ ID NO: 900235 - DNA, 25 bp, Mus musculus
ccagctgagcaccttgagccacgtg

SEQ ID NO: 900236 - DNA, 25 bp, Mus musculus
ccagctgagcacgttgagccacgtg

SEQ ID NO: 900237 - DNA, 25 bp, Mus musculus
ccagctgatcctcataccgctattg

SEQ ID NO: 900238 - DNA, 25 bp, Mus musculus
ccagctgatcctgataccgctattg

SEQ ID NO: 900239 - DNA, 25 bp, Mus musculus
ccagctgcagcaagctgagcagacc

SEQ ID NO: 900240 - DNA, 25 bp, Mus musculus
ccagctgcagctgcacatcgaggag

SEQ ID NO: 900241 - DNA, 25 bp, Mus musculus
ccagctgcagctgctcatcgaggag

SEQ ID NO: 900242 - DNA, 25 bp, Mus musculus
ccagctgcaggaagctgagcagacc

SEQ ID NO: 900243 - DNA, 25 bp, Mus musculus
ccagctgccgcactgccctccaggg

SEQ ID NO: 900244 - DNA, 25 bp, Mus musculus
ccagctgccggactgccctccaggg

SEQ ID NO: 900245 - DNA, 25 bp, Mus musculus
ccagctgcgcagacaactttactgg

SEQ ID NO: 900246 - DNA, 25 bp, Mus musculus
ccagctgcgcagactactttactgg

SEQ ID NO: 900247 - DNA, 25 bp, Mus musculus
ccagctgctcagcagccgggctggg

SEQ ID NO: 900248 - DNA, 25 bp, Mus musculus
ccagctgctcaggagccgggctggg

SEQ ID NO: 900249 - DNA, 25 bp, Mus musculus
ccagctgctgagaacccaatatggc

SEQ ID NO: 900250 - DNA, 25 bp, Mus musculus
ccagctgctgtgaacccaatatggc

SEQ ID NO: 900251 - DNA, 25 bp, Mus musculus
ccagctggagatcaccattcttaga

SEQ ID NO: 900252 - DNA, 25 bp, Mus musculus
ccagctggagatcagcattcttaga

SEQ ID NO: 900253 - DNA, 25 bp, Mus musculus
ccagctggcaagcttatgaaaacta

SEQ ID NO: 900254 - DNA, 25 bp, Mus musculus
ccagctggcaaggttatgaaaacta

SEQ ID NO: 900255 - DNA, 25 bp, Mus musculus
ccagctggcagacgcatacttgtac

SEQ ID NO: 900256 - DNA, 25 bp, Mus musculus
ccagctggcagaggcatacttgtac

SEQ ID NO: 900257 - DNA, 25 bp, Mus musculus
ccagctggtacacgctgtgaaattt

SEQ ID NO: 900258 - DNA, 25 bp, Mus musculus
ccagctggtacaggctgtgaaattt

SEQ ID NO: 900259 - DNA, 25 bp, Mus musculus
ccagctggtggacgaggaagtgaac

SEQ ID NO: 900260 - DNA, 25 bp, Mus musculus
ccagctggtggaggaggaagtgaac

SEQ ID NO: 900261 - DNA, 25 bp, Mus musculus
ccagctgtatgacgacaaccacgag

SEQ ID NO: 900262 - DNA, 25 bp, Mus musculus
ccagctgtatgaggacaaccacgag

SEQ ID NO: 900263 - DNA, 25 bp, Mus musculus
ccagctgtcttgcacgtggaatgcc

SEQ ID NO: 900264 - DNA, 25 bp, Mus musculus
ccagctgtcttgcaggtggaatgcc

SEQ ID NO: 900265 - DNA, 25 bp, Mus musculus
ccagctgtgagacacacattgacga

SEQ ID NO: 900266 - DNA, 25 bp, Mus musculus
ccagctgtgagacacactcttcctg

SEQ ID NO: 900267 - DNA, 25 bp, Mus musculus
ccagctgtgagacagacattgacga

SEQ ID NO: 900268 - DNA, 25 bp, Mus musculus
ccagctgtgagacagactcttcctg

SEQ ID NO: 900269 - DNA, 25 bp, Mus musculus
ccagctgtggcgcagttttggcacg

SEQ ID NO: 900270 - DNA, 25 bp, Mus musculus
ccagctgtggggcagttttggcacg

SEQ ID NO: 900271 - DNA, 25 bp, Mus musculus
ccagcttatgagcattgaggaggct

SEQ ID NO: 900272 - DNA, 25 bp, Mus musculus
ccagcttatgaggattgaggaggct

SEQ ID NO: 900273 - DNA, 25 bp, Mus musculus
ccagcttccctcccaacctcctgac

SEQ ID NO: 900274 - DNA, 25 bp, Mus musculus
ccagcttccctcccggggctgcggt

SEQ ID NO: 900275 - DNA, 25 bp, Mus musculus
ccagcttccctcgcaacctcctgac

SEQ ID NO: 900276 - DNA, 25 bp, Mus musculus
ccagcttccctcgcggggctgcggt

SEQ ID NO: 900277 - DNA, 25 bp, Mus musculus
ccagcttcctgacatagaagacatg

SEQ ID NO: 900278 - DNA, 25 bp, Mus musculus
ccagcttcctgagatagaagacatg

SEQ ID NO: 900279 - DNA, 25 bp, Mus musculus
ccagcttccttgaacacacccacag

SEQ ID NO: 900280 - DNA, 25 bp, Mus musculus
ccagcttccttgaagacacccacag

SEQ ID NO: 900281 - DNA, 25 bp, Mus musculus
ccagcttcgcaggacccaacctcct

SEQ ID NO: 900282 - DNA, 25 bp, Mus musculus
ccagcttcgctggacccaacctcct

SEQ ID NO: 900283 - DNA, 25 bp, Mus musculus
ccagcttctatacaggaagggtcca

SEQ ID NO: 900284 - DNA, 25 bp, Mus musculus
ccagcttctatagaggaagggtcca

SEQ ID NO: 900285 - DNA, 25 bp, Mus musculus
ccagctttaatgccaccaccacctc

SEQ ID NO: 900286 - DNA, 25 bp, Mus musculus
ccagctttaatggcaccaccacctc

SEQ ID NO: 900287 - DNA, 25 bp, Mus musculus
ccagctttagtcctcaaaggccagt

SEQ ID NO: 900288 - DNA, 25 bp, Mus musculus
ccagctttagtcgtcaaaggccagt

SEQ ID NO: 900289 - DNA, 25 bp, Mus musculus
ccagctttccagctgggatcgagga

SEQ ID NO: 900290 - DNA, 25 bp, Mus musculus
ccagctttccaggtgggatcgagga

SEQ ID NO: 900291 - DNA, 25 bp, Mus musculus
ccagctttcgaccccaggactatct

SEQ ID NO: 900292 - DNA, 25 bp, Mus musculus
ccagctttcgacccgaggactatct

SEQ ID NO: 900293 - DNA, 25 bp, Mus musculus
ccagctttgataagcacaagttaac

SEQ ID NO: 900294 - DNA, 25 bp, Mus musculus
ccagctttgataaggacaagttaac

SEQ ID NO: 900295 - DNA, 25 bp, Mus musculus
ccagctttggggcgctggctgtggg

SEQ ID NO: 900296 - DNA, 25 bp, Mus musculus
ccagctttggggggctggctgtggg

SEQ ID NO: 900297 - DNA, 25 bp, Mus musculus
ccaggaaaagcgcgcatcttctgtc

SEQ ID NO: 900298 - DNA, 25 bp, Mus musculus
ccaggaaaagcgggcatcttctgtc

SEQ ID NO: 900299 - DNA, 25 bp, Mus musculus
ccaggaaaataacttctgaaaatca

SEQ ID NO: 900300 - DNA, 25 bp, Mus musculus
ccaggaaaataagttctgaaaatca

SEQ ID NO: 900301 - DNA, 25 bp, Mus musculus
ccaggaaaatctttacatgaggaac

SEQ ID NO: 900302 - DNA, 25 bp, Mus musculus
ccaggaaaatgtttacatgaggaac

SEQ ID NO: 900303 - DNA, 25 bp, Mus musculus
ccaggaaaccagcaatgacacggga

SEQ ID NO: 900304 - DNA, 25 bp, Mus musculus
ccaggaaaccaggaatgacacggga

SEQ ID NO: 900305 - DNA, 25 bp, Mus musculus
ccaggaaatcctcccaacaagggat

SEQ ID NO: 900306 - DNA, 25 bp, Mus musculus
ccaggaaatcctgccaacaagggat

SEQ ID NO: 900307 - DNA, 25 bp, Mus musculus
ccaggaaatgcacgttttccttact

SEQ ID NO: 900308 - DNA, 25 bp, Mus musculus
ccaggaaatgcaggttttccttact

SEQ ID NO: 900309 - DNA, 25 bp, Mus musculus
ccaggaacacaaagctaagaaagca

SEQ ID NO: 900310 - DNA, 25 bp, Mus musculus
ccaggaacacaaaggtaagaaagca

SEQ ID NO: 900311 - DNA, 25 bp, Mus musculus
ccaggaacagagagaacattataag

SEQ ID NO: 900312 - DNA, 25 bp, Mus musculus
ccaggaacagtgagaacattataag

SEQ ID NO: 900313 - DNA, 25 bp, Mus musculus
ccaggaactcacaaccaagttgtgt

SEQ ID NO: 900314 - DNA, 25 bp, Mus musculus
ccaggaactcacacagaaccaagtt

SEQ ID NO: 900315 - DNA, 25 bp, Mus musculus
ccaggaactcactaccaagttgtgt

SEQ ID NO: 900316 - DNA, 25 bp, Mus musculus
ccaggaactcactcagaaccaagtt

SEQ ID NO: 900317 - DNA, 25 bp, Mus musculus
ccaggaactcgacgctcctggagga

SEQ ID NO: 900318 - DNA, 25 bp, Mus musculus
ccaggaactcgaggctcctggagga

SEQ ID NO: 900319 - DNA, 25 bp, Mus musculus
ccaggaacttcacgatcatctggga

SEQ ID NO: 900320 - DNA, 25 bp, Mus musculus
ccaggaacttcacttggcgagtctt

SEQ ID NO: 900321 - DNA, 25 bp, Mus musculus
ccaggaacttcaggatcatctggga

SEQ ID NO: 900322 - DNA, 25 bp, Mus musculus
ccaggaacttcagttggcgagtctt

SEQ ID NO: 900323 - DNA, 25 bp, Mus musculus
ccaggaagaaagcaaaatcagaggc

SEQ ID NO: 900324 - DNA, 25 bp, Mus musculus
ccaggaagaaaggaaaatcagaggc

SEQ ID NO: 900325 - DNA, 25 bp, Mus musculus
ccaggaagagcacatgacagatgac

SEQ ID NO: 900326 - DNA, 25 bp, Mus musculus
ccaggaagagcacgatttcatcact

SEQ ID NO: 900327 - DNA, 25 bp, Mus musculus
ccaggaagagcaggatttcatcact

SEQ ID NO: 900328 - DNA, 25 bp, Mus musculus
ccaggaagagcctccacctctcctc

SEQ ID NO: 900329 - DNA, 25 bp, Mus musculus
ccaggaagaggaaacagatgagccg

SEQ ID NO: 900330 - DNA, 25 bp, Mus musculus
ccaggaagaggaaagagatgagccg

SEQ ID NO: 900331 - DNA, 25 bp, Mus musculus
ccaggaagaggacatgacagatgac

SEQ ID NO: 900332 - DNA, 25 bp, Mus musculus
ccaggaagaggctccacctctcctc

SEQ ID NO: 900333 - DNA, 25 bp, Mus musculus
ccaggaagcagagacgagaaaagga

SEQ ID NO: 900334 - DNA, 25 bp, Mus musculus
ccaggaagcagagaggagaaaagga

SEQ ID NO: 900335 - DNA, 25 bp, Mus musculus
ccaggaagccagcctcaggaaccct

SEQ ID NO: 900336 - DNA, 25 bp, Mus musculus
ccaggaagccagctctttggccagt

SEQ ID NO: 900337 - DNA, 25 bp, Mus musculus
ccaggaagccaggctcaggaaccct

SEQ ID NO: 900338 - DNA, 25 bp, Mus musculus
ccaggaagccaggtctttggccagt

SEQ ID NO: 900339 - DNA, 25 bp, Mus musculus
ccaggaagccctgacgtcacttggt

SEQ ID NO: 900340 - DNA, 25 bp, Mus musculus
ccaggaagccctgacgtgtggttcc

SEQ ID NO: 900341 - DNA, 25 bp, Mus musculus
ccaggaagccctgaggtcacttggt

SEQ ID NO: 900342 - DNA, 25 bp, Mus musculus
ccaggaagccctgaggtgtggttcc

SEQ ID NO: 900343 - DNA, 25 bp, Mus musculus
ccaggaagcgccacacccccagagg

SEQ ID NO: 900344 - DNA, 25 bp, Mus musculus
ccaggaagcgccactcccccagagg

SEQ ID NO: 900345 - DNA, 25 bp, Mus musculus
ccaggaagggacaatattgatcagt

SEQ ID NO: 900346 - DNA, 25 bp, Mus musculus
ccaggaagggactatattgatcagt

SEQ ID NO: 900347 - DNA, 25 bp, Mus musculus
ccaggacaaacaaccagctaagttc

SEQ ID NO: 900348 - DNA, 25 bp, Mus musculus
ccaggacaaacaacgagctaagttc

SEQ ID NO: 900349 - DNA, 25 bp, Mus musculus
ccaggacaagagctgcccagctgtg

SEQ ID NO: 900350 - DNA, 25 bp, Mus musculus
ccaggacaagaggtgcccagctgtg

SEQ ID NO: 900351 - DNA, 25 bp, Mus musculus
ccaggacaagatatttcaaggaaac

SEQ ID NO: 900352 - DNA, 25 bp, Mus musculus
ccaggacaagcacgtcccatgcatc

SEQ ID NO: 900353 - DNA, 25 bp, Mus musculus
ccaggacaagcaggtcccatgcatc

SEQ ID NO: 900354 - DNA, 25 bp, Mus musculus
ccaggacaagttatttcaaggaaac

SEQ ID NO: 900355 - DNA, 25 bp, Mus musculus
ccaggacacacgcgctacttgtcct

SEQ ID NO: 900356 - DNA, 25 bp, Mus musculus
ccaggacacacgggctacttgtcct

SEQ ID NO: 900357 - DNA, 25 bp, Mus musculus
ccaggacacgattctgtgttgtggg

SEQ ID NO: 900358 - DNA, 25 bp, Mus musculus
ccaggacacgtttctgtgttgtggg

SEQ ID NO: 900359 - DNA, 25 bp, Mus musculus
ccaggacagtagcgaacagacgccg

SEQ ID NO: 900360 - DNA, 25 bp, Mus musculus
ccaggacagtagggaacagacgccg

SEQ ID NO: 900361 - DNA, 25 bp, Mus musculus
ccaggacccagtcgaacaattggat

SEQ ID NO: 900362 - DNA, 25 bp, Mus musculus
ccaggacccagtggaacaattggat

SEQ ID NO: 900363 - DNA, 25 bp, Mus musculus
ccaggacccgcctgacacttggtaa

SEQ ID NO: 900364 - DNA, 25 bp, Mus musculus
ccaggacccgcgatcagtcaagaag

SEQ ID NO: 900365 - DNA, 25 bp, Mus musculus
ccaggacccggctgacacttggtaa

SEQ ID NO: 900366 - DNA, 25 bp, Mus musculus
ccaggacccgggatcagtcaagaag

SEQ ID NO: 900367 - DNA, 25 bp, Mus musculus
ccaggacgccaacggcttaagtcta

SEQ ID NO: 900368 - DNA, 25 bp, Mus musculus
ccaggacgccaagggcttaagtcta

SEQ ID NO: 900369 - DNA, 25 bp, Mus musculus
ccaggacgctggactgccatcaaag

SEQ ID NO: 900370 - DNA, 25 bp, Mus musculus
ccaggacgctggtctgccatcaaag

SEQ ID NO: 900371 - DNA, 25 bp, Mus musculus
ccaggacggggacacccatataatg

SEQ ID NO: 900372 - DNA, 25 bp, Mus musculus
ccaggacggggagacccatataatg

SEQ ID NO: 900373 - DNA, 25 bp, Mus musculus
ccaggactatagcgcagcagcagct

SEQ ID NO: 900374 - DNA, 25 bp, Mus musculus
ccaggactatgacactgataagcgg

SEQ ID NO: 900375 - DNA, 25 bp, Mus musculus
ccaggactatgacagtgataagcgg

SEQ ID NO: 900376 - DNA, 25 bp, Mus musculus
ccaggactattgcgcagcagcagct

SEQ ID NO: 900377 - DNA, 25 bp, Mus musculus
ccaggagaagcatgccctgcaagag

SEQ ID NO: 900378 - DNA, 25 bp, Mus musculus
ccaggagaaggatgccctgcaagag

SEQ ID NO: 900379 - DNA, 25 bp, Mus musculus
ccaggagaccagcgagagaaataca

SEQ ID NO: 900380 - DNA, 25 bp, Mus musculus
ccaggagaccagcgcctattttctg

SEQ ID NO: 900381 - DNA, 25 bp, Mus musculus
ccaggagaccagggagagaaataca

SEQ ID NO: 900382 - DNA, 25 bp, Mus musculus
ccaggagaccagggcctattttctg

SEQ ID NO: 900383 - DNA, 25 bp, Mus musculus
ccaggagacctggtcggtgtgaaca

SEQ ID NO: 900384 - DNA, 25 bp, Mus musculus
ccaggagacctggtgggtgtgaaca

SEQ ID NO: 900385 - DNA, 25 bp, Mus musculus
ccaggagagaggcgagaaaggggag

SEQ ID NO: 900386 - DNA, 25 bp, Mus musculus
ccaggagagaggggagaaaggggag

SEQ ID NO: 900387 - DNA, 25 bp, Mus musculus
ccaggagagcagctcggcagctctg

SEQ ID NO: 900388 - DNA, 25 bp, Mus musculus
ccaggagagcaggtcggcagctctg

SEQ ID NO: 900389 - DNA, 25 bp, Mus musculus
ccaggagatacattcgtaggtatgg

SEQ ID NO: 900390 - DNA, 25 bp, Mus musculus
ccaggagatacattggtaggtatgg

SEQ ID NO: 900391 - DNA, 25 bp, Mus musculus
ccaggagcagctcgctgcagagctg

SEQ ID NO: 900392 - DNA, 25 bp, Mus musculus
ccaggagcagctggctgcagagctg

SEQ ID NO: 900393 - DNA, 25 bp, Mus musculus
ccaggagcagctgtagctacttcac

SEQ ID NO: 900394 - DNA, 25 bp, Mus musculus
ccaggagcaggtgtagctacttcac

SEQ ID NO: 900395 - DNA, 25 bp, Mus musculus
ccaggagccaatcacgtgtccggta

SEQ ID NO: 900396 - DNA, 25 bp, Mus musculus
ccaggagccaatcaggtgtccggta

SEQ ID NO: 900397 - DNA, 25 bp, Mus musculus
ccaggagcctcggactctgtgacca

SEQ ID NO: 900398 - DNA, 25 bp, Mus musculus
ccaggagcctgggactctgtgacca

SEQ ID NO: 900399 - DNA, 25 bp, Mus musculus
ccaggagcggatccactccctggct

SEQ ID NO: 900400 - DNA, 25 bp, Mus musculus
ccaggagcggttcacgtctgtgacg

SEQ ID NO: 900401 - DNA, 25 bp, Mus musculus
ccaggagcggttcaggtctgtgacg

SEQ ID NO: 900402 - DNA, 25 bp, Mus musculus
ccaggagcggttccactccctggct

SEQ ID NO: 900403 - DNA, 25 bp, Mus musculus
ccaggagctctgaggtctacgctca

SEQ ID NO: 900404 - DNA, 25 bp, Mus musculus
ccaggagctctgtggtctacgctca

SEQ ID NO: 900405 - DNA, 25 bp, Mus musculus
ccaggagctgatcgattaacaggac

SEQ ID NO: 900406 - DNA, 25 bp, Mus musculus
ccaggagctgatggattaacaggac

SEQ ID NO: 900407 - DNA, 25 bp, Mus musculus
ccaggaggagagcctctctcggtat

SEQ ID NO: 900408 - DNA, 25 bp, Mus musculus
ccaggaggagaggctctctcggtat

SEQ ID NO: 900409 - DNA, 25 bp, Mus musculus
ccaggaggaggacccagtgaagaag

SEQ ID NO: 900410 - DNA, 25 bp, Mus musculus
ccaggaggaggagccagtgaagaag

SEQ ID NO: 900411 - DNA, 25 bp, Mus musculus
ccaggaggctcttctggctatgtcc

SEQ ID NO: 900412 - DNA, 25 bp, Mus musculus
ccaggaggctgttctggctatgtcc

SEQ ID NO: 900413 - DNA, 25 bp, Mus musculus
ccaggagggacgattctgacgttgg

SEQ ID NO: 900414 - DNA, 25 bp, Mus musculus
ccaggagggacgtttctgacgttgg

SEQ ID NO: 900415 - DNA, 25 bp, Mus musculus
ccaggaggtggcaacgtgcaaatag

SEQ ID NO: 900416 - DNA, 25 bp, Mus musculus
ccaggaggtggcaacgtgcagataa

SEQ ID NO: 900417 - DNA, 25 bp, Mus musculus
ccaggaggtggcaaggtgcaaatag

SEQ ID NO: 900418 - DNA, 25 bp, Mus musculus
ccaggaggtggcaaggtgcagataa

SEQ ID NO: 900419 - DNA, 25 bp, Mus musculus
ccaggagtttctcctcctacagaac

SEQ ID NO: 900420 - DNA, 25 bp, Mus musculus
ccaggagtttctgctcctacagaac

SEQ ID NO: 900421 - DNA, 25 bp, Mus musculus
ccaggatccaactcaaatattgatc

SEQ ID NO: 900422 - DNA, 25 bp, Mus musculus
ccaggatccaactctaatattgatc

SEQ ID NO: 900423 - DNA, 25 bp, Mus musculus
ccaggatccaggatttatccagagg

SEQ ID NO: 900424 - DNA, 25 bp, Mus musculus
ccaggatccaggcgccaggcagcac

SEQ ID NO: 900425 - DNA, 25 bp, Mus musculus
ccaggatccaggggccaggcagcac

SEQ ID NO: 900426 - DNA, 25 bp, Mus musculus
ccaggatccaggttttatccagagg

SEQ ID NO: 900427 - DNA, 25 bp, Mus musculus
ccaggatcccctcctgtgcccctgg

SEQ ID NO: 900428 - DNA, 25 bp, Mus musculus
ccaggatcccctcgcctcgctggac

SEQ ID NO: 900429 - DNA, 25 bp, Mus musculus
ccaggatcccctgctgtgcccctgg

SEQ ID NO: 900430 - DNA, 25 bp, Mus musculus
ccaggatcccctggcctcgctggac

SEQ ID NO: 900431 - DNA, 25 bp, Mus musculus
ccaggatcctccagagtctccagaa

SEQ ID NO: 900432 - DNA, 25 bp, Mus musculus
ccaggatcctccagtgtctccagaa

SEQ ID NO: 900433 - DNA, 25 bp, Mus musculus
ccaggatgaagccgacgctcatgca

SEQ ID NO: 900434 - DNA, 25 bp, Mus musculus
ccaggatgaagcggacgctcatgca

SEQ ID NO: 900435 - DNA, 25 bp, Mus musculus
ccaggatgaccctgacatcgtagct

SEQ ID NO: 900436 - DNA, 25 bp, Mus musculus
ccaggatgaccctgtcatcgtagct

SEQ ID NO: 900437 - DNA, 25 bp, Mus musculus
ccaggatgaccgattcttccaggac

SEQ ID NO: 900438 - DNA, 25 bp, Mus musculus
ccaggatgaccgtttcttccaggac

SEQ ID NO: 900439 - DNA, 25 bp, Mus musculus
ccaggatgctaacatggctggtatt

SEQ ID NO: 900440 - DNA, 25 bp, Mus musculus
ccaggatgctaagatggctggtatt

SEQ ID NO: 900441 - DNA, 25 bp, Mus musculus
ccaggatgctgacgttggtgatggc

SEQ ID NO: 900442 - DNA, 25 bp, Mus musculus
ccaggatgctgaggttggtgatggc

SEQ ID NO: 900443 - DNA, 25 bp, Mus musculus
ccaggatgctgatgcattctctgct

SEQ ID NO: 900444 - DNA, 25 bp, Mus musculus
ccaggatgctgatggattctctgct

SEQ ID NO: 900445 - DNA, 25 bp, Mus musculus
ccaggatgctggcacgtatctgtgt

SEQ ID NO: 900446 - DNA, 25 bp, Mus musculus
ccaggatgctggcaggtatctgtgt

SEQ ID NO: 900447 - DNA, 25 bp, Mus musculus
ccaggatggccacggccccaatcct

SEQ ID NO: 900448 - DNA, 25 bp, Mus musculus
ccaggatggccagggccccaatcct

SEQ ID NO: 900449 - DNA, 25 bp, Mus musculus
ccaggatggctgatatagacagaat

SEQ ID NO: 900450 - DNA, 25 bp, Mus musculus
ccaggatggctgttatagacagaat

SEQ ID NO: 900451 - DNA, 25 bp, Mus musculus
ccaggatttcagattcttcccacgg

SEQ ID NO: 900452 - DNA, 25 bp, Mus musculus
ccaggatttcagtttcttcccacgg

SEQ ID NO: 900453 - DNA, 25 bp, Mus musculus
ccaggatttgagcaactacagtttc

SEQ ID NO: 900454 - DNA, 25 bp, Mus musculus
ccaggatttgaggaactacagtttc

SEQ ID NO: 900455 - DNA, 25 bp, Mus musculus
ccaggatttgggcgtgctgtaacag

SEQ ID NO: 900456 - DNA, 25 bp, Mus musculus
ccaggatttgggggtgctgtaacag

SEQ ID NO: 900457 - DNA, 25 bp, Mus musculus
ccaggcaactaagcccatgtgggag

SEQ ID NO: 900458 - DNA, 25 bp, Mus musculus
ccaggcaactaagcgcatgtgggag

SEQ ID NO: 900459 - DNA, 25 bp, Mus musculus
ccaggcaaggagcgcctcatcggct

SEQ ID NO: 900460 - DNA, 25 bp, Mus musculus
ccaggcaaggagggcctcatcggct

SEQ ID NO: 900461 - DNA, 25 bp, Mus musculus
ccaggcaatgctggcccagtgatca

SEQ ID NO: 900462 - DNA, 25 bp, Mus musculus
ccaggcaatggtggcccagtgatca

SEQ ID NO: 900463 - DNA, 25 bp, Mus musculus
ccaggcacccatcgctcaaactacc

SEQ ID NO: 900464 - DNA, 25 bp, Mus musculus
ccaggcacccatggctcaaactacc

SEQ ID NO: 900465 - DNA, 25 bp, Mus musculus
ccaggcagaagactggtactttgga

SEQ ID NO: 900466 - DNA, 25 bp, Mus musculus
ccaggcagaagagtggtactttgga

SEQ ID NO: 900467 - DNA, 25 bp, Mus musculus
ccaggcagtgaacgaccgtgcaggc

SEQ ID NO: 900468 - DNA, 25 bp, Mus musculus
ccaggcagtgaacgcccttgctgct

SEQ ID NO: 900469 - DNA, 25 bp, Mus musculus
ccaggcagtgaaggaccgtgcaggc

SEQ ID NO: 900470 - DNA, 25 bp, Mus musculus
ccaggcagtgaaggcccttgctgct

SEQ ID NO: 900471 - DNA, 25 bp, Mus musculus
ccaggcatgaggcgccataaagggg

SEQ ID NO: 900472 - DNA, 25 bp, Mus musculus
ccaggcatgaggggccataaagggg

SEQ ID NO: 900473 - DNA, 25 bp, Mus musculus
ccaggcatgcgacgtctgctttgat

SEQ ID NO: 900474 - DNA, 25 bp, Mus musculus
ccaggcatgcgaggtctgctttgat

SEQ ID NO: 900475 - DNA, 25 bp, Mus musculus
ccaggccaaccacctcaccgtgggt

SEQ ID NO: 900476 - DNA, 25 bp, Mus musculus
ccaggccaaccagctcaccgtgggt

SEQ ID NO: 900477 - DNA, 25 bp, Mus musculus
ccaggccaagcagaacgatttcgat

SEQ ID NO: 900478 - DNA, 25 bp, Mus musculus
ccaggccaagcaggagtcagaaaag

SEQ ID NO: 900479 - DNA, 25 bp, Mus musculus
ccaggccaaggagaacgatttcgat

SEQ ID NO: 900480 - DNA, 25 bp, Mus musculus
ccaggccaaggaggagtcagaaaag

SEQ ID NO: 900481 - DNA, 25 bp, Mus musculus
ccaggccaatcgctccctcttcgca

SEQ ID NO: 900482 - DNA, 25 bp, Mus musculus
ccaggccaatcggtccctcttcgca

SEQ ID NO: 900483 - DNA, 25 bp, Mus musculus
ccaggccactcacgatcggaacgtc

SEQ ID NO: 900484 - DNA, 25 bp, Mus musculus
ccaggccactcaggatcggaacgtc

SEQ ID NO: 900485 - DNA, 25 bp, Mus musculus
ccaggccagcagagggctctggcaa

SEQ ID NO: 900486 - DNA, 25 bp, Mus musculus
ccaggccagcagctgtacagtgggc

SEQ ID NO: 900487 - DNA, 25 bp, Mus musculus
ccaggccagcaggtgtacagtgggc

SEQ ID NO: 900488 - DNA, 25 bp, Mus musculus
ccaggccagcagtgggctctggcaa

SEQ ID NO: 900489 - DNA, 25 bp, Mus musculus
ccaggcccagccgtgctggtcacca

SEQ ID NO: 900490 - DNA, 25 bp, Mus musculus
ccaggcccaggcgtgctggtcacca

SEQ ID NO: 900491 - DNA, 25 bp, Mus musculus
ccaggcccgaagcacatacacagag

SEQ ID NO: 900492 - DNA, 25 bp, Mus musculus
ccaggcccgaaggacatacacagag

SEQ ID NO: 900493 - DNA, 25 bp, Mus musculus
ccaggcccgactctttcttggaagt

SEQ ID NO: 900494 - DNA, 25 bp, Mus musculus
ccaggcccgactgtttcttggaagt

SEQ ID NO: 900495 - DNA, 25 bp, Mus musculus
ccaggccctcagtgcctcccacaga

SEQ ID NO: 900496 - DNA, 25 bp, Mus musculus
ccaggccctcagtggctcccacaga

SEQ ID NO: 900497 - DNA, 25 bp, Mus musculus
ccaggccctcagttattatgagaag

SEQ ID NO: 900498 - DNA, 25 bp, Mus musculus
ccaggccctcagtttttatgagaag

SEQ ID NO: 900499 - DNA, 25 bp, Mus musculus
ccaggccctgaatgaagaagagtca

SEQ ID NO: 900500 - DNA, 25 bp, Mus musculus
ccaggccctgtatgaagaagagtca

SEQ ID NO: 900501 - DNA, 25 bp, Mus musculus
ccaggccgtgaatgaccagtgcctg

SEQ ID NO: 900502 - DNA, 25 bp, Mus musculus
ccaggccgtgcactaaagaccagga

SEQ ID NO: 900503 - DNA, 25 bp, Mus musculus
ccaggccgtggactaaagaccagga

SEQ ID NO: 900504 - DNA, 25 bp, Mus musculus
ccaggccgtgtatgaccagtgcctg

SEQ ID NO: 900505 - DNA, 25 bp, Mus musculus
ccaggcctctggcacagcctgcccc

SEQ ID NO: 900506 - DNA, 25 bp, Mus musculus
ccaggcctctggcagagcctgcccc

SEQ ID NO: 900507 - DNA, 25 bp, Mus musculus
ccaggccttgcgccagttcctgtgg

SEQ ID NO: 900508 - DNA, 25 bp, Mus musculus
ccaggccttgcggcagttcctgtgg

SEQ ID NO: 900509 - DNA, 25 bp, Mus musculus
ccaggcgcggcgcgatatgtggtac

SEQ ID NO: 900510 - DNA, 25 bp, Mus musculus
ccaggcgcggcgggatatgtggtac

SEQ ID NO: 900511 - DNA, 25 bp, Mus musculus
ccaggcggatggcacccttatcaca

SEQ ID NO: 900512 - DNA, 25 bp, Mus musculus
ccaggcggatgggacccttatcaca

SEQ ID NO: 900513 - DNA, 25 bp, Mus musculus
ccaggcggggcgcacctgggcacca

SEQ ID NO: 900514 - DNA, 25 bp, Mus musculus
ccaggcggggcgcagctgggcacca

SEQ ID NO: 900515 - DNA, 25 bp, Mus musculus
ccaggctacaaacaacccaagagat

SEQ ID NO: 900516 - DNA, 25 bp, Mus musculus
ccaggctacaaagaacccaagagat

SEQ ID NO: 900517 - DNA, 25 bp, Mus musculus
ccaggctacacacgaagcatgtgta

SEQ ID NO: 900518 - DNA, 25 bp, Mus musculus
ccaggctacacaggaagcatgtgta

SEQ ID NO: 900519 - DNA, 25 bp, Mus musculus
ccaggctacatccttttgttttaca

SEQ ID NO: 900520 - DNA, 25 bp, Mus musculus
ccaggctacatcgttttgttttaca

SEQ ID NO: 900521 - DNA, 25 bp, Mus musculus
ccaggctaccagagcgtggcttctc

SEQ ID NO: 900522 - DNA, 25 bp, Mus musculus
ccaggctaccagtgcgtggcttctc

SEQ ID NO: 900523 - DNA, 25 bp, Mus musculus
ccaggctcacagaacagagctgtga

SEQ ID NO: 900524 - DNA, 25 bp, Mus musculus
ccaggctcacagaacgctgttcatt

SEQ ID NO: 900525 - DNA, 25 bp, Mus musculus
ccaggctcacagaagagagctgtga

SEQ ID NO: 900526 - DNA, 25 bp, Mus musculus
ccaggctcacagaaggctgttcatt

SEQ ID NO: 900527 - DNA, 25 bp, Mus musculus
ccaggctctgcccaggcagtacatg

SEQ ID NO: 900528 - DNA, 25 bp, Mus musculus
ccaggctctggccaggcagtacatg

SEQ ID NO: 900529 - DNA, 25 bp, Mus musculus
ccaggctgacaacgcccttttagct

SEQ ID NO: 900530 - DNA, 25 bp, Mus musculus
ccaggctgacaaggcccttttagct

SEQ ID NO: 900531 - DNA, 25 bp, Mus musculus
ccaggctgcaggcctgtgggccgaa

SEQ ID NO: 900532 - DNA, 25 bp, Mus musculus
ccaggctgcagggctgtgggccgaa

SEQ ID NO: 900533 - DNA, 25 bp, Mus musculus
ccaggctggaagaactctattcgtc

SEQ ID NO: 900534 - DNA, 25 bp, Mus musculus
ccaggctggaagtactctattcgtc

SEQ ID NO: 900535 - DNA, 25 bp, Mus musculus
ccaggctggcagcaaccacacagag

SEQ ID NO: 900536 - DNA, 25 bp, Mus musculus
ccaggctggcagctgctcaccgagt

SEQ ID NO: 900537 - DNA, 25 bp, Mus musculus
ccaggctggcaggaaccacacagag

SEQ ID NO: 900538 - DNA, 25 bp, Mus musculus
ccaggctggcaggtgctcaccgagt

SEQ ID NO: 900539 - DNA, 25 bp, Mus musculus
ccaggctggcatgaaatcctggggc

SEQ ID NO: 900540 - DNA, 25 bp, Mus musculus
ccaggctggcatgatatcctggggc

SEQ ID NO: 900541 - DNA, 25 bp, Mus musculus
ccaggctgttcacaaggctgtgggc

SEQ ID NO: 900542 - DNA, 25 bp, Mus musculus
ccaggctgttcacgtcctgctctcc

SEQ ID NO: 900543 - DNA, 25 bp, Mus musculus
ccaggctgttcagaaggctgtgggc

SEQ ID NO: 900544 - DNA, 25 bp, Mus musculus
ccaggctgttcaggtcctgctctcc

SEQ ID NO: 900545 - DNA, 25 bp, Mus musculus
ccaggcttcttccaccccttcatgt

SEQ ID NO: 900546 - DNA, 25 bp, Mus musculus
ccaggcttcttccagcccttcatgt

SEQ ID NO: 900547 - DNA, 25 bp, Mus musculus
ccagggaaactgcgatctgttggca

SEQ ID NO: 900548 - DNA, 25 bp, Mus musculus
ccagggaaactgggatctgttggca

SEQ ID NO: 900549 - DNA, 25 bp, Mus musculus
ccagggacagactcactctgtggag

SEQ ID NO: 900550 - DNA, 25 bp, Mus musculus
ccagggacagctggtggagtttgac

SEQ ID NO: 900551 - DNA, 25 bp, Mus musculus
ccagggacaggtggtggagtttgac

SEQ ID NO: 900552 - DNA, 25 bp, Mus musculus
ccagggacagtctcactctgtggag

SEQ ID NO: 900553 - DNA, 25 bp, Mus musculus
ccagggacatagcaatgttctagaa

SEQ ID NO: 900554 - DNA, 25 bp, Mus musculus
ccagggacataggaatgttctagaa

SEQ ID NO: 900555 - DNA, 25 bp, Mus musculus
ccagggaccactgacaggcctacgt

SEQ ID NO: 900556 - DNA, 25 bp, Mus musculus
ccagggaccactgaccctgagcaga

SEQ ID NO: 900557 - DNA, 25 bp, Mus musculus
ccagggaccactgagaggcctacgt

SEQ ID NO: 900558 - DNA, 25 bp, Mus musculus
ccagggaccactgagcctgagcaga

SEQ ID NO: 900559 - DNA, 25 bp, Mus musculus
ccagggacccagcacgtggacagta

SEQ ID NO: 900560 - DNA, 25 bp, Mus musculus
ccagggacccagcaggtggacagta

SEQ ID NO: 900561 - DNA, 25 bp, Mus musculus
ccagggacttatcgagctcctgttt

SEQ ID NO: 900562 - DNA, 25 bp, Mus musculus
ccagggacttttcgagctcctgttt

SEQ ID NO: 900563 - DNA, 25 bp, Mus musculus
ccagggagggcaagagtcatacaaa

SEQ ID NO: 900564 - DNA, 25 bp, Mus musculus
ccagggaggggaagagtcatacaaa

SEQ ID NO: 900565 - DNA, 25 bp, Mus musculus
ccagggagtaaacggacatctctac

SEQ ID NO: 900566 - DNA, 25 bp, Mus musculus
ccagggagtaaagggacatctctac

SEQ ID NO: 900567 - DNA, 25 bp, Mus musculus
ccagggatctcatgcgggctcctgg

SEQ ID NO: 900568 - DNA, 25 bp, Mus musculus
ccagggatctctctctccacccccg

SEQ ID NO: 900569 - DNA, 25 bp, Mus musculus
ccagggatctgatgcgggctcctgg

SEQ ID NO: 900570 - DNA, 25 bp, Mus musculus
ccagggatctgtctctccacccccg

SEQ ID NO: 900571 - DNA, 25 bp, Mus musculus
ccagggattcatcctgtattttcat

SEQ ID NO: 900572 - DNA, 25 bp, Mus musculus
ccagggattcatgctgtattttcat

SEQ ID NO: 900573 - DNA, 25 bp, Mus musculus
ccagggcaagaaccatcctcctcct

SEQ ID NO: 900574 - DNA, 25 bp, Mus musculus
ccagggcaagaacgtgggaatccta

SEQ ID NO: 900575 - DNA, 25 bp, Mus musculus
ccagggcaagaagcatcctcctcct

SEQ ID NO: 900576 - DNA, 25 bp, Mus musculus
ccagggcaagaaggtgggaatccta

SEQ ID NO: 900577 - DNA, 25 bp, Mus musculus
ccagggcaagcattctgtacccaga

SEQ ID NO: 900578 - DNA, 25 bp, Mus musculus
ccagggcaagccccaggactggacg

SEQ ID NO: 900579 - DNA, 25 bp, Mus musculus
ccagggcaagctggctgcctttgac

SEQ ID NO: 900580 - DNA, 25 bp, Mus musculus
ccagggcaaggattctgtacccaga

SEQ ID NO: 900581 - DNA, 25 bp, Mus musculus
ccagggcaaggcccaggactggacg

SEQ ID NO: 900582 - DNA, 25 bp, Mus musculus
ccagggcaaggtggctgcctttgac

SEQ ID NO: 900583 - DNA, 25 bp, Mus musculus
ccagggcaccaacgctgctttggca

SEQ ID NO: 900584 - DNA, 25 bp, Mus musculus
ccagggcaccaacttctccagccaa

SEQ ID NO: 900585 - DNA, 25 bp, Mus musculus
ccagggcaccaaggctgctttggca

SEQ ID NO: 900586 - DNA, 25 bp, Mus musculus
ccagggcaccaagttctccagccaa

SEQ ID NO: 900587 - DNA, 25 bp, Mus musculus
ccagggccagatgtcatggaccacg

SEQ ID NO: 900588 - DNA, 25 bp, Mus musculus
ccagggccagttgtcatggaccacg

SEQ ID NO: 900589 - DNA, 25 bp, Mus musculus
ccagggccctcccggcagagcgccg

SEQ ID NO: 900590 - DNA, 25 bp, Mus musculus
ccagggccctccgggcagagcgccg

SEQ ID NO: 900591 - DNA, 25 bp, Mus musculus
ccagggctacatcgtgcttcaggca

SEQ ID NO: 900592 - DNA, 25 bp, Mus musculus
ccagggctacatggtgcttcaggca

SEQ ID NO: 900593 - DNA, 25 bp, Mus musculus
ccagggctctcccaacctagctagc

SEQ ID NO: 900594 - DNA, 25 bp, Mus musculus
ccagggctctcccagaccgaagccc

SEQ ID NO: 900595 - DNA, 25 bp, Mus musculus
ccagggctctcccgcgcatctccca

SEQ ID NO: 900596 - DNA, 25 bp, Mus musculus
ccagggctctccgaacctagctagc

SEQ ID NO: 900597 - DNA, 25 bp, Mus musculus
ccagggctctccgagaccgaagccc

SEQ ID NO: 900598 - DNA, 25 bp, Mus musculus
ccagggctctccggcgcatctccca

SEQ ID NO: 900599 - DNA, 25 bp, Mus musculus
ccagggctgcctcacgtcgcatagg

SEQ ID NO: 900600 - DNA, 25 bp, Mus musculus
ccagggctgcctcaggtcgcatagg

SEQ ID NO: 900601 - DNA, 25 bp, Mus musculus
ccaggggcaacgccatcgccttctc

SEQ ID NO: 900602 - DNA, 25 bp, Mus musculus
ccaggggcaacggcatcgccttctc

SEQ ID NO: 900603 - DNA, 25 bp, Mus musculus
ccaggggccttccacagtagaggcc

SEQ ID NO: 900604 - DNA, 25 bp, Mus musculus
ccaggggccttccagagtagaggcc

SEQ ID NO: 900605 - DNA, 25 bp, Mus musculus
ccagggggcaggcacccactcccga

SEQ ID NO: 900606 - DNA, 25 bp, Mus musculus
ccagggggcaggcagccactcccga

SEQ ID NO: 900607 - DNA, 25 bp, Mus musculus
ccagggtcagaactactacgcatcc

SEQ ID NO: 900608 - DNA, 25 bp, Mus musculus
ccagggtcagaagtactacgcatcc

SEQ ID NO: 900609 - DNA, 25 bp, Mus musculus
ccagggtcagcgcgagcacctggcg

SEQ ID NO: 900610 - DNA, 25 bp, Mus musculus
ccagggtcagcgggagcacctggcg

SEQ ID NO: 900611 - DNA, 25 bp, Mus musculus
ccagggtcagctgaaccaccaaaat

SEQ ID NO: 900612 - DNA, 25 bp, Mus musculus
ccagggtcagcttccaagcaaccgc

SEQ ID NO: 900613 - DNA, 25 bp, Mus musculus
ccagggtcaggtgaaccaccaaaat

SEQ ID NO: 900614 - DNA, 25 bp, Mus musculus
ccagggtcaggttccaagcaaccgc

SEQ ID NO: 900615 - DNA, 25 bp, Mus musculus
ccagggtcttggcctcgaaatgtga

SEQ ID NO: 900616 - DNA, 25 bp, Mus musculus
ccagggtcttgggctcgaaatgtga

SEQ ID NO: 900617 - DNA, 25 bp, Mus musculus
ccagggtgactctaaatctgcattt

SEQ ID NO: 900618 - DNA, 25 bp, Mus musculus
ccagggtgactctatatctgcattt

SEQ ID NO: 900619 - DNA, 25 bp, Mus musculus
ccagggtgagaatatgattccttgt

SEQ ID NO: 900620 - DNA, 25 bp, Mus musculus
ccagggtgagtatatgattccttgt

SEQ ID NO: 900621 - DNA, 25 bp, Mus musculus
ccagggtgatcgcgggctaggagtg

SEQ ID NO: 900622 - DNA, 25 bp, Mus musculus
ccagggtgatggcgggctaggagtg

SEQ ID NO: 900623 - DNA, 25 bp, Mus musculus
ccagggtggtcacgaaaatcatgtc

SEQ ID NO: 900624 - DNA, 25 bp, Mus musculus
ccagggtggtcacgaaggtctatat

SEQ ID NO: 900625 - DNA, 25 bp, Mus musculus
ccagggtggtcaggaaaatcatgtc

SEQ ID NO: 900626 - DNA, 25 bp, Mus musculus
ccagggtggtcaggaaggtctatat

SEQ ID NO: 900627 - DNA, 25 bp, Mus musculus
ccagggttcaggctgccatggacac

SEQ ID NO: 900628 - DNA, 25 bp, Mus musculus
ccagggttcagggtgccatggacac

SEQ ID NO: 900629 - DNA, 25 bp, Mus musculus
ccaggtacagatcatattgatcagt

SEQ ID NO: 900630 - DNA, 25 bp, Mus musculus
ccaggtacagatgatattgatcagt

SEQ ID NO: 900631 - DNA, 25 bp, Mus musculus
ccaggtacctcatgtgatggtggtg

SEQ ID NO: 900632 - DNA, 25 bp, Mus musculus
ccaggtacctgatgtgatggtggtg

SEQ ID NO: 900633 - DNA, 25 bp, Mus musculus
ccaggtcaacagatacaagctgtcg

SEQ ID NO: 900634 - DNA, 25 bp, Mus musculus
ccaggtcaacagttacaagctgtcg

SEQ ID NO: 900635 - DNA, 25 bp, Mus musculus
ccaggtcaagcactatgagaaagcc

SEQ ID NO: 900636 - DNA, 25 bp, Mus musculus
ccaggtcaagcagtccatgaagatt

SEQ ID NO: 900637 - DNA, 25 bp, Mus musculus
ccaggtcaaggactatgagaaagcc

SEQ ID NO: 900638 - DNA, 25 bp, Mus musculus
ccaggtcaaggagtccatgaagatt

SEQ ID NO: 900639 - DNA, 25 bp, Mus musculus
ccaggtcgctcacgacatcagcaac

SEQ ID NO: 900640 - DNA, 25 bp, Mus musculus
ccaggtcgctcacgcttgcagatgg

SEQ ID NO: 900641 - DNA, 25 bp, Mus musculus
ccaggtcgctcaggacatcagcaac

SEQ ID NO: 900642 - DNA, 25 bp, Mus musculus
ccaggtcgctcaggcttgcagatgg

SEQ ID NO: 900643 - DNA, 25 bp, Mus musculus
ccaggtctcccgcctctgctttgtg

SEQ ID NO: 900644 - DNA, 25 bp, Mus musculus
ccaggtctcccggctctgctttgtg

SEQ ID NO: 900645 - DNA, 25 bp, Mus musculus
ccaggtgcaccaccgagcctgtcac

SEQ ID NO: 900646 - DNA, 25 bp, Mus musculus
ccaggtgcaccagcgagcctgtcac

SEQ ID NO: 900647 - DNA, 25 bp, Mus musculus
ccaggtgcagctcgtgatcaaggac

SEQ ID NO: 900648 - DNA, 25 bp, Mus musculus
ccaggtgcagctggtgatcaaggac

SEQ ID NO: 900649 - DNA, 25 bp, Mus musculus
ccaggtgccgtccacggatgcagcc

SEQ ID NO: 900650 - DNA, 25 bp, Mus musculus
ccaggtgccgtccagggatgcagcc

SEQ ID NO: 900651 - DNA, 25 bp, Mus musculus
ccaggtgctacacctcctagggaag

SEQ ID NO: 900652 - DNA, 25 bp, Mus musculus
ccaggtgctacagctcctagggaag

SEQ ID NO: 900653 - DNA, 25 bp, Mus musculus
ccaggtgctccacgccatccagaag

SEQ ID NO: 900654 - DNA, 25 bp, Mus musculus
ccaggtgctccaggccatccagaag

SEQ ID NO: 900655 - DNA, 25 bp, Mus musculus
ccaggtgcttcacgggctgacgttc

SEQ ID NO: 900656 - DNA, 25 bp, Mus musculus
ccaggtgcttcaggggctgacgttc

SEQ ID NO: 900657 - DNA, 25 bp, Mus musculus
ccaggtggaaagcaagcagaacaca

SEQ ID NO: 900658 - DNA, 25 bp, Mus musculus
ccaggtggaaagcatgcagaacaca

SEQ ID NO: 900659 - DNA, 25 bp, Mus musculus
ccaggtggagagcatatccgagggc

SEQ ID NO: 900660 - DNA, 25 bp, Mus musculus
ccaggtggagataagtcattgtgat

SEQ ID NO: 900661 - DNA, 25 bp, Mus musculus
ccaggtggagtgcatatccgagggc

SEQ ID NO: 900662 - DNA, 25 bp, Mus musculus
ccaggtggagttaagtcattgtgat

SEQ ID NO: 900663 - DNA, 25 bp, Mus musculus
ccaggtggtgatctgcgaccagtac

SEQ ID NO: 900664 - DNA, 25 bp, Mus musculus
ccaggtggtgatgtgcgaccagtac

SEQ ID NO: 900665 - DNA, 25 bp, Mus musculus
ccaggtgtccggcgtgaagatggcc

SEQ ID NO: 900666 - DNA, 25 bp, Mus musculus
ccaggtgtccggggtgaagatggcc

SEQ ID NO: 900667 - DNA, 25 bp, Mus musculus
ccaggttccctgaaagcacatcgag

SEQ ID NO: 900668 - DNA, 25 bp, Mus musculus
ccaggttccctgacacatcgagaac

SEQ ID NO: 900669 - DNA, 25 bp, Mus musculus
ccaggttccctgtaagcacatcgag

SEQ ID NO: 900670 - DNA, 25 bp, Mus musculus
ccaggttccctgtcacatcgagaac

SEQ ID NO: 900671 - DNA, 25 bp, Mus musculus
ccaggttgagctctggagaattgag

SEQ ID NO: 900672 - DNA, 25 bp, Mus musculus
ccaggttgaggtctggagaattgag

SEQ ID NO: 900673 - DNA, 25 bp, Mus musculus
ccagtaaacccactgatcaggtgta

SEQ ID NO: 900674 - DNA, 25 bp, Mus musculus
ccagtaaacccagtgatcaggtgta

SEQ ID NO: 900675 - DNA, 25 bp, Mus musculus
ccagtaatacatacaaactacaact

SEQ ID NO: 900676 - DNA, 25 bp, Mus musculus
ccagtaatacattcaaactacaact

SEQ ID NO: 900677 - DNA, 25 bp, Mus musculus
ccagtacagccacgtgaccgagctg

SEQ ID NO: 900678 - DNA, 25 bp, Mus musculus
ccagtacagccaggtgaccgagctg

SEQ ID NO: 900679 - DNA, 25 bp, Mus musculus
ccagtacatgagcatcccatcctct

SEQ ID NO: 900680 - DNA, 25 bp, Mus musculus
ccagtacatgaggatcccatcctct

SEQ ID NO: 900681 - DNA, 25 bp, Mus musculus
ccagtacctcgtctggctcacccag

SEQ ID NO: 900682 - DNA, 25 bp, Mus musculus
ccagtacctcgtgtggctcacccag

SEQ ID NO: 900683 - DNA, 25 bp, Mus musculus
ccagtacgacctgacgtcccagaag

SEQ ID NO: 900684 - DNA, 25 bp, Mus musculus
ccagtacgacctgaggtcccagaag

SEQ ID NO: 900685 - DNA, 25 bp, Mus musculus
ccagtacttcagactgaacccccag

SEQ ID NO: 900686 - DNA, 25 bp, Mus musculus
ccagtacttcagtctgaacccccag

SEQ ID NO: 900687 - DNA, 25 bp, Mus musculus
ccagtagaacaacagactaagtctg

SEQ ID NO: 900688 - DNA, 25 bp, Mus musculus
ccagtagaacaactatcatctcaga

SEQ ID NO: 900689 - DNA, 25 bp, Mus musculus
ccagtagaacaagagactaagtctg

SEQ ID NO: 900690 - DNA, 25 bp, Mus musculus
ccagtagaacaagtatcatctcaga

SEQ ID NO: 900691 - DNA, 25 bp, Mus musculus
ccagtagattctgccttataggcct

SEQ ID NO: 900692 - DNA, 25 bp, Mus musculus
ccagtagattgtgccttataggcct

SEQ ID NO: 900693 - DNA, 25 bp, Mus musculus
ccagtagcctagaggtgacaggaac

SEQ ID NO: 900694 - DNA, 25 bp, Mus musculus
ccagtagcctagtggtgacaggaac

SEQ ID NO: 900695 - DNA, 25 bp, Mus musculus
ccagtagtactacatgccaaatccg

SEQ ID NO: 900696 - DNA, 25 bp, Mus musculus
ccagtagtactagatgccaaatccg

SEQ ID NO: 900697 - DNA, 25 bp, Mus musculus
ccagtatagatgaaggcaaaagaaa

SEQ ID NO: 900698 - DNA, 25 bp, Mus musculus
ccagtatagatgtaggcaaaagaaa

SEQ ID NO: 900699 - DNA, 25 bp, Mus musculus
ccagtatgttgccgatgctatgggt

SEQ ID NO: 900700 - DNA, 25 bp, Mus musculus
ccagtatgttgcggatgctatgggt

SEQ ID NO: 900701 - DNA, 25 bp, Mus musculus
ccagtcaatgctatcattgagcatg

SEQ ID NO: 900702 - DNA, 25 bp, Mus musculus
ccagtcaatggtatcattgagcatg

SEQ ID NO: 900703 - DNA, 25 bp, Mus musculus
ccagtcacagtacaagaggcttgcc

SEQ ID NO: 900704 - DNA, 25 bp, Mus musculus
ccagtcacagtacatgaggcttgcc

SEQ ID NO: 900705 - DNA, 25 bp, Mus musculus
ccagtcactcagctgttagcattgc

SEQ ID NO: 900706 - DNA, 25 bp, Mus musculus
ccagtcactcaggtgttagcattgc

SEQ ID NO: 900707 - DNA, 25 bp, Mus musculus
ccagtcagaaaacagtttggtcagt

SEQ ID NO: 900708 - DNA, 25 bp, Mus musculus
ccagtcagaatacagtttggtcagt

SEQ ID NO: 900709 - DNA, 25 bp, Mus musculus
ccagtcagagagctcgcagtggttc

SEQ ID NO: 900710 - DNA, 25 bp, Mus musculus
ccagtcagagaggtcgcagtggttc

SEQ ID NO: 900711 - DNA, 25 bp, Mus musculus
ccagtcagagcgcgccagcgcttac

SEQ ID NO: 900712 - DNA, 25 bp, Mus musculus
ccagtcagagggcgccagcgcttac

SEQ ID NO: 900713 - DNA, 25 bp, Mus musculus
ccagtcagatcacgtttggactcct

SEQ ID NO: 900714 - DNA, 25 bp, Mus musculus
ccagtcagatcaggtttggactcct

SEQ ID NO: 900715 - DNA, 25 bp, Mus musculus
ccagtcaggatgctgaagcgcagct

SEQ ID NO: 900716 - DNA, 25 bp, Mus musculus
ccagtcaggatggtgaagcgcagct

SEQ ID NO: 900717 - DNA, 25 bp, Mus musculus
ccagtcagtacgacaactgcctgac

SEQ ID NO: 900718 - DNA, 25 bp, Mus musculus
ccagtcagtacgtcaactgcctgac

SEQ ID NO: 900719 - DNA, 25 bp, Mus musculus
ccagtcatacaggacatcgatgtgt

SEQ ID NO: 900720 - DNA, 25 bp, Mus musculus
ccagtcatacaggagatcgatgtgt

SEQ ID NO: 900721 - DNA, 25 bp, Mus musculus
ccagtcccgatgaacaactaagtgg

SEQ ID NO: 900722 - DNA, 25 bp, Mus musculus
ccagtcccgatgaacaatggataac

SEQ ID NO: 900723 - DNA, 25 bp, Mus musculus
ccagtcccgatgaagaactaagtgg

SEQ ID NO: 900724 - DNA, 25 bp, Mus musculus
ccagtcccgatgaagaatggataac

SEQ ID NO: 900725 - DNA, 25 bp, Mus musculus
ccagtcctacagagtctacagctac

SEQ ID NO: 900726 - DNA, 25 bp, Mus musculus
ccagtcctacagtgtctacagctac

SEQ ID NO: 900727 - DNA, 25 bp, Mus musculus
ccagtcctccgccaaaatgaccatg

SEQ ID NO: 900728 - DNA, 25 bp, Mus musculus
ccagtcctccgcgaaaatgaccatg

SEQ ID NO: 900729 - DNA, 25 bp, Mus musculus
ccagtctcagatggaagagagcagc

SEQ ID NO: 900730 - DNA, 25 bp, Mus musculus
ccagtctcagttggaagagagcagc

SEQ ID NO: 900731 - DNA, 25 bp, Mus musculus
ccagtctccaagatggcggtaaatg

SEQ ID NO: 900732 - DNA, 25 bp, Mus musculus
ccagtctccaagcaagaactagagt

SEQ ID NO: 900733 - DNA, 25 bp, Mus musculus
ccagtctccaaggaagaactagagt

SEQ ID NO: 900734 - DNA, 25 bp, Mus musculus
ccagtctccaagttggcggtaaatg

SEQ ID NO: 900735 - DNA, 25 bp, Mus musculus
ccagtctggccaccatgtgatggtg

SEQ ID NO: 900736 - DNA, 25 bp, Mus musculus
ccagtctggccagcatgtgatggtg

SEQ ID NO: 900737 - DNA, 25 bp, Mus musculus
ccagtgaaatccctgcccagaaaaa

SEQ ID NO: 900738 - DNA, 25 bp, Mus musculus
ccagtgaaatgcctgcccagaaaaa

SEQ ID NO: 900739 - DNA, 25 bp, Mus musculus
ccagtgaaatgtctgcccagaaaaa

SEQ ID NO: 900740 - DNA, 25 bp, Mus musculus
ccagtgaaatgtgtgcccagaaaaa

SEQ ID NO: 900741 - DNA, 25 bp, Mus musculus
ccagtgacacagcttcagcggtggg

SEQ ID NO: 900742 - DNA, 25 bp, Mus musculus
ccagtgacacaggttcagcggtggg

SEQ ID NO: 900743 - DNA, 25 bp, Mus musculus
ccagtgaccaggccgtccctgccat

SEQ ID NO: 900744 - DNA, 25 bp, Mus musculus
ccagtgaccagggcgtccctgccat

SEQ ID NO: 900745 - DNA, 25 bp, Mus musculus
ccagtgagcgcgccccacacaagaa

SEQ ID NO: 900746 - DNA, 25 bp, Mus musculus
ccagtgagcgggccccacacaagaa

SEQ ID NO: 900747 - DNA, 25 bp, Mus musculus
ccagtgagtcagatttccccccagt

SEQ ID NO: 900748 - DNA, 25 bp, Mus musculus
ccagtgagtcagttttccccccagt

SEQ ID NO: 900749 - DNA, 25 bp, Mus musculus
ccagtgatttcacttttcagaacat

SEQ ID NO: 900750 - DNA, 25 bp, Mus musculus
ccagtgatttcagttttcagaacat

SEQ ID NO: 900751 - DNA, 25 bp, Mus musculus
ccagtgcaagaatggccatttgtgc

SEQ ID NO: 900752 - DNA, 25 bp, Mus musculus
ccagtgcaagtatggccatttgtgc

SEQ ID NO: 900753 - DNA, 25 bp, Mus musculus
ccagtgcaccctcgaacagcttcag

SEQ ID NO: 900754 - DNA, 25 bp, Mus musculus
ccagtgcaccctggaaaaagtccac

SEQ ID NO: 900755 - DNA, 25 bp, Mus musculus
ccagtgcaccctggaacagcttcag

SEQ ID NO: 900756 - DNA, 25 bp, Mus musculus
ccagtgcaccgtggaaaaagtccac

SEQ ID NO: 900757 - DNA, 25 bp, Mus musculus
ccagtgcagaagctgtagctatctc

SEQ ID NO: 900758 - DNA, 25 bp, Mus musculus
ccagtgcagaaggtgtagctatctc

SEQ ID NO: 900759 - DNA, 25 bp, Mus musculus
ccagtgcagcaggccacgcggggac

SEQ ID NO: 900760 - DNA, 25 bp, Mus musculus
ccagtgcagccctgtagcatcctag

SEQ ID NO: 900761 - DNA, 25 bp, Mus musculus
ccagtgcagcgctgtagcatcctag

SEQ ID NO: 900762 - DNA, 25 bp, Mus musculus
ccagtgcagctggccacgcggggac

SEQ ID NO: 900763 - DNA, 25 bp, Mus musculus
ccagtgcccatgatcatctttgcta

SEQ ID NO: 900764 - DNA, 25 bp, Mus musculus
ccagtgcccatgttcatctttgcta

SEQ ID NO: 900765 - DNA, 25 bp, Mus musculus
ccagtgcccccaccggatgcagaag

SEQ ID NO: 900766 - DNA, 25 bp, Mus musculus
ccagtgcccccagcggatgcagaag

SEQ ID NO: 900767 - DNA, 25 bp, Mus musculus
ccagtgccgcacagtctggaataaa

SEQ ID NO: 900768 - DNA, 25 bp, Mus musculus
ccagtgccgcactgtctggaataaa

SEQ ID NO: 900769 - DNA, 25 bp, Mus musculus
ccagtgctgacacggtccctcccta

SEQ ID NO: 900770 - DNA, 25 bp, Mus musculus
ccagtgctgacagggtccctcccta

SEQ ID NO: 900771 - DNA, 25 bp, Mus musculus
ccagtgcttccaaaccacaggctgg

SEQ ID NO: 900772 - DNA, 25 bp, Mus musculus
ccagtgcttccaaacccaggtgtca

SEQ ID NO: 900773 - DNA, 25 bp, Mus musculus
ccagtgcttccaaagcacaggctgg

SEQ ID NO: 900774 - DNA, 25 bp, Mus musculus
ccagtgcttccaaagccaggtgtca

SEQ ID NO: 900775 - DNA, 25 bp, Mus musculus
ccagtggaaaacacggttatctgcg

SEQ ID NO: 900776 - DNA, 25 bp, Mus musculus
ccagtggaaatcacggttatctgcg

SEQ ID NO: 900777 - DNA, 25 bp, Mus musculus
ccagtggaaatgccactgctgagac

SEQ ID NO: 900778 - DNA, 25 bp, Mus musculus
ccagtggaaatggcactgctgagac

SEQ ID NO: 900779 - DNA, 25 bp, Mus musculus
ccagtggagccactgcctccttccc

SEQ ID NO: 900780 - DNA, 25 bp, Mus musculus
ccagtggagccagtgcctccttccc

SEQ ID NO: 900781 - DNA, 25 bp, Mus musculus
ccagtggataaacgtctccagagct

SEQ ID NO: 900782 - DNA, 25 bp, Mus musculus
ccagtggataaaggtctccagagct

SEQ ID NO: 900783 - DNA, 25 bp, Mus musculus
ccagtggcacagatgccctaggtct

SEQ ID NO: 900784 - DNA, 25 bp, Mus musculus
ccagtggcacagctctccaccgcta

SEQ ID NO: 900785 - DNA, 25 bp, Mus musculus
ccagtggcacaggtctccaccgcta

SEQ ID NO: 900786 - DNA, 25 bp, Mus musculus
ccagtggcacagttgccctaggtct

SEQ ID NO: 900787 - DNA, 25 bp, Mus musculus
ccagtggccccacctgcccccagca

SEQ ID NO: 900788 - DNA, 25 bp, Mus musculus
ccagtggccccagctgcccccagca

SEQ ID NO: 900789 - DNA, 25 bp, Mus musculus
ccagtggctgcaccagtgaacagtc

SEQ ID NO: 900790 - DNA, 25 bp, Mus musculus
ccagtggctgcagcagtgaacagtc

SEQ ID NO: 900791 - DNA, 25 bp, Mus musculus
ccagtgggagaacacatccgacgta

SEQ ID NO: 900792 - DNA, 25 bp, Mus musculus
ccagtgggagaacagatccgacgta

SEQ ID NO: 900793 - DNA, 25 bp, Mus musculus
ccagtgtaaccaaacatgtcgcact

SEQ ID NO: 900794 - DNA, 25 bp, Mus musculus
ccagtgtaaccaaagatgtcgcact

SEQ ID NO: 900795 - DNA, 25 bp, Mus musculus
ccagtgtacaaaaacgtacgtcatc

SEQ ID NO: 900796 - DNA, 25 bp, Mus musculus
ccagtgtacaaaaaggtacgtcatc

SEQ ID NO: 900797 - DNA, 25 bp, Mus musculus
ccagtgtagaacaatttttttgaat

SEQ ID NO: 900798 - DNA, 25 bp, Mus musculus
ccagtgtagaactatttttttgaat

SEQ ID NO: 900799 - DNA, 25 bp, Mus musculus
ccagtgtcagctcaattaccatgct

SEQ ID NO: 900800 - DNA, 25 bp, Mus musculus
ccagtgtcaggtcaattaccatgct

SEQ ID NO: 900801 - DNA, 25 bp, Mus musculus
ccagtgtccagacgtttgcctgtgg

SEQ ID NO: 900802 - DNA, 25 bp, Mus musculus
ccagtgtccagaggtttgcctgtgg

SEQ ID NO: 900803 - DNA, 25 bp, Mus musculus
ccagtgtcgcaacgacaactgcgtg

SEQ ID NO: 900804 - DNA, 25 bp, Mus musculus
ccagtgtcgcaaggacaactgcgtg

SEQ ID NO: 900805 - DNA, 25 bp, Mus musculus
ccagtgtggtgccacgactggatcc

SEQ ID NO: 900806 - DNA, 25 bp, Mus musculus
ccagtgtggtgccaggactggatcc

SEQ ID NO: 900807 - DNA, 25 bp, Mus musculus
ccagtgtgttaacccaaatttacgg

SEQ ID NO: 900808 - DNA, 25 bp, Mus musculus
ccagtgtgttaactattttggaaat

SEQ ID NO: 900809 - DNA, 25 bp, Mus musculus
ccagtgtgttaagccaaatttacgg

SEQ ID NO: 900810 - DNA, 25 bp, Mus musculus
ccagtgtgttaagtattttggaaat

SEQ ID NO: 900811 - DNA, 25 bp, Mus musculus
ccagttaaggaacacgctttcatgc

SEQ ID NO: 900812 - DNA, 25 bp, Mus musculus
ccagttaaggaacaggctttcatgc

SEQ ID NO: 900813 - DNA, 25 bp, Mus musculus
ccagttacagaatctggtcgattgt

SEQ ID NO: 900814 - DNA, 25 bp, Mus musculus
ccagttacagtatctggtcgattgt

SEQ ID NO: 900815 - DNA, 25 bp, Mus musculus
ccagttcaaccgcgagaatttgcca

SEQ ID NO: 900816 - DNA, 25 bp, Mus musculus
ccagttcaaccgggagaatttgcca

SEQ ID NO: 900817 - DNA, 25 bp, Mus musculus
ccagttcagcagcctgcagcagggc

SEQ ID NO: 900818 - DNA, 25 bp, Mus musculus
ccagttcagcagcgcacctacgccc

SEQ ID NO: 900819 - DNA, 25 bp, Mus musculus
ccagttcagcaggctgcagcagggc

SEQ ID NO: 900820 - DNA, 25 bp, Mus musculus
ccagttcagcagggcacctacgccc

SEQ ID NO: 900821 - DNA, 25 bp, Mus musculus
ccagttcatccgacagaagcgccgt

SEQ ID NO: 900822 - DNA, 25 bp, Mus musculus
ccagttcatccgactgaagcgccgt

SEQ ID NO: 900823 - DNA, 25 bp, Mus musculus
ccagttccaagaaacgtgcttacag

SEQ ID NO: 900824 - DNA, 25 bp, Mus musculus
ccagttccaagaaaggtgcttacag

SEQ ID NO: 900825 - DNA, 25 bp, Mus musculus
ccagttcctgagcggcatcccagag

SEQ ID NO: 900826 - DNA, 25 bp, Mus musculus
ccagttcctgaggggcatcccagag

SEQ ID NO: 900827 - DNA, 25 bp, Mus musculus
ccagttcttcagagctgagcctacc

SEQ ID NO: 900828 - DNA, 25 bp, Mus musculus
ccagttcttcagtgctgagcctacc

SEQ ID NO: 900829 - DNA, 25 bp, Mus musculus
ccagttgccaagcatgtggatttgg

SEQ ID NO: 900830 - DNA, 25 bp, Mus musculus
ccagttgccaaggatgtggatttgg

SEQ ID NO: 900831 - DNA, 25 bp, Mus musculus
ccagttgcctcggactttcagcctc

SEQ ID NO: 900832 - DNA, 25 bp, Mus musculus
ccagttgcctcggagtttcagcctc

SEQ ID NO: 900833 - DNA, 25 bp, Mus musculus
ccagttgtcgggcacaactgtgtct

SEQ ID NO: 900834 - DNA, 25 bp, Mus musculus
ccagttgtcgggcacccagccattc

SEQ ID NO: 900835 - DNA, 25 bp, Mus musculus
ccagttgtcgggcagaactgtgtct

SEQ ID NO: 900836 - DNA, 25 bp, Mus musculus
ccagttgtcgggcagccagccattc

SEQ ID NO: 900837 - DNA, 25 bp, Mus musculus
ccagtttattctcccgggagggaag

SEQ ID NO: 900838 - DNA, 25 bp, Mus musculus
ccagtttattctgccgggagggaag

SEQ ID NO: 900839 - DNA, 25 bp, Mus musculus
ccagtttccgtgccattgaagatga

SEQ ID NO: 900840 - DNA, 25 bp, Mus musculus
ccagtttccgtgcctttgaagatga

SEQ ID NO: 900841 - DNA, 25 bp, Mus musculus
ccagtttgacagcacacagagctgc

SEQ ID NO: 900842 - DNA, 25 bp, Mus musculus
ccagtttgacaggacacagagctgc

SEQ ID NO: 900843 - DNA, 25 bp, Mus musculus
ccagtttgagactgtgaaagcagaa

SEQ ID NO: 900844 - DNA, 25 bp, Mus musculus
ccagtttgagtctgtgaaagcagaa

SEQ ID NO: 900845 - DNA, 25 bp, Mus musculus
ccagtttgcaaacaagtttgtggtg

SEQ ID NO: 900846 - DNA, 25 bp, Mus musculus
ccagtttgcaaagaagtttgtggtg

SEQ ID NO: 900847 - DNA, 25 bp, Mus musculus
ccagtttgcatttacgaggactgac

SEQ ID NO: 900848 - DNA, 25 bp, Mus musculus
ccagtttgcatttaggaggactgac

SEQ ID NO: 900849 - DNA, 25 bp, Mus musculus
ccagtttggggacattgaggccatt

SEQ ID NO: 900850 - DNA, 25 bp, Mus musculus
ccagtttggggagattgaggccatt

SEQ ID NO: 900851 - DNA, 25 bp, Mus musculus
ccagttttacagcaatctgggcaaa

SEQ ID NO: 900852 - DNA, 25 bp, Mus musculus
ccagttttacaggaatctgggcaaa

SEQ ID NO: 900853 - DNA, 25 bp, Mus musculus
ccagttttctcacgaaattgggctt

SEQ ID NO: 900854 - DNA, 25 bp, Mus musculus
ccagttttctcaggaaattgggctt

SEQ ID NO: 900855 - DNA, 25 bp, Mus musculus
ccataaaaacattattagcttatta

SEQ ID NO: 900856 - DNA, 25 bp, Mus musculus
ccataaaaactttattagcttatta

SEQ ID NO: 900857 - DNA, 25 bp, Mus musculus
ccataaacagactgtccagtgtcag

SEQ ID NO: 900858 - DNA, 25 bp, Mus musculus
ccataaacagtctgtccagtgtcag

SEQ ID NO: 900859 - DNA, 25 bp, Mus musculus
ccataaagtgcgcacggcacccctg

SEQ ID NO: 900860 - DNA, 25 bp, Mus musculus
ccataaagtgcgcagggcacccctg

SEQ ID NO: 900861 - DNA, 25 bp, Mus musculus
ccataaccaccacacacttcccaca

SEQ ID NO: 900862 - DNA, 25 bp, Mus musculus
ccataaccaccacagacttcccaca

SEQ ID NO: 900863 - DNA, 25 bp, Mus musculus
ccataaccctctcagcctcatgtac

SEQ ID NO: 900864 - DNA, 25 bp, Mus musculus
ccataaccctctgagcctcatgtac

SEQ ID NO: 900865 - DNA, 25 bp, Mus musculus
ccataacctgaatgtagagtacaac

SEQ ID NO: 900866 - DNA, 25 bp, Mus musculus
ccataacctgtatgtagagtacaac

SEQ ID NO: 900867 - DNA, 25 bp, Mus musculus
ccataagtttggatgatttaccttg

SEQ ID NO: 900868 - DNA, 25 bp, Mus musculus
ccataagtttggttgatttaccttg

SEQ ID NO: 900869 - DNA, 25 bp, Mus musculus
ccataatcgaagcttggctgctgag

SEQ ID NO: 900870 - DNA, 25 bp, Mus musculus
ccataatcgaaggttggctgctgag

SEQ ID NO: 900871 - DNA, 25 bp, Mus musculus
ccataatctgcgctgaatcatgaaa

SEQ ID NO: 900872 - DNA, 25 bp, Mus musculus
ccataatctgggctgaatcatgaaa

SEQ ID NO: 900873 - DNA, 25 bp, Mus musculus
ccataatgagctggagtttgagtgg

SEQ ID NO: 900874 - DNA, 25 bp, Mus musculus
ccataatgaggtggagtttgagtgg

SEQ ID NO: 900875 - DNA, 25 bp, Mus musculus
ccatacactgaggtccaagaatttg

SEQ ID NO: 900876 - DNA, 25 bp, Mus musculus
ccatacactgtggtccaagaatttg

SEQ ID NO: 900877 - DNA, 25 bp, Mus musculus
ccatacatgcagcaaagaccagtga

SEQ ID NO: 900878 - DNA, 25 bp, Mus musculus
ccatacatgcaggaaagaccagtga

SEQ ID NO: 900879 - DNA, 25 bp, Mus musculus
ccatacattaaccccatcatcccct

SEQ ID NO: 900880 - DNA, 25 bp, Mus musculus
ccatacattaacccgatcatcccct

SEQ ID NO: 900881 - DNA, 25 bp, Mus musculus
ccatacccaaagccaggagctgtga

SEQ ID NO: 900882 - DNA, 25 bp, Mus musculus
ccatacccaaaggcaggagctgtga

SEQ ID NO: 900883 - DNA, 25 bp, Mus musculus
ccatacccagccatgaacaaccggg

SEQ ID NO: 900884 - DNA, 25 bp, Mus musculus
ccatacccaggcatgaacaaccggg

SEQ ID NO: 900885 - DNA, 25 bp, Mus musculus
ccatacgtgacacaaatggctcagg

SEQ ID NO: 900886 - DNA, 25 bp, Mus musculus
ccatacgtgacagaaatggctcagg

SEQ ID NO: 900887 - DNA, 25 bp, Mus musculus
ccatacgtttttcacaatgccggac

SEQ ID NO: 900888 - DNA, 25 bp, Mus musculus
ccatacgtttttcagaatgccggac

SEQ ID NO: 900889 - DNA, 25 bp, Mus musculus
ccatactaatttatcgcggaaccct

SEQ ID NO: 900890 - DNA, 25 bp, Mus musculus
ccatactaatttatggcggaaccct

SEQ ID NO: 900891 - DNA, 25 bp, Mus musculus
ccatactatgatccctcaagaacag

SEQ ID NO: 900892 - DNA, 25 bp, Mus musculus
ccatactatgttccctcaagaacag

SEQ ID NO: 900893 - DNA, 25 bp, Mus musculus
ccatactgtgagctcgcccagtcct

SEQ ID NO: 900894 - DNA, 25 bp, Mus musculus
ccatactgtgagctcgttcacccac

SEQ ID NO: 900895 - DNA, 25 bp, Mus musculus
ccatactgtgagctggcccagtcct

SEQ ID NO: 900896 - DNA, 25 bp, Mus musculus
ccatactgtgagctggttcacccac

SEQ ID NO: 900897 - DNA, 25 bp, Mus musculus
ccatagacatgaggcgatgaaggtc

SEQ ID NO: 900898 - DNA, 25 bp, Mus musculus
ccatagacatgaggggatgaaggtc

SEQ ID NO: 900899 - DNA, 25 bp, Mus musculus
ccatagccagcacagcgctggagtt

SEQ ID NO: 900900 - DNA, 25 bp, Mus musculus
ccatagccaggacagcgctggagtt

SEQ ID NO: 900901 - DNA, 25 bp, Mus musculus
ccataggaaacaaaatgtatgtatt

SEQ ID NO: 900902 - DNA, 25 bp, Mus musculus
ccataggaaacataatgtatgtatt

SEQ ID NO: 900903 - DNA, 25 bp, Mus musculus
ccatagtcacagccccgacctgttt

SEQ ID NO: 900904 - DNA, 25 bp, Mus musculus
ccatagtcacaggcccgacctgttt

SEQ ID NO: 900905 - DNA, 25 bp, Mus musculus
ccatagtggctgcacagaatgatgt

SEQ ID NO: 900906 - DNA, 25 bp, Mus musculus
ccatagtggctgcagagaatgatgt

SEQ ID NO: 900907 - DNA, 25 bp, Mus musculus
ccatatacagcagccacgtgtgagg

SEQ ID NO: 900908 - DNA, 25 bp, Mus musculus
ccatatacaggagccacgtgtgagg

SEQ ID NO: 900909 - DNA, 25 bp, Mus musculus
ccatatcaagaacccctggctgtcc

SEQ ID NO: 900910 - DNA, 25 bp, Mus musculus
ccatatcaagaacgagtttgacaag

SEQ ID NO: 900911 - DNA, 25 bp, Mus musculus
ccatatcaagaagccctggctgtcc

SEQ ID NO: 900912 - DNA, 25 bp, Mus musculus
ccatatcaagaaggagtttgacaag

SEQ ID NO: 900913 - DNA, 25 bp, Mus musculus
ccatatcatctcagatggaggctgc

SEQ ID NO: 900914 - DNA, 25 bp, Mus musculus
ccatatcatctctgatggaggctgc

SEQ ID NO: 900915 - DNA, 25 bp, Mus musculus
ccatatctcgcctgatatactggtt

SEQ ID NO: 900916 - DNA, 25 bp, Mus musculus
ccatatctcggctgatatactggtt

SEQ ID NO: 900917 - DNA, 25 bp, Mus musculus
ccatatctgcaacgacatgagccca

SEQ ID NO: 900918 - DNA, 25 bp, Mus musculus
ccatatctgcaaggacatgagccca

SEQ ID NO: 900919 - DNA, 25 bp, Mus musculus
ccatatgcagcacatttttatcatt

SEQ ID NO: 900920 - DNA, 25 bp, Mus musculus
ccatatgcagcacgggggagcaccg

SEQ ID NO: 900921 - DNA, 25 bp, Mus musculus
ccatatgcagcagatttttatcatt

SEQ ID NO: 900922 - DNA, 25 bp, Mus musculus
ccatatgcagcaggggggagcaccg

SEQ ID NO: 900923 - DNA, 25 bp, Mus musculus
ccatatgccaagagccaccgttccc

SEQ ID NO: 900924 - DNA, 25 bp, Mus musculus
ccatatgccaagtgccaccgttccc

SEQ ID NO: 900925 - DNA, 25 bp, Mus musculus
ccatatgtcaatgacgtaatcgtcg

SEQ ID NO: 900926 - DNA, 25 bp, Mus musculus
ccatatgtcaatgaggtaatcgtcg

SEQ ID NO: 900927 - DNA, 25 bp, Mus musculus
ccatatttagcattcccgtcaataa

SEQ ID NO: 900928 - DNA, 25 bp, Mus musculus
ccatatttaggattcccgtcaataa

SEQ ID NO: 900929 - DNA, 25 bp, Mus musculus
ccatcaacacaccctttggggcgat

SEQ ID NO: 900930 - DNA, 25 bp, Mus musculus
ccatcaacacacgctttggggcgat

SEQ ID NO: 900931 - DNA, 25 bp, Mus musculus
ccatcaacagcggaattttcactga

SEQ ID NO: 900932 - DNA, 25 bp, Mus musculus
ccatcaacaggggaattttcactga

SEQ ID NO: 900933 - DNA, 25 bp, Mus musculus
ccatcaacctctactttggctccaa

SEQ ID NO: 900934 - DNA, 25 bp, Mus musculus
ccatcaacctcttctttggctccaa

SEQ ID NO: 900935 - DNA, 25 bp, Mus musculus
ccatcaactaaccaatactggagta

SEQ ID NO: 900936 - DNA, 25 bp, Mus musculus
ccatcaactaacgaatactggagta

SEQ ID NO: 900937 - DNA, 25 bp, Mus musculus
ccatcaaggagtgcaagaccaacga

SEQ ID NO: 900938 - DNA, 25 bp, Mus musculus
ccatcaaggagtgctagaccaacga

SEQ ID NO: 900939 - DNA, 25 bp, Mus musculus
ccatcaatacagctccaaaaggtgt

SEQ ID NO: 900940 - DNA, 25 bp, Mus musculus
ccatcaatacaggtccaaaaggtgt

SEQ ID NO: 900941 - DNA, 25 bp, Mus musculus
ccatcacaagatctgatactcttgg

SEQ ID NO: 900942 - DNA, 25 bp, Mus musculus
ccatcacaaggtctgatactcttgg

SEQ ID NO: 900943 - DNA, 25 bp, Mus musculus
ccatcacaaggtgtgatactcttgg

SEQ ID NO: 900944 - DNA, 25 bp, Mus musculus
ccatcacaagttctgatactcttgg

SEQ ID NO: 900945 - DNA, 25 bp, Mus musculus
ccatcacacgctgcctgcagcttgg

SEQ ID NO: 900946 - DNA, 25 bp, Mus musculus
ccatcacacggtgcctgcagcttgg

SEQ ID NO: 900947 - DNA, 25 bp, Mus musculus
ccatcacagtcctgcttcctccacg

SEQ ID NO: 900948 - DNA, 25 bp, Mus musculus
ccatcacagtcctggttcctccacg

SEQ ID NO: 900949 - DNA, 25 bp, Mus musculus
ccatcaccaccgaggttcccactgc

SEQ ID NO: 900950 - DNA, 25 bp, Mus musculus
ccatcaccaccgtcctgggggagcc

SEQ ID NO: 900951 - DNA, 25 bp, Mus musculus
ccatcaccaccgtcgtgggggagcc

SEQ ID NO: 900952 - DNA, 25 bp, Mus musculus
ccatcaccaccgtggttcccactgc

SEQ ID NO: 900953 - DNA, 25 bp, Mus musculus
ccatcaccagcatccatgtcttaca

SEQ ID NO: 900954 - DNA, 25 bp, Mus musculus
ccatcaccagcctcgagaaagagat

SEQ ID NO: 900955 - DNA, 25 bp, Mus musculus
ccatcaccagcgtgtttccacaggt

SEQ ID NO: 900956 - DNA, 25 bp, Mus musculus
ccatcaccagctgcgtgatgacatt

SEQ ID NO: 900957 - DNA, 25 bp, Mus musculus
ccatcaccaggatccatgtcttaca

SEQ ID NO: 900958 - DNA, 25 bp, Mus musculus
ccatcaccaggctcgagaaagagat

SEQ ID NO: 900959 - DNA, 25 bp, Mus musculus
ccatcaccagggtgtttccacaggt

SEQ ID NO: 900960 - DNA, 25 bp, Mus musculus
ccatcaccaggtgcgtgatgacatt

SEQ ID NO: 900961 - DNA, 25 bp, Mus musculus
ccatcacccgaaacaggccaccatc

SEQ ID NO: 900962 - DNA, 25 bp, Mus musculus
ccatcacccgtaacaggccaccatc

SEQ ID NO: 900963 - DNA, 25 bp, Mus musculus
ccatcacctctgcgtactatcgtgg

SEQ ID NO: 900964 - DNA, 25 bp, Mus musculus
ccatcacctctgggtactatcgtgg

SEQ ID NO: 900965 - DNA, 25 bp, Mus musculus
ccatcactcacacctatgtccccgt

SEQ ID NO: 900966 - DNA, 25 bp, Mus musculus
ccatcactcagacctatgtccccgt

SEQ ID NO: 900967 - DNA, 25 bp, Mus musculus
ccatcactgtccaacacccagcaac

SEQ ID NO: 900968 - DNA, 25 bp, Mus musculus
ccatcactgtccaacggcccaagtc

SEQ ID NO: 900969 - DNA, 25 bp, Mus musculus
ccatcactgtccaactggacacggg

SEQ ID NO: 900970 - DNA, 25 bp, Mus musculus
ccatcactgtccaagacccagcaac

SEQ ID NO: 900971 - DNA, 25 bp, Mus musculus
ccatcactgtccaagggcccaagtc

SEQ ID NO: 900972 - DNA, 25 bp, Mus musculus
ccatcactgtccaagtggacacggg

SEQ ID NO: 900973 - DNA, 25 bp, Mus musculus
ccatcactgtgccgcagctggaggc

SEQ ID NO: 900974 - DNA, 25 bp, Mus musculus
ccatcactgtgcggcagctggaggc

SEQ ID NO: 900975 - DNA, 25 bp, Mus musculus
ccatcagaagacctaggtactggtg

SEQ ID NO: 900976 - DNA, 25 bp, Mus musculus
ccatcagaagtcctaggtactggtg

SEQ ID NO: 900977 - DNA, 25 bp, Mus musculus
ccatcagacaaattggctggatccc

SEQ ID NO: 900978 - DNA, 25 bp, Mus musculus
ccatcagacatattggctggatccc

SEQ ID NO: 900979 - DNA, 25 bp, Mus musculus
ccatcagagagacatcttctctgtc

SEQ ID NO: 900980 - DNA, 25 bp, Mus musculus
ccatcagagagagatcttctctgtc

SEQ ID NO: 900981 - DNA, 25 bp, Mus musculus
ccatcagaggaccagcatgagtgca

SEQ ID NO: 900982 - DNA, 25 bp, Mus musculus
ccatcagaggtccagcatgagtgca

SEQ ID NO: 900983 - DNA, 25 bp, Mus musculus
ccatcaggaaggagcaggaagaatt

SEQ ID NO: 900984 - DNA, 25 bp, Mus musculus
ccatcaggaaggtgcaggaagaatt

SEQ ID NO: 900985 - DNA, 25 bp, Mus musculus
ccatcaggacagacttgaaccggac

SEQ ID NO: 900986 - DNA, 25 bp, Mus musculus
ccatcaggacagtcttgaaccggac

SEQ ID NO: 900987 - DNA, 25 bp, Mus musculus
ccatcaggaggacgtttgaaaagcg

SEQ ID NO: 900988 - DNA, 25 bp, Mus musculus
ccatcaggaggaggtttgaaaagcg

SEQ ID NO: 900989 - DNA, 25 bp, Mus musculus
ccatcagggaagatacattgtgtgt

SEQ ID NO: 900990 - DNA, 25 bp, Mus musculus
ccatcagggaagcttccctgttgaa

SEQ ID NO: 900991 - DNA, 25 bp, Mus musculus
ccatcagggaaggttccctgttgaa

SEQ ID NO: 900992 - DNA, 25 bp, Mus musculus
ccatcagggaagttacattgtgtgt

SEQ ID NO: 900993 - DNA, 25 bp, Mus musculus
ccatcaggtcaccaccatgggattt

SEQ ID NO: 900994 - DNA, 25 bp, Mus musculus
ccatcaggtcaccagcatgggattt

SEQ ID NO: 900995 - DNA, 25 bp, Mus musculus
ccatcagtacagacatgcctgcagc

SEQ ID NO: 900996 - DNA, 25 bp, Mus musculus
ccatcagtacagcgagcagatcaag

SEQ ID NO: 900997 - DNA, 25 bp, Mus musculus
ccatcagtacagggagcagatcaag

SEQ ID NO: 900998 - DNA, 25 bp, Mus musculus
ccatcagtacagtcatgcctgcagc

SEQ ID NO: 900999 - DNA, 25 bp, Mus musculus
ccatcagttctgagctcaaagatcc

SEQ ID NO: 901000 - DNA, 25 bp, Mus musculus
ccatcagttctgtgctcaaagatcc

SEQ ID NO: 901001 - DNA, 25 bp, Mus musculus
ccatcatcacagacaccacggcgac

SEQ ID NO: 901002 - DNA, 25 bp, Mus musculus
ccatcatcacagattctcgagcagg

SEQ ID NO: 901003 - DNA, 25 bp, Mus musculus
ccatcatcacagtcaccacggcgac

SEQ ID NO: 901004 - DNA, 25 bp, Mus musculus
ccatcatcacagtttctcgagcagg

SEQ ID NO: 901005 - DNA, 25 bp, Mus musculus
ccatcatcacggcacatggcagtga

SEQ ID NO: 901006 - DNA, 25 bp, Mus musculus
ccatcatcacggcagatggcagtga

SEQ ID NO: 901007 - DNA, 25 bp, Mus musculus
ccatcatcagccaaacaggcatggg

SEQ ID NO: 901008 - DNA, 25 bp, Mus musculus
ccatcatcaggcaaacaggcatggg

SEQ ID NO: 901009 - DNA, 25 bp, Mus musculus
ccatcatcccaccacgggcttgctg

SEQ ID NO: 901010 - DNA, 25 bp, Mus musculus
ccatcatcccaccaggggcttgctg

SEQ ID NO: 901011 - DNA, 25 bp, Mus musculus
ccatcatcgatgctgcacaggaggc

SEQ ID NO: 901012 - DNA, 25 bp, Mus musculus
ccatcatcgatggtgcacaggaggc

SEQ ID NO: 901013 - DNA, 25 bp, Mus musculus
ccatcatgagatatctgccaagaga

SEQ ID NO: 901014 - DNA, 25 bp, Mus musculus
ccatcatgagttatctgccaagaga

SEQ ID NO: 901015 - DNA, 25 bp, Mus musculus
ccatcatgccagctacccgcaagat

SEQ ID NO: 901016 - DNA, 25 bp, Mus musculus
ccatcatgccaggtacccgcaagat

SEQ ID NO: 901017 - DNA, 25 bp, Mus musculus
ccatcatggcggagaaagtgaacaa

SEQ ID NO: 901018 - DNA, 25 bp, Mus musculus
ccatcatggcggctttgagcaggtt

SEQ ID NO: 901019 - DNA, 25 bp, Mus musculus
ccatcatggcgggtttgagcaggtt

SEQ ID NO: 901020 - DNA, 25 bp, Mus musculus
ccatcatggcggtgaaagtgaacaa

SEQ ID NO: 901021 - DNA, 25 bp, Mus musculus
ccatcattcgctgtatgatgttcct

SEQ ID NO: 901022 - DNA, 25 bp, Mus musculus
ccatcattcggtgtatgatgttcct

SEQ ID NO: 901023 - DNA, 25 bp, Mus musculus
ccatcattggctggcggacacctac

SEQ ID NO: 901024 - DNA, 25 bp, Mus musculus
ccatcattggctgggggacacctac

SEQ ID NO: 901025 - DNA, 25 bp, Mus musculus
ccatccaacaagcatgcagctctaa

SEQ ID NO: 901026 - DNA, 25 bp, Mus musculus
ccatccaacaaggatgcagctctaa

SEQ ID NO: 901027 - DNA, 25 bp, Mus musculus
ccatccaatgagcgcaatattcatg

SEQ ID NO: 901028 - DNA, 25 bp, Mus musculus
ccatccaatgagggcaatattcatg

SEQ ID NO: 901029 - DNA, 25 bp, Mus musculus
ccatccacaccccacgttttatgta

SEQ ID NO: 901030 - DNA, 25 bp, Mus musculus
ccatccacaccccaggttttatgta

SEQ ID NO: 901031 - DNA, 25 bp, Mus musculus
ccatccacaccttccgccaggtacg

SEQ ID NO: 901032 - DNA, 25 bp, Mus musculus
ccatccacacgttccgccaggtacg

SEQ ID NO: 901033 - DNA, 25 bp, Mus musculus
ccatccaggccacgctgggcagcat

SEQ ID NO: 901034 - DNA, 25 bp, Mus musculus
ccatccaggccaggctgggcagcat

SEQ ID NO: 901035 - DNA, 25 bp, Mus musculus
ccatccaggcctgtaaacttgcaca

SEQ ID NO: 901036 - DNA, 25 bp, Mus musculus
ccatccaggcgtgtaaacttgcaca

SEQ ID NO: 901037 - DNA, 25 bp, Mus musculus
ccatccaggctgcccgcccggatgg

SEQ ID NO: 901038 - DNA, 25 bp, Mus musculus
ccatccaggctggccgcccggatgg

SEQ ID NO: 901039 - DNA, 25 bp, Mus musculus
ccatccatagagaccatgagggtgg

SEQ ID NO: 901040 - DNA, 25 bp, Mus musculus
ccatccatagtgaccatgagggtgg

SEQ ID NO: 901041 - DNA, 25 bp, Mus musculus
ccatcccaaaggctttgcatatata

SEQ ID NO: 901042 - DNA, 25 bp, Mus musculus
ccatcccaaagggtttgcatatata

SEQ ID NO: 901043 - DNA, 25 bp, Mus musculus
ccatcccaacagctgatgaccccac

SEQ ID NO: 901044 - DNA, 25 bp, Mus musculus
ccatcccaacaggtgatgaccccac

SEQ ID NO: 901045 - DNA, 25 bp, Mus musculus
ccatcccaagggctgacccagtgcg

SEQ ID NO: 901046 - DNA, 25 bp, Mus musculus
ccatcccaaggggtgacccagtgcg

SEQ ID NO: 901047 - DNA, 25 bp, Mus musculus
ccatcccaccaattcccacagagaa

SEQ ID NO: 901048 - DNA, 25 bp, Mus musculus
ccatcccaccaattgccacagagaa

SEQ ID NO: 901049 - DNA, 25 bp, Mus musculus
ccatcccagcagccccaaaaggaaa

SEQ ID NO: 901050 - DNA, 25 bp, Mus musculus
ccatcccagcagctcatgaccccac

SEQ ID NO: 901051 - DNA, 25 bp, Mus musculus
ccatcccagcaggcccaaaaggaaa

SEQ ID NO: 901052 - DNA, 25 bp, Mus musculus
ccatcccagcaggtcatgaccccac

SEQ ID NO: 901053 - DNA, 25 bp, Mus musculus
ccatcccatgctatataatgaccag

SEQ ID NO: 901054 - DNA, 25 bp, Mus musculus
ccatcccatggtatataatgaccag

SEQ ID NO: 901055 - DNA, 25 bp, Mus musculus
ccatccccacagatgacaacgttgt

SEQ ID NO: 901056 - DNA, 25 bp, Mus musculus
ccatccccacagttgacaacgttgt

SEQ ID NO: 901057 - DNA, 25 bp, Mus musculus
ccatccccagagcattatcacaaaa

SEQ ID NO: 901058 - DNA, 25 bp, Mus musculus
ccatccccagaggattatcacaaaa

SEQ ID NO: 901059 - DNA, 25 bp, Mus musculus
ccatccccagctcactggatggtcg

SEQ ID NO: 901060 - DNA, 25 bp, Mus musculus
ccatccccaggtcactggatggtcg

SEQ ID NO: 901061 - DNA, 25 bp, Mus musculus
ccatcccccacaccaccacaagaga

SEQ ID NO: 901062 - DNA, 25 bp, Mus musculus
ccatcccccacagcaccacaagaga

SEQ ID NO: 901063 - DNA, 25 bp, Mus musculus
ccatcccccgagctacaaatggaaa

SEQ ID NO: 901064 - DNA, 25 bp, Mus musculus
ccatcccccgcagtgctacaaatgg

SEQ ID NO: 901065 - DNA, 25 bp, Mus musculus
ccatcccccgcttgaaagatgccaa

SEQ ID NO: 901066 - DNA, 25 bp, Mus musculus
ccatcccccggagtgctacaaatgg

SEQ ID NO: 901067 - DNA, 25 bp, Mus musculus
ccatcccccggttgaaagatgccaa

SEQ ID NO: 901068 - DNA, 25 bp, Mus musculus
ccatcccccgtgctacaaatggaaa

SEQ ID NO: 901069 - DNA, 25 bp, Mus musculus
ccatccccgaccttctcaagtggat

SEQ ID NO: 901070 - DNA, 25 bp, Mus musculus
ccatccccgagcttctcaagtggat

SEQ ID NO: 901071 - DNA, 25 bp, Mus musculus
ccatcccgaccattcggtttaatgt

SEQ ID NO: 901072 - DNA, 25 bp, Mus musculus
ccatcccgaccattgggtttaatgt

SEQ ID NO: 901073 - DNA, 25 bp, Mus musculus
ccatccctaccatacgtttcaatgt

SEQ ID NO: 901074 - DNA, 25 bp, Mus musculus
ccatccctaccataggtttcaatgt

SEQ ID NO: 901075 - DNA, 25 bp, Mus musculus
ccatccctagatccagtccctgact

SEQ ID NO: 901076 - DNA, 25 bp, Mus musculus
ccatccctagttccagtccctgact

SEQ ID NO: 901077 - DNA, 25 bp, Mus musculus
ccatcctcagctcaccagtccccag

SEQ ID NO: 901078 - DNA, 25 bp, Mus musculus
ccatcctcaggtcaccagtccccag

SEQ ID NO: 901079 - DNA, 25 bp, Mus musculus
ccatcctgaaagccgagaaaggtga

SEQ ID NO: 901080 - DNA, 25 bp, Mus musculus
ccatcctgaaaggcgagaaaggtga

SEQ ID NO: 901081 - DNA, 25 bp, Mus musculus
ccatcctgagccctgactaccagaa

SEQ ID NO: 901082 - DNA, 25 bp, Mus musculus
ccatcctgaggcctgactaccagaa

SEQ ID NO: 901083 - DNA, 25 bp, Mus musculus
ccatcctgtccaagttcttcctcat

SEQ ID NO: 901084 - DNA, 25 bp, Mus musculus
ccatcctgtccatgttcttcctcat

SEQ ID NO: 901085 - DNA, 25 bp, Mus musculus
ccatcctgtctaaggagaaaataag

SEQ ID NO: 901086 - DNA, 25 bp, Mus musculus
ccatcctgtctatggagaaaataag

SEQ ID NO: 901087 - DNA, 25 bp, Mus musculus
ccatccttacagcacgtggcccctt

SEQ ID NO: 901088 - DNA, 25 bp, Mus musculus
ccatccttacagcaggtggcccctt

SEQ ID NO: 901089 - DNA, 25 bp, Mus musculus
ccatccttcctctcatgctcttagt

SEQ ID NO: 901090 - DNA, 25 bp, Mus musculus
ccatccttcctctcttgctcttagt

SEQ ID NO: 901091 - DNA, 25 bp, Mus musculus
ccatcgacagtgccaaccctcctgc

SEQ ID NO: 901092 - DNA, 25 bp, Mus musculus
ccatcgacagtggcaaccctcctgc

SEQ ID NO: 901093 - DNA, 25 bp, Mus musculus
ccatcgaccaggctgcagaggacgt

SEQ ID NO: 901094 - DNA, 25 bp, Mus musculus
ccatcgaccagggtgcagaggacgt

SEQ ID NO: 901095 - DNA, 25 bp, Mus musculus
ccatcgacttcaccttctgtctaaa

SEQ ID NO: 901096 - DNA, 25 bp, Mus musculus
ccatcgacttcagcttctgtctaaa

SEQ ID NO: 901097 - DNA, 25 bp, Mus musculus
ccatcgatgtgcgacattgtgaagg

SEQ ID NO: 901098 - DNA, 25 bp, Mus musculus
ccatcgatgtgcgacggaaggttgt

SEQ ID NO: 901099 - DNA, 25 bp, Mus musculus
ccatcgatgtgcgagattgtgaagg

SEQ ID NO: 901100 - DNA, 25 bp, Mus musculus
ccatcgatgtgcgagggaaggttgt

SEQ ID NO: 901101 - DNA, 25 bp, Mus musculus
ccatcgctacagatactttatgcat

SEQ ID NO: 901102 - DNA, 25 bp, Mus musculus
ccatcgctacagttactttatgcat

SEQ ID NO: 901103 - DNA, 25 bp, Mus musculus
ccatcggctatgcaggtagaagagg

SEQ ID NO: 901104 - DNA, 25 bp, Mus musculus
ccatcggctatggaggtagaagagg

SEQ ID NO: 901105 - DNA, 25 bp, Mus musculus
ccatcggcttcacatatttatcaac

SEQ ID NO: 901106 - DNA, 25 bp, Mus musculus
ccatcggcttcagatatttatcaac

SEQ ID NO: 901107 - DNA, 25 bp, Mus musculus
ccatcggggcagaacagattgtgga

SEQ ID NO: 901108 - DNA, 25 bp, Mus musculus
ccatcggggcagaagagattgtgga

SEQ ID NO: 901109 - DNA, 25 bp, Mus musculus
ccatcgtactcgcgctccttgtgta

SEQ ID NO: 901110 - DNA, 25 bp, Mus musculus
ccatcgtactcgggctccttgtgta

SEQ ID NO: 901111 - DNA, 25 bp, Mus musculus
ccatcgtagaagccctggaaaccaa

SEQ ID NO: 901112 - DNA, 25 bp, Mus musculus
ccatcgtagatgccctggaaaccaa

SEQ ID NO: 901113 - DNA, 25 bp, Mus musculus
ccatcgtgatcgccaagaagccagt

SEQ ID NO: 901114 - DNA, 25 bp, Mus musculus
ccatcgtgatcgctgagaaggaccg

SEQ ID NO: 901115 - DNA, 25 bp, Mus musculus
ccatcgtgatcggcaagaagccagt

SEQ ID NO: 901116 - DNA, 25 bp, Mus musculus
ccatcgtgatcggtgagaaggaccg

SEQ ID NO: 901117 - DNA, 25 bp, Mus musculus
ccatctagcactaagagcggcgcta

SEQ ID NO: 901118 - DNA, 25 bp, Mus musculus
ccatctagcagtaagagcggcgcta

SEQ ID NO: 901119 - DNA, 25 bp, Mus musculus
ccatctagtgctcttcctcctggcc

SEQ ID NO: 901120 - DNA, 25 bp, Mus musculus
ccatctagtggtcttcctcctggcc

SEQ ID NO: 901121 - DNA, 25 bp, Mus musculus
ccatctatagatcttaccaatatat

SEQ ID NO: 901122 - DNA, 25 bp, Mus musculus
ccatctatagcattcatgaataaaa

SEQ ID NO: 901123 - DNA, 25 bp, Mus musculus
ccatctataggattcatgaataaaa

SEQ ID NO: 901124 - DNA, 25 bp, Mus musculus
ccatctatagttcttaccaatatat

SEQ ID NO: 901125 - DNA, 25 bp, Mus musculus
ccatctatggaacgtggtattaatg

SEQ ID NO: 901126 - DNA, 25 bp, Mus musculus
ccatctatggaaggtggtattaatg

SEQ ID NO: 901127 - DNA, 25 bp, Mus musculus
ccatctattgagccaaaagattcca

SEQ ID NO: 901128 - DNA, 25 bp, Mus musculus
ccatctattgaggcaaaagattcca

SEQ ID NO: 901129 - DNA, 25 bp, Mus musculus
ccatctcctatccacgaggagagca

SEQ ID NO: 901130 - DNA, 25 bp, Mus musculus
ccatctcctatccaggaggagagca

SEQ ID NO: 901131 - DNA, 25 bp, Mus musculus
ccatctcttaaatacaatgtcaaaa

SEQ ID NO: 901132 - DNA, 25 bp, Mus musculus
ccatctcttaaatagaatgtcaaaa

SEQ ID NO: 901133 - DNA, 25 bp, Mus musculus
ccatctgaagagtctactcggatgg

SEQ ID NO: 901134 - DNA, 25 bp, Mus musculus
ccatctgaagtgtctactcggatgg

SEQ ID NO: 901135 - DNA, 25 bp, Mus musculus
ccatctgcagcggaaggaggaattt

SEQ ID NO: 901136 - DNA, 25 bp, Mus musculus
ccatctgcagctacaacttgccaat

SEQ ID NO: 901137 - DNA, 25 bp, Mus musculus
ccatctgcaggggaaggaggaattt

SEQ ID NO: 901138 - DNA, 25 bp, Mus musculus
ccatctgcaggtacaacttgccaat

SEQ ID NO: 901139 - DNA, 25 bp, Mus musculus
ccatcttagaacatcctttactgtg

SEQ ID NO: 901140 - DNA, 25 bp, Mus musculus
ccatcttagaacttcctttactgtg

SEQ ID NO: 901141 - DNA, 25 bp, Mus musculus
ccatcttcagagcctcaattgatga

SEQ ID NO: 901142 - DNA, 25 bp, Mus musculus
ccatcttcagtgcctcaattgatga

SEQ ID NO: 901143 - DNA, 25 bp, Mus musculus
ccatcttccccacgttctccaagcc

SEQ ID NO: 901144 - DNA, 25 bp, Mus musculus
ccatcttccccaggttctccaagcc

SEQ ID NO: 901145 - DNA, 25 bp, Mus musculus
ccatcttccttgactcctgcgccat

SEQ ID NO: 901146 - DNA, 25 bp, Mus musculus
ccatcttccttgagactcctgcgcc

SEQ ID NO: 901147 - DNA, 25 bp, Mus musculus
ccatcttccttgtctcctgcgccat

SEQ ID NO: 901148 - DNA, 25 bp, Mus musculus
ccatcttccttgtgactcctgcgcc

SEQ ID NO: 901149 - DNA, 25 bp, Mus musculus
ccatcttcgccatacgtagcattgc

SEQ ID NO: 901150 - DNA, 25 bp, Mus musculus
ccatcttcgccataggtagcattgc

SEQ ID NO: 901151 - DNA, 25 bp, Mus musculus
ccatcttgagaaagattctgatgta

SEQ ID NO: 901152 - DNA, 25 bp, Mus musculus
ccatcttgagaatgattctgatgta

SEQ ID NO: 901153 - DNA, 25 bp, Mus musculus
ccatcttggatgatctggacacagc

SEQ ID NO: 901154 - DNA, 25 bp, Mus musculus
ccatcttggatgttctggacacagc

SEQ ID NO: 901155 - DNA, 25 bp, Mus musculus
ccatctttgacacggtgctaacaga

SEQ ID NO: 901156 - DNA, 25 bp, Mus musculus
ccatctttgacagggtgctaacaga

SEQ ID NO: 901157 - DNA, 25 bp, Mus musculus
ccatctttggagaaaaatgtggaat

SEQ ID NO: 901158 - DNA, 25 bp, Mus musculus
ccatctttggagaataatgtggaat

SEQ ID NO: 901159 - DNA, 25 bp, Mus musculus
ccatctttggctggcgtctgccggc

SEQ ID NO: 901160 - DNA, 25 bp, Mus musculus
ccatctttggctggggtctgccggc

SEQ ID NO: 901161 - DNA, 25 bp, Mus musculus
ccatctttgtcacggatgttcctga

SEQ ID NO: 901162 - DNA, 25 bp, Mus musculus
ccatctttgtcagggatgttcctga

SEQ ID NO: 901163 - DNA, 25 bp, Mus musculus
ccatgaaaggcctccgtactgatga

SEQ ID NO: 901164 - DNA, 25 bp, Mus musculus
ccatgaaaggcctcggtactgatga

SEQ ID NO: 901165 - DNA, 25 bp, Mus musculus
ccatgaacagcaaacgtcaatatcc

SEQ ID NO: 901166 - DNA, 25 bp, Mus musculus
ccatgaacagcaaaggtcaatatcc

SEQ ID NO: 901167 - DNA, 25 bp, Mus musculus
ccatgaacatatcccgtactcttcc

SEQ ID NO: 901168 - DNA, 25 bp, Mus musculus
ccatgaacatcggtccaggagtgcg

SEQ ID NO: 901169 - DNA, 25 bp, Mus musculus
ccatgaacatgggtccaggagtgcg

SEQ ID NO: 901170 - DNA, 25 bp, Mus musculus
ccatgaacatttcccgtactcttcc

SEQ ID NO: 901171 - DNA, 25 bp, Mus musculus
ccatgaagaaagcagccagttatct

SEQ ID NO: 901172 - DNA, 25 bp, Mus musculus
ccatgaagaaaggagccagttatct

SEQ ID NO: 901173 - DNA, 25 bp, Mus musculus
ccatgaagagcaagtcaacacccta

SEQ ID NO: 901174 - DNA, 25 bp, Mus musculus
ccatgaagaggaagtcaacacccta

SEQ ID NO: 901175 - DNA, 25 bp, Mus musculus
ccatgaagtacacgctggacattgt

SEQ ID NO: 901176 - DNA, 25 bp, Mus musculus
ccatgaagtacaggctggacattgt

SEQ ID NO: 901177 - DNA, 25 bp, Mus musculus
ccatgaccacacaacgcttcctgaa

SEQ ID NO: 901178 - DNA, 25 bp, Mus musculus
ccatgaccacacaaggcttcctgaa

SEQ ID NO: 901179 - DNA, 25 bp, Mus musculus
ccatgaccccagagaccgtctggtt

SEQ ID NO: 901180 - DNA, 25 bp, Mus musculus
ccatgaccccagtgaccgtctggtt

SEQ ID NO: 901181 - DNA, 25 bp, Mus musculus
ccatgactggagcctgaaaggtgcc

SEQ ID NO: 901182 - DNA, 25 bp, Mus musculus
ccatgactggaggctgaaaggtgcc

SEQ ID NO: 901183 - DNA, 25 bp, Mus musculus
ccatgacttaaacgccaatgtggag

SEQ ID NO: 901184 - DNA, 25 bp, Mus musculus
ccatgacttaaaggccaatgtggag

SEQ ID NO: 901185 - DNA, 25 bp, Mus musculus
ccatgagaagagcaagcttcttgat

SEQ ID NO: 901186 - DNA, 25 bp, Mus musculus
ccatgagaagaggaagcttcttgat

SEQ ID NO: 901187 - DNA, 25 bp, Mus musculus
ccatgagaccctcgacatgaacaag

SEQ ID NO: 901188 - DNA, 25 bp, Mus musculus
ccatgagaccctctacatgggctgt

SEQ ID NO: 901189 - DNA, 25 bp, Mus musculus
ccatgagaccctggacatgaacaag

SEQ ID NO: 901190 - DNA, 25 bp, Mus musculus
ccatgagaccctgtacatgggctgt

SEQ ID NO: 901191 - DNA, 25 bp, Mus musculus
ccatgagattggcagcccagcggag

SEQ ID NO: 901192 - DNA, 25 bp, Mus musculus
ccatgagattgggagcccagcggag

SEQ ID NO: 901193 - DNA, 25 bp, Mus musculus
ccatgagctacacacgttttgtcca

SEQ ID NO: 901194 - DNA, 25 bp, Mus musculus
ccatgagctacacaggttttgtcca

SEQ ID NO: 901195 - DNA, 25 bp, Mus musculus
ccatgaggaaacccagtcgcatagg

SEQ ID NO: 901196 - DNA, 25 bp, Mus musculus
ccatgaggaaaccctgtcgcatagg

SEQ ID NO: 901197 - DNA, 25 bp, Mus musculus
ccatgaggagcaagtcaacaccctg

SEQ ID NO: 901198 - DNA, 25 bp, Mus musculus
ccatgaggagcagatgaaggaattc

SEQ ID NO: 901199 - DNA, 25 bp, Mus musculus
ccatgaggaggaagtcaacaccctg

SEQ ID NO: 901200 - DNA, 25 bp, Mus musculus
ccatgaggaggagatgaaggaattc

SEQ ID NO: 901201 - DNA, 25 bp, Mus musculus
ccatgagtacaacaatctgagtctg

SEQ ID NO: 901202 - DNA, 25 bp, Mus musculus
ccatgagtacaagaatctgagtctg

SEQ ID NO: 901203 - DNA, 25 bp, Mus musculus
ccatgagtcagccacgattgaggat

SEQ ID NO: 901204 - DNA, 25 bp, Mus musculus
ccatgagtcagccaggattgaggat

SEQ ID NO: 901205 - DNA, 25 bp, Mus musculus
ccatgatagtctctccaaccgcacc

SEQ ID NO: 901206 - DNA, 25 bp, Mus musculus
ccatgatagtctgtccaaccgcacc

SEQ ID NO: 901207 - DNA, 25 bp, Mus musculus
ccatgatgctaacggagacagtgag

SEQ ID NO: 901208 - DNA, 25 bp, Mus musculus
ccatgatgctaagggagacagtgag

SEQ ID NO: 901209 - DNA, 25 bp, Mus musculus
ccatgatgcttgagccctcgatggg

SEQ ID NO: 901210 - DNA, 25 bp, Mus musculus
ccatgatgcttgtgccctcgatggg

SEQ ID NO: 901211 - DNA, 25 bp, Mus musculus
ccatgattagagcgggacatgtcaa

SEQ ID NO: 901212 - DNA, 25 bp, Mus musculus
ccatgattagagggggacatgtcaa

SEQ ID NO: 901213 - DNA, 25 bp, Mus musculus
ccatgattctgtttcgaacttccac

SEQ ID NO: 901214 - DNA, 25 bp, Mus musculus
ccatgattctgtttggaacttccac

SEQ ID NO: 901215 - DNA, 25 bp, Mus musculus
ccatgcaaatacatcgccccctgcc

SEQ ID NO: 901216 - DNA, 25 bp, Mus musculus
ccatgcaaattcatcgccccctgcc

SEQ ID NO: 901217 - DNA, 25 bp, Mus musculus
ccatgcaagtcccaaatttacggat

SEQ ID NO: 901218 - DNA, 25 bp, Mus musculus
ccatgcaagtgccaaatttacggat

SEQ ID NO: 901219 - DNA, 25 bp, Mus musculus
ccatgcagaacacggctgttttgcg

SEQ ID NO: 901220 - DNA, 25 bp, Mus musculus
ccatgcagaacagggctgttttgcg

SEQ ID NO: 901221 - DNA, 25 bp, Mus musculus
ccatgcagccaggccatgacgtggt

SEQ ID NO: 901222 - DNA, 25 bp, Mus musculus
ccatgcagccaggcgatgacgtggt

SEQ ID NO: 901223 - DNA, 25 bp, Mus musculus
ccatgcatagcaagcaccttcagga

SEQ ID NO: 901224 - DNA, 25 bp, Mus musculus
ccatgcataggaagcaccttcagga

SEQ ID NO: 901225 - DNA, 25 bp, Mus musculus
ccatgccaagcctagcagtaaccaa

SEQ ID NO: 901226 - DNA, 25 bp, Mus musculus
ccatgccaaggctagcagtaaccaa

SEQ ID NO: 901227 - DNA, 25 bp, Mus musculus
ccatgccactaggtcgactgcatat

SEQ ID NO: 901228 - DNA, 25 bp, Mus musculus
ccatgccactaggtggactgcatat

SEQ ID NO: 901229 - DNA, 25 bp, Mus musculus
ccatgccagcatcacggagcctgta

SEQ ID NO: 901230 - DNA, 25 bp, Mus musculus
ccatgccagcatcagggagcctgta

SEQ ID NO: 901231 - DNA, 25 bp, Mus musculus
ccatgccctgagatcagaccacctc

SEQ ID NO: 901232 - DNA, 25 bp, Mus musculus
ccatgccctgtgatcagaccacctc

SEQ ID NO: 901233 - DNA, 25 bp, Mus musculus
ccatgcgcagctccagacctcttgg

SEQ ID NO: 901234 - DNA, 25 bp, Mus musculus
ccatgcgcaggtccagacctcttgg

SEQ ID NO: 901235 - DNA, 25 bp, Mus musculus
ccatgcgtcacgaaatgtgttttcc

SEQ ID NO: 901236 - DNA, 25 bp, Mus musculus
ccatgcgtcaggaaatgtgttttcc

SEQ ID NO: 901237 - DNA, 25 bp, Mus musculus
ccatgctctgcacgcttcgagtacc

SEQ ID NO: 901238 - DNA, 25 bp, Mus musculus
ccatgctctgcaggcttcgagtacc

SEQ ID NO: 901239 - DNA, 25 bp, Mus musculus
ccatgctggtaacgattcactaatc

SEQ ID NO: 901240 - DNA, 25 bp, Mus musculus
ccatgctggtaaggattcactaatc

SEQ ID NO: 901241 - DNA, 25 bp, Mus musculus
ccatgctgtgctgtgtcaaggatgc

SEQ ID NO: 901242 - DNA, 25 bp, Mus musculus
ccatgctgtggtgtgtcaaggatgc

SEQ ID NO: 901243 - DNA, 25 bp, Mus musculus
ccatgctgttctcaatgaagggacc

SEQ ID NO: 901244 - DNA, 25 bp, Mus musculus
ccatgctgttctgaatgaagggacc

SEQ ID NO: 901245 - DNA, 25 bp, Mus musculus
ccatgcttcggaaactccttcaggc

SEQ ID NO: 901246 - DNA, 25 bp, Mus musculus
ccatgcttcggaaagtccttcaggc

SEQ ID NO: 901247 - DNA, 25 bp, Mus musculus
ccatggaagagccacgggagaagtg

SEQ ID NO: 901248 - DNA, 25 bp, Mus musculus
ccatggaagagccaggggagaagtg

SEQ ID NO: 901249 - DNA, 25 bp, Mus musculus
ccatggaagattctcgcacttcacc

SEQ ID NO: 901250 - DNA, 25 bp, Mus musculus
ccatggaagattctggcacttcacc

SEQ ID NO: 901251 - DNA, 25 bp, Mus musculus
ccatggaatgcacacaacggttttg

SEQ ID NO: 901252 - DNA, 25 bp, Mus musculus
ccatggaatggacacaacggttttg

SEQ ID NO: 901253 - DNA, 25 bp, Mus musculus
ccatggacagactacagatgctgga

SEQ ID NO: 901254 - DNA, 25 bp, Mus musculus
ccatggacagtctacagatgctgga

SEQ ID NO: 901255 - DNA, 25 bp, Mus musculus
ccatggacccagaacatgtagagct

SEQ ID NO: 901256 - DNA, 25 bp, Mus musculus
ccatggacccagtacatgtagagct

SEQ ID NO: 901257 - DNA, 25 bp, Mus musculus
ccatggagaaatccaaccatatctt

SEQ ID NO: 901258 - DNA, 25 bp, Mus musculus
ccatggagaaatgcaaccatatctt

SEQ ID NO: 901259 - DNA, 25 bp, Mus musculus
ccatggagaacacgtgcttttacaa

SEQ ID NO: 901260 - DNA, 25 bp, Mus musculus
ccatggagaacaggtgcttttacaa

SEQ ID NO: 901261 - DNA, 25 bp, Mus musculus
ccatggagagattgatcctgttaca

SEQ ID NO: 901262 - DNA, 25 bp, Mus musculus
ccatggagagtttgatcctgttaca

SEQ ID NO: 901263 - DNA, 25 bp, Mus musculus
ccatggagctctatctacctccagt

SEQ ID NO: 901264 - DNA, 25 bp, Mus musculus
ccatggagctctttctacctccagt

SEQ ID NO: 901265 - DNA, 25 bp, Mus musculus
ccatggagttaaccacggaaataac

SEQ ID NO: 901266 - DNA, 25 bp, Mus musculus
ccatggagttaactggctaaaagcc

SEQ ID NO: 901267 - DNA, 25 bp, Mus musculus
ccatggagttaagcacggaaataac

SEQ ID NO: 901268 - DNA, 25 bp, Mus musculus
ccatggagttaagtggctaaaagcc

SEQ ID NO: 901269 - DNA, 25 bp, Mus musculus
ccatggatggagcgatcgcttacac

SEQ ID NO: 901270 - DNA, 25 bp, Mus musculus
ccatggatggagggatcgcttacac

SEQ ID NO: 901271 - DNA, 25 bp, Mus musculus
ccatggcaacagaggtgctgaccgt

SEQ ID NO: 901272 - DNA, 25 bp, Mus musculus
ccatggcaacagtggtgctgaccgt

SEQ ID NO: 901273 - DNA, 25 bp, Mus musculus
ccatggccaaaatccaagcaaaaat

SEQ ID NO: 901274 - DNA, 25 bp, Mus musculus
ccatggccaatatccaagcaaaaat

SEQ ID NO: 901275 - DNA, 25 bp, Mus musculus
ccatggccagcgcttggatgaagaa

SEQ ID NO: 901276 - DNA, 25 bp, Mus musculus
ccatggccagcggttggatgaagaa

SEQ ID NO: 901277 - DNA, 25 bp, Mus musculus
ccatggccagtgcacaagctccaca

SEQ ID NO: 901278 - DNA, 25 bp, Mus musculus
ccatggccagtgcagaagctccaca

SEQ ID NO: 901279 - DNA, 25 bp, Mus musculus
ccatggcttctggacgtggtgtccc

SEQ ID NO: 901280 - DNA, 25 bp, Mus musculus
ccatggcttctggaggtggtgtccc

SEQ ID NO: 901281 - DNA, 25 bp, Mus musculus
ccatgggaagatcccaacgctggtg

SEQ ID NO: 901282 - DNA, 25 bp, Mus musculus
ccatgggaagttcccaacgctggtg

SEQ ID NO: 901283 - DNA, 25 bp, Mus musculus
ccatgggcaatgacacgtccccatc

SEQ ID NO: 901284 - DNA, 25 bp, Mus musculus
ccatgggcaatgtcacgtccccatc

SEQ ID NO: 901285 - DNA, 25 bp, Mus musculus
ccatgggccccgcacactgtatgct

SEQ ID NO: 901286 - DNA, 25 bp, Mus musculus
ccatgggccccggacactgtatgct

SEQ ID NO: 901287 - DNA, 25 bp, Mus musculus
ccatgggggacgctcctgactatga

SEQ ID NO: 901288 - DNA, 25 bp, Mus musculus
ccatgggggacggtcctgactatga

SEQ ID NO: 901289 - DNA, 25 bp, Mus musculus
ccatgggtgatgctcctgactatga

SEQ ID NO: 901290 - DNA, 25 bp, Mus musculus
ccatgggtgatggtcctgactatga

SEQ ID NO: 901291 - DNA, 25 bp, Mus musculus
ccatggtagattaccctcacaacaa

SEQ ID NO: 901292 - DNA, 25 bp, Mus musculus
ccatggtagattacgctcacaacaa

SEQ ID NO: 901293 - DNA, 25 bp, Mus musculus
ccatggtcactgaggaccctgatgc

SEQ ID NO: 901294 - DNA, 25 bp, Mus musculus
ccatggtcactgtggaccctgatgc

SEQ ID NO: 901295 - DNA, 25 bp, Mus musculus
ccatggtcagcaatcgggctggaga

SEQ ID NO: 901296 - DNA, 25 bp, Mus musculus
ccatggtcagcaatcggttcagacc

SEQ ID NO: 901297 - DNA, 25 bp, Mus musculus
ccatggtcagcaatggggctggaga

SEQ ID NO: 901298 - DNA, 25 bp, Mus musculus
ccatggtcagcaatgggttcagacc

SEQ ID NO: 901299 - DNA, 25 bp, Mus musculus
ccatggtcttaaccccatcgtacct

SEQ ID NO: 901300 - DNA, 25 bp, Mus musculus
ccatggtcttaagcccatcgtacct

SEQ ID NO: 901301 - DNA, 25 bp, Mus musculus
ccatggtcttcagccccatgggagc

SEQ ID NO: 901302 - DNA, 25 bp, Mus musculus
ccatggtcttcagcgccatgggagc

SEQ ID NO: 901303 - DNA, 25 bp, Mus musculus
ccatggtgagatgtcactgatgatg

SEQ ID NO: 901304 - DNA, 25 bp, Mus musculus
ccatggtgagttgtcactgatgatg

SEQ ID NO: 901305 - DNA, 25 bp, Mus musculus
ccatggtggtctcccggttctgcag

SEQ ID NO: 901306 - DNA, 25 bp, Mus musculus
ccatggtggtctccgggttctgcag

SEQ ID NO: 901307 - DNA, 25 bp, Mus musculus
ccatggttatcaccaggtacgtggt

SEQ ID NO: 901308 - DNA, 25 bp, Mus musculus
ccatggttatcacctggtacgtggt

SEQ ID NO: 901309 - DNA, 25 bp, Mus musculus
ccatgtactaagacctgttcccgtc

SEQ ID NO: 901310 - DNA, 25 bp, Mus musculus
ccatgtactaagattccccctgctc

SEQ ID NO: 901311 - DNA, 25 bp, Mus musculus
ccatgtactaagcgatacagtggaa

SEQ ID NO: 901312 - DNA, 25 bp, Mus musculus
ccatgtactaagctatacagttttg

SEQ ID NO: 901313 - DNA, 25 bp, Mus musculus
ccatgtactaagggatacagtggaa

SEQ ID NO: 901314 - DNA, 25 bp, Mus musculus
ccatgtactaaggtatacagttttg

SEQ ID NO: 901315 - DNA, 25 bp, Mus musculus
ccatgtactaagtcctgttcccgtc

SEQ ID NO: 901316 - DNA, 25 bp, Mus musculus
ccatgtactaagtttccccctgctc

SEQ ID NO: 901317 - DNA, 25 bp, Mus musculus
ccatgtatacagatgccgatgaatg

SEQ ID NO: 901318 - DNA, 25 bp, Mus musculus
ccatgtatacagttgccgatgaatg

SEQ ID NO: 901319 - DNA, 25 bp, Mus musculus
ccatgtatagaaccaaggcaccacg

SEQ ID NO: 901320 - DNA, 25 bp, Mus musculus
ccatgtatagataaaaatgtcatgg

SEQ ID NO: 901321 - DNA, 25 bp, Mus musculus
ccatgtatagataataatgtcatgg

SEQ ID NO: 901322 - DNA, 25 bp, Mus musculus
ccatgtatagtaccaaggcaccacg

SEQ ID NO: 901323 - DNA, 25 bp, Mus musculus
ccatgtcaaaaacgtatggttccga

SEQ ID NO: 901324 - DNA, 25 bp, Mus musculus
ccatgtcaaaaaggtatggttccga

SEQ ID NO: 901325 - DNA, 25 bp, Mus musculus
ccatgtcaagatttctgactttggg

SEQ ID NO: 901326 - DNA, 25 bp, Mus musculus
ccatgtcaagttttctgactttggg

SEQ ID NO: 901327 - DNA, 25 bp, Mus musculus
ccatgtcaccaaaactgtgaaggga

SEQ ID NO: 901328 - DNA, 25 bp, Mus musculus
ccatgtcaccaatactgtgaaggga

SEQ ID NO: 901329 - DNA, 25 bp, Mus musculus
ccatgtccaaaaaattgcggtagag

SEQ ID NO: 901330 - DNA, 25 bp, Mus musculus
ccatgtccaaaatattgcggtagag

SEQ ID NO: 901331 - DNA, 25 bp, Mus musculus
ccatgtcccacaattctcgactatc

SEQ ID NO: 901332 - DNA, 25 bp, Mus musculus
ccatgtcccacactaacccctctaa

SEQ ID NO: 901333 - DNA, 25 bp, Mus musculus
ccatgtcccacagtaacccctctaa

SEQ ID NO: 901334 - DNA, 25 bp, Mus musculus
ccatgtcccacatttctcgactatc

SEQ ID NO: 901335 - DNA, 25 bp, Mus musculus
ccatgtccgcaggccgctcaaagac

SEQ ID NO: 901336 - DNA, 25 bp, Mus musculus
ccatgtccgcaggcggctcaaagac

SEQ ID NO: 901337 - DNA, 25 bp, Mus musculus
ccatgtctacgacctcatcaaccag

SEQ ID NO: 901338 - DNA, 25 bp, Mus musculus
ccatgtctacgagctcatcaaccag

SEQ ID NO: 901339 - DNA, 25 bp, Mus musculus
ccatgtgaacagcaagatgacaaca

SEQ ID NO: 901340 - DNA, 25 bp, Mus musculus
ccatgtgaacagcgacacgctgggc

SEQ ID NO: 901341 - DNA, 25 bp, Mus musculus
ccatgtgaacaggaagatgacaaca

SEQ ID NO: 901342 - DNA, 25 bp, Mus musculus
ccatgtgaacagggacacgctgggc

SEQ ID NO: 901343 - DNA, 25 bp, Mus musculus
ccatgtgaagatccgctcgctgtcc

SEQ ID NO: 901344 - DNA, 25 bp, Mus musculus
ccatgtgaagttccgctcgctgtcc

SEQ ID NO: 901345 - DNA, 25 bp, Mus musculus
ccatgtgcagcacccaaggctggaa

SEQ ID NO: 901346 - DNA, 25 bp, Mus musculus
ccatgtgcaggacccaaggctggaa

SEQ ID NO: 901347 - DNA, 25 bp, Mus musculus
ccatgtgggaagaaccctggcttca

SEQ ID NO: 901348 - DNA, 25 bp, Mus musculus
ccatgtgggaagtaccctggcttca

SEQ ID NO: 901349 - DNA, 25 bp, Mus musculus
ccatgtggttcaacggctggactgt

SEQ ID NO: 901350 - DNA, 25 bp, Mus musculus
ccatgtggttcatcggctggactgt

SEQ ID NO: 901351 - DNA, 25 bp, Mus musculus
ccatgtgtgaggacgtgaatgagtg

SEQ ID NO: 901352 - DNA, 25 bp, Mus musculus
ccatgtgtgaggtcgtgaatgagtg

SEQ ID NO: 901353 - DNA, 25 bp, Mus musculus
ccatgttcagctacacattccaggt

SEQ ID NO: 901354 - DNA, 25 bp, Mus musculus
ccatgttcaggtacacattccaggt

SEQ ID NO: 901355 - DNA, 25 bp, Mus musculus
ccatgttcgacaccacgccccactc

SEQ ID NO: 901356 - DNA, 25 bp, Mus musculus
ccatgttcgagaccacgccccactc

SEQ ID NO: 901357 - DNA, 25 bp, Mus musculus
ccatgttgctgtcacgaacccatgt

SEQ ID NO: 901358 - DNA, 25 bp, Mus musculus
ccatgttgctgtcaggaacccatgt

SEQ ID NO: 901359 - DNA, 25 bp, Mus musculus
ccattaatctctacccgcttaccaa

SEQ ID NO: 901360 - DNA, 25 bp, Mus musculus
ccattaatctgtacccgcttaccaa

SEQ ID NO: 901361 - DNA, 25 bp, Mus musculus
ccattacaaacacttattcagaaac

SEQ ID NO: 901362 - DNA, 25 bp, Mus musculus
ccattacaaacagttattcagaaac

SEQ ID NO: 901363 - DNA, 25 bp, Mus musculus
ccattacaagaccgaccagggcatc

SEQ ID NO: 901364 - DNA, 25 bp, Mus musculus
ccattacaagtccgaccagggcatc

SEQ ID NO: 901365 - DNA, 25 bp, Mus musculus
ccattacaggaactcaacagtcatg

SEQ ID NO: 901366 - DNA, 25 bp, Mus musculus
ccattacaggtactcaacagtcatg

SEQ ID NO: 901367 - DNA, 25 bp, Mus musculus
ccattacattgacgtggtgaaggct

SEQ ID NO: 901368 - DNA, 25 bp, Mus musculus
ccattacattgaggtggtgaaggct

SEQ ID NO: 901369 - DNA, 25 bp, Mus musculus
ccattaccagctgcctcgcacctca

SEQ ID NO: 901370 - DNA, 25 bp, Mus musculus
ccattaccaggtgcctcgcacctca

SEQ ID NO: 901371 - DNA, 25 bp, Mus musculus
ccattactcgcacggcaacaaagaa

SEQ ID NO: 901372 - DNA, 25 bp, Mus musculus
ccattactcgcactgagatgagtca

SEQ ID NO: 901373 - DNA, 25 bp, Mus musculus
ccattactcgcagggcaacaaagaa

SEQ ID NO: 901374 - DNA, 25 bp, Mus musculus
ccattactcgcagtgagatgagtca

SEQ ID NO: 901375 - DNA, 25 bp, Mus musculus
ccattactctacggctggcccgctc

SEQ ID NO: 901376 - DNA, 25 bp, Mus musculus
ccattactcttcggctggcccgctc

SEQ ID NO: 901377 - DNA, 25 bp, Mus musculus
ccattatcaccaccttctgcaaggg

SEQ ID NO: 901378 - DNA, 25 bp, Mus musculus
ccattatcaccagcttctgcaaggg

SEQ ID NO: 901379 - DNA, 25 bp, Mus musculus
ccattatcttgaatgtggaatgggt

SEQ ID NO: 901380 - DNA, 25 bp, Mus musculus
ccattatcttgattgtggaatgggt

SEQ ID NO: 901381 - DNA, 25 bp, Mus musculus
ccattatgaaattgaagaccaaatt

SEQ ID NO: 901382 - DNA, 25 bp, Mus musculus
ccattatgaacaaacagggaagctc

SEQ ID NO: 901383 - DNA, 25 bp, Mus musculus
ccattatgaagaaacagggaagctc

SEQ ID NO: 901384 - DNA, 25 bp, Mus musculus
ccattatgaatttgaagaccaaatt

SEQ ID NO: 901385 - DNA, 25 bp, Mus musculus
ccattcaaagccattggccaggagc

SEQ ID NO: 901386 - DNA, 25 bp, Mus musculus
ccattcaaaggcattggccaggagc

SEQ ID NO: 901387 - DNA, 25 bp, Mus musculus
ccattcacacagcccgatacaaagc

SEQ ID NO: 901388 - DNA, 25 bp, Mus musculus
ccattcacacaggccgatacaaagc

SEQ ID NO: 901389 - DNA, 25 bp, Mus musculus
ccattcaccattcacgaaaacttga

SEQ ID NO: 901390 - DNA, 25 bp, Mus musculus
ccattcaccattcaggaaaacttga

SEQ ID NO: 901391 - DNA, 25 bp, Mus musculus
ccattcacctaccattaccacaccc

SEQ ID NO: 901392 - DNA, 25 bp, Mus musculus
ccattcacctaccgcaagagatgtc

SEQ ID NO: 901393 - DNA, 25 bp, Mus musculus
ccattcacctacgattaccacaccc

SEQ ID NO: 901394 - DNA, 25 bp, Mus musculus
ccattcacctacggcaagagatgtc

SEQ ID NO: 901395 - DNA, 25 bp, Mus musculus
ccattcataagaagatactgcagct

SEQ ID NO: 901396 - DNA, 25 bp, Mus musculus
ccattcataagaagttactgcagct

SEQ ID NO: 901397 - DNA, 25 bp, Mus musculus
ccattcatctctcgtcttgacgaag

SEQ ID NO: 901398 - DNA, 25 bp, Mus musculus
ccattcatctctggtcttgacgaag

SEQ ID NO: 901399 - DNA, 25 bp, Mus musculus
ccattcatttcacttgcctctctgc

SEQ ID NO: 901400 - DNA, 25 bp, Mus musculus
ccattcatttcagttgcctctctgc

SEQ ID NO: 901401 - DNA, 25 bp, Mus musculus
ccattcccaccattcgtttcaatgt

SEQ ID NO: 901402 - DNA, 25 bp, Mus musculus
ccattcccaccattggtttcaatgt

SEQ ID NO: 901403 - DNA, 25 bp, Mus musculus
ccattcccggagaacagtttattgc

SEQ ID NO: 901404 - DNA, 25 bp, Mus musculus
ccattcccggagaagagtttattgc

SEQ ID NO: 901405 - DNA, 25 bp, Mus musculus
ccattccggaagcacctcatcagcc

SEQ ID NO: 901406 - DNA, 25 bp, Mus musculus
ccattccggaaggacctcatcagcc

SEQ ID NO: 901407 - DNA, 25 bp, Mus musculus
ccattctcaatgcaaatatggaaac

SEQ ID NO: 901408 - DNA, 25 bp, Mus musculus
ccattctcaatgcgaaaaagagctt

SEQ ID NO: 901409 - DNA, 25 bp, Mus musculus
ccattctcaatggaaatatggaaac

SEQ ID NO: 901410 - DNA, 25 bp, Mus musculus
ccattctcaatgggaaaaagagctt

SEQ ID NO: 901411 - DNA, 25 bp, Mus musculus
ccattctcagcacgccgcagatcat

SEQ ID NO: 901412 - DNA, 25 bp, Mus musculus
ccattctcagcaggccgcagatcat

SEQ ID NO: 901413 - DNA, 25 bp, Mus musculus
ccattctgcacactaaatccatggc

SEQ ID NO: 901414 - DNA, 25 bp, Mus musculus
ccattctgcacagtaaatccatggc

SEQ ID NO: 901415 - DNA, 25 bp, Mus musculus
ccattcttaactatacaaagggcct

SEQ ID NO: 901416 - DNA, 25 bp, Mus musculus
ccattcttaactttacaaagggcct

SEQ ID NO: 901417 - DNA, 25 bp, Mus musculus
ccattcttagaaaacgcctccttgg

SEQ ID NO: 901418 - DNA, 25 bp, Mus musculus
ccattcttagaatacgcctccttgg

SEQ ID NO: 901419 - DNA, 25 bp, Mus musculus
ccattgaagtgaaacctgctcctga

SEQ ID NO: 901420 - DNA, 25 bp, Mus musculus
ccattgaagtgaaacgagatttcta

SEQ ID NO: 901421 - DNA, 25 bp, Mus musculus
ccattgaagtgaaagctgctcctga

SEQ ID NO: 901422 - DNA, 25 bp, Mus musculus
ccattgaagtgaaaggagatttcta

SEQ ID NO: 901423 - DNA, 25 bp, Mus musculus
ccattgaatatacacctgaaaacca

SEQ ID NO: 901424 - DNA, 25 bp, Mus musculus
ccattgaatatagacctgaaaacca

SEQ ID NO: 901425 - DNA, 25 bp, Mus musculus
ccattgaccagcctgtgcagattat

SEQ ID NO: 901426 - DNA, 25 bp, Mus musculus
ccattgaccagcgtgtgcagattat

SEQ ID NO: 901427 - DNA, 25 bp, Mus musculus
ccattgacgcagattgtttgctgca

SEQ ID NO: 901428 - DNA, 25 bp, Mus musculus
ccattgacgcagtttgtttgctgca

SEQ ID NO: 901429 - DNA, 25 bp, Mus musculus
ccattgagcaagcacagctggacag

SEQ ID NO: 901430 - DNA, 25 bp, Mus musculus
ccattgagcaagcagagctggacag

SEQ ID NO: 901431 - DNA, 25 bp, Mus musculus
ccattgagtacaaggccccagagat

SEQ ID NO: 901432 - DNA, 25 bp, Mus musculus
ccattgagtacatggccccagagat

SEQ ID NO: 901433 - DNA, 25 bp, Mus musculus
ccattgcacagaccctcaacacctc

SEQ ID NO: 901434 - DNA, 25 bp, Mus musculus
ccattgcacagagcctcaacacctc

SEQ ID NO: 901435 - DNA, 25 bp, Mus musculus
ccattgccacatttcagattgcgtc

SEQ ID NO: 901436 - DNA, 25 bp, Mus musculus
ccattgccacttttcagattgcgtc

SEQ ID NO: 901437 - DNA, 25 bp, Mus musculus
ccattgccagagatccttgtgtgtg

SEQ ID NO: 901438 - DNA, 25 bp, Mus musculus
ccattgccagagttccttgtgtgtg

SEQ ID NO: 901439 - DNA, 25 bp, Mus musculus
ccattgcgactgctcaccatgagca

SEQ ID NO: 901440 - DNA, 25 bp, Mus musculus
ccattgcgactgctcagaccatgag

SEQ ID NO: 901441 - DNA, 25 bp, Mus musculus
ccattgcgactgctgaccatgagca

SEQ ID NO: 901442 - DNA, 25 bp, Mus musculus
ccattgcgactgctgagaccatgag

SEQ ID NO: 901443 - DNA, 25 bp, Mus musculus
ccattgctgcagcaaatgctgccat

SEQ ID NO: 901444 - DNA, 25 bp, Mus musculus
ccattgctgcaggaaatgctgccat

SEQ ID NO: 901445 - DNA, 25 bp, Mus musculus
ccattggaaacacgttcagacaatg

SEQ ID NO: 901446 - DNA, 25 bp, Mus musculus
ccattggaaacaggttcagacaatg

SEQ ID NO: 901447 - DNA, 25 bp, Mus musculus
ccattggaagatgccatgtaccgag

SEQ ID NO: 901448 - DNA, 25 bp, Mus musculus
ccattggaagttgccatgtaccgag

SEQ ID NO: 901449 - DNA, 25 bp, Mus musculus
ccattggaggaaaaaacattgctga

SEQ ID NO: 901450 - DNA, 25 bp, Mus musculus
ccattggaggaataaacattgctga

SEQ ID NO: 901451 - DNA, 25 bp, Mus musculus
ccattggcagctcacgcctatgggc

SEQ ID NO: 901452 - DNA, 25 bp, Mus musculus
ccattggcagctcaggcctatgggc

SEQ ID NO: 901453 - DNA, 25 bp, Mus musculus
ccattggcccaccacgtcctcaagg

SEQ ID NO: 901454 - DNA, 25 bp, Mus musculus
ccattggcccaccaggtcctcaagg

SEQ ID NO: 901455 - DNA, 25 bp, Mus musculus
ccattgggcacacgggcccagtgga

SEQ ID NO: 901456 - DNA, 25 bp, Mus musculus
ccattgggcacaggggcccagtgga

SEQ ID NO: 901457 - DNA, 25 bp, Mus musculus
ccattgtagaagctcgtgggatgca

SEQ ID NO: 901458 - DNA, 25 bp, Mus musculus
ccattgtagaagctggtgggatgca

SEQ ID NO: 901459 - DNA, 25 bp, Mus musculus
ccattgtagagacttacattggctt

SEQ ID NO: 901460 - DNA, 25 bp, Mus musculus
ccattgtagagagttacattggctt

SEQ ID NO: 901461 - DNA, 25 bp, Mus musculus
ccattgtcaacactcttgcacagaa

SEQ ID NO: 901462 - DNA, 25 bp, Mus musculus
ccattgtcaagactcttgcacagaa

SEQ ID NO: 901463 - DNA, 25 bp, Mus musculus
ccattgtcagcaatgcatcctgtac

SEQ ID NO: 901464 - DNA, 25 bp, Mus musculus
ccattgtcaggaatgcatcctgtac

SEQ ID NO: 901465 - DNA, 25 bp, Mus musculus
ccattgtctgcaagtgtctgcccag

SEQ ID NO: 901466 - DNA, 25 bp, Mus musculus
ccattgtctgcatgtgtctgcccag

SEQ ID NO: 901467 - DNA, 25 bp, Mus musculus
ccattgtttgtgcacttgctttatt

SEQ ID NO: 901468 - DNA, 25 bp, Mus musculus
ccattgtttgtgcagttgctttatt

SEQ ID NO: 901469 - DNA, 25 bp, Mus musculus
ccatttacagcgagaagctgggcac

SEQ ID NO: 901470 - DNA, 25 bp, Mus musculus
ccatttacagggagaagctgggcac

SEQ ID NO: 901471 - DNA, 25 bp, Mus musculus
ccatttagcatgcctgttggaaagc

SEQ ID NO: 901472 - DNA, 25 bp, Mus musculus
ccatttagcatggctgttggaaagc

SEQ ID NO: 901473 - DNA, 25 bp, Mus musculus
ccatttatctgtaacagcgtggaag

SEQ ID NO: 901474 - DNA, 25 bp, Mus musculus
ccatttatctgttacagcgtggaag

SEQ ID NO: 901475 - DNA, 25 bp, Mus musculus
ccatttcacacttgtggaatgtcac

SEQ ID NO: 901476 - DNA, 25 bp, Mus musculus
ccatttcacagttgtggaatgtcac

SEQ ID NO: 901477 - DNA, 25 bp, Mus musculus
ccatttcagatcacacctcagggat

SEQ ID NO: 901478 - DNA, 25 bp, Mus musculus
ccatttcagatcactcctcagggat

SEQ ID NO: 901479 - DNA, 25 bp, Mus musculus
ccatttcctcagctgaagctgtgtg

SEQ ID NO: 901480 - DNA, 25 bp, Mus musculus
ccatttcctcaggtgaagctgtgtg

SEQ ID NO: 901481 - DNA, 25 bp, Mus musculus
ccatttcggatgatcctgccttctc

SEQ ID NO: 901482 - DNA, 25 bp, Mus musculus
ccatttcggatgttcctgccttctc

SEQ ID NO: 901483 - DNA, 25 bp, Mus musculus
ccatttctgcaacccgcctgtgtca

SEQ ID NO: 901484 - DNA, 25 bp, Mus musculus
ccatttctgcaagccgcctgtgtca

SEQ ID NO: 901485 - DNA, 25 bp, Mus musculus
ccatttctggctctgttccctcttc

SEQ ID NO: 901486 - DNA, 25 bp, Mus musculus
ccatttctgggtctgttccctcttc

SEQ ID NO: 901487 - DNA, 25 bp, Mus musculus
ccatttctttcatacatgaagcccg

SEQ ID NO: 901488 - DNA, 25 bp, Mus musculus
ccatttctttcatagatgaagcccg

SEQ ID NO: 901489 - DNA, 25 bp, Mus musculus
ccatttgaaaatcatgccagaattt

SEQ ID NO: 901490 - DNA, 25 bp, Mus musculus
ccatttgaaaatgatgccagaattt

SEQ ID NO: 901491 - DNA, 25 bp, Mus musculus
ccatttgaacagctcaaaggcattg

SEQ ID NO: 901492 - DNA, 25 bp, Mus musculus
ccatttgaacaggtcaaaggcattg

SEQ ID NO: 901493 - DNA, 25 bp, Mus musculus
ccatttgcagagagtactgcctggc

SEQ ID NO: 901494 - DNA, 25 bp, Mus musculus
ccatttgcagatgaaaagaacatcc

SEQ ID NO: 901495 - DNA, 25 bp, Mus musculus
ccatttgcagtgagtactgcctggc

SEQ ID NO: 901496 - DNA, 25 bp, Mus musculus
ccatttgcagttgaaaagaacatcc

SEQ ID NO: 901497 - DNA, 25 bp, Mus musculus
ccatttgcgaagacatcgacgagtg

SEQ ID NO: 901498 - DNA, 25 bp, Mus musculus
ccatttgcgaagtcatcgacgagtg

SEQ ID NO: 901499 - DNA, 25 bp, Mus musculus
ccattttcggctcgacgtcgactgt

SEQ ID NO: 901500 - DNA, 25 bp, Mus musculus
ccattttcggctggacgtcgactgt

SEQ ID NO: 901501 - DNA, 25 bp, Mus musculus
ccattttgacaacaagcagacaggc

SEQ ID NO: 901502 - DNA, 25 bp, Mus musculus
ccattttgacaacgaccatggcggg

SEQ ID NO: 901503 - DNA, 25 bp, Mus musculus
ccattttgacaagaagcagacaggc

SEQ ID NO: 901504 - DNA, 25 bp, Mus musculus
ccattttgacaaggaccatggcggg

SEQ ID NO: 901505 - DNA, 25 bp, Mus musculus
ccatttttcaagcaagagaagtggt

SEQ ID NO: 901506 - DNA, 25 bp, Mus musculus
ccatttttcaaggaagagaagtggt

SEQ ID NO: 901507 - DNA, 25 bp, Mus musculus
cccaaaagagagaaaactcatgggg

SEQ ID NO: 901508 - DNA, 25 bp, Mus musculus
cccaaaagagagaatactcatgggg

SEQ ID NO: 901509 - DNA, 25 bp, Mus musculus
cccaaacagcaaccgcctgtgagag

SEQ ID NO: 901510 - DNA, 25 bp, Mus musculus
cccaaacagcaagcgcctgtgagag

SEQ ID NO: 901511 - DNA, 25 bp, Mus musculus
cccaaacagcagaacgtagagcttg

SEQ ID NO: 901512 - DNA, 25 bp, Mus musculus
cccaaacagcagaaggtagagcttg

SEQ ID NO: 901513 - DNA, 25 bp, Mus musculus
cccaaacgtgcaaggacctgctgac

SEQ ID NO: 901514 - DNA, 25 bp, Mus musculus
cccaaacgtggaaggacctgctgac

SEQ ID NO: 901515 - DNA, 25 bp, Mus musculus
cccaaactactccgacaagcatgaa

SEQ ID NO: 901516 - DNA, 25 bp, Mus musculus
cccaaactactcggacaagcatgaa

SEQ ID NO: 901517 - DNA, 25 bp, Mus musculus
cccaaactcatcatccgcgagtgca

SEQ ID NO: 901518 - DNA, 25 bp, Mus musculus
cccaaactcatcatgcgcgagtgca

SEQ ID NO: 901519 - DNA, 25 bp, Mus musculus
cccaaactttgacgtctcccatgac

SEQ ID NO: 901520 - DNA, 25 bp, Mus musculus
cccaaactttgaggtctcccatgac

SEQ ID NO: 901521 - DNA, 25 bp, Mus musculus
cccaaagaagacacccatataatgc

SEQ ID NO: 901522 - DNA, 25 bp, Mus musculus
cccaaagaagactcccatataatgc

SEQ ID NO: 901523 - DNA, 25 bp, Mus musculus
cccaaagagattaccccagaagact

SEQ ID NO: 901524 - DNA, 25 bp, Mus musculus
cccaaagagattacgccagaagact

SEQ ID NO: 901525 - DNA, 25 bp, Mus musculus
cccaaagattggaacaatcaagatc

SEQ ID NO: 901526 - DNA, 25 bp, Mus musculus
cccaaagattggaagaatcaagatc

SEQ ID NO: 901527 - DNA, 25 bp, Mus musculus
cccaaagcaatccaaggatcttatt

SEQ ID NO: 901528 - DNA, 25 bp, Mus musculus
cccaaagcaatccatggatcttatt

SEQ ID NO: 901529 - DNA, 25 bp, Mus musculus
cccaaaggacagaataatcctcagg

SEQ ID NO: 901530 - DNA, 25 bp, Mus musculus
cccaaaggacagctggctgtatagg

SEQ ID NO: 901531 - DNA, 25 bp, Mus musculus
cccaaaggacaggtggctgtatagg

SEQ ID NO: 901532 - DNA, 25 bp, Mus musculus
cccaaaggacagtataatcctcagg

SEQ ID NO: 901533 - DNA, 25 bp, Mus musculus
cccaaagtattccacgctctgtgca

SEQ ID NO: 901534 - DNA, 25 bp, Mus musculus
cccaaagtattccaggctctgtgca

SEQ ID NO: 901535 - DNA, 25 bp, Mus musculus
cccaaagtgcaaccccgcgtgcagg

SEQ ID NO: 901536 - DNA, 25 bp, Mus musculus
cccaaagtgcaagcccgcgtgcagg

SEQ ID NO: 901537 - DNA, 25 bp, Mus musculus
cccaaatcagctaccaactggatga

SEQ ID NO: 901538 - DNA, 25 bp, Mus musculus
cccaaatcaggtaccaactggatga

SEQ ID NO: 901539 - DNA, 25 bp, Mus musculus
cccaaatctgcacatctcataggat

SEQ ID NO: 901540 - DNA, 25 bp, Mus musculus
cccaaatctgcacatgtgaatccta

SEQ ID NO: 901541 - DNA, 25 bp, Mus musculus
cccaaatctgcagatctcataggat

SEQ ID NO: 901542 - DNA, 25 bp, Mus musculus
cccaaatctgcagatgtgaatccta

SEQ ID NO: 901543 - DNA, 25 bp, Mus musculus
cccaaatgctgaatcgtattttgac

SEQ ID NO: 901544 - DNA, 25 bp, Mus musculus
cccaaatgctgaatggtattttgac

SEQ ID NO: 901545 - DNA, 25 bp, Mus musculus
cccaaattcaaccacgaggtacaga

SEQ ID NO: 901546 - DNA, 25 bp, Mus musculus
cccaaattcaaccaggaggtacaga

SEQ ID NO: 901547 - DNA, 25 bp, Mus musculus
cccaaattgacacgtagctacatca

SEQ ID NO: 901548 - DNA, 25 bp, Mus musculus
cccaaattgacaggtagctacatca

SEQ ID NO: 901549 - DNA, 25 bp, Mus musculus
cccaaattggatcatatccatccgt

SEQ ID NO: 901550 - DNA, 25 bp, Mus musculus
cccaaattggatgatatccatccgt

SEQ ID NO: 901551 - DNA, 25 bp, Mus musculus
cccaacaaagccagctgagatgctt

SEQ ID NO: 901552 - DNA, 25 bp, Mus musculus
cccaacaaaggcagctgagatgctt

SEQ ID NO: 901553 - DNA, 25 bp, Mus musculus
cccaacacagatgatgaggacagtg

SEQ ID NO: 901554 - DNA, 25 bp, Mus musculus
cccaacacagttgatgaggacagtg

SEQ ID NO: 901555 - DNA, 25 bp, Mus musculus
cccaacaccctagacaggatttcca

SEQ ID NO: 901556 - DNA, 25 bp, Mus musculus
cccaacaccctagagaggatttcca

SEQ ID NO: 901557 - DNA, 25 bp, Mus musculus
cccaacagaagcagacatcatgttc

SEQ ID NO: 901558 - DNA, 25 bp, Mus musculus
cccaacagaagcagcatgtctgctg

SEQ ID NO: 901559 - DNA, 25 bp, Mus musculus
cccaacagaagctgacatcatgttc

SEQ ID NO: 901560 - DNA, 25 bp, Mus musculus
cccaacagaagctgcatgtctgctg

SEQ ID NO: 901561 - DNA, 25 bp, Mus musculus
cccaacagagcaagtgacaaatgac

SEQ ID NO: 901562 - DNA, 25 bp, Mus musculus
cccaacagagcaatctctggcaaac

SEQ ID NO: 901563 - DNA, 25 bp, Mus musculus
cccaacagagcatgtgacaaatgac

SEQ ID NO: 901564 - DNA, 25 bp, Mus musculus
cccaacagagcattctctggcaaac

SEQ ID NO: 901565 - DNA, 25 bp, Mus musculus
cccaacagcgcgccacagattgtac

SEQ ID NO: 901566 - DNA, 25 bp, Mus musculus
cccaacagcgcgtctggaggagggg

SEQ ID NO: 901567 - DNA, 25 bp, Mus musculus
cccaacagcgggccacagattgtac

SEQ ID NO: 901568 - DNA, 25 bp, Mus musculus
cccaacagcgggtctggaggagggg

SEQ ID NO: 901569 - DNA, 25 bp, Mus musculus
cccaacatagataagttgtttgaag

SEQ ID NO: 901570 - DNA, 25 bp, Mus musculus
cccaacatagttaagttgtttgaag

SEQ ID NO: 901571 - DNA, 25 bp, Mus musculus
cccaacatcctagacgccatgattt

SEQ ID NO: 901572 - DNA, 25 bp, Mus musculus
cccaacatcctagaggccatgattt

SEQ ID NO: 901573 - DNA, 25 bp, Mus musculus
cccaacatggagccggcgtgtctcc

SEQ ID NO: 901574 - DNA, 25 bp, Mus musculus
cccaacatggaggcggcgtgtctcc

SEQ ID NO: 901575 - DNA, 25 bp, Mus musculus
cccaacatttatgacaatggagatg

SEQ ID NO: 901576 - DNA, 25 bp, Mus musculus
cccaacatttatgagaatggagatg

SEQ ID NO: 901577 - DNA, 25 bp, Mus musculus
cccaacgacaaaacagctaacccag

SEQ ID NO: 901578 - DNA, 25 bp, Mus musculus
cccaacgacaaaactgctaacccag

SEQ ID NO: 901579 - DNA, 25 bp, Mus musculus
cccaacgagtcgcatggcatgtcag

SEQ ID NO: 901580 - DNA, 25 bp, Mus musculus
cccaacgagtcgccagatggcatgt

SEQ ID NO: 901581 - DNA, 25 bp, Mus musculus
cccaacgagtcggatggcatgtcag

SEQ ID NO: 901582 - DNA, 25 bp, Mus musculus
cccaacgagtcggcagatggcatgt

SEQ ID NO: 901583 - DNA, 25 bp, Mus musculus
cccaacgattctagcccagcctgta

SEQ ID NO: 901584 - DNA, 25 bp, Mus musculus
cccaacgattgtagcccagcctgta

SEQ ID NO: 901585 - DNA, 25 bp, Mus musculus
cccaacgttcaacgtctcactcatg

SEQ ID NO: 901586 - DNA, 25 bp, Mus musculus
cccaacgttcaaggtctcactcatg

SEQ ID NO: 901587 - DNA, 25 bp, Mus musculus
cccaactatgaccaagtggtgctgg

SEQ ID NO: 901588 - DNA, 25 bp, Mus musculus
cccaactatgaccatgtggtgctgg

SEQ ID NO: 901589 - DNA, 25 bp, Mus musculus
cccaactcccagcgatcgttgctgg

SEQ ID NO: 901590 - DNA, 25 bp, Mus musculus
cccaactcccagggatcgttgctgg

SEQ ID NO: 901591 - DNA, 25 bp, Mus musculus
cccaactctatacgcttcgaggtgg

SEQ ID NO: 901592 - DNA, 25 bp, Mus musculus
cccaactctataggcttcgaggtgg

SEQ ID NO: 901593 - DNA, 25 bp, Mus musculus
cccaactctgaactctctgcaggtg

SEQ ID NO: 901594 - DNA, 25 bp, Mus musculus
cccaactctgaagtctctgcaggtg

SEQ ID NO: 901595 - DNA, 25 bp, Mus musculus
cccaactctgctcacatgtataact

SEQ ID NO: 901596 - DNA, 25 bp, Mus musculus
cccaactctgctcagatgtataact

SEQ ID NO: 901597 - DNA, 25 bp, Mus musculus
cccaactgagcgcaggctggatata

SEQ ID NO: 901598 - DNA, 25 bp, Mus musculus
cccaactgagggcaggctggatata

SEQ ID NO: 901599 - DNA, 25 bp, Mus musculus
cccaagaaacatccactgataaagc

SEQ ID NO: 901600 - DNA, 25 bp, Mus musculus
cccaagaaacatcggattactgctg

SEQ ID NO: 901601 - DNA, 25 bp, Mus musculus
cccaagaaacatgcactgataaagc

SEQ ID NO: 901602 - DNA, 25 bp, Mus musculus
cccaagaaacatgggattactgctg

SEQ ID NO: 901603 - DNA, 25 bp, Mus musculus
cccaagaaactccacgctgcgctgg

SEQ ID NO: 901604 - DNA, 25 bp, Mus musculus
cccaagaaactccaggctgcgctgg

SEQ ID NO: 901605 - DNA, 25 bp, Mus musculus
cccaagaaagaatggcttcacttct

SEQ ID NO: 901606 - DNA, 25 bp, Mus musculus
cccaagaaagcgagtgagaagacag

SEQ ID NO: 901607 - DNA, 25 bp, Mus musculus
cccaagaaagctggcaggagatcgc

SEQ ID NO: 901608 - DNA, 25 bp, Mus musculus
cccaagaaagggagtgagaagacag

SEQ ID NO: 901609 - DNA, 25 bp, Mus musculus
cccaagaaaggtggcaggagatcgc

SEQ ID NO: 901610 - DNA, 25 bp, Mus musculus
cccaagaaagtatggcttcacttct

SEQ ID NO: 901611 - DNA, 25 bp, Mus musculus
cccaagaaccagacccgagtcagaa

SEQ ID NO: 901612 - DNA, 25 bp, Mus musculus
cccaagaaccagtcccgagtcagaa

SEQ ID NO: 901613 - DNA, 25 bp, Mus musculus
cccaagaagaagagcgagcgagatc

SEQ ID NO: 901614 - DNA, 25 bp, Mus musculus
cccaagaagaagagggagcgagatc

SEQ ID NO: 901615 - DNA, 25 bp, Mus musculus
cccaagaagcagccagagacagtcc

SEQ ID NO: 901616 - DNA, 25 bp, Mus musculus
cccaagaagcaggcagagacagtcc

SEQ ID NO: 901617 - DNA, 25 bp, Mus musculus
cccaagagctcaagtgccccacccc

SEQ ID NO: 901618 - DNA, 25 bp, Mus musculus
cccaagagctcatgtgccccacccc

SEQ ID NO: 901619 - DNA, 25 bp, Mus musculus
cccaagaggaagcttagcgcggatg

SEQ ID NO: 901620 - DNA, 25 bp, Mus musculus
cccaagaggaaggttagcgcggatg

SEQ ID NO: 901621 - DNA, 25 bp, Mus musculus
cccaagatcctggaccacttggaat

SEQ ID NO: 901622 - DNA, 25 bp, Mus musculus
cccaagatcctggagcacttggaat

SEQ ID NO: 901623 - DNA, 25 bp, Mus musculus
cccaagattgataattaggaaagtt

SEQ ID NO: 901624 - DNA, 25 bp, Mus musculus
cccaagattgttaattaggaaagtt

SEQ ID NO: 901625 - DNA, 25 bp, Mus musculus
cccaagcacaagctgagactgtgga

SEQ ID NO: 901626 - DNA, 25 bp, Mus musculus
cccaagcacaaggtgagactgtgga

SEQ ID NO: 901627 - DNA, 25 bp, Mus musculus
cccaagcaccgtgtcaccatgaacg

SEQ ID NO: 901628 - DNA, 25 bp, Mus musculus
cccaagcaccgtgtgaccatgaacg

SEQ ID NO: 901629 - DNA, 25 bp, Mus musculus
cccaagcagcctagtggcagcaacc

SEQ ID NO: 901630 - DNA, 25 bp, Mus musculus
cccaagcagccttgtggcagcaacc

SEQ ID NO: 901631 - DNA, 25 bp, Mus musculus
cccaagcataaacgaaatggtaact

SEQ ID NO: 901632 - DNA, 25 bp, Mus musculus
cccaagcataaaggaaatggtaact

SEQ ID NO: 901633 - DNA, 25 bp, Mus musculus
cccaagccaaagcgctcatccaggt

SEQ ID NO: 901634 - DNA, 25 bp, Mus musculus
cccaagccaaagggctcatccaggt

SEQ ID NO: 901635 - DNA, 25 bp, Mus musculus
cccaagccggtgcccggctttcagg

SEQ ID NO: 901636 - DNA, 25 bp, Mus musculus
cccaagccggtgccgggctttcagg

SEQ ID NO: 901637 - DNA, 25 bp, Mus musculus
cccaagcgaaggctctcggcagcaa

SEQ ID NO: 901638 - DNA, 25 bp, Mus musculus
cccaagcgaaggctgtcggcagcaa

SEQ ID NO: 901639 - DNA, 25 bp, Mus musculus
cccaagcgtgagtgcaaggagcccc

SEQ ID NO: 901640 - DNA, 25 bp, Mus musculus
cccaagcgtgtgtgcaaggagcccc

SEQ ID NO: 901641 - DNA, 25 bp, Mus musculus
cccaagctcttgaaacaatttgaat

SEQ ID NO: 901642 - DNA, 25 bp, Mus musculus
cccaagctcttgaatcaatttgaat

SEQ ID NO: 901643 - DNA, 25 bp, Mus musculus
cccaagctggaatccccaaaagaag

SEQ ID NO: 901644 - DNA, 25 bp, Mus musculus
cccaagctggtatccccaaaagaag

SEQ ID NO: 901645 - DNA, 25 bp, Mus musculus
cccaagggaggtgacgaggaagaag

SEQ ID NO: 901646 - DNA, 25 bp, Mus musculus
cccaagggaggtgaggaggaagaag

SEQ ID NO: 901647 - DNA, 25 bp, Mus musculus
cccaagggtgaacacggtgcctctg

SEQ ID NO: 901648 - DNA, 25 bp, Mus musculus
cccaagggtgaacagggtgcctctg

SEQ ID NO: 901649 - DNA, 25 bp, Mus musculus
cccaagtatgcactgctcgatgaag

SEQ ID NO: 901650 - DNA, 25 bp, Mus musculus
cccaagtatgcagtgctcgatgaag

SEQ ID NO: 901651 - DNA, 25 bp, Mus musculus
cccaagtcaaagctggcctcagggc

SEQ ID NO: 901652 - DNA, 25 bp, Mus musculus
cccaagtcaaaggtggcctcagggc

SEQ ID NO: 901653 - DNA, 25 bp, Mus musculus
cccaagtcagcacttgcccaggcgt

SEQ ID NO: 901654 - DNA, 25 bp, Mus musculus
cccaagtcaggacttgcccaggcgt

SEQ ID NO: 901655 - DNA, 25 bp, Mus musculus
cccaagtcgggccacgtacatccaa

SEQ ID NO: 901656 - DNA, 25 bp, Mus musculus
cccaagtcgggccaggtacatccaa

SEQ ID NO: 901657 - DNA, 25 bp, Mus musculus
cccaagtcgtcagcagtgtttgagg

SEQ ID NO: 901658 - DNA, 25 bp, Mus musculus
cccaagtcgtgagcagtgtttgagg

SEQ ID NO: 901659 - DNA, 25 bp, Mus musculus
cccaagtgctggagatctttggctt

SEQ ID NO: 901660 - DNA, 25 bp, Mus musculus
cccaagtgctggtgatctttggctt

SEQ ID NO: 901661 - DNA, 25 bp, Mus musculus
cccaagtggctgaccacctggacca

SEQ ID NO: 901662 - DNA, 25 bp, Mus musculus
cccaagtggctgtccacctggacca

SEQ ID NO: 901663 - DNA, 25 bp, Mus musculus
cccaataacaaatactacacaggat

SEQ ID NO: 901664 - DNA, 25 bp, Mus musculus
cccaataacaaatagtacacaggat

SEQ ID NO: 901665 - DNA, 25 bp, Mus musculus
cccaatagagataatgcaggggatg

SEQ ID NO: 901666 - DNA, 25 bp, Mus musculus
cccaatagagatggcttgccagtag

SEQ ID NO: 901667 - DNA, 25 bp, Mus musculus
cccaatagagttaatgcaggggatg

SEQ ID NO: 901668 - DNA, 25 bp, Mus musculus
cccaatagagttggcttgccagtag

SEQ ID NO: 901669 - DNA, 25 bp, Mus musculus
cccaatatcactgacaaaaacattg

SEQ ID NO: 901670 - DNA, 25 bp, Mus musculus
cccaatatcactgaccagaaaaaca

SEQ ID NO: 901671 - DNA, 25 bp, Mus musculus
cccaatatcactgagaaaaacattg

SEQ ID NO: 901672 - DNA, 25 bp, Mus musculus
cccaatatcactgagcagaaaaaca

SEQ ID NO: 901673 - DNA, 25 bp, Mus musculus
cccaatcataaactcttgtccagag

SEQ ID NO: 901674 - DNA, 25 bp, Mus musculus
cccaatcataaagtcttgtccagag

SEQ ID NO: 901675 - DNA, 25 bp, Mus musculus
cccaatccagaacaggaggctgctg

SEQ ID NO: 901676 - DNA, 25 bp, Mus musculus
cccaatccagcaggctgctggagcc

SEQ ID NO: 901677 - DNA, 25 bp, Mus musculus
cccaatccaggaggctgctggagcc

SEQ ID NO: 901678 - DNA, 25 bp, Mus musculus
cccaatccagtacaggaggctgctg

SEQ ID NO: 901679 - DNA, 25 bp, Mus musculus
cccaatcccactcattttaggtgat

SEQ ID NO: 901680 - DNA, 25 bp, Mus musculus
cccaatcccactgattttaggtgat

SEQ ID NO: 901681 - DNA, 25 bp, Mus musculus
cccaatctcgaagatatgtttgatg

SEQ ID NO: 901682 - DNA, 25 bp, Mus musculus
cccaatctcgatatgtttgatgact

SEQ ID NO: 901683 - DNA, 25 bp, Mus musculus
cccaatctcgtagatatgtttgatg

SEQ ID NO: 901684 - DNA, 25 bp, Mus musculus
cccaatctcgttatgtttgatgact

SEQ ID NO: 901685 - DNA, 25 bp, Mus musculus
cccaatgacgctcaagatgctgaat

SEQ ID NO: 901686 - DNA, 25 bp, Mus musculus
cccaatgacggtcaagatgctgaat

SEQ ID NO: 901687 - DNA, 25 bp, Mus musculus
cccaatgccactccatggcggaaga

SEQ ID NO: 901688 - DNA, 25 bp, Mus musculus
cccaatgccactgcatggcggaaga

SEQ ID NO: 901689 - DNA, 25 bp, Mus musculus
cccaatgcctctgcggccgcgggct

SEQ ID NO: 901690 - DNA, 25 bp, Mus musculus
cccaatgcctgtgcggccgcgggct

SEQ ID NO: 901691 - DNA, 25 bp, Mus musculus
cccaattatatccccgtggacttgc

SEQ ID NO: 901692 - DNA, 25 bp, Mus musculus
cccaattatatcccggtggacttgc

SEQ ID NO: 901693 - DNA, 25 bp, Mus musculus
cccaattgtgctctgccatctgcac

SEQ ID NO: 901694 - DNA, 25 bp, Mus musculus
cccaattgtggtctgccatctgcac

SEQ ID NO: 901695 - DNA, 25 bp, Mus musculus
cccacaaacatacacgggaaatatc

SEQ ID NO: 901696 - DNA, 25 bp, Mus musculus
cccacaaacatacaggggaaatatc

SEQ ID NO: 901697 - DNA, 25 bp, Mus musculus
cccacaaagccccacgcattcttca

SEQ ID NO: 901698 - DNA, 25 bp, Mus musculus
cccacaaagccccaggcattcttca

SEQ ID NO: 901699 - DNA, 25 bp, Mus musculus
cccacaacacagctcagccaaagca

SEQ ID NO: 901700 - DNA, 25 bp, Mus musculus
cccacaacacaggtcagccaaagca

SEQ ID NO: 901701 - DNA, 25 bp, Mus musculus
cccacaagcctgaaatcaactccac

SEQ ID NO: 901702 - DNA, 25 bp, Mus musculus
cccacaagcctgagccaggagggcc

SEQ ID NO: 901703 - DNA, 25 bp, Mus musculus
cccacaagcctgtaatcaactccac

SEQ ID NO: 901704 - DNA, 25 bp, Mus musculus
cccacaagcctgtgccaggagggcc

SEQ ID NO: 901705 - DNA, 25 bp, Mus musculus
cccacaaggtcaaacagttctgtga

SEQ ID NO: 901706 - DNA, 25 bp, Mus musculus
cccacaaggtcaaagagttctgtga

SEQ ID NO: 901707 - DNA, 25 bp, Mus musculus
cccacaatcgaagatgcttataaaa

SEQ ID NO: 901708 - DNA, 25 bp, Mus musculus
cccacaatcgccagagttcacggcc

SEQ ID NO: 901709 - DNA, 25 bp, Mus musculus
cccacaatcggcagagttcacggcc

SEQ ID NO: 901710 - DNA, 25 bp, Mus musculus
cccacaatcgtagatgcttataaaa

SEQ ID NO: 901711 - DNA, 25 bp, Mus musculus
cccacactgcgcagagtgcaccaat

SEQ ID NO: 901712 - DNA, 25 bp, Mus musculus
cccacactgcgctgagtgcaccaat

SEQ ID NO: 901713 - DNA, 25 bp, Mus musculus
cccacactggcccccactgggaagc

SEQ ID NO: 901714 - DNA, 25 bp, Mus musculus
cccacactggccgccactgggaagc

SEQ ID NO: 901715 - DNA, 25 bp, Mus musculus
cccacacttcttccagccttaacca

SEQ ID NO: 901716 - DNA, 25 bp, Mus musculus
cccacacttcttcctgccttaacca

SEQ ID NO: 901717 - DNA, 25 bp, Mus musculus
cccacagaaatgctgcacaatgtca

SEQ ID NO: 901718 - DNA, 25 bp, Mus musculus
cccacagaaatggtgcacaatgtca

SEQ ID NO: 901719 - DNA, 25 bp, Mus musculus
cccacagaacgacagcgccatctgt

SEQ ID NO: 901720 - DNA, 25 bp, Mus musculus
cccacagaacgagagcgccatctgt

SEQ ID NO: 901721 - DNA, 25 bp, Mus musculus
cccacagaactcacaagccttattc

SEQ ID NO: 901722 - DNA, 25 bp, Mus musculus
cccacagaactcactagccttattc

SEQ ID NO: 901723 - DNA, 25 bp, Mus musculus
cccacagaagctgattgaacagagc

SEQ ID NO: 901724 - DNA, 25 bp, Mus musculus
cccacagaaggtgattgaacagagc

SEQ ID NO: 901725 - DNA, 25 bp, Mus musculus
cccacagacaagctggagcgaatca

SEQ ID NO: 901726 - DNA, 25 bp, Mus musculus
cccacagacaaggtggagcgaatca

SEQ ID NO: 901727 - DNA, 25 bp, Mus musculus
cccacagacccaacatgtctctcct

SEQ ID NO: 901728 - DNA, 25 bp, Mus musculus
cccacagacccatcatgtctctcct

SEQ ID NO: 901729 - DNA, 25 bp, Mus musculus
cccacagacgattggggctgctagt

SEQ ID NO: 901730 - DNA, 25 bp, Mus musculus
cccacagacgtttggggctgctagt

SEQ ID NO: 901731 - DNA, 25 bp, Mus musculus
cccacagaggaacacgtgtcttggc

SEQ ID NO: 901732 - DNA, 25 bp, Mus musculus
cccacagaggaacaggtgtcttggc

SEQ ID NO: 901733 - DNA, 25 bp, Mus musculus
cccacagcaaaacgccagatattct

SEQ ID NO: 901734 - DNA, 25 bp, Mus musculus
cccacagcaaaaggccagatattct

SEQ ID NO: 901735 - DNA, 25 bp, Mus musculus
cccacagcagagtctgtgcgcccca

SEQ ID NO: 901736 - DNA, 25 bp, Mus musculus
cccacagcagtgtctgtgcgcccca

SEQ ID NO: 901737 - DNA, 25 bp, Mus musculus
cccacagccttccacgatgcctgaa

SEQ ID NO: 901738 - DNA, 25 bp, Mus musculus
cccacagccttccaggatgcctgaa

SEQ ID NO: 901739 - DNA, 25 bp, Mus musculus
cccacagcgtcctccgggtagctgg

SEQ ID NO: 901740 - DNA, 25 bp, Mus musculus
cccacagcgtcctcggggtagctgg

SEQ ID NO: 901741 - DNA, 25 bp, Mus musculus
cccacagctgcgcgctcagtatgag

SEQ ID NO: 901742 - DNA, 25 bp, Mus musculus
cccacagctgggcgctcagtatgag

SEQ ID NO: 901743 - DNA, 25 bp, Mus musculus
cccacagcttcccacgagatgtacg

SEQ ID NO: 901744 - DNA, 25 bp, Mus musculus
cccacagcttcccaggagatgtacg

SEQ ID NO: 901745 - DNA, 25 bp, Mus musculus
cccacaggaagtcacctagcagcca

SEQ ID NO: 901746 - DNA, 25 bp, Mus musculus
cccacaggaagtcagctagcagcca

SEQ ID NO: 901747 - DNA, 25 bp, Mus musculus
cccacaggcgggcgctgtatcctca

SEQ ID NO: 901748 - DNA, 25 bp, Mus musculus
cccacaggcgggcggtgtatcctca

SEQ ID NO: 901749 - DNA, 25 bp, Mus musculus
cccacagtggatctcactgtggatg

SEQ ID NO: 901750 - DNA, 25 bp, Mus musculus
cccacagtggcggctgaagaatact

SEQ ID NO: 901751 - DNA, 25 bp, Mus musculus
cccacagtgggggctgaagaatact

SEQ ID NO: 901752 - DNA, 25 bp, Mus musculus
cccacagtggttctcactgtggatg

SEQ ID NO: 901753 - DNA, 25 bp, Mus musculus
cccacatcaattagagcccggcggg

SEQ ID NO: 901754 - DNA, 25 bp, Mus musculus
cccacatcaattgccagagcccggc

SEQ ID NO: 901755 - DNA, 25 bp, Mus musculus
cccacatcaattgcgagagcccggc

SEQ ID NO: 901756 - DNA, 25 bp, Mus musculus
cccacatcaatttgagcccggcggg

SEQ ID NO: 901757 - DNA, 25 bp, Mus musculus
cccacatccccacaggtataatagg

SEQ ID NO: 901758 - DNA, 25 bp, Mus musculus
cccacatccccagaggtataatagg

SEQ ID NO: 901759 - DNA, 25 bp, Mus musculus
cccacatgcaatctttccagcggtt

SEQ ID NO: 901760 - DNA, 25 bp, Mus musculus
cccacatgcaatgtttccagcggtt

SEQ ID NO: 901761 - DNA, 25 bp, Mus musculus
cccacatgttgcctatgacggacct

SEQ ID NO: 901762 - DNA, 25 bp, Mus musculus
cccacatgttgcctttgacggacct

SEQ ID NO: 901763 - DNA, 25 bp, Mus musculus
cccacattccagcgccctctgcctc

SEQ ID NO: 901764 - DNA, 25 bp, Mus musculus
cccacattccagggccctctgcctc

SEQ ID NO: 901765 - DNA, 25 bp, Mus musculus
cccaccaagatcccagtgattatag

SEQ ID NO: 901766 - DNA, 25 bp, Mus musculus
cccaccaagatccctgtgattatag

SEQ ID NO: 901767 - DNA, 25 bp, Mus musculus
cccaccacacagcttgtctgagcag

SEQ ID NO: 901768 - DNA, 25 bp, Mus musculus
cccaccacacaggttgtctgagcag

SEQ ID NO: 901769 - DNA, 25 bp, Mus musculus
cccaccacacctctctcctccttca

SEQ ID NO: 901770 - DNA, 25 bp, Mus musculus
cccaccacacctgtctcctccttca

SEQ ID NO: 901771 - DNA, 25 bp, Mus musculus
cccaccagagacaacgtccactggg

SEQ ID NO: 901772 - DNA, 25 bp, Mus musculus
cccaccagagacaaggtccactggg

SEQ ID NO: 901773 - DNA, 25 bp, Mus musculus
cccaccaggcagaacgcgacagact

SEQ ID NO: 901774 - DNA, 25 bp, Mus musculus
cccaccaggcagaaggcgacagact

SEQ ID NO: 901775 - DNA, 25 bp, Mus musculus
cccaccatccgcccatttcagcctt

SEQ ID NO: 901776 - DNA, 25 bp, Mus musculus
cccaccatccgcccttttcagcctt

SEQ ID NO: 901777 - DNA, 25 bp, Mus musculus
cccaccatgaaacagctccagacga

SEQ ID NO: 901778 - DNA, 25 bp, Mus musculus
cccaccatgaaagagctccagacga

SEQ ID NO: 901779 - DNA, 25 bp, Mus musculus
cccaccattgaagatgcttataaga

SEQ ID NO: 901780 - DNA, 25 bp, Mus musculus
cccaccattgctttcaatgtggaga

SEQ ID NO: 901781 - DNA, 25 bp, Mus musculus
cccaccattggtttcaatgtggaga

SEQ ID NO: 901782 - DNA, 25 bp, Mus musculus
cccaccattgtagatgcttataaga

SEQ ID NO: 901783 - DNA, 25 bp, Mus musculus
cccaccccagcctaaaccatacctt

SEQ ID NO: 901784 - DNA, 25 bp, Mus musculus
cccaccccagcctataccatacctt

SEQ ID NO: 901785 - DNA, 25 bp, Mus musculus
cccaccccagcgcaggaatgacatt

SEQ ID NO: 901786 - DNA, 25 bp, Mus musculus
cccaccccagggcaggaatgacatt

SEQ ID NO: 901787 - DNA, 25 bp, Mus musculus
cccaccccccagcaagagccagagg

SEQ ID NO: 901788 - DNA, 25 bp, Mus musculus
cccaccccccagcacatgacagatg

SEQ ID NO: 901789 - DNA, 25 bp, Mus musculus
cccaccccccaggaagagccagagg

SEQ ID NO: 901790 - DNA, 25 bp, Mus musculus
cccaccccccaggacatgacagatg

SEQ ID NO: 901791 - DNA, 25 bp, Mus musculus
cccaccccgctgccaaatctcatgc

SEQ ID NO: 901792 - DNA, 25 bp, Mus musculus
cccaccccgctggcaaatctcatgc

SEQ ID NO: 901793 - DNA, 25 bp, Mus musculus
cccaccgagcagctgacattcccac

SEQ ID NO: 901794 - DNA, 25 bp, Mus musculus
cccaccgagcaggtgacattcccac

SEQ ID NO: 901795 - DNA, 25 bp, Mus musculus
cccaccgcatctgtagcatcctggc

SEQ ID NO: 901796 - DNA, 25 bp, Mus musculus
cccaccgcatgtgtagcatcctggc

SEQ ID NO: 901797 - DNA, 25 bp, Mus musculus
cccaccgccaagagaataaagactc

SEQ ID NO: 901798 - DNA, 25 bp, Mus musculus
cccaccgccaagatggattcatggg

SEQ ID NO: 901799 - DNA, 25 bp, Mus musculus
cccaccgccaagtgaataaagactc

SEQ ID NO: 901800 - DNA, 25 bp, Mus musculus
cccaccgccaagttggattcatggg

SEQ ID NO: 901801 - DNA, 25 bp, Mus musculus
cccaccgcgcagccagctgaaaaag

SEQ ID NO: 901802 - DNA, 25 bp, Mus musculus
cccaccgcgcaggcagctgaaaaag

SEQ ID NO: 901803 - DNA, 25 bp, Mus musculus
cccaccggagcgtcagtactgtaca

SEQ ID NO: 901804 - DNA, 25 bp, Mus musculus
cccaccggagggtcagtactgtaca

SEQ ID NO: 901805 - DNA, 25 bp, Mus musculus
cccacctacagagacgaggcttctc

SEQ ID NO: 901806 - DNA, 25 bp, Mus musculus
cccacctacagagaggaggcttctc

SEQ ID NO: 901807 - DNA, 25 bp, Mus musculus
cccacctatcgtctcgccagtggtg

SEQ ID NO: 901808 - DNA, 25 bp, Mus musculus
cccacctatcgtgtcgccagtggtg

SEQ ID NO: 901809 - DNA, 25 bp, Mus musculus
cccacctccgctgatccaggcgtgc

SEQ ID NO: 901810 - DNA, 25 bp, Mus musculus
cccacctccggtgatccaggcgtgc

SEQ ID NO: 901811 - DNA, 25 bp, Mus musculus
cccacctctgaacgttacagcatca

SEQ ID NO: 901812 - DNA, 25 bp, Mus musculus
cccacctctgaaggttacagcatca

SEQ ID NO: 901813 - DNA, 25 bp, Mus musculus
cccacctgacatcccggtctgcctt

SEQ ID NO: 901814 - DNA, 25 bp, Mus musculus
cccacctgacatccgggtctgcctt

SEQ ID NO: 901815 - DNA, 25 bp, Mus musculus
cccacctgcaagactacagagagcc

SEQ ID NO: 901816 - DNA, 25 bp, Mus musculus
cccacctgcaagattctggtgctaa

SEQ ID NO: 901817 - DNA, 25 bp, Mus musculus
cccacctgcaagtctacagagagcc

SEQ ID NO: 901818 - DNA, 25 bp, Mus musculus
cccacctgcaagtttctggtgctaa

SEQ ID NO: 901819 - DNA, 25 bp, Mus musculus
cccacgaaatcgcaaatcccaaatg

SEQ ID NO: 901820 - DNA, 25 bp, Mus musculus
cccacgaaatggcaaatcccaaatg

SEQ ID NO: 901821 - DNA, 25 bp, Mus musculus
cccacgacctcacgtgcccggagag

SEQ ID NO: 901822 - DNA, 25 bp, Mus musculus
cccacgacctcaggtgcccggagag

SEQ ID NO: 901823 - DNA, 25 bp, Mus musculus
cccacgatataccacaagtctacaa

SEQ ID NO: 901824 - DNA, 25 bp, Mus musculus
cccacgatataccagaagtctacaa

SEQ ID NO: 901825 - DNA, 25 bp, Mus musculus
cccacgattccgacccactgccaag

SEQ ID NO: 901826 - DNA, 25 bp, Mus musculus
cccacgattcggacccactgccaag

SEQ ID NO: 901827 - DNA, 25 bp, Mus musculus
cccacgcaagatggctgccagcaac

SEQ ID NO: 901828 - DNA, 25 bp, Mus musculus
cccacgcaagttggctgccagcaac

SEQ ID NO: 901829 - DNA, 25 bp, Mus musculus
cccacgccagacctgcctatccaga

SEQ ID NO: 901830 - DNA, 25 bp, Mus musculus
cccacgccagcattacatcttctac

SEQ ID NO: 901831 - DNA, 25 bp, Mus musculus
cccacgccaggattacatcttctac

SEQ ID NO: 901832 - DNA, 25 bp, Mus musculus
cccacgccagtcctgcctatccaga

SEQ ID NO: 901833 - DNA, 25 bp, Mus musculus
cccacgccggccttaagcgacacgt

SEQ ID NO: 901834 - DNA, 25 bp, Mus musculus
cccacgccgggcttaagcgacacgt

SEQ ID NO: 901835 - DNA, 25 bp, Mus musculus
cccacgcttgccttccttgctcctg

SEQ ID NO: 901836 - DNA, 25 bp, Mus musculus
cccacgcttgccttgcttgctcctg

SEQ ID NO: 901837 - DNA, 25 bp, Mus musculus
cccacggctgctcacctcctgcaga

SEQ ID NO: 901838 - DNA, 25 bp, Mus musculus
cccacggctgctgacctcctgcaga

SEQ ID NO: 901839 - DNA, 25 bp, Mus musculus
cccacgggagagacctaccaggatc

SEQ ID NO: 901840 - DNA, 25 bp, Mus musculus
cccacgggagagtcctaccaggatc

SEQ ID NO: 901841 - DNA, 25 bp, Mus musculus
cccacggtcatccatgaagttcgca

SEQ ID NO: 901842 - DNA, 25 bp, Mus musculus
cccacggtcatcgatgaagttcgca

SEQ ID NO: 901843 - DNA, 25 bp, Mus musculus
cccacgtatgcacgctctgcctggt

SEQ ID NO: 901844 - DNA, 25 bp, Mus musculus
cccacgtatgcaggctctgcctggt

SEQ ID NO: 901845 - DNA, 25 bp, Mus musculus
cccacgtatgcccctgcagcggctg

SEQ ID NO: 901846 - DNA, 25 bp, Mus musculus
cccacgtatggccctgcagcggctg

SEQ ID NO: 901847 - DNA, 25 bp, Mus musculus
cccacgtcagacctaggaaaggctc

SEQ ID NO: 901848 - DNA, 25 bp, Mus musculus
cccacgtcagtcctaggaaaggctc

SEQ ID NO: 901849 - DNA, 25 bp, Mus musculus
cccacgtgtgcacggtcctgtgggc

SEQ ID NO: 901850 - DNA, 25 bp, Mus musculus
cccacgtgtgcagggtcctgtgggc

SEQ ID NO: 901851 - DNA, 25 bp, Mus musculus
cccacgttggcatctgaaccaatga

SEQ ID NO: 901852 - DNA, 25 bp, Mus musculus
cccacgttgggatctgaaccaatga

SEQ ID NO: 901853 - DNA, 25 bp, Mus musculus
cccactaacattcacaggaaatatc

SEQ ID NO: 901854 - DNA, 25 bp, Mus musculus
cccactaacattcagaggaaatatc

SEQ ID NO: 901855 - DNA, 25 bp, Mus musculus
cccactatagagcactcctaccgga

SEQ ID NO: 901856 - DNA, 25 bp, Mus musculus
cccactatagaggactcctaccgga

SEQ ID NO: 901857 - DNA, 25 bp, Mus musculus
cccactcaaaagatcttcagtgagc

SEQ ID NO: 901858 - DNA, 25 bp, Mus musculus
cccactcaaaagttcttcagtgagc

SEQ ID NO: 901859 - DNA, 25 bp, Mus musculus
cccactcactagagggaacaccata

SEQ ID NO: 901860 - DNA, 25 bp, Mus musculus
cccactcactagtgggaacaccata

SEQ ID NO: 901861 - DNA, 25 bp, Mus musculus
cccactcagacacggttcctccagc

SEQ ID NO: 901862 - DNA, 25 bp, Mus musculus
cccactcagacagggttcctccagc

SEQ ID NO: 901863 - DNA, 25 bp, Mus musculus
cccactccaccgcgtatgaagctaa

SEQ ID NO: 901864 - DNA, 25 bp, Mus musculus
cccactccaccgggtatgaagctaa

SEQ ID NO: 901865 - DNA, 25 bp, Mus musculus
cccactctcctgaacttccaggtcc

SEQ ID NO: 901866 - DNA, 25 bp, Mus musculus
cccactctcctgcgctgcaactgga

SEQ ID NO: 901867 - DNA, 25 bp, Mus musculus
cccactctcctgctcctgagtcaga

SEQ ID NO: 901868 - DNA, 25 bp, Mus musculus
cccactctcctgggctgcaactgga

SEQ ID NO: 901869 - DNA, 25 bp, Mus musculus
cccactctcctggtcctgagtcaga

SEQ ID NO: 901870 - DNA, 25 bp, Mus musculus
cccactctcctgtacttccaggtcc

SEQ ID NO: 901871 - DNA, 25 bp, Mus musculus
cccactgccagaagatctgcagagg

SEQ ID NO: 901872 - DNA, 25 bp, Mus musculus
cccactgccagatgatctgcagagg

SEQ ID NO: 901873 - DNA, 25 bp, Mus musculus
cccactgccaggatatcaacgaatg

SEQ ID NO: 901874 - DNA, 25 bp, Mus musculus
cccactgccaggttatcaacgaatg

SEQ ID NO: 901875 - DNA, 25 bp, Mus musculus
cccactgcggagacgtggatgaatg

SEQ ID NO: 901876 - DNA, 25 bp, Mus musculus
cccactgcggagtcgtggatgaatg

SEQ ID NO: 901877 - DNA, 25 bp, Mus musculus
cccactgtggagacaccaacgagtg

SEQ ID NO: 901878 - DNA, 25 bp, Mus musculus
cccactgtggagtcaccaacgagtg

SEQ ID NO: 901879 - DNA, 25 bp, Mus musculus
cccagaaaactgctaccactgcctt

SEQ ID NO: 901880 - DNA, 25 bp, Mus musculus
cccagaaaactggtaccactgcctt

SEQ ID NO: 901881 - DNA, 25 bp, Mus musculus
cccagaaagatgaaaggctgtggtc

SEQ ID NO: 901882 - DNA, 25 bp, Mus musculus
cccagaaagatgaatggctgtggtc

SEQ ID NO: 901883 - DNA, 25 bp, Mus musculus
cccagaaagccacaagctaatccac

SEQ ID NO: 901884 - DNA, 25 bp, Mus musculus
cccagaaagccacatgctaatccac

SEQ ID NO: 901885 - DNA, 25 bp, Mus musculus
cccagaagagctagaggccgaggct

SEQ ID NO: 901886 - DNA, 25 bp, Mus musculus
cccagaagaggtagaggccgaggct

SEQ ID NO: 901887 - DNA, 25 bp, Mus musculus
cccagaagcaacaacgaggatctca

SEQ ID NO: 901888 - DNA, 25 bp, Mus musculus
cccagaagcaacaaggaggatctca

SEQ ID NO: 901889 - DNA, 25 bp, Mus musculus
cccagaaggcagagaactgtgccaa

SEQ ID NO: 901890 - DNA, 25 bp, Mus musculus
cccagaaggcagagtactgtgccaa

SEQ ID NO: 901891 - DNA, 25 bp, Mus musculus
cccagaagggctgtgctgaaatgat

SEQ ID NO: 901892 - DNA, 25 bp, Mus musculus
cccagaaggggtgtgctgaaatgat

SEQ ID NO: 901893 - DNA, 25 bp, Mus musculus
cccagaagtaagattggcctgttcg

SEQ ID NO: 901894 - DNA, 25 bp, Mus musculus
cccagaagtaagtttggcctgttcg

SEQ ID NO: 901895 - DNA, 25 bp, Mus musculus
cccagacaagatcgattatttctcc

SEQ ID NO: 901896 - DNA, 25 bp, Mus musculus
cccagacaagatggattatttctcc

SEQ ID NO: 901897 - DNA, 25 bp, Mus musculus
cccagacacaagcattcccactatg

SEQ ID NO: 901898 - DNA, 25 bp, Mus musculus
cccagacacaaggattcccactatg

SEQ ID NO: 901899 - DNA, 25 bp, Mus musculus
cccagacacactggctgctttgctg

SEQ ID NO: 901900 - DNA, 25 bp, Mus musculus
cccagacacagtggctgctttgctg

SEQ ID NO: 901901 - DNA, 25 bp, Mus musculus
cccagacaggccccatcagtctcac

SEQ ID NO: 901902 - DNA, 25 bp, Mus musculus
cccagacagggcccatcagtctcac

SEQ ID NO: 901903 - DNA, 25 bp, Mus musculus
cccagacatgatagtgatcggcaac

SEQ ID NO: 901904 - DNA, 25 bp, Mus musculus
cccagacatgttagtgatcggcaac

SEQ ID NO: 901905 - DNA, 25 bp, Mus musculus
cccagaccacagcacggcaacccag

SEQ ID NO: 901906 - DNA, 25 bp, Mus musculus
cccagaccacagcagggcaacccag

SEQ ID NO: 901907 - DNA, 25 bp, Mus musculus
cccagaccagagggatgtggaccac

SEQ ID NO: 901908 - DNA, 25 bp, Mus musculus
cccagaccagtgggatgtggaccac

SEQ ID NO: 901909 - DNA, 25 bp, Mus musculus
cccagacctccctccatgaacattg

SEQ ID NO: 901910 - DNA, 25 bp, Mus musculus
cccagacctcgctccatgaacattg

SEQ ID NO: 901911 - DNA, 25 bp, Mus musculus
cccagaccttcacctcttagctgac

SEQ ID NO: 901912 - DNA, 25 bp, Mus musculus
cccagaccttcacgaagctcttagc

SEQ ID NO: 901913 - DNA, 25 bp, Mus musculus
cccagaccttcacgggctcagctgc

SEQ ID NO: 901914 - DNA, 25 bp, Mus musculus
cccagaccttcagctcttagctgac

SEQ ID NO: 901915 - DNA, 25 bp, Mus musculus
cccagaccttcaggaagctcttagc

SEQ ID NO: 901916 - DNA, 25 bp, Mus musculus
cccagaccttcaggggctcagctgc

SEQ ID NO: 901917 - DNA, 25 bp, Mus musculus
cccagacttcccacagtctctgaac

SEQ ID NO: 901918 - DNA, 25 bp, Mus musculus
cccagacttcccactgtctctgaac

SEQ ID NO: 901919 - DNA, 25 bp, Mus musculus
cccagacttctgcgcttaaggtgat

SEQ ID NO: 901920 - DNA, 25 bp, Mus musculus
cccagacttctgggcttaaggtgat

SEQ ID NO: 901921 - DNA, 25 bp, Mus musculus
cccagagaagtccacgaagatgggc

SEQ ID NO: 901922 - DNA, 25 bp, Mus musculus
cccagagaagtccaggaagatgggc

SEQ ID NO: 901923 - DNA, 25 bp, Mus musculus
cccagagacccacaaagacctgggg

SEQ ID NO: 901924 - DNA, 25 bp, Mus musculus
cccagagacccagaaagacctgggg

SEQ ID NO: 901925 - DNA, 25 bp, Mus musculus
cccagagatggagacgctggaatga

SEQ ID NO: 901926 - DNA, 25 bp, Mus musculus
cccagagatggagaggctggaatga

SEQ ID NO: 901927 - DNA, 25 bp, Mus musculus
cccagagcagctggcagaggaggag

SEQ ID NO: 901928 - DNA, 25 bp, Mus musculus
cccagagcaggtggcagaggaggag

SEQ ID NO: 901929 - DNA, 25 bp, Mus musculus
cccagagctcaaagcgaagctaaca

SEQ ID NO: 901930 - DNA, 25 bp, Mus musculus
cccagagctcaaagggaagctaaca

SEQ ID NO: 901931 - DNA, 25 bp, Mus musculus
cccagagctcaacgagcgaatctgc

SEQ ID NO: 901932 - DNA, 25 bp, Mus musculus
cccagagctcaacgctaaccctttc

SEQ ID NO: 901933 - DNA, 25 bp, Mus musculus
cccagagctcaaggagcgaatctgc

SEQ ID NO: 901934 - DNA, 25 bp, Mus musculus
cccagagctcaaggctaaccctttc

SEQ ID NO: 901935 - DNA, 25 bp, Mus musculus
cccagagctccgcgctcaagtccac

SEQ ID NO: 901936 - DNA, 25 bp, Mus musculus
cccagagctccgggctcaagtccac

SEQ ID NO: 901937 - DNA, 25 bp, Mus musculus
cccagagctgctggaacacattgtc

SEQ ID NO: 901938 - DNA, 25 bp, Mus musculus
cccagagctggtggaacacattgtc

SEQ ID NO: 901939 - DNA, 25 bp, Mus musculus
cccagaggagcgagtgagctacttt

SEQ ID NO: 901940 - DNA, 25 bp, Mus musculus
cccagaggaggagaaggacaagcct

SEQ ID NO: 901941 - DNA, 25 bp, Mus musculus
cccagaggaggagatggacaagcct

SEQ ID NO: 901942 - DNA, 25 bp, Mus musculus
cccagaggagggagtgagctacttt

SEQ ID NO: 901943 - DNA, 25 bp, Mus musculus
cccagaggataaatgcagctgtagc

SEQ ID NO: 901944 - DNA, 25 bp, Mus musculus
cccagaggataattgcagctgtagc

SEQ ID NO: 901945 - DNA, 25 bp, Mus musculus
cccagaggcaacacagaagatgact

SEQ ID NO: 901946 - DNA, 25 bp, Mus musculus
cccagaggcatcacagaagatgact

SEQ ID NO: 901947 - DNA, 25 bp, Mus musculus
cccagatcaaatatcgtgaccttct

SEQ ID NO: 901948 - DNA, 25 bp, Mus musculus
cccagatcaaatatggtgaccttct

SEQ ID NO: 901949 - DNA, 25 bp, Mus musculus
cccagatcaaatcgtgtccagccct

SEQ ID NO: 901950 - DNA, 25 bp, Mus musculus
cccagatcaactattagacatgttc

SEQ ID NO: 901951 - DNA, 25 bp, Mus musculus
cccagatcaagtattagacatgttc

SEQ ID NO: 901952 - DNA, 25 bp, Mus musculus
cccagatcaattcgtgtccagccct

SEQ ID NO: 901953 - DNA, 25 bp, Mus musculus
cccagatcgcagctacagaaccttg

SEQ ID NO: 901954 - DNA, 25 bp, Mus musculus
cccagatcgcaggtacagaaccttg

SEQ ID NO: 901955 - DNA, 25 bp, Mus musculus
cccagatgtgagcacgaggcctctg

SEQ ID NO: 901956 - DNA, 25 bp, Mus musculus
cccagatgtgagcaggaggcctctg

SEQ ID NO: 901957 - DNA, 25 bp, Mus musculus
cccagattaaagacaaataatttag

SEQ ID NO: 901958 - DNA, 25 bp, Mus musculus
cccagattaaagtcaaataatttag

SEQ ID NO: 901959 - DNA, 25 bp, Mus musculus
cccagattcaaactgccgtggtgag

SEQ ID NO: 901960 - DNA, 25 bp, Mus musculus
cccagattcaaagtgccgtggtgag

SEQ ID NO: 901961 - DNA, 25 bp, Mus musculus
cccagattgaaactttgaatgaaga

SEQ ID NO: 901962 - DNA, 25 bp, Mus musculus
cccagattgaaagtttgaatgaaga

SEQ ID NO: 901963 - DNA, 25 bp, Mus musculus
cccagcacagcaatcttccctggta

SEQ ID NO: 901964 - DNA, 25 bp, Mus musculus
cccagcacagctcaattctttgtga

SEQ ID NO: 901965 - DNA, 25 bp, Mus musculus
cccagcacaggaatcttccctggta

SEQ ID NO: 901966 - DNA, 25 bp, Mus musculus
cccagcacaggtcaattctttgtga

SEQ ID NO: 901967 - DNA, 25 bp, Mus musculus
cccagcacctcacgtttctaaggac

SEQ ID NO: 901968 - DNA, 25 bp, Mus musculus
cccagcacctcaggtttctaaggac

SEQ ID NO: 901969 - DNA, 25 bp, Mus musculus
cccagcactgggcatgtccagctcg

SEQ ID NO: 901970 - DNA, 25 bp, Mus musculus
cccagcactggggatgtccagctcg

SEQ ID NO: 901971 - DNA, 25 bp, Mus musculus
cccagcagaacaatccgcttgaacc

SEQ ID NO: 901972 - DNA, 25 bp, Mus musculus
cccagcagaacattccgcttgaacc

SEQ ID NO: 901973 - DNA, 25 bp, Mus musculus
cccagcagaacgagtgtcctctccc

SEQ ID NO: 901974 - DNA, 25 bp, Mus musculus
cccagcagaacgcagcaagcgccca

SEQ ID NO: 901975 - DNA, 25 bp, Mus musculus
cccagcagaaggagtgtcctctccc

SEQ ID NO: 901976 - DNA, 25 bp, Mus musculus
cccagcagaaggcagcaagcgccca

SEQ ID NO: 901977 - DNA, 25 bp, Mus musculus
cccagcagagcgcagacaccaaaaa

SEQ ID NO: 901978 - DNA, 25 bp, Mus musculus
cccagcagagggcagacaccaaaaa

SEQ ID NO: 901979 - DNA, 25 bp, Mus musculus
cccagcagcaagctgtctggtcgga

SEQ ID NO: 901980 - DNA, 25 bp, Mus musculus
cccagcagcaaggtgtctggtcgga

SEQ ID NO: 901981 - DNA, 25 bp, Mus musculus
cccagcaggcagctgccagaccctc

SEQ ID NO: 901982 - DNA, 25 bp, Mus musculus
cccagcaggcaggtgccagaccctc

SEQ ID NO: 901983 - DNA, 25 bp, Mus musculus
cccagcaggtcagggccccctgggg

SEQ ID NO: 901984 - DNA, 25 bp, Mus musculus
cccagcaggtgagggccccctgggg

SEQ ID NO: 901985 - DNA, 25 bp, Mus musculus
cccagcatttggcggagagcacggt

SEQ ID NO: 901986 - DNA, 25 bp, Mus musculus
cccagcatttgggggagagcacggt

SEQ ID NO: 901987 - DNA, 25 bp, Mus musculus
cccagccaaacccctggactatttg

SEQ ID NO: 901988 - DNA, 25 bp, Mus musculus
cccagccaaagccctggactatttg

SEQ ID NO: 901989 - DNA, 25 bp, Mus musculus
cccagccagcaaaggtgctcagacc

SEQ ID NO: 901990 - DNA, 25 bp, Mus musculus
cccagccagcaatggtgctcagacc

SEQ ID NO: 901991 - DNA, 25 bp, Mus musculus
cccagccaggagctatcctctgaac

SEQ ID NO: 901992 - DNA, 25 bp, Mus musculus
cccagccaggaggtatcctctgaac

SEQ ID NO: 901993 - DNA, 25 bp, Mus musculus
cccagccagggccacatgtcatgga

SEQ ID NO: 901994 - DNA, 25 bp, Mus musculus
cccagccagggccagatgtcatgga

SEQ ID NO: 901995 - DNA, 25 bp, Mus musculus
cccagccatcccccccagtgctaca

SEQ ID NO: 901996 - DNA, 25 bp, Mus musculus
cccagccatcccccccttgaaagat

SEQ ID NO: 901997 - DNA, 25 bp, Mus musculus
cccagccatcccccctgctacaaat

SEQ ID NO: 901998 - DNA, 25 bp, Mus musculus
cccagccatcccccgcagtgctaca

SEQ ID NO: 901999 - DNA, 25 bp, Mus musculus
cccagccatcccccgcttgaaagat

SEQ ID NO: 902000 - DNA, 25 bp, Mus musculus
cccagccatcccccgtgctacaaat

SEQ ID NO: 902001 - DNA, 25 bp, Mus musculus
cccagcccacaactcctgcacagga

SEQ ID NO: 902002 - DNA, 25 bp, Mus musculus
cccagcccacaagtcctgcacagga

SEQ ID NO: 902003 - DNA, 25 bp, Mus musculus
cccagcccagaacaagcctgccatc

SEQ ID NO: 902004 - DNA, 25 bp, Mus musculus
cccagcccagcttccgagtccgagg

SEQ ID NO: 902005 - DNA, 25 bp, Mus musculus
cccagcccaggttccgagtccgagg

SEQ ID NO: 902006 - DNA, 25 bp, Mus musculus
cccagcccagtacaagcctgccatc

SEQ ID NO: 902007 - DNA, 25 bp, Mus musculus
cccagccctggacactccaccaact

SEQ ID NO: 902008 - DNA, 25 bp, Mus musculus
cccagccctggagactccaccaact

SEQ ID NO: 902009 - DNA, 25 bp, Mus musculus
cccagcctagccttcatgaaagaat

SEQ ID NO: 902010 - DNA, 25 bp, Mus musculus
cccagcctagccttgatgaaagaat

SEQ ID NO: 902011 - DNA, 25 bp, Mus musculus
cccagcctataccatacctttctac

SEQ ID NO: 902012 - DNA, 25 bp, Mus musculus
cccagcctattccatacctttctac

SEQ ID NO: 902013 - DNA, 25 bp, Mus musculus
cccagcctcattcgtggcaaccact

SEQ ID NO: 902014 - DNA, 25 bp, Mus musculus
cccagcctcattggtggcaaccact

SEQ ID NO: 902015 - DNA, 25 bp, Mus musculus
cccagccttgagaactttcactcct

SEQ ID NO: 902016 - DNA, 25 bp, Mus musculus
cccagccttgagaagtttcactcct

SEQ ID NO: 902017 - DNA, 25 bp, Mus musculus
cccagcgagaagcagaaattctccc

SEQ ID NO: 902018 - DNA, 25 bp, Mus musculus
cccagcgagaaggagaaattctccc

SEQ ID NO: 902019 - DNA, 25 bp, Mus musculus
cccagcgagcagccctgcaactccc

SEQ ID NO: 902020 - DNA, 25 bp, Mus musculus
cccagcgagcaggcctgcaactccc

SEQ ID NO: 902021 - DNA, 25 bp, Mus musculus
cccagcgattctcaaggtgaagaga

SEQ ID NO: 902022 - DNA, 25 bp, Mus musculus
cccagcgattctgaaggtgaagaga

SEQ ID NO: 902023 - DNA, 25 bp, Mus musculus
cccagcgcttccagcagcttttctt

SEQ ID NO: 902024 - DNA, 25 bp, Mus musculus
cccagcgcttcctgcagcttttctt

SEQ ID NO: 902025 - DNA, 25 bp, Mus musculus
cccagcggttctcagatatgcattg

SEQ ID NO: 902026 - DNA, 25 bp, Mus musculus
cccagcggttctgagatatgcattg

SEQ ID NO: 902027 - DNA, 25 bp, Mus musculus
cccagcgtcgtgattagcgatgatg

SEQ ID NO: 902028 - DNA, 25 bp, Mus musculus
cccagcgtcgtgtttagcgatgatg

SEQ ID NO: 902029 - DNA, 25 bp, Mus musculus
cccagctaacaaaagcgcggtggtc

SEQ ID NO: 902030 - DNA, 25 bp, Mus musculus
cccagctaactaaagcgcggtggtc

SEQ ID NO: 902031 - DNA, 25 bp, Mus musculus
cccagctactcacatggacgtccta

SEQ ID NO: 902032 - DNA, 25 bp, Mus musculus
cccagctactcagatggacgtccta

SEQ ID NO: 902033 - DNA, 25 bp, Mus musculus
cccagctatgcttacccagtgcggt

SEQ ID NO: 902034 - DNA, 25 bp, Mus musculus
cccagctatggttacccagtgcggt

SEQ ID NO: 902035 - DNA, 25 bp, Mus musculus
cccagctcaaagcaaccagctccct

SEQ ID NO: 902036 - DNA, 25 bp, Mus musculus
cccagctcaaaggaaccagctccct

SEQ ID NO: 902037 - DNA, 25 bp, Mus musculus
cccagctcagggcacgaaaccttct

SEQ ID NO: 902038 - DNA, 25 bp, Mus musculus
cccagctcagggcaggaaaccttct

SEQ ID NO: 902039 - DNA, 25 bp, Mus musculus
cccagctcctccgacgtggtgacgt

SEQ ID NO: 902040 - DNA, 25 bp, Mus musculus
cccagctcctccgaggtggtgacgt

SEQ ID NO: 902041 - DNA, 25 bp, Mus musculus
cccagctcctctcatgttgccaccc

SEQ ID NO: 902042 - DNA, 25 bp, Mus musculus
cccagctcctctgatgttgccaccc

SEQ ID NO: 902043 - DNA, 25 bp, Mus musculus
cccagctgagactggctggtggaca

SEQ ID NO: 902044 - DNA, 25 bp, Mus musculus
cccagctgagtctggctggtggaca

SEQ ID NO: 902045 - DNA, 25 bp, Mus musculus
cccagctgccagcacgtagatcatg

SEQ ID NO: 902046 - DNA, 25 bp, Mus musculus
cccagctgccagcacgtctccccct

SEQ ID NO: 902047 - DNA, 25 bp, Mus musculus
cccagctgccagcaggtagatcatg

SEQ ID NO: 902048 - DNA, 25 bp, Mus musculus
cccagctgccagcaggtctccccct

SEQ ID NO: 902049 - DNA, 25 bp, Mus musculus
cccagctgctcacgagccgggctgg

SEQ ID NO: 902050 - DNA, 25 bp, Mus musculus
cccagctgctcaggagccgggctgg

SEQ ID NO: 902051 - DNA, 25 bp, Mus musculus
cccagctggccataccctggtgcct

SEQ ID NO: 902052 - DNA, 25 bp, Mus musculus
cccagctggccatagcctggtgcct

SEQ ID NO: 902053 - DNA, 25 bp, Mus musculus
cccagctgtgggaggtcctcgattc

SEQ ID NO: 902054 - DNA, 25 bp, Mus musculus
cccagctgtgggtggtcctcgattc

SEQ ID NO: 902055 - DNA, 25 bp, Mus musculus
cccagcttcaagcgtacacggtcct

SEQ ID NO: 902056 - DNA, 25 bp, Mus musculus
cccagcttcaagggtacacggtcct

SEQ ID NO: 902057 - DNA, 25 bp, Mus musculus
cccagctttccacgtgggatcgagg

SEQ ID NO: 902058 - DNA, 25 bp, Mus musculus
cccagctttccaggtgggatcgagg

SEQ ID NO: 902059 - DNA, 25 bp, Mus musculus
cccaggaaaccacgaatgacacggg

SEQ ID NO: 902060 - DNA, 25 bp, Mus musculus
cccaggaaaccaggaatgacacggg

SEQ ID NO: 902061 - DNA, 25 bp, Mus musculus
cccaggaactcaaacaagtcacagt

SEQ ID NO: 902062 - DNA, 25 bp, Mus musculus
cccaggaactcaaagaagtcacagt

SEQ ID NO: 902063 - DNA, 25 bp, Mus musculus
cccaggaagccaccctcaggaaccc

SEQ ID NO: 902064 - DNA, 25 bp, Mus musculus
cccaggaagccagcctcaggaaccc

SEQ ID NO: 902065 - DNA, 25 bp, Mus musculus
cccaggaagctgcagaaggggtgga

SEQ ID NO: 902066 - DNA, 25 bp, Mus musculus
cccaggaagctgctccagctcagct

SEQ ID NO: 902067 - DNA, 25 bp, Mus musculus
cccaggaagctggagaaggggtgga

SEQ ID NO: 902068 - DNA, 25 bp, Mus musculus
cccaggaagctggtccagctcagct

SEQ ID NO: 902069 - DNA, 25 bp, Mus musculus
cccaggacaaaaacctcagcgagct

SEQ ID NO: 902070 - DNA, 25 bp, Mus musculus
cccaggacaataacctcagcgagct

SEQ ID NO: 902071 - DNA, 25 bp, Mus musculus
cccaggacagacagctgcagcacga

SEQ ID NO: 902072 - DNA, 25 bp, Mus musculus
cccaggacagctggatcgccggggt

SEQ ID NO: 902073 - DNA, 25 bp, Mus musculus
cccaggacaggtggatcgccggggt

SEQ ID NO: 902074 - DNA, 25 bp, Mus musculus
cccaggacagtcagctgcagcacga

SEQ ID NO: 902075 - DNA, 25 bp, Mus musculus
cccaggactcagctactgcggtgct

SEQ ID NO: 902076 - DNA, 25 bp, Mus musculus
cccaggactcaggtactgcggtgct

SEQ ID NO: 902077 - DNA, 25 bp, Mus musculus
cccaggactgctcaatgtggctacc

SEQ ID NO: 902078 - DNA, 25 bp, Mus musculus
cccaggactggtcaatgtggctacc

SEQ ID NO: 902079 - DNA, 25 bp, Mus musculus
cccaggagacggaatgacctggatg

SEQ ID NO: 902080 - DNA, 25 bp, Mus musculus
cccaggagacggtatgacctggatg

SEQ ID NO: 902081 - DNA, 25 bp, Mus musculus
cccaggagagattccttctgtcact

SEQ ID NO: 902082 - DNA, 25 bp, Mus musculus
cccaggagagcacgtcggcagctct

SEQ ID NO: 902083 - DNA, 25 bp, Mus musculus
cccaggagagcaggtcggcagctct

SEQ ID NO: 902084 - DNA, 25 bp, Mus musculus
cccaggagagtttccttctgtcact

SEQ ID NO: 902085 - DNA, 25 bp, Mus musculus
cccaggagctctcaggtctacgctc

SEQ ID NO: 902086 - DNA, 25 bp, Mus musculus
cccaggagctctgaggtctacgctc

SEQ ID NO: 902087 - DNA, 25 bp, Mus musculus
cccaggaggagacgctctctcggta

SEQ ID NO: 902088 - DNA, 25 bp, Mus musculus
cccaggaggagaggctctctcggta

SEQ ID NO: 902089 - DNA, 25 bp, Mus musculus
cccaggagtggccacgtatggcgta

SEQ ID NO: 902090 - DNA, 25 bp, Mus musculus
cccaggagtggccaggtatggcgta

SEQ ID NO: 902091 - DNA, 25 bp, Mus musculus
cccaggatcagttaagagacttcag

SEQ ID NO: 902092 - DNA, 25 bp, Mus musculus
cccaggatcagttaaggcagtaatg

SEQ ID NO: 902093 - DNA, 25 bp, Mus musculus
cccaggatcagttaagtttttattt

SEQ ID NO: 902094 - DNA, 25 bp, Mus musculus
cccaggatcagttatgagacttcag

SEQ ID NO: 902095 - DNA, 25 bp, Mus musculus
cccaggatcagttatggcagtaatg

SEQ ID NO: 902096 - DNA, 25 bp, Mus musculus
cccaggatcagttatgtttttattt

SEQ ID NO: 902097 - DNA, 25 bp, Mus musculus
cccaggatgaccctttcttccagga

SEQ ID NO: 902098 - DNA, 25 bp, Mus musculus
cccaggatgaccgtttcttccagga

SEQ ID NO: 902099 - DNA, 25 bp, Mus musculus
cccaggatggcgaccatttccagag

SEQ ID NO: 902100 - DNA, 25 bp, Mus musculus
cccaggatggcgacgatttccagag

SEQ ID NO: 902101 - DNA, 25 bp, Mus musculus
cccaggcaagcctggaagagttgtg

SEQ ID NO: 902102 - DNA, 25 bp, Mus musculus
cccaggcaagcgcagtgtatggggt

SEQ ID NO: 902103 - DNA, 25 bp, Mus musculus
cccaggcaaggctggaagagttgtg

SEQ ID NO: 902104 - DNA, 25 bp, Mus musculus
cccaggcaagggcagtgtatggggt

SEQ ID NO: 902105 - DNA, 25 bp, Mus musculus
cccaggcaccagaaacctcatccag

SEQ ID NO: 902106 - DNA, 25 bp, Mus musculus
cccaggcaccagagtgtccattgtc

SEQ ID NO: 902107 - DNA, 25 bp, Mus musculus
cccaggcaccagccagtaagtgctc

SEQ ID NO: 902108 - DNA, 25 bp, Mus musculus
cccaggcaccagcttgctccaggac

SEQ ID NO: 902109 - DNA, 25 bp, Mus musculus
cccaggcaccaggcagtaagtgctc

SEQ ID NO: 902110 - DNA, 25 bp, Mus musculus
cccaggcaccaggttgctccaggac

SEQ ID NO: 902111 - DNA, 25 bp, Mus musculus
cccaggcaccagtaacctcatccag

SEQ ID NO: 902112 - DNA, 25 bp, Mus musculus
cccaggcaccagtgtgtccattgtc

SEQ ID NO: 902113 - DNA, 25 bp, Mus musculus
cccaggcagacccacgtttcagttc

SEQ ID NO: 902114 - DNA, 25 bp, Mus musculus
cccaggcagacccaggtttcagttc

SEQ ID NO: 902115 - DNA, 25 bp, Mus musculus
cccaggccaagaagctggccttaca

SEQ ID NO: 902116 - DNA, 25 bp, Mus musculus
cccaggccaagaaggtggccttaca

SEQ ID NO: 902117 - DNA, 25 bp, Mus musculus
cccaggccagcacgtgtacagtggg

SEQ ID NO: 902118 - DNA, 25 bp, Mus musculus
cccaggccagcactgggctctggca

SEQ ID NO: 902119 - DNA, 25 bp, Mus musculus
cccaggccagcaggtgtacagtggg

SEQ ID NO: 902120 - DNA, 25 bp, Mus musculus
cccaggccagcagtgggctctggca

SEQ ID NO: 902121 - DNA, 25 bp, Mus musculus
cccaggcccaatattgtgatcactc

SEQ ID NO: 902122 - DNA, 25 bp, Mus musculus
cccaggcccaccctgcaactcccac

SEQ ID NO: 902123 - DNA, 25 bp, Mus musculus
cccaggcccagcctgcaactcccac

SEQ ID NO: 902124 - DNA, 25 bp, Mus musculus
cccaggcccaggaacaaacatgtat

SEQ ID NO: 902125 - DNA, 25 bp, Mus musculus
cccaggcccaggaacaagaatgtcc

SEQ ID NO: 902126 - DNA, 25 bp, Mus musculus
cccaggcccaggaagaaacatgtat

SEQ ID NO: 902127 - DNA, 25 bp, Mus musculus
cccaggcccaggaagaagaatgtcc

SEQ ID NO: 902128 - DNA, 25 bp, Mus musculus
cccaggcccattattgtgatcactc

SEQ ID NO: 902129 - DNA, 25 bp, Mus musculus
cccaggcggatgccacccttatcac

SEQ ID NO: 902130 - DNA, 25 bp, Mus musculus
cccaggcggatggcacccttatcac

SEQ ID NO: 902131 - DNA, 25 bp, Mus musculus
cccaggctaccacagcgtggcttct

SEQ ID NO: 902132 - DNA, 25 bp, Mus musculus
cccaggctaccagagcgtggcttct

SEQ ID NO: 902133 - DNA, 25 bp, Mus musculus
cccaggctccagatcatgagaagct

SEQ ID NO: 902134 - DNA, 25 bp, Mus musculus
cccaggctccagatcctgtggccag

SEQ ID NO: 902135 - DNA, 25 bp, Mus musculus
cccaggctccagatgatgagaagct

SEQ ID NO: 902136 - DNA, 25 bp, Mus musculus
cccaggctccagatgctgtggccag

SEQ ID NO: 902137 - DNA, 25 bp, Mus musculus
cccaggctgaatctgagaatagcca

SEQ ID NO: 902138 - DNA, 25 bp, Mus musculus
cccaggctgaatgtgagaatagcca

SEQ ID NO: 902139 - DNA, 25 bp, Mus musculus
cccagggaagaggctacagatgtct

SEQ ID NO: 902140 - DNA, 25 bp, Mus musculus
cccagggaagtggctacagatgtct

SEQ ID NO: 902141 - DNA, 25 bp, Mus musculus
cccagggactcagacggcctagatg

SEQ ID NO: 902142 - DNA, 25 bp, Mus musculus
cccagggactcagagggcctagatg

SEQ ID NO: 902143 - DNA, 25 bp, Mus musculus
cccagggccagcagcgtctcctgca

SEQ ID NO: 902144 - DNA, 25 bp, Mus musculus
cccagggccagcagggtctcctgca

SEQ ID NO: 902145 - DNA, 25 bp, Mus musculus
cccagggctacaaggtgcttcaggc

SEQ ID NO: 902146 - DNA, 25 bp, Mus musculus
cccagggctacatggtgcttcaggc

SEQ ID NO: 902147 - DNA, 25 bp, Mus musculus
cccaggggagatgtataccaggtgg

SEQ ID NO: 902148 - DNA, 25 bp, Mus musculus
cccaggggagttgtataccaggtgg

SEQ ID NO: 902149 - DNA, 25 bp, Mus musculus
cccaggggccttccaggcagtagag

SEQ ID NO: 902150 - DNA, 25 bp, Mus musculus
cccaggggccttcctggcagtagag

SEQ ID NO: 902151 - DNA, 25 bp, Mus musculus
cccaggtcaacacatacaagctgtc

SEQ ID NO: 902152 - DNA, 25 bp, Mus musculus
cccaggtcaacagatacaagctgtc

SEQ ID NO: 902153 - DNA, 25 bp, Mus musculus
cccaggtcccctctcgtctttggat

SEQ ID NO: 902154 - DNA, 25 bp, Mus musculus
cccaggtcccctctggtctttggat

SEQ ID NO: 902155 - DNA, 25 bp, Mus musculus
cccaggtctccccgctctgctttgt

SEQ ID NO: 902156 - DNA, 25 bp, Mus musculus
cccaggtctcccggctctgctttgt

SEQ ID NO: 902157 - DNA, 25 bp, Mus musculus
cccagtacagcaagatgagtctcca

SEQ ID NO: 902158 - DNA, 25 bp, Mus musculus
cccagtacaggaagatgagtctcca

SEQ ID NO: 902159 - DNA, 25 bp, Mus musculus
cccagtacatgaccatcccatcctc

SEQ ID NO: 902160 - DNA, 25 bp, Mus musculus
cccagtacatgagcatcccatcctc

SEQ ID NO: 902161 - DNA, 25 bp, Mus musculus
cccagtaggcagagatggcaccacc

SEQ ID NO: 902162 - DNA, 25 bp, Mus musculus
cccagtaggcagtgatggcaccacc

SEQ ID NO: 902163 - DNA, 25 bp, Mus musculus
cccagtcaagacttcagctgaaatc

SEQ ID NO: 902164 - DNA, 25 bp, Mus musculus
cccagtcaagtcttcagctgaaatc

SEQ ID NO: 902165 - DNA, 25 bp, Mus musculus
cccagtcactcacgtgttagcattg

SEQ ID NO: 902166 - DNA, 25 bp, Mus musculus
cccagtcactcaggtgttagcattg

SEQ ID NO: 902167 - DNA, 25 bp, Mus musculus
cccagtcctgttcaccaccatcagc

SEQ ID NO: 902168 - DNA, 25 bp, Mus musculus
cccagtcctgttcagcaccatcagc

SEQ ID NO: 902169 - DNA, 25 bp, Mus musculus
cccagtgacacacgttcagcggtgg

SEQ ID NO: 902170 - DNA, 25 bp, Mus musculus
cccagtgacacaggttcagcggtgg

SEQ ID NO: 902171 - DNA, 25 bp, Mus musculus
cccagtgaccagcctggcagcgagc

SEQ ID NO: 902172 - DNA, 25 bp, Mus musculus
cccagtgaccaggctggcagcgagc

SEQ ID NO: 902173 - DNA, 25 bp, Mus musculus
cccagtgagtcacatttccccccag

SEQ ID NO: 902174 - DNA, 25 bp, Mus musculus
cccagtgagtcagatttccccccag

SEQ ID NO: 902175 - DNA, 25 bp, Mus musculus
cccagtgatttcacttttcagaaca

SEQ ID NO: 902176 - DNA, 25 bp, Mus musculus
cccagtgatttctcttttcagaaca

SEQ ID NO: 902177 - DNA, 25 bp, Mus musculus
cccagtgcagattaaggttgaggaa

SEQ ID NO: 902178 - DNA, 25 bp, Mus musculus
cccagtgcagccctgccactggtga

SEQ ID NO: 902179 - DNA, 25 bp, Mus musculus
cccagtgcaggcctgccactggtga

SEQ ID NO: 902180 - DNA, 25 bp, Mus musculus
cccagtgcagtttaaggttgaggaa

SEQ ID NO: 902181 - DNA, 25 bp, Mus musculus
cccagtggcacacatgccctaggtc

SEQ ID NO: 902182 - DNA, 25 bp, Mus musculus
cccagtggcacacgtctccaccgct

SEQ ID NO: 902183 - DNA, 25 bp, Mus musculus
cccagtggcacagatgccctaggtc

SEQ ID NO: 902184 - DNA, 25 bp, Mus musculus
cccagtggcacaggtctccaccgct

SEQ ID NO: 902185 - DNA, 25 bp, Mus musculus
cccagtgggcagagaatcccagtgg

SEQ ID NO: 902186 - DNA, 25 bp, Mus musculus
cccagtgggcagagtatcccagtgg

SEQ ID NO: 902187 - DNA, 25 bp, Mus musculus
cccagtgtcagtatctggtccagtg

SEQ ID NO: 902188 - DNA, 25 bp, Mus musculus
cccagtgtcagtatgtggtccagtg

SEQ ID NO: 902189 - DNA, 25 bp, Mus musculus
cccagttcctgaccggcatcccaga

SEQ ID NO: 902190 - DNA, 25 bp, Mus musculus
cccagttcctgagcggcatcccaga

SEQ ID NO: 902191 - DNA, 25 bp, Mus musculus
cccagttctcagagccccgtattcg

SEQ ID NO: 902192 - DNA, 25 bp, Mus musculus
cccagttctcagtgccccgtattcg

SEQ ID NO: 902193 - DNA, 25 bp, Mus musculus
cccagttgacagctctgttctggaa

SEQ ID NO: 902194 - DNA, 25 bp, Mus musculus
cccagttgacaggtctgttctggaa

SEQ ID NO: 902195 - DNA, 25 bp, Mus musculus
cccagttgccaacgatgtggatttg

SEQ ID NO: 902196 - DNA, 25 bp, Mus musculus
cccagttgccaaggatgtggatttg

SEQ ID NO: 902197 - DNA, 25 bp, Mus musculus
cccagttgcgcgcctaacctgcctc

SEQ ID NO: 902198 - DNA, 25 bp, Mus musculus
cccagttgcgggcctaacctgcctc

SEQ ID NO: 902199 - DNA, 25 bp, Mus musculus
cccagtttagccagtcatggccaac

SEQ ID NO: 902200 - DNA, 25 bp, Mus musculus
cccagtttaggcagtcatggccaac

SEQ ID NO: 902201 - DNA, 25 bp, Mus musculus
cccatacaagcacctcctggaccca

SEQ ID NO: 902202 - DNA, 25 bp, Mus musculus
cccatacaaggacctcctggaccca

SEQ ID NO: 902203 - DNA, 25 bp, Mus musculus
cccataccagatgtgagatccaggg

SEQ ID NO: 902204 - DNA, 25 bp, Mus musculus
cccataccagttgtgagatccaggg

SEQ ID NO: 902205 - DNA, 25 bp, Mus musculus
cccataggacagaacaagagaactc

SEQ ID NO: 902206 - DNA, 25 bp, Mus musculus
cccataggacagaagaagagaactc

SEQ ID NO: 902207 - DNA, 25 bp, Mus musculus
cccatatacatggtcgtacaccatg

SEQ ID NO: 902208 - DNA, 25 bp, Mus musculus
cccatatacatggtggtacaccatg

SEQ ID NO: 902209 - DNA, 25 bp, Mus musculus
cccatcaagctacccagactccggg

SEQ ID NO: 902210 - DNA, 25 bp, Mus musculus
cccatcaagctaccgagactccggg

SEQ ID NO: 902211 - DNA, 25 bp, Mus musculus
cccatcaagtagatcgtgttcagtt

SEQ ID NO: 902212 - DNA, 25 bp, Mus musculus
cccatcaagtagatggtgttcagtt

SEQ ID NO: 902213 - DNA, 25 bp, Mus musculus
cccatcccagcacgtcatgacccca

SEQ ID NO: 902214 - DNA, 25 bp, Mus musculus
cccatcccagcaggtcatgacccca

SEQ ID NO: 902215 - DNA, 25 bp, Mus musculus
cccatcgcctatgactttaacccag

SEQ ID NO: 902216 - DNA, 25 bp, Mus musculus
cccatcgcctatgagtttaacccag

SEQ ID NO: 902217 - DNA, 25 bp, Mus musculus
cccatcgtactccggctccttgtgt

SEQ ID NO: 902218 - DNA, 25 bp, Mus musculus
cccatcgtactcgggctccttgtgt

SEQ ID NO: 902219 - DNA, 25 bp, Mus musculus
cccatctaaactagccttgaacaca

SEQ ID NO: 902220 - DNA, 25 bp, Mus musculus
cccatctaaacttgccttgaacaca

SEQ ID NO: 902221 - DNA, 25 bp, Mus musculus
cccatctcagagatgggctttgctg

SEQ ID NO: 902222 - DNA, 25 bp, Mus musculus
cccatctcagagcctggtgtttgct

SEQ ID NO: 902223 - DNA, 25 bp, Mus musculus
cccatctcagaggctggtgtttgct

SEQ ID NO: 902224 - DNA, 25 bp, Mus musculus
cccatctcagagttgggctttgctg

SEQ ID NO: 902225 - DNA, 25 bp, Mus musculus
cccatctcccagactgataatggtc

SEQ ID NO: 902226 - DNA, 25 bp, Mus musculus
cccatctcccagtctgataatggtc

SEQ ID NO: 902227 - DNA, 25 bp, Mus musculus
cccatctggaagccccttctctggt

SEQ ID NO: 902228 - DNA, 25 bp, Mus musculus
cccatctggaaggcccttctctggt

SEQ ID NO: 902229 - DNA, 25 bp, Mus musculus
cccatcttgaaacctcacttccgga

SEQ ID NO: 902230 - DNA, 25 bp, Mus musculus
cccatcttgaaagctcacttccgga

SEQ ID NO: 902231 - DNA, 25 bp, Mus musculus
cccatgaagaaacgagccagttatc

SEQ ID NO: 902232 - DNA, 25 bp, Mus musculus
cccatgaagaaaggagccagttatc

SEQ ID NO: 902233 - DNA, 25 bp, Mus musculus
cccatgacagcatggctggctttga

SEQ ID NO: 902234 - DNA, 25 bp, Mus musculus
cccatgacaggatggctggctttga

SEQ ID NO: 902235 - DNA, 25 bp, Mus musculus
cccatgaccatacacatcatgtcat

SEQ ID NO: 902236 - DNA, 25 bp, Mus musculus
cccatgaccatacagatcatgtcat

SEQ ID NO: 902237 - DNA, 25 bp, Mus musculus
cccatgagacagcttttttaggacc

SEQ ID NO: 902238 - DNA, 25 bp, Mus musculus
cccatgagactgcttttttaggacc

SEQ ID NO: 902239 - DNA, 25 bp, Mus musculus
cccatgagcgaggacacgccaatgg

SEQ ID NO: 902240 - DNA, 25 bp, Mus musculus
cccatgagcgaggacagacgccaat

SEQ ID NO: 902241 - DNA, 25 bp, Mus musculus
cccatgagcgaggagacgccaatgg

SEQ ID NO: 902242 - DNA, 25 bp, Mus musculus
cccatgagcgaggagagacgccaat

SEQ ID NO: 902243 - DNA, 25 bp, Mus musculus
cccatgatgcttgacgccctcgatg

SEQ ID NO: 902244 - DNA, 25 bp, Mus musculus
cccatgatgcttgaggccctcgatg

SEQ ID NO: 902245 - DNA, 25 bp, Mus musculus
cccatgattacgctggatgggaaga

SEQ ID NO: 902246 - DNA, 25 bp, Mus musculus
cccatgattacggtggatgggaaga

SEQ ID NO: 902247 - DNA, 25 bp, Mus musculus
cccatgcaccaaatcactcgaccga

SEQ ID NO: 902248 - DNA, 25 bp, Mus musculus
cccatgcaccaaatgactcgaccga

SEQ ID NO: 902249 - DNA, 25 bp, Mus musculus
cccatgctgccaaacgataccatac

SEQ ID NO: 902250 - DNA, 25 bp, Mus musculus
cccatgctgccaaaggataccatac

SEQ ID NO: 902251 - DNA, 25 bp, Mus musculus
cccatggaaaagacgaagagagtat

SEQ ID NO: 902252 - DNA, 25 bp, Mus musculus
cccatggaaatgacgaagagagtat

SEQ ID NO: 902253 - DNA, 25 bp, Mus musculus
cccatggaagacaaagtctggagct

SEQ ID NO: 902254 - DNA, 25 bp, Mus musculus
cccatggaagagaccgtgcgggcca

SEQ ID NO: 902255 - DNA, 25 bp, Mus musculus
cccatggaagcaccccccattggac

SEQ ID NO: 902256 - DNA, 25 bp, Mus musculus
cccatggaaggaccccccattggac

SEQ ID NO: 902257 - DNA, 25 bp, Mus musculus
cccatggaagtcaaagtctggagct

SEQ ID NO: 902258 - DNA, 25 bp, Mus musculus
cccatggaagtgaccgtgcgggcca

SEQ ID NO: 902259 - DNA, 25 bp, Mus musculus
cccatggacccacaacatgtagagc

SEQ ID NO: 902260 - DNA, 25 bp, Mus musculus
cccatggacccagaacatgtagagc

SEQ ID NO: 902261 - DNA, 25 bp, Mus musculus
cccatggagatgctggaagggcatc

SEQ ID NO: 902262 - DNA, 25 bp, Mus musculus
cccatggagatggtggaagggcatc

SEQ ID NO: 902263 - DNA, 25 bp, Mus musculus
cccatggatggacggatcgcttaca

SEQ ID NO: 902264 - DNA, 25 bp, Mus musculus
cccatggatggagggatcgcttaca

SEQ ID NO: 902265 - DNA, 25 bp, Mus musculus
cccatggccactgtcgcctcctgag

SEQ ID NO: 902266 - DNA, 25 bp, Mus musculus
cccatggccactgtcgtctctgtga

SEQ ID NO: 902267 - DNA, 25 bp, Mus musculus
cccatggccactgtggcctcctgag

SEQ ID NO: 902268 - DNA, 25 bp, Mus musculus
cccatggccactgtggtctctgtga

SEQ ID NO: 902269 - DNA, 25 bp, Mus musculus
cccatggccagccgttggatgaaga

SEQ ID NO: 902270 - DNA, 25 bp, Mus musculus
cccatggccagcggttggatgaaga

SEQ ID NO: 902271 - DNA, 25 bp, Mus musculus
cccatggctcagactccgtggtttc

SEQ ID NO: 902272 - DNA, 25 bp, Mus musculus
cccatggctcagtctccgtggtttc

SEQ ID NO: 902273 - DNA, 25 bp, Mus musculus
cccatggctgacacccttccaggtc

SEQ ID NO: 902274 - DNA, 25 bp, Mus musculus
cccatggctgacaccgtccgaggag

SEQ ID NO: 902275 - DNA, 25 bp, Mus musculus
cccatggctgacacgcttccaggtc

SEQ ID NO: 902276 - DNA, 25 bp, Mus musculus
cccatggctgacacggtccgaggag

SEQ ID NO: 902277 - DNA, 25 bp, Mus musculus
cccatgggcccccgacactgtatgc

SEQ ID NO: 902278 - DNA, 25 bp, Mus musculus
cccatgggccccggacactgtatgc

SEQ ID NO: 902279 - DNA, 25 bp, Mus musculus
cccatggggctacaccatcaaccac

SEQ ID NO: 902280 - DNA, 25 bp, Mus musculus
cccatggggctacagcatcaaccac

SEQ ID NO: 902281 - DNA, 25 bp, Mus musculus
cccatgggtttcaactcttgtgatg

SEQ ID NO: 902282 - DNA, 25 bp, Mus musculus
cccatgggtttcaagtcttgtgatg

SEQ ID NO: 902283 - DNA, 25 bp, Mus musculus
cccatgtaccaactgtccccaagga

SEQ ID NO: 902284 - DNA, 25 bp, Mus musculus
cccatgtaccaagtgtccccaagga

SEQ ID NO: 902285 - DNA, 25 bp, Mus musculus
cccatgtactaacacctgttcccgt

SEQ ID NO: 902286 - DNA, 25 bp, Mus musculus
cccatgtactaacggatacagtgga

SEQ ID NO: 902287 - DNA, 25 bp, Mus musculus
cccatgtactaacgtatacagtttt

SEQ ID NO: 902288 - DNA, 25 bp, Mus musculus
cccatgtactaactttccccctgct

SEQ ID NO: 902289 - DNA, 25 bp, Mus musculus
cccatgtactaagacctgttcccgt

SEQ ID NO: 902290 - DNA, 25 bp, Mus musculus
cccatgtactaagggatacagtgga

SEQ ID NO: 902291 - DNA, 25 bp, Mus musculus
cccatgtactaaggtatacagtttt

SEQ ID NO: 902292 - DNA, 25 bp, Mus musculus
cccatgtactaagtttccccctgct

SEQ ID NO: 902293 - DNA, 25 bp, Mus musculus
cccatgtgggaacaaccctggcttc

SEQ ID NO: 902294 - DNA, 25 bp, Mus musculus
cccatgtgggaagaaccctggcttc

SEQ ID NO: 902295 - DNA, 25 bp, Mus musculus
cccatgttataccaccactgagctt

SEQ ID NO: 902296 - DNA, 25 bp, Mus musculus
cccatgttataccagcactgagctt

SEQ ID NO: 902297 - DNA, 25 bp, Mus musculus
cccattacatatcttgtgaagttat

SEQ ID NO: 902298 - DNA, 25 bp, Mus musculus
cccattacatttcttgtgaagttat

SEQ ID NO: 902299 - DNA, 25 bp, Mus musculus
cccattacctaaatcactgataatg

SEQ ID NO: 902300 - DNA, 25 bp, Mus musculus
cccattacctaaatcgacaggatcc

SEQ ID NO: 902301 - DNA, 25 bp, Mus musculus
cccattacctaaatgactgataatg

SEQ ID NO: 902302 - DNA, 25 bp, Mus musculus
cccattacctaaatggacaggatcc

SEQ ID NO: 902303 - DNA, 25 bp, Mus musculus
cccattagtgctctgggtggcacaa

SEQ ID NO: 902304 - DNA, 25 bp, Mus musculus
cccattagtggtctgggtggcacaa

SEQ ID NO: 902305 - DNA, 25 bp, Mus musculus
cccattccagctgtcgcagagatga

SEQ ID NO: 902306 - DNA, 25 bp, Mus musculus
cccattccaggtgtcgcagagatga

SEQ ID NO: 902307 - DNA, 25 bp, Mus musculus
cccattccggaacgacctcatcagc

SEQ ID NO: 902308 - DNA, 25 bp, Mus musculus
cccattccggaaggacctcatcagc

SEQ ID NO: 902309 - DNA, 25 bp, Mus musculus
cccattcttaagattcctttgagag

SEQ ID NO: 902310 - DNA, 25 bp, Mus musculus
cccattcttaagtttcctttgagag

SEQ ID NO: 902311 - DNA, 25 bp, Mus musculus
cccattgagacattcaggaaaaaag

SEQ ID NO: 902312 - DNA, 25 bp, Mus musculus
cccattgagacattgaggaaaaaag

SEQ ID NO: 902313 - DNA, 25 bp, Mus musculus
cccattgcagcgatgcctgctgtct

SEQ ID NO: 902314 - DNA, 25 bp, Mus musculus
cccattgcagggatgcctgctgtct

SEQ ID NO: 902315 - DNA, 25 bp, Mus musculus
cccatttatgcactcgtgaatcttg

SEQ ID NO: 902316 - DNA, 25 bp, Mus musculus
cccatttatgcactggtgaatcttg

SEQ ID NO: 902317 - DNA, 25 bp, Mus musculus
cccatttcagctgctggtggcaaca

SEQ ID NO: 902318 - DNA, 25 bp, Mus musculus
cccatttcaggtgctggtggcaaca

SEQ ID NO: 902319 - DNA, 25 bp, Mus musculus
cccatttccctgccaggttcaccgg

SEQ ID NO: 902320 - DNA, 25 bp, Mus musculus
cccatttccctggcaggttcaccgg

SEQ ID NO: 902321 - DNA, 25 bp, Mus musculus
cccatttccgagcgcagatttactg

SEQ ID NO: 902322 - DNA, 25 bp, Mus musculus
cccatttccgagggcagatttactg

SEQ ID NO: 902323 - DNA, 25 bp, Mus musculus
cccatttcggatcttcctgccttct

SEQ ID NO: 902324 - DNA, 25 bp, Mus musculus
cccatttcggatgttcctgccttct

SEQ ID NO: 902325 - DNA, 25 bp, Mus musculus
cccatttgcgaacacatcgacgagt

SEQ ID NO: 902326 - DNA, 25 bp, Mus musculus
cccatttgcgaagacatcgacgagt

SEQ ID NO: 902327 - DNA, 25 bp, Mus musculus
cccattttacagaactgtatgaggc

SEQ ID NO: 902328 - DNA, 25 bp, Mus musculus
cccattttacagtactgtatgaggc

SEQ ID NO: 902329 - DNA, 25 bp, Mus musculus
cccattttctctatgagtattggag

SEQ ID NO: 902330 - DNA, 25 bp, Mus musculus
cccattttctctttgagtattggag

SEQ ID NO: 902331 - DNA, 25 bp, Mus musculus
ccccaaaagccaaacatgtgtgcca

SEQ ID NO: 902332 - DNA, 25 bp, Mus musculus
ccccaaaagccaaagatgtgtgcca

SEQ ID NO: 902333 - DNA, 25 bp, Mus musculus
ccccaaaatgagagaaatgtgtgag

SEQ ID NO: 902334 - DNA, 25 bp, Mus musculus
ccccaaaatgagtgaaatgtgtgag

SEQ ID NO: 902335 - DNA, 25 bp, Mus musculus
ccccaaagagccaagctctcaacat

SEQ ID NO: 902336 - DNA, 25 bp, Mus musculus
ccccaaagaggcaagctctcaacat

SEQ ID NO: 902337 - DNA, 25 bp, Mus musculus
ccccaaatcgagagccaacctcact

SEQ ID NO: 902338 - DNA, 25 bp, Mus musculus
ccccaaatcgagtgccaacctcact

SEQ ID NO: 902339 - DNA, 25 bp, Mus musculus
ccccaaatgctgcggagcccaccac

SEQ ID NO: 902340 - DNA, 25 bp, Mus musculus
ccccaaatgctggggagcccaccac

SEQ ID NO: 902341 - DNA, 25 bp, Mus musculus
ccccaaattggaagatatccatccg

SEQ ID NO: 902342 - DNA, 25 bp, Mus musculus
ccccaaattggatgatatccatccg

SEQ ID NO: 902343 - DNA, 25 bp, Mus musculus
ccccaacactagcgacaataaatat

SEQ ID NO: 902344 - DNA, 25 bp, Mus musculus
ccccaacactagggacaataaatat

SEQ ID NO: 902345 - DNA, 25 bp, Mus musculus
ccccaaccagctctcgccagtgaag

SEQ ID NO: 902346 - DNA, 25 bp, Mus musculus
ccccaaccaggtctcgccagtgaag

SEQ ID NO: 902347 - DNA, 25 bp, Mus musculus
ccccaacctcagctttctgacctgt

SEQ ID NO: 902348 - DNA, 25 bp, Mus musculus
ccccaacctcaggtttctgacctgt

SEQ ID NO: 902349 - DNA, 25 bp, Mus musculus
ccccaactacacgacacctgtgttc

SEQ ID NO: 902350 - DNA, 25 bp, Mus musculus
ccccaactacacgagacctgtgttc

SEQ ID NO: 902351 - DNA, 25 bp, Mus musculus
ccccaagaaaggaatggcttcactt

SEQ ID NO: 902352 - DNA, 25 bp, Mus musculus
ccccaagaaaggtatggcttcactt

SEQ ID NO: 902353 - DNA, 25 bp, Mus musculus
ccccaagaaccacacccgagtcaga

SEQ ID NO: 902354 - DNA, 25 bp, Mus musculus
ccccaagaaccagacccgagtcaga

SEQ ID NO: 902355 - DNA, 25 bp, Mus musculus
ccccaagacacacacgtgttctggg

SEQ ID NO: 902356 - DNA, 25 bp, Mus musculus
ccccaagacacagacgtgttctggg

SEQ ID NO: 902357 - DNA, 25 bp, Mus musculus
ccccaagagaagggagtggatcaca

SEQ ID NO: 902358 - DNA, 25 bp, Mus musculus
ccccaagagacacaacaatcctctc

SEQ ID NO: 902359 - DNA, 25 bp, Mus musculus
ccccaagagagacaacaatcctctc

SEQ ID NO: 902360 - DNA, 25 bp, Mus musculus
ccccaagagatgggagtggatcaca

SEQ ID NO: 902361 - DNA, 25 bp, Mus musculus
ccccaagcacaacgtgagactgtgg

SEQ ID NO: 902362 - DNA, 25 bp, Mus musculus
ccccaagcacaaggtgagactgtgg

SEQ ID NO: 902363 - DNA, 25 bp, Mus musculus
ccccaagtaatgcaagtgtggcacc

SEQ ID NO: 902364 - DNA, 25 bp, Mus musculus
ccccaagtaatgcatgtgtggcacc

SEQ ID NO: 902365 - DNA, 25 bp, Mus musculus
ccccaagtagttcaccctgggaagc

SEQ ID NO: 902366 - DNA, 25 bp, Mus musculus
ccccaagtagttcagcctgggaagc

SEQ ID NO: 902367 - DNA, 25 bp, Mus musculus
ccccaagtcaaacgtggcctcaggg

SEQ ID NO: 902368 - DNA, 25 bp, Mus musculus
ccccaagtcaaaggtggcctcaggg

SEQ ID NO: 902369 - DNA, 25 bp, Mus musculus
ccccaagtcccccacacatatccca

SEQ ID NO: 902370 - DNA, 25 bp, Mus musculus
ccccaagtcccccagacatatccca

SEQ ID NO: 902371 - DNA, 25 bp, Mus musculus
ccccaagtgctgcacgaggctactt

SEQ ID NO: 902372 - DNA, 25 bp, Mus musculus
ccccaagtgctgcaggaggctactt

SEQ ID NO: 902373 - DNA, 25 bp, Mus musculus
ccccaagtggctcaccacctggacc

SEQ ID NO: 902374 - DNA, 25 bp, Mus musculus
ccccaagtggctgaccacctggacc

SEQ ID NO: 902375 - DNA, 25 bp, Mus musculus
ccccaatgaccacaagtatacgccc

SEQ ID NO: 902376 - DNA, 25 bp, Mus musculus
ccccaatgaccacatgtatacgccc

SEQ ID NO: 902377 - DNA, 25 bp, Mus musculus
ccccaatgtatgcgcctgttcacct

SEQ ID NO: 902378 - DNA, 25 bp, Mus musculus
ccccaatgtatgggcctgttcacct

SEQ ID NO: 902379 - DNA, 25 bp, Mus musculus
ccccacaatgattccgcagacgggc

SEQ ID NO: 902380 - DNA, 25 bp, Mus musculus
ccccacaatgattcggcagacgggc

SEQ ID NO: 902381 - DNA, 25 bp, Mus musculus
ccccacagccaacacgtcagaccaa

SEQ ID NO: 902382 - DNA, 25 bp, Mus musculus
ccccacagccaacaggtcagaccaa

SEQ ID NO: 902383 - DNA, 25 bp, Mus musculus
ccccaccatcatcacgcaaacaggc

SEQ ID NO: 902384 - DNA, 25 bp, Mus musculus
ccccaccatcatcaggcaaacaggc

SEQ ID NO: 902385 - DNA, 25 bp, Mus musculus
ccccaccatgaaattgtggccctaa

SEQ ID NO: 902386 - DNA, 25 bp, Mus musculus
ccccaccatgaatttgtggccctaa

SEQ ID NO: 902387 - DNA, 25 bp, Mus musculus
ccccacccagattctgtgttgtggg

SEQ ID NO: 902388 - DNA, 25 bp, Mus musculus
ccccacccagctggaggatgcggtg

SEQ ID NO: 902389 - DNA, 25 bp, Mus musculus
ccccacccaggtggaggatgcggtg

SEQ ID NO: 902390 - DNA, 25 bp, Mus musculus
ccccacccagtttctgtgttgtggg

SEQ ID NO: 902391 - DNA, 25 bp, Mus musculus
ccccaccccccaccaagagccagag

SEQ ID NO: 902392 - DNA, 25 bp, Mus musculus
ccccaccccccacgacatgacagat

SEQ ID NO: 902393 - DNA, 25 bp, Mus musculus
ccccaccccccagcaagagccagag

SEQ ID NO: 902394 - DNA, 25 bp, Mus musculus
ccccaccccccaggacatgacagat

SEQ ID NO: 902395 - DNA, 25 bp, Mus musculus
ccccaccccgctcgcaaatctcatg

SEQ ID NO: 902396 - DNA, 25 bp, Mus musculus
ccccaccccgctggcaaatctcatg

SEQ ID NO: 902397 - DNA, 25 bp, Mus musculus
ccccacctccagccattatggctcc

SEQ ID NO: 902398 - DNA, 25 bp, Mus musculus
ccccacctccagcgtgaagttgatt

SEQ ID NO: 902399 - DNA, 25 bp, Mus musculus
ccccacctccaggcattatggctcc

SEQ ID NO: 902400 - DNA, 25 bp, Mus musculus
ccccacctccagggtgaagttgatt

SEQ ID NO: 902401 - DNA, 25 bp, Mus musculus
ccccacgagtgcagcgacaccccag

SEQ ID NO: 902402 - DNA, 25 bp, Mus musculus
ccccacgagtgcagggacaccccag

SEQ ID NO: 902403 - DNA, 25 bp, Mus musculus
ccccacgctacactcgagagtacag

SEQ ID NO: 902404 - DNA, 25 bp, Mus musculus
ccccacgctacagtcgagagtacag

SEQ ID NO: 902405 - DNA, 25 bp, Mus musculus
ccccactattggcgcatctttcatg

SEQ ID NO: 902406 - DNA, 25 bp, Mus musculus
ccccactattggcttaagtttgctg

SEQ ID NO: 902407 - DNA, 25 bp, Mus musculus
ccccactattggggcatctttcatg

SEQ ID NO: 902408 - DNA, 25 bp, Mus musculus
ccccactattgggttaagtttgctg

SEQ ID NO: 902409 - DNA, 25 bp, Mus musculus
ccccactcattgccctgggtgtgat

SEQ ID NO: 902410 - DNA, 25 bp, Mus musculus
ccccactcattggcctgggtgtgat

SEQ ID NO: 902411 - DNA, 25 bp, Mus musculus
ccccactgagatgatcccccagcac

SEQ ID NO: 902412 - DNA, 25 bp, Mus musculus
ccccactgagttgatcccccagcac

SEQ ID NO: 902413 - DNA, 25 bp, Mus musculus
ccccactggtggcggccatgtagga

SEQ ID NO: 902414 - DNA, 25 bp, Mus musculus
ccccactggtgggggccatgtagga

SEQ ID NO: 902415 - DNA, 25 bp, Mus musculus
ccccagaaaactcgtaccactgcct

SEQ ID NO: 902416 - DNA, 25 bp, Mus musculus
ccccagaaaactggtaccactgcct

SEQ ID NO: 902417 - DNA, 25 bp, Mus musculus
ccccagaacaagagctgaggctgca

SEQ ID NO: 902418 - DNA, 25 bp, Mus musculus
ccccagaacaagtgctgaggctgca

SEQ ID NO: 902419 - DNA, 25 bp, Mus musculus
ccccagaagtaacattggcctgttc

SEQ ID NO: 902420 - DNA, 25 bp, Mus musculus
ccccagaagtaagattggcctgttc

SEQ ID NO: 902421 - DNA, 25 bp, Mus musculus
ccccagaatgctgtcggcacactgg

SEQ ID NO: 902422 - DNA, 25 bp, Mus musculus
ccccagaatgctgtgggcacactgg

SEQ ID NO: 902423 - DNA, 25 bp, Mus musculus
ccccagagacagcgcactgctggct

SEQ ID NO: 902424 - DNA, 25 bp, Mus musculus
ccccagagacagggcactgctggct

SEQ ID NO: 902425 - DNA, 25 bp, Mus musculus
ccccagagacatgcatgtctgtcac

SEQ ID NO: 902426 - DNA, 25 bp, Mus musculus
ccccagagacatgcttgtctgtcac

SEQ ID NO: 902427 - DNA, 25 bp, Mus musculus
ccccagagagaaccttcttccactc

SEQ ID NO: 902428 - DNA, 25 bp, Mus musculus
ccccagagagatgaggaaagtgagg

SEQ ID NO: 902429 - DNA, 25 bp, Mus musculus
ccccagagagcatttctggctgctt

SEQ ID NO: 902430 - DNA, 25 bp, Mus musculus
ccccagagagctctcatggtaccaa

SEQ ID NO: 902431 - DNA, 25 bp, Mus musculus
ccccagagaggatttctggctgctt

SEQ ID NO: 902432 - DNA, 25 bp, Mus musculus
ccccagagaggtctcatggtaccaa

SEQ ID NO: 902433 - DNA, 25 bp, Mus musculus
ccccagagagtaccttcttccactc

SEQ ID NO: 902434 - DNA, 25 bp, Mus musculus
ccccagagagttgaggaaagtgagg

SEQ ID NO: 902435 - DNA, 25 bp, Mus musculus
ccccagagataacctgacgctgggc

SEQ ID NO: 902436 - DNA, 25 bp, Mus musculus
ccccagagataagctgacgctgggc

SEQ ID NO: 902437 - DNA, 25 bp, Mus musculus
ccccagagccagcagcaatgctact

SEQ ID NO: 902438 - DNA, 25 bp, Mus musculus
ccccagagccaggagcaatgctact

SEQ ID NO: 902439 - DNA, 25 bp, Mus musculus
ccccagatagctcacctctgggact

SEQ ID NO: 902440 - DNA, 25 bp, Mus musculus
ccccagataggtcacctctgggact

SEQ ID NO: 902441 - DNA, 25 bp, Mus musculus
ccccagcagaacattccgcttgaac

SEQ ID NO: 902442 - DNA, 25 bp, Mus musculus
ccccagcagaactttccgcttgaac

SEQ ID NO: 902443 - DNA, 25 bp, Mus musculus
ccccagcaggcacctgccagaccct

SEQ ID NO: 902444 - DNA, 25 bp, Mus musculus
ccccagcaggcagctgccagaccct

SEQ ID NO: 902445 - DNA, 25 bp, Mus musculus
ccccagccagcatgatgtctacaga

SEQ ID NO: 902446 - DNA, 25 bp, Mus musculus
ccccagccaggatgatgtctacaga

SEQ ID NO: 902447 - DNA, 25 bp, Mus musculus
ccccagccccagaccttcaggctcc

SEQ ID NO: 902448 - DNA, 25 bp, Mus musculus
ccccagccccagcagcctggtagat

SEQ ID NO: 902449 - DNA, 25 bp, Mus musculus
ccccagccccaggagcctggtagat

SEQ ID NO: 902450 - DNA, 25 bp, Mus musculus
ccccagccccagtccttcaggctcc

SEQ ID NO: 902451 - DNA, 25 bp, Mus musculus
ccccagccttgccacttccaccttg

SEQ ID NO: 902452 - DNA, 25 bp, Mus musculus
ccccagccttgccagttccaccttg

SEQ ID NO: 902453 - DNA, 25 bp, Mus musculus
ccccagcgagacagaggcttacatc

SEQ ID NO: 902454 - DNA, 25 bp, Mus musculus
ccccagcgagaccttcggggagcca

SEQ ID NO: 902455 - DNA, 25 bp, Mus musculus
ccccagcgagagctagctgagccac

SEQ ID NO: 902456 - DNA, 25 bp, Mus musculus
ccccagcgagtcagaggcttacatc

SEQ ID NO: 902457 - DNA, 25 bp, Mus musculus
ccccagcgagtccttcggggagcca

SEQ ID NO: 902458 - DNA, 25 bp, Mus musculus
ccccagcgagtgctagctgagccac

SEQ ID NO: 902459 - DNA, 25 bp, Mus musculus
ccccagcgtgcgcatgatgccaggc

SEQ ID NO: 902460 - DNA, 25 bp, Mus musculus
ccccagcgtgcggatgatgccaggc

SEQ ID NO: 902461 - DNA, 25 bp, Mus musculus
ccccagctacctcaagatctttgtc

SEQ ID NO: 902462 - DNA, 25 bp, Mus musculus
ccccagctacctcatgatctttgtc

SEQ ID NO: 902463 - DNA, 25 bp, Mus musculus
ccccagctcaccaaatgaccctgtt

SEQ ID NO: 902464 - DNA, 25 bp, Mus musculus
ccccagctcagcaaatgaccctgtt

SEQ ID NO: 902465 - DNA, 25 bp, Mus musculus
ccccagctcgccaacgagtcccaaa

SEQ ID NO: 902466 - DNA, 25 bp, Mus musculus
ccccagctcggcaacgagtcccaaa

SEQ ID NO: 902467 - DNA, 25 bp, Mus musculus
ccccagctgtggcaggtcctcgatt

SEQ ID NO: 902468 - DNA, 25 bp, Mus musculus
ccccagctgtggcgcagttttggca

SEQ ID NO: 902469 - DNA, 25 bp, Mus musculus
ccccagctgtgggaggtcctcgatt

SEQ ID NO: 902470 - DNA, 25 bp, Mus musculus
ccccagctgtggggcagttttggca

SEQ ID NO: 902471 - DNA, 25 bp, Mus musculus
ccccaggaaaagcgcgcatcttctg

SEQ ID NO: 902472 - DNA, 25 bp, Mus musculus
ccccaggaaaagcgggcatcttctg

SEQ ID NO: 902473 - DNA, 25 bp, Mus musculus
ccccaggaacttcacgatcatctgg

SEQ ID NO: 902474 - DNA, 25 bp, Mus musculus
ccccaggaacttcacttggcgagtc

SEQ ID NO: 902475 - DNA, 25 bp, Mus musculus
ccccaggaacttcaggatcatctgg

SEQ ID NO: 902476 - DNA, 25 bp, Mus musculus
ccccaggaacttcagttggcgagtc

SEQ ID NO: 902477 - DNA, 25 bp, Mus musculus
ccccaggaagagcacatgacagatg

SEQ ID NO: 902478 - DNA, 25 bp, Mus musculus
ccccaggaagagcctccacctctcc

SEQ ID NO: 902479 - DNA, 25 bp, Mus musculus
ccccaggaagaggacatgacagatg

SEQ ID NO: 902480 - DNA, 25 bp, Mus musculus
ccccaggaagaggctccacctctcc

SEQ ID NO: 902481 - DNA, 25 bp, Mus musculus
ccccaggacccgcgatcagtcaaga

SEQ ID NO: 902482 - DNA, 25 bp, Mus musculus
ccccaggacccgggatcagtcaaga

SEQ ID NO: 902483 - DNA, 25 bp, Mus musculus
ccccaggactcacgtactgcggtgc

SEQ ID NO: 902484 - DNA, 25 bp, Mus musculus
ccccaggactcaggtactgcggtgc

SEQ ID NO: 902485 - DNA, 25 bp, Mus musculus
ccccaggagcctcggactctgtgac

SEQ ID NO: 902486 - DNA, 25 bp, Mus musculus
ccccaggagcctgggactctgtgac

SEQ ID NO: 902487 - DNA, 25 bp, Mus musculus
ccccaggaggaggacccagtgaaga

SEQ ID NO: 902488 - DNA, 25 bp, Mus musculus
ccccaggaggaggagccagtgaaga

SEQ ID NO: 902489 - DNA, 25 bp, Mus musculus
ccccaggcaatgctggcccagtgat

SEQ ID NO: 902490 - DNA, 25 bp, Mus musculus
ccccaggcaatggtggcccagtgat

SEQ ID NO: 902491 - DNA, 25 bp, Mus musculus
ccccaggcccagccgtgctggtcac

SEQ ID NO: 902492 - DNA, 25 bp, Mus musculus
ccccaggcccaggcgtgctggtcac

SEQ ID NO: 902493 - DNA, 25 bp, Mus musculus
ccccaggccgtgaatgaccagtgcc

SEQ ID NO: 902494 - DNA, 25 bp, Mus musculus
ccccaggccgtgcactaaagaccag

SEQ ID NO: 902495 - DNA, 25 bp, Mus musculus
ccccaggccgtggactaaagaccag

SEQ ID NO: 902496 - DNA, 25 bp, Mus musculus
ccccaggccgtgtatgaccagtgcc

SEQ ID NO: 902497 - DNA, 25 bp, Mus musculus
ccccaggctggcagcaaccacacag

SEQ ID NO: 902498 - DNA, 25 bp, Mus musculus
ccccaggctggcagctgctcaccga

SEQ ID NO: 902499 - DNA, 25 bp, Mus musculus
ccccaggctggcaggaaccacacag

SEQ ID NO: 902500 - DNA, 25 bp, Mus musculus
ccccaggctggcaggtgctcaccga

SEQ ID NO: 902501 - DNA, 25 bp, Mus musculus
ccccagggaacaggaacagctcagc

SEQ ID NO: 902502 - DNA, 25 bp, Mus musculus
ccccagggaagaggaacagctcagc

SEQ ID NO: 902503 - DNA, 25 bp, Mus musculus
ccccagggcaagcattctgtaccca

SEQ ID NO: 902504 - DNA, 25 bp, Mus musculus
ccccagggcaagctggctgcctttg

SEQ ID NO: 902505 - DNA, 25 bp, Mus musculus
ccccagggcaaggattctgtaccca

SEQ ID NO: 902506 - DNA, 25 bp, Mus musculus
ccccagggcaaggtggctgcctttg

SEQ ID NO: 902507 - DNA, 25 bp, Mus musculus
ccccagggtggtcacgaaggtctat

SEQ ID NO: 902508 - DNA, 25 bp, Mus musculus
ccccagggtggtcaggaaggtctat

SEQ ID NO: 902509 - DNA, 25 bp, Mus musculus
ccccaggtgctacacctcctaggga

SEQ ID NO: 902510 - DNA, 25 bp, Mus musculus
ccccaggtgctacagctcctaggga

SEQ ID NO: 902511 - DNA, 25 bp, Mus musculus
ccccagtaggcacagatggcaccac

SEQ ID NO: 902512 - DNA, 25 bp, Mus musculus
ccccagtaggcagagatggcaccac

SEQ ID NO: 902513 - DNA, 25 bp, Mus musculus
ccccagtcagatctgtctcgagagc

SEQ ID NO: 902514 - DNA, 25 bp, Mus musculus
ccccagtcagcccggggctgtgccc

SEQ ID NO: 902515 - DNA, 25 bp, Mus musculus
ccccagtcaggccggggctgtgccc

SEQ ID NO: 902516 - DNA, 25 bp, Mus musculus
ccccagtcagttctgtctcgagagc

SEQ ID NO: 902517 - DNA, 25 bp, Mus musculus
ccccagtctcagatggaagagagca

SEQ ID NO: 902518 - DNA, 25 bp, Mus musculus
ccccagtctcagttggaagagagca

SEQ ID NO: 902519 - DNA, 25 bp, Mus musculus
ccccagtggaaaacacggttatctg

SEQ ID NO: 902520 - DNA, 25 bp, Mus musculus
ccccagtggaaatcacggttatctg

SEQ ID NO: 902521 - DNA, 25 bp, Mus musculus
ccccagtggccccacctgcccccag

SEQ ID NO: 902522 - DNA, 25 bp, Mus musculus
ccccagtggccccagctgcccccag

SEQ ID NO: 902523 - DNA, 25 bp, Mus musculus
ccccagttgacacctctgttctgga

SEQ ID NO: 902524 - DNA, 25 bp, Mus musculus
ccccagttgacagctctgttctgga

SEQ ID NO: 902525 - DNA, 25 bp, Mus musculus
ccccagtttgagactgtgaaagcag

SEQ ID NO: 902526 - DNA, 25 bp, Mus musculus
ccccagtttgagtctgtgaaagcag

SEQ ID NO: 902527 - DNA, 25 bp, Mus musculus
ccccatacactgaggtccaagaatt

SEQ ID NO: 902528 - DNA, 25 bp, Mus musculus
ccccatacactgtggtccaagaatt

SEQ ID NO: 902529 - DNA, 25 bp, Mus musculus
ccccatcactgtgccgcagctggag

SEQ ID NO: 902530 - DNA, 25 bp, Mus musculus
ccccatcactgtgcggcagctggag

SEQ ID NO: 902531 - DNA, 25 bp, Mus musculus
ccccatcctcagctcaccagtcccc

SEQ ID NO: 902532 - DNA, 25 bp, Mus musculus
ccccatcctcaggtcaccagtcccc

SEQ ID NO: 902533 - DNA, 25 bp, Mus musculus
ccccatcctgtccaagttcttcctc

SEQ ID NO: 902534 - DNA, 25 bp, Mus musculus
ccccatcctgtccatgttcttcctc

SEQ ID NO: 902535 - DNA, 25 bp, Mus musculus
ccccatctattgagccaaaagattc

SEQ ID NO: 902536 - DNA, 25 bp, Mus musculus
ccccatctattgaggcaaaagattc

SEQ ID NO: 902537 - DNA, 25 bp, Mus musculus
ccccatctcagacatgggctttgct

SEQ ID NO: 902538 - DNA, 25 bp, Mus musculus
ccccatctcagacgctggtgtttgc

SEQ ID NO: 902539 - DNA, 25 bp, Mus musculus
ccccatctcagagatgggctttgct

SEQ ID NO: 902540 - DNA, 25 bp, Mus musculus
ccccatctcagaggctggtgtttgc

SEQ ID NO: 902541 - DNA, 25 bp, Mus musculus
ccccatctggaacgcccttctctgg

SEQ ID NO: 902542 - DNA, 25 bp, Mus musculus
ccccatctggaaggcccttctctgg

SEQ ID NO: 902543 - DNA, 25 bp, Mus musculus
ccccatgcgcagctccagacctctt

SEQ ID NO: 902544 - DNA, 25 bp, Mus musculus
ccccatgcgcaggtccagacctctt

SEQ ID NO: 902545 - DNA, 25 bp, Mus musculus
ccccatgctctgcacgcttcgagta

SEQ ID NO: 902546 - DNA, 25 bp, Mus musculus
ccccatgctctgcaggcttcgagta

SEQ ID NO: 902547 - DNA, 25 bp, Mus musculus
ccccatggagctactaaagactcgg

SEQ ID NO: 902548 - DNA, 25 bp, Mus musculus
ccccatggaggtactaaagactcgg

SEQ ID NO: 902549 - DNA, 25 bp, Mus musculus
ccccatgtggccacagtacacgaac

SEQ ID NO: 902550 - DNA, 25 bp, Mus musculus
ccccatgtgggcacagtacacgaac

SEQ ID NO: 902551 - DNA, 25 bp, Mus musculus
ccccattgagctgaccagaatggag

SEQ ID NO: 902552 - DNA, 25 bp, Mus musculus
ccccattgaggtgaccagaatggag

SEQ ID NO: 902553 - DNA, 25 bp, Mus musculus
ccccattgtagagacttacattggc

SEQ ID NO: 902554 - DNA, 25 bp, Mus musculus
ccccattgtagagagttacattggc

SEQ ID NO: 902555 - DNA, 25 bp, Mus musculus
ccccattgtcaacactcttgcacag

SEQ ID NO: 902556 - DNA, 25 bp, Mus musculus
ccccattgtcaagactcttgcacag

SEQ ID NO: 902557 - DNA, 25 bp, Mus musculus
ccccatttacagcgagaagctgggc

SEQ ID NO: 902558 - DNA, 25 bp, Mus musculus
ccccatttacagggagaagctgggc

SEQ ID NO: 902559 - DNA, 25 bp, Mus musculus
ccccatttccctcgcaggttcaccg

SEQ ID NO: 902560 - DNA, 25 bp, Mus musculus
ccccatttccctggcaggttcaccg

SEQ ID NO: 902561 - DNA, 25 bp, Mus musculus
ccccattttacacaactgtatgagg

SEQ ID NO: 902562 - DNA, 25 bp, Mus musculus
ccccattttacagaactgtatgagg

SEQ ID NO: 902563 - DNA, 25 bp, Mus musculus
cccccaaactttgacgtctcccatg

SEQ ID NO: 902564 - DNA, 25 bp, Mus musculus
cccccaaactttgaggtctcccatg

SEQ ID NO: 902565 - DNA, 25 bp, Mus musculus
cccccaacgttcaacgtctcactca

SEQ ID NO: 902566 - DNA, 25 bp, Mus musculus
cccccaacgttcaaggtctcactca

SEQ ID NO: 902567 - DNA, 25 bp, Mus musculus
cccccaactgagcgcaggctggata

SEQ ID NO: 902568 - DNA, 25 bp, Mus musculus
cccccaactgagggcaggctggata

SEQ ID NO: 902569 - DNA, 25 bp, Mus musculus
cccccaagaaagaatggcttcactt

SEQ ID NO: 902570 - DNA, 25 bp, Mus musculus
cccccaagaaagcaatggcttcact

SEQ ID NO: 902571 - DNA, 25 bp, Mus musculus
cccccaagaaaggaatggcttcact

SEQ ID NO: 902572 - DNA, 25 bp, Mus musculus
cccccaagaaagtatggcttcactt

SEQ ID NO: 902573 - DNA, 25 bp, Mus musculus
cccccaagccacaccctaaggctga

SEQ ID NO: 902574 - DNA, 25 bp, Mus musculus
cccccaagcctcaccctaaggctga

SEQ ID NO: 902575 - DNA, 25 bp, Mus musculus
cccccaagtgctggagatctttggc

SEQ ID NO: 902576 - DNA, 25 bp, Mus musculus
cccccaagtgctggtgatctttggc

SEQ ID NO: 902577 - DNA, 25 bp, Mus musculus
cccccaatccagaacaggaggctgc

SEQ ID NO: 902578 - DNA, 25 bp, Mus musculus
cccccaatccagcaggctgctggag

SEQ ID NO: 902579 - DNA, 25 bp, Mus musculus
cccccaatccaggaggctgctggag

SEQ ID NO: 902580 - DNA, 25 bp, Mus musculus
cccccaatccagtacaggaggctgc

SEQ ID NO: 902581 - DNA, 25 bp, Mus musculus
cccccaatgactacactgcagcctg

SEQ ID NO: 902582 - DNA, 25 bp, Mus musculus
cccccaatgagtacactgcagcctg

SEQ ID NO: 902583 - DNA, 25 bp, Mus musculus
cccccacaagcctgaaatcaactcc

SEQ ID NO: 902584 - DNA, 25 bp, Mus musculus
cccccacaagcctgagccaggaggg

SEQ ID NO: 902585 - DNA, 25 bp, Mus musculus
cccccacaagcctgtaatcaactcc

SEQ ID NO: 902586 - DNA, 25 bp, Mus musculus
cccccacaagcctgtgccaggaggg

SEQ ID NO: 902587 - DNA, 25 bp, Mus musculus
cccccaccagcttcccttcagggca

SEQ ID NO: 902588 - DNA, 25 bp, Mus musculus
cccccaccaggttcccttcagggca

SEQ ID NO: 902589 - DNA, 25 bp, Mus musculus
cccccaccatgaatttgtggcccta

SEQ ID NO: 902590 - DNA, 25 bp, Mus musculus
cccccaccatgattttgtggcccta

SEQ ID NO: 902591 - DNA, 25 bp, Mus musculus
cccccactggatgatgcagaatttg

SEQ ID NO: 902592 - DNA, 25 bp, Mus musculus
cccccactggttgatgcagaatttg

SEQ ID NO: 902593 - DNA, 25 bp, Mus musculus
cccccagagccacgagcaatgctac

SEQ ID NO: 902594 - DNA, 25 bp, Mus musculus
cccccagagccaggagcaatgctac

SEQ ID NO: 902595 - DNA, 25 bp, Mus musculus
cccccagagctgctggaacacattg

SEQ ID NO: 902596 - DNA, 25 bp, Mus musculus
cccccagagctggtggaacacattg

SEQ ID NO: 902597 - DNA, 25 bp, Mus musculus
cccccagccactgtgaccccacaac

SEQ ID NO: 902598 - DNA, 25 bp, Mus musculus
cccccagccagtgtgaccccacaac

SEQ ID NO: 902599 - DNA, 25 bp, Mus musculus
cccccagccccaccagcctggtaga

SEQ ID NO: 902600 - DNA, 25 bp, Mus musculus
cccccagccccactccttcaggctc

SEQ ID NO: 902601 - DNA, 25 bp, Mus musculus
cccccagccccagcagcctggtaga

SEQ ID NO: 902602 - DNA, 25 bp, Mus musculus
cccccagccccagtccttcaggctc

SEQ ID NO: 902603 - DNA, 25 bp, Mus musculus
cccccaggcaatcctggcccagtga

SEQ ID NO: 902604 - DNA, 25 bp, Mus musculus
cccccaggcaatgctggcccagtga

SEQ ID NO: 902605 - DNA, 25 bp, Mus musculus
cccccaggcccacgcgtgctggtca

SEQ ID NO: 902606 - DNA, 25 bp, Mus musculus
cccccaggcccaggcgtgctggtca

SEQ ID NO: 902607 - DNA, 25 bp, Mus musculus
cccccagggctacaaggtgcttcag

SEQ ID NO: 902608 - DNA, 25 bp, Mus musculus
cccccagggctacatggtgcttcag

SEQ ID NO: 902609 - DNA, 25 bp, Mus musculus
cccccatcagccccctcaagttctc

SEQ ID NO: 902610 - DNA, 25 bp, Mus musculus
cccccatcaggcccctcaagttctc

SEQ ID NO: 902611 - DNA, 25 bp, Mus musculus
cccccatgaagaaacgagccagtta

SEQ ID NO: 902612 - DNA, 25 bp, Mus musculus
cccccatgaagaaaggagccagtta

SEQ ID NO: 902613 - DNA, 25 bp, Mus musculus
cccccatgacagcatggctggcttt

SEQ ID NO: 902614 - DNA, 25 bp, Mus musculus
cccccatgacaggatggctggcttt

SEQ ID NO: 902615 - DNA, 25 bp, Mus musculus
cccccatgcgcacctccagacctct

SEQ ID NO: 902616 - DNA, 25 bp, Mus musculus
cccccatgcgcagctccagacctct

SEQ ID NO: 902617 - DNA, 25 bp, Mus musculus
cccccatgtgggaacaaccctggct

SEQ ID NO: 902618 - DNA, 25 bp, Mus musculus
cccccatgtgggaagaaccctggct

SEQ ID NO: 902619 - DNA, 25 bp, Mus musculus
cccccattacatatcttgtgaagtt

SEQ ID NO: 902620 - DNA, 25 bp, Mus musculus
cccccattacatttcttgtgaagtt

SEQ ID NO: 902621 - DNA, 25 bp, Mus musculus
ccccccaactgacggcaggctggat

SEQ ID NO: 902622 - DNA, 25 bp, Mus musculus
ccccccaactgagggcaggctggat

SEQ ID NO: 902623 - DNA, 25 bp, Mus musculus
ccccccagagctcgtggaacacatt

SEQ ID NO: 902624 - DNA, 25 bp, Mus musculus
ccccccagagctggtggaacacatt

SEQ ID NO: 902625 - DNA, 25 bp, Mus musculus
ccccccagccagcatgatgtctaca

SEQ ID NO: 902626 - DNA, 25 bp, Mus musculus
ccccccagccaggatgatgtctaca

SEQ ID NO: 902627 - DNA, 25 bp, Mus musculus
ccccccatgacacgatggctggctt

SEQ ID NO: 902628 - DNA, 25 bp, Mus musculus
ccccccatgacaggatggctggctt

SEQ ID NO: 902629 - DNA, 25 bp, Mus musculus
cccccctaagcgcagcagcaatgac

SEQ ID NO: 902630 - DNA, 25 bp, Mus musculus
cccccctaagggcagcagcaatgac

SEQ ID NO: 902631 - DNA, 25 bp, Mus musculus
cccccctgggattacgagtgccagg

SEQ ID NO: 902632 - DNA, 25 bp, Mus musculus
cccccctgggattaggagtgccagg

SEQ ID NO: 902633 - DNA, 25 bp, Mus musculus
ccccccttttctcaatgaagatatc

SEQ ID NO: 902634 - DNA, 25 bp, Mus musculus
ccccccttttctgaatgaagatatc

SEQ ID NO: 902635 - DNA, 25 bp, Mus musculus
cccccgagctcgagtcctcagacga

SEQ ID NO: 902636 - DNA, 25 bp, Mus musculus
cccccgagctcgtgtcctcagacga

SEQ ID NO: 902637 - DNA, 25 bp, Mus musculus
cccccgcatgaacagtgggcggctg

SEQ ID NO: 902638 - DNA, 25 bp, Mus musculus
cccccgcatgaagagtgggcggctg

SEQ ID NO: 902639 - DNA, 25 bp, Mus musculus
cccccgcgggagcaccaccccttgg

SEQ ID NO: 902640 - DNA, 25 bp, Mus musculus
cccccgcgggagcacgccggaagct

SEQ ID NO: 902641 - DNA, 25 bp, Mus musculus
cccccgcgggagcagcaccccttgg

SEQ ID NO: 902642 - DNA, 25 bp, Mus musculus
cccccgcgggagcaggccggaagct

SEQ ID NO: 902643 - DNA, 25 bp, Mus musculus
cccccgctacagagccttgcccaaa

SEQ ID NO: 902644 - DNA, 25 bp, Mus musculus
cccccgctacagtgccttgcccaaa

SEQ ID NO: 902645 - DNA, 25 bp, Mus musculus
cccccggagtcgcacatcatcatga

SEQ ID NO: 902646 - DNA, 25 bp, Mus musculus
cccccggagtcggacatcatcatga

SEQ ID NO: 902647 - DNA, 25 bp, Mus musculus
cccccgtcaggacgcaagctgctgg

SEQ ID NO: 902648 - DNA, 25 bp, Mus musculus
cccccgtcaggaggcaagctgctgg

SEQ ID NO: 902649 - DNA, 25 bp, Mus musculus
ccccctacaagccaccaatcagagc

SEQ ID NO: 902650 - DNA, 25 bp, Mus musculus
ccccctacaagccagcaatcagagc

SEQ ID NO: 902651 - DNA, 25 bp, Mus musculus
ccccctcagcccctcgctgccacca

SEQ ID NO: 902652 - DNA, 25 bp, Mus musculus
ccccctcagcccctggctgccacca

SEQ ID NO: 902653 - DNA, 25 bp, Mus musculus
ccccctccttccatccaaatgttgc

SEQ ID NO: 902654 - DNA, 25 bp, Mus musculus
ccccctccttccttccaaatgttgc

SEQ ID NO: 902655 - DNA, 25 bp, Mus musculus
ccccctgcactgcacacctgtgctg

SEQ ID NO: 902656 - DNA, 25 bp, Mus musculus
ccccctgcactgcacagacctgtgc

SEQ ID NO: 902657 - DNA, 25 bp, Mus musculus
ccccctgcactgcacgagacctgtg

SEQ ID NO: 902658 - DNA, 25 bp, Mus musculus
ccccctgcactgcagacctgtgctg

SEQ ID NO: 902659 - DNA, 25 bp, Mus musculus
ccccctgcactgcagagacctgtgc

SEQ ID NO: 902660 - DNA, 25 bp, Mus musculus
ccccctgcactgcaggagacctgtg

SEQ ID NO: 902661 - DNA, 25 bp, Mus musculus
ccccctgcagcagcccccacaacca

SEQ ID NO: 902662 - DNA, 25 bp, Mus musculus
ccccctgcaggagcccccacaacca

SEQ ID NO: 902663 - DNA, 25 bp, Mus musculus
ccccctgcattacacgttggctgtt

SEQ ID NO: 902664 - DNA, 25 bp, Mus musculus
ccccctgcattacaggttggctgtt

SEQ ID NO: 902665 - DNA, 25 bp, Mus musculus
ccccctggacggctcgtggatgcag

SEQ ID NO: 902666 - DNA, 25 bp, Mus musculus
ccccctggacggctggtggatgcag

SEQ ID NO: 902667 - DNA, 25 bp, Mus musculus
ccccctgggtctccagccatggcaa

SEQ ID NO: 902668 - DNA, 25 bp, Mus musculus
ccccctgggtctcccatggcaatga

SEQ ID NO: 902669 - DNA, 25 bp, Mus musculus
ccccctgggtctgcagccatggcaa

SEQ ID NO: 902670 - DNA, 25 bp, Mus musculus
ccccctgggtctgccatggcaatga

SEQ ID NO: 902671 - DNA, 25 bp, Mus musculus
ccccctggtcagccactcggacatg

SEQ ID NO: 902672 - DNA, 25 bp, Mus musculus
ccccctggtcaggcactcggacatg

SEQ ID NO: 902673 - DNA, 25 bp, Mus musculus
ccccctgtggcacaatccctgtgat

SEQ ID NO: 902674 - DNA, 25 bp, Mus musculus
ccccctgtggcagaatccctgtgat

SEQ ID NO: 902675 - DNA, 25 bp, Mus musculus
ccccctttcacacagcatgatctcc

SEQ ID NO: 902676 - DNA, 25 bp, Mus musculus
ccccctttcacacgctcctgagcat

SEQ ID NO: 902677 - DNA, 25 bp, Mus musculus
ccccctttcacagagcatgatctcc

SEQ ID NO: 902678 - DNA, 25 bp, Mus musculus
ccccctttcacaggctcctgagcat

SEQ ID NO: 902679 - DNA, 25 bp, Mus musculus
ccccgaacaacacacgagctaaact

SEQ ID NO: 902680 - DNA, 25 bp, Mus musculus
ccccgaacaacacgtcttcacacaa

SEQ ID NO: 902681 - DNA, 25 bp, Mus musculus
ccccgaacaacagacgagctaaact

SEQ ID NO: 902682 - DNA, 25 bp, Mus musculus
ccccgaacaacaggtcttcacacaa

SEQ ID NO: 902683 - DNA, 25 bp, Mus musculus
ccccgaagatgccacccaatggttc

SEQ ID NO: 902684 - DNA, 25 bp, Mus musculus
ccccgaagatgccagccaatggttc

SEQ ID NO: 902685 - DNA, 25 bp, Mus musculus
ccccgacttggtgaaaaggtacagt

SEQ ID NO: 902686 - DNA, 25 bp, Mus musculus
ccccgacttggtgaagaaaccatta

SEQ ID NO: 902687 - DNA, 25 bp, Mus musculus
ccccgacttggtgataaggtacagt

SEQ ID NO: 902688 - DNA, 25 bp, Mus musculus
ccccgacttggtgatgaaaccatta

SEQ ID NO: 902689 - DNA, 25 bp, Mus musculus
ccccgagagccactcattgccacag

SEQ ID NO: 902690 - DNA, 25 bp, Mus musculus
ccccgagagccactcgactgacaga

SEQ ID NO: 902691 - DNA, 25 bp, Mus musculus
ccccgagagccactgattgccacag

SEQ ID NO: 902692 - DNA, 25 bp, Mus musculus
ccccgagagccactggactgacaga

SEQ ID NO: 902693 - DNA, 25 bp, Mus musculus
ccccgagcgcccccgtccagaggac

SEQ ID NO: 902694 - DNA, 25 bp, Mus musculus
ccccgagcgcccgcgtccagaggac

SEQ ID NO: 902695 - DNA, 25 bp, Mus musculus
ccccgaggaagagaaggtgaagctg

SEQ ID NO: 902696 - DNA, 25 bp, Mus musculus
ccccgaggaagagatggtgaagctg

SEQ ID NO: 902697 - DNA, 25 bp, Mus musculus
ccccgaggagcactatacactcggg

SEQ ID NO: 902698 - DNA, 25 bp, Mus musculus
ccccgaggagcagtatacactcggg

SEQ ID NO: 902699 - DNA, 25 bp, Mus musculus
ccccgaggccatcaccgctgcatgc

SEQ ID NO: 902700 - DNA, 25 bp, Mus musculus
ccccgaggccatcagcgctgcatgc

SEQ ID NO: 902701 - DNA, 25 bp, Mus musculus
ccccgatcagaacatgccattgctc

SEQ ID NO: 902702 - DNA, 25 bp, Mus musculus
ccccgatcagtacatgccattgctc

SEQ ID NO: 902703 - DNA, 25 bp, Mus musculus
ccccgatgaagtcaactccctcatg

SEQ ID NO: 902704 - DNA, 25 bp, Mus musculus
ccccgatgaagtgaactccctcatg

SEQ ID NO: 902705 - DNA, 25 bp, Mus musculus
ccccgatgacagcgacaactgtcca

SEQ ID NO: 902706 - DNA, 25 bp, Mus musculus
ccccgatgacagggacaactgtcca

SEQ ID NO: 902707 - DNA, 25 bp, Mus musculus
ccccgcagggtattagtaaagatga

SEQ ID NO: 902708 - DNA, 25 bp, Mus musculus
ccccgcagggtatttgtaaagatga

SEQ ID NO: 902709 - DNA, 25 bp, Mus musculus
ccccgcatgaagagtgggcggctgg

SEQ ID NO: 902710 - DNA, 25 bp, Mus musculus
ccccgcatgaagtgtgggcggctgg

SEQ ID NO: 902711 - DNA, 25 bp, Mus musculus
ccccgccacccacatctggaacaac

SEQ ID NO: 902712 - DNA, 25 bp, Mus musculus
ccccgccacccaccggccacatcct

SEQ ID NO: 902713 - DNA, 25 bp, Mus musculus
ccccgccacccagatctggaacaac

SEQ ID NO: 902714 - DNA, 25 bp, Mus musculus
ccccgccacccagcggccacatcct

SEQ ID NO: 902715 - DNA, 25 bp, Mus musculus
ccccgcccagcacacgtcaattctt

SEQ ID NO: 902716 - DNA, 25 bp, Mus musculus
ccccgcccagcacaggtcaattctt

SEQ ID NO: 902717 - DNA, 25 bp, Mus musculus
ccccgccccattgacgtgaccagaa

SEQ ID NO: 902718 - DNA, 25 bp, Mus musculus
ccccgccccattgaggtgaccagaa

SEQ ID NO: 902719 - DNA, 25 bp, Mus musculus
ccccgccgctgccgcagattggcag

SEQ ID NO: 902720 - DNA, 25 bp, Mus musculus
ccccgccgctgccggagattggcag

SEQ ID NO: 902721 - DNA, 25 bp, Mus musculus
ccccgccggccaatgggcccagtgc

SEQ ID NO: 902722 - DNA, 25 bp, Mus musculus
ccccgccggccattgggcccagtgc

SEQ ID NO: 902723 - DNA, 25 bp, Mus musculus
ccccgcctccttcctacaggtacat

SEQ ID NO: 902724 - DNA, 25 bp, Mus musculus
ccccgcctccttgctacaggtacat

SEQ ID NO: 902725 - DNA, 25 bp, Mus musculus
ccccgcgccacgcacaagtgacgca

SEQ ID NO: 902726 - DNA, 25 bp, Mus musculus
ccccgcgccacggacaagtgacgca

SEQ ID NO: 902727 - DNA, 25 bp, Mus musculus
ccccgctatgagcttgaggaggcac

SEQ ID NO: 902728 - DNA, 25 bp, Mus musculus
ccccgctatgtgcttgaggaggcac

SEQ ID NO: 902729 - DNA, 25 bp, Mus musculus
ccccgctgctcgatggccccatgct

SEQ ID NO: 902730 - DNA, 25 bp, Mus musculus
ccccgctgctcgttggccccatgct

SEQ ID NO: 902731 - DNA, 25 bp, Mus musculus
ccccgctttggacacaaaatcaccg

SEQ ID NO: 902732 - DNA, 25 bp, Mus musculus
ccccgctttggacacgatattgact

SEQ ID NO: 902733 - DNA, 25 bp, Mus musculus
ccccgctttggacagaaaatcaccg

SEQ ID NO: 902734 - DNA, 25 bp, Mus musculus
ccccgctttggacaggatattgact

SEQ ID NO: 902735 - DNA, 25 bp, Mus musculus
ccccggagccagagctcccagaact

SEQ ID NO: 902736 - DNA, 25 bp, Mus musculus
ccccggagccagtgctcccagaact

SEQ ID NO: 902737 - DNA, 25 bp, Mus musculus
ccccggagtcggacatcatcatgat

SEQ ID NO: 902738 - DNA, 25 bp, Mus musculus
ccccggagtcggtcatcatcatgat

SEQ ID NO: 902739 - DNA, 25 bp, Mus musculus
ccccggataacgaggaccatgtgtt

SEQ ID NO: 902740 - DNA, 25 bp, Mus musculus
ccccggataacgtggaccatgtgtt

SEQ ID NO: 902741 - DNA, 25 bp, Mus musculus
ccccggccagctgactgctgtccac

SEQ ID NO: 902742 - DNA, 25 bp, Mus musculus
ccccggccaggtgactgctgtccac

SEQ ID NO: 902743 - DNA, 25 bp, Mus musculus
ccccggccccagcgctggctgtggg

SEQ ID NO: 902744 - DNA, 25 bp, Mus musculus
ccccggccccagctgagtgatcgct

SEQ ID NO: 902745 - DNA, 25 bp, Mus musculus
ccccggccccagggctggctgtggg

SEQ ID NO: 902746 - DNA, 25 bp, Mus musculus
ccccggccccaggtgagtgatcgct

SEQ ID NO: 902747 - DNA, 25 bp, Mus musculus
ccccggcggacacagttgatggtgt

SEQ ID NO: 902748 - DNA, 25 bp, Mus musculus
ccccggcggacagagttgatggtgt

SEQ ID NO: 902749 - DNA, 25 bp, Mus musculus
ccccggcggagacatcgagttgagg

SEQ ID NO: 902750 - DNA, 25 bp, Mus musculus
ccccggcggagagatcgagttgagg

SEQ ID NO: 902751 - DNA, 25 bp, Mus musculus
ccccggctgcccactccgccttgat

SEQ ID NO: 902752 - DNA, 25 bp, Mus musculus
ccccggctgccctctccgccttgat

SEQ ID NO: 902753 - DNA, 25 bp, Mus musculus
ccccgggatggacatgaggtgccac

SEQ ID NO: 902754 - DNA, 25 bp, Mus musculus
ccccgggatggagatgaggtgccac

SEQ ID NO: 902755 - DNA, 25 bp, Mus musculus
ccccgggcagcgcgcgtgctgtatg

SEQ ID NO: 902756 - DNA, 25 bp, Mus musculus
ccccgggcagcgcgggtgctgtatg

SEQ ID NO: 902757 - DNA, 25 bp, Mus musculus
ccccggggctgacctggctagagat

SEQ ID NO: 902758 - DNA, 25 bp, Mus musculus
ccccggggctgagctggctagagat

SEQ ID NO: 902759 - DNA, 25 bp, Mus musculus
ccccggtctgcacgctttggatgaa

SEQ ID NO: 902760 - DNA, 25 bp, Mus musculus
ccccggtctgcaggctttggatgaa

SEQ ID NO: 902761 - DNA, 25 bp, Mus musculus
ccccggtggtgctgctgcctggtga

SEQ ID NO: 902762 - DNA, 25 bp, Mus musculus
ccccggtggtgctggtgcctggtga

SEQ ID NO: 902763 - DNA, 25 bp, Mus musculus
ccccgtcaggagccaagctgctgga

SEQ ID NO: 902764 - DNA, 25 bp, Mus musculus
ccccgtcaggaggcaagctgctgga

SEQ ID NO: 902765 - DNA, 25 bp, Mus musculus
ccccgtccccagcacacaacctgag

SEQ ID NO: 902766 - DNA, 25 bp, Mus musculus
ccccgtccccagcagacaacctgag

SEQ ID NO: 902767 - DNA, 25 bp, Mus musculus
ccccgtccccttctcaacagcaggt

SEQ ID NO: 902768 - DNA, 25 bp, Mus musculus
ccccgtccccttctgaacagcaggt

SEQ ID NO: 902769 - DNA, 25 bp, Mus musculus
ccccgtcttcccaccaacaagatgc

SEQ ID NO: 902770 - DNA, 25 bp, Mus musculus
ccccgtcttcccaccgatgtgatct

SEQ ID NO: 902771 - DNA, 25 bp, Mus musculus
ccccgtcttcccacgaacaagatgc

SEQ ID NO: 902772 - DNA, 25 bp, Mus musculus
ccccgtcttcccacggatgtgatct

SEQ ID NO: 902773 - DNA, 25 bp, Mus musculus
ccccgtgccgtgagcgcgttgactg

SEQ ID NO: 902774 - DNA, 25 bp, Mus musculus
ccccgtgccgtgagggcgttgactg

SEQ ID NO: 902775 - DNA, 25 bp, Mus musculus
ccccgtgttacaaacattatacgag

SEQ ID NO: 902776 - DNA, 25 bp, Mus musculus
ccccgtgttacaaagattatacgag

SEQ ID NO: 902777 - DNA, 25 bp, Mus musculus
cccctaacagccacggtcagagcgg

SEQ ID NO: 902778 - DNA, 25 bp, Mus musculus
cccctaacaggcacggtcagagcgg

SEQ ID NO: 902779 - DNA, 25 bp, Mus musculus
cccctaccagcagcccaagagaaga

SEQ ID NO: 902780 - DNA, 25 bp, Mus musculus
cccctaccaggagcccaagagaaga

SEQ ID NO: 902781 - DNA, 25 bp, Mus musculus
cccctacccatgctcccaagttata

SEQ ID NO: 902782 - DNA, 25 bp, Mus musculus
cccctacccatggtcccaagttata

SEQ ID NO: 902783 - DNA, 25 bp, Mus musculus
cccctaggcaagactggacgagtag

SEQ ID NO: 902784 - DNA, 25 bp, Mus musculus
cccctaggcaagtctggacgagtag

SEQ ID NO: 902785 - DNA, 25 bp, Mus musculus
cccctataagcgctcaccttcagaa

SEQ ID NO: 902786 - DNA, 25 bp, Mus musculus
cccctataagcggtcaccttcagaa

SEQ ID NO: 902787 - DNA, 25 bp, Mus musculus
cccctatgcctgctgtgccccagag

SEQ ID NO: 902788 - DNA, 25 bp, Mus musculus
cccctatgcctggtgtgccccagag

SEQ ID NO: 902789 - DNA, 25 bp, Mus musculus
cccctcaagtctcagtttgtgatcc

SEQ ID NO: 902790 - DNA, 25 bp, Mus musculus
cccctcaagtctgagtttgtgatcc

SEQ ID NO: 902791 - DNA, 25 bp, Mus musculus
cccctcaccgagcaggagaatggcg

SEQ ID NO: 902792 - DNA, 25 bp, Mus musculus
cccctcaccgaggaggagaatggcg

SEQ ID NO: 902793 - DNA, 25 bp, Mus musculus
cccctcagagctctatgggctaatg

SEQ ID NO: 902794 - DNA, 25 bp, Mus musculus
cccctcagagctgtatgggctaatg

SEQ ID NO: 902795 - DNA, 25 bp, Mus musculus
cccctcagcaggacaatgaccagtt

SEQ ID NO: 902796 - DNA, 25 bp, Mus musculus
cccctcagcaggactatgaccagtt

SEQ ID NO: 902797 - DNA, 25 bp, Mus musculus
cccctcagcccacgatctagagtca

SEQ ID NO: 902798 - DNA, 25 bp, Mus musculus
cccctcagcccacggtctccctaca

SEQ ID NO: 902799 - DNA, 25 bp, Mus musculus
cccctcagcccacgtggtgctctgg

SEQ ID NO: 902800 - DNA, 25 bp, Mus musculus
cccctcagcccaggatctagagtca

SEQ ID NO: 902801 - DNA, 25 bp, Mus musculus
cccctcagcccagggtctccctaca

SEQ ID NO: 902802 - DNA, 25 bp, Mus musculus
cccctcagcccaggtggtgctctgg

SEQ ID NO: 902803 - DNA, 25 bp, Mus musculus
cccctcagctgcagcctacttagga

SEQ ID NO: 902804 - DNA, 25 bp, Mus musculus
cccctcagctgctgcctacttagga

SEQ ID NO: 902805 - DNA, 25 bp, Mus musculus
cccctccacctgatccaggtgagcg

SEQ ID NO: 902806 - DNA, 25 bp, Mus musculus
cccctccacctgttccaggtgagcg

SEQ ID NO: 902807 - DNA, 25 bp, Mus musculus
cccctcctacagcagcgggagaaga

SEQ ID NO: 902808 - DNA, 25 bp, Mus musculus
cccctcctacagcatccgattggca

SEQ ID NO: 902809 - DNA, 25 bp, Mus musculus
cccctcctacaggagcgggagaaga

SEQ ID NO: 902810 - DNA, 25 bp, Mus musculus
cccctcctacaggatccgattggca

SEQ ID NO: 902811 - DNA, 25 bp, Mus musculus
cccctcctccagctatgatgggccc

SEQ ID NO: 902812 - DNA, 25 bp, Mus musculus
cccctcctccaggtatgatgggccc

SEQ ID NO: 902813 - DNA, 25 bp, Mus musculus
cccctcctgagacacggttgtgagc

SEQ ID NO: 902814 - DNA, 25 bp, Mus musculus
cccctcctgagacagggttgtgagc

SEQ ID NO: 902815 - DNA, 25 bp, Mus musculus
cccctccttccaaccaaatgttgcc

SEQ ID NO: 902816 - DNA, 25 bp, Mus musculus
cccctccttccatccaaatgttgcc

SEQ ID NO: 902817 - DNA, 25 bp, Mus musculus
cccctcgccatgaacaagcccattg

SEQ ID NO: 902818 - DNA, 25 bp, Mus musculus
cccctcgccatgaagaagcccattg

SEQ ID NO: 902819 - DNA, 25 bp, Mus musculus
cccctcgtctatcactcttgtctgt

SEQ ID NO: 902820 - DNA, 25 bp, Mus musculus
cccctcgtctatcagtcttgtctgt

SEQ ID NO: 902821 - DNA, 25 bp, Mus musculus
cccctctataaaccattgaggccaa

SEQ ID NO: 902822 - DNA, 25 bp, Mus musculus
cccctctataaagcattgaggccaa

SEQ ID NO: 902823 - DNA, 25 bp, Mus musculus
cccctctcttggaggtgcaattgaa

SEQ ID NO: 902824 - DNA, 25 bp, Mus musculus
cccctctcttggtggtgcaattgaa

SEQ ID NO: 902825 - DNA, 25 bp, Mus musculus
cccctctggctgcacgaattgttgg

SEQ ID NO: 902826 - DNA, 25 bp, Mus musculus
cccctctggctgcaggaattgttgg

SEQ ID NO: 902827 - DNA, 25 bp, Mus musculus
cccctgaacatccacgacaaggaca

SEQ ID NO: 902828 - DNA, 25 bp, Mus musculus
cccctgaacatccaggacaaggaca

SEQ ID NO: 902829 - DNA, 25 bp, Mus musculus
cccctgaaccgtcacgtgcgtgtgg

SEQ ID NO: 902830 - DNA, 25 bp, Mus musculus
cccctgaaccgtcaggtgcgtgtgg

SEQ ID NO: 902831 - DNA, 25 bp, Mus musculus
cccctgaagcattgaaaaaggcaag

SEQ ID NO: 902832 - DNA, 25 bp, Mus musculus
cccctgaagccaatcatctggggaa

SEQ ID NO: 902833 - DNA, 25 bp, Mus musculus
cccctgaagcgaatcatctggggaa

SEQ ID NO: 902834 - DNA, 25 bp, Mus musculus
cccctgaagctttgaaaaaggcaag

SEQ ID NO: 902835 - DNA, 25 bp, Mus musculus
cccctgaccgaacagctctggctgg

SEQ ID NO: 902836 - DNA, 25 bp, Mus musculus
cccctgaccgaagagctctggctgg

SEQ ID NO: 902837 - DNA, 25 bp, Mus musculus
cccctgactgcgattacaattccta

SEQ ID NO: 902838 - DNA, 25 bp, Mus musculus
cccctgactgcgtttacaattccta

SEQ ID NO: 902839 - DNA, 25 bp, Mus musculus
cccctgatctctcactgtaccccga

SEQ ID NO: 902840 - DNA, 25 bp, Mus musculus
cccctgatctctcagtgtaccccga

SEQ ID NO: 902841 - DNA, 25 bp, Mus musculus
cccctgcaagcgtgactctggaggg

SEQ ID NO: 902842 - DNA, 25 bp, Mus musculus
cccctgcaagggtgactctggaggg

SEQ ID NO: 902843 - DNA, 25 bp, Mus musculus
cccctgcagtagacatatggagcct

SEQ ID NO: 902844 - DNA, 25 bp, Mus musculus
cccctgcagtagtcatatggagcct

SEQ ID NO: 902845 - DNA, 25 bp, Mus musculus
cccctgccagactcctggctgctta

SEQ ID NO: 902846 - DNA, 25 bp, Mus musculus
cccctgccagataatcagcctttat

SEQ ID NO: 902847 - DNA, 25 bp, Mus musculus
cccctgccagtctcctggctgctta

SEQ ID NO: 902848 - DNA, 25 bp, Mus musculus
cccctgccagttaatcagcctttat

SEQ ID NO: 902849 - DNA, 25 bp, Mus musculus
cccctgccccagacaacattctggg

SEQ ID NO: 902850 - DNA, 25 bp, Mus musculus
cccctgccccagtcaacattctggg

SEQ ID NO: 902851 - DNA, 25 bp, Mus musculus
cccctgcctgagcaaggggaccagg

SEQ ID NO: 902852 - DNA, 25 bp, Mus musculus
cccctgcctgaggaaggggaccagg

SEQ ID NO: 902853 - DNA, 25 bp, Mus musculus
cccctgccttgtccgaggtgttctg

SEQ ID NO: 902854 - DNA, 25 bp, Mus musculus
cccctgccttgtgcgaggtgttctg

SEQ ID NO: 902855 - DNA, 25 bp, Mus musculus
cccctgcggagacacggggctcacc

SEQ ID NO: 902856 - DNA, 25 bp, Mus musculus
cccctgcggagacacgtttcggccg

SEQ ID NO: 902857 - DNA, 25 bp, Mus musculus
cccctgcggagacagggggctcacc

SEQ ID NO: 902858 - DNA, 25 bp, Mus musculus
cccctgcggagacaggtttcggccg

SEQ ID NO: 902859 - DNA, 25 bp, Mus musculus
cccctgctcaagactgaaaatgcag

SEQ ID NO: 902860 - DNA, 25 bp, Mus musculus
cccctgctcaagtctgaaaatgcag

SEQ ID NO: 902861 - DNA, 25 bp, Mus musculus
cccctgctgcaacgcattgctgact

SEQ ID NO: 902862 - DNA, 25 bp, Mus musculus
cccctgctgcaaggcattgctgact

SEQ ID NO: 902863 - DNA, 25 bp, Mus musculus
cccctgctgcagcgcccagatatta

SEQ ID NO: 902864 - DNA, 25 bp, Mus musculus
cccctgctgcagggcccagatatta

SEQ ID NO: 902865 - DNA, 25 bp, Mus musculus
cccctgctgtcactcgggtcacttt

SEQ ID NO: 902866 - DNA, 25 bp, Mus musculus
cccctgctgtcactggggtcacttt

SEQ ID NO: 902867 - DNA, 25 bp, Mus musculus
cccctggacttcaacgagaatccgg

SEQ ID NO: 902868 - DNA, 25 bp, Mus musculus
cccctggacttcaaggagaatccgg

SEQ ID NO: 902869 - DNA, 25 bp, Mus musculus
cccctggagggcgtcgtcagtatcg

SEQ ID NO: 902870 - DNA, 25 bp, Mus musculus
cccctggagggcgtggtcagtatcg

SEQ ID NO: 902871 - DNA, 25 bp, Mus musculus
cccctggagtagcaccaccttctga

SEQ ID NO: 902872 - DNA, 25 bp, Mus musculus
cccctggagtagcagcaccttctga

SEQ ID NO: 902873 - DNA, 25 bp, Mus musculus
cccctggcagctgacggcttctctg

SEQ ID NO: 902874 - DNA, 25 bp, Mus musculus
cccctggcaggtgacggcttctctg

SEQ ID NO: 902875 - DNA, 25 bp, Mus musculus
cccctgggagagcttacttttctgg

SEQ ID NO: 902876 - DNA, 25 bp, Mus musculus
cccctgggagtgcttacttttctgg

SEQ ID NO: 902877 - DNA, 25 bp, Mus musculus
cccctgggattacgagtgccaggag

SEQ ID NO: 902878 - DNA, 25 bp, Mus musculus
cccctgggattaggagtgccaggag

SEQ ID NO: 902879 - DNA, 25 bp, Mus musculus
cccctgggggccaactgctcaccga

SEQ ID NO: 902880 - DNA, 25 bp, Mus musculus
cccctgggggccaagtgctcaccga

SEQ ID NO: 902881 - DNA, 25 bp, Mus musculus
cccctgggtctgcagccatggcaat

SEQ ID NO: 902882 - DNA, 25 bp, Mus musculus
cccctgggtctgccatggcaatgac

SEQ ID NO: 902883 - DNA, 25 bp, Mus musculus
cccctgggtctggagccatggcaat

SEQ ID NO: 902884 - DNA, 25 bp, Mus musculus
cccctgggtctggcatggcaatgac

SEQ ID NO: 902885 - DNA, 25 bp, Mus musculus
cccctggtagcccacgccaccatgg

SEQ ID NO: 902886 - DNA, 25 bp, Mus musculus
cccctggtagcccaggccaccatgg

SEQ ID NO: 902887 - DNA, 25 bp, Mus musculus
cccctggtcaggcactcggacatgc

SEQ ID NO: 902888 - DNA, 25 bp, Mus musculus
cccctggtcagggactcggacatgc

SEQ ID NO: 902889 - DNA, 25 bp, Mus musculus
cccctggtcatcgacctcctcagtc

SEQ ID NO: 902890 - DNA, 25 bp, Mus musculus
cccctggtcatcgagctcctcagtc

SEQ ID NO: 902891 - DNA, 25 bp, Mus musculus
cccctgtaccagcacatggccccca

SEQ ID NO: 902892 - DNA, 25 bp, Mus musculus
cccctgtaccagcagatggccccca

SEQ ID NO: 902893 - DNA, 25 bp, Mus musculus
cccctgtccttgccaaccagtgtca

SEQ ID NO: 902894 - DNA, 25 bp, Mus musculus
cccctgtccttggcaaccagtgtca

SEQ ID NO: 902895 - DNA, 25 bp, Mus musculus
cccctgtggcagaatccctgtgatg

SEQ ID NO: 902896 - DNA, 25 bp, Mus musculus
cccctgtggcagtatccctgtgatg

SEQ ID NO: 902897 - DNA, 25 bp, Mus musculus
ccccttcaaatactcaactgtccct

SEQ ID NO: 902898 - DNA, 25 bp, Mus musculus
ccccttcaaatactgaactgtccct

SEQ ID NO: 902899 - DNA, 25 bp, Mus musculus
ccccttcactttaacgtgcctgctg

SEQ ID NO: 902900 - DNA, 25 bp, Mus musculus
ccccttcactttaaggtgcctgctg

SEQ ID NO: 902901 - DNA, 25 bp, Mus musculus
ccccttcccccgcagcaggagccag

SEQ ID NO: 902902 - DNA, 25 bp, Mus musculus
ccccttccccggcagcaggagccag

SEQ ID NO: 902903 - DNA, 25 bp, Mus musculus
ccccttcctcaacactgtctacatt

SEQ ID NO: 902904 - DNA, 25 bp, Mus musculus
ccccttcctcaacagtgtctacatt

SEQ ID NO: 902905 - DNA, 25 bp, Mus musculus
ccccttctacagcggcaatgaagat

SEQ ID NO: 902906 - DNA, 25 bp, Mus musculus
ccccttctacaggggcaatgaagat

SEQ ID NO: 902907 - DNA, 25 bp, Mus musculus
ccccttctcaatctgaaattcagca

SEQ ID NO: 902908 - DNA, 25 bp, Mus musculus
ccccttctcaatgtgaaattcagca

SEQ ID NO: 902909 - DNA, 25 bp, Mus musculus
ccccttctgcagcatgtcattgcaa

SEQ ID NO: 902910 - DNA, 25 bp, Mus musculus
ccccttctgcaggatgtcattgcaa

SEQ ID NO: 902911 - DNA, 25 bp, Mus musculus
ccccttcttccacggtctggactgg

SEQ ID NO: 902912 - DNA, 25 bp, Mus musculus
ccccttcttccagggtctggactgg

SEQ ID NO: 902913 - DNA, 25 bp, Mus musculus
ccccttcttcgcagaatacaaacag

SEQ ID NO: 902914 - DNA, 25 bp, Mus musculus
ccccttcttcgcagattcttttctt

SEQ ID NO: 902915 - DNA, 25 bp, Mus musculus
ccccttcttcgctgaatacaaacag

SEQ ID NO: 902916 - DNA, 25 bp, Mus musculus
ccccttcttcgctgattcttttctt

SEQ ID NO: 902917 - DNA, 25 bp, Mus musculus
cccctttagtgaccagtaccagaat

SEQ ID NO: 902918 - DNA, 25 bp, Mus musculus
cccctttagtgactaccagaatggg

SEQ ID NO: 902919 - DNA, 25 bp, Mus musculus
cccctttagtgagcagtaccagaat

SEQ ID NO: 902920 - DNA, 25 bp, Mus musculus
cccctttagtgagtaccagaatggg

SEQ ID NO: 902921 - DNA, 25 bp, Mus musculus
cccctttatcagcgtatcagagcat

SEQ ID NO: 902922 - DNA, 25 bp, Mus musculus
cccctttatcagggtatcagagcat

SEQ ID NO: 902923 - DNA, 25 bp, Mus musculus
cccctttcacagagcatgatctcct

SEQ ID NO: 902924 - DNA, 25 bp, Mus musculus
cccctttcacagcctcctgagcatt

SEQ ID NO: 902925 - DNA, 25 bp, Mus musculus
cccctttcacaggctcctgagcatt

SEQ ID NO: 902926 - DNA, 25 bp, Mus musculus
cccctttcacagtgcatgatctcct

SEQ ID NO: 902927 - DNA, 25 bp, Mus musculus
cccctttctgatccagccagatggt

SEQ ID NO: 902928 - DNA, 25 bp, Mus musculus
cccctttctgttccagccagatggt

SEQ ID NO: 902929 - DNA, 25 bp, Mus musculus
cccctttgtcaagcactggctgaaa

SEQ ID NO: 902930 - DNA, 25 bp, Mus musculus
cccctttgtcaagctctggctgaaa

SEQ ID NO: 902931 - DNA, 25 bp, Mus musculus
ccccttttagacaactgccacgtga

SEQ ID NO: 902932 - DNA, 25 bp, Mus musculus
ccccttttagtcaactgccacgtga

SEQ ID NO: 902933 - DNA, 25 bp, Mus musculus
ccccttttctcaatgaagatatcct

SEQ ID NO: 902934 - DNA, 25 bp, Mus musculus
ccccttttctgaatgaagatatcct

SEQ ID NO: 902935 - DNA, 25 bp, Mus musculus
cccgaaaacgtctgcgcgatgacaa

SEQ ID NO: 902936 - DNA, 25 bp, Mus musculus
cccgaaaacgtctgggcgatgacaa

SEQ ID NO: 902937 - DNA, 25 bp, Mus musculus
cccgaaaccaagaggagctgattgc

SEQ ID NO: 902938 - DNA, 25 bp, Mus musculus
cccgaaaccaagtggagctgattgc

SEQ ID NO: 902939 - DNA, 25 bp, Mus musculus
cccgaacaacagacgagctaaactc

SEQ ID NO: 902940 - DNA, 25 bp, Mus musculus
cccgaacaacagctcttcacacaac

SEQ ID NO: 902941 - DNA, 25 bp, Mus musculus
cccgaacaacaggtcttcacacaac

SEQ ID NO: 902942 - DNA, 25 bp, Mus musculus
cccgaacaacagtcgagctaaactc

SEQ ID NO: 902943 - DNA, 25 bp, Mus musculus
cccgaaccagatatgagcggaatgt

SEQ ID NO: 902944 - DNA, 25 bp, Mus musculus
cccgaaccagttatgagcggaatgt

SEQ ID NO: 902945 - DNA, 25 bp, Mus musculus
cccgaactacatcacgtgcatcaag

SEQ ID NO: 902946 - DNA, 25 bp, Mus musculus
cccgaactacatcaggtgcatcaag

SEQ ID NO: 902947 - DNA, 25 bp, Mus musculus
cccgaagacagcagagaagacgaaa

SEQ ID NO: 902948 - DNA, 25 bp, Mus musculus
cccgaagacagcagtgaagacgaaa

SEQ ID NO: 902949 - DNA, 25 bp, Mus musculus
cccgaagcagaggatgaaggacgca

SEQ ID NO: 902950 - DNA, 25 bp, Mus musculus
cccgaagcagtggatgaaggacgca

SEQ ID NO: 902951 - DNA, 25 bp, Mus musculus
cccgaagctgatgacgcatgacccc

SEQ ID NO: 902952 - DNA, 25 bp, Mus musculus
cccgaagctgatgaggcatgacccc

SEQ ID NO: 902953 - DNA, 25 bp, Mus musculus
cccgaagtatcaagtaccggagctt

SEQ ID NO: 902954 - DNA, 25 bp, Mus musculus
cccgaagtatcatgtaccggagctt

SEQ ID NO: 902955 - DNA, 25 bp, Mus musculus
cccgaagtggccaacctgtcagata

SEQ ID NO: 902956 - DNA, 25 bp, Mus musculus
cccgaagtggccaacttggctgtca

SEQ ID NO: 902957 - DNA, 25 bp, Mus musculus
cccgaagtggccaagctgtcagata

SEQ ID NO: 902958 - DNA, 25 bp, Mus musculus
cccgaagtggccaagttggctgtca

SEQ ID NO: 902959 - DNA, 25 bp, Mus musculus
cccgaatacccacgctccaacacct

SEQ ID NO: 902960 - DNA, 25 bp, Mus musculus
cccgaatacccaggctccaacacct

SEQ ID NO: 902961 - DNA, 25 bp, Mus musculus
cccgaattacagagtcttaataccg

SEQ ID NO: 902962 - DNA, 25 bp, Mus musculus
cccgaattacagtgtcttaataccg

SEQ ID NO: 902963 - DNA, 25 bp, Mus musculus
cccgacacaggtcgagaatataaat

SEQ ID NO: 902964 - DNA, 25 bp, Mus musculus
cccgacacaggtctgtatccagagt

SEQ ID NO: 902965 - DNA, 25 bp, Mus musculus
cccgacacaggtggagaatataaat

SEQ ID NO: 902966 - DNA, 25 bp, Mus musculus
cccgacacaggtgtgtatccagagt

SEQ ID NO: 902967 - DNA, 25 bp, Mus musculus
cccgacagaattctcctaagaccac

SEQ ID NO: 902968 - DNA, 25 bp, Mus musculus
cccgacagaattgtcctaagaccac

SEQ ID NO: 902969 - DNA, 25 bp, Mus musculus
cccgacatcgacgtggaggtggatg

SEQ ID NO: 902970 - DNA, 25 bp, Mus musculus
cccgacatcgtcgtggaggtggatg

SEQ ID NO: 902971 - DNA, 25 bp, Mus musculus
cccgaccagcctggccacatggggc

SEQ ID NO: 902972 - DNA, 25 bp, Mus musculus
cccgaccagcctgggcacatggggc

SEQ ID NO: 902973 - DNA, 25 bp, Mus musculus
cccgaccatgaacacaccgtggaag

SEQ ID NO: 902974 - DNA, 25 bp, Mus musculus
cccgaccatgaacatgaagcggcag

SEQ ID NO: 902975 - DNA, 25 bp, Mus musculus
cccgaccatgaagacaccgtggaag

SEQ ID NO: 902976 - DNA, 25 bp, Mus musculus
cccgaccatgaagatgaagcggcag

SEQ ID NO: 902977 - DNA, 25 bp, Mus musculus
cccgaccctcaacgtgccctatgag

SEQ ID NO: 902978 - DNA, 25 bp, Mus musculus
cccgaccctcaaggtgccctatgag

SEQ ID NO: 902979 - DNA, 25 bp, Mus musculus
cccgaccgattacatgtccatgcag

SEQ ID NO: 902980 - DNA, 25 bp, Mus musculus
cccgaccgattagatgtccatgcag

SEQ ID NO: 902981 - DNA, 25 bp, Mus musculus
cccgaccgctgccacgcctcctctg

SEQ ID NO: 902982 - DNA, 25 bp, Mus musculus
cccgaccgctgccaggcctcctctg

SEQ ID NO: 902983 - DNA, 25 bp, Mus musculus
cccgactacgatcgacctaacactt

SEQ ID NO: 902984 - DNA, 25 bp, Mus musculus
cccgactacgatggacctaacactt

SEQ ID NO: 902985 - DNA, 25 bp, Mus musculus
cccgacttggacaacaccatcaaga

SEQ ID NO: 902986 - DNA, 25 bp, Mus musculus
cccgacttggacaagaccatcaaga

SEQ ID NO: 902987 - DNA, 25 bp, Mus musculus
cccgagaaagattccagagtcagtg

SEQ ID NO: 902988 - DNA, 25 bp, Mus musculus
cccgagaaagtttccagagtcagtg

SEQ ID NO: 902989 - DNA, 25 bp, Mus musculus
cccgagactgccaacactcactctg

SEQ ID NO: 902990 - DNA, 25 bp, Mus musculus
cccgagactgccaacgaggccgagt

SEQ ID NO: 902991 - DNA, 25 bp, Mus musculus
cccgagactgccaagactcactctg

SEQ ID NO: 902992 - DNA, 25 bp, Mus musculus
cccgagactgccaaggaggccgagt

SEQ ID NO: 902993 - DNA, 25 bp, Mus musculus
cccgagagcatcgacggcctgtacc

SEQ ID NO: 902994 - DNA, 25 bp, Mus musculus
cccgagagcatcgagggcctgtacc

SEQ ID NO: 902995 - DNA, 25 bp, Mus musculus
cccgagaggttcctctgctttgcct

SEQ ID NO: 902996 - DNA, 25 bp, Mus musculus
cccgagaggttcgtctgctttgcct

SEQ ID NO: 902997 - DNA, 25 bp, Mus musculus
cccgagagtcaaacagcgtgcttcc

SEQ ID NO: 902998 - DNA, 25 bp, Mus musculus
cccgagagtcaaacgtgcttccggc

SEQ ID NO: 902999 - DNA, 25 bp, Mus musculus
cccgagagtcaatcagcgtgcttcc

SEQ ID NO: 903000 - DNA, 25 bp, Mus musculus
cccgagagtcaatcgtgcttccggc

SEQ ID NO: 903001 - DNA, 25 bp, Mus musculus
cccgagccagagcagtacttttgag

SEQ ID NO: 903002 - DNA, 25 bp, Mus musculus
cccgagccagaggagtacttttgag

SEQ ID NO: 903003 - DNA, 25 bp, Mus musculus
cccgagcgcccgcgtccagaggacc

SEQ ID NO: 903004 - DNA, 25 bp, Mus musculus
cccgagcgcccgggtccagaggacc

SEQ ID NO: 903005 - DNA, 25 bp, Mus musculus
cccgagctagcggaagacacccagt

SEQ ID NO: 903006 - DNA, 25 bp, Mus musculus
cccgagctaggggaagacacccagt

SEQ ID NO: 903007 - DNA, 25 bp, Mus musculus
cccgagctcgagtcctcagacgact

SEQ ID NO: 903008 - DNA, 25 bp, Mus musculus
cccgagctcgtgtcctcagacgact

SEQ ID NO: 903009 - DNA, 25 bp, Mus musculus
cccgaggagcagaatacactcgggg

SEQ ID NO: 903010 - DNA, 25 bp, Mus musculus
cccgaggagcagtatacactcgggg

SEQ ID NO: 903011 - DNA, 25 bp, Mus musculus
cccgaggccgagcgattatgtgcat

SEQ ID NO: 903012 - DNA, 25 bp, Mus musculus
cccgaggccgagggattatgtgcat

SEQ ID NO: 903013 - DNA, 25 bp, Mus musculus
cccgagtgcgagcgcgttgctgttc

SEQ ID NO: 903014 - DNA, 25 bp, Mus musculus
cccgagtgcgagcgggttgctgttc

SEQ ID NO: 903015 - DNA, 25 bp, Mus musculus
cccgagtttgtcccccccgagatcg

SEQ ID NO: 903016 - DNA, 25 bp, Mus musculus
cccgagtttgtcgcccccgagatcg

SEQ ID NO: 903017 - DNA, 25 bp, Mus musculus
cccgatatcgtgaacgttatcaaga

SEQ ID NO: 903018 - DNA, 25 bp, Mus musculus
cccgatatcgtgaaggttatcaaga

SEQ ID NO: 903019 - DNA, 25 bp, Mus musculus
cccgatcaagatcatactctcctag

SEQ ID NO: 903020 - DNA, 25 bp, Mus musculus
cccgatcaagctgggagatgccatt

SEQ ID NO: 903021 - DNA, 25 bp, Mus musculus
cccgatcaaggtgggagatgccatt

SEQ ID NO: 903022 - DNA, 25 bp, Mus musculus
cccgatcaagttcatactctcctag

SEQ ID NO: 903023 - DNA, 25 bp, Mus musculus
cccgatcgtgtgcgcgcatttcagg

SEQ ID NO: 903024 - DNA, 25 bp, Mus musculus
cccgatcgtgtgcgggcatttcagg

SEQ ID NO: 903025 - DNA, 25 bp, Mus musculus
cccgatgaagaactaagtggaaaag

SEQ ID NO: 903026 - DNA, 25 bp, Mus musculus
cccgatgaagaatggataacgacca

SEQ ID NO: 903027 - DNA, 25 bp, Mus musculus
cccgatgaagtactaagtggaaaag

SEQ ID NO: 903028 - DNA, 25 bp, Mus musculus
cccgatgaagtatggataacgacca

SEQ ID NO: 903029 - DNA, 25 bp, Mus musculus
cccgatgacaggcacaactgtccat

SEQ ID NO: 903030 - DNA, 25 bp, Mus musculus
cccgatgacagggacaactgtccat

SEQ ID NO: 903031 - DNA, 25 bp, Mus musculus
cccgcaaaagaagtctgtggaccga

SEQ ID NO: 903032 - DNA, 25 bp, Mus musculus
cccgcaaaagctccctccaacatgc

SEQ ID NO: 903033 - DNA, 25 bp, Mus musculus
cccgcaaaaggtccctccaacatgc

SEQ ID NO: 903034 - DNA, 25 bp, Mus musculus
cccgcaaaagtagtctgtggaccga

SEQ ID NO: 903035 - DNA, 25 bp, Mus musculus
cccgcaactgcgaaagcagctgacg

SEQ ID NO: 903036 - DNA, 25 bp, Mus musculus
cccgcaactgggaaagcagctgacg

SEQ ID NO: 903037 - DNA, 25 bp, Mus musculus
cccgcaagacacctagagactagca

SEQ ID NO: 903038 - DNA, 25 bp, Mus musculus
cccgcaagacaccttgagactagca

SEQ ID NO: 903039 - DNA, 25 bp, Mus musculus
cccgcactggagcgtgctcttcagg

SEQ ID NO: 903040 - DNA, 25 bp, Mus musculus
cccgcactggagggtgctcttcagg

SEQ ID NO: 903041 - DNA, 25 bp, Mus musculus
cccgcagacgctacctcctgtatga

SEQ ID NO: 903042 - DNA, 25 bp, Mus musculus
cccgcagacggtacctcctgtatga

SEQ ID NO: 903043 - DNA, 25 bp, Mus musculus
cccgcagcggtgcacttgacagttc

SEQ ID NO: 903044 - DNA, 25 bp, Mus musculus
cccgcagcggtgcagttgacagttc

SEQ ID NO: 903045 - DNA, 25 bp, Mus musculus
cccgcagcgtgacccagtgggtgtt

SEQ ID NO: 903046 - DNA, 25 bp, Mus musculus
cccgcagcgtgacgtcctggtattt

SEQ ID NO: 903047 - DNA, 25 bp, Mus musculus
cccgcagcgtgagccagtgggtgtt

SEQ ID NO: 903048 - DNA, 25 bp, Mus musculus
cccgcagcgtgaggtcctggtattt

SEQ ID NO: 903049 - DNA, 25 bp, Mus musculus
cccgcagcttgcgcccccggccgcc

SEQ ID NO: 903050 - DNA, 25 bp, Mus musculus
cccgcagcttgcgcgcccggccgcc

SEQ ID NO: 903051 - DNA, 25 bp, Mus musculus
cccgcagttgccctgaatgtgtaca

SEQ ID NO: 903052 - DNA, 25 bp, Mus musculus
cccgcagttggcctgaatgtgtaca

SEQ ID NO: 903053 - DNA, 25 bp, Mus musculus
cccgcatggggcagcgcatgggtgc

SEQ ID NO: 903054 - DNA, 25 bp, Mus musculus
cccgcatggggcagggcatgggtgc

SEQ ID NO: 903055 - DNA, 25 bp, Mus musculus
cccgcatggtataacgatgacatcg

SEQ ID NO: 903056 - DNA, 25 bp, Mus musculus
cccgcatggtataaggatgacatcg

SEQ ID NO: 903057 - DNA, 25 bp, Mus musculus
cccgccaaaccccatgagaatttcc

SEQ ID NO: 903058 - DNA, 25 bp, Mus musculus
cccgccaaacgccatgagaatttcc

SEQ ID NO: 903059 - DNA, 25 bp, Mus musculus
cccgccacccagatctggaacaacg

SEQ ID NO: 903060 - DNA, 25 bp, Mus musculus
cccgccacccagcggccacatcctg

SEQ ID NO: 903061 - DNA, 25 bp, Mus musculus
cccgccacccaggggccacatcctg

SEQ ID NO: 903062 - DNA, 25 bp, Mus musculus
cccgccacccagttctggaacaacg

SEQ ID NO: 903063 - DNA, 25 bp, Mus musculus
cccgccactgcagacgcattgcccg

SEQ ID NO: 903064 - DNA, 25 bp, Mus musculus
cccgccactgcagaggcattgcccg

SEQ ID NO: 903065 - DNA, 25 bp, Mus musculus
cccgccaggtggctgggatgaggtg

SEQ ID NO: 903066 - DNA, 25 bp, Mus musculus
cccgccaggtgggtgggatgaggtg

SEQ ID NO: 903067 - DNA, 25 bp, Mus musculus
cccgcctccttgctacaggtacatt

SEQ ID NO: 903068 - DNA, 25 bp, Mus musculus
cccgcctccttggtacaggtacatt

SEQ ID NO: 903069 - DNA, 25 bp, Mus musculus
cccgcctcggcttgctgttctggct

SEQ ID NO: 903070 - DNA, 25 bp, Mus musculus
cccgcctcgggttgctgttctggct

SEQ ID NO: 903071 - DNA, 25 bp, Mus musculus
cccgccttggagctggctcagctgc

SEQ ID NO: 903072 - DNA, 25 bp, Mus musculus
cccgccttggaggtggctcagctgc

SEQ ID NO: 903073 - DNA, 25 bp, Mus musculus
cccgcgagtagcagcaggcgtccgg

SEQ ID NO: 903074 - DNA, 25 bp, Mus musculus
cccgcgagtagcaggaggcgtccgg

SEQ ID NO: 903075 - DNA, 25 bp, Mus musculus
cccgcgcgtgcccgccctgccgcct

SEQ ID NO: 903076 - DNA, 25 bp, Mus musculus
cccgcgcgtgcccggcctgccgcct

SEQ ID NO: 903077 - DNA, 25 bp, Mus musculus
cccgcggacgccactgagagtatga

SEQ ID NO: 903078 - DNA, 25 bp, Mus musculus
cccgcggacgccatggcaggaccta

SEQ ID NO: 903079 - DNA, 25 bp, Mus musculus
cccgcggacggcactgagagtatga

SEQ ID NO: 903080 - DNA, 25 bp, Mus musculus
cccgcggacggcatggcaggaccta

SEQ ID NO: 903081 - DNA, 25 bp, Mus musculus
cccgcggcggcgcccgtgccaagtg

SEQ ID NO: 903082 - DNA, 25 bp, Mus musculus
cccgcggcggcgccggtgccaagtg

SEQ ID NO: 903083 - DNA, 25 bp, Mus musculus
cccgcgggagcaccaccccttgggg

SEQ ID NO: 903084 - DNA, 25 bp, Mus musculus
cccgcgggagcacgccggaagctca

SEQ ID NO: 903085 - DNA, 25 bp, Mus musculus
cccgcgggagcagcaccccttgggg

SEQ ID NO: 903086 - DNA, 25 bp, Mus musculus
cccgcgggagcaggccggaagctca

SEQ ID NO: 903087 - DNA, 25 bp, Mus musculus
cccgctacagagccttgcccaaact

SEQ ID NO: 903088 - DNA, 25 bp, Mus musculus
cccgctacagtgccttgcccaaact

SEQ ID NO: 903089 - DNA, 25 bp, Mus musculus
cccgctaccgccgggcagaacagac

SEQ ID NO: 903090 - DNA, 25 bp, Mus musculus
cccgctaccggcgggcagaacagac

SEQ ID NO: 903091 - DNA, 25 bp, Mus musculus
cccgctcctgctagagcaatgatag

SEQ ID NO: 903092 - DNA, 25 bp, Mus musculus
cccgctcctggtagagcaatgatag

SEQ ID NO: 903093 - DNA, 25 bp, Mus musculus
cccgctgcagctggaaagcaagcca

SEQ ID NO: 903094 - DNA, 25 bp, Mus musculus
cccgctgcaggtggaaagcaagcca

SEQ ID NO: 903095 - DNA, 25 bp, Mus musculus
cccgctgcgtggacattgatgagtg

SEQ ID NO: 903096 - DNA, 25 bp, Mus musculus
cccgctgcgtggtcattgatgagtg

SEQ ID NO: 903097 - DNA, 25 bp, Mus musculus
cccgctggctcaatcaacccaagtt

SEQ ID NO: 903098 - DNA, 25 bp, Mus musculus
cccgctggctcaatgaacccaagtt

SEQ ID NO: 903099 - DNA, 25 bp, Mus musculus
cccgctggtggacggtgtcaccgaa

SEQ ID NO: 903100 - DNA, 25 bp, Mus musculus
cccgctggtggagggtgtcaccgaa

SEQ ID NO: 903101 - DNA, 25 bp, Mus musculus
cccgctgtcccccacgcgagtttgt

SEQ ID NO: 903102 - DNA, 25 bp, Mus musculus
cccgctgtcccccaggcgagtttgt

SEQ ID NO: 903103 - DNA, 25 bp, Mus musculus
cccggaaccctgaacgatcctcgct

SEQ ID NO: 903104 - DNA, 25 bp, Mus musculus
cccggaaccctgaaggatcctcgct

SEQ ID NO: 903105 - DNA, 25 bp, Mus musculus
cccggaagagcctcccagatggact

SEQ ID NO: 903106 - DNA, 25 bp, Mus musculus
cccggaagaggctcccagatggact

SEQ ID NO: 903107 - DNA, 25 bp, Mus musculus
cccggaaggaagctcggcagctctg

SEQ ID NO: 903108 - DNA, 25 bp, Mus musculus
cccggaaggaaggtcggcagctctg

SEQ ID NO: 903109 - DNA, 25 bp, Mus musculus
cccggaagggacaatattgaccagt

SEQ ID NO: 903110 - DNA, 25 bp, Mus musculus
cccggaagggactatattgaccagt

SEQ ID NO: 903111 - DNA, 25 bp, Mus musculus
cccggaccgccacattgtgccttct

SEQ ID NO: 903112 - DNA, 25 bp, Mus musculus
cccggaccgccagattgtgccttct

SEQ ID NO: 903113 - DNA, 25 bp, Mus musculus
cccggacctcagcagaaatctcccg

SEQ ID NO: 903114 - DNA, 25 bp, Mus musculus
cccggacctcagctctctgcctccg

SEQ ID NO: 903115 - DNA, 25 bp, Mus musculus
cccggacctcaggagaaatctcccg

SEQ ID NO: 903116 - DNA, 25 bp, Mus musculus
cccggacctcaggtctctgcctccg

SEQ ID NO: 903117 - DNA, 25 bp, Mus musculus
cccggagaagagcgagcaaatcaat

SEQ ID NO: 903118 - DNA, 25 bp, Mus musculus
cccggagaagagggagcaaatcaat

SEQ ID NO: 903119 - DNA, 25 bp, Mus musculus
cccggagaagagtttattgccatgt

SEQ ID NO: 903120 - DNA, 25 bp, Mus musculus
cccggagaagtgtttattgccatgt

SEQ ID NO: 903121 - DNA, 25 bp, Mus musculus
cccggagatgagccgtcgatcagca

SEQ ID NO: 903122 - DNA, 25 bp, Mus musculus
cccggagatgaggcgtcgatcagca

SEQ ID NO: 903123 - DNA, 25 bp, Mus musculus
cccggaggagctgacagagttagtc

SEQ ID NO: 903124 - DNA, 25 bp, Mus musculus
cccggaggaggtgacagagttagtc

SEQ ID NO: 903125 - DNA, 25 bp, Mus musculus
cccggagtcgccatccctacaacac

SEQ ID NO: 903126 - DNA, 25 bp, Mus musculus
cccggagtcgccatctcaccccagg

SEQ ID NO: 903127 - DNA, 25 bp, Mus musculus
cccggagtcgccatgcctacaacac

SEQ ID NO: 903128 - DNA, 25 bp, Mus musculus
cccggagtcgccatgtcaccccagg

SEQ ID NO: 903129 - DNA, 25 bp, Mus musculus
cccggatgagccctgggcatttcct

SEQ ID NO: 903130 - DNA, 25 bp, Mus musculus
cccggatgagctggctctggtccag

SEQ ID NO: 903131 - DNA, 25 bp, Mus musculus
cccggatgaggcctgggcatttcct

SEQ ID NO: 903132 - DNA, 25 bp, Mus musculus
cccggatgaggtggctctggtccag

SEQ ID NO: 903133 - DNA, 25 bp, Mus musculus
cccggatgtatccacgctcacccag

SEQ ID NO: 903134 - DNA, 25 bp, Mus musculus
cccggatgtatccaggctcacccag

SEQ ID NO: 903135 - DNA, 25 bp, Mus musculus
cccggattattgcagatccatcact

SEQ ID NO: 903136 - DNA, 25 bp, Mus musculus
cccggattattggagatccatcact

SEQ ID NO: 903137 - DNA, 25 bp, Mus musculus
cccggcagaggaccctggaggaggg

SEQ ID NO: 903138 - DNA, 25 bp, Mus musculus
cccggcagaggagcctggaggaggg

SEQ ID NO: 903139 - DNA, 25 bp, Mus musculus
cccggcagctctacgttttgggcca

SEQ ID NO: 903140 - DNA, 25 bp, Mus musculus
cccggcagctgtacgttttgggcca

SEQ ID NO: 903141 - DNA, 25 bp, Mus musculus
cccggccaagctattgctgtcccta

SEQ ID NO: 903142 - DNA, 25 bp, Mus musculus
cccggccaaggtattgctgtcccta

SEQ ID NO: 903143 - DNA, 25 bp, Mus musculus
cccggccgagttcgcactttctgca

SEQ ID NO: 903144 - DNA, 25 bp, Mus musculus
cccggccgagttcggactttctgca

SEQ ID NO: 903145 - DNA, 25 bp, Mus musculus
cccggcctgcagcacgtgtctgtga

SEQ ID NO: 903146 - DNA, 25 bp, Mus musculus
cccggcctgcagcaggtgtctgtga

SEQ ID NO: 903147 - DNA, 25 bp, Mus musculus
cccggcctgcttctggtgtgcattt

SEQ ID NO: 903148 - DNA, 25 bp, Mus musculus
cccggcctgcttgtggtgtgcattt

SEQ ID NO: 903149 - DNA, 25 bp, Mus musculus
cccggccttacccacagctcatctc

SEQ ID NO: 903150 - DNA, 25 bp, Mus musculus
cccggccttacccagagctcatctc

SEQ ID NO: 903151 - DNA, 25 bp, Mus musculus
cccggcgcggcgcgagccgctcccg

SEQ ID NO: 903152 - DNA, 25 bp, Mus musculus
cccggcgcggcgggagccgctcccg

SEQ ID NO: 903153 - DNA, 25 bp, Mus musculus
cccggcggacagagttgatggtgtc

SEQ ID NO: 903154 - DNA, 25 bp, Mus musculus
cccggcggacagtgttgatggtgtc

SEQ ID NO: 903155 - DNA, 25 bp, Mus musculus
cccggcggagagatcgagttgagga

SEQ ID NO: 903156 - DNA, 25 bp, Mus musculus
cccggcggagagttcgagttgagga

SEQ ID NO: 903157 - DNA, 25 bp, Mus musculus
cccggcggagatgaggaaactgagg

SEQ ID NO: 903158 - DNA, 25 bp, Mus musculus
cccggcggagttgaggaaactgagg

SEQ ID NO: 903159 - DNA, 25 bp, Mus musculus
cccggcgtccagatgattgctgaag

SEQ ID NO: 903160 - DNA, 25 bp, Mus musculus
cccggcgtccagttgattgctgaag

SEQ ID NO: 903161 - DNA, 25 bp, Mus musculus
cccggctcacagatgatgtctccaa

SEQ ID NO: 903162 - DNA, 25 bp, Mus musculus
cccggctcacagttgatgtctccaa

SEQ ID NO: 903163 - DNA, 25 bp, Mus musculus
cccggctcagagctgcttcgaatcc

SEQ ID NO: 903164 - DNA, 25 bp, Mus musculus
cccggctcagaggtgcttcgaatcc

SEQ ID NO: 903165 - DNA, 25 bp, Mus musculus
cccggctctgaccatgaagatgagt

SEQ ID NO: 903166 - DNA, 25 bp, Mus musculus
cccggctctgacgatgaagatgagt

SEQ ID NO: 903167 - DNA, 25 bp, Mus musculus
cccggctctgtgctgccttagctgg

SEQ ID NO: 903168 - DNA, 25 bp, Mus musculus
cccggctctgtggtgccttagctgg

SEQ ID NO: 903169 - DNA, 25 bp, Mus musculus
cccggctgcccactccgccttgata

SEQ ID NO: 903170 - DNA, 25 bp, Mus musculus
cccggctgcccagtccgccttgata

SEQ ID NO: 903171 - DNA, 25 bp, Mus musculus
cccggctgctcacatgcccccacca

SEQ ID NO: 903172 - DNA, 25 bp, Mus musculus
cccggctgctcagatgcccccacca

SEQ ID NO: 903173 - DNA, 25 bp, Mus musculus
cccggcttcgagtatcctcagagat

SEQ ID NO: 903174 - DNA, 25 bp, Mus musculus
cccggcttcgtgtatcctcagagat

SEQ ID NO: 903175 - DNA, 25 bp, Mus musculus
cccgggagcgcggcagccacagaac

SEQ ID NO: 903176 - DNA, 25 bp, Mus musculus
cccgggagcgctcgagctagaggag

SEQ ID NO: 903177 - DNA, 25 bp, Mus musculus
cccgggagcggggcagccacagaac

SEQ ID NO: 903178 - DNA, 25 bp, Mus musculus
cccgggagcggtcgagctagaggag

SEQ ID NO: 903179 - DNA, 25 bp, Mus musculus
cccgggatggagatgaggtgccact

SEQ ID NO: 903180 - DNA, 25 bp, Mus musculus
cccgggatggagttgaggtgccact

SEQ ID NO: 903181 - DNA, 25 bp, Mus musculus
cccgggcagcagagccccccaactc

SEQ ID NO: 903182 - DNA, 25 bp, Mus musculus
cccgggcagcagaggcccccaactc

SEQ ID NO: 903183 - DNA, 25 bp, Mus musculus
cccgggctggacatcatgccacagg

SEQ ID NO: 903184 - DNA, 25 bp, Mus musculus
cccgggctggtcatcatgccacagg

SEQ ID NO: 903185 - DNA, 25 bp, Mus musculus
cccggggagagaaggacttccaggc

SEQ ID NO: 903186 - DNA, 25 bp, Mus musculus
cccggggagagatggacttccaggc

SEQ ID NO: 903187 - DNA, 25 bp, Mus musculus
cccggggatacacaacatctcccgg

SEQ ID NO: 903188 - DNA, 25 bp, Mus musculus
cccggggatacacctttggggcgat

SEQ ID NO: 903189 - DNA, 25 bp, Mus musculus
cccggggatacagaacatctcccgg

SEQ ID NO: 903190 - DNA, 25 bp, Mus musculus
cccggggatacagctttggggcgat

SEQ ID NO: 903191 - DNA, 25 bp, Mus musculus
cccggggctgagctggctagagatc

SEQ ID NO: 903192 - DNA, 25 bp, Mus musculus
cccggggctgaggtggctagagatc

SEQ ID NO: 903193 - DNA, 25 bp, Mus musculus
cccgggggacacagcgtgtacactg

SEQ ID NO: 903194 - DNA, 25 bp, Mus musculus
cccgggggacacagggtgtacactg

SEQ ID NO: 903195 - DNA, 25 bp, Mus musculus
cccggtagagctatggatggatctt

SEQ ID NO: 903196 - DNA, 25 bp, Mus musculus
cccggtagaggtatggatggatctt

SEQ ID NO: 903197 - DNA, 25 bp, Mus musculus
cccggtccacagcacgattccccct

SEQ ID NO: 903198 - DNA, 25 bp, Mus musculus
cccggtccacagcaggattccccct

SEQ ID NO: 903199 - DNA, 25 bp, Mus musculus
cccggtctgcagcctttggatgaag

SEQ ID NO: 903200 - DNA, 25 bp, Mus musculus
cccggtctgcaggctttggatgaag

SEQ ID NO: 903201 - DNA, 25 bp, Mus musculus
cccggtggctcaatcatccttcctt

SEQ ID NO: 903202 - DNA, 25 bp, Mus musculus
cccggtggctcaatgatccttcctt

SEQ ID NO: 903203 - DNA, 25 bp, Mus musculus
cccggtgttgcacatatgaaacatc

SEQ ID NO: 903204 - DNA, 25 bp, Mus musculus
cccggtgttggacatatgaaacatc

SEQ ID NO: 903205 - DNA, 25 bp, Mus musculus
cccggttgtcatctatcacggtgat

SEQ ID NO: 903206 - DNA, 25 bp, Mus musculus
cccggttgtcatgtatcacggtgat

SEQ ID NO: 903207 - DNA, 25 bp, Mus musculus
cccgtagcctcagacatgctggagt

SEQ ID NO: 903208 - DNA, 25 bp, Mus musculus
cccgtagcctcagagatgctggagt

SEQ ID NO: 903209 - DNA, 25 bp, Mus musculus
cccgtcaaatatgaatacccagatg

SEQ ID NO: 903210 - DNA, 25 bp, Mus musculus
cccgtcaaatttgaatacccagatg

SEQ ID NO: 903211 - DNA, 25 bp, Mus musculus
cccgtcctgtgccacgaaagcactg

SEQ ID NO: 903212 - DNA, 25 bp, Mus musculus
cccgtcctgtgccacgcaaggtgac

SEQ ID NO: 903213 - DNA, 25 bp, Mus musculus
cccgtcctgtgccaggaaagcactg

SEQ ID NO: 903214 - DNA, 25 bp, Mus musculus
cccgtcctgtgccaggcaaggtgac

SEQ ID NO: 903215 - DNA, 25 bp, Mus musculus
cccgtcgctgatctactcccacaca

SEQ ID NO: 903216 - DNA, 25 bp, Mus musculus
cccgtcgctgatcttctcccacaca

SEQ ID NO: 903217 - DNA, 25 bp, Mus musculus
cccgtgaggactatcgcaggttcac

SEQ ID NO: 903218 - DNA, 25 bp, Mus musculus
cccgtgaggactatggcaggttcac

SEQ ID NO: 903219 - DNA, 25 bp, Mus musculus
cccgtgaggagaatctcccagaaat

SEQ ID NO: 903220 - DNA, 25 bp, Mus musculus
cccgtgaggagaatgtcccagaaat

SEQ ID NO: 903221 - DNA, 25 bp, Mus musculus
cccgtgcacccacaaaacgaagaga

SEQ ID NO: 903222 - DNA, 25 bp, Mus musculus
cccgtgcacccagaaaacgaagaga

SEQ ID NO: 903223 - DNA, 25 bp, Mus musculus
cccgtggaagacaccatcattggac

SEQ ID NO: 903224 - DNA, 25 bp, Mus musculus
cccgtggaagactccatcattggac

SEQ ID NO: 903225 - DNA, 25 bp, Mus musculus
cccgtggaggagaacggaacgcaag

SEQ ID NO: 903226 - DNA, 25 bp, Mus musculus
cccgtggaggagaagggaacgcaag

SEQ ID NO: 903227 - DNA, 25 bp, Mus musculus
cccgtggccacagacacactggagc

SEQ ID NO: 903228 - DNA, 25 bp, Mus musculus
cccgtggccacagagacactggagc

SEQ ID NO: 903229 - DNA, 25 bp, Mus musculus
cccgtggtgcgaaagaaaaagtcag

SEQ ID NO: 903230 - DNA, 25 bp, Mus musculus
cccgtggtgcgatagaaaaagtcag

SEQ ID NO: 903231 - DNA, 25 bp, Mus musculus
cccgtgttccagcaccacctctgca

SEQ ID NO: 903232 - DNA, 25 bp, Mus musculus
cccgtgttccaggaccacctctgca

SEQ ID NO: 903233 - DNA, 25 bp, Mus musculus
cccgttactgggcacgtgtctgtgc

SEQ ID NO: 903234 - DNA, 25 bp, Mus musculus
cccgttactgggcaggtgtctgtgc

SEQ ID NO: 903235 - DNA, 25 bp, Mus musculus
cccgttctagctactttgaggccat

SEQ ID NO: 903236 - DNA, 25 bp, Mus musculus
cccgttctaggtactttgaggccat

SEQ ID NO: 903237 - DNA, 25 bp, Mus musculus
cccgttgctatcatccgtgagtgca

SEQ ID NO: 903238 - DNA, 25 bp, Mus musculus
cccgttgctatcatgcgtgagtgca

SEQ ID NO: 903239 - DNA, 25 bp, Mus musculus
cccgttgtagcccacaaagtcctag

SEQ ID NO: 903240 - DNA, 25 bp, Mus musculus
cccgttgtagcccagaaagtcctag

SEQ ID NO: 903241 - DNA, 25 bp, Mus musculus
ccctaaagagctgaacattgaccac

SEQ ID NO: 903242 - DNA, 25 bp, Mus musculus
ccctaaagaggtgaacattgaccac

SEQ ID NO: 903243 - DNA, 25 bp, Mus musculus
ccctaaagatgacgcttccgtgtac

SEQ ID NO: 903244 - DNA, 25 bp, Mus musculus
ccctaaagatgaggcttccgtgtac

SEQ ID NO: 903245 - DNA, 25 bp, Mus musculus
ccctaacatgacaaaatatcttcat

SEQ ID NO: 903246 - DNA, 25 bp, Mus musculus
ccctaacatgtcaaaatatcttcat

SEQ ID NO: 903247 - DNA, 25 bp, Mus musculus
ccctaacgagcaagacaattgcccg

SEQ ID NO: 903248 - DNA, 25 bp, Mus musculus
ccctaacgagcatgacaattgcccg

SEQ ID NO: 903249 - DNA, 25 bp, Mus musculus
ccctaagcagcagccatcctcggct

SEQ ID NO: 903250 - DNA, 25 bp, Mus musculus
ccctaagcagccatcctcggctgac

SEQ ID NO: 903251 - DNA, 25 bp, Mus musculus
ccctaagcaggagccatcctcggct

SEQ ID NO: 903252 - DNA, 25 bp, Mus musculus
ccctaagcaggcatcctcggctgac

SEQ ID NO: 903253 - DNA, 25 bp, Mus musculus
ccctaatatgagcaactgtactgag

SEQ ID NO: 903254 - DNA, 25 bp, Mus musculus
ccctaatatgaggaactgtactgag

SEQ ID NO: 903255 - DNA, 25 bp, Mus musculus
ccctacaactataactcggatgttt

SEQ ID NO: 903256 - DNA, 25 bp, Mus musculus
ccctacaactataagtcggatgttt

SEQ ID NO: 903257 - DNA, 25 bp, Mus musculus
ccctacaagccaccaatcagagcga

SEQ ID NO: 903258 - DNA, 25 bp, Mus musculus
ccctacaagccagcaatcagagcga

SEQ ID NO: 903259 - DNA, 25 bp, Mus musculus
ccctacacagagcctcggtgggggc

SEQ ID NO: 903260 - DNA, 25 bp, Mus musculus
ccctacacagaggctcggtgggggc

SEQ ID NO: 903261 - DNA, 25 bp, Mus musculus
ccctacagaccaaacatggatgcat

SEQ ID NO: 903262 - DNA, 25 bp, Mus musculus
ccctacagaccaaagatggatgcat

SEQ ID NO: 903263 - DNA, 25 bp, Mus musculus
ccctacagcgctgtcatgatgacca

SEQ ID NO: 903264 - DNA, 25 bp, Mus musculus
ccctacagcgctgtgatgatgacca

SEQ ID NO: 903265 - DNA, 25 bp, Mus musculus
ccctacagtcctcacgcaaacaggt

SEQ ID NO: 903266 - DNA, 25 bp, Mus musculus
ccctacagtcctcaggcaaacaggt

SEQ ID NO: 903267 - DNA, 25 bp, Mus musculus
ccctaccatgtgaacttccgctcgc

SEQ ID NO: 903268 - DNA, 25 bp, Mus musculus
ccctaccatgtgaagttccgctcgc

SEQ ID NO: 903269 - DNA, 25 bp, Mus musculus
ccctacccagccacttgaacctgac

SEQ ID NO: 903270 - DNA, 25 bp, Mus musculus
ccctacccagctggaatggaacatg

SEQ ID NO: 903271 - DNA, 25 bp, Mus musculus
ccctacccaggcacttgaacctgac

SEQ ID NO: 903272 - DNA, 25 bp, Mus musculus
ccctacccaggtggaatggaacatg

SEQ ID NO: 903273 - DNA, 25 bp, Mus musculus
ccctaccgcaagcaccagtctctgg

SEQ ID NO: 903274 - DNA, 25 bp, Mus musculus
ccctaccgcaagcagcagtctctgg

SEQ ID NO: 903275 - DNA, 25 bp, Mus musculus
ccctaccgggaagaccaatgttttg

SEQ ID NO: 903276 - DNA, 25 bp, Mus musculus
ccctaccgggaagagcaatgttttg

SEQ ID NO: 903277 - DNA, 25 bp, Mus musculus
ccctacctctgaaacgtggttccat

SEQ ID NO: 903278 - DNA, 25 bp, Mus musculus
ccctacctctgaaaggtggttccat

SEQ ID NO: 903279 - DNA, 25 bp, Mus musculus
ccctacgcacagagtatgataggct

SEQ ID NO: 903280 - DNA, 25 bp, Mus musculus
ccctacgcacagtgtatgataggct

SEQ ID NO: 903281 - DNA, 25 bp, Mus musculus
ccctacgcagctcccacagatacgt

SEQ ID NO: 903282 - DNA, 25 bp, Mus musculus
ccctacgcagctcctgtccagagtg

SEQ ID NO: 903283 - DNA, 25 bp, Mus musculus
ccctacgcaggtcccacagatacgt

SEQ ID NO: 903284 - DNA, 25 bp, Mus musculus
ccctacgcaggtcctgtccagagtg

SEQ ID NO: 903285 - DNA, 25 bp, Mus musculus
ccctacggcgatttcgtcgctttga

SEQ ID NO: 903286 - DNA, 25 bp, Mus musculus
ccctacggcgatttggtcgctttga

SEQ ID NO: 903287 - DNA, 25 bp, Mus musculus
ccctactacgcaccccctaataagt

SEQ ID NO: 903288 - DNA, 25 bp, Mus musculus
ccctactacgcagcccctaataagt

SEQ ID NO: 903289 - DNA, 25 bp, Mus musculus
ccctactcagccctcctggtatgta

SEQ ID NO: 903290 - DNA, 25 bp, Mus musculus
ccctactcaggcctcctggtatgta

SEQ ID NO: 903291 - DNA, 25 bp, Mus musculus
ccctactgtttgtgagctgtgtttt

SEQ ID NO: 903292 - DNA, 25 bp, Mus musculus
ccctactgtttgtgtgctgtgtttt

SEQ ID NO: 903293 - DNA, 25 bp, Mus musculus
ccctacttccctcctaaccaggaga

SEQ ID NO: 903294 - DNA, 25 bp, Mus musculus
ccctacttccctgctaaccaggaga

SEQ ID NO: 903295 - DNA, 25 bp, Mus musculus
ccctagaaagaacacagcatccagt

SEQ ID NO: 903296 - DNA, 25 bp, Mus musculus
ccctagaaagaacagagcatccagt

SEQ ID NO: 903297 - DNA, 25 bp, Mus musculus
ccctagatatcaaagtctggatgaa

SEQ ID NO: 903298 - DNA, 25 bp, Mus musculus
ccctagatatgaaagtctggatgaa

SEQ ID NO: 903299 - DNA, 25 bp, Mus musculus
ccctagcaaaccattgacaaaggac

SEQ ID NO: 903300 - DNA, 25 bp, Mus musculus
ccctagcaaacctttgacaaaggac

SEQ ID NO: 903301 - DNA, 25 bp, Mus musculus
ccctagccgcagcctcgcgcggctg

SEQ ID NO: 903302 - DNA, 25 bp, Mus musculus
ccctagccgcaggctcgcgcggctg

SEQ ID NO: 903303 - DNA, 25 bp, Mus musculus
ccctagcctacccacgaagaagctc

SEQ ID NO: 903304 - DNA, 25 bp, Mus musculus
ccctagcctacccaggaagaagctc

SEQ ID NO: 903305 - DNA, 25 bp, Mus musculus
ccctagcttgggcgctttcaggtag

SEQ ID NO: 903306 - DNA, 25 bp, Mus musculus
ccctagcttgggggctttcaggtag

SEQ ID NO: 903307 - DNA, 25 bp, Mus musculus
ccctaggagaagggaaatatgctgg

SEQ ID NO: 903308 - DNA, 25 bp, Mus musculus
ccctaggagaagggtaatatgctgg

SEQ ID NO: 903309 - DNA, 25 bp, Mus musculus
ccctaggagagattcatgctgcacc

SEQ ID NO: 903310 - DNA, 25 bp, Mus musculus
ccctaggagagattgatgctgcacc

SEQ ID NO: 903311 - DNA, 25 bp, Mus musculus
ccctaggagggattcatgctgcacc

SEQ ID NO: 903312 - DNA, 25 bp, Mus musculus
ccctaggagggattgatgctgcacc

SEQ ID NO: 903313 - DNA, 25 bp, Mus musculus
ccctagtgactggacgattctgtac

SEQ ID NO: 903314 - DNA, 25 bp, Mus musculus
ccctagtgactggaggattctgtac

SEQ ID NO: 903315 - DNA, 25 bp, Mus musculus
ccctatagtgaatacttcgagtact

SEQ ID NO: 903316 - DNA, 25 bp, Mus musculus
ccctatagtgtatacttcgagtact

SEQ ID NO: 903317 - DNA, 25 bp, Mus musculus
ccctatatccagcaggagtttctcc

SEQ ID NO: 903318 - DNA, 25 bp, Mus musculus
ccctatatccaggaggagtttctcc

SEQ ID NO: 903319 - DNA, 25 bp, Mus musculus
ccctatcagaacaccatcggggctg

SEQ ID NO: 903320 - DNA, 25 bp, Mus musculus
ccctatcagaactccatcggggctg

SEQ ID NO: 903321 - DNA, 25 bp, Mus musculus
ccctatccttcacaccatttggaag

SEQ ID NO: 903322 - DNA, 25 bp, Mus musculus
ccctatccttcacagcatttggaag

SEQ ID NO: 903323 - DNA, 25 bp, Mus musculus
ccctatgaagatgaaaacacagctg

SEQ ID NO: 903324 - DNA, 25 bp, Mus musculus
ccctatgaagcgaacgacggatctt

SEQ ID NO: 903325 - DNA, 25 bp, Mus musculus
ccctatgaagcgaaggacggatctt

SEQ ID NO: 903326 - DNA, 25 bp, Mus musculus
ccctatgaagttgaaaacacagctg

SEQ ID NO: 903327 - DNA, 25 bp, Mus musculus
ccctatgcaacagctgcaaaagcag

SEQ ID NO: 903328 - DNA, 25 bp, Mus musculus
ccctatgcaagagctgcaaaagcag

SEQ ID NO: 903329 - DNA, 25 bp, Mus musculus
ccctatgcagtcatcgctcttgaga

SEQ ID NO: 903330 - DNA, 25 bp, Mus musculus
ccctatgcagtcatggctcttgaga

SEQ ID NO: 903331 - DNA, 25 bp, Mus musculus
ccctatgcccaacgttgtgatggtg

SEQ ID NO: 903332 - DNA, 25 bp, Mus musculus
ccctatgcccaaggttgtgatggtg

SEQ ID NO: 903333 - DNA, 25 bp, Mus musculus
ccctatgctctggacactcttctca

SEQ ID NO: 903334 - DNA, 25 bp, Mus musculus
ccctatgctctggagactcttctca

SEQ ID NO: 903335 - DNA, 25 bp, Mus musculus
ccctatggcaatctcgcctttcccc

SEQ ID NO: 903336 - DNA, 25 bp, Mus musculus
ccctatggcaatgtcgcctttcccc

SEQ ID NO: 903337 - DNA, 25 bp, Mus musculus
ccctatggctcgccacagattgtac

SEQ ID NO: 903338 - DNA, 25 bp, Mus musculus
ccctatggctggccacagattgtac

SEQ ID NO: 903339 - DNA, 25 bp, Mus musculus
ccctattgatggctacctgtcccac

SEQ ID NO: 903340 - DNA, 25 bp, Mus musculus
ccctattgatgggtacctgtcccac

SEQ ID NO: 903341 - DNA, 25 bp, Mus musculus
ccctattgtagtaacccaattacct

SEQ ID NO: 903342 - DNA, 25 bp, Mus musculus
ccctattgtagtaagccaattacct

SEQ ID NO: 903343 - DNA, 25 bp, Mus musculus
ccctcaaaccagctgatcatgctaa

SEQ ID NO: 903344 - DNA, 25 bp, Mus musculus
ccctcaaaccaggtgatcatgctaa

SEQ ID NO: 903345 - DNA, 25 bp, Mus musculus
ccctcaaagacaacaacacctacac

SEQ ID NO: 903346 - DNA, 25 bp, Mus musculus
ccctcaaagacatcaacacctacac

SEQ ID NO: 903347 - DNA, 25 bp, Mus musculus
ccctcaacagcttgtctgaaaacca

SEQ ID NO: 903348 - DNA, 25 bp, Mus musculus
ccctcaacaggttgtctgaaaacca

SEQ ID NO: 903349 - DNA, 25 bp, Mus musculus
ccctcaagaaagaacactcctgcca

SEQ ID NO: 903350 - DNA, 25 bp, Mus musculus
ccctcaagaaagaagactcctgcca

SEQ ID NO: 903351 - DNA, 25 bp, Mus musculus
ccctcaagtctgagtttgtgatcct

SEQ ID NO: 903352 - DNA, 25 bp, Mus musculus
ccctcaagtctgtgtttgtgatcct

SEQ ID NO: 903353 - DNA, 25 bp, Mus musculus
ccctcaatgtcaaccaccccagtcc

SEQ ID NO: 903354 - DNA, 25 bp, Mus musculus
ccctcaatgtcaacgaccccagtcc

SEQ ID NO: 903355 - DNA, 25 bp, Mus musculus
ccctcacaagataatcgttatgtac

SEQ ID NO: 903356 - DNA, 25 bp, Mus musculus
ccctcacaagttaatcgttatgtac

SEQ ID NO: 903357 - DNA, 25 bp, Mus musculus
ccctcacagagcacagctgtcccag

SEQ ID NO: 903358 - DNA, 25 bp, Mus musculus
ccctcacagagcactgctgtcccag

SEQ ID NO: 903359 - DNA, 25 bp, Mus musculus
ccctcaccagacaatccctgttgtt

SEQ ID NO: 903360 - DNA, 25 bp, Mus musculus
ccctcaccagtcaatccctgttgtt

SEQ ID NO: 903361 - DNA, 25 bp, Mus musculus
ccctcacccagccactctcaggcga

SEQ ID NO: 903362 - DNA, 25 bp, Mus musculus
ccctcacccagccagtctcaggcga

SEQ ID NO: 903363 - DNA, 25 bp, Mus musculus
ccctcagaagcaactccatcgcctg

SEQ ID NO: 903364 - DNA, 25 bp, Mus musculus
ccctcagaagcatctccatcgcctg

SEQ ID NO: 903365 - DNA, 25 bp, Mus musculus
ccctcagaccagcacaacgagatgg

SEQ ID NO: 903366 - DNA, 25 bp, Mus musculus
ccctcagaccagcagaacgagatgg

SEQ ID NO: 903367 - DNA, 25 bp, Mus musculus
ccctcagactcgcggtcgcatccct

SEQ ID NO: 903368 - DNA, 25 bp, Mus musculus
ccctcagactcgctacctcggaatc

SEQ ID NO: 903369 - DNA, 25 bp, Mus musculus
ccctcagactcgctcccccagaggt

SEQ ID NO: 903370 - DNA, 25 bp, Mus musculus
ccctcagactcggggtcgcatccct

SEQ ID NO: 903371 - DNA, 25 bp, Mus musculus
ccctcagactcggtacctcggaatc

SEQ ID NO: 903372 - DNA, 25 bp, Mus musculus
ccctcagactcggtcccccagaggt

SEQ ID NO: 903373 - DNA, 25 bp, Mus musculus
ccctcagcccagcatctagagtcat

SEQ ID NO: 903374 - DNA, 25 bp, Mus musculus
ccctcagcccagcgtctccctacag

SEQ ID NO: 903375 - DNA, 25 bp, Mus musculus
ccctcagcccagctggtgctctggg

SEQ ID NO: 903376 - DNA, 25 bp, Mus musculus
ccctcagcccaggatctagagtcat

SEQ ID NO: 903377 - DNA, 25 bp, Mus musculus
ccctcagcccagggtctccctacag

SEQ ID NO: 903378 - DNA, 25 bp, Mus musculus
ccctcagcccaggtggtgctctggg

SEQ ID NO: 903379 - DNA, 25 bp, Mus musculus
ccctcagcccctcgctgccaccatg

SEQ ID NO: 903380 - DNA, 25 bp, Mus musculus
ccctcagcccctggctgccaccatg

SEQ ID NO: 903381 - DNA, 25 bp, Mus musculus
ccctcagctgcaccctacttaggag

SEQ ID NO: 903382 - DNA, 25 bp, Mus musculus
ccctcagctgcagcctacttaggag

SEQ ID NO: 903383 - DNA, 25 bp, Mus musculus
ccctcagctgctcctggacttctag

SEQ ID NO: 903384 - DNA, 25 bp, Mus musculus
ccctcagctggtcctggacttctag

SEQ ID NO: 903385 - DNA, 25 bp, Mus musculus
ccctcagcttcaagcagcttatatg

SEQ ID NO: 903386 - DNA, 25 bp, Mus musculus
ccctcagcttgaagcagcttatatg

SEQ ID NO: 903387 - DNA, 25 bp, Mus musculus
ccctcaggggttcacatgccccata

SEQ ID NO: 903388 - DNA, 25 bp, Mus musculus
ccctcaggggttcacccaacaattc

SEQ ID NO: 903389 - DNA, 25 bp, Mus musculus
ccctcaggggttcagatgccccata

SEQ ID NO: 903390 - DNA, 25 bp, Mus musculus
ccctcaggggttcagccaacaattc

SEQ ID NO: 903391 - DNA, 25 bp, Mus musculus
ccctcagtggctcccacagatacgt

SEQ ID NO: 903392 - DNA, 25 bp, Mus musculus
ccctcagtgggtcccacagatacgt

SEQ ID NO: 903393 - DNA, 25 bp, Mus musculus
ccctcagttaatatgagaagtcaga

SEQ ID NO: 903394 - DNA, 25 bp, Mus musculus
ccctcagttattatgagaagtcaga

SEQ ID NO: 903395 - DNA, 25 bp, Mus musculus
ccctcatgcattaagtcttgtgata

SEQ ID NO: 903396 - DNA, 25 bp, Mus musculus
ccctcatgcatttagtcttgtgata

SEQ ID NO: 903397 - DNA, 25 bp, Mus musculus
ccctcatgttatcactcaacaagga

SEQ ID NO: 903398 - DNA, 25 bp, Mus musculus
ccctcatgttatgactcaacaagga

SEQ ID NO: 903399 - DNA, 25 bp, Mus musculus
ccctcatttgtcctacatgtaacgt

SEQ ID NO: 903400 - DNA, 25 bp, Mus musculus
ccctcatttgtccttcatgtaacgt

SEQ ID NO: 903401 - DNA, 25 bp, Mus musculus
ccctccagagctgcctggagttgca

SEQ ID NO: 903402 - DNA, 25 bp, Mus musculus
ccctccagaggtgcctggagttgca

SEQ ID NO: 903403 - DNA, 25 bp, Mus musculus
ccctccatttcactgctaatcattg

SEQ ID NO: 903404 - DNA, 25 bp, Mus musculus
ccctccatttcacttgctaatcatt

SEQ ID NO: 903405 - DNA, 25 bp, Mus musculus
ccctccatttcagtgctaatcattg

SEQ ID NO: 903406 - DNA, 25 bp, Mus musculus
ccctccatttcagttgctaatcatt

SEQ ID NO: 903407 - DNA, 25 bp, Mus musculus
ccctccccagatgtagctggtagaa

SEQ ID NO: 903408 - DNA, 25 bp, Mus musculus
ccctccccagcaacattgaccatgt

SEQ ID NO: 903409 - DNA, 25 bp, Mus musculus
ccctccccagcaatctactctcctt

SEQ ID NO: 903410 - DNA, 25 bp, Mus musculus
ccctccccaggaacattgaccatgt

SEQ ID NO: 903411 - DNA, 25 bp, Mus musculus
ccctccccaggaatctactctcctt

SEQ ID NO: 903412 - DNA, 25 bp, Mus musculus
ccctccccagttgtagctggtagaa

SEQ ID NO: 903413 - DNA, 25 bp, Mus musculus
ccctccctgacaaacgtgactctcg

SEQ ID NO: 903414 - DNA, 25 bp, Mus musculus
ccctccctgacaaaggtgactctcg

SEQ ID NO: 903415 - DNA, 25 bp, Mus musculus
ccctccctgactcttggcatggtca

SEQ ID NO: 903416 - DNA, 25 bp, Mus musculus
ccctccctgagtcttggcatggtca

SEQ ID NO: 903417 - DNA, 25 bp, Mus musculus
ccctccgtgaagaggaaggcctgaa

SEQ ID NO: 903418 - DNA, 25 bp, Mus musculus
ccctccgtgaagtggaaggcctgaa

SEQ ID NO: 903419 - DNA, 25 bp, Mus musculus
ccctcctacacacaccgagtcctat

SEQ ID NO: 903420 - DNA, 25 bp, Mus musculus
ccctcctacacagaccgagtcctat

SEQ ID NO: 903421 - DNA, 25 bp, Mus musculus
ccctcctctgcacttgttgacctcc

SEQ ID NO: 903422 - DNA, 25 bp, Mus musculus
ccctcctctgcagttgttgacctcc

SEQ ID NO: 903423 - DNA, 25 bp, Mus musculus
ccctcctgcccacgtttgcacaccc

SEQ ID NO: 903424 - DNA, 25 bp, Mus musculus
ccctcctgcccaggtttgcacaccc

SEQ ID NO: 903425 - DNA, 25 bp, Mus musculus
ccctcctgctgtcaagtgggctagt

SEQ ID NO: 903426 - DNA, 25 bp, Mus musculus
ccctcctgctgtgaagtgggctagt

SEQ ID NO: 903427 - DNA, 25 bp, Mus musculus
ccctccttccttcacaagagttcgc

SEQ ID NO: 903428 - DNA, 25 bp, Mus musculus
ccctccttccttcagaagagttcgc

SEQ ID NO: 903429 - DNA, 25 bp, Mus musculus
ccctcgaaggatgcagctccacccc

SEQ ID NO: 903430 - DNA, 25 bp, Mus musculus
ccctcgaaggttgcagctccacccc

SEQ ID NO: 903431 - DNA, 25 bp, Mus musculus
ccctcgacagtgcgtcttccagcca

SEQ ID NO: 903432 - DNA, 25 bp, Mus musculus
ccctcgacagtgggtcttccagcca

SEQ ID NO: 903433 - DNA, 25 bp, Mus musculus
ccctcgaccgctcatctttggtgtc

SEQ ID NO: 903434 - DNA, 25 bp, Mus musculus
ccctcgaccggtcatctttggtgtc

SEQ ID NO: 903435 - DNA, 25 bp, Mus musculus
ccctcgacctgcttcgaatgatgga

SEQ ID NO: 903436 - DNA, 25 bp, Mus musculus
ccctcgacctgcttggaatgatgga

SEQ ID NO: 903437 - DNA, 25 bp, Mus musculus
ccctcgagttaacgccacagctttt

SEQ ID NO: 903438 - DNA, 25 bp, Mus musculus
ccctcgagttaaggccacagctttt

SEQ ID NO: 903439 - DNA, 25 bp, Mus musculus
ccctcgatcaactcaataaagccgt

SEQ ID NO: 903440 - DNA, 25 bp, Mus musculus
ccctcgatcaactcagccggctcaa

SEQ ID NO: 903441 - DNA, 25 bp, Mus musculus
ccctcgatcaactctataaagccgt

SEQ ID NO: 903442 - DNA, 25 bp, Mus musculus
ccctcgatcaactctgccggctcaa

SEQ ID NO: 903443 - DNA, 25 bp, Mus musculus
ccctcgatgacatgtgatcttcgtg

SEQ ID NO: 903444 - DNA, 25 bp, Mus musculus
ccctcgatgagatgtgatcttcgtg

SEQ ID NO: 903445 - DNA, 25 bp, Mus musculus
ccctcgccaactcacattcgatgta

SEQ ID NO: 903446 - DNA, 25 bp, Mus musculus
ccctcgccaactcagattcgatgta

SEQ ID NO: 903447 - DNA, 25 bp, Mus musculus
ccctcgccttcaccacaggtgcagc

SEQ ID NO: 903448 - DNA, 25 bp, Mus musculus
ccctcgccttcacgtgcagcagtga

SEQ ID NO: 903449 - DNA, 25 bp, Mus musculus
ccctcgccttcagcacaggtgcagc

SEQ ID NO: 903450 - DNA, 25 bp, Mus musculus
ccctcgccttcaggtgcagcagtga

SEQ ID NO: 903451 - DNA, 25 bp, Mus musculus
ccctcgggagattatcaacacatac

SEQ ID NO: 903452 - DNA, 25 bp, Mus musculus
ccctcgggagtttatcaacacatac

SEQ ID NO: 903453 - DNA, 25 bp, Mus musculus
ccctcggtcacacgtatcatggctg

SEQ ID NO: 903454 - DNA, 25 bp, Mus musculus
ccctcggtcacaggtatcatggctg

SEQ ID NO: 903455 - DNA, 25 bp, Mus musculus
ccctctaaaacactgcctccccact

SEQ ID NO: 903456 - DNA, 25 bp, Mus musculus
ccctctaaaacagtgcctccccact

SEQ ID NO: 903457 - DNA, 25 bp, Mus musculus
ccctctaacctgcaacccagcctat

SEQ ID NO: 903458 - DNA, 25 bp, Mus musculus
ccctctaacctgcatcccagcctat

SEQ ID NO: 903459 - DNA, 25 bp, Mus musculus
ccctctaatgtcaacggcctgtccg

SEQ ID NO: 903460 - DNA, 25 bp, Mus musculus
ccctctaatgtcaagggcctgtccg

SEQ ID NO: 903461 - DNA, 25 bp, Mus musculus
ccctctacagattcaggcctggtct

SEQ ID NO: 903462 - DNA, 25 bp, Mus musculus
ccctctacagcagttttcttcaact

SEQ ID NO: 903463 - DNA, 25 bp, Mus musculus
ccctctacaggagttttcttcaact

SEQ ID NO: 903464 - DNA, 25 bp, Mus musculus
ccctctacagtttcaggcctggtct

SEQ ID NO: 903465 - DNA, 25 bp, Mus musculus
ccctctacttcaagaagagaacaat

SEQ ID NO: 903466 - DNA, 25 bp, Mus musculus
ccctctacttcatgaagagaacaat

SEQ ID NO: 903467 - DNA, 25 bp, Mus musculus
ccctctataaagcattgaggccaag

SEQ ID NO: 903468 - DNA, 25 bp, Mus musculus
ccctctataaaggattgaggccaag

SEQ ID NO: 903469 - DNA, 25 bp, Mus musculus
ccctctatatcacgcgtgggacttt

SEQ ID NO: 903470 - DNA, 25 bp, Mus musculus
ccctctatatcacgggtgggacttt

SEQ ID NO: 903471 - DNA, 25 bp, Mus musculus
ccctctcaagctcagccttttcttc

SEQ ID NO: 903472 - DNA, 25 bp, Mus musculus
ccctctcaaggtcagccttttcttc

SEQ ID NO: 903473 - DNA, 25 bp, Mus musculus
ccctctccaagtatctaggaggagt

SEQ ID NO: 903474 - DNA, 25 bp, Mus musculus
ccctctccaagtatgtaggaggagt

SEQ ID NO: 903475 - DNA, 25 bp, Mus musculus
ccctctcctgaaagcgctgagaagc

SEQ ID NO: 903476 - DNA, 25 bp, Mus musculus
ccctctcctgaatgcgctgagaagc

SEQ ID NO: 903477 - DNA, 25 bp, Mus musculus
ccctctctgcctaacgggcagactc

SEQ ID NO: 903478 - DNA, 25 bp, Mus musculus
ccctctctgcctaaggggcagactc

SEQ ID NO: 903479 - DNA, 25 bp, Mus musculus
ccctctctggaacagttcaagattt

SEQ ID NO: 903480 - DNA, 25 bp, Mus musculus
ccctctctggaagagttcaagattt

SEQ ID NO: 903481 - DNA, 25 bp, Mus musculus
ccctctctggcacaacccctgtgat

SEQ ID NO: 903482 - DNA, 25 bp, Mus musculus
ccctctctggcagaacccctgtgat

SEQ ID NO: 903483 - DNA, 25 bp, Mus musculus
ccctctgaaactctgccgatcccct

SEQ ID NO: 903484 - DNA, 25 bp, Mus musculus
ccctctgaaactgtgccgatcccct

SEQ ID NO: 903485 - DNA, 25 bp, Mus musculus
ccctctgcagtcaaatgacaaggaa

SEQ ID NO: 903486 - DNA, 25 bp, Mus musculus
ccctctgcagtcaattgacaaggaa

SEQ ID NO: 903487 - DNA, 25 bp, Mus musculus
ccctctgcccagcacggtgaagagg

SEQ ID NO: 903488 - DNA, 25 bp, Mus musculus
ccctctgcccagcagggtgaagagg

SEQ ID NO: 903489 - DNA, 25 bp, Mus musculus
ccctctgctagtctccttgaacgtc

SEQ ID NO: 903490 - DNA, 25 bp, Mus musculus
ccctctgctagtgtccttgaacgtc

SEQ ID NO: 903491 - DNA, 25 bp, Mus musculus
ccctctggacagatgctgattatgg

SEQ ID NO: 903492 - DNA, 25 bp, Mus musculus
ccctctggacagttgctgattatgg

SEQ ID NO: 903493 - DNA, 25 bp, Mus musculus
ccctctggagatcctctggaccttc

SEQ ID NO: 903494 - DNA, 25 bp, Mus musculus
ccctctggagttcctctggaccttc

SEQ ID NO: 903495 - DNA, 25 bp, Mus musculus
ccctctgtaaagagatggctgcagc

SEQ ID NO: 903496 - DNA, 25 bp, Mus musculus
ccctctgtaaagtgatggctgcagc

SEQ ID NO: 903497 - DNA, 25 bp, Mus musculus
ccctctgtgcagaacattcaaggta

SEQ ID NO: 903498 - DNA, 25 bp, Mus musculus
ccctctgtgcagaagattcaaggta

SEQ ID NO: 903499 - DNA, 25 bp, Mus musculus
ccctctgtgccgaacatctcatcat

SEQ ID NO: 903500 - DNA, 25 bp, Mus musculus
ccctctgtgccgtacatctcatcat

SEQ ID NO: 903501 - DNA, 25 bp, Mus musculus
ccctcttcctggagttccctgagga

SEQ ID NO: 903502 - DNA, 25 bp, Mus musculus
ccctcttcctggtgttccctgagga

SEQ ID NO: 903503 - DNA, 25 bp, Mus musculus
ccctcttctcaacgacatgtttgga

SEQ ID NO: 903504 - DNA, 25 bp, Mus musculus
ccctcttctcaaggacatgtttgga

SEQ ID NO: 903505 - DNA, 25 bp, Mus musculus
ccctcttctcccctcacagacccgg

SEQ ID NO: 903506 - DNA, 25 bp, Mus musculus
ccctcttctcccctcgtttctgtat

SEQ ID NO: 903507 - DNA, 25 bp, Mus musculus
ccctcttctcccctgacagacccgg

SEQ ID NO: 903508 - DNA, 25 bp, Mus musculus
ccctcttctcccctggtttctgtat

SEQ ID NO: 903509 - DNA, 25 bp, Mus musculus
ccctcttctgcacatcgagtcacgt

SEQ ID NO: 903510 - DNA, 25 bp, Mus musculus
ccctcttctggacatcgagtcacgt

SEQ ID NO: 903511 - DNA, 25 bp, Mus musculus
ccctgaaaagagcaggtgtgcattg

SEQ ID NO: 903512 - DNA, 25 bp, Mus musculus
ccctgaaaagtgcaggtgtgcattg

SEQ ID NO: 903513 - DNA, 25 bp, Mus musculus
ccctgaaacaatcgttgaaatttgg

SEQ ID NO: 903514 - DNA, 25 bp, Mus musculus
ccctgaaacaatggttgaaatttgg

SEQ ID NO: 903515 - DNA, 25 bp, Mus musculus
ccctgaaatgccattatccaattgg

SEQ ID NO: 903516 - DNA, 25 bp, Mus musculus
ccctgaaatggcattatccaattgg

SEQ ID NO: 903517 - DNA, 25 bp, Mus musculus
ccctgaaccaatattttcatggact

SEQ ID NO: 903518 - DNA, 25 bp, Mus musculus
ccctgaaccaattttttcatggact

SEQ ID NO: 903519 - DNA, 25 bp, Mus musculus
ccctgaactccgaacaggactatcc

SEQ ID NO: 903520 - DNA, 25 bp, Mus musculus
ccctgaactccgaagaggactatcc

SEQ ID NO: 903521 - DNA, 25 bp, Mus musculus
ccctgaagagcactgcattatctgt

SEQ ID NO: 903522 - DNA, 25 bp, Mus musculus
ccctgaagaggactgcattatctgt

SEQ ID NO: 903523 - DNA, 25 bp, Mus musculus
ccctgaaggaatgccatatcaacga

SEQ ID NO: 903524 - DNA, 25 bp, Mus musculus
ccctgaaggaatgcgatatcaacga

SEQ ID NO: 903525 - DNA, 25 bp, Mus musculus
ccctgaaggtgtcgttcggacaaag

SEQ ID NO: 903526 - DNA, 25 bp, Mus musculus
ccctgaaggtgtggttcggacaaag

SEQ ID NO: 903527 - DNA, 25 bp, Mus musculus
ccctgacaacaacagcctggccatc

SEQ ID NO: 903528 - DNA, 25 bp, Mus musculus
ccctgacaacaagagcctggccatc

SEQ ID NO: 903529 - DNA, 25 bp, Mus musculus
ccctgacacacctccgggccctcat

SEQ ID NO: 903530 - DNA, 25 bp, Mus musculus
ccctgacacacctcggggccctcat

SEQ ID NO: 903531 - DNA, 25 bp, Mus musculus
ccctgaccgaagagctctggctgga

SEQ ID NO: 903532 - DNA, 25 bp, Mus musculus
ccctgaccgaagtgctctggctgga

SEQ ID NO: 903533 - DNA, 25 bp, Mus musculus
ccctgaccgggactacctgagaaag

SEQ ID NO: 903534 - DNA, 25 bp, Mus musculus
ccctgaccgggagtacctgagaaag

SEQ ID NO: 903535 - DNA, 25 bp, Mus musculus
ccctgactcgatcgcaccgcatgcg

SEQ ID NO: 903536 - DNA, 25 bp, Mus musculus
ccctgactcgatggcaccgcatgcg

SEQ ID NO: 903537 - DNA, 25 bp, Mus musculus
ccctgagaaactcggtgctcttctc

SEQ ID NO: 903538 - DNA, 25 bp, Mus musculus
ccctgagaaactgggtgctcttctc

SEQ ID NO: 903539 - DNA, 25 bp, Mus musculus
ccctgagactcccagcaaattcccc

SEQ ID NO: 903540 - DNA, 25 bp, Mus musculus
ccctgagactgccagcaaattcccc

SEQ ID NO: 903541 - DNA, 25 bp, Mus musculus
ccctgagagtcctgaggattgtgaa

SEQ ID NO: 903542 - DNA, 25 bp, Mus musculus
ccctgagagtcctgtggattgtgaa

SEQ ID NO: 903543 - DNA, 25 bp, Mus musculus
ccctgagatgggagcctgcatggta

SEQ ID NO: 903544 - DNA, 25 bp, Mus musculus
ccctgagatgggtgcctgcatggta

SEQ ID NO: 903545 - DNA, 25 bp, Mus musculus
ccctgagcaaagagatcctttttcg

SEQ ID NO: 903546 - DNA, 25 bp, Mus musculus
ccctgagcaaagtgatcctttttcg

SEQ ID NO: 903547 - DNA, 25 bp, Mus musculus
ccctgagcagcagtctgcaggtgct

SEQ ID NO: 903548 - DNA, 25 bp, Mus musculus
ccctgagcaggagtctgcaggtgct

SEQ ID NO: 903549 - DNA, 25 bp, Mus musculus
ccctgagcgactgacgcaattaaaa

SEQ ID NO: 903550 - DNA, 25 bp, Mus musculus
ccctgagcgactgacgtctgccgac

SEQ ID NO: 903551 - DNA, 25 bp, Mus musculus
ccctgagcgactgaggcaattaaaa

SEQ ID NO: 903552 - DNA, 25 bp, Mus musculus
ccctgagcgactgaggtctgccgac

SEQ ID NO: 903553 - DNA, 25 bp, Mus musculus
ccctgagctgcacaagtgacgcaga

SEQ ID NO: 903554 - DNA, 25 bp, Mus musculus
ccctgagctggacaagtgacgcaga

SEQ ID NO: 903555 - DNA, 25 bp, Mus musculus
ccctgaggaaccatgttcaccagat

SEQ ID NO: 903556 - DNA, 25 bp, Mus musculus
ccctgaggaagcatgttcaccagat

SEQ ID NO: 903557 - DNA, 25 bp, Mus musculus
ccctgaggactcgcactacctgttt

SEQ ID NO: 903558 - DNA, 25 bp, Mus musculus
ccctgaggactcgctctacctgttt

SEQ ID NO: 903559 - DNA, 25 bp, Mus musculus
ccctgaggatgcagtggatgaaccc

SEQ ID NO: 903560 - DNA, 25 bp, Mus musculus
ccctgaggatgctgtggatgaaccc

SEQ ID NO: 903561 - DNA, 25 bp, Mus musculus
ccctgataagagactatggtggtta

SEQ ID NO: 903562 - DNA, 25 bp, Mus musculus
ccctgataagagtctatggtggtta

SEQ ID NO: 903563 - DNA, 25 bp, Mus musculus
ccctgatcacaaagcagacccagga

SEQ ID NO: 903564 - DNA, 25 bp, Mus musculus
ccctgatcacaatgcagacccagga

SEQ ID NO: 903565 - DNA, 25 bp, Mus musculus
ccctgatctgcgccggtcagggaaa

SEQ ID NO: 903566 - DNA, 25 bp, Mus musculus
ccctgatctgcggcggtcagggaaa

SEQ ID NO: 903567 - DNA, 25 bp, Mus musculus
ccctgattccacccttcttgccacc

SEQ ID NO: 903568 - DNA, 25 bp, Mus musculus
ccctgattccacgcttcttgccacc

SEQ ID NO: 903569 - DNA, 25 bp, Mus musculus
ccctgattttaacgtgttcagatac

SEQ ID NO: 903570 - DNA, 25 bp, Mus musculus
ccctgattttaaggtgttcagatac

SEQ ID NO: 903571 - DNA, 25 bp, Mus musculus
ccctgcaaagattcctgcgacggag

SEQ ID NO: 903572 - DNA, 25 bp, Mus musculus
ccctgcaaagcttttccatctcctc

SEQ ID NO: 903573 - DNA, 25 bp, Mus musculus
ccctgcaaaggttttccatctcctc

SEQ ID NO: 903574 - DNA, 25 bp, Mus musculus
ccctgcaaagtttcctgcgacggag

SEQ ID NO: 903575 - DNA, 25 bp, Mus musculus
ccctgcaagagtcgtgcgtgggctg

SEQ ID NO: 903576 - DNA, 25 bp, Mus musculus
ccctgcaagagtggtgcgtgggctg

SEQ ID NO: 903577 - DNA, 25 bp, Mus musculus
ccctgcaagccactggaatacccac

SEQ ID NO: 903578 - DNA, 25 bp, Mus musculus
ccctgcaagccagtggaatacccac

SEQ ID NO: 903579 - DNA, 25 bp, Mus musculus
ccctgcacagccaggtcctggtgat

SEQ ID NO: 903580 - DNA, 25 bp, Mus musculus
ccctgcacaggcaggtcctggtgat

SEQ ID NO: 903581 - DNA, 25 bp, Mus musculus
ccctgcactgcacacctgtgctgtg

SEQ ID NO: 903582 - DNA, 25 bp, Mus musculus
ccctgcactgcacagacctgtgctg

SEQ ID NO: 903583 - DNA, 25 bp, Mus musculus
ccctgcactgcacgagacctgtgct

SEQ ID NO: 903584 - DNA, 25 bp, Mus musculus
ccctgcactgcagacctgtgctgtg

SEQ ID NO: 903585 - DNA, 25 bp, Mus musculus
ccctgcactgcagagacctgtgctg

SEQ ID NO: 903586 - DNA, 25 bp, Mus musculus
ccctgcactgcaggagacctgtgct

SEQ ID NO: 903587 - DNA, 25 bp, Mus musculus
ccctgcactgctcctccatcggctc

SEQ ID NO: 903588 - DNA, 25 bp, Mus musculus
ccctgcactggtcctccatcggctc

SEQ ID NO: 903589 - DNA, 25 bp, Mus musculus
ccctgcagagctcaccaagctccag

SEQ ID NO: 903590 - DNA, 25 bp, Mus musculus
ccctgcagaggtcaccaagctccag

SEQ ID NO: 903591 - DNA, 25 bp, Mus musculus
ccctgcagctaacgcagaaaagata

SEQ ID NO: 903592 - DNA, 25 bp, Mus musculus
ccctgcagctaaggcagaaaagata

SEQ ID NO: 903593 - DNA, 25 bp, Mus musculus
ccctgcaggacacgtggcctctgat

SEQ ID NO: 903594 - DNA, 25 bp, Mus musculus
ccctgcaggacaggtggcctctgat

SEQ ID NO: 903595 - DNA, 25 bp, Mus musculus
ccctgcagggcagagaatcaatgct

SEQ ID NO: 903596 - DNA, 25 bp, Mus musculus
ccctgcaggggagagaatcaatgct

SEQ ID NO: 903597 - DNA, 25 bp, Mus musculus
ccctgcatagagctagttcctaata

SEQ ID NO: 903598 - DNA, 25 bp, Mus musculus
ccctgcatagagctgtgaaattgaa

SEQ ID NO: 903599 - DNA, 25 bp, Mus musculus
ccctgcatagaggtagttcctaata

SEQ ID NO: 903600 - DNA, 25 bp, Mus musculus
ccctgcatagaggtgtgaaattgaa

SEQ ID NO: 903601 - DNA, 25 bp, Mus musculus
ccctgcatcaagcagcttgtgtcag

SEQ ID NO: 903602 - DNA, 25 bp, Mus musculus
ccctgcatcaaggagcttgtgtcag

SEQ ID NO: 903603 - DNA, 25 bp, Mus musculus
ccctgcatcaaggtacttgtgtcag

SEQ ID NO: 903604 - DNA, 25 bp, Mus musculus
ccctgcatcaaggttcttgtgtcag

SEQ ID NO: 903605 - DNA, 25 bp, Mus musculus
ccctgcatggcgcgctttgggaacc

SEQ ID NO: 903606 - DNA, 25 bp, Mus musculus
ccctgcatggggcgctttgggaacc

SEQ ID NO: 903607 - DNA, 25 bp, Mus musculus
ccctgcattacacgttggctgttgt

SEQ ID NO: 903608 - DNA, 25 bp, Mus musculus
ccctgcattacaggttggctgttgt

SEQ ID NO: 903609 - DNA, 25 bp, Mus musculus
ccctgccaagattttcacctgacgg

SEQ ID NO: 903610 - DNA, 25 bp, Mus musculus
ccctgccaagtttttcacctgacgg

SEQ ID NO: 903611 - DNA, 25 bp, Mus musculus
ccctgcccagctgaggcaaaaggtg

SEQ ID NO: 903612 - DNA, 25 bp, Mus musculus
ccctgcccaggtgaggcaaaaggtg

SEQ ID NO: 903613 - DNA, 25 bp, Mus musculus
ccctgccccaccaccacctaccctg

SEQ ID NO: 903614 - DNA, 25 bp, Mus musculus
ccctgccccagcaccacctaccctg

SEQ ID NO: 903615 - DNA, 25 bp, Mus musculus
ccctgccccgctatcagcttgagga

SEQ ID NO: 903616 - DNA, 25 bp, Mus musculus
ccctgccccgctatgagcttgagga

SEQ ID NO: 903617 - DNA, 25 bp, Mus musculus
ccctgcccctatgacccatgcctgg

SEQ ID NO: 903618 - DNA, 25 bp, Mus musculus
ccctgcccctttgacccatgcctgg

SEQ ID NO: 903619 - DNA, 25 bp, Mus musculus
ccctgcccggaattctgatcaagaa

SEQ ID NO: 903620 - DNA, 25 bp, Mus musculus
ccctgcccggtattctgatcaagaa

SEQ ID NO: 903621 - DNA, 25 bp, Mus musculus
ccctgcctgacccgccttcaacacc

SEQ ID NO: 903622 - DNA, 25 bp, Mus musculus
ccctgcctgaccggccttcaacacc

SEQ ID NO: 903623 - DNA, 25 bp, Mus musculus
ccctgcctggcacacaagccttcag

SEQ ID NO: 903624 - DNA, 25 bp, Mus musculus
ccctgcctggcacagaagccttcag

SEQ ID NO: 903625 - DNA, 25 bp, Mus musculus
ccctgcctgtcacgcttcctgcggg

SEQ ID NO: 903626 - DNA, 25 bp, Mus musculus
ccctgcctgtcaggcttcctgcggg

SEQ ID NO: 903627 - DNA, 25 bp, Mus musculus
ccctgccttgaacgtcatggcacag

SEQ ID NO: 903628 - DNA, 25 bp, Mus musculus
ccctgccttgaaggtcatggcacag

SEQ ID NO: 903629 - DNA, 25 bp, Mus musculus
ccctgccttggacaccctccactgc

SEQ ID NO: 903630 - DNA, 25 bp, Mus musculus
ccctgccttggacagcctccactgc

SEQ ID NO: 903631 - DNA, 25 bp, Mus musculus
ccctgccttgtgcgaggtgttctgc

SEQ ID NO: 903632 - DNA, 25 bp, Mus musculus
ccctgccttgtgggaggtgttctgc

SEQ ID NO: 903633 - DNA, 25 bp, Mus musculus
ccctgcgatgaatgcgtgtatgccc

SEQ ID NO: 903634 - DNA, 25 bp, Mus musculus
ccctgcgatgaatgggtgtatgccc

SEQ ID NO: 903635 - DNA, 25 bp, Mus musculus
ccctgcgatgagcttggcttcaatg

SEQ ID NO: 903636 - DNA, 25 bp, Mus musculus
ccctgcgatgaggttggcttcaatg

SEQ ID NO: 903637 - DNA, 25 bp, Mus musculus
ccctgcgccatgcagctgatctggt

SEQ ID NO: 903638 - DNA, 25 bp, Mus musculus
ccctgcgccatggagctgatctggt

SEQ ID NO: 903639 - DNA, 25 bp, Mus musculus
ccctgcgctgactgacatctactgc

SEQ ID NO: 903640 - DNA, 25 bp, Mus musculus
ccctgcgctgactgtcatctactgc

SEQ ID NO: 903641 - DNA, 25 bp, Mus musculus
ccctgctcagcacatgcttctacct

SEQ ID NO: 903642 - DNA, 25 bp, Mus musculus
ccctgctcagcagatgcttctacct

SEQ ID NO: 903643 - DNA, 25 bp, Mus musculus
ccctgctcccatccttatcattgca

SEQ ID NO: 903644 - DNA, 25 bp, Mus musculus
ccctgctcccatgcttatcattgca

SEQ ID NO: 903645 - DNA, 25 bp, Mus musculus
ccctgctccgccaagacattgcttt

SEQ ID NO: 903646 - DNA, 25 bp, Mus musculus
ccctgctccggcaagacattgcttt

SEQ ID NO: 903647 - DNA, 25 bp, Mus musculus
ccctgctctcagaattccggctgac

SEQ ID NO: 903648 - DNA, 25 bp, Mus musculus
ccctgctctcagtattccggctgac

SEQ ID NO: 903649 - DNA, 25 bp, Mus musculus
ccctgctctgtcttcgactgactct

SEQ ID NO: 903650 - DNA, 25 bp, Mus musculus
ccctgctctgtcttggactgactct

SEQ ID NO: 903651 - DNA, 25 bp, Mus musculus
ccctgctcttcgtgcgtgagaagat

SEQ ID NO: 903652 - DNA, 25 bp, Mus musculus
ccctgctcttcgtgggtgagaagat

SEQ ID NO: 903653 - DNA, 25 bp, Mus musculus
ccctgctgcaagccattgctgacta

SEQ ID NO: 903654 - DNA, 25 bp, Mus musculus
ccctgctgcaaggcattgctgacta

SEQ ID NO: 903655 - DNA, 25 bp, Mus musculus
ccctgctgctatcgcaattgcaaat

SEQ ID NO: 903656 - DNA, 25 bp, Mus musculus
ccctgctgctatcggaattgcaaat

SEQ ID NO: 903657 - DNA, 25 bp, Mus musculus
ccctgcttggatggtgccatacaag

SEQ ID NO: 903658 - DNA, 25 bp, Mus musculus
ccctgcttggttggtgccatacaag

SEQ ID NO: 903659 - DNA, 25 bp, Mus musculus
ccctgctttttgcagaggacgacct

SEQ ID NO: 903660 - DNA, 25 bp, Mus musculus
ccctgctttttggagaggacgacct

SEQ ID NO: 903661 - DNA, 25 bp, Mus musculus
ccctggaagagaaggccctgatggc

SEQ ID NO: 903662 - DNA, 25 bp, Mus musculus
ccctggaagagatggccctgatggc

SEQ ID NO: 903663 - DNA, 25 bp, Mus musculus
ccctggacagctattacgccatctg

SEQ ID NO: 903664 - DNA, 25 bp, Mus musculus
ccctggacagctttgcgcagttttt

SEQ ID NO: 903665 - DNA, 25 bp, Mus musculus
ccctggacaggtattacgccatctg

SEQ ID NO: 903666 - DNA, 25 bp, Mus musculus
ccctggacaggtttgcgcagttttt

SEQ ID NO: 903667 - DNA, 25 bp, Mus musculus
ccctggacattgagacactgacatg

SEQ ID NO: 903668 - DNA, 25 bp, Mus musculus
ccctggacattgtgacactgacatg

SEQ ID NO: 903669 - DNA, 25 bp, Mus musculus
ccctggaccaagctgcttcacctgg

SEQ ID NO: 903670 - DNA, 25 bp, Mus musculus
ccctggaccaaggtgcttcacctgg

SEQ ID NO: 903671 - DNA, 25 bp, Mus musculus
ccctggacgacccgcgtgtgcagcc

SEQ ID NO: 903672 - DNA, 25 bp, Mus musculus
ccctggacgaccctatctggactag

SEQ ID NO: 903673 - DNA, 25 bp, Mus musculus
ccctggacgaccggcgtgtgcagcc

SEQ ID NO: 903674 - DNA, 25 bp, Mus musculus
ccctggacgaccgtatctggactag

SEQ ID NO: 903675 - DNA, 25 bp, Mus musculus
ccctggacggctcgtggatgcaggc

SEQ ID NO: 903676 - DNA, 25 bp, Mus musculus
ccctggacggctggtggatgcaggc

SEQ ID NO: 903677 - DNA, 25 bp, Mus musculus
ccctggacgttgagtgtggaaaatg

SEQ ID NO: 903678 - DNA, 25 bp, Mus musculus
ccctggacgttgtgtgtggaaaatg

SEQ ID NO: 903679 - DNA, 25 bp, Mus musculus
ccctggagacagcggtcccattggc

SEQ ID NO: 903680 - DNA, 25 bp, Mus musculus
ccctggagacaggggtcccattggc

SEQ ID NO: 903681 - DNA, 25 bp, Mus musculus
ccctggagctggcacaggcacctcg

SEQ ID NO: 903682 - DNA, 25 bp, Mus musculus
ccctggagctggcagaggcacctcg

SEQ ID NO: 903683 - DNA, 25 bp, Mus musculus
ccctggaggtggcacgcttctcagg

SEQ ID NO: 903684 - DNA, 25 bp, Mus musculus
ccctggaggtggcaggcttctcagg

SEQ ID NO: 903685 - DNA, 25 bp, Mus musculus
ccctggagtaagctaccgcactcga

SEQ ID NO: 903686 - DNA, 25 bp, Mus musculus
ccctggagtaaggtaccgcactcga

SEQ ID NO: 903687 - DNA, 25 bp, Mus musculus
ccctggatccagcacgtggaccaga

SEQ ID NO: 903688 - DNA, 25 bp, Mus musculus
ccctggatccagcaggtggaccaga

SEQ ID NO: 903689 - DNA, 25 bp, Mus musculus
ccctggcaaaggcacgatctattcc

SEQ ID NO: 903690 - DNA, 25 bp, Mus musculus
ccctggcaaaggcaggatctattcc

SEQ ID NO: 903691 - DNA, 25 bp, Mus musculus
ccctggcaagcaagaacaaggatga

SEQ ID NO: 903692 - DNA, 25 bp, Mus musculus
ccctggcaagcaagtacaaggatga

SEQ ID NO: 903693 - DNA, 25 bp, Mus musculus
ccctggcacacgccccaaggaaagt

SEQ ID NO: 903694 - DNA, 25 bp, Mus musculus
ccctggcacacggcccaaggaaagt

SEQ ID NO: 903695 - DNA, 25 bp, Mus musculus
ccctggcattagaacactgtagctg

SEQ ID NO: 903696 - DNA, 25 bp, Mus musculus
ccctggcattagcgcaggctggata

SEQ ID NO: 903697 - DNA, 25 bp, Mus musculus
ccctggcattagggcaggctggata

SEQ ID NO: 903698 - DNA, 25 bp, Mus musculus
ccctggcattagtacactgtagctg

SEQ ID NO: 903699 - DNA, 25 bp, Mus musculus
ccctggccagctgcgcaccctgtgg

SEQ ID NO: 903700 - DNA, 25 bp, Mus musculus
ccctggccaggtgcgcaccctgtgg

SEQ ID NO: 903701 - DNA, 25 bp, Mus musculus
ccctggcccagtcggtagccatgga

SEQ ID NO: 903702 - DNA, 25 bp, Mus musculus
ccctggcccagtgggtagccatgga

SEQ ID NO: 903703 - DNA, 25 bp, Mus musculus
ccctggcctgaacatggatcaccaa

SEQ ID NO: 903704 - DNA, 25 bp, Mus musculus
ccctggcctgaagatggatcaccaa

SEQ ID NO: 903705 - DNA, 25 bp, Mus musculus
ccctggcctgcctgagggatctgag

SEQ ID NO: 903706 - DNA, 25 bp, Mus musculus
ccctggcctggctgagggatctgag

SEQ ID NO: 903707 - DNA, 25 bp, Mus musculus
ccctggctggcggatgggctcttcc

SEQ ID NO: 903708 - DNA, 25 bp, Mus musculus
ccctggctgggggatgggctcttcc

SEQ ID NO: 903709 - DNA, 25 bp, Mus musculus
ccctgggacagacgcgagcaacaag

SEQ ID NO: 903710 - DNA, 25 bp, Mus musculus
ccctgggacagaggcgagcaacaag

SEQ ID NO: 903711 - DNA, 25 bp, Mus musculus
ccctgggactagctcaggccctgga

SEQ ID NO: 903712 - DNA, 25 bp, Mus musculus
ccctgggacttgctcaggccctgga

SEQ ID NO: 903713 - DNA, 25 bp, Mus musculus
ccctgggatgtcaccaagttaaagt

SEQ ID NO: 903714 - DNA, 25 bp, Mus musculus
ccctgggatgtcacgaagttaaagt

SEQ ID NO: 903715 - DNA, 25 bp, Mus musculus
ccctgggattagcagtgccaggagg

SEQ ID NO: 903716 - DNA, 25 bp, Mus musculus
ccctgggattaggagtgccaggagg

SEQ ID NO: 903717 - DNA, 25 bp, Mus musculus
ccctgggcagcctgctggttgtcta

SEQ ID NO: 903718 - DNA, 25 bp, Mus musculus
ccctgggcagctttcagtcgttcct

SEQ ID NO: 903719 - DNA, 25 bp, Mus musculus
ccctgggcaggacatgcagtgggac

SEQ ID NO: 903720 - DNA, 25 bp, Mus musculus
ccctgggcaggagatgcagtgggac

SEQ ID NO: 903721 - DNA, 25 bp, Mus musculus
ccctgggcaggctgctggttgtcta

SEQ ID NO: 903722 - DNA, 25 bp, Mus musculus
ccctgggcaggtttcagtcgttcct

SEQ ID NO: 903723 - DNA, 25 bp, Mus musculus
ccctgggctgctggctctcgagggc

SEQ ID NO: 903724 - DNA, 25 bp, Mus musculus
ccctgggctggtggctctcgagggc

SEQ ID NO: 903725 - DNA, 25 bp, Mus musculus
ccctggggagagagctcagttacat

SEQ ID NO: 903726 - DNA, 25 bp, Mus musculus
ccctggggagagtgctcagttacat

SEQ ID NO: 903727 - DNA, 25 bp, Mus musculus
ccctgggtgcagggcgaacagctgt

SEQ ID NO: 903728 - DNA, 25 bp, Mus musculus
ccctgggtgcagggctgtgccccag

SEQ ID NO: 903729 - DNA, 25 bp, Mus musculus
ccctgggtgcagggggaacagctgt

SEQ ID NO: 903730 - DNA, 25 bp, Mus musculus
ccctgggtgcaggggtgtgccccag

SEQ ID NO: 903731 - DNA, 25 bp, Mus musculus
ccctggtaagctgccagagccagag

SEQ ID NO: 903732 - DNA, 25 bp, Mus musculus
ccctggtaaggtgccagagccagag

SEQ ID NO: 903733 - DNA, 25 bp, Mus musculus
ccctggtcaccaccacgttcatcat

SEQ ID NO: 903734 - DNA, 25 bp, Mus musculus
ccctggtcaccagcacgttcatcat

SEQ ID NO: 903735 - DNA, 25 bp, Mus musculus
ccctggtcagcccgtttctctccgt

SEQ ID NO: 903736 - DNA, 25 bp, Mus musculus
ccctggtcagccggtttctctccgt

SEQ ID NO: 903737 - DNA, 25 bp, Mus musculus
ccctggtcagtgcgagctcaacctt

SEQ ID NO: 903738 - DNA, 25 bp, Mus musculus
ccctggtcagtgggagctcaacctt

SEQ ID NO: 903739 - DNA, 25 bp, Mus musculus
ccctggtcctcaaacgtggccagag

SEQ ID NO: 903740 - DNA, 25 bp, Mus musculus
ccctggtcctcaaaggtggccagag

SEQ ID NO: 903741 - DNA, 25 bp, Mus musculus
ccctggtgcccacaggacatagtgt

SEQ ID NO: 903742 - DNA, 25 bp, Mus musculus
ccctggtgcccagaggacatagtgt

SEQ ID NO: 903743 - DNA, 25 bp, Mus musculus
ccctggtggttggtcgcgcagtcca

SEQ ID NO: 903744 - DNA, 25 bp, Mus musculus
ccctggtggttggtggcgcagtcca

SEQ ID NO: 903745 - DNA, 25 bp, Mus musculus
ccctggttacaaattctgttgacag

SEQ ID NO: 903746 - DNA, 25 bp, Mus musculus
ccctggttacaatttctgttgacag

SEQ ID NO: 903747 - DNA, 25 bp, Mus musculus
ccctgtaaatggcttgctgaaaggg

SEQ ID NO: 903748 - DNA, 25 bp, Mus musculus
ccctgtaaatgggttgctgaaaggg

SEQ ID NO: 903749 - DNA, 25 bp, Mus musculus
ccctgtacaaagcggcagccacaga

SEQ ID NO: 903750 - DNA, 25 bp, Mus musculus
ccctgtacaaaggggcagccacaga

SEQ ID NO: 903751 - DNA, 25 bp, Mus musculus
ccctgtcaagctgggctgtcaacgg

SEQ ID NO: 903752 - DNA, 25 bp, Mus musculus
ccctgtcaaggtgggctgtcaacgg

SEQ ID NO: 903753 - DNA, 25 bp, Mus musculus
ccctgtcacccctgaatatcaacct

SEQ ID NO: 903754 - DNA, 25 bp, Mus musculus
ccctgtcacccctgtatatcaacct

SEQ ID NO: 903755 - DNA, 25 bp, Mus musculus
ccctgtcagactttgtagacacgct

SEQ ID NO: 903756 - DNA, 25 bp, Mus musculus
ccctgtcagagtttgtagacacgct

SEQ ID NO: 903757 - DNA, 25 bp, Mus musculus
ccctgtcatcagattgatcttttca

SEQ ID NO: 903758 - DNA, 25 bp, Mus musculus
ccctgtcatcagtttgatcttttca

SEQ ID NO: 903759 - DNA, 25 bp, Mus musculus
ccctgtccagatactgcaggaatat

SEQ ID NO: 903760 - DNA, 25 bp, Mus musculus
ccctgtccagttactgcaggaatat

SEQ ID NO: 903761 - DNA, 25 bp, Mus musculus
ccctgtcgcctgactgccacaactt

SEQ ID NO: 903762 - DNA, 25 bp, Mus musculus
ccctgtcgcctgtctgccacaactt

SEQ ID NO: 903763 - DNA, 25 bp, Mus musculus
ccctgtctcaggctgaaacgcaaat

SEQ ID NO: 903764 - DNA, 25 bp, Mus musculus
ccctgtctcagggtgaaacgcaaat

SEQ ID NO: 903765 - DNA, 25 bp, Mus musculus
ccctgtctcggtcctcttcaaatgt

SEQ ID NO: 903766 - DNA, 25 bp, Mus musculus
ccctgtctcggtctccttcccgtcg

SEQ ID NO: 903767 - DNA, 25 bp, Mus musculus
ccctgtctcggtgctcttcaaatgt

SEQ ID NO: 903768 - DNA, 25 bp, Mus musculus
ccctgtctcggtgtccttcccgtcg

SEQ ID NO: 903769 - DNA, 25 bp, Mus musculus
ccctgtgaacatcatgccctggcag

SEQ ID NO: 903770 - DNA, 25 bp, Mus musculus
ccctgtgaacatgatgccctggcag

SEQ ID NO: 903771 - DNA, 25 bp, Mus musculus
ccctgtgacattctgctgggctttg

SEQ ID NO: 903772 - DNA, 25 bp, Mus musculus
ccctgtgacattgtgctgggctttg

SEQ ID NO: 903773 - DNA, 25 bp, Mus musculus
ccctgtgacgaatggcacacgaaac

SEQ ID NO: 903774 - DNA, 25 bp, Mus musculus
ccctgtgacgtatggcacacgaaac

SEQ ID NO: 903775 - DNA, 25 bp, Mus musculus
ccctgtgataaacaccagaatatgg

SEQ ID NO: 903776 - DNA, 25 bp, Mus musculus
ccctgtgataaacgtgtccccaagg

SEQ ID NO: 903777 - DNA, 25 bp, Mus musculus
ccctgtgataaagaccagaatatgg

SEQ ID NO: 903778 - DNA, 25 bp, Mus musculus
ccctgtgataaaggtgtccccaagg

SEQ ID NO: 903779 - DNA, 25 bp, Mus musculus
ccctgtgcaacaccaaaatcaaatt

SEQ ID NO: 903780 - DNA, 25 bp, Mus musculus
ccctgtgcaacagcaaaatcaaatt

SEQ ID NO: 903781 - DNA, 25 bp, Mus musculus
ccctgtgcagatttccctcagggtg

SEQ ID NO: 903782 - DNA, 25 bp, Mus musculus
ccctgtgcagccttgtgacagattt

SEQ ID NO: 903783 - DNA, 25 bp, Mus musculus
ccctgtgcaggcttgtgacagattt

SEQ ID NO: 903784 - DNA, 25 bp, Mus musculus
ccctgtgcagttttccctcagggtg

SEQ ID NO: 903785 - DNA, 25 bp, Mus musculus
ccctgtgcatggcttcatgtactgg

SEQ ID NO: 903786 - DNA, 25 bp, Mus musculus
ccctgtgcatgggttcatgtactgg

SEQ ID NO: 903787 - DNA, 25 bp, Mus musculus
ccctgtgcctccctttaatgtgatc

SEQ ID NO: 903788 - DNA, 25 bp, Mus musculus
ccctgtgcctgcctttaatgtgatc

SEQ ID NO: 903789 - DNA, 25 bp, Mus musculus
ccctgtgggcagaggtctaggttac

SEQ ID NO: 903790 - DNA, 25 bp, Mus musculus
ccctgtgggcagtggtctaggttac

SEQ ID NO: 903791 - DNA, 25 bp, Mus musculus
ccctgtgtcctgcatcaaccttagc

SEQ ID NO: 903792 - DNA, 25 bp, Mus musculus
ccctgtgtcctggatcaaccttagc

SEQ ID NO: 903793 - DNA, 25 bp, Mus musculus
ccctgtgtgagactgtggctatctt

SEQ ID NO: 903794 - DNA, 25 bp, Mus musculus
ccctgtgtgagagtgtggctatctt

SEQ ID NO: 903795 - DNA, 25 bp, Mus musculus
ccctgtgtttgtcgtcctccactct

SEQ ID NO: 903796 - DNA, 25 bp, Mus musculus
ccctgtgtttgtcgtctttgctgat

SEQ ID NO: 903797 - DNA, 25 bp, Mus musculus
ccctgtgtttgtggtcctccactct

SEQ ID NO: 903798 - DNA, 25 bp, Mus musculus
ccctgtgtttgtggtctttgctgat

SEQ ID NO: 903799 - DNA, 25 bp, Mus musculus
ccctgttaagaatgtgattgatgga

SEQ ID NO: 903800 - DNA, 25 bp, Mus musculus
ccctgttaagtatgtgattgatgga

SEQ ID NO: 903801 - DNA, 25 bp, Mus musculus
ccctgttctgctgattgaggctgac

SEQ ID NO: 903802 - DNA, 25 bp, Mus musculus
ccctgttctggtgattgaggctgac

SEQ ID NO: 903803 - DNA, 25 bp, Mus musculus
ccctgttggctatactgaagtgcat

SEQ ID NO: 903804 - DNA, 25 bp, Mus musculus
ccctgttggctatagtgaagtgcat

SEQ ID NO: 903805 - DNA, 25 bp, Mus musculus
cccttaactgatctgccggtgaatc

SEQ ID NO: 903806 - DNA, 25 bp, Mus musculus
cccttaactgatgtgccggtgaatc

SEQ ID NO: 903807 - DNA, 25 bp, Mus musculus
cccttaatggagtctccaagcctga

SEQ ID NO: 903808 - DNA, 25 bp, Mus musculus
cccttaatggtgtctccaagcctga

SEQ ID NO: 903809 - DNA, 25 bp, Mus musculus
cccttacatccagcctttcatagaa

SEQ ID NO: 903810 - DNA, 25 bp, Mus musculus
cccttacatccagcgtttcatagaa

SEQ ID NO: 903811 - DNA, 25 bp, Mus musculus
cccttaccagccaaatccaaaagct

SEQ ID NO: 903812 - DNA, 25 bp, Mus musculus
cccttaccaggcaaatccaaaagct

SEQ ID NO: 903813 - DNA, 25 bp, Mus musculus
cccttacgatgaacaggtagctgca

SEQ ID NO: 903814 - DNA, 25 bp, Mus musculus
cccttacgatgaactggtagctgca

SEQ ID NO: 903815 - DNA, 25 bp, Mus musculus
cccttatcagagcctgccccagttc

SEQ ID NO: 903816 - DNA, 25 bp, Mus musculus
cccttatcagtgcctgccccagttc

SEQ ID NO: 903817 - DNA, 25 bp, Mus musculus
cccttattgatgaacgtgtagaagt

SEQ ID NO: 903818 - DNA, 25 bp, Mus musculus
cccttattgatgaaggtgtagaagt

SEQ ID NO: 903819 - DNA, 25 bp, Mus musculus
cccttcacagcaatcagcaggagga

SEQ ID NO: 903820 - DNA, 25 bp, Mus musculus
cccttcacaggaatcagcaggagga

SEQ ID NO: 903821 - DNA, 25 bp, Mus musculus
cccttcactccccacatatacaaaa

SEQ ID NO: 903822 - DNA, 25 bp, Mus musculus
cccttcactccccagatatacaaaa

SEQ ID NO: 903823 - DNA, 25 bp, Mus musculus
cccttcactctgcacttcagtcaaa

SEQ ID NO: 903824 - DNA, 25 bp, Mus musculus
cccttcactctgcagttcagtcaaa

SEQ ID NO: 903825 - DNA, 25 bp, Mus musculus
cccttcagaatgcgttctacgcagc

SEQ ID NO: 903826 - DNA, 25 bp, Mus musculus
cccttcagaatgggttctacgcagc

SEQ ID NO: 903827 - DNA, 25 bp, Mus musculus
cccttcagagagctctatctccatg

SEQ ID NO: 903828 - DNA, 25 bp, Mus musculus
cccttcagagaggtctatctccatg

SEQ ID NO: 903829 - DNA, 25 bp, Mus musculus
cccttcagattgatgcacggctgaa

SEQ ID NO: 903830 - DNA, 25 bp, Mus musculus
cccttcagattgttgcacggctgaa

SEQ ID NO: 903831 - DNA, 25 bp, Mus musculus
cccttcagccgacaaacatcccaaa

SEQ ID NO: 903832 - DNA, 25 bp, Mus musculus
cccttcagccgacaagaactttgat

SEQ ID NO: 903833 - DNA, 25 bp, Mus musculus
cccttcagccgagaaacatcccaaa

SEQ ID NO: 903834 - DNA, 25 bp, Mus musculus
cccttcagccgagaagaactttgat

SEQ ID NO: 903835 - DNA, 25 bp, Mus musculus
cccttcaggaaaccctgtgggccga

SEQ ID NO: 903836 - DNA, 25 bp, Mus musculus
cccttcaggaaagcctgtgggccga

SEQ ID NO: 903837 - DNA, 25 bp, Mus musculus
cccttcagtctctcagtgcctgtgc

SEQ ID NO: 903838 - DNA, 25 bp, Mus musculus
cccttcagtctctctgtgcctgtgc

SEQ ID NO: 903839 - DNA, 25 bp, Mus musculus
cccttcatctggctatctacagtga

SEQ ID NO: 903840 - DNA, 25 bp, Mus musculus
cccttcatctgggtatctacagtga

SEQ ID NO: 903841 - DNA, 25 bp, Mus musculus
cccttccaccggcaggatcagctgg

SEQ ID NO: 903842 - DNA, 25 bp, Mus musculus
cccttccaccgggaggatcagctgg

SEQ ID NO: 903843 - DNA, 25 bp, Mus musculus
cccttccacgggccgcccaatgtgt

SEQ ID NO: 903844 - DNA, 25 bp, Mus musculus
cccttccacggggcgcccaatgtgt

SEQ ID NO: 903845 - DNA, 25 bp, Mus musculus
cccttccgctgccgtgtcatggaga

SEQ ID NO: 903846 - DNA, 25 bp, Mus musculus
cccttccgctgcggtgtcatggaga

SEQ ID NO: 903847 - DNA, 25 bp, Mus musculus
cccttccggctgcccacccccatca

SEQ ID NO: 903848 - DNA, 25 bp, Mus musculus
cccttccggctggccacccccatca

SEQ ID NO: 903849 - DNA, 25 bp, Mus musculus
cccttcctccgaaggctacagatgt

SEQ ID NO: 903850 - DNA, 25 bp, Mus musculus
cccttcctccgatggctacagatgt

SEQ ID NO: 903851 - DNA, 25 bp, Mus musculus
cccttcctcgctctcgccggtgaca

SEQ ID NO: 903852 - DNA, 25 bp, Mus musculus
cccttcctcggtctcgccggtgaca

SEQ ID NO: 903853 - DNA, 25 bp, Mus musculus
cccttccttacacataccatttatg

SEQ ID NO: 903854 - DNA, 25 bp, Mus musculus
cccttccttacagataccatttatg

SEQ ID NO: 903855 - DNA, 25 bp, Mus musculus
cccttcgaagtaagacgaccaccag

SEQ ID NO: 903856 - DNA, 25 bp, Mus musculus
cccttcgaagtaagtcgaccaccag

SEQ ID NO: 903857 - DNA, 25 bp, Mus musculus
cccttcggtgttcgtctggtcagct

SEQ ID NO: 903858 - DNA, 25 bp, Mus musculus
cccttcggtgttggtctggtcagct

SEQ ID NO: 903859 - DNA, 25 bp, Mus musculus
cccttctacacaatttatcagttct

SEQ ID NO: 903860 - DNA, 25 bp, Mus musculus
cccttctacagaatttatcagttct

SEQ ID NO: 903861 - DNA, 25 bp, Mus musculus
cccttctactaccatgatactaccc

SEQ ID NO: 903862 - DNA, 25 bp, Mus musculus
cccttctactacgatgatactaccc

SEQ ID NO: 903863 - DNA, 25 bp, Mus musculus
cccttctagactggcccgtgatata

SEQ ID NO: 903864 - DNA, 25 bp, Mus musculus
cccttctagagtggcccgtgatata

SEQ ID NO: 903865 - DNA, 25 bp, Mus musculus
cccttctcaacacggaaacggatat

SEQ ID NO: 903866 - DNA, 25 bp, Mus musculus
cccttctcaacagggaaacggatat

SEQ ID NO: 903867 - DNA, 25 bp, Mus musculus
cccttctcaatgagaaattcagcaa

SEQ ID NO: 903868 - DNA, 25 bp, Mus musculus
cccttctcaatgtgaaattcagcaa

SEQ ID NO: 903869 - DNA, 25 bp, Mus musculus
cccttctcagaatacagcccagttg

SEQ ID NO: 903870 - DNA, 25 bp, Mus musculus
cccttctcagtatacagcccagttg

SEQ ID NO: 903871 - DNA, 25 bp, Mus musculus
cccttctccggctgccccaccttgg

SEQ ID NO: 903872 - DNA, 25 bp, Mus musculus
cccttctccggctggcccaccttgg

SEQ ID NO: 903873 - DNA, 25 bp, Mus musculus
cccttctgattctccccgagctgct

SEQ ID NO: 903874 - DNA, 25 bp, Mus musculus
cccttctgattctcgccgagctgct

SEQ ID NO: 903875 - DNA, 25 bp, Mus musculus
cccttctgcaggatgtcattgcaac

SEQ ID NO: 903876 - DNA, 25 bp, Mus musculus
cccttctgcaggttgtcattgcaac

SEQ ID NO: 903877 - DNA, 25 bp, Mus musculus
cccttcttagagggtcctgtgtcag

SEQ ID NO: 903878 - DNA, 25 bp, Mus musculus
cccttcttagtgggtcctgtgtcag

SEQ ID NO: 903879 - DNA, 25 bp, Mus musculus
cccttcttcaagaaaggtacactgt

SEQ ID NO: 903880 - DNA, 25 bp, Mus musculus
cccttcttcaagtaaggtacactgt

SEQ ID NO: 903881 - DNA, 25 bp, Mus musculus
cccttcttccagcgtctggactggg

SEQ ID NO: 903882 - DNA, 25 bp, Mus musculus
cccttcttccagggtctggactggg

SEQ ID NO: 903883 - DNA, 25 bp, Mus musculus
cccttgaactcaggaacgggcatgt

SEQ ID NO: 903884 - DNA, 25 bp, Mus musculus
cccttgaactgaggaacgggcatgt

SEQ ID NO: 903885 - DNA, 25 bp, Mus musculus
cccttgacctgaaacatcctataaa

SEQ ID NO: 903886 - DNA, 25 bp, Mus musculus
cccttgacctgatacatcctataaa

SEQ ID NO: 903887 - DNA, 25 bp, Mus musculus
cccttgatggcaagtatgtctatat

SEQ ID NO: 903888 - DNA, 25 bp, Mus musculus
cccttgatggcatgtatgtctatat

SEQ ID NO: 903889 - DNA, 25 bp, Mus musculus
cccttgatgtgacgcgtgtgtggac

SEQ ID NO: 903890 - DNA, 25 bp, Mus musculus
cccttgatgtgaggcgtgtgtggac

SEQ ID NO: 903891 - DNA, 25 bp, Mus musculus
cccttgcagccacacgttaggggat

SEQ ID NO: 903892 - DNA, 25 bp, Mus musculus
cccttgcagccactgcaagaaaaat

SEQ ID NO: 903893 - DNA, 25 bp, Mus musculus
cccttgcagccagacgttaggggat

SEQ ID NO: 903894 - DNA, 25 bp, Mus musculus
cccttgcagccagtgcaagaaaaat

SEQ ID NO: 903895 - DNA, 25 bp, Mus musculus
cccttgccacaacctgaagtgattc

SEQ ID NO: 903896 - DNA, 25 bp, Mus musculus
cccttgccacaagctgaagtgattc

SEQ ID NO: 903897 - DNA, 25 bp, Mus musculus
cccttgccagcctttctgcagagcc

SEQ ID NO: 903898 - DNA, 25 bp, Mus musculus
cccttgccaggctttctgcagagcc

SEQ ID NO: 903899 - DNA, 25 bp, Mus musculus
cccttgcggcagccttccgggctgc

SEQ ID NO: 903900 - DNA, 25 bp, Mus musculus
cccttgcggcaggcttccgggctgc

SEQ ID NO: 903901 - DNA, 25 bp, Mus musculus
cccttgctcctgcaggcagtgacat

SEQ ID NO: 903902 - DNA, 25 bp, Mus musculus
cccttgctcctgcttgcttcccaga

SEQ ID NO: 903903 - DNA, 25 bp, Mus musculus
cccttgctcctggaggcagtgacat

SEQ ID NO: 903904 - DNA, 25 bp, Mus musculus
cccttgctcctggttgcttcccaga

SEQ ID NO: 903905 - DNA, 25 bp, Mus musculus
cccttgcttcagctacgccaggatc

SEQ ID NO: 903906 - DNA, 25 bp, Mus musculus
cccttgcttcaggtacgccaggatc

SEQ ID NO: 903907 - DNA, 25 bp, Mus musculus
cccttggagcagctcaaagctgcaa

SEQ ID NO: 903908 - DNA, 25 bp, Mus musculus
cccttggagcaggtcaaagctgcaa

SEQ ID NO: 903909 - DNA, 25 bp, Mus musculus
cccttggattcaccagtgcactcac

SEQ ID NO: 903910 - DNA, 25 bp, Mus musculus
cccttggattcagcagtgcactcac

SEQ ID NO: 903911 - DNA, 25 bp, Mus musculus
cccttggcagacagggtcccttgca

SEQ ID NO: 903912 - DNA, 25 bp, Mus musculus
cccttggcagtcagggtcccttgca

SEQ ID NO: 903913 - DNA, 25 bp, Mus musculus
cccttggggaagcacatggagttcc

SEQ ID NO: 903914 - DNA, 25 bp, Mus musculus
cccttggggaagcagatggagttcc

SEQ ID NO: 903915 - DNA, 25 bp, Mus musculus
cccttggggcgacatgtacaacatc

SEQ ID NO: 903916 - DNA, 25 bp, Mus musculus
cccttggggcgagatgtacaacatc

SEQ ID NO: 903917 - DNA, 25 bp, Mus musculus
cccttgggtcaacgtcgagtatgcc

SEQ ID NO: 903918 - DNA, 25 bp, Mus musculus
cccttgggtcaaggtcgagtatgcc

SEQ ID NO: 903919 - DNA, 25 bp, Mus musculus
cccttggttgcacatttgcaataca

SEQ ID NO: 903920 - DNA, 25 bp, Mus musculus
cccttggttgcacgtttgcaataca

SEQ ID NO: 903921 - DNA, 25 bp, Mus musculus
cccttggttgcagatttgcaataca

SEQ ID NO: 903922 - DNA, 25 bp, Mus musculus
cccttggttgcaggtttgcaataca

SEQ ID NO: 903923 - DNA, 25 bp, Mus musculus
cccttgtatacagacgagcattccg

SEQ ID NO: 903924 - DNA, 25 bp, Mus musculus
cccttgtatacagaggagcattccg

SEQ ID NO: 903925 - DNA, 25 bp, Mus musculus
cccttgtcccccatcagcaagcaga

SEQ ID NO: 903926 - DNA, 25 bp, Mus musculus
cccttgtcccccatgagcaagcaga

SEQ ID NO: 903927 - DNA, 25 bp, Mus musculus
ccctttaaagaccaccagtcttgcc

SEQ ID NO: 903928 - DNA, 25 bp, Mus musculus
ccctttaaagaccagcagtcttgcc

SEQ ID NO: 903929 - DNA, 25 bp, Mus musculus
ccctttagtgagaaccagaatgggg

SEQ ID NO: 903930 - DNA, 25 bp, Mus musculus
ccctttagtgagcagtaccagaatg

SEQ ID NO: 903931 - DNA, 25 bp, Mus musculus
ccctttagtgaggagtaccagaatg

SEQ ID NO: 903932 - DNA, 25 bp, Mus musculus
ccctttagtgagtaccagaatgggg

SEQ ID NO: 903933 - DNA, 25 bp, Mus musculus
ccctttcagaccagccacagggttc

SEQ ID NO: 903934 - DNA, 25 bp, Mus musculus
ccctttcagacctgccacagggttc

SEQ ID NO: 903935 - DNA, 25 bp, Mus musculus
ccctttcataagcccaattatacag

SEQ ID NO: 903936 - DNA, 25 bp, Mus musculus
ccctttcataaggccaattatacag

SEQ ID NO: 903937 - DNA, 25 bp, Mus musculus
ccctttctgatgctctgtcagacac

SEQ ID NO: 903938 - DNA, 25 bp, Mus musculus
ccctttctgatggtctgtcagacac

SEQ ID NO: 903939 - DNA, 25 bp, Mus musculus
ccctttgaactgaaacaggcaccgc

SEQ ID NO: 903940 - DNA, 25 bp, Mus musculus
ccctttgaactgaaagcaccgctcc

SEQ ID NO: 903941 - DNA, 25 bp, Mus musculus
ccctttgaactgaatcaggcaccgc

SEQ ID NO: 903942 - DNA, 25 bp, Mus musculus
ccctttgaactgaatgcaccgctcc

SEQ ID NO: 903943 - DNA, 25 bp, Mus musculus
ccctttgcagcggaactcattcttt

SEQ ID NO: 903944 - DNA, 25 bp, Mus musculus
ccctttgcaggggaactcattcttt

SEQ ID NO: 903945 - DNA, 25 bp, Mus musculus
ccctttgggaagcgcctgctgaacg

SEQ ID NO: 903946 - DNA, 25 bp, Mus musculus
ccctttgggaagggcctgctgaacg

SEQ ID NO: 903947 - DNA, 25 bp, Mus musculus
ccctttggtgaacgccgcagtacaa

SEQ ID NO: 903948 - DNA, 25 bp, Mus musculus
ccctttggtgaaggccgcagtacaa

SEQ ID NO: 903949 - DNA, 25 bp, Mus musculus
ccgaaaactgctggaggtcactgca

SEQ ID NO: 903950 - DNA, 25 bp, Mus musculus
ccgaaaactggtggaggtcactgca

SEQ ID NO: 903951 - DNA, 25 bp, Mus musculus
ccgaaaagtgacggaagagaacaga

SEQ ID NO: 903952 - DNA, 25 bp, Mus musculus
ccgaaaagtgtcggaagagaacaga

SEQ ID NO: 903953 - DNA, 25 bp, Mus musculus
ccgaaaccgcagccttatgatggag

SEQ ID NO: 903954 - DNA, 25 bp, Mus musculus
ccgaaaccgcaggcttatgatggag

SEQ ID NO: 903955 - DNA, 25 bp, Mus musculus
ccgaaactatacatcaggcccgctg

SEQ ID NO: 903956 - DNA, 25 bp, Mus musculus
ccgaaactatacttcaggcccgctg

SEQ ID NO: 903957 - DNA, 25 bp, Mus musculus
ccgaaagaccagccaacaattctct

SEQ ID NO: 903958 - DNA, 25 bp, Mus musculus
ccgaaagaccaggcaacaattctct

SEQ ID NO: 903959 - DNA, 25 bp, Mus musculus
ccgaaagataagaaagactgtacat

SEQ ID NO: 903960 - DNA, 25 bp, Mus musculus
ccgaaagataagaatgactgtacat

SEQ ID NO: 903961 - DNA, 25 bp, Mus musculus
ccgaaagttcagactggactgccca

SEQ ID NO: 903962 - DNA, 25 bp, Mus musculus
ccgaaagttcagtctggactgccca

SEQ ID NO: 903963 - DNA, 25 bp, Mus musculus
ccgaaatgagctggaattttggagg

SEQ ID NO: 903964 - DNA, 25 bp, Mus musculus
ccgaaatgaggtggaattttggagg

SEQ ID NO: 903965 - DNA, 25 bp, Mus musculus
ccgaaattaacagacgatattttgc

SEQ ID NO: 903966 - DNA, 25 bp, Mus musculus
ccgaaattaacagaggatattttgc

SEQ ID NO: 903967 - DNA, 25 bp, Mus musculus
ccgaacacagagaggatgccatgag

SEQ ID NO: 903968 - DNA, 25 bp, Mus musculus
ccgaacacagtgaggatgccatgag

SEQ ID NO: 903969 - DNA, 25 bp, Mus musculus
ccgaactaccagacggttctatgac

SEQ ID NO: 903970 - DNA, 25 bp, Mus musculus
ccgaactaccagtcggttctatgac

SEQ ID NO: 903971 - DNA, 25 bp, Mus musculus
ccgaactcagcgattgctttctgaa

SEQ ID NO: 903972 - DNA, 25 bp, Mus musculus
ccgaactcagggattgctttctgaa

SEQ ID NO: 903973 - DNA, 25 bp, Mus musculus
ccgaagatgccacccaatggttcag

SEQ ID NO: 903974 - DNA, 25 bp, Mus musculus
ccgaagatgccagccaatggttcag

SEQ ID NO: 903975 - DNA, 25 bp, Mus musculus
ccgaagccccagatgtaccgagctg

SEQ ID NO: 903976 - DNA, 25 bp, Mus musculus
ccgaagccccagttgtaccgagctg

SEQ ID NO: 903977 - DNA, 25 bp, Mus musculus
ccgaagctggaaatcgaaccagtga

SEQ ID NO: 903978 - DNA, 25 bp, Mus musculus
ccgaagctggaaatggaaccagtga

SEQ ID NO: 903979 - DNA, 25 bp, Mus musculus
ccgaagctttaacgtttgattctca

SEQ ID NO: 903980 - DNA, 25 bp, Mus musculus
ccgaagctttaaggtttgattctca

SEQ ID NO: 903981 - DNA, 25 bp, Mus musculus
ccgaaggacgcgctatgaagtctta

SEQ ID NO: 903982 - DNA, 25 bp, Mus musculus
ccgaaggacgcggtatgaagtctta

SEQ ID NO: 903983 - DNA, 25 bp, Mus musculus
ccgaaggagcagcagccgctcccgt

SEQ ID NO: 903984 - DNA, 25 bp, Mus musculus
ccgaaggagcaggagccgctcccgt

SEQ ID NO: 903985 - DNA, 25 bp, Mus musculus
ccgaaggatcaaccttctttacctg

SEQ ID NO: 903986 - DNA, 25 bp, Mus musculus
ccgaaggatcaagcttctttacctg

SEQ ID NO: 903987 - DNA, 25 bp, Mus musculus
ccgaaggctgtttaaggatgaccag

SEQ ID NO: 903988 - DNA, 25 bp, Mus musculus
ccgaaggctgtttatggatgaccag

SEQ ID NO: 903989 - DNA, 25 bp, Mus musculus
ccgaagtatcatctaccggagcttt

SEQ ID NO: 903990 - DNA, 25 bp, Mus musculus
ccgaagtatcatgtaccggagcttt

SEQ ID NO: 903991 - DNA, 25 bp, Mus musculus
ccgaagtcagaccgaaagagtggtc

SEQ ID NO: 903992 - DNA, 25 bp, Mus musculus
ccgaagtcagacggaaagagtggtc

SEQ ID NO: 903993 - DNA, 25 bp, Mus musculus
ccgaagtgagggccttgcagatggg

SEQ ID NO: 903994 - DNA, 25 bp, Mus musculus
ccgaagtgaggggcttgcagatggg

SEQ ID NO: 903995 - DNA, 25 bp, Mus musculus
ccgaatacccagcctccaacaccta

SEQ ID NO: 903996 - DNA, 25 bp, Mus musculus
ccgaatacccaggctccaacaccta

SEQ ID NO: 903997 - DNA, 25 bp, Mus musculus
ccgaatcctgagtagcaagatgggt

SEQ ID NO: 903998 - DNA, 25 bp, Mus musculus
ccgaatcctgtgtagcaagatgggt

SEQ ID NO: 903999 - DNA, 25 bp, Mus musculus
ccgaatctttgactgtgagaaactt

SEQ ID NO: 904000 - DNA, 25 bp, Mus musculus
ccgaatctttgagtgtgagaaactt

SEQ ID NO: 904001 - DNA, 25 bp, Mus musculus
ccgaatgtcaagctggcagtgtttt

SEQ ID NO: 904002 - DNA, 25 bp, Mus musculus
ccgaatgtcaaggtggcagtgtttt

SEQ ID NO: 904003 - DNA, 25 bp, Mus musculus
ccgaatgtggagcccagtgctctcc

SEQ ID NO: 904004 - DNA, 25 bp, Mus musculus
ccgaatgtggaggccagtgctctcc

SEQ ID NO: 904005 - DNA, 25 bp, Mus musculus
ccgaattagctgcacactcaagtgc

SEQ ID NO: 904006 - DNA, 25 bp, Mus musculus
ccgaattagctggacactcaagtgc

SEQ ID NO: 904007 - DNA, 25 bp, Mus musculus
ccgaattctcaacgcccggctagag

SEQ ID NO: 904008 - DNA, 25 bp, Mus musculus
ccgaattctcaaggcccggctagag

SEQ ID NO: 904009 - DNA, 25 bp, Mus musculus
ccgaattctgcacacccatgcagat

SEQ ID NO: 904010 - DNA, 25 bp, Mus musculus
ccgaattctgcacgtatccaacggt

SEQ ID NO: 904011 - DNA, 25 bp, Mus musculus
ccgaattctgcagacccatgcagat

SEQ ID NO: 904012 - DNA, 25 bp, Mus musculus
ccgaattctgcaggtatccaacggt

SEQ ID NO: 904013 - DNA, 25 bp, Mus musculus
ccgacaaacagccccatttgaccgc

SEQ ID NO: 904014 - DNA, 25 bp, Mus musculus
ccgacaaacagcccgatttgaccgc

SEQ ID NO: 904015 - DNA, 25 bp, Mus musculus
ccgacacaagagcaagctgattgca

SEQ ID NO: 904016 - DNA, 25 bp, Mus musculus
ccgacacaagtgcaagctgattgca

SEQ ID NO: 904017 - DNA, 25 bp, Mus musculus
ccgacacaggtgagtatccagagtg

SEQ ID NO: 904018 - DNA, 25 bp, Mus musculus
ccgacacaggtgcagaatataaata

SEQ ID NO: 904019 - DNA, 25 bp, Mus musculus
ccgacacaggtggagaatataaata

SEQ ID NO: 904020 - DNA, 25 bp, Mus musculus
ccgacacaggtgtgtatccagagtg

SEQ ID NO: 904021 - DNA, 25 bp, Mus musculus
ccgacacctgagagatgaaggccta

SEQ ID NO: 904022 - DNA, 25 bp, Mus musculus
ccgacacctgagtgatgaaggccta

SEQ ID NO: 904023 - DNA, 25 bp, Mus musculus
ccgacacgcaggaccaccagaagct

SEQ ID NO: 904024 - DNA, 25 bp, Mus musculus
ccgacacgcaggtccaccagaagct

SEQ ID NO: 904025 - DNA, 25 bp, Mus musculus
ccgacagcagcaggtgttcatgttc

SEQ ID NO: 904026 - DNA, 25 bp, Mus musculus
ccgacagcaggaggtgttcatgttc

SEQ ID NO: 904027 - DNA, 25 bp, Mus musculus
ccgacagcatcaaaatgccaggcag

SEQ ID NO: 904028 - DNA, 25 bp, Mus musculus
ccgacagcatcaaggacaattcaag

SEQ ID NO: 904029 - DNA, 25 bp, Mus musculus
ccgacagcatcaaggcctgggagga

SEQ ID NO: 904030 - DNA, 25 bp, Mus musculus
ccgacagcatcataatgccaggcag

SEQ ID NO: 904031 - DNA, 25 bp, Mus musculus
ccgacagcatcatggacaattcaag

SEQ ID NO: 904032 - DNA, 25 bp, Mus musculus
ccgacagcatcatggcctgggagga

SEQ ID NO: 904033 - DNA, 25 bp, Mus musculus
ccgacaggagccgacccagtggaat

SEQ ID NO: 904034 - DNA, 25 bp, Mus musculus
ccgacaggagctacgagaggttcac

SEQ ID NO: 904035 - DNA, 25 bp, Mus musculus
ccgacaggaggcgacccagtggaat

SEQ ID NO: 904036 - DNA, 25 bp, Mus musculus
ccgacaggaggtacgagaggttcac

SEQ ID NO: 904037 - DNA, 25 bp, Mus musculus
ccgacagtacaccgctcgacgacca

SEQ ID NO: 904038 - DNA, 25 bp, Mus musculus
ccgacagtacacggctcgacgacca

SEQ ID NO: 904039 - DNA, 25 bp, Mus musculus
ccgacatctgtaccatatatccggt

SEQ ID NO: 904040 - DNA, 25 bp, Mus musculus
ccgacatctgtagcatatatccggt

SEQ ID NO: 904041 - DNA, 25 bp, Mus musculus
ccgaccatgaagacaccgtggaagg

SEQ ID NO: 904042 - DNA, 25 bp, Mus musculus
ccgaccatgaagatgaagcggcagc

SEQ ID NO: 904043 - DNA, 25 bp, Mus musculus
ccgaccatgaagtcaccgtggaagg

SEQ ID NO: 904044 - DNA, 25 bp, Mus musculus
ccgaccatgaagttgaagcggcagc

SEQ ID NO: 904045 - DNA, 25 bp, Mus musculus
ccgaccattgcgtttaatgtggaga

SEQ ID NO: 904046 - DNA, 25 bp, Mus musculus
ccgaccattgggtttaatgtggaga

SEQ ID NO: 904047 - DNA, 25 bp, Mus musculus
ccgacccaccaccggagccaggtat

SEQ ID NO: 904048 - DNA, 25 bp, Mus musculus
ccgacccaccacgggagccaggtat

SEQ ID NO: 904049 - DNA, 25 bp, Mus musculus
ccgacccagagtagctcacactcgc

SEQ ID NO: 904050 - DNA, 25 bp, Mus musculus
ccgacccagagttgctcacactcgc

SEQ ID NO: 904051 - DNA, 25 bp, Mus musculus
ccgaccccaagacttccgatgcctc

SEQ ID NO: 904052 - DNA, 25 bp, Mus musculus
ccgaccccaagagttccgatgcctc

SEQ ID NO: 904053 - DNA, 25 bp, Mus musculus
ccgaccctcaagctgccctatgaga

SEQ ID NO: 904054 - DNA, 25 bp, Mus musculus
ccgaccctcaaggtgccctatgaga

SEQ ID NO: 904055 - DNA, 25 bp, Mus musculus
ccgacctcactgatggccagttcta

SEQ ID NO: 904056 - DNA, 25 bp, Mus musculus
ccgacctcactgttggccagttcta

SEQ ID NO: 904057 - DNA, 25 bp, Mus musculus
ccgacctttggccacgcttacagtt

SEQ ID NO: 904058 - DNA, 25 bp, Mus musculus
ccgacctttggccaggcttacagtt

SEQ ID NO: 904059 - DNA, 25 bp, Mus musculus
ccgacgagatctatgagatcatgca

SEQ ID NO: 904060 - DNA, 25 bp, Mus musculus
ccgacgagatgtatgagatcatgca

SEQ ID NO: 904061 - DNA, 25 bp, Mus musculus
ccgacgctgacaaggactgggctgt

SEQ ID NO: 904062 - DNA, 25 bp, Mus musculus
ccgacgctgacatggactgggctgt

SEQ ID NO: 904063 - DNA, 25 bp, Mus musculus
ccgactacgatgcacctaacactta

SEQ ID NO: 904064 - DNA, 25 bp, Mus musculus
ccgactacgatggacctaacactta

SEQ ID NO: 904065 - DNA, 25 bp, Mus musculus
ccgactcagaagatctcttccagga

SEQ ID NO: 904066 - DNA, 25 bp, Mus musculus
ccgactcagaagttctcttccagga

SEQ ID NO: 904067 - DNA, 25 bp, Mus musculus
ccgactcctgagcacattgggaagc

SEQ ID NO: 904068 - DNA, 25 bp, Mus musculus
ccgactcctgagcagattgggaagc

SEQ ID NO: 904069 - DNA, 25 bp, Mus musculus
ccgactctgcagaatatgcacagcc

SEQ ID NO: 904070 - DNA, 25 bp, Mus musculus
ccgactctgcagtatatgcacagcc

SEQ ID NO: 904071 - DNA, 25 bp, Mus musculus
ccgactggtgggcaccttcatgttg

SEQ ID NO: 904072 - DNA, 25 bp, Mus musculus
ccgactggtgggcacggccttcgta

SEQ ID NO: 904073 - DNA, 25 bp, Mus musculus
ccgactggtgggcagcttcatgttg

SEQ ID NO: 904074 - DNA, 25 bp, Mus musculus
ccgactggtgggcagggccttcgta

SEQ ID NO: 904075 - DNA, 25 bp, Mus musculus
ccgactgtggggagtgccttcttca

SEQ ID NO: 904076 - DNA, 25 bp, Mus musculus
ccgactgtggggtgtgccttcttca

SEQ ID NO: 904077 - DNA, 25 bp, Mus musculus
ccgacttggtgaaaaggtacagttt

SEQ ID NO: 904078 - DNA, 25 bp, Mus musculus
ccgacttggtgaagaaaccattaga

SEQ ID NO: 904079 - DNA, 25 bp, Mus musculus
ccgacttggtgataaggtacagttt

SEQ ID NO: 904080 - DNA, 25 bp, Mus musculus
ccgacttggtgatgaaaccattaga

SEQ ID NO: 904081 - DNA, 25 bp, Mus musculus
ccgacttttcagagccactcagcac

SEQ ID NO: 904082 - DNA, 25 bp, Mus musculus
ccgacttttcagcgttcagactggg

SEQ ID NO: 904083 - DNA, 25 bp, Mus musculus
ccgacttttcagggttcagactggg

SEQ ID NO: 904084 - DNA, 25 bp, Mus musculus
ccgacttttcagtgccactcagcac

SEQ ID NO: 904085 - DNA, 25 bp, Mus musculus
ccgagacatgcagatcgagggcgca

SEQ ID NO: 904086 - DNA, 25 bp, Mus musculus
ccgagacatggagatcgagggcgca

SEQ ID NO: 904087 - DNA, 25 bp, Mus musculus
ccgagaccagacccctgagcagcta

SEQ ID NO: 904088 - DNA, 25 bp, Mus musculus
ccgagaccagatcatcttcatggta

SEQ ID NO: 904089 - DNA, 25 bp, Mus musculus
ccgagaccagtcccctgagcagcta

SEQ ID NO: 904090 - DNA, 25 bp, Mus musculus
ccgagaccagttcatcttcatggta

SEQ ID NO: 904091 - DNA, 25 bp, Mus musculus
ccgagactgttctgcaacctgatgt

SEQ ID NO: 904092 - DNA, 25 bp, Mus musculus
ccgagactgttctggaacctgatgt

SEQ ID NO: 904093 - DNA, 25 bp, Mus musculus
ccgagactttgtaatgtggaagttc

SEQ ID NO: 904094 - DNA, 25 bp, Mus musculus
ccgagactttgttatgtggaagttc

SEQ ID NO: 904095 - DNA, 25 bp, Mus musculus
ccgagagaaagtcgtggacatagaa

SEQ ID NO: 904096 - DNA, 25 bp, Mus musculus
ccgagagaaagtggtggacatagaa

SEQ ID NO: 904097 - DNA, 25 bp, Mus musculus
ccgagagaagacacagctggtatgg

SEQ ID NO: 904098 - DNA, 25 bp, Mus musculus
ccgagagaagaccaccaaggccttt

SEQ ID NO: 904099 - DNA, 25 bp, Mus musculus
ccgagagaagctcttgggcactgac

SEQ ID NO: 904100 - DNA, 25 bp, Mus musculus
ccgagagaagctgggtgacatcacc

SEQ ID NO: 904101 - DNA, 25 bp, Mus musculus
ccgagagaaggtcttgggcactgac

SEQ ID NO: 904102 - DNA, 25 bp, Mus musculus
ccgagagaaggtgggtgacatcacc

SEQ ID NO: 904103 - DNA, 25 bp, Mus musculus
ccgagagaagtcacagctggtatgg

SEQ ID NO: 904104 - DNA, 25 bp, Mus musculus
ccgagagaagtccaccaaggccttt

SEQ ID NO: 904105 - DNA, 25 bp, Mus musculus
ccgagagccactcattgccacagca

SEQ ID NO: 904106 - DNA, 25 bp, Mus musculus
ccgagagccactcgactgacagacg

SEQ ID NO: 904107 - DNA, 25 bp, Mus musculus
ccgagagccactgattgccacagca

SEQ ID NO: 904108 - DNA, 25 bp, Mus musculus
ccgagagccactggactgacagacg

SEQ ID NO: 904109 - DNA, 25 bp, Mus musculus
ccgagagccaggcgcagcacgcccc

SEQ ID NO: 904110 - DNA, 25 bp, Mus musculus
ccgagagccaggcggagcacgcccc

SEQ ID NO: 904111 - DNA, 25 bp, Mus musculus
ccgagagctccacatccatgatgag

SEQ ID NO: 904112 - DNA, 25 bp, Mus musculus
ccgagagctccagatccatgatgag

SEQ ID NO: 904113 - DNA, 25 bp, Mus musculus
ccgagaggaacgccgcgagaaccaa

SEQ ID NO: 904114 - DNA, 25 bp, Mus musculus
ccgagaggaacggcgcgagaaccaa

SEQ ID NO: 904115 - DNA, 25 bp, Mus musculus
ccgagaggttcgactgctttgcctt

SEQ ID NO: 904116 - DNA, 25 bp, Mus musculus
ccgagaggttcgtctgctttgcctt

SEQ ID NO: 904117 - DNA, 25 bp, Mus musculus
ccgagagtcaaacagcgtgcttccg

SEQ ID NO: 904118 - DNA, 25 bp, Mus musculus
ccgagagtcaaacgtgcttccggct

SEQ ID NO: 904119 - DNA, 25 bp, Mus musculus
ccgagagtcaaagagcgtgcttccg

SEQ ID NO: 904120 - DNA, 25 bp, Mus musculus
ccgagagtcaaaggtgcttccggct

SEQ ID NO: 904121 - DNA, 25 bp, Mus musculus
ccgagatgctgaatcgcaagagcta

SEQ ID NO: 904122 - DNA, 25 bp, Mus musculus
ccgagatgctgaatggcaagagcta

SEQ ID NO: 904123 - DNA, 25 bp, Mus musculus
ccgagcagcgaacagttgaatagat

SEQ ID NO: 904124 - DNA, 25 bp, Mus musculus
ccgagcagcgtacagttgaatagat

SEQ ID NO: 904125 - DNA, 25 bp, Mus musculus
ccgagcagctgacacgattcagttt

SEQ ID NO: 904126 - DNA, 25 bp, Mus musculus
ccgagcagctgacaggattcagttt

SEQ ID NO: 904127 - DNA, 25 bp, Mus musculus
ccgagcagtgccccgagacattcaa

SEQ ID NO: 904128 - DNA, 25 bp, Mus musculus
ccgagcagtggcccgagacattcaa

SEQ ID NO: 904129 - DNA, 25 bp, Mus musculus
ccgagccatgagctattactacaaa

SEQ ID NO: 904130 - DNA, 25 bp, Mus musculus
ccgagccatgaggtattactacaaa

SEQ ID NO: 904131 - DNA, 25 bp, Mus musculus
ccgagcgccctcagttgagccccac

SEQ ID NO: 904132 - DNA, 25 bp, Mus musculus
ccgagcgccctctgttgagccccac

SEQ ID NO: 904133 - DNA, 25 bp, Mus musculus
ccgagctcagcaaacaagttgggat

SEQ ID NO: 904134 - DNA, 25 bp, Mus musculus
ccgagctcagcaaagaagttgggat

SEQ ID NO: 904135 - DNA, 25 bp, Mus musculus
ccgagctggtgccacgcccagatta

SEQ ID NO: 904136 - DNA, 25 bp, Mus musculus
ccgagctggtgccaggcccagatta

SEQ ID NO: 904137 - DNA, 25 bp, Mus musculus
ccgaggaagagaaggtgaagctgga

SEQ ID NO: 904138 - DNA, 25 bp, Mus musculus
ccgaggaagagatggtgaagctgga

SEQ ID NO: 904139 - DNA, 25 bp, Mus musculus
ccgaggagacccgacgcccaggaga

SEQ ID NO: 904140 - DNA, 25 bp, Mus musculus
ccgaggagacccgaggcccaggaga

SEQ ID NO: 904141 - DNA, 25 bp, Mus musculus
ccgaggagctaaacagtgagatgat

SEQ ID NO: 904142 - DNA, 25 bp, Mus musculus
ccgaggagctaaatctgaagtccct

SEQ ID NO: 904143 - DNA, 25 bp, Mus musculus
ccgaggagctaatcagtgagatgat

SEQ ID NO: 904144 - DNA, 25 bp, Mus musculus
ccgaggagctaattctgaagtccct

SEQ ID NO: 904145 - DNA, 25 bp, Mus musculus
ccgaggagggccgtgctggtcacca

SEQ ID NO: 904146 - DNA, 25 bp, Mus musculus
ccgaggaggggcgtgctggtcacca

SEQ ID NO: 904147 - DNA, 25 bp, Mus musculus
ccgaggatggagaacaagtgggaaa

SEQ ID NO: 904148 - DNA, 25 bp, Mus musculus
ccgaggatggagaagaagtgggaaa

SEQ ID NO: 904149 - DNA, 25 bp, Mus musculus
ccgaggccaaccctccagaaggatg

SEQ ID NO: 904150 - DNA, 25 bp, Mus musculus
ccgaggccaaccctgtgctgctgaa

SEQ ID NO: 904151 - DNA, 25 bp, Mus musculus
ccgaggccaaccgtccagaaggatg

SEQ ID NO: 904152 - DNA, 25 bp, Mus musculus
ccgaggccaaccgtgtgctgctgaa

SEQ ID NO: 904153 - DNA, 25 bp, Mus musculus
ccgaggccatcaccgctgcatgcac

SEQ ID NO: 904154 - DNA, 25 bp, Mus musculus
ccgaggccatcagcgctgcatgcac

SEQ ID NO: 904155 - DNA, 25 bp, Mus musculus
ccgagggagacgcactgatggagga

SEQ ID NO: 904156 - DNA, 25 bp, Mus musculus
ccgagggagaggcactgatggagga

SEQ ID NO: 904157 - DNA, 25 bp, Mus musculus
ccgagggatgctcaaggacagtgct

SEQ ID NO: 904158 - DNA, 25 bp, Mus musculus
ccgagggatgctcatggacagtgct

SEQ ID NO: 904159 - DNA, 25 bp, Mus musculus
ccgagggctgaactatatacattcg

SEQ ID NO: 904160 - DNA, 25 bp, Mus musculus
ccgagggctgaagtatatacattcg

SEQ ID NO: 904161 - DNA, 25 bp, Mus musculus
ccgaggggtcatcaccctgtctcag

SEQ ID NO: 904162 - DNA, 25 bp, Mus musculus
ccgaggggtcatcagcctgtctcag

SEQ ID NO: 904163 - DNA, 25 bp, Mus musculus
ccgaggtcacagatgaaattatgga

SEQ ID NO: 904164 - DNA, 25 bp, Mus musculus
ccgaggtcacagttgaaattatgga

SEQ ID NO: 904165 - DNA, 25 bp, Mus musculus
ccgaggtcatcctgcagttgggctg

SEQ ID NO: 904166 - DNA, 25 bp, Mus musculus
ccgaggtcatcctggagttgggctg

SEQ ID NO: 904167 - DNA, 25 bp, Mus musculus
ccgagtataagcaattaaccctgaa

SEQ ID NO: 904168 - DNA, 25 bp, Mus musculus
ccgagtataagctattaaccctgaa

SEQ ID NO: 904169 - DNA, 25 bp, Mus musculus
ccgagtcctcagcccaatgtgcttt

SEQ ID NO: 904170 - DNA, 25 bp, Mus musculus
ccgagtcctcaggccaatgtgcttt

SEQ ID NO: 904171 - DNA, 25 bp, Mus musculus
ccgagtgcagtgcccctggaccata

SEQ ID NO: 904172 - DNA, 25 bp, Mus musculus
ccgagtgcagtggccctggaccata

SEQ ID NO: 904173 - DNA, 25 bp, Mus musculus
ccgagtgccattaacggagaaatca

SEQ ID NO: 904174 - DNA, 25 bp, Mus musculus
ccgagtgccattaagggagaaatca

SEQ ID NO: 904175 - DNA, 25 bp, Mus musculus
ccgagtggcacaccacgcccgggcg

SEQ ID NO: 904176 - DNA, 25 bp, Mus musculus
ccgagtggcacagcacgcccgggcg

SEQ ID NO: 904177 - DNA, 25 bp, Mus musculus
ccgagttcagattctccgagtcaag

SEQ ID NO: 904178 - DNA, 25 bp, Mus musculus
ccgagttcagcgaacagattctccg

SEQ ID NO: 904179 - DNA, 25 bp, Mus musculus
ccgagttcagggaacagattctccg

SEQ ID NO: 904180 - DNA, 25 bp, Mus musculus
ccgagttcagtttctccgagtcaag

SEQ ID NO: 904181 - DNA, 25 bp, Mus musculus
ccgagttcggactttctgcactggc

SEQ ID NO: 904182 - DNA, 25 bp, Mus musculus
ccgagttcggtctttctgcactggc

SEQ ID NO: 904183 - DNA, 25 bp, Mus musculus
ccgagtttgtcgcccccgagatcgt

SEQ ID NO: 904184 - DNA, 25 bp, Mus musculus
ccgagtttgtcggccccgagatcgt

SEQ ID NO: 904185 - DNA, 25 bp, Mus musculus
ccgataactaaccacattgaatgtc

SEQ ID NO: 904186 - DNA, 25 bp, Mus musculus
ccgataactaaccagattgaatgtc

SEQ ID NO: 904187 - DNA, 25 bp, Mus musculus
ccgataggaagtatgaacatcatct

SEQ ID NO: 904188 - DNA, 25 bp, Mus musculus
ccgataggaagtttgaacatcatct

SEQ ID NO: 904189 - DNA, 25 bp, Mus musculus
ccgataggcagaccagctccatcag

SEQ ID NO: 904190 - DNA, 25 bp, Mus musculus
ccgataggcagacgtcagtaccatg

SEQ ID NO: 904191 - DNA, 25 bp, Mus musculus
ccgataggcagagcagctccatcag

SEQ ID NO: 904192 - DNA, 25 bp, Mus musculus
ccgataggcagaggtcagtaccatg

SEQ ID NO: 904193 - DNA, 25 bp, Mus musculus
ccgatcagtgtgagaatatacactt

SEQ ID NO: 904194 - DNA, 25 bp, Mus musculus
ccgatcagtgtgagtatatacactt

SEQ ID NO: 904195 - DNA, 25 bp, Mus musculus
ccgatccaacagaccctcaggactt

SEQ ID NO: 904196 - DNA, 25 bp, Mus musculus
ccgatccaacagtccctcaggactt

SEQ ID NO: 904197 - DNA, 25 bp, Mus musculus
ccgatccaccacagtgcgcctgctg

SEQ ID NO: 904198 - DNA, 25 bp, Mus musculus
ccgatccaccactgtgcgcctgctg

SEQ ID NO: 904199 - DNA, 25 bp, Mus musculus
ccgatgaagtcaactccctcatgga

SEQ ID NO: 904200 - DNA, 25 bp, Mus musculus
ccgatgaagtgaactccctcatgga

SEQ ID NO: 904201 - DNA, 25 bp, Mus musculus
ccgatgacgtcttgcctcatgctgc

SEQ ID NO: 904202 - DNA, 25 bp, Mus musculus
ccgatgacgtcttggctcatgctgc

SEQ ID NO: 904203 - DNA, 25 bp, Mus musculus
ccgatgagtacaaaccatacgagga

SEQ ID NO: 904204 - DNA, 25 bp, Mus musculus
ccgatgagtacaaagcatacgagga

SEQ ID NO: 904205 - DNA, 25 bp, Mus musculus
ccgatgatcttgcttttgagttctt

SEQ ID NO: 904206 - DNA, 25 bp, Mus musculus
ccgatgatcttggttttgagttctt

SEQ ID NO: 904207 - DNA, 25 bp, Mus musculus
ccgatggacagcaactattgacagt

SEQ ID NO: 904208 - DNA, 25 bp, Mus musculus
ccgatggacagcaagtattgacagt

SEQ ID NO: 904209 - DNA, 25 bp, Mus musculus
ccgatggactctgaaagcagagcgt

SEQ ID NO: 904210 - DNA, 25 bp, Mus musculus
ccgatggactctgatagcagagcgt

SEQ ID NO: 904211 - DNA, 25 bp, Mus musculus
ccgattgaaaaacatccatttcctg

SEQ ID NO: 904212 - DNA, 25 bp, Mus musculus
ccgattgaaatacatccatttcctg

SEQ ID NO: 904213 - DNA, 25 bp, Mus musculus
ccgattggttacctcccctttgtag

SEQ ID NO: 904214 - DNA, 25 bp, Mus musculus
ccgattggttacctgccctttgtag

SEQ ID NO: 904215 - DNA, 25 bp, Mus musculus
ccgcaaagggatgccattccgccag

SEQ ID NO: 904216 - DNA, 25 bp, Mus musculus
ccgcaaagggttgccattccgccag

SEQ ID NO: 904217 - DNA, 25 bp, Mus musculus
ccgcaacacggacacactggtccct

SEQ ID NO: 904218 - DNA, 25 bp, Mus musculus
ccgcaacacggacagactggtccct

SEQ ID NO: 904219 - DNA, 25 bp, Mus musculus
ccgcaacagtaacaagatgcagagc

SEQ ID NO: 904220 - DNA, 25 bp, Mus musculus
ccgcaacagtaagaagatgcagagc

SEQ ID NO: 904221 - DNA, 25 bp, Mus musculus
ccgcaacggccccacaaattactgt

SEQ ID NO: 904222 - DNA, 25 bp, Mus musculus
ccgcaacggccccacaagctgactg

SEQ ID NO: 904223 - DNA, 25 bp, Mus musculus
ccgcaacggccccagaaattactgt

SEQ ID NO: 904224 - DNA, 25 bp, Mus musculus
ccgcaacggccccagaagctgactg

SEQ ID NO: 904225 - DNA, 25 bp, Mus musculus
ccgcaactacagctctcaccccacc

SEQ ID NO: 904226 - DNA, 25 bp, Mus musculus
ccgcaactacaggtctcaccccacc

SEQ ID NO: 904227 - DNA, 25 bp, Mus musculus
ccgcaacttacaggaagttgtgcca

SEQ ID NO: 904228 - DNA, 25 bp, Mus musculus
ccgcaacttacaggtagttgtgcca

SEQ ID NO: 904229 - DNA, 25 bp, Mus musculus
ccgcaagaagccggcggctctgcca

SEQ ID NO: 904230 - DNA, 25 bp, Mus musculus
ccgcaagaagccgggggctctgcca

SEQ ID NO: 904231 - DNA, 25 bp, Mus musculus
ccgcaagcagcagtctctggtccca

SEQ ID NO: 904232 - DNA, 25 bp, Mus musculus
ccgcaagcaggagtctctggtccca

SEQ ID NO: 904233 - DNA, 25 bp, Mus musculus
ccgcaagccaggacccacctgcaca

SEQ ID NO: 904234 - DNA, 25 bp, Mus musculus
ccgcaagccaggtcccacctgcaca

SEQ ID NO: 904235 - DNA, 25 bp, Mus musculus
ccgcaagcgagaccccatcagtgag

SEQ ID NO: 904236 - DNA, 25 bp, Mus musculus
ccgcaagcgagagcccatcagtgag

SEQ ID NO: 904237 - DNA, 25 bp, Mus musculus
ccgcaagctgactgatcagtgcaca

SEQ ID NO: 904238 - DNA, 25 bp, Mus musculus
ccgcaagctgccccccaagtgtcca

SEQ ID NO: 904239 - DNA, 25 bp, Mus musculus
ccgcaagctggcccccaagtgtcca

SEQ ID NO: 904240 - DNA, 25 bp, Mus musculus
ccgcaagctgtctgatcagtgcaca

SEQ ID NO: 904241 - DNA, 25 bp, Mus musculus
ccgcaagggccacctggcaaagatg

SEQ ID NO: 904242 - DNA, 25 bp, Mus musculus
ccgcaagggccagctggcaaagatg

SEQ ID NO: 904243 - DNA, 25 bp, Mus musculus
ccgcacaagtacaccacagacggca

SEQ ID NO: 904244 - DNA, 25 bp, Mus musculus
ccgcacaagtacaccgaaatgtgtc

SEQ ID NO: 904245 - DNA, 25 bp, Mus musculus
ccgcacaagtacacgacagacggca

SEQ ID NO: 904246 - DNA, 25 bp, Mus musculus
ccgcacaagtacacggaaatgtgtc

SEQ ID NO: 904247 - DNA, 25 bp, Mus musculus
ccgcacagcctgctcttcctcctgg

SEQ ID NO: 904248 - DNA, 25 bp, Mus musculus
ccgcacagcctggtcttcctcctgg

SEQ ID NO: 904249 - DNA, 25 bp, Mus musculus
ccgcacccccatcacccccctcaag

SEQ ID NO: 904250 - DNA, 25 bp, Mus musculus
ccgcacccccatcagccccctcaag

SEQ ID NO: 904251 - DNA, 25 bp, Mus musculus
ccgcaccgccaacgagatcatagac

SEQ ID NO: 904252 - DNA, 25 bp, Mus musculus
ccgcaccgccaaggagatcatagac

SEQ ID NO: 904253 - DNA, 25 bp, Mus musculus
ccgcacctccagacaagttcagaat

SEQ ID NO: 904254 - DNA, 25 bp, Mus musculus
ccgcacctccagtcaagttcagaat

SEQ ID NO: 904255 - DNA, 25 bp, Mus musculus
ccgcacctccttccagaagagtaaa

SEQ ID NO: 904256 - DNA, 25 bp, Mus musculus
ccgcacctccttcctgaagagtaaa

SEQ ID NO: 904257 - DNA, 25 bp, Mus musculus
ccgcacctgcaacagagagttgaca

SEQ ID NO: 904258 - DNA, 25 bp, Mus musculus
ccgcacctgcaacaggagagagttg

SEQ ID NO: 904259 - DNA, 25 bp, Mus musculus
ccgcacctgcaagagagagttgaca

SEQ ID NO: 904260 - DNA, 25 bp, Mus musculus
ccgcacctgcaagaggagagagttg

SEQ ID NO: 904261 - DNA, 25 bp, Mus musculus
ccgcagagagcaactggcccaaatc

SEQ ID NO: 904262 - DNA, 25 bp, Mus musculus
ccgcagagaggaactggcccaaatc

SEQ ID NO: 904263 - DNA, 25 bp, Mus musculus
ccgcagcaccggcgtgttgcccacc

SEQ ID NO: 904264 - DNA, 25 bp, Mus musculus
ccgcagcaccggggtgttgcccacc

SEQ ID NO: 904265 - DNA, 25 bp, Mus musculus
ccgcagcagcccagtttgatctgtg

SEQ ID NO: 904266 - DNA, 25 bp, Mus musculus
ccgcagcagccctgctgtctgagag

SEQ ID NO: 904267 - DNA, 25 bp, Mus musculus
ccgcagcagccctggtgtctgagag

SEQ ID NO: 904268 - DNA, 25 bp, Mus musculus
ccgcagcagccctgtttgatctgtg

SEQ ID NO: 904269 - DNA, 25 bp, Mus musculus
ccgcagccatacagccccagaggct

SEQ ID NO: 904270 - DNA, 25 bp, Mus musculus
ccgcagccatactgccccagaggct

SEQ ID NO: 904271 - DNA, 25 bp, Mus musculus
ccgcagccatgaccaaagtctcacg

SEQ ID NO: 904272 - DNA, 25 bp, Mus musculus
ccgcagccatgaccagcaaagtctc

SEQ ID NO: 904273 - DNA, 25 bp, Mus musculus
ccgcagccatgagcaaagtctcacg

SEQ ID NO: 904274 - DNA, 25 bp, Mus musculus
ccgcagccatgagcagcaaagtctc

SEQ ID NO: 904275 - DNA, 25 bp, Mus musculus
ccgcagcccccgcacggagctccgc

SEQ ID NO: 904276 - DNA, 25 bp, Mus musculus
ccgcagcccccgcagggagctccgc

SEQ ID NO: 904277 - DNA, 25 bp, Mus musculus
ccgcagcgtgagccagtgggtgttt

SEQ ID NO: 904278 - DNA, 25 bp, Mus musculus
ccgcagcgtgagctcctggtatttt

SEQ ID NO: 904279 - DNA, 25 bp, Mus musculus
ccgcagcgtgaggcagtgggtgttt

SEQ ID NO: 904280 - DNA, 25 bp, Mus musculus
ccgcagcgtgaggtcctggtatttt

SEQ ID NO: 904281 - DNA, 25 bp, Mus musculus
ccgcaggacgcggaaccatgtgccc

SEQ ID NO: 904282 - DNA, 25 bp, Mus musculus
ccgcaggacggggaaccatgtgccc

SEQ ID NO: 904283 - DNA, 25 bp, Mus musculus
ccgcaggccccagtcggctctgtgt

SEQ ID NO: 904284 - DNA, 25 bp, Mus musculus
ccgcaggccccagtgggctctgtgt

SEQ ID NO: 904285 - DNA, 25 bp, Mus musculus
ccgcaggcggaaagtatccattatg

SEQ ID NO: 904286 - DNA, 25 bp, Mus musculus
ccgcaggcggaatgtatccattatg

SEQ ID NO: 904287 - DNA, 25 bp, Mus musculus
ccgcagggtattagtaaagatgagc

SEQ ID NO: 904288 - DNA, 25 bp, Mus musculus
ccgcagggtatttgtaaagatgagc

SEQ ID NO: 904289 - DNA, 25 bp, Mus musculus
ccgcagtgcccacacctgtgttaca

SEQ ID NO: 904290 - DNA, 25 bp, Mus musculus
ccgcagtgcccaccagcatcactat

SEQ ID NO: 904291 - DNA, 25 bp, Mus musculus
ccgcagtgcccaccatcactatttc

SEQ ID NO: 904292 - DNA, 25 bp, Mus musculus
ccgcagtgcccagacctgtgttaca

SEQ ID NO: 904293 - DNA, 25 bp, Mus musculus
ccgcagtgcccagcagcatcactat

SEQ ID NO: 904294 - DNA, 25 bp, Mus musculus
ccgcagtgcccagcatcactatttc

SEQ ID NO: 904295 - DNA, 25 bp, Mus musculus
ccgcagtgtcaacgtggccaaagtg

SEQ ID NO: 904296 - DNA, 25 bp, Mus musculus
ccgcagtgtcaaggtggccaaagtg

SEQ ID NO: 904297 - DNA, 25 bp, Mus musculus
ccgcagtgtgagtgcctgctcactg

SEQ ID NO: 904298 - DNA, 25 bp, Mus musculus
ccgcagtgtgtgtgcctgctcactg

SEQ ID NO: 904299 - DNA, 25 bp, Mus musculus
ccgcatcagatccgcatcaagcaga

SEQ ID NO: 904300 - DNA, 25 bp, Mus musculus
ccgcatcagatcggcatcaagcaga

SEQ ID NO: 904301 - DNA, 25 bp, Mus musculus
ccgcatccagagcagcgaggcctcc

SEQ ID NO: 904302 - DNA, 25 bp, Mus musculus
ccgcatccagagcatgctgcccaga

SEQ ID NO: 904303 - DNA, 25 bp, Mus musculus
ccgcatccagaggatgctgcccaga

SEQ ID NO: 904304 - DNA, 25 bp, Mus musculus
ccgcatccagtcaacggcctttgat

SEQ ID NO: 904305 - DNA, 25 bp, Mus musculus
ccgcatccagtcaagggcctttgat

SEQ ID NO: 904306 - DNA, 25 bp, Mus musculus
ccgcatccagtgcagcgaggcctcc

SEQ ID NO: 904307 - DNA, 25 bp, Mus musculus
ccgcatctcaacaacgacttggctt

SEQ ID NO: 904308 - DNA, 25 bp, Mus musculus
ccgcatctcaacaaggacttggctt

SEQ ID NO: 904309 - DNA, 25 bp, Mus musculus
ccgcatgaagagtgggcggctggtg

SEQ ID NO: 904310 - DNA, 25 bp, Mus musculus
ccgcatgaagtgtgggcggctggtg

SEQ ID NO: 904311 - DNA, 25 bp, Mus musculus
ccgcattcagagcgttctcatcgtg

SEQ ID NO: 904312 - DNA, 25 bp, Mus musculus
ccgcattcagagggttctcatcgtg

SEQ ID NO: 904313 - DNA, 25 bp, Mus musculus
ccgccaccaccgctcacgatgcaga

SEQ ID NO: 904314 - DNA, 25 bp, Mus musculus
ccgccaccaccgctgacgatgcaga

SEQ ID NO: 904315 - DNA, 25 bp, Mus musculus
ccgccaccacctcgaactggtgagc

SEQ ID NO: 904316 - DNA, 25 bp, Mus musculus
ccgccaccacctggaactggtgagc

SEQ ID NO: 904317 - DNA, 25 bp, Mus musculus
ccgccacccaaacgcagaagagtgt

SEQ ID NO: 904318 - DNA, 25 bp, Mus musculus
ccgccacccaaaggcagaagagtgt

SEQ ID NO: 904319 - DNA, 25 bp, Mus musculus
ccgccactattaaacctggtgatga

SEQ ID NO: 904320 - DNA, 25 bp, Mus musculus
ccgccactattatacctggtgatga

SEQ ID NO: 904321 - DNA, 25 bp, Mus musculus
ccgccagcgccgaccgtgacctcgt

SEQ ID NO: 904322 - DNA, 25 bp, Mus musculus
ccgccagcgccgtccgtgacctcgt

SEQ ID NO: 904323 - DNA, 25 bp, Mus musculus
ccgccaggtgggagggatgaggtga

SEQ ID NO: 904324 - DNA, 25 bp, Mus musculus
ccgccaggtgggtgggatgaggtga

SEQ ID NO: 904325 - DNA, 25 bp, Mus musculus
ccgccagtgtcacgtcaattaccat

SEQ ID NO: 904326 - DNA, 25 bp, Mus musculus
ccgccagtgtcaggtcaattaccat

SEQ ID NO: 904327 - DNA, 25 bp, Mus musculus
ccgccatatcagcaacaagttcctg

SEQ ID NO: 904328 - DNA, 25 bp, Mus musculus
ccgccatatcaggaacaagttcctg

SEQ ID NO: 904329 - DNA, 25 bp, Mus musculus
ccgccatccacacgttccgccaggt

SEQ ID NO: 904330 - DNA, 25 bp, Mus musculus
ccgccatccacaggttccgccaggt

SEQ ID NO: 904331 - DNA, 25 bp, Mus musculus
ccgccatcgtagctgccgatcccct

SEQ ID NO: 904332 - DNA, 25 bp, Mus musculus
ccgccatcgtaggtgccgatcccct

SEQ ID NO: 904333 - DNA, 25 bp, Mus musculus
ccgccatgaacctcaacgtggacgg

SEQ ID NO: 904334 - DNA, 25 bp, Mus musculus
ccgccatgaagctcaacgtggacgg

SEQ ID NO: 904335 - DNA, 25 bp, Mus musculus
ccgccatgctcgagggctccctgct

SEQ ID NO: 904336 - DNA, 25 bp, Mus musculus
ccgccatgctcgtgggctccctgct

SEQ ID NO: 904337 - DNA, 25 bp, Mus musculus
ccgccatggactcctccaccttcgc

SEQ ID NO: 904338 - DNA, 25 bp, Mus musculus
ccgccatggagtcctccaccttcgc

SEQ ID NO: 904339 - DNA, 25 bp, Mus musculus
ccgccatggcgaacaaatttctgga

SEQ ID NO: 904340 - DNA, 25 bp, Mus musculus
ccgccatggcgatcaaatttctgga

SEQ ID NO: 904341 - DNA, 25 bp, Mus musculus
ccgcccacagagatgagccgccaga

SEQ ID NO: 904342 - DNA, 25 bp, Mus musculus
ccgcccacagtgatgagccgccaga

SEQ ID NO: 904343 - DNA, 25 bp, Mus musculus
ccgcccagcacacgtcaattctttg

SEQ ID NO: 904344 - DNA, 25 bp, Mus musculus
ccgcccagcacaggtcaattctttg

SEQ ID NO: 904345 - DNA, 25 bp, Mus musculus
ccgcccatgtaccaagtgtccccaa

SEQ ID NO: 904346 - DNA, 25 bp, Mus musculus
ccgcccatgtaccatgtgtccccaa

SEQ ID NO: 904347 - DNA, 25 bp, Mus musculus
ccgccccattgacgtgaccagaatg

SEQ ID NO: 904348 - DNA, 25 bp, Mus musculus
ccgccccattgaggtgaccagaatg

SEQ ID NO: 904349 - DNA, 25 bp, Mus musculus
ccgcccggagatgacgcgtcgatca

SEQ ID NO: 904350 - DNA, 25 bp, Mus musculus
ccgcccggagatgaggcgtcgatca

SEQ ID NO: 904351 - DNA, 25 bp, Mus musculus
ccgcccggagctgcttgaggcgagc

SEQ ID NO: 904352 - DNA, 25 bp, Mus musculus
ccgcccggaggtgcttgaggcgagc

SEQ ID NO: 904353 - DNA, 25 bp, Mus musculus
ccgcccgggctgcacatcatgccac

SEQ ID NO: 904354 - DNA, 25 bp, Mus musculus
ccgcccgggctggacatcatgccac

SEQ ID NO: 904355 - DNA, 25 bp, Mus musculus
ccgccctcgggacattatcaacaca

SEQ ID NO: 904356 - DNA, 25 bp, Mus musculus
ccgccctcgggagattatcaacaca

SEQ ID NO: 904357 - DNA, 25 bp, Mus musculus
ccgcccttctagagtggcccgtgat

SEQ ID NO: 904358 - DNA, 25 bp, Mus musculus
ccgcccttctagtgtggcccgtgat

SEQ ID NO: 904359 - DNA, 25 bp, Mus musculus
ccgcccttgtggctagctcctacat

SEQ ID NO: 904360 - DNA, 25 bp, Mus musculus
ccgcccttgtgggtagctcctacat

SEQ ID NO: 904361 - DNA, 25 bp, Mus musculus
ccgccgaaagaccacccaacaattc

SEQ ID NO: 904362 - DNA, 25 bp, Mus musculus
ccgccgaaagaccagccaacaattc

SEQ ID NO: 904363 - DNA, 25 bp, Mus musculus
ccgccgaaggagcacgagccgctcc

SEQ ID NO: 904364 - DNA, 25 bp, Mus musculus
ccgccgaaggagcaggagccgctcc

SEQ ID NO: 904365 - DNA, 25 bp, Mus musculus
ccgccgccagctgtgcaacagaaga

SEQ ID NO: 904366 - DNA, 25 bp, Mus musculus
ccgccgccaggtgtgcaacagaaga

SEQ ID NO: 904367 - DNA, 25 bp, Mus musculus
ccgccgccatatcacgaacaagttc

SEQ ID NO: 904368 - DNA, 25 bp, Mus musculus
ccgccgccatatcaggaacaagttc

SEQ ID NO: 904369 - DNA, 25 bp, Mus musculus
ccgccgccatggcgatcaaatttct

SEQ ID NO: 904370 - DNA, 25 bp, Mus musculus
ccgccgccatggcgttcaaatttct

SEQ ID NO: 904371 - DNA, 25 bp, Mus musculus
ccgccgccgccgcccgtgcataagt

SEQ ID NO: 904372 - DNA, 25 bp, Mus musculus
ccgccgccgccgccggtgcataagt

SEQ ID NO: 904373 - DNA, 25 bp, Mus musculus
ccgccgccgccgctgcataagtaaa

SEQ ID NO: 904374 - DNA, 25 bp, Mus musculus
ccgccgccgccggtgcataagtaaa

SEQ ID NO: 904375 - DNA, 25 bp, Mus musculus
ccgccgctcgccggccctgctgagg

SEQ ID NO: 904376 - DNA, 25 bp, Mus musculus
ccgccgctcgcttacctgccttgcg

SEQ ID NO: 904377 - DNA, 25 bp, Mus musculus
ccgccgctcggcggccctgctgagg

SEQ ID NO: 904378 - DNA, 25 bp, Mus musculus
ccgccgctcggttacctgccttgcg

SEQ ID NO: 904379 - DNA, 25 bp, Mus musculus
ccgccgctgccgcagattggcagac

SEQ ID NO: 904380 - DNA, 25 bp, Mus musculus
ccgccgctgccggagattggcagac

SEQ ID NO: 904381 - DNA, 25 bp, Mus musculus
ccgccggaagtgaaccccctgcccg

SEQ ID NO: 904382 - DNA, 25 bp, Mus musculus
ccgccggaagtgaagcccctgcccg

SEQ ID NO: 904383 - DNA, 25 bp, Mus musculus
ccgccggagctgatttatgaccaga

SEQ ID NO: 904384 - DNA, 25 bp, Mus musculus
ccgccggagctgttttatgaccaga

SEQ ID NO: 904385 - DNA, 25 bp, Mus musculus
ccgccggccaatgggcccagtgcac

SEQ ID NO: 904386 - DNA, 25 bp, Mus musculus
ccgccggccagccacataagtacgg

SEQ ID NO: 904387 - DNA, 25 bp, Mus musculus
ccgccggccagccagataagtacgg

SEQ ID NO: 904388 - DNA, 25 bp, Mus musculus
ccgccggccattgggcccagtgcac

SEQ ID NO: 904389 - DNA, 25 bp, Mus musculus
ccgccggcgcgcgccgagacctggt

SEQ ID NO: 904390 - DNA, 25 bp, Mus musculus
ccgccggcgcgcgcggagacctggt

SEQ ID NO: 904391 - DNA, 25 bp, Mus musculus
ccgccggctactatctctcagacct

SEQ ID NO: 904392 - DNA, 25 bp, Mus musculus
ccgccggctagtatctctcagacct

SEQ ID NO: 904393 - DNA, 25 bp, Mus musculus
ccgccgggagatgctgttgacggag

SEQ ID NO: 904394 - DNA, 25 bp, Mus musculus
ccgccgggagttgctgttgacggag

SEQ ID NO: 904395 - DNA, 25 bp, Mus musculus
ccgccggggcaacgtctgttcacta

SEQ ID NO: 904396 - DNA, 25 bp, Mus musculus
ccgccggggcaaggtctgttcacta

SEQ ID NO: 904397 - DNA, 25 bp, Mus musculus
ccgccgttggcctggctgccgtgtg

SEQ ID NO: 904398 - DNA, 25 bp, Mus musculus
ccgccgttgggctggctgccgtgtg

SEQ ID NO: 904399 - DNA, 25 bp, Mus musculus
ccgcctacagcacgaagcccaatgc

SEQ ID NO: 904400 - DNA, 25 bp, Mus musculus
ccgcctacagcaggaagcccaatgc

SEQ ID NO: 904401 - DNA, 25 bp, Mus musculus
ccgcctcaccaacgtgtctctgaag

SEQ ID NO: 904402 - DNA, 25 bp, Mus musculus
ccgcctcaccaaggtgtctctgaag

SEQ ID NO: 904403 - DNA, 25 bp, Mus musculus
ccgcctcgacttaactgacagtatc

SEQ ID NO: 904404 - DNA, 25 bp, Mus musculus
ccgcctcgacttaagtgacagtatc

SEQ ID NO: 904405 - DNA, 25 bp, Mus musculus
ccgcctctggcctggagccttcctc

SEQ ID NO: 904406 - DNA, 25 bp, Mus musculus
ccgcctctgggctggagccttcctc

SEQ ID NO: 904407 - DNA, 25 bp, Mus musculus
ccgcctcttaagggagatcgccacg

SEQ ID NO: 904408 - DNA, 25 bp, Mus musculus
ccgcctcttaagggtgatcgccacg

SEQ ID NO: 904409 - DNA, 25 bp, Mus musculus
ccgcctcttgaagaagtttcctgtg

SEQ ID NO: 904410 - DNA, 25 bp, Mus musculus
ccgcctcttgaagatgtttcctgtg

SEQ ID NO: 904411 - DNA, 25 bp, Mus musculus
ccgcctgatcaacatgacagcatgg

SEQ ID NO: 904412 - DNA, 25 bp, Mus musculus
ccgcctgatcaacttctcctactca

SEQ ID NO: 904413 - DNA, 25 bp, Mus musculus
ccgcctgatcaagatgacagcatgg

SEQ ID NO: 904414 - DNA, 25 bp, Mus musculus
ccgcctgatcaagttctcctactca

SEQ ID NO: 904415 - DNA, 25 bp, Mus musculus
ccgcctgccgcacgtggccatggct

SEQ ID NO: 904416 - DNA, 25 bp, Mus musculus
ccgcctgccgcaggtggccatggct

SEQ ID NO: 904417 - DNA, 25 bp, Mus musculus
ccgcctgcggttaactgagcaaacc

SEQ ID NO: 904418 - DNA, 25 bp, Mus musculus
ccgcctgcggttaagtgagcaaacc

SEQ ID NO: 904419 - DNA, 25 bp, Mus musculus
ccgcctgggcagcgatccctgctgc

SEQ ID NO: 904420 - DNA, 25 bp, Mus musculus
ccgcctgggcagggatccctgctgc

SEQ ID NO: 904421 - DNA, 25 bp, Mus musculus
ccgcctggtcttctgggccgagtgg

SEQ ID NO: 904422 - DNA, 25 bp, Mus musculus
ccgcctggtcttgtgggccgagtgg

SEQ ID NO: 904423 - DNA, 25 bp, Mus musculus
ccgcctgtgcaacgagaacggctta

SEQ ID NO: 904424 - DNA, 25 bp, Mus musculus
ccgcctgtgcaaggagaacggctta

SEQ ID NO: 904425 - DNA, 25 bp, Mus musculus
ccgcctgtgccgcccccgtctcctt

SEQ ID NO: 904426 - DNA, 25 bp, Mus musculus
ccgcctgtgccggccccgtctcctt

SEQ ID NO: 904427 - DNA, 25 bp, Mus musculus
ccgccttcgccacttctcaggccgc

SEQ ID NO: 904428 - DNA, 25 bp, Mus musculus
ccgccttcgccagttctcaggccgc

SEQ ID NO: 904429 - DNA, 25 bp, Mus musculus
ccgccttgcacacagaagtgattga

SEQ ID NO: 904430 - DNA, 25 bp, Mus musculus
ccgccttgcacagagaagtgattga

SEQ ID NO: 904431 - DNA, 25 bp, Mus musculus
ccgccttgcccacgcagagaactct

SEQ ID NO: 904432 - DNA, 25 bp, Mus musculus
ccgccttgcccaggcagagaactct

SEQ ID NO: 904433 - DNA, 25 bp, Mus musculus
ccgccttggaggaggctcagctgcg

SEQ ID NO: 904434 - DNA, 25 bp, Mus musculus
ccgccttggaggtggctcagctgcg

SEQ ID NO: 904435 - DNA, 25 bp, Mus musculus
ccgcctttggagcatggaagagtgt

SEQ ID NO: 904436 - DNA, 25 bp, Mus musculus
ccgcctttggaggatggaagagtgt

SEQ ID NO: 904437 - DNA, 25 bp, Mus musculus
ccgcctttggcaactgcgagtgcta

SEQ ID NO: 904438 - DNA, 25 bp, Mus musculus
ccgcctttggcactcagaccaagcc

SEQ ID NO: 904439 - DNA, 25 bp, Mus musculus
ccgcctttggcactgtagctatctc

SEQ ID NO: 904440 - DNA, 25 bp, Mus musculus
ccgcctttggcagtcagaccaagcc

SEQ ID NO: 904441 - DNA, 25 bp, Mus musculus
ccgcctttggcagtgtagctatctc

SEQ ID NO: 904442 - DNA, 25 bp, Mus musculus
ccgcctttggcatctgcgagtgcta

SEQ ID NO: 904443 - DNA, 25 bp, Mus musculus
ccgcgaacaacaccccctctatggc

SEQ ID NO: 904444 - DNA, 25 bp, Mus musculus
ccgcgaacaagaccccctctatggc

SEQ ID NO: 904445 - DNA, 25 bp, Mus musculus
ccgcgacaaacagaacagaaaagaa

SEQ ID NO: 904446 - DNA, 25 bp, Mus musculus
ccgcgacaaacagaatgcaacaagg

SEQ ID NO: 904447 - DNA, 25 bp, Mus musculus
ccgcgacaaacagatcagaaaagaa

SEQ ID NO: 904448 - DNA, 25 bp, Mus musculus
ccgcgacaaacagattgcaacaagg

SEQ ID NO: 904449 - DNA, 25 bp, Mus musculus
ccgcgacatgcactgtcctgtgcag

SEQ ID NO: 904450 - DNA, 25 bp, Mus musculus
ccgcgacatggactgtcctgtgcag

SEQ ID NO: 904451 - DNA, 25 bp, Mus musculus
ccgcgagcaggacgcgaaggatgcg

SEQ ID NO: 904452 - DNA, 25 bp, Mus musculus
ccgcgagcaggacgggaaggatgcg

SEQ ID NO: 904453 - DNA, 25 bp, Mus musculus
ccgcgagtgcgacattaagtacacg

SEQ ID NO: 904454 - DNA, 25 bp, Mus musculus
ccgcgagtgcgagattaagtacacg

SEQ ID NO: 904455 - DNA, 25 bp, Mus musculus
ccgcgatgagccaacgcatagagat

SEQ ID NO: 904456 - DNA, 25 bp, Mus musculus
ccgcgatgagccaaggcatagagat

SEQ ID NO: 904457 - DNA, 25 bp, Mus musculus
ccgcgccacgcacaagtgacgcaga

SEQ ID NO: 904458 - DNA, 25 bp, Mus musculus
ccgcgccacggacaagtgacgcaga

SEQ ID NO: 904459 - DNA, 25 bp, Mus musculus
ccgcgccatcactcggaacccactt

SEQ ID NO: 904460 - DNA, 25 bp, Mus musculus
ccgcgccatctctcggaacccactt

SEQ ID NO: 904461 - DNA, 25 bp, Mus musculus
ccgcgcctctcactgctcaggagct

SEQ ID NO: 904462 - DNA, 25 bp, Mus musculus
ccgcgcctctcagtgctcaggagct

SEQ ID NO: 904463 - DNA, 25 bp, Mus musculus
ccgcgcggccatcgagcagctgaag

SEQ ID NO: 904464 - DNA, 25 bp, Mus musculus
ccgcgcggccatggagcagctgaag

SEQ ID NO: 904465 - DNA, 25 bp, Mus musculus
ccgcgctgggagccatgtcatgtta

SEQ ID NO: 904466 - DNA, 25 bp, Mus musculus
ccgcgctgggaggcatgtcatgtta

SEQ ID NO: 904467 - DNA, 25 bp, Mus musculus
ccgcgcttgcgacgtgataggaaat

SEQ ID NO: 904468 - DNA, 25 bp, Mus musculus
ccgcgcttgcgaggtgataggaaat

SEQ ID NO: 904469 - DNA, 25 bp, Mus musculus
ccgcggcgcgcgcacaggtttcata

SEQ ID NO: 904470 - DNA, 25 bp, Mus musculus
ccgcggcgcgcgcagaggtttcata

SEQ ID NO: 904471 - DNA, 25 bp, Mus musculus
ccgcggctacgaccacgtggacatc

SEQ ID NO: 904472 - DNA, 25 bp, Mus musculus
ccgcggctacgagcacgtggacatc

SEQ ID NO: 904473 - DNA, 25 bp, Mus musculus
ccgcgggagcagcaccccttgggga

SEQ ID NO: 904474 - DNA, 25 bp, Mus musculus
ccgcgggagcagcccggaagctcat

SEQ ID NO: 904475 - DNA, 25 bp, Mus musculus
ccgcgggagcaggaccccttgggga

SEQ ID NO: 904476 - DNA, 25 bp, Mus musculus
ccgcgggagcaggccggaagctcat

SEQ ID NO: 904477 - DNA, 25 bp, Mus musculus
ccgcggttacagcgcatctgactgg

SEQ ID NO: 904478 - DNA, 25 bp, Mus musculus
ccgcggttacagggcatctgactgg

SEQ ID NO: 904479 - DNA, 25 bp, Mus musculus
ccgcgtcatgggcgttaattcctat

SEQ ID NO: 904480 - DNA, 25 bp, Mus musculus
ccgcgtcatgggggttaattcctat

SEQ ID NO: 904481 - DNA, 25 bp, Mus musculus
ccgcgtcgggaccacgatgaggctg

SEQ ID NO: 904482 - DNA, 25 bp, Mus musculus
ccgcgtcgggaccaggatgaggctg

SEQ ID NO: 904483 - DNA, 25 bp, Mus musculus
ccgcgtgtgctcgtcgcacggaggt

SEQ ID NO: 904484 - DNA, 25 bp, Mus musculus
ccgcgtgtgctcgtggcacggaggt

SEQ ID NO: 904485 - DNA, 25 bp, Mus musculus
ccgctattatcactcggccctctct

SEQ ID NO: 904486 - DNA, 25 bp, Mus musculus
ccgctattatcactgggccctctct

SEQ ID NO: 904487 - DNA, 25 bp, Mus musculus
ccgctcaaagcttgatgaagctgta

SEQ ID NO: 904488 - DNA, 25 bp, Mus musculus
ccgctcaaaggttgatgaagctgta

SEQ ID NO: 904489 - DNA, 25 bp, Mus musculus
ccgctcaccaaacgtactcgttttg

SEQ ID NO: 904490 - DNA, 25 bp, Mus musculus
ccgctcaccaaaggtactcgttttg

SEQ ID NO: 904491 - DNA, 25 bp, Mus musculus
ccgctcagaacaccatcccctaccc

SEQ ID NO: 904492 - DNA, 25 bp, Mus musculus
ccgctcagaacacgtcttcacatgc

SEQ ID NO: 904493 - DNA, 25 bp, Mus musculus
ccgctcagaacagcatcccctaccc

SEQ ID NO: 904494 - DNA, 25 bp, Mus musculus
ccgctcagaacaggtcttcacatgc

SEQ ID NO: 904495 - DNA, 25 bp, Mus musculus
ccgctcatcttcacacagcagccgg

SEQ ID NO: 904496 - DNA, 25 bp, Mus musculus
ccgctcatcttcacagcacagcagc

SEQ ID NO: 904497 - DNA, 25 bp, Mus musculus
ccgctcatcttctcacagcagccgg

SEQ ID NO: 904498 - DNA, 25 bp, Mus musculus
ccgctcatcttctcagcacagcagc

SEQ ID NO: 904499 - DNA, 25 bp, Mus musculus
ccgctccagtgccactttactggaa

SEQ ID NO: 904500 - DNA, 25 bp, Mus musculus
ccgctccagtgcgactttactggaa

SEQ ID NO: 904501 - DNA, 25 bp, Mus musculus
ccgctccgcgtgagaatcaaatacc

SEQ ID NO: 904502 - DNA, 25 bp, Mus musculus
ccgctccgcgtgtgaatcaaatacc

SEQ ID NO: 904503 - DNA, 25 bp, Mus musculus
ccgctctcacgacggtgagacttcc

SEQ ID NO: 904504 - DNA, 25 bp, Mus musculus
ccgctctcacgagggtgagacttcc

SEQ ID NO: 904505 - DNA, 25 bp, Mus musculus
ccgctctgagctcccgcccactgac

SEQ ID NO: 904506 - DNA, 25 bp, Mus musculus
ccgctctgaggtcccgcccactgac

SEQ ID NO: 904507 - DNA, 25 bp, Mus musculus
ccgctctgatgtatcgatcggaacg

SEQ ID NO: 904508 - DNA, 25 bp, Mus musculus
ccgctctgatgtatggatcggaacg

SEQ ID NO: 904509 - DNA, 25 bp, Mus musculus
ccgctgaagcccctcccgcagactc

SEQ ID NO: 904510 - DNA, 25 bp, Mus musculus
ccgctgaagcccctgccgcagactc

SEQ ID NO: 904511 - DNA, 25 bp, Mus musculus
ccgctgacaaaattgaagatgctcc

SEQ ID NO: 904512 - DNA, 25 bp, Mus musculus
ccgctgacaatattgaagatgctcc

SEQ ID NO: 904513 - DNA, 25 bp, Mus musculus
ccgctgagaataagtacttttctca

SEQ ID NO: 904514 - DNA, 25 bp, Mus musculus
ccgctgagaatatgtacttttctca

SEQ ID NO: 904515 - DNA, 25 bp, Mus musculus
ccgctgcacgcccgcatgtgtttct

SEQ ID NO: 904516 - DNA, 25 bp, Mus musculus
ccgctgcacgccctaatttctaatg

SEQ ID NO: 904517 - DNA, 25 bp, Mus musculus
ccgctgcacgccggcatgtgtttct

SEQ ID NO: 904518 - DNA, 25 bp, Mus musculus
ccgctgcacgccgtaatttctaatg

SEQ ID NO: 904519 - DNA, 25 bp, Mus musculus
ccgctgccagccacaatggaaggtc

SEQ ID NO: 904520 - DNA, 25 bp, Mus musculus
ccgctgccagccctcctctgacagc

SEQ ID NO: 904521 - DNA, 25 bp, Mus musculus
ccgctgccaggcacaatggaaggtc

SEQ ID NO: 904522 - DNA, 25 bp, Mus musculus
ccgctgccaggcctcctctgacagc

SEQ ID NO: 904523 - DNA, 25 bp, Mus musculus
ccgctgcccgcccccaatatgcctg

SEQ ID NO: 904524 - DNA, 25 bp, Mus musculus
ccgctgcccgccgccaatatgcctg

SEQ ID NO: 904525 - DNA, 25 bp, Mus musculus
ccgctgccggagattggcagactca

SEQ ID NO: 904526 - DNA, 25 bp, Mus musculus
ccgctgccggtgattggcagactca

SEQ ID NO: 904527 - DNA, 25 bp, Mus musculus
ccgctgcctgcatcaacctttgcag

SEQ ID NO: 904528 - DNA, 25 bp, Mus musculus
ccgctgcctgcatcagtctcttaac

SEQ ID NO: 904529 - DNA, 25 bp, Mus musculus
ccgctgcctgcatctacctttgcag

SEQ ID NO: 904530 - DNA, 25 bp, Mus musculus
ccgctgcctgcatctgtctcttaac

SEQ ID NO: 904531 - DNA, 25 bp, Mus musculus
ccgctgcctgttctcctttcagtgt

SEQ ID NO: 904532 - DNA, 25 bp, Mus musculus
ccgctgcctgttctgctttcagtgt

SEQ ID NO: 904533 - DNA, 25 bp, Mus musculus
ccgctgcgggctttcggaatgtcaa

SEQ ID NO: 904534 - DNA, 25 bp, Mus musculus
ccgctgcgggctttgggaatgtcaa

SEQ ID NO: 904535 - DNA, 25 bp, Mus musculus
ccgctgctcaaccacacgcacctct

SEQ ID NO: 904536 - DNA, 25 bp, Mus musculus
ccgctgctcaaccactggacatatc

SEQ ID NO: 904537 - DNA, 25 bp, Mus musculus
ccgctgctcaaccagacgcacctct

SEQ ID NO: 904538 - DNA, 25 bp, Mus musculus
ccgctgctcaaccagtggacatatc

SEQ ID NO: 904539 - DNA, 25 bp, Mus musculus
ccgctgctcgatggccccatgctga

SEQ ID NO: 904540 - DNA, 25 bp, Mus musculus
ccgctgctcgttggccccatgctga

SEQ ID NO: 904541 - DNA, 25 bp, Mus musculus
ccgctgctggctggctgcgttgatg

SEQ ID NO: 904542 - DNA, 25 bp, Mus musculus
ccgctgctgggtggctgcgttgatg

SEQ ID NO: 904543 - DNA, 25 bp, Mus musculus
ccgctgcttgcaaggagaagttgac

SEQ ID NO: 904544 - DNA, 25 bp, Mus musculus
ccgctgcttggaaggagaagttgac

SEQ ID NO: 904545 - DNA, 25 bp, Mus musculus
ccgctggagccccagtggcaccagc

SEQ ID NO: 904546 - DNA, 25 bp, Mus musculus
ccgctggagccccatggttttcgga

SEQ ID NO: 904547 - DNA, 25 bp, Mus musculus
ccgctggagcccgagtggcaccagc

SEQ ID NO: 904548 - DNA, 25 bp, Mus musculus
ccgctggagcccgatggttttcgga

SEQ ID NO: 904549 - DNA, 25 bp, Mus musculus
ccgctggtggagcgtgtcaccgaag

SEQ ID NO: 904550 - DNA, 25 bp, Mus musculus
ccgctggtggagggtgtcaccgaag

SEQ ID NO: 904551 - DNA, 25 bp, Mus musculus
ccgctgtcagcagctgaaatacgac

SEQ ID NO: 904552 - DNA, 25 bp, Mus musculus
ccgctgtcaggagctgaaatacgac

SEQ ID NO: 904553 - DNA, 25 bp, Mus musculus
ccgctgtccgcgcaggtgcctaggc

SEQ ID NO: 904554 - DNA, 25 bp, Mus musculus
ccgctgtccgcggaggtgcctaggc

SEQ ID NO: 904555 - DNA, 25 bp, Mus musculus
ccgctgtctgagcgcaggctgtgac

SEQ ID NO: 904556 - DNA, 25 bp, Mus musculus
ccgctgtctgcccaccagccctatc

SEQ ID NO: 904557 - DNA, 25 bp, Mus musculus
ccgctgtctgcccacccctatccgg

SEQ ID NO: 904558 - DNA, 25 bp, Mus musculus
ccgctgtctgcccagcagccctatc

SEQ ID NO: 904559 - DNA, 25 bp, Mus musculus
ccgctgtctgcccagccctatccgg

SEQ ID NO: 904560 - DNA, 25 bp, Mus musculus
ccgctgtctgtgcgcaggctgtgac

SEQ ID NO: 904561 - DNA, 25 bp, Mus musculus
ccgctgtgagctacagtcatgtcgg

SEQ ID NO: 904562 - DNA, 25 bp, Mus musculus
ccgctgtgaggtacagtcatgtcgg

SEQ ID NO: 904563 - DNA, 25 bp, Mus musculus
ccgcttaagcgacacgtgtccttgg

SEQ ID NO: 904564 - DNA, 25 bp, Mus musculus
ccgcttaagcgacaggtgtccttgg

SEQ ID NO: 904565 - DNA, 25 bp, Mus musculus
ccgcttatagcccaaggaacagagg

SEQ ID NO: 904566 - DNA, 25 bp, Mus musculus
ccgcttatagccttggggcatatct

SEQ ID NO: 904567 - DNA, 25 bp, Mus musculus
ccgcttataggccaaggaacagagg

SEQ ID NO: 904568 - DNA, 25 bp, Mus musculus
ccgcttataggcttggggcatatct

SEQ ID NO: 904569 - DNA, 25 bp, Mus musculus
ccgcttcacatacacgagcgacagt

SEQ ID NO: 904570 - DNA, 25 bp, Mus musculus
ccgcttcacatacaggagcgacagt

SEQ ID NO: 904571 - DNA, 25 bp, Mus musculus
ccgcttccagctcccgatgcccggt

SEQ ID NO: 904572 - DNA, 25 bp, Mus musculus
ccgcttccaggtcccgatgcccggt

SEQ ID NO: 904573 - DNA, 25 bp, Mus musculus
ccgcttctatgacgaatttgacatc

SEQ ID NO: 904574 - DNA, 25 bp, Mus musculus
ccgcttctatgaggaatttgacatc

SEQ ID NO: 904575 - DNA, 25 bp, Mus musculus
ccgcttctgcctcacagtgaagatg

SEQ ID NO: 904576 - DNA, 25 bp, Mus musculus
ccgcttctgcctccagacagtgaag

SEQ ID NO: 904577 - DNA, 25 bp, Mus musculus
ccgcttctgcctgacagtgaagatg

SEQ ID NO: 904578 - DNA, 25 bp, Mus musculus
ccgcttctgcctgcagacagtgaag

SEQ ID NO: 904579 - DNA, 25 bp, Mus musculus
ccgcttgcctggcgcccgaaaagca

SEQ ID NO: 904580 - DNA, 25 bp, Mus musculus
ccgcttgcctggcggccgaaaagca

SEQ ID NO: 904581 - DNA, 25 bp, Mus musculus
ccgctttcagcaggacattatttct

SEQ ID NO: 904582 - DNA, 25 bp, Mus musculus
ccgctttcaggaggacattatttct

SEQ ID NO: 904583 - DNA, 25 bp, Mus musculus
ccgctttccctcagcagacacgcac

SEQ ID NO: 904584 - DNA, 25 bp, Mus musculus
ccgctttccctctgcagacacgcac

SEQ ID NO: 904585 - DNA, 25 bp, Mus musculus
ccgctttgagcgcctgaggaagatc

SEQ ID NO: 904586 - DNA, 25 bp, Mus musculus
ccgctttgagggcctgaggaagatc

SEQ ID NO: 904587 - DNA, 25 bp, Mus musculus
ccgctttggacacaaaatcaccgtg

SEQ ID NO: 904588 - DNA, 25 bp, Mus musculus
ccgctttggacacgatattgactag

SEQ ID NO: 904589 - DNA, 25 bp, Mus musculus
ccgctttggacagaaaatcaccgtg

SEQ ID NO: 904590 - DNA, 25 bp, Mus musculus
ccgctttggacaggatattgactag

SEQ ID NO: 904591 - DNA, 25 bp, Mus musculus
ccgctttggcagacgcaactctatg

SEQ ID NO: 904592 - DNA, 25 bp, Mus musculus
ccgctttggcagtcgcaactctatg

SEQ ID NO: 904593 - DNA, 25 bp, Mus musculus
ccgctttgtctcaacattgccagcg

SEQ ID NO: 904594 - DNA, 25 bp, Mus musculus
ccgctttgtctcaagattgccagcg

SEQ ID NO: 904595 - DNA, 25 bp, Mus musculus
ccggaaaaagttcgtgatggcatga

SEQ ID NO: 904596 - DNA, 25 bp, Mus musculus
ccggaaaaagttggtgatggcatga

SEQ ID NO: 904597 - DNA, 25 bp, Mus musculus
ccggaaagaacacgttcagcaaaga

SEQ ID NO: 904598 - DNA, 25 bp, Mus musculus
ccggaaagaacaggttcagcaaaga

SEQ ID NO: 904599 - DNA, 25 bp, Mus musculus
ccggaacactggcccgagaagctgg

SEQ ID NO: 904600 - DNA, 25 bp, Mus musculus
ccggaacactggcccgcacaatatg

SEQ ID NO: 904601 - DNA, 25 bp, Mus musculus
ccggaacactggccggagaagctgg

SEQ ID NO: 904602 - DNA, 25 bp, Mus musculus
ccggaacactggccggcacaatatg

SEQ ID NO: 904603 - DNA, 25 bp, Mus musculus
ccggaacctcaacgtagaccagctc

SEQ ID NO: 904604 - DNA, 25 bp, Mus musculus
ccggaacctcaaggtagaccagctc

SEQ ID NO: 904605 - DNA, 25 bp, Mus musculus
ccggaacctgcacgaggttctaggg

SEQ ID NO: 904606 - DNA, 25 bp, Mus musculus
ccggaacctgcaggaggttctaggg

SEQ ID NO: 904607 - DNA, 25 bp, Mus musculus
ccggaacgggctatggagtcaaaat

SEQ ID NO: 904608 - DNA, 25 bp, Mus musculus
ccggaacggggctgactatggagtc

SEQ ID NO: 904609 - DNA, 25 bp, Mus musculus
ccggaacggggctgtctatggagtc

SEQ ID NO: 904610 - DNA, 25 bp, Mus musculus
ccggaacggggtatggagtcaaaat

SEQ ID NO: 904611 - DNA, 25 bp, Mus musculus
ccggaagatgaacagctgcctagag

SEQ ID NO: 904612 - DNA, 25 bp, Mus musculus
ccggaagatgaagagctgcctagag

SEQ ID NO: 904613 - DNA, 25 bp, Mus musculus
ccggaagatgatgccagaccagttt

SEQ ID NO: 904614 - DNA, 25 bp, Mus musculus
ccggaagatgttgccagaccagttt

SEQ ID NO: 904615 - DNA, 25 bp, Mus musculus
ccggaagccaagaggcctctttatt

SEQ ID NO: 904616 - DNA, 25 bp, Mus musculus
ccggaagccaagtggcctctttatt

SEQ ID NO: 904617 - DNA, 25 bp, Mus musculus
ccggaagggactatattgaccagtg

SEQ ID NO: 904618 - DNA, 25 bp, Mus musculus
ccggaagggactttattgaccagtg

SEQ ID NO: 904619 - DNA, 25 bp, Mus musculus
ccggaagtataagccggaagaggca

SEQ ID NO: 904620 - DNA, 25 bp, Mus musculus
ccggaagtattagccggaagaggca

SEQ ID NO: 904621 - DNA, 25 bp, Mus musculus
ccggaagtcatgcaagtcctgcaaa

SEQ ID NO: 904622 - DNA, 25 bp, Mus musculus
ccggaagtcatggaagtcctgcaaa

SEQ ID NO: 904623 - DNA, 25 bp, Mus musculus
ccggaagtgaagcccctgcccggat

SEQ ID NO: 904624 - DNA, 25 bp, Mus musculus
ccggaagtgaaggccctgcccggat

SEQ ID NO: 904625 - DNA, 25 bp, Mus musculus
ccggaatcagatctgctttcagctc

SEQ ID NO: 904626 - DNA, 25 bp, Mus musculus
ccggaatcagttctgctttcagctc

SEQ ID NO: 904627 - DNA, 25 bp, Mus musculus
ccggaatgccagctcatcctcccac

SEQ ID NO: 904628 - DNA, 25 bp, Mus musculus
ccggaatgccaggtcatcctcccac

SEQ ID NO: 904629 - DNA, 25 bp, Mus musculus
ccggacacagaatatccagttatgg

SEQ ID NO: 904630 - DNA, 25 bp, Mus musculus
ccggacacagtatatccagttatgg

SEQ ID NO: 904631 - DNA, 25 bp, Mus musculus
ccggacactgtgcgctgtgctctga

SEQ ID NO: 904632 - DNA, 25 bp, Mus musculus
ccggacactgtgggctgtgctctga

SEQ ID NO: 904633 - DNA, 25 bp, Mus musculus
ccggaccaagactggatgacagaaa

SEQ ID NO: 904634 - DNA, 25 bp, Mus musculus
ccggaccaagtctggatgacagaaa

SEQ ID NO: 904635 - DNA, 25 bp, Mus musculus
ccggaccactaccaagcaccagcac

SEQ ID NO: 904636 - DNA, 25 bp, Mus musculus
ccggaccactaccatgcaccagcac

SEQ ID NO: 904637 - DNA, 25 bp, Mus musculus
ccggaccctagacgcaaagctggtg

SEQ ID NO: 904638 - DNA, 25 bp, Mus musculus
ccggaccctagaggcaaagctggtg

SEQ ID NO: 904639 - DNA, 25 bp, Mus musculus
ccggaccgccagattgtgccttctg

SEQ ID NO: 904640 - DNA, 25 bp, Mus musculus
ccggaccgccagtttgtgccttctg

SEQ ID NO: 904641 - DNA, 25 bp, Mus musculus
ccggaccgggtgcccgtcatcgtgg

SEQ ID NO: 904642 - DNA, 25 bp, Mus musculus
ccggaccgggtgccggtcatcgtgg

SEQ ID NO: 904643 - DNA, 25 bp, Mus musculus
ccggacctggcacgggactgtcaaa

SEQ ID NO: 904644 - DNA, 25 bp, Mus musculus
ccggacctggcaggggactgtcaaa

SEQ ID NO: 904645 - DNA, 25 bp, Mus musculus
ccggactaccagcttctaacatccg

SEQ ID NO: 904646 - DNA, 25 bp, Mus musculus
ccggactaccaggttctaacatccg

SEQ ID NO: 904647 - DNA, 25 bp, Mus musculus
ccggactcagatcatctttagatgg

SEQ ID NO: 904648 - DNA, 25 bp, Mus musculus
ccggactcagttcatctttagatgg

SEQ ID NO: 904649 - DNA, 25 bp, Mus musculus
ccggactgagagaattctgagtgcc

SEQ ID NO: 904650 - DNA, 25 bp, Mus musculus
ccggactgagagtattctgagtgcc

SEQ ID NO: 904651 - DNA, 25 bp, Mus musculus
ccggagaagaggcagcaaatcaata

SEQ ID NO: 904652 - DNA, 25 bp, Mus musculus
ccggagaagagggagcaaatcaata

SEQ ID NO: 904653 - DNA, 25 bp, Mus musculus
ccggagactcaacgtcactggagac

SEQ ID NO: 904654 - DNA, 25 bp, Mus musculus
ccggagactcaaggtcactggagac

SEQ ID NO: 904655 - DNA, 25 bp, Mus musculus
ccggagcaagcacctcgaggaggac

SEQ ID NO: 904656 - DNA, 25 bp, Mus musculus
ccggagcaagcacctggaagatgag

SEQ ID NO: 904657 - DNA, 25 bp, Mus musculus
ccggagcaagcagctcgaggaggac

SEQ ID NO: 904658 - DNA, 25 bp, Mus musculus
ccggagcaagcagctggaagatgag

SEQ ID NO: 904659 - DNA, 25 bp, Mus musculus
ccggagccagagctcccagaactgc

SEQ ID NO: 904660 - DNA, 25 bp, Mus musculus
ccggagccagtgctcccagaactgc

SEQ ID NO: 904661 - DNA, 25 bp, Mus musculus
ccggagccagttcaaccacatcatc

SEQ ID NO: 904662 - DNA, 25 bp, Mus musculus
ccggagccagttgaaccacatcatc

SEQ ID NO: 904663 - DNA, 25 bp, Mus musculus
ccggagctgtatgacgaagtaaagc

SEQ ID NO: 904664 - DNA, 25 bp, Mus musculus
ccggagctgtatgaggaagtaaagc

SEQ ID NO: 904665 - DNA, 25 bp, Mus musculus
ccggagctttgacttgctggttgtt

SEQ ID NO: 904666 - DNA, 25 bp, Mus musculus
ccggagctttgagttgctggttgtt

SEQ ID NO: 904667 - DNA, 25 bp, Mus musculus
ccggaggagatgcacgtggatgagt

SEQ ID NO: 904668 - DNA, 25 bp, Mus musculus
ccggaggagatgcagcacgccccag

SEQ ID NO: 904669 - DNA, 25 bp, Mus musculus
ccggaggagatggacgtggatgagt

SEQ ID NO: 904670 - DNA, 25 bp, Mus musculus
ccggaggagatggagcacgccccag

SEQ ID NO: 904671 - DNA, 25 bp, Mus musculus
ccggaggcgagacgccccacgcatg

SEQ ID NO: 904672 - DNA, 25 bp, Mus musculus
ccggaggcgagaggccccacgcatg

SEQ ID NO: 904673 - DNA, 25 bp, Mus musculus
ccggaggggttggtcatggattcat

SEQ ID NO: 904674 - DNA, 25 bp, Mus musculus
ccggaggggttggtgatggattcat

SEQ ID NO: 904675 - DNA, 25 bp, Mus musculus
ccggaggtgacaaccaaaatatctg

SEQ ID NO: 904676 - DNA, 25 bp, Mus musculus
ccggaggtgacaacgaaaatatctg

SEQ ID NO: 904677 - DNA, 25 bp, Mus musculus
ccggagtatgaccgaaacaactcct

SEQ ID NO: 904678 - DNA, 25 bp, Mus musculus
ccggagtatgacggaaacaactcct

SEQ ID NO: 904679 - DNA, 25 bp, Mus musculus
ccggagtcactcaacgtctcgctct

SEQ ID NO: 904680 - DNA, 25 bp, Mus musculus
ccggagtcactcaaggtctcgctct

SEQ ID NO: 904681 - DNA, 25 bp, Mus musculus
ccggagtccgactacagagagccag

SEQ ID NO: 904682 - DNA, 25 bp, Mus musculus
ccggagtccgtctacagagagccag

SEQ ID NO: 904683 - DNA, 25 bp, Mus musculus
ccggagtcggacatcatcatgatgg

SEQ ID NO: 904684 - DNA, 25 bp, Mus musculus
ccggagtcggtcatcatcatgatgg

SEQ ID NO: 904685 - DNA, 25 bp, Mus musculus
ccggagtgcgcacacgcatcattgg

SEQ ID NO: 904686 - DNA, 25 bp, Mus musculus
ccggagtgcgcacaggcatcattgg

SEQ ID NO: 904687 - DNA, 25 bp, Mus musculus
ccggagttcgagcctccggagccag

SEQ ID NO: 904688 - DNA, 25 bp, Mus musculus
ccggagttcgtgcctccggagccag

SEQ ID NO: 904689 - DNA, 25 bp, Mus musculus
ccggagttgcagaagactcatgcag

SEQ ID NO: 904690 - DNA, 25 bp, Mus musculus
ccggagttgcagagaagactcatgc

SEQ ID NO: 904691 - DNA, 25 bp, Mus musculus
ccggagttgcagcagaagactcatg

SEQ ID NO: 904692 - DNA, 25 bp, Mus musculus
ccggagttgcaggagaagactcatg

SEQ ID NO: 904693 - DNA, 25 bp, Mus musculus
ccggagttgcagtagactcatgcag

SEQ ID NO: 904694 - DNA, 25 bp, Mus musculus
ccggagttgcagtgaagactcatgc

SEQ ID NO: 904695 - DNA, 25 bp, Mus musculus
ccggataacgaggaccatgtgtttc

SEQ ID NO: 904696 - DNA, 25 bp, Mus musculus
ccggataacgtggaccatgtgtttc

SEQ ID NO: 904697 - DNA, 25 bp, Mus musculus
ccggatcaggagggccaggaggagt

SEQ ID NO: 904698 - DNA, 25 bp, Mus musculus
ccggatcaggtgggccaggaggagt

SEQ ID NO: 904699 - DNA, 25 bp, Mus musculus
ccggatgcagatatttccgtgagcc

SEQ ID NO: 904700 - DNA, 25 bp, Mus musculus
ccggatgcagttatttccgtgagcc

SEQ ID NO: 904701 - DNA, 25 bp, Mus musculus
ccggatgcccagactcaacgcaaag

SEQ ID NO: 904702 - DNA, 25 bp, Mus musculus
ccggatgcccagtctcaacgcaaag

SEQ ID NO: 904703 - DNA, 25 bp, Mus musculus
ccggatgcctgctacttcccagcac

SEQ ID NO: 904704 - DNA, 25 bp, Mus musculus
ccggatgcctgctagttcccagcac

SEQ ID NO: 904705 - DNA, 25 bp, Mus musculus
ccggatgctcagcgaggacccgtgg

SEQ ID NO: 904706 - DNA, 25 bp, Mus musculus
ccggatgctcagggaggacccgtgg

SEQ ID NO: 904707 - DNA, 25 bp, Mus musculus
ccggatgctgagatggtttttgatc

SEQ ID NO: 904708 - DNA, 25 bp, Mus musculus
ccggatgctgagttggtttttgatc

SEQ ID NO: 904709 - DNA, 25 bp, Mus musculus
ccggatggagagcgaagccttgctg

SEQ ID NO: 904710 - DNA, 25 bp, Mus musculus
ccggatggagagggaagccttgctg

SEQ ID NO: 904711 - DNA, 25 bp, Mus musculus
ccggattacatacccaacaaggaga

SEQ ID NO: 904712 - DNA, 25 bp, Mus musculus
ccggattacatactgtatcccctac

SEQ ID NO: 904713 - DNA, 25 bp, Mus musculus
ccggattacatagccaacaaggaga

SEQ ID NO: 904714 - DNA, 25 bp, Mus musculus
ccggattacatagtgtatcccctac

SEQ ID NO: 904715 - DNA, 25 bp, Mus musculus
ccggattcagcaggtggatgcccag

SEQ ID NO: 904716 - DNA, 25 bp, Mus musculus
ccggattcaggaggtggatgcccag

SEQ ID NO: 904717 - DNA, 25 bp, Mus musculus
ccggattgagcacttggatgaggtc

SEQ ID NO: 904718 - DNA, 25 bp, Mus musculus
ccggattgagcagttggatgaggtc

SEQ ID NO: 904719 - DNA, 25 bp, Mus musculus
ccggattgcctgcagagtgtgaagg

SEQ ID NO: 904720 - DNA, 25 bp, Mus musculus
ccggattgcctggagagtgtgaagg

SEQ ID NO: 904721 - DNA, 25 bp, Mus musculus
ccggcaaattagctctgactttgtg

SEQ ID NO: 904722 - DNA, 25 bp, Mus musculus
ccggcaaattaggtctgactttgtg

SEQ ID NO: 904723 - DNA, 25 bp, Mus musculus
ccggcaacagctggaagatctcaag

SEQ ID NO: 904724 - DNA, 25 bp, Mus musculus
ccggcaacaggtggaagatctcaag

SEQ ID NO: 904725 - DNA, 25 bp, Mus musculus
ccggcaacgactagtcccgtggtca

SEQ ID NO: 904726 - DNA, 25 bp, Mus musculus
ccggcaacgacttgtcccgtggtca

SEQ ID NO: 904727 - DNA, 25 bp, Mus musculus
ccggcacactcgatctgatttgtac

SEQ ID NO: 904728 - DNA, 25 bp, Mus musculus
ccggcacactcgttctgatttgtac

SEQ ID NO: 904729 - DNA, 25 bp, Mus musculus
ccggcaccaacaccgccaggcagca

SEQ ID NO: 904730 - DNA, 25 bp, Mus musculus
ccggcaccaacagcgccaggcagca

SEQ ID NO: 904731 - DNA, 25 bp, Mus musculus
ccggcactcgcgctcctcccacctc

SEQ ID NO: 904732 - DNA, 25 bp, Mus musculus
ccggcactcgggctcctcccacctc

SEQ ID NO: 904733 - DNA, 25 bp, Mus musculus
ccggcagacatacatatgaggacac

SEQ ID NO: 904734 - DNA, 25 bp, Mus musculus
ccggcagacatagatatgaggacac

SEQ ID NO: 904735 - DNA, 25 bp, Mus musculus
ccggcagagaagcaccggtacctgg

SEQ ID NO: 904736 - DNA, 25 bp, Mus musculus
ccggcagagaagcagcggtacctgg

SEQ ID NO: 904737 - DNA, 25 bp, Mus musculus
ccggcagaggagcctggaggaggga

SEQ ID NO: 904738 - DNA, 25 bp, Mus musculus
ccggcagaggaggctggaggaggga

SEQ ID NO: 904739 - DNA, 25 bp, Mus musculus
ccggcaggctcacctgcaggctgtg

SEQ ID NO: 904740 - DNA, 25 bp, Mus musculus
ccggcaggctcagctgcaggctgtg

SEQ ID NO: 904741 - DNA, 25 bp, Mus musculus
ccggcagtggcgccgtccagaggac

SEQ ID NO: 904742 - DNA, 25 bp, Mus musculus
ccggcagtggcggcgtccagaggac

SEQ ID NO: 904743 - DNA, 25 bp, Mus musculus
ccggcatcctgaaacgggtgaacct

SEQ ID NO: 904744 - DNA, 25 bp, Mus musculus
ccggcatcctgaaaggggtgaacct

SEQ ID NO: 904745 - DNA, 25 bp, Mus musculus
ccggcatcctgtatatggaacacga

SEQ ID NO: 904746 - DNA, 25 bp, Mus musculus
ccggcatcctgtttatggaacacga

SEQ ID NO: 904747 - DNA, 25 bp, Mus musculus
ccggcatgaattcacggatgacctg

SEQ ID NO: 904748 - DNA, 25 bp, Mus musculus
ccggcatgaattcagggatgacctg

SEQ ID NO: 904749 - DNA, 25 bp, Mus musculus
ccggcatgctggctatcatcattat

SEQ ID NO: 904750 - DNA, 25 bp, Mus musculus
ccggcatgctgggtatcatcattat

SEQ ID NO: 904751 - DNA, 25 bp, Mus musculus
ccggccagccagataagtacggttt

SEQ ID NO: 904752 - DNA, 25 bp, Mus musculus
ccggccagccagttaagtacggttt

SEQ ID NO: 904753 - DNA, 25 bp, Mus musculus
ccggccattgtacctttcagtgtct

SEQ ID NO: 904754 - DNA, 25 bp, Mus musculus
ccggccattgtagctttcagtgtct

SEQ ID NO: 904755 - DNA, 25 bp, Mus musculus
ccggcccagccccgtcaagcaggta

SEQ ID NO: 904756 - DNA, 25 bp, Mus musculus
ccggcccagcccggtcaagcaggta

SEQ ID NO: 904757 - DNA, 25 bp, Mus musculus
ccggccccagcgctggctgtgggct

SEQ ID NO: 904758 - DNA, 25 bp, Mus musculus
ccggccccagctgagtgatcgctct

SEQ ID NO: 904759 - DNA, 25 bp, Mus musculus
ccggccccagggctggctgtgggct

SEQ ID NO: 904760 - DNA, 25 bp, Mus musculus
ccggccccaggtgagtgatcgctct

SEQ ID NO: 904761 - DNA, 25 bp, Mus musculus
ccggccgaagcatcatctgtcccta

SEQ ID NO: 904762 - DNA, 25 bp, Mus musculus
ccggccgaagcttcttgattgtcta

SEQ ID NO: 904763 - DNA, 25 bp, Mus musculus
ccggccgaaggatcatctgtcccta

SEQ ID NO: 904764 - DNA, 25 bp, Mus musculus
ccggccgaaggttcttgattgtcta

SEQ ID NO: 904765 - DNA, 25 bp, Mus musculus
ccggcctccaacaacaaataagaaa

SEQ ID NO: 904766 - DNA, 25 bp, Mus musculus
ccggcctccatcaacaaataagaaa

SEQ ID NO: 904767 - DNA, 25 bp, Mus musculus
ccggcctctcagaacacaaaagaga

SEQ ID NO: 904768 - DNA, 25 bp, Mus musculus
ccggcctctcagaaccatcactatt

SEQ ID NO: 904769 - DNA, 25 bp, Mus musculus
ccggcctctcagaagacaaaagaga

SEQ ID NO: 904770 - DNA, 25 bp, Mus musculus
ccggcctctcagaagcatcactatt

SEQ ID NO: 904771 - DNA, 25 bp, Mus musculus
ccggcctcttgcctcctagcagcca

SEQ ID NO: 904772 - DNA, 25 bp, Mus musculus
ccggcctcttgcctgctagcagcca

SEQ ID NO: 904773 - DNA, 25 bp, Mus musculus
ccggcctctttgcaggctcatccaa

SEQ ID NO: 904774 - DNA, 25 bp, Mus musculus
ccggcctctttgcctgctgggaacg

SEQ ID NO: 904775 - DNA, 25 bp, Mus musculus
ccggcctctttggaggctcatccaa

SEQ ID NO: 904776 - DNA, 25 bp, Mus musculus
ccggcctctttggctgctgggaacg

SEQ ID NO: 904777 - DNA, 25 bp, Mus musculus
ccggcctgctcatgtgtattcctac

SEQ ID NO: 904778 - DNA, 25 bp, Mus musculus
ccggcctgctgatgtgtattcctac

SEQ ID NO: 904779 - DNA, 25 bp, Mus musculus
ccggcctgcttgaggtgtgcatttt

SEQ ID NO: 904780 - DNA, 25 bp, Mus musculus
ccggcctgcttgtggtgtgcatttt

SEQ ID NO: 904781 - DNA, 25 bp, Mus musculus
ccggcctggggactatgagcagttt

SEQ ID NO: 904782 - DNA, 25 bp, Mus musculus
ccggcctggggagtatgagcagttt

SEQ ID NO: 904783 - DNA, 25 bp, Mus musculus
ccggcctgtgccaacgtcgagtatg

SEQ ID NO: 904784 - DNA, 25 bp, Mus musculus
ccggcctgtgccaaggtcgagtatg

SEQ ID NO: 904785 - DNA, 25 bp, Mus musculus
ccggcgagagcttaattctcaagcc

SEQ ID NO: 904786 - DNA, 25 bp, Mus musculus
ccggcgagaggttaattctcaagcc

SEQ ID NO: 904787 - DNA, 25 bp, Mus musculus
ccggcgcgcgcgcagacctggtgag

SEQ ID NO: 904788 - DNA, 25 bp, Mus musculus
ccggcgcgcgcggagacctggtgag

SEQ ID NO: 904789 - DNA, 25 bp, Mus musculus
ccggcgcggcggcagccgctcccgt

SEQ ID NO: 904790 - DNA, 25 bp, Mus musculus
ccggcgcggcgggagccgctcccgt

SEQ ID NO: 904791 - DNA, 25 bp, Mus musculus
ccggcgctaccttgcagcttcagtc

SEQ ID NO: 904792 - DNA, 25 bp, Mus musculus
ccggcgctaccttggagcttcagtc

SEQ ID NO: 904793 - DNA, 25 bp, Mus musculus
ccggcggacgcggaacgtgctttgg

SEQ ID NO: 904794 - DNA, 25 bp, Mus musculus
ccggcggacggggaacgtgctttgg

SEQ ID NO: 904795 - DNA, 25 bp, Mus musculus
ccggcggcaaagcaatggacattct

SEQ ID NO: 904796 - DNA, 25 bp, Mus musculus
ccggcggcaaagcattggacattct

SEQ ID NO: 904797 - DNA, 25 bp, Mus musculus
ccggcggcagcatgtgtgaccggaa

SEQ ID NO: 904798 - DNA, 25 bp, Mus musculus
ccggcggcaggatgtgtgaccggaa

SEQ ID NO: 904799 - DNA, 25 bp, Mus musculus
ccggcgtggtaaatcatgacggtac

SEQ ID NO: 904800 - DNA, 25 bp, Mus musculus
ccggcgtggtaaatgatgacggtac

SEQ ID NO: 904801 - DNA, 25 bp, Mus musculus
ccggctacgactacagtcagggtag

SEQ ID NO: 904802 - DNA, 25 bp, Mus musculus
ccggctacgactactgtcagggtag

SEQ ID NO: 904803 - DNA, 25 bp, Mus musculus
ccggctagggtacgttgttcctgct

SEQ ID NO: 904804 - DNA, 25 bp, Mus musculus
ccggctagggtaggttgttcctgct

SEQ ID NO: 904805 - DNA, 25 bp, Mus musculus
ccggctcacagaagatgtctccaaa

SEQ ID NO: 904806 - DNA, 25 bp, Mus musculus
ccggctcacagatgatgtctccaaa

SEQ ID NO: 904807 - DNA, 25 bp, Mus musculus
ccggctccctcacgtataagtattg

SEQ ID NO: 904808 - DNA, 25 bp, Mus musculus
ccggctccctcaggtataagtattg

SEQ ID NO: 904809 - DNA, 25 bp, Mus musculus
ccggctcgctaacccacactcattc

SEQ ID NO: 904810 - DNA, 25 bp, Mus musculus
ccggctcgctaacccggctgccctt

SEQ ID NO: 904811 - DNA, 25 bp, Mus musculus
ccggctcgctaagccacactcattc

SEQ ID NO: 904812 - DNA, 25 bp, Mus musculus
ccggctcgctaagccggctgccctt

SEQ ID NO: 904813 - DNA, 25 bp, Mus musculus
ccggctctgacgatgaagatgagtc

SEQ ID NO: 904814 - DNA, 25 bp, Mus musculus
ccggctctgacgttgaagatgagtc

SEQ ID NO: 904815 - DNA, 25 bp, Mus musculus
ccggctgacctgatgaacactctga

SEQ ID NO: 904816 - DNA, 25 bp, Mus musculus
ccggctgacctgcaaatctggttct

SEQ ID NO: 904817 - DNA, 25 bp, Mus musculus
ccggctgacctgcccctctgtcctg

SEQ ID NO: 904818 - DNA, 25 bp, Mus musculus
ccggctgacctggaaatctggttct

SEQ ID NO: 904819 - DNA, 25 bp, Mus musculus
ccggctgacctggccctctgtcctg

SEQ ID NO: 904820 - DNA, 25 bp, Mus musculus
ccggctgacctgttgaacactctga

SEQ ID NO: 904821 - DNA, 25 bp, Mus musculus
ccggctgcacagcagcaacacgtcg

SEQ ID NO: 904822 - DNA, 25 bp, Mus musculus
ccggctgcacagcccatctctgagc

SEQ ID NO: 904823 - DNA, 25 bp, Mus musculus
ccggctgcacaggagcaacacgtcg

SEQ ID NO: 904824 - DNA, 25 bp, Mus musculus
ccggctgcacaggccatctctgagc

SEQ ID NO: 904825 - DNA, 25 bp, Mus musculus
ccggctgcagcgtctgtcaccgctg

SEQ ID NO: 904826 - DNA, 25 bp, Mus musculus
ccggctgcagggtctgtcaccgctg

SEQ ID NO: 904827 - DNA, 25 bp, Mus musculus
ccggctgctcagatgcccccaccac

SEQ ID NO: 904828 - DNA, 25 bp, Mus musculus
ccggctgctcagttgcccccaccac

SEQ ID NO: 904829 - DNA, 25 bp, Mus musculus
ccggctggagcaacccatgcttcaa

SEQ ID NO: 904830 - DNA, 25 bp, Mus musculus
ccggctggaggaacccatgcttcaa

SEQ ID NO: 904831 - DNA, 25 bp, Mus musculus
ccggctgtggatattactgtgccac

SEQ ID NO: 904832 - DNA, 25 bp, Mus musculus
ccggctgtggattttactgtgccac

SEQ ID NO: 904833 - DNA, 25 bp, Mus musculus
ccggcttagaactctccgctggtgt

SEQ ID NO: 904834 - DNA, 25 bp, Mus musculus
ccggcttagatctctccgctggtgt

SEQ ID NO: 904835 - DNA, 25 bp, Mus musculus
ccggcttctccaccagtcctgagtc

SEQ ID NO: 904836 - DNA, 25 bp, Mus musculus
ccggcttctccacctgtcctgagtc

SEQ ID NO: 904837 - DNA, 25 bp, Mus musculus
ccggcttctgcaagtcacctgggca

SEQ ID NO: 904838 - DNA, 25 bp, Mus musculus
ccggcttctgccccccactgcctca

SEQ ID NO: 904839 - DNA, 25 bp, Mus musculus
ccggcttctggaagtcacctgggca

SEQ ID NO: 904840 - DNA, 25 bp, Mus musculus
ccggcttctggcccccactgcctca

SEQ ID NO: 904841 - DNA, 25 bp, Mus musculus
ccggcttggcgtcgtcactaatgta

SEQ ID NO: 904842 - DNA, 25 bp, Mus musculus
ccggcttggcgtggtcactaatgta

SEQ ID NO: 904843 - DNA, 25 bp, Mus musculus
ccgggaaaagacctattcagagtgt

SEQ ID NO: 904844 - DNA, 25 bp, Mus musculus
ccgggaaaagtcctattcagagtgt

SEQ ID NO: 904845 - DNA, 25 bp, Mus musculus
ccgggaacagagcagtgcccggatc

SEQ ID NO: 904846 - DNA, 25 bp, Mus musculus
ccgggaacagtgcagtgcccggatc

SEQ ID NO: 904847 - DNA, 25 bp, Mus musculus
ccgggaagagcaatgttttggtgtt

SEQ ID NO: 904848 - DNA, 25 bp, Mus musculus
ccgggaagagctcgcatttcagtcg

SEQ ID NO: 904849 - DNA, 25 bp, Mus musculus
ccgggaagagctgctgagctatgct

SEQ ID NO: 904850 - DNA, 25 bp, Mus musculus
ccgggaagagctggcatttcagtcg

SEQ ID NO: 904851 - DNA, 25 bp, Mus musculus
ccgggaagaggaatgttttggtgtt

SEQ ID NO: 904852 - DNA, 25 bp, Mus musculus
ccgggaagaggtgctgagctatgct

SEQ ID NO: 904853 - DNA, 25 bp, Mus musculus
ccgggaagctgtgaacttcaggacc

SEQ ID NO: 904854 - DNA, 25 bp, Mus musculus
ccgggaagctgtgatcttcaggacc

SEQ ID NO: 904855 - DNA, 25 bp, Mus musculus
ccgggacaaaattctggctgccacc

SEQ ID NO: 904856 - DNA, 25 bp, Mus musculus
ccgggacaaatttctggctgccacc

SEQ ID NO: 904857 - DNA, 25 bp, Mus musculus
ccgggacaccatcttccagaaagaa

SEQ ID NO: 904858 - DNA, 25 bp, Mus musculus
ccgggacaccatgttccagaaagaa

SEQ ID NO: 904859 - DNA, 25 bp, Mus musculus
ccgggacagcacaaaagtctgcaga

SEQ ID NO: 904860 - DNA, 25 bp, Mus musculus
ccgggacagcacaatagtctgcaga

SEQ ID NO: 904861 - DNA, 25 bp, Mus musculus
ccgggaccagagaattggagttgac

SEQ ID NO: 904862 - DNA, 25 bp, Mus musculus
ccgggaccagagtattggagttgac

SEQ ID NO: 904863 - DNA, 25 bp, Mus musculus
ccgggaccccaaagtgccagctgat

SEQ ID NO: 904864 - DNA, 25 bp, Mus musculus
ccgggaccccaatgtgccagctgat

SEQ ID NO: 904865 - DNA, 25 bp, Mus musculus
ccgggacctgaacctggagaacctc

SEQ ID NO: 904866 - DNA, 25 bp, Mus musculus
ccgggacctgaagctggagaacctc

SEQ ID NO: 904867 - DNA, 25 bp, Mus musculus
ccgggagaagagagctctggctgca

SEQ ID NO: 904868 - DNA, 25 bp, Mus musculus
ccgggagaagctcgacgggctgtac

SEQ ID NO: 904869 - DNA, 25 bp, Mus musculus
ccgggagaagctctggctgcagagc

SEQ ID NO: 904870 - DNA, 25 bp, Mus musculus
ccgggagaagctggacgggctgtac

SEQ ID NO: 904871 - DNA, 25 bp, Mus musculus
ccgggagaaggtctggctgcagagc

SEQ ID NO: 904872 - DNA, 25 bp, Mus musculus
ccgggagaagtgagctctggctgca

SEQ ID NO: 904873 - DNA, 25 bp, Mus musculus
ccgggagcagcctgaagctgaggtg

SEQ ID NO: 904874 - DNA, 25 bp, Mus musculus
ccgggagcaggctgaagctgaggtg

SEQ ID NO: 904875 - DNA, 25 bp, Mus musculus
ccgggaggtccgcatgctgttgacg

SEQ ID NO: 904876 - DNA, 25 bp, Mus musculus
ccgggaggtccggatgctgttgacg

SEQ ID NO: 904877 - DNA, 25 bp, Mus musculus
ccgggagtccagcctaagcttcagt

SEQ ID NO: 904878 - DNA, 25 bp, Mus musculus
ccgggagtccaggctaagcttcagt

SEQ ID NO: 904879 - DNA, 25 bp, Mus musculus
ccgggcactgcagacacaggtactt

SEQ ID NO: 904880 - DNA, 25 bp, Mus musculus
ccgggcactgcagagacaggtactt

SEQ ID NO: 904881 - DNA, 25 bp, Mus musculus
ccgggcagagctcacgatttctggt

SEQ ID NO: 904882 - DNA, 25 bp, Mus musculus
ccgggcagagctcaggatttctggt

SEQ ID NO: 904883 - DNA, 25 bp, Mus musculus
ccgggcagaggccgaacgtgatgtc

SEQ ID NO: 904884 - DNA, 25 bp, Mus musculus
ccgggcagaggcggaacgtgatgtc

SEQ ID NO: 904885 - DNA, 25 bp, Mus musculus
ccgggcagccagccaccacctaccc

SEQ ID NO: 904886 - DNA, 25 bp, Mus musculus
ccgggcagccaggcaccacctaccc

SEQ ID NO: 904887 - DNA, 25 bp, Mus musculus
ccgggcagcgcgcgtgctgtatgct

SEQ ID NO: 904888 - DNA, 25 bp, Mus musculus
ccgggcagcgcgggtgctgtatgct

SEQ ID NO: 904889 - DNA, 25 bp, Mus musculus
ccgggcccagcaactgcataggaca

SEQ ID NO: 904890 - DNA, 25 bp, Mus musculus
ccgggcccaggaactgcataggaca

SEQ ID NO: 904891 - DNA, 25 bp, Mus musculus
ccgggcggtgcacttcactgagacc

SEQ ID NO: 904892 - DNA, 25 bp, Mus musculus
ccgggcggtgcagttcactgagacc

SEQ ID NO: 904893 - DNA, 25 bp, Mus musculus
ccgggctatgagatattactacaaa

SEQ ID NO: 904894 - DNA, 25 bp, Mus musculus
ccgggctatgagttattactacaaa

SEQ ID NO: 904895 - DNA, 25 bp, Mus musculus
ccgggctcacacaacgacctcaccc

SEQ ID NO: 904896 - DNA, 25 bp, Mus musculus
ccgggctcacacaaggacctcaccc

SEQ ID NO: 904897 - DNA, 25 bp, Mus musculus
ccgggctcctgacgcatggaggggt

SEQ ID NO: 904898 - DNA, 25 bp, Mus musculus
ccgggctcctgaggcatggaggggt

SEQ ID NO: 904899 - DNA, 25 bp, Mus musculus
ccgggctgagacaagtccatcatct

SEQ ID NO: 904900 - DNA, 25 bp, Mus musculus
ccgggctgagtcaagtccatcatct

SEQ ID NO: 904901 - DNA, 25 bp, Mus musculus
ccggggacagcccttcccaggctct

SEQ ID NO: 904902 - DNA, 25 bp, Mus musculus
ccggggacaggccttcccaggctct

SEQ ID NO: 904903 - DNA, 25 bp, Mus musculus
ccggggagagatcgacttccaggcc

SEQ ID NO: 904904 - DNA, 25 bp, Mus musculus
ccggggagagatggacttccaggcc

SEQ ID NO: 904905 - DNA, 25 bp, Mus musculus
ccggggatacagaacatctcccggg

SEQ ID NO: 904906 - DNA, 25 bp, Mus musculus
ccggggatacagctttggggcgatg

SEQ ID NO: 904907 - DNA, 25 bp, Mus musculus
ccggggatacaggtttggggcgatg

SEQ ID NO: 904908 - DNA, 25 bp, Mus musculus
ccggggatacagtacatctcccggg

SEQ ID NO: 904909 - DNA, 25 bp, Mus musculus
ccggggcaagctctgttcactagag

SEQ ID NO: 904910 - DNA, 25 bp, Mus musculus
ccggggcaaggtctgttcactagag

SEQ ID NO: 904911 - DNA, 25 bp, Mus musculus
ccggggccccagctctttcagccat

SEQ ID NO: 904912 - DNA, 25 bp, Mus musculus
ccggggccccagctgtttcagccat

SEQ ID NO: 904913 - DNA, 25 bp, Mus musculus
ccggggcgagcttctctccactatg

SEQ ID NO: 904914 - DNA, 25 bp, Mus musculus
ccggggcgaggttctctccactatg

SEQ ID NO: 904915 - DNA, 25 bp, Mus musculus
ccggggcttgcacaggcctacgtga

SEQ ID NO: 904916 - DNA, 25 bp, Mus musculus
ccggggcttgcagaggcctacgtga

SEQ ID NO: 904917 - DNA, 25 bp, Mus musculus
ccgggggcgaagccattacagtgtt

SEQ ID NO: 904918 - DNA, 25 bp, Mus musculus
ccgggggcgaaggcattacagtgtt

SEQ ID NO: 904919 - DNA, 25 bp, Mus musculus
ccggggtattcacctgttccagtca

SEQ ID NO: 904920 - DNA, 25 bp, Mus musculus
ccggggtattcagctgttccagtca

SEQ ID NO: 904921 - DNA, 25 bp, Mus musculus
ccggggtcagccatgggagccgcct

SEQ ID NO: 904922 - DNA, 25 bp, Mus musculus
ccggggtcaggcatgggagccgcct

SEQ ID NO: 904923 - DNA, 25 bp, Mus musculus
ccggggtggccaattggagaagcta

SEQ ID NO: 904924 - DNA, 25 bp, Mus musculus
ccggggtggccatttggagaagcta

SEQ ID NO: 904925 - DNA, 25 bp, Mus musculus
ccggggttcatcctcactatgcggc

SEQ ID NO: 904926 - DNA, 25 bp, Mus musculus
ccggggttcatcctcccagagacta

SEQ ID NO: 904927 - DNA, 25 bp, Mus musculus
ccggggttcatcctgactatgcggc

SEQ ID NO: 904928 - DNA, 25 bp, Mus musculus
ccggggttcatcctgccagagacta

SEQ ID NO: 904929 - DNA, 25 bp, Mus musculus
ccgggtcatcaacggtcacagtaaa

SEQ ID NO: 904930 - DNA, 25 bp, Mus musculus
ccgggtcatcaagggtcacagtaaa

SEQ ID NO: 904931 - DNA, 25 bp, Mus musculus
ccgggtgccgctcatcgtggagaag

SEQ ID NO: 904932 - DNA, 25 bp, Mus musculus
ccgggtgccggtcatcgtggagaag

SEQ ID NO: 904933 - DNA, 25 bp, Mus musculus
ccgggtggaggcagagtgcaaatag

SEQ ID NO: 904934 - DNA, 25 bp, Mus musculus
ccgggtggaggcagatgtctgctac

SEQ ID NO: 904935 - DNA, 25 bp, Mus musculus
ccgggtggaggcagtgtgcaaatag

SEQ ID NO: 904936 - DNA, 25 bp, Mus musculus
ccgggtggaggcagttgtctgctac

SEQ ID NO: 904937 - DNA, 25 bp, Mus musculus
ccgggtgtcagcggcaacagcagtg

SEQ ID NO: 904938 - DNA, 25 bp, Mus musculus
ccgggtgtcagcgggaacagcagtg

SEQ ID NO: 904939 - DNA, 25 bp, Mus musculus
ccgggttctgctccagagacagcac

SEQ ID NO: 904940 - DNA, 25 bp, Mus musculus
ccgggttctgctcggccactgccgg

SEQ ID NO: 904941 - DNA, 25 bp, Mus musculus
ccgggttctgctctctcagtgccat

SEQ ID NO: 904942 - DNA, 25 bp, Mus musculus
ccgggttctgctgcagagacagcac

SEQ ID NO: 904943 - DNA, 25 bp, Mus musculus
ccgggttctgctgggccactgccgg

SEQ ID NO: 904944 - DNA, 25 bp, Mus musculus
ccgggttctgctgtctcagtgccat

SEQ ID NO: 904945 - DNA, 25 bp, Mus musculus
ccgggttttcagcacactgccccat

SEQ ID NO: 904946 - DNA, 25 bp, Mus musculus
ccgggttttcaggacactgccccat

SEQ ID NO: 904947 - DNA, 25 bp, Mus musculus
ccggtaccagcgtccagcctgtgac

SEQ ID NO: 904948 - DNA, 25 bp, Mus musculus
ccggtaccagggtccagcctgtgac

SEQ ID NO: 904949 - DNA, 25 bp, Mus musculus
ccggtcacctttgacgtgaagtcag

SEQ ID NO: 904950 - DNA, 25 bp, Mus musculus
ccggtcacctttgaggtgaagtcag

SEQ ID NO: 904951 - DNA, 25 bp, Mus musculus
ccggtcactatgagtgaaacatctt

SEQ ID NO: 904952 - DNA, 25 bp, Mus musculus
ccggtcactatgctgataaagttac

SEQ ID NO: 904953 - DNA, 25 bp, Mus musculus
ccggtcactatggtgataaagttac

SEQ ID NO: 904954 - DNA, 25 bp, Mus musculus
ccggtcactatgtgtgaaacatctt

SEQ ID NO: 904955 - DNA, 25 bp, Mus musculus
ccggtcagagacggcccagtcaagc

SEQ ID NO: 904956 - DNA, 25 bp, Mus musculus
ccggtcagagtcggcccagtcaagc

SEQ ID NO: 904957 - DNA, 25 bp, Mus musculus
ccggtctcgatccacgtcaggttcc

SEQ ID NO: 904958 - DNA, 25 bp, Mus musculus
ccggtctcgatccaggtcaggttcc

SEQ ID NO: 904959 - DNA, 25 bp, Mus musculus
ccggtgagcgtgcacaacccgggaa

SEQ ID NO: 904960 - DNA, 25 bp, Mus musculus
ccggtgagcgtgcagaacccgggaa

SEQ ID NO: 904961 - DNA, 25 bp, Mus musculus
ccggtggacggccacggaagtctcg

SEQ ID NO: 904962 - DNA, 25 bp, Mus musculus
ccggtggacggccagggaagtctcg

SEQ ID NO: 904963 - DNA, 25 bp, Mus musculus
ccggtggagacacacaccactgagg

SEQ ID NO: 904964 - DNA, 25 bp, Mus musculus
ccggtggagacacagaccactgagg

SEQ ID NO: 904965 - DNA, 25 bp, Mus musculus
ccggtggcattactagtgatgagga

SEQ ID NO: 904966 - DNA, 25 bp, Mus musculus
ccggtggcattactgatgaggaaga

SEQ ID NO: 904967 - DNA, 25 bp, Mus musculus
ccggtggcattagtagtgatgagga

SEQ ID NO: 904968 - DNA, 25 bp, Mus musculus
ccggtggcattagtgatgaggaaga

SEQ ID NO: 904969 - DNA, 25 bp, Mus musculus
ccggtggtccagcaatggcctgcca

SEQ ID NO: 904970 - DNA, 25 bp, Mus musculus
ccggtggtccaggaatggcctgcca

SEQ ID NO: 904971 - DNA, 25 bp, Mus musculus
ccggtggtgctgctgcctggtgatt

SEQ ID NO: 904972 - DNA, 25 bp, Mus musculus
ccggtggtgctggtgcctggtgatt

SEQ ID NO: 904973 - DNA, 25 bp, Mus musculus
ccggtggtggctcaggctccagcgg

SEQ ID NO: 904974 - DNA, 25 bp, Mus musculus
ccggtggtggctgaggctccagcgg

SEQ ID NO: 904975 - DNA, 25 bp, Mus musculus
ccggtgtaagcatgatgaattcaca

SEQ ID NO: 904976 - DNA, 25 bp, Mus musculus
ccggtgtaaggatgatgaattcaca

SEQ ID NO: 904977 - DNA, 25 bp, Mus musculus
ccggttagggactgcatgagaagac

SEQ ID NO: 904978 - DNA, 25 bp, Mus musculus
ccggttagggtctgcatgagaagac

SEQ ID NO: 904979 - DNA, 25 bp, Mus musculus
ccggttatatcacagtggtgatgta

SEQ ID NO: 904980 - DNA, 25 bp, Mus musculus
ccggttatatcagagtggtgatgta

SEQ ID NO: 904981 - DNA, 25 bp, Mus musculus
ccggttgtcatgaatcacggtgatc

SEQ ID NO: 904982 - DNA, 25 bp, Mus musculus
ccggttgtcatgtatcacggtgatc

SEQ ID NO: 904983 - DNA, 25 bp, Mus musculus
ccggtttcacatgagagcacatgca

SEQ ID NO: 904984 - DNA, 25 bp, Mus musculus
ccggtttcacttgagagcacatgca

SEQ ID NO: 904985 - DNA, 25 bp, Mus musculus
ccgtaacaagcacgctttgacaaac

SEQ ID NO: 904986 - DNA, 25 bp, Mus musculus
ccgtaacaagcaggctttgacaaac

SEQ ID NO: 904987 - DNA, 25 bp, Mus musculus
ccgtaagaatatcatcctatctaag

SEQ ID NO: 904988 - DNA, 25 bp, Mus musculus
ccgtaagaatttcatcctatctaag

SEQ ID NO: 904989 - DNA, 25 bp, Mus musculus
ccgtaagatgcgaaatccacagaga

SEQ ID NO: 904990 - DNA, 25 bp, Mus musculus
ccgtaagatgggaaatccacagaga

SEQ ID NO: 904991 - DNA, 25 bp, Mus musculus
ccgtacaatatgcacaatctcatga

SEQ ID NO: 904992 - DNA, 25 bp, Mus musculus
ccgtacaatatgcagaatctcatga

SEQ ID NO: 904993 - DNA, 25 bp, Mus musculus
ccgtacacagcaattctttatgctg

SEQ ID NO: 904994 - DNA, 25 bp, Mus musculus
ccgtacacaggaattctttatgctg

SEQ ID NO: 904995 - DNA, 25 bp, Mus musculus
ccgtaccaagcgatagcccacctca

SEQ ID NO: 904996 - DNA, 25 bp, Mus musculus
ccgtaccaagggatagcccacctca

SEQ ID NO: 904997 - DNA, 25 bp, Mus musculus
ccgtacgagatcaagaaggtgttcg

SEQ ID NO: 904998 - DNA, 25 bp, Mus musculus
ccgtacgagatctagaaggtgttcg

SEQ ID NO: 904999 - DNA, 25 bp, Mus musculus
ccgtactgcacacacgagagcctgt

SEQ ID NO: 905000 - DNA, 25 bp, Mus musculus
ccgtactgcacacaggagagcctgt

SEQ ID NO: 905001 - DNA, 25 bp, Mus musculus
ccgtagaggaatcgaggcagcttca

SEQ ID NO: 905002 - DNA, 25 bp, Mus musculus
ccgtagaggaatggaggcagcttca

SEQ ID NO: 905003 - DNA, 25 bp, Mus musculus
ccgtaggaagaactccctctcgtga

SEQ ID NO: 905004 - DNA, 25 bp, Mus musculus
ccgtaggaagaagtccctctcgtga

SEQ ID NO: 905005 - DNA, 25 bp, Mus musculus
ccgtagtcagaatgagtctgcatgt

SEQ ID NO: 905006 - DNA, 25 bp, Mus musculus
ccgtagtcagtatgagtctgcatgt

SEQ ID NO: 905007 - DNA, 25 bp, Mus musculus
ccgtatagagcaagcccagccctgg

SEQ ID NO: 905008 - DNA, 25 bp, Mus musculus
ccgtatagaggaagcccagccctgg

SEQ ID NO: 905009 - DNA, 25 bp, Mus musculus
ccgtatgaagctggaagatatcaac

SEQ ID NO: 905010 - DNA, 25 bp, Mus musculus
ccgtatgaaggtggaagatatcaac

SEQ ID NO: 905011 - DNA, 25 bp, Mus musculus
ccgtatggtggaaacgatccagttt

SEQ ID NO: 905012 - DNA, 25 bp, Mus musculus
ccgtatggtggaaaggatccagttt

SEQ ID NO: 905013 - DNA, 25 bp, Mus musculus
ccgtcaatgtctcacatgcactccc

SEQ ID NO: 905014 - DNA, 25 bp, Mus musculus
ccgtcaatgtctcagatgcactccc

SEQ ID NO: 905015 - DNA, 25 bp, Mus musculus
ccgtcagaagcgttggtgagaagat

SEQ ID NO: 905016 - DNA, 25 bp, Mus musculus
ccgtcagaagggttggtgagaagat

SEQ ID NO: 905017 - DNA, 25 bp, Mus musculus
ccgtcagatgagccctaggaccatg

SEQ ID NO: 905018 - DNA, 25 bp, Mus musculus
ccgtcagatgaggcctaggaccatg

SEQ ID NO: 905019 - DNA, 25 bp, Mus musculus
ccgtcaggagccaagctgctggatg

SEQ ID NO: 905020 - DNA, 25 bp, Mus musculus
ccgtcaggaggcaagctgctggatg

SEQ ID NO: 905021 - DNA, 25 bp, Mus musculus
ccgtcatagcatcacgcactgttgt

SEQ ID NO: 905022 - DNA, 25 bp, Mus musculus
ccgtcatagcatcaggcactgttgt

SEQ ID NO: 905023 - DNA, 25 bp, Mus musculus
ccgtcatcagccctcctggacacca

SEQ ID NO: 905024 - DNA, 25 bp, Mus musculus
ccgtcatcaggcctcctggacacca

SEQ ID NO: 905025 - DNA, 25 bp, Mus musculus
ccgtcatgacccaacttcggcacag

SEQ ID NO: 905026 - DNA, 25 bp, Mus musculus
ccgtcatgacgcaacttcggcacag

SEQ ID NO: 905027 - DNA, 25 bp, Mus musculus
ccgtccagagccagtgcttgaggcg

SEQ ID NO: 905028 - DNA, 25 bp, Mus musculus
ccgtccagagcctgtgcttgaggcg

SEQ ID NO: 905029 - DNA, 25 bp, Mus musculus
ccgtccatgaaggacgatcaggtta

SEQ ID NO: 905030 - DNA, 25 bp, Mus musculus
ccgtccatgaaggaggatcaggtta

SEQ ID NO: 905031 - DNA, 25 bp, Mus musculus
ccgtccccagcacacaacctgagcc

SEQ ID NO: 905032 - DNA, 25 bp, Mus musculus
ccgtccccagcagacaacctgagcc

SEQ ID NO: 905033 - DNA, 25 bp, Mus musculus
ccgtcccctacgccatccaagagtc

SEQ ID NO: 905034 - DNA, 25 bp, Mus musculus
ccgtcccctaggccatccaagagtc

SEQ ID NO: 905035 - DNA, 25 bp, Mus musculus
ccgtccccttctcaacagcaggttg

SEQ ID NO: 905036 - DNA, 25 bp, Mus musculus
ccgtccccttctgaacagcaggttg

SEQ ID NO: 905037 - DNA, 25 bp, Mus musculus
ccgtccgaggatgtggatgagtgtg

SEQ ID NO: 905038 - DNA, 25 bp, Mus musculus
ccgtccgaggttgtggatgagtgtg

SEQ ID NO: 905039 - DNA, 25 bp, Mus musculus
ccgtcgaggcccggcggctggatat

SEQ ID NO: 905040 - DNA, 25 bp, Mus musculus
ccgtcgaggcccgggggctggatat

SEQ ID NO: 905041 - DNA, 25 bp, Mus musculus
ccgtcgcgcacacgattacatcttc

SEQ ID NO: 905042 - DNA, 25 bp, Mus musculus
ccgtcgcgcacacgccctaccgtgg

SEQ ID NO: 905043 - DNA, 25 bp, Mus musculus
ccgtcgcgcacaggattacatcttc

SEQ ID NO: 905044 - DNA, 25 bp, Mus musculus
ccgtcgcgcacaggccctaccgtgg

SEQ ID NO: 905045 - DNA, 25 bp, Mus musculus
ccgtcgcttacccgtggaagcttgg

SEQ ID NO: 905046 - DNA, 25 bp, Mus musculus
ccgtcgcttacccttaccgcaggtg

SEQ ID NO: 905047 - DNA, 25 bp, Mus musculus
ccgtcgcttaccggtggaagcttgg

SEQ ID NO: 905048 - DNA, 25 bp, Mus musculus
ccgtcgcttaccgttaccgcaggtg

SEQ ID NO: 905049 - DNA, 25 bp, Mus musculus
ccgtcggtgctgcccttcccagaac

SEQ ID NO: 905050 - DNA, 25 bp, Mus musculus
ccgtcggtgctgcgatccggaggaa

SEQ ID NO: 905051 - DNA, 25 bp, Mus musculus
ccgtcggtgctggccttcccagaac

SEQ ID NO: 905052 - DNA, 25 bp, Mus musculus
ccgtcggtgctgggatccggaggaa

SEQ ID NO: 905053 - DNA, 25 bp, Mus musculus
ccgtcgtgtgcacgcagtcagggga

SEQ ID NO: 905054 - DNA, 25 bp, Mus musculus
ccgtcgtgtgcaggcagtcagggga

SEQ ID NO: 905055 - DNA, 25 bp, Mus musculus
ccgtctcctcagagtctgcgagaaa

SEQ ID NO: 905056 - DNA, 25 bp, Mus musculus
ccgtctcctcagtgtctgcgagaaa

SEQ ID NO: 905057 - DNA, 25 bp, Mus musculus
ccgtctcctgccacaatcaaaacca

SEQ ID NO: 905058 - DNA, 25 bp, Mus musculus
ccgtctcctgccactatcaaaacca

SEQ ID NO: 905059 - DNA, 25 bp, Mus musculus
ccgtctcctttaccacaggtgcagc

SEQ ID NO: 905060 - DNA, 25 bp, Mus musculus
ccgtctcctttagcacaggtgcagc

SEQ ID NO: 905061 - DNA, 25 bp, Mus musculus
ccgtctgccaagcactttattgacc

SEQ ID NO: 905062 - DNA, 25 bp, Mus musculus
ccgtctgccaaggactttattgacc

SEQ ID NO: 905063 - DNA, 25 bp, Mus musculus
ccgtctgtaactcggatcatggcag

SEQ ID NO: 905064 - DNA, 25 bp, Mus musculus
ccgtctgtaactctcatcagagatc

SEQ ID NO: 905065 - DNA, 25 bp, Mus musculus
ccgtctgtaactgggatcatggcag

SEQ ID NO: 905066 - DNA, 25 bp, Mus musculus
ccgtctgtaactgtcatcagagatc

SEQ ID NO: 905067 - DNA, 25 bp, Mus musculus
ccgtcttcccaccaacaagatgcca

SEQ ID NO: 905068 - DNA, 25 bp, Mus musculus
ccgtcttcccaccgatgtgatcttc

SEQ ID NO: 905069 - DNA, 25 bp, Mus musculus
ccgtcttcccacgaacaagatgcca

SEQ ID NO: 905070 - DNA, 25 bp, Mus musculus
ccgtcttcccacggatgtgatcttc

SEQ ID NO: 905071 - DNA, 25 bp, Mus musculus
ccgtgaatatagcaaggaagagaga

SEQ ID NO: 905072 - DNA, 25 bp, Mus musculus
ccgtgaatataggaaggaagagaga

SEQ ID NO: 905073 - DNA, 25 bp, Mus musculus
ccgtgacaatccccagtaaggagac

SEQ ID NO: 905074 - DNA, 25 bp, Mus musculus
ccgtgacaatcccctgtaaggagac

SEQ ID NO: 905075 - DNA, 25 bp, Mus musculus
ccgtgatcagaattgcatttgtaaa

SEQ ID NO: 905076 - DNA, 25 bp, Mus musculus
ccgtgatcagatccgtatctacttc

SEQ ID NO: 905077 - DNA, 25 bp, Mus musculus
ccgtgatcagcctgatggtaaattt

SEQ ID NO: 905078 - DNA, 25 bp, Mus musculus
ccgtgatcaggctgatggtaaattt

SEQ ID NO: 905079 - DNA, 25 bp, Mus musculus
ccgtgatcagtattgcatttgtaaa

SEQ ID NO: 905080 - DNA, 25 bp, Mus musculus
ccgtgatcagttccgtatctacttc

SEQ ID NO: 905081 - DNA, 25 bp, Mus musculus
ccgtgatgggaacgtatggatgtat

SEQ ID NO: 905082 - DNA, 25 bp, Mus musculus
ccgtgatgggaaggtatggatgtat

SEQ ID NO: 905083 - DNA, 25 bp, Mus musculus
ccgtgcacagcacggtgtctcctct

SEQ ID NO: 905084 - DNA, 25 bp, Mus musculus
ccgtgcacagcagggtgtctcctct

SEQ ID NO: 905085 - DNA, 25 bp, Mus musculus
ccgtgcacccagaaaacgaagagat

SEQ ID NO: 905086 - DNA, 25 bp, Mus musculus
ccgtgcacccagtaaacgaagagat

SEQ ID NO: 905087 - DNA, 25 bp, Mus musculus
ccgtgcagagcaagccatacaggag

SEQ ID NO: 905088 - DNA, 25 bp, Mus musculus
ccgtgcagagcatctactgccgagg

SEQ ID NO: 905089 - DNA, 25 bp, Mus musculus
ccgtgcagaggaagccatacaggag

SEQ ID NO: 905090 - DNA, 25 bp, Mus musculus
ccgtgcagaggatctactgccgagg

SEQ ID NO: 905091 - DNA, 25 bp, Mus musculus
ccgtgcattacgctattattatgat

SEQ ID NO: 905092 - DNA, 25 bp, Mus musculus
ccgtgcattacggtattattatgat

SEQ ID NO: 905093 - DNA, 25 bp, Mus musculus
ccgtgcccatcacgaggcagagaca

SEQ ID NO: 905094 - DNA, 25 bp, Mus musculus
ccgtgcccatcaggaggcagagaca

SEQ ID NO: 905095 - DNA, 25 bp, Mus musculus
ccgtgcccttaccacgcaaatccaa

SEQ ID NO: 905096 - DNA, 25 bp, Mus musculus
ccgtgcccttaccaggcaaatccaa

SEQ ID NO: 905097 - DNA, 25 bp, Mus musculus
ccgtgccgcctctgcgctggagcct

SEQ ID NO: 905098 - DNA, 25 bp, Mus musculus
ccgtgccgcctctgggctggagcct

SEQ ID NO: 905099 - DNA, 25 bp, Mus musculus
ccgtgccgtgagcgcgttgactgga

SEQ ID NO: 905100 - DNA, 25 bp, Mus musculus
ccgtgccgtgagggcgttgactgga

SEQ ID NO: 905101 - DNA, 25 bp, Mus musculus
ccgtgctcacagcctttgcaaatgg

SEQ ID NO: 905102 - DNA, 25 bp, Mus musculus
ccgtgctcacaggctttgcaaatgg

SEQ ID NO: 905103 - DNA, 25 bp, Mus musculus
ccgtgctcagcatcaaggagacgga

SEQ ID NO: 905104 - DNA, 25 bp, Mus musculus
ccgtgctcaggatcaaggagacgga

SEQ ID NO: 905105 - DNA, 25 bp, Mus musculus
ccgtgctcaggtcactgattcttct

SEQ ID NO: 905106 - DNA, 25 bp, Mus musculus
ccgtgctcaggtgactgattcttct

SEQ ID NO: 905107 - DNA, 25 bp, Mus musculus
ccgtgctgtgagagtttccaccact

SEQ ID NO: 905108 - DNA, 25 bp, Mus musculus
ccgtgctgtgagtgtttccaccact

SEQ ID NO: 905109 - DNA, 25 bp, Mus musculus
ccgtggaagacaccatcattggacc

SEQ ID NO: 905110 - DNA, 25 bp, Mus musculus
ccgtggaagacagcatcattggacc

SEQ ID NO: 905111 - DNA, 25 bp, Mus musculus
ccgtggacacctatcaacttgcgat

SEQ ID NO: 905112 - DNA, 25 bp, Mus musculus
ccgtggacacctatcttttcaaaga

SEQ ID NO: 905113 - DNA, 25 bp, Mus musculus
ccgtggacacctatgaacttgcgat

SEQ ID NO: 905114 - DNA, 25 bp, Mus musculus
ccgtggacacctatgttttcaaaga

SEQ ID NO: 905115 - DNA, 25 bp, Mus musculus
ccgtggagagcaagctcgaagagga

SEQ ID NO: 905116 - DNA, 25 bp, Mus musculus
ccgtggagagcaaggtcgaagagga

SEQ ID NO: 905117 - DNA, 25 bp, Mus musculus
ccgtggagctgctgcgaagatgcta

SEQ ID NO: 905118 - DNA, 25 bp, Mus musculus
ccgtggagctgctgggaagatgcta

SEQ ID NO: 905119 - DNA, 25 bp, Mus musculus
ccgtggatgacctacgcaagtcggc

SEQ ID NO: 905120 - DNA, 25 bp, Mus musculus
ccgtggatgacctaggcaagtcggc

SEQ ID NO: 905121 - DNA, 25 bp, Mus musculus
ccgtggcaaaagctctcagatcacc

SEQ ID NO: 905122 - DNA, 25 bp, Mus musculus
ccgtggcaaaaggtctcagatcacc

SEQ ID NO: 905123 - DNA, 25 bp, Mus musculus
ccgtggcagacgcgcttacggcgtg

SEQ ID NO: 905124 - DNA, 25 bp, Mus musculus
ccgtggcagacgggcttacggcgtg

SEQ ID NO: 905125 - DNA, 25 bp, Mus musculus
ccgtggcccagacactgactcaggt

SEQ ID NO: 905126 - DNA, 25 bp, Mus musculus
ccgtggcccagacagtgactcaggt

SEQ ID NO: 905127 - DNA, 25 bp, Mus musculus
ccgtggctagcggatggcctcttga

SEQ ID NO: 905128 - DNA, 25 bp, Mus musculus
ccgtggctaggggatggcctcttga

SEQ ID NO: 905129 - DNA, 25 bp, Mus musculus
ccgtggcttctttgcctctgaaccc

SEQ ID NO: 905130 - DNA, 25 bp, Mus musculus
ccgtggcttctttggctctgaaccc

SEQ ID NO: 905131 - DNA, 25 bp, Mus musculus
ccgtgggagcatcaacaatgagatg

SEQ ID NO: 905132 - DNA, 25 bp, Mus musculus
ccgtgggagcatgaacaatgagatg

SEQ ID NO: 905133 - DNA, 25 bp, Mus musculus
ccgtgggtgtgtcaaatgcacttag

SEQ ID NO: 905134 - DNA, 25 bp, Mus musculus
ccgtgggtgtgtcgactgtgcagca

SEQ ID NO: 905135 - DNA, 25 bp, Mus musculus
ccgtgggtgtgtgaaatgcacttag

SEQ ID NO: 905136 - DNA, 25 bp, Mus musculus
ccgtgggtgtgtggactgtgcagca

SEQ ID NO: 905137 - DNA, 25 bp, Mus musculus
ccgtgggttgtggcacgcctgagtc

SEQ ID NO: 905138 - DNA, 25 bp, Mus musculus
ccgtgggttgtggctcgcctgagtc

SEQ ID NO: 905139 - DNA, 25 bp, Mus musculus
ccgtggtcccacataccttgccctt

SEQ ID NO: 905140 - DNA, 25 bp, Mus musculus
ccgtggtcccacattccttgccctt

SEQ ID NO: 905141 - DNA, 25 bp, Mus musculus
ccgtggtctgcgaagtggctgatga

SEQ ID NO: 905142 - DNA, 25 bp, Mus musculus
ccgtggtctgggaagtggctgatga

SEQ ID NO: 905143 - DNA, 25 bp, Mus musculus
ccgtggttcctacacggctagagca

SEQ ID NO: 905144 - DNA, 25 bp, Mus musculus
ccgtggttcctacagggctagagca

SEQ ID NO: 905145 - DNA, 25 bp, Mus musculus
ccgtgtcattcattcgcaatggcgt

SEQ ID NO: 905146 - DNA, 25 bp, Mus musculus
ccgtgtcattcattggcaatggcgt

SEQ ID NO: 905147 - DNA, 25 bp, Mus musculus
ccgtgtccagcgcgttgcctgtggc

SEQ ID NO: 905148 - DNA, 25 bp, Mus musculus
ccgtgtccagcgggttgcctgtggc

SEQ ID NO: 905149 - DNA, 25 bp, Mus musculus
ccgtgtctcagaaacgaagtgcgag

SEQ ID NO: 905150 - DNA, 25 bp, Mus musculus
ccgtgtctcagaaaggaagtgcgag

SEQ ID NO: 905151 - DNA, 25 bp, Mus musculus
ccgtgtgcagcttctctgtgaaaac

SEQ ID NO: 905152 - DNA, 25 bp, Mus musculus
ccgtgtgcaggttctctgtgaaaac

SEQ ID NO: 905153 - DNA, 25 bp, Mus musculus
ccgtgtggagcacgttggatggaca

SEQ ID NO: 905154 - DNA, 25 bp, Mus musculus
ccgtgtggagcaggttggatggaca

SEQ ID NO: 905155 - DNA, 25 bp, Mus musculus
ccgtgtggcagactgctcaacaggc

SEQ ID NO: 905156 - DNA, 25 bp, Mus musculus
ccgtgtggcagagtgctcaacaggc

SEQ ID NO: 905157 - DNA, 25 bp, Mus musculus
ccgtgttaagattttggccacagga

SEQ ID NO: 905158 - DNA, 25 bp, Mus musculus
ccgtgttaagtttttggccacagga

SEQ ID NO: 905159 - DNA, 25 bp, Mus musculus
ccgtgttacaaacattatacgagaa

SEQ ID NO: 905160 - DNA, 25 bp, Mus musculus
ccgtgttacaaagattatacgagaa

SEQ ID NO: 905161 - DNA, 25 bp, Mus musculus
ccgttcaaacacaacttggaaatct

SEQ ID NO: 905162 - DNA, 25 bp, Mus musculus
ccgttcaaacacaagttggaaatct

SEQ ID NO: 905163 - DNA, 25 bp, Mus musculus
ccgttcagagcacatcggagagaaa

SEQ ID NO: 905164 - DNA, 25 bp, Mus musculus
ccgttcagagcagatcggagagaaa

SEQ ID NO: 905165 - DNA, 25 bp, Mus musculus
ccgttcgttcaacgggcagaatcct

SEQ ID NO: 905166 - DNA, 25 bp, Mus musculus
ccgttcgttcaaggggcagaatcct

SEQ ID NO: 905167 - DNA, 25 bp, Mus musculus
ccgttctagtcacacggaaccacac

SEQ ID NO: 905168 - DNA, 25 bp, Mus musculus
ccgttctagtcacagggaaccacac

SEQ ID NO: 905169 - DNA, 25 bp, Mus musculus
ccgttctggaagccctggaagagag

SEQ ID NO: 905170 - DNA, 25 bp, Mus musculus
ccgttctggaaggcctggaagagag

SEQ ID NO: 905171 - DNA, 25 bp, Mus musculus
ccgttcttcataaaactctgaaggc

SEQ ID NO: 905172 - DNA, 25 bp, Mus musculus
ccgttcttcatataactctgaaggc

SEQ ID NO: 905173 - DNA, 25 bp, Mus musculus
ccgttgatctgtcacaagctccagt

SEQ ID NO: 905174 - DNA, 25 bp, Mus musculus
ccgttgatctgtcacaggaagaagc

SEQ ID NO: 905175 - DNA, 25 bp, Mus musculus
ccgttgatctgtcacgaagaagctc

SEQ ID NO: 905176 - DNA, 25 bp, Mus musculus
ccgttgatctgtcagaagctccagt

SEQ ID NO: 905177 - DNA, 25 bp, Mus musculus
ccgttgatctgtcagaggaagaagc

SEQ ID NO: 905178 - DNA, 25 bp, Mus musculus
ccgttgatctgtcaggaagaagctc

SEQ ID NO: 905179 - DNA, 25 bp, Mus musculus
ccgtttctccaacgaggatgaagcc

SEQ ID NO: 905180 - DNA, 25 bp, Mus musculus
ccgtttctccaaggaggatgaagcc

SEQ ID NO: 905181 - DNA, 25 bp, Mus musculus
ccgtttgacataaacgagattgaag

SEQ ID NO: 905182 - DNA, 25 bp, Mus musculus
ccgtttgacataaaggagattgaag

SEQ ID NO: 905183 - DNA, 25 bp, Mus musculus
ccgttttaagataccgatttctgca

SEQ ID NO: 905184 - DNA, 25 bp, Mus musculus
ccgttttaagttaccgatttctgca

SEQ ID NO: 905185 - DNA, 25 bp, Mus musculus
cctaaaactatagacgtgccttgga

SEQ ID NO: 905186 - DNA, 25 bp, Mus musculus
cctaaaactatagaggtgccttgga

SEQ ID NO: 905187 - DNA, 25 bp, Mus musculus
cctaaaccccacgcatgccccactt

SEQ ID NO: 905188 - DNA, 25 bp, Mus musculus
cctaaaccccacgcttgccccactt

SEQ ID NO: 905189 - DNA, 25 bp, Mus musculus
cctaaagaaagactttgacctggtg

SEQ ID NO: 905190 - DNA, 25 bp, Mus musculus
cctaaagaaagagtttgacctggtg

SEQ ID NO: 905191 - DNA, 25 bp, Mus musculus
cctaaagaatgactttgacctggtg

SEQ ID NO: 905192 - DNA, 25 bp, Mus musculus
cctaaagaatgagtttgacctggtg

SEQ ID NO: 905193 - DNA, 25 bp, Mus musculus
cctaaagatgagccttccgtgtaca

SEQ ID NO: 905194 - DNA, 25 bp, Mus musculus
cctaaagatgaggcttccgtgtaca

SEQ ID NO: 905195 - DNA, 25 bp, Mus musculus
cctaaaggacctttcatcaattctg

SEQ ID NO: 905196 - DNA, 25 bp, Mus musculus
cctaaaggacctttgatcaattctg

SEQ ID NO: 905197 - DNA, 25 bp, Mus musculus
cctaaaggagacagcggtgtaccag

SEQ ID NO: 905198 - DNA, 25 bp, Mus musculus
cctaaaggagacaggggtgtaccag

SEQ ID NO: 905199 - DNA, 25 bp, Mus musculus
cctaaagtcatgcacgtcaagaatt

SEQ ID NO: 905200 - DNA, 25 bp, Mus musculus
cctaaagtcatgcaggtcaagaatt

SEQ ID NO: 905201 - DNA, 25 bp, Mus musculus
cctaaatcagcaattcgtcaacaac

SEQ ID NO: 905202 - DNA, 25 bp, Mus musculus
cctaaatcagctactacttggctta

SEQ ID NO: 905203 - DNA, 25 bp, Mus musculus
cctaaatcagctgctgaaatcgtcc

SEQ ID NO: 905204 - DNA, 25 bp, Mus musculus
cctaaatcaggaattcgtcaacaac

SEQ ID NO: 905205 - DNA, 25 bp, Mus musculus
cctaaatcaggtactacttggctta

SEQ ID NO: 905206 - DNA, 25 bp, Mus musculus
cctaaatcaggtgctgaaatcgtcc

SEQ ID NO: 905207 - DNA, 25 bp, Mus musculus
cctaaatttaagaatgcagtactgt

SEQ ID NO: 905208 - DNA, 25 bp, Mus musculus
cctaaatttaagtatgcagtactgt

SEQ ID NO: 905209 - DNA, 25 bp, Mus musculus
cctaaccagacacatggagaaagac

SEQ ID NO: 905210 - DNA, 25 bp, Mus musculus
cctaaccagacagatggagaaagac

SEQ ID NO: 905211 - DNA, 25 bp, Mus musculus
cctaacccagactgtttcaattctg

SEQ ID NO: 905212 - DNA, 25 bp, Mus musculus
cctaacccagtctgtttcaattctg

SEQ ID NO: 905213 - DNA, 25 bp, Mus musculus
cctaacctgcccaacgacaagctgg

SEQ ID NO: 905214 - DNA, 25 bp, Mus musculus
cctaacctgcccaaggacaagctgg

SEQ ID NO: 905215 - DNA, 25 bp, Mus musculus
cctaacgagcaacacaattgcccgc

SEQ ID NO: 905216 - DNA, 25 bp, Mus musculus
cctaacgagcaagacaattgcccgc

SEQ ID NO: 905217 - DNA, 25 bp, Mus musculus
cctaactgctaaccaagctctgagt

SEQ ID NO: 905218 - DNA, 25 bp, Mus musculus
cctaactgctaagcaagctctgagt

SEQ ID NO: 905219 - DNA, 25 bp, Mus musculus
cctaagaaaccatcaagaagcgtcc

SEQ ID NO: 905220 - DNA, 25 bp, Mus musculus
cctaagaaacccaggctccagctgt

SEQ ID NO: 905221 - DNA, 25 bp, Mus musculus
cctaagaaacgatcaagaagcgtcc

SEQ ID NO: 905222 - DNA, 25 bp, Mus musculus
cctaagaaacgcaggctccagctgt

SEQ ID NO: 905223 - DNA, 25 bp, Mus musculus
cctaagagagctgagcgcttacacc

SEQ ID NO: 905224 - DNA, 25 bp, Mus musculus
cctaagagaggtgagcgcttacacc

SEQ ID NO: 905225 - DNA, 25 bp, Mus musculus
cctaagccacagagacaacagctac

SEQ ID NO: 905226 - DNA, 25 bp, Mus musculus
cctaagccacagtgacaacagctac

SEQ ID NO: 905227 - DNA, 25 bp, Mus musculus
cctaagccagcacgcctcagggctg

SEQ ID NO: 905228 - DNA, 25 bp, Mus musculus
cctaagccagcacggcctgggctgg

SEQ ID NO: 905229 - DNA, 25 bp, Mus musculus
cctaagccagcaggcctcagggctg

SEQ ID NO: 905230 - DNA, 25 bp, Mus musculus
cctaagccagcagggcctgggctgg

SEQ ID NO: 905231 - DNA, 25 bp, Mus musculus
cctaagcctgacgtgcagccagagc

SEQ ID NO: 905232 - DNA, 25 bp, Mus musculus
cctaagcctgcagacgtgcagccag

SEQ ID NO: 905233 - DNA, 25 bp, Mus musculus
cctaagcctggagacgtgcagccag

SEQ ID NO: 905234 - DNA, 25 bp, Mus musculus
cctaagcctgtcgtgcagccagagc

SEQ ID NO: 905235 - DNA, 25 bp, Mus musculus
cctaagcttcctcgtgcaaatagtc

SEQ ID NO: 905236 - DNA, 25 bp, Mus musculus
cctaagcttcctggtgcaaatagtc

SEQ ID NO: 905237 - DNA, 25 bp, Mus musculus
cctaaggaagcctcagagaaataat

SEQ ID NO: 905238 - DNA, 25 bp, Mus musculus
cctaaggaaggctcagagaaataat

SEQ ID NO: 905239 - DNA, 25 bp, Mus musculus
cctaaggcgcagaacgatcgccacg

SEQ ID NO: 905240 - DNA, 25 bp, Mus musculus
cctaaggcgcagaaggatcgccacg

SEQ ID NO: 905241 - DNA, 25 bp, Mus musculus
cctaaggcggattctccactgcggc

SEQ ID NO: 905242 - DNA, 25 bp, Mus musculus
cctaaggcggtttctccactgcggc

SEQ ID NO: 905243 - DNA, 25 bp, Mus musculus
cctaatacagctctagccctggaca

SEQ ID NO: 905244 - DNA, 25 bp, Mus musculus
cctaatacaggtctagccctggaca

SEQ ID NO: 905245 - DNA, 25 bp, Mus musculus
cctaatagaaaaaaacacaaatgga

SEQ ID NO: 905246 - DNA, 25 bp, Mus musculus
cctaatagaaaataacacaaatgga

SEQ ID NO: 905247 - DNA, 25 bp, Mus musculus
cctaatggaacaaaagtggctgtgc

SEQ ID NO: 905248 - DNA, 25 bp, Mus musculus
cctaatggaacaaatgtggctgtgc

SEQ ID NO: 905249 - DNA, 25 bp, Mus musculus
cctaatgttacacgacatggagaag

SEQ ID NO: 905250 - DNA, 25 bp, Mus musculus
cctaatgttacaggacatggagaag

SEQ ID NO: 905251 - DNA, 25 bp, Mus musculus
cctaatgttagagacctggcagaaa

SEQ ID NO: 905252 - DNA, 25 bp, Mus musculus
cctaatgttagagagctggcagaaa

SEQ ID NO: 905253 - DNA, 25 bp, Mus musculus
cctaattaaagacgctcattgggaa

SEQ ID NO: 905254 - DNA, 25 bp, Mus musculus
cctaattaaagaggctcattgggaa

SEQ ID NO: 905255 - DNA, 25 bp, Mus musculus
cctaattcccagcaggtctctgggg

SEQ ID NO: 905256 - DNA, 25 bp, Mus musculus
cctaattcccagctctctgggggtg

SEQ ID NO: 905257 - DNA, 25 bp, Mus musculus
cctaattcccaggaggtctctgggg

SEQ ID NO: 905258 - DNA, 25 bp, Mus musculus
cctaattcccaggtctctgggggtg

SEQ ID NO: 905259 - DNA, 25 bp, Mus musculus
cctacaaacagacggcagagaatac

SEQ ID NO: 905260 - DNA, 25 bp, Mus musculus
cctacaaacagagggcagagaatac

SEQ ID NO: 905261 - DNA, 25 bp, Mus musculus
cctacaaaccagaggccactacatt

SEQ ID NO: 905262 - DNA, 25 bp, Mus musculus
cctacaaaccagtggccactacatt

SEQ ID NO: 905263 - DNA, 25 bp, Mus musculus
cctacaaatcagaatgtttctccat

SEQ ID NO: 905264 - DNA, 25 bp, Mus musculus
cctacaaatcagtatgtttctccat

SEQ ID NO: 905265 - DNA, 25 bp, Mus musculus
cctacaacaacacacagatccaggt

SEQ ID NO: 905266 - DNA, 25 bp, Mus musculus
cctacaacaagacacagatccaggt

SEQ ID NO: 905267 - DNA, 25 bp, Mus musculus
cctacaacatcaaacactccacggg

SEQ ID NO: 905268 - DNA, 25 bp, Mus musculus
cctacaacatcaaagactccacggg

SEQ ID NO: 905269 - DNA, 25 bp, Mus musculus
cctacaaccaaaggtacttcgagaa

SEQ ID NO: 905270 - DNA, 25 bp, Mus musculus
cctacaaccataggtacttcgagaa

SEQ ID NO: 905271 - DNA, 25 bp, Mus musculus
cctacaactaccagggcagcccatt

SEQ ID NO: 905272 - DNA, 25 bp, Mus musculus
cctacaactacctgggcagcccatt

SEQ ID NO: 905273 - DNA, 25 bp, Mus musculus
cctacaagagaactctgaaggcatg

SEQ ID NO: 905274 - DNA, 25 bp, Mus musculus
cctacaagagcagagtcaaacacaa

SEQ ID NO: 905275 - DNA, 25 bp, Mus musculus
cctacaagaggagagtcaaacacaa

SEQ ID NO: 905276 - DNA, 25 bp, Mus musculus
cctacaagagtactctgaaggcatg

SEQ ID NO: 905277 - DNA, 25 bp, Mus musculus
cctacaagccagcaatcagagcgaa

SEQ ID NO: 905278 - DNA, 25 bp, Mus musculus
cctacaagccaggaatcagagcgaa

SEQ ID NO: 905279 - DNA, 25 bp, Mus musculus
cctacacaaaaacctgttcagcaga

SEQ ID NO: 905280 - DNA, 25 bp, Mus musculus
cctacacaaaaagctgttcagcaga

SEQ ID NO: 905281 - DNA, 25 bp, Mus musculus
cctacacaagaccattctggttggt

SEQ ID NO: 905282 - DNA, 25 bp, Mus musculus
cctacacaagtccattctggttggt

SEQ ID NO: 905283 - DNA, 25 bp, Mus musculus
cctacacagccacctccggtctgat

SEQ ID NO: 905284 - DNA, 25 bp, Mus musculus
cctacacagccagctccggtctgat

SEQ ID NO: 905285 - DNA, 25 bp, Mus musculus
cctacacatcccaacgtcgagacat

SEQ ID NO: 905286 - DNA, 25 bp, Mus musculus
cctacacatcccaaggtcgagacat

SEQ ID NO: 905287 - DNA, 25 bp, Mus musculus
cctacaccagcgactttgactgcgc

SEQ ID NO: 905288 - DNA, 25 bp, Mus musculus
cctacaccagggactttgactgcgc

SEQ ID NO: 905289 - DNA, 25 bp, Mus musculus
cctacacccaatacaagcagctcac

SEQ ID NO: 905290 - DNA, 25 bp, Mus musculus
cctacacccattacaagcagctcac

SEQ ID NO: 905291 - DNA, 25 bp, Mus musculus
cctacagaaactgttccgagaagta

SEQ ID NO: 905292 - DNA, 25 bp, Mus musculus
cctacagaaagtgttccgagaagta

SEQ ID NO: 905293 - DNA, 25 bp, Mus musculus
cctacagaagaggaggccactgggg

SEQ ID NO: 905294 - DNA, 25 bp, Mus musculus
cctacagaagtggaggccactgggg

SEQ ID NO: 905295 - DNA, 25 bp, Mus musculus
cctacagcagcaagcccaatgctga

SEQ ID NO: 905296 - DNA, 25 bp, Mus musculus
cctacagcaggaagcccaatgctga

SEQ ID NO: 905297 - DNA, 25 bp, Mus musculus
cctacagcataacacggtcttggca

SEQ ID NO: 905298 - DNA, 25 bp, Mus musculus
cctacagcataacagggtcttggca

SEQ ID NO: 905299 - DNA, 25 bp, Mus musculus
cctacagcgtcaccaaccgtgtcgg

SEQ ID NO: 905300 - DNA, 25 bp, Mus musculus
cctacagcgtcagcaaccgtgtcgg

SEQ ID NO: 905301 - DNA, 25 bp, Mus musculus
cctacaggaagtcgtgcgctacaac

SEQ ID NO: 905302 - DNA, 25 bp, Mus musculus
cctacaggaagtggtgcgctacaac

SEQ ID NO: 905303 - DNA, 25 bp, Mus musculus
cctacaggacaaagtttccatcctc

SEQ ID NO: 905304 - DNA, 25 bp, Mus musculus
cctacaggacaacaatgccctggac

SEQ ID NO: 905305 - DNA, 25 bp, Mus musculus
cctacaggacaacctaagcattgag

SEQ ID NO: 905306 - DNA, 25 bp, Mus musculus
cctacaggacaagaatgccctggac

SEQ ID NO: 905307 - DNA, 25 bp, Mus musculus
cctacaggacaagctaagcattgag

SEQ ID NO: 905308 - DNA, 25 bp, Mus musculus
cctacaggacaatgtttccatcctc

SEQ ID NO: 905309 - DNA, 25 bp, Mus musculus
cctacagtattcagaggaaatataa

SEQ ID NO: 905310 - DNA, 25 bp, Mus musculus
cctacagtattcagttacggtcttt

SEQ ID NO: 905311 - DNA, 25 bp, Mus musculus
cctacagtattcatgagaacctgca

SEQ ID NO: 905312 - DNA, 25 bp, Mus musculus
cctacagtattctgaggaaatataa

SEQ ID NO: 905313 - DNA, 25 bp, Mus musculus
cctacagtattctgttacggtcttt

SEQ ID NO: 905314 - DNA, 25 bp, Mus musculus
cctacagtattcttgagaacctgca

SEQ ID NO: 905315 - DNA, 25 bp, Mus musculus
cctacagttgcacgcatcccacaaa

SEQ ID NO: 905316 - DNA, 25 bp, Mus musculus
cctacagttgcaggcatcccacaaa

SEQ ID NO: 905317 - DNA, 25 bp, Mus musculus
cctacatcagcttcctgacgcagtg

SEQ ID NO: 905318 - DNA, 25 bp, Mus musculus
cctacatcaggttcctgacgcagtg

SEQ ID NO: 905319 - DNA, 25 bp, Mus musculus
cctacatcatccttagtgggtactc

SEQ ID NO: 905320 - DNA, 25 bp, Mus musculus
cctacatcatgcttagtgggtactc

SEQ ID NO: 905321 - DNA, 25 bp, Mus musculus
cctacatccaggcttgccccgttgc

SEQ ID NO: 905322 - DNA, 25 bp, Mus musculus
cctacatccagggttgccccgttgc

SEQ ID NO: 905323 - DNA, 25 bp, Mus musculus
cctacatcctcctgagcggagcgtc

SEQ ID NO: 905324 - DNA, 25 bp, Mus musculus
cctacatcctgctgagcggagcgtc

SEQ ID NO: 905325 - DNA, 25 bp, Mus musculus
cctacatgaaaaccttgtggcagag

SEQ ID NO: 905326 - DNA, 25 bp, Mus musculus
cctacatgaaaagcttgtggcagag

SEQ ID NO: 905327 - DNA, 25 bp, Mus musculus
cctacattaatgattccattggctt

SEQ ID NO: 905328 - DNA, 25 bp, Mus musculus
cctacattaatgctaccgtcttgat

SEQ ID NO: 905329 - DNA, 25 bp, Mus musculus
cctacattaatggtaccgtcttgat

SEQ ID NO: 905330 - DNA, 25 bp, Mus musculus
cctacattaatgtttccattggctt

SEQ ID NO: 905331 - DNA, 25 bp, Mus musculus
cctacattagctttgctttggtgag

SEQ ID NO: 905332 - DNA, 25 bp, Mus musculus
cctacattaggtttgctttggtgag

SEQ ID NO: 905333 - DNA, 25 bp, Mus musculus
cctacattatcactggctgcctctt

SEQ ID NO: 905334 - DNA, 25 bp, Mus musculus
cctacattatcagtggctgcctctt

SEQ ID NO: 905335 - DNA, 25 bp, Mus musculus
cctaccatagctttcaatgtggaga

SEQ ID NO: 905336 - DNA, 25 bp, Mus musculus
cctaccataggtttcaatgtggaga

SEQ ID NO: 905337 - DNA, 25 bp, Mus musculus
cctacccaagcaaactgccaggaag

SEQ ID NO: 905338 - DNA, 25 bp, Mus musculus
cctacccaagcaaactgccaggcaa

SEQ ID NO: 905339 - DNA, 25 bp, Mus musculus
cctacccaaggaaactgccaggaag

SEQ ID NO: 905340 - DNA, 25 bp, Mus musculus
cctacccaaggaaactgccaggcaa

SEQ ID NO: 905341 - DNA, 25 bp, Mus musculus
cctacccacctaagtgctcccaaga

SEQ ID NO: 905342 - DNA, 25 bp, Mus musculus
cctacccacctatgtgctcccaaga

SEQ ID NO: 905343 - DNA, 25 bp, Mus musculus
cctacccagaagcacggcactagaa

SEQ ID NO: 905344 - DNA, 25 bp, Mus musculus
cctacccagaagcacggcattagaa

SEQ ID NO: 905345 - DNA, 25 bp, Mus musculus
cctacccagaaggacggcactagaa

SEQ ID NO: 905346 - DNA, 25 bp, Mus musculus
cctacccagaaggacggcattagaa

SEQ ID NO: 905347 - DNA, 25 bp, Mus musculus
cctacccatgctcccaagttataag

SEQ ID NO: 905348 - DNA, 25 bp, Mus musculus
cctacccatggtcccaagttataag

SEQ ID NO: 905349 - DNA, 25 bp, Mus musculus
cctaccccaaatcacgtaccaactg

SEQ ID NO: 905350 - DNA, 25 bp, Mus musculus
cctaccccaaatcaggtaccaactg

SEQ ID NO: 905351 - DNA, 25 bp, Mus musculus
cctacccgacagcaaggtctatatg

SEQ ID NO: 905352 - DNA, 25 bp, Mus musculus
cctacccgacaggaaggtctatatg

SEQ ID NO: 905353 - DNA, 25 bp, Mus musculus
cctacccgagaggacgcgaccgtag

SEQ ID NO: 905354 - DNA, 25 bp, Mus musculus
cctacccgagtggacgcgaccgtag

SEQ ID NO: 905355 - DNA, 25 bp, Mus musculus
cctaccctacttccattcaatgctg

SEQ ID NO: 905356 - DNA, 25 bp, Mus musculus
cctaccctacttcctttcaatgctg

SEQ ID NO: 905357 - DNA, 25 bp, Mus musculus
cctaccctcctaagtgctcccaaga

SEQ ID NO: 905358 - DNA, 25 bp, Mus musculus
cctaccctcctatgtgctcccaaga

SEQ ID NO: 905359 - DNA, 25 bp, Mus musculus
cctaccgctccgcccgtgttggtgg

SEQ ID NO: 905360 - DNA, 25 bp, Mus musculus
cctaccgctccgccggtgttggtgg

SEQ ID NO: 905361 - DNA, 25 bp, Mus musculus
cctacctcatggcggtatcagtgag

SEQ ID NO: 905362 - DNA, 25 bp, Mus musculus
cctacctcatgggggtatcagtgag

SEQ ID NO: 905363 - DNA, 25 bp, Mus musculus
cctacctctcagctgacgtgctagt

SEQ ID NO: 905364 - DNA, 25 bp, Mus musculus
cctacctctcaggtgacgtgctagt

SEQ ID NO: 905365 - DNA, 25 bp, Mus musculus
cctacctgtgaaaagatcatctgtt

SEQ ID NO: 905366 - DNA, 25 bp, Mus musculus
cctacctgtgaatagatcatctgtt

SEQ ID NO: 905367 - DNA, 25 bp, Mus musculus
cctacctgtggacacggtgctacgg

SEQ ID NO: 905368 - DNA, 25 bp, Mus musculus
cctacctgtggagacggtgctacgg

SEQ ID NO: 905369 - DNA, 25 bp, Mus musculus
cctacgaaccacacagtaccagcaa

SEQ ID NO: 905370 - DNA, 25 bp, Mus musculus
cctacgaaccacactgtaccagcaa

SEQ ID NO: 905371 - DNA, 25 bp, Mus musculus
cctacgacgaacaagtggctgcaca

SEQ ID NO: 905372 - DNA, 25 bp, Mus musculus
cctacgacgaactagtggctgcaca

SEQ ID NO: 905373 - DNA, 25 bp, Mus musculus
cctacgactcagatgtccctggatg

SEQ ID NO: 905374 - DNA, 25 bp, Mus musculus
cctacgactcagttgtccctggatg

SEQ ID NO: 905375 - DNA, 25 bp, Mus musculus
cctacgcaataacagtttctaatta

SEQ ID NO: 905376 - DNA, 25 bp, Mus musculus
cctacgcaataagagtttctaatta

SEQ ID NO: 905377 - DNA, 25 bp, Mus musculus
cctacgcacactatcaacacctggg

SEQ ID NO: 905378 - DNA, 25 bp, Mus musculus
cctacgcacactatgaacacctggg

SEQ ID NO: 905379 - DNA, 25 bp, Mus musculus
cctacgggatcacacgtatatccat

SEQ ID NO: 905380 - DNA, 25 bp, Mus musculus
cctacgggatcacaggtatatccat

SEQ ID NO: 905381 - DNA, 25 bp, Mus musculus
cctacgtcattgctacagccagtgt

SEQ ID NO: 905382 - DNA, 25 bp, Mus musculus
cctacgtcattggtacagccagtgt

SEQ ID NO: 905383 - DNA, 25 bp, Mus musculus
cctactacgcagcccctaataagtg

SEQ ID NO: 905384 - DNA, 25 bp, Mus musculus
cctactacgcaggccctaataagtg

SEQ ID NO: 905385 - DNA, 25 bp, Mus musculus
cctactataccacctctggagaaga

SEQ ID NO: 905386 - DNA, 25 bp, Mus musculus
cctactataccagctctggagaaga

SEQ ID NO: 905387 - DNA, 25 bp, Mus musculus
cctactatatcaaccacgagaccca

SEQ ID NO: 905388 - DNA, 25 bp, Mus musculus
cctactatatcatccacgagaccca

SEQ ID NO: 905389 - DNA, 25 bp, Mus musculus
cctactcatgacaggcaaactgaag

SEQ ID NO: 905390 - DNA, 25 bp, Mus musculus
cctactcatgtcaggcaaactgaag

SEQ ID NO: 905391 - DNA, 25 bp, Mus musculus
cctactccacctcgcatgtaaagtg

SEQ ID NO: 905392 - DNA, 25 bp, Mus musculus
cctactccacctggcatgtaaagtg

SEQ ID NO: 905393 - DNA, 25 bp, Mus musculus
cctactgccgagcgaggtgtggacc

SEQ ID NO: 905394 - DNA, 25 bp, Mus musculus
cctactgccgagggaggtgtggacc

SEQ ID NO: 905395 - DNA, 25 bp, Mus musculus
cctactgctcacattctttgtgctg

SEQ ID NO: 905396 - DNA, 25 bp, Mus musculus
cctactgctcactttctttgtgctg

SEQ ID NO: 905397 - DNA, 25 bp, Mus musculus
cctactgctgtgcatttccagccac

SEQ ID NO: 905398 - DNA, 25 bp, Mus musculus
cctactgctgtggatttccagccac

SEQ ID NO: 905399 - DNA, 25 bp, Mus musculus
cctactggaaaacacagaaaatatg

SEQ ID NO: 905400 - DNA, 25 bp, Mus musculus
cctactggaaaagacagaaaatatg

SEQ ID NO: 905401 - DNA, 25 bp, Mus musculus
cctactgtaatccatgagatccgaa

SEQ ID NO: 905402 - DNA, 25 bp, Mus musculus
cctactgtaatcgatgagatccgaa

SEQ ID NO: 905403 - DNA, 25 bp, Mus musculus
cctactgtgaagacattgacgagtg

SEQ ID NO: 905404 - DNA, 25 bp, Mus musculus
cctactgtgaagtcattgacgagtg

SEQ ID NO: 905405 - DNA, 25 bp, Mus musculus
cctactgtggccgtactgccccttc

SEQ ID NO: 905406 - DNA, 25 bp, Mus musculus
cctactgtggccgttctgccccttc

SEQ ID NO: 905407 - DNA, 25 bp, Mus musculus
cctacttcagaaacagacctcgatg

SEQ ID NO: 905408 - DNA, 25 bp, Mus musculus
cctacttcagaaacatctcctttca

SEQ ID NO: 905409 - DNA, 25 bp, Mus musculus
cctacttcagaaactgacctcgatg

SEQ ID NO: 905410 - DNA, 25 bp, Mus musculus
cctacttcagaaacttctcctttca

SEQ ID NO: 905411 - DNA, 25 bp, Mus musculus
cctacttccctgctaaccaggagat

SEQ ID NO: 905412 - DNA, 25 bp, Mus musculus
cctacttccctggtaaccaggagat

SEQ ID NO: 905413 - DNA, 25 bp, Mus musculus
cctacttcctatcaatgctgccaat

SEQ ID NO: 905414 - DNA, 25 bp, Mus musculus
cctacttcctttcaatgctgccaat

SEQ ID NO: 905415 - DNA, 25 bp, Mus musculus
cctagaagctgacggttcaaggaag

SEQ ID NO: 905416 - DNA, 25 bp, Mus musculus
cctagaagctgagggttcaaggaag

SEQ ID NO: 905417 - DNA, 25 bp, Mus musculus
cctagacaaccaaacgtctgcgcag

SEQ ID NO: 905418 - DNA, 25 bp, Mus musculus
cctagacaaccaaaggtctgcgcag

SEQ ID NO: 905419 - DNA, 25 bp, Mus musculus
cctagagaagaagcgagatgagcgc

SEQ ID NO: 905420 - DNA, 25 bp, Mus musculus
cctagagaagaccgaatggttccat

SEQ ID NO: 905421 - DNA, 25 bp, Mus musculus
cctagagaagacggaatggttccat

SEQ ID NO: 905422 - DNA, 25 bp, Mus musculus
cctagagaagcgagatgagcgcagt

SEQ ID NO: 905423 - DNA, 25 bp, Mus musculus
cctagagaagggagatgagcgcagt

SEQ ID NO: 905424 - DNA, 25 bp, Mus musculus
cctagagaagtagcgagatgagcgc

SEQ ID NO: 905425 - DNA, 25 bp, Mus musculus
cctagagagcaacttcattacagca

SEQ ID NO: 905426 - DNA, 25 bp, Mus musculus
cctagagagcaagttcattacagca

SEQ ID NO: 905427 - DNA, 25 bp, Mus musculus
cctagagcggctgactgagatacta

SEQ ID NO: 905428 - DNA, 25 bp, Mus musculus
cctagagcgggtgactgagatacta

SEQ ID NO: 905429 - DNA, 25 bp, Mus musculus
cctagaggctagcgcacctggactg

SEQ ID NO: 905430 - DNA, 25 bp, Mus musculus
cctagaggctagggcacctggactg

SEQ ID NO: 905431 - DNA, 25 bp, Mus musculus
cctagatctcagagcatctaactca

SEQ ID NO: 905432 - DNA, 25 bp, Mus musculus
cctagatctcagtgcatctaactca

SEQ ID NO: 905433 - DNA, 25 bp, Mus musculus
cctagatgagccagctgcggcagaa

SEQ ID NO: 905434 - DNA, 25 bp, Mus musculus
cctagatgaggcagctgcggcagaa

SEQ ID NO: 905435 - DNA, 25 bp, Mus musculus
cctagcaaaccaatgacaaaggacc

SEQ ID NO: 905436 - DNA, 25 bp, Mus musculus
cctagcaaaccattgacaaaggacc

SEQ ID NO: 905437 - DNA, 25 bp, Mus musculus
cctagcatctttcggtacctttcaa

SEQ ID NO: 905438 - DNA, 25 bp, Mus musculus
cctagcatctttgggtacctttcaa

SEQ ID NO: 905439 - DNA, 25 bp, Mus musculus
cctagcccacagccctctagggcca

SEQ ID NO: 905440 - DNA, 25 bp, Mus musculus
cctagcccacaggcctctagggcca

SEQ ID NO: 905441 - DNA, 25 bp, Mus musculus
cctagcccagatcccaccctgaccc

SEQ ID NO: 905442 - DNA, 25 bp, Mus musculus
cctagcccagttcccaccctgaccc

SEQ ID NO: 905443 - DNA, 25 bp, Mus musculus
cctagccgagggagaggcactgatg

SEQ ID NO: 905444 - DNA, 25 bp, Mus musculus
cctagccgagggagtggcactgatg

SEQ ID NO: 905445 - DNA, 25 bp, Mus musculus
cctagcctattttacgcggctgcac

SEQ ID NO: 905446 - DNA, 25 bp, Mus musculus
cctagcctattttaggcggctgcac

SEQ ID NO: 905447 - DNA, 25 bp, Mus musculus
cctagccttgatgaaagaatattaa

SEQ ID NO: 905448 - DNA, 25 bp, Mus musculus
cctagccttgttgaaagaatattaa

SEQ ID NO: 905449 - DNA, 25 bp, Mus musculus
cctagcgccacaccaggctccatga

SEQ ID NO: 905450 - DNA, 25 bp, Mus musculus
cctagcgccacacgcatggggagga

SEQ ID NO: 905451 - DNA, 25 bp, Mus musculus
cctagcgccacacgctccatgacct

SEQ ID NO: 905452 - DNA, 25 bp, Mus musculus
cctagcgccacagcaggctccatga

SEQ ID NO: 905453 - DNA, 25 bp, Mus musculus
cctagcgccacaggcatggggagga

SEQ ID NO: 905454 - DNA, 25 bp, Mus musculus
cctagcgccacaggctccatgacct

SEQ ID NO: 905455 - DNA, 25 bp, Mus musculus
cctagcgccgagagatagtgctgga

SEQ ID NO: 905456 - DNA, 25 bp, Mus musculus
cctagcgccgagagattggagaatg

SEQ ID NO: 905457 - DNA, 25 bp, Mus musculus
cctagcgccgagtgatagtgctgga

SEQ ID NO: 905458 - DNA, 25 bp, Mus musculus
cctagcgccgagtgattggagaatg

SEQ ID NO: 905459 - DNA, 25 bp, Mus musculus
cctagctcagcgttttatgagctga

SEQ ID NO: 905460 - DNA, 25 bp, Mus musculus
cctagctcagggttttatgagctga

SEQ ID NO: 905461 - DNA, 25 bp, Mus musculus
cctagctgtgccaccaaggagctgg

SEQ ID NO: 905462 - DNA, 25 bp, Mus musculus
cctagctgtggcaccaaggagctgg

SEQ ID NO: 905463 - DNA, 25 bp, Mus musculus
cctagcttaactatacctggccttg

SEQ ID NO: 905464 - DNA, 25 bp, Mus musculus
cctagcttaagtatacctggccttg

SEQ ID NO: 905465 - DNA, 25 bp, Mus musculus
cctaggcaagactggacgagtagac

SEQ ID NO: 905466 - DNA, 25 bp, Mus musculus
cctaggcaagtctggacgagtagac

SEQ ID NO: 905467 - DNA, 25 bp, Mus musculus
cctaggcactcgctcgtgtccttcg

SEQ ID NO: 905468 - DNA, 25 bp, Mus musculus
cctaggcactcgctggtgtccttcg

SEQ ID NO: 905469 - DNA, 25 bp, Mus musculus
cctaggcctgatccagagctcagag

SEQ ID NO: 905470 - DNA, 25 bp, Mus musculus
cctaggcctgttccagagctcagag

SEQ ID NO: 905471 - DNA, 25 bp, Mus musculus
cctagggacaagacactgttctggg

SEQ ID NO: 905472 - DNA, 25 bp, Mus musculus
cctagggacaagtcactgttctggg

SEQ ID NO: 905473 - DNA, 25 bp, Mus musculus
cctaggggagctcatcaatatctgc

SEQ ID NO: 905474 - DNA, 25 bp, Mus musculus
cctaggggaggtcatcaatatctgc

SEQ ID NO: 905475 - DNA, 25 bp, Mus musculus
cctagtcttgctgctgggcctctct

SEQ ID NO: 905476 - DNA, 25 bp, Mus musculus
cctagtcttggtgctgggcctctct

SEQ ID NO: 905477 - DNA, 25 bp, Mus musculus
cctagtgagacactctacacggagc

SEQ ID NO: 905478 - DNA, 25 bp, Mus musculus
cctagtgagagactctacacggagc

SEQ ID NO: 905479 - DNA, 25 bp, Mus musculus
cctagttcaagacgaagaaatgccc

SEQ ID NO: 905480 - DNA, 25 bp, Mus musculus
cctagttcaagacgacacaatgtag

SEQ ID NO: 905481 - DNA, 25 bp, Mus musculus
cctagttcaagaggaagaaatgccc

SEQ ID NO: 905482 - DNA, 25 bp, Mus musculus
cctagttcaagaggacacaatgtag

SEQ ID NO: 905483 - DNA, 25 bp, Mus musculus
cctataagcgctcaccttcagaatc

SEQ ID NO: 905484 - DNA, 25 bp, Mus musculus
cctataagcggtcaccttcagaatc

SEQ ID NO: 905485 - DNA, 25 bp, Mus musculus
cctataatggccgcagagacctgga

SEQ ID NO: 905486 - DNA, 25 bp, Mus musculus
cctataatgggcgcagagacctgga

SEQ ID NO: 905487 - DNA, 25 bp, Mus musculus
cctatcagttctcacacttggattc

SEQ ID NO: 905488 - DNA, 25 bp, Mus musculus
cctatcagttctcagacttggattc

SEQ ID NO: 905489 - DNA, 25 bp, Mus musculus
cctatccacactgaacggaggtgtg

SEQ ID NO: 905490 - DNA, 25 bp, Mus musculus
cctatccacagtgaacggaggtgtg

SEQ ID NO: 905491 - DNA, 25 bp, Mus musculus
cctatcggccccaacgatggaatgc

SEQ ID NO: 905492 - DNA, 25 bp, Mus musculus
cctatcggccccaaggatggaatgc

SEQ ID NO: 905493 - DNA, 25 bp, Mus musculus
cctatctgtcctgccatccatgatg

SEQ ID NO: 905494 - DNA, 25 bp, Mus musculus
cctatctgtcctgcgatccatgatg

SEQ ID NO: 905495 - DNA, 25 bp, Mus musculus
cctatgaatacacgagtggaggctg

SEQ ID NO: 905496 - DNA, 25 bp, Mus musculus
cctatgaatacaggagtggaggctg

SEQ ID NO: 905497 - DNA, 25 bp, Mus musculus
cctatgagaaagcgaagacctcgga

SEQ ID NO: 905498 - DNA, 25 bp, Mus musculus
cctatgagaaagggaagacctcgga

SEQ ID NO: 905499 - DNA, 25 bp, Mus musculus
cctatgatgctctgaatgaaggggg

SEQ ID NO: 905500 - DNA, 25 bp, Mus musculus
cctatgatgctctgtatgaaggggg

SEQ ID NO: 905501 - DNA, 25 bp, Mus musculus
cctatgatggcaaaattaaagtgtg

SEQ ID NO: 905502 - DNA, 25 bp, Mus musculus
cctatgatgggaaaattaaagtgtg

SEQ ID NO: 905503 - DNA, 25 bp, Mus musculus
cctatgatgtcctaaatgaactgag

SEQ ID NO: 905504 - DNA, 25 bp, Mus musculus
cctatgatgtcctatatgaactgag

SEQ ID NO: 905505 - DNA, 25 bp, Mus musculus
cctatgccaaggcacgctgtcaggt

SEQ ID NO: 905506 - DNA, 25 bp, Mus musculus
cctatgccaaggcaggctgtcaggt

SEQ ID NO: 905507 - DNA, 25 bp, Mus musculus
cctatgccaccacgtacgccatcac

SEQ ID NO: 905508 - DNA, 25 bp, Mus musculus
cctatgccaccaggtacgccatcac

SEQ ID NO: 905509 - DNA, 25 bp, Mus musculus
cctatgcccaagcttgtgatggtgg

SEQ ID NO: 905510 - DNA, 25 bp, Mus musculus
cctatgcccaaggttgtgatggtgg

SEQ ID NO: 905511 - DNA, 25 bp, Mus musculus
cctatgcctgctgtgccccagagag

SEQ ID NO: 905512 - DNA, 25 bp, Mus musculus
cctatgcctggtgtgccccagagag

SEQ ID NO: 905513 - DNA, 25 bp, Mus musculus
cctatgctggcctgccgttccacgc

SEQ ID NO: 905514 - DNA, 25 bp, Mus musculus
cctatgctggcctggcgttccacgc

SEQ ID NO: 905515 - DNA, 25 bp, Mus musculus
cctatggaccaacgtgttggggcca

SEQ ID NO: 905516 - DNA, 25 bp, Mus musculus
cctatggaccaaggtgttggggcca

SEQ ID NO: 905517 - DNA, 25 bp, Mus musculus
cctatggcaatgacgcctttcccca

SEQ ID NO: 905518 - DNA, 25 bp, Mus musculus
cctatggcaatgtcgcctttcccca

SEQ ID NO: 905519 - DNA, 25 bp, Mus musculus
cctatgtagaaaaccgtggcaagtg

SEQ ID NO: 905520 - DNA, 25 bp, Mus musculus
cctatgtagaaaacctaggtggcaa

SEQ ID NO: 905521 - DNA, 25 bp, Mus musculus
cctatgtagaaaacggtggcaagtg

SEQ ID NO: 905522 - DNA, 25 bp, Mus musculus
cctatgtagaaaacgtaggtggcaa

SEQ ID NO: 905523 - DNA, 25 bp, Mus musculus
cctatgtgggagcatgatgcaaata

SEQ ID NO: 905524 - DNA, 25 bp, Mus musculus
cctatgtgggaggatgatgcaaata

SEQ ID NO: 905525 - DNA, 25 bp, Mus musculus
cctatgtgtcagcaaggccaaggac

SEQ ID NO: 905526 - DNA, 25 bp, Mus musculus
cctatgtgtcagctaggaaggccaa

SEQ ID NO: 905527 - DNA, 25 bp, Mus musculus
cctatgtgtcaggaaggccaaggac

SEQ ID NO: 905528 - DNA, 25 bp, Mus musculus
cctatgtgtcaggtaggaaggccaa

SEQ ID NO: 905529 - DNA, 25 bp, Mus musculus
cctattaagaatgacgtggcgagtg

SEQ ID NO: 905530 - DNA, 25 bp, Mus musculus
cctattaagaatgaggtggcgagtg

SEQ ID NO: 905531 - DNA, 25 bp, Mus musculus
cctattcacagaagcgttgactaca

SEQ ID NO: 905532 - DNA, 25 bp, Mus musculus
cctattcacagaagggttgactaca

SEQ ID NO: 905533 - DNA, 25 bp, Mus musculus
cctattcacattcacgtatcacgta

SEQ ID NO: 905534 - DNA, 25 bp, Mus musculus
cctattcacattcaggtatcacgta

SEQ ID NO: 905535 - DNA, 25 bp, Mus musculus
cctattcctgcgtcggtgtgttcaa

SEQ ID NO: 905536 - DNA, 25 bp, Mus musculus
cctattcctgggtcggtgtgttcaa

SEQ ID NO: 905537 - DNA, 25 bp, Mus musculus
cctattgaagaaaactttcaggccg

SEQ ID NO: 905538 - DNA, 25 bp, Mus musculus
cctattgaagaaaagtttcaggccg

SEQ ID NO: 905539 - DNA, 25 bp, Mus musculus
cctattggaatgctgccaacacgcc

SEQ ID NO: 905540 - DNA, 25 bp, Mus musculus
cctattggaatggtgccaacacgcc

SEQ ID NO: 905541 - DNA, 25 bp, Mus musculus
cctattgtggcttccactcgcaagc

SEQ ID NO: 905542 - DNA, 25 bp, Mus musculus
cctattgtgggttccactcgcaagc

SEQ ID NO: 905543 - DNA, 25 bp, Mus musculus
cctatttcagcaaactcccatcttg

SEQ ID NO: 905544 - DNA, 25 bp, Mus musculus
cctatttcagcttgtctacttttgg

SEQ ID NO: 905545 - DNA, 25 bp, Mus musculus
cctatttcaggaaactcccatcttg

SEQ ID NO: 905546 - DNA, 25 bp, Mus musculus
cctatttcaggttgtctacttttgg

SEQ ID NO: 905547 - DNA, 25 bp, Mus musculus
cctattttagccggctgcactgcac

SEQ ID NO: 905548 - DNA, 25 bp, Mus musculus
cctattttaggcggctgcactgcac

SEQ ID NO: 905549 - DNA, 25 bp, Mus musculus
cctcaaacacatccacttcagcacc

SEQ ID NO: 905550 - DNA, 25 bp, Mus musculus
cctcaaacacatctgactctcctat

SEQ ID NO: 905551 - DNA, 25 bp, Mus musculus
cctcaaacacatgcacttcagcacc

SEQ ID NO: 905552 - DNA, 25 bp, Mus musculus
cctcaaacacatgtgactctcctat

SEQ ID NO: 905553 - DNA, 25 bp, Mus musculus
cctcaaacatcgtgctcatgggagc

SEQ ID NO: 905554 - DNA, 25 bp, Mus musculus
cctcaaacatggtgctcatgggagc

SEQ ID NO: 905555 - DNA, 25 bp, Mus musculus
cctcaaagacaacaacacctacacc

SEQ ID NO: 905556 - DNA, 25 bp, Mus musculus
cctcaaagacaagaacacctacacc

SEQ ID NO: 905557 - DNA, 25 bp, Mus musculus
cctcaaatgacacgggcatcgatgt

SEQ ID NO: 905558 - DNA, 25 bp, Mus musculus
cctcaaatgacaggggcatcgatgt

SEQ ID NO: 905559 - DNA, 25 bp, Mus musculus
cctcaaattctcataagacgtctgt

SEQ ID NO: 905560 - DNA, 25 bp, Mus musculus
cctcaaattctcattagacgtctgt

SEQ ID NO: 905561 - DNA, 25 bp, Mus musculus
cctcaacaagctgactgtattcaca

SEQ ID NO: 905562 - DNA, 25 bp, Mus musculus
cctcaacaaggtgactgtattcaca

SEQ ID NO: 905563 - DNA, 25 bp, Mus musculus
cctcaacactgacacgagtctggtg

SEQ ID NO: 905564 - DNA, 25 bp, Mus musculus
cctcaacactgacaggagtctggtg

SEQ ID NO: 905565 - DNA, 25 bp, Mus musculus
cctcaacagacacactcctggtacc

SEQ ID NO: 905566 - DNA, 25 bp, Mus musculus
cctcaacagacacagtcctggtacc

SEQ ID NO: 905567 - DNA, 25 bp, Mus musculus
cctcaaccagcataacttgaatatt

SEQ ID NO: 905568 - DNA, 25 bp, Mus musculus
cctcaaccaggataacttgaatatt

SEQ ID NO: 905569 - DNA, 25 bp, Mus musculus
cctcaacccccgctccataacaagc

SEQ ID NO: 905570 - DNA, 25 bp, Mus musculus
cctcaacccccgctgcataacaagc

SEQ ID NO: 905571 - DNA, 25 bp, Mus musculus
cctcaacctggtcacccatccctga

SEQ ID NO: 905572 - DNA, 25 bp, Mus musculus
cctcaacctggtctatgaaacaact

SEQ ID NO: 905573 - DNA, 25 bp, Mus musculus
cctcaacctggtgacccatccctga

SEQ ID NO: 905574 - DNA, 25 bp, Mus musculus
cctcaacctggtgtatgaaacaact

SEQ ID NO: 905575 - DNA, 25 bp, Mus musculus
cctcaactccaccctgaagagcttt

SEQ ID NO: 905576 - DNA, 25 bp, Mus musculus
cctcaactccacgctgaagagcttt

SEQ ID NO: 905577 - DNA, 25 bp, Mus musculus
cctcaactgatgcgaccctgccact

SEQ ID NO: 905578 - DNA, 25 bp, Mus musculus
cctcaactgatgggaccctgccact

SEQ ID NO: 905579 - DNA, 25 bp, Mus musculus
cctcaactgtctgtgcaacagaaga

SEQ ID NO: 905580 - DNA, 25 bp, Mus musculus
cctcaactgtgtgtgcaacagaaga

SEQ ID NO: 905581 - DNA, 25 bp, Mus musculus
cctcaacttcagaatgttcgatgtg

SEQ ID NO: 905582 - DNA, 25 bp, Mus musculus
cctcaacttcagtatgttcgatgtg

SEQ ID NO: 905583 - DNA, 25 bp, Mus musculus
cctcaactttatcacgttcctggag

SEQ ID NO: 905584 - DNA, 25 bp, Mus musculus
cctcaactttatcaggttcctggag

SEQ ID NO: 905585 - DNA, 25 bp, Mus musculus
cctcaagaagcgggcgtccagtgct

SEQ ID NO: 905586 - DNA, 25 bp, Mus musculus
cctcaagaagcgggggtccagtgct

SEQ ID NO: 905587 - DNA, 25 bp, Mus musculus
cctcaagaggaacgcagtagagtcc

SEQ ID NO: 905588 - DNA, 25 bp, Mus musculus
cctcaagaggaacgccgaggatgag

SEQ ID NO: 905589 - DNA, 25 bp, Mus musculus
cctcaagaggaaggcagtagagtcc

SEQ ID NO: 905590 - DNA, 25 bp, Mus musculus
cctcaagaggaaggccgaggatgag

SEQ ID NO: 905591 - DNA, 25 bp, Mus musculus
cctcaagaggagctgtcctaacttg

SEQ ID NO: 905592 - DNA, 25 bp, Mus musculus
cctcaagaggaggtgtcctaacttg

SEQ ID NO: 905593 - DNA, 25 bp, Mus musculus
cctcaagcacctcccatggtggatt

SEQ ID NO: 905594 - DNA, 25 bp, Mus musculus
cctcaagcacctgccatggtggatt

SEQ ID NO: 905595 - DNA, 25 bp, Mus musculus
cctcaagctgaaggacttcgagcct

SEQ ID NO: 905596 - DNA, 25 bp, Mus musculus
cctcaagctgtaggacttcgagcct

SEQ ID NO: 905597 - DNA, 25 bp, Mus musculus
cctcaaggagcgttcagaagcggct

SEQ ID NO: 905598 - DNA, 25 bp, Mus musculus
cctcaaggagctctaggtggcgatg

SEQ ID NO: 905599 - DNA, 25 bp, Mus musculus
cctcaaggagctgtaggtggcgatg

SEQ ID NO: 905600 - DNA, 25 bp, Mus musculus
cctcaaggagggttcagaagcggct

SEQ ID NO: 905601 - DNA, 25 bp, Mus musculus
cctcaaggatggacacattcattac

SEQ ID NO: 905602 - DNA, 25 bp, Mus musculus
cctcaaggatggactcattcattac

SEQ ID NO: 905603 - DNA, 25 bp, Mus musculus
cctcaaggggagcctcgtgtgcgtc

SEQ ID NO: 905604 - DNA, 25 bp, Mus musculus
cctcaaggggaggctcgtgtgcgtc

SEQ ID NO: 905605 - DNA, 25 bp, Mus musculus
cctcaatgaaagcaggcactgtgtg

SEQ ID NO: 905606 - DNA, 25 bp, Mus musculus
cctcaatgaaaggaggcactgtgtg

SEQ ID NO: 905607 - DNA, 25 bp, Mus musculus
cctcaatgtcggcgacatcgggggt

SEQ ID NO: 905608 - DNA, 25 bp, Mus musculus
cctcaatgtcggggacatcgggggt

SEQ ID NO: 905609 - DNA, 25 bp, Mus musculus
cctcaattctctggttgaattttgc

SEQ ID NO: 905610 - DNA, 25 bp, Mus musculus
cctcaattctgtggttgaattttgc

SEQ ID NO: 905611 - DNA, 25 bp, Mus musculus
cctcacaaagctagttcttccaacg

SEQ ID NO: 905612 - DNA, 25 bp, Mus musculus
cctcacaaaggtagttcttccaacg

SEQ ID NO: 905613 - DNA, 25 bp, Mus musculus
cctcacacacaacgcatgaacaagt

SEQ ID NO: 905614 - DNA, 25 bp, Mus musculus
cctcacacacaacggatgaacaagt

SEQ ID NO: 905615 - DNA, 25 bp, Mus musculus
cctcacacaccgcaccttgtcagga

SEQ ID NO: 905616 - DNA, 25 bp, Mus musculus
cctcacacaccgcagcttgtcagga

SEQ ID NO: 905617 - DNA, 25 bp, Mus musculus
cctcacacagaaaggcctaaagaat

SEQ ID NO: 905618 - DNA, 25 bp, Mus musculus
cctcacacagagaggtctgaagaat

SEQ ID NO: 905619 - DNA, 25 bp, Mus musculus
cctcacacagccctaaagaatgtgt

SEQ ID NO: 905620 - DNA, 25 bp, Mus musculus
cctcacacagctttccctctgtagc

SEQ ID NO: 905621 - DNA, 25 bp, Mus musculus
cctcacacaggcctaaagaatgtgt

SEQ ID NO: 905622 - DNA, 25 bp, Mus musculus
cctcacacaggtttccctctgtagc

SEQ ID NO: 905623 - DNA, 25 bp, Mus musculus
cctcacacagtaaggcctaaagaat

SEQ ID NO: 905624 - DNA, 25 bp, Mus musculus
cctcacacagtgaggtctgaagaat

SEQ ID NO: 905625 - DNA, 25 bp, Mus musculus
cctcacagcaagcagcctcccatgt

SEQ ID NO: 905626 - DNA, 25 bp, Mus musculus
cctcacagcaagcctcccatgtggc

SEQ ID NO: 905627 - DNA, 25 bp, Mus musculus
cctcacagcaaggagcctcccatgt

SEQ ID NO: 905628 - DNA, 25 bp, Mus musculus
cctcacagcaaggctcccatgtggc

SEQ ID NO: 905629 - DNA, 25 bp, Mus musculus
cctcacatcgcaggtttagctcccg

SEQ ID NO: 905630 - DNA, 25 bp, Mus musculus
cctcacatcggaggtttagctcccg

SEQ ID NO: 905631 - DNA, 25 bp, Mus musculus
cctcacatttggagcgaaggaaaat

SEQ ID NO: 905632 - DNA, 25 bp, Mus musculus
cctcacatttggagggaaggaaaat

SEQ ID NO: 905633 - DNA, 25 bp, Mus musculus
cctcaccaagctgtctctgaagatt

SEQ ID NO: 905634 - DNA, 25 bp, Mus musculus
cctcaccaagcttagcaaggagtat

SEQ ID NO: 905635 - DNA, 25 bp, Mus musculus
cctcaccaaggtgtctctgaagatt

SEQ ID NO: 905636 - DNA, 25 bp, Mus musculus
cctcaccaaggttagcaaggagtat

SEQ ID NO: 905637 - DNA, 25 bp, Mus musculus
cctcaccagcaacctggttctagtg

SEQ ID NO: 905638 - DNA, 25 bp, Mus musculus
cctcaccagcaagctggttctagtg

SEQ ID NO: 905639 - DNA, 25 bp, Mus musculus
cctcaccatcaacggtgccggacac

SEQ ID NO: 905640 - DNA, 25 bp, Mus musculus
cctcaccatcaagggtgccggacac

SEQ ID NO: 905641 - DNA, 25 bp, Mus musculus
cctcaccatccatactgaccatgag

SEQ ID NO: 905642 - DNA, 25 bp, Mus musculus
cctcaccatccatagtgaccatgag

SEQ ID NO: 905643 - DNA, 25 bp, Mus musculus
cctcaccgagcaggagaatggcgct

SEQ ID NO: 905644 - DNA, 25 bp, Mus musculus
cctcaccgaggaggagaatggcgct

SEQ ID NO: 905645 - DNA, 25 bp, Mus musculus
cctcacctaaagatactgagccaaa

SEQ ID NO: 905646 - DNA, 25 bp, Mus musculus
cctcacctaaagttactgagccaaa

SEQ ID NO: 905647 - DNA, 25 bp, Mus musculus
cctcacctacaacgacttcctgatc

SEQ ID NO: 905648 - DNA, 25 bp, Mus musculus
cctcacctacaaggacttcctgatc

SEQ ID NO: 905649 - DNA, 25 bp, Mus musculus
cctcacctcccactggcaccaccga

SEQ ID NO: 905650 - DNA, 25 bp, Mus musculus
cctcacctcccagtggcaccaccga

SEQ ID NO: 905651 - DNA, 25 bp, Mus musculus
cctcacgcctgtcgtggttacgctc

SEQ ID NO: 905652 - DNA, 25 bp, Mus musculus
cctcacgcctgtggtggttacgctc

SEQ ID NO: 905653 - DNA, 25 bp, Mus musculus
cctcacgtatttaccgcagaaacag

SEQ ID NO: 905654 - DNA, 25 bp, Mus musculus
cctcacgtatttacggcagaaacag

SEQ ID NO: 905655 - DNA, 25 bp, Mus musculus
cctcactgaaagctgggaagtcatc

SEQ ID NO: 905656 - DNA, 25 bp, Mus musculus
cctcactgaaaggtgggaagtcatc

SEQ ID NO: 905657 - DNA, 25 bp, Mus musculus
cctcactgatcacgaactgaaacat

SEQ ID NO: 905658 - DNA, 25 bp, Mus musculus
cctcactgatcaggaactgaaacat

SEQ ID NO: 905659 - DNA, 25 bp, Mus musculus
cctcactgcaggcaagtttcttgaa

SEQ ID NO: 905660 - DNA, 25 bp, Mus musculus
cctcactgcagggaagtttcttgaa

SEQ ID NO: 905661 - DNA, 25 bp, Mus musculus
cctcactgcttgccgtactactaac

SEQ ID NO: 905662 - DNA, 25 bp, Mus musculus
cctcactgcttggcgtactactaac

SEQ ID NO: 905663 - DNA, 25 bp, Mus musculus
cctcactgggaacacggtcttcttc

SEQ ID NO: 905664 - DNA, 25 bp, Mus musculus
cctcactgggaacagggtcttcttc

SEQ ID NO: 905665 - DNA, 25 bp, Mus musculus
cctcacttgcttcacccagagtaac

SEQ ID NO: 905666 - DNA, 25 bp, Mus musculus
cctcacttgcttcagccagagtaac

SEQ ID NO: 905667 - DNA, 25 bp, Mus musculus
cctcactttccaagttataaacact

SEQ ID NO: 905668 - DNA, 25 bp, Mus musculus
cctcactttccatgttataaacact

SEQ ID NO: 905669 - DNA, 25 bp, Mus musculus
cctcagaaaacaagatgagtatcat

SEQ ID NO: 905670 - DNA, 25 bp, Mus musculus
cctcagaaaagaagatgagtatcat

SEQ ID NO: 905671 - DNA, 25 bp, Mus musculus
cctcagaaaataaaccaattgaacc

SEQ ID NO: 905672 - DNA, 25 bp, Mus musculus
cctcagaaaataaagcaattgaacc

SEQ ID NO: 905673 - DNA, 25 bp, Mus musculus
cctcagaagcatctccatcgcctgg

SEQ ID NO: 905674 - DNA, 25 bp, Mus musculus
cctcagaagcatgtccatcgcctgg

SEQ ID NO: 905675 - DNA, 25 bp, Mus musculus
cctcagaaggtgcccttcccaggac

SEQ ID NO: 905676 - DNA, 25 bp, Mus musculus
cctcagaaggtggccttcccaggac

SEQ ID NO: 905677 - DNA, 25 bp, Mus musculus
cctcagacaagacgtaaagaagaag

SEQ ID NO: 905678 - DNA, 25 bp, Mus musculus
cctcagacaagaggtaaagaagaag

SEQ ID NO: 905679 - DNA, 25 bp, Mus musculus
cctcagacatctcgctcagcatggg

SEQ ID NO: 905680 - DNA, 25 bp, Mus musculus
cctcagacatctggctcagcatggg

SEQ ID NO: 905681 - DNA, 25 bp, Mus musculus
cctcagacctcaggagtttagcatg

SEQ ID NO: 905682 - DNA, 25 bp, Mus musculus
cctcagacctcaggtgtttagcatg

SEQ ID NO: 905683 - DNA, 25 bp, Mus musculus
cctcagactcagcgttgagctccat

SEQ ID NO: 905684 - DNA, 25 bp, Mus musculus
cctcagactcagggttgagctccat

SEQ ID NO: 905685 - DNA, 25 bp, Mus musculus
cctcagacttctaacgcctctcctg

SEQ ID NO: 905686 - DNA, 25 bp, Mus musculus
cctcagacttctaaggcctctcctg

SEQ ID NO: 905687 - DNA, 25 bp, Mus musculus
cctcagagctctatgggctaatgag

SEQ ID NO: 905688 - DNA, 25 bp, Mus musculus
cctcagagctgtatgggctaatgag

SEQ ID NO: 905689 - DNA, 25 bp, Mus musculus
cctcagagtctgcacaaccagtgtg

SEQ ID NO: 905690 - DNA, 25 bp, Mus musculus
cctcagagtctgcagaaccagtgtg

SEQ ID NO: 905691 - DNA, 25 bp, Mus musculus
cctcagatggcacgaccccacaggc

SEQ ID NO: 905692 - DNA, 25 bp, Mus musculus
cctcagatggcacgcccaagtatct

SEQ ID NO: 905693 - DNA, 25 bp, Mus musculus
cctcagatggcaggaccccacaggc

SEQ ID NO: 905694 - DNA, 25 bp, Mus musculus
cctcagatggcaggcccaagtatct

SEQ ID NO: 905695 - DNA, 25 bp, Mus musculus
cctcagattccacaatggctcatca

SEQ ID NO: 905696 - DNA, 25 bp, Mus musculus
cctcagattccagaatggctcatca

SEQ ID NO: 905697 - DNA, 25 bp, Mus musculus
cctcagcaaatgaggtaaacagctg

SEQ ID NO: 905698 - DNA, 25 bp, Mus musculus
cctcagcaaatgtggtaaacagctg

SEQ ID NO: 905699 - DNA, 25 bp, Mus musculus
cctcagcacactgacatatgcagat

SEQ ID NO: 905700 - DNA, 25 bp, Mus musculus
cctcagcacactgagatatgcagat

SEQ ID NO: 905701 - DNA, 25 bp, Mus musculus
cctcagcaggacaatgaccagttga

SEQ ID NO: 905702 - DNA, 25 bp, Mus musculus
cctcagcaggactatgaccagttga

SEQ ID NO: 905703 - DNA, 25 bp, Mus musculus
cctcagcccctgcctgccaccatgg

SEQ ID NO: 905704 - DNA, 25 bp, Mus musculus
cctcagcccctggctgccaccatgg

SEQ ID NO: 905705 - DNA, 25 bp, Mus musculus
cctcagccctcacacgcacccggtc

SEQ ID NO: 905706 - DNA, 25 bp, Mus musculus
cctcagccctcacaggcacccggtc

SEQ ID NO: 905707 - DNA, 25 bp, Mus musculus
cctcagccctcatcaatgaggaact

SEQ ID NO: 905708 - DNA, 25 bp, Mus musculus
cctcagccctcatctatgaggaact

SEQ ID NO: 905709 - DNA, 25 bp, Mus musculus
cctcagccgcagcctggaggagaac

SEQ ID NO: 905710 - DNA, 25 bp, Mus musculus
cctcagccgcaggctggaggagaac

SEQ ID NO: 905711 - DNA, 25 bp, Mus musculus
cctcagcctacgatttcttttgatg

SEQ ID NO: 905712 - DNA, 25 bp, Mus musculus
cctcagcctacgttttcttttgatg

SEQ ID NO: 905713 - DNA, 25 bp, Mus musculus
cctcagcgccgcctctccgcttccc

SEQ ID NO: 905714 - DNA, 25 bp, Mus musculus
cctcagcgccgcctgtccgcttccc

SEQ ID NO: 905715 - DNA, 25 bp, Mus musculus
cctcagctcctgcaccaaattagcc

SEQ ID NO: 905716 - DNA, 25 bp, Mus musculus
cctcagctcctgcagcaaattagcc

SEQ ID NO: 905717 - DNA, 25 bp, Mus musculus
cctcagctcggaggacaggtcaatg

SEQ ID NO: 905718 - DNA, 25 bp, Mus musculus
cctcagctcggaggtcaggtcaatg

SEQ ID NO: 905719 - DNA, 25 bp, Mus musculus
cctcagctggttctgcagacaaaat

SEQ ID NO: 905720 - DNA, 25 bp, Mus musculus
cctcagctggttctgcagtcaaaat

SEQ ID NO: 905721 - DNA, 25 bp, Mus musculus
cctcagctggttgtgcagacaaaat

SEQ ID NO: 905722 - DNA, 25 bp, Mus musculus
cctcagctggttgtgcagtcaaaat

SEQ ID NO: 905723 - DNA, 25 bp, Mus musculus
cctcaggaagcccacaaaatccaat

SEQ ID NO: 905724 - DNA, 25 bp, Mus musculus
cctcaggaagcccagaaaatccaat

SEQ ID NO: 905725 - DNA, 25 bp, Mus musculus
cctcaggagagccacgcttagaatc

SEQ ID NO: 905726 - DNA, 25 bp, Mus musculus
cctcaggagagccaggcttagaatc

SEQ ID NO: 905727 - DNA, 25 bp, Mus musculus
cctcaggatgtgatcgtgccctact

SEQ ID NO: 905728 - DNA, 25 bp, Mus musculus
cctcaggatgtgatggtgccctact

SEQ ID NO: 905729 - DNA, 25 bp, Mus musculus
cctcagggagagcctgcacttctgc

SEQ ID NO: 905730 - DNA, 25 bp, Mus musculus
cctcagggagtgcctgcacttctgc

SEQ ID NO: 905731 - DNA, 25 bp, Mus musculus
cctcagggccgcaacgtcctggagc

SEQ ID NO: 905732 - DNA, 25 bp, Mus musculus
cctcagggccgcaaggtcctggagc

SEQ ID NO: 905733 - DNA, 25 bp, Mus musculus
cctcagggcgagctgactgtgatga

SEQ ID NO: 905734 - DNA, 25 bp, Mus musculus
cctcagggcgaggtgactgtgatga

SEQ ID NO: 905735 - DNA, 25 bp, Mus musculus
cctcagtgagcccataactgcacga

SEQ ID NO: 905736 - DNA, 25 bp, Mus musculus
cctcagtgagctgatgactccgagg

SEQ ID NO: 905737 - DNA, 25 bp, Mus musculus
cctcagtgaggccataactgcacga

SEQ ID NO: 905738 - DNA, 25 bp, Mus musculus
cctcagtgaggtgatgactccgagg

SEQ ID NO: 905739 - DNA, 25 bp, Mus musculus
cctcagtgctcccacgggtgatctg

SEQ ID NO: 905740 - DNA, 25 bp, Mus musculus
cctcagtgctcccaggggtgatctg

SEQ ID NO: 905741 - DNA, 25 bp, Mus musculus
cctcagttctcccacgttgttcctc

SEQ ID NO: 905742 - DNA, 25 bp, Mus musculus
cctcagttctcccaggttgttcctc

SEQ ID NO: 905743 - DNA, 25 bp, Mus musculus
cctcataaagcaggtggacatctac

SEQ ID NO: 905744 - DNA, 25 bp, Mus musculus
cctcataaaggaggtggacatctac

SEQ ID NO: 905745 - DNA, 25 bp, Mus musculus
cctcatacattgcaacctccaactg

SEQ ID NO: 905746 - DNA, 25 bp, Mus musculus
cctcatacattggaacctccaactg

SEQ ID NO: 905747 - DNA, 25 bp, Mus musculus
cctcatcaactgcacaggagagggt

SEQ ID NO: 905748 - DNA, 25 bp, Mus musculus
cctcatcaactggacaggagagggt

SEQ ID NO: 905749 - DNA, 25 bp, Mus musculus
cctcatcaagcacgttctctatgag

SEQ ID NO: 905750 - DNA, 25 bp, Mus musculus
cctcatcaaggacgttctctatgag

SEQ ID NO: 905751 - DNA, 25 bp, Mus musculus
cctcatcactcatctgctaaatgag

SEQ ID NO: 905752 - DNA, 25 bp, Mus musculus
cctcatcactgatctgctaaatgag

SEQ ID NO: 905753 - DNA, 25 bp, Mus musculus
cctcatcagtgagccaatggctgca

SEQ ID NO: 905754 - DNA, 25 bp, Mus musculus
cctcatcagtgagcgaatggctgca

SEQ ID NO: 905755 - DNA, 25 bp, Mus musculus
cctcatcatccacctggatagcagt

SEQ ID NO: 905756 - DNA, 25 bp, Mus musculus
cctcatcatccagctggatagcagt

SEQ ID NO: 905757 - DNA, 25 bp, Mus musculus
cctcatccagaccagagggcctgcc

SEQ ID NO: 905758 - DNA, 25 bp, Mus musculus
cctcatccagacctgggctgacgcg

SEQ ID NO: 905759 - DNA, 25 bp, Mus musculus
cctcatccagcgtcaaagttgtgag

SEQ ID NO: 905760 - DNA, 25 bp, Mus musculus
cctcatccagcttactggcggtttt

SEQ ID NO: 905761 - DNA, 25 bp, Mus musculus
cctcatccagggtcaaagttgtgag

SEQ ID NO: 905762 - DNA, 25 bp, Mus musculus
cctcatccaggttactggcggtttt

SEQ ID NO: 905763 - DNA, 25 bp, Mus musculus
cctcatccagtccagagggcctgcc

SEQ ID NO: 905764 - DNA, 25 bp, Mus musculus
cctcatccagtcctgggctgacgcg

SEQ ID NO: 905765 - DNA, 25 bp, Mus musculus
cctcatcccaggctttactcctggc

SEQ ID NO: 905766 - DNA, 25 bp, Mus musculus
cctcatcccagggtttactcctggc

SEQ ID NO: 905767 - DNA, 25 bp, Mus musculus
cctcatcctcaatacttgaactttc

SEQ ID NO: 905768 - DNA, 25 bp, Mus musculus
cctcatcctcaatagttgaactttc

SEQ ID NO: 905769 - DNA, 25 bp, Mus musculus
cctcatcgacataaagattacagat

SEQ ID NO: 905770 - DNA, 25 bp, Mus musculus
cctcatcgacataatgattacagat

SEQ ID NO: 905771 - DNA, 25 bp, Mus musculus
cctcatcgtgttcagccttccagtg

SEQ ID NO: 905772 - DNA, 25 bp, Mus musculus
cctcatcgtgttgagccttccagtg

SEQ ID NO: 905773 - DNA, 25 bp, Mus musculus
cctcatctagctacgtaggtgccat

SEQ ID NO: 905774 - DNA, 25 bp, Mus musculus
cctcatctaggtacgtaggtgccat

SEQ ID NO: 905775 - DNA, 25 bp, Mus musculus
cctcatctatgacggctacgagggc

SEQ ID NO: 905776 - DNA, 25 bp, Mus musculus
cctcatctatgagggctacgagggc

SEQ ID NO: 905777 - DNA, 25 bp, Mus musculus
cctcatctccttcactgaggatgcc

SEQ ID NO: 905778 - DNA, 25 bp, Mus musculus
cctcatctccttcagtgaggatgcc

SEQ ID NO: 905779 - DNA, 25 bp, Mus musculus
cctcatctctggcggatcctaaaac

SEQ ID NO: 905780 - DNA, 25 bp, Mus musculus
cctcatctctgggggatcctaaaac

SEQ ID NO: 905781 - DNA, 25 bp, Mus musculus
cctcatcttctgcggggcagctggc

SEQ ID NO: 905782 - DNA, 25 bp, Mus musculus
cctcatcttctggggggcagctggc

SEQ ID NO: 905783 - DNA, 25 bp, Mus musculus
cctcatgcattaagtcttgtgatat

SEQ ID NO: 905784 - DNA, 25 bp, Mus musculus
cctcatgcattatgtcttgtgatat

SEQ ID NO: 905785 - DNA, 25 bp, Mus musculus
cctcatgccgagcaactgtgggtta

SEQ ID NO: 905786 - DNA, 25 bp, Mus musculus
cctcatgccgtgcaactgtgggtta

SEQ ID NO: 905787 - DNA, 25 bp, Mus musculus
cctcatgcctttcggcttggaagtg

SEQ ID NO: 905788 - DNA, 25 bp, Mus musculus
cctcatgcctttgggcttggaagtg

SEQ ID NO: 905789 - DNA, 25 bp, Mus musculus
cctcatgcttgtgaccatactctcc

SEQ ID NO: 905790 - DNA, 25 bp, Mus musculus
cctcatgcttgtgagcatactctcc

SEQ ID NO: 905791 - DNA, 25 bp, Mus musculus
cctcatggcatccacggaccagagc

SEQ ID NO: 905792 - DNA, 25 bp, Mus musculus
cctcatggcatccagggaccagagc

SEQ ID NO: 905793 - DNA, 25 bp, Mus musculus
cctcatggctgccggtttcctgtgc

SEQ ID NO: 905794 - DNA, 25 bp, Mus musculus
cctcatggctgcgggtttcctgtgc

SEQ ID NO: 905795 - DNA, 25 bp, Mus musculus
cctcatgttatgactcaacaaggac

SEQ ID NO: 905796 - DNA, 25 bp, Mus musculus
cctcatgttatgtctcaacaaggac

SEQ ID NO: 905797 - DNA, 25 bp, Mus musculus
cctcattggtctaatctctgaccgc

SEQ ID NO: 905798 - DNA, 25 bp, Mus musculus
cctcattggtcttatctctgaccgc

SEQ ID NO: 905799 - DNA, 25 bp, Mus musculus
cctcatttccgacgctactaaagca

SEQ ID NO: 905800 - DNA, 25 bp, Mus musculus
cctcatttccgaggctactaaagca

SEQ ID NO: 905801 - DNA, 25 bp, Mus musculus
cctcatttgctcaacgacgtgggct

SEQ ID NO: 905802 - DNA, 25 bp, Mus musculus
cctcatttgctcaaggacgtgggct

SEQ ID NO: 905803 - DNA, 25 bp, Mus musculus
cctccaaaagctgttcttctgtatg

SEQ ID NO: 905804 - DNA, 25 bp, Mus musculus
cctccaaaaggtgttcttctgtatg

SEQ ID NO: 905805 - DNA, 25 bp, Mus musculus
cctccaaatgcttctgaatcagacg

SEQ ID NO: 905806 - DNA, 25 bp, Mus musculus
cctccaaatggttctgaatcagacg

SEQ ID NO: 905807 - DNA, 25 bp, Mus musculus
cctccaacaaatgcagaaccccgac

SEQ ID NO: 905808 - DNA, 25 bp, Mus musculus
cctccaacaattgcagaaccccgac

SEQ ID NO: 905809 - DNA, 25 bp, Mus musculus
cctccaagagccggagtcgccggca

SEQ ID NO: 905810 - DNA, 25 bp, Mus musculus
cctccaagaggcggagtcgccggca

SEQ ID NO: 905811 - DNA, 25 bp, Mus musculus
cctccacactgctgagcgccatcac

SEQ ID NO: 905812 - DNA, 25 bp, Mus musculus
cctccacactgctgtgcgccatcac

SEQ ID NO: 905813 - DNA, 25 bp, Mus musculus
cctccacagacttcctaccaggttt

SEQ ID NO: 905814 - DNA, 25 bp, Mus musculus
cctccacagagttcctaccaggttt

SEQ ID NO: 905815 - DNA, 25 bp, Mus musculus
cctccacaggatatgggagcagaaa

SEQ ID NO: 905816 - DNA, 25 bp, Mus musculus
cctccacaggttatgggagcagaaa

SEQ ID NO: 905817 - DNA, 25 bp, Mus musculus
cctccaccagctaaaaatagcaaca

SEQ ID NO: 905818 - DNA, 25 bp, Mus musculus
cctccaccaggtaaaaatagcaaca

SEQ ID NO: 905819 - DNA, 25 bp, Mus musculus
cctccaccatttcacagtcagcttg

SEQ ID NO: 905820 - DNA, 25 bp, Mus musculus
cctccaccatttcagagtcagcttg

SEQ ID NO: 905821 - DNA, 25 bp, Mus musculus
cctccacccccacaaacgtgtgccg

SEQ ID NO: 905822 - DNA, 25 bp, Mus musculus
cctccacccccagaaacgtgtgccg

SEQ ID NO: 905823 - DNA, 25 bp, Mus musculus
cctccacccgaatggtaacatcact

SEQ ID NO: 905824 - DNA, 25 bp, Mus musculus
cctccacccgtatggtaacatcact

SEQ ID NO: 905825 - DNA, 25 bp, Mus musculus
cctccaccgacgcgatcggctttgc

SEQ ID NO: 905826 - DNA, 25 bp, Mus musculus
cctccaccgacgggatcggctttgc

SEQ ID NO: 905827 - DNA, 25 bp, Mus musculus
cctccacctgatccaggtgagcggc

SEQ ID NO: 905828 - DNA, 25 bp, Mus musculus
cctccacctgttccaggtgagcggc

SEQ ID NO: 905829 - DNA, 25 bp, Mus musculus
cctccacgagccgagcctgtcacag

SEQ ID NO: 905830 - DNA, 25 bp, Mus musculus
cctccacgaggcgagcctgtcacag

SEQ ID NO: 905831 - DNA, 25 bp, Mus musculus
cctccactccagatcatgtcatcag

SEQ ID NO: 905832 - DNA, 25 bp, Mus musculus
cctccactccagttcatgtcatcag

SEQ ID NO: 905833 - DNA, 25 bp, Mus musculus
cctccactggcacgtcaaaaatgtg

SEQ ID NO: 905834 - DNA, 25 bp, Mus musculus
cctccactggcaggtcaaaaatgtg

SEQ ID NO: 905835 - DNA, 25 bp, Mus musculus
cctccacttcaacatcaaagatcct

SEQ ID NO: 905836 - DNA, 25 bp, Mus musculus
cctccacttcaagatcaaagatcct

SEQ ID NO: 905837 - DNA, 25 bp, Mus musculus
cctccacttcagcctgtttgacgtc

SEQ ID NO: 905838 - DNA, 25 bp, Mus musculus
cctccacttcaggctgtttgacgtc

SEQ ID NO: 905839 - DNA, 25 bp, Mus musculus
cctccagaaaatcttgccatgcatg

SEQ ID NO: 905840 - DNA, 25 bp, Mus musculus
cctccagaaattcttgccatgcatg

SEQ ID NO: 905841 - DNA, 25 bp, Mus musculus
cctccagaagcccaagaaatatgca

SEQ ID NO: 905842 - DNA, 25 bp, Mus musculus
cctccagaaggccaagaaatatgca

SEQ ID NO: 905843 - DNA, 25 bp, Mus musculus
cctccagaccagcctgcagtgttga

SEQ ID NO: 905844 - DNA, 25 bp, Mus musculus
cctccagaccaggctgcagtgttga

SEQ ID NO: 905845 - DNA, 25 bp, Mus musculus
cctccagacccacacacttccaaat

SEQ ID NO: 905846 - DNA, 25 bp, Mus musculus
cctccagacccacacaggctcccaa

SEQ ID NO: 905847 - DNA, 25 bp, Mus musculus
cctccagacccacagacttccaaat

SEQ ID NO: 905848 - DNA, 25 bp, Mus musculus
cctccagacccacagaggctcccaa

SEQ ID NO: 905849 - DNA, 25 bp, Mus musculus
cctccagagaaacgtgcttaaactt

SEQ ID NO: 905850 - DNA, 25 bp, Mus musculus
cctccagagaaaggtgcttaaactt

SEQ ID NO: 905851 - DNA, 25 bp, Mus musculus
cctccagagctcctctttattcatg

SEQ ID NO: 905852 - DNA, 25 bp, Mus musculus
cctccagagctcctgtttattcatg

SEQ ID NO: 905853 - DNA, 25 bp, Mus musculus
cctccagaggagaacatcaagactc

SEQ ID NO: 905854 - DNA, 25 bp, Mus musculus
cctccagaggagaagatcaagactc

SEQ ID NO: 905855 - DNA, 25 bp, Mus musculus
cctccagatataagctctcgaacag

SEQ ID NO: 905856 - DNA, 25 bp, Mus musculus
cctccagatatatgctctcgaacag

SEQ ID NO: 905857 - DNA, 25 bp, Mus musculus
cctccagatatcctcagcagagggg

SEQ ID NO: 905858 - DNA, 25 bp, Mus musculus
cctccagatatcctgagcagagggg

SEQ ID NO: 905859 - DNA, 25 bp, Mus musculus
cctccagatgacaacagacgcatgc

SEQ ID NO: 905860 - DNA, 25 bp, Mus musculus
cctccagatgactacagacgcatgc

SEQ ID NO: 905861 - DNA, 25 bp, Mus musculus
cctccagatggaaatctgtatccta

SEQ ID NO: 905862 - DNA, 25 bp, Mus musculus
cctccagatggatatctgtatccta

SEQ ID NO: 905863 - DNA, 25 bp, Mus musculus
cctccagatgttcgcaagaagacat

SEQ ID NO: 905864 - DNA, 25 bp, Mus musculus
cctccagatgttggcaagaagacat

SEQ ID NO: 905865 - DNA, 25 bp, Mus musculus
cctccagcagcgccctggtcaagac

SEQ ID NO: 905866 - DNA, 25 bp, Mus musculus
cctccagcagggccctggtcaagac

SEQ ID NO: 905867 - DNA, 25 bp, Mus musculus
cctccagcggcccacgggcttgact

SEQ ID NO: 905868 - DNA, 25 bp, Mus musculus
cctccagcggcccaggggcttgact

SEQ ID NO: 905869 - DNA, 25 bp, Mus musculus
cctccagctccgagcatccaaggag

SEQ ID NO: 905870 - DNA, 25 bp, Mus musculus
cctccagctccgtgcatccaaggag

SEQ ID NO: 905871 - DNA, 25 bp, Mus musculus
cctccagctcttcgcagaagacttt

SEQ ID NO: 905872 - DNA, 25 bp, Mus musculus
cctccagctcttggcagaagacttt

SEQ ID NO: 905873 - DNA, 25 bp, Mus musculus
cctccaggacccagaggaacaattg

SEQ ID NO: 905874 - DNA, 25 bp, Mus musculus
cctccaggacccagtggaacaattg

SEQ ID NO: 905875 - DNA, 25 bp, Mus musculus
cctccaggacggcgtctgcctggac

SEQ ID NO: 905876 - DNA, 25 bp, Mus musculus
cctccaggacggggtctgcctggac

SEQ ID NO: 905877 - DNA, 25 bp, Mus musculus
cctccaggcaaggacggcctcatcg

SEQ ID NO: 905878 - DNA, 25 bp, Mus musculus
cctccaggcaaggagggcctcatcg

SEQ ID NO: 905879 - DNA, 25 bp, Mus musculus
cctccagggtcaccttccaagcaac

SEQ ID NO: 905880 - DNA, 25 bp, Mus musculus
cctccagggtcacgtgaaccaccaa

SEQ ID NO: 905881 - DNA, 25 bp, Mus musculus
cctccagggtcagaagtactacgca

SEQ ID NO: 905882 - DNA, 25 bp, Mus musculus
cctccagggtcagatgtactacgca

SEQ ID NO: 905883 - DNA, 25 bp, Mus musculus
cctccagggtcagcttccaagcaac

SEQ ID NO: 905884 - DNA, 25 bp, Mus musculus
cctccagggtcaggtgaaccaccaa

SEQ ID NO: 905885 - DNA, 25 bp, Mus musculus
cctccagtgcagaacctgtagctat

SEQ ID NO: 905886 - DNA, 25 bp, Mus musculus
cctccagtgcagaagctgtagctat

SEQ ID NO: 905887 - DNA, 25 bp, Mus musculus
cctccatcagttctctgctcaaaga

SEQ ID NO: 905888 - DNA, 25 bp, Mus musculus
cctccatcagttctgtgctcaaaga

SEQ ID NO: 905889 - DNA, 25 bp, Mus musculus
cctccatcgctacacatactttatg

SEQ ID NO: 905890 - DNA, 25 bp, Mus musculus
cctccatcgctacagatactttatg

SEQ ID NO: 905891 - DNA, 25 bp, Mus musculus
cctccatttcagagctaatcattga

SEQ ID NO: 905892 - DNA, 25 bp, Mus musculus
cctccatttcagatgctaatcattg

SEQ ID NO: 905893 - DNA, 25 bp, Mus musculus
cctccatttcagtgctaatcattga

SEQ ID NO: 905894 - DNA, 25 bp, Mus musculus
cctccatttcagttgctaatcattg

SEQ ID NO: 905895 - DNA, 25 bp, Mus musculus
cctcccaaagatactggcattgccc

SEQ ID NO: 905896 - DNA, 25 bp, Mus musculus
cctcccaaagattctggcattgccc

SEQ ID NO: 905897 - DNA, 25 bp, Mus musculus
cctcccaagaaaccgagtgagaaga

SEQ ID NO: 905898 - DNA, 25 bp, Mus musculus
cctcccaagaaagcgagtgagaaga

SEQ ID NO: 905899 - DNA, 25 bp, Mus musculus
cctcccacctcccctgatccaggcg

SEQ ID NO: 905900 - DNA, 25 bp, Mus musculus
cctcccacctccgctgatccaggcg

SEQ ID NO: 905901 - DNA, 25 bp, Mus musculus
cctcccagcagaaggagtgtcctct

SEQ ID NO: 905902 - DNA, 25 bp, Mus musculus
cctcccagcagaaggcagcaagcgc

SEQ ID NO: 905903 - DNA, 25 bp, Mus musculus
cctcccagcagatggagtgtcctct

SEQ ID NO: 905904 - DNA, 25 bp, Mus musculus
cctcccagcagatggcagcaagcgc

SEQ ID NO: 905905 - DNA, 25 bp, Mus musculus
cctcccagcagcaacgtgtctggtc

SEQ ID NO: 905906 - DNA, 25 bp, Mus musculus
cctcccagcagcaaggtgtctggtc

SEQ ID NO: 905907 - DNA, 25 bp, Mus musculus
cctcccagctaacaaaagcgcggtg

SEQ ID NO: 905908 - DNA, 25 bp, Mus musculus
cctcccagctaagaaaagcgcggtg

SEQ ID NO: 905909 - DNA, 25 bp, Mus musculus
cctccccaaaatgactgaaatgtgt

SEQ ID NO: 905910 - DNA, 25 bp, Mus musculus
cctccccaaaatgagtgaaatgtgt

SEQ ID NO: 905911 - DNA, 25 bp, Mus musculus
cctccccaacctcacctttctgacc

SEQ ID NO: 905912 - DNA, 25 bp, Mus musculus
cctccccaacctcagctttctgacc

SEQ ID NO: 905913 - DNA, 25 bp, Mus musculus
cctccccacgctacagtcgagagta

SEQ ID NO: 905914 - DNA, 25 bp, Mus musculus
cctccccacgctactgtcgagagta

SEQ ID NO: 905915 - DNA, 25 bp, Mus musculus
cctccccaggaccccggatcagtca

SEQ ID NO: 905916 - DNA, 25 bp, Mus musculus
cctccccaggacccgggatcagtca

SEQ ID NO: 905917 - DNA, 25 bp, Mus musculus
cctcccccaacactacaggcgcctc

SEQ ID NO: 905918 - DNA, 25 bp, Mus musculus
cctcccccaagactacaggcgcctc

SEQ ID NO: 905919 - DNA, 25 bp, Mus musculus
cctcccccactgcatgatgcagaat

SEQ ID NO: 905920 - DNA, 25 bp, Mus musculus
cctcccccactggatgatgcagaat

SEQ ID NO: 905921 - DNA, 25 bp, Mus musculus
cctcccccagagtgctgacctagct

SEQ ID NO: 905922 - DNA, 25 bp, Mus musculus
cctcccccagtgtgctgacctagct

SEQ ID NO: 905923 - DNA, 25 bp, Mus musculus
cctccccgcgccaccgacaagtgac

SEQ ID NO: 905924 - DNA, 25 bp, Mus musculus
cctccccgcgccacggacaagtgac

SEQ ID NO: 905925 - DNA, 25 bp, Mus musculus
cctcccgaagccgctcaaggtccag

SEQ ID NO: 905926 - DNA, 25 bp, Mus musculus
cctcccgaaggcgctcaaggtccag

SEQ ID NO: 905927 - DNA, 25 bp, Mus musculus
cctcccggaaggaacgtcggcagct

SEQ ID NO: 905928 - DNA, 25 bp, Mus musculus
cctcccggaaggaaggtcggcagct

SEQ ID NO: 905929 - DNA, 25 bp, Mus musculus
cctcccggctcagacgtgcttcgaa

SEQ ID NO: 905930 - DNA, 25 bp, Mus musculus
cctcccggctcagaggtgcttcgaa

SEQ ID NO: 905931 - DNA, 25 bp, Mus musculus
cctccctactcacccctcctggtat

SEQ ID NO: 905932 - DNA, 25 bp, Mus musculus
cctccctactcagccctcctggtat

SEQ ID NO: 905933 - DNA, 25 bp, Mus musculus
cctccctccccacatgtagctggta

SEQ ID NO: 905934 - DNA, 25 bp, Mus musculus
cctccctccccagatgtagctggta

SEQ ID NO: 905935 - DNA, 25 bp, Mus musculus
cctccctccctgccagggggaggag

SEQ ID NO: 905936 - DNA, 25 bp, Mus musculus
cctccctccctggcagggggaggag

SEQ ID NO: 905937 - DNA, 25 bp, Mus musculus
cctccctctaagcccaacgcctgga

SEQ ID NO: 905938 - DNA, 25 bp, Mus musculus
cctccctctaaggccaacgcctgga

SEQ ID NO: 905939 - DNA, 25 bp, Mus musculus
cctccctctgatcgatgaggtgata

SEQ ID NO: 905940 - DNA, 25 bp, Mus musculus
cctccctctgttcgatgaggtgata

SEQ ID NO: 905941 - DNA, 25 bp, Mus musculus
cctccgaaaactcctggaggtcact

SEQ ID NO: 905942 - DNA, 25 bp, Mus musculus
cctccgaaaactgctggaggtcact

SEQ ID NO: 905943 - DNA, 25 bp, Mus musculus
cctccgaagtgaggcgcttgcagat

SEQ ID NO: 905944 - DNA, 25 bp, Mus musculus
cctccgaagtgaggggcttgcagat

SEQ ID NO: 905945 - DNA, 25 bp, Mus musculus
cctccgacctcactcttggccagtt

SEQ ID NO: 905946 - DNA, 25 bp, Mus musculus
cctccgacctcactgttggccagtt

SEQ ID NO: 905947 - DNA, 25 bp, Mus musculus
cctccgacgagaactatgagatcat

SEQ ID NO: 905948 - DNA, 25 bp, Mus musculus
cctccgacgagatctatgagatcat

SEQ ID NO: 905949 - DNA, 25 bp, Mus musculus
cctccgagagagctgccgttctctg

SEQ ID NO: 905950 - DNA, 25 bp, Mus musculus
cctccgagagaggtgccgttctctg

SEQ ID NO: 905951 - DNA, 25 bp, Mus musculus
cctccgagcagtcgcccgagacatt

SEQ ID NO: 905952 - DNA, 25 bp, Mus musculus
cctccgagcagtggcccgagacatt

SEQ ID NO: 905953 - DNA, 25 bp, Mus musculus
cctccgccagatctagactggctgg

SEQ ID NO: 905954 - DNA, 25 bp, Mus musculus
cctccgccagttctagactggctgg

SEQ ID NO: 905955 - DNA, 25 bp, Mus musculus
cctccgccatcgtacgtgccgatcc

SEQ ID NO: 905956 - DNA, 25 bp, Mus musculus
cctccgccatcgtaggtgccgatcc

SEQ ID NO: 905957 - DNA, 25 bp, Mus musculus
cctccgccggcagtgagtccctcca

SEQ ID NO: 905958 - DNA, 25 bp, Mus musculus
cctccgccgggagtgagtccctcca

SEQ ID NO: 905959 - DNA, 25 bp, Mus musculus
cctccggaagaatctctgtggccca

SEQ ID NO: 905960 - DNA, 25 bp, Mus musculus
cctccggaagtatctctgtggccca

SEQ ID NO: 905961 - DNA, 25 bp, Mus musculus
cctccggcatgctgcgtatcatcat

SEQ ID NO: 905962 - DNA, 25 bp, Mus musculus
cctccggcatgctgggtatcatcat

SEQ ID NO: 905963 - DNA, 25 bp, Mus musculus
cctccggccattctttcagtgtctg

SEQ ID NO: 905964 - DNA, 25 bp, Mus musculus
cctccggccattgtttcagtgtctg

SEQ ID NO: 905965 - DNA, 25 bp, Mus musculus
cctccgtcatgacgcaacttcggca

SEQ ID NO: 905966 - DNA, 25 bp, Mus musculus
cctccgtcatgaggcaacttcggca

SEQ ID NO: 905967 - DNA, 25 bp, Mus musculus
cctccgtcccccacacacctgctct

SEQ ID NO: 905968 - DNA, 25 bp, Mus musculus
cctccgtccccctcacacctgctct

SEQ ID NO: 905969 - DNA, 25 bp, Mus musculus
cctccgtgctggcggcagaatcctt

SEQ ID NO: 905970 - DNA, 25 bp, Mus musculus
cctccgtgctgggggcagaatcctt

SEQ ID NO: 905971 - DNA, 25 bp, Mus musculus
cctcctaaagatactggcattgctc

SEQ ID NO: 905972 - DNA, 25 bp, Mus musculus
cctcctaaagattctggcattgctc

SEQ ID NO: 905973 - DNA, 25 bp, Mus musculus
cctcctaaggaacgctcagagaaat

SEQ ID NO: 905974 - DNA, 25 bp, Mus musculus
cctcctaaggaaggctcagagaaat

SEQ ID NO: 905975 - DNA, 25 bp, Mus musculus
cctcctaattcccaccaggtctctg

SEQ ID NO: 905976 - DNA, 25 bp, Mus musculus
cctcctaattcccacgtctctgggg

SEQ ID NO: 905977 - DNA, 25 bp, Mus musculus
cctcctaattcccagcaggtctctg

SEQ ID NO: 905978 - DNA, 25 bp, Mus musculus
cctcctaattcccaggtctctgggg

SEQ ID NO: 905979 - DNA, 25 bp, Mus musculus
cctcctacagcagcgggagaagatc

SEQ ID NO: 905980 - DNA, 25 bp, Mus musculus
cctcctacagcatccgattggcagg

SEQ ID NO: 905981 - DNA, 25 bp, Mus musculus
cctcctacaggagcgggagaagatc

SEQ ID NO: 905982 - DNA, 25 bp, Mus musculus
cctcctacaggatccgattggcagg

SEQ ID NO: 905983 - DNA, 25 bp, Mus musculus
cctcctcaagcaccagccatggtgg

SEQ ID NO: 905984 - DNA, 25 bp, Mus musculus
cctcctcaagcacctgccatggtgg

SEQ ID NO: 905985 - DNA, 25 bp, Mus musculus
cctcctcaagctaaagaacgcttct

SEQ ID NO: 905986 - DNA, 25 bp, Mus musculus
cctcctcaagctcaaggacttcgag

SEQ ID NO: 905987 - DNA, 25 bp, Mus musculus
cctcctcaagctgaaggacttcgag

SEQ ID NO: 905988 - DNA, 25 bp, Mus musculus
cctcctcaaggtaaagaacgcttct

SEQ ID NO: 905989 - DNA, 25 bp, Mus musculus
cctcctcagtgacgtgatgactccg

SEQ ID NO: 905990 - DNA, 25 bp, Mus musculus
cctcctcagtgaggtgatgactccg

SEQ ID NO: 905991 - DNA, 25 bp, Mus musculus
cctcctcatccacggtcaaagttgt

SEQ ID NO: 905992 - DNA, 25 bp, Mus musculus
cctcctcatccagggtcaaagttgt

SEQ ID NO: 905993 - DNA, 25 bp, Mus musculus
cctcctccagctatgatgggcccac

SEQ ID NO: 905994 - DNA, 25 bp, Mus musculus
cctcctccaggtatgatgggcccac

SEQ ID NO: 905995 - DNA, 25 bp, Mus musculus
cctcctcccaaagaaactggcattg

SEQ ID NO: 905996 - DNA, 25 bp, Mus musculus
cctcctcccaaagatactggcattg

SEQ ID NO: 905997 - DNA, 25 bp, Mus musculus
cctcctccgaggcggatgtgctaag

SEQ ID NO: 905998 - DNA, 25 bp, Mus musculus
cctcctccgagggggatgtgctaag

SEQ ID NO: 905999 - DNA, 25 bp, Mus musculus
cctcctcgaatgataatctggaggc

SEQ ID NO: 906000 - DNA, 25 bp, Mus musculus
cctcctcgaatgttaatctggaggc

SEQ ID NO: 906001 - DNA, 25 bp, Mus musculus
cctcctcggcctcacgtttgaagct

SEQ ID NO: 906002 - DNA, 25 bp, Mus musculus
cctcctcggcctcaggtttgaagct

SEQ ID NO: 906003 - DNA, 25 bp, Mus musculus
cctcctctctagactcggcataatc

SEQ ID NO: 906004 - DNA, 25 bp, Mus musculus
cctcctctcttgactcggcataatc

SEQ ID NO: 906005 - DNA, 25 bp, Mus musculus
cctcctctgcagatgttgacctcct

SEQ ID NO: 906006 - DNA, 25 bp, Mus musculus
cctcctctgcagttgttgacctcct

SEQ ID NO: 906007 - DNA, 25 bp, Mus musculus
cctcctctggctcgtaaattgcttg

SEQ ID NO: 906008 - DNA, 25 bp, Mus musculus
cctcctctggctggtaaattgcttg

SEQ ID NO: 906009 - DNA, 25 bp, Mus musculus
cctcctctttgacggcgagaccaac

SEQ ID NO: 906010 - DNA, 25 bp, Mus musculus
cctcctctttgagggcgagaccaac

SEQ ID NO: 906011 - DNA, 25 bp, Mus musculus
cctcctgaccagctcaccagctcag

SEQ ID NO: 906012 - DNA, 25 bp, Mus musculus
cctcctgaccaggtcaccagctcag

SEQ ID NO: 906013 - DNA, 25 bp, Mus musculus
cctcctgagacacggttgtgagccc

SEQ ID NO: 906014 - DNA, 25 bp, Mus musculus
cctcctgagacagggttgtgagccc

SEQ ID NO: 906015 - DNA, 25 bp, Mus musculus
cctcctgcccagctttgcacaccct

SEQ ID NO: 906016 - DNA, 25 bp, Mus musculus
cctcctgcccaggtttgcacaccct

SEQ ID NO: 906017 - DNA, 25 bp, Mus musculus
cctcctgctccactgactttccagc

SEQ ID NO: 906018 - DNA, 25 bp, Mus musculus
cctcctgctccagtgactttccagc

SEQ ID NO: 906019 - DNA, 25 bp, Mus musculus
cctcctgctgtgaagtgggctagtg

SEQ ID NO: 906020 - DNA, 25 bp, Mus musculus
cctcctgctgtgtagtgggctagtg

SEQ ID NO: 906021 - DNA, 25 bp, Mus musculus
cctcctggagaacgcaccagcagtc

SEQ ID NO: 906022 - DNA, 25 bp, Mus musculus
cctcctggagaaggcaccagcagtc

SEQ ID NO: 906023 - DNA, 25 bp, Mus musculus
cctcctggagttcccggaaaggcag

SEQ ID NO: 906024 - DNA, 25 bp, Mus musculus
cctcctggagttccgggaaaggcag

SEQ ID NO: 906025 - DNA, 25 bp, Mus musculus
cctcctggccaggtggccattgaag

SEQ ID NO: 906026 - DNA, 25 bp, Mus musculus
cctcctggccccaacgtggccattg

SEQ ID NO: 906027 - DNA, 25 bp, Mus musculus
cctcctggccccaaggtggccattg

SEQ ID NO: 906028 - DNA, 25 bp, Mus musculus
cctcctggcctggtggccattgaag

SEQ ID NO: 906029 - DNA, 25 bp, Mus musculus
cctcctggcttgcatcttgtctaca

SEQ ID NO: 906030 - DNA, 25 bp, Mus musculus
cctcctggcttggatcttgtctaca

SEQ ID NO: 906031 - DNA, 25 bp, Mus musculus
cctcctgtccagcaaatctcccagc

SEQ ID NO: 906032 - DNA, 25 bp, Mus musculus
cctcctgtccaggaaatctcccagc

SEQ ID NO: 906033 - DNA, 25 bp, Mus musculus
cctcctgtgcccacaagcctcccct

SEQ ID NO: 906034 - DNA, 25 bp, Mus musculus
cctcctgtgcccactagcctcccct

SEQ ID NO: 906035 - DNA, 25 bp, Mus musculus
cctccttagcaacgtcaacaacagt

SEQ ID NO: 906036 - DNA, 25 bp, Mus musculus
cctccttagcaaggtcaacaacagt

SEQ ID NO: 906037 - DNA, 25 bp, Mus musculus
cctccttcagatgacggattccacc

SEQ ID NO: 906038 - DNA, 25 bp, Mus musculus
cctccttcagccctcaggcttgggg

SEQ ID NO: 906039 - DNA, 25 bp, Mus musculus
cctccttcaggcctcaggcttgggg

SEQ ID NO: 906040 - DNA, 25 bp, Mus musculus
cctccttcagttgacggattccacc

SEQ ID NO: 906041 - DNA, 25 bp, Mus musculus
cctccttccaaccaaatgttgccag

SEQ ID NO: 906042 - DNA, 25 bp, Mus musculus
cctccttccatccaaatgttgccag

SEQ ID NO: 906043 - DNA, 25 bp, Mus musculus
cctccttcctcaagagtaaaggtat

SEQ ID NO: 906044 - DNA, 25 bp, Mus musculus
cctccttcctgaagagtaaaggtat

SEQ ID NO: 906045 - DNA, 25 bp, Mus musculus
cctccttggctgccagcacagactc

SEQ ID NO: 906046 - DNA, 25 bp, Mus musculus
cctccttggctgcgaaaatgaccca

SEQ ID NO: 906047 - DNA, 25 bp, Mus musculus
cctccttggctgcgggaagaacagt

SEQ ID NO: 906048 - DNA, 25 bp, Mus musculus
cctccttggctggcagcacagactc

SEQ ID NO: 906049 - DNA, 25 bp, Mus musculus
cctccttggctgggaaaatgaccca

SEQ ID NO: 906050 - DNA, 25 bp, Mus musculus
cctccttggctgggggaagaacagt

SEQ ID NO: 906051 - DNA, 25 bp, Mus musculus
cctcctttcaccaacctccatgtgt

SEQ ID NO: 906052 - DNA, 25 bp, Mus musculus
cctcctttcaccaagctccatgtgt

SEQ ID NO: 906053 - DNA, 25 bp, Mus musculus
cctcctttcgcttcaagcacaaatg

SEQ ID NO: 906054 - DNA, 25 bp, Mus musculus
cctcctttcggttcaagcacaaatg

SEQ ID NO: 906055 - DNA, 25 bp, Mus musculus
cctcgacagtggctcttccagccac

SEQ ID NO: 906056 - DNA, 25 bp, Mus musculus
cctcgacagtgggtcttccagccac

SEQ ID NO: 906057 - DNA, 25 bp, Mus musculus
cctcgacccatcagactgtttacag

SEQ ID NO: 906058 - DNA, 25 bp, Mus musculus
cctcgacccatctgactgtttacag

SEQ ID NO: 906059 - DNA, 25 bp, Mus musculus
cctcgacttaagagacagtatcatg

SEQ ID NO: 906060 - DNA, 25 bp, Mus musculus
cctcgacttaagtgacagtatcatg

SEQ ID NO: 906061 - DNA, 25 bp, Mus musculus
cctcgacttagtgccgctgtgtgga

SEQ ID NO: 906062 - DNA, 25 bp, Mus musculus
cctcgacttagtgcggctgtgtgga

SEQ ID NO: 906063 - DNA, 25 bp, Mus musculus
cctcgagagccgactattcagtgtg

SEQ ID NO: 906064 - DNA, 25 bp, Mus musculus
cctcgagagccgtctattcagtgtg

SEQ ID NO: 906065 - DNA, 25 bp, Mus musculus
cctcgagttaagcccacagcttttt

SEQ ID NO: 906066 - DNA, 25 bp, Mus musculus
cctcgagttaaggccacagcttttt

SEQ ID NO: 906067 - DNA, 25 bp, Mus musculus
cctcgcaaattacgtccacagcaaa

SEQ ID NO: 906068 - DNA, 25 bp, Mus musculus
cctcgcaaattaggtccacagcaaa

SEQ ID NO: 906069 - DNA, 25 bp, Mus musculus
cctcgcacagaggaagtatggcgtg

SEQ ID NO: 906070 - DNA, 25 bp, Mus musculus
cctcgcacagtggaagtatggcgtg

SEQ ID NO: 906071 - DNA, 25 bp, Mus musculus
cctcgcagagattcagagatggaga

SEQ ID NO: 906072 - DNA, 25 bp, Mus musculus
cctcgcagagtttcagagatggaga

SEQ ID NO: 906073 - DNA, 25 bp, Mus musculus
cctcgccaagagttcctccagcaga

SEQ ID NO: 906074 - DNA, 25 bp, Mus musculus
cctcgccaagctatgtggaccgagt

SEQ ID NO: 906075 - DNA, 25 bp, Mus musculus
cctcgccaaggtatgtggaccgagt

SEQ ID NO: 906076 - DNA, 25 bp, Mus musculus
cctcgccaagtgttcctccagcaga

SEQ ID NO: 906077 - DNA, 25 bp, Mus musculus
cctcgccatgaacaagcccattgga

SEQ ID NO: 906078 - DNA, 25 bp, Mus musculus
cctcgccatgaagaagcccattgga

SEQ ID NO: 906079 - DNA, 25 bp, Mus musculus
cctcgccatgcctgaccagctgact

SEQ ID NO: 906080 - DNA, 25 bp, Mus musculus
cctcgccatggctgaccagctgact

SEQ ID NO: 906081 - DNA, 25 bp, Mus musculus
cctcgccctccctgagtcttggcat

SEQ ID NO: 906082 - DNA, 25 bp, Mus musculus
cctcgccctccctgtgtcttggcat

SEQ ID NO: 906083 - DNA, 25 bp, Mus musculus
cctcgccctctcaacctcagccttt

SEQ ID NO: 906084 - DNA, 25 bp, Mus musculus
cctcgccctctcaagctcagccttt

SEQ ID NO: 906085 - DNA, 25 bp, Mus musculus
cctcgcctgttgaacgtttaccagg

SEQ ID NO: 906086 - DNA, 25 bp, Mus musculus
cctcgcctgttgaaggtttaccagg

SEQ ID NO: 906087 - DNA, 25 bp, Mus musculus
cctcgccttcagcacaggtgcagca

SEQ ID NO: 906088 - DNA, 25 bp, Mus musculus
cctcgccttcagctgcagcagtgaa

SEQ ID NO: 906089 - DNA, 25 bp, Mus musculus
cctcgccttcaggacaggtgcagca

SEQ ID NO: 906090 - DNA, 25 bp, Mus musculus
cctcgccttcaggtgcagcagtgaa

SEQ ID NO: 906091 - DNA, 25 bp, Mus musculus
cctcgcgtagagagaggccatcgcg

SEQ ID NO: 906092 - DNA, 25 bp, Mus musculus
cctcgcgtagtgagaggccatcgcg

SEQ ID NO: 906093 - DNA, 25 bp, Mus musculus
cctcgctatttgcaccaccacatta

SEQ ID NO: 906094 - DNA, 25 bp, Mus musculus
cctcgctatttgcagcaccacatta

SEQ ID NO: 906095 - DNA, 25 bp, Mus musculus
cctcggagcgaccgcgtcatgtagg

SEQ ID NO: 906096 - DNA, 25 bp, Mus musculus
cctcggagcgaccgggtcatgtagg

SEQ ID NO: 906097 - DNA, 25 bp, Mus musculus
cctcggatctttcacggatactcct

SEQ ID NO: 906098 - DNA, 25 bp, Mus musculus
cctcggatctttcagggatactcct

SEQ ID NO: 906099 - DNA, 25 bp, Mus musculus
cctcggcaacaacacgctgccgtcc

SEQ ID NO: 906100 - DNA, 25 bp, Mus musculus
cctcggcaacaagacgctgccgtcc

SEQ ID NO: 906101 - DNA, 25 bp, Mus musculus
cctcggcccgggccagcagggcggg

SEQ ID NO: 906102 - DNA, 25 bp, Mus musculus
cctcggcccggggcagcagggcggg

SEQ ID NO: 906103 - DNA, 25 bp, Mus musculus
cctcggcctcagctttgaagctggc

SEQ ID NO: 906104 - DNA, 25 bp, Mus musculus
cctcggcctcaggtttgaagctggc

SEQ ID NO: 906105 - DNA, 25 bp, Mus musculus
cctcggcctggcacatgccctggtg

SEQ ID NO: 906106 - DNA, 25 bp, Mus musculus
cctcggcctggcacttgccctggtg

SEQ ID NO: 906107 - DNA, 25 bp, Mus musculus
cctcggctcacacatggctgccagc

SEQ ID NO: 906108 - DNA, 25 bp, Mus musculus
cctcggctcacacgcagaagacttt

SEQ ID NO: 906109 - DNA, 25 bp, Mus musculus
cctcggctcacagatggctgccagc

SEQ ID NO: 906110 - DNA, 25 bp, Mus musculus
cctcggctcacaggcagaagacttt

SEQ ID NO: 906111 - DNA, 25 bp, Mus musculus
cctcgggactcagcctgatgtaaac

SEQ ID NO: 906112 - DNA, 25 bp, Mus musculus
cctcgggactgagcctgatgtaaac

SEQ ID NO: 906113 - DNA, 25 bp, Mus musculus
cctcgggggactcgcaatgtttgcc

SEQ ID NO: 906114 - DNA, 25 bp, Mus musculus
cctcgggggactcgccatgtttgcc

SEQ ID NO: 906115 - DNA, 25 bp, Mus musculus
cctcgggggactggcaatgtttgcc

SEQ ID NO: 906116 - DNA, 25 bp, Mus musculus
cctcgggggactggccatgtttgcc

SEQ ID NO: 906117 - DNA, 25 bp, Mus musculus
cctcggtcacagctatcatggctgg

SEQ ID NO: 906118 - DNA, 25 bp, Mus musculus
cctcggtcacaggtatcatggctgg

SEQ ID NO: 906119 - DNA, 25 bp, Mus musculus
cctcggtgctggtgcgggaagaact

SEQ ID NO: 906120 - DNA, 25 bp, Mus musculus
cctcggtgctggtgggggaagaact

SEQ ID NO: 906121 - DNA, 25 bp, Mus musculus
cctcggtggctcagcaggtgggttt

SEQ ID NO: 906122 - DNA, 25 bp, Mus musculus
cctcggtggctcaggaggtgggttt

SEQ ID NO: 906123 - DNA, 25 bp, Mus musculus
cctcgtactcagaaacgaaagctgc

SEQ ID NO: 906124 - DNA, 25 bp, Mus musculus
cctcgtactcagtaacgaaagctgc

SEQ ID NO: 906125 - DNA, 25 bp, Mus musculus
cctcgtcaccagaactataatcaag

SEQ ID NO: 906126 - DNA, 25 bp, Mus musculus
cctcgtcaccagtactataatcaag

SEQ ID NO: 906127 - DNA, 25 bp, Mus musculus
cctcgtctatcactcttgtctgtat

SEQ ID NO: 906128 - DNA, 25 bp, Mus musculus
cctcgtctatcagtcttgtctgtat

SEQ ID NO: 906129 - DNA, 25 bp, Mus musculus
cctcgtggacttgtcgggccccctg

SEQ ID NO: 906130 - DNA, 25 bp, Mus musculus
cctcgtggacttgtggggccccctg

SEQ ID NO: 906131 - DNA, 25 bp, Mus musculus
cctcgtggcctgcaaaatatgattc

SEQ ID NO: 906132 - DNA, 25 bp, Mus musculus
cctcgtggcctggaaaatatgattc

SEQ ID NO: 906133 - DNA, 25 bp, Mus musculus
cctcgtgtgcggagcacgatctgat

SEQ ID NO: 906134 - DNA, 25 bp, Mus musculus
cctcgtgtgcggattcctttgtttc

SEQ ID NO: 906135 - DNA, 25 bp, Mus musculus
cctcgtgtgcggtgcacgatctgat

SEQ ID NO: 906136 - DNA, 25 bp, Mus musculus
cctcgtgtgcggtttcctttgtttc

SEQ ID NO: 906137 - DNA, 25 bp, Mus musculus
cctcgttgcccagaacctgtgggcc

SEQ ID NO: 906138 - DNA, 25 bp, Mus musculus
cctcgttgcccagatcctgtgggcc

SEQ ID NO: 906139 - DNA, 25 bp, Mus musculus
cctctaaaacagagcctccccacta

SEQ ID NO: 906140 - DNA, 25 bp, Mus musculus
cctctaaaacagtgcctccccacta

SEQ ID NO: 906141 - DNA, 25 bp, Mus musculus
cctctaaacaagacgggccgcattg

SEQ ID NO: 906142 - DNA, 25 bp, Mus musculus
cctctaaacaagtcgggccgcattg

SEQ ID NO: 906143 - DNA, 25 bp, Mus musculus
cctctaaagacccgaaagcactgcc

SEQ ID NO: 906144 - DNA, 25 bp, Mus musculus
cctctaaagaccggaaagcactgcc

SEQ ID NO: 906145 - DNA, 25 bp, Mus musculus
cctctaacagagctaccttaatgga

SEQ ID NO: 906146 - DNA, 25 bp, Mus musculus
cctctaacagaggtaccttaatgga

SEQ ID NO: 906147 - DNA, 25 bp, Mus musculus
cctctaacagctaccagctccaggc

SEQ ID NO: 906148 - DNA, 25 bp, Mus musculus
cctctaacaggtaccagctccaggc

SEQ ID NO: 906149 - DNA, 25 bp, Mus musculus
cctctaacatcacacattgctgaaa

SEQ ID NO: 906150 - DNA, 25 bp, Mus musculus
cctctaacatcacagattgctgaaa

SEQ ID NO: 906151 - DNA, 25 bp, Mus musculus
cctctaagcttacacgagtgccagg

SEQ ID NO: 906152 - DNA, 25 bp, Mus musculus
cctctaagcttacaggagtgccagg

SEQ ID NO: 906153 - DNA, 25 bp, Mus musculus
cctctacaagagacatcttgaaagc

SEQ ID NO: 906154 - DNA, 25 bp, Mus musculus
cctctacaagctcggcttcttcaaa

SEQ ID NO: 906155 - DNA, 25 bp, Mus musculus
cctctacaaggtcggcttcttcaaa

SEQ ID NO: 906156 - DNA, 25 bp, Mus musculus
cctctacaagtgacatcttgaaagc

SEQ ID NO: 906157 - DNA, 25 bp, Mus musculus
cctctacagaagcctgaggagctat

SEQ ID NO: 906158 - DNA, 25 bp, Mus musculus
cctctacagaaggctgaggagctat

SEQ ID NO: 906159 - DNA, 25 bp, Mus musculus
cctctacagatgctgatggaacttg

SEQ ID NO: 906160 - DNA, 25 bp, Mus musculus
cctctacagatggtgatggaacttg

SEQ ID NO: 906161 - DNA, 25 bp, Mus musculus
cctctaccagcacgcttccccacca

SEQ ID NO: 906162 - DNA, 25 bp, Mus musculus
cctctaccagcaggcttccccacca

SEQ ID NO: 906163 - DNA, 25 bp, Mus musculus
cctctaccagctctacaaagcgcct

SEQ ID NO: 906164 - DNA, 25 bp, Mus musculus
cctctaccagcttccaccacagcct

SEQ ID NO: 906165 - DNA, 25 bp, Mus musculus
cctctaccaggtctacaaagcgcct

SEQ ID NO: 906166 - DNA, 25 bp, Mus musculus
cctctaccaggttccaccacagcct

SEQ ID NO: 906167 - DNA, 25 bp, Mus musculus
cctctaccctcaaccagcaagcctg

SEQ ID NO: 906168 - DNA, 25 bp, Mus musculus
cctctaccctcatccagcaagcctg

SEQ ID NO: 906169 - DNA, 25 bp, Mus musculus
cctctaccggacacacctgctctca

SEQ ID NO: 906170 - DNA, 25 bp, Mus musculus
cctctaccggtcacacctgctctca

SEQ ID NO: 906171 - DNA, 25 bp, Mus musculus
cctctacctcgcagagaggccatcg

SEQ ID NO: 906172 - DNA, 25 bp, Mus musculus
cctctacctcgctgagaggccatcg

SEQ ID NO: 906173 - DNA, 25 bp, Mus musculus
cctctacgccgacggctgtgaggct

SEQ ID NO: 906174 - DNA, 25 bp, Mus musculus
cctctacgccgagggctgtgaggct

SEQ ID NO: 906175 - DNA, 25 bp, Mus musculus
cctctacggagacacattctatgaa

SEQ ID NO: 906176 - DNA, 25 bp, Mus musculus
cctctacggagacagattctatgaa

SEQ ID NO: 906177 - DNA, 25 bp, Mus musculus
cctctactcctgcacactggcataa

SEQ ID NO: 906178 - DNA, 25 bp, Mus musculus
cctctactcctgcagactggcataa

SEQ ID NO: 906179 - DNA, 25 bp, Mus musculus
cctctacttcaacaagagaacaatg

SEQ ID NO: 906180 - DNA, 25 bp, Mus musculus
cctctacttcaagaagagaacaatg

SEQ ID NO: 906181 - DNA, 25 bp, Mus musculus
cctctataccatgacgctcaccatc

SEQ ID NO: 906182 - DNA, 25 bp, Mus musculus
cctctataccatgaggctcaccatc

SEQ ID NO: 906183 - DNA, 25 bp, Mus musculus
cctctatagcagctatggaggaggg

SEQ ID NO: 906184 - DNA, 25 bp, Mus musculus
cctctatagcaggtatggaggaggg

SEQ ID NO: 906185 - DNA, 25 bp, Mus musculus
cctctatcagactcgacacaataca

SEQ ID NO: 906186 - DNA, 25 bp, Mus musculus
cctctatcagctttggcatcggccg

SEQ ID NO: 906187 - DNA, 25 bp, Mus musculus
cctctatcaggtttggcatcggccg

SEQ ID NO: 906188 - DNA, 25 bp, Mus musculus
cctctatcagtctcgacacaataca

SEQ ID NO: 906189 - DNA, 25 bp, Mus musculus
cctctatgggtcccgggtctactct

SEQ ID NO: 906190 - DNA, 25 bp, Mus musculus
cctctatgggtccgttccgggagcg

SEQ ID NO: 906191 - DNA, 25 bp, Mus musculus
cctctatgggtcgcgggtctactct

SEQ ID NO: 906192 - DNA, 25 bp, Mus musculus
cctctatgggtcggttccgggagcg

SEQ ID NO: 906193 - DNA, 25 bp, Mus musculus
cctctatttaagaacagaaggtggc

SEQ ID NO: 906194 - DNA, 25 bp, Mus musculus
cctctatttaagaacatgaaaccag

SEQ ID NO: 906195 - DNA, 25 bp, Mus musculus
cctctatttaagaagagaaggtggc

SEQ ID NO: 906196 - DNA, 25 bp, Mus musculus
cctctatttaagaagatgaaaccag

SEQ ID NO: 906197 - DNA, 25 bp, Mus musculus
cctctcaaagcacagtgaacttttg

SEQ ID NO: 906198 - DNA, 25 bp, Mus musculus
cctctcaaaggacagtgaacttttg

SEQ ID NO: 906199 - DNA, 25 bp, Mus musculus
cctctcaactggctcatgcttgact

SEQ ID NO: 906200 - DNA, 25 bp, Mus musculus
cctctcaactggctgatgcttgact

SEQ ID NO: 906201 - DNA, 25 bp, Mus musculus
cctctcaagaaacatgcgccaggag

SEQ ID NO: 906202 - DNA, 25 bp, Mus musculus
cctctcaagaaacgacagatcgtta

SEQ ID NO: 906203 - DNA, 25 bp, Mus musculus
cctctcaagaaagatgcgccaggag

SEQ ID NO: 906204 - DNA, 25 bp, Mus musculus
cctctcaagaaaggacagatcgtta

SEQ ID NO: 906205 - DNA, 25 bp, Mus musculus
cctctcaagcctgccgacttgactg

SEQ ID NO: 906206 - DNA, 25 bp, Mus musculus
cctctcaagcctgcggacttgactg

SEQ ID NO: 906207 - DNA, 25 bp, Mus musculus
cctctcaaggatagacattagcttt

SEQ ID NO: 906208 - DNA, 25 bp, Mus musculus
cctctcaaggttagacattagcttt

SEQ ID NO: 906209 - DNA, 25 bp, Mus musculus
cctctcaatgaattcctggaggaga

SEQ ID NO: 906210 - DNA, 25 bp, Mus musculus
cctctcaatgtattcctggaggaga

SEQ ID NO: 906211 - DNA, 25 bp, Mus musculus
cctctcaatttcactcaagagtttc

SEQ ID NO: 906212 - DNA, 25 bp, Mus musculus
cctctcaatttctctcaagagtttc

SEQ ID NO: 906213 - DNA, 25 bp, Mus musculus
cctctcaccgccctgcccaggagtt

SEQ ID NO: 906214 - DNA, 25 bp, Mus musculus
cctctcaccgccgtgcccaggagtt

SEQ ID NO: 906215 - DNA, 25 bp, Mus musculus
cctctcatccagctcagattgtcaa

SEQ ID NO: 906216 - DNA, 25 bp, Mus musculus
cctctcatccaggtcagattgtcaa

SEQ ID NO: 906217 - DNA, 25 bp, Mus musculus
cctctcatctcccacttcttcgcca

SEQ ID NO: 906218 - DNA, 25 bp, Mus musculus
cctctcatctccgacttcttcgcca

SEQ ID NO: 906219 - DNA, 25 bp, Mus musculus
cctctcatggcggttggggtgattg

SEQ ID NO: 906220 - DNA, 25 bp, Mus musculus
cctctcatgggggttggggtgattg

SEQ ID NO: 906221 - DNA, 25 bp, Mus musculus
cctctccaagacatataacaccaac

SEQ ID NO: 906222 - DNA, 25 bp, Mus musculus
cctctccaagagcttgtatgtctgc

SEQ ID NO: 906223 - DNA, 25 bp, Mus musculus
cctctccaagtcatataacaccaac

SEQ ID NO: 906224 - DNA, 25 bp, Mus musculus
cctctccaagtgcttgtatgtctgc

SEQ ID NO: 906225 - DNA, 25 bp, Mus musculus
cctctccatcggatacagtagcgta

SEQ ID NO: 906226 - DNA, 25 bp, Mus musculus
cctctccatcggttacagtagcgta

SEQ ID NO: 906227 - DNA, 25 bp, Mus musculus
cctctcccaccaacccaaatttatt

SEQ ID NO: 906228 - DNA, 25 bp, Mus musculus
cctctcccaccaagaaacaaaagga

SEQ ID NO: 906229 - DNA, 25 bp, Mus musculus
cctctcccaccatcccaaatttatt

SEQ ID NO: 906230 - DNA, 25 bp, Mus musculus
cctctcccaccatgaaacaaaagga

SEQ ID NO: 906231 - DNA, 25 bp, Mus musculus
cctctccgtacacatcttcgtccct

SEQ ID NO: 906232 - DNA, 25 bp, Mus musculus
cctctccgtacaccgccatggctac

SEQ ID NO: 906233 - DNA, 25 bp, Mus musculus
cctctccgtacagatcttcgtccct

SEQ ID NO: 906234 - DNA, 25 bp, Mus musculus
cctctccgtacagcgccatggctac

SEQ ID NO: 906235 - DNA, 25 bp, Mus musculus
cctctcctgaaaccgctgagaagca

SEQ ID NO: 906236 - DNA, 25 bp, Mus musculus
cctctcctgaaagcgctgagaagca

SEQ ID NO: 906237 - DNA, 25 bp, Mus musculus
cctctccttagtcgcgtgagtcacg

SEQ ID NO: 906238 - DNA, 25 bp, Mus musculus
cctctccttagtggcgtgagtcacg

SEQ ID NO: 906239 - DNA, 25 bp, Mus musculus
cctctcctttccacctcgtggctga

SEQ ID NO: 906240 - DNA, 25 bp, Mus musculus
cctctcctttccacgtcgtggctga

SEQ ID NO: 906241 - DNA, 25 bp, Mus musculus
cctctcgcagaaatagtagacgtcg

SEQ ID NO: 906242 - DNA, 25 bp, Mus musculus
cctctcgcagtaatagtagacgtcg

SEQ ID NO: 906243 - DNA, 25 bp, Mus musculus
cctctcggtgccacagatgagcggc

SEQ ID NO: 906244 - DNA, 25 bp, Mus musculus
cctctcggtgccactgatgagcggc

SEQ ID NO: 906245 - DNA, 25 bp, Mus musculus
cctctctatgctgtcgtttgccact

SEQ ID NO: 906246 - DNA, 25 bp, Mus musculus
cctctctatgctgtggtttgccact

SEQ ID NO: 906247 - DNA, 25 bp, Mus musculus
cctctctcagcttgtacggcgcagg

SEQ ID NO: 906248 - DNA, 25 bp, Mus musculus
cctctctcaggttgtacggcgcagg

SEQ ID NO: 906249 - DNA, 25 bp, Mus musculus
cctctctcatgctacttcagcaatc

SEQ ID NO: 906250 - DNA, 25 bp, Mus musculus
cctctctcatgctagttcagcaatc

SEQ ID NO: 906251 - DNA, 25 bp, Mus musculus
cctctctccaggaccgcacaaaagg

SEQ ID NO: 906252 - DNA, 25 bp, Mus musculus
cctctctccaggacggcacaaaagg

SEQ ID NO: 906253 - DNA, 25 bp, Mus musculus
cctctctgatattacggaggtgccc

SEQ ID NO: 906254 - DNA, 25 bp, Mus musculus
cctctctgatattagggaggtgccc

SEQ ID NO: 906255 - DNA, 25 bp, Mus musculus
cctctctgcctgttattgagccacg

SEQ ID NO: 906256 - DNA, 25 bp, Mus musculus
cctctctgcctgtttttgagccacg

SEQ ID NO: 906257 - DNA, 25 bp, Mus musculus
cctctctgctgccgtcatgtaggaa

SEQ ID NO: 906258 - DNA, 25 bp, Mus musculus
cctctctgctgcggtcatgtaggaa

SEQ ID NO: 906259 - DNA, 25 bp, Mus musculus
cctctctgctggcggcagctcacag

SEQ ID NO: 906260 - DNA, 25 bp, Mus musculus
cctctctgctgggggcagctcacag

SEQ ID NO: 906261 - DNA, 25 bp, Mus musculus
cctctctggaagagttcaagatttt

SEQ ID NO: 906262 - DNA, 25 bp, Mus musculus
cctctctggaagtgttcaagatttt

SEQ ID NO: 906263 - DNA, 25 bp, Mus musculus
cctctctggcagaacccctgtgatg

SEQ ID NO: 906264 - DNA, 25 bp, Mus musculus
cctctctggcagtacccctgtgatg

SEQ ID NO: 906265 - DNA, 25 bp, Mus musculus
cctctcttggacaaactacaactcc

SEQ ID NO: 906266 - DNA, 25 bp, Mus musculus
cctctcttggaggtgcaattgaaac

SEQ ID NO: 906267 - DNA, 25 bp, Mus musculus
cctctcttggtcaaactacaactcc

SEQ ID NO: 906268 - DNA, 25 bp, Mus musculus
cctctcttggtggtgcaattgaaac

SEQ ID NO: 906269 - DNA, 25 bp, Mus musculus
cctctgaaactgtaccttctttgtt

SEQ ID NO: 906270 - DNA, 25 bp, Mus musculus
cctctgaaactgtagcttctttgtt

SEQ ID NO: 906271 - DNA, 25 bp, Mus musculus
cctctgaaagctggttccatggtca

SEQ ID NO: 906272 - DNA, 25 bp, Mus musculus
cctctgaaaggtggttccatggtca

SEQ ID NO: 906273 - DNA, 25 bp, Mus musculus
cctctgacagactcatctttggact

SEQ ID NO: 906274 - DNA, 25 bp, Mus musculus
cctctgacagtctcatctttggact

SEQ ID NO: 906275 - DNA, 25 bp, Mus musculus
cctctgagctgcaacataagcagac

SEQ ID NO: 906276 - DNA, 25 bp, Mus musculus
cctctgagctgcaacgaactcatta

SEQ ID NO: 906277 - DNA, 25 bp, Mus musculus
cctctgagctgcaagataagcagac

SEQ ID NO: 906278 - DNA, 25 bp, Mus musculus
cctctgagctgcaaggaactcatta

SEQ ID NO: 906279 - DNA, 25 bp, Mus musculus
cctctgataaagccaactgttggat

SEQ ID NO: 906280 - DNA, 25 bp, Mus musculus
cctctgataaaggcaactgttggat

SEQ ID NO: 906281 - DNA, 25 bp, Mus musculus
cctctgatacagcgcggagttcaga

SEQ ID NO: 906282 - DNA, 25 bp, Mus musculus
cctctgatacagggcggagttcaga

SEQ ID NO: 906283 - DNA, 25 bp, Mus musculus
cctctgcaaatggccaaagtcctag

SEQ ID NO: 906284 - DNA, 25 bp, Mus musculus
cctctgcaaatggcgaaagtcctag

SEQ ID NO: 906285 - DNA, 25 bp, Mus musculus
cctctgcagatgattgtgaacactt

SEQ ID NO: 906286 - DNA, 25 bp, Mus musculus
cctctgcagatgtttgtgaacactt

SEQ ID NO: 906287 - DNA, 25 bp, Mus musculus
cctctgcatgccccagagtggccat

SEQ ID NO: 906288 - DNA, 25 bp, Mus musculus
cctctgcatgccgcagagtggccat

SEQ ID NO: 906289 - DNA, 25 bp, Mus musculus
cctctgccagcaacagattggctgg

SEQ ID NO: 906290 - DNA, 25 bp, Mus musculus
cctctgccaggaacagattggctgg

SEQ ID NO: 906291 - DNA, 25 bp, Mus musculus
cctctgcccgatcatcattggccgt

SEQ ID NO: 906292 - DNA, 25 bp, Mus musculus
cctctgcccgatgatcattggccgt

SEQ ID NO: 906293 - DNA, 25 bp, Mus musculus
cctctgccgcccgaccagttgcccc

SEQ ID NO: 906294 - DNA, 25 bp, Mus musculus
cctctgccgcccgagcagttgcccc

SEQ ID NO: 906295 - DNA, 25 bp, Mus musculus
cctctgcctgctcatttggctgtcc

SEQ ID NO: 906296 - DNA, 25 bp, Mus musculus
cctctgcctggtcatttggctgtcc

SEQ ID NO: 906297 - DNA, 25 bp, Mus musculus
cctctgcgaaccaaacacactgggt

SEQ ID NO: 906298 - DNA, 25 bp, Mus musculus
cctctgcgaaccaactgccagggga

SEQ ID NO: 906299 - DNA, 25 bp, Mus musculus
cctctgcgaacctaacacactgggt

SEQ ID NO: 906300 - DNA, 25 bp, Mus musculus
cctctgcgaacctactgccagggga

SEQ ID NO: 906301 - DNA, 25 bp, Mus musculus
cctctgcgcagacacgtgtcagctg

SEQ ID NO: 906302 - DNA, 25 bp, Mus musculus
cctctgcgcagacaggtgtcagctg

SEQ ID NO: 906303 - DNA, 25 bp, Mus musculus
cctctgctccaccgtaaccatgtgc

SEQ ID NO: 906304 - DNA, 25 bp, Mus musculus
cctctgctccacggtaaccatgtgc

SEQ ID NO: 906305 - DNA, 25 bp, Mus musculus
cctctgctctcaccaggccaagctc

SEQ ID NO: 906306 - DNA, 25 bp, Mus musculus
cctctgctctcacgccaagctcctt

SEQ ID NO: 906307 - DNA, 25 bp, Mus musculus
cctctgctctcagcaggccaagctc

SEQ ID NO: 906308 - DNA, 25 bp, Mus musculus
cctctgctctcaggccaagctcctt

SEQ ID NO: 906309 - DNA, 25 bp, Mus musculus
cctctggaacgtcgctgacgtggtt

SEQ ID NO: 906310 - DNA, 25 bp, Mus musculus
cctctggaacgtggctgacgtggtt

SEQ ID NO: 906311 - DNA, 25 bp, Mus musculus
cctctggagccgattcaaaaggtga

SEQ ID NO: 906312 - DNA, 25 bp, Mus musculus
cctctggagccgtttcaaaaggtga

SEQ ID NO: 906313 - DNA, 25 bp, Mus musculus
cctctggcaaaaagcgtgcccacac

SEQ ID NO: 906314 - DNA, 25 bp, Mus musculus
cctctggcaaaatgcgtgcccacac

SEQ ID NO: 906315 - DNA, 25 bp, Mus musculus
cctctggcagagcctgccccagttc

SEQ ID NO: 906316 - DNA, 25 bp, Mus musculus
cctctggcagtgcctgccccagttc

SEQ ID NO: 906317 - DNA, 25 bp, Mus musculus
cctctggccccacctcgaagctgga

SEQ ID NO: 906318 - DNA, 25 bp, Mus musculus
cctctggccccagctcgaagctgga

SEQ ID NO: 906319 - DNA, 25 bp, Mus musculus
cctctggctgcacgaattgttgggg

SEQ ID NO: 906320 - DNA, 25 bp, Mus musculus
cctctggctgcaggaattgttgggg

SEQ ID NO: 906321 - DNA, 25 bp, Mus musculus
cctctggctgctaaattgcttgata

SEQ ID NO: 906322 - DNA, 25 bp, Mus musculus
cctctggctggtaaattgcttgata

SEQ ID NO: 906323 - DNA, 25 bp, Mus musculus
cctctgggaaaacggtcaatgctag

SEQ ID NO: 906324 - DNA, 25 bp, Mus musculus
cctctgggaaaagggtcaatgctag

SEQ ID NO: 906325 - DNA, 25 bp, Mus musculus
cctctgggacaaacatcaccctgag

SEQ ID NO: 906326 - DNA, 25 bp, Mus musculus
cctctgggacaatcatcaccctgag

SEQ ID NO: 906327 - DNA, 25 bp, Mus musculus
cctctgggacatctgtaactacttg

SEQ ID NO: 906328 - DNA, 25 bp, Mus musculus
cctctgggacatgtgtaactacttg

SEQ ID NO: 906329 - DNA, 25 bp, Mus musculus
cctctgggtgtccacacgctgcggc

SEQ ID NO: 906330 - DNA, 25 bp, Mus musculus
cctctgggtgtccagacgctgcggc

SEQ ID NO: 906331 - DNA, 25 bp, Mus musculus
cctctgtaaagtcatggctgcagca

SEQ ID NO: 906332 - DNA, 25 bp, Mus musculus
cctctgtaaagtgatggctgcagca

SEQ ID NO: 906333 - DNA, 25 bp, Mus musculus
cctctgtcagatgatgatcattttt

SEQ ID NO: 906334 - DNA, 25 bp, Mus musculus
cctctgtcagttgatgatcattttt

SEQ ID NO: 906335 - DNA, 25 bp, Mus musculus
cctctgtccagactcacagcctcta

SEQ ID NO: 906336 - DNA, 25 bp, Mus musculus
cctctgtccagagtcacagcctcta

SEQ ID NO: 906337 - DNA, 25 bp, Mus musculus
cctctgtccccacggaacagactgc

SEQ ID NO: 906338 - DNA, 25 bp, Mus musculus
cctctgtccccagggaacagactgc

SEQ ID NO: 906339 - DNA, 25 bp, Mus musculus
cctctgtggcaacggtgacagctct

SEQ ID NO: 906340 - DNA, 25 bp, Mus musculus
cctctgtggcaagggtgacagctct

SEQ ID NO: 906341 - DNA, 25 bp, Mus musculus
cctctgtgtctcactaatgctcata

SEQ ID NO: 906342 - DNA, 25 bp, Mus musculus
cctctgtgtctcctttaaaaagctt

SEQ ID NO: 906343 - DNA, 25 bp, Mus musculus
cctctgtgtctcgtttaaaaagctt

SEQ ID NO: 906344 - DNA, 25 bp, Mus musculus
cctctgtgtctctctaatgctcata

SEQ ID NO: 906345 - DNA, 25 bp, Mus musculus
cctctgtgtgagctcgaaatgaagc

SEQ ID NO: 906346 - DNA, 25 bp, Mus musculus
cctctgtgtgagctggaaatgaagc

SEQ ID NO: 906347 - DNA, 25 bp, Mus musculus
cctcttaagggacatcgccacgact

SEQ ID NO: 906348 - DNA, 25 bp, Mus musculus
cctcttaagggagatcgccacgact

SEQ ID NO: 906349 - DNA, 25 bp, Mus musculus
cctcttaatatgcaagttacttgga

SEQ ID NO: 906350 - DNA, 25 bp, Mus musculus
cctcttaatatgcatgttacttgga

SEQ ID NO: 906351 - DNA, 25 bp, Mus musculus
cctcttatccagctatatgattcct

SEQ ID NO: 906352 - DNA, 25 bp, Mus musculus
cctcttatccaggtatatgattcct

SEQ ID NO: 906353 - DNA, 25 bp, Mus musculus
cctcttcacccggacgcttctttgg

SEQ ID NO: 906354 - DNA, 25 bp, Mus musculus
cctcttcacccggactaggcttctt

SEQ ID NO: 906355 - DNA, 25 bp, Mus musculus
cctcttcacccggaggcttctttgg

SEQ ID NO: 906356 - DNA, 25 bp, Mus musculus
cctcttcacccggagtaggcttctt

SEQ ID NO: 906357 - DNA, 25 bp, Mus musculus
cctcttcaggctctgtgttccgagg

SEQ ID NO: 906358 - DNA, 25 bp, Mus musculus
cctcttcagggtctgtgttccgagg

SEQ ID NO: 906359 - DNA, 25 bp, Mus musculus
cctcttcagtggaacgtaaacagaa

SEQ ID NO: 906360 - DNA, 25 bp, Mus musculus
cctcttcagtggaaggtaaacagaa

SEQ ID NO: 906361 - DNA, 25 bp, Mus musculus
cctcttcatcaccacgtatcacgta

SEQ ID NO: 906362 - DNA, 25 bp, Mus musculus
cctcttcatcaccaggtatcacgta

SEQ ID NO: 906363 - DNA, 25 bp, Mus musculus
cctcttcatcagcatgctgcacaac

SEQ ID NO: 906364 - DNA, 25 bp, Mus musculus
cctcttcatcaggatgctgcacaac

SEQ ID NO: 906365 - DNA, 25 bp, Mus musculus
cctcttccacaacaatcacctatgt

SEQ ID NO: 906366 - DNA, 25 bp, Mus musculus
cctcttccacaagaatcacctatgt

SEQ ID NO: 906367 - DNA, 25 bp, Mus musculus
cctcttccactgcggtgtgtctgca

SEQ ID NO: 906368 - DNA, 25 bp, Mus musculus
cctcttccactggggtgtgtctgca

SEQ ID NO: 906369 - DNA, 25 bp, Mus musculus
cctcttccagacccatgacaacaga

SEQ ID NO: 906370 - DNA, 25 bp, Mus musculus
cctcttccagacgctgaatcgcacg

SEQ ID NO: 906371 - DNA, 25 bp, Mus musculus
cctcttccagtcccatgacaacaga

SEQ ID NO: 906372 - DNA, 25 bp, Mus musculus
cctcttccagtcgctgaatcgcacg

SEQ ID NO: 906373 - DNA, 25 bp, Mus musculus
cctcttccatggaacatctcatgga

SEQ ID NO: 906374 - DNA, 25 bp, Mus musculus
cctcttccatggaagatctcatgga

SEQ ID NO: 906375 - DNA, 25 bp, Mus musculus
cctcttcctggacttccctgaggat

SEQ ID NO: 906376 - DNA, 25 bp, Mus musculus
cctcttcctggagttccctgaggat

SEQ ID NO: 906377 - DNA, 25 bp, Mus musculus
cctcttctagatgacatcaccgaag

SEQ ID NO: 906378 - DNA, 25 bp, Mus musculus
cctcttctagatgagatcaccgaag

SEQ ID NO: 906379 - DNA, 25 bp, Mus musculus
cctcttctcaagcacatgtttggac

SEQ ID NO: 906380 - DNA, 25 bp, Mus musculus
cctcttctcaaggacatgtttggac

SEQ ID NO: 906381 - DNA, 25 bp, Mus musculus
cctcttctcagcatatgccctggtt

SEQ ID NO: 906382 - DNA, 25 bp, Mus musculus
cctcttctcagcatttgccctggtt

SEQ ID NO: 906383 - DNA, 25 bp, Mus musculus
cctcttctggcctccgatggtgaca

SEQ ID NO: 906384 - DNA, 25 bp, Mus musculus
cctcttctggcctcggatggtgaca

SEQ ID NO: 906385 - DNA, 25 bp, Mus musculus
cctcttctgtgacgtgagtgtagta

SEQ ID NO: 906386 - DNA, 25 bp, Mus musculus
cctcttctgtgaggtgagtgtagta

SEQ ID NO: 906387 - DNA, 25 bp, Mus musculus
cctcttgaagaactttcctgtggcc

SEQ ID NO: 906388 - DNA, 25 bp, Mus musculus
cctcttgaagaagtttcctgtggcc

SEQ ID NO: 906389 - DNA, 25 bp, Mus musculus
cctcttgaagagctaagtgaagacc

SEQ ID NO: 906390 - DNA, 25 bp, Mus musculus
cctcttgaagagcttagtgaagacc

SEQ ID NO: 906391 - DNA, 25 bp, Mus musculus
cctcttgcagcaagggttggcggag

SEQ ID NO: 906392 - DNA, 25 bp, Mus musculus
cctcttgcaggaagggttggcggag

SEQ ID NO: 906393 - DNA, 25 bp, Mus musculus
cctcttgccacacgattttgcagac

SEQ ID NO: 906394 - DNA, 25 bp, Mus musculus
cctcttgccacaggattttgcagac

SEQ ID NO: 906395 - DNA, 25 bp, Mus musculus
cctcttggaactaattctgcataga

SEQ ID NO: 906396 - DNA, 25 bp, Mus musculus
cctcttggaacttattctgcataga

SEQ ID NO: 906397 - DNA, 25 bp, Mus musculus
cctctttatcaaactgctggagaac

SEQ ID NO: 906398 - DNA, 25 bp, Mus musculus
cctctttatcaatctgctggagaac

SEQ ID NO: 906399 - DNA, 25 bp, Mus musculus
cctctttcaagccgtaattgctggc

SEQ ID NO: 906400 - DNA, 25 bp, Mus musculus
cctctttcaagcggtaattgctggc

SEQ ID NO: 906401 - DNA, 25 bp, Mus musculus
cctctttcatagccggaaccctctg

SEQ ID NO: 906402 - DNA, 25 bp, Mus musculus
cctctttcatagcgattttgataaa

SEQ ID NO: 906403 - DNA, 25 bp, Mus musculus
cctctttcataggcggaaccctctg

SEQ ID NO: 906404 - DNA, 25 bp, Mus musculus
cctctttcatagggattttgataaa

SEQ ID NO: 906405 - DNA, 25 bp, Mus musculus
cctctttgagcgcgagaccaacagg

SEQ ID NO: 906406 - DNA, 25 bp, Mus musculus
cctctttgagggcgagaccaacagg

SEQ ID NO: 906407 - DNA, 25 bp, Mus musculus
cctctttgtccacgtggacactctt

SEQ ID NO: 906408 - DNA, 25 bp, Mus musculus
cctctttgtccaggtggacactctt

SEQ ID NO: 906409 - DNA, 25 bp, Mus musculus
cctctttttccaccagttggaattg

SEQ ID NO: 906410 - DNA, 25 bp, Mus musculus
cctctttttccagcagttggaattg

SEQ ID NO: 906411 - DNA, 25 bp, Mus musculus
cctgaaaacatacaagttgccagga

SEQ ID NO: 906412 - DNA, 25 bp, Mus musculus
cctgaaaacatacatgttgccagga

SEQ ID NO: 906413 - DNA, 25 bp, Mus musculus
cctgaaaatgatactgtggatggca

SEQ ID NO: 906414 - DNA, 25 bp, Mus musculus
cctgaaaatgttactgtggatggca

SEQ ID NO: 906415 - DNA, 25 bp, Mus musculus
cctgaaacaatgcttgaaatttgga

SEQ ID NO: 906416 - DNA, 25 bp, Mus musculus
cctgaaacaatggttgaaatttgga

SEQ ID NO: 906417 - DNA, 25 bp, Mus musculus
cctgaaacagctactacttgtcctc

SEQ ID NO: 906418 - DNA, 25 bp, Mus musculus
cctgaaacaggtactacttgtcctc

SEQ ID NO: 906419 - DNA, 25 bp, Mus musculus
cctgaaacccgacaacatcttgtac

SEQ ID NO: 906420 - DNA, 25 bp, Mus musculus
cctgaaacccgagaacatcttgtac

SEQ ID NO: 906421 - DNA, 25 bp, Mus musculus
cctgaaagatcaatcggcagcagca

SEQ ID NO: 906422 - DNA, 25 bp, Mus musculus
cctgaaagatcaatgggcagcagca

SEQ ID NO: 906423 - DNA, 25 bp, Mus musculus
cctgaaatgtctcccctattacgct

SEQ ID NO: 906424 - DNA, 25 bp, Mus musculus
cctgaaatgtctccgctattacgct

SEQ ID NO: 906425 - DNA, 25 bp, Mus musculus
cctgaacaagatgcactcccatcct

SEQ ID NO: 906426 - DNA, 25 bp, Mus musculus
cctgaacaagctcagccctggggag

SEQ ID NO: 906427 - DNA, 25 bp, Mus musculus
cctgaacaagctggcaatgaagcac

SEQ ID NO: 906428 - DNA, 25 bp, Mus musculus
cctgaacaaggtcagccctggggag

SEQ ID NO: 906429 - DNA, 25 bp, Mus musculus
cctgaacaaggtggcaatgaagcac

SEQ ID NO: 906430 - DNA, 25 bp, Mus musculus
cctgaacaagttgcactcccatcct

SEQ ID NO: 906431 - DNA, 25 bp, Mus musculus
cctgaacagtgacgtacagtgtgaa

SEQ ID NO: 906432 - DNA, 25 bp, Mus musculus
cctgaacagtgaggtacagtgtgaa

SEQ ID NO: 906433 - DNA, 25 bp, Mus musculus
cctgaacagtgccatatgagaacat

SEQ ID NO: 906434 - DNA, 25 bp, Mus musculus
cctgaacagtgccgcaacataacat

SEQ ID NO: 906435 - DNA, 25 bp, Mus musculus
cctgaacagtgcgatatgagaacat

SEQ ID NO: 906436 - DNA, 25 bp, Mus musculus
cctgaacagtgcggcaacataacat

SEQ ID NO: 906437 - DNA, 25 bp, Mus musculus
cctgaacatccacgacaaggacagc

SEQ ID NO: 906438 - DNA, 25 bp, Mus musculus
cctgaacatccaggacaaggacagc

SEQ ID NO: 906439 - DNA, 25 bp, Mus musculus
cctgaaccagctggtccctgagaag

SEQ ID NO: 906440 - DNA, 25 bp, Mus musculus
cctgaaccaggtggtccctgagaag

SEQ ID NO: 906441 - DNA, 25 bp, Mus musculus
cctgaaccgtcacgtgcgtgtggaa

SEQ ID NO: 906442 - DNA, 25 bp, Mus musculus
cctgaaccgtcaggtgcgtgtggaa

SEQ ID NO: 906443 - DNA, 25 bp, Mus musculus
cctgaagaagctggccgagatccac

SEQ ID NO: 906444 - DNA, 25 bp, Mus musculus
cctgaagaaggtggccgagatccac

SEQ ID NO: 906445 - DNA, 25 bp, Mus musculus
cctgaagagcagcagcagaggaaag

SEQ ID NO: 906446 - DNA, 25 bp, Mus musculus
cctgaagagcaggagcagaggaaag

SEQ ID NO: 906447 - DNA, 25 bp, Mus musculus
cctgaagagggagacgctgaagaaa

SEQ ID NO: 906448 - DNA, 25 bp, Mus musculus
cctgaagagggagaggctgaagaaa

SEQ ID NO: 906449 - DNA, 25 bp, Mus musculus
cctgaagcacttcgcatggttcgag

SEQ ID NO: 906450 - DNA, 25 bp, Mus musculus
cctgaagcacttcggatggttcgag

SEQ ID NO: 906451 - DNA, 25 bp, Mus musculus
cctgaagctcggctatgtgtcccgg

SEQ ID NO: 906452 - DNA, 25 bp, Mus musculus
cctgaagctcgggtatgtgtcccgg

SEQ ID NO: 906453 - DNA, 25 bp, Mus musculus
cctgaaggagccctcgcctgcctcc

SEQ ID NO: 906454 - DNA, 25 bp, Mus musculus
cctgaaggagccgtcgcctgcctcc

SEQ ID NO: 906455 - DNA, 25 bp, Mus musculus
cctgaaggcccacgtcctgccccct

SEQ ID NO: 906456 - DNA, 25 bp, Mus musculus
cctgaaggcccaggtcctgccccct

SEQ ID NO: 906457 - DNA, 25 bp, Mus musculus
cctgaaggtgtgcttcggacaaagg

SEQ ID NO: 906458 - DNA, 25 bp, Mus musculus
cctgaaggtgtggttcggacaaagg

SEQ ID NO: 906459 - DNA, 25 bp, Mus musculus
cctgaagtcacccaacatgctaatc

SEQ ID NO: 906460 - DNA, 25 bp, Mus musculus
cctgaagtcacccatcatgctaatc

SEQ ID NO: 906461 - DNA, 25 bp, Mus musculus
cctgaagtcagaactggaaaacatc

SEQ ID NO: 906462 - DNA, 25 bp, Mus musculus
cctgaagtcagatctggaaaacatc

SEQ ID NO: 906463 - DNA, 25 bp, Mus musculus
cctgaagtggcaccttgtttttccg

SEQ ID NO: 906464 - DNA, 25 bp, Mus musculus
cctgaagtggcagcttgtttttccg

SEQ ID NO: 906465 - DNA, 25 bp, Mus musculus
cctgaatacaagcgcgagtggaaac

SEQ ID NO: 906466 - DNA, 25 bp, Mus musculus
cctgaatacaagggcgagtggaaac

SEQ ID NO: 906467 - DNA, 25 bp, Mus musculus
cctgaatacacacgccccagtgcct

SEQ ID NO: 906468 - DNA, 25 bp, Mus musculus
cctgaatacacaggccccagtgcct

SEQ ID NO: 906469 - DNA, 25 bp, Mus musculus
cctgaatagcgtccctcaggagccg

SEQ ID NO: 906470 - DNA, 25 bp, Mus musculus
cctgaatagcgtgcctcaggagccg

SEQ ID NO: 906471 - DNA, 25 bp, Mus musculus
cctgaatcgccacacagcctacaga

SEQ ID NO: 906472 - DNA, 25 bp, Mus musculus
cctgaatcgccacagagcctacaga

SEQ ID NO: 906473 - DNA, 25 bp, Mus musculus
cctgaatggggacgtacaggcagag

SEQ ID NO: 906474 - DNA, 25 bp, Mus musculus
cctgaatggggaggtacaggcagag

SEQ ID NO: 906475 - DNA, 25 bp, Mus musculus
cctgaatgtgaacagatctcagggg

SEQ ID NO: 906476 - DNA, 25 bp, Mus musculus
cctgaatgtgaagagatctcagggg

SEQ ID NO: 906477 - DNA, 25 bp, Mus musculus
cctgacaaagaacgagcaccctcca

SEQ ID NO: 906478 - DNA, 25 bp, Mus musculus
cctgacaaagaaggagcaccctcca

SEQ ID NO: 906479 - DNA, 25 bp, Mus musculus
cctgacaaagctgactctcgggctg

SEQ ID NO: 906480 - DNA, 25 bp, Mus musculus
cctgacaaaggtgactctcgggctg

SEQ ID NO: 906481 - DNA, 25 bp, Mus musculus
cctgacaacaagagcctggccatcc

SEQ ID NO: 906482 - DNA, 25 bp, Mus musculus
cctgacaacaagtgcctggccatcc

SEQ ID NO: 906483 - DNA, 25 bp, Mus musculus
cctgacacagctaacttcacagcca

SEQ ID NO: 906484 - DNA, 25 bp, Mus musculus
cctgacacagctaagttcacagcca

SEQ ID NO: 906485 - DNA, 25 bp, Mus musculus
cctgacaccaccaacatcccatggt

SEQ ID NO: 906486 - DNA, 25 bp, Mus musculus
cctgacaccaccaagatcccatggt

SEQ ID NO: 906487 - DNA, 25 bp, Mus musculus
cctgacaccatcaacctctgggaag

SEQ ID NO: 906488 - DNA, 25 bp, Mus musculus
cctgacaccatcaagctctgggaag

SEQ ID NO: 906489 - DNA, 25 bp, Mus musculus
cctgacaccgatggcagactttctg

SEQ ID NO: 906490 - DNA, 25 bp, Mus musculus
cctgacaccgttggcagactttctg

SEQ ID NO: 906491 - DNA, 25 bp, Mus musculus
cctgacagagcggaatgtgtccctg

SEQ ID NO: 906492 - DNA, 25 bp, Mus musculus
cctgacagaggggaatgtgtccctg

SEQ ID NO: 906493 - DNA, 25 bp, Mus musculus
cctgacagataccacttcgattcca

SEQ ID NO: 906494 - DNA, 25 bp, Mus musculus
cctgacagataccagttcgattcca

SEQ ID NO: 906495 - DNA, 25 bp, Mus musculus
cctgacagccttcacgacagtggtg

SEQ ID NO: 906496 - DNA, 25 bp, Mus musculus
cctgacagccttcaggacagtggtg

SEQ ID NO: 906497 - DNA, 25 bp, Mus musculus
cctgacagctggcatctccatcttt

SEQ ID NO: 906498 - DNA, 25 bp, Mus musculus
cctgacagctgggatctccatcttt

SEQ ID NO: 906499 - DNA, 25 bp, Mus musculus
cctgacaggcagcccaggagtgtgc

SEQ ID NO: 906500 - DNA, 25 bp, Mus musculus
cctgacaggcaggccaggagtgtgc

SEQ ID NO: 906501 - DNA, 25 bp, Mus musculus
cctgacagtttgcaaaacattcctg

SEQ ID NO: 906502 - DNA, 25 bp, Mus musculus
cctgacagtttggaaaacattcctg

SEQ ID NO: 906503 - DNA, 25 bp, Mus musculus
cctgacatgaagcccccctaggccc

SEQ ID NO: 906504 - DNA, 25 bp, Mus musculus
cctgacatgaaggccccctaggccc

SEQ ID NO: 906505 - DNA, 25 bp, Mus musculus
cctgacatgagacgcgagatggagc

SEQ ID NO: 906506 - DNA, 25 bp, Mus musculus
cctgacatgagacgggagatggagc

SEQ ID NO: 906507 - DNA, 25 bp, Mus musculus
cctgaccacgctgattgggatacta

SEQ ID NO: 906508 - DNA, 25 bp, Mus musculus
cctgaccacgctttggctccttccg

SEQ ID NO: 906509 - DNA, 25 bp, Mus musculus
cctgaccacggtgattgggatacta

SEQ ID NO: 906510 - DNA, 25 bp, Mus musculus
cctgaccacggtttggctccttccg

SEQ ID NO: 906511 - DNA, 25 bp, Mus musculus
cctgaccagtctatatatattgggg

SEQ ID NO: 906512 - DNA, 25 bp, Mus musculus
cctgaccagtctttatatattgggg

SEQ ID NO: 906513 - DNA, 25 bp, Mus musculus
cctgacccagagctctttgacccac

SEQ ID NO: 906514 - DNA, 25 bp, Mus musculus
cctgacccagaggtctttgacccac

SEQ ID NO: 906515 - DNA, 25 bp, Mus musculus
cctgaccccagactccccagactcg

SEQ ID NO: 906516 - DNA, 25 bp, Mus musculus
cctgaccccagagtccccagactcg

SEQ ID NO: 906517 - DNA, 25 bp, Mus musculus
cctgaccgggagaacctgagaaaga

SEQ ID NO: 906518 - DNA, 25 bp, Mus musculus
cctgaccgggagtacctgagaaaga

SEQ ID NO: 906519 - DNA, 25 bp, Mus musculus
cctgaccttgttcgaagtgggcaca

SEQ ID NO: 906520 - DNA, 25 bp, Mus musculus
cctgaccttgttggaagtgggcaca

SEQ ID NO: 906521 - DNA, 25 bp, Mus musculus
cctgacgagacgctaaaggtgctga

SEQ ID NO: 906522 - DNA, 25 bp, Mus musculus
cctgacgagacggtaaaggtgctga

SEQ ID NO: 906523 - DNA, 25 bp, Mus musculus
cctgacggagcacaagacccagcat

SEQ ID NO: 906524 - DNA, 25 bp, Mus musculus
cctgacggagcacacccagcatgga

SEQ ID NO: 906525 - DNA, 25 bp, Mus musculus
cctgacggagcacgcctgtctcgtc

SEQ ID NO: 906526 - DNA, 25 bp, Mus musculus
cctgacggagcagaagacccagcat

SEQ ID NO: 906527 - DNA, 25 bp, Mus musculus
cctgacggagcagacccagcatgga

SEQ ID NO: 906528 - DNA, 25 bp, Mus musculus
cctgacggagcaggcctgtctcgtc

SEQ ID NO: 906529 - DNA, 25 bp, Mus musculus
cctgacggaggacaaagagcggacc

SEQ ID NO: 906530 - DNA, 25 bp, Mus musculus
cctgacggaggagaaagagcggacc

SEQ ID NO: 906531 - DNA, 25 bp, Mus musculus
cctgacgtctatagccccacctccc

SEQ ID NO: 906532 - DNA, 25 bp, Mus musculus
cctgacgtctttagccccacctccc

SEQ ID NO: 906533 - DNA, 25 bp, Mus musculus
cctgactcagagaggaagaacctgt

SEQ ID NO: 906534 - DNA, 25 bp, Mus musculus
cctgactcagcttctgcggacgatg

SEQ ID NO: 906535 - DNA, 25 bp, Mus musculus
cctgactcaggttctgcggacgatg

SEQ ID NO: 906536 - DNA, 25 bp, Mus musculus
cctgactcagtgaggaagaacctgt

SEQ ID NO: 906537 - DNA, 25 bp, Mus musculus
cctgactcccacagaggagaggcgc

SEQ ID NO: 906538 - DNA, 25 bp, Mus musculus
cctgactcccacagtggagaggcgc

SEQ ID NO: 906539 - DNA, 25 bp, Mus musculus
cctgactcgatgccaccgcatgcgt

SEQ ID NO: 906540 - DNA, 25 bp, Mus musculus
cctgactcgatggcaccgcatgcgt

SEQ ID NO: 906541 - DNA, 25 bp, Mus musculus
cctgactgagattggagagcgagga

SEQ ID NO: 906542 - DNA, 25 bp, Mus musculus
cctgactgagctgaaagtgatgcgg

SEQ ID NO: 906543 - DNA, 25 bp, Mus musculus
cctgactgaggtgaaagtgatgcgg

SEQ ID NO: 906544 - DNA, 25 bp, Mus musculus
cctgactgagtttggagagcgagga

SEQ ID NO: 906545 - DNA, 25 bp, Mus musculus
cctgactgcgattacaattcctaga

SEQ ID NO: 906546 - DNA, 25 bp, Mus musculus
cctgactgcgtttacaattcctaga

SEQ ID NO: 906547 - DNA, 25 bp, Mus musculus
cctgactgtcttgactgtctagctg

SEQ ID NO: 906548 - DNA, 25 bp, Mus musculus
cctgactgtcttgagtgtctagctg

SEQ ID NO: 906549 - DNA, 25 bp, Mus musculus
cctgacttgagacgcccaggatggg

SEQ ID NO: 906550 - DNA, 25 bp, Mus musculus
cctgacttgagaggcccaggatggg

SEQ ID NO: 906551 - DNA, 25 bp, Mus musculus
cctgagaaataccactccctggcct

SEQ ID NO: 906552 - DNA, 25 bp, Mus musculus
cctgagaaataccagtccctggcct

SEQ ID NO: 906553 - DNA, 25 bp, Mus musculus
cctgagaacttcagcctcctgggca

SEQ ID NO: 906554 - DNA, 25 bp, Mus musculus
cctgagaacttcaggctcctgggca

SEQ ID NO: 906555 - DNA, 25 bp, Mus musculus
cctgagaagcagcctgtgcagctat

SEQ ID NO: 906556 - DNA, 25 bp, Mus musculus
cctgagaagcagctctgttctcctg

SEQ ID NO: 906557 - DNA, 25 bp, Mus musculus
cctgagaagcaggctgtgcagctat

SEQ ID NO: 906558 - DNA, 25 bp, Mus musculus
cctgagaagcaggtctgttctcctg

SEQ ID NO: 906559 - DNA, 25 bp, Mus musculus
cctgagaatgcgaagagaaagatac

SEQ ID NO: 906560 - DNA, 25 bp, Mus musculus
cctgagaatgggaagagaaagatac

SEQ ID NO: 906561 - DNA, 25 bp, Mus musculus
cctgagacagcgttgtgagccccgg

SEQ ID NO: 906562 - DNA, 25 bp, Mus musculus
cctgagacagggttgtgagccccgg

SEQ ID NO: 906563 - DNA, 25 bp, Mus musculus
cctgagagaactgtgctaatgaaaa

SEQ ID NO: 906564 - DNA, 25 bp, Mus musculus
cctgagagaagcctgtgctaatgaa

SEQ ID NO: 906565 - DNA, 25 bp, Mus musculus
cctgagagaagcgtgtgctaatgaa

SEQ ID NO: 906566 - DNA, 25 bp, Mus musculus
cctgagagaagtgtgctaatgaaaa

SEQ ID NO: 906567 - DNA, 25 bp, Mus musculus
cctgagagctagcacacatctctgt

SEQ ID NO: 906568 - DNA, 25 bp, Mus musculus
cctgagagctagcacttccagtgca

SEQ ID NO: 906569 - DNA, 25 bp, Mus musculus
cctgagagctagcagacatctctgt

SEQ ID NO: 906570 - DNA, 25 bp, Mus musculus
cctgagagctagcagttccagtgca

SEQ ID NO: 906571 - DNA, 25 bp, Mus musculus
cctgagatacaacgaaagaaaggag

SEQ ID NO: 906572 - DNA, 25 bp, Mus musculus
cctgagatacaaggaaagaaaggag

SEQ ID NO: 906573 - DNA, 25 bp, Mus musculus
cctgagcaaaagtgaactcaatgca

SEQ ID NO: 906574 - DNA, 25 bp, Mus musculus
cctgagcaaacgctacaacaaggct

SEQ ID NO: 906575 - DNA, 25 bp, Mus musculus
cctgagcaaaggctacaacaaggct

SEQ ID NO: 906576 - DNA, 25 bp, Mus musculus
cctgagcaaatgtgaactcaatgca

SEQ ID NO: 906577 - DNA, 25 bp, Mus musculus
cctgagcacaaacgaaccctttgct

SEQ ID NO: 906578 - DNA, 25 bp, Mus musculus
cctgagcacaaaggaaccctttgct

SEQ ID NO: 906579 - DNA, 25 bp, Mus musculus
cctgagcccgagaccgtcagtgggc

SEQ ID NO: 906580 - DNA, 25 bp, Mus musculus
cctgagcccgagacggtcagtgggc

SEQ ID NO: 906581 - DNA, 25 bp, Mus musculus
cctgagcctcttaacgtcattttct

SEQ ID NO: 906582 - DNA, 25 bp, Mus musculus
cctgagcctcttaaggtcattttct

SEQ ID NO: 906583 - DNA, 25 bp, Mus musculus
cctgagctacctcactcgccaagag

SEQ ID NO: 906584 - DNA, 25 bp, Mus musculus
cctgagctacctcagtcgccaagag

SEQ ID NO: 906585 - DNA, 25 bp, Mus musculus
cctgagctggccaaaaggccagata

SEQ ID NO: 906586 - DNA, 25 bp, Mus musculus
cctgagctggctctctgacaaatgg

SEQ ID NO: 906587 - DNA, 25 bp, Mus musculus
cctgagctgggcaaaaggccagata

SEQ ID NO: 906588 - DNA, 25 bp, Mus musculus
cctgagctgggtctctgacaaatgg

SEQ ID NO: 906589 - DNA, 25 bp, Mus musculus
cctgagctgtgacgcgcagcaagca

SEQ ID NO: 906590 - DNA, 25 bp, Mus musculus
cctgagctgtgaggcgcagcaagca

SEQ ID NO: 906591 - DNA, 25 bp, Mus musculus
cctgaggaaaagcacgcatatattc

SEQ ID NO: 906592 - DNA, 25 bp, Mus musculus
cctgaggaaaagcaggcatatattc

SEQ ID NO: 906593 - DNA, 25 bp, Mus musculus
cctgaggaagaggtttgagccatcc

SEQ ID NO: 906594 - DNA, 25 bp, Mus musculus
cctgaggaagtggtttgagccatcc

SEQ ID NO: 906595 - DNA, 25 bp, Mus musculus
cctgaggacattaacacctgctgta

SEQ ID NO: 906596 - DNA, 25 bp, Mus musculus
cctgaggacattaagacctgctgta

SEQ ID NO: 906597 - DNA, 25 bp, Mus musculus
cctgaggagacttgcgttgggggca

SEQ ID NO: 906598 - DNA, 25 bp, Mus musculus
cctgaggagacttgggttgggggca

SEQ ID NO: 906599 - DNA, 25 bp, Mus musculus
cctgaggatgctctggatgaacccc

SEQ ID NO: 906600 - DNA, 25 bp, Mus musculus
cctgaggatgctgtggatgaacccc

SEQ ID NO: 906601 - DNA, 25 bp, Mus musculus
cctgaggctgctactttttaaagat

SEQ ID NO: 906602 - DNA, 25 bp, Mus musculus
cctgaggctgctagggaaccaacag

SEQ ID NO: 906603 - DNA, 25 bp, Mus musculus
cctgaggctgcttctttttaaagat

SEQ ID NO: 906604 - DNA, 25 bp, Mus musculus
cctgaggctgcttgggaaccaacag

SEQ ID NO: 906605 - DNA, 25 bp, Mus musculus
cctgagggagacagaggcattcaag

SEQ ID NO: 906606 - DNA, 25 bp, Mus musculus
cctgagggagacagtggcattcaag

SEQ ID NO: 906607 - DNA, 25 bp, Mus musculus
cctgaggtcttgccagctgagaaag

SEQ ID NO: 906608 - DNA, 25 bp, Mus musculus
cctgaggtcttgcctgctgagaaag

SEQ ID NO: 906609 - DNA, 25 bp, Mus musculus
cctgaggtctttcaagaaatgctgt

SEQ ID NO: 906610 - DNA, 25 bp, Mus musculus
cctgaggtctttcatgaaatgctgt

SEQ ID NO: 906611 - DNA, 25 bp, Mus musculus
cctgaggtggtgcacgagatccccc

SEQ ID NO: 906612 - DNA, 25 bp, Mus musculus
cctgaggtggtgcaggagatccccc

SEQ ID NO: 906613 - DNA, 25 bp, Mus musculus
cctgaggtgtcaaatagctgaaact

SEQ ID NO: 906614 - DNA, 25 bp, Mus musculus
cctgaggtgtcatatagctgaaact

SEQ ID NO: 906615 - DNA, 25 bp, Mus musculus
cctgagtacacgcgggccaacaagt

SEQ ID NO: 906616 - DNA, 25 bp, Mus musculus
cctgagtacacgggggccaacaagt

SEQ ID NO: 906617 - DNA, 25 bp, Mus musculus
cctgagtgagatggaaatagggaca

SEQ ID NO: 906618 - DNA, 25 bp, Mus musculus
cctgagtgagcatcatggctgctgt

SEQ ID NO: 906619 - DNA, 25 bp, Mus musculus
cctgagtgagctcatccactggaac

SEQ ID NO: 906620 - DNA, 25 bp, Mus musculus
cctgagtgaggatcatggctgctgt

SEQ ID NO: 906621 - DNA, 25 bp, Mus musculus
cctgagtgaggtcatccactggaac

SEQ ID NO: 906622 - DNA, 25 bp, Mus musculus
cctgagtgagttggaaatagggaca

SEQ ID NO: 906623 - DNA, 25 bp, Mus musculus
cctgataactcaaagcctcctgtgt

SEQ ID NO: 906624 - DNA, 25 bp, Mus musculus
cctgataactgaaagcctcctgtgt

SEQ ID NO: 906625 - DNA, 25 bp, Mus musculus
cctgatacccaacggcacagatgtc

SEQ ID NO: 906626 - DNA, 25 bp, Mus musculus
cctgatacccaagggcacagatgtc

SEQ ID NO: 906627 - DNA, 25 bp, Mus musculus
cctgatagagttccaacatctcgga

SEQ ID NO: 906628 - DNA, 25 bp, Mus musculus
cctgatagagttgcaacatctcgga

SEQ ID NO: 906629 - DNA, 25 bp, Mus musculus
cctgatcaagatctcctactcagcc

SEQ ID NO: 906630 - DNA, 25 bp, Mus musculus
cctgatcaagatgacagcatggagt

SEQ ID NO: 906631 - DNA, 25 bp, Mus musculus
cctgatcaagttctcctactcagcc

SEQ ID NO: 906632 - DNA, 25 bp, Mus musculus
cctgatcaagttgacagcatggagt

SEQ ID NO: 906633 - DNA, 25 bp, Mus musculus
cctgatcacccacttgttttggaga

SEQ ID NO: 906634 - DNA, 25 bp, Mus musculus
cctgatcacccagttgttttggaga

SEQ ID NO: 906635 - DNA, 25 bp, Mus musculus
cctgatcattggctattctaccatc

SEQ ID NO: 906636 - DNA, 25 bp, Mus musculus
cctgatcattgggtattctaccatc

SEQ ID NO: 906637 - DNA, 25 bp, Mus musculus
cctgatccggaatgtggagaacaac

SEQ ID NO: 906638 - DNA, 25 bp, Mus musculus
cctgatccggtatgtggagaacaac

SEQ ID NO: 906639 - DNA, 25 bp, Mus musculus
cctgatcctaaccacctaagatgga

SEQ ID NO: 906640 - DNA, 25 bp, Mus musculus
cctgatcctaaccagctaagatgga

SEQ ID NO: 906641 - DNA, 25 bp, Mus musculus
cctgatcgagaacaaacttggcctc

SEQ ID NO: 906642 - DNA, 25 bp, Mus musculus
cctgatcgagaagaaacttggcctc

SEQ ID NO: 906643 - DNA, 25 bp, Mus musculus
cctgatctctcactgtaccccgaag

SEQ ID NO: 906644 - DNA, 25 bp, Mus musculus
cctgatctctcagtgtaccccgaag

SEQ ID NO: 906645 - DNA, 25 bp, Mus musculus
cctgatctgcggcggtcagggaaac

SEQ ID NO: 906646 - DNA, 25 bp, Mus musculus
cctgatctgcgggggtcagggaaac

SEQ ID NO: 906647 - DNA, 25 bp, Mus musculus
cctgatctttatcgtacagaaccat

SEQ ID NO: 906648 - DNA, 25 bp, Mus musculus
cctgatctttatggtacagaaccat

SEQ ID NO: 906649 - DNA, 25 bp, Mus musculus
cctgatgaaaatgcctttgagtaat

SEQ ID NO: 906650 - DNA, 25 bp, Mus musculus
cctgatgaaaccatctgtggcaagg

SEQ ID NO: 906651 - DNA, 25 bp, Mus musculus
cctgatgaaagcatctgtggcaagg

SEQ ID NO: 906652 - DNA, 25 bp, Mus musculus
cctgatgaaattgcctttgagtaat

SEQ ID NO: 906653 - DNA, 25 bp, Mus musculus
cctgatgaatgtcccttccgacaag

SEQ ID NO: 906654 - DNA, 25 bp, Mus musculus
cctgatgaatgtgccttccgacaag

SEQ ID NO: 906655 - DNA, 25 bp, Mus musculus
cctgatgatgatcgtatatttgtaa

SEQ ID NO: 906656 - DNA, 25 bp, Mus musculus
cctgatgatgatggtatatttgtaa

SEQ ID NO: 906657 - DNA, 25 bp, Mus musculus
cctgatggccggcaaattgtcttct

SEQ ID NO: 906658 - DNA, 25 bp, Mus musculus
cctgatggccgggaaattgtcttct

SEQ ID NO: 906659 - DNA, 25 bp, Mus musculus
cctgatggctgtcgttcacctgcca

SEQ ID NO: 906660 - DNA, 25 bp, Mus musculus
cctgatggctgtggttcacctgcca

SEQ ID NO: 906661 - DNA, 25 bp, Mus musculus
cctgatggtgcacaacaaaagaaaa

SEQ ID NO: 906662 - DNA, 25 bp, Mus musculus
cctgatggtgcagaacaaaagaaaa

SEQ ID NO: 906663 - DNA, 25 bp, Mus musculus
cctgatgtatgacgcttcctgcggg

SEQ ID NO: 906664 - DNA, 25 bp, Mus musculus
cctgatgtatgaggcttcctgcggg

SEQ ID NO: 906665 - DNA, 25 bp, Mus musculus
cctgatgtcaatcctgagctggccc

SEQ ID NO: 906666 - DNA, 25 bp, Mus musculus
cctgatgtcaatgctgagctggccc

SEQ ID NO: 906667 - DNA, 25 bp, Mus musculus
cctgattaacagcggagcacatatt

SEQ ID NO: 906668 - DNA, 25 bp, Mus musculus
cctgattaacaggggagcacatatt

SEQ ID NO: 906669 - DNA, 25 bp, Mus musculus
cctgattccaatgattcgcctccag

SEQ ID NO: 906670 - DNA, 25 bp, Mus musculus
cctgattccattgattcgcctccag

SEQ ID NO: 906671 - DNA, 25 bp, Mus musculus
cctgattcctatggcgataacttcg

SEQ ID NO: 906672 - DNA, 25 bp, Mus musculus
cctgattcctatggggataacttcg

SEQ ID NO: 906673 - DNA, 25 bp, Mus musculus
cctgattctgagcttctgctgtgaa

SEQ ID NO: 906674 - DNA, 25 bp, Mus musculus
cctgattctgaggttctgctgtgaa

SEQ ID NO: 906675 - DNA, 25 bp, Mus musculus
cctgattggttatgacacaaacata

SEQ ID NO: 906676 - DNA, 25 bp, Mus musculus
cctgattggttatgaggcagcagaa

SEQ ID NO: 906677 - DNA, 25 bp, Mus musculus
cctgattggttatgtcacaaacata

SEQ ID NO: 906678 - DNA, 25 bp, Mus musculus
cctgattggttatgtggcagcagaa

SEQ ID NO: 906679 - DNA, 25 bp, Mus musculus
cctgattttaagctgttcagataca

SEQ ID NO: 906680 - DNA, 25 bp, Mus musculus
cctgattttaaggtgttcagataca

SEQ ID NO: 906681 - DNA, 25 bp, Mus musculus
cctgcaaaaccacatccaagtggag

SEQ ID NO: 906682 - DNA, 25 bp, Mus musculus
cctgcaaaaccagatccaagtggag

SEQ ID NO: 906683 - DNA, 25 bp, Mus musculus
cctgcaaaggccatccctggatcct

SEQ ID NO: 906684 - DNA, 25 bp, Mus musculus
cctgcaaagggcatccctggatcct

SEQ ID NO: 906685 - DNA, 25 bp, Mus musculus
cctgcaaccaagatgagtccttcca

SEQ ID NO: 906686 - DNA, 25 bp, Mus musculus
cctgcaaccaagttgagtccttcca

SEQ ID NO: 906687 - DNA, 25 bp, Mus musculus
cctgcaactcaacgatggatgccct

SEQ ID NO: 906688 - DNA, 25 bp, Mus musculus
cctgcaactcaacgtctaaggtaca

SEQ ID NO: 906689 - DNA, 25 bp, Mus musculus
cctgcaactcaaggatggatgccct

SEQ ID NO: 906690 - DNA, 25 bp, Mus musculus
cctgcaactcaaggtctaaggtaca

SEQ ID NO: 906691 - DNA, 25 bp, Mus musculus
cctgcaagagtgctgcgtgggctgt

SEQ ID NO: 906692 - DNA, 25 bp, Mus musculus
cctgcaagagtggtgcgtgggctgt

SEQ ID NO: 906693 - DNA, 25 bp, Mus musculus
cctgcaagccagaggaatacccact

SEQ ID NO: 906694 - DNA, 25 bp, Mus musculus
cctgcaagccagcttttcacacatc

SEQ ID NO: 906695 - DNA, 25 bp, Mus musculus
cctgcaagccaggttttcacacatc

SEQ ID NO: 906696 - DNA, 25 bp, Mus musculus
cctgcaagccagtggaatacccact

SEQ ID NO: 906697 - DNA, 25 bp, Mus musculus
cctgcaaggccagtcgatgcgccta

SEQ ID NO: 906698 - DNA, 25 bp, Mus musculus
cctgcaaggccagtggatgcgccta

SEQ ID NO: 906699 - DNA, 25 bp, Mus musculus
cctgcaatagaaaggacctaagtgt

SEQ ID NO: 906700 - DNA, 25 bp, Mus musculus
cctgcaatagtaaggacctaagtgt

SEQ ID NO: 906701 - DNA, 25 bp, Mus musculus
cctgcacaagaacggtgcaggtagc

SEQ ID NO: 906702 - DNA, 25 bp, Mus musculus
cctgcacaagaagggtgcaggtagc

SEQ ID NO: 906703 - DNA, 25 bp, Mus musculus
cctgcacaagctgggtatcatctac

SEQ ID NO: 906704 - DNA, 25 bp, Mus musculus
cctgcacaaggtgggtatcatctac

SEQ ID NO: 906705 - DNA, 25 bp, Mus musculus
cctgcacaggatatatgtgcctctc

SEQ ID NO: 906706 - DNA, 25 bp, Mus musculus
cctgcacaggctggccagagcgggc

SEQ ID NO: 906707 - DNA, 25 bp, Mus musculus
cctgcacagggtggccagagcgggc

SEQ ID NO: 906708 - DNA, 25 bp, Mus musculus
cctgcacaggttatatgtgcctctc

SEQ ID NO: 906709 - DNA, 25 bp, Mus musculus
cctgcacatctctgatgtggaaggg

SEQ ID NO: 906710 - DNA, 25 bp, Mus musculus
cctgcacatctctgttgtggaaggg

SEQ ID NO: 906711 - DNA, 25 bp, Mus musculus
cctgcaccaaaggacggcccatcta

SEQ ID NO: 906712 - DNA, 25 bp, Mus musculus
cctgcaccaaaggagggcccatcta

SEQ ID NO: 906713 - DNA, 25 bp, Mus musculus
cctgcaccagagacggaaaaccctc

SEQ ID NO: 906714 - DNA, 25 bp, Mus musculus
cctgcaccagcattctaatcccttt

SEQ ID NO: 906715 - DNA, 25 bp, Mus musculus
cctgcaccaggattctaatcccttt

SEQ ID NO: 906716 - DNA, 25 bp, Mus musculus
cctgcaccagtgacggaaaaccctc

SEQ ID NO: 906717 - DNA, 25 bp, Mus musculus
cctgcacctggaagcaccctgctct

SEQ ID NO: 906718 - DNA, 25 bp, Mus musculus
cctgcacctggaagcattttgttcc

SEQ ID NO: 906719 - DNA, 25 bp, Mus musculus
cctgcacctggatgcaccctgctct

SEQ ID NO: 906720 - DNA, 25 bp, Mus musculus
cctgcacctggatgcattttgttcc

SEQ ID NO: 906721 - DNA, 25 bp, Mus musculus
cctgcaccttcacgctggagccaga

SEQ ID NO: 906722 - DNA, 25 bp, Mus musculus
cctgcaccttcaggctggagccaga

SEQ ID NO: 906723 - DNA, 25 bp, Mus musculus
cctgcacgcaggatcgacctctcta

SEQ ID NO: 906724 - DNA, 25 bp, Mus musculus
cctgcacgcaggatctgtatccatc

SEQ ID NO: 906725 - DNA, 25 bp, Mus musculus
cctgcacgcaggatggacctctcta

SEQ ID NO: 906726 - DNA, 25 bp, Mus musculus
cctgcacgcaggatgtgtatccatc

SEQ ID NO: 906727 - DNA, 25 bp, Mus musculus
cctgcactctgacagagaagctgga

SEQ ID NO: 906728 - DNA, 25 bp, Mus musculus
cctgcactctgagagagaagctgga

SEQ ID NO: 906729 - DNA, 25 bp, Mus musculus
cctgcactgcagacctgtgctgtga

SEQ ID NO: 906730 - DNA, 25 bp, Mus musculus
cctgcactgcagagacctgtgctgt

SEQ ID NO: 906731 - DNA, 25 bp, Mus musculus
cctgcactgcagcagacctgtgctg

SEQ ID NO: 906732 - DNA, 25 bp, Mus musculus
cctgcactgcaggagacctgtgctg

SEQ ID NO: 906733 - DNA, 25 bp, Mus musculus
cctgcactgcagtcctgtgctgtga

SEQ ID NO: 906734 - DNA, 25 bp, Mus musculus
cctgcactgcagtgacctgtgctgt

SEQ ID NO: 906735 - DNA, 25 bp, Mus musculus
cctgcactgggaaatatggctttgt

SEQ ID NO: 906736 - DNA, 25 bp, Mus musculus
cctgcactgggaaggcttgtcgctt

SEQ ID NO: 906737 - DNA, 25 bp, Mus musculus
cctgcactgggatatatggctttgt

SEQ ID NO: 906738 - DNA, 25 bp, Mus musculus
cctgcactgggatggcttgtcgctt

SEQ ID NO: 906739 - DNA, 25 bp, Mus musculus
cctgcagaaagaaaagcccttatgt

SEQ ID NO: 906740 - DNA, 25 bp, Mus musculus
cctgcagaaagaaatgcccttatgt

SEQ ID NO: 906741 - DNA, 25 bp, Mus musculus
cctgcagaatcgcccagcgcccgag

SEQ ID NO: 906742 - DNA, 25 bp, Mus musculus
cctgcagaatcggccagcgcccgag

SEQ ID NO: 906743 - DNA, 25 bp, Mus musculus
cctgcagacggggacggcagaagat

SEQ ID NO: 906744 - DNA, 25 bp, Mus musculus
cctgcagacggggagggcagaagat

SEQ ID NO: 906745 - DNA, 25 bp, Mus musculus
cctgcagagcccagcctttcgggaa

SEQ ID NO: 906746 - DNA, 25 bp, Mus musculus
cctgcagagcccatctttcagggag

SEQ ID NO: 906747 - DNA, 25 bp, Mus musculus
cctgcagagccctgcctttcgggaa

SEQ ID NO: 906748 - DNA, 25 bp, Mus musculus
cctgcagagcccttctttcagggag

SEQ ID NO: 906749 - DNA, 25 bp, Mus musculus
cctgcagaggcacatataatggaac

SEQ ID NO: 906750 - DNA, 25 bp, Mus musculus
cctgcagaggcagatataatggaac

SEQ ID NO: 906751 - DNA, 25 bp, Mus musculus
cctgcagcaaagccaccatgccaat

SEQ ID NO: 906752 - DNA, 25 bp, Mus musculus
cctgcagcaaaggcaccatgccaat

SEQ ID NO: 906753 - DNA, 25 bp, Mus musculus
cctgcagcagctgattcaggattac

SEQ ID NO: 906754 - DNA, 25 bp, Mus musculus
cctgcagcagctgtctgtgaggagc

SEQ ID NO: 906755 - DNA, 25 bp, Mus musculus
cctgcagcagctgttcaggatgatt

SEQ ID NO: 906756 - DNA, 25 bp, Mus musculus
cctgcagcaggtgattcaggattac

SEQ ID NO: 906757 - DNA, 25 bp, Mus musculus
cctgcagcaggtgtctgtgaggagc

SEQ ID NO: 906758 - DNA, 25 bp, Mus musculus
cctgcagcaggtgttcaggatgatt

SEQ ID NO: 906759 - DNA, 25 bp, Mus musculus
cctgcagcgcaggaccttcagccag

SEQ ID NO: 906760 - DNA, 25 bp, Mus musculus
cctgcagcgcaggagcttcagccag

SEQ ID NO: 906761 - DNA, 25 bp, Mus musculus
cctgcagctaagccagaaaagatag

SEQ ID NO: 906762 - DNA, 25 bp, Mus musculus
cctgcagctaaggcagaaaagatag

SEQ ID NO: 906763 - DNA, 25 bp, Mus musculus
cctgcagctgctggctgcactccag

SEQ ID NO: 906764 - DNA, 25 bp, Mus musculus
cctgcagctggtggctgcactccag

SEQ ID NO: 906765 - DNA, 25 bp, Mus musculus
cctgcaggacagctggcctctgatg

SEQ ID NO: 906766 - DNA, 25 bp, Mus musculus
cctgcaggacaggtggcctctgatg

SEQ ID NO: 906767 - DNA, 25 bp, Mus musculus
cctgcaggacatctcctggcagctt

SEQ ID NO: 906768 - DNA, 25 bp, Mus musculus
cctgcaggacatgtcctggcagctt

SEQ ID NO: 906769 - DNA, 25 bp, Mus musculus
cctgcaggagaagaacacaagaggg

SEQ ID NO: 906770 - DNA, 25 bp, Mus musculus
cctgcaggagaagaaggtggatcgc

SEQ ID NO: 906771 - DNA, 25 bp, Mus musculus
cctgcaggagaagatcacaagaggg

SEQ ID NO: 906772 - DNA, 25 bp, Mus musculus
cctgcaggagaagatggtggatcgc

SEQ ID NO: 906773 - DNA, 25 bp, Mus musculus
cctgcaggcgtgagcaaactgctgt

SEQ ID NO: 906774 - DNA, 25 bp, Mus musculus
cctgcaggcgtgaggaaactgctgt

SEQ ID NO: 906775 - DNA, 25 bp, Mus musculus
cctgcagggaggctgtttgtgttct

SEQ ID NO: 906776 - DNA, 25 bp, Mus musculus
cctgcagggagggtgtttgtgttct

SEQ ID NO: 906777 - DNA, 25 bp, Mus musculus
cctgcagtacctaaatttctctaca

SEQ ID NO: 906778 - DNA, 25 bp, Mus musculus
cctgcagtacctaattttctctaca

SEQ ID NO: 906779 - DNA, 25 bp, Mus musculus
cctgcagtagacatatggagcctgg

SEQ ID NO: 906780 - DNA, 25 bp, Mus musculus
cctgcagtagtcatatggagcctgg

SEQ ID NO: 906781 - DNA, 25 bp, Mus musculus
cctgcagtgtcactgctgccctagg

SEQ ID NO: 906782 - DNA, 25 bp, Mus musculus
cctgcagtgtcacttcctttctaga

SEQ ID NO: 906783 - DNA, 25 bp, Mus musculus
cctgcagtgtcagtgctgccctagg

SEQ ID NO: 906784 - DNA, 25 bp, Mus musculus
cctgcagtgtcagttcctttctaga

SEQ ID NO: 906785 - DNA, 25 bp, Mus musculus
cctgcagttccaacaatccccaaag

SEQ ID NO: 906786 - DNA, 25 bp, Mus musculus
cctgcagttccaactatccccaaag

SEQ ID NO: 906787 - DNA, 25 bp, Mus musculus
cctgcagttccgcacgctcagggaa

SEQ ID NO: 906788 - DNA, 25 bp, Mus musculus
cctgcagttccgcaggctcagggaa

SEQ ID NO: 906789 - DNA, 25 bp, Mus musculus
cctgcataagagagcaactgttcat

SEQ ID NO: 906790 - DNA, 25 bp, Mus musculus
cctgcataagcggtgtgtctgctac

SEQ ID NO: 906791 - DNA, 25 bp, Mus musculus
cctgcataagcttataagtacatgg

SEQ ID NO: 906792 - DNA, 25 bp, Mus musculus
cctgcataaggggtgtgtctgctac

SEQ ID NO: 906793 - DNA, 25 bp, Mus musculus
cctgcataaggttataagtacatgg

SEQ ID NO: 906794 - DNA, 25 bp, Mus musculus
cctgcataagtgagcaactgttcat

SEQ ID NO: 906795 - DNA, 25 bp, Mus musculus
cctgcatattcagacctctatcgtc

SEQ ID NO: 906796 - DNA, 25 bp, Mus musculus
cctgcatattcagagctctatcgtc

SEQ ID NO: 906797 - DNA, 25 bp, Mus musculus
cctgcatctgaacaggtggccatgg

SEQ ID NO: 906798 - DNA, 25 bp, Mus musculus
cctgcatctgaagaggtggccatgg

SEQ ID NO: 906799 - DNA, 25 bp, Mus musculus
cctgcatctgacaacgtgcagcaag

SEQ ID NO: 906800 - DNA, 25 bp, Mus musculus
cctgcatctgacaaggtgcagcaag

SEQ ID NO: 906801 - DNA, 25 bp, Mus musculus
cctgcatctgattggagagtacctg

SEQ ID NO: 906802 - DNA, 25 bp, Mus musculus
cctgcatctgtttggagagtacctg

SEQ ID NO: 906803 - DNA, 25 bp, Mus musculus
cctgcatgtcctcgacaccctggag

SEQ ID NO: 906804 - DNA, 25 bp, Mus musculus
cctgcatgtcctggacaccctggag

SEQ ID NO: 906805 - DNA, 25 bp, Mus musculus
cctgcatgtttgctcaaaacaatgg

SEQ ID NO: 906806 - DNA, 25 bp, Mus musculus
cctgcatgtttgctgaaaacaatgg

SEQ ID NO: 906807 - DNA, 25 bp, Mus musculus
cctgcattacagcttggctgttgtc

SEQ ID NO: 906808 - DNA, 25 bp, Mus musculus
cctgcattacaggttggctgttgtc

SEQ ID NO: 906809 - DNA, 25 bp, Mus musculus
cctgcattagcggaaagctgggggc

SEQ ID NO: 906810 - DNA, 25 bp, Mus musculus
cctgcattaggggaaagctgggggc

SEQ ID NO: 906811 - DNA, 25 bp, Mus musculus
cctgccaaagcgaaccatgatcctg

SEQ ID NO: 906812 - DNA, 25 bp, Mus musculus
cctgccaaagcggctgactgaaagt

SEQ ID NO: 906813 - DNA, 25 bp, Mus musculus
cctgccaaagggaaccatgatcctg

SEQ ID NO: 906814 - DNA, 25 bp, Mus musculus
cctgccaaaggggctgactgaaagt

SEQ ID NO: 906815 - DNA, 25 bp, Mus musculus
cctgccaactcccatttctcctcct

SEQ ID NO: 906816 - DNA, 25 bp, Mus musculus
cctgccaactccgatttctcctcct

SEQ ID NO: 906817 - DNA, 25 bp, Mus musculus
cctgccaatgtgagcaaaggcacaa

SEQ ID NO: 906818 - DNA, 25 bp, Mus musculus
cctgccaatgtgtgcaaaggcacaa

SEQ ID NO: 906819 - DNA, 25 bp, Mus musculus
cctgccacagagctgagtacgtgga

SEQ ID NO: 906820 - DNA, 25 bp, Mus musculus
cctgccacagcaagagagctcagag

SEQ ID NO: 906821 - DNA, 25 bp, Mus musculus
cctgccacaggaagagagctcagag

SEQ ID NO: 906822 - DNA, 25 bp, Mus musculus
cctgccacagtgctgagtacgtgga

SEQ ID NO: 906823 - DNA, 25 bp, Mus musculus
cctgccaccgcagccgtgtcagcta

SEQ ID NO: 906824 - DNA, 25 bp, Mus musculus
cctgccaccgcagcggtgtcagcta

SEQ ID NO: 906825 - DNA, 25 bp, Mus musculus
cctgccagccagaaaatgacctgaa

SEQ ID NO: 906826 - DNA, 25 bp, Mus musculus
cctgccagccagtaaatgacctgaa

SEQ ID NO: 906827 - DNA, 25 bp, Mus musculus
cctgccatgttgcatgccgccttgg

SEQ ID NO: 906828 - DNA, 25 bp, Mus musculus
cctgccatgttggatgccgccttgg

SEQ ID NO: 906829 - DNA, 25 bp, Mus musculus
cctgcccaagcacaagctgggacgt

SEQ ID NO: 906830 - DNA, 25 bp, Mus musculus
cctgcccaaggacaagctgggacgt

SEQ ID NO: 906831 - DNA, 25 bp, Mus musculus
cctgcccaccgtcacatcgacgaat

SEQ ID NO: 906832 - DNA, 25 bp, Mus musculus
cctgcccaccgtgacatcgacgaat

SEQ ID NO: 906833 - DNA, 25 bp, Mus musculus
cctgcccagaaactccccccaggcc

SEQ ID NO: 906834 - DNA, 25 bp, Mus musculus
cctgcccagaccctgaccccaggac

SEQ ID NO: 906835 - DNA, 25 bp, Mus musculus
cctgcccagagcctgaccccaggac

SEQ ID NO: 906836 - DNA, 25 bp, Mus musculus
cctgcccagatactccccccaggcc

SEQ ID NO: 906837 - DNA, 25 bp, Mus musculus
cctgcccaggcgtggagctgccccc

SEQ ID NO: 906838 - DNA, 25 bp, Mus musculus
cctgcccaggggtggagctgccccc

SEQ ID NO: 906839 - DNA, 25 bp, Mus musculus
cctgcccagtcttgaagaaattgta

SEQ ID NO: 906840 - DNA, 25 bp, Mus musculus
cctgcccagtgttgaagaaattgta

SEQ ID NO: 906841 - DNA, 25 bp, Mus musculus
cctgccccagaaaacatcggaccag

SEQ ID NO: 906842 - DNA, 25 bp, Mus musculus
cctgccccagacaacattctggggg

SEQ ID NO: 906843 - DNA, 25 bp, Mus musculus
cctgccccagattgctgccaagatc

SEQ ID NO: 906844 - DNA, 25 bp, Mus musculus
cctgccccagcatcagaatggcatg

SEQ ID NO: 906845 - DNA, 25 bp, Mus musculus
cctgccccaggatcagaatggcatg

SEQ ID NO: 906846 - DNA, 25 bp, Mus musculus
cctgccccagtaaacatcggaccag

SEQ ID NO: 906847 - DNA, 25 bp, Mus musculus
cctgccccagtcaacattctggggg

SEQ ID NO: 906848 - DNA, 25 bp, Mus musculus
cctgccccagtttgctgccaagatc

SEQ ID NO: 906849 - DNA, 25 bp, Mus musculus
cctgcccccaaagacccaagctctc

SEQ ID NO: 906850 - DNA, 25 bp, Mus musculus
cctgcccccaaagagccaagctctc

SEQ ID NO: 906851 - DNA, 25 bp, Mus musculus
cctgcccgaaagagtctaaagcgcc

SEQ ID NO: 906852 - DNA, 25 bp, Mus musculus
cctgcccgaaagtgtctaaagcgcc

SEQ ID NO: 906853 - DNA, 25 bp, Mus musculus
cctgccctcccgcaaattgtggctg

SEQ ID NO: 906854 - DNA, 25 bp, Mus musculus
cctgccctcccggaaattgtggctg

SEQ ID NO: 906855 - DNA, 25 bp, Mus musculus
cctgccgcagctggccatggctaca

SEQ ID NO: 906856 - DNA, 25 bp, Mus musculus
cctgccgcaggtggccatggctaca

SEQ ID NO: 906857 - DNA, 25 bp, Mus musculus
cctgccgccaagccttccaggagct

SEQ ID NO: 906858 - DNA, 25 bp, Mus musculus
cctgccgccaaggcttccaggagct

SEQ ID NO: 906859 - DNA, 25 bp, Mus musculus
cctgccgcccagatagaggtgcccc

SEQ ID NO: 906860 - DNA, 25 bp, Mus musculus
cctgccgcccagttagaggtgcccc

SEQ ID NO: 906861 - DNA, 25 bp, Mus musculus
cctgccggctgacgagaaacaacaa

SEQ ID NO: 906862 - DNA, 25 bp, Mus musculus
cctgccggctgaggagaaacaacaa

SEQ ID NO: 906863 - DNA, 25 bp, Mus musculus
cctgcctatgcaacccccagtcccc

SEQ ID NO: 906864 - DNA, 25 bp, Mus musculus
cctgcctatgcatcccccagtcccc

SEQ ID NO: 906865 - DNA, 25 bp, Mus musculus
cctgcctcttcgcgtttgtctacta

SEQ ID NO: 906866 - DNA, 25 bp, Mus musculus
cctgcctcttcgggtttgtctacta

SEQ ID NO: 906867 - DNA, 25 bp, Mus musculus
cctgcctgagcaaggggaccaggat

SEQ ID NO: 906868 - DNA, 25 bp, Mus musculus
cctgcctgagcagctgcagaagtgc

SEQ ID NO: 906869 - DNA, 25 bp, Mus musculus
cctgcctgaggaaaaagctggtggc

SEQ ID NO: 906870 - DNA, 25 bp, Mus musculus
cctgcctgaggaaatagctggtggc

SEQ ID NO: 906871 - DNA, 25 bp, Mus musculus
cctgcctgaggaaggggaccaggat

SEQ ID NO: 906872 - DNA, 25 bp, Mus musculus
cctgcctgaggagctgcagaagtgc

SEQ ID NO: 906873 - DNA, 25 bp, Mus musculus
cctgcctgccagaacatgctgtttg

SEQ ID NO: 906874 - DNA, 25 bp, Mus musculus
cctgcctgccagtacatgctgtttg

SEQ ID NO: 906875 - DNA, 25 bp, Mus musculus
cctgcctgggcaatgaattccacag

SEQ ID NO: 906876 - DNA, 25 bp, Mus musculus
cctgcctggggaatgaattccacag

SEQ ID NO: 906877 - DNA, 25 bp, Mus musculus
cctgcctggggcttcgaacatgggt

SEQ ID NO: 906878 - DNA, 25 bp, Mus musculus
cctgcctggggcttggaacatgggt

SEQ ID NO: 906879 - DNA, 25 bp, Mus musculus
cctgcctgtcagccttcctgcgggc

SEQ ID NO: 906880 - DNA, 25 bp, Mus musculus
cctgcctgtcaggcttcctgcgggc

SEQ ID NO: 906881 - DNA, 25 bp, Mus musculus
cctgcctgtgccgacagttcccagc

SEQ ID NO: 906882 - DNA, 25 bp, Mus musculus
cctgcctgtgccgagagttcccagc

SEQ ID NO: 906883 - DNA, 25 bp, Mus musculus
cctgccttcagacgccttctacatg

SEQ ID NO: 906884 - DNA, 25 bp, Mus musculus
cctgccttcagaggccttctacatg

SEQ ID NO: 906885 - DNA, 25 bp, Mus musculus
cctgccttgaagctcatggcacagt

SEQ ID NO: 906886 - DNA, 25 bp, Mus musculus
cctgccttgaaggtcatggcacagt

SEQ ID NO: 906887 - DNA, 25 bp, Mus musculus
cctgccttgatgacagggtcccttg

SEQ ID NO: 906888 - DNA, 25 bp, Mus musculus
cctgccttgatgtcagggtcccttg

SEQ ID NO: 906889 - DNA, 25 bp, Mus musculus
cctgcctttgaaaacgtgttgaaga

SEQ ID NO: 906890 - DNA, 25 bp, Mus musculus
cctgcctttgaaaaggtgttgaaga

SEQ ID NO: 906891 - DNA, 25 bp, Mus musculus
cctgcgacccagccattcattgaga

SEQ ID NO: 906892 - DNA, 25 bp, Mus musculus
cctgcgacccagctgcctggctgca

SEQ ID NO: 906893 - DNA, 25 bp, Mus musculus
cctgcgacccaggcattcattgaga

SEQ ID NO: 906894 - DNA, 25 bp, Mus musculus
cctgcgacccaggtgcctggctgca

SEQ ID NO: 906895 - DNA, 25 bp, Mus musculus
cctgcgagaggacgcctcccacctt

SEQ ID NO: 906896 - DNA, 25 bp, Mus musculus
cctgcgagaggaggcctcccacctt

SEQ ID NO: 906897 - DNA, 25 bp, Mus musculus
cctgcgagataactttggggaggcc

SEQ ID NO: 906898 - DNA, 25 bp, Mus musculus
cctgcgagataagtttggggaggcc

SEQ ID NO: 906899 - DNA, 25 bp, Mus musculus
cctgcgattgaagactcttttcaca

SEQ ID NO: 906900 - DNA, 25 bp, Mus musculus
cctgcgattgaagagtcttttcaca

SEQ ID NO: 906901 - DNA, 25 bp, Mus musculus
cctgcgcaagcgcaaagagcccaag

SEQ ID NO: 906902 - DNA, 25 bp, Mus musculus
cctgcgcaagggcaaagagcccaag

SEQ ID NO: 906903 - DNA, 25 bp, Mus musculus
cctgcgcagctccgcatttcagtcg

SEQ ID NO: 906904 - DNA, 25 bp, Mus musculus
cctgcgcagctcggcatttcagtcg

SEQ ID NO: 906905 - DNA, 25 bp, Mus musculus
cctgcgcagtgtcgacccgttcccc

SEQ ID NO: 906906 - DNA, 25 bp, Mus musculus
cctgcgcagtgtggacccgttcccc

SEQ ID NO: 906907 - DNA, 25 bp, Mus musculus
cctgcgccatggagctgatctggtt

SEQ ID NO: 906908 - DNA, 25 bp, Mus musculus
cctgcgccatggtgctgatctggtt

SEQ ID NO: 906909 - DNA, 25 bp, Mus musculus
cctgcggacacgacttttgctctgc

SEQ ID NO: 906910 - DNA, 25 bp, Mus musculus
cctgcggacacgagaatgtctgaag

SEQ ID NO: 906911 - DNA, 25 bp, Mus musculus
cctgcggacacgattcatcctatct

SEQ ID NO: 906912 - DNA, 25 bp, Mus musculus
cctgcggacacgtcttttgctctgc

SEQ ID NO: 906913 - DNA, 25 bp, Mus musculus
cctgcggacacgtgaatgtctgaag

SEQ ID NO: 906914 - DNA, 25 bp, Mus musculus
cctgcggacacgtttcatcctatct

SEQ ID NO: 906915 - DNA, 25 bp, Mus musculus
cctgcggagacacggggctcaccct

SEQ ID NO: 906916 - DNA, 25 bp, Mus musculus
cctgcggagacacgtttcggccgag

SEQ ID NO: 906917 - DNA, 25 bp, Mus musculus
cctgcggagacagggggctcaccct

SEQ ID NO: 906918 - DNA, 25 bp, Mus musculus
cctgcggagacaggtttcggccgag

SEQ ID NO: 906919 - DNA, 25 bp, Mus musculus
cctgcggatgctcgttcaggataag

SEQ ID NO: 906920 - DNA, 25 bp, Mus musculus
cctgcggatgctggttcaggataag

SEQ ID NO: 906921 - DNA, 25 bp, Mus musculus
cctgcggcacataaatttcacacga

SEQ ID NO: 906922 - DNA, 25 bp, Mus musculus
cctgcggcacattaatttcacacga

SEQ ID NO: 906923 - DNA, 25 bp, Mus musculus
cctgcgggcacacgtggacgacccc

SEQ ID NO: 906924 - DNA, 25 bp, Mus musculus
cctgcgggcacaggtggacgacccc

SEQ ID NO: 906925 - DNA, 25 bp, Mus musculus
cctgcgggcgcgcattgtgccttct

SEQ ID NO: 906926 - DNA, 25 bp, Mus musculus
cctgcgggcgcggattgtgccttct

SEQ ID NO: 906927 - DNA, 25 bp, Mus musculus
cctgcggtctgccccggaagtgtgg

SEQ ID NO: 906928 - DNA, 25 bp, Mus musculus
cctgcggtctgcccgggaagtgtgg

SEQ ID NO: 906929 - DNA, 25 bp, Mus musculus
cctgcggttaagagagcaaaccaac

SEQ ID NO: 906930 - DNA, 25 bp, Mus musculus
cctgcggttaagtgagcaaaccaac

SEQ ID NO: 906931 - DNA, 25 bp, Mus musculus
cctgcgtcgggacgctccatcatgg

SEQ ID NO: 906932 - DNA, 25 bp, Mus musculus
cctgcgtcgggaggctccatcatgg

SEQ ID NO: 906933 - DNA, 25 bp, Mus musculus
cctgctaacgaagacccagcatgga

SEQ ID NO: 906934 - DNA, 25 bp, Mus musculus
cctgctaacgacccagcatggagtt

SEQ ID NO: 906935 - DNA, 25 bp, Mus musculus
cctgctaacgtagacccagcatgga

SEQ ID NO: 906936 - DNA, 25 bp, Mus musculus
cctgctaacgtcccagcatggagtt

SEQ ID NO: 906937 - DNA, 25 bp, Mus musculus
cctgctaagcgacaaaggcaaacag

SEQ ID NO: 906938 - DNA, 25 bp, Mus musculus
cctgctaagcgagaaaggcaaacag

SEQ ID NO: 906939 - DNA, 25 bp, Mus musculus
cctgctacagcaacttctcctggcc

SEQ ID NO: 906940 - DNA, 25 bp, Mus musculus
cctgctacaggaacttctcctggcc

SEQ ID NO: 906941 - DNA, 25 bp, Mus musculus
cctgctaccatacgagactacacgg

SEQ ID NO: 906942 - DNA, 25 bp, Mus musculus
cctgctaccatacgctccacttacc

SEQ ID NO: 906943 - DNA, 25 bp, Mus musculus
cctgctaccataggagactacacgg

SEQ ID NO: 906944 - DNA, 25 bp, Mus musculus
cctgctaccataggctccacttacc

SEQ ID NO: 906945 - DNA, 25 bp, Mus musculus
cctgctacctggaacagtgcctgct

SEQ ID NO: 906946 - DNA, 25 bp, Mus musculus
cctgctacctggaagagtgcctgct

SEQ ID NO: 906947 - DNA, 25 bp, Mus musculus
cctgctagactgcggtgctgacccc

SEQ ID NO: 906948 - DNA, 25 bp, Mus musculus
cctgctagactggggtgctgacccc

SEQ ID NO: 906949 - DNA, 25 bp, Mus musculus
cctgctagccagagctttcgcagtt

SEQ ID NO: 906950 - DNA, 25 bp, Mus musculus
cctgctagccagtgctttcgcagtt

SEQ ID NO: 906951 - DNA, 25 bp, Mus musculus
cctgctagcgctcctgggttttgtc

SEQ ID NO: 906952 - DNA, 25 bp, Mus musculus
cctgctagcggtcctgggttttgtc

SEQ ID NO: 906953 - DNA, 25 bp, Mus musculus
cctgctaggagagacgaggaaaagc

SEQ ID NO: 906954 - DNA, 25 bp, Mus musculus
cctgctaggagagaggaggaaaagc

SEQ ID NO: 906955 - DNA, 25 bp, Mus musculus
cctgctataaagtcagcaaattctg

SEQ ID NO: 906956 - DNA, 25 bp, Mus musculus
cctgctataaagtctgcaaattctg

SEQ ID NO: 906957 - DNA, 25 bp, Mus musculus
cctgctatagctcagttctcagttc

SEQ ID NO: 906958 - DNA, 25 bp, Mus musculus
cctgctataggtcagttctcagttc

SEQ ID NO: 906959 - DNA, 25 bp, Mus musculus
cctgctatcatgaacaaattagaag

SEQ ID NO: 906960 - DNA, 25 bp, Mus musculus
cctgctatcatgaagaaattagaag

SEQ ID NO: 906961 - DNA, 25 bp, Mus musculus
cctgctattcaaaacagcgtggaag

SEQ ID NO: 906962 - DNA, 25 bp, Mus musculus
cctgctattcaatacagcgtggaag

SEQ ID NO: 906963 - DNA, 25 bp, Mus musculus
cctgctcaacaacgtgaatgacctt

SEQ ID NO: 906964 - DNA, 25 bp, Mus musculus
cctgctcaacaaggtgaatgacctt

SEQ ID NO: 906965 - DNA, 25 bp, Mus musculus
cctgctcaagactgaaaatgcagct

SEQ ID NO: 906966 - DNA, 25 bp, Mus musculus
cctgctcaagtctgaaaatgcagct

SEQ ID NO: 906967 - DNA, 25 bp, Mus musculus
cctgctcacccactgtgtcctgaga

SEQ ID NO: 906968 - DNA, 25 bp, Mus musculus
cctgctcacccagtgtgtcctgaga

SEQ ID NO: 906969 - DNA, 25 bp, Mus musculus
cctgctcacgctgtccctggatcag

SEQ ID NO: 906970 - DNA, 25 bp, Mus musculus
cctgctcacggtgtccctggatcag

SEQ ID NO: 906971 - DNA, 25 bp, Mus musculus
cctgctcagcagaatcgggttgaga

SEQ ID NO: 906972 - DNA, 25 bp, Mus musculus
cctgctcagcagatgcttctacctg

SEQ ID NO: 906973 - DNA, 25 bp, Mus musculus
cctgctcagcagtatcgggttgaga

SEQ ID NO: 906974 - DNA, 25 bp, Mus musculus
cctgctcagcagttgcttctacctg

SEQ ID NO: 906975 - DNA, 25 bp, Mus musculus
cctgctccagagcctcaacctggcc

SEQ ID NO: 906976 - DNA, 25 bp, Mus musculus
cctgctccagctcaccactcctttc

SEQ ID NO: 906977 - DNA, 25 bp, Mus musculus
cctgctccaggtcaccactcctttc

SEQ ID NO: 906978 - DNA, 25 bp, Mus musculus
cctgctccagtgcctcaacctggcc

SEQ ID NO: 906979 - DNA, 25 bp, Mus musculus
cctgctcccacacagagccaaccca

SEQ ID NO: 906980 - DNA, 25 bp, Mus musculus
cctgctcccacagagagccaaccca

SEQ ID NO: 906981 - DNA, 25 bp, Mus musculus
cctgctcccatgcttatcattgcaa

SEQ ID NO: 906982 - DNA, 25 bp, Mus musculus
cctgctcccatggttatcattgcaa

SEQ ID NO: 906983 - DNA, 25 bp, Mus musculus
cctgctcctcggagcggagctgatc

SEQ ID NO: 906984 - DNA, 25 bp, Mus musculus
cctgctcctcggtgcggagctgatc

SEQ ID NO: 906985 - DNA, 25 bp, Mus musculus
cctgctcgagcctatgaactcttat

SEQ ID NO: 906986 - DNA, 25 bp, Mus musculus
cctgctcgaggctatgaactcttat

SEQ ID NO: 906987 - DNA, 25 bp, Mus musculus
cctgctcgggccgactgaccgtggc

SEQ ID NO: 906988 - DNA, 25 bp, Mus musculus
cctgctcgggccgagtgaccgtggc

SEQ ID NO: 906989 - DNA, 25 bp, Mus musculus
cctgctctctcagcccatctcctcc

SEQ ID NO: 906990 - DNA, 25 bp, Mus musculus
cctgctctctcagcgcatctcctcc

SEQ ID NO: 906991 - DNA, 25 bp, Mus musculus
cctgctctggatgacagggagatga

SEQ ID NO: 906992 - DNA, 25 bp, Mus musculus
cctgctctggatgagagggagatga

SEQ ID NO: 906993 - DNA, 25 bp, Mus musculus
cctgctcttattaacgatacagcca

SEQ ID NO: 906994 - DNA, 25 bp, Mus musculus
cctgctcttattaaggatacagcca

SEQ ID NO: 906995 - DNA, 25 bp, Mus musculus
cctgctgaaattcgtgaattatgta

SEQ ID NO: 906996 - DNA, 25 bp, Mus musculus
cctgctgaaattggtgaattatgta

SEQ ID NO: 906997 - DNA, 25 bp, Mus musculus
cctgctgaacagagcctggatatgg

SEQ ID NO: 906998 - DNA, 25 bp, Mus musculus
cctgctgaacagtgcctggatatgg

SEQ ID NO: 906999 - DNA, 25 bp, Mus musculus
cctgctgagcacagactcagaaact

SEQ ID NO: 907000 - DNA, 25 bp, Mus musculus
cctgctgagcactgactcagaaact

SEQ ID NO: 907001 - DNA, 25 bp, Mus musculus
cctgctgatgcaagctgagaggtac

SEQ ID NO: 907002 - DNA, 25 bp, Mus musculus
cctgctgatgcatgctgagaggtac

SEQ ID NO: 907003 - DNA, 25 bp, Mus musculus
cctgctgcagaacagacccaagcca

SEQ ID NO: 907004 - DNA, 25 bp, Mus musculus
cctgctgcagaacgagtttgttgta

SEQ ID NO: 907005 - DNA, 25 bp, Mus musculus
cctgctgcagaagagacccaagcca

SEQ ID NO: 907006 - DNA, 25 bp, Mus musculus
cctgctgcagaaggagtttgttgta

SEQ ID NO: 907007 - DNA, 25 bp, Mus musculus
cctgctgcagcgcccagatattaca

SEQ ID NO: 907008 - DNA, 25 bp, Mus musculus
cctgctgcagggcccagatattaca

SEQ ID NO: 907009 - DNA, 25 bp, Mus musculus
cctgctgcctatcgctattgctatg

SEQ ID NO: 907010 - DNA, 25 bp, Mus musculus
cctgctgcctatggctattgctatg

SEQ ID NO: 907011 - DNA, 25 bp, Mus musculus
cctgctgctgcgcttcagctcaact

SEQ ID NO: 907012 - DNA, 25 bp, Mus musculus
cctgctgctgcggttcagctcaact

SEQ ID NO: 907013 - DNA, 25 bp, Mus musculus
cctgctgcttctcactcaggatggc

SEQ ID NO: 907014 - DNA, 25 bp, Mus musculus
cctgctgcttctcagtcaggatggc

SEQ ID NO: 907015 - DNA, 25 bp, Mus musculus
cctgctggaactctctaataaagaa

SEQ ID NO: 907016 - DNA, 25 bp, Mus musculus
cctgctggaagtctctaataaagaa

SEQ ID NO: 907017 - DNA, 25 bp, Mus musculus
cctgctgggcttctgtcttccaaaa

SEQ ID NO: 907018 - DNA, 25 bp, Mus musculus
cctgctgggcttgtgtcttccaaaa

SEQ ID NO: 907019 - DNA, 25 bp, Mus musculus
cctgctggtggtgaactaaagcacc

SEQ ID NO: 907020 - DNA, 25 bp, Mus musculus
cctgctggtggtgaactgctgtatc

SEQ ID NO: 907021 - DNA, 25 bp, Mus musculus
cctgctggtggtgaagtatatcatg

SEQ ID NO: 907022 - DNA, 25 bp, Mus musculus
cctgctggtggtgatctaaagcacc

SEQ ID NO: 907023 - DNA, 25 bp, Mus musculus
cctgctggtggtgatctgctgtatc

SEQ ID NO: 907024 - DNA, 25 bp, Mus musculus
cctgctggtggtgatgtatatcatg

SEQ ID NO: 907025 - DNA, 25 bp, Mus musculus
cctgctgtataccctggtcagcctg

SEQ ID NO: 907026 - DNA, 25 bp, Mus musculus
cctgctgtataccggtcagctgctg

SEQ ID NO: 907027 - DNA, 25 bp, Mus musculus
cctgctgtatacgctggtcagcctg

SEQ ID NO: 907028 - DNA, 25 bp, Mus musculus
cctgctgtatacgggtcagctgctg

SEQ ID NO: 907029 - DNA, 25 bp, Mus musculus
cctgctgtatgacatggcagctctc

SEQ ID NO: 907030 - DNA, 25 bp, Mus musculus
cctgctgtatgagatggcagctctc

SEQ ID NO: 907031 - DNA, 25 bp, Mus musculus
cctgctgtcactcgggtcactttcc

SEQ ID NO: 907032 - DNA, 25 bp, Mus musculus
cctgctgtcactggggtcactttcc

SEQ ID NO: 907033 - DNA, 25 bp, Mus musculus
cctgctgtccagaatgtgctggata

SEQ ID NO: 907034 - DNA, 25 bp, Mus musculus
cctgctgtccagtatgtgctggata

SEQ ID NO: 907035 - DNA, 25 bp, Mus musculus
cctgctgtcccacgtgctcctggtc

SEQ ID NO: 907036 - DNA, 25 bp, Mus musculus
cctgctgtcccaggtgctcctggtc

SEQ ID NO: 907037 - DNA, 25 bp, Mus musculus
cctgctgtctcacttcttcaacttt

SEQ ID NO: 907038 - DNA, 25 bp, Mus musculus
cctgctgtctcagttcttcaacttt

SEQ ID NO: 907039 - DNA, 25 bp, Mus musculus
cctgctgtgaaaacttctattccaa

SEQ ID NO: 907040 - DNA, 25 bp, Mus musculus
cctgctgtgaaatcttctattccaa

SEQ ID NO: 907041 - DNA, 25 bp, Mus musculus
cctgctgtgcccagaagtaacacag

SEQ ID NO: 907042 - DNA, 25 bp, Mus musculus
cctgctgtgcccagtagtaacacag

SEQ ID NO: 907043 - DNA, 25 bp, Mus musculus
cctgctgttctgcttccttgccttg

SEQ ID NO: 907044 - DNA, 25 bp, Mus musculus
cctgctgttctggttccttgccttg

SEQ ID NO: 907045 - DNA, 25 bp, Mus musculus
cctgcttactgacaaactcaagcca

SEQ ID NO: 907046 - DNA, 25 bp, Mus musculus
cctgcttactgagaaactcaagcca

SEQ ID NO: 907047 - DNA, 25 bp, Mus musculus
cctgcttcagcaagcttccctgttt

SEQ ID NO: 907048 - DNA, 25 bp, Mus musculus
cctgcttcaggaagcttccctgttt

SEQ ID NO: 907049 - DNA, 25 bp, Mus musculus
cctgcttcatgtctcgatgtgtcta

SEQ ID NO: 907050 - DNA, 25 bp, Mus musculus
cctgcttcatgtctggatgtgtcta

SEQ ID NO: 907051 - DNA, 25 bp, Mus musculus
cctgcttccgctgttccgaatgcca

SEQ ID NO: 907052 - DNA, 25 bp, Mus musculus
cctgcttccggtgttccgaatgcca

SEQ ID NO: 907053 - DNA, 25 bp, Mus musculus
cctgcttctgtccacgaccagacga

SEQ ID NO: 907054 - DNA, 25 bp, Mus musculus
cctgcttctgtccaggaccagacga

SEQ ID NO: 907055 - DNA, 25 bp, Mus musculus
cctgcttgaccacgtgttcttccag

SEQ ID NO: 907056 - DNA, 25 bp, Mus musculus
cctgcttgaccaggtgttcttccag

SEQ ID NO: 907057 - DNA, 25 bp, Mus musculus
cctgcttgccagcttttgctggaca

SEQ ID NO: 907058 - DNA, 25 bp, Mus musculus
cctgcttgccaggttttgctggaca

SEQ ID NO: 907059 - DNA, 25 bp, Mus musculus
cctgcttgtcaacacgaggagccat

SEQ ID NO: 907060 - DNA, 25 bp, Mus musculus
cctgcttgtcaacacggtccaggtg

SEQ ID NO: 907061 - DNA, 25 bp, Mus musculus
cctgcttgtcaacaggaggagccat

SEQ ID NO: 907062 - DNA, 25 bp, Mus musculus
cctgcttgtcaacagggtccaggtg

SEQ ID NO: 907063 - DNA, 25 bp, Mus musculus
cctggaaaatacagagcatacgatg

SEQ ID NO: 907064 - DNA, 25 bp, Mus musculus
cctggaaaatacagatctgtgtcag

SEQ ID NO: 907065 - DNA, 25 bp, Mus musculus
cctggaaaatacagtgcatacgatg

SEQ ID NO: 907066 - DNA, 25 bp, Mus musculus
cctggaaaatacagttctgtgtcag

SEQ ID NO: 907067 - DNA, 25 bp, Mus musculus
cctggaaaatatcacgaaggagatg

SEQ ID NO: 907068 - DNA, 25 bp, Mus musculus
cctggaaaatatcaggaaggagatg

SEQ ID NO: 907069 - DNA, 25 bp, Mus musculus
cctggaacaaagcatgtaatggagc

SEQ ID NO: 907070 - DNA, 25 bp, Mus musculus
cctggaacaaaggatgtaatggagc

SEQ ID NO: 907071 - DNA, 25 bp, Mus musculus
cctggaacagcccgaatctggttgg

SEQ ID NO: 907072 - DNA, 25 bp, Mus musculus
cctggaacagctgacatgtatgaag

SEQ ID NO: 907073 - DNA, 25 bp, Mus musculus
cctggaacaggccgaatctggttgg

SEQ ID NO: 907074 - DNA, 25 bp, Mus musculus
cctggaacaggtgacatgtatgaag

SEQ ID NO: 907075 - DNA, 25 bp, Mus musculus
cctggaacccaacaccatcttgggt

SEQ ID NO: 907076 - DNA, 25 bp, Mus musculus
cctggaacccaacagcatcttgggt

SEQ ID NO: 907077 - DNA, 25 bp, Mus musculus
cctggaagagaacgccctgatggcc

SEQ ID NO: 907078 - DNA, 25 bp, Mus musculus
cctggaagagaaggccctgatggcc

SEQ ID NO: 907079 - DNA, 25 bp, Mus musculus
cctggaaggaacaatgctgttggct

SEQ ID NO: 907080 - DNA, 25 bp, Mus musculus
cctggaaggaactatgctgttggct

SEQ ID NO: 907081 - DNA, 25 bp, Mus musculus
cctggaaggagtctgaaggaagagg

SEQ ID NO: 907082 - DNA, 25 bp, Mus musculus
cctggaaggagtgtgaaggaagagg

SEQ ID NO: 907083 - DNA, 25 bp, Mus musculus
cctggaagggctcacccagagtaac

SEQ ID NO: 907084 - DNA, 25 bp, Mus musculus
cctggaagggctcagccagagtaac

SEQ ID NO: 907085 - DNA, 25 bp, Mus musculus
cctggacaacttcggctacagaaca

SEQ ID NO: 907086 - DNA, 25 bp, Mus musculus
cctggacaacttgggctacagaaca

SEQ ID NO: 907087 - DNA, 25 bp, Mus musculus
cctggacaagatcctggaccagact

SEQ ID NO: 907088 - DNA, 25 bp, Mus musculus
cctggacaagatgctggaccagact

SEQ ID NO: 907089 - DNA, 25 bp, Mus musculus
cctggacaagctgtggccagcgtca

SEQ ID NO: 907090 - DNA, 25 bp, Mus musculus
cctggacaaggtgtggccagcgtca

SEQ ID NO: 907091 - DNA, 25 bp, Mus musculus
cctggacagcagcacgttcttcgtc

SEQ ID NO: 907092 - DNA, 25 bp, Mus musculus
cctggacagcagcaggttcttcgtc

SEQ ID NO: 907093 - DNA, 25 bp, Mus musculus
cctggaccagaaccaggatggctgc

SEQ ID NO: 907094 - DNA, 25 bp, Mus musculus
cctggaccagaacctggatggctgc

SEQ ID NO: 907095 - DNA, 25 bp, Mus musculus
cctggaccagctgccggcctgtcaa

SEQ ID NO: 907096 - DNA, 25 bp, Mus musculus
cctggaccagctgcgggcctgtcaa

SEQ ID NO: 907097 - DNA, 25 bp, Mus musculus
cctggacctacaacaccacctctgc

SEQ ID NO: 907098 - DNA, 25 bp, Mus musculus
cctggacctacatcaccacctctgc

SEQ ID NO: 907099 - DNA, 25 bp, Mus musculus
cctggacgaactgctctctagacgg

SEQ ID NO: 907100 - DNA, 25 bp, Mus musculus
cctggacgaagtgctctctagacgg

SEQ ID NO: 907101 - DNA, 25 bp, Mus musculus
cctggacgaccgaatctggactaga

SEQ ID NO: 907102 - DNA, 25 bp, Mus musculus
cctggacgaccgccgtgtgcagcct

SEQ ID NO: 907103 - DNA, 25 bp, Mus musculus
cctggacgaccggcgtgtgcagcct

SEQ ID NO: 907104 - DNA, 25 bp, Mus musculus
cctggacgaccgtatctggactaga

SEQ ID NO: 907105 - DNA, 25 bp, Mus musculus
cctggacgcacacgcctcctgtgcc

SEQ ID NO: 907106 - DNA, 25 bp, Mus musculus
cctggacgcacaggcctcctgtgcc

SEQ ID NO: 907107 - DNA, 25 bp, Mus musculus
cctggacggctgctggatgcaggca

SEQ ID NO: 907108 - DNA, 25 bp, Mus musculus
cctggacggctggtggatgcaggca

SEQ ID NO: 907109 - DNA, 25 bp, Mus musculus
cctggactaaggatcaccactactt

SEQ ID NO: 907110 - DNA, 25 bp, Mus musculus
cctggactaaggttcaccactactt

SEQ ID NO: 907111 - DNA, 25 bp, Mus musculus
cctggactcaggctagatggaatgg

SEQ ID NO: 907112 - DNA, 25 bp, Mus musculus
cctggactcagggtagatggaatgg

SEQ ID NO: 907113 - DNA, 25 bp, Mus musculus
cctggactcattttcgccaccccgt

SEQ ID NO: 907114 - DNA, 25 bp, Mus musculus
cctggactcattttggccaccccgt

SEQ ID NO: 907115 - DNA, 25 bp, Mus musculus
cctggactgatgcgaaggaggccat

SEQ ID NO: 907116 - DNA, 25 bp, Mus musculus
cctggactgatgggaaggaggccat

SEQ ID NO: 907117 - DNA, 25 bp, Mus musculus
cctggacttcaacgagaatccggag

SEQ ID NO: 907118 - DNA, 25 bp, Mus musculus
cctggacttcaaggagaatccggag

SEQ ID NO: 907119 - DNA, 25 bp, Mus musculus
cctggagaaagacgctgccactcgc

SEQ ID NO: 907120 - DNA, 25 bp, Mus musculus
cctggagaaagacgtggaggtgatt

SEQ ID NO: 907121 - DNA, 25 bp, Mus musculus
cctggagaaagaggctgccactcgc

SEQ ID NO: 907122 - DNA, 25 bp, Mus musculus
cctggagaaagaggtggaggtgatt

SEQ ID NO: 907123 - DNA, 25 bp, Mus musculus
cctggagaagattgaacagcaactc

SEQ ID NO: 907124 - DNA, 25 bp, Mus musculus
cctggagaagccaccagcagtcacc

SEQ ID NO: 907125 - DNA, 25 bp, Mus musculus
cctggagaagctcccacctgctcgc

SEQ ID NO: 907126 - DNA, 25 bp, Mus musculus
cctggagaaggcaccagcagtcacc

SEQ ID NO: 907127 - DNA, 25 bp, Mus musculus
cctggagaaggtcccacctgctcgc

SEQ ID NO: 907128 - DNA, 25 bp, Mus musculus
cctggagaagtttgaacagcaactc

SEQ ID NO: 907129 - DNA, 25 bp, Mus musculus
cctggagaatagctcctgtatcagc

SEQ ID NO: 907130 - DNA, 25 bp, Mus musculus
cctggagaattgctcctgtatcagc

SEQ ID NO: 907131 - DNA, 25 bp, Mus musculus
cctggagacaagctacgcatggagt

SEQ ID NO: 907132 - DNA, 25 bp, Mus musculus
cctggagacaaggtacgcatggagt

SEQ ID NO: 907133 - DNA, 25 bp, Mus musculus
cctggagacaggcgtcccattggcc

SEQ ID NO: 907134 - DNA, 25 bp, Mus musculus
cctggagacaggggtcccattggcc

SEQ ID NO: 907135 - DNA, 25 bp, Mus musculus
cctggagacgctgacgcatggcagt

SEQ ID NO: 907136 - DNA, 25 bp, Mus musculus
cctggagacgctgaggcatggcagt

SEQ ID NO: 907137 - DNA, 25 bp, Mus musculus
cctggagaggagcgtctagagacat

SEQ ID NO: 907138 - DNA, 25 bp, Mus musculus
cctggagaggagggtctagagacat

SEQ ID NO: 907139 - DNA, 25 bp, Mus musculus
cctggagcagcaacagctcccaagc

SEQ ID NO: 907140 - DNA, 25 bp, Mus musculus
cctggagcagccccaggctgaagct

SEQ ID NO: 907141 - DNA, 25 bp, Mus musculus
cctggagcaggaacagctcccaagc

SEQ ID NO: 907142 - DNA, 25 bp, Mus musculus
cctggagcaggcccaggctgaagct

SEQ ID NO: 907143 - DNA, 25 bp, Mus musculus
cctggagccagcaactccaacaagc

SEQ ID NO: 907144 - DNA, 25 bp, Mus musculus
cctggagccagcaagtccaacaagc

SEQ ID NO: 907145 - DNA, 25 bp, Mus musculus
cctggagctgcttaagtaccaccct

SEQ ID NO: 907146 - DNA, 25 bp, Mus musculus
cctggagctgcttatgtaccaccct

SEQ ID NO: 907147 - DNA, 25 bp, Mus musculus
cctggagctgtgcaaggtccaaacc

SEQ ID NO: 907148 - DNA, 25 bp, Mus musculus
cctggagctgtggaaggtccaaacc

SEQ ID NO: 907149 - DNA, 25 bp, Mus musculus
cctggaggagatcttcctaaaggtg

SEQ ID NO: 907150 - DNA, 25 bp, Mus musculus
cctggaggagttcttcctaaaggtg

SEQ ID NO: 907151 - DNA, 25 bp, Mus musculus
cctggaggagttgacttaaaagaag

SEQ ID NO: 907152 - DNA, 25 bp, Mus musculus
cctggaggagttgagttaaaagaag

SEQ ID NO: 907153 - DNA, 25 bp, Mus musculus
cctggagggcgtcgtcagtatcgac

SEQ ID NO: 907154 - DNA, 25 bp, Mus musculus
cctggagggcgtggtcagtatcgac

SEQ ID NO: 907155 - DNA, 25 bp, Mus musculus
cctggaggtcagcgtggcagtggtg

SEQ ID NO: 907156 - DNA, 25 bp, Mus musculus
cctggaggtcagggtggcagtggtg

SEQ ID NO: 907157 - DNA, 25 bp, Mus musculus
cctggagtaacgcgactgcaaggac

SEQ ID NO: 907158 - DNA, 25 bp, Mus musculus
cctggagtaacgggactgcaaggac

SEQ ID NO: 907159 - DNA, 25 bp, Mus musculus
cctggagtagcaccaccttctgacc

SEQ ID NO: 907160 - DNA, 25 bp, Mus musculus
cctggagtagcagcaccttctgacc

SEQ ID NO: 907161 - DNA, 25 bp, Mus musculus
cctggagtccatctgtaaagagctg

SEQ ID NO: 907162 - DNA, 25 bp, Mus musculus
cctggagtccatgtgtaaagagctg

SEQ ID NO: 907163 - DNA, 25 bp, Mus musculus
cctggagttccgcgaaaggcaggcg

SEQ ID NO: 907164 - DNA, 25 bp, Mus musculus
cctggagttccgggaaaggcaggcg

SEQ ID NO: 907165 - DNA, 25 bp, Mus musculus
cctggatagacgagaagttgttacg

SEQ ID NO: 907166 - DNA, 25 bp, Mus musculus
cctggatagaggagaagttgttacg

SEQ ID NO: 907167 - DNA, 25 bp, Mus musculus
cctggatatatgccggtgataactt

SEQ ID NO: 907168 - DNA, 25 bp, Mus musculus
cctggatatatggcggtgataactt

SEQ ID NO: 907169 - DNA, 25 bp, Mus musculus
cctggatcatataatagagaagaag

SEQ ID NO: 907170 - DNA, 25 bp, Mus musculus
cctggatcatattatagagaagaag

SEQ ID NO: 907171 - DNA, 25 bp, Mus musculus
cctggatgaaagataagcagtccct

SEQ ID NO: 907172 - DNA, 25 bp, Mus musculus
cctggatgaaagctcgagatttcag

SEQ ID NO: 907173 - DNA, 25 bp, Mus musculus
cctggatgaaaggtcgagatttcag

SEQ ID NO: 907174 - DNA, 25 bp, Mus musculus
cctggatgaaagttaagcagtccct

SEQ ID NO: 907175 - DNA, 25 bp, Mus musculus
cctggatgagatgaagttctccttg

SEQ ID NO: 907176 - DNA, 25 bp, Mus musculus
cctggatgagccattcgtgactggg

SEQ ID NO: 907177 - DNA, 25 bp, Mus musculus
cctggatgaggcattcgtgactggg

SEQ ID NO: 907178 - DNA, 25 bp, Mus musculus
cctggatgagttgaagttctccttg

SEQ ID NO: 907179 - DNA, 25 bp, Mus musculus
cctggatgcagtcgtgaatgtgatg

SEQ ID NO: 907180 - DNA, 25 bp, Mus musculus
cctggatgcagtggtgaatgtgatg

SEQ ID NO: 907181 - DNA, 25 bp, Mus musculus
cctggatgcgtctacgtcttccaag

SEQ ID NO: 907182 - DNA, 25 bp, Mus musculus
cctggatgcgtctaggtcttccaag

SEQ ID NO: 907183 - DNA, 25 bp, Mus musculus
cctggatgctgtgacacatgcaaga

SEQ ID NO: 907184 - DNA, 25 bp, Mus musculus
cctggatgctgtgagacatgcaaga

SEQ ID NO: 907185 - DNA, 25 bp, Mus musculus
cctggatgtcaacccggagaacctg

SEQ ID NO: 907186 - DNA, 25 bp, Mus musculus
cctggatgtcaagccggagaacctg

SEQ ID NO: 907187 - DNA, 25 bp, Mus musculus
cctggatttaaccacagctgtctgt

SEQ ID NO: 907188 - DNA, 25 bp, Mus musculus
cctggatttaaccagagctgtctgt

SEQ ID NO: 907189 - DNA, 25 bp, Mus musculus
cctggcaatctaccttctttggttt

SEQ ID NO: 907190 - DNA, 25 bp, Mus musculus
cctggcaatctagcttctttggttt

SEQ ID NO: 907191 - DNA, 25 bp, Mus musculus
cctggcacagaaacatcatccaaga

SEQ ID NO: 907192 - DNA, 25 bp, Mus musculus
cctggcacagaagccttcagggaga

SEQ ID NO: 907193 - DNA, 25 bp, Mus musculus
cctggcacagagaacctgtgctcaa

SEQ ID NO: 907194 - DNA, 25 bp, Mus musculus
cctggcacagcaagcttccctggca

SEQ ID NO: 907195 - DNA, 25 bp, Mus musculus
cctggcacagctacaaagtgaaata

SEQ ID NO: 907196 - DNA, 25 bp, Mus musculus
cctggcacaggaagcttccctggca

SEQ ID NO: 907197 - DNA, 25 bp, Mus musculus
cctggcacaggtacaaagtgaaata

SEQ ID NO: 907198 - DNA, 25 bp, Mus musculus
cctggcacagtaacatcatccaaga

SEQ ID NO: 907199 - DNA, 25 bp, Mus musculus
cctggcacagtagccttcagggaga

SEQ ID NO: 907200 - DNA, 25 bp, Mus musculus
cctggcacagtgaacctgtgctcaa

SEQ ID NO: 907201 - DNA, 25 bp, Mus musculus
cctggcactgcaagtttccccagca

SEQ ID NO: 907202 - DNA, 25 bp, Mus musculus
cctggcactggaagtttccccagca

SEQ ID NO: 907203 - DNA, 25 bp, Mus musculus
cctggcagagaccgagggcatgctc

SEQ ID NO: 907204 - DNA, 25 bp, Mus musculus
cctggcagagacggagggcatgctc

SEQ ID NO: 907205 - DNA, 25 bp, Mus musculus
cctggcagagctcgcatctctcggg

SEQ ID NO: 907206 - DNA, 25 bp, Mus musculus
cctggcagaggacaagtcttcgttg

SEQ ID NO: 907207 - DNA, 25 bp, Mus musculus
cctggcagaggacatgtcttcgttg

SEQ ID NO: 907208 - DNA, 25 bp, Mus musculus
cctggcagaggacgtttccaagcta

SEQ ID NO: 907209 - DNA, 25 bp, Mus musculus
cctggcagaggaggtttccaagcta

SEQ ID NO: 907210 - DNA, 25 bp, Mus musculus
cctggcagaggtcgcatctctcggg

SEQ ID NO: 907211 - DNA, 25 bp, Mus musculus
cctggcagccccacagactgaagtt

SEQ ID NO: 907212 - DNA, 25 bp, Mus musculus
cctggcagccccacagcagactgaa

SEQ ID NO: 907213 - DNA, 25 bp, Mus musculus
cctggcagcccctcagactgaagtt

SEQ ID NO: 907214 - DNA, 25 bp, Mus musculus
cctggcagcccctcagcagactgaa

SEQ ID NO: 907215 - DNA, 25 bp, Mus musculus
cctggcagctactccggacccgcag

SEQ ID NO: 907216 - DNA, 25 bp, Mus musculus
cctggcagctactcgggacccgcag

SEQ ID NO: 907217 - DNA, 25 bp, Mus musculus
cctggcaggatgcgagcctcctgcc

SEQ ID NO: 907218 - DNA, 25 bp, Mus musculus
cctggcaggatgcgccaccgctgac

SEQ ID NO: 907219 - DNA, 25 bp, Mus musculus
cctggcaggatgggagcctcctgcc

SEQ ID NO: 907220 - DNA, 25 bp, Mus musculus
cctggcaggatgggccaccgctgac

SEQ ID NO: 907221 - DNA, 25 bp, Mus musculus
cctggcatggctatgtgagtgacat

SEQ ID NO: 907222 - DNA, 25 bp, Mus musculus
cctggcatggctttgtgagtgacat

SEQ ID NO: 907223 - DNA, 25 bp, Mus musculus
cctggcattaagcgctccacggggc

SEQ ID NO: 907224 - DNA, 25 bp, Mus musculus
cctggcattaagggctccacggggc

SEQ ID NO: 907225 - DNA, 25 bp, Mus musculus
cctggccaaaaccgcatttgatgag

SEQ ID NO: 907226 - DNA, 25 bp, Mus musculus
cctggccaaaacggcatttgatgag

SEQ ID NO: 907227 - DNA, 25 bp, Mus musculus
cctggccaagaaccgcctctatcag

SEQ ID NO: 907228 - DNA, 25 bp, Mus musculus
cctggccaagctcctggacaatact

SEQ ID NO: 907229 - DNA, 25 bp, Mus musculus
cctggccaaggtcctggacaatact

SEQ ID NO: 907230 - DNA, 25 bp, Mus musculus
cctggccaagtaccgcctctatcag

SEQ ID NO: 907231 - DNA, 25 bp, Mus musculus
cctggccaccagcacgtgtctccct

SEQ ID NO: 907232 - DNA, 25 bp, Mus musculus
cctggccaccagcaggtgtctccct

SEQ ID NO: 907233 - DNA, 25 bp, Mus musculus
cctggccaccagcataaagcatgag

SEQ ID NO: 907234 - DNA, 25 bp, Mus musculus
cctggccaccagccccactctgccc

SEQ ID NO: 907235 - DNA, 25 bp, Mus musculus
cctggccaccaggataaagcatgag

SEQ ID NO: 907236 - DNA, 25 bp, Mus musculus
cctggccaccaggcccactctgccc

SEQ ID NO: 907237 - DNA, 25 bp, Mus musculus
cctggccacgaccttctacaattac

SEQ ID NO: 907238 - DNA, 25 bp, Mus musculus
cctggccacgtccttctacaattac

SEQ ID NO: 907239 - DNA, 25 bp, Mus musculus
cctggccagtgaacttctagagtgg

SEQ ID NO: 907240 - DNA, 25 bp, Mus musculus
cctggccagtgatcttctagagtgg

SEQ ID NO: 907241 - DNA, 25 bp, Mus musculus
cctggccatgcacgcccaggacccc

SEQ ID NO: 907242 - DNA, 25 bp, Mus musculus
cctggccatgcaggcccaggacccc

SEQ ID NO: 907243 - DNA, 25 bp, Mus musculus
cctggccatgtccaaagataacatg

SEQ ID NO: 907244 - DNA, 25 bp, Mus musculus
cctggccatgtcgaaagataacatg

SEQ ID NO: 907245 - DNA, 25 bp, Mus musculus
cctggcccagcaaccttccctggca

SEQ ID NO: 907246 - DNA, 25 bp, Mus musculus
cctggcccagcaagcttccctggca

SEQ ID NO: 907247 - DNA, 25 bp, Mus musculus
cctggcccagcttccctggcacagg

SEQ ID NO: 907248 - DNA, 25 bp, Mus musculus
cctggcccaggaaccttccctggca

SEQ ID NO: 907249 - DNA, 25 bp, Mus musculus
cctggcccaggaagcttccctggca

SEQ ID NO: 907250 - DNA, 25 bp, Mus musculus
cctggcccaggttccctggcacagg

SEQ ID NO: 907251 - DNA, 25 bp, Mus musculus
cctggcccagtgcgtagccatggag

SEQ ID NO: 907252 - DNA, 25 bp, Mus musculus
cctggcccagtgggtagccatggag

SEQ ID NO: 907253 - DNA, 25 bp, Mus musculus
cctggccccaagctggccattgaag

SEQ ID NO: 907254 - DNA, 25 bp, Mus musculus
cctggccccaaggtggccattgaag

SEQ ID NO: 907255 - DNA, 25 bp, Mus musculus
cctggcccccaacgccatgaagaag

SEQ ID NO: 907256 - DNA, 25 bp, Mus musculus
cctggcccccaaggccatgaagaag

SEQ ID NO: 907257 - DNA, 25 bp, Mus musculus
cctggcccctgacgtgctggaggac

SEQ ID NO: 907258 - DNA, 25 bp, Mus musculus
cctggcccctgaggtgctggaggac

SEQ ID NO: 907259 - DNA, 25 bp, Mus musculus
cctggccctcaccgtatatgctatg

SEQ ID NO: 907260 - DNA, 25 bp, Mus musculus
cctggccctcacggtatatgctatg

SEQ ID NO: 907261 - DNA, 25 bp, Mus musculus
cctggccgagcaagccgagataccc

SEQ ID NO: 907262 - DNA, 25 bp, Mus musculus
cctggccgaggaagccgagataccc

SEQ ID NO: 907263 - DNA, 25 bp, Mus musculus
cctggccggcctccatcaacaaata

SEQ ID NO: 907264 - DNA, 25 bp, Mus musculus
cctggccggcctccttcaacaaata

SEQ ID NO: 907265 - DNA, 25 bp, Mus musculus
cctggcctcatcaacgacgttctct

SEQ ID NO: 907266 - DNA, 25 bp, Mus musculus
cctggcctcatcaaggacgttctct

SEQ ID NO: 907267 - DNA, 25 bp, Mus musculus
cctggcctccggataaagatagaga

SEQ ID NO: 907268 - DNA, 25 bp, Mus musculus
cctggcctccggctttgtattgagg

SEQ ID NO: 907269 - DNA, 25 bp, Mus musculus
cctggcctccgggtttgtattgagg

SEQ ID NO: 907270 - DNA, 25 bp, Mus musculus
cctggcctccggttaaagatagaga

SEQ ID NO: 907271 - DNA, 25 bp, Mus musculus
cctggcctgaagatggatcaccaac

SEQ ID NO: 907272 - DNA, 25 bp, Mus musculus
cctggcctgaagttggatcaccaac

SEQ ID NO: 907273 - DNA, 25 bp, Mus musculus
cctggcctgtgagactgtggacatt

SEQ ID NO: 907274 - DNA, 25 bp, Mus musculus
cctggcctgtgagagtgtggacatt

SEQ ID NO: 907275 - DNA, 25 bp, Mus musculus
cctggccttccacgtgaaagaggcc

SEQ ID NO: 907276 - DNA, 25 bp, Mus musculus
cctggccttccaggtgaaagaggcc

SEQ ID NO: 907277 - DNA, 25 bp, Mus musculus
cctggcgcaggacctagtatgttca

SEQ ID NO: 907278 - DNA, 25 bp, Mus musculus
cctggcgcaggagctagtatgttca

SEQ ID NO: 907279 - DNA, 25 bp, Mus musculus
cctggcgccccacagcttgaggagg

SEQ ID NO: 907280 - DNA, 25 bp, Mus musculus
cctggcgccccagagcttgaggagg

SEQ ID NO: 907281 - DNA, 25 bp, Mus musculus
cctggcggacagcctgggccgtcgg

SEQ ID NO: 907282 - DNA, 25 bp, Mus musculus
cctggcggacaggctgggccgtcgg

SEQ ID NO: 907283 - DNA, 25 bp, Mus musculus
cctggcggttcacaagagcaagatg

SEQ ID NO: 907284 - DNA, 25 bp, Mus musculus
cctggcggttgacaagagcaagatg

SEQ ID NO: 907285 - DNA, 25 bp, Mus musculus
cctggcgttacacgcttcagtctag

SEQ ID NO: 907286 - DNA, 25 bp, Mus musculus
cctggcgttacaggcttcagtctag

SEQ ID NO: 907287 - DNA, 25 bp, Mus musculus
cctggctaagcaagcttccctgttt

SEQ ID NO: 907288 - DNA, 25 bp, Mus musculus
cctggctaaggaagcttccctgttt

SEQ ID NO: 907289 - DNA, 25 bp, Mus musculus
cctggctcaaactaagtggcctgct

SEQ ID NO: 907290 - DNA, 25 bp, Mus musculus
cctggctcaaactatgtggcctgct

SEQ ID NO: 907291 - DNA, 25 bp, Mus musculus
cctggctccaatccatgaggcgccc

SEQ ID NO: 907292 - DNA, 25 bp, Mus musculus
cctggctccactctgttctcctggc

SEQ ID NO: 907293 - DNA, 25 bp, Mus musculus
cctggctccagtctgttctcctggc

SEQ ID NO: 907294 - DNA, 25 bp, Mus musculus
cctggctccattccatgaggcgccc

SEQ ID NO: 907295 - DNA, 25 bp, Mus musculus
cctggctgaggacctcctttcttat

SEQ ID NO: 907296 - DNA, 25 bp, Mus musculus
cctggctgaggacctcggatgggtc

SEQ ID NO: 907297 - DNA, 25 bp, Mus musculus
cctggctgaggagctcctttcttat

SEQ ID NO: 907298 - DNA, 25 bp, Mus musculus
cctggctgaggagctcggatgggtc

SEQ ID NO: 907299 - DNA, 25 bp, Mus musculus
cctggctgtgcgtggtgagaagcta

SEQ ID NO: 907300 - DNA, 25 bp, Mus musculus
cctggctgtgggtggtgagaagcta

SEQ ID NO: 907301 - DNA, 25 bp, Mus musculus
cctggctgttctaacacccacctgc

SEQ ID NO: 907302 - DNA, 25 bp, Mus musculus
cctggctgttctaagacccacctgc

SEQ ID NO: 907303 - DNA, 25 bp, Mus musculus
cctggcttatctgacgtggggaaag

SEQ ID NO: 907304 - DNA, 25 bp, Mus musculus
cctggcttatctgaggtggggaaag

SEQ ID NO: 907305 - DNA, 25 bp, Mus musculus
cctggcttggatcttgtctacatag

SEQ ID NO: 907306 - DNA, 25 bp, Mus musculus
cctggcttggttcttgtctacatag

SEQ ID NO: 907307 - DNA, 25 bp, Mus musculus
cctgggaaacaatatctatcagtgg

SEQ ID NO: 907308 - DNA, 25 bp, Mus musculus
cctgggaaactatatctatcagtgg

SEQ ID NO: 907309 - DNA, 25 bp, Mus musculus
cctgggaaagctgtggtatctcttg

SEQ ID NO: 907310 - DNA, 25 bp, Mus musculus
cctgggaaaggtgtggtatctcttg

SEQ ID NO: 907311 - DNA, 25 bp, Mus musculus
cctgggaaagtgaacgactttctca

SEQ ID NO: 907312 - DNA, 25 bp, Mus musculus
cctgggaaagtgaaggactttctca

SEQ ID NO: 907313 - DNA, 25 bp, Mus musculus
cctgggaatgcacaccagcagtgca

SEQ ID NO: 907314 - DNA, 25 bp, Mus musculus
cctgggaatgcacaccagtgcacaa

SEQ ID NO: 907315 - DNA, 25 bp, Mus musculus
cctgggaatgcacagcagcagtgca

SEQ ID NO: 907316 - DNA, 25 bp, Mus musculus
cctgggaatgcacagcagtgcacaa

SEQ ID NO: 907317 - DNA, 25 bp, Mus musculus
cctgggacagagccgagcaacaagg

SEQ ID NO: 907318 - DNA, 25 bp, Mus musculus
cctgggacagaggcgagcaacaagg

SEQ ID NO: 907319 - DNA, 25 bp, Mus musculus
cctgggaccaactccgtacctgagc

SEQ ID NO: 907320 - DNA, 25 bp, Mus musculus
cctgggaccaactcggtacctgagc

SEQ ID NO: 907321 - DNA, 25 bp, Mus musculus
cctgggagaacacatacaaaggatg

SEQ ID NO: 907322 - DNA, 25 bp, Mus musculus
cctgggagaacagatacaaaggatg

SEQ ID NO: 907323 - DNA, 25 bp, Mus musculus
cctgggagcttgccaaacgcggagc

SEQ ID NO: 907324 - DNA, 25 bp, Mus musculus
cctgggagcttgcctaacgcggagc

SEQ ID NO: 907325 - DNA, 25 bp, Mus musculus
cctgggatctcagacggatttgacc

SEQ ID NO: 907326 - DNA, 25 bp, Mus musculus
cctgggatctcagagggatttgacc

SEQ ID NO: 907327 - DNA, 25 bp, Mus musculus
cctgggcacacacgccagcggtgtg

SEQ ID NO: 907328 - DNA, 25 bp, Mus musculus
cctgggcacacaggccagcggtgtg

SEQ ID NO: 907329 - DNA, 25 bp, Mus musculus
cctgggcaggagatgcagtgggact

SEQ ID NO: 907330 - DNA, 25 bp, Mus musculus
cctgggcaggagttgcagtgggact

SEQ ID NO: 907331 - DNA, 25 bp, Mus musculus
cctgggcaggcatccctgctgcctt

SEQ ID NO: 907332 - DNA, 25 bp, Mus musculus
cctgggcagggatccctgctgcctt

SEQ ID NO: 907333 - DNA, 25 bp, Mus musculus
cctgggcctcaactccccaagactt

SEQ ID NO: 907334 - DNA, 25 bp, Mus musculus
cctgggcctcaagtccccaagactt

SEQ ID NO: 907335 - DNA, 25 bp, Mus musculus
cctgggcgcgcacgatgcacctggc

SEQ ID NO: 907336 - DNA, 25 bp, Mus musculus
cctgggcgcgcaggatgcacctggc

SEQ ID NO: 907337 - DNA, 25 bp, Mus musculus
cctgggctactgcagacatggaagc

SEQ ID NO: 907338 - DNA, 25 bp, Mus musculus
cctgggctactggagacatggaagc

SEQ ID NO: 907339 - DNA, 25 bp, Mus musculus
cctgggctctgtcggggcagctggc

SEQ ID NO: 907340 - DNA, 25 bp, Mus musculus
cctgggctctgtgggggcagctggc

SEQ ID NO: 907341 - DNA, 25 bp, Mus musculus
cctgggctgcaactgggtgctgtac

SEQ ID NO: 907342 - DNA, 25 bp, Mus musculus
cctgggctgcaagtgggtgctgtac

SEQ ID NO: 907343 - DNA, 25 bp, Mus musculus
cctgggctgtcgtggtgagaagcta

SEQ ID NO: 907344 - DNA, 25 bp, Mus musculus
cctgggctgtggtggtgagaagcta

SEQ ID NO: 907345 - DNA, 25 bp, Mus musculus
cctgggcttccacttcacacctgcc

SEQ ID NO: 907346 - DNA, 25 bp, Mus musculus
cctgggcttccagttcacacctgcc

SEQ ID NO: 907347 - DNA, 25 bp, Mus musculus
cctggggaacatcacatcattcagt

SEQ ID NO: 907348 - DNA, 25 bp, Mus musculus
cctggggaacatcagatcattcagt

SEQ ID NO: 907349 - DNA, 25 bp, Mus musculus
cctggggaagatatatgaagcctac

SEQ ID NO: 907350 - DNA, 25 bp, Mus musculus
cctggggaagttatatgaagcctac

SEQ ID NO: 907351 - DNA, 25 bp, Mus musculus
cctggggaccctctcctccatccag

SEQ ID NO: 907352 - DNA, 25 bp, Mus musculus
cctggggaccctgtcctccatccag

SEQ ID NO: 907353 - DNA, 25 bp, Mus musculus
cctggggataattgccctgtggaag

SEQ ID NO: 907354 - DNA, 25 bp, Mus musculus
cctggggataattggcctgtggaag

SEQ ID NO: 907355 - DNA, 25 bp, Mus musculus
cctggggatgctgtgaccccacaac

SEQ ID NO: 907356 - DNA, 25 bp, Mus musculus
cctggggatggtgtgaccccacaac

SEQ ID NO: 907357 - DNA, 25 bp, Mus musculus
cctggggccatgatcagtacctata

SEQ ID NO: 907358 - DNA, 25 bp, Mus musculus
cctggggccatgatgagtacctata

SEQ ID NO: 907359 - DNA, 25 bp, Mus musculus
cctggggccccatccgaagctcaga

SEQ ID NO: 907360 - DNA, 25 bp, Mus musculus
cctggggccccatcggaagctcaga

SEQ ID NO: 907361 - DNA, 25 bp, Mus musculus
cctgggggagctctcagatactccc

SEQ ID NO: 907362 - DNA, 25 bp, Mus musculus
cctgggggaggtctcagatactccc

SEQ ID NO: 907363 - DNA, 25 bp, Mus musculus
cctgggggccaactgctcaccgagt

SEQ ID NO: 907364 - DNA, 25 bp, Mus musculus
cctgggggccaagtgctcaccgagt

SEQ ID NO: 907365 - DNA, 25 bp, Mus musculus
cctgggtacaagccaaaggtcattc

SEQ ID NO: 907366 - DNA, 25 bp, Mus musculus
cctgggtacaaggcaaaggtcattc

SEQ ID NO: 907367 - DNA, 25 bp, Mus musculus
cctgggtccgacagcatggaaagcc

SEQ ID NO: 907368 - DNA, 25 bp, Mus musculus
cctgggtccgacaggatggaaagcc

SEQ ID NO: 907369 - DNA, 25 bp, Mus musculus
cctgggtcgcagctggcatgcacta

SEQ ID NO: 907370 - DNA, 25 bp, Mus musculus
cctgggtcgcaggtggcatgcacta

SEQ ID NO: 907371 - DNA, 25 bp, Mus musculus
cctgggtctgcagccatggcaatga

SEQ ID NO: 907372 - DNA, 25 bp, Mus musculus
cctgggtctgccatggcaatgacag

SEQ ID NO: 907373 - DNA, 25 bp, Mus musculus
cctgggtctggagccatggcaatga

SEQ ID NO: 907374 - DNA, 25 bp, Mus musculus
cctgggtctggcatggcaatgacag

SEQ ID NO: 907375 - DNA, 25 bp, Mus musculus
cctgggtgcccgcgatgaaagtggg

SEQ ID NO: 907376 - DNA, 25 bp, Mus musculus
cctgggtgcccgggatgaaagtggg

SEQ ID NO: 907377 - DNA, 25 bp, Mus musculus
cctgggtgcctacacagaagcggtc

SEQ ID NO: 907378 - DNA, 25 bp, Mus musculus
cctgggtgcctacagagaagcggtc

SEQ ID NO: 907379 - DNA, 25 bp, Mus musculus
cctgggtggacacgtgagcaatgcc

SEQ ID NO: 907380 - DNA, 25 bp, Mus musculus
cctgggtggacaggtgagcaatgcc

SEQ ID NO: 907381 - DNA, 25 bp, Mus musculus
cctgggtggtccaacggtcaagtat

SEQ ID NO: 907382 - DNA, 25 bp, Mus musculus
cctgggtggtccaagggtcaagtat

SEQ ID NO: 907383 - DNA, 25 bp, Mus musculus
cctgggtgtgaaaccggacttgcca

SEQ ID NO: 907384 - DNA, 25 bp, Mus musculus
cctgggtgtgtaaccggacttgcca

SEQ ID NO: 907385 - DNA, 25 bp, Mus musculus
cctgggttcacacacgagtgccagg

SEQ ID NO: 907386 - DNA, 25 bp, Mus musculus
cctgggttcacacaggagtgccagg

SEQ ID NO: 907387 - DNA, 25 bp, Mus musculus
cctggtacagaccatattaaccagc

SEQ ID NO: 907388 - DNA, 25 bp, Mus musculus
cctggtacagaccatattgatcagt

SEQ ID NO: 907389 - DNA, 25 bp, Mus musculus
cctggtacagacgatattaaccagc

SEQ ID NO: 907390 - DNA, 25 bp, Mus musculus
cctggtacagacgatattgatcagt

SEQ ID NO: 907391 - DNA, 25 bp, Mus musculus
cctggtacagcaagcttccctgttt

SEQ ID NO: 907392 - DNA, 25 bp, Mus musculus
cctggtacagcaagctttcctggca

SEQ ID NO: 907393 - DNA, 25 bp, Mus musculus
cctggtacagcttccctgtttcagg

SEQ ID NO: 907394 - DNA, 25 bp, Mus musculus
cctggtacaggaagcttccctgttt

SEQ ID NO: 907395 - DNA, 25 bp, Mus musculus
cctggtacaggaagctttcctggca

SEQ ID NO: 907396 - DNA, 25 bp, Mus musculus
cctggtacaggttccctgtttcagg

SEQ ID NO: 907397 - DNA, 25 bp, Mus musculus
cctggtagcccacgccaccatggca

SEQ ID NO: 907398 - DNA, 25 bp, Mus musculus
cctggtagcccaggccaccatggca

SEQ ID NO: 907399 - DNA, 25 bp, Mus musculus
cctggtatatggatcctcatctttg

SEQ ID NO: 907400 - DNA, 25 bp, Mus musculus
cctggtatatggatgctcatctttg

SEQ ID NO: 907401 - DNA, 25 bp, Mus musculus
cctggtcaccagcacgttcatcatc

SEQ ID NO: 907402 - DNA, 25 bp, Mus musculus
cctggtcaccaggacgttcatcatc

SEQ ID NO: 907403 - DNA, 25 bp, Mus musculus
cctggtcagcaacaatgcctttgtg

SEQ ID NO: 907404 - DNA, 25 bp, Mus musculus
cctggtcagcaagaatgcctttgtg

SEQ ID NO: 907405 - DNA, 25 bp, Mus musculus
cctggtcagccgctttctctccgtc

SEQ ID NO: 907406 - DNA, 25 bp, Mus musculus
cctggtcagccggtttctctccgtc

SEQ ID NO: 907407 - DNA, 25 bp, Mus musculus
cctggtcaggcactcggacatgcca

SEQ ID NO: 907408 - DNA, 25 bp, Mus musculus
cctggtcagggactcggacatgcca

SEQ ID NO: 907409 - DNA, 25 bp, Mus musculus
cctggtcatcgacctcctcagtcag

SEQ ID NO: 907410 - DNA, 25 bp, Mus musculus
cctggtcatcgagctcctcagtcag

SEQ ID NO: 907411 - DNA, 25 bp, Mus musculus
cctggtctaaagaatcagaagtact

SEQ ID NO: 907412 - DNA, 25 bp, Mus musculus
cctggtctaaagtatcagaagtact

SEQ ID NO: 907413 - DNA, 25 bp, Mus musculus
cctggtctaccacacagaaaggccc

SEQ ID NO: 907414 - DNA, 25 bp, Mus musculus
cctggtctaccacagagaaaggccc

SEQ ID NO: 907415 - DNA, 25 bp, Mus musculus
cctggtctctctctttctcatcatt

SEQ ID NO: 907416 - DNA, 25 bp, Mus musculus
cctggtctctgtctttctcatcatt

SEQ ID NO: 907417 - DNA, 25 bp, Mus musculus
cctggtcttgagggccgagtggtca

SEQ ID NO: 907418 - DNA, 25 bp, Mus musculus
cctggtcttgtgggccgagtggtca

SEQ ID NO: 907419 - DNA, 25 bp, Mus musculus
cctggtgaagctggagccatgggta

SEQ ID NO: 907420 - DNA, 25 bp, Mus musculus
cctggtgaaggtggagccatgggta

SEQ ID NO: 907421 - DNA, 25 bp, Mus musculus
cctggtgacaagcgttccaaaggag

SEQ ID NO: 907422 - DNA, 25 bp, Mus musculus
cctggtgacaagggttccaaaggag

SEQ ID NO: 907423 - DNA, 25 bp, Mus musculus
cctggtgatgcgtacgaggaactaa

SEQ ID NO: 907424 - DNA, 25 bp, Mus musculus
cctggtgatgggtacgaggaactaa

SEQ ID NO: 907425 - DNA, 25 bp, Mus musculus
cctggtgcaagacaactgaacatcg

SEQ ID NO: 907426 - DNA, 25 bp, Mus musculus
cctggtgcaagacagtgtccaagca

SEQ ID NO: 907427 - DNA, 25 bp, Mus musculus
cctggtgcaagacggatacccctga

SEQ ID NO: 907428 - DNA, 25 bp, Mus musculus
cctggtgcaagacgtagaactgaac

SEQ ID NO: 907429 - DNA, 25 bp, Mus musculus
cctggtgcaagagaactgaacatcg

SEQ ID NO: 907430 - DNA, 25 bp, Mus musculus
cctggtgcaagagagtgtccaagca

SEQ ID NO: 907431 - DNA, 25 bp, Mus musculus
cctggtgcaagagggatacccctga

SEQ ID NO: 907432 - DNA, 25 bp, Mus musculus
cctggtgcaagaggtagaactgaac

SEQ ID NO: 907433 - DNA, 25 bp, Mus musculus
cctggtgcagagccttcaccaccgg

SEQ ID NO: 907434 - DNA, 25 bp, Mus musculus
cctggtgcagtgccttcaccaccgg

SEQ ID NO: 907435 - DNA, 25 bp, Mus musculus
cctggtgcccagaggacatagtgta

SEQ ID NO: 907436 - DNA, 25 bp, Mus musculus
cctggtgcccagtggacatagtgta

SEQ ID NO: 907437 - DNA, 25 bp, Mus musculus
cctggtgccccgcgtcttgctggcc

SEQ ID NO: 907438 - DNA, 25 bp, Mus musculus
cctggtgccccgggtcttgctggcc

SEQ ID NO: 907439 - DNA, 25 bp, Mus musculus
cctggtgcgccgagccctaaagacc

SEQ ID NO: 907440 - DNA, 25 bp, Mus musculus
cctggtgcgccgaggcctaaagacc

SEQ ID NO: 907441 - DNA, 25 bp, Mus musculus
cctggtggacaaagatggagaaatc

SEQ ID NO: 907442 - DNA, 25 bp, Mus musculus
cctggtggacaatgatggagaaatc

SEQ ID NO: 907443 - DNA, 25 bp, Mus musculus
cctggtggagcacatggaaaacaaa

SEQ ID NO: 907444 - DNA, 25 bp, Mus musculus
cctggtggaggacatggaaaacaaa

SEQ ID NO: 907445 - DNA, 25 bp, Mus musculus
cctggtggcacaacgtgaaaaggct

SEQ ID NO: 907446 - DNA, 25 bp, Mus musculus
cctggtggcagaacgtgaaaaggct

SEQ ID NO: 907447 - DNA, 25 bp, Mus musculus
cctggtggtgaacgtcattgcacag

SEQ ID NO: 907448 - DNA, 25 bp, Mus musculus
cctggtggtgaaggtcattgcacag

SEQ ID NO: 907449 - DNA, 25 bp, Mus musculus
cctggtggtgaccgcagggaggcct

SEQ ID NO: 907450 - DNA, 25 bp, Mus musculus
cctggtggtgcgtcttctgggacct

SEQ ID NO: 907451 - DNA, 25 bp, Mus musculus
cctggtggtgggtcttctgggacct

SEQ ID NO: 907452 - DNA, 25 bp, Mus musculus
cctggtggtgtccgcagggaggcct

SEQ ID NO: 907453 - DNA, 25 bp, Mus musculus
cctggtgtccccaacgtctgcatcc

SEQ ID NO: 907454 - DNA, 25 bp, Mus musculus
cctggtgtccccaaggtctgcatcc

SEQ ID NO: 907455 - DNA, 25 bp, Mus musculus
cctggtgtgccgcggtcaccaggtc

SEQ ID NO: 907456 - DNA, 25 bp, Mus musculus
cctggtgtgccggggtcaccaggtc

SEQ ID NO: 907457 - DNA, 25 bp, Mus musculus
cctggtgttggaccccctgggaaca

SEQ ID NO: 907458 - DNA, 25 bp, Mus musculus
cctggtgttggacctctgtgataca

SEQ ID NO: 907459 - DNA, 25 bp, Mus musculus
cctggtgttggacgaagtaaagctc

SEQ ID NO: 907460 - DNA, 25 bp, Mus musculus
cctggtgttggagcccctgggaaca

SEQ ID NO: 907461 - DNA, 25 bp, Mus musculus
cctggtgttggagctctgtgataca

SEQ ID NO: 907462 - DNA, 25 bp, Mus musculus
cctggtgttggaggaagtaaagctc

SEQ ID NO: 907463 - DNA, 25 bp, Mus musculus
cctggttgcttctgcggtcacagga

SEQ ID NO: 907464 - DNA, 25 bp, Mus musculus
cctggttgcttctggggtcacagga

SEQ ID NO: 907465 - DNA, 25 bp, Mus musculus
cctggttgttcgaccatccatcctc

SEQ ID NO: 907466 - DNA, 25 bp, Mus musculus
cctggttgttcgacgatccatcctc

SEQ ID NO: 907467 - DNA, 25 bp, Mus musculus
cctggtttcacacgtcaactttgtg

SEQ ID NO: 907468 - DNA, 25 bp, Mus musculus
cctggtttcacaggtcaactttgtg

SEQ ID NO: 907469 - DNA, 25 bp, Mus musculus
cctggtttgaagatcccaatacttc

SEQ ID NO: 907470 - DNA, 25 bp, Mus musculus
cctggtttgaagctttggagtcgag

SEQ ID NO: 907471 - DNA, 25 bp, Mus musculus
cctggtttgaaggtttggagtcgag

SEQ ID NO: 907472 - DNA, 25 bp, Mus musculus
cctggtttgaagttcccaatacttc

SEQ ID NO: 907473 - DNA, 25 bp, Mus musculus
cctggttttgatcaacaacatgctt

SEQ ID NO: 907474 - DNA, 25 bp, Mus musculus
cctggttttgttcaacaacatgctt

SEQ ID NO: 907475 - DNA, 25 bp, Mus musculus
cctgtacaagacaaataagatgacc

SEQ ID NO: 907476 - DNA, 25 bp, Mus musculus
cctgtacaagacaattaagatgacc

SEQ ID NO: 907477 - DNA, 25 bp, Mus musculus
cctgtaccactgaccaggtggagat

SEQ ID NO: 907478 - DNA, 25 bp, Mus musculus
cctgtaccactgtccaggtggagat

SEQ ID NO: 907479 - DNA, 25 bp, Mus musculus
cctgtaccagatgaaatcgcagaat

SEQ ID NO: 907480 - DNA, 25 bp, Mus musculus
cctgtaccagatgatatcgcagaat

SEQ ID NO: 907481 - DNA, 25 bp, Mus musculus
cctgtaccagcacatggcccccagc

SEQ ID NO: 907482 - DNA, 25 bp, Mus musculus
cctgtaccagcagatggcccccagc

SEQ ID NO: 907483 - DNA, 25 bp, Mus musculus
cctgtacctgcgcaaagcatgttta

SEQ ID NO: 907484 - DNA, 25 bp, Mus musculus
cctgtacctgggcaaagcatgttta

SEQ ID NO: 907485 - DNA, 25 bp, Mus musculus
cctgtacgggacaaccaaggaagct

SEQ ID NO: 907486 - DNA, 25 bp, Mus musculus
cctgtacgggacaacgaagctgttc

SEQ ID NO: 907487 - DNA, 25 bp, Mus musculus
cctgtacgggacaagcaaggaagct

SEQ ID NO: 907488 - DNA, 25 bp, Mus musculus
cctgtacgggacaaggaagctgttc

SEQ ID NO: 907489 - DNA, 25 bp, Mus musculus
cctgtagccaagaccacatccttca

SEQ ID NO: 907490 - DNA, 25 bp, Mus musculus
cctgtagccaagctcagattacctg

SEQ ID NO: 907491 - DNA, 25 bp, Mus musculus
cctgtagccaaggtcagattacctg

SEQ ID NO: 907492 - DNA, 25 bp, Mus musculus
cctgtagccaagtccacatccttca

SEQ ID NO: 907493 - DNA, 25 bp, Mus musculus
cctgtagcctacgtctgaacaggct

SEQ ID NO: 907494 - DNA, 25 bp, Mus musculus
cctgtagcctacgtgtgaacaggct

SEQ ID NO: 907495 - DNA, 25 bp, Mus musculus
cctgtagcctgaaacaacccgagct

SEQ ID NO: 907496 - DNA, 25 bp, Mus musculus
cctgtagcctgaaagaacccgagct

SEQ ID NO: 907497 - DNA, 25 bp, Mus musculus
cctgtatagaagagggaagatgccc

SEQ ID NO: 907498 - DNA, 25 bp, Mus musculus
cctgtatagaagtgggaagatgccc

SEQ ID NO: 907499 - DNA, 25 bp, Mus musculus
cctgtatcagaatatgtctgtactg

SEQ ID NO: 907500 - DNA, 25 bp, Mus musculus
cctgtatcagtatatgtctgtactg

SEQ ID NO: 907501 - DNA, 25 bp, Mus musculus
cctgtatgagcgaggcaaccagcgt

SEQ ID NO: 907502 - DNA, 25 bp, Mus musculus
cctgtatgagggaggcaaccagcgt

SEQ ID NO: 907503 - DNA, 25 bp, Mus musculus
cctgtatttatcccctgagcagcag

SEQ ID NO: 907504 - DNA, 25 bp, Mus musculus
cctgtatttatcgcctgagcagcag

SEQ ID NO: 907505 - DNA, 25 bp, Mus musculus
cctgtcaaagagcagaaggctggaa

SEQ ID NO: 907506 - DNA, 25 bp, Mus musculus
cctgtcaaagaggagaaggctggaa

SEQ ID NO: 907507 - DNA, 25 bp, Mus musculus
cctgtcacctccagtgaccacctgg

SEQ ID NO: 907508 - DNA, 25 bp, Mus musculus
cctgtcacctcctgtgaccacctgg

SEQ ID NO: 907509 - DNA, 25 bp, Mus musculus
cctgtcactgcagccacggctccgg

SEQ ID NO: 907510 - DNA, 25 bp, Mus musculus
cctgtcactgcagccctgctgtggc

SEQ ID NO: 907511 - DNA, 25 bp, Mus musculus
cctgtcactgcagcgacggctccgg

SEQ ID NO: 907512 - DNA, 25 bp, Mus musculus
cctgtcactgcagcgctgctgtggc

SEQ ID NO: 907513 - DNA, 25 bp, Mus musculus
cctgtcagcgctttgtggagaagta

SEQ ID NO: 907514 - DNA, 25 bp, Mus musculus
cctgtcagcggtttgtggagaagta

SEQ ID NO: 907515 - DNA, 25 bp, Mus musculus
cctgtcaggaagcagtcacacctga

SEQ ID NO: 907516 - DNA, 25 bp, Mus musculus
cctgtcaggaaggagtcacacctga

SEQ ID NO: 907517 - DNA, 25 bp, Mus musculus
cctgtcagtcccaggtcctgcccac

SEQ ID NO: 907518 - DNA, 25 bp, Mus musculus
cctgtcagtcgcaggtcctgcccac

SEQ ID NO: 907519 - DNA, 25 bp, Mus musculus
cctgtcatccggaacctggcaaaaa

SEQ ID NO: 907520 - DNA, 25 bp, Mus musculus
cctgtcatccggaagctggcaaaaa

SEQ ID NO: 907521 - DNA, 25 bp, Mus musculus
cctgtcatcctccaagccaagctgg

SEQ ID NO: 907522 - DNA, 25 bp, Mus musculus
cctgtcatcctcctgcctggctgct

SEQ ID NO: 907523 - DNA, 25 bp, Mus musculus
cctgtcatcctcgaagccaagctgg

SEQ ID NO: 907524 - DNA, 25 bp, Mus musculus
cctgtcatcctcgtgcctggctgct

SEQ ID NO: 907525 - DNA, 25 bp, Mus musculus
cctgtccacacacgtttatgaagct

SEQ ID NO: 907526 - DNA, 25 bp, Mus musculus
cctgtccacacaggtttatgaagct

SEQ ID NO: 907527 - DNA, 25 bp, Mus musculus
cctgtcccatgcatttgaaataagt

SEQ ID NO: 907528 - DNA, 25 bp, Mus musculus
cctgtcccatgcttttgaaataagt

SEQ ID NO: 907529 - DNA, 25 bp, Mus musculus
cctgtccccaagcgcataaagaagc

SEQ ID NO: 907530 - DNA, 25 bp, Mus musculus
cctgtccccaagggcataaagaagc

SEQ ID NO: 907531 - DNA, 25 bp, Mus musculus
cctgtccctcagctacatttgtcaa

SEQ ID NO: 907532 - DNA, 25 bp, Mus musculus
cctgtccctcaggtacatttgtcaa

SEQ ID NO: 907533 - DNA, 25 bp, Mus musculus
cctgtccgagcatggatgccctgag

SEQ ID NO: 907534 - DNA, 25 bp, Mus musculus
cctgtccgaggatggatgccctgag

SEQ ID NO: 907535 - DNA, 25 bp, Mus musculus
cctgtcctaaacatgaccttcaatg

SEQ ID NO: 907536 - DNA, 25 bp, Mus musculus
cctgtcctaaacttgaccttcaatg

SEQ ID NO: 907537 - DNA, 25 bp, Mus musculus
cctgtcctaagaaaccatcaagaag

SEQ ID NO: 907538 - DNA, 25 bp, Mus musculus
cctgtcctaagaaacgcaggctcca

SEQ ID NO: 907539 - DNA, 25 bp, Mus musculus
cctgtcctaagaaagcatcaagaag

SEQ ID NO: 907540 - DNA, 25 bp, Mus musculus
cctgtcctaagaaaggcaggctcca

SEQ ID NO: 907541 - DNA, 25 bp, Mus musculus
cctgtcctcaacaacctgactgtat

SEQ ID NO: 907542 - DNA, 25 bp, Mus musculus
cctgtcctcaacaagctgactgtat

SEQ ID NO: 907543 - DNA, 25 bp, Mus musculus
cctgtccttgccaaccagtgtcaca

SEQ ID NO: 907544 - DNA, 25 bp, Mus musculus
cctgtccttggcaaccagtgtcaca

SEQ ID NO: 907545 - DNA, 25 bp, Mus musculus
cctgtcgactctgactggtttggat

SEQ ID NO: 907546 - DNA, 25 bp, Mus musculus
cctgtcgactctgagtggtttggat

SEQ ID NO: 907547 - DNA, 25 bp, Mus musculus
cctgtcgccattcgatcatctgtcc

SEQ ID NO: 907548 - DNA, 25 bp, Mus musculus
cctgtcgccattggatcatctgtcc

SEQ ID NO: 907549 - DNA, 25 bp, Mus musculus
cctgtcgcccatattttaatatccc

SEQ ID NO: 907550 - DNA, 25 bp, Mus musculus
cctgtcgcccctgagtgcaatatcc

SEQ ID NO: 907551 - DNA, 25 bp, Mus musculus
cctgtcgcccgtgagtgcaatatcc

SEQ ID NO: 907552 - DNA, 25 bp, Mus musculus
cctgtcgcccttattttaatatccc

SEQ ID NO: 907553 - DNA, 25 bp, Mus musculus
cctgtcggcgcctggcagggatgaa

SEQ ID NO: 907554 - DNA, 25 bp, Mus musculus
cctgtcggcggctggcagggatgaa

SEQ ID NO: 907555 - DNA, 25 bp, Mus musculus
cctgtcggtcacatcgaaagagcaa

SEQ ID NO: 907556 - DNA, 25 bp, Mus musculus
cctgtcggtcacatggaaagagcaa

SEQ ID NO: 907557 - DNA, 25 bp, Mus musculus
cctgtcgtgatcaacaataagacct

SEQ ID NO: 907558 - DNA, 25 bp, Mus musculus
cctgtcgtgatcaagaataagacct

SEQ ID NO: 907559 - DNA, 25 bp, Mus musculus
cctgtctcaacaaaagggctctact

SEQ ID NO: 907560 - DNA, 25 bp, Mus musculus
cctgtctcaacaaatgggctctact

SEQ ID NO: 907561 - DNA, 25 bp, Mus musculus
cctgtctcacagacaagctctcttt

SEQ ID NO: 907562 - DNA, 25 bp, Mus musculus
cctgtctcacagtcaagctctcttt

SEQ ID NO: 907563 - DNA, 25 bp, Mus musculus
cctgtctcggtgaccttcccgtcga

SEQ ID NO: 907564 - DNA, 25 bp, Mus musculus
cctgtctcggtgctcttcaaatgtc

SEQ ID NO: 907565 - DNA, 25 bp, Mus musculus
cctgtctcggtggtcttcaaatgtc

SEQ ID NO: 907566 - DNA, 25 bp, Mus musculus
cctgtctcggtgtccttcccgtcga

SEQ ID NO: 907567 - DNA, 25 bp, Mus musculus
cctgtctgagatccgttgggaaaag

SEQ ID NO: 907568 - DNA, 25 bp, Mus musculus
cctgtctgagcccctacagaacctg

SEQ ID NO: 907569 - DNA, 25 bp, Mus musculus
cctgtctgagccgctacagaacctg

SEQ ID NO: 907570 - DNA, 25 bp, Mus musculus
cctgtctgagttccgttgggaaaag

SEQ ID NO: 907571 - DNA, 25 bp, Mus musculus
cctgtctgtgcccaggagggccgta

SEQ ID NO: 907572 - DNA, 25 bp, Mus musculus
cctgtctgtggccaggagggccgta

SEQ ID NO: 907573 - DNA, 25 bp, Mus musculus
cctgtcttcaagctgccgccatgct

SEQ ID NO: 907574 - DNA, 25 bp, Mus musculus
cctgtcttcaaggtgccgccatgct

SEQ ID NO: 907575 - DNA, 25 bp, Mus musculus
cctgtctttggagacctcaaagaga

SEQ ID NO: 907576 - DNA, 25 bp, Mus musculus
cctgtctttggagagctcaaagaga

SEQ ID NO: 907577 - DNA, 25 bp, Mus musculus
cctgtgaacactgacggctgcatgg

SEQ ID NO: 907578 - DNA, 25 bp, Mus musculus
cctgtgaacactgagggctgcatgg

SEQ ID NO: 907579 - DNA, 25 bp, Mus musculus
cctgtgaagaaccacggccagtgcg

SEQ ID NO: 907580 - DNA, 25 bp, Mus musculus
cctgtgaagaaccagggccagtgcg

SEQ ID NO: 907581 - DNA, 25 bp, Mus musculus
cctgtgaagtccaacctggaggcat

SEQ ID NO: 907582 - DNA, 25 bp, Mus musculus
cctgtgaagtccaagctggaggcat

SEQ ID NO: 907583 - DNA, 25 bp, Mus musculus
cctgtgaatatcactgttgtgaatt

SEQ ID NO: 907584 - DNA, 25 bp, Mus musculus
cctgtgaatatctctgttgtgaatt

SEQ ID NO: 907585 - DNA, 25 bp, Mus musculus
cctgtgacattgagctgggctttga

SEQ ID NO: 907586 - DNA, 25 bp, Mus musculus
cctgtgacattgtgctgggctttga

SEQ ID NO: 907587 - DNA, 25 bp, Mus musculus
cctgtgacccagagcagaggggcag

SEQ ID NO: 907588 - DNA, 25 bp, Mus musculus
cctgtgacccagaggggcaggctgg

SEQ ID NO: 907589 - DNA, 25 bp, Mus musculus
cctgtgacccagtgcagaggggcag

SEQ ID NO: 907590 - DNA, 25 bp, Mus musculus
cctgtgacccagtggggcaggctgg

SEQ ID NO: 907591 - DNA, 25 bp, Mus musculus
cctgtgagaacgacctcagtgggca

SEQ ID NO: 907592 - DNA, 25 bp, Mus musculus
cctgtgagaacgtcctcagtgggca

SEQ ID NO: 907593 - DNA, 25 bp, Mus musculus
cctgtgagagagtggacattgacct

SEQ ID NO: 907594 - DNA, 25 bp, Mus musculus
cctgtgagagatctactgccatgga

SEQ ID NO: 907595 - DNA, 25 bp, Mus musculus
cctgtgagagccagatctactgcca

SEQ ID NO: 907596 - DNA, 25 bp, Mus musculus
cctgtgagaggcagatctactgcca

SEQ ID NO: 907597 - DNA, 25 bp, Mus musculus
cctgtgagagtgtggacattgacct

SEQ ID NO: 907598 - DNA, 25 bp, Mus musculus
cctgtgagagttctactgccatgga

SEQ ID NO: 907599 - DNA, 25 bp, Mus musculus
cctgtgagcgactgcatcgtcaacg

SEQ ID NO: 907600 - DNA, 25 bp, Mus musculus
cctgtgagcgactggatcgtcaacg

SEQ ID NO: 907601 - DNA, 25 bp, Mus musculus
cctgtgataaagaccagaatatggt

SEQ ID NO: 907602 - DNA, 25 bp, Mus musculus
cctgtgataaagatcaggaaatggt

SEQ ID NO: 907603 - DNA, 25 bp, Mus musculus
cctgtgataaagctgtccccaagga

SEQ ID NO: 907604 - DNA, 25 bp, Mus musculus
cctgtgataaaggtgtccccaagga

SEQ ID NO: 907605 - DNA, 25 bp, Mus musculus
cctgtgataaagtccagaatatggt

SEQ ID NO: 907606 - DNA, 25 bp, Mus musculus
cctgtgataaagttcaggaaatggt

SEQ ID NO: 907607 - DNA, 25 bp, Mus musculus
cctgtgattatgcatatggaacttg

SEQ ID NO: 907608 - DNA, 25 bp, Mus musculus
cctgtgattatggatatggaacttg

SEQ ID NO: 907609 - DNA, 25 bp, Mus musculus
cctgtgcaaacacgtcgccagtaag

SEQ ID NO: 907610 - DNA, 25 bp, Mus musculus
cctgtgcaaacaggtcgccagtaag

SEQ ID NO: 907611 - DNA, 25 bp, Mus musculus
cctgtgcaacagcaaaatcaaattg

SEQ ID NO: 907612 - DNA, 25 bp, Mus musculus
cctgtgcaacaggaaaatcaaattg

SEQ ID NO: 907613 - DNA, 25 bp, Mus musculus
cctgtgcaagcagaacggcttagat

SEQ ID NO: 907614 - DNA, 25 bp, Mus musculus
cctgtgcaaggagaacggcttagat

SEQ ID NO: 907615 - DNA, 25 bp, Mus musculus
cctgtgcaccaacgtgcagagtggc

SEQ ID NO: 907616 - DNA, 25 bp, Mus musculus
cctgtgcaccaaggtgcagagtggc

SEQ ID NO: 907617 - DNA, 25 bp, Mus musculus
cctgtgcaccttgtcgcttgcgctc

SEQ ID NO: 907618 - DNA, 25 bp, Mus musculus
cctgtgcaccttgtggcttgcgctc

SEQ ID NO: 907619 - DNA, 25 bp, Mus musculus
cctgtgcagaaatgagggaggacag

SEQ ID NO: 907620 - DNA, 25 bp, Mus musculus
cctgtgcagaagccaaggcctgcga

SEQ ID NO: 907621 - DNA, 25 bp, Mus musculus
cctgtgcagaaggcaaggcctgcga

SEQ ID NO: 907622 - DNA, 25 bp, Mus musculus
cctgtgcagacacacggcagatgta

SEQ ID NO: 907623 - DNA, 25 bp, Mus musculus
cctgtgcagacacagggcagatgta

SEQ ID NO: 907624 - DNA, 25 bp, Mus musculus
cctgtgcagatatgagggaggacag

SEQ ID NO: 907625 - DNA, 25 bp, Mus musculus
cctgtgcagtagcggacggaggcaa

SEQ ID NO: 907626 - DNA, 25 bp, Mus musculus
cctgtgcagtaggggacggaggcaa

SEQ ID NO: 907627 - DNA, 25 bp, Mus musculus
cctgtgccagcaaagcactgccacc

SEQ ID NO: 907628 - DNA, 25 bp, Mus musculus
cctgtgccagccaaggtgacccatg

SEQ ID NO: 907629 - DNA, 25 bp, Mus musculus
cctgtgccaggaaagcactgccacc

SEQ ID NO: 907630 - DNA, 25 bp, Mus musculus
cctgtgccaggcaaggtgacccatg

SEQ ID NO: 907631 - DNA, 25 bp, Mus musculus
cctgtgcccacaagcctcccctcgc

SEQ ID NO: 907632 - DNA, 25 bp, Mus musculus
cctgtgcccacatgcctcccctcgc

SEQ ID NO: 907633 - DNA, 25 bp, Mus musculus
cctgtgctagacagtgtgctcaatg

SEQ ID NO: 907634 - DNA, 25 bp, Mus musculus
cctgtgctagtcagtgtgctcaatg

SEQ ID NO: 907635 - DNA, 25 bp, Mus musculus
cctgtgctggagccttttgggaatg

SEQ ID NO: 907636 - DNA, 25 bp, Mus musculus
cctgtgctggaggcttttgggaatg

SEQ ID NO: 907637 - DNA, 25 bp, Mus musculus
cctgtggacattcgcacatctctga

SEQ ID NO: 907638 - DNA, 25 bp, Mus musculus
cctgtggacattggcacatctctga

SEQ ID NO: 907639 - DNA, 25 bp, Mus musculus
cctgtggaccaacgcaccaagggaa

SEQ ID NO: 907640 - DNA, 25 bp, Mus musculus
cctgtggaccaaggcaccaagggaa

SEQ ID NO: 907641 - DNA, 25 bp, Mus musculus
cctgtggacctgatggggtgacacc

SEQ ID NO: 907642 - DNA, 25 bp, Mus musculus
cctgtggacctgttggggtgacacc

SEQ ID NO: 907643 - DNA, 25 bp, Mus musculus
cctgtggcaaaacactgctggagtt

SEQ ID NO: 907644 - DNA, 25 bp, Mus musculus
cctgtggcaaaacccctggaagaga

SEQ ID NO: 907645 - DNA, 25 bp, Mus musculus
cctgtggcaaaagactgctggagtt

SEQ ID NO: 907646 - DNA, 25 bp, Mus musculus
cctgtggcaaaagccctggaagaga

SEQ ID NO: 907647 - DNA, 25 bp, Mus musculus
cctgtggcacagcagtggactccat

SEQ ID NO: 907648 - DNA, 25 bp, Mus musculus
cctgtggcacaggagtggactccat

SEQ ID NO: 907649 - DNA, 25 bp, Mus musculus
cctgtggcagaatccctgtgatgac

SEQ ID NO: 907650 - DNA, 25 bp, Mus musculus
cctgtggcagaggaggtgaagccgg

SEQ ID NO: 907651 - DNA, 25 bp, Mus musculus
cctgtggcagctgaccttggacaag

SEQ ID NO: 907652 - DNA, 25 bp, Mus musculus
cctgtggcaggtgaccttggacaag

SEQ ID NO: 907653 - DNA, 25 bp, Mus musculus
cctgtggcagtatccctgtgatgac

SEQ ID NO: 907654 - DNA, 25 bp, Mus musculus
cctgtggcagtggaggtgaagccgg

SEQ ID NO: 907655 - DNA, 25 bp, Mus musculus
cctgtggcataacgtgatgttccct

SEQ ID NO: 907656 - DNA, 25 bp, Mus musculus
cctgtggcataaggtgatgttccct

SEQ ID NO: 907657 - DNA, 25 bp, Mus musculus
cctgtggcatatcggtgccgggtgg

SEQ ID NO: 907658 - DNA, 25 bp, Mus musculus
cctgtggcatatgggtgccgggtgg

SEQ ID NO: 907659 - DNA, 25 bp, Mus musculus
cctgtggcctgaaaccggctgtggt

SEQ ID NO: 907660 - DNA, 25 bp, Mus musculus
cctgtggcctgaaagcggctgtggt

SEQ ID NO: 907661 - DNA, 25 bp, Mus musculus
cctgtgggaactatctcatggtcca

SEQ ID NO: 907662 - DNA, 25 bp, Mus musculus
cctgtgggaagtatctcatggtcca

SEQ ID NO: 907663 - DNA, 25 bp, Mus musculus
cctgtggtgagccacgtcccaggac

SEQ ID NO: 907664 - DNA, 25 bp, Mus musculus
cctgtggtgagccaggtcccaggac

SEQ ID NO: 907665 - DNA, 25 bp, Mus musculus
cctgtggtggccatcgtctgggaag

SEQ ID NO: 907666 - DNA, 25 bp, Mus musculus
cctgtggtggccatggtctgggaag

SEQ ID NO: 907667 - DNA, 25 bp, Mus musculus
cctgtggtttgcatctctgacatgc

SEQ ID NO: 907668 - DNA, 25 bp, Mus musculus
cctgtggtttgcatgtctgacatgc

SEQ ID NO: 907669 - DNA, 25 bp, Mus musculus
cctgtgtatcagcagctgagacagt

SEQ ID NO: 907670 - DNA, 25 bp, Mus musculus
cctgtgtatcaggagctgagacagt

SEQ ID NO: 907671 - DNA, 25 bp, Mus musculus
cctgtgtgagagagtggctatcttg

SEQ ID NO: 907672 - DNA, 25 bp, Mus musculus
cctgtgtgagagtgtggctatcttg

SEQ ID NO: 907673 - DNA, 25 bp, Mus musculus
cctgtgtgatttgccgaaatccctc

SEQ ID NO: 907674 - DNA, 25 bp, Mus musculus
cctgtgtgatttgcggaaatccctc

SEQ ID NO: 907675 - DNA, 25 bp, Mus musculus
cctgtgtgcaaccacgtagaatgtc

SEQ ID NO: 907676 - DNA, 25 bp, Mus musculus
cctgtgtgcaaccaggtagaatgtc

SEQ ID NO: 907677 - DNA, 25 bp, Mus musculus
cctgtgtggcaacgttggtgctctc

SEQ ID NO: 907678 - DNA, 25 bp, Mus musculus
cctgtgtggcaaggttggtgctctc

SEQ ID NO: 907679 - DNA, 25 bp, Mus musculus
cctgtgtgtcgacgagatggtgtct

SEQ ID NO: 907680 - DNA, 25 bp, Mus musculus
cctgtgtgtcgaggagatggtgtct

SEQ ID NO: 907681 - DNA, 25 bp, Mus musculus
cctgtgttcaagcctgcaaattggg

SEQ ID NO: 907682 - DNA, 25 bp, Mus musculus
cctgtgttcaaggctgcaaattggg

SEQ ID NO: 907683 - DNA, 25 bp, Mus musculus
cctgtgtttgtgctcctccactctt

SEQ ID NO: 907684 - DNA, 25 bp, Mus musculus
cctgtgtttgtgctctttgctgatt

SEQ ID NO: 907685 - DNA, 25 bp, Mus musculus
cctgtgtttgtggtcctccactctt

SEQ ID NO: 907686 - DNA, 25 bp, Mus musculus
cctgtgtttgtggtctttgctgatt

SEQ ID NO: 907687 - DNA, 25 bp, Mus musculus
cctgttacgcttctacttcatcctg

SEQ ID NO: 907688 - DNA, 25 bp, Mus musculus
cctgttacgcttgtacttcatcctg

SEQ ID NO: 907689 - DNA, 25 bp, Mus musculus
cctgttagacattgcatgccgcctt

SEQ ID NO: 907690 - DNA, 25 bp, Mus musculus
cctgttagacattgcctgcggttct

SEQ ID NO: 907691 - DNA, 25 bp, Mus musculus
cctgttagacattggatgccgcctt

SEQ ID NO: 907692 - DNA, 25 bp, Mus musculus
cctgttagacattggctgcggttct

SEQ ID NO: 907693 - DNA, 25 bp, Mus musculus
cctgttcaaaagccaccccagagac

SEQ ID NO: 907694 - DNA, 25 bp, Mus musculus
cctgttcaaaaggcaccccagagac

SEQ ID NO: 907695 - DNA, 25 bp, Mus musculus
cctgttcaagaaatcaacatgcaga

SEQ ID NO: 907696 - DNA, 25 bp, Mus musculus
cctgttcaagcttcgcccagagacc

SEQ ID NO: 907697 - DNA, 25 bp, Mus musculus
cctgttcaaggttcgcccagagacc

SEQ ID NO: 907698 - DNA, 25 bp, Mus musculus
cctgttcaagtaatcaacatgcaga

SEQ ID NO: 907699 - DNA, 25 bp, Mus musculus
cctgttcactcagacgcagccatgg

SEQ ID NO: 907700 - DNA, 25 bp, Mus musculus
cctgttcactcagaggcagccatgg

SEQ ID NO: 907701 - DNA, 25 bp, Mus musculus
cctgttcgtgagcattagtgatcag

SEQ ID NO: 907702 - DNA, 25 bp, Mus musculus
cctgttcgtgaggattagtgatcag

SEQ ID NO: 907703 - DNA, 25 bp, Mus musculus
cctgttcttgcctcactgtcagaaa

SEQ ID NO: 907704 - DNA, 25 bp, Mus musculus
cctgttcttggctcactgtcagaaa

SEQ ID NO: 907705 - DNA, 25 bp, Mus musculus
cctgttgaagctttaccaggcactg

SEQ ID NO: 907706 - DNA, 25 bp, Mus musculus
cctgttgaaggtttaccaggcactg

SEQ ID NO: 907707 - DNA, 25 bp, Mus musculus
cctgttgcaagacggtgaagaagct

SEQ ID NO: 907708 - DNA, 25 bp, Mus musculus
cctgttgcaagagggtgaagaagct

SEQ ID NO: 907709 - DNA, 25 bp, Mus musculus
cctgttgctgctcttatttccgaga

SEQ ID NO: 907710 - DNA, 25 bp, Mus musculus
cctgttgctgctgttatttccgaga

SEQ ID NO: 907711 - DNA, 25 bp, Mus musculus
cctgttggagagagcggtctggcag

SEQ ID NO: 907712 - DNA, 25 bp, Mus musculus
cctgttggagagaggggtctggcag

SEQ ID NO: 907713 - DNA, 25 bp, Mus musculus
cctgtttcagcaaccttccatggct

SEQ ID NO: 907714 - DNA, 25 bp, Mus musculus
cctgtttcagcaaccttccctgctt

SEQ ID NO: 907715 - DNA, 25 bp, Mus musculus
cctgtttcagcaaccttccctggta

SEQ ID NO: 907716 - DNA, 25 bp, Mus musculus
cctgtttcagcaagcttccctgttt

SEQ ID NO: 907717 - DNA, 25 bp, Mus musculus
cctgtttcagcaatcttccctggta

SEQ ID NO: 907718 - DNA, 25 bp, Mus musculus
cctgtttcagcttccctgtttcagg

SEQ ID NO: 907719 - DNA, 25 bp, Mus musculus
cctgtttcaggaaccttccatggct

SEQ ID NO: 907720 - DNA, 25 bp, Mus musculus
cctgtttcaggaaccttccctgctt

SEQ ID NO: 907721 - DNA, 25 bp, Mus musculus
cctgtttcaggaaccttccctggta

SEQ ID NO: 907722 - DNA, 25 bp, Mus musculus
cctgtttcaggaagcttccctgttt

SEQ ID NO: 907723 - DNA, 25 bp, Mus musculus
cctgtttcaggaatcttccctggta

SEQ ID NO: 907724 - DNA, 25 bp, Mus musculus
cctgtttcaggttccctgtttcagg

SEQ ID NO: 907725 - DNA, 25 bp, Mus musculus
cctgtttccactgcatggcctgcag

SEQ ID NO: 907726 - DNA, 25 bp, Mus musculus
cctgtttccactgcttggcctgcag

SEQ ID NO: 907727 - DNA, 25 bp, Mus musculus
cctgtttgcacacgttgtgttgcct

SEQ ID NO: 907728 - DNA, 25 bp, Mus musculus
cctgtttgcacaggttgtgttgcct

SEQ ID NO: 907729 - DNA, 25 bp, Mus musculus
cctgtttggagacacatcatttcag

SEQ ID NO: 907730 - DNA, 25 bp, Mus musculus
cctgtttggagacagacatcatttc

SEQ ID NO: 907731 - DNA, 25 bp, Mus musculus
cctgtttggagagacatcatttcag

SEQ ID NO: 907732 - DNA, 25 bp, Mus musculus
cctgtttggagagagacatcatttc

SEQ ID NO: 907733 - DNA, 25 bp, Mus musculus
cctgtttggtcacgtggtacgtggg

SEQ ID NO: 907734 - DNA, 25 bp, Mus musculus
cctgtttggtcaggtggtacgtggg

SEQ ID NO: 907735 - DNA, 25 bp, Mus musculus
cctgtttgtttacacgaaagatgta

SEQ ID NO: 907736 - DNA, 25 bp, Mus musculus
cctgtttgtttacaggaaagatgta

SEQ ID NO: 907737 - DNA, 25 bp, Mus musculus
cctgttttctaccctgcagaaaaag

SEQ ID NO: 907738 - DNA, 25 bp, Mus musculus
cctgttttctatcgaaggcagtatt

SEQ ID NO: 907739 - DNA, 25 bp, Mus musculus
cctgttttctatggaaggcagtatt

SEQ ID NO: 907740 - DNA, 25 bp, Mus musculus
cctgttttcttccctgcagaaaaag

SEQ ID NO: 907741 - DNA, 25 bp, Mus musculus
ccttaaaacaagaaactccatcaag

SEQ ID NO: 907742 - DNA, 25 bp, Mus musculus
ccttaaaacaagtaactccatcaag

SEQ ID NO: 907743 - DNA, 25 bp, Mus musculus
ccttaaatcactgtcggtgacgttt

SEQ ID NO: 907744 - DNA, 25 bp, Mus musculus
ccttaaatcagtgtcggtgacgttt

SEQ ID NO: 907745 - DNA, 25 bp, Mus musculus
ccttaaatgtaacaatgttgctgaa

SEQ ID NO: 907746 - DNA, 25 bp, Mus musculus
ccttaaatgtaagaatgttgctgaa

SEQ ID NO: 907747 - DNA, 25 bp, Mus musculus
ccttaacaaatgaggacctaagagg

SEQ ID NO: 907748 - DNA, 25 bp, Mus musculus
ccttaacaaatgtggacctaagagg

SEQ ID NO: 907749 - DNA, 25 bp, Mus musculus
ccttaacctgcgatcgcttacactt

SEQ ID NO: 907750 - DNA, 25 bp, Mus musculus
ccttaacctgggatcgcttacactt

SEQ ID NO: 907751 - DNA, 25 bp, Mus musculus
ccttaaggaatgcacggacattcct

SEQ ID NO: 907752 - DNA, 25 bp, Mus musculus
ccttaaggaatgcagggacattcct

SEQ ID NO: 907753 - DNA, 25 bp, Mus musculus
ccttacaatcaacatttctgaccga

SEQ ID NO: 907754 - DNA, 25 bp, Mus musculus
ccttacaatcaagatttctgaccga

SEQ ID NO: 907755 - DNA, 25 bp, Mus musculus
ccttacacagcgaggcaagggagac

SEQ ID NO: 907756 - DNA, 25 bp, Mus musculus
ccttacacagggaggcaagggagac

SEQ ID NO: 907757 - DNA, 25 bp, Mus musculus
ccttacactccacgaacactatggc

SEQ ID NO: 907758 - DNA, 25 bp, Mus musculus
ccttacactccaggaacactatggc

SEQ ID NO: 907759 - DNA, 25 bp, Mus musculus
ccttacagctcaccaacaagaagaa

SEQ ID NO: 907760 - DNA, 25 bp, Mus musculus
ccttacagctcacgaaatggagaca

SEQ ID NO: 907761 - DNA, 25 bp, Mus musculus
ccttacagctcagcaacaagaagaa

SEQ ID NO: 907762 - DNA, 25 bp, Mus musculus
ccttacagctcaggaaatggagaca

SEQ ID NO: 907763 - DNA, 25 bp, Mus musculus
ccttacagttaacgaagctgtgctg

SEQ ID NO: 907764 - DNA, 25 bp, Mus musculus
ccttacagttaaggaagctgtgctg

SEQ ID NO: 907765 - DNA, 25 bp, Mus musculus
ccttaccatgagccctggggggcag

SEQ ID NO: 907766 - DNA, 25 bp, Mus musculus
ccttaccatgtgccctggggggcag

SEQ ID NO: 907767 - DNA, 25 bp, Mus musculus
ccttacccagagctcatctctcgcc

SEQ ID NO: 907768 - DNA, 25 bp, Mus musculus
ccttacccagtgctcatctctcgcc

SEQ ID NO: 907769 - DNA, 25 bp, Mus musculus
ccttacctccagaacccgctcagtt

SEQ ID NO: 907770 - DNA, 25 bp, Mus musculus
ccttacctccagtacccgctcagtt

SEQ ID NO: 907771 - DNA, 25 bp, Mus musculus
ccttacctgccacactgctgagtac

SEQ ID NO: 907772 - DNA, 25 bp, Mus musculus
ccttacctgccacagtgctgagtac

SEQ ID NO: 907773 - DNA, 25 bp, Mus musculus
ccttacgacttgcctttgtggctgg

SEQ ID NO: 907774 - DNA, 25 bp, Mus musculus
ccttacgacttggctttgtggctgg

SEQ ID NO: 907775 - DNA, 25 bp, Mus musculus
ccttagagcaaagacgataaaggag

SEQ ID NO: 907776 - DNA, 25 bp, Mus musculus
ccttagagcaaagaggataaaggag

SEQ ID NO: 907777 - DNA, 25 bp, Mus musculus
ccttagatttagacattcaaacaca

SEQ ID NO: 907778 - DNA, 25 bp, Mus musculus
ccttagatttagtcattcaaacaca

SEQ ID NO: 907779 - DNA, 25 bp, Mus musculus
ccttagcaagctcaacaacagtcct

SEQ ID NO: 907780 - DNA, 25 bp, Mus musculus
ccttagcaaggccactgatctagag

SEQ ID NO: 907781 - DNA, 25 bp, Mus musculus
ccttagcaaggccagtgatctagag

SEQ ID NO: 907782 - DNA, 25 bp, Mus musculus
ccttagcaaggtcaacaacagtcct

SEQ ID NO: 907783 - DNA, 25 bp, Mus musculus
ccttagccaacagctgtcccgacca

SEQ ID NO: 907784 - DNA, 25 bp, Mus musculus
ccttagccaagagctgtcccgacca

SEQ ID NO: 907785 - DNA, 25 bp, Mus musculus
ccttagggtgcaccaagccggggag

SEQ ID NO: 907786 - DNA, 25 bp, Mus musculus
ccttagggtgcagcaagccggggag

SEQ ID NO: 907787 - DNA, 25 bp, Mus musculus
ccttaggtttgcagatgatacgtat

SEQ ID NO: 907788 - DNA, 25 bp, Mus musculus
ccttaggtttgcatgggacacagca

SEQ ID NO: 907789 - DNA, 25 bp, Mus musculus
ccttaggtttgctgatgatacgtat

SEQ ID NO: 907790 - DNA, 25 bp, Mus musculus
ccttaggtttgcttgggacacagca

SEQ ID NO: 907791 - DNA, 25 bp, Mus musculus
ccttagtctgctacatagcccatct

SEQ ID NO: 907792 - DNA, 25 bp, Mus musculus
ccttagtctggtacatagcccatct

SEQ ID NO: 907793 - DNA, 25 bp, Mus musculus
ccttatagtctgattcctttctcct

SEQ ID NO: 907794 - DNA, 25 bp, Mus musculus
ccttatagtctgtttcctttctcct

SEQ ID NO: 907795 - DNA, 25 bp, Mus musculus
ccttatcaaaagcatgcttcatgat

SEQ ID NO: 907796 - DNA, 25 bp, Mus musculus
ccttatcaaaaggatgcttcatgat

SEQ ID NO: 907797 - DNA, 25 bp, Mus musculus
ccttatctgtaacaactgctttaag

SEQ ID NO: 907798 - DNA, 25 bp, Mus musculus
ccttatctgtaagaactgctttaag

SEQ ID NO: 907799 - DNA, 25 bp, Mus musculus
ccttatgaagaaaacgatggatcat

SEQ ID NO: 907800 - DNA, 25 bp, Mus musculus
ccttatgaagaaaaggatggatcat

SEQ ID NO: 907801 - DNA, 25 bp, Mus musculus
ccttatgaagctctttgaacagtct

SEQ ID NO: 907802 - DNA, 25 bp, Mus musculus
ccttatgaaggtctttgaacagtct

SEQ ID NO: 907803 - DNA, 25 bp, Mus musculus
ccttatgcccagctccaggctatgc

SEQ ID NO: 907804 - DNA, 25 bp, Mus musculus
ccttatgcccaggtccaggctatgc

SEQ ID NO: 907805 - DNA, 25 bp, Mus musculus
ccttatggagactctgacacagttc

SEQ ID NO: 907806 - DNA, 25 bp, Mus musculus
ccttatggagtctctgacacagttc

SEQ ID NO: 907807 - DNA, 25 bp, Mus musculus
ccttatggcgaggacccatcaagca

SEQ ID NO: 907808 - DNA, 25 bp, Mus musculus
ccttatggcgaggacgaggtgtagc

SEQ ID NO: 907809 - DNA, 25 bp, Mus musculus
ccttatggcgaggagccatcaagca

SEQ ID NO: 907810 - DNA, 25 bp, Mus musculus
ccttatggcgaggaggaggtgtagc

SEQ ID NO: 907811 - DNA, 25 bp, Mus musculus
ccttatgggtatttcgtgctataca

SEQ ID NO: 907812 - DNA, 25 bp, Mus musculus
ccttatgggtatttggtgctataca

SEQ ID NO: 907813 - DNA, 25 bp, Mus musculus
ccttattaccacagcgtttatgttt

SEQ ID NO: 907814 - DNA, 25 bp, Mus musculus
ccttattaccacaggaactgcatga

SEQ ID NO: 907815 - DNA, 25 bp, Mus musculus
ccttattaccactgcgtttatgttt

SEQ ID NO: 907816 - DNA, 25 bp, Mus musculus
ccttattaccactggaactgcatga

SEQ ID NO: 907817 - DNA, 25 bp, Mus musculus
ccttattcaaggcctggtgtgtgcc

SEQ ID NO: 907818 - DNA, 25 bp, Mus musculus
ccttattcaaggcgtgtggaatatt

SEQ ID NO: 907819 - DNA, 25 bp, Mus musculus
ccttattcaagggctggtgtgtgcc

SEQ ID NO: 907820 - DNA, 25 bp, Mus musculus
ccttattcaaggggtgtggaatatt

SEQ ID NO: 907821 - DNA, 25 bp, Mus musculus
ccttattcagcggatgtttgtgagt

SEQ ID NO: 907822 - DNA, 25 bp, Mus musculus
ccttattcaggggatgtttgtgagt

SEQ ID NO: 907823 - DNA, 25 bp, Mus musculus
ccttattggagacaagttagtagga

SEQ ID NO: 907824 - DNA, 25 bp, Mus musculus
ccttattggagacatgttagtagga

SEQ ID NO: 907825 - DNA, 25 bp, Mus musculus
ccttattttacactgaaaatgtgct

SEQ ID NO: 907826 - DNA, 25 bp, Mus musculus
ccttattttacagtgaaaatgtgct

SEQ ID NO: 907827 - DNA, 25 bp, Mus musculus
ccttcaaagcagaagcctcctgcca

SEQ ID NO: 907828 - DNA, 25 bp, Mus musculus
ccttcaaagcagcccaatcatggaa

SEQ ID NO: 907829 - DNA, 25 bp, Mus musculus
ccttcaaagcaggccaatcatggaa

SEQ ID NO: 907830 - DNA, 25 bp, Mus musculus
ccttcaaagcagtagcctcctgcca

SEQ ID NO: 907831 - DNA, 25 bp, Mus musculus
ccttcaaatactcaactgtccctga

SEQ ID NO: 907832 - DNA, 25 bp, Mus musculus
ccttcaaatactgaactgtccctga

SEQ ID NO: 907833 - DNA, 25 bp, Mus musculus
ccttcaaatttgatcatcccaaatt

SEQ ID NO: 907834 - DNA, 25 bp, Mus musculus
ccttcaaatttgatgatcccaaatt

SEQ ID NO: 907835 - DNA, 25 bp, Mus musculus
ccttcaacagatccagtctgacaca

SEQ ID NO: 907836 - DNA, 25 bp, Mus musculus
ccttcaacagttccagtctgacaca

SEQ ID NO: 907837 - DNA, 25 bp, Mus musculus
ccttcaacggagctactgtattggc

SEQ ID NO: 907838 - DNA, 25 bp, Mus musculus
ccttcaacggaggtactgtattggc

SEQ ID NO: 907839 - DNA, 25 bp, Mus musculus
ccttcaagaactggaactagtggac

SEQ ID NO: 907840 - DNA, 25 bp, Mus musculus
ccttcaagaactggtactagtggac

SEQ ID NO: 907841 - DNA, 25 bp, Mus musculus
ccttcaagtacacagatgaactcaa

SEQ ID NO: 907842 - DNA, 25 bp, Mus musculus
ccttcaagtacagagatgaactcaa

SEQ ID NO: 907843 - DNA, 25 bp, Mus musculus
ccttcaagtacaggaatgaactcaa

SEQ ID NO: 907844 - DNA, 25 bp, Mus musculus
ccttcaagtacaggtatgaactcaa

SEQ ID NO: 907845 - DNA, 25 bp, Mus musculus
ccttcacaatctccagaactacagc

SEQ ID NO: 907846 - DNA, 25 bp, Mus musculus
ccttcacaatgtccagaactacagc

SEQ ID NO: 907847 - DNA, 25 bp, Mus musculus
ccttcaccagcgatgactctgttcc

SEQ ID NO: 907848 - DNA, 25 bp, Mus musculus
ccttcaccagggatgactctgttcc

SEQ ID NO: 907849 - DNA, 25 bp, Mus musculus
ccttcacctgctggaaaattctggt

SEQ ID NO: 907850 - DNA, 25 bp, Mus musculus
ccttcacctggtggaaaattctggt

SEQ ID NO: 907851 - DNA, 25 bp, Mus musculus
ccttcacgagacagagttagcagag

SEQ ID NO: 907852 - DNA, 25 bp, Mus musculus
ccttcacgagactgagttagcagag

SEQ ID NO: 907853 - DNA, 25 bp, Mus musculus
ccttcactctagcccatccagtccc

SEQ ID NO: 907854 - DNA, 25 bp, Mus musculus
ccttcactcttgcccatccagtccc

SEQ ID NO: 907855 - DNA, 25 bp, Mus musculus
ccttcactttaacgtgcctgctgtt

SEQ ID NO: 907856 - DNA, 25 bp, Mus musculus
ccttcactttaaggtgcctgctgtt

SEQ ID NO: 907857 - DNA, 25 bp, Mus musculus
ccttcagaatggcttctacgcagct

SEQ ID NO: 907858 - DNA, 25 bp, Mus musculus
ccttcagaatgggttctacgcagct

SEQ ID NO: 907859 - DNA, 25 bp, Mus musculus
ccttcagacctcacctgagatgggg

SEQ ID NO: 907860 - DNA, 25 bp, Mus musculus
ccttcagacctctcctgagatgggg

SEQ ID NO: 907861 - DNA, 25 bp, Mus musculus
ccttcagattgtagcacggctgaag

SEQ ID NO: 907862 - DNA, 25 bp, Mus musculus
ccttcagattgttgcacggctgaag

SEQ ID NO: 907863 - DNA, 25 bp, Mus musculus
ccttcagccgagaaacatcccaaac

SEQ ID NO: 907864 - DNA, 25 bp, Mus musculus
ccttcagccgagaagaactttgatc

SEQ ID NO: 907865 - DNA, 25 bp, Mus musculus
ccttcagccgagtaacatcccaaac

SEQ ID NO: 907866 - DNA, 25 bp, Mus musculus
ccttcagccgagtagaactttgatc

SEQ ID NO: 907867 - DNA, 25 bp, Mus musculus
ccttcagcgaggaacatgaggacga

SEQ ID NO: 907868 - DNA, 25 bp, Mus musculus
ccttcagcgaggaagatgaggacga

SEQ ID NO: 907869 - DNA, 25 bp, Mus musculus
ccttcagcttcacgaatgcactgga

SEQ ID NO: 907870 - DNA, 25 bp, Mus musculus
ccttcagcttcaggaatgcactgga

SEQ ID NO: 907871 - DNA, 25 bp, Mus musculus
ccttcaggaaagcctgcacaaggcc

SEQ ID NO: 907872 - DNA, 25 bp, Mus musculus
ccttcaggaaagcctgtgggccgaa

SEQ ID NO: 907873 - DNA, 25 bp, Mus musculus
ccttcaggaaaggctgcacaaggcc

SEQ ID NO: 907874 - DNA, 25 bp, Mus musculus
ccttcaggaaaggctgtgggccgaa

SEQ ID NO: 907875 - DNA, 25 bp, Mus musculus
ccttcataagaagtctttccacgat

SEQ ID NO: 907876 - DNA, 25 bp, Mus musculus
ccttcataagaagtgtttccacgat

SEQ ID NO: 907877 - DNA, 25 bp, Mus musculus
ccttcatagaagatcaagatgtaga

SEQ ID NO: 907878 - DNA, 25 bp, Mus musculus
ccttcatagaagctacttcaagagt

SEQ ID NO: 907879 - DNA, 25 bp, Mus musculus
ccttcatagaaggtacttcaagagt

SEQ ID NO: 907880 - DNA, 25 bp, Mus musculus
ccttcatagaagttcaagatgtaga

SEQ ID NO: 907881 - DNA, 25 bp, Mus musculus
ccttcatcctcacaaacaaaggaag

SEQ ID NO: 907882 - DNA, 25 bp, Mus musculus
ccttcatcctcagaaacaaaggaag

SEQ ID NO: 907883 - DNA, 25 bp, Mus musculus
ccttcatctgggaatctacagtgat

SEQ ID NO: 907884 - DNA, 25 bp, Mus musculus
ccttcatctgggtatctacagtgat

SEQ ID NO: 907885 - DNA, 25 bp, Mus musculus
ccttcatgaaagatccgacgagata

SEQ ID NO: 907886 - DNA, 25 bp, Mus musculus
ccttcatgaaagcaatacagatgtt

SEQ ID NO: 907887 - DNA, 25 bp, Mus musculus
ccttcatgaaaggaatacagatgtt

SEQ ID NO: 907888 - DNA, 25 bp, Mus musculus
ccttcatgaaagttccgacgagata

SEQ ID NO: 907889 - DNA, 25 bp, Mus musculus
ccttcatgtttggacgccatgacac

SEQ ID NO: 907890 - DNA, 25 bp, Mus musculus
ccttcatgtttggaggccatgacac

SEQ ID NO: 907891 - DNA, 25 bp, Mus musculus
ccttccaaagagccctgctgttccc

SEQ ID NO: 907892 - DNA, 25 bp, Mus musculus
ccttccaaagaggcctgctgttccc

SEQ ID NO: 907893 - DNA, 25 bp, Mus musculus
ccttccaactcacgctgcttctgat

SEQ ID NO: 907894 - DNA, 25 bp, Mus musculus
ccttccaactcaggctgcttctgat

SEQ ID NO: 907895 - DNA, 25 bp, Mus musculus
ccttccacatctcgcacagcggaca

SEQ ID NO: 907896 - DNA, 25 bp, Mus musculus
ccttccacatctggcacagcggaca

SEQ ID NO: 907897 - DNA, 25 bp, Mus musculus
ccttccacggggcgcccaatgtgtg

SEQ ID NO: 907898 - DNA, 25 bp, Mus musculus
ccttccacggggggcccaatgtgtg

SEQ ID NO: 907899 - DNA, 25 bp, Mus musculus
ccttccacttccagcctcgagatgc

SEQ ID NO: 907900 - DNA, 25 bp, Mus musculus
ccttccacttccaggctcgagatgc

SEQ ID NO: 907901 - DNA, 25 bp, Mus musculus
ccttccacttccagtgcttctgctt

SEQ ID NO: 907902 - DNA, 25 bp, Mus musculus
ccttccacttcctgtgcttctgctt

SEQ ID NO: 907903 - DNA, 25 bp, Mus musculus
ccttccagatacattgacatcagca

SEQ ID NO: 907904 - DNA, 25 bp, Mus musculus
ccttccagatacctcttccaagttg

SEQ ID NO: 907905 - DNA, 25 bp, Mus musculus
ccttccagatacgtcttccaagttg

SEQ ID NO: 907906 - DNA, 25 bp, Mus musculus
ccttccagatactttgacatcagca

SEQ ID NO: 907907 - DNA, 25 bp, Mus musculus
ccttccaggaccaccatgtccctgg

SEQ ID NO: 907908 - DNA, 25 bp, Mus musculus
ccttccaggaccacgatgtccctgg

SEQ ID NO: 907909 - DNA, 25 bp, Mus musculus
ccttccagtcagaggacatcctgga

SEQ ID NO: 907910 - DNA, 25 bp, Mus musculus
ccttccagtcagtggacatcctgga

SEQ ID NO: 907911 - DNA, 25 bp, Mus musculus
ccttccagtgagcttgcttcccaga

SEQ ID NO: 907912 - DNA, 25 bp, Mus musculus
ccttccagtgaggttgcttcccaga

SEQ ID NO: 907913 - DNA, 25 bp, Mus musculus
ccttccagtgcgatgatctggccca

SEQ ID NO: 907914 - DNA, 25 bp, Mus musculus
ccttccagtgggatgatctggccca

SEQ ID NO: 907915 - DNA, 25 bp, Mus musculus
ccttccatcctaaatagtctacatg

SEQ ID NO: 907916 - DNA, 25 bp, Mus musculus
ccttccatcctatatagtctacatg

SEQ ID NO: 907917 - DNA, 25 bp, Mus musculus
ccttccatggctcaccaagcttccc

SEQ ID NO: 907918 - DNA, 25 bp, Mus musculus
ccttccatggctcagcaagcttccc

SEQ ID NO: 907919 - DNA, 25 bp, Mus musculus
ccttcccaagctcatcagtggtgag

SEQ ID NO: 907920 - DNA, 25 bp, Mus musculus
ccttcccaaggtcatcagtggtgag

SEQ ID NO: 907921 - DNA, 25 bp, Mus musculus
ccttcccccttgcttgcctctctgc

SEQ ID NO: 907922 - DNA, 25 bp, Mus musculus
ccttcccccttggttgcctctctgc

SEQ ID NO: 907923 - DNA, 25 bp, Mus musculus
ccttcccgccgccgaggagaatggc

SEQ ID NO: 907924 - DNA, 25 bp, Mus musculus
ccttcccgccgcggaggagaatggc

SEQ ID NO: 907925 - DNA, 25 bp, Mus musculus
ccttccctgcttcaccaagcttccc

SEQ ID NO: 907926 - DNA, 25 bp, Mus musculus
ccttccctgcttcagcaagcttccc

SEQ ID NO: 907927 - DNA, 25 bp, Mus musculus
ccttccctggcactccaagtttccc

SEQ ID NO: 907928 - DNA, 25 bp, Mus musculus
ccttccctggcactgcaagtttccc

SEQ ID NO: 907929 - DNA, 25 bp, Mus musculus
ccttccctggtacaccaagcttccc

SEQ ID NO: 907930 - DNA, 25 bp, Mus musculus
ccttccctggtacaccttccctgtt

SEQ ID NO: 907931 - DNA, 25 bp, Mus musculus
ccttccctggtacagcaagcttccc

SEQ ID NO: 907932 - DNA, 25 bp, Mus musculus
ccttccctggtacagcttccctgtt

SEQ ID NO: 907933 - DNA, 25 bp, Mus musculus
ccttccgcacccaacccagtttgga

SEQ ID NO: 907934 - DNA, 25 bp, Mus musculus
ccttccgcacccaactttggacaag

SEQ ID NO: 907935 - DNA, 25 bp, Mus musculus
ccttccgcacccaagccagtttgga

SEQ ID NO: 907936 - DNA, 25 bp, Mus musculus
ccttccgcacccaagtttggacaag

SEQ ID NO: 907937 - DNA, 25 bp, Mus musculus
ccttccgcagagcccgtgccgacat

SEQ ID NO: 907938 - DNA, 25 bp, Mus musculus
ccttccgcagagccggtgccgacat

SEQ ID NO: 907939 - DNA, 25 bp, Mus musculus
ccttccgcatctttcactttgatga

SEQ ID NO: 907940 - DNA, 25 bp, Mus musculus
ccttccgcatctttgactttgatga

SEQ ID NO: 907941 - DNA, 25 bp, Mus musculus
ccttccgctgcgctgtcatggagaa

SEQ ID NO: 907942 - DNA, 25 bp, Mus musculus
ccttccgctgcggtgtcatggagaa

SEQ ID NO: 907943 - DNA, 25 bp, Mus musculus
ccttccggcaagctgttggagccaa

SEQ ID NO: 907944 - DNA, 25 bp, Mus musculus
ccttccggcaaggtgttggagccaa

SEQ ID NO: 907945 - DNA, 25 bp, Mus musculus
ccttccggcctcgtcggtccacaag

SEQ ID NO: 907946 - DNA, 25 bp, Mus musculus
ccttccggcctcgtgggtccacaag

SEQ ID NO: 907947 - DNA, 25 bp, Mus musculus
ccttccggcggcaaatggacattct

SEQ ID NO: 907948 - DNA, 25 bp, Mus musculus
ccttccggcggcaattggacattct

SEQ ID NO: 907949 - DNA, 25 bp, Mus musculus
ccttccggctggccacccccatcag

SEQ ID NO: 907950 - DNA, 25 bp, Mus musculus
ccttccggctgggcacccccatcag

SEQ ID NO: 907951 - DNA, 25 bp, Mus musculus
ccttcctcaacactgtctacattgg

SEQ ID NO: 907952 - DNA, 25 bp, Mus musculus
ccttcctcaacagtgtctacattgg

SEQ ID NO: 907953 - DNA, 25 bp, Mus musculus
ccttcctcagctactgtgactacta

SEQ ID NO: 907954 - DNA, 25 bp, Mus musculus
ccttcctcaggtactgtgactacta

SEQ ID NO: 907955 - DNA, 25 bp, Mus musculus
ccttcctcccacaggccaggcttcg

SEQ ID NO: 907956 - DNA, 25 bp, Mus musculus
ccttcctcccactggccaggcttcg

SEQ ID NO: 907957 - DNA, 25 bp, Mus musculus
ccttcctcctccaaccatcagggtt

SEQ ID NO: 907958 - DNA, 25 bp, Mus musculus
ccttcctcctccaagcatcagggtt

SEQ ID NO: 907959 - DNA, 25 bp, Mus musculus
ccttcctcgccacacgcttgatgca

SEQ ID NO: 907960 - DNA, 25 bp, Mus musculus
ccttcctcgccacaggcttgatgca

SEQ ID NO: 907961 - DNA, 25 bp, Mus musculus
ccttcctcttccaacagtcccccag

SEQ ID NO: 907962 - DNA, 25 bp, Mus musculus
ccttcctcttccaagagtcccccag

SEQ ID NO: 907963 - DNA, 25 bp, Mus musculus
ccttcctgagcattatttgtatgga

SEQ ID NO: 907964 - DNA, 25 bp, Mus musculus
ccttcctgaggattatttgtatgga

SEQ ID NO: 907965 - DNA, 25 bp, Mus musculus
ccttcctgagtgagctcattgccca

SEQ ID NO: 907966 - DNA, 25 bp, Mus musculus
ccttcctgagtgtgctcattgccca

SEQ ID NO: 907967 - DNA, 25 bp, Mus musculus
ccttcctgctggcccgcattgaatg

SEQ ID NO: 907968 - DNA, 25 bp, Mus musculus
ccttcctgctggccggcattgaatg

SEQ ID NO: 907969 - DNA, 25 bp, Mus musculus
ccttcctggacaccctgcgaaggcc

SEQ ID NO: 907970 - DNA, 25 bp, Mus musculus
ccttcctggacagcctgcgaaggcc

SEQ ID NO: 907971 - DNA, 25 bp, Mus musculus
ccttcctggtgctaccacaggttag

SEQ ID NO: 907972 - DNA, 25 bp, Mus musculus
ccttcctggtgctacctggtgaaga

SEQ ID NO: 907973 - DNA, 25 bp, Mus musculus
ccttcctggtgctacgagtggcctg

SEQ ID NO: 907974 - DNA, 25 bp, Mus musculus
ccttcctggtgctagcacaggttag

SEQ ID NO: 907975 - DNA, 25 bp, Mus musculus
ccttcctggtgctagctggtgaaga

SEQ ID NO: 907976 - DNA, 25 bp, Mus musculus
ccttcctggtgctaggagtggcctg

SEQ ID NO: 907977 - DNA, 25 bp, Mus musculus
ccttcctgtcagagctctggatgtt

SEQ ID NO: 907978 - DNA, 25 bp, Mus musculus
ccttcctgtcagtgctctggatgtt

SEQ ID NO: 907979 - DNA, 25 bp, Mus musculus
ccttccttacagataccatttatga

SEQ ID NO: 907980 - DNA, 25 bp, Mus musculus
ccttccttacagttaccatttatga

SEQ ID NO: 907981 - DNA, 25 bp, Mus musculus
ccttccttcacgagaatattgggac

SEQ ID NO: 907982 - DNA, 25 bp, Mus musculus
ccttccttcaggagaatattgggac

SEQ ID NO: 907983 - DNA, 25 bp, Mus musculus
ccttcgagaaatgactcctctctgg

SEQ ID NO: 907984 - DNA, 25 bp, Mus musculus
ccttcgagaaatgagtcctctctgg

SEQ ID NO: 907985 - DNA, 25 bp, Mus musculus
ccttcgagagctgctgagcttgtga

SEQ ID NO: 907986 - DNA, 25 bp, Mus musculus
ccttcgagaggtgctgagcttgtga

SEQ ID NO: 907987 - DNA, 25 bp, Mus musculus
ccttcgataccgacatccatgctgt

SEQ ID NO: 907988 - DNA, 25 bp, Mus musculus
ccttcgataccgtcatccatgctgt

SEQ ID NO: 907989 - DNA, 25 bp, Mus musculus
ccttcgccagatctcaggccgcctg

SEQ ID NO: 907990 - DNA, 25 bp, Mus musculus
ccttcgccagttctcaggccgcctg

SEQ ID NO: 907991 - DNA, 25 bp, Mus musculus
ccttcgcgtcaccgtcttgttgcag

SEQ ID NO: 907992 - DNA, 25 bp, Mus musculus
ccttcgcgtcacggtcttgttgcag

SEQ ID NO: 907993 - DNA, 25 bp, Mus musculus
ccttcggcagctcacgtgcctggtc

SEQ ID NO: 907994 - DNA, 25 bp, Mus musculus
ccttcggcagctcaggtgcctggtc

SEQ ID NO: 907995 - DNA, 25 bp, Mus musculus
ccttcggctgaaccacatgtcagtg

SEQ ID NO: 907996 - DNA, 25 bp, Mus musculus
ccttcggctgaacctcatgtcagtg

SEQ ID NO: 907997 - DNA, 25 bp, Mus musculus
ccttcggtgttgctctggtcagcta

SEQ ID NO: 907998 - DNA, 25 bp, Mus musculus
ccttcggtgttggtctggtcagcta

SEQ ID NO: 907999 - DNA, 25 bp, Mus musculus
ccttctaagccacatccttccacac

SEQ ID NO: 908000 - DNA, 25 bp, Mus musculus
ccttctaagccagatccttccacac

SEQ ID NO: 908001 - DNA, 25 bp, Mus musculus
ccttctacagcatgctggcccagaa

SEQ ID NO: 908002 - DNA, 25 bp, Mus musculus
ccttctacagcggcaatgaagatac

SEQ ID NO: 908003 - DNA, 25 bp, Mus musculus
ccttctacaggatgctggcccagaa

SEQ ID NO: 908004 - DNA, 25 bp, Mus musculus
ccttctacaggggcaatgaagatac

SEQ ID NO: 908005 - DNA, 25 bp, Mus musculus
ccttctaccccactgctgtgatctc

SEQ ID NO: 908006 - DNA, 25 bp, Mus musculus
ccttctaccccagtgctgtgatctc

SEQ ID NO: 908007 - DNA, 25 bp, Mus musculus
ccttctacggctgtgccttcttcca

SEQ ID NO: 908008 - DNA, 25 bp, Mus musculus
ccttctacgggtgtgccttcttcca

SEQ ID NO: 908009 - DNA, 25 bp, Mus musculus
ccttctacgtggccatctacattct

SEQ ID NO: 908010 - DNA, 25 bp, Mus musculus
ccttctacgtgggcatctacattct

SEQ ID NO: 908011 - DNA, 25 bp, Mus musculus
ccttctactacgatgatactaccct

SEQ ID NO: 908012 - DNA, 25 bp, Mus musculus
ccttctactacgttgatactaccct

SEQ ID NO: 908013 - DNA, 25 bp, Mus musculus
ccttctagacaacgcaggttcaccg

SEQ ID NO: 908014 - DNA, 25 bp, Mus musculus
ccttctagacaaggcaggttcaccg

SEQ ID NO: 908015 - DNA, 25 bp, Mus musculus
ccttctcaaaattacgtgtgaacat

SEQ ID NO: 908016 - DNA, 25 bp, Mus musculus
ccttctcaaaattaggtgtgaacat

SEQ ID NO: 908017 - DNA, 25 bp, Mus musculus
ccttctcaacagcgaaacggatatg

SEQ ID NO: 908018 - DNA, 25 bp, Mus musculus
ccttctcaacagggaaacggatatg

SEQ ID NO: 908019 - DNA, 25 bp, Mus musculus
ccttctcacttcgtcacatcaccgc

SEQ ID NO: 908020 - DNA, 25 bp, Mus musculus
ccttctcacttcgtgacatcaccgc

SEQ ID NO: 908021 - DNA, 25 bp, Mus musculus
ccttctcagcagcgggcttcgcagg

SEQ ID NO: 908022 - DNA, 25 bp, Mus musculus
ccttctcagccacagtgcgggcttc

SEQ ID NO: 908023 - DNA, 25 bp, Mus musculus
ccttctcagcgacagtgcgggcttc

SEQ ID NO: 908024 - DNA, 25 bp, Mus musculus
ccttctcagctgcgggcttcgcagg

SEQ ID NO: 908025 - DNA, 25 bp, Mus musculus
ccttctcatcttgacaacccagcag

SEQ ID NO: 908026 - DNA, 25 bp, Mus musculus
ccttctcatcttgagaacccagcag

SEQ ID NO: 908027 - DNA, 25 bp, Mus musculus
ccttctccaaattaagtgccaccaa

SEQ ID NO: 908028 - DNA, 25 bp, Mus musculus
ccttctccaaattatgtgccaccaa

SEQ ID NO: 908029 - DNA, 25 bp, Mus musculus
ccttctccaagtatcaaggaggagt

SEQ ID NO: 908030 - DNA, 25 bp, Mus musculus
ccttctccaagtatgaaggaggagt

SEQ ID NO: 908031 - DNA, 25 bp, Mus musculus
ccttctccagcaccaagagccagag

SEQ ID NO: 908032 - DNA, 25 bp, Mus musculus
ccttctccagcacgacccaacctcc

SEQ ID NO: 908033 - DNA, 25 bp, Mus musculus
ccttctccagcagcaagagccagag

SEQ ID NO: 908034 - DNA, 25 bp, Mus musculus
ccttctccagcaggacccaacctcc

SEQ ID NO: 908035 - DNA, 25 bp, Mus musculus
ccttctccatcacggcatccagaga

SEQ ID NO: 908036 - DNA, 25 bp, Mus musculus
ccttctccatcagggcatccagaga

SEQ ID NO: 908037 - DNA, 25 bp, Mus musculus
ccttctccccgacattctgaagtat

SEQ ID NO: 908038 - DNA, 25 bp, Mus musculus
ccttctccccgagattctgaagtat

SEQ ID NO: 908039 - DNA, 25 bp, Mus musculus
ccttctcctgaaacactgtgcccca

SEQ ID NO: 908040 - DNA, 25 bp, Mus musculus
ccttctcctgaaatccctaacatac

SEQ ID NO: 908041 - DNA, 25 bp, Mus musculus
ccttctcctgaaatgcctaacatac

SEQ ID NO: 908042 - DNA, 25 bp, Mus musculus
ccttctcctgtaacactgtgcccca

SEQ ID NO: 908043 - DNA, 25 bp, Mus musculus
ccttctctacagcaggtgtaggggg

SEQ ID NO: 908044 - DNA, 25 bp, Mus musculus
ccttctctacaggaggtgtaggggg

SEQ ID NO: 908045 - DNA, 25 bp, Mus musculus
ccttctctcactcatgattccttca

SEQ ID NO: 908046 - DNA, 25 bp, Mus musculus
ccttctctcactgatgattccttca

SEQ ID NO: 908047 - DNA, 25 bp, Mus musculus
ccttctgcctgacaaattgacatca

SEQ ID NO: 908048 - DNA, 25 bp, Mus musculus
ccttctgcctgacaattggcagctt

SEQ ID NO: 908049 - DNA, 25 bp, Mus musculus
ccttctgcctgacatattgacatca

SEQ ID NO: 908050 - DNA, 25 bp, Mus musculus
ccttctgcctgacatttggcagctt

SEQ ID NO: 908051 - DNA, 25 bp, Mus musculus
ccttctggactgtccggccttccac

SEQ ID NO: 908052 - DNA, 25 bp, Mus musculus
ccttctggactgtcgggccttccac

SEQ ID NO: 908053 - DNA, 25 bp, Mus musculus
ccttctggagcacatcttatactgc

SEQ ID NO: 908054 - DNA, 25 bp, Mus musculus
ccttctggaggacatcttatactgc

SEQ ID NO: 908055 - DNA, 25 bp, Mus musculus
ccttctggcctgaacggggagcctg

SEQ ID NO: 908056 - DNA, 25 bp, Mus musculus
ccttctggcctgaagggggagcctg

SEQ ID NO: 908057 - DNA, 25 bp, Mus musculus
ccttctggggaacacactttggact

SEQ ID NO: 908058 - DNA, 25 bp, Mus musculus
ccttctggggaacagactttggact

SEQ ID NO: 908059 - DNA, 25 bp, Mus musculus
ccttcttcagaaaggtgcagatccc

SEQ ID NO: 908060 - DNA, 25 bp, Mus musculus
ccttcttcagaatggtgcagatccc

SEQ ID NO: 908061 - DNA, 25 bp, Mus musculus
ccttcttcagagggagtctggagga

SEQ ID NO: 908062 - DNA, 25 bp, Mus musculus
ccttcttcagtgggagtctggagga

SEQ ID NO: 908063 - DNA, 25 bp, Mus musculus
ccttcttcgcagaatacaaacagct

SEQ ID NO: 908064 - DNA, 25 bp, Mus musculus
ccttcttcgcagattcttttcttgc

SEQ ID NO: 908065 - DNA, 25 bp, Mus musculus
ccttcttcgctgaatacaaacagct

SEQ ID NO: 908066 - DNA, 25 bp, Mus musculus
ccttcttcgctgattcttttcttgc

SEQ ID NO: 908067 - DNA, 25 bp, Mus musculus
ccttcttgagcgccttcttgaagta

SEQ ID NO: 908068 - DNA, 25 bp, Mus musculus
ccttcttgagctgaaaattgagaag

SEQ ID NO: 908069 - DNA, 25 bp, Mus musculus
ccttcttgagggccttcttgaagta

SEQ ID NO: 908070 - DNA, 25 bp, Mus musculus
ccttcttgaggtgaaaattgagaag

SEQ ID NO: 908071 - DNA, 25 bp, Mus musculus
ccttcttgcagcagctctgctttgc

SEQ ID NO: 908072 - DNA, 25 bp, Mus musculus
ccttcttgcagcaggtctgctttgc

SEQ ID NO: 908073 - DNA, 25 bp, Mus musculus
ccttcttgcatgaatggagaaaagt

SEQ ID NO: 908074 - DNA, 25 bp, Mus musculus
ccttcttgcatgcagaatggagaaa

SEQ ID NO: 908075 - DNA, 25 bp, Mus musculus
ccttcttgcatggagaatggagaaa

SEQ ID NO: 908076 - DNA, 25 bp, Mus musculus
ccttcttgcatgtatggagaaaagt

SEQ ID NO: 908077 - DNA, 25 bp, Mus musculus
ccttcttggccacactgaacacttg

SEQ ID NO: 908078 - DNA, 25 bp, Mus musculus
ccttcttggccagactgaacacttg

SEQ ID NO: 908079 - DNA, 25 bp, Mus musculus
ccttctttcccgctcaatctgtgtg

SEQ ID NO: 908080 - DNA, 25 bp, Mus musculus
ccttctttcccggtcaatctgtgtg

SEQ ID NO: 908081 - DNA, 25 bp, Mus musculus
ccttcttttgccgtgcccacacttt

SEQ ID NO: 908082 - DNA, 25 bp, Mus musculus
ccttcttttgcttctgcagtgagag

SEQ ID NO: 908083 - DNA, 25 bp, Mus musculus
ccttcttttggcgtgcccacacttt

SEQ ID NO: 908084 - DNA, 25 bp, Mus musculus
ccttcttttggttctgcagtgagag

SEQ ID NO: 908085 - DNA, 25 bp, Mus musculus
ccttgaaagcagccgctaacgtcct

SEQ ID NO: 908086 - DNA, 25 bp, Mus musculus
ccttgaaagcaggcgctaacgtcct

SEQ ID NO: 908087 - DNA, 25 bp, Mus musculus
ccttgaacggtgcacatgtcgacga

SEQ ID NO: 908088 - DNA, 25 bp, Mus musculus
ccttgaacggtgcagatgtcgacga

SEQ ID NO: 908089 - DNA, 25 bp, Mus musculus
ccttgacaatatcaacatgacacac

SEQ ID NO: 908090 - DNA, 25 bp, Mus musculus
ccttgacaatttcaacatgacacac

SEQ ID NO: 908091 - DNA, 25 bp, Mus musculus
ccttgacatgtgcggagttggctgt

SEQ ID NO: 908092 - DNA, 25 bp, Mus musculus
ccttgacatgtggggagttggctgt

SEQ ID NO: 908093 - DNA, 25 bp, Mus musculus
ccttgacccatgctgccagtttggt

SEQ ID NO: 908094 - DNA, 25 bp, Mus musculus
ccttgacccatggtgccagtttggt

SEQ ID NO: 908095 - DNA, 25 bp, Mus musculus
ccttgacctgaaacatcctataaat

SEQ ID NO: 908096 - DNA, 25 bp, Mus musculus
ccttgacctgaatcatcctataaat

SEQ ID NO: 908097 - DNA, 25 bp, Mus musculus
ccttgacgagatgctgttggctgct

SEQ ID NO: 908098 - DNA, 25 bp, Mus musculus
ccttgacgagcggatgagagagtcc

SEQ ID NO: 908099 - DNA, 25 bp, Mus musculus
ccttgacgaggggatgagagagtcc

SEQ ID NO: 908100 - DNA, 25 bp, Mus musculus
ccttgacgagttgctgttggctgct

SEQ ID NO: 908101 - DNA, 25 bp, Mus musculus
ccttgactacatcgccacctggaac

SEQ ID NO: 908102 - DNA, 25 bp, Mus musculus
ccttgactacatggccacctggaac

SEQ ID NO: 908103 - DNA, 25 bp, Mus musculus
ccttgacttctgctaagcggtacat

SEQ ID NO: 908104 - DNA, 25 bp, Mus musculus
ccttgacttctggtaagcggtacat

SEQ ID NO: 908105 - DNA, 25 bp, Mus musculus
ccttgagaagattcactcctgggtt

SEQ ID NO: 908106 - DNA, 25 bp, Mus musculus
ccttgagaagtttcactcctgggtt

SEQ ID NO: 908107 - DNA, 25 bp, Mus musculus
ccttgagacaccgacagtgtgggtt

SEQ ID NO: 908108 - DNA, 25 bp, Mus musculus
ccttgagacaccgagagtgtgggtt

SEQ ID NO: 908109 - DNA, 25 bp, Mus musculus
ccttgagagtctatcaccactactt

SEQ ID NO: 908110 - DNA, 25 bp, Mus musculus
ccttgagagtctttcaccactactt

SEQ ID NO: 908111 - DNA, 25 bp, Mus musculus
ccttgagcagcaggcttctcagaca

SEQ ID NO: 908112 - DNA, 25 bp, Mus musculus
ccttgagcagcccaaagaagtgcag

SEQ ID NO: 908113 - DNA, 25 bp, Mus musculus
ccttgagcaggaggcttctcagaca

SEQ ID NO: 908114 - DNA, 25 bp, Mus musculus
ccttgagcaggccaaagaagtgcag

SEQ ID NO: 908115 - DNA, 25 bp, Mus musculus
ccttgatagtcacacagctctttgc

SEQ ID NO: 908116 - DNA, 25 bp, Mus musculus
ccttgatagtcacagagctctttgc

SEQ ID NO: 908117 - DNA, 25 bp, Mus musculus
ccttgatgcaaaatttgctgatcag

SEQ ID NO: 908118 - DNA, 25 bp, Mus musculus
ccttgatgcaaattttgctgatcag

SEQ ID NO: 908119 - DNA, 25 bp, Mus musculus
ccttgatgccagacggaaaaggcgt

SEQ ID NO: 908120 - DNA, 25 bp, Mus musculus
ccttgatgccagtcggaaaaggcgt

SEQ ID NO: 908121 - DNA, 25 bp, Mus musculus
ccttgatggcaactatgtctatata

SEQ ID NO: 908122 - DNA, 25 bp, Mus musculus
ccttgatggcaagtatgtctatata

SEQ ID NO: 908123 - DNA, 25 bp, Mus musculus
ccttgatgtgaccgcgtgtgtggac

SEQ ID NO: 908124 - DNA, 25 bp, Mus musculus
ccttgatgtgacggcgtgtgtggac

SEQ ID NO: 908125 - DNA, 25 bp, Mus musculus
ccttgattgccagacgcatgaatcc

SEQ ID NO: 908126 - DNA, 25 bp, Mus musculus
ccttgattgccagaggcatgaatcc

SEQ ID NO: 908127 - DNA, 25 bp, Mus musculus
ccttgcaaatcaacaggtggcctag

SEQ ID NO: 908128 - DNA, 25 bp, Mus musculus
ccttgcaaatcatcaggtggcctag

SEQ ID NO: 908129 - DNA, 25 bp, Mus musculus
ccttgcacagagaagtgattgaaaa

SEQ ID NO: 908130 - DNA, 25 bp, Mus musculus
ccttgcacagtgaagtgattgaaaa

SEQ ID NO: 908131 - DNA, 25 bp, Mus musculus
ccttgcagaaagcacgccgtctact

SEQ ID NO: 908132 - DNA, 25 bp, Mus musculus
ccttgcagaaagcacggctgactgt

SEQ ID NO: 908133 - DNA, 25 bp, Mus musculus
ccttgcagaaagcaggccgtctact

SEQ ID NO: 908134 - DNA, 25 bp, Mus musculus
ccttgcagaaagcagggctgactgt

SEQ ID NO: 908135 - DNA, 25 bp, Mus musculus
ccttgcaggtgtatcatgaagaccc

SEQ ID NO: 908136 - DNA, 25 bp, Mus musculus
ccttgcaggtgtatgatgaagaccc

SEQ ID NO: 908137 - DNA, 25 bp, Mus musculus
ccttgcatacagaaatgtgcaagaa

SEQ ID NO: 908138 - DNA, 25 bp, Mus musculus
ccttgcatacagtaatgtgcaagaa

SEQ ID NO: 908139 - DNA, 25 bp, Mus musculus
ccttgcatgagtcgtgtgacggctg

SEQ ID NO: 908140 - DNA, 25 bp, Mus musculus
ccttgcatgagtggtgtgacggctg

SEQ ID NO: 908141 - DNA, 25 bp, Mus musculus
ccttgccaaaaactttctgaagcgg

SEQ ID NO: 908142 - DNA, 25 bp, Mus musculus
ccttgccaaaaagtttctgaagcgg

SEQ ID NO: 908143 - DNA, 25 bp, Mus musculus
ccttgcccagccagagaactcttcg

SEQ ID NO: 908144 - DNA, 25 bp, Mus musculus
ccttgcccaggcagagaactcttcg

SEQ ID NO: 908145 - DNA, 25 bp, Mus musculus
ccttgccgctcacattttggcagtg

SEQ ID NO: 908146 - DNA, 25 bp, Mus musculus
ccttgccgctcagattttggcagtg

SEQ ID NO: 908147 - DNA, 25 bp, Mus musculus
ccttgcctgaacaacatgcactccc

SEQ ID NO: 908148 - DNA, 25 bp, Mus musculus
ccttgcctgaacaacctcagccctg

SEQ ID NO: 908149 - DNA, 25 bp, Mus musculus
ccttgcctgaacaagatgcactccc

SEQ ID NO: 908150 - DNA, 25 bp, Mus musculus
ccttgcctgaacaagctcagccctg

SEQ ID NO: 908151 - DNA, 25 bp, Mus musculus
ccttgcctgctggaagtctctaata

SEQ ID NO: 908152 - DNA, 25 bp, Mus musculus
ccttgcctgctggatgtctctaata

SEQ ID NO: 908153 - DNA, 25 bp, Mus musculus
ccttgcgttaagactcctgtccctg

SEQ ID NO: 908154 - DNA, 25 bp, Mus musculus
ccttgcgttatgactcctgtccctg

SEQ ID NO: 908155 - DNA, 25 bp, Mus musculus
ccttgctactcacgtgatcggaaga

SEQ ID NO: 908156 - DNA, 25 bp, Mus musculus
ccttgctactcaggtgatcggaaga

SEQ ID NO: 908157 - DNA, 25 bp, Mus musculus
ccttgctattttctatcctgtttac

SEQ ID NO: 908158 - DNA, 25 bp, Mus musculus
ccttgctattttgtatcctgtttac

SEQ ID NO: 908159 - DNA, 25 bp, Mus musculus
ccttgctcaaagcaaccaacgcatc

SEQ ID NO: 908160 - DNA, 25 bp, Mus musculus
ccttgctcaaaggaaccaacgcatc

SEQ ID NO: 908161 - DNA, 25 bp, Mus musculus
ccttgctcacagcggactacattcc

SEQ ID NO: 908162 - DNA, 25 bp, Mus musculus
ccttgctcacaggggactacattcc

SEQ ID NO: 908163 - DNA, 25 bp, Mus musculus
ccttgctgagcctacagaatccctg

SEQ ID NO: 908164 - DNA, 25 bp, Mus musculus
ccttgctgaggctacagaatccctg

SEQ ID NO: 908165 - DNA, 25 bp, Mus musculus
ccttgctgccagctatgaatcaagt

SEQ ID NO: 908166 - DNA, 25 bp, Mus musculus
ccttgctgccaggtatgaatcaagt

SEQ ID NO: 908167 - DNA, 25 bp, Mus musculus
ccttgctgcgcacatgatgctgaat

SEQ ID NO: 908168 - DNA, 25 bp, Mus musculus
ccttgctgcgcacatgcagaacccc

SEQ ID NO: 908169 - DNA, 25 bp, Mus musculus
ccttgctgcgcagatgatgctgaat

SEQ ID NO: 908170 - DNA, 25 bp, Mus musculus
ccttgctgcgcagatgcagaacccc

SEQ ID NO: 908171 - DNA, 25 bp, Mus musculus
ccttgctgctggctgacactttgca

SEQ ID NO: 908172 - DNA, 25 bp, Mus musculus
ccttgctgctgggtgacactttgca

SEQ ID NO: 908173 - DNA, 25 bp, Mus musculus
ccttgctggttggtcgttttgggct

SEQ ID NO: 908174 - DNA, 25 bp, Mus musculus
ccttgctggttggtggttttgggct

SEQ ID NO: 908175 - DNA, 25 bp, Mus musculus
ccttgctgttctctttgtgaagttc

SEQ ID NO: 908176 - DNA, 25 bp, Mus musculus
ccttgctgttctgtttgtgaagttc

SEQ ID NO: 908177 - DNA, 25 bp, Mus musculus
ccttggaaccagacgggcatgcggg

SEQ ID NO: 908178 - DNA, 25 bp, Mus musculus
ccttggaaccagtcgggcatgcggg

SEQ ID NO: 908179 - DNA, 25 bp, Mus musculus
ccttggacagcctccactgccgccg

SEQ ID NO: 908180 - DNA, 25 bp, Mus musculus
ccttggacaggctccactgccgccg

SEQ ID NO: 908181 - DNA, 25 bp, Mus musculus
ccttggagaatgcttataagtacat

SEQ ID NO: 908182 - DNA, 25 bp, Mus musculus
ccttggagaatggttataagtacat

SEQ ID NO: 908183 - DNA, 25 bp, Mus musculus
ccttggagatcacacacatgggggt

SEQ ID NO: 908184 - DNA, 25 bp, Mus musculus
ccttggagatcacagacatgggggt

SEQ ID NO: 908185 - DNA, 25 bp, Mus musculus
ccttggataactggttagatgaacg

SEQ ID NO: 908186 - DNA, 25 bp, Mus musculus
ccttggataagtggttagatgaacg

SEQ ID NO: 908187 - DNA, 25 bp, Mus musculus
ccttggatccagcaagtggaccaga

SEQ ID NO: 908188 - DNA, 25 bp, Mus musculus
ccttggatccagcatgtggaccaga

SEQ ID NO: 908189 - DNA, 25 bp, Mus musculus
ccttggatccagcccgtggtcccaa

SEQ ID NO: 908190 - DNA, 25 bp, Mus musculus
ccttggatccagccggtggtcccaa

SEQ ID NO: 908191 - DNA, 25 bp, Mus musculus
ccttggatgagaatcaatgcagagt

SEQ ID NO: 908192 - DNA, 25 bp, Mus musculus
ccttggatgagaatgaatgcagagt

SEQ ID NO: 908193 - DNA, 25 bp, Mus musculus
ccttggattcagcagtgcactcaca

SEQ ID NO: 908194 - DNA, 25 bp, Mus musculus
ccttggattcaggagtgcactcaca

SEQ ID NO: 908195 - DNA, 25 bp, Mus musculus
ccttggcaacagaccccaatatcct

SEQ ID NO: 908196 - DNA, 25 bp, Mus musculus
ccttggcaacagtccccaatatcct

SEQ ID NO: 908197 - DNA, 25 bp, Mus musculus
ccttggcagaagctagcacggcttc

SEQ ID NO: 908198 - DNA, 25 bp, Mus musculus
ccttggcagaagctctgcagatcca

SEQ ID NO: 908199 - DNA, 25 bp, Mus musculus
ccttggcagaaggtagcacggcttc

SEQ ID NO: 908200 - DNA, 25 bp, Mus musculus
ccttggcagaaggtctgcagatcca

SEQ ID NO: 908201 - DNA, 25 bp, Mus musculus
ccttggcaggcgaatcaaagactcc

SEQ ID NO: 908202 - DNA, 25 bp, Mus musculus
ccttggcaggggaatcaaagactcc

SEQ ID NO: 908203 - DNA, 25 bp, Mus musculus
ccttggccaagcagcgaaaagctgc

SEQ ID NO: 908204 - DNA, 25 bp, Mus musculus
ccttggccaagcagggaaaagctgc

SEQ ID NO: 908205 - DNA, 25 bp, Mus musculus
ccttggccaccactcctaatagtac

SEQ ID NO: 908206 - DNA, 25 bp, Mus musculus
ccttggccaccagtcctaatagtac

SEQ ID NO: 908207 - DNA, 25 bp, Mus musculus
ccttggctacagcattatcagactt

SEQ ID NO: 908208 - DNA, 25 bp, Mus musculus
ccttggctacaggattatcagactt

SEQ ID NO: 908209 - DNA, 25 bp, Mus musculus
ccttggctatccctttggtgtttat

SEQ ID NO: 908210 - DNA, 25 bp, Mus musculus
ccttggctatccgtttggtgtttat

SEQ ID NO: 908211 - DNA, 25 bp, Mus musculus
ccttggctgacctatatgaagaatc

SEQ ID NO: 908212 - DNA, 25 bp, Mus musculus
ccttggctgagctatatgaagaatc

SEQ ID NO: 908213 - DNA, 25 bp, Mus musculus
ccttggctggcgaaaaaatggctac

SEQ ID NO: 908214 - DNA, 25 bp, Mus musculus
ccttggctggcgacagaaaaatggc

SEQ ID NO: 908215 - DNA, 25 bp, Mus musculus
ccttggctggcgtaaaaatggctac

SEQ ID NO: 908216 - DNA, 25 bp, Mus musculus
ccttggctggcgtcagaaaaatggc

SEQ ID NO: 908217 - DNA, 25 bp, Mus musculus
ccttggcttgcacataaaaatatat

SEQ ID NO: 908218 - DNA, 25 bp, Mus musculus
ccttggcttgcagataaaaatatat

SEQ ID NO: 908219 - DNA, 25 bp, Mus musculus
ccttgggaagcctgctgatctggtg

SEQ ID NO: 908220 - DNA, 25 bp, Mus musculus
ccttgggaaggctgctgatctggtg

SEQ ID NO: 908221 - DNA, 25 bp, Mus musculus
ccttgggaagtatgcgcgagggctt

SEQ ID NO: 908222 - DNA, 25 bp, Mus musculus
ccttgggaagtatgggcgagggctt

SEQ ID NO: 908223 - DNA, 25 bp, Mus musculus
ccttgggagtttcatactatttgca

SEQ ID NO: 908224 - DNA, 25 bp, Mus musculus
ccttgggagtttgatactatttgca

SEQ ID NO: 908225 - DNA, 25 bp, Mus musculus
ccttggggagagcgatgagttcagc

SEQ ID NO: 908226 - DNA, 25 bp, Mus musculus
ccttggggagagggatgagttcagc

SEQ ID NO: 908227 - DNA, 25 bp, Mus musculus
ccttggggcgagatgtacaacatct

SEQ ID NO: 908228 - DNA, 25 bp, Mus musculus
ccttggggcgagttgtacaacatct

SEQ ID NO: 908229 - DNA, 25 bp, Mus musculus
ccttgggtcaagctcgagtatgcct

SEQ ID NO: 908230 - DNA, 25 bp, Mus musculus
ccttgggtcaaggtcgagtatgcct

SEQ ID NO: 908231 - DNA, 25 bp, Mus musculus
ccttggtcctgtcacgacttctggg

SEQ ID NO: 908232 - DNA, 25 bp, Mus musculus
ccttggtcctgtcaggacttctggg

SEQ ID NO: 908233 - DNA, 25 bp, Mus musculus
ccttggtgagcacacctccgtcttc

SEQ ID NO: 908234 - DNA, 25 bp, Mus musculus
ccttggtgagcacagctccgtcttc

SEQ ID NO: 908235 - DNA, 25 bp, Mus musculus
ccttggtgatgagacgaagctttgt

SEQ ID NO: 908236 - DNA, 25 bp, Mus musculus
ccttggtgatgagaggaagctttgt

SEQ ID NO: 908237 - DNA, 25 bp, Mus musculus
ccttggttcaaaacagaagcaaagg

SEQ ID NO: 908238 - DNA, 25 bp, Mus musculus
ccttggttcaaatcagaagcaaagg

SEQ ID NO: 908239 - DNA, 25 bp, Mus musculus
ccttggttgcagatttgcaatacat

SEQ ID NO: 908240 - DNA, 25 bp, Mus musculus
ccttggttgcagctttgcaatacat

SEQ ID NO: 908241 - DNA, 25 bp, Mus musculus
ccttggttgcaggtttgcaatacat

SEQ ID NO: 908242 - DNA, 25 bp, Mus musculus
ccttggttgcagttttgcaatacat

SEQ ID NO: 908243 - DNA, 25 bp, Mus musculus
ccttgtaaaaagctatatcatgtat

SEQ ID NO: 908244 - DNA, 25 bp, Mus musculus
ccttgtaaaaaggtatatcatgtat

SEQ ID NO: 908245 - DNA, 25 bp, Mus musculus
ccttgtaaagaaacgtgtgagaacg

SEQ ID NO: 908246 - DNA, 25 bp, Mus musculus
ccttgtaaagtaacgtgtgagaacg

SEQ ID NO: 908247 - DNA, 25 bp, Mus musculus
ccttgtacagctatcacaaggctgc

SEQ ID NO: 908248 - DNA, 25 bp, Mus musculus
ccttgtacaggtatcacaaggctgc

SEQ ID NO: 908249 - DNA, 25 bp, Mus musculus
ccttgtagacttaacacatgaagag

SEQ ID NO: 908250 - DNA, 25 bp, Mus musculus
ccttgtagactttacacatgaagag

SEQ ID NO: 908251 - DNA, 25 bp, Mus musculus
ccttgtcagaacctggcaccaccga

SEQ ID NO: 908252 - DNA, 25 bp, Mus musculus
ccttgtcagaacgtggcaccaccga

SEQ ID NO: 908253 - DNA, 25 bp, Mus musculus
ccttgtccaacatcgagcggtccac

SEQ ID NO: 908254 - DNA, 25 bp, Mus musculus
ccttgtccaagatcgagcggtccac

SEQ ID NO: 908255 - DNA, 25 bp, Mus musculus
ccttgtccatgcagaatgctgcctg

SEQ ID NO: 908256 - DNA, 25 bp, Mus musculus
ccttgtccatgcagacccccagcct

SEQ ID NO: 908257 - DNA, 25 bp, Mus musculus
ccttgtccatgcagtatgctgcctg

SEQ ID NO: 908258 - DNA, 25 bp, Mus musculus
ccttgtccatgcagtcccccagcct

SEQ ID NO: 908259 - DNA, 25 bp, Mus musculus
ccttgtctagttcacgccagctgct

SEQ ID NO: 908260 - DNA, 25 bp, Mus musculus
ccttgtctagttcaggccagctgct

SEQ ID NO: 908261 - DNA, 25 bp, Mus musculus
ccttgtgagcatgacgttgtctatt

SEQ ID NO: 908262 - DNA, 25 bp, Mus musculus
ccttgtgagcatgacttggatatac

SEQ ID NO: 908263 - DNA, 25 bp, Mus musculus
ccttgtgagcatgaggttgtctatt

SEQ ID NO: 908264 - DNA, 25 bp, Mus musculus
ccttgtgagcatgagttggatatac

SEQ ID NO: 908265 - DNA, 25 bp, Mus musculus
ccttgtgcctacttgagcatcgatg

SEQ ID NO: 908266 - DNA, 25 bp, Mus musculus
ccttgtgccttcttgagcatcgatg

SEQ ID NO: 908267 - DNA, 25 bp, Mus musculus
ccttgtggagctcttccaagttgct

SEQ ID NO: 908268 - DNA, 25 bp, Mus musculus
ccttgtggaggtcttccaagttgct

SEQ ID NO: 908269 - DNA, 25 bp, Mus musculus
ccttgtggtcaaagcttctttggac

SEQ ID NO: 908270 - DNA, 25 bp, Mus musculus
ccttgtggtcaatgcttctttggac

SEQ ID NO: 908271 - DNA, 25 bp, Mus musculus
ccttgttgcaagagaaccatccttc

SEQ ID NO: 908272 - DNA, 25 bp, Mus musculus
ccttgttgcaagtgaaccatccttc

SEQ ID NO: 908273 - DNA, 25 bp, Mus musculus
ccttgttgctctctcgatcctgacc

SEQ ID NO: 908274 - DNA, 25 bp, Mus musculus
ccttgttgctctgtcgatcctgacc

SEQ ID NO: 908275 - DNA, 25 bp, Mus musculus
ccttgttgtcctcgtgggtaccaga

SEQ ID NO: 908276 - DNA, 25 bp, Mus musculus
ccttgttgtcctggtgggtaccaga

SEQ ID NO: 908277 - DNA, 25 bp, Mus musculus
ccttgttttctgtcaagacaccatg

SEQ ID NO: 908278 - DNA, 25 bp, Mus musculus
ccttgttttctgtctagacaccatg

SEQ ID NO: 908279 - DNA, 25 bp, Mus musculus
cctttaacccagctgactcatattc

SEQ ID NO: 908280 - DNA, 25 bp, Mus musculus
cctttaacccaggtgactcatattc

SEQ ID NO: 908281 - DNA, 25 bp, Mus musculus
cctttaccagacagcactgcatctg

SEQ ID NO: 908282 - DNA, 25 bp, Mus musculus
cctttaccagcgccactcagtccca

SEQ ID NO: 908283 - DNA, 25 bp, Mus musculus
cctttaccagcggcactcagtccca

SEQ ID NO: 908284 - DNA, 25 bp, Mus musculus
cctttaccagtcagcactgcatctg

SEQ ID NO: 908285 - DNA, 25 bp, Mus musculus
cctttactccagacaaatcgccatc

SEQ ID NO: 908286 - DNA, 25 bp, Mus musculus
cctttactccagagcctatgactcc

SEQ ID NO: 908287 - DNA, 25 bp, Mus musculus
cctttactccagtcaaatcgccatc

SEQ ID NO: 908288 - DNA, 25 bp, Mus musculus
cctttactccagtgcctatgactcc

SEQ ID NO: 908289 - DNA, 25 bp, Mus musculus
cctttactgacaccttttgcctacc

SEQ ID NO: 908290 - DNA, 25 bp, Mus musculus
cctttactgacagcttttgcctacc

SEQ ID NO: 908291 - DNA, 25 bp, Mus musculus
cctttactttcaacatcaaagtggc

SEQ ID NO: 908292 - DNA, 25 bp, Mus musculus
cctttactttcatcatcaaagtggc

SEQ ID NO: 908293 - DNA, 25 bp, Mus musculus
cctttagccccactggatctaaagg

SEQ ID NO: 908294 - DNA, 25 bp, Mus musculus
cctttagccccagtggatctaaagg

SEQ ID NO: 908295 - DNA, 25 bp, Mus musculus
cctttatcagcgtatcagagcatcg

SEQ ID NO: 908296 - DNA, 25 bp, Mus musculus
cctttatcagggtatcagagcatcg

SEQ ID NO: 908297 - DNA, 25 bp, Mus musculus
cctttatgtttggacgccatgacac

SEQ ID NO: 908298 - DNA, 25 bp, Mus musculus
cctttatgtttggaggccatgacac

SEQ ID NO: 908299 - DNA, 25 bp, Mus musculus
cctttcaaagatacccctgatcaag

SEQ ID NO: 908300 - DNA, 25 bp, Mus musculus
cctttcaaagttacccctgatcaag

SEQ ID NO: 908301 - DNA, 25 bp, Mus musculus
cctttcacagagcatgatctcctcc

SEQ ID NO: 908302 - DNA, 25 bp, Mus musculus
cctttcacagcctcctgagcattcc

SEQ ID NO: 908303 - DNA, 25 bp, Mus musculus
cctttcacaggctcctgagcattcc

SEQ ID NO: 908304 - DNA, 25 bp, Mus musculus
cctttcacagtgcatgatctcctcc

SEQ ID NO: 908305 - DNA, 25 bp, Mus musculus
cctttcaccaacctccatgtgtcct

SEQ ID NO: 908306 - DNA, 25 bp, Mus musculus
cctttcaccaacgtccatgtgtcct

SEQ ID NO: 908307 - DNA, 25 bp, Mus musculus
cctttcagaacactgtggaagtcgg

SEQ ID NO: 908308 - DNA, 25 bp, Mus musculus
cctttcagaacagtgtggaagtcgg

SEQ ID NO: 908309 - DNA, 25 bp, Mus musculus
cctttcagaccacccacagggttct

SEQ ID NO: 908310 - DNA, 25 bp, Mus musculus
cctttcagaccagccacagggttct

SEQ ID NO: 908311 - DNA, 25 bp, Mus musculus
cctttcatgtaacgtggtttgtgat

SEQ ID NO: 908312 - DNA, 25 bp, Mus musculus
cctttcatgtaaggtggtttgtgat

SEQ ID NO: 908313 - DNA, 25 bp, Mus musculus
cctttccacgacgtggctgagtgcc

SEQ ID NO: 908314 - DNA, 25 bp, Mus musculus
cctttccacgtcgtggctgagtgcc

SEQ ID NO: 908315 - DNA, 25 bp, Mus musculus
cctttcctaacgctgctgcattttt

SEQ ID NO: 908316 - DNA, 25 bp, Mus musculus
cctttcctaacggtgctgcattttt

SEQ ID NO: 908317 - DNA, 25 bp, Mus musculus
cctttcctgaagatgatccatgcca

SEQ ID NO: 908318 - DNA, 25 bp, Mus musculus
cctttcctgaagttgatccatgcca

SEQ ID NO: 908319 - DNA, 25 bp, Mus musculus
cctttcctttcacgcctcagggctg

SEQ ID NO: 908320 - DNA, 25 bp, Mus musculus
cctttcctttcaggcctcagggctg

SEQ ID NO: 908321 - DNA, 25 bp, Mus musculus
cctttcggtgctagcctggatgtct

SEQ ID NO: 908322 - DNA, 25 bp, Mus musculus
cctttcggtggtagcctggatgtct

SEQ ID NO: 908323 - DNA, 25 bp, Mus musculus
cctttctactatcattggtacagcc

SEQ ID NO: 908324 - DNA, 25 bp, Mus musculus
cctttctactatgattggtacagcc

SEQ ID NO: 908325 - DNA, 25 bp, Mus musculus
cctttctattctggagaaagaacgg

SEQ ID NO: 908326 - DNA, 25 bp, Mus musculus
cctttctattctggtgaaagaacgg

SEQ ID NO: 908327 - DNA, 25 bp, Mus musculus
cctttctctacacacgaaatccacc

SEQ ID NO: 908328 - DNA, 25 bp, Mus musculus
cctttctctacacacgctgacaaga

SEQ ID NO: 908329 - DNA, 25 bp, Mus musculus
cctttctctacacaggaaatccacc

SEQ ID NO: 908330 - DNA, 25 bp, Mus musculus
cctttctctacacaggctgacaaga

SEQ ID NO: 908331 - DNA, 25 bp, Mus musculus
cctttctctgagctcctggcctact

SEQ ID NO: 908332 - DNA, 25 bp, Mus musculus
cctttctctgaggtcctggcctact

SEQ ID NO: 908333 - DNA, 25 bp, Mus musculus
cctttctctgattgacgggcatctc

SEQ ID NO: 908334 - DNA, 25 bp, Mus musculus
cctttctctgtttgacgggcatctc

SEQ ID NO: 908335 - DNA, 25 bp, Mus musculus
cctttctcttaccttactgggagca

SEQ ID NO: 908336 - DNA, 25 bp, Mus musculus
cctttctcttacgttactgggagca

SEQ ID NO: 908337 - DNA, 25 bp, Mus musculus
cctttctgaagactcctcacgaggc

SEQ ID NO: 908338 - DNA, 25 bp, Mus musculus
cctttctgaagagtcctcacgaggc

SEQ ID NO: 908339 - DNA, 25 bp, Mus musculus
cctttctgagcaactggtgttcaat

SEQ ID NO: 908340 - DNA, 25 bp, Mus musculus
cctttctgaggaactggtgttcaat

SEQ ID NO: 908341 - DNA, 25 bp, Mus musculus
cctttctgcaagactacagagcggg

SEQ ID NO: 908342 - DNA, 25 bp, Mus musculus
cctttctgcaagtctacagagcggg

SEQ ID NO: 908343 - DNA, 25 bp, Mus musculus
cctttctggaaacaatatccagtta

SEQ ID NO: 908344 - DNA, 25 bp, Mus musculus
cctttctggaaagaatatccagtta

SEQ ID NO: 908345 - DNA, 25 bp, Mus musculus
cctttctgtccacactggaagacca

SEQ ID NO: 908346 - DNA, 25 bp, Mus musculus
cctttctgtccagactggaagacca

SEQ ID NO: 908347 - DNA, 25 bp, Mus musculus
cctttctgtgaacaaaagacatgct

SEQ ID NO: 908348 - DNA, 25 bp, Mus musculus
cctttctgtgaagaaaagacatgct

SEQ ID NO: 908349 - DNA, 25 bp, Mus musculus
cctttctttgatatgcacatgatgg

SEQ ID NO: 908350 - DNA, 25 bp, Mus musculus
cctttctttgttatgcacatgatgg

SEQ ID NO: 908351 - DNA, 25 bp, Mus musculus
cctttgaagccacgtgtttggcctt

SEQ ID NO: 908352 - DNA, 25 bp, Mus musculus
cctttgaagccaggtgtttggcctt

SEQ ID NO: 908353 - DNA, 25 bp, Mus musculus
cctttgacaattggctcattgaaga

SEQ ID NO: 908354 - DNA, 25 bp, Mus musculus
cctttgacaattgggtcattgaaga

SEQ ID NO: 908355 - DNA, 25 bp, Mus musculus
cctttgaccgcacacgtactgagac

SEQ ID NO: 908356 - DNA, 25 bp, Mus musculus
cctttgaccgcacaggtactgagac

SEQ ID NO: 908357 - DNA, 25 bp, Mus musculus
cctttgacctgttccacatcgggca

SEQ ID NO: 908358 - DNA, 25 bp, Mus musculus
cctttgacctgttcgacatcgggca

SEQ ID NO: 908359 - DNA, 25 bp, Mus musculus
cctttgacgacatcgctgaaggctc

SEQ ID NO: 908360 - DNA, 25 bp, Mus musculus
cctttgacgagatcgctgaaggctc

SEQ ID NO: 908361 - DNA, 25 bp, Mus musculus
cctttgactgaggcagccacagcag

SEQ ID NO: 908362 - DNA, 25 bp, Mus musculus
cctttgactgtggcagccacagcag

SEQ ID NO: 908363 - DNA, 25 bp, Mus musculus
cctttgagcgcttacgagacaagca

SEQ ID NO: 908364 - DNA, 25 bp, Mus musculus
cctttgagcgcttaggagacaagca

SEQ ID NO: 908365 - DNA, 25 bp, Mus musculus
cctttgagtacacgtgatttgaact

SEQ ID NO: 908366 - DNA, 25 bp, Mus musculus
cctttgagtacaggactgtaccaca

SEQ ID NO: 908367 - DNA, 25 bp, Mus musculus
cctttgagtacaggtctgtaccaca

SEQ ID NO: 908368 - DNA, 25 bp, Mus musculus
cctttgagtacaggtgatttgaact

SEQ ID NO: 908369 - DNA, 25 bp, Mus musculus
cctttgatttttacatggacttgac

SEQ ID NO: 908370 - DNA, 25 bp, Mus musculus
cctttgatttttacttggacttgac

SEQ ID NO: 908371 - DNA, 25 bp, Mus musculus
cctttgcaatcgatggcagctcaac

SEQ ID NO: 908372 - DNA, 25 bp, Mus musculus
cctttgcaatcgttggcagctcaac

SEQ ID NO: 908373 - DNA, 25 bp, Mus musculus
cctttgccaaagcccactgtggaat

SEQ ID NO: 908374 - DNA, 25 bp, Mus musculus
cctttgccaaaggccactgtggaat

SEQ ID NO: 908375 - DNA, 25 bp, Mus musculus
cctttgccacatcacggcacttgat

SEQ ID NO: 908376 - DNA, 25 bp, Mus musculus
cctttgccacatcagggcacttgat

SEQ ID NO: 908377 - DNA, 25 bp, Mus musculus
cctttgccatcctttcactgaccta

SEQ ID NO: 908378 - DNA, 25 bp, Mus musculus
cctttgccatgctttcactgaccta

SEQ ID NO: 908379 - DNA, 25 bp, Mus musculus
cctttgctgcagcaatcctggagag

SEQ ID NO: 908380 - DNA, 25 bp, Mus musculus
cctttgctgcaggaatcctggagag

SEQ ID NO: 908381 - DNA, 25 bp, Mus musculus
cctttggaggtgtgcgtgccagtgg

SEQ ID NO: 908382 - DNA, 25 bp, Mus musculus
cctttggaggtgtgggtgccagtgg

SEQ ID NO: 908383 - DNA, 25 bp, Mus musculus
cctttggcccgacacttctctttgg

SEQ ID NO: 908384 - DNA, 25 bp, Mus musculus
cctttggcccgacagttctctttgg

SEQ ID NO: 908385 - DNA, 25 bp, Mus musculus
cctttggcgtagccggacttggagg

SEQ ID NO: 908386 - DNA, 25 bp, Mus musculus
cctttggcgtaggcggacttggagg

SEQ ID NO: 908387 - DNA, 25 bp, Mus musculus
cctttggtagacactggctggaggc

SEQ ID NO: 908388 - DNA, 25 bp, Mus musculus
cctttggtagactctggctggaggc

SEQ ID NO: 908389 - DNA, 25 bp, Mus musculus
cctttggtgaagcccgcagtacaaa

SEQ ID NO: 908390 - DNA, 25 bp, Mus musculus
cctttggtgaaggccgcagtacaaa

SEQ ID NO: 908391 - DNA, 25 bp, Mus musculus
cctttgtcaagcactggctgaaacc

SEQ ID NO: 908392 - DNA, 25 bp, Mus musculus
cctttgtcaagctctggctgaaacc

SEQ ID NO: 908393 - DNA, 25 bp, Mus musculus
cctttgtgcgagacggcccccttga

SEQ ID NO: 908394 - DNA, 25 bp, Mus musculus
cctttgtgcgagtcggcccccttga

SEQ ID NO: 908395 - DNA, 25 bp, Mus musculus
cctttgtggcagacttcccaggcca

SEQ ID NO: 908396 - DNA, 25 bp, Mus musculus
cctttgtggcagactttcagccaac

SEQ ID NO: 908397 - DNA, 25 bp, Mus musculus
cctttgtggcagtcttcccaggcca

SEQ ID NO: 908398 - DNA, 25 bp, Mus musculus
cctttgtggcagtctttcagccaac

SEQ ID NO: 908399 - DNA, 25 bp, Mus musculus
cctttgttccataacggtcctgtga

SEQ ID NO: 908400 - DNA, 25 bp, Mus musculus
cctttgttccataagggtcctgtga

SEQ ID NO: 908401 - DNA, 25 bp, Mus musculus
cctttgttctctcgcattggctacg

SEQ ID NO: 908402 - DNA, 25 bp, Mus musculus
cctttgttctctggcattggctacg

SEQ ID NO: 908403 - DNA, 25 bp, Mus musculus
cctttgtttccccacatcctgtctt

SEQ ID NO: 908404 - DNA, 25 bp, Mus musculus
cctttgtttccccagatcctgtctt

SEQ ID NO: 908405 - DNA, 25 bp, Mus musculus
ccttttaaagcctgcttccatgtgc

SEQ ID NO: 908406 - DNA, 25 bp, Mus musculus
ccttttaaaggctgcttccatgtgc

SEQ ID NO: 908407 - DNA, 25 bp, Mus musculus
ccttttacagcaagtatgagctgta

SEQ ID NO: 908408 - DNA, 25 bp, Mus musculus
ccttttacaggaagtatgagctgta

SEQ ID NO: 908409 - DNA, 25 bp, Mus musculus
ccttttcaaccataactatttcaag

SEQ ID NO: 908410 - DNA, 25 bp, Mus musculus
ccttttcaaccatatctatttcaag

SEQ ID NO: 908411 - DNA, 25 bp, Mus musculus
ccttttcataggatggatgatacat

SEQ ID NO: 908412 - DNA, 25 bp, Mus musculus
ccttttcataggttggatgatacat

SEQ ID NO: 908413 - DNA, 25 bp, Mus musculus
ccttttccagacagtccaggatggc

SEQ ID NO: 908414 - DNA, 25 bp, Mus musculus
ccttttccagatggatgtccctggc

SEQ ID NO: 908415 - DNA, 25 bp, Mus musculus
ccttttccagtcagtccaggatggc

SEQ ID NO: 908416 - DNA, 25 bp, Mus musculus
ccttttccagttggatgtccctggc

SEQ ID NO: 908417 - DNA, 25 bp, Mus musculus
ccttttctacagcaagagcagtgaa

SEQ ID NO: 908418 - DNA, 25 bp, Mus musculus
ccttttctacaggaagagcagtgaa

SEQ ID NO: 908419 - DNA, 25 bp, Mus musculus
ccttttgaaggtcaattcttcaaag

SEQ ID NO: 908420 - DNA, 25 bp, Mus musculus
ccttttgaaggtgaattcttcaaag

SEQ ID NO: 908421 - DNA, 25 bp, Mus musculus
ccttttgtcatgaacagccccttta

SEQ ID NO: 908422 - DNA, 25 bp, Mus musculus
ccttttgtcatgaagagccccttta

SEQ ID NO: 908423 - DNA, 25 bp, Mus musculus
cctttttgtgtacacgcctgaccag

SEQ ID NO: 908424 - DNA, 25 bp, Mus musculus
cctttttgtgtacaggcctgaccag

SEQ ID NO: 908425 - DNA, 25 bp, Mus musculus
cgaaaaaatcagcccccgactctca

SEQ ID NO: 908426 - DNA, 25 bp, Mus musculus
cgaaaaaatcaggccccgactctca

SEQ ID NO: 908427 - DNA, 25 bp, Mus musculus
cgaaaacgtctgcgcgatgacaacc

SEQ ID NO: 908428 - DNA, 25 bp, Mus musculus
cgaaaacgtctgggcgatgacaacc

SEQ ID NO: 908429 - DNA, 25 bp, Mus musculus
cgaaaactcccatttgttgagaaag

SEQ ID NO: 908430 - DNA, 25 bp, Mus musculus
cgaaaactccgatttgttgagaaag

SEQ ID NO: 908431 - DNA, 25 bp, Mus musculus
cgaaacaatgaaaaagcaaatcgct

SEQ ID NO: 908432 - DNA, 25 bp, Mus musculus
cgaaacaatgaaaatgcaaatcgct

SEQ ID NO: 908433 - DNA, 25 bp, Mus musculus
cgaaacaatgtacacatgtggagag

SEQ ID NO: 908434 - DNA, 25 bp, Mus musculus
cgaaacaatgtacagatgtggagag

SEQ ID NO: 908435 - DNA, 25 bp, Mus musculus
cgaaacagtacacagtgagataatc

SEQ ID NO: 908436 - DNA, 25 bp, Mus musculus
cgaaacagtacagagtgagataatc

SEQ ID NO: 908437 - DNA, 25 bp, Mus musculus
cgaaaccaagaatcttgtggaagct

SEQ ID NO: 908438 - DNA, 25 bp, Mus musculus
cgaaaccaagaggagctgattgcag

SEQ ID NO: 908439 - DNA, 25 bp, Mus musculus
cgaaaccaagtatcttgtggaagct

SEQ ID NO: 908440 - DNA, 25 bp, Mus musculus
cgaaaccaagtggagctgattgcag

SEQ ID NO: 908441 - DNA, 25 bp, Mus musculus
cgaaaccacgaaccgcatgcacgaa

SEQ ID NO: 908442 - DNA, 25 bp, Mus musculus
cgaaaccacgaaccgcatgcacgag

SEQ ID NO: 908443 - DNA, 25 bp, Mus musculus
cgaaaccacgtaccgcatgcacgaa

SEQ ID NO: 908444 - DNA, 25 bp, Mus musculus
cgaaaccacgtaccgcatgcacgag

SEQ ID NO: 908445 - DNA, 25 bp, Mus musculus
cgaaaccagaggcgcaggacacagg

SEQ ID NO: 908446 - DNA, 25 bp, Mus musculus
cgaaaccagaggggcaggacacagg

SEQ ID NO: 908447 - DNA, 25 bp, Mus musculus
cgaaaccgcaggcttatgatggagc

SEQ ID NO: 908448 - DNA, 25 bp, Mus musculus
cgaaaccgcagggttatgatggagc

SEQ ID NO: 908449 - DNA, 25 bp, Mus musculus
cgaaacgagaaacgtgagatctcaa

SEQ ID NO: 908450 - DNA, 25 bp, Mus musculus
cgaaacgagaaaggtgagatctcaa

SEQ ID NO: 908451 - DNA, 25 bp, Mus musculus
cgaaactatactacaggcccgctgc

SEQ ID NO: 908452 - DNA, 25 bp, Mus musculus
cgaaactatacttcaggcccgctgc

SEQ ID NO: 908453 - DNA, 25 bp, Mus musculus
cgaaagagtgctatctctgatgagt

SEQ ID NO: 908454 - DNA, 25 bp, Mus musculus
cgaaagagtggtatctctgatgagt

SEQ ID NO: 908455 - DNA, 25 bp, Mus musculus
cgaaagcagtctgtggaccactata

SEQ ID NO: 908456 - DNA, 25 bp, Mus musculus
cgaaagcagtgtgtggaccactata

SEQ ID NO: 908457 - DNA, 25 bp, Mus musculus
cgaaagcattaacgcacaaacaaaa

SEQ ID NO: 908458 - DNA, 25 bp, Mus musculus
cgaaagcattaaggcacaaacaaaa

SEQ ID NO: 908459 - DNA, 25 bp, Mus musculus
cgaaagccaagcctcggactcaata

SEQ ID NO: 908460 - DNA, 25 bp, Mus musculus
cgaaagccaagcctgggactcaata

SEQ ID NO: 908461 - DNA, 25 bp, Mus musculus
cgaaagtgagcttgccaaccttaag

SEQ ID NO: 908462 - DNA, 25 bp, Mus musculus
cgaaagtgaggttgccaaccttaag

SEQ ID NO: 908463 - DNA, 25 bp, Mus musculus
cgaaagttcagactggactgcccac

SEQ ID NO: 908464 - DNA, 25 bp, Mus musculus
cgaaagttcagagtggactgcccac

SEQ ID NO: 908465 - DNA, 25 bp, Mus musculus
cgaaagttctaactgtctcctgttt

SEQ ID NO: 908466 - DNA, 25 bp, Mus musculus
cgaaagttctaagtgtctcctgttt

SEQ ID NO: 908467 - DNA, 25 bp, Mus musculus
cgaaagttgcagcatgtgtttgagt

SEQ ID NO: 908468 - DNA, 25 bp, Mus musculus
cgaaagttgcaggatgtgtttgagt

SEQ ID NO: 908469 - DNA, 25 bp, Mus musculus
cgaaatcagatactcttccccgctg

SEQ ID NO: 908470 - DNA, 25 bp, Mus musculus
cgaaatcagatagtcttccccgctg

SEQ ID NO: 908471 - DNA, 25 bp, Mus musculus
cgaaattcagcatgaagaggacgat

SEQ ID NO: 908472 - DNA, 25 bp, Mus musculus
cgaaattcaggatgaagaggacgat

SEQ ID NO: 908473 - DNA, 25 bp, Mus musculus
cgaacaacagacgagctaaactcag

SEQ ID NO: 908474 - DNA, 25 bp, Mus musculus
cgaacaacagctcttcacacaacga

SEQ ID NO: 908475 - DNA, 25 bp, Mus musculus
cgaacaacaggtcttcacacaacga

SEQ ID NO: 908476 - DNA, 25 bp, Mus musculus
cgaacaacagtcgagctaaactcag

SEQ ID NO: 908477 - DNA, 25 bp, Mus musculus
cgaacaagcccacgagacaatcagg

SEQ ID NO: 908478 - DNA, 25 bp, Mus musculus
cgaacaagcccaggagacaatcagg

SEQ ID NO: 908479 - DNA, 25 bp, Mus musculus
cgaacaatacagacaggatggctaa

SEQ ID NO: 908480 - DNA, 25 bp, Mus musculus
cgaacaatacagctggccaagaagg

SEQ ID NO: 908481 - DNA, 25 bp, Mus musculus
cgaacaatacaggtggccaagaagg

SEQ ID NO: 908482 - DNA, 25 bp, Mus musculus
cgaacaatacagtcaggatggctaa

SEQ ID NO: 908483 - DNA, 25 bp, Mus musculus
cgaacacagtctcgcagtggggtac

SEQ ID NO: 908484 - DNA, 25 bp, Mus musculus
cgaacacagtctcggagtggggtac

SEQ ID NO: 908485 - DNA, 25 bp, Mus musculus
cgaacacatacacgcgagaaacctt

SEQ ID NO: 908486 - DNA, 25 bp, Mus musculus
cgaacacatacaggcgagaaacctt

SEQ ID NO: 908487 - DNA, 25 bp, Mus musculus
cgaacagacaagcctttgaggacct

SEQ ID NO: 908488 - DNA, 25 bp, Mus musculus
cgaacagacaagcgtgtgtctgcag

SEQ ID NO: 908489 - DNA, 25 bp, Mus musculus
cgaacagacaaggctttgaggacct

SEQ ID NO: 908490 - DNA, 25 bp, Mus musculus
cgaacagacaagggtgtgtctgcag

SEQ ID NO: 908491 - DNA, 25 bp, Mus musculus
cgaacagctccacggtagccccagt

SEQ ID NO: 908492 - DNA, 25 bp, Mus musculus
cgaacagctccagggtagccccagt

SEQ ID NO: 908493 - DNA, 25 bp, Mus musculus
cgaacagggtcacggaagtcctctt

SEQ ID NO: 908494 - DNA, 25 bp, Mus musculus
cgaacagggtcagggaagtcctctt

SEQ ID NO: 908495 - DNA, 25 bp, Mus musculus
cgaacatagcagagttgagctgaaa

SEQ ID NO: 908496 - DNA, 25 bp, Mus musculus
cgaacatagcagtgttgagctgaaa

SEQ ID NO: 908497 - DNA, 25 bp, Mus musculus
cgaaccccagagcacgtggcagagg

SEQ ID NO: 908498 - DNA, 25 bp, Mus musculus
cgaaccccagagcaggtggcagagg

SEQ ID NO: 908499 - DNA, 25 bp, Mus musculus
cgaacgtggactcacacatataaag

SEQ ID NO: 908500 - DNA, 25 bp, Mus musculus
cgaacgtggactcagacatataaag

SEQ ID NO: 908501 - DNA, 25 bp, Mus musculus
cgaactacatcacgtgcatcaagcc

SEQ ID NO: 908502 - DNA, 25 bp, Mus musculus
cgaactacatcaggtgcatcaagcc

SEQ ID NO: 908503 - DNA, 25 bp, Mus musculus
cgaactatgatgccctgactcccct

SEQ ID NO: 908504 - DNA, 25 bp, Mus musculus
cgaactatgatggcctgactcccct

SEQ ID NO: 908505 - DNA, 25 bp, Mus musculus
cgaactcacccaagtgcaaaacatg

SEQ ID NO: 908506 - DNA, 25 bp, Mus musculus
cgaactcacccaagtgttgcccacc

SEQ ID NO: 908507 - DNA, 25 bp, Mus musculus
cgaactcacccatgtgcaaaacatg

SEQ ID NO: 908508 - DNA, 25 bp, Mus musculus
cgaactcacccatgtgttgcccacc

SEQ ID NO: 908509 - DNA, 25 bp, Mus musculus
cgaactcttcaacaatgccatgagg

SEQ ID NO: 908510 - DNA, 25 bp, Mus musculus
cgaactcttcaagaatgccatgagg

SEQ ID NO: 908511 - DNA, 25 bp, Mus musculus
cgaactgccaagaacgttcaacggg

SEQ ID NO: 908512 - DNA, 25 bp, Mus musculus
cgaactgccaagaaggttcaacggg

SEQ ID NO: 908513 - DNA, 25 bp, Mus musculus
cgaagacagcagagaagacgaaaat

SEQ ID NO: 908514 - DNA, 25 bp, Mus musculus
cgaagacagcagtgaagacgaaaat

SEQ ID NO: 908515 - DNA, 25 bp, Mus musculus
cgaagaccaagccctggaaggtagg

SEQ ID NO: 908516 - DNA, 25 bp, Mus musculus
cgaagaccaagccgatctctttcct

SEQ ID NO: 908517 - DNA, 25 bp, Mus musculus
cgaagaccaagcgctggaaggtagg

SEQ ID NO: 908518 - DNA, 25 bp, Mus musculus
cgaagaccaagcggatctctttcct

SEQ ID NO: 908519 - DNA, 25 bp, Mus musculus
cgaagaccacagccaaatcctaaga

SEQ ID NO: 908520 - DNA, 25 bp, Mus musculus
cgaagaccacaggcaaatcctaaga

SEQ ID NO: 908521 - DNA, 25 bp, Mus musculus
cgaagacctcatccgtcaaactgaa

SEQ ID NO: 908522 - DNA, 25 bp, Mus musculus
cgaagacctcatgcgtcaaactgaa

SEQ ID NO: 908523 - DNA, 25 bp, Mus musculus
cgaagagacgcagctggtggctggt

SEQ ID NO: 908524 - DNA, 25 bp, Mus musculus
cgaagagacggagctggtggctggt

SEQ ID NO: 908525 - DNA, 25 bp, Mus musculus
cgaagagatcacagagcatttccgc

SEQ ID NO: 908526 - DNA, 25 bp, Mus musculus
cgaagagatcacagtgcatttccgc

SEQ ID NO: 908527 - DNA, 25 bp, Mus musculus
cgaagagcagagagccttctgctgg

SEQ ID NO: 908528 - DNA, 25 bp, Mus musculus
cgaagagcagagtgccttctgctgg

SEQ ID NO: 908529 - DNA, 25 bp, Mus musculus
cgaagagccgctctctggggaagcg

SEQ ID NO: 908530 - DNA, 25 bp, Mus musculus
cgaagagccggtctctggggaagcg

SEQ ID NO: 908531 - DNA, 25 bp, Mus musculus
cgaagagcttcgccagaaacctcag

SEQ ID NO: 908532 - DNA, 25 bp, Mus musculus
cgaagagcttcgcctgaaacctcag

SEQ ID NO: 908533 - DNA, 25 bp, Mus musculus
cgaagaggcacgcaacacagtgggt

SEQ ID NO: 908534 - DNA, 25 bp, Mus musculus
cgaagaggcacggaacacagtgggt

SEQ ID NO: 908535 - DNA, 25 bp, Mus musculus
cgaagatgccagccaatggttcagc

SEQ ID NO: 908536 - DNA, 25 bp, Mus musculus
cgaagatgccaggcaatggttcagc

SEQ ID NO: 908537 - DNA, 25 bp, Mus musculus
cgaagcaaagagaactccattgcgg

SEQ ID NO: 908538 - DNA, 25 bp, Mus musculus
cgaagcaaagagtactccattgcgg

SEQ ID NO: 908539 - DNA, 25 bp, Mus musculus
cgaagcagagcctgaggagcctgag

SEQ ID NO: 908540 - DNA, 25 bp, Mus musculus
cgaagcagaggctgaggagcctgag

SEQ ID NO: 908541 - DNA, 25 bp, Mus musculus
cgaagccaacaacggcagctctcca

SEQ ID NO: 908542 - DNA, 25 bp, Mus musculus
cgaagccaacaagggcagctctcca

SEQ ID NO: 908543 - DNA, 25 bp, Mus musculus
cgaagccaagccccaggccttgtca

SEQ ID NO: 908544 - DNA, 25 bp, Mus musculus
cgaagccaaggcccaggccttgtca

SEQ ID NO: 908545 - DNA, 25 bp, Mus musculus
cgaagccatactcggacccactcgc

SEQ ID NO: 908546 - DNA, 25 bp, Mus musculus
cgaagccatactgggacccactcgc

SEQ ID NO: 908547 - DNA, 25 bp, Mus musculus
cgaagcgctgcctcatcgtgggggc

SEQ ID NO: 908548 - DNA, 25 bp, Mus musculus
cgaagcgctggctcatcgtgggggc

SEQ ID NO: 908549 - DNA, 25 bp, Mus musculus
cgaagctcaaagacaatgtcagtgc

SEQ ID NO: 908550 - DNA, 25 bp, Mus musculus
cgaagctcaatgacaatgtcagtgc

SEQ ID NO: 908551 - DNA, 25 bp, Mus musculus
cgaagctccccccatgagaatttcc

SEQ ID NO: 908552 - DNA, 25 bp, Mus musculus
cgaagctcccgccatgagaatttcc

SEQ ID NO: 908553 - DNA, 25 bp, Mus musculus
cgaagctgaaggcacgtgacactgt

SEQ ID NO: 908554 - DNA, 25 bp, Mus musculus
cgaagctgaaggcaggtgacactgt

SEQ ID NO: 908555 - DNA, 25 bp, Mus musculus
cgaagctgagatactccatgtttcc

SEQ ID NO: 908556 - DNA, 25 bp, Mus musculus
cgaagctgagttactccatgtttcc

SEQ ID NO: 908557 - DNA, 25 bp, Mus musculus
cgaagctgatgacgcatgacccctt

SEQ ID NO: 908558 - DNA, 25 bp, Mus musculus
cgaagctgatgaggcatgacccctt

SEQ ID NO: 908559 - DNA, 25 bp, Mus musculus
cgaagctgccagcatatcaatgaat

SEQ ID NO: 908560 - DNA, 25 bp, Mus musculus
cgaagctgccaggatatcaatgaat

SEQ ID NO: 908561 - DNA, 25 bp, Mus musculus
cgaagctttaacctttgattctcat

SEQ ID NO: 908562 - DNA, 25 bp, Mus musculus
cgaagctttaacgtttgattctcat

SEQ ID NO: 908563 - DNA, 25 bp, Mus musculus
cgaaggaagagacattgctgctgaa

SEQ ID NO: 908564 - DNA, 25 bp, Mus musculus
cgaaggaagagagattgctgctgaa

SEQ ID NO: 908565 - DNA, 25 bp, Mus musculus
cgaaggagaccaagagatgagacca

SEQ ID NO: 908566 - DNA, 25 bp, Mus musculus
cgaaggagacgaagagatgagacca

SEQ ID NO: 908567 - DNA, 25 bp, Mus musculus
cgaaggagcagtctcatggagccag

SEQ ID NO: 908568 - DNA, 25 bp, Mus musculus
cgaaggagcagtctgatggagccag

SEQ ID NO: 908569 - DNA, 25 bp, Mus musculus
cgaaggatcaagcttctttacctga

SEQ ID NO: 908570 - DNA, 25 bp, Mus musculus
cgaaggatcaaggttctttacctga

SEQ ID NO: 908571 - DNA, 25 bp, Mus musculus
cgaaggcagttgaattgtttgagga

SEQ ID NO: 908572 - DNA, 25 bp, Mus musculus
cgaaggcagttgtattgtttgagga

SEQ ID NO: 908573 - DNA, 25 bp, Mus musculus
cgaagtaagacgaccaccagagagc

SEQ ID NO: 908574 - DNA, 25 bp, Mus musculus
cgaagtaagaggaccaccagagagc

SEQ ID NO: 908575 - DNA, 25 bp, Mus musculus
cgaagtcagacgcaaagagtggtca

SEQ ID NO: 908576 - DNA, 25 bp, Mus musculus
cgaagtcagacggaaagagtggtca

SEQ ID NO: 908577 - DNA, 25 bp, Mus musculus
cgaagtcattggcacgtgtaagtgc

SEQ ID NO: 908578 - DNA, 25 bp, Mus musculus
cgaagtcattggcaggtgtaagtgc

SEQ ID NO: 908579 - DNA, 25 bp, Mus musculus
cgaagtccagatgctgagcgagtgg

SEQ ID NO: 908580 - DNA, 25 bp, Mus musculus
cgaagtccagttgctgagcgagtgg

SEQ ID NO: 908581 - DNA, 25 bp, Mus musculus
cgaagtcttcgtcggacctcgcaag

SEQ ID NO: 908582 - DNA, 25 bp, Mus musculus
cgaagtcttcgtgggacctcgcaag

SEQ ID NO: 908583 - DNA, 25 bp, Mus musculus
cgaagtggccaacctgtcagatata

SEQ ID NO: 908584 - DNA, 25 bp, Mus musculus
cgaagtggccaacttggctgtcaga

SEQ ID NO: 908585 - DNA, 25 bp, Mus musculus
cgaagtggccaagctgtcagatata

SEQ ID NO: 908586 - DNA, 25 bp, Mus musculus
cgaagtggccaagttggctgtcaga

SEQ ID NO: 908587 - DNA, 25 bp, Mus musculus
cgaagttcagatcttgaagggcctc

SEQ ID NO: 908588 - DNA, 25 bp, Mus musculus
cgaagttcagttcttgaagggcctc

SEQ ID NO: 908589 - DNA, 25 bp, Mus musculus
cgaagttctctgacaggaatgaatt

SEQ ID NO: 908590 - DNA, 25 bp, Mus musculus
cgaagttctctgactggaatgaatt

SEQ ID NO: 908591 - DNA, 25 bp, Mus musculus
cgaatcaaagagatggatctgtccg

SEQ ID NO: 908592 - DNA, 25 bp, Mus musculus
cgaatcaaagagttggatctgtccg

SEQ ID NO: 908593 - DNA, 25 bp, Mus musculus
cgaatcacagcattagtcgtatcta

SEQ ID NO: 908594 - DNA, 25 bp, Mus musculus
cgaatcacaggattagtcgtatcta

SEQ ID NO: 908595 - DNA, 25 bp, Mus musculus
cgaatcaccgctcacatgaagaacg

SEQ ID NO: 908596 - DNA, 25 bp, Mus musculus
cgaatcaccgctgacatgaagaacg

SEQ ID NO: 908597 - DNA, 25 bp, Mus musculus
cgaatccgggaacacagcagtgccc

SEQ ID NO: 908598 - DNA, 25 bp, Mus musculus
cgaatccgggaacagagcagtgccc

SEQ ID NO: 908599 - DNA, 25 bp, Mus musculus
cgaatctcagcctcaggtccctgga

SEQ ID NO: 908600 - DNA, 25 bp, Mus musculus
cgaatctcaggctcaggtccctgga

SEQ ID NO: 908601 - DNA, 25 bp, Mus musculus
cgaatctgtgaaactgatcccaaag

SEQ ID NO: 908602 - DNA, 25 bp, Mus musculus
cgaatctgtgtaactgatcccaaag

SEQ ID NO: 908603 - DNA, 25 bp, Mus musculus
cgaatctttgagagtgagaaacttt

SEQ ID NO: 908604 - DNA, 25 bp, Mus musculus
cgaatctttgagtgtgagaaacttt

SEQ ID NO: 908605 - DNA, 25 bp, Mus musculus
cgaatggtttttcgtctcagtgtgt

SEQ ID NO: 908606 - DNA, 25 bp, Mus musculus
cgaatggtttttggtctcagtgtgt

SEQ ID NO: 908607 - DNA, 25 bp, Mus musculus
cgaattacagagtcttaataccgaa

SEQ ID NO: 908608 - DNA, 25 bp, Mus musculus
cgaattacagtgtcttaataccgaa

SEQ ID NO: 908609 - DNA, 25 bp, Mus musculus
cgaattacctattgaagtggacctt

SEQ ID NO: 908610 - DNA, 25 bp, Mus musculus
cgaattaccttttgaagtggacctt

SEQ ID NO: 908611 - DNA, 25 bp, Mus musculus
cgaattccggagctcgactgaactt

SEQ ID NO: 908612 - DNA, 25 bp, Mus musculus
cgaattccggagctggactgaactt

SEQ ID NO: 908613 - DNA, 25 bp, Mus musculus
cgaattctcaagccccggctagagt

SEQ ID NO: 908614 - DNA, 25 bp, Mus musculus
cgaattctcaaggcccggctagagt

SEQ ID NO: 908615 - DNA, 25 bp, Mus musculus
cgaattctgcagacccatgcagatg

SEQ ID NO: 908616 - DNA, 25 bp, Mus musculus
cgaattctgcagctatccaacggtt

SEQ ID NO: 908617 - DNA, 25 bp, Mus musculus
cgaattctgcaggtatccaacggtt

SEQ ID NO: 908618 - DNA, 25 bp, Mus musculus
cgaattctgcagtcccatgcagatg

SEQ ID NO: 908619 - DNA, 25 bp, Mus musculus
cgacaaaactcctaacccagtagag

SEQ ID NO: 908620 - DNA, 25 bp, Mus musculus
cgacaaaactgctaacccagtagag

SEQ ID NO: 908621 - DNA, 25 bp, Mus musculus
cgacaaacagaaagcaacaaggatg

SEQ ID NO: 908622 - DNA, 25 bp, Mus musculus
cgacaaacagaacagaaaagaaatg

SEQ ID NO: 908623 - DNA, 25 bp, Mus musculus
cgacaaacagaagagaaaagaaatg

SEQ ID NO: 908624 - DNA, 25 bp, Mus musculus
cgacaaacagaatgcaacaaggatg

SEQ ID NO: 908625 - DNA, 25 bp, Mus musculus
cgacaacatctgcagagagacttgc

SEQ ID NO: 908626 - DNA, 25 bp, Mus musculus
cgacaacatctggagagagacttgc

SEQ ID NO: 908627 - DNA, 25 bp, Mus musculus
cgacaaccagcttggcttcaaaaat

SEQ ID NO: 908628 - DNA, 25 bp, Mus musculus
cgacaaccaggttggcttcaaaaat

SEQ ID NO: 908629 - DNA, 25 bp, Mus musculus
cgacaaggagctcatcagtcctgac

SEQ ID NO: 908630 - DNA, 25 bp, Mus musculus
cgacaaggaggtcatcagtcctgac

SEQ ID NO: 908631 - DNA, 25 bp, Mus musculus
cgacaatgaagacgtggggtcagag

SEQ ID NO: 908632 - DNA, 25 bp, Mus musculus
cgacaatgaagaggtggggtcagag

SEQ ID NO: 908633 - DNA, 25 bp, Mus musculus
cgacacaagcaggacttcctggaca

SEQ ID NO: 908634 - DNA, 25 bp, Mus musculus
cgacacaagcaggagttcctggaca

SEQ ID NO: 908635 - DNA, 25 bp, Mus musculus
cgacacattgcgagaggtgtgcggc

SEQ ID NO: 908636 - DNA, 25 bp, Mus musculus
cgacacattgggagaggtgtgcggc

SEQ ID NO: 908637 - DNA, 25 bp, Mus musculus
cgacaccaaaagcgctcaggatgct

SEQ ID NO: 908638 - DNA, 25 bp, Mus musculus
cgacaccaaaagggctcaggatgct

SEQ ID NO: 908639 - DNA, 25 bp, Mus musculus
cgacaccatgagctacattctaatc

SEQ ID NO: 908640 - DNA, 25 bp, Mus musculus
cgacaccatgaggtacattctaatc

SEQ ID NO: 908641 - DNA, 25 bp, Mus musculus
cgacacctgagacatgaaggcctaa

SEQ ID NO: 908642 - DNA, 25 bp, Mus musculus
cgacacctgagagatgaaggcctaa

SEQ ID NO: 908643 - DNA, 25 bp, Mus musculus
cgacacgcacagcgaggtatgtggt

SEQ ID NO: 908644 - DNA, 25 bp, Mus musculus
cgacacgcacagggaggtatgtggt

SEQ ID NO: 908645 - DNA, 25 bp, Mus musculus
cgacacttttgtcgattacgatgtt

SEQ ID NO: 908646 - DNA, 25 bp, Mus musculus
cgacacttttgtggattacgatgtt

SEQ ID NO: 908647 - DNA, 25 bp, Mus musculus
cgacagaaagatgtccgaccccgga

SEQ ID NO: 908648 - DNA, 25 bp, Mus musculus
cgacagaaagttgtccgaccccgga

SEQ ID NO: 908649 - DNA, 25 bp, Mus musculus
cgacagaacgcacatgtgaactttc

SEQ ID NO: 908650 - DNA, 25 bp, Mus musculus
cgacagaacgcagatgtgaactttc

SEQ ID NO: 908651 - DNA, 25 bp, Mus musculus
cgacagaagaagacatcaacaagca

SEQ ID NO: 908652 - DNA, 25 bp, Mus musculus
cgacagaagaagacttcaacaagca

SEQ ID NO: 908653 - DNA, 25 bp, Mus musculus
cgacagaattctcctaagaccacga

SEQ ID NO: 908654 - DNA, 25 bp, Mus musculus
cgacagaattgtcctaagaccacga

SEQ ID NO: 908655 - DNA, 25 bp, Mus musculus
cgacagattgcttctaggtcttata

SEQ ID NO: 908656 - DNA, 25 bp, Mus musculus
cgacagattggttctaggtcttata

SEQ ID NO: 908657 - DNA, 25 bp, Mus musculus
cgacagcaggaacacaggaagatct

SEQ ID NO: 908658 - DNA, 25 bp, Mus musculus
cgacagcaggaacgaaagaaaggag

SEQ ID NO: 908659 - DNA, 25 bp, Mus musculus
cgacagcaggaagacaggaagatct

SEQ ID NO: 908660 - DNA, 25 bp, Mus musculus
cgacagcaggaaggaaagaaaggag

SEQ ID NO: 908661 - DNA, 25 bp, Mus musculus
cgacagcatcaaaatgccaggcagg

SEQ ID NO: 908662 - DNA, 25 bp, Mus musculus
cgacagcatcaacgacaattcaagc

SEQ ID NO: 908663 - DNA, 25 bp, Mus musculus
cgacagcatcaacgcctgggaggag

SEQ ID NO: 908664 - DNA, 25 bp, Mus musculus
cgacagcatcaaggacaattcaagc

SEQ ID NO: 908665 - DNA, 25 bp, Mus musculus
cgacagcatcaaggcctgggaggag

SEQ ID NO: 908666 - DNA, 25 bp, Mus musculus
cgacagcatcaatatgccaggcagg

SEQ ID NO: 908667 - DNA, 25 bp, Mus musculus
cgacagccctcacaggagacccaag

SEQ ID NO: 908668 - DNA, 25 bp, Mus musculus
cgacagccctcagaggagacccaag

SEQ ID NO: 908669 - DNA, 25 bp, Mus musculus
cgacagcggcaaaatagtgtttcta

SEQ ID NO: 908670 - DNA, 25 bp, Mus musculus
cgacagcggcaatatagtgtttcta

SEQ ID NO: 908671 - DNA, 25 bp, Mus musculus
cgacagctgatgcttccagcatctt

SEQ ID NO: 908672 - DNA, 25 bp, Mus musculus
cgacagctgatggttccagcatctt

SEQ ID NO: 908673 - DNA, 25 bp, Mus musculus
cgacaggaatacgacaaagccctgc

SEQ ID NO: 908674 - DNA, 25 bp, Mus musculus
cgacaggaatacgagaaagccctgc

SEQ ID NO: 908675 - DNA, 25 bp, Mus musculus
cgacagggctcccagccgcaaggac

SEQ ID NO: 908676 - DNA, 25 bp, Mus musculus
cgacagggctccgagccgcaaggac

SEQ ID NO: 908677 - DNA, 25 bp, Mus musculus
cgacagtaagtacacttgatacact

SEQ ID NO: 908678 - DNA, 25 bp, Mus musculus
cgacagtaagtacagttgatacact

SEQ ID NO: 908679 - DNA, 25 bp, Mus musculus
cgacagtacacgcctcgacgaccag

SEQ ID NO: 908680 - DNA, 25 bp, Mus musculus
cgacagtacacggctcgacgaccag

SEQ ID NO: 908681 - DNA, 25 bp, Mus musculus
cgacagtgggcaaggctctggaggg

SEQ ID NO: 908682 - DNA, 25 bp, Mus musculus
cgacagtgggcatggctctggaggg

SEQ ID NO: 908683 - DNA, 25 bp, Mus musculus
cgacatatggagcctgtgaagacac

SEQ ID NO: 908684 - DNA, 25 bp, Mus musculus
cgacatatggaggctgtgaagacac

SEQ ID NO: 908685 - DNA, 25 bp, Mus musculus
cgacatcaagcactccaaagcttat

SEQ ID NO: 908686 - DNA, 25 bp, Mus musculus
cgacatcaaggactccaaagcttat

SEQ ID NO: 908687 - DNA, 25 bp, Mus musculus
cgacatcacccttgcgcatccacta

SEQ ID NO: 908688 - DNA, 25 bp, Mus musculus
cgacatcacccttgggcatccacta

SEQ ID NO: 908689 - DNA, 25 bp, Mus musculus
cgacatcagaccaggtctctacggc

SEQ ID NO: 908690 - DNA, 25 bp, Mus musculus
cgacatcagacctggtctctacggc

SEQ ID NO: 908691 - DNA, 25 bp, Mus musculus
cgacatccaggtcaaactgtttgtg

SEQ ID NO: 908692 - DNA, 25 bp, Mus musculus
cgacatccaggtgaaactgtttgtg

SEQ ID NO: 908693 - DNA, 25 bp, Mus musculus
cgacatcctataacccagtttatgg

SEQ ID NO: 908694 - DNA, 25 bp, Mus musculus
cgacatcctatatcccagtttatgg

SEQ ID NO: 908695 - DNA, 25 bp, Mus musculus
cgacatcgagagtgaccctacctac

SEQ ID NO: 908696 - DNA, 25 bp, Mus musculus
cgacatcgagagtgtccctacctac

SEQ ID NO: 908697 - DNA, 25 bp, Mus musculus
cgacatctgtagcatatatccggtc

SEQ ID NO: 908698 - DNA, 25 bp, Mus musculus
cgacatctgtaggatatatccggtc

SEQ ID NO: 908699 - DNA, 25 bp, Mus musculus
cgacatgactgccaagattcatgaa

SEQ ID NO: 908700 - DNA, 25 bp, Mus musculus
cgacatgactgccatgattcatgaa

SEQ ID NO: 908701 - DNA, 25 bp, Mus musculus
cgacatggagcggaccctctctgcc

SEQ ID NO: 908702 - DNA, 25 bp, Mus musculus
cgacatggagcggacgtctcattgg

SEQ ID NO: 908703 - DNA, 25 bp, Mus musculus
cgacatggagcggagcctctctgcc

SEQ ID NO: 908704 - DNA, 25 bp, Mus musculus
cgacatggagcggaggtctcattgg

SEQ ID NO: 908705 - DNA, 25 bp, Mus musculus
cgacattgataatccggaccagcga

SEQ ID NO: 908706 - DNA, 25 bp, Mus musculus
cgacattgataatcgggaccagcga

SEQ ID NO: 908707 - DNA, 25 bp, Mus musculus
cgacattgctaccacggtccgcctg

SEQ ID NO: 908708 - DNA, 25 bp, Mus musculus
cgacattgctaccagggtccgcctg

SEQ ID NO: 908709 - DNA, 25 bp, Mus musculus
cgacattgtgagatcactgaagaag

SEQ ID NO: 908710 - DNA, 25 bp, Mus musculus
cgacattgtgagttcactgaagaag

SEQ ID NO: 908711 - DNA, 25 bp, Mus musculus
cgacatttttaacacattagttcat

SEQ ID NO: 908712 - DNA, 25 bp, Mus musculus
cgacatttttaacagattagttcat

SEQ ID NO: 908713 - DNA, 25 bp, Mus musculus
cgaccaaagaccacctggatgaagg

SEQ ID NO: 908714 - DNA, 25 bp, Mus musculus
cgaccaaagaccacgtggatgaagg

SEQ ID NO: 908715 - DNA, 25 bp, Mus musculus
cgaccaagagatgctaaaatgcata

SEQ ID NO: 908716 - DNA, 25 bp, Mus musculus
cgaccaagagttgctaaaatgcata

SEQ ID NO: 908717 - DNA, 25 bp, Mus musculus
cgaccaccacaccggcttgctgaat

SEQ ID NO: 908718 - DNA, 25 bp, Mus musculus
cgaccaccacacgggcttgctgaat

SEQ ID NO: 908719 - DNA, 25 bp, Mus musculus
cgaccaccagcctacctcattcacg

SEQ ID NO: 908720 - DNA, 25 bp, Mus musculus
cgaccaccaggctacctcattcacg

SEQ ID NO: 908721 - DNA, 25 bp, Mus musculus
cgaccacgaaatgacgaagatgcaa

SEQ ID NO: 908722 - DNA, 25 bp, Mus musculus
cgaccacgaaatgaggaagatgcaa

SEQ ID NO: 908723 - DNA, 25 bp, Mus musculus
cgaccagaggcacagtgaagaaatc

SEQ ID NO: 908724 - DNA, 25 bp, Mus musculus
cgaccagaggcagagtgaagaaatc

SEQ ID NO: 908725 - DNA, 25 bp, Mus musculus
cgaccagcctggccacatggggctc

SEQ ID NO: 908726 - DNA, 25 bp, Mus musculus
cgaccagcctgggcacatggggctc

SEQ ID NO: 908727 - DNA, 25 bp, Mus musculus
cgacccaagttgcatttaaatatta

SEQ ID NO: 908728 - DNA, 25 bp, Mus musculus
cgacccaagttgctggacaaatttg

SEQ ID NO: 908729 - DNA, 25 bp, Mus musculus
cgacccaagttggatttaaatatta

SEQ ID NO: 908730 - DNA, 25 bp, Mus musculus
cgacccaagttggtggacaaatttg

SEQ ID NO: 908731 - DNA, 25 bp, Mus musculus
cgacccacaaagcagaatgtggaat

SEQ ID NO: 908732 - DNA, 25 bp, Mus musculus
cgacccacaaaggagaatgtggaat

SEQ ID NO: 908733 - DNA, 25 bp, Mus musculus
cgacccaccacgcgagccaggtatg

SEQ ID NO: 908734 - DNA, 25 bp, Mus musculus
cgacccaccacgggagccaggtatg

SEQ ID NO: 908735 - DNA, 25 bp, Mus musculus
cgacccagagtacctcacactcgct

SEQ ID NO: 908736 - DNA, 25 bp, Mus musculus
cgacccagagtagctcacactcgct

SEQ ID NO: 908737 - DNA, 25 bp, Mus musculus
cgacccatcacactgtttacagcct

SEQ ID NO: 908738 - DNA, 25 bp, Mus musculus
cgacccatcagactgtttacagcct

SEQ ID NO: 908739 - DNA, 25 bp, Mus musculus
cgacccatcttgaaagctcacttcc

SEQ ID NO: 908740 - DNA, 25 bp, Mus musculus
cgacccatcttgaatgctcacttcc

SEQ ID NO: 908741 - DNA, 25 bp, Mus musculus
cgaccccaagagatccgatgcctca

SEQ ID NO: 908742 - DNA, 25 bp, Mus musculus
cgaccccaagagttccgatgcctca

SEQ ID NO: 908743 - DNA, 25 bp, Mus musculus
cgaccccaggaagaccctccacctc

SEQ ID NO: 908744 - DNA, 25 bp, Mus musculus
cgaccccaggaagacgacatgacag

SEQ ID NO: 908745 - DNA, 25 bp, Mus musculus
cgaccccaggaagagcctccacctc

SEQ ID NO: 908746 - DNA, 25 bp, Mus musculus
cgaccccaggaagaggacatgacag

SEQ ID NO: 908747 - DNA, 25 bp, Mus musculus
cgaccctcaactgccctgtgatgct

SEQ ID NO: 908748 - DNA, 25 bp, Mus musculus
cgaccctcaagtgccctgtgatgct

SEQ ID NO: 908749 - DNA, 25 bp, Mus musculus
cgaccctgagcttgcaagatacctc

SEQ ID NO: 908750 - DNA, 25 bp, Mus musculus
cgaccctgaggttgcaagatacctc

SEQ ID NO: 908751 - DNA, 25 bp, Mus musculus
cgaccctgcaagagttctttttgca

SEQ ID NO: 908752 - DNA, 25 bp, Mus musculus
cgaccctgcaagatggagggggcag

SEQ ID NO: 908753 - DNA, 25 bp, Mus musculus
cgaccctgcaagtgttctttttgca

SEQ ID NO: 908754 - DNA, 25 bp, Mus musculus
cgaccctgcaagttggagggggcag

SEQ ID NO: 908755 - DNA, 25 bp, Mus musculus
cgaccgaatcctcagtagcaagatg

SEQ ID NO: 908756 - DNA, 25 bp, Mus musculus
cgaccgaatcctgagtagcaagatg

SEQ ID NO: 908757 - DNA, 25 bp, Mus musculus
cgaccgattacatgtccatgcagag

SEQ ID NO: 908758 - DNA, 25 bp, Mus musculus
cgaccgattagatgtccatgcagag

SEQ ID NO: 908759 - DNA, 25 bp, Mus musculus
cgaccgcaggagggcaggtgtgctg

SEQ ID NO: 908760 - DNA, 25 bp, Mus musculus
cgaccgcaggtgggcaggtgtgctg

SEQ ID NO: 908761 - DNA, 25 bp, Mus musculus
cgaccgctgcacgccggcatgtgtt

SEQ ID NO: 908762 - DNA, 25 bp, Mus musculus
cgaccgctgcacgccgtaatttcta

SEQ ID NO: 908763 - DNA, 25 bp, Mus musculus
cgaccgctgcacgcgggcatgtgtt

SEQ ID NO: 908764 - DNA, 25 bp, Mus musculus
cgaccgctgcacgcggtaatttcta

SEQ ID NO: 908765 - DNA, 25 bp, Mus musculus
cgaccgctgccacgcctcctctgac

SEQ ID NO: 908766 - DNA, 25 bp, Mus musculus
cgaccgctgccaggcctcctctgac

SEQ ID NO: 908767 - DNA, 25 bp, Mus musculus
cgaccgggcagaggcggaacgtgat

SEQ ID NO: 908768 - DNA, 25 bp, Mus musculus
cgaccgggcagagggggaacgtgat

SEQ ID NO: 908769 - DNA, 25 bp, Mus musculus
cgacctcacaagagcacgatctgat

SEQ ID NO: 908770 - DNA, 25 bp, Mus musculus
cgacctcacaagctgactggacaga

SEQ ID NO: 908771 - DNA, 25 bp, Mus musculus
cgacctcacaaggtgactggacaga

SEQ ID NO: 908772 - DNA, 25 bp, Mus musculus
cgacctcacaagtgcacgatctgat

SEQ ID NO: 908773 - DNA, 25 bp, Mus musculus
cgacctcatctacgtacgtaggtgc

SEQ ID NO: 908774 - DNA, 25 bp, Mus musculus
cgacctcatctaggtacgtaggtgc

SEQ ID NO: 908775 - DNA, 25 bp, Mus musculus
cgacctccaaatcgttctgaatcag

SEQ ID NO: 908776 - DNA, 25 bp, Mus musculus
cgacctccaaatggttctgaatcag

SEQ ID NO: 908777 - DNA, 25 bp, Mus musculus
cgacctccctagcattctcaaagct

SEQ ID NO: 908778 - DNA, 25 bp, Mus musculus
cgacctccctagctgaggattatga

SEQ ID NO: 908779 - DNA, 25 bp, Mus musculus
cgacctccctaggattctcaaagct

SEQ ID NO: 908780 - DNA, 25 bp, Mus musculus
cgacctccctaggtgaggattatga

SEQ ID NO: 908781 - DNA, 25 bp, Mus musculus
cgacctctatcactctcgacacaat

SEQ ID NO: 908782 - DNA, 25 bp, Mus musculus
cgacctctatcagtctcgacacaat

SEQ ID NO: 908783 - DNA, 25 bp, Mus musculus
cgacctgactgacattggagagcga

SEQ ID NO: 908784 - DNA, 25 bp, Mus musculus
cgacctgactgagattggagagcga

SEQ ID NO: 908785 - DNA, 25 bp, Mus musculus
cgacctgcagctactgaagtcaaga

SEQ ID NO: 908786 - DNA, 25 bp, Mus musculus
cgacctgcaggtactgaagtcaaga

SEQ ID NO: 908787 - DNA, 25 bp, Mus musculus
cgaccttcagcgaaaatgccaagtg

SEQ ID NO: 908788 - DNA, 25 bp, Mus musculus
cgaccttcagggaaaatgccaagtg

SEQ ID NO: 908789 - DNA, 25 bp, Mus musculus
cgacgaaggaggagtcataaacgag

SEQ ID NO: 908790 - DNA, 25 bp, Mus musculus
cgacgaaggaggtgtcataaacgag

SEQ ID NO: 908791 - DNA, 25 bp, Mus musculus
cgacgaagtgaaccgaatgcacgag

SEQ ID NO: 908792 - DNA, 25 bp, Mus musculus
cgacgaagtgtaccgaatgcacgag

SEQ ID NO: 908793 - DNA, 25 bp, Mus musculus
cgacgaatctgtcaaactgatccca

SEQ ID NO: 908794 - DNA, 25 bp, Mus musculus
cgacgaatctgtgaaactgatccca

SEQ ID NO: 908795 - DNA, 25 bp, Mus musculus
cgacgagaaaaacctggagagatgt

SEQ ID NO: 908796 - DNA, 25 bp, Mus musculus
cgacgagaaaaagctggagagatgt

SEQ ID NO: 908797 - DNA, 25 bp, Mus musculus
cgacgcggagtccactcaccacagg

SEQ ID NO: 908798 - DNA, 25 bp, Mus musculus
cgacgcggagtccagtcaccacagg

SEQ ID NO: 908799 - DNA, 25 bp, Mus musculus
cgacggagacaacccatccaactac

SEQ ID NO: 908800 - DNA, 25 bp, Mus musculus
cgacggagacaaccgatccaactac

SEQ ID NO: 908801 - DNA, 25 bp, Mus musculus
cgacggcacactcaaaagatccgct

SEQ ID NO: 908802 - DNA, 25 bp, Mus musculus
cgacggcacactcatgagcgcccct

SEQ ID NO: 908803 - DNA, 25 bp, Mus musculus
cgacggcacactgaaaagatccgct

SEQ ID NO: 908804 - DNA, 25 bp, Mus musculus
cgacggcacactgatgagcgcccct

SEQ ID NO: 908805 - DNA, 25 bp, Mus musculus
cgacggccctaacgtttgaggattg

SEQ ID NO: 908806 - DNA, 25 bp, Mus musculus
cgacggccctaactgggagccggtg

SEQ ID NO: 908807 - DNA, 25 bp, Mus musculus
cgacggccctaaggtttgaggattg

SEQ ID NO: 908808 - DNA, 25 bp, Mus musculus
cgacggccctaagtgggagccggtg

SEQ ID NO: 908809 - DNA, 25 bp, Mus musculus
cgacggcctgctagtattaaagata

SEQ ID NO: 908810 - DNA, 25 bp, Mus musculus
cgacggcctggtagtattaaagata

SEQ ID NO: 908811 - DNA, 25 bp, Mus musculus
cgacggccttgagtccatggccatg

SEQ ID NO: 908812 - DNA, 25 bp, Mus musculus
cgacggccttgagtgcatggccatg

SEQ ID NO: 908813 - DNA, 25 bp, Mus musculus
cgacgtggagatcacaggaccagat

SEQ ID NO: 908814 - DNA, 25 bp, Mus musculus
cgacgtggagttcacaggaccagat

SEQ ID NO: 908815 - DNA, 25 bp, Mus musculus
cgacgtggtcaacacccagagaaca

SEQ ID NO: 908816 - DNA, 25 bp, Mus musculus
cgacgtggtcaacattgactttgaa

SEQ ID NO: 908817 - DNA, 25 bp, Mus musculus
cgacgtggtcaagacccagagaaca

SEQ ID NO: 908818 - DNA, 25 bp, Mus musculus
cgacgtggtcaagattgactttgaa

SEQ ID NO: 908819 - DNA, 25 bp, Mus musculus
cgacgtgtccgtgacagaagaggaa

SEQ ID NO: 908820 - DNA, 25 bp, Mus musculus
cgacgtgtccgtgagagaagaggaa

SEQ ID NO: 908821 - DNA, 25 bp, Mus musculus
cgacgttaatgactgcaatgctcac

SEQ ID NO: 908822 - DNA, 25 bp, Mus musculus
cgacgttaatgagtgcaatgctcac

SEQ ID NO: 908823 - DNA, 25 bp, Mus musculus
cgactacagaagtgacctctaggga

SEQ ID NO: 908824 - DNA, 25 bp, Mus musculus
cgactacagaagtgacctctggtcc

SEQ ID NO: 908825 - DNA, 25 bp, Mus musculus
cgactacagatgtgacctctaggga

SEQ ID NO: 908826 - DNA, 25 bp, Mus musculus
cgactacagatgtgacctctggtcc

SEQ ID NO: 908827 - DNA, 25 bp, Mus musculus
cgactacggcaacagagagatcctg

SEQ ID NO: 908828 - DNA, 25 bp, Mus musculus
cgactacggcaagagagagatcctg

SEQ ID NO: 908829 - DNA, 25 bp, Mus musculus
cgactagccagaaacgtccacacca

SEQ ID NO: 908830 - DNA, 25 bp, Mus musculus
cgactagccagaaactttcaggcca

SEQ ID NO: 908831 - DNA, 25 bp, Mus musculus
cgactagccagaaaggtccacacca

SEQ ID NO: 908832 - DNA, 25 bp, Mus musculus
cgactagccagaaagtttcaggcca

SEQ ID NO: 908833 - DNA, 25 bp, Mus musculus
cgactatatttcgtattctcatcgc

SEQ ID NO: 908834 - DNA, 25 bp, Mus musculus
cgactatatttcgttttctcatcgc

SEQ ID NO: 908835 - DNA, 25 bp, Mus musculus
cgactcagcctgcacaccaactggt

SEQ ID NO: 908836 - DNA, 25 bp, Mus musculus
cgactcagcctgcagaccaactggt

SEQ ID NO: 908837 - DNA, 25 bp, Mus musculus
cgactctccgagcattcgggttctt

SEQ ID NO: 908838 - DNA, 25 bp, Mus musculus
cgactctccgaggattcgggttctt

SEQ ID NO: 908839 - DNA, 25 bp, Mus musculus
cgactctgagagcagaggggcaggc

SEQ ID NO: 908840 - DNA, 25 bp, Mus musculus
cgactctgagaggtttggattttac

SEQ ID NO: 908841 - DNA, 25 bp, Mus musculus
cgactctgagcaagcaggctgaggg

SEQ ID NO: 908842 - DNA, 25 bp, Mus musculus
cgactctgaggaagcaggctgaggg

SEQ ID NO: 908843 - DNA, 25 bp, Mus musculus
cgactctgagtgcagaggggcaggc

SEQ ID NO: 908844 - DNA, 25 bp, Mus musculus
cgactctgagtggtttggattttac

SEQ ID NO: 908845 - DNA, 25 bp, Mus musculus
cgactctgctgacacacactgtcct

SEQ ID NO: 908846 - DNA, 25 bp, Mus musculus
cgactctgctgacagacactgtcct

SEQ ID NO: 908847 - DNA, 25 bp, Mus musculus
cgactctgtatgattatttctctca

SEQ ID NO: 908848 - DNA, 25 bp, Mus musculus
cgactctgtatgtttatttctctca

SEQ ID NO: 908849 - DNA, 25 bp, Mus musculus
cgactcttcttcaccgtgccttgga

SEQ ID NO: 908850 - DNA, 25 bp, Mus musculus
cgactcttcttcacggtgccttgga

SEQ ID NO: 908851 - DNA, 25 bp, Mus musculus
cgactcttgccacggagacagtgga

SEQ ID NO: 908852 - DNA, 25 bp, Mus musculus
cgactcttgccagggagacagtgga

SEQ ID NO: 908853 - DNA, 25 bp, Mus musculus
cgactgaaagatatcgatgaagact

SEQ ID NO: 908854 - DNA, 25 bp, Mus musculus
cgactgaaagttatcgatgaagact

SEQ ID NO: 908855 - DNA, 25 bp, Mus musculus
cgactgatcaagcaactggctaaat

SEQ ID NO: 908856 - DNA, 25 bp, Mus musculus
cgactgatcaaggaactggctaaat

SEQ ID NO: 908857 - DNA, 25 bp, Mus musculus
cgactgcaaacacatcattgccaac

SEQ ID NO: 908858 - DNA, 25 bp, Mus musculus
cgactgcaaacagatcattgccaac

SEQ ID NO: 908859 - DNA, 25 bp, Mus musculus
cgactgcaagcacttgtcctacaag

SEQ ID NO: 908860 - DNA, 25 bp, Mus musculus
cgactgcaaggacttgtcctacaag

SEQ ID NO: 908861 - DNA, 25 bp, Mus musculus
cgactgcaataacatctatgaacga

SEQ ID NO: 908862 - DNA, 25 bp, Mus musculus
cgactgcaataagatctatgaacga

SEQ ID NO: 908863 - DNA, 25 bp, Mus musculus
cgactgccagccagcattttgtgga

SEQ ID NO: 908864 - DNA, 25 bp, Mus musculus
cgactgccagccaggattttgtgga

SEQ ID NO: 908865 - DNA, 25 bp, Mus musculus
cgactgcgggacgatcctcctgcaa

SEQ ID NO: 908866 - DNA, 25 bp, Mus musculus
cgactgcggggtgacacgatcctcc

SEQ ID NO: 908867 - DNA, 25 bp, Mus musculus
cgactgcggggtgagacgatcctcc

SEQ ID NO: 908868 - DNA, 25 bp, Mus musculus
cgactgcgggtcgatcctcctgcaa

SEQ ID NO: 908869 - DNA, 25 bp, Mus musculus
cgactggaaaaacgacaggtgcagt

SEQ ID NO: 908870 - DNA, 25 bp, Mus musculus
cgactggaaaaacgataggtgcggt

SEQ ID NO: 908871 - DNA, 25 bp, Mus musculus
cgactggaaaaaggacaggtgcagt

SEQ ID NO: 908872 - DNA, 25 bp, Mus musculus
cgactggaaaaaggataggtgcggt

SEQ ID NO: 908873 - DNA, 25 bp, Mus musculus
cgactggccgccagaagcctcagca

SEQ ID NO: 908874 - DNA, 25 bp, Mus musculus
cgactggccggcagaagcctcagca

SEQ ID NO: 908875 - DNA, 25 bp, Mus musculus
cgactgtcactgcacgccacagccc

SEQ ID NO: 908876 - DNA, 25 bp, Mus musculus
cgactgtcactgcaggccacagccc

SEQ ID NO: 908877 - DNA, 25 bp, Mus musculus
cgactgtggggtctgccttcttcac

SEQ ID NO: 908878 - DNA, 25 bp, Mus musculus
cgactgtggggtgtgccttcttcac

SEQ ID NO: 908879 - DNA, 25 bp, Mus musculus
cgacttagagcccaatttcgagaag

SEQ ID NO: 908880 - DNA, 25 bp, Mus musculus
cgacttagaggccaatttcgagaag

SEQ ID NO: 908881 - DNA, 25 bp, Mus musculus
cgacttagtcagctgtcaaaagacc

SEQ ID NO: 908882 - DNA, 25 bp, Mus musculus
cgacttagtcaggtgtcaaaagacc

SEQ ID NO: 908883 - DNA, 25 bp, Mus musculus
cgacttagtgcgcctgtgtggagat

SEQ ID NO: 908884 - DNA, 25 bp, Mus musculus
cgacttagtgcggctgtgtggagat

SEQ ID NO: 908885 - DNA, 25 bp, Mus musculus
cgacttcaagcacacagcaggccag

SEQ ID NO: 908886 - DNA, 25 bp, Mus musculus
cgacttcaagcccacctatgggacc

SEQ ID NO: 908887 - DNA, 25 bp, Mus musculus
cgacttcaagcccactcttgcctcc

SEQ ID NO: 908888 - DNA, 25 bp, Mus musculus
cgacttcaagcccagctatgggacc

SEQ ID NO: 908889 - DNA, 25 bp, Mus musculus
cgacttcaagcccagtcttgcctcc

SEQ ID NO: 908890 - DNA, 25 bp, Mus musculus
cgacttcaaggacacagcaggccag

SEQ ID NO: 908891 - DNA, 25 bp, Mus musculus
cgacttcacagactactacctggtg

SEQ ID NO: 908892 - DNA, 25 bp, Mus musculus
cgacttcacagacttctacctggtg

SEQ ID NO: 908893 - DNA, 25 bp, Mus musculus
cgacttcaggaccaagtatgagaca

SEQ ID NO: 908894 - DNA, 25 bp, Mus musculus
cgacttcaggaccatgtatgagaca

SEQ ID NO: 908895 - DNA, 25 bp, Mus musculus
cgacttcaggctcaagtatgagaat

SEQ ID NO: 908896 - DNA, 25 bp, Mus musculus
cgacttcaggctcatgtatgagaat

SEQ ID NO: 908897 - DNA, 25 bp, Mus musculus
cgacttcgacgggacgtggcccagg

SEQ ID NO: 908898 - DNA, 25 bp, Mus musculus
cgacttcgacgggaggtggcccagg

SEQ ID NO: 908899 - DNA, 25 bp, Mus musculus
cgacttggacaacaccatcaagaaa

SEQ ID NO: 908900 - DNA, 25 bp, Mus musculus
cgacttggacaagaccatcaagaaa

SEQ ID NO: 908901 - DNA, 25 bp, Mus musculus
cgacttggtgataaggtacagtttt

SEQ ID NO: 908902 - DNA, 25 bp, Mus musculus
cgacttggtgatcaaaccattagag

SEQ ID NO: 908903 - DNA, 25 bp, Mus musculus
cgacttggtgatgaaaccattagag

SEQ ID NO: 908904 - DNA, 25 bp, Mus musculus
cgacttggtgattaggtacagtttt

SEQ ID NO: 908905 - DNA, 25 bp, Mus musculus
cgacttgtgagttccactgtgattt

SEQ ID NO: 908906 - DNA, 25 bp, Mus musculus
cgacttgtgagttcgactgtgattt

SEQ ID NO: 908907 - DNA, 25 bp, Mus musculus
cgactttacttcagtggagtcaatt

SEQ ID NO: 908908 - DNA, 25 bp, Mus musculus
cgactttacttctgtggagtcaatt

SEQ ID NO: 908909 - DNA, 25 bp, Mus musculus
cgagaaaaagctggagagatgtctg

SEQ ID NO: 908910 - DNA, 25 bp, Mus musculus
cgagaaaaaggtggagagatgtctg

SEQ ID NO: 908911 - DNA, 25 bp, Mus musculus
cgagaaaagaaacaagcgagatatc

SEQ ID NO: 908912 - DNA, 25 bp, Mus musculus
cgagaaaagaaaccgagatatccct

SEQ ID NO: 908913 - DNA, 25 bp, Mus musculus
cgagaaaagaaagaagcgagatatc

SEQ ID NO: 908914 - DNA, 25 bp, Mus musculus
cgagaaaagaaagcgagatatccct

SEQ ID NO: 908915 - DNA, 25 bp, Mus musculus
cgagaaagagcagtaggtaatgttg

SEQ ID NO: 908916 - DNA, 25 bp, Mus musculus
cgagaaagaggagtaggtaatgttg

SEQ ID NO: 908917 - DNA, 25 bp, Mus musculus
cgagaacacctgcacagagaagggt

SEQ ID NO: 908918 - DNA, 25 bp, Mus musculus
cgagaacacctgcagagagaagggt

SEQ ID NO: 908919 - DNA, 25 bp, Mus musculus
cgagaacatgaacatcttgcgtctg

SEQ ID NO: 908920 - DNA, 25 bp, Mus musculus
cgagaacatgaagatcttgcgtctg

SEQ ID NO: 908921 - DNA, 25 bp, Mus musculus
cgagaaccagagggcacatctgctg

SEQ ID NO: 908922 - DNA, 25 bp, Mus musculus
cgagaaccagatgataaaattacgt

SEQ ID NO: 908923 - DNA, 25 bp, Mus musculus
cgagaaccagtgggcacatctgctg

SEQ ID NO: 908924 - DNA, 25 bp, Mus musculus
cgagaaccagttgataaaattacgt

SEQ ID NO: 908925 - DNA, 25 bp, Mus musculus
cgagaacctgagctcattgctgcag

SEQ ID NO: 908926 - DNA, 25 bp, Mus musculus
cgagaacctgaggtcattgctgcag

SEQ ID NO: 908927 - DNA, 25 bp, Mus musculus
cgagaagaagaaggaggagaggtac

SEQ ID NO: 908928 - DNA, 25 bp, Mus musculus
cgagaagaagcaggagaggtacaaa

SEQ ID NO: 908929 - DNA, 25 bp, Mus musculus
cgagaagaaggaggagaggtacaaa

SEQ ID NO: 908930 - DNA, 25 bp, Mus musculus
cgagaagaagtaggaggagaggtac

SEQ ID NO: 908931 - DNA, 25 bp, Mus musculus
cgagaagaggatcgctgctcccagg

SEQ ID NO: 908932 - DNA, 25 bp, Mus musculus
cgagaagaggatggctgctcccagg

SEQ ID NO: 908933 - DNA, 25 bp, Mus musculus
cgagaagaggttctcagtcttaggt

SEQ ID NO: 908934 - DNA, 25 bp, Mus musculus
cgagaagaggttctgagtcttaggt

SEQ ID NO: 908935 - DNA, 25 bp, Mus musculus
cgagaagcaaggacagtcagcgtga

SEQ ID NO: 908936 - DNA, 25 bp, Mus musculus
cgagaagcaaggactgtcagcgtga

SEQ ID NO: 908937 - DNA, 25 bp, Mus musculus
cgagaagccattacaatgtgagatc

SEQ ID NO: 908938 - DNA, 25 bp, Mus musculus
cgagaagccattactatgtgagatc

SEQ ID NO: 908939 - DNA, 25 bp, Mus musculus
cgagaagcggagacacgaccacctg

SEQ ID NO: 908940 - DNA, 25 bp, Mus musculus
cgagaagcggagtcacgaccacctg

SEQ ID NO: 908941 - DNA, 25 bp, Mus musculus
cgagaagctgaaaaagaccgagcct

SEQ ID NO: 908942 - DNA, 25 bp, Mus musculus
cgagaagctgaaaatgaccgagcct

SEQ ID NO: 908943 - DNA, 25 bp, Mus musculus
cgagaaggagcacgttggccacatt

SEQ ID NO: 908944 - DNA, 25 bp, Mus musculus
cgagaaggagcaggttggccacatt

SEQ ID NO: 908945 - DNA, 25 bp, Mus musculus
cgagaaggagctcatcgaagcgttg

SEQ ID NO: 908946 - DNA, 25 bp, Mus musculus
cgagaaggagctcccaaggcggcaa

SEQ ID NO: 908947 - DNA, 25 bp, Mus musculus
cgagaaggagctgatcgaagcgttg

SEQ ID NO: 908948 - DNA, 25 bp, Mus musculus
cgagaaggagctgccaaggcggcaa

SEQ ID NO: 908949 - DNA, 25 bp, Mus musculus
cgagaagggggacattgagcaggag

SEQ ID NO: 908950 - DNA, 25 bp, Mus musculus
cgagaagggggagattgagcaggag

SEQ ID NO: 908951 - DNA, 25 bp, Mus musculus
cgagaagtcccgagctgaagaggtt

SEQ ID NO: 908952 - DNA, 25 bp, Mus musculus
cgagaagtcccgtgctgaagaggtt

SEQ ID NO: 908953 - DNA, 25 bp, Mus musculus
cgagaatctgacctcccacgagttg

SEQ ID NO: 908954 - DNA, 25 bp, Mus musculus
cgagaatctgtcctcccacgagttg

SEQ ID NO: 908955 - DNA, 25 bp, Mus musculus
cgagaatgagatgtttagcatggtg

SEQ ID NO: 908956 - DNA, 25 bp, Mus musculus
cgagaatgagttgtttagcatggtg

SEQ ID NO: 908957 - DNA, 25 bp, Mus musculus
cgagacactgaaaaccacatttcac

SEQ ID NO: 908958 - DNA, 25 bp, Mus musculus
cgagacactgaaaagcacatttcac

SEQ ID NO: 908959 - DNA, 25 bp, Mus musculus
cgagacagggagccacagctggtga

SEQ ID NO: 908960 - DNA, 25 bp, Mus musculus
cgagacagggaggcacagctggtga

SEQ ID NO: 908961 - DNA, 25 bp, Mus musculus
cgagacatggatctcgtgtgagtgt

SEQ ID NO: 908962 - DNA, 25 bp, Mus musculus
cgagacatggatctggtgtgagtgt

SEQ ID NO: 908963 - DNA, 25 bp, Mus musculus
cgagacccaaatcttggtgggctgt

SEQ ID NO: 908964 - DNA, 25 bp, Mus musculus
cgagacccaattcttggtgggctgt

SEQ ID NO: 908965 - DNA, 25 bp, Mus musculus
cgagacctcttgcacgaagggttgg

SEQ ID NO: 908966 - DNA, 25 bp, Mus musculus
cgagacctcttgcaggaagggttgg

SEQ ID NO: 908967 - DNA, 25 bp, Mus musculus
cgagacggaggaagcccccaaagat

SEQ ID NO: 908968 - DNA, 25 bp, Mus musculus
cgagacggaggaaggccccaaagat

SEQ ID NO: 908969 - DNA, 25 bp, Mus musculus
cgagacggcaagcactatgtcatca

SEQ ID NO: 908970 - DNA, 25 bp, Mus musculus
cgagacggcaagcagtatgtcatca

SEQ ID NO: 908971 - DNA, 25 bp, Mus musculus
cgagactgaggaccagtattcactg

SEQ ID NO: 908972 - DNA, 25 bp, Mus musculus
cgagactgaggagcagtattcactg

SEQ ID NO: 908973 - DNA, 25 bp, Mus musculus
cgagactgccaacactcactctgtg

SEQ ID NO: 908974 - DNA, 25 bp, Mus musculus
cgagactgccaacgaggccgagtta

SEQ ID NO: 908975 - DNA, 25 bp, Mus musculus
cgagactgccaagactcactctgtg

SEQ ID NO: 908976 - DNA, 25 bp, Mus musculus
cgagactgccaaggaggccgagtta

SEQ ID NO: 908977 - DNA, 25 bp, Mus musculus
cgagacttggcaggatgacctggat

SEQ ID NO: 908978 - DNA, 25 bp, Mus musculus
cgagacttgggaggatgacctggat

SEQ ID NO: 908979 - DNA, 25 bp, Mus musculus
cgagactttgttatgtggaagttca

SEQ ID NO: 908980 - DNA, 25 bp, Mus musculus
cgagactttgttttgtggaagttca

SEQ ID NO: 908981 - DNA, 25 bp, Mus musculus
cgagagaaagctgtggactgtgaca

SEQ ID NO: 908982 - DNA, 25 bp, Mus musculus
cgagagaaaggtgtggactgtgaca

SEQ ID NO: 908983 - DNA, 25 bp, Mus musculus
cgagagaaagtgctggacatagaaa

SEQ ID NO: 908984 - DNA, 25 bp, Mus musculus
cgagagaaagtggtggacatagaaa

SEQ ID NO: 908985 - DNA, 25 bp, Mus musculus
cgagagaggaagatcgtcctactcc

SEQ ID NO: 908986 - DNA, 25 bp, Mus musculus
cgagagaggaagttcgtcctactcc

SEQ ID NO: 908987 - DNA, 25 bp, Mus musculus
cgagagatgaatcggaagtatgtgg

SEQ ID NO: 908988 - DNA, 25 bp, Mus musculus
cgagagatgaatgggaagtatgtgg

SEQ ID NO: 908989 - DNA, 25 bp, Mus musculus
cgagagattgataatcatgatgcgg

SEQ ID NO: 908990 - DNA, 25 bp, Mus musculus
cgagagattgttaatcatgatgcgg

SEQ ID NO: 908991 - DNA, 25 bp, Mus musculus
cgagagcaaaaactctcagtttgaa

SEQ ID NO: 908992 - DNA, 25 bp, Mus musculus
cgagagcaaaaagtctcagtttgaa

SEQ ID NO: 908993 - DNA, 25 bp, Mus musculus
cgagagcaagctctctgagatgtct

SEQ ID NO: 908994 - DNA, 25 bp, Mus musculus
cgagagcaaggtctctgagatgtct

SEQ ID NO: 908995 - DNA, 25 bp, Mus musculus
cgagagcaatgactgggaagtggtg

SEQ ID NO: 908996 - DNA, 25 bp, Mus musculus
cgagagcaatgagtgggaagtggtg

SEQ ID NO: 908997 - DNA, 25 bp, Mus musculus
cgagagcatcgacggcctgtaccac

SEQ ID NO: 908998 - DNA, 25 bp, Mus musculus
cgagagcatcgagggcctgtaccac

SEQ ID NO: 908999 - DNA, 25 bp, Mus musculus
cgagagcatgaacactccgtggttt

SEQ ID NO: 909000 - DNA, 25 bp, Mus musculus
cgagagcatgaacggcgttttttct

SEQ ID NO: 909001 - DNA, 25 bp, Mus musculus
cgagagcatgaactgggccaatccg

SEQ ID NO: 909002 - DNA, 25 bp, Mus musculus
cgagagcatgaagactccgtggttt

SEQ ID NO: 909003 - DNA, 25 bp, Mus musculus
cgagagcatgaagggcgttttttct

SEQ ID NO: 909004 - DNA, 25 bp, Mus musculus
cgagagcatgaagtgggccaatccg

SEQ ID NO: 909005 - DNA, 25 bp, Mus musculus
cgagagccactgattgccacagcag

SEQ ID NO: 909006 - DNA, 25 bp, Mus musculus
cgagagccactgcactgacagacga

SEQ ID NO: 909007 - DNA, 25 bp, Mus musculus
cgagagccactggactgacagacga

SEQ ID NO: 909008 - DNA, 25 bp, Mus musculus
cgagagccactgtttgccacagcag

SEQ ID NO: 909009 - DNA, 25 bp, Mus musculus
cgagagccccttataatccattggg

SEQ ID NO: 909010 - DNA, 25 bp, Mus musculus
cgagagccccttattatccattggg

SEQ ID NO: 909011 - DNA, 25 bp, Mus musculus
cgagagctccagatccatgatgagg

SEQ ID NO: 909012 - DNA, 25 bp, Mus musculus
cgagagctccagttccatgatgagg

SEQ ID NO: 909013 - DNA, 25 bp, Mus musculus
cgagaggaccttcgcggctgggctt

SEQ ID NO: 909014 - DNA, 25 bp, Mus musculus
cgagaggaccttcggggctgggctt

SEQ ID NO: 909015 - DNA, 25 bp, Mus musculus
cgagaggagggacacgagtgacact

SEQ ID NO: 909016 - DNA, 25 bp, Mus musculus
cgagaggagggacaggagtgacact

SEQ ID NO: 909017 - DNA, 25 bp, Mus musculus
cgagaggatgaggacaacaacgaga

SEQ ID NO: 909018 - DNA, 25 bp, Mus musculus
cgagaggatgaggagaacaacgaga

SEQ ID NO: 909019 - DNA, 25 bp, Mus musculus
cgagaggcgcgacgccgcaaaacgg

SEQ ID NO: 909020 - DNA, 25 bp, Mus musculus
cgagaggcgcgaggccgcaaaacgg

SEQ ID NO: 909021 - DNA, 25 bp, Mus musculus
cgagaggctgcacgctacagaacct

SEQ ID NO: 909022 - DNA, 25 bp, Mus musculus
cgagaggctgcaggctacagaacct

SEQ ID NO: 909023 - DNA, 25 bp, Mus musculus
cgagagggctgccatactggttgta

SEQ ID NO: 909024 - DNA, 25 bp, Mus musculus
cgagagggctgcgatactggttgta

SEQ ID NO: 909025 - DNA, 25 bp, Mus musculus
cgagaggtcaagcccccacgcatgg

SEQ ID NO: 909026 - DNA, 25 bp, Mus musculus
cgagaggtcaaggccccacgcatgg

SEQ ID NO: 909027 - DNA, 25 bp, Mus musculus
cgagagtgtcaaaggatcaatgtga

SEQ ID NO: 909028 - DNA, 25 bp, Mus musculus
cgagagtgtcaaagtacttcaactc

SEQ ID NO: 909029 - DNA, 25 bp, Mus musculus
cgagagtgtcaatggatcaatgtga

SEQ ID NO: 909030 - DNA, 25 bp, Mus musculus
cgagagtgtcaatgtacttcaactc

SEQ ID NO: 909031 - DNA, 25 bp, Mus musculus
cgagataagagactgggaggcgaaa

SEQ ID NO: 909032 - DNA, 25 bp, Mus musculus
cgagataagagagtgggaggcgaaa

SEQ ID NO: 909033 - DNA, 25 bp, Mus musculus
cgagatagcgctcgtctcctagatc

SEQ ID NO: 909034 - DNA, 25 bp, Mus musculus
cgagatagcgctggtctcctagatc

SEQ ID NO: 909035 - DNA, 25 bp, Mus musculus
cgagatatcaaacctgccaacgtgc

SEQ ID NO: 909036 - DNA, 25 bp, Mus musculus
cgagatatcaaagctgccaacgtgc

SEQ ID NO: 909037 - DNA, 25 bp, Mus musculus
cgagatattcataacaagaaatccc

SEQ ID NO: 909038 - DNA, 25 bp, Mus musculus
cgagatattcttaacaagaaatccc

SEQ ID NO: 909039 - DNA, 25 bp, Mus musculus
cgagatcaagatcatgaagagtgaa

SEQ ID NO: 909040 - DNA, 25 bp, Mus musculus
cgagatcaagttcatgaagagtgaa

SEQ ID NO: 909041 - DNA, 25 bp, Mus musculus
cgagatcatcaaaccagaagatttc

SEQ ID NO: 909042 - DNA, 25 bp, Mus musculus
cgagatcatcaatccagaagatttc

SEQ ID NO: 909043 - DNA, 25 bp, Mus musculus
cgagatccgcagaatgttccggaag

SEQ ID NO: 909044 - DNA, 25 bp, Mus musculus
cgagatccgcagaggtttctctgta

SEQ ID NO: 909045 - DNA, 25 bp, Mus musculus
cgagatccgcagtatgttccggaag

SEQ ID NO: 909046 - DNA, 25 bp, Mus musculus
cgagatccgcagtggtttctctgta

SEQ ID NO: 909047 - DNA, 25 bp, Mus musculus
cgagatcgagccatggtggagctag

SEQ ID NO: 909048 - DNA, 25 bp, Mus musculus
cgagatcgaggcatggtggagctag

SEQ ID NO: 909049 - DNA, 25 bp, Mus musculus
cgagatcgatgcaggtgtgtgtgag

SEQ ID NO: 909050 - DNA, 25 bp, Mus musculus
cgagatcgatgctggtgtgtgtgag

SEQ ID NO: 909051 - DNA, 25 bp, Mus musculus
cgagatcttcctcacctacatctct

SEQ ID NO: 909052 - DNA, 25 bp, Mus musculus
cgagatcttcctgacctacatctct

SEQ ID NO: 909053 - DNA, 25 bp, Mus musculus
cgagatgccatttccatcttccact

SEQ ID NO: 909054 - DNA, 25 bp, Mus musculus
cgagatgccatttcgatcttccact

SEQ ID NO: 909055 - DNA, 25 bp, Mus musculus
cgagatgctcagcctttgctcctgt

SEQ ID NO: 909056 - DNA, 25 bp, Mus musculus
cgagatgctcaggctttgctcctgt

SEQ ID NO: 909057 - DNA, 25 bp, Mus musculus
cgagatgctcatcctctccccgggt

SEQ ID NO: 909058 - DNA, 25 bp, Mus musculus
cgagatgctcatgctctccccgggt

SEQ ID NO: 909059 - DNA, 25 bp, Mus musculus
cgagatggatccatcaggacagttg

SEQ ID NO: 909060 - DNA, 25 bp, Mus musculus
cgagatggatccttcaggacagttg

SEQ ID NO: 909061 - DNA, 25 bp, Mus musculus
cgagatgtcacagccgacttttatg

SEQ ID NO: 909062 - DNA, 25 bp, Mus musculus
cgagatgtcacagcggacttttatg

SEQ ID NO: 909063 - DNA, 25 bp, Mus musculus
cgagatgtggagattctagtgcagc

SEQ ID NO: 909064 - DNA, 25 bp, Mus musculus
cgagatgtggagtttctagtgcagc

SEQ ID NO: 909065 - DNA, 25 bp, Mus musculus
cgagatgtgttggacgtcctggatg

SEQ ID NO: 909066 - DNA, 25 bp, Mus musculus
cgagatgtgttggaggtcctggatg

SEQ ID NO: 909067 - DNA, 25 bp, Mus musculus
cgagattccacaaacgattgttgag

SEQ ID NO: 909068 - DNA, 25 bp, Mus musculus
cgagattccacaaaggattgttgag

SEQ ID NO: 909069 - DNA, 25 bp, Mus musculus
cgagattgacataatcaatctaagg

SEQ ID NO: 909070 - DNA, 25 bp, Mus musculus
cgagattgacttaatcaatctaagg

SEQ ID NO: 909071 - DNA, 25 bp, Mus musculus
cgagatttccgatgagttcctggta

SEQ ID NO: 909072 - DNA, 25 bp, Mus musculus
cgagatttccgatgtgttcctggta

SEQ ID NO: 909073 - DNA, 25 bp, Mus musculus
cgagcaaaacatcgtgagcattgcc

SEQ ID NO: 909074 - DNA, 25 bp, Mus musculus
cgagcaaaacatggtgagcattgcc

SEQ ID NO: 909075 - DNA, 25 bp, Mus musculus
cgagcaaaatctcaaattgctctta

SEQ ID NO: 909076 - DNA, 25 bp, Mus musculus
cgagcaaaatctcatattgctctta

SEQ ID NO: 909077 - DNA, 25 bp, Mus musculus
cgagcaaatccacaaagtgcaagtg

SEQ ID NO: 909078 - DNA, 25 bp, Mus musculus
cgagcaaatccagaaagtgcaagtg

SEQ ID NO: 909079 - DNA, 25 bp, Mus musculus
cgagcacatgcccttaggcccagga

SEQ ID NO: 909080 - DNA, 25 bp, Mus musculus
cgagcacatgcgagtgttgtgaaga

SEQ ID NO: 909081 - DNA, 25 bp, Mus musculus
cgagcacatggccttaggcccagga

SEQ ID NO: 909082 - DNA, 25 bp, Mus musculus
cgagcacatgggagtgttgtgaaga

SEQ ID NO: 909083 - DNA, 25 bp, Mus musculus
cgagcacccgggatacacttttggc

SEQ ID NO: 909084 - DNA, 25 bp, Mus musculus
cgagcacccgggcaggcagagtaag

SEQ ID NO: 909085 - DNA, 25 bp, Mus musculus
cgagcacccggggaggcagagtaag

SEQ ID NO: 909086 - DNA, 25 bp, Mus musculus
cgagcacccgggttacacttttggc

SEQ ID NO: 909087 - DNA, 25 bp, Mus musculus
cgagcagaagcaagccatacaggag

SEQ ID NO: 909088 - DNA, 25 bp, Mus musculus
cgagcagaaggaagccatacaggag

SEQ ID NO: 909089 - DNA, 25 bp, Mus musculus
cgagcagagcgaggcgtccgtctcc

SEQ ID NO: 909090 - DNA, 25 bp, Mus musculus
cgagcagagcgaggggtccgtctcc

SEQ ID NO: 909091 - DNA, 25 bp, Mus musculus
cgagcagatgctcgcgctgtcattt

SEQ ID NO: 909092 - DNA, 25 bp, Mus musculus
cgagcagatgctcgggctgtcattt

SEQ ID NO: 909093 - DNA, 25 bp, Mus musculus
cgagcagccaacatcgttcgagctg

SEQ ID NO: 909094 - DNA, 25 bp, Mus musculus
cgagcagccaacatggttcgagctg

SEQ ID NO: 909095 - DNA, 25 bp, Mus musculus
cgagcagcgtccttcagctgaggct

SEQ ID NO: 909096 - DNA, 25 bp, Mus musculus
cgagcagcgtccttgagctgaggct

SEQ ID NO: 909097 - DNA, 25 bp, Mus musculus
cgagcaggacggcaaggatgcgaac

SEQ ID NO: 909098 - DNA, 25 bp, Mus musculus
cgagcaggacgggaaggatgcgaac

SEQ ID NO: 909099 - DNA, 25 bp, Mus musculus
cgagcaggagctactaaatgcaata

SEQ ID NO: 909100 - DNA, 25 bp, Mus musculus
cgagcaggaggtactaaatgcaata

SEQ ID NO: 909101 - DNA, 25 bp, Mus musculus
cgagcagttaaccactgctgagcct

SEQ ID NO: 909102 - DNA, 25 bp, Mus musculus
cgagcagttaaccagtgctgagcct

SEQ ID NO: 909103 - DNA, 25 bp, Mus musculus
cgagcatctactaacggctggcccg

SEQ ID NO: 909104 - DNA, 25 bp, Mus musculus
cgagcatctactacagctgcgtgca

SEQ ID NO: 909105 - DNA, 25 bp, Mus musculus
cgagcatctacttacggctggcccg

SEQ ID NO: 909106 - DNA, 25 bp, Mus musculus
cgagcatctacttcagctgcgtgca

SEQ ID NO: 909107 - DNA, 25 bp, Mus musculus
cgagccaagaagctggcctggcccg

SEQ ID NO: 909108 - DNA, 25 bp, Mus musculus
cgagccaagaaggtggcctggcccg

SEQ ID NO: 909109 - DNA, 25 bp, Mus musculus
cgagccagagcagtacttttgagga

SEQ ID NO: 909110 - DNA, 25 bp, Mus musculus
cgagccagaggagtacttttgagga

SEQ ID NO: 909111 - DNA, 25 bp, Mus musculus
cgagccagcaaccgtatagaaaatg

SEQ ID NO: 909112 - DNA, 25 bp, Mus musculus
cgagccagcaacggtatagaaaatg

SEQ ID NO: 909113 - DNA, 25 bp, Mus musculus
cgagccccaacggcagccacaagtc

SEQ ID NO: 909114 - DNA, 25 bp, Mus musculus
cgagccccaagggcagccacaagtc

SEQ ID NO: 909115 - DNA, 25 bp, Mus musculus
cgagcccgcctcagttgacagcatt

SEQ ID NO: 909116 - DNA, 25 bp, Mus musculus
cgagcccgcctctgttgacagcatt

SEQ ID NO: 909117 - DNA, 25 bp, Mus musculus
cgagccgcagaggttttatgaagag

SEQ ID NO: 909118 - DNA, 25 bp, Mus musculus
cgagccgcagcgcggatgccgttct

SEQ ID NO: 909119 - DNA, 25 bp, Mus musculus
cgagccgcagcggggatgccgttct

SEQ ID NO: 909120 - DNA, 25 bp, Mus musculus
cgagccgcagtggttttatgaagag

SEQ ID NO: 909121 - DNA, 25 bp, Mus musculus
cgagccgccaccatcacggtgggca

SEQ ID NO: 909122 - DNA, 25 bp, Mus musculus
cgagccgccaccatgacggtgggca

SEQ ID NO: 909123 - DNA, 25 bp, Mus musculus
cgagccgcggatccccatttgcagg

SEQ ID NO: 909124 - DNA, 25 bp, Mus musculus
cgagccgcggatccgcatttgcagg

SEQ ID NO: 909125 - DNA, 25 bp, Mus musculus
cgagccggagagcatggcggactac

SEQ ID NO: 909126 - DNA, 25 bp, Mus musculus
cgagccggagaggatggcggactac

SEQ ID NO: 909127 - DNA, 25 bp, Mus musculus
cgagccgggcagcgccctggaggag

SEQ ID NO: 909128 - DNA, 25 bp, Mus musculus
cgagccgggcagcggcctggaggag

SEQ ID NO: 909129 - DNA, 25 bp, Mus musculus
cgagcctctgagatttgtctagatg

SEQ ID NO: 909130 - DNA, 25 bp, Mus musculus
cgagcctctgagttttgtctagatg

SEQ ID NO: 909131 - DNA, 25 bp, Mus musculus
cgagcgatcctggcaactctggaga

SEQ ID NO: 909132 - DNA, 25 bp, Mus musculus
cgagcgatcctggctactctggaga

SEQ ID NO: 909133 - DNA, 25 bp, Mus musculus
cgagcgcccgcgtccagaggaccag

SEQ ID NO: 909134 - DNA, 25 bp, Mus musculus
cgagcgcccgggtccagaggaccag

SEQ ID NO: 909135 - DNA, 25 bp, Mus musculus
cgagcgctatatggtgtcaggtacc

SEQ ID NO: 909136 - DNA, 25 bp, Mus musculus
cgagcgctatttggtgtcaggtacc

SEQ ID NO: 909137 - DNA, 25 bp, Mus musculus
cgagcggcatgacggtcgagagggc

SEQ ID NO: 909138 - DNA, 25 bp, Mus musculus
cgagcggcatgagggtcgagagggc

SEQ ID NO: 909139 - DNA, 25 bp, Mus musculus
cgagcgtaagatcccctgcttcgag

SEQ ID NO: 909140 - DNA, 25 bp, Mus musculus
cgagcgtaagcctgatggatgtctg

SEQ ID NO: 909141 - DNA, 25 bp, Mus musculus
cgagcgtaaggctgatggatgtctg

SEQ ID NO: 909142 - DNA, 25 bp, Mus musculus
cgagcgtaagttcccctgcttcgag

SEQ ID NO: 909143 - DNA, 25 bp, Mus musculus
cgagctctgaagatagcagtggacc

SEQ ID NO: 909144 - DNA, 25 bp, Mus musculus
cgagctctgaagttagcagtggacc

SEQ ID NO: 909145 - DNA, 25 bp, Mus musculus
cgagctctgcatgctggttgttgga

SEQ ID NO: 909146 - DNA, 25 bp, Mus musculus
cgagctctgcttgctggttgttgga

SEQ ID NO: 909147 - DNA, 25 bp, Mus musculus
cgagctgccgtgcgttgaaaaatac

SEQ ID NO: 909148 - DNA, 25 bp, Mus musculus
cgagctgccgtgggttgaaaaatac

SEQ ID NO: 909149 - DNA, 25 bp, Mus musculus
cgagctgcgggacagggtctgctga

SEQ ID NO: 909150 - DNA, 25 bp, Mus musculus
cgagctgcgggagagggtctgctga

SEQ ID NO: 909151 - DNA, 25 bp, Mus musculus
cgagctgctagacacgaagatccat

SEQ ID NO: 909152 - DNA, 25 bp, Mus musculus
cgagctgctagacaggaagatccat

SEQ ID NO: 909153 - DNA, 25 bp, Mus musculus
cgagctggagagagcaaaccaacat

SEQ ID NO: 909154 - DNA, 25 bp, Mus musculus
cgagctggagtgagcaaaccaacat

SEQ ID NO: 909155 - DNA, 25 bp, Mus musculus
cgagcttacaaacaatggaattgct

SEQ ID NO: 909156 - DNA, 25 bp, Mus musculus
cgagcttacaaagaatggaattgct

SEQ ID NO: 909157 - DNA, 25 bp, Mus musculus
cgagcttctgcaaggttctgtcccc

SEQ ID NO: 909158 - DNA, 25 bp, Mus musculus
cgagcttctgcatggttctgtcccc

SEQ ID NO: 909159 - DNA, 25 bp, Mus musculus
cgaggaaagcatccttgaagaagtg

SEQ ID NO: 909160 - DNA, 25 bp, Mus musculus
cgaggaaagcatgcttgaagaagtg

SEQ ID NO: 909161 - DNA, 25 bp, Mus musculus
cgaggaagagatcgtgaagctggag

SEQ ID NO: 909162 - DNA, 25 bp, Mus musculus
cgaggaagagatggtgaagctggag

SEQ ID NO: 909163 - DNA, 25 bp, Mus musculus
cgaggaagcgctcctgcaggcagag

SEQ ID NO: 909164 - DNA, 25 bp, Mus musculus
cgaggaagcgctgctgcaggcagag

SEQ ID NO: 909165 - DNA, 25 bp, Mus musculus
cgaggaccagatggcttcacacccc

SEQ ID NO: 909166 - DNA, 25 bp, Mus musculus
cgaggaccagttggcttcacacccc

SEQ ID NO: 909167 - DNA, 25 bp, Mus musculus
cgaggacccgcgagatgctgaggat

SEQ ID NO: 909168 - DNA, 25 bp, Mus musculus
cgaggacccgcgtgatgctgaggat

SEQ ID NO: 909169 - DNA, 25 bp, Mus musculus
cgaggaccctcacgtttgatgaaga

SEQ ID NO: 909170 - DNA, 25 bp, Mus musculus
cgaggaccctcaggtttgatgaaga

SEQ ID NO: 909171 - DNA, 25 bp, Mus musculus
cgaggacgaagtctttgactttggc

SEQ ID NO: 909172 - DNA, 25 bp, Mus musculus
cgaggacgaagtgtttgactttggc

SEQ ID NO: 909173 - DNA, 25 bp, Mus musculus
cgaggacgagagctctatttcagtg

SEQ ID NO: 909174 - DNA, 25 bp, Mus musculus
cgaggacgagagctctggtgcaagt

SEQ ID NO: 909175 - DNA, 25 bp, Mus musculus
cgaggacgagaggtctatttcagtg

SEQ ID NO: 909176 - DNA, 25 bp, Mus musculus
cgaggacgagaggtctggtgcaagt

SEQ ID NO: 909177 - DNA, 25 bp, Mus musculus
cgaggactacaaggaatatgggtat

SEQ ID NO: 909178 - DNA, 25 bp, Mus musculus
cgaggactacaaggtatatgggtat

SEQ ID NO: 909179 - DNA, 25 bp, Mus musculus
cgaggactgcaacctaccttgcaac

SEQ ID NO: 909180 - DNA, 25 bp, Mus musculus
cgaggactgcaacctgccctgcaac

SEQ ID NO: 909181 - DNA, 25 bp, Mus musculus
cgaggactgcaagctaccttgcaac

SEQ ID NO: 909182 - DNA, 25 bp, Mus musculus
cgaggactgcaagctgccctgcaac

SEQ ID NO: 909183 - DNA, 25 bp, Mus musculus
cgaggacttccacaaaagccagtaa

SEQ ID NO: 909184 - DNA, 25 bp, Mus musculus
cgaggacttccagaaaagccagtaa

SEQ ID NO: 909185 - DNA, 25 bp, Mus musculus
cgaggagaactcagaggaggatgaa

SEQ ID NO: 909186 - DNA, 25 bp, Mus musculus
cgaggagaactctgaggaggatgaa

SEQ ID NO: 909187 - DNA, 25 bp, Mus musculus
cgaggagagcaacttcccacatgcc

SEQ ID NO: 909188 - DNA, 25 bp, Mus musculus
cgaggagagcaagttcccacatgcc

SEQ ID NO: 909189 - DNA, 25 bp, Mus musculus
cgaggagagcagcaaatgtggtcta

SEQ ID NO: 909190 - DNA, 25 bp, Mus musculus
cgaggagagcaggaaatgtggtcta

SEQ ID NO: 909191 - DNA, 25 bp, Mus musculus
cgaggagagccgcttgtctggagac

SEQ ID NO: 909192 - DNA, 25 bp, Mus musculus
cgaggagagccggttgtctggagac

SEQ ID NO: 909193 - DNA, 25 bp, Mus musculus
cgaggagatcgacggcctgatctca

SEQ ID NO: 909194 - DNA, 25 bp, Mus musculus
cgaggagatcgagggcctgatctca

SEQ ID NO: 909195 - DNA, 25 bp, Mus musculus
cgaggagcagaatacactcggggca

SEQ ID NO: 909196 - DNA, 25 bp, Mus musculus
cgaggagcagtatacactcggggca

SEQ ID NO: 909197 - DNA, 25 bp, Mus musculus
cgaggaggagagcctgcgcctgtcc

SEQ ID NO: 909198 - DNA, 25 bp, Mus musculus
cgaggaggagaggctgcgcctgtcc

SEQ ID NO: 909199 - DNA, 25 bp, Mus musculus
cgaggaggagcacaaaagcaaaaga

SEQ ID NO: 909200 - DNA, 25 bp, Mus musculus
cgaggaggagcagaaaagcaaaaga

SEQ ID NO: 909201 - DNA, 25 bp, Mus musculus
cgaggatcacagaacgtccctagca

SEQ ID NO: 909202 - DNA, 25 bp, Mus musculus
cgaggatcacagaaggtccctagca

SEQ ID NO: 909203 - DNA, 25 bp, Mus musculus
cgaggatgagagcgaggagaagaga

SEQ ID NO: 909204 - DNA, 25 bp, Mus musculus
cgaggatgagagggaggagaagaga

SEQ ID NO: 909205 - DNA, 25 bp, Mus musculus
cgaggcaaatggaacgaaacttcat

SEQ ID NO: 909206 - DNA, 25 bp, Mus musculus
cgaggcaaatggaaggaaacttcat

SEQ ID NO: 909207 - DNA, 25 bp, Mus musculus
cgaggcaacaaaatggagaggggtc

SEQ ID NO: 909208 - DNA, 25 bp, Mus musculus
cgaggcaacaaattggagaggggtc

SEQ ID NO: 909209 - DNA, 25 bp, Mus musculus
cgaggcaataaaatggagagaggtc

SEQ ID NO: 909210 - DNA, 25 bp, Mus musculus
cgaggcaataaattggagagaggtc

SEQ ID NO: 909211 - DNA, 25 bp, Mus musculus
cgaggcactccacattctcctgctc

SEQ ID NO: 909212 - DNA, 25 bp, Mus musculus
cgaggcactccagattctcctgctc

SEQ ID NO: 909213 - DNA, 25 bp, Mus musculus
cgaggcagcctttactgtggcagtg

SEQ ID NO: 909214 - DNA, 25 bp, Mus musculus
cgaggcagcctttagtgtggcagtg

SEQ ID NO: 909215 - DNA, 25 bp, Mus musculus
cgaggcagcttccgcacatatttca

SEQ ID NO: 909216 - DNA, 25 bp, Mus musculus
cgaggcagcttcggcacatatttca

SEQ ID NO: 909217 - DNA, 25 bp, Mus musculus
cgaggccatcagcgctgcatgcaca

SEQ ID NO: 909218 - DNA, 25 bp, Mus musculus
cgaggccatcagggctgcatgcaca

SEQ ID NO: 909219 - DNA, 25 bp, Mus musculus
cgaggcccagctgatgctggcgctg

SEQ ID NO: 909220 - DNA, 25 bp, Mus musculus
cgaggcccaggtgatgctggcgctg

SEQ ID NO: 909221 - DNA, 25 bp, Mus musculus
cgaggccctgctcacaggctctgtt

SEQ ID NO: 909222 - DNA, 25 bp, Mus musculus
cgaggccctggtcacaggctctgtt

SEQ ID NO: 909223 - DNA, 25 bp, Mus musculus
cgaggccgagatctgtcgctttatc

SEQ ID NO: 909224 - DNA, 25 bp, Mus musculus
cgaggccgagcgattatgtgcatga

SEQ ID NO: 909225 - DNA, 25 bp, Mus musculus
cgaggccgagggattatgtgcatga

SEQ ID NO: 909226 - DNA, 25 bp, Mus musculus
cgaggccgagttctgtcgctttatc

SEQ ID NO: 909227 - DNA, 25 bp, Mus musculus
cgaggccgcaatctgtcgctttatc

SEQ ID NO: 909228 - DNA, 25 bp, Mus musculus
cgaggccgcattctgtcgctttatc

SEQ ID NO: 909229 - DNA, 25 bp, Mus musculus
cgaggcctataacattcttgctcac

SEQ ID NO: 909230 - DNA, 25 bp, Mus musculus
cgaggcctataagattcttgctcac

SEQ ID NO: 909231 - DNA, 25 bp, Mus musculus
cgaggccttctggaccacatcttat

SEQ ID NO: 909232 - DNA, 25 bp, Mus musculus
cgaggccttctggagcacatcttat

SEQ ID NO: 909233 - DNA, 25 bp, Mus musculus
cgaggcgcaagcaaagaaacatgct

SEQ ID NO: 909234 - DNA, 25 bp, Mus musculus
cgaggcgcaagcaatgaaacatgct

SEQ ID NO: 909235 - DNA, 25 bp, Mus musculus
cgaggcgccaaggaatttgcgtccg

SEQ ID NO: 909236 - DNA, 25 bp, Mus musculus
cgaggcgccaaggattttgcgtccg

SEQ ID NO: 909237 - DNA, 25 bp, Mus musculus
cgaggcgcgtgacacgcagaggcag

SEQ ID NO: 909238 - DNA, 25 bp, Mus musculus
cgaggcgcgtgacatgcccggaacc

SEQ ID NO: 909239 - DNA, 25 bp, Mus musculus
cgaggcgcgtgagacgcagaggcag

SEQ ID NO: 909240 - DNA, 25 bp, Mus musculus
cgaggcgcgtgagatgcccggaacc

SEQ ID NO: 909241 - DNA, 25 bp, Mus musculus
cgaggctaatgacgaagcattaggg

SEQ ID NO: 909242 - DNA, 25 bp, Mus musculus
cgaggctaatgacgtttctggctcc

SEQ ID NO: 909243 - DNA, 25 bp, Mus musculus
cgaggctaatgaggaagcattaggg

SEQ ID NO: 909244 - DNA, 25 bp, Mus musculus
cgaggctaatgaggtttctggctcc

SEQ ID NO: 909245 - DNA, 25 bp, Mus musculus
cgaggctatctgcggcgctgtccgg

SEQ ID NO: 909246 - DNA, 25 bp, Mus musculus
cgaggctatctggggcgctgtccgg

SEQ ID NO: 909247 - DNA, 25 bp, Mus musculus
cgaggctccaggaacgtggctgacg

SEQ ID NO: 909248 - DNA, 25 bp, Mus musculus
cgaggctccaggaaggtggctgacg

SEQ ID NO: 909249 - DNA, 25 bp, Mus musculus
cgaggcttccagctccagaaatctt

SEQ ID NO: 909250 - DNA, 25 bp, Mus musculus
cgaggcttccaggtccagaaatctt

SEQ ID NO: 909251 - DNA, 25 bp, Mus musculus
cgagggacagtgcaaccccctgtat

SEQ ID NO: 909252 - DNA, 25 bp, Mus musculus
cgagggacagtgcatccccctgtat

SEQ ID NO: 909253 - DNA, 25 bp, Mus musculus
cgagggagagccaatacagagtgct

SEQ ID NO: 909254 - DNA, 25 bp, Mus musculus
cgagggagaggcaatacagagtgct

SEQ ID NO: 909255 - DNA, 25 bp, Mus musculus
cgagggatcacacggattgaagaca

SEQ ID NO: 909256 - DNA, 25 bp, Mus musculus
cgagggatcacagggattgaagaca

SEQ ID NO: 909257 - DNA, 25 bp, Mus musculus
cgagggcccgttcacggctgggctt

SEQ ID NO: 909258 - DNA, 25 bp, Mus musculus
cgagggcccgttcagggctgggctt

SEQ ID NO: 909259 - DNA, 25 bp, Mus musculus
cgagggccttcacgaagatgctacc

SEQ ID NO: 909260 - DNA, 25 bp, Mus musculus
cgagggccttcaggaagatgctacc

SEQ ID NO: 909261 - DNA, 25 bp, Mus musculus
cgagggcgagcctcggctattagcc

SEQ ID NO: 909262 - DNA, 25 bp, Mus musculus
cgagggcgaggctcggctattagcc

SEQ ID NO: 909263 - DNA, 25 bp, Mus musculus
cgagggcggcagacgccagtgctgt

SEQ ID NO: 909264 - DNA, 25 bp, Mus musculus
cgagggcggcagtcgccagtgctgt

SEQ ID NO: 909265 - DNA, 25 bp, Mus musculus
cgagggctgaagaatatacattcgg

SEQ ID NO: 909266 - DNA, 25 bp, Mus musculus
cgagggctgaagtatatacattcgg

SEQ ID NO: 909267 - DNA, 25 bp, Mus musculus
cgaggggacctggacacagccttcc

SEQ ID NO: 909268 - DNA, 25 bp, Mus musculus
cgaggggacctggagacagccttcc

SEQ ID NO: 909269 - DNA, 25 bp, Mus musculus
cgaggggatccccggtgagccaggt

SEQ ID NO: 909270 - DNA, 25 bp, Mus musculus
cgaggggatcccgggtgagccaggt

SEQ ID NO: 909271 - DNA, 25 bp, Mus musculus
cgaggggcccccatcctggcccctg

SEQ ID NO: 909272 - DNA, 25 bp, Mus musculus
cgaggggcccccatgctggcccctg

SEQ ID NO: 909273 - DNA, 25 bp, Mus musculus
cgagggtgagctgtgtgtgaaaggg

SEQ ID NO: 909274 - DNA, 25 bp, Mus musculus
cgagggtgaggtgtgtgtgaaaggg

SEQ ID NO: 909275 - DNA, 25 bp, Mus musculus
cgagggtgatggcagtgagcctgta

SEQ ID NO: 909276 - DNA, 25 bp, Mus musculus
cgagggtgatgggagtgagcctgta

SEQ ID NO: 909277 - DNA, 25 bp, Mus musculus
cgaggtccagatacaggaggtgtgc

SEQ ID NO: 909278 - DNA, 25 bp, Mus musculus
cgaggtccagttacaggaggtgtgc

SEQ ID NO: 909279 - DNA, 25 bp, Mus musculus
cgaggtcgggtgcctgtttgcagac

SEQ ID NO: 909280 - DNA, 25 bp, Mus musculus
cgaggtcgggtggctgtttgcagac

SEQ ID NO: 909281 - DNA, 25 bp, Mus musculus
cgaggtgccaaaccacttagttggt

SEQ ID NO: 909282 - DNA, 25 bp, Mus musculus
cgaggtgccaaagcacttagttggt

SEQ ID NO: 909283 - DNA, 25 bp, Mus musculus
cgagtaaagagaagtttgaagatac

SEQ ID NO: 909284 - DNA, 25 bp, Mus musculus
cgagtaaagagatgtttgaagatac

SEQ ID NO: 909285 - DNA, 25 bp, Mus musculus
cgagtaagtccacatctgatttgta

SEQ ID NO: 909286 - DNA, 25 bp, Mus musculus
cgagtaagtccagatctgatttgta

SEQ ID NO: 909287 - DNA, 25 bp, Mus musculus
cgagtaccagagcccacagacgctt

SEQ ID NO: 909288 - DNA, 25 bp, Mus musculus
cgagtaccagcacctgacgttcctg

SEQ ID NO: 909289 - DNA, 25 bp, Mus musculus
cgagtaccaggacctgacgttcctg

SEQ ID NO: 909290 - DNA, 25 bp, Mus musculus
cgagtaccagtgcccacagacgctt

SEQ ID NO: 909291 - DNA, 25 bp, Mus musculus
cgagtaccgcggcgctgagaaggag

SEQ ID NO: 909292 - DNA, 25 bp, Mus musculus
cgagtaccgcggggctgagaaggag

SEQ ID NO: 909293 - DNA, 25 bp, Mus musculus
cgagtacgcattcggtgaagaaaag

SEQ ID NO: 909294 - DNA, 25 bp, Mus musculus
cgagtacgcattgggtgaagaaaag

SEQ ID NO: 909295 - DNA, 25 bp, Mus musculus
cgagtagaagatgaaagtctggata

SEQ ID NO: 909296 - DNA, 25 bp, Mus musculus
cgagtagaagttgaaagtctggata

SEQ ID NO: 909297 - DNA, 25 bp, Mus musculus
cgagtagaggagctggaggatgcaa

SEQ ID NO: 909298 - DNA, 25 bp, Mus musculus
cgagtagaggaggtggaggatgcaa

SEQ ID NO: 909299 - DNA, 25 bp, Mus musculus
cgagtagcagcaataaacacgtttg

SEQ ID NO: 909300 - DNA, 25 bp, Mus musculus
cgagtagcaggaataaacacgtttg

SEQ ID NO: 909301 - DNA, 25 bp, Mus musculus
cgagtagggcagccaatggcatcca

SEQ ID NO: 909302 - DNA, 25 bp, Mus musculus
cgagtagggcaggcaatggcatcca

SEQ ID NO: 909303 - DNA, 25 bp, Mus musculus
cgagtcaaccagaccgtggatttct

SEQ ID NO: 909304 - DNA, 25 bp, Mus musculus
cgagtcaaccagacggtggatttct

SEQ ID NO: 909305 - DNA, 25 bp, Mus musculus
cgagtcacagcgggtgacatggcag

SEQ ID NO: 909306 - DNA, 25 bp, Mus musculus
cgagtcacagggggtgacatggcag

SEQ ID NO: 909307 - DNA, 25 bp, Mus musculus
cgagtcaccgattgccatctctgga

SEQ ID NO: 909308 - DNA, 25 bp, Mus musculus
cgagtcaccgtttgccatctctgga

SEQ ID NO: 909309 - DNA, 25 bp, Mus musculus
cgagtcagcgcactgatcgagtccc

SEQ ID NO: 909310 - DNA, 25 bp, Mus musculus
cgagtcagcggactgatcgagtccc

SEQ ID NO: 909311 - DNA, 25 bp, Mus musculus
cgagtcctcgcccagtgacttctcc

SEQ ID NO: 909312 - DNA, 25 bp, Mus musculus
cgagtcctcggccagtgacttctcc

SEQ ID NO: 909313 - DNA, 25 bp, Mus musculus
cgagtccttatgacacgtccccatc

SEQ ID NO: 909314 - DNA, 25 bp, Mus musculus
cgagtccttatgtcacgtccccatc

SEQ ID NO: 909315 - DNA, 25 bp, Mus musculus
cgagtcgccggacgacacagagctg

SEQ ID NO: 909316 - DNA, 25 bp, Mus musculus
cgagtcgccggaggacacagagctg

SEQ ID NO: 909317 - DNA, 25 bp, Mus musculus
cgagtcttacagcacattcgctcag

SEQ ID NO: 909318 - DNA, 25 bp, Mus musculus
cgagtcttacagcagattcgctcag

SEQ ID NO: 909319 - DNA, 25 bp, Mus musculus
cgagtcttcgggcccctctgtcctg

SEQ ID NO: 909320 - DNA, 25 bp, Mus musculus
cgagtcttcggggccctctgtcctg

SEQ ID NO: 909321 - DNA, 25 bp, Mus musculus
cgagtgaatcagcccatctggctgc

SEQ ID NO: 909322 - DNA, 25 bp, Mus musculus
cgagtgaatcaggccatctggctgc

SEQ ID NO: 909323 - DNA, 25 bp, Mus musculus
cgagtgacagctggtcaagatgcag

SEQ ID NO: 909324 - DNA, 25 bp, Mus musculus
cgagtgacaggtggtcaagatgcag

SEQ ID NO: 909325 - DNA, 25 bp, Mus musculus
cgagtgaccgcaatctgtgggctcc

SEQ ID NO: 909326 - DNA, 25 bp, Mus musculus
cgagtgaccggaatctgtgggctcc

SEQ ID NO: 909327 - DNA, 25 bp, Mus musculus
cgagtgcaggcacaccccagcctgg

SEQ ID NO: 909328 - DNA, 25 bp, Mus musculus
cgagtgcagggacaccccagcctgg

SEQ ID NO: 909329 - DNA, 25 bp, Mus musculus
cgagtgcagtggccctggaccatag

SEQ ID NO: 909330 - DNA, 25 bp, Mus musculus
cgagtgcagtgggcctggaccatag

SEQ ID NO: 909331 - DNA, 25 bp, Mus musculus
cgagtgcctgcacgatcggaacgtc

SEQ ID NO: 909332 - DNA, 25 bp, Mus musculus
cgagtgcctgcaggatcggaacgtc

SEQ ID NO: 909333 - DNA, 25 bp, Mus musculus
cgagtgcgagattaagtacacgggc

SEQ ID NO: 909334 - DNA, 25 bp, Mus musculus
cgagtgcgagcgcgttgctgttctg

SEQ ID NO: 909335 - DNA, 25 bp, Mus musculus
cgagtgcgagcgggttgctgttctg

SEQ ID NO: 909336 - DNA, 25 bp, Mus musculus
cgagtgcgagtttaagtacacgggc

SEQ ID NO: 909337 - DNA, 25 bp, Mus musculus
cgagtgcttgctgccccagccatct

SEQ ID NO: 909338 - DNA, 25 bp, Mus musculus
cgagtgcttggtgccccagccatct

SEQ ID NO: 909339 - DNA, 25 bp, Mus musculus
cgagtggaagattgagaagtccaaa

SEQ ID NO: 909340 - DNA, 25 bp, Mus musculus
cgagtggaagtttgagaagtccaaa

SEQ ID NO: 909341 - DNA, 25 bp, Mus musculus
cgagtggcacagcacgcccgggcga

SEQ ID NO: 909342 - DNA, 25 bp, Mus musculus
cgagtggcacaggacgcccgggcga

SEQ ID NO: 909343 - DNA, 25 bp, Mus musculus
cgagtggcagagttgcacagcaaat

SEQ ID NO: 909344 - DNA, 25 bp, Mus musculus
cgagtggcagtgttgcacagcaaat

SEQ ID NO: 909345 - DNA, 25 bp, Mus musculus
cgagtgtagtagctctgttcctgcg

SEQ ID NO: 909346 - DNA, 25 bp, Mus musculus
cgagtgtagtaggtctgttcctgcg

SEQ ID NO: 909347 - DNA, 25 bp, Mus musculus
cgagtgtttgacaacgatgggaatg

SEQ ID NO: 909348 - DNA, 25 bp, Mus musculus
cgagtgtttgacaaggatgggaatg

SEQ ID NO: 909349 - DNA, 25 bp, Mus musculus
cgagtgtttggacgctgtgccggac

SEQ ID NO: 909350 - DNA, 25 bp, Mus musculus
cgagtgtttggacggtgtgccggac

SEQ ID NO: 909351 - DNA, 25 bp, Mus musculus
cgagttacagcagggaatcttgact

SEQ ID NO: 909352 - DNA, 25 bp, Mus musculus
cgagttacaggagggaatcttgact

SEQ ID NO: 909353 - DNA, 25 bp, Mus musculus
cgagttcaaccacgtggtgatcttt

SEQ ID NO: 909354 - DNA, 25 bp, Mus musculus
cgagttcaaccaggtggtgatcttt

SEQ ID NO: 909355 - DNA, 25 bp, Mus musculus
cgagttcatgaacgaagcgggtgca

SEQ ID NO: 909356 - DNA, 25 bp, Mus musculus
cgagttcatgaacgaggatttcgat

SEQ ID NO: 909357 - DNA, 25 bp, Mus musculus
cgagttcatgaaggaagcgggtgca

SEQ ID NO: 909358 - DNA, 25 bp, Mus musculus
cgagttcatgaaggaggatttcgat

SEQ ID NO: 909359 - DNA, 25 bp, Mus musculus
cgagttccagagcgatctaaagagt

SEQ ID NO: 909360 - DNA, 25 bp, Mus musculus
cgagttccagagggatctaaagagt

SEQ ID NO: 909361 - DNA, 25 bp, Mus musculus
cgagttctgggaccgcaatgtgctc

SEQ ID NO: 909362 - DNA, 25 bp, Mus musculus
cgagttctgggagcgcaatgtgctc

SEQ ID NO: 909363 - DNA, 25 bp, Mus musculus
cgagtttcatagcctggagattcag

SEQ ID NO: 909364 - DNA, 25 bp, Mus musculus
cgagtttcataggctggagattcag

SEQ ID NO: 909365 - DNA, 25 bp, Mus musculus
cgagtttgaaattcctatcacatat

SEQ ID NO: 909366 - DNA, 25 bp, Mus musculus
cgagtttgaatttcctatcacatat

SEQ ID NO: 909367 - DNA, 25 bp, Mus musculus
cgagtttgagaacgtatgcagcaat

SEQ ID NO: 909368 - DNA, 25 bp, Mus musculus
cgagtttgagaaggtatgcagcaat

SEQ ID NO: 909369 - DNA, 25 bp, Mus musculus
cgagtttgagttagaggtgactggg

SEQ ID NO: 909370 - DNA, 25 bp, Mus musculus
cgagtttgagtttgaggtgactggg

SEQ ID NO: 909371 - DNA, 25 bp, Mus musculus
cgagtttgcattccccttgcttccc

SEQ ID NO: 909372 - DNA, 25 bp, Mus musculus
cgagtttgcattccgcttgcttccc

SEQ ID NO: 909373 - DNA, 25 bp, Mus musculus
cgagttttctgccacattcaagaac

SEQ ID NO: 909374 - DNA, 25 bp, Mus musculus
cgagttttctgccagattcaagaac

SEQ ID NO: 909375 - DNA, 25 bp, Mus musculus
cgataaagggtcagaaaacgcttgg

SEQ ID NO: 909376 - DNA, 25 bp, Mus musculus
cgataaagggtctgaaaacgcttgg

SEQ ID NO: 909377 - DNA, 25 bp, Mus musculus
cgataaccggctctggtacatggat

SEQ ID NO: 909378 - DNA, 25 bp, Mus musculus
cgataaccgggtctggtacatggat

SEQ ID NO: 909379 - DNA, 25 bp, Mus musculus
cgataggcagagcagctccatcagc

SEQ ID NO: 909380 - DNA, 25 bp, Mus musculus
cgataggcagagctcagtaccatga

SEQ ID NO: 909381 - DNA, 25 bp, Mus musculus
cgataggcagaggagctccatcagc

SEQ ID NO: 909382 - DNA, 25 bp, Mus musculus
cgataggcagaggtcagtaccatga

SEQ ID NO: 909383 - DNA, 25 bp, Mus musculus
cgataggtacagatctgacacaaca

SEQ ID NO: 909384 - DNA, 25 bp, Mus musculus
cgataggtacagttctgacacaaca

SEQ ID NO: 909385 - DNA, 25 bp, Mus musculus
cgataggtctcccacgtgacccagg

SEQ ID NO: 909386 - DNA, 25 bp, Mus musculus
cgataggtctcccaggtgacccagg

SEQ ID NO: 909387 - DNA, 25 bp, Mus musculus
cgatagttactgcaccgagaagagt

SEQ ID NO: 909388 - DNA, 25 bp, Mus musculus
cgatagttactgcagcgagaagagt

SEQ ID NO: 909389 - DNA, 25 bp, Mus musculus
cgatatcaaaccagcatttggcacc

SEQ ID NO: 909390 - DNA, 25 bp, Mus musculus
cgatatcaaacctgcatttggcacc

SEQ ID NO: 909391 - DNA, 25 bp, Mus musculus
cgatatcgtgaacgttatcaagaaa

SEQ ID NO: 909392 - DNA, 25 bp, Mus musculus
cgatatcgtgaaggttatcaagaaa

SEQ ID NO: 909393 - DNA, 25 bp, Mus musculus
cgatatctgaagcgcgagaatcctt

SEQ ID NO: 909394 - DNA, 25 bp, Mus musculus
cgatatctgaagggcgagaatcctt

SEQ ID NO: 909395 - DNA, 25 bp, Mus musculus
cgatatgacttccaaataagtttct

SEQ ID NO: 909396 - DNA, 25 bp, Mus musculus
cgatatgacttccatataagtttct

SEQ ID NO: 909397 - DNA, 25 bp, Mus musculus
cgatcaagaccacgccctggctttg

SEQ ID NO: 909398 - DNA, 25 bp, Mus musculus
cgatcaagaccaggccctggctttg

SEQ ID NO: 909399 - DNA, 25 bp, Mus musculus
cgatcaatacagctatactcgaaat

SEQ ID NO: 909400 - DNA, 25 bp, Mus musculus
cgatcaatacaggtatactcgaaat

SEQ ID NO: 909401 - DNA, 25 bp, Mus musculus
cgatccacagagatccagaagcccc

SEQ ID NO: 909402 - DNA, 25 bp, Mus musculus
cgatccacagagttccagaagcccc

SEQ ID NO: 909403 - DNA, 25 bp, Mus musculus
cgatccacaggcaacgttgtctact

SEQ ID NO: 909404 - DNA, 25 bp, Mus musculus
cgatccacaggcaaggttgtctact

SEQ ID NO: 909405 - DNA, 25 bp, Mus musculus
cgatccaccacactgcgcctgctgt

SEQ ID NO: 909406 - DNA, 25 bp, Mus musculus
cgatccaccacagtgcgcctgctgt

SEQ ID NO: 909407 - DNA, 25 bp, Mus musculus
cgatccacgtcagcattcctccgag

SEQ ID NO: 909408 - DNA, 25 bp, Mus musculus
cgatccacgtgagcattcctccgag

SEQ ID NO: 909409 - DNA, 25 bp, Mus musculus
cgatccagcacacaaggcagggagt

SEQ ID NO: 909410 - DNA, 25 bp, Mus musculus
cgatccagcacacgcagggagtgtg

SEQ ID NO: 909411 - DNA, 25 bp, Mus musculus
cgatccagcacagaaggcagggagt

SEQ ID NO: 909412 - DNA, 25 bp, Mus musculus
cgatccagcacaggcagggagtgtg

SEQ ID NO: 909413 - DNA, 25 bp, Mus musculus
cgatcccactgtaccagatggaggc

SEQ ID NO: 909414 - DNA, 25 bp, Mus musculus
cgatcccactgtacgagatggaggc

SEQ ID NO: 909415 - DNA, 25 bp, Mus musculus
cgatccctcaagctctgcctacttc

SEQ ID NO: 909416 - DNA, 25 bp, Mus musculus
cgatccctcaaggtctgcctacttc

SEQ ID NO: 909417 - DNA, 25 bp, Mus musculus
cgatccgcccaacagctcaaagccc

SEQ ID NO: 909418 - DNA, 25 bp, Mus musculus
cgatccgcccaagagctcaaagccc

SEQ ID NO: 909419 - DNA, 25 bp, Mus musculus
cgatccgtgacacactcaaactaga

SEQ ID NO: 909420 - DNA, 25 bp, Mus musculus
cgatccgtgacacgccctttgaacg

SEQ ID NO: 909421 - DNA, 25 bp, Mus musculus
cgatccgtgacagactcaaactaga

SEQ ID NO: 909422 - DNA, 25 bp, Mus musculus
cgatccgtgacaggccctttgaacg

SEQ ID NO: 909423 - DNA, 25 bp, Mus musculus
cgatcgtgtgcgcgcatttcaggga

SEQ ID NO: 909424 - DNA, 25 bp, Mus musculus
cgatcgtgtgcgggcatttcaggga

SEQ ID NO: 909425 - DNA, 25 bp, Mus musculus
cgatctctgccacctttgtttacta

SEQ ID NO: 909426 - DNA, 25 bp, Mus musculus
cgatctctgccagctttgtttacta

SEQ ID NO: 909427 - DNA, 25 bp, Mus musculus
cgatctgcgccccgcgctccagcat

SEQ ID NO: 909428 - DNA, 25 bp, Mus musculus
cgatctgcgccccgggctccagcat

SEQ ID NO: 909429 - DNA, 25 bp, Mus musculus
cgatgaaatcaacgaacaagcaatg

SEQ ID NO: 909430 - DNA, 25 bp, Mus musculus
cgatgaaatcaacgtaactatggat

SEQ ID NO: 909431 - DNA, 25 bp, Mus musculus
cgatgaaatcaaggaacaagcaatg

SEQ ID NO: 909432 - DNA, 25 bp, Mus musculus
cgatgaaatcaaggtaactatggat

SEQ ID NO: 909433 - DNA, 25 bp, Mus musculus
cgatgaaatgccctttggttgtatc

SEQ ID NO: 909434 - DNA, 25 bp, Mus musculus
cgatgaaatgccgtttggttgtatc

SEQ ID NO: 909435 - DNA, 25 bp, Mus musculus
cgatgaatggctgtatgcccagctg

SEQ ID NO: 909436 - DNA, 25 bp, Mus musculus
cgatgaatgggtgtatgcccagctg

SEQ ID NO: 909437 - DNA, 25 bp, Mus musculus
cgatgacaggcacaactgtccattc

SEQ ID NO: 909438 - DNA, 25 bp, Mus musculus
cgatgacagggacaactgtccattc

SEQ ID NO: 909439 - DNA, 25 bp, Mus musculus
cgatgagccaagccatagagatctc

SEQ ID NO: 909440 - DNA, 25 bp, Mus musculus
cgatgagccaaggcatagagatctc

SEQ ID NO: 909441 - DNA, 25 bp, Mus musculus
cgatgaggaccacgtggtagttaat

SEQ ID NO: 909442 - DNA, 25 bp, Mus musculus
cgatgaggaccaggtggtagttaat

SEQ ID NO: 909443 - DNA, 25 bp, Mus musculus
cgatgatggcatggcgtatggcgac

SEQ ID NO: 909444 - DNA, 25 bp, Mus musculus
cgatgatggcatggggtatggcgac

SEQ ID NO: 909445 - DNA, 25 bp, Mus musculus
cgatgcacagcccatagaagccaac

SEQ ID NO: 909446 - DNA, 25 bp, Mus musculus
cgatgcacaggccatagaagccaac

SEQ ID NO: 909447 - DNA, 25 bp, Mus musculus
cgatgcattgaacgatgtggatacg

SEQ ID NO: 909448 - DNA, 25 bp, Mus musculus
cgatgcattgaaggatgtggatacg

SEQ ID NO: 909449 - DNA, 25 bp, Mus musculus
cgatgccctgaacgttctcctcagc

SEQ ID NO: 909450 - DNA, 25 bp, Mus musculus
cgatgccctgaaggttctcctcagc

SEQ ID NO: 909451 - DNA, 25 bp, Mus musculus
cgatgccgtgatcacgctgatggta

SEQ ID NO: 909452 - DNA, 25 bp, Mus musculus
cgatgccgtgatcaggctgatggta

SEQ ID NO: 909453 - DNA, 25 bp, Mus musculus
cgatgcctgccacggggactcaggt

SEQ ID NO: 909454 - DNA, 25 bp, Mus musculus
cgatgcctgccacggtgactccggg

SEQ ID NO: 909455 - DNA, 25 bp, Mus musculus
cgatgcctgccagggggactcaggt

SEQ ID NO: 909456 - DNA, 25 bp, Mus musculus
cgatgcctgccagggtgactccggg

SEQ ID NO: 909457 - DNA, 25 bp, Mus musculus
cgatgctagcagagcggcggcggaa

SEQ ID NO: 909458 - DNA, 25 bp, Mus musculus
cgatgctagcagaggcggcggaagc

SEQ ID NO: 909459 - DNA, 25 bp, Mus musculus
cgatgctagcagaggggcggcggaa

SEQ ID NO: 909460 - DNA, 25 bp, Mus musculus
cgatgctagcagtggcggcggaagc

SEQ ID NO: 909461 - DNA, 25 bp, Mus musculus
cgatgctatgccactgggaaatcat

SEQ ID NO: 909462 - DNA, 25 bp, Mus musculus
cgatgctatggcactgggaaatcat

SEQ ID NO: 909463 - DNA, 25 bp, Mus musculus
cgatggctgaggaccctcctgtgtc

SEQ ID NO: 909464 - DNA, 25 bp, Mus musculus
cgatggctgaggacgctcctgtgtc

SEQ ID NO: 909465 - DNA, 25 bp, Mus musculus
cgatgggagtcggagccgaggggag

SEQ ID NO: 909466 - DNA, 25 bp, Mus musculus
cgatgggagtgggagccgaggggag

SEQ ID NO: 909467 - DNA, 25 bp, Mus musculus
cgatgggccaagagtaaccagctct

SEQ ID NO: 909468 - DNA, 25 bp, Mus musculus
cgatgggccaagtgtaaccagctct

SEQ ID NO: 909469 - DNA, 25 bp, Mus musculus
cgatgggctgcatgaagtgtcctct

SEQ ID NO: 909470 - DNA, 25 bp, Mus musculus
cgatgggctggatgaagtgtcctct

SEQ ID NO: 909471 - DNA, 25 bp, Mus musculus
cgatggtagccgcaagctgtgctga

SEQ ID NO: 909472 - DNA, 25 bp, Mus musculus
cgatggtagccgctgccgtgactta

SEQ ID NO: 909473 - DNA, 25 bp, Mus musculus
cgatggtagccggaagctgtgctga

SEQ ID NO: 909474 - DNA, 25 bp, Mus musculus
cgatggtagccggtgccgtgactta

SEQ ID NO: 909475 - DNA, 25 bp, Mus musculus
cgatggtgtaagctggatgatgact

SEQ ID NO: 909476 - DNA, 25 bp, Mus musculus
cgatggtgtaaggtggatgatgact

SEQ ID NO: 909477 - DNA, 25 bp, Mus musculus
cgatgtactgactcttttggaaaag

SEQ ID NO: 909478 - DNA, 25 bp, Mus musculus
cgatgtactgtctcttttggaaaag

SEQ ID NO: 909479 - DNA, 25 bp, Mus musculus
cgatgtccccaagacgtacttttct

SEQ ID NO: 909480 - DNA, 25 bp, Mus musculus
cgatgtccccaagaggtacttttct

SEQ ID NO: 909481 - DNA, 25 bp, Mus musculus
cgatgtcgccagcgcccctccagca

SEQ ID NO: 909482 - DNA, 25 bp, Mus musculus
cgatgtcgccagggcccctccagca

SEQ ID NO: 909483 - DNA, 25 bp, Mus musculus
cgatgtgaagagttgttggatgaaa

SEQ ID NO: 909484 - DNA, 25 bp, Mus musculus
cgatgtgaagtgttgttggatgaaa

SEQ ID NO: 909485 - DNA, 25 bp, Mus musculus
cgatgtgctgcagctgttggacaaa

SEQ ID NO: 909486 - DNA, 25 bp, Mus musculus
cgatgtgctgctgttggacaaatat

SEQ ID NO: 909487 - DNA, 25 bp, Mus musculus
cgatgtgctggagctgttggacaaa

SEQ ID NO: 909488 - DNA, 25 bp, Mus musculus
cgatgtgctggtgttggacaaatat

SEQ ID NO: 909489 - DNA, 25 bp, Mus musculus
cgatgtgtctcacgtgatccgcaac

SEQ ID NO: 909490 - DNA, 25 bp, Mus musculus
cgatgtgtctcaggtgatccgcaac

SEQ ID NO: 909491 - DNA, 25 bp, Mus musculus
cgatgtgtggaaattctctgcacac

SEQ ID NO: 909492 - DNA, 25 bp, Mus musculus
cgatgtgtggtaattctctgcacac

SEQ ID NO: 909493 - DNA, 25 bp, Mus musculus
cgatgttccactcgctctttgccat

SEQ ID NO: 909494 - DNA, 25 bp, Mus musculus
cgatgttccactcggatcaagtttg

SEQ ID NO: 909495 - DNA, 25 bp, Mus musculus
cgatgttccactggctctttgccat

SEQ ID NO: 909496 - DNA, 25 bp, Mus musculus
cgatgttccactgggatcaagtttg

SEQ ID NO: 909497 - DNA, 25 bp, Mus musculus
cgattacaagcatgtgcagaacttg

SEQ ID NO: 909498 - DNA, 25 bp, Mus musculus
cgattacaaggatgtgcagaacttg

SEQ ID NO: 909499 - DNA, 25 bp, Mus musculus
cgattacttgctgtcccttactcga

SEQ ID NO: 909500 - DNA, 25 bp, Mus musculus
cgattacttggtgtcccttactcga

SEQ ID NO: 909501 - DNA, 25 bp, Mus musculus
cgattatcagaatccctctgcgcaa

SEQ ID NO: 909502 - DNA, 25 bp, Mus musculus
cgattatcagagtccagtagaggaa

SEQ ID NO: 909503 - DNA, 25 bp, Mus musculus
cgattatcagcctttgaaccagtat

SEQ ID NO: 909504 - DNA, 25 bp, Mus musculus
cgattatcaggctttgaaccagtat

SEQ ID NO: 909505 - DNA, 25 bp, Mus musculus
cgattatcagtatccctctgcgcaa

SEQ ID NO: 909506 - DNA, 25 bp, Mus musculus
cgattatcagtgtccagtagaggaa

SEQ ID NO: 909507 - DNA, 25 bp, Mus musculus
cgattcaaccacaatgacggattcc

SEQ ID NO: 909508 - DNA, 25 bp, Mus musculus
cgattcaaccactatgacggattcc

SEQ ID NO: 909509 - DNA, 25 bp, Mus musculus
cgattcaagcatcgtggaagggact

SEQ ID NO: 909510 - DNA, 25 bp, Mus musculus
cgattcaagcatggtggaagggact

SEQ ID NO: 909511 - DNA, 25 bp, Mus musculus
cgattcagcagtgtcttgtgggagg

SEQ ID NO: 909512 - DNA, 25 bp, Mus musculus
cgattcagcagtgtgttgtgggagg

SEQ ID NO: 909513 - DNA, 25 bp, Mus musculus
cgattccagcagcctggttttaacc

SEQ ID NO: 909514 - DNA, 25 bp, Mus musculus
cgattccagcaggctggttttaacc

SEQ ID NO: 909515 - DNA, 25 bp, Mus musculus
cgattctccacagtcgctggagagt

SEQ ID NO: 909516 - DNA, 25 bp, Mus musculus
cgattctccacagtggctggagagt

SEQ ID NO: 909517 - DNA, 25 bp, Mus musculus
cgattctgagccactcctccacact

SEQ ID NO: 909518 - DNA, 25 bp, Mus musculus
cgattctgaggcactcctccacact

SEQ ID NO: 909519 - DNA, 25 bp, Mus musculus
cgattgctgctgcaccctgtgcaca

SEQ ID NO: 909520 - DNA, 25 bp, Mus musculus
cgattgctgctgcagcctgtgcaca

SEQ ID NO: 909521 - DNA, 25 bp, Mus musculus
cgattggaatgacccagagtgggac

SEQ ID NO: 909522 - DNA, 25 bp, Mus musculus
cgattggaatgaccgagagtgggac

SEQ ID NO: 909523 - DNA, 25 bp, Mus musculus
cgatttaaagcttgtgccccagcag

SEQ ID NO: 909524 - DNA, 25 bp, Mus musculus
cgatttaaaggttgtgccccagcag

SEQ ID NO: 909525 - DNA, 25 bp, Mus musculus
cgatttctggctagtgaggaatctc

SEQ ID NO: 909526 - DNA, 25 bp, Mus musculus
cgatttctgggtagtgaggaatctc

SEQ ID NO: 909527 - DNA, 25 bp, Mus musculus
cgatttgaaaagaatgggatcaaac

SEQ ID NO: 909528 - DNA, 25 bp, Mus musculus
cgatttgaaaagtatgggatcaaac

SEQ ID NO: 909529 - DNA, 25 bp, Mus musculus
cgatttgggcaccatgtataccagg

SEQ ID NO: 909530 - DNA, 25 bp, Mus musculus
cgatttgggcaccgactgtcagggc

SEQ ID NO: 909531 - DNA, 25 bp, Mus musculus
cgatttgggcacgatgtataccagg

SEQ ID NO: 909532 - DNA, 25 bp, Mus musculus
cgatttgggcacggactgtcagggc

SEQ ID NO: 909533 - DNA, 25 bp, Mus musculus
cgcaaacggcagcaggaggaagagg

SEQ ID NO: 909534 - DNA, 25 bp, Mus musculus
cgcaaacggcaggaggaggaagagg

SEQ ID NO: 909535 - DNA, 25 bp, Mus musculus
cgcaaagaagatccaccaggtgaga

SEQ ID NO: 909536 - DNA, 25 bp, Mus musculus
cgcaaagaagttccaccaggtgaga

SEQ ID NO: 909537 - DNA, 25 bp, Mus musculus
cgcaaattacctccacagcaaagga

SEQ ID NO: 909538 - DNA, 25 bp, Mus musculus
cgcaaattacgtccacagcaaagga

SEQ ID NO: 909539 - DNA, 25 bp, Mus musculus
cgcaaattggaccacgtctctcagt

SEQ ID NO: 909540 - DNA, 25 bp, Mus musculus
cgcaaattggaccaggtctctcagt

SEQ ID NO: 909541 - DNA, 25 bp, Mus musculus
cgcaacagggcaaaacactgtcttt

SEQ ID NO: 909542 - DNA, 25 bp, Mus musculus
cgcaacaggggaaaacactgtcttt

SEQ ID NO: 909543 - DNA, 25 bp, Mus musculus
cgcaacagtaagaagatgcagagct

SEQ ID NO: 909544 - DNA, 25 bp, Mus musculus
cgcaacagtaagtagatgcagagct

SEQ ID NO: 909545 - DNA, 25 bp, Mus musculus
cgcaacgaccagctggtcacggacc

SEQ ID NO: 909546 - DNA, 25 bp, Mus musculus
cgcaacgaccaggtggtcacggacc

SEQ ID NO: 909547 - DNA, 25 bp, Mus musculus
cgcaacgtcctgacaatgcagacct

SEQ ID NO: 909548 - DNA, 25 bp, Mus musculus
cgcaacgtcctgactatgcagacct

SEQ ID NO: 909549 - DNA, 25 bp, Mus musculus
cgcaactcagatggctccagatgct

SEQ ID NO: 909550 - DNA, 25 bp, Mus musculus
cgcaactcagcctgactcccctata

SEQ ID NO: 909551 - DNA, 25 bp, Mus musculus
cgcaactcaggctgactcccctata

SEQ ID NO: 909552 - DNA, 25 bp, Mus musculus
cgcaactcagttggctccagatgct

SEQ ID NO: 909553 - DNA, 25 bp, Mus musculus
cgcaagacacctagagactagcaca

SEQ ID NO: 909554 - DNA, 25 bp, Mus musculus
cgcaagacaccttgagactagcaca

SEQ ID NO: 909555 - DNA, 25 bp, Mus musculus
cgcaagcaaacaaacatgctctgaa

SEQ ID NO: 909556 - DNA, 25 bp, Mus musculus
cgcaagcaaagaaacatgctctgaa

SEQ ID NO: 909557 - DNA, 25 bp, Mus musculus
cgcaagctggtaacagtgcacaggt

SEQ ID NO: 909558 - DNA, 25 bp, Mus musculus
cgcaagctggtatcagtgcacaggt

SEQ ID NO: 909559 - DNA, 25 bp, Mus musculus
cgcaaggaagcagacatgcccggaa

SEQ ID NO: 909560 - DNA, 25 bp, Mus musculus
cgcaaggaagcagagatgcccggaa

SEQ ID NO: 909561 - DNA, 25 bp, Mus musculus
cgcaaggagatgatgtctgtaggtg

SEQ ID NO: 909562 - DNA, 25 bp, Mus musculus
cgcaaggagatgctggggctgcgac

SEQ ID NO: 909563 - DNA, 25 bp, Mus musculus
cgcaaggagatgctgtggggcctgt

SEQ ID NO: 909564 - DNA, 25 bp, Mus musculus
cgcaaggagatggtggggctgcgac

SEQ ID NO: 909565 - DNA, 25 bp, Mus musculus
cgcaaggagatggtgtggggcctgt

SEQ ID NO: 909566 - DNA, 25 bp, Mus musculus
cgcaaggagatgttgtctgtaggtg

SEQ ID NO: 909567 - DNA, 25 bp, Mus musculus
cgcaaggaggccgtgcagcgaggcc

SEQ ID NO: 909568 - DNA, 25 bp, Mus musculus
cgcaaggagggcgtgcagcgaggcc

SEQ ID NO: 909569 - DNA, 25 bp, Mus musculus
cgcaaggcccagcattttcactggc

SEQ ID NO: 909570 - DNA, 25 bp, Mus musculus
cgcaaggcccaggattttcactggc

SEQ ID NO: 909571 - DNA, 25 bp, Mus musculus
cgcaagggccagctggcaaagatgt

SEQ ID NO: 909572 - DNA, 25 bp, Mus musculus
cgcaagggccaggtggcaaagatgt

SEQ ID NO: 909573 - DNA, 25 bp, Mus musculus
cgcaaggttattggcattgagtgtt

SEQ ID NO: 909574 - DNA, 25 bp, Mus musculus
cgcaaggttattgggattgagtgtt

SEQ ID NO: 909575 - DNA, 25 bp, Mus musculus
cgcaagttcacacatgtgaccttga

SEQ ID NO: 909576 - DNA, 25 bp, Mus musculus
cgcaagttcacagatgtgaccttga

SEQ ID NO: 909577 - DNA, 25 bp, Mus musculus
cgcaagtttgcggaggcgatcggag

SEQ ID NO: 909578 - DNA, 25 bp, Mus musculus
cgcaagtttggggaggcgatcggag

SEQ ID NO: 909579 - DNA, 25 bp, Mus musculus
cgcaatgacaagctgttctttgcct

SEQ ID NO: 909580 - DNA, 25 bp, Mus musculus
cgcaatgacaaggtgttctttgcct

SEQ ID NO: 909581 - DNA, 25 bp, Mus musculus
cgcaattcagacaggatggctaaag

SEQ ID NO: 909582 - DNA, 25 bp, Mus musculus
cgcaattcagtcaggatggctaaag

SEQ ID NO: 909583 - DNA, 25 bp, Mus musculus
cgcacaagccacaatttacacccac

SEQ ID NO: 909584 - DNA, 25 bp, Mus musculus
cgcacaagccactatttacacccac

SEQ ID NO: 909585 - DNA, 25 bp, Mus musculus
cgcacagaagcctctctggatgccc

SEQ ID NO: 909586 - DNA, 25 bp, Mus musculus
cgcacagaagcgatacctggaggag

SEQ ID NO: 909587 - DNA, 25 bp, Mus musculus
cgcacagaaggctctctggatgccc

SEQ ID NO: 909588 - DNA, 25 bp, Mus musculus
cgcacagaagggatacctggaggag

SEQ ID NO: 909589 - DNA, 25 bp, Mus musculus
cgcacagagaagctggggactctag

SEQ ID NO: 909590 - DNA, 25 bp, Mus musculus
cgcacagagaaggtggggactctag

SEQ ID NO: 909591 - DNA, 25 bp, Mus musculus
cgcacaggctcacccgtggaagctc

SEQ ID NO: 909592 - DNA, 25 bp, Mus musculus
cgcacaggctcagccgtggaagctc

SEQ ID NO: 909593 - DNA, 25 bp, Mus musculus
cgcaccaaagctgtgactttgaggt

SEQ ID NO: 909594 - DNA, 25 bp, Mus musculus
cgcaccaaaggtgtgactttgaggt

SEQ ID NO: 909595 - DNA, 25 bp, Mus musculus
cgcaccagagcaacttctgcaggtg

SEQ ID NO: 909596 - DNA, 25 bp, Mus musculus
cgcaccagaggaacttctgcaggtg

SEQ ID NO: 909597 - DNA, 25 bp, Mus musculus
cgcacccaagattggacaagcacaa

SEQ ID NO: 909598 - DNA, 25 bp, Mus musculus
cgcacccaagccagtttggacaagc

SEQ ID NO: 909599 - DNA, 25 bp, Mus musculus
cgcacccaaggcagtttggacaagc

SEQ ID NO: 909600 - DNA, 25 bp, Mus musculus
cgcacccaagtttggacaagcacaa

SEQ ID NO: 909601 - DNA, 25 bp, Mus musculus
cgcacccacactcgactgcagaagg

SEQ ID NO: 909602 - DNA, 25 bp, Mus musculus
cgcacccacactcgtgagaagccat

SEQ ID NO: 909603 - DNA, 25 bp, Mus musculus
cgcacccacactggactgcagaagg

SEQ ID NO: 909604 - DNA, 25 bp, Mus musculus
cgcacccacactggtgagaagccat

SEQ ID NO: 909605 - DNA, 25 bp, Mus musculus
cgcacccgccgctccccggccctgc

SEQ ID NO: 909606 - DNA, 25 bp, Mus musculus
cgcacccgccgctccgttacctgcc

SEQ ID NO: 909607 - DNA, 25 bp, Mus musculus
cgcacccgccgctcgccggccctgc

SEQ ID NO: 909608 - DNA, 25 bp, Mus musculus
cgcacccgccgctcggttacctgcc

SEQ ID NO: 909609 - DNA, 25 bp, Mus musculus
cgcacccttcagaacaagcccacca

SEQ ID NO: 909610 - DNA, 25 bp, Mus musculus
cgcacccttcagtacaagcccacca

SEQ ID NO: 909611 - DNA, 25 bp, Mus musculus
cgcacctccaggacctgtctcccac

SEQ ID NO: 909612 - DNA, 25 bp, Mus musculus
cgcacctccaggacctttctaagct

SEQ ID NO: 909613 - DNA, 25 bp, Mus musculus
cgcacctccaggacgtgtctcccac

SEQ ID NO: 909614 - DNA, 25 bp, Mus musculus
cgcacctccaggacgtttctaagct

SEQ ID NO: 909615 - DNA, 25 bp, Mus musculus
cgcacctgccggctgcgaccgaggg

SEQ ID NO: 909616 - DNA, 25 bp, Mus musculus
cgcacctgccgggtgcgaccgaggg

SEQ ID NO: 909617 - DNA, 25 bp, Mus musculus
cgcacctgtgagcacgagccagagg

SEQ ID NO: 909618 - DNA, 25 bp, Mus musculus
cgcacctgtgagcaggagccagagg

SEQ ID NO: 909619 - DNA, 25 bp, Mus musculus
cgcaccttcacacgtctgccctgta

SEQ ID NO: 909620 - DNA, 25 bp, Mus musculus
cgcaccttcacaggtctgccctgta

SEQ ID NO: 909621 - DNA, 25 bp, Mus musculus
cgcacgagggcgcgctgtggacaaa

SEQ ID NO: 909622 - DNA, 25 bp, Mus musculus
cgcacgagggcgcggtgtggacaaa

SEQ ID NO: 909623 - DNA, 25 bp, Mus musculus
cgcacgccatgtatctttccaccgg

SEQ ID NO: 909624 - DNA, 25 bp, Mus musculus
cgcacgccatgtatgtttccaccgg

SEQ ID NO: 909625 - DNA, 25 bp, Mus musculus
cgcacggagaccacagtcaaaaaag

SEQ ID NO: 909626 - DNA, 25 bp, Mus musculus
cgcacggagaccactgtcaaaaaag

SEQ ID NO: 909627 - DNA, 25 bp, Mus musculus
cgcacggctccacaaagatgacagg

SEQ ID NO: 909628 - DNA, 25 bp, Mus musculus
cgcacggctccagaaagatgacagg

SEQ ID NO: 909629 - DNA, 25 bp, Mus musculus
cgcactaaagcgggctgcctgctag

SEQ ID NO: 909630 - DNA, 25 bp, Mus musculus
cgcactaaagggggctgcctgctag

SEQ ID NO: 909631 - DNA, 25 bp, Mus musculus
cgcactagggaacgtcccggatgtt

SEQ ID NO: 909632 - DNA, 25 bp, Mus musculus
cgcactagggaaggtcccggatgtt

SEQ ID NO: 909633 - DNA, 25 bp, Mus musculus
cgcactcatcatcgtggacaatgcc

SEQ ID NO: 909634 - DNA, 25 bp, Mus musculus
cgcactcatcatggtggacaatgcc

SEQ ID NO: 909635 - DNA, 25 bp, Mus musculus
cgcactctgcgtgcagttccggaat

SEQ ID NO: 909636 - DNA, 25 bp, Mus musculus
cgcactctgcgtgctgttccggaat

SEQ ID NO: 909637 - DNA, 25 bp, Mus musculus
cgcactgcagacaattgcctatagc

SEQ ID NO: 909638 - DNA, 25 bp, Mus musculus
cgcactgcagtcaattgcctatagc

SEQ ID NO: 909639 - DNA, 25 bp, Mus musculus
cgcactggagcgtgctcttcaggat

SEQ ID NO: 909640 - DNA, 25 bp, Mus musculus
cgcactggagggtgctcttcaggat

SEQ ID NO: 909641 - DNA, 25 bp, Mus musculus
cgcactggataacgctagagaaggc

SEQ ID NO: 909642 - DNA, 25 bp, Mus musculus
cgcactggataaggctagagaaggc

SEQ ID NO: 909643 - DNA, 25 bp, Mus musculus
cgcactggcacacggttactactca

SEQ ID NO: 909644 - DNA, 25 bp, Mus musculus
cgcactggcacagggttactactca

SEQ ID NO: 909645 - DNA, 25 bp, Mus musculus
cgcactgtcacaagcatcacatgaa

SEQ ID NO: 909646 - DNA, 25 bp, Mus musculus
cgcactgtcacaaggatcacatgaa

SEQ ID NO: 909647 - DNA, 25 bp, Mus musculus
cgcacttctcctcgtactggctctg

SEQ ID NO: 909648 - DNA, 25 bp, Mus musculus
cgcacttctcctggtactggctctg

SEQ ID NO: 909649 - DNA, 25 bp, Mus musculus
cgcacttgggcaaacagcagagccg

SEQ ID NO: 909650 - DNA, 25 bp, Mus musculus
cgcacttgggcaaacagccgccggg

SEQ ID NO: 909651 - DNA, 25 bp, Mus musculus
cgcacttgggcaaagagcagagccg

SEQ ID NO: 909652 - DNA, 25 bp, Mus musculus
cgcacttgggcaaagagccgccggg

SEQ ID NO: 909653 - DNA, 25 bp, Mus musculus
cgcactttccaccactctcctaggc

SEQ ID NO: 909654 - DNA, 25 bp, Mus musculus
cgcactttccaccagtctcctaggc

SEQ ID NO: 909655 - DNA, 25 bp, Mus musculus
cgcagaagagactgagaggaatcag

SEQ ID NO: 909656 - DNA, 25 bp, Mus musculus
cgcagaagagattgactttggcgac

SEQ ID NO: 909657 - DNA, 25 bp, Mus musculus
cgcagaagagcctaccgaggacgaa

SEQ ID NO: 909658 - DNA, 25 bp, Mus musculus
cgcagaagaggctaccgaggacgaa

SEQ ID NO: 909659 - DNA, 25 bp, Mus musculus
cgcagaagagtctgagaggaatcag

SEQ ID NO: 909660 - DNA, 25 bp, Mus musculus
cgcagaagagtttgactttggcgac

SEQ ID NO: 909661 - DNA, 25 bp, Mus musculus
cgcagacaggtaacagtgtcagctg

SEQ ID NO: 909662 - DNA, 25 bp, Mus musculus
cgcagacaggtaactgtgtcagctg

SEQ ID NO: 909663 - DNA, 25 bp, Mus musculus
cgcagagccgctgccgacatcatca

SEQ ID NO: 909664 - DNA, 25 bp, Mus musculus
cgcagagccggtgccgacatcatca

SEQ ID NO: 909665 - DNA, 25 bp, Mus musculus
cgcagagctagacgtcacctggagg

SEQ ID NO: 909666 - DNA, 25 bp, Mus musculus
cgcagagctagaggtcacctggagg

SEQ ID NO: 909667 - DNA, 25 bp, Mus musculus
cgcagaggacagcaccaggaaagat

SEQ ID NO: 909668 - DNA, 25 bp, Mus musculus
cgcagaggacagcacgaaagatggt

SEQ ID NO: 909669 - DNA, 25 bp, Mus musculus
cgcagaggacagcacggaaggtgtg

SEQ ID NO: 909670 - DNA, 25 bp, Mus musculus
cgcagaggacagcacgtgtgaacct

SEQ ID NO: 909671 - DNA, 25 bp, Mus musculus
cgcagaggacagcagcaggaaagat

SEQ ID NO: 909672 - DNA, 25 bp, Mus musculus
cgcagaggacagcaggaaagatggt

SEQ ID NO: 909673 - DNA, 25 bp, Mus musculus
cgcagaggacagcagggaaggtgtg

SEQ ID NO: 909674 - DNA, 25 bp, Mus musculus
cgcagaggacagcaggtgtgaacct

SEQ ID NO: 909675 - DNA, 25 bp, Mus musculus
cgcagaggccagctgctcctctggt

SEQ ID NO: 909676 - DNA, 25 bp, Mus musculus
cgcagaggccaggtgctcctctggt

SEQ ID NO: 909677 - DNA, 25 bp, Mus musculus
cgcagagtacgaccagttcctacct

SEQ ID NO: 909678 - DNA, 25 bp, Mus musculus
cgcagagtacgacttcctacctggc

SEQ ID NO: 909679 - DNA, 25 bp, Mus musculus
cgcagagtacgagcagttcctacct

SEQ ID NO: 909680 - DNA, 25 bp, Mus musculus
cgcagagtacgagttcctacctggc

SEQ ID NO: 909681 - DNA, 25 bp, Mus musculus
cgcagagttcaactgtaaactggag

SEQ ID NO: 909682 - DNA, 25 bp, Mus musculus
cgcagagttcaagtgtaaactggag

SEQ ID NO: 909683 - DNA, 25 bp, Mus musculus
cgcagagtttcactatccctctgtg

SEQ ID NO: 909684 - DNA, 25 bp, Mus musculus
cgcagagtttgactatccctctgtg

SEQ ID NO: 909685 - DNA, 25 bp, Mus musculus
cgcagcaacaaacgctgtactttgg

SEQ ID NO: 909686 - DNA, 25 bp, Mus musculus
cgcagcaacaaaggctgtactttgg

SEQ ID NO: 909687 - DNA, 25 bp, Mus musculus
cgcagcaagaaacggaagctgccca

SEQ ID NO: 909688 - DNA, 25 bp, Mus musculus
cgcagcaagaaagggaagctgccca

SEQ ID NO: 909689 - DNA, 25 bp, Mus musculus
cgcagcaccggcctgttgcccacca

SEQ ID NO: 909690 - DNA, 25 bp, Mus musculus
cgcagcaccggcgtgttgcccacca

SEQ ID NO: 909691 - DNA, 25 bp, Mus musculus
cgcagcagccctctttgatctgtgg

SEQ ID NO: 909692 - DNA, 25 bp, Mus musculus
cgcagcagccctgtttgatctgtgg

SEQ ID NO: 909693 - DNA, 25 bp, Mus musculus
cgcagccaaggcatcagacactgcc

SEQ ID NO: 909694 - DNA, 25 bp, Mus musculus
cgcagccaaggcatcgcagtcatcg

SEQ ID NO: 909695 - DNA, 25 bp, Mus musculus
cgcagccaaggcatctcatcggggt

SEQ ID NO: 909696 - DNA, 25 bp, Mus musculus
cgcagccaaggcatgagacactgcc

SEQ ID NO: 909697 - DNA, 25 bp, Mus musculus
cgcagccaaggcatggcagtcatcg

SEQ ID NO: 909698 - DNA, 25 bp, Mus musculus
cgcagccaaggcatgtcatcggggt

SEQ ID NO: 909699 - DNA, 25 bp, Mus musculus
cgcagccaccgcacctgcgggaggc

SEQ ID NO: 909700 - DNA, 25 bp, Mus musculus
cgcagccaccgccctcatgcgtgct

SEQ ID NO: 909701 - DNA, 25 bp, Mus musculus
cgcagccaccgcgctcatgcgtgct

SEQ ID NO: 909702 - DNA, 25 bp, Mus musculus
cgcagccaccgctcctgcgggaggc

SEQ ID NO: 909703 - DNA, 25 bp, Mus musculus
cgcagccatacacccccagaggctc

SEQ ID NO: 909704 - DNA, 25 bp, Mus musculus
cgcagccatacagccccagaggctc

SEQ ID NO: 909705 - DNA, 25 bp, Mus musculus
cgcagccatgagcaaagtctcacgc

SEQ ID NO: 909706 - DNA, 25 bp, Mus musculus
cgcagccatgagcagcaaagtctca

SEQ ID NO: 909707 - DNA, 25 bp, Mus musculus
cgcagccatgaggaaagtctcacgc

SEQ ID NO: 909708 - DNA, 25 bp, Mus musculus
cgcagccatgaggagcaaagtctca

SEQ ID NO: 909709 - DNA, 25 bp, Mus musculus
cgcagcccacaccgtgacagaaacc

SEQ ID NO: 909710 - DNA, 25 bp, Mus musculus
cgcagcccacacggtgacagaaacc

SEQ ID NO: 909711 - DNA, 25 bp, Mus musculus
cgcagccgagcctcgcgctgtatgt

SEQ ID NO: 909712 - DNA, 25 bp, Mus musculus
cgcagccgaggctcgcgctgtatgt

SEQ ID NO: 909713 - DNA, 25 bp, Mus musculus
cgcagccgctgacgtcaacaagcag

SEQ ID NO: 909714 - DNA, 25 bp, Mus musculus
cgcagccgctgaggtcaacaagcag

SEQ ID NO: 909715 - DNA, 25 bp, Mus musculus
cgcagcgacactagtccttcacaca

SEQ ID NO: 909716 - DNA, 25 bp, Mus musculus
cgcagcgacacttgtccttcacaca

SEQ ID NO: 909717 - DNA, 25 bp, Mus musculus
cgcagcgaggccgacatctgtcgct

SEQ ID NO: 909718 - DNA, 25 bp, Mus musculus
cgcagcgaggccgagatctgtcgct

SEQ ID NO: 909719 - DNA, 25 bp, Mus musculus
cgcagcgcagaccgcagaggccctg

SEQ ID NO: 909720 - DNA, 25 bp, Mus musculus
cgcagcgcagtccgcagaggccctg

SEQ ID NO: 909721 - DNA, 25 bp, Mus musculus
cgcagcgcccagcctgggaattgct

SEQ ID NO: 909722 - DNA, 25 bp, Mus musculus
cgcagcgcccaggctgggaattgct

SEQ ID NO: 909723 - DNA, 25 bp, Mus musculus
cgcagcggtgcacttgacagttcgt

SEQ ID NO: 909724 - DNA, 25 bp, Mus musculus
cgcagcggtgcagttgacagttcgt

SEQ ID NO: 909725 - DNA, 25 bp, Mus musculus
cgcagcttcaaaatattgtatctac

SEQ ID NO: 909726 - DNA, 25 bp, Mus musculus
cgcagcttcataatattgtatctac

SEQ ID NO: 909727 - DNA, 25 bp, Mus musculus
cgcagcttgcgcccccggccgcccc

SEQ ID NO: 909728 - DNA, 25 bp, Mus musculus
cgcagcttgcgcgcccggccgcccc

SEQ ID NO: 909729 - DNA, 25 bp, Mus musculus
cgcaggacagcaccacgccccactc

SEQ ID NO: 909730 - DNA, 25 bp, Mus musculus
cgcaggacaggaccacgccccactc

SEQ ID NO: 909731 - DNA, 25 bp, Mus musculus
cgcaggaccaataacgaggtcccca

SEQ ID NO: 909732 - DNA, 25 bp, Mus musculus
cgcaggaccaataaggaggtcccca

SEQ ID NO: 909733 - DNA, 25 bp, Mus musculus
cgcaggagcgtgcattggtgaccag

SEQ ID NO: 909734 - DNA, 25 bp, Mus musculus
cgcaggagcgtggattggtgaccag

SEQ ID NO: 909735 - DNA, 25 bp, Mus musculus
cgcaggatcaaggactcctggggtc

SEQ ID NO: 909736 - DNA, 25 bp, Mus musculus
cgcaggatcaaggagtcctggggtc

SEQ ID NO: 909737 - DNA, 25 bp, Mus musculus
cgcaggatggagcagagagggccac

SEQ ID NO: 909738 - DNA, 25 bp, Mus musculus
cgcaggatggaggagagagggccac

SEQ ID NO: 909739 - DNA, 25 bp, Mus musculus
cgcaggattgtaccctctatcacac

SEQ ID NO: 909740 - DNA, 25 bp, Mus musculus
cgcaggattgtagcctctatcacac

SEQ ID NO: 909741 - DNA, 25 bp, Mus musculus
cgcaggcacaagccttgttggagac

SEQ ID NO: 909742 - DNA, 25 bp, Mus musculus
cgcaggcacaaggcttgttggagac

SEQ ID NO: 909743 - DNA, 25 bp, Mus musculus
cgcaggcatccgcgaagctgaatgc

SEQ ID NO: 909744 - DNA, 25 bp, Mus musculus
cgcaggcatccgggaagctgaatgc

SEQ ID NO: 909745 - DNA, 25 bp, Mus musculus
cgcaggccatcctgcgttgctcttc

SEQ ID NO: 909746 - DNA, 25 bp, Mus musculus
cgcaggccatcctgggttgctcttc

SEQ ID NO: 909747 - DNA, 25 bp, Mus musculus
cgcaggcggaaactatccattatga

SEQ ID NO: 909748 - DNA, 25 bp, Mus musculus
cgcaggcggaaagtatccattatga

SEQ ID NO: 909749 - DNA, 25 bp, Mus musculus
cgcagggactgggtcgacttggctt

SEQ ID NO: 909750 - DNA, 25 bp, Mus musculus
cgcagggactgggtggacttggctt

SEQ ID NO: 909751 - DNA, 25 bp, Mus musculus
cgcagggagcgacagtgtgaacatg

SEQ ID NO: 909752 - DNA, 25 bp, Mus musculus
cgcagggagcgagagtgtgaacatg

SEQ ID NO: 909753 - DNA, 25 bp, Mus musculus
cgcaggggacaacatcacctttgtg

SEQ ID NO: 909754 - DNA, 25 bp, Mus musculus
cgcaggggacaagatcacctttgtg

SEQ ID NO: 909755 - DNA, 25 bp, Mus musculus
cgcagggtatttctaaagatgagcc

SEQ ID NO: 909756 - DNA, 25 bp, Mus musculus
cgcagggtatttgtaaagatgagcc

SEQ ID NO: 909757 - DNA, 25 bp, Mus musculus
cgcaggtaaggtaacatctcaagca

SEQ ID NO: 909758 - DNA, 25 bp, Mus musculus
cgcaggtaaggtaagatctcaagca

SEQ ID NO: 909759 - DNA, 25 bp, Mus musculus
cgcagtatcacaccctgaagctgga

SEQ ID NO: 909760 - DNA, 25 bp, Mus musculus
cgcagtatcacagcctgaagctgga

SEQ ID NO: 909761 - DNA, 25 bp, Mus musculus
cgcagtctgaccactacaagaagac

SEQ ID NO: 909762 - DNA, 25 bp, Mus musculus
cgcagtctgacctctacaagaagac

SEQ ID NO: 909763 - DNA, 25 bp, Mus musculus
cgcagtgcccagacctgtgttacat

SEQ ID NO: 909764 - DNA, 25 bp, Mus musculus
cgcagtgcccagcagcatcactatt

SEQ ID NO: 909765 - DNA, 25 bp, Mus musculus
cgcagtgcccagcatcactatttca

SEQ ID NO: 909766 - DNA, 25 bp, Mus musculus
cgcagtgcccaggagcatcactatt

SEQ ID NO: 909767 - DNA, 25 bp, Mus musculus
cgcagtgcccaggatcactatttca

SEQ ID NO: 909768 - DNA, 25 bp, Mus musculus
cgcagtgcccagtcctgtgttacat

SEQ ID NO: 909769 - DNA, 25 bp, Mus musculus
cgcagtgcttagagaacgatgtgga

SEQ ID NO: 909770 - DNA, 25 bp, Mus musculus
cgcagtgcttagctcttctgtcgga

SEQ ID NO: 909771 - DNA, 25 bp, Mus musculus
cgcagtgcttaggtcttctgtcgga

SEQ ID NO: 909772 - DNA, 25 bp, Mus musculus
cgcagtgcttagtgaacgatgtgga

SEQ ID NO: 909773 - DNA, 25 bp, Mus musculus
cgcagtgtcaagctggccaaagtgg

SEQ ID NO: 909774 - DNA, 25 bp, Mus musculus
cgcagtgtcaaggtggccaaagtgg

SEQ ID NO: 909775 - DNA, 25 bp, Mus musculus
cgcagttcaaggagatgccagacca

SEQ ID NO: 909776 - DNA, 25 bp, Mus musculus
cgcagttcaaggtgatgccagacca

SEQ ID NO: 909777 - DNA, 25 bp, Mus musculus
cgcagttcagcttgctctcatccac

SEQ ID NO: 909778 - DNA, 25 bp, Mus musculus
cgcagttcaggttgctctcatccac

SEQ ID NO: 909779 - DNA, 25 bp, Mus musculus
cgcagtttagaagacggctgtcaaa

SEQ ID NO: 909780 - DNA, 25 bp, Mus musculus
cgcagtttagaagagggctgtcaaa

SEQ ID NO: 909781 - DNA, 25 bp, Mus musculus
cgcataacttccagagaaggacttg

SEQ ID NO: 909782 - DNA, 25 bp, Mus musculus
cgcataacttcctgagaaggacttg

SEQ ID NO: 909783 - DNA, 25 bp, Mus musculus
cgcatatgcgctcgtggacgcagac

SEQ ID NO: 909784 - DNA, 25 bp, Mus musculus
cgcatatgcgctcgttccagatgcc

SEQ ID NO: 909785 - DNA, 25 bp, Mus musculus
cgcatatgcgctggtggacgcagac

SEQ ID NO: 909786 - DNA, 25 bp, Mus musculus
cgcatatgcgctggttccagatgcc

SEQ ID NO: 909787 - DNA, 25 bp, Mus musculus
cgcatcagatcgccatcaagcagat

SEQ ID NO: 909788 - DNA, 25 bp, Mus musculus
cgcatcagatcggcatcaagcagat

SEQ ID NO: 909789 - DNA, 25 bp, Mus musculus
cgcatcatgaggctggagttctact

SEQ ID NO: 909790 - DNA, 25 bp, Mus musculus
cgcatcatgagggtggagttctact

SEQ ID NO: 909791 - DNA, 25 bp, Mus musculus
cgcatccaggagctcttggacaagc

SEQ ID NO: 909792 - DNA, 25 bp, Mus musculus
cgcatccaggaggtcttggacaagc

SEQ ID NO: 909793 - DNA, 25 bp, Mus musculus
cgcatccatgttcgacaccacgccc

SEQ ID NO: 909794 - DNA, 25 bp, Mus musculus
cgcatccatgttcgtcaccacgccc

SEQ ID NO: 909795 - DNA, 25 bp, Mus musculus
cgcatcgcagagatgacatcctgct

SEQ ID NO: 909796 - DNA, 25 bp, Mus musculus
cgcatcgcagagttgacatcctgct

SEQ ID NO: 909797 - DNA, 25 bp, Mus musculus
cgcatctgcctcaacgatgacggtg

SEQ ID NO: 909798 - DNA, 25 bp, Mus musculus
cgcatctgcctctacgatgacggtg

SEQ ID NO: 909799 - DNA, 25 bp, Mus musculus
cgcatctttgactttgatgacgatg

SEQ ID NO: 909800 - DNA, 25 bp, Mus musculus
cgcatctttgtctttgatgacgatg

SEQ ID NO: 909801 - DNA, 25 bp, Mus musculus
cgcatgacacagaacagggacatac

SEQ ID NO: 909802 - DNA, 25 bp, Mus musculus
cgcatgacacagtacagggacatac

SEQ ID NO: 909803 - DNA, 25 bp, Mus musculus
cgcatgggcgcacacgtctgctgtg

SEQ ID NO: 909804 - DNA, 25 bp, Mus musculus
cgcatgggcgcacaggtctgctgtg

SEQ ID NO: 909805 - DNA, 25 bp, Mus musculus
cgcatggggcagcgcatgggtgcca

SEQ ID NO: 909806 - DNA, 25 bp, Mus musculus
cgcatggggcagggcatgggtgcca

SEQ ID NO: 909807 - DNA, 25 bp, Mus musculus
cgcatgggtctcaacatgttgttga

SEQ ID NO: 909808 - DNA, 25 bp, Mus musculus
cgcatgggtctcaagatgttgttga

SEQ ID NO: 909809 - DNA, 25 bp, Mus musculus
cgcatggtataacgatgacatcgtt

SEQ ID NO: 909810 - DNA, 25 bp, Mus musculus
cgcatggtataaggatgacatcgtt

SEQ ID NO: 909811 - DNA, 25 bp, Mus musculus
cgcatggtggagcaccccgtggctg

SEQ ID NO: 909812 - DNA, 25 bp, Mus musculus
cgcatggtggaggaccccgtggctg

SEQ ID NO: 909813 - DNA, 25 bp, Mus musculus
cgcattcatgcacaaaatcttttca

SEQ ID NO: 909814 - DNA, 25 bp, Mus musculus
cgcattcatgcagaaaatcttttca

SEQ ID NO: 909815 - DNA, 25 bp, Mus musculus
cgcattcatttgcacatcactctgg

SEQ ID NO: 909816 - DNA, 25 bp, Mus musculus
cgcattcatttgcagatcactctgg

SEQ ID NO: 909817 - DNA, 25 bp, Mus musculus
cgcattccagagtctgggggagata

SEQ ID NO: 909818 - DNA, 25 bp, Mus musculus
cgcattccagtgtctgggggagata

SEQ ID NO: 909819 - DNA, 25 bp, Mus musculus
cgcatttggatgaggatggaagact

SEQ ID NO: 909820 - DNA, 25 bp, Mus musculus
cgcatttggatgtggatggaagact

SEQ ID NO: 909821 - DNA, 25 bp, Mus musculus
cgcattttgccgcaacccagataat

SEQ ID NO: 909822 - DNA, 25 bp, Mus musculus
cgcattttgccggaacccagataat

SEQ ID NO: 909823 - DNA, 25 bp, Mus musculus
cgcatttttcaaaaatgtatattta

SEQ ID NO: 909824 - DNA, 25 bp, Mus musculus
cgcatttttcaataatgtatattta

SEQ ID NO: 909825 - DNA, 25 bp, Mus musculus
cgccaaactctgctggataccctcc

SEQ ID NO: 909826 - DNA, 25 bp, Mus musculus
cgccaaactctgcttcttctggttc

SEQ ID NO: 909827 - DNA, 25 bp, Mus musculus
cgccaaactctggtggataccctcc

SEQ ID NO: 909828 - DNA, 25 bp, Mus musculus
cgccaaactctggttcttctggttc

SEQ ID NO: 909829 - DNA, 25 bp, Mus musculus
cgccaactcctggtcgtcactagct

SEQ ID NO: 909830 - DNA, 25 bp, Mus musculus
cgccaactcctggtggtcactagct

SEQ ID NO: 909831 - DNA, 25 bp, Mus musculus
cgccaagaagcacgctcgcagcctt

SEQ ID NO: 909832 - DNA, 25 bp, Mus musculus
cgccaagaagcaggctcgcagcctt

SEQ ID NO: 909833 - DNA, 25 bp, Mus musculus
cgccaagaggagggcgcatgaatcc

SEQ ID NO: 909834 - DNA, 25 bp, Mus musculus
cgccaagaggagggcttatcatgct

SEQ ID NO: 909835 - DNA, 25 bp, Mus musculus
cgccaagaggagggggcatgaatcc

SEQ ID NO: 909836 - DNA, 25 bp, Mus musculus
cgccaagaggaggggttatcatgct

SEQ ID NO: 909837 - DNA, 25 bp, Mus musculus
cgccaagatttgcattcaagtcaat

SEQ ID NO: 909838 - DNA, 25 bp, Mus musculus
cgccaagatttggattcaagtcaat

SEQ ID NO: 909839 - DNA, 25 bp, Mus musculus
cgccaagccaagcactgtttgaaag

SEQ ID NO: 909840 - DNA, 25 bp, Mus musculus
cgccaagccaagcagtgtttgaaag

SEQ ID NO: 909841 - DNA, 25 bp, Mus musculus
cgccaaggagaattaccctctgtac

SEQ ID NO: 909842 - DNA, 25 bp, Mus musculus
cgccaaggagtattaccctctgtac

SEQ ID NO: 909843 - DNA, 25 bp, Mus musculus
cgccaaggatattgcgtccgaccca

SEQ ID NO: 909844 - DNA, 25 bp, Mus musculus
cgccaaggattttgcgtccgaccca

SEQ ID NO: 909845 - DNA, 25 bp, Mus musculus
cgccaaggccagagaaatcttggta

SEQ ID NO: 909846 - DNA, 25 bp, Mus musculus
cgccaaggccagtgaaatcttggta

SEQ ID NO: 909847 - DNA, 25 bp, Mus musculus
cgccaaggcggaccccaagcgccgc

SEQ ID NO: 909848 - DNA, 25 bp, Mus musculus
cgccaaggcggagcccaagcgccgc

SEQ ID NO: 909849 - DNA, 25 bp, Mus musculus
cgccaatggccaaatcaaagaaatc

SEQ ID NO: 909850 - DNA, 25 bp, Mus musculus
cgccaatggccatatcaaagaaatc

SEQ ID NO: 909851 - DNA, 25 bp, Mus musculus
cgccacaacaacagctttcgtgaga

SEQ ID NO: 909852 - DNA, 25 bp, Mus musculus
cgccacaacaacaggtttcgtgaga

SEQ ID NO: 909853 - DNA, 25 bp, Mus musculus
cgccaccaagcatgctgtggctgtc

SEQ ID NO: 909854 - DNA, 25 bp, Mus musculus
cgccaccaaggatgctgtggctgtc

SEQ ID NO: 909855 - DNA, 25 bp, Mus musculus
cgccaccacctgcaactggtgagca

SEQ ID NO: 909856 - DNA, 25 bp, Mus musculus
cgccaccacctggaactggtgagca

SEQ ID NO: 909857 - DNA, 25 bp, Mus musculus
cgccaccatgacggtgggcaagagc

SEQ ID NO: 909858 - DNA, 25 bp, Mus musculus
cgccaccatgagcgatcagcagctg

SEQ ID NO: 909859 - DNA, 25 bp, Mus musculus
cgccaccatgtcggtgggcaagagc

SEQ ID NO: 909860 - DNA, 25 bp, Mus musculus
cgccaccatgtgcgatcagcagctg

SEQ ID NO: 909861 - DNA, 25 bp, Mus musculus
cgccacccaaagccagaagagtgtt

SEQ ID NO: 909862 - DNA, 25 bp, Mus musculus
cgccacccaaaggcagaagagtgtt

SEQ ID NO: 909863 - DNA, 25 bp, Mus musculus
cgccacccagatctggaacaacgac

SEQ ID NO: 909864 - DNA, 25 bp, Mus musculus
cgccacccagcggccacatcctggt

SEQ ID NO: 909865 - DNA, 25 bp, Mus musculus
cgccacccaggggccacatcctggt

SEQ ID NO: 909866 - DNA, 25 bp, Mus musculus
cgccacccagttctggaacaacgac

SEQ ID NO: 909867 - DNA, 25 bp, Mus musculus
cgccacctctctcgtggaatgcaga

SEQ ID NO: 909868 - DNA, 25 bp, Mus musculus
cgccacctctctggtggaatgcaga

SEQ ID NO: 909869 - DNA, 25 bp, Mus musculus
cgccacgagaacaggacatttggtc

SEQ ID NO: 909870 - DNA, 25 bp, Mus musculus
cgccacgagaacctcattgggctac

SEQ ID NO: 909871 - DNA, 25 bp, Mus musculus
cgccacgagaacgtcattgggctac

SEQ ID NO: 909872 - DNA, 25 bp, Mus musculus
cgccacgagaactggacatttggtc

SEQ ID NO: 909873 - DNA, 25 bp, Mus musculus
cgccacgagtcagcccactgatcga

SEQ ID NO: 909874 - DNA, 25 bp, Mus musculus
cgccacgagtcagcgcactgatcga

SEQ ID NO: 909875 - DNA, 25 bp, Mus musculus
cgccacgtggcacccggtcccagtg

SEQ ID NO: 909876 - DNA, 25 bp, Mus musculus
cgccacgtggcaccgggtcccagtg

SEQ ID NO: 909877 - DNA, 25 bp, Mus musculus
cgccactaagaggggaggcgcactg

SEQ ID NO: 909878 - DNA, 25 bp, Mus musculus
cgccactaagtggggaggcgcactg

SEQ ID NO: 909879 - DNA, 25 bp, Mus musculus
cgccactattaaacctggtgatgac

SEQ ID NO: 909880 - DNA, 25 bp, Mus musculus
cgccactattaatcctggtgatgac

SEQ ID NO: 909881 - DNA, 25 bp, Mus musculus
cgccactgcagacgcattgcccgaa

SEQ ID NO: 909882 - DNA, 25 bp, Mus musculus
cgccactgcagaggcattgcccgaa

SEQ ID NO: 909883 - DNA, 25 bp, Mus musculus
cgccagaaagattgttctctggggg

SEQ ID NO: 909884 - DNA, 25 bp, Mus musculus
cgccagaaagtttgttctctggggg

SEQ ID NO: 909885 - DNA, 25 bp, Mus musculus
cgccagaacactcgcaccatgaggt

SEQ ID NO: 909886 - DNA, 25 bp, Mus musculus
cgccagaacactggcaccatgaggt

SEQ ID NO: 909887 - DNA, 25 bp, Mus musculus
cgccagaacgatgccccatccccga

SEQ ID NO: 909888 - DNA, 25 bp, Mus musculus
cgccagaacgttgccccatccccga

SEQ ID NO: 909889 - DNA, 25 bp, Mus musculus
cgccagagagatcaaatgctcccac

SEQ ID NO: 909890 - DNA, 25 bp, Mus musculus
cgccagagagatgaaatgctcccac

SEQ ID NO: 909891 - DNA, 25 bp, Mus musculus
cgccagcaacatctccagcacctgc

SEQ ID NO: 909892 - DNA, 25 bp, Mus musculus
cgccagcaacttctccagcacctgc

SEQ ID NO: 909893 - DNA, 25 bp, Mus musculus
cgccagcaagcgctggggcaggagc

SEQ ID NO: 909894 - DNA, 25 bp, Mus musculus
cgccagcaagcggtggggcaggagc

SEQ ID NO: 909895 - DNA, 25 bp, Mus musculus
cgccagcacaagctgtggcgaaagt

SEQ ID NO: 909896 - DNA, 25 bp, Mus musculus
cgccagcacaaggtgtggcgaaagt

SEQ ID NO: 909897 - DNA, 25 bp, Mus musculus
cgccagcgtcctaacgggcaatgtc

SEQ ID NO: 909898 - DNA, 25 bp, Mus musculus
cgccagcgtcctaaggggcaatgtc

SEQ ID NO: 909899 - DNA, 25 bp, Mus musculus
cgccaggatgaaacccatcctgctg

SEQ ID NO: 909900 - DNA, 25 bp, Mus musculus
cgccaggatgatcccagctaccgtt

SEQ ID NO: 909901 - DNA, 25 bp, Mus musculus
cgccaggatgtaacccatcctgctg

SEQ ID NO: 909902 - DNA, 25 bp, Mus musculus
cgccaggatgttcccagctaccgtt

SEQ ID NO: 909903 - DNA, 25 bp, Mus musculus
cgccagtgctaaagtagacttcgac

SEQ ID NO: 909904 - DNA, 25 bp, Mus musculus
cgccagtgcttaagtagacttcgac

SEQ ID NO: 909905 - DNA, 25 bp, Mus musculus
cgccagtgtcagctcaattaccatg

SEQ ID NO: 909906 - DNA, 25 bp, Mus musculus
cgccagtgtcaggtcaattaccatg

SEQ ID NO: 909907 - DNA, 25 bp, Mus musculus
cgccagtgtcgcaacgacaactgcg

SEQ ID NO: 909908 - DNA, 25 bp, Mus musculus
cgccagtgtcgcaaggacaactgcg

SEQ ID NO: 909909 - DNA, 25 bp, Mus musculus
cgccataaagagcaacgggagaaag

SEQ ID NO: 909910 - DNA, 25 bp, Mus musculus
cgccataaagtgcaacgggagaaag

SEQ ID NO: 909911 - DNA, 25 bp, Mus musculus
cgccatcatgactgccacaacttct

SEQ ID NO: 909912 - DNA, 25 bp, Mus musculus
cgccatcatgtctgccacaacttct

SEQ ID NO: 909913 - DNA, 25 bp, Mus musculus
cgccatccacaccttccgccaggta

SEQ ID NO: 909914 - DNA, 25 bp, Mus musculus
cgccatccacacgttccgccaggta

SEQ ID NO: 909915 - DNA, 25 bp, Mus musculus
cgccatccagatagtgatcgtgcag

SEQ ID NO: 909916 - DNA, 25 bp, Mus musculus
cgccatccagctcatcacgcgcatg

SEQ ID NO: 909917 - DNA, 25 bp, Mus musculus
cgccatccagctgatcacgcgcatg

SEQ ID NO: 909918 - DNA, 25 bp, Mus musculus
cgccatccagttagtgatcgtgcag

SEQ ID NO: 909919 - DNA, 25 bp, Mus musculus
cgccatcctggccatcattacaggg

SEQ ID NO: 909920 - DNA, 25 bp, Mus musculus
cgccatcctggccgggaattctacc

SEQ ID NO: 909921 - DNA, 25 bp, Mus musculus
cgccatcctggcgatcattacaggg

SEQ ID NO: 909922 - DNA, 25 bp, Mus musculus
cgccatcctggcggggaattctacc

SEQ ID NO: 909923 - DNA, 25 bp, Mus musculus
cgccatcgacttcaccttctgtcta

SEQ ID NO: 909924 - DNA, 25 bp, Mus musculus
cgccatcgacttcagcttctgtcta

SEQ ID NO: 909925 - DNA, 25 bp, Mus musculus
cgccatcgagcacgtattcccaagc

SEQ ID NO: 909926 - DNA, 25 bp, Mus musculus
cgccatcgagcacgtgtcaccggat

SEQ ID NO: 909927 - DNA, 25 bp, Mus musculus
cgccatcgagcaggtattcccaagc

SEQ ID NO: 909928 - DNA, 25 bp, Mus musculus
cgccatcgagcaggtgtcaccggat

SEQ ID NO: 909929 - DNA, 25 bp, Mus musculus
cgccatcgtagaagccctggaaacc

SEQ ID NO: 909930 - DNA, 25 bp, Mus musculus
cgccatcgtagatgccctggaaacc

SEQ ID NO: 909931 - DNA, 25 bp, Mus musculus
cgccatctttgacacggtgctaaca

SEQ ID NO: 909932 - DNA, 25 bp, Mus musculus
cgccatctttgacagggtgctaaca

SEQ ID NO: 909933 - DNA, 25 bp, Mus musculus
cgccatgaagaagcccattggaata

SEQ ID NO: 909934 - DNA, 25 bp, Mus musculus
cgccatgaagtagcccattggaata

SEQ ID NO: 909935 - DNA, 25 bp, Mus musculus
cgccatgattagagcgggacatgtc

SEQ ID NO: 909936 - DNA, 25 bp, Mus musculus
cgccatgattagagggggacatgtc

SEQ ID NO: 909937 - DNA, 25 bp, Mus musculus
cgccatgccaagcctagcagtaacc

SEQ ID NO: 909938 - DNA, 25 bp, Mus musculus
cgccatgccaaggctagcagtaacc

SEQ ID NO: 909939 - DNA, 25 bp, Mus musculus
cgccatgctgttctcaatgaaggga

SEQ ID NO: 909940 - DNA, 25 bp, Mus musculus
cgccatgctgttctgaatgaaggga

SEQ ID NO: 909941 - DNA, 25 bp, Mus musculus
cgccatgtcaaaaacgtatggttcc

SEQ ID NO: 909942 - DNA, 25 bp, Mus musculus
cgccatgtcaaaaaggtatggttcc

SEQ ID NO: 909943 - DNA, 25 bp, Mus musculus
cgccatgtggttcaacggctggact

SEQ ID NO: 909944 - DNA, 25 bp, Mus musculus
cgccatgtggttcatcggctggact

SEQ ID NO: 909945 - DNA, 25 bp, Mus musculus
cgccatgttcagctacacattccag

SEQ ID NO: 909946 - DNA, 25 bp, Mus musculus
cgccatgttcaggtacacattccag

SEQ ID NO: 909947 - DNA, 25 bp, Mus musculus
cgccattggtgacctgaaaaatgaa

SEQ ID NO: 909948 - DNA, 25 bp, Mus musculus
cgccattggtgagctgaaaaatgaa

SEQ ID NO: 909949 - DNA, 25 bp, Mus musculus
cgcccaacagctaccgctattacca

SEQ ID NO: 909950 - DNA, 25 bp, Mus musculus
cgcccaacaggtaccgctattacca

SEQ ID NO: 909951 - DNA, 25 bp, Mus musculus
cgcccaagaaagctggcaggagatc

SEQ ID NO: 909952 - DNA, 25 bp, Mus musculus
cgcccaagaaaggtggcaggagatc

SEQ ID NO: 909953 - DNA, 25 bp, Mus musculus
cgcccacagacgattggggctgcta

SEQ ID NO: 909954 - DNA, 25 bp, Mus musculus
cgcccacagacgtttggggctgcta

SEQ ID NO: 909955 - DNA, 25 bp, Mus musculus
cgcccacagcagagtctgtgcgccc

SEQ ID NO: 909956 - DNA, 25 bp, Mus musculus
cgcccacagcagtgtctgtgcgccc

SEQ ID NO: 909957 - DNA, 25 bp, Mus musculus
cgcccacgacctcacgtgcccggag

SEQ ID NO: 909958 - DNA, 25 bp, Mus musculus
cgcccacgacctcaggtgcccggag

SEQ ID NO: 909959 - DNA, 25 bp, Mus musculus
cgcccacgccagacctgcctatcca

SEQ ID NO: 909960 - DNA, 25 bp, Mus musculus
cgcccacgccagtcctgcctatcca

SEQ ID NO: 909961 - DNA, 25 bp, Mus musculus
cgcccacgttggcatctgaaccaat

SEQ ID NO: 909962 - DNA, 25 bp, Mus musculus
cgcccacgttgggatctgaaccaat

SEQ ID NO: 909963 - DNA, 25 bp, Mus musculus
cgcccactccaccgcgtatgaagct

SEQ ID NO: 909964 - DNA, 25 bp, Mus musculus
cgcccactccaccgggtatgaagct

SEQ ID NO: 909965 - DNA, 25 bp, Mus musculus
cgcccagaagcacgtactctatcta

SEQ ID NO: 909966 - DNA, 25 bp, Mus musculus
cgcccagaagcaggtactctatcta

SEQ ID NO: 909967 - DNA, 25 bp, Mus musculus
cgcccagaagctagccgttgcccag

SEQ ID NO: 909968 - DNA, 25 bp, Mus musculus
cgcccagaaggtagccgttgcccag

SEQ ID NO: 909969 - DNA, 25 bp, Mus musculus
cgcccagcacagctcaattctttgt

SEQ ID NO: 909970 - DNA, 25 bp, Mus musculus
cgcccagcacaggtcaattctttgt

SEQ ID NO: 909971 - DNA, 25 bp, Mus musculus
cgcccagcactgggcatgtccagct

SEQ ID NO: 909972 - DNA, 25 bp, Mus musculus
cgcccagcactggggatgtccagct

SEQ ID NO: 909973 - DNA, 25 bp, Mus musculus
cgcccagcgagccctgcgaagctgg

SEQ ID NO: 909974 - DNA, 25 bp, Mus musculus
cgcccagcgagcgctgcgaagctgg

SEQ ID NO: 909975 - DNA, 25 bp, Mus musculus
cgcccaggagcacgtgtagctactt

SEQ ID NO: 909976 - DNA, 25 bp, Mus musculus
cgcccaggagcaggtgtagctactt

SEQ ID NO: 909977 - DNA, 25 bp, Mus musculus
cgcccaggagctctcaggtctacgc

SEQ ID NO: 909978 - DNA, 25 bp, Mus musculus
cgcccaggagctctgaggtctacgc

SEQ ID NO: 909979 - DNA, 25 bp, Mus musculus
cgcccaggcggatgccacccttatc

SEQ ID NO: 909980 - DNA, 25 bp, Mus musculus
cgcccaggcggatggcacccttatc

SEQ ID NO: 909981 - DNA, 25 bp, Mus musculus
cgcccaggggagatgtataccaggt

SEQ ID NO: 909982 - DNA, 25 bp, Mus musculus
cgcccaggggagttgtataccaggt

SEQ ID NO: 909983 - DNA, 25 bp, Mus musculus
cgcccaggtcaacgactatgagaaa

SEQ ID NO: 909984 - DNA, 25 bp, Mus musculus
cgcccaggtcaacgagtccatgaag

SEQ ID NO: 909985 - DNA, 25 bp, Mus musculus
cgcccaggtcaaggactatgagaaa

SEQ ID NO: 909986 - DNA, 25 bp, Mus musculus
cgcccaggtcaaggagtccatgaag

SEQ ID NO: 909987 - DNA, 25 bp, Mus musculus
cgcccagttcctgaccggcatccca

SEQ ID NO: 909988 - DNA, 25 bp, Mus musculus
cgcccagttcctgagcggcatccca

SEQ ID NO: 909989 - DNA, 25 bp, Mus musculus
cgcccatggaagagaccgtgcgggc

SEQ ID NO: 909990 - DNA, 25 bp, Mus musculus
cgcccatggaagtgaccgtgcgggc

SEQ ID NO: 909991 - DNA, 25 bp, Mus musculus
cgcccatttgcgaacacatcgacga

SEQ ID NO: 909992 - DNA, 25 bp, Mus musculus
cgcccatttgcgaagacatcgacga

SEQ ID NO: 909993 - DNA, 25 bp, Mus musculus
cgccccattgagctgaccagaatgg

SEQ ID NO: 909994 - DNA, 25 bp, Mus musculus
cgccccattgaggtgaccagaatgg

SEQ ID NO: 909995 - DNA, 25 bp, Mus musculus
cgccccggccaacgtattgctgtcc

SEQ ID NO: 909996 - DNA, 25 bp, Mus musculus
cgccccggccaaggtattgctgtcc

SEQ ID NO: 909997 - DNA, 25 bp, Mus musculus
cgcccctgagatcctgcagggcctg

SEQ ID NO: 909998 - DNA, 25 bp, Mus musculus
cgcccctgagctgtgtgagccatcc

SEQ ID NO: 909999 - DNA, 25 bp, Mus musculus
cgcccctgaggtgtgtgagccatcc

SEQ ID NO: 910000 - DNA, 25 bp, Mus musculus
cgcccctgagttcctgcagggcctg

SEQ ID NO: 910001 - DNA, 25 bp, Mus musculus
cgccccttcccccgcagcaggagcc

SEQ ID NO: 910002 - DNA, 25 bp, Mus musculus
cgccccttccccggcagcaggagcc

SEQ ID NO: 910003 - DNA, 25 bp, Mus musculus
cgcccgaccatgaacacaccgtgga

SEQ ID NO: 910004 - DNA, 25 bp, Mus musculus
cgcccgaccatgaacatgaagcggc

SEQ ID NO: 910005 - DNA, 25 bp, Mus musculus
cgcccgaccatgaagacaccgtgga

SEQ ID NO: 910006 - DNA, 25 bp, Mus musculus
cgcccgaccatgaagatgaagcggc

SEQ ID NO: 910007 - DNA, 25 bp, Mus musculus
cgcccggaccgccacattgtgcctt

SEQ ID NO: 910008 - DNA, 25 bp, Mus musculus
cgcccggaccgccagattgtgcctt

SEQ ID NO: 910009 - DNA, 25 bp, Mus musculus
cgcccgggctggacatcatgccaca

SEQ ID NO: 910010 - DNA, 25 bp, Mus musculus
cgcccgggctggtcatcatgccaca

SEQ ID NO: 910011 - DNA, 25 bp, Mus musculus
cgccctccagagctgcctggagttg

SEQ ID NO: 910012 - DNA, 25 bp, Mus musculus
cgccctccagaggtgcctggagttg

SEQ ID NO: 910013 - DNA, 25 bp, Mus musculus
cgccctccctgactcttggcatggt

SEQ ID NO: 910014 - DNA, 25 bp, Mus musculus
cgccctccctgagtcttggcatggt

SEQ ID NO: 910015 - DNA, 25 bp, Mus musculus
cgccctcctgcccacgtttgcacac

SEQ ID NO: 910016 - DNA, 25 bp, Mus musculus
cgccctcctgcccaggtttgcacac

SEQ ID NO: 910017 - DNA, 25 bp, Mus musculus
cgccctcgggagattatcaacacat

SEQ ID NO: 910018 - DNA, 25 bp, Mus musculus
cgccctcgggagtttatcaacacat

SEQ ID NO: 910019 - DNA, 25 bp, Mus musculus
cgccctctcaagctcagccttttct

SEQ ID NO: 910020 - DNA, 25 bp, Mus musculus
cgccctctcaaggtcagccttttct

SEQ ID NO: 910021 - DNA, 25 bp, Mus musculus
cgccctctggatgaggaactgctga

SEQ ID NO: 910022 - DNA, 25 bp, Mus musculus
cgccctctggttgaggaactgctga

SEQ ID NO: 910023 - DNA, 25 bp, Mus musculus
cgccctgagctgcacaagtgacgca

SEQ ID NO: 910024 - DNA, 25 bp, Mus musculus
cgccctgagctggacaagtgacgca

SEQ ID NO: 910025 - DNA, 25 bp, Mus musculus
cgccctgcagcacgtgattcaggat

SEQ ID NO: 910026 - DNA, 25 bp, Mus musculus
cgccctgcagcaggtgattcaggat

SEQ ID NO: 910027 - DNA, 25 bp, Mus musculus
cgccctgcataacgggtgtgtctgc

SEQ ID NO: 910028 - DNA, 25 bp, Mus musculus
cgccctgcataaggggtgtgtctgc

SEQ ID NO: 910029 - DNA, 25 bp, Mus musculus
cgccctgccaagattttcacctgac

SEQ ID NO: 910030 - DNA, 25 bp, Mus musculus
cgccctgccaagtttttcacctgac

SEQ ID NO: 910031 - DNA, 25 bp, Mus musculus
cgccctggagctattgaagtctctt

SEQ ID NO: 910032 - DNA, 25 bp, Mus musculus
cgccctggaggtattgaagtctctt

SEQ ID NO: 910033 - DNA, 25 bp, Mus musculus
cgcccttctagactggcccgtgata

SEQ ID NO: 910034 - DNA, 25 bp, Mus musculus
cgcccttctagagtggcccgtgata

SEQ ID NO: 910035 - DNA, 25 bp, Mus musculus
cgccgacaggagccgacccagtgga

SEQ ID NO: 910036 - DNA, 25 bp, Mus musculus
cgccgacaggagctacgagaggttc

SEQ ID NO: 910037 - DNA, 25 bp, Mus musculus
cgccgacaggaggcgacccagtgga

SEQ ID NO: 910038 - DNA, 25 bp, Mus musculus
cgccgacaggaggtacgagaggttc

SEQ ID NO: 910039 - DNA, 25 bp, Mus musculus
cgccgaccagatccttcgagtcacc

SEQ ID NO: 910040 - DNA, 25 bp, Mus musculus
cgccgaccagttccttcgagtcacc

SEQ ID NO: 910041 - DNA, 25 bp, Mus musculus
cgccgactgcggcacgatcctcctg

SEQ ID NO: 910042 - DNA, 25 bp, Mus musculus
cgccgactgcgggacgatcctcctg

SEQ ID NO: 910043 - DNA, 25 bp, Mus musculus
cgccgagagctccacatccatgatg

SEQ ID NO: 910044 - DNA, 25 bp, Mus musculus
cgccgagagctccagatccatgatg

SEQ ID NO: 910045 - DNA, 25 bp, Mus musculus
cgccgatcagcttaaagatcgaggt

SEQ ID NO: 910046 - DNA, 25 bp, Mus musculus
cgccgatcaggttaaagatcgaggt

SEQ ID NO: 910047 - DNA, 25 bp, Mus musculus
cgccgcaggcggaaagtatccatta

SEQ ID NO: 910048 - DNA, 25 bp, Mus musculus
cgccgcaggcggaatgtatccatta

SEQ ID NO: 910049 - DNA, 25 bp, Mus musculus
cgccgcagtgctgtttgcctacgtg

SEQ ID NO: 910050 - DNA, 25 bp, Mus musculus
cgccgcagtggtgtttgcctacgtg

SEQ ID NO: 910051 - DNA, 25 bp, Mus musculus
cgccgccaagcctgaagctgacgta

SEQ ID NO: 910052 - DNA, 25 bp, Mus musculus
cgccgccaaggctgaagctgacgta

SEQ ID NO: 910053 - DNA, 25 bp, Mus musculus
cgccgccaccatcagcgatcagcag

SEQ ID NO: 910054 - DNA, 25 bp, Mus musculus
cgccgccaccatgagcgatcagcag

SEQ ID NO: 910055 - DNA, 25 bp, Mus musculus
cgccgccagaaccatgccccatccc

SEQ ID NO: 910056 - DNA, 25 bp, Mus musculus
cgccgccagaacgatgccccatccc

SEQ ID NO: 910057 - DNA, 25 bp, Mus musculus
cgccgccagtgtcacgtcaattacc

SEQ ID NO: 910058 - DNA, 25 bp, Mus musculus
cgccgccagtgtcaggtcaattacc

SEQ ID NO: 910059 - DNA, 25 bp, Mus musculus
cgccgccatggactcctccaccttc

SEQ ID NO: 910060 - DNA, 25 bp, Mus musculus
cgccgccatggagtcctccaccttc

SEQ ID NO: 910061 - DNA, 25 bp, Mus musculus
cgccgcccgggctgcacatcatgcc

SEQ ID NO: 910062 - DNA, 25 bp, Mus musculus
cgccgcccgggctggacatcatgcc

SEQ ID NO: 910063 - DNA, 25 bp, Mus musculus
cgccgcctcacgcgccagcaggtgg

SEQ ID NO: 910064 - DNA, 25 bp, Mus musculus
cgccgcctcacgggccagcaggtgg

SEQ ID NO: 910065 - DNA, 25 bp, Mus musculus
cgccgcctgatcaacatgacagcat

SEQ ID NO: 910066 - DNA, 25 bp, Mus musculus
cgccgcctgatcaacttctcctact

SEQ ID NO: 910067 - DNA, 25 bp, Mus musculus
cgccgcctgatcaagatgacagcat

SEQ ID NO: 910068 - DNA, 25 bp, Mus musculus
cgccgcctgatcaagttctcctact

SEQ ID NO: 910069 - DNA, 25 bp, Mus musculus
cgccgccttgcccacgcagagaact

SEQ ID NO: 910070 - DNA, 25 bp, Mus musculus
cgccgccttgcccaggcagagaact

SEQ ID NO: 910071 - DNA, 25 bp, Mus musculus
cgccgcggagcacgcatggagagta

SEQ ID NO: 910072 - DNA, 25 bp, Mus musculus
cgccgcggagcaggcatggagagta

SEQ ID NO: 910073 - DNA, 25 bp, Mus musculus
cgccgcggagctctttggccagtat

SEQ ID NO: 910074 - DNA, 25 bp, Mus musculus
cgccgcggaggtctttggccagtat

SEQ ID NO: 910075 - DNA, 25 bp, Mus musculus
cgccgcggcccacgttaaatggaat

SEQ ID NO: 910076 - DNA, 25 bp, Mus musculus
cgccgcggcccaggttaaatggaat

SEQ ID NO: 910077 - DNA, 25 bp, Mus musculus
cgccgctgccggagattggcagact

SEQ ID NO: 910078 - DNA, 25 bp, Mus musculus
cgccgctgccggtgattggcagact

SEQ ID NO: 910079 - DNA, 25 bp, Mus musculus
cgccgctgtgagctacagtcatgtc

SEQ ID NO: 910080 - DNA, 25 bp, Mus musculus
cgccgctgtgaggtacagtcatgtc

SEQ ID NO: 910081 - DNA, 25 bp, Mus musculus
cgccgctttccctcagcagacacgc

SEQ ID NO: 910082 - DNA, 25 bp, Mus musculus
cgccgctttccctctgcagacacgc

SEQ ID NO: 910083 - DNA, 25 bp, Mus musculus
cgccggaagatgatgccagaccagt

SEQ ID NO: 910084 - DNA, 25 bp, Mus musculus
cgccggaagatgttgccagaccagt

SEQ ID NO: 910085 - DNA, 25 bp, Mus musculus
cgccggagccagttcaaccacatca

SEQ ID NO: 910086 - DNA, 25 bp, Mus musculus
cgccggagccagttgaaccacatca

SEQ ID NO: 910087 - DNA, 25 bp, Mus musculus
cgccggagctttcaacaaagagtgg

SEQ ID NO: 910088 - DNA, 25 bp, Mus musculus
cgccggagctttgaacaaagagtgg

SEQ ID NO: 910089 - DNA, 25 bp, Mus musculus
cgccggcaagcacaagggcgggtcc

SEQ ID NO: 910090 - DNA, 25 bp, Mus musculus
cgccggcaagcagaagggcgggtcc

SEQ ID NO: 910091 - DNA, 25 bp, Mus musculus
cgccggcatcctgtatatggaacac

SEQ ID NO: 910092 - DNA, 25 bp, Mus musculus
cgccggcatcctgtttatggaacac

SEQ ID NO: 910093 - DNA, 25 bp, Mus musculus
cgccggctcgctaacccacactcat

SEQ ID NO: 910094 - DNA, 25 bp, Mus musculus
cgccggctcgctaacccggctgccc

SEQ ID NO: 910095 - DNA, 25 bp, Mus musculus
cgccggctcgctaagccacactcat

SEQ ID NO: 910096 - DNA, 25 bp, Mus musculus
cgccggctcgctaagccggctgccc

SEQ ID NO: 910097 - DNA, 25 bp, Mus musculus
cgccgggaagagctcgcatttcagt

SEQ ID NO: 910098 - DNA, 25 bp, Mus musculus
cgccgggaagagctggcatttcagt

SEQ ID NO: 910099 - DNA, 25 bp, Mus musculus
cgccgggaggtccgcatgctgttga

SEQ ID NO: 910100 - DNA, 25 bp, Mus musculus
cgccgggaggtccggatgctgttga

SEQ ID NO: 910101 - DNA, 25 bp, Mus musculus
cgccggggcaagctctgttcactag

SEQ ID NO: 910102 - DNA, 25 bp, Mus musculus
cgccggggcaaggtctgttcactag

SEQ ID NO: 910103 - DNA, 25 bp, Mus musculus
cgccgtacacagcaattctttatgc

SEQ ID NO: 910104 - DNA, 25 bp, Mus musculus
cgccgtacacaggaattctttatgc

SEQ ID NO: 910105 - DNA, 25 bp, Mus musculus
cgccgtccaagacgccattgtgagc

SEQ ID NO: 910106 - DNA, 25 bp, Mus musculus
cgccgtccaagaggccattgtgagc

SEQ ID NO: 910107 - DNA, 25 bp, Mus musculus
cgccgtgccgcgcgagaggaaaagc

SEQ ID NO: 910108 - DNA, 25 bp, Mus musculus
cgccgtgccgcgcgtgtgccaggag

SEQ ID NO: 910109 - DNA, 25 bp, Mus musculus
cgccgtgccgcgggagaggaaaagc

SEQ ID NO: 910110 - DNA, 25 bp, Mus musculus
cgccgtgccgcgggtgtgccaggag

SEQ ID NO: 910111 - DNA, 25 bp, Mus musculus
cgccgtgcggcgagcagcaatgaat

SEQ ID NO: 910112 - DNA, 25 bp, Mus musculus
cgccgtgcggcgatagctgccccag

SEQ ID NO: 910113 - DNA, 25 bp, Mus musculus
cgccgtgcggggagcagcaatgaat

SEQ ID NO: 910114 - DNA, 25 bp, Mus musculus
cgccgtgcggggatagctgccccag

SEQ ID NO: 910115 - DNA, 25 bp, Mus musculus
cgccgtggacgacgtgtccacagaa

SEQ ID NO: 910116 - DNA, 25 bp, Mus musculus
cgccgtggacgaggtgtccacagaa

SEQ ID NO: 910117 - DNA, 25 bp, Mus musculus
cgccgtgggagcatcaacaatgaga

SEQ ID NO: 910118 - DNA, 25 bp, Mus musculus
cgccgtgggagcatgaacaatgaga

SEQ ID NO: 910119 - DNA, 25 bp, Mus musculus
cgcctacagcagcaagcccaatgct

SEQ ID NO: 910120 - DNA, 25 bp, Mus musculus
cgcctacagcaggaagcccaatgct

SEQ ID NO: 910121 - DNA, 25 bp, Mus musculus
cgcctatccacacatgctacggaac

SEQ ID NO: 910122 - DNA, 25 bp, Mus musculus
cgcctatccacagatgctacggaac

SEQ ID NO: 910123 - DNA, 25 bp, Mus musculus
cgcctatgagattaacccagaactg

SEQ ID NO: 910124 - DNA, 25 bp, Mus musculus
cgcctatgagtttaacccagaactg

SEQ ID NO: 910125 - DNA, 25 bp, Mus musculus
cgcctcaccaagctgtctctgaaga

SEQ ID NO: 910126 - DNA, 25 bp, Mus musculus
cgcctcaccaaggtgtctctgaaga

SEQ ID NO: 910127 - DNA, 25 bp, Mus musculus
cgcctcacggcccagcaggtggcca

SEQ ID NO: 910128 - DNA, 25 bp, Mus musculus
cgcctcacgggccagcaggtggcca

SEQ ID NO: 910129 - DNA, 25 bp, Mus musculus
cgcctcagagagtgttcagttccct

SEQ ID NO: 910130 - DNA, 25 bp, Mus musculus
cgcctcagagatccctggcagctca

SEQ ID NO: 910131 - DNA, 25 bp, Mus musculus
cgcctcagagctcgagcccagtgac

SEQ ID NO: 910132 - DNA, 25 bp, Mus musculus
cgcctcagagctggcatgcagatct

SEQ ID NO: 910133 - DNA, 25 bp, Mus musculus
cgcctcagaggtcgagcccagtgac

SEQ ID NO: 910134 - DNA, 25 bp, Mus musculus
cgcctcagaggtggcatgcagatct

SEQ ID NO: 910135 - DNA, 25 bp, Mus musculus
cgcctcagagtgtgttcagttccct

SEQ ID NO: 910136 - DNA, 25 bp, Mus musculus
cgcctcagagttccctggcagctca

SEQ ID NO: 910137 - DNA, 25 bp, Mus musculus
cgcctcatcgtgcattactcctgcg

SEQ ID NO: 910138 - DNA, 25 bp, Mus musculus
cgcctcatcgtggattactcctgcg

SEQ ID NO: 910139 - DNA, 25 bp, Mus musculus
cgcctccaccagctaaaaatagcaa

SEQ ID NO: 910140 - DNA, 25 bp, Mus musculus
cgcctccaccaggtaaaaatagcaa

SEQ ID NO: 910141 - DNA, 25 bp, Mus musculus
cgcctccacttcaacatcaaagatc

SEQ ID NO: 910142 - DNA, 25 bp, Mus musculus
cgcctccacttcaagatcaaagatc

SEQ ID NO: 910143 - DNA, 25 bp, Mus musculus
cgcctccagcagcgccctggtcaag

SEQ ID NO: 910144 - DNA, 25 bp, Mus musculus
cgcctccagcagggccctggtcaag

SEQ ID NO: 910145 - DNA, 25 bp, Mus musculus
cgcctccctactcacccctcctggt

SEQ ID NO: 910146 - DNA, 25 bp, Mus musculus
cgcctccctactcagccctcctggt

SEQ ID NO: 910147 - DNA, 25 bp, Mus musculus
cgcctcctcccagcctgaagctacc

SEQ ID NO: 910148 - DNA, 25 bp, Mus musculus
cgcctcctccgagcctgaagctacc

SEQ ID NO: 910149 - DNA, 25 bp, Mus musculus
cgcctccttgctacaggtacattca

SEQ ID NO: 910150 - DNA, 25 bp, Mus musculus
cgcctccttggtacaggtacattca

SEQ ID NO: 910151 - DNA, 25 bp, Mus musculus
cgcctctatgggtcccgggtctact

SEQ ID NO: 910152 - DNA, 25 bp, Mus musculus
cgcctctatgggtccgttccgggag

SEQ ID NO: 910153 - DNA, 25 bp, Mus musculus
cgcctctatgggtcgcgggtctact

SEQ ID NO: 910154 - DNA, 25 bp, Mus musculus
cgcctctatgggtcggttccgggag

SEQ ID NO: 910155 - DNA, 25 bp, Mus musculus
cgcctctcaaggatagacattagct

SEQ ID NO: 910156 - DNA, 25 bp, Mus musculus
cgcctctcaaggttagacattagct

SEQ ID NO: 910157 - DNA, 25 bp, Mus musculus
cgcctctcagagctcaggagctgtc

SEQ ID NO: 910158 - DNA, 25 bp, Mus musculus
cgcctctcagtgctcaggagctgtc

SEQ ID NO: 910159 - DNA, 25 bp, Mus musculus
cgcctctgacggcgcatatctgctg

SEQ ID NO: 910160 - DNA, 25 bp, Mus musculus
cgcctctgacggggcatatctgctg

SEQ ID NO: 910161 - DNA, 25 bp, Mus musculus
cgcctgacggagcacaagacccagc

SEQ ID NO: 910162 - DNA, 25 bp, Mus musculus
cgcctgacggagcacacccagcatg

SEQ ID NO: 910163 - DNA, 25 bp, Mus musculus
cgcctgacggagcacgcctgtctcg

SEQ ID NO: 910164 - DNA, 25 bp, Mus musculus
cgcctgacggagcagaagacccagc

SEQ ID NO: 910165 - DNA, 25 bp, Mus musculus
cgcctgacggagcagacccagcatg

SEQ ID NO: 910166 - DNA, 25 bp, Mus musculus
cgcctgacggagcaggcctgtctcg

SEQ ID NO: 910167 - DNA, 25 bp, Mus musculus
cgcctgagagctgactctgtcctct

SEQ ID NO: 910168 - DNA, 25 bp, Mus musculus
cgcctgagaggtgactctgtcctct

SEQ ID NO: 910169 - DNA, 25 bp, Mus musculus
cgcctgaggagccggaagaatgggc

SEQ ID NO: 910170 - DNA, 25 bp, Mus musculus
cgcctgaggagcgggaagaatgggc

SEQ ID NO: 910171 - DNA, 25 bp, Mus musculus
cgcctgatcaagatctcctactcag

SEQ ID NO: 910172 - DNA, 25 bp, Mus musculus
cgcctgatcaagatgacagcatgga

SEQ ID NO: 910173 - DNA, 25 bp, Mus musculus
cgcctgatcaagttctcctactcag

SEQ ID NO: 910174 - DNA, 25 bp, Mus musculus
cgcctgatcaagttgacagcatgga

SEQ ID NO: 910175 - DNA, 25 bp, Mus musculus
cgcctgcaactccgtcataaagcag

SEQ ID NO: 910176 - DNA, 25 bp, Mus musculus
cgcctgcaactcggtcataaagcag

SEQ ID NO: 910177 - DNA, 25 bp, Mus musculus
cgcctgcaagagtctcactttacag

SEQ ID NO: 910178 - DNA, 25 bp, Mus musculus
cgcctgcaagcttcctgctgctgtc

SEQ ID NO: 910179 - DNA, 25 bp, Mus musculus
cgcctgcaaggttcctgctgctgtc

SEQ ID NO: 910180 - DNA, 25 bp, Mus musculus
cgcctgcaagtgtctcactttacag

SEQ ID NO: 910181 - DNA, 25 bp, Mus musculus
cgcctgcactctgacagagaagctg

SEQ ID NO: 910182 - DNA, 25 bp, Mus musculus
cgcctgcactctgagagagaagctg

SEQ ID NO: 910183 - DNA, 25 bp, Mus musculus
cgcctgccgcagctggccatggcta

SEQ ID NO: 910184 - DNA, 25 bp, Mus musculus
cgcctgccgcaggtggccatggcta

SEQ ID NO: 910185 - DNA, 25 bp, Mus musculus
cgcctgccggctgacgagaaacaac

SEQ ID NO: 910186 - DNA, 25 bp, Mus musculus
cgcctgccggctgaggagaaacaac

SEQ ID NO: 910187 - DNA, 25 bp, Mus musculus
cgcctgcctgggcaatgaattccac

SEQ ID NO: 910188 - DNA, 25 bp, Mus musculus
cgcctgcctggggaatgaattccac

SEQ ID NO: 910189 - DNA, 25 bp, Mus musculus
cgcctgcgcgatgtagatcatggcc

SEQ ID NO: 910190 - DNA, 25 bp, Mus musculus
cgcctgcgcgttgtagatcatggcc

SEQ ID NO: 910191 - DNA, 25 bp, Mus musculus
cgcctgcgggcgcgcattgtgcctt

SEQ ID NO: 910192 - DNA, 25 bp, Mus musculus
cgcctgcgggcgcggattgtgcctt

SEQ ID NO: 910193 - DNA, 25 bp, Mus musculus
cgcctgcgtgacctgtcacgatgtc

SEQ ID NO: 910194 - DNA, 25 bp, Mus musculus
cgcctgcgtgacgtgtcacgatgtc

SEQ ID NO: 910195 - DNA, 25 bp, Mus musculus
cgcctgctcatgcaatttgacatct

SEQ ID NO: 910196 - DNA, 25 bp, Mus musculus
cgcctgctcatggaatttgacatct

SEQ ID NO: 910197 - DNA, 25 bp, Mus musculus
cgcctgctgagcacagactcagaaa

SEQ ID NO: 910198 - DNA, 25 bp, Mus musculus
cgcctgctgagcactgactcagaaa

SEQ ID NO: 910199 - DNA, 25 bp, Mus musculus
cgcctggccagtgaacttctagagt

SEQ ID NO: 910200 - DNA, 25 bp, Mus musculus
cgcctggccagtgatcttctagagt

SEQ ID NO: 910201 - DNA, 25 bp, Mus musculus
cgcctgggcaggcatccctgctgcc

SEQ ID NO: 910202 - DNA, 25 bp, Mus musculus
cgcctgggcagggatccctgctgcc

SEQ ID NO: 910203 - DNA, 25 bp, Mus musculus
cgcctggtcttgagggccgagtggt

SEQ ID NO: 910204 - DNA, 25 bp, Mus musculus
cgcctggtcttgtgggccgagtggt

SEQ ID NO: 910205 - DNA, 25 bp, Mus musculus
cgcctggtggagcacatggaaaaca

SEQ ID NO: 910206 - DNA, 25 bp, Mus musculus
cgcctggtggaggacatggaaaaca

SEQ ID NO: 910207 - DNA, 25 bp, Mus musculus
cgcctgtcaacacgctcaagtacat

SEQ ID NO: 910208 - DNA, 25 bp, Mus musculus
cgcctgtcaacaggctcaagtacat

SEQ ID NO: 910209 - DNA, 25 bp, Mus musculus
cgcctgtgcaagcagaacggcttag

SEQ ID NO: 910210 - DNA, 25 bp, Mus musculus
cgcctgtgcaaggagaacggcttag

SEQ ID NO: 910211 - DNA, 25 bp, Mus musculus
cgcctgtgcgcgaaggacctgtgtg

SEQ ID NO: 910212 - DNA, 25 bp, Mus musculus
cgcctgtgcgggaaggacctgtgtg

SEQ ID NO: 910213 - DNA, 25 bp, Mus musculus
cgcctgttgaagctttaccaggcac

SEQ ID NO: 910214 - DNA, 25 bp, Mus musculus
cgcctgttgaaggtttaccaggcac

SEQ ID NO: 910215 - DNA, 25 bp, Mus musculus
cgccttcaccagcgatgactctgtt

SEQ ID NO: 910216 - DNA, 25 bp, Mus musculus
cgccttcaccagggatgactctgtt

SEQ ID NO: 910217 - DNA, 25 bp, Mus musculus
cgccttccttcacgagaatattggg

SEQ ID NO: 910218 - DNA, 25 bp, Mus musculus
cgccttccttcaggagaatattggg

SEQ ID NO: 910219 - DNA, 25 bp, Mus musculus
cgccttcgccagatctcaggccgcc

SEQ ID NO: 910220 - DNA, 25 bp, Mus musculus
cgccttcgccagttctcaggccgcc

SEQ ID NO: 910221 - DNA, 25 bp, Mus musculus
cgccttgaagcctcagaagtacaac

SEQ ID NO: 910222 - DNA, 25 bp, Mus musculus
cgccttgaaggctcagaagtacaac

SEQ ID NO: 910223 - DNA, 25 bp, Mus musculus
cgccttgcacagagaagtgattgaa

SEQ ID NO: 910224 - DNA, 25 bp, Mus musculus
cgccttgcacagtgaagtgattgaa

SEQ ID NO: 910225 - DNA, 25 bp, Mus musculus
cgccttgcccagccagagaactctt

SEQ ID NO: 910226 - DNA, 25 bp, Mus musculus
cgccttgcccaggcagagaactctt

SEQ ID NO: 910227 - DNA, 25 bp, Mus musculus
cgcctttcaccacaaatacactgtg

SEQ ID NO: 910228 - DNA, 25 bp, Mus musculus
cgcctttcaccagaaatacactgtg

SEQ ID NO: 910229 - DNA, 25 bp, Mus musculus
cgcctttcctttcacgcctcagggc

SEQ ID NO: 910230 - DNA, 25 bp, Mus musculus
cgcctttcctttcaggcctcagggc

SEQ ID NO: 910231 - DNA, 25 bp, Mus musculus
cgcctttgtctgcaagcggcctctg

SEQ ID NO: 910232 - DNA, 25 bp, Mus musculus
cgcctttgtctggaagcggcctctg

SEQ ID NO: 910233 - DNA, 25 bp, Mus musculus
cgcgaagccaacaacggcagctctc

SEQ ID NO: 910234 - DNA, 25 bp, Mus musculus
cgcgaagccaacaagggcagctctc

SEQ ID NO: 910235 - DNA, 25 bp, Mus musculus
cgcgaagtctgtcattcgtaagaca

SEQ ID NO: 910236 - DNA, 25 bp, Mus musculus
cgcgaagtctgtgattcgtaagaca

SEQ ID NO: 910237 - DNA, 25 bp, Mus musculus
cgcgaccttccaccagcagcatgaa

SEQ ID NO: 910238 - DNA, 25 bp, Mus musculus
cgcgaccttccagcagcagcatgaa

SEQ ID NO: 910239 - DNA, 25 bp, Mus musculus
cgcgacgccgctgccttcgccggct

SEQ ID NO: 910240 - DNA, 25 bp, Mus musculus
cgcgacgccggtgccttcgccggct

SEQ ID NO: 910241 - DNA, 25 bp, Mus musculus
cgcgactccactgtatagaaaaact

SEQ ID NO: 910242 - DNA, 25 bp, Mus musculus
cgcgactccagtgtatagaaaaact

SEQ ID NO: 910243 - DNA, 25 bp, Mus musculus
cgcgagaacacttcaagggcagacg

SEQ ID NO: 910244 - DNA, 25 bp, Mus musculus
cgcgagaacagttcaagggcagacg

SEQ ID NO: 910245 - DNA, 25 bp, Mus musculus
cgcgagacagcgctgatgaagcctc

SEQ ID NO: 910246 - DNA, 25 bp, Mus musculus
cgcgagacagggctgatgaagcctc

SEQ ID NO: 910247 - DNA, 25 bp, Mus musculus
cgcgagatagcgctcgtctcctaga

SEQ ID NO: 910248 - DNA, 25 bp, Mus musculus
cgcgagatagcgctggtctcctaga

SEQ ID NO: 910249 - DNA, 25 bp, Mus musculus
cgcgaggtcttccaaagaaccaagc

SEQ ID NO: 910250 - DNA, 25 bp, Mus musculus
cgcgaggtcttccgccttcccagga

SEQ ID NO: 910251 - DNA, 25 bp, Mus musculus
cgcgaggtcttcgaaagaaccaagc

SEQ ID NO: 910252 - DNA, 25 bp, Mus musculus
cgcgaggtcttcggccttcccagga

SEQ ID NO: 910253 - DNA, 25 bp, Mus musculus
cgcgagtagcagcaggcgtccggtc

SEQ ID NO: 910254 - DNA, 25 bp, Mus musculus
cgcgagtagcaggaggcgtccggtc

SEQ ID NO: 910255 - DNA, 25 bp, Mus musculus
cgcgagtgcgagattaagtacacgg

SEQ ID NO: 910256 - DNA, 25 bp, Mus musculus
cgcgagtgcgagtttaagtacacgg

SEQ ID NO: 910257 - DNA, 25 bp, Mus musculus
cgcgatgaggctgcccggaccaatg

SEQ ID NO: 910258 - DNA, 25 bp, Mus musculus
cgcgatgagggtgcccggaccaatg

SEQ ID NO: 910259 - DNA, 25 bp, Mus musculus
cgcgattatcagaatccctctgcgc

SEQ ID NO: 910260 - DNA, 25 bp, Mus musculus
cgcgattatcagagtccagtagagg

SEQ ID NO: 910261 - DNA, 25 bp, Mus musculus
cgcgattatcagtatccctctgcgc

SEQ ID NO: 910262 - DNA, 25 bp, Mus musculus
cgcgattatcagtgtccagtagagg

SEQ ID NO: 910263 - DNA, 25 bp, Mus musculus
cgcgcaagtctccgtagtggttcca

SEQ ID NO: 910264 - DNA, 25 bp, Mus musculus
cgcgcaagtctcggtagtggttcca

SEQ ID NO: 910265 - DNA, 25 bp, Mus musculus
cgcgcaccagcattctcgtgtggac

SEQ ID NO: 910266 - DNA, 25 bp, Mus musculus
cgcgcaccaggattctcgtgtggac

SEQ ID NO: 910267 - DNA, 25 bp, Mus musculus
cgcgcacggctccacaaagatgaca

SEQ ID NO: 910268 - DNA, 25 bp, Mus musculus
cgcgcacggctccagaaagatgaca

SEQ ID NO: 910269 - DNA, 25 bp, Mus musculus
cgcgcagcagcatggctgacctgct

SEQ ID NO: 910270 - DNA, 25 bp, Mus musculus
cgcgcagcaggatggctgacctgct

SEQ ID NO: 910271 - DNA, 25 bp, Mus musculus
cgcgcagcggaacaaatggcaaaat

SEQ ID NO: 910272 - DNA, 25 bp, Mus musculus
cgcgcagcggaagaaatggcaaaat

SEQ ID NO: 910273 - DNA, 25 bp, Mus musculus
cgcgccgcggccttagaagaaatct

SEQ ID NO: 910274 - DNA, 25 bp, Mus musculus
cgcgccgcggctccatgttctacga

SEQ ID NO: 910275 - DNA, 25 bp, Mus musculus
cgcgccgcgggcttagaagaaatct

SEQ ID NO: 910276 - DNA, 25 bp, Mus musculus
cgcgccgcgggtccatgttctacga

SEQ ID NO: 910277 - DNA, 25 bp, Mus musculus
cgcgcctcagagactgagcggctgc

SEQ ID NO: 910278 - DNA, 25 bp, Mus musculus
cgcgcctcagtgactgagcggctgc

SEQ ID NO: 910279 - DNA, 25 bp, Mus musculus
cgcgcctctcagagctcaggagctg

SEQ ID NO: 910280 - DNA, 25 bp, Mus musculus
cgcgcctctcagtgctcaggagctg

SEQ ID NO: 910281 - DNA, 25 bp, Mus musculus
cgcgcctgtcaacacgctcaagtac

SEQ ID NO: 910282 - DNA, 25 bp, Mus musculus
cgcgcctgtcaacaggctcaagtac

SEQ ID NO: 910283 - DNA, 25 bp, Mus musculus
cgcgcgagaacctcgcgctgtatgt

SEQ ID NO: 910284 - DNA, 25 bp, Mus musculus
cgcgcgagaagctcgcgctgtatgt

SEQ ID NO: 910285 - DNA, 25 bp, Mus musculus
cgcgcgcaagtctccgtagtggttc

SEQ ID NO: 910286 - DNA, 25 bp, Mus musculus
cgcgcgcaagtctcggtagtggttc

SEQ ID NO: 910287 - DNA, 25 bp, Mus musculus
cgcgcgcagcggaacaaatggcaaa

SEQ ID NO: 910288 - DNA, 25 bp, Mus musculus
cgcgcgcagcggaagaaatggcaaa

SEQ ID NO: 910289 - DNA, 25 bp, Mus musculus
cgcgcgcgggctgctgtgagtggct

SEQ ID NO: 910290 - DNA, 25 bp, Mus musculus
cgcgcgcggggtgctgtgagtggct

SEQ ID NO: 910291 - DNA, 25 bp, Mus musculus
cgcgcgctgctggacgacagagaaa

SEQ ID NO: 910292 - DNA, 25 bp, Mus musculus
cgcgcgctgctggaggacagagaaa

SEQ ID NO: 910293 - DNA, 25 bp, Mus musculus
cgcgcggacccacagtgcttgggat

SEQ ID NO: 910294 - DNA, 25 bp, Mus musculus
cgcgcggacccagagtgcttgggat

SEQ ID NO: 910295 - DNA, 25 bp, Mus musculus
cgcgcggagcagactgtcgctaacc

SEQ ID NO: 910296 - DNA, 25 bp, Mus musculus
cgcgcggagcagccctctctatagc

SEQ ID NO: 910297 - DNA, 25 bp, Mus musculus
cgcgcggagcaggcctctctatagc

SEQ ID NO: 910298 - DNA, 25 bp, Mus musculus
cgcgcggagcagtctgtcgctaacc

SEQ ID NO: 910299 - DNA, 25 bp, Mus musculus
cgcgcggccatgcagcagctgaagg

SEQ ID NO: 910300 - DNA, 25 bp, Mus musculus
cgcgcggccatggagcagctgaagg

SEQ ID NO: 910301 - DNA, 25 bp, Mus musculus
cgcgcggggaagagtcttgcgctca

SEQ ID NO: 910302 - DNA, 25 bp, Mus musculus
cgcgcggggaagtgtcttgcgctca

SEQ ID NO: 910303 - DNA, 25 bp, Mus musculus
cgcgcggtgactcggatactttgca

SEQ ID NO: 910304 - DNA, 25 bp, Mus musculus
cgcgcggtgactgggatactttgca

SEQ ID NO: 910305 - DNA, 25 bp, Mus musculus
cgcgcggttggagacagtgtgaaca

SEQ ID NO: 910306 - DNA, 25 bp, Mus musculus
cgcgcggttggagagagtgtgaaca

SEQ ID NO: 910307 - DNA, 25 bp, Mus musculus
cgcgcgtgcccgccctgccgcctat

SEQ ID NO: 910308 - DNA, 25 bp, Mus musculus
cgcgcgtgcccggcctgccgcctat

SEQ ID NO: 910309 - DNA, 25 bp, Mus musculus
cgcgctaaaaatccttgtttctggg

SEQ ID NO: 910310 - DNA, 25 bp, Mus musculus
cgcgctaaaaatgcttgtttctggg

SEQ ID NO: 910311 - DNA, 25 bp, Mus musculus
cgcgctcaaccacgtggatgtgtgg

SEQ ID NO: 910312 - DNA, 25 bp, Mus musculus
cgcgctcaaccaggtggatgtgtgg

SEQ ID NO: 910313 - DNA, 25 bp, Mus musculus
cgcgctgctggacgacagagaaaaa

SEQ ID NO: 910314 - DNA, 25 bp, Mus musculus
cgcgctgctggaggacagagaaaaa

SEQ ID NO: 910315 - DNA, 25 bp, Mus musculus
cgcgcttgcgagctgataggaaata

SEQ ID NO: 910316 - DNA, 25 bp, Mus musculus
cgcgcttgcgaggtgataggaaata

SEQ ID NO: 910317 - DNA, 25 bp, Mus musculus
cgcgcttggcagagccagacatcag

SEQ ID NO: 910318 - DNA, 25 bp, Mus musculus
cgcgcttggcagtgccagacatcag

SEQ ID NO: 910319 - DNA, 25 bp, Mus musculus
cgcggagaagctcatcgattatgga

SEQ ID NO: 910320 - DNA, 25 bp, Mus musculus
cgcggagaaggtcatcgattatgga

SEQ ID NO: 910321 - DNA, 25 bp, Mus musculus
cgcggagagcggacccgtaggcctc

SEQ ID NO: 910322 - DNA, 25 bp, Mus musculus
cgcggagagcggtcccgtaggcctc

SEQ ID NO: 910323 - DNA, 25 bp, Mus musculus
cgcggagcagactgtcgctaaccat

SEQ ID NO: 910324 - DNA, 25 bp, Mus musculus
cgcggagcagccatggagagtagaa

SEQ ID NO: 910325 - DNA, 25 bp, Mus musculus
cgcggagcagccctctctatagcct

SEQ ID NO: 910326 - DNA, 25 bp, Mus musculus
cgcggagcaggcatggagagtagaa

SEQ ID NO: 910327 - DNA, 25 bp, Mus musculus
cgcggagcaggcctctctatagcct

SEQ ID NO: 910328 - DNA, 25 bp, Mus musculus
cgcggagcagtctgtcgctaaccat

SEQ ID NO: 910329 - DNA, 25 bp, Mus musculus
cgcggagggccgcaacaccaagaag

SEQ ID NO: 910330 - DNA, 25 bp, Mus musculus
cgcggagggccggaacaccaagaag

SEQ ID NO: 910331 - DNA, 25 bp, Mus musculus
cgcggagtccagacaccacaggctc

SEQ ID NO: 910332 - DNA, 25 bp, Mus musculus
cgcggagtccagtcaccacaggctc

SEQ ID NO: 910333 - DNA, 25 bp, Mus musculus
cgcggatccgcatttgcaggcccaa

SEQ ID NO: 910334 - DNA, 25 bp, Mus musculus
cgcggatccggatttgcaggcccaa

SEQ ID NO: 910335 - DNA, 25 bp, Mus musculus
cgcggcaatgcacagggaggagaag

SEQ ID NO: 910336 - DNA, 25 bp, Mus musculus
cgcggcaatgcagagggaggagaag

SEQ ID NO: 910337 - DNA, 25 bp, Mus musculus
cgcggcagagcacaccattaagcac

SEQ ID NO: 910338 - DNA, 25 bp, Mus musculus
cgcggcagagcagaccattaagcac

SEQ ID NO: 910339 - DNA, 25 bp, Mus musculus
cgcggcaggctcagcccaccccaca

SEQ ID NO: 910340 - DNA, 25 bp, Mus musculus
cgcggcaggctcagcctaccgagtc

SEQ ID NO: 910341 - DNA, 25 bp, Mus musculus
cgcggcaggctcaggccaccccaca

SEQ ID NO: 910342 - DNA, 25 bp, Mus musculus
cgcggcaggctcaggctaccgagtc

SEQ ID NO: 910343 - DNA, 25 bp, Mus musculus
cgcggcatagcccttcagaagtatt

SEQ ID NO: 910344 - DNA, 25 bp, Mus musculus
cgcggcataggccttcagaagtatt

SEQ ID NO: 910345 - DNA, 25 bp, Mus musculus
cgcggccagactctggaaataaagc

SEQ ID NO: 910346 - DNA, 25 bp, Mus musculus
cgcggccagagtctggaaataaagc

SEQ ID NO: 910347 - DNA, 25 bp, Mus musculus
cgcggccagatccacggctttgcag

SEQ ID NO: 910348 - DNA, 25 bp, Mus musculus
cgcggccagatccagggctttgcag

SEQ ID NO: 910349 - DNA, 25 bp, Mus musculus
cgcggccatgaaccatgtctgctgt

SEQ ID NO: 910350 - DNA, 25 bp, Mus musculus
cgcggccatgaacgcgggtgctact

SEQ ID NO: 910351 - DNA, 25 bp, Mus musculus
cgcggccatgaagcatgtctgctgt

SEQ ID NO: 910352 - DNA, 25 bp, Mus musculus
cgcggccatgaaggcgggtgctact

SEQ ID NO: 910353 - DNA, 25 bp, Mus musculus
cgcggccatgcagcagctgaaggcc

SEQ ID NO: 910354 - DNA, 25 bp, Mus musculus
cgcggccatggagcagctgaaggcc

SEQ ID NO: 910355 - DNA, 25 bp, Mus musculus
cgcggcccagcttaaatggaatcca

SEQ ID NO: 910356 - DNA, 25 bp, Mus musculus
cgcggcccaggttaaatggaatcca

SEQ ID NO: 910357 - DNA, 25 bp, Mus musculus
cgcggccctgcacatcaccagcaaa

SEQ ID NO: 910358 - DNA, 25 bp, Mus musculus
cgcggccctgcacgagtgactagca

SEQ ID NO: 910359 - DNA, 25 bp, Mus musculus
cgcggccctgcagatcaccagcaaa

SEQ ID NO: 910360 - DNA, 25 bp, Mus musculus
cgcggccctgcaggagtgactagca

SEQ ID NO: 910361 - DNA, 25 bp, Mus musculus
cgcggccgtgcagttggaattgatc

SEQ ID NO: 910362 - DNA, 25 bp, Mus musculus
cgcggccgtggagttggaattgatc

SEQ ID NO: 910363 - DNA, 25 bp, Mus musculus
cgcggcctgtgacggtcaaagcttg

SEQ ID NO: 910364 - DNA, 25 bp, Mus musculus
cgcggcctgtgagggtcaaagcttg

SEQ ID NO: 910365 - DNA, 25 bp, Mus musculus
cgcggccttgacgacatgctgttgg

SEQ ID NO: 910366 - DNA, 25 bp, Mus musculus
cgcggccttgacgacgggatgagag

SEQ ID NO: 910367 - DNA, 25 bp, Mus musculus
cgcggccttgacgagatgctgttgg

SEQ ID NO: 910368 - DNA, 25 bp, Mus musculus
cgcggccttgacgaggggatgagag

SEQ ID NO: 910369 - DNA, 25 bp, Mus musculus
cgcggcgcggagacacattagcttt

SEQ ID NO: 910370 - DNA, 25 bp, Mus musculus
cgcggcgcggagcttagcagatcat

SEQ ID NO: 910371 - DNA, 25 bp, Mus musculus
cgcggcgcggaggttagcagatcat

SEQ ID NO: 910372 - DNA, 25 bp, Mus musculus
cgcggcgcggagtcacattagcttt

SEQ ID NO: 910373 - DNA, 25 bp, Mus musculus
cgcggcggcccgacgctgcggccag

SEQ ID NO: 910374 - DNA, 25 bp, Mus musculus
cgcggcggcccgtcgctgcggccag

SEQ ID NO: 910375 - DNA, 25 bp, Mus musculus
cgcggcggcgcccgtgccaagtgct

SEQ ID NO: 910376 - DNA, 25 bp, Mus musculus
cgcggcggcgccggtgccaagtgct

SEQ ID NO: 910377 - DNA, 25 bp, Mus musculus
cgcggctacgagcacgtggacatcc

SEQ ID NO: 910378 - DNA, 25 bp, Mus musculus
cgcggctacgaggacgtggacatcc

SEQ ID NO: 910379 - DNA, 25 bp, Mus musculus
cgcggctacggcttcgtgaccatgg

SEQ ID NO: 910380 - DNA, 25 bp, Mus musculus
cgcggctacggcttggtgaccatgg

SEQ ID NO: 910381 - DNA, 25 bp, Mus musculus
cgcggctctcaaccagaaaaatggc

SEQ ID NO: 910382 - DNA, 25 bp, Mus musculus
cgcggctctcaacgaggccaaagca

SEQ ID NO: 910383 - DNA, 25 bp, Mus musculus
cgcggctctcaagcagaaaaatggc

SEQ ID NO: 910384 - DNA, 25 bp, Mus musculus
cgcggctctcaaggaggccaaagca

SEQ ID NO: 910385 - DNA, 25 bp, Mus musculus
cgcgggaaagagtccagcctctgaa

SEQ ID NO: 910386 - DNA, 25 bp, Mus musculus
cgcgggaaagcataaagcatcagac

SEQ ID NO: 910387 - DNA, 25 bp, Mus musculus
cgcgggaaaggataaagcatcagac

SEQ ID NO: 910388 - DNA, 25 bp, Mus musculus
cgcgggaaagtgtccagcctctgaa

SEQ ID NO: 910389 - DNA, 25 bp, Mus musculus
cgcgggagatggaggtcctggcaac

SEQ ID NO: 910390 - DNA, 25 bp, Mus musculus
cgcgggagatggtggtcctggcaac

SEQ ID NO: 910391 - DNA, 25 bp, Mus musculus
cgcgggattccgctcacagtttgca

SEQ ID NO: 910392 - DNA, 25 bp, Mus musculus
cgcgggattccggtcacagtttgca

SEQ ID NO: 910393 - DNA, 25 bp, Mus musculus
cgcgggcctgagcgtacctgaagct

SEQ ID NO: 910394 - DNA, 25 bp, Mus musculus
cgcgggcctgagggtacctgaagct

SEQ ID NO: 910395 - DNA, 25 bp, Mus musculus
cgcgggctccagaggcgtccggtcg

SEQ ID NO: 910396 - DNA, 25 bp, Mus musculus
cgcgggctccagtggcgtccggtcg

SEQ ID NO: 910397 - DNA, 25 bp, Mus musculus
cgcgggcttcagagctggaggaggc

SEQ ID NO: 910398 - DNA, 25 bp, Mus musculus
cgcgggcttcagctagaagccactc

SEQ ID NO: 910399 - DNA, 25 bp, Mus musculus
cgcgggcttcagctgaggatcccat

SEQ ID NO: 910400 - DNA, 25 bp, Mus musculus
cgcgggcttcaggtagaagccactc

SEQ ID NO: 910401 - DNA, 25 bp, Mus musculus
cgcgggcttcaggtgaggatcccat

SEQ ID NO: 910402 - DNA, 25 bp, Mus musculus
cgcgggcttcagtgctggaggaggc

SEQ ID NO: 910403 - DNA, 25 bp, Mus musculus
cgcggggaagagtcttgcgctcagg

SEQ ID NO: 910404 - DNA, 25 bp, Mus musculus
cgcggggaagtgtcttgcgctcagg

SEQ ID NO: 910405 - DNA, 25 bp, Mus musculus
cgcggggactggacacctgggctgt

SEQ ID NO: 910406 - DNA, 25 bp, Mus musculus
cgcggggactggtcacctgggctgt

SEQ ID NO: 910407 - DNA, 25 bp, Mus musculus
cgcggggatcagcgcagagatggcc

SEQ ID NO: 910408 - DNA, 25 bp, Mus musculus
cgcggggatcagggcagagatggcc

SEQ ID NO: 910409 - DNA, 25 bp, Mus musculus
cgcggggatcgagacgcattcgagg

SEQ ID NO: 910410 - DNA, 25 bp, Mus musculus
cgcggggatcgagaggcattcgagg

SEQ ID NO: 910411 - DNA, 25 bp, Mus musculus
cgcggggcgtggcattgaagtgagt

SEQ ID NO: 910412 - DNA, 25 bp, Mus musculus
cgcggggcgtgggattgaagtgagt

SEQ ID NO: 910413 - DNA, 25 bp, Mus musculus
cgcgggtagccaccgagcacctgtg

SEQ ID NO: 910414 - DNA, 25 bp, Mus musculus
cgcgggtagccagcgagcacctgtg

SEQ ID NO: 910415 - DNA, 25 bp, Mus musculus
cgcgggtcatggaccggcaccacgg

SEQ ID NO: 910416 - DNA, 25 bp, Mus musculus
cgcgggtcatggtccggcaccacgg

SEQ ID NO: 910417 - DNA, 25 bp, Mus musculus
cgcggtagcggtcaacgctgttgct

SEQ ID NO: 910418 - DNA, 25 bp, Mus musculus
cgcggtagcggtcccttctctccgt

SEQ ID NO: 910419 - DNA, 25 bp, Mus musculus
cgcggtagcggtcggtgtcaccgaa

SEQ ID NO: 910420 - DNA, 25 bp, Mus musculus
cgcggtagcggtctatgtgggatcc

SEQ ID NO: 910421 - DNA, 25 bp, Mus musculus
cgcggtagcggtgaacgctgttgct

SEQ ID NO: 910422 - DNA, 25 bp, Mus musculus
cgcggtagcggtgccttctctccgt

SEQ ID NO: 910423 - DNA, 25 bp, Mus musculus
cgcggtagcggtgggtgtcaccgaa

SEQ ID NO: 910424 - DNA, 25 bp, Mus musculus
cgcggtagcggtgtatgtgggatcc

SEQ ID NO: 910425 - DNA, 25 bp, Mus musculus
cgcggtcaagaaaggctctggagct

SEQ ID NO: 910426 - DNA, 25 bp, Mus musculus
cgcggtcaagcatcatctgcttcgg

SEQ ID NO: 910427 - DNA, 25 bp, Mus musculus
cgcggtcaaggatcatctgcttcgg

SEQ ID NO: 910428 - DNA, 25 bp, Mus musculus
cgcggtcaagtaaggctctggagct

SEQ ID NO: 910429 - DNA, 25 bp, Mus musculus
cgcggtcaatggacagcaagatcca

SEQ ID NO: 910430 - DNA, 25 bp, Mus musculus
cgcggtcaatggtcagcaagatcca

SEQ ID NO: 910431 - DNA, 25 bp, Mus musculus
cgcggtgcaggactcggctacacag

SEQ ID NO: 910432 - DNA, 25 bp, Mus musculus
cgcggtgcaggactcggctacgcag

SEQ ID NO: 910433 - DNA, 25 bp, Mus musculus
cgcggtgcaggactgggctacacag

SEQ ID NO: 910434 - DNA, 25 bp, Mus musculus
cgcggtgcaggactgggctacgcag

SEQ ID NO: 910435 - DNA, 25 bp, Mus musculus
cgcggttggagacagtgtgaacatg

SEQ ID NO: 910436 - DNA, 25 bp, Mus musculus
cgcggttggagagagtgtgaacatg

SEQ ID NO: 910437 - DNA, 25 bp, Mus musculus
cgcgtactgccagtcggaagatctt

SEQ ID NO: 910438 - DNA, 25 bp, Mus musculus
cgcgtactgccagtgggaagatctt

SEQ ID NO: 910439 - DNA, 25 bp, Mus musculus
cgcgtcaacactcggctgcatggcc

SEQ ID NO: 910440 - DNA, 25 bp, Mus musculus
cgcgtcaacactgggctgcatggcc

SEQ ID NO: 910441 - DNA, 25 bp, Mus musculus
cgcgtcatggggcttaattcctata

SEQ ID NO: 910442 - DNA, 25 bp, Mus musculus
cgcgtcatgggggttaattcctata

SEQ ID NO: 910443 - DNA, 25 bp, Mus musculus
cgcgtcattatcaactgccctacct

SEQ ID NO: 910444 - DNA, 25 bp, Mus musculus
cgcgtcattatcaagtgccctacct

SEQ ID NO: 910445 - DNA, 25 bp, Mus musculus
cgcgtccgggagatctctgggctag

SEQ ID NO: 910446 - DNA, 25 bp, Mus musculus
cgcgtccgggtgatctctgggctag

SEQ ID NO: 910447 - DNA, 25 bp, Mus musculus
cgcgtcgtgtcttgcgtcttctcca

SEQ ID NO: 910448 - DNA, 25 bp, Mus musculus
cgcgtcgtgtcttgggtcttctcca

SEQ ID NO: 910449 - DNA, 25 bp, Mus musculus
cgcgtctccttcgacctgtttgcag

SEQ ID NO: 910450 - DNA, 25 bp, Mus musculus
cgcgtctccttcgagctgtttgcag

SEQ ID NO: 910451 - DNA, 25 bp, Mus musculus
cgcgtgcgccgcaacgtacctgcgc

SEQ ID NO: 910452 - DNA, 25 bp, Mus musculus
cgcgtgcgccgcaaggtacctgcgc

SEQ ID NO: 910453 - DNA, 25 bp, Mus musculus
cgcgtgcgggtgaggtacaagctgg

SEQ ID NO: 910454 - DNA, 25 bp, Mus musculus
cgcgtgcgggtgtggtacaagctgg

SEQ ID NO: 910455 - DNA, 25 bp, Mus musculus
cgcgtggaagctttgaaccagaaga

SEQ ID NO: 910456 - DNA, 25 bp, Mus musculus
cgcgtggaaggtttgaaccagaaga

SEQ ID NO: 910457 - DNA, 25 bp, Mus musculus
cgcgtggatcggcgcttcattacag

SEQ ID NO: 910458 - DNA, 25 bp, Mus musculus
cgcgtggatcggcggttcattacag

SEQ ID NO: 910459 - DNA, 25 bp, Mus musculus
cgcgtggattggcccgctatggggc

SEQ ID NO: 910460 - DNA, 25 bp, Mus musculus
cgcgtggattggccggctatggggc

SEQ ID NO: 910461 - DNA, 25 bp, Mus musculus
cgcgtggtgctggacgtgtcctgtc

SEQ ID NO: 910462 - DNA, 25 bp, Mus musculus
cgcgtggtgctggacttaaaggcag

SEQ ID NO: 910463 - DNA, 25 bp, Mus musculus
cgcgtggtgctggaggtgtcctgtc

SEQ ID NO: 910464 - DNA, 25 bp, Mus musculus
cgcgtggtgctggagttaaaggcag

SEQ ID NO: 910465 - DNA, 25 bp, Mus musculus
cgctaaaaatccttgtttctggggc

SEQ ID NO: 910466 - DNA, 25 bp, Mus musculus
cgctaaaaatgcttgtttctggggc

SEQ ID NO: 910467 - DNA, 25 bp, Mus musculus
cgctaaactttgagacttgcactaa

SEQ ID NO: 910468 - DNA, 25 bp, Mus musculus
cgctaaactttgtgacttgcactaa

SEQ ID NO: 910469 - DNA, 25 bp, Mus musculus
cgctaacttacacagttgagtggcc

SEQ ID NO: 910470 - DNA, 25 bp, Mus musculus
cgctaacttacagagttgagtggcc

SEQ ID NO: 910471 - DNA, 25 bp, Mus musculus
cgctaatgacaaaacgctgcagcaa

SEQ ID NO: 910472 - DNA, 25 bp, Mus musculus
cgctaatgacaaaaggctgcagcaa

SEQ ID NO: 910473 - DNA, 25 bp, Mus musculus
cgctacacaggacatcatgcctatg

SEQ ID NO: 910474 - DNA, 25 bp, Mus musculus
cgctacacaggagatcatgcctatg

SEQ ID NO: 910475 - DNA, 25 bp, Mus musculus
cgctacactctactctgggaagtgc

SEQ ID NO: 910476 - DNA, 25 bp, Mus musculus
cgctacactctactgtgggaagtgc

SEQ ID NO: 910477 - DNA, 25 bp, Mus musculus
cgctacatcgtggtcgacagtgaac

SEQ ID NO: 910478 - DNA, 25 bp, Mus musculus
cgctacatcgtggtctatgttgtat

SEQ ID NO: 910479 - DNA, 25 bp, Mus musculus
cgctacatcgtggtggacagtgaac

SEQ ID NO: 910480 - DNA, 25 bp, Mus musculus
cgctacatcgtggtgtatgttgtat

SEQ ID NO: 910481 - DNA, 25 bp, Mus musculus
cgctacctctcacgcccaagctgga

SEQ ID NO: 910482 - DNA, 25 bp, Mus musculus
cgctacctctcaggcccaagctgga

SEQ ID NO: 910483 - DNA, 25 bp, Mus musculus
cgctacctggttttcttcaacaaca

SEQ ID NO: 910484 - DNA, 25 bp, Mus musculus
cgctacctggttttgttcaacaaca

SEQ ID NO: 910485 - DNA, 25 bp, Mus musculus
cgctacgtcatccgcattgaccagg

SEQ ID NO: 910486 - DNA, 25 bp, Mus musculus
cgctacgtcatccggattgaccagg

SEQ ID NO: 910487 - DNA, 25 bp, Mus musculus
cgctactatgaccacgcagaagatg

SEQ ID NO: 910488 - DNA, 25 bp, Mus musculus
cgctactatgaccaggcagaagatg

SEQ ID NO: 910489 - DNA, 25 bp, Mus musculus
cgctactgtgttcatgtgaacgagt

SEQ ID NO: 910490 - DNA, 25 bp, Mus musculus
cgctactgtgttgatgtgaacgagt

SEQ ID NO: 910491 - DNA, 25 bp, Mus musculus
cgctacttagccccaaccatactta

SEQ ID NO: 910492 - DNA, 25 bp, Mus musculus
cgctacttagctgatgcaagaagaa

SEQ ID NO: 910493 - DNA, 25 bp, Mus musculus
cgctacttaggcccaaccatactta

SEQ ID NO: 910494 - DNA, 25 bp, Mus musculus
cgctacttaggtgatgcaagaagaa

SEQ ID NO: 910495 - DNA, 25 bp, Mus musculus
cgctacttatcaactgtatgtggaa

SEQ ID NO: 910496 - DNA, 25 bp, Mus musculus
cgctacttatcatctgtatgtggaa

SEQ ID NO: 910497 - DNA, 25 bp, Mus musculus
cgctagaagtttatcatttgattcg

SEQ ID NO: 910498 - DNA, 25 bp, Mus musculus
cgctagaagtttatgatttgattcg

SEQ ID NO: 910499 - DNA, 25 bp, Mus musculus
cgctatccagcttgtcatttcaaaa

SEQ ID NO: 910500 - DNA, 25 bp, Mus musculus
cgctatccaggttgtcatttcaaaa

SEQ ID NO: 910501 - DNA, 25 bp, Mus musculus
cgctatgaccttacagtcccttttg

SEQ ID NO: 910502 - DNA, 25 bp, Mus musculus
cgctatgaccttactgtcccttttg

SEQ ID NO: 910503 - DNA, 25 bp, Mus musculus
cgctatgggtcacgtagtgggcagc

SEQ ID NO: 910504 - DNA, 25 bp, Mus musculus
cgctatgggtcaggtagtgggcagc

SEQ ID NO: 910505 - DNA, 25 bp, Mus musculus
cgctattgggccttctatgtgggga

SEQ ID NO: 910506 - DNA, 25 bp, Mus musculus
cgctattggggcttctatgtgggga

SEQ ID NO: 910507 - DNA, 25 bp, Mus musculus
cgctatttgcagcaccacattaaat

SEQ ID NO: 910508 - DNA, 25 bp, Mus musculus
cgctatttgcaggaccacattaaat

SEQ ID NO: 910509 - DNA, 25 bp, Mus musculus
cgctcaaacacacctcaaagattag

SEQ ID NO: 910510 - DNA, 25 bp, Mus musculus
cgctcaaacacagctcaaagattag

SEQ ID NO: 910511 - DNA, 25 bp, Mus musculus
cgctcaagtcaacagatatgatcat

SEQ ID NO: 910512 - DNA, 25 bp, Mus musculus
cgctcaagtcaagagatatgatcat

SEQ ID NO: 910513 - DNA, 25 bp, Mus musculus
cgctcaatcttatccgcaaagctaa

SEQ ID NO: 910514 - DNA, 25 bp, Mus musculus
cgctcaatcttatcggcaaagctaa

SEQ ID NO: 910515 - DNA, 25 bp, Mus musculus
cgctcacaggcttaagcgagatgta

SEQ ID NO: 910516 - DNA, 25 bp, Mus musculus
cgctcacagggttaagcgagatgta

SEQ ID NO: 910517 - DNA, 25 bp, Mus musculus
cgctcaccaaagctactcgttttgg

SEQ ID NO: 910518 - DNA, 25 bp, Mus musculus
cgctcaccaaaggtactcgttttgg

SEQ ID NO: 910519 - DNA, 25 bp, Mus musculus
cgctcaccagtcatcaggagaaccc

SEQ ID NO: 910520 - DNA, 25 bp, Mus musculus
cgctcaccagtcatgaggagaaccc

SEQ ID NO: 910521 - DNA, 25 bp, Mus musculus
cgctcaccctcacgaaaggcgggaa

SEQ ID NO: 910522 - DNA, 25 bp, Mus musculus
cgctcaccctcaggaaaggcgggaa

SEQ ID NO: 910523 - DNA, 25 bp, Mus musculus
cgctcactcgatcaatgagctcagc

SEQ ID NO: 910524 - DNA, 25 bp, Mus musculus
cgctcactcgttcaatgagctcagc

SEQ ID NO: 910525 - DNA, 25 bp, Mus musculus
cgctcagaacagcatcccctacccc

SEQ ID NO: 910526 - DNA, 25 bp, Mus musculus
cgctcagaacagctcttcacatgct

SEQ ID NO: 910527 - DNA, 25 bp, Mus musculus
cgctcagaacaggatcccctacccc

SEQ ID NO: 910528 - DNA, 25 bp, Mus musculus
cgctcagaacaggtcttcacatgct

SEQ ID NO: 910529 - DNA, 25 bp, Mus musculus
cgctcagaagaaggcctgagctgta

SEQ ID NO: 910530 - DNA, 25 bp, Mus musculus
cgctcagaagtaggcctgagctgta

SEQ ID NO: 910531 - DNA, 25 bp, Mus musculus
cgctcagcagactccgttgggtacc

SEQ ID NO: 910532 - DNA, 25 bp, Mus musculus
cgctcagcagtctccgttgggtacc

SEQ ID NO: 910533 - DNA, 25 bp, Mus musculus
cgctcatagcagagccgctccatgg

SEQ ID NO: 910534 - DNA, 25 bp, Mus musculus
cgctcatagcagtgccgctccatgg

SEQ ID NO: 910535 - DNA, 25 bp, Mus musculus
cgctcatcttcacacagcagccgga

SEQ ID NO: 910536 - DNA, 25 bp, Mus musculus
cgctcatcttcacagcacagcagcc

SEQ ID NO: 910537 - DNA, 25 bp, Mus musculus
cgctcatcttcagacagcagccgga

SEQ ID NO: 910538 - DNA, 25 bp, Mus musculus
cgctcatcttcagagcacagcagcc

SEQ ID NO: 910539 - DNA, 25 bp, Mus musculus
cgctcatgccagcttttttattggc

SEQ ID NO: 910540 - DNA, 25 bp, Mus musculus
cgctcatgccaggttttttattggc

SEQ ID NO: 910541 - DNA, 25 bp, Mus musculus
cgctccaagtcgtccccaaccagcc

SEQ ID NO: 910542 - DNA, 25 bp, Mus musculus
cgctccaagtcgtcgccaaccagcc

SEQ ID NO: 910543 - DNA, 25 bp, Mus musculus
cgctccaatgagggtatgaactgca

SEQ ID NO: 910544 - DNA, 25 bp, Mus musculus
cgctccaatgtgggtatgaactgca

SEQ ID NO: 910545 - DNA, 25 bp, Mus musculus
cgctccacagcacctgctaagactc

SEQ ID NO: 910546 - DNA, 25 bp, Mus musculus
cgctccacaggacctgctaagactc

SEQ ID NO: 910547 - DNA, 25 bp, Mus musculus
cgctccagcatacccccacggcctg

SEQ ID NO: 910548 - DNA, 25 bp, Mus musculus
cgctccagcatagccccacggcctg

SEQ ID NO: 910549 - DNA, 25 bp, Mus musculus
cgctccagtgcgactttactggaaa

SEQ ID NO: 910550 - DNA, 25 bp, Mus musculus
cgctccagtgcgtctttactggaaa

SEQ ID NO: 910551 - DNA, 25 bp, Mus musculus
cgctcccacacacccttggacaaat

SEQ ID NO: 910552 - DNA, 25 bp, Mus musculus
cgctcccacacacgtgagaagccct

SEQ ID NO: 910553 - DNA, 25 bp, Mus musculus
cgctcccacacagccttggacaaat

SEQ ID NO: 910554 - DNA, 25 bp, Mus musculus
cgctcccacacaggtgagaagccct

SEQ ID NO: 910555 - DNA, 25 bp, Mus musculus
cgctcccagaatcgatgtaaccatt

SEQ ID NO: 910556 - DNA, 25 bp, Mus musculus
cgctcccagaatcttatggctgcag

SEQ ID NO: 910557 - DNA, 25 bp, Mus musculus
cgctcccagaatggatgtaaccatt

SEQ ID NO: 910558 - DNA, 25 bp, Mus musculus
cgctcccagaatgttatggctgcag

SEQ ID NO: 910559 - DNA, 25 bp, Mus musculus
cgctccccggcggacatgaggaaac

SEQ ID NO: 910560 - DNA, 25 bp, Mus musculus
cgctccccggcggagatgaggaaac

SEQ ID NO: 910561 - DNA, 25 bp, Mus musculus
cgctccgcccctgttggtggaatga

SEQ ID NO: 910562 - DNA, 25 bp, Mus musculus
cgctccgcccgtgttggtggaatga

SEQ ID NO: 910563 - DNA, 25 bp, Mus musculus
cgctccgccgattcctttgtgatcg

SEQ ID NO: 910564 - DNA, 25 bp, Mus musculus
cgctccgccgctgagcacgagcctg

SEQ ID NO: 910565 - DNA, 25 bp, Mus musculus
cgctccgccggtgagcacgagcctg

SEQ ID NO: 910566 - DNA, 25 bp, Mus musculus
cgctccgccgtttcctttgtgatcg

SEQ ID NO: 910567 - DNA, 25 bp, Mus musculus
cgctcctatgccatgtgggcacatt

SEQ ID NO: 910568 - DNA, 25 bp, Mus musculus
cgctcctatggcatgtgggcacatt

SEQ ID NO: 910569 - DNA, 25 bp, Mus musculus
cgctcctcagccaaacactatgggg

SEQ ID NO: 910570 - DNA, 25 bp, Mus musculus
cgctcctcaggcaaacactatgggg

SEQ ID NO: 910571 - DNA, 25 bp, Mus musculus
cgctcgaacggccacgtgtcgtgat

SEQ ID NO: 910572 - DNA, 25 bp, Mus musculus
cgctcgaacggccaggtgtcgtgat

SEQ ID NO: 910573 - DNA, 25 bp, Mus musculus
cgctcgcacacgccctctgtgctcg

SEQ ID NO: 910574 - DNA, 25 bp, Mus musculus
cgctcgcacacgccctggaggtgtg

SEQ ID NO: 910575 - DNA, 25 bp, Mus musculus
cgctcgcacacggcctctgtgctcg

SEQ ID NO: 910576 - DNA, 25 bp, Mus musculus
cgctcgcacacggcctggaggtgtg

SEQ ID NO: 910577 - DNA, 25 bp, Mus musculus
cgctcgcaccatcgctgatcagctg

SEQ ID NO: 910578 - DNA, 25 bp, Mus musculus
cgctcgcaccatggctgatcagctg

SEQ ID NO: 910579 - DNA, 25 bp, Mus musculus
cgctcgccgcaagacgcttgagatg

SEQ ID NO: 910580 - DNA, 25 bp, Mus musculus
cgctcgccgcaagaggcttgagatg

SEQ ID NO: 910581 - DNA, 25 bp, Mus musculus
cgctcggagatcccttttgtggcta

SEQ ID NO: 910582 - DNA, 25 bp, Mus musculus
cgctcggagatcctatacttgaagg

SEQ ID NO: 910583 - DNA, 25 bp, Mus musculus
cgctcggagatcgcttttgtggcta

SEQ ID NO: 910584 - DNA, 25 bp, Mus musculus
cgctcggagatcgtatacttgaagg

SEQ ID NO: 910585 - DNA, 25 bp, Mus musculus
cgctcggccagagacgccggggccc

SEQ ID NO: 910586 - DNA, 25 bp, Mus musculus
cgctcggccagagaggccggggccc

SEQ ID NO: 910587 - DNA, 25 bp, Mus musculus
cgctcgtgcgtgcacctgaacgagt

SEQ ID NO: 910588 - DNA, 25 bp, Mus musculus
cgctcgtgcgtggacctgaacgagt

SEQ ID NO: 910589 - DNA, 25 bp, Mus musculus
cgctcgttcgattctctcatatcct

SEQ ID NO: 910590 - DNA, 25 bp, Mus musculus
cgctcgttcgtttctctcatatcct

SEQ ID NO: 910591 - DNA, 25 bp, Mus musculus
cgctctagtgcacgggatgtcacta

SEQ ID NO: 910592 - DNA, 25 bp, Mus musculus
cgctctagtgcaggggatgtcacta

SEQ ID NO: 910593 - DNA, 25 bp, Mus musculus
cgctctatcctacggactctgactg

SEQ ID NO: 910594 - DNA, 25 bp, Mus musculus
cgctctatcctagggactctgactg

SEQ ID NO: 910595 - DNA, 25 bp, Mus musculus
cgctctcacgagcgtgagacttcct

SEQ ID NO: 910596 - DNA, 25 bp, Mus musculus
cgctctcacgagggtgagacttcct

SEQ ID NO: 910597 - DNA, 25 bp, Mus musculus
cgctctctgctgacctatgaggaga

SEQ ID NO: 910598 - DNA, 25 bp, Mus musculus
cgctctctgctgagtctgaagatgc

SEQ ID NO: 910599 - DNA, 25 bp, Mus musculus
cgctctctgctgtcctatgaggaga

SEQ ID NO: 910600 - DNA, 25 bp, Mus musculus
cgctctctgctgtgtctgaagatgc

SEQ ID NO: 910601 - DNA, 25 bp, Mus musculus
cgctctgcagctcgtcacagctctg

SEQ ID NO: 910602 - DNA, 25 bp, Mus musculus
cgctctgcagctctatgttgtatgg

SEQ ID NO: 910603 - DNA, 25 bp, Mus musculus
cgctctgcagctggtcacagctctg

SEQ ID NO: 910604 - DNA, 25 bp, Mus musculus
cgctctgcagctgtatgttgtatgg

SEQ ID NO: 910605 - DNA, 25 bp, Mus musculus
cgctctggagaacatgtttcgagtc

SEQ ID NO: 910606 - DNA, 25 bp, Mus musculus
cgctctggagaagatgtttcgagtc

SEQ ID NO: 910607 - DNA, 25 bp, Mus musculus
cgctctggagccagctggtcatgct

SEQ ID NO: 910608 - DNA, 25 bp, Mus musculus
cgctctggagcctgctggtcatgct

SEQ ID NO: 910609 - DNA, 25 bp, Mus musculus
cgctcttcacgcctcatgcctgtgg

SEQ ID NO: 910610 - DNA, 25 bp, Mus musculus
cgctcttcacgcctgatgcctgtgg

SEQ ID NO: 910611 - DNA, 25 bp, Mus musculus
cgctcttccgctccctaaccatgga

SEQ ID NO: 910612 - DNA, 25 bp, Mus musculus
cgctcttccggtccctaaccatgga

SEQ ID NO: 910613 - DNA, 25 bp, Mus musculus
cgctgaagagcgtattgaagggcga

SEQ ID NO: 910614 - DNA, 25 bp, Mus musculus
cgctgaagagggtattgaagggcga

SEQ ID NO: 910615 - DNA, 25 bp, Mus musculus
cgctgaatttaccgtcaccattctt

SEQ ID NO: 910616 - DNA, 25 bp, Mus musculus
cgctgaatttaccgtggctctccca

SEQ ID NO: 910617 - DNA, 25 bp, Mus musculus
cgctgaatttacggtcaccattctt

SEQ ID NO: 910618 - DNA, 25 bp, Mus musculus
cgctgaatttacggtggctctccca

SEQ ID NO: 910619 - DNA, 25 bp, Mus musculus
cgctgacaagctgaagaaggagatg

SEQ ID NO: 910620 - DNA, 25 bp, Mus musculus
cgctgacaaggtgaagaaggagatg

SEQ ID NO: 910621 - DNA, 25 bp, Mus musculus
cgctgacattcacagttgaaactgt

SEQ ID NO: 910622 - DNA, 25 bp, Mus musculus
cgctgacattcacgtgcagtctttg

SEQ ID NO: 910623 - DNA, 25 bp, Mus musculus
cgctgacattcagagttgaaactgt

SEQ ID NO: 910624 - DNA, 25 bp, Mus musculus
cgctgacattcaggtgcagtctttg

SEQ ID NO: 910625 - DNA, 25 bp, Mus musculus
cgctgaccagtgacaccaatatgcc

SEQ ID NO: 910626 - DNA, 25 bp, Mus musculus
cgctgaccagtgactccaatatgcc

SEQ ID NO: 910627 - DNA, 25 bp, Mus musculus
cgctgactgacatctactgccgagg

SEQ ID NO: 910628 - DNA, 25 bp, Mus musculus
cgctgactgagatctactgccgagg

SEQ ID NO: 910629 - DNA, 25 bp, Mus musculus
cgctgactttcagaaacggaagcca

SEQ ID NO: 910630 - DNA, 25 bp, Mus musculus
cgctgactttcagaagctgaagcca

SEQ ID NO: 910631 - DNA, 25 bp, Mus musculus
cgctgactttcgcctgcatgagggt

SEQ ID NO: 910632 - DNA, 25 bp, Mus musculus
cgctgactttgagaaacggaagcca

SEQ ID NO: 910633 - DNA, 25 bp, Mus musculus
cgctgactttgagaagctgaagcca

SEQ ID NO: 910634 - DNA, 25 bp, Mus musculus
cgctgactttggcctgcatgagggt

SEQ ID NO: 910635 - DNA, 25 bp, Mus musculus
cgctgagaatatctacttttctcac

SEQ ID NO: 910636 - DNA, 25 bp, Mus musculus
cgctgagaatatgtacttttctcac

SEQ ID NO: 910637 - DNA, 25 bp, Mus musculus
cgctgagcagctatgtgtgtggaag

SEQ ID NO: 910638 - DNA, 25 bp, Mus musculus
cgctgagcaggtatgtgtgtggaag

SEQ ID NO: 910639 - DNA, 25 bp, Mus musculus
cgctgagcccatgactggaaacaag

SEQ ID NO: 910640 - DNA, 25 bp, Mus musculus
cgctgagcccatgagtggaaacaag

SEQ ID NO: 910641 - DNA, 25 bp, Mus musculus
cgctgagtggatacattccaccact

SEQ ID NO: 910642 - DNA, 25 bp, Mus musculus
cgctgagtggttacattccaccact

SEQ ID NO: 910643 - DNA, 25 bp, Mus musculus
cgctgatcttctcccacacatgcct

SEQ ID NO: 910644 - DNA, 25 bp, Mus musculus
cgctgatcttgtcccacacatgcct

SEQ ID NO: 910645 - DNA, 25 bp, Mus musculus
cgctgatggccacattttcatttat

SEQ ID NO: 910646 - DNA, 25 bp, Mus musculus
cgctgatggccagattttcatttat

SEQ ID NO: 910647 - DNA, 25 bp, Mus musculus
cgctgcaatggacagttgtgatcgc

SEQ ID NO: 910648 - DNA, 25 bp, Mus musculus
cgctgcaatggagagttgtgatcgc

SEQ ID NO: 910649 - DNA, 25 bp, Mus musculus
cgctgcactctacacgtgagctcca

SEQ ID NO: 910650 - DNA, 25 bp, Mus musculus
cgctgcactctacaggtgagctcca

SEQ ID NO: 910651 - DNA, 25 bp, Mus musculus
cgctgcagccaaaaaacgggaagag

SEQ ID NO: 910652 - DNA, 25 bp, Mus musculus
cgctgcagccaataaacgggaagag

SEQ ID NO: 910653 - DNA, 25 bp, Mus musculus
cgctgcagctctagttatttacgtc

SEQ ID NO: 910654 - DNA, 25 bp, Mus musculus
cgctgcagctcttgttatttacgtc

SEQ ID NO: 910655 - DNA, 25 bp, Mus musculus
cgctgccaaacacatcgaaaaggac

SEQ ID NO: 910656 - DNA, 25 bp, Mus musculus
cgctgccaaacagatcgaaaaggac

SEQ ID NO: 910657 - DNA, 25 bp, Mus musculus
cgctgccaaatatacgaggcactga

SEQ ID NO: 910658 - DNA, 25 bp, Mus musculus
cgctgccaaatataggaggcactga

SEQ ID NO: 910659 - DNA, 25 bp, Mus musculus
cgctgcccaccggacggtcagtact

SEQ ID NO: 910660 - DNA, 25 bp, Mus musculus
cgctgcccaccggagggtcagtact

SEQ ID NO: 910661 - DNA, 25 bp, Mus musculus
cgctgcccgccgccaatatgcctga

SEQ ID NO: 910662 - DNA, 25 bp, Mus musculus
cgctgcccgccggcaatatgcctga

SEQ ID NO: 910663 - DNA, 25 bp, Mus musculus
cgctgcccggcatctccatctttcc

SEQ ID NO: 910664 - DNA, 25 bp, Mus musculus
cgctgcccgggatctccatctttcc

SEQ ID NO: 910665 - DNA, 25 bp, Mus musculus
cgctgccgccgttgcgctggctgcc

SEQ ID NO: 910666 - DNA, 25 bp, Mus musculus
cgctgccgccgttgggctggctgcc

SEQ ID NO: 910667 - DNA, 25 bp, Mus musculus
cgctgccgcgagcagtatggcgttt

SEQ ID NO: 910668 - DNA, 25 bp, Mus musculus
cgctgccgcgaggagtatggcgttt

SEQ ID NO: 910669 - DNA, 25 bp, Mus musculus
cgctgcgaccagcggagccccagaa

SEQ ID NO: 910670 - DNA, 25 bp, Mus musculus
cgctgcgaccaggggagccccagaa

SEQ ID NO: 910671 - DNA, 25 bp, Mus musculus
cgctgcgctaattgtaaattcacct

SEQ ID NO: 910672 - DNA, 25 bp, Mus musculus
cgctgcgctatttgtaaattcacct

SEQ ID NO: 910673 - DNA, 25 bp, Mus musculus
cgctgcgctgcgctaattgtaaatt

SEQ ID NO: 910674 - DNA, 25 bp, Mus musculus
cgctgcgctgcgcttattgtaaatt

SEQ ID NO: 910675 - DNA, 25 bp, Mus musculus
cgctgcgtggacattgatgagtgcc

SEQ ID NO: 910676 - DNA, 25 bp, Mus musculus
cgctgcgtggtcattgatgagtgcc

SEQ ID NO: 910677 - DNA, 25 bp, Mus musculus
cgctgctcattcgccctgtggacag

SEQ ID NO: 910678 - DNA, 25 bp, Mus musculus
cgctgctcattcgcgctgtggacag

SEQ ID NO: 910679 - DNA, 25 bp, Mus musculus
cgctgctgaaagagcccctgactgg

SEQ ID NO: 910680 - DNA, 25 bp, Mus musculus
cgctgctgaaagtgcccctgactgg

SEQ ID NO: 910681 - DNA, 25 bp, Mus musculus
cgctgctgagctcgtacaccctgga

SEQ ID NO: 910682 - DNA, 25 bp, Mus musculus
cgctgctgaggtcgtacaccctgga

SEQ ID NO: 910683 - DNA, 25 bp, Mus musculus
cgctgctggaaaagctgaagtggta

SEQ ID NO: 910684 - DNA, 25 bp, Mus musculus
cgctgctggaaatgctgaagtggta

SEQ ID NO: 910685 - DNA, 25 bp, Mus musculus
cgctgctgtccacacgtccacggtg

SEQ ID NO: 910686 - DNA, 25 bp, Mus musculus
cgctgctgtccacaggtccacggtg

SEQ ID NO: 910687 - DNA, 25 bp, Mus musculus
cgctggaaaacttattaagtgcaaa

SEQ ID NO: 910688 - DNA, 25 bp, Mus musculus
cgctggaaaagttattaagtgcaaa

SEQ ID NO: 910689 - DNA, 25 bp, Mus musculus
cgctggacggctggagtgtcatctt

SEQ ID NO: 910690 - DNA, 25 bp, Mus musculus
cgctggacgggtggagtgtcatctt

SEQ ID NO: 910691 - DNA, 25 bp, Mus musculus
cgctggagagatcgccaccgggaca

SEQ ID NO: 910692 - DNA, 25 bp, Mus musculus
cgctggagagatggccaccgggaca

SEQ ID NO: 910693 - DNA, 25 bp, Mus musculus
cgctggagcccgagtggcaccagct

SEQ ID NO: 910694 - DNA, 25 bp, Mus musculus
cgctggagcccgatggttttcggaa

SEQ ID NO: 910695 - DNA, 25 bp, Mus musculus
cgctggagcccgtgtggcaccagct

SEQ ID NO: 910696 - DNA, 25 bp, Mus musculus
cgctggagcccgttggttttcggaa

SEQ ID NO: 910697 - DNA, 25 bp, Mus musculus
cgctggcaaatgatcagagttctag

SEQ ID NO: 910698 - DNA, 25 bp, Mus musculus
cgctggcaaatgatgagagttctag

SEQ ID NO: 910699 - DNA, 25 bp, Mus musculus
cgctggcatcaacgtttggatgcta

SEQ ID NO: 910700 - DNA, 25 bp, Mus musculus
cgctggcatcaaggtttggatgcta

SEQ ID NO: 910701 - DNA, 25 bp, Mus musculus
cgctggccagacagctgcagcacga

SEQ ID NO: 910702 - DNA, 25 bp, Mus musculus
cgctggccagctattgttagaactc

SEQ ID NO: 910703 - DNA, 25 bp, Mus musculus
cgctggccaggtattgttagaactc

SEQ ID NO: 910704 - DNA, 25 bp, Mus musculus
cgctggccagtcagctgcagcacga

SEQ ID NO: 910705 - DNA, 25 bp, Mus musculus
cgctggcggcaccacgcccgggtgg

SEQ ID NO: 910706 - DNA, 25 bp, Mus musculus
cgctggcggcaccaggcccgggtgg

SEQ ID NO: 910707 - DNA, 25 bp, Mus musculus
cgctggctcaatcaacccaagtttg

SEQ ID NO: 910708 - DNA, 25 bp, Mus musculus
cgctggctcaatgaacccaagtttg

SEQ ID NO: 910709 - DNA, 25 bp, Mus musculus
cgctggctgacccgagcggtgctcg

SEQ ID NO: 910710 - DNA, 25 bp, Mus musculus
cgctggctgacccgtgcggtgctcg

SEQ ID NO: 910711 - DNA, 25 bp, Mus musculus
cgctgggagaccacaatttccatcc

SEQ ID NO: 910712 - DNA, 25 bp, Mus musculus
cgctgggagaccactatttccatcc

SEQ ID NO: 910713 - DNA, 25 bp, Mus musculus
cgctgggcagaggtcgtgctctctg

SEQ ID NO: 910714 - DNA, 25 bp, Mus musculus
cgctgggcagaggtggtgctctctg

SEQ ID NO: 910715 - DNA, 25 bp, Mus musculus
cgctggtcaaagccatcatcgacag

SEQ ID NO: 910716 - DNA, 25 bp, Mus musculus
cgctggtcaaaggcatcatcgacag

SEQ ID NO: 910717 - DNA, 25 bp, Mus musculus
cgctggtggtctcacgaggctgttg

SEQ ID NO: 910718 - DNA, 25 bp, Mus musculus
cgctggtggtctcaggaggctgttg

SEQ ID NO: 910719 - DNA, 25 bp, Mus musculus
cgctggtttgcgctccctccaacat

SEQ ID NO: 910720 - DNA, 25 bp, Mus musculus
cgctggtttgcggtccctccaacat

SEQ ID NO: 910721 - DNA, 25 bp, Mus musculus
cgctggtttggagtcgtgtttgtgg

SEQ ID NO: 910722 - DNA, 25 bp, Mus musculus
cgctggtttggagtggtgtttgtgg

SEQ ID NO: 910723 - DNA, 25 bp, Mus musculus
cgctgtaaagagccccttcctaggt

SEQ ID NO: 910724 - DNA, 25 bp, Mus musculus
cgctgtaaagaggcccttcctaggt

SEQ ID NO: 910725 - DNA, 25 bp, Mus musculus
cgctgtacaagattcggcagcccag

SEQ ID NO: 910726 - DNA, 25 bp, Mus musculus
cgctgtacaagattcgtcaactcag

SEQ ID NO: 910727 - DNA, 25 bp, Mus musculus
cgctgtacaagattgggcagcccag

SEQ ID NO: 910728 - DNA, 25 bp, Mus musculus
cgctgtacaagattggtcaactcag

SEQ ID NO: 910729 - DNA, 25 bp, Mus musculus
cgctgtatagaatgcggggttcgct

SEQ ID NO: 910730 - DNA, 25 bp, Mus musculus
cgctgtatagtatgcggggttcgct

SEQ ID NO: 910731 - DNA, 25 bp, Mus musculus
cgctgtcaaaagtcttgcgctcagg

SEQ ID NO: 910732 - DNA, 25 bp, Mus musculus
cgctgtcaaatgtcttgcgctcagg

SEQ ID NO: 910733 - DNA, 25 bp, Mus musculus
cgctgtcagtatcttcccgagtgga

SEQ ID NO: 910734 - DNA, 25 bp, Mus musculus
cgctgtcagtttcttcccgagtgga

SEQ ID NO: 910735 - DNA, 25 bp, Mus musculus
cgctgtccagcagctggagaagctg

SEQ ID NO: 910736 - DNA, 25 bp, Mus musculus
cgctgtccagctcgtagtgcatgtt

SEQ ID NO: 910737 - DNA, 25 bp, Mus musculus
cgctgtccaggagctggagaagctg

SEQ ID NO: 910738 - DNA, 25 bp, Mus musculus
cgctgtccaggtcgtagtgcatgtt

SEQ ID NO: 910739 - DNA, 25 bp, Mus musculus
cgctgtcccccacgcgagtttgtct

SEQ ID NO: 910740 - DNA, 25 bp, Mus musculus
cgctgtcccccaggcgagtttgtct

SEQ ID NO: 910741 - DNA, 25 bp, Mus musculus
cgctgtccgcggaggtgcctaggca

SEQ ID NO: 910742 - DNA, 25 bp, Mus musculus
cgctgtccgcggtggtgcctaggca

SEQ ID NO: 910743 - DNA, 25 bp, Mus musculus
cgctgtcctgtgcaggtgtaaagaa

SEQ ID NO: 910744 - DNA, 25 bp, Mus musculus
cgctgtcctgtggaggtgtaaagaa

SEQ ID NO: 910745 - DNA, 25 bp, Mus musculus
cgctgtgaggacattgatgaatgtg

SEQ ID NO: 910746 - DNA, 25 bp, Mus musculus
cgctgtgaggtcattgatgaatgtg

SEQ ID NO: 910747 - DNA, 25 bp, Mus musculus
cgctgtgcagataactggactattc

SEQ ID NO: 910748 - DNA, 25 bp, Mus musculus
cgctgtgcagttaactggactattc

SEQ ID NO: 910749 - DNA, 25 bp, Mus musculus
cgctgttgccgtcacctttgcagat

SEQ ID NO: 910750 - DNA, 25 bp, Mus musculus
cgctgttgccgtgacctttgcagat

SEQ ID NO: 910751 - DNA, 25 bp, Mus musculus
cgctgttgtgatgagcaatgtgaag

SEQ ID NO: 910752 - DNA, 25 bp, Mus musculus
cgctgttgtgttgagcaatgtgaag

SEQ ID NO: 910753 - DNA, 25 bp, Mus musculus
cgcttaatgacagacatacttggtc

SEQ ID NO: 910754 - DNA, 25 bp, Mus musculus
cgcttaatgacagagatacttggtc

SEQ ID NO: 910755 - DNA, 25 bp, Mus musculus
cgcttactgccgcaacccagacaag

SEQ ID NO: 910756 - DNA, 25 bp, Mus musculus
cgcttactgccggaacccagacaag

SEQ ID NO: 910757 - DNA, 25 bp, Mus musculus
cgcttattaaagctggagcacgagt

SEQ ID NO: 910758 - DNA, 25 bp, Mus musculus
cgcttattaaaggtggagcacgagt

SEQ ID NO: 910759 - DNA, 25 bp, Mus musculus
cgcttatttgagcagaatgagatca

SEQ ID NO: 910760 - DNA, 25 bp, Mus musculus
cgcttatttgaggagaatgagatca

SEQ ID NO: 910761 - DNA, 25 bp, Mus musculus
cgcttcaaagatgtcctgttgctgc

SEQ ID NO: 910762 - DNA, 25 bp, Mus musculus
cgcttcaaagttgtcctgttgctgc

SEQ ID NO: 910763 - DNA, 25 bp, Mus musculus
cgcttcaaatggatagtcacatgct

SEQ ID NO: 910764 - DNA, 25 bp, Mus musculus
cgcttcaaatggcgaattggacggc

SEQ ID NO: 910765 - DNA, 25 bp, Mus musculus
cgcttcaaatggggaattggacggc

SEQ ID NO: 910766 - DNA, 25 bp, Mus musculus
cgcttcaaatggttagtcacatgct

SEQ ID NO: 910767 - DNA, 25 bp, Mus musculus
cgcttcctcaagctgagtcctgaga

SEQ ID NO: 910768 - DNA, 25 bp, Mus musculus
cgcttcctcaaggtgagtcctgaga

SEQ ID NO: 910769 - DNA, 25 bp, Mus musculus
cgcttcctgtccctacagagactca

SEQ ID NO: 910770 - DNA, 25 bp, Mus musculus
cgcttcctgtccgtacagagactca

SEQ ID NO: 910771 - DNA, 25 bp, Mus musculus
cgcttcggagaacatgtggacccct

SEQ ID NO: 910772 - DNA, 25 bp, Mus musculus
cgcttcggagaacgcctcctgccag

SEQ ID NO: 910773 - DNA, 25 bp, Mus musculus
cgcttcggagaagatgtggacccct

SEQ ID NO: 910774 - DNA, 25 bp, Mus musculus
cgcttcggagaaggcctcctgccag

SEQ ID NO: 910775 - DNA, 25 bp, Mus musculus
cgcttctatgagcaatttgacatcc

SEQ ID NO: 910776 - DNA, 25 bp, Mus musculus
cgcttctatgaggaatttgacatcc

SEQ ID NO: 910777 - DNA, 25 bp, Mus musculus
cgcttctcatcgaaccctttctggg

SEQ ID NO: 910778 - DNA, 25 bp, Mus musculus
cgcttctcatcgaagcctttctggg

SEQ ID NO: 910779 - DNA, 25 bp, Mus musculus
cgcttctgcctgacagtgaagatga

SEQ ID NO: 910780 - DNA, 25 bp, Mus musculus
cgcttctgcctgcagacagtgaaga

SEQ ID NO: 910781 - DNA, 25 bp, Mus musculus
cgcttctgcctggagacagtgaaga

SEQ ID NO: 910782 - DNA, 25 bp, Mus musculus
cgcttctgcctgtcagtgaagatga

SEQ ID NO: 910783 - DNA, 25 bp, Mus musculus
cgcttgacaaatcggaacagtctgg

SEQ ID NO: 910784 - DNA, 25 bp, Mus musculus
cgcttgacaaatgggaacagtctgg

SEQ ID NO: 910785 - DNA, 25 bp, Mus musculus
cgcttgcgagctgataggaaataca

SEQ ID NO: 910786 - DNA, 25 bp, Mus musculus
cgcttgcgaggtgataggaaataca

SEQ ID NO: 910787 - DNA, 25 bp, Mus musculus
cgcttgcggacgtttggattcagga

SEQ ID NO: 910788 - DNA, 25 bp, Mus musculus
cgcttgcggaggtttggattcagga

SEQ ID NO: 910789 - DNA, 25 bp, Mus musculus
cgcttggagaatggcagcagcagca

SEQ ID NO: 910790 - DNA, 25 bp, Mus musculus
cgcttggagattggcagcagcagca

SEQ ID NO: 910791 - DNA, 25 bp, Mus musculus
cgctttccctcaccagacacgcacc

SEQ ID NO: 910792 - DNA, 25 bp, Mus musculus
cgctttccctcagcagacacgcacc

SEQ ID NO: 910793 - DNA, 25 bp, Mus musculus
cgctttggacagaaaatcaccgtgc

SEQ ID NO: 910794 - DNA, 25 bp, Mus musculus
cgctttggacagcatattgactaga

SEQ ID NO: 910795 - DNA, 25 bp, Mus musculus
cgctttggacaggatattgactaga

SEQ ID NO: 910796 - DNA, 25 bp, Mus musculus
cgctttggacagtaaatcaccgtgc

SEQ ID NO: 910797 - DNA, 25 bp, Mus musculus
cgctttggactgcgagctgaagttg

SEQ ID NO: 910798 - DNA, 25 bp, Mus musculus
cgctttggactgggagctgaagttg

SEQ ID NO: 910799 - DNA, 25 bp, Mus musculus
cgctttggcagccgatctccatctt

SEQ ID NO: 910800 - DNA, 25 bp, Mus musculus
cgctttggcagcggatctccatctt

SEQ ID NO: 910801 - DNA, 25 bp, Mus musculus
cgcttttgccagacaagcagtgaaa

SEQ ID NO: 910802 - DNA, 25 bp, Mus musculus
cgcttttgccagctgatggaaaacg

SEQ ID NO: 910803 - DNA, 25 bp, Mus musculus
cgcttttgccaggtgatggaaaacg

SEQ ID NO: 910804 - DNA, 25 bp, Mus musculus
cgcttttgccagtcaagcagtgaaa

SEQ ID NO: 910805 - DNA, 25 bp, Mus musculus
cggaaaaaggaacgtcatcgtggag

SEQ ID NO: 910806 - DNA, 25 bp, Mus musculus
cggaaaaaggaaggtcatcgtggag

SEQ ID NO: 910807 - DNA, 25 bp, Mus musculus
cggaaaaagttgctgatggcatgaa

SEQ ID NO: 910808 - DNA, 25 bp, Mus musculus
cggaaaaagttggtgatggcatgaa

SEQ ID NO: 910809 - DNA, 25 bp, Mus musculus
cggaaaacctcttcatcaaattctg

SEQ ID NO: 910810 - DNA, 25 bp, Mus musculus
cggaaaacctgttcatcaaattctg

SEQ ID NO: 910811 - DNA, 25 bp, Mus musculus
cggaaacctgctgctgatctttctg

SEQ ID NO: 910812 - DNA, 25 bp, Mus musculus
cggaaacctggtgctgatctttctg

SEQ ID NO: 910813 - DNA, 25 bp, Mus musculus
cggaaagaacagcttcagcaaagag

SEQ ID NO: 910814 - DNA, 25 bp, Mus musculus
cggaaagaacaggttcagcaaagag

SEQ ID NO: 910815 - DNA, 25 bp, Mus musculus
cggaaatatccacagcgacgagatt

SEQ ID NO: 910816 - DNA, 25 bp, Mus musculus
cggaaatatccacatttagagcgac

SEQ ID NO: 910817 - DNA, 25 bp, Mus musculus
cggaaatatccagagcgacgagatt

SEQ ID NO: 910818 - DNA, 25 bp, Mus musculus
cggaaatatccagatttagagcgac

SEQ ID NO: 910819 - DNA, 25 bp, Mus musculus
cggaaatgctctttcttcaggttcc

SEQ ID NO: 910820 - DNA, 25 bp, Mus musculus
cggaaatgctgtttcttcaggttcc

SEQ ID NO: 910821 - DNA, 25 bp, Mus musculus
cggaaattacagataaatttgggca

SEQ ID NO: 910822 - DNA, 25 bp, Mus musculus
cggaaattacagttaaatttgggca

SEQ ID NO: 910823 - DNA, 25 bp, Mus musculus
cggaaattagggcaagagccagagg

SEQ ID NO: 910824 - DNA, 25 bp, Mus musculus
cggaaattaggggaagagccagagg

SEQ ID NO: 910825 - DNA, 25 bp, Mus musculus
cggaacaagacgataacagaagatg

SEQ ID NO: 910826 - DNA, 25 bp, Mus musculus
cggaacaagacgttaacagaagatg

SEQ ID NO: 910827 - DNA, 25 bp, Mus musculus
cggaacagcctcaacatctggttca

SEQ ID NO: 910828 - DNA, 25 bp, Mus musculus
cggaacagcctcaagatctggttca

SEQ ID NO: 910829 - DNA, 25 bp, Mus musculus
cggaacagttcatgaaatcttttga

SEQ ID NO: 910830 - DNA, 25 bp, Mus musculus
cggaacagttcatgaggttacgtcc

SEQ ID NO: 910831 - DNA, 25 bp, Mus musculus
cggaacagttcatgtaatcttttga

SEQ ID NO: 910832 - DNA, 25 bp, Mus musculus
cggaacagttcatgtggttacgtcc

SEQ ID NO: 910833 - DNA, 25 bp, Mus musculus
cggaaccaagatcgtcacatagatg

SEQ ID NO: 910834 - DNA, 25 bp, Mus musculus
cggaaccaagatggtcacatagatg

SEQ ID NO: 910835 - DNA, 25 bp, Mus musculus
cggaaccaagctggctatggcggtt

SEQ ID NO: 910836 - DNA, 25 bp, Mus musculus
cggaaccaaggtggctatggcggtt

SEQ ID NO: 910837 - DNA, 25 bp, Mus musculus
cggaacccagattgatctccgagat

SEQ ID NO: 910838 - DNA, 25 bp, Mus musculus
cggaacccagtttgatctccgagat

SEQ ID NO: 910839 - DNA, 25 bp, Mus musculus
cggaaccctgaacgatcctcgctct

SEQ ID NO: 910840 - DNA, 25 bp, Mus musculus
cggaaccctgaaggatcctcgctct

SEQ ID NO: 910841 - DNA, 25 bp, Mus musculus
cggaacctcaagctagaccagctct

SEQ ID NO: 910842 - DNA, 25 bp, Mus musculus
cggaacctcaaggtagaccagctct

SEQ ID NO: 910843 - DNA, 25 bp, Mus musculus
cggaacctgcagcaggttctagggg

SEQ ID NO: 910844 - DNA, 25 bp, Mus musculus
cggaacctgcaggaggttctagggg

SEQ ID NO: 910845 - DNA, 25 bp, Mus musculus
cggaacctgtccagtgctcataagg

SEQ ID NO: 910846 - DNA, 25 bp, Mus musculus
cggaacctgtcctgtgctcataagg

SEQ ID NO: 910847 - DNA, 25 bp, Mus musculus
cggaactatgaatacaggcaaattt

SEQ ID NO: 910848 - DNA, 25 bp, Mus musculus
cggaactatgaatagaggcaaattt

SEQ ID NO: 910849 - DNA, 25 bp, Mus musculus
cggaactcgtgcaacagctggaatc

SEQ ID NO: 910850 - DNA, 25 bp, Mus musculus
cggaactcgtgcaagagctggaatc

SEQ ID NO: 910851 - DNA, 25 bp, Mus musculus
cggaactctgaaccactatgaagtc

SEQ ID NO: 910852 - DNA, 25 bp, Mus musculus
cggaactctgaacctctatgaagtc

SEQ ID NO: 910853 - DNA, 25 bp, Mus musculus
cggaagatgaagagctgcctagagt

SEQ ID NO: 910854 - DNA, 25 bp, Mus musculus
cggaagatgaagtgctgcctagagt

SEQ ID NO: 910855 - DNA, 25 bp, Mus musculus
cggaagatgtcaccacgcacaggcg

SEQ ID NO: 910856 - DNA, 25 bp, Mus musculus
cggaagatgtcacctcgcacaggcg

SEQ ID NO: 910857 - DNA, 25 bp, Mus musculus
cggaagattaaactgtggagacatg

SEQ ID NO: 910858 - DNA, 25 bp, Mus musculus
cggaagattaaagtgtggagacatg

SEQ ID NO: 910859 - DNA, 25 bp, Mus musculus
cggaagcacaagcacctgtacctgc

SEQ ID NO: 910860 - DNA, 25 bp, Mus musculus
cggaagcacaaggacctgtacctgc

SEQ ID NO: 910861 - DNA, 25 bp, Mus musculus
cggaagcagagaaggcccagctgat

SEQ ID NO: 910862 - DNA, 25 bp, Mus musculus
cggaagcagagatggcccagctgat

SEQ ID NO: 910863 - DNA, 25 bp, Mus musculus
cggaaggaagctcggcagctctgct

SEQ ID NO: 910864 - DNA, 25 bp, Mus musculus
cggaaggaaggtcggcagctctgct

SEQ ID NO: 910865 - DNA, 25 bp, Mus musculus
cggaaggactatccggtgcaggtgg

SEQ ID NO: 910866 - DNA, 25 bp, Mus musculus
cggaaggactatgcggtgcaggtgg

SEQ ID NO: 910867 - DNA, 25 bp, Mus musculus
cggaaggagctgactggccaatcac

SEQ ID NO: 910868 - DNA, 25 bp, Mus musculus
cggaaggagctgtctggccaatcac

SEQ ID NO: 910869 - DNA, 25 bp, Mus musculus
cggaaggtcaagaagtttgagcaag

SEQ ID NO: 910870 - DNA, 25 bp, Mus musculus
cggaaggtcaagtagtttgagcaag

SEQ ID NO: 910871 - DNA, 25 bp, Mus musculus
cggaagtatgaagacgtggcccgta

SEQ ID NO: 910872 - DNA, 25 bp, Mus musculus
cggaagtatgaagaggtggcccgta

SEQ ID NO: 910873 - DNA, 25 bp, Mus musculus
cggaagtgaactcaaagacagatct

SEQ ID NO: 910874 - DNA, 25 bp, Mus musculus
cggaagtgaagtcaaagacagatct

SEQ ID NO: 910875 - DNA, 25 bp, Mus musculus
cggaagtgacagaatgaatcgcacc

SEQ ID NO: 910876 - DNA, 25 bp, Mus musculus
cggaagtgacagtatgaatcgcacc

SEQ ID NO: 910877 - DNA, 25 bp, Mus musculus
cggaatagagggaaacaggccacca

SEQ ID NO: 910878 - DNA, 25 bp, Mus musculus
cggaatagagggtaacaggccacca

SEQ ID NO: 910879 - DNA, 25 bp, Mus musculus
cggaatatttgacaatcaagaccgg

SEQ ID NO: 910880 - DNA, 25 bp, Mus musculus
cggaatatttgaccagaatcaagac

SEQ ID NO: 910881 - DNA, 25 bp, Mus musculus
cggaatatttgagaatcaagaccgg

SEQ ID NO: 910882 - DNA, 25 bp, Mus musculus
cggaatatttgagcagaatcaagac

SEQ ID NO: 910883 - DNA, 25 bp, Mus musculus
cggaatcagatccacgatgctcgga

SEQ ID NO: 910884 - DNA, 25 bp, Mus musculus
cggaatcagatccaggatgctcgga

SEQ ID NO: 910885 - DNA, 25 bp, Mus musculus
cggaatctaggaccccaccttggga

SEQ ID NO: 910886 - DNA, 25 bp, Mus musculus
cggaatctaggagcccaccttggga

SEQ ID NO: 910887 - DNA, 25 bp, Mus musculus
cggaatgagcaagccgcccttgatt

SEQ ID NO: 910888 - DNA, 25 bp, Mus musculus
cggaatgagcaagccgcttgttatg

SEQ ID NO: 910889 - DNA, 25 bp, Mus musculus
cggaatgagcaagcggcccttgatt

SEQ ID NO: 910890 - DNA, 25 bp, Mus musculus
cggaatgagcaagcggcttgttatg

SEQ ID NO: 910891 - DNA, 25 bp, Mus musculus
cggacacacacttgatccgaggatt

SEQ ID NO: 910892 - DNA, 25 bp, Mus musculus
cggacacacagttgatccgaggatt

SEQ ID NO: 910893 - DNA, 25 bp, Mus musculus
cggacaccgcagccagtgtccttgt

SEQ ID NO: 910894 - DNA, 25 bp, Mus musculus
cggacaccgcaggcagtgtccttgt

SEQ ID NO: 910895 - DNA, 25 bp, Mus musculus
cggacaccgccagcactgctgtggc

SEQ ID NO: 910896 - DNA, 25 bp, Mus musculus
cggacaccgccagctctgctgtggc

SEQ ID NO: 910897 - DNA, 25 bp, Mus musculus
cggacactcagacactgtctctgga

SEQ ID NO: 910898 - DNA, 25 bp, Mus musculus
cggacactcagacgatttccctaga

SEQ ID NO: 910899 - DNA, 25 bp, Mus musculus
cggacactcagagactgtctctgga

SEQ ID NO: 910900 - DNA, 25 bp, Mus musculus
cggacactcagaggatttccctaga

SEQ ID NO: 910901 - DNA, 25 bp, Mus musculus
cggacactgtggcctgtgctctgaa

SEQ ID NO: 910902 - DNA, 25 bp, Mus musculus
cggacactgtgggctgtgctctgaa

SEQ ID NO: 910903 - DNA, 25 bp, Mus musculus
cggacacttgtgaagcagcaggaag

SEQ ID NO: 910904 - DNA, 25 bp, Mus musculus
cggacacttgtgcagcattctggaa

SEQ ID NO: 910905 - DNA, 25 bp, Mus musculus
cggacacttgtggagcattctggaa

SEQ ID NO: 910906 - DNA, 25 bp, Mus musculus
cggacacttgtgtagcagcaggaag

SEQ ID NO: 910907 - DNA, 25 bp, Mus musculus
cggacaggagatgattatgttgcaa

SEQ ID NO: 910908 - DNA, 25 bp, Mus musculus
cggacaggagttgattatgttgcaa

SEQ ID NO: 910909 - DNA, 25 bp, Mus musculus
cggacagtcactcacgtagtacccg

SEQ ID NO: 910910 - DNA, 25 bp, Mus musculus
cggacagtcactcaggtagtacccg

SEQ ID NO: 910911 - DNA, 25 bp, Mus musculus
cggacatgccaacacattgacgagt

SEQ ID NO: 910912 - DNA, 25 bp, Mus musculus
cggacatgccaagacattgacgagt

SEQ ID NO: 910913 - DNA, 25 bp, Mus musculus
cggaccatagcggcctgcaatctcc

SEQ ID NO: 910914 - DNA, 25 bp, Mus musculus
cggaccataggggcctgcaatctcc

SEQ ID NO: 910915 - DNA, 25 bp, Mus musculus
cggaccctagagccaaagctggtga

SEQ ID NO: 910916 - DNA, 25 bp, Mus musculus
cggaccctagaggcaaagctggtga

SEQ ID NO: 910917 - DNA, 25 bp, Mus musculus
cggaccgcagagcgactatacaact

SEQ ID NO: 910918 - DNA, 25 bp, Mus musculus
cggaccgcagagcggactatacaac

SEQ ID NO: 910919 - DNA, 25 bp, Mus musculus
cggaccgcagagggactatacaact

SEQ ID NO: 910920 - DNA, 25 bp, Mus musculus
cggaccgcagaggggactatacaac

SEQ ID NO: 910921 - DNA, 25 bp, Mus musculus
cggacctcagcagaaatctcccgga

SEQ ID NO: 910922 - DNA, 25 bp, Mus musculus
cggacctcagctctctgcctccgcg

SEQ ID NO: 910923 - DNA, 25 bp, Mus musculus
cggacctcaggagaaatctcccgga

SEQ ID NO: 910924 - DNA, 25 bp, Mus musculus
cggacctcaggtctctgcctccgcg

SEQ ID NO: 910925 - DNA, 25 bp, Mus musculus
cggacctcccagcagctgcagatga

SEQ ID NO: 910926 - DNA, 25 bp, Mus musculus
cggacctcccaggagctgcagatga

SEQ ID NO: 910927 - DNA, 25 bp, Mus musculus
cggacctggcagcggactgtcaaac

SEQ ID NO: 910928 - DNA, 25 bp, Mus musculus
cggacctggcaggggactgtcaaac

SEQ ID NO: 910929 - DNA, 25 bp, Mus musculus
cggaccttccggcacgcagttcctc

SEQ ID NO: 910930 - DNA, 25 bp, Mus musculus
cggaccttccggcaggcagttcctc

SEQ ID NO: 910931 - DNA, 25 bp, Mus musculus
cggacgcggcgacacgtcttctact

SEQ ID NO: 910932 - DNA, 25 bp, Mus musculus
cggacgcggcgacaggtcttctact

SEQ ID NO: 910933 - DNA, 25 bp, Mus musculus
cggacgctcacacccatggcgacgc

SEQ ID NO: 910934 - DNA, 25 bp, Mus musculus
cggacgctcacaccctaaagatggc

SEQ ID NO: 910935 - DNA, 25 bp, Mus musculus
cggacgctcacaccgatggcgacgc

SEQ ID NO: 910936 - DNA, 25 bp, Mus musculus
cggacgctcacaccgtaaagatggc

SEQ ID NO: 910937 - DNA, 25 bp, Mus musculus
cggacgctgtcacgtctgtctgcac

SEQ ID NO: 910938 - DNA, 25 bp, Mus musculus
cggacgctgtcaggtctgtctgcac

SEQ ID NO: 910939 - DNA, 25 bp, Mus musculus
cggacgctttgtcatcgaagaggtt

SEQ ID NO: 910940 - DNA, 25 bp, Mus musculus
cggacgctttgtgatcgaagaggtt

SEQ ID NO: 910941 - DNA, 25 bp, Mus musculus
cggacggaatcgcagccctggatca

SEQ ID NO: 910942 - DNA, 25 bp, Mus musculus
cggacggaatggcagccctggatca

SEQ ID NO: 910943 - DNA, 25 bp, Mus musculus
cggacggctgcccggttgtgagccc

SEQ ID NO: 910944 - DNA, 25 bp, Mus musculus
cggacggctgccgggttgtgagccc

SEQ ID NO: 910945 - DNA, 25 bp, Mus musculus
cggacgtagaagccctctttgacag

SEQ ID NO: 910946 - DNA, 25 bp, Mus musculus
cggacgtagaaggcctctttgacag

SEQ ID NO: 910947 - DNA, 25 bp, Mus musculus
cggacgtgcatccagacatgtgcag

SEQ ID NO: 910948 - DNA, 25 bp, Mus musculus
cggacgtgcatcgagacatgtgcag

SEQ ID NO: 910949 - DNA, 25 bp, Mus musculus
cggactaatttagacatgaaatcct

SEQ ID NO: 910950 - DNA, 25 bp, Mus musculus
cggactaatttagacgggctccata

SEQ ID NO: 910951 - DNA, 25 bp, Mus musculus
cggactaatttagagatgaaatcct

SEQ ID NO: 910952 - DNA, 25 bp, Mus musculus
cggactaatttagaggggctccata

SEQ ID NO: 910953 - DNA, 25 bp, Mus musculus
cggactacgggacattcttggcacc

SEQ ID NO: 910954 - DNA, 25 bp, Mus musculus
cggactacgggagattcttggcacc

SEQ ID NO: 910955 - DNA, 25 bp, Mus musculus
cggactacttagctgaagccaggaa

SEQ ID NO: 910956 - DNA, 25 bp, Mus musculus
cggactacttaggtgaagccaggaa

SEQ ID NO: 910957 - DNA, 25 bp, Mus musculus
cggactgaagaccttatgttcatat

SEQ ID NO: 910958 - DNA, 25 bp, Mus musculus
cggactgaagacgttatgttcatat

SEQ ID NO: 910959 - DNA, 25 bp, Mus musculus
cggactgatgtctgctccctaggct

SEQ ID NO: 910960 - DNA, 25 bp, Mus musculus
cggactgatgtctggtccctaggct

SEQ ID NO: 910961 - DNA, 25 bp, Mus musculus
cggacttcagctgactcggactctg

SEQ ID NO: 910962 - DNA, 25 bp, Mus musculus
cggacttcagctgattcacaagatg

SEQ ID NO: 910963 - DNA, 25 bp, Mus musculus
cggacttcaggtgactcggactctg

SEQ ID NO: 910964 - DNA, 25 bp, Mus musculus
cggacttcaggtgattcacaagatg

SEQ ID NO: 910965 - DNA, 25 bp, Mus musculus
cggagaaacacacgtccttcaccca

SEQ ID NO: 910966 - DNA, 25 bp, Mus musculus
cggagaaacacaggtccttcaccca

SEQ ID NO: 910967 - DNA, 25 bp, Mus musculus
cggagaacaagatccgttctctttg

SEQ ID NO: 910968 - DNA, 25 bp, Mus musculus
cggagaacaagatccttggaatgcc

SEQ ID NO: 910969 - DNA, 25 bp, Mus musculus
cggagaacaagatcggttctctttg

SEQ ID NO: 910970 - DNA, 25 bp, Mus musculus
cggagaacaagatcgttggaatgcc

SEQ ID NO: 910971 - DNA, 25 bp, Mus musculus
cggagaagctgacgacaagatctaa

SEQ ID NO: 910972 - DNA, 25 bp, Mus musculus
cggagaagctgaggacaagatctaa

SEQ ID NO: 910973 - DNA, 25 bp, Mus musculus
cggagaaggcagcacgtataagtag

SEQ ID NO: 910974 - DNA, 25 bp, Mus musculus
cggagaaggcagcaggtataagtag

SEQ ID NO: 910975 - DNA, 25 bp, Mus musculus
cggagaatcagagaccctgcagcgg

SEQ ID NO: 910976 - DNA, 25 bp, Mus musculus
cggagaatcagagagcctgcagcgg

SEQ ID NO: 910977 - DNA, 25 bp, Mus musculus
cggagacaaccgatccaactactag

SEQ ID NO: 910978 - DNA, 25 bp, Mus musculus
cggagacaaccgttccaactactag

SEQ ID NO: 910979 - DNA, 25 bp, Mus musculus
cggagacatgcgcggtatggccttg

SEQ ID NO: 910980 - DNA, 25 bp, Mus musculus
cggagacatgggcggtatggccttg

SEQ ID NO: 910981 - DNA, 25 bp, Mus musculus
cggagaccccaacggagagatggct

SEQ ID NO: 910982 - DNA, 25 bp, Mus musculus
cggagaccccaagggagagatggct

SEQ ID NO: 910983 - DNA, 25 bp, Mus musculus
cggagaccgcggcacgatgggtccc

SEQ ID NO: 910984 - DNA, 25 bp, Mus musculus
cggagaccgcggcaggatgggtccc

SEQ ID NO: 910985 - DNA, 25 bp, Mus musculus
cggagactcaagctcactggagacc

SEQ ID NO: 910986 - DNA, 25 bp, Mus musculus
cggagactcaaggtcactggagacc

SEQ ID NO: 910987 - DNA, 25 bp, Mus musculus
cggagactccagatgaggacgatgt

SEQ ID NO: 910988 - DNA, 25 bp, Mus musculus
cggagactccagcccacaatggaga

SEQ ID NO: 910989 - DNA, 25 bp, Mus musculus
cggagactccagctgctgaagtcca

SEQ ID NO: 910990 - DNA, 25 bp, Mus musculus
cggagactccaggccacaatggaga

SEQ ID NO: 910991 - DNA, 25 bp, Mus musculus
cggagactccaggtgctgaagtcca

SEQ ID NO: 910992 - DNA, 25 bp, Mus musculus
cggagactccagttgaggacgatgt

SEQ ID NO: 910993 - DNA, 25 bp, Mus musculus
cggagagccagcctcgcgacccagt

SEQ ID NO: 910994 - DNA, 25 bp, Mus musculus
cggagagccagcctggcgacccagt

SEQ ID NO: 910995 - DNA, 25 bp, Mus musculus
cggagagcgccagacgcatgcccag

SEQ ID NO: 910996 - DNA, 25 bp, Mus musculus
cggagagcgccagaggcatgcccag

SEQ ID NO: 910997 - DNA, 25 bp, Mus musculus
cggagagcggacccgtaggcctcac

SEQ ID NO: 910998 - DNA, 25 bp, Mus musculus
cggagagcggcacaggttccagggc

SEQ ID NO: 910999 - DNA, 25 bp, Mus musculus
cggagagcggcagaggttccagggc

SEQ ID NO: 911000 - DNA, 25 bp, Mus musculus
cggagagcggtcccgtaggcctcac

SEQ ID NO: 911001 - DNA, 25 bp, Mus musculus
cggagaggagcgagggagccatcac

SEQ ID NO: 911002 - DNA, 25 bp, Mus musculus
cggagaggagggagggagccatcac

SEQ ID NO: 911003 - DNA, 25 bp, Mus musculus
cggagagtggaacacatcgctgtag

SEQ ID NO: 911004 - DNA, 25 bp, Mus musculus
cggagagtggaacagatcgctgtag

SEQ ID NO: 911005 - DNA, 25 bp, Mus musculus
cggagatatgcaaggagatggctca

SEQ ID NO: 911006 - DNA, 25 bp, Mus musculus
cggagatatggaaggagatggctca

SEQ ID NO: 911007 - DNA, 25 bp, Mus musculus
cggagatgagccgtcgatcagcaag

SEQ ID NO: 911008 - DNA, 25 bp, Mus musculus
cggagatgaggcgtcgatcagcaag

SEQ ID NO: 911009 - DNA, 25 bp, Mus musculus
cggagatggcccagtttgagcaaga

SEQ ID NO: 911010 - DNA, 25 bp, Mus musculus
cggagatggccctgtttgagcaaga

SEQ ID NO: 911011 - DNA, 25 bp, Mus musculus
cggagatggtgacacgtttctccat

SEQ ID NO: 911012 - DNA, 25 bp, Mus musculus
cggagatggtgacaggtttctccat

SEQ ID NO: 911013 - DNA, 25 bp, Mus musculus
cggagatttcctgacgcactgatgc

SEQ ID NO: 911014 - DNA, 25 bp, Mus musculus
cggagatttcctgaggcactgatgc

SEQ ID NO: 911015 - DNA, 25 bp, Mus musculus
cggagatttgcactccaacgtcgtg

SEQ ID NO: 911016 - DNA, 25 bp, Mus musculus
cggagatttgcagtccaacgtcgtg

SEQ ID NO: 911017 - DNA, 25 bp, Mus musculus
cggagcaagcagctcgaggaggaca

SEQ ID NO: 911018 - DNA, 25 bp, Mus musculus
cggagcaagcagctggaagatgagc

SEQ ID NO: 911019 - DNA, 25 bp, Mus musculus
cggagcaagcaggtcgaggaggaca

SEQ ID NO: 911020 - DNA, 25 bp, Mus musculus
cggagcaagcaggtggaagatgagc

SEQ ID NO: 911021 - DNA, 25 bp, Mus musculus
cggagcagaatgatttccagagcag

SEQ ID NO: 911022 - DNA, 25 bp, Mus musculus
cggagcagaatgttttccagagcag

SEQ ID NO: 911023 - DNA, 25 bp, Mus musculus
cggagcagagcacacaggctcctcc

SEQ ID NO: 911024 - DNA, 25 bp, Mus musculus
cggagcagagcacagaggctcctcc

SEQ ID NO: 911025 - DNA, 25 bp, Mus musculus
cggagccagcggatgaagctaccca

SEQ ID NO: 911026 - DNA, 25 bp, Mus musculus
cggagccagcggttgaagctaccca

SEQ ID NO: 911027 - DNA, 25 bp, Mus musculus
cggagccagttcaaccacatcatcc

SEQ ID NO: 911028 - DNA, 25 bp, Mus musculus
cggagccagttctaccacatcatcc

SEQ ID NO: 911029 - DNA, 25 bp, Mus musculus
cggagccggcgagacgttaattctc

SEQ ID NO: 911030 - DNA, 25 bp, Mus musculus
cggagccggcgagaggttaattctc

SEQ ID NO: 911031 - DNA, 25 bp, Mus musculus
cggagcctatgatgcgaaaattaaa

SEQ ID NO: 911032 - DNA, 25 bp, Mus musculus
cggagcctatgatgggaaaattaaa

SEQ ID NO: 911033 - DNA, 25 bp, Mus musculus
cggagcctccttcacgcctcaggct

SEQ ID NO: 911034 - DNA, 25 bp, Mus musculus
cggagcctccttcaggcctcaggct

SEQ ID NO: 911035 - DNA, 25 bp, Mus musculus
cggagccttcagcacgatttattct

SEQ ID NO: 911036 - DNA, 25 bp, Mus musculus
cggagccttcaggacgatttattct

SEQ ID NO: 911037 - DNA, 25 bp, Mus musculus
cggagcgaccggctcatgtaggaaa

SEQ ID NO: 911038 - DNA, 25 bp, Mus musculus
cggagcgaccgggtcatgtaggaaa

SEQ ID NO: 911039 - DNA, 25 bp, Mus musculus
cggagcggctcacgttccagctacg

SEQ ID NO: 911040 - DNA, 25 bp, Mus musculus
cggagcggctcaggttccagctacg

SEQ ID NO: 911041 - DNA, 25 bp, Mus musculus
cggagcggggcccgggtctgcgtgc

SEQ ID NO: 911042 - DNA, 25 bp, Mus musculus
cggagcggggccggggtctgcgtgc

SEQ ID NO: 911043 - DNA, 25 bp, Mus musculus
cggagctgcctacgcgtatcatacc

SEQ ID NO: 911044 - DNA, 25 bp, Mus musculus
cggagctgcctacgggtatcatacc

SEQ ID NO: 911045 - DNA, 25 bp, Mus musculus
cggagctgctgctccgagagcggga

SEQ ID NO: 911046 - DNA, 25 bp, Mus musculus
cggagctgctgctcggagagcggga

SEQ ID NO: 911047 - DNA, 25 bp, Mus musculus
cggagctttgaacaaagagtggaag

SEQ ID NO: 911048 - DNA, 25 bp, Mus musculus
cggagctttgagatgctggttgttg

SEQ ID NO: 911049 - DNA, 25 bp, Mus musculus
cggagctttgagttgctggttgttg

SEQ ID NO: 911050 - DNA, 25 bp, Mus musculus
cggagctttgtacaaagagtggaag

SEQ ID NO: 911051 - DNA, 25 bp, Mus musculus
cggaggaaggccccaaagatgcctt

SEQ ID NO: 911052 - DNA, 25 bp, Mus musculus
cggaggaagggcccaaagatgcctt

SEQ ID NO: 911053 - DNA, 25 bp, Mus musculus
cggaggagatggacgtggatgagtg

SEQ ID NO: 911054 - DNA, 25 bp, Mus musculus
cggaggagatggagcacgccccaga

SEQ ID NO: 911055 - DNA, 25 bp, Mus musculus
cggaggagatggtcgtggatgagtg

SEQ ID NO: 911056 - DNA, 25 bp, Mus musculus
cggaggagatggtgcacgccccaga

SEQ ID NO: 911057 - DNA, 25 bp, Mus musculus
cggaggagccagcaaggtggtcagt

SEQ ID NO: 911058 - DNA, 25 bp, Mus musculus
cggaggagccaggaaggtggtcagt

SEQ ID NO: 911059 - DNA, 25 bp, Mus musculus
cggaggaggcggacgagcaaaaatc

SEQ ID NO: 911060 - DNA, 25 bp, Mus musculus
cggaggaggcggtcgagcaaaaatc

SEQ ID NO: 911061 - DNA, 25 bp, Mus musculus
cggaggagggcaccagaaccagaca

SEQ ID NO: 911062 - DNA, 25 bp, Mus musculus
cggaggagggcacgaatcccagcca

SEQ ID NO: 911063 - DNA, 25 bp, Mus musculus
cggaggagggcagcagaaccagaca

SEQ ID NO: 911064 - DNA, 25 bp, Mus musculus
cggaggagggcaggaatcccagcca

SEQ ID NO: 911065 - DNA, 25 bp, Mus musculus
cggaggaggtggcaccgctctcaaa

SEQ ID NO: 911066 - DNA, 25 bp, Mus musculus
cggaggaggtggcagcgctctcaaa

SEQ ID NO: 911067 - DNA, 25 bp, Mus musculus
cggaggagtgctgtggaaggcagtg

SEQ ID NO: 911068 - DNA, 25 bp, Mus musculus
cggaggagtggtgtggaaggcagtg

SEQ ID NO: 911069 - DNA, 25 bp, Mus musculus
cggaggatcaagacgaaactgcagc

SEQ ID NO: 911070 - DNA, 25 bp, Mus musculus
cggaggatcaagagttgaaagcgct

SEQ ID NO: 911071 - DNA, 25 bp, Mus musculus
cggaggatcaagtcgaaactgcagc

SEQ ID NO: 911072 - DNA, 25 bp, Mus musculus
cggaggatcaagtgttgaaagcgct

SEQ ID NO: 911073 - DNA, 25 bp, Mus musculus
cggaggattcacctatgggacccag

SEQ ID NO: 911074 - DNA, 25 bp, Mus musculus
cggaggattcacgtatgggacccag

SEQ ID NO: 911075 - DNA, 25 bp, Mus musculus
cggaggcagaacacagttcgatcct

SEQ ID NO: 911076 - DNA, 25 bp, Mus musculus
cggaggcagatcacagttcgatcct

SEQ ID NO: 911077 - DNA, 25 bp, Mus musculus
cggaggccagatctggtccgcatac

SEQ ID NO: 911078 - DNA, 25 bp, Mus musculus
cggaggccagcctgtccttctactc

SEQ ID NO: 911079 - DNA, 25 bp, Mus musculus
cggaggccaggctgtccttctactc

SEQ ID NO: 911080 - DNA, 25 bp, Mus musculus
cggaggccagttctggtccgcatac

SEQ ID NO: 911081 - DNA, 25 bp, Mus musculus
cggaggccctgacccattcacaatg

SEQ ID NO: 911082 - DNA, 25 bp, Mus musculus
cggaggccctgaccgattcacaatg

SEQ ID NO: 911083 - DNA, 25 bp, Mus musculus
cggaggcctgctcatgctcctgcca

SEQ ID NO: 911084 - DNA, 25 bp, Mus musculus
cggaggcctgctgatgctcctgcca

SEQ ID NO: 911085 - DNA, 25 bp, Mus musculus
cggaggcgagagcccccacgcatgg

SEQ ID NO: 911086 - DNA, 25 bp, Mus musculus
cggaggcgagaggccccacgcatgg

SEQ ID NO: 911087 - DNA, 25 bp, Mus musculus
cggaggctcgcagacgcaggggtag

SEQ ID NO: 911088 - DNA, 25 bp, Mus musculus
cggaggctcgcagaggcaggggtag

SEQ ID NO: 911089 - DNA, 25 bp, Mus musculus
cggagggccatgaacggagctggca

SEQ ID NO: 911090 - DNA, 25 bp, Mus musculus
cggagggccatgaagggagctggca

SEQ ID NO: 911091 - DNA, 25 bp, Mus musculus
cggagggccgcaacaccaagaagga

SEQ ID NO: 911092 - DNA, 25 bp, Mus musculus
cggagggccggaacaccaagaagga

SEQ ID NO: 911093 - DNA, 25 bp, Mus musculus
cggagggcctaccaactccacatat

SEQ ID NO: 911094 - DNA, 25 bp, Mus musculus
cggagggccttccaactccacatat

SEQ ID NO: 911095 - DNA, 25 bp, Mus musculus
cggagtagtgaggccattggtcaaa

SEQ ID NO: 911096 - DNA, 25 bp, Mus musculus
cggagtagtgaggcgattggtcaaa

SEQ ID NO: 911097 - DNA, 25 bp, Mus musculus
cggagtatgacgcaaacaactccta

SEQ ID NO: 911098 - DNA, 25 bp, Mus musculus
cggagtatgacggaaacaactccta

SEQ ID NO: 911099 - DNA, 25 bp, Mus musculus
cggagtcatgcgggtctgctgcaca

SEQ ID NO: 911100 - DNA, 25 bp, Mus musculus
cggagtcatgggggtctgctgcaca

SEQ ID NO: 911101 - DNA, 25 bp, Mus musculus
cggagtccagacaccacaggctcgg

SEQ ID NO: 911102 - DNA, 25 bp, Mus musculus
cggagtccagtcaccacaggctcgg

SEQ ID NO: 911103 - DNA, 25 bp, Mus musculus
cggagtcgccatccctacaacacag

SEQ ID NO: 911104 - DNA, 25 bp, Mus musculus
cggagtcgccatctcaccccaggat

SEQ ID NO: 911105 - DNA, 25 bp, Mus musculus
cggagtcgccatgcctacaacacag

SEQ ID NO: 911106 - DNA, 25 bp, Mus musculus
cggagtcgccatgtcaccccaggat

SEQ ID NO: 911107 - DNA, 25 bp, Mus musculus
cggagtctgccgagtggttggctgt

SEQ ID NO: 911108 - DNA, 25 bp, Mus musculus
cggagtctgccgtgtggttggctgt

SEQ ID NO: 911109 - DNA, 25 bp, Mus musculus
cggagtgcggagcgcgggggcagag

SEQ ID NO: 911110 - DNA, 25 bp, Mus musculus
cggagtgcggagggcgggggcagag

SEQ ID NO: 911111 - DNA, 25 bp, Mus musculus
cggagtgctgaacatctgtgacttc

SEQ ID NO: 911112 - DNA, 25 bp, Mus musculus
cggagtgctgaagatctgtgacttc

SEQ ID NO: 911113 - DNA, 25 bp, Mus musculus
cggagtggagctgtgaaattgaggc

SEQ ID NO: 911114 - DNA, 25 bp, Mus musculus
cggagtggaggtgtgaaattgaggc

SEQ ID NO: 911115 - DNA, 25 bp, Mus musculus
cggagttcagaagacgatgactgag

SEQ ID NO: 911116 - DNA, 25 bp, Mus musculus
cggagttcagaagaggatgactgag

SEQ ID NO: 911117 - DNA, 25 bp, Mus musculus
cggagttccagacgttgttcaaaca

SEQ ID NO: 911118 - DNA, 25 bp, Mus musculus
cggagttccagaggttgttcaaaca

SEQ ID NO: 911119 - DNA, 25 bp, Mus musculus
cggatagatatccggaactatgtgc

SEQ ID NO: 911120 - DNA, 25 bp, Mus musculus
cggatagatatcgggaactatgtgc

SEQ ID NO: 911121 - DNA, 25 bp, Mus musculus
cggatatgagaactcaaactacaac

SEQ ID NO: 911122 - DNA, 25 bp, Mus musculus
cggatatgagaagtcaaactacaac

SEQ ID NO: 911123 - DNA, 25 bp, Mus musculus
cggatattggaccagccatcctcca

SEQ ID NO: 911124 - DNA, 25 bp, Mus musculus
cggatattggacgagccatcctcca

SEQ ID NO: 911125 - DNA, 25 bp, Mus musculus
cggatatttctgcttcttggaacac

SEQ ID NO: 911126 - DNA, 25 bp, Mus musculus
cggatatttctggttcttggaacac

SEQ ID NO: 911127 - DNA, 25 bp, Mus musculus
cggatcaatgcctctgcctggtacc

SEQ ID NO: 911128 - DNA, 25 bp, Mus musculus
cggatcaatggctctgcctggtacc

SEQ ID NO: 911129 - DNA, 25 bp, Mus musculus
cggatcactgatgtggacaatggct

SEQ ID NO: 911130 - DNA, 25 bp, Mus musculus
cggatcactgttgtggacaatggct

SEQ ID NO: 911131 - DNA, 25 bp, Mus musculus
cggatcataaagagctgcgagtcct

SEQ ID NO: 911132 - DNA, 25 bp, Mus musculus
cggatcataaagtgctgcgagtcct

SEQ ID NO: 911133 - DNA, 25 bp, Mus musculus
cggatccaagctcagtttgcccagc

SEQ ID NO: 911134 - DNA, 25 bp, Mus musculus
cggatccaaggtcagtttgcccagc

SEQ ID NO: 911135 - DNA, 25 bp, Mus musculus
cggatccagaagcaactgactgatt

SEQ ID NO: 911136 - DNA, 25 bp, Mus musculus
cggatccagaagcttgctttcacta

SEQ ID NO: 911137 - DNA, 25 bp, Mus musculus
cggatccagaaggaactgactgatt

SEQ ID NO: 911138 - DNA, 25 bp, Mus musculus
cggatccagaaggttgctttcacta

SEQ ID NO: 911139 - DNA, 25 bp, Mus musculus
cggatccagacacacatccgcgtcg

SEQ ID NO: 911140 - DNA, 25 bp, Mus musculus
cggatccagacacagatccgcgtcg

SEQ ID NO: 911141 - DNA, 25 bp, Mus musculus
cggatccctttgcgtcctgcgcttc

SEQ ID NO: 911142 - DNA, 25 bp, Mus musculus
cggatccctttgcgttcacactcgc

SEQ ID NO: 911143 - DNA, 25 bp, Mus musculus
cggatccctttgggtcctgcgcttc

SEQ ID NO: 911144 - DNA, 25 bp, Mus musculus
cggatccctttgggttcacactcgc

SEQ ID NO: 911145 - DNA, 25 bp, Mus musculus
cggatccgagctgccgccgccggac

SEQ ID NO: 911146 - DNA, 25 bp, Mus musculus
cggatccgaggtgccgccgccggac

SEQ ID NO: 911147 - DNA, 25 bp, Mus musculus
cggatccgcaagctcccccccaagt

SEQ ID NO: 911148 - DNA, 25 bp, Mus musculus
cggatccgcaagctctctgatcagt

SEQ ID NO: 911149 - DNA, 25 bp, Mus musculus
cggatccgcaagctgccccccaagt

SEQ ID NO: 911150 - DNA, 25 bp, Mus musculus
cggatccgcaagctgtctgatcagt

SEQ ID NO: 911151 - DNA, 25 bp, Mus musculus
cggatcgcagctgcctgtcccagag

SEQ ID NO: 911152 - DNA, 25 bp, Mus musculus
cggatcgcaggtgcctgtcccagag

SEQ ID NO: 911153 - DNA, 25 bp, Mus musculus
cggatctcagataataaccaaagag

SEQ ID NO: 911154 - DNA, 25 bp, Mus musculus
cggatctcagattataaccaaagag

SEQ ID NO: 911155 - DNA, 25 bp, Mus musculus
cggatcttcaacacaggtgtgtgat

SEQ ID NO: 911156 - DNA, 25 bp, Mus musculus
cggatcttcaacagtgtgtgatgtg

SEQ ID NO: 911157 - DNA, 25 bp, Mus musculus
cggatcttcaactcaggtgtgtgat

SEQ ID NO: 911158 - DNA, 25 bp, Mus musculus
cggatcttcaactgtgtgtgatgtg

SEQ ID NO: 911159 - DNA, 25 bp, Mus musculus
cggatctttcagcgatactccttcg

SEQ ID NO: 911160 - DNA, 25 bp, Mus musculus
cggatctttcagggatactccttcg

SEQ ID NO: 911161 - DNA, 25 bp, Mus musculus
cggatgaaaacccactgagatgagt

SEQ ID NO: 911162 - DNA, 25 bp, Mus musculus
cggatgaaaacccagtgagatgagt

SEQ ID NO: 911163 - DNA, 25 bp, Mus musculus
cggatgacacctgacgatttgacgg

SEQ ID NO: 911164 - DNA, 25 bp, Mus musculus
cggatgacacctgaggatttgacgg

SEQ ID NO: 911165 - DNA, 25 bp, Mus musculus
cggatgccagcggctgagctggctc

SEQ ID NO: 911166 - DNA, 25 bp, Mus musculus
cggatgccaggggctgagctggctc

SEQ ID NO: 911167 - DNA, 25 bp, Mus musculus
cggatgctgtcgctggctacagatg

SEQ ID NO: 911168 - DNA, 25 bp, Mus musculus
cggatgctgtcggtggctacagatg

SEQ ID NO: 911169 - DNA, 25 bp, Mus musculus
cggatgctgtgaccacgacagaaaa

SEQ ID NO: 911170 - DNA, 25 bp, Mus musculus
cggatgctgtgagcacgacagaaaa

SEQ ID NO: 911171 - DNA, 25 bp, Mus musculus
cggatggaaaagcacctggatgctt

SEQ ID NO: 911172 - DNA, 25 bp, Mus musculus
cggatggaaaaggacctggatgctt

SEQ ID NO: 911173 - DNA, 25 bp, Mus musculus
cggatggacaatcaccgcctgttgg

SEQ ID NO: 911174 - DNA, 25 bp, Mus musculus
cggatggacaatcagcgcctgttgg

SEQ ID NO: 911175 - DNA, 25 bp, Mus musculus
cggatggaccaacgggtaggtctgg

SEQ ID NO: 911176 - DNA, 25 bp, Mus musculus
cggatggaccaaggggtaggtctgg

SEQ ID NO: 911177 - DNA, 25 bp, Mus musculus
cggatgtatccacgctcacccagac

SEQ ID NO: 911178 - DNA, 25 bp, Mus musculus
cggatgtatccaggctcacccagac

SEQ ID NO: 911179 - DNA, 25 bp, Mus musculus
cggatgtgcagttacgtatctctgg

SEQ ID NO: 911180 - DNA, 25 bp, Mus musculus
cggatgtgcagttaggtatctctgg

SEQ ID NO: 911181 - DNA, 25 bp, Mus musculus
cggatgtgttcacaggaaagattac

SEQ ID NO: 911182 - DNA, 25 bp, Mus musculus
cggatgtgttcagaggaaagattac

SEQ ID NO: 911183 - DNA, 25 bp, Mus musculus
cggatgttcgacagaatttttggac

SEQ ID NO: 911184 - DNA, 25 bp, Mus musculus
cggatgttcgacagtatttttggac

SEQ ID NO: 911185 - DNA, 25 bp, Mus musculus
cggattacatagagtatcccctact

SEQ ID NO: 911186 - DNA, 25 bp, Mus musculus
cggattacatagccaacaaggagag

SEQ ID NO: 911187 - DNA, 25 bp, Mus musculus
cggattacataggcaacaaggagag

SEQ ID NO: 911188 - DNA, 25 bp, Mus musculus
cggattacatagtgtatcccctact

SEQ ID NO: 911189 - DNA, 25 bp, Mus musculus
cggattattgcagatccatcacttc

SEQ ID NO: 911190 - DNA, 25 bp, Mus musculus
cggattattggagatccatcacttc

SEQ ID NO: 911191 - DNA, 25 bp, Mus musculus
cggattcacaaataaagtggtgaca

SEQ ID NO: 911192 - DNA, 25 bp, Mus musculus
cggattcacatataaagtggtgaca

SEQ ID NO: 911193 - DNA, 25 bp, Mus musculus
cggattcagagcgacaggagattga

SEQ ID NO: 911194 - DNA, 25 bp, Mus musculus
cggattcagagcgagaggagattga

SEQ ID NO: 911195 - DNA, 25 bp, Mus musculus
cggattccgcagcggagaagaccac

SEQ ID NO: 911196 - DNA, 25 bp, Mus musculus
cggattccgcaggggagaagaccac

SEQ ID NO: 911197 - DNA, 25 bp, Mus musculus
cggattctgaagacagacatgatgt

SEQ ID NO: 911198 - DNA, 25 bp, Mus musculus
cggattctgaagtcagacatgatgt

SEQ ID NO: 911199 - DNA, 25 bp, Mus musculus
cggattctggcattgaagagggtca

SEQ ID NO: 911200 - DNA, 25 bp, Mus musculus
cggattctgggattgaagagggtca

SEQ ID NO: 911201 - DNA, 25 bp, Mus musculus
cggattgagcagatggatgaggtca

SEQ ID NO: 911202 - DNA, 25 bp, Mus musculus
cggattgagcagttggatgaggtca

SEQ ID NO: 911203 - DNA, 25 bp, Mus musculus
cggattgcctggagagtgtgaagga

SEQ ID NO: 911204 - DNA, 25 bp, Mus musculus
cggattgcctggtgagtgtgaagga

SEQ ID NO: 911205 - DNA, 25 bp, Mus musculus
cggcaaagaaaacaccgctattcca

SEQ ID NO: 911206 - DNA, 25 bp, Mus musculus
cggcaaagaaaacagcgctattcca

SEQ ID NO: 911207 - DNA, 25 bp, Mus musculus
cggcaaagagccattctggaattta

SEQ ID NO: 911208 - DNA, 25 bp, Mus musculus
cggcaaagaggcattctggaattta

SEQ ID NO: 911209 - DNA, 25 bp, Mus musculus
cggcaaattgtcagcgacatgaagg

SEQ ID NO: 911210 - DNA, 25 bp, Mus musculus
cggcaaattgtcagggacatgaagg

SEQ ID NO: 911211 - DNA, 25 bp, Mus musculus
cggcaacaagacgctgccgtccagg

SEQ ID NO: 911212 - DNA, 25 bp, Mus musculus
cggcaacaagtcgctgccgtccagg

SEQ ID NO: 911213 - DNA, 25 bp, Mus musculus
cggcaacgccaccggcaagctggtg

SEQ ID NO: 911214 - DNA, 25 bp, Mus musculus
cggcaacgccacgggcaagctggtg

SEQ ID NO: 911215 - DNA, 25 bp, Mus musculus
cggcaagcagaagggcgggtcctgc

SEQ ID NO: 911216 - DNA, 25 bp, Mus musculus
cggcaagcagaatgtcatcaaaaag

SEQ ID NO: 911217 - DNA, 25 bp, Mus musculus
cggcaagcagtagggcgggtcctgc

SEQ ID NO: 911218 - DNA, 25 bp, Mus musculus
cggcaagcagtatgtcatcaaaaag

SEQ ID NO: 911219 - DNA, 25 bp, Mus musculus
cggcaagcccctcccgacacccatc

SEQ ID NO: 911220 - DNA, 25 bp, Mus musculus
cggcaagcccctccgacacctgcgg

SEQ ID NO: 911221 - DNA, 25 bp, Mus musculus
cggcaagcccctgccgacacccatc

SEQ ID NO: 911222 - DNA, 25 bp, Mus musculus
cggcaagcccctgcgacacctgcgg

SEQ ID NO: 911223 - DNA, 25 bp, Mus musculus
cggcaaggggagactggccaatcac

SEQ ID NO: 911224 - DNA, 25 bp, Mus musculus
cggcaaggggagtctggccaatcac

SEQ ID NO: 911225 - DNA, 25 bp, Mus musculus
cggcaagtgtgaccggatccggggt

SEQ ID NO: 911226 - DNA, 25 bp, Mus musculus
cggcaagtgtgagcggatccggggt

SEQ ID NO: 911227 - DNA, 25 bp, Mus musculus
cggcacaaagcaacctacctgacac

SEQ ID NO: 911228 - DNA, 25 bp, Mus musculus
cggcacaaaggaacctacctgacac

SEQ ID NO: 911229 - DNA, 25 bp, Mus musculus
cggcacaatcagagccttggctgtt

SEQ ID NO: 911230 - DNA, 25 bp, Mus musculus
cggcacaatcagtgccttggctgtt

SEQ ID NO: 911231 - DNA, 25 bp, Mus musculus
cggcacacagagtggacttgattgc

SEQ ID NO: 911232 - DNA, 25 bp, Mus musculus
cggcacacagtgtggacttgattgc

SEQ ID NO: 911233 - DNA, 25 bp, Mus musculus
cggcacactgaaaagatccgcttca

SEQ ID NO: 911234 - DNA, 25 bp, Mus musculus
cggcacactgatgagcgcccctaca

SEQ ID NO: 911235 - DNA, 25 bp, Mus musculus
cggcacactgtaaagatccgcttca

SEQ ID NO: 911236 - DNA, 25 bp, Mus musculus
cggcacactgttgagcgcccctaca

SEQ ID NO: 911237 - DNA, 25 bp, Mus musculus
cggcacattgaacatgagtttgatg

SEQ ID NO: 911238 - DNA, 25 bp, Mus musculus
cggcacattgaagatgagtttgatg

SEQ ID NO: 911239 - DNA, 25 bp, Mus musculus
cggcaccaacagcgccaggcagcac

SEQ ID NO: 911240 - DNA, 25 bp, Mus musculus
cggcaccaacagggccaggcagcac

SEQ ID NO: 911241 - DNA, 25 bp, Mus musculus
cggcaccatgccgtttatgtttgaa

SEQ ID NO: 911242 - DNA, 25 bp, Mus musculus
cggcaccatggcgtttatgtttgaa

SEQ ID NO: 911243 - DNA, 25 bp, Mus musculus
cggcacccctgactacttggctcca

SEQ ID NO: 911244 - DNA, 25 bp, Mus musculus
cggcacccctgagtacttggctcca

SEQ ID NO: 911245 - DNA, 25 bp, Mus musculus
cggcactggagacgtatcttcagag

SEQ ID NO: 911246 - DNA, 25 bp, Mus musculus
cggcactggagaggtatcttcagag

SEQ ID NO: 911247 - DNA, 25 bp, Mus musculus
cggcacttgtagcttggactctatg

SEQ ID NO: 911248 - DNA, 25 bp, Mus musculus
cggcacttgtaggttggactctatg

SEQ ID NO: 911249 - DNA, 25 bp, Mus musculus
cggcagaacgcaccctcaccctcgc

SEQ ID NO: 911250 - DNA, 25 bp, Mus musculus
cggcagaacgcagcctcaccctcgc

SEQ ID NO: 911251 - DNA, 25 bp, Mus musculus
cggcagacatagatatgaggacaca

SEQ ID NO: 911252 - DNA, 25 bp, Mus musculus
cggcagacatagttatgaggacaca

SEQ ID NO: 911253 - DNA, 25 bp, Mus musculus
cggcagactgcaccctaggatgtca

SEQ ID NO: 911254 - DNA, 25 bp, Mus musculus
cggcagactgcactttcaggtcaga

SEQ ID NO: 911255 - DNA, 25 bp, Mus musculus
cggcagactgcagcctaggatgtca

SEQ ID NO: 911256 - DNA, 25 bp, Mus musculus
cggcagactgcagtttcaggtcaga

SEQ ID NO: 911257 - DNA, 25 bp, Mus musculus
cggcagatgggctgcgccttggccg

SEQ ID NO: 911258 - DNA, 25 bp, Mus musculus
cggcagatgggctgggccttggccg

SEQ ID NO: 911259 - DNA, 25 bp, Mus musculus
cggcagatggtacaccagccttcaa

SEQ ID NO: 911260 - DNA, 25 bp, Mus musculus
cggcagatggtacagcagccttcaa

SEQ ID NO: 911261 - DNA, 25 bp, Mus musculus
cggcagcaacagcagcagctcctga

SEQ ID NO: 911262 - DNA, 25 bp, Mus musculus
cggcagcaacaggagcagctcctga

SEQ ID NO: 911263 - DNA, 25 bp, Mus musculus
cggcagcagcagcggtaccatccca

SEQ ID NO: 911264 - DNA, 25 bp, Mus musculus
cggcagcagcaggggtaccatccca

SEQ ID NO: 911265 - DNA, 25 bp, Mus musculus
cggcagcaggccgccctagaaaatg

SEQ ID NO: 911266 - DNA, 25 bp, Mus musculus
cggcagcaggccgcgctagaaaatg

SEQ ID NO: 911267 - DNA, 25 bp, Mus musculus
cggcagccaggcgcaacctgcggga

SEQ ID NO: 911268 - DNA, 25 bp, Mus musculus
cggcagccaggcgctacctgcggga

SEQ ID NO: 911269 - DNA, 25 bp, Mus musculus
cggcagctgctgaccctgagcaatg

SEQ ID NO: 911270 - DNA, 25 bp, Mus musculus
cggcagctgctgtccctgagcaatg

SEQ ID NO: 911271 - DNA, 25 bp, Mus musculus
cggcaggaactgagtggacgacccc

SEQ ID NO: 911272 - DNA, 25 bp, Mus musculus
cggcaggaactgtgtggacgacccc

SEQ ID NO: 911273 - DNA, 25 bp, Mus musculus
cggcaggattcacgttggtgaccag

SEQ ID NO: 911274 - DNA, 25 bp, Mus musculus
cggcaggattcaggttggtgaccag

SEQ ID NO: 911275 - DNA, 25 bp, Mus musculus
cggcaggctcagcccaccccacatc

SEQ ID NO: 911276 - DNA, 25 bp, Mus musculus
cggcaggctcagcctaccgagtcta

SEQ ID NO: 911277 - DNA, 25 bp, Mus musculus
cggcaggctcagctgcaggctgtga

SEQ ID NO: 911278 - DNA, 25 bp, Mus musculus
cggcaggctcaggccaccccacatc

SEQ ID NO: 911279 - DNA, 25 bp, Mus musculus
cggcaggctcaggctaccgagtcta

SEQ ID NO: 911280 - DNA, 25 bp, Mus musculus
cggcaggctcaggtgcaggctgtga

SEQ ID NO: 911281 - DNA, 25 bp, Mus musculus
cggcagggagcacacaacctttgac

SEQ ID NO: 911282 - DNA, 25 bp, Mus musculus
cggcagggagcacacctcatcctgt

SEQ ID NO: 911283 - DNA, 25 bp, Mus musculus
cggcagggagcacagaacctttgac

SEQ ID NO: 911284 - DNA, 25 bp, Mus musculus
cggcagggagcacagctcatcctgt

SEQ ID NO: 911285 - DNA, 25 bp, Mus musculus
cggcagtggcgccgtccagaggacc

SEQ ID NO: 911286 - DNA, 25 bp, Mus musculus
cggcagtggcgcggtccagaggacc

SEQ ID NO: 911287 - DNA, 25 bp, Mus musculus
cggcatcctgtaaatggaacacgag

SEQ ID NO: 911288 - DNA, 25 bp, Mus musculus
cggcatcctgtatatggaacacgag

SEQ ID NO: 911289 - DNA, 25 bp, Mus musculus
cggcatcgcggacgatcggtcatgg

SEQ ID NO: 911290 - DNA, 25 bp, Mus musculus
cggcatcgcggaggatcggtcatgg

SEQ ID NO: 911291 - DNA, 25 bp, Mus musculus
cggcatctataatgtcacccagagg

SEQ ID NO: 911292 - DNA, 25 bp, Mus musculus
cggcatctatccggagctgacccgg

SEQ ID NO: 911293 - DNA, 25 bp, Mus musculus
cggcatctatctacgtgccctggaa

SEQ ID NO: 911294 - DNA, 25 bp, Mus musculus
cggcatctatgcggagctgacccgg

SEQ ID NO: 911295 - DNA, 25 bp, Mus musculus
cggcatctatgtacgtgccctggaa

SEQ ID NO: 911296 - DNA, 25 bp, Mus musculus
cggcatctattatgtcacccagagg

SEQ ID NO: 911297 - DNA, 25 bp, Mus musculus
cggcatcttactacctgaaccagct

SEQ ID NO: 911298 - DNA, 25 bp, Mus musculus
cggcatcttagtacctgaaccagct

SEQ ID NO: 911299 - DNA, 25 bp, Mus musculus
cggcatgaagctgcgggagctgacc

SEQ ID NO: 911300 - DNA, 25 bp, Mus musculus
cggcatgaaggtgcgggagctgacc

SEQ ID NO: 911301 - DNA, 25 bp, Mus musculus
cggcatgcagaggaatctggggtcc

SEQ ID NO: 911302 - DNA, 25 bp, Mus musculus
cggcatgcagcgtgtgtctgcagca

SEQ ID NO: 911303 - DNA, 25 bp, Mus musculus
cggcatgcagggtgtgtctgcagca

SEQ ID NO: 911304 - DNA, 25 bp, Mus musculus
cggcatgcagtggaatctggggtcc

SEQ ID NO: 911305 - DNA, 25 bp, Mus musculus
cggcatggccaactatacctccgga

SEQ ID NO: 911306 - DNA, 25 bp, Mus musculus
cggcatggccaagtatacctccgga

SEQ ID NO: 911307 - DNA, 25 bp, Mus musculus
cggcatggcgagctatgttttggac

SEQ ID NO: 911308 - DNA, 25 bp, Mus musculus
cggcatggcgaggtatgttttggac

SEQ ID NO: 911309 - DNA, 25 bp, Mus musculus
cggcatgttcaaagtgaacctgttc

SEQ ID NO: 911310 - DNA, 25 bp, Mus musculus
cggcatgttcaatgtgaacctgttc

SEQ ID NO: 911311 - DNA, 25 bp, Mus musculus
cggcattcagcttctaaatggcttc

SEQ ID NO: 911312 - DNA, 25 bp, Mus musculus
cggcattcaggttctaaatggcttc

SEQ ID NO: 911313 - DNA, 25 bp, Mus musculus
cggccaagagacggttccggaggca

SEQ ID NO: 911314 - DNA, 25 bp, Mus musculus
cggccaagagtcggttccggaggca

SEQ ID NO: 911315 - DNA, 25 bp, Mus musculus
cggccaagccaacgtggtcctgaag

SEQ ID NO: 911316 - DNA, 25 bp, Mus musculus
cggccaagccaaggtggtcctgaag

SEQ ID NO: 911317 - DNA, 25 bp, Mus musculus
cggccaagccaccaagtattcagta

SEQ ID NO: 911318 - DNA, 25 bp, Mus musculus
cggccaagccacgaagtattcagta

SEQ ID NO: 911319 - DNA, 25 bp, Mus musculus
cggccaagtctacacgtggtgtcta

SEQ ID NO: 911320 - DNA, 25 bp, Mus musculus
cggccaagtctacaggtggtgtcta

SEQ ID NO: 911321 - DNA, 25 bp, Mus musculus
cggccaatgcgaaccacttcttcgc

SEQ ID NO: 911322 - DNA, 25 bp, Mus musculus
cggccaatgcgaacgacttcttcgc

SEQ ID NO: 911323 - DNA, 25 bp, Mus musculus
cggccaattccacctgatgcaggga

SEQ ID NO: 911324 - DNA, 25 bp, Mus musculus
cggccaattccagctgatgcaggga

SEQ ID NO: 911325 - DNA, 25 bp, Mus musculus
cggccacagaagcaccaggggagaa

SEQ ID NO: 911326 - DNA, 25 bp, Mus musculus
cggccacagaagcacgggagaaccc

SEQ ID NO: 911327 - DNA, 25 bp, Mus musculus
cggccacagaagcagcaggggagaa

SEQ ID NO: 911328 - DNA, 25 bp, Mus musculus
cggccacagaagcaggggagaaccc

SEQ ID NO: 911329 - DNA, 25 bp, Mus musculus
cggccacatccacattgtgaagagg

SEQ ID NO: 911330 - DNA, 25 bp, Mus musculus
cggccacatccagattgtgaagagg

SEQ ID NO: 911331 - DNA, 25 bp, Mus musculus
cggccacggcatcgaggagaaggag

SEQ ID NO: 911332 - DNA, 25 bp, Mus musculus
cggccacggcatggaggagaaggag

SEQ ID NO: 911333 - DNA, 25 bp, Mus musculus
cggccactgaccgacaagtgccccc

SEQ ID NO: 911334 - DNA, 25 bp, Mus musculus
cggccactgaccgagaagtgccccc

SEQ ID NO: 911335 - DNA, 25 bp, Mus musculus
cggccagacacccacaggctggtcc

SEQ ID NO: 911336 - DNA, 25 bp, Mus musculus
cggccagacacccagaggctggtcc

SEQ ID NO: 911337 - DNA, 25 bp, Mus musculus
cggccagatccacggctttgcagtc

SEQ ID NO: 911338 - DNA, 25 bp, Mus musculus
cggccagatccagggctttgcagtc

SEQ ID NO: 911339 - DNA, 25 bp, Mus musculus
cggccagcagatcgtgtccagccct

SEQ ID NO: 911340 - DNA, 25 bp, Mus musculus
cggccagcagctactcctgagcact

SEQ ID NO: 911341 - DNA, 25 bp, Mus musculus
cggccagcaggtactcctgagcact

SEQ ID NO: 911342 - DNA, 25 bp, Mus musculus
cggccagcagttcgtgtccagccct

SEQ ID NO: 911343 - DNA, 25 bp, Mus musculus
cggccagcccagcgcaaacgctaca

SEQ ID NO: 911344 - DNA, 25 bp, Mus musculus
cggccagcccagcggcacctacccg

SEQ ID NO: 911345 - DNA, 25 bp, Mus musculus
cggccagcccagggcaaacgctaca

SEQ ID NO: 911346 - DNA, 25 bp, Mus musculus
cggccagcccaggggcacctacccg

SEQ ID NO: 911347 - DNA, 25 bp, Mus musculus
cggccagtcagaatacagtttggtc

SEQ ID NO: 911348 - DNA, 25 bp, Mus musculus
cggccagtcagattacagtttggtc

SEQ ID NO: 911349 - DNA, 25 bp, Mus musculus
cggccatgggctctgtgacagcagc

SEQ ID NO: 911350 - DNA, 25 bp, Mus musculus
cggccatggggtctgtgacagcagc

SEQ ID NO: 911351 - DNA, 25 bp, Mus musculus
cggccattgtagctttcagtgtctg

SEQ ID NO: 911352 - DNA, 25 bp, Mus musculus
cggccattgtaggtttcagtgtctg

SEQ ID NO: 911353 - DNA, 25 bp, Mus musculus
cggcccaaagagatgaagttggcgc

SEQ ID NO: 911354 - DNA, 25 bp, Mus musculus
cggcccaaagagttgaagttggcgc

SEQ ID NO: 911355 - DNA, 25 bp, Mus musculus
cggcccaagtcacgacttgcccagg

SEQ ID NO: 911356 - DNA, 25 bp, Mus musculus
cggcccaagtcaggacttgcccagg

SEQ ID NO: 911357 - DNA, 25 bp, Mus musculus
cggcccacccagcacctgtgaactc

SEQ ID NO: 911358 - DNA, 25 bp, Mus musculus
cggcccacccaggacctgtgaactc

SEQ ID NO: 911359 - DNA, 25 bp, Mus musculus
cggcccactcactactgggaacacc

SEQ ID NO: 911360 - DNA, 25 bp, Mus musculus
cggcccactcactagtgggaacacc

SEQ ID NO: 911361 - DNA, 25 bp, Mus musculus
cggcccagcccgctcaagcaggtag

SEQ ID NO: 911362 - DNA, 25 bp, Mus musculus
cggcccagcccggtcaagcaggtag

SEQ ID NO: 911363 - DNA, 25 bp, Mus musculus
cggcccaggcccaccctgcaactcc

SEQ ID NO: 911364 - DNA, 25 bp, Mus musculus
cggcccaggcccattattgtgatca

SEQ ID NO: 911365 - DNA, 25 bp, Mus musculus
cggcccaggccctccctgcaactcc

SEQ ID NO: 911366 - DNA, 25 bp, Mus musculus
cggcccaggccctttattgtgatca

SEQ ID NO: 911367 - DNA, 25 bp, Mus musculus
cggccccaagcatggaatgcagaaa

SEQ ID NO: 911368 - DNA, 25 bp, Mus musculus
cggccccaaggatggaatgcagaaa

SEQ ID NO: 911369 - DNA, 25 bp, Mus musculus
cggcccctgcagaagactgctagct

SEQ ID NO: 911370 - DNA, 25 bp, Mus musculus
cggcccctgcagtagactgctagct

SEQ ID NO: 911371 - DNA, 25 bp, Mus musculus
cggcccctttctcatccagccagat

SEQ ID NO: 911372 - DNA, 25 bp, Mus musculus
cggcccctttctgatccagccagat

SEQ ID NO: 911373 - DNA, 25 bp, Mus musculus
cggccctaagagggagccggtgaag

SEQ ID NO: 911374 - DNA, 25 bp, Mus musculus
cggccctaagctttgaggattgcgt

SEQ ID NO: 911375 - DNA, 25 bp, Mus musculus
cggccctaaggtttgaggattgcgt

SEQ ID NO: 911376 - DNA, 25 bp, Mus musculus
cggccctaagtgggagccggtgaag

SEQ ID NO: 911377 - DNA, 25 bp, Mus musculus
cggccctacgcacctcccacagata

SEQ ID NO: 911378 - DNA, 25 bp, Mus musculus
cggccctacgcacgtcctgtccaga

SEQ ID NO: 911379 - DNA, 25 bp, Mus musculus
cggccctacgcagctcccacagata

SEQ ID NO: 911380 - DNA, 25 bp, Mus musculus
cggccctacgcaggtcctgtccaga

SEQ ID NO: 911381 - DNA, 25 bp, Mus musculus
cggccctgcgatgacgttggcttca

SEQ ID NO: 911382 - DNA, 25 bp, Mus musculus
cggccctgcgatgaggttggcttca

SEQ ID NO: 911383 - DNA, 25 bp, Mus musculus
cggcccttggagcacgtcaaagctg

SEQ ID NO: 911384 - DNA, 25 bp, Mus musculus
cggcccttggagcaggtcaaagctg

SEQ ID NO: 911385 - DNA, 25 bp, Mus musculus
cggccgagttcgcactttctgcact

SEQ ID NO: 911386 - DNA, 25 bp, Mus musculus
cggccgagttcggactttctgcact

SEQ ID NO: 911387 - DNA, 25 bp, Mus musculus
cggccgccagactccacagaggcgt

SEQ ID NO: 911388 - DNA, 25 bp, Mus musculus
cggccgccagtctccacagaggcgt

SEQ ID NO: 911389 - DNA, 25 bp, Mus musculus
cggccgcgaacaagaccccctctat

SEQ ID NO: 911390 - DNA, 25 bp, Mus musculus
cggccgcgaacatgaccccctctat

SEQ ID NO: 911391 - DNA, 25 bp, Mus musculus
cggccgcgccatcactcggaaccca

SEQ ID NO: 911392 - DNA, 25 bp, Mus musculus
cggccgcgccatgactcggaaccca

SEQ ID NO: 911393 - DNA, 25 bp, Mus musculus
cggccggaagagttactgtgacaac

SEQ ID NO: 911394 - DNA, 25 bp, Mus musculus
cggccggaagatggcagactttctg

SEQ ID NO: 911395 - DNA, 25 bp, Mus musculus
cggccggaagcagtggaatgtgacg

SEQ ID NO: 911396 - DNA, 25 bp, Mus musculus
cggccggaaggagtggaatgtgacg

SEQ ID NO: 911397 - DNA, 25 bp, Mus musculus
cggccggaagtgttactgtgacaac

SEQ ID NO: 911398 - DNA, 25 bp, Mus musculus
cggccggaagttggcagactttctg

SEQ ID NO: 911399 - DNA, 25 bp, Mus musculus
cggccggagtggcctctgcatccta

SEQ ID NO: 911400 - DNA, 25 bp, Mus musculus
cggccggagtggcctggtgttcccg

SEQ ID NO: 911401 - DNA, 25 bp, Mus musculus
cggccggagtgggctctgcatccta

SEQ ID NO: 911402 - DNA, 25 bp, Mus musculus
cggccggagtgggctggtgttcccg

SEQ ID NO: 911403 - DNA, 25 bp, Mus musculus
cggccggccgaacgatcatctgtcc

SEQ ID NO: 911404 - DNA, 25 bp, Mus musculus
cggccggccgaacgttcttgattgt

SEQ ID NO: 911405 - DNA, 25 bp, Mus musculus
cggccggccgaaggatcatctgtcc

SEQ ID NO: 911406 - DNA, 25 bp, Mus musculus
cggccggccgaaggttcttgattgt

SEQ ID NO: 911407 - DNA, 25 bp, Mus musculus
cggccgggagagaccctcaggactt

SEQ ID NO: 911408 - DNA, 25 bp, Mus musculus
cggccgggagagacgcagtgagaaa

SEQ ID NO: 911409 - DNA, 25 bp, Mus musculus
cggccgggagagtccctcaggactt

SEQ ID NO: 911410 - DNA, 25 bp, Mus musculus
cggccgggagagtcgcagtgagaaa

SEQ ID NO: 911411 - DNA, 25 bp, Mus musculus
cggccgggttttcaccacactgccc

SEQ ID NO: 911412 - DNA, 25 bp, Mus musculus
cggccgggttttcagcacactgccc

SEQ ID NO: 911413 - DNA, 25 bp, Mus musculus
cggcctaagccacactgacaacagc

SEQ ID NO: 911414 - DNA, 25 bp, Mus musculus
cggcctaagccacagtgacaacagc

SEQ ID NO: 911415 - DNA, 25 bp, Mus musculus
cggcctacactcatacgagaagcgg

SEQ ID NO: 911416 - DNA, 25 bp, Mus musculus
cggcctacactcttacgagaagcgg

SEQ ID NO: 911417 - DNA, 25 bp, Mus musculus
cggcctagctcacggttttatgagc

SEQ ID NO: 911418 - DNA, 25 bp, Mus musculus
cggcctagctcagggttttatgagc

SEQ ID NO: 911419 - DNA, 25 bp, Mus musculus
cggcctccagagatccgtgaagagg

SEQ ID NO: 911420 - DNA, 25 bp, Mus musculus
cggcctccagtgatccgtgaagagg

SEQ ID NO: 911421 - DNA, 25 bp, Mus musculus
cggcctcgtgcgtccacaaggctct

SEQ ID NO: 911422 - DNA, 25 bp, Mus musculus
cggcctcgtgggtccacaaggctct

SEQ ID NO: 911423 - DNA, 25 bp, Mus musculus
cggcctctaccgcacacacctgctc

SEQ ID NO: 911424 - DNA, 25 bp, Mus musculus
cggcctctaccggacacacctgctc

SEQ ID NO: 911425 - DNA, 25 bp, Mus musculus
cggcctctttggaggctcatccaaa

SEQ ID NO: 911426 - DNA, 25 bp, Mus musculus
cggcctctttggctgctgggaacgc

SEQ ID NO: 911427 - DNA, 25 bp, Mus musculus
cggcctctttgggtgctgggaacgc

SEQ ID NO: 911428 - DNA, 25 bp, Mus musculus
cggcctctttggtggctcatccaaa

SEQ ID NO: 911429 - DNA, 25 bp, Mus musculus
cggcctgcagattcaggcctgtcga

SEQ ID NO: 911430 - DNA, 25 bp, Mus musculus
cggcctgcagcacgtgtctgtgagg

SEQ ID NO: 911431 - DNA, 25 bp, Mus musculus
cggcctgcagcagacctggtactgg

SEQ ID NO: 911432 - DNA, 25 bp, Mus musculus
cggcctgcagcaggtgtctgtgagg

SEQ ID NO: 911433 - DNA, 25 bp, Mus musculus
cggcctgcagccctgtcgaggggca

SEQ ID NO: 911434 - DNA, 25 bp, Mus musculus
cggcctgcagctgcggacctatggt

SEQ ID NO: 911435 - DNA, 25 bp, Mus musculus
cggcctgcaggagacctggtactgg

SEQ ID NO: 911436 - DNA, 25 bp, Mus musculus
cggcctgcaggcctgtcgaggggca

SEQ ID NO: 911437 - DNA, 25 bp, Mus musculus
cggcctgcaggtgcggacctatggt

SEQ ID NO: 911438 - DNA, 25 bp, Mus musculus
cggcctgcagtttcaggcctgtcga

SEQ ID NO: 911439 - DNA, 25 bp, Mus musculus
cggcctgccccaccatcagaatggc

SEQ ID NO: 911440 - DNA, 25 bp, Mus musculus
cggcctgccccagcatcagaatggc

SEQ ID NO: 911441 - DNA, 25 bp, Mus musculus
cggcctgctgatgcaagctgagagg

SEQ ID NO: 911442 - DNA, 25 bp, Mus musculus
cggcctgctgatgctagctgagagg

SEQ ID NO: 911443 - DNA, 25 bp, Mus musculus
cggcctggcacaagccctggtggaa

SEQ ID NO: 911444 - DNA, 25 bp, Mus musculus
cggcctggcacatgccctggtggaa

SEQ ID NO: 911445 - DNA, 25 bp, Mus musculus
cggcctggcccgcacttagcattca

SEQ ID NO: 911446 - DNA, 25 bp, Mus musculus
cggcctggcccggacttagcattca

SEQ ID NO: 911447 - DNA, 25 bp, Mus musculus
cggcctggggagaatgagcagtttg

SEQ ID NO: 911448 - DNA, 25 bp, Mus musculus
cggcctggggagtatgagcagtttg

SEQ ID NO: 911449 - DNA, 25 bp, Mus musculus
cggccttacccacagctcatctctc

SEQ ID NO: 911450 - DNA, 25 bp, Mus musculus
cggccttacccagagctcatctctc

SEQ ID NO: 911451 - DNA, 25 bp, Mus musculus
cggccttgacgacatgctgttggct

SEQ ID NO: 911452 - DNA, 25 bp, Mus musculus
cggccttgacgacgggatgagagag

SEQ ID NO: 911453 - DNA, 25 bp, Mus musculus
cggccttgacgagatgctgttggct

SEQ ID NO: 911454 - DNA, 25 bp, Mus musculus
cggccttgacgaggggatgagagag

SEQ ID NO: 911455 - DNA, 25 bp, Mus musculus
cggccttgagtgcatggccatgacg

SEQ ID NO: 911456 - DNA, 25 bp, Mus musculus
cggccttgagtggatggccatgacg

SEQ ID NO: 911457 - DNA, 25 bp, Mus musculus
cggcctttagccccagtggatctaa

SEQ ID NO: 911458 - DNA, 25 bp, Mus musculus
cggcctttagcccctgtggatctaa

SEQ ID NO: 911459 - DNA, 25 bp, Mus musculus
cggccttttccacatggatgtccct

SEQ ID NO: 911460 - DNA, 25 bp, Mus musculus
cggccttttccagatggatgtccct

SEQ ID NO: 911461 - DNA, 25 bp, Mus musculus
cggcgacatgcctaaacgcaccaag

SEQ ID NO: 911462 - DNA, 25 bp, Mus musculus
cggcgacatggctaaacgcaccaag

SEQ ID NO: 911463 - DNA, 25 bp, Mus musculus
cggcgactggcccgcagaagcctca

SEQ ID NO: 911464 - DNA, 25 bp, Mus musculus
cggcgactggccggcagaagcctca

SEQ ID NO: 911465 - DNA, 25 bp, Mus musculus
cggcgagacccaaatcttggtgggc

SEQ ID NO: 911466 - DNA, 25 bp, Mus musculus
cggcgagacccatatcttggtgggc

SEQ ID NO: 911467 - DNA, 25 bp, Mus musculus
cggcgagccccaacggcagccacaa

SEQ ID NO: 911468 - DNA, 25 bp, Mus musculus
cggcgagccccatcggcagccacaa

SEQ ID NO: 911469 - DNA, 25 bp, Mus musculus
cggcgaggaaagcaaccttgaagaa

SEQ ID NO: 911470 - DNA, 25 bp, Mus musculus
cggcgaggaaagcatccttgaagaa

SEQ ID NO: 911471 - DNA, 25 bp, Mus musculus
cggcgatttgctcgctttgacagag

SEQ ID NO: 911472 - DNA, 25 bp, Mus musculus
cggcgatttggtcgctttgacagag

SEQ ID NO: 911473 - DNA, 25 bp, Mus musculus
cggcgcaggcagcaaagcgcccccc

SEQ ID NO: 911474 - DNA, 25 bp, Mus musculus
cggcgcaggcaggaaagcgcccccc

SEQ ID NO: 911475 - DNA, 25 bp, Mus musculus
cggcgccaagatccccagctcaagg

SEQ ID NO: 911476 - DNA, 25 bp, Mus musculus
cggcgccaagttccccagctcaagg

SEQ ID NO: 911477 - DNA, 25 bp, Mus musculus
cggcgccgatcacgttaaagatcga

SEQ ID NO: 911478 - DNA, 25 bp, Mus musculus
cggcgccgatcaggttaaagatcga

SEQ ID NO: 911479 - DNA, 25 bp, Mus musculus
cggcgccgtgagattcgcgcagagg

SEQ ID NO: 911480 - DNA, 25 bp, Mus musculus
cggcgccgtgagtttcgcgcagagg

SEQ ID NO: 911481 - DNA, 25 bp, Mus musculus
cggcgcctcgcctggacattgtgca

SEQ ID NO: 911482 - DNA, 25 bp, Mus musculus
cggcgcctcggctggacattgtgca

SEQ ID NO: 911483 - DNA, 25 bp, Mus musculus
cggcgcctgaagcaactcatcggtg

SEQ ID NO: 911484 - DNA, 25 bp, Mus musculus
cggcgcctgaaggaactcatcggtg

SEQ ID NO: 911485 - DNA, 25 bp, Mus musculus
cggcgcgcacagagctgaagcgctg

SEQ ID NO: 911486 - DNA, 25 bp, Mus musculus
cggcgcgcacagctgggtggctgtg

SEQ ID NO: 911487 - DNA, 25 bp, Mus musculus
cggcgcgcacaggtgggtggctgtg

SEQ ID NO: 911488 - DNA, 25 bp, Mus musculus
cggcgcgcacagtgctgaagcgctg

SEQ ID NO: 911489 - DNA, 25 bp, Mus musculus
cggcgcgccgagatgaactttctag

SEQ ID NO: 911490 - DNA, 25 bp, Mus musculus
cggcgcgccgagcgtgtgtgggatg

SEQ ID NO: 911491 - DNA, 25 bp, Mus musculus
cggcgcgccgagggtgtgtgggatg

SEQ ID NO: 911492 - DNA, 25 bp, Mus musculus
cggcgcgccgagttgaactttctag

SEQ ID NO: 911493 - DNA, 25 bp, Mus musculus
cggcgcgcctcacagactgagcggc

SEQ ID NO: 911494 - DNA, 25 bp, Mus musculus
cggcgcgcctcagagactgagcggc

SEQ ID NO: 911495 - DNA, 25 bp, Mus musculus
cggcgcgcgcagaggtttcatagtc

SEQ ID NO: 911496 - DNA, 25 bp, Mus musculus
cggcgcgcgcagtggtttcatagtc

SEQ ID NO: 911497 - DNA, 25 bp, Mus musculus
cggcgcgcggagcacactgtcgcta

SEQ ID NO: 911498 - DNA, 25 bp, Mus musculus
cggcgcgcggagcacccctctctat

SEQ ID NO: 911499 - DNA, 25 bp, Mus musculus
cggcgcgcggagcagactgtcgcta

SEQ ID NO: 911500 - DNA, 25 bp, Mus musculus
cggcgcgcggagcagccctctctat

SEQ ID NO: 911501 - DNA, 25 bp, Mus musculus
cggcgcggagacacattagcttttt

SEQ ID NO: 911502 - DNA, 25 bp, Mus musculus
cggcgcggagcttagcagatcatac

SEQ ID NO: 911503 - DNA, 25 bp, Mus musculus
cggcgcggaggttagcagatcatac

SEQ ID NO: 911504 - DNA, 25 bp, Mus musculus
cggcgcggagtcacattagcttttt

SEQ ID NO: 911505 - DNA, 25 bp, Mus musculus
cggcgcgggctccacaggcgtccgg

SEQ ID NO: 911506 - DNA, 25 bp, Mus musculus
cggcgcgggctccagaggcgtccgg

SEQ ID NO: 911507 - DNA, 25 bp, Mus musculus
cggcgctccgcccattcctttgtga

SEQ ID NO: 911508 - DNA, 25 bp, Mus musculus
cggcgctccgcccgtgagcacgagc

SEQ ID NO: 911509 - DNA, 25 bp, Mus musculus
cggcgctccgccgattcctttgtga

SEQ ID NO: 911510 - DNA, 25 bp, Mus musculus
cggcgctccgccggtgagcacgagc

SEQ ID NO: 911511 - DNA, 25 bp, Mus musculus
cggcgctggcggctgatgaagcctg

SEQ ID NO: 911512 - DNA, 25 bp, Mus musculus
cggcgctggcggctgttccgaatgc

SEQ ID NO: 911513 - DNA, 25 bp, Mus musculus
cggcgctggcgggtgatgaagcctg

SEQ ID NO: 911514 - DNA, 25 bp, Mus musculus
cggcgctggcgggtgttccgaatgc

SEQ ID NO: 911515 - DNA, 25 bp, Mus musculus
cggcgctgtcagatcaagatccact

SEQ ID NO: 911516 - DNA, 25 bp, Mus musculus
cggcgctgtcagttcaagatccact

SEQ ID NO: 911517 - DNA, 25 bp, Mus musculus
cggcggacagagttgatggtgtcaa

SEQ ID NO: 911518 - DNA, 25 bp, Mus musculus
cggcggacagtgttgatggtgtcaa

SEQ ID NO: 911519 - DNA, 25 bp, Mus musculus
cggcggagagatcgagttgaggact

SEQ ID NO: 911520 - DNA, 25 bp, Mus musculus
cggcggagagatgagcctacggtga

SEQ ID NO: 911521 - DNA, 25 bp, Mus musculus
cggcggagagttcgagttgaggact

SEQ ID NO: 911522 - DNA, 25 bp, Mus musculus
cggcggagagttgagcctacggtga

SEQ ID NO: 911523 - DNA, 25 bp, Mus musculus
cggcggaggagccacgaaggtggtc

SEQ ID NO: 911524 - DNA, 25 bp, Mus musculus
cggcggaggagccaggaaggtggtc

SEQ ID NO: 911525 - DNA, 25 bp, Mus musculus
cggcggcaaaaggacattctcctat

SEQ ID NO: 911526 - DNA, 25 bp, Mus musculus
cggcggcaaatggacattctcctat

SEQ ID NO: 911527 - DNA, 25 bp, Mus musculus
cggcggcagcagcacgggtaccatc

SEQ ID NO: 911528 - DNA, 25 bp, Mus musculus
cggcggcagcagcaggggtaccatc

SEQ ID NO: 911529 - DNA, 25 bp, Mus musculus
cggcggccagcacatcgtgtccagc

SEQ ID NO: 911530 - DNA, 25 bp, Mus musculus
cggcggccagcacgtactcctgagc

SEQ ID NO: 911531 - DNA, 25 bp, Mus musculus
cggcggccagcagatcgtgtccagc

SEQ ID NO: 911532 - DNA, 25 bp, Mus musculus
cggcggccagcaggtactcctgagc

SEQ ID NO: 911533 - DNA, 25 bp, Mus musculus
cggcggcccgacgctgcggccaggc

SEQ ID NO: 911534 - DNA, 25 bp, Mus musculus
cggcggcccgtcgctgcggccaggc

SEQ ID NO: 911535 - DNA, 25 bp, Mus musculus
cggcggccggagtgccctctgcatc

SEQ ID NO: 911536 - DNA, 25 bp, Mus musculus
cggcggccggagtgcgctggtgttc

SEQ ID NO: 911537 - DNA, 25 bp, Mus musculus
cggcggccggagtggcctctgcatc

SEQ ID NO: 911538 - DNA, 25 bp, Mus musculus
cggcggccggagtgggctggtgttc

SEQ ID NO: 911539 - DNA, 25 bp, Mus musculus
cggcggcgagaagccgctgcggcct

SEQ ID NO: 911540 - DNA, 25 bp, Mus musculus
cggcggcgagtagccgctgcggcct

SEQ ID NO: 911541 - DNA, 25 bp, Mus musculus
cggcggcgcgcacacagctgaagcg

SEQ ID NO: 911542 - DNA, 25 bp, Mus musculus
cggcggcgcgcacacctgggtggct

SEQ ID NO: 911543 - DNA, 25 bp, Mus musculus
cggcggcgcgcacagagctgaagcg

SEQ ID NO: 911544 - DNA, 25 bp, Mus musculus
cggcggcgcgcacagctgggtggct

SEQ ID NO: 911545 - DNA, 25 bp, Mus musculus
cggcggcggcagaacccagcagtga

SEQ ID NO: 911546 - DNA, 25 bp, Mus musculus
cggcggcggcagtacccagcagtga

SEQ ID NO: 911547 - DNA, 25 bp, Mus musculus
cggcggcggcggcacaacccagcag

SEQ ID NO: 911548 - DNA, 25 bp, Mus musculus
cggcggcggcggcagaacccagcag

SEQ ID NO: 911549 - DNA, 25 bp, Mus musculus
cggcggcgggacaacctggggtctc

SEQ ID NO: 911550 - DNA, 25 bp, Mus musculus
cggcggcgggacaacgaggtctgaa

SEQ ID NO: 911551 - DNA, 25 bp, Mus musculus
cggcggcgggacaagctggggtctc

SEQ ID NO: 911552 - DNA, 25 bp, Mus musculus
cggcggcgggacaaggaggtctgaa

SEQ ID NO: 911553 - DNA, 25 bp, Mus musculus
cggcggctgcagcacgccaccatgg

SEQ ID NO: 911554 - DNA, 25 bp, Mus musculus
cggcggctgcagcaggccaccatgg

SEQ ID NO: 911555 - DNA, 25 bp, Mus musculus
cggcggctgcgagaccttcctctca

SEQ ID NO: 911556 - DNA, 25 bp, Mus musculus
cggcggctgcgagagcttcctctca

SEQ ID NO: 911557 - DNA, 25 bp, Mus musculus
cggcgggaagcttggctgctggagg

SEQ ID NO: 911558 - DNA, 25 bp, Mus musculus
cggcgggaaggttggctgctggagg

SEQ ID NO: 911559 - DNA, 25 bp, Mus musculus
cggcgggacaagcaggtctgaagaa

SEQ ID NO: 911560 - DNA, 25 bp, Mus musculus
cggcgggacaagctggggtctcaga

SEQ ID NO: 911561 - DNA, 25 bp, Mus musculus
cggcgggacaaggaggtctgaagaa

SEQ ID NO: 911562 - DNA, 25 bp, Mus musculus
cggcgggacaaggtggggtctcaga

SEQ ID NO: 911563 - DNA, 25 bp, Mus musculus
cggcgggagcgacggagcggacatg

SEQ ID NO: 911564 - DNA, 25 bp, Mus musculus
cggcgggagcgagggagcggacatg

SEQ ID NO: 911565 - DNA, 25 bp, Mus musculus
cggcgggctgagcttttgcctgatt

SEQ ID NO: 911566 - DNA, 25 bp, Mus musculus
cggcgggctgaggttttgcctgatt

SEQ ID NO: 911567 - DNA, 25 bp, Mus musculus
cggcggggacagatctcaagaccag

SEQ ID NO: 911568 - DNA, 25 bp, Mus musculus
cggcggggacagttctcaagaccag

SEQ ID NO: 911569 - DNA, 25 bp, Mus musculus
cggcggggagcacttgcactaagaa

SEQ ID NO: 911570 - DNA, 25 bp, Mus musculus
cggcggggaggacttgcactaagaa

SEQ ID NO: 911571 - DNA, 25 bp, Mus musculus
cggcgggtaggacgcaagctgcagc

SEQ ID NO: 911572 - DNA, 25 bp, Mus musculus
cggcgggtaggaggcaagctgcagc

SEQ ID NO: 911573 - DNA, 25 bp, Mus musculus
cggcgggtggatcgggaatctgtct

SEQ ID NO: 911574 - DNA, 25 bp, Mus musculus
cggcgggtggatggggaatctgtct

SEQ ID NO: 911575 - DNA, 25 bp, Mus musculus
cggcggttgagacttctccattccc

SEQ ID NO: 911576 - DNA, 25 bp, Mus musculus
cggcggttgagagttctccattccc

SEQ ID NO: 911577 - DNA, 25 bp, Mus musculus
cggcgtcatcatccctgtctccgag

SEQ ID NO: 911578 - DNA, 25 bp, Mus musculus
cggcgtcatcatgcctgtctccgag

SEQ ID NO: 911579 - DNA, 25 bp, Mus musculus
cggcgtccagatgattgctgaagcc

SEQ ID NO: 911580 - DNA, 25 bp, Mus musculus
cggcgtccagttgattgctgaagcc

SEQ ID NO: 911581 - DNA, 25 bp, Mus musculus
cggcgtggaggtggcgtgctgtgag

SEQ ID NO: 911582 - DNA, 25 bp, Mus musculus
cggcgtggaggtggggtgctgtgag

SEQ ID NO: 911583 - DNA, 25 bp, Mus musculus
cggctaaggcgaggcattttaggtg

SEQ ID NO: 911584 - DNA, 25 bp, Mus musculus
cggctaaggcgagggattttaggtg

SEQ ID NO: 911585 - DNA, 25 bp, Mus musculus
cggctacaacttcacatatgccaag

SEQ ID NO: 911586 - DNA, 25 bp, Mus musculus
cggctacaacttcagatatgccaag

SEQ ID NO: 911587 - DNA, 25 bp, Mus musculus
cggctacgagcacgtggacatccag

SEQ ID NO: 911588 - DNA, 25 bp, Mus musculus
cggctacgaggacgtggacatccag

SEQ ID NO: 911589 - DNA, 25 bp, Mus musculus
cggctacggcttcgtgaccatggca

SEQ ID NO: 911590 - DNA, 25 bp, Mus musculus
cggctacggcttggtgaccatggca

SEQ ID NO: 911591 - DNA, 25 bp, Mus musculus
cggctacttcaacgcacatattaag

SEQ ID NO: 911592 - DNA, 25 bp, Mus musculus
cggctacttcaaggcacatattaag

SEQ ID NO: 911593 - DNA, 25 bp, Mus musculus
cggctagatcacagtcaagcaggta

SEQ ID NO: 911594 - DNA, 25 bp, Mus musculus
cggctagatcactgtcaagcaggta

SEQ ID NO: 911595 - DNA, 25 bp, Mus musculus
cggctagggtagcttgttcctgctt

SEQ ID NO: 911596 - DNA, 25 bp, Mus musculus
cggctagggtaggttgttcctgctt

SEQ ID NO: 911597 - DNA, 25 bp, Mus musculus
cggctatcagaccaggatcccgttg

SEQ ID NO: 911598 - DNA, 25 bp, Mus musculus
cggctatcagtccaggatcccgttg

SEQ ID NO: 911599 - DNA, 25 bp, Mus musculus
cggctcacagatggctgccagcaac

SEQ ID NO: 911600 - DNA, 25 bp, Mus musculus
cggctcacagccagaagactttaac

SEQ ID NO: 911601 - DNA, 25 bp, Mus musculus
cggctcacaggcagaagactttaac

SEQ ID NO: 911602 - DNA, 25 bp, Mus musculus
cggctcacagttggctgccagcaac

SEQ ID NO: 911603 - DNA, 25 bp, Mus musculus
cggctcagagctgcttcgaatccag

SEQ ID NO: 911604 - DNA, 25 bp, Mus musculus
cggctcagaggtgcttcgaatccag

SEQ ID NO: 911605 - DNA, 25 bp, Mus musculus
cggctcagatatgtcactgtccagt

SEQ ID NO: 911606 - DNA, 25 bp, Mus musculus
cggctcagatttgtcactgtccagt

SEQ ID NO: 911607 - DNA, 25 bp, Mus musculus
cggctcattgagctgaatgggcaga

SEQ ID NO: 911608 - DNA, 25 bp, Mus musculus
cggctcattgaggtgaatgggcaga

SEQ ID NO: 911609 - DNA, 25 bp, Mus musculus
cggctccaagcatgccaacaaggag

SEQ ID NO: 911610 - DNA, 25 bp, Mus musculus
cggctccaaggatgccaacaaggag

SEQ ID NO: 911611 - DNA, 25 bp, Mus musculus
cggctccacagacgttggaaagctg

SEQ ID NO: 911612 - DNA, 25 bp, Mus musculus
cggctccacagaggttggaaagctg

SEQ ID NO: 911613 - DNA, 25 bp, Mus musculus
cggctcccccagctcctcacctggg

SEQ ID NO: 911614 - DNA, 25 bp, Mus musculus
cggctcccccaggtcctcacctggg

SEQ ID NO: 911615 - DNA, 25 bp, Mus musculus
cggctcccgccacagctcaggccct

SEQ ID NO: 911616 - DNA, 25 bp, Mus musculus
cggctcccgccacctcaaggtgatg

SEQ ID NO: 911617 - DNA, 25 bp, Mus musculus
cggctcccgccacgagaatggtgcc

SEQ ID NO: 911618 - DNA, 25 bp, Mus musculus
cggctcccgccagagctcaggccct

SEQ ID NO: 911619 - DNA, 25 bp, Mus musculus
cggctcccgccagctcaaggtgatg

SEQ ID NO: 911620 - DNA, 25 bp, Mus musculus
cggctcccgccaggagaatggtgcc

SEQ ID NO: 911621 - DNA, 25 bp, Mus musculus
cggctccctcagctataagtattgt

SEQ ID NO: 911622 - DNA, 25 bp, Mus musculus
cggctccctcaggtataagtattgt

SEQ ID NO: 911623 - DNA, 25 bp, Mus musculus
cggctccctccccatgagaagaagc

SEQ ID NO: 911624 - DNA, 25 bp, Mus musculus
cggctccctccccggatatttgctt

SEQ ID NO: 911625 - DNA, 25 bp, Mus musculus
cggctccctcccgatgagaagaagc

SEQ ID NO: 911626 - DNA, 25 bp, Mus musculus
cggctccctcccgggatatttgctt

SEQ ID NO: 911627 - DNA, 25 bp, Mus musculus
cggctccggtaccacggtccagcct

SEQ ID NO: 911628 - DNA, 25 bp, Mus musculus
cggctccggtaccagggtccagcct

SEQ ID NO: 911629 - DNA, 25 bp, Mus musculus
cggctcgctaagccacactcattct

SEQ ID NO: 911630 - DNA, 25 bp, Mus musculus
cggctcgctaagccggctgcccttt

SEQ ID NO: 911631 - DNA, 25 bp, Mus musculus
cggctcgctaaggcacactcattct

SEQ ID NO: 911632 - DNA, 25 bp, Mus musculus
cggctcgctaaggcggctgcccttt

SEQ ID NO: 911633 - DNA, 25 bp, Mus musculus
cggctctcggcttggaggatcctta

SEQ ID NO: 911634 - DNA, 25 bp, Mus musculus
cggctctcgggttggaggatcctta

SEQ ID NO: 911635 - DNA, 25 bp, Mus musculus
cggctctgaccatggggaaccccct

SEQ ID NO: 911636 - DNA, 25 bp, Mus musculus
cggctctgacgatggggaaccccct

SEQ ID NO: 911637 - DNA, 25 bp, Mus musculus
cggctctgagcacttctgaagatga

SEQ ID NO: 911638 - DNA, 25 bp, Mus musculus
cggctctgagcagttctgaagatga

SEQ ID NO: 911639 - DNA, 25 bp, Mus musculus
cggctctgattggacgtcggtgagc

SEQ ID NO: 911640 - DNA, 25 bp, Mus musculus
cggctctgattggaggtcggtgagc

SEQ ID NO: 911641 - DNA, 25 bp, Mus musculus
cggctctgtgctgccttagctggat

SEQ ID NO: 911642 - DNA, 25 bp, Mus musculus
cggctctgtggtgccttagctggat

SEQ ID NO: 911643 - DNA, 25 bp, Mus musculus
cggctgagagccaggctgtcaatgc

SEQ ID NO: 911644 - DNA, 25 bp, Mus musculus
cggctgagaggcaggctgtcaatgc

SEQ ID NO: 911645 - DNA, 25 bp, Mus musculus
cggctgagcttgcacgcatctagtc

SEQ ID NO: 911646 - DNA, 25 bp, Mus musculus
cggctgagcttgcaggcatctagtc

SEQ ID NO: 911647 - DNA, 25 bp, Mus musculus
cggctgcacaagcgcgtcactgagc

SEQ ID NO: 911648 - DNA, 25 bp, Mus musculus
cggctgcacaagcgggtcactgagc

SEQ ID NO: 911649 - DNA, 25 bp, Mus musculus
cggctgcagcagcccaccatggcag

SEQ ID NO: 911650 - DNA, 25 bp, Mus musculus
cggctgcagcaggccaccatggcag

SEQ ID NO: 911651 - DNA, 25 bp, Mus musculus
cggctgcatggtagcctaagcacac

SEQ ID NO: 911652 - DNA, 25 bp, Mus musculus
cggctgcatggtaggctaagcacac

SEQ ID NO: 911653 - DNA, 25 bp, Mus musculus
cggctgccagatctatgaaggctac

SEQ ID NO: 911654 - DNA, 25 bp, Mus musculus
cggctgccagttctatgaaggctac

SEQ ID NO: 911655 - DNA, 25 bp, Mus musculus
cggctgcccactccgccttgataca

SEQ ID NO: 911656 - DNA, 25 bp, Mus musculus
cggctgcccagtccgccttgataca

SEQ ID NO: 911657 - DNA, 25 bp, Mus musculus
cggctgcgagagcttcctctcacag

SEQ ID NO: 911658 - DNA, 25 bp, Mus musculus
cggctgcgagaggttcctctcacag

SEQ ID NO: 911659 - DNA, 25 bp, Mus musculus
cggctgcgctgcgacagaggaagac

SEQ ID NO: 911660 - DNA, 25 bp, Mus musculus
cggctgcgctgcgagagaggaagac

SEQ ID NO: 911661 - DNA, 25 bp, Mus musculus
cggctgctaggcaactacaagttca

SEQ ID NO: 911662 - DNA, 25 bp, Mus musculus
cggctgctaggcaagtacaagttca

SEQ ID NO: 911663 - DNA, 25 bp, Mus musculus
cggctgctcatgcaaacgtgtgccg

SEQ ID NO: 911664 - DNA, 25 bp, Mus musculus
cggctgctcatggaaacgtgtgccg

SEQ ID NO: 911665 - DNA, 25 bp, Mus musculus
cggctgctcctggacggaggtgtgg

SEQ ID NO: 911666 - DNA, 25 bp, Mus musculus
cggctgctcctggagggaggtgtgg

SEQ ID NO: 911667 - DNA, 25 bp, Mus musculus
cggctgctggcttcaaagtgtgtta

SEQ ID NO: 911668 - DNA, 25 bp, Mus musculus
cggctgctggcttcatgtgttacag

SEQ ID NO: 911669 - DNA, 25 bp, Mus musculus
cggctgctggcttctaagtgtgtta

SEQ ID NO: 911670 - DNA, 25 bp, Mus musculus
cggctgctggcttcttgtgttacag

SEQ ID NO: 911671 - DNA, 25 bp, Mus musculus
cggctggaagagcaacaaagaagag

SEQ ID NO: 911672 - DNA, 25 bp, Mus musculus
cggctggaagaggaacaaagaagag

SEQ ID NO: 911673 - DNA, 25 bp, Mus musculus
cggctggaggagcacctgtccatca

SEQ ID NO: 911674 - DNA, 25 bp, Mus musculus
cggctggaggagcagctgtccatca

SEQ ID NO: 911675 - DNA, 25 bp, Mus musculus
cggctgggaaagcttgcagactgga

SEQ ID NO: 911676 - DNA, 25 bp, Mus musculus
cggctgggaaaggttgcagactgga

SEQ ID NO: 911677 - DNA, 25 bp, Mus musculus
cggctgggcccacgaactgcatagg

SEQ ID NO: 911678 - DNA, 25 bp, Mus musculus
cggctgggcccaggaactgcatagg

SEQ ID NO: 911679 - DNA, 25 bp, Mus musculus
cggctgggccttctacacagcgtgg

SEQ ID NO: 911680 - DNA, 25 bp, Mus musculus
cggctgggccttcttcacagcgtgg

SEQ ID NO: 911681 - DNA, 25 bp, Mus musculus
cggctggggtcattctcagagcttc

SEQ ID NO: 911682 - DNA, 25 bp, Mus musculus
cggctggggtgattctcagagcttc

SEQ ID NO: 911683 - DNA, 25 bp, Mus musculus
cggctgtatgtgcacagccccgagg

SEQ ID NO: 911684 - DNA, 25 bp, Mus musculus
cggctgtatgtgcacggatgacgac

SEQ ID NO: 911685 - DNA, 25 bp, Mus musculus
cggctgtatgtgcagcacagccccg

SEQ ID NO: 911686 - DNA, 25 bp, Mus musculus
cggctgtatgtggacagccccgagg

SEQ ID NO: 911687 - DNA, 25 bp, Mus musculus
cggctgtatgtggacggatgacgac

SEQ ID NO: 911688 - DNA, 25 bp, Mus musculus
cggctgtatgtggagcacagccccg

SEQ ID NO: 911689 - DNA, 25 bp, Mus musculus
cggctgtcagagactatgaaatccc

SEQ ID NO: 911690 - DNA, 25 bp, Mus musculus
cggctgtcagagtctatgaaatccc

SEQ ID NO: 911691 - DNA, 25 bp, Mus musculus
cggctgtggatgatttactgtgcca

SEQ ID NO: 911692 - DNA, 25 bp, Mus musculus
cggctgtggatgttttactgtgcca

SEQ ID NO: 911693 - DNA, 25 bp, Mus musculus
cggcttaatgctgattttgctcagc

SEQ ID NO: 911694 - DNA, 25 bp, Mus musculus
cggcttaatggtgattttgctcagc

SEQ ID NO: 911695 - DNA, 25 bp, Mus musculus
cggcttccggcagctgtgccaacag

SEQ ID NO: 911696 - DNA, 25 bp, Mus musculus
cggcttccgggagctgtgccaacag

SEQ ID NO: 911697 - DNA, 25 bp, Mus musculus
cggcttcctgagatgaagaaactga

SEQ ID NO: 911698 - DNA, 25 bp, Mus musculus
cggcttcctgagttgaagaaactga

SEQ ID NO: 911699 - DNA, 25 bp, Mus musculus
cggcttccttaacacagatgggagc

SEQ ID NO: 911700 - DNA, 25 bp, Mus musculus
cggcttccttaagacagatgggagc

SEQ ID NO: 911701 - DNA, 25 bp, Mus musculus
cggcttgatagtcagattggcagac

SEQ ID NO: 911702 - DNA, 25 bp, Mus musculus
cggcttgatagtgagattggcagac

SEQ ID NO: 911703 - DNA, 25 bp, Mus musculus
cggcttggcaaacgcgagagcaaac

SEQ ID NO: 911704 - DNA, 25 bp, Mus musculus
cggcttggcaaacgggagagcaaac

SEQ ID NO: 911705 - DNA, 25 bp, Mus musculus
cggcttggcgtgctcactaatgtat

SEQ ID NO: 911706 - DNA, 25 bp, Mus musculus
cggcttggcgtggtcactaatgtat

SEQ ID NO: 911707 - DNA, 25 bp, Mus musculus
cggcttgtggctgcacccgcaggct

SEQ ID NO: 911708 - DNA, 25 bp, Mus musculus
cggcttgtggctgctcccgcaggct

SEQ ID NO: 911709 - DNA, 25 bp, Mus musculus
cggctttctatacagctgggctcgt

SEQ ID NO: 911710 - DNA, 25 bp, Mus musculus
cggctttctatagagctgggctcgt

SEQ ID NO: 911711 - DNA, 25 bp, Mus musculus
cggctttctgatcacgtgttgtttg

SEQ ID NO: 911712 - DNA, 25 bp, Mus musculus
cggctttctgatcaggtgttgtttg

SEQ ID NO: 911713 - DNA, 25 bp, Mus musculus
cggctttgacagctgcaggtcctgg

SEQ ID NO: 911714 - DNA, 25 bp, Mus musculus
cggctttgacaggtgcaggtcctgg

SEQ ID NO: 911715 - DNA, 25 bp, Mus musculus
cggctttgcaagcatggagtcaaca

SEQ ID NO: 911716 - DNA, 25 bp, Mus musculus
cggctttgcaaggatggagtcaaca

SEQ ID NO: 911717 - DNA, 25 bp, Mus musculus
cgggaaagctcatgcgcggactgga

SEQ ID NO: 911718 - DNA, 25 bp, Mus musculus
cgggaaagctcatgggcggactgga

SEQ ID NO: 911719 - DNA, 25 bp, Mus musculus
cgggaaatcacgaacatagcctgta

SEQ ID NO: 911720 - DNA, 25 bp, Mus musculus
cgggaaatcacgaagatagcctgta

SEQ ID NO: 911721 - DNA, 25 bp, Mus musculus
cgggaaattacacgctctgcaaagt

SEQ ID NO: 911722 - DNA, 25 bp, Mus musculus
cgggaaattacaggctctgcaaagt

SEQ ID NO: 911723 - DNA, 25 bp, Mus musculus
cgggaaccagagcctggtcaacgag

SEQ ID NO: 911724 - DNA, 25 bp, Mus musculus
cgggaaccagaggctggtcaacgag

SEQ ID NO: 911725 - DNA, 25 bp, Mus musculus
cgggaactgctgctgtgatccttgc

SEQ ID NO: 911726 - DNA, 25 bp, Mus musculus
cgggaactgctggtgtgatccttgc

SEQ ID NO: 911727 - DNA, 25 bp, Mus musculus
cgggaagaaaagcacagtaagcttc

SEQ ID NO: 911728 - DNA, 25 bp, Mus musculus
cgggaagaaaagcagagtaagcttc

SEQ ID NO: 911729 - DNA, 25 bp, Mus musculus
cgggaagagctgccatttcagtcga

SEQ ID NO: 911730 - DNA, 25 bp, Mus musculus
cgggaagagctggcatttcagtcga

SEQ ID NO: 911731 - DNA, 25 bp, Mus musculus
cgggaagaggagcccaagtcagaac

SEQ ID NO: 911732 - DNA, 25 bp, Mus musculus
cgggaagaggaggccaagtcagaac

SEQ ID NO: 911733 - DNA, 25 bp, Mus musculus
cgggaagccccaccctgtgatggta

SEQ ID NO: 911734 - DNA, 25 bp, Mus musculus
cgggaagccccagcctgtgatggta

SEQ ID NO: 911735 - DNA, 25 bp, Mus musculus
cgggaagcgcaacacgtcacctgga

SEQ ID NO: 911736 - DNA, 25 bp, Mus musculus
cgggaagcgcaacaggtcacctgga

SEQ ID NO: 911737 - DNA, 25 bp, Mus musculus
cgggaagctaagaaactgaggctcc

SEQ ID NO: 911738 - DNA, 25 bp, Mus musculus
cgggaagctaagtaactgaggctcc

SEQ ID NO: 911739 - DNA, 25 bp, Mus musculus
cgggaaggacagcacagcaaggtac

SEQ ID NO: 911740 - DNA, 25 bp, Mus musculus
cgggaaggacagcttcaactggaga

SEQ ID NO: 911741 - DNA, 25 bp, Mus musculus
cgggaaggacaggacagcaaggtac

SEQ ID NO: 911742 - DNA, 25 bp, Mus musculus
cgggaaggacaggttcaactggaga

SEQ ID NO: 911743 - DNA, 25 bp, Mus musculus
cgggaagggacgcagtcagtgtgct

SEQ ID NO: 911744 - DNA, 25 bp, Mus musculus
cgggaagggacggagtcagtgtgct

SEQ ID NO: 911745 - DNA, 25 bp, Mus musculus
cgggaaggtgaacaagcttggacag

SEQ ID NO: 911746 - DNA, 25 bp, Mus musculus
cgggaaggtgaagaagcttggacag

SEQ ID NO: 911747 - DNA, 25 bp, Mus musculus
cgggaatgcacacgagagaaatgtc

SEQ ID NO: 911748 - DNA, 25 bp, Mus musculus
cgggaatgcacaggagagaaatgtc

SEQ ID NO: 911749 - DNA, 25 bp, Mus musculus
cgggacaagcagcagctgctcaatg

SEQ ID NO: 911750 - DNA, 25 bp, Mus musculus
cgggacaagcaggagctgctcaatg

SEQ ID NO: 911751 - DNA, 25 bp, Mus musculus
cgggacaagtggctcgcacccgatg

SEQ ID NO: 911752 - DNA, 25 bp, Mus musculus
cgggacaagtggctggcacccgatg

SEQ ID NO: 911753 - DNA, 25 bp, Mus musculus
cgggacacacagcttatctgtcctg

SEQ ID NO: 911754 - DNA, 25 bp, Mus musculus
cgggacacacaggttatctgtcctg

SEQ ID NO: 911755 - DNA, 25 bp, Mus musculus
cgggacaccatcatccagaaagaac

SEQ ID NO: 911756 - DNA, 25 bp, Mus musculus
cgggacaccatcttccagaaagaac

SEQ ID NO: 911757 - DNA, 25 bp, Mus musculus
cgggacactgcgatcttccttgact

SEQ ID NO: 911758 - DNA, 25 bp, Mus musculus
cgggacactgggatcttccttgact

SEQ ID NO: 911759 - DNA, 25 bp, Mus musculus
cgggacagataaccagcgtgcttcc

SEQ ID NO: 911760 - DNA, 25 bp, Mus musculus
cgggacagataagcagcgtgcttcc

SEQ ID NO: 911761 - DNA, 25 bp, Mus musculus
cgggaccacccagccgtggctgcca

SEQ ID NO: 911762 - DNA, 25 bp, Mus musculus
cgggaccacccagcggtggctgcca

SEQ ID NO: 911763 - DNA, 25 bp, Mus musculus
cgggaccagcagatcctatgcaccc

SEQ ID NO: 911764 - DNA, 25 bp, Mus musculus
cgggaccagcagatgctatgcaccc

SEQ ID NO: 911765 - DNA, 25 bp, Mus musculus
cgggaccccaaactgccagctgatg

SEQ ID NO: 911766 - DNA, 25 bp, Mus musculus
cgggaccccaaagtgccagctgatg

SEQ ID NO: 911767 - DNA, 25 bp, Mus musculus
cgggaccgagcagccaacagttgaa

SEQ ID NO: 911768 - DNA, 25 bp, Mus musculus
cgggaccgagcagcgaacagttgaa

SEQ ID NO: 911769 - DNA, 25 bp, Mus musculus
cgggacctcacctccaactcttctg

SEQ ID NO: 911770 - DNA, 25 bp, Mus musculus
cgggacctcagctccaactcttctg

SEQ ID NO: 911771 - DNA, 25 bp, Mus musculus
cgggacctgaagctggagaacctca

SEQ ID NO: 911772 - DNA, 25 bp, Mus musculus
cgggacctgaaggtggagaacctca

SEQ ID NO: 911773 - DNA, 25 bp, Mus musculus
cgggacgcaaagcaggaagccagca

SEQ ID NO: 911774 - DNA, 25 bp, Mus musculus
cgggacgcaaaggaggaagccagca

SEQ ID NO: 911775 - DNA, 25 bp, Mus musculus
cgggactctgatcatgttcttggtc

SEQ ID NO: 911776 - DNA, 25 bp, Mus musculus
cgggactctgatgatgttcttggtc

SEQ ID NO: 911777 - DNA, 25 bp, Mus musculus
cgggactggcatcacgggcactagc

SEQ ID NO: 911778 - DNA, 25 bp, Mus musculus
cgggactggcatcaggggcactagc

SEQ ID NO: 911779 - DNA, 25 bp, Mus musculus
cgggagaagcaacgagagtacgaga

SEQ ID NO: 911780 - DNA, 25 bp, Mus musculus
cgggagaagcaaggagagtacgaga

SEQ ID NO: 911781 - DNA, 25 bp, Mus musculus
cgggagaagctgcacgggctgtacg

SEQ ID NO: 911782 - DNA, 25 bp, Mus musculus
cgggagaagctggacgggctgtacg

SEQ ID NO: 911783 - DNA, 25 bp, Mus musculus
cgggagaatggacgaagaagctttg

SEQ ID NO: 911784 - DNA, 25 bp, Mus musculus
cgggagaatggaggaagaagctttg

SEQ ID NO: 911785 - DNA, 25 bp, Mus musculus
cgggagacagcattcgaactgttct

SEQ ID NO: 911786 - DNA, 25 bp, Mus musculus
cgggagacaggattcgaactgttct

SEQ ID NO: 911787 - DNA, 25 bp, Mus musculus
cgggagagagagccccagctgattc

SEQ ID NO: 911788 - DNA, 25 bp, Mus musculus
cgggagagagaggcccagctgattc

SEQ ID NO: 911789 - DNA, 25 bp, Mus musculus
cgggagaggtcagacgatgcaaaga

SEQ ID NO: 911790 - DNA, 25 bp, Mus musculus
cgggagaggtcagacgctgtcaaaa

SEQ ID NO: 911791 - DNA, 25 bp, Mus musculus
cgggagaggtcagaggatgcaaaga

SEQ ID NO: 911792 - DNA, 25 bp, Mus musculus
cgggagaggtcagaggctgtcaaaa

SEQ ID NO: 911793 - DNA, 25 bp, Mus musculus
cgggagatcgagcacgtgaatgagc

SEQ ID NO: 911794 - DNA, 25 bp, Mus musculus
cgggagatcgagcacgttcctcatg

SEQ ID NO: 911795 - DNA, 25 bp, Mus musculus
cgggagatcgagcaggtgaatgagc

SEQ ID NO: 911796 - DNA, 25 bp, Mus musculus
cgggagatcgagcaggttcctcatg

SEQ ID NO: 911797 - DNA, 25 bp, Mus musculus
cgggagcactaccacgaagacatgg

SEQ ID NO: 911798 - DNA, 25 bp, Mus musculus
cgggagcactaccaggaagacatgg

SEQ ID NO: 911799 - DNA, 25 bp, Mus musculus
cgggagcagaagatccgcctgaagc

SEQ ID NO: 911800 - DNA, 25 bp, Mus musculus
cgggagcagaagttccgcctgaagc

SEQ ID NO: 911801 - DNA, 25 bp, Mus musculus
cgggagcatctctccgtctatgccg

SEQ ID NO: 911802 - DNA, 25 bp, Mus musculus
cgggagcatctctcggtctatgccg

SEQ ID NO: 911803 - DNA, 25 bp, Mus musculus
cgggagcctgaaaaatacattgccc

SEQ ID NO: 911804 - DNA, 25 bp, Mus musculus
cgggagcctgaaaattacattgccc

SEQ ID NO: 911805 - DNA, 25 bp, Mus musculus
cgggagcgagcgagcggacatggac

SEQ ID NO: 911806 - DNA, 25 bp, Mus musculus
cgggagcgagggagcggacatggac

SEQ ID NO: 911807 - DNA, 25 bp, Mus musculus
cgggaggaaatggacgcaagaagac

SEQ ID NO: 911808 - DNA, 25 bp, Mus musculus
cgggaggaaatggaggcaagaagac

SEQ ID NO: 911809 - DNA, 25 bp, Mus musculus
cgggaggcagagcctggccttgaac

SEQ ID NO: 911810 - DNA, 25 bp, Mus musculus
cgggaggcagaggctggccttgaac

SEQ ID NO: 911811 - DNA, 25 bp, Mus musculus
cgggaggcatagctcgtctgaagag

SEQ ID NO: 911812 - DNA, 25 bp, Mus musculus
cgggaggcatagctggtctgaagag

SEQ ID NO: 911813 - DNA, 25 bp, Mus musculus
cgggaggcctttcacagcttcctgg

SEQ ID NO: 911814 - DNA, 25 bp, Mus musculus
cgggaggcctttcagagcttcctgg

SEQ ID NO: 911815 - DNA, 25 bp, Mus musculus
cgggaggtccggatgctgttgacgg

SEQ ID NO: 911816 - DNA, 25 bp, Mus musculus
cgggaggtccggttgctgttgacgg

SEQ ID NO: 911817 - DNA, 25 bp, Mus musculus
cgggaggtttgccacctcctattgg

SEQ ID NO: 911818 - DNA, 25 bp, Mus musculus
cgggaggtttgccagctcctattgg

SEQ ID NO: 911819 - DNA, 25 bp, Mus musculus
cgggagtactgggaaacccggcgca

SEQ ID NO: 911820 - DNA, 25 bp, Mus musculus
cgggagtactgggatacccggcgca

SEQ ID NO: 911821 - DNA, 25 bp, Mus musculus
cgggagtccctagacgtgttggtgg

SEQ ID NO: 911822 - DNA, 25 bp, Mus musculus
cgggagtccctagaggtgttggtgg

SEQ ID NO: 911823 - DNA, 25 bp, Mus musculus
cgggagtgccgacagaaggacccga

SEQ ID NO: 911824 - DNA, 25 bp, Mus musculus
cgggagtgccgagagaaggacccga

SEQ ID NO: 911825 - DNA, 25 bp, Mus musculus
cgggagttaagagacgtaatagaat

SEQ ID NO: 911826 - DNA, 25 bp, Mus musculus
cgggagttaagagaggtaatagaat

SEQ ID NO: 911827 - DNA, 25 bp, Mus musculus
cgggataactgggacgatgagcccc

SEQ ID NO: 911828 - DNA, 25 bp, Mus musculus
cgggataactgggaggatgagcccc

SEQ ID NO: 911829 - DNA, 25 bp, Mus musculus
cgggatacagctgtgaatgaggcag

SEQ ID NO: 911830 - DNA, 25 bp, Mus musculus
cgggatacaggtgtgaatgaggcag

SEQ ID NO: 911831 - DNA, 25 bp, Mus musculus
cgggatacgaacgtcgatgaggctg

SEQ ID NO: 911832 - DNA, 25 bp, Mus musculus
cgggatacgaacgtggatgaggctg

SEQ ID NO: 911833 - DNA, 25 bp, Mus musculus
cgggatacggcaggctaaggccaag

SEQ ID NO: 911834 - DNA, 25 bp, Mus musculus
cgggatacgggaggctaaggccaag

SEQ ID NO: 911835 - DNA, 25 bp, Mus musculus
cgggatatgcagctgtgcccctggc

SEQ ID NO: 911836 - DNA, 25 bp, Mus musculus
cgggatatgcaggtgtgcccctggc

SEQ ID NO: 911837 - DNA, 25 bp, Mus musculus
cgggatcaagccagagatgctttat

SEQ ID NO: 911838 - DNA, 25 bp, Mus musculus
cgggatcaaggcagagatgctttat

SEQ ID NO: 911839 - DNA, 25 bp, Mus musculus
cgggatcagcgtcggagctccgctt

SEQ ID NO: 911840 - DNA, 25 bp, Mus musculus
cgggatcagcgtgggagctccgctt

SEQ ID NO: 911841 - DNA, 25 bp, Mus musculus
cgggatgatctacactactcgttat

SEQ ID NO: 911842 - DNA, 25 bp, Mus musculus
cgggatgatctacagtactcgttat

SEQ ID NO: 911843 - DNA, 25 bp, Mus musculus
cgggatggagatgaggtgccacttc

SEQ ID NO: 911844 - DNA, 25 bp, Mus musculus
cgggatggagttgaggtgccacttc

SEQ ID NO: 911845 - DNA, 25 bp, Mus musculus
cgggatgtaaagaacagcaaccttc

SEQ ID NO: 911846 - DNA, 25 bp, Mus musculus
cgggatgtaaagaagagcaaccttc

SEQ ID NO: 911847 - DNA, 25 bp, Mus musculus
cgggatgtcaagatggtgaagaaag

SEQ ID NO: 911848 - DNA, 25 bp, Mus musculus
cgggatgtcaagcacggtaatctcc

SEQ ID NO: 911849 - DNA, 25 bp, Mus musculus
cgggatgtcaagcagggtaatctcc

SEQ ID NO: 911850 - DNA, 25 bp, Mus musculus
cgggatgtcaagttggtgaagaaag

SEQ ID NO: 911851 - DNA, 25 bp, Mus musculus
cgggattccgctcacagtttgcact

SEQ ID NO: 911852 - DNA, 25 bp, Mus musculus
cgggattccggtcacagtttgcact

SEQ ID NO: 911853 - DNA, 25 bp, Mus musculus
cgggattgtgctttgagcgctgccg

SEQ ID NO: 911854 - DNA, 25 bp, Mus musculus
cgggattgtggtttgagcgctgccg

SEQ ID NO: 911855 - DNA, 25 bp, Mus musculus
cgggatttattactcgtgatcaagc

SEQ ID NO: 911856 - DNA, 25 bp, Mus musculus
cgggatttattactggtgatcaagc

SEQ ID NO: 911857 - DNA, 25 bp, Mus musculus
cgggcaccgtcacgctcaagtccac

SEQ ID NO: 911858 - DNA, 25 bp, Mus musculus
cgggcaccgtcaggctcaagtccac

SEQ ID NO: 911859 - DNA, 25 bp, Mus musculus
cgggcacgtgaccgactccgggacg

SEQ ID NO: 911860 - DNA, 25 bp, Mus musculus
cgggcacgtgaccgtctccgggacg

SEQ ID NO: 911861 - DNA, 25 bp, Mus musculus
cgggcactggcacgcctgtacggag

SEQ ID NO: 911862 - DNA, 25 bp, Mus musculus
cgggcactggcacggctggtctaca

SEQ ID NO: 911863 - DNA, 25 bp, Mus musculus
cgggcactggcaggcctgtacggag

SEQ ID NO: 911864 - DNA, 25 bp, Mus musculus
cgggcactggcagggctggtctaca

SEQ ID NO: 911865 - DNA, 25 bp, Mus musculus
cgggcacttcgacaggttgcaggcc

SEQ ID NO: 911866 - DNA, 25 bp, Mus musculus
cgggcacttcgagaggttgcaggcc

SEQ ID NO: 911867 - DNA, 25 bp, Mus musculus
cgggcagacgccagcatccgcttgt

SEQ ID NO: 911868 - DNA, 25 bp, Mus musculus
cgggcagacggcagcatccgcttgt

SEQ ID NO: 911869 - DNA, 25 bp, Mus musculus
cgggcagcagagccccccaactcct

SEQ ID NO: 911870 - DNA, 25 bp, Mus musculus
cgggcagcagaggcccccaactcct

SEQ ID NO: 911871 - DNA, 25 bp, Mus musculus
cgggcagcgcggctgctgtatgctg

SEQ ID NO: 911872 - DNA, 25 bp, Mus musculus
cgggcagcgcgggtgctgtatgctg

SEQ ID NO: 911873 - DNA, 25 bp, Mus musculus
cgggcagcggcctggaggagggacg

SEQ ID NO: 911874 - DNA, 25 bp, Mus musculus
cgggcagcgggctggaggagggacg

SEQ ID NO: 911875 - DNA, 25 bp, Mus musculus
cgggccaagtctcgcgtggatgaaa

SEQ ID NO: 911876 - DNA, 25 bp, Mus musculus
cgggccaagtctcgggtggatgaaa

SEQ ID NO: 911877 - DNA, 25 bp, Mus musculus
cgggcccagtgcagcaggccacgcg

SEQ ID NO: 911878 - DNA, 25 bp, Mus musculus
cgggcccagtgcagcgctgtagcat

SEQ ID NO: 911879 - DNA, 25 bp, Mus musculus
cgggcccagtgcaggaggccacgcg

SEQ ID NO: 911880 - DNA, 25 bp, Mus musculus
cgggcccagtgcagggctgtagcat

SEQ ID NO: 911881 - DNA, 25 bp, Mus musculus
cgggccccgcagccacagccgccgt

SEQ ID NO: 911882 - DNA, 25 bp, Mus musculus
cgggccccgcaggcacagccgccgt

SEQ ID NO: 911883 - DNA, 25 bp, Mus musculus
cgggcccgcagtgtcagtgcctgct

SEQ ID NO: 911884 - DNA, 25 bp, Mus musculus
cgggcccgcagtgtgagtgcctgct

SEQ ID NO: 911885 - DNA, 25 bp, Mus musculus
cgggcccgggagcacgctgaagctg

SEQ ID NO: 911886 - DNA, 25 bp, Mus musculus
cgggcccgggagcaggctgaagctg

SEQ ID NO: 911887 - DNA, 25 bp, Mus musculus
cgggccggcgaaatggcaaaatgtc

SEQ ID NO: 911888 - DNA, 25 bp, Mus musculus
cgggccggcgtaatggcaaaatgtc

SEQ ID NO: 911889 - DNA, 25 bp, Mus musculus
cgggcctcgcagagacctgatgtcc

SEQ ID NO: 911890 - DNA, 25 bp, Mus musculus
cgggcctcgcagtgacctgatgtcc

SEQ ID NO: 911891 - DNA, 25 bp, Mus musculus
cgggcctgagcgtacctgaagctca

SEQ ID NO: 911892 - DNA, 25 bp, Mus musculus
cgggcctgagggtacctgaagctca

SEQ ID NO: 911893 - DNA, 25 bp, Mus musculus
cgggcctgggaacggccccagtgct

SEQ ID NO: 911894 - DNA, 25 bp, Mus musculus
cgggcctgggaagggccccagtgct

SEQ ID NO: 911895 - DNA, 25 bp, Mus musculus
cgggcgacggcgctatggtggattg

SEQ ID NO: 911896 - DNA, 25 bp, Mus musculus
cgggcgacggcgctttggtggattg

SEQ ID NO: 911897 - DNA, 25 bp, Mus musculus
cgggcgactcagccaccatgagcca

SEQ ID NO: 911898 - DNA, 25 bp, Mus musculus
cgggcgactcaggcaccatgagcca

SEQ ID NO: 911899 - DNA, 25 bp, Mus musculus
cgggcgcatctgccaaacgatgacg

SEQ ID NO: 911900 - DNA, 25 bp, Mus musculus
cgggcgcatctgcctaacgatgacg

SEQ ID NO: 911901 - DNA, 25 bp, Mus musculus
cgggcgctagctccgtctcccaggg

SEQ ID NO: 911902 - DNA, 25 bp, Mus musculus
cgggcgctaggtccgtctcccaggg

SEQ ID NO: 911903 - DNA, 25 bp, Mus musculus
cgggcggaggccgcctgtaatgttc

SEQ ID NO: 911904 - DNA, 25 bp, Mus musculus
cgggcggaggccgcgtgtaatgttc

SEQ ID NO: 911905 - DNA, 25 bp, Mus musculus
cgggcggcccagcgcggcaccttgc

SEQ ID NO: 911906 - DNA, 25 bp, Mus musculus
cgggcggcccagggcggcaccttgc

SEQ ID NO: 911907 - DNA, 25 bp, Mus musculus
cgggcggtgcagatcactgagacct

SEQ ID NO: 911908 - DNA, 25 bp, Mus musculus
cgggcggtgcagttcactgagacct

SEQ ID NO: 911909 - DNA, 25 bp, Mus musculus
cgggctaatgggaacagtacatctc

SEQ ID NO: 911910 - DNA, 25 bp, Mus musculus
cgggctaatgggaagagtacatctc

SEQ ID NO: 911911 - DNA, 25 bp, Mus musculus
cgggctacagcttgcgttacagtaa

SEQ ID NO: 911912 - DNA, 25 bp, Mus musculus
cgggctacaggttgcgttacagtaa

SEQ ID NO: 911913 - DNA, 25 bp, Mus musculus
cgggctcaaaatgtccctctcccag

SEQ ID NO: 911914 - DNA, 25 bp, Mus musculus
cgggctcaaaatgtgcctctcccag

SEQ ID NO: 911915 - DNA, 25 bp, Mus musculus
cgggctcaccttcaaaatgaagtcc

SEQ ID NO: 911916 - DNA, 25 bp, Mus musculus
cgggctcaccttctgttcgacttcc

SEQ ID NO: 911917 - DNA, 25 bp, Mus musculus
cgggctcaccttgaaaatgaagtcc

SEQ ID NO: 911918 - DNA, 25 bp, Mus musculus
cgggctcaccttgtgttcgacttcc

SEQ ID NO: 911919 - DNA, 25 bp, Mus musculus
cgggctcagtggatgagaccctttt

SEQ ID NO: 911920 - DNA, 25 bp, Mus musculus
cgggctcagtggatgttgacctcct

SEQ ID NO: 911921 - DNA, 25 bp, Mus musculus
cgggctcagtggttgagaccctttt

SEQ ID NO: 911922 - DNA, 25 bp, Mus musculus
cgggctcagtggttgttgacctcct

SEQ ID NO: 911923 - DNA, 25 bp, Mus musculus
cgggctccagaggcgtccggtcgca

SEQ ID NO: 911924 - DNA, 25 bp, Mus musculus
cgggctccagctcttcacttgagac

SEQ ID NO: 911925 - DNA, 25 bp, Mus musculus
cgggctccaggtcttcacttgagac

SEQ ID NO: 911926 - DNA, 25 bp, Mus musculus
cgggctccagtggcgtccggtcgca

SEQ ID NO: 911927 - DNA, 25 bp, Mus musculus
cgggctcctgagccatggaggggtc

SEQ ID NO: 911928 - DNA, 25 bp, Mus musculus
cgggctcctgaggcatggaggggtc

SEQ ID NO: 911929 - DNA, 25 bp, Mus musculus
cgggctctgtagcttgtgaaccatg

SEQ ID NO: 911930 - DNA, 25 bp, Mus musculus
cgggctctgtaggttgtgaaccatg

SEQ ID NO: 911931 - DNA, 25 bp, Mus musculus
cgggctgcagatgggcaccaacaag

SEQ ID NO: 911932 - DNA, 25 bp, Mus musculus
cgggctgcagttgggcaccaacaag

SEQ ID NO: 911933 - DNA, 25 bp, Mus musculus
cgggctgccaagagcccttcacagt

SEQ ID NO: 911934 - DNA, 25 bp, Mus musculus
cgggctgccaagtgcccttcacagt

SEQ ID NO: 911935 - DNA, 25 bp, Mus musculus
cgggctgtgaccgacatcaagatcc

SEQ ID NO: 911936 - DNA, 25 bp, Mus musculus
cgggctgtgaccgacgttgaacatt

SEQ ID NO: 911937 - DNA, 25 bp, Mus musculus
cgggctgtgaccgagatcaagatcc

SEQ ID NO: 911938 - DNA, 25 bp, Mus musculus
cgggctgtgaccgaggttgaacatt

SEQ ID NO: 911939 - DNA, 25 bp, Mus musculus
cgggctgtgagccgctgatctctgg

SEQ ID NO: 911940 - DNA, 25 bp, Mus musculus
cgggctgtgagccggtgatctctgg

SEQ ID NO: 911941 - DNA, 25 bp, Mus musculus
cgggcttcagagctggaggaggcca

SEQ ID NO: 911942 - DNA, 25 bp, Mus musculus
cgggcttcagcgggctgaggcgatg

SEQ ID NO: 911943 - DNA, 25 bp, Mus musculus
cgggcttcagctagaagccactcat

SEQ ID NO: 911944 - DNA, 25 bp, Mus musculus
cgggcttcagctgaggatcccattt

SEQ ID NO: 911945 - DNA, 25 bp, Mus musculus
cgggcttcagggggctgaggcgatg

SEQ ID NO: 911946 - DNA, 25 bp, Mus musculus
cgggcttcaggtagaagccactcat

SEQ ID NO: 911947 - DNA, 25 bp, Mus musculus
cgggcttcaggtgaggatcccattt

SEQ ID NO: 911948 - DNA, 25 bp, Mus musculus
cgggcttcagtgctggaggaggcca

SEQ ID NO: 911949 - DNA, 25 bp, Mus musculus
cgggcttgcctgcaagccttctcat

SEQ ID NO: 911950 - DNA, 25 bp, Mus musculus
cgggcttgcctgcatgccttctcat

SEQ ID NO: 911951 - DNA, 25 bp, Mus musculus
cgggcttgcggctaagtagtgtgtg

SEQ ID NO: 911952 - DNA, 25 bp, Mus musculus
cgggcttgcggctatgtagtgtgtg

SEQ ID NO: 911953 - DNA, 25 bp, Mus musculus
cggggaaaagcattcggactgtcct

SEQ ID NO: 911954 - DNA, 25 bp, Mus musculus
cggggaaaaggattcggactgtcct

SEQ ID NO: 911955 - DNA, 25 bp, Mus musculus
cggggaacagaacacgaaacaatgg

SEQ ID NO: 911956 - DNA, 25 bp, Mus musculus
cggggaacagaacaggaaacaatgg

SEQ ID NO: 911957 - DNA, 25 bp, Mus musculus
cggggaatgggagacatgcagaaag

SEQ ID NO: 911958 - DNA, 25 bp, Mus musculus
cggggaatgggagaccttttgccta

SEQ ID NO: 911959 - DNA, 25 bp, Mus musculus
cggggaatgggagagatgcagaaag

SEQ ID NO: 911960 - DNA, 25 bp, Mus musculus
cggggaatgggagagcttttgccta

SEQ ID NO: 911961 - DNA, 25 bp, Mus musculus
cggggacagtctcgatcaactgcta

SEQ ID NO: 911962 - DNA, 25 bp, Mus musculus
cggggacagtctggatcaactgcta

SEQ ID NO: 911963 - DNA, 25 bp, Mus musculus
cggggacgagatgatttttgatcct

SEQ ID NO: 911964 - DNA, 25 bp, Mus musculus
cggggacgagttgatttttgatcct

SEQ ID NO: 911965 - DNA, 25 bp, Mus musculus
cggggactcctatacgtcaccgtgg

SEQ ID NO: 911966 - DNA, 25 bp, Mus musculus
cggggactcctataggtcaccgtgg

SEQ ID NO: 911967 - DNA, 25 bp, Mus musculus
cggggactgagccgtcttgacgaag

SEQ ID NO: 911968 - DNA, 25 bp, Mus musculus
cggggactgagcggtcttgacgaag

SEQ ID NO: 911969 - DNA, 25 bp, Mus musculus
cggggagcagaccacgtgactggtt

SEQ ID NO: 911970 - DNA, 25 bp, Mus musculus
cggggagcagaccactaggggcaag

SEQ ID NO: 911971 - DNA, 25 bp, Mus musculus
cggggagcagaccaggtgactggtt

SEQ ID NO: 911972 - DNA, 25 bp, Mus musculus
cggggagcagaccagtaggggcaag

SEQ ID NO: 911973 - DNA, 25 bp, Mus musculus
cggggagggcaccacgtcactactt

SEQ ID NO: 911974 - DNA, 25 bp, Mus musculus
cggggagggcaccaggtcactactt

SEQ ID NO: 911975 - DNA, 25 bp, Mus musculus
cggggatcagcgcagagatggcctt

SEQ ID NO: 911976 - DNA, 25 bp, Mus musculus
cggggatcagggcagagatggcctt

SEQ ID NO: 911977 - DNA, 25 bp, Mus musculus
cggggatcgagacgcattcgaggag

SEQ ID NO: 911978 - DNA, 25 bp, Mus musculus
cggggatcgagaggcattcgaggag

SEQ ID NO: 911979 - DNA, 25 bp, Mus musculus
cggggcactctcgaccaaatcatga

SEQ ID NO: 911980 - DNA, 25 bp, Mus musculus
cggggcactctcgagcaaatcatga

SEQ ID NO: 911981 - DNA, 25 bp, Mus musculus
cggggcatcttggacaaagaggcct

SEQ ID NO: 911982 - DNA, 25 bp, Mus musculus
cggggcatcttggagaaagaggcct

SEQ ID NO: 911983 - DNA, 25 bp, Mus musculus
cggggcgaggcccatactccatgtt

SEQ ID NO: 911984 - DNA, 25 bp, Mus musculus
cggggcgaggccgatactccatgtt

SEQ ID NO: 911985 - DNA, 25 bp, Mus musculus
cggggcgcagctgggcaccacaaga

SEQ ID NO: 911986 - DNA, 25 bp, Mus musculus
cggggcgcaggtgggcaccacaaga

SEQ ID NO: 911987 - DNA, 25 bp, Mus musculus
cggggctccgatcagtcaccagccc

SEQ ID NO: 911988 - DNA, 25 bp, Mus musculus
cggggctccgttcagtcaccagccc

SEQ ID NO: 911989 - DNA, 25 bp, Mus musculus
cggggctgacagatcaacttatgag

SEQ ID NO: 911990 - DNA, 25 bp, Mus musculus
cggggctgacagttcaacttatgag

SEQ ID NO: 911991 - DNA, 25 bp, Mus musculus
cggggctgagctggctagagatctg

SEQ ID NO: 911992 - DNA, 25 bp, Mus musculus
cggggctgaggtggctagagatctg

SEQ ID NO: 911993 - DNA, 25 bp, Mus musculus
cggggctgctcccaccatggcggac

SEQ ID NO: 911994 - DNA, 25 bp, Mus musculus
cggggctgctcccagcatggcggac

SEQ ID NO: 911995 - DNA, 25 bp, Mus musculus
cggggcttgcagaggcctacgtgaa

SEQ ID NO: 911996 - DNA, 25 bp, Mus musculus
cggggcttgcagcaggtggttgcat

SEQ ID NO: 911997 - DNA, 25 bp, Mus musculus
cggggcttgcagctggttgcatttt

SEQ ID NO: 911998 - DNA, 25 bp, Mus musculus
cggggcttgcaggaggtggttgcat

SEQ ID NO: 911999 - DNA, 25 bp, Mus musculus
cggggcttgcaggtggttgcatttt

SEQ ID NO: 912000 - DNA, 25 bp, Mus musculus
cggggcttgcagtggcctacgtgaa

SEQ ID NO: 912001 - DNA, 25 bp, Mus musculus
cgggggacacagcgtgtacactgtg

SEQ ID NO: 912002 - DNA, 25 bp, Mus musculus
cgggggacacagggtgtacactgtg

SEQ ID NO: 912003 - DNA, 25 bp, Mus musculus
cgggggacagatgcagctatctatg

SEQ ID NO: 912004 - DNA, 25 bp, Mus musculus
cgggggacagttgcagctatctatg

SEQ ID NO: 912005 - DNA, 25 bp, Mus musculus
cgggggactgccaatgtttgcccgc

SEQ ID NO: 912006 - DNA, 25 bp, Mus musculus
cgggggactgcccatgtttgccagc

SEQ ID NO: 912007 - DNA, 25 bp, Mus musculus
cgggggactggcaatgtttgcccgc

SEQ ID NO: 912008 - DNA, 25 bp, Mus musculus
cgggggactggccatgtttgccagc

SEQ ID NO: 912009 - DNA, 25 bp, Mus musculus
cgggggagaagaaacatgtaagtgg

SEQ ID NO: 912010 - DNA, 25 bp, Mus musculus
cgggggagaagaaagatgtaagtgg

SEQ ID NO: 912011 - DNA, 25 bp, Mus musculus
cgggggagagctcttcttccatcta

SEQ ID NO: 912012 - DNA, 25 bp, Mus musculus
cgggggagaggtcttcttccatcta

SEQ ID NO: 912013 - DNA, 25 bp, Mus musculus
cgggggcagattcaccacagagctg

SEQ ID NO: 912014 - DNA, 25 bp, Mus musculus
cgggggcagattcacgtgattctcg

SEQ ID NO: 912015 - DNA, 25 bp, Mus musculus
cgggggcagattcagcacagagctg

SEQ ID NO: 912016 - DNA, 25 bp, Mus musculus
cgggggcagattcaggtgattctcg

SEQ ID NO: 912017 - DNA, 25 bp, Mus musculus
cgggggccagcgttatcaggcagaa

SEQ ID NO: 912018 - DNA, 25 bp, Mus musculus
cgggggccagggttatcaggcagaa

SEQ ID NO: 912019 - DNA, 25 bp, Mus musculus
cgggggcgaaggcattacagtgttt

SEQ ID NO: 912020 - DNA, 25 bp, Mus musculus
cgggggcgaagggattacagtgttt

SEQ ID NO: 912021 - DNA, 25 bp, Mus musculus
cgggggtcatcactcgcttgggtct

SEQ ID NO: 912022 - DNA, 25 bp, Mus musculus
cgggggtcatcactggcttgggtct

SEQ ID NO: 912023 - DNA, 25 bp, Mus musculus
cggggtattcagctgttccagtcaa

SEQ ID NO: 912024 - DNA, 25 bp, Mus musculus
cggggtattcaggtgttccagtcaa

SEQ ID NO: 912025 - DNA, 25 bp, Mus musculus
cggggtcgccctcgcgttccagcag

SEQ ID NO: 912026 - DNA, 25 bp, Mus musculus
cggggtcgccctcgggttccagcag

SEQ ID NO: 912027 - DNA, 25 bp, Mus musculus
cggggtgcggagctcgctcatccga

SEQ ID NO: 912028 - DNA, 25 bp, Mus musculus
cggggtgcggaggtcgctcatccga

SEQ ID NO: 912029 - DNA, 25 bp, Mus musculus
cgggtaggagccaagctgcagcatt

SEQ ID NO: 912030 - DNA, 25 bp, Mus musculus
cgggtaggaggcaagctgcagcatt

SEQ ID NO: 912031 - DNA, 25 bp, Mus musculus
cgggtatgagtgccccaggatgggt

SEQ ID NO: 912032 - DNA, 25 bp, Mus musculus
cgggtatgagtggcccaggatgggt

SEQ ID NO: 912033 - DNA, 25 bp, Mus musculus
cgggtcatcaagcgtcacagtaaat

SEQ ID NO: 912034 - DNA, 25 bp, Mus musculus
cgggtcatcaagggtcacagtaaat

SEQ ID NO: 912035 - DNA, 25 bp, Mus musculus
cgggtcatcagcaaccccctgcctg

SEQ ID NO: 912036 - DNA, 25 bp, Mus musculus
cgggtcatcagcaagcccctgcctg

SEQ ID NO: 912037 - DNA, 25 bp, Mus musculus
cgggtcatcggcaacctaatccagt

SEQ ID NO: 912038 - DNA, 25 bp, Mus musculus
cgggtcatcggcaagctaatccagt

SEQ ID NO: 912039 - DNA, 25 bp, Mus musculus
cgggtcatggaccggcaccacggta

SEQ ID NO: 912040 - DNA, 25 bp, Mus musculus
cgggtcatggtccggcaccacggta

SEQ ID NO: 912041 - DNA, 25 bp, Mus musculus
cgggtcgaagcgctcgctcatcgtg

SEQ ID NO: 912042 - DNA, 25 bp, Mus musculus
cgggtcgaagcgctggctcatcgtg

SEQ ID NO: 912043 - DNA, 25 bp, Mus musculus
cgggtctatgttcgcaatgttgctt

SEQ ID NO: 912044 - DNA, 25 bp, Mus musculus
cgggtctatgttggcaatgttgctt

SEQ ID NO: 912045 - DNA, 25 bp, Mus musculus
cgggtgatcccgatgaagagagcag

SEQ ID NO: 912046 - DNA, 25 bp, Mus musculus
cgggtgatcccgttgaagagagcag

SEQ ID NO: 912047 - DNA, 25 bp, Mus musculus
cgggtgatgctgcacaagtgggaga

SEQ ID NO: 912048 - DNA, 25 bp, Mus musculus
cgggtgatgctggacaagtgggaga

SEQ ID NO: 912049 - DNA, 25 bp, Mus musculus
cgggtgctgtgcccttctattccaa

SEQ ID NO: 912050 - DNA, 25 bp, Mus musculus
cgggtgctgtgcgcttctattccaa

SEQ ID NO: 912051 - DNA, 25 bp, Mus musculus
cgggtggatgcggaatctgtctggc

SEQ ID NO: 912052 - DNA, 25 bp, Mus musculus
cgggtggatggggaatctgtctggc

SEQ ID NO: 912053 - DNA, 25 bp, Mus musculus
cgggtggctggacttgaattcagtc

SEQ ID NO: 912054 - DNA, 25 bp, Mus musculus
cgggtggctggagttgaattcagtc

SEQ ID NO: 912055 - DNA, 25 bp, Mus musculus
cgggtggtttcctgcctggtcctgg

SEQ ID NO: 912056 - DNA, 25 bp, Mus musculus
cgggtggtttcctggctggtcctgg

SEQ ID NO: 912057 - DNA, 25 bp, Mus musculus
cgggttataagagccagaggagggg

SEQ ID NO: 912058 - DNA, 25 bp, Mus musculus
cgggttataagagcgagaggagggg

SEQ ID NO: 912059 - DNA, 25 bp, Mus musculus
cgggttctgctgactcagtgccatt

SEQ ID NO: 912060 - DNA, 25 bp, Mus musculus
cgggttctgctgcagagacagcact

SEQ ID NO: 912061 - DNA, 25 bp, Mus musculus
cgggttctgctgcgccactgccggt

SEQ ID NO: 912062 - DNA, 25 bp, Mus musculus
cgggttctgctggagagacagcact

SEQ ID NO: 912063 - DNA, 25 bp, Mus musculus
cgggttctgctgggccactgccggt

SEQ ID NO: 912064 - DNA, 25 bp, Mus musculus
cgggttctgctgtctcagtgccatt

SEQ ID NO: 912065 - DNA, 25 bp, Mus musculus
cgggttcttcagctcctggagaaag

SEQ ID NO: 912066 - DNA, 25 bp, Mus musculus
cgggttcttcaggtcctggagaaag

SEQ ID NO: 912067 - DNA, 25 bp, Mus musculus
cggtaatcaagagaacttctcggac

SEQ ID NO: 912068 - DNA, 25 bp, Mus musculus
cggtaatcaagagatcttctcggac

SEQ ID NO: 912069 - DNA, 25 bp, Mus musculus
cggtaccctggtcatcgagaaatgc

SEQ ID NO: 912070 - DNA, 25 bp, Mus musculus
cggtaccctggtgatcgagaaatgc

SEQ ID NO: 912071 - DNA, 25 bp, Mus musculus
cggtaggaagaacccattgctcctg

SEQ ID NO: 912072 - DNA, 25 bp, Mus musculus
cggtaggaagaagccattgctcctg

SEQ ID NO: 912073 - DNA, 25 bp, Mus musculus
cggtaggaagtgcagatatagatga

SEQ ID NO: 912074 - DNA, 25 bp, Mus musculus
cggtaggaagtggagatatagatga

SEQ ID NO: 912075 - DNA, 25 bp, Mus musculus
cggtagggtggcggcgccctccatg

SEQ ID NO: 912076 - DNA, 25 bp, Mus musculus
cggtagggtggcggggccctccatg

SEQ ID NO: 912077 - DNA, 25 bp, Mus musculus
cggtatctcatcctctatgcagcct

SEQ ID NO: 912078 - DNA, 25 bp, Mus musculus
cggtatctcatcctgtatgcagcct

SEQ ID NO: 912079 - DNA, 25 bp, Mus musculus
cggtattcctcaccttatggctatt

SEQ ID NO: 912080 - DNA, 25 bp, Mus musculus
cggtattcctcagcttatggctatt

SEQ ID NO: 912081 - DNA, 25 bp, Mus musculus
cggtcaatggacagcaagatccaga

SEQ ID NO: 912082 - DNA, 25 bp, Mus musculus
cggtcaatggtcagcaagatccaga

SEQ ID NO: 912083 - DNA, 25 bp, Mus musculus
cggtcacatgcaaagagcaacccgt

SEQ ID NO: 912084 - DNA, 25 bp, Mus musculus
cggtcacatggaaagagcaacccgt

SEQ ID NO: 912085 - DNA, 25 bp, Mus musculus
cggtcagagtgtgacgccggcgtgt

SEQ ID NO: 912086 - DNA, 25 bp, Mus musculus
cggtcagagtgtgaggccggcgtgt

SEQ ID NO: 912087 - DNA, 25 bp, Mus musculus
cggtcaggccaagacatgcccggaa

SEQ ID NO: 912088 - DNA, 25 bp, Mus musculus
cggtcaggccaagagatgcccggaa

SEQ ID NO: 912089 - DNA, 25 bp, Mus musculus
cggtcatcgacgcgcacaacgactt

SEQ ID NO: 912090 - DNA, 25 bp, Mus musculus
cggtcatcgacgggcacaacgactt

SEQ ID NO: 912091 - DNA, 25 bp, Mus musculus
cggtcatcggtaattcgcaccggca

SEQ ID NO: 912092 - DNA, 25 bp, Mus musculus
cggtcatcggtatttcgcaccggca

SEQ ID NO: 912093 - DNA, 25 bp, Mus musculus
cggtcattagaccacttcctggact

SEQ ID NO: 912094 - DNA, 25 bp, Mus musculus
cggtcattagcttcaaccagatgtg

SEQ ID NO: 912095 - DNA, 25 bp, Mus musculus
cggtcattaggttcaaccagatgtg

SEQ ID NO: 912096 - DNA, 25 bp, Mus musculus
cggtcattagtccacttcctggact

SEQ ID NO: 912097 - DNA, 25 bp, Mus musculus
cggtccacagcacgattccccctct

SEQ ID NO: 912098 - DNA, 25 bp, Mus musculus
cggtccacagcaggattccccctct

SEQ ID NO: 912099 - DNA, 25 bp, Mus musculus
cggtccagcgaacaatgctcattca

SEQ ID NO: 912100 - DNA, 25 bp, Mus musculus
cggtccagcgaacattgctcattca

SEQ ID NO: 912101 - DNA, 25 bp, Mus musculus
cggtcccaagcgtgacagaggcttt

SEQ ID NO: 912102 - DNA, 25 bp, Mus musculus
cggtcccaagggtgacagaggcttt

SEQ ID NO: 912103 - DNA, 25 bp, Mus musculus
cggtcctcggggcacaaaatatctg

SEQ ID NO: 912104 - DNA, 25 bp, Mus musculus
cggtcctcggggcacatcgtaatgt

SEQ ID NO: 912105 - DNA, 25 bp, Mus musculus
cggtcctcggggcagaaaatatctg

SEQ ID NO: 912106 - DNA, 25 bp, Mus musculus
cggtcctcggggcagatcgtaatgt

SEQ ID NO: 912107 - DNA, 25 bp, Mus musculus
cggtcctttccgcgatgcagctcag

SEQ ID NO: 912108 - DNA, 25 bp, Mus musculus
cggtcctttccgggatgcagctcag

SEQ ID NO: 912109 - DNA, 25 bp, Mus musculus
cggtcgagtggaaagcacaatccac

SEQ ID NO: 912110 - DNA, 25 bp, Mus musculus
cggtcgagtggatagcacaatccac

SEQ ID NO: 912111 - DNA, 25 bp, Mus musculus
cggtcgctgacccacgtcaaggagc

SEQ ID NO: 912112 - DNA, 25 bp, Mus musculus
cggtcgctgacccaggtcaaggagc

SEQ ID NO: 912113 - DNA, 25 bp, Mus musculus
cggtcggggctgctcaggacaaaga

SEQ ID NO: 912114 - DNA, 25 bp, Mus musculus
cggtcggggctggtcaggacaaaga

SEQ ID NO: 912115 - DNA, 25 bp, Mus musculus
cggtcgtggtcactcgcgccaatag

SEQ ID NO: 912116 - DNA, 25 bp, Mus musculus
cggtcgtggtcactggcgccaatag

SEQ ID NO: 912117 - DNA, 25 bp, Mus musculus
cggtctccagattcgcctctaatct

SEQ ID NO: 912118 - DNA, 25 bp, Mus musculus
cggtctccagtttcgcctctaatct

SEQ ID NO: 912119 - DNA, 25 bp, Mus musculus
cggtctctcgatctcatcgcagaca

SEQ ID NO: 912120 - DNA, 25 bp, Mus musculus
cggtctctcgttctcatcgcagaca

SEQ ID NO: 912121 - DNA, 25 bp, Mus musculus
cggtctctgacactcctcctacagt

SEQ ID NO: 912122 - DNA, 25 bp, Mus musculus
cggtctctgacagtcctcctacagt

SEQ ID NO: 912123 - DNA, 25 bp, Mus musculus
cggtctgattaaacaaattggagaa

SEQ ID NO: 912124 - DNA, 25 bp, Mus musculus
cggtctgattaatcaaattggagaa

SEQ ID NO: 912125 - DNA, 25 bp, Mus musculus
cggtctgcagcctttggatgaagag

SEQ ID NO: 912126 - DNA, 25 bp, Mus musculus
cggtctgcaggctttggatgaagag

SEQ ID NO: 912127 - DNA, 25 bp, Mus musculus
cggtgaagccagccaaagttataaa

SEQ ID NO: 912128 - DNA, 25 bp, Mus musculus
cggtgaagccaggcaaagttataaa

SEQ ID NO: 912129 - DNA, 25 bp, Mus musculus
cggtgaatccagctttgatctgtgg

SEQ ID NO: 912130 - DNA, 25 bp, Mus musculus
cggtgaatccaggtttgatctgtgg

SEQ ID NO: 912131 - DNA, 25 bp, Mus musculus
cggtgacatgaccaatgaggaattc

SEQ ID NO: 912132 - DNA, 25 bp, Mus musculus
cggtgacatgtccaatgaggaattc

SEQ ID NO: 912133 - DNA, 25 bp, Mus musculus
cggtgacgcacacgttctccacaaa

SEQ ID NO: 912134 - DNA, 25 bp, Mus musculus
cggtgacgcacaggttctccacaaa

SEQ ID NO: 912135 - DNA, 25 bp, Mus musculus
cggtgagagccagacgcactgagag

SEQ ID NO: 912136 - DNA, 25 bp, Mus musculus
cggtgagagccagaggcactgagag

SEQ ID NO: 912137 - DNA, 25 bp, Mus musculus
cggtgcacatctcaatgcccagact

SEQ ID NO: 912138 - DNA, 25 bp, Mus musculus
cggtgcacatgtcaatgcccagact

SEQ ID NO: 912139 - DNA, 25 bp, Mus musculus
cggtgcagagccaccatgccaatca

SEQ ID NO: 912140 - DNA, 25 bp, Mus musculus
cggtgcagaggcaccatgccaatca

SEQ ID NO: 912141 - DNA, 25 bp, Mus musculus
cggtgcaggactcggctacacagag

SEQ ID NO: 912142 - DNA, 25 bp, Mus musculus
cggtgcaggactcggctacgcagat

SEQ ID NO: 912143 - DNA, 25 bp, Mus musculus
cggtgcaggactgggctacacagag

SEQ ID NO: 912144 - DNA, 25 bp, Mus musculus
cggtgcaggactgggctacgcagat

SEQ ID NO: 912145 - DNA, 25 bp, Mus musculus
cggtgcatacaaccaacatgctgcc

SEQ ID NO: 912146 - DNA, 25 bp, Mus musculus
cggtgcatacaacgttagcagaggc

SEQ ID NO: 912147 - DNA, 25 bp, Mus musculus
cggtgcatacaagcaacatgctgcc

SEQ ID NO: 912148 - DNA, 25 bp, Mus musculus
cggtgcatacaaggttagcagaggc

SEQ ID NO: 912149 - DNA, 25 bp, Mus musculus
cggtgccaaggccgccacagaacca

SEQ ID NO: 912150 - DNA, 25 bp, Mus musculus
cggtgccaaggcggccacagaacca

SEQ ID NO: 912151 - DNA, 25 bp, Mus musculus
cggtgccactcatgagcggcaccac

SEQ ID NO: 912152 - DNA, 25 bp, Mus musculus
cggtgccactgatgagcggcaccac

SEQ ID NO: 912153 - DNA, 25 bp, Mus musculus
cggtgcctcgccatcgctgaccagc

SEQ ID NO: 912154 - DNA, 25 bp, Mus musculus
cggtgcctcgccatggctgaccagc

SEQ ID NO: 912155 - DNA, 25 bp, Mus musculus
cggtgctcgaagcatctacaccagt

SEQ ID NO: 912156 - DNA, 25 bp, Mus musculus
cggtgctcgaaggatctacaccagt

SEQ ID NO: 912157 - DNA, 25 bp, Mus musculus
cggtgctgccagaggaagacctcac

SEQ ID NO: 912158 - DNA, 25 bp, Mus musculus
cggtgctgccagtggaagacctcac

SEQ ID NO: 912159 - DNA, 25 bp, Mus musculus
cggtgctggcccagcgactctgctg

SEQ ID NO: 912160 - DNA, 25 bp, Mus musculus
cggtgctggcgcagcgactctgctg

SEQ ID NO: 912161 - DNA, 25 bp, Mus musculus
cggtgctggtggcggaagaactgta

SEQ ID NO: 912162 - DNA, 25 bp, Mus musculus
cggtgctggtgggggaagaactgta

SEQ ID NO: 912163 - DNA, 25 bp, Mus musculus
cggtggagacagcacgggactcgga

SEQ ID NO: 912164 - DNA, 25 bp, Mus musculus
cggtggagacagcaggggactcgga

SEQ ID NO: 912165 - DNA, 25 bp, Mus musculus
cggtggcattagaagtgatgaggaa

SEQ ID NO: 912166 - DNA, 25 bp, Mus musculus
cggtggcattagagatgaggaagag

SEQ ID NO: 912167 - DNA, 25 bp, Mus musculus
cggtggcattagtagtgatgaggaa

SEQ ID NO: 912168 - DNA, 25 bp, Mus musculus
cggtggcattagtgatgaggaagag

SEQ ID NO: 912169 - DNA, 25 bp, Mus musculus
cggtggccagccagccctgcagcat

SEQ ID NO: 912170 - DNA, 25 bp, Mus musculus
cggtggccagccaggcctgcagcat

SEQ ID NO: 912171 - DNA, 25 bp, Mus musculus
cggtggccgacacagtgcttgggat

SEQ ID NO: 912172 - DNA, 25 bp, Mus musculus
cggtggccgacagagtgcttgggat

SEQ ID NO: 912173 - DNA, 25 bp, Mus musculus
cggtggctcaatcatccttccttca

SEQ ID NO: 912174 - DNA, 25 bp, Mus musculus
cggtggctcaatgatccttccttca

SEQ ID NO: 912175 - DNA, 25 bp, Mus musculus
cggtggctcaggaggtgggtttcac

SEQ ID NO: 912176 - DNA, 25 bp, Mus musculus
cggtggctcaggtggtgggtttcac

SEQ ID NO: 912177 - DNA, 25 bp, Mus musculus
cggtgggcaaagccaagagaatatc

SEQ ID NO: 912178 - DNA, 25 bp, Mus musculus
cggtgggcaaaggcaagagaatatc

SEQ ID NO: 912179 - DNA, 25 bp, Mus musculus
cggtggggatcccgacacagctgag

SEQ ID NO: 912180 - DNA, 25 bp, Mus musculus
cggtggggatccggacacagctgag

SEQ ID NO: 912181 - DNA, 25 bp, Mus musculus
cggtggtgctggagcctggtgattt

SEQ ID NO: 912182 - DNA, 25 bp, Mus musculus
cggtggtgctggtgcctggtgattt

SEQ ID NO: 912183 - DNA, 25 bp, Mus musculus
cggtggtggagtccacctgtcaagc

SEQ ID NO: 912184 - DNA, 25 bp, Mus musculus
cggtggtggagtgcacctgtcaagc

SEQ ID NO: 912185 - DNA, 25 bp, Mus musculus
cggtggtggctgaggctccagcggg

SEQ ID NO: 912186 - DNA, 25 bp, Mus musculus
cggtggtggctgtggctccagcggg

SEQ ID NO: 912187 - DNA, 25 bp, Mus musculus
cggtggttgcaggaccacccccacc

SEQ ID NO: 912188 - DNA, 25 bp, Mus musculus
cggtggttgcaggacggtgaagggc

SEQ ID NO: 912189 - DNA, 25 bp, Mus musculus
cggtggttgcaggagcacccccacc

SEQ ID NO: 912190 - DNA, 25 bp, Mus musculus
cggtggttgcaggagggtgaagggc

SEQ ID NO: 912191 - DNA, 25 bp, Mus musculus
cggtgtacagtacacgcaaatttcc

SEQ ID NO: 912192 - DNA, 25 bp, Mus musculus
cggtgtacagtacaggcaaatttcc

SEQ ID NO: 912193 - DNA, 25 bp, Mus musculus
cggtgtcgatatcgaaaggcgccga

SEQ ID NO: 912194 - DNA, 25 bp, Mus musculus
cggtgtcgatatggaaaggcgccga

SEQ ID NO: 912195 - DNA, 25 bp, Mus musculus
cggtgtgcaaccattcctgaccaag

SEQ ID NO: 912196 - DNA, 25 bp, Mus musculus
cggtgtgcaagcattcctgaccaag

SEQ ID NO: 912197 - DNA, 25 bp, Mus musculus
cggtgtggaagacatgaaccggaca

SEQ ID NO: 912198 - DNA, 25 bp, Mus musculus
cggtgtggaagagatgaaccggaca

SEQ ID NO: 912199 - DNA, 25 bp, Mus musculus
cggtgttcagcgactgctgaccttt

SEQ ID NO: 912200 - DNA, 25 bp, Mus musculus
cggtgttcagctcactgcaagacat

SEQ ID NO: 912201 - DNA, 25 bp, Mus musculus
cggtgttcagggactgctgaccttt

SEQ ID NO: 912202 - DNA, 25 bp, Mus musculus
cggtgttcaggtcactgcaagacat

SEQ ID NO: 912203 - DNA, 25 bp, Mus musculus
cggtgttcgtgccgtcttttgatgg

SEQ ID NO: 912204 - DNA, 25 bp, Mus musculus
cggtgttcgtgcggtcttttgatgg

SEQ ID NO: 912205 - DNA, 25 bp, Mus musculus
cggttacacacacacgattggagag

SEQ ID NO: 912206 - DNA, 25 bp, Mus musculus
cggttacacacacaggattggagag

SEQ ID NO: 912207 - DNA, 25 bp, Mus musculus
cggttatatcagagtggtgatgtat

SEQ ID NO: 912208 - DNA, 25 bp, Mus musculus
cggttatatcagtgtggtgatgtat

SEQ ID NO: 912209 - DNA, 25 bp, Mus musculus
cggttccacgcctgattctggcagg

SEQ ID NO: 912210 - DNA, 25 bp, Mus musculus
cggttccacgcctgtttctggcagg

SEQ ID NO: 912211 - DNA, 25 bp, Mus musculus
cggttccgagctgtgtgaggacgag

SEQ ID NO: 912212 - DNA, 25 bp, Mus musculus
cggttccgaggtgtgtgaggacgag

SEQ ID NO: 912213 - DNA, 25 bp, Mus musculus
cggttcgaagcgcctgctatggtgt

SEQ ID NO: 912214 - DNA, 25 bp, Mus musculus
cggttcgaagggcctgctatggtgt

SEQ ID NO: 912215 - DNA, 25 bp, Mus musculus
cggttgatgaaaatggaagacaagg

SEQ ID NO: 912216 - DNA, 25 bp, Mus musculus
cggttgatgataatggaagacaagg

SEQ ID NO: 912217 - DNA, 25 bp, Mus musculus
cggttgccgggcgacctggaaacca

SEQ ID NO: 912218 - DNA, 25 bp, Mus musculus
cggttgccgggcgagctggaaacca

SEQ ID NO: 912219 - DNA, 25 bp, Mus musculus
cggtttatacccagtgtctgcagtg

SEQ ID NO: 912220 - DNA, 25 bp, Mus musculus
cggtttataccctgtgtctgcagtg

SEQ ID NO: 912221 - DNA, 25 bp, Mus musculus
cggtttatcatgacaccaagctgga

SEQ ID NO: 912222 - DNA, 25 bp, Mus musculus
cggtttatcatgtcaccaagctgga

SEQ ID NO: 912223 - DNA, 25 bp, Mus musculus
cggtttgaagctccctgcatagatt

SEQ ID NO: 912224 - DNA, 25 bp, Mus musculus
cggtttgaaggtccctgcatagatt

SEQ ID NO: 912225 - DNA, 25 bp, Mus musculus
cggtttgccaggccgacggaacaag

SEQ ID NO: 912226 - DNA, 25 bp, Mus musculus
cggtttgccagggcgacggaacaag

SEQ ID NO: 912227 - DNA, 25 bp, Mus musculus
cggtttgtgagcctcccgctcatgc

SEQ ID NO: 912228 - DNA, 25 bp, Mus musculus
cggtttgtgagcctctttgtgggct

SEQ ID NO: 912229 - DNA, 25 bp, Mus musculus
cggtttgtgagcctgccgctcatgc

SEQ ID NO: 912230 - DNA, 25 bp, Mus musculus
cggtttgtgagcctgtttgtgggct

SEQ ID NO: 912231 - DNA, 25 bp, Mus musculus
cgtaacaagcaccctttgacaaact

SEQ ID NO: 912232 - DNA, 25 bp, Mus musculus
cgtaacaagcacgctttgacaaact

SEQ ID NO: 912233 - DNA, 25 bp, Mus musculus
cgtaacaataagctcatcaaacggg

SEQ ID NO: 912234 - DNA, 25 bp, Mus musculus
cgtaacaataaggtcatcaaacggg

SEQ ID NO: 912235 - DNA, 25 bp, Mus musculus
cgtaacttcccacacggacgactgc

SEQ ID NO: 912236 - DNA, 25 bp, Mus musculus
cgtaacttcccacagggacgactgc

SEQ ID NO: 912237 - DNA, 25 bp, Mus musculus
cgtacaaatcattgcaggaggctga

SEQ ID NO: 912238 - DNA, 25 bp, Mus musculus
cgtacaaatcattggaggaggctga

SEQ ID NO: 912239 - DNA, 25 bp, Mus musculus
cgtacacatacacgagagaagaaat

SEQ ID NO: 912240 - DNA, 25 bp, Mus musculus
cgtacacatacaggagagaagaaat

SEQ ID NO: 912241 - DNA, 25 bp, Mus musculus
cgtacactttgtcatgtagatgccg

SEQ ID NO: 912242 - DNA, 25 bp, Mus musculus
cgtacactttgtgatgtagatgccg

SEQ ID NO: 912243 - DNA, 25 bp, Mus musculus
cgtaccagtgcaaagaccctaaaga

SEQ ID NO: 912244 - DNA, 25 bp, Mus musculus
cgtaccagtggaaagaccctaaaga

SEQ ID NO: 912245 - DNA, 25 bp, Mus musculus
cgtacctcagaacaagcccaccacc

SEQ ID NO: 912246 - DNA, 25 bp, Mus musculus
cgtacctcagatctggctcaaggta

SEQ ID NO: 912247 - DNA, 25 bp, Mus musculus
cgtacctcagcctcatgtacagtca

SEQ ID NO: 912248 - DNA, 25 bp, Mus musculus
cgtacctcaggctcatgtacagtca

SEQ ID NO: 912249 - DNA, 25 bp, Mus musculus
cgtacctcagtacaagcccaccacc

SEQ ID NO: 912250 - DNA, 25 bp, Mus musculus
cgtacctcagttctggctcaaggta

SEQ ID NO: 912251 - DNA, 25 bp, Mus musculus
cgtacgagatcaagaaggtgttcgc

SEQ ID NO: 912252 - DNA, 25 bp, Mus musculus
cgtacgagatcatgaaggtgttcgc

SEQ ID NO: 912253 - DNA, 25 bp, Mus musculus
cgtacggaccaaatcgaatgaataa

SEQ ID NO: 912254 - DNA, 25 bp, Mus musculus
cgtacggaccaaatggaatgaataa

SEQ ID NO: 912255 - DNA, 25 bp, Mus musculus
cgtactaaaactgtgcagggctatc

SEQ ID NO: 912256 - DNA, 25 bp, Mus musculus
cgtactaaaagtgtgcagggctatc

SEQ ID NO: 912257 - DNA, 25 bp, Mus musculus
cgtactcccacccttgagctgtgac

SEQ ID NO: 912258 - DNA, 25 bp, Mus musculus
cgtactcccaccgttgagctgtgac

SEQ ID NO: 912259 - DNA, 25 bp, Mus musculus
cgtactcctgtacccgtgcccgtca

SEQ ID NO: 912260 - DNA, 25 bp, Mus musculus
cgtactcctgtaccggtgcccgtca

SEQ ID NO: 912261 - DNA, 25 bp, Mus musculus
cgtactgccagtcggaagatcttag

SEQ ID NO: 912262 - DNA, 25 bp, Mus musculus
cgtactgccagtgggaagatcttag

SEQ ID NO: 912263 - DNA, 25 bp, Mus musculus
cgtactggagaacttatttccgaga

SEQ ID NO: 912264 - DNA, 25 bp, Mus musculus
cgtactggagaagttatttccgaga

SEQ ID NO: 912265 - DNA, 25 bp, Mus musculus
cgtagacctgaacgtgtcccccttg

SEQ ID NO: 912266 - DNA, 25 bp, Mus musculus
cgtagacctgaaggtgtcccccttg

SEQ ID NO: 912267 - DNA, 25 bp, Mus musculus
cgtagactccgacggacatctctac

SEQ ID NO: 912268 - DNA, 25 bp, Mus musculus
cgtagactccgagggacatctctac

SEQ ID NO: 912269 - DNA, 25 bp, Mus musculus
cgtagaggaatgcaggcagcttcag

SEQ ID NO: 912270 - DNA, 25 bp, Mus musculus
cgtagaggaatggaggcagcttcag

SEQ ID NO: 912271 - DNA, 25 bp, Mus musculus
cgtagatcagagcatggataagggc

SEQ ID NO: 912272 - DNA, 25 bp, Mus musculus
cgtagatcagtgcatggataagggc

SEQ ID NO: 912273 - DNA, 25 bp, Mus musculus
cgtagcaagcccctcctggacaata

SEQ ID NO: 912274 - DNA, 25 bp, Mus musculus
cgtagcaagcccgtcctggacaata

SEQ ID NO: 912275 - DNA, 25 bp, Mus musculus
cgtagccagctgctcagaacccaat

SEQ ID NO: 912276 - DNA, 25 bp, Mus musculus
cgtagccagctgctgagaacccaat

SEQ ID NO: 912277 - DNA, 25 bp, Mus musculus
cgtagcccagaaaaatatgaagatc

SEQ ID NO: 912278 - DNA, 25 bp, Mus musculus
cgtagcccagagcaagtccctccac

SEQ ID NO: 912279 - DNA, 25 bp, Mus musculus
cgtagcccagcaggacagggccccc

SEQ ID NO: 912280 - DNA, 25 bp, Mus musculus
cgtagcccagcaggtcagggccccc

SEQ ID NO: 912281 - DNA, 25 bp, Mus musculus
cgtagcccagtaaaatatgaagatc

SEQ ID NO: 912282 - DNA, 25 bp, Mus musculus
cgtagcccagtgcaagtccctccac

SEQ ID NO: 912283 - DNA, 25 bp, Mus musculus
cgtagcctcagacatgctggagtgt

SEQ ID NO: 912284 - DNA, 25 bp, Mus musculus
cgtagcctcagagatgctggagtgt

SEQ ID NO: 912285 - DNA, 25 bp, Mus musculus
cgtagggaccgacaggccgagcacg

SEQ ID NO: 912286 - DNA, 25 bp, Mus musculus
cgtagggaccgacgccgagcacggc

SEQ ID NO: 912287 - DNA, 25 bp, Mus musculus
cgtagggaccgagaggccgagcacg

SEQ ID NO: 912288 - DNA, 25 bp, Mus musculus
cgtagggaccgaggccgagcacggc

SEQ ID NO: 912289 - DNA, 25 bp, Mus musculus
cgtagtcaagctcattgaaagcaaa

SEQ ID NO: 912290 - DNA, 25 bp, Mus musculus
cgtagtcaagctgattgaaagcaaa

SEQ ID NO: 912291 - DNA, 25 bp, Mus musculus
cgtagtgaagctggccctatgaaac

SEQ ID NO: 912292 - DNA, 25 bp, Mus musculus
cgtagtgaaggtggccctatgaaac

SEQ ID NO: 912293 - DNA, 25 bp, Mus musculus
cgtatacaagatccctctaggaatt

SEQ ID NO: 912294 - DNA, 25 bp, Mus musculus
cgtatacaagttccctctaggaatt

SEQ ID NO: 912295 - DNA, 25 bp, Mus musculus
cgtatcatcaaaaacaacattttct

SEQ ID NO: 912296 - DNA, 25 bp, Mus musculus
cgtatcatcaaatacaacattttct

SEQ ID NO: 912297 - DNA, 25 bp, Mus musculus
cgtatggagccccacggtacccagc

SEQ ID NO: 912298 - DNA, 25 bp, Mus musculus
cgtatggagccccagggtacccagc

SEQ ID NO: 912299 - DNA, 25 bp, Mus musculus
cgtattactgaaccttaaaaagcaa

SEQ ID NO: 912300 - DNA, 25 bp, Mus musculus
cgtattactgaagcttaaaaagcaa

SEQ ID NO: 912301 - DNA, 25 bp, Mus musculus
cgtattccttggagagactctccct

SEQ ID NO: 912302 - DNA, 25 bp, Mus musculus
cgtattccttggagtgactctccct

SEQ ID NO: 912303 - DNA, 25 bp, Mus musculus
cgtattgaacaacaaaatgttatca

SEQ ID NO: 912304 - DNA, 25 bp, Mus musculus
cgtattgaacaagaaaatgttatca

SEQ ID NO: 912305 - DNA, 25 bp, Mus musculus
cgtatttaccccagaaacagtattg

SEQ ID NO: 912306 - DNA, 25 bp, Mus musculus
cgtatttaccgcagaaacagtattg

SEQ ID NO: 912307 - DNA, 25 bp, Mus musculus
cgtatttgggatctttcgctatgca

SEQ ID NO: 912308 - DNA, 25 bp, Mus musculus
cgtatttgggatgtttcgctatgca

SEQ ID NO: 912309 - DNA, 25 bp, Mus musculus
cgtcaaaagcctcatcttcaaaggt

SEQ ID NO: 912310 - DNA, 25 bp, Mus musculus
cgtcaaaagcgtcatcttcaaaggt

SEQ ID NO: 912311 - DNA, 25 bp, Mus musculus
cgtcaaacagatgaagatcattcac

SEQ ID NO: 912312 - DNA, 25 bp, Mus musculus
cgtcaaacagatgatgatcattcac

SEQ ID NO: 912313 - DNA, 25 bp, Mus musculus
cgtcaaactggacgaaagcacagac

SEQ ID NO: 912314 - DNA, 25 bp, Mus musculus
cgtcaaactggaggaaagcacagac

SEQ ID NO: 912315 - DNA, 25 bp, Mus musculus
cgtcaaagtcatagttgatattcca

SEQ ID NO: 912316 - DNA, 25 bp, Mus musculus
cgtcaaagtcattgttgatattcca

SEQ ID NO: 912317 - DNA, 25 bp, Mus musculus
cgtcaacacccgcggctccttccag

SEQ ID NO: 912318 - DNA, 25 bp, Mus musculus
cgtcaacacccggggctccttccag

SEQ ID NO: 912319 - DNA, 25 bp, Mus musculus
cgtcaacactcggctgcatggccca

SEQ ID NO: 912320 - DNA, 25 bp, Mus musculus
cgtcaacactgggctgcatggccca

SEQ ID NO: 912321 - DNA, 25 bp, Mus musculus
cgtcaacctaagccctgacaagtca

SEQ ID NO: 912322 - DNA, 25 bp, Mus musculus
cgtcaacctaaggcctgacaagtca

SEQ ID NO: 912323 - DNA, 25 bp, Mus musculus
cgtcaacgggctgacatctcttgat

SEQ ID NO: 912324 - DNA, 25 bp, Mus musculus
cgtcaacgggctgacgtctgtgcag

SEQ ID NO: 912325 - DNA, 25 bp, Mus musculus
cgtcaacgggctgagatctcttgat

SEQ ID NO: 912326 - DNA, 25 bp, Mus musculus
cgtcaacgggctgaggtctgtgcag

SEQ ID NO: 912327 - DNA, 25 bp, Mus musculus
cgtcaactggcaatctatgaatgca

SEQ ID NO: 912328 - DNA, 25 bp, Mus musculus
cgtcaactggcaatgtatgaatgca

SEQ ID NO: 912329 - DNA, 25 bp, Mus musculus
cgtcaagatgctcctctctgggtgc

SEQ ID NO: 912330 - DNA, 25 bp, Mus musculus
cgtcaagatggtcctctctgggtgc

SEQ ID NO: 912331 - DNA, 25 bp, Mus musculus
cgtcaagcagatgaagatcatccat

SEQ ID NO: 912332 - DNA, 25 bp, Mus musculus
cgtcaagcagatgatgatcatccat

SEQ ID NO: 912333 - DNA, 25 bp, Mus musculus
cgtcaagcccatcacaaaatcaccg

SEQ ID NO: 912334 - DNA, 25 bp, Mus musculus
cgtcaagcccatcagaaaatcaccg

SEQ ID NO: 912335 - DNA, 25 bp, Mus musculus
cgtcaagtactgcttgggtggtccg

SEQ ID NO: 912336 - DNA, 25 bp, Mus musculus
cgtcaagtactgctttacaggaaca

SEQ ID NO: 912337 - DNA, 25 bp, Mus musculus
cgtcaagtactggttgggtggtccg

SEQ ID NO: 912338 - DNA, 25 bp, Mus musculus
cgtcaagtactggtttacaggaaca

SEQ ID NO: 912339 - DNA, 25 bp, Mus musculus
cgtcaagtcacccactgaatacctc

SEQ ID NO: 912340 - DNA, 25 bp, Mus musculus
cgtcaagtcacccagtgaatacctc

SEQ ID NO: 912341 - DNA, 25 bp, Mus musculus
cgtcaatagtgccggaaactgctat

SEQ ID NO: 912342 - DNA, 25 bp, Mus musculus
cgtcaatagtgcgggaaactgctat

SEQ ID NO: 912343 - DNA, 25 bp, Mus musculus
cgtcacaacaccctggccctaatgc

SEQ ID NO: 912344 - DNA, 25 bp, Mus musculus
cgtcacaacagcctggccctaatgc

SEQ ID NO: 912345 - DNA, 25 bp, Mus musculus
cgtcacagcggacgatgcaagacgt

SEQ ID NO: 912346 - DNA, 25 bp, Mus musculus
cgtcacagcggaggatgcaagacgt

SEQ ID NO: 912347 - DNA, 25 bp, Mus musculus
cgtcaccatgcccctggctagagat

SEQ ID NO: 912348 - DNA, 25 bp, Mus musculus
cgtcaccatgccgctggctagagat

SEQ ID NO: 912349 - DNA, 25 bp, Mus musculus
cgtcaccgagcatgaagaggaagaa

SEQ ID NO: 912350 - DNA, 25 bp, Mus musculus
cgtcaccgaggaccttccacaactc

SEQ ID NO: 912351 - DNA, 25 bp, Mus musculus
cgtcaccgaggagcttccacaactc

SEQ ID NO: 912352 - DNA, 25 bp, Mus musculus
cgtcaccgaggatgaagaggaagaa

SEQ ID NO: 912353 - DNA, 25 bp, Mus musculus
cgtcactccaaggaacagccatggc

SEQ ID NO: 912354 - DNA, 25 bp, Mus musculus
cgtcactccatggaacagccatggc

SEQ ID NO: 912355 - DNA, 25 bp, Mus musculus
cgtcactgtaagattctgattttag

SEQ ID NO: 912356 - DNA, 25 bp, Mus musculus
cgtcactgtaagtttctgattttag

SEQ ID NO: 912357 - DNA, 25 bp, Mus musculus
cgtcagaccacctcgtgctgtggca

SEQ ID NO: 912358 - DNA, 25 bp, Mus musculus
cgtcagaccagctcgtgctgtggca

SEQ ID NO: 912359 - DNA, 25 bp, Mus musculus
cgtcagagaaaaaccgctcttgctt

SEQ ID NO: 912360 - DNA, 25 bp, Mus musculus
cgtcagagaaaaacggctcttgctt

SEQ ID NO: 912361 - DNA, 25 bp, Mus musculus
cgtcagcaggaaccgcatccagtat

SEQ ID NO: 912362 - DNA, 25 bp, Mus musculus
cgtcagcaggaactatggaagcttc

SEQ ID NO: 912363 - DNA, 25 bp, Mus musculus
cgtcagcaggaagcgcatccagtat

SEQ ID NO: 912364 - DNA, 25 bp, Mus musculus
cgtcagcaggaagtatggaagcttc

SEQ ID NO: 912365 - DNA, 25 bp, Mus musculus
cgtcagcgaaaccacgtccacagga

SEQ ID NO: 912366 - DNA, 25 bp, Mus musculus
cgtcagcgaaaccaggtccacagga

SEQ ID NO: 912367 - DNA, 25 bp, Mus musculus
cgtcaggaagccctctctgctcccc

SEQ ID NO: 912368 - DNA, 25 bp, Mus musculus
cgtcaggaaggcctctctgctcccc

SEQ ID NO: 912369 - DNA, 25 bp, Mus musculus
cgtcaggactgacacaacaactaat

SEQ ID NO: 912370 - DNA, 25 bp, Mus musculus
cgtcaggactgacagaacaactaat

SEQ ID NO: 912371 - DNA, 25 bp, Mus musculus
cgtcagttctgggaagtctccaggc

SEQ ID NO: 912372 - DNA, 25 bp, Mus musculus
cgtcagttctgggatgtctccaggc

SEQ ID NO: 912373 - DNA, 25 bp, Mus musculus
cgtcatagtacaggattcatcccag

SEQ ID NO: 912374 - DNA, 25 bp, Mus musculus
cgtcatagtactagattcatcccag

SEQ ID NO: 912375 - DNA, 25 bp, Mus musculus
cgtcatagtacttgattcatcccag

SEQ ID NO: 912376 - DNA, 25 bp, Mus musculus
cgtcatagtagaggattcatcccag

SEQ ID NO: 912377 - DNA, 25 bp, Mus musculus
cgtcatcaacaacgagactagggtc

SEQ ID NO: 912378 - DNA, 25 bp, Mus musculus
cgtcatcaacaaggagactagggtc

SEQ ID NO: 912379 - DNA, 25 bp, Mus musculus
cgtcatcaatcacgctggagacacc

SEQ ID NO: 912380 - DNA, 25 bp, Mus musculus
cgtcatcaatcaggctggagacacc

SEQ ID NO: 912381 - DNA, 25 bp, Mus musculus
cgtcatcactgcagttctgatcttc

SEQ ID NO: 912382 - DNA, 25 bp, Mus musculus
cgtcatcactgctgttctgatcttc

SEQ ID NO: 912383 - DNA, 25 bp, Mus musculus
cgtcatcatgcctgtctccgagatc

SEQ ID NO: 912384 - DNA, 25 bp, Mus musculus
cgtcatcatggctgtctccgagatc

SEQ ID NO: 912385 - DNA, 25 bp, Mus musculus
cgtcatccgcattgaccaggatggg

SEQ ID NO: 912386 - DNA, 25 bp, Mus musculus
cgtcatccgctttgaccaggatggg

SEQ ID NO: 912387 - DNA, 25 bp, Mus musculus
cgtcatcggcaacatctacctgtcc

SEQ ID NO: 912388 - DNA, 25 bp, Mus musculus
cgtcatcggcaagatctacctgtcc

SEQ ID NO: 912389 - DNA, 25 bp, Mus musculus
cgtcatgggccccattgacgacagt

SEQ ID NO: 912390 - DNA, 25 bp, Mus musculus
cgtcatgggcccgattgacgacagt

SEQ ID NO: 912391 - DNA, 25 bp, Mus musculus
cgtcatggggcttaattcctatatc

SEQ ID NO: 912392 - DNA, 25 bp, Mus musculus
cgtcatgggggttaattcctatatc

SEQ ID NO: 912393 - DNA, 25 bp, Mus musculus
cgtcatgtgcagagacaggctttga

SEQ ID NO: 912394 - DNA, 25 bp, Mus musculus
cgtcatgtgcagcctttgatatgtc

SEQ ID NO: 912395 - DNA, 25 bp, Mus musculus
cgtcatgtgcaggctttgatatgtc

SEQ ID NO: 912396 - DNA, 25 bp, Mus musculus
cgtcatgtgcagtgacaggctttga

SEQ ID NO: 912397 - DNA, 25 bp, Mus musculus
cgtcattatcaactgccctacctca

SEQ ID NO: 912398 - DNA, 25 bp, Mus musculus
cgtcattatcaagtgccctacctca

SEQ ID NO: 912399 - DNA, 25 bp, Mus musculus
cgtcattcagagaggaatgcgattc

SEQ ID NO: 912400 - DNA, 25 bp, Mus musculus
cgtcattcagtgaggaatgcgattc

SEQ ID NO: 912401 - DNA, 25 bp, Mus musculus
cgtcattgagctggagcatcagttg

SEQ ID NO: 912402 - DNA, 25 bp, Mus musculus
cgtcattgaggtggagcatcagttg

SEQ ID NO: 912403 - DNA, 25 bp, Mus musculus
cgtcattgatacttgccgagacctg

SEQ ID NO: 912404 - DNA, 25 bp, Mus musculus
cgtcattgattcttgccgagacctg

SEQ ID NO: 912405 - DNA, 25 bp, Mus musculus
cgtcattggtgtgaccttccatgtg

SEQ ID NO: 912406 - DNA, 25 bp, Mus musculus
cgtcattggtgtgagcttccatgtg

SEQ ID NO: 912407 - DNA, 25 bp, Mus musculus
cgtcatttcactgtcgtggaaggga

SEQ ID NO: 912408 - DNA, 25 bp, Mus musculus
cgtcatttcactgtggtggaaggga

SEQ ID NO: 912409 - DNA, 25 bp, Mus musculus
cgtccaagagcccattgtgagcttt

SEQ ID NO: 912410 - DNA, 25 bp, Mus musculus
cgtccaagaggccattgtgagcttt

SEQ ID NO: 912411 - DNA, 25 bp, Mus musculus
cgtccaccaacaacgccagctgcta

SEQ ID NO: 912412 - DNA, 25 bp, Mus musculus
cgtccaccaagaacgccagctgcta

SEQ ID NO: 912413 - DNA, 25 bp, Mus musculus
cgtccaccagagaaaatgtgctatt

SEQ ID NO: 912414 - DNA, 25 bp, Mus musculus
cgtccaccagtgaaaatgtgctatt

SEQ ID NO: 912415 - DNA, 25 bp, Mus musculus
cgtccagagcctctgcttgaggcga

SEQ ID NO: 912416 - DNA, 25 bp, Mus musculus
cgtccagagcctgtgcttgaggcga

SEQ ID NO: 912417 - DNA, 25 bp, Mus musculus
cgtccaggatatactcttcgtacca

SEQ ID NO: 912418 - DNA, 25 bp, Mus musculus
cgtccaggatattctcttcgtacca

SEQ ID NO: 912419 - DNA, 25 bp, Mus musculus
cgtccaggccttgccgcagttcctg

SEQ ID NO: 912420 - DNA, 25 bp, Mus musculus
cgtccaggccttgcggcagttcctg

SEQ ID NO: 912421 - DNA, 25 bp, Mus musculus
cgtccagtatagcgagaagctgggc

SEQ ID NO: 912422 - DNA, 25 bp, Mus musculus
cgtccagtatagggagaagctgggc

SEQ ID NO: 912423 - DNA, 25 bp, Mus musculus
cgtccatctgcacgggaaggaggaa

SEQ ID NO: 912424 - DNA, 25 bp, Mus musculus
cgtccatctgcaggggaaggaggaa

SEQ ID NO: 912425 - DNA, 25 bp, Mus musculus
cgtccatgaacaaatcccgtactct

SEQ ID NO: 912426 - DNA, 25 bp, Mus musculus
cgtccatgaacaagggtccaggagt

SEQ ID NO: 912427 - DNA, 25 bp, Mus musculus
cgtccatgaacatatcccgtactct

SEQ ID NO: 912428 - DNA, 25 bp, Mus musculus
cgtccatgaacatgggtccaggagt

SEQ ID NO: 912429 - DNA, 25 bp, Mus musculus
cgtcccagcgagcacccctgcaact

SEQ ID NO: 912430 - DNA, 25 bp, Mus musculus
cgtcccagcgagcagccctgcaact

SEQ ID NO: 912431 - DNA, 25 bp, Mus musculus
cgtccccagcagacaacctgagcca

SEQ ID NO: 912432 - DNA, 25 bp, Mus musculus
cgtccccagcagtcaacctgagcca

SEQ ID NO: 912433 - DNA, 25 bp, Mus musculus
cgtccccggacgcagctgaagaaga

SEQ ID NO: 912434 - DNA, 25 bp, Mus musculus
cgtccccggacggagctgaagaaga

SEQ ID NO: 912435 - DNA, 25 bp, Mus musculus
cgtccccttctgaacagcaggttgc

SEQ ID NO: 912436 - DNA, 25 bp, Mus musculus
cgtccccttctgtacagcaggttgc

SEQ ID NO: 912437 - DNA, 25 bp, Mus musculus
cgtccctgtcatcacattgatcttt

SEQ ID NO: 912438 - DNA, 25 bp, Mus musculus
cgtccctgtcatcagattgatcttt

SEQ ID NO: 912439 - DNA, 25 bp, Mus musculus
cgtcccttgcagccactgcaagaaa

SEQ ID NO: 912440 - DNA, 25 bp, Mus musculus
cgtcccttgcagccagacgttaggg

SEQ ID NO: 912441 - DNA, 25 bp, Mus musculus
cgtcccttgcagcctctgcaagaaa

SEQ ID NO: 912442 - DNA, 25 bp, Mus musculus
cgtcccttgcagcctgacgttaggg

SEQ ID NO: 912443 - DNA, 25 bp, Mus musculus
cgtccgagacatcgagatcgagggc

SEQ ID NO: 912444 - DNA, 25 bp, Mus musculus
cgtccgagacatggagatcgagggc

SEQ ID NO: 912445 - DNA, 25 bp, Mus musculus
cgtccgccagactcagtccgctagt

SEQ ID NO: 912446 - DNA, 25 bp, Mus musculus
cgtccgccagagtacagttgaccaa

SEQ ID NO: 912447 - DNA, 25 bp, Mus musculus
cgtccgccagtctcagtccgctagt

SEQ ID NO: 912448 - DNA, 25 bp, Mus musculus
cgtccgccagtgtacagttgaccaa

SEQ ID NO: 912449 - DNA, 25 bp, Mus musculus
cgtccgcttccacctcccgatgccc

SEQ ID NO: 912450 - DNA, 25 bp, Mus musculus
cgtccgcttccagctcccgatgccc

SEQ ID NO: 912451 - DNA, 25 bp, Mus musculus
cgtccgtcccctaggccatccaaga

SEQ ID NO: 912452 - DNA, 25 bp, Mus musculus
cgtccgtccccttggccatccaaga

SEQ ID NO: 912453 - DNA, 25 bp, Mus musculus
cgtcctcgggacagagcctgatgta

SEQ ID NO: 912454 - DNA, 25 bp, Mus musculus
cgtcctcgggactgagcctgatgta

SEQ ID NO: 912455 - DNA, 25 bp, Mus musculus
cgtcctcgtaagagccattctgtct

SEQ ID NO: 912456 - DNA, 25 bp, Mus musculus
cgtcctcgtaagtgccattctgtct

SEQ ID NO: 912457 - DNA, 25 bp, Mus musculus
cgtcctctacaacctcggcttcttc

SEQ ID NO: 912458 - DNA, 25 bp, Mus musculus
cgtcctctacaagctcggcttcttc

SEQ ID NO: 912459 - DNA, 25 bp, Mus musculus
cgtcctctcgacccggagagtgggc

SEQ ID NO: 912460 - DNA, 25 bp, Mus musculus
cgtcctctcgtcccggagagtgggc

SEQ ID NO: 912461 - DNA, 25 bp, Mus musculus
cgtcctgacaatgcagaccttgcga

SEQ ID NO: 912462 - DNA, 25 bp, Mus musculus
cgtcctgacattgcagaccttgcga

SEQ ID NO: 912463 - DNA, 25 bp, Mus musculus
cgtcctgcagagcgacgtttttctg

SEQ ID NO: 912464 - DNA, 25 bp, Mus musculus
cgtcctgcagtgcgacgtttttctg

SEQ ID NO: 912465 - DNA, 25 bp, Mus musculus
cgtcctgtgccacgaaagcactgcc

SEQ ID NO: 912466 - DNA, 25 bp, Mus musculus
cgtcctgtgccacgcaaggtgaccc

SEQ ID NO: 912467 - DNA, 25 bp, Mus musculus
cgtcctgtgccaggaaagcactgcc

SEQ ID NO: 912468 - DNA, 25 bp, Mus musculus
cgtcctgtgccaggcaaggtgaccc

SEQ ID NO: 912469 - DNA, 25 bp, Mus musculus
cgtccttgctgctgcctgacacttt

SEQ ID NO: 912470 - DNA, 25 bp, Mus musculus
cgtccttgctgctggctgacacttt

SEQ ID NO: 912471 - DNA, 25 bp, Mus musculus
cgtccttggtagatccgccaggaaa

SEQ ID NO: 912472 - DNA, 25 bp, Mus musculus
cgtccttggttgatccgccaggaaa

SEQ ID NO: 912473 - DNA, 25 bp, Mus musculus
cgtccttttctacacgaagagcagt

SEQ ID NO: 912474 - DNA, 25 bp, Mus musculus
cgtccttttctacaggaagagcagt

SEQ ID NO: 912475 - DNA, 25 bp, Mus musculus
cgtcgacgacagcgaacgaatggag

SEQ ID NO: 912476 - DNA, 25 bp, Mus musculus
cgtcgacgacagggaacgaatggag

SEQ ID NO: 912477 - DNA, 25 bp, Mus musculus
cgtcgagtgaatcacgccatctggc

SEQ ID NO: 912478 - DNA, 25 bp, Mus musculus
cgtcgagtgaatcaggccatctggc

SEQ ID NO: 912479 - DNA, 25 bp, Mus musculus
cgtcgatgagagcaaagaagtgcct

SEQ ID NO: 912480 - DNA, 25 bp, Mus musculus
cgtcgatgagtgcaaagaagtgcct

SEQ ID NO: 912481 - DNA, 25 bp, Mus musculus
cgtcgatggtagcccctgccgtgac

SEQ ID NO: 912482 - DNA, 25 bp, Mus musculus
cgtcgatggtagcccgaagctgtgc

SEQ ID NO: 912483 - DNA, 25 bp, Mus musculus
cgtcgatggtagccgctgccgtgac

SEQ ID NO: 912484 - DNA, 25 bp, Mus musculus
cgtcgatggtagccggaagctgtgc

SEQ ID NO: 912485 - DNA, 25 bp, Mus musculus
cgtcgcacagcatggaggagtgcga

SEQ ID NO: 912486 - DNA, 25 bp, Mus musculus
cgtcgcacaggatggaggagtgcga

SEQ ID NO: 912487 - DNA, 25 bp, Mus musculus
cgtcgccaagcatgaggttgcccac

SEQ ID NO: 912488 - DNA, 25 bp, Mus musculus
cgtcgccaaggatgaggttgcccac

SEQ ID NO: 912489 - DNA, 25 bp, Mus musculus
cgtcgcctgcagcatactttggaac

SEQ ID NO: 912490 - DNA, 25 bp, Mus musculus
cgtcgcctgcagctgattttcgata

SEQ ID NO: 912491 - DNA, 25 bp, Mus musculus
cgtcgcctgcagctgtctaagcact

SEQ ID NO: 912492 - DNA, 25 bp, Mus musculus
cgtcgcctgcaggatactttggaac

SEQ ID NO: 912493 - DNA, 25 bp, Mus musculus
cgtcgcctgcaggtgattttcgata

SEQ ID NO: 912494 - DNA, 25 bp, Mus musculus
cgtcgcctgcaggtgtctaagcact

SEQ ID NO: 912495 - DNA, 25 bp, Mus musculus
cgtcgcgcacagcattacatcttct

SEQ ID NO: 912496 - DNA, 25 bp, Mus musculus
cgtcgcgcacagcccctaccgtgga

SEQ ID NO: 912497 - DNA, 25 bp, Mus musculus
cgtcgcgcacaggattacatcttct

SEQ ID NO: 912498 - DNA, 25 bp, Mus musculus
cgtcgcgcacaggccctaccgtgga

SEQ ID NO: 912499 - DNA, 25 bp, Mus musculus
cgtcgctcactccatcaatgagctc

SEQ ID NO: 912500 - DNA, 25 bp, Mus musculus
cgtcgctcactcgatcaatgagctc

SEQ ID NO: 912501 - DNA, 25 bp, Mus musculus
cgtcgctgatctactcccacacatg

SEQ ID NO: 912502 - DNA, 25 bp, Mus musculus
cgtcgctgatcttctcccacacatg

SEQ ID NO: 912503 - DNA, 25 bp, Mus musculus
cgtcgcttaccgataccgcaggtgg

SEQ ID NO: 912504 - DNA, 25 bp, Mus musculus
cgtcgcttaccgctggaagcttgga

SEQ ID NO: 912505 - DNA, 25 bp, Mus musculus
cgtcgcttaccggtggaagcttgga

SEQ ID NO: 912506 - DNA, 25 bp, Mus musculus
cgtcgcttaccgttaccgcaggtgg

SEQ ID NO: 912507 - DNA, 25 bp, Mus musculus
cgtcgcttcctcaacctgagtcctg

SEQ ID NO: 912508 - DNA, 25 bp, Mus musculus
cgtcgcttcctcaagctgagtcctg

SEQ ID NO: 912509 - DNA, 25 bp, Mus musculus
cgtcggagagctgctgaatgccatc

SEQ ID NO: 912510 - DNA, 25 bp, Mus musculus
cgtcggagaggtgctgaatgccatc

SEQ ID NO: 912511 - DNA, 25 bp, Mus musculus
cgtcggcatcagaacggccggtttg

SEQ ID NO: 912512 - DNA, 25 bp, Mus musculus
cgtcggcatcagtacggccggtttg

SEQ ID NO: 912513 - DNA, 25 bp, Mus musculus
cgtcggcttcggactatacctggag

SEQ ID NO: 912514 - DNA, 25 bp, Mus musculus
cgtcggcttcggtctatacctggag

SEQ ID NO: 912515 - DNA, 25 bp, Mus musculus
cgtcgggaccagcatgaggctgtag

SEQ ID NO: 912516 - DNA, 25 bp, Mus musculus
cgtcgggaccaggatgaggctgtag

SEQ ID NO: 912517 - DNA, 25 bp, Mus musculus
cgtcgtcgtccgctccagaaatctt

SEQ ID NO: 912518 - DNA, 25 bp, Mus musculus
cgtcgtcgtccggtccagaaatctt

SEQ ID NO: 912519 - DNA, 25 bp, Mus musculus
cgtcgtcgtgcaccaatgaaaagag

SEQ ID NO: 912520 - DNA, 25 bp, Mus musculus
cgtcgtcgtggaccaatgaaaagag

SEQ ID NO: 912521 - DNA, 25 bp, Mus musculus
cgtcgtgagagtcgcttggaaacac

SEQ ID NO: 912522 - DNA, 25 bp, Mus musculus
cgtcgtgagagtggcttggaaacac

SEQ ID NO: 912523 - DNA, 25 bp, Mus musculus
cgtcgtgcaacatttcctgccaatt

SEQ ID NO: 912524 - DNA, 25 bp, Mus musculus
cgtcgtgcaagatttcctgccaatt

SEQ ID NO: 912525 - DNA, 25 bp, Mus musculus
cgtcgtgtcttgcgtcttctccatc

SEQ ID NO: 912526 - DNA, 25 bp, Mus musculus
cgtcgtgtcttgggtcttctccatc

SEQ ID NO: 912527 - DNA, 25 bp, Mus musculus
cgtcgtgtgcagccagtcaggggag

SEQ ID NO: 912528 - DNA, 25 bp, Mus musculus
cgtcgtgtgcaggcagtcaggggag

SEQ ID NO: 912529 - DNA, 25 bp, Mus musculus
cgtctacttaacaatacaacacact

SEQ ID NO: 912530 - DNA, 25 bp, Mus musculus
cgtctacttaactatacaacacact

SEQ ID NO: 912531 - DNA, 25 bp, Mus musculus
cgtctatcagacttgtctgtattcc

SEQ ID NO: 912532 - DNA, 25 bp, Mus musculus
cgtctatcagtcttgtctgtattcc

SEQ ID NO: 912533 - DNA, 25 bp, Mus musculus
cgtctatctcagcggccctggaaga

SEQ ID NO: 912534 - DNA, 25 bp, Mus musculus
cgtctatctcaggggccctggaaga

SEQ ID NO: 912535 - DNA, 25 bp, Mus musculus
cgtctccagaaaagaaatctgctcc

SEQ ID NO: 912536 - DNA, 25 bp, Mus musculus
cgtctccagaaatgaaatctgctcc

SEQ ID NO: 912537 - DNA, 25 bp, Mus musculus
cgtctcccacgtcactcctaggaaa

SEQ ID NO: 912538 - DNA, 25 bp, Mus musculus
cgtctcccacgtcagtcctaggaaa

SEQ ID NO: 912539 - DNA, 25 bp, Mus musculus
cgtctcccagatcctacagaacctt

SEQ ID NO: 912540 - DNA, 25 bp, Mus musculus
cgtctcccagatgctacagaacctt

SEQ ID NO: 912541 - DNA, 25 bp, Mus musculus
cgtctcccgctgcacgtggaaagca

SEQ ID NO: 912542 - DNA, 25 bp, Mus musculus
cgtctcccgctgcaggtggaaagca

SEQ ID NO: 912543 - DNA, 25 bp, Mus musculus
cgtctcctagacaaagccaccagcc

SEQ ID NO: 912544 - DNA, 25 bp, Mus musculus
cgtctcctagtcaaagccaccagcc

SEQ ID NO: 912545 - DNA, 25 bp, Mus musculus
cgtctcctgcacctgaggagcatgt

SEQ ID NO: 912546 - DNA, 25 bp, Mus musculus
cgtctcctgcacgtgaggagcatgt

SEQ ID NO: 912547 - DNA, 25 bp, Mus musculus
cgtctccttcgacctgtttgcagac

SEQ ID NO: 912548 - DNA, 25 bp, Mus musculus
cgtctccttcgagctgtttgcagac

SEQ ID NO: 912549 - DNA, 25 bp, Mus musculus
cgtctccttgtccaagatcgagcgg

SEQ ID NO: 912550 - DNA, 25 bp, Mus musculus
cgtctccttgtccatgatcgagcgg

SEQ ID NO: 912551 - DNA, 25 bp, Mus musculus
cgtctcctttagcacaggtgcagca

SEQ ID NO: 912552 - DNA, 25 bp, Mus musculus
cgtctcctttaggacaggtgcagca

SEQ ID NO: 912553 - DNA, 25 bp, Mus musculus
cgtctctcgtggaacgtgaagccgt

SEQ ID NO: 912554 - DNA, 25 bp, Mus musculus
cgtctctcgtggaaggtgaagccgt

SEQ ID NO: 912555 - DNA, 25 bp, Mus musculus
cgtctctgggaacgtgcggttccca

SEQ ID NO: 912556 - DNA, 25 bp, Mus musculus
cgtctctgggaaggtgcggttccca

SEQ ID NO: 912557 - DNA, 25 bp, Mus musculus
cgtctctgttttagaggagcaaacc

SEQ ID NO: 912558 - DNA, 25 bp, Mus musculus
cgtctctgtttttgaggagcaaacc

SEQ ID NO: 912559 - DNA, 25 bp, Mus musculus
cgtctgagtgtatcccacaagaaga

SEQ ID NO: 912560 - DNA, 25 bp, Mus musculus
cgtctgagtgtatcgcacaagaaga

SEQ ID NO: 912561 - DNA, 25 bp, Mus musculus
cgtctgcaccagacccacaggctga

SEQ ID NO: 912562 - DNA, 25 bp, Mus musculus
cgtctgcaccagtcccacaggctga

SEQ ID NO: 912563 - DNA, 25 bp, Mus musculus
cgtctgccagagcgaccagtaccgg

SEQ ID NO: 912564 - DNA, 25 bp, Mus musculus
cgtctgccagtgcgaccagtaccgg

SEQ ID NO: 912565 - DNA, 25 bp, Mus musculus
cgtctgcgccagcatccgcctctga

SEQ ID NO: 912566 - DNA, 25 bp, Mus musculus
cgtctgcgccaggatccgcctctga

SEQ ID NO: 912567 - DNA, 25 bp, Mus musculus
cgtctgctgctgatatcccctttga

SEQ ID NO: 912568 - DNA, 25 bp, Mus musculus
cgtctgctgctgttatcccctttga

SEQ ID NO: 912569 - DNA, 25 bp, Mus musculus
cgtctggaatagcgaaaaccgagct

SEQ ID NO: 912570 - DNA, 25 bp, Mus musculus
cgtctggaatagggaaaaccgagct

SEQ ID NO: 912571 - DNA, 25 bp, Mus musculus
cgtctggatcaccacccctccccgg

SEQ ID NO: 912572 - DNA, 25 bp, Mus musculus
cgtctggatcacgacccctccccgg

SEQ ID NO: 912573 - DNA, 25 bp, Mus musculus
cgtctggcaccccaccagcaggatg

SEQ ID NO: 912574 - DNA, 25 bp, Mus musculus
cgtctggcacccgaccagcaggatg

SEQ ID NO: 912575 - DNA, 25 bp, Mus musculus
cgtctggcagctccaagggtagcca

SEQ ID NO: 912576 - DNA, 25 bp, Mus musculus
cgtctggcaggtccaagggtagcca

SEQ ID NO: 912577 - DNA, 25 bp, Mus musculus
cgtctggggccacgtcatcgccacc

SEQ ID NO: 912578 - DNA, 25 bp, Mus musculus
cgtctggggccaggtcatcgccacc

SEQ ID NO: 912579 - DNA, 25 bp, Mus musculus
cgtctggtacctcatcatcaatgct

SEQ ID NO: 912580 - DNA, 25 bp, Mus musculus
cgtctggtacctgatcatcaatgct

SEQ ID NO: 912581 - DNA, 25 bp, Mus musculus
cgtctgtaactgacatcagagatca

SEQ ID NO: 912582 - DNA, 25 bp, Mus musculus
cgtctgtaactgcgatcatggcagg

SEQ ID NO: 912583 - DNA, 25 bp, Mus musculus
cgtctgtaactgggatcatggcagg

SEQ ID NO: 912584 - DNA, 25 bp, Mus musculus
cgtctgtaactgtcatcagagatca

SEQ ID NO: 912585 - DNA, 25 bp, Mus musculus
cgtctgtcctgactgaaactggttc

SEQ ID NO: 912586 - DNA, 25 bp, Mus musculus
cgtctgtcctgagtgaaactggttc

SEQ ID NO: 912587 - DNA, 25 bp, Mus musculus
cgtctgttatcagaccaatgtcttg

SEQ ID NO: 912588 - DNA, 25 bp, Mus musculus
cgtctgttatgagaccaatgtcttg

SEQ ID NO: 912589 - DNA, 25 bp, Mus musculus
cgtctgtttgctttgagcgctgccg

SEQ ID NO: 912590 - DNA, 25 bp, Mus musculus
cgtctgtttggtttgagcgctgccg

SEQ ID NO: 912591 - DNA, 25 bp, Mus musculus
cgtcttccaaatatggcatgaattg

SEQ ID NO: 912592 - DNA, 25 bp, Mus musculus
cgtcttccaattatggcatgaattg

SEQ ID NO: 912593 - DNA, 25 bp, Mus musculus
cgtcttccagcgcgttgataaagac

SEQ ID NO: 912594 - DNA, 25 bp, Mus musculus
cgtcttccagcgggttgataaagac

SEQ ID NO: 912595 - DNA, 25 bp, Mus musculus
cgtcttcccacgaacaagatgccat

SEQ ID NO: 912596 - DNA, 25 bp, Mus musculus
cgtcttcccacgcatgtgatcttcg

SEQ ID NO: 912597 - DNA, 25 bp, Mus musculus
cgtcttcccacggatgtgatcttcg

SEQ ID NO: 912598 - DNA, 25 bp, Mus musculus
cgtcttcccacgtacaagatgccat

SEQ ID NO: 912599 - DNA, 25 bp, Mus musculus
cgtcttccgagcccaggtaaactgc

SEQ ID NO: 912600 - DNA, 25 bp, Mus musculus
cgtcttccgagccctggtaaactgc

SEQ ID NO: 912601 - DNA, 25 bp, Mus musculus
cgtcttctggatcactggggtgatc

SEQ ID NO: 912602 - DNA, 25 bp, Mus musculus
cgtcttctggctggctggaggcgtg

SEQ ID NO: 912603 - DNA, 25 bp, Mus musculus
cgtcttctgggtggctggaggcgtg

SEQ ID NO: 912604 - DNA, 25 bp, Mus musculus
cgtcttctggttcactggggtgatc

SEQ ID NO: 912605 - DNA, 25 bp, Mus musculus
cgtcttgagaccatcgttgatgccc

SEQ ID NO: 912606 - DNA, 25 bp, Mus musculus
cgtcttgagaccatggttgatgccc

SEQ ID NO: 912607 - DNA, 25 bp, Mus musculus
cgtcttgcagaggttgacagacata

SEQ ID NO: 912608 - DNA, 25 bp, Mus musculus
cgtcttgcagcttgacagacatatt

SEQ ID NO: 912609 - DNA, 25 bp, Mus musculus
cgtcttgcaggttgacagacatatt

SEQ ID NO: 912610 - DNA, 25 bp, Mus musculus
cgtcttgcagtggttgacagacata

SEQ ID NO: 912611 - DNA, 25 bp, Mus musculus
cgtcttgtttaacattgacgagtat

SEQ ID NO: 912612 - DNA, 25 bp, Mus musculus
cgtcttgtttaagattgacgagtat

SEQ ID NO: 912613 - DNA, 25 bp, Mus musculus
cgtgaaaaagaatcttggaagatgg

SEQ ID NO: 912614 - DNA, 25 bp, Mus musculus
cgtgaaaaagtatcttggaagatgg

SEQ ID NO: 912615 - DNA, 25 bp, Mus musculus
cgtgaacctcaccaccatgtccaaa

SEQ ID NO: 912616 - DNA, 25 bp, Mus musculus
cgtgaacctcaccagcatgtccaaa

SEQ ID NO: 912617 - DNA, 25 bp, Mus musculus
cgtgaaggatctggtggttcagagg

SEQ ID NO: 912618 - DNA, 25 bp, Mus musculus
cgtgaaggatgtggtggttcagagg

SEQ ID NO: 912619 - DNA, 25 bp, Mus musculus
cgtgaaggtcatcagatcagccctt

SEQ ID NO: 912620 - DNA, 25 bp, Mus musculus
cgtgaaggtcatgagatcagccctt

SEQ ID NO: 912621 - DNA, 25 bp, Mus musculus
cgtgaatgccaacgcttacaatgga

SEQ ID NO: 912622 - DNA, 25 bp, Mus musculus
cgtgaatgccaaggcttacaatgga

SEQ ID NO: 912623 - DNA, 25 bp, Mus musculus
cgtgaatgggcgcaatggcatctcc

SEQ ID NO: 912624 - DNA, 25 bp, Mus musculus
cgtgaatgggggcaatggcatctcc

SEQ ID NO: 912625 - DNA, 25 bp, Mus musculus
cgtgacacctaacgtgaaggcgata

SEQ ID NO: 912626 - DNA, 25 bp, Mus musculus
cgtgacacctaaggtgaaggcgata

SEQ ID NO: 912627 - DNA, 25 bp, Mus musculus
cgtgactccccacaagctccctggg

SEQ ID NO: 912628 - DNA, 25 bp, Mus musculus
cgtgactccccacatgctccctggg

SEQ ID NO: 912629 - DNA, 25 bp, Mus musculus
cgtgactgagaggaaccttgtgtgc

SEQ ID NO: 912630 - DNA, 25 bp, Mus musculus
cgtgactgagtggaaccttgtgtgc

SEQ ID NO: 912631 - DNA, 25 bp, Mus musculus
cgtgacttctataaaatacaaggag

SEQ ID NO: 912632 - DNA, 25 bp, Mus musculus
cgtgacttctataatatacaaggag

SEQ ID NO: 912633 - DNA, 25 bp, Mus musculus
cgtgagacagcacgacatagccacc

SEQ ID NO: 912634 - DNA, 25 bp, Mus musculus
cgtgagacagcaggacatagccacc

SEQ ID NO: 912635 - DNA, 25 bp, Mus musculus
cgtgagagatctcaagcagataaag

SEQ ID NO: 912636 - DNA, 25 bp, Mus musculus
cgtgagagatctgaagcagataaag

SEQ ID NO: 912637 - DNA, 25 bp, Mus musculus
cgtgagagtgccttggaaacaccac

SEQ ID NO: 912638 - DNA, 25 bp, Mus musculus
cgtgagagtggcttggaaacaccac

SEQ ID NO: 912639 - DNA, 25 bp, Mus musculus
cgtgagccagattacaagattcctt

SEQ ID NO: 912640 - DNA, 25 bp, Mus musculus
cgtgagccagtttacaagattcctt

SEQ ID NO: 912641 - DNA, 25 bp, Mus musculus
cgtgaggactatcgcaggttcaccg

SEQ ID NO: 912642 - DNA, 25 bp, Mus musculus
cgtgaggactatggcaggttcaccg

SEQ ID NO: 912643 - DNA, 25 bp, Mus musculus
cgtgaggagaatctcccagaaatcc

SEQ ID NO: 912644 - DNA, 25 bp, Mus musculus
cgtgaggagaatgtcccagaaatcc

SEQ ID NO: 912645 - DNA, 25 bp, Mus musculus
cgtgaggaggagcacgatgtggacc

SEQ ID NO: 912646 - DNA, 25 bp, Mus musculus
cgtgaggaggaggacgatgtggacc

SEQ ID NO: 912647 - DNA, 25 bp, Mus musculus
cgtgaggagtaccacgagaccctga

SEQ ID NO: 912648 - DNA, 25 bp, Mus musculus
cgtgaggagtaccacgaggagctgg

SEQ ID NO: 912649 - DNA, 25 bp, Mus musculus
cgtgaggagtaccaggagaccctga

SEQ ID NO: 912650 - DNA, 25 bp, Mus musculus
cgtgaggagtaccaggaggagctgg

SEQ ID NO: 912651 - DNA, 25 bp, Mus musculus
cgtgatcaagaataagacctggaag

SEQ ID NO: 912652 - DNA, 25 bp, Mus musculus
cgtgatcaagtataagacctggaag

SEQ ID NO: 912653 - DNA, 25 bp, Mus musculus
cgtgatcaatggatctccctgccag

SEQ ID NO: 912654 - DNA, 25 bp, Mus musculus
cgtgatcaatggttctccctgccag

SEQ ID NO: 912655 - DNA, 25 bp, Mus musculus
cgtgatcgttagcactggagagagc

SEQ ID NO: 912656 - DNA, 25 bp, Mus musculus
cgtgatcgttaggactggagagagc

SEQ ID NO: 912657 - DNA, 25 bp, Mus musculus
cgtgatctcgcagtcctccgggcag

SEQ ID NO: 912658 - DNA, 25 bp, Mus musculus
cgtgatctcgcgcaatggcagcaga

SEQ ID NO: 912659 - DNA, 25 bp, Mus musculus
cgtgatctcggagtcctccgggcag

SEQ ID NO: 912660 - DNA, 25 bp, Mus musculus
cgtgatctcgggcaatggcagcaga

SEQ ID NO: 912661 - DNA, 25 bp, Mus musculus
cgtgatgggaagctatggatgtatt

SEQ ID NO: 912662 - DNA, 25 bp, Mus musculus
cgtgatgggaaggtatggatgtatt

SEQ ID NO: 912663 - DNA, 25 bp, Mus musculus
cgtgatgttgggaaagtattaatga

SEQ ID NO: 912664 - DNA, 25 bp, Mus musculus
cgtgatgttgggtaagtattaatga

SEQ ID NO: 912665 - DNA, 25 bp, Mus musculus
cgtgatttccagaccctgcagggct

SEQ ID NO: 912666 - DNA, 25 bp, Mus musculus
cgtgatttccagtccctgcagggct

SEQ ID NO: 912667 - DNA, 25 bp, Mus musculus
cgtgcaatcaagcacgaacctgggc

SEQ ID NO: 912668 - DNA, 25 bp, Mus musculus
cgtgcaatcaagcaggaacctgggc

SEQ ID NO: 912669 - DNA, 25 bp, Mus musculus
cgtgcacacaggatcgtcctcttta

SEQ ID NO: 912670 - DNA, 25 bp, Mus musculus
cgtgcacacaggatggtcctcttta

SEQ ID NO: 912671 - DNA, 25 bp, Mus musculus
cgtgcacacagggtcggcccctgta

SEQ ID NO: 912672 - DNA, 25 bp, Mus musculus
cgtgcacacagggtgggcccctgta

SEQ ID NO: 912673 - DNA, 25 bp, Mus musculus
cgtgcacagcagcgtgtctcctctg

SEQ ID NO: 912674 - DNA, 25 bp, Mus musculus
cgtgcacagcagggtgtctcctctg

SEQ ID NO: 912675 - DNA, 25 bp, Mus musculus
cgtgcacgcgagaaagccaagtaga

SEQ ID NO: 912676 - DNA, 25 bp, Mus musculus
cgtgcacgcggtcacaactgtgccg

SEQ ID NO: 912677 - DNA, 25 bp, Mus musculus
cgtgcacgcggtcacagaaagccaa

SEQ ID NO: 912678 - DNA, 25 bp, Mus musculus
cgtgcacgcggtcagaactgtgccg

SEQ ID NO: 912679 - DNA, 25 bp, Mus musculus
cgtgcacgcggtcagagaaagccaa

SEQ ID NO: 912680 - DNA, 25 bp, Mus musculus
cgtgcacgcgtgaaagccaagtaga

SEQ ID NO: 912681 - DNA, 25 bp, Mus musculus
cgtgcactgcaaacaatattatgcc

SEQ ID NO: 912682 - DNA, 25 bp, Mus musculus
cgtgcactgcaaactatattatgcc

SEQ ID NO: 912683 - DNA, 25 bp, Mus musculus
cgtgcagccgcaatcgatccaagtt

SEQ ID NO: 912684 - DNA, 25 bp, Mus musculus
cgtgcagccgcaatggatccaagtt

SEQ ID NO: 912685 - DNA, 25 bp, Mus musculus
cgtgcaggcgcacgtcaagtgctgt

SEQ ID NO: 912686 - DNA, 25 bp, Mus musculus
cgtgcaggcgcaggtcaagtgctgt

SEQ ID NO: 912687 - DNA, 25 bp, Mus musculus
cgtgccaaagaaggactccatgaaa

SEQ ID NO: 912688 - DNA, 25 bp, Mus musculus
cgtgccaaagcactccatgaaagat

SEQ ID NO: 912689 - DNA, 25 bp, Mus musculus
cgtgccaaaggactccatgaaagat

SEQ ID NO: 912690 - DNA, 25 bp, Mus musculus
cgtgccaaagtaggactccatgaaa

SEQ ID NO: 912691 - DNA, 25 bp, Mus musculus
cgtgccagatatactgtcttgtttc

SEQ ID NO: 912692 - DNA, 25 bp, Mus musculus
cgtgccagatattctgtcttgtttc

SEQ ID NO: 912693 - DNA, 25 bp, Mus musculus
cgtgccatcggcttcgtatttgcat

SEQ ID NO: 912694 - DNA, 25 bp, Mus musculus
cgtgccatcggcttggtatttgcat

SEQ ID NO: 912695 - DNA, 25 bp, Mus musculus
cgtgccatggacgacattcagccag

SEQ ID NO: 912696 - DNA, 25 bp, Mus musculus
cgtgccatggacgagattcagccag

SEQ ID NO: 912697 - DNA, 25 bp, Mus musculus
cgtgcccatcagcaggcagagacaa

SEQ ID NO: 912698 - DNA, 25 bp, Mus musculus
cgtgcccatcaggaggcagagacaa

SEQ ID NO: 912699 - DNA, 25 bp, Mus musculus
cgtgcccgagattcaggtgccatgc

SEQ ID NO: 912700 - DNA, 25 bp, Mus musculus
cgtgcccgagtttcaggtgccatgc

SEQ ID NO: 912701 - DNA, 25 bp, Mus musculus
cgtgcccgtatacattacatctcgc

SEQ ID NO: 912702 - DNA, 25 bp, Mus musculus
cgtgcccgtatacgcacgtcagctt

SEQ ID NO: 912703 - DNA, 25 bp, Mus musculus
cgtgcccgtatagattacatctcgc

SEQ ID NO: 912704 - DNA, 25 bp, Mus musculus
cgtgcccgtataggcacgtcagctt

SEQ ID NO: 912705 - DNA, 25 bp, Mus musculus
cgtgccctgcagcacgtgttcagga

SEQ ID NO: 912706 - DNA, 25 bp, Mus musculus
cgtgccctgcagcaggtgttcagga

SEQ ID NO: 912707 - DNA, 25 bp, Mus musculus
cgtgccgcggcagaggaaaagcagc

SEQ ID NO: 912708 - DNA, 25 bp, Mus musculus
cgtgccgcggctgtgccaggagagg

SEQ ID NO: 912709 - DNA, 25 bp, Mus musculus
cgtgccgcgggagaggaaaagcagc

SEQ ID NO: 912710 - DNA, 25 bp, Mus musculus
cgtgccgcgggtgtgccaggagagg

SEQ ID NO: 912711 - DNA, 25 bp, Mus musculus
cgtgccgtgaggccgttgactggat

SEQ ID NO: 912712 - DNA, 25 bp, Mus musculus
cgtgccgtgagggcgttgactggat

SEQ ID NO: 912713 - DNA, 25 bp, Mus musculus
cgtgcctacgcaaacatgacagctg

SEQ ID NO: 912714 - DNA, 25 bp, Mus musculus
cgtgcctacggaaacatgacagctg

SEQ ID NO: 912715 - DNA, 25 bp, Mus musculus
cgtgcctacggcaaggaaacatgac

SEQ ID NO: 912716 - DNA, 25 bp, Mus musculus
cgtgcctacggctaggaaacatgac

SEQ ID NO: 912717 - DNA, 25 bp, Mus musculus
cgtgcgatagggataaccctcgaga

SEQ ID NO: 912718 - DNA, 25 bp, Mus musculus
cgtgcgatagggttaaccctcgaga

SEQ ID NO: 912719 - DNA, 25 bp, Mus musculus
cgtgcgccgcaacgtacctgcgctg

SEQ ID NO: 912720 - DNA, 25 bp, Mus musculus
cgtgcgccgcaaggtacctgcgctg

SEQ ID NO: 912721 - DNA, 25 bp, Mus musculus
cgtgcgcctgcacgtctctgcaaga

SEQ ID NO: 912722 - DNA, 25 bp, Mus musculus
cgtgcgcctgcacgtggtggtggaa

SEQ ID NO: 912723 - DNA, 25 bp, Mus musculus
cgtgcgcctgcacgttcacattgag

SEQ ID NO: 912724 - DNA, 25 bp, Mus musculus
cgtgcgcctgcaggtctctgcaaga

SEQ ID NO: 912725 - DNA, 25 bp, Mus musculus
cgtgcgcctgcaggtggtggtggaa

SEQ ID NO: 912726 - DNA, 25 bp, Mus musculus
cgtgcgcctgcaggttcacattgag

SEQ ID NO: 912727 - DNA, 25 bp, Mus musculus
cgtgcgctcggaacagtgtcgtgat

SEQ ID NO: 912728 - DNA, 25 bp, Mus musculus
cgtgcgctcggaactgtgtcgtgat

SEQ ID NO: 912729 - DNA, 25 bp, Mus musculus
cgtgcgggaagccgcggcggccctg

SEQ ID NO: 912730 - DNA, 25 bp, Mus musculus
cgtgcgggaagcggcggcggccctg

SEQ ID NO: 912731 - DNA, 25 bp, Mus musculus
cgtgcgggtgagaacaacgtgggca

SEQ ID NO: 912732 - DNA, 25 bp, Mus musculus
cgtgcgggtgaggtacaagctggac

SEQ ID NO: 912733 - DNA, 25 bp, Mus musculus
cgtgcgggtgtgaacaacgtgggca

SEQ ID NO: 912734 - DNA, 25 bp, Mus musculus
cgtgcgggtgtggtacaagctggac

SEQ ID NO: 912735 - DNA, 25 bp, Mus musculus
cgtgctcaagcttaactacatcctg

SEQ ID NO: 912736 - DNA, 25 bp, Mus musculus
cgtgctcaaggttaactacatcctg

SEQ ID NO: 912737 - DNA, 25 bp, Mus musculus
cgtgctcacagcctttgcaaatgga

SEQ ID NO: 912738 - DNA, 25 bp, Mus musculus
cgtgctcacagcgtttgcaaatgga

SEQ ID NO: 912739 - DNA, 25 bp, Mus musculus
cgtgctcaggtgactgattcttctc

SEQ ID NO: 912740 - DNA, 25 bp, Mus musculus
cgtgctcaggtgtctgattcttctc

SEQ ID NO: 912741 - DNA, 25 bp, Mus musculus
cgtgctccagagtggcgctgactcc

SEQ ID NO: 912742 - DNA, 25 bp, Mus musculus
cgtgctccagtgtggcgctgactcc

SEQ ID NO: 912743 - DNA, 25 bp, Mus musculus
cgtgctcgccagcaagtagcatctc

SEQ ID NO: 912744 - DNA, 25 bp, Mus musculus
cgtgctcgccaggaagtagcatctc

SEQ ID NO: 912745 - DNA, 25 bp, Mus musculus
cgtgctgatggacacccctgggatc

SEQ ID NO: 912746 - DNA, 25 bp, Mus musculus
cgtgctgatggacagccctgggatc

SEQ ID NO: 912747 - DNA, 25 bp, Mus musculus
cgtgctgcagtcctcgtgtgagaag

SEQ ID NO: 912748 - DNA, 25 bp, Mus musculus
cgtgctgcagtcctggtgtgagaag

SEQ ID NO: 912749 - DNA, 25 bp, Mus musculus
cgtgctggggagctccaaggtgctg

SEQ ID NO: 912750 - DNA, 25 bp, Mus musculus
cgtgctggggtgctccaaggtgctg

SEQ ID NO: 912751 - DNA, 25 bp, Mus musculus
cgtgcttcagactggtttacctgag

SEQ ID NO: 912752 - DNA, 25 bp, Mus musculus
cgtgcttcagtctggtttacctgag

SEQ ID NO: 912753 - DNA, 25 bp, Mus musculus
cgtgcttgcagaccttgtgactgcc

SEQ ID NO: 912754 - DNA, 25 bp, Mus musculus
cgtgcttgcagagcttgtgactgcc

SEQ ID NO: 912755 - DNA, 25 bp, Mus musculus
cgtgcttggcggcgcctgtgagaga

SEQ ID NO: 912756 - DNA, 25 bp, Mus musculus
cgtgcttggcggggcctgtgagaga

SEQ ID NO: 912757 - DNA, 25 bp, Mus musculus
cgtggaagagctcagcagagcactt

SEQ ID NO: 912758 - DNA, 25 bp, Mus musculus
cgtggaagagctcagggccaaaact

SEQ ID NO: 912759 - DNA, 25 bp, Mus musculus
cgtggaagaggtcagcagagcactt

SEQ ID NO: 912760 - DNA, 25 bp, Mus musculus
cgtggaagaggtcagggccaaaact

SEQ ID NO: 912761 - DNA, 25 bp, Mus musculus
cgtggaatggaactcctgtgacttg

SEQ ID NO: 912762 - DNA, 25 bp, Mus musculus
cgtggaatggaagtcctgtgacttg

SEQ ID NO: 912763 - DNA, 25 bp, Mus musculus
cgtggacactccaacgcatgtagaa

SEQ ID NO: 912764 - DNA, 25 bp, Mus musculus
cgtggacactccaaggcatgtagaa

SEQ ID NO: 912765 - DNA, 25 bp, Mus musculus
cgtggacgagctgtccacagaactg

SEQ ID NO: 912766 - DNA, 25 bp, Mus musculus
cgtggacgaggtgtccacagaactg

SEQ ID NO: 912767 - DNA, 25 bp, Mus musculus
cgtggactggcatattcaccatggc

SEQ ID NO: 912768 - DNA, 25 bp, Mus musculus
cgtggactgggatattcaccatggc

SEQ ID NO: 912769 - DNA, 25 bp, Mus musculus
cgtggactgtagcacagatccagat

SEQ ID NO: 912770 - DNA, 25 bp, Mus musculus
cgtggactgttgcacagatccagat

SEQ ID NO: 912771 - DNA, 25 bp, Mus musculus
cgtggacttagaccatcactcttac

SEQ ID NO: 912772 - DNA, 25 bp, Mus musculus
cgtggacttagagcatcactcttac

SEQ ID NO: 912773 - DNA, 25 bp, Mus musculus
cgtggacttgtgcggccccctggca

SEQ ID NO: 912774 - DNA, 25 bp, Mus musculus
cgtggacttgtggggccccctggca

SEQ ID NO: 912775 - DNA, 25 bp, Mus musculus
cgtggagaagcacccagatgcagat

SEQ ID NO: 912776 - DNA, 25 bp, Mus musculus
cgtggagaaggacccagatgcagat

SEQ ID NO: 912777 - DNA, 25 bp, Mus musculus
cgtggagaatgtcggctcatggcag

SEQ ID NO: 912778 - DNA, 25 bp, Mus musculus
cgtggagaatgtgggctcatggcag

SEQ ID NO: 912779 - DNA, 25 bp, Mus musculus
cgtggagactctgacgttggattcc

SEQ ID NO: 912780 - DNA, 25 bp, Mus musculus
cgtggagactctgaggttggattcc

SEQ ID NO: 912781 - DNA, 25 bp, Mus musculus
cgtggagcccttcacgcctccttgg

SEQ ID NO: 912782 - DNA, 25 bp, Mus musculus
cgtggagcccttgacgcctccttgg

SEQ ID NO: 912783 - DNA, 25 bp, Mus musculus
cgtggaggagaacggaacgcaagga

SEQ ID NO: 912784 - DNA, 25 bp, Mus musculus
cgtggaggagaagggaacgcaagga

SEQ ID NO: 912785 - DNA, 25 bp, Mus musculus
cgtggaggagatggaggcggaagaa

SEQ ID NO: 912786 - DNA, 25 bp, Mus musculus
cgtggaggagcaacagaagcgcctg

SEQ ID NO: 912787 - DNA, 25 bp, Mus musculus
cgtggaggaggaacagaagcgcctg

SEQ ID NO: 912788 - DNA, 25 bp, Mus musculus
cgtggaggagttggaggcggaagaa

SEQ ID NO: 912789 - DNA, 25 bp, Mus musculus
cgtggagggcaacgaagggaagcag

SEQ ID NO: 912790 - DNA, 25 bp, Mus musculus
cgtggagggcaaggaagggaagcag

SEQ ID NO: 912791 - DNA, 25 bp, Mus musculus
cgtggaggtgggctgctgtgagtgg

SEQ ID NO: 912792 - DNA, 25 bp, Mus musculus
cgtggaggtggggtgctgtgagtgg

SEQ ID NO: 912793 - DNA, 25 bp, Mus musculus
cgtggatcggcgcttcattacagca

SEQ ID NO: 912794 - DNA, 25 bp, Mus musculus
cgtggatcggcggttcattacagca

SEQ ID NO: 912795 - DNA, 25 bp, Mus musculus
cgtggatgactgaagctggccccgt

SEQ ID NO: 912796 - DNA, 25 bp, Mus musculus
cgtggatgactgcgcagccacgccc

SEQ ID NO: 912797 - DNA, 25 bp, Mus musculus
cgtggatgactgggcagccacgccc

SEQ ID NO: 912798 - DNA, 25 bp, Mus musculus
cgtggatgactgtagctggccccgt

SEQ ID NO: 912799 - DNA, 25 bp, Mus musculus
cgtggatgatgtcttcctgcgggtg

SEQ ID NO: 912800 - DNA, 25 bp, Mus musculus
cgtggatgatgtgttcctgcgggtg

SEQ ID NO: 912801 - DNA, 25 bp, Mus musculus
cgtggatgggaacgaagagataaga

SEQ ID NO: 912802 - DNA, 25 bp, Mus musculus
cgtggatgggaaggaagagataaga

SEQ ID NO: 912803 - DNA, 25 bp, Mus musculus
cgtggattggcccgctatggggcat

SEQ ID NO: 912804 - DNA, 25 bp, Mus musculus
cgtggattggccggctatggggcat

SEQ ID NO: 912805 - DNA, 25 bp, Mus musculus
cgtggatttccacgcagtagaggcc

SEQ ID NO: 912806 - DNA, 25 bp, Mus musculus
cgtggatttccacgccgtggtattc

SEQ ID NO: 912807 - DNA, 25 bp, Mus musculus
cgtggatttccaggcagtagaggcc

SEQ ID NO: 912808 - DNA, 25 bp, Mus musculus
cgtggatttccaggccgtggtattc

SEQ ID NO: 912809 - DNA, 25 bp, Mus musculus
cgtggcaaaaagtcagtccgaccgc

SEQ ID NO: 912810 - DNA, 25 bp, Mus musculus
cgtggcaaaacccaaagtgacagag

SEQ ID NO: 912811 - DNA, 25 bp, Mus musculus
cgtggcaaaaccgaaagtgacagag

SEQ ID NO: 912812 - DNA, 25 bp, Mus musculus
cgtggcaaaagcactcagatcaccg

SEQ ID NO: 912813 - DNA, 25 bp, Mus musculus
cgtggcaaaagctctcagatcaccg

SEQ ID NO: 912814 - DNA, 25 bp, Mus musculus
cgtggcaaaatgtcagtccgaccgc

SEQ ID NO: 912815 - DNA, 25 bp, Mus musculus
cgtggcaccgcgtcccagtgcccga

SEQ ID NO: 912816 - DNA, 25 bp, Mus musculus
cgtggcaccgggtcccagtgcccga

SEQ ID NO: 912817 - DNA, 25 bp, Mus musculus
cgtggcacggcacgattcacagatg

SEQ ID NO: 912818 - DNA, 25 bp, Mus musculus
cgtggcacggcaggattcacagatg

SEQ ID NO: 912819 - DNA, 25 bp, Mus musculus
cgtggccacagacacactggagctc

SEQ ID NO: 912820 - DNA, 25 bp, Mus musculus
cgtggccacagagacactggagctc

SEQ ID NO: 912821 - DNA, 25 bp, Mus musculus
cgtggccacctaaatttttatcttt

SEQ ID NO: 912822 - DNA, 25 bp, Mus musculus
cgtggccacctatatttttatcttt

SEQ ID NO: 912823 - DNA, 25 bp, Mus musculus
cgtggccatacacgtcctgtccaga

SEQ ID NO: 912824 - DNA, 25 bp, Mus musculus
cgtggccatacaggtcctgtccaga

SEQ ID NO: 912825 - DNA, 25 bp, Mus musculus
cgtggcccagactatcatgaacaag

SEQ ID NO: 912826 - DNA, 25 bp, Mus musculus
cgtggcccagtctatcatgaacaag

SEQ ID NO: 912827 - DNA, 25 bp, Mus musculus
cgtggcccatcttttcttggaaggg

SEQ ID NO: 912828 - DNA, 25 bp, Mus musculus
cgtggcccatgttttcttggaaggg

SEQ ID NO: 912829 - DNA, 25 bp, Mus musculus
cgtggcctccagaagccaccatggg

SEQ ID NO: 912830 - DNA, 25 bp, Mus musculus
cgtggcctccagtagccaccatggg

SEQ ID NO: 912831 - DNA, 25 bp, Mus musculus
cgtggcctggaaaatatgattcctt

SEQ ID NO: 912832 - DNA, 25 bp, Mus musculus
cgtggcctggtaaatatgattcctt

SEQ ID NO: 912833 - DNA, 25 bp, Mus musculus
cgtggccttaccatctgccctgggg

SEQ ID NO: 912834 - DNA, 25 bp, Mus musculus
cgtggccttaccatgtgccctgggg

SEQ ID NO: 912835 - DNA, 25 bp, Mus musculus
cgtggcgccagaaacattgttctct

SEQ ID NO: 912836 - DNA, 25 bp, Mus musculus
cgtggcgccagaaagattgttctct

SEQ ID NO: 912837 - DNA, 25 bp, Mus musculus
cgtggctcgcagaacctcaggtacc

SEQ ID NO: 912838 - DNA, 25 bp, Mus musculus
cgtggctcgcagaagctcaggtacc

SEQ ID NO: 912839 - DNA, 25 bp, Mus musculus
cgtggctgcagacgtatctgttctt

SEQ ID NO: 912840 - DNA, 25 bp, Mus musculus
cgtggctgcagaggtatctgttctt

SEQ ID NO: 912841 - DNA, 25 bp, Mus musculus
cgtggctgcttcaacgacaccaccc

SEQ ID NO: 912842 - DNA, 25 bp, Mus musculus
cgtggctgcttcaaggacaccaccc

SEQ ID NO: 912843 - DNA, 25 bp, Mus musculus
cgtggctgcttccacgcttttattt

SEQ ID NO: 912844 - DNA, 25 bp, Mus musculus
cgtggctgcttccaggcttttattt

SEQ ID NO: 912845 - DNA, 25 bp, Mus musculus
cgtggcttgaggaacaaaagaatcg

SEQ ID NO: 912846 - DNA, 25 bp, Mus musculus
cgtggcttgaggtacaaaagaatcg

SEQ ID NO: 912847 - DNA, 25 bp, Mus musculus
cgtggcttgcagacgcatagcctgg

SEQ ID NO: 912848 - DNA, 25 bp, Mus musculus
cgtggcttgcagtcgcatagcctgg

SEQ ID NO: 912849 - DNA, 25 bp, Mus musculus
cgtgggaatcatacatgacgccttt

SEQ ID NO: 912850 - DNA, 25 bp, Mus musculus
cgtgggaatcatacttgacgccttt

SEQ ID NO: 912851 - DNA, 25 bp, Mus musculus
cgtgggagcatgaacaatgagatgc

SEQ ID NO: 912852 - DNA, 25 bp, Mus musculus
cgtgggagcatgtacaatgagatgc

SEQ ID NO: 912853 - DNA, 25 bp, Mus musculus
cgtgggcgcccgccgcagcaagcac

SEQ ID NO: 912854 - DNA, 25 bp, Mus musculus
cgtgggcgcccggcgcagcaagcac

SEQ ID NO: 912855 - DNA, 25 bp, Mus musculus
cgtggggctaaaagaacaggtccta

SEQ ID NO: 912856 - DNA, 25 bp, Mus musculus
cgtggggctaaatgaacaggtccta

SEQ ID NO: 912857 - DNA, 25 bp, Mus musculus
cgtgggtcacaacaagccgtctcag

SEQ ID NO: 912858 - DNA, 25 bp, Mus musculus
cgtgggtcacaacgtcaaagcaagt

SEQ ID NO: 912859 - DNA, 25 bp, Mus musculus
cgtgggtcacaagaagccgtctcag

SEQ ID NO: 912860 - DNA, 25 bp, Mus musculus
cgtgggtcacaaggtcaaagcaagt

SEQ ID NO: 912861 - DNA, 25 bp, Mus musculus
cgtgggtgatgactccccagtgttt

SEQ ID NO: 912862 - DNA, 25 bp, Mus musculus
cgtgggtgatgactgcccagtgttt

SEQ ID NO: 912863 - DNA, 25 bp, Mus musculus
cgtgggtgtgtgaaatgcacttagc

SEQ ID NO: 912864 - DNA, 25 bp, Mus musculus
cgtgggtgtgtgcactgtgcagcat

SEQ ID NO: 912865 - DNA, 25 bp, Mus musculus
cgtgggtgtgtggactgtgcagcat

SEQ ID NO: 912866 - DNA, 25 bp, Mus musculus
cgtgggtgtgtgtaatgcacttagc

SEQ ID NO: 912867 - DNA, 25 bp, Mus musculus
cgtggtcaagacccagagaacatgg

SEQ ID NO: 912868 - DNA, 25 bp, Mus musculus
cgtggtcaagattgactttgaagat

SEQ ID NO: 912869 - DNA, 25 bp, Mus musculus
cgtggtcaagtcccagagaacatgg

SEQ ID NO: 912870 - DNA, 25 bp, Mus musculus
cgtggtcaagtttgactttgaagat

SEQ ID NO: 912871 - DNA, 25 bp, Mus musculus
cgtggtcctccacatcatggagctt

SEQ ID NO: 912872 - DNA, 25 bp, Mus musculus
cgtggtcctccagatcatggagctt

SEQ ID NO: 912873 - DNA, 25 bp, Mus musculus
cgtggtgaagaacgttcattatgat

SEQ ID NO: 912874 - DNA, 25 bp, Mus musculus
cgtggtgaagaaggttcattatgat

SEQ ID NO: 912875 - DNA, 25 bp, Mus musculus
cgtggtgcgaaagaaaaagtcagca

SEQ ID NO: 912876 - DNA, 25 bp, Mus musculus
cgtggtgcgatagaaaaagtcagca

SEQ ID NO: 912877 - DNA, 25 bp, Mus musculus
cgtggtgctggacgtgtcctgtcca

SEQ ID NO: 912878 - DNA, 25 bp, Mus musculus
cgtggtgctggacttaaaggcagat

SEQ ID NO: 912879 - DNA, 25 bp, Mus musculus
cgtggtgctggaggtgtcctgtcca

SEQ ID NO: 912880 - DNA, 25 bp, Mus musculus
cgtggtgctggagttaaaggcagat

SEQ ID NO: 912881 - DNA, 25 bp, Mus musculus
cgtggtggctgccggccatgactgc

SEQ ID NO: 912882 - DNA, 25 bp, Mus musculus
cgtggtggctgcgggccatgactgc

SEQ ID NO: 912883 - DNA, 25 bp, Mus musculus
cgtggttcactgcaccgctgggatt

SEQ ID NO: 912884 - DNA, 25 bp, Mus musculus
cgtggttcactgcagcgctgggatt

SEQ ID NO: 912885 - DNA, 25 bp, Mus musculus
cgtggtttactgatctcttactgtg

SEQ ID NO: 912886 - DNA, 25 bp, Mus musculus
cgtggtttactgttctcttactgtg

SEQ ID NO: 912887 - DNA, 25 bp, Mus musculus
cgtggtttatatccattcacatcat

SEQ ID NO: 912888 - DNA, 25 bp, Mus musculus
cgtggtttatatccttgtgggcttt

SEQ ID NO: 912889 - DNA, 25 bp, Mus musculus
cgtggtttatatgcattcacatcat

SEQ ID NO: 912890 - DNA, 25 bp, Mus musculus
cgtggtttatatgcttgtgggcttt

SEQ ID NO: 912891 - DNA, 25 bp, Mus musculus
cgtgtaacagatgctccatcctcag

SEQ ID NO: 912892 - DNA, 25 bp, Mus musculus
cgtgtaacagcggctccttattgga

SEQ ID NO: 912893 - DNA, 25 bp, Mus musculus
cgtgtaacaggggctccttattgga

SEQ ID NO: 912894 - DNA, 25 bp, Mus musculus
cgtgtaacagttgctccatcctcag

SEQ ID NO: 912895 - DNA, 25 bp, Mus musculus
cgtgtataaatgagactgctattga

SEQ ID NO: 912896 - DNA, 25 bp, Mus musculus
cgtgtataaatgagtctgctattga

SEQ ID NO: 912897 - DNA, 25 bp, Mus musculus
cgtgtccaagacttggctactgatg

SEQ ID NO: 912898 - DNA, 25 bp, Mus musculus
cgtgtccaagtcttggctactgatg

SEQ ID NO: 912899 - DNA, 25 bp, Mus musculus
cgtgtccagactcgcggccctgttc

SEQ ID NO: 912900 - DNA, 25 bp, Mus musculus
cgtgtccagactcggggccctgttc

SEQ ID NO: 912901 - DNA, 25 bp, Mus musculus
cgtgtccagcggcttgcctgtggct

SEQ ID NO: 912902 - DNA, 25 bp, Mus musculus
cgtgtccagcgggttgcctgtggct

SEQ ID NO: 912903 - DNA, 25 bp, Mus musculus
cgtgtcccagacagcgcccatcagt

SEQ ID NO: 912904 - DNA, 25 bp, Mus musculus
cgtgtcccagacagggcccatcagt

SEQ ID NO: 912905 - DNA, 25 bp, Mus musculus
cgtgtccgtgagagaagaggaagta

SEQ ID NO: 912906 - DNA, 25 bp, Mus musculus
cgtgtccgtgagtgaagaggaagta

SEQ ID NO: 912907 - DNA, 25 bp, Mus musculus
cgtgtcctgaagattcccctcgtgt

SEQ ID NO: 912908 - DNA, 25 bp, Mus musculus
cgtgtcctgaagtttcccctcgtgt

SEQ ID NO: 912909 - DNA, 25 bp, Mus musculus
cgtgtcgaaggagacgaagagatga

SEQ ID NO: 912910 - DNA, 25 bp, Mus musculus
cgtgtcgaaggagaggaagagatga

SEQ ID NO: 912911 - DNA, 25 bp, Mus musculus
cgtgtcttggctcttctccatcgtg

SEQ ID NO: 912912 - DNA, 25 bp, Mus musculus
cgtgtcttgggtcttctccatcgtg

SEQ ID NO: 912913 - DNA, 25 bp, Mus musculus
cgtgtctttgacaacgatgggaatg

SEQ ID NO: 912914 - DNA, 25 bp, Mus musculus
cgtgtctttgacaaggatgggaatg

SEQ ID NO: 912915 - DNA, 25 bp, Mus musculus
cgtgtctttgcgcgcgtgctggtca

SEQ ID NO: 912916 - DNA, 25 bp, Mus musculus
cgtgtctttgcgcgtgcctggctga

SEQ ID NO: 912917 - DNA, 25 bp, Mus musculus
cgtgtctttgcgggcgtgctggtca

SEQ ID NO: 912918 - DNA, 25 bp, Mus musculus
cgtgtctttgcgggtgcctggctga

SEQ ID NO: 912919 - DNA, 25 bp, Mus musculus
cgtgtgcacgctgaaacctacagat

SEQ ID NO: 912920 - DNA, 25 bp, Mus musculus
cgtgtgcacggtgaaacctacagat

SEQ ID NO: 912921 - DNA, 25 bp, Mus musculus
cgtgtgcaggatgttcattctggac

SEQ ID NO: 912922 - DNA, 25 bp, Mus musculus
cgtgtgcaggttgttcattctggac

SEQ ID NO: 912923 - DNA, 25 bp, Mus musculus
cgtgtgctcgtgccacggaggtgcc

SEQ ID NO: 912924 - DNA, 25 bp, Mus musculus
cgtgtgctcgtggcacggaggtgcc

SEQ ID NO: 912925 - DNA, 25 bp, Mus musculus
cgtgtggagcagcttggatggacaa

SEQ ID NO: 912926 - DNA, 25 bp, Mus musculus
cgtgtggagcaggttggatggacaa

SEQ ID NO: 912927 - DNA, 25 bp, Mus musculus
cgtgtggatcaacccggaagaccaa

SEQ ID NO: 912928 - DNA, 25 bp, Mus musculus
cgtgtggatcaagccggaagaccaa

SEQ ID NO: 912929 - DNA, 25 bp, Mus musculus
cgtgtggcagagagctcaacaggca

SEQ ID NO: 912930 - DNA, 25 bp, Mus musculus
cgtgtggcagagtgctcaacaggca

SEQ ID NO: 912931 - DNA, 25 bp, Mus musculus
cgtgtgtgtgagaaccgtcgtcgcg

SEQ ID NO: 912932 - DNA, 25 bp, Mus musculus
cgtgtgtgtgagaccagaaccgtcg

SEQ ID NO: 912933 - DNA, 25 bp, Mus musculus
cgtgtgtgtgagtaccgtcgtcgcg

SEQ ID NO: 912934 - DNA, 25 bp, Mus musculus
cgtgtgtgtgagtccagaaccgtcg

SEQ ID NO: 912935 - DNA, 25 bp, Mus musculus
cgtgtgttgaggagcccaccgcaac

SEQ ID NO: 912936 - DNA, 25 bp, Mus musculus
cgtgtgttgaggtgcccaccgcaac

SEQ ID NO: 912937 - DNA, 25 bp, Mus musculus
cgtgttaaaccgatcttcggaggat

SEQ ID NO: 912938 - DNA, 25 bp, Mus musculus
cgtgttaaaccgttcttcggaggat

SEQ ID NO: 912939 - DNA, 25 bp, Mus musculus
cgtgttaatgagaacggagccttct

SEQ ID NO: 912940 - DNA, 25 bp, Mus musculus
cgtgttaatgagaagggagccttct

SEQ ID NO: 912941 - DNA, 25 bp, Mus musculus
cgtgttacaaagattatacgagaaa

SEQ ID NO: 912942 - DNA, 25 bp, Mus musculus
cgtgttacaaagtttatacgagaaa

SEQ ID NO: 912943 - DNA, 25 bp, Mus musculus
cgtgttagtcagagccacctgtata

SEQ ID NO: 912944 - DNA, 25 bp, Mus musculus
cgtgttagtcagtgccacctgtata

SEQ ID NO: 912945 - DNA, 25 bp, Mus musculus
cgtgttcaagctgtttgtggccaac

SEQ ID NO: 912946 - DNA, 25 bp, Mus musculus
cgtgttcaaggtgtttgtggccaac

SEQ ID NO: 912947 - DNA, 25 bp, Mus musculus
cgtgttccagcaccacctctgcagt

SEQ ID NO: 912948 - DNA, 25 bp, Mus musculus
cgtgttccaggaccacctctgcagt

SEQ ID NO: 912949 - DNA, 25 bp, Mus musculus
cgtgttctcccgcacgagggatctg

SEQ ID NO: 912950 - DNA, 25 bp, Mus musculus
cgtgttctcccggacgagggatctg

SEQ ID NO: 912951 - DNA, 25 bp, Mus musculus
cgtgttgaccgaaaccacagccatc

SEQ ID NO: 912952 - DNA, 25 bp, Mus musculus
cgtgttgaccgaaagcacagccatc

SEQ ID NO: 912953 - DNA, 25 bp, Mus musculus
cgtgtttcaaaacctctcttctccc

SEQ ID NO: 912954 - DNA, 25 bp, Mus musculus
cgtgtttcaaaacgcattgcgctcc

SEQ ID NO: 912955 - DNA, 25 bp, Mus musculus
cgtgtttcaaaagctctcttctccc

SEQ ID NO: 912956 - DNA, 25 bp, Mus musculus
cgtgtttcaaaaggcattgcgctcc

SEQ ID NO: 912957 - DNA, 25 bp, Mus musculus
cgttaatgagagcaatgctcacccc

SEQ ID NO: 912958 - DNA, 25 bp, Mus musculus
cgttaatgagtgcaatgctcacccc

SEQ ID NO: 912959 - DNA, 25 bp, Mus musculus
cgttacaaaaccaacaatgcccagc

SEQ ID NO: 912960 - DNA, 25 bp, Mus musculus
cgttacaaaaccaagaatgcccagc

SEQ ID NO: 912961 - DNA, 25 bp, Mus musculus
cgttacaaacagattgttctaacag

SEQ ID NO: 912962 - DNA, 25 bp, Mus musculus
cgttacaaacagtttgttctaacag

SEQ ID NO: 912963 - DNA, 25 bp, Mus musculus
cgttacaagataaacctcacttcaa

SEQ ID NO: 912964 - DNA, 25 bp, Mus musculus
cgttacaagataaagctcacttcaa

SEQ ID NO: 912965 - DNA, 25 bp, Mus musculus
cgttactgggcacgtgtctgtgctg

SEQ ID NO: 912966 - DNA, 25 bp, Mus musculus
cgttactgggcaggtgtctgtgctg

SEQ ID NO: 912967 - DNA, 25 bp, Mus musculus
cgttagactcagaggagctgtgatt

SEQ ID NO: 912968 - DNA, 25 bp, Mus musculus
cgttagactcagagtcataaggtca

SEQ ID NO: 912969 - DNA, 25 bp, Mus musculus
cgttagactcagtggagctgtgatt

SEQ ID NO: 912970 - DNA, 25 bp, Mus musculus
cgttagactcagtgtcataaggtca

SEQ ID NO: 912971 - DNA, 25 bp, Mus musculus
cgttagatgcagatgggagaagctg

SEQ ID NO: 912972 - DNA, 25 bp, Mus musculus
cgttagatgcagttgggagaagctg

SEQ ID NO: 912973 - DNA, 25 bp, Mus musculus
cgttatccaagccactgcccgccac

SEQ ID NO: 912974 - DNA, 25 bp, Mus musculus
cgttatccaagccagtgcccgccac

SEQ ID NO: 912975 - DNA, 25 bp, Mus musculus
cgttatgctcaacgaaggatatgag

SEQ ID NO: 912976 - DNA, 25 bp, Mus musculus
cgttatgctcaaggaaggatatgag

SEQ ID NO: 912977 - DNA, 25 bp, Mus musculus
cgttatgttgattcacaatgacatc

SEQ ID NO: 912978 - DNA, 25 bp, Mus musculus
cgttatgttgtttcacaatgacatc

SEQ ID NO: 912979 - DNA, 25 bp, Mus musculus
cgttcaagtgaaagaggtcaaccgg

SEQ ID NO: 912980 - DNA, 25 bp, Mus musculus
cgttcaagtgaaagtggtcaaccgg

SEQ ID NO: 912981 - DNA, 25 bp, Mus musculus
cgttcacaagactgagttcacttgc

SEQ ID NO: 912982 - DNA, 25 bp, Mus musculus
cgttcacaagatcatttccatgtgt

SEQ ID NO: 912983 - DNA, 25 bp, Mus musculus
cgttcacaagtctgagttcacttgc

SEQ ID NO: 912984 - DNA, 25 bp, Mus musculus
cgttcacaagttcatttccatgtgt

SEQ ID NO: 912985 - DNA, 25 bp, Mus musculus
cgttcactcgagacctatgaaaggc

SEQ ID NO: 912986 - DNA, 25 bp, Mus musculus
cgttcactcgtgacctatgaaaggc

SEQ ID NO: 912987 - DNA, 25 bp, Mus musculus
cgttcactttggaacagctcattgc

SEQ ID NO: 912988 - DNA, 25 bp, Mus musculus
cgttcactttggaagagctcattgc

SEQ ID NO: 912989 - DNA, 25 bp, Mus musculus
cgttcagagcagatcggagagaaaa

SEQ ID NO: 912990 - DNA, 25 bp, Mus musculus
cgttcagagcagttcggagagaaaa

SEQ ID NO: 912991 - DNA, 25 bp, Mus musculus
cgttccagtgggcatggagaagagc

SEQ ID NO: 912992 - DNA, 25 bp, Mus musculus
cgttccagtggggatggagaagagc

SEQ ID NO: 912993 - DNA, 25 bp, Mus musculus
cgttcgagctagccatggtggtgag

SEQ ID NO: 912994 - DNA, 25 bp, Mus musculus
cgttcgagctaggcatggtggtgag

SEQ ID NO: 912995 - DNA, 25 bp, Mus musculus
cgttcggtcccgaaccagctatgat

SEQ ID NO: 912996 - DNA, 25 bp, Mus musculus
cgttcggtcccgaacctatgatgac

SEQ ID NO: 912997 - DNA, 25 bp, Mus musculus
cgttcggtcccgaagcagctatgat

SEQ ID NO: 912998 - DNA, 25 bp, Mus musculus
cgttcggtcccgaagctatgatgac

SEQ ID NO: 912999 - DNA, 25 bp, Mus musculus
cgttcgttcaagcggcagaatcctt

SEQ ID NO: 913000 - DNA, 25 bp, Mus musculus
cgttcgttcaaggggcagaatcctt

SEQ ID NO: 913001 - DNA, 25 bp, Mus musculus
cgttctacctggaacgtggcttcag

SEQ ID NO: 913002 - DNA, 25 bp, Mus musculus
cgttctacctggaaggtggcttcag

SEQ ID NO: 913003 - DNA, 25 bp, Mus musculus
cgttctcagagacaaatttggggat

SEQ ID NO: 913004 - DNA, 25 bp, Mus musculus
cgttctcagagacatatttggggat

SEQ ID NO: 913005 - DNA, 25 bp, Mus musculus
cgttctctgtgacatcattgggcag

SEQ ID NO: 913006 - DNA, 25 bp, Mus musculus
cgttctctgtgagatcattgggcag

SEQ ID NO: 913007 - DNA, 25 bp, Mus musculus
cgttctctttcacccatcatcggga

SEQ ID NO: 913008 - DNA, 25 bp, Mus musculus
cgttctctttcaccgatcatcggga

SEQ ID NO: 913009 - DNA, 25 bp, Mus musculus
cgttctgaaccccacgtttgaggag

SEQ ID NO: 913010 - DNA, 25 bp, Mus musculus
cgttctgaaccccaggtttgaggag

SEQ ID NO: 913011 - DNA, 25 bp, Mus musculus
cgttctgaccagagccaaaagaatg

SEQ ID NO: 913012 - DNA, 25 bp, Mus musculus
cgttctgaccagtgccaaaagaatg

SEQ ID NO: 913013 - DNA, 25 bp, Mus musculus
cgttctgatgacgttacagaagcaa

SEQ ID NO: 913014 - DNA, 25 bp, Mus musculus
cgttctgatgtcgttacagaagcaa

SEQ ID NO: 913015 - DNA, 25 bp, Mus musculus
cgttctgcacttcacctgtatggac

SEQ ID NO: 913016 - DNA, 25 bp, Mus musculus
cgttctgcacttcagctgtatggac

SEQ ID NO: 913017 - DNA, 25 bp, Mus musculus
cgttcttcagagaggatgcccctgg

SEQ ID NO: 913018 - DNA, 25 bp, Mus musculus
cgttcttcagtgaggatgcccctgg

SEQ ID NO: 913019 - DNA, 25 bp, Mus musculus
cgttcttcataaaactctgaaggca

SEQ ID NO: 913020 - DNA, 25 bp, Mus musculus
cgttcttcataatactctgaaggca

SEQ ID NO: 913021 - DNA, 25 bp, Mus musculus
cgttcttccgcctggtgtcaccgga

SEQ ID NO: 913022 - DNA, 25 bp, Mus musculus
cgttcttccggctggtgtcaccgga

SEQ ID NO: 913023 - DNA, 25 bp, Mus musculus
cgttctttctctcacccaaagcctt

SEQ ID NO: 913024 - DNA, 25 bp, Mus musculus
cgttctttctctcagccaaagcctt

SEQ ID NO: 913025 - DNA, 25 bp, Mus musculus
cgttgacacagtggacccagatact

SEQ ID NO: 913026 - DNA, 25 bp, Mus musculus
cgttgacacagtggtcccagatact

SEQ ID NO: 913027 - DNA, 25 bp, Mus musculus
cgttgacctgaaaacgaaacctgca

SEQ ID NO: 913028 - DNA, 25 bp, Mus musculus
cgttgacctgaaaaggaaacctgca

SEQ ID NO: 913029 - DNA, 25 bp, Mus musculus
cgttgcaatgatacaatccctgagg

SEQ ID NO: 913030 - DNA, 25 bp, Mus musculus
cgttgcaatgttacaatccctgagg

SEQ ID NO: 913031 - DNA, 25 bp, Mus musculus
cgttgccaagctcatgcaggttttg

SEQ ID NO: 913032 - DNA, 25 bp, Mus musculus
cgttgccaaggtcatgcaggttttg

SEQ ID NO: 913033 - DNA, 25 bp, Mus musculus
cgttgcccagatcctgtgggccgaa

SEQ ID NO: 913034 - DNA, 25 bp, Mus musculus
cgttgcccagatgctgtgggccgaa

SEQ ID NO: 913035 - DNA, 25 bp, Mus musculus
cgttgcctttctctctttgacgggc

SEQ ID NO: 913036 - DNA, 25 bp, Mus musculus
cgttgcctttctctgtttgacgggc

SEQ ID NO: 913037 - DNA, 25 bp, Mus musculus
cgttgcgcagttcgtttacggcagc

SEQ ID NO: 913038 - DNA, 25 bp, Mus musculus
cgttgcgcagttggtttacggcagc

SEQ ID NO: 913039 - DNA, 25 bp, Mus musculus
cgttgctatcatccgtgagtgcatc

SEQ ID NO: 913040 - DNA, 25 bp, Mus musculus
cgttgctatcatgcgtgagtgcatc

SEQ ID NO: 913041 - DNA, 25 bp, Mus musculus
cgttgctatgctaactatgagagcc

SEQ ID NO: 913042 - DNA, 25 bp, Mus musculus
cgttgctatgctaagtatgagagcc

SEQ ID NO: 913043 - DNA, 25 bp, Mus musculus
cgttgctgggaggacagcgacatgt

SEQ ID NO: 913044 - DNA, 25 bp, Mus musculus
cgttgctgggaggagagcgacatgt

SEQ ID NO: 913045 - DNA, 25 bp, Mus musculus
cgttgcttatggatcactccttaac

SEQ ID NO: 913046 - DNA, 25 bp, Mus musculus
cgttgcttatggatgactccttaac

SEQ ID NO: 913047 - DNA, 25 bp, Mus musculus
cgttggagctcacgtgcccctggga

SEQ ID NO: 913048 - DNA, 25 bp, Mus musculus
cgttggagctcaggtgcccctggga

SEQ ID NO: 913049 - DNA, 25 bp, Mus musculus
cgttggcaatctggactatggtgca

SEQ ID NO: 913050 - DNA, 25 bp, Mus musculus
cgttggcaatgtggactatggtgca

SEQ ID NO: 913051 - DNA, 25 bp, Mus musculus
cgttgtagagagtgtaatgctgtgt

SEQ ID NO: 913052 - DNA, 25 bp, Mus musculus
cgttgtagagtgtgtaatgctgtgt

SEQ ID NO: 913053 - DNA, 25 bp, Mus musculus
cgttgtagcccacaaagtcctaggt

SEQ ID NO: 913054 - DNA, 25 bp, Mus musculus
cgttgtagcccagaaagtcctaggt

SEQ ID NO: 913055 - DNA, 25 bp, Mus musculus
cgttgtcagtctaatggggcccaga

SEQ ID NO: 913056 - DNA, 25 bp, Mus musculus
cgttgtcagtcttatggggcccaga

SEQ ID NO: 913057 - DNA, 25 bp, Mus musculus
cgttgtggaagacaaagaacgacag

SEQ ID NO: 913058 - DNA, 25 bp, Mus musculus
cgttgtggaagacatagaacgacag

SEQ ID NO: 913059 - DNA, 25 bp, Mus musculus
cgtttacagctcttcatgtctcgcc

SEQ ID NO: 913060 - DNA, 25 bp, Mus musculus
cgtttacagctcttgatgtctcgcc

SEQ ID NO: 913061 - DNA, 25 bp, Mus musculus
cgtttacatactcccacaagccgaa

SEQ ID NO: 913062 - DNA, 25 bp, Mus musculus
cgtttacatactgccacaagccgaa

SEQ ID NO: 913063 - DNA, 25 bp, Mus musculus
cgtttccaccctggaatgcaaagct

SEQ ID NO: 913064 - DNA, 25 bp, Mus musculus
cgtttccaccgtggaatgcaaagct

SEQ ID NO: 913065 - DNA, 25 bp, Mus musculus
cgtttccacgcaagatgctaccaag

SEQ ID NO: 913066 - DNA, 25 bp, Mus musculus
cgtttccacggaagatgctaccaag

SEQ ID NO: 913067 - DNA, 25 bp, Mus musculus
cgtttcccagatctgtctcgagagc

SEQ ID NO: 913068 - DNA, 25 bp, Mus musculus
cgtttcccagttctgtctcgagagc

SEQ ID NO: 913069 - DNA, 25 bp, Mus musculus
cgtttcccttgacgttctgatctta

SEQ ID NO: 913070 - DNA, 25 bp, Mus musculus
cgtttcccttgaggttctgatctta

SEQ ID NO: 913071 - DNA, 25 bp, Mus musculus
cgtttccttgtggacgtcttccaag

SEQ ID NO: 913072 - DNA, 25 bp, Mus musculus
cgtttccttgtggaggtcttccaag

SEQ ID NO: 913073 - DNA, 25 bp, Mus musculus
cgtttctccaagcaggatgaagcct

SEQ ID NO: 913074 - DNA, 25 bp, Mus musculus
cgtttctccaaggaggatgaagcct

SEQ ID NO: 913075 - DNA, 25 bp, Mus musculus
cgtttgcaagctgacacgcttggtg

SEQ ID NO: 913076 - DNA, 25 bp, Mus musculus
cgtttgcaaggtgacacgcttggtg

SEQ ID NO: 913077 - DNA, 25 bp, Mus musculus
cgtttgcgcatcctccagccacatt

SEQ ID NO: 913078 - DNA, 25 bp, Mus musculus
cgtttgcgcatcctgcagccacatt

SEQ ID NO: 913079 - DNA, 25 bp, Mus musculus
cgtttgtcagattttccactcacga

SEQ ID NO: 913080 - DNA, 25 bp, Mus musculus
cgtttgtcagtttttccactcacga

SEQ ID NO: 913081 - DNA, 25 bp, Mus musculus
cgtttgtcctcctgtgtttcaaatc

SEQ ID NO: 913082 - DNA, 25 bp, Mus musculus
cgtttgtcctgctgtgtttcaaatc

SEQ ID NO: 913083 - DNA, 25 bp, Mus musculus
cgtttgtgagttagatgcagcctac

SEQ ID NO: 913084 - DNA, 25 bp, Mus musculus
cgtttgtgagttagtctttggaggc

SEQ ID NO: 913085 - DNA, 25 bp, Mus musculus
cgtttgtgagtttgatgcagcctac

SEQ ID NO: 913086 - DNA, 25 bp, Mus musculus
cgtttgtgagtttgtctttggaggc

SEQ ID NO: 913087 - DNA, 25 bp, Mus musculus
cgttttggcaggcaattcacgcagc

SEQ ID NO: 913088 - DNA, 25 bp, Mus musculus
cgttttggcagggaattcacgcagc

SEQ ID NO: 913089 - DNA, 25 bp, Mus musculus
cgtttttcagaatgccggacacaga

SEQ ID NO: 913090 - DNA, 25 bp, Mus musculus
cgtttttcagtatgccggacacaga

SEQ ID NO: 913091 - DNA, 25 bp, Mus musculus
ctaaaaaaatcgatgataccatctt

SEQ ID NO: 913092 - DNA, 25 bp, Mus musculus
ctaaaaaaatcgttgataccatctt

SEQ ID NO: 913093 - DNA, 25 bp, Mus musculus
ctaaaaactcaacatgtggagtaca

SEQ ID NO: 913094 - DNA, 25 bp, Mus musculus
ctaaaaactcaagatgtggagtaca

SEQ ID NO: 913095 - DNA, 25 bp, Mus musculus
ctaaaaactggacgcctcagctgct

SEQ ID NO: 913096 - DNA, 25 bp, Mus musculus
ctaaaaactggaggcctcagctgct

SEQ ID NO: 913097 - DNA, 25 bp, Mus musculus
ctaaaaagccatagactaagatcgt

SEQ ID NO: 913098 - DNA, 25 bp, Mus musculus
ctaaaaagccattgactaagatcgt

SEQ ID NO: 913099 - DNA, 25 bp, Mus musculus
ctaaaagaagagatgcaaagcttac

SEQ ID NO: 913100 - DNA, 25 bp, Mus musculus
ctaaaagaagagttgcaaagcttac

SEQ ID NO: 913101 - DNA, 25 bp, Mus musculus
ctaaaagacaagccaggctacatgt

SEQ ID NO: 913102 - DNA, 25 bp, Mus musculus
ctaaaagacaaggcaggctacatgt

SEQ ID NO: 913103 - DNA, 25 bp, Mus musculus
ctaaacaacaagatctgtgatattg

SEQ ID NO: 913104 - DNA, 25 bp, Mus musculus
ctaaacaacaagttctgtgatattg

SEQ ID NO: 913105 - DNA, 25 bp, Mus musculus
ctaaacaagcccatcaagtgccccc

SEQ ID NO: 913106 - DNA, 25 bp, Mus musculus
ctaaacaagcccatgaagtgccccc

SEQ ID NO: 913107 - DNA, 25 bp, Mus musculus
ctaaacaatcagcccaggagttaaa

SEQ ID NO: 913108 - DNA, 25 bp, Mus musculus
ctaaacaatcaggccaggagttaaa

SEQ ID NO: 913109 - DNA, 25 bp, Mus musculus
ctaaacacagcgctgtgagtcagca

SEQ ID NO: 913110 - DNA, 25 bp, Mus musculus
ctaaacacagggctgtgagtcagca

SEQ ID NO: 913111 - DNA, 25 bp, Mus musculus
ctaaacacccagatgcaaaactttc

SEQ ID NO: 913112 - DNA, 25 bp, Mus musculus
ctaaacacccagttgcaaaactttc

SEQ ID NO: 913113 - DNA, 25 bp, Mus musculus
ctaaacatcatcaccaaactgaggc

SEQ ID NO: 913114 - DNA, 25 bp, Mus musculus
ctaaacatcatcacgaaactgaggc

SEQ ID NO: 913115 - DNA, 25 bp, Mus musculus
ctaaacccaagcgtctgtgcaagga

SEQ ID NO: 913116 - DNA, 25 bp, Mus musculus
ctaaacccaagcgtgtgtgcaagga

SEQ ID NO: 913117 - DNA, 25 bp, Mus musculus
ctaaagaaagagattgacctggtgt

SEQ ID NO: 913118 - DNA, 25 bp, Mus musculus
ctaaagaaagagtttgacctggtgt

SEQ ID NO: 913119 - DNA, 25 bp, Mus musculus
ctaaagaaagataagatcagcatcc

SEQ ID NO: 913120 - DNA, 25 bp, Mus musculus
ctaaagaaagatcagcatccgggtg

SEQ ID NO: 913121 - DNA, 25 bp, Mus musculus
ctaaagaaagttaagatcagcatcc

SEQ ID NO: 913122 - DNA, 25 bp, Mus musculus
ctaaagaaagttcagcatccgggtg

SEQ ID NO: 913123 - DNA, 25 bp, Mus musculus
ctaaagaatgagattgacctggtgt

SEQ ID NO: 913124 - DNA, 25 bp, Mus musculus
ctaaagaatgagtttgacctggtgt

SEQ ID NO: 913125 - DNA, 25 bp, Mus musculus
ctaaagaccgcaaagcactgccacc

SEQ ID NO: 913126 - DNA, 25 bp, Mus musculus
ctaaagaccggaaagcactgccacc

SEQ ID NO: 913127 - DNA, 25 bp, Mus musculus
ctaaagaggctgcgttcctcatggg

SEQ ID NO: 913128 - DNA, 25 bp, Mus musculus
ctaaagaggctgggttcctcatggg

SEQ ID NO: 913129 - DNA, 25 bp, Mus musculus
ctaaagataataagtttcacaagaa

SEQ ID NO: 913130 - DNA, 25 bp, Mus musculus
ctaaagataatatgtttcacaagaa

SEQ ID NO: 913131 - DNA, 25 bp, Mus musculus
ctaaagccaggaccagcaggtggat

SEQ ID NO: 913132 - DNA, 25 bp, Mus musculus
ctaaagccaggaccaggtggatgga

SEQ ID NO: 913133 - DNA, 25 bp, Mus musculus
ctaaagccaggagcagcaggtggat

SEQ ID NO: 913134 - DNA, 25 bp, Mus musculus
ctaaagccaggagcaggtggatgga

SEQ ID NO: 913135 - DNA, 25 bp, Mus musculus
ctaaagccttaagtccttgcttccc

SEQ ID NO: 913136 - DNA, 25 bp, Mus musculus
ctaaagccttaagtgcttgcttccc

SEQ ID NO: 913137 - DNA, 25 bp, Mus musculus
ctaaaggaataccacgaaaatagtg

SEQ ID NO: 913138 - DNA, 25 bp, Mus musculus
ctaaaggaataccacgaaatgataa

SEQ ID NO: 913139 - DNA, 25 bp, Mus musculus
ctaaaggaataccaggaaaatagtg

SEQ ID NO: 913140 - DNA, 25 bp, Mus musculus
ctaaaggaataccaggaaatgataa

SEQ ID NO: 913141 - DNA, 25 bp, Mus musculus
ctaaaggctgtccaacaggtgcgcc

SEQ ID NO: 913142 - DNA, 25 bp, Mus musculus
ctaaaggctgtccatcaggtgcgcc

SEQ ID NO: 913143 - DNA, 25 bp, Mus musculus
ctaaagggctctcattcatctatgg

SEQ ID NO: 913144 - DNA, 25 bp, Mus musculus
ctaaagggctctgattcatctatgg

SEQ ID NO: 913145 - DNA, 25 bp, Mus musculus
ctaaaggggaagaaaagacatgctc

SEQ ID NO: 913146 - DNA, 25 bp, Mus musculus
ctaaaggggaagtaaagacatgctc

SEQ ID NO: 913147 - DNA, 25 bp, Mus musculus
ctaaagtagacactcagggtgaccc

SEQ ID NO: 913148 - DNA, 25 bp, Mus musculus
ctaaagtagagactcagggtgaccc

SEQ ID NO: 913149 - DNA, 25 bp, Mus musculus
ctaaagtcatcaccgatgccagaga

SEQ ID NO: 913150 - DNA, 25 bp, Mus musculus
ctaaagtcatcagcgatgccagaga

SEQ ID NO: 913151 - DNA, 25 bp, Mus musculus
ctaaagtgaacacgccatggcgcag

SEQ ID NO: 913152 - DNA, 25 bp, Mus musculus
ctaaagtgaacacgtgccttcttca

SEQ ID NO: 913153 - DNA, 25 bp, Mus musculus
ctaaagtgaacaggccatggcgcag

SEQ ID NO: 913154 - DNA, 25 bp, Mus musculus
ctaaagtgaacaggtgccttcttca

SEQ ID NO: 913155 - DNA, 25 bp, Mus musculus
ctaaatattaagacatgttcgttct

SEQ ID NO: 913156 - DNA, 25 bp, Mus musculus
ctaaatattaagtcatgttcgttct

SEQ ID NO: 913157 - DNA, 25 bp, Mus musculus
ctaaatgataagaatggcacacgaa

SEQ ID NO: 913158 - DNA, 25 bp, Mus musculus
ctaaatgataagcaacatgacattg

SEQ ID NO: 913159 - DNA, 25 bp, Mus musculus
ctaaatgataaggaacatgacattg

SEQ ID NO: 913160 - DNA, 25 bp, Mus musculus
ctaaatgataagtatggcacacgaa

SEQ ID NO: 913161 - DNA, 25 bp, Mus musculus
ctaaatgatgcacagaacctctcat

SEQ ID NO: 913162 - DNA, 25 bp, Mus musculus
ctaaatgatgcagagaacctctcat

SEQ ID NO: 913163 - DNA, 25 bp, Mus musculus
ctaaatggcagccacactcagtcct

SEQ ID NO: 913164 - DNA, 25 bp, Mus musculus
ctaaatggcagccagactcagtcct

SEQ ID NO: 913165 - DNA, 25 bp, Mus musculus
ctaaatttttgacatgcgatgatga

SEQ ID NO: 913166 - DNA, 25 bp, Mus musculus
ctaaatttttgagatgcgatgatga

SEQ ID NO: 913167 - DNA, 25 bp, Mus musculus
ctaacagactgtgtcgtaatgagag

SEQ ID NO: 913168 - DNA, 25 bp, Mus musculus
ctaacagactgtgtggtaatgagag

SEQ ID NO: 913169 - DNA, 25 bp, Mus musculus
ctaacaggagcttggtggttcgatg

SEQ ID NO: 913170 - DNA, 25 bp, Mus musculus
ctaacaggaggttggtggttcgatg

SEQ ID NO: 913171 - DNA, 25 bp, Mus musculus
ctaacatcacagattgctgaaagac

SEQ ID NO: 913172 - DNA, 25 bp, Mus musculus
ctaacatcacagtttgctgaaagac

SEQ ID NO: 913173 - DNA, 25 bp, Mus musculus
ctaacatctaagctgccaagtgctg

SEQ ID NO: 913174 - DNA, 25 bp, Mus musculus
ctaacatctaaggtgccaagtgctg

SEQ ID NO: 913175 - DNA, 25 bp, Mus musculus
ctaaccagacagatggagaaagacg

SEQ ID NO: 913176 - DNA, 25 bp, Mus musculus
ctaaccagacagttggagaaagacg

SEQ ID NO: 913177 - DNA, 25 bp, Mus musculus
ctaaccagagccaccaggatcatct

SEQ ID NO: 913178 - DNA, 25 bp, Mus musculus
ctaaccagaggcaccaggatcatct

SEQ ID NO: 913179 - DNA, 25 bp, Mus musculus
ctaaccagctcgacttgagcagcgg

SEQ ID NO: 913180 - DNA, 25 bp, Mus musculus
ctaaccagctcgtcttgagcagcgg

SEQ ID NO: 913181 - DNA, 25 bp, Mus musculus
ctaacccaggccaacgaggagtcag

SEQ ID NO: 913182 - DNA, 25 bp, Mus musculus
ctaacccaggccaaggaggagtcag

SEQ ID NO: 913183 - DNA, 25 bp, Mus musculus
ctaacctcagagtcactgcaaagat

SEQ ID NO: 913184 - DNA, 25 bp, Mus musculus
ctaacctcagtgtcactgcaaagat

SEQ ID NO: 913185 - DNA, 25 bp, Mus musculus
ctaacgaagcagcgttgcaaaacct

SEQ ID NO: 913186 - DNA, 25 bp, Mus musculus
ctaacgaagcagggttgcaaaacct

SEQ ID NO: 913187 - DNA, 25 bp, Mus musculus
ctaacgcccacccacgttatgaaca

SEQ ID NO: 913188 - DNA, 25 bp, Mus musculus
ctaacgcccacccaggttatgaaca

SEQ ID NO: 913189 - DNA, 25 bp, Mus musculus
ctaagaaacatcgaaaaccctgcta

SEQ ID NO: 913190 - DNA, 25 bp, Mus musculus
ctaagaaacatcgataaccctgcta

SEQ ID NO: 913191 - DNA, 25 bp, Mus musculus
ctaagacattgctaccatttgaaga

SEQ ID NO: 913192 - DNA, 25 bp, Mus musculus
ctaagacattgctagcatttgaaga

SEQ ID NO: 913193 - DNA, 25 bp, Mus musculus
ctaagacgccagcacgtcctgctgg

SEQ ID NO: 913194 - DNA, 25 bp, Mus musculus
ctaagacgccagcaggtcctgctgg

SEQ ID NO: 913195 - DNA, 25 bp, Mus musculus
ctaagactaaatcggtgaccgaggt

SEQ ID NO: 913196 - DNA, 25 bp, Mus musculus
ctaagactaaatgggtgaccgaggt

SEQ ID NO: 913197 - DNA, 25 bp, Mus musculus
ctaagagagcagacccgtctgaaac

SEQ ID NO: 913198 - DNA, 25 bp, Mus musculus
ctaagagagcagtcccgtctgaaac

SEQ ID NO: 913199 - DNA, 25 bp, Mus musculus
ctaagagcccagagccatgtcggac

SEQ ID NO: 913200 - DNA, 25 bp, Mus musculus
ctaagagcccagcttgtctgttctt

SEQ ID NO: 913201 - DNA, 25 bp, Mus musculus
ctaagagcccaggttgtctgttctt

SEQ ID NO: 913202 - DNA, 25 bp, Mus musculus
ctaagagcccagtgccatgtcggac

SEQ ID NO: 913203 - DNA, 25 bp, Mus musculus
ctaagagtggatcacatcatcatgg

SEQ ID NO: 913204 - DNA, 25 bp, Mus musculus
ctaagagtggatcagatcatcatgg

SEQ ID NO: 913205 - DNA, 25 bp, Mus musculus
ctaagatactgacggaatttgtaaa

SEQ ID NO: 913206 - DNA, 25 bp, Mus musculus
ctaagatactgagggaatttgtaaa

SEQ ID NO: 913207 - DNA, 25 bp, Mus musculus
ctaagccagcagccctcagggctgg

SEQ ID NO: 913208 - DNA, 25 bp, Mus musculus
ctaagccagcagcgcctgggctggt

SEQ ID NO: 913209 - DNA, 25 bp, Mus musculus
ctaagccagcaggcctcagggctgg

SEQ ID NO: 913210 - DNA, 25 bp, Mus musculus
ctaagccagcagggcctgggctggt

SEQ ID NO: 913211 - DNA, 25 bp, Mus musculus
ctaagccagtggcagtgtgcagcca

SEQ ID NO: 913212 - DNA, 25 bp, Mus musculus
ctaagccagtgggagtgtgcagcca

SEQ ID NO: 913213 - DNA, 25 bp, Mus musculus
ctaagcttacagcagtgccaggagg

SEQ ID NO: 913214 - DNA, 25 bp, Mus musculus
ctaagcttacaggagtgccaggagg

SEQ ID NO: 913215 - DNA, 25 bp, Mus musculus
ctaagcttcctgctgcaaatagtct

SEQ ID NO: 913216 - DNA, 25 bp, Mus musculus
ctaagcttcctggtgcaaatagtct

SEQ ID NO: 913217 - DNA, 25 bp, Mus musculus
ctaaggagcaaagaccagagctgtc

SEQ ID NO: 913218 - DNA, 25 bp, Mus musculus
ctaaggagcaaagagcagagctgtc

SEQ ID NO: 913219 - DNA, 25 bp, Mus musculus
ctaaggagccagagccagtccttcc

SEQ ID NO: 913220 - DNA, 25 bp, Mus musculus
ctaaggagccagtgccagtccttcc

SEQ ID NO: 913221 - DNA, 25 bp, Mus musculus
ctaaggagtgaggactcaccactac

SEQ ID NO: 913222 - DNA, 25 bp, Mus musculus
ctaaggagtgaggagtcaccactac

SEQ ID NO: 913223 - DNA, 25 bp, Mus musculus
ctaaggatgtcaaacggacccaaga

SEQ ID NO: 913224 - DNA, 25 bp, Mus musculus
ctaaggatgtcaaagggacccaaga

SEQ ID NO: 913225 - DNA, 25 bp, Mus musculus
ctaaggattcagcctaaaaccgact

SEQ ID NO: 913226 - DNA, 25 bp, Mus musculus
ctaaggattcaggctaaaaccgact

SEQ ID NO: 913227 - DNA, 25 bp, Mus musculus
ctaaggcagggtgcccagatgatgg

SEQ ID NO: 913228 - DNA, 25 bp, Mus musculus
ctaaggcagggtgcgcagatgatgg

SEQ ID NO: 913229 - DNA, 25 bp, Mus musculus
ctaaggcgagggattttaggtgatg

SEQ ID NO: 913230 - DNA, 25 bp, Mus musculus
ctaaggcgagggtttttaggtgatg

SEQ ID NO: 913231 - DNA, 25 bp, Mus musculus
ctaagggaaacacgagaccatgaca

SEQ ID NO: 913232 - DNA, 25 bp, Mus musculus
ctaagggaaacaggagaccatgaca

SEQ ID NO: 913233 - DNA, 25 bp, Mus musculus
ctaagggacaagcctgtcccttcca

SEQ ID NO: 913234 - DNA, 25 bp, Mus musculus
ctaagggacaaggctgtcccttcca

SEQ ID NO: 913235 - DNA, 25 bp, Mus musculus
ctaagtcattgtgtcaacttgtata

SEQ ID NO: 913236 - DNA, 25 bp, Mus musculus
ctaagtcattgtgtgaacttgtata

SEQ ID NO: 913237 - DNA, 25 bp, Mus musculus
ctaagtgtcctcctcgccaatatgt

SEQ ID NO: 913238 - DNA, 25 bp, Mus musculus
ctaagtgtcctcctggccaatatgt

SEQ ID NO: 913239 - DNA, 25 bp, Mus musculus
ctaataagatgcacaccatgaatgg

SEQ ID NO: 913240 - DNA, 25 bp, Mus musculus
ctaataagatgcactccatgaatgg

SEQ ID NO: 913241 - DNA, 25 bp, Mus musculus
ctaatagaaaataacacaaatggaa

SEQ ID NO: 913242 - DNA, 25 bp, Mus musculus
ctaatagaaaattacacaaatggaa

SEQ ID NO: 913243 - DNA, 25 bp, Mus musculus
ctaatagttaagcgtcgtgcatctc

SEQ ID NO: 913244 - DNA, 25 bp, Mus musculus
ctaatagttaagggtcgtgcatctc

SEQ ID NO: 913245 - DNA, 25 bp, Mus musculus
ctaatatgagcaactgtactgagtg

SEQ ID NO: 913246 - DNA, 25 bp, Mus musculus
ctaatatgaggaactgtactgagtg

SEQ ID NO: 913247 - DNA, 25 bp, Mus musculus
ctaatcagcaagcagctagctgagc

SEQ ID NO: 913248 - DNA, 25 bp, Mus musculus
ctaatcagcaaggagctagctgagc

SEQ ID NO: 913249 - DNA, 25 bp, Mus musculus
ctaatcctaaatctccacagttgac

SEQ ID NO: 913250 - DNA, 25 bp, Mus musculus
ctaatcctaaatgtccacagttgac

SEQ ID NO: 913251 - DNA, 25 bp, Mus musculus
ctaatcctggagatagcagcccaag

SEQ ID NO: 913252 - DNA, 25 bp, Mus musculus
ctaatcctggagctcctagaagacc

SEQ ID NO: 913253 - DNA, 25 bp, Mus musculus
ctaatcctggaggtcctagaagacc

SEQ ID NO: 913254 - DNA, 25 bp, Mus musculus
ctaatcctggagttagcagcccaag

SEQ ID NO: 913255 - DNA, 25 bp, Mus musculus
ctaatcgtggcaaaaagtcagtccg

SEQ ID NO: 913256 - DNA, 25 bp, Mus musculus
ctaatcgtggcaaatagtcagtccg

SEQ ID NO: 913257 - DNA, 25 bp, Mus musculus
ctaatctgtccctgagcagtggctt

SEQ ID NO: 913258 - DNA, 25 bp, Mus musculus
ctaatctgtcgctgagcagtggctt

SEQ ID NO: 913259 - DNA, 25 bp, Mus musculus
ctaatgacaaaacgctgcagcaaga

SEQ ID NO: 913260 - DNA, 25 bp, Mus musculus
ctaatgacaaaaggctgcagcaaga

SEQ ID NO: 913261 - DNA, 25 bp, Mus musculus
ctaatgacagaaattatgccaccct

SEQ ID NO: 913262 - DNA, 25 bp, Mus musculus
ctaatgacagtaattatgccaccct

SEQ ID NO: 913263 - DNA, 25 bp, Mus musculus
ctaatgagagcaaagatgatgaaca

SEQ ID NO: 913264 - DNA, 25 bp, Mus musculus
ctaatgagagcatagatgatgaaca

SEQ ID NO: 913265 - DNA, 25 bp, Mus musculus
ctaatgatactgacggccagtgaag

SEQ ID NO: 913266 - DNA, 25 bp, Mus musculus
ctaatgatactgtcggccagtgaag

SEQ ID NO: 913267 - DNA, 25 bp, Mus musculus
ctaatgattacatccgaggctgcca

SEQ ID NO: 913268 - DNA, 25 bp, Mus musculus
ctaatgattacatcggaggctgcca

SEQ ID NO: 913269 - DNA, 25 bp, Mus musculus
ctaatgcccactcgaggaggtaaaa

SEQ ID NO: 913270 - DNA, 25 bp, Mus musculus
ctaatgcccactggaggaggtaaaa

SEQ ID NO: 913271 - DNA, 25 bp, Mus musculus
ctaatgctgacacctcctcatggac

SEQ ID NO: 913272 - DNA, 25 bp, Mus musculus
ctaatgctgacagctcctcatggac

SEQ ID NO: 913273 - DNA, 25 bp, Mus musculus
ctaatggaatggccattatatttag

SEQ ID NO: 913274 - DNA, 25 bp, Mus musculus
ctaatggaatggcccttgcatttag

SEQ ID NO: 913275 - DNA, 25 bp, Mus musculus
ctaatggaatgggcattatatttag

SEQ ID NO: 913276 - DNA, 25 bp, Mus musculus
ctaatggaatgggccttgcatttag

SEQ ID NO: 913277 - DNA, 25 bp, Mus musculus
ctaatggctcagctttcaacatttc

SEQ ID NO: 913278 - DNA, 25 bp, Mus musculus
ctaatggctcaggtttcaacatttc

SEQ ID NO: 913279 - DNA, 25 bp, Mus musculus
ctaatgtcagctccggccctgcccc

SEQ ID NO: 913280 - DNA, 25 bp, Mus musculus
ctaatgtcaggtccggccctgcccc

SEQ ID NO: 913281 - DNA, 25 bp, Mus musculus
ctaatgtccgctttgttgctcattg

SEQ ID NO: 913282 - DNA, 25 bp, Mus musculus
ctaatgtccggtttgttgctcattg

SEQ ID NO: 913283 - DNA, 25 bp, Mus musculus
ctaatgtgagatccaacgagggttt

SEQ ID NO: 913284 - DNA, 25 bp, Mus musculus
ctaatgtgagttccaacgagggttt

SEQ ID NO: 913285 - DNA, 25 bp, Mus musculus
ctaatgttacagcacatggagaagg

SEQ ID NO: 913286 - DNA, 25 bp, Mus musculus
ctaatgttacaggacatggagaagg

SEQ ID NO: 913287 - DNA, 25 bp, Mus musculus
ctaattaaagagcctcattgggaag

SEQ ID NO: 913288 - DNA, 25 bp, Mus musculus
ctaattaaagaggctcattgggaag

SEQ ID NO: 913289 - DNA, 25 bp, Mus musculus
ctaattaaagtgaacacgctgactg

SEQ ID NO: 913290 - DNA, 25 bp, Mus musculus
ctaattaaagtgaactccaccacag

SEQ ID NO: 913291 - DNA, 25 bp, Mus musculus
ctaattaaagtgaagacgctgactg

SEQ ID NO: 913292 - DNA, 25 bp, Mus musculus
ctaattaaagtgaagtccaccacag

SEQ ID NO: 913293 - DNA, 25 bp, Mus musculus
ctaattcccaagcattcacacctcc

SEQ ID NO: 913294 - DNA, 25 bp, Mus musculus
ctaattcccaaggattcacacctcc

SEQ ID NO: 913295 - DNA, 25 bp, Mus musculus
ctaattcttggtcgtctctaggtat

SEQ ID NO: 913296 - DNA, 25 bp, Mus musculus
ctaattcttggtggtctctaggtat

SEQ ID NO: 913297 - DNA, 25 bp, Mus musculus
ctaattgaatatcattgcatggtta

SEQ ID NO: 913298 - DNA, 25 bp, Mus musculus
ctaattgaatttcattgcatggtta

SEQ ID NO: 913299 - DNA, 25 bp, Mus musculus
ctaattgatcataaagctgaccttg

SEQ ID NO: 913300 - DNA, 25 bp, Mus musculus
ctaattgatcattaagctgaccttg

SEQ ID NO: 913301 - DNA, 25 bp, Mus musculus
ctaattgatgagatggttggtaaag

SEQ ID NO: 913302 - DNA, 25 bp, Mus musculus
ctaattgatgagttggttggtaaag

SEQ ID NO: 913303 - DNA, 25 bp, Mus musculus
ctaattgtgggactctgcagtgatg

SEQ ID NO: 913304 - DNA, 25 bp, Mus musculus
ctaattgtgggagtctgcagtgatg

SEQ ID NO: 913305 - DNA, 25 bp, Mus musculus
ctaatttatgccggaaccctctgca

SEQ ID NO: 913306 - DNA, 25 bp, Mus musculus
ctaatttatggcggaaccctctgca

SEQ ID NO: 913307 - DNA, 25 bp, Mus musculus
ctaatttctattgtagtcaactttg

SEQ ID NO: 913308 - DNA, 25 bp, Mus musculus
ctaatttctattgttgtcaactttg

SEQ ID NO: 913309 - DNA, 25 bp, Mus musculus
ctaattttggcacattaactaaact

SEQ ID NO: 913310 - DNA, 25 bp, Mus musculus
ctaattttggcagattaactaaact

SEQ ID NO: 913311 - DNA, 25 bp, Mus musculus
ctacaaacagagcgcagagaatact

SEQ ID NO: 913312 - DNA, 25 bp, Mus musculus
ctacaaacagagggcagagaatact

SEQ ID NO: 913313 - DNA, 25 bp, Mus musculus
ctacaaagagccctttgccagtgag

SEQ ID NO: 913314 - DNA, 25 bp, Mus musculus
ctacaaagagctggcagaactggct

SEQ ID NO: 913315 - DNA, 25 bp, Mus musculus
ctacaaagaggcctttgccagtgag

SEQ ID NO: 913316 - DNA, 25 bp, Mus musculus
ctacaaagaggtggcagaactggct

SEQ ID NO: 913317 - DNA, 25 bp, Mus musculus
ctacaaagtgaactgctcaggagct

SEQ ID NO: 913318 - DNA, 25 bp, Mus musculus
ctacaaagtgaagtgctcaggagct

SEQ ID NO: 913319 - DNA, 25 bp, Mus musculus
ctacaacaagaacgtagaggcagtc

SEQ ID NO: 913320 - DNA, 25 bp, Mus musculus
ctacaacaagaaggtagaggcagtc

SEQ ID NO: 913321 - DNA, 25 bp, Mus musculus
ctacaacaccaagacaggtattgtg

SEQ ID NO: 913322 - DNA, 25 bp, Mus musculus
ctacaacaccaagaccttactggcg

SEQ ID NO: 913323 - DNA, 25 bp, Mus musculus
ctacaacaccaagagaggtattgtg

SEQ ID NO: 913324 - DNA, 25 bp, Mus musculus
ctacaacaccaagagcttactggcg

SEQ ID NO: 913325 - DNA, 25 bp, Mus musculus
ctacaacagcgtatatggggcccag

SEQ ID NO: 913326 - DNA, 25 bp, Mus musculus
ctacaacagcgtttatggggcccag

SEQ ID NO: 913327 - DNA, 25 bp, Mus musculus
ctacaacagtctgacggaggctgta

SEQ ID NO: 913328 - DNA, 25 bp, Mus musculus
ctacaacagtctgagggaggctgta

SEQ ID NO: 913329 - DNA, 25 bp, Mus musculus
ctacaaccagcgcgtgaatgggaaa

SEQ ID NO: 913330 - DNA, 25 bp, Mus musculus
ctacaaccagcgggtgaatgggaaa

SEQ ID NO: 913331 - DNA, 25 bp, Mus musculus
ctacaacccacccacgaacaattgt

SEQ ID NO: 913332 - DNA, 25 bp, Mus musculus
ctacaacccacccaggaacaattgt

SEQ ID NO: 913333 - DNA, 25 bp, Mus musculus
ctacaactaccgccatgggcagccc

SEQ ID NO: 913334 - DNA, 25 bp, Mus musculus
ctacaactaccgccttgggcagccc

SEQ ID NO: 913335 - DNA, 25 bp, Mus musculus
ctacaactataactcggatgtttgg

SEQ ID NO: 913336 - DNA, 25 bp, Mus musculus
ctacaactataagtcggatgtttgg

SEQ ID NO: 913337 - DNA, 25 bp, Mus musculus
ctacaacttcagatatgccaagtac

SEQ ID NO: 913338 - DNA, 25 bp, Mus musculus
ctacaacttcagttatgccaagtac

SEQ ID NO: 913339 - DNA, 25 bp, Mus musculus
ctacaagagcgaaatgaaattgtaa

SEQ ID NO: 913340 - DNA, 25 bp, Mus musculus
ctacaagagcgatatgaaattgtaa

SEQ ID NO: 913341 - DNA, 25 bp, Mus musculus
ctacaagatccactcactgggcctg

SEQ ID NO: 913342 - DNA, 25 bp, Mus musculus
ctacaagatccagtcactgggcctg

SEQ ID NO: 913343 - DNA, 25 bp, Mus musculus
ctacaagcaacacccaagagttaca

SEQ ID NO: 913344 - DNA, 25 bp, Mus musculus
ctacaagcaagacccaagagttaca

SEQ ID NO: 913345 - DNA, 25 bp, Mus musculus
ctacaagcacaactcctaatagtac

SEQ ID NO: 913346 - DNA, 25 bp, Mus musculus
ctacaagcacaagtcctaatagtac

SEQ ID NO: 913347 - DNA, 25 bp, Mus musculus
ctacaaggacccccagagttgatgg

SEQ ID NO: 913348 - DNA, 25 bp, Mus musculus
ctacaaggacccgcagagttgatgg

SEQ ID NO: 913349 - DNA, 25 bp, Mus musculus
ctacaagtctacatctctcccagga

SEQ ID NO: 913350 - DNA, 25 bp, Mus musculus
ctacaagtctacttctctcccagga

SEQ ID NO: 913351 - DNA, 25 bp, Mus musculus
ctacaagttctacacgcctgagaat

SEQ ID NO: 913352 - DNA, 25 bp, Mus musculus
ctacaagttctacacgctgccacag

SEQ ID NO: 913353 - DNA, 25 bp, Mus musculus
ctacaagttctacaggcctgagaat

SEQ ID NO: 913354 - DNA, 25 bp, Mus musculus
ctacaagttctacaggctgccacag

SEQ ID NO: 913355 - DNA, 25 bp, Mus musculus
ctacaatctgaatgaagaaagacac

SEQ ID NO: 913356 - DNA, 25 bp, Mus musculus
ctacaatctgtatgaagaaagacac

SEQ ID NO: 913357 - DNA, 25 bp, Mus musculus
ctacaatgagaacatctatgagctg

SEQ ID NO: 913358 - DNA, 25 bp, Mus musculus
ctacaatgagaagatctatgagctg

SEQ ID NO: 913359 - DNA, 25 bp, Mus musculus
ctacacaatggaccatatccgtgtg

SEQ ID NO: 913360 - DNA, 25 bp, Mus musculus
ctacacaatggagcatatccgtgtg

SEQ ID NO: 913361 - DNA, 25 bp, Mus musculus
ctacacaatttgcgagtgagctact

SEQ ID NO: 913362 - DNA, 25 bp, Mus musculus
ctacacaatttgggagtgagctact

SEQ ID NO: 913363 - DNA, 25 bp, Mus musculus
ctacacagagcctcggtgggggctc

SEQ ID NO: 913364 - DNA, 25 bp, Mus musculus
ctacacagaggccgtgaaggaatat

SEQ ID NO: 913365 - DNA, 25 bp, Mus musculus
ctacacagaggcggtgaaggaatat

SEQ ID NO: 913366 - DNA, 25 bp, Mus musculus
ctacacagaggctcggtgggggctc

SEQ ID NO: 913367 - DNA, 25 bp, Mus musculus
ctacacagccagcagtcctgtctca

SEQ ID NO: 913368 - DNA, 25 bp, Mus musculus
ctacacagccagctccggtctgatg

SEQ ID NO: 913369 - DNA, 25 bp, Mus musculus
ctacacagccaggagtcctgtctca

SEQ ID NO: 913370 - DNA, 25 bp, Mus musculus
ctacacagccaggtccggtctgatg

SEQ ID NO: 913371 - DNA, 25 bp, Mus musculus
ctacaccatccacaaactcatcgag

SEQ ID NO: 913372 - DNA, 25 bp, Mus musculus
ctacaccatccagaaactcatcgag

SEQ ID NO: 913373 - DNA, 25 bp, Mus musculus
ctacaccatccccccgcaggctggc

SEQ ID NO: 913374 - DNA, 25 bp, Mus musculus
ctacaccatcccgccgcaggctggc

SEQ ID NO: 913375 - DNA, 25 bp, Mus musculus
ctacacctgccgctcagggatcccc

SEQ ID NO: 913376 - DNA, 25 bp, Mus musculus
ctacacctgccgctccaaccgtgac

SEQ ID NO: 913377 - DNA, 25 bp, Mus musculus
ctacacctgccggtcagggatcccc

SEQ ID NO: 913378 - DNA, 25 bp, Mus musculus
ctacacctgccggtccaaccgtgac

SEQ ID NO: 913379 - DNA, 25 bp, Mus musculus
ctacactaggccccagtttgatcta

SEQ ID NO: 913380 - DNA, 25 bp, Mus musculus
ctacactagggcccagtttgatcta

SEQ ID NO: 913381 - DNA, 25 bp, Mus musculus
ctacactctactctgggaagtgcca

SEQ ID NO: 913382 - DNA, 25 bp, Mus musculus
ctacactctactgtgggaagtgcca

SEQ ID NO: 913383 - DNA, 25 bp, Mus musculus
ctacagaagaccattgactacatcc

SEQ ID NO: 913384 - DNA, 25 bp, Mus musculus
ctacagaagagcattgactacatcc

SEQ ID NO: 913385 - DNA, 25 bp, Mus musculus
ctacagacaaattttgacactttac

SEQ ID NO: 913386 - DNA, 25 bp, Mus musculus
ctacagacaatttttgacactttac

SEQ ID NO: 913387 - DNA, 25 bp, Mus musculus
ctacagaccaaacatggatgcatct

SEQ ID NO: 913388 - DNA, 25 bp, Mus musculus
ctacagaccaaagatggatgcatct

SEQ ID NO: 913389 - DNA, 25 bp, Mus musculus
ctacagagagcacattctgcccttt

SEQ ID NO: 913390 - DNA, 25 bp, Mus musculus
ctacagagagcagattctgcccttt

SEQ ID NO: 913391 - DNA, 25 bp, Mus musculus
ctacagagagcaggcttctcagaca

SEQ ID NO: 913392 - DNA, 25 bp, Mus musculus
ctacagagaggaggcttctcagaca

SEQ ID NO: 913393 - DNA, 25 bp, Mus musculus
ctacagagctaactatgtgagacta

SEQ ID NO: 913394 - DNA, 25 bp, Mus musculus
ctacagagctaagtatgtgagacta

SEQ ID NO: 913395 - DNA, 25 bp, Mus musculus
ctacagagtgcagacgccaagaact

SEQ ID NO: 913396 - DNA, 25 bp, Mus musculus
ctacagagtgcagaggccaagaact

SEQ ID NO: 913397 - DNA, 25 bp, Mus musculus
ctacagagtgctgcccaggtccgca

SEQ ID NO: 913398 - DNA, 25 bp, Mus musculus
ctacagagtggtgcccaggtccgca

SEQ ID NO: 913399 - DNA, 25 bp, Mus musculus
ctacagatagctatgtaggattttg

SEQ ID NO: 913400 - DNA, 25 bp, Mus musculus
ctacagataggtatgtaggattttg

SEQ ID NO: 913401 - DNA, 25 bp, Mus musculus
ctacagattgctaaaagtactatta

SEQ ID NO: 913402 - DNA, 25 bp, Mus musculus
ctacagattgctaaagaccagagta

SEQ ID NO: 913403 - DNA, 25 bp, Mus musculus
ctacagattgctaatagtactatta

SEQ ID NO: 913404 - DNA, 25 bp, Mus musculus
ctacagattgctaatgaccagagta

SEQ ID NO: 913405 - DNA, 25 bp, Mus musculus
ctacagcaaaccaggactagacaag

SEQ ID NO: 913406 - DNA, 25 bp, Mus musculus
ctacagcaaacctggactagacaag

SEQ ID NO: 913407 - DNA, 25 bp, Mus musculus
ctacagcaagccatcgtcaagtccc

SEQ ID NO: 913408 - DNA, 25 bp, Mus musculus
ctacagcaaggcatcgtcaagtccc

SEQ ID NO: 913409 - DNA, 25 bp, Mus musculus
ctacagcatgcaagccaaaggagga

SEQ ID NO: 913410 - DNA, 25 bp, Mus musculus
ctacagcatggaagccaaaggagga

SEQ ID NO: 913411 - DNA, 25 bp, Mus musculus
ctacagcctagaacaggcagcagaa

SEQ ID NO: 913412 - DNA, 25 bp, Mus musculus
ctacagcctagaactggcagcagaa

SEQ ID NO: 913413 - DNA, 25 bp, Mus musculus
ctacagcgctgtcatgatgaccagc

SEQ ID NO: 913414 - DNA, 25 bp, Mus musculus
ctacagcgctgtgatgatgaccagc

SEQ ID NO: 913415 - DNA, 25 bp, Mus musculus
ctacagcgtcagcaaccgtgtcggg

SEQ ID NO: 913416 - DNA, 25 bp, Mus musculus
ctacagcgtcaggaaccgtgtcggg

SEQ ID NO: 913417 - DNA, 25 bp, Mus musculus
ctacagctaacccacaaatgacatc

SEQ ID NO: 913418 - DNA, 25 bp, Mus musculus
ctacagctaacccagaaatgacatc

SEQ ID NO: 913419 - DNA, 25 bp, Mus musculus
ctacaggaagagggaggtctgaaaa

SEQ ID NO: 913420 - DNA, 25 bp, Mus musculus
ctacaggaagtgctgcgctacaaca

SEQ ID NO: 913421 - DNA, 25 bp, Mus musculus
ctacaggaagtgggaggtctgaaaa

SEQ ID NO: 913422 - DNA, 25 bp, Mus musculus
ctacaggaagtggtgcgctacaaca

SEQ ID NO: 913423 - DNA, 25 bp, Mus musculus
ctacaggacaaactttccatcctca

SEQ ID NO: 913424 - DNA, 25 bp, Mus musculus
ctacaggacaaagtttccatcctca

SEQ ID NO: 913425 - DNA, 25 bp, Mus musculus
ctacaggacaagaatgccctggact

SEQ ID NO: 913426 - DNA, 25 bp, Mus musculus
ctacaggacaagctaagcattgagg

SEQ ID NO: 913427 - DNA, 25 bp, Mus musculus
ctacaggacaaggtaagcattgagg

SEQ ID NO: 913428 - DNA, 25 bp, Mus musculus
ctacaggacaagtatgccctggact

SEQ ID NO: 913429 - DNA, 25 bp, Mus musculus
ctacaggtgatccagtcagcaatgg

SEQ ID NO: 913430 - DNA, 25 bp, Mus musculus
ctacaggtgatcgagtcagcaatgg

SEQ ID NO: 913431 - DNA, 25 bp, Mus musculus
ctacagtattcaagagaacctgcag

SEQ ID NO: 913432 - DNA, 25 bp, Mus musculus
ctacagtattcacaggaaatataag

SEQ ID NO: 913433 - DNA, 25 bp, Mus musculus
ctacagtattcacttacggtctttg

SEQ ID NO: 913434 - DNA, 25 bp, Mus musculus
ctacagtattcagaggaaatataag

SEQ ID NO: 913435 - DNA, 25 bp, Mus musculus
ctacagtattcagttacggtctttg

SEQ ID NO: 913436 - DNA, 25 bp, Mus musculus
ctacagtattcatgagaacctgcag

SEQ ID NO: 913437 - DNA, 25 bp, Mus musculus
ctacagtcagctccagtgtcacagc

SEQ ID NO: 913438 - DNA, 25 bp, Mus musculus
ctacagtcaggtccagtgtcacagc

SEQ ID NO: 913439 - DNA, 25 bp, Mus musculus
ctacagtcccagcacagtgatggtt

SEQ ID NO: 913440 - DNA, 25 bp, Mus musculus
ctacagtcccagcacgacatggatt

SEQ ID NO: 913441 - DNA, 25 bp, Mus musculus
ctacagtcccagcagagtgatggtt

SEQ ID NO: 913442 - DNA, 25 bp, Mus musculus
ctacagtcccagcaggacatggatt

SEQ ID NO: 913443 - DNA, 25 bp, Mus musculus
ctacagtcctcacgcaaacaggtat

SEQ ID NO: 913444 - DNA, 25 bp, Mus musculus
ctacagtcctcaggcaaacaggtat

SEQ ID NO: 913445 - DNA, 25 bp, Mus musculus
ctacagtctacaaaactgctgctac

SEQ ID NO: 913446 - DNA, 25 bp, Mus musculus
ctacagtctagaaaactgctgctac

SEQ ID NO: 913447 - DNA, 25 bp, Mus musculus
ctacagtctgaatgaagaaagacac

SEQ ID NO: 913448 - DNA, 25 bp, Mus musculus
ctacagtctgtatgaagaaagacac

SEQ ID NO: 913449 - DNA, 25 bp, Mus musculus
ctacagtgacaacattgacagttat

SEQ ID NO: 913450 - DNA, 25 bp, Mus musculus
ctacagtgacaagattgacagttat

SEQ ID NO: 913451 - DNA, 25 bp, Mus musculus
ctacagtgagaccacgtgacaaagt

SEQ ID NO: 913452 - DNA, 25 bp, Mus musculus
ctacagtgagaccaggtgacaaagt

SEQ ID NO: 913453 - DNA, 25 bp, Mus musculus
ctacagtgatcacgttcagcgtcct

SEQ ID NO: 913454 - DNA, 25 bp, Mus musculus
ctacagtgatcaggttcagcgtcct

SEQ ID NO: 913455 - DNA, 25 bp, Mus musculus
ctacagtgcgcgcgatgaggctgta

SEQ ID NO: 913456 - DNA, 25 bp, Mus musculus
ctacagtgcgcgggatgaggctgta

SEQ ID NO: 913457 - DNA, 25 bp, Mus musculus
ctacagttgcagccatcccacaaag

SEQ ID NO: 913458 - DNA, 25 bp, Mus musculus
ctacagttgcaggcatcccacaaag

SEQ ID NO: 913459 - DNA, 25 bp, Mus musculus
ctacatagctcgcttttttctcaca

SEQ ID NO: 913460 - DNA, 25 bp, Mus musculus
ctacatagctggcttttttctcaca

SEQ ID NO: 913461 - DNA, 25 bp, Mus musculus
ctacatcctgctgtttgtggtagcc

SEQ ID NO: 913462 - DNA, 25 bp, Mus musculus
ctacatcctggtgtttgtggtagcc

SEQ ID NO: 913463 - DNA, 25 bp, Mus musculus
ctacatcgtggtcgacagtgaactt

SEQ ID NO: 913464 - DNA, 25 bp, Mus musculus
ctacatcgtggtctatgttgtatgg

SEQ ID NO: 913465 - DNA, 25 bp, Mus musculus
ctacatcgtggtggacagtgaactt

SEQ ID NO: 913466 - DNA, 25 bp, Mus musculus
ctacatcgtggtgtatgttgtatgg

SEQ ID NO: 913467 - DNA, 25 bp, Mus musculus
ctacatctttcattaatctttcctg

SEQ ID NO: 913468 - DNA, 25 bp, Mus musculus
ctacatctttcatttatctttcctg

SEQ ID NO: 913469 - DNA, 25 bp, Mus musculus
ctacatgaaaagcttgtggcagaga

SEQ ID NO: 913470 - DNA, 25 bp, Mus musculus
ctacatgaaaaggttgtggcagaga

SEQ ID NO: 913471 - DNA, 25 bp, Mus musculus
ctacatgaagaattacaatgactat

SEQ ID NO: 913472 - DNA, 25 bp, Mus musculus
ctacatgaagagcctgtgaggaaac

SEQ ID NO: 913473 - DNA, 25 bp, Mus musculus
ctacatgaagaggctgtgaggaaac

SEQ ID NO: 913474 - DNA, 25 bp, Mus musculus
ctacatgaagtattacaatgactat

SEQ ID NO: 913475 - DNA, 25 bp, Mus musculus
ctacatgatccacaaaaagagccgt

SEQ ID NO: 913476 - DNA, 25 bp, Mus musculus
ctacatgatccagaaaaagagccgt

SEQ ID NO: 913477 - DNA, 25 bp, Mus musculus
ctacatgcaatacttagctgccact

SEQ ID NO: 913478 - DNA, 25 bp, Mus musculus
ctacatgcaatagttagctgccact

SEQ ID NO: 913479 - DNA, 25 bp, Mus musculus
ctacatggagccccactctcggacc

SEQ ID NO: 913480 - DNA, 25 bp, Mus musculus
ctacatggaggcccactctcggacc

SEQ ID NO: 913481 - DNA, 25 bp, Mus musculus
ctacatggcctgcacgctgttgtgg

SEQ ID NO: 913482 - DNA, 25 bp, Mus musculus
ctacatggcctgcaggctgttgtgg

SEQ ID NO: 913483 - DNA, 25 bp, Mus musculus
ctacatggcctgccccccttcttca

SEQ ID NO: 913484 - DNA, 25 bp, Mus musculus
ctacatggcctggcccccttcttca

SEQ ID NO: 913485 - DNA, 25 bp, Mus musculus
ctacatgtgtaacgaggtgatccaa

SEQ ID NO: 913486 - DNA, 25 bp, Mus musculus
ctacatgtgtaaggaggtgatccaa

SEQ ID NO: 913487 - DNA, 25 bp, Mus musculus
ctacattaacgtcgttcattatgat

SEQ ID NO: 913488 - DNA, 25 bp, Mus musculus
ctacattaacgtggttcattatgat

SEQ ID NO: 913489 - DNA, 25 bp, Mus musculus
ctacattatcagaggctgcctcttt

SEQ ID NO: 913490 - DNA, 25 bp, Mus musculus
ctacattatcagtggctgcctcttt

SEQ ID NO: 913491 - DNA, 25 bp, Mus musculus
ctacattcttcacgtcgttatcaac

SEQ ID NO: 913492 - DNA, 25 bp, Mus musculus
ctacattcttcaggtcgttatcaac

SEQ ID NO: 913493 - DNA, 25 bp, Mus musculus
ctacattgagatggagaactgtacc

SEQ ID NO: 913494 - DNA, 25 bp, Mus musculus
ctacattgagttggagaactgtacc

SEQ ID NO: 913495 - DNA, 25 bp, Mus musculus
ctacatttcaaacgttagcgatgca

SEQ ID NO: 913496 - DNA, 25 bp, Mus musculus
ctacatttcaaaggttagcgatgca

SEQ ID NO: 913497 - DNA, 25 bp, Mus musculus
ctaccaaaatcgctaaggagagctg

SEQ ID NO: 913498 - DNA, 25 bp, Mus musculus
ctaccaaaatcggtaaggagagctg

SEQ ID NO: 913499 - DNA, 25 bp, Mus musculus
ctaccaaaatctcacaactcaagtg

SEQ ID NO: 913500 - DNA, 25 bp, Mus musculus
ctaccaaaatctcacgctggcctgt

SEQ ID NO: 913501 - DNA, 25 bp, Mus musculus
ctaccaaaatctcagaactcaagtg

SEQ ID NO: 913502 - DNA, 25 bp, Mus musculus
ctaccaaaatctcaggctggcctgt

SEQ ID NO: 913503 - DNA, 25 bp, Mus musculus
ctaccaaacgaatcagcttatgacc

SEQ ID NO: 913504 - DNA, 25 bp, Mus musculus
ctaccaaacgaatctgcttatgacc

SEQ ID NO: 913505 - DNA, 25 bp, Mus musculus
ctaccaaagtctagtgatttgaact

SEQ ID NO: 913506 - DNA, 25 bp, Mus musculus
ctaccaaagtcttgtgatttgaact

SEQ ID NO: 913507 - DNA, 25 bp, Mus musculus
ctaccaacacatattcagtgtagca

SEQ ID NO: 913508 - DNA, 25 bp, Mus musculus
ctaccaacacattttcagtgtagca

SEQ ID NO: 913509 - DNA, 25 bp, Mus musculus
ctaccaagagaacccgcatggagag

SEQ ID NO: 913510 - DNA, 25 bp, Mus musculus
ctaccaagagaaccggcatggagag

SEQ ID NO: 913511 - DNA, 25 bp, Mus musculus
ctaccacaaccacctgctgaaccga

SEQ ID NO: 913512 - DNA, 25 bp, Mus musculus
ctaccacaaccagctgctgaaccga

SEQ ID NO: 913513 - DNA, 25 bp, Mus musculus
ctaccaccagaacatagtgaaatgt

SEQ ID NO: 913514 - DNA, 25 bp, Mus musculus
ctaccaccagcactttcggctcgtc

SEQ ID NO: 913515 - DNA, 25 bp, Mus musculus
ctaccaccagcagtttcggctcgtc

SEQ ID NO: 913516 - DNA, 25 bp, Mus musculus
ctaccaccagtacatagtgaaatgt

SEQ ID NO: 913517 - DNA, 25 bp, Mus musculus
ctaccacggctgcaaactccagtca

SEQ ID NO: 913518 - DNA, 25 bp, Mus musculus
ctaccacggctggaaactccagtca

SEQ ID NO: 913519 - DNA, 25 bp, Mus musculus
ctaccagaagaatgaagagtcactg

SEQ ID NO: 913520 - DNA, 25 bp, Mus musculus
ctaccagaagtatgaagagtcactg

SEQ ID NO: 913521 - DNA, 25 bp, Mus musculus
ctaccagagcaaccctttctatggc

SEQ ID NO: 913522 - DNA, 25 bp, Mus musculus
ctaccagagcaaccgtttctatggc

SEQ ID NO: 913523 - DNA, 25 bp, Mus musculus
ctaccagatgctaccgggctcctga

SEQ ID NO: 913524 - DNA, 25 bp, Mus musculus
ctaccagatggtaccgggctcctga

SEQ ID NO: 913525 - DNA, 25 bp, Mus musculus
ctaccagcagccttccccaccagat

SEQ ID NO: 913526 - DNA, 25 bp, Mus musculus
ctaccagcaggcttccccaccagat

SEQ ID NO: 913527 - DNA, 25 bp, Mus musculus
ctaccagccaatccagtctcccact

SEQ ID NO: 913528 - DNA, 25 bp, Mus musculus
ctaccagccacacgagctcttaggg

SEQ ID NO: 913529 - DNA, 25 bp, Mus musculus
ctaccagccacaggagctcttaggg

SEQ ID NO: 913530 - DNA, 25 bp, Mus musculus
ctaccagccattccagtctcccact

SEQ ID NO: 913531 - DNA, 25 bp, Mus musculus
ctaccagcctgtcgaatagtcactg

SEQ ID NO: 913532 - DNA, 25 bp, Mus musculus
ctaccagcctgtcggtccgaagcag

SEQ ID NO: 913533 - DNA, 25 bp, Mus musculus
ctaccagcctgtggaatagtcactg

SEQ ID NO: 913534 - DNA, 25 bp, Mus musculus
ctaccagcctgtgggtccgaagcag

SEQ ID NO: 913535 - DNA, 25 bp, Mus musculus
ctaccagctcagcaaagagtacaca

SEQ ID NO: 913536 - DNA, 25 bp, Mus musculus
ctaccagctcagcatagagtacaca

SEQ ID NO: 913537 - DNA, 25 bp, Mus musculus
ctaccagctgaacacttgattgcaa

SEQ ID NO: 913538 - DNA, 25 bp, Mus musculus
ctaccagctgaagacttgattgcaa

SEQ ID NO: 913539 - DNA, 25 bp, Mus musculus
ctaccagctgagtcatttcctacag

SEQ ID NO: 913540 - DNA, 25 bp, Mus musculus
ctaccagctgccctataggttgcaa

SEQ ID NO: 913541 - DNA, 25 bp, Mus musculus
ctaccagctgcgtaacgacattgcc

SEQ ID NO: 913542 - DNA, 25 bp, Mus musculus
ctaccagctggcctataggttgcaa

SEQ ID NO: 913543 - DNA, 25 bp, Mus musculus
ctaccagctgggtaacgacattgcc

SEQ ID NO: 913544 - DNA, 25 bp, Mus musculus
ctaccagctgtgtcatttcctacag

SEQ ID NO: 913545 - DNA, 25 bp, Mus musculus
ctaccaggagagcaggccttgggag

SEQ ID NO: 913546 - DNA, 25 bp, Mus musculus
ctaccaggagtgcaggccttgggag

SEQ ID NO: 913547 - DNA, 25 bp, Mus musculus
ctaccaggcatgagcggccataaag

SEQ ID NO: 913548 - DNA, 25 bp, Mus musculus
ctaccaggcatgaggggccataaag

SEQ ID NO: 913549 - DNA, 25 bp, Mus musculus
ctaccatctgaacagtctactcgga

SEQ ID NO: 913550 - DNA, 25 bp, Mus musculus
ctaccatctgaagagtctactcgga

SEQ ID NO: 913551 - DNA, 25 bp, Mus musculus
ctaccatgtcaacatttctgacttt

SEQ ID NO: 913552 - DNA, 25 bp, Mus musculus
ctaccatgtcaagatttctgacttt

SEQ ID NO: 913553 - DNA, 25 bp, Mus musculus
ctaccatgtgaacttccgctcgctg

SEQ ID NO: 913554 - DNA, 25 bp, Mus musculus
ctaccatgtgaagttccgctcgctg

SEQ ID NO: 913555 - DNA, 25 bp, Mus musculus
ctacccacctatctgctcccaagat

SEQ ID NO: 913556 - DNA, 25 bp, Mus musculus
ctacccacctatgtgctcccaagat

SEQ ID NO: 913557 - DNA, 25 bp, Mus musculus
ctacccagacaagaacgattatttc

SEQ ID NO: 913558 - DNA, 25 bp, Mus musculus
ctacccagacaagatcgattatttc

SEQ ID NO: 913559 - DNA, 25 bp, Mus musculus
ctacccatggctcacactccgtggt

SEQ ID NO: 913560 - DNA, 25 bp, Mus musculus
ctacccatggctcagactccgtggt

SEQ ID NO: 913561 - DNA, 25 bp, Mus musculus
ctaccccgggagccaccaggatcat

SEQ ID NO: 913562 - DNA, 25 bp, Mus musculus
ctaccccgggaggcaccaggatcat

SEQ ID NO: 913563 - DNA, 25 bp, Mus musculus
ctacccctaggcaacactggacgag

SEQ ID NO: 913564 - DNA, 25 bp, Mus musculus
ctacccctaggcaagactggacgag

SEQ ID NO: 913565 - DNA, 25 bp, Mus musculus
ctacccctcaagaaaagctactggc

SEQ ID NO: 913566 - DNA, 25 bp, Mus musculus
ctacccctcaagccttcctgcctga

SEQ ID NO: 913567 - DNA, 25 bp, Mus musculus
ctacccctcatgaaaagctactggc

SEQ ID NO: 913568 - DNA, 25 bp, Mus musculus
ctacccctcatgccttcctgcctga

SEQ ID NO: 913569 - DNA, 25 bp, Mus musculus
ctaccctcaaccagcaagcctgcct

SEQ ID NO: 913570 - DNA, 25 bp, Mus musculus
ctaccctcaagcagcaagcctgcct

SEQ ID NO: 913571 - DNA, 25 bp, Mus musculus
ctaccctcctatctgctcccaagat

SEQ ID NO: 913572 - DNA, 25 bp, Mus musculus
ctaccctcctatgtgctcccaagat

SEQ ID NO: 913573 - DNA, 25 bp, Mus musculus
ctaccgaagcagagttttgccgaat

SEQ ID NO: 913574 - DNA, 25 bp, Mus musculus
ctaccgaagcagtgttttgccgaat

SEQ ID NO: 913575 - DNA, 25 bp, Mus musculus
ctaccgatcgcgatatcgtggcctt

SEQ ID NO: 913576 - DNA, 25 bp, Mus musculus
ctaccgatcgggatatcgtggcctt

SEQ ID NO: 913577 - DNA, 25 bp, Mus musculus
ctaccgcaagcaccagtctctggtc

SEQ ID NO: 913578 - DNA, 25 bp, Mus musculus
ctaccgcaagcagcagtctctggtc

SEQ ID NO: 913579 - DNA, 25 bp, Mus musculus
ctaccggagttgcatcggtcatggg

SEQ ID NO: 913580 - DNA, 25 bp, Mus musculus
ctaccggagttggatcggtcatggg

SEQ ID NO: 913581 - DNA, 25 bp, Mus musculus
ctaccggctgtggaatttactgtgc

SEQ ID NO: 913582 - DNA, 25 bp, Mus musculus
ctaccggctgtggattttactgtgc

SEQ ID NO: 913583 - DNA, 25 bp, Mus musculus
ctaccgggaagaccaatgttttggt

SEQ ID NO: 913584 - DNA, 25 bp, Mus musculus
ctaccgggaagagcaatgttttggt

SEQ ID NO: 913585 - DNA, 25 bp, Mus musculus
ctaccgggctaccttttatgcagct

SEQ ID NO: 913586 - DNA, 25 bp, Mus musculus
ctaccgggctacgttttatgcagct

SEQ ID NO: 913587 - DNA, 25 bp, Mus musculus
ctacctacaagacaactctgaaggc

SEQ ID NO: 913588 - DNA, 25 bp, Mus musculus
ctacctacaagacgagagtcaaaca

SEQ ID NO: 913589 - DNA, 25 bp, Mus musculus
ctacctacaagagaactctgaaggc

SEQ ID NO: 913590 - DNA, 25 bp, Mus musculus
ctacctacaagaggagagtcaaaca

SEQ ID NO: 913591 - DNA, 25 bp, Mus musculus
ctacctagagaagacggaatggttc

SEQ ID NO: 913592 - DNA, 25 bp, Mus musculus
ctacctagagaagagggaatggttc

SEQ ID NO: 913593 - DNA, 25 bp, Mus musculus
ctacctagcgagtgcacccccacca

SEQ ID NO: 913594 - DNA, 25 bp, Mus musculus
ctacctagcgtgtgcacccccacca

SEQ ID NO: 913595 - DNA, 25 bp, Mus musculus
ctacctcaaccaccataacttgaat

SEQ ID NO: 913596 - DNA, 25 bp, Mus musculus
ctacctcaaccagcataacttgaat

SEQ ID NO: 913597 - DNA, 25 bp, Mus musculus
ctacctcaggaatgaatcagaattc

SEQ ID NO: 913598 - DNA, 25 bp, Mus musculus
ctacctcaggggctgggggatgtgc

SEQ ID NO: 913599 - DNA, 25 bp, Mus musculus
ctacctcagggggtgggggatgtgc

SEQ ID NO: 913600 - DNA, 25 bp, Mus musculus
ctacctcaggtatgaatcagaattc

SEQ ID NO: 913601 - DNA, 25 bp, Mus musculus
ctacctcagtctcacggatgattga

SEQ ID NO: 913602 - DNA, 25 bp, Mus musculus
ctacctcagtgtcacggatgattga

SEQ ID NO: 913603 - DNA, 25 bp, Mus musculus
ctacctccgactctgtgtgatacta

SEQ ID NO: 913604 - DNA, 25 bp, Mus musculus
ctacctccgagtctgtgtgatacta

SEQ ID NO: 913605 - DNA, 25 bp, Mus musculus
ctacctcctttcccttcaagcacaa

SEQ ID NO: 913606 - DNA, 25 bp, Mus musculus
ctacctcctttcgcttcaagcacaa

SEQ ID NO: 913607 - DNA, 25 bp, Mus musculus
ctacctcgcgtactgagaggccatc

SEQ ID NO: 913608 - DNA, 25 bp, Mus musculus
ctacctcgcgtagtgagaggccatc

SEQ ID NO: 913609 - DNA, 25 bp, Mus musculus
ctacctctgaaacgtggttccatgg

SEQ ID NO: 913610 - DNA, 25 bp, Mus musculus
ctacctctgaaaggtggttccatgg

SEQ ID NO: 913611 - DNA, 25 bp, Mus musculus
ctacctgaacagcgacccagaaggg

SEQ ID NO: 913612 - DNA, 25 bp, Mus musculus
ctacctgaacagggacccagaaggg

SEQ ID NO: 913613 - DNA, 25 bp, Mus musculus
ctacctgaagagcaccaagctgtgg

SEQ ID NO: 913614 - DNA, 25 bp, Mus musculus
ctacctgaagcatctgaaaacatca

SEQ ID NO: 913615 - DNA, 25 bp, Mus musculus
ctacctgaaggatctgaaaacatca

SEQ ID NO: 913616 - DNA, 25 bp, Mus musculus
ctacctgaagtgcaccaagctgtgg

SEQ ID NO: 913617 - DNA, 25 bp, Mus musculus
ctacctgcacagcgtggccagagcg

SEQ ID NO: 913618 - DNA, 25 bp, Mus musculus
ctacctgcacagggtggccagagcg

SEQ ID NO: 913619 - DNA, 25 bp, Mus musculus
ctacctgcaccacagacggaaaacc

SEQ ID NO: 913620 - DNA, 25 bp, Mus musculus
ctacctgcaccacgattctaatccc

SEQ ID NO: 913621 - DNA, 25 bp, Mus musculus
ctacctgcaccagagacggaaaacc

SEQ ID NO: 913622 - DNA, 25 bp, Mus musculus
ctacctgcaccaggattctaatccc

SEQ ID NO: 913623 - DNA, 25 bp, Mus musculus
ctacctgcagcagaccccatgtttc

SEQ ID NO: 913624 - DNA, 25 bp, Mus musculus
ctacctgcagcatcgaatcctggac

SEQ ID NO: 913625 - DNA, 25 bp, Mus musculus
ctacctgcagccagcctgatctctc

SEQ ID NO: 913626 - DNA, 25 bp, Mus musculus
ctacctgcaggagaccccatgtttc

SEQ ID NO: 913627 - DNA, 25 bp, Mus musculus
ctacctgcaggatcgaatcctggac

SEQ ID NO: 913628 - DNA, 25 bp, Mus musculus
ctacctgcaggcagcctgatctctc

SEQ ID NO: 913629 - DNA, 25 bp, Mus musculus
ctacctgccgcaaatctcccagctg

SEQ ID NO: 913630 - DNA, 25 bp, Mus musculus
ctacctgccggaaatctcccagctg

SEQ ID NO: 913631 - DNA, 25 bp, Mus musculus
ctacctgcggatcgttcaggataag

SEQ ID NO: 913632 - DNA, 25 bp, Mus musculus
ctacctgcggatgcaggttcaggat

SEQ ID NO: 913633 - DNA, 25 bp, Mus musculus
ctacctgcggatgctggttcaggat

SEQ ID NO: 913634 - DNA, 25 bp, Mus musculus
ctacctgcggatggttcaggataag

SEQ ID NO: 913635 - DNA, 25 bp, Mus musculus
ctacctggatccccagtactatggc

SEQ ID NO: 913636 - DNA, 25 bp, Mus musculus
ctacctggatgcccagtactatggc

SEQ ID NO: 913637 - DNA, 25 bp, Mus musculus
ctacctggcggacacgctgggccgt

SEQ ID NO: 913638 - DNA, 25 bp, Mus musculus
ctacctggcggacaggctgggccgt

SEQ ID NO: 913639 - DNA, 25 bp, Mus musculus
ctacctggttttcttcaacaacatg

SEQ ID NO: 913640 - DNA, 25 bp, Mus musculus
ctacctggttttgttcaacaacatg

SEQ ID NO: 913641 - DNA, 25 bp, Mus musculus
ctacctgtcagccgtttgtggagaa

SEQ ID NO: 913642 - DNA, 25 bp, Mus musculus
ctacctgtcagcggtttgtggagaa

SEQ ID NO: 913643 - DNA, 25 bp, Mus musculus
ctacctgtgaaaagatcatctgttc

SEQ ID NO: 913644 - DNA, 25 bp, Mus musculus
ctacctgtgaaatgatcatctgttc

SEQ ID NO: 913645 - DNA, 25 bp, Mus musculus
ctacctgtggagacggtgctacgga

SEQ ID NO: 913646 - DNA, 25 bp, Mus musculus
ctacctgtggagtcggtgctacgga

SEQ ID NO: 913647 - DNA, 25 bp, Mus musculus
ctaccttggggagacggatgagttc

SEQ ID NO: 913648 - DNA, 25 bp, Mus musculus
ctaccttggggagagggatgagttc

SEQ ID NO: 913649 - DNA, 25 bp, Mus musculus
ctacgaagagcagactgccttctgc

SEQ ID NO: 913650 - DNA, 25 bp, Mus musculus
ctacgaagagcagagtgccttctgc

SEQ ID NO: 913651 - DNA, 25 bp, Mus musculus
ctacgaagaggcaccgaacacagtg

SEQ ID NO: 913652 - DNA, 25 bp, Mus musculus
ctacgaagaggcacggaacacagtg

SEQ ID NO: 913653 - DNA, 25 bp, Mus musculus
ctacgacctccctacgattctcaaa

SEQ ID NO: 913654 - DNA, 25 bp, Mus musculus
ctacgacctccctacgtgaggatta

SEQ ID NO: 913655 - DNA, 25 bp, Mus musculus
ctacgacctccctaggattctcaaa

SEQ ID NO: 913656 - DNA, 25 bp, Mus musculus
ctacgacctccctaggtgaggatta

SEQ ID NO: 913657 - DNA, 25 bp, Mus musculus
ctacgacgaacaagtggctgcacag

SEQ ID NO: 913658 - DNA, 25 bp, Mus musculus
ctacgacgaacatgtggctgcacag

SEQ ID NO: 913659 - DNA, 25 bp, Mus musculus
ctacgagccggagaccatggcggac

SEQ ID NO: 913660 - DNA, 25 bp, Mus musculus
ctacgagccggagagcatggcggac

SEQ ID NO: 913661 - DNA, 25 bp, Mus musculus
ctacgagctgccgtcggttgaaaaa

SEQ ID NO: 913662 - DNA, 25 bp, Mus musculus
ctacgagctgccgtgggttgaaaaa

SEQ ID NO: 913663 - DNA, 25 bp, Mus musculus
ctacgagtaccgccatgtcatgtta

SEQ ID NO: 913664 - DNA, 25 bp, Mus musculus
ctacgagtaccggcatgtcatgtta

SEQ ID NO: 913665 - DNA, 25 bp, Mus musculus
ctacgatgctatcgcactgggaaat

SEQ ID NO: 913666 - DNA, 25 bp, Mus musculus
ctacgatgctatggcactgggaaat

SEQ ID NO: 913667 - DNA, 25 bp, Mus musculus
ctacgcaataagagtttctaattat

SEQ ID NO: 913668 - DNA, 25 bp, Mus musculus
ctacgcaataagtgtttctaattat

SEQ ID NO: 913669 - DNA, 25 bp, Mus musculus
ctacgcacagaacggatacctggag

SEQ ID NO: 913670 - DNA, 25 bp, Mus musculus
ctacgcacagaagggatacctggag

SEQ ID NO: 913671 - DNA, 25 bp, Mus musculus
ctacgcacagagtatgataggctgg

SEQ ID NO: 913672 - DNA, 25 bp, Mus musculus
ctacgcacagtgtatgataggctgg

SEQ ID NO: 913673 - DNA, 25 bp, Mus musculus
ctacgcaccaaacgtgtgactttga

SEQ ID NO: 913674 - DNA, 25 bp, Mus musculus
ctacgcaccaaaggtgtgactttga

SEQ ID NO: 913675 - DNA, 25 bp, Mus musculus
ctacgccgagcgctgtgaggctctt

SEQ ID NO: 913676 - DNA, 25 bp, Mus musculus
ctacgccgagggctgtgaggctctt

SEQ ID NO: 913677 - DNA, 25 bp, Mus musculus
ctacgcggagaacctcatcgattat

SEQ ID NO: 913678 - DNA, 25 bp, Mus musculus
ctacgcggagaagctcatcgattat

SEQ ID NO: 913679 - DNA, 25 bp, Mus musculus
ctacgctgctggaaaagctgaagtg

SEQ ID NO: 913680 - DNA, 25 bp, Mus musculus
ctacgctgctggaatagctgaagtg

SEQ ID NO: 913681 - DNA, 25 bp, Mus musculus
ctacgctgtgcacttaactggacta

SEQ ID NO: 913682 - DNA, 25 bp, Mus musculus
ctacgctgtgcagttaactggacta

SEQ ID NO: 913683 - DNA, 25 bp, Mus musculus
ctacggaaagaatgatgaagtggaa

SEQ ID NO: 913684 - DNA, 25 bp, Mus musculus
ctacggaaagatcagaaacatcgag

SEQ ID NO: 913685 - DNA, 25 bp, Mus musculus
ctacggaaagctgactcagaactgc

SEQ ID NO: 913686 - DNA, 25 bp, Mus musculus
ctacggaaaggtgactcagaactgc

SEQ ID NO: 913687 - DNA, 25 bp, Mus musculus
ctacggaaagtatgatgaagtggaa

SEQ ID NO: 913688 - DNA, 25 bp, Mus musculus
ctacggaaagttcagaaacatcgag

SEQ ID NO: 913689 - DNA, 25 bp, Mus musculus
ctacggaacaagaccttaacagaag

SEQ ID NO: 913690 - DNA, 25 bp, Mus musculus
ctacggaacaagacgttaacagaag

SEQ ID NO: 913691 - DNA, 25 bp, Mus musculus
ctacggagacagattctatgaattt

SEQ ID NO: 913692 - DNA, 25 bp, Mus musculus
ctacggagacagtttctatgaattt

SEQ ID NO: 913693 - DNA, 25 bp, Mus musculus
ctacggagccagcgcatgaagctac

SEQ ID NO: 913694 - DNA, 25 bp, Mus musculus
ctacggagccagcggatgaagctac

SEQ ID NO: 913695 - DNA, 25 bp, Mus musculus
ctacggcaacagagagatcctgcca

SEQ ID NO: 913696 - DNA, 25 bp, Mus musculus
ctacggcaactgagagatcctgcca

SEQ ID NO: 913697 - DNA, 25 bp, Mus musculus
ctacggccaagacacggttccggag

SEQ ID NO: 913698 - DNA, 25 bp, Mus musculus
ctacggccaagagacggttccggag

SEQ ID NO: 913699 - DNA, 25 bp, Mus musculus
ctacggccgcactcggaacccactt

SEQ ID NO: 913700 - DNA, 25 bp, Mus musculus
ctacggccgctctcggaacccactt

SEQ ID NO: 913701 - DNA, 25 bp, Mus musculus
ctacggcgatttcgtcgctttgaca

SEQ ID NO: 913702 - DNA, 25 bp, Mus musculus
ctacggcgatttggtcgctttgaca

SEQ ID NO: 913703 - DNA, 25 bp, Mus musculus
ctacggcttcctgaccatggcagat

SEQ ID NO: 913704 - DNA, 25 bp, Mus musculus
ctacggcttcgtgaccatggcagat

SEQ ID NO: 913705 - DNA, 25 bp, Mus musculus
ctacgggaaggacacgacagcaagg

SEQ ID NO: 913706 - DNA, 25 bp, Mus musculus
ctacgggaaggacacgttcaactgg

SEQ ID NO: 913707 - DNA, 25 bp, Mus musculus
ctacgggaaggacaggacagcaagg

SEQ ID NO: 913708 - DNA, 25 bp, Mus musculus
ctacgggaaggacaggttcaactgg

SEQ ID NO: 913709 - DNA, 25 bp, Mus musculus
ctacgggcagcctggaacgagctgc

SEQ ID NO: 913710 - DNA, 25 bp, Mus musculus
ctacgggcaggctggaacgagctgc

SEQ ID NO: 913711 - DNA, 25 bp, Mus musculus
ctacggtcagcaaaccgcatcatca

SEQ ID NO: 913712 - DNA, 25 bp, Mus musculus
ctacggtcaggaaaccgcatcatca

SEQ ID NO: 913713 - DNA, 25 bp, Mus musculus
ctacggtcctttcccggatgcagct

SEQ ID NO: 913714 - DNA, 25 bp, Mus musculus
ctacggtcctttccgggatgcagct

SEQ ID NO: 913715 - DNA, 25 bp, Mus musculus
ctacgtcacgctgagagtgagcaag

SEQ ID NO: 913716 - DNA, 25 bp, Mus musculus
ctacgtcacggtgagagtgagcaag

SEQ ID NO: 913717 - DNA, 25 bp, Mus musculus
ctacgtcactccatggaacagccat

SEQ ID NO: 913718 - DNA, 25 bp, Mus musculus
ctacgtcactccttggaacagccat

SEQ ID NO: 913719 - DNA, 25 bp, Mus musculus
ctacgtcatccgcattgaccaggat

SEQ ID NO: 913720 - DNA, 25 bp, Mus musculus
ctacgtcatccggattgaccaggat

SEQ ID NO: 913721 - DNA, 25 bp, Mus musculus
ctacgtcctgcacagcgacgttttt

SEQ ID NO: 913722 - DNA, 25 bp, Mus musculus
ctacgtcctgcagagcgacgttttt

SEQ ID NO: 913723 - DNA, 25 bp, Mus musculus
ctacgtgaagcaatggagacattcc

SEQ ID NO: 913724 - DNA, 25 bp, Mus musculus
ctacgtgaaggaactggtggttcag

SEQ ID NO: 913725 - DNA, 25 bp, Mus musculus
ctacgtgaaggaatggagacattcc

SEQ ID NO: 913726 - DNA, 25 bp, Mus musculus
ctacgtgaaggatctggtggttcag

SEQ ID NO: 913727 - DNA, 25 bp, Mus musculus
ctacgtggatgatgagttcctgcgg

SEQ ID NO: 913728 - DNA, 25 bp, Mus musculus
ctacgtggatgatgtgttcctgcgg

SEQ ID NO: 913729 - DNA, 25 bp, Mus musculus
ctacgttggcaaagtggactatggt

SEQ ID NO: 913730 - DNA, 25 bp, Mus musculus
ctacgttggcaatgtggactatggt

SEQ ID NO: 913731 - DNA, 25 bp, Mus musculus
ctactaatggaatgcgcattatatt

SEQ ID NO: 913732 - DNA, 25 bp, Mus musculus
ctactaatggaatgcgccttgcatt

SEQ ID NO: 913733 - DNA, 25 bp, Mus musculus
ctactaatggaatgggcattatatt

SEQ ID NO: 913734 - DNA, 25 bp, Mus musculus
ctactaatggaatgggccttgcatt

SEQ ID NO: 913735 - DNA, 25 bp, Mus musculus
ctactacacgaccaaggacaaaatg

SEQ ID NO: 913736 - DNA, 25 bp, Mus musculus
ctactacacgtccaaggacaaaatg

SEQ ID NO: 913737 - DNA, 25 bp, Mus musculus
ctactacactagcgcccagtttgat

SEQ ID NO: 913738 - DNA, 25 bp, Mus musculus
ctactacactagggcccagtttgat

SEQ ID NO: 913739 - DNA, 25 bp, Mus musculus
ctactagagacacctgtaaaaccac

SEQ ID NO: 913740 - DNA, 25 bp, Mus musculus
ctactagagacagctgtaaaaccac

SEQ ID NO: 913741 - DNA, 25 bp, Mus musculus
ctactaggcaccaaaatggctggag

SEQ ID NO: 913742 - DNA, 25 bp, Mus musculus
ctactaggcagcaaaatggctggag

SEQ ID NO: 913743 - DNA, 25 bp, Mus musculus
ctactataagagtgacctgaccaag

SEQ ID NO: 913744 - DNA, 25 bp, Mus musculus
ctactataagtgtgacctgaccaag

SEQ ID NO: 913745 - DNA, 25 bp, Mus musculus
ctactataccagctctggagaagac

SEQ ID NO: 913746 - DNA, 25 bp, Mus musculus
ctactataccaggtctggagaagac

SEQ ID NO: 913747 - DNA, 25 bp, Mus musculus
ctactatatcaaccacgagacccaa

SEQ ID NO: 913748 - DNA, 25 bp, Mus musculus
ctactatatcaagcacgagacccaa

SEQ ID NO: 913749 - DNA, 25 bp, Mus musculus
ctactatgaccacgcagaagatgaa

SEQ ID NO: 913750 - DNA, 25 bp, Mus musculus
ctactatgaccaggcagaagatgaa

SEQ ID NO: 913751 - DNA, 25 bp, Mus musculus
ctactcacagagaattgaaggacag

SEQ ID NO: 913752 - DNA, 25 bp, Mus musculus
ctactcacagtgaattgaaggacag

SEQ ID NO: 913753 - DNA, 25 bp, Mus musculus
ctactcactcagcgatgactatgag

SEQ ID NO: 913754 - DNA, 25 bp, Mus musculus
ctactcactcagggatgactatgag

SEQ ID NO: 913755 - DNA, 25 bp, Mus musculus
ctactccaagcacgctgagctgatg

SEQ ID NO: 913756 - DNA, 25 bp, Mus musculus
ctactccaagcaggctgagctgatg

SEQ ID NO: 913757 - DNA, 25 bp, Mus musculus
ctactccaaggagacgtcaatacta

SEQ ID NO: 913758 - DNA, 25 bp, Mus musculus
ctactccaaggagaggtcaatacta

SEQ ID NO: 913759 - DNA, 25 bp, Mus musculus
ctactccacctgccatgtaaagtga

SEQ ID NO: 913760 - DNA, 25 bp, Mus musculus
ctactccacctggcatgtaaagtga

SEQ ID NO: 913761 - DNA, 25 bp, Mus musculus
ctactcccagagaccttcagaatgc

SEQ ID NO: 913762 - DNA, 25 bp, Mus musculus
ctactcccagagcagagacggaggc

SEQ ID NO: 913763 - DNA, 25 bp, Mus musculus
ctactcccagaggagagacggaggc

SEQ ID NO: 913764 - DNA, 25 bp, Mus musculus
ctactcccagcttgcccacattccc

SEQ ID NO: 913765 - DNA, 25 bp, Mus musculus
ctactcccaggttgcccacattccc

SEQ ID NO: 913766 - DNA, 25 bp, Mus musculus
ctactcccagtgaccttcagaatgc

SEQ ID NO: 913767 - DNA, 25 bp, Mus musculus
ctactccgtgcacaactgaactttg

SEQ ID NO: 913768 - DNA, 25 bp, Mus musculus
ctactccgtgcagaactgaactttg

SEQ ID NO: 913769 - DNA, 25 bp, Mus musculus
ctactcctgcagactggcataacac

SEQ ID NO: 913770 - DNA, 25 bp, Mus musculus
ctactcctgcagtctggcataacac

SEQ ID NO: 913771 - DNA, 25 bp, Mus musculus
ctactcgtccagctcaagtctctgc

SEQ ID NO: 913772 - DNA, 25 bp, Mus musculus
ctactcgtccaggtcaagtctctgc

SEQ ID NO: 913773 - DNA, 25 bp, Mus musculus
ctactctgagaaccttcgggaactg

SEQ ID NO: 913774 - DNA, 25 bp, Mus musculus
ctactctgagaagcttcgggaactg

SEQ ID NO: 913775 - DNA, 25 bp, Mus musculus
ctactctgtcccaggcgtggggaca

SEQ ID NO: 913776 - DNA, 25 bp, Mus musculus
ctactctgtccctggcgtggggaca

SEQ ID NO: 913777 - DNA, 25 bp, Mus musculus
ctactctgtgaacgcccgagaccag

SEQ ID NO: 913778 - DNA, 25 bp, Mus musculus
ctactctgtgaacggacaggaagat

SEQ ID NO: 913779 - DNA, 25 bp, Mus musculus
ctactctgtgaactctagggacagg

SEQ ID NO: 913780 - DNA, 25 bp, Mus musculus
ctactctgtgaaggcccgagaccag

SEQ ID NO: 913781 - DNA, 25 bp, Mus musculus
ctactctgtgaagggacaggaagat

SEQ ID NO: 913782 - DNA, 25 bp, Mus musculus
ctactctgtgaagtctagggacagg

SEQ ID NO: 913783 - DNA, 25 bp, Mus musculus
ctactctgtggacgtcagctacatg

SEQ ID NO: 913784 - DNA, 25 bp, Mus musculus
ctactctgtggaggtcagctacatg

SEQ ID NO: 913785 - DNA, 25 bp, Mus musculus
ctactcttcaatcgtgtgttgtccc

SEQ ID NO: 913786 - DNA, 25 bp, Mus musculus
ctactcttcaatggtgtgttgtccc

SEQ ID NO: 913787 - DNA, 25 bp, Mus musculus
ctactgaaccacgaagactgctaca

SEQ ID NO: 913788 - DNA, 25 bp, Mus musculus
ctactgaaccacgatgactgctaca

SEQ ID NO: 913789 - DNA, 25 bp, Mus musculus
ctactgatagttcccttatcttccg

SEQ ID NO: 913790 - DNA, 25 bp, Mus musculus
ctactgatagttccggatgacggag

SEQ ID NO: 913791 - DNA, 25 bp, Mus musculus
ctactgatagttgccttatcttccg

SEQ ID NO: 913792 - DNA, 25 bp, Mus musculus
ctactgatagttgcggatgacggag

SEQ ID NO: 913793 - DNA, 25 bp, Mus musculus
ctactgattttacctctgatctcac

SEQ ID NO: 913794 - DNA, 25 bp, Mus musculus
ctactgattttagctctgatctcac

SEQ ID NO: 913795 - DNA, 25 bp, Mus musculus
ctactgcaagcgaccttctatgccc

SEQ ID NO: 913796 - DNA, 25 bp, Mus musculus
ctactgcaagggaccttctatgccc

SEQ ID NO: 913797 - DNA, 25 bp, Mus musculus
ctactgccgagccaggtgtggacct

SEQ ID NO: 913798 - DNA, 25 bp, Mus musculus
ctactgccgagcgaggtgtggacct

SEQ ID NO: 913799 - DNA, 25 bp, Mus musculus
ctactgcctgtgctaatccatactt

SEQ ID NO: 913800 - DNA, 25 bp, Mus musculus
ctactgcctgtgcttatccatactt

SEQ ID NO: 913801 - DNA, 25 bp, Mus musculus
ctactgctcactatctttgtgctgc

SEQ ID NO: 913802 - DNA, 25 bp, Mus musculus
ctactgctcactttctttgtgctgc

SEQ ID NO: 913803 - DNA, 25 bp, Mus musculus
ctactggaaaagacagaaaatatgt

SEQ ID NO: 913804 - DNA, 25 bp, Mus musculus
ctactggaaaagtcagaaaatatgt

SEQ ID NO: 913805 - DNA, 25 bp, Mus musculus
ctactggaagagccatgaagaatcg

SEQ ID NO: 913806 - DNA, 25 bp, Mus musculus
ctactggaagcagagccatgaagaa

SEQ ID NO: 913807 - DNA, 25 bp, Mus musculus
ctactggaagctacccagggcatgt

SEQ ID NO: 913808 - DNA, 25 bp, Mus musculus
ctactggaaggagagccatgaagaa

SEQ ID NO: 913809 - DNA, 25 bp, Mus musculus
ctactggaagggaacgatgcacagg

SEQ ID NO: 913810 - DNA, 25 bp, Mus musculus
ctactggaagggaaggatgcacagg

SEQ ID NO: 913811 - DNA, 25 bp, Mus musculus
ctactggaaggtacccagggcatgt

SEQ ID NO: 913812 - DNA, 25 bp, Mus musculus
ctactggaagtgccatgaagaatcg

SEQ ID NO: 913813 - DNA, 25 bp, Mus musculus
ctactggagaagaagtcttggacag

SEQ ID NO: 913814 - DNA, 25 bp, Mus musculus
ctactggagaagctgcaaaacatgt

SEQ ID NO: 913815 - DNA, 25 bp, Mus musculus
ctactggagaaggtgcaaaacatgt

SEQ ID NO: 913816 - DNA, 25 bp, Mus musculus
ctactggagaagtagtcttggacag

SEQ ID NO: 913817 - DNA, 25 bp, Mus musculus
ctactggagcctctgccagtcagac

SEQ ID NO: 913818 - DNA, 25 bp, Mus musculus
ctactggagcctgtgccagtcagac

SEQ ID NO: 913819 - DNA, 25 bp, Mus musculus
ctactggccacacgaccagctgcca

SEQ ID NO: 913820 - DNA, 25 bp, Mus musculus
ctactggccacaggaccagctgcca

SEQ ID NO: 913821 - DNA, 25 bp, Mus musculus
ctactggccctgctctctgctctct

SEQ ID NO: 913822 - DNA, 25 bp, Mus musculus
ctactggccctggtctctgctctct

SEQ ID NO: 913823 - DNA, 25 bp, Mus musculus
ctactgtaatcgatgagatccgaaa

SEQ ID NO: 913824 - DNA, 25 bp, Mus musculus
ctactgtaatcgttgagatccgaaa

SEQ ID NO: 913825 - DNA, 25 bp, Mus musculus
ctactgtatgcccggagcacagata

SEQ ID NO: 913826 - DNA, 25 bp, Mus musculus
ctactgtatgccgggagcacagata

SEQ ID NO: 913827 - DNA, 25 bp, Mus musculus
ctactgtgatctacagtacagagct

SEQ ID NO: 913828 - DNA, 25 bp, Mus musculus
ctactgtgatctactgtacagagct

SEQ ID NO: 913829 - DNA, 25 bp, Mus musculus
ctactgtgcacgactctagggctcg

SEQ ID NO: 913830 - DNA, 25 bp, Mus musculus
ctactgtgcaggactctagggctcg

SEQ ID NO: 913831 - DNA, 25 bp, Mus musculus
ctactgtgcagtctgtgcaagatga

SEQ ID NO: 913832 - DNA, 25 bp, Mus musculus
ctactgtgcagtgtgtgcaagatga

SEQ ID NO: 913833 - DNA, 25 bp, Mus musculus
ctactgtgcgcaatggatctgtccg

SEQ ID NO: 913834 - DNA, 25 bp, Mus musculus
ctactgtgcgcattggatctgtccg

SEQ ID NO: 913835 - DNA, 25 bp, Mus musculus
ctactgtttgtgagctgtgttttgt

SEQ ID NO: 913836 - DNA, 25 bp, Mus musculus
ctactgtttgtgtgctgtgttttgt

SEQ ID NO: 913837 - DNA, 25 bp, Mus musculus
ctacttaaagcctttatcttctgag

SEQ ID NO: 913838 - DNA, 25 bp, Mus musculus
ctacttaaaggctttatcttctgag

SEQ ID NO: 913839 - DNA, 25 bp, Mus musculus
ctacttaacaatacaacacactcag

SEQ ID NO: 913840 - DNA, 25 bp, Mus musculus
ctacttaacattacaacacactcag

SEQ ID NO: 913841 - DNA, 25 bp, Mus musculus
ctacttcaagcataaaagagtacat

SEQ ID NO: 913842 - DNA, 25 bp, Mus musculus
ctacttcaagccacatattaagttt

SEQ ID NO: 913843 - DNA, 25 bp, Mus musculus
ctacttcaagcctcagtacaaggta

SEQ ID NO: 913844 - DNA, 25 bp, Mus musculus
ctacttcaaggataaaagagtacat

SEQ ID NO: 913845 - DNA, 25 bp, Mus musculus
ctacttcaaggcacatattaagttt

SEQ ID NO: 913846 - DNA, 25 bp, Mus musculus
ctacttcaaggctcagtacaaggta

SEQ ID NO: 913847 - DNA, 25 bp, Mus musculus
ctacttcattgaacataatacgaag

SEQ ID NO: 913848 - DNA, 25 bp, Mus musculus
ctacttcattgatcataatacgaag

SEQ ID NO: 913849 - DNA, 25 bp, Mus musculus
ctacttcctcgacgcctacaattca

SEQ ID NO: 913850 - DNA, 25 bp, Mus musculus
ctacttcctcgaggcctacaattca

SEQ ID NO: 913851 - DNA, 25 bp, Mus musculus
ctacttcgagaggcttcagggatct

SEQ ID NO: 913852 - DNA, 25 bp, Mus musculus
ctacttcgagtggcttcagggatct

SEQ ID NO: 913853 - DNA, 25 bp, Mus musculus
ctacttcggagagtccaacagtggt

SEQ ID NO: 913854 - DNA, 25 bp, Mus musculus
ctacttcggagagtgcaacagtggt

SEQ ID NO: 913855 - DNA, 25 bp, Mus musculus
ctacttctcaagcaaacttcattct

SEQ ID NO: 913856 - DNA, 25 bp, Mus musculus
ctacttctcaagcaggcgcttccat

SEQ ID NO: 913857 - DNA, 25 bp, Mus musculus
ctacttctcaaggaaacttcattct

SEQ ID NO: 913858 - DNA, 25 bp, Mus musculus
ctacttctcaaggaggcgcttccat

SEQ ID NO: 913859 - DNA, 25 bp, Mus musculus
ctacttctcctgcacgtgcgaccgc

SEQ ID NO: 913860 - DNA, 25 bp, Mus musculus
ctacttctcctgccaacgatatccc

SEQ ID NO: 913861 - DNA, 25 bp, Mus musculus
ctacttctcctggacgtgcgaccgc

SEQ ID NO: 913862 - DNA, 25 bp, Mus musculus
ctacttctcctggcaacgatatccc

SEQ ID NO: 913863 - DNA, 25 bp, Mus musculus
ctacttgagcagctattatctacgt

SEQ ID NO: 913864 - DNA, 25 bp, Mus musculus
ctacttgagcaggtattatctacgt

SEQ ID NO: 913865 - DNA, 25 bp, Mus musculus
ctacttggcacgaaagcaatataga

SEQ ID NO: 913866 - DNA, 25 bp, Mus musculus
ctacttggcacgtaagcaatataga

SEQ ID NO: 913867 - DNA, 25 bp, Mus musculus
ctacttggttcgctacatgggctgt

SEQ ID NO: 913868 - DNA, 25 bp, Mus musculus
ctacttggttcggtacatgggctgt

SEQ ID NO: 913869 - DNA, 25 bp, Mus musculus
ctacttgttcaacggtagtcagtac

SEQ ID NO: 913870 - DNA, 25 bp, Mus musculus
ctacttgttcaagggtagtcagtac

SEQ ID NO: 913871 - DNA, 25 bp, Mus musculus
ctactttcagctgctgtgcagcatc

SEQ ID NO: 913872 - DNA, 25 bp, Mus musculus
ctactttcaggtgctgtgcagcatc

SEQ ID NO: 913873 - DNA, 25 bp, Mus musculus
ctactttggcttcgccactgtgtgc

SEQ ID NO: 913874 - DNA, 25 bp, Mus musculus
ctactttggcttggccactgtgtgc

SEQ ID NO: 913875 - DNA, 25 bp, Mus musculus
ctagaaaaagagctataccaagagg

SEQ ID NO: 913876 - DNA, 25 bp, Mus musculus
ctagaaaaagaggtataccaagagg

SEQ ID NO: 913877 - DNA, 25 bp, Mus musculus
ctagaaagaacacagcatccagtgg

SEQ ID NO: 913878 - DNA, 25 bp, Mus musculus
ctagaaagaacagagcatccagtgg

SEQ ID NO: 913879 - DNA, 25 bp, Mus musculus
ctagaaatggcccaagattttgttc

SEQ ID NO: 913880 - DNA, 25 bp, Mus musculus
ctagaaatggcccaagtgctctgta

SEQ ID NO: 913881 - DNA, 25 bp, Mus musculus
ctagaaatggcccaatgaaaagagt

SEQ ID NO: 913882 - DNA, 25 bp, Mus musculus
ctagaaatggcccatgattttgttc

SEQ ID NO: 913883 - DNA, 25 bp, Mus musculus
ctagaaatggcccatgtgctctgta

SEQ ID NO: 913884 - DNA, 25 bp, Mus musculus
ctagaaatggcccattgaaaagagt

SEQ ID NO: 913885 - DNA, 25 bp, Mus musculus
ctagaacaacagcgacagctatttg

SEQ ID NO: 913886 - DNA, 25 bp, Mus musculus
ctagaacaacagctgttgggagccc

SEQ ID NO: 913887 - DNA, 25 bp, Mus musculus
ctagaacaacagggacagctatttg

SEQ ID NO: 913888 - DNA, 25 bp, Mus musculus
ctagaacaacaggtgttgggagccc

SEQ ID NO: 913889 - DNA, 25 bp, Mus musculus
ctagaacacgctctgcaaagaaagc

SEQ ID NO: 913890 - DNA, 25 bp, Mus musculus
ctagaacacggtctgcaaagaaagc

SEQ ID NO: 913891 - DNA, 25 bp, Mus musculus
ctagaacccacagacatataaacta

SEQ ID NO: 913892 - DNA, 25 bp, Mus musculus
ctagaacccacagagatataaacta

SEQ ID NO: 913893 - DNA, 25 bp, Mus musculus
ctagaaccctcaaccgtgttaggag

SEQ ID NO: 913894 - DNA, 25 bp, Mus musculus
ctagaaccctcaacggtgttaggag

SEQ ID NO: 913895 - DNA, 25 bp, Mus musculus
ctagaactagcagccagtgttgacc

SEQ ID NO: 913896 - DNA, 25 bp, Mus musculus
ctagaactaggagccagtgttgacc

SEQ ID NO: 913897 - DNA, 25 bp, Mus musculus
ctagaagacaccatcctgcttgcac

SEQ ID NO: 913898 - DNA, 25 bp, Mus musculus
ctagaagacaccatgctgcttgcac

SEQ ID NO: 913899 - DNA, 25 bp, Mus musculus
ctagaagctgagcgttcaaggaagg

SEQ ID NO: 913900 - DNA, 25 bp, Mus musculus
ctagaagctgagggttcaaggaagg

SEQ ID NO: 913901 - DNA, 25 bp, Mus musculus
ctagaagtgcagaataaaccgcaag

SEQ ID NO: 913902 - DNA, 25 bp, Mus musculus
ctagaagtgcagtataaaccgcaag

SEQ ID NO: 913903 - DNA, 25 bp, Mus musculus
ctagaagtggtacaaatggacctac

SEQ ID NO: 913904 - DNA, 25 bp, Mus musculus
ctagaagtggtagaaatggacctac

SEQ ID NO: 913905 - DNA, 25 bp, Mus musculus
ctagaagtttatcatttgattcgaa

SEQ ID NO: 913906 - DNA, 25 bp, Mus musculus
ctagaagtttatgatttgattcgaa

SEQ ID NO: 913907 - DNA, 25 bp, Mus musculus
ctagaatgggccaaccagaaaagaa

SEQ ID NO: 913908 - DNA, 25 bp, Mus musculus
ctagaatgggccaagcagaaaagaa

SEQ ID NO: 913909 - DNA, 25 bp, Mus musculus
ctagaattcttacgcaccagagccc

SEQ ID NO: 913910 - DNA, 25 bp, Mus musculus
ctagaattcttaggcaccagagccc

SEQ ID NO: 913911 - DNA, 25 bp, Mus musculus
ctagaattgctacactccacaagaa

SEQ ID NO: 913912 - DNA, 25 bp, Mus musculus
ctagaattgctacagtccacaagaa

SEQ ID NO: 913913 - DNA, 25 bp, Mus musculus
ctagacaaggcgccctctctgagtt

SEQ ID NO: 913914 - DNA, 25 bp, Mus musculus
ctagacaaggggccctctctgagtt

SEQ ID NO: 913915 - DNA, 25 bp, Mus musculus
ctagacatacagaatgctcctgaag

SEQ ID NO: 913916 - DNA, 25 bp, Mus musculus
ctagacatacagtatgctcctgaag

SEQ ID NO: 913917 - DNA, 25 bp, Mus musculus
ctagacccagcagttttgctctgca

SEQ ID NO: 913918 - DNA, 25 bp, Mus musculus
ctagacccaggagttttgctctgca

SEQ ID NO: 913919 - DNA, 25 bp, Mus musculus
ctagactttgagcaggaagaagtgc

SEQ ID NO: 913920 - DNA, 25 bp, Mus musculus
ctagactttgaggaggaagaagtgc

SEQ ID NO: 913921 - DNA, 25 bp, Mus musculus
ctagagaaatatctgcatgagctca

SEQ ID NO: 913922 - DNA, 25 bp, Mus musculus
ctagagaaatatgtgcatgagctca

SEQ ID NO: 913923 - DNA, 25 bp, Mus musculus
ctagagacagctgtaaaaccaccat

SEQ ID NO: 913924 - DNA, 25 bp, Mus musculus
ctagagacaggtgtaaaaccaccat

SEQ ID NO: 913925 - DNA, 25 bp, Mus musculus
ctagagagcaagatcattacagcat

SEQ ID NO: 913926 - DNA, 25 bp, Mus musculus
ctagagagcaagttcattacagcat

SEQ ID NO: 913927 - DNA, 25 bp, Mus musculus
ctagagcataagctttatctcaagt

SEQ ID NO: 913928 - DNA, 25 bp, Mus musculus
ctagagcataaggtttatctcaagt

SEQ ID NO: 913929 - DNA, 25 bp, Mus musculus
ctagagcatgccccacccctggaag

SEQ ID NO: 913930 - DNA, 25 bp, Mus musculus
ctagagcatggcccacccctggaag

SEQ ID NO: 913931 - DNA, 25 bp, Mus musculus
ctagagccctccatcgacatagtct

SEQ ID NO: 913932 - DNA, 25 bp, Mus musculus
ctagagccctccatggacatagtct

SEQ ID NO: 913933 - DNA, 25 bp, Mus musculus
ctagagcgtgtgcgcatcgttctgc

SEQ ID NO: 913934 - DNA, 25 bp, Mus musculus
ctagagcgtgtgggcatcgttctgc

SEQ ID NO: 913935 - DNA, 25 bp, Mus musculus
ctagaggagacagacgtattgacct

SEQ ID NO: 913936 - DNA, 25 bp, Mus musculus
ctagaggagacagaggtattgacct

SEQ ID NO: 913937 - DNA, 25 bp, Mus musculus
ctagatatcaaaatcgggtcatgca

SEQ ID NO: 913938 - DNA, 25 bp, Mus musculus
ctagatatcaatctgtggttctctg

SEQ ID NO: 913939 - DNA, 25 bp, Mus musculus
ctagatatcataatcgggtcatgca

SEQ ID NO: 913940 - DNA, 25 bp, Mus musculus
ctagatatcattctgtggttctctg

SEQ ID NO: 913941 - DNA, 25 bp, Mus musculus
ctagatcacactcaagcaggtagag

SEQ ID NO: 913942 - DNA, 25 bp, Mus musculus
ctagatcacagtcaagcaggtagag

SEQ ID NO: 913943 - DNA, 25 bp, Mus musculus
ctagatcagacccacgctcttgcca

SEQ ID NO: 913944 - DNA, 25 bp, Mus musculus
ctagatcagacccaggctcttgcca

SEQ ID NO: 913945 - DNA, 25 bp, Mus musculus
ctagatctctggcacgtcaagtccg

SEQ ID NO: 913946 - DNA, 25 bp, Mus musculus
ctagatctctggcaggtcaagtccg

SEQ ID NO: 913947 - DNA, 25 bp, Mus musculus
ctagatgaaactaaaactacttcca

SEQ ID NO: 913948 - DNA, 25 bp, Mus musculus
ctagatgaaagtaaaactacttcca

SEQ ID NO: 913949 - DNA, 25 bp, Mus musculus
ctagatgcagctgtcattaagatgg

SEQ ID NO: 913950 - DNA, 25 bp, Mus musculus
ctagatgcaggtgtcattaagatgg

SEQ ID NO: 913951 - DNA, 25 bp, Mus musculus
ctagatgctgtacacaagagtgtgg

SEQ ID NO: 913952 - DNA, 25 bp, Mus musculus
ctagatgctgtacacagtgtggaaa

SEQ ID NO: 913953 - DNA, 25 bp, Mus musculus
ctagatgctgtacagaagagtgtgg

SEQ ID NO: 913954 - DNA, 25 bp, Mus musculus
ctagatgctgtacagagtgtggaaa

SEQ ID NO: 913955 - DNA, 25 bp, Mus musculus
ctagcaaatcagaagttacgagact

SEQ ID NO: 913956 - DNA, 25 bp, Mus musculus
ctagcaaatcagcaggtgcttgtct

SEQ ID NO: 913957 - DNA, 25 bp, Mus musculus
ctagcaaatcaggaggtgcttgtct

SEQ ID NO: 913958 - DNA, 25 bp, Mus musculus
ctagcaaatcagtagttacgagact

SEQ ID NO: 913959 - DNA, 25 bp, Mus musculus
ctagcagagccgcggcggaagcaga

SEQ ID NO: 913960 - DNA, 25 bp, Mus musculus
ctagcagagcggcggcggaagcaga

SEQ ID NO: 913961 - DNA, 25 bp, Mus musculus
ctagcatacaaattcgtttcatgac

SEQ ID NO: 913962 - DNA, 25 bp, Mus musculus
ctagcatacaaattggtttcatgac

SEQ ID NO: 913963 - DNA, 25 bp, Mus musculus
ctagcatcaggccgtgaccatgccc

SEQ ID NO: 913964 - DNA, 25 bp, Mus musculus
ctagcatcaggcggtgaccatgccc

SEQ ID NO: 913965 - DNA, 25 bp, Mus musculus
ctagcatctgggaacaagccaccat

SEQ ID NO: 913966 - DNA, 25 bp, Mus musculus
ctagcatctgggaagaagccaccat

SEQ ID NO: 913967 - DNA, 25 bp, Mus musculus
ctagcatctttgcgtacctttcaac

SEQ ID NO: 913968 - DNA, 25 bp, Mus musculus
ctagcatctttgggtacctttcaac

SEQ ID NO: 913969 - DNA, 25 bp, Mus musculus
ctagcattacaacgaggtgcccctg

SEQ ID NO: 913970 - DNA, 25 bp, Mus musculus
ctagcattacaaggaggtgcccctg

SEQ ID NO: 913971 - DNA, 25 bp, Mus musculus
ctagcatttcaacgatattaccttc

SEQ ID NO: 913972 - DNA, 25 bp, Mus musculus
ctagcatttcaaggatattaccttc

SEQ ID NO: 913973 - DNA, 25 bp, Mus musculus
ctagccagaaagattcaggccatcc

SEQ ID NO: 913974 - DNA, 25 bp, Mus musculus
ctagccagaaagctccacaccagtc

SEQ ID NO: 913975 - DNA, 25 bp, Mus musculus
ctagccagaaaggtccacaccagtc

SEQ ID NO: 913976 - DNA, 25 bp, Mus musculus
ctagccagaaagtttcaggccatcc

SEQ ID NO: 913977 - DNA, 25 bp, Mus musculus
ctagccctgctccactgcctcaacc

SEQ ID NO: 913978 - DNA, 25 bp, Mus musculus
ctagccctgctccagtgcctcaacc

SEQ ID NO: 913979 - DNA, 25 bp, Mus musculus
ctagccgcagcctcgcgcggctgga

SEQ ID NO: 913980 - DNA, 25 bp, Mus musculus
ctagccgcaggctcgcgcggctgga

SEQ ID NO: 913981 - DNA, 25 bp, Mus musculus
ctagccgcctcacgtgtttgaacca

SEQ ID NO: 913982 - DNA, 25 bp, Mus musculus
ctagccgcctcaggtgtttgaacca

SEQ ID NO: 913983 - DNA, 25 bp, Mus musculus
ctagcctaagatctgagaagtcaga

SEQ ID NO: 913984 - DNA, 25 bp, Mus musculus
ctagcctaagttctgagaagtcaga

SEQ ID NO: 913985 - DNA, 25 bp, Mus musculus
ctagcctacccacgaagaagctcac

SEQ ID NO: 913986 - DNA, 25 bp, Mus musculus
ctagcctacccaggaagaagctcac

SEQ ID NO: 913987 - DNA, 25 bp, Mus musculus
ctagcctgtgccttcgacggctgtt

SEQ ID NO: 913988 - DNA, 25 bp, Mus musculus
ctagcctgtgccttggacggctgtt

SEQ ID NO: 913989 - DNA, 25 bp, Mus musculus
ctagcgccacagcaggctccatgac

SEQ ID NO: 913990 - DNA, 25 bp, Mus musculus
ctagcgccacagccatggggaggat

SEQ ID NO: 913991 - DNA, 25 bp, Mus musculus
ctagcgccacagcctccatgaccta

SEQ ID NO: 913992 - DNA, 25 bp, Mus musculus
ctagcgccacaggaggctccatgac

SEQ ID NO: 913993 - DNA, 25 bp, Mus musculus
ctagcgccacaggcatggggaggat

SEQ ID NO: 913994 - DNA, 25 bp, Mus musculus
ctagcgccacaggctccatgaccta

SEQ ID NO: 913995 - DNA, 25 bp, Mus musculus
ctagcgcttcagagttcctggttca

SEQ ID NO: 913996 - DNA, 25 bp, Mus musculus
ctagcgcttcagtgttcctggttca

SEQ ID NO: 913997 - DNA, 25 bp, Mus musculus
ctagcgggaacagcagtagcagtcc

SEQ ID NO: 913998 - DNA, 25 bp, Mus musculus
ctagcgggaagagcagtagcagtcc

SEQ ID NO: 913999 - DNA, 25 bp, Mus musculus
ctagctaatgcggtagctgggagta

SEQ ID NO: 914000 - DNA, 25 bp, Mus musculus
ctagctaatggggtagctgggagta

SEQ ID NO: 914001 - DNA, 25 bp, Mus musculus
ctagctacagaactgtgccggatca

SEQ ID NO: 914002 - DNA, 25 bp, Mus musculus
ctagctacagtactgtgccggatca

SEQ ID NO: 914003 - DNA, 25 bp, Mus musculus
ctagctactccacgtacgtaggtgc

SEQ ID NO: 914004 - DNA, 25 bp, Mus musculus
ctagctactccaggtacgtaggtgc

SEQ ID NO: 914005 - DNA, 25 bp, Mus musculus
ctagctagttcacgcactggctcca

SEQ ID NO: 914006 - DNA, 25 bp, Mus musculus
ctagctagttcaggcactggctcca

SEQ ID NO: 914007 - DNA, 25 bp, Mus musculus
ctagctctggaacaggtgctgctgg

SEQ ID NO: 914008 - DNA, 25 bp, Mus musculus
ctagctctggaagaggtgctgctgg

SEQ ID NO: 914009 - DNA, 25 bp, Mus musculus
ctagctcttcagcactgggcagctc

SEQ ID NO: 914010 - DNA, 25 bp, Mus musculus
ctagctcttcagctctggggacact

SEQ ID NO: 914011 - DNA, 25 bp, Mus musculus
ctagctcttcaggactgggcagctc

SEQ ID NO: 914012 - DNA, 25 bp, Mus musculus
ctagctcttcaggtctggggacact

SEQ ID NO: 914013 - DNA, 25 bp, Mus musculus
ctagctgaagagagcaaaccaacat

SEQ ID NO: 914014 - DNA, 25 bp, Mus musculus
ctagctgaagtgagcaaaccaacat

SEQ ID NO: 914015 - DNA, 25 bp, Mus musculus
ctagctgcacagatcagagacaaat

SEQ ID NO: 914016 - DNA, 25 bp, Mus musculus
ctagctgcacagatgagagacaaat

SEQ ID NO: 914017 - DNA, 25 bp, Mus musculus
ctagctggaaatctggcctatggtt

SEQ ID NO: 914018 - DNA, 25 bp, Mus musculus
ctagctggaaatgtggcctatggtt

SEQ ID NO: 914019 - DNA, 25 bp, Mus musculus
ctagctgtctacgacaccctgaaga

SEQ ID NO: 914020 - DNA, 25 bp, Mus musculus
ctagctgtctacgagaccctgaaga

SEQ ID NO: 914021 - DNA, 25 bp, Mus musculus
ctagcttgggcgctttcaggtagct

SEQ ID NO: 914022 - DNA, 25 bp, Mus musculus
ctagcttgggggctttcaggtagct

SEQ ID NO: 914023 - DNA, 25 bp, Mus musculus
ctaggaacaaagagaacctgcaccc

SEQ ID NO: 914024 - DNA, 25 bp, Mus musculus
ctaggaacaaagagaccccgaggca

SEQ ID NO: 914025 - DNA, 25 bp, Mus musculus
ctaggaacaaagctcaggtgcccat

SEQ ID NO: 914026 - DNA, 25 bp, Mus musculus
ctaggaacaaaggtcaggtgcccat

SEQ ID NO: 914027 - DNA, 25 bp, Mus musculus
ctaggaacaaagtgaacctgcaccc

SEQ ID NO: 914028 - DNA, 25 bp, Mus musculus
ctaggaacaaagtgaccccgaggca

SEQ ID NO: 914029 - DNA, 25 bp, Mus musculus
ctaggaacccgtgacgtcaatatcc

SEQ ID NO: 914030 - DNA, 25 bp, Mus musculus
ctaggaacccgtgaggtcaatatcc

SEQ ID NO: 914031 - DNA, 25 bp, Mus musculus
ctaggaagagctcagccatgtcatc

SEQ ID NO: 914032 - DNA, 25 bp, Mus musculus
ctaggaagaggtcagccatgtcatc

SEQ ID NO: 914033 - DNA, 25 bp, Mus musculus
ctaggagaagggaaatatgctggct

SEQ ID NO: 914034 - DNA, 25 bp, Mus musculus
ctaggagaagggtaatatgctggct

SEQ ID NO: 914035 - DNA, 25 bp, Mus musculus
ctaggagagattcatgctgcacctc

SEQ ID NO: 914036 - DNA, 25 bp, Mus musculus
ctaggagagattgatgctgcacctc

SEQ ID NO: 914037 - DNA, 25 bp, Mus musculus
ctaggagggattcatgctgcacctc

SEQ ID NO: 914038 - DNA, 25 bp, Mus musculus
ctaggagggattgatgctgcacctc

SEQ ID NO: 914039 - DNA, 25 bp, Mus musculus
ctaggcaacaagcccgatgtaagca

SEQ ID NO: 914040 - DNA, 25 bp, Mus musculus
ctaggcaacaaggccgatgtaagca

SEQ ID NO: 914041 - DNA, 25 bp, Mus musculus
ctaggccccactcgggccatgtagg

SEQ ID NO: 914042 - DNA, 25 bp, Mus musculus
ctaggccccactggggccatgtagg

SEQ ID NO: 914043 - DNA, 25 bp, Mus musculus
ctaggccctcagatcaatgatgatg

SEQ ID NO: 914044 - DNA, 25 bp, Mus musculus
ctaggccctcagttcaatgatgatg

SEQ ID NO: 914045 - DNA, 25 bp, Mus musculus
ctaggctgaggccacgtctcttaac

SEQ ID NO: 914046 - DNA, 25 bp, Mus musculus
ctaggctgaggccaggtctcttaac

SEQ ID NO: 914047 - DNA, 25 bp, Mus musculus
ctaggctggctgcctgcctactgga

SEQ ID NO: 914048 - DNA, 25 bp, Mus musculus
ctaggctggctgctagctgcctact

SEQ ID NO: 914049 - DNA, 25 bp, Mus musculus
ctaggctggctggctgcctactgga

SEQ ID NO: 914050 - DNA, 25 bp, Mus musculus
ctaggctggctggtagctgcctact

SEQ ID NO: 914051 - DNA, 25 bp, Mus musculus
ctagggaatgaaggtgaagagattg

SEQ ID NO: 914052 - DNA, 25 bp, Mus musculus
ctagggaatgtaggtgaagagattg

SEQ ID NO: 914053 - DNA, 25 bp, Mus musculus
ctagggattaccaacgtgggcagcc

SEQ ID NO: 914054 - DNA, 25 bp, Mus musculus
ctagggattaccaaggtgggcagcc

SEQ ID NO: 914055 - DNA, 25 bp, Mus musculus
ctaggtcagcgacgtattgaagccc

SEQ ID NO: 914056 - DNA, 25 bp, Mus musculus
ctaggtcagcgaggtattgaagccc

SEQ ID NO: 914057 - DNA, 25 bp, Mus musculus
ctaggtctgcagctgcagttccctt

SEQ ID NO: 914058 - DNA, 25 bp, Mus musculus
ctaggtctgcaggtgcagttccctt

SEQ ID NO: 914059 - DNA, 25 bp, Mus musculus
ctaggttttcagctcatcttcacag

SEQ ID NO: 914060 - DNA, 25 bp, Mus musculus
ctaggttttcaggtcatcttcacag

SEQ ID NO: 914061 - DNA, 25 bp, Mus musculus
ctagtagcagaagctgggagggcag

SEQ ID NO: 914062 - DNA, 25 bp, Mus musculus
ctagtagcagtagctgggagggcag

SEQ ID NO: 914063 - DNA, 25 bp, Mus musculus
ctagtagtgacacgacactactgga

SEQ ID NO: 914064 - DNA, 25 bp, Mus musculus
ctagtagtgacaggacactactgga

SEQ ID NO: 914065 - DNA, 25 bp, Mus musculus
ctagtcacagcgaaccacacagaga

SEQ ID NO: 914066 - DNA, 25 bp, Mus musculus
ctagtcacagggaaccacacagaga

SEQ ID NO: 914067 - DNA, 25 bp, Mus musculus
ctagtcatctgccaacacgactcct

SEQ ID NO: 914068 - DNA, 25 bp, Mus musculus
ctagtcatctgcgaacacgactcct

SEQ ID NO: 914069 - DNA, 25 bp, Mus musculus
ctagtccagttgcgttgccatctat

SEQ ID NO: 914070 - DNA, 25 bp, Mus musculus
ctagtccagttgggttgccatctat

SEQ ID NO: 914071 - DNA, 25 bp, Mus musculus
ctagtcctgctcgacgctatgaact

SEQ ID NO: 914072 - DNA, 25 bp, Mus musculus
ctagtcctgctcgaggctatgaact

SEQ ID NO: 914073 - DNA, 25 bp, Mus musculus
ctagtcgaagagcccccctccttgg

SEQ ID NO: 914074 - DNA, 25 bp, Mus musculus
ctagtcgaagcccagagaagaaggt

SEQ ID NO: 914075 - DNA, 25 bp, Mus musculus
ctagtcgaaggccagagaagaaggt

SEQ ID NO: 914076 - DNA, 25 bp, Mus musculus
ctagtcgaagtgcccccctccttgg

SEQ ID NO: 914077 - DNA, 25 bp, Mus musculus
ctagtcggagatacagccgctgtct

SEQ ID NO: 914078 - DNA, 25 bp, Mus musculus
ctagtcggagctgtatcgttactct

SEQ ID NO: 914079 - DNA, 25 bp, Mus musculus
ctagtcggaggtgtatcgttactct

SEQ ID NO: 914080 - DNA, 25 bp, Mus musculus
ctagtcggagttacagccgctgtct

SEQ ID NO: 914081 - DNA, 25 bp, Mus musculus
ctagtcttttaatggagaatggagt

SEQ ID NO: 914082 - DNA, 25 bp, Mus musculus
ctagtcttttaggtaagaagtatgg

SEQ ID NO: 914083 - DNA, 25 bp, Mus musculus
ctagtctttttatggagaatggagt

SEQ ID NO: 914084 - DNA, 25 bp, Mus musculus
ctagtctttttggtaagaagtatgg

SEQ ID NO: 914085 - DNA, 25 bp, Mus musculus
ctagtgaactctcacttagtcacca

SEQ ID NO: 914086 - DNA, 25 bp, Mus musculus
ctagtgaactctcagttagtcacca

SEQ ID NO: 914087 - DNA, 25 bp, Mus musculus
ctagtgaagattcacgcttgttccc

SEQ ID NO: 914088 - DNA, 25 bp, Mus musculus
ctagtgaagattcaggcttgttccc

SEQ ID NO: 914089 - DNA, 25 bp, Mus musculus
ctagtgactggacgattctgtaccc

SEQ ID NO: 914090 - DNA, 25 bp, Mus musculus
ctagtgactggaggattctgtaccc

SEQ ID NO: 914091 - DNA, 25 bp, Mus musculus
ctagtgcaagaacttttacatcacc

SEQ ID NO: 914092 - DNA, 25 bp, Mus musculus
ctagtgcaagtacttttacatcacc

SEQ ID NO: 914093 - DNA, 25 bp, Mus musculus
ctagtgccactgcacacggtgctgg

SEQ ID NO: 914094 - DNA, 25 bp, Mus musculus
ctagtgccactggacacggtgctgg

SEQ ID NO: 914095 - DNA, 25 bp, Mus musculus
ctagtgctggacgctgctggagttg

SEQ ID NO: 914096 - DNA, 25 bp, Mus musculus
ctagtgctggtcgctgctggagttg

SEQ ID NO: 914097 - DNA, 25 bp, Mus musculus
ctagtggatcatctctatgctatcc

SEQ ID NO: 914098 - DNA, 25 bp, Mus musculus
ctagtggatcatgtctatgctatcc

SEQ ID NO: 914099 - DNA, 25 bp, Mus musculus
ctagtggcagcgcgccacgactgct

SEQ ID NO: 914100 - DNA, 25 bp, Mus musculus
ctagtggcagcgggccacgactgct

SEQ ID NO: 914101 - DNA, 25 bp, Mus musculus
ctagtgtaaaagaaagatgatgaca

SEQ ID NO: 914102 - DNA, 25 bp, Mus musculus
ctagtgtaaaagtaagatgatgaca

SEQ ID NO: 914103 - DNA, 25 bp, Mus musculus
ctagtgtcagataagttctggaaga

SEQ ID NO: 914104 - DNA, 25 bp, Mus musculus
ctagtgtcagttaagttctggaaga

SEQ ID NO: 914105 - DNA, 25 bp, Mus musculus
ctagtgtgcagaatctctcacagat

SEQ ID NO: 914106 - DNA, 25 bp, Mus musculus
ctagtgtgcagaatgtctcacagat

SEQ ID NO: 914107 - DNA, 25 bp, Mus musculus
ctagtgttagaacacatcccagaaa

SEQ ID NO: 914108 - DNA, 25 bp, Mus musculus
ctagtgttagaacagatcccagaaa

SEQ ID NO: 914109 - DNA, 25 bp, Mus musculus
ctagttcaagagcaagaaatgcccc

SEQ ID NO: 914110 - DNA, 25 bp, Mus musculus
ctagttcaagagcacacaatgtagg

SEQ ID NO: 914111 - DNA, 25 bp, Mus musculus
ctagttcaagaggaagaaatgcccc

SEQ ID NO: 914112 - DNA, 25 bp, Mus musculus
ctagttcaagaggacacaatgtagg

SEQ ID NO: 914113 - DNA, 25 bp, Mus musculus
ctagttgtggctcgcatccgaaaca

SEQ ID NO: 914114 - DNA, 25 bp, Mus musculus
ctagttgtgggtcgcatccgaaaca

SEQ ID NO: 914115 - DNA, 25 bp, Mus musculus
ctagttgttggacgaactgctgaag

SEQ ID NO: 914116 - DNA, 25 bp, Mus musculus
ctagttgttggaggaactgctgaag

SEQ ID NO: 914117 - DNA, 25 bp, Mus musculus
ctataaaaagaagtaccagcaggta

SEQ ID NO: 914118 - DNA, 25 bp, Mus musculus
ctataaaaagtagtaccagcaggta

SEQ ID NO: 914119 - DNA, 25 bp, Mus musculus
ctataaagtggacggtggctgtatc

SEQ ID NO: 914120 - DNA, 25 bp, Mus musculus
ctataaagtggagggtggctgtatc

SEQ ID NO: 914121 - DNA, 25 bp, Mus musculus
ctataacgtctgcatactatcgtgg

SEQ ID NO: 914122 - DNA, 25 bp, Mus musculus
ctataacgtctggatactatcgtgg

SEQ ID NO: 914123 - DNA, 25 bp, Mus musculus
ctataagcagcctgctgtggaggtg

SEQ ID NO: 914124 - DNA, 25 bp, Mus musculus
ctataagcaggctgctgtggaggtg

SEQ ID NO: 914125 - DNA, 25 bp, Mus musculus
ctataaggtcaaccctgtgggccga

SEQ ID NO: 914126 - DNA, 25 bp, Mus musculus
ctataaggtcaagcctgtgggccga

SEQ ID NO: 914127 - DNA, 25 bp, Mus musculus
ctatacaacaccagactgggcccac

SEQ ID NO: 914128 - DNA, 25 bp, Mus musculus
ctatacaacacctgactgggcccac

SEQ ID NO: 914129 - DNA, 25 bp, Mus musculus
ctatacacagagcaccgcctggggc

SEQ ID NO: 914130 - DNA, 25 bp, Mus musculus
ctatacacagaggaccgcctggggc

SEQ ID NO: 914131 - DNA, 25 bp, Mus musculus
ctatacacagatcaaggtagtgaag

SEQ ID NO: 914132 - DNA, 25 bp, Mus musculus
ctatacacagctgattttcgatata

SEQ ID NO: 914133 - DNA, 25 bp, Mus musculus
ctatacacaggtgattttcgatata

SEQ ID NO: 914134 - DNA, 25 bp, Mus musculus
ctatacacagttcaaggtagtgaag

SEQ ID NO: 914135 - DNA, 25 bp, Mus musculus
ctatacagacatcattcacaatcgc

SEQ ID NO: 914136 - DNA, 25 bp, Mus musculus
ctatacagacatcggcagattcaca

SEQ ID NO: 914137 - DNA, 25 bp, Mus musculus
ctatacagacatgattcacaatcgc

SEQ ID NO: 914138 - DNA, 25 bp, Mus musculus
ctatacagacatgggcagattcaca

SEQ ID NO: 914139 - DNA, 25 bp, Mus musculus
ctataccagaagcgcttcctaccac

SEQ ID NO: 914140 - DNA, 25 bp, Mus musculus
ctataccagaagggcttcctaccac

SEQ ID NO: 914141 - DNA, 25 bp, Mus musculus
ctataccatgagcctcaccatcaac

SEQ ID NO: 914142 - DNA, 25 bp, Mus musculus
ctataccatgaggctcaccatcaac

SEQ ID NO: 914143 - DNA, 25 bp, Mus musculus
ctatatacagcctacagacaagaga

SEQ ID NO: 914144 - DNA, 25 bp, Mus musculus
ctatatacaggctacagacaagaga

SEQ ID NO: 914145 - DNA, 25 bp, Mus musculus
ctatatattatgcgtgtgctggata

SEQ ID NO: 914146 - DNA, 25 bp, Mus musculus
ctatatattatgggtgtgctggata

SEQ ID NO: 914147 - DNA, 25 bp, Mus musculus
ctatatcaagaacgaatttgacaag

SEQ ID NO: 914148 - DNA, 25 bp, Mus musculus
ctatatcaagaaggaatttgacaag

SEQ ID NO: 914149 - DNA, 25 bp, Mus musculus
ctatatcaagactctctctttggaa

SEQ ID NO: 914150 - DNA, 25 bp, Mus musculus
ctatatcaagtctctctctttggaa

SEQ ID NO: 914151 - DNA, 25 bp, Mus musculus
ctatatcaatgacacacacaccggg

SEQ ID NO: 914152 - DNA, 25 bp, Mus musculus
ctatatcaatgagacacacaccggg

SEQ ID NO: 914153 - DNA, 25 bp, Mus musculus
ctatatccagcaggagtttctcctc

SEQ ID NO: 914154 - DNA, 25 bp, Mus musculus
ctatatccaggaggagtttctcctc

SEQ ID NO: 914155 - DNA, 25 bp, Mus musculus
ctatatgaagccattatatgagagg

SEQ ID NO: 914156 - DNA, 25 bp, Mus musculus
ctatatgaaggcattatatgagagg

SEQ ID NO: 914157 - DNA, 25 bp, Mus musculus
ctatatgcggcaaacagggcctatc

SEQ ID NO: 914158 - DNA, 25 bp, Mus musculus
ctatatgcgggaaacagggcctatc

SEQ ID NO: 914159 - DNA, 25 bp, Mus musculus
ctatatggaccaacctcggaggcag

SEQ ID NO: 914160 - DNA, 25 bp, Mus musculus
ctatatggacgaacctcggaggcag

SEQ ID NO: 914161 - DNA, 25 bp, Mus musculus
ctatatggctcccgagcgcatcgac

SEQ ID NO: 914162 - DNA, 25 bp, Mus musculus
ctatatggctgccgagcgcatcgac

SEQ ID NO: 914163 - DNA, 25 bp, Mus musculus
ctatattcagacataccggaaaaag

SEQ ID NO: 914164 - DNA, 25 bp, Mus musculus
ctatattcagcgctacaacaaggct

SEQ ID NO: 914165 - DNA, 25 bp, Mus musculus
ctatattcagctgacagacttcggt

SEQ ID NO: 914166 - DNA, 25 bp, Mus musculus
ctatattcagggctacaacaaggct

SEQ ID NO: 914167 - DNA, 25 bp, Mus musculus
ctatattcaggtgacagacttcggt

SEQ ID NO: 914168 - DNA, 25 bp, Mus musculus
ctatattcagtcataccggaaaaag

SEQ ID NO: 914169 - DNA, 25 bp, Mus musculus
ctatatttcgttatctcatcgcaga

SEQ ID NO: 914170 - DNA, 25 bp, Mus musculus
ctatatttcgttttctcatcgcaga

SEQ ID NO: 914171 - DNA, 25 bp, Mus musculus
ctatcaacacagccattcctgaagt

SEQ ID NO: 914172 - DNA, 25 bp, Mus musculus
ctatcaacacaggcattcctgaagt

SEQ ID NO: 914173 - DNA, 25 bp, Mus musculus
ctatcacaagaattttaattacctg

SEQ ID NO: 914174 - DNA, 25 bp, Mus musculus
ctatcacaagtattttaattacctg

SEQ ID NO: 914175 - DNA, 25 bp, Mus musculus
ctatcagaacaccatcggggctgct

SEQ ID NO: 914176 - DNA, 25 bp, Mus musculus
ctatcagaactccatcggggctgct

SEQ ID NO: 914177 - DNA, 25 bp, Mus musculus
ctatcagagaaacgtggaagctccc

SEQ ID NO: 914178 - DNA, 25 bp, Mus musculus
ctatcagagaaaggtggaagctccc

SEQ ID NO: 914179 - DNA, 25 bp, Mus musculus
ctatcagcagaggcagctgaaatac

SEQ ID NO: 914180 - DNA, 25 bp, Mus musculus
ctatcagcagtggcagctgaaatac

SEQ ID NO: 914181 - DNA, 25 bp, Mus musculus
ctatcagcggccttatccgctggag

SEQ ID NO: 914182 - DNA, 25 bp, Mus musculus
ctatcagcggctcatagaagagctt

SEQ ID NO: 914183 - DNA, 25 bp, Mus musculus
ctatcagcgggcttatccgctggag

SEQ ID NO: 914184 - DNA, 25 bp, Mus musculus
ctatcagcgggtcatagaagagctt

SEQ ID NO: 914185 - DNA, 25 bp, Mus musculus
ctatcagctgcacgtggccaagacg

SEQ ID NO: 914186 - DNA, 25 bp, Mus musculus
ctatcagctgcaggtggccaagacg

SEQ ID NO: 914187 - DNA, 25 bp, Mus musculus
ctatcagttctgacccccacttcga

SEQ ID NO: 914188 - DNA, 25 bp, Mus musculus
ctatcagttctgtcccccacttcga

SEQ ID NO: 914189 - DNA, 25 bp, Mus musculus
ctatccaactcacgttctcggtaaa

SEQ ID NO: 914190 - DNA, 25 bp, Mus musculus
ctatccaactcaggttctcggtaaa

SEQ ID NO: 914191 - DNA, 25 bp, Mus musculus
ctatccacagatgctacggaacact

SEQ ID NO: 914192 - DNA, 25 bp, Mus musculus
ctatccacagttgctacggaacact

SEQ ID NO: 914193 - DNA, 25 bp, Mus musculus
ctatccacatatcgaacagccttac

SEQ ID NO: 914194 - DNA, 25 bp, Mus musculus
ctatccacatatggaacagccttac

SEQ ID NO: 914195 - DNA, 25 bp, Mus musculus
ctatccagatctacgtgccctggaa

SEQ ID NO: 914196 - DNA, 25 bp, Mus musculus
ctatccagatgtacgtgccctggaa

SEQ ID NO: 914197 - DNA, 25 bp, Mus musculus
ctatcccacgagagcgttttttgca

SEQ ID NO: 914198 - DNA, 25 bp, Mus musculus
ctatcccacgagagggttttttgca

SEQ ID NO: 914199 - DNA, 25 bp, Mus musculus
ctatcctgaagtcattttcctcgca

SEQ ID NO: 914200 - DNA, 25 bp, Mus musculus
ctatcctgaagtgattttcctcgca

SEQ ID NO: 914201 - DNA, 25 bp, Mus musculus
ctatccttcacaccatttggaagct

SEQ ID NO: 914202 - DNA, 25 bp, Mus musculus
ctatccttcacagcatttggaagct

SEQ ID NO: 914203 - DNA, 25 bp, Mus musculus
ctatcgaacaatgacgtgatagagt

SEQ ID NO: 914204 - DNA, 25 bp, Mus musculus
ctatcgaacaatgaggtgatagagt

SEQ ID NO: 914205 - DNA, 25 bp, Mus musculus
ctatcgccaaatacctggacaacat

SEQ ID NO: 914206 - DNA, 25 bp, Mus musculus
ctatcgccaattacctggacaacat

SEQ ID NO: 914207 - DNA, 25 bp, Mus musculus
ctatctaaagcacactcaccaacgg

SEQ ID NO: 914208 - DNA, 25 bp, Mus musculus
ctatctaaaggacactcaccaacgg

SEQ ID NO: 914209 - DNA, 25 bp, Mus musculus
ctatctagagatgttcgttcacgtg

SEQ ID NO: 914210 - DNA, 25 bp, Mus musculus
ctatctagagttgttcgttcacgtg

SEQ ID NO: 914211 - DNA, 25 bp, Mus musculus
ctatctagccagcgtcacagctctg

SEQ ID NO: 914212 - DNA, 25 bp, Mus musculus
ctatctagccagggtcacagctctg

SEQ ID NO: 914213 - DNA, 25 bp, Mus musculus
ctatctatctatcatctatctacct

SEQ ID NO: 914214 - DNA, 25 bp, Mus musculus
ctatctatctatgatctatctacct

SEQ ID NO: 914215 - DNA, 25 bp, Mus musculus
ctatctgacaagcacaaacgggaga

SEQ ID NO: 914216 - DNA, 25 bp, Mus musculus
ctatctgacacaagtggtccttctc

SEQ ID NO: 914217 - DNA, 25 bp, Mus musculus
ctatctgacagaagtggtccttctc

SEQ ID NO: 914218 - DNA, 25 bp, Mus musculus
ctatctgacatgcacaaacgggaga

SEQ ID NO: 914219 - DNA, 25 bp, Mus musculus
ctatcttagcagctcggtctccagt

SEQ ID NO: 914220 - DNA, 25 bp, Mus musculus
ctatcttagcaggtcggtctccagt

SEQ ID NO: 914221 - DNA, 25 bp, Mus musculus
ctatcttcagccagccatggctgtt

SEQ ID NO: 914222 - DNA, 25 bp, Mus musculus
ctatcttcagcctgccatggctgtt

SEQ ID NO: 914223 - DNA, 25 bp, Mus musculus
ctatcttgacaaagaaatcgacctt

SEQ ID NO: 914224 - DNA, 25 bp, Mus musculus
ctatcttgacaaagtaatcgacctt

SEQ ID NO: 914225 - DNA, 25 bp, Mus musculus
ctatcttgatgaaacgagagatgtc

SEQ ID NO: 914226 - DNA, 25 bp, Mus musculus
ctatcttgatgaaaggagagatgtc

SEQ ID NO: 914227 - DNA, 25 bp, Mus musculus
ctatcttgtaagcgtggggatgtcc

SEQ ID NO: 914228 - DNA, 25 bp, Mus musculus
ctatcttgtaagggtggggatgtcc

SEQ ID NO: 914229 - DNA, 25 bp, Mus musculus
ctatgaaaagcgatggatctttaca

SEQ ID NO: 914230 - DNA, 25 bp, Mus musculus
ctatgaaaagctgacgtgcacagac

SEQ ID NO: 914231 - DNA, 25 bp, Mus musculus
ctatgaaaagggatggatctttaca

SEQ ID NO: 914232 - DNA, 25 bp, Mus musculus
ctatgaaaaggtgacgtgcacagac

SEQ ID NO: 914233 - DNA, 25 bp, Mus musculus
ctatgaacaaataggagacagcttg

SEQ ID NO: 914234 - DNA, 25 bp, Mus musculus
ctatgaacaattaggagacagcttg

SEQ ID NO: 914235 - DNA, 25 bp, Mus musculus
ctatgaactccacgcaagtcgttgg

SEQ ID NO: 914236 - DNA, 25 bp, Mus musculus
ctatgaactccaggcaagtcgttgg

SEQ ID NO: 914237 - DNA, 25 bp, Mus musculus
ctatgaagacagcagtcttttattc

SEQ ID NO: 914238 - DNA, 25 bp, Mus musculus
ctatgaagacaggagtcttttattc

SEQ ID NO: 914239 - DNA, 25 bp, Mus musculus
ctatgaagcaaacgtgaatcttctg

SEQ ID NO: 914240 - DNA, 25 bp, Mus musculus
ctatgaagcaaaggtgaatcttctg

SEQ ID NO: 914241 - DNA, 25 bp, Mus musculus
ctatgaagccaacattgtaagggcc

SEQ ID NO: 914242 - DNA, 25 bp, Mus musculus
ctatgaagccaagattgtaagggcc

SEQ ID NO: 914243 - DNA, 25 bp, Mus musculus
ctatgaagcgaacgacggatcttgt

SEQ ID NO: 914244 - DNA, 25 bp, Mus musculus
ctatgaagcgaaggacggatcttgt

SEQ ID NO: 914245 - DNA, 25 bp, Mus musculus
ctatgaagctacctacagccagctg

SEQ ID NO: 914246 - DNA, 25 bp, Mus musculus
ctatgaagctctggccatgggcaag

SEQ ID NO: 914247 - DNA, 25 bp, Mus musculus
ctatgaagctgtggccatgggcaag

SEQ ID NO: 914248 - DNA, 25 bp, Mus musculus
ctatgaagcttcctacagccagctg

SEQ ID NO: 914249 - DNA, 25 bp, Mus musculus
ctatgaaggacgttccgagttggga

SEQ ID NO: 914250 - DNA, 25 bp, Mus musculus
ctatgaaggaggttccgagttggga

SEQ ID NO: 914251 - DNA, 25 bp, Mus musculus
ctatgaaggcgtcaatatgacatct

SEQ ID NO: 914252 - DNA, 25 bp, Mus musculus
ctatgaaggcgtcggtatgcaatat

SEQ ID NO: 914253 - DNA, 25 bp, Mus musculus
ctatgaaggcgtgaatatgacatct

SEQ ID NO: 914254 - DNA, 25 bp, Mus musculus
ctatgaaggcgtgggtatgcaatat

SEQ ID NO: 914255 - DNA, 25 bp, Mus musculus
ctatgaatacagcagtggaggctgg

SEQ ID NO: 914256 - DNA, 25 bp, Mus musculus
ctatgaatacaggagtggaggctgg

SEQ ID NO: 914257 - DNA, 25 bp, Mus musculus
ctatgaatagaggcaaatttttgga

SEQ ID NO: 914258 - DNA, 25 bp, Mus musculus
ctatgaatagtggcaaatttttgga

SEQ ID NO: 914259 - DNA, 25 bp, Mus musculus
ctatgacaagccttacacggatgag

SEQ ID NO: 914260 - DNA, 25 bp, Mus musculus
ctatgacaaggcttacacggatgag

SEQ ID NO: 914261 - DNA, 25 bp, Mus musculus
ctatgacatcaccacccgagaaacc

SEQ ID NO: 914262 - DNA, 25 bp, Mus musculus
ctatgacatcaccagccgagaaacc

SEQ ID NO: 914263 - DNA, 25 bp, Mus musculus
ctatgaccagccagaagatgaatcc

SEQ ID NO: 914264 - DNA, 25 bp, Mus musculus
ctatgaccaggcagaagatgaatcc

SEQ ID NO: 914265 - DNA, 25 bp, Mus musculus
ctatgaccatctggtgctgggagga

SEQ ID NO: 914266 - DNA, 25 bp, Mus musculus
ctatgaccatgtggtgctgggagga

SEQ ID NO: 914267 - DNA, 25 bp, Mus musculus
ctatgacccctgcgaggcggtgctg

SEQ ID NO: 914268 - DNA, 25 bp, Mus musculus
ctatgacccctgcgtggcggtgctg

SEQ ID NO: 914269 - DNA, 25 bp, Mus musculus
ctatgaccttacagtcccttttgct

SEQ ID NO: 914270 - DNA, 25 bp, Mus musculus
ctatgaccttactgtcccttttgct

SEQ ID NO: 914271 - DNA, 25 bp, Mus musculus
ctatgacgttcagacgttcatcgtg

SEQ ID NO: 914272 - DNA, 25 bp, Mus musculus
ctatgacgttcagaggttcatcgtg

SEQ ID NO: 914273 - DNA, 25 bp, Mus musculus
ctatgactggaatggaggaacacca

SEQ ID NO: 914274 - DNA, 25 bp, Mus musculus
ctatgactggtatggaggaacacca

SEQ ID NO: 914275 - DNA, 25 bp, Mus musculus
ctatgacttcaacgctgacatctgg

SEQ ID NO: 914276 - DNA, 25 bp, Mus musculus
ctatgacttcaaggctgacatctgg

SEQ ID NO: 914277 - DNA, 25 bp, Mus musculus
ctatgacttgcccggttttctcgag

SEQ ID NO: 914278 - DNA, 25 bp, Mus musculus
ctatgacttggccggttttctcgag

SEQ ID NO: 914279 - DNA, 25 bp, Mus musculus
ctatgagaagataaagaaagacccc

SEQ ID NO: 914280 - DNA, 25 bp, Mus musculus
ctatgagaagattaagaaagacccc

SEQ ID NO: 914281 - DNA, 25 bp, Mus musculus
ctatgagcagctcaacatggacgac

SEQ ID NO: 914282 - DNA, 25 bp, Mus musculus
ctatgagcagctggggaccagtgcc

SEQ ID NO: 914283 - DNA, 25 bp, Mus musculus
ctatgagcaggtcaacatggacgac

SEQ ID NO: 914284 - DNA, 25 bp, Mus musculus
ctatgagcaggtggggaccagtgcc

SEQ ID NO: 914285 - DNA, 25 bp, Mus musculus
ctatgaggagcccttaagatacttt

SEQ ID NO: 914286 - DNA, 25 bp, Mus musculus
ctatgaggaggaccaggtagagcgg

SEQ ID NO: 914287 - DNA, 25 bp, Mus musculus
ctatgaggaggagcaggtagagcgg

SEQ ID NO: 914288 - DNA, 25 bp, Mus musculus
ctatgaggaggccttaagatacttt

SEQ ID NO: 914289 - DNA, 25 bp, Mus musculus
ctatgagtacctcacgaaatctgtc

SEQ ID NO: 914290 - DNA, 25 bp, Mus musculus
ctatgagtacctcacgttcaggaaa

SEQ ID NO: 914291 - DNA, 25 bp, Mus musculus
ctatgagtacctcaggaaatctgtc

SEQ ID NO: 914292 - DNA, 25 bp, Mus musculus
ctatgagtacctcaggttcaggaaa

SEQ ID NO: 914293 - DNA, 25 bp, Mus musculus
ctatgagtagtgcgatgagagtcat

SEQ ID NO: 914294 - DNA, 25 bp, Mus musculus
ctatgagtagtgggatgagagtcat

SEQ ID NO: 914295 - DNA, 25 bp, Mus musculus
ctatgagtcgctttatggccagtgc

SEQ ID NO: 914296 - DNA, 25 bp, Mus musculus
ctatgagtcggtttatggccagtgc

SEQ ID NO: 914297 - DNA, 25 bp, Mus musculus
ctatgagtttctcaagagctggact

SEQ ID NO: 914298 - DNA, 25 bp, Mus musculus
ctatgagtttgtcaagagctggact

SEQ ID NO: 914299 - DNA, 25 bp, Mus musculus
ctatgcagccagcccctgtgtcaaa

SEQ ID NO: 914300 - DNA, 25 bp, Mus musculus
ctatgcagccaggccctgtgtcaaa

SEQ ID NO: 914301 - DNA, 25 bp, Mus musculus
ctatgcagtcatcgctcttgagaat

SEQ ID NO: 914302 - DNA, 25 bp, Mus musculus
ctatgcagtcatggctcttgagaat

SEQ ID NO: 914303 - DNA, 25 bp, Mus musculus
ctatgcattcggcactgtgtggtat

SEQ ID NO: 914304 - DNA, 25 bp, Mus musculus
ctatgcattcgggactgtgtggtat

SEQ ID NO: 914305 - DNA, 25 bp, Mus musculus
ctatgccaccagctacgccatcact

SEQ ID NO: 914306 - DNA, 25 bp, Mus musculus
ctatgccaccaggtacgccatcact

SEQ ID NO: 914307 - DNA, 25 bp, Mus musculus
ctatgccttcttcgtttgatatcgt

SEQ ID NO: 914308 - DNA, 25 bp, Mus musculus
ctatgccttcttggtttgatatcgt

SEQ ID NO: 914309 - DNA, 25 bp, Mus musculus
ctatgcgaagcacatttatggtctg

SEQ ID NO: 914310 - DNA, 25 bp, Mus musculus
ctatgcgaagcacggtgtgcagatt

SEQ ID NO: 914311 - DNA, 25 bp, Mus musculus
ctatgcgaagcagatttatggtctg

SEQ ID NO: 914312 - DNA, 25 bp, Mus musculus
ctatgcgaagcagggtgtgcagatt

SEQ ID NO: 914313 - DNA, 25 bp, Mus musculus
ctatgctaagaatgagagccagacg

SEQ ID NO: 914314 - DNA, 25 bp, Mus musculus
ctatgctaagtatgagagccagacg

SEQ ID NO: 914315 - DNA, 25 bp, Mus musculus
ctatgctaataacatgtacctgaac

SEQ ID NO: 914316 - DNA, 25 bp, Mus musculus
ctatgctaattacatgtacctgaac

SEQ ID NO: 914317 - DNA, 25 bp, Mus musculus
ctatgctctggacactcttctcact

SEQ ID NO: 914318 - DNA, 25 bp, Mus musculus
ctatgctctggagactcttctcact

SEQ ID NO: 914319 - DNA, 25 bp, Mus musculus
ctatgctgtgctttgccactagctt

SEQ ID NO: 914320 - DNA, 25 bp, Mus musculus
ctatgctgtggtttgccactagctt

SEQ ID NO: 914321 - DNA, 25 bp, Mus musculus
ctatggaccaagctgttggggccac

SEQ ID NO: 914322 - DNA, 25 bp, Mus musculus
ctatggaccaaggtgttggggccac

SEQ ID NO: 914323 - DNA, 25 bp, Mus musculus
ctatggagagagtgctgaggctgta

SEQ ID NO: 914324 - DNA, 25 bp, Mus musculus
ctatggagagtgtgctgaggctgta

SEQ ID NO: 914325 - DNA, 25 bp, Mus musculus
ctatggcaagctgttccaggtgaga

SEQ ID NO: 914326 - DNA, 25 bp, Mus musculus
ctatggcaaggtgttccaggtgaga

SEQ ID NO: 914327 - DNA, 25 bp, Mus musculus
ctatggcatgagcgacagccgctca

SEQ ID NO: 914328 - DNA, 25 bp, Mus musculus
ctatggcatgagggacagccgctca

SEQ ID NO: 914329 - DNA, 25 bp, Mus musculus
ctatggctacaaatctctgctttct

SEQ ID NO: 914330 - DNA, 25 bp, Mus musculus
ctatggctacaattctctgctttct

SEQ ID NO: 914331 - DNA, 25 bp, Mus musculus
ctatggctatctcaccgtccttaat

SEQ ID NO: 914332 - DNA, 25 bp, Mus musculus
ctatggctatgtcaccgtccttaat

SEQ ID NO: 914333 - DNA, 25 bp, Mus musculus
ctatggctcagctaatgcggtggtg

SEQ ID NO: 914334 - DNA, 25 bp, Mus musculus
ctatggctcagctattgcggtggtg

SEQ ID NO: 914335 - DNA, 25 bp, Mus musculus
ctatggctccagatgggaatggtgg

SEQ ID NO: 914336 - DNA, 25 bp, Mus musculus
ctatggctccagttgggaatggtgg

SEQ ID NO: 914337 - DNA, 25 bp, Mus musculus
ctatggctcggtgtctcccttagaa

SEQ ID NO: 914338 - DNA, 25 bp, Mus musculus
ctatggctcggtgtctgctgctttt

SEQ ID NO: 914339 - DNA, 25 bp, Mus musculus
ctatggctcggtgtgtcccttagaa

SEQ ID NO: 914340 - DNA, 25 bp, Mus musculus
ctatggctcggtgtgtgctgctttt

SEQ ID NO: 914341 - DNA, 25 bp, Mus musculus
ctatgggatcagaattgatgatatt

SEQ ID NO: 914342 - DNA, 25 bp, Mus musculus
ctatgggatcagtattgatgatatt

SEQ ID NO: 914343 - DNA, 25 bp, Mus musculus
ctatgggatgtaactctcagtgaaa

SEQ ID NO: 914344 - DNA, 25 bp, Mus musculus
ctatgggatgtatctctcagtgaaa

SEQ ID NO: 914345 - DNA, 25 bp, Mus musculus
ctatgggcagctgttcacctacaag

SEQ ID NO: 914346 - DNA, 25 bp, Mus musculus
ctatgggcaggtattcacctacaag

SEQ ID NO: 914347 - DNA, 25 bp, Mus musculus
ctatgggcaggtgttcacctacaag

SEQ ID NO: 914348 - DNA, 25 bp, Mus musculus
ctatgggcaggttttcacctacaag

SEQ ID NO: 914349 - DNA, 25 bp, Mus musculus
ctatgggccctgcacgactgttccc

SEQ ID NO: 914350 - DNA, 25 bp, Mus musculus
ctatgggccctgcaggactgttccc

SEQ ID NO: 914351 - DNA, 25 bp, Mus musculus
ctatgggtcgcgggtctactctgtg

SEQ ID NO: 914352 - DNA, 25 bp, Mus musculus
ctatgggtcgcttccgggagcgcat

SEQ ID NO: 914353 - DNA, 25 bp, Mus musculus
ctatgggtcgggggtctactctgtg

SEQ ID NO: 914354 - DNA, 25 bp, Mus musculus
ctatgggtcggttccgggagcgcat

SEQ ID NO: 914355 - DNA, 25 bp, Mus musculus
ctatggtcagattgaccatggggtg

SEQ ID NO: 914356 - DNA, 25 bp, Mus musculus
ctatggtcagtttgaccatggggtg

SEQ ID NO: 914357 - DNA, 25 bp, Mus musculus
ctatggtgcagtgtcctctgcagta

SEQ ID NO: 914358 - DNA, 25 bp, Mus musculus
ctatggtgcagtgtgctctgcagta

SEQ ID NO: 914359 - DNA, 25 bp, Mus musculus
ctatggtgtgcttctctgggagatg

SEQ ID NO: 914360 - DNA, 25 bp, Mus musculus
ctatggtgtggttctctgggagatg

SEQ ID NO: 914361 - DNA, 25 bp, Mus musculus
ctatgtcagtgacgttcctgctgct

SEQ ID NO: 914362 - DNA, 25 bp, Mus musculus
ctatgtcagtgaggttcctgctgct

SEQ ID NO: 914363 - DNA, 25 bp, Mus musculus
ctatgtcatgatcgtgtttggcctt

SEQ ID NO: 914364 - DNA, 25 bp, Mus musculus
ctatgtcatgatggtgtttggcctt

SEQ ID NO: 914365 - DNA, 25 bp, Mus musculus
ctatgtcatgctggggttttttggt

SEQ ID NO: 914366 - DNA, 25 bp, Mus musculus
ctatgtcatggtggggttttttggt

SEQ ID NO: 914367 - DNA, 25 bp, Mus musculus
ctatgtctgccactgtgccccaggc

SEQ ID NO: 914368 - DNA, 25 bp, Mus musculus
ctatgtctgccagtgtgccccaggc

SEQ ID NO: 914369 - DNA, 25 bp, Mus musculus
ctatgtgcagcctgatagccctgaa

SEQ ID NO: 914370 - DNA, 25 bp, Mus musculus
ctatgtgcaggctgatagccctgaa

SEQ ID NO: 914371 - DNA, 25 bp, Mus musculus
ctatgtttagcgcagtgcttgacaa

SEQ ID NO: 914372 - DNA, 25 bp, Mus musculus
ctatgtttagggcagtgcttgacaa

SEQ ID NO: 914373 - DNA, 25 bp, Mus musculus
ctattaaaagagggtgcctcagaag

SEQ ID NO: 914374 - DNA, 25 bp, Mus musculus
ctattaaaagtgggtgcctcagaag

SEQ ID NO: 914375 - DNA, 25 bp, Mus musculus
ctattaacggcttgctaggaagagg

SEQ ID NO: 914376 - DNA, 25 bp, Mus musculus
ctattaacgggttgctaggaagagg

SEQ ID NO: 914377 - DNA, 25 bp, Mus musculus
ctattacatgcatacatgggcggca

SEQ ID NO: 914378 - DNA, 25 bp, Mus musculus
ctattacatgccaacaattctcttg

SEQ ID NO: 914379 - DNA, 25 bp, Mus musculus
ctattacatggatacatgggcggca

SEQ ID NO: 914380 - DNA, 25 bp, Mus musculus
ctattacatggcaacaattctcttg

SEQ ID NO: 914381 - DNA, 25 bp, Mus musculus
ctattaccaaatcgaacaccgagcg

SEQ ID NO: 914382 - DNA, 25 bp, Mus musculus
ctattaccaaatggaacaccgagcg

SEQ ID NO: 914383 - DNA, 25 bp, Mus musculus
ctattataaactgatttcatcagtt

SEQ ID NO: 914384 - DNA, 25 bp, Mus musculus
ctattataaagtgatttcatcagtt

SEQ ID NO: 914385 - DNA, 25 bp, Mus musculus
ctattatcactgcgccctctctttc

SEQ ID NO: 914386 - DNA, 25 bp, Mus musculus
ctattatcactgggccctctctttc

SEQ ID NO: 914387 - DNA, 25 bp, Mus musculus
ctattatcagcacctgaacacagag

SEQ ID NO: 914388 - DNA, 25 bp, Mus musculus
ctattatcagcagctgaacacagag

SEQ ID NO: 914389 - DNA, 25 bp, Mus musculus
ctattcaccgatcacaaacctgata

SEQ ID NO: 914390 - DNA, 25 bp, Mus musculus
ctattcaccgatcacgacaacatcc

SEQ ID NO: 914391 - DNA, 25 bp, Mus musculus
ctattcaccgatcagaaacctgata

SEQ ID NO: 914392 - DNA, 25 bp, Mus musculus
ctattcaccgatcaggacaacatcc

SEQ ID NO: 914393 - DNA, 25 bp, Mus musculus
ctattcagcaggaaccgtcccaggt

SEQ ID NO: 914394 - DNA, 25 bp, Mus musculus
ctattcagcaggaactaaaatctct

SEQ ID NO: 914395 - DNA, 25 bp, Mus musculus
ctattcagcaggaagcgtcccaggt

SEQ ID NO: 914396 - DNA, 25 bp, Mus musculus
ctattcagcaggaagtaaaatctct

SEQ ID NO: 914397 - DNA, 25 bp, Mus musculus
ctattcagcattaacagaaattgct

SEQ ID NO: 914398 - DNA, 25 bp, Mus musculus
ctattcagcattaagagaaattgct

SEQ ID NO: 914399 - DNA, 25 bp, Mus musculus
ctattccaaagaaactggcattgcc

SEQ ID NO: 914400 - DNA, 25 bp, Mus musculus
ctattccaaagatactggcattgcc

SEQ ID NO: 914401 - DNA, 25 bp, Mus musculus
ctattcccagatctgtggggaaaga

SEQ ID NO: 914402 - DNA, 25 bp, Mus musculus
ctattcccagttctgtggggaaaga

SEQ ID NO: 914403 - DNA, 25 bp, Mus musculus
ctattccttcagctcgctggatttg

SEQ ID NO: 914404 - DNA, 25 bp, Mus musculus
ctattccttcaggtcgctggatttg

SEQ ID NO: 914405 - DNA, 25 bp, Mus musculus
ctattcgtttgtcacattttccact

SEQ ID NO: 914406 - DNA, 25 bp, Mus musculus
ctattcgtttgtcagattttccact

SEQ ID NO: 914407 - DNA, 25 bp, Mus musculus
ctattctaagcacatgctaccaagt

SEQ ID NO: 914408 - DNA, 25 bp, Mus musculus
ctattctaagcacgaagatgctacc

SEQ ID NO: 914409 - DNA, 25 bp, Mus musculus
ctattctaagcagatgctaccaagt

SEQ ID NO: 914410 - DNA, 25 bp, Mus musculus
ctattctaagcaggaagatgctacc

SEQ ID NO: 914411 - DNA, 25 bp, Mus musculus
ctattctggtcaaagaacggtgacc

SEQ ID NO: 914412 - DNA, 25 bp, Mus musculus
ctattctggtgaaagaacggtgacc

SEQ ID NO: 914413 - DNA, 25 bp, Mus musculus
ctattctgtgaacaaaatgatgaag

SEQ ID NO: 914414 - DNA, 25 bp, Mus musculus
ctattctgtgaagaaaatgatgaag

SEQ ID NO: 914415 - DNA, 25 bp, Mus musculus
ctattcttactacacgaatgagtgc

SEQ ID NO: 914416 - DNA, 25 bp, Mus musculus
ctattcttactacaggaatgagtgc

SEQ ID NO: 914417 - DNA, 25 bp, Mus musculus
ctattgaagacgcctgtgtggttcc

SEQ ID NO: 914418 - DNA, 25 bp, Mus musculus
ctattgaagacggctgtgtggttcc

SEQ ID NO: 914419 - DNA, 25 bp, Mus musculus
ctattgagataaaagccagagttac

SEQ ID NO: 914420 - DNA, 25 bp, Mus musculus
ctattgagataatagccagagttac

SEQ ID NO: 914421 - DNA, 25 bp, Mus musculus
ctattgaggcaagacgctaaagaag

SEQ ID NO: 914422 - DNA, 25 bp, Mus musculus
ctattgaggcaagaggctaaagaag

SEQ ID NO: 914423 - DNA, 25 bp, Mus musculus
ctattgatggctacctgtcccacac

SEQ ID NO: 914424 - DNA, 25 bp, Mus musculus
ctattgatgggtacctgtcccacac

SEQ ID NO: 914425 - DNA, 25 bp, Mus musculus
ctattgcaatagaaagtgccagaaa

SEQ ID NO: 914426 - DNA, 25 bp, Mus musculus
ctattgcaatagtaagtgccagaaa

SEQ ID NO: 914427 - DNA, 25 bp, Mus musculus
ctattgcacgcatggtgaactttga

SEQ ID NO: 914428 - DNA, 25 bp, Mus musculus
ctattgcacggatggtgaactttga

SEQ ID NO: 914429 - DNA, 25 bp, Mus musculus
ctattggcacaacgtgcaaatataa

SEQ ID NO: 914430 - DNA, 25 bp, Mus musculus
ctattggcacaaggtgcaaatataa

SEQ ID NO: 914431 - DNA, 25 bp, Mus musculus
ctattgtagtaacccaattaccttg

SEQ ID NO: 914432 - DNA, 25 bp, Mus musculus
ctattgtagtaagccaattaccttg

SEQ ID NO: 914433 - DNA, 25 bp, Mus musculus
ctattgtgagcaactaatgaccatt

SEQ ID NO: 914434 - DNA, 25 bp, Mus musculus
ctattgtgaggaactaatgaccatt

SEQ ID NO: 914435 - DNA, 25 bp, Mus musculus
ctatttaagaagagaaggtggctgc

SEQ ID NO: 914436 - DNA, 25 bp, Mus musculus
ctatttaagaagatgaaaccagatt

SEQ ID NO: 914437 - DNA, 25 bp, Mus musculus
ctatttaagaagtgaaggtggctgc

SEQ ID NO: 914438 - DNA, 25 bp, Mus musculus
ctatttaagaagttgaaaccagatt

SEQ ID NO: 914439 - DNA, 25 bp, Mus musculus
ctatttccagcgcttccgagtggac

SEQ ID NO: 914440 - DNA, 25 bp, Mus musculus
ctatttccagggcttccgagtggac

SEQ ID NO: 914441 - DNA, 25 bp, Mus musculus
ctatttgcagcaccacattaaatac

SEQ ID NO: 914442 - DNA, 25 bp, Mus musculus
ctatttgcaggaccacattaaatac

SEQ ID NO: 914443 - DNA, 25 bp, Mus musculus
ctatttgcgtagccgcctgtgtggt

SEQ ID NO: 914444 - DNA, 25 bp, Mus musculus
ctatttgcgtaggcgcctgtgtggt

SEQ ID NO: 914445 - DNA, 25 bp, Mus musculus
ctatttgtggcattgttcatcacct

SEQ ID NO: 914446 - DNA, 25 bp, Mus musculus
ctatttgtgggattgttcatcacct

SEQ ID NO: 914447 - DNA, 25 bp, Mus musculus
ctattttaagcgaataatgcaggat

SEQ ID NO: 914448 - DNA, 25 bp, Mus musculus
ctattttaagggaataatgcaggat

SEQ ID NO: 914449 - DNA, 25 bp, Mus musculus
ctattttctggatgcatcattgctc

SEQ ID NO: 914450 - DNA, 25 bp, Mus musculus
ctattttctggatggatcattgctc

SEQ ID NO: 914451 - DNA, 25 bp, Mus musculus
ctcaaaaagtgtgcaggtttcaact

SEQ ID NO: 914452 - DNA, 25 bp, Mus musculus
ctcaaaaagtgtgctggtttcaact

SEQ ID NO: 914453 - DNA, 25 bp, Mus musculus
ctcaaaaggctcaacggctttgctg

SEQ ID NO: 914454 - DNA, 25 bp, Mus musculus
ctcaaaaggctcaagggctttgctg

SEQ ID NO: 914455 - DNA, 25 bp, Mus musculus
ctcaaaattcaaatgctgatagccc

SEQ ID NO: 914456 - DNA, 25 bp, Mus musculus
ctcaaaattcaaattctgttgcccc

SEQ ID NO: 914457 - DNA, 25 bp, Mus musculus
ctcaaaattcaattgctgatagccc

SEQ ID NO: 914458 - DNA, 25 bp, Mus musculus
ctcaaaattcaatttctgttgcccc

SEQ ID NO: 914459 - DNA, 25 bp, Mus musculus
ctcaaacaagcttcagagtctcagg

SEQ ID NO: 914460 - DNA, 25 bp, Mus musculus
ctcaaacaaggttcagagtctcagg

SEQ ID NO: 914461 - DNA, 25 bp, Mus musculus
ctcaaacaataggtgaccagtgtgt

SEQ ID NO: 914462 - DNA, 25 bp, Mus musculus
ctcaaacaatgcagacttttagttg

SEQ ID NO: 914463 - DNA, 25 bp, Mus musculus
ctcaaacaatgcagtcttttagttg

SEQ ID NO: 914464 - DNA, 25 bp, Mus musculus
ctcaaacaattggtgaccagtgtgt

SEQ ID NO: 914465 - DNA, 25 bp, Mus musculus
ctcaaacattatgacggtgctctcg

SEQ ID NO: 914466 - DNA, 25 bp, Mus musculus
ctcaaacattatgagggtgctctcg

SEQ ID NO: 914467 - DNA, 25 bp, Mus musculus
ctcaaaccagcattatcccacctat

SEQ ID NO: 914468 - DNA, 25 bp, Mus musculus
ctcaaaccagctgatcatgctaacc

SEQ ID NO: 914469 - DNA, 25 bp, Mus musculus
ctcaaaccaggattatcccacctat

SEQ ID NO: 914470 - DNA, 25 bp, Mus musculus
ctcaaaccaggtgatcatgctaacc

SEQ ID NO: 914471 - DNA, 25 bp, Mus musculus
ctcaaactaactggcctgcttgatt

SEQ ID NO: 914472 - DNA, 25 bp, Mus musculus
ctcaaactaagtggcctgcttgatt

SEQ ID NO: 914473 - DNA, 25 bp, Mus musculus
ctcaaactctcagacaaccgagccc

SEQ ID NO: 914474 - DNA, 25 bp, Mus musculus
ctcaaactctcagagaaccgagccc

SEQ ID NO: 914475 - DNA, 25 bp, Mus musculus
ctcaaagccatgctttgactctgct

SEQ ID NO: 914476 - DNA, 25 bp, Mus musculus
ctcaaagccatggtttgactctgct

SEQ ID NO: 914477 - DNA, 25 bp, Mus musculus
ctcaaagctctggacgaccttggaa

SEQ ID NO: 914478 - DNA, 25 bp, Mus musculus
ctcaaagctctggaggaccttggaa

SEQ ID NO: 914479 - DNA, 25 bp, Mus musculus
ctcaaaggactgaacggagtggaaa

SEQ ID NO: 914480 - DNA, 25 bp, Mus musculus
ctcaaaggactgaagggagtggaaa

SEQ ID NO: 914481 - DNA, 25 bp, Mus musculus
ctcaaaggagaactgcagtttggct

SEQ ID NO: 914482 - DNA, 25 bp, Mus musculus
ctcaaaggagaagtgcagtttggct

SEQ ID NO: 914483 - DNA, 25 bp, Mus musculus
ctcaaaggtcttaacggtgagccag

SEQ ID NO: 914484 - DNA, 25 bp, Mus musculus
ctcaaaggtcttaagggtgagccag

SEQ ID NO: 914485 - DNA, 25 bp, Mus musculus
ctcaaataaacaagatacattattt

SEQ ID NO: 914486 - DNA, 25 bp, Mus musculus
ctcaaataaagaagatacattattt

SEQ ID NO: 914487 - DNA, 25 bp, Mus musculus
ctcaaatgacagcggcatcgatgtg

SEQ ID NO: 914488 - DNA, 25 bp, Mus musculus
ctcaaatgacaggggcatcgatgtg

SEQ ID NO: 914489 - DNA, 25 bp, Mus musculus
ctcaaattctcacgacagcagccct

SEQ ID NO: 914490 - DNA, 25 bp, Mus musculus
ctcaaattctcaggacagcagccct

SEQ ID NO: 914491 - DNA, 25 bp, Mus musculus
ctcaacaaaacggctctactacatg

SEQ ID NO: 914492 - DNA, 25 bp, Mus musculus
ctcaacaaaagggctctactacatg

SEQ ID NO: 914493 - DNA, 25 bp, Mus musculus
ctcaacaaacctcgttggcatggac

SEQ ID NO: 914494 - DNA, 25 bp, Mus musculus
ctcaacaaacctggttggcatggac

SEQ ID NO: 914495 - DNA, 25 bp, Mus musculus
ctcaacacagaccctgctctcgact

SEQ ID NO: 914496 - DNA, 25 bp, Mus musculus
ctcaacacagtccctgctctcgact

SEQ ID NO: 914497 - DNA, 25 bp, Mus musculus
ctcaacagaacacgatttgtgcagg

SEQ ID NO: 914498 - DNA, 25 bp, Mus musculus
ctcaacagaacactgctcttggctc

SEQ ID NO: 914499 - DNA, 25 bp, Mus musculus
ctcaacagaacaggatttgtgcagg

SEQ ID NO: 914500 - DNA, 25 bp, Mus musculus
ctcaacagaacagtgctcttggctc

SEQ ID NO: 914501 - DNA, 25 bp, Mus musculus
ctcaacagacatttgctccaagtac

SEQ ID NO: 914502 - DNA, 25 bp, Mus musculus
ctcaacagacttttgctccaagtac

SEQ ID NO: 914503 - DNA, 25 bp, Mus musculus
ctcaacagccagcctctgaggtcat

SEQ ID NO: 914504 - DNA, 25 bp, Mus musculus
ctcaacagccaggctctgaggtcat

SEQ ID NO: 914505 - DNA, 25 bp, Mus musculus
ctcaacataacgaactggagcgccg

SEQ ID NO: 914506 - DNA, 25 bp, Mus musculus
ctcaacataacgaagtggagcgccg

SEQ ID NO: 914507 - DNA, 25 bp, Mus musculus
ctcaacatccagccaggcattaatg

SEQ ID NO: 914508 - DNA, 25 bp, Mus musculus
ctcaacatccaggcaggcattaatg

SEQ ID NO: 914509 - DNA, 25 bp, Mus musculus
ctcaacatggagaggcaccacttcc

SEQ ID NO: 914510 - DNA, 25 bp, Mus musculus
ctcaacatggtgaggcaccacttcc

SEQ ID NO: 914511 - DNA, 25 bp, Mus musculus
ctcaacatgtatggttttcggaagg

SEQ ID NO: 914512 - DNA, 25 bp, Mus musculus
ctcaacatgtttggttttcggaagg

SEQ ID NO: 914513 - DNA, 25 bp, Mus musculus
ctcaaccaccatcgagaacagtctc

SEQ ID NO: 914514 - DNA, 25 bp, Mus musculus
ctcaaccaccatggagaacagtctc

SEQ ID NO: 914515 - DNA, 25 bp, Mus musculus
ctcaaccagaagatggaggtgcagc

SEQ ID NO: 914516 - DNA, 25 bp, Mus musculus
ctcaaccagaagttggaggtgcagc

SEQ ID NO: 914517 - DNA, 25 bp, Mus musculus
ctcaaccctcgtctcttctgtcgga

SEQ ID NO: 914518 - DNA, 25 bp, Mus musculus
ctcaaccctcgtgtcttctgtcgga

SEQ ID NO: 914519 - DNA, 25 bp, Mus musculus
ctcaacctaaatcacgaattcgtca

SEQ ID NO: 914520 - DNA, 25 bp, Mus musculus
ctcaacctaaatcaggaattcgtca

SEQ ID NO: 914521 - DNA, 25 bp, Mus musculus
ctcaacctggataccatggcctggg

SEQ ID NO: 914522 - DNA, 25 bp, Mus musculus
ctcaacctggtcaatgaaacaactg

SEQ ID NO: 914523 - DNA, 25 bp, Mus musculus
ctcaacctggtcacccatccctgac

SEQ ID NO: 914524 - DNA, 25 bp, Mus musculus
ctcaacctggtctatgaaacaactg

SEQ ID NO: 914525 - DNA, 25 bp, Mus musculus
ctcaacctggtctcccatccctgac

SEQ ID NO: 914526 - DNA, 25 bp, Mus musculus
ctcaacctggttaccatggcctggg

SEQ ID NO: 914527 - DNA, 25 bp, Mus musculus
ctcaacgccaagctcgctgttcaga

SEQ ID NO: 914528 - DNA, 25 bp, Mus musculus
ctcaacgccaaggtcgctgttcaga

SEQ ID NO: 914529 - DNA, 25 bp, Mus musculus
ctcaacggcaagacccaatcagaga

SEQ ID NO: 914530 - DNA, 25 bp, Mus musculus
ctcaacggcaagtcccaatcagaga

SEQ ID NO: 914531 - DNA, 25 bp, Mus musculus
ctcaactacctccgactctgtgtga

SEQ ID NO: 914532 - DNA, 25 bp, Mus musculus
ctcaactacctccgtctctgtgtga

SEQ ID NO: 914533 - DNA, 25 bp, Mus musculus
ctcaactactgccaggaggcggtgg

SEQ ID NO: 914534 - DNA, 25 bp, Mus musculus
ctcaactactgcgaggaggcggtgg

SEQ ID NO: 914535 - DNA, 25 bp, Mus musculus
ctcaactccaccctgaagagctttg

SEQ ID NO: 914536 - DNA, 25 bp, Mus musculus
ctcaactccaccgtgaagagctttg

SEQ ID NO: 914537 - DNA, 25 bp, Mus musculus
ctcaactgccagaaccttgtgcgct

SEQ ID NO: 914538 - DNA, 25 bp, Mus musculus
ctcaactgccagtaccttgtgcgct

SEQ ID NO: 914539 - DNA, 25 bp, Mus musculus
ctcaactggaagcacgacaacaatc

SEQ ID NO: 914540 - DNA, 25 bp, Mus musculus
ctcaactggaagcaggacaacaatc

SEQ ID NO: 914541 - DNA, 25 bp, Mus musculus
ctcaactggctgatgcttgacttcc

SEQ ID NO: 914542 - DNA, 25 bp, Mus musculus
ctcaactggctgttgcttgacttcc

SEQ ID NO: 914543 - DNA, 25 bp, Mus musculus
ctcaagaaagaacactcctgccagc

SEQ ID NO: 914544 - DNA, 25 bp, Mus musculus
ctcaagaaagaagactcctgccagc

SEQ ID NO: 914545 - DNA, 25 bp, Mus musculus
ctcaagaaagatgcgccaggaggag

SEQ ID NO: 914546 - DNA, 25 bp, Mus musculus
ctcaagaaagcacagatcgttacga

SEQ ID NO: 914547 - DNA, 25 bp, Mus musculus
ctcaagaaagcatggatgatccata

SEQ ID NO: 914548 - DNA, 25 bp, Mus musculus
ctcaagaaaggacagatcgttacga

SEQ ID NO: 914549 - DNA, 25 bp, Mus musculus
ctcaagaaaggatggatgatccata

SEQ ID NO: 914550 - DNA, 25 bp, Mus musculus
ctcaagaaagttgcgccaggaggag

SEQ ID NO: 914551 - DNA, 25 bp, Mus musculus
ctcaagacatcgagtgctgcggagc

SEQ ID NO: 914552 - DNA, 25 bp, Mus musculus
ctcaagacatggagtgctgcggagc

SEQ ID NO: 914553 - DNA, 25 bp, Mus musculus
ctcaagagaacattctcagcgacca

SEQ ID NO: 914554 - DNA, 25 bp, Mus musculus
ctcaagagaagattctcagcgacca

SEQ ID NO: 914555 - DNA, 25 bp, Mus musculus
ctcaagaggaagccagtagagtcca

SEQ ID NO: 914556 - DNA, 25 bp, Mus musculus
ctcaagaggaagcccgaggatgaga

SEQ ID NO: 914557 - DNA, 25 bp, Mus musculus
ctcaagaggaaggcagtagagtcca

SEQ ID NO: 914558 - DNA, 25 bp, Mus musculus
ctcaagaggaaggccgaggatgaga

SEQ ID NO: 914559 - DNA, 25 bp, Mus musculus
ctcaagcaagcagcagactctggtc

SEQ ID NO: 914560 - DNA, 25 bp, Mus musculus
ctcaagcaaggagcagactctggtc

SEQ ID NO: 914561 - DNA, 25 bp, Mus musculus
ctcaagcagggaccaggccctctgc

SEQ ID NO: 914562 - DNA, 25 bp, Mus musculus
ctcaagcagggaccatggttggggt

SEQ ID NO: 914563 - DNA, 25 bp, Mus musculus
ctcaagcagggacctggccctctgc

SEQ ID NO: 914564 - DNA, 25 bp, Mus musculus
ctcaagcagggaccttggttggggt

SEQ ID NO: 914565 - DNA, 25 bp, Mus musculus
ctcaagcctgcgcacttgactgcgt

SEQ ID NO: 914566 - DNA, 25 bp, Mus musculus
ctcaagcctgcgcggacttgactgc

SEQ ID NO: 914567 - DNA, 25 bp, Mus musculus
ctcaagcctgcggacttgactgcgt

SEQ ID NO: 914568 - DNA, 25 bp, Mus musculus
ctcaagcctgcggggacttgactgc

SEQ ID NO: 914569 - DNA, 25 bp, Mus musculus
ctcaagccttctaacctacctgaac

SEQ ID NO: 914570 - DNA, 25 bp, Mus musculus
ctcaagccttctaagctacctgaac

SEQ ID NO: 914571 - DNA, 25 bp, Mus musculus
ctcaagctcctccacgttgtctatc

SEQ ID NO: 914572 - DNA, 25 bp, Mus musculus
ctcaagctcctccaggttgtctatc

SEQ ID NO: 914573 - DNA, 25 bp, Mus musculus
ctcaagctcgctggcagggtaaaga

SEQ ID NO: 914574 - DNA, 25 bp, Mus musculus
ctcaagctcggtggcagggtaaaga

SEQ ID NO: 914575 - DNA, 25 bp, Mus musculus
ctcaaggaccgagacggttacacat

SEQ ID NO: 914576 - DNA, 25 bp, Mus musculus
ctcaaggaccgagacgtgagacgtg

SEQ ID NO: 914577 - DNA, 25 bp, Mus musculus
ctcaaggaccgagacgtgatctgta

SEQ ID NO: 914578 - DNA, 25 bp, Mus musculus
ctcaaggaccgagagggttacacat

SEQ ID NO: 914579 - DNA, 25 bp, Mus musculus
ctcaaggaccgagaggtgagacgtg

SEQ ID NO: 914580 - DNA, 25 bp, Mus musculus
ctcaaggaccgagaggtgatctgta

SEQ ID NO: 914581 - DNA, 25 bp, Mus musculus
ctcaaggatctgcacaaattagtct

SEQ ID NO: 914582 - DNA, 25 bp, Mus musculus
ctcaaggatctgcagaaattagtct

SEQ ID NO: 914583 - DNA, 25 bp, Mus musculus
ctcaaggctaagccccaggccctgg

SEQ ID NO: 914584 - DNA, 25 bp, Mus musculus
ctcaaggctaaggcccaggccctgg

SEQ ID NO: 914585 - DNA, 25 bp, Mus musculus
ctcaagggcattggcgatgaagctc

SEQ ID NO: 914586 - DNA, 25 bp, Mus musculus
ctcaagggcattggggatgaagctc

SEQ ID NO: 914587 - DNA, 25 bp, Mus musculus
ctcaaggggagcagcgagcggaggg

SEQ ID NO: 914588 - DNA, 25 bp, Mus musculus
ctcaaggggagcagggagcggaggg

SEQ ID NO: 914589 - DNA, 25 bp, Mus musculus
ctcaagggtgacaacggtgactcag

SEQ ID NO: 914590 - DNA, 25 bp, Mus musculus
ctcaagggtgacaagggtgactcag

SEQ ID NO: 914591 - DNA, 25 bp, Mus musculus
ctcaagggtgccaacggggagccag

SEQ ID NO: 914592 - DNA, 25 bp, Mus musculus
ctcaagggtgccaagggggagccag

SEQ ID NO: 914593 - DNA, 25 bp, Mus musculus
ctcaaggtcctgaaccactcgggga

SEQ ID NO: 914594 - DNA, 25 bp, Mus musculus
ctcaaggtcctgaagcactcgggga

SEQ ID NO: 914595 - DNA, 25 bp, Mus musculus
ctcaagtccaccaacatctcattta

SEQ ID NO: 914596 - DNA, 25 bp, Mus musculus
ctcaagtccaccaagatctcattta

SEQ ID NO: 914597 - DNA, 25 bp, Mus musculus
ctcaagtctgagtttgtgatcctga

SEQ ID NO: 914598 - DNA, 25 bp, Mus musculus
ctcaagtctgtgtttgtgatcctga

SEQ ID NO: 914599 - DNA, 25 bp, Mus musculus
ctcaagtggaaccgccaatgcagca

SEQ ID NO: 914600 - DNA, 25 bp, Mus musculus
ctcaagtggaacggccaatgcagca

SEQ ID NO: 914601 - DNA, 25 bp, Mus musculus
ctcaataggaggcttaaggtcaata

SEQ ID NO: 914602 - DNA, 25 bp, Mus musculus
ctcaataggagggttaaggtcaata

SEQ ID NO: 914603 - DNA, 25 bp, Mus musculus
ctcaatcttatccgcaaagctaaaa

SEQ ID NO: 914604 - DNA, 25 bp, Mus musculus
ctcaatcttatcggcaaagctaaaa

SEQ ID NO: 914605 - DNA, 25 bp, Mus musculus
ctcaatgaaaatctcatggttttta

SEQ ID NO: 914606 - DNA, 25 bp, Mus musculus
ctcaatgaaaatgtcatggttttta

SEQ ID NO: 914607 - DNA, 25 bp, Mus musculus
ctcaatgaagcaagtgcttgctcct

SEQ ID NO: 914608 - DNA, 25 bp, Mus musculus
ctcaatgaaggaagtgcttgctcct

SEQ ID NO: 914609 - DNA, 25 bp, Mus musculus
ctcaatgctgaacgtgtgattagct

SEQ ID NO: 914610 - DNA, 25 bp, Mus musculus
ctcaatgctgaaggtgtgattagct

SEQ ID NO: 914611 - DNA, 25 bp, Mus musculus
ctcaatgtcaaccaccccagtccag

SEQ ID NO: 914612 - DNA, 25 bp, Mus musculus
ctcaatgtcaacgaccccagtccag

SEQ ID NO: 914613 - DNA, 25 bp, Mus musculus
ctcaattcaggacgcgtggtcccag

SEQ ID NO: 914614 - DNA, 25 bp, Mus musculus
ctcaattcaggacgggtggtcccag

SEQ ID NO: 914615 - DNA, 25 bp, Mus musculus
ctcaattcttatattgtccccattg

SEQ ID NO: 914616 - DNA, 25 bp, Mus musculus
ctcaattcttttattgtccccattg

SEQ ID NO: 914617 - DNA, 25 bp, Mus musculus
ctcaatttcactcaagagtttccat

SEQ ID NO: 914618 - DNA, 25 bp, Mus musculus
ctcaatttcagtcaagagtttccat

SEQ ID NO: 914619 - DNA, 25 bp, Mus musculus
ctcacaacatcgacaatgtctgcat

SEQ ID NO: 914620 - DNA, 25 bp, Mus musculus
ctcacaacatcgtcaatgtctgcat

SEQ ID NO: 914621 - DNA, 25 bp, Mus musculus
ctcacaaccaatgacgaatacttgg

SEQ ID NO: 914622 - DNA, 25 bp, Mus musculus
ctcacaaccaatgaggaatacttgg

SEQ ID NO: 914623 - DNA, 25 bp, Mus musculus
ctcacaacggacgcctccttggcat

SEQ ID NO: 914624 - DNA, 25 bp, Mus musculus
ctcacaacggcattgtcttggggat

SEQ ID NO: 914625 - DNA, 25 bp, Mus musculus
ctcacaacgggattgtcttggggat

SEQ ID NO: 914626 - DNA, 25 bp, Mus musculus
ctcacaacggtcgcctccttggcat

SEQ ID NO: 914627 - DNA, 25 bp, Mus musculus
ctcacaatcctttaccagctactcc

SEQ ID NO: 914628 - DNA, 25 bp, Mus musculus
ctcacaatcctttagcagctactcc

SEQ ID NO: 914629 - DNA, 25 bp, Mus musculus
ctcacacaagcacctcacccggtgc

SEQ ID NO: 914630 - DNA, 25 bp, Mus musculus
ctcacacaaggacctcacccggtgc

SEQ ID NO: 914631 - DNA, 25 bp, Mus musculus
ctcacaccaaagcagtgccaggagg

SEQ ID NO: 914632 - DNA, 25 bp, Mus musculus
ctcacaccaaaggagtgccaggagg

SEQ ID NO: 914633 - DNA, 25 bp, Mus musculus
ctcacacgctgtgcagaatgagcaa

SEQ ID NO: 914634 - DNA, 25 bp, Mus musculus
ctcacacgctgtgctgaatgagcaa

SEQ ID NO: 914635 - DNA, 25 bp, Mus musculus
ctcacactcaggcgacaattcaagc

SEQ ID NO: 914636 - DNA, 25 bp, Mus musculus
ctcacactcaggggacaattcaagc

SEQ ID NO: 914637 - DNA, 25 bp, Mus musculus
ctcacagaagagagctgtgaattcc

SEQ ID NO: 914638 - DNA, 25 bp, Mus musculus
ctcacagaagatacccagctattgt

SEQ ID NO: 914639 - DNA, 25 bp, Mus musculus
ctcacagaagcctgcagagcctatc

SEQ ID NO: 914640 - DNA, 25 bp, Mus musculus
ctcacagaagcctgttcatttagaa

SEQ ID NO: 914641 - DNA, 25 bp, Mus musculus
ctcacagaaggctgcagagcctatc

SEQ ID NO: 914642 - DNA, 25 bp, Mus musculus
ctcacagaaggctgttcatttagaa

SEQ ID NO: 914643 - DNA, 25 bp, Mus musculus
ctcacagaagtgagctgtgaattcc

SEQ ID NO: 914644 - DNA, 25 bp, Mus musculus
ctcacagaagttacccagctattgt

SEQ ID NO: 914645 - DNA, 25 bp, Mus musculus
ctcacagagcacagctgtcccagaa

SEQ ID NO: 914646 - DNA, 25 bp, Mus musculus
ctcacagagcactgctgtcccagaa

SEQ ID NO: 914647 - DNA, 25 bp, Mus musculus
ctcacagatgcccactttgaggaca

SEQ ID NO: 914648 - DNA, 25 bp, Mus musculus
ctcacagatggccactttgaggaca

SEQ ID NO: 914649 - DNA, 25 bp, Mus musculus
ctcacagcatgactctgtgtccatt

SEQ ID NO: 914650 - DNA, 25 bp, Mus musculus
ctcacagcatgactgtgtgtccatt

SEQ ID NO: 914651 - DNA, 25 bp, Mus musculus
ctcacagctctgcagatggtgaaag

SEQ ID NO: 914652 - DNA, 25 bp, Mus musculus
ctcacagctctggagatggtgaaag

SEQ ID NO: 914653 - DNA, 25 bp, Mus musculus
ctcacagctttccacaattcctcag

SEQ ID NO: 914654 - DNA, 25 bp, Mus musculus
ctcacagctttccacacttacaaca

SEQ ID NO: 914655 - DNA, 25 bp, Mus musculus
ctcacagctttccagaattcctcag

SEQ ID NO: 914656 - DNA, 25 bp, Mus musculus
ctcacagctttccagacttacaaca

SEQ ID NO: 914657 - DNA, 25 bp, Mus musculus
ctcacaggacccaacggagagccag

SEQ ID NO: 914658 - DNA, 25 bp, Mus musculus
ctcacaggacccaagggagagccag

SEQ ID NO: 914659 - DNA, 25 bp, Mus musculus
ctcacaggccgagacgttgcaataa

SEQ ID NO: 914660 - DNA, 25 bp, Mus musculus
ctcacaggccgagaggttgcaataa

SEQ ID NO: 914661 - DNA, 25 bp, Mus musculus
ctcacaggtaaccatgaggtcatcg

SEQ ID NO: 914662 - DNA, 25 bp, Mus musculus
ctcacaggtaacgatgaggtcatcg

SEQ ID NO: 914663 - DNA, 25 bp, Mus musculus
ctcacagtcctcgacacttcacccg

SEQ ID NO: 914664 - DNA, 25 bp, Mus musculus
ctcacagtcctcgagacttcacccg

SEQ ID NO: 914665 - DNA, 25 bp, Mus musculus
ctcacagtctcacaaaccattgaat

SEQ ID NO: 914666 - DNA, 25 bp, Mus musculus
ctcacagtctcacccacagagaacc

SEQ ID NO: 914667 - DNA, 25 bp, Mus musculus
ctcacagtctcacgacccatcgaaa

SEQ ID NO: 914668 - DNA, 25 bp, Mus musculus
ctcacagtctcagaaaccattgaat

SEQ ID NO: 914669 - DNA, 25 bp, Mus musculus
ctcacagtctcagccacagagaacc

SEQ ID NO: 914670 - DNA, 25 bp, Mus musculus
ctcacagtctcaggacccatcgaaa

SEQ ID NO: 914671 - DNA, 25 bp, Mus musculus
ctcacagtgaagccccgtgagcact

SEQ ID NO: 914672 - DNA, 25 bp, Mus musculus
ctcacagtgaaggcccgtgagcact

SEQ ID NO: 914673 - DNA, 25 bp, Mus musculus
ctcacatacaaacctgggagctgat

SEQ ID NO: 914674 - DNA, 25 bp, Mus musculus
ctcacatacatacctgggagctgat

SEQ ID NO: 914675 - DNA, 25 bp, Mus musculus
ctcacatgaccagtcatcggcgcca

SEQ ID NO: 914676 - DNA, 25 bp, Mus musculus
ctcacatgaccagtctcgttaggag

SEQ ID NO: 914677 - DNA, 25 bp, Mus musculus
ctcacatgaccagtgatcggcgcca

SEQ ID NO: 914678 - DNA, 25 bp, Mus musculus
ctcacatgaccagtgtcgttaggag

SEQ ID NO: 914679 - DNA, 25 bp, Mus musculus
ctcaccaaagctactcgttttggct

SEQ ID NO: 914680 - DNA, 25 bp, Mus musculus
ctcaccaaaggtactcgttttggct

SEQ ID NO: 914681 - DNA, 25 bp, Mus musculus
ctcaccaacctgcacatggcagcag

SEQ ID NO: 914682 - DNA, 25 bp, Mus musculus
ctcaccaacctgcacatggcagctc

SEQ ID NO: 914683 - DNA, 25 bp, Mus musculus
ctcaccaacctgcagatggcagcag

SEQ ID NO: 914684 - DNA, 25 bp, Mus musculus
ctcaccaacctgcagatggcagctc

SEQ ID NO: 914685 - DNA, 25 bp, Mus musculus
ctcaccacagagcgaaacatcttca

SEQ ID NO: 914686 - DNA, 25 bp, Mus musculus
ctcaccacagagggaaacatcttca

SEQ ID NO: 914687 - DNA, 25 bp, Mus musculus
ctcaccactgctgacgtcatatctc

SEQ ID NO: 914688 - DNA, 25 bp, Mus musculus
ctcaccactgctgaggtcatatctc

SEQ ID NO: 914689 - DNA, 25 bp, Mus musculus
ctcaccagcaacccagattgcttca

SEQ ID NO: 914690 - DNA, 25 bp, Mus musculus
ctcaccagcaaccctgattgcttca

SEQ ID NO: 914691 - DNA, 25 bp, Mus musculus
ctcaccagcaagctggttctagtga

SEQ ID NO: 914692 - DNA, 25 bp, Mus musculus
ctcaccagcaaggtggttctagtga

SEQ ID NO: 914693 - DNA, 25 bp, Mus musculus
ctcaccagtcatcaggagaaccctg

SEQ ID NO: 914694 - DNA, 25 bp, Mus musculus
ctcaccagtcatgaggagaaccctg

SEQ ID NO: 914695 - DNA, 25 bp, Mus musculus
ctcaccatatttgacgatcgcgtct

SEQ ID NO: 914696 - DNA, 25 bp, Mus musculus
ctcaccatatttgaggatcgcgtct

SEQ ID NO: 914697 - DNA, 25 bp, Mus musculus
ctcaccatcaagcgtgccggacaca

SEQ ID NO: 914698 - DNA, 25 bp, Mus musculus
ctcaccatcaagggtgccggacaca

SEQ ID NO: 914699 - DNA, 25 bp, Mus musculus
ctcaccatcacacaccctcggccca

SEQ ID NO: 914700 - DNA, 25 bp, Mus musculus
ctcaccatcacacagcctcggccca

SEQ ID NO: 914701 - DNA, 25 bp, Mus musculus
ctcaccattggacgcagagcaccct

SEQ ID NO: 914702 - DNA, 25 bp, Mus musculus
ctcaccattggaggcagagcaccct

SEQ ID NO: 914703 - DNA, 25 bp, Mus musculus
ctcacccaagatctggatcctggtt

SEQ ID NO: 914704 - DNA, 25 bp, Mus musculus
ctcacccaagttctggatcctggtt

SEQ ID NO: 914705 - DNA, 25 bp, Mus musculus
ctcacccagccactctcaggcgagc

SEQ ID NO: 914706 - DNA, 25 bp, Mus musculus
ctcacccagccagtctcaggcgagc

SEQ ID NO: 914707 - DNA, 25 bp, Mus musculus
ctcacccaggagatcttcagaacaa

SEQ ID NO: 914708 - DNA, 25 bp, Mus musculus
ctcacccaggagatggagttccaga

SEQ ID NO: 914709 - DNA, 25 bp, Mus musculus
ctcacccaggagttcttcagaacaa

SEQ ID NO: 914710 - DNA, 25 bp, Mus musculus
ctcacccaggagttggagttccaga

SEQ ID NO: 914711 - DNA, 25 bp, Mus musculus
ctcacccaggatctgagagtctggg

SEQ ID NO: 914712 - DNA, 25 bp, Mus musculus
ctcacccaggatgtgagagtctggg

SEQ ID NO: 914713 - DNA, 25 bp, Mus musculus
ctcaccctacaccatagaatttttg

SEQ ID NO: 914714 - DNA, 25 bp, Mus musculus
ctcaccctacacgatagaatttttg

SEQ ID NO: 914715 - DNA, 25 bp, Mus musculus
ctcaccctcacgctctgagtcagat

SEQ ID NO: 914716 - DNA, 25 bp, Mus musculus
ctcaccctcaggctctgagtcagat

SEQ ID NO: 914717 - DNA, 25 bp, Mus musculus
ctcaccctggagcttcctggtgtcg

SEQ ID NO: 914718 - DNA, 25 bp, Mus musculus
ctcaccctggaggttcctggtgtcg

SEQ ID NO: 914719 - DNA, 25 bp, Mus musculus
ctcaccggcaagctgatgcttcttg

SEQ ID NO: 914720 - DNA, 25 bp, Mus musculus
ctcaccggcaaggtgatgcttcttg

SEQ ID NO: 914721 - DNA, 25 bp, Mus musculus
ctcacctatggctaagtcaccgtcc

SEQ ID NO: 914722 - DNA, 25 bp, Mus musculus
ctcacctatggctatgtcaccgtcc

SEQ ID NO: 914723 - DNA, 25 bp, Mus musculus
ctcacctcccagaggcaccaccgag

SEQ ID NO: 914724 - DNA, 25 bp, Mus musculus
ctcacctcccagtggcaccaccgag

SEQ ID NO: 914725 - DNA, 25 bp, Mus musculus
ctcacctgaatgcacattgaggatg

SEQ ID NO: 914726 - DNA, 25 bp, Mus musculus
ctcacctgaatgcagattgaggatg

SEQ ID NO: 914727 - DNA, 25 bp, Mus musculus
ctcacctgtgcagtagggacggagg

SEQ ID NO: 914728 - DNA, 25 bp, Mus musculus
ctcacctgtgcagttgggacggagg

SEQ ID NO: 914729 - DNA, 25 bp, Mus musculus
ctcacctttgctattgtcctgctta

SEQ ID NO: 914730 - DNA, 25 bp, Mus musculus
ctcacctttggtattgtcctgctta

SEQ ID NO: 914731 - DNA, 25 bp, Mus musculus
ctcacgccagaatctggaccagatc

SEQ ID NO: 914732 - DNA, 25 bp, Mus musculus
ctcacgccagtatctggaccagatc

SEQ ID NO: 914733 - DNA, 25 bp, Mus musculus
ctcacgcctgtgctggttacgctct

SEQ ID NO: 914734 - DNA, 25 bp, Mus musculus
ctcacgcctgtggtggttacgctct

SEQ ID NO: 914735 - DNA, 25 bp, Mus musculus
ctcacgcgagacgaagacagctcag

SEQ ID NO: 914736 - DNA, 25 bp, Mus musculus
ctcacgcgagtcgaagacagctcag

SEQ ID NO: 914737 - DNA, 25 bp, Mus musculus
ctcacgtcacgacggaccgtgaagg

SEQ ID NO: 914738 - DNA, 25 bp, Mus musculus
ctcacgtcacgagggaccgtgaagg

SEQ ID NO: 914739 - DNA, 25 bp, Mus musculus
ctcacgttccgaccccataaggaag

SEQ ID NO: 914740 - DNA, 25 bp, Mus musculus
ctcacgttccgagcccataaggaag

SEQ ID NO: 914741 - DNA, 25 bp, Mus musculus
ctcactacggagctgcatcctgagc

SEQ ID NO: 914742 - DNA, 25 bp, Mus musculus
ctcactacggaggtgcatcctgagc

SEQ ID NO: 914743 - DNA, 25 bp, Mus musculus
ctcactagaccagaagtttgtctat

SEQ ID NO: 914744 - DNA, 25 bp, Mus musculus
ctcactagaccagatgtttgtctat

SEQ ID NO: 914745 - DNA, 25 bp, Mus musculus
ctcactatgtgcaacacggccccct

SEQ ID NO: 914746 - DNA, 25 bp, Mus musculus
ctcactatgtgcaagacggccccct

SEQ ID NO: 914747 - DNA, 25 bp, Mus musculus
ctcactccagtaaacactccttgtt

SEQ ID NO: 914748 - DNA, 25 bp, Mus musculus
ctcactccagtaaagactccttgtt

SEQ ID NO: 914749 - DNA, 25 bp, Mus musculus
ctcactctacaaccaatgctgtgac

SEQ ID NO: 914750 - DNA, 25 bp, Mus musculus
ctcactctacaacgactccctgctg

SEQ ID NO: 914751 - DNA, 25 bp, Mus musculus
ctcactctacaagcaatgctgtgac

SEQ ID NO: 914752 - DNA, 25 bp, Mus musculus
ctcactctacaaggactccctgctg

SEQ ID NO: 914753 - DNA, 25 bp, Mus musculus
ctcactctgtcgcacattggaagaa

SEQ ID NO: 914754 - DNA, 25 bp, Mus musculus
ctcactctgtcgcagattggaagaa

SEQ ID NO: 914755 - DNA, 25 bp, Mus musculus
ctcactgaactgaagaatccctcca

SEQ ID NO: 914756 - DNA, 25 bp, Mus musculus
ctcactgaactgtagaatccctcca

SEQ ID NO: 914757 - DNA, 25 bp, Mus musculus
ctcactgatcagcaactgaaacatt

SEQ ID NO: 914758 - DNA, 25 bp, Mus musculus
ctcactgatcaggaactgaaacatt

SEQ ID NO: 914759 - DNA, 25 bp, Mus musculus
ctcactgccaagcggacaatgacgg

SEQ ID NO: 914760 - DNA, 25 bp, Mus musculus
ctcactgccaagctgaaagcagcca

SEQ ID NO: 914761 - DNA, 25 bp, Mus musculus
ctcactgccaaggggacaatgacgg

SEQ ID NO: 914762 - DNA, 25 bp, Mus musculus
ctcactgccaaggtgaaagcagcca

SEQ ID NO: 914763 - DNA, 25 bp, Mus musculus
ctcactgcctgaaaaatacaacacc

SEQ ID NO: 914764 - DNA, 25 bp, Mus musculus
ctcactgcctgaagttgtccaggaa

SEQ ID NO: 914765 - DNA, 25 bp, Mus musculus
ctcactgcctgataaatacaacacc

SEQ ID NO: 914766 - DNA, 25 bp, Mus musculus
ctcactgcctgatgttgtccaggaa

SEQ ID NO: 914767 - DNA, 25 bp, Mus musculus
ctcactgctaatgacactcagtccg

SEQ ID NO: 914768 - DNA, 25 bp, Mus musculus
ctcactgctaatgagactcagtccg

SEQ ID NO: 914769 - DNA, 25 bp, Mus musculus
ctcactggagagaacgtggatgtct

SEQ ID NO: 914770 - DNA, 25 bp, Mus musculus
ctcactggagagaaggtggatgtct

SEQ ID NO: 914771 - DNA, 25 bp, Mus musculus
ctcactggatcgccgcccttcactg

SEQ ID NO: 914772 - DNA, 25 bp, Mus musculus
ctcactggatcggcgcccttcactg

SEQ ID NO: 914773 - DNA, 25 bp, Mus musculus
ctcactggccaacaccgggagccca

SEQ ID NO: 914774 - DNA, 25 bp, Mus musculus
ctcactggccaagaccgggagccca

SEQ ID NO: 914775 - DNA, 25 bp, Mus musculus
ctcactggtgagaaccctctgcagg

SEQ ID NO: 914776 - DNA, 25 bp, Mus musculus
ctcactggtgagaggcccccgagaa

SEQ ID NO: 914777 - DNA, 25 bp, Mus musculus
ctcactggtgagtaccctctgcagg

SEQ ID NO: 914778 - DNA, 25 bp, Mus musculus
ctcactggtgagtggcccccgagaa

SEQ ID NO: 914779 - DNA, 25 bp, Mus musculus
ctcactggttatcctttccatgaag

SEQ ID NO: 914780 - DNA, 25 bp, Mus musculus
ctcactggttatcgatccatctgtt

SEQ ID NO: 914781 - DNA, 25 bp, Mus musculus
ctcactggttatgctttccatgaag

SEQ ID NO: 914782 - DNA, 25 bp, Mus musculus
ctcactggttatggatccatctgtt

SEQ ID NO: 914783 - DNA, 25 bp, Mus musculus
ctcactgtaaggcccatcctttgtg

SEQ ID NO: 914784 - DNA, 25 bp, Mus musculus
ctcactgtaaggccgatcctttgtg

SEQ ID NO: 914785 - DNA, 25 bp, Mus musculus
ctcactgtgcatattgcgccaacta

SEQ ID NO: 914786 - DNA, 25 bp, Mus musculus
ctcactgtgcattttgcgccaacta

SEQ ID NO: 914787 - DNA, 25 bp, Mus musculus
ctcactgtgctaaaggcccacgttg

SEQ ID NO: 914788 - DNA, 25 bp, Mus musculus
ctcactgtgctataggcccacgttg

SEQ ID NO: 914789 - DNA, 25 bp, Mus musculus
ctcactgtgctcaacccagcccagg

SEQ ID NO: 914790 - DNA, 25 bp, Mus musculus
ctcactgtgctctacccagcccagg

SEQ ID NO: 914791 - DNA, 25 bp, Mus musculus
ctcactgtggagcagctgaagttca

SEQ ID NO: 914792 - DNA, 25 bp, Mus musculus
ctcactgtggaggagctgaagttca

SEQ ID NO: 914793 - DNA, 25 bp, Mus musculus
ctcactgtgtaaaacgccttaacca

SEQ ID NO: 914794 - DNA, 25 bp, Mus musculus
ctcactgtgtaaaaggccttaacca

SEQ ID NO: 914795 - DNA, 25 bp, Mus musculus
ctcacttcacctctggagatgggaa

SEQ ID NO: 914796 - DNA, 25 bp, Mus musculus
ctcacttcacctgtggagatgggaa

SEQ ID NO: 914797 - DNA, 25 bp, Mus musculus
ctcacttctcaactccaccttgtca

SEQ ID NO: 914798 - DNA, 25 bp, Mus musculus
ctcacttctcaagtccaccttgtca

SEQ ID NO: 914799 - DNA, 25 bp, Mus musculus
ctcactttccatcttataaacactg

SEQ ID NO: 914800 - DNA, 25 bp, Mus musculus
ctcactttccatgttataaacactg

SEQ ID NO: 914801 - DNA, 25 bp, Mus musculus
ctcagaaaaaatagaagaatggcgg

SEQ ID NO: 914802 - DNA, 25 bp, Mus musculus
ctcagaaaaattagaagaatggcgg

SEQ ID NO: 914803 - DNA, 25 bp, Mus musculus
ctcagaaaacaggactctacagtga

SEQ ID NO: 914804 - DNA, 25 bp, Mus musculus
ctcagaaaacaggagtctacagtga

SEQ ID NO: 914805 - DNA, 25 bp, Mus musculus
ctcagaaaattgacctgcctgagta

SEQ ID NO: 914806 - DNA, 25 bp, Mus musculus
ctcagaaaattgacgtgcctgagta

SEQ ID NO: 914807 - DNA, 25 bp, Mus musculus
ctcagaaataaaaaagaaatttgca

SEQ ID NO: 914808 - DNA, 25 bp, Mus musculus
ctcagaaataaaaatgaaatttgca

SEQ ID NO: 914809 - DNA, 25 bp, Mus musculus
ctcagaacagcatcccctaccccag

SEQ ID NO: 914810 - DNA, 25 bp, Mus musculus
ctcagaacagcctccaggtagcctc

SEQ ID NO: 914811 - DNA, 25 bp, Mus musculus
ctcagaacagctcttcacatgctcc

SEQ ID NO: 914812 - DNA, 25 bp, Mus musculus
ctcagaacaggatcccctaccccag

SEQ ID NO: 914813 - DNA, 25 bp, Mus musculus
ctcagaacaggctccaggtagcctc

SEQ ID NO: 914814 - DNA, 25 bp, Mus musculus
ctcagaacaggtcttcacatgctcc

SEQ ID NO: 914815 - DNA, 25 bp, Mus musculus
ctcagaacctttcaatcttcctgag

SEQ ID NO: 914816 - DNA, 25 bp, Mus musculus
ctcagaacctttgaatcttcctgag

SEQ ID NO: 914817 - DNA, 25 bp, Mus musculus
ctcagaacgtccagccatgtgagac

SEQ ID NO: 914818 - DNA, 25 bp, Mus musculus
ctcagaacgtccaggcatgtgagac

SEQ ID NO: 914819 - DNA, 25 bp, Mus musculus
ctcagaacgttacgactatcctgtt

SEQ ID NO: 914820 - DNA, 25 bp, Mus musculus
ctcagaacgttaggactatcctgtt

SEQ ID NO: 914821 - DNA, 25 bp, Mus musculus
ctcagaactcagatcaccacaatgg

SEQ ID NO: 914822 - DNA, 25 bp, Mus musculus
ctcagaactcagttcaccacaatgg

SEQ ID NO: 914823 - DNA, 25 bp, Mus musculus
ctcagaactggccacacaccttgtt

SEQ ID NO: 914824 - DNA, 25 bp, Mus musculus
ctcagaactggccacatccgtctac

SEQ ID NO: 914825 - DNA, 25 bp, Mus musculus
ctcagaactggccacccccctgcct

SEQ ID NO: 914826 - DNA, 25 bp, Mus musculus
ctcagaactggccagacaccttgtt

SEQ ID NO: 914827 - DNA, 25 bp, Mus musculus
ctcagaactggccagatccgtctac

SEQ ID NO: 914828 - DNA, 25 bp, Mus musculus
ctcagaactggccagccccctgcct

SEQ ID NO: 914829 - DNA, 25 bp, Mus musculus
ctcagaaggactccaactgcctgca

SEQ ID NO: 914830 - DNA, 25 bp, Mus musculus
ctcagaaggactgcaactgcctgca

SEQ ID NO: 914831 - DNA, 25 bp, Mus musculus
ctcagacaagagctaaagaagaaga

SEQ ID NO: 914832 - DNA, 25 bp, Mus musculus
ctcagacaagaggtaaagaagaaga

SEQ ID NO: 914833 - DNA, 25 bp, Mus musculus
ctcagacacaagcacgtcagatgta

SEQ ID NO: 914834 - DNA, 25 bp, Mus musculus
ctcagacacaagcaggtcagatgta

SEQ ID NO: 914835 - DNA, 25 bp, Mus musculus
ctcagacacctgccagtgcttaatt

SEQ ID NO: 914836 - DNA, 25 bp, Mus musculus
ctcagacacctgctcaacatggcgc

SEQ ID NO: 914837 - DNA, 25 bp, Mus musculus
ctcagacacctggcagtgcttaatt

SEQ ID NO: 914838 - DNA, 25 bp, Mus musculus
ctcagacacctggtcaacatggcgc

SEQ ID NO: 914839 - DNA, 25 bp, Mus musculus
ctcagacacgccttgatggtgaagt

SEQ ID NO: 914840 - DNA, 25 bp, Mus musculus
ctcagacacggcttgatggtgaagt

SEQ ID NO: 914841 - DNA, 25 bp, Mus musculus
ctcagacaggctgtgctgggcatca

SEQ ID NO: 914842 - DNA, 25 bp, Mus musculus
ctcagacagggtgtgctgggcatca

SEQ ID NO: 914843 - DNA, 25 bp, Mus musculus
ctcagacagtggctgtccacccagc

SEQ ID NO: 914844 - DNA, 25 bp, Mus musculus
ctcagacagtgggtgtccacccagc

SEQ ID NO: 914845 - DNA, 25 bp, Mus musculus
ctcagacatctgcctcagcatggga

SEQ ID NO: 914846 - DNA, 25 bp, Mus musculus
ctcagacatctggctcagcatggga

SEQ ID NO: 914847 - DNA, 25 bp, Mus musculus
ctcagaccacctatcagcaagtccc

SEQ ID NO: 914848 - DNA, 25 bp, Mus musculus
ctcagaccacctatccaagtccctc

SEQ ID NO: 914849 - DNA, 25 bp, Mus musculus
ctcagaccacctatgagcaagtccc

SEQ ID NO: 914850 - DNA, 25 bp, Mus musculus
ctcagaccacctatgcaagtccctc

SEQ ID NO: 914851 - DNA, 25 bp, Mus musculus
ctcagaccagcacaacgagatggtg

SEQ ID NO: 914852 - DNA, 25 bp, Mus musculus
ctcagaccagcagaacgagatggtg

SEQ ID NO: 914853 - DNA, 25 bp, Mus musculus
ctcagactatcacactttcagctcc

SEQ ID NO: 914854 - DNA, 25 bp, Mus musculus
ctcagactatcacagtttcagctcc

SEQ ID NO: 914855 - DNA, 25 bp, Mus musculus
ctcagactccctcacgagggagctc

SEQ ID NO: 914856 - DNA, 25 bp, Mus musculus
ctcagactccctcaggagggagctc

SEQ ID NO: 914857 - DNA, 25 bp, Mus musculus
ctcagactcgataaaacgtttacaa

SEQ ID NO: 914858 - DNA, 25 bp, Mus musculus
ctcagactcgcggtcgcatccctgg

SEQ ID NO: 914859 - DNA, 25 bp, Mus musculus
ctcagactcgctacctcggaatcgg

SEQ ID NO: 914860 - DNA, 25 bp, Mus musculus
ctcagactcgctcccccagaggtgc

SEQ ID NO: 914861 - DNA, 25 bp, Mus musculus
ctcagactcggggtcgcatccctgg

SEQ ID NO: 914862 - DNA, 25 bp, Mus musculus
ctcagactcggtacctcggaatcgg

SEQ ID NO: 914863 - DNA, 25 bp, Mus musculus
ctcagactcggtcccccagaggtgc

SEQ ID NO: 914864 - DNA, 25 bp, Mus musculus
ctcagactcgttaaaacgtttacaa

SEQ ID NO: 914865 - DNA, 25 bp, Mus musculus
ctcagactctgtagcatttgcaaat

SEQ ID NO: 914866 - DNA, 25 bp, Mus musculus
ctcagactctgtaggatttgcaaat

SEQ ID NO: 914867 - DNA, 25 bp, Mus musculus
ctcagagacccaagtgcataagtaa

SEQ ID NO: 914868 - DNA, 25 bp, Mus musculus
ctcagagacccatgtgcataagtaa

SEQ ID NO: 914869 - DNA, 25 bp, Mus musculus
ctcagagaccgcaatctcactggtc

SEQ ID NO: 914870 - DNA, 25 bp, Mus musculus
ctcagagaccgcaatgtgtatgtcg

SEQ ID NO: 914871 - DNA, 25 bp, Mus musculus
ctcagagaccgctatctcactggtc

SEQ ID NO: 914872 - DNA, 25 bp, Mus musculus
ctcagagaccgctatgtgtatgtcg

SEQ ID NO: 914873 - DNA, 25 bp, Mus musculus
ctcagagagtcgccgtccctacagc

SEQ ID NO: 914874 - DNA, 25 bp, Mus musculus
ctcagagagtcgcgtctgagtgccc

SEQ ID NO: 914875 - DNA, 25 bp, Mus musculus
ctcagagagtcggcgtccctacagc

SEQ ID NO: 914876 - DNA, 25 bp, Mus musculus
ctcagagagtcgggtctgagtgccc

SEQ ID NO: 914877 - DNA, 25 bp, Mus musculus
ctcagagattggaccggatatccta

SEQ ID NO: 914878 - DNA, 25 bp, Mus musculus
ctcagagattggacgggatatccta

SEQ ID NO: 914879 - DNA, 25 bp, Mus musculus
ctcagagcacagctgcctggatcct

SEQ ID NO: 914880 - DNA, 25 bp, Mus musculus
ctcagagcacaggtgcctggatcct

SEQ ID NO: 914881 - DNA, 25 bp, Mus musculus
ctcagagctgactgcagacctgctc

SEQ ID NO: 914882 - DNA, 25 bp, Mus musculus
ctcagagctgtctgcagacctgctc

SEQ ID NO: 914883 - DNA, 25 bp, Mus musculus
ctcagaggctgacaaaataatgttg

SEQ ID NO: 914884 - DNA, 25 bp, Mus musculus
ctcagaggctgacgacaaatgagaa

SEQ ID NO: 914885 - DNA, 25 bp, Mus musculus
ctcagaggctgagaaaataatgttg

SEQ ID NO: 914886 - DNA, 25 bp, Mus musculus
ctcagaggctgaggacaaatgagaa

SEQ ID NO: 914887 - DNA, 25 bp, Mus musculus
ctcagaggggctccgtgtgaatgta

SEQ ID NO: 914888 - DNA, 25 bp, Mus musculus
ctcagagggggtccgtgtgaatgta

SEQ ID NO: 914889 - DNA, 25 bp, Mus musculus
ctcagagtacagcagctggagatgc

SEQ ID NO: 914890 - DNA, 25 bp, Mus musculus
ctcagagtacaggagctggagatgc

SEQ ID NO: 914891 - DNA, 25 bp, Mus musculus
ctcagagtctcatgccaagccatga

SEQ ID NO: 914892 - DNA, 25 bp, Mus musculus
ctcagagtctccaagaaactacatt

SEQ ID NO: 914893 - DNA, 25 bp, Mus musculus
ctcagagtctgatgccaagccatga

SEQ ID NO: 914894 - DNA, 25 bp, Mus musculus
ctcagagtctgcaagaaactacatt

SEQ ID NO: 914895 - DNA, 25 bp, Mus musculus
ctcagagtgaagaacaactcctacc

SEQ ID NO: 914896 - DNA, 25 bp, Mus musculus
ctcagagtgaagaaccgagatcatc

SEQ ID NO: 914897 - DNA, 25 bp, Mus musculus
ctcagagtgaagaagaactcctacc

SEQ ID NO: 914898 - DNA, 25 bp, Mus musculus
ctcagagtgaagaagcgagatcatc

SEQ ID NO: 914899 - DNA, 25 bp, Mus musculus
ctcagagttctcagggagctgacaa

SEQ ID NO: 914900 - DNA, 25 bp, Mus musculus
ctcagagttctctgggagctgacaa

SEQ ID NO: 914901 - DNA, 25 bp, Mus musculus
ctcagatcagctaagggagcacaca

SEQ ID NO: 914902 - DNA, 25 bp, Mus musculus
ctcagatcaggtaagggagcacaca

SEQ ID NO: 914903 - DNA, 25 bp, Mus musculus
ctcagatgcacccccgggcacatgg

SEQ ID NO: 914904 - DNA, 25 bp, Mus musculus
ctcagatgcaccccggggcacatgg

SEQ ID NO: 914905 - DNA, 25 bp, Mus musculus
ctcagatgcctacaccaccggaagc

SEQ ID NO: 914906 - DNA, 25 bp, Mus musculus
ctcagatgcctacagcaccggaagc

SEQ ID NO: 914907 - DNA, 25 bp, Mus musculus
ctcagatggcagcaccccacaggcc

SEQ ID NO: 914908 - DNA, 25 bp, Mus musculus
ctcagatggcagccccaagtatctg

SEQ ID NO: 914909 - DNA, 25 bp, Mus musculus
ctcagatggcaggaccccacaggcc

SEQ ID NO: 914910 - DNA, 25 bp, Mus musculus
ctcagatggcaggcccaagtatctg

SEQ ID NO: 914911 - DNA, 25 bp, Mus musculus
ctcagattccagaatggctcatcat

SEQ ID NO: 914912 - DNA, 25 bp, Mus musculus
ctcagattccagtatggctcatcat

SEQ ID NO: 914913 - DNA, 25 bp, Mus musculus
ctcagattgaggaacctatatatca

SEQ ID NO: 914914 - DNA, 25 bp, Mus musculus
ctcagattgaggaagctatatatca

SEQ ID NO: 914915 - DNA, 25 bp, Mus musculus
ctcagatttggacaccttccttgtg

SEQ ID NO: 914916 - DNA, 25 bp, Mus musculus
ctcagatttggacactttccagcag

SEQ ID NO: 914917 - DNA, 25 bp, Mus musculus
ctcagatttggacagcttccttgtg

SEQ ID NO: 914918 - DNA, 25 bp, Mus musculus
ctcagatttggacagtttccagcag

SEQ ID NO: 914919 - DNA, 25 bp, Mus musculus
ctcagcaaagaagttgggatatcta

SEQ ID NO: 914920 - DNA, 25 bp, Mus musculus
ctcagcaaagccagctgagatgctt

SEQ ID NO: 914921 - DNA, 25 bp, Mus musculus
ctcagcaaaggcagctgagatgctt

SEQ ID NO: 914922 - DNA, 25 bp, Mus musculus
ctcagcaaagtagttgggatatcta

SEQ ID NO: 914923 - DNA, 25 bp, Mus musculus
ctcagcaactatgacgtgttccagt

SEQ ID NO: 914924 - DNA, 25 bp, Mus musculus
ctcagcaactatgaggtgttccagt

SEQ ID NO: 914925 - DNA, 25 bp, Mus musculus
ctcagcaagactggctctgaaggta

SEQ ID NO: 914926 - DNA, 25 bp, Mus musculus
ctcagcaagactgggtctgaaggta

SEQ ID NO: 914927 - DNA, 25 bp, Mus musculus
ctcagcacaaaggatcataagagtg

SEQ ID NO: 914928 - DNA, 25 bp, Mus musculus
ctcagcacaatggatcataagagtg

SEQ ID NO: 914929 - DNA, 25 bp, Mus musculus
ctcagcacaccacaactatgccgag

SEQ ID NO: 914930 - DNA, 25 bp, Mus musculus
ctcagcacaccagaactatgccgag

SEQ ID NO: 914931 - DNA, 25 bp, Mus musculus
ctcagcacagagcgagggaagacac

SEQ ID NO: 914932 - DNA, 25 bp, Mus musculus
ctcagcacagtgcgagggaagacac

SEQ ID NO: 914933 - DNA, 25 bp, Mus musculus
ctcagcacctcatgctgatacattg

SEQ ID NO: 914934 - DNA, 25 bp, Mus musculus
ctcagcacctcatggtgatacattg

SEQ ID NO: 914935 - DNA, 25 bp, Mus musculus
ctcagcacgacacagggcgtccctc

SEQ ID NO: 914936 - DNA, 25 bp, Mus musculus
ctcagcacgacagagggcgtccctc

SEQ ID NO: 914937 - DNA, 25 bp, Mus musculus
ctcagcactgtcaaccggaagatgg

SEQ ID NO: 914938 - DNA, 25 bp, Mus musculus
ctcagcactgtcaaccttctcatgc

SEQ ID NO: 914939 - DNA, 25 bp, Mus musculus
ctcagcactgtcaacgatgtgtttg

SEQ ID NO: 914940 - DNA, 25 bp, Mus musculus
ctcagcactgtcaagcggaagatgg

SEQ ID NO: 914941 - DNA, 25 bp, Mus musculus
ctcagcactgtcaagcttctcatgc

SEQ ID NO: 914942 - DNA, 25 bp, Mus musculus
ctcagcactgtcaaggatgtgtttg

SEQ ID NO: 914943 - DNA, 25 bp, Mus musculus
ctcagcagaaagatgttaaacactc

SEQ ID NO: 914944 - DNA, 25 bp, Mus musculus
ctcagcagaaagttgttaaacactc

SEQ ID NO: 914945 - DNA, 25 bp, Mus musculus
ctcagcagagcctacaaccaaatct

SEQ ID NO: 914946 - DNA, 25 bp, Mus musculus
ctcagcagaggctacaaccaaatct

SEQ ID NO: 914947 - DNA, 25 bp, Mus musculus
ctcagcagatttgcactgaatcatc

SEQ ID NO: 914948 - DNA, 25 bp, Mus musculus
ctcagcagatttgctctgaatcatc

SEQ ID NO: 914949 - DNA, 25 bp, Mus musculus
ctcagcagccagcgccacatcaaac

SEQ ID NO: 914950 - DNA, 25 bp, Mus musculus
ctcagcagccagggccacatcaaac

SEQ ID NO: 914951 - DNA, 25 bp, Mus musculus
ctcagcagctcgcaaattcgatgga

SEQ ID NO: 914952 - DNA, 25 bp, Mus musculus
ctcagcagctcggaaattcgatgga

SEQ ID NO: 914953 - DNA, 25 bp, Mus musculus
ctcagcaggacaatgaccagttgaa

SEQ ID NO: 914954 - DNA, 25 bp, Mus musculus
ctcagcaggacattgaccagttgaa

SEQ ID NO: 914955 - DNA, 25 bp, Mus musculus
ctcagcatgcagcggagccctggag

SEQ ID NO: 914956 - DNA, 25 bp, Mus musculus
ctcagcatgcaggggagccctggag

SEQ ID NO: 914957 - DNA, 25 bp, Mus musculus
ctcagccaagaacaataccattgtg

SEQ ID NO: 914958 - DNA, 25 bp, Mus musculus
ctcagccaagaagaataccattgtg

SEQ ID NO: 914959 - DNA, 25 bp, Mus musculus
ctcagccagacaaacgtacactagg

SEQ ID NO: 914960 - DNA, 25 bp, Mus musculus
ctcagccagacaaaggtacactagg

SEQ ID NO: 914961 - DNA, 25 bp, Mus musculus
ctcagccaggaccagctgacagtcc

SEQ ID NO: 914962 - DNA, 25 bp, Mus musculus
ctcagccaggacgagctgacagtcc

SEQ ID NO: 914963 - DNA, 25 bp, Mus musculus
ctcagcccactgcatcaaacaacat

SEQ ID NO: 914964 - DNA, 25 bp, Mus musculus
ctcagcccactggatcaaacaacat

SEQ ID NO: 914965 - DNA, 25 bp, Mus musculus
ctcagcccagcatctagagtcatgt

SEQ ID NO: 914966 - DNA, 25 bp, Mus musculus
ctcagcccagcgtctccctacagag

SEQ ID NO: 914967 - DNA, 25 bp, Mus musculus
ctcagcccagctggtgctctgggtc

SEQ ID NO: 914968 - DNA, 25 bp, Mus musculus
ctcagcccaggatctagagtcatgt

SEQ ID NO: 914969 - DNA, 25 bp, Mus musculus
ctcagcccagggtctccctacagag

SEQ ID NO: 914970 - DNA, 25 bp, Mus musculus
ctcagcccaggtggtgctctgggtc

SEQ ID NO: 914971 - DNA, 25 bp, Mus musculus
ctcagccccagggaagaggaacagc

SEQ ID NO: 914972 - DNA, 25 bp, Mus musculus
ctcagccccagggatgaggaacagc

SEQ ID NO: 914973 - DNA, 25 bp, Mus musculus
ctcagccgcttactacctgaatgat

SEQ ID NO: 914974 - DNA, 25 bp, Mus musculus
ctcagccgcttagtacctgaatgat

SEQ ID NO: 914975 - DNA, 25 bp, Mus musculus
ctcagcctccgccgcgagtgagtcc

SEQ ID NO: 914976 - DNA, 25 bp, Mus musculus
ctcagcctccgccgggagtgagtcc

SEQ ID NO: 914977 - DNA, 25 bp, Mus musculus
ctcagcctgcagaccaactggtatg

SEQ ID NO: 914978 - DNA, 25 bp, Mus musculus
ctcagcctgcagtccaactggtatg

SEQ ID NO: 914979 - DNA, 25 bp, Mus musculus
ctcagcctggagcacacagagctgc

SEQ ID NO: 914980 - DNA, 25 bp, Mus musculus
ctcagcctggaggacacagagctgc

SEQ ID NO: 914981 - DNA, 25 bp, Mus musculus
ctcagcgcaactcacatggctccag

SEQ ID NO: 914982 - DNA, 25 bp, Mus musculus
ctcagcgcaactcacgctgactccc

SEQ ID NO: 914983 - DNA, 25 bp, Mus musculus
ctcagcgcaactcagatggctccag

SEQ ID NO: 914984 - DNA, 25 bp, Mus musculus
ctcagcgcaactcaggctgactccc

SEQ ID NO: 914985 - DNA, 25 bp, Mus musculus
ctcagcgcagcttgtgacaatgtga

SEQ ID NO: 914986 - DNA, 25 bp, Mus musculus
ctcagcgcaggttgtgacaatgtga

SEQ ID NO: 914987 - DNA, 25 bp, Mus musculus
ctcagcgccctggacctattgaagt

SEQ ID NO: 914988 - DNA, 25 bp, Mus musculus
ctcagcgccctggagctattgaagt

SEQ ID NO: 914989 - DNA, 25 bp, Mus musculus
ctcagcgctcaccttcttgagagtc

SEQ ID NO: 914990 - DNA, 25 bp, Mus musculus
ctcagcgctcacgttcttgagagtc

SEQ ID NO: 914991 - DNA, 25 bp, Mus musculus
ctcagcgtgatcccaatgagaggta

SEQ ID NO: 914992 - DNA, 25 bp, Mus musculus
ctcagcgtgatcgcaatgagaggta

SEQ ID NO: 914993 - DNA, 25 bp, Mus musculus
ctcagcgtggagaaccacccagatg

SEQ ID NO: 914994 - DNA, 25 bp, Mus musculus
ctcagcgtggagaagcacccagatg

SEQ ID NO: 914995 - DNA, 25 bp, Mus musculus
ctcagcgtggagcccttggatgaag

SEQ ID NO: 914996 - DNA, 25 bp, Mus musculus
ctcagcgtggagctgcagcccttgg

SEQ ID NO: 914997 - DNA, 25 bp, Mus musculus
ctcagcgtggaggccttggatgaag

SEQ ID NO: 914998 - DNA, 25 bp, Mus musculus
ctcagcgtggaggtgcagcccttgg

SEQ ID NO: 914999 - DNA, 25 bp, Mus musculus
ctcagctactagcagccctaaactg

SEQ ID NO: 915000 - DNA, 25 bp, Mus musculus
ctcagctactaggagccctaaactg

SEQ ID NO: 915001 - DNA, 25 bp, Mus musculus
ctcagctcagagaacagtttgcagt

SEQ ID NO: 915002 - DNA, 25 bp, Mus musculus
ctcagctcagcggaacctgcctctt

SEQ ID NO: 915003 - DNA, 25 bp, Mus musculus
ctcagctcagcggtcacacagcaaa

SEQ ID NO: 915004 - DNA, 25 bp, Mus musculus
ctcagctcaggggaacctgcctctt

SEQ ID NO: 915005 - DNA, 25 bp, Mus musculus
ctcagctcaggggtcacacagcaaa

SEQ ID NO: 915006 - DNA, 25 bp, Mus musculus
ctcagctcagtgaacagtttgcagt

SEQ ID NO: 915007 - DNA, 25 bp, Mus musculus
ctcagctgcaccctacttaggagcc

SEQ ID NO: 915008 - DNA, 25 bp, Mus musculus
ctcagctgcagcctacttaggagcc

SEQ ID NO: 915009 - DNA, 25 bp, Mus musculus
ctcagctggaaggacgaagatgggc

SEQ ID NO: 915010 - DNA, 25 bp, Mus musculus
ctcagctggaaggaggaagatgggc

SEQ ID NO: 915011 - DNA, 25 bp, Mus musculus
ctcagcttccgggacttcctgctca

SEQ ID NO: 915012 - DNA, 25 bp, Mus musculus
ctcagcttccgggagttcctgctca

SEQ ID NO: 915013 - DNA, 25 bp, Mus musculus
ctcagcttcctcaacgctaacttag

SEQ ID NO: 915014 - DNA, 25 bp, Mus musculus
ctcagcttcctcaaggctaacttag

SEQ ID NO: 915015 - DNA, 25 bp, Mus musculus
ctcaggacaatgcaccttcacttgg

SEQ ID NO: 915016 - DNA, 25 bp, Mus musculus
ctcaggacaatgcactgctgaaagg

SEQ ID NO: 915017 - DNA, 25 bp, Mus musculus
ctcaggacaatgcagcttcacttgg

SEQ ID NO: 915018 - DNA, 25 bp, Mus musculus
ctcaggacaatgcagtgctgaaagg

SEQ ID NO: 915019 - DNA, 25 bp, Mus musculus
ctcaggacagctataaggcagtatg

SEQ ID NO: 915020 - DNA, 25 bp, Mus musculus
ctcaggacaggtataaggcagtatg

SEQ ID NO: 915021 - DNA, 25 bp, Mus musculus
ctcaggaccccacctctgtcagcat

SEQ ID NO: 915022 - DNA, 25 bp, Mus musculus
ctcaggaccccacgaccttgccaca

SEQ ID NO: 915023 - DNA, 25 bp, Mus musculus
ctcaggaccccagctctgtcagcat

SEQ ID NO: 915024 - DNA, 25 bp, Mus musculus
ctcaggaccccaggaccttgccaca

SEQ ID NO: 915025 - DNA, 25 bp, Mus musculus
ctcaggagaacacatggcctcctac

SEQ ID NO: 915026 - DNA, 25 bp, Mus musculus
ctcaggagaacagatggcctcctac

SEQ ID NO: 915027 - DNA, 25 bp, Mus musculus
ctcaggagagcacacgattaagttg

SEQ ID NO: 915028 - DNA, 25 bp, Mus musculus
ctcaggagagcacaggattaagttg

SEQ ID NO: 915029 - DNA, 25 bp, Mus musculus
ctcaggagagcagccatttattgaa

SEQ ID NO: 915030 - DNA, 25 bp, Mus musculus
ctcaggagagctacttggaaggctg

SEQ ID NO: 915031 - DNA, 25 bp, Mus musculus
ctcaggagaggagccatttattgaa

SEQ ID NO: 915032 - DNA, 25 bp, Mus musculus
ctcaggagaggtacttggaaggctg

SEQ ID NO: 915033 - DNA, 25 bp, Mus musculus
ctcaggagattaagcctgccaccta

SEQ ID NO: 915034 - DNA, 25 bp, Mus musculus
ctcaggagattaaggctgccaccta

SEQ ID NO: 915035 - DNA, 25 bp, Mus musculus
ctcaggagcagccggtttattgcct

SEQ ID NO: 915036 - DNA, 25 bp, Mus musculus
ctcaggagcagcgggtttattgcct

SEQ ID NO: 915037 - DNA, 25 bp, Mus musculus
ctcaggagctcaacgagctggacta

SEQ ID NO: 915038 - DNA, 25 bp, Mus musculus
ctcaggagctcatcgagctggacta

SEQ ID NO: 915039 - DNA, 25 bp, Mus musculus
ctcaggaggagctgcagatggaagc

SEQ ID NO: 915040 - DNA, 25 bp, Mus musculus
ctcaggaggagctgcatggaagcaa

SEQ ID NO: 915041 - DNA, 25 bp, Mus musculus
ctcaggaggagctggagatggaagc

SEQ ID NO: 915042 - DNA, 25 bp, Mus musculus
ctcaggaggagctggatggaagcaa

SEQ ID NO: 915043 - DNA, 25 bp, Mus musculus
ctcaggatgacacgcccttcttcct

SEQ ID NO: 915044 - DNA, 25 bp, Mus musculus
ctcaggatgacaggcccttcttcct

SEQ ID NO: 915045 - DNA, 25 bp, Mus musculus
ctcaggattggaagatcgaagcctg

SEQ ID NO: 915046 - DNA, 25 bp, Mus musculus
ctcaggattggatgatcgaagcctg

SEQ ID NO: 915047 - DNA, 25 bp, Mus musculus
ctcaggcaccagcttcctccaacac

SEQ ID NO: 915048 - DNA, 25 bp, Mus musculus
ctcaggcaccaggttcctccaacac

SEQ ID NO: 915049 - DNA, 25 bp, Mus musculus
ctcaggcacggaatcgctattgtga

SEQ ID NO: 915050 - DNA, 25 bp, Mus musculus
ctcaggcacggaatggctattgtga

SEQ ID NO: 915051 - DNA, 25 bp, Mus musculus
ctcaggctctggcagttggaaccct

SEQ ID NO: 915052 - DNA, 25 bp, Mus musculus
ctcaggctctgggagttggaaccct

SEQ ID NO: 915053 - DNA, 25 bp, Mus musculus
ctcaggctgtgacatatctgtttca

SEQ ID NO: 915054 - DNA, 25 bp, Mus musculus
ctcaggctgtgagatatctgtttca

SEQ ID NO: 915055 - DNA, 25 bp, Mus musculus
ctcaggcttgtgattctatctttcc

SEQ ID NO: 915056 - DNA, 25 bp, Mus musculus
ctcaggcttgtgtttctatctttcc

SEQ ID NO: 915057 - DNA, 25 bp, Mus musculus
ctcagggaaaagcaacaccatggac

SEQ ID NO: 915058 - DNA, 25 bp, Mus musculus
ctcagggaaaagcacagagctgatg

SEQ ID NO: 915059 - DNA, 25 bp, Mus musculus
ctcagggaaaaggaacaccatggac

SEQ ID NO: 915060 - DNA, 25 bp, Mus musculus
ctcagggaaaaggacagagctgatg

SEQ ID NO: 915061 - DNA, 25 bp, Mus musculus
ctcagggaacaaccccaggactgtg

SEQ ID NO: 915062 - DNA, 25 bp, Mus musculus
ctcagggaacaagcccaggactgtg

SEQ ID NO: 915063 - DNA, 25 bp, Mus musculus
ctcagggaatggactatttgcatgc

SEQ ID NO: 915064 - DNA, 25 bp, Mus musculus
ctcagggaatggtctatttgcatgc

SEQ ID NO: 915065 - DNA, 25 bp, Mus musculus
ctcagggagaaacagcctggcccaa

SEQ ID NO: 915066 - DNA, 25 bp, Mus musculus
ctcagggagaaagagcctggcccaa

SEQ ID NO: 915067 - DNA, 25 bp, Mus musculus
ctcagggcagcaaaccttctggaga

SEQ ID NO: 915068 - DNA, 25 bp, Mus musculus
ctcagggcaggaaaccttctggaga

SEQ ID NO: 915069 - DNA, 25 bp, Mus musculus
ctcagggctgttcagcttccagaga

SEQ ID NO: 915070 - DNA, 25 bp, Mus musculus
ctcagggctgttgagcttccagaga

SEQ ID NO: 915071 - DNA, 25 bp, Mus musculus
ctcaggggccagcagctgaagttgc

SEQ ID NO: 915072 - DNA, 25 bp, Mus musculus
ctcaggggccaggagctgaagttgc

SEQ ID NO: 915073 - DNA, 25 bp, Mus musculus
ctcaggggttcacatgccccatata

SEQ ID NO: 915074 - DNA, 25 bp, Mus musculus
ctcaggggttcacccaacaattctc

SEQ ID NO: 915075 - DNA, 25 bp, Mus musculus
ctcaggggttcagatgccccatata

SEQ ID NO: 915076 - DNA, 25 bp, Mus musculus
ctcaggggttcagccaacaattctc

SEQ ID NO: 915077 - DNA, 25 bp, Mus musculus
ctcaggtcacagagaccgatgagtg

SEQ ID NO: 915078 - DNA, 25 bp, Mus musculus
ctcaggtcacagtgaccgatgagtg

SEQ ID NO: 915079 - DNA, 25 bp, Mus musculus
ctcaggtcaccacggaggccatcag

SEQ ID NO: 915080 - DNA, 25 bp, Mus musculus
ctcaggtcaccagggaggccatcag

SEQ ID NO: 915081 - DNA, 25 bp, Mus musculus
ctcaggtgagcacgatcggaacgtc

SEQ ID NO: 915082 - DNA, 25 bp, Mus musculus
ctcaggtgagcaggatcggaacgtc

SEQ ID NO: 915083 - DNA, 25 bp, Mus musculus
ctcagtacagaagacacaggtgaga

SEQ ID NO: 915084 - DNA, 25 bp, Mus musculus
ctcagtacagaagagacaggtgaga

SEQ ID NO: 915085 - DNA, 25 bp, Mus musculus
ctcagtacatccctcgagccggccc

SEQ ID NO: 915086 - DNA, 25 bp, Mus musculus
ctcagtacatccctggagccggccc

SEQ ID NO: 915087 - DNA, 25 bp, Mus musculus
ctcagtatccagcacaacagcttta

SEQ ID NO: 915088 - DNA, 25 bp, Mus musculus
ctcagtatccaggacaacagcttta

SEQ ID NO: 915089 - DNA, 25 bp, Mus musculus
ctcagtatccatcattgccagtaga

SEQ ID NO: 915090 - DNA, 25 bp, Mus musculus
ctcagtatccatgattgccagtaga

SEQ ID NO: 915091 - DNA, 25 bp, Mus musculus
ctcagtatgaaacttacaggtcttt

SEQ ID NO: 915092 - DNA, 25 bp, Mus musculus
ctcagtatgaaagttacaggtcttt

SEQ ID NO: 915093 - DNA, 25 bp, Mus musculus
ctcagtcacaagtgcgttttattga

SEQ ID NO: 915094 - DNA, 25 bp, Mus musculus
ctcagtcacaagtgggttttattga

SEQ ID NO: 915095 - DNA, 25 bp, Mus musculus
ctcagtcacccacgggaccttggag

SEQ ID NO: 915096 - DNA, 25 bp, Mus musculus
ctcagtcacccaggggaccttggag

SEQ ID NO: 915097 - DNA, 25 bp, Mus musculus
ctcagtcggcctcaagcccctgaag

SEQ ID NO: 915098 - DNA, 25 bp, Mus musculus
ctcagtcggcctcatgcccctgaag

SEQ ID NO: 915099 - DNA, 25 bp, Mus musculus
ctcagtctgcaacacttgtttaatg

SEQ ID NO: 915100 - DNA, 25 bp, Mus musculus
ctcagtctgcaacagttgtttaatg

SEQ ID NO: 915101 - DNA, 25 bp, Mus musculus
ctcagtgaagagacacatactcacc

SEQ ID NO: 915102 - DNA, 25 bp, Mus musculus
ctcagtgaagagtcacatactcacc

SEQ ID NO: 915103 - DNA, 25 bp, Mus musculus
ctcagtgcagcttgtgacaatgtgg

SEQ ID NO: 915104 - DNA, 25 bp, Mus musculus
ctcagtgcaggttgtgacaatgtgg

SEQ ID NO: 915105 - DNA, 25 bp, Mus musculus
ctcagtggtgtccgcattgctagct

SEQ ID NO: 915106 - DNA, 25 bp, Mus musculus
ctcagtggtgtccgtgttgccagtg

SEQ ID NO: 915107 - DNA, 25 bp, Mus musculus
ctcagtggtgtcggcattgctagct

SEQ ID NO: 915108 - DNA, 25 bp, Mus musculus
ctcagtggtgtcggtgttgccagtg

SEQ ID NO: 915109 - DNA, 25 bp, Mus musculus
ctcagtgtgtgcaaaaaatccgaga

SEQ ID NO: 915110 - DNA, 25 bp, Mus musculus
ctcagtgtgtgcaataaatccgaga

SEQ ID NO: 915111 - DNA, 25 bp, Mus musculus
ctcagttcacagaaataccagatcc

SEQ ID NO: 915112 - DNA, 25 bp, Mus musculus
ctcagttcacagtaataccagatcc

SEQ ID NO: 915113 - DNA, 25 bp, Mus musculus
ctcagttcctaccacatcctgaata

SEQ ID NO: 915114 - DNA, 25 bp, Mus musculus
ctcagttcctaccagatcctgaata

SEQ ID NO: 915115 - DNA, 25 bp, Mus musculus
ctcagttgcatacacgtggatgagt

SEQ ID NO: 915116 - DNA, 25 bp, Mus musculus
ctcagttgcatagacgtggatgagt

SEQ ID NO: 915117 - DNA, 25 bp, Mus musculus
ctcagtttctcctcttggataacca

SEQ ID NO: 915118 - DNA, 25 bp, Mus musculus
ctcagtttctgcagacttgtactgg

SEQ ID NO: 915119 - DNA, 25 bp, Mus musculus
ctcagtttctgcagtcttgtactgg

SEQ ID NO: 915120 - DNA, 25 bp, Mus musculus
ctcagtttctgctcttggataacca

SEQ ID NO: 915121 - DNA, 25 bp, Mus musculus
ctcataagtaaacgagaggagccaa

SEQ ID NO: 915122 - DNA, 25 bp, Mus musculus
ctcataagtaaaggagaggagccaa

SEQ ID NO: 915123 - DNA, 25 bp, Mus musculus
ctcataattgcccacgactcgttaa

SEQ ID NO: 915124 - DNA, 25 bp, Mus musculus
ctcataattgcccactatttaacag

SEQ ID NO: 915125 - DNA, 25 bp, Mus musculus
ctcataattgcccaggactcgttaa

SEQ ID NO: 915126 - DNA, 25 bp, Mus musculus
ctcataattgcccagtatttaacag

SEQ ID NO: 915127 - DNA, 25 bp, Mus musculus
ctcatacaccagcaactctgatgat

SEQ ID NO: 915128 - DNA, 25 bp, Mus musculus
ctcatacaccaggaactctgatgat

SEQ ID NO: 915129 - DNA, 25 bp, Mus musculus
ctcatacagacacaacgacagaacc

SEQ ID NO: 915130 - DNA, 25 bp, Mus musculus
ctcatacagacagaacgacagaacc

SEQ ID NO: 915131 - DNA, 25 bp, Mus musculus
ctcatagacaacatgggagctttct

SEQ ID NO: 915132 - DNA, 25 bp, Mus musculus
ctcatagacaacttgggagctttct

SEQ ID NO: 915133 - DNA, 25 bp, Mus musculus
ctcatagacacacaaacagctatga

SEQ ID NO: 915134 - DNA, 25 bp, Mus musculus
ctcatagacacagaaacagctatga

SEQ ID NO: 915135 - DNA, 25 bp, Mus musculus
ctcatagcagagccgctccatgggc

SEQ ID NO: 915136 - DNA, 25 bp, Mus musculus
ctcatagcagtgccgctccatgggc

SEQ ID NO: 915137 - DNA, 25 bp, Mus musculus
ctcatatctgcgaactctcagactt

SEQ ID NO: 915138 - DNA, 25 bp, Mus musculus
ctcatatctgggaactctcagactt

SEQ ID NO: 915139 - DNA, 25 bp, Mus musculus
ctcatatttaagcgaaaatctctga

SEQ ID NO: 915140 - DNA, 25 bp, Mus musculus
ctcatatttaagggaaaatctctga

SEQ ID NO: 915141 - DNA, 25 bp, Mus musculus
ctcatcaaagagctcgggttccctc

SEQ ID NO: 915142 - DNA, 25 bp, Mus musculus
ctcatcaaagaggtcgggttccctc

SEQ ID NO: 915143 - DNA, 25 bp, Mus musculus
ctcatcaaattgcacaagacagtgg

SEQ ID NO: 915144 - DNA, 25 bp, Mus musculus
ctcatcaaattggacaagacagtgg

SEQ ID NO: 915145 - DNA, 25 bp, Mus musculus
ctcatcaactggacaggagagggtg

SEQ ID NO: 915146 - DNA, 25 bp, Mus musculus
ctcatcaactggtcaggagagggtg

SEQ ID NO: 915147 - DNA, 25 bp, Mus musculus
ctcatcaagcatcgaggaaggggag

SEQ ID NO: 915148 - DNA, 25 bp, Mus musculus
ctcatcaagcatggaggaaggggag

SEQ ID NO: 915149 - DNA, 25 bp, Mus musculus
ctcatcaagctacggatggagaacg

SEQ ID NO: 915150 - DNA, 25 bp, Mus musculus
ctcatcaagctagggatggagaacg

SEQ ID NO: 915151 - DNA, 25 bp, Mus musculus
ctcatcaagtgacgaatctgaggaa

SEQ ID NO: 915152 - DNA, 25 bp, Mus musculus
ctcatcaagtgaggaatctgaggaa

SEQ ID NO: 915153 - DNA, 25 bp, Mus musculus
ctcatcaatgcacgaaaggaaacag

SEQ ID NO: 915154 - DNA, 25 bp, Mus musculus
ctcatcaatgcaggaaaggaaacag

SEQ ID NO: 915155 - DNA, 25 bp, Mus musculus
ctcatcaattcatttggtgccattt

SEQ ID NO: 915156 - DNA, 25 bp, Mus musculus
ctcatcaattgatttggtgccattt

SEQ ID NO: 915157 - DNA, 25 bp, Mus musculus
ctcatcacaccacgctcagctcaca

SEQ ID NO: 915158 - DNA, 25 bp, Mus musculus
ctcatcacaccaggctcagctcaca

SEQ ID NO: 915159 - DNA, 25 bp, Mus musculus
ctcatcacactgatgaagagaagga

SEQ ID NO: 915160 - DNA, 25 bp, Mus musculus
ctcatcacactgttgaagagaagga

SEQ ID NO: 915161 - DNA, 25 bp, Mus musculus
ctcatcacggcccgcctaaggaacg

SEQ ID NO: 915162 - DNA, 25 bp, Mus musculus
ctcatcacgggccgcctaaggaacg

SEQ ID NO: 915163 - DNA, 25 bp, Mus musculus
ctcatcagcctgaacgagaaggatg

SEQ ID NO: 915164 - DNA, 25 bp, Mus musculus
ctcatcagcctgtacgagaaggatg

SEQ ID NO: 915165 - DNA, 25 bp, Mus musculus
ctcatcagtacagcagtaggcaagt

SEQ ID NO: 915166 - DNA, 25 bp, Mus musculus
ctcatcagtacagctgtaggcaagt

SEQ ID NO: 915167 - DNA, 25 bp, Mus musculus
ctcatcagtcagatctcaggttcca

SEQ ID NO: 915168 - DNA, 25 bp, Mus musculus
ctcatcagtcagttctcaggttcca

SEQ ID NO: 915169 - DNA, 25 bp, Mus musculus
ctcatcatccagctggacaagtctg

SEQ ID NO: 915170 - DNA, 25 bp, Mus musculus
ctcatcatccagctggatagcagtg

SEQ ID NO: 915171 - DNA, 25 bp, Mus musculus
ctcatcatccaggtggacaagtctg

SEQ ID NO: 915172 - DNA, 25 bp, Mus musculus
ctcatcatccaggtggatagcagtg

SEQ ID NO: 915173 - DNA, 25 bp, Mus musculus
ctcatcatcccgaacgttcttgctc

SEQ ID NO: 915174 - DNA, 25 bp, Mus musculus
ctcatcatcccgaaggttcttgctc

SEQ ID NO: 915175 - DNA, 25 bp, Mus musculus
ctcatcattgcgggaggaggtggtc

SEQ ID NO: 915176 - DNA, 25 bp, Mus musculus
ctcatcattgggggaggaggtggtc

SEQ ID NO: 915177 - DNA, 25 bp, Mus musculus
ctcatccacgcacgttctggccagc

SEQ ID NO: 915178 - DNA, 25 bp, Mus musculus
ctcatccacgcaggttctggccagc

SEQ ID NO: 915179 - DNA, 25 bp, Mus musculus
ctcatccagactctgttcatctcca

SEQ ID NO: 915180 - DNA, 25 bp, Mus musculus
ctcatccagactgtgttcatctcca

SEQ ID NO: 915181 - DNA, 25 bp, Mus musculus
ctcatcccagcagaaaagcccgtga

SEQ ID NO: 915182 - DNA, 25 bp, Mus musculus
ctcatcccaggagaaaagcccgtga

SEQ ID NO: 915183 - DNA, 25 bp, Mus musculus
ctcatccgctgacacccatgcggac

SEQ ID NO: 915184 - DNA, 25 bp, Mus musculus
ctcatccgctgacatgctggtggac

SEQ ID NO: 915185 - DNA, 25 bp, Mus musculus
ctcatccgctgagacccatgcggac

SEQ ID NO: 915186 - DNA, 25 bp, Mus musculus
ctcatccgctgagatgctggtggac

SEQ ID NO: 915187 - DNA, 25 bp, Mus musculus
ctcatcctgcagcaaattgccttca

SEQ ID NO: 915188 - DNA, 25 bp, Mus musculus
ctcatcctgcaggaaattgccttca

SEQ ID NO: 915189 - DNA, 25 bp, Mus musculus
ctcatcctggactacgtgagcggtg

SEQ ID NO: 915190 - DNA, 25 bp, Mus musculus
ctcatcctggtctacgtgagcggtg

SEQ ID NO: 915191 - DNA, 25 bp, Mus musculus
ctcatccttatacgagaaaccatca

SEQ ID NO: 915192 - DNA, 25 bp, Mus musculus
ctcatccttataggagaaaccatca

SEQ ID NO: 915193 - DNA, 25 bp, Mus musculus
ctcatcgaagcctttctgggtgccc

SEQ ID NO: 915194 - DNA, 25 bp, Mus musculus
ctcatcgaaggctttctgggtgccc

SEQ ID NO: 915195 - DNA, 25 bp, Mus musculus
ctcatcgacaaggacgtcatcagtc

SEQ ID NO: 915196 - DNA, 25 bp, Mus musculus
ctcatcgacaaggaggtcatcagtc

SEQ ID NO: 915197 - DNA, 25 bp, Mus musculus
ctcatcggaacccacattgatctcc

SEQ ID NO: 915198 - DNA, 25 bp, Mus musculus
ctcatcggaacccagattgatctcc

SEQ ID NO: 915199 - DNA, 25 bp, Mus musculus
ctcatcgtccgccacactcagtccg

SEQ ID NO: 915200 - DNA, 25 bp, Mus musculus
ctcatcgtccgccacagtacagttg

SEQ ID NO: 915201 - DNA, 25 bp, Mus musculus
ctcatcgtccgccagactcagtccg

SEQ ID NO: 915202 - DNA, 25 bp, Mus musculus
ctcatcgtccgccagagtacagttg

SEQ ID NO: 915203 - DNA, 25 bp, Mus musculus
ctcatcgtggactgcgatattcacc

SEQ ID NO: 915204 - DNA, 25 bp, Mus musculus
ctcatcgtggactgggatattcacc

SEQ ID NO: 915205 - DNA, 25 bp, Mus musculus
ctcatcgtggattactcctgcgccc

SEQ ID NO: 915206 - DNA, 25 bp, Mus musculus
ctcatcgtggtttactcctgcgccc

SEQ ID NO: 915207 - DNA, 25 bp, Mus musculus
ctcatctacttcaaccctcagtaca

SEQ ID NO: 915208 - DNA, 25 bp, Mus musculus
ctcatctacttcaagcctcagtaca

SEQ ID NO: 915209 - DNA, 25 bp, Mus musculus
ctcatctagattcggcaaatacatg

SEQ ID NO: 915210 - DNA, 25 bp, Mus musculus
ctcatctagattgggcaaatacatg

SEQ ID NO: 915211 - DNA, 25 bp, Mus musculus
ctcatctataagcaccctgctgtgg

SEQ ID NO: 915212 - DNA, 25 bp, Mus musculus
ctcatctataagcagcctgctgtgg

SEQ ID NO: 915213 - DNA, 25 bp, Mus musculus
ctcatctatgagcgctacgagggcc

SEQ ID NO: 915214 - DNA, 25 bp, Mus musculus
ctcatctatgagggctacgagggcc

SEQ ID NO: 915215 - DNA, 25 bp, Mus musculus
ctcatctcagcgctgtccaagaagc

SEQ ID NO: 915216 - DNA, 25 bp, Mus musculus
ctcatctcagggctgtccaagaagc

SEQ ID NO: 915217 - DNA, 25 bp, Mus musculus
ctcatctccaagatcaagtcgccgt

SEQ ID NO: 915218 - DNA, 25 bp, Mus musculus
ctcatctccaagttcaagtcgccgt

SEQ ID NO: 915219 - DNA, 25 bp, Mus musculus
ctcatctcccagacatacgggagcc

SEQ ID NO: 915220 - DNA, 25 bp, Mus musculus
ctcatctcccagtcatacgggagcc

SEQ ID NO: 915221 - DNA, 25 bp, Mus musculus
ctcatctccgacttcttcgccaagc

SEQ ID NO: 915222 - DNA, 25 bp, Mus musculus
ctcatctccgtcttcttcgccaagc

SEQ ID NO: 915223 - DNA, 25 bp, Mus musculus
ctcatctctgggcgatcctaaaact

SEQ ID NO: 915224 - DNA, 25 bp, Mus musculus
ctcatctctgggggatcctaaaact

SEQ ID NO: 915225 - DNA, 25 bp, Mus musculus
ctcatctgccgagacgggtcccaca

SEQ ID NO: 915226 - DNA, 25 bp, Mus musculus
ctcatctgccgagaggggtcccaca

SEQ ID NO: 915227 - DNA, 25 bp, Mus musculus
ctcatctgggataacgacgacccac

SEQ ID NO: 915228 - DNA, 25 bp, Mus musculus
ctcatctgggataaggacgacccac

SEQ ID NO: 915229 - DNA, 25 bp, Mus musculus
ctcatcttcacacagcagccggaga

SEQ ID NO: 915230 - DNA, 25 bp, Mus musculus
ctcatcttcacagcacagcagccgg

SEQ ID NO: 915231 - DNA, 25 bp, Mus musculus
ctcatcttcagacagcagccggaga

SEQ ID NO: 915232 - DNA, 25 bp, Mus musculus
ctcatcttcagagcacagcagccgg

SEQ ID NO: 915233 - DNA, 25 bp, Mus musculus
ctcatcttctggcgggcagctggca

SEQ ID NO: 915234 - DNA, 25 bp, Mus musculus
ctcatcttctggggggcagctggca

SEQ ID NO: 915235 - DNA, 25 bp, Mus musculus
ctcatcttggtccacgatctttctc

SEQ ID NO: 915236 - DNA, 25 bp, Mus musculus
ctcatcttggtccacgtcatcccag

SEQ ID NO: 915237 - DNA, 25 bp, Mus musculus
ctcatcttggtccaggatctttctc

SEQ ID NO: 915238 - DNA, 25 bp, Mus musculus
ctcatcttggtccaggtcatcccag

SEQ ID NO: 915239 - DNA, 25 bp, Mus musculus
ctcatcttttctgccgttgatccaa

SEQ ID NO: 915240 - DNA, 25 bp, Mus musculus
ctcatcttttctgcggttgatccaa

SEQ ID NO: 915241 - DNA, 25 bp, Mus musculus
ctcatgaaatgaaagcatcgacatc

SEQ ID NO: 915242 - DNA, 25 bp, Mus musculus
ctcatgaaatgatagcatcgacatc

SEQ ID NO: 915243 - DNA, 25 bp, Mus musculus
ctcatgagcgcgacatacttcaatg

SEQ ID NO: 915244 - DNA, 25 bp, Mus musculus
ctcatgagcgcgtcatacttcaatg

SEQ ID NO: 915245 - DNA, 25 bp, Mus musculus
ctcatgcaatagaaatgatcaaaac

SEQ ID NO: 915246 - DNA, 25 bp, Mus musculus
ctcatgcaatagatccagttcagac

SEQ ID NO: 915247 - DNA, 25 bp, Mus musculus
ctcatgcaatagtaatgatcaaaac

SEQ ID NO: 915248 - DNA, 25 bp, Mus musculus
ctcatgcaatagttccagttcagac

SEQ ID NO: 915249 - DNA, 25 bp, Mus musculus
ctcatgcacttacacctggattaca

SEQ ID NO: 915250 - DNA, 25 bp, Mus musculus
ctcatgcacttacagctggattaca

SEQ ID NO: 915251 - DNA, 25 bp, Mus musculus
ctcatgcagcaacgttctgagctca

SEQ ID NO: 915252 - DNA, 25 bp, Mus musculus
ctcatgcagcaaggttctgagctca

SEQ ID NO: 915253 - DNA, 25 bp, Mus musculus
ctcatgcaggatgctgatgccccct

SEQ ID NO: 915254 - DNA, 25 bp, Mus musculus
ctcatgcaggttgctgatgccccct

SEQ ID NO: 915255 - DNA, 25 bp, Mus musculus
ctcatgccagctatgaacctgaact

SEQ ID NO: 915256 - DNA, 25 bp, Mus musculus
ctcatgccagcttttttattggcac

SEQ ID NO: 915257 - DNA, 25 bp, Mus musculus
ctcatgccaggtatgaacctgaact

SEQ ID NO: 915258 - DNA, 25 bp, Mus musculus
ctcatgccaggttttttattggcac

SEQ ID NO: 915259 - DNA, 25 bp, Mus musculus
ctcatgcccaatcgtctgcgcggac

SEQ ID NO: 915260 - DNA, 25 bp, Mus musculus
ctcatgcccaatggtctgcgcggac

SEQ ID NO: 915261 - DNA, 25 bp, Mus musculus
ctcatgcctggaaacggccaaggag

SEQ ID NO: 915262 - DNA, 25 bp, Mus musculus
ctcatgcctggaaagggccaaggag

SEQ ID NO: 915263 - DNA, 25 bp, Mus musculus
ctcatgcctttgcgcttggaagtgt

SEQ ID NO: 915264 - DNA, 25 bp, Mus musculus
ctcatgcctttgggcttggaagtgt

SEQ ID NO: 915265 - DNA, 25 bp, Mus musculus
ctcatgctagatcagcaatcagcaa

SEQ ID NO: 915266 - DNA, 25 bp, Mus musculus
ctcatgctagttcagcaatcagcaa

SEQ ID NO: 915267 - DNA, 25 bp, Mus musculus
ctcatggaagccgcccctcggagtg

SEQ ID NO: 915268 - DNA, 25 bp, Mus musculus
ctcatggaaggcgcccctcggagtg

SEQ ID NO: 915269 - DNA, 25 bp, Mus musculus
ctcatggaatcacctgctctgccct

SEQ ID NO: 915270 - DNA, 25 bp, Mus musculus
ctcatggaatcacgtgccaacaggc

SEQ ID NO: 915271 - DNA, 25 bp, Mus musculus
ctcatggaatcagctgctctgccct

SEQ ID NO: 915272 - DNA, 25 bp, Mus musculus
ctcatggaatcaggtgccaacaggc

SEQ ID NO: 915273 - DNA, 25 bp, Mus musculus
ctcatggagtctatgctctaaaagc

SEQ ID NO: 915274 - DNA, 25 bp, Mus musculus
ctcatggagtctttgctctaaaagc

SEQ ID NO: 915275 - DNA, 25 bp, Mus musculus
ctcatggccctagacgtgccagagc

SEQ ID NO: 915276 - DNA, 25 bp, Mus musculus
ctcatggccctagaggtgccagagc

SEQ ID NO: 915277 - DNA, 25 bp, Mus musculus
ctcatggccctgggcctgggtcctt

SEQ ID NO: 915278 - DNA, 25 bp, Mus musculus
ctcatggccctggggctgggtcctt

SEQ ID NO: 915279 - DNA, 25 bp, Mus musculus
ctcatggctcagctgaaccagacct

SEQ ID NO: 915280 - DNA, 25 bp, Mus musculus
ctcatggctcaggtgaaccagacct

SEQ ID NO: 915281 - DNA, 25 bp, Mus musculus
ctcatggctgcgcgtttcctgtgct

SEQ ID NO: 915282 - DNA, 25 bp, Mus musculus
ctcatggctgcgggtttcctgtgct

SEQ ID NO: 915283 - DNA, 25 bp, Mus musculus
ctcatggctggaggcgatgccaaca

SEQ ID NO: 915284 - DNA, 25 bp, Mus musculus
ctcatggctggaggcgtgatggtaa

SEQ ID NO: 915285 - DNA, 25 bp, Mus musculus
ctcatggctggaggggatgccaaca

SEQ ID NO: 915286 - DNA, 25 bp, Mus musculus
ctcatggctggaggggtgatggtaa

SEQ ID NO: 915287 - DNA, 25 bp, Mus musculus
ctcatgggacagctgaacaccttta

SEQ ID NO: 915288 - DNA, 25 bp, Mus musculus
ctcatgggacaggtgaacaccttta

SEQ ID NO: 915289 - DNA, 25 bp, Mus musculus
ctcatgggcagaggcaacatcccaa

SEQ ID NO: 915290 - DNA, 25 bp, Mus musculus
ctcatgggcagagggaacatcccaa

SEQ ID NO: 915291 - DNA, 25 bp, Mus musculus
ctcatgtcagcacgaaatgatggat

SEQ ID NO: 915292 - DNA, 25 bp, Mus musculus
ctcatgtcagcacgctggcgcattg

SEQ ID NO: 915293 - DNA, 25 bp, Mus musculus
ctcatgtcagcaggaaatgatggat

SEQ ID NO: 915294 - DNA, 25 bp, Mus musculus
ctcatgtcagcaggctggcgcattg

SEQ ID NO: 915295 - DNA, 25 bp, Mus musculus
ctcatgtgcatgaccatgctgtgga

SEQ ID NO: 915296 - DNA, 25 bp, Mus musculus
ctcatgtgcatgatcatgacttgca

SEQ ID NO: 915297 - DNA, 25 bp, Mus musculus
ctcatgtgcatgtccatgctgtgga

SEQ ID NO: 915298 - DNA, 25 bp, Mus musculus
ctcatgtgcatgttcatgacttgca

SEQ ID NO: 915299 - DNA, 25 bp, Mus musculus
ctcatgttctagccagcaagagctt

SEQ ID NO: 915300 - DNA, 25 bp, Mus musculus
ctcatgttctaggcagcaagagctt

SEQ ID NO: 915301 - DNA, 25 bp, Mus musculus
ctcatgtttaatagttcctgctgct

SEQ ID NO: 915302 - DNA, 25 bp, Mus musculus
ctcatgtttaattgttcctgctgct

SEQ ID NO: 915303 - DNA, 25 bp, Mus musculus
ctcattaaagcaaaaggatataact

SEQ ID NO: 915304 - DNA, 25 bp, Mus musculus
ctcattaaaggaaaaggatataact

SEQ ID NO: 915305 - DNA, 25 bp, Mus musculus
ctcattactgtacacgtggtacctg

SEQ ID NO: 915306 - DNA, 25 bp, Mus musculus
ctcattactgtacaggtggtacctg

SEQ ID NO: 915307 - DNA, 25 bp, Mus musculus
ctcattattctgaagtggctgatgg

SEQ ID NO: 915308 - DNA, 25 bp, Mus musculus
ctcattattctgtagtggctgatgg

SEQ ID NO: 915309 - DNA, 25 bp, Mus musculus
ctcattcctccacctacactcctct

SEQ ID NO: 915310 - DNA, 25 bp, Mus musculus
ctcattcctccagctacactcctct

SEQ ID NO: 915311 - DNA, 25 bp, Mus musculus
ctcattcgcgctgtggacagaggcg

SEQ ID NO: 915312 - DNA, 25 bp, Mus musculus
ctcattcgcggtgtggacagaggcg

SEQ ID NO: 915313 - DNA, 25 bp, Mus musculus
ctcattctgcagcgcagagtcgagg

SEQ ID NO: 915314 - DNA, 25 bp, Mus musculus
ctcattctgcagggcagagtcgagg

SEQ ID NO: 915315 - DNA, 25 bp, Mus musculus
ctcattctggtgcacgtagagcagc

SEQ ID NO: 915316 - DNA, 25 bp, Mus musculus
ctcattctggtgcaggtagagcagc

SEQ ID NO: 915317 - DNA, 25 bp, Mus musculus
ctcattctttttaacctatcccaga

SEQ ID NO: 915318 - DNA, 25 bp, Mus musculus
ctcattctttttaagctatcccaga

SEQ ID NO: 915319 - DNA, 25 bp, Mus musculus
ctcattgactttgacggcaaaaaag

SEQ ID NO: 915320 - DNA, 25 bp, Mus musculus
ctcattgactttgagggcaaaaaag

SEQ ID NO: 915321 - DNA, 25 bp, Mus musculus
ctcattgatgtgcatgagaaaaacc

SEQ ID NO: 915322 - DNA, 25 bp, Mus musculus
ctcattgatgtggatgagaaaaacc

SEQ ID NO: 915323 - DNA, 25 bp, Mus musculus
ctcattgcaaacaacgaacatttac

SEQ ID NO: 915324 - DNA, 25 bp, Mus musculus
ctcattgcaaacaaggaacatttac

SEQ ID NO: 915325 - DNA, 25 bp, Mus musculus
ctcattgcagcccagattaacactt

SEQ ID NO: 915326 - DNA, 25 bp, Mus musculus
ctcattgcaggccagattaacactt

SEQ ID NO: 915327 - DNA, 25 bp, Mus musculus
ctcattggagcctccatccctgaag

SEQ ID NO: 915328 - DNA, 25 bp, Mus musculus
ctcattggaggctccatccctgaag

SEQ ID NO: 915329 - DNA, 25 bp, Mus musculus
ctcattgggaagaacgtcaatgtga

SEQ ID NO: 915330 - DNA, 25 bp, Mus musculus
ctcattgggaagaaggtcaatgtga

SEQ ID NO: 915331 - DNA, 25 bp, Mus musculus
ctcattggtctaatctctgaccgcc

SEQ ID NO: 915332 - DNA, 25 bp, Mus musculus
ctcattggtctattctctgaccgcc

SEQ ID NO: 915333 - DNA, 25 bp, Mus musculus
ctcattgttgcaaactctgctctca

SEQ ID NO: 915334 - DNA, 25 bp, Mus musculus
ctcattgttggaaactctgctctca

SEQ ID NO: 915335 - DNA, 25 bp, Mus musculus
ctcatttatgatcccataaaaactg

SEQ ID NO: 915336 - DNA, 25 bp, Mus musculus
ctcatttatgttcccataaaaactg

SEQ ID NO: 915337 - DNA, 25 bp, Mus musculus
ctcatttcagattgccctctgccac

SEQ ID NO: 915338 - DNA, 25 bp, Mus musculus
ctcatttcagtttgccctctgccac

SEQ ID NO: 915339 - DNA, 25 bp, Mus musculus
ctcatttccgagcctactaaagcag

SEQ ID NO: 915340 - DNA, 25 bp, Mus musculus
ctcatttccgaggctactaaagcag

SEQ ID NO: 915341 - DNA, 25 bp, Mus musculus
ctcatttggatgccaccacccctgt

SEQ ID NO: 915342 - DNA, 25 bp, Mus musculus
ctcatttggatggcaccacccctgt

SEQ ID NO: 915343 - DNA, 25 bp, Mus musculus
ctcatttgtcctacatgtaacgtga

SEQ ID NO: 915344 - DNA, 25 bp, Mus musculus
ctcatttgtccttcatgtaacgtga

SEQ ID NO: 915345 - DNA, 25 bp, Mus musculus
ctcatttgttcgcttcagttcccat

SEQ ID NO: 915346 - DNA, 25 bp, Mus musculus
ctcatttgttcggttcagttcccat

SEQ ID NO: 915347 - DNA, 25 bp, Mus musculus
ctcattttcagtcacatatacttta

SEQ ID NO: 915348 - DNA, 25 bp, Mus musculus
ctcattttcagtcagatatacttta

SEQ ID NO: 915349 - DNA, 25 bp, Mus musculus
ctccaaaaacaccgcatcttgagta

SEQ ID NO: 915350 - DNA, 25 bp, Mus musculus
ctccaaaaacacggcatcttgagta

SEQ ID NO: 915351 - DNA, 25 bp, Mus musculus
ctccaaaaacttcaccctcatcaaa

SEQ ID NO: 915352 - DNA, 25 bp, Mus musculus
ctccaaaaacttgaccctcatcaaa

SEQ ID NO: 915353 - DNA, 25 bp, Mus musculus
ctccaaaaagcccaactgctttgag

SEQ ID NO: 915354 - DNA, 25 bp, Mus musculus
ctccaaaaagccgaactgctttgag

SEQ ID NO: 915355 - DNA, 25 bp, Mus musculus
ctccaaaagcagatggcagccaagg

SEQ ID NO: 915356 - DNA, 25 bp, Mus musculus
ctccaaaagcagttggcagccaagg

SEQ ID NO: 915357 - DNA, 25 bp, Mus musculus
ctccaaaagtgaccaattttcagag

SEQ ID NO: 915358 - DNA, 25 bp, Mus musculus
ctccaaaagtgacctattttcagag

SEQ ID NO: 915359 - DNA, 25 bp, Mus musculus
ctccaaaccacccacatctcttgct

SEQ ID NO: 915360 - DNA, 25 bp, Mus musculus
ctccaaaccacccagatctcttgct

SEQ ID NO: 915361 - DNA, 25 bp, Mus musculus
ctccaaacctcacaggccagagcaa

SEQ ID NO: 915362 - DNA, 25 bp, Mus musculus
ctccaaacctcagaggccagagcaa

SEQ ID NO: 915363 - DNA, 25 bp, Mus musculus
ctccaaacgccccacgtctcttgtg

SEQ ID NO: 915364 - DNA, 25 bp, Mus musculus
ctccaaacgccccaggtctcttgtg

SEQ ID NO: 915365 - DNA, 25 bp, Mus musculus
ctccaaagagaacgaaaagtgatag

SEQ ID NO: 915366 - DNA, 25 bp, Mus musculus
ctccaaagagaaggaaaagtgatag

SEQ ID NO: 915367 - DNA, 25 bp, Mus musculus
ctccaaaggattcgaacttctggag

SEQ ID NO: 915368 - DNA, 25 bp, Mus musculus
ctccaaaggattggaacttctggag

SEQ ID NO: 915369 - DNA, 25 bp, Mus musculus
ctccaaaggcagcaccttcctgcct

SEQ ID NO: 915370 - DNA, 25 bp, Mus musculus
ctccaaaggcaggaccttcctgcct

SEQ ID NO: 915371 - DNA, 25 bp, Mus musculus
ctccaaagtcagacaagaagatgaa

SEQ ID NO: 915372 - DNA, 25 bp, Mus musculus
ctccaaagtcagtcaagaagatgaa

SEQ ID NO: 915373 - DNA, 25 bp, Mus musculus
ctccaaataaagctgcaatgatgag

SEQ ID NO: 915374 - DNA, 25 bp, Mus musculus
ctccaaataaaggtgcaatgatgag

SEQ ID NO: 915375 - DNA, 25 bp, Mus musculus
ctccaacatcatcgaagttaaaatc

SEQ ID NO: 915376 - DNA, 25 bp, Mus musculus
ctccaacatcatgacagtgatctcc

SEQ ID NO: 915377 - DNA, 25 bp, Mus musculus
ctccaacatcatgagagtgatctcc

SEQ ID NO: 915378 - DNA, 25 bp, Mus musculus
ctccaacatcatggaagttaaaatc

SEQ ID NO: 915379 - DNA, 25 bp, Mus musculus
ctccaaccaccacttttggttcatc

SEQ ID NO: 915380 - DNA, 25 bp, Mus musculus
ctccaaccaccagttttggttcatc

SEQ ID NO: 915381 - DNA, 25 bp, Mus musculus
ctccaaccagatacagttagtgcag

SEQ ID NO: 915382 - DNA, 25 bp, Mus musculus
ctccaaccagcagtatctggacctg

SEQ ID NO: 915383 - DNA, 25 bp, Mus musculus
ctccaaccagccaatagttacagtt

SEQ ID NO: 915384 - DNA, 25 bp, Mus musculus
ctccaaccaggagtatctggacctg

SEQ ID NO: 915385 - DNA, 25 bp, Mus musculus
ctccaaccaggcaatagttacagtt

SEQ ID NO: 915386 - DNA, 25 bp, Mus musculus
ctccaaccagttacagttagtgcag

SEQ ID NO: 915387 - DNA, 25 bp, Mus musculus
ctccaacctgcttcgtcccttcact

SEQ ID NO: 915388 - DNA, 25 bp, Mus musculus
ctccaacctggttcgtcccttcact

SEQ ID NO: 915389 - DNA, 25 bp, Mus musculus
ctccaactgctgaacacgtgactgc

SEQ ID NO: 915390 - DNA, 25 bp, Mus musculus
ctccaactgctgaagacgtgactgc

SEQ ID NO: 915391 - DNA, 25 bp, Mus musculus
ctccaagagaaacatctcctgggct

SEQ ID NO: 915392 - DNA, 25 bp, Mus musculus
ctccaagagaaagatctcctgggct

SEQ ID NO: 915393 - DNA, 25 bp, Mus musculus
ctccaagagtcacatccaggctttt

SEQ ID NO: 915394 - DNA, 25 bp, Mus musculus
ctccaagagtcagatccaggctttt

SEQ ID NO: 915395 - DNA, 25 bp, Mus musculus
ctccaagcacagcacaatcgccagc

SEQ ID NO: 915396 - DNA, 25 bp, Mus musculus
ctccaagcacagcagaatcgccagc

SEQ ID NO: 915397 - DNA, 25 bp, Mus musculus
ctccaagcagatgacccggaagtac

SEQ ID NO: 915398 - DNA, 25 bp, Mus musculus
ctccaagcagcctgagctgatgagc

SEQ ID NO: 915399 - DNA, 25 bp, Mus musculus
ctccaagcaggctgagctgatgagc

SEQ ID NO: 915400 - DNA, 25 bp, Mus musculus
ctccaagcagttgacccggaagtac

SEQ ID NO: 915401 - DNA, 25 bp, Mus musculus
ctccaagcgctgcaacttccccagc

SEQ ID NO: 915402 - DNA, 25 bp, Mus musculus
ctccaagcgctggaacttccccagc

SEQ ID NO: 915403 - DNA, 25 bp, Mus musculus
ctccaagctgtacacgttgggctta

SEQ ID NO: 915404 - DNA, 25 bp, Mus musculus
ctccaagctgtacaggttgggctta

SEQ ID NO: 915405 - DNA, 25 bp, Mus musculus
ctccaaggagagctcaatactatca

SEQ ID NO: 915406 - DNA, 25 bp, Mus musculus
ctccaaggagaggtcaatactatca

SEQ ID NO: 915407 - DNA, 25 bp, Mus musculus
ctccaaggcaaacgtgttgaacgag

SEQ ID NO: 915408 - DNA, 25 bp, Mus musculus
ctccaaggcaaaggtgttgaacgag

SEQ ID NO: 915409 - DNA, 25 bp, Mus musculus
ctccaaggctaacgtgatttacgtg

SEQ ID NO: 915410 - DNA, 25 bp, Mus musculus
ctccaaggctaaggtgatttacgtg

SEQ ID NO: 915411 - DNA, 25 bp, Mus musculus
ctccaagggcaaggcactccgaggg

SEQ ID NO: 915412 - DNA, 25 bp, Mus musculus
ctccaagggcaagggactccgaggg

SEQ ID NO: 915413 - DNA, 25 bp, Mus musculus
ctccaagtcgtccccaaccagcccc

SEQ ID NO: 915414 - DNA, 25 bp, Mus musculus
ctccaagtcgtcgccaaccagcccc

SEQ ID NO: 915415 - DNA, 25 bp, Mus musculus
ctccaatgacaaatttgagtatctg

SEQ ID NO: 915416 - DNA, 25 bp, Mus musculus
ctccaatgacaattttgagtatctg

SEQ ID NO: 915417 - DNA, 25 bp, Mus musculus
ctccaatttgcacgtagctatccga

SEQ ID NO: 915418 - DNA, 25 bp, Mus musculus
ctccaatttgcaggtagctatccga

SEQ ID NO: 915419 - DNA, 25 bp, Mus musculus
ctccaattttaagacagggtgcctc

SEQ ID NO: 915420 - DNA, 25 bp, Mus musculus
ctccaattttaagagagggtgcctc

SEQ ID NO: 915421 - DNA, 25 bp, Mus musculus
ctccacaaagcctgtggtgaagctg

SEQ ID NO: 915422 - DNA, 25 bp, Mus musculus
ctccacaaaggctgtggtgaagctg

SEQ ID NO: 915423 - DNA, 25 bp, Mus musculus
ctccacacaagaaacctcagtctac

SEQ ID NO: 915424 - DNA, 25 bp, Mus musculus
ctccacacaagaaagctcagtctac

SEQ ID NO: 915425 - DNA, 25 bp, Mus musculus
ctccacacatgatccgaacaccatg

SEQ ID NO: 915426 - DNA, 25 bp, Mus musculus
ctccacacatgatcggaacaccatg

SEQ ID NO: 915427 - DNA, 25 bp, Mus musculus
ctccacacctcgaacgatcctgcac

SEQ ID NO: 915428 - DNA, 25 bp, Mus musculus
ctccacacctcgaaggatcctgcac

SEQ ID NO: 915429 - DNA, 25 bp, Mus musculus
ctccacactcaacatcaattctctc

SEQ ID NO: 915430 - DNA, 25 bp, Mus musculus
ctccacactcaagatcaattctctc

SEQ ID NO: 915431 - DNA, 25 bp, Mus musculus
ctccacagagcttggaaagctggtc

SEQ ID NO: 915432 - DNA, 25 bp, Mus musculus
ctccacagaggttggaaagctggtc

SEQ ID NO: 915433 - DNA, 25 bp, Mus musculus
ctccacagcacaattggtcagaaaa

SEQ ID NO: 915434 - DNA, 25 bp, Mus musculus
ctccacagcacatttggtcagaaaa

SEQ ID NO: 915435 - DNA, 25 bp, Mus musculus
ctccacagctccggtgctcttagca

SEQ ID NO: 915436 - DNA, 25 bp, Mus musculus
ctccacagctgcggtgctcttagca

SEQ ID NO: 915437 - DNA, 25 bp, Mus musculus
ctccacagtccctggagagtcaggc

SEQ ID NO: 915438 - DNA, 25 bp, Mus musculus
ctccacagtcgctggagagtcaggc

SEQ ID NO: 915439 - DNA, 25 bp, Mus musculus
ctccacagtgtaaacctctatgtca

SEQ ID NO: 915440 - DNA, 25 bp, Mus musculus
ctccacagtgtaaagctctatgtca

SEQ ID NO: 915441 - DNA, 25 bp, Mus musculus
ctccacattgtcaacgtggtggcca

SEQ ID NO: 915442 - DNA, 25 bp, Mus musculus
ctccacattgtcaaggtggtggcca

SEQ ID NO: 915443 - DNA, 25 bp, Mus musculus
ctccaccaagccttacctgatgaag

SEQ ID NO: 915444 - DNA, 25 bp, Mus musculus
ctccaccaaggcttacctgatgaag

SEQ ID NO: 915445 - DNA, 25 bp, Mus musculus
ctccaccaccagctttcctgctgaa

SEQ ID NO: 915446 - DNA, 25 bp, Mus musculus
ctccaccaccaggtttcctgctgaa

SEQ ID NO: 915447 - DNA, 25 bp, Mus musculus
ctccaccagcagctccagacaagaa

SEQ ID NO: 915448 - DNA, 25 bp, Mus musculus
ctccaccagcaggtccagacaagaa

SEQ ID NO: 915449 - DNA, 25 bp, Mus musculus
ctccaccaggcgcacgttagatgat

SEQ ID NO: 915450 - DNA, 25 bp, Mus musculus
ctccaccaggggcacgttagatgat

SEQ ID NO: 915451 - DNA, 25 bp, Mus musculus
ctccacccccagaaacgtgtgccgt

SEQ ID NO: 915452 - DNA, 25 bp, Mus musculus
ctccacccccagtaacgtgtgccgt

SEQ ID NO: 915453 - DNA, 25 bp, Mus musculus
ctccacccttgactcaagtccatca

SEQ ID NO: 915454 - DNA, 25 bp, Mus musculus
ctccacccttgagtcaagtccatca

SEQ ID NO: 915455 - DNA, 25 bp, Mus musculus
ctccaccgacggcatcggctttgcc

SEQ ID NO: 915456 - DNA, 25 bp, Mus musculus
ctccaccgacgggatcggctttgcc

SEQ ID NO: 915457 - DNA, 25 bp, Mus musculus
ctccaccgtcagagtgtgggatgta

SEQ ID NO: 915458 - DNA, 25 bp, Mus musculus
ctccaccgtcagtgtgtgggatgta

SEQ ID NO: 915459 - DNA, 25 bp, Mus musculus
ctccacctccagaggtgtcttccag

SEQ ID NO: 915460 - DNA, 25 bp, Mus musculus
ctccacctccagtggtgtcttccag

SEQ ID NO: 915461 - DNA, 25 bp, Mus musculus
ctccacctctccacagaagaatgag

SEQ ID NO: 915462 - DNA, 25 bp, Mus musculus
ctccacctctgcacagaagaatgag

SEQ ID NO: 915463 - DNA, 25 bp, Mus musculus
ctccaccttctcactcttcctcctg

SEQ ID NO: 915464 - DNA, 25 bp, Mus musculus
ctccaccttctctctcttcctcctg

SEQ ID NO: 915465 - DNA, 25 bp, Mus musculus
ctccacgaacaactgcaccagggac

SEQ ID NO: 915466 - DNA, 25 bp, Mus musculus
ctccacgaacaagtgcaccagggac

SEQ ID NO: 915467 - DNA, 25 bp, Mus musculus
ctccacggagcttggtcacctaatc

SEQ ID NO: 915468 - DNA, 25 bp, Mus musculus
ctccacggaggttggtcacctaatc

SEQ ID NO: 915469 - DNA, 25 bp, Mus musculus
ctccacgtgcagcgtctgttgcatg

SEQ ID NO: 915470 - DNA, 25 bp, Mus musculus
ctccacgtgcagggtctgttgcatg

SEQ ID NO: 915471 - DNA, 25 bp, Mus musculus
ctccactattaaaacagggtgcctc

SEQ ID NO: 915472 - DNA, 25 bp, Mus musculus
ctccactattaaaagagggtgcctc

SEQ ID NO: 915473 - DNA, 25 bp, Mus musculus
ctccactcatggagctgacctgcag

SEQ ID NO: 915474 - DNA, 25 bp, Mus musculus
ctccactcatggtgctgacctgcag

SEQ ID NO: 915475 - DNA, 25 bp, Mus musculus
ctccactccagaaagtggagtggcc

SEQ ID NO: 915476 - DNA, 25 bp, Mus musculus
ctccactccagatagtggagtggcc

SEQ ID NO: 915477 - DNA, 25 bp, Mus musculus
ctccactggagaagaagtggccatg

SEQ ID NO: 915478 - DNA, 25 bp, Mus musculus
ctccactggagatgaagtggccatg

SEQ ID NO: 915479 - DNA, 25 bp, Mus musculus
ctccactggcagctcaaaaatgtga

SEQ ID NO: 915480 - DNA, 25 bp, Mus musculus
ctccactggcaggtcaaaaatgtga

SEQ ID NO: 915481 - DNA, 25 bp, Mus musculus
ctccacttcaagatcaaagatcctg

SEQ ID NO: 915482 - DNA, 25 bp, Mus musculus
ctccacttcaagttcaaagatcctg

SEQ ID NO: 915483 - DNA, 25 bp, Mus musculus
ctccacttggcgggatcggatgtgg

SEQ ID NO: 915484 - DNA, 25 bp, Mus musculus
ctccacttggggaaccctgagatgg

SEQ ID NO: 915485 - DNA, 25 bp, Mus musculus
ctccacttggggaagcctgagatgg

SEQ ID NO: 915486 - DNA, 25 bp, Mus musculus
ctccacttggggggatcggatgtgg

SEQ ID NO: 915487 - DNA, 25 bp, Mus musculus
ctccactttgctgaaagtcaacata

SEQ ID NO: 915488 - DNA, 25 bp, Mus musculus
ctccactttggtgaaagtcaacata

SEQ ID NO: 915489 - DNA, 25 bp, Mus musculus
ctccagaaaacacatctttgtacca

SEQ ID NO: 915490 - DNA, 25 bp, Mus musculus
ctccagaaaacagatctttgtacca

SEQ ID NO: 915491 - DNA, 25 bp, Mus musculus
ctccagaaagctccaatcactgcag

SEQ ID NO: 915492 - DNA, 25 bp, Mus musculus
ctccagaaaggtccaatcactgcag

SEQ ID NO: 915493 - DNA, 25 bp, Mus musculus
ctccagaaatagtggctcccgagag

SEQ ID NO: 915494 - DNA, 25 bp, Mus musculus
ctccagaaatcaaatctgctccaaa

SEQ ID NO: 915495 - DNA, 25 bp, Mus musculus
ctccagaaatgaaatctgctccaaa

SEQ ID NO: 915496 - DNA, 25 bp, Mus musculus
ctccagaaattgtggctcccgagag

SEQ ID NO: 915497 - DNA, 25 bp, Mus musculus
ctccagaacagcaatggatttgcca

SEQ ID NO: 915498 - DNA, 25 bp, Mus musculus
ctccagaacagcagttcctaaggct

SEQ ID NO: 915499 - DNA, 25 bp, Mus musculus
ctccagaacagctatggatttgcca

SEQ ID NO: 915500 - DNA, 25 bp, Mus musculus
ctccagaacagctgttcctaaggct

SEQ ID NO: 915501 - DNA, 25 bp, Mus musculus
ctccagacctggctgcccagacccc

SEQ ID NO: 915502 - DNA, 25 bp, Mus musculus
ctccagacctgggtgcccagacccc

SEQ ID NO: 915503 - DNA, 25 bp, Mus musculus
ctccagagaaagctgcttaaacttc

SEQ ID NO: 915504 - DNA, 25 bp, Mus musculus
ctccagagaaaggtgcttaaacttc

SEQ ID NO: 915505 - DNA, 25 bp, Mus musculus
ctccagagtctctccctgtagctgt

SEQ ID NO: 915506 - DNA, 25 bp, Mus musculus
ctccagagtctctcgctgtagctgt

SEQ ID NO: 915507 - DNA, 25 bp, Mus musculus
ctccagatatatcctctcgaacagt

SEQ ID NO: 915508 - DNA, 25 bp, Mus musculus
ctccagatatatgctctcgaacagt

SEQ ID NO: 915509 - DNA, 25 bp, Mus musculus
ctccagatgacaacagacgcatgct

SEQ ID NO: 915510 - DNA, 25 bp, Mus musculus
ctccagatgacatcagacgcatgct

SEQ ID NO: 915511 - DNA, 25 bp, Mus musculus
ctccagatggaaatctgtatcctaa

SEQ ID NO: 915512 - DNA, 25 bp, Mus musculus
ctccagatggaattctgtatcctaa

SEQ ID NO: 915513 - DNA, 25 bp, Mus musculus
ctccagatgttgccaagaagacatc

SEQ ID NO: 915514 - DNA, 25 bp, Mus musculus
ctccagatgttggcaagaagacatc

SEQ ID NO: 915515 - DNA, 25 bp, Mus musculus
ctccagattcagccgacaactggcc

SEQ ID NO: 915516 - DNA, 25 bp, Mus musculus
ctccagattcaggcgacaactggcc

SEQ ID NO: 915517 - DNA, 25 bp, Mus musculus
ctccagcacacccaccagcccgagc

SEQ ID NO: 915518 - DNA, 25 bp, Mus musculus
ctccagcacacccagcagcccgagc

SEQ ID NO: 915519 - DNA, 25 bp, Mus musculus
ctccagcacctctacgccctggtct

SEQ ID NO: 915520 - DNA, 25 bp, Mus musculus
ctccagcacctctaggccctggtct

SEQ ID NO: 915521 - DNA, 25 bp, Mus musculus
ctccagccacagcccaagcccagca

SEQ ID NO: 915522 - DNA, 25 bp, Mus musculus
ctccagccacaggccaagcccagca

SEQ ID NO: 915523 - DNA, 25 bp, Mus musculus
ctccagccaccaccccctgcccgga

SEQ ID NO: 915524 - DNA, 25 bp, Mus musculus
ctccagccaccacgtgactctactg

SEQ ID NO: 915525 - DNA, 25 bp, Mus musculus
ctccagccaccagcccctgcccgga

SEQ ID NO: 915526 - DNA, 25 bp, Mus musculus
ctccagccaccaggtgactctactg

SEQ ID NO: 915527 - DNA, 25 bp, Mus musculus
ctccagccagcatgtgatggtggtg

SEQ ID NO: 915528 - DNA, 25 bp, Mus musculus
ctccagccaggatgtgatggtggtg

SEQ ID NO: 915529 - DNA, 25 bp, Mus musculus
ctccagcctgattaaagtgaacatt

SEQ ID NO: 915530 - DNA, 25 bp, Mus musculus
ctccagcctgtttaaagtgaacatt

SEQ ID NO: 915531 - DNA, 25 bp, Mus musculus
ctccagctatgacaagcaacaggcc

SEQ ID NO: 915532 - DNA, 25 bp, Mus musculus
ctccagctatgaccctggagtactc

SEQ ID NO: 915533 - DNA, 25 bp, Mus musculus
ctccagctatgagaagcaacaggcc

SEQ ID NO: 915534 - DNA, 25 bp, Mus musculus
ctccagctatgagcctggagtactc

SEQ ID NO: 915535 - DNA, 25 bp, Mus musculus
ctccagctcgagctgacatggagga

SEQ ID NO: 915536 - DNA, 25 bp, Mus musculus
ctccagctcgaggtgacatggagga

SEQ ID NO: 915537 - DNA, 25 bp, Mus musculus
ctccagctcttgccagaagacttta

SEQ ID NO: 915538 - DNA, 25 bp, Mus musculus
ctccagctcttggcagaagacttta

SEQ ID NO: 915539 - DNA, 25 bp, Mus musculus
ctccagctgactcaccaaatggaac

SEQ ID NO: 915540 - DNA, 25 bp, Mus musculus
ctccagctgactcagcaaatggaac

SEQ ID NO: 915541 - DNA, 25 bp, Mus musculus
ctccagctggctagccccagtggag

SEQ ID NO: 915542 - DNA, 25 bp, Mus musculus
ctccagctgggtagccccagtggag

SEQ ID NO: 915543 - DNA, 25 bp, Mus musculus
ctccagctggtacacgctgtgaaat

SEQ ID NO: 915544 - DNA, 25 bp, Mus musculus
ctccagctggtacaggctgtgaaat

SEQ ID NO: 915545 - DNA, 25 bp, Mus musculus
ctccaggaacctcgtcacacacctg

SEQ ID NO: 915546 - DNA, 25 bp, Mus musculus
ctccaggaacctggtcacacacctg

SEQ ID NO: 915547 - DNA, 25 bp, Mus musculus
ctccaggaagctggctgacggtctg

SEQ ID NO: 915548 - DNA, 25 bp, Mus musculus
ctccaggaaggtggctgacggtctg

SEQ ID NO: 915549 - DNA, 25 bp, Mus musculus
ctccaggacgagtctcccactccct

SEQ ID NO: 915550 - DNA, 25 bp, Mus musculus
ctccaggacgattctaagctgacta

SEQ ID NO: 915551 - DNA, 25 bp, Mus musculus
ctccaggacgccacaaaaggaccat

SEQ ID NO: 915552 - DNA, 25 bp, Mus musculus
ctccaggacggcacaaaaggaccat

SEQ ID NO: 915553 - DNA, 25 bp, Mus musculus
ctccaggacgtgtctcccactccct

SEQ ID NO: 915554 - DNA, 25 bp, Mus musculus
ctccaggacgtttctaagctgacta

SEQ ID NO: 915555 - DNA, 25 bp, Mus musculus
ctccaggcatgcgacgtctgctttg

SEQ ID NO: 915556 - DNA, 25 bp, Mus musculus
ctccaggcatgcgaggtctgctttg

SEQ ID NO: 915557 - DNA, 25 bp, Mus musculus
ctccaggccagacccgacagagttc

SEQ ID NO: 915558 - DNA, 25 bp, Mus musculus
ctccaggccagagccgacagagttc

SEQ ID NO: 915559 - DNA, 25 bp, Mus musculus
ctccaggccccacctttggtggccc

SEQ ID NO: 915560 - DNA, 25 bp, Mus musculus
ctccaggccccagctttggtggccc

SEQ ID NO: 915561 - DNA, 25 bp, Mus musculus
ctccagggagaacgaacttacaaag

SEQ ID NO: 915562 - DNA, 25 bp, Mus musculus
ctccagggagaaggaacttacaaag

SEQ ID NO: 915563 - DNA, 25 bp, Mus musculus
ctccagggagaccaaggaggcgttc

SEQ ID NO: 915564 - DNA, 25 bp, Mus musculus
ctccagggagacgaaggaggcgttc

SEQ ID NO: 915565 - DNA, 25 bp, Mus musculus
ctccagggagcctatgacaccatca

SEQ ID NO: 915566 - DNA, 25 bp, Mus musculus
ctccagggaggctatgacaccatca

SEQ ID NO: 915567 - DNA, 25 bp, Mus musculus
ctccagggcaagccccaggactgga

SEQ ID NO: 915568 - DNA, 25 bp, Mus musculus
ctccagggcaaggcccaggactgga

SEQ ID NO: 915569 - DNA, 25 bp, Mus musculus
ctccagggtcagctgaaccaccaaa

SEQ ID NO: 915570 - DNA, 25 bp, Mus musculus
ctccagggtcagcttccaagcaacc

SEQ ID NO: 915571 - DNA, 25 bp, Mus musculus
ctccagggtcaggtgaaccaccaaa

SEQ ID NO: 915572 - DNA, 25 bp, Mus musculus
ctccagggtcaggttccaagcaacc

SEQ ID NO: 915573 - DNA, 25 bp, Mus musculus
ctccaggtacaacacgaactggaga

SEQ ID NO: 915574 - DNA, 25 bp, Mus musculus
ctccaggtacaagacgaactggaga

SEQ ID NO: 915575 - DNA, 25 bp, Mus musculus
ctccaggttccctgaaagcacatcg

SEQ ID NO: 915576 - DNA, 25 bp, Mus musculus
ctccaggttccctgacacatcgaga

SEQ ID NO: 915577 - DNA, 25 bp, Mus musculus
ctccaggttccctgtaagcacatcg

SEQ ID NO: 915578 - DNA, 25 bp, Mus musculus
ctccaggttccctgtcacatcgaga

SEQ ID NO: 915579 - DNA, 25 bp, Mus musculus
ctccagtcagatcacgtttggactc

SEQ ID NO: 915580 - DNA, 25 bp, Mus musculus
ctccagtcagatcaggtttggactc

SEQ ID NO: 915581 - DNA, 25 bp, Mus musculus
ctccagtcctccgccaaaatgacca

SEQ ID NO: 915582 - DNA, 25 bp, Mus musculus
ctccagtcctccgcgaaaatgacca

SEQ ID NO: 915583 - DNA, 25 bp, Mus musculus
ctccagtctgcacgtcctaggtgct

SEQ ID NO: 915584 - DNA, 25 bp, Mus musculus
ctccagtctgcaggtcctaggtgct

SEQ ID NO: 915585 - DNA, 25 bp, Mus musculus
ctccagtgcgactttactggaaaga

SEQ ID NO: 915586 - DNA, 25 bp, Mus musculus
ctccagtgcgtctttactggaaaga

SEQ ID NO: 915587 - DNA, 25 bp, Mus musculus
ctccagtggagccactgcctccttc

SEQ ID NO: 915588 - DNA, 25 bp, Mus musculus
ctccagtggagccagtgcctccttc

SEQ ID NO: 915589 - DNA, 25 bp, Mus musculus
ctccagtggataaacgtctccagag

SEQ ID NO: 915590 - DNA, 25 bp, Mus musculus
ctccagtggataaaggtctccagag

SEQ ID NO: 915591 - DNA, 25 bp, Mus musculus
ctccagtggatccgaaaaggcctac

SEQ ID NO: 915592 - DNA, 25 bp, Mus musculus
ctccagtggatcggaaaaggcctac

SEQ ID NO: 915593 - DNA, 25 bp, Mus musculus
ctccataaacagactgtccagtgtc

SEQ ID NO: 915594 - DNA, 25 bp, Mus musculus
ctccataaacagtctgtccagtgtc

SEQ ID NO: 915595 - DNA, 25 bp, Mus musculus
ctccatcaccaccgaggttcccact

SEQ ID NO: 915596 - DNA, 25 bp, Mus musculus
ctccatcaccaccgtggttcccact

SEQ ID NO: 915597 - DNA, 25 bp, Mus musculus
ctccatcatccgacagcagctccag

SEQ ID NO: 915598 - DNA, 25 bp, Mus musculus
ctccatcatccgacagctccaggct

SEQ ID NO: 915599 - DNA, 25 bp, Mus musculus
ctccatcatccgtcagcagctccag

SEQ ID NO: 915600 - DNA, 25 bp, Mus musculus
ctccatcatccgtcagctccaggct

SEQ ID NO: 915601 - DNA, 25 bp, Mus musculus
ctccatcctgaactccctgctatgt

SEQ ID NO: 915602 - DNA, 25 bp, Mus musculus
ctccatcctgaagtccctgctatgt

SEQ ID NO: 915603 - DNA, 25 bp, Mus musculus
ctccatcctgtctaaggagaaaata

SEQ ID NO: 915604 - DNA, 25 bp, Mus musculus
ctccatcctgtctatggagaaaata

SEQ ID NO: 915605 - DNA, 25 bp, Mus musculus
ctccatcggcggcgaagtttggtga

SEQ ID NO: 915606 - DNA, 25 bp, Mus musculus
ctccatcggcggggaagtttggtga

SEQ ID NO: 915607 - DNA, 25 bp, Mus musculus
ctccatcggcttcacatatttatca

SEQ ID NO: 915608 - DNA, 25 bp, Mus musculus
ctccatcggcttcagatatttatca

SEQ ID NO: 915609 - DNA, 25 bp, Mus musculus
ctccatctatagatcttaccaatat

SEQ ID NO: 915610 - DNA, 25 bp, Mus musculus
ctccatctatagcattcatgaataa

SEQ ID NO: 915611 - DNA, 25 bp, Mus musculus
ctccatctataggattcatgaataa

SEQ ID NO: 915612 - DNA, 25 bp, Mus musculus
ctccatctatagttcttaccaatat

SEQ ID NO: 915613 - DNA, 25 bp, Mus musculus
ctccatcttgccatgtgctccactg

SEQ ID NO: 915614 - DNA, 25 bp, Mus musculus
ctccatcttggcatgtgctccactg

SEQ ID NO: 915615 - DNA, 25 bp, Mus musculus
ctccatgaagctccacctgctcttt

SEQ ID NO: 915616 - DNA, 25 bp, Mus musculus
ctccatgaaggtccacctgctcttt

SEQ ID NO: 915617 - DNA, 25 bp, Mus musculus
ctccatgagaccctcgacatgaaca

SEQ ID NO: 915618 - DNA, 25 bp, Mus musculus
ctccatgagaccctctacatgggct

SEQ ID NO: 915619 - DNA, 25 bp, Mus musculus
ctccatgagaccctggacatgaaca

SEQ ID NO: 915620 - DNA, 25 bp, Mus musculus
ctccatgagaccctgtacatgggct

SEQ ID NO: 915621 - DNA, 25 bp, Mus musculus
ctccatgagtacaacaatctgagtc

SEQ ID NO: 915622 - DNA, 25 bp, Mus musculus
ctccatgagtacaagaatctgagtc

SEQ ID NO: 915623 - DNA, 25 bp, Mus musculus
ctccatgcaagtcccaaatttacgg

SEQ ID NO: 915624 - DNA, 25 bp, Mus musculus
ctccatgcaagtgccaaatttacgg

SEQ ID NO: 915625 - DNA, 25 bp, Mus musculus
ctccatgcagaacacggctgttttg

SEQ ID NO: 915626 - DNA, 25 bp, Mus musculus
ctccatgcagaacagggctgttttg

SEQ ID NO: 915627 - DNA, 25 bp, Mus musculus
ctccatgcagacccgctatgacttc

SEQ ID NO: 915628 - DNA, 25 bp, Mus musculus
ctccatgcagctagtgcatatggct

SEQ ID NO: 915629 - DNA, 25 bp, Mus musculus
ctccatgcaggtagtgcatatggct

SEQ ID NO: 915630 - DNA, 25 bp, Mus musculus
ctccatgcagtcccgctatgacttc

SEQ ID NO: 915631 - DNA, 25 bp, Mus musculus
ctccatggacagactacagatgctg

SEQ ID NO: 915632 - DNA, 25 bp, Mus musculus
ctccatggacagtctacagatgctg

SEQ ID NO: 915633 - DNA, 25 bp, Mus musculus
ctccatggagaacacgtgcttttac

SEQ ID NO: 915634 - DNA, 25 bp, Mus musculus
ctccatggagaacaggtgcttttac

SEQ ID NO: 915635 - DNA, 25 bp, Mus musculus
ctccatggatcatttggcaagtctg

SEQ ID NO: 915636 - DNA, 25 bp, Mus musculus
ctccatggatgatttggcaagtctg

SEQ ID NO: 915637 - DNA, 25 bp, Mus musculus
ctccatgtcccacacattcagtact

SEQ ID NO: 915638 - DNA, 25 bp, Mus musculus
ctccatgtcccagacattcagtact

SEQ ID NO: 915639 - DNA, 25 bp, Mus musculus
ctccatgtggatataccgctgtggg

SEQ ID NO: 915640 - DNA, 25 bp, Mus musculus
ctccatgtggcatttggcacatcct

SEQ ID NO: 915641 - DNA, 25 bp, Mus musculus
ctccatgtgggatttggcacatcct

SEQ ID NO: 915642 - DNA, 25 bp, Mus musculus
ctccatgtggttataccgctgtggg

SEQ ID NO: 915643 - DNA, 25 bp, Mus musculus
ctccattgctaaagctgggatcact

SEQ ID NO: 915644 - DNA, 25 bp, Mus musculus
ctccattgctaatgctgggatcact

SEQ ID NO: 915645 - DNA, 25 bp, Mus musculus
ctccatttatctgtaacagcgtgga

SEQ ID NO: 915646 - DNA, 25 bp, Mus musculus
ctccatttatctgttacagcgtgga

SEQ ID NO: 915647 - DNA, 25 bp, Mus musculus
ctccatttcgctttccagattcagg

SEQ ID NO: 915648 - DNA, 25 bp, Mus musculus
ctccatttcggtttccagattcagg

SEQ ID NO: 915649 - DNA, 25 bp, Mus musculus
ctcccaacgagtcgcatggcatgtc

SEQ ID NO: 915650 - DNA, 25 bp, Mus musculus
ctcccaacgagtcgccagatggcat

SEQ ID NO: 915651 - DNA, 25 bp, Mus musculus
ctcccaacgagtcggatggcatgtc

SEQ ID NO: 915652 - DNA, 25 bp, Mus musculus
ctcccaacgagtcggcagatggcat

SEQ ID NO: 915653 - DNA, 25 bp, Mus musculus
ctcccaactacacaaaagcagtcag

SEQ ID NO: 915654 - DNA, 25 bp, Mus musculus
ctcccaactacagaaaagcagtcag

SEQ ID NO: 915655 - DNA, 25 bp, Mus musculus
ctcccaagaaagcgagtgagaagac

SEQ ID NO: 915656 - DNA, 25 bp, Mus musculus
ctcccaagaaagggagtgagaagac

SEQ ID NO: 915657 - DNA, 25 bp, Mus musculus
ctcccaagattgataattaggaaag

SEQ ID NO: 915658 - DNA, 25 bp, Mus musculus
ctcccaagattgttaattaggaaag

SEQ ID NO: 915659 - DNA, 25 bp, Mus musculus
ctcccaagctggaatccccaaaaga

SEQ ID NO: 915660 - DNA, 25 bp, Mus musculus
ctcccaagctggtatccccaaaaga

SEQ ID NO: 915661 - DNA, 25 bp, Mus musculus
ctcccaatgacgctcaagatgctga

SEQ ID NO: 915662 - DNA, 25 bp, Mus musculus
ctcccaatgacggtcaagatgctga

SEQ ID NO: 915663 - DNA, 25 bp, Mus musculus
ctcccaatgcctctgcggccgcggg

SEQ ID NO: 915664 - DNA, 25 bp, Mus musculus
ctcccaatgcctgtgcggccgcggg

SEQ ID NO: 915665 - DNA, 25 bp, Mus musculus
ctcccacagacgagaggcgcatctc

SEQ ID NO: 915666 - DNA, 25 bp, Mus musculus
ctcccacagaggagaggcgcatctc

SEQ ID NO: 915667 - DNA, 25 bp, Mus musculus
ctcccacagtgacacagtactatgc

SEQ ID NO: 915668 - DNA, 25 bp, Mus musculus
ctcccacagtgagacagtactatgc

SEQ ID NO: 915669 - DNA, 25 bp, Mus musculus
ctcccaccatcaaacaaaaggaggg

SEQ ID NO: 915670 - DNA, 25 bp, Mus musculus
ctcccaccatcccaaatttattcct

SEQ ID NO: 915671 - DNA, 25 bp, Mus musculus
ctcccaccatgaaacaaaaggaggg

SEQ ID NO: 915672 - DNA, 25 bp, Mus musculus
ctcccaccatgccaaatttattcct

SEQ ID NO: 915673 - DNA, 25 bp, Mus musculus
ctcccacctccgctgatccaggcgt

SEQ ID NO: 915674 - DNA, 25 bp, Mus musculus
ctcccacctccggtgatccaggcgt

SEQ ID NO: 915675 - DNA, 25 bp, Mus musculus
ctcccacgtcagacctaggaaaggc

SEQ ID NO: 915676 - DNA, 25 bp, Mus musculus
ctcccacgtcagtcctaggaaaggc

SEQ ID NO: 915677 - DNA, 25 bp, Mus musculus
ctcccagaagatagtcacatgctgg

SEQ ID NO: 915678 - DNA, 25 bp, Mus musculus
ctcccagaagttagtcacatgctgg

SEQ ID NO: 915679 - DNA, 25 bp, Mus musculus
ctcccagagctcaacgagcgaatct

SEQ ID NO: 915680 - DNA, 25 bp, Mus musculus
ctcccagagctcaacgctaaccctt

SEQ ID NO: 915681 - DNA, 25 bp, Mus musculus
ctcccagagctcaaggagcgaatct

SEQ ID NO: 915682 - DNA, 25 bp, Mus musculus
ctcccagagctcaaggctaaccctt

SEQ ID NO: 915683 - DNA, 25 bp, Mus musculus
ctcccagatcctacagaaccttggc

SEQ ID NO: 915684 - DNA, 25 bp, Mus musculus
ctcccagatcgtacagaaccttggc

SEQ ID NO: 915685 - DNA, 25 bp, Mus musculus
ctcccagatgctgtcataagccgaa

SEQ ID NO: 915686 - DNA, 25 bp, Mus musculus
ctcccagatggtgtcataagccgaa

SEQ ID NO: 915687 - DNA, 25 bp, Mus musculus
ctcccagcagaacgagtgtcctctc

SEQ ID NO: 915688 - DNA, 25 bp, Mus musculus
ctcccagcagaacgcagcaagcgcc

SEQ ID NO: 915689 - DNA, 25 bp, Mus musculus
ctcccagcagaaggagtgtcctctc

SEQ ID NO: 915690 - DNA, 25 bp, Mus musculus
ctcccagcagaaggcagcaagcgcc

SEQ ID NO: 915691 - DNA, 25 bp, Mus musculus
ctcccagctaacaaaagcgcggtgg

SEQ ID NO: 915692 - DNA, 25 bp, Mus musculus
ctcccagctaactaaagcgcggtgg

SEQ ID NO: 915693 - DNA, 25 bp, Mus musculus
ctcccagcttcgcaggacccaacct

SEQ ID NO: 915694 - DNA, 25 bp, Mus musculus
ctcccagcttcggaggacccaacct

SEQ ID NO: 915695 - DNA, 25 bp, Mus musculus
ctcccaggaacagagggagaaggcg

SEQ ID NO: 915696 - DNA, 25 bp, Mus musculus
ctcccaggaagagagggagaaggcg

SEQ ID NO: 915697 - DNA, 25 bp, Mus musculus
ctcccaggactgctcaatgtggcta

SEQ ID NO: 915698 - DNA, 25 bp, Mus musculus
ctcccaggactggtcaatgtggcta

SEQ ID NO: 915699 - DNA, 25 bp, Mus musculus
ctcccaggccctcaatgaagaagag

SEQ ID NO: 915700 - DNA, 25 bp, Mus musculus
ctcccaggccctgaatgaagaagag

SEQ ID NO: 915701 - DNA, 25 bp, Mus musculus
ctcccagtagatccaactgggacac

SEQ ID NO: 915702 - DNA, 25 bp, Mus musculus
ctcccagtagttccaactgggacac

SEQ ID NO: 915703 - DNA, 25 bp, Mus musculus
ctcccagtggcacacatgccctagg

SEQ ID NO: 915704 - DNA, 25 bp, Mus musculus
ctcccagtggcacacgtctccaccg

SEQ ID NO: 915705 - DNA, 25 bp, Mus musculus
ctcccagtggcacagatgccctagg

SEQ ID NO: 915706 - DNA, 25 bp, Mus musculus
ctcccagtggcacaggtctccaccg

SEQ ID NO: 915707 - DNA, 25 bp, Mus musculus
ctccccacaacctccctggggaagg

SEQ ID NO: 915708 - DNA, 25 bp, Mus musculus
ctccccacaagctccctggggaagg

SEQ ID NO: 915709 - DNA, 25 bp, Mus musculus
ctccccacagcgcgccatgactcct

SEQ ID NO: 915710 - DNA, 25 bp, Mus musculus
ctccccacagggcgccatgactcct

SEQ ID NO: 915711 - DNA, 25 bp, Mus musculus
ctccccatacaacgacctcctggac

SEQ ID NO: 915712 - DNA, 25 bp, Mus musculus
ctccccatacaaggacctcctggac

SEQ ID NO: 915713 - DNA, 25 bp, Mus musculus
ctcccccactggatgatgcagaatt

SEQ ID NO: 915714 - DNA, 25 bp, Mus musculus
ctcccccactggttgatgcagaatt

SEQ ID NO: 915715 - DNA, 25 bp, Mus musculus
ctcccccatgcagaagatttagcgc

SEQ ID NO: 915716 - DNA, 25 bp, Mus musculus
ctcccccatggagaagatttagcgc

SEQ ID NO: 915717 - DNA, 25 bp, Mus musculus
ctccccggcggacatgaggaaactg

SEQ ID NO: 915718 - DNA, 25 bp, Mus musculus
ctccccggcggagatgaggaaactg

SEQ ID NO: 915719 - DNA, 25 bp, Mus musculus
ctcccctgcaaacattcctgcgacg

SEQ ID NO: 915720 - DNA, 25 bp, Mus musculus
ctcccctgcaaagattcctgcgacg

SEQ ID NO: 915721 - DNA, 25 bp, Mus musculus
ctcccgagcacaaggagaagacgag

SEQ ID NO: 915722 - DNA, 25 bp, Mus musculus
ctcccgagcagaaggagaagacgag

SEQ ID NO: 915723 - DNA, 25 bp, Mus musculus
ctcccgcagcgtgacccagtgggtg

SEQ ID NO: 915724 - DNA, 25 bp, Mus musculus
ctcccgcagcgtgacgtcctggtat

SEQ ID NO: 915725 - DNA, 25 bp, Mus musculus
ctcccgcagcgtgagccagtgggtg

SEQ ID NO: 915726 - DNA, 25 bp, Mus musculus
ctcccgcagcgtgaggtcctggtat

SEQ ID NO: 915727 - DNA, 25 bp, Mus musculus
ctcccgccaaaccccatgagaattt

SEQ ID NO: 915728 - DNA, 25 bp, Mus musculus
ctcccgccaaacgccatgagaattt

SEQ ID NO: 915729 - DNA, 25 bp, Mus musculus
ctcccgccagagctcaggccctgga

SEQ ID NO: 915730 - DNA, 25 bp, Mus musculus
ctcccgccagcagaatggtgccagc

SEQ ID NO: 915731 - DNA, 25 bp, Mus musculus
ctcccgccagctcaaggtgatgctg

SEQ ID NO: 915732 - DNA, 25 bp, Mus musculus
ctcccgccaggagaatggtgccagc

SEQ ID NO: 915733 - DNA, 25 bp, Mus musculus
ctcccgccaggtcaaggtgatgctg

SEQ ID NO: 915734 - DNA, 25 bp, Mus musculus
ctcccgccagtgctcaggccctgga

SEQ ID NO: 915735 - DNA, 25 bp, Mus musculus
ctcccgcctcggcttgctgttctgg

SEQ ID NO: 915736 - DNA, 25 bp, Mus musculus
ctcccgcctcgggttgctgttctgg

SEQ ID NO: 915737 - DNA, 25 bp, Mus musculus
ctcccgctgcagctggaaagcaagc

SEQ ID NO: 915738 - DNA, 25 bp, Mus musculus
ctcccgctgcaggtggaaagcaagc

SEQ ID NO: 915739 - DNA, 25 bp, Mus musculus
ctcccggcagaggaccctggaggag

SEQ ID NO: 915740 - DNA, 25 bp, Mus musculus
ctcccggcagaggagcctggaggag

SEQ ID NO: 915741 - DNA, 25 bp, Mus musculus
ctcccggcagctctacgttttgggc

SEQ ID NO: 915742 - DNA, 25 bp, Mus musculus
ctcccggcagctgtacgttttgggc

SEQ ID NO: 915743 - DNA, 25 bp, Mus musculus
ctcccgggagcgcggcagccacaga

SEQ ID NO: 915744 - DNA, 25 bp, Mus musculus
ctcccgggagcgctcgagctagagg

SEQ ID NO: 915745 - DNA, 25 bp, Mus musculus
ctcccgggagcggggcagccacaga

SEQ ID NO: 915746 - DNA, 25 bp, Mus musculus
ctcccgggagcggtcgagctagagg

SEQ ID NO: 915747 - DNA, 25 bp, Mus musculus
ctcccgtgcacccacaaaacgaaga

SEQ ID NO: 915748 - DNA, 25 bp, Mus musculus
ctcccgtgcacccagaaaacgaaga

SEQ ID NO: 915749 - DNA, 25 bp, Mus musculus
ctccctaacatgacaaaatatcttc

SEQ ID NO: 915750 - DNA, 25 bp, Mus musculus
ctccctaacatgtcaaaatatcttc

SEQ ID NO: 915751 - DNA, 25 bp, Mus musculus
ctccctacccagccacttgaacctg

SEQ ID NO: 915752 - DNA, 25 bp, Mus musculus
ctccctacccaggcacttgaacctg

SEQ ID NO: 915753 - DNA, 25 bp, Mus musculus
ctccctactcagccctcctggtatg

SEQ ID NO: 915754 - DNA, 25 bp, Mus musculus
ctccctactcaggcctcctggtatg

SEQ ID NO: 915755 - DNA, 25 bp, Mus musculus
ctccctcaagaacaaagtcacaatc

SEQ ID NO: 915756 - DNA, 25 bp, Mus musculus
ctccctcaagattcaaacagacaag

SEQ ID NO: 915757 - DNA, 25 bp, Mus musculus
ctccctcaagtacaaagtcacaatc

SEQ ID NO: 915758 - DNA, 25 bp, Mus musculus
ctccctcaagtttcaaacagacaag

SEQ ID NO: 915759 - DNA, 25 bp, Mus musculus
ctccctcaccaaccttagcaaggag

SEQ ID NO: 915760 - DNA, 25 bp, Mus musculus
ctccctcaccaagcttagcaaggag

SEQ ID NO: 915761 - DNA, 25 bp, Mus musculus
ctccctcagctgctcctggacttct

SEQ ID NO: 915762 - DNA, 25 bp, Mus musculus
ctccctcagctggtcctggacttct

SEQ ID NO: 915763 - DNA, 25 bp, Mus musculus
ctccctccccagatgtagctggtag

SEQ ID NO: 915764 - DNA, 25 bp, Mus musculus
ctccctccccagttgtagctggtag

SEQ ID NO: 915765 - DNA, 25 bp, Mus musculus
ctccctcccgatgagaagaagcaaa

SEQ ID NO: 915766 - DNA, 25 bp, Mus musculus
ctccctcccgcgatatttgcttgaa

SEQ ID NO: 915767 - DNA, 25 bp, Mus musculus
ctccctcccgggatatttgcttgaa

SEQ ID NO: 915768 - DNA, 25 bp, Mus musculus
ctccctcccgttgagaagaagcaaa

SEQ ID NO: 915769 - DNA, 25 bp, Mus musculus
ctccctcgacagtgcgtcttccagc

SEQ ID NO: 915770 - DNA, 25 bp, Mus musculus
ctccctcgacagtgggtcttccagc

SEQ ID NO: 915771 - DNA, 25 bp, Mus musculus
ctccctctggctctctcaaaagaaa

SEQ ID NO: 915772 - DNA, 25 bp, Mus musculus
ctccctctgggtctctcaaaagaaa

SEQ ID NO: 915773 - DNA, 25 bp, Mus musculus
ctccctgaagcgctaccagtggttg

SEQ ID NO: 915774 - DNA, 25 bp, Mus musculus
ctccctgaagggctaccagtggttg

SEQ ID NO: 915775 - DNA, 25 bp, Mus musculus
ctccctgacaaacgtgactctcggg

SEQ ID NO: 915776 - DNA, 25 bp, Mus musculus
ctccctgacaaaggtgactctcggg

SEQ ID NO: 915777 - DNA, 25 bp, Mus musculus
ctccctgacacaggatggtttgttt

SEQ ID NO: 915778 - DNA, 25 bp, Mus musculus
ctccctgacacctatattgtcttca

SEQ ID NO: 915779 - DNA, 25 bp, Mus musculus
ctccctgacagaggatggtttgttt

SEQ ID NO: 915780 - DNA, 25 bp, Mus musculus
ctccctgacagctatattgtcttca

SEQ ID NO: 915781 - DNA, 25 bp, Mus musculus
ctccctgactcgatcgcaccgcatg

SEQ ID NO: 915782 - DNA, 25 bp, Mus musculus
ctccctgactcgatggcaccgcatg

SEQ ID NO: 915783 - DNA, 25 bp, Mus musculus
ctccctgcactgctcctccatcggc

SEQ ID NO: 915784 - DNA, 25 bp, Mus musculus
ctccctgcactggtcctccatcggc

SEQ ID NO: 915785 - DNA, 25 bp, Mus musculus
ctccctgccaaacgggctgactgaa

SEQ ID NO: 915786 - DNA, 25 bp, Mus musculus
ctccctgccaaaggggctgactgaa

SEQ ID NO: 915787 - DNA, 25 bp, Mus musculus
ctccctgctccacctcaccactcct

SEQ ID NO: 915788 - DNA, 25 bp, Mus musculus
ctccctgctccagctcaccactcct

SEQ ID NO: 915789 - DNA, 25 bp, Mus musculus
ctccctgctccgccaagacattgct

SEQ ID NO: 915790 - DNA, 25 bp, Mus musculus
ctccctgctccggcaagacattgct

SEQ ID NO: 915791 - DNA, 25 bp, Mus musculus
ctccctggagctttgcctcaaatac

SEQ ID NO: 915792 - DNA, 25 bp, Mus musculus
ctccctggaggtttgcctcaaatac

SEQ ID NO: 915793 - DNA, 25 bp, Mus musculus
ctccctgggacagacgcgagcaaca

SEQ ID NO: 915794 - DNA, 25 bp, Mus musculus
ctccctgggacagaggcgagcaaca

SEQ ID NO: 915795 - DNA, 25 bp, Mus musculus
ctccctgggctgaggtggtgagaag

SEQ ID NO: 915796 - DNA, 25 bp, Mus musculus
ctccctgggctgtggtggtgagaag

SEQ ID NO: 915797 - DNA, 25 bp, Mus musculus
ctccctgtgcctccctttaatgtga

SEQ ID NO: 915798 - DNA, 25 bp, Mus musculus
ctccctgtgcctgcctttaatgtga

SEQ ID NO: 915799 - DNA, 25 bp, Mus musculus
ctcccttaatggagtctccaagcct

SEQ ID NO: 915800 - DNA, 25 bp, Mus musculus
ctcccttaatggtgtctccaagcct

SEQ ID NO: 915801 - DNA, 25 bp, Mus musculus
ctcccttccggctgcccacccccat

SEQ ID NO: 915802 - DNA, 25 bp, Mus musculus
ctcccttccggctggccacccccat

SEQ ID NO: 915803 - DNA, 25 bp, Mus musculus
ctccgaaaactgctggaggtcactg

SEQ ID NO: 915804 - DNA, 25 bp, Mus musculus
ctccgaaaactggtggaggtcactg

SEQ ID NO: 915805 - DNA, 25 bp, Mus musculus
ctccgaacctcattcacagatggag

SEQ ID NO: 915806 - DNA, 25 bp, Mus musculus
ctccgaacctgattcacagatggag

SEQ ID NO: 915807 - DNA, 25 bp, Mus musculus
ctccgaagctttaacgtttgattct

SEQ ID NO: 915808 - DNA, 25 bp, Mus musculus
ctccgaagctttaaggtttgattct

SEQ ID NO: 915809 - DNA, 25 bp, Mus musculus
ctccgaagtcagaccgaaagagtgg

SEQ ID NO: 915810 - DNA, 25 bp, Mus musculus
ctccgaagtcagacggaaagagtgg

SEQ ID NO: 915811 - DNA, 25 bp, Mus musculus
ctccgacccaccaccggagccaggt

SEQ ID NO: 915812 - DNA, 25 bp, Mus musculus
ctccgacccaccacgggagccaggt

SEQ ID NO: 915813 - DNA, 25 bp, Mus musculus
ctccgacgagatctatgagatcatg

SEQ ID NO: 915814 - DNA, 25 bp, Mus musculus
ctccgacgagatgtatgagatcatg

SEQ ID NO: 915815 - DNA, 25 bp, Mus musculus
ctccgactggaagaatgcctgtgcc

SEQ ID NO: 915816 - DNA, 25 bp, Mus musculus
ctccgactggtagaatgcctgtgcc

SEQ ID NO: 915817 - DNA, 25 bp, Mus musculus
ctccgagaaccacagggcacatctg

SEQ ID NO: 915818 - DNA, 25 bp, Mus musculus
ctccgagaaccacttgataaaatta

SEQ ID NO: 915819 - DNA, 25 bp, Mus musculus
ctccgagaaccagagggcacatctg

SEQ ID NO: 915820 - DNA, 25 bp, Mus musculus
ctccgagaaccagttgataaaatta

SEQ ID NO: 915821 - DNA, 25 bp, Mus musculus
ctccgagcacattccatggccctgt

SEQ ID NO: 915822 - DNA, 25 bp, Mus musculus
ctccgagcactttccatggccctgt

SEQ ID NO: 915823 - DNA, 25 bp, Mus musculus
ctccgagcagcggactcgtggggga

SEQ ID NO: 915824 - DNA, 25 bp, Mus musculus
ctccgagcaggggactcgtggggga

SEQ ID NO: 915825 - DNA, 25 bp, Mus musculus
ctccgagcagtgccccgagacattc

SEQ ID NO: 915826 - DNA, 25 bp, Mus musculus
ctccgagcagtggcccgagacattc

SEQ ID NO: 915827 - DNA, 25 bp, Mus musculus
ctccgagggctgaactatatacatt

SEQ ID NO: 915828 - DNA, 25 bp, Mus musculus
ctccgagggctgaagtatatacatt

SEQ ID NO: 915829 - DNA, 25 bp, Mus musculus
ctccgagtgcttcctgccccagcca

SEQ ID NO: 915830 - DNA, 25 bp, Mus musculus
ctccgagtgcttgctgccccagcca

SEQ ID NO: 915831 - DNA, 25 bp, Mus musculus
ctccgataggcagaccagctccatc

SEQ ID NO: 915832 - DNA, 25 bp, Mus musculus
ctccgataggcagacgtcagtacca

SEQ ID NO: 915833 - DNA, 25 bp, Mus musculus
ctccgataggcagagcagctccatc

SEQ ID NO: 915834 - DNA, 25 bp, Mus musculus
ctccgataggcagaggtcagtacca

SEQ ID NO: 915835 - DNA, 25 bp, Mus musculus
ctccgcaccagacgaacttctgcag

SEQ ID NO: 915836 - DNA, 25 bp, Mus musculus
ctccgcaccagaggaacttctgcag

SEQ ID NO: 915837 - DNA, 25 bp, Mus musculus
ctccgcagccatacagccccagagg

SEQ ID NO: 915838 - DNA, 25 bp, Mus musculus
ctccgcagccatactgccccagagg

SEQ ID NO: 915839 - DNA, 25 bp, Mus musculus
ctccgcagccgacgctcgcgctgta

SEQ ID NO: 915840 - DNA, 25 bp, Mus musculus
ctccgcagccgaggctcgcgctgta

SEQ ID NO: 915841 - DNA, 25 bp, Mus musculus
ctccgcagtgcccacacctgtgtta

SEQ ID NO: 915842 - DNA, 25 bp, Mus musculus
ctccgcagtgcccaccagcatcact

SEQ ID NO: 915843 - DNA, 25 bp, Mus musculus
ctccgcagtgcccaccatcactatt

SEQ ID NO: 915844 - DNA, 25 bp, Mus musculus
ctccgcagtgcccagacctgtgtta

SEQ ID NO: 915845 - DNA, 25 bp, Mus musculus
ctccgcagtgcccagcagcatcact

SEQ ID NO: 915846 - DNA, 25 bp, Mus musculus
ctccgcagtgcccagcatcactatt

SEQ ID NO: 915847 - DNA, 25 bp, Mus musculus
ctccgccaagctggataatgccagg

SEQ ID NO: 915848 - DNA, 25 bp, Mus musculus
ctccgccaaggtggataatgccagg

SEQ ID NO: 915849 - DNA, 25 bp, Mus musculus
ctccgcccacagagatgagccgcca

SEQ ID NO: 915850 - DNA, 25 bp, Mus musculus
ctccgcccacagtgatgagccgcca

SEQ ID NO: 915851 - DNA, 25 bp, Mus musculus
ctccgccggctactatctctcagac

SEQ ID NO: 915852 - DNA, 25 bp, Mus musculus
ctccgccggctagtatctctcagac

SEQ ID NO: 915853 - DNA, 25 bp, Mus musculus
ctccgccggggcaacgtctgttcac

SEQ ID NO: 915854 - DNA, 25 bp, Mus musculus
ctccgccggggcaaggtctgttcac

SEQ ID NO: 915855 - DNA, 25 bp, Mus musculus
ctccgcctgccgcacgtggccatgg

SEQ ID NO: 915856 - DNA, 25 bp, Mus musculus
ctccgcctgccgcaggtggccatgg

SEQ ID NO: 915857 - DNA, 25 bp, Mus musculus
ctccgccttgcacacagaagtgatt

SEQ ID NO: 915858 - DNA, 25 bp, Mus musculus
ctccgccttgcacagagaagtgatt

SEQ ID NO: 915859 - DNA, 25 bp, Mus musculus
ctccgcggcgcagacccctgtgcgg

SEQ ID NO: 915860 - DNA, 25 bp, Mus musculus
ctccgcggcggagacccctgtgcgg

SEQ ID NO: 915861 - DNA, 25 bp, Mus musculus
ctccgctcaaagcttgatgaagctg

SEQ ID NO: 915862 - DNA, 25 bp, Mus musculus
ctccgctcaaaggttgatgaagctg

SEQ ID NO: 915863 - DNA, 25 bp, Mus musculus
ctccgctcagcaacgagttcaagta

SEQ ID NO: 915864 - DNA, 25 bp, Mus musculus
ctccgctcagctaaacagaatctgg

SEQ ID NO: 915865 - DNA, 25 bp, Mus musculus
ctccgctcaggaacgagttcaagta

SEQ ID NO: 915866 - DNA, 25 bp, Mus musculus
ctccgctcaggtaaacagaatctgg

SEQ ID NO: 915867 - DNA, 25 bp, Mus musculus
ctccgctgagaataagtacttttct

SEQ ID NO: 915868 - DNA, 25 bp, Mus musculus
ctccgctgagaatatgtacttttct

SEQ ID NO: 915869 - DNA, 25 bp, Mus musculus
ctccggaagatgaacagctgcctag

SEQ ID NO: 915870 - DNA, 25 bp, Mus musculus
ctccggaagatgaagagctgcctag

SEQ ID NO: 915871 - DNA, 25 bp, Mus musculus
ctccggacacagaatatccagttat

SEQ ID NO: 915872 - DNA, 25 bp, Mus musculus
ctccggacacagtatatccagttat

SEQ ID NO: 915873 - DNA, 25 bp, Mus musculus
ctccggcaacagctggaagatctca

SEQ ID NO: 915874 - DNA, 25 bp, Mus musculus
ctccggcaacaggtggaagatctca

SEQ ID NO: 915875 - DNA, 25 bp, Mus musculus
ctccggcaggcaagcccagccctgg

SEQ ID NO: 915876 - DNA, 25 bp, Mus musculus
ctccggcagggaagcccagccctgg

SEQ ID NO: 915877 - DNA, 25 bp, Mus musculus
ctccggccattgtacctttcagtgt

SEQ ID NO: 915878 - DNA, 25 bp, Mus musculus
ctccggccattgtagctttcagtgt

SEQ ID NO: 915879 - DNA, 25 bp, Mus musculus
ctccggcctctttgcaggctcatcc

SEQ ID NO: 915880 - DNA, 25 bp, Mus musculus
ctccggcctctttgcctgctgggaa

SEQ ID NO: 915881 - DNA, 25 bp, Mus musculus
ctccggcctctttggaggctcatcc

SEQ ID NO: 915882 - DNA, 25 bp, Mus musculus
ctccggcctctttggctgctgggaa

SEQ ID NO: 915883 - DNA, 25 bp, Mus musculus
ctccggcctgcaggatccgattctg

SEQ ID NO: 915884 - DNA, 25 bp, Mus musculus
ctccggcctggaggatccgattctg

SEQ ID NO: 915885 - DNA, 25 bp, Mus musculus
ctccggctcagaaatgtcactgtcc

SEQ ID NO: 915886 - DNA, 25 bp, Mus musculus
ctccggctcagatatgtcactgtcc

SEQ ID NO: 915887 - DNA, 25 bp, Mus musculus
ctccggctggcccaccttgggacac

SEQ ID NO: 915888 - DNA, 25 bp, Mus musculus
ctccggctgggccaccttgggacac

SEQ ID NO: 915889 - DNA, 25 bp, Mus musculus
ctccgggacactcggatcttccttg

SEQ ID NO: 915890 - DNA, 25 bp, Mus musculus
ctccgggacactgggatcttccttg

SEQ ID NO: 915891 - DNA, 25 bp, Mus musculus
ctccgggattgtcctttgagcgctg

SEQ ID NO: 915892 - DNA, 25 bp, Mus musculus
ctccgggattgtgctttgagcgctg

SEQ ID NO: 915893 - DNA, 25 bp, Mus musculus
ctccgggcagaccccagcatccgct

SEQ ID NO: 915894 - DNA, 25 bp, Mus musculus
ctccgggcagacgccagcatccgct

SEQ ID NO: 915895 - DNA, 25 bp, Mus musculus
ctccgggctcctgacgcatggaggg

SEQ ID NO: 915896 - DNA, 25 bp, Mus musculus
ctccgggctcctgaggcatggaggg

SEQ ID NO: 915897 - DNA, 25 bp, Mus musculus
ctccgggctgagacaagtccatcat

SEQ ID NO: 915898 - DNA, 25 bp, Mus musculus
ctccgggctgagtcaagtccatcat

SEQ ID NO: 915899 - DNA, 25 bp, Mus musculus
ctccggggacagcccttcccaggct

SEQ ID NO: 915900 - DNA, 25 bp, Mus musculus
ctccggggacaggccttcccaggct

SEQ ID NO: 915901 - DNA, 25 bp, Mus musculus
ctccgggggacacttgcagctatct

SEQ ID NO: 915902 - DNA, 25 bp, Mus musculus
ctccgggggacagttgcagctatct

SEQ ID NO: 915903 - DNA, 25 bp, Mus musculus
ctccgggtcatcaacggtcacagta

SEQ ID NO: 915904 - DNA, 25 bp, Mus musculus
ctccgggtcatcaagggtcacagta

SEQ ID NO: 915905 - DNA, 25 bp, Mus musculus
ctccggtaccagcgtccagcctgtg

SEQ ID NO: 915906 - DNA, 25 bp, Mus musculus
ctccggtaccagggtccagcctgtg

SEQ ID NO: 915907 - DNA, 25 bp, Mus musculus
ctccgtaagatgcgaaatccacaga

SEQ ID NO: 915908 - DNA, 25 bp, Mus musculus
ctccgtaagatgggaaatccacaga

SEQ ID NO: 915909 - DNA, 25 bp, Mus musculus
ctccgtacagatcttcgtccctccc

SEQ ID NO: 915910 - DNA, 25 bp, Mus musculus
ctccgtacagcgccatggctactta

SEQ ID NO: 915911 - DNA, 25 bp, Mus musculus
ctccgtacagggccatggctactta

SEQ ID NO: 915912 - DNA, 25 bp, Mus musculus
ctccgtacagttcttcgtccctccc

SEQ ID NO: 915913 - DNA, 25 bp, Mus musculus
ctccgtatagagcaagcccagccct

SEQ ID NO: 915914 - DNA, 25 bp, Mus musculus
ctccgtatagaggaagcccagccct

SEQ ID NO: 915915 - DNA, 25 bp, Mus musculus
ctccgtcatgacccaacttcggcac

SEQ ID NO: 915916 - DNA, 25 bp, Mus musculus
ctccgtcatgacgcaacttcggcac

SEQ ID NO: 915917 - DNA, 25 bp, Mus musculus
ctccgtcgcttacccgtggaagctt

SEQ ID NO: 915918 - DNA, 25 bp, Mus musculus
ctccgtcgcttacccttaccgcagg

SEQ ID NO: 915919 - DNA, 25 bp, Mus musculus
ctccgtcgcttaccggtggaagctt

SEQ ID NO: 915920 - DNA, 25 bp, Mus musculus
ctccgtcgcttaccgttaccgcagg

SEQ ID NO: 915921 - DNA, 25 bp, Mus musculus
ctccgtgaagacacggatgcagagt

SEQ ID NO: 915922 - DNA, 25 bp, Mus musculus
ctccgtgaagaggaaggcctgaaag

SEQ ID NO: 915923 - DNA, 25 bp, Mus musculus
ctccgtgaagtcacggatgcagagt

SEQ ID NO: 915924 - DNA, 25 bp, Mus musculus
ctccgtgaagtggaaggcctgaaag

SEQ ID NO: 915925 - DNA, 25 bp, Mus musculus
ctccgtgcagaactgaactttgggg

SEQ ID NO: 915926 - DNA, 25 bp, Mus musculus
ctccgtgcagtactgaactttgggg

SEQ ID NO: 915927 - DNA, 25 bp, Mus musculus
ctccgtgcccatcacgaggcagaga

SEQ ID NO: 915928 - DNA, 25 bp, Mus musculus
ctccgtgcccatcaggaggcagaga

SEQ ID NO: 915929 - DNA, 25 bp, Mus musculus
ctccgtgcccgactttcaggtgcca

SEQ ID NO: 915930 - DNA, 25 bp, Mus musculus
ctccgtgcccgagtttcaggtgcca

SEQ ID NO: 915931 - DNA, 25 bp, Mus musculus
ctccgtgggtgtgtcaaatgcactt

SEQ ID NO: 915932 - DNA, 25 bp, Mus musculus
ctccgtgggtgtgtcgactgtgcag

SEQ ID NO: 915933 - DNA, 25 bp, Mus musculus
ctccgtgggtgtgtgaaatgcactt

SEQ ID NO: 915934 - DNA, 25 bp, Mus musculus
ctccgtgggtgtgtggactgtgcag

SEQ ID NO: 915935 - DNA, 25 bp, Mus musculus
ctccgtggtgcaccggcttcggctt

SEQ ID NO: 915936 - DNA, 25 bp, Mus musculus
ctccgtggtggaccggcttcggctt

SEQ ID NO: 915937 - DNA, 25 bp, Mus musculus
ctcctaactgctcagtaccatgaat

SEQ ID NO: 915938 - DNA, 25 bp, Mus musculus
ctcctaactggtcagtaccatgaat

SEQ ID NO: 915939 - DNA, 25 bp, Mus musculus
ctcctaaggaagcctcagagaaata

SEQ ID NO: 915940 - DNA, 25 bp, Mus musculus
ctcctaaggaaggctcagagaaata

SEQ ID NO: 915941 - DNA, 25 bp, Mus musculus
ctcctaatgttacacgacatggaga

SEQ ID NO: 915942 - DNA, 25 bp, Mus musculus
ctcctaatgttacaggacatggaga

SEQ ID NO: 915943 - DNA, 25 bp, Mus musculus
ctcctacacacaccgagtcctatac

SEQ ID NO: 915944 - DNA, 25 bp, Mus musculus
ctcctacacagaccgagtcctatac

SEQ ID NO: 915945 - DNA, 25 bp, Mus musculus
ctcctacattatcactggctgcctc

SEQ ID NO: 915946 - DNA, 25 bp, Mus musculus
ctcctacattatcagtggctgcctc

SEQ ID NO: 915947 - DNA, 25 bp, Mus musculus
ctcctaccctcctaagtgctcccaa

SEQ ID NO: 915948 - DNA, 25 bp, Mus musculus
ctcctaccctcctatgtgctcccaa

SEQ ID NO: 915949 - DNA, 25 bp, Mus musculus
ctcctacctgaacagcaccaagctg

SEQ ID NO: 915950 - DNA, 25 bp, Mus musculus
ctcctacctgaagagcaccaagctg

SEQ ID NO: 915951 - DNA, 25 bp, Mus musculus
ctcctacctgtgaaaagatcatctg

SEQ ID NO: 915952 - DNA, 25 bp, Mus musculus
ctcctacctgtgaatagatcatctg

SEQ ID NO: 915953 - DNA, 25 bp, Mus musculus
ctcctactacacctccaaggacaaa

SEQ ID NO: 915954 - DNA, 25 bp, Mus musculus
ctcctactacacgtccaaggacaaa

SEQ ID NO: 915955 - DNA, 25 bp, Mus musculus
ctcctactggaacagccatgaagaa

SEQ ID NO: 915956 - DNA, 25 bp, Mus musculus
ctcctactggaaccagagccatgaa

SEQ ID NO: 915957 - DNA, 25 bp, Mus musculus
ctcctactggaacgtacccagggca

SEQ ID NO: 915958 - DNA, 25 bp, Mus musculus
ctcctactggaagagccatgaagaa

SEQ ID NO: 915959 - DNA, 25 bp, Mus musculus
ctcctactggaagcagagccatgaa

SEQ ID NO: 915960 - DNA, 25 bp, Mus musculus
ctcctactggaaggtacccagggca

SEQ ID NO: 915961 - DNA, 25 bp, Mus musculus
ctcctagaagcgcctcctcacagcg

SEQ ID NO: 915962 - DNA, 25 bp, Mus musculus
ctcctagaagggcctcctcacagcg

SEQ ID NO: 915963 - DNA, 25 bp, Mus musculus
ctcctagcccagatcccaccctgac

SEQ ID NO: 915964 - DNA, 25 bp, Mus musculus
ctcctagcccagttcccaccctgac

SEQ ID NO: 915965 - DNA, 25 bp, Mus musculus
ctcctatggaccaacgtgttggggc

SEQ ID NO: 915966 - DNA, 25 bp, Mus musculus
ctcctatggaccaaggtgttggggc

SEQ ID NO: 915967 - DNA, 25 bp, Mus musculus
ctcctatttgtgcgattgttcatca

SEQ ID NO: 915968 - DNA, 25 bp, Mus musculus
ctcctatttgtgggattgttcatca

SEQ ID NO: 915969 - DNA, 25 bp, Mus musculus
ctcctcaacctggtcacccatccct

SEQ ID NO: 915970 - DNA, 25 bp, Mus musculus
ctcctcaacctggtctatgaaacaa

SEQ ID NO: 915971 - DNA, 25 bp, Mus musculus
ctcctcaacctggtgacccatccct

SEQ ID NO: 915972 - DNA, 25 bp, Mus musculus
ctcctcaacctggtgtatgaaacaa

SEQ ID NO: 915973 - DNA, 25 bp, Mus musculus
ctcctcaagctgaaggacttcgagc

SEQ ID NO: 915974 - DNA, 25 bp, Mus musculus
ctcctcaagctgtaggacttcgagc

SEQ ID NO: 915975 - DNA, 25 bp, Mus musculus
ctcctcacagaggaaggaaagatct

SEQ ID NO: 915976 - DNA, 25 bp, Mus musculus
ctcctcacagtggaaggaaagatct

SEQ ID NO: 915977 - DNA, 25 bp, Mus musculus
ctcctcagacagcgtgtgctgggca

SEQ ID NO: 915978 - DNA, 25 bp, Mus musculus
ctcctcagacagggtgtgctgggca

SEQ ID NO: 915979 - DNA, 25 bp, Mus musculus
ctcctcagagtcagatgccaagcca

SEQ ID NO: 915980 - DNA, 25 bp, Mus musculus
ctcctcagagtcagcaagaaactac

SEQ ID NO: 915981 - DNA, 25 bp, Mus musculus
ctcctcagagtctgatgccaagcca

SEQ ID NO: 915982 - DNA, 25 bp, Mus musculus
ctcctcagagtctgcaagaaactac

SEQ ID NO: 915983 - DNA, 25 bp, Mus musculus
ctcctcagtgagctgatgactccga

SEQ ID NO: 915984 - DNA, 25 bp, Mus musculus
ctcctcagtgaggtgatgactccga

SEQ ID NO: 915985 - DNA, 25 bp, Mus musculus
ctcctcatccagcgtcaaagttgtg

SEQ ID NO: 915986 - DNA, 25 bp, Mus musculus
ctcctcatccagggtcaaagttgtg

SEQ ID NO: 915987 - DNA, 25 bp, Mus musculus
ctcctcattgcaagcaatccggagg

SEQ ID NO: 915988 - DNA, 25 bp, Mus musculus
ctcctcattggaagcaatccggagg

SEQ ID NO: 915989 - DNA, 25 bp, Mus musculus
ctcctccaagcatcagggttgtggt

SEQ ID NO: 915990 - DNA, 25 bp, Mus musculus
ctcctccaaggatcagggttgtggt

SEQ ID NO: 915991 - DNA, 25 bp, Mus musculus
ctcctccacaggatatgggagcaga

SEQ ID NO: 915992 - DNA, 25 bp, Mus musculus
ctcctccacaggttatgggagcaga

SEQ ID NO: 915993 - DNA, 25 bp, Mus musculus
ctcctccagggtcaccttccaagca

SEQ ID NO: 915994 - DNA, 25 bp, Mus musculus
ctcctccagggtcacgtgaaccacc

SEQ ID NO: 915995 - DNA, 25 bp, Mus musculus
ctcctccagggtcagcttccaagca

SEQ ID NO: 915996 - DNA, 25 bp, Mus musculus
ctcctccagggtcaggtgaaccacc

SEQ ID NO: 915997 - DNA, 25 bp, Mus musculus
ctcctccatcttcgcatgtgctcca

SEQ ID NO: 915998 - DNA, 25 bp, Mus musculus
ctcctccatcttggcatgtgctcca

SEQ ID NO: 915999 - DNA, 25 bp, Mus musculus
ctcctcccagagccctggggggcag

SEQ ID NO: 916000 - DNA, 25 bp, Mus musculus
ctcctcccagtgccctggggggcag

SEQ ID NO: 916001 - DNA, 25 bp, Mus musculus
ctcctccctccccacatgtagctgg

SEQ ID NO: 916002 - DNA, 25 bp, Mus musculus
ctcctccctccccagatgtagctgg

SEQ ID NO: 916003 - DNA, 25 bp, Mus musculus
ctcctccgacctggtgacgtatgcc

SEQ ID NO: 916004 - DNA, 25 bp, Mus musculus
ctcctccgacgtggtgacgtatgcc

SEQ ID NO: 916005 - DNA, 25 bp, Mus musculus
ctcctcctggcacatcatttgtagc

SEQ ID NO: 916006 - DNA, 25 bp, Mus musculus
ctcctcctggcagatcatttgtagc

SEQ ID NO: 916007 - DNA, 25 bp, Mus musculus
ctcctcgcagagattcagagatgga

SEQ ID NO: 916008 - DNA, 25 bp, Mus musculus
ctcctcgcagagtttcagagatgga

SEQ ID NO: 916009 - DNA, 25 bp, Mus musculus
ctcctctaaaagccaacaactctac

SEQ ID NO: 916010 - DNA, 25 bp, Mus musculus
ctcctctaaaagcgccgcgcctgcg

SEQ ID NO: 916011 - DNA, 25 bp, Mus musculus
ctcctctaaaaggcaacaactctac

SEQ ID NO: 916012 - DNA, 25 bp, Mus musculus
ctcctctaaaagggccgcgcctgcg

SEQ ID NO: 916013 - DNA, 25 bp, Mus musculus
ctcctctaacagctaccagctccag

SEQ ID NO: 916014 - DNA, 25 bp, Mus musculus
ctcctctaacaggtaccagctccag

SEQ ID NO: 916015 - DNA, 25 bp, Mus musculus
ctcctctatcagctttggcatcggc

SEQ ID NO: 916016 - DNA, 25 bp, Mus musculus
ctcctctatcaggtttggcatcggc

SEQ ID NO: 916017 - DNA, 25 bp, Mus musculus
ctcctctcttggacaaactacaact

SEQ ID NO: 916018 - DNA, 25 bp, Mus musculus
ctcctctcttggtcaaactacaact

SEQ ID NO: 916019 - DNA, 25 bp, Mus musculus
ctcctctggaatcgcctatttacac

SEQ ID NO: 916020 - DNA, 25 bp, Mus musculus
ctcctctggaatggcctatttacac

SEQ ID NO: 916021 - DNA, 25 bp, Mus musculus
ctcctctggctgctaaattgcttga

SEQ ID NO: 916022 - DNA, 25 bp, Mus musculus
ctcctctggctggtaaattgcttga

SEQ ID NO: 916023 - DNA, 25 bp, Mus musculus
ctcctctttgagcgcgagaccaaca

SEQ ID NO: 916024 - DNA, 25 bp, Mus musculus
ctcctctttgagggcgagaccaaca

SEQ ID NO: 916025 - DNA, 25 bp, Mus musculus
ctcctgaaccagctggtccctgaga

SEQ ID NO: 916026 - DNA, 25 bp, Mus musculus
ctcctgaaccaggtggtccctgaga

SEQ ID NO: 916027 - DNA, 25 bp, Mus musculus
ctcctgaatgcacagtcaccacctg

SEQ ID NO: 916028 - DNA, 25 bp, Mus musculus
ctcctgaatgcacttggaatgccaa

SEQ ID NO: 916029 - DNA, 25 bp, Mus musculus
ctcctgaatgcagttggaatgccaa

SEQ ID NO: 916030 - DNA, 25 bp, Mus musculus
ctcctgaatggacagtcaccacctg

SEQ ID NO: 916031 - DNA, 25 bp, Mus musculus
ctcctgaccttgttcgaagtgggca

SEQ ID NO: 916032 - DNA, 25 bp, Mus musculus
ctcctgaccttgttggaagtgggca

SEQ ID NO: 916033 - DNA, 25 bp, Mus musculus
ctcctgagacagcgttgtgagcccc

SEQ ID NO: 916034 - DNA, 25 bp, Mus musculus
ctcctgagacagggttgtgagcccc

SEQ ID NO: 916035 - DNA, 25 bp, Mus musculus
ctcctgagagaacgatgtcacagct

SEQ ID NO: 916036 - DNA, 25 bp, Mus musculus
ctcctgagagaaggatgtcacagct

SEQ ID NO: 916037 - DNA, 25 bp, Mus musculus
ctcctgagataaccaggatgctgcg

SEQ ID NO: 916038 - DNA, 25 bp, Mus musculus
ctcctgagataacgatgctgcggct

SEQ ID NO: 916039 - DNA, 25 bp, Mus musculus
ctcctgagataagcaggatgctgcg

SEQ ID NO: 916040 - DNA, 25 bp, Mus musculus
ctcctgagataaggatgctgcggct

SEQ ID NO: 916041 - DNA, 25 bp, Mus musculus
ctcctgagggcaattccgtcatcgt

SEQ ID NO: 916042 - DNA, 25 bp, Mus musculus
ctcctgagggcatttccgtcatcgt

SEQ ID NO: 916043 - DNA, 25 bp, Mus musculus
ctcctgataacacgtacctgtatgt

SEQ ID NO: 916044 - DNA, 25 bp, Mus musculus
ctcctgataacaggtacctgtatgt

SEQ ID NO: 916045 - DNA, 25 bp, Mus musculus
ctcctgccagcgcccctttgacctg

SEQ ID NO: 916046 - DNA, 25 bp, Mus musculus
ctcctgccagggcccctttgacctg

SEQ ID NO: 916047 - DNA, 25 bp, Mus musculus
ctcctgctattcaaaacagcgtgga

SEQ ID NO: 916048 - DNA, 25 bp, Mus musculus
ctcctgctattcaatacagcgtgga

SEQ ID NO: 916049 - DNA, 25 bp, Mus musculus
ctcctgctgcctatcgctattgcta

SEQ ID NO: 916050 - DNA, 25 bp, Mus musculus
ctcctgctgcctatggctattgcta

SEQ ID NO: 916051 - DNA, 25 bp, Mus musculus
ctcctgctggcggctggagaatcag

SEQ ID NO: 916052 - DNA, 25 bp, Mus musculus
ctcctgctgggggctggagaatcag

SEQ ID NO: 916053 - DNA, 25 bp, Mus musculus
ctcctgctgtgaaaacttctattcc

SEQ ID NO: 916054 - DNA, 25 bp, Mus musculus
ctcctgctgtgaaatcttctattcc

SEQ ID NO: 916055 - DNA, 25 bp, Mus musculus
ctcctgcttccgctgttccgaatgc

SEQ ID NO: 916056 - DNA, 25 bp, Mus musculus
ctcctgcttccggtgttccgaatgc

SEQ ID NO: 916057 - DNA, 25 bp, Mus musculus
ctcctggaaggagtctgaaggaaga

SEQ ID NO: 916058 - DNA, 25 bp, Mus musculus
ctcctggaaggagtgtgaaggaaga

SEQ ID NO: 916059 - DNA, 25 bp, Mus musculus
ctcctggagaagccaccagcagtca

SEQ ID NO: 916060 - DNA, 25 bp, Mus musculus
ctcctggagaaggcaccagcagtca

SEQ ID NO: 916061 - DNA, 25 bp, Mus musculus
ctcctggagcagccccaggctgaag

SEQ ID NO: 916062 - DNA, 25 bp, Mus musculus
ctcctggagcaggcccaggctgaag

SEQ ID NO: 916063 - DNA, 25 bp, Mus musculus
ctcctggatgagatgaagttctcct

SEQ ID NO: 916064 - DNA, 25 bp, Mus musculus
ctcctggatgagttgaagttctcct

SEQ ID NO: 916065 - DNA, 25 bp, Mus musculus
ctcctggattctcgcattaatgtgg

SEQ ID NO: 916066 - DNA, 25 bp, Mus musculus
ctcctggattctggcattaatgtgg

SEQ ID NO: 916067 - DNA, 25 bp, Mus musculus
ctcctggcagaactgaagcaagccc

SEQ ID NO: 916068 - DNA, 25 bp, Mus musculus
ctcctggcagatcatttgtagcaga

SEQ ID NO: 916069 - DNA, 25 bp, Mus musculus
ctcctggcagtactgaagcaagccc

SEQ ID NO: 916070 - DNA, 25 bp, Mus musculus
ctcctggcagtgcgaagtcagagtc

SEQ ID NO: 916071 - DNA, 25 bp, Mus musculus
ctcctggcagtgcgaggccagagtc

SEQ ID NO: 916072 - DNA, 25 bp, Mus musculus
ctcctggcagtgggaagtcagagtc

SEQ ID NO: 916073 - DNA, 25 bp, Mus musculus
ctcctggcagtgggaggccagagtc

SEQ ID NO: 916074 - DNA, 25 bp, Mus musculus
ctcctggcagttcatttgtagcaga

SEQ ID NO: 916075 - DNA, 25 bp, Mus musculus
ctcctggccacgaccttctacaatt

SEQ ID NO: 916076 - DNA, 25 bp, Mus musculus
ctcctggccacgtccttctacaatt

SEQ ID NO: 916077 - DNA, 25 bp, Mus musculus
ctcctggcccagcaaccttccctgg

SEQ ID NO: 916078 - DNA, 25 bp, Mus musculus
ctcctggcccagcaagcttccctgg

SEQ ID NO: 916079 - DNA, 25 bp, Mus musculus
ctcctggcccagcttccctggcaca

SEQ ID NO: 916080 - DNA, 25 bp, Mus musculus
ctcctggcccaggaaccttccctgg

SEQ ID NO: 916081 - DNA, 25 bp, Mus musculus
ctcctggcccaggaagcttccctgg

SEQ ID NO: 916082 - DNA, 25 bp, Mus musculus
ctcctggcccaggttccctggcaca

SEQ ID NO: 916083 - DNA, 25 bp, Mus musculus
ctcctggcgttacacgcttcagtct

SEQ ID NO: 916084 - DNA, 25 bp, Mus musculus
ctcctggcgttacaggcttcagtct

SEQ ID NO: 916085 - DNA, 25 bp, Mus musculus
ctcctggcttcactaagttccggct

SEQ ID NO: 916086 - DNA, 25 bp, Mus musculus
ctcctggcttcagtaagttccggct

SEQ ID NO: 916087 - DNA, 25 bp, Mus musculus
ctcctggcttggatcttgtctacat

SEQ ID NO: 916088 - DNA, 25 bp, Mus musculus
ctcctggcttggttcttgtctacat

SEQ ID NO: 916089 - DNA, 25 bp, Mus musculus
ctcctgggcgcgcacgatgcacctg

SEQ ID NO: 916090 - DNA, 25 bp, Mus musculus
ctcctgggcgcgcaggatgcacctg

SEQ ID NO: 916091 - DNA, 25 bp, Mus musculus
ctcctgggggagctctcagatactc

SEQ ID NO: 916092 - DNA, 25 bp, Mus musculus
ctcctgggggaggtctcagatactc

SEQ ID NO: 916093 - DNA, 25 bp, Mus musculus
ctcctgggtgcccgcgatgaaagtg

SEQ ID NO: 916094 - DNA, 25 bp, Mus musculus
ctcctgggtgcccgggatgaaagtg

SEQ ID NO: 916095 - DNA, 25 bp, Mus musculus
ctcctggtaccaccaccagcgagca

SEQ ID NO: 916096 - DNA, 25 bp, Mus musculus
ctcctggtaccagcaccagcgagca

SEQ ID NO: 916097 - DNA, 25 bp, Mus musculus
ctcctggtatcaccatcagcgatcc

SEQ ID NO: 916098 - DNA, 25 bp, Mus musculus
ctcctggtatcagcatcagcgatcc

SEQ ID NO: 916099 - DNA, 25 bp, Mus musculus
ctcctggtctcacgtaatctccaaa

SEQ ID NO: 916100 - DNA, 25 bp, Mus musculus
ctcctggtctcaggtaatctccaaa

SEQ ID NO: 916101 - DNA, 25 bp, Mus musculus
ctcctggtgcagagccttcaccacc

SEQ ID NO: 916102 - DNA, 25 bp, Mus musculus
ctcctggtgcagtgccttcaccacc

SEQ ID NO: 916103 - DNA, 25 bp, Mus musculus
ctcctggtggtgaccgcagggaggc

SEQ ID NO: 916104 - DNA, 25 bp, Mus musculus
ctcctggtggtgcgtcttctgggac

SEQ ID NO: 916105 - DNA, 25 bp, Mus musculus
ctcctggtggtgggtcttctgggac

SEQ ID NO: 916106 - DNA, 25 bp, Mus musculus
ctcctggtggtgtccgcagggaggc

SEQ ID NO: 916107 - DNA, 25 bp, Mus musculus
ctcctggtgttggaccccctgggaa

SEQ ID NO: 916108 - DNA, 25 bp, Mus musculus
ctcctggtgttggacctctgtgata

SEQ ID NO: 916109 - DNA, 25 bp, Mus musculus
ctcctggtgttggacgaagtaaagc

SEQ ID NO: 916110 - DNA, 25 bp, Mus musculus
ctcctggtgttggagcccctgggaa

SEQ ID NO: 916111 - DNA, 25 bp, Mus musculus
ctcctggtgttggagctctgtgata

SEQ ID NO: 916112 - DNA, 25 bp, Mus musculus
ctcctggtgttggaggaagtaaagc

SEQ ID NO: 916113 - DNA, 25 bp, Mus musculus
ctcctgtacctgcgcaaagcatgtt

SEQ ID NO: 916114 - DNA, 25 bp, Mus musculus
ctcctgtacctgggcaaagcatgtt

SEQ ID NO: 916115 - DNA, 25 bp, Mus musculus
ctcctgtatttatcccctgagcagc

SEQ ID NO: 916116 - DNA, 25 bp, Mus musculus
ctcctgtatttatcgcctgagcagc

SEQ ID NO: 916117 - DNA, 25 bp, Mus musculus
ctcctgttagccgtctcttttctcc

SEQ ID NO: 916118 - DNA, 25 bp, Mus musculus
ctcctgttaggcgtctcttttctcc

SEQ ID NO: 916119 - DNA, 25 bp, Mus musculus
ctcctgtttgaacggatcgcccgaa

SEQ ID NO: 916120 - DNA, 25 bp, Mus musculus
ctcctgtttgaagggatcgcccgaa

SEQ ID NO: 916121 - DNA, 25 bp, Mus musculus
ctccttacacagcgaggcaagggag

SEQ ID NO: 916122 - DNA, 25 bp, Mus musculus
ctccttacacagggaggcaagggag

SEQ ID NO: 916123 - DNA, 25 bp, Mus musculus
ctccttagcaagctcaacaacagtc

SEQ ID NO: 916124 - DNA, 25 bp, Mus musculus
ctccttagcaaggtcaacaacagtc

SEQ ID NO: 916125 - DNA, 25 bp, Mus musculus
ctccttaggtttgcagatgatacgt

SEQ ID NO: 916126 - DNA, 25 bp, Mus musculus
ctccttaggtttgcatgggacacag

SEQ ID NO: 916127 - DNA, 25 bp, Mus musculus
ctccttaggtttgctgatgatacgt

SEQ ID NO: 916128 - DNA, 25 bp, Mus musculus
ctccttaggtttgcttgggacacag

SEQ ID NO: 916129 - DNA, 25 bp, Mus musculus
ctccttagtgccgtgagtcacgcag

SEQ ID NO: 916130 - DNA, 25 bp, Mus musculus
ctccttagtggcgtgagtcacgcag

SEQ ID NO: 916131 - DNA, 25 bp, Mus musculus
ctccttattaccacagcgtttatgt

SEQ ID NO: 916132 - DNA, 25 bp, Mus musculus
ctccttattaccacaggaactgcat

SEQ ID NO: 916133 - DNA, 25 bp, Mus musculus
ctccttattaccactgcgtttatgt

SEQ ID NO: 916134 - DNA, 25 bp, Mus musculus
ctccttattaccactggaactgcat

SEQ ID NO: 916135 - DNA, 25 bp, Mus musculus
ctccttcaagcacaactcaaacctg

SEQ ID NO: 916136 - DNA, 25 bp, Mus musculus
ctccttcaaggacaactcaaacctg

SEQ ID NO: 916137 - DNA, 25 bp, Mus musculus
ctccttcagtgacattaaagatttt

SEQ ID NO: 916138 - DNA, 25 bp, Mus musculus
ctccttcagtgagattaaagatttt

SEQ ID NO: 916139 - DNA, 25 bp, Mus musculus
ctccttcatggacgatgatcgggtg

SEQ ID NO: 916140 - DNA, 25 bp, Mus musculus
ctccttcatggaggatgatcgggtg

SEQ ID NO: 916141 - DNA, 25 bp, Mus musculus
ctccttccagcatcccctgccgtgg

SEQ ID NO: 916142 - DNA, 25 bp, Mus musculus
ctccttccagcgctttgtggtggct

SEQ ID NO: 916143 - DNA, 25 bp, Mus musculus
ctccttccaggatcccctgccgtgg

SEQ ID NO: 916144 - DNA, 25 bp, Mus musculus
ctccttccagggctttgtggtggct

SEQ ID NO: 916145 - DNA, 25 bp, Mus musculus
ctccttccagtgcgatgatctggcc

SEQ ID NO: 916146 - DNA, 25 bp, Mus musculus
ctccttccagtgggatgatctggcc

SEQ ID NO: 916147 - DNA, 25 bp, Mus musculus
ctccttcctcagctactgtgactac

SEQ ID NO: 916148 - DNA, 25 bp, Mus musculus
ctccttcctcaggtactgtgactac

SEQ ID NO: 916149 - DNA, 25 bp, Mus musculus
ctccttccttcacaagagttcgctc

SEQ ID NO: 916150 - DNA, 25 bp, Mus musculus
ctccttccttcagaagagttcgctc

SEQ ID NO: 916151 - DNA, 25 bp, Mus musculus
ctccttcgagctgtttgcagacaaa

SEQ ID NO: 916152 - DNA, 25 bp, Mus musculus
ctccttcgaggtgtttgcagacaaa

SEQ ID NO: 916153 - DNA, 25 bp, Mus musculus
ctccttgaagctgctaaggaaatac

SEQ ID NO: 916154 - DNA, 25 bp, Mus musculus
ctccttgaagctggctgtcttcatg

SEQ ID NO: 916155 - DNA, 25 bp, Mus musculus
ctccttgaaggtgctaaggaaatac

SEQ ID NO: 916156 - DNA, 25 bp, Mus musculus
ctccttgaaggtggctgtcttcatg

SEQ ID NO: 916157 - DNA, 25 bp, Mus musculus
ctccttgcaaatcaacaggtggcct

SEQ ID NO: 916158 - DNA, 25 bp, Mus musculus
ctccttgcaaatcatcaggtggcct

SEQ ID NO: 916159 - DNA, 25 bp, Mus musculus
ctccttgcagcatatctttaaattt

SEQ ID NO: 916160 - DNA, 25 bp, Mus musculus
ctccttgcaggatatctttaaattt

SEQ ID NO: 916161 - DNA, 25 bp, Mus musculus
ctccttgctactcacgtgatcggaa

SEQ ID NO: 916162 - DNA, 25 bp, Mus musculus
ctccttgctactcaggtgatcggaa

SEQ ID NO: 916163 - DNA, 25 bp, Mus musculus
ctccttggagaccgcctcacagagt

SEQ ID NO: 916164 - DNA, 25 bp, Mus musculus
ctccttggagacggcctcacagagt

SEQ ID NO: 916165 - DNA, 25 bp, Mus musculus
ctccttggcttgcacataaaaatat

SEQ ID NO: 916166 - DNA, 25 bp, Mus musculus
ctccttggcttgcagataaaaatat

SEQ ID NO: 916167 - DNA, 25 bp, Mus musculus
ctccttgtccaacatcgagcggtcc

SEQ ID NO: 916168 - DNA, 25 bp, Mus musculus
ctccttgtccaagatcgagcggtcc

SEQ ID NO: 916169 - DNA, 25 bp, Mus musculus
ctccttgttgtcctcgtgggtacca

SEQ ID NO: 916170 - DNA, 25 bp, Mus musculus
ctccttgttgtcctggtgggtacca

SEQ ID NO: 916171 - DNA, 25 bp, Mus musculus
ctcctttactgacaccttttgccta

SEQ ID NO: 916172 - DNA, 25 bp, Mus musculus
ctcctttactgacagcttttgccta

SEQ ID NO: 916173 - DNA, 25 bp, Mus musculus
ctcctttccacgacgtggctgagtg

SEQ ID NO: 916174 - DNA, 25 bp, Mus musculus
ctcctttccacgtcgtggctgagtg

SEQ ID NO: 916175 - DNA, 25 bp, Mus musculus
ctcctttgccatcctttcactgacc

SEQ ID NO: 916176 - DNA, 25 bp, Mus musculus
ctcctttgccatgctttcactgacc

SEQ ID NO: 916177 - DNA, 25 bp, Mus musculus
ctcgaaagagagctggaggcccagc

SEQ ID NO: 916178 - DNA, 25 bp, Mus musculus
ctcgaaagagtgctggaggcccagc

SEQ ID NO: 916179 - DNA, 25 bp, Mus musculus
ctcgaacggccacgtgtcgtgatta

SEQ ID NO: 916180 - DNA, 25 bp, Mus musculus
ctcgaacggccaggtgtcgtgatta

SEQ ID NO: 916181 - DNA, 25 bp, Mus musculus
ctcgaacgtgccacggtcagggaaa

SEQ ID NO: 916182 - DNA, 25 bp, Mus musculus
ctcgaacgtgcctcggtcagggaaa

SEQ ID NO: 916183 - DNA, 25 bp, Mus musculus
ctcgaagagacagacgacaaagcaa

SEQ ID NO: 916184 - DNA, 25 bp, Mus musculus
ctcgaagagagagacgacaaagcaa

SEQ ID NO: 916185 - DNA, 25 bp, Mus musculus
ctcgacaaccagcttggcttcaaaa

SEQ ID NO: 916186 - DNA, 25 bp, Mus musculus
ctcgacaaccaggttggcttcaaaa

SEQ ID NO: 916187 - DNA, 25 bp, Mus musculus
ctcgacccatcacactgtttacagc

SEQ ID NO: 916188 - DNA, 25 bp, Mus musculus
ctcgacccatcagactgtttacagc

SEQ ID NO: 916189 - DNA, 25 bp, Mus musculus
ctcgacctgcttcgaatgatggagg

SEQ ID NO: 916190 - DNA, 25 bp, Mus musculus
ctcgacctgcttggaatgatggagg

SEQ ID NO: 916191 - DNA, 25 bp, Mus musculus
ctcgagaaggagcacgttggccaca

SEQ ID NO: 916192 - DNA, 25 bp, Mus musculus
ctcgagaaggagcaggttggccaca

SEQ ID NO: 916193 - DNA, 25 bp, Mus musculus
ctcgagagaggaagatcgtcctact

SEQ ID NO: 916194 - DNA, 25 bp, Mus musculus
ctcgagagaggaagttcgtcctact

SEQ ID NO: 916195 - DNA, 25 bp, Mus musculus
ctcgagcagactccgtctcccaggg

SEQ ID NO: 916196 - DNA, 25 bp, Mus musculus
ctcgagcagagtccgtctcccaggg

SEQ ID NO: 916197 - DNA, 25 bp, Mus musculus
ctcgagccagcttctctccactatg

SEQ ID NO: 916198 - DNA, 25 bp, Mus musculus
ctcgagccaggttctctccactatg

SEQ ID NO: 916199 - DNA, 25 bp, Mus musculus
ctcgagccgcagcgcggatgccgtt

SEQ ID NO: 916200 - DNA, 25 bp, Mus musculus
ctcgagccgcagcggggatgccgtt

SEQ ID NO: 916201 - DNA, 25 bp, Mus musculus
ctcgagggccttcacgaagatgcta

SEQ ID NO: 916202 - DNA, 25 bp, Mus musculus
ctcgagggccttcaggaagatgcta

SEQ ID NO: 916203 - DNA, 25 bp, Mus musculus
ctcgagtcaccgattgccatctctg

SEQ ID NO: 916204 - DNA, 25 bp, Mus musculus
ctcgagtcaccgtttgccatctctg

SEQ ID NO: 916205 - DNA, 25 bp, Mus musculus
ctcgagttcaaccacgtggtgatct

SEQ ID NO: 916206 - DNA, 25 bp, Mus musculus
ctcgagttcaaccaggtggtgatct

SEQ ID NO: 916207 - DNA, 25 bp, Mus musculus
ctcgatacagcacagaactcggcat

SEQ ID NO: 916208 - DNA, 25 bp, Mus musculus
ctcgatacaggacagaactcggcat

SEQ ID NO: 916209 - DNA, 25 bp, Mus musculus
ctcgatcaactcaataaagccgttg

SEQ ID NO: 916210 - DNA, 25 bp, Mus musculus
ctcgatcaactcagccggctcaaca

SEQ ID NO: 916211 - DNA, 25 bp, Mus musculus
ctcgatcaactctataaagccgttg

SEQ ID NO: 916212 - DNA, 25 bp, Mus musculus
ctcgatcaactctgccggctcaaca

SEQ ID NO: 916213 - DNA, 25 bp, Mus musculus
ctcgatccacgtcagcattcctccg

SEQ ID NO: 916214 - DNA, 25 bp, Mus musculus
ctcgatccacgtgagcattcctccg

SEQ ID NO: 916215 - DNA, 25 bp, Mus musculus
ctcgatccagctcaggttcccactc

SEQ ID NO: 916216 - DNA, 25 bp, Mus musculus
ctcgatccaggtcaggttcccactc

SEQ ID NO: 916217 - DNA, 25 bp, Mus musculus
ctcgatggcgcagaggtgtctgtga

SEQ ID NO: 916218 - DNA, 25 bp, Mus musculus
ctcgatggcggagaggtgtctgtga

SEQ ID NO: 916219 - DNA, 25 bp, Mus musculus
ctcgatgtcgttcaacggtcaccac

SEQ ID NO: 916220 - DNA, 25 bp, Mus musculus
ctcgatgtcgttgaacggtcaccac

SEQ ID NO: 916221 - DNA, 25 bp, Mus musculus
ctcgatgttccactcgctctttgcc

SEQ ID NO: 916222 - DNA, 25 bp, Mus musculus
ctcgatgttccactcggatcaagtt

SEQ ID NO: 916223 - DNA, 25 bp, Mus musculus
ctcgatgttccactggctctttgcc

SEQ ID NO: 916224 - DNA, 25 bp, Mus musculus
ctcgatgttccactgggatcaagtt

SEQ ID NO: 916225 - DNA, 25 bp, Mus musculus
ctcgcaaattacctccacagcaaag

SEQ ID NO: 916226 - DNA, 25 bp, Mus musculus
ctcgcaaattacgtccacagcaaag

SEQ ID NO: 916227 - DNA, 25 bp, Mus musculus
ctcgcacagaagcctctctggatgc

SEQ ID NO: 916228 - DNA, 25 bp, Mus musculus
ctcgcacagaaggctctctggatgc

SEQ ID NO: 916229 - DNA, 25 bp, Mus musculus
ctcgcacctcaccgcctccccgaag

SEQ ID NO: 916230 - DNA, 25 bp, Mus musculus
ctcgcacctcacggcctccccgaag

SEQ ID NO: 916231 - DNA, 25 bp, Mus musculus
ctcgcactatcgtccacgcttcatg

SEQ ID NO: 916232 - DNA, 25 bp, Mus musculus
ctcgcactatggtccacgcttcatg

SEQ ID NO: 916233 - DNA, 25 bp, Mus musculus
ctcgcagaagctcaggtaccggaca

SEQ ID NO: 916234 - DNA, 25 bp, Mus musculus
ctcgcagaaggtcaggtaccggaca

SEQ ID NO: 916235 - DNA, 25 bp, Mus musculus
ctcgcagatgagagccttgagccag

SEQ ID NO: 916236 - DNA, 25 bp, Mus musculus
ctcgcagatgtgagccttgagccag

SEQ ID NO: 916237 - DNA, 25 bp, Mus musculus
ctcgccaaacctgatgagaatttcc

SEQ ID NO: 916238 - DNA, 25 bp, Mus musculus
ctcgccaaacgtgatgagaatttcc

SEQ ID NO: 916239 - DNA, 25 bp, Mus musculus
ctcgccaactcacattcgatgtaca

SEQ ID NO: 916240 - DNA, 25 bp, Mus musculus
ctcgccaactcagattcgatgtaca

SEQ ID NO: 916241 - DNA, 25 bp, Mus musculus
ctcgccacagccttgatgcaggttc

SEQ ID NO: 916242 - DNA, 25 bp, Mus musculus
ctcgccacaggcttgatgcaggttc

SEQ ID NO: 916243 - DNA, 25 bp, Mus musculus
ctcgccagtcacagtatgcggtgac

SEQ ID NO: 916244 - DNA, 25 bp, Mus musculus
ctcgccagtcactgtatgcggtgac

SEQ ID NO: 916245 - DNA, 25 bp, Mus musculus
ctcgccatcgagcacgtattcccaa

SEQ ID NO: 916246 - DNA, 25 bp, Mus musculus
ctcgccatcgagcacgtgtcaccgg

SEQ ID NO: 916247 - DNA, 25 bp, Mus musculus
ctcgccatcgagcaggtattcccaa

SEQ ID NO: 916248 - DNA, 25 bp, Mus musculus
ctcgccatcgagcaggtgtcaccgg

SEQ ID NO: 916249 - DNA, 25 bp, Mus musculus
ctcgccatgaagaagcccattggaa

SEQ ID NO: 916250 - DNA, 25 bp, Mus musculus
ctcgccatgaagtagcccattggaa

SEQ ID NO: 916251 - DNA, 25 bp, Mus musculus
ctcgccgcaagacgcttgagatgct

SEQ ID NO: 916252 - DNA, 25 bp, Mus musculus
ctcgccgcaagaggcttgagatgct

SEQ ID NO: 916253 - DNA, 25 bp, Mus musculus
ctcgccgccagaaccatgccccatc

SEQ ID NO: 916254 - DNA, 25 bp, Mus musculus
ctcgccgccagaacgatgccccatc

SEQ ID NO: 916255 - DNA, 25 bp, Mus musculus
ctcgcctcagagagtgttcagttcc

SEQ ID NO: 916256 - DNA, 25 bp, Mus musculus
ctcgcctcagagatccctggcagct

SEQ ID NO: 916257 - DNA, 25 bp, Mus musculus
ctcgcctcagagtgtgttcagttcc

SEQ ID NO: 916258 - DNA, 25 bp, Mus musculus
ctcgcctcagagttccctggcagct

SEQ ID NO: 916259 - DNA, 25 bp, Mus musculus
ctcgcctgcaagagtctcactttac

SEQ ID NO: 916260 - DNA, 25 bp, Mus musculus
ctcgcctgcaagcttcctgctgctg

SEQ ID NO: 916261 - DNA, 25 bp, Mus musculus
ctcgcctgcaaggttcctgctgctg

SEQ ID NO: 916262 - DNA, 25 bp, Mus musculus
ctcgcctgcaagtgtctcactttac

SEQ ID NO: 916263 - DNA, 25 bp, Mus musculus
ctcgcctgcgtgacctgtcacgatg

SEQ ID NO: 916264 - DNA, 25 bp, Mus musculus
ctcgcctgcgtgacgtgtcacgatg

SEQ ID NO: 916265 - DNA, 25 bp, Mus musculus
ctcgcctgtgaactcatcagcacct

SEQ ID NO: 916266 - DNA, 25 bp, Mus musculus
ctcgcctgtgtactcatcagcacct

SEQ ID NO: 916267 - DNA, 25 bp, Mus musculus
ctcgccttgaagcctcagaagtaca

SEQ ID NO: 916268 - DNA, 25 bp, Mus musculus
ctcgccttgaaggctcagaagtaca

SEQ ID NO: 916269 - DNA, 25 bp, Mus musculus
ctcgcggaggaaaatcaactaaaca

SEQ ID NO: 916270 - DNA, 25 bp, Mus musculus
ctcgcggaggtaaatcaactaaaca

SEQ ID NO: 916271 - DNA, 25 bp, Mus musculus
ctcgcggcagagcacaccattaagc

SEQ ID NO: 916272 - DNA, 25 bp, Mus musculus
ctcgcggcagagcagaccattaagc

SEQ ID NO: 916273 - DNA, 25 bp, Mus musculus
ctcgcggcggaagactgctagctac

SEQ ID NO: 916274 - DNA, 25 bp, Mus musculus
ctcgcggcggtagactgctagctac

SEQ ID NO: 916275 - DNA, 25 bp, Mus musculus
ctcgcgggagatggaggtcctggca

SEQ ID NO: 916276 - DNA, 25 bp, Mus musculus
ctcgcgggagatggtggtcctggca

SEQ ID NO: 916277 - DNA, 25 bp, Mus musculus
ctcgctacctctcacgcccaagctg

SEQ ID NO: 916278 - DNA, 25 bp, Mus musculus
ctcgctacctctcaggcccaagctg

SEQ ID NO: 916279 - DNA, 25 bp, Mus musculus
ctcgctgctatacgcatgaaagaag

SEQ ID NO: 916280 - DNA, 25 bp, Mus musculus
ctcgctgctatacgctactattgga

SEQ ID NO: 916281 - DNA, 25 bp, Mus musculus
ctcgctgctataggcatgaaagaag

SEQ ID NO: 916282 - DNA, 25 bp, Mus musculus
ctcgctgctataggctactattgga

SEQ ID NO: 916283 - DNA, 25 bp, Mus musculus
ctcgctggtgcctggaggggtagca

SEQ ID NO: 916284 - DNA, 25 bp, Mus musculus
ctcgctggtggctggaggggtagca

SEQ ID NO: 916285 - DNA, 25 bp, Mus musculus
ctcggaacagcatggttcgaggaga

SEQ ID NO: 916286 - DNA, 25 bp, Mus musculus
ctcggaacaggatggttcgaggaga

SEQ ID NO: 916287 - DNA, 25 bp, Mus musculus
ctcggaacagttctttatttatgtg

SEQ ID NO: 916288 - DNA, 25 bp, Mus musculus
ctcggaacagttgtttatttatgtg

SEQ ID NO: 916289 - DNA, 25 bp, Mus musculus
ctcggaacctgtccagtgctcataa

SEQ ID NO: 916290 - DNA, 25 bp, Mus musculus
ctcggaacctgtcctgtgctcataa

SEQ ID NO: 916291 - DNA, 25 bp, Mus musculus
ctcggaagcagacatggctatgaac

SEQ ID NO: 916292 - DNA, 25 bp, Mus musculus
ctcggaagcagagatggctatgaac

SEQ ID NO: 916293 - DNA, 25 bp, Mus musculus
ctcggaagtgaactcaaagacagat

SEQ ID NO: 916294 - DNA, 25 bp, Mus musculus
ctcggaagtgaagtcaaagacagat

SEQ ID NO: 916295 - DNA, 25 bp, Mus musculus
ctcggaatatttgacaatcaagacc

SEQ ID NO: 916296 - DNA, 25 bp, Mus musculus
ctcggaatatttgaccagaatcaag

SEQ ID NO: 916297 - DNA, 25 bp, Mus musculus
ctcggaatatttgagaatcaagacc

SEQ ID NO: 916298 - DNA, 25 bp, Mus musculus
ctcggaatatttgagcagaatcaag

SEQ ID NO: 916299 - DNA, 25 bp, Mus musculus
ctcggaatggcaaccctaatggcaa

SEQ ID NO: 916300 - DNA, 25 bp, Mus musculus
ctcggaatgggaaccctaatggcaa

SEQ ID NO: 916301 - DNA, 25 bp, Mus musculus
ctcggacactcagacactgtctctg

SEQ ID NO: 916302 - DNA, 25 bp, Mus musculus
ctcggacactcagacgatttcccta

SEQ ID NO: 916303 - DNA, 25 bp, Mus musculus
ctcggacactcagagactgtctctg

SEQ ID NO: 916304 - DNA, 25 bp, Mus musculus
ctcggacactcagaggatttcccta

SEQ ID NO: 916305 - DNA, 25 bp, Mus musculus
ctcggactcaacttctctgcggccc

SEQ ID NO: 916306 - DNA, 25 bp, Mus musculus
ctcggactcatcttctctgcggccc

SEQ ID NO: 916307 - DNA, 25 bp, Mus musculus
ctcggagatcccttttgtggctaca

SEQ ID NO: 916308 - DNA, 25 bp, Mus musculus
ctcggagatcctatacttgaaggct

SEQ ID NO: 916309 - DNA, 25 bp, Mus musculus
ctcggagatcgcttttgtggctaca

SEQ ID NO: 916310 - DNA, 25 bp, Mus musculus
ctcggagatcgtatacttgaaggct

SEQ ID NO: 916311 - DNA, 25 bp, Mus musculus
ctcggagcagagcgatcagcagctg

SEQ ID NO: 916312 - DNA, 25 bp, Mus musculus
ctcggagcagctggagctgatcaca

SEQ ID NO: 916313 - DNA, 25 bp, Mus musculus
ctcggagcaggtggagctgatcaca

SEQ ID NO: 916314 - DNA, 25 bp, Mus musculus
ctcggagcagtgcgatcagcagctg

SEQ ID NO: 916315 - DNA, 25 bp, Mus musculus
ctcggatattggaccagccatcctc

SEQ ID NO: 916316 - DNA, 25 bp, Mus musculus
ctcggatattggacgagccatcctc

SEQ ID NO: 916317 - DNA, 25 bp, Mus musculus
ctcggatccctttgcgtcctgcgct

SEQ ID NO: 916318 - DNA, 25 bp, Mus musculus
ctcggatccctttgcgttcacactc

SEQ ID NO: 916319 - DNA, 25 bp, Mus musculus
ctcggatccctttgggtcctgcgct

SEQ ID NO: 916320 - DNA, 25 bp, Mus musculus
ctcggatccctttgggttcacactc

SEQ ID NO: 916321 - DNA, 25 bp, Mus musculus
ctcggatcttcaacacaggtgtgtg

SEQ ID NO: 916322 - DNA, 25 bp, Mus musculus
ctcggatcttcaacagtgtgtgatg

SEQ ID NO: 916323 - DNA, 25 bp, Mus musculus
ctcggatcttcaactcaggtgtgtg

SEQ ID NO: 916324 - DNA, 25 bp, Mus musculus
ctcggatcttcaactgtgtgtgatg

SEQ ID NO: 916325 - DNA, 25 bp, Mus musculus
ctcggatgccagcggctgagctggc

SEQ ID NO: 916326 - DNA, 25 bp, Mus musculus
ctcggatgccaggggctgagctggc

SEQ ID NO: 916327 - DNA, 25 bp, Mus musculus
ctcggcaaagatggctcacatgaag

SEQ ID NO: 916328 - DNA, 25 bp, Mus musculus
ctcggcaaagttggctcacatgaag

SEQ ID NO: 916329 - DNA, 25 bp, Mus musculus
ctcggcaacaagacgctgccgtcca

SEQ ID NO: 916330 - DNA, 25 bp, Mus musculus
ctcggcaacaagtcgctgccgtcca

SEQ ID NO: 916331 - DNA, 25 bp, Mus musculus
ctcggcaagtgtgaccggatccggg

SEQ ID NO: 916332 - DNA, 25 bp, Mus musculus
ctcggcaagtgtgagcggatccggg

SEQ ID NO: 916333 - DNA, 25 bp, Mus musculus
ctcggcatcttactacctgaaccag

SEQ ID NO: 916334 - DNA, 25 bp, Mus musculus
ctcggcatcttagtacctgaaccag

SEQ ID NO: 916335 - DNA, 25 bp, Mus musculus
ctcggcatgttcctgtggacaaatg

SEQ ID NO: 916336 - DNA, 25 bp, Mus musculus
ctcggcatgttcgtgtggacaaatg

SEQ ID NO: 916337 - DNA, 25 bp, Mus musculus
ctcggccaaccacggtttctctgtc

SEQ ID NO: 916338 - DNA, 25 bp, Mus musculus
ctcggccaaccagggtttctctgtc

SEQ ID NO: 916339 - DNA, 25 bp, Mus musculus
ctcggccagagacgccggggcccgc

SEQ ID NO: 916340 - DNA, 25 bp, Mus musculus
ctcggccagagaggccggggcccgc

SEQ ID NO: 916341 - DNA, 25 bp, Mus musculus
ctcggcccagcacagccccccagcg

SEQ ID NO: 916342 - DNA, 25 bp, Mus musculus
ctcggcccaggacagccccccagcg

SEQ ID NO: 916343 - DNA, 25 bp, Mus musculus
ctcggcctccagagatccgtgaaga

SEQ ID NO: 916344 - DNA, 25 bp, Mus musculus
ctcggcctccagtgatccgtgaaga

SEQ ID NO: 916345 - DNA, 25 bp, Mus musculus
ctcggctatcagaccaggatcccgt

SEQ ID NO: 916346 - DNA, 25 bp, Mus musculus
ctcggctatcagtccaggatcccgt

SEQ ID NO: 916347 - DNA, 25 bp, Mus musculus
ctcggctcacagatggctgccagca

SEQ ID NO: 916348 - DNA, 25 bp, Mus musculus
ctcggctcacagccagaagacttta

SEQ ID NO: 916349 - DNA, 25 bp, Mus musculus
ctcggctcacaggcagaagacttta

SEQ ID NO: 916350 - DNA, 25 bp, Mus musculus
ctcggctcacagttggctgccagca

SEQ ID NO: 916351 - DNA, 25 bp, Mus musculus
ctcggctccctccccatgagaagaa

SEQ ID NO: 916352 - DNA, 25 bp, Mus musculus
ctcggctccctccccggatatttgc

SEQ ID NO: 916353 - DNA, 25 bp, Mus musculus
ctcggctccctcccgatgagaagaa

SEQ ID NO: 916354 - DNA, 25 bp, Mus musculus
ctcggctccctcccgggatatttgc

SEQ ID NO: 916355 - DNA, 25 bp, Mus musculus
ctcggctgaggacgccaccatggca

SEQ ID NO: 916356 - DNA, 25 bp, Mus musculus
ctcggctgaggaggccaccatggca

SEQ ID NO: 916357 - DNA, 25 bp, Mus musculus
ctcggctgccagatctatgaaggct

SEQ ID NO: 916358 - DNA, 25 bp, Mus musculus
ctcggctgccagttctatgaaggct

SEQ ID NO: 916359 - DNA, 25 bp, Mus musculus
ctcggctgcccgcgcctgactacca

SEQ ID NO: 916360 - DNA, 25 bp, Mus musculus
ctcggctgcccgggcctgactacca

SEQ ID NO: 916361 - DNA, 25 bp, Mus musculus
ctcggctgggcccacgaactgcata

SEQ ID NO: 916362 - DNA, 25 bp, Mus musculus
ctcggctgggcccaggaactgcata

SEQ ID NO: 916363 - DNA, 25 bp, Mus musculus
ctcggctggggtcattctcagagct

SEQ ID NO: 916364 - DNA, 25 bp, Mus musculus
ctcggctggggtgattctcagagct

SEQ ID NO: 916365 - DNA, 25 bp, Mus musculus
ctcgggaaattacacgctctgcaaa

SEQ ID NO: 916366 - DNA, 25 bp, Mus musculus
ctcgggaaattacaggctctgcaaa

SEQ ID NO: 916367 - DNA, 25 bp, Mus musculus
ctcgggagaatggacgaagaagctt

SEQ ID NO: 916368 - DNA, 25 bp, Mus musculus
ctcgggagaatggaggaagaagctt

SEQ ID NO: 916369 - DNA, 25 bp, Mus musculus
ctcgggagacagcattcgaactgtt

SEQ ID NO: 916370 - DNA, 25 bp, Mus musculus
ctcgggagacaggattcgaactgtt

SEQ ID NO: 916371 - DNA, 25 bp, Mus musculus
ctcgggagagcttctaaatggcatt

SEQ ID NO: 916372 - DNA, 25 bp, Mus musculus
ctcgggagaggttctaaatggcatt

SEQ ID NO: 916373 - DNA, 25 bp, Mus musculus
ctcgggatcagcgtcggagctccgc

SEQ ID NO: 916374 - DNA, 25 bp, Mus musculus
ctcgggatcagcgtgggagctccgc

SEQ ID NO: 916375 - DNA, 25 bp, Mus musculus
ctcgggcaagcacttagcattcagg

SEQ ID NO: 916376 - DNA, 25 bp, Mus musculus
ctcgggcaaggacttagcattcagg

SEQ ID NO: 916377 - DNA, 25 bp, Mus musculus
ctcgggcaccgtcacgctcaagtcc

SEQ ID NO: 916378 - DNA, 25 bp, Mus musculus
ctcgggcaccgtcaggctcaagtcc

SEQ ID NO: 916379 - DNA, 25 bp, Mus musculus
ctcggggaagaccctcagtgtgttt

SEQ ID NO: 916380 - DNA, 25 bp, Mus musculus
ctcggggaagtccctcagtgtgttt

SEQ ID NO: 916381 - DNA, 25 bp, Mus musculus
ctcggggcagaaaatatctgcagaa

SEQ ID NO: 916382 - DNA, 25 bp, Mus musculus
ctcggggcagatcgtaatgtaaata

SEQ ID NO: 916383 - DNA, 25 bp, Mus musculus
ctcggggcagtaaatatctgcagaa

SEQ ID NO: 916384 - DNA, 25 bp, Mus musculus
ctcggggcagttcgtaatgtaaata

SEQ ID NO: 916385 - DNA, 25 bp, Mus musculus
ctcgggggactgccaatgtttgccc

SEQ ID NO: 916386 - DNA, 25 bp, Mus musculus
ctcgggggactgcccatgtttgcca

SEQ ID NO: 916387 - DNA, 25 bp, Mus musculus
ctcgggggactggcaatgtttgccc

SEQ ID NO: 916388 - DNA, 25 bp, Mus musculus
ctcgggggactggccatgtttgcca

SEQ ID NO: 916389 - DNA, 25 bp, Mus musculus
ctcggggtttgcctgaagagaagga

SEQ ID NO: 916390 - DNA, 25 bp, Mus musculus
ctcggggtttgcgtgaagagaagga

SEQ ID NO: 916391 - DNA, 25 bp, Mus musculus
ctcgggtcggaacctccagctctcc

SEQ ID NO: 916392 - DNA, 25 bp, Mus musculus
ctcgggtcggtacctccagctctcc

SEQ ID NO: 916393 - DNA, 25 bp, Mus musculus
ctcgggtgcccacgatcgatccgta

SEQ ID NO: 916394 - DNA, 25 bp, Mus musculus
ctcgggtgcccaggatcgatccgta

SEQ ID NO: 916395 - DNA, 25 bp, Mus musculus
ctcgggtggctggacttgaattcag

SEQ ID NO: 916396 - DNA, 25 bp, Mus musculus
ctcgggtggctggagttgaattcag

SEQ ID NO: 916397 - DNA, 25 bp, Mus musculus
ctcggtccagcacttcaaagaggaa

SEQ ID NO: 916398 - DNA, 25 bp, Mus musculus
ctcggtccagcagttcaaagaggaa

SEQ ID NO: 916399 - DNA, 25 bp, Mus musculus
ctcggtgacgcacacgttctccaca

SEQ ID NO: 916400 - DNA, 25 bp, Mus musculus
ctcggtgacgcacaggttctccaca

SEQ ID NO: 916401 - DNA, 25 bp, Mus musculus
ctcggtgcagcctatctatgtgcct

SEQ ID NO: 916402 - DNA, 25 bp, Mus musculus
ctcggtgcaggctatctatgtgcct

SEQ ID NO: 916403 - DNA, 25 bp, Mus musculus
ctcggtgccactcatgagcggcacc

SEQ ID NO: 916404 - DNA, 25 bp, Mus musculus
ctcggtgccactgatgagcggcacc

SEQ ID NO: 916405 - DNA, 25 bp, Mus musculus
ctcggtggccgacacagtgcttggg

SEQ ID NO: 916406 - DNA, 25 bp, Mus musculus
ctcggtggccgacagagtgcttggg

SEQ ID NO: 916407 - DNA, 25 bp, Mus musculus
ctcggtggcgtacgcctgggctgct

SEQ ID NO: 916408 - DNA, 25 bp, Mus musculus
ctcggtggcgtaggcctgggctgct

SEQ ID NO: 916409 - DNA, 25 bp, Mus musculus
ctcggtgtggaagacatgaaccgga

SEQ ID NO: 916410 - DNA, 25 bp, Mus musculus
ctcggtgtggaagagatgaaccgga

SEQ ID NO: 916411 - DNA, 25 bp, Mus musculus
ctcggttgtgaacggagtgagaaaa

SEQ ID NO: 916412 - DNA, 25 bp, Mus musculus
ctcggttgtgaagggagtgagaaaa

SEQ ID NO: 916413 - DNA, 25 bp, Mus musculus
ctcgtaccagccacagaagaatgag

SEQ ID NO: 916414 - DNA, 25 bp, Mus musculus
ctcgtaccaggcacagaagaatgag

SEQ ID NO: 916415 - DNA, 25 bp, Mus musculus
ctcgtattgaacaacaaaatgttat

SEQ ID NO: 916416 - DNA, 25 bp, Mus musculus
ctcgtattgaacaagaaaatgttat

SEQ ID NO: 916417 - DNA, 25 bp, Mus musculus
ctcgtcaaagctctcattcaggaac

SEQ ID NO: 916418 - DNA, 25 bp, Mus musculus
ctcgtcaaaggtctcattcaggaac

SEQ ID NO: 916419 - DNA, 25 bp, Mus musculus
ctcgtcagaaaacgcgagtcttcag

SEQ ID NO: 916420 - DNA, 25 bp, Mus musculus
ctcgtcagaaaaggcgagtcttcag

SEQ ID NO: 916421 - DNA, 25 bp, Mus musculus
ctcgtcagaagacaagacgccagca

SEQ ID NO: 916422 - DNA, 25 bp, Mus musculus
ctcgtcagaagacgagtccaaaatc

SEQ ID NO: 916423 - DNA, 25 bp, Mus musculus
ctcgtcagaagagaagacgccagca

SEQ ID NO: 916424 - DNA, 25 bp, Mus musculus
ctcgtcagaagaggagtccaaaatc

SEQ ID NO: 916425 - DNA, 25 bp, Mus musculus
ctcgtccgtcccctaggccatccaa

SEQ ID NO: 916426 - DNA, 25 bp, Mus musculus
ctcgtccgtccccttggccatccaa

SEQ ID NO: 916427 - DNA, 25 bp, Mus musculus
ctcgtccgtggacgttgtcagagaa

SEQ ID NO: 916428 - DNA, 25 bp, Mus musculus
ctcgtccgtggaggttgtcagagaa

SEQ ID NO: 916429 - DNA, 25 bp, Mus musculus
ctcgtctatcagacttgtctgtatt

SEQ ID NO: 916430 - DNA, 25 bp, Mus musculus
ctcgtctatcagtcttgtctgtatt

SEQ ID NO: 916431 - DNA, 25 bp, Mus musculus
ctcgtctgcaagactgtgttctctt

SEQ ID NO: 916432 - DNA, 25 bp, Mus musculus
ctcgtctgcaagtctgtgttctctt

SEQ ID NO: 916433 - DNA, 25 bp, Mus musculus
ctcgtctggggccacgtcatcgcca

SEQ ID NO: 916434 - DNA, 25 bp, Mus musculus
ctcgtctggggccaggtcatcgcca

SEQ ID NO: 916435 - DNA, 25 bp, Mus musculus
ctcgtgcaagagctggaatcacttc

SEQ ID NO: 916436 - DNA, 25 bp, Mus musculus
ctcgtgcaagtgctggaatcacttc

SEQ ID NO: 916437 - DNA, 25 bp, Mus musculus
ctcgtgcctacgcaaacatgacagc

SEQ ID NO: 916438 - DNA, 25 bp, Mus musculus
ctcgtgcctacggaaacatgacagc

SEQ ID NO: 916439 - DNA, 25 bp, Mus musculus
ctcgtgcctacggcaaggaaacatg

SEQ ID NO: 916440 - DNA, 25 bp, Mus musculus
ctcgtgcctacggctaggaaacatg

SEQ ID NO: 916441 - DNA, 25 bp, Mus musculus
ctcgtggaagctgaagccgtccacc

SEQ ID NO: 916442 - DNA, 25 bp, Mus musculus
ctcgtggaaggtgaagccgtccacc

SEQ ID NO: 916443 - DNA, 25 bp, Mus musculus
ctcgtggcctggaaaatatgattcc

SEQ ID NO: 916444 - DNA, 25 bp, Mus musculus
ctcgtggcctggtaaatatgattcc

SEQ ID NO: 916445 - DNA, 25 bp, Mus musculus
ctcgttaggatcccaccagagtata

SEQ ID NO: 916446 - DNA, 25 bp, Mus musculus
ctcgttaggatcgcaccagagtata

SEQ ID NO: 916447 - DNA, 25 bp, Mus musculus
ctcgttatcgcaatgaccaatagac

SEQ ID NO: 916448 - DNA, 25 bp, Mus musculus
ctcgttatcggaatgaccaatagac

SEQ ID NO: 916449 - DNA, 25 bp, Mus musculus
ctcgttcactccaatgatggcactc

SEQ ID NO: 916450 - DNA, 25 bp, Mus musculus
ctcgttcactcctatgatggcactc

SEQ ID NO: 916451 - DNA, 25 bp, Mus musculus
ctcgttcctcaacatggccgactct

SEQ ID NO: 916452 - DNA, 25 bp, Mus musculus
ctcgttcctcaagatggccgactct

SEQ ID NO: 916453 - DNA, 25 bp, Mus musculus
ctcgttcttcagagaggatgcccct

SEQ ID NO: 916454 - DNA, 25 bp, Mus musculus
ctcgttcttcagtgaggatgcccct

SEQ ID NO: 916455 - DNA, 25 bp, Mus musculus
ctcgtttcccttgacgttctgatct

SEQ ID NO: 916456 - DNA, 25 bp, Mus musculus
ctcgtttcccttgaggttctgatct

SEQ ID NO: 916457 - DNA, 25 bp, Mus musculus
ctctaaaactactatcatcctgaag

SEQ ID NO: 916458 - DNA, 25 bp, Mus musculus
ctctaaaactcaagcaccttcagga

SEQ ID NO: 916459 - DNA, 25 bp, Mus musculus
ctctaaaactgaagcaccttcagga

SEQ ID NO: 916460 - DNA, 25 bp, Mus musculus
ctctaaaacttctatcatcctgaag

SEQ ID NO: 916461 - DNA, 25 bp, Mus musculus
ctctaaaaggcaacaactctacata

SEQ ID NO: 916462 - DNA, 25 bp, Mus musculus
ctctaaaaggcccgcgcctgcgcag

SEQ ID NO: 916463 - DNA, 25 bp, Mus musculus
ctctaaaagggaacaactctacata

SEQ ID NO: 916464 - DNA, 25 bp, Mus musculus
ctctaaaagggccgcgcctgcgcag

SEQ ID NO: 916465 - DNA, 25 bp, Mus musculus
ctctaaacagcttttagaacagttt

SEQ ID NO: 916466 - DNA, 25 bp, Mus musculus
ctctaaacaggttttagaacagttt

SEQ ID NO: 916467 - DNA, 25 bp, Mus musculus
ctctaaagaccgcaaagcactgcca

SEQ ID NO: 916468 - DNA, 25 bp, Mus musculus
ctctaaagaccggaaagcactgcca

SEQ ID NO: 916469 - DNA, 25 bp, Mus musculus
ctctaacctgcaacccagcctatga

SEQ ID NO: 916470 - DNA, 25 bp, Mus musculus
ctctaacctgcatcccagcctatga

SEQ ID NO: 916471 - DNA, 25 bp, Mus musculus
ctctaagaacagtgttcaccgagac

SEQ ID NO: 916472 - DNA, 25 bp, Mus musculus
ctctaagaactgtgttcaccgagac

SEQ ID NO: 916473 - DNA, 25 bp, Mus musculus
ctctaagaagagtatacaccgagac

SEQ ID NO: 916474 - DNA, 25 bp, Mus musculus
ctctaagaagatcatctatttccag

SEQ ID NO: 916475 - DNA, 25 bp, Mus musculus
ctctaagaagatgatctatttccag

SEQ ID NO: 916476 - DNA, 25 bp, Mus musculus
ctctaagaagtgtatacaccgagac

SEQ ID NO: 916477 - DNA, 25 bp, Mus musculus
ctctaagagctgcaaaatcaactaa

SEQ ID NO: 916478 - DNA, 25 bp, Mus musculus
ctctaagagctggaaaatcaactaa

SEQ ID NO: 916479 - DNA, 25 bp, Mus musculus
ctctaatctgtccctgagcagtggc

SEQ ID NO: 916480 - DNA, 25 bp, Mus musculus
ctctaatctgtcgctgagcagtggc

SEQ ID NO: 916481 - DNA, 25 bp, Mus musculus
ctctaatgtcaacggcctgtccggg

SEQ ID NO: 916482 - DNA, 25 bp, Mus musculus
ctctaatgtcaagggcctgtccggg

SEQ ID NO: 916483 - DNA, 25 bp, Mus musculus
ctctaatgtcagctccggccctgcc

SEQ ID NO: 916484 - DNA, 25 bp, Mus musculus
ctctaatgtcaggtccggccctgcc

SEQ ID NO: 916485 - DNA, 25 bp, Mus musculus
ctctacaaaaagattgaagacctga

SEQ ID NO: 916486 - DNA, 25 bp, Mus musculus
ctctacaaaaagtttgaagacctga

SEQ ID NO: 916487 - DNA, 25 bp, Mus musculus
ctctacacaacgcattttatccttc

SEQ ID NO: 916488 - DNA, 25 bp, Mus musculus
ctctacacaacggattttatccttc

SEQ ID NO: 916489 - DNA, 25 bp, Mus musculus
ctctacacagcaaatccaccttcca

SEQ ID NO: 916490 - DNA, 25 bp, Mus musculus
ctctacacagcctgacaagaaaact

SEQ ID NO: 916491 - DNA, 25 bp, Mus musculus
ctctacacaggaaatccaccttcca

SEQ ID NO: 916492 - DNA, 25 bp, Mus musculus
ctctacacaggctgacaagaaaact

SEQ ID NO: 916493 - DNA, 25 bp, Mus musculus
ctctacaggcaacgtgagctccacc

SEQ ID NO: 916494 - DNA, 25 bp, Mus musculus
ctctacaggcaaggtgagctccacc

SEQ ID NO: 916495 - DNA, 25 bp, Mus musculus
ctctacatgatccacaaaaagagcc

SEQ ID NO: 916496 - DNA, 25 bp, Mus musculus
ctctacatgatccagaaaaagagcc

SEQ ID NO: 916497 - DNA, 25 bp, Mus musculus
ctctacattgcacattcatcgtgag

SEQ ID NO: 916498 - DNA, 25 bp, Mus musculus
ctctacattgcagattcatcgtgag

SEQ ID NO: 916499 - DNA, 25 bp, Mus musculus
ctctaccagcagccttccccaccag

SEQ ID NO: 916500 - DNA, 25 bp, Mus musculus
ctctaccagcaggcttccccaccag

SEQ ID NO: 916501 - DNA, 25 bp, Mus musculus
ctctaccaggagagcaggccttggg

SEQ ID NO: 916502 - DNA, 25 bp, Mus musculus
ctctaccaggagtgcaggccttggg

SEQ ID NO: 916503 - DNA, 25 bp, Mus musculus
ctctacccagatgaggtggcatgtg

SEQ ID NO: 916504 - DNA, 25 bp, Mus musculus
ctctacccagttgaggtggcatgtg

SEQ ID NO: 916505 - DNA, 25 bp, Mus musculus
ctctaccctcaaccagcaagcctgc

SEQ ID NO: 916506 - DNA, 25 bp, Mus musculus
ctctaccctcaagcagcaagcctgc

SEQ ID NO: 916507 - DNA, 25 bp, Mus musculus
ctctacctcgcgtactgagaggcca

SEQ ID NO: 916508 - DNA, 25 bp, Mus musculus
ctctacctcgcgtagtgagaggcca

SEQ ID NO: 916509 - DNA, 25 bp, Mus musculus
ctctacctgcagccagcctgatctc

SEQ ID NO: 916510 - DNA, 25 bp, Mus musculus
ctctacctgcaggcagcctgatctc

SEQ ID NO: 916511 - DNA, 25 bp, Mus musculus
ctctacgccgagcgctgtgaggctc

SEQ ID NO: 916512 - DNA, 25 bp, Mus musculus
ctctacgccgagggctgtgaggctc

SEQ ID NO: 916513 - DNA, 25 bp, Mus musculus
ctctactactgaataccccaagtac

SEQ ID NO: 916514 - DNA, 25 bp, Mus musculus
ctctactactgattaccccaagtac

SEQ ID NO: 916515 - DNA, 25 bp, Mus musculus
ctctactcctttcctgctgctgttg

SEQ ID NO: 916516 - DNA, 25 bp, Mus musculus
ctctactcctttgctgctgctgttg

SEQ ID NO: 916517 - DNA, 25 bp, Mus musculus
ctctactgcaaactttgctatgcca

SEQ ID NO: 916518 - DNA, 25 bp, Mus musculus
ctctactgcaaagtttgctatgcca

SEQ ID NO: 916519 - DNA, 25 bp, Mus musculus
ctctactgtccccgtgtgccagcct

SEQ ID NO: 916520 - DNA, 25 bp, Mus musculus
ctctactgtcccggtgtgccagcct

SEQ ID NO: 916521 - DNA, 25 bp, Mus musculus
ctctactgtgaacgtgtggtccggt

SEQ ID NO: 916522 - DNA, 25 bp, Mus musculus
ctctactgtgaaggtgtggtccggt

SEQ ID NO: 916523 - DNA, 25 bp, Mus musculus
ctctactgtgcagtctgtgcaagat

SEQ ID NO: 916524 - DNA, 25 bp, Mus musculus
ctctactgtgcagtgtgtgcaagat

SEQ ID NO: 916525 - DNA, 25 bp, Mus musculus
ctctagaactcaactcattatacaa

SEQ ID NO: 916526 - DNA, 25 bp, Mus musculus
ctctagaactgaactcattatacaa

SEQ ID NO: 916527 - DNA, 25 bp, Mus musculus
ctctagcctaagatctgagaagtca

SEQ ID NO: 916528 - DNA, 25 bp, Mus musculus
ctctagcctaagttctgagaagtca

SEQ ID NO: 916529 - DNA, 25 bp, Mus musculus
ctctagctgaagagagcaaaccaac

SEQ ID NO: 916530 - DNA, 25 bp, Mus musculus
ctctagctgaagtgagcaaaccaac

SEQ ID NO: 916531 - DNA, 25 bp, Mus musculus
ctctaggtcagcgacgtattgaagc

SEQ ID NO: 916532 - DNA, 25 bp, Mus musculus
ctctaggtcagcgaggtattgaagc

SEQ ID NO: 916533 - DNA, 25 bp, Mus musculus
ctctataaagcattgaggccaagct

SEQ ID NO: 916534 - DNA, 25 bp, Mus musculus
ctctataaaggattgaggccaagct

SEQ ID NO: 916535 - DNA, 25 bp, Mus musculus
ctctataatgcttaactttgtgctt

SEQ ID NO: 916536 - DNA, 25 bp, Mus musculus
ctctataatggttaactttgtgctt

SEQ ID NO: 916537 - DNA, 25 bp, Mus musculus
ctctatatcacgcgtgggactttaa

SEQ ID NO: 916538 - DNA, 25 bp, Mus musculus
ctctatatcacgggtgggactttaa

SEQ ID NO: 916539 - DNA, 25 bp, Mus musculus
ctctatcctgaagtcattttcctcg

SEQ ID NO: 916540 - DNA, 25 bp, Mus musculus
ctctatcctgaagtgattttcctcg

SEQ ID NO: 916541 - DNA, 25 bp, Mus musculus
ctctatcgtgacttgtgggcacagg

SEQ ID NO: 916542 - DNA, 25 bp, Mus musculus
ctctatcgtgtcttgtgggcacagg

SEQ ID NO: 916543 - DNA, 25 bp, Mus musculus
ctctatgaactccacgcaagtcgtt

SEQ ID NO: 916544 - DNA, 25 bp, Mus musculus
ctctatgaactccaggcaagtcgtt

SEQ ID NO: 916545 - DNA, 25 bp, Mus musculus
ctctatgaagactggaccacgccaa

SEQ ID NO: 916546 - DNA, 25 bp, Mus musculus
ctctatgaagtctggaccacgccaa

SEQ ID NO: 916547 - DNA, 25 bp, Mus musculus
ctctatgaggaggaccaggtagagc

SEQ ID NO: 916548 - DNA, 25 bp, Mus musculus
ctctatgaggaggagcaggtagagc

SEQ ID NO: 916549 - DNA, 25 bp, Mus musculus
ctctatgagtagtgcgatgagagtc

SEQ ID NO: 916550 - DNA, 25 bp, Mus musculus
ctctatgagtagtgggatgagagtc

SEQ ID NO: 916551 - DNA, 25 bp, Mus musculus
ctctatgctgtgctttgccactagc

SEQ ID NO: 916552 - DNA, 25 bp, Mus musculus
ctctatgctgtggtttgccactagc

SEQ ID NO: 916553 - DNA, 25 bp, Mus musculus
ctctatggcacacgaccgctctgca

SEQ ID NO: 916554 - DNA, 25 bp, Mus musculus
ctctatggcacaggaccgctctgca

SEQ ID NO: 916555 - DNA, 25 bp, Mus musculus
ctctatgggtcgcgggtctactctg

SEQ ID NO: 916556 - DNA, 25 bp, Mus musculus
ctctatgggtcgcttccgggagcgc

SEQ ID NO: 916557 - DNA, 25 bp, Mus musculus
ctctatgggtcgggggtctactctg

SEQ ID NO: 916558 - DNA, 25 bp, Mus musculus
ctctatgggtcggttccgggagcgc

SEQ ID NO: 916559 - DNA, 25 bp, Mus musculus
ctctatgtcacacatgtggttccag

SEQ ID NO: 916560 - DNA, 25 bp, Mus musculus
ctctatgtcacagatgtggttccag

SEQ ID NO: 916561 - DNA, 25 bp, Mus musculus
ctctcaaatccacggacaaatttag

SEQ ID NO: 916562 - DNA, 25 bp, Mus musculus
ctctcaaatccagggacaaatttag

SEQ ID NO: 916563 - DNA, 25 bp, Mus musculus
ctctcaacaaacctcgttggcatgg

SEQ ID NO: 916564 - DNA, 25 bp, Mus musculus
ctctcaacaaacctggttggcatgg

SEQ ID NO: 916565 - DNA, 25 bp, Mus musculus
ctctcaacagatcacagtcagtcta

SEQ ID NO: 916566 - DNA, 25 bp, Mus musculus
ctctcaacagttcacagtcagtcta

SEQ ID NO: 916567 - DNA, 25 bp, Mus musculus
ctctcaacatggagaggcaccactt

SEQ ID NO: 916568 - DNA, 25 bp, Mus musculus
ctctcaacatggtgaggcaccactt

SEQ ID NO: 916569 - DNA, 25 bp, Mus musculus
ctctcaacattacgtcccatttgga

SEQ ID NO: 916570 - DNA, 25 bp, Mus musculus
ctctcaacattaggtcccatttgga

SEQ ID NO: 916571 - DNA, 25 bp, Mus musculus
ctctcaagaaagatgcgccaggagg

SEQ ID NO: 916572 - DNA, 25 bp, Mus musculus
ctctcaagaaagcacagatcgttac

SEQ ID NO: 916573 - DNA, 25 bp, Mus musculus
ctctcaagaaaggacagatcgttac

SEQ ID NO: 916574 - DNA, 25 bp, Mus musculus
ctctcaagaaagttgcgccaggagg

SEQ ID NO: 916575 - DNA, 25 bp, Mus musculus
ctctcaagcctgcgcggacttgact

SEQ ID NO: 916576 - DNA, 25 bp, Mus musculus
ctctcaagcctgcggggacttgact

SEQ ID NO: 916577 - DNA, 25 bp, Mus musculus
ctctcaatttcactcaagagtttcc

SEQ ID NO: 916578 - DNA, 25 bp, Mus musculus
ctctcaatttcagtcaagagtttcc

SEQ ID NO: 916579 - DNA, 25 bp, Mus musculus
ctctcacagaagatacccagctatt

SEQ ID NO: 916580 - DNA, 25 bp, Mus musculus
ctctcacagaagttacccagctatt

SEQ ID NO: 916581 - DNA, 25 bp, Mus musculus
ctctcacatggacaaactgctgtca

SEQ ID NO: 916582 - DNA, 25 bp, Mus musculus
ctctcacatggagaaactgctgtca

SEQ ID NO: 916583 - DNA, 25 bp, Mus musculus
ctctcacgagcgtgagacttcctac

SEQ ID NO: 916584 - DNA, 25 bp, Mus musculus
ctctcacgagggtgagacttcctac

SEQ ID NO: 916585 - DNA, 25 bp, Mus musculus
ctctcactggccaacaccgggagcc

SEQ ID NO: 916586 - DNA, 25 bp, Mus musculus
ctctcactggccaagaccgggagcc

SEQ ID NO: 916587 - DNA, 25 bp, Mus musculus
ctctcagaacagcctccaggtagcc

SEQ ID NO: 916588 - DNA, 25 bp, Mus musculus
ctctcagaacaggctccaggtagcc

SEQ ID NO: 916589 - DNA, 25 bp, Mus musculus
ctctcagaagacaaaagagagcatt

SEQ ID NO: 916590 - DNA, 25 bp, Mus musculus
ctctcagaagcatcactatttcatg

SEQ ID NO: 916591 - DNA, 25 bp, Mus musculus
ctctcagaaggatcactatttcatg

SEQ ID NO: 916592 - DNA, 25 bp, Mus musculus
ctctcagaagtcaaaagagagcatt

SEQ ID NO: 916593 - DNA, 25 bp, Mus musculus
ctctcagaggctgacaaaataatgt

SEQ ID NO: 916594 - DNA, 25 bp, Mus musculus
ctctcagaggctgacgacaaatgag

SEQ ID NO: 916595 - DNA, 25 bp, Mus musculus
ctctcagaggctgagaaaataatgt

SEQ ID NO: 916596 - DNA, 25 bp, Mus musculus
ctctcagaggctgaggacaaatgag

SEQ ID NO: 916597 - DNA, 25 bp, Mus musculus
ctctcagcagatcatcctctaggca

SEQ ID NO: 916598 - DNA, 25 bp, Mus musculus
ctctcagcagatgatcctctaggca

SEQ ID NO: 916599 - DNA, 25 bp, Mus musculus
ctctcagcagattccaaaggctggc

SEQ ID NO: 916600 - DNA, 25 bp, Mus musculus
ctctcagcagcccgctttgttgaag

SEQ ID NO: 916601 - DNA, 25 bp, Mus musculus
ctctcagcagcccttgagcctccct

SEQ ID NO: 916602 - DNA, 25 bp, Mus musculus
ctctcagcagctcagtcagctgtgg

SEQ ID NO: 916603 - DNA, 25 bp, Mus musculus
ctctcagcagctgagtcagctgtgg

SEQ ID NO: 916604 - DNA, 25 bp, Mus musculus
ctctcagcaggccgctttgttgaag

SEQ ID NO: 916605 - DNA, 25 bp, Mus musculus
ctctcagcaggccttgagcctccct

SEQ ID NO: 916606 - DNA, 25 bp, Mus musculus
ctctcagcagtttccaaaggctggc

SEQ ID NO: 916607 - DNA, 25 bp, Mus musculus
ctctcagctcaacggcaaatgactc

SEQ ID NO: 916608 - DNA, 25 bp, Mus musculus
ctctcagctcaagggcaaatgactc

SEQ ID NO: 916609 - DNA, 25 bp, Mus musculus
ctctcagctcagcggaacctgcctc

SEQ ID NO: 916610 - DNA, 25 bp, Mus musculus
ctctcagctcagcggtcacacagca

SEQ ID NO: 916611 - DNA, 25 bp, Mus musculus
ctctcagctcaggggaacctgcctc

SEQ ID NO: 916612 - DNA, 25 bp, Mus musculus
ctctcagctcaggggtcacacagca

SEQ ID NO: 916613 - DNA, 25 bp, Mus musculus
ctctcaggaccacgtagattccata

SEQ ID NO: 916614 - DNA, 25 bp, Mus musculus
ctctcaggaccaggtagattccata

SEQ ID NO: 916615 - DNA, 25 bp, Mus musculus
ctctcaggctgtgacatatctgttt

SEQ ID NO: 916616 - DNA, 25 bp, Mus musculus
ctctcaggctgtgagatatctgttt

SEQ ID NO: 916617 - DNA, 25 bp, Mus musculus
ctctcaggttttcgctaccggctct

SEQ ID NO: 916618 - DNA, 25 bp, Mus musculus
ctctcaggttttggctaccggctct

SEQ ID NO: 916619 - DNA, 25 bp, Mus musculus
ctctcagtgctgcgttttcagagca

SEQ ID NO: 916620 - DNA, 25 bp, Mus musculus
ctctcagtgctgggttttcagagca

SEQ ID NO: 916621 - DNA, 25 bp, Mus musculus
ctctcagtgtcactttctcagcagg

SEQ ID NO: 916622 - DNA, 25 bp, Mus musculus
ctctcagtgtcagtttctcagcagg

SEQ ID NO: 916623 - DNA, 25 bp, Mus musculus
ctctcataaacacatcatggaaaat

SEQ ID NO: 916624 - DNA, 25 bp, Mus musculus
ctctcataaacagatcatggaaaat

SEQ ID NO: 916625 - DNA, 25 bp, Mus musculus
ctctcatcacaccacgctcagctca

SEQ ID NO: 916626 - DNA, 25 bp, Mus musculus
ctctcatcacaccaggctcagctca

SEQ ID NO: 916627 - DNA, 25 bp, Mus musculus
ctctcatccacgcacgttctggcca

SEQ ID NO: 916628 - DNA, 25 bp, Mus musculus
ctctcatccacgcaggttctggcca

SEQ ID NO: 916629 - DNA, 25 bp, Mus musculus
ctctcatctccgacttcttcgccaa

SEQ ID NO: 916630 - DNA, 25 bp, Mus musculus
ctctcatctccgtcttcttcgccaa

SEQ ID NO: 916631 - DNA, 25 bp, Mus musculus
ctctcatgcagcaacgttctgagct

SEQ ID NO: 916632 - DNA, 25 bp, Mus musculus
ctctcatgcagcaaggttctgagct

SEQ ID NO: 916633 - DNA, 25 bp, Mus musculus
ctctcatgctagatcagcaatcagc

SEQ ID NO: 916634 - DNA, 25 bp, Mus musculus
ctctcatgctagttcagcaatcagc

SEQ ID NO: 916635 - DNA, 25 bp, Mus musculus
ctctccaaccaacgcatcctcggag

SEQ ID NO: 916636 - DNA, 25 bp, Mus musculus
ctctccaaccaacgtatcatgtttg

SEQ ID NO: 916637 - DNA, 25 bp, Mus musculus
ctctccaaccaaggcatcctcggag

SEQ ID NO: 916638 - DNA, 25 bp, Mus musculus
ctctccaaccaaggtatcatgtttg

SEQ ID NO: 916639 - DNA, 25 bp, Mus musculus
ctctccaaccagatacagttagtgc

SEQ ID NO: 916640 - DNA, 25 bp, Mus musculus
ctctccaaccagccaatagttacag

SEQ ID NO: 916641 - DNA, 25 bp, Mus musculus
ctctccaaccaggcaatagttacag

SEQ ID NO: 916642 - DNA, 25 bp, Mus musculus
ctctccaaccagttacagttagtgc

SEQ ID NO: 916643 - DNA, 25 bp, Mus musculus
ctctccaagtatctaggaggagtaa

SEQ ID NO: 916644 - DNA, 25 bp, Mus musculus
ctctccaagtatgtaggaggagtaa

SEQ ID NO: 916645 - DNA, 25 bp, Mus musculus
ctctccactccagaaagtggagtgg

SEQ ID NO: 916646 - DNA, 25 bp, Mus musculus
ctctccactccagatagtggagtgg

SEQ ID NO: 916647 - DNA, 25 bp, Mus musculus
ctctccacttggcgggatcggatgt

SEQ ID NO: 916648 - DNA, 25 bp, Mus musculus
ctctccacttggggggatcggatgt

SEQ ID NO: 916649 - DNA, 25 bp, Mus musculus
ctctccagagcttggggcgatcagc

SEQ ID NO: 916650 - DNA, 25 bp, Mus musculus
ctctccagaggttggggcgatcagc

SEQ ID NO: 916651 - DNA, 25 bp, Mus musculus
ctctccagcagaactaaagaacgct

SEQ ID NO: 916652 - DNA, 25 bp, Mus musculus
ctctccagcagatctaaagaacgct

SEQ ID NO: 916653 - DNA, 25 bp, Mus musculus
ctctccagccagcatgtgatggtgg

SEQ ID NO: 916654 - DNA, 25 bp, Mus musculus
ctctccagccaggatgtgatggtgg

SEQ ID NO: 916655 - DNA, 25 bp, Mus musculus
ctctccagctatgacaagcaacagg

SEQ ID NO: 916656 - DNA, 25 bp, Mus musculus
ctctccagctatgaccctggagtac

SEQ ID NO: 916657 - DNA, 25 bp, Mus musculus
ctctccagctatgagaagcaacagg

SEQ ID NO: 916658 - DNA, 25 bp, Mus musculus
ctctccagctatgagcctggagtac

SEQ ID NO: 916659 - DNA, 25 bp, Mus musculus
ctctccaggacgccacaaaaggacc

SEQ ID NO: 916660 - DNA, 25 bp, Mus musculus
ctctccaggacggcacaaaaggacc

SEQ ID NO: 916661 - DNA, 25 bp, Mus musculus
ctctccaggctcaacttctgttcat

SEQ ID NO: 916662 - DNA, 25 bp, Mus musculus
ctctccaggctcagggaccctgaaa

SEQ ID NO: 916663 - DNA, 25 bp, Mus musculus
ctctccaggctctacttctgttcat

SEQ ID NO: 916664 - DNA, 25 bp, Mus musculus
ctctccaggctctgggaccctgaaa

SEQ ID NO: 916665 - DNA, 25 bp, Mus musculus
ctctccagggagaacgaacttacaa

SEQ ID NO: 916666 - DNA, 25 bp, Mus musculus
ctctccagggagaaggaacttacaa

SEQ ID NO: 916667 - DNA, 25 bp, Mus musculus
ctctccatcctgaactccctgctat

SEQ ID NO: 916668 - DNA, 25 bp, Mus musculus
ctctccatcctgaagtccctgctat

SEQ ID NO: 916669 - DNA, 25 bp, Mus musculus
ctctcccaaagacagtccctccagt

SEQ ID NO: 916670 - DNA, 25 bp, Mus musculus
ctctcccaaagagagtccctccagt

SEQ ID NO: 916671 - DNA, 25 bp, Mus musculus
ctctcccaccatcaaacaaaaggag

SEQ ID NO: 916672 - DNA, 25 bp, Mus musculus
ctctcccaccatcccaaatttattc

SEQ ID NO: 916673 - DNA, 25 bp, Mus musculus
ctctcccaccatgaaacaaaaggag

SEQ ID NO: 916674 - DNA, 25 bp, Mus musculus
ctctcccaccatgccaaatttattc

SEQ ID NO: 916675 - DNA, 25 bp, Mus musculus
ctctcccagcttcgcaggacccaac

SEQ ID NO: 916676 - DNA, 25 bp, Mus musculus
ctctcccagcttcggaggacccaac

SEQ ID NO: 916677 - DNA, 25 bp, Mus musculus
ctctcccattggcgtgtacacatct

SEQ ID NO: 916678 - DNA, 25 bp, Mus musculus
ctctcccattggggtgtacacatct

SEQ ID NO: 916679 - DNA, 25 bp, Mus musculus
ctctccctgggctgaggtggtgaga

SEQ ID NO: 916680 - DNA, 25 bp, Mus musculus
ctctccctgggctgtggtggtgaga

SEQ ID NO: 916681 - DNA, 25 bp, Mus musculus
ctctccgaatctaaatcacccagcg

SEQ ID NO: 916682 - DNA, 25 bp, Mus musculus
ctctccgaatgtaaatcacccagcg

SEQ ID NO: 916683 - DNA, 25 bp, Mus musculus
ctctccgcagcacgatgagccggca

SEQ ID NO: 916684 - DNA, 25 bp, Mus musculus
ctctccgcagcactttacaatctgt

SEQ ID NO: 916685 - DNA, 25 bp, Mus musculus
ctctccgcagcaggatgagccggca

SEQ ID NO: 916686 - DNA, 25 bp, Mus musculus
ctctccgcagcagtttacaatctgt

SEQ ID NO: 916687 - DNA, 25 bp, Mus musculus
ctctccgggattgtcctttgagcgc

SEQ ID NO: 916688 - DNA, 25 bp, Mus musculus
ctctccgggattgtgctttgagcgc

SEQ ID NO: 916689 - DNA, 25 bp, Mus musculus
ctctccgtacagatcttcgtccctc

SEQ ID NO: 916690 - DNA, 25 bp, Mus musculus
ctctccgtacagcgccatggctact

SEQ ID NO: 916691 - DNA, 25 bp, Mus musculus
ctctccgtacagggccatggctact

SEQ ID NO: 916692 - DNA, 25 bp, Mus musculus
ctctccgtacagttcttcgtccctc

SEQ ID NO: 916693 - DNA, 25 bp, Mus musculus
ctctccgtgactcactcatctgaag

SEQ ID NO: 916694 - DNA, 25 bp, Mus musculus
ctctccgtgactgactcatctgaag

SEQ ID NO: 916695 - DNA, 25 bp, Mus musculus
ctctccgtggaacctgacgaccacc

SEQ ID NO: 916696 - DNA, 25 bp, Mus musculus
ctctccgtggtacctgacgaccacc

SEQ ID NO: 916697 - DNA, 25 bp, Mus musculus
ctctcctaaagacgtcagcttggac

SEQ ID NO: 916698 - DNA, 25 bp, Mus musculus
ctctcctaaagaggtcagcttggac

SEQ ID NO: 916699 - DNA, 25 bp, Mus musculus
ctctcctaactgctcagtaccatga

SEQ ID NO: 916700 - DNA, 25 bp, Mus musculus
ctctcctaactggtcagtaccatga

SEQ ID NO: 916701 - DNA, 25 bp, Mus musculus
ctctcctacactcggctcctccacc

SEQ ID NO: 916702 - DNA, 25 bp, Mus musculus
ctctcctacactgggctcctccacc

SEQ ID NO: 916703 - DNA, 25 bp, Mus musculus
ctctcctactacacctccaaggaca

SEQ ID NO: 916704 - DNA, 25 bp, Mus musculus
ctctcctactacacgtccaaggaca

SEQ ID NO: 916705 - DNA, 25 bp, Mus musculus
ctctcctcacagagctcagcgacag

SEQ ID NO: 916706 - DNA, 25 bp, Mus musculus
ctctcctcacagtgctcagcgacag

SEQ ID NO: 916707 - DNA, 25 bp, Mus musculus
ctctcctgatgacatggctgctcag

SEQ ID NO: 916708 - DNA, 25 bp, Mus musculus
ctctcctgatgagatggctgctcag

SEQ ID NO: 916709 - DNA, 25 bp, Mus musculus
ctctcctggcttcactaagttccgg

SEQ ID NO: 916710 - DNA, 25 bp, Mus musculus
ctctcctggcttcagtaagttccgg

SEQ ID NO: 916711 - DNA, 25 bp, Mus musculus
ctctcctgttagccgtctcttttct

SEQ ID NO: 916712 - DNA, 25 bp, Mus musculus
ctctcctgttaggcgtctcttttct

SEQ ID NO: 916713 - DNA, 25 bp, Mus musculus
ctctccttagtgccgtgagtcacgc

SEQ ID NO: 916714 - DNA, 25 bp, Mus musculus
ctctccttagtggcgtgagtcacgc

SEQ ID NO: 916715 - DNA, 25 bp, Mus musculus
ctctccttcccactttctgaacttc

SEQ ID NO: 916716 - DNA, 25 bp, Mus musculus
ctctccttcccagtttctgaacttc

SEQ ID NO: 916717 - DNA, 25 bp, Mus musculus
ctctcctttcaacaattacaggccc

SEQ ID NO: 916718 - DNA, 25 bp, Mus musculus
ctctcctttcaagaattacaggccc

SEQ ID NO: 916719 - DNA, 25 bp, Mus musculus
ctctcgaaggcaaacagcatgcaag

SEQ ID NO: 916720 - DNA, 25 bp, Mus musculus
ctctcgaagggaaacagcatgcaag

SEQ ID NO: 916721 - DNA, 25 bp, Mus musculus
ctctcgacagcaagtcatctcctac

SEQ ID NO: 916722 - DNA, 25 bp, Mus musculus
ctctcgacaggaagtcatctcctac

SEQ ID NO: 916723 - DNA, 25 bp, Mus musculus
ctctcgacataccatcccttcagag

SEQ ID NO: 916724 - DNA, 25 bp, Mus musculus
ctctcgacattccatcccttcagag

SEQ ID NO: 916725 - DNA, 25 bp, Mus musculus
ctctcgccaaacctgatgagaattt

SEQ ID NO: 916726 - DNA, 25 bp, Mus musculus
ctctcgccaaacgtgatgagaattt

SEQ ID NO: 916727 - DNA, 25 bp, Mus musculus
ctctcgccaacaccaatataactgc

SEQ ID NO: 916728 - DNA, 25 bp, Mus musculus
ctctcgccaacagcaatataactgc

SEQ ID NO: 916729 - DNA, 25 bp, Mus musculus
ctctcggccaaccacggtttctctg

SEQ ID NO: 916730 - DNA, 25 bp, Mus musculus
ctctcggccaaccagggtttctctg

SEQ ID NO: 916731 - DNA, 25 bp, Mus musculus
ctctcgggagagcttctaaatggca

SEQ ID NO: 916732 - DNA, 25 bp, Mus musculus
ctctcgggagaggttctaaatggca

SEQ ID NO: 916733 - DNA, 25 bp, Mus musculus
ctctcgtcagatgtcgtcaccgtca

SEQ ID NO: 916734 - DNA, 25 bp, Mus musculus
ctctcgtcagcactgcaagaggctt

SEQ ID NO: 916735 - DNA, 25 bp, Mus musculus
ctctcgtcaggactgcaagaggctt

SEQ ID NO: 916736 - DNA, 25 bp, Mus musculus
ctctcgtcagttgtcgtcaccgtca

SEQ ID NO: 916737 - DNA, 25 bp, Mus musculus
ctctcgtggaagctgaagccgtcca

SEQ ID NO: 916738 - DNA, 25 bp, Mus musculus
ctctcgtggaaggtgaagccgtcca

SEQ ID NO: 916739 - DNA, 25 bp, Mus musculus
ctctctaagaagatcatctatttcc

SEQ ID NO: 916740 - DNA, 25 bp, Mus musculus
ctctctaagaagatgatctatttcc

SEQ ID NO: 916741 - DNA, 25 bp, Mus musculus
ctctctagaactcaactcattatac

SEQ ID NO: 916742 - DNA, 25 bp, Mus musculus
ctctctagaactgaactcattatac

SEQ ID NO: 916743 - DNA, 25 bp, Mus musculus
ctctctatttcacgctgcccccgac

SEQ ID NO: 916744 - DNA, 25 bp, Mus musculus
ctctctatttcgagagaaatacatc

SEQ ID NO: 916745 - DNA, 25 bp, Mus musculus
ctctctatttgacgctgcccccgac

SEQ ID NO: 916746 - DNA, 25 bp, Mus musculus
ctctctatttggagagaaatacatc

SEQ ID NO: 916747 - DNA, 25 bp, Mus musculus
ctctctcagcagcccgctttgttga

SEQ ID NO: 916748 - DNA, 25 bp, Mus musculus
ctctctcagcaggccgctttgttga

SEQ ID NO: 916749 - DNA, 25 bp, Mus musculus
ctctctcatgcgctcaataaactca

SEQ ID NO: 916750 - DNA, 25 bp, Mus musculus
ctctctcatgggctcaataaactca

SEQ ID NO: 916751 - DNA, 25 bp, Mus musculus
ctctctccagacagacaatacatca

SEQ ID NO: 916752 - DNA, 25 bp, Mus musculus
ctctctccagataatctggaggctg

SEQ ID NO: 916753 - DNA, 25 bp, Mus musculus
ctctctccagtcagacaatacatca

SEQ ID NO: 916754 - DNA, 25 bp, Mus musculus
ctctctccagttaatctggaggctg

SEQ ID NO: 916755 - DNA, 25 bp, Mus musculus
ctctctcctaaagacgtcagcttgg

SEQ ID NO: 916756 - DNA, 25 bp, Mus musculus
ctctctcctaaagaggtcagcttgg

SEQ ID NO: 916757 - DNA, 25 bp, Mus musculus
ctctctctccagataatctggaggc

SEQ ID NO: 916758 - DNA, 25 bp, Mus musculus
ctctctctccagttaatctggaggc

SEQ ID NO: 916759 - DNA, 25 bp, Mus musculus
ctctctctggctcagtgactgggtg

SEQ ID NO: 916760 - DNA, 25 bp, Mus musculus
ctctctctggctgagtgactgggtg

SEQ ID NO: 916761 - DNA, 25 bp, Mus musculus
ctctctctgtaaactgaaggataca

SEQ ID NO: 916762 - DNA, 25 bp, Mus musculus
ctctctctgtaatctgaaggataca

SEQ ID NO: 916763 - DNA, 25 bp, Mus musculus
ctctctcttacacatcaagatctta

SEQ ID NO: 916764 - DNA, 25 bp, Mus musculus
ctctctcttacacgcactacagact

SEQ ID NO: 916765 - DNA, 25 bp, Mus musculus
ctctctcttacagatcaagatctta

SEQ ID NO: 916766 - DNA, 25 bp, Mus musculus
ctctctcttacaggcactacagact

SEQ ID NO: 916767 - DNA, 25 bp, Mus musculus
ctctctgattacaacatccagaaag

SEQ ID NO: 916768 - DNA, 25 bp, Mus musculus
ctctctgattacaagatccagaaag

SEQ ID NO: 916769 - DNA, 25 bp, Mus musculus
ctctctgcaagacgtttgcggtgag

SEQ ID NO: 916770 - DNA, 25 bp, Mus musculus
ctctctgcaagaggtttgcggtgag

SEQ ID NO: 916771 - DNA, 25 bp, Mus musculus
ctctctgcccatgtcatcatgattc

SEQ ID NO: 916772 - DNA, 25 bp, Mus musculus
ctctctgcccatgtgatcatgattc

SEQ ID NO: 916773 - DNA, 25 bp, Mus musculus
ctctctgcctaacgggcagactcct

SEQ ID NO: 916774 - DNA, 25 bp, Mus musculus
ctctctgcctaaggggcagactcct

SEQ ID NO: 916775 - DNA, 25 bp, Mus musculus
ctctctgctacacaccctcttgcca

SEQ ID NO: 916776 - DNA, 25 bp, Mus musculus
ctctctgctacacagcctcttgcca

SEQ ID NO: 916777 - DNA, 25 bp, Mus musculus
ctctctgctgacctatgaggagatc

SEQ ID NO: 916778 - DNA, 25 bp, Mus musculus
ctctctgctgagtctgaagatgcaa

SEQ ID NO: 916779 - DNA, 25 bp, Mus musculus
ctctctgctgcgctcatgtaggaaa

SEQ ID NO: 916780 - DNA, 25 bp, Mus musculus
ctctctgctgcggtcatgtaggaaa

SEQ ID NO: 916781 - DNA, 25 bp, Mus musculus
ctctctgctgtccactggggacctc

SEQ ID NO: 916782 - DNA, 25 bp, Mus musculus
ctctctgctgtccagtggggacctc

SEQ ID NO: 916783 - DNA, 25 bp, Mus musculus
ctctctgctgtcctatgaggagatc

SEQ ID NO: 916784 - DNA, 25 bp, Mus musculus
ctctctgctgtgtctgaagatgcaa

SEQ ID NO: 916785 - DNA, 25 bp, Mus musculus
ctctctgcttgacgaagaagctcac

SEQ ID NO: 916786 - DNA, 25 bp, Mus musculus
ctctctgcttgaggaagaagctcac

SEQ ID NO: 916787 - DNA, 25 bp, Mus musculus
ctctctggaaaccacgaagtgagtg

SEQ ID NO: 916788 - DNA, 25 bp, Mus musculus
ctctctggaaaccacgagaacagta

SEQ ID NO: 916789 - DNA, 25 bp, Mus musculus
ctctctggaaaccaggaagtgagtg

SEQ ID NO: 916790 - DNA, 25 bp, Mus musculus
ctctctggaaaccaggagaacagta

SEQ ID NO: 916791 - DNA, 25 bp, Mus musculus
ctctctggatccaacattcattact

SEQ ID NO: 916792 - DNA, 25 bp, Mus musculus
ctctctggatcctacattcattact

SEQ ID NO: 916793 - DNA, 25 bp, Mus musculus
ctctctggcctgctttgctactggc

SEQ ID NO: 916794 - DNA, 25 bp, Mus musculus
ctctctggcctggtttgctactggc

SEQ ID NO: 916795 - DNA, 25 bp, Mus musculus
ctctctggctcagtgactgggtgac

SEQ ID NO: 916796 - DNA, 25 bp, Mus musculus
ctctctggctcccgcgtcatccact

SEQ ID NO: 916797 - DNA, 25 bp, Mus musculus
ctctctggctcccgggtcatccact

SEQ ID NO: 916798 - DNA, 25 bp, Mus musculus
ctctctggctgagtgactgggtgac

SEQ ID NO: 916799 - DNA, 25 bp, Mus musculus
ctctctgtagaccacggctaattag

SEQ ID NO: 916800 - DNA, 25 bp, Mus musculus
ctctctgtagaccagggctaattag

SEQ ID NO: 916801 - DNA, 25 bp, Mus musculus
ctctctgtgcgccgcaatacagagt

SEQ ID NO: 916802 - DNA, 25 bp, Mus musculus
ctctctgtgcgcggcaatacagagt

SEQ ID NO: 916803 - DNA, 25 bp, Mus musculus
ctctctgtggtcaaccccctggact

SEQ ID NO: 916804 - DNA, 25 bp, Mus musculus
ctctctgtggtcaagcccctggact

SEQ ID NO: 916805 - DNA, 25 bp, Mus musculus
ctctcttgccttcgggaaatggcca

SEQ ID NO: 916806 - DNA, 25 bp, Mus musculus
ctctcttgccttggggaaatggcca

SEQ ID NO: 916807 - DNA, 25 bp, Mus musculus
ctctctttcaagcctggagacgtaa

SEQ ID NO: 916808 - DNA, 25 bp, Mus musculus
ctctctttcaaggctggagacgtaa

SEQ ID NO: 916809 - DNA, 25 bp, Mus musculus
ctctgaaactccctgaagaatgtca

SEQ ID NO: 916810 - DNA, 25 bp, Mus musculus
ctctgaaactctgccgatccccttg

SEQ ID NO: 916811 - DNA, 25 bp, Mus musculus
ctctgaaactgcctgaagaatgtca

SEQ ID NO: 916812 - DNA, 25 bp, Mus musculus
ctctgaaactgtgccgatccccttg

SEQ ID NO: 916813 - DNA, 25 bp, Mus musculus
ctctgaaagaatcaagtagcagctg

SEQ ID NO: 916814 - DNA, 25 bp, Mus musculus
ctctgaaagaatcatgtagcagctg

SEQ ID NO: 916815 - DNA, 25 bp, Mus musculus
ctctgaaagataataccaggagact

SEQ ID NO: 916816 - DNA, 25 bp, Mus musculus
ctctgaaagatattaccaggagact

SEQ ID NO: 916817 - DNA, 25 bp, Mus musculus
ctctgaaattgtacaactgtatgga

SEQ ID NO: 916818 - DNA, 25 bp, Mus musculus
ctctgaaattgttcaactgtatgga

SEQ ID NO: 916819 - DNA, 25 bp, Mus musculus
ctctgaaccgccagatcaaggcgga

SEQ ID NO: 916820 - DNA, 25 bp, Mus musculus
ctctgaaccgccagttcaaggcgga

SEQ ID NO: 916821 - DNA, 25 bp, Mus musculus
ctctgaacctctatgaagtcttaca

SEQ ID NO: 916822 - DNA, 25 bp, Mus musculus
ctctgaacctcttccagctacggtc

SEQ ID NO: 916823 - DNA, 25 bp, Mus musculus
ctctgaacctgtatgaagtcttaca

SEQ ID NO: 916824 - DNA, 25 bp, Mus musculus
ctctgaacctgttccagctacggtc

SEQ ID NO: 916825 - DNA, 25 bp, Mus musculus
ctctgaacttaacatctctgaaagt

SEQ ID NO: 916826 - DNA, 25 bp, Mus musculus
ctctgaactttacatctctgaaagt

SEQ ID NO: 916827 - DNA, 25 bp, Mus musculus
ctctgaagagaaccttgacctccgc

SEQ ID NO: 916828 - DNA, 25 bp, Mus musculus
ctctgaagagtaccttgacctccgc

SEQ ID NO: 916829 - DNA, 25 bp, Mus musculus
ctctgacaaaaacgatgcaccccca

SEQ ID NO: 916830 - DNA, 25 bp, Mus musculus
ctctgacaaaaaggatgcaccccca

SEQ ID NO: 916831 - DNA, 25 bp, Mus musculus
ctctgacaagaacaggacatattcc

SEQ ID NO: 916832 - DNA, 25 bp, Mus musculus
ctctgacaagtacaggacatattcc

SEQ ID NO: 916833 - DNA, 25 bp, Mus musculus
ctctgacagtgacgttggtggggcc

SEQ ID NO: 916834 - DNA, 25 bp, Mus musculus
ctctgacagtgaggttggtggggcc

SEQ ID NO: 916835 - DNA, 25 bp, Mus musculus
ctctgacccactcttggaactgaag

SEQ ID NO: 916836 - DNA, 25 bp, Mus musculus
ctctgacccagtcttggaactgaag

SEQ ID NO: 916837 - DNA, 25 bp, Mus musculus
ctctgacctccacaaaggtgctgga

SEQ ID NO: 916838 - DNA, 25 bp, Mus musculus
ctctgacctccagaaaggtgctgga

SEQ ID NO: 916839 - DNA, 25 bp, Mus musculus
ctctgacctccgcctcttcagtctg

SEQ ID NO: 916840 - DNA, 25 bp, Mus musculus
ctctgacctccggctcttcagtctg

SEQ ID NO: 916841 - DNA, 25 bp, Mus musculus
ctctgacgagcacgactcggtgcgg

SEQ ID NO: 916842 - DNA, 25 bp, Mus musculus
ctctgacgagcaggactcggtgcgg

SEQ ID NO: 916843 - DNA, 25 bp, Mus musculus
ctctgacgggccatatctgctgttc

SEQ ID NO: 916844 - DNA, 25 bp, Mus musculus
ctctgacggggcatatctgctgttc

SEQ ID NO: 916845 - DNA, 25 bp, Mus musculus
ctctgacgtgcacgctgtgatgtca

SEQ ID NO: 916846 - DNA, 25 bp, Mus musculus
ctctgacgtgcaggctgtgatgtca

SEQ ID NO: 916847 - DNA, 25 bp, Mus musculus
ctctgactctcactttcatgaagta

SEQ ID NO: 916848 - DNA, 25 bp, Mus musculus
ctctgactctcagtttcatgaagta

SEQ ID NO: 916849 - DNA, 25 bp, Mus musculus
ctctgactctgaccccgttggtatt

SEQ ID NO: 916850 - DNA, 25 bp, Mus musculus
ctctgactctgagcccgttggtatt

SEQ ID NO: 916851 - DNA, 25 bp, Mus musculus
ctctgacttcgacacgtatctcctg

SEQ ID NO: 916852 - DNA, 25 bp, Mus musculus
ctctgacttcgacaggtatctcctg

SEQ ID NO: 916853 - DNA, 25 bp, Mus musculus
ctctgagaacagcaagcccagccct

SEQ ID NO: 916854 - DNA, 25 bp, Mus musculus
ctctgagaacaggaagcccagccct

SEQ ID NO: 916855 - DNA, 25 bp, Mus musculus
ctctgagaagctctattacaatggc

SEQ ID NO: 916856 - DNA, 25 bp, Mus musculus
ctctgagaagcttcgggaactggtc

SEQ ID NO: 916857 - DNA, 25 bp, Mus musculus
ctctgagaaggtctattacaatggc

SEQ ID NO: 916858 - DNA, 25 bp, Mus musculus
ctctgagaaggttcgggaactggtc

SEQ ID NO: 916859 - DNA, 25 bp, Mus musculus
ctctgagaggcccctgcccggatgg

SEQ ID NO: 916860 - DNA, 25 bp, Mus musculus
ctctgagagggccctgcccggatgg

SEQ ID NO: 916861 - DNA, 25 bp, Mus musculus
ctctgagcagatctgaagatgaact

SEQ ID NO: 916862 - DNA, 25 bp, Mus musculus
ctctgagcagttctgaagatgaact

SEQ ID NO: 916863 - DNA, 25 bp, Mus musculus
ctctgaggcactgtcatgatgatgc

SEQ ID NO: 916864 - DNA, 25 bp, Mus musculus
ctctgaggcactgtgatgatgatgc

SEQ ID NO: 916865 - DNA, 25 bp, Mus musculus
ctctgaggctagcactatttctcag

SEQ ID NO: 916866 - DNA, 25 bp, Mus musculus
ctctgaggctagcagtatttctcag

SEQ ID NO: 916867 - DNA, 25 bp, Mus musculus
ctctgaggtgcacgccaggaaagat

SEQ ID NO: 916868 - DNA, 25 bp, Mus musculus
ctctgaggtgcacgcctgtgtttgg

SEQ ID NO: 916869 - DNA, 25 bp, Mus musculus
ctctgaggtgcacgcgaaagatggt

SEQ ID NO: 916870 - DNA, 25 bp, Mus musculus
ctctgaggtgcacggcaggaaagat

SEQ ID NO: 916871 - DNA, 25 bp, Mus musculus
ctctgaggtgcacggctgtgtttgg

SEQ ID NO: 916872 - DNA, 25 bp, Mus musculus
ctctgaggtgcacgggaaagatggt

SEQ ID NO: 916873 - DNA, 25 bp, Mus musculus
ctctgatattagcgaggtgcccctg

SEQ ID NO: 916874 - DNA, 25 bp, Mus musculus
ctctgatattagggaggtgcccctg

SEQ ID NO: 916875 - DNA, 25 bp, Mus musculus
ctctgatccttcatggcagtgaaga

SEQ ID NO: 916876 - DNA, 25 bp, Mus musculus
ctctgatccttcttggcagtgaaga

SEQ ID NO: 916877 - DNA, 25 bp, Mus musculus
ctctgatgggcaccacagcgactcc

SEQ ID NO: 916878 - DNA, 25 bp, Mus musculus
ctctgatgggcagcacagcgactcc

SEQ ID NO: 916879 - DNA, 25 bp, Mus musculus
ctctgatgtatgcatcggaacgtca

SEQ ID NO: 916880 - DNA, 25 bp, Mus musculus
ctctgatgtatggatcggaacgtca

SEQ ID NO: 916881 - DNA, 25 bp, Mus musculus
ctctgattacaacatccagaaagag

SEQ ID NO: 916882 - DNA, 25 bp, Mus musculus
ctctgattacaagatccagaaagag

SEQ ID NO: 916883 - DNA, 25 bp, Mus musculus
ctctgattggagctcggtgagctgg

SEQ ID NO: 916884 - DNA, 25 bp, Mus musculus
ctctgattggaggtcggtgagctgg

SEQ ID NO: 916885 - DNA, 25 bp, Mus musculus
ctctgcaaatggcacccgaacccat

SEQ ID NO: 916886 - DNA, 25 bp, Mus musculus
ctctgcaaatggcagccgaacccat

SEQ ID NO: 916887 - DNA, 25 bp, Mus musculus
ctctgcaaccaacgcctttgtagat

SEQ ID NO: 916888 - DNA, 25 bp, Mus musculus
ctctgcaaccaaggcctttgtagat

SEQ ID NO: 916889 - DNA, 25 bp, Mus musculus
ctctgcacaggacacatcaagactg

SEQ ID NO: 916890 - DNA, 25 bp, Mus musculus
ctctgcacaggacagatcaagactg

SEQ ID NO: 916891 - DNA, 25 bp, Mus musculus
ctctgcagataacactgtagcttta

SEQ ID NO: 916892 - DNA, 25 bp, Mus musculus
ctctgcagataagactgtagcttta

SEQ ID NO: 916893 - DNA, 25 bp, Mus musculus
ctctgcagcacacgccatccatcca

SEQ ID NO: 916894 - DNA, 25 bp, Mus musculus
ctctgcagcacaggccatccatcca

SEQ ID NO: 916895 - DNA, 25 bp, Mus musculus
ctctgcagtcaaatgacaaggaaca

SEQ ID NO: 916896 - DNA, 25 bp, Mus musculus
ctctgcagtcaattgacaaggaaca

SEQ ID NO: 916897 - DNA, 25 bp, Mus musculus
ctctgcagtgacacctgctggctta

SEQ ID NO: 916898 - DNA, 25 bp, Mus musculus
ctctgcagtgtcacctgctggctta

SEQ ID NO: 916899 - DNA, 25 bp, Mus musculus
ctctgcatcatgccatgtgagccag

SEQ ID NO: 916900 - DNA, 25 bp, Mus musculus
ctctgcatcatggcatgtgagccag

SEQ ID NO: 916901 - DNA, 25 bp, Mus musculus
ctctgcatgccgcagagtggccatg

SEQ ID NO: 916902 - DNA, 25 bp, Mus musculus
ctctgcatgccggagagtggccatg

SEQ ID NO: 916903 - DNA, 25 bp, Mus musculus
ctctgccaaatactacctggacagc

SEQ ID NO: 916904 - DNA, 25 bp, Mus musculus
ctctgccaaatagtacctggacagc

SEQ ID NO: 916905 - DNA, 25 bp, Mus musculus
ctctgccaagcctgccctgagggat

SEQ ID NO: 916906 - DNA, 25 bp, Mus musculus
ctctgccaaggctgccctgagggat

SEQ ID NO: 916907 - DNA, 25 bp, Mus musculus
ctctgccagcaacgtgtagctactt

SEQ ID NO: 916908 - DNA, 25 bp, Mus musculus
ctctgccagcaaggtgtagctactt

SEQ ID NO: 916909 - DNA, 25 bp, Mus musculus
ctctgccagtgcaacaatggccatt

SEQ ID NO: 916910 - DNA, 25 bp, Mus musculus
ctctgccagtgcaagaatggccatt

SEQ ID NO: 916911 - DNA, 25 bp, Mus musculus
ctctgccatatacacgagccacgtg

SEQ ID NO: 916912 - DNA, 25 bp, Mus musculus
ctctgccatatacaggagccacgtg

SEQ ID NO: 916913 - DNA, 25 bp, Mus musculus
ctctgccatgctgaactccctggat

SEQ ID NO: 916914 - DNA, 25 bp, Mus musculus
ctctgccatggtgaactccctggat

SEQ ID NO: 916915 - DNA, 25 bp, Mus musculus
ctctgcccaccacgcttggaaggga

SEQ ID NO: 916916 - DNA, 25 bp, Mus musculus
ctctgcccaccaggcttggaaggga

SEQ ID NO: 916917 - DNA, 25 bp, Mus musculus
ctctgcccagactcgggggcaatag

SEQ ID NO: 916918 - DNA, 25 bp, Mus musculus
ctctgcccagcacggtgaagaggtt

SEQ ID NO: 916919 - DNA, 25 bp, Mus musculus
ctctgcccagcagggtgaagaggtt

SEQ ID NO: 916920 - DNA, 25 bp, Mus musculus
ctctgcccagtctcgggggcaatag

SEQ ID NO: 916921 - DNA, 25 bp, Mus musculus
ctctgcccatgtcatcatgattctg

SEQ ID NO: 916922 - DNA, 25 bp, Mus musculus
ctctgcccatgtgatcatgattctg

SEQ ID NO: 916923 - DNA, 25 bp, Mus musculus
ctctgcccgatgatcattggccgtg

SEQ ID NO: 916924 - DNA, 25 bp, Mus musculus
ctctgcccgatgttcattggccgtg

SEQ ID NO: 916925 - DNA, 25 bp, Mus musculus
ctctgccctacccacctggaatgga

SEQ ID NO: 916926 - DNA, 25 bp, Mus musculus
ctctgccctacccagctggaatgga

SEQ ID NO: 916927 - DNA, 25 bp, Mus musculus
ctctgcccttctccgtggggcccga

SEQ ID NO: 916928 - DNA, 25 bp, Mus musculus
ctctgcccttgtccgtggggcccga

SEQ ID NO: 916929 - DNA, 25 bp, Mus musculus
ctctgccgccagctcctcagatgac

SEQ ID NO: 916930 - DNA, 25 bp, Mus musculus
ctctgccgccaggtcctcagatgac

SEQ ID NO: 916931 - DNA, 25 bp, Mus musculus
ctctgcctgtttatgagccacgtgg

SEQ ID NO: 916932 - DNA, 25 bp, Mus musculus
ctctgcctgtttttgagccacgtgg

SEQ ID NO: 916933 - DNA, 25 bp, Mus musculus
ctctgccttcctcgattcaccggcg

SEQ ID NO: 916934 - DNA, 25 bp, Mus musculus
ctctgccttcctggattcaccggcg

SEQ ID NO: 916935 - DNA, 25 bp, Mus musculus
ctctgccttttacacgaagtatgag

SEQ ID NO: 916936 - DNA, 25 bp, Mus musculus
ctctgccttttacaggaagtatgag

SEQ ID NO: 916937 - DNA, 25 bp, Mus musculus
ctctgcgaaccaaacacactgggtt

SEQ ID NO: 916938 - DNA, 25 bp, Mus musculus
ctctgcgaaccaactgccaggggac

SEQ ID NO: 916939 - DNA, 25 bp, Mus musculus
ctctgcgaaccatacacactgggtt

SEQ ID NO: 916940 - DNA, 25 bp, Mus musculus
ctctgcgaaccatctgccaggggac

SEQ ID NO: 916941 - DNA, 25 bp, Mus musculus
ctctgcgaagcgaaatgctcataaa

SEQ ID NO: 916942 - DNA, 25 bp, Mus musculus
ctctgcgaagggaaatgctcataaa

SEQ ID NO: 916943 - DNA, 25 bp, Mus musculus
ctctgcgagccgcactggttttatg

SEQ ID NO: 916944 - DNA, 25 bp, Mus musculus
ctctgcgagccgcagtggttttatg

SEQ ID NO: 916945 - DNA, 25 bp, Mus musculus
ctctgcgccacgtatcagagcatcg

SEQ ID NO: 916946 - DNA, 25 bp, Mus musculus
ctctgcgccaggtatcagagcatcg

SEQ ID NO: 916947 - DNA, 25 bp, Mus musculus
ctctgctacacaccctcttgccagc

SEQ ID NO: 916948 - DNA, 25 bp, Mus musculus
ctctgctacacagcctcttgccagc

SEQ ID NO: 916949 - DNA, 25 bp, Mus musculus
ctctgctacagagtcgtgcccaggt

SEQ ID NO: 916950 - DNA, 25 bp, Mus musculus
ctctgctacagagtggtgcccaggt

SEQ ID NO: 916951 - DNA, 25 bp, Mus musculus
ctctgctagtctccttgaacgtcag

SEQ ID NO: 916952 - DNA, 25 bp, Mus musculus
ctctgctagtgtccttgaacgtcag

SEQ ID NO: 916953 - DNA, 25 bp, Mus musculus
ctctgctatcaacgtgcagagcccc

SEQ ID NO: 916954 - DNA, 25 bp, Mus musculus
ctctgctatcaaggtgcagagcccc

SEQ ID NO: 916955 - DNA, 25 bp, Mus musculus
ctctgctcagatgtataactttacc

SEQ ID NO: 916956 - DNA, 25 bp, Mus musculus
ctctgctcagcacccactctctaca

SEQ ID NO: 916957 - DNA, 25 bp, Mus musculus
ctctgctcagcacggataactctct

SEQ ID NO: 916958 - DNA, 25 bp, Mus musculus
ctctgctcagcagccactctctaca

SEQ ID NO: 916959 - DNA, 25 bp, Mus musculus
ctctgctcagcagggataactctct

SEQ ID NO: 916960 - DNA, 25 bp, Mus musculus
ctctgctcagttgtataactttacc

SEQ ID NO: 916961 - DNA, 25 bp, Mus musculus
ctctgctccacgctaaccatgtgcg

SEQ ID NO: 916962 - DNA, 25 bp, Mus musculus
ctctgctccacggtaaccatgtgcg

SEQ ID NO: 916963 - DNA, 25 bp, Mus musculus
ctctgctctcagcaggccaagctcc

SEQ ID NO: 916964 - DNA, 25 bp, Mus musculus
ctctgctctcagcccaagctccttt

SEQ ID NO: 916965 - DNA, 25 bp, Mus musculus
ctctgctctcaggaggccaagctcc

SEQ ID NO: 916966 - DNA, 25 bp, Mus musculus
ctctgctctcaggccaagctccttt

SEQ ID NO: 916967 - DNA, 25 bp, Mus musculus
ctctgctgacagacactgtcctgtt

SEQ ID NO: 916968 - DNA, 25 bp, Mus musculus
ctctgctgacagtcactgtcctgtt

SEQ ID NO: 916969 - DNA, 25 bp, Mus musculus
ctctgctgccggctcagcacctcgg

SEQ ID NO: 916970 - DNA, 25 bp, Mus musculus
ctctgctgccggcttttctcctgaa

SEQ ID NO: 916971 - DNA, 25 bp, Mus musculus
ctctgctgccgggtcagcacctcgg

SEQ ID NO: 916972 - DNA, 25 bp, Mus musculus
ctctgctgccgggttttctcctgaa

SEQ ID NO: 916973 - DNA, 25 bp, Mus musculus
ctctgctgcgctcatgtaggaaatt

SEQ ID NO: 916974 - DNA, 25 bp, Mus musculus
ctctgctgcggtcatgtaggaaatt

SEQ ID NO: 916975 - DNA, 25 bp, Mus musculus
ctctgctggacacccaatccattcc

SEQ ID NO: 916976 - DNA, 25 bp, Mus musculus
ctctgctggacagccaatccattcc

SEQ ID NO: 916977 - DNA, 25 bp, Mus musculus
ctctgctgtccactggggacctcca

SEQ ID NO: 916978 - DNA, 25 bp, Mus musculus
ctctgctgtccagtggggacctcca

SEQ ID NO: 916979 - DNA, 25 bp, Mus musculus
ctctggaaaccacgaagtgagtgcc

SEQ ID NO: 916980 - DNA, 25 bp, Mus musculus
ctctggaaaccacgagaacagtacg

SEQ ID NO: 916981 - DNA, 25 bp, Mus musculus
ctctggaaaccaggaagtgagtgcc

SEQ ID NO: 916982 - DNA, 25 bp, Mus musculus
ctctggaaaccaggagaacagtacg

SEQ ID NO: 916983 - DNA, 25 bp, Mus musculus
ctctggaaagagattcaagggtatt

SEQ ID NO: 916984 - DNA, 25 bp, Mus musculus
ctctggaaagtgattcaagggtatt

SEQ ID NO: 916985 - DNA, 25 bp, Mus musculus
ctctggaacgtgcctgacgtggtta

SEQ ID NO: 916986 - DNA, 25 bp, Mus musculus
ctctggaacgtggctgacgtggtta

SEQ ID NO: 916987 - DNA, 25 bp, Mus musculus
ctctggaatgccctatttacactcc

SEQ ID NO: 916988 - DNA, 25 bp, Mus musculus
ctctggaatggcctatttacactcc

SEQ ID NO: 916989 - DNA, 25 bp, Mus musculus
ctctggacagaaaggaattcagtgt

SEQ ID NO: 916990 - DNA, 25 bp, Mus musculus
ctctggacagatgctgattatggat

SEQ ID NO: 916991 - DNA, 25 bp, Mus musculus
ctctggacagtaaggaattcagtgt

SEQ ID NO: 916992 - DNA, 25 bp, Mus musculus
ctctggacagttgctgattatggat

SEQ ID NO: 916993 - DNA, 25 bp, Mus musculus
ctctggagaaagagtttgagaggac

SEQ ID NO: 916994 - DNA, 25 bp, Mus musculus
ctctggagaaagcggcattgatggg

SEQ ID NO: 916995 - DNA, 25 bp, Mus musculus
ctctggagaaaggggcattgatggg

SEQ ID NO: 916996 - DNA, 25 bp, Mus musculus
ctctggagaaagtgtttgagaggac

SEQ ID NO: 916997 - DNA, 25 bp, Mus musculus
ctctggagaacaagacttcaccttt

SEQ ID NO: 916998 - DNA, 25 bp, Mus musculus
ctctggagaacatgacttcaccttt

SEQ ID NO: 916999 - DNA, 25 bp, Mus musculus
ctctggagccagctggtcatgctcc

SEQ ID NO: 917000 - DNA, 25 bp, Mus musculus
ctctggagccgaatcaaaaggtgat

SEQ ID NO: 917001 - DNA, 25 bp, Mus musculus
ctctggagccgattcaaaaggtgat

SEQ ID NO: 917002 - DNA, 25 bp, Mus musculus
ctctggagcctgctggtcatgctcc

SEQ ID NO: 917003 - DNA, 25 bp, Mus musculus
ctctggaggcagagtaaaagacatc

SEQ ID NO: 917004 - DNA, 25 bp, Mus musculus
ctctggaggcagtgtaaaagacatc

SEQ ID NO: 917005 - DNA, 25 bp, Mus musculus
ctctggagttcatgcctcctgagat

SEQ ID NO: 917006 - DNA, 25 bp, Mus musculus
ctctggagttcatggctcctgagat

SEQ ID NO: 917007 - DNA, 25 bp, Mus musculus
ctctggatgtagaacagcgtcacgc

SEQ ID NO: 917008 - DNA, 25 bp, Mus musculus
ctctggatgtcgtcacgctggccgt

SEQ ID NO: 917009 - DNA, 25 bp, Mus musculus
ctctggatgtctcttcggagcctca

SEQ ID NO: 917010 - DNA, 25 bp, Mus musculus
ctctggatgtggtcacgctggccgt

SEQ ID NO: 917011 - DNA, 25 bp, Mus musculus
ctctggatgtgtcttcggagcctca

SEQ ID NO: 917012 - DNA, 25 bp, Mus musculus
ctctggatgttgaacagcgtcacgc

SEQ ID NO: 917013 - DNA, 25 bp, Mus musculus
ctctggcaaaatccgtgcccacact

SEQ ID NO: 917014 - DNA, 25 bp, Mus musculus
ctctggcaaaatgcgtgcccacact

SEQ ID NO: 917015 - DNA, 25 bp, Mus musculus
ctctggcagaagcttctctctcttg

SEQ ID NO: 917016 - DNA, 25 bp, Mus musculus
ctctggcagaaggttctctctcttg

SEQ ID NO: 917017 - DNA, 25 bp, Mus musculus
ctctggcatcggcgatgaagaccgg

SEQ ID NO: 917018 - DNA, 25 bp, Mus musculus
ctctggcatcggggatgaagaccgg

SEQ ID NO: 917019 - DNA, 25 bp, Mus musculus
ctctggcatgcgagctgtgatggtt

SEQ ID NO: 917020 - DNA, 25 bp, Mus musculus
ctctggcatgggagctgtgatggtt

SEQ ID NO: 917021 - DNA, 25 bp, Mus musculus
ctctggccccagctcgaagctggag

SEQ ID NO: 917022 - DNA, 25 bp, Mus musculus
ctctggccccaggtcgaagctggag

SEQ ID NO: 917023 - DNA, 25 bp, Mus musculus
ctctggccgtcgcggctggactgta

SEQ ID NO: 917024 - DNA, 25 bp, Mus musculus
ctctggccgtcggggctggactgta

SEQ ID NO: 917025 - DNA, 25 bp, Mus musculus
ctctggcctgctttgctactggctt

SEQ ID NO: 917026 - DNA, 25 bp, Mus musculus
ctctggcctggtttgctactggctt

SEQ ID NO: 917027 - DNA, 25 bp, Mus musculus
ctctggctcccgcgtcatccactct

SEQ ID NO: 917028 - DNA, 25 bp, Mus musculus
ctctggctcccgggtcatccactct

SEQ ID NO: 917029 - DNA, 25 bp, Mus musculus
ctctggctgaaatgcggtggcaact

SEQ ID NO: 917030 - DNA, 25 bp, Mus musculus
ctctggctgaaatggggtggcaact

SEQ ID NO: 917031 - DNA, 25 bp, Mus musculus
ctctggctgaccaacagtcatgcaa

SEQ ID NO: 917032 - DNA, 25 bp, Mus musculus
ctctggctgaccaagagtcatgcaa

SEQ ID NO: 917033 - DNA, 25 bp, Mus musculus
ctctggctgcagcaattgttgggga

SEQ ID NO: 917034 - DNA, 25 bp, Mus musculus
ctctggctgcaggaattgttgggga

SEQ ID NO: 917035 - DNA, 25 bp, Mus musculus
ctctggctgtacattggtatcaaca

SEQ ID NO: 917036 - DNA, 25 bp, Mus musculus
ctctggctgtactttggtatcaaca

SEQ ID NO: 917037 - DNA, 25 bp, Mus musculus
ctctgggaaaagcgtcaatgctagg

SEQ ID NO: 917038 - DNA, 25 bp, Mus musculus
ctctgggaaaagggtcaatgctagg

SEQ ID NO: 917039 - DNA, 25 bp, Mus musculus
ctctgggaagattgctacagaagca

SEQ ID NO: 917040 - DNA, 25 bp, Mus musculus
ctctgggaagctgcggttcccatcc

SEQ ID NO: 917041 - DNA, 25 bp, Mus musculus
ctctgggaaggtgcggttcccatcc

SEQ ID NO: 917042 - DNA, 25 bp, Mus musculus
ctctgggaagtttgctacagaagca

SEQ ID NO: 917043 - DNA, 25 bp, Mus musculus
ctctgggacatgagtaactacttgg

SEQ ID NO: 917044 - DNA, 25 bp, Mus musculus
ctctgggacatgtgtaactacttgg

SEQ ID NO: 917045 - DNA, 25 bp, Mus musculus
ctctgggacccacaaaaccttgagg

SEQ ID NO: 917046 - DNA, 25 bp, Mus musculus
ctctgggacccagaaaaccttgagg

SEQ ID NO: 917047 - DNA, 25 bp, Mus musculus
ctctgggatcagcgggctcattgtc

SEQ ID NO: 917048 - DNA, 25 bp, Mus musculus
ctctgggatcagggggctcattgtc

SEQ ID NO: 917049 - DNA, 25 bp, Mus musculus
ctctgggccacacacgggaatatgg

SEQ ID NO: 917050 - DNA, 25 bp, Mus musculus
ctctgggccacacaggggaatatgg

SEQ ID NO: 917051 - DNA, 25 bp, Mus musculus
ctctgggcgacccgtcacttcatgg

SEQ ID NO: 917052 - DNA, 25 bp, Mus musculus
ctctgggcgaccggtcacttcatgg

SEQ ID NO: 917053 - DNA, 25 bp, Mus musculus
ctctgggctgagcaaattcaagctg

SEQ ID NO: 917054 - DNA, 25 bp, Mus musculus
ctctgggctgaggaaattcaagctg

SEQ ID NO: 917055 - DNA, 25 bp, Mus musculus
ctctggggatcatgacggtcacaca

SEQ ID NO: 917056 - DNA, 25 bp, Mus musculus
ctctggggatcatgtcggtcacaca

SEQ ID NO: 917057 - DNA, 25 bp, Mus musculus
ctctggtccagatgcggaaagatgc

SEQ ID NO: 917058 - DNA, 25 bp, Mus musculus
ctctggtccagatggggaaagatgc

SEQ ID NO: 917059 - DNA, 25 bp, Mus musculus
ctctggtcttagcttcttgattgtc

SEQ ID NO: 917060 - DNA, 25 bp, Mus musculus
ctctggtcttaggttcttgattgtc

SEQ ID NO: 917061 - DNA, 25 bp, Mus musculus
ctctggtggagcaacgtggccctgt

SEQ ID NO: 917062 - DNA, 25 bp, Mus musculus
ctctggtggagcaaggtggccctgt

SEQ ID NO: 917063 - DNA, 25 bp, Mus musculus
ctctggtgtacacagggcggcccat

SEQ ID NO: 917064 - DNA, 25 bp, Mus musculus
ctctggtgtacagagggcggcccat

SEQ ID NO: 917065 - DNA, 25 bp, Mus musculus
ctctggtgtacccggaccagaataa

SEQ ID NO: 917066 - DNA, 25 bp, Mus musculus
ctctggtgtaccgggaccagaataa

SEQ ID NO: 917067 - DNA, 25 bp, Mus musculus
ctctgtaaaaaacgttctctatata

SEQ ID NO: 917068 - DNA, 25 bp, Mus musculus
ctctgtaaaaaaggttctctatata

SEQ ID NO: 917069 - DNA, 25 bp, Mus musculus
ctctgtaagcagcctaggatgtcag

SEQ ID NO: 917070 - DNA, 25 bp, Mus musculus
ctctgtaagcaggctaggatgtcag

SEQ ID NO: 917071 - DNA, 25 bp, Mus musculus
ctctgtacacctccggatagcttct

SEQ ID NO: 917072 - DNA, 25 bp, Mus musculus
ctctgtacacgtccggatagcttct

SEQ ID NO: 917073 - DNA, 25 bp, Mus musculus
ctctgtagaccacggctaattagta

SEQ ID NO: 917074 - DNA, 25 bp, Mus musculus
ctctgtagaccagggctaattagta

SEQ ID NO: 917075 - DNA, 25 bp, Mus musculus
ctctgtatgaatatttctctcagtt

SEQ ID NO: 917076 - DNA, 25 bp, Mus musculus
ctctgtatgattatttctctcagtt

SEQ ID NO: 917077 - DNA, 25 bp, Mus musculus
ctctgtcaaacgtggaaagatcaac

SEQ ID NO: 917078 - DNA, 25 bp, Mus musculus
ctctgtcaaaggtggaaagatcaac

SEQ ID NO: 917079 - DNA, 25 bp, Mus musculus
ctctgtcaagccccgagaccagaag

SEQ ID NO: 917080 - DNA, 25 bp, Mus musculus
ctctgtcaaggcccgagaccagaag

SEQ ID NO: 917081 - DNA, 25 bp, Mus musculus
ctctgtcacccacctttacacgcta

SEQ ID NO: 917082 - DNA, 25 bp, Mus musculus
ctctgtcacccagctttacacgcta

SEQ ID NO: 917083 - DNA, 25 bp, Mus musculus
ctctgtccccagcgaacagactgct

SEQ ID NO: 917084 - DNA, 25 bp, Mus musculus
ctctgtccccagggaacagactgct

SEQ ID NO: 917085 - DNA, 25 bp, Mus musculus
ctctgtccctcgcgtggggacagtg

SEQ ID NO: 917086 - DNA, 25 bp, Mus musculus
ctctgtccctggcgtggggacagtg

SEQ ID NO: 917087 - DNA, 25 bp, Mus musculus
ctctgtccttatgcctttatcatgg

SEQ ID NO: 917088 - DNA, 25 bp, Mus musculus
ctctgtccttctcttatctcctctg

SEQ ID NO: 917089 - DNA, 25 bp, Mus musculus
ctctgtccttgtcttatctcctctg

SEQ ID NO: 917090 - DNA, 25 bp, Mus musculus
ctctgtccttttgcctttatcatgg

SEQ ID NO: 917091 - DNA, 25 bp, Mus musculus
ctctgtctaaaaacctcttctgaaa

SEQ ID NO: 917092 - DNA, 25 bp, Mus musculus
ctctgtctaaaaacgtcttctgaaa

SEQ ID NO: 917093 - DNA, 25 bp, Mus musculus
ctctgtctcacccacgatgagtttc

SEQ ID NO: 917094 - DNA, 25 bp, Mus musculus
ctctgtctcacccaggatgagtttc

SEQ ID NO: 917095 - DNA, 25 bp, Mus musculus
ctctgtctcagacaaatacaacaac

SEQ ID NO: 917096 - DNA, 25 bp, Mus musculus
ctctgtctcagagaaatacaacaac

SEQ ID NO: 917097 - DNA, 25 bp, Mus musculus
ctctgtctgttacaagaaatggagc

SEQ ID NO: 917098 - DNA, 25 bp, Mus musculus
ctctgtctgttagaagaaatggagc

SEQ ID NO: 917099 - DNA, 25 bp, Mus musculus
ctctgtcttgcactgactctgaggc

SEQ ID NO: 917100 - DNA, 25 bp, Mus musculus
ctctgtcttggactgactctgaggc

SEQ ID NO: 917101 - DNA, 25 bp, Mus musculus
ctctgtgaagactagggacaggaag

SEQ ID NO: 917102 - DNA, 25 bp, Mus musculus
ctctgtgaagccccgagaccagaag

SEQ ID NO: 917103 - DNA, 25 bp, Mus musculus
ctctgtgaagcgacaggaagatggt

SEQ ID NO: 917104 - DNA, 25 bp, Mus musculus
ctctgtgaaggcccgagaccagaag

SEQ ID NO: 917105 - DNA, 25 bp, Mus musculus
ctctgtgaagggacaggaagatggt

SEQ ID NO: 917106 - DNA, 25 bp, Mus musculus
ctctgtgaagtctagggacaggaag

SEQ ID NO: 917107 - DNA, 25 bp, Mus musculus
ctctgtgcagaacattcaaggtaca

SEQ ID NO: 917108 - DNA, 25 bp, Mus musculus
ctctgtgcagaagattcaaggtaca

SEQ ID NO: 917109 - DNA, 25 bp, Mus musculus
ctctgtgcagctatataatttgtct

SEQ ID NO: 917110 - DNA, 25 bp, Mus musculus
ctctgtgcaggtatataatttgtct

SEQ ID NO: 917111 - DNA, 25 bp, Mus musculus
ctctgtgccgaacatctcatcattg

SEQ ID NO: 917112 - DNA, 25 bp, Mus musculus
ctctgtgccgtacatctcatcattg

SEQ ID NO: 917113 - DNA, 25 bp, Mus musculus
ctctgtggacaacagggtcctgtca

SEQ ID NO: 917114 - DNA, 25 bp, Mus musculus
ctctgtggacaacgtcctgtcagaa

SEQ ID NO: 917115 - DNA, 25 bp, Mus musculus
ctctgtggacaagagggtcctgtca

SEQ ID NO: 917116 - DNA, 25 bp, Mus musculus
ctctgtggacaaggtcctgtcagaa

SEQ ID NO: 917117 - DNA, 25 bp, Mus musculus
ctctgtggagcctttggccactgcc

SEQ ID NO: 917118 - DNA, 25 bp, Mus musculus
ctctgtggagctcagctacatggag

SEQ ID NO: 917119 - DNA, 25 bp, Mus musculus
ctctgtggaggctttggccactgcc

SEQ ID NO: 917120 - DNA, 25 bp, Mus musculus
ctctgtggaggtcagctacatggag

SEQ ID NO: 917121 - DNA, 25 bp, Mus musculus
ctctgtggatgacgtcactacttca

SEQ ID NO: 917122 - DNA, 25 bp, Mus musculus
ctctgtggatgaggtcactacttca

SEQ ID NO: 917123 - DNA, 25 bp, Mus musculus
ctctgtggcaagcgtgacagctcta

SEQ ID NO: 917124 - DNA, 25 bp, Mus musculus
ctctgtggcaagggtgacagctcta

SEQ ID NO: 917125 - DNA, 25 bp, Mus musculus
ctctgtggcgaggacaaagcggtgg

SEQ ID NO: 917126 - DNA, 25 bp, Mus musculus
ctctgtggcgaggagaaagcggtgg

SEQ ID NO: 917127 - DNA, 25 bp, Mus musculus
ctctgtggtcaaccccctggactat

SEQ ID NO: 917128 - DNA, 25 bp, Mus musculus
ctctgtggtcaagcccctggactat

SEQ ID NO: 917129 - DNA, 25 bp, Mus musculus
ctctgttagcaaatactctgtctgc

SEQ ID NO: 917130 - DNA, 25 bp, Mus musculus
ctctgttagcaaattctctgtctgc

SEQ ID NO: 917131 - DNA, 25 bp, Mus musculus
ctctgttcagagcataccacgggcc

SEQ ID NO: 917132 - DNA, 25 bp, Mus musculus
ctctgttcagaggataccacgggcc

SEQ ID NO: 917133 - DNA, 25 bp, Mus musculus
ctctgttcagcatatgcagtacctt

SEQ ID NO: 917134 - DNA, 25 bp, Mus musculus
ctctgttcagcccttcccacaaatc

SEQ ID NO: 917135 - DNA, 25 bp, Mus musculus
ctctgttcaggatatgcagtacctt

SEQ ID NO: 917136 - DNA, 25 bp, Mus musculus
ctctgttcaggccttcccacaaatc

SEQ ID NO: 917137 - DNA, 25 bp, Mus musculus
ctctgttcttggagcagggcaatgc

SEQ ID NO: 917138 - DNA, 25 bp, Mus musculus
ctctgttcttggaggagggcaatgc

SEQ ID NO: 917139 - DNA, 25 bp, Mus musculus
ctctgttgtgacttcctgatacacc

SEQ ID NO: 917140 - DNA, 25 bp, Mus musculus
ctctgttgtgtcttcctgatacacc

SEQ ID NO: 917141 - DNA, 25 bp, Mus musculus
ctctgtttactgcatgtccgatcaa

SEQ ID NO: 917142 - DNA, 25 bp, Mus musculus
ctctgtttactggatgtccgatcaa

SEQ ID NO: 917143 - DNA, 25 bp, Mus musculus
ctctgtttgagtcatgagccggcag

SEQ ID NO: 917144 - DNA, 25 bp, Mus musculus
ctctgtttgagtgatgagccggcag

SEQ ID NO: 917145 - DNA, 25 bp, Mus musculus
ctctgttttacaggagcaaacctac

SEQ ID NO: 917146 - DNA, 25 bp, Mus musculus
ctctgttttagaggagcaaacctac

SEQ ID NO: 917147 - DNA, 25 bp, Mus musculus
ctctgttttatcctcgtctctaata

SEQ ID NO: 917148 - DNA, 25 bp, Mus musculus
ctctgttttatcctggtctctaata

SEQ ID NO: 917149 - DNA, 25 bp, Mus musculus
ctcttaacaagcacaatgggtgtgt

SEQ ID NO: 917150 - DNA, 25 bp, Mus musculus
ctcttaacaagcactatgggtgtgt

SEQ ID NO: 917151 - DNA, 25 bp, Mus musculus
ctcttaattatgcgagatacagttc

SEQ ID NO: 917152 - DNA, 25 bp, Mus musculus
ctcttaattatgggagatacagttc

SEQ ID NO: 917153 - DNA, 25 bp, Mus musculus
ctcttacaagctacactttcttctc

SEQ ID NO: 917154 - DNA, 25 bp, Mus musculus
ctcttacaaggtacactttcttctc

SEQ ID NO: 917155 - DNA, 25 bp, Mus musculus
ctcttaccacctgtcgtggactggt

SEQ ID NO: 917156 - DNA, 25 bp, Mus musculus
ctcttaccacctgtggtggactggt

SEQ ID NO: 917157 - DNA, 25 bp, Mus musculus
ctcttagaattacacagttcatcat

SEQ ID NO: 917158 - DNA, 25 bp, Mus musculus
ctcttagaattagacagttcatcat

SEQ ID NO: 917159 - DNA, 25 bp, Mus musculus
ctcttagctgcgagcctgctgtccc

SEQ ID NO: 917160 - DNA, 25 bp, Mus musculus
ctcttagctgcgtgcctgctgtccc

SEQ ID NO: 917161 - DNA, 25 bp, Mus musculus
ctcttatatgcttctctgacaactc

SEQ ID NO: 917162 - DNA, 25 bp, Mus musculus
ctcttatatggttctctgacaactc

SEQ ID NO: 917163 - DNA, 25 bp, Mus musculus
ctcttatccaggaatatgattcctt

SEQ ID NO: 917164 - DNA, 25 bp, Mus musculus
ctcttatccaggtatatgattcctt

SEQ ID NO: 917165 - DNA, 25 bp, Mus musculus
ctcttcaaagacaacctcaaacatg

SEQ ID NO: 917166 - DNA, 25 bp, Mus musculus
ctcttcaaagacaacgtgagggtgg

SEQ ID NO: 917167 - DNA, 25 bp, Mus musculus
ctcttcaaagacaagctcaaacatg

SEQ ID NO: 917168 - DNA, 25 bp, Mus musculus
ctcttcaaagacaaggtgagggtgg

SEQ ID NO: 917169 - DNA, 25 bp, Mus musculus
ctcttcaaccatcacgggctggtgt

SEQ ID NO: 917170 - DNA, 25 bp, Mus musculus
ctcttcaaccatcacgtctaggtgg

SEQ ID NO: 917171 - DNA, 25 bp, Mus musculus
ctcttcaaccatcaggggctggtgt

SEQ ID NO: 917172 - DNA, 25 bp, Mus musculus
ctcttcaaccatcaggtctaggtgg

SEQ ID NO: 917173 - DNA, 25 bp, Mus musculus
ctcttcacaaccattcctggtctga

SEQ ID NO: 917174 - DNA, 25 bp, Mus musculus
ctcttcacaacctttcctggtctga

SEQ ID NO: 917175 - DNA, 25 bp, Mus musculus
ctcttcacacagacttccgtgttta

SEQ ID NO: 917176 - DNA, 25 bp, Mus musculus
ctcttcacacagtcttccgtgttta

SEQ ID NO: 917177 - DNA, 25 bp, Mus musculus
ctcttcaccacacgtgtggtctatg

SEQ ID NO: 917178 - DNA, 25 bp, Mus musculus
ctcttcaccacaggtgtggtctatg

SEQ ID NO: 917179 - DNA, 25 bp, Mus musculus
ctcttcacctgcatcctggcagtgg

SEQ ID NO: 917180 - DNA, 25 bp, Mus musculus
ctcttcacctgcttcctggcagtgg

SEQ ID NO: 917181 - DNA, 25 bp, Mus musculus
ctcttcacgcctcatgcctgtggcc

SEQ ID NO: 917182 - DNA, 25 bp, Mus musculus
ctcttcacgcctgatgcctgtggcc

SEQ ID NO: 917183 - DNA, 25 bp, Mus musculus
ctcttcatcaggatgctgcacaaca

SEQ ID NO: 917184 - DNA, 25 bp, Mus musculus
ctcttcatcaggttgctgcacaaca

SEQ ID NO: 917185 - DNA, 25 bp, Mus musculus
ctcttcatgagcctcaataaggatg

SEQ ID NO: 917186 - DNA, 25 bp, Mus musculus
ctcttcatgagcctgaataaggatg

SEQ ID NO: 917187 - DNA, 25 bp, Mus musculus
ctcttcatgccacattcagaaagca

SEQ ID NO: 917188 - DNA, 25 bp, Mus musculus
ctcttcatgccagattcagaaagca

SEQ ID NO: 917189 - DNA, 25 bp, Mus musculus
ctcttcatggcggctctgcccttcc

SEQ ID NO: 917190 - DNA, 25 bp, Mus musculus
ctcttcatgggggctctgcccttcc

SEQ ID NO: 917191 - DNA, 25 bp, Mus musculus
ctcttccaagagccaacaactgtat

SEQ ID NO: 917192 - DNA, 25 bp, Mus musculus
ctcttccaagaggcaacaactgtat

SEQ ID NO: 917193 - DNA, 25 bp, Mus musculus
ctcttccaagagtcccccagaagca

SEQ ID NO: 917194 - DNA, 25 bp, Mus musculus
ctcttccaagtgtcccccagaagca

SEQ ID NO: 917195 - DNA, 25 bp, Mus musculus
ctcttccaattgctctgattgttgg

SEQ ID NO: 917196 - DNA, 25 bp, Mus musculus
ctcttccaattggtctgattgttgg

SEQ ID NO: 917197 - DNA, 25 bp, Mus musculus
ctcttccacaagaatcacctatgta

SEQ ID NO: 917198 - DNA, 25 bp, Mus musculus
ctcttccacaagtatcacctatgta

SEQ ID NO: 917199 - DNA, 25 bp, Mus musculus
ctcttccactggcgtgtgtctgcag

SEQ ID NO: 917200 - DNA, 25 bp, Mus musculus
ctcttccactggggtgtgtctgcag

SEQ ID NO: 917201 - DNA, 25 bp, Mus musculus
ctcttccatgccagttcccacccag

SEQ ID NO: 917202 - DNA, 25 bp, Mus musculus
ctcttccatgcctgttcccacccag

SEQ ID NO: 917203 - DNA, 25 bp, Mus musculus
ctcttcccccagatgcctgtcggtg

SEQ ID NO: 917204 - DNA, 25 bp, Mus musculus
ctcttcccccagttgcctgtcggtg

SEQ ID NO: 917205 - DNA, 25 bp, Mus musculus
ctcttcctctcacgataaggatgcg

SEQ ID NO: 917206 - DNA, 25 bp, Mus musculus
ctcttcctctgacactctcatcttt

SEQ ID NO: 917207 - DNA, 25 bp, Mus musculus
ctcttcctctgacagtctcatcttt

SEQ ID NO: 917208 - DNA, 25 bp, Mus musculus
ctcttcctctgacgataaggatgcg

SEQ ID NO: 917209 - DNA, 25 bp, Mus musculus
ctcttccttacacatgatgaagata

SEQ ID NO: 917210 - DNA, 25 bp, Mus musculus
ctcttccttagacatgatgaagata

SEQ ID NO: 917211 - DNA, 25 bp, Mus musculus
ctcttcgccgccattgctcctgtgc

SEQ ID NO: 917212 - DNA, 25 bp, Mus musculus
ctcttcgccggcattgctcctgtgc

SEQ ID NO: 917213 - DNA, 25 bp, Mus musculus
ctcttcggacaggacatgattatgt

SEQ ID NO: 917214 - DNA, 25 bp, Mus musculus
ctcttcggacaggagatgattatgt

SEQ ID NO: 917215 - DNA, 25 bp, Mus musculus
ctcttcgtcaagcaaacctgcagat

SEQ ID NO: 917216 - DNA, 25 bp, Mus musculus
ctcttcgtcaagcccggaagtgatg

SEQ ID NO: 917217 - DNA, 25 bp, Mus musculus
ctcttcgtcaaggaaacctgcagat

SEQ ID NO: 917218 - DNA, 25 bp, Mus musculus
ctcttcgtcaaggccggaagtgatg

SEQ ID NO: 917219 - DNA, 25 bp, Mus musculus
ctcttcgtggctgagaagatgttcc

SEQ ID NO: 917220 - DNA, 25 bp, Mus musculus
ctcttcgtgggtgagaagatgttcc

SEQ ID NO: 917221 - DNA, 25 bp, Mus musculus
ctcttctaaccagacgcaccaggat

SEQ ID NO: 917222 - DNA, 25 bp, Mus musculus
ctcttctaaccagaggcaccaggat

SEQ ID NO: 917223 - DNA, 25 bp, Mus musculus
ctcttctcacagccacagcggaagc

SEQ ID NO: 917224 - DNA, 25 bp, Mus musculus
ctcttctcacaggcacagcggaagc

SEQ ID NO: 917225 - DNA, 25 bp, Mus musculus
ctcttctcccagccaccaggtgcag

SEQ ID NO: 917226 - DNA, 25 bp, Mus musculus
ctcttctcccaggcaccaggtgcag

SEQ ID NO: 917227 - DNA, 25 bp, Mus musculus
ctcttctcccctcacagacccggag

SEQ ID NO: 917228 - DNA, 25 bp, Mus musculus
ctcttctcccctcgtttctgtatgc

SEQ ID NO: 917229 - DNA, 25 bp, Mus musculus
ctcttctcccctgacagacccggag

SEQ ID NO: 917230 - DNA, 25 bp, Mus musculus
ctcttctcccctggtttctgtatgc

SEQ ID NO: 917231 - DNA, 25 bp, Mus musculus
ctcttctgagctacctgaattcagg

SEQ ID NO: 917232 - DNA, 25 bp, Mus musculus
ctcttctgaggtacctgaattcagg

SEQ ID NO: 917233 - DNA, 25 bp, Mus musculus
ctcttctgcatcaaagtgttgtctg

SEQ ID NO: 917234 - DNA, 25 bp, Mus musculus
ctcttctgcatcaatgtgttgtctg

SEQ ID NO: 917235 - DNA, 25 bp, Mus musculus
ctcttctgtgagctgagtgtagtac

SEQ ID NO: 917236 - DNA, 25 bp, Mus musculus
ctcttctgtgaggtgagtgtagtac

SEQ ID NO: 917237 - DNA, 25 bp, Mus musculus
ctcttcttcacgctgccttggagca

SEQ ID NO: 917238 - DNA, 25 bp, Mus musculus
ctcttcttcacggtgccttggagca

SEQ ID NO: 917239 - DNA, 25 bp, Mus musculus
ctcttgaccaagatccaggaagaca

SEQ ID NO: 917240 - DNA, 25 bp, Mus musculus
ctcttgaccaagttccaggaagaca

SEQ ID NO: 917241 - DNA, 25 bp, Mus musculus
ctcttgatagtgatctttccagaac

SEQ ID NO: 917242 - DNA, 25 bp, Mus musculus
ctcttgatagtgttctttccagaac

SEQ ID NO: 917243 - DNA, 25 bp, Mus musculus
ctcttgcagctgactagcccatgcc

SEQ ID NO: 917244 - DNA, 25 bp, Mus musculus
ctcttgcagctgtctagcccatgcc

SEQ ID NO: 917245 - DNA, 25 bp, Mus musculus
ctcttgccaacacacggtgtgggcc

SEQ ID NO: 917246 - DNA, 25 bp, Mus musculus
ctcttgccaacacagggtgtgggcc

SEQ ID NO: 917247 - DNA, 25 bp, Mus musculus
ctcttgccacagcattttgcagact

SEQ ID NO: 917248 - DNA, 25 bp, Mus musculus
ctcttgccacaggattttgcagact

SEQ ID NO: 917249 - DNA, 25 bp, Mus musculus
ctcttgccagcgagacagtggaggg

SEQ ID NO: 917250 - DNA, 25 bp, Mus musculus
ctcttgccagggagacagtggaggg

SEQ ID NO: 917251 - DNA, 25 bp, Mus musculus
ctcttgcctgctagcagccacatag

SEQ ID NO: 917252 - DNA, 25 bp, Mus musculus
ctcttgcctggtagcagccacatag

SEQ ID NO: 917253 - DNA, 25 bp, Mus musculus
ctcttgcctgtgccctgttcactgc

SEQ ID NO: 917254 - DNA, 25 bp, Mus musculus
ctcttgcctgtggcctgttcactgc

SEQ ID NO: 917255 - DNA, 25 bp, Mus musculus
ctcttggacagcaacggccatgtga

SEQ ID NO: 917256 - DNA, 25 bp, Mus musculus
ctcttggacagcaagggccatgtga

SEQ ID NO: 917257 - DNA, 25 bp, Mus musculus
ctcttggactgccacggtcacgtgg

SEQ ID NO: 917258 - DNA, 25 bp, Mus musculus
ctcttggactgccactacttggctc

SEQ ID NO: 917259 - DNA, 25 bp, Mus musculus
ctcttggactgccagggtcacgtgg

SEQ ID NO: 917260 - DNA, 25 bp, Mus musculus
ctcttggactgccagtacttggctc

SEQ ID NO: 917261 - DNA, 25 bp, Mus musculus
ctcttggagaagatcatcagtggtg

SEQ ID NO: 917262 - DNA, 25 bp, Mus musculus
ctcttggagaagttcatcagtggtg

SEQ ID NO: 917263 - DNA, 25 bp, Mus musculus
ctcttgggagccaacaactcatcct

SEQ ID NO: 917264 - DNA, 25 bp, Mus musculus
ctcttgggagccaagaactcatcct

SEQ ID NO: 917265 - DNA, 25 bp, Mus musculus
ctcttggtccttcaggatttcaaac

SEQ ID NO: 917266 - DNA, 25 bp, Mus musculus
ctcttggtccttcttccaccctcca

SEQ ID NO: 917267 - DNA, 25 bp, Mus musculus
ctcttggtccttgaggatttcaaac

SEQ ID NO: 917268 - DNA, 25 bp, Mus musculus
ctcttggtccttgttccaccctcca

SEQ ID NO: 917269 - DNA, 25 bp, Mus musculus
ctcttggtgcagcgtttgtggtagt

SEQ ID NO: 917270 - DNA, 25 bp, Mus musculus
ctcttggtgcagggtttgtggtagt

SEQ ID NO: 917271 - DNA, 25 bp, Mus musculus
ctcttggtgtggacacttcccgagt

SEQ ID NO: 917272 - DNA, 25 bp, Mus musculus
ctcttggtgtggtcacttcccgagt

SEQ ID NO: 917273 - DNA, 25 bp, Mus musculus
ctcttgtctccaacctgagccccta

SEQ ID NO: 917274 - DNA, 25 bp, Mus musculus
ctcttgtctccatcctgagccccta

SEQ ID NO: 917275 - DNA, 25 bp, Mus musculus
ctcttgttggccaacgatgaacatg

SEQ ID NO: 917276 - DNA, 25 bp, Mus musculus
ctcttgttggccaaggatgaacatg

SEQ ID NO: 917277 - DNA, 25 bp, Mus musculus
ctctttaaagatactatcgtggagc

SEQ ID NO: 917278 - DNA, 25 bp, Mus musculus
ctctttaaagttactatcgtggagc

SEQ ID NO: 917279 - DNA, 25 bp, Mus musculus
ctctttatcaatctgctggagaact

SEQ ID NO: 917280 - DNA, 25 bp, Mus musculus
ctctttatcaatgtgctggagaact

SEQ ID NO: 917281 - DNA, 25 bp, Mus musculus
ctctttatgtcaaccttgcccccaa

SEQ ID NO: 917282 - DNA, 25 bp, Mus musculus
ctctttatgtcaacgttgcccccaa

SEQ ID NO: 917283 - DNA, 25 bp, Mus musculus
ctctttcaagccctaattgctggct

SEQ ID NO: 917284 - DNA, 25 bp, Mus musculus
ctctttcaagccgtaattgctggct

SEQ ID NO: 917285 - DNA, 25 bp, Mus musculus
ctctttcaagcctggagacgtaata

SEQ ID NO: 917286 - DNA, 25 bp, Mus musculus
ctctttcaaggctggagacgtaata

SEQ ID NO: 917287 - DNA, 25 bp, Mus musculus
ctctttcagaaaaaagtctgctcca

SEQ ID NO: 917288 - DNA, 25 bp, Mus musculus
ctctttcagaaaaatgtctgctcca

SEQ ID NO: 917289 - DNA, 25 bp, Mus musculus
ctctttcatcaacggtgacacttcc

SEQ ID NO: 917290 - DNA, 25 bp, Mus musculus
ctctttcatcaagggtgacacttcc

SEQ ID NO: 917291 - DNA, 25 bp, Mus musculus
ctctttcccggaagcatattgacca

SEQ ID NO: 917292 - DNA, 25 bp, Mus musculus
ctctttcccggaaggatattgacca

SEQ ID NO: 917293 - DNA, 25 bp, Mus musculus
ctctttctaactccccacctttgac

SEQ ID NO: 917294 - DNA, 25 bp, Mus musculus
ctctttctaactgcccacctttgac

SEQ ID NO: 917295 - DNA, 25 bp, Mus musculus
ctctttgaaaaacgagagcaacttc

SEQ ID NO: 917296 - DNA, 25 bp, Mus musculus
ctctttgaaaaaggagagcaacttc

SEQ ID NO: 917297 - DNA, 25 bp, Mus musculus
ctctttgatcagctggtaaagacga

SEQ ID NO: 917298 - DNA, 25 bp, Mus musculus
ctctttgatcaggtggtaaagacga

SEQ ID NO: 917299 - DNA, 25 bp, Mus musculus
ctctttgatgtggactgcaaagaag

SEQ ID NO: 917300 - DNA, 25 bp, Mus musculus
ctctttgatgtggagtgcaaagaag

SEQ ID NO: 917301 - DNA, 25 bp, Mus musculus
ctctttgccaaccactccgagaaag

SEQ ID NO: 917302 - DNA, 25 bp, Mus musculus
ctctttgccaaccagtccgagaaag

SEQ ID NO: 917303 - DNA, 25 bp, Mus musculus
ctctttggagctcggtttgacacag

SEQ ID NO: 917304 - DNA, 25 bp, Mus musculus
ctctttggagctgggtttgacacag

SEQ ID NO: 917305 - DNA, 25 bp, Mus musculus
ctctttgtacagcatgagaaaggtg

SEQ ID NO: 917306 - DNA, 25 bp, Mus musculus
ctctttgtacaggatgagaaaggtg

SEQ ID NO: 917307 - DNA, 25 bp, Mus musculus
ctctttgtccagctggacactcttt

SEQ ID NO: 917308 - DNA, 25 bp, Mus musculus
ctctttgtccaggtggacactcttt

SEQ ID NO: 917309 - DNA, 25 bp, Mus musculus
ctctttttccagcagttggaattga

SEQ ID NO: 917310 - DNA, 25 bp, Mus musculus
ctctttttccaggagttggaattga

SEQ ID NO: 917311 - DNA, 25 bp, Mus musculus
ctcttttttgagattgagctccttg

SEQ ID NO: 917312 - DNA, 25 bp, Mus musculus
ctcttttttgagtttgagctccttg

SEQ ID NO: 917313 - DNA, 25 bp, Mus musculus
ctgaaaaatttgaacgagacatcaa

SEQ ID NO: 917314 - DNA, 25 bp, Mus musculus
ctgaaaaatttgaaggagacatcaa

SEQ ID NO: 917315 - DNA, 25 bp, Mus musculus
ctgaaaaccttgcggatgtccagat

SEQ ID NO: 917316 - DNA, 25 bp, Mus musculus
ctgaaaaccttggggatgtccagat

SEQ ID NO: 917317 - DNA, 25 bp, Mus musculus
ctgaaaatagaacccagttatgagt

SEQ ID NO: 917318 - DNA, 25 bp, Mus musculus
ctgaaaatagaagccagttatgagt

SEQ ID NO: 917319 - DNA, 25 bp, Mus musculus
ctgaaaatagaattgccaagaagat

SEQ ID NO: 917320 - DNA, 25 bp, Mus musculus
ctgaaaatagtattgccaagaagat

SEQ ID NO: 917321 - DNA, 25 bp, Mus musculus
ctgaaaatccaatacacttttctta

SEQ ID NO: 917322 - DNA, 25 bp, Mus musculus
ctgaaaatccaatagacttttctta

SEQ ID NO: 917323 - DNA, 25 bp, Mus musculus
ctgaaacagcacaacgtttggcgga

SEQ ID NO: 917324 - DNA, 25 bp, Mus musculus
ctgaaacagcacaaggtttggcgga

SEQ ID NO: 917325 - DNA, 25 bp, Mus musculus
ctgaaacccgagaacatcttgtacg

SEQ ID NO: 917326 - DNA, 25 bp, Mus musculus
ctgaaacccgagtacatcttgtacg

SEQ ID NO: 917327 - DNA, 25 bp, Mus musculus
ctgaaactcaagcacgtgttctttg

SEQ ID NO: 917328 - DNA, 25 bp, Mus musculus
ctgaaactcaagcaggtgttctttg

SEQ ID NO: 917329 - DNA, 25 bp, Mus musculus
ctgaaactgtagcttctttgttaca

SEQ ID NO: 917330 - DNA, 25 bp, Mus musculus
ctgaaactgtaggttctttgttaca

SEQ ID NO: 917331 - DNA, 25 bp, Mus musculus
ctgaaagaatcaagtagcagctgtg

SEQ ID NO: 917332 - DNA, 25 bp, Mus musculus
ctgaaagaatcatgtagcagctgtg

SEQ ID NO: 917333 - DNA, 25 bp, Mus musculus
ctgaaagacgaagacaaacgactca

SEQ ID NO: 917334 - DNA, 25 bp, Mus musculus
ctgaaagacgaagagaaacgactca

SEQ ID NO: 917335 - DNA, 25 bp, Mus musculus
ctgaaagataataccaggagactga

SEQ ID NO: 917336 - DNA, 25 bp, Mus musculus
ctgaaagatattaccaggagactga

SEQ ID NO: 917337 - DNA, 25 bp, Mus musculus
ctgaaagcagaccggcattctcaaa

SEQ ID NO: 917338 - DNA, 25 bp, Mus musculus
ctgaaagcagcgcctgtgcaggtga

SEQ ID NO: 917339 - DNA, 25 bp, Mus musculus
ctgaaagcagggcctgtgcaggtga

SEQ ID NO: 917340 - DNA, 25 bp, Mus musculus
ctgaaagcagtccggcattctcaaa

SEQ ID NO: 917341 - DNA, 25 bp, Mus musculus
ctgaaagcatccagtttgtgctcga

SEQ ID NO: 917342 - DNA, 25 bp, Mus musculus
ctgaaagcatcctgtttgtgctcga

SEQ ID NO: 917343 - DNA, 25 bp, Mus musculus
ctgaaagcccaactggccgcacgag

SEQ ID NO: 917344 - DNA, 25 bp, Mus musculus
ctgaaagcccaagtggccgcacgag

SEQ ID NO: 917345 - DNA, 25 bp, Mus musculus
ctgaaagctactctcgtggagagct

SEQ ID NO: 917346 - DNA, 25 bp, Mus musculus
ctgaaagctactctggtggagagct

SEQ ID NO: 917347 - DNA, 25 bp, Mus musculus
ctgaaagcttatttcgtatgctaac

SEQ ID NO: 917348 - DNA, 25 bp, Mus musculus
ctgaaagcttatttggtatgctaac

SEQ ID NO: 917349 - DNA, 25 bp, Mus musculus
ctgaaaggaaatatcggtgtttgct

SEQ ID NO: 917350 - DNA, 25 bp, Mus musculus
ctgaaaggaaatatgggtgtttgct

SEQ ID NO: 917351 - DNA, 25 bp, Mus musculus
ctgaaatcaaccaacctgctcttct

SEQ ID NO: 917352 - DNA, 25 bp, Mus musculus
ctgaaatcaaccaagctgctcttct

SEQ ID NO: 917353 - DNA, 25 bp, Mus musculus
ctgaaatctgaagaaggcgccagcc

SEQ ID NO: 917354 - DNA, 25 bp, Mus musculus
ctgaaatctgaagatggcgccagcc

SEQ ID NO: 917355 - DNA, 25 bp, Mus musculus
ctgaacaaaccgatccttccatcat

SEQ ID NO: 917356 - DNA, 25 bp, Mus musculus
ctgaacaaaccgttccttccatcat

SEQ ID NO: 917357 - DNA, 25 bp, Mus musculus
ctgaacaatcacaccagcgagcact

SEQ ID NO: 917358 - DNA, 25 bp, Mus musculus
ctgaacaatcacacgagcgagcact

SEQ ID NO: 917359 - DNA, 25 bp, Mus musculus
ctgaacaattccagtatactctgga

SEQ ID NO: 917360 - DNA, 25 bp, Mus musculus
ctgaacaattcctgtatactctgga

SEQ ID NO: 917361 - DNA, 25 bp, Mus musculus
ctgaacacaatcaaccccccactgt

SEQ ID NO: 917362 - DNA, 25 bp, Mus musculus
ctgaacacaatcaacgcacttcgga

SEQ ID NO: 917363 - DNA, 25 bp, Mus musculus
ctgaacacaatcaacgtccacagga

SEQ ID NO: 917364 - DNA, 25 bp, Mus musculus
ctgaacacaatcaagcccccactgt

SEQ ID NO: 917365 - DNA, 25 bp, Mus musculus
ctgaacacaatcaaggcacttcgga

SEQ ID NO: 917366 - DNA, 25 bp, Mus musculus
ctgaacacaatcaaggtccacagga

SEQ ID NO: 917367 - DNA, 25 bp, Mus musculus
ctgaacacagcggagccgatggcag

SEQ ID NO: 917368 - DNA, 25 bp, Mus musculus
ctgaacacaggggagccgatggcag

SEQ ID NO: 917369 - DNA, 25 bp, Mus musculus
ctgaacagagggcacgaccctgtgc

SEQ ID NO: 917370 - DNA, 25 bp, Mus musculus
ctgaacagaggggacgaccctgtgc

SEQ ID NO: 917371 - DNA, 25 bp, Mus musculus
ctgaacagctggacaccacctgagg

SEQ ID NO: 917372 - DNA, 25 bp, Mus musculus
ctgaacagctggtcaccacctgagg

SEQ ID NO: 917373 - DNA, 25 bp, Mus musculus
ctgaacagtgagctacagtgtgaac

SEQ ID NO: 917374 - DNA, 25 bp, Mus musculus
ctgaacagtgaggtacagtgtgaac

SEQ ID NO: 917375 - DNA, 25 bp, Mus musculus
ctgaacagtgccatatgagaacatg

SEQ ID NO: 917376 - DNA, 25 bp, Mus musculus
ctgaacagtgccccaacataacatg

SEQ ID NO: 917377 - DNA, 25 bp, Mus musculus
ctgaacagtgccgcaacataacatg

SEQ ID NO: 917378 - DNA, 25 bp, Mus musculus
ctgaacagtgccttatgagaacatg

SEQ ID NO: 917379 - DNA, 25 bp, Mus musculus
ctgaacatcaaccgttctcccatgg

SEQ ID NO: 917380 - DNA, 25 bp, Mus musculus
ctgaacatcaacggttctcccatgg

SEQ ID NO: 917381 - DNA, 25 bp, Mus musculus
ctgaacatccagcacaaggacagca

SEQ ID NO: 917382 - DNA, 25 bp, Mus musculus
ctgaacatccaggacaaggacagca

SEQ ID NO: 917383 - DNA, 25 bp, Mus musculus
ctgaacatgatgatcaacttgttcc

SEQ ID NO: 917384 - DNA, 25 bp, Mus musculus
ctgaacatgatgatgaacttgttcc

SEQ ID NO: 917385 - DNA, 25 bp, Mus musculus
ctgaacatggtggacgcctgtctgc

SEQ ID NO: 917386 - DNA, 25 bp, Mus musculus
ctgaacatggtggaggcctgtctgc

SEQ ID NO: 917387 - DNA, 25 bp, Mus musculus
ctgaaccaagagaccgggttggaca

SEQ ID NO: 917388 - DNA, 25 bp, Mus musculus
ctgaaccaagtgaccgggttggaca

SEQ ID NO: 917389 - DNA, 25 bp, Mus musculus
ctgaaccaatattttcatggactaa

SEQ ID NO: 917390 - DNA, 25 bp, Mus musculus
ctgaaccaattttttcatggactaa

SEQ ID NO: 917391 - DNA, 25 bp, Mus musculus
ctgaaccacgatcactgctacatcc

SEQ ID NO: 917392 - DNA, 25 bp, Mus musculus
ctgaaccacgatgactgctacatcc

SEQ ID NO: 917393 - DNA, 25 bp, Mus musculus
ctgaaccactgcagcatttctggca

SEQ ID NO: 917394 - DNA, 25 bp, Mus musculus
ctgaaccactgcaggatttctggca

SEQ ID NO: 917395 - DNA, 25 bp, Mus musculus
ctgaaccatggaatccacacaacgg

SEQ ID NO: 917396 - DNA, 25 bp, Mus musculus
ctgaaccatggaatgcacacaacgg

SEQ ID NO: 917397 - DNA, 25 bp, Mus musculus
ctgaaccccagctcaccaaatgacc

SEQ ID NO: 917398 - DNA, 25 bp, Mus musculus
ctgaaccccagctctccaaatgacc

SEQ ID NO: 917399 - DNA, 25 bp, Mus musculus
ctgaacccttctacagaatttatca

SEQ ID NO: 917400 - DNA, 25 bp, Mus musculus
ctgaacccttctactgaatttatca

SEQ ID NO: 917401 - DNA, 25 bp, Mus musculus
ctgaaccgccagatcaaggcggata

SEQ ID NO: 917402 - DNA, 25 bp, Mus musculus
ctgaaccgccagttcaaggcggata

SEQ ID NO: 917403 - DNA, 25 bp, Mus musculus
ctgaaccgtcagctgcgtgtggaag

SEQ ID NO: 917404 - DNA, 25 bp, Mus musculus
ctgaaccgtcaggtgcgtgtggaag

SEQ ID NO: 917405 - DNA, 25 bp, Mus musculus
ctgaacgcctcactgactccatctc

SEQ ID NO: 917406 - DNA, 25 bp, Mus musculus
ctgaacgcctcagtgactccatctc

SEQ ID NO: 917407 - DNA, 25 bp, Mus musculus
ctgaacggcacgagcttgggaaagt

SEQ ID NO: 917408 - DNA, 25 bp, Mus musculus
ctgaacggcacgtgcttgggaaagt

SEQ ID NO: 917409 - DNA, 25 bp, Mus musculus
ctgaacgtcgtgctggacggactgt

SEQ ID NO: 917410 - DNA, 25 bp, Mus musculus
ctgaacgtcgtggtggacggactgt

SEQ ID NO: 917411 - DNA, 25 bp, Mus musculus
ctgaactaagacagaaagacatggc

SEQ ID NO: 917412 - DNA, 25 bp, Mus musculus
ctgaactaagtcagaaagacatggc

SEQ ID NO: 917413 - DNA, 25 bp, Mus musculus
ctgaactccgaacaggactatccca

SEQ ID NO: 917414 - DNA, 25 bp, Mus musculus
ctgaactccgaagaggactatccca

SEQ ID NO: 917415 - DNA, 25 bp, Mus musculus
ctgaactgtgtgaatatccccaaag

SEQ ID NO: 917416 - DNA, 25 bp, Mus musculus
ctgaactgtgtgtatatccccaaag

SEQ ID NO: 917417 - DNA, 25 bp, Mus musculus
ctgaacttgaagaagcatctgatgt

SEQ ID NO: 917418 - DNA, 25 bp, Mus musculus
ctgaacttgatgaagcatctgatgt

SEQ ID NO: 917419 - DNA, 25 bp, Mus musculus
ctgaactttgcccacgtgtggtgtg

SEQ ID NO: 917420 - DNA, 25 bp, Mus musculus
ctgaactttgcccaggtgtggtgtg

SEQ ID NO: 917421 - DNA, 25 bp, Mus musculus
ctgaagaaaaaacatcctgtgacat

SEQ ID NO: 917422 - DNA, 25 bp, Mus musculus
ctgaagaaaaaagatcctgtgacat

SEQ ID NO: 917423 - DNA, 25 bp, Mus musculus
ctgaagaagggttaatgcacgttga

SEQ ID NO: 917424 - DNA, 25 bp, Mus musculus
ctgaagaagggttattgcacgttga

SEQ ID NO: 917425 - DNA, 25 bp, Mus musculus
ctgaagaaggtgcacatctttgaga

SEQ ID NO: 917426 - DNA, 25 bp, Mus musculus
ctgaagaaggtgcagatctttgaga

SEQ ID NO: 917427 - DNA, 25 bp, Mus musculus
ctgaagaattccaaatagcatagct

SEQ ID NO: 917428 - DNA, 25 bp, Mus musculus
ctgaagaattccaaatgcttacttt

SEQ ID NO: 917429 - DNA, 25 bp, Mus musculus
ctgaagaattccaattagcatagct

SEQ ID NO: 917430 - DNA, 25 bp, Mus musculus
ctgaagaattccaattgcttacttt

SEQ ID NO: 917431 - DNA, 25 bp, Mus musculus
ctgaagacacagcggctccttattg

SEQ ID NO: 917432 - DNA, 25 bp, Mus musculus
ctgaagacacaggggctccttattg

SEQ ID NO: 917433 - DNA, 25 bp, Mus musculus
ctgaagactactcagacacaaaggt

SEQ ID NO: 917434 - DNA, 25 bp, Mus musculus
ctgaagactactgagacacaaaggt

SEQ ID NO: 917435 - DNA, 25 bp, Mus musculus
ctgaagagcgaggacacgagcaaaa

SEQ ID NO: 917436 - DNA, 25 bp, Mus musculus
ctgaagagcgaggacgtggaagata

SEQ ID NO: 917437 - DNA, 25 bp, Mus musculus
ctgaagagcgaggagacgagcaaaa

SEQ ID NO: 917438 - DNA, 25 bp, Mus musculus
ctgaagagcgaggaggtggaagata

SEQ ID NO: 917439 - DNA, 25 bp, Mus musculus
ctgaagagctactgaaatgatcagt

SEQ ID NO: 917440 - DNA, 25 bp, Mus musculus
ctgaagagctactgtaatgatcagt

SEQ ID NO: 917441 - DNA, 25 bp, Mus musculus
ctgaagatgaaaaaggtcatttact

SEQ ID NO: 917442 - DNA, 25 bp, Mus musculus
ctgaagatgagaaacgtcatttact

SEQ ID NO: 917443 - DNA, 25 bp, Mus musculus
ctgaagatgagaaaggtcatttact

SEQ ID NO: 917444 - DNA, 25 bp, Mus musculus
ctgaagatgataaaggtcatttact

SEQ ID NO: 917445 - DNA, 25 bp, Mus musculus
ctgaagcccctgccgcagactccgc

SEQ ID NO: 917446 - DNA, 25 bp, Mus musculus
ctgaagcccctggcgcagactccgc

SEQ ID NO: 917447 - DNA, 25 bp, Mus musculus
ctgaagcctcaacggcgccctgagc

SEQ ID NO: 917448 - DNA, 25 bp, Mus musculus
ctgaagcctcaagggcgccctgagc

SEQ ID NO: 917449 - DNA, 25 bp, Mus musculus
ctgaagcctgaacgtctccaccagc

SEQ ID NO: 917450 - DNA, 25 bp, Mus musculus
ctgaagcctgaaggtctccaccagc

SEQ ID NO: 917451 - DNA, 25 bp, Mus musculus
ctgaagcctgtgacagcggagcctt

SEQ ID NO: 917452 - DNA, 25 bp, Mus musculus
ctgaagcctgtgactgcagcggagc

SEQ ID NO: 917453 - DNA, 25 bp, Mus musculus
ctgaagcctgtgtcagcggagcctt

SEQ ID NO: 917454 - DNA, 25 bp, Mus musculus
ctgaagcctgtgtctgcagcggagc

SEQ ID NO: 917455 - DNA, 25 bp, Mus musculus
ctgaagcctttgccaagattgtggc

SEQ ID NO: 917456 - DNA, 25 bp, Mus musculus
ctgaagcctttggcaagattgtggc

SEQ ID NO: 917457 - DNA, 25 bp, Mus musculus
ctgaagcgagttgcagtggagaact

SEQ ID NO: 917458 - DNA, 25 bp, Mus musculus
ctgaagcgagttgctgtggagaact

SEQ ID NO: 917459 - DNA, 25 bp, Mus musculus
ctgaagctacacagatagcctcctc

SEQ ID NO: 917460 - DNA, 25 bp, Mus musculus
ctgaagctacactgatagcctcctc

SEQ ID NO: 917461 - DNA, 25 bp, Mus musculus
ctgaagctacagcgttgaaaaatac

SEQ ID NO: 917462 - DNA, 25 bp, Mus musculus
ctgaagctacagggttgaaaaatac

SEQ ID NO: 917463 - DNA, 25 bp, Mus musculus
ctgaagctggacactttaaccaccc

SEQ ID NO: 917464 - DNA, 25 bp, Mus musculus
ctgaagctggtcactttaaccaccc

SEQ ID NO: 917465 - DNA, 25 bp, Mus musculus
ctgaagctttcaaacccattggcac

SEQ ID NO: 917466 - DNA, 25 bp, Mus musculus
ctgaagctttcaaagccattggcac

SEQ ID NO: 917467 - DNA, 25 bp, Mus musculus
ctgaaggaagctgtgcgccttgacc

SEQ ID NO: 917468 - DNA, 25 bp, Mus musculus
ctgaaggaaggtgtgcgccttgacc

SEQ ID NO: 917469 - DNA, 25 bp, Mus musculus
ctgaaggaatgccatatcaacgaat

SEQ ID NO: 917470 - DNA, 25 bp, Mus musculus
ctgaaggaatgcgatatcaacgaat

SEQ ID NO: 917471 - DNA, 25 bp, Mus musculus
ctgaaggacttgcaaaccttgatcc

SEQ ID NO: 917472 - DNA, 25 bp, Mus musculus
ctgaaggacttgcataccttgatcc

SEQ ID NO: 917473 - DNA, 25 bp, Mus musculus
ctgaaggagatgccaattccggtct

SEQ ID NO: 917474 - DNA, 25 bp, Mus musculus
ctgaaggagatggcaattccggtct

SEQ ID NO: 917475 - DNA, 25 bp, Mus musculus
ctgaaggagccaaacttggcaagct

SEQ ID NO: 917476 - DNA, 25 bp, Mus musculus
ctgaaggagccaaagttggcaagct

SEQ ID NO: 917477 - DNA, 25 bp, Mus musculus
ctgaaggatgagagtcctgaagtcc

SEQ ID NO: 917478 - DNA, 25 bp, Mus musculus
ctgaaggatgagtgtcctgaagtcc

SEQ ID NO: 917479 - DNA, 25 bp, Mus musculus
ctgaaggcagctgacactgtcatcc

SEQ ID NO: 917480 - DNA, 25 bp, Mus musculus
ctgaaggcaggtgacactgtcatcc

SEQ ID NO: 917481 - DNA, 25 bp, Mus musculus
ctgaaggcccagctcctgccccctc

SEQ ID NO: 917482 - DNA, 25 bp, Mus musculus
ctgaaggcccaggtcctgccccctc

SEQ ID NO: 917483 - DNA, 25 bp, Mus musculus
ctgaaggcctggatctgcataagca

SEQ ID NO: 917484 - DNA, 25 bp, Mus musculus
ctgaaggcctggttctgcataagca

SEQ ID NO: 917485 - DNA, 25 bp, Mus musculus
ctgaaggctagacgcctgacaggtt

SEQ ID NO: 917486 - DNA, 25 bp, Mus musculus
ctgaaggctagaggcctgacaggtt

SEQ ID NO: 917487 - DNA, 25 bp, Mus musculus
ctgaaggggccccccctctctgtga

SEQ ID NO: 917488 - DNA, 25 bp, Mus musculus
ctgaaggggcccccgctctctgtga

SEQ ID NO: 917489 - DNA, 25 bp, Mus musculus
ctgaagtacttggacgacagcaaga

SEQ ID NO: 917490 - DNA, 25 bp, Mus musculus
ctgaagtacttggaggacagcaaga

SEQ ID NO: 917491 - DNA, 25 bp, Mus musculus
ctgaagtgagagggcccagccacgg

SEQ ID NO: 917492 - DNA, 25 bp, Mus musculus
ctgaagtgagcggggtccagcgagt

SEQ ID NO: 917493 - DNA, 25 bp, Mus musculus
ctgaagtgaggggggtccagcgagt

SEQ ID NO: 917494 - DNA, 25 bp, Mus musculus
ctgaagtgagtgggcccagccacgg

SEQ ID NO: 917495 - DNA, 25 bp, Mus musculus
ctgaagtgattactcgaaccctgtg

SEQ ID NO: 917496 - DNA, 25 bp, Mus musculus
ctgaagtgattactggaaccctgtg

SEQ ID NO: 917497 - DNA, 25 bp, Mus musculus
ctgaagtggcagcttgtttttccgg

SEQ ID NO: 917498 - DNA, 25 bp, Mus musculus
ctgaagtggcaggttgtttttccgg

SEQ ID NO: 917499 - DNA, 25 bp, Mus musculus
ctgaagtgtggcttcgtacctggaa

SEQ ID NO: 917500 - DNA, 25 bp, Mus musculus
ctgaagtgtggcttggtacctggaa

SEQ ID NO: 917501 - DNA, 25 bp, Mus musculus
ctgaagttcatgatggcttgtgcca

SEQ ID NO: 917502 - DNA, 25 bp, Mus musculus
ctgaagttcatgttggcttgtgcca

SEQ ID NO: 917503 - DNA, 25 bp, Mus musculus
ctgaataagcaccgtaagcagatcc

SEQ ID NO: 917504 - DNA, 25 bp, Mus musculus
ctgaataagcacggtaagcagatcc

SEQ ID NO: 917505 - DNA, 25 bp, Mus musculus
ctgaatacacagcccccagtgcctt

SEQ ID NO: 917506 - DNA, 25 bp, Mus musculus
ctgaatacacaggccccagtgcctt

SEQ ID NO: 917507 - DNA, 25 bp, Mus musculus
ctgaatagcgtgcctcaggagccgt

SEQ ID NO: 917508 - DNA, 25 bp, Mus musculus
ctgaatagcgtggctcaggagccgt

SEQ ID NO: 917509 - DNA, 25 bp, Mus musculus
ctgaatagttttcgcttggatgcca

SEQ ID NO: 917510 - DNA, 25 bp, Mus musculus
ctgaatagttttggcttggatgcca

SEQ ID NO: 917511 - DNA, 25 bp, Mus musculus
ctgaatataaaaagaaagaaatggg

SEQ ID NO: 917512 - DNA, 25 bp, Mus musculus
ctgaatataataagaaagaaatggg

SEQ ID NO: 917513 - DNA, 25 bp, Mus musculus
ctgaatatgaagcacaatcagttaa

SEQ ID NO: 917514 - DNA, 25 bp, Mus musculus
ctgaatatgaaggacaatcagttaa

SEQ ID NO: 917515 - DNA, 25 bp, Mus musculus
ctgaatcacttcaacgtggacctgg

SEQ ID NO: 917516 - DNA, 25 bp, Mus musculus
ctgaatcacttcaaggtggacctgg

SEQ ID NO: 917517 - DNA, 25 bp, Mus musculus
ctgaatctagagcgtgagaaagtcc

SEQ ID NO: 917518 - DNA, 25 bp, Mus musculus
ctgaatctagagggtgagaaagtcc

SEQ ID NO: 917519 - DNA, 25 bp, Mus musculus
ctgaatcttaacaacggataactct

SEQ ID NO: 917520 - DNA, 25 bp, Mus musculus
ctgaatcttaacaagggataactct

SEQ ID NO: 917521 - DNA, 25 bp, Mus musculus
ctgaatgacagactagacgagcttt

SEQ ID NO: 917522 - DNA, 25 bp, Mus musculus
ctgaatgacagagtagacgagcttt

SEQ ID NO: 917523 - DNA, 25 bp, Mus musculus
ctgaatgcagatggaatgccaagat

SEQ ID NO: 917524 - DNA, 25 bp, Mus musculus
ctgaatgcagattgaggatgggtac

SEQ ID NO: 917525 - DNA, 25 bp, Mus musculus
ctgaatgcagttggaatgccaagat

SEQ ID NO: 917526 - DNA, 25 bp, Mus musculus
ctgaatgcagtttgaggatgggtac

SEQ ID NO: 917527 - DNA, 25 bp, Mus musculus
ctgaatgccaacaaactacaactcc

SEQ ID NO: 917528 - DNA, 25 bp, Mus musculus
ctgaatgccatcaaactacaactcc

SEQ ID NO: 917529 - DNA, 25 bp, Mus musculus
ctgaatgctccacgactcaattact

SEQ ID NO: 917530 - DNA, 25 bp, Mus musculus
ctgaatgctccaggactcaattact

SEQ ID NO: 917531 - DNA, 25 bp, Mus musculus
ctgaatgggcacaacgcgacccaag

SEQ ID NO: 917532 - DNA, 25 bp, Mus musculus
ctgaatgggcacaacggtgtggact

SEQ ID NO: 917533 - DNA, 25 bp, Mus musculus
ctgaatgggcacaaggcgacccaag

SEQ ID NO: 917534 - DNA, 25 bp, Mus musculus
ctgaatgggcacaagggtgtggact

SEQ ID NO: 917535 - DNA, 25 bp, Mus musculus
ctgaatggggagctacaggcagaga

SEQ ID NO: 917536 - DNA, 25 bp, Mus musculus
ctgaatggggaggtacaggcagaga

SEQ ID NO: 917537 - DNA, 25 bp, Mus musculus
ctgaatgtgaagagatctcaggggt

SEQ ID NO: 917538 - DNA, 25 bp, Mus musculus
ctgaatgtgaagtgatctcaggggt

SEQ ID NO: 917539 - DNA, 25 bp, Mus musculus
ctgaatgtggctcacgcttattatg

SEQ ID NO: 917540 - DNA, 25 bp, Mus musculus
ctgaatgtggctcaggcttattatg

SEQ ID NO: 917541 - DNA, 25 bp, Mus musculus
ctgaatgtgtggatgtgaatgagtg

SEQ ID NO: 917542 - DNA, 25 bp, Mus musculus
ctgaatgtgtggttgtgaatgagtg

SEQ ID NO: 917543 - DNA, 25 bp, Mus musculus
ctgaatgtttatcagaacactgata

SEQ ID NO: 917544 - DNA, 25 bp, Mus musculus
ctgaatgtttatgagaacactgata

SEQ ID NO: 917545 - DNA, 25 bp, Mus musculus
ctgaattctgtgaaataccacggat

SEQ ID NO: 917546 - DNA, 25 bp, Mus musculus
ctgaattctgtgtaataccacggat

SEQ ID NO: 917547 - DNA, 25 bp, Mus musculus
ctgaatttatcgacagatacagagt

SEQ ID NO: 917548 - DNA, 25 bp, Mus musculus
ctgaatttatcgtcagatacagagt

SEQ ID NO: 917549 - DNA, 25 bp, Mus musculus
ctgacaaaaacgatgcacccccact

SEQ ID NO: 917550 - DNA, 25 bp, Mus musculus
ctgacaaaaaggatgcacccccact

SEQ ID NO: 917551 - DNA, 25 bp, Mus musculus
ctgacaaacaagacagtaatggcac

SEQ ID NO: 917552 - DNA, 25 bp, Mus musculus
ctgacaaacaagtcagtaatggcac

SEQ ID NO: 917553 - DNA, 25 bp, Mus musculus
ctgacaaagaagcagcaccctccag

SEQ ID NO: 917554 - DNA, 25 bp, Mus musculus
ctgacaaagaagcctggattctcat

SEQ ID NO: 917555 - DNA, 25 bp, Mus musculus
ctgacaaagaaggagcaccctccag

SEQ ID NO: 917556 - DNA, 25 bp, Mus musculus
ctgacaaagaaggctggattctcat

SEQ ID NO: 917557 - DNA, 25 bp, Mus musculus
ctgacaaatgacacccagtcttctg

SEQ ID NO: 917558 - DNA, 25 bp, Mus musculus
ctgacaaatgactcccagtcttctg

SEQ ID NO: 917559 - DNA, 25 bp, Mus musculus
ctgacaacaaagctatgtcaccagt

SEQ ID NO: 917560 - DNA, 25 bp, Mus musculus
ctgacaacaaaggtatgtcaccagt

SEQ ID NO: 917561 - DNA, 25 bp, Mus musculus
ctgacaacaagaacctctgtgtcca

SEQ ID NO: 917562 - DNA, 25 bp, Mus musculus
ctgacaacaagatcctctgtgtcca

SEQ ID NO: 917563 - DNA, 25 bp, Mus musculus
ctgacaacagccaagagaaacatca

SEQ ID NO: 917564 - DNA, 25 bp, Mus musculus
ctgacaacagctcaccttcgtctcc

SEQ ID NO: 917565 - DNA, 25 bp, Mus musculus
ctgacaacaggcaagagaaacatca

SEQ ID NO: 917566 - DNA, 25 bp, Mus musculus
ctgacaacaggtcaccttcgtctcc

SEQ ID NO: 917567 - DNA, 25 bp, Mus musculus
ctgacaacagtctcagccctgcctg

SEQ ID NO: 917568 - DNA, 25 bp, Mus musculus
ctgacaacagtctctgccctgcctg

SEQ ID NO: 917569 - DNA, 25 bp, Mus musculus
ctgacacacctccgggccctcatgg

SEQ ID NO: 917570 - DNA, 25 bp, Mus musculus
ctgacacacctcggggccctcatgg

SEQ ID NO: 917571 - DNA, 25 bp, Mus musculus
ctgacacagctctgatgtacgacaa

SEQ ID NO: 917572 - DNA, 25 bp, Mus musculus
ctgacacagctctgttgtacgacaa

SEQ ID NO: 917573 - DNA, 25 bp, Mus musculus
ctgacaccagcctcaggacatggag

SEQ ID NO: 917574 - DNA, 25 bp, Mus musculus
ctgacaccaggctcaggacatggag

SEQ ID NO: 917575 - DNA, 25 bp, Mus musculus
ctgacaccgtacgacgcagctgtgg

SEQ ID NO: 917576 - DNA, 25 bp, Mus musculus
ctgacaccgtacgaggcagctgtgg

SEQ ID NO: 917577 - DNA, 25 bp, Mus musculus
ctgacacctcagcgcacacttgccg

SEQ ID NO: 917578 - DNA, 25 bp, Mus musculus
ctgacacctcagggcacacttgccg

SEQ ID NO: 917579 - DNA, 25 bp, Mus musculus
ctgacactgactctcatggtaccaa

SEQ ID NO: 917580 - DNA, 25 bp, Mus musculus
ctgacactgagtctcatggtaccaa

SEQ ID NO: 917581 - DNA, 25 bp, Mus musculus
ctgacactttcgcctccaccatgga

SEQ ID NO: 917582 - DNA, 25 bp, Mus musculus
ctgacactttcggctccaccatgga

SEQ ID NO: 917583 - DNA, 25 bp, Mus musculus
ctgacagagcagctgtcttagctgg

SEQ ID NO: 917584 - DNA, 25 bp, Mus musculus
ctgacagagcaggtgtcttagctgg

SEQ ID NO: 917585 - DNA, 25 bp, Mus musculus
ctgacagatgatatcctggacaaat

SEQ ID NO: 917586 - DNA, 25 bp, Mus musculus
ctgacagatgatatgctggacaaat

SEQ ID NO: 917587 - DNA, 25 bp, Mus musculus
ctgacagccccccacaagtgtcaac

SEQ ID NO: 917588 - DNA, 25 bp, Mus musculus
ctgacagccccccagaagtgtcaac

SEQ ID NO: 917589 - DNA, 25 bp, Mus musculus
ctgacagcctgtcaatccctggcca

SEQ ID NO: 917590 - DNA, 25 bp, Mus musculus
ctgacagcctgtgaatccctggcca

SEQ ID NO: 917591 - DNA, 25 bp, Mus musculus
ctgacagctgcatcactgatgggcg

SEQ ID NO: 917592 - DNA, 25 bp, Mus musculus
ctgacagctggatcactgatgggcg

SEQ ID NO: 917593 - DNA, 25 bp, Mus musculus
ctgacagtcaatacgccccctcagt

SEQ ID NO: 917594 - DNA, 25 bp, Mus musculus
ctgacagtcaattcgccccctcagt

SEQ ID NO: 917595 - DNA, 25 bp, Mus musculus
ctgacagtgccggtcctgtaagagg

SEQ ID NO: 917596 - DNA, 25 bp, Mus musculus
ctgacagtgccggtgctgtaagagg

SEQ ID NO: 917597 - DNA, 25 bp, Mus musculus
ctgacagtttggaaaacattcctga

SEQ ID NO: 917598 - DNA, 25 bp, Mus musculus
ctgacagtttggtaaacattcctga

SEQ ID NO: 917599 - DNA, 25 bp, Mus musculus
ctgacatccccgtctgccttctagg

SEQ ID NO: 917600 - DNA, 25 bp, Mus musculus
ctgacatcccggtctgccttctagg

SEQ ID NO: 917601 - DNA, 25 bp, Mus musculus
ctgacatctgccccgtgggcgtcgt

SEQ ID NO: 917602 - DNA, 25 bp, Mus musculus
ctgacatctggcccgtgggcgtcgt

SEQ ID NO: 917603 - DNA, 25 bp, Mus musculus
ctgacatgtgcagcattggcgtcat

SEQ ID NO: 917604 - DNA, 25 bp, Mus musculus
ctgacatgtgcctgagcggagcgtc

SEQ ID NO: 917605 - DNA, 25 bp, Mus musculus
ctgacatgtggagcattggcgtcat

SEQ ID NO: 917606 - DNA, 25 bp, Mus musculus
ctgacatgtggctgagcggagcgtc

SEQ ID NO: 917607 - DNA, 25 bp, Mus musculus
ctgacattatttcttaatggccagc

SEQ ID NO: 917608 - DNA, 25 bp, Mus musculus
ctgacattatttgttaatggccagc

SEQ ID NO: 917609 - DNA, 25 bp, Mus musculus
ctgaccaactgaaacaggttggcat

SEQ ID NO: 917610 - DNA, 25 bp, Mus musculus
ctgaccaactgaaagaggttggcat

SEQ ID NO: 917611 - DNA, 25 bp, Mus musculus
ctgaccaccacgccatcacggctgc

SEQ ID NO: 917612 - DNA, 25 bp, Mus musculus
ctgaccaccacggcatcacggctgc

SEQ ID NO: 917613 - DNA, 25 bp, Mus musculus
ctgaccagagagcttctgtgtggag

SEQ ID NO: 917614 - DNA, 25 bp, Mus musculus
ctgaccagagtgcttctgtgtggag

SEQ ID NO: 917615 - DNA, 25 bp, Mus musculus
ctgaccagtgacaccaatatgcctg

SEQ ID NO: 917616 - DNA, 25 bp, Mus musculus
ctgaccagtgactccaatatgcctg

SEQ ID NO: 917617 - DNA, 25 bp, Mus musculus
ctgaccatccccaactcatcaagcc

SEQ ID NO: 917618 - DNA, 25 bp, Mus musculus
ctgaccatccccaagtcatcaagcc

SEQ ID NO: 917619 - DNA, 25 bp, Mus musculus
ctgaccatggccaacatggagttcc

SEQ ID NO: 917620 - DNA, 25 bp, Mus musculus
ctgaccatggccaagatggagttcc

SEQ ID NO: 917621 - DNA, 25 bp, Mus musculus
ctgacccaagagattgctatggagc

SEQ ID NO: 917622 - DNA, 25 bp, Mus musculus
ctgacccaagcttatgatggagcag

SEQ ID NO: 917623 - DNA, 25 bp, Mus musculus
ctgacccaaggttatgatggagcag

SEQ ID NO: 917624 - DNA, 25 bp, Mus musculus
ctgacccaagtgattgctatggagc

SEQ ID NO: 917625 - DNA, 25 bp, Mus musculus
ctgacccagttactccctggcaggc

SEQ ID NO: 917626 - DNA, 25 bp, Mus musculus
ctgacccagttagtccctggcaggc

SEQ ID NO: 917627 - DNA, 25 bp, Mus musculus
ctgaccccagagaccccagactcgg

SEQ ID NO: 917628 - DNA, 25 bp, Mus musculus
ctgaccccagagtccccagactcgg

SEQ ID NO: 917629 - DNA, 25 bp, Mus musculus
ctgacccccaagaggccattaactg

SEQ ID NO: 917630 - DNA, 25 bp, Mus musculus
ctgacccccaagcccatcgcccact

SEQ ID NO: 917631 - DNA, 25 bp, Mus musculus
ctgacccccaaggccatcgcccact

SEQ ID NO: 917632 - DNA, 25 bp, Mus musculus
ctgacccccaagtggccattaactg

SEQ ID NO: 917633 - DNA, 25 bp, Mus musculus
ctgaccctgaagacacaacaggctg

SEQ ID NO: 917634 - DNA, 25 bp, Mus musculus
ctgaccctgaagtcacaacaggctg

SEQ ID NO: 917635 - DNA, 25 bp, Mus musculus
ctgaccgaagagctctggctggagt

SEQ ID NO: 917636 - DNA, 25 bp, Mus musculus
ctgaccgaagtgctctggctggagt

SEQ ID NO: 917637 - DNA, 25 bp, Mus musculus
ctgaccgttgaatcttttgagcata

SEQ ID NO: 917638 - DNA, 25 bp, Mus musculus
ctgaccgttgtatcttttgagcata

SEQ ID NO: 917639 - DNA, 25 bp, Mus musculus
ctgacctagacactttgaaggataa

SEQ ID NO: 917640 - DNA, 25 bp, Mus musculus
ctgacctagacagtttgaaggataa

SEQ ID NO: 917641 - DNA, 25 bp, Mus musculus
ctgacctcacagatgccacgcccac

SEQ ID NO: 917642 - DNA, 25 bp, Mus musculus
ctgacctcacagttgccacgcccac

SEQ ID NO: 917643 - DNA, 25 bp, Mus musculus
ctgacctccgcctcttcagtctgtc

SEQ ID NO: 917644 - DNA, 25 bp, Mus musculus
ctgacctccggctcttcagtctgtc

SEQ ID NO: 917645 - DNA, 25 bp, Mus musculus
ctgacctgagtccgcagaacgcttt

SEQ ID NO: 917646 - DNA, 25 bp, Mus musculus
ctgacctgagtcggcagaacgcttt

SEQ ID NO: 917647 - DNA, 25 bp, Mus musculus
ctgaccttcaatagactgctggaaa

SEQ ID NO: 917648 - DNA, 25 bp, Mus musculus
ctgaccttcaatagtctgctggaaa

SEQ ID NO: 917649 - DNA, 25 bp, Mus musculus
ctgaccttgaagcggactcagaaga

SEQ ID NO: 917650 - DNA, 25 bp, Mus musculus
ctgaccttgaaggggactcagaaga

SEQ ID NO: 917651 - DNA, 25 bp, Mus musculus
ctgaccttgttgcaagtgggcacat

SEQ ID NO: 917652 - DNA, 25 bp, Mus musculus
ctgaccttgttggaagtgggcacat

SEQ ID NO: 917653 - DNA, 25 bp, Mus musculus
ctgacgcagaacctggctcggctga

SEQ ID NO: 917654 - DNA, 25 bp, Mus musculus
ctgacgcagaacgtggctcggctga

SEQ ID NO: 917655 - DNA, 25 bp, Mus musculus
ctgacgctctacaccatgcggccga

SEQ ID NO: 917656 - DNA, 25 bp, Mus musculus
ctgacgctctacacgatgcggccga

SEQ ID NO: 917657 - DNA, 25 bp, Mus musculus
ctgacggagcagaagacccagcatg

SEQ ID NO: 917658 - DNA, 25 bp, Mus musculus
ctgacggagcagacccagcatggag

SEQ ID NO: 917659 - DNA, 25 bp, Mus musculus
ctgacggagcagccctgtctcgtca

SEQ ID NO: 917660 - DNA, 25 bp, Mus musculus
ctgacggagcaggcctgtctcgtca

SEQ ID NO: 917661 - DNA, 25 bp, Mus musculus
ctgacggagcagtagacccagcatg

SEQ ID NO: 917662 - DNA, 25 bp, Mus musculus
ctgacggagcagtcccagcatggag

SEQ ID NO: 917663 - DNA, 25 bp, Mus musculus
ctgacggaggagaaagagcggacct

SEQ ID NO: 917664 - DNA, 25 bp, Mus musculus
ctgacggaggagtaagagcggacct

SEQ ID NO: 917665 - DNA, 25 bp, Mus musculus
ctgacggggaaagacgtagctgtga

SEQ ID NO: 917666 - DNA, 25 bp, Mus musculus
ctgacggggaaagaggtagctgtga

SEQ ID NO: 917667 - DNA, 25 bp, Mus musculus
ctgacgtagccaaacggatgcatta

SEQ ID NO: 917668 - DNA, 25 bp, Mus musculus
ctgacgtagccaaagggatgcatta

SEQ ID NO: 917669 - DNA, 25 bp, Mus musculus
ctgacgtgagcaccccccagccctg

SEQ ID NO: 917670 - DNA, 25 bp, Mus musculus
ctgacgtgaggaccccccagccctg

SEQ ID NO: 917671 - DNA, 25 bp, Mus musculus
ctgacgtgcgatagcgtgtctataa

SEQ ID NO: 917672 - DNA, 25 bp, Mus musculus
ctgacgtgcgatagggtgtctataa

SEQ ID NO: 917673 - DNA, 25 bp, Mus musculus
ctgactactgcacccagcggccccg

SEQ ID NO: 917674 - DNA, 25 bp, Mus musculus
ctgactactgcagccagcggccccg

SEQ ID NO: 917675 - DNA, 25 bp, Mus musculus
ctgactatagcatacgaaaccttca

SEQ ID NO: 917676 - DNA, 25 bp, Mus musculus
ctgactatagcataggaaaccttca

SEQ ID NO: 917677 - DNA, 25 bp, Mus musculus
ctgactcagaacaggtgagaactca

SEQ ID NO: 917678 - DNA, 25 bp, Mus musculus
ctgactcagactggccccagtcttc

SEQ ID NO: 917679 - DNA, 25 bp, Mus musculus
ctgactcagactgggcccagtcttc

SEQ ID NO: 917680 - DNA, 25 bp, Mus musculus
ctgactcagatcaggtgagaactca

SEQ ID NO: 917681 - DNA, 25 bp, Mus musculus
ctgactccattaatagtgaggttgg

SEQ ID NO: 917682 - DNA, 25 bp, Mus musculus
ctgactccattaattgtgaggttgg

SEQ ID NO: 917683 - DNA, 25 bp, Mus musculus
ctgactctacagccactacgaaggt

SEQ ID NO: 917684 - DNA, 25 bp, Mus musculus
ctgactctacagccattgggcatgg

SEQ ID NO: 917685 - DNA, 25 bp, Mus musculus
ctgactctacaggcactacgaaggt

SEQ ID NO: 917686 - DNA, 25 bp, Mus musculus
ctgactctacaggcattgggcatgg

SEQ ID NO: 917687 - DNA, 25 bp, Mus musculus
ctgactctgcaaacagtgccaccaa

SEQ ID NO: 917688 - DNA, 25 bp, Mus musculus
ctgactctgcaaactgtgccaccaa

SEQ ID NO: 917689 - DNA, 25 bp, Mus musculus
ctgactctgcagcgacctctagtgc

SEQ ID NO: 917690 - DNA, 25 bp, Mus musculus
ctgactctgcagggacctctagtgc

SEQ ID NO: 917691 - DNA, 25 bp, Mus musculus
ctgactgagagccaaattgttcaga

SEQ ID NO: 917692 - DNA, 25 bp, Mus musculus
ctgactgagagccatattgttcaga

SEQ ID NO: 917693 - DNA, 25 bp, Mus musculus
ctgactgagcacactctgcagagga

SEQ ID NO: 917694 - DNA, 25 bp, Mus musculus
ctgactgagcacccggtggagggag

SEQ ID NO: 917695 - DNA, 25 bp, Mus musculus
ctgactgagcacgcggtggagggag

SEQ ID NO: 917696 - DNA, 25 bp, Mus musculus
ctgactgagcactctctgcagagga

SEQ ID NO: 917697 - DNA, 25 bp, Mus musculus
ctgactgataagtcttctattttta

SEQ ID NO: 917698 - DNA, 25 bp, Mus musculus
ctgactgatatgtcttctattttta

SEQ ID NO: 917699 - DNA, 25 bp, Mus musculus
ctgactgcagagctgtatctccagt

SEQ ID NO: 917700 - DNA, 25 bp, Mus musculus
ctgactgcagaggtgtatctccagt

SEQ ID NO: 917701 - DNA, 25 bp, Mus musculus
ctgactgcagatctgatttgtactc

SEQ ID NO: 917702 - DNA, 25 bp, Mus musculus
ctgactgcagttctgatttgtactc

SEQ ID NO: 917703 - DNA, 25 bp, Mus musculus
ctgactgcctgactcgaaagccacc

SEQ ID NO: 917704 - DNA, 25 bp, Mus musculus
ctgactgcctgactggaaagccacc

SEQ ID NO: 917705 - DNA, 25 bp, Mus musculus
ctgactgcggcacacgccttcacag

SEQ ID NO: 917706 - DNA, 25 bp, Mus musculus
ctgactgcggcacaggccttcacag

SEQ ID NO: 917707 - DNA, 25 bp, Mus musculus
ctgactgtgaagaggctgccctgga

SEQ ID NO: 917708 - DNA, 25 bp, Mus musculus
ctgactgtgaagtggctgccctgga

SEQ ID NO: 917709 - DNA, 25 bp, Mus musculus
ctgactgtgcacaaggcccccagag

SEQ ID NO: 917710 - DNA, 25 bp, Mus musculus
ctgactgtgcactaggcccccagag

SEQ ID NO: 917711 - DNA, 25 bp, Mus musculus
ctgactgtggagccctttgtcagcc

SEQ ID NO: 917712 - DNA, 25 bp, Mus musculus
ctgactgtggaggcctttgtcagcc

SEQ ID NO: 917713 - DNA, 25 bp, Mus musculus
ctgacttcagcgatgttctatgtaa

SEQ ID NO: 917714 - DNA, 25 bp, Mus musculus
ctgacttcagcgcttttgcaggggc

SEQ ID NO: 917715 - DNA, 25 bp, Mus musculus
ctgacttcaggccggcttttgcagg

SEQ ID NO: 917716 - DNA, 25 bp, Mus musculus
ctgacttcaggcgggcttttgcagg

SEQ ID NO: 917717 - DNA, 25 bp, Mus musculus
ctgacttcagggatgttctatgtaa

SEQ ID NO: 917718 - DNA, 25 bp, Mus musculus
ctgacttcagggcttttgcaggggc

SEQ ID NO: 917719 - DNA, 25 bp, Mus musculus
ctgacttcctttgaaattccagcta

SEQ ID NO: 917720 - DNA, 25 bp, Mus musculus
ctgacttcctttgatattccagcta

SEQ ID NO: 917721 - DNA, 25 bp, Mus musculus
ctgacttcgacacgtatctcctgtt

SEQ ID NO: 917722 - DNA, 25 bp, Mus musculus
ctgacttcgacaggtatctcctgtt

SEQ ID NO: 917723 - DNA, 25 bp, Mus musculus
ctgacttgagagccccaggatgggt

SEQ ID NO: 917724 - DNA, 25 bp, Mus musculus
ctgacttgagaggcccaggatgggt

SEQ ID NO: 917725 - DNA, 25 bp, Mus musculus
ctgacttgctagcaggtcttttctc

SEQ ID NO: 917726 - DNA, 25 bp, Mus musculus
ctgacttgctaggaggtcttttctc

SEQ ID NO: 917727 - DNA, 25 bp, Mus musculus
ctgacttgctatcacgtgtactgca

SEQ ID NO: 917728 - DNA, 25 bp, Mus musculus
ctgacttgctatcaggtgtactgca

SEQ ID NO: 917729 - DNA, 25 bp, Mus musculus
ctgactttgaccacaggatccccaa

SEQ ID NO: 917730 - DNA, 25 bp, Mus musculus
ctgactttgagcacaggatccccaa

SEQ ID NO: 917731 - DNA, 25 bp, Mus musculus
ctgactttgatgagctacagtatca

SEQ ID NO: 917732 - DNA, 25 bp, Mus musculus
ctgactttgatgaggtacagtatca

SEQ ID NO: 917733 - DNA, 25 bp, Mus musculus
ctgagaaactcggtgctcttctctc

SEQ ID NO: 917734 - DNA, 25 bp, Mus musculus
ctgagaaactgggtgctcttctctc

SEQ ID NO: 917735 - DNA, 25 bp, Mus musculus
ctgagaaagcataacaatgttttga

SEQ ID NO: 917736 - DNA, 25 bp, Mus musculus
ctgagaaagcataacgtgactcata

SEQ ID NO: 917737 - DNA, 25 bp, Mus musculus
ctgagaaagcataagaatgttttga

SEQ ID NO: 917738 - DNA, 25 bp, Mus musculus
ctgagaaagcataaggtgactcata

SEQ ID NO: 917739 - DNA, 25 bp, Mus musculus
ctgagaaatgcacgaatctccggtt

SEQ ID NO: 917740 - DNA, 25 bp, Mus musculus
ctgagaaatgcaggaatctccggtt

SEQ ID NO: 917741 - DNA, 25 bp, Mus musculus
ctgagaacagagcacctacgaagaa

SEQ ID NO: 917742 - DNA, 25 bp, Mus musculus
ctgagaacagagcagctacgaagaa

SEQ ID NO: 917743 - DNA, 25 bp, Mus musculus
ctgagaacagcaagcccagccctgg

SEQ ID NO: 917744 - DNA, 25 bp, Mus musculus
ctgagaacaggaagcccagccctgg

SEQ ID NO: 917745 - DNA, 25 bp, Mus musculus
ctgagaatatctacttttctcactt

SEQ ID NO: 917746 - DNA, 25 bp, Mus musculus
ctgagaatatgtacttttctcactt

SEQ ID NO: 917747 - DNA, 25 bp, Mus musculus
ctgagaatgactcgtgggtgagcaa

SEQ ID NO: 917748 - DNA, 25 bp, Mus musculus
ctgagaatgactggtgggtgagcaa

SEQ ID NO: 917749 - DNA, 25 bp, Mus musculus
ctgagaattcaactctgtcacctaa

SEQ ID NO: 917750 - DNA, 25 bp, Mus musculus
ctgagaattcaagtctgtcacctaa

SEQ ID NO: 917751 - DNA, 25 bp, Mus musculus
ctgagacccgctacgtgtcagaact

SEQ ID NO: 917752 - DNA, 25 bp, Mus musculus
ctgagacccggtacgtgtcagaact

SEQ ID NO: 917753 - DNA, 25 bp, Mus musculus
ctgagacctcccctcgaagagccag

SEQ ID NO: 917754 - DNA, 25 bp, Mus musculus
ctgagacctcccctggaagagccag

SEQ ID NO: 917755 - DNA, 25 bp, Mus musculus
ctgagacggttctacatccctttca

SEQ ID NO: 917756 - DNA, 25 bp, Mus musculus
ctgagacggttctagatccctttca

SEQ ID NO: 917757 - DNA, 25 bp, Mus musculus
ctgagagaaactgcaagaaaaatga

SEQ ID NO: 917758 - DNA, 25 bp, Mus musculus
ctgagagaaagtgcaagaaaaatga

SEQ ID NO: 917759 - DNA, 25 bp, Mus musculus
ctgagagaagcatgtcacagctgag

SEQ ID NO: 917760 - DNA, 25 bp, Mus musculus
ctgagagaaggatgtcacagctgag

SEQ ID NO: 917761 - DNA, 25 bp, Mus musculus
ctgagagacaagacaggccagctgc

SEQ ID NO: 917762 - DNA, 25 bp, Mus musculus
ctgagagacaagtcaggccagctgc

SEQ ID NO: 917763 - DNA, 25 bp, Mus musculus
ctgagagataagccacctccaagtg

SEQ ID NO: 917764 - DNA, 25 bp, Mus musculus
ctgagagataaggcacctccaagtg

SEQ ID NO: 917765 - DNA, 25 bp, Mus musculus
ctgagagatcccagcatatcaatga

SEQ ID NO: 917766 - DNA, 25 bp, Mus musculus
ctgagagatcccaggatatcaatga

SEQ ID NO: 917767 - DNA, 25 bp, Mus musculus
ctgagagatctccgtgtgccaccag

SEQ ID NO: 917768 - DNA, 25 bp, Mus musculus
ctgagagatctcggtgtgccaccag

SEQ ID NO: 917769 - DNA, 25 bp, Mus musculus
ctgagagattagaacaaaaccacga

SEQ ID NO: 917770 - DNA, 25 bp, Mus musculus
ctgagagattagaagaaaaccacga

SEQ ID NO: 917771 - DNA, 25 bp, Mus musculus
ctgagagcgatgctcgtgggaaggc

SEQ ID NO: 917772 - DNA, 25 bp, Mus musculus
ctgagagcgatgctggtgggaaggc

SEQ ID NO: 917773 - DNA, 25 bp, Mus musculus
ctgagaggaacccttctctgaggat

SEQ ID NO: 917774 - DNA, 25 bp, Mus musculus
ctgagaggaacttttatctgtgcaa

SEQ ID NO: 917775 - DNA, 25 bp, Mus musculus
ctgagaggaacttttatctgtgcag

SEQ ID NO: 917776 - DNA, 25 bp, Mus musculus
ctgagaggaagccttctctgaggat

SEQ ID NO: 917777 - DNA, 25 bp, Mus musculus
ctgagaggaagttttatctgtgcaa

SEQ ID NO: 917778 - DNA, 25 bp, Mus musculus
ctgagaggaagttttatctgtgcag

SEQ ID NO: 917779 - DNA, 25 bp, Mus musculus
ctgagagtcctgaggattgtgaaca

SEQ ID NO: 917780 - DNA, 25 bp, Mus musculus
ctgagagtcctgtggattgtgaaca

SEQ ID NO: 917781 - DNA, 25 bp, Mus musculus
ctgagagtcgggccctgtctccaac

SEQ ID NO: 917782 - DNA, 25 bp, Mus musculus
ctgagagtcgggcgcctggtgtaca

SEQ ID NO: 917783 - DNA, 25 bp, Mus musculus
ctgagagtcggggcctgtctccaac

SEQ ID NO: 917784 - DNA, 25 bp, Mus musculus
ctgagagtcgggggcctggtgtaca

SEQ ID NO: 917785 - DNA, 25 bp, Mus musculus
ctgagataagcaggatgctgcggct

SEQ ID NO: 917786 - DNA, 25 bp, Mus musculus
ctgagataagcatgctgcggctaag

SEQ ID NO: 917787 - DNA, 25 bp, Mus musculus
ctgagataaggaggatgctgcggct

SEQ ID NO: 917788 - DNA, 25 bp, Mus musculus
ctgagataaggatgctgcggctaag

SEQ ID NO: 917789 - DNA, 25 bp, Mus musculus
ctgagatacaagcaaagaaaggaga

SEQ ID NO: 917790 - DNA, 25 bp, Mus musculus
ctgagatacaaggaaagaaaggaga

SEQ ID NO: 917791 - DNA, 25 bp, Mus musculus
ctgagatactacagaaggttaagca

SEQ ID NO: 917792 - DNA, 25 bp, Mus musculus
ctgagatactactgaaggttaagca

SEQ ID NO: 917793 - DNA, 25 bp, Mus musculus
ctgagatcaacgcccagctggagac

SEQ ID NO: 917794 - DNA, 25 bp, Mus musculus
ctgagatcaaggcccagctggagac

SEQ ID NO: 917795 - DNA, 25 bp, Mus musculus
ctgagatcattacgaaacaggtctc

SEQ ID NO: 917796 - DNA, 25 bp, Mus musculus
ctgagatcattacgtctcagccact

SEQ ID NO: 917797 - DNA, 25 bp, Mus musculus
ctgagatcattaggaaacaggtctc

SEQ ID NO: 917798 - DNA, 25 bp, Mus musculus
ctgagatcattaggtctcagccact

SEQ ID NO: 917799 - DNA, 25 bp, Mus musculus
ctgagatgggagcctgcatggtacc

SEQ ID NO: 917800 - DNA, 25 bp, Mus musculus
ctgagatgggtgcctgcatggtacc

SEQ ID NO: 917801 - DNA, 25 bp, Mus musculus
ctgagattaaagacagctgcagcac

SEQ ID NO: 917802 - DNA, 25 bp, Mus musculus
ctgagattaaagtcagctgcagcac

SEQ ID NO: 917803 - DNA, 25 bp, Mus musculus
ctgagattacagaggcctcattcac

SEQ ID NO: 917804 - DNA, 25 bp, Mus musculus
ctgagattacagtggcctcattcac

SEQ ID NO: 917805 - DNA, 25 bp, Mus musculus
ctgagcaaacagctgcccgggagga

SEQ ID NO: 917806 - DNA, 25 bp, Mus musculus
ctgagcaaacaggtgcccgggagga

SEQ ID NO: 917807 - DNA, 25 bp, Mus musculus
ctgagcaaagagatcctttttcgag

SEQ ID NO: 917808 - DNA, 25 bp, Mus musculus
ctgagcaaagatgaagcggcagctg

SEQ ID NO: 917809 - DNA, 25 bp, Mus musculus
ctgagcaaagtgatcctttttcgag

SEQ ID NO: 917810 - DNA, 25 bp, Mus musculus
ctgagcaaagttgaagcggcagctg

SEQ ID NO: 917811 - DNA, 25 bp, Mus musculus
ctgagcacaaagcaaccctttgctc

SEQ ID NO: 917812 - DNA, 25 bp, Mus musculus
ctgagcacaaaggaaccctttgctc

SEQ ID NO: 917813 - DNA, 25 bp, Mus musculus
ctgagcacagcacaaggtgtggtct

SEQ ID NO: 917814 - DNA, 25 bp, Mus musculus
ctgagcacaggacaaggtgtggtct

SEQ ID NO: 917815 - DNA, 25 bp, Mus musculus
ctgagcactacccggtcctgggcag

SEQ ID NO: 917816 - DNA, 25 bp, Mus musculus
ctgagcactaccgggtcctgggcag

SEQ ID NO: 917817 - DNA, 25 bp, Mus musculus
ctgagcagactcagtgtgtggtctg

SEQ ID NO: 917818 - DNA, 25 bp, Mus musculus
ctgagcagactctgtgtgtggtctg

SEQ ID NO: 917819 - DNA, 25 bp, Mus musculus
ctgagcagtccgcacgtctttggcc

SEQ ID NO: 917820 - DNA, 25 bp, Mus musculus
ctgagcagtccgcaggtctttggcc

SEQ ID NO: 917821 - DNA, 25 bp, Mus musculus
ctgagcatcacacagcctgcgctac

SEQ ID NO: 917822 - DNA, 25 bp, Mus musculus
ctgagcatcacagagcctgcgctac

SEQ ID NO: 917823 - DNA, 25 bp, Mus musculus
ctgagcatggtccacgattgaggct

SEQ ID NO: 917824 - DNA, 25 bp, Mus musculus
ctgagcatggtccaggattgaggct

SEQ ID NO: 917825 - DNA, 25 bp, Mus musculus
ctgagccaacatcgtcgtgaaaata

SEQ ID NO: 917826 - DNA, 25 bp, Mus musculus
ctgagccaacatggtcgtgaaaata

SEQ ID NO: 917827 - DNA, 25 bp, Mus musculus
ctgagccagtcagacggcgccagcg

SEQ ID NO: 917828 - DNA, 25 bp, Mus musculus
ctgagccagtcagagggcgccagcg

SEQ ID NO: 917829 - DNA, 25 bp, Mus musculus
ctgagcccatgactggaaacaagtt

SEQ ID NO: 917830 - DNA, 25 bp, Mus musculus
ctgagcccatgagtggaaacaagtt

SEQ ID NO: 917831 - DNA, 25 bp, Mus musculus
ctgagccccggtacaggctccgtgt

SEQ ID NO: 917832 - DNA, 25 bp, Mus musculus
ctgagccccggttcaggctccgtgt

SEQ ID NO: 917833 - DNA, 25 bp, Mus musculus
ctgagcctcactcgtgggtgtgcaa

SEQ ID NO: 917834 - DNA, 25 bp, Mus musculus
ctgagcctcactggtgggtgtgcaa

SEQ ID NO: 917835 - DNA, 25 bp, Mus musculus
ctgagcctgctcaccgtgtccctgg

SEQ ID NO: 917836 - DNA, 25 bp, Mus musculus
ctgagcctgctcacggtgtccctgg

SEQ ID NO: 917837 - DNA, 25 bp, Mus musculus
ctgagcgactgacgcaattaaaaac

SEQ ID NO: 917838 - DNA, 25 bp, Mus musculus
ctgagcgactgacgtctgccgacgg

SEQ ID NO: 917839 - DNA, 25 bp, Mus musculus
ctgagcgactgaggcaattaaaaac

SEQ ID NO: 917840 - DNA, 25 bp, Mus musculus
ctgagcgactgaggtctgccgacgg

SEQ ID NO: 917841 - DNA, 25 bp, Mus musculus
ctgagcgagagacggaactggagga

SEQ ID NO: 917842 - DNA, 25 bp, Mus musculus
ctgagcgagagagggaactggagga

SEQ ID NO: 917843 - DNA, 25 bp, Mus musculus
ctgagcgaggcccacgtgatgctgg

SEQ ID NO: 917844 - DNA, 25 bp, Mus musculus
ctgagcgaggcccaggtgatgctgg

SEQ ID NO: 917845 - DNA, 25 bp, Mus musculus
ctgagcggccggaacatggcagact

SEQ ID NO: 917846 - DNA, 25 bp, Mus musculus
ctgagcggccggaacgagtggaatg

SEQ ID NO: 917847 - DNA, 25 bp, Mus musculus
ctgagcggccggaactgttactgtg

SEQ ID NO: 917848 - DNA, 25 bp, Mus musculus
ctgagcggccggaagatggcagact

SEQ ID NO: 917849 - DNA, 25 bp, Mus musculus
ctgagcggccggaaggagtggaatg

SEQ ID NO: 917850 - DNA, 25 bp, Mus musculus
ctgagcggccggaagtgttactgtg

SEQ ID NO: 917851 - DNA, 25 bp, Mus musculus
ctgagctgcaagataagcagacagc

SEQ ID NO: 917852 - DNA, 25 bp, Mus musculus
ctgagctgcaagcaactcattatac

SEQ ID NO: 917853 - DNA, 25 bp, Mus musculus
ctgagctgcaaggaactcattatac

SEQ ID NO: 917854 - DNA, 25 bp, Mus musculus
ctgagctgcaagttaagcagacagc

SEQ ID NO: 917855 - DNA, 25 bp, Mus musculus
ctgagctggcaccacctgaggatgg

SEQ ID NO: 917856 - DNA, 25 bp, Mus musculus
ctgagctggcaccagctgaggatgg

SEQ ID NO: 917857 - DNA, 25 bp, Mus musculus
ctgagctgtgagccgcagcaagcac

SEQ ID NO: 917858 - DNA, 25 bp, Mus musculus
ctgagctgtgaggcgcagcaagcac

SEQ ID NO: 917859 - DNA, 25 bp, Mus musculus
ctgagcttgcagccatctagtcttg

SEQ ID NO: 917860 - DNA, 25 bp, Mus musculus
ctgagcttgcaggcatctagtcttg

SEQ ID NO: 917861 - DNA, 25 bp, Mus musculus
ctgaggaaagagttaaaaattgctt

SEQ ID NO: 917862 - DNA, 25 bp, Mus musculus
ctgaggaaagtgttaaaaattgctt

SEQ ID NO: 917863 - DNA, 25 bp, Mus musculus
ctgaggaaatagctggtggcgttga

SEQ ID NO: 917864 - DNA, 25 bp, Mus musculus
ctgaggaaattgctggtggcgttga

SEQ ID NO: 917865 - DNA, 25 bp, Mus musculus
ctgaggaagcctaacgatgatgctg

SEQ ID NO: 917866 - DNA, 25 bp, Mus musculus
ctgaggaagcctaaggatgatgctg

SEQ ID NO: 917867 - DNA, 25 bp, Mus musculus
ctgaggaccagcgacattcatagga

SEQ ID NO: 917868 - DNA, 25 bp, Mus musculus
ctgaggaccagcgagattcatagga

SEQ ID NO: 917869 - DNA, 25 bp, Mus musculus
ctgaggactaacaacacagaggtca

SEQ ID NO: 917870 - DNA, 25 bp, Mus musculus
ctgaggactaacaagacagaggtca

SEQ ID NO: 917871 - DNA, 25 bp, Mus musculus
ctgaggactcgcactacctgtttgc

SEQ ID NO: 917872 - DNA, 25 bp, Mus musculus
ctgaggactcgctctacctgtttgc

SEQ ID NO: 917873 - DNA, 25 bp, Mus musculus
ctgaggagatttcaaaagctgatgt

SEQ ID NO: 917874 - DNA, 25 bp, Mus musculus
ctgaggagatttcataagctgatgt

SEQ ID NO: 917875 - DNA, 25 bp, Mus musculus
ctgaggagcaaaccctgtgaactcc

SEQ ID NO: 917876 - DNA, 25 bp, Mus musculus
ctgaggagcaaagcctgtgaactcc

SEQ ID NO: 917877 - DNA, 25 bp, Mus musculus
ctgaggagcgcgaagaatgggccac

SEQ ID NO: 917878 - DNA, 25 bp, Mus musculus
ctgaggagcgggaagaatgggccac

SEQ ID NO: 917879 - DNA, 25 bp, Mus musculus
ctgaggagctcctcaacaagcttaa

SEQ ID NO: 917880 - DNA, 25 bp, Mus musculus
ctgaggagctcctctacaagcttaa

SEQ ID NO: 917881 - DNA, 25 bp, Mus musculus
ctgaggaggacactcaaagtgtcat

SEQ ID NO: 917882 - DNA, 25 bp, Mus musculus
ctgaggaggacactctagaaagtgt

SEQ ID NO: 917883 - DNA, 25 bp, Mus musculus
ctgaggaggacactgaaagtgtcat

SEQ ID NO: 917884 - DNA, 25 bp, Mus musculus
ctgaggaggacactgtagaaagtgt

SEQ ID NO: 917885 - DNA, 25 bp, Mus musculus
ctgaggaggcagtacggttgctaga

SEQ ID NO: 917886 - DNA, 25 bp, Mus musculus
ctgaggaggcagtagggttgctaga

SEQ ID NO: 917887 - DNA, 25 bp, Mus musculus
ctgaggagtccccgcgtggagcgtt

SEQ ID NO: 917888 - DNA, 25 bp, Mus musculus
ctgaggagtccccgctcatcactct

SEQ ID NO: 917889 - DNA, 25 bp, Mus musculus
ctgaggagtcccggcgtggagcgtt

SEQ ID NO: 917890 - DNA, 25 bp, Mus musculus
ctgaggagtcccggctcatcactct

SEQ ID NO: 917891 - DNA, 25 bp, Mus musculus
ctgaggcactgtcatgatgatgcca

SEQ ID NO: 917892 - DNA, 25 bp, Mus musculus
ctgaggcactgtgatgatgatgcca

SEQ ID NO: 917893 - DNA, 25 bp, Mus musculus
ctgaggccagatcatggccctccac

SEQ ID NO: 917894 - DNA, 25 bp, Mus musculus
ctgaggccagctctcttaaccttca

SEQ ID NO: 917895 - DNA, 25 bp, Mus musculus
ctgaggccaggtctcttaaccttca

SEQ ID NO: 917896 - DNA, 25 bp, Mus musculus
ctgaggccagttcatggccctccac

SEQ ID NO: 917897 - DNA, 25 bp, Mus musculus
ctgaggccttgcaaccaaggtgcag

SEQ ID NO: 917898 - DNA, 25 bp, Mus musculus
ctgaggccttgcaacctatgtctga

SEQ ID NO: 917899 - DNA, 25 bp, Mus musculus
ctgaggccttgcaacgggagagtta

SEQ ID NO: 917900 - DNA, 25 bp, Mus musculus
ctgaggccttgcaagcaaggtgcag

SEQ ID NO: 917901 - DNA, 25 bp, Mus musculus
ctgaggccttgcaagctatgtctga

SEQ ID NO: 917902 - DNA, 25 bp, Mus musculus
ctgaggccttgcaaggggagagtta

SEQ ID NO: 917903 - DNA, 25 bp, Mus musculus
ctgaggcgagcacctggtggccccc

SEQ ID NO: 917904 - DNA, 25 bp, Mus musculus
ctgaggcgagcacctgtggcccctc

SEQ ID NO: 917905 - DNA, 25 bp, Mus musculus
ctgaggcgagcagctggtggccccc

SEQ ID NO: 917906 - DNA, 25 bp, Mus musculus
ctgaggcgagcagctgtggcccctc

SEQ ID NO: 917907 - DNA, 25 bp, Mus musculus
ctgaggcgcacagccgggactcgag

SEQ ID NO: 917908 - DNA, 25 bp, Mus musculus
ctgaggcgcacagccgtaaaatgtc

SEQ ID NO: 917909 - DNA, 25 bp, Mus musculus
ctgaggcgcacagcggggactcgag

SEQ ID NO: 917910 - DNA, 25 bp, Mus musculus
ctgaggcgcacagcggtaaaatgtc

SEQ ID NO: 917911 - DNA, 25 bp, Mus musculus
ctgaggctagcactatttctcagag

SEQ ID NO: 917912 - DNA, 25 bp, Mus musculus
ctgaggctagcagtatttctcagag

SEQ ID NO: 917913 - DNA, 25 bp, Mus musculus
ctgaggctgcggaggtactgccatc

SEQ ID NO: 917914 - DNA, 25 bp, Mus musculus
ctgaggctgcggtggtactgccatc

SEQ ID NO: 917915 - DNA, 25 bp, Mus musculus
ctgaggctgcttcggaaccaacaga

SEQ ID NO: 917916 - DNA, 25 bp, Mus musculus
ctgaggctgcttctttttaaagatg

SEQ ID NO: 917917 - DNA, 25 bp, Mus musculus
ctgaggctgcttgggaaccaacaga

SEQ ID NO: 917918 - DNA, 25 bp, Mus musculus
ctgaggctgcttgtttttaaagatg

SEQ ID NO: 917919 - DNA, 25 bp, Mus musculus
ctgagggacactaccttctgaattc
